United States Patent 10,706,955 (BIOINFORMATIC PROCESSES FOR DETERMINATION OF PEPTIDE BINDING) - sequence listing, part 74

SEQ ID NO: 2816561 - protein, 26 aa, Entamoeba invadens
ENICLSCQDPYYLFNQTCLSCASGSY

SEQ ID NO: 2816562 - protein, 25 aa, Entamoeba invadens
ENIEGFTRLIWRLTNIRSSDGYIPV

SEQ ID NO: 2816563 - protein, 27 aa, Entamoeba invadens
ENIFTCICFFFYGLNYLVFFNGVVNVG

SEQ ID NO: 2816564 - protein, 24 aa, Entamoeba invadens
ENIKVSFHLIKTLVVYINSTKSVI

SEQ ID NO: 2816565 - protein, 17 aa, Entamoeba invadens
ENINIELLLYILALFIL

SEQ ID NO: 2816566 - protein, 27 aa, Entamoeba invadens
ENINKWVDLIFGYLQRPPAAFDADNVF

SEQ ID NO: 2816567 - protein, 23 aa, Entamoeba invadens
ENISHSTFIFRNGQILSIIDNNQ

SEQ ID NO: 2816568 - protein, 20 aa, Entamoeba invadens
ENIVHFYGAVFIPNHICMVT

SEQ ID NO: 2816569 - protein, 24 aa, Entamoeba invadens
ENIVHFYGAVFIPNKVCLVTEFAQ

SEQ ID NO: 2816570 - protein, 30 aa, Entamoeba invadens
ENKFCFSLSRRFIMLFTELSKLTGVTDPKK

SEQ ID NO: 2816571 - protein, 19 aa, Entamoeba invadens
ENLILTLIDTFKVSTERTI

SEQ ID NO: 2816572 - protein, 21 aa, Entamoeba invadens
ENLKRAGLYVFFPFETNCGKG

SEQ ID NO: 2816573 - protein, 20 aa, Entamoeba invadens
ENLLFFPTICGFVGKSECAI

SEQ ID NO: 2816574 - protein, 27 aa, Entamoeba invadens
ENLQLERYIILCVMLRSLHPTYQTLTN

SEQ ID NO: 2816575 - protein, 21 aa, Entamoeba invadens
ENMINFLFSLVDVGVVANACR

SEQ ID NO: 2816576 - protein, 33 aa, Entamoeba invadens
ENMKFWKSLNTLPKLNTLILGIIGLDVKDLMES

SEQ ID NO: 2816577 - protein, 28 aa, Entamoeba invadens
ENNLYYYDEMYAVLPFILDIVNGDEVIV

SEQ ID NO: 2816578 - protein, 24 aa, Entamoeba invadens
ENNPLFPYEFLMDNAFYLFVNSVI

SEQ ID NO: 2816579 - protein, 18 aa, Entamoeba invadens
ENNYFYVRFFAIVMIFFI

SEQ ID NO: 2816580 - protein, 23 aa, Entamoeba invadens
ENPTPYFFISKKFKTLEIPVQST

SEQ ID NO: 2816581 - protein, 36 aa, Entamoeba invadens
ENPYQKSILYLSAIELFMMEQLGYSFLISSNIRNKK

SEQ ID NO: 2816582 - protein, 22 aa, Entamoeba invadens
ENQRLELIQIRLAKEMYDRKQR

SEQ ID NO: 2816583 - protein, 25 aa, Entamoeba invadens
ENSIYTIPMIMKALDSLWKNHPDLP

SEQ ID NO: 2816584 - protein, 23 aa, Entamoeba invadens
ENSLNEIYIVGSAILMSDKSLGM

SEQ ID NO: 2816585 - protein, 24 aa, Entamoeba invadens
ENSNTYIFVTICVSLLIGLCCINC

SEQ ID NO: 2816586 - protein, 34 aa, Entamoeba invadens
ENSQCEVVFYSLTLQLVPQFLKRVIKSVRPVTER

SEQ ID NO: 2816587 - protein, 24 aa, Entamoeba invadens
ENTAIPICFYSDTCLLFSFFVEEG

SEQ ID NO: 2816588 - protein, 19 aa, Entamoeba invadens
ENTCQYDIKISNLMLTCQY

SEQ ID NO: 2816589 - protein, 25 aa, Entamoeba invadens
ENTNPILVILPMNGGGYADLEANFE

SEQ ID NO: 2816590 - protein, 23 aa, Entamoeba invadens
ENTTPPLCIKPSGSPLLEEQKVE

SEQ ID NO: 2816591 - protein, 18 aa, Entamoeba invadens
ENVELFHPSFMLSADYFS

SEQ ID NO: 2816592 - protein, 25 aa, Entamoeba invadens
ENVQYFNNFAFFDSGLESLSFGENV

SEQ ID NO: 2816593 - protein, 21 aa, Entamoeba invadens
ENVVLQFTKVVRPYVMISGDV

SEQ ID NO: 2816594 - protein, 18 aa, Entamoeba invadens
ENYFKTIYDTGLCQPYAN

SEQ ID NO: 2816595 - protein, 28 aa, Entamoeba invadens
EPEKMKTSFVLLSRYPKFLTFEAKAEVF

SEQ ID NO: 2816596 - protein, 25 aa, Entamoeba invadens
EPEKSLIGYFRYIFEIPSLSGETVT

SEQ ID NO: 2816597 - protein, 19 aa, Entamoeba invadens
EPEVVLIKRGCACEFSLYL

SEQ ID NO: 2816598 - protein, 25 aa, Entamoeba invadens
  misc_feature (25)..(25): Xaa can be any naturally occurring amino acid
EPFALFEKTIFPDVPVIIGVGLFGX

SEQ ID NO: 2816599 - protein, 19 aa, Entamoeba invadens
EPFDLAVTNIPFVSTISTS

SEQ ID NO: 2816600 - protein, 18 aa, Entamoeba invadens
EPFQKFLSLLIAGLKMTD

SEQ ID NO: 2816601 - protein, 35 aa, Entamoeba invadens
EPILLALVVVSILIMFIPKPIILYMRLRKQQKAHI

SEQ ID NO: 2816602 - protein, 56 aa, Entamoeba invadens
EPIVKKDVPTWVIVILIIIGIFIVIILILFVVFVIVARKILLKRKAPKVFNDEDNM

SEQ ID NO: 2816603 - protein, 49 aa, Entamoeba invadens
EPIVKKDVPTWVIVILIIIGVFIVIILILFVVFIVVARKILLRRRNLKV

SEQ ID NO: 2816604 - protein, 50 aa, Entamoeba invadens
EPIVKKDVPTWVIVILIIIGVFIVIILILFVVFIVVARKILLRRRNLKVF

SEQ ID NO: 2816605 - protein, 22 aa, Entamoeba invadens
EPLGNLFTKCKLTLPTGGGCAI

SEQ ID NO: 2816606 - protein, 19 aa, Entamoeba invadens
EPMDLEAPILTGRMAHVIT

SEQ ID NO: 2816607 - protein, 26 aa, Entamoeba invadens
EPNGFGFLSLTLFVSLSLLDFFSSQL

SEQ ID NO: 2816608 - protein, 21 aa, Entamoeba invadens
EPPLIIGLVGFCAVLMALFGV

SEQ ID NO: 2816609 - protein, 17 aa, Entamoeba invadens
EPQVLFLRPSVTKVITV

SEQ ID NO: 2816610 - protein, 19 aa, Entamoeba invadens
EPQVVIIPPRRGSVPMITY

SEQ ID NO: 2816611 - protein, 19 aa, Entamoeba invadens
EPRTTYPNCKKFKRILDDN

SEQ ID NO: 2816612 - protein, 25 aa, Entamoeba invadens
EPSETPVFSFAYPSAINLSIFLNLK

SEQ ID NO: 2816613 - protein, 21 aa, Entamoeba invadens
EPTEKIVLAMYYFPSQTQVEE

SEQ ID NO: 2816614 - protein, 20 aa, Entamoeba invadens
EPVFMMSIIPHFISLNMLMR

SEQ ID NO: 2816615 - protein, 17 aa, Entamoeba invadens
EPVLFACTIKQNILLGA

SEQ ID NO: 2816616 - protein, 25 aa, Entamoeba invadens
EPYDKMEFKFPWKIAEFVISGKRLP

SEQ ID NO: 2816617 - protein, 17 aa, Entamoeba invadens
EPYPKSEFKFAWSVADF

SEQ ID NO: 2816618 - protein, 26 aa, Entamoeba invadens
EPYSKDQFKYPWKIADFVMGGNRLKK

SEQ ID NO: 2816619 - protein, 26 aa, Entamoeba invadens
EPYSKDQFKYPWKIAEFVMAGNRLKK

SEQ ID NO: 2816620 - protein, 26 aa, Entamoeba invadens
EPYVNILEGCYLLYPLEVVSCLGEKT

SEQ ID NO: 2816621 - protein, 25 aa, Entamoeba invadens
EQACMQVYRYLLDKVRKGNPVTQMK

SEQ ID NO: 2816622 - protein, 18 aa, Entamoeba invadens
EQCLLCQDGYYLQNNGSC

SEQ ID NO: 2816623 - protein, 30 aa, Entamoeba invadens
EQDDEWVYIVRRWFALKDNLCYKCGENCTT

SEQ ID NO: 2816624 - protein, 33 aa, Entamoeba invadens
EQDNFLLGILFFVLLIFFLPCSFIYAYYFSILL

SEQ ID NO: 2816625 - protein, 26 aa, Entamoeba invadens
EQEALLEELYLFPKMEVFEIYNDPSE

SEQ ID NO: 2816626 - protein, 29 aa, Entamoeba invadens
EQEDWELWMWFGIITAVIIVFIALVMGTI

SEQ ID NO: 2816627 - protein, 23 aa, Entamoeba invadens
EQEKFQFVMLHFIKNFPTDVKNV

SEQ ID NO: 2816628 - protein, 25 aa, Entamoeba invadens
EQEKMKILITSGALFYIYGKQYSTL

SEQ ID NO: 2816629 - protein, 23 aa, Entamoeba invadens
EQEQKKRIAAMKKAKILTQNLRD

SEQ ID NO: 2816630 - protein, 17 aa, Entamoeba invadens
EQFDSRILTFHLNSLLL

SEQ ID NO: 2816631 - protein, 26 aa, Entamoeba invadens
EQFRKLANVYFLIISIFQAIPGLSPT

SEQ ID NO: 2816632 - protein, 19 aa, Entamoeba invadens
EQFRLLLACELLCPHSFDV

SEQ ID NO: 2816633 - protein, 23 aa, Entamoeba invadens
EQGDLLRQPFASVVFQAMCIVVD

SEQ ID NO: 2816634 - protein, 27 aa, Entamoeba invadens
EQHQKFIEILQKLNKIYLFPTDSSCVI

SEQ ID NO: 2816635 - protein, 25 aa, Entamoeba invadens
EQIFSPPMIVALPKKIHYTRLSLDD

SEQ ID NO: 2816636 - protein, 23 aa, Entamoeba invadens
EQKKYQLLMFSSKQILFTGNYEL

SEQ ID NO: 2816637 - protein, 25 aa, Entamoeba invadens
EQLDIFQLRFLLESGAFPMSSNQKL

SEQ ID NO: 2816638 - protein, 27 aa, Entamoeba invadens
EQLHLNTFTIFTRQWLTEGAKATLFVQ

SEQ ID NO: 2816639 - protein, 18 aa, Entamoeba invadens
EQLMALKGFYYTLAMQQY

SEQ ID NO: 2816640 - protein, 23 aa, Entamoeba invadens
EQNCKSLLLPISINSVRISSAEH

SEQ ID NO: 2816641 - protein, 23 aa, Entamoeba invadens
EQNIFAFPTIIFDSSVEVIFTKD

SEQ ID NO: 2816642 - protein, 38 aa, Entamoeba invadens
EQPKTLFSFLKRFTSMQFLYFLPFNHSPQNILHSGRCN

SEQ ID NO: 2816643 - protein, 26 aa, Entamoeba invadens
EQPNTYLFVVVFVLVAIAPLLIRNTC

SEQ ID NO: 2816644 - protein, 26 aa, Entamoeba invadens
EQRHNLPMYYYLNDTIVQTLFFDSTL

SEQ ID NO: 2816645 - protein, 23 aa, Entamoeba invadens
EQSFLWEHMLLMKHPHPKVALLA

SEQ ID NO: 2816646 - protein, 22 aa, Entamoeba invadens
EQSIVLHFFPINDPAILQIRDL

SEQ ID NO: 2816647 - protein, 53 aa, Entamoeba invadens
EQSKRQFVLKHLNKNKLIWVYKRFYQLDYHSMRTLIFLSFTVFTAFSNECKPP

SEQ ID NO: 2816648 - protein, 55 aa, Entamoeba invadens
EQSKRQFVLKHLNKNKLIWVYKRFYQLDYHSMRTLIFLSITVFTAFSDECKPPVE

SEQ ID NO: 2816649 - protein, 34 aa, Entamoeba invadens
EQTQKFQIMILLNVFLMVYFVQSWIVMASDSNEM

SEQ ID NO: 2816650 - protein, 25 aa, Entamoeba invadens
EQTWDILHLLLFITTLVSLLSKKGF

SEQ ID NO: 2816651 - protein, 29 aa, Entamoeba invadens
EQVLYFVCALFFIVFFVNGALQMEKIFLT

SEQ ID NO: 2816652 - protein, 18 aa, Entamoeba invadens
EQWDCSNKYFINKKTFKC

SEQ ID NO: 2816653 - protein, 26 aa, Entamoeba invadens
EQYDHLMISMSKLAFFSQTKNFIQLR

SEQ ID NO: 2816654 - protein, 24 aa, Entamoeba invadens
ERCDSLVIPLHFPQQAKQSKSTDE

SEQ ID NO: 2816655 - protein, 28 aa, Entamoeba invadens
ERCGSLDVLQIKRLIFDLYNIDVQESAV

SEQ ID NO: 2816656 - protein, 30 aa, Entamoeba invadens
ERCLSCKNGYFRIPLEKIKLCLSYDSNLNC

SEQ ID NO: 2816657 - protein, 21 aa, Entamoeba invadens
ERDIKLIYSLTKPCLEKVNLP

SEQ ID NO: 2816658 - protein, 26 aa, Entamoeba invadens
ERDTQYYCNIFKWAIDTKILAEIKKY

SEQ ID NO: 2816659 - protein, 17 aa, Entamoeba invadens
ERESFCVVFWKYYAELM

SEQ ID NO: 2816660 - protein, 23 aa, Entamoeba invadens
ERFKFAWNIADFTSAGKRLVIPE

SEQ ID NO: 2816661 - protein, 17 aa, Entamoeba invadens
ERFNQPWMIPQFVIEGN

SEQ ID NO: 2816662 - protein, 27 aa, Entamoeba invadens
ERGEFGCIWCKAGFYKGGDGIKCVECP

SEQ ID NO: 2816663 - protein, 33 aa, Entamoeba invadens
ERGVMNLLIGRSNVIYCLLESLALEECYRVFQS

SEQ ID NO: 2816664 - protein, 17 aa, Entamoeba invadens
ERGYFRFVAFSVAMESC

SEQ ID NO: 2816665 - protein, 25 aa, Entamoeba invadens
ERIEKLFTIMYLRTDKRFYAKIMKL

SEQ ID NO: 2816666 - protein, 17 aa, Entamoeba invadens
ERIRSPFVLGFIGSVVM

SEQ ID NO: 2816667 - protein, 24 aa, Entamoeba invadens
ERKCVTCMTGKYPKLDGKCYECDL

SEQ ID NO: 2816668 - protein, 23 aa, Entamoeba invadens
ERKIKWYFVIKSLITTYFGNLIG

SEQ ID NO: 2816669 - protein, 20 aa, Entamoeba invadens
ERKLGEGSFGIVYKGTYRGN

SEQ ID NO: 2816670 - protein, 22 aa, Entamoeba invadens
ERKLGEGSFGIVYKGTYRGNVV

SEQ ID NO: 2816671 - protein, 23 aa, Entamoeba invadens
ERKYKYYIYISVTQLCDVKLNLS

SEQ ID NO: 2816672 - protein, 24 aa, Entamoeba invadens
ERLERWWFILTDMRNSVVLNAAHG

SEQ ID NO: 2816673 - protein, 24 aa, Entamoeba invadens
ERLIKFDLSSLFDLAFYSININHS

SEQ ID NO: 2816674 - protein, 24 aa, Entamoeba invadens
ERLKREFLPLLFVGITHLNQTIFS

SEQ ID NO: 2816675 - protein, 28 aa, Entamoeba invadens
ERLSDGYYYYIFISATLIIQFNVTFKSV

SEQ ID NO: 2816676 - protein, 24 aa, Entamoeba invadens
ERMINPFIRTDLFVWMVNTQLPKL

SEQ ID NO: 2816677 - protein, 18 aa, Entamoeba invadens
ERMLNDLLGLYNHITFLV

SEQ ID NO: 2816678 - protein, 39 aa, Entamoeba invadens
ERNLYIAYQSVLMLLLSPSTSFIIGKPSHRATKTLNFIV

SEQ ID NO: 2816679 - protein, 23 aa, Entamoeba invadens
ERNQPAPLPYFPPTAHTQTNTTT

SEQ ID NO: 2816680 - protein, 23 aa, Entamoeba invadens
ERQRSFVITLLSLIVTKDGKLNP

SEQ ID NO: 2816681 - protein, 48 aa, Entamoeba invadens
ERRVLGWAVGVCIVCGVLFICIVLLILFVLYRYYEKRQIIIQYKRENG

SEQ ID NO: 2816682 - protein, 25 aa, Entamoeba invadens
ERSFCNWMKLFKEVFRDKFMVEVNA

SEQ ID NO: 2816683 - protein, 21 aa, Entamoeba invadens
ERSRIPLSLFFGSLGVKKETN

SEQ ID NO: 2816684 - protein, 24 aa, Entamoeba invadens
ERTEGMPDNYWNLLNKCWAQEAEK

SEQ ID NO: 2816685 - protein, 27 aa, Entamoeba invadens
ERTIKDLPLFFVLNTVTITGFAAFQHE

SEQ ID NO: 2816686 - protein, 24 aa, Entamoeba invadens
ERTIRDIPLIQTTVLFFSNVNTIV

SEQ ID NO: 2816687 - protein, 27 aa, Entamoeba invadens
ERTNNPYIIVWQNTFPTYPKFYNYNYE

SEQ ID NO: 2816688 - protein, 18 aa, Entamoeba invadens
ERVKLYCKYKKVIDMLYP

SEQ ID NO: 2816689 - protein, 26 aa, Entamoeba invadens
ERVLTDFLYFNAPVDTVLYPDLYTEM

SEQ ID NO: 2816690 - protein, 44 aa, Entamoeba invadens
ERWSRKKTTFKWTYIIVAVPVLAAVVFIIYSFCKTSKTSTGQKT

SEQ ID NO: 2816691 - protein, 25 aa, Entamoeba invadens
ERYKSLFSVVKYIPPIFLTDGVKCK

SEQ ID NO: 2816692 - protein, 23 aa, Entamoeba invadens
ERYTEFMYYLFISTNEIADFEFS

SEQ ID NO: 2816693 - protein, 23 aa, Entamoeba invadens
ESCLDLLLVFPYESVQTVYNTTK

SEQ ID NO: 2816694 - protein, 24 aa, Entamoeba invadens
ESDDLIIPTGLFSAVFIITPADIT

SEQ ID NO: 2816695 - protein, 25 aa, Entamoeba invadens
ESDTHLWNPVFLMGILCMQSGAVSA

SEQ ID NO: 2816696 - protein, 26 aa, Entamoeba invadens
ESDVYSFGMILWELSTLSSPFPQFKF

SEQ ID NO: 2816697 - protein, 30 aa, Entamoeba invadens
ESESDDLTWLWITLGVVGGVVLIAAIILII

SEQ ID NO: 2816698 - protein, 21 aa, Entamoeba invadens
ESFIMLFVRKEILGSFVLPNM

SEQ ID NO: 2816699 - protein, 19 aa, Entamoeba invadens
ESFPLFIGVSYIEISSYIV

SEQ ID NO: 2816700 - protein, 17 aa, Entamoeba invadens
ESGDVVTVPYYFKFVPL

SEQ ID NO: 2816701 - protein, 47 aa, Entamoeba invadens
ESGTFCNTKAVWWFILIIIIFVLVIITMFVVCIYIILIKIQKNRHRK

SEQ ID NO: 2816702 - protein, 17 aa, Entamoeba invadens
ESGYYLDSINKCQTLGD

SEQ ID NO: 2816703 - protein, 21 aa, Entamoeba invadens
ESICKYVLLNGYEDLKMCLSC

SEQ ID NO: 2816704 - protein, 19 aa, Entamoeba invadens
ESIGFYLSSLEPLAKEVCD

SEQ ID NO: 2816705 - protein, 26 aa, Entamoeba invadens
ESIKNMILPSLFDPITLKQIPTDTNA

SEQ ID NO: 2816706 - protein, 27 aa, Entamoeba invadens
ESINFIVDILFVMGYSLRCSIKGGRKD

SEQ ID NO: 2816707 - protein, 19 aa, Entamoeba invadens
ESINMYNLLVFLEDPLDSQ

SEQ ID NO: 2816708 - protein, 18 aa, Entamoeba invadens
ESITLFFTNNLTSSCIGN

SEQ ID NO: 2816709 - protein, 26 aa, Entamoeba invadens
ESKIQKLYFTPQRFIDKEYSQYGFSN

SEQ ID NO: 2816710 - protein, 25 aa, Entamoeba invadens
ESKTKMVIIVTAVVILCISVAFWIE

SEQ ID NO: 2816711 - protein, 28 aa, Entamoeba invadens
ESLLKEYKILFKWYDGPLIEAMKTGEMF

SEQ ID NO: 2816712 - protein, 29 aa, Entamoeba invadens
ESLNLYEPALWLVLLNIVRNLVVDEGLCD

SEQ ID NO: 2816713 - protein, 17 aa, Entamoeba invadens
ESLTFNLVAFALPLIVG

SEQ ID NO: 2816714 - protein, 17 aa, Entamoeba invadens
ESLTFNLVAFLLPLIVG

SEQ ID NO: 2816715 - protein, 28 aa, Entamoeba invadens
ESLTTTDFVLFLLSKPVSKGTISPLSYK

SEQ ID NO: 2816716 - protein, 26 aa, Entamoeba invadens
ESMFNPDYLLFRPTDDGQFQANPASE

SEQ ID NO: 2816717 - protein, 29 aa, Entamoeba invadens
ESNDYRLVGSLFFFRGQLLNDVLSNTVQT

SEQ ID NO: 2816718 - protein, 22 aa, Entamoeba invadens
ESNFILINEVCNPLAVVQYCVS

SEQ ID NO: 2816719 - protein, 17 aa, Entamoeba invadens
ESNFILINEVCNPLSVV

SEQ ID NO: 2816720 - protein, 24 aa, Entamoeba invadens
ESNGITHYLTFGQWIVALEEKNGV

SEQ ID NO: 2816721 - protein, 27 aa, Entamoeba invadens
ESNVAFQIVLTKLRFLFDVLTEAEFIK

SEQ ID NO: 2816722 - protein, 17 aa, Entamoeba invadens
ESNYYLLNITFCQQCDT

SEQ ID NO: 2816723 - protein, 24 aa, Entamoeba invadens
ESNYYPKQGLCVPCDYGCTTCSSA

SEQ ID NO: 2816724 - protein, 17 aa, Entamoeba invadens
ESPLSEIDGCLLYDIKI

SEQ ID NO: 2816725 - protein, 21 aa, Entamoeba invadens
ESQHFNVWWYRNKMSELTSKI

SEQ ID NO: 2816726 - protein, 24 aa, Entamoeba invadens
ESQNYSIRLFYTSNMPIILHSALT

SEQ ID NO: 2816727 - protein, 23 aa, Entamoeba invadens
ESRLYEAFTLMYSKAFDQKTFDL

SEQ ID NO: 2816728 - protein, 23 aa, Entamoeba invadens
ESSDDLMFCLITLLQQIERQITT

SEQ ID NO: 2816729 - protein, 30 aa, Entamoeba invadens
ESSEEDLTWLWITLGVVGGVLLIAVIILVV

SEQ ID NO: 2816730 - protein, 18 aa, Entamoeba invadens
ESSFVINYFIFANDSKTC

SEQ ID NO: 2816731 - protein, 25 aa, Entamoeba invadens
ESSGLFWVVPVITFPIIIGLSSDYD

SEQ ID NO: 2816732 - protein, 22 aa, Entamoeba invadens
ESSQFFRDIFPIIASLAAIHPK

SEQ ID NO: 2816733 - protein, 23 aa, Entamoeba invadens
ESSVMVPLVDFILRVIGSHRGKL

SEQ ID NO: 2816734 - protein, 24 aa, Entamoeba invadens
ESSYQLWLVPFYVGLIFNIITHVF

SEQ ID NO: 2816735 - protein, 20 aa, Entamoeba invadens
ESTCKYVLLNGYEDLKKCLS

SEQ ID NO: 2816736 - protein, 26 aa, Entamoeba invadens
ESTECQYIFNYLGVSVKPTLSQNLDE

SEQ ID NO: 2816737 - protein, 23 aa, Entamoeba invadens
ESTGLTNVYFSTALKKLGDGAFK

SEQ ID NO: 2816738 - protein, 29 aa, Entamoeba invadens
ESTLPFTHLDFFKYFLSDKSKETQKKMLE

SEQ ID NO: 2816739 - protein, 31 aa, Entamoeba invadens
ESTTKVNAPFLFMGGLFLGAAGVFVRPFDGV

SEQ ID NO: 2816740 - protein, 20 aa, Entamoeba invadens
ESTWLLEEILGLDASYEKLN

SEQ ID NO: 2816741 - protein, 18 aa, Entamoeba invadens
ESVFTIGIPFIFQKCPVK

SEQ ID NO: 2816742 - protein, 19 aa, Entamoeba invadens
ESVIVNKLFRMCKRYKPDY

SEQ ID NO: 2816743 - protein, 21 aa, Entamoeba invadens
ESVLKCWLKSRLYNPNYDKSP

SEQ ID NO: 2816744 - protein, 23 aa, Entamoeba invadens
ESVMFKERFSDWASVPIGGKVDI

SEQ ID NO: 2816745 - protein, 28 aa, Entamoeba invadens
ESVTFPSYLLTIWDRCFEFCMSLKSIKI

SEQ ID NO: 2816746 - protein, 17 aa, Entamoeba invadens
ESWEWMNCFMTAGTFKA

SEQ ID NO: 2816747 - protein, 20 aa, Entamoeba invadens
ESYCLIPQKQSILKNKGVFV

SEQ ID NO: 2816748 - protein, 17 aa, Entamoeba invadens
ESYGYFEQEYCPCKMCQ

SEQ ID NO: 2816749 - protein, 22 aa, Entamoeba invadens
ESYILKVYPIVTSADLFVLLIK

SEQ ID NO: 2816750 - protein, 25 aa, Entamoeba invadens
ESYLMYDKSYLPRVLLRLVKTVVLC

SEQ ID NO: 2816751 - protein, 24 aa, Entamoeba invadens
ESYSQMILKVNQPIFVSSPKTAKN

SEQ ID NO: 2816752 - protein, 31 aa, Entamoeba invadens
ESYTSFFFGEVLSMFLLYLSIARGKLNTTQI

SEQ ID NO: 2816753 - protein, 26 aa, Entamoeba invadens
ESYTSYMKLPHLLGSEIYFPSNTTNA

SEQ ID NO: 2816754 - protein, 25 aa, Entamoeba invadens
ESYVLNCWSGYFIGQSFKCVSCRQG

SEQ ID NO: 2816755 - protein, 23 aa, Entamoeba invadens
ETAKIPCYVIINNLNKDSYGVVL

SEQ ID NO: 2816756 - protein, 24 aa, Entamoeba invadens
ETCLGFVVPFLCASSVFCTRHFSG

SEQ ID NO: 2816757 - protein, 18 aa, Entamoeba invadens
ETCMCYYGYYPKVVGEYS

SEQ ID NO: 2816758 - protein, 18 aa, Entamoeba invadens
ETEFVLDLSLNPFSVVDF

SEQ ID NO: 2816759 - protein, 22 aa, Entamoeba invadens
ETFSWSCAYPEDKFKFPWKIAE

SEQ ID NO: 2816760 - protein, 19 aa, Entamoeba invadens
ETFYNFWERVISISQTVVN

SEQ ID NO: 2816761 - protein, 24 aa, Entamoeba invadens
ETHCCGIIPLMKLFDKTPPTQVIN

SEQ ID NO: 2816762 - protein, 18 aa, Entamoeba invadens
ETHWFNLFNCEEGNYLAI

SEQ ID NO: 2816763 - protein, 35 aa, Entamoeba invadens
ETINGLLKYHKLYETFIYLKFKTNSIVLCLDSEDA

SEQ ID NO: 2816764 - protein, 22 aa, Entamoeba invadens
ETIPITIRELPFYHISKPSGEK

SEQ ID NO: 2816765 - protein, 23 aa, Entamoeba invadens
ETISLCVLFIIAGGMMIACSFIQ

SEQ ID NO: 2816766 - protein, 17 aa, Entamoeba invadens
ETISWREAYPKSEFKFP

SEQ ID NO: 2816767 - protein, 17 aa, Entamoeba invadens
ETISWTKIGSKAFYQCY

SEQ ID NO: 2816768 - protein, 30 aa, Entamoeba invadens
ETIVGYVALLFSVLLFGSFLVPVKKFEAGD

SEQ ID NO: 2816769 - protein, 28 aa, Entamoeba invadens
ETLATILKIVMVTTIVCLVWLCYVIIMA

SEQ ID NO: 2816770 - protein, 19 aa, Entamoeba invadens
ETLPQLDKIIFLTPSNKSN

SEQ ID NO: 2816771 - protein, 21 aa, Entamoeba invadens
ETLQRMNYIFTFPTEYSTAVC

SEQ ID NO: 2816772 - protein, 21 aa, Entamoeba invadens
ETNNYLFLKGSFHLITSPTRP

SEQ ID NO: 2816773 - protein, 24 aa, Entamoeba invadens
ETNPTLVPNTLRFYLPGENLTCLW

SEQ ID NO: 2816774 - protein, 31 aa, Entamoeba invadens
ETNTDLQFFYNAFIFLTATDSLLSLQGLCMK

SEQ ID NO: 2816775 - protein, 20 aa, Entamoeba invadens
ETNTFYCYISSKVYFENDSH

SEQ ID NO: 2816776 - protein, 25 aa, Entamoeba invadens
ETPDYRFFFIYSIYYYNTTNIIFFN

SEQ ID NO: 2816777 - protein, 24 aa, Entamoeba invadens
ETQDHPEYILLTKFINSYDGLIDV

SEQ ID NO: 2816778 - protein, 20 aa, Entamoeba invadens
ETQDIYCINYRLVDEAYQCD

SEQ ID NO: 2816779 - protein, 23 aa, Entamoeba invadens
ETQKTYTPVPKINKLKISQFSPK

SEQ ID NO: 2816780 - protein, 25 aa, Entamoeba invadens
ETQMCKTCELGYYLVSDTNECVASC

SEQ ID NO: 2816781 - protein, 23 aa, Entamoeba invadens
ETQNALLDFLKRCLTFDPKERMT

SEQ ID NO: 2816782 - protein, 30 aa, Entamoeba invadens
ETQRSLISYVRMPIRLQSYVFNDCHVEYVS

SEQ ID NO: 2816783 - protein, 23 aa, Entamoeba invadens
ETRCTPIRGIGHCLQYSFNELKV

SEQ ID NO: 2816784 - protein, 19 aa, Entamoeba invadens
ETRFLYTVLVSNWVFEYYE

SEQ ID NO: 2816785 - protein, 20 aa, Entamoeba invadens
ETRGLESFPLFIGVSYIEIS

SEQ ID NO: 2816786 - protein, 24 aa, Entamoeba invadens
ETRKQILYALYRMLYDNKQALGDA

SEQ ID NO: 2816787 - protein, 23 aa, Entamoeba invadens
ETRKRKEAEKQNEILKLLVDEKE

SEQ ID NO: 2816788 - protein, 33 aa, Entamoeba invadens
ETRTVITPQQELPWHKKLLIYAKDSGEDFMVVF

SEQ ID NO: 2816789 - protein, 23 aa, Entamoeba invadens
ETSEKYLQLFRYELKDIKEVLMK

SEQ ID NO: 2816790 - protein, 36 aa, Entamoeba invadens
ETSKILWRNNYNINKMLFVWDRYIGITVNTKLHDLE

SEQ ID NO: 2816791 - protein, 32 aa, Entamoeba invadens
ETSKYIQVFNFISLIFFPITLVVNSFGCNIRV

SEQ ID NO: 2816792 - protein, 17 aa, Entamoeba invadens
ETSLFCEHRVTLLVFYI

SEQ ID NO: 2816793 - protein, 24 aa, Entamoeba invadens
ETSLSPMRVPLMNSILPTSDSFNC

SEQ ID NO: 2816794 - protein, 24 aa, Entamoeba invadens
ETSYPQRLYILTPQPFNTSIQNYF

SEQ ID NO: 2816795 - protein, 22 aa, Entamoeba invadens
ETTIITHGLPYPDNLKVANELE

SEQ ID NO: 2816796 - protein, 24 aa, Entamoeba invadens
ETTKMPFPTWAYKNNNKCLPKKCL

SEQ ID NO: 2816797 - protein, 26 aa, Entamoeba invadens
ETVALKLYMTEFKLYDLNTLKATNCT

SEQ ID NO: 2816798 - protein, 17 aa, Entamoeba invadens
ETVCYFLVNVMYTIIAM

SEQ ID NO: 2816799 - protein, 18 aa, Entamoeba invadens
ETVKGGGIILVLLSGMTS

SEQ ID NO: 2816800 - protein, 26 aa, Entamoeba invadens
ETVNPSLWRQSQLIRIDGLFELIPNK

SEQ ID NO: 2816801 - protein, 26 aa, Entamoeba invadens
ETWKDTYPLETFKFPWKIAEFVTSGE

SEQ ID NO: 2816802 - protein, 17 aa, Entamoeba invadens
ETYGVVLPALLPKYTTV

SEQ ID NO: 2816803 - protein, 22 aa, Entamoeba invadens
ETYLFKIPNLSECFVFLGDDFF

SEQ ID NO: 2816804 - protein, 24 aa, Entamoeba invadens
ETYSTLIVPFYRENEIDFLKPLDK

SEQ ID NO: 2816805 - protein, 18 aa, Entamoeba invadens
EVAFDLGIPVSLYVINRT

SEQ ID NO: 2816806 - protein, 29 aa, Entamoeba invadens
EVALSLYLFFTMIYLNLIKLTILERIVDL

SEQ ID NO: 2816807 - protein, 34 aa, Entamoeba invadens
EVAMLAKFVSPYVIRFYGACFIPNRICMVTELAK

SEQ ID NO: 2816808 - protein, 23 aa, Entamoeba invadens
EVCLKCIKGYVLSNVTCVKLLTS

SEQ ID NO: 2816809 - protein, 26 aa, Entamoeba invadens
EVDMKLRMKFLLDAAKGIQYLHENGI

SEQ ID NO: 2816810 - protein, 28 aa, Entamoeba invadens
EVDMLDKFRNIKPDNLLVFSLDANEKVN

SEQ ID NO: 2816811 - protein, 34 aa, Entamoeba invadens
EVDMLDKFRSGYIIYFYGAVLFKNRFALVTEFAD

SEQ ID NO: 2816812 - protein, 29 aa, Entamoeba invadens
EVEFETVIPILRFILKPTQYTGLLTVTQV

SEQ ID NO: 2816813 - protein, 26 aa, Entamoeba invadens
EVEMHLRIKFILDASKGILYLHENGI

SEQ ID NO: 2816814 - protein, 32 aa, Entamoeba invadens
EVEMLDKFRSDFLVIFYGACLIPNKICIVTEF

SEQ ID NO: 2816815 - protein, 19 aa, Entamoeba invadens
EVENKYTTLLFYNISRVYK

SEQ ID NO: 2816816 - protein, 25 aa, Entamoeba invadens
EVETKMRIIIILDGAKGIQYLHENS

SEQ ID NO: 2816817 - protein, 25 aa, Entamoeba invadens
EVETKMRIIIILDGARGIQYLHENG

SEQ ID NO: 2816818 - protein, 21 aa, Entamoeba invadens
EVETKMRIKIILDAARGIQYL

SEQ ID NO: 2816819 - protein, 26 aa, Entamoeba invadens
EVETNIFHFLTMHDVYKSFSCILSNF

SEQ ID NO: 2816820 - protein, 19 aa, Entamoeba invadens
EVEYWFKLFEELVDMAHNR

SEQ ID NO: 2816821 - protein, 29 aa, Entamoeba invadens
EVFGWTNAYPLDAFKFPWKIAEFVICMKI

SEQ ID NO: 2816822 - protein, 19 aa, Entamoeba invadens
EVFLTPFCTMKLHDEIMIV

SEQ ID NO: 2816823 - protein, 17 aa, Entamoeba invadens
EVFMTYNINLELIHTEE

SEQ ID NO: 2816824 - protein, 18 aa, Entamoeba invadens
EVFPFLKVLGHNDSKMYQ

SEQ ID NO: 2816825 - protein, 19 aa, Entamoeba invadens
EVFQLINRKLQKKGSITTI

SEQ ID NO: 2816826 - protein, 30 aa, Entamoeba invadens
EVGCDAMFTLPWYLTWFIHSISSVEVGVRL

SEQ ID NO: 2816827 - protein, 24 aa, Entamoeba invadens
EVGCLLCQNGYYTNEYNKCTKCGD

SEQ ID NO: 2816828 - protein, 22 aa, Entamoeba invadens
EVIDNLHFEMKCGTWRVKTDLK

SEQ ID NO: 2816829 - protein, 25 aa, Entamoeba invadens
EVIMKLRLKMMLDASKGILYLHENG

SEQ ID NO: 2816830 - protein, 18 aa, Entamoeba invadens
EVIWFYLNSISIGAGIVA

SEQ ID NO: 2816831 - protein, 23 aa, Entamoeba invadens
EVKLNSFNKLLSVSGIMADCGKR

SEQ ID NO: 2816832 - protein, 33 aa, Entamoeba invadens
EVKMLEKFRCNYIITFLGAVFIPSKTCIVMEYA

SEQ ID NO: 2816833 - protein, 22 aa, Entamoeba invadens
EVKNMFSILLREYKTIRGVAKD

SEQ ID NO: 2816834 - protein, 18 aa, Entamoeba invadens
EVKRILWVIAFRSCMNFI

SEQ ID NO: 2816835 - protein, 18 aa, Entamoeba invadens
EVKRLIKKNWYYLFGTAG

SEQ ID NO: 2816836 - protein, 28 aa, Entamoeba invadens
EVKYQISLYLIVLVVFFGFDEMITVLTN

SEQ ID NO: 2816837 - protein, 20 aa, Entamoeba invadens
EVLCFLFLVIFQGTFTNIDG

SEQ ID NO: 2816838 - protein, 46 aa, Entamoeba invadens
EVLDKRHYKFPADIYSYAITMYEIEKWGHAFPKEKFKHAWDVANFI

SEQ ID NO: 2816839 - protein, 24 aa, Entamoeba invadens
EVLKSILSIIILIAVWAVMFCIVI

SEQ ID NO: 2816840 - protein, 17 aa, Entamoeba invadens
EVLLKKKYKTPADIFSF

SEQ ID NO: 2816841 - protein, 21 aa, Entamoeba invadens
EVLNYYNGIYHFQRNTFEFTP

SEQ ID NO: 2816842 - protein, 26 aa, Entamoeba invadens
EVLSKLKVLIFIYLIPISLKCEQNKE

SEQ ID NO: 2816843 - protein, 18 aa, Entamoeba invadens
EVMFRKHYKKPADIYSFG

SEQ ID NO: 2816844 - protein, 20 aa, Entamoeba invadens
EVMLLFLGILIPKDFFIMVA

SEQ ID NO: 2816845 - protein, 39 aa, Entamoeba invadens
EVNAAPVLISPRPLEWIHNNRIPLFHVGALLTTQKTSTS

SEQ ID NO: 2816846 - protein, 26 aa, Entamoeba invadens
EVNIKLKIKFMLDASKGLLYLHENGI

SEQ ID NO: 2816847 - protein, 24 aa, Entamoeba invadens
EVNKPELRFDLDASMVPVGKESRD

SEQ ID NO: 2816848 - protein, 20 aa, Entamoeba invadens
EVNLSIVEFIRDLYSVMDIQ

SEQ ID NO: 2816849 - protein, 28 aa, Entamoeba invadens
EVPNNYEFIYPLITSWIAPLNVMHIYPD

SEQ ID NO: 2816850 - protein, 24 aa, Entamoeba invadens
EVPNVLDLLPLQKTPITKKPEEKV

SEQ ID NO: 2816851 - protein, 36 aa, Entamoeba invadens
EVPSRLQILVNILTRYILLFSYFPINETIDVYEEVD

SEQ ID NO: 2816852 - protein, 27 aa, Entamoeba invadens
EVQMPIALLCVFLLLAEALFLNWGVVA

SEQ ID NO: 2816853 - protein, 39 aa, Entamoeba invadens
EVRDDHGCVLIPQNILPWVVTKAVIGGNKPVFEMRKNFK

SEQ ID NO: 2816854 - protein, 21 aa, Entamoeba invadens
EVRSSLVLAGSLIVDEIFTAS

SEQ ID NO: 2816855 - protein, 18 aa, Entamoeba invadens
EVSESCFLFSAGTSKYIH

SEQ ID NO: 2816856 - protein, 23 aa, Entamoeba invadens
EVSIIGWFKVSLGDYKILAIKRN

SEQ ID NO: 2816857 - protein, 28 aa, Entamoeba invadens
EVSKMRNICVFPMKKSNINMFTLEGSVV

SEQ ID NO: 2816858 - protein, 27 aa, Entamoeba invadens
EVSMLDKFRIDYVVNFYGSVFIPNKIC

SEQ ID NO: 2816859 - protein, 30 aa, Entamoeba invadens
EVSMLDKFRSPYIVHFYGAVVIPNKICMVT

SEQ ID NO: 2816860 - protein, 25 aa, Entamoeba invadens
EVSSIFFEVLIYLLDEFEKVKDFHY

SEQ ID NO: 2816861 - protein, 25 aa, Entamoeba invadens
EVTKILFTPIVHPCSYFYNTVNWPE

SEQ ID NO: 2816862 - protein, 27 aa, Entamoeba invadens
EVTNTHALLLLKALHDFPIEVSPHFQR

SEQ ID NO: 2816863 - protein, 29 aa, Entamoeba invadens
EVTQYFHDYHFWSLPTVLWNFINSNQHKR

SEQ ID NO: 2816864 - protein, 29 aa, Entamoeba invadens
EVTYLFNRIFPQIWIWRHASLYQTINRVL

SEQ ID NO: 2816865 - protein, 20 aa, Entamoeba invadens
EVVGDFFMICQNGTFSIFSE

SEQ ID NO: 2816866 - protein, 25 aa, Entamoeba invadens
EVVKMRNICVFPMKKSNVKMVTLEG

SEQ ID NO: 2816867 - protein, 27 aa, Entamoeba invadens
EVVLFWVFVIVWRKKKVLTFVVYCCLI

SEQ ID NO: 2816868 - protein, 21 aa, Entamoeba invadens
EVVMKMRIKLMLDTAKGIQYL

SEQ ID NO: 2816869 - protein, 24 aa, Entamoeba invadens
EVVNLLLDVLFEFGVVLLNARDES

SEQ ID NO: 2816870 - protein, 30 aa, Entamoeba invadens
EVYEKSQFKFPWIIAEYVSNGLRLNRPENV

SEQ ID NO: 2816871 - protein, 18 aa, Entamoeba invadens
EVYIKPLCTCKIDDLFVM

SEQ ID NO: 2816872 - protein, 17 aa, Entamoeba invadens
EVYKYLESLAKKLGVEH

SEQ ID NO: 2816873 - protein, 29 aa, Entamoeba invadens
EVYMCGLNIILNLLYIGFMNQNIAVMALF

SEQ ID NO: 2816874 - protein, 18 aa, Entamoeba invadens
EVYPKSEFKFAWSVADFV

SEQ ID NO: 2816875 - protein, 18 aa, Entamoeba invadens
EVYWCKFKSIVKPEEDNK

SEQ ID NO: 2816876 - protein, 23 aa, Entamoeba invadens
EWKIDLTLKLLVVVSLDRFGDFI

SEQ ID NO: 2816877 - protein, 17 aa, Entamoeba invadens
EWLGFTISTLTVLLIVI

SEQ ID NO: 2816878 - protein, 19 aa, Entamoeba invadens
EWNEKLVFQFPLEKIVKMY

SEQ ID NO: 2816879 - protein, 17 aa, Entamoeba invadens
EWNINEVKYKSTCQLCD

SEQ ID NO: 2816880 - protein, 18 aa, Entamoeba invadens
EWPDIWKLTPAKVKSGNE

SEQ ID NO: 2816881 - protein, 20 aa, Entamoeba invadens
EWPLLVICPSSVRHNWKDEI

SEQ ID NO: 2816882 - protein, 25 aa, Entamoeba invadens
EWSDGMVVMLIAGENNPLFTLETIG

SEQ ID NO: 2816883 - protein, 25 aa, Entamoeba invadens
EWVAKTLPWLMFLGGLVSSLGYLLT

SEQ ID NO: 2816884 - protein, 33 aa, Entamoeba invadens
EWYVVVLAFVGWFLAFFVPLLLPIDLASSFNYK

SEQ ID NO: 2816885 - protein, 20 aa, Entamoeba invadens
EYAAVLYYYERNKCDLVEGK

SEQ ID NO: 2816886 - protein, 23 aa, Entamoeba invadens
EYADLFVHFFKFTDKLCDDADKM

SEQ ID NO: 2816887 - protein, 18 aa, Entamoeba invadens
EYAFLNQNLLEKITFETT

SEQ ID NO: 2816888 - protein, 24 aa, Entamoeba invadens
EYCKCLVGVVFFLAPYVSNIDIYS

SEQ ID NO: 2816889 - protein, 18 aa, Entamoeba invadens
EYCLFCDLNFYNSNGYCL

SEQ ID NO: 2816890 - protein, 19 aa, Entamoeba invadens
EYESVVFKLFAQATICNLN

SEQ ID NO: 2816891 - protein, 28 aa, Entamoeba invadens
EYFELIYITFYVWGYLSLGVCALEIVLE

SEQ ID NO: 2816892 - protein, 34 aa, Entamoeba invadens
EYFKKQYRVKFYLKAILIFSIILTVILAVVRAVF

SEQ ID NO: 2816893 - protein, 25 aa, Entamoeba invadens
EYGCAVCYDGYYQNKYYKCSKCNDL

SEQ ID NO: 2816894 - protein, 25 aa, Entamoeba invadens
EYGYAVCYNGYYQNKYYKCTKCNDL

SEQ ID NO: 2816895 - protein, 34 aa, Entamoeba invadens
EYILGFFPIQLVCLMVIVLLLIALAFQSLLMGIR

SEQ ID NO: 2816896 - protein, 18 aa, Entamoeba invadens
EYIMVIGLDIKTGVQYNE

SEQ ID NO: 2816897 - protein, 18 aa, Entamoeba invadens
EYIVHFYGAVFIENKVSV

SEQ ID NO: 2816898 - protein, 20 aa, Entamoeba invadens
EYIVHFYGAVFIPNKICLVT

SEQ ID NO: 2816899 - protein, 19 aa, Entamoeba invadens
EYIVHFYGAVFIPNKVCMV

SEQ ID NO: 2816900 - protein, 18 aa, Entamoeba invadens
EYIVYFYGAVMFEKRFAI

SEQ ID NO: 2816901 - protein, 31 aa, Entamoeba invadens
EYKIFNIFQEITLKYFFIQTRFRDSRITLEE

SEQ ID NO: 2816902 - protein, 26 aa, Entamoeba invadens
EYKLTDILMILKRRYLLENKGVEIVM

SEQ ID NO: 2816903 - protein, 17 aa, Entamoeba invadens
EYKWRNLVTTGEDTVLS

SEQ ID NO: 2816904 - protein, 26 aa, Entamoeba invadens
EYLHNFDLLVVISFVFGKSAIHRLKK

SEQ ID NO: 2816905 - protein, 17 aa, Entamoeba invadens
EYLMYLNVKSGRSGLDV

SEQ ID NO: 2816906 - protein, 21 aa, Entamoeba invadens
EYLVFFVLAVVMYFSQIVCYQ

SEQ ID NO: 2816907 - protein, 28 aa, Entamoeba invadens
EYNGQHFDRYWKAILFEGSGKRTLSGKS

SEQ ID NO: 2816908 - protein, 17 aa, Entamoeba invadens
EYNHFFNKTTFSCETVE

SEQ ID NO: 2816909 - protein, 39 aa, Entamoeba invadens
EYNPNIQYFIYFNFIVNKTNFWLLCIFQKKLLTTKQIFE

SEQ ID NO: 2816910 - protein, 17 aa, Entamoeba invadens
EYPCTFCSNLTYCTKCD

SEQ ID NO: 2816911 - protein, 19 aa, Entamoeba invadens
EYPCTYCSNLTYCTKCDAY

SEQ ID NO: 2816912 - protein, 26 aa, Entamoeba invadens
EYPYPFTHRHCPLPYDSAYVNHFNVI

SEQ ID NO: 2816913 - protein, 21 aa, Entamoeba invadens
EYSLFITVKLRELSDGSFFVS

SEQ ID NO: 2816914 - protein, 24 aa, Entamoeba invadens
EYSRKISWLIEKFPVDLRPRVMSG

SEQ ID NO: 2816915 - protein, 29 aa, Entamoeba invadens
EYTDAFATYFLKLDLFAPENQKLLQIFKD

SEQ ID NO: 2816916 - protein, 24 aa, Entamoeba invadens
EYTDILMKLLPSGELRKSFKKMLQ

SEQ ID NO: 2816917 - protein, 18 aa, Entamoeba invadens
EYTLLNEMWRFDAQSRIK

SEQ ID NO: 2816918 - protein, 23 aa, Entamoeba invadens
EYTPFTFFGILEDFRNQCIGILE

SEQ ID NO: 2816919 - protein, 25 aa, Entamoeba invadens
EYTVAFITPRYPLFGGWSATLMVTH

SEQ ID NO: 2816920 - protein, 31 aa, Entamoeba invadens
EYVGTVYLVSYLYIEGRVLPTLVLQCLNTLS

SEQ ID NO: 2816921 - protein, 19 aa, Entamoeba invadens
EYVLVNLQCLHFTKVEHCV

SEQ ID NO: 2816922 - protein, 25 aa, Entamoeba invadens
EYVNYVVVIFQKVLLPLVQQDSIEE

SEQ ID NO: 2816923 - protein, 33 aa, Entamoeba invadens
EYYNNHLGMSFINWPFNYLVIACFCKKCVSFVF

SEQ ID NO: 2816924 - protein, 17 aa, Entamoeba invadens
EYYTLIHKIANGLAHYG

SEQ ID NO: 2816925 - protein, 17 aa, Entamoeba invadens
FACEFEVFITPYCTMDL

SEQ ID NO: 2816926 - protein, 20 aa, Entamoeba invadens
FACEFEVFLTPHCTLSLEDK

SEQ ID NO: 2816927 - protein, 23 aa, Entamoeba invadens
FACEFEVFLTPLCTMNLSDEIVI

SEQ ID NO: 2816928 - protein, 21 aa, Entamoeba invadens
FACEFSIYLKPKCTCRINNTI

SEQ ID NO: 2816929 - protein, 24 aa, Entamoeba invadens
FACEFSMYLTPLCTCQIISSIQIV

SEQ ID NO: 2816930 - protein, 28 aa, Entamoeba invadens
FACPINPIPLPQENIVFPNFVRGDVKMS

SEQ ID NO: 2816931 - protein, 18 aa, Entamoeba invadens
FAFLFEYIGEKSKDYIYS

SEQ ID NO: 2816932 - protein, 24 aa, Entamoeba invadens
FAFTQLCLLLFCLALTLVFMKKVF

SEQ ID NO: 2816933 - protein, 25 aa, Entamoeba invadens
FAGDVLLERILFTENVIRLGKNALK

SEQ ID NO: 2816934 - protein, 27 aa, Entamoeba invadens
FAGIIGLYGLIICIMLFINVSKDDYSL

SEQ ID NO: 2816935 - protein, 34 aa, Entamoeba invadens
FAGLTSLQQITFYKYFPSIIRKNAFRNSGLQSIG

SEQ ID NO: 2816936 - protein, 34 aa, Entamoeba invadens
FAGLTSLQQITFYKYFPSTIRKNAFRNSGLQSIG

SEQ ID NO: 2816937 - protein, 17 aa, Entamoeba invadens
FAHDEMILLFNGTSFTS

SEQ ID NO: 2816938 - protein, 19 aa, Entamoeba invadens
FAHQRIELIDWKKIKIRYS

SEQ ID NO: 2816939 - protein, 19 aa, Entamoeba invadens
FAICMLEIWIGRDVYPPDK

SEQ ID NO: 2816940 - protein, 17 aa, Entamoeba invadens
FAIKTPCTLKRWKLYDK

SEQ ID NO: 2816941 - protein, 19 aa, Entamoeba invadens
FAIQAFNFNKPLKKLQIGY

SEQ ID NO: 2816942 - protein, 35 aa, Entamoeba invadens
FAISMYECFTWKDPYPKEFFKFAWSIADFVASGKH

SEQ ID NO: 2816943 - protein, 24 aa, Entamoeba invadens
FAITMFETISWREAFPKSEFKYPW

SEQ ID NO: 2816944 - protein, 23 aa, Entamoeba invadens
FAITMFETISWREAYPKSEFKYP

SEQ ID NO: 2816945 - protein, 18 aa, Entamoeba invadens
FAITMFETITWKEAFPKS

SEQ ID NO: 2816946 - protein, 30 aa, Entamoeba invadens
FAITMYECFGWKEAFPKNIYKFAWDIADSI

SEQ ID NO: 2816947 - protein, 37 aa, Entamoeba invadens
FAITMYECFIWKEAYPKEDFKFPWKIAEFVNSGKRFE

SEQ ID NO: 2816948 - protein, 37 aa, Entamoeba invadens
FAITTLECFLWGEAFPKSTYIFPWTIADDVASGKRPI

SEQ ID NO: 2816949 - protein, 25 aa, Entamoeba invadens
FAKQIMFIVNYFLFRDLYVYPNPLG

SEQ ID NO: 2816950 - protein, 20 aa, Entamoeba invadens
FALGIAFYFDWRVSACVLAA

SEQ ID NO: 2816951 - protein, 18 aa, Entamoeba invadens
FALIFLLVYAVFSVIFYI

SEQ ID NO: 2816952 - protein, 20 aa, Entamoeba invadens
FALLFCYFNSLTKTARAICP

SEQ ID NO: 2816953 - protein, 17 aa, Entamoeba invadens
FALLPFSMIASIVCGLL

SEQ ID NO: 2816954 - protein, 20 aa, Entamoeba invadens
FALVSYTYYYWCKMFCENEI

SEQ ID NO: 2816955 - protein, 18 aa, Entamoeba invadens
FAMKLSNVKFILLRGGIS

SEQ ID NO: 2816956 - protein, 24 aa, Entamoeba invadens
FAMTMFEVFQWDFVFKKMMRGFNT

SEQ ID NO: 2816957 - protein, 37 aa, Entamoeba invadens
FAMTMYECFRWKDAYDKIEFKYPWKIADFVTGGNRLN

SEQ ID NO: 2816958 - protein, 32 aa, Entamoeba invadens
FAMTMYECFSWSVAYPPEVFKFPWKIAEFVSA

SEQ ID NO: 2816959 - protein, 23 aa, Entamoeba invadens
FAMTMYEVLQWDFVFKNDDERFL

SEQ ID NO: 2816960 - protein, 25 aa, Entamoeba invadens
FANTEIALSALFVRTKLSSSYVVFG

SEQ ID NO: 2816961 - protein, 20 aa, Entamoeba invadens
FANVLLYIRGMSTFQKLLLV

SEQ ID NO: 2816962 - protein, 17 aa, Entamoeba invadens
FAPWCKTCASNSSRICV

SEQ ID NO: 2816963 - protein, 23 aa, Entamoeba invadens
FAQFGVCMDYLKASYHYSSKLDT

SEQ ID NO: 2816964 - protein, 19 aa, Entamoeba invadens
FATAMLHFAPGLTPAIYVS

SEQ ID NO: 2816965 - protein, 24 aa, Entamoeba invadens
FATYAFLNLLYYFAPIYSTFGNQK

SEQ ID NO: 2816966 - protein, 27 aa, Entamoeba invadens
FATYLPGIILWSFILLAIGGFIVVMLY

SEQ ID NO: 2816967 - protein, 17 aa, Entamoeba invadens
FAVLAFFIATLITKEFY

SEQ ID NO: 2816968 - protein, 17 aa, Entamoeba invadens
FAVLISLVVLCLAFGLP

SEQ ID NO: 2816969 - protein, 30 aa, Entamoeba invadens
FAVSSLISFERFVFIASISGILCFDRNKMK

SEQ ID NO: 2816970 - protein, 33 aa, Entamoeba invadens
FAVTMFECMIWGNAFLKESFPYAWDIVDFVVNG

SEQ ID NO: 2816971 - protein, 30 aa, Entamoeba invadens
FAVTMLLFTLFVVGFVLFQSRFKCSDFGKV

SEQ ID NO: 2816972 - protein, 25 aa, Entamoeba invadens
FAWENAYPNDLFKFAWSIADYITGG

SEQ ID NO: 2816973 - protein, 24 aa, Entamoeba invadens
FCAPTLMVAYITFGVNFKGNYSLL

SEQ ID NO: 2816974 - protein, 24 aa, Entamoeba invadens
FCCLACWCIFMLQPTFRCSVITPM

SEQ ID NO: 2816975 - protein, 17 aa, Entamoeba invadens
FCCPHWFHYLQGIGYYC

SEQ ID NO: 2816976 - protein, 27 aa, Entamoeba invadens
FCEIMTWIFFDLMTGIPLMGVAFSFCG

SEQ ID NO: 2816977 - protein, 19 aa, Entamoeba invadens
FCEYGSIQDLMKKHKEKIL

SEQ ID NO: 2816978 - protein, 24 aa, Entamoeba invadens
FCFFFIFFCFHFSIFCFLFSPIFL

SEQ ID NO: 2816979 - protein, 17 aa, Entamoeba invadens
FCFFGNEKSLFTATSSN

SEQ ID NO: 2816980 - protein, 29 aa, Entamoeba invadens
FCFKEQWIKQFYLKTIPLIPQFKYQSTAT

SEQ ID NO: 2816981 - protein, 17 aa, Entamoeba invadens
FCFLCNEEYILIDGVCV

SEQ ID NO: 2816982 - protein, 27 aa, Entamoeba invadens
FCFYKNKYRFGKWFKLLYNVKNSSHVR

SEQ ID NO: 2816983 - protein, 22 aa, Entamoeba invadens
FCGHPIFGTMLLRYFEQENKSN

SEQ ID NO: 2816984 - protein, 23 aa, Entamoeba invadens
FCIDTFVVLTKLLRTIIQRRILD

SEQ ID NO: 2816985 - protein, 50 aa, Entamoeba invadens
FCKEKTKIWVYIVILFSIILLIIIIISIIILPLYFIFKKHKNTEEKTIFK

SEQ ID NO: 2816986 - protein, 27 aa, Entamoeba invadens
FCKKIPPFWSIVELQFFTPQKAVASDE

SEQ ID NO: 2816987 - protein, 48 aa, Entamoeba invadens
FCKTALRYDIIFGTIVGFIVFIVLLIVLIIVIIYRIKLHKTEEKKMRN

SEQ ID NO: 2816988 - protein, 18 aa, Entamoeba invadens
FCLLFCTPCLICTLFNCV

SEQ ID NO: 2816989 - protein, 17 aa, Entamoeba invadens
FCLSCNTNYVFRVTFSS

SEQ ID NO: 2816990 - protein, 17 aa, Entamoeba invadens
FCLTCKNGYFVNDFKCV

SEQ ID NO: 2816991 - protein, 18 aa, Entamoeba invadens
FCLTINPSVVVLKQGEAC

SEQ ID NO: 2816992 - protein, 25 aa, Entamoeba invadens
FCNYFILFGNLCLMGFRAVAVLRSY

SEQ ID NO: 2816993 - protein, 18 aa, Entamoeba invadens
FCPLLKTIKYSKKQVKRI

SEQ ID NO: 2816994 - protein, 23 aa, Entamoeba invadens
FCSNSFGIKLLISSSSKLIIETD

SEQ ID NO: 2816995 - protein, 19 aa, Entamoeba invadens
FCSQLLSMYFVVADLRKCH

SEQ ID NO: 2816996 - protein, 17 aa, Entamoeba invadens
FCTSCEDGYYLSENKCI

SEQ ID NO: 2816997 - protein, 19 aa, Entamoeba invadens
FCTSKIQSFFLLVATAFDT

SEQ ID NO: 2816998 - protein, 19 aa, Entamoeba invadens
FCTTCSDGFYLSPESRRYG

SEQ ID NO: 2816999 - protein, 20 aa, Entamoeba invadens
FCVCTFYLALVIIACWTYNI

SEQ ID NO: 2817000 - protein, 24 aa, Entamoeba invadens
FCVMKGCDYYTIRTEPALVNLKSG

SEQ ID NO: 2817001 - protein, 20 aa, Entamoeba invadens
FCVNYPLIYLQMVWAQKYSE

SEQ ID NO: 2817002 - protein, 18 aa, Entamoeba invadens
FCVSVVFPLVLLLSTQRE

SEQ ID NO: 2817003 - protein, 19 aa, Entamoeba invadens
FCVVFWKYYAELMNNNIVV

SEQ ID NO: 2817004 - protein, 18 aa, Entamoeba invadens
FCYPALKFLGSTSLFVEP

SEQ ID NO: 2817005 - protein, 17 aa, Entamoeba invadens
FCYSPLDIPTKVFVFSE

SEQ ID NO: 2817006 - protein, 20 aa, Entamoeba invadens
FCYYNPKYRIGKWIKLNMTL

SEQ ID NO: 2817007 - protein, 17 aa, Entamoeba invadens
FDATGATVTFLGTSSIA

SEQ ID NO: 2817008 - protein, 19 aa, Entamoeba invadens
FDCLRCIDNYYFDSNTRSC

SEQ ID NO: 2817009 - protein, 24 aa, Entamoeba invadens
FDDKTFIEWLNNQFLLSKTSFDEI

SEQ ID NO: 2817010 - protein, 30 aa, Entamoeba invadens
FDDNNIGNPLFVKLLEIFTENKFVEKFKEA

SEQ ID NO: 2817011 - protein, 24 aa, Entamoeba invadens
FDEFVFFHFIGWWARAMVCRDVGL

SEQ ID NO: 2817012 - protein, 28 aa, Entamoeba invadens
FDEPFPVFYDEAFKFEWMTVYCKASLYN

SEQ ID NO: 2817013 - protein, 19 aa, Entamoeba invadens
FDFAFSSIPFNFTLNNDKF

SEQ ID NO: 2817014 - protein, 17 aa, Entamoeba invadens
FDFPRMLSFYLYGKGRI

SEQ ID NO: 2817015 - protein, 28 aa, Entamoeba invadens
FDGFIVLKVPFPLSYRFKLITQQGMGFL

SEQ ID NO: 2817016 - protein, 18 aa, Entamoeba invadens
FDGILCKMGVITNNVLSC

SEQ ID NO: 2817017 - protein, 17 aa, Entamoeba invadens
FDGYYIKDSKCLECGGN

SEQ ID NO: 2817018 - protein, 19 aa, Entamoeba invadens
FDHVALLVFGIFNVFISNS

SEQ ID NO: 2817019 - protein, 30 aa, Entamoeba invadens
FDIIEELFYFFLYSWALYILAMTYNFVTVP

SEQ ID NO: 2817020 - protein, 18 aa, Entamoeba invadens
FDIKICYIPTLVGVVFTL

SEQ ID NO: 2817021 - protein, 18 aa, Entamoeba invadens
FDILMEWYYVFTSHFTYD

SEQ ID NO: 2817022 - protein, 26 aa, Entamoeba invadens
FDIYADTLPRWTVKSVALTPTSYIGS

SEQ ID NO: 2817023 - protein, 19 aa, Entamoeba invadens
FDKICIECKFGYYKDVDGC

SEQ ID NO: 2817024 - protein, 51 aa, Entamoeba invadens
FDKNEKTILMVFKSIIKRFWFKGVELKPKNFNVWLQRVFHKEVNASNEWNT

SEQ ID NO: 2817025 - protein, 23 aa, Entamoeba invadens
FDKRGCFLVNLPNEYFGISPKEF

SEQ ID NO: 2817026 - protein, 22 aa, Entamoeba invadens
FDLHVLIVIAPAGLYYCFKKFD

SEQ ID NO: 2817027 - protein, 25 aa, Entamoeba invadens
FDLLPSLCVLLLLSGLRYYFSKRFF

SEQ ID NO: 2817028 - protein, 33 aa, Entamoeba invadens
FDMIAKSLILIQKPFLVKLLYSKNRIFMAQAIF

SEQ ID NO: 2817029 - protein, 17 aa, Entamoeba invadens
FDPMIKSTKFRIFHRAE

SEQ ID NO: 2817030 - protein, 30 aa, Entamoeba invadens
FDQNVVLWSWFFFDIIIRSTVEYLHEQMDK

SEQ ID NO: 2817031 - protein, 23 aa, Entamoeba invadens
FDSRLMFFFGFALPFTSLSFFCS

SEQ ID NO: 2817032 - protein, 17 aa, Entamoeba invadens
FDSTKILLGSKLYRICY

SEQ ID NO: 2817033 - protein, 25 aa, Entamoeba invadens
FDTFLDLLMPTKSVVIFCVFGAIVV

SEQ ID NO: 2817034 - protein, 18 aa, Entamoeba invadens
FDTIFQRGLFRNCSNESY

SEQ ID NO: 2817035 - protein, 28 aa, Entamoeba invadens
FDTIINAFALIIYLYSALPMDFEKTVLH

SEQ ID NO: 2817036 - protein, 20 aa, Entamoeba invadens
FDTLPMYVLFDQKFASELCS

SEQ ID NO: 2817037 - protein, 25 aa, Entamoeba invadens
FDTNEYPISLILPMNGGGLGDLVAS

SEQ ID NO: 2817038 - protein, 21 aa, Entamoeba invadens
FDTVHMMFVIRFSTFCWSVAD

SEQ ID NO: 2817039 - protein, 28 aa, Entamoeba invadens
FDVKDTMFLAFAGFYYDILNITKVCCDK

SEQ ID NO: 2817040 - protein, 20 aa, Entamoeba invadens
FDVTPLGRLLNYFSRDLRFV

SEQ ID NO: 2817041 - protein, 42 aa, Entamoeba invadens
FDVVKAILFITALLFIALNIISFIFRLFRAKGYKRFVELRLK

SEQ ID NO: 2817042 - protein, 17 aa, Entamoeba invadens
FDYSTITLLILNCIFVA

SEQ ID NO: 2817043 - protein, 17 aa, Entamoeba invadens
FEAFAWEEAYVDVKYFF

SEQ ID NO: 2817044 - protein, 18 aa, Entamoeba invadens
FECFAWKEAYKGLKFKFA

SEQ ID NO: 2817045 - protein, 36 aa, Entamoeba invadens
FECFDYNEILKPQKLLFNTYNTMFLNDIISPMPKSE

SEQ ID NO: 2817046 - protein, 26 aa, Entamoeba invadens
FECISWSYAYSKDKFKFPWSIAEFVI

SEQ ID NO: 2817047 - protein, 27 aa, Entamoeba invadens
FECISWSYAYSYDKFKFPWSIAEFVIK

SEQ ID NO: 2817048 - protein, 24 aa, Entamoeba invadens
FECTKLSKAIRWLNTRPTDFCVEL

SEQ ID NO: 2817049 - protein, 18 aa, Entamoeba invadens
FECVSCENGTFKNTEKGC

SEQ ID NO: 2817050 - protein, 20 aa, Entamoeba invadens
FECVTWKNPYPKEQFKFAWD

SEQ ID NO: 2817051 - protein, 20 aa, Entamoeba invadens
FEDVTLITRTIYGRAVYSGC

SEQ ID NO: 2817052 - protein, 28 aa, Entamoeba invadens
FEEDFYRKFPIFKLPTEVWYIEPYGEEL

SEQ ID NO: 2817053 - protein, 17 aa, Entamoeba invadens
FEEVLTALLIYGLIFFN

SEQ ID NO: 2817054 - protein, 36 aa, Entamoeba invadens
FEGLSSFILFLLYGWVFVLLLFLYSQVHPPLYKERV

SEQ ID NO: 2817055 - protein, 26 aa, Entamoeba invadens
FEGNAKAVLFYLLVSNSTTLSMKEYS

SEQ ID NO: 2817056 - protein, 27 aa, Entamoeba invadens
FEGRVKFSYLIIKSKPISGVYNLNDWT

SEQ ID NO: 2817057 - protein, 19 aa, Entamoeba invadens
FEHCVANMFFLPTAQMYGA

SEQ ID NO: 2817058 - protein, 18 aa, Entamoeba invadens
FEHLLDSLSMVVDKYKIL

SEQ ID NO: 2817059 - protein, 24 aa, Entamoeba invadens
FEHSVANMFFLPLAQMYGAKINML

SEQ ID NO: 2817060 - protein, 25 aa, Entamoeba invadens
FEHTFPFLFLLIDCLLFAQGSKHID

SEQ ID NO: 2817061 - protein, 20 aa, Entamoeba invadens
FEIFIKPLCSCHLEEDIMVI

SEQ ID NO: 2817062 - protein, 19 aa, Entamoeba invadens
FEIFIKPLCSCRIEECIMV

SEQ ID NO: 2817063 - protein, 20 aa, Entamoeba invadens
FEIFITPLCTFKIEDQLKVI

SEQ ID NO: 2817064 - protein, 18 aa, Entamoeba invadens
FEIFLKPYCSCQINDEIL

SEQ ID NO: 2817065 - protein, 30 aa, Entamoeba invadens
FEINWKRIFNWLILFWGYTAFECFEQESHL

SEQ ID NO: 2817066 - protein, 18 aa, Entamoeba invadens
FEIVDVKLLLIKNIEKAS

SEQ ID NO: 2817067 - protein, 29 aa, Entamoeba invadens
FEKIKVVLRNFAMAGPGLMLYTVLKNFFG

SEQ ID NO: 2817068 - protein, 49 aa, Entamoeba invadens
FEKKYCETKVVWWVILISVLVIIVFLFFTFVAIFLITRTILAHFHQKEV

SEQ ID NO: 2817069 - protein, 28 aa, Entamoeba invadens
FEKLQTHRLYFVIQMLFAFIENNDYVQT

SEQ ID NO: 2817070 - protein, 17 aa, Entamoeba invadens
FEKTMWVYLYTTPHTRQ

SEQ ID NO: 2817071 - protein, 20 aa, Entamoeba invadens
FELFLTPNYTTKINTTIALV

SEQ ID NO: 2817072 - protein, 18 aa, Entamoeba invadens
FELIPNKVYQFRGYDVAN

SEQ ID NO: 2817073 - protein, 26 aa, Entamoeba invadens
FELTFLDVVTVIYFFVNQKNYSEDEN

SEQ ID NO: 2817074 - protein, 18 aa, Entamoeba invadens
FEMFGWCEIYSKNVFNYP

SEQ ID NO: 2817075 - protein, 24 aa, Entamoeba invadens
FEMRCPLDFLLVQLLVACLLEVPF

SEQ ID NO: 2817076 - protein, 19 aa, Entamoeba invadens
FEMTPLLNIVRVSFFMSIR

SEQ ID NO: 2817077 - protein, 18 aa, Entamoeba invadens
FEMYVTLCRANDFPLFCG

SEQ ID NO: 2817078 - protein, 20 aa, Entamoeba invadens
FENIYSYGQIILFGTPGYST

SEQ ID NO: 2817079 - protein, 18 aa, Entamoeba invadens
FENLFYNSKCLATMVLKK

SEQ ID NO: 2817080 - protein, 21 aa, Entamoeba invadens
FENLKKFNESLAEKVKEAKNA

SEQ ID NO: 2817081 - protein, 18 aa, Entamoeba invadens
FENNYSPSKKRIFQILPT

SEQ ID NO: 2817082 - protein, 36 aa, Entamoeba invadens
FENSKEFVLLFFHLYKTLQEFLNNPAPYPLCYKSHG

SEQ ID NO: 2817083 - protein, 26 aa, Entamoeba invadens
FEPAFIFSFAFWWKVGVITLVNALPF

SEQ ID NO: 2817084 - protein, 20 aa, Entamoeba invadens
FEPKLRKLREGLTLKPIAGV

SEQ ID NO: 2817085 - protein, 18 aa, Entamoeba invadens
FEQFVCSKLRVLYKLNWL

SEQ ID NO: 2817086 - protein, 24 aa, Entamoeba invadens
FEQNDVFLKLHNYNYEKFDISCYN

SEQ ID NO: 2817087 - protein, 20 aa, Entamoeba invadens
FEQQLTFYIINVANTLTFSS

SEQ ID NO: 2817088 - protein, 23 aa, Entamoeba invadens
FEQSIWYSLYVNVRIQYLITSTN

SEQ ID NO: 2817089 - protein, 30 aa, Entamoeba invadens
FERNKKVFFINFLVDLATLMDFELVSIVSR

SEQ ID NO: 2817090 - protein, 29 aa, Entamoeba invadens
FERPLFFNFLMFFGMFLALIVYFVITIVK

SEQ ID NO: 2817091 - protein, 29 aa, Entamoeba invadens
FESCNNMMFLHLPATLTTLGEDWIKGVTN

SEQ ID NO: 2817092 - protein, 24 aa, Entamoeba invadens
FESFGWCNAYPKKDFTYPWKIAEF

SEQ ID NO: 2817093 - protein, 18 aa, Entamoeba invadens
FESFNRRINIKAGSLKLG

SEQ ID NO: 2817094 - protein, 33 aa, Entamoeba invadens
FESWSKLLKKVQPWYVTLLRRFIRAEVSQFATT

SEQ ID NO: 2817095 - protein, 18 aa, Entamoeba invadens
FETVPNKDYYIFVAPYNF

SEQ ID NO: 2817096 - protein, 23 aa, Entamoeba invadens
FETYNPIISDWFVRGKEIIIHNT

SEQ ID NO: 2817097 - protein, 20 aa, Entamoeba invadens
FEVFGPPIVVLMLAIVFSIF

SEQ ID NO: 2817098 - protein, 17 aa, Entamoeba invadens
FEVFGWEEPYNKLEFKF

SEQ ID NO: 2817099 - protein, 18 aa, Entamoeba invadens
FEVFIVPLCTSHLTDNIM

SEQ ID NO: 2817100 - protein, 18 aa, Entamoeba invadens
FEVGITCEFLFVVPAFVS

SEQ ID NO: 2817101 - protein, 25 aa, Entamoeba invadens
FEYTRKTMMSFYLSNNILVKNCTFR

SEQ ID NO: 2817102 - protein, 18 aa, Entamoeba invadens
FFAILNRVPEITLCASNV

SEQ ID NO: 2817103 - protein, 27 aa, Entamoeba invadens
FFAISRSLVIKAPFTNAPIKTKGAAQI

SEQ ID NO: 2817104 - protein, 24 aa, Entamoeba invadens
FFATRIVMILMILGSIGLIVTGFF

SEQ ID NO: 2817105 - protein, 23 aa, Entamoeba invadens
FFATWCGPCKSIAPYFEELARKT

SEQ ID NO: 2817106 - protein, 19 aa, Entamoeba invadens
FFCCFQSYSLTWCSSENGT

SEQ ID NO: 2817107 - protein, 23 aa, Entamoeba invadens
FFCCGLSFLFIFFFDRVVATHGG

SEQ ID NO: 2817108 - protein, 18 aa, Entamoeba invadens
FFCLITWVVNLMLFNRSQ

SEQ ID NO: 2817109 - protein, 18 aa, Entamoeba invadens
FFCVLCIYGMLLCLSPPT

SEQ ID NO: 2817110 - protein, 19 aa, Entamoeba invadens
FFDITKYLPGKSANNIFAY

SEQ ID NO: 2817111 - protein, 21 aa, Entamoeba invadens
FFDSFVFYYSYYLLYLIVNSI

SEQ ID NO: 2817112 - protein, 20 aa, Entamoeba invadens
FFEAFAWKDAFGDVKYFFEI

SEQ ID NO: 2817113 - protein, 17 aa, Entamoeba invadens
FFEHFWQRQNSIDKKLS

SEQ ID NO: 2817114 - protein, 21 aa, Entamoeba invadens
FFEMNDFISLFSELLIQRNHF

SEQ ID NO: 2817115 - protein, 22 aa, Entamoeba invadens
FFFALSYSLYWCQSGEDKVECF

SEQ ID NO: 2817116 - protein, 22 aa, Entamoeba invadens
FFFLLVALPLVYMFAPLYNNYL

SEQ ID NO: 2817117 - protein, 21 aa, Entamoeba invadens
FFFQIIFVHFVTAFCGDGVRD

SEQ ID NO: 2817118 - protein, 17 aa, Entamoeba invadens
FFHLILTRPDKLGALYD

SEQ ID NO: 2817119 - protein, 26 aa, Entamoeba invadens
FFIGFYLSTILSLIINVYGCDQVKCD

SEQ ID NO: 2817120 - protein, 19 aa, Entamoeba invadens
FFILFIVFGSLVGVSLFVS

SEQ ID NO: 2817121 - protein, 18 aa, Entamoeba invadens
FFISLSFGCVLHNITLSA

SEQ ID NO: 2817122 - protein, 18 aa, Entamoeba invadens
FFIVCFWIMFVVAILVMC

SEQ ID NO: 2817123 - protein, 38 aa, Entamoeba invadens
FFKKEKWYRDISIYKLSFVLVINFVYFGVELAMGLYLK

SEQ ID NO: 2817124 - protein, 30 aa, Entamoeba invadens
FFKKSPELLDLWKFPIFNVYTMNNNRGLLD

SEQ ID NO: 2817125 - protein, 25 aa, Entamoeba invadens
FFKMCFNVYVLSYSYFRVLDNANVE

SEQ ID NO: 2817126 - protein, 18 aa, Entamoeba invadens
FFLCFVAIACAGAVNETE

SEQ ID NO: 2817127 - protein, 22 aa, Entamoeba invadens
FFLFYITYAVTTKHCYAFDSND

SEQ ID NO: 2817128 - protein, 21 aa, Entamoeba invadens
FFLIFFLYFVCGAVVSLHGLT

SEQ ID NO: 2817129 - protein, 17 aa, Entamoeba invadens
FFLIPSEQLLCQDYSNL

SEQ ID NO: 2817130 - protein, 21 aa, Entamoeba invadens
FFLLYATFFITAYAGKDHIDV

SEQ ID NO: 2817131 - protein, 18 aa, Entamoeba invadens
FFLRVSTSIFENWMSDSD

SEQ ID NO: 2817132 - protein, 17 aa, Entamoeba invadens
FFLVNMFYAFISNFTVQ

SEQ ID NO: 2817133 - protein, 19 aa, Entamoeba invadens
FFLVSVIIIYFFSSPFTIK

SEQ ID NO: 2817134 - protein, 18 aa, Entamoeba invadens
FFMICQNGTFSIFSETGK

SEQ ID NO: 2817135 - protein, 18 aa, Entamoeba invadens
FFNEILRNIKFIKYNRWE

SEQ ID NO: 2817136 - protein, 17 aa, Entamoeba invadens
FFNLIKNCTYYYGFALV

SEQ ID NO: 2817137 - protein, 17 aa, Entamoeba invadens
FFNVLSRLDGVDPLYLY

SEQ ID NO: 2817138 - protein, 17 aa, Entamoeba invadens
FFPFQDFKEQRTKTANP

SEQ ID NO: 2817139 - protein, 17 aa, Entamoeba invadens
FFQNFFSTSRPTSKLRL

SEQ ID NO: 2817140 - protein, 22 aa, Entamoeba invadens
FFRIWVAFIGLLIFLTGLIHLC

SEQ ID NO: 2817141 - protein, 19 aa, Entamoeba invadens
FFSFFGMIDKLAILGIFIS

SEQ ID NO: 2817142 - protein, 17 aa, Entamoeba invadens
FFSLFPALLPQLVVTFL

SEQ ID NO: 2817143 - protein, 39 aa, Entamoeba invadens
FFTWWNTIMQNVSGWLLLAWWFFCVFKLRCHVCGDTCVE

SEQ ID NO: 2817144 - protein, 18 aa, Entamoeba invadens
FFVALIVVVSFIFVIFLV

SEQ ID NO: 2817145 - protein, 18 aa, Entamoeba invadens
FFVFFEESDFIHINPLEI

SEQ ID NO: 2817146 - protein, 35 aa, Entamoeba invadens
FFVIAVFFLCFYWAGLFFVVMFWIAFSVAILVVVA

SEQ ID NO: 2817147 - protein, 23 aa, Entamoeba invadens
FFVLHIALLVFYFVNFRDHPFRP

SEQ ID NO: 2817148 - protein, 21 aa, Entamoeba invadens
FFVLLFLIKSYCQTIENYCQV

SEQ ID NO: 2817149 - protein, 25 aa, Entamoeba invadens
FFYEFVIILCILIETLLFIAHALLS

SEQ ID NO: 2817150 - protein, 21 aa, Entamoeba invadens
FGCLICNNTFYLDELTKQCVS

SEQ ID NO: 2817151 - protein, 18 aa, Entamoeba invadens
FGCLVCKSGYFMNNFTCV

SEQ ID NO: 2817152 - protein, 17 aa, Entamoeba invadens
FGDAANMYALFLALFIV

SEQ ID NO: 2817153 - protein, 26 aa, Entamoeba invadens
FGDIFNVMLQYLPYSDVIGGKLDVYV

SEQ ID NO: 2817154 - protein, 18 aa, Entamoeba invadens
FGDVKFVRTQKSLFKKHY

SEQ ID NO: 2817155 - protein, 25 aa, Entamoeba invadens
FGDYAFMGTKLTTITFPTTAVTTFG

SEQ ID NO: 2817156 - protein, 25 aa, Entamoeba invadens
FGERTVLSLFRFLDKIPVTPYHITL

SEQ ID NO: 2817157 - protein, 43 aa, Entamoeba invadens
FGFDEMITVLTNPLLFILCLIIGGFGFTAYKLGLGGVVTSYMT

SEQ ID NO: 2817158 - protein, 19 aa, Entamoeba invadens
FGFGFLLCCLWLVDYCKYR

SEQ ID NO: 2817159 - protein, 31 aa, Entamoeba invadens
FGFRREEHFFKPLIFGLFSMIFEVYNQLSKI

SEQ ID NO: 2817160 - protein, 18 aa, Entamoeba invadens
FGGHVNIPFMFTVNKTLS

SEQ ID NO: 2817161 - protein, 22 aa, Entamoeba invadens
FGGITFFETFPYILPNIVCACF

SEQ ID NO: 2817162 - protein, 26 aa, Entamoeba invadens
FGGKHSFITLRELFKWADRHASSYEE

SEQ ID NO: 2817163 - protein, 17 aa, Entamoeba invadens
FGGLMKWARSDVSDISV

SEQ ID NO: 2817164 - protein, 27 aa, Entamoeba invadens
FGGSDRYMLLSNYLYTYAYNNINCTSL

SEQ ID NO: 2817165 - protein, 24 aa, Entamoeba invadens
FGGWICPVLSFLASLVLFVYASFS

SEQ ID NO: 2817166 - protein, 18 aa, Entamoeba invadens
FGHSKLFWVGERSQWEDI

SEQ ID NO: 2817167 - protein, 27 aa, Entamoeba invadens
FGIFAMIFAIVYMIIEIYGFFGVENPK

SEQ ID NO: 2817168 - protein, 25 aa, Entamoeba invadens
FGIGNLVIILFLFLPSSILSISSSN

SEQ ID NO: 2817169 - protein, 31 aa, Entamoeba invadens
FGIGVAFYFDWRIALCVIAVTPILITVVFLN

SEQ ID NO: 2817170 - protein, 20 aa, Entamoeba invadens
FGIGVFEWIASLETVNLGGL

SEQ ID NO: 2817171 - protein, 18 aa, Entamoeba invadens
FGIGYWGWSDVAYYSDIV

SEQ ID NO: 2817172 - protein, 24 aa, Entamoeba invadens
FGIIGWELFYMKNAFFDYSNEEEI

SEQ ID NO: 2817173 - protein, 19 aa, Entamoeba invadens
FGIIMWELAHRQKPYEKLK

SEQ ID NO: 2817174 - protein, 34 aa, Entamoeba invadens
FGIKTPISMLCPAKFFTIYYHPVEYQFVQKTATG

SEQ ID NO: 2817175 - protein, 30 aa, Entamoeba invadens
FGILCAIISLIWFCIWVFNWVMALIKAQSQ

SEQ ID NO: 2817176 - protein, 33 aa, Entamoeba invadens
FGITMYEVFGWCKAYPITTFKFPWKIAEFVTAG

SEQ ID NO: 2817177 - protein, 22 aa, Entamoeba invadens
FGIVMWEFLTRDVPYKNVPPQS

SEQ ID NO: 2817178 - protein, 25 aa, Entamoeba invadens
FGKELGYYYFLLQPDGEKFENLDKN

SEQ ID NO: 2817179 - protein, 26 aa, Entamoeba invadens
FGKFLYRFCFFILSERIGLKIRKLYF

SEQ ID NO: 2817180 - protein, 23 aa, Entamoeba invadens
FGKMMWRPHLLPSHVAYTMLKTS

SEQ ID NO: 2817181 - protein, 19 aa, Entamoeba invadens
FGKVYLGLFRGTQVALKIL

SEQ ID NO: 2817182 - protein, 23 aa, Entamoeba invadens
FGLFVSILRWVLLFDLFGSVVYA

SEQ ID NO: 2817183 - protein, 17 aa, Entamoeba invadens
FGLIQQFITYRMDSLDM

SEQ ID NO: 2817184 - protein, 18 aa, Entamoeba invadens
FGLISIWITMAIKVKRFN

SEQ ID NO: 2817185 - protein, 19 aa, Entamoeba invadens
FGLPFAYFTAGIPLSAIAI

SEQ ID NO: 2817186 - protein, 26 aa, Entamoeba invadens
FGLSEGVGYFILKFCFFVVSERQGIK

SEQ ID NO: 2817187 - protein, 24 aa, Entamoeba invadens
FGLTTSPPIWIYDASDFKAQEQKA

SEQ ID NO: 2817188 - protein, 17 aa, Entamoeba invadens
FGLVYKGIYKTNKVAVK

SEQ ID NO: 2817189 - protein, 31 aa, Entamoeba invadens; identical to SEQ ID NO: 2593692

SEQ ID NO: 2817190 - protein, 17 aa, Entamoeba invadens
FGMIFQTLAAFISGYAL

SEQ ID NO: 2817191 - protein, 17 aa, Entamoeba invadens
FGPFCVGGELLLFDGGV

SEQ ID NO: 2817192 - protein, 20 aa, Entamoeba invadens
FGPHQFPEKLIPKFITLLDR

SEQ ID NO: 2817193 - protein, 19 aa, Entamoeba invadens
FGQLLALGNFPEHVVPICF

SEQ ID NO: 2817194 - protein, 26 aa, Entamoeba invadens
FGRKFSVPIRVIVSVGLLIDKWEIIP

SEQ ID NO: 2817195 - protein, 23 aa, Entamoeba invadens
FGSARAISLYKTALTLTKQIGTL

SEQ ID NO: 2817196 - protein, 24 aa, Entamoeba invadens
FGSFSFFIIFPEQCDLLLTASVGK

SEQ ID NO: 2817197 - protein, 26 aa, Entamoeba invadens
FGSIIGFIVVILVLIGIIVLIVKTDK

SEQ ID NO: 2817198 - protein, 27 aa, Entamoeba invadens
FGSIIGFIVVILVLIGIIVLIVKTDKV

SEQ ID NO: 2817199 - protein, 23 aa, Entamoeba invadens
FGSKYIVHFYGAVFIPSKVCMVT

SEQ ID NO: 2817200 - protein, 28 aa, Entamoeba invadens
FGSYNSMTFPIAPKKRYSYLNNDQNFFI

SEQ ID NO: 2817201 - protein, 32 aa, Entamoeba invadens
FGTALLYFIGYIFPLIWMVQLFYIFSKDENTK

SEQ ID NO: 2817202 - protein, 18 aa, Entamoeba invadens
FGTARFTALTAFIDTIDF

SEQ ID NO: 2817203 - protein, 26 aa, Entamoeba invadens
FGTAYGIMTYLILPRAMLALNLTAMF

SEQ ID NO: 2817204 - protein, 25 aa, Entamoeba invadens
FGVEICLVLFSFILSDPTHLYASRG

SEQ ID NO: 2817205 - protein, 23 aa, Entamoeba invadens
FGVGFFKVVPLISVQFFAFDQYK

SEQ ID NO: 2817206 - protein, 20 aa, Entamoeba invadens
FGVLSIGAQLFLFEGGLLVL

SEQ ID NO: 2817207 - protein, 32 aa, Entamoeba invadens
FGVSLFECVTWKEPYPKIRFKFAWDIVDFVAS

SEQ ID NO: 2817208 - protein, 35 aa, Entamoeba invadens
FGVSMYECFIWQRPFLDKGFKYPWNIIKYVTSGER

SEQ ID NO: 2817209 - protein, 30 aa, Entamoeba invadens
FGVTLYECLSWSLAYQPPQFKFPWEIADFV

SEQ ID NO: 2817210 - protein, 25 aa, Entamoeba invadens
FGVTMFECLSWRTAFPKSEYPFSWK

SEQ ID NO: 2817211 - protein, 21 aa, Entamoeba invadens
FGVVYLGYFRGNKVAVKHMRN

SEQ ID NO: 2817212 - protein, 18 aa, Entamoeba invadens
FGVVYQGLYRSQKVAIKK

SEQ ID NO: 2817213 - protein, 17 aa, Entamoeba invadens
FGWCEAYPVKQFKFPWK

SEQ ID NO: 2817214 - protein, 18 aa, Entamoeba invadens
FGWCPIFFVRDYDPSIEE

SEQ ID NO: 2817215 - protein, 25 aa, Entamoeba invadens
FGYHYMLTLFFTFIARFCLIAMSVS

SEQ ID NO: 2817216 - protein, 25 aa, Entamoeba invadens
FHDRFPTLLVLVYNVVLKFYPDELI

SEQ ID NO: 2817217 - protein, 24 aa, Entamoeba invadens
FHFSFITLCCLFSYAVSQTQCEPG

SEQ ID NO: 2817218 - protein, 18 aa, Entamoeba invadens
FHFSPQVVFLRPNTKFCM

SEQ ID NO: 2817219 - protein, 17 aa, Entamoeba invadens
FHGKNLITHFIIGSKDV

SEQ ID NO: 2817220 - protein, 27 aa, Entamoeba invadens
FHGNEDILYYVTPIEQLVFVGQNYSNE

SEQ ID NO: 2817221 - protein, 22 aa, Entamoeba invadens
FHHLTWWEIINIFFFEFTDLDE

SEQ ID NO: 2817222 - protein, 25 aa, Entamoeba invadens
FHLLLRCMRCLDGVKLINIINLKQY

SEQ ID NO: 2817223 - protein, 26 aa, Entamoeba invadens
FHLNSLLLVFYYKNRKRQISAFVVIS

SEQ ID NO: 2817224 - protein, 17 aa, Entamoeba invadens
FHREFITMIQSVNDLSL

SEQ ID NO: 2817225 - protein, 17 aa, Entamoeba invadens
FHRNFIFTRQNLLTKNL

SEQ ID NO: 2817226 - protein, 23 aa, Entamoeba invadens
FHSFVLIVILMVSLTHSVVIGVS

SEQ ID NO: 2817227 - protein, 18 aa, Entamoeba invadens
FHTANLFTIQLLDETKVP

SEQ ID NO: 2817228 - protein, 17 aa, Entamoeba invadens
FHVFPCLKPKDVRKTPL

SEQ ID NO: 2817229 - protein, 18 aa, Entamoeba invadens
FIAGILFVVSIGLTIASL

SEQ ID NO: 2817230 - protein, 26 aa, Entamoeba invadens
FIARAFYQSFGLPLIITRGNNVFGPH

SEQ ID NO: 2817231 - protein, 27 aa, Entamoeba invadens
FIASPAVYFPFVIVVLPVVIVPHMKMI

SEQ ID NO: 2817232 - protein, 30 aa, Entamoeba invadens
FICHGVDTFKYKLVFRPKSGRLKPHREIKI

SEQ ID NO: 2817233 - protein, 18 aa, Entamoeba invadens
FICLVFCGRVILVYYGGY

SEQ ID NO: 2817234 - protein, 24 aa, Entamoeba invadens
FIDEYNRMIVNGEPIFPIGSALDN

SEQ ID NO: 2817235 - protein, 39 aa, Entamoeba invadens
  misc_feature (27)..(28): Xaa can be any naturally occurring amino acid
FIDLFQAIKMIRLDIIFILLALMFGWXXLNCAVVIAQFI

SEQ ID NO: 2817236 - protein, 23 aa, Entamoeba invadens
FIECELFRMYFDLNTISTIEILQ

SEQ ID NO: 2817237 - protein, 17 aa, Entamoeba invadens
FIEEIYFGNKLAFGYKQ

SEQ ID NO: 2817238 - protein, 25 aa, Entamoeba invadens
FIEGKYPKWLMIKSHIIVYIGNFIG

SEQ ID NO: 2817239 - protein, 18 aa, Entamoeba invadens
FIEYDKDTLIKMIKEIGE

SEQ ID NO: 2817240 - protein, 18 aa, Entamoeba invadens
FIFADFFATFSSNDLFFT

SEQ ID NO: 2817241 - protein, 23 aa, Entamoeba invadens
FIFFVFFNVVFSANIICEVGYYV

SEQ ID NO: 2817242 - protein, 22 aa, Entamoeba invadens
FIFFVFFNVVFSANMICEVRYY

SEQ ID NO: 2817243 - protein, 20 aa, Entamoeba invadens
FIFKLNWLRDEDCNLISTIS

SEQ ID NO: 2817244 - protein, 17 aa, Entamoeba invadens
FIFLIIKTRLAQADPII

SEQ ID NO: 2817245 - protein, 18 aa, Entamoeba invadens
FIFVISMIYKSNAEIKCL

SEQ ID NO: 2817246 - protein, 30 aa, Entamoeba invadens
FIGAICKCHFLTIPMFPTAIVFAVLSMILV

SEQ ID NO: 2817247 - protein, 18 aa, Entamoeba invadens
FIGRLLEFIPKTPPTKVI

SEQ ID NO: 2817248 - protein, 26 aa, Entamoeba invadens
FIGVFFFVVFLMFTIGFISVANFKFL

SEQ ID NO: 2817249 - protein, 21 aa, Entamoeba invadens
FIHTNYTWYAVFINDTQYNTW

SEQ ID NO: 2817250 - protein, 17 aa, Entamoeba invadens
FIHVVAFAVKCVERLVS

SEQ ID NO: 2817251 - protein, 50 aa, Entamoeba invadens
FIIDNHSFITTLKFWLLLVWGKCKTLNILFLIVICSGIFILLISITQQNN

SEQ ID NO: 2817252 - protein, 27 aa, Entamoeba invadens
FIIEYKSFWYVLFTNVLHFLAMGIEVV

SEQ ID NO: 2817253 - protein, 19 aa, Entamoeba invadens
FIIFQLLMGILVLIYGFLF

SEQ ID NO: 2817254 - protein, 22 aa, Entamoeba invadens
FIIKMPLLHRIACFRDDVVFVI

SEQ ID NO: 2817255 - protein, 18 aa, Entamoeba invadens
FIILFVAISIALNQFTNP

SEQ ID NO: 2817256 - protein, 25 aa, Entamoeba invadens
FIISTNFGVLLYISNKLAPSYITTN

SEQ ID NO: 2817257 - protein, 26 aa, Entamoeba invadens
FIKFKPYFPFGFLAVDFFFMLSGFLV

SEQ ID NO: 2817258 - protein, 19 aa, Entamoeba invadens
FILKQIPSVSFCEFLLRIH

SEQ ID NO: 2817259 - protein, 19 aa, Entamoeba invadens
FILTDSKQLKWCKYQDSLS

SEQ ID NO: 2817260 - protein, 17 aa, Entamoeba invadens
FIMKTMCGLYNVGTQRG

SEQ ID NO: 2817261 - protein, 17 aa, Entamoeba invadens
FIMTCSEDTFIEGTNTG

SEQ ID NO: 2817262 - protein, 18 aa, Entamoeba invadens
FIMVAYLAIRWKAYLKKR

SEQ ID NO: 2817263 - protein, 27 aa, Entamoeba invadens
FINDNMWILWIMSFMYSFSYVLFWIPI

SEQ ID NO: 2817264 - protein, 26 aa, Entamoeba invadens
FINFVQYAQLLWLLTTAVEFLLAQME

SEQ ID NO: 2817265 - protein, 18 aa, Entamoeba invadens
FINHRLCREYKGVSPYLD

SEQ ID NO: 2817266 - protein, 29 aa, Entamoeba invadens
FIPEDMLRKYSWCLLITNETIKIQCKDGN

SEQ ID NO: 2817267 - protein, 24 aa, Entamoeba invadens
FIQADLRIPLRPQTFFEIMTSRNA

SEQ ID NO: 2817268 - protein, 17 aa, Entamoeba invadens
FIQNMLLYIILQNTQAA

SEQ ID NO: 2817269 - protein, 25 aa, Entamoeba invadens
FIQSGLSAHFLRFAPTALFILYFQM

SEQ ID NO: 2817270 - protein, 27 aa, Entamoeba invadens
FIQTACFADFFMKKIIFTKNASLLANY

SEQ ID NO: 2817271 - protein, 18 aa, Entamoeba invadens
FIQVTYFITIVALPMVHL

SEQ ID NO: 2817272 - protein, 21 aa, Entamoeba invadens
FIQYDPSCTFVNLVFTCLRQL

SEQ ID NO: 2817273 - protein, 17 aa, Entamoeba invadens
FISSFVFMFVEGGMPES

SEQ ID NO: 2817274 - protein, 18 aa, Entamoeba invadens
FISVMYNKWSKKGKKMIV

SEQ ID NO: 2817275 - protein, 18 aa, Entamoeba invadens
FITISRFGNMQFTNALSL

SEQ ID NO: 2817276 - protein, 27 aa, Entamoeba invadens
FITNFITFVILYNNLVPISLYVSMEIV

SEQ ID NO: 2817277 - protein, 17 aa, Entamoeba invadens
FITPNFTTTIDSTIAIV

SEQ ID NO: 2817278 - protein, 23 aa, Entamoeba invadens
FIVLAVIVAIILAVHFSKKDNGN

SEQ ID NO: 2817279 - protein, 23 aa, Entamoeba invadens
FIVMPLALLILLYVVQSPVLLTI

SEQ ID NO: 2817280 - protein, 18 aa, Entamoeba invadens
FIVVQYYVTDILKLLDKS

SEQ ID NO: 2817281 - protein, 23 aa, Entamoeba invadens
FIVVYFVFFILRHKNFKVSFKTA

SEQ ID NO: 2817282 - protein, 20 aa, Entamoeba invadens
FIWEYYCEKVPFFNPVYERV

SEQ ID NO: 2817283 - protein, 24 aa, Entamoeba invadens
FIYKYLRHPSYTGWFYWSVFSQVV

SEQ ID NO: 2817284 - protein, 19 aa, Entamoeba invadens
FIYLVNSYELNCYPVGYNQ

SEQ ID NO: 2817285 - protein, 18 aa, Entamoeba invadens
FKCDTCEGVLLNYQMQQC

SEQ ID NO: 2817286 - protein, 18 aa, Entamoeba invadens
FKCKDYYTGLIDGNGYKC

SEQ ID NO: 2817287 - protein, 24 aa, Entamoeba invadens
FKDCKALFGIPMTNTITTLGDNAF

SEQ ID NO: 2817288 - protein, 30 aa, Entamoeba invadens
FKDFIQCMLRPKIIPYLDACKKDMWINIRN

SEQ ID NO: 2817289 - protein, 39 aa, Entamoeba invadens
FKDNMSVYVFIFSLFDSFQGMLLFLHNNSSLYFDVYDKT

SEQ ID NO: 2817290 - protein, 26 aa, Entamoeba invadens
FKDQIRVFYVFENAIISLIQVPWVEN

SEQ ID NO: 2817291 - protein, 24 aa, Entamoeba invadens
FKEDFAVYFMKKTVLRSTIESQGV

SEQ ID NO: 2817292 - protein, 26 aa, Entamoeba invadens
FKEPSPFAKLKFWKKKEEYEPFGHSE

SEQ ID NO: 2817293 - protein, 35 aa, Entamoeba invadens
FKEWGWCYIFIVVLTLLIVICLLLSGFFIGKRVTN

SEQ ID NO: 2817294 - protein, 18 aa, Entamoeba invadens
FKFAWSIADFITSGKRIV

SEQ ID NO: 2817295 - protein, 20 aa, Entamoeba invadens
FKFLFFNRWNMIVFLIISTA

SEQ ID NO: 2817296 - protein, 17 aa, Entamoeba invadens
FKFLWNIAEFVISGKRL

SEQ ID NO: 2817297 - protein, 17 aa, Entamoeba invadens
FKFPWKIAEFVISGKRL

SEQ ID NO: 2817298 - protein, 18 aa, Entamoeba invadens
FKFPWKIAEFVTSGERMK

SEQ ID NO: 2817299 - protein, 18 aa, Entamoeba invadens
FKFPWKIAEFVTTGERLP

SEQ ID NO: 2817300 - protein, 17 aa, Entamoeba invadens
FKFPWKIVEYVISGERL

SEQ ID NO: 2817301 - protein, 17 aa, Entamoeba invadens
FKFPWNVVDFVLKGNRE

SEQ ID NO: 2817302 - protein, 23 aa, Entamoeba invadens
FKFSNYCAQLIIMKIMTTKDCRC

SEQ ID NO: 2817303 - protein, 31 aa, Entamoeba invadens
FKFYVLAIFVFYIPVALLNFKFFLAESALNF

SEQ ID NO: 2817304 - protein, 30 aa, Entamoeba invadens
FKGFPLGMFITGVTFMFIFFVDRVIVEHSH

SEQ ID NO: 2817305 - protein, 25 aa, Entamoeba invadens
FKGKYRGNIVAIKKMKIGSGDNSQI

SEQ ID NO: 2817306 - protein, 27 aa, Entamoeba invadens
FKGNRPPYREGMSKILYSVIEKAWCMN

SEQ ID NO: 2817307 - protein, 17 aa, Entamoeba invadens
FKGVFRGNSVAVKQMKN

SEQ ID NO: 2817308 - protein, 35 aa, Entamoeba invadens
FKHTQLCLFIQMYSIIFLSLVLSVLSTTSCYVKDE

SEQ ID NO: 2817309 - protein, 20 aa, Entamoeba invadens
FKINYIVLFFIMFLSSFLVS

SEQ ID NO: 2817310 - protein, 18 aa, Entamoeba invadens
FKIPNLSECFVFLGDDFF

SEQ ID NO: 2817311 - protein, 27 aa, Entamoeba invadens
FKKFDFNMLFLIIYSVSVFYFSCVMSR

SEQ ID NO: 2817312 - protein, 24 aa, Entamoeba invadens
FKLKHTNMIFVKMADGLTIHTRNE

SEQ ID NO: 2817313 - protein, 18 aa, Entamoeba invadens
FKLLAGNQLLRYGESNRL

SEQ ID NO: 2817314 - protein, 17 aa, Entamoeba invadens
FKLRLDCEFCDKSCKQC

SEQ ID NO: 2817315 - protein, 19 aa, Entamoeba invadens
FKMELIGSTLVLIENCVLT

SEQ ID NO: 2817316 - protein, 26 aa, Entamoeba invadens
FKMSRSNVIFYKVNDWLVSNKEILIF

SEQ ID NO: 2817317 - protein, 25 aa, Entamoeba invadens
FKPAQFPIFISFLTLISSLSSFTIV

SEQ ID NO: 2817318 - protein, 41 aa, Entamoeba invadens
FKQIGIPIIVIIIVIVIVMITLFCVIIYVFNRHQDNKKTRD

SEQ ID NO: 2817319 - protein, 18 aa, Entamoeba invadens
FKQLYTRNFTNCSTTAFA

SEQ ID NO: 2817320 - protein, 19 aa, Entamoeba invadens
FKQQQPIYYLYINGSSKIE

SEQ ID NO: 2817321 - protein, 18 aa, Entamoeba invadens
FKRMYWRKKFQMSDEIVS

SEQ ID NO: 2817322 - protein, 31 aa, Entamoeba invadens
FKRTRKLFLYLILFVFLSGALTLLTLVLVQP

SEQ ID NO: 2817323 - protein, 25 aa, Entamoeba invadens
FKSISVKMYLSILSPSQFVTQNITN

SEQ ID NO: 2817324 - protein, 19 aa, Entamoeba invadens
FKTLKINWATLPTPSEENS

SEQ ID NO: 2817325 - protein, 28 aa, Entamoeba invadens
FKTMPPATVLVWLLTPSSETTKGITISI

SEQ ID NO: 2817326 - protein, 25 aa, Entamoeba invadens
FKTQKGFLKWFGFSIIIIGVFVCII

SEQ ID NO: 2817327 - protein, 17 aa, Entamoeba invadens
FKVLLEGHLLRYGASDK

SEQ ID NO: 2817328 - protein, 19 aa, Entamoeba invadens
FKVLLEGHLLRYGASNKIY

SEQ ID NO: 2817329 - protein, 18 aa, Entamoeba invadens
FKYAWDIADFISAGNRLV

SEQ ID NO: 2817330 - protein, 28 aa, Entamoeba invadens
FKYSNWVDYILLFVGIFGGLAVGILNPL

SEQ ID NO: 2817331 - protein, 19 aa, Entamoeba invadens
FLAFVVYIIAAMAVLVVCY

SEQ ID NO: 2817332 - protein, 34 aa, Entamoeba invadens
FLAVFFGMFFLFVKPLYNFFFTGPLRIVGNTMKL

SEQ ID NO: 2817333 - protein, 18 aa, Entamoeba invadens
FLAVNSFECSVGCLTPCV

SEQ ID NO: 2817334 - protein, 17 aa, Entamoeba invadens
FLCDPLYYNRFGCIPCP

SEQ ID NO: 2817335 - protein, 19 aa, Entamoeba invadens
FLCLFFVSPVSSHDFESFS

SEQ ID NO: 2817336 - protein, 19 aa, Entamoeba invadens
FLCVVYSFSKKINICKSGY

SEQ ID NO: 2817337 - protein, 18 aa, Entamoeba invadens
FLDLSMKCQTLGELAKRC

SEQ ID NO: 2817338 - protein, 22 aa, Entamoeba invadens
FLEFVKTAQPLFSIFVANHKTI

SEQ ID NO: 2817339 - protein, 17 aa, Entamoeba invadens
FLEVRGQLLGFMSKIFD

SEQ ID NO: 2817340 - protein, 22 aa, Entamoeba invadens
FLFDHYGTRGALIYAFVMGTLG

SEQ ID NO: 2817341 - protein, 31 aa, Entamoeba invadens
FLFFFLLLSKYIFFKKVFFPIYSQIVKRDKY

SEQ ID NO: 2817342 - protein, 27 aa, Entamoeba invadens
FLFFSAIITFFFLFRTSNNTLKYTSNI

SEQ ID NO: 2817343 - protein, 18 aa, Entamoeba invadens
FLFFVVPQLVMVFYALTK

SEQ ID NO: 2817344 - protein, 20 aa, Entamoeba invadens
FLFGIQHEGRCLIADEMGLG

SEQ ID NO: 2817345 - protein, 22 aa, Entamoeba invadens
FLFLCCLFTFSCSMYCGGGQYE

SEQ ID NO: 2817346 - protein, 17 aa, Entamoeba invadens
FLFSNIHADVCFEIDTQ

SEQ ID NO: 2817347 - protein, 19 aa, Entamoeba invadens
FLFSPIPPPFPLLKSKPKK

SEQ ID NO: 2817348 - protein, 19 aa, Entamoeba invadens
FLFTLFNVPISGTEVTELE

SEQ ID NO: 2817349 - protein, 18 aa, Entamoeba invadens
FLFVIAYIFLPFFQAHLS

SEQ ID NO: 2817350 - protein, 18 aa, Entamoeba invadens
FLGMTLCLFIYFFQFYVL

SEQ ID NO: 2817351 - protein, 18 aa, Entamoeba invadens
FLHDNNIIHRDIKGENVL

SEQ ID NO: 2817352 - protein, 18 aa, Entamoeba invadens
FLHHNQIIHRDIKGENVL

SEQ ID NO: 2817353 - protein, 32 aa, Entamoeba invadens
FLHISSLISWIHLLFYLLGVGCGPFLSSMMDY

SEQ ID NO: 2817354 - protein, 21 aa, Entamoeba invadens
FLHLSAFMAIITWMKGGFGQK

SEQ ID NO: 2817355 - protein, 24 aa, Entamoeba invadens
FLHTLRLHWIEFQNKFYVGDGVPF

SEQ ID NO: 2817356 - protein, 23 aa, Entamoeba invadens
FLHTLRLHWVEFQNKFYLGDGVR

SEQ ID NO: 2817357 - protein, 23 aa, Entamoeba invadens
FLIEKFHMILNRISEVLIPKRDI

SEQ ID NO: 2817358 - protein, 25 aa, Entamoeba invadens
FLIERYRECFAVILDYDSIAHVKNP

SEQ ID NO: 2817359 - protein, 25 aa, Entamoeba invadens
FLIKEGLEWFACGLVSFLVSHICNI

SEQ ID NO: 2817360 - protein, 21 aa, Entamoeba invadens
FLILCLLNRTLSVVCNSGQYQ

SEQ ID NO: 2817361 - protein, 17 aa, Entamoeba invadens
FLIMWIAGDITNLLGCI

SEQ ID NO: 2817362 - protein, 18 aa, Entamoeba invadens
FLIQTQCVEFLKMIFKTF

SEQ ID NO: 2817363 - protein, 17 aa, Entamoeba invadens
FLIRTEPTLVTLKKGFA

SEQ ID NO: 2817364 - protein, 18 aa, Entamoeba invadens
FLISFSFSVNPNNRAQKK

SEQ ID NO: 2817365 - protein, 25 aa, Entamoeba invadens
FLKSHPKRVVLQRLPFNFYNPHTAI

SEQ ID NO: 2817366 - protein, 25 aa, Entamoeba invadens
FLLAVRTCLLPVFRKAKSEISEDLR

SEQ ID NO: 2817367 - protein, 24 aa, Entamoeba invadens
FLLFLFFRLIPCVASLTSLNNSKT

SEQ ID NO: 2817368 - protein, 21 aa, Entamoeba invadens
FLLLFCYTTLSIDNWCQRTKN

SEQ ID NO: 2817369 - protein, 26 aa, Entamoeba invadens
FLLLILCCLVIFTPTYPVYSYSTEEH

SEQ ID NO: 2817370 - protein, 18 aa, Entamoeba invadens
FLLLTCSYSFSTVFNFSS

SEQ ID NO: 2817371 - protein, 18 aa, Entamoeba invadens
FLLPNYTCNIEDKIACVC

SEQ ID NO: 2817372 - protein, 19 aa, Entamoeba invadens
FLLTFAQSICVLCCTNYTS

SEQ ID NO: 2817373 - protein, 24 aa, Entamoeba invadens
FLMSKRAFFPLKQNRNFKWTMSQY

SEQ ID NO: 2817374 - protein, 21 aa, Entamoeba invadens
FLNGCILCDNTIPNKCLLCAQ

SEQ ID NO: 2817375 - protein, 25 aa, Entamoeba invadens
FLNGTFNYKWMIKSFDLKTAIDFSK

SEQ ID NO: 2817376 - protein, 19 aa, Entamoeba invadens
FLNWAMFLGMTLCLFIYFF

SEQ ID NO: 2817377 - protein, 18 aa, Entamoeba invadens
FLPIVFPLNDSKLSVRHF

SEQ ID NO: 2817378 - protein, 18 aa, Entamoeba invadens
FLPKTDLVFNLNSKVGTV

SEQ ID NO: 2817379 - protein, 27 aa, Entamoeba invadens
FLPSRWVMKLWPVLIVFTLAEIVTLLI

SEQ ID NO: 2817380 - protein, 29 aa, Entamoeba invadens
FLPTLTTKILPELFLKIPMLIKANNDTFY

SEQ ID NO: 2817381 - protein, 19 aa, Entamoeba invadens
FLRIAFYIGKPYQTFLLLQ

SEQ ID NO: 2817382 - protein, 19 aa, Entamoeba invadens
FLRLKYLKCWRQISLVGGF

SEQ ID NO: 2817383 - protein, 19 aa, Entamoeba invadens
FLRVCQLIYVCFTAKHLSQ

SEQ ID NO: 2817384 - protein, 17 aa, Entamoeba invadens
FLSKLVVFTITFNGNYS

SEQ ID NO: 2817385 - protein, 27 aa, Entamoeba invadens
FLSLFISLSFFIFPTKFALIFTFGNVL

SEQ ID NO: 2817386 - protein, 28 aa, Entamoeba invadens
FLSLPFALLFFVFPINFNLSPTQIAVFA

SEQ ID NO: 2817387 - protein, 27 aa, Entamoeba invadens
FLSLVTTVLFILFTSLSIWDDVLNDMM

SEQ ID NO: 2817388 - protein, 18 aa, Entamoeba invadens
FLSPISKAKTVTALITIL

SEQ ID NO: 2817389 - protein, 32 aa, Entamoeba invadens
FLSTLYAFFHLPLVFFLTTPIPLFTFACLVFA

SEQ ID NO: 2817390 - protein, 18 aa, Entamoeba invadens
FLSYVLSQNNVPMCTSVN

SEQ ID NO: 2817391 - protein, 17 aa, Entamoeba invadens
FLTLQKNRTVVLGFYFF

SEQ ID NO: 2817392 - protein, 19 aa, Entamoeba invadens
FLTPLCSCFIKEKVQLRIF

SEQ ID NO: 2817393 - protein, 19 aa, Entamoeba invadens
FLTTPQRKMAFRLLTITVA

SEQ ID NO: 2817394 - protein, 27 aa, Entamoeba invadens
FLVDVATEFGFLFFTSKMKNKFNRNKI

SEQ ID NO: 2817395 - protein, 18 aa, Entamoeba invadens
FLVDVFPATVVTLRKGRA

SEQ ID NO: 2817396 - protein, 34 aa, Entamoeba invadens
FLVEVVGSYLIFYFVVCIWVFVAHHKLTKDIKQE

SEQ ID NO: 2817397 - protein, 17 aa, Entamoeba invadens
FLVFDNFVTILSDVPRK

SEQ ID NO: 2817398 - protein, 21 aa, Entamoeba invadens
FLVILGMFLESFSFNFLGLAG

SEQ ID NO: 2817399 - protein, 25 aa, Entamoeba invadens
FLVITFSILVIMGSLIYGMILGAIT

SEQ ID NO: 2817400 - protein, 19 aa, Entamoeba invadens
FLVKMTDHFLYSGHLCIVQ

SEQ ID NO: 2817401 - protein, 18 aa, Entamoeba invadens
FLVSLIGFYLIRVRHMSN

SEQ ID NO: 2817402 - protein, 17 aa, Entamoeba invadens
FLVVDKKVLQFALTNDN

SEQ ID NO: 2817403 - protein, 20 aa, Entamoeba invadens
FLVVVLAEDLMLFEDGTLYE

SEQ ID NO: 2817404 - protein, 19 aa, Entamoeba invadens
FLVVYSITDRVLFDELDHF

SEQ ID NO: 2817405 - protein, 19 aa, Entamoeba invadens
FLYDHIYIGFWLKYRFQMA

SEQ ID NO: 2817406 - protein, 18 aa, Entamoeba invadens
FLYTRGFLDFLFDNRVID

SEQ ID NO: 2817407 - protein, 30 aa, Entamoeba invadens
FMENFVGGFPLLFRVLFHLIKDNYLVEYVN

SEQ ID NO: 2817408 - protein, 26 aa, Entamoeba invadens
FMFILIPSLLLTLTTSRWCIVGNKIQ

SEQ ID NO: 2817409 - protein, 20 aa, Entamoeba invadens
FMFSEGAFEVFAFLALFIAF

SEQ ID NO: 2817410 - protein, 18 aa, Entamoeba invadens
FMFVSLHQPTLFVFILPI

SEQ ID NO: 2817411 - protein, 20 aa, Entamoeba invadens
FMGRLRVKMFDSILSQEIGF

SEQ ID NO: 2817412 - protein, 25 aa, Entamoeba invadens
FMKTNDCQLFYITKLNIIKCLTCPP

SEQ ID NO: 2817413 - protein, 20 aa, Entamoeba invadens
FMLDVAMGIMYLHENGILHR

SEQ ID NO: 2817414 - protein, 18 aa, Entamoeba invadens
FMMAFLMEIPITLFLRYL

SEQ ID NO: 2817415 - protein, 17 aa, Entamoeba invadens
FMMYLTVLVLVFNPYVI

SEQ ID NO: 2817416 - protein, 24 aa, Entamoeba invadens
FMNRMISFNFGTAIRLLVKTSSTD

SEQ ID NO: 2817417 - protein, 31 aa, Entamoeba invadens
FMTLSIQGFFCFPMVDYIFFGETSKISTQWK

SEQ ID NO: 2817418 - protein, 17 aa, Entamoeba invadens
FMVAFFVLGYNFINLNT

SEQ ID NO: 2817419 - protein, 17 aa, Entamoeba invadens
FMYEILVEFLYPRGVMK

SEQ ID NO: 2817420 - protein, 18 aa, Entamoeba invadens
FMYFSFDNDHFTGVTVRS

SEQ ID NO: 2817421 - protein, 20 aa, Entamoeba invadens
FMYSFSYVLFWIPIQTSISR

SEQ ID NO: 2817422 - protein, 24 aa, Entamoeba invadens
FNCDQRIFVFGKTKITTLNIKQGC

SEQ ID NO: 2817423 - protein, 30 aa, Entamoeba invadens
FNCQKDNYFLYYIYLIAVVYSIYIIAFFIL

SEQ ID NO: 2817424 - protein, 20 aa, Entamoeba invadens
FNCYSIKTLNLPDSLKMIGS

SEQ ID NO: 2817425 - protein, 18 aa, Entamoeba invadens
FNEDKSVHMFLKGAPEAV

SEQ ID NO: 2817426 - protein, 20 aa, Entamoeba invadens
FNEFVYDIYFNEFTPDFLEH

SEQ ID NO: 2817427 - protein, 17 aa, Entamoeba invadens
FNEILRNIKFIKYNRWE

SEQ ID NO: 2817428 - protein, 25 aa, Entamoeba invadens
FNEKMPLKFLPLFRVEHVRVCAIPK

SEQ ID NO: 2817429 - protein, 25 aa, Entamoeba invadens
FNEKTPTFALLYPALNVAINQCVSK

SEQ ID NO: 2817430 - protein, 17 aa, Entamoeba invadens
FNELKVCLECEKGYYLN

SEQ ID NO: 2817431 - protein, 28 aa, Entamoeba invadens
FNELVSFTPPFDPLTFTENFRTSGPVSA

SEQ ID NO: 2817432 - protein, 23 aa, Entamoeba invadens
FNESVWFLTIEVIVGFYGVFDKD

SEQ ID NO: 2817433 - protein, 17 aa, Entamoeba invadens
FNFAFPQEKFEYPWKIA

SEQ ID NO: 2817434 - protein, 17 aa, Entamoeba invadens
FNFAMFIKSIEDEVLAF

SEQ ID NO: 2817435 - protein, 26 aa, Entamoeba invadens
FNFGAFLFWIVVPLIATRQGASNLDL

SEQ ID NO: 2817436 - protein, 27 aa, Entamoeba invadens
FNGKLWPPGFMSFFTMAPFISANFQVH

SEQ ID NO: 2817437 - protein, 27 aa, Entamoeba invadens
FNGLILPAILYIFWQIVYLIITEGFKK

SEQ ID NO: 2817438 - protein, 19 aa, Entamoeba invadens
FNGQEFGMLYDVVGYIKSG

SEQ ID NO: 2817439 - protein, 24 aa, Entamoeba invadens
FNGTIFKFTFGTFIAYPNMTNSVN

SEQ ID NO: 2817440 - protein, 17 aa, Entamoeba invadens
FNGYLYNSTMCVKCNEI

SEQ ID NO: 2817441 - protein, 21 aa, Entamoeba invadens
FNIFAYCFIGDVVGILLSEEA

SEQ ID NO: 2817442 - protein, 34 aa, Entamoeba invadens
FNIHYEIIVFVLLTVLFFFIRTYSFTKLKVTFEE

SEQ ID NO: 2817443 - protein, 32 aa, Entamoeba invadens
FNISVIVFFYIFFLLYVLIIFEFYKNGKGTKK

SEQ ID NO: 2817444 - protein, 19 aa, Entamoeba invadens
FNKARILMFDANKTPLIVQ

SEQ ID NO: 2817445 - protein, 17 aa, Entamoeba invadens
FNKITIPTTNTLVINKL

SEQ ID NO: 2817446 - protein, 26 aa, Entamoeba invadens
FNKMFFSSYSFLDYYIRKSSVFFLVY

SEQ ID NO: 2817447 - protein, 26 aa, Entamoeba invadens
FNMKRSNILMIPLCDSLCTNKEILKF

SEQ ID NO: 2817448 - protein, 17 aa, Entamoeba invadens
FNMKRSNIPMFSLCDSL

SEQ ID NO: 2817449 - protein, 18 aa, Entamoeba invadens
FNMLITNMTFTKGIGTPK

SEQ ID NO: 2817450 - protein, 18 aa, Entamoeba invadens
FNMLSFLHISSLISWIHL

SEQ ID NO: 2817451 - protein, 43 aa, Entamoeba invadens
FNMRGVNVVLVPRKWRKTKDKVLLGFLYVGLLCTGVLATMYVV

SEQ ID NO: 2817452 - protein, 26 aa, Entamoeba invadens
FNNKKYFILLLLYNTLMSSFVVFINS

SEQ ID NO: 2817453 - protein, 23 aa, Entamoeba invadens
FNNNQCEYSYYYCNTIISNCVGC

SEQ ID NO: 2817454 - protein, 24 aa, Entamoeba invadens
FNNTIYFSRFLGIVNSNPVYSKID

SEQ ID NO: 2817455 - protein, 25 aa, Entamoeba invadens
FNNVKNSIFIYKNSTFFKTNETRIS

SEQ ID NO: 2817456 - protein, 19 aa, Entamoeba invadens
FNNVTHLCDGCELGMIYTT

SEQ ID NO: 2817457 - protein, 20 aa, Entamoeba invadens
FNQNIKLFIGEKYGFSCTNN

SEQ ID NO: 2817458 - protein, 19 aa, Entamoeba invadens
FNQPWMIPQFVIEGNRLDK

SEQ ID NO: 2817459 - protein, 28 aa, Entamoeba invadens
FNSFSIVLLVLFFLLNKELLPELQNEEL

SEQ ID NO: 2817460 - protein, 17 aa, Entamoeba invadens
FNSLHVVKPISFGPNIK

SEQ ID NO: 2817461 - protein, 18 aa, Entamoeba invadens
FNSWGIIGIMIIFAIAVL

SEQ ID NO: 2817462 - protein, 19 aa, Entamoeba invadens
FNTLKKLFILIPEMDYKQY

SEQ ID NO: 2817463 - protein, 20 aa, Entamoeba invadens
FNTLLAYILFLIAAALCLLH

SEQ ID NO: 2817464 - protein, 17 aa, Entamoeba invadens
FNTMYSYSSRRVCGETI

SEQ ID NO: 2817465 - protein, 35 aa, Entamoeba invadens
FNTNGILRMMDQTNLWTTFLSLKNSSELFISGQSI

SEQ ID NO: 2817466 - protein, 18 aa, Entamoeba invadens
FNTVNFQNNTFFLMSNSE

SEQ ID NO: 2817467 - protein, 25 aa, Entamoeba invadens
FNVAVTLIILLLSSLVRSNTSKCSS

SEQ ID NO: 2817468 - protein, 33 aa, Entamoeba invadens
FNVDQFKPICSFLNFIIPLIPQNVSLSFFVWYL

SEQ ID NO: 2817469 - protein, 19 aa, Entamoeba invadens
FNVLFISKKIQIDGVVFTL

SEQ ID NO: 2817470 - protein, 20 aa, Entamoeba invadens
FNVSCVIYTILIVQLVHKLQ

SEQ ID NO: 2817471 - protein, 30 aa, Entamoeba invadens
FNYITYFIQMLFFVLFITLSFAEETLKTSK

SEQ ID NO: 2817472 - protein, 23 aa, Entamoeba invadens
FPEHVVPICFNWPSGKHSFSKHK

SEQ ID NO: 2817473 - protein, 25 aa, Entamoeba invadens
FPEKLIPKFITLLDRGMNCSIHGNG

SEQ ID NO: 2817474 - protein, 25 aa, Entamoeba invadens
FPENTKIRICNLLGMYLNATETNLR

SEQ ID NO: 2817475 - protein, 17 aa, Entamoeba invadens
FPFQLPTWKLTFFYCWE

SEQ ID NO: 2817476 - protein, 19 aa, Entamoeba invadens
FPGQVAYYFSILQLKIING

SEQ ID NO: 2817477 - protein, 19 aa, Entamoeba invadens
FPIAYWSEFYSIAPAIAVA

SEQ ID NO: 2817478 - protein, 28 aa, Entamoeba invadens
FPIEDVVLYFITYLKNMKPKLFKKEDIE

SEQ ID NO: 2817479 - protein, 19 aa, Entamoeba invadens
FPISFNCWCPSCACGRKCK

SEQ ID NO: 2817480 - protein, 31 aa, Entamoeba invadens
FPKNRIIFLVSVIFPFVGYYGLFALTTNNRR

SEQ ID NO: 2817481 - protein, 30 aa, Entamoeba invadens
FPLCYSAFPYTASLRSFFAYFKHNNMITKS

SEQ ID NO: 2817482 - protein, 20 aa, Entamoeba invadens
FPLIPYIPFFLSKNRTKLFQ

SEQ ID NO: 2817483 - protein, 26 aa, Entamoeba invadens
FPLNQYLPFFILMLSGMVCALLIFVT

SEQ ID NO: 2817484 - protein, 19 aa, Entamoeba invadens
FPMKIPIFEFCGKKELFDS

SEQ ID NO: 2817485 - protein, 22 aa, Entamoeba invadens
FPMTTINNLYLSNVLFGQIPKP

SEQ ID NO: 2817486 - protein, 18 aa, Entamoeba invadens
FPNAKKLVLLLPGEENKD

SEQ ID NO: 2817487 - protein, 18 aa, Entamoeba invadens
FPNFKQYIDMSFDKRMKE

SEQ ID NO: 2817488 - protein, 22 aa, Entamoeba invadens
FPNPVNILTYKQPSTTTPKLIS

SEQ ID NO: 2817489 - protein, 25 aa, Entamoeba invadens
FPQHIVPFVFNWPSSQNAACYYCAA

SEQ ID NO: 2817490 - protein, 24 aa, Entamoeba invadens
FPQNILYRYISCPNLLFEALFFTA

SEQ ID NO: 2817491 - protein, 31 aa, Entamoeba invadens
FPRLCLTAFLFNFASYFYWLVVPLMCVDQGG

SEQ ID NO: 2817492 - protein, 17 aa, Entamoeba invadens
FPRWLFVGDITGPARTA

SEQ ID NO: 2817493 - protein, 24 aa, Entamoeba invadens
FPSAQWVLYVLFGMIMKEISVLSD

SEQ ID NO: 2817494 - protein, 24 aa, Entamoeba invadens
FPSSKFYYFIVVAIIKEYADDIID

SEQ ID NO: 2817495 - protein, 33 aa, Entamoeba invadens
FPTYRYYIFCITFLFCLLLLVVFYPYFLLHVFG

SEQ ID NO: 2817496 - protein, 17 aa, Entamoeba invadens
FPVVAWVATYLMYRYRV

SEQ ID NO: 2817497 - protein, 19 aa, Entamoeba invadens
FPVYPLLFNTVRSVFLKSS

SEQ ID NO: 2817498 - protein, 25 aa, Entamoeba invadens
FQADGCFDLFGYIYSYELDETETSK

SEQ ID NO: 2817499 - protein, 19 aa, Entamoeba invadens
FQCGTNCKLLMNKFSIIKA

SEQ ID NO: 2817500 - protein, 18 aa, Entamoeba invadens
FQCILCNTGYFVQDGVCY

SEQ ID NO: 2817501 - protein, 32 aa, Entamoeba invadens
FQEESHFWARYFKLLFVLSKREKDFQKFIHTR

SEQ ID NO: 2817502 - protein, 19 aa, Entamoeba invadens
FQFFVGTIFIFSSGSMLCV

SEQ ID NO: 2817503 - protein, 17 aa, Entamoeba invadens
FQFPWKVAEFVSGGRRL

SEQ ID NO: 2817504 - protein, 32 aa, Entamoeba invadens
FQGCTKLKYLINSKYITIILSYAFDGCVNLHD

SEQ ID NO: 2817505 - protein, 33 aa, Entamoeba invadens
FQIRCVSPVMQIVRPLGVIRLWGAQIVNRDISQ

SEQ ID NO: 2817506 - protein, 23 aa, Entamoeba invadens
FQIVVRMHFLLFVLFEDFTEFVN

SEQ ID NO: 2817507 - protein, 19 aa, Entamoeba invadens
FQKDGFLFGIQHEGRCLIA

SEQ ID NO: 2817508 - protein, 17 aa, Entamoeba invadens
FQKNYQQILLTRPTRKT

SEQ ID NO: 2817509 - protein, 40 aa, Entamoeba invadens
FQKSSHRILFIFLIKMFFEDRFLIFYKNKTNRINFKKYFP

SEQ ID NO: 2817510 - protein, 36 aa, Entamoeba invadens
FQLDVLRTMLRRILRMFLYFHPHGYFQGLNDIVSIA

SEQ ID NO: 2817511 - protein, 25 aa, Entamoeba invadens
FQLFYSSFSFFCEKGNYLGADNECH

SEQ ID NO: 2817512 - protein, 25 aa, Entamoeba invadens
FQMKKSNIHFFKINEWLVSNRKVLE

SEQ ID NO: 2817513 - protein, 24 aa, Entamoeba invadens
FQMSFCVIFTVLVLFFVVVCVVVG

SEQ ID NO: 2817514 - protein, 36 aa, Entamoeba invadens
FQNIEPLLESFLFPGKFLYDNILPPKTSFDQLNEEL

SEQ ID NO: 2817515 - protein, 23 aa, Entamoeba invadens
FQNNKCLLCSPYCTTNKCDTVQG

SEQ ID NO: 2817516 - protein, 17 aa, Entamoeba invadens
FQWSIEGSFISLGEDDI

SEQ ID NO: 2817517 - protein, 17 aa, Entamoeba invadens
FRAIFRQEWMQFVLIYF

SEQ ID NO: 2817518 - protein, 32 aa, Entamoeba invadens
FRAIKKRNFDVVKMLLLLGADPFVNCKKWTPY

SEQ ID NO: 2817519 - protein, 37 aa, Entamoeba invadens
FRAWELVHLYFTGFFRALFYMVTIDVGPMMAILMFVA

SEQ ID NO: 2817520 - protein, 23 aa, Entamoeba invadens
FRCDQIIHFFGSVRMPKIIGMVI

SEQ ID NO: 2817521 - protein, 17 aa, Entamoeba invadens
FRCDYIIHFYGACVIKS

SEQ ID NO: 2817522 - protein, 26 aa, Entamoeba invadens
FRCDYIVHFYGAVFFPNKICMVTEFA

SEQ ID NO: 2817523 - protein, 19 aa, Entamoeba invadens
FRCDYIVHFYGAVFIPTKI

SEQ ID NO: 2817524 - protein, 17 aa, Entamoeba invadens
FRCEATTACWFTSQYLV

SEQ ID NO: 2817525 - protein, 19 aa, Entamoeba invadens
FRCEYIVHFYGAVFIPSKF

SEQ ID NO: 2817526 - protein, 23 aa, Entamoeba invadens
FRCEYIVHFYGAVFIPSKVCMVT

SEQ ID NO: 2817527 - protein, 18 aa, Entamoeba invadens
FRCEYIVHFYGAVFIPTK

SEQ ID NO: 2817528 - protein, 26 aa, Entamoeba invadens
FRCEYIVHFYGAVLIPSKMCLVTEFA

SEQ ID NO: 2817529 - protein, 24 aa, Entamoeba invadens
FRCKYLLLLMTFLLAMTAFVLYYQ

SEQ ID NO: 2817530 - protein, 25 aa, Entamoeba invadens
FRDYNRLRFRIFDNAIFEMEQNTEL

SEQ ID NO: 2817531 - protein, 37 aa, Entamoeba invadens
FRFEFSIIVLALYQIIAILVLILLAVYQPFLELEVAN

SEQ ID NO: 2817532 - protein, 18 aa, Entamoeba invadens
FRFVAFSVAMESCNMMLL

SEQ ID NO: 2817533 - protein, 17 aa, Entamoeba invadens
FRGLTVYQIFVSTFSDG

SEQ ID NO: 2817534 - protein, 18 aa, Entamoeba invadens
FRKEVFQLINRKLQKKGS

SEQ ID NO: 2817535 - protein, 38 aa, Entamoeba invadens
FRKSTFPFLICCILFWGINIVFIVYFAKKRNSTKYLIN

SEQ ID NO: 2817536 - protein, 25 aa, Entamoeba invadens
FRNLIIVYLITFMSIDYSMLVDLTF

SEQ ID NO: 2817537 - protein, 28 aa, Entamoeba invadens
FRPHFYALVMPIVKVLDFLLFTRIKDEI

SEQ ID NO: 2817538 - protein, 33 aa, Entamoeba invadens
FRQEWMQFVLIYFTTAIYELFALAFPLMSSFII

SEQ ID NO: 2817539 - protein, 29 aa, Entamoeba invadens
FRRWHQKVPFFWTYKPYYEPRTLRMPMSD

SEQ ID NO: 2817540 - protein, 20 aa, Entamoeba invadens
FRSCMNFIVWAIPPAVSFAT

SEQ ID NO: 2817541 - protein, 26 aa, Entamoeba invadens
FRSCMNFIVWAIPPTVSFVTYLILII

SEQ ID NO: 2817542 - protein, 17 aa, Entamoeba invadens
FRSEYIVHFYGAVFIEN

SEQ ID NO: 2817543 - protein, 25 aa, Entamoeba invadens
FRSEYIVHFYGAVFVALKKCMVTEF

SEQ ID NO: 2817544 - protein, 24 aa, Entamoeba invadens
FRSEYIVHFYGAVFVPSKTCMVTE

SEQ ID NO: 2817545 - protein, 28 aa, Entamoeba invadens
FRSLSSGNIFWVKAPQNKGNKLVIYEFN

SEQ ID NO: 2817546 - protein, 23 aa, Entamoeba invadens
FRVEWKHLLLCYGCLLFSQITTL

SEQ ID NO: 2817547 - protein, 32 aa, Entamoeba invadens
FSDCGHGFFIFLFGLSFIIFAKKLQGKAMNDI

SEQ ID NO: 2817548 - protein, 28 aa, Entamoeba invadens
FSEFKNIYFQINVFSFVAKLFSIFLTNS

SEQ ID NO: 2817549 - protein, 27 aa, Entamoeba invadens
FSESSLKFIFYGITQQKYQISFSPSRG

SEQ ID NO: 2817550 - protein, 25 aa, Entamoeba invadens
FSETVALVYKIIGGVGMLALVIVAI

SEQ ID NO: 2817551 - protein, 26 aa, Entamoeba invadens
FSEVVKHFLLCPKLLAAIVTPDFVVP

SEQ ID NO: 2817552 - protein, 40 aa, Entamoeba invadens
FSFAISMYEVFIWKDPFPKDKFIFPWSIADFISAGKRFER

SEQ ID NO: 2817553 - protein, 27 aa, Entamoeba invadens
FSFAITMYETFTWKEPYPKSEFKFAWC

SEQ ID NO: 2817554 - protein, 25 aa, Entamoeba invadens
FSFDLTHNFVFPTTITKIRNHNIWY

SEQ ID NO: 2817555 - protein, 53 aa, Entamoeba invadens
FSFEVFGPAIWILTTAILFSIFTIIVPFLLPELIILFCVMMTMTIVLWVAVIV

SEQ ID NO: 2817556 - protein, 20 aa, Entamoeba invadens
FSFGVTMYEVFGWTNAYPLD

SEQ ID NO: 2817557 - protein, 19 aa, Entamoeba invadens
FSFGVTMYEVFGWTNVYPL

SEQ ID NO: 2817558 - protein, 17 aa, Entamoeba invadens
FSFLSIDPNIVFDSFIK

SEQ ID NO: 2817559 - protein, 37 aa, Entamoeba invadens
FSFLSVFLVFFSFIPLYYRFFVFIVRFSEQEILTPNN

SEQ ID NO: 2817560 - protein, 25 aa, Entamoeba invadens
FSFLVGLFLLFITLPLTGIYSTKPI

SEQ ID NO: 2817561 - protein, 18 aa, Entamoeba invadens
FSFNFLGLAGWAFDILNF

SEQ ID NO: 2817562 - protein, 25 aa, Entamoeba invadens
FSFVAKLFSIFLTNSGIKRKHATVH

SEQ ID NO: 2817563 - protein, 21 aa, Entamoeba invadens
FSFVLCFTLPCIFQYLSRRKA

SEQ ID NO: 2817564 - protein, 17 aa, Entamoeba invadens
FSFWISVTVYFYDGLLL

SEQ ID NO: 2817565 - protein, 18 aa, Entamoeba invadens
FSGECDVGYFPFDNYCWS

SEQ ID NO: 2817566 - protein, 22 aa, Entamoeba invadens
FSGHFLIIFLEQVVIQNRSVVF

SEQ ID NO: 2817567 - protein, 19 aa, Entamoeba invadens
FSGNFVIFADFISAKTLSN

SEQ ID NO: 2817568 - protein, 21 aa, Entamoeba invadens
FSHEYIMCTLGLIGGIGGGAI

SEQ ID NO: 2817569 - protein, 28 aa, Entamoeba invadens
FSIAPLQYFQLVHILKFRMGFISSIRTQ

SEQ ID NO: 2817570 - protein, 17 aa, Entamoeba invadens
FSIIFLINIFVPGKSPR

SEQ ID NO: 2817571 - protein, 18 aa, Entamoeba invadens
FSIRVFSLTCRLIDCLKI

SEQ ID NO: 2817572 - protein, 35 aa, Entamoeba invadens
FSIYNHIPFFIVIAPLLVFILSLFIATDDFPHMYY

SEQ ID NO: 2817573 - protein, 17 aa, Entamoeba invadens
FSKIFYSLLIQFDPNIP

SEQ ID NO: 2817574 - protein, 26 aa, Entamoeba invadens
FSKKRSWFHLLPIVLFMTLLLFCLFC

SEQ ID NO: 2817575 - protein, 25 aa, Entamoeba invadens
FSKNKYLMIIFHTPNSPKYVFYFDP

SEQ ID NO: 2817576 - protein, 25 aa, Entamoeba invadens
FSKNKYMMIIFHVPQSPKYTFYFDP

SEQ ID NO: 2817577 - protein, 21 aa, Entamoeba invadens
FSKQFLVLRQINFTDENFIFD

SEQ ID NO: 2817578 - protein, 25 aa, Entamoeba invadens
FSKSNACFKCLIGYSLQGITCEYKE

SEQ ID NO: 2817579 - protein, 24 aa, Entamoeba invadens
FSKTKIIPLQCQTNYIFETTSNQC

SEQ ID NO: 2817580 - protein, 20 aa, Entamoeba invadens
FSLFLVIVALAIVGGSAFAG

SEQ ID NO: 2817581 - protein, 17 aa, Entamoeba invadens
FSLFSVATKSFDNCQPG

SEQ ID NO: 2817582 - protein, 19 aa, Entamoeba invadens
FSLICYFNCIRYPFMNFGY

SEQ ID NO: 2817583 - protein, 17 aa, Entamoeba invadens
FSMFFYNPLPIKNTKIF

SEQ ID NO: 2817584 - protein, 19 aa, Entamoeba invadens
FSMKCSNLFYGCYSCDYKQ

SEQ ID NO: 2817585 - protein, 34 aa, Entamoeba invadens
FSMKLIFQIMMLVIGLFLLIFVSGLIPYAIDSYS

SEQ ID NO: 2817586 - protein, 39 aa, Entamoeba invadens
FSMMCSGVISLICFFSAFFFDQVLLYAVSVLSCLTFCVF

SEQ ID NO: 2817587 - protein, 31 aa, Entamoeba invadens
FSMSEAFPIEQFPFPWKIAEFVTAGNRLKKT

SEQ ID NO: 2817588 - protein, 19 aa, Entamoeba invadens
FSNFYILNFLTQIGNTMTI

SEQ ID NO: 2817589 - protein, 26 aa, Entamoeba invadens
FSNIDQRYWIVYRRQSNMPYSPYFFI

SEQ ID NO: 2817590 - protein, 21 aa, Entamoeba invadens
FSNLLYKMWKPTREPTVISMS

SEQ ID NO: 2817591 - protein, 49 aa, Entamoeba invadens
FSNTNYGLVIVLPVVIVFLSILGIVMVVIIILVILRKHQEVSKMRNICV

SEQ ID NO: 2817592 - protein, 19 aa, Entamoeba invadens
FSPIELFKVARTTLLKEVC

SEQ ID NO: 2817593 - protein, 17 aa, Entamoeba invadens
FSPLLPILIAIYPQAFP

SEQ ID NO: 2817594 - protein, 25 aa, Entamoeba invadens
FSPNNFEIEWLAKRIGYKGGECDGG

SEQ ID NO: 2817595 - protein, 24 aa, Entamoeba invadens
FSPVILTLLWLIVAFFHVVGVFCK

SEQ ID NO: 2817596 - protein, 25 aa, Entamoeba invadens
FSQGDLKLYLLVGGKLRDMTVLRRI

SEQ ID NO: 2817597 - protein, 23 aa, Entamoeba invadens
FSQKYTFYFNDVKFIKNPVAVED

SEQ ID NO: 2817598 - protein, 17 aa, Entamoeba invadens
FSQYLKDYLEFIQATQN

SEQ ID NO: 2817599 - protein, 26 aa, Entamoeba invadens
FSRLVYICDFFLISFTLFYWAHDFTN

SEQ ID NO: 2817600 - protein, 19 aa, Entamoeba invadens
FSRVTPFWLSLAKEVMMTN

SEQ ID NO: 2817601 - protein, 24 aa, Entamoeba invadens
FSSGSFLLYIYDSASIGYQFTTKI

SEQ ID NO: 2817602 - protein, 24 aa, Entamoeba invadens
FSSNYEYYVLLLLKDGVGGQYKLN

SEQ ID NO: 2817603 - protein, 24 aa, Entamoeba invadens
FSTIGYLMLINYYLDYASADTLMV

SEQ ID NO: 2817604 - protein, 19 aa, Entamoeba invadens
FSTVFRGISAGIILGGGID

SEQ ID NO: 2817605 - protein, 19 aa, Entamoeba invadens
FSTWYMKCLEWIGGNLPIV

SEQ ID NO: 2817606 - protein, 26 aa, Entamoeba invadens
FSVDFDTICSLPIDKPSRDLLCVGNN

SEQ ID NO: 2817607 - protein, 19 aa, Entamoeba invadens
FSVFLLIAASLAAYPVDLQ

SEQ ID NO: 2817608 - protein, 17 aa, Entamoeba invadens
FSVGLFGVYFSFLTGFL

SEQ ID NO: 2817609 - protein, 24 aa, Entamoeba invadens
FSVMKGCDYYTIRTEPALVNLKSG

SEQ ID NO: 2817610 - protein, 33 aa, Entamoeba invadens
FSVTPFPGINFVQWMFCLFLSAMSLVVGQFAIR

SEQ ID NO: 2817611 - protein, 23 aa, Entamoeba invadens
FSVVACEIGYYTFNGTCHKCSDK

SEQ ID NO: 2817612 - protein, 25 aa, Entamoeba invadens
FSWKDAYPITTFKFPWKIAEFVSSG

SEQ ID NO: 2817613 - protein, 23 aa, Entamoeba invadens
FSWKEAYLIKDFKFPWKIAEFVT

SEQ ID NO: 2817614 - protein, 29 aa, Entamoeba invadens
FSWTKAYADHKFVYPWQVADFVVGGQRLQ

SEQ ID NO: 2817615 - protein, 36 aa, Entamoeba invadens
FSYGITLYEVMNWGGLYPLDQFPFPWSVAEFVNQGK

SEQ ID NO: 2817616 - protein, 25 aa, Entamoeba invadens
FSYLMCILICFFTSFFGCCCIGLIF

SEQ ID NO: 2817617 - protein, 17 aa, Entamoeba invadens
FTAAYLFDSIKNSQIIV

SEQ ID NO: 2817618 - protein, 25 aa, Entamoeba invadens
FTALCEWEMFGFGLVVNAIQPLEKY

SEQ ID NO: 2817619 - protein, 24 aa, Entamoeba invadens
FTCEKCVKGYYLDIDKCKQCDSKC

SEQ ID NO: 2817620 - protein, 24 aa, Entamoeba invadens
FTCEPLGDLFTKCALTLPTGGGCA

SEQ ID NO: 2817621 - protein, 26 aa, Entamoeba invadens
FTCEPLGDLFTKCDLTLPTGGGCAIC

SEQ ID NO: 2817622 - protein, 27 aa, Entamoeba invadens
FTCEPLGDLFTKCDLTLPTGGGCAICK

SEQ ID NO: 2817623 - protein, 26 aa, Entamoeba invadens
FTCEPLGDLFTKCDLTLPTGGGCAVC

SEQ ID NO: 2817624 - protein, 26 aa, Entamoeba invadens
FTCEPLGDLFTKCELTLPTGGGCAIC

SEQ ID NO: 2817625 - protein, 21 aa, Entamoeba invadens
FTCNSMYFLDNGKCFRCNSAI

SEQ ID NO: 2817626 - protein, 17 aa, Entamoeba invadens
FTCSSGCQSTCIANYTC

SEQ ID NO: 2817627 - protein, 31 aa, Entamoeba invadens; identical to SEQ ID NO: 2791287

SEQ ID NO: 2817628 - protein, 38 aa, Entamoeba invadens
FTDNNYGLIVGIPIMCVVVMVVVIIATVIIVVLIVFKK

SEQ ID NO: 2817629 - protein, 30 aa, Entamoeba invadens
FTDTQQRMIFLWMVWLVMNQHTTVFGFNAS

SEQ ID NO: 2817630 - protein, 23 aa, Entamoeba invadens
FTDYRNFLFCYPTELCLGKERKR

SEQ ID NO: 2817631 - protein, 29 aa, Entamoeba invadens
FTEFRRYMRLYPRMSLLVNTFYAIFDDTV

SEQ ID NO: 2817632 - protein, 19 aa, Entamoeba invadens
FTEHGIIVFMLALIAHVVC

SEQ ID NO: 2817633 - protein, 31 aa, Entamoeba invadens
FTEVKRLLLIYNTPLFITFDKSTIRPMHRCD

SEQ ID NO: 2817634 - protein, 25 aa, Entamoeba invadens
FTEWDCTNTYYLNKKIFKCTNTNVA

SEQ ID NO: 2817635 - protein, 17 aa, Entamoeba invadens
FTFIPFDTIPLVTLLLS

SEQ ID NO: 2817636 - protein, 18 aa, Entamoeba invadens
FTFNIKQYNMILSIIIVI

SEQ ID NO: 2817637 - protein, 18 aa, Entamoeba invadens
FTFPLLTTHLIYSPKNDF

SEQ ID NO: 2817638 - protein, 21 aa, Entamoeba invadens
FTFVPAFSIAFVGNYMKHNYV

SEQ ID NO: 2817639 - protein, 20 aa, Entamoeba invadens
FTGDLFIETALFSLYDSSVI

SEQ ID NO: 2817640 - protein, 23 aa, Entamoeba invadens
FTGNYELFKLYKPPNEVKDIVWM

SEQ ID NO: 2817641 - protein, 28 aa, Entamoeba invadens
FTGRVVSVPFLLTLSYKDLTVKNIEKVI

SEQ ID NO: 2817642 - protein, 19 aa, Entamoeba invadens
FTHFNFPSLKAIHVSLRKS

SEQ ID NO: 2817643 - protein, 21 aa, Entamoeba invadens
FTIENAYMWLSQQPLVDHPCH

SEQ ID NO: 2817644 - protein, 18 aa, Entamoeba invadens
FTIFTAFSNDCNPPVENC

SEQ ID NO: 2817645 - protein, 17 aa, Entamoeba invadens
FTIGVLGALGGGLVMQF

SEQ ID NO: 2817646 - protein, 17 aa, Entamoeba invadens
FTILYFGFYYTNFPNSW

SEQ ID NO: 2817647 - protein, 18 aa, Entamoeba invadens
FTIRKYLLLTPSGYGEML

SEQ ID NO: 2817648 - protein, 28 aa, Entamoeba invadens
FTITIISLLILPLTFFKNLSALRFSSFL

SEQ ID NO: 2817649 - protein, 20 aa, Entamoeba invadens
FTIVVVLSFIPFICIFTYKT

SEQ ID NO: 2817650 - protein, 19 aa, Entamoeba invadens
FTKDLFLTHAYKALEMFAK

SEQ ID NO: 2817651 - protein, 19 aa, Entamoeba invadens
FTKGFYRQASAHAALGQLP

SEQ ID NO: 2817652 - protein, 23 aa, Entamoeba invadens
FTKPGYWQFIKESVYFTLGLLNS

SEQ ID NO: 2817653 - protein, 24 aa, Entamoeba invadens
FTKPLGLRTAPFPSSVPAGSDKGY

SEQ ID NO: 2817654 - protein, 18 aa, Entamoeba invadens
FTKVFKKIPNKEIQKRFQ

SEQ ID NO: 2817655 - protein, 24 aa, Entamoeba invadens
FTLAYFEAMLVYKVNYDQADAFSW

SEQ ID NO: 2817656 - protein, 26 aa, Entamoeba invadens
FTLKSSALFVLLKKAIFTAGTTTLQS

SEQ ID NO: 2817657 - protein, 18 aa, Entamoeba invadens
FTLLTMIFVRIVPFLHIF

SEQ ID NO: 2817658 - protein, 17 aa, Entamoeba invadens
FTLPHCPCKDCQLFLQE

SEQ ID NO: 2817659 - protein, 20 aa, Entamoeba invadens
FTLRVSPELISLKKGFACEF

SEQ ID NO: 2817660 - protein, 19 aa, Entamoeba invadens
FTLVMKLINKLFVSINFQM

SEQ ID NO: 2817661 - protein, 18 aa, Entamoeba invadens
FTLYLLPVLCFCVMTGES

SEQ ID NO: 2817662 - protein, 19 aa, Entamoeba invadens
FTMLLLFFDSLVVVMYFSA

SEQ ID NO: 2817663 - protein, 25 aa, Entamoeba invadens
FTNKHFYTLFDKHLVRYCPDSFDRN

SEQ ID NO: 2817664 - protein, 20 aa, Entamoeba invadens
FTNLWFLVSLGLSVGSFVSC

SEQ ID NO: 2817665 - protein, 19 aa, Entamoeba invadens
FTNPVFVGVVYFVNVLMTE

SEQ ID NO: 2817666 - protein, 36 aa, Entamoeba invadens
FTNPYLESLILPSALMIIVFLIVVVVFIMCGCVHCC

SEQ ID NO: 2817667 - protein, 18 aa, Entamoeba invadens
FTQKNYFRYLEFENVLLF

SEQ ID NO: 2817668 - protein, 23 aa, Entamoeba invadens
FTQVLFICRTLYNKYSYTVRYID

SEQ ID NO: 2817669 - protein, 18 aa, Entamoeba invadens
FTRDGLVIFGKRITESLL

SEQ ID NO: 2817670 - protein, 17 aa, Entamoeba invadens
FTRKMRGKILYDAARGL

SEQ ID NO: 2817671 - protein, 49 aa, Entamoeba invadens
FTSCETKAVWWVLLLVVLCALFIVVVLMVSFVGITIWIVYAISQKHDEI

SEQ ID NO: 2817672 - protein, 18 aa, Entamoeba invadens
FTSGCTAALRLIGESYPF

SEQ ID NO: 2817673 - protein, 26 aa, Entamoeba invadens
FTSGFFWSVLFLIVSLFVNALFQALT

SEQ ID NO: 2817674 - protein, 29 aa, Entamoeba invadens
FTSLYGMAIKFFPFLKSLSFVVKDKWDNL

SEQ ID NO: 2817675 - protein, 19 aa, Entamoeba invadens
FTSQYLVNCIGAVTSNQVF

SEQ ID NO: 2817676 - protein, 23 aa, Entamoeba invadens
FTTDFFSMWYSSEKIFSNLPYYL

SEQ ID NO: 2817677 - protein, 19 aa, Entamoeba invadens
FTTLPFCVFCVASFPSFSV

SEQ ID NO: 2817678 - protein, 25 aa, Entamoeba invadens
FTTNVFVSMRFIFSPTLCLFIGGCL

SEQ ID NO: 2817679 - protein, 27 aa, Entamoeba invadens
FTTQHQLTLFLHFDYTVTIISPKDPHK

SEQ ID NO: 2817680 - protein, 25 aa, Entamoeba invadens
FTTVWVSFPEYSIFSFNMNKTIQID

SEQ ID NO: 2817681 - protein, 33 aa, Entamoeba invadens
FTVFSHIAYFGSLIFYFLWGMGYGIVAAIPKIT

SEQ ID NO: 2817682 - protein, 18 aa, Entamoeba invadens
FTVFTAFSDECKPPFDNC

SEQ ID NO: 2817683 - protein, 19 aa, Entamoeba invadens
FTVFTAFSIECKPPVKNCH

SEQ ID NO: 2817684 - protein, 20 aa, Entamoeba invadens
FTVFTAFSTSPNECEPDVVN

SEQ ID NO: 2817685 - protein, 29 aa, Entamoeba invadens
FTVHNLNIDKLILDFKWINTEFTQIDTTI

SEQ ID NO: 2817686 - protein, 20 aa, Entamoeba invadens
FTVKIIPTTNWIVDDFFVQE

SEQ ID NO: 2817687 - protein, 19 aa, Entamoeba invadens
FTVLILIELLNIGFTIRRW

SEQ ID NO: 2817688 - protein, 26 aa, Entamoeba invadens
FTVVSLIAFYLYQGLLSFPMQNLGQS

SEQ ID NO: 2817689 - protein, 19 aa, Entamoeba invadens
FTYRPKGAFPVLLSGELFV

SEQ ID NO: 2817690 - protein, 17 aa, Entamoeba invadens
FTYWFGYVFGFGSAVIT

SEQ ID NO: 2817691 - protein, 19 aa, Entamoeba invadens
FVADFLALFLCEMSIVFLC

SEQ ID NO: 2817692 - protein, 21 aa, Entamoeba invadens
FVAFTFFVLYSAQTIAFIVMS

SEQ ID NO: 2817693 - protein, 17 aa, Entamoeba invadens
FVAFYFMKFLPEALREN

SEQ ID NO: 2817694 - protein, 33 aa, Entamoeba invadens
FVAWNILTIVYFIYTWFYFNKAIYLTGAATLGE

SEQ ID NO: 2817695 - protein, 34 aa, Entamoeba invadens
FVAWNILTIVYFIYTWFYFNKAIYLTGAATLGEL

SEQ ID NO: 2817696 - protein, 18 aa, Entamoeba invadens
FVAYFFQVFLSLFTKTSP

SEQ ID NO: 2817697 - protein, 24 aa, Entamoeba invadens
FVAYPFDVLPSKSFGFSADEVLFE

SEQ ID NO: 2817698 - protein, 17 aa, Entamoeba invadens
FVAYSISKNVRWCFDLN

SEQ ID NO: 2817699 - protein, 19 aa, Entamoeba invadens
FVCSFGVMFLFTFAFSVYG

SEQ ID NO: 2817700 - protein, 19 aa, Entamoeba invadens
FVCTSGVTGVALVAFLGVL

SEQ ID NO: 2817701 - protein, 26 aa, Entamoeba invadens
FVDFFKLFHLFLLTLGLAFNFISTTE

SEQ ID NO: 2817702 - protein, 20 aa, Entamoeba invadens
FVDKIGRWDLLDFEEIVLFA

SEQ ID NO: 2817703 - protein, 17 aa, Entamoeba invadens
FVDLLLIGTLWLMCRKR

SEQ ID NO: 2817704 - protein, 18 aa, Entamoeba invadens
FVDYYYLVGKNQKSFGFI

SEQ ID NO: 2817705 - protein, 19 aa, Entamoeba invadens
FVECRYVWNIAEKAARGER

SEQ ID NO: 2817706 - protein, 26 aa, Entamoeba invadens
FVEKNVFVFIILSYFLIMAGVVYDMI

SEQ ID NO: 2817707 - protein, 18 aa, Entamoeba invadens
FVEYLLIDSKGKPPKQNI

SEQ ID NO: 2817708 - protein, 19 aa, Entamoeba invadens
FVFCTLSSPLSINIFDVGQ

SEQ ID NO: 2817709 - protein, 20 aa, Entamoeba invadens
FVFEHYIVVILGILTLLGTK

SEQ ID NO: 2817710 - protein, 19 aa, Entamoeba invadens
FVFHFDPQYLIIHSRNIKH

SEQ ID NO: 2817711 - protein, 25 aa, Entamoeba invadens
FVFHRYMYFILCIMKKPMNDANCTV

SEQ ID NO: 2817712 - protein, 27 aa, Entamoeba invadens
FVFLGDDFFFYRPTPPDYYFKGEKLVI

SEQ ID NO: 2817713 - protein, 17 aa, Entamoeba invadens
FVFLTITFFTDIVAALV

SEQ ID NO: 2817714 - protein, 19 aa, Entamoeba invadens
FVFVKIDVLDVKKVNTKQG

SEQ ID NO: 2817715 - protein, 26 aa, Entamoeba invadens
FVGGFFFGDYLLYPVISISSVLCVIL

SEQ ID NO: 2817716 - protein, 21 aa, Entamoeba invadens
FVGITTFYYKGTSALTTCTNL

SEQ ID NO: 2817717 - protein, 17 aa, Entamoeba invadens
FVGTWWHEAISVGNTVT

SEQ ID NO: 2817718 - protein, 18 aa, Entamoeba invadens
FVGTWWHEAISVGNTVTG

SEQ ID NO: 2817719 - protein, 28 aa, Entamoeba invadens
FVGVYLVLFWLVFLKRFAYSFVPAFLVF

SEQ ID NO: 2817720 - protein, 19 aa, Entamoeba invadens
FVGYISSEGVCTACNSAYN

SEQ ID NO: 2817721 - protein, 19 aa, Entamoeba invadens
FVGYLSSKGMCTPCYPDYK

SEQ ID NO: 2817722 - protein, 23 aa, Entamoeba invadens
FVHTGMNQLLYNSYKLPEDVLVA

SEQ ID NO: 2817723 - protein, 19 aa, Entamoeba invadens
FVHYLCRNGFITTSKIVCI

SEQ ID NO: 2817724 - protein, 24 aa, Entamoeba invadens
FVIGFGFFMLLFFVGGRAREDSVV

SEQ ID NO: 2817725 - protein, 18 aa, Entamoeba invadens
FVIKLMGLVFNNKDLFRC

SEQ ID NO: 2817726 - protein, 17 aa, Entamoeba invadens
FVINILSKFNKIEGITP

SEQ ID NO: 2817727 - protein, 27 aa, Entamoeba invadens
FVISFIVYFFMYFLASNKSPFATITEE

SEQ ID NO: 2817728 - protein, 25 aa, Entamoeba invadens
FVISSNEMVFVNYYGLIGGKDMKES

SEQ ID NO: 2817729 - protein, 19 aa, Entamoeba invadens
FVKCWDLSLVILSIAPFMI

SEQ ID NO: 2817730 - protein, 26 aa, Entamoeba invadens
FVKEYKLCFVMIAIAPLMAGAAGIFA

SEQ ID NO: 2817731 - protein, 24 aa, Entamoeba invadens
FVKGVDRMLFDTPMKFTKLTVGSS

SEQ ID NO: 2817732 - protein, 18 aa, Entamoeba invadens
FVKPYFTCVFEENILIIS

SEQ ID NO: 2817733 - protein, 28 aa, Entamoeba invadens
FVKQFGLILHELFIKITFTLDDLLGMNE

SEQ ID NO: 2817734 - protein, 18 aa, Entamoeba invadens
FVKYEIMCKPFTGTIKPK

SEQ ID NO: 2817735 - protein, 17 aa, Entamoeba invadens
FVLCTLSMEWCDVGGNI

SEQ ID NO: 2817736 - protein, 20 aa, Entamoeba invadens
FVLGFFCCCIWIVVYRKFKH

SEQ ID NO: 2817737 - protein, 20 aa, Entamoeba invadens
FVLKQFVMTSPSTFFTRAFN

SEQ ID NO: 2817738 - protein, 18 aa, Entamoeba invadens
FVLLITSTNSAVFTWSSG

SEQ ID NO: 2817739 - protein, 23 aa, Entamoeba invadens
FVLLVLGFLLYTKVIKIPCWFNY

SEQ ID NO: 2817740 - protein, 31 aa, Entamoeba invadens
FVLNSVLVFITYFFIIKLPKIDLSVLGWKSL

SEQ ID NO: 2817741 - protein, 18 aa, Entamoeba invadens
FVLRKYPDNYLKIDVDSF

SEQ ID NO: 2817742 - protein, 24 aa, Entamoeba invadens
FVMEFMKIFPITTLDYGKIITQIH

SEQ ID NO: 2817743 - protein, 24 aa, Entamoeba invadens
FVMNKSNIKFIPLQGGVCVSIDLI

SEQ ID NO: 2817744 - protein, 18 aa, Entamoeba invadens
FVNFIFSMAFLAPSTPML

SEQ ID NO: 2817745 - protein, 30 aa, Entamoeba invadens
FVNSNWFFALWYFILSCLTFFITGVLGLVV

SEQ ID NO: 2817746 - protein, 21 aa, Entamoeba invadens
FVNYYIIHFSIFTAVCFLFAL

SEQ ID NO: 2817747 - protein, 19 aa, Entamoeba invadens
FVPITFISSMFIGGSVGVL

SEQ ID NO: 2817748 - protein, 29 aa, Entamoeba invadens
FVPSFSDNLIINALIVDILELPTSYKSLV

SEQ ID NO: 2817749 - protein, 34 aa, Entamoeba invadens
FVQFPTKMSSFTPPPYLVPLNLIVLYDVSSSNEQ

SEQ ID NO: 2817750 - protein, 23 aa, Entamoeba invadens
FVQYISLALLNPNPLLLGFTVLS

SEQ ID NO: 2817751 - protein, 30 aa, Entamoeba invadens
FVRLCKSIVVPINYWKIAIVASTVMVCVVA

SEQ ID NO: 2817752 - protein, 18 aa, Entamoeba invadens
FVRLLALQSFCIGLLDCL

SEQ ID NO: 2817753 - protein, 25 aa, Entamoeba invadens
FVRNNCFLCEPYYFLMNKTCTKCPD

SEQ ID NO: 2817754 - protein, 19 aa, Entamoeba invadens
FVRPFDGVFGLFKSFSDGI

SEQ ID NO: 2817755 - protein, 21 aa, Entamoeba invadens
FVSFMLFPRFLSTTYRWFACE

SEQ ID NO: 2817756 - protein, 25 aa, Entamoeba invadens
FVSIKRIMNFLLTLELKPVESSSDF

SEQ ID NO: 2817757 - protein, 17 aa, Entamoeba invadens
FVSILLVTNLKIVTIIK

SEQ ID NO: 2817758 - protein, 25 aa, Entamoeba invadens
FVSINFQMWLDPKNISIIKALCHSF

SEQ ID NO: 2817759 - protein, 17 aa, Entamoeba invadens
FVSLLLSFGISLVCVFY

SEQ ID NO: 2817760 - protein, 28 aa, Entamoeba invadens
FVSTTLLGFLILGFGVLGIVYAVQPSFK

SEQ ID NO: 2817761 - protein, 27 aa, Entamoeba invadens
FVSTYFFIDVIAVLALLLIKLFFTKEI

SEQ ID NO: 2817762 - protein, 22 aa, Entamoeba invadens
FVTGFSLGFTKSWDLTLIILMV

SEQ ID NO: 2817763 - protein, 23 aa, Entamoeba invadens
FVTTPFYLELTIFVGLLISIDTF

SEQ ID NO: 2817764 - protein, 18 aa, Entamoeba invadens
FVVDRWGSKLYLWSDEFY

SEQ ID NO: 2817765 - protein, 31 aa, Entamoeba invadens
FVVGVILSLVISFFLVFKKKPKATPLVPEVT

SEQ ID NO: 2817766 - protein, 17 aa, Entamoeba invadens
FVVIPIFFNFVLSVFSC

SEQ ID NO: 2817767 - protein, 22 aa, Entamoeba invadens
FVVMLFTFVCASIPLNHFVNSQ

SEQ ID NO: 2817768 - protein, 19 aa, Entamoeba invadens
FVVVITVIVSLYIYRTKRK

SEQ ID NO: 2817769 - protein, 25 aa, Entamoeba invadens
FVWASFNFLMILLTAFSVSSTLTNH

SEQ ID NO: 2817770 - protein, 21 aa, Entamoeba invadens
FVWGRRRIFLAVGAFIDVLGM

SEQ ID NO: 2817771 - protein, 18 aa, Entamoeba invadens
FVYGTLYESSISTLSITG

SEQ ID NO: 2817772 - protein, 18 aa, Entamoeba invadens
FVYNNLIMKYQWCATLLN

SEQ ID NO: 2817773 - protein, 20 aa, Entamoeba invadens
FWCLVLGDWCLIETGVYTCI

SEQ ID NO: 2817774 - protein, 27 aa, Entamoeba invadens
FWCNTCSAGYFLYYVGSGVQTCMPCAN

SEQ ID NO: 2817775 - protein, 18 aa, Entamoeba invadens
FWGILTEMKFSLLSLTFI

SEQ ID NO: 2817776 - protein, 26 aa, Entamoeba invadens
FWIGRIMFFIAFFIVILVTLLYNEGF

SEQ ID NO: 2817777 - protein, 28 aa, Entamoeba invadens
FWLIFHFFLFQLFIFSEGACPSNYNIIS

SEQ ID NO: 2817778 - protein, 27 aa, Entamoeba invadens
FWLIFNFFLFQLFIFSKGACPSNYNII

SEQ ID NO: 2817779 - protein, 20 aa, Entamoeba invadens
FWSIIYKEMNTLALPYILII

SEQ ID NO: 2817780 - protein, 17 aa, Entamoeba invadens
FWTTIRVDFTYGSCVIP

SEQ ID NO: 2817781 - protein, 19 aa, Entamoeba invadens
FYAHLYSFAADFVLMYFTI

SEQ ID NO: 2817782 - protein, 23 aa, Entamoeba invadens
FYAMFNVVFFCFLFFVDDSFTKQ

SEQ ID NO: 2817783 - protein, 20 aa, Entamoeba invadens
FYEALVWGEVYPKSEFKFAW

SEQ ID NO: 2817784 - protein, 29 aa, Entamoeba invadens
FYGILIILMIIFFVLYYVFFKGDNIFASA

SEQ ID NO: 2817785 - protein, 18 aa, Entamoeba invadens
FYGINEWLVSNKETIIFA

SEQ ID NO: 2817786 - protein, 20 aa, Entamoeba invadens
FYGVSAWAYLNGNHKIKLLK

SEQ ID NO: 2817787 - protein, 19 aa, Entamoeba invadens
FYHLLVVITLVLAVMTTMT

SEQ ID NO: 2817788 - protein, 36 aa, Entamoeba invadens
FYIPVFCYYYIPYTTPWYMFFIMLLFSFTNGYVSAW

SEQ ID NO: 2817789 - protein, 17 aa, Entamoeba invadens
FYLASLVAQVQTLLLAM

SEQ ID NO: 2817790 - protein, 19 aa, Entamoeba invadens
FYLGYPRCRFINGPNLCTC

SEQ ID NO: 2817791 - protein, 17 aa, Entamoeba invadens
FYLLIQFINQVTAVANG

SEQ ID NO: 2817792 - protein, 18 aa, Entamoeba invadens
FYLTFSTQILSTTIDTPE

SEQ ID NO: 2817793 - protein, 18 aa, Entamoeba invadens
FYNIKRLLGKTFEELQDE

SEQ ID NO: 2817794 - protein, 25 aa, Entamoeba invadens
FYQNGLYLILKATISVGTVILYLPT

SEQ ID NO: 2817795 - protein, 20 aa, Entamoeba invadens
FYRSILRQNIGWFDRKENMV

SEQ ID NO: 2817796 - protein, 22 aa, Entamoeba invadens
FYVEQTEWNIKLLAGICSEEFW

SEQ ID NO: 2817797 - protein, 25 aa, Entamoeba invadens
FYVESLLNGYMCYCNYTNGVWDPSD

SEQ ID NO: 2817798 - protein, 18 aa, Entamoeba invadens
FYVIQQGVLLAFINSYCG

SEQ ID NO: 2817799 - protein, 25 aa, Entamoeba invadens
FYVRFFAIVMIFFITSLVGLVASVF

SEQ ID NO: 2817800 - protein, 28 aa, Entamoeba invadens
GAAIGIFLGMIADTLLVIIYSSDMYKKK

SEQ ID NO: 2817801 - protein, 47 aa, Entamoeba invadens
GAAPIMFVCVFIALGIFVRIWCLIPLGVLIVGLILNALFGQGIGKFY

SEQ ID NO: 2817802 - protein, 21 aa, Entamoeba invadens
GACIRCKVRYYLQGNQCVRCG

SEQ ID NO: 2817803 - protein, 19 aa, Entamoeba invadens
GACISCIPGYGFYNHHCYR

SEQ ID NO: 2817804 - protein, 20 aa, Entamoeba invadens
GACTCSFNDIFDTCKKCVST

SEQ ID NO: 2817805 - protein, 23 aa, Entamoeba invadens
GACTGCLFNYIYSSTDPKKCVMC

SEQ ID NO: 2817806 - protein, 21 aa, Entamoeba invadens
GACVILEGLATTCQTFLPGGD

SEQ ID NO: 2817807 - protein, 23 aa, Entamoeba invadens
GADVFSFGVTMYETFGWSEAYNK

SEQ ID NO: 2817808 - protein, 26 aa, Entamoeba invadens
GAEVLIPKFLALLKSFKNVNFGGNEE

SEQ ID NO: 2817809 - protein, 18 aa, Entamoeba invadens
GAFGIVFKGVFRGNSVAV

SEQ ID NO: 2817810 - protein, 22 aa, Entamoeba invadens
GAFNNTLFISFMSDAGIASLGE

SEQ ID NO: 2817811 - protein, 20 aa, Entamoeba invadens
GAFTWMVYFAVEVFVFDTPK

SEQ ID NO: 2817812 - protein, 33 aa, Entamoeba invadens
GAGAAFPFYSLKFVDMLLILMRLEVGTDLTNSQ

SEQ ID NO: 2817813 - protein, 30 aa, Entamoeba invadens
GAGQRPLFSLRTLCLALQYITDVNGFFGFE

SEQ ID NO: 2817814 - protein, 23 aa, Entamoeba invadens
GAIVFITIIVVSIYSALRYKKID

SEQ ID NO: 2817815 - protein, 23 aa, Entamoeba invadens
GAKAFFSNMMLTEIKLPKIITTI

SEQ ID NO: 2817816 - protein, 22 aa, Entamoeba invadens
GAKAFYSSMLTEIKLPSVITTI

SEQ ID NO: 2817817 - protein, 23 aa, Entamoeba invadens
GAKGVFYYSFFDLVFMNDKGDPF

SEQ ID NO: 2817818 - protein, 18 aa, Entamoeba invadens
GALFQMIGTVLSAIVLCF

SEQ ID NO: 2817819 - protein, 17 aa, Entamoeba invadens
GALFYIYGKQYSTLECQ

SEQ ID NO: 2817820 - protein, 21 aa, Entamoeba invadens
GALGCFIFAIVFMLFGFGIVK

SEQ ID NO: 2817821 - protein, 20 aa, Entamoeba invadens
GALISFLGFSLYHTYILLAH

SEQ ID NO: 2817822 - protein, 22 aa, Entamoeba invadens
GALTVIVTVFSLIKKYFDKKQT

SEQ ID NO: 2817823 - protein, 33 aa, Entamoeba invadens
GANIKTFAECDFSLALPLTLQTGVELTCNKLNN

SEQ ID NO: 2817824 - protein, 17 aa, Entamoeba invadens
GANLIFSSILRVNFSGA

SEQ ID NO: 2817825 - protein, 17 aa, Entamoeba invadens
GAPLSQDIAKFFRIVIS

SEQ ID NO: 2817826 - protein, 30 aa, Entamoeba invadens
GAPMTVTFVIIVFIVAIIMVIISMIQKRKQ

SEQ ID NO: 2817827 - protein, 23 aa, Entamoeba invadens
GAPNLNFCFYIKHISSITNKVTE

SEQ ID NO: 2817828 - protein, 19 aa, Entamoeba invadens
GAQLFLFEGGLLVLVTKEN

SEQ ID NO: 2817829 - protein, 25 aa, Entamoeba invadens
GAQLSVKWIFVLSLRLRNSIISMIY

SEQ ID NO: 2817830 - protein, 23 aa, Entamoeba invadens
GASLQFLMVAMNLLEKKAAYLDT

SEQ ID NO: 2817831 - protein, 25 aa, Entamoeba invadens
GATLQIYLSLFLAASILVICLALMF

SEQ ID NO: 2817832 - protein, 18 aa, Entamoeba invadens
GATTSFAFLIRLGDDTYG

SEQ ID NO: 2817833 - protein, 17 aa, Entamoeba invadens
GAVFIRSKECMITEFAL

SEQ ID NO: 2817834 - protein, 17 aa, Entamoeba invadens
GAVLLNGVCSLCISGTM

SEQ ID NO: 2817835 - protein, 30 aa, Entamoeba invadens
GAVLTIDKLYVSEYFLLFGDVNVDEMVVSS

SEQ ID NO: 2817836 - protein, 24 aa, Entamoeba invadens
GAVMFIWVLTFLQSFMLFRTYKWY

SEQ ID NO: 2817837 - protein, 33 aa, Entamoeba invadens
GAVVQGLVLGWVHSFIFWKYAVLMYVAGQQLQK

SEQ ID NO: 2817838 - protein, 27 aa, Entamoeba invadens
GAVVYPPYYQDPLQTLGLLNNEWKSSC

SEQ ID NO: 2817839 - protein, 22 aa, Entamoeba invadens
GAYCGLFYLLETLEGNYCKYLA

SEQ ID NO: 2817840 - protein, 17 aa, Entamoeba invadens
GCAICHDGYYYQDKDCI

SEQ ID NO: 2817841 - protein, 25 aa, Entamoeba invadens
GCAICKNGYYWQGRNCYKCGSNCTT

SEQ ID NO: 2817842 - protein, 23 aa, Entamoeba invadens
GCAICRDGYYYKDKDCIKCDKSC

SEQ ID NO: 2817843 - protein, 19 aa, Entamoeba invadens
GCALCQEGYYREKSDCVTC

SEQ ID NO: 2817844 - protein, 17 aa, Entamoeba invadens
GCAVCQTGYLWQEKSCY

SEQ ID NO: 2817845 - protein, 46 aa, Entamoeba invadens
GCDIAFIVIICMADVTLLLVLGVFGTLAILQFLKNRKHAGTEGADA

SEQ ID NO: 2817846 - protein, 17 aa, Entamoeba invadens
GCDICEPNYLIVPQTKE

SEQ ID NO: 2817847 - protein, 25 aa, Entamoeba invadens
GCDNYTIRTIPPLITLSKGEACEFE

SEQ ID NO: 2817848 - protein, 30 aa, Entamoeba invadens
GCDTPNYVLVNFKCLFYSKVDNCISAEDSK

SEQ ID NO: 2817849 - protein, 17 aa, Entamoeba invadens
GCDVCQTGYYLTDPYCF

SEQ ID NO: 2817850 - protein, 20 aa, Entamoeba invadens
GCDYYEIRSVPPFVTLKPGY

SEQ ID NO: 2817851 - protein, 20 aa, Entamoeba invadens
GCDYYEIRSVPPLVNLKRGE

SEQ ID NO: 2817852 - protein, 20 aa, Entamoeba invadens
GCDYYEIRSVPPLVTLKPGY

SEQ ID NO: 2817853 - protein, 22 aa, Entamoeba invadens
GCDYYEIRSVPPLVTLKPGYAC

SEQ ID NO: 2817854 - protein, 21 aa, Entamoeba invadens
GCDYYQVRTVPPLVNLKRGFA

SEQ ID NO: 2817855 - protein, 46 aa, Entamoeba invadens
GCEKSGWKWYYYFLLIVGIFIVVIVLIIAIILIVAVNKKTTFDPDT

SEQ ID NO: 2817856 - protein, 17 aa, Entamoeba invadens
GCEYIVHFYGAVFVPNK

SEQ ID NO: 2817857 - protein, 27 aa, Entamoeba invadens
GCFFSTYLWFSVLLFASLLVRFVDKEN

SEQ ID NO: 2817858 - protein, 17 aa, Entamoeba invadens
GCFRCSDGFYLDNLKCI

SEQ ID NO: 2817859 - protein, 20 aa, Entamoeba invadens
GCFYTLLCLFGGCTIGCVLI

SEQ ID NO: 2817860 - protein, 22 aa, Entamoeba invadens
GCGSFLLYWVVSVIFCFIPVMI

SEQ ID NO: 2817861 - protein, 19 aa, Entamoeba invadens
GCIECECQPDWFGHGSADC

SEQ ID NO: 2817862 - protein, 27 aa, Entamoeba invadens
GCIEWICKRGFIPTLLKTLMGTTSLDM

SEQ ID NO: 2817863 - protein, 23 aa, Entamoeba invadens
GCIKCKDAFYINNKMCSPCNSNC

SEQ ID NO: 2817864 - protein, 24 aa, Entamoeba invadens
GCIKCKDAFYINNKMCSPCNSNCN

SEQ ID NO: 2817865 - protein, 32 aa, Entamoeba invadens
GCINQIGELCYLCKWAYVLIENKCHNYSIPCM

SEQ ID NO: 2817866 - protein, 17 aa, Entamoeba invadens
GCIRCMTGYYLSNGNCK

SEQ ID NO: 2817867 - protein, 17 aa, Entamoeba invadens
GCISCLDGYYLTNNSCN

SEQ ID NO: 2817868 - protein, 17 aa, Entamoeba invadens
GCKIGYVPNITTSLQCI

SEQ ID NO: 2817869 - protein, 23 aa, Entamoeba invadens
GCLKCLTGFYQQNQFCVTYNLTT

SEQ ID NO: 2817870 - protein, 25 aa, Entamoeba invadens
GCLRCCDGYYILNSLCVKCEYPCTQ

SEQ ID NO: 2817871 - protein, 17 aa, Entamoeba invadens
GCLSCNDGYYLENNKCV

SEQ ID NO: 2817872 - protein, 17 aa, Entamoeba invadens
GCLSCNNGYYLENNKCV

SEQ ID NO: 2817873 - protein, 17 aa, Entamoeba invadens
GCLSCSVGYYLDDGKCQ

SEQ ID NO: 2817874 - protein, 18 aa, Entamoeba invadens
GCLVCKVGYYKKGADCAQ

SEQ ID NO: 2817875 - protein, 18 aa, Entamoeba invadens
GCLVCKVGYYKKGADCVL

SEQ ID NO: 2817876 - protein, 17 aa, Entamoeba invadens
GCMLCESGYYLSNNLCV

SEQ ID NO: 2817877 - protein, 28 aa, Entamoeba invadens
GCMQCEGGYYLFNNLCVKCQDTCTQCNG

SEQ ID NO: 2817878 - protein, 17 aa, Entamoeba invadens
GCQICEFGYFPNNKKCS

SEQ ID NO: 2817879 - protein, 22 aa, Entamoeba invadens
GCQRCFEGFYIDSTECLKCNTN

SEQ ID NO: 2817880 - protein, 27 aa, Entamoeba invadens
GCSFIGRSCLLCPAGYYSPGGTQSCTL

SEQ ID NO: 2817881 - protein, 23 aa, Entamoeba invadens
GCSNIKSIYLKESVRFDKYLVFA

SEQ ID NO: 2817882 - protein, 17 aa, Entamoeba invadens
GCTECWIGYYKDNKGCS

SEQ ID NO: 2817883 - protein, 17 aa, Entamoeba invadens
GCTLCEDGFALKDNLCH

SEQ ID NO: 2817884 - protein, 23 aa, Entamoeba invadens
GCTLCVNGFAPKDNLCYKCGENC

SEQ ID NO: 2817885 - protein, 24 aa, Entamoeba invadens
GCTQCLDGFYIATPFCLSCQENCL

SEQ ID NO: 2817886 - protein, 28 aa, Entamoeba invadens
GCVCAFLIAVVIIGIIIFLVAKTKKIDI

SEQ ID NO: 2817887 - protein, 18 aa, Entamoeba invadens
GCVKCIIKINGSVIKTKC

SEQ ID NO: 2817888 - protein, 25 aa, Entamoeba invadens
GCVKFKDFCLLPPKQPNCVIEMVDK

SEQ ID NO: 2817889 - protein, 29 aa, Entamoeba invadens
GCVKLLSVNFYAPLTKLLDSLASQNNLFF

SEQ ID NO: 2817890 - protein, 17 aa, Entamoeba invadens
GCVLCEDGYYINSQYCF

SEQ ID NO: 2817891 - protein, 17 aa, Entamoeba invadens
GCVLCEESFYLQNGRCF

SEQ ID NO: 2817892 - protein, 20 aa, Entamoeba invadens
GCVQCKENCRFCNVSTCFLC

SEQ ID NO: 2817893 - protein, 18 aa, Entamoeba invadens
GCYSCRNGYYLTQISRCY

SEQ ID NO: 2817894 - protein, 29 aa, Entamoeba invadens
GDAFVSFPNLFPWDVAGLIAKNYRPPLDI

SEQ ID NO: 2817895 - protein, 39 aa, Entamoeba invadens
GDAKAMWTYIKYGGYFYFAMVVFFFFISSFMLIGSNFWL

SEQ ID NO: 2817896 - protein, 29 aa, Entamoeba invadens
GDANFIFFTYNILNIEKLILNANLRVSGN

SEQ ID NO: 2817897 - protein, 26 aa, Entamoeba invadens
GDCMDLINYKYHYSDKFDPFNFGYGY

SEQ ID NO: 2817898 - protein, 32 aa, Entamoeba invadens
GDDAIIPPFTNPHIFKLFDGHLVKYCPEGIDH

SEQ ID NO: 2817899 - protein, 17 aa, Entamoeba invadens
GDFLLSNKQIITFGVLN

SEQ ID NO: 2817900 - protein, 19 aa, Entamoeba invadens
GDFNKICNVSLPLSKGCAI

SEQ ID NO: 2817901 - protein, 27 aa, Entamoeba invadens
GDFPNVISIPSFYQPKQIETLSLGVNA

SEQ ID NO: 2817902 - protein, 43 aa, Entamoeba invadens
GDGCNTKIVWWVLLLVVLFVVMILILLIVVTALFTNKMLKKIH

SEQ ID NO: 2817903 - protein, 35 aa, Entamoeba invadens
GDGKELWFAYIIKYLILFFPVLNLTSTFPLLSNTL

SEQ ID NO: 2817904 - protein, 25 aa, Entamoeba invadens
GDGRIAFWQLGLYGHWGEWHEYYIK

SEQ ID NO: 2817905 - protein, 24 aa, Entamoeba invadens
GDIEALCIVLLDLIAIRLDTLKFL

SEQ ID NO: 2817906 - protein, 25 aa, Entamoeba invadens
GDIVKAPYYFLYVSTSSLSESAQKR

SEQ ID NO: 2817907 - protein, 19 aa, Entamoeba invadens
GDKFIYYKPGWGPGVRKFR

SEQ ID NO: 2817908 - protein, 23 aa, Entamoeba invadens
GDKVEYCSKCEPGYFLYDEDRPQ

SEQ ID NO: 2817909 - protein, 17 aa, Entamoeba invadens
GDLAFNAVTAVTTIIIP

SEQ ID NO: 2817910 - protein, 26 aa, Entamoeba invadens
GDLDQLKWTFVTRLVGFRSVGTNYTI

SEQ ID NO: 2817911 - protein, 17 aa, Entamoeba invadens
GDLFTKCALTLPTSGGC

SEQ ID NO: 2817912 - protein, 22 aa, Entamoeba invadens
GDLHFSTVVLLENCVITCPKTS

SEQ ID NO: 2817913 - protein, 18 aa, Entamoeba invadens
GDLKWFYAHLYSFAADFV

SEQ ID NO: 2817914 - protein, 24 aa, Entamoeba invadens
GDLLNLLWFPLTFVVQPLAADIDC

SEQ ID NO: 2817915 - protein, 27 aa, Entamoeba invadens
GDLNMWNTIIFMKSYQSLIIGTDIILT

SEQ ID NO: 2817916 - protein, 19 aa, Entamoeba invadens
GDNKDRIMCSTKVLIFENE

SEQ ID NO: 2817917 - protein, 24 aa, Entamoeba invadens
GDNKNLLWKFLINNKNVLWHLKNL

SEQ ID NO: 2817918 - protein, 52 aa, Entamoeba invadens
GDSCLYSLNLGIAVGIPISIVIVIIIIVTTIIVVTVILIQRKKERIKEKNVC

SEQ ID NO: 2817919 - protein, 26 aa, Entamoeba invadens
GDTEVFLCFLKWLCSDITITAWKAFW

SEQ ID NO: 2817920 - protein, 26 aa, Entamoeba invadens
GDTSYQLWLVPFYVGVLFSVITHVFD

SEQ ID NO: 2817921 - protein, 24 aa, Entamoeba invadens
GDVISLITSLLKTRTFFIPNRNET

SEQ ID NO: 2817922 - protein, 26 aa, Entamoeba invadens
GDVSAWVSGLLYFFGRFPQAVHIYRK

SEQ ID NO: 2817923 - protein, 24 aa, Entamoeba invadens
GDWNLFNSTWLLPKNHTAKIAASK

SEQ ID NO: 2817924 - protein, 43 aa, Entamoeba invadens
GDYCEYVLNIGLYIVLPIIVVLIFLTLVVIISTLLVFSILKKI

SEQ ID NO: 2817925 - protein, 25 aa, Entamoeba invadens
GDYEKLLFKIAPDFLVYEPSKISTG

SEQ ID NO: 2817926 - protein, 29 aa, Entamoeba invadens
GDYLRRMWESLVLVLFLRPFDIGDRISVG

SEQ ID NO: 2817927 - protein, 24 aa, Entamoeba invadens
GDYTKYIILSKPFVGTIRPKESVT

SEQ ID NO: 2817928 - protein, 23 aa, Entamoeba invadens
GEACEFEMFVTPHCSLKLHEEIM

SEQ ID NO: 2817929 - protein, 29 aa, Entamoeba invadens
GEAFPSEEFAFPWMIADFVFKGNRPPYRE

SEQ ID NO: 2817930 - protein, 18 aa, Entamoeba invadens
GECLLCDDGNYLTTDGGC

SEQ ID NO: 2817931 - protein, 24 aa, Entamoeba invadens
GECLTCYAGYGLGYDGNCELCPDG

SEQ ID NO: 2817932 - protein, 23 aa, Entamoeba invadens
GECLTCYSGYQLNASQSCEICQR

SEQ ID NO: 2817933 - protein, 24 aa, Entamoeba invadens
GECPSCLDGFFLNSLTCYPCSVSC

SEQ ID NO: 2817934 - protein, 24 aa, Entamoeba invadens
GEDITKICPLLYNYSNFTIFYSKC

SEQ ID NO: 2817935 - protein, 35 aa, Entamoeba invadens
GEDKLELNQPYYFSFTLQNLFSKVLLFTFHGVDSH

SEQ ID NO: 2817936 - protein, 20 aa, Entamoeba invadens
GEDPFFCLYYCIGSGNITNS

SEQ ID NO: 2817937 - protein, 17 aa, Entamoeba invadens
GEDTKMLFANKKMDAFA

SEQ ID NO: 2817938 - protein, 24 aa, Entamoeba invadens
GEEIRLQWYLGMIVVICGVTLLLV

SEQ ID NO: 2817939 - protein, 22 aa, Entamoeba invadens
GEEYFIIRNYWGDWGEEGYMRV

SEQ ID NO: 2817940 - protein, 24 aa, Entamoeba invadens
GEGNPYYHPAPTTAYRLHSVSETV

SEQ ID NO: 2817941 - protein, 30 aa, Entamoeba invadens
GEGSFGIVYKGLFKEKIVAIKKLKNANTTK

SEQ ID NO: 2817942 - protein, 20 aa, Entamoeba invadens
GEGSFGIVYKGSYRKNVVAI

SEQ ID NO: 2817943 - protein, 17 aa, Entamoeba invadens
GEIFIECPFYVKNLTKT

SEQ ID NO: 2817944 - protein, 24 aa, Entamoeba invadens
GEIFLAYVTTLFRIGDAFAQNPLT

SEQ ID NO: 2817945 - protein, 23 aa, Entamoeba invadens
GEINFSYVFSLLPKHIDDAHLMH

SEQ ID NO: 2817946 - protein, 23 aa, Entamoeba invadens
GEIQFFILAFCIDAFLFLGGVSF

SEQ ID NO: 2817947 - protein, 26 aa, Entamoeba invadens
GEITKFYFPPFYKTYFDELLAPFRTF

SEQ ID NO: 2817948 - protein, 26 aa, Entamoeba invadens
GELKQRAPVLFKYFNREISAFITDCI

SEQ ID NO: 2817949 - protein, 20 aa, Entamoeba invadens
GELTSKCYLTLPTGGGCAIC

SEQ ID NO: 2817950 - protein, 19 aa, Entamoeba invadens
GELYPRVGCFKVLDGKYVQ

SEQ ID NO: 2817951 - protein, 25 aa, Entamoeba invadens
GEMSDYFFLEVVSTIWFNERAYREM

SEQ ID NO: 2817952 - protein, 22 aa, Entamoeba invadens
GENVLIFSLNPHSAVCGKLTDF

SEQ ID NO: 2817953 - protein, 22 aa, Entamoeba invadens
GEPEYFMTCPMIEWSVDQRNCV

SEQ ID NO: 2817954 - protein, 17 aa, Entamoeba invadens
GEQPPMPLPPQAPTYNP

SEQ ID NO: 2817955 - protein, 18 aa, Entamoeba invadens
GERNILITSALPYCNNYP

SEQ ID NO: 2817956 - protein, 23 aa, Entamoeba invadens
GESFWVIYVLVIVFYILFIVFLH

SEQ ID NO: 2817957 - protein, 25 aa, Entamoeba invadens
GESKQYIFISIGAVVFVLVVGVVVF

SEQ ID NO: 2817958 - protein, 18 aa, Entamoeba invadens
GESLLLEYAVDQFLIDGT

SEQ ID NO: 2817959 - protein, 20 aa, Entamoeba invadens
GETCLKCDTGFYLSGSECSK

SEQ ID NO: 2817960 - protein, 26 aa, Entamoeba invadens
GETMSFIKYEFKFCYLFTTNKKTSYK

SEQ ID NO: 2817961 - protein, 22 aa, Entamoeba invadens
GEVNIKLRLKFLLDGAKGIQYL

SEQ ID NO: 2817962 - protein, 23 aa, Entamoeba invadens
GEVTTVYSLQIPPTITSVNVARN

SEQ ID NO: 2817963 - protein, 18 aa, Entamoeba invadens
GEVYFVETCINPSGVYAV

SEQ ID NO: 2817964 - protein, 25 aa, Entamoeba invadens
GEYKSFLIRLTDYAPSPYPYVYVAN

SEQ ID NO: 2817965 - protein, 20 aa, Entamoeba invadens
GFACEFEIFITPHCTLNLND

SEQ ID NO: 2817966 - protein, 29 aa, Entamoeba invadens
GFACEFEIFLTPLCTMHLVDEIVLVALDL

SEQ ID NO: 2817967 - protein, 24 aa, Entamoeba invadens
GFACEFEVFLTPLCTMDLSDEIVI

SEQ ID NO: 2817968 - protein, 24 aa, Entamoeba invadens
GFACEFEVFLTPYCTMDLSDEIVI

SEQ ID NO: 2817969 - protein, 26 aa, Entamoeba invadens
GFAKQFYQFTMFLKSYTTYINHQSLV

SEQ ID NO: 2817970 - protein, 21 aa, Entamoeba invadens
GFALSAIETLFYYGTSEPILG

SEQ ID NO: 2817971 - protein, 20 aa, Entamoeba invadens
GFCTLCEIGFYRDNTKCDSC

SEQ ID NO: 2817972 - protein, 27 aa, Entamoeba invadens
GFCTSCKLNYLLYDGLCYPKATNCATY

SEQ ID NO: 2817973 - protein, 20 aa, Entamoeba invadens
GFCYPALKFLGSTSLFIEPP

SEQ ID NO: 2817974 - protein, 30 aa, Entamoeba invadens
GFDVKQENTFLWLGKYTYTYTFSGSCCFSG

SEQ ID NO: 2817975 - protein, 17 aa, Entamoeba invadens
GFDWGVVESILLGSVNR

SEQ ID NO: 2817976 - protein, 24 aa, Entamoeba invadens
GFEKYLFFVPIMVMKYTIPRFNFV

SEQ ID NO: 2817977 - protein, 18 aa, Entamoeba invadens
GFELPQELMKVMPMIPFN

SEQ ID NO: 2817978 - protein, 29 aa, Entamoeba invadens
GFETHIDPYWFHYLMDFGAWAIPTAIYGK

SEQ ID NO: 2817979 - protein, 19 aa, Entamoeba invadens
GFFGYYPIDEPKLDCYEEF

SEQ ID NO: 2817980 - protein, 23 aa, Entamoeba invadens
GFFTLIYMSFISTGLFNCSRTIG

SEQ ID NO: 2817981 - protein, 21 aa, Entamoeba invadens
GFGAWAMITLAILIGMESLSA

SEQ ID NO: 2817982 - protein, 26 aa, Entamoeba invadens
GFGIFTLIIVFVFTIVLTVLLFGGYD

SEQ ID NO: 2817983 - protein, 24 aa, Entamoeba invadens
GFKAIFTHPLLLSIVFMVSSGFLN

SEQ ID NO: 2817984 - protein, 17 aa, Entamoeba invadens
GFKIPLVLLVSVHFLGV

SEQ ID NO: 2817985 - protein, 24 aa, Entamoeba invadens
GFKIQIIRKFLKQIINSLEILSRG

SEQ ID NO: 2817986 - protein, 28 aa, Entamoeba invadens
GFKMLTGIYCKSGYYYNKTLFDCVSYTD

SEQ ID NO: 2817987 - protein, 18 aa, Entamoeba invadens
GFLTFSRYSFSFGTARFT

SEQ ID NO: 2817988 - protein, 17 aa, Entamoeba invadens
GFLVFLMILGVVQNFAG

SEQ ID NO: 2817989 - protein, 30 aa, Entamoeba invadens
GFMFNFGVYFFWLVIPIILKDYDVNSIFIG

SEQ ID NO: 2817990 - protein, 20 aa, Entamoeba invadens
GFNEAKLFPHHNYGDGVYSN

SEQ ID NO: 2817991 - protein, 19 aa, Entamoeba invadens
GFNENLLVSLAIYNTKKLE

SEQ ID NO: 2817992 - protein, 33 aa, Entamoeba invadens
GFNIACAPLLWVCTFCMLVTIIPNFRSINLLID

SEQ ID NO: 2817993 - protein, 27 aa, Entamoeba invadens
GFPSTGVSFLPLLGLIGVEGILCVVLS

SEQ ID NO: 2817994 - protein, 21 aa, Entamoeba invadens
GFSFTIFVSILLVTNLKIVTI

SEQ ID NO: 2817995 - protein, 38 aa, Entamoeba invadens
  misc_feature (38)..(38): Xaa can be any naturally occurring amino acid
GFSSGNLWKFIFLILNFLFLNIIYNKPNKINMFRQVWX

SEQ ID NO: 2817996 - protein, 20 aa, Entamoeba invadens
GFTHDCDFDFLFTNNTLNES

SEQ ID NO: 2817997 - protein, 18 aa, Entamoeba invadens
GFTIRRWNWIIFASETSS

SEQ ID NO: 2817998 - protein, 30 aa, Entamoeba invadens
GFTKSWDLTLIILMVTPIMILCTLIIGFSS

SEQ ID NO: 2817999 - protein, 25 aa, Entamoeba invadens
GFVFPLIFFSIWQTLYLVITEGFKR

SEQ ID NO: 2818000 - protein, 36 aa, Entamoeba invadens
GFVKCWDLSLVILSIAPFMILGTIFMGSSTKVTRSK

SEQ ID NO: 2818001 - protein, 18 aa, Entamoeba invadens
GFVLINGVCSPCSSNCIT

SEQ ID NO: 2818002 - protein, 25 aa, Entamoeba invadens
GFVNWLCMWGCLVLATLIAQGMFYS

SEQ ID NO: 2818003 - protein, 34 aa, Entamoeba invadens
GFVVTFISLTTLLLFSATFYALVFNEKPAIFAKK

SEQ ID NO: 2818004 - protein, 18 aa, Entamoeba invadens
GFYCKFIEFNKNDPLEDT

SEQ ID NO: 2818005 - protein, 18 aa, Entamoeba invadens
GFYISVHRNNIFQDSFSQ

SEQ ID NO: 2818006 - protein, 17 aa, Entamoeba invadens
GFYLKGFNCKSLLTIEI

SEQ ID NO: 2818007 - protein, 21 aa, Entamoeba invadens
GFYPSCTSCLPKYYLSGIYCE

SEQ ID NO: 2818008 - protein, 30 aa, Entamoeba invadens
GGAAGFVLVLFITIIIIYFTVKLDRIDTNT

SEQ ID NO: 2818009 - protein, 29 aa, Entamoeba invadens
GGAVLVLIVIVVIFIFVIRIVTKNKRVDF

SEQ ID NO: 2818010 - protein, 18 aa, Entamoeba invadens
GGCLYIVGFIFKFRESRL

SEQ ID NO: 2818011 - protein, 24 aa, Entamoeba invadens
GGGEVVLPLFNKVYYIFVSVDQAV

SEQ ID NO: 2818012 - protein, 26 aa, Entamoeba invadens
GGGQPFQFFIIIGVFLLLTSLHSAFT

SEQ ID NO: 2818013 - protein, 24 aa, Entamoeba invadens
GGHLDALWLWVNGSEEKWVESVKK

SEQ ID NO: 2818014 - protein, 27 aa, Entamoeba invadens
GGIGVGIFLAIFIFQCYHRNCFQKIRE

SEQ ID NO: 2818015 - protein, 27 aa, Entamoeba invadens
GGIIPAMMFLLKFPEYQPTLIQIFVLG

SEQ ID NO: 2818016 - protein, 33 aa, Entamoeba invadens; identical to SEQ ID NO: 2594121

SEQ ID NO: 2818017 - protein, 28 aa, Entamoeba invadens
GGKCSSCIKGFFLTAYFKCDSCSKQCKG

SEQ ID NO: 2818018 - protein, 25 aa, Entamoeba invadens
GGKKYKIFADIFSYGITLYEVMNWG

SEQ ID NO: 2818019 - protein, 24 aa, Entamoeba invadens
GGKSVTFRSFNGLNAQFVSDYYTN

SEQ ID NO: 2818020 - protein, 24 aa, Entamoeba invadens
GGLCYLYFMYTFTRKDRDFSGKHI

SEQ ID NO: 2818021 - protein, 18 aa, Entamoeba invadens
GGLGCIECECQPDWFGHG

SEQ ID NO: 2818022 - protein, 24 aa, Entamoeba invadens
GGLMYMHCFLRKSLVIHETIPWML

SEQ ID NO: 2818023 - protein, 25 aa, Entamoeba invadens
GGLVLIFIVLFLLGYFLNGYLPELS

SEQ ID NO: 2818024 - protein, 20 aa, Entamoeba invadens
GGLYAVVFCPKKQSFSFIDL

SEQ ID NO: 2818025 - protein, 19 aa, Entamoeba invadens
GGMCNVAMLVGKKAGTKFF

SEQ ID NO: 2818026 - protein, 23 aa, Entamoeba invadens
GGMFLLKCFSAIQVLFSAFNAND

SEQ ID NO: 2818027 - protein, 20 aa, Entamoeba invadens
GGMVLFFNKYNFQTEITIPQ

SEQ ID NO: 2818028 - protein, 23 aa, Entamoeba invadens
GGSHQILLFITKYKPKLVCFGHT

SEQ ID NO: 2818029 - protein, 23 aa, Entamoeba invadens
GGSIYIPITTKTLTLKKITLVSR

SEQ ID NO: 2818030 - protein, 26 aa, Entamoeba invadens
GGSTRIPQFTFLSCGSLSLLTGTEKV

SEQ ID NO: 2818031 - protein, 17 aa, Entamoeba invadens
GGSYDILIFDKTSQIGF

SEQ ID NO: 2818032 - protein, 39 aa, Entamoeba invadens
GGTAPLLFLIVCIILLVLITYWALIPIGVCLLFVVINMI

SEQ ID NO: 2818033 - protein, 25 aa, Entamoeba invadens
GGTIKWYVIAVGLFVRMVICPAICI

SEQ ID NO: 2818034 - protein, 20 aa, Entamoeba invadens
GGTYFYASMYYGDKAKLIEL

SEQ ID NO: 2818035 - protein, 46 aa, Entamoeba invadens
GGVAWSTYFRYFSAGGFFWLFLLIVPFILRCGTRICYNLFLTWWTN

SEQ ID NO: 2818036 - protein, 36 aa, Entamoeba invadens
GGVGYKVFIYILALIIPLFLAIFTKYFKPTKVKYQN

SEQ ID NO: 2818037 - protein, 31 aa, Entamoeba invadens
GGVGYKVFIYILALIIPPFLAIFAKYFKPTK

SEQ ID NO: 2818038 - protein, 30 aa, Entamoeba invadens
GGVLLILLLLVTFLYIVYSILFQSRWVIKL

SEQ ID NO: 2818039 - protein, 33 aa, Entamoeba invadens
GGVMTNYLIHLFHLFMYPGTAPLLKFLVVGVIG

SEQ ID NO: 2818040 - protein, 27 aa, Entamoeba invadens
GGVSRAAYYKIFVPRKVSVQMNTCGWK

SEQ ID NO: 2818041 - protein, 35 aa, Entamoeba invadens
GGVVAFVIILCFLLIVFIFVFRYKKIDINIYKTQQ

SEQ ID NO: 2818042 - protein, 33 aa, Entamoeba invadens
GGVVAFWLLCFLNTFFLLFASTEITILCFVSQR

SEQ ID NO: 2818043 - protein, 31 aa, Entamoeba invadens
GGVVLIAAIILIIVAVVFFMKKKSSKYQEID

SEQ ID NO: 2818044 - protein, 29 aa, Entamoeba invadens
GGVVLLIGLILAFFFASLKIMKVQKMKEL

SEQ ID NO: 2818045 - protein, 19 aa, Entamoeba invadens
GGYEMLKVLLIVEKKLEWM

SEQ ID NO: 2818046 - protein, 18 aa, Entamoeba invadens
GGYFPFKQLNVLCVMYDA

SEQ ID NO: 2818047 - protein, 19 aa, Entamoeba invadens
GGYVLYVFSLVLLPISVCV

SEQ ID NO: 2818048 - protein, 19 aa, Entamoeba invadens
GHCFAFLAIVWKTPQLQKL

SEQ ID NO: 2818049 - protein, 27 aa, Entamoeba invadens
GHGDSMYRLMLLFNDPQFVQYNKTRAM

SEQ ID NO: 2818050 - protein, 18 aa, Entamoeba invadens
GHLVSFVLNCWDVLVKRL

SEQ ID NO: 2818051 - protein, 26 aa, Entamoeba invadens
GHNNGIYYQYTFLTGKSYVIDTCGLE

SEQ ID NO: 2818052 - protein, 20 aa, Entamoeba invadens
GHPFSNNLQYALAIILAVTL

SEQ ID NO: 2818053 - protein, 24 aa, Entamoeba invadens
GHPQNAFWFAISSLAGLEIPPKRY

SEQ ID NO: 2818054 - protein, 26 aa, Entamoeba invadens
GHRKDHGHFLPLKKYDSVFSQLRSTG

SEQ ID NO: 2818055 - protein, 27 aa, Entamoeba invadens
GHSEKTTFFTFAAKMLSYPTLTEHDKS

SEQ ID NO: 2818056 - protein, 17 aa, Entamoeba invadens
GHWILLDEINLASHETL

SEQ ID NO: 2818057 - protein, 29 aa, Entamoeba invadens
GIALGVVFGVILLCCGVAVIILKLKKKKN

SEQ ID NO: 2818058 - protein, 33 aa, Entamoeba invadens
GIALVLHFIVMLIKFIFSFLLLSGYNGTIFFIF

SEQ ID NO: 2818059 - protein, 30 aa, Entamoeba invadens
GIALYSYGNGRWWVLKHPNELFLFVNGTEA

SEQ ID NO: 2818060 - protein, 23 aa, Entamoeba invadens
GIANKMVLVYSEGQLYVINPKTL

SEQ ID NO: 2818061 - protein, 32 aa, Entamoeba invadens
GIAVVGKFPFIWIFLVFASICFWMSHQFAPKG

SEQ ID NO: 2818062 - protein, 26 aa, Entamoeba invadens
GICCLHIALYIGLLYDFKCEKLLEMC

SEQ ID NO: 2818063 - protein, 18 aa, Entamoeba invadens
GICKACEAGYFSLGGTAS

SEQ ID NO: 2818064 - protein, 18 aa, Entamoeba invadens
GICLICESGFTLKKPKNL

SEQ ID NO: 2818065 - protein, 19 aa, Entamoeba invadens
GICYEMVGLSGTLRFRVDN

SEQ ID NO: 2818066 - protein, 25 aa, Entamoeba invadens
GIDEKPVLFKKWELKECYRLSVDKS

SEQ ID NO: 2818067 - protein, 22 aa, Entamoeba invadens
GIDIYLLKWNEHYTMTFPEALA

SEQ ID NO: 2818068 - protein, 35 aa, Entamoeba invadens
GIDPTKFIADYAYKYFLLKNVNGAVTYFIRSFTGC

SEQ ID NO: 2818069 - protein, 23 aa, Entamoeba invadens
GIEVFCGLPFIETTGFIALNREK

SEQ ID NO: 2818070 - protein, 24 aa, Entamoeba invadens
GIFLLSVGLFIFLEAVERFIQIQV

SEQ ID NO: 2818071 - protein, 17 aa, Entamoeba invadens
GIFYCKNCTTKSVGIPL

SEQ ID NO: 2818072 - protein, 22 aa, Entamoeba invadens
GIGALFVVLTIAFQLITCTSSE

SEQ ID NO: 2818073 - protein, 49 aa, Entamoeba invadens
GIGCKSHAVWWIILLVILFLIICVVFVIFIAFYFTKFVSKIIHKQKQEE

SEQ ID NO: 2818074 - protein, 24 aa, Entamoeba invadens
GIGEFIADNFLPSNYIIYSGSCVL

SEQ ID NO: 2818075 - protein, 27 aa, Entamoeba invadens
GIGGGAVFPFYTLQFMDVLMVMMTMTP

SEQ ID NO: 2818076 - protein, 25 aa, Entamoeba invadens
GIGMGFVMFTIFCSITLGLFYGTVV

SEQ ID NO: 2818077 - protein, 25 aa, Entamoeba invadens
GIGQGAIFPFYSIKFMDIMMVMLNM

SEQ ID NO: 2818078 - protein, 30 aa, Entamoeba invadens
GIGWCDAYPKGLFAFPWKIAEYVNNGKRPE

SEQ ID NO: 2818079 - protein, 29 aa, Entamoeba invadens
GIHLFSNIDQHWWIVFHRNETISYSPYIL

SEQ ID NO: 2818080 - protein, 41 aa, Entamoeba invadens
GIIAAVIIGLLALVVIIAILCCSAVYIYRKKRKTANKDDTK

SEQ ID NO: 2818081 - protein, 18 aa, Entamoeba invadens
GIIFKCLVCLYVCCGLCL

SEQ ID NO: 2818082 - protein, 17 aa, Entamoeba invadens
GIIIFLVAKTKKIDINI

SEQ ID NO: 2818083 - protein, 21 aa, Entamoeba invadens
GIIIVLFCTILCEIVYHVGYV

SEQ ID NO: 2818084 - protein, 31 aa, Entamoeba invadens
GIIKTPLKFGVYTLLFKYNKPLQTYLEKKVT

SEQ ID NO: 2818085 - protein, 29 aa, Entamoeba invadens
GIILTVIAIILIFPFVAVSFVYSKDLKDY

SEQ ID NO: 2818086 - protein, 22 aa, Entamoeba invadens
GIISCFLAMVFMFVLRGTLFIS

SEQ ID NO: 2818087 - protein, 30 aa, Entamoeba invadens
GIIVNQKRYVFFFFYNFVVNQISHENSENH

SEQ ID NO: 2818088 - protein, 17 aa, Entamoeba invadens
GIIYMAVGGVFVIIAIL

SEQ ID NO: 2818089 - protein, 27 aa, Entamoeba invadens
GIKLSPTFWWYVGGLVFCLLFCTPCLI

SEQ ID NO: 2818090 - protein, 19 aa, Entamoeba invadens
GIKLTWWLGINLSLVYFFE

SEQ ID NO: 2818091 - protein, 21 aa, Entamoeba invadens
GIKRCFSMRRLIYWVIEALVV

SEQ ID NO: 2818092 - protein, 17 aa, Entamoeba invadens
GIKVYYIPLLPVFNECV

SEQ ID NO: 2818093 - protein, 22 aa, Entamoeba invadens
GILCIIIVVIVVLVKVVRKKMA

SEQ ID NO: 2818094 - protein, 17 aa, Entamoeba invadens
GILFLTIAPLTFNPLAA

SEQ ID NO: 2818095 - protein, 30 aa, Entamoeba invadens
GILHRDIKPDNFLVFSLDYGDEITAKLTDF

SEQ ID NO: 2818096 - protein, 21 aa, Entamoeba invadens
GILHRDIKPGNILICDYSYAA

SEQ ID NO: 2818097 - protein, 27 aa, Entamoeba invadens
GILKLMDSIFIKNFMYYFIDGSKTDQS

SEQ ID NO: 2818098 - protein, 18 aa, Entamoeba invadens
GIMSYKNGIFTFPQDVCQ

SEQ ID NO: 2818099 - protein, 23 aa, Entamoeba invadens
GINKYPCQKGYYSNNRAVSCTLC

SEQ ID NO: 2818100 - protein, 18 aa, Entamoeba invadens
GIPVVPLTVLFISFSLKT

SEQ ID NO: 2818101 - protein, 36 aa, Entamoeba invadens
GIQPILFVLTVISVLLMLIPKPIIVILLKRKDRMRV

SEQ ID NO: 2818102 - protein, 24 aa, Entamoeba invadens
GIQSFNFILEWEFNVSFKGSHAQE

SEQ ID NO: 2818103 - protein, 20 aa, Entamoeba invadens
GIRGVVWTHGNIIAQCCALK

SEQ ID NO: 2818104 - protein, 22 aa, Entamoeba invadens
GISLFFLIVFIPEMLTYIIYEW

SEQ ID NO: 2818105 - protein, 35 aa, Entamoeba invadens
GISSYGWIVVLQQPTFYLLLIVAVSFASLPQVVTH

SEQ ID NO: 2818106 - protein, 25 aa, Entamoeba invadens
GISTIFRKLLLSIYPNFVNYYIIHF

SEQ ID NO: 2818107 - protein, 26 aa, Entamoeba invadens
GISWKDPYPIEKYKFPWSISQCVTEG

SEQ ID NO: 2818108 - protein, 34 aa, Entamoeba invadens
GISWKDPYPIQKFKFPWSISQWVIEGKRPEILVD

SEQ ID NO: 2818109 - protein, 22 aa, Entamoeba invadens
GITAWEIFYQREPYFELKSVFE

SEQ ID NO: 2818110 - protein, 23 aa, Entamoeba invadens
GITLPSQITYGVILVKKSVTTPT

SEQ ID NO: 2818111 - protein, 38 aa, Entamoeba invadens
GITMFECFGWCQAYPKTQFKFPWTIAEFVIEGKRLDKK

SEQ ID NO: 2818112 - protein, 18 aa, Entamoeba invadens
GITMYEVFGWCKAYPITT

SEQ ID NO: 2818113 - protein, 22 aa, Entamoeba invadens
GIVFFIFLLLVIGSLIGTVYIP

SEQ ID NO: 2818114 - protein, 19 aa, Entamoeba invadens
GIVFKGTYRRNVVAIKKMK

SEQ ID NO: 2818115 - protein, 24 aa, Entamoeba invadens
GIVSCYPEYFLLDNACVLCSSKYS

SEQ ID NO: 2818116 - protein, 31 aa, Entamoeba invadens
GIVVFKEIFGWRNFMFFAAGTLVLFVGIICI

SEQ ID NO: 2818117 - protein, 36 aa, Entamoeba invadens
GIVVTSVIVFIFILGLISLLLYFALRYKKADVSIYK

SEQ ID NO: 2818118 - protein, 23 aa, Entamoeba invadens
GIYIYPICTPTKLLKGVFFSVNF

SEQ ID NO: 2818119 - protein, 40 aa, Entamoeba invadens
GIYLVLVLGMWLWGQFFCQWKNVFYLFLGISVVGVCVIGA

SEQ ID NO: 2818120 - protein, 20 aa, Entamoeba invadens
GIYPTIFDYGKFRPFALQNS

SEQ ID NO: 2818121 - protein, 29 aa, Entamoeba invadens
GIYRNGVYYQCKNIEYLNYFNSCTTCGGA

SEQ ID NO: 2818122 - protein, 30 aa, Entamoeba invadens
GKAQRVIYVIFWPLLMLLAYTIPDVKIKSL

SEQ ID NO: 2818123 - protein, 25 aa, Entamoeba invadens
GKAVEFEIFVTPLCTCSISETIAIV

SEQ ID NO: 2818124 - protein, 24 aa, Entamoeba invadens
GKCAYCKIQYYLDPINLICKDCPN

SEQ ID NO: 2818125 - protein, 20 aa, Entamoeba invadens
GKCDPYFRCVVRNSLGECTE

SEQ ID NO: 2818126 - protein, 20 aa, Entamoeba invadens
GKCFRLFTKSNFDKFQPSPT

SEQ ID NO: 2818127 - protein, 18 aa, Entamoeba invadens
GKCISCEGGYYIDGQYTC

SEQ ID NO: 2818128 - protein, 20 aa, Entamoeba invadens
GKCISCIMGYGLYSNNNCIK

SEQ ID NO: 2818129 - protein, 20 aa, Entamoeba invadens
GKCRCQDGYLFNETTETCSP

SEQ ID NO: 2818130 - protein, 20 aa, Entamoeba invadens
GKCYSPYLGYFLKNGECLKC

SEQ ID NO: 2818131 - protein, 41 aa, Entamoeba invadens
GKDCELQVTWILLIVFSILITLLGIFAVTTIFVLINKEKKG

SEQ ID NO: 2818132 - protein, 26 aa, Entamoeba invadens
GKDMYTFVIPVRIPVFFSTDLATDSK

SEQ ID NO: 2818133 - protein, 23 aa, Entamoeba invadens
GKEAPYLLVYQLLNQLVCQKMIM

SEQ ID NO: 2818134 - protein, 17 aa, Entamoeba invadens
GKEKFFYMKYAESLENP

SEQ ID NO: 2818135 - protein, 27 aa, Entamoeba invadens
GKEVHVNIWIAVIVPLAAIAIISFVAR

SEQ ID NO: 2818136 - protein, 19 aa, Entamoeba invadens
GKFEILQNCKFVLVEMVWE

SEQ ID NO: 2818137 - protein, 23 aa, Entamoeba invadens
GKFRINVHTFLHETLHALGFSSS

SEQ ID NO: 2818138 - protein, 27 aa, Entamoeba invadens
GKFRSEYIVHFYGAVFIPDKICMVTEF

SEQ ID NO: 2818139 - protein, 29 aa, Entamoeba invadens
GKGIAEIQIFAFDKLSLVLKSTRAPHIVK

SEQ ID NO: 2818140 - protein, 22 aa, Entamoeba invadens
GKGSFGIVYVGLYKGNKVAIKK

SEQ ID NO: 2818141 - protein, 24 aa, Entamoeba invadens
GKHYNAALPLPLRKILLNQMNATL

SEQ ID NO: 2818142 - protein, 25 aa, Entamoeba invadens
GKIDQYIFFMSLGAEITFFSAYARQ

SEQ ID NO: 2818143 - protein, 23 aa, Entamoeba invadens
GKIFTVLRVLTPINIANFEFTED

SEQ ID NO: 2818144 - protein, 17 aa, Entamoeba invadens
GKIPQGELLIRGPSLFK

SEQ ID NO: 2818145 - protein, 39 aa, Entamoeba invadens
GKIQTTFYGLLILSIVLFLVLAYWLFMLSKQCYITELKA

SEQ ID NO: 2818146 - protein, 29 aa, Entamoeba invadens
GKKKDLSIVYFLVLVRLLQTFDQKNLPNN

SEQ ID NO: 2818147 - protein, 17 aa, Entamoeba invadens
GKKLTTTQWRALLALVV

SEQ ID NO: 2818148 - protein, 22 aa, Entamoeba invadens
GKKRYFSFLSQDYRAEITMALS

SEQ ID NO: 2818149 - protein, 24 aa, Entamoeba invadens
GKLCMDWFFTFQEKSDVVYSTHSM

SEQ ID NO: 2818150 - protein, 27 aa, Entamoeba invadens
GKLDLYCGLWYFGIGFIGAAFGQFGFS

SEQ ID NO: 2818151 - protein, 25 aa, Entamoeba invadens
GKLFLIIFIVFNCFVAIGVFGVVSY

SEQ ID NO: 2818152 - protein, 30 aa, Entamoeba invadens
GKLGFGCALIVFSILVVYWVIDAINYSDMV

SEQ ID NO: 2818153 - protein, 21 aa, Entamoeba invadens
GKLTGMRLVGWVFPGELFTVT

SEQ ID NO: 2818154 - protein, 25 aa, Entamoeba invadens
GKLWPPGFMSFFTMAPFISANFQVH

SEQ ID NO: 2818155 - protein, 22 aa, Entamoeba invadens
GKMKFAIFSDVIPRPAELFFQH

SEQ ID NO: 2818156 - protein, 18 aa, Entamoeba invadens
GKMLHMWGLLSHSVIPLV

SEQ ID NO: 2818157 - protein, 37 aa, Entamoeba invadens
GKNNMKFFLQFMFYASITLFFAIIINGSSLFHAITNM

SEQ ID NO: 2818158 - protein, 24 aa, Entamoeba invadens
GKNVLFLTKCRFTKFAKVLYRKYN

SEQ ID NO: 2818159 - protein, 32 aa, Entamoeba invadens
GKQNFVEYFYKFQRLIFDLHDLHISISLKSNT

SEQ ID NO: 2818160 - protein, 20 aa, Entamoeba invadens
GKRLFIPNKVPNELSIIITK

SEQ ID NO: 2818161 - protein, 19 aa, Entamoeba invadens
GKRLVVPVTYYIKQTPDVD

SEQ ID NO: 2818162 - protein, 24 aa, Entamoeba invadens
GKSITFRSFNGYDSNIRYGIVWGI

SEQ ID NO: 2818163 - protein, 24 aa, Entamoeba invadens
GKSPYNDWGFNALPNWVDTKMFHR

SEQ ID NO: 2818164 - protein, 18 aa, Entamoeba invadens
GKTIKCAIGYFIKSNKCE

SEQ ID NO: 2818165 - protein, 34 aa, Entamoeba invadens
GKTQMKSKMTFFVSTLLVILSMSKTLYVDQTLGS

SEQ ID NO: 2818166 - protein, 22 aa, Entamoeba invadens
GKVFAILRVLTPINVANFKIKD

SEQ ID NO: 2818167 - protein, 23 aa, Entamoeba invadens
GKVFTVLRVLTPINIANFEFTED

SEQ ID NO: 2818168 - protein, 21 aa, Entamoeba invadens
GKVFVYFDNILSGFSPRFELV

SEQ ID NO: 2818169 - protein, 31 aa, Entamoeba invadens
GKYLKHNFFQFRFFCLRSKRYILKHMIFFKM

SEQ ID NO: 2818170 - protein, 17 aa, Entamoeba invadens
GLAGLRNLYYSIYPNYN

SEQ ID NO: 2818171 - protein, 45 aa, Entamoeba invadens
GLAIGLPVVFVIIIVTLIALSIVGIYLLFLHNKKEKKMLNVCVFK

SEQ ID NO: 2818172 - protein, 44 aa, Entamoeba invadens
GLAIGLPVVFVIIIVTLIALSIVGIYLLYLHNKEEKKMLNVCVF

SEQ ID NO: 2818173 - protein, 21 aa, Entamoeba invadens
GLAIGYPFSVLALTAIVLGMG

SEQ ID NO: 2818174 - protein, 18 aa, Entamoeba invadens
GLAILIISFVIFAISCCK

SEQ ID NO: 2818175 - protein, 18 aa, Entamoeba invadens
GLCIRCSDGYFLNNIFCE

SEQ ID NO: 2818176 - protein, 26 aa, Entamoeba invadens
GLCKPCYQMFDKCLNCFSNGSYCYSC

SEQ ID NO: 2818177 - protein, 23 aa, Entamoeba invadens
GLCNNFFLNSLWTFPQNVDTKEK

SEQ ID NO: 2818178 - protein, 17 aa, Entamoeba invadens
GLFIFSMYRKNQKVGYQ

SEQ ID NO: 2818179 - protein, 21 aa, Entamoeba invadens
GLFLTLISFFETQDFKVLTCP

SEQ ID NO: 2818180 - protein, 21 aa, Entamoeba invadens
GLFNAFLILLTPRSLSFTKSA

SEQ ID NO: 2818181 - protein, 25 aa, Entamoeba invadens
GLFVAYLCVFGWHEVSIEDKYTFES

SEQ ID NO: 2818182 - protein, 18 aa, Entamoeba invadens
GLGFLSLFISLSFFIFPT

SEQ ID NO: 2818183 - protein, 17 aa, Entamoeba invadens
GLHLFSNIDQRYWIVYR

SEQ ID NO: 2818184 - protein, 28 aa, Entamoeba invadens
GLHNLKFFFLFLLYAFAIVSIHFRLSIL

SEQ ID NO: 2818185 - protein, 19 aa, Entamoeba invadens
GLHYFARTFSAMNVTKYAR

SEQ ID NO: 2818186 - protein, 22 aa, Entamoeba invadens
GLICFIFCYWYIYNLVTFILIF

SEQ ID NO: 2818187 - protein, 17 aa, Entamoeba invadens
GLIFSFLGDLLLLFEGN

SEQ ID NO: 2818188 - protein, 44 aa, Entamoeba invadens
GLILGASISAFIVLLLLVVILTMIVFFLLRKKKEDMKTLFKMKD

SEQ ID NO: 2818189 - protein, 26 aa, Entamoeba invadens
GLILSIVFVVLYIEKKMRHKQIEQTT

SEQ ID NO: 2818190 - protein, 46 aa, Entamoeba invadens
GLIQIEMFEMSLWPLVVLFVFIATTGAIVLFVIAFDKIKHFCKMLC

SEQ ID NO: 2818191 - protein, 18 aa, Entamoeba invadens
GLITFFNLIPYIPKEIEC

SEQ ID NO: 2818192 - protein, 24 aa, Entamoeba invadens
GLKVLLLFVLFLTFCLFCVENHPV

SEQ ID NO: 2818193 - protein, 21 aa, Entamoeba invadens
GLLFVQYRCLKIKNLLKEWWP

SEQ ID NO: 2818194 - protein, 19 aa, Entamoeba invadens
GLLIDKWEIIPIEEVLLVS

SEQ ID NO: 2818195 - protein, 18 aa, Entamoeba invadens
GLLILMLGFSLNGNDLQS

SEQ ID NO: 2818196 - protein, 25 aa, Entamoeba invadens
GLLLYTFLCFVLFSKYQIKDYVKLM

SEQ ID NO: 2818197 - protein, 17 aa, Entamoeba invadens
GLLPYYTTTRFLQNSMP

SEQ ID NO: 2818198 - protein, 20 aa, Entamoeba invadens
GLLRLIYTLYCSQKDFVSKL

SEQ ID NO: 2818199 - protein, 18 aa, Entamoeba invadens
GLMKLDVILFGEKLDQIT

SEQ ID NO: 2818200 - protein, 27 aa, Entamoeba invadens
GLNRYTLLVWIILFLGWTANLAFENSN

SEQ ID NO: 2818201 - protein, 29 aa, Entamoeba invadens
GLNSKLLEWDLILFLKPNSLEVQKKTSKN

SEQ ID NO: 2818202 - protein, 26 aa, Entamoeba invadens
GLNTTIFLSLALLISKLPHLVETITP

SEQ ID NO: 2818203 - protein, 22 aa, Entamoeba invadens
GLPEWLYYFRDNNQNWAIPSNA

SEQ ID NO: 2818204 - protein, 24 aa, Entamoeba invadens
GLPLSMIMIIVMLILTILTSFYTM

SEQ ID NO: 2818205 - protein, 19 aa, Entamoeba invadens
GLPTKFRFAKYATSCFRRL

SEQ ID NO: 2818206 - protein, 19 aa, Entamoeba invadens
GLQLYVLPVPNVITTELWI

SEQ ID NO: 2818207 - protein, 30 aa, Entamoeba invadens
GLSGFAFVVYLFILAFMVMAVRTHPVFTLL

SEQ ID NO: 2818208 - protein, 24 aa, Entamoeba invadens
GLSLLECMKWRQAYEKPEFNYMWQ

SEQ ID NO: 2818209 - protein, 40 aa, Entamoeba invadens
GLSVVCVVVLVVIIIATITSVVLFLLKKKDNKHTEDICVF

SEQ ID NO: 2818210 - protein, 20 aa, Entamoeba invadens
GLTRRVNFYLLGLSAKSQDV

SEQ ID NO: 2818211 - protein, 24 aa, Entamoeba invadens
GLVIYLSNIFYFFTTILHVIEEVV

SEQ ID NO: 2818212 - protein, 29 aa, Entamoeba invadens
GLVTMMYSVVMFLTLVTNYRLLLEELSEN

SEQ ID NO: 2818213 - protein, 42 aa, Entamoeba invadens
GLVVGVPISITLTVIVLIVVIIIILITMIQKKKIAKKEQNIC

SEQ ID NO: 2818214 - protein, 18 aa, Entamoeba invadens
GLWYRLIHVTEGQSEAFT

SEQ ID NO: 2818215 - protein, 18 aa, Entamoeba invadens
GLYLLPVAIINCILPATN

SEQ ID NO: 2818216 - protein, 21 aa, Entamoeba invadens
GLYVFFPFETNCGKGEFGCFN

SEQ ID NO: 2818217 - protein, 17 aa, Entamoeba invadens
GMCADFTYWFGYVFGFG

SEQ ID NO: 2818218 - protein, 34 aa, Entamoeba invadens
GMCLAYIMIFLFDFILYFFRPLVKAIVLITCFYI

SEQ ID NO: 2818219 - protein, 18 aa, Entamoeba invadens
GMCLTCNDGYYLTSQNTC

SEQ ID NO: 2818220 - protein, 39 aa, Entamoeba invadens
GMDKDLMITIIVFSIAVFLLIVINIGLIGFIIYSKKVKK

SEQ ID NO: 2818221 - protein, 27 aa, Entamoeba invadens
GMECLHTFRIPLIHRDLKSPNVLIRLD

SEQ ID NO: 2818222 - protein, 17 aa, Entamoeba invadens
GMFITSICGCDVPLLHI

SEQ ID NO: 2818223 - protein, 24 aa, Entamoeba invadens
GMFMGMPMFHVVKMMRNMKKLVET

SEQ ID NO: 2818224 - protein, 20 aa, Entamoeba invadens
GMIDDLIFSLGLTVQKGDAD

SEQ ID NO: 2818225 - protein, 18 aa, Entamoeba invadens
GMIFFSVMPLLKNSANLL

SEQ ID NO: 2818226 - protein, 26 aa, Entamoeba invadens
GMIVALVIVILLIPFLVVGVVGNKGF

SEQ ID NO: 2818227 - protein, 17 aa, Entamoeba invadens
GMKMRVKIMLDSSKGIF

SEQ ID NO: 2818228 - protein, 29 aa, Entamoeba invadens
GMKTFSFRHFSFKDGIFKDCKELETVNMY

SEQ ID NO: 2818229 - protein, 17 aa, Entamoeba invadens
GMKVDKFGKLVYCSIKG

SEQ ID NO: 2818230 - protein, 23 aa, Entamoeba invadens
GMKVYKHVILKNAFQIYKVKEFS

SEQ ID NO: 2818231 - protein, 26 aa, Entamoeba invadens
GMLNCLQCEPGWYLIGQNCYNTTTSC

SEQ ID NO: 2818232 - protein, 25 aa, Entamoeba invadens
GMPHVIALCRAVMSNWIAFKDIPNS

SEQ ID NO: 2818233 - protein, 41 aa, Entamoeba invadens
GMSLTLVWTYKRSLFLLFQTGFILFLLIIGVSRNAYLNWFM

SEQ ID NO: 2818234 - protein, 24 aa, Entamoeba invadens
GMSNQPLLYILKAPTRMSLYFFSS

SEQ ID NO: 2818235 - protein, 25 aa, Entamoeba invadens
GMSPLLIMISIIMIIASFITYYLVP

SEQ ID NO: 2818236 - protein, 25 aa, Entamoeba invadens
GMSQKFAILFQTLAGFITGYAIGFS

SEQ ID NO: 2818237 - protein, 20 aa, Entamoeba invadens
GMTRLLLRMLDITHITNPFK

SEQ ID NO: 2818238 - protein, 43 aa, Entamoeba invadens
GMTTGFIVAITVLSIFIALIFIVVVVLITLFVIKKCKKSNAPG

SEQ ID NO: 2818239 - protein, 18 aa, Entamoeba invadens
GMTTPFLLKLMKIKMGGA

SEQ ID NO: 2818240 - protein, 23 aa, Entamoeba invadens
GMTWVWRILIILALELLELSVCM

SEQ ID NO: 2818241 - protein, 26 aa, Entamoeba invadens
GMVLRGSYYRFYLNKPMHITVKTCTS

SEQ ID NO: 2818242 - protein, 24 aa, Entamoeba invadens
GMVMGYFFAIFTDKLGIFPTLVVH

SEQ ID NO: 2818243 - protein, 30 aa, Entamoeba invadens
GNANLYVYKRLNELFLFVNGTKPSDIFFSF

SEQ ID NO: 2818244 - protein, 19 aa, Entamoeba invadens
GNCEICVDGYYSLGGTLSC

SEQ ID NO: 2818245 - protein, 21 aa, Entamoeba invadens
GNCEVVCMYYIFNIIKEFKED

SEQ ID NO: 2818246 - protein, 17 aa, Entamoeba invadens
GNCLILADGLKGKWFTF

SEQ ID NO: 2818247 - protein, 19 aa, Entamoeba invadens
GNDCLLCDAGYLLVQQNGV

SEQ ID NO: 2818248 - protein, 22 aa, Entamoeba invadens
GNDFLGNVFRKSFEKIHMETSG

SEQ ID NO: 2818249 - protein, 27 aa, Entamoeba invadens
GNDILRFFCDVLYQTVIYKDHRIFYKS

SEQ ID NO: 2818250 - protein, 17 aa, Entamoeba invadens
GNDLRSLNLKWLRNQIG

SEQ ID NO: 2818251 - protein, 25 aa, Entamoeba invadens
GNDVDWYITPLYNVTSLLIENTTKS

SEQ ID NO: 2818252 - protein, 27 aa, Entamoeba invadens
GNERSRLLPYTLFRLGGAAILLSNKSS

SEQ ID NO: 2818253 - protein, 23 aa, Entamoeba invadens
GNFIGGTFFVGVPFWFAHVSNVY

SEQ ID NO: 2818254 - protein, 23 aa, Entamoeba invadens
GNFTIHSYKQLTLKLRNTFIINE

SEQ ID NO: 2818255 - protein, 24 aa, Entamoeba invadens
GNFTLFNNSLFTTKLPIGITSTIS

SEQ ID NO: 2818256 - protein, 20 aa, Entamoeba invadens
GNGFQCIPCQKGTYSSLPGS

SEQ ID NO: 2818257 - protein, 21 aa, Entamoeba invadens
GNGIVFLDSIIRAHSFRFSEN

SEQ ID NO: 2818258 - protein, 27 aa, Entamoeba invadens
GNGSFGIVFLGTFRRKKVAIKKMKQST

SEQ ID NO: 2818259 - protein, 25 aa, Entamoeba invadens
GNGTTLTKSFYFLDNNYINIKTLFI

SEQ ID NO: 2818260 - protein, 36 aa, Entamoeba invadens
GNHYSSIATPLVFLFRAEPYTYMHMKLFDGHFDTER

SEQ ID NO: 2818261 - protein, 18 aa, Entamoeba invadens
GNIFIVGSNNFKLSSTLT

SEQ ID NO: 2818262 - protein, 22 aa, Entamoeba invadens
GNKYMMVIIHTPNNPKFVFYFD

SEQ ID NO: 2818263 - protein, 23 aa, Entamoeba invadens
GNNLILFFCKMNFTVTGNTISTV

SEQ ID NO: 2818264 - protein, 29 aa, Entamoeba invadens
GNQELVYMHLYIRLMRKIFKHSPKSGEKF

SEQ ID NO: 2818265 - protein, 37 aa, Entamoeba invadens
GNQFPLNIYFPFFCFMAFGFIDFFASLFLPKSINFPK

SEQ ID NO: 2818266 - protein, 29 aa, Entamoeba invadens
GNSAFMGTKLVTLILPTTPITTFGTGVFE

SEQ ID NO: 2818267 - protein, 24 aa, Entamoeba invadens
GNSTFFVIFPLLMIAEYGVGGFNF

SEQ ID NO: 2818268 - protein, 33 aa, Entamoeba invadens
GNTYSFYFGALLPLIIFVVFPRIPGYKNDQTNP

SEQ ID NO: 2818269 - protein, 19 aa, Entamoeba invadens
GNVALLIHIFSVVKIEIKK

SEQ ID NO: 2818270 - protein, 21 aa, Entamoeba invadens
GNYAYEFTAVDKFPLSLDTNT

SEQ ID NO: 2818271 - protein, 24 aa, Entamoeba invadens
GNYIPSYILSTQTKLGFSYILGGI

SEQ ID NO: 2818272 - protein, 23 aa, Entamoeba invadens
GNYKGNLVAIKKMKQIASPNTLT

SEQ ID NO: 2818273 - protein, 23 aa, Entamoeba invadens
GNYKGNLVAIKKMKQIASTNTLT

SEQ ID NO: 2818274 - protein, 25 aa, Entamoeba invadens
GNYNSSLFPIKYTSGIAILISHNRL

SEQ ID NO: 2818275 - protein, 23 aa, Entamoeba invadens
GNYRGNIVAIKKMKQIASPNTVT

SEQ ID NO: 2818276 - protein, 20 aa, Entamoeba invadens
GPAMTAKLTTLLSLGNHFHE

SEQ ID NO: 2818277 - protein, 31 aa, Entamoeba invadens
GPEGTLLGLLTPTQTFNLPQSLKPARRNAQI

SEQ ID NO: 2818278 - protein, 27 aa, Entamoeba invadens
GPEKACQTPVFDLRWVPELERFKRSQQ

SEQ ID NO: 2818279 - protein, 22 aa, Entamoeba invadens
GPFMSFLMFLTMVLNKVELDVE

SEQ ID NO: 2818280 - protein, 24 aa, Entamoeba invadens
GPLDGLVVSFFFYDSKKNERVTSS

SEQ ID NO: 2818281 - protein, 19 aa, Entamoeba invadens
GPLYSFYYELKQIIRDAND

SEQ ID NO: 2818282 - protein, 23 aa, Entamoeba invadens
GPNNTMFSLSVFPKSLFTSSKIN

SEQ ID NO: 2818283 - protein, 17 aa, Entamoeba invadens
GPPLPVELLIAPGGVTK

SEQ ID NO: 2818284 - protein, 26 aa, Entamoeba invadens
GPVESFFYVFYFGAVSFFMSSRFTCQ

SEQ ID NO: 2818285 - protein, 18 aa, Entamoeba invadens
GPVHLPNASLFLSGSVEF

SEQ ID NO: 2818286 - protein, 23 aa, Entamoeba invadens
GQDHWYCAVFTFQTLQKNPLVLV

SEQ ID NO: 2818287 - protein, 28 aa, Entamoeba invadens
GQFVPFGWFVYLFFRWPNGFYNIKKGDH

SEQ ID NO: 2818288 - protein, 18 aa, Entamoeba invadens
GQIALFIPVPEQKVKKFK

SEQ ID NO: 2818289 - protein, 25 aa, Entamoeba invadens
GQIFAKIFFALLIGSIFFDIKNDQQ

SEQ ID NO: 2818290 - protein, 19 aa, Entamoeba invadens
GQIKLWIEPLYLECVHTSS

SEQ ID NO: 2818291 - protein, 34 aa, Entamoeba invadens
GQIKTTWVYVNLFFLVFLCPLLNTPQLFVEGISQ

SEQ ID NO: 2818292 - protein, 25 aa, Entamoeba invadens
GQNCLSCFYGYTLNGTTCIKCTDHC

SEQ ID NO: 2818293 - protein, 18 aa, Entamoeba invadens
GQNCYQYPAKSPLVSIIL

SEQ ID NO: 2818294 - protein, 26 aa, Entamoeba invadens
GQNLPITFSITKFGIDHLKISKGTAV

SEQ ID NO: 2818295 - protein, 24 aa, Entamoeba invadens
GQNNKYRYLISVTPPVVLLKKNEA

SEQ ID NO: 2818296 - protein, 20 aa, Entamoeba invadens
GQQCSLCELGYSLNNSKCEK

SEQ ID NO: 2818297 - protein, 21 aa, Entamoeba invadens
GQQICLRCYGNYSFGTESGKT

SEQ ID NO: 2818298 - protein, 20 aa, Entamoeba invadens
GQSEFYIGADAFLIFSKRQH

SEQ ID NO: 2818299 - protein, 19 aa, Entamoeba invadens
GQSKFWIEPLYLECVQTSS

SEQ ID NO: 2818300 - protein, 19 aa, Entamoeba invadens
GQTKLWIEPLYLECVHTSS

SEQ ID NO: 2818301 - protein, 23 aa, Entamoeba invadens
GQTPFQYIRTFAEMFAGMKNEHA

SEQ ID NO: 2818302 - protein, 22 aa, Entamoeba invadens
GQTPILVALRFNHPEIALEIVK

SEQ ID NO: 2818303 - protein, 21 aa, Entamoeba invadens
GQTQKLLFSKLNDKYVFYQQK

SEQ ID NO: 2818304 - protein, 37 aa, Entamoeba invadens
GQVIVDGIIEEDIIALYLVFFALADNTLSEDDGILFL

SEQ ID NO: 2818305 - protein, 23 aa, Entamoeba invadens
GQVRVQMLQIPSSTLWISFHELP

SEQ ID NO: 2818306 - protein, 19 aa, Entamoeba invadens
GQVWKLLIGYIPCERQKQF

SEQ ID NO: 2818307 - protein, 25 aa, Entamoeba invadens
GQYILTLIMTPSYPPVLQLFDHFDP

SEQ ID NO: 2818308 - protein, 37 aa, Entamoeba invadens
GQYQVTNFFNDLTNGLSLILFMETLSRNHMKRYNKTP

SEQ ID NO: 2818309 - protein, 18 aa, Entamoeba invadens
GQYSPLSYILFQNETIQT

SEQ ID NO: 2818310 - protein, 29 aa, Entamoeba invadens
GRCGQIVCTPGQFITPEKTCRNCKATYED

SEQ ID NO: 2818311 - protein, 19 aa, Entamoeba invadens
GRCLTCIEGYLLTKIGECE

SEQ ID NO: 2818312 - protein, 20 aa, Entamoeba invadens
GRCPADRYFDISTLSCMPCK

SEQ ID NO: 2818313 - protein, 18 aa, Entamoeba invadens
GRCVLSHCLTFVINLNTT

SEQ ID NO: 2818314 - protein, 19 aa, Entamoeba invadens
GREAPGKCFRLFTKSNFDK

SEQ ID NO: 2818315 - protein, 27 aa, Entamoeba invadens
GRFVLTQYAFYFIPYVEENIATKSANL

SEQ ID NO: 2818316 - protein, 23 aa, Entamoeba invadens
GRIEEKRWYVKGKGLPIHNDENG

SEQ ID NO: 2818317 - protein, 17 aa, Entamoeba invadens
GRIFTGVCSFKLDNCSI

SEQ ID NO: 2818318 - protein, 20 aa, Entamoeba invadens
GRIPVLTWFDQKSQKALLRS

SEQ ID NO: 2818319 - protein, 25 aa, Entamoeba invadens
GRNITFLGKVILPDSPILITGSVIF

SEQ ID NO: 2818320 - protein, 17 aa, Entamoeba invadens
GRPLFAKLPLYENGRVV

SEQ ID NO: 2818321 - protein, 32 aa, Entamoeba invadens
GRRAFYVESLLNGYMCYCNYTNGIWDPSDAFL

SEQ ID NO: 2818322 - protein, 28 aa, Entamoeba invadens
GRRIPVINIFLSPFVFSALVCMIDRLIC

SEQ ID NO: 2818323 - protein, 34 aa, Entamoeba invadens
GRSVFMTIFGLISFALFLLLTYCHYKAIHTSPGV

SEQ ID NO: 2818324 - protein, 45 aa, Entamoeba invadens
GRVKLKWRPVHFITWTVILSIIHISFIVQCILGYGGVIMSCVYTI

SEQ ID NO: 2818325 - protein, 52 aa, Entamoeba invadens
GRVPLHVYWQYIKSGSLLMFFIMWLCLAGRICALYFYNTYLTKWGKSIRPLK

SEQ ID NO: 2818326 - protein, 52 aa, Entamoeba invadens
GRVPLHVYWQYIKSGSLLMFFIMWLCLAGRICALYYYNTYLTKWGKSIRPLK

SEQ ID NO: 2818327 - protein, 25 aa, Entamoeba invadens
GRVPLRVFWEYIKSGSLVMFVIMWI

SEQ ID NO: 2818328 - protein, 24 aa, Entamoeba invadens
GRVVPLNIWNFCFGDGLHLSHFNQ

SEQ ID NO: 2818329 - protein, 20 aa, Entamoeba invadens
GRVYFLSNIDAPTGLKKTCV

SEQ ID NO: 2818330 - protein, 25 aa, Entamoeba invadens
GSAALTLFLFLYTNFHYISFHITRF

SEQ ID NO: 2818331 - protein, 28 aa, Entamoeba invadens
GSADAYFFNPIYKGQFSYLYKLKVMKDI

SEQ ID NO: 2818332 - protein, 27 aa, Entamoeba invadens
GSAFEELMFFKWYIKHINMDGTGTMYD

SEQ ID NO: 2818333 - protein, 21 aa, Entamoeba invadens
GSCVPLPPGVKYYINDTTLEC

SEQ ID NO: 2818334 - protein, 17 aa, Entamoeba invadens
GSDEYLELPYHLKLRIL

SEQ ID NO: 2818335 - protein, 47 aa, Entamoeba invadens
GSENFFKMFRFFETIDQILLFWGLVGSLLVGILDPLVVLILGNVFDA

SEQ ID NO: 2818336 - protein, 22 aa, Entamoeba invadens
GSFAEYFVLSLLSVKKLDFSVV

SEQ ID NO: 2818337 - protein, 43 aa, Entamoeba invadens
GSFCKTAMRYDIIFGTIVGVVILIILVLVIVVVLCYQINLHNK

SEQ ID NO: 2818338 - protein, 19 aa, Entamoeba invadens
GSFCKTAMRYDIIFVTNVA

SEQ ID NO: 2818339 - protein, 24 aa, Entamoeba invadens
GSFGIVFLGYYRGNKVAIKYARNI

SEQ ID NO: 2818340 - protein, 18 aa, Entamoeba invadens
GSFGIVYKGAYRGNVVAI

SEQ ID NO: 2818341 - protein, 18 aa, Entamoeba invadens
GSFGIVYKGTFRGNVVCI

SEQ ID NO: 2818342 - protein, 25 aa, Entamoeba invadens
GSFGIVYLGEFRGLKVAIKKLREGC

SEQ ID NO: 2818343 - protein, 20 aa, Entamoeba invadens
GSFGIVYLGTFRGNKVAIKK

SEQ ID NO: 2818344 - protein, 32 aa, Entamoeba invadens
GSFGVECVLTLFLFMIAFPNSLYLARGNHETK

SEQ ID NO: 2818345 - protein, 26 aa, Entamoeba invadens
GSFGVVFLGFYKGNRVAIKKLKITQI

SEQ ID NO: 2818346 - protein, 23 aa, Entamoeba invadens
GSGCATCIKFVESKTVKCIKCTA

SEQ ID NO: 2818347 - protein, 24 aa, Entamoeba invadens
GSGKTFIILSLLNKLEKSTGEVAL

SEQ ID NO: 2818348 - protein, 26 aa, Entamoeba invadens
GSGYPANMLIPFDNPIMGKFVVDTSN

SEQ ID NO: 2818349 - protein, 31 aa, Entamoeba invadens
GSIIGFIVVILILIIIIVLLVKTDKVSIETF

SEQ ID NO: 2818350 - protein, 18 aa, Entamoeba invadens
GSISRIKSHIKSDKLCFG

SEQ ID NO: 2818351 - protein, 29 aa, Entamoeba invadens
GSITYIPQISIVLDYFFLGSLEDYIRIDN

SEQ ID NO: 2818352 - protein, 26 aa, Entamoeba invadens
GSIVLFVLGFIFPCFWLINGCMCCCS

SEQ ID NO: 2818353 - protein, 24 aa, Entamoeba invadens
GSLAFYVKMLIEKIDLLITNINIT

SEQ ID NO: 2818354 - protein, 18 aa, Entamoeba invadens
GSLIYGMILGAITGYYQM

SEQ ID NO: 2818355 - protein, 28 aa, Entamoeba invadens
GSLSLPKLYRFSDTLDLLLLFGGIIGDV

SEQ ID NO: 2818356 - protein, 33 aa, Entamoeba invadens
GSLSRIWGKHDVSYLLKVKILEDVAFALSYLHQ

SEQ ID NO: 2818357 - protein, 19 aa, Entamoeba invadens
GSLSYLISKKKILTKYLRV

SEQ ID NO: 2818358 - protein, 26 aa, Entamoeba invadens
GSLVICKYYFDIYDNTTFTLEKGGQL

SEQ ID NO: 2818359 - protein, 26 aa, Entamoeba invadens
GSMGPPIYLKILLNASPDVLEIQQRI

SEQ ID NO: 2818360 - protein, 23 aa, Entamoeba invadens
GSNMTFLSPVYLPNDNLIIDGMV

SEQ ID NO: 2818361 - protein, 17 aa, Entamoeba invadens
GSPQLYLALLVAFSLLA

SEQ ID NO: 2818362 - protein, 17 aa, Entamoeba invadens
GSQYPLLNYWNDKIDEA

SEQ ID NO: 2818363 - protein, 31 aa, Entamoeba invadens
GSRFGIPYQYSLIVLLVFQACAIGSLVLCTI

SEQ ID NO: 2818364 - protein, 25 aa, Entamoeba invadens
GSRICTNCMVGYFPQSDGRCGLCDT

SEQ ID NO: 2818365 - protein, 43 aa, Entamoeba invadens
GSSCVTKAVWWVIFIIVLIVILLFIILLIVIVVITKMILDKLH

SEQ ID NO: 2818366 - protein, 43 aa, Entamoeba invadens
GSSCVTKAVWWVIFIIVLIVILLLIILLIVIIVVTKMILDKLH

SEQ ID NO: 2818367 - protein, 31 aa, Entamoeba invadens
GSSITLPTTIALGIFILPTSVANPPGAYNCP

SEQ ID NO: 2818368 - protein, 27 aa, Entamoeba invadens
GSSYPAYMVIPLDNPIMGNMCYILGGV

SEQ ID NO: 2818369 - protein, 28 aa, Entamoeba invadens
GSTFEETMFFKWYIKHIKMDATGTMYDS

SEQ ID NO: 2818370 - protein, 26 aa, Entamoeba invadens
GSTGNWNPFFLTFDNLGLAPRINYGE

SEQ ID NO: 2818371 - protein, 25 aa, Entamoeba invadens
GSTICDYCPFLTYSNRGWPHCKKCS

SEQ ID NO: 2818372 - protein, 24 aa, Entamoeba invadens
GSTITLKMKKIKSIKFNNIEWDSE

SEQ ID NO: 2818373 - protein, 29 aa, Entamoeba invadens
GSTQWYAYIIRYLILAFPLVNLTSSFPIV

SEQ ID NO: 2818374 - protein, 28 aa, Entamoeba invadens
GSVCTLYNNVYFDYLCKSTSIIDIEDFK

SEQ ID NO: 2818375 - protein, 23 aa, Entamoeba invadens
GSVEFIYYLGDEAKKLILPHSVC

SEQ ID NO: 2818376 - protein, 18 aa, Entamoeba invadens
GSVIAGVAIFIKNKRHHN

SEQ ID NO: 2818377 - protein, 24 aa, Entamoeba invadens
GSVRMPKIIGMVIEYAPYGSLRNN

SEQ ID NO: 2818378 - protein, 21 aa, Entamoeba invadens
GSVSFIYIIPISTAFVNFLTV

SEQ ID NO: 2818379 - protein, 24 aa, Entamoeba invadens
GSVSWNIFTLTMTTTLLYGKITAT

SEQ ID NO: 2818380 - protein, 46 aa, Entamoeba invadens
GSYCEKYTPAWLVIVIVFAILVMFVLFVALLLIASLVLLKKMKERR

SEQ ID NO: 2818381 - protein, 22 aa, Entamoeba invadens
GSYLLVCVAIAVLIRIYSVLRY

SEQ ID NO: 2818382 - protein, 31 aa, Entamoeba invadens
GSYTFFDLCWRFAFIFYSVIVVLAFLITFRK

SEQ ID NO: 2818383 - protein, 40 aa, Entamoeba invadens
GTACDLKAVWWVLLFVIVISILVVILIIAVVVVTTNHIIT

SEQ ID NO: 2818384 - protein, 26 aa, Entamoeba invadens
GTAKSLMQTLFITKFTIGKKRILMDI

SEQ ID NO: 2818385 - protein, 20 aa, Entamoeba invadens
GTCAIFICLVFCGRVILVYY

SEQ ID NO: 2818386 - protein, 23 aa, Entamoeba invadens
GTCKICADGYYKSSYGICSECPL

SEQ ID NO: 2818387 - protein, 26 aa, Entamoeba invadens
GTCKLMHTYYEFLIHLKFDCVICRHK

SEQ ID NO: 2818388 - protein, 18 aa, Entamoeba invadens
GTCQLLLWGYYPDEPSAR

SEQ ID NO: 2818389 - protein, 24 aa, Entamoeba invadens
GTCYLCKEGYYLDNNKCVKCKDNC

SEQ ID NO: 2818390 - protein, 24 aa, Entamoeba invadens
GTDSFNYYIYISISDICELNLEIE

SEQ ID NO: 2818391 - protein, 31 aa, Entamoeba invadens
GTDVYLPPPILKERKRLELMLERIIKREERN

SEQ ID NO: 2818392 - protein, 25 aa, Entamoeba invadens
GTEKPTMELLKRKPFKRTDGLLSKQ

SEQ ID NO: 2818393 - protein, 18 aa, Entamoeba invadens
GTELLKPNLKFAKARPTT

SEQ ID NO: 2818394 - protein, 47 aa, Entamoeba invadens
GTFCNKKVVWWVLLIIVLFIIGVLIILILTIVFVALYVEKKIHQKEI

SEQ ID NO: 2818395 - protein, 18 aa, Entamoeba invadens
GTFLPFLFCTTDQTQHIS

SEQ ID NO: 2818396 - protein, 26 aa, Entamoeba invadens
GTHDKYYYVCSNSYEGFLPCPKGERC

SEQ ID NO: 2818397 - protein, 27 aa, Entamoeba invadens
GTIFTAIWHLFYIITKVPPERVSEEIS

SEQ ID NO: 2818398 - protein, 21 aa, Entamoeba invadens
GTIGVILPLNGGGYLDLESII

SEQ ID NO: 2818399 - protein, 28 aa, Entamoeba invadens
GTIIAYLFPVLYLIQLIFSIAVICFFGF

SEQ ID NO: 2818400 - protein, 18 aa, Entamoeba invadens
GTILLGLAILIISFVIFA

SEQ ID NO: 2818401 - protein, 21 aa, Entamoeba invadens
GTIVFIVRYRKMKGREMLKEY

SEQ ID NO: 2818402 - protein, 23 aa, Entamoeba invadens
GTIVLIVMVVYVSLFVVIGGICI

SEQ ID NO: 2818403 - protein, 23 aa, Entamoeba invadens
GTKALALEMYKKALLTDDVKVPI

SEQ ID NO: 2818404 - protein, 32 aa, Entamoeba invadens
GTKKLVYWIPRILFFLLFFVSVEVTFVYNKIV

SEQ ID NO: 2818405 - protein, 17 aa, Entamoeba invadens
GTKLTAITLPTTAVTAF

SEQ ID NO: 2818406 - protein, 17 aa, Entamoeba invadens
GTKLTAITLPTTAVTTF

SEQ ID NO: 2818407 - protein, 46 aa, Entamoeba invadens
GTLCDKKVVWWVLLVIILFTIIMMILYVLLIVFTVKYIEKKIHQKQ

SEQ ID NO: 2818408 - protein, 41 aa, Entamoeba invadens
GTLCESQIVWWVIFVLVICVLIVFIILIVSIVIVTKTTFNK

SEQ ID NO: 2818409 - protein, 46 aa, Entamoeba invadens
GTLCNKKIVWWVLFIIILFTIIMMIFLILLIVFTVKCIEKKVHQKQ

SEQ ID NO: 2818410 - protein, 23 aa, Entamoeba invadens
GTLDSDFLCVIASGKKFEGPSTF

SEQ ID NO: 2818411 - protein, 23 aa, Entamoeba invadens
GTLFGLLFEFLLENEIKCIGVLK

SEQ ID NO: 2818412 - protein, 21 aa, Entamoeba invadens
GTLFYPVLTKGVIQITLCGVS

SEQ ID NO: 2818413 - protein, 25 aa, Entamoeba invadens
GTLTFFNTIMIFTNTIHFALNENST

SEQ ID NO: 2818414 - protein, 27 aa, Entamoeba invadens
GTLVHVMALYFLLLSIISALIGSTMDI

SEQ ID NO: 2818415 - protein, 23 aa, Entamoeba invadens
GTNIFEQCWDLAIIDFGGSTRIP

SEQ ID NO: 2818416 - protein, 22 aa, Entamoeba invadens
GTPKFMAPEILQRTVYQKPADV

SEQ ID NO: 2818417 - protein, 26 aa, Entamoeba invadens
GTPKYMAPEILNKKHYKKPADVYSFA

SEQ ID NO: 2818418 - protein, 25 aa, Entamoeba invadens
GTPKYMAPEILNKQHYKKPADVYSF

SEQ ID NO: 2818419 - protein, 21 aa, Entamoeba invadens
GTQCKTNFYLVADTSKCVDKC

SEQ ID NO: 2818420 - protein, 22 aa, Entamoeba invadens
GTQKNCYIIINKGGSITIDEFS

SEQ ID NO: 2818421 - protein, 24 aa, Entamoeba invadens
GTRSCTLCKSTFYISDHKKCSKCD

SEQ ID NO: 2818422 - protein, 23 aa, Entamoeba invadens
GTSCLSCYSSCLYCSGPNSNQCT

SEQ ID NO: 2818423 - protein, 24 aa, Entamoeba invadens
GTSMKNYVLPPRDYKYFVFGHVVT

SEQ ID NO: 2818424 - protein, 26 aa, Entamoeba invadens
GTSTYQYCHIILDDLKIISTYETISN

SEQ ID NO: 2818425 - protein, 25 aa, Entamoeba invadens
GTSYCDMCPLGFYQSLEGQSECYEC

SEQ ID NO: 2818426 - protein, 28 aa, Entamoeba invadens
GTTKIQCTLSCDVLLSGAFEIISDNVVI

SEQ ID NO: 2818427 - protein, 19 aa, Entamoeba invadens
GTTQYLFIHSKYAAAPMKD

SEQ ID NO: 2818428 - protein, 23 aa, Entamoeba invadens
GTYAIFIFVALLTGSIVFYVWQV

SEQ ID NO: 2818429 - protein, 49 aa, Entamoeba invadens
GTYCDKSPVWWVIVIVVIVALVILIVVFTVFALVAFLLSHLTKKKKTEE

SEQ ID NO: 2818430 - protein, 47 aa, Entamoeba invadens
GTYCEKHTVWWVILVIVLFIIIVLTLFIIILVFTVKHILKKIHTKEL

SEQ ID NO: 2818431 - protein, 47 aa, Entamoeba invadens
GTYCEKHTVWWVILVIVLFIIIVLTLFIIILVYTVKHILKKIHTKEL

SEQ ID NO: 2818432 - protein, 48 aa, Entamoeba invadens
GTYCEKHTVWWVILVIVLFIIIVLTLFIIILVYTVKYILKNIHTKELE

SEQ ID NO: 2818433 - protein, 48 aa, Entamoeba invadens
GTYCEKHTVWWVILVIVLFIIIVLTLFIILLVFTVKHILKKIHTKELE

SEQ ID NO: 2818434 - protein, 45 aa, Entamoeba invadens
GTYCNSHVVWWVILIGVLLIIVIFIVTTLVIVLIVKHVSKYLKEK

SEQ ID NO: 2818435 - protein, 50 aa, Entamoeba invadens
GTYCTTQAEWWVILIIIISLILLIIIIILIVYFFTKRVLEKIHLKAASKS

SEQ ID NO: 2818436 - protein, 35 aa, Entamoeba invadens
GTYSVLIPPTLELPHEFWLEIFPDGLVVSKTPRKP

SEQ ID NO: 2818437 - protein, 21 aa, Entamoeba invadens
GVACFILHFCFFVLSEQQGIK

SEQ ID NO: 2818438 - protein, 26 aa, Entamoeba invadens
GVCEQQSVYWLVRNGVVFGCKAGTYL

SEQ ID NO: 2818439 - protein, 30 aa, Entamoeba invadens
GVCKFIEKMILEGTKFLVFAHHQEMLDAIE

SEQ ID NO: 2818440 - protein, 30 aa, Entamoeba invadens
GVCLSCIEGYYLEYGKCYWCYIKEHCVECS

SEQ ID NO: 2818441 - protein, 19 aa, Entamoeba invadens
GVCVLCEDTFILKNEKCIP

SEQ ID NO: 2818442 - protein, 28 aa, Entamoeba invadens
GVCYRCNSGFYLTPIYTKGVICTACSAL

SEQ ID NO: 2818443 - protein, 18 aa, Entamoeba invadens
GVDILVSFIMKKVKKDKD

SEQ ID NO: 2818444 - protein, 20 aa, Entamoeba invadens
GVDMVYLGAQKERILCSTKE

SEQ ID NO: 2818445 - protein, 22 aa, Entamoeba invadens
GVFAGLVYVSFKMTRKPKKVVM

SEQ ID NO: 2818446 - protein, 26 aa, Entamoeba invadens
GVFVIIAILLFILTKTSPRKFADKRF

SEQ ID NO: 2818447 - protein, 20 aa, Entamoeba invadens
GVGIWFTNTQIFQGEAHGGP

SEQ ID NO: 2818448 - protein, 33 aa, Entamoeba invadens
GVGKTTWWAFIIKYLILLFPIVNLTNEFPLVAT

SEQ ID NO: 2818449 - protein, 17 aa, Entamoeba invadens
GVGLFFSSMIRTIIFDL

SEQ ID NO: 2818450 - protein, 26 aa, Entamoeba invadens
GVGLVPALLIYFAVRTKYVLQLIQQK

SEQ ID NO: 2818451 - protein, 24 aa, Entamoeba invadens
GVGNVRFFVCFLVSFAISLLLAFV

SEQ ID NO: 2818452 - protein, 25 aa, Entamoeba invadens
GVHPTSFLLILFSVTLSGVLGNLLD

SEQ ID NO: 2818453 - protein, 26 aa, Entamoeba invadens
GVICSCPQGYYYNSYFRQCFKQVGGV

SEQ ID NO: 2818454 - protein, 24 aa, Entamoeba invadens
GVIEYICKFGFIKNILQTMMNSTD

SEQ ID NO: 2818455 - protein, 32 aa, Entamoeba invadens
GVIFAIPKMPVMWLYCWGMSVVLWVCCWRQRG

SEQ ID NO: 2818456 - protein, 20 aa, Entamoeba invadens
GVIICLTMHYLLTKKIRQDI

SEQ ID NO: 2818457 - protein, 18 aa, Entamoeba invadens
GVIIGIVVSVIVCVIIAV

SEQ ID NO: 2818458 - protein, 24 aa, Entamoeba invadens
GVIIVFVVIVLGSIIIFELVRERA

SEQ ID NO: 2818459 - protein, 28 aa, Entamoeba invadens
GVIQAGIFFSLFYFVINGTDVTFYGKVN

SEQ ID NO: 2818460 - protein, 18 aa, Entamoeba invadens
GVITSLVLVLTNKYYRSF

SEQ ID NO: 2818461 - protein, 44 aa, Entamoeba invadens
GVIVGVPITIIIVLIIVITVGIIITIFFIIRHKEKIETLNICVF

SEQ ID NO: 2818462 - protein, 17 aa, Entamoeba invadens
GVIVLKRPFKRVGQSHV

SEQ ID NO: 2818463 - protein, 19 aa, Entamoeba invadens
GVLIIGKIIYRNVINRLNT

SEQ ID NO: 2818464 - protein, 31 aa, Entamoeba invadens
GVLIITEPVFDPLIFFYARNIELLNQTKGDL

SEQ ID NO: 2818465 - protein, 23 aa, Entamoeba invadens
GVLLLEILLRFYGAAHVEIFSDL

SEQ ID NO: 2818466 - protein, 25 aa, Entamoeba invadens
GVLLNGKCILTPTDIILEIVDNYDT

SEQ ID NO: 2818467 - protein, 18 aa, Entamoeba invadens
GVLLRKKICRLWSRVNPD

SEQ ID NO: 2818468 - protein, 34 aa, Entamoeba invadens
GVLLVMTAATIWFFQKYKIKFAIVFSLFCVVLVT

SEQ ID NO: 2818469 - protein, 26 aa, Entamoeba invadens
GVLMFVAIFIFVVLLIVAFFLGFENS

SEQ ID NO: 2818470 - protein, 18 aa, Entamoeba invadens
GVLMIRFGDAANMYALFL

SEQ ID NO: 2818471 - protein, 27 aa, Entamoeba invadens
GVLVMSRTYFNYTYLPKGENAFAPKIN

SEQ ID NO: 2818472 - protein, 38 aa, Entamoeba invadens
GVLVMSTWTYLILINLITFLITLHSMVYFVTPLNTIET

SEQ ID NO: 2818473 - protein, 25 aa, Entamoeba invadens
GVLVYFVYLITFTPLPSYFVTLQID

SEQ ID NO: 2818474 - protein, 27 aa, Entamoeba invadens
GVMLSCLYLAYDIHPLYDFTSSNLFDA

SEQ ID NO: 2818475 - protein, 22 aa, Entamoeba invadens
GVMYAFSYVLFWIPIQTSISRE

SEQ ID NO: 2818476 - protein, 21 aa, Entamoeba invadens
GVPLTYRNLSASSSSLWMRVP

SEQ ID NO: 2818477 - protein, 26 aa, Entamoeba invadens
GVQSFGIDLFSGFPAWSSWEYIVSEA

SEQ ID NO: 2818478 - protein, 24 aa, Entamoeba invadens
GVSGVLQFYYVRFFGTNIDKHLDG

SEQ ID NO: 2818479 - protein, 39 aa, Entamoeba invadens
GVSHLVILFFILLYCMDFLFESTLFRKFNLYIASGLTII

SEQ ID NO: 2818480 - protein, 25 aa, Entamoeba invadens
GVSQNQFFNLWALIAEHCKDEETVL

SEQ ID NO: 2818481 - protein, 24 aa, Entamoeba invadens
GVSVDLIMMLLSPTIKKAILVPLT

SEQ ID NO: 2818482 - protein, 22 aa, Entamoeba invadens
GVTKLILVGKNKSNKFIITEPP

SEQ ID NO: 2818483 - protein, 26 aa, Entamoeba invadens
GVTSEFPILGLMRKWLKTIYEGGYDN

SEQ ID NO: 2818484 - protein, 41 aa, Entamoeba invadens
GVVFGIPIVSVFIIVLIIVGIIIITIIVLQKRKETKKMENI

SEQ ID NO: 2818485 - protein, 17 aa, Entamoeba invadens
GVVFMSGLFLLAFFFFN

SEQ ID NO: 2818486 - protein, 27 aa, Entamoeba invadens
GVVGLTRALLILDYMLRYHNDFSVDLL

SEQ ID NO: 2818487 - protein, 26 aa, Entamoeba invadens
GVVICMFIISIIFLVVTFTLKCKDFT

SEQ ID NO: 2818488 - protein, 43 aa, Entamoeba invadens
GVVIGIPITVRILLVIFITMIILLIIILLNKRQVKKKMQNVCV

SEQ ID NO: 2818489 - protein, 43 aa, Entamoeba invadens
GVVIGIPLSVVIVLIIIVSIIIVLLYLLVLKKKEEVKMRNICV

SEQ ID NO: 2818490 - protein, 39 aa, Entamoeba invadens
GVVIGIPVAVLIVFFILIAIILVVVLFINTKKKEKMKMK

SEQ ID NO: 2818491 - protein, 22 aa, Entamoeba invadens
GVVLPALLPKYTTVNNALLTVE

SEQ ID NO: 2818492 - protein, 43 aa, Entamoeba invadens
GVVVGIPIVIVLILLLVIISIIIIIVLVFHKQEKTKKMENICV

SEQ ID NO: 2818493 - protein, 41 aa, Entamoeba invadens
GVVVGIPIVSVFIIVFIIIGFLIITIVVLQKRKETKKMENI

SEQ ID NO: 2818494 - protein, 45 aa, Entamoeba invadens
GVVVGVPISVVLLLVLLIVCVIVTILYILMKRKEKVKMENVCVFR

SEQ ID NO: 2818495 - protein, 18 aa, Entamoeba invadens
GVVYFFLSLVLDVSDTIA

SEQ ID NO: 2818496 - protein, 21 aa, Entamoeba invadens
GVVYLGLYRGAYVAVKTFNWE

SEQ ID NO: 2818497 - protein, 36 aa, Entamoeba invadens
GVYCKWHYIILYLVALLLNLPLIIPKSVKFLNRISM

SEQ ID NO: 2818498 - protein, 37 aa, Entamoeba invadens
GVYCKWHYIILYLVAVLLNFPLIIPKSVKFLNRISML

SEQ ID NO: 2818499 - protein, 27 aa, Entamoeba invadens
GVYPSLLILILFFFLNNITAGYVLEAL

SEQ ID NO: 2818500 - protein, 34 aa, Entamoeba invadens
GWAVVSMYITFSGFFMVFFTLMTQVKTWNWWTVF

SEQ ID NO: 2818501 - protein, 20 aa, Entamoeba invadens
GWCEAIPITTFKFPWKIAEF

SEQ ID NO: 2818502 - protein, 22 aa, Entamoeba invadens
GWCIYTCFVFIILGLIGCGATQ

SEQ ID NO: 2818503 - protein, 28 aa, Entamoeba invadens
GWECGYRIVFFIHKLLLGCSLYDSVKYN

SEQ ID NO: 2818504 - protein, 36 aa, Entamoeba invadens
GWELYQIVTWYIIFSIFMCLVMLTLVIGSYVCILVG

SEQ ID NO: 2818505 - protein, 28 aa, Entamoeba invadens
GWHYIILYLVAVILNFPLIIPRSVKFLS

SEQ ID NO: 2818506 - protein, 17 aa, Entamoeba invadens
GWNRYFIKAQTAGSLCT

SEQ ID NO: 2818507 - protein, 18 aa, Entamoeba invadens
GWQYKQMFNLLAFGAMLV

SEQ ID NO: 2818508 - protein, 22 aa, Entamoeba invadens
GWSNAYPIETFKFPWKIAEFVM

SEQ ID NO: 2818509 - protein, 31 aa, Entamoeba invadens
GWYMSALQLFDTFIPLLPIRVLFFIFSVVGV

SEQ ID NO: 2818510 - protein, 24 aa, Entamoeba invadens
GYACEFEIFITPKCTLKTQDNFVI

SEQ ID NO: 2818511 - protein, 22 aa, Entamoeba invadens
GYAVFHLLRWLPGSEENVERIK

SEQ ID NO: 2818512 - protein, 24 aa, Entamoeba invadens
GYCCEFHIYLKPMCTCRVVEDIVF

SEQ ID NO: 2818513 - protein, 17 aa, Entamoeba invadens
GYCFAGKSGYYTTRQDS

SEQ ID NO: 2818514 - protein, 22 aa, Entamoeba invadens
GYCLSCVTGFVLSASPSQHCIT

SEQ ID NO: 2818515 - protein, 23 aa, Entamoeba invadens
GYCTSCISGYYLYGAECITNEQS

SEQ ID NO: 2818516 - protein, 25 aa, Entamoeba invadens
GYCVHKLDLHYSFDSTKTNPQCADG

SEQ ID NO: 2818517 - protein, 24 aa, Entamoeba invadens
GYDQALFNVLYYNGTFNSIGAEAS

SEQ ID NO: 2818518 - protein, 24 aa, Entamoeba invadens
GYDQALLNVLYYHGKFNSTGLKLV

SEQ ID NO: 2818519 - protein, 23 aa, Entamoeba invadens
GYDRLMLCLFMPELINFVISIPQ

SEQ ID NO: 2818520 - protein, 31 aa, Entamoeba invadens
GYDVWNMFNNLFKCLPLCAVVDNKLFCVHGG

SEQ ID NO: 2818521 - protein, 26 aa, Entamoeba invadens
GYETVCLMLFIFHNLSRDSRILYMRK

SEQ ID NO: 2818522 - protein, 20 aa, Entamoeba invadens
GYFALNGECNLFANGGLEMS

SEQ ID NO: 2818523 - protein, 19 aa, Entamoeba invadens
GYFALNGECNLFSNGGLEM

SEQ ID NO: 2818524 - protein, 18 aa, Entamoeba invadens
GYFNKIEMYKIDSLPNLN

SEQ ID NO: 2818525 - protein, 23 aa, Entamoeba invadens
GYGKVGVLLWLLDLEDMLCPDNE

SEQ ID NO: 2818526 - protein, 19 aa, Entamoeba invadens
GYHIMIVSKYFKTINDFIN

SEQ ID NO: 2818527 - protein, 30 aa, Entamoeba invadens
GYHNFRYFFLFLFYLWVSVLFVVFNIYEIF

SEQ ID NO: 2818528 - protein, 31 aa, Entamoeba invadens
GYIIYHVIHLYFNQHKLIFYPTHNGEDFPTL

SEQ ID NO: 2818529 - protein, 19 aa, Entamoeba invadens
GYIKFSTVFRGISAGIILG

SEQ ID NO: 2818530 - protein, 24 aa, Entamoeba invadens
GYIKFSTVFRGLSAGIILGGGIDI

SEQ ID NO: 2818531 - protein, 30 aa, Entamoeba invadens
GYIPTGTHLYFKQLLRYGNLTDFFCHVEHF

SEQ ID NO: 2818532 - protein, 20 aa, Entamoeba invadens
GYIQNGIYVCLLCGTAKPIS

SEQ ID NO: 2818533 - protein, 27 aa, Entamoeba invadens
GYKIFIYIIALIIPPFLAIFVRYFKTT

SEQ ID NO: 2818534 - protein, 21 aa, Entamoeba invadens
GYLISNKKLIRFCPNGTQLDT

SEQ ID NO: 2818535 - protein, 25 aa, Entamoeba invadens
GYLKIDGRLITTLNIKWLRNQIGLV

SEQ ID NO: 2818536 - protein, 26 aa, Entamoeba invadens
GYLWMLIPVILLVLYFFCTYVIDRYF

SEQ ID NO: 2818537 - protein, 17 aa, Entamoeba invadens
GYNIKCDVVYRRNYLYK

SEQ ID NO: 2818538 - protein, 25 aa, Entamoeba invadens
GYNYNWQLNLIINYTVYMTDQINIK

SEQ ID NO: 2818539 - protein, 19 aa, Entamoeba invadens
GYSFVIRKPTKTQCKRMSH

SEQ ID NO: 2818540 - protein, 17 aa, Entamoeba invadens
GYSKLPADKFLSILTTL

SEQ ID NO: 2818541 - protein, 17 aa, Entamoeba invadens
GYTIALVKCWDLALVVI

SEQ ID NO: 2818542 - protein, 17 aa, Entamoeba invadens
GYTLNTFGECVFCKTYF

SEQ ID NO: 2818543 - protein, 19 aa, Entamoeba invadens
GYTSFVLFAVVVAAIFVLF

SEQ ID NO: 2818544 - protein, 19 aa, Entamoeba invadens
GYVIGFVKCWDLSLVILSI

SEQ ID NO: 2818545 - protein, 25 aa, Entamoeba invadens
GYYFMTYDVFLEHNLRHPIGGHDTY

SEQ ID NO: 2818546 - protein, 20 aa, Entamoeba invadens
GYYLLNNVCNSCASLFPNCQ

SEQ ID NO: 2818547 - protein, 23 aa, Entamoeba invadens
HWYGLFFHIPWDYSLNGSQNRSC

SEQ ID NO: 2818548 - protein, 28 aa, Entamoeba invadens
HAADTVVFAELYWTPGILRQAEDRVHRI

SEQ ID NO: 2818549 - protein, 24 aa, Entamoeba invadens
HACITIFGFLFLLTYTVYGMADAG

SEQ ID NO: 2818550 - protein, 44 aa, Entamoeba invadens
HAGIYPLAILILLFSCIWPYTKLILLFFTWTTPPTIMSTKVRYR

SEQ ID NO: 2818551 - protein, 25 aa, Entamoeba invadens
HANIVLHQFVLDDVLFGIFPFVDLV

SEQ ID NO: 2818552 - protein, 27 aa, Entamoeba invadens
HAQLSAVFLEYVFYLLLGLNNCITTFF

SEQ ID NO: 2818553 - protein, 17 aa, Entamoeba invadens
HASVKMVFEFFSHFVLT

SEQ ID NO: 2818554 - protein, 17 aa, Entamoeba invadens
HCKMCSRDYARKCYECN

SEQ ID NO: 2818555 - protein, 19 aa, Entamoeba invadens
HCLECEKEHMSLGYGLTQC

SEQ ID NO: 2818556 - protein, 18 aa, Entamoeba invadens
HCLSCRPELEFLNKDNTC

SEQ ID NO: 2818557 - protein, 17 aa, Entamoeba invadens
HCMFFDQVPLKMIYDVR

SEQ ID NO: 2818558 - protein, 18 aa, Entamoeba invadens
HCTKCQDGYFIDATDHKC

SEQ ID NO: 2818559 - protein, 17 aa, Entamoeba invadens
HCTSCYVGMITQNGICV

SEQ ID NO: 2818560 - protein, 21 aa, Entamoeba invadens
HDEMILLFNGTSFTSTTLTQG

SEQ ID NO: 2818561 - protein, 24 aa, Entamoeba invadens
HDFSYITIIMIFITSIGGILVALV

SEQ ID NO: 2818562 - protein, 23 aa, Entamoeba invadens
HDIVNIIYIFTMFVGSYPIQMIR

SEQ ID NO: 2818563 - protein, 27 aa, Entamoeba invadens
HDMRLLKKLLMILTPCSMVLNSLATKV

SEQ ID NO: 2818564 - protein, 21 aa, Entamoeba invadens
HDTSLLEMNFATISVVQAGLP

SEQ ID NO: 2818565 - protein, 26 aa, Entamoeba invadens
HDVLALVKIMLNMFPQWAKLDQTSIF

SEQ ID NO: 2818566 - protein, 23 aa, Entamoeba invadens
HEDPDLHILYGFRAEAFSKYDPE

SEQ ID NO: 2818567 - protein, 33 aa, Entamoeba invadens
HEEAVYIFFAFNAVVFCLFIVITFPVGQIQSGK

SEQ ID NO: 2818568 - protein, 27 aa, Entamoeba invadens
HEEYHPYLLSILTPLLTKAPPKDPTSS

SEQ ID NO: 2818569 - protein, 19 aa, Entamoeba invadens
HEKFLLLMNDSFIYPRELL

SEQ ID NO: 2818570 - protein, 19 aa, Entamoeba invadens
HELLLPYLEKLFEDKSFHQ

SEQ ID NO: 2818571 - protein, 18 aa, Entamoeba invadens
HENGILHRDIKPDNLLVI

SEQ ID NO: 2818572 - protein, 18 aa, Entamoeba invadens
HENGILHRDIKPDNLLVV

SEQ ID NO: 2818573 - protein, 17 aa, Entamoeba invadens
HENGILHRDIKSDNILV

SEQ ID NO: 2818574 - protein, 18 aa, Entamoeba invadens
HENMMFLHKASRTVNRCG

SEQ ID NO: 2818575 - protein, 23 aa, Entamoeba invadens
HENNLFKWSLFQKQIDGSIEEID

SEQ ID NO: 2818576 - protein, 25 aa, Entamoeba invadens
HEVSMLLQMRYVSVVELIGAIYTEG

SEQ ID NO: 2818577 - protein, 18 aa, Entamoeba invadens
HFCFTLRNTTRTVMLYTF

SEQ ID NO: 2818578 - protein, 25 aa, Entamoeba invadens
HFDKEELLEFFYYPIKMSVKSVKHQ

SEQ ID NO: 2818579 - protein, 26 aa, Entamoeba invadens
HFEMPKDMFMSDDSMFYFFFGIAQES

SEQ ID NO: 2818580 - protein, 22 aa, Entamoeba invadens
HFEPFSFLLKRIIRLQPMQVLS

SEQ ID NO: 2818581 - protein, 18 aa, Entamoeba invadens
HFHFLNPAFEGFFRSINE

SEQ ID NO: 2818582 - protein, 23 aa, Entamoeba invadens
HFKRHMQKVMRPKLFPVFENCAD

SEQ ID NO: 2818583 - protein, 27 aa, Entamoeba invadens
HFMIYGTFLTLLYLVGSVLLSYAIFEI

SEQ ID NO: 2818584 - protein, 18 aa, Entamoeba invadens
HFMNGFFIMWRLKDCAIG

SEQ ID NO: 2818585 - protein, 18 aa, Entamoeba invadens
HFNPLPIRTMRFNVETDG

SEQ ID NO: 2818586 - protein, 19 aa, Entamoeba invadens
HFPLFGLFVSILRWVLLFD

SEQ ID NO: 2818587 - protein, 22 aa, Entamoeba invadens
HFRKLLNYIFFGWKIPKNKICK

SEQ ID NO: 2818588 - protein, 18 aa, Entamoeba invadens
HFSFVKWSENQKVEMCLT

SEQ ID NO: 2818589 - protein, 26 aa, Entamoeba invadens
HFSMTSLFLLSILYAFYAFNLKFRLH

SEQ ID NO: 2818590 - protein, 27 aa, Entamoeba invadens
HFVRLIEESLLFFPTKDFKTTSVLLIQ

SEQ ID NO: 2818591 - protein, 20 aa, Entamoeba invadens
HGCAICEDRYYWQGRNCYKC

SEQ ID NO: 2818592 - protein, 17 aa, Entamoeba invadens
HGFFKQVDFAKKTQHVL

SEQ ID NO: 2818593 - protein, 36 aa, Entamoeba invadens
HGGFDSLFRFLGLNPLVFLAIIPVVSDIYTARRGRK

SEQ ID NO: 2818594 - protein, 35 aa, Entamoeba invadens
HGGFDSLFRFLGLNPLVFLAIRPVVSDIYTARRGR

SEQ ID NO: 2818595 - protein, 24 aa, Entamoeba invadens
HGGPTDWKGFALFIDTYDNDRNKD

SEQ ID NO: 2818596 - protein, 20 aa, Entamoeba invadens
HGGVLKWIVRFHPDLVFSLS

SEQ ID NO: 2818597 - protein, 17 aa, Entamoeba invadens
HGIATIVYILVSLISEA

SEQ ID NO: 2818598 - protein, 23 aa, Entamoeba invadens
HGLKSMYLLEYGDRSFWSFNNSN

SEQ ID NO: 2818599 - protein, 20 aa, Entamoeba invadens
HGLYPGYLLFFFCCGIPYEF

SEQ ID NO: 2818600 - protein, 20 aa, Entamoeba invadens
HGVFFVLFIATTVFYIIKNN

SEQ ID NO: 2818601 - protein, 26 aa, Entamoeba invadens
HHASDQFLLEKLKIVAILSVCDIEPY

SEQ ID NO: 2818602 - protein, 27 aa, Entamoeba invadens
HHETIINTAYLFYLTDHSIFTMNDDSI

SEQ ID NO: 2818603 - protein, 24 aa, Entamoeba invadens
HHETIINTAYLLYLTDHSIFTMND

SEQ ID NO: 2818604 - protein, 26 aa, Entamoeba invadens
HHICKTSLVFLLRYFELNSARQEKTF

SEQ ID NO: 2818605 - protein, 37 aa, Entamoeba invadens
HHKMNWLRPLIIPLIKLRPYELLQHLMIITNDLNRME

SEQ ID NO: 2818606 - protein, 17 aa, Entamoeba invadens
HHKVIKFYTVREMTLRI

SEQ ID NO: 2818607 - protein, 31 aa, Entamoeba invadens
HICRCLFLRVIPMDYLVLFVSTLLLEKRLFI

SEQ ID NO: 2818608 - protein, 24 aa, Entamoeba invadens
HIDLSIFRQQQPFYYFDITQSTSL

SEQ ID NO: 2818609 - protein, 26 aa, Entamoeba invadens
HIFQILTYFRRLCVHPKLVLDDNHPM

SEQ ID NO: 2818610 - protein, 20 aa, Entamoeba invadens
HIHTHIYIYIYICVCVYVCV

SEQ ID NO: 2818611 - protein, 25 aa, Entamoeba invadens
HIILIINCVLLFIYYFILLVNFNKL

SEQ ID NO: 2818612 - protein, 29 aa, Entamoeba invadens
HIITIPPNYGCEFSLFLTPLCNSNMESSF

SEQ ID NO: 2818613 - protein, 17 aa, Entamoeba invadens
HILCIIQSLKRVLNLNP

SEQ ID NO: 2818614 - protein, 19 aa, Entamoeba invadens
HILCIVAMLAVDTQFFVSA

SEQ ID NO: 2818615 - protein, 20 aa, Entamoeba invadens
HILVYNMLLMVHILLDTNKC

SEQ ID NO: 2818616 - protein, 17 aa, Entamoeba invadens
HIPITPTNPLYLKNNNE

SEQ ID NO: 2818617 - protein, 28 aa, Entamoeba invadens
HIRKALLLFSVFPMQTLPDAPKLYLKEL

SEQ ID NO: 2818618 - protein, 23 aa, Entamoeba invadens
HISAYWCSDAQDIPPSFITCDMK

SEQ ID NO: 2818619 - protein, 25 aa, Entamoeba invadens
HITIFSIAVFLILTGSYVIFISWVY

SEQ ID NO: 2818620 - protein, 30 aa, Entamoeba invadens
HITQRIFFVLDFSFFIVCDLSLILPRVGLF

SEQ ID NO: 2818621 - protein, 22 aa, Entamoeba invadens
HITRPYKMFSLPVALFCLTPLT

SEQ ID NO: 2818622 - protein, 36 aa, Entamoeba invadens
HIVLITLVTISCIFLFFVLIITVCLTIIISRKERFI

SEQ ID NO: 2818623 - protein, 17 aa, Entamoeba invadens
HIYKELEYPKFEFDEEF

SEQ ID NO: 2818624 - protein, 38 aa, Entamoeba invadens
HIYSLSFVRIIYSNVLLGTIINFLWVGKDQKFYDIVST

SEQ ID NO: 2818625 - protein, 32 aa, Entamoeba invadens
HKIKLLKYDEEYTWCFPPTKASGFFVGPFIME

SEQ ID NO: 2818626 - protein, 19 aa, Entamoeba invadens
HKIMCILVYVLLFPLILVS

SEQ ID NO: 2818627 - protein, 24 aa, Entamoeba invadens
HKKKLFEIALFTAAIMDEGIQPRC

SEQ ID NO: 2818628 - protein, 31 aa, Entamoeba invadens
HKKREDIDIKLRIKMMIDAAKGILYLHENGI

SEQ ID NO: 2818629 - protein, 26 aa, Entamoeba invadens
HKLSKAIFFEVFLTSEEWILIYSNRE

SEQ ID NO: 2818630 - protein, 25 aa, Entamoeba invadens
HKNLIHKLLKCKLGFFDVTPMGRII

SEQ ID NO: 2818631 - protein, 26 aa, Entamoeba invadens
HKNLIHKLLKCKLGFFDVTPMGRIIN

SEQ ID NO: 2818632 - protein, 18 aa, Entamoeba invadens
HKNLIIHRNLSTSTIVIC

SEQ ID NO: 2818633 - protein, 24 aa, Entamoeba invadens
HKNNEVMQTLIWTNDLFSNNTQLL

SEQ ID NO: 2818634 - protein, 17 aa, Entamoeba invadens
HKPLTLNNNLTLTIPLL

SEQ ID NO: 2818635 - protein, 26 aa, Entamoeba invadens
HKQLDVRPLLLNLMKALITFIKSDQT

SEQ ID NO: 2818636 - protein, 28 aa, Entamoeba invadens
HKQMPELVFFSIKFLDVLATKLVLSPKF

SEQ ID NO: 2818637 - protein, 23 aa, Entamoeba invadens
HKSPQLFHLFMTYKTFCIDTFVV

SEQ ID NO: 2818638 - protein, 28 aa, Entamoeba invadens
HKTATEFFFLILTQTFQLNLQLVCMPEI

SEQ ID NO: 2818639 - protein, 34 aa, Entamoeba invadens
HKTRTIFLSLLVLEFITLTPFITITWVKGSQEEL

SEQ ID NO: 2818640 - protein, 18 aa, Entamoeba invadens
HLCVCKSDYELIAGKCLK

SEQ ID NO: 2818641 - protein, 27 aa, Entamoeba invadens
HLDELFVWQLYRVTPSLRLVPITFDNG

SEQ ID NO: 2818642 - protein, 18 aa, Entamoeba invadens
HLDGVVFEFMTRSDVWAS

SEQ ID NO: 2818643 - protein, 42 aa, Entamoeba invadens
HLEITMKYLLLYLLIVVIIFIILPSYSLLFISVRPFSTPYWY

SEQ ID NO: 2818644 - protein, 26 aa, Entamoeba invadens
HLFSNIDQRWWLSFHRDSTMLYSPYL

SEQ ID NO: 2818645 - protein, 19 aa, Entamoeba invadens
HLGTMMVMFPRNLCIKSCR

SEQ ID NO: 2818646 - protein, 23 aa, Entamoeba invadens
HLHDTCHTALPIQIPFSGVFSNH

SEQ ID NO: 2818647 - protein, 20 aa, Entamoeba invadens
HLICFMTIRNYFAMNSPLIT

SEQ ID NO: 2818648 - protein, 18 aa, Entamoeba invadens
HLIFLETVGFLNGDGSSY

SEQ ID NO: 2818649 - protein, 18 aa, Entamoeba invadens
HLKIEQPIECENVMMSAI

SEQ ID NO: 2818650 - protein, 18 aa, Entamoeba invadens
HLKYLVVCSLISSVPALI

SEQ ID NO: 2818651 - protein, 19 aa, Entamoeba invadens
HLLAYLDHRIIRDIPDNVR

SEQ ID NO: 2818652 - protein, 27 aa, Entamoeba invadens
HLLGKLLVISRWLGRNPVLHDITTFNA

SEQ ID NO: 2818653 - protein, 17 aa, Entamoeba invadens
HLLMLQRNNILFPKSQP

SEQ ID NO: 2818654 - protein, 24 aa, Entamoeba invadens
HLLSLVFPALLSFSATYLQNVGLV

SEQ ID NO: 2818655 - protein, 18 aa, Entamoeba invadens
HLMNSLCKIKYGGGTRYS

SEQ ID NO: 2818656 - protein, 28 aa, Entamoeba invadens
HLNIIYTCLSCNLGYYPTNYNCALCNAG

SEQ ID NO: 2818657 - protein, 18 aa, Entamoeba invadens
HLPLLFINGQITNFNRVT

SEQ ID NO: 2818658 - protein, 17 aa, Entamoeba invadens
HLQCALIAFISAKADIK

SEQ ID NO: 2818659 - protein, 20 aa, Entamoeba invadens
HLQLVKLLRRNAETGCFVGD

SEQ ID NO: 2818660 - protein, 22 aa, Entamoeba invadens
HLRKKKLPLGFKYLQKKINVKD

SEQ ID NO: 2818661 - protein, 17 aa, Entamoeba invadens
HLRLLNVSSMYLLKANE

SEQ ID NO: 2818662 - protein, 29 aa, Entamoeba invadens
HLSKQLCYFHKWYKFFNFHGKNISRCGQF

SEQ ID NO: 2818663 - protein, 19 aa, Entamoeba invadens
HLSLPYKLKVRMLYDTARG

SEQ ID NO: 2818664 - protein, 26 aa, Entamoeba invadens
HLSTYSLDILYLMPFENITATVNTIV

SEQ ID NO: 2818665 - protein, 22 aa, Entamoeba invadens
HLTALFVWFFLLFTALYIVTWL

SEQ ID NO: 2818666 - protein, 30 aa, Entamoeba invadens
HLTLLPEKWNEIFLIHFKTNNLMKVVINSE

SEQ ID NO: 2818667 - protein, 18 aa, Entamoeba invadens
HLTTIIQLITILPNPMES

SEQ ID NO: 2818668 - protein, 26 aa, Entamoeba invadens
HLVADYFVVNPIQFSLKGTKVYFSVP

SEQ ID NO: 2818669 - protein, 27 aa, Entamoeba invadens
HLVMAALLALWAFTAYSRLTKKIRQEI

SEQ ID NO: 2818670 - protein, 32 aa, Entamoeba invadens
HLYVLLYIEFGVNVYLLLSWFYEFVVNLHVRR

SEQ ID NO: 2818671 - protein, 17 aa, Entamoeba invadens
HMAVKEMIFALPEKTPQ

SEQ ID NO: 2818672 - protein, 31 aa, Entamoeba invadens
HMKKYINIWFHWIPEMIFMICSFGYLCFLII

SEQ ID NO: 2818673 - protein, 27 aa, Entamoeba invadens
HMLRKHEFFRVLLQTQFYTIVGNYDLS

SEQ ID NO: 2818674 - protein, 17 aa, Entamoeba invadens
HMPQGAYKLIKAVDFMP

SEQ ID NO: 2818675 - protein, 18 aa, Entamoeba invadens
HMWFGEGVCLKIPKDKMS

SEQ ID NO: 2818676 - protein, 18 aa, Entamoeba invadens
HMWKTILPDSFFSSEEFQ

SEQ ID NO: 2818677 - protein, 25 aa, Entamoeba invadens
HNHLFSDFLMMTLSSTLKMIVTMVN

SEQ ID NO: 2818678 - protein, 27 aa, Entamoeba invadens
HNIFQNIFANMYFACIFVGISITQVII

SEQ ID NO: 2818679 - protein, 34 aa, Entamoeba invadens
HNLSRDSRILYMRKLFKIILNAPVKINTKGVVGL

SEQ ID NO: 2818680 - protein, 25 aa, Entamoeba invadens
HNNDILHRDIKPDNFLIVSLDQNVK

SEQ ID NO: 2818681 - protein, 17 aa, Entamoeba invadens
HNPDDFAFWAGVRFVII

SEQ ID NO: 2818682 - protein, 31 aa, Entamoeba invadens
HNRTIRDIPLIQTIFIYFSNANTVVSEFDFD

SEQ ID NO: 2818683 - protein, 29 aa, Entamoeba invadens
HPCHNLKVFCLLLQKTFITYTEKVLKIFC

SEQ ID NO: 2818684 - protein, 22 aa, Entamoeba invadens
HPCYSVYWQYLDTTKYLPTFDA

SEQ ID NO: 2818685 - protein, 17 aa, Entamoeba invadens
HPDFVSISFYKMFGFPT

SEQ ID NO: 2818686 - protein, 29 aa, Entamoeba invadens
HPEPPKYILFYFINALILHFHVYGTIAII

SEQ ID NO: 2818687 - protein, 17 aa, Entamoeba invadens
HPFTLLLVFCAAKTTTD

SEQ ID NO: 2818688 - protein, 23 aa, Entamoeba invadens
HPGLYSILSQLKILSAALLSVII

SEQ ID NO: 2818689 - protein, 25 aa, Entamoeba invadens
HPILMFVVVLVWYASPKLIKNEMMK

SEQ ID NO: 2818690 - protein, 21 aa, Entamoeba invadens
HPKIVLSAYLNLTSDFNVFED

SEQ ID NO: 2818691 - protein, 30 aa, Entamoeba invadens
HPKKVHTTFPFKLLVTGGNFLFMETFVKIE

SEQ ID NO: 2818692 - protein, 20 aa, Entamoeba invadens
HPKMPWSTRLNIAVSIAKGM

SEQ ID NO: 2818693 - protein, 26 aa, Entamoeba invadens
HPKSPSLLRALFRMEWKQLLLCILAM

SEQ ID NO: 2818694 - protein, 27 aa, Entamoeba invadens
HPYQCKSCVTGFYLNTSTYTCEQGATP

SEQ ID NO: 2818695 - protein, 26 aa, Entamoeba invadens
HQETCNLFFFFEESIFFQQSLSFAVK

SEQ ID NO: 2818696 - protein, 28 aa, Entamoeba invadens
HQETGTQCFLLYDITSFTGAVKHAKSCL

SEQ ID NO: 2818697 - protein, 19 aa, Entamoeba invadens
HQIGLTQILFAFLVLTESK

SEQ ID NO: 2818698 - protein, 19 aa, Entamoeba invadens
HQIRLKICIDSAKGLFYLH

SEQ ID NO: 2818699 - protein, 19 aa, Entamoeba invadens
HQISTLVNFYNLSVTHTLS

SEQ ID NO: 2818700 - protein, 24 aa, Entamoeba invadens
HQLNSWFFYQFGDVSNFTTVTAKP

SEQ ID NO: 2818701 - protein, 17 aa, Entamoeba invadens
HQNGILHRDIKPGNILI

SEQ ID NO: 2818702 - protein, 19 aa, Entamoeba invadens
HQQYDPYFLDFLHSCFNVE

SEQ ID NO: 2818703 - protein, 23 aa, Entamoeba invadens
HQTERIFILPPTDTSVQLTPNVT

SEQ ID NO: 2818704 - protein, 19 aa, Entamoeba invadens
HRDFKPDNILIVSLEIFDK

SEQ ID NO: 2818705 - protein, 26 aa, Entamoeba invadens
HRDIKPANLLIFSYDTDEPILAKLTD

SEQ ID NO: 2818706 - protein, 18 aa, Entamoeba invadens
HRDIKPDNFLIFSLEAKD

SEQ ID NO: 2818707 - protein, 24 aa, Entamoeba invadens
HRDIKPDNFLVLSLDLNEIVNAKL

SEQ ID NO: 2818708 - protein, 20 aa, Entamoeba invadens
HRDIKPDNILIFSLDDNERV

SEQ ID NO: 2818709 - protein, 24 aa, Entamoeba invadens
HRDIKPDNILLFSLQPNVQINAKL

SEQ ID NO: 2818710 - protein, 27 aa, Entamoeba invadens
HRDIKPDNILVFLLNINDKVNAKLTDF

SEQ ID NO: 2818711 - protein, 19 aa, Entamoeba invadens
HRDIKPDNILVFSLDTIDK

SEQ ID NO: 2818712 - protein, 17 aa, Entamoeba invadens
HRDIKPDNLLVFSINLK

SEQ ID NO: 2818713 - protein, 24 aa, Entamoeba invadens
HRDIKPDNYLIFSLDINDCVNAKL

SEQ ID NO: 2818714 - protein, 18 aa, Entamoeba invadens
HRDVKGENLLIFSMNPHT

SEQ ID NO: 2818715 - protein, 27 aa, Entamoeba invadens
HRDVKPANLLIFSYDLEETILAKLTDF

SEQ ID NO: 2818716 - protein, 43 aa, Entamoeba invadens
HRGSVWNFVLWWFYGAYQSLIFFLVFYWIILPTDVNGPNGING

SEQ ID NO: 2818717 - protein, 40 aa, Entamoeba invadens
HRHLYKLLGVQSILIFIVFKIIEIFLFKKTLYKDFGFDRT

SEQ ID NO: 2818718 - protein, 24 aa, Entamoeba invadens
HRHNLSVYWYYLSLAFDFPKSTVR

SEQ ID NO: 2818719 - protein, 17 aa, Entamoeba invadens
HRHVVWYWKSENSLFLY

SEQ ID NO: 2818720 - protein, 27 aa, Entamoeba invadens
HRKVWYPVLLIWKVLYFLNRFTYFRIF

SEQ ID NO: 2818721 - protein, 22 aa, Entamoeba invadens
HRNFDRMFCHWNHNVRVFFCEL

SEQ ID NO: 2818722 - protein, 24 aa, Entamoeba invadens
HRQMCGIVIFMYAKPDIANLMKNV

SEQ ID NO: 2818723 - protein, 21 aa, Entamoeba invadens
HSAFTLRWLYTAAHPIFIVLS

SEQ ID NO: 2818724 - protein, 18 aa, Entamoeba invadens
HSCVESYILIKGTCVHFE

SEQ ID NO: 2818725 - protein, 28 aa, Entamoeba invadens
HSEINNNLFIFKFENSFLTLNKFSKINN

SEQ ID NO: 2818726 - protein, 37 aa, Entamoeba invadens
HSFDNGVDIFYYLAMQPWRHFVWTQKENNIWVTNTMN

SEQ ID NO: 2818727 - protein, 24 aa, Entamoeba invadens
HSFPFLLLLTCLATSQSCWHLNNS

SEQ ID NO: 2818728 - protein, 22 aa, Entamoeba invadens
HSFPLLFLLVDCFVFAQGNKRV

SEQ ID NO: 2818729 - protein, 25 aa, Entamoeba invadens
HSGRLSVFNYFSGVILKSVTIKSCA

SEQ ID NO: 2818730 - protein, 18 aa, Entamoeba invadens
HSKLNYIRTFYLRNGGNP

SEQ ID NO: 2818731 - protein, 17 aa, Entamoeba invadens
HSKRRLTANDIFGPLTP

SEQ ID NO: 2818732 - protein, 24 aa, Entamoeba invadens
HSLCFLRIIYVDCLFSEALMYFWI

SEQ ID NO: 2818733 - protein, 17 aa, Entamoeba invadens
HSLRYDVIIRLVGAVYT

SEQ ID NO: 2818734 - protein, 19 aa, Entamoeba invadens
HSMFLDGWSIWNGVIGDEF

SEQ ID NO: 2818735 - protein, 25 aa, Entamoeba invadens
HSNGIAFWFTQTPLKLGNAFGAEEK

SEQ ID NO: 2818736 - protein, 17 aa, Entamoeba invadens
HSNQYWCSQCNSGYFPY

SEQ ID NO: 2818737 - protein, 19 aa, Entamoeba invadens
HSPVQCTKGFLLNSHTKEC

SEQ ID NO: 2818738 - protein, 21 aa, Entamoeba invadens
HSQMCLTCHYGYVLSTIDNSC

SEQ ID NO: 2818739 - protein, 17 aa, Entamoeba invadens
HSRLLVEGIELGRQHLF

SEQ ID NO: 2818740 - protein, 26 aa, Entamoeba invadens
HSSSPVNRYFVWTPYLNVSGISKQFN

SEQ ID NO: 2818741 - protein, 20 aa, Entamoeba invadens
HSSYCRLLNNLLIGLENNTT

SEQ ID NO: 2818742 - protein, 46 aa, Entamoeba invadens
HSTCYSKPVWWVIMISCFISVFIVVCVIAVIYFVSNTILKKVDFAL

SEQ ID NO: 2818743 - protein, 24 aa, Entamoeba invadens
HSTTYLFLMIFDVMMTVLIADLVH

SEQ ID NO: 2818744 - protein, 26 aa, Entamoeba invadens
HSVIPLVLFCYIIKPDYSIWKENIDA

SEQ ID NO: 2818745 - protein, 24 aa, Entamoeba invadens
HSYISCDIGYYLLFAKCHPCSENC

SEQ ID NO: 2818746 - protein, 17 aa, Entamoeba invadens
HSYKQLTLKLRNTFIIN

SEQ ID NO: 2818747 - protein, 17 aa, Entamoeba invadens
HSYLAVDFFFLVSGFFV

SEQ ID NO: 2818748 - protein, 23 aa, Entamoeba invadens
HTCTVFLEMKSNPILYFSGELIS

SEQ ID NO: 2818749 - protein, 29 aa, Entamoeba invadens
HTDCYFAREFFYQKLLGKDYPRCGICVEV

SEQ ID NO: 2818750 - protein, 23 aa, Entamoeba invadens
HTFFFFLFINVLVQPITVAVDSN

SEQ ID NO: 2818751 - protein, 36 aa, Entamoeba invadens
HTFSSLIHPFVWQHILIPILPPKMLDLAHAPMPFII

SEQ ID NO: 2818752 - protein, 20 aa, Entamoeba invadens
HTFYQYIQSRYYRSPEVALG

SEQ ID NO: 2818753 - protein, 25 aa, Entamoeba invadens
HTGAAPILFLLCSVAMFCIPQRYFT

SEQ ID NO: 2818754 - protein, 28 aa, Entamoeba invadens
HTKIVNDLVFFFTFGKVKISLFDDSSSF

SEQ ID NO: 2818755 - protein, 23 aa, Entamoeba invadens
HTKQFMLIIFHTPNIQKYTIHFC

SEQ ID NO: 2818756 - protein, 23 aa, Entamoeba invadens
HTLIKQFDLKSIPEITIKQGVTL

SEQ ID NO: 2818757 - protein, 23 aa, Entamoeba invadens
HTLLFLFVVFTINTILYALGLPS

SEQ ID NO: 2818758 - protein, 23 aa, Entamoeba invadens
HTLTLFFHIMALNVSINSSGYAL

SEQ ID NO: 2818759 - protein, 25 aa, Entamoeba invadens
HTLVKKIPLALLKKVSMKKATPDVL

SEQ ID NO: 2818760 - protein, 18 aa, Entamoeba invadens
HTNGILHRDIKPDNFLVF

SEQ ID NO: 2818761 - protein, 27 aa, Entamoeba invadens
HTPNDPKFILNFKPQVLFLSPISKAKT

SEQ ID NO: 2818762 - protein, 29 aa, Entamoeba invadens
HTPNNPKFVFYFDPQVIFLRPKQKTTLTS

SEQ ID NO: 2818763 - protein, 34 aa, Entamoeba invadens
HTPNSPKFIFHFDPQVLYIPPSFNGKNMKIMTCY

SEQ ID NO: 2818764 - protein, 20 aa, Entamoeba invadens
HTRAVFITDLYLGSTRKLSQ

SEQ ID NO: 2818765 - protein, 28 aa, Entamoeba invadens
HTRKDYLWKEIPPLVSPPLYNMRSRVTQ

SEQ ID NO: 2818766 - protein, 19 aa, Entamoeba invadens
HTRQFLRKYKFGRPPYFYL

SEQ ID NO: 2818767 - protein, 33 aa, Entamoeba invadens
HTTKKELYSLYTFFMFLLLTKTVQSNTFDCANG

SEQ ID NO: 2818768 - protein, 18 aa, Entamoeba invadens
HTVKYRFCTKCTSCLNYI

SEQ ID NO: 2818769 - protein, 26 aa, Entamoeba invadens
HVCSYASERLYWADLSRGITKVLSEE

SEQ ID NO: 2818770 - protein, 18 aa, Entamoeba invadens
HVENELIPTILSLVVRPT

SEQ ID NO: 2818771 - protein, 18 aa, Entamoeba invadens
HVFGEVFAENGFLQRSDR

SEQ ID NO: 2818772 - protein, 17 aa, Entamoeba invadens
HVFGEVFSENGFFQRSD

SEQ ID NO: 2818773 - protein, 17 aa, Entamoeba invadens
HVGPECTLRCKLFNYNT

SEQ ID NO: 2818774 - protein, 26 aa, Entamoeba invadens
HVISYFYLIKICPFTLSFLQSPLQVL

SEQ ID NO: 2818775 - protein, 25 aa, Entamoeba invadens
HVLFNGYLIILKYFSSFTGKNVLFL

SEQ ID NO: 2818776 - protein, 17 aa, Entamoeba invadens
HVMQIVRPLGVTRLWGA

SEQ ID NO: 2818777 - protein, 24 aa, Entamoeba invadens
HVPIWRYLVFIPCMVICVGLCILS

SEQ ID NO: 2818778 - protein, 18 aa, Entamoeba invadens
HVSALYLAILGLLSALVG

SEQ ID NO: 2818779 - protein, 17 aa, Entamoeba invadens
HVSLFMTLSIQGFFCFP

SEQ ID NO: 2818780 - protein, 25 aa, Entamoeba invadens
HVTNIYFLLVAIISLIPQISATNPV

SEQ ID NO: 2818781 - protein, 22 aa, Entamoeba invadens
HVTPLIFVLTVAVLKELFDEVH

SEQ ID NO: 2818782 - protein, 26 aa, Entamoeba invadens
HVVLDFLLILFALLMFCNHWFTYTLF

SEQ ID NO: 2818783 - protein, 18 aa, Entamoeba invadens
HVYGEIFAENGFLQRSDK

SEQ ID NO: 2818784 - protein, 17 aa, Entamoeba invadens
HVYIVRRKNMKVFEDGE

SEQ ID NO: 2818785 - protein, 19 aa, Entamoeba invadens
HYDRPCEDDECRKCTGGVV

SEQ ID NO: 2818786 - protein, 18 aa, Entamoeba invadens
HYIMDRYIIPTFNGFCVI

SEQ ID NO: 2818787 - protein, 19 aa, Entamoeba invadens
HYNNQNTLLKLCPDHFLLS

SEQ ID NO: 2818788 - protein, 29 aa, Entamoeba invadens
HYSFVPQPILLFGLFLAVLMYFIPMIVGY

SEQ ID NO: 2818789 - protein, 28 aa, Entamoeba invadens
HYSSKLDVYKLNYGFPQSPDFIEEADKE

SEQ ID NO: 2818790 - protein, 31 aa, Entamoeba invadens
HYSTPAYVVFFLVRLVPEFMLHLQNGVFDKP

SEQ ID NO: 2818791 - protein, 17 aa, Entamoeba invadens
HYVVLFLASYTQSNHHE

SEQ ID NO: 2818792 - protein, 19 aa, Entamoeba invadens
IAAIKLNKWNLLKKGRVLI

SEQ ID NO: 2818793 - protein, 20 aa, Entamoeba invadens
IAAIPPWETFYNFWERVISI

SEQ ID NO: 2818794 - protein, 27 aa, Entamoeba invadens
IAALNGSYVTLKWLLTKGANPNAENCM

SEQ ID NO: 2818795 - protein, 17 aa, Entamoeba invadens
IACKKIIETFFGFMVKT

SEQ ID NO: 2818796 - protein, 32 aa, Entamoeba invadens
IADLFSITTLIRAVIFLIKQSGIWVKRTALMI

SEQ ID NO: 2818797 - protein, 22 aa, Entamoeba invadens
IADVILPVYALIVKGGKYNKIE

SEQ ID NO: 2818798 - protein, 20 aa, Entamoeba invadens
IADYVNSQHICTTCFAPYVT

SEQ ID NO: 2818799 - protein, 17 aa, Entamoeba invadens
IAEFVISGKGLPNKEII

SEQ ID NO: 2818800 - protein, 24 aa, Entamoeba invadens
IAEKVIAKVYLPDGAKYTKCTGLG

SEQ ID NO: 2818801 - protein, 18 aa, Entamoeba invadens
IAFFLFVVYGQNCYYNQI

SEQ ID NO: 2818802 - protein, 33 aa, Entamoeba invadens
IAGGLILIAVILVFIFLLWRRRRRTEKERETEI

SEQ ID NO: 2818803 - protein, 21 aa, Entamoeba invadens
IAGIVIGVIIFVAVSALLIGV

SEQ ID NO: 2818804 - protein, 33 aa, Entamoeba invadens
IAGLIGHAIILLLLYVVTLFLIKRFDRNNYKNE

SEQ ID NO: 2818805 - protein, 33 aa, Entamoeba invadens
IAGLVIVVVVVVLILFLIWRRRLAVEKERKKSF

SEQ ID NO: 2818806 - protein, 28 aa, Entamoeba invadens
IAGPVCYTLFALHFFTPQFKTMSEQKRK

SEQ ID NO: 2818807 - protein, 17 aa, Entamoeba invadens
IAGTIVITVLIISLCAY

SEQ ID NO: 2818808 - protein, 20 aa, Entamoeba invadens
IAHCDVCFPPFSPQNGDCVS

SEQ ID NO: 2818809 - protein, 19 aa, Entamoeba invadens
IAHKPIGMLFNYITKKKDS

SEQ ID NO: 2818810 - protein, 31 aa, Entamoeba invadens
IAIIMCVLYIVFWMFTLYPGGGVFVIWYCVV

SEQ ID NO: 2818811 - protein, 31 aa, Entamoeba invadens
IAILSMYKYANWFDYTLLLVGIVGAIGVGIL

SEQ ID NO: 2818812 - protein, 21 aa, Entamoeba invadens
IAIPDGTFVNCTILSTVTGFE

SEQ ID NO: 2818813 - protein, 24 aa, Entamoeba invadens
IAITTLIIIYLVKHIKKQEEMYRY

SEQ ID NO: 2818814 - protein, 26 aa, Entamoeba invadens
IAKKRLPRLFAWKQFHSYIRELGIDE

SEQ ID NO: 2818815 - protein, 17 aa, Entamoeba invadens
IAKLFLLQTYSFDFPTP

SEQ ID NO: 2818816 - protein, 26 aa, Entamoeba invadens
IAKLSMFVFPRYLSIFSIAVFLSTII

SEQ ID NO: 2818817 - protein, 24 aa, Entamoeba invadens
IAKNLREMYWQYNSLHSYIKNDPI

SEQ ID NO: 2818818 - protein, 17 aa, Entamoeba invadens
IAKQLLLTESMKSVFVL

SEQ ID NO: 2818819 - protein, 22 aa, Entamoeba invadens
IALFDYDLTWDYIKRYPQSHRE

SEQ ID NO: 2818820 - protein, 23 aa, Entamoeba invadens
IALFLCVLGFYRGTHISIERIFL

SEQ ID NO: 2818821 - protein, 25 aa, Entamoeba invadens
IALLLRLVHIFPDTKLRVPLRGFFV

SEQ ID NO: 2818822 - protein, 20 aa, Entamoeba invadens
IALLNQFCSIKLQKPFKQSV

SEQ ID NO: 2818823 - protein, 23 aa, Entamoeba invadens
IALNKIVFLFEKFNAETSAEYVN

SEQ ID NO: 2818824 - protein, 27 aa, Entamoeba invadens
IALTIVIVSVFLAIGFIGLVLNKRFQM

SEQ ID NO: 2818825 - protein, 20 aa, Entamoeba invadens
IALVFFFLNNVVVAGYFILD

SEQ ID NO: 2818826 - protein, 22 aa, Entamoeba invadens
IALVSFVFFIISTVFTIFVVGY

SEQ ID NO: 2818827 - protein, 18 aa, Entamoeba invadens
IALWTIQNEMPLCIILRE

SEQ ID NO: 2818828 - protein, 35 aa, Entamoeba invadens
IALYSYGNGKWWVIKHLYELFLFVKGTEASDITFD

SEQ ID NO: 2818829 - protein, 18 aa, Entamoeba invadens
IAMLFIATSNGMIHCLDG

SEQ ID NO: 2818830 - protein, 23 aa, Entamoeba invadens
IAMPDCRIVFLLFSSIPSTCVGN

SEQ ID NO: 2818831 - protein, 26 aa, Entamoeba invadens
IAMPDCRIVFLLFSSIPSTCVGNFKR

SEQ ID NO: 2818832 - protein, 19 aa, Entamoeba invadens
IAPFMILGTIFMGSSTKVT

SEQ ID NO: 2818833 - protein, 18 aa, Entamoeba invadens
IAPIVIVVLMIFTGFFIQ

SEQ ID NO: 2818834 - protein, 24 aa, Entamoeba invadens
IAQIPVFILLIIAFVFLTLIKNHH

SEQ ID NO: 2818835 - protein, 25 aa, Entamoeba invadens
IAQYKKQLLPPDLIDVILPLDRAEK

SEQ ID NO: 2818836 - protein, 34 aa, Entamoeba invadens
IAREALVDVILLLPIICIVLYFIGAICKCHFLTI

SEQ ID NO: 2818837 - protein, 25 aa, Entamoeba invadens
IASIGISVFFPPAAPYVLVGAGVML

SEQ ID NO: 2818838 - protein, 24 aa, Entamoeba invadens
IASPNLFNLISIPQVFKIGDQVRF

SEQ ID NO: 2818839 - protein, 18 aa, Entamoeba invadens
IATIPYVGLVIYLSNIFY

SEQ ID NO: 2818840 - protein, 24 aa, Entamoeba invadens
IATLIMVLILLFKLVIATVVGFAN

SEQ ID NO: 2818841 - protein, 28 aa, Entamoeba invadens
IATLLEMATLFFLFIFSGTFKNSTNLRG

SEQ ID NO: 2818842 - protein, 27 aa, Entamoeba invadens
IATVSLVIFYIFKVIYWVFSGLQIKSG

SEQ ID NO: 2818843 - protein, 22 aa, Entamoeba invadens
IAVIPFSIFSDPQKIPILIEFV

SEQ ID NO: 2818844 - protein, 24 aa, Entamoeba invadens
IAVRPYPENVAFAQLLIRAGNDVG

SEQ ID NO: 2818845 - protein, 30 aa, Entamoeba invadens
IAVSVSCAIFVFFIIFVGAALIVGLVVRSA

SEQ ID NO: 2818846 - protein, 19 aa, Entamoeba invadens
IAVTILTFIFALTLSLFVA

SEQ ID NO: 2818847 - protein, 21 aa, Entamoeba invadens
IAVVVVLIILKRKSSANYSSF

SEQ ID NO: 2818848 - protein, 31 aa, Entamoeba invadens
IAVVYSIYIIAFFILLTYFVIKYKQINDVIA

SEQ ID NO: 2818849 - protein, 18 aa, Entamoeba invadens
IAWLNPRPGSHAQHEQIY

SEQ ID NO: 2818850 - protein, 38 aa, Entamoeba invadens
IAYELPVKLPFHYPLWKAMIAITLLLTPIALDVAGFYK

SEQ ID NO: 2818851 - protein, 20 aa, Entamoeba invadens
ICADGYYLYNGACVPCTTKF

SEQ ID NO: 2818852 - protein, 22 aa, Entamoeba invadens
ICASFFFIMVSSGFVMVHKATE

SEQ ID NO: 2818853 - protein, 28 aa, Entamoeba invadens
ICCFGIPRKVRGFVWYALLLKPEDANDI

SEQ ID NO: 2818854 - protein, 25 aa, Entamoeba invadens
ICCIAILFLVVKWRMAKQVDSEEKS

SEQ ID NO: 2818855 - protein, 25 aa, Entamoeba invadens
ICCYPQKFRQGRWFKFNLSQMTKDH

SEQ ID NO: 2818856 - protein, 47 aa, Entamoeba invadens
ICETKSLWWISLVVIISIFFVILVIVLYFLLTFISKKVLKVKQENTI

SEQ ID NO: 2818857 - protein, 25 aa, Entamoeba invadens
ICFPERMYKCVLFTLEYNGNYSLLI

SEQ ID NO: 2818858 - protein, 25 aa, Entamoeba invadens
ICFQKAICLALLGFFGNFTIKIPKK

SEQ ID NO: 2818859 - protein, 36 aa, Entamoeba invadens
ICFVFGVLYFAWYLLMYPIFLKFIKPNTHLFYRENV

SEQ ID NO: 2818860 - protein, 18 aa, Entamoeba invadens
ICGFLGCILIVIGLALGS

SEQ ID NO: 2818861 - protein, 19 aa, Entamoeba invadens
ICGTMSVLFVIIVTPGIAY

SEQ ID NO: 2818862 - protein, 19 aa, Entamoeba invadens
ICGVIWGLWHAPLVYFGHN

SEQ ID NO: 2818863 - protein, 17 aa, Entamoeba invadens
ICHRCLKGFYLSNGICK

SEQ ID NO: 2818864 - protein, 30 aa, Entamoeba invadens
ICIGINFALWYYGIVPSDPMFFFVLCVESS

SEQ ID NO: 2818865 - protein, 17 aa, Entamoeba invadens
ICINYKSISIVLSCGNN

SEQ ID NO: 2818866 - protein, 26 aa, Entamoeba invadens
ICLDKNFYFISLNSIGSLILSSSNVF

SEQ ID NO: 2818867 - protein, 18 aa, Entamoeba invadens
ICLFAYIVFFTTLGFIKD

SEQ ID NO: 2818868 - protein, 27 aa, Entamoeba invadens
ICLKGNLMIIAITTSGFVFGSYNSMTF

SEQ ID NO: 2818869 - protein, 24 aa, Entamoeba invadens
ICLTITMVVTFVALTVMVANIVDI

SEQ ID NO: 2818870 - protein, 19 aa, Entamoeba invadens
ICLVLYIYASWTFFEDRIP

SEQ ID NO: 2818871 - protein, 19 aa, Entamoeba invadens
ICLVTEFALLGSLQDLIKH

SEQ ID NO: 2818872 - protein, 26 aa, Entamoeba invadens
ICMCMYVYNYYLYPSPLKGVAPLDCV

SEQ ID NO: 2818873 - protein, 17 aa, Entamoeba invadens
ICMLCGAPLCSENYCLI

SEQ ID NO: 2818874 - protein, 17 aa, Entamoeba invadens
ICMVAGSVKPFFRTLPF

SEQ ID NO: 2818875 - protein, 22 aa, Entamoeba invadens
ICNECKLPFYPSQSGQNIGQCI

SEQ ID NO: 2818876 - protein, 20 aa, Entamoeba invadens
ICNNGYYLDNNMCSLCNSIS

SEQ ID NO: 2818877 - protein, 26 aa, Entamoeba invadens
ICNSYEICTYCYPNFYLDNGICLFCQ

SEQ ID NO: 2818878 - protein, 27 aa, Entamoeba invadens
ICNSYEICTYCYPNFYLDNGKCLSCQF

SEQ ID NO: 2818879 - protein, 17 aa, Entamoeba invadens
ICNTCQIGYFPEIQCKS

SEQ ID NO: 2818880 - protein, 34 aa, Entamoeba invadens
ICPDHKIRWYGYLIQFIVLMFPLVNLTSEYPLVS

SEQ ID NO: 2818881 - protein, 17 aa, Entamoeba invadens
ICRVCRDGFYFKDKKCV

SEQ ID NO: 2818882 - protein, 17 aa, Entamoeba invadens
ICSFFAIFFVKFVSTIF

SEQ ID NO: 2818883 - protein, 25 aa, Entamoeba invadens
ICSFGYLCFLIIFKWCAPFQEGAPM

SEQ ID NO: 2818884 - protein, 19 aa, Entamoeba invadens
ICSNYIVITRFSKDEKTIC

SEQ ID NO: 2818885 - protein, 19 aa, Entamoeba invadens
ICTACMAEYKLEGGKCNGA

SEQ ID NO: 2818886 - protein, 26 aa, Entamoeba invadens
ICTDFNYRPQLFNSFFFRFERGQNGI

SEQ ID NO: 2818887 - protein, 24 aa, Entamoeba invadens
ICTIFVTIIILPIQTKSILDIVSQ

SEQ ID NO: 2818888 - protein, 22 aa, Entamoeba invadens
ICTLCIDYYYYNQTNKTCLQYN

SEQ ID NO: 2818889 - protein, 18 aa, Entamoeba invadens
ICTPMITNCKYQKSFKGV

SEQ ID NO: 2818890 - protein, 18 aa, Entamoeba invadens
ICTSCFAPYSLNVNTRRC

SEQ ID NO: 2818891 - protein, 17 aa, Entamoeba invadens
ICTSCNFGYYLSDFICV

SEQ ID NO: 2818892 - protein, 26 aa, Entamoeba invadens
ICVGRRPPCLIGMDPTLFDIIANCWE

SEQ ID NO: 2818893 - protein, 19 aa, Entamoeba invadens
ICVMCPDMQYSFAGSTMCK

SEQ ID NO: 2818894 - protein, 33 aa, Entamoeba invadens
ICVMSLISTFLLSRIIMLYGLNITVPSLKENLL

SEQ ID NO: 2818895 - protein, 28 aa, Entamoeba invadens
ICVRMFTRYGLLSIYVPSAQPTYAKREI

SEQ ID NO: 2818896 - protein, 50 aa, Entamoeba invadens
ICVTQFTLGLLSPFLMCMFSVLVMLVFFFRHHLSRFYFLVPTIPNTDMSS

SEQ ID NO: 2818897 - protein, 18 aa, Entamoeba invadens
ICWIPGTAFFYTVEHLLW

SEQ ID NO: 2818898 - protein, 17 aa, Entamoeba invadens
ICYFNCIRLPFMNFGYF

SEQ ID NO: 2818899 - protein, 21 aa, Entamoeba invadens
ICYLIPNCKNGYYDNATLKCT

SEQ ID NO: 2818900 - protein, 31 aa, Entamoeba invadens
IDATSQHVILVQMVFIWTMGSVQHVKQNISI

SEQ ID NO: 2818901 - protein, 34 aa, Entamoeba invadens
IDAYTKDFYYYLLPPLVLYLFDVLLRITHICVPG

SEQ ID NO: 2818902 - protein, 23 aa, Entamoeba invadens
IDCTLCPLGYYSNGGASQCTACL

SEQ ID NO: 2818903 - protein, 19 aa, Entamoeba invadens
IDCVTKGCLTCDATKCLSC

SEQ ID NO: 2818904 - protein, 55 aa, Entamoeba invadens
IDDRISVFKIFHVFQSLMILHIICSPFHLAVTLFWLLFPLRSFSQTYCAAGTYPL

SEQ ID NO: 2818905 - protein, 23 aa, Entamoeba invadens
IDDVLVYSTCWRLAHSELEIENF

SEQ ID NO: 2818906 - protein, 23 aa, Entamoeba invadens
IDEDLLLMIAIGHPDTKFVENLP

SEQ ID NO: 2818907 - protein, 21 aa, Entamoeba invadens
IDEDYYIYYYGNDTIIPTPIA

SEQ ID NO: 2818908 - protein, 25 aa, Entamoeba invadens
IDEEKHICFLKPVNCLEYENNIYRG

SEQ ID NO: 2818909 - protein, 23 aa, Entamoeba invadens
IDEKFRIVYTRDLSTVTPLVYID

SEQ ID NO: 2818910 - protein, 18 aa, Entamoeba invadens
IDEKNYFERITPFVTKMI

SEQ ID NO: 2818911 - protein, 24 aa, Entamoeba invadens
IDERFRIVYTRNVFTTVPLVYIDG

SEQ ID NO: 2818912 - protein, 37 aa, Entamoeba invadens
IDFASECIRWLGAFRFILWTLWYCVKLMCTKMVVKVK

SEQ ID NO: 2818913 - protein, 26 aa, Entamoeba invadens
IDFKKYLQIQPIYFYDIIGSSEITKT

SEQ ID NO: 2818914 - protein, 33 aa, Entamoeba invadens
IDFSRRKWFCFVFLIGFVIFSFAIYYGDWKKEA

SEQ ID NO: 2818915 - protein, 40 aa, Entamoeba invadens
IDFVGWIAICVAIVVILFVILAIYLFYRFRPKKVEEPLKS

SEQ ID NO: 2818916 - protein, 26 aa, Entamoeba invadens
IDGKGFLSVGFFYPTEMLISQDFKEL

SEQ ID NO: 2818917 - protein, 17 aa, Entamoeba invadens
IDGYYLNGKTCKKCGEN

SEQ ID NO: 2818918 - protein, 18 aa, Entamoeba invadens
IDIDMKIKFMLDAAKGIE

SEQ ID NO: 2818919 - protein, 27 aa, Entamoeba invadens
IDIKEFILFVFYSLFSFEMTFFIFVQD

SEQ ID NO: 2818920 - protein, 21 aa, Entamoeba invadens
IDKFIFKVEPEVVLIKRGRAC

SEQ ID NO: 2818921 - protein, 17 aa, Entamoeba invadens
IDKLFGVSFNYLNDKKS

SEQ ID NO: 2818922 - protein, 17 aa, Entamoeba invadens
IDKNCFKCKDPCYHCSG

SEQ ID NO: 2818923 - protein, 24 aa, Entamoeba invadens
IDKNMRIKILLDASKGVKYLHDND

SEQ ID NO: 2818924 - protein, 25 aa, Entamoeba invadens
IDLLPLTMIDYLTSPMTYLIGICQE

SEQ ID NO: 2818925 - protein, 27 aa, Entamoeba invadens
IDLQGMELYFFPLFHNFPSLENVTKLC

SEQ ID NO: 2818926 - protein, 29 aa, Entamoeba invadens
IDLSVLLMESPFLNLFDWNDDLNTPLHYL

SEQ ID NO: 2818927 - protein, 17 aa, Entamoeba invadens
IDLWFELCRTVQFQEFI

SEQ ID NO: 2818928 - protein, 18 aa, Entamoeba invadens
IDMKMRVKMLLDAANGIS

SEQ ID NO: 2818929 - protein, 18 aa, Entamoeba invadens
IDMKMRVKMLLDATNGIS

SEQ ID NO: 2818930 - protein, 33 aa, Entamoeba invadens
IDMWSLGCLTAVFYFGVPLFSTKSEYSLLRRMV

SEQ ID NO: 2818931 - protein, 26 aa, Entamoeba invadens
IDNDFSLPTFPFTVNGGFIVNGVLTI

SEQ ID NO: 2818932 - protein, 19 aa, Entamoeba invadens
IDNDKFVCVLGYSNTTHFN

SEQ ID NO: 2818933 - protein, 32 aa, Entamoeba invadens
IDNETKWKWGEYKQFHMIGYINQSSLIILNAD

SEQ ID NO: 2818934 - protein, 18 aa, Entamoeba invadens
IDNILYIDDTWLYSNTIT

SEQ ID NO: 2818935 - protein, 29 aa, Entamoeba invadens
IDNYILTNKQCVYKRLLGCETYDREKQTC

SEQ ID NO: 2818936 - protein, 20 aa, Entamoeba invadens
IDNYNFAFGYPQSDEFMAEA

SEQ ID NO: 2818937 - protein, 23 aa, Entamoeba invadens
IDNYYNFMFILSAVLIAITSFVT

SEQ ID NO: 2818938 - protein, 25 aa, Entamoeba invadens
IDPERTINDLLLIWNVRKPADKNET

SEQ ID NO: 2818939 - protein, 34 aa, Entamoeba invadens
IDREQRRVIINKPFFFILVDSKSLPLFFGKCTHP

SEQ ID NO: 2818940 - protein, 33 aa, Entamoeba invadens
IDSALSFMFSVSWSSVLYLAQDLGIFSTLLPKP

SEQ ID NO: 2818941 - protein, 27 aa, Entamoeba invadens
IDSESRVHLFPYSIVRGNGYIREMDVQ

SEQ ID NO: 2818942 - protein, 17 aa, Entamoeba invadens
IDSVIVELLPNGTYNYT

SEQ ID NO: 2818943 - protein, 17 aa, Entamoeba invadens
IDTFLSYFPLNHEDSLK

SEQ ID NO: 2818944 - protein, 28 aa, Entamoeba invadens
IDTVFICFLMFYVLIMFDALRKPIKQRM

SEQ ID NO: 2818945 - protein, 18 aa, Entamoeba invadens
IDVFILKMESASLGVVVS

SEQ ID NO: 2818946 - protein, 24 aa, Entamoeba invadens
IDVLFNGAFVVSKLLCVAKKNGED

SEQ ID NO: 2818947 - protein, 30 aa, Entamoeba invadens
IDVLLTTEMKVFLFLLDGFGNYRTHFNFSQ

SEQ ID NO: 2818948 - protein, 18 aa, Entamoeba invadens
IDVSMLITFSLQGYFCFP

SEQ ID NO: 2818949 - protein, 26 aa, Entamoeba invadens
IDVTDKFFLYAPDPQSPLATKIEFLE

SEQ ID NO: 2818950 - protein, 25 aa, Entamoeba invadens
IDWKTSFFPLTNFTKTLSFLVEPKS

SEQ ID NO: 2818951 - protein, 17 aa, Entamoeba invadens
IDWLIIVSRILMIIVVV

SEQ ID NO: 2818952 - protein, 24 aa, Entamoeba invadens
IDYHVINLKTLFIREKYSYHSFYI

SEQ ID NO: 2818953 - protein, 32 aa, Entamoeba invadens
IDYIYIIHSFFKRYLVPFELLKRNISGSHPKS

SEQ ID NO: 2818954 - protein, 24 aa, Entamoeba invadens
IDYTFNPLLFKDSLLSILTGIVCG

SEQ ID NO: 2818955 - protein, 25 aa, Entamoeba invadens
IDYYTLQFIEFGFDSVLSIQDVCPS

SEQ ID NO: 2818956 - protein, 29 aa, Entamoeba invadens
IEADEMATLFFLFIGLFKSSVLIENDFTS

SEQ ID NO: 2818957 - protein, 18 aa, Entamoeba invadens
IEADQFVFTLLKLKNALA

SEQ ID NO: 2818958 - protein, 23 aa, Entamoeba invadens
IECKEMYFNYPGSLSKLCLSYET

SEQ ID NO: 2818959 - protein, 18 aa, Entamoeba invadens
IECKFWYTPSEDGTYCAS

SEQ ID NO: 2818960 - protein, 25 aa, Entamoeba invadens
IECWDLTLVILSSLPFVVLSTSFIG

SEQ ID NO: 2818961 - protein, 24 aa, Entamoeba invadens
IECYGCLIGYYLDKNDCLECPSIC

SEQ ID NO: 2818962 - protein, 25 aa, Entamoeba invadens
IEDEDLLFVLSRYKEYLTLKTQIKS

SEQ ID NO: 2818963 - protein, 17 aa, Entamoeba invadens
IEDLKVFKYKIVKEFIF

SEQ ID NO: 2818964 - protein, 20 aa, Entamoeba invadens
IEEQIFKKSFPYISYYRLDG

SEQ ID NO: 2818965 - protein, 18 aa, Entamoeba invadens
IEFIADECNLPILTESRE

SEQ ID NO: 2818966 - protein, 18 aa, Entamoeba invadens
IEFPRKCGLIQCDGVAQG

SEQ ID NO: 2818967 - protein, 25 aa, Entamoeba invadens
IEGKYSYCLPIPREDNCKYLTTSNS

SEQ ID NO: 2818968 - protein, 24 aa, Entamoeba invadens
IEGNLVRLYIKNKIQTKYVNINNL

SEQ ID NO: 2818969 - protein, 25 aa, Entamoeba invadens
IEHGLCEVAIVYYLFKSLYGDNVAG

SEQ ID NO: 2818970 - protein, 25 aa, Entamoeba invadens
IEIKLRIKFMLDASKGILYLHTNGI

SEQ ID NO: 2818971 - protein, 32 aa, Entamoeba invadens
IEIPLNVIINKPFFFVIVDPHSLPIFFGKCTT

SEQ ID NO: 2818972 - protein, 31 aa, Entamoeba invadens
IEISKKYIAATYLITFIIGVLGKYAQPEDSE

SEQ ID NO: 2818973 - protein, 31 aa, Entamoeba invadens
IEITDWYSVIFAPDKFWTFIREYEDVKYLNF

SEQ ID NO: 2818974 - protein, 19 aa, Entamoeba invadens
IEIYRNGNIPMFGPLIHGD

SEQ ID NO: 2818975 - protein, 35 aa, Entamoeba invadens
IEKIQWLCRLPFQFLFATLYWAYKKLILCQWSKKN

SEQ ID NO: 2818976 - protein, 25 aa, Entamoeba invadens
IEKLSWTINTYYIISGSTLTLMGRA

SEQ ID NO: 2818977 - protein, 19 aa, Entamoeba invadens
IEKTKRDGELLKTEKEKVI

SEQ ID NO: 2818978 - protein, 25 aa, Entamoeba invadens
IELKKRYVFQLFIGNKSLNIASFAI

SEQ ID NO: 2818979 - protein, 22 aa, Entamoeba invadens
IELKVAFNIKSLIYANVITITQ

SEQ ID NO: 2818980 - protein, 24 aa, Entamoeba invadens
IELMKQICQLLLSSASMEYNDMFL

SEQ ID NO: 2818981 - protein, 18 aa, Entamoeba invadens
IELVIKRGGLSEQSTLIA

SEQ ID NO: 2818982 - protein, 24 aa, Entamoeba invadens
IEMASILFYNKTSLRIEADPFPLF

SEQ ID NO: 2818983 - protein, 25 aa, Entamoeba invadens
IEMKLRIKLMLDTLSGILYLHTNGI

SEQ ID NO: 2818984 - protein, 26 aa, Entamoeba invadens
IENFNNKVLYCKPTFYFKKTKCDYCG

SEQ ID NO: 2818985 - protein, 22 aa, Entamoeba invadens
IENLQKQYLFLKSFKDAEYILD

SEQ ID NO: 2818986 - protein, 22 aa, Entamoeba invadens
IENMWVIYVLYITALIPSFLSY

SEQ ID NO: 2818987 - protein, 18 aa, Entamoeba invadens
IENSFLSITSLKKFNCLS

SEQ ID NO: 2818988 - protein, 19 aa, Entamoeba invadens
IEQLKTLVLTHKLPVVQVK

SEQ ID NO: 2818989 - protein, 24 aa, Entamoeba invadens
IEQRKIFISFLFDGVRSQSIAQFA

SEQ ID NO: 2818990 - protein, 23 aa, Entamoeba invadens
IEQSTIPMLFMSDNGFLVEINET

SEQ ID NO: 2818991 - protein, 27 aa, Entamoeba invadens
IERMGGWFKVVISLIVSLVIVSVGVIV

SEQ ID NO: 2818992 - protein, 20 aa, Entamoeba invadens
IERRTIGVYSLLYKRLTSGV

SEQ ID NO: 2818993 - protein, 23 aa, Entamoeba invadens
IESKSFCIKKWKNLIEEYESNIN

SEQ ID NO: 2818994 - protein, 24 aa, Entamoeba invadens
IETELLIQIPYNENLILKFTKERK

SEQ ID NO: 2818995 - protein, 17 aa, Entamoeba invadens
IETLDMLVRGGIKVWVI

SEQ ID NO: 2818996 - protein, 17 aa, Entamoeba invadens
IETLFYYGTSEPILGKD

SEQ ID NO: 2818997 - protein, 31 aa, Entamoeba invadens
IEVTKIRFNIYPEPLQLRFSFYDMDFCKMTA

SEQ ID NO: 2818998 - protein, 31 aa, Entamoeba invadens
IEVTVLCTLKFQSSFLLVANLFEKEKAICKE

SEQ ID NO: 2818999 - protein, 17 aa, Entamoeba invadens
IEWFYGLWVIYGIIFLV

SEQ ID NO: 2819000 - protein, 17 aa, Entamoeba invadens
IEWLIVMVDFYIEKKRS

SEQ ID NO: 2819001 - protein, 20 aa, Entamoeba invadens
IEWLRLQDYRLPPSTDKLLP

SEQ ID NO: 2819002 - protein, 17 aa, Entamoeba invadens
IEWSAFPVLKTIVIFLV

SEQ ID NO: 2819003 - protein, 19 aa, Entamoeba invadens
IEYITINLQFFPFSTQKVS

SEQ ID NO: 2819004 - protein, 35 aa, Entamoeba invadens
IEYPKIDSPPLVLWDSYYLHLNYNYHGRPNFSIIN

SEQ ID NO: 2819005 - protein, 32 aa, Entamoeba invadens
IFAFCQNKQLLACHFLWLLKNGVCSLGLKAEN

SEQ ID NO: 2819006 - protein, 28 aa, Entamoeba invadens
IFAILAVLLYLLFVEIPFVFQALLNFVS

SEQ ID NO: 2819007 - protein, 19 aa, Entamoeba invadens
IFANLIEKSWQHKVSMRPS

SEQ ID NO: 2819008 - protein, 18 aa, Entamoeba invadens
IFCSMLVRYLVPENRNLI

SEQ ID NO: 2819009 - protein, 26 aa, Entamoeba invadens
IFDEKKLRFYLDPTSSKFLLNSVIEF

SEQ ID NO: 2819010 - protein, 29 aa, Entamoeba invadens
IFDIEMLGLIFVWVLKNLKKEVLVEWIKN

SEQ ID NO: 2819011 - protein, 18 aa, Entamoeba invadens
IFEIFKCNTNTILKTNEG

SEQ ID NO: 2819012 - protein, 24 aa, Entamoeba invadens
IFEIIALLWYLFSYIPYGQEMLKK

SEQ ID NO: 2819013 - protein, 24 aa, Entamoeba invadens
IFEKDGVVLLYNLQSNVIQIKCSN

SEQ ID NO: 2819014 - protein, 22 aa, Entamoeba invadens
IFFALLLPLTLTLYTSEKTSPQ

SEQ ID NO: 2819015 - protein, 20 aa, Entamoeba invadens
IFFGTLIYVISRWALVPLVT

SEQ ID NO: 2819016 - protein, 17 aa, Entamoeba invadens
IFFILGFFCYCIWIVAF

SEQ ID NO: 2819017 - protein, 18 aa, Entamoeba invadens
IFFILGFFCYCIWIVAFC

SEQ ID NO: 2819018 - protein, 26 aa, Entamoeba invadens
IFGFSFMLISLIFIFVPLSYARRAWP

SEQ ID NO: 2819019 - protein, 20 aa, Entamoeba invadens
IFGILLMKYRGCRDKALRET

SEQ ID NO: 2819020 - protein, 17 aa, Entamoeba invadens
IFGINYYSDLTPKEMGI

SEQ ID NO: 2819021 - protein, 23 aa, Entamoeba invadens
IFGLIGLPVVIFFVSSEKYILTT

SEQ ID NO: 2819022 - protein, 18 aa, Entamoeba invadens
IFGLVLSEQRKDLREVLA

SEQ ID NO: 2819023 - protein, 24 aa, Entamoeba invadens
IFGPKLLHITIPTTLTQIGKNVLD

SEQ ID NO: 2819024 - protein, 23 aa, Entamoeba invadens
IFGSWYKLRIRENVNYRLYGGVI

SEQ ID NO: 2819025 - protein, 24 aa, Entamoeba invadens
IFGVITFVIILTSLNFKFIKRQAM

SEQ ID NO: 2819026 - protein, 19 aa, Entamoeba invadens
IFGVLVIVMIVLTLICIVV

SEQ ID NO: 2819027 - protein, 21 aa, Entamoeba invadens
IFGWLITLWYLIKVDMSFKDN

SEQ ID NO: 2819028 - protein, 20 aa, Entamoeba invadens
IFHFFAIVMIFYNQKRYHKT

SEQ ID NO: 2819029 - protein, 19 aa, Entamoeba invadens
IFIECPFYVKNLTKTPKVV

SEQ ID NO: 2819030 - protein, 26 aa, Entamoeba invadens
IFIGLLFAFFIFALYHNYIKLAQTRN

SEQ ID NO: 2819031 - protein, 35 aa, Entamoeba invadens
IFITHWCATLTYTTFLLLFLISAASSWCLTVMTFS

SEQ ID NO: 2819032 - protein, 19 aa, Entamoeba invadens
IFKFPWKIAEFVTSGQRPE

SEQ ID NO: 2819033 - protein, 19 aa, Entamoeba invadens
IFKNGWVVMLFSLPMGMVA

SEQ ID NO: 2819034 - protein, 18 aa, Entamoeba invadens
IFKTCMIIIGIGAGAFCA

SEQ ID NO: 2819035 - protein, 17 aa, Entamoeba invadens
IFKVLTQNFDITTQNDL

SEQ ID NO: 2819036 - protein, 31 aa, Entamoeba invadens
IFKVMHYLRYAIIVFWLVCALGFCYPALKFL

SEQ ID NO: 2819037 - protein, 24 aa, Entamoeba invadens
IFKVYTFIFCLYLFNKSIYVHHNY

SEQ ID NO: 2819038 - protein, 17 aa, Entamoeba invadens
IFLGLVAAFFFITPTEI

SEQ ID NO: 2819039 - protein, 25 aa, Entamoeba invadens
IFLLSVGFFIFIEAIQRFIDIEEIT

SEQ ID NO: 2819040 - protein, 20 aa, Entamoeba invadens
IFLTLPIGVIIVCALALIIT

SEQ ID NO: 2819041 - protein, 21 aa, Entamoeba invadens
IFLVMKLFYLKNHNWDSFLSM

SEQ ID NO: 2819042 - protein, 31 aa, Entamoeba invadens
IFMFSIAFEWKMIWVMLTWLCIYNTIESVDF

SEQ ID NO: 2819043 - protein, 23 aa, Entamoeba invadens
IFNFSTFTMLLFAIAIDSTLIIE

SEQ ID NO: 2819044 - protein, 29 aa, Entamoeba invadens
IFNFTGIFGFFLLFIIPAVLQIYSKFIIR

SEQ ID NO: 2819045 - protein, 18 aa, Entamoeba invadens
IFNMKKSNISFTKLNDFL

SEQ ID NO: 2819046 - protein, 30 aa, Entamoeba invadens
IFNPITFMLHRFIRLFPMQLFGTCLLSATF

SEQ ID NO: 2819047 - protein, 18 aa, Entamoeba invadens
IFNSIKLPFQSFGFLIAC

SEQ ID NO: 2819048 - protein, 39 aa, Entamoeba invadens
IFNTKLYLRIYKLGRIPYFYLFLVALFTAVVTSPWGNIS

SEQ ID NO: 2819049 - protein, 17 aa, Entamoeba invadens
IFNTSPVKIYGADKVKT

SEQ ID NO: 2819050 - protein, 33 aa, Entamoeba invadens
IFNVLNIFLCIPLVLYFLPNVGFFSSFFGVGAV

SEQ ID NO: 2819051 - protein, 17 aa, Entamoeba invadens
IFNYSFIFAYEPNAKSA

SEQ ID NO: 2819052 - protein, 23 aa, Entamoeba invadens
IFPFNMFIKFFHSKACGLFNITS

SEQ ID NO: 2819053 - protein, 25 aa, Entamoeba invadens
IFQAVVHFIVIQLALKWAKEAAGSD

SEQ ID NO: 2819054 - protein, 20 aa, Entamoeba invadens
IFSFGFYKLFPDLPRTFTFV

SEQ ID NO: 2819055 - protein, 26 aa, Entamoeba invadens
IFSFTALFLLYLGPITFHILEAPLSF

SEQ ID NO: 2819056 - protein, 31 aa, Entamoeba invadens
IFSIFVVYIGPLSIIMLWPRIEKLGDPNFRK

SEQ ID NO: 2819057 - protein, 19 aa, Entamoeba invadens
IFSIVLALDDFTVHIFKVG

SEQ ID NO: 2819058 - protein, 17 aa, Entamoeba invadens
IFSYVHFPFLVTSVVLS

SEQ ID NO: 2819059 - protein, 21 aa, Entamoeba invadens
IFTFIILLCLTNFGSYDWDLV

SEQ ID NO: 2819060 - protein, 17 aa, Entamoeba invadens
IFTGVCSFKLDNCSILP

SEQ ID NO: 2819061 - protein, 17 aa, Entamoeba invadens
IFTIPETRYTLFKNIES

SEQ ID NO: 2819062 - protein, 27 aa, Entamoeba invadens
IFTKLNGTLGLLYFDCLLTDDIPTTPV

SEQ ID NO: 2819063 - protein, 26 aa, Entamoeba invadens
IFTSKMLWLLIPSFIGLIIIYIFQAV

SEQ ID NO: 2819064 - protein, 26 aa, Entamoeba invadens
IFTVPSILFLVFALALIIAFFVGFGY

SEQ ID NO: 2819065 - protein, 17 aa, Entamoeba invadens
IFVALRVPSPVNSFVLF

SEQ ID NO: 2819066 - protein, 19 aa, Entamoeba invadens
IFVDVVFCLLLVLSQLHVL

SEQ ID NO: 2819067 - protein, 18 aa, Entamoeba invadens
IFVETLILFVWNLIYQNS

SEQ ID NO: 2819068 - protein, 17 aa, Entamoeba invadens
IFVIFSVCKSESGWCED

SEQ ID NO: 2819069 - protein, 27 aa, Entamoeba invadens
IFVIILFILLYVVLKTRKISSFPKTIP

SEQ ID NO: 2819070 - protein, 18 aa, Entamoeba invadens
IFVTLFCTSKIQSSFLLV

SEQ ID NO: 2819071 - protein, 17 aa, Entamoeba invadens
IFVVETYTYVCDCYPKG

SEQ ID NO: 2819072 - protein, 20 aa, Entamoeba invadens
IFVVICTCSYYLIIVVVFIL

SEQ ID NO: 2819073 - protein, 18 aa, Entamoeba invadens
IFVVTKGMKWCRYGNVIR

SEQ ID NO: 2819074 - protein, 18 aa, Entamoeba invadens
IFYRCKKLSTIYLPPHIL

SEQ ID NO: 2819075 - protein, 34 aa, Entamoeba invadens
IGAFCKLHFLVIPIFPCSIFFAVVAAVIVMVEYP

SEQ ID NO: 2819076 - protein, 29 aa, Entamoeba invadens
IGAVVLFIFLVCVYFAWVGLLLARLDIPK

SEQ ID NO: 2819077 - protein, 24 aa, Entamoeba invadens
IGCDKCSFGFLWNSTTQSCTTVAY

SEQ ID NO: 2819078 - protein, 18 aa, Entamoeba invadens
IGCLWCENGYYLDNYICK

SEQ ID NO: 2819079 - protein, 19 aa, Entamoeba invadens
IGCSSNYVFLTTNSLICDS

SEQ ID NO: 2819080 - protein, 23 aa, Entamoeba invadens
IGCTQCLAGYYLNAGQCVQCDWS

SEQ ID NO: 2819081 - protein, 27 aa, Entamoeba invadens
IGCTSEVIPVLYIINTFFTIDRKMSTV

SEQ ID NO: 2819082 - protein, 20 aa, Entamoeba invadens
IGCVTYLIDAFFPALIVSMS

SEQ ID NO: 2819083 - protein, 24 aa, Entamoeba invadens
IGDHDYVIWMGDLNYRIQMDDKEV

SEQ ID NO: 2819084 - protein, 25 aa, Entamoeba invadens
IGEKCFNWCSYLSSITIPLGVTSFS

SEQ ID NO: 2819085 - protein, 20 aa, Entamoeba invadens
IGEPKVVMWNINRLHLYKNS

SEQ ID NO: 2819086 - protein, 26 aa, Entamoeba invadens
IGETCVLPSLGYYLFDGKTNECDNRH

SEQ ID NO: 2819087 - protein, 18 aa, Entamoeba invadens
IGFIFLVISYARFRLWVF

SEQ ID NO: 2819088 - protein, 30 aa, Entamoeba invadens
IGFLHKRRYYLQLFGYYGMVPTSNVVLFTR

SEQ ID NO: 2819089 - protein, 17 aa, Entamoeba invadens
IGFPFFLFCVILGGAME

SEQ ID NO: 2819090 - protein, 24 aa, Entamoeba invadens
IGGFIPFFIKFLPNRKLAGDILDV

SEQ ID NO: 2819091 - protein, 28 aa, Entamoeba invadens
IGGFLILLPFCCFIYKFKWTLDTNQVVP

SEQ ID NO: 2819092 - protein, 18 aa, Entamoeba invadens
IGGFSYFVNNSHVRWSTI

SEQ ID NO: 2819093 - protein, 34 aa, Entamoeba invadens
IGGGAIFPFFTLKFIDIIMVLMVLSPSVPITDEQ

SEQ ID NO: 2819094 - protein, 25 aa, Entamoeba invadens
IGGIHHQFYFTTSFLKILISECKDF

SEQ ID NO: 2819095 - protein, 32 aa, Entamoeba invadens
IGGIVFVVILITIIITVILLVLNYKQIDIEVF

SEQ ID NO: 2819096 - protein, 38 aa, Entamoeba invadens
IGGNLLMRRKFVRRPFWLNRILRMRGRRWRGNRRFQYG

SEQ ID NO: 2819097 - protein, 20 aa, Entamoeba invadens
IGGVQQYLGAYLKLVGVLEL

SEQ ID NO: 2819098 - protein, 25 aa, Entamoeba invadens
IGHYYCKELLFFQTQFYIKAKNKER

SEQ ID NO: 2819099 - protein, 25 aa, Entamoeba invadens
IGINALIFLVYPYTHVKWLKDKLIE

SEQ ID NO: 2819100 - protein, 18 aa, Entamoeba invadens
IGIPLNNLERWNGEHHVI

SEQ ID NO: 2819101 - protein, 18 aa, Entamoeba invadens
IGISGIVTGVILYNRKKA

SEQ ID NO: 2819102 - protein, 24 aa, Entamoeba invadens
IGKFYGKFTFWKDKRLGFFGEIIH

SEQ ID NO: 2819103 - protein, 30 aa, Entamoeba invadens
IGKKTVDDYIWPLLEKKLYITGEALDGKES

SEQ ID NO: 2819104 - protein, 37 aa, Entamoeba invadens
IGKMGMLCAGVVFVVLSLWWFYKAVTFNGYVLKGDHC

SEQ ID NO: 2819105 - protein, 18 aa, Entamoeba invadens
IGKYRNTIVAVKKVKFVL

SEQ ID NO: 2819106 - protein, 33 aa, Entamoeba invadens
IGLAIAFLVVLLVSIFVIYFTLYRKEKAKNNLT

SEQ ID NO: 2819107 - protein, 30 aa, Entamoeba invadens
IGLGMGFFMFVNLCTFALGLFYGTLVISGR

SEQ ID NO: 2819108 - protein, 18 aa, Entamoeba invadens
IGLILGYLGNVTIAWVAT

SEQ ID NO: 2819109 - protein, 22 aa, Entamoeba invadens
IGLKIRKLYFSSLLRQDSTFYD

SEQ ID NO: 2819110 - protein, 56 aa, Entamoeba invadens
IGLRLRQPIQFASFTSCPILRHVLYFTIYILFQLLLTFLLDRLNTILLAEYVSTIS

SEQ ID NO: 2819111 - protein, 37 aa, Entamoeba invadens
IGLSFGTIMLFMMLSLALSGWYGSLLMMGKGKTPNFT

SEQ ID NO: 2819112 - protein, 38 aa, Entamoeba invadens
IGLSVAGFIILLIVGIIIIVLFVIFHSLRNEEKRKEAQ

SEQ ID NO: 2819113 - protein, 23 aa, Entamoeba invadens
IGLYSVVVLFLYSLLKSNYSGMA

SEQ ID NO: 2819114 - protein, 25 aa, Entamoeba invadens
IGMKKTDLPFAIRPISNTKLSHSDI

SEQ ID NO: 2819115 - protein, 25 aa, Entamoeba invadens
IGNKIQFIFYMRQTATLFVLEEVSD

SEQ ID NO: 2819116 - protein, 26 aa, Entamoeba invadens
IGNNIKYAMKTFPTKTMIVFECNEGF

SEQ ID NO: 2819117 - protein, 33 aa, Entamoeba invadens
IGPLKLVQFVGFDILPILLRLAVHAFLKSQPLN

SEQ ID NO: 2819118 - protein, 27 aa, Entamoeba invadens
IGQIRLFEDIWCFTPGLFPLIRSGSTD

SEQ ID NO: 2819119 - protein, 22 aa, Entamoeba invadens
IGQMILACFYYRKLKTNFSYSY

SEQ ID NO: 2819120 - protein, 22 aa, Entamoeba invadens
IGRKFDIWLTTNEITNGGIAVQ

SEQ ID NO: 2819121 - protein, 41 aa, Entamoeba invadens
IGRKPMFIVTAIFLIFFSVASAFVFPIIFAAPYVGLSIIRF

SEQ ID NO: 2819122 - protein, 35 aa, Entamoeba invadens
IGRVYSFNFLPLQFMMMFLSIFAVKHKLINSWRGG

SEQ ID NO: 2819123 - protein, 29 aa, Entamoeba invadens
IGSFNIIIFPLFVVPYYRYKKTKKSLENV

SEQ ID NO: 2819124 - protein, 28 aa, Entamoeba invadens
IGSGVLLLFFIIMTVFIILITQKERFIV

SEQ ID NO: 2819125 - protein, 29 aa, Entamoeba invadens
IGSMGVGVLFPLFAYQFVCLTSVFSQITT

SEQ ID NO: 2819126 - protein, 24 aa, Entamoeba invadens
IGSVFGYFHRGPHPSLKTWRIPQT

SEQ ID NO: 2819127 - protein, 19 aa, Entamoeba invadens
IGSVIAGVAIFIKNKRHHN

SEQ ID NO: 2819128 - protein, 17 aa, Entamoeba invadens
IGSYIILRSAYLTRSDA

SEQ ID NO: 2819129 - protein, 24 aa, Entamoeba invadens
IGTNQFSFYFVDKFVMTIKSKQMI

SEQ ID NO: 2819130 - protein, 27 aa, Entamoeba invadens
IGTSQNQLLIYCEIPTILNVIFEGAND

SEQ ID NO: 2819131 - protein, 20 aa, Entamoeba invadens
IGTTYFIKVFCREKACDMTL

SEQ ID NO: 2819132 - protein, 18 aa, Entamoeba invadens
IGTYDTTYKFCKYKGVNS

SEQ ID NO: 2819133 - protein, 26 aa, Entamoeba invadens
IGVGAFITFLLYVGVFEYSSAGMIGR

SEQ ID NO: 2819134 - protein, 28 aa, Entamoeba invadens
IGVIFTPATLLIKKWYDPLPKAIVSVKD

SEQ ID NO: 2819135 - protein, 19 aa, Entamoeba invadens
IGVTICWLRKNKNVALETG

SEQ ID NO: 2819136 - protein, 37 aa, Entamoeba invadens
IGYNLYVFGTLIPLVVVYYKNLITLQMGTLLGLNSCE

SEQ ID NO: 2819137 - protein, 22 aa, Entamoeba invadens
IGYTFIVILLLYSSVGVFKVNI

SEQ ID NO: 2819138 - protein, 24 aa, Entamoeba invadens
IHCDTCLPGYFKFDSYSCSACFVG

SEQ ID NO: 2819139 - protein, 24 aa, Entamoeba invadens
IHCTLCFAPYILNDNKLSCIDANN

SEQ ID NO: 2819140 - protein, 20 aa, Entamoeba invadens
IHDIFYLTSFQNSSLFINPY

SEQ ID NO: 2819141 - protein, 18 aa, Entamoeba invadens
IHFSIFTAVCFLFALFCV

SEQ ID NO: 2819142 - protein, 19 aa, Entamoeba invadens
IHHYGSVLVAIMANATGIM

SEQ ID NO: 2819143 - protein, 17 aa, Entamoeba invadens
IHIIFSLITFVEKSPHC

SEQ ID NO: 2819144 - protein, 19 aa, Entamoeba invadens
IHISFIISTVLGFGGLILT

SEQ ID NO: 2819145 - protein, 17 aa, Entamoeba invadens
IHKFDKEYLEHCLQTVL

SEQ ID NO: 2819146 - protein, 34 aa, Entamoeba invadens
IHLLGGVIIPLFVKTPKLYRPASVVWLYANVMEK

SEQ ID NO: 2819147 - protein, 19 aa, Entamoeba invadens
IHLQLLMNVVYFLSREFSR

SEQ ID NO: 2819148 - protein, 19 aa, Entamoeba invadens
IHMNYYLNILSTSVAPLKD

SEQ ID NO: 2819149 - protein, 18 aa, Entamoeba invadens
IHNFLMFDALICVDKKLQ

SEQ ID NO: 2819150 - protein, 26 aa, Entamoeba invadens
IHNKFVLAGGYIRLFNSLRTVRRVPT

SEQ ID NO: 2819151 - protein, 17 aa, Entamoeba invadens
IHPGLYSILAQAKILSA

SEQ ID NO: 2819152 - protein, 21 aa, Entamoeba invadens
IHPIWESKRKYTYTFPFAQVH

SEQ ID NO: 2819153 - protein, 20 aa, Entamoeba invadens
IHPTFFVNYFMYLDTESPSA

SEQ ID NO: 2819154 - protein, 28 aa, Entamoeba invadens
IHRDVKGENLLLFSLNPHSPVCAKLTDF

SEQ ID NO: 2819155 - protein, 28 aa, Entamoeba invadens
IHRDVKGENLLLFSLNPRSPVCAKLTDF

SEQ ID NO: 2819156 - protein, 23 aa, Entamoeba invadens
IHSLNLTLLFKNVSLMKEQIELC

SEQ ID NO: 2819157 - protein, 17 aa, Entamoeba invadens
IHYIPFPLVITSGVGSH

SEQ ID NO: 2819158 - protein, 18 aa, Entamoeba invadens
IIAMTTAHWCLIEETIRC

SEQ ID NO: 2819159 - protein, 25 aa, Entamoeba invadens
IIASTDFGLLIYISNQLKPSTITTT

SEQ ID NO: 2819160 - protein, 22 aa, Entamoeba invadens
IIATVIIVVLIVFKKKDDKLIE

SEQ ID NO: 2819161 - protein, 44 aa, Entamoeba invadens
IICGVVLVLFYYWQLGLCIIAIFPVLLFFLFWNGYLNSEQSSPA

SEQ ID NO: 2819162 - protein, 24 aa, Entamoeba invadens
IICTHCYDSYYLNKTDLTCSNCNI

SEQ ID NO: 2819163 - protein, 18 aa, Entamoeba invadens
IIDFRDVLFFADFFRTFS

SEQ ID NO: 2819164 - protein, 31 aa, Entamoeba invadens
IIDIGACTLTFHIFRKMQMDIMSRFTLIETT

SEQ ID NO: 2819165 - protein, 31 aa, Entamoeba invadens
IIDLTYVVVWVWYIYHFNFGLVLLPYSIFCV

SEQ ID NO: 2819166 - protein, 27 aa, Entamoeba invadens
IIEGVVFLLYNIIKLLLRLKTVQQFFS

SEQ ID NO: 2819167 - protein, 24 aa, Entamoeba invadens
IIELKRLGLLWQKAPQKKIRLLLP

SEQ ID NO: 2819168 - protein, 17 aa, Entamoeba invadens
IIELKSDWYKRCFLDGR

SEQ ID NO: 2819169 - protein, 24 aa, Entamoeba invadens
IIENVFEFLKLMVDLLPTVVETFQ

SEQ ID NO: 2819170 - protein, 22 aa, Entamoeba invadens
IIESNLILSYLTKIGYDTSSFN

SEQ ID NO: 2819171 - protein, 24 aa, Entamoeba invadens
IIFAMFLAIFWRKQKQRAFHFIGV

SEQ ID NO: 2819172 - protein, 17 aa, Entamoeba invadens
IIFFNFLILFMINGQDN

SEQ ID NO: 2819173 - protein, 20 aa, Entamoeba invadens
IIFFSTEYLVRRCCAFYLGS

SEQ ID NO: 2819174 - protein, 22 aa, Entamoeba invadens
IIFILWNLFFISTTLFLLCCYF

SEQ ID NO: 2819175 - protein, 17 aa, Entamoeba invadens
IIFITLLTATSVYTVLG

SEQ ID NO: 2819176 - protein, 26 aa, Entamoeba invadens
IIFQQFTTLLIDKVVRIVFHNPQNNT

SEQ ID NO: 2819177 - protein, 23 aa, Entamoeba invadens
IIFTIWYTLFWQRKITVVGGFLI

SEQ ID NO: 2819178 - protein, 23 aa, Entamoeba invadens
IIGAIIFVCIAVVFVVVVLVVVS

SEQ ID NO: 2819179 - protein, 19 aa, Entamoeba invadens
IIGGVFTVFQLIDAFVFDS

SEQ ID NO: 2819180 - protein, 25 aa, Entamoeba invadens
IIGLKAKLFMLGSSQLTYVKDSVYQ

SEQ ID NO: 2819181 - protein, 26 aa, Entamoeba invadens
IIGSLLGVVCVFAIGSVIAGVAIFIK

SEQ ID NO: 2819182 - protein, 19 aa, Entamoeba invadens
IIGSYKISYISLGYASSVI

SEQ ID NO: 2819183 - protein, 17 aa, Entamoeba invadens
IIIKKRNEKYQLFETST

SEQ ID NO: 2819184 - protein, 21 aa, Entamoeba invadens
IIILGLFLYYVKVGWVLVIFV

SEQ ID NO: 2819185 - protein, 20 aa, Entamoeba invadens
IIIMLGYLIIRWKDFVYKRK

SEQ ID NO: 2819186 - protein, 27 aa, Entamoeba invadens
IIIPENGFVFFFDNFINFSRKSYFICK

SEQ ID NO: 2819187 - protein, 17 aa, Entamoeba invadens
IIISVNSSILKWCKVKD

SEQ ID NO: 2819188 - protein, 28 aa, Entamoeba invadens
IIIVILTILYFYRPPRLSKDLYGVWIGE

SEQ ID NO: 2819189 - protein, 17 aa, Entamoeba invadens
IIKMRRNAKLRKQFSIF

SEQ ID NO: 2819190 - protein, 24 aa, Entamoeba invadens
IIKNKFVIIYYGIALVIVAIVQSV

SEQ ID NO: 2819191 - protein, 24 aa, Entamoeba invadens
IIKQQKLLFNTYNTMFCNEHVSST

SEQ ID NO: 2819192 - protein, 18 aa, Entamoeba invadens
IIKRILQYTMYDYPKDVD

SEQ ID NO: 2819193 - protein, 24 aa, Entamoeba invadens
IIKRLIYCIFPCCLPPFVANSRLE

SEQ ID NO: 2819194 - protein, 19 aa, Entamoeba invadens
IIKSLVCVILIINTSLLTF

SEQ ID NO: 2819195 - protein, 26 aa, Entamoeba invadens
IIKVYNGGILLFTDIRFVFPDTFIND

SEQ ID NO: 2819196 - protein, 17 aa, Entamoeba invadens
IILDAARGIQYLHENSI

SEQ ID NO: 2819197 - protein, 17 aa, Entamoeba invadens
IILEKYEISKMKGKAFS

SEQ ID NO: 2819198 - protein, 32 aa, Entamoeba invadens
IILFIVFVTLLAFFPILTLCPKKVLPPPQIVT

SEQ ID NO: 2819199 - protein, 18 aa, Entamoeba invadens
IILHCITALKYEGNECRC

SEQ ID NO: 2819200 - protein, 22 aa, Entamoeba invadens
IILKNIFFEQLGDFKGIFSQDS

SEQ ID NO: 2819201 - protein, 17 aa, Entamoeba invadens
IILLCCLCPAPLLNIIY

SEQ ID NO: 2819202 - protein, 18 aa, Entamoeba invadens
IILTFYTKIVNDLVFSFT

SEQ ID NO: 2819203 - protein, 25 aa, Entamoeba invadens
IIMILLTVFVIFSLRVVRPLLVVLM

SEQ ID NO: 2819204 - protein, 26 aa, Entamoeba invadens
IIMVLSMFVILLYVVGYPQFYVDIKK

SEQ ID NO: 2819205 - protein, 21 aa, Entamoeba invadens
IINAYLKCESLVILSSNVIKS

SEQ ID NO: 2819206 - protein, 21 aa, Entamoeba invadens
IINCSILKLFDKNTSLFMTDN

SEQ ID NO: 2819207 - protein, 26 aa, Entamoeba invadens
IINLLYLTLFVVIFVLFVANNSPIDS

SEQ ID NO: 2819208 - protein, 23 aa, Entamoeba invadens
IINSTFILCFYSATLVMNLNTQI

SEQ ID NO: 2819209 - protein, 27 aa, Entamoeba invadens
IINTLVIKEKLILTSPYIITNLVDAVE

SEQ ID NO: 2819210 - protein, 19 aa, Entamoeba invadens
IIPIPTLKEDVHLGMFICS

SEQ ID NO: 2819211 - protein, 26 aa, Entamoeba invadens
IIQQFNELITKIPFKFINKTVGDVLL

SEQ ID NO: 2819212 - protein, 17 aa, Entamoeba invadens
IISAMQLTSLTTAVKCQ

SEQ ID NO: 2819213 - protein, 31 aa, Entamoeba invadens
IISATYNLLILLLRYFGMLLTPSSLTDNTWT

SEQ ID NO: 2819214 - protein, 17 aa, Entamoeba invadens
IISFICYTTKFKTLWGN

SEQ ID NO: 2819215 - protein, 18 aa, Entamoeba invadens
IISIFQAIPGLSPTGRFT

SEQ ID NO: 2819216 - protein, 17 aa, Entamoeba invadens
IISIFVVSYFFALLQAS

SEQ ID NO: 2819217 - protein, 18 aa, Entamoeba invadens
IISLFSMFCNLTALNWEN

SEQ ID NO: 2819218 - protein, 26 aa, Entamoeba invadens
IISLLLYMVYLVFIVLAVRSHPVLTA

SEQ ID NO: 2819219 - protein, 24 aa, Entamoeba invadens
IISNYTTLICNNKIFLNNNSTLII

SEQ ID NO: 2819220 - protein, 17 aa, Entamoeba invadens
IISSLTQFDFGVSNTAI

SEQ ID NO: 2819221 - protein, 23 aa, Entamoeba invadens
IISTITTYILFNVYNNNKNKKKT

SEQ ID NO: 2819222 - protein, 23 aa, Entamoeba invadens
IISTLLVFSILKKIERKQQDEQV

SEQ ID NO: 2819223 - protein, 26 aa, Entamoeba invadens
IISVLFVFFHYLVYHARFFDITKYLP

SEQ ID NO: 2819224 - protein, 24 aa, Entamoeba invadens
IITAILYISLFALNAIIPPRNAYS

SEQ ID NO: 2819225 - protein, 21 aa, Entamoeba invadens
IITFFLYIFVSEITFKSPSHF

SEQ ID NO: 2819226 - protein, 18 aa, Entamoeba invadens
IITLLCVFSPFLFQIDKR

SEQ ID NO: 2819227 - protein, 17 aa, Entamoeba invadens
IITNAYYYCDYERNGTF

SEQ ID NO: 2819228 - protein, 25 aa, Entamoeba invadens
IITTIVLVFVQPFIFMNVKDMARPY

SEQ ID NO: 2819229 - protein, 18 aa, Entamoeba invadens
IITYNTVYYAFVWSNTIP

SEQ ID NO: 2819230 - protein, 46 aa, Entamoeba invadens
IIVDFTLIITVVPLFLYFFGAFFRLHFFVAVIFPFAVIFACISMSY

SEQ ID NO: 2819231 - protein, 32 aa, Entamoeba invadens
IIVEHFYRLTFVYFIFISILCFIPSLERGRET

SEQ ID NO: 2819232 - protein, 42 aa, Entamoeba invadens
IIVGIVVGICFFFIVFITIALVLLFVVLRRNKKEHVKKINMS

SEQ ID NO: 2819233 - protein, 33 aa, Entamoeba invadens
IIVKLVLITIPTLIVLKIFKFWKSYLDLSSGIF

SEQ ID NO: 2819234 - protein, 17 aa, Entamoeba invadens
IIVLTHSRGIKTTTDPE

SEQ ID NO: 2819235 - protein, 25 aa, Entamoeba invadens
IIVSRILMIIVVVISYPALMFPTCA

SEQ ID NO: 2819236 - protein, 32 aa, Entamoeba invadens
IIVTACCFVLFFIIIAIVGVLLAYMMKSKEKE

SEQ ID NO: 2819237 - protein, 25 aa, Entamoeba invadens
IIVVIIFLLPLFYSTPTIIFWTIVT

SEQ ID NO: 2819238 - protein, 17 aa, Entamoeba invadens
IIYEHFTCTPKEINLIP

SEQ ID NO: 2819239 - protein, 18 aa, Entamoeba invadens
IIYHIVFVILKEVKIRFI

SEQ ID NO: 2819240 - protein, 31 aa, Entamoeba invadens
IKAHWSVFLKLTTSPIFIQILVKLVKEEEAA

SEQ ID NO: 2819241 - protein, 24 aa, Entamoeba invadens
IKATTLTWILQIEQLRDPLSKIKR

SEQ ID NO: 2819242 - protein, 21 aa, Entamoeba invadens
IKCDVVYRRNYLYKTQTEGNT

SEQ ID NO: 2819243 - protein, 21 aa, Entamoeba invadens
IKCENFLIEPLPGVSLDAVTN

SEQ ID NO: 2819244 - protein, 20 aa, Entamoeba invadens
IKCLPGYFLIQGKCGNCIPN

SEQ ID NO: 2819245 - protein, 19 aa, Entamoeba invadens
IKCLRPNNLSLPLKSIKDK

SEQ ID NO: 2819246 - protein, 18 aa, Entamoeba invadens
IKCPFWQAPSVDGLYCMN

SEQ ID NO: 2819247 - protein, 30 aa, Entamoeba invadens
IKCVTFITLYLLLIVVLYQINLYIGDQQYV

SEQ ID NO: 2819248 - protein, 23 aa, Entamoeba invadens
IKDGNILKLDYAPEFSARLAYDQ

SEQ ID NO: 2819249 - protein, 43 aa, Entamoeba invadens
IKDNYKYIVTSLKTDLFLIGPKGLTFYSLPEPIPNVVITETYV

SEQ ID NO: 2819250 - protein, 38 aa, Entamoeba invadens
IKDSEEQFPLYDLFIRLFKMFALPKDLHFALNIQSNTT

SEQ ID NO: 2819251 - protein, 22 aa, Entamoeba invadens
IKDYFFTAILLLSALATMIYGY

SEQ ID NO: 2819252 - protein, 22 aa, Entamoeba invadens
IKEGVRILSFPIGYYEEMLPNN

SEQ ID NO: 2819253 - protein, 20 aa, Entamoeba invadens
IKEHLLAIFAGKKYIQPFLD

SEQ ID NO: 2819254 - protein, 18 aa, Entamoeba invadens
IKFTLAVILFLAMSFVTM

SEQ ID NO: 2819255 - protein, 23 aa, Entamoeba invadens
IKFWQKDLHLWPYTYEFSQSDLD

SEQ ID NO: 2819256 - protein, 23 aa, Entamoeba invadens
IKGKFKVYIFSSTITSYRGYVMT

SEQ ID NO: 2819257 - protein, 17 aa, Entamoeba invadens
IKHFGISNLALLVQPCE

SEQ ID NO: 2819258 - protein, 26 aa, Entamoeba invadens
IKIKDMKYRVSTFNKYYCTYKNDVEG

SEQ ID NO: 2819259 - protein, 18 aa, Entamoeba invadens
IKMFHSLKFYRCSCWSYF

SEQ ID NO: 2819260 - protein, 27 aa, Entamoeba invadens
IKMFNVNFVLILIFNKHDLLISQKNII

SEQ ID NO: 2819261 - protein, 18 aa, Entamoeba invadens
IKNIYLFQDVKLTGDFIL

SEQ ID NO: 2819262 - protein, 17 aa, Entamoeba invadens
IKNLLKEWWPQVVKFSK

SEQ ID NO: 2819263 - protein, 21 aa, Entamoeba invadens
IKNMFPYTFTVTRQYKYMYCP

SEQ ID NO: 2819264 - protein, 32 aa, Entamoeba invadens
IKNSYMYYKYTIYYNSLIQTLSIYPNLNIDIE

SEQ ID NO: 2819265 - protein, 24 aa, Entamoeba invadens
IKPDNILIFSYDLKENVLAKLTDF

SEQ ID NO: 2819266 - protein, 25 aa, Entamoeba invadens
IKPDNILVFSLNFNANFPSKLTDFG

SEQ ID NO: 2819267 - protein, 23 aa, Entamoeba invadens
IKPDNLLIFSLDLGTTINAKMTD

SEQ ID NO: 2819268 - protein, 17 aa, Entamoeba invadens
IKPLCTCEISDKIAIIS

SEQ ID NO: 2819269 - protein, 19 aa, Entamoeba invadens
IKPLCTCVIKNKIMIFSKG

SEQ ID NO: 2819270 - protein, 28 aa, Entamoeba invadens
IKPPPFYLQMYIKRTSNILTLCSEALLP

SEQ ID NO: 2819271 - protein, 27 aa, Entamoeba invadens
IKRSSLWRKVLLLTILSAFLALEMSYC

SEQ ID NO: 2819272 - protein, 29 aa, Entamoeba invadens
IKRTIRDLPIFFIYQINTTIFTFQSSYEV

SEQ ID NO: 2819273 - protein, 22 aa, Entamoeba invadens
IKSFEYPWCIADFVTQGKRMEK

SEQ ID NO: 2819274 - protein, 42 aa, Entamoeba invadens
IKSGSYMMFVLMWLCLAGRICALYYYNSYLTLWGKSIETNNE

SEQ ID NO: 2819275 - protein, 18 aa, Entamoeba invadens
IKSLMCVSLYKKCDIETP

SEQ ID NO: 2819276 - protein, 26 aa, Entamoeba invadens
IKSLNATTFTPFASFDKLTISDVMTV

SEQ ID NO: 2819277 - protein, 20 aa, Entamoeba invadens
IKSLSFLKTTKPPKSSMLKN

SEQ ID NO: 2819278 - protein, 28 aa, Entamoeba invadens
IKSPVLIFKIQENVPLYIFLHTKYAEKT

SEQ ID NO: 2819279 - protein, 36 aa, Entamoeba invadens
IKSQLIFSEYLFLPKNIGLSPNALFLVFDNFVTILS

SEQ ID NO: 2819280 - protein, 27 aa, Entamoeba invadens
IKTAKTFYQTMYWINGIPSVAVEYTPF

SEQ ID NO: 2819281 - protein, 17 aa, Entamoeba invadens
IKTSTLDKLLTKNPRKP

SEQ ID NO: 2819282 - protein, 21 aa, Entamoeba invadens
IKVGWICLIFAVPTGFISGLD

SEQ ID NO: 2819283 - protein, 17 aa, Entamoeba invadens
IKVKLPTPISFTTTLVF

SEQ ID NO: 2819284 - protein, 26 aa, Entamoeba invadens
IKVMTRLFIILFGVVFPVIFSVILIV

SEQ ID NO: 2819285 - protein, 20 aa, Entamoeba invadens
IKYATQWYGSVLVLLAVLIS

SEQ ID NO: 2819286 - protein, 30 aa, Entamoeba invadens
ILAAQAMFLLFLILLVVVFNPYVIFAIAFF

SEQ ID NO: 2819287 - protein, 32 aa, Entamoeba invadens
ILAEIKKYKYPTFFPFFMSYSHTYNGNKYGRT

SEQ ID NO: 2819288 - protein, 17 aa, Entamoeba invadens
ILANADPFLKVGEIEPR

SEQ ID NO: 2819289 - protein, 18 aa, Entamoeba invadens
ILCEGLYNCIQLNLRFQT

SEQ ID NO: 2819290 - protein, 20 aa, Entamoeba invadens
ILCETKYYRTLQNSTKYFNP

SEQ ID NO: 2819291 - protein, 18 aa, Entamoeba invadens
ILCPEGCATGCLTDNTCR

SEQ ID NO: 2819292 - protein, 18 aa, Entamoeba invadens
ILCSLFIGQLLVVLGFVL

SEQ ID NO: 2819293 - protein, 29 aa, Entamoeba invadens
ILDKRWRKLCFFDYILYTVGTPTTICNDL

SEQ ID NO: 2819294 - protein, 18 aa, Entamoeba invadens
ILEETWNIKLAILSLCFS

SEQ ID NO: 2819295 - protein, 19 aa, Entamoeba invadens
ILEFLPSIQTFLKAKVRIG

SEQ ID NO: 2819296 - protein, 18 aa, Entamoeba invadens
ILEIFIFNTIHAIEFVLG

SEQ ID NO: 2819297 - protein, 27 aa, Entamoeba invadens
ILENFPQSSYLTKLIGKVLLDKTHLIV

SEQ ID NO: 2819298 - protein, 17 aa, Entamoeba invadens
ILEQSVAIRYVIFHKYI

SEQ ID NO: 2819299 - protein, 17 aa, Entamoeba invadens
ILETIQMMYFAVTGLSE

SEQ ID NO: 2819300 - protein, 27 aa, Entamoeba invadens
ILFAAFVIFLLIIVVFEGVKTIQRKMN

SEQ ID NO: 2819301 - protein, 30 aa, Entamoeba invadens
ILFDDWIMTCFNILFTSLPPGAIALFDYEL

SEQ ID NO: 2819302 - protein, 18 aa, Entamoeba invadens
ILFFCIAQSTLIYCNNNS

SEQ ID NO: 2819303 - protein, 19 aa, Entamoeba invadens
ILFFLVHLQAECPPEELIG

SEQ ID NO: 2819304 - protein, 29 aa, Entamoeba invadens
ILFFQGLLDWVAVIILPFLFEHVPFEEAR

SEQ ID NO: 2819305 - protein, 24 aa, Entamoeba invadens
ILFTALLAVFVRKVKLLPNQVFSL

SEQ ID NO: 2819306 - protein, 21 aa, Entamoeba invadens
ILFVLGFFCLITWVVNLMLFN

SEQ ID NO: 2819307 - protein, 25 aa, Entamoeba invadens
ILFVVLYVFWLLYVVCRSCSEGKKI

SEQ ID NO: 2819308 - protein, 24 aa, Entamoeba invadens
ILGAFLAFLFYSFNVYKLVTTTKM

SEQ ID NO: 2819309 - protein, 24 aa, Entamoeba invadens
ILHCPIIEDLLRKIQTVDNVLIVG

SEQ ID NO: 2819310 - protein, 17 aa, Entamoeba invadens
ILHEKPHMMIITLESEN

SEQ ID NO: 2819311 - protein, 35 aa, Entamoeba invadens
ILHGIMNTIFLAYLIFFVIAFFQYLRIDNGLFLNK

SEQ ID NO: 2819312 - protein, 20 aa, Entamoeba invadens
ILHHVIQLILLVVGFSLVCC

SEQ ID NO: 2819313 - protein, 18 aa, Entamoeba invadens
ILHLVTIPTPKWCRYVLF

SEQ ID NO: 2819314 - protein, 30 aa, Entamoeba invadens
ILHRDIKPDNFLILSLDLYEKVNAKLTDFG

SEQ ID NO: 2819315 - protein, 19 aa, Entamoeba invadens
ILHRDIKPDNFLVTSIHED

SEQ ID NO: 2819316 - protein, 30 aa, Entamoeba invadens
ILHRDIKPDNILIFSLELSVSVNAKLTDFG

SEQ ID NO: 2819317 - protein, 30 aa, Entamoeba invadens
ILHRDIKPDNILIFTLEFDAKVNGKLTDFG

SEQ ID NO: 2819318 - protein, 29 aa, Entamoeba invadens
ILHRDIKPDNYLIFSLDPNEKVNAKLTDF

SEQ ID NO: 2819319 - protein, 29 aa, Entamoeba invadens
ILHRDLKPDNLLLFSFSPKVQFAAKISDF

SEQ ID NO: 2819320 - protein, 33 aa, Entamoeba invadens
ILHYSKFMFDRLFYLEDVGLFIAMIFGLFDGST

SEQ ID NO: 2819321 - protein, 18 aa, Entamoeba invadens
ILIASAVVSLILAAIVPH

SEQ ID NO: 2819322 - protein, 29 aa, Entamoeba invadens
ILICALYALIFISLITLTAIIHFNCSKQF

SEQ ID NO: 2819323 - protein, 19 aa, Entamoeba invadens
ILIDLSQASLPDIHNSILG

SEQ ID NO: 2819324 - protein, 21 aa, Entamoeba invadens
ILIELIVIFIARIFYRDTDTY

SEQ ID NO: 2819325 - protein, 28 aa, Entamoeba invadens
ILIESGAILLLGALFAPLLEGLIVSDRV

SEQ ID NO: 2819326 - protein, 23 aa, Entamoeba invadens
ILIFLSILPFTVSKVIQVSLTGN

SEQ ID NO: 2819327 - protein, 18 aa, Entamoeba invadens
ILINFIVGTGVFGLPHAF

SEQ ID NO: 2819328 - protein, 25 aa, Entamoeba invadens
ILINTIYFKGTWSEKFDVLPNKMKF

SEQ ID NO: 2819329 - protein, 18 aa, Entamoeba invadens
ILISTLVNFLYIYMKRAF

SEQ ID NO: 2819330 - protein, 17 aa, Entamoeba invadens
ILKKRKTKINGQIVLIK

SEQ ID NO: 2819331 - protein, 18 aa, Entamoeba invadens
ILKLIGDFSLKVSGEKNV

SEQ ID NO: 2819332 - protein, 23 aa, Entamoeba invadens
ILKNCLLILLIGVTTMISFFFYV

SEQ ID NO: 2819333 - protein, 25 aa, Entamoeba invadens
ILKTSNFHLFSPQLTKLDIKELIVD

SEQ ID NO: 2819334 - protein, 19 aa, Entamoeba invadens
ILLCLCIILSVIGLRWFDE

SEQ ID NO: 2819335 - protein, 17 aa, Entamoeba invadens
ILLFFLNSSQFGIEMVY

SEQ ID NO: 2819336 - protein, 18 aa, Entamoeba invadens
ILLFVVWLSFIWEALKII

SEQ ID NO: 2819337 - protein, 20 aa, Entamoeba invadens
ILLLSSIFFVLGFVFCPGYF

SEQ ID NO: 2819338 - protein, 25 aa, Entamoeba invadens
ILLPVIIITLLVLRLFKKKKTVAFF

SEQ ID NO: 2819339 - protein, 25 aa, Entamoeba invadens
ILLRNVFFLYLCVIGLLTLLTGLLH

SEQ ID NO: 2819340 - protein, 27 aa, Entamoeba invadens
ILLSLTLVFFGIFTCLSQFLITIPPVE

SEQ ID NO: 2819341 - protein, 33 aa, Entamoeba invadens
ILLSTGVAVLGVLFIVAVIIIGALFTLFVLSRR

SEQ ID NO: 2819342 - protein, 18 aa, Entamoeba invadens
ILNDFMFSGCKKLTTVNG

SEQ ID NO: 2819343 - protein, 27 aa, Entamoeba invadens
ILNIQTSLIKLLLGNKYKFANTINSNN

SEQ ID NO: 2819344 - protein, 23 aa, Entamoeba invadens
ILNVLYLIVLIVIDIVMITTKLS

SEQ ID NO: 2819345 - protein, 17 aa, Entamoeba invadens
ILPLMENVIHELFLRRL

SEQ ID NO: 2819346 - protein, 19 aa, Entamoeba invadens
ILRFNKWWELFNPFAKQVD

SEQ ID NO: 2819347 - protein, 17 aa, Entamoeba invadens
ILRKKMCILPQEATLFS

SEQ ID NO: 2819348 - protein, 17 aa, Entamoeba invadens
ILRLCPTNHIDTSITCE

SEQ ID NO: 2819349 - protein, 27 aa, Entamoeba invadens
ILRVDMLNIFRDSSLLFLSSYIESTES

SEQ ID NO: 2819350 - protein, 37 aa, Entamoeba invadens
ILSAFCWCCFRIFDILFSFFFLLYTILNTSPSDSTSP

SEQ ID NO: 2819351 - protein, 17 aa, Entamoeba invadens
ILSLFYSTEAIVDFLRS

SEQ ID NO: 2819352 - protein, 17 aa, Entamoeba invadens
ILSLRNGVIYRCEKSKY

SEQ ID NO: 2819353 - protein, 27 aa, Entamoeba invadens
ILSPHWEFWRLLLVNIYTLWTVPLLLV

SEQ ID NO: 2819354 - protein, 18 aa, Entamoeba invadens
ILSTMFPYKFDDGTGYLI

SEQ ID NO: 2819355 - protein, 33 aa, Entamoeba invadens
ILSVLPYYQNALFMKLFHLCKPTIFANLVKLDK

SEQ ID NO: 2819356 - protein, 18 aa, Entamoeba invadens
ILTCKIYVKLFECIEMLK

SEQ ID NO: 2819357 - protein, 31 aa, Entamoeba invadens
ILTITICVITILYIIRPSPLDTKLFGVWVGE

SEQ ID NO: 2819358 - protein, 26 aa, Entamoeba invadens
ILTIVLWTVVIAQRKKLKDFLIFRVM

SEQ ID NO: 2819359 - protein, 18 aa, Entamoeba invadens
ILTKAQSFALLLAKVYFK

SEQ ID NO: 2819360 - protein, 25 aa, Entamoeba invadens
ILTKNLPYLYILKSPTRISAYLFSS

SEQ ID NO: 2819361 - protein, 19 aa, Entamoeba invadens
ILTVFLAMVLSSQSLSMVA

SEQ ID NO: 2819362 - protein, 19 aa, Entamoeba invadens
ILTVFSYELTLKNLKTNCM

SEQ ID NO: 2819363 - protein, 17 aa, Entamoeba invadens
ILVDNKSVLWRLKNLKK

SEQ ID NO: 2819364 - protein, 27 aa, Entamoeba invadens
ILVDYYFLFFFTLGCIFIVPPLVLNTS

SEQ ID NO: 2819365 - protein, 31 aa, Entamoeba invadens
ILVFLSGRIAALFYFNTFLTKWGKSLHPLLK

SEQ ID NO: 2819366 - protein, 17 aa, Entamoeba invadens
ILVFSIDKGIPVNAKLT

SEQ ID NO: 2819367 - protein, 17 aa, Entamoeba invadens
ILVIIRKLQEVVKMRNI

SEQ ID NO: 2819368 - protein, 18 aa, Entamoeba invadens
ILVKRRCEYYTTIKYCAS

SEQ ID NO: 2819369 - protein, 26 aa, Entamoeba invadens
ILVMQTIVLFLSQNYFKFSNWRDYIK

SEQ ID NO: 2819370 - protein, 26 aa, Entamoeba invadens
ILVNKTTFFLNRCGGWLQLIGPSENV

SEQ ID NO: 2819371 - protein, 17 aa, Entamoeba invadens
ILVSVGLTTHFTTTSTT

SEQ ID NO: 2819372 - protein, 17 aa, Entamoeba invadens
ILWLIGGVQQYLGAYLK

SEQ ID NO: 2819373 - protein, 29 aa, Entamoeba invadens
ILWLIIQLSASLMWCQIGKEIIQCNTTTL

SEQ ID NO: 2819374 - protein, 19 aa, Entamoeba invadens
ILWNVPFEEHGAFAQPICF

SEQ ID NO: 2819375 - protein, 17 aa, Entamoeba invadens
ILYCATSYYKDTSSNSC

SEQ ID NO: 2819376 - protein, 19 aa, Entamoeba invadens
IMAITFYRWSIENNILKNK

SEQ ID NO: 2819377 - protein, 31 aa, Entamoeba invadens
IMCHNMSYYVERLFSLYLPIMVGYHVYISTD

SEQ ID NO: 2819378 - protein, 28 aa, Entamoeba invadens
IMISIPVGLLLIIFKVVITVVCFVGGAF

SEQ ID NO: 2819379 - protein, 20 aa, Entamoeba invadens
IMIVSKYLEFFNNTNFINLE

SEQ ID NO: 2819380 - protein, 24 aa, Entamoeba invadens
IMKLPFIGFGLYWMDNIMLKRNFA

SEQ ID NO: 2819381 - protein, 17 aa, Entamoeba invadens
IMKTMLFTMNFTGDYSI

SEQ ID NO: 2819382 - protein, 20 aa, Entamoeba invadens
IMNAFWHGLYPGYLLFFFCC

SEQ ID NO: 2819383 - protein, 21 aa, Entamoeba invadens
IMNSLSLIMYSSCSECAVVIQ

SEQ ID NO: 2819384 - protein, 24 aa, Entamoeba invadens
IMNVAIYLLTLCALIGFVGGFFFG

SEQ ID NO: 2819385 - protein, 18 aa, Entamoeba invadens
IMPPIGEGAFGMVFRGTY

SEQ ID NO: 2819386 - protein, 27 aa, Entamoeba invadens
IMRNQHFFHGILIRQFMKILVKDVSGT

SEQ ID NO: 2819387 - protein, 19 aa, Entamoeba invadens
IMRVKQYASMKLLTLEKNS

SEQ ID NO: 2819388 - protein, 18 aa, Entamoeba invadens
IMSLCFIAFYLKKGRSFP

SEQ ID NO: 2819389 - protein, 19 aa, Entamoeba invadens
IMSQLFMLFFSSFFSQNTS

SEQ ID NO: 2819390 - protein, 28 aa, Entamoeba invadens
IMVVIIFAILWFPLLLMSSAAPNFIQPA

SEQ ID NO: 2819391 - protein, 19 aa, Entamoeba invadens
IMYEEHNYLIFGCVDSLLG

SEQ ID NO: 2819392 - protein, 22 aa, Entamoeba invadens
INAVKFLHFFNSNAKKTVFSKV

SEQ ID NO: 2819393 - protein, 23 aa, Entamoeba invadens
INCKKCNTPYYLTSDTKACVIEC

SEQ ID NO: 2819394 - protein, 24 aa, Entamoeba invadens
INDNFCLLQWSLGCIRCITNMTEP

SEQ ID NO: 2819395 - protein, 19 aa, Entamoeba invadens
INEILPFVKHFALGGGVGG

SEQ ID NO: 2819396 - protein, 30 aa, Entamoeba invadens
INEQKYVHLYVKFFIRITQLMETMENKKEI

SEQ ID NO: 2819397 - protein, 20 aa, Entamoeba invadens
INESNVLWKLLNNSSLGVST

SEQ ID NO: 2819398 - protein, 26 aa, Entamoeba invadens
INETSKVFLIVYYNNGQLEFHKETIP

SEQ ID NO: 2819399 - protein, 20 aa, Entamoeba invadens
INEYILKDNTCVFKRDLFCE

SEQ ID NO: 2819400 - protein, 36 aa, Entamoeba invadens
INFKVKQTLFFTLENTFYKFLKIKNYFENITNLFKK

SEQ ID NO: 2819401 - protein, 21 aa, Entamoeba invadens
INFLTLWMVSFGFITTVWANN

SEQ ID NO: 2819402 - protein, 17 aa, Entamoeba invadens
INFVTQQYPALASMFLQ

SEQ ID NO: 2819403 - protein, 28 aa, Entamoeba invadens
INGKTCYQYPAKSPLVYVALSEKMTAET

SEQ ID NO: 2819404 - protein, 25 aa, Entamoeba invadens
INGPLYSVGLGFSNLLYKMWKPTRE

SEQ ID NO: 2819405 - protein, 23 aa, Entamoeba invadens
INGYNFPVFKFNTIVTTTEVDTI

SEQ ID NO: 2819406 - protein, 39 aa, Entamoeba invadens
INHRSSLYTLLSLLLPFVTPLFVFLIGSPRLPDSQEYVP

SEQ ID NO: 2819407 - protein, 23 aa, Entamoeba invadens
INILVTMVVCAMALGFVGYGYGG

SEQ ID NO: 2819408 - protein, 23 aa, Entamoeba invadens
INKDKTIIILRCSGNKILNEKID

SEQ ID NO: 2819409 - protein, 23 aa, Entamoeba invadens
INKLFQFIDIIFTKTAVISFAEY

SEQ ID NO: 2819410 - protein, 29 aa, Entamoeba invadens
INKVSAMLFARMKRGLLPLVHGGTFTFEK

SEQ ID NO: 2819411 - protein, 26 aa, Entamoeba invadens
INLAERIPKLMFFNCSTLANVTHTES

SEQ ID NO: 2819412 - protein, 24 aa, Entamoeba invadens
INLGFVLYYFVDNILPFASFPKVH

SEQ ID NO: 2819413 - protein, 18 aa, Entamoeba invadens
INLIKRKIVNYTFSLSFC

SEQ ID NO: 2819414 - protein, 23 aa, Entamoeba invadens
INLKNYPYIIRNTNKKYQIHNIS

SEQ ID NO: 2819415 - protein, 21 aa, Entamoeba invadens
INLLMTNMTFTKGIGTPVYMA

SEQ ID NO: 2819416 - protein, 27 aa, Entamoeba invadens
INMATYFCWLILPYLIKEQGGSSFMIG

SEQ ID NO: 2819417 - protein, 24 aa, Entamoeba invadens
INMKLRIKFVLDASKGLLYLHENG

SEQ ID NO: 2819418 - protein, 20 aa, Entamoeba invadens
INMVIKLVYIDLKRGEEKSY

SEQ ID NO: 2819419 - protein, 25 aa, Entamoeba invadens
INNFKDFDLFFRELDIYKKINTILI

SEQ ID NO: 2819420 - protein, 26 aa, Entamoeba invadens
INNIIKLIFNCHFIYSKKAKICFFFF

SEQ ID NO: 2819421 - protein, 30 aa, Entamoeba invadens
INNLSLSLLCKPNYIFTLKDSLCSDDTNCA

SEQ ID NO: 2819422 - protein, 24 aa, Entamoeba invadens
INQWSTLIRLLCQEKQFKSIWAYF

SEQ ID NO: 2819423 - protein, 36 aa, Entamoeba invadens
INRGTRTLKIILLHMQVLLILSVAIAAIATPKCPQT

SEQ ID NO: 2819424 - protein, 18 aa, Entamoeba invadens
INRLFICAICDQKYFRND

SEQ ID NO: 2819425 - protein, 17 aa, Entamoeba invadens
INRLFMCAICDQKYFRN

SEQ ID NO: 2819426 - protein, 18 aa, Entamoeba invadens
INSFVLKMLGVSNNVFDR

SEQ ID NO: 2819427 - protein, 17 aa, Entamoeba invadens
INSIKFFGVIHISPLCP

SEQ ID NO: 2819428 - protein, 26 aa, Entamoeba invadens
INSKFTNLVFLFTFGKVETIIKEDIY

SEQ ID NO: 2819429 - protein, 19 aa, Entamoeba invadens
INTIIFRMAMKQIMKGRKG

SEQ ID NO: 2819430 - protein, 32 aa, Entamoeba invadens
INVCIFPMKKSNIHFFKINEWLVSNKKVLEFE

SEQ ID NO: 2819431 - protein, 21 aa, Entamoeba invadens
INYGYFFVRIGVIIGSPRMGE

SEQ ID NO: 2819432 - protein, 29 aa, Entamoeba invadens
INYLELLYCHNWFYPILAFMVLGIVVIFY

SEQ ID NO: 2819433 - protein, 17 aa, Entamoeba invadens
INYVLYSGDVRMFSLFD

SEQ ID NO: 2819434 - protein, 25 aa, Entamoeba invadens
IPAEVWRYYLLMNRPEQSDTIFLWT

SEQ ID NO: 2819435 - protein, 32 aa, Entamoeba invadens
IPALMDAIYIKNFRYYFVPTPPTSQAELPIYA

SEQ ID NO: 2819436 - protein, 22 aa, Entamoeba invadens
IPANMIIEEPIWDDKWSALKYT

SEQ ID NO: 2819437 - protein, 24 aa, Entamoeba invadens
IPDEMILFVQLIRYISNDPKQYII

SEQ ID NO: 2819438 - protein, 18 aa, Entamoeba invadens
IPDFANLMTMVVKTSISA

SEQ ID NO: 2819439 - protein, 22 aa, Entamoeba invadens
IPDIPVFYSDMLITIGDSAQYL

SEQ ID NO: 2819440 - protein, 30 aa, Entamoeba invadens
IPEDVIINKPFFFVIVDPHSLPIFFGKCTT

SEQ ID NO: 2819441 - protein, 29 aa, Entamoeba invadens
IPEKYRQCLILLPDLFQCCLHFIQYDPSC

SEQ ID NO: 2819442 - protein, 17 aa, Entamoeba invadens
IPHCKSFTRTITGGVPT

SEQ ID NO: 2819443 - protein, 18 aa, Entamoeba invadens
IPHYFFMYYINELVVHFT

SEQ ID NO: 2819444 - protein, 33 aa, Entamoeba invadens
IPIAFTTFLYIILWTFYSLYAWVAYKFDLFGVK

SEQ ID NO: 2819445 - protein, 26 aa, Entamoeba invadens
IPIFRYLTCFVLSNLPLLFLAYYAIT

SEQ ID NO: 2819446 - protein, 18 aa, Entamoeba invadens
IPIQVNVTIFPPAALHVV

SEQ ID NO: 2819447 - protein, 21 aa, Entamoeba invadens
IPKDMFKMHFAEELLAGIAMG

SEQ ID NO: 2819448 - protein, 20 aa, Entamoeba invadens
IPKDTFKGCILLNEVDGFEK

SEQ ID NO: 2819449 - protein, 27 aa, Entamoeba invadens
IPLIILWVILFILQIGIFIVSVISFTM

SEQ ID NO: 2819450 - protein, 20 aa, Entamoeba invadens
IPLIVSFIQPIFGLLSDIFP

SEQ ID NO: 2819451 - protein, 22 aa, Entamoeba invadens
IPLLWMIYTNAFNLEKNYNFSC

SEQ ID NO: 2819452 - protein, 21 aa, Entamoeba invadens
IPLVLNCVLFVPTLNTYLIGS

SEQ ID NO: 2819453 - protein, 18 aa, Entamoeba invadens
IPMEEGVMYPFTIDFTSK

SEQ ID NO: 2819454 - protein, 24 aa, Entamoeba invadens
IPMEIIWYVIYYTLIVFAAIILPF

SEQ ID NO: 2819455 - protein, 19 aa, Entamoeba invadens
IPMLYNIVRLKSSSQIYTD

SEQ ID NO: 2819456 - protein, 20 aa, Entamoeba invadens
IPNHICMVTEFALYGSLQDL

SEQ ID NO: 2819457 - protein, 32 aa, Entamoeba invadens
IPNSMGCAFCKDGYYWSEWSCLECSAACLTCS

SEQ ID NO: 2819458 - protein, 29 aa, Entamoeba invadens
IPNYSFSYLLTKYLDYYLNFDYSKRISTS

SEQ ID NO: 2819459 - protein, 26 aa, Entamoeba invadens
IPPDFNGFFFTLVYNAIRALSDSILR

SEQ ID NO: 2819460 - protein, 24 aa, Entamoeba invadens
IPPGYRFVTIFTQSTWTRTAGFAG

SEQ ID NO: 2819461 - protein, 19 aa, Entamoeba invadens
IPPHRKGVITLFATLFCTT

SEQ ID NO: 2819462 - protein, 20 aa, Entamoeba invadens
IPPKFACEFSLFLNPLCTST

SEQ ID NO: 2819463 - protein, 18 aa, Entamoeba invadens
IPQISMVIQFFVLGSLGE

SEQ ID NO: 2819464 - protein, 32 aa, Entamoeba invadens
IPQNVSLSFFVWYLHEVQSLFKILPNSLVLIE

SEQ ID NO: 2819465 - protein, 19 aa, Entamoeba invadens
IPQVSMVIQFFILGSLGEY

SEQ ID NO: 2819466 - protein, 19 aa, Entamoeba invadens
IPQVSMVIQFFVLGALGEY

SEQ ID NO: 2819467 - protein, 18 aa, Entamoeba invadens
IPQVSMVIQFFVLGSLGE

SEQ ID NO: 2819468 - protein, 22 aa, Entamoeba invadens
IPRDLILPDFFFKILPHLKQSW

SEQ ID NO: 2819469 - protein, 32 aa, Entamoeba invadens
IPRLNYDKLIVGDVYYLYIYDYKDTSTNNKAG

SEQ ID NO: 2819470 - protein, 18 aa, Entamoeba invadens
IPRPINLNIPKRGPLKTK

SEQ ID NO: 2819471 - protein, 27 aa, Entamoeba invadens
IPSAFIAIVLVILTLVVYIFACTRCCF

SEQ ID NO: 2819472 - protein, 18 aa, Entamoeba invadens
IPSDLLDFVLKTMCNFDL

SEQ ID NO: 2819473 - protein, 20 aa, Entamoeba invadens
IPSEFLLLSQPTENPLIITQ

SEQ ID NO: 2819474 - protein, 19 aa, Entamoeba invadens
IPSICCLLIYFMKGTYKIE

SEQ ID NO: 2819475 - protein, 20 aa, Entamoeba invadens
IPSPLVRFIHAAHLVVIDGV

SEQ ID NO: 2819476 - protein, 27 aa, Entamoeba invadens
IPTMSAIFGIIFMLIKPLRDTLLVSGN

SEQ ID NO: 2819477 - protein, 32 aa, Entamoeba invadens
IPTTNTLVINKLFKFFVMKMSQNINIRATKSL

SEQ ID NO: 2819478 - protein, 20 aa, Entamoeba invadens
IPVISWFLPFIGHPAVCDTK

SEQ ID NO: 2819479 - protein, 45 aa, Entamoeba invadens
IPVTNIVAIVLPIVFVMIFIVLIVVIFALIGFYIRNKKLENKRKE

SEQ ID NO: 2819480 - protein, 23 aa, Entamoeba invadens
IPVTPYHITLVKQHGRPFTKSVV

SEQ ID NO: 2819481 - protein, 17 aa, Entamoeba invadens
IPYSVWFSRSKKTLEKI

SEQ ID NO: 2819482 - protein, 20 aa, Entamoeba invadens
IPYTGIPVNCDLTIDGDVSV

SEQ ID NO: 2819483 - protein, 17 aa, Entamoeba invadens
IPYTVWFSQSRRTLNEL

SEQ ID NO: 2819484 - protein, 20 aa, Entamoeba invadens
IQATLRLLAFFQNVFETKNQ

SEQ ID NO: 2819485 - protein, 24 aa, Entamoeba invadens
IQDITIIILIVFYAKKIDAKFIEI

SEQ ID NO: 2819486 - protein, 23 aa, Entamoeba invadens
IQEKLCVFDISRSNVKFFKTSAP

SEQ ID NO: 2819487 - protein, 19 aa, Entamoeba invadens
IQESFALAFFWSICEYLLS

SEQ ID NO: 2819488 - protein, 19 aa, Entamoeba invadens
IQKFYLPHNLKLKGSFDSE

SEQ ID NO: 2819489 - protein, 24 aa, Entamoeba invadens
IQKTTPAVLFPLSLTLMTVCTSVV

SEQ ID NO: 2819490 - protein, 17 aa, Entamoeba invadens
IQKWRCWQLKSWDKMTE

SEQ ID NO: 2819491 - protein, 20 aa, Entamoeba invadens
IQLEEKSIFYLNNSKVVYTT

SEQ ID NO: 2819492 - protein, 27 aa, Entamoeba invadens
IQLGMFKIMCLILSKYEDYVRCSWVTD

SEQ ID NO: 2819493 - protein, 18 aa, Entamoeba invadens
IQLITILPNPMESIKHFF

SEQ ID NO: 2819494 - protein, 17 aa, Entamoeba invadens
IQLMRRLTHPNVLQFFG

SEQ ID NO: 2819495 - protein, 30 aa, Entamoeba invadens
IQLPAPTNLLKILFPILCLVIPCILEAFKV

SEQ ID NO: 2819496 - protein, 19 aa, Entamoeba invadens
IQMSKLNSILLSNKKLLKF

SEQ ID NO: 2819497 - protein, 18 aa, Entamoeba invadens
IQMTRISDVLLTNKNVLK

SEQ ID NO: 2819498 - protein, 25 aa, Entamoeba invadens
IQNEMPLCIILRESDDYYKTSEVIT

SEQ ID NO: 2819499 - protein, 30 aa, Entamoeba invadens
IQNVKISCTSIFLLEINIPKDLASIWVSLN

SEQ ID NO: 2819500 - protein, 26 aa, Entamoeba invadens
IQNVVDTRLFFGILASFHANLLMSKA

SEQ ID NO: 2819501 - protein, 17 aa, Entamoeba invadens
IQQQFKELILSLKANFD

SEQ ID NO: 2819502 - protein, 29 aa, Entamoeba invadens
IQSLCFVHPDFFIVNKSTLFLNRCGEWLQ

SEQ ID NO: 2819503 - protein, 28 aa, Entamoeba invadens
IQSPFLDFLLSWKLFGMLYVVSMMVGLN

SEQ ID NO: 2819504 - protein, 20 aa, Entamoeba invadens
IQTCLKCFAPYVINDMTSEC

SEQ ID NO: 2819505 - protein, 25 aa, Entamoeba invadens
IQTFIIYHMWLDILIRAGVSIIPIL

SEQ ID NO: 2819506 - protein, 17 aa, Entamoeba invadens
IQTFYMVNQYSNVSFGE

SEQ ID NO: 2819507 - protein, 18 aa, Entamoeba invadens
IQTIKSLALPPHCEFLFG

SEQ ID NO: 2819508 - protein, 18 aa, Entamoeba invadens
IQVFGQFSIGYDLTIENP

SEQ ID NO: 2819509 - protein, 27 aa, Entamoeba invadens
IQVRAVVTHLLTLNLKILYIHMKKCTE

SEQ ID NO: 2819510 - protein, 23 aa, Entamoeba invadens
IQWMQLWMVYAVDKYGVWAIVAL

SEQ ID NO: 2819511 - protein, 19 aa, Entamoeba invadens
IRAFVFLMALIRSSKIDPQ

SEQ ID NO: 2819512 - protein, 18 aa, Entamoeba invadens
IRAKFYTVDIPAGKKLRV

SEQ ID NO: 2819513 - protein, 21 aa, Entamoeba invadens
IRCDVGYYLYNSKCVNCPSHC

SEQ ID NO: 2819514 - protein, 29 aa, Entamoeba invadens
IRCNSHVVWWVIVIVAIVCLSMIIVFTTT

SEQ ID NO: 2819515 - protein, 18 aa, Entamoeba invadens
IRCYSCVSGYYQSYGHCY

SEQ ID NO: 2819516 - protein, 17 aa, Entamoeba invadens
IRDIPLFQVNKVSNFDK

SEQ ID NO: 2819517 - protein, 17 aa, Entamoeba invadens
IRDLPVMFNINSIYIDF

SEQ ID NO: 2819518 - protein, 25 aa, Entamoeba invadens
IRFELSIVTIPPKFACEFSLFLNPL

SEQ ID NO: 2819519 - protein, 23 aa, Entamoeba invadens
IRFEPSIATIPPKFACEFSLFLN

SEQ ID NO: 2819520 - protein, 34 aa, Entamoeba invadens
IRFNQWFLTFTFILSFILWPYGGFWIVSGDLFGL

SEQ ID NO: 2819521 - protein, 19 aa, Entamoeba invadens
IRFTILLLTTLFASFLADI

SEQ ID NO: 2819522 - protein, 18 aa, Entamoeba invadens
IRFTPFRGVIRPKSEKDV

SEQ ID NO: 2819523 - protein, 27 aa, Entamoeba invadens
IRGTKIPYTVWFSRNRFVLKQIAELLK

SEQ ID NO: 2819524 - protein, 26 aa, Entamoeba invadens
IRHHRLYHAYFRYFARYSVNDPRAAM

SEQ ID NO: 2819525 - protein, 22 aa, Entamoeba invadens
IRKCTTCLTGKYPNPSSPFSCI

SEQ ID NO: 2819526 - protein, 26 aa, Entamoeba invadens
IRKKVPIDMKMRFKLLYDAAKGIEYL

SEQ ID NO: 2819527 - protein, 20 aa, Entamoeba invadens
IRKMIISGVRPKLGKEIPQC

SEQ ID NO: 2819528 - protein, 28 aa, Entamoeba invadens
IRLCSFNVVLWLLPVKFGLSDKFDYKIF

SEQ ID NO: 2819529 - protein, 19 aa, Entamoeba invadens
IRLVAFGMFKACLITLMVE

SEQ ID NO: 2819530 - protein, 26 aa, Entamoeba invadens
IRMLLTIFCVMYISSYLIYLLEGESI

SEQ ID NO: 2819531 - protein, 31 aa, Entamoeba invadens
IRNNHWVAFIFLKRDLTWSLFYFDTLPQNNK

SEQ ID NO: 2819532 - protein, 25 aa, Entamoeba invadens
IRQCALFFLNFFVTTQLAYCISSGF

SEQ ID NO: 2819533 - protein, 40 aa, Entamoeba invadens
IRQIISLVFSIVFQPLGCATLFAIRLRRSLNLLKMMDGDE

SEQ ID NO: 2819534 - protein, 41 aa, Entamoeba invadens
IRREFIQFKLYVLKNVFVQQIMFILILSLILDVSSYNCSYG

SEQ ID NO: 2819535 - protein, 18 aa, Entamoeba invadens
IRSNSWINVLQLFDISKN

SEQ ID NO: 2819536 - protein, 26 aa, Entamoeba invadens
IRSSRNTHLFFLKPITHIDLTSTFIR

SEQ ID NO: 2819537 - protein, 51 aa, Entamoeba invadens
IRTEPQIVTLKYGFACEFEIFLTPYCTMQLIDEIIIIALDLTTGKQNTTSI

SEQ ID NO: 2819538 - protein, 17 aa, Entamoeba invadens
IRTTLPRGTKLLIDGRL

SEQ ID NO: 2819539 - protein, 32 aa, Entamoeba invadens
IRVEWKSFLFCYLFLLISQLGTLLIPLVIQFL

SEQ ID NO: 2819540 - protein, 23 aa, Entamoeba invadens
IRVLLYFVVAIGNSFNFWSNSKL

SEQ ID NO: 2819541 - protein, 27 aa, Entamoeba invadens
IRWYVIIIGLFTRLVIVPAICIGINYL

SEQ ID NO: 2819542 - protein, 18 aa, Entamoeba invadens
ISALCVVIIIAVTLGVVL

SEQ ID NO: 2819543 - protein, 24 aa, Entamoeba invadens
ISATLNRWIDLIFGYKSCGEEALK

SEQ ID NO: 2819544 - protein, 41 aa, Entamoeba invadens
ISAYEVIGWVDCYPKKLFHFPWDIATFIAKGGRRPKTPNMS

SEQ ID NO: 2819545 - protein, 26 aa, Entamoeba invadens
ISCHSRYFLDLFMKCQTLGELANRCE

SEQ ID NO: 2819546 - protein, 21 aa, Entamoeba invadens
ISCNDGYYLNNGTCHNCPSAC

SEQ ID NO: 2819547 - protein, 28 aa, Entamoeba invadens
ISDCPIDFLTLPPVIFAKQVTLLQSEVF

SEQ ID NO: 2819548 - protein, 24 aa, Entamoeba invadens
ISDEFVAVSFFKLTKSVLLISQNA

SEQ ID NO: 2819549 - protein, 26 aa, Entamoeba invadens
ISDGSCVTFYMKDDLYLKNNVYYRCE

SEQ ID NO: 2819550 - protein, 24 aa, Entamoeba invadens
ISDNQILYLPRRLTSMKLFEINLN

SEQ ID NO: 2819551 - protein, 25 aa, Entamoeba invadens
ISDQVWLLLTLSFLSGLVAGFAYQT

SEQ ID NO: 2819552 - protein, 24 aa, Entamoeba invadens
ISDTRTIVWRLEKNRRIILETIVR

SEQ ID NO: 2819553 - protein, 22 aa, Entamoeba invadens
ISEDLCYELKLFSGLETIHADV

SEQ ID NO: 2819554 - protein, 26 aa, Entamoeba invadens
ISELLRLIQIAFIASPIFYSINVTCS

SEQ ID NO: 2819555 - protein, 17 aa, Entamoeba invadens
ISELRLISFDYNKLIIK

SEQ ID NO: 2819556 - protein, 26 aa, Entamoeba invadens
ISESSSFIYPMHCPIYTNSSLFKVES

SEQ ID NO: 2819557 - protein, 19 aa, Entamoeba invadens
ISFPFEAEGYFAYPVCFQT

SEQ ID NO: 2819558 - protein, 24 aa, Entamoeba invadens
ISFYLITPIQRIPRYELLIRDMLK

SEQ ID NO: 2819559 - protein, 21 aa, Entamoeba invadens
ISGDLKPLTLLQKGARLITSK

SEQ ID NO: 2819560 - protein, 22 aa, Entamoeba invadens
ISGMPFYIFNLIEELDEEGEYY

SEQ ID NO: 2819561 - protein, 20 aa, Entamoeba invadens
ISGNGLDVFFNCHICPAGTY

SEQ ID NO: 2819562 - protein, 25 aa, Entamoeba invadens
ISIAKKSGLIFAGGKIRLPGSNESV

SEQ ID NO: 2819563 - protein, 26 aa, Entamoeba invadens
ISIAVLFQLLFFTTVMLFGICVIFIT

SEQ ID NO: 2819564 - protein, 23 aa, Entamoeba invadens
ISIIHFSFYNLVLSATLLIFVLI

SEQ ID NO: 2819565 - protein, 21 aa, Entamoeba invadens
ISIIIRVIVPLVIFLTFAVFI

SEQ ID NO: 2819566 - protein, 17 aa, Entamoeba invadens
ISIIYSHFDRTPKVWLL

SEQ ID NO: 2819567 - protein, 25 aa, Entamoeba invadens
ISILVFLGLLIFFNNPFEVLRYWFN

SEQ ID NO: 2819568 - protein, 18 aa, Entamoeba invadens
ISILYFYIFGFVEVLICL

SEQ ID NO: 2819569 - protein, 29 aa, Entamoeba invadens
ISIPIETPLIMFKTLKRKITGITPICSNY

SEQ ID NO: 2819570 - protein, 26 aa, Entamoeba invadens
ISISYFFQFLFPEEFLKQKVIHNYFE

SEQ ID NO: 2819571 - protein, 17 aa, Entamoeba invadens
ISITQVIIVVFLGIIFD

SEQ ID NO: 2819572 - protein, 35 aa, Entamoeba invadens
ISITSKQWDFVYFWQYYLKLLVPGKTRIYVCLIHE

SEQ ID NO: 2819573 - protein, 24 aa, Entamoeba invadens
ISKILRVRFCLNAAKGIQYLHSNG

SEQ ID NO: 2819574 - protein, 25 aa, Entamoeba invadens
ISKKCLDIFLVIPKIEISAQRLNVT

SEQ ID NO: 2819575 - protein, 17 aa, Entamoeba invadens
ISKKKILTKYLRVKLCL

SEQ ID NO: 2819576 - protein, 18 aa, Entamoeba invadens
ISKLEFKCFCNCRNMSKI

SEQ ID NO: 2819577 - protein, 17 aa, Entamoeba invadens
ISKNLDQLLLLLDKERL

SEQ ID NO: 2819578 - protein, 30 aa, Entamoeba invadens
ISKSSFVLQYLFTLAFIIKKELYVKMQMRP

SEQ ID NO: 2819579 - protein, 45 aa, Entamoeba invadens
ISKTALAISLPLIATLFIIFFVVFIILLVLFLREKNHKNQLEKSI

SEQ ID NO: 2819580 - protein, 32 aa, Entamoeba invadens
ISKWSSAKNLWIKGYFKYLWSDSTIAVDNINT

SEQ ID NO: 2819581 - protein, 18 aa, Entamoeba invadens
ISLAVMFWVGLTDVSIFG

SEQ ID NO: 2819582 - protein, 17 aa, Entamoeba invadens
ISLFGCCDKIIDGLFLG

SEQ ID NO: 2819583 - protein, 19 aa, Entamoeba invadens
ISLLFTAVLAVLTYVRQSK

SEQ ID NO: 2819584 - protein, 18 aa, Entamoeba invadens
ISLTLLICITLAENLICP

SEQ ID NO: 2819585 - protein, 17 aa, Entamoeba invadens
ISLVLFMVITIPLSYIN

SEQ ID NO: 2819586 - protein, 17 aa, Entamoeba invadens
ISNFAPDIPLIVTEWSF

SEQ ID NO: 2819587 - protein, 18 aa, Entamoeba invadens
ISNFWFKKGLGVTSVTIT

SEQ ID NO: 2819588 - protein, 25 aa, Entamoeba invadens
ISNKWINVLQLFYISKDTTLVLNGL

SEQ ID NO: 2819589 - protein, 38 aa, Entamoeba invadens
ISNPKLDAPPLDLWDSMYLHLYHNYPGRLDFEIKNPIG

SEQ ID NO: 2819590 - protein, 25 aa, Entamoeba invadens
ISNSFSKFLKHRNFFNKISTRLVTS

SEQ ID NO: 2819591 - protein, 41 aa, Entamoeba invadens
ISNYMIRNITIQTLYQLACMLPLIFAGRFIPFLEAPCGFVS

SEQ ID NO: 2819592 - protein, 25 aa, Entamoeba invadens
ISPFEWCNVCIDLLPLTMIDYLTSP

SEQ ID NO: 2819593 - protein, 31 aa, Entamoeba invadens
ISPILSLCMLLRYFYLRFVNKLETSTSDIIV

SEQ ID NO: 2819594 - protein, 23 aa, Entamoeba invadens
ISQMKVPPSPLPLLVSFTNIILE

SEQ ID NO: 2819595 - protein, 23 aa, Entamoeba invadens
ISQRDWIFLYQSSARIANLIPFN

SEQ ID NO: 2819596 - protein, 18 aa, Entamoeba invadens
ISRFILLSSNNPVIDCDC

SEQ ID NO: 2819597 - protein, 26 aa, Entamoeba invadens
ISSVVVLFIICITITIVVITKKHSKV

SEQ ID NO: 2819598 - protein, 20 aa, Entamoeba invadens
ISTEVFALNTLYSSPNNISQ

SEQ ID NO: 2819599 - protein, 22 aa, Entamoeba invadens
ISTFEYLCILNFFAGRSFVDIS

SEQ ID NO: 2819600 - protein, 25 aa, Entamoeba invadens
ISTVLILYILFLILENRKVCDLQKK

SEQ ID NO: 2819601 - protein, 19 aa, Entamoeba invadens
ISVCIIGFVALLQHTFENF

SEQ ID NO: 2819602 - protein, 23 aa, Entamoeba invadens
ISVDTKFIFVKSTLIINNRDIRD

SEQ ID NO: 2819603 - protein, 37 aa, Entamoeba invadens
ISVIESFFNIILYNKSIFIFKTLGFTMNLFAANIEDD

SEQ ID NO: 2819604 - protein, 25 aa, Entamoeba invadens
ISVISPFLPFLNLTRKFDTQLVQLL

SEQ ID NO: 2819605 - protein, 24 aa, Entamoeba invadens
ISVSNVFLDIIWTKMIVSNVPIYA

SEQ ID NO: 2819606 - protein, 25 aa, Entamoeba invadens
ISVTVAIPLFIIFHITTRPHSFTCD

SEQ ID NO: 2819607 - protein, 26 aa, Entamoeba invadens
ISYARFRLWVFPRYIIYAAFQAYHVI

SEQ ID NO: 2819608 - protein, 24 aa, Entamoeba invadens
ITAAYILKIIYFRGVVRENCNLIM

SEQ ID NO: 2819609 - protein, 17 aa, Entamoeba invadens
ITAGCCLVIIPLAFITK

SEQ ID NO: 2819610 - protein, 17 aa, Entamoeba invadens
ITALLSLAFYYLKNKYG

SEQ ID NO: 2819611 - protein, 31 aa, Entamoeba invadens
ITAVGYTYCTIYAFVLFLKKGLDCSELNQSD

SEQ ID NO: 2819612 - protein, 32 aa, Entamoeba invadens
ITAVGYTYCTIYAFVLFLKKGLDCSELNQSDY

SEQ ID NO: 2819613 - protein, 20 aa, Entamoeba invadens
ITCLPDFSRKCKVCAIGFYP

SEQ ID NO: 2819614 - protein, 25 aa, Entamoeba invadens
ITCRENSGFYLFNGRCVVCDLTCKA

SEQ ID NO: 2819615 - protein, 24 aa, Entamoeba invadens
ITCTSCREGYYIDITNQCTICEVS

SEQ ID NO: 2819616 - protein, 25 aa, Entamoeba invadens
ITCVVLFTVFVTVPCVLISTVLITK

SEQ ID NO: 2819617 - protein, 17 aa, Entamoeba invadens
ITEFALFGSLKDVLKHK

SEQ ID NO: 2819618 - protein, 19 aa, Entamoeba invadens
ITEKLMFWCDERKFEANCY

SEQ ID NO: 2819619 - protein, 20 aa, Entamoeba invadens
ITFEPIPNKKICTNKLILHF

SEQ ID NO: 2819620 - protein, 24 aa, Entamoeba invadens
ITFESPYSILLLNSIKTENVKIHV

SEQ ID NO: 2819621 - protein, 21 aa, Entamoeba invadens
ITFQDNLQYITELFYHGINAP

SEQ ID NO: 2819622 - protein, 21 aa, Entamoeba invadens
ITFQDNLQYITELFYHGVNAP

SEQ ID NO: 2819623 - protein, 26 aa, Entamoeba invadens
ITFSYDKLYFISNKPRKILITNQSTM

SEQ ID NO: 2819624 - protein, 23 aa, Entamoeba invadens
ITFTEPIIKQYFFKNSKIDSYNG

SEQ ID NO: 2819625 - protein, 21 aa, Entamoeba invadens
ITFYDINEWLVSNKKTLVFVN

SEQ ID NO: 2819626 - protein, 31 aa, Entamoeba invadens
ITGTILVYIIFIPIILWAVCRFAYKVKNSLV

SEQ ID NO: 2819627 - protein, 34 aa, Entamoeba invadens
ITIALPDFIITKFIALAIRLYLKLMKQAAYNDHV

SEQ ID NO: 2819628 - protein, 31 aa, Entamoeba invadens
ITIEEYNPLIYWAINTYYILSGSTITFIGRN

SEQ ID NO: 2819629 - protein, 17 aa, Entamoeba invadens
ITIKCKIPSQLFVISFD

SEQ ID NO: 2819630 - protein, 18 aa, Entamoeba invadens
ITIPFTTIGFIDPNARNT

SEQ ID NO: 2819631 - protein, 20 aa, Entamoeba invadens
ITITPELVFLRPNKAMEFTI

SEQ ID NO: 2819632 - protein, 18 aa, Entamoeba invadens
ITKFIWRTKYNINKRLLI

SEQ ID NO: 2819633 - protein, 20 aa, Entamoeba invadens
ITKIRNHNIWYGCNGKFVVP

SEQ ID NO: 2819634 - protein, 20 aa, Entamoeba invadens
ITKKMRVKFMLDASKGILYL

SEQ ID NO: 2819635 - protein, 25 aa, Entamoeba invadens
ITKKTYFFEVLATPSHRYSLDIEPP

SEQ ID NO: 2819636 - protein, 18 aa, Entamoeba invadens
ITKLGEGSFGIVYKGNYR

SEQ ID NO: 2819637 - protein, 34 aa, Entamoeba invadens
ITKLKAQNFFDNMVKYIGAFAFFDIAKNPPQPES

SEQ ID NO: 2819638 - protein, 27 aa, Entamoeba invadens
ITKVSQPFIFLWSKLPEIVRFSIKNFF

SEQ ID NO: 2819639 - protein, 32 aa, Entamoeba invadens
ITLFECFGWREAYPVAMFPYAWNIAEFVSNGN

SEQ ID NO: 2819640 - protein, 20 aa, Entamoeba invadens
ITLFPFDIIRWIGFGCTLCV

SEQ ID NO: 2819641 - protein, 24 aa, Entamoeba invadens
ITLGEISMLRLIAQRYGKKVIIGS

SEQ ID NO: 2819642 - protein, 19 aa, Entamoeba invadens
ITLILTVTTLIVLSTKFGE

SEQ ID NO: 2819643 - protein, 19 aa, Entamoeba invadens
ITLKDDVWKKEFVLGFLHT

SEQ ID NO: 2819644 - protein, 33 aa, Entamoeba invadens
ITLQDLLICIIIIIITMVFIKLNIQIKKKLVLK

SEQ ID NO: 2819645 - protein, 20 aa, Entamoeba invadens
ITLRFAWVLNLVVIYCNWFD

SEQ ID NO: 2819646 - protein, 17 aa, Entamoeba invadens
ITLSFKFVSPKKQSVFY

SEQ ID NO: 2819647 - protein, 18 aa, Entamoeba invadens
ITLYILPSTSRITKTVTV

SEQ ID NO: 2819648 - protein, 26 aa, Entamoeba invadens
ITLYSLSVLPPLKNFPLRTVVWLTCY

SEQ ID NO: 2819649 - protein, 25 aa, Entamoeba invadens
ITMDAFLMNYFAYNINRNLNRSCES

SEQ ID NO: 2819650 - protein, 25 aa, Entamoeba invadens
ITMDKLSVILFFHSSKKFLSVTTEF

SEQ ID NO: 2819651 - protein, 24 aa, Entamoeba invadens
ITMRDTFVLTVHPKPLFAIRRVMD

SEQ ID NO: 2819652 - protein, 20 aa, Entamoeba invadens
ITMVKTEKWGLLKKGTLSLY

SEQ ID NO: 2819653 - protein, 34 aa, Entamoeba invadens
ITMYECFQWTEAYPKTFFNYPWKIAEFVTAGKRL

SEQ ID NO: 2819654 - protein, 24 aa, Entamoeba invadens
ITMYECFTWSDAFPKDVYKYAWDI

SEQ ID NO: 2819655 - protein, 22 aa, Entamoeba invadens
ITNESSFDFAITKIPLTQSEMP

SEQ ID NO: 2819656 - protein, 18 aa, Entamoeba invadens
ITNKLFQPKLKGANLYTH

SEQ ID NO: 2819657 - protein, 48 aa, Entamoeba invadens
ITNYGVVIGVPLFILVALIIVISLIIVIIYLLIMKQKEKKKLENICVF

SEQ ID NO: 2819658 - protein, 19 aa, Entamoeba invadens
ITPIQRIPRYELLIRDMLK

SEQ ID NO: 2819659 - protein, 39 aa, Entamoeba invadens
ITPRKLFIYINGSSVFLMFIYLLVLSLWNLFASVADRFG

SEQ ID NO: 2819660 - protein, 25 aa, Entamoeba invadens
ITPTDTLFPIYRLPKNQIVKNYPEE

SEQ ID NO: 2819661 - protein, 44 aa, Entamoeba invadens
ITQIVYFLTIVAIPILHLVSLFALWFLPLQRKFQSWLYHACEVF

SEQ ID NO: 2819662 - protein, 30 aa, Entamoeba invadens
ITQKNVILVHLFLLLMYSFVIDKKDGEKYD

SEQ ID NO: 2819663 - protein, 21 aa, Entamoeba invadens
ITQTFQYLPECDYIYVMKNNT

SEQ ID NO: 2819664 - protein, 26 aa, Entamoeba invadens
ITQVIIVVFLGIIFDGTPFSPSNNQY

SEQ ID NO: 2819665 - protein, 26 aa, Entamoeba invadens
ITRDDYFMWAMAFHPDRGNLYPNIPL

SEQ ID NO: 2819666 - protein, 17 aa, Entamoeba invadens
ITRGIYFRIQTNEEWTI

SEQ ID NO: 2819667 - protein, 22 aa, Entamoeba invadens
ITRMCIVLFNYLCYFRSTSLSS

SEQ ID NO: 2819668 - protein, 38 aa, Entamoeba invadens
ITRTFVIPLEYLSQLLSLFFLLPNYPDNFLASLSNLVM

SEQ ID NO: 2819669 - protein, 34 aa, Entamoeba invadens
ITSDFLCKFLSLLRLYLLLFSALLHLTTTFSFTS

SEQ ID NO: 2819670 - protein, 18 aa, Entamoeba invadens
ITSGAFEIFALLAIALAF

SEQ ID NO: 2819671 - protein, 19 aa, Entamoeba invadens
ITSGAFEVFALLALALAFL

SEQ ID NO: 2819672 - protein, 19 aa, Entamoeba invadens
ITSLFIGDLWCDIDPLSRI

SEQ ID NO: 2819673 - protein, 42 aa, Entamoeba invadens
ITSLSVTFVVIVIIVVIVLLFTLSYLYNYFGNKKKMQNVCVF

SEQ ID NO: 2819674 - protein, 27 aa, Entamoeba invadens
ITSNGINFFFPPLKLNSIFALKVTSDK

SEQ ID NO: 2819675 - protein, 26 aa, Entamoeba invadens
ITSPSWLIIVVLVLLLGYTSYKTFTK

SEQ ID NO: 2819676 - protein, 27 aa, Entamoeba invadens
ITSTLKGLFRRLPVLLIPKSVNDRIEQ

SEQ ID NO: 2819677 - protein, 26 aa, Entamoeba invadens
ITTCTVCLAAYILQTNGTCLMSSNPA

SEQ ID NO: 2819678 - protein, 23 aa, Entamoeba invadens
ITTHINIMMPYGRPSIKILDLMN

SEQ ID NO: 2819679 - protein, 22 aa, Entamoeba invadens
ITTLQYFCQYIFRQVNRLVQFS

SEQ ID NO: 2819680 - protein, 30 aa, Entamoeba invadens
ITTMIGVTVLLLFIIPISKSQERIFVLDKC

SEQ ID NO: 2819681 - protein, 26 aa, Entamoeba invadens
ITTNLTFDILVIGKIGFFSSGELCKY

SEQ ID NO: 2819682 - protein, 33 aa, Entamoeba invadens
ITTTKTIEILWRQLFFVFFVEDGNLIRKGKVRH

SEQ ID NO: 2819683 - protein, 25 aa, Entamoeba invadens
ITVLICIILAMNFFMKLARTREMKQ

SEQ ID NO: 2819684 - protein, 17 aa, Entamoeba invadens
ITVLIISLCAYTTKPTG

SEQ ID NO: 2819685 - protein, 18 aa, Entamoeba invadens
ITVLKTPLGVILDMNKLT

SEQ ID NO: 2819686 - protein, 18 aa, Entamoeba invadens
ITWNTFRGFPIYTGAFCC

SEQ ID NO: 2819687 - protein, 25 aa, Entamoeba invadens
ITYSVPLCIIMFAALFRELREDIRR

SEQ ID NO: 2819688 - protein, 20 aa, Entamoeba invadens
IVACVVAFVELFFFSQSAVS

SEQ ID NO: 2819689 - protein, 28 aa, Entamoeba invadens
IVAIPLLHMIMMLFLWVTPMTRKVQFYV

SEQ ID NO: 2819690 - protein, 33 aa, Entamoeba invadens
IVALFQPQLYFGLFLFVAVLLTYKALLQSNPSF

SEQ ID NO: 2819691 - protein, 34 aa, Entamoeba invadens
IVALLILTTVIILVVILFVKIFNHLKHKNQSRHM

SEQ ID NO: 2819692 - protein, 18 aa, Entamoeba invadens
IVCKKECDYGNGIYVHCT

SEQ ID NO: 2819693 - protein, 25 aa, Entamoeba invadens
IVCLSMIIVFTTTVYIIIRNIIKQR

SEQ ID NO: 2819694 - protein, 24 aa, Entamoeba invadens
IVCMMLLNYQIQYLDTLDIPCDTL

SEQ ID NO: 2819695 - protein, 18 aa, Entamoeba invadens
IVCMVAGFMNLKVNNTLM

SEQ ID NO: 2819696 - protein, 18 aa, Entamoeba invadens
IVCRRMLHSFLVEGITVL

SEQ ID NO: 2819697 - protein, 18 aa, Entamoeba invadens
IVCSFICSILGALAWYYP

SEQ ID NO: 2819698 - protein, 19 aa, Entamoeba invadens
IVCTECFSGYFLTSSYTCE

SEQ ID NO: 2819699 - protein, 44 aa, Entamoeba invadens
IVCTSMLYYLLGNAIFYGLFALFLCFILILCLSKIQRKLRTQLM

SEQ ID NO: 2819700 - protein, 18 aa, Entamoeba invadens
IVDFIQRICPLSSLFEFH

SEQ ID NO: 2819701 - protein, 35 aa, Entamoeba invadens
IVDLNMIINVITAIPLFYFVFASKSILYPWRSHVY

SEQ ID NO: 2819702 - protein, 25 aa, Entamoeba invadens
IVDLNVGRALFYFKPYSSEVKDVRE

SEQ ID NO: 2819703 - protein, 26 aa, Entamoeba invadens
IVDYNIAWFIPSLFFFCTIVLLDIFT

SEQ ID NO: 2819704 - protein, 30 aa, Entamoeba invadens
IVEKLRLRSLTILKLFLDDICLQNVPVPNG

SEQ ID NO: 2819705 - protein, 30 aa, Entamoeba invadens
IVELLLLCYPIFFLFLVFYKDKKSKNFKRS

SEQ ID NO: 2819706 - protein, 19 aa, Entamoeba invadens
IVESGAYIYLFGDFINEDN

SEQ ID NO: 2819707 - protein, 20 aa, Entamoeba invadens
IVFDTTFSCVALLNTLQLTE

SEQ ID NO: 2819708 - protein, 30 aa, Entamoeba invadens
IVFGISFLLAILAYLFWLAFDVIRSFSERR

SEQ ID NO: 2819709 - protein, 29 aa, Entamoeba invadens
IVFGIVVIYIYYFLTQLKPFFFSFVNLIL

SEQ ID NO: 2819710 - protein, 32 aa, Entamoeba invadens
IVFIILSTLVFSLLLLFYSTLGYGIATLTYPR

SEQ ID NO: 2819711 - protein, 25 aa, Entamoeba invadens
IVFILIYLLYVIFIGYITRGKPLIK

SEQ ID NO: 2819712 - protein, 30 aa, Entamoeba invadens
IVFLDSIIRALFFTFYENSTLHLNSNATIE

SEQ ID NO: 2819713 - protein, 17 aa, Entamoeba invadens
IVFSHGIDIFISTEGQD

SEQ ID NO: 2819714 - protein, 17 aa, Entamoeba invadens
IVFSLFCVVLVTVSACA

SEQ ID NO: 2819715 - protein, 27 aa, Entamoeba invadens
IVFSTHSIFIAFMMIYIGSKENTKKQL

SEQ ID NO: 2819716 - protein, 20 aa, Entamoeba invadens
IVFSVFNFHVGQELQFTIGL

SEQ ID NO: 2819717 - protein, 18 aa, Entamoeba invadens
IVFTFYRTSNGPDVQENV

SEQ ID NO: 2819718 - protein, 17 aa, Entamoeba invadens
IVFTVMSTEVDITCSST

SEQ ID NO: 2819719 - protein, 38 aa, Entamoeba invadens
IVGGFVLILLIIMFFTFQAILLLPTIQRLIHRIPYLDR

SEQ ID NO: 2819720 - protein, 21 aa, Entamoeba invadens
IVGIFFTLFIPSKSSFEDEQN

SEQ ID NO: 2819721 - protein, 19 aa, Entamoeba invadens
IVGKHNLPIFFGKITHPIT

SEQ ID NO: 2819722 - protein, 21 aa, Entamoeba invadens
IVGLVIGCVCAFLIAVVIIGI

SEQ ID NO: 2819723 - protein, 24 aa, Entamoeba invadens
IVGNKVYEYLYYNPTNNTLNTIHE

SEQ ID NO: 2819724 - protein, 41 aa, Entamoeba invadens
IVGNLRKCLKCFAPYYLSSDGLLCILAYSATTHYNNTLQTK

SEQ ID NO: 2819725 - protein, 17 aa, Entamoeba invadens
IVGVILCSILVAGIILY

SEQ ID NO: 2819726 - protein, 46 aa, Entamoeba invadens
IVGYIFEEKYHMSPFILHLVGAAFCQLLLICQISGKEKIYLTLDRN

SEQ ID NO: 2819727 - protein, 28 aa, Entamoeba invadens
IVIIISIATFIIITYSYVLKIKQKKVSL

SEQ ID NO: 2819728 - protein, 24 aa, Entamoeba invadens
IVIIKIVVMEYTDILMKLLPSGEL

SEQ ID NO: 2819729 - protein, 18 aa, Entamoeba invadens
IVILSRLVYRKGVDLAVG

SEQ ID NO: 2819730 - protein, 18 aa, Entamoeba invadens
IVIPQSFYEVIAKKKYYS

SEQ ID NO: 2819731 - protein, 29 aa, Entamoeba invadens
IVISETVRFFHVIWVAFQTSDTLLWYVLH

SEQ ID NO: 2819732 - protein, 21 aa, Entamoeba invadens
IVITLIIIIIIVIVLIVVFKK

SEQ ID NO: 2819733 - protein, 27 aa, Entamoeba invadens
IVIVLHSLFYVFYKRIVVAPSIFIALS

SEQ ID NO: 2819734 - protein, 17 aa, Entamoeba invadens
IVIYIIGILFQMPVSLA

SEQ ID NO: 2819735 - protein, 21 aa, Entamoeba invadens
IVIYTLTCYIPGYSTYNISWH

SEQ ID NO: 2819736 - protein, 24 aa, Entamoeba invadens
IVKEFEIFYKLLDVIKKLINTKEQ

SEQ ID NO: 2819737 - protein, 22 aa, Entamoeba invadens
IVKIECHIISTLQIHVSDDIKY

SEQ ID NO: 2819738 - protein, 25 aa, Entamoeba invadens
IVKIERIFLAFFQVANFKTKQELVH

SEQ ID NO: 2819739 - protein, 17 aa, Entamoeba invadens
IVKLTDFGYQDTYMKFW

SEQ ID NO: 2819740 - protein, 29 aa, Entamoeba invadens
IVKRSKGFSNVKYYFFKGTFEIQLQGNFT

SEQ ID NO: 2819741 - protein, 25 aa, Entamoeba invadens
IVKSEKVILVIYRLLCRMNEATNNS

SEQ ID NO: 2819742 - protein, 28 aa, Entamoeba invadens
IVLAMIQITFPVYLLTKLDIPFKEEESR

SEQ ID NO: 2819743 - protein, 18 aa, Entamoeba invadens
IVLATFFAVLFQVVRIIS

SEQ ID NO: 2819744 - protein, 23 aa, Entamoeba invadens
IVLCLLTALLYYFDITKFVFSYY

SEQ ID NO: 2819745 - protein, 22 aa, Entamoeba invadens
IVLHQFVLDDVLFGIFPFVDLV

SEQ ID NO: 2819746 - protein, 17 aa, Entamoeba invadens
IVLIKKYSNLCIIVVLV

SEQ ID NO: 2819747 - protein, 22 aa, Entamoeba invadens
IVLKGFQLYDYSTLAISNNALI

SEQ ID NO: 2819748 - protein, 19 aa, Entamoeba invadens
IVLLAAKLNKSAQLVRLVF

SEQ ID NO: 2819749 - protein, 18 aa, Entamoeba invadens
IVLLALSVLLVHSLLTIN

SEQ ID NO: 2819750 - protein, 18 aa, Entamoeba invadens
IVLLGLGLICLVLTFLEG

SEQ ID NO: 2819751 - protein, 41 aa, Entamoeba invadens
IVLNEILMSLPLLKPHRRCALLYALSYFKKTKMCGEGVIQL

SEQ ID NO: 2819752 - protein, 18 aa, Entamoeba invadens
IVLVFICITTTKGAISPW

SEQ ID NO: 2819753 - protein, 26 aa, Entamoeba invadens
IVLVSLLIFNSIWTIPLSGGPFEGIT

SEQ ID NO: 2819754 - protein, 46 aa, Entamoeba invadens
IVLVTFVFVLLFYFRCMKIIVGWLLLSVILLLMFFGGSIFQTILGV

SEQ ID NO: 2819755 - protein, 23 aa, Entamoeba invadens
IVLVTSILIYFIVDNKNVCYRNA

SEQ ID NO: 2819756 - protein, 25 aa, Entamoeba invadens
IVMIVFVCFFFFVSGYFVIAFSICL

SEQ ID NO: 2819757 - protein, 17 aa, Entamoeba invadens
IVMSVMMTILETVFILW

SEQ ID NO: 2819758 - protein, 19 aa, Entamoeba invadens
IVMWEFLARKEPYPDIPRF

SEQ ID NO: 2819759 - protein, 36 aa, Entamoeba invadens
IVMYECLGWSMAYPKEQFVFPWDIAEFISKGQRLPK

SEQ ID NO: 2819760 - protein, 24 aa, Entamoeba invadens
IVNKNVIQFVYIEGAFVEMGMRLK

SEQ ID NO: 2819761 - protein, 21 aa, Entamoeba invadens
IVPAFLYYKYQYLNLAWIILC

SEQ ID NO: 2819762 - protein, 34 aa, Entamoeba invadens
IVPGIPLYFVLVAIVFIIVIFIMLIKAFGYVVAT

SEQ ID NO: 2819763 - protein, 34 aa, Entamoeba invadens
IVPVSFPSLPWNCYDPTFLFSAPLPSNLEISLTT

SEQ ID NO: 2819764 - protein, 17 aa, Entamoeba invadens
IVQLIGMKKTDLPFAIR

SEQ ID NO: 2819765 - protein, 17 aa, Entamoeba invadens
IVQLIQRFYDPTYGIVK

SEQ ID NO: 2819766 - protein, 27 aa, Entamoeba invadens
IVQMCYFLVFLRLVLITLFDFTQELSI

SEQ ID NO: 2819767 - protein, 18 aa, Entamoeba invadens
IVQTLFFDSTLSIVKNRT

SEQ ID NO: 2819768 - protein, 19 aa, Entamoeba invadens
IVRLMILFGKDTINSNFVI

SEQ ID NO: 2819769 - protein, 30 aa, Entamoeba invadens
IVRVGFLFFIAAVAVILIFPSSIPALYVSV

SEQ ID NO: 2819770 - protein, 25 aa, Entamoeba invadens
IVSHLRPVIILLLHKILQCEKTQQK

SEQ ID NO: 2819771 - protein, 24 aa, Entamoeba invadens
IVSIIIILITMIQKKKLAKKEQNI

SEQ ID NO: 2819772 - protein, 35 aa, Entamoeba invadens
IVSNIAIIDLPLNKWPDLMTFLLSDITMAKLKAVV

SEQ ID NO: 2819773 - protein, 23 aa, Entamoeba invadens
IVSPTLNIVPWELLEPFKDCVRY

SEQ ID NO: 2819774 - protein, 25 aa, Entamoeba invadens
IVSVIVIVVLVVRRLKKYTDEVSMQ

SEQ ID NO: 2819775 - protein, 23 aa, Entamoeba invadens
IVSVQMWFLSVSTLFIMVAYLAI

SEQ ID NO: 2819776 - protein, 19 aa, Entamoeba invadens
IVTGYIRNAFMLLQSRVVV

SEQ ID NO: 2819777 - protein, 28 aa, Entamoeba invadens
IVTKQWTIYVWFNALLLLGSALCSNPFE

SEQ ID NO: 2819778 - protein, 18 aa, Entamoeba invadens
IVTNVYLIRPLYFVASAG

SEQ ID NO: 2819779 - protein, 24 aa, Entamoeba invadens
IVTRKNFHFTFDTTQIIFKNYCGN

SEQ ID NO: 2819780 - protein, 25 aa, Entamoeba invadens
IVTSADLFVLLIKNLPHTSQLLSRL

SEQ ID NO: 2819781 - protein, 17 aa, Entamoeba invadens
IVTSVGLNSLWGKTKES

SEQ ID NO: 2819782 - protein, 26 aa, Entamoeba invadens
IVTTIAFVVFISFTAVVIGLAVGLSV

SEQ ID NO: 2819783 - protein, 21 aa, Entamoeba invadens
IVTTIIVVTVILIQRKKERIK

SEQ ID NO: 2819784 - protein, 17 aa, Entamoeba invadens
IVVEFNKMFFSSYSFLD

SEQ ID NO: 2819785 - protein, 37 aa, Entamoeba invadens
IVVGCVAFFIILVVVFIIVFIFAMQFKKVDISIFKLQ

SEQ ID NO: 2819786 - protein, 47 aa, Entamoeba invadens
IVVLMLAIVFSIFSIVLPFFVPYLFFTLGVLVILTIVLWTVVIAQRK

SEQ ID NO: 2819787 - protein, 33 aa, Entamoeba invadens
IVVNHLLYNNWFDICLLFACLLFGTLIIDCVIS

SEQ ID NO: 2819788 - protein, 20 aa, Entamoeba invadens
IVVNKFKLKFDIDTDEFIPV

SEQ ID NO: 2819789 - protein, 19 aa, Entamoeba invadens
IVVRVKFMIDLANGILYLH

SEQ ID NO: 2819790 - protein, 24 aa, Entamoeba invadens
IVVSLVWFYYTIALHIPLASLFIT

SEQ ID NO: 2819791 - protein, 36 aa, Entamoeba invadens
IVWTLFTYFVGHIGFLFFLHFGALLFLPIFAYSAFA

SEQ ID NO: 2819792 - protein, 23 aa, Entamoeba invadens
IVYEADYFWNLWTNGKVDIDGRY

SEQ ID NO: 2819793 - protein, 18 aa, Entamoeba invadens
IVYILYNAFMFFVTLCFV

SEQ ID NO: 2819794 - protein, 24 aa, Entamoeba invadens
IVYKGDFIVHFYGAVLIPNKVCMV

SEQ ID NO: 2819795 - protein, 20 aa, Entamoeba invadens
IVYLGEFRGYKIAIKKMKEG

SEQ ID NO: 2819796 - protein, 24 aa, Entamoeba invadens
IVYPSGYSILIDLGEELNNHKPTN

SEQ ID NO: 2819797 - protein, 20 aa, Entamoeba invadens
IWGCLICEPGYYNNDNNCVK

SEQ ID NO: 2819798 - protein, 18 aa, Entamoeba invadens
IWQYKLTLNLISLAIILG

SEQ ID NO: 2819799 - protein, 17 aa, Entamoeba invadens
IWRRRVIQFIGEQINTY

SEQ ID NO: 2819800 - protein, 18 aa, Entamoeba invadens
IWVKRTALMILNQKLTDL

SEQ ID NO: 2819801 - protein, 25 aa, Entamoeba invadens
IYCTNFNYLLMEIQLFDYMSHSISK

SEQ ID NO: 2819802 - protein, 26 aa, Entamoeba invadens
IYDENISVLIFTLNNTKVTFLNTKQV

SEQ ID NO: 2819803 - protein, 23 aa, Entamoeba invadens
IYDFLCPYYFPERVQTFFDVIVK

SEQ ID NO: 2819804 - protein, 17 aa, Entamoeba invadens
IYDICYPVRWCPVCNSF

SEQ ID NO: 2819805 - protein, 18 aa, Entamoeba invadens
IYEIVLLRDVYGIEYKYP

SEQ ID NO: 2819806 - protein, 33 aa, Entamoeba invadens
IYEVVGWCKAYPTETFKFPWKIAEFVMSGKRLE

SEQ ID NO: 2819807 - protein, 23 aa, Entamoeba invadens
IYFVSACFFLIFSIGIIAGCLLI

SEQ ID NO: 2819808 - protein, 33 aa, Entamoeba invadens
IYGGIIAVVLFLFIFRFFFLGALNGKASIKIHF

SEQ ID NO: 2819809 - protein, 18 aa, Entamoeba invadens
IYGIIGMSVAFFAAIMNK

SEQ ID NO: 2819810 - protein, 24 aa, Entamoeba invadens
IYGLFYDLFLFNVKPNALAIVGAV

SEQ ID NO: 2819811 - protein, 20 aa, Entamoeba invadens
IYGYTFINVKFIGLGSQNLS

SEQ ID NO: 2819812 - protein, 19 aa, Entamoeba invadens
IYHIPKTVLLYMIELFDQL

SEQ ID NO: 2819813 - protein, 19 aa, Entamoeba invadens
IYIAEDVLVIAKNGFIMTQ

SEQ ID NO: 2819814 - protein, 19 aa, Entamoeba invadens
IYIFACLLLMFINDNMWIL

SEQ ID NO: 2819815 - protein, 25 aa, Entamoeba invadens
IYIGFVFSLFLFKLYHNYILFCAIR

SEQ ID NO: 2819816 - protein, 19 aa, Entamoeba invadens
IYIKPLCSCVIDEDIMVIA

SEQ ID NO: 2819817 - protein, 18 aa, Entamoeba invadens
IYKIIKLCWAQDSNLRLD

SEQ ID NO: 2819818 - protein, 29 aa, Entamoeba invadens
IYKLWNGGGFWFIIFKKLSSFFQILVVAT

SEQ ID NO: 2819819 - protein, 26 aa, Entamoeba invadens
IYKTQQPLYHFYISGSSRTPPSKENR

SEQ ID NO: 2819820 - protein, 19 aa, Entamoeba invadens
IYLGYILQCGVYGTSAIVT

SEQ ID NO: 2819821 - protein, 26 aa, Entamoeba invadens
IYLLLNQFIVLIYTTTQYSFLKLSDL

SEQ ID NO: 2819822 - protein, 28 aa, Entamoeba invadens
IYLNVTQWFSIIFKTNRKYILNGIDVSV

SEQ ID NO: 2819823 - protein, 30 aa, Entamoeba invadens
IYLSAFLRAFGFLNMFSFLVPVSCLVSLEF

SEQ ID NO: 2819824 - protein, 21 aa, Entamoeba invadens
IYLYRKIVVKILDLSLFGEIN

SEQ ID NO: 2819825 - protein, 18 aa, Entamoeba invadens
IYMYPWTIADDVASGKRP

SEQ ID NO: 2819826 - protein, 49 aa, Entamoeba invadens
IYNTNILAIVLPIVFGFLIIILLIIVIALLLFYKHFKTEQKVWKELVSE

SEQ ID NO: 2819827 - protein, 28 aa, Entamoeba invadens
IYNVTTQIRYNLIWCKDFIPGVNANITL

SEQ ID NO: 2819828 - protein, 18 aa, Entamoeba invadens
IYQFCLNKFYDKIDTLTE

SEQ ID NO: 2819829 - protein, 17 aa, Entamoeba invadens
IYRLIHLANTLLLTAVT

SEQ ID NO: 2819830 - protein, 25 aa, Entamoeba invadens
IYSFAIIMWEVVMTKIPFGETDNVE

SEQ ID NO: 2819831 - protein, 25 aa, Entamoeba invadens
IYSFAITMFEVFGWSQAYRIDTFKF

SEQ ID NO: 2819832 - protein, 20 aa, Entamoeba invadens
IYSFAITMYETFNWGDAYPK

SEQ ID NO: 2819833 - protein, 34 aa, Entamoeba invadens
IYSFAMTMLEVASWAPAFPANRFKHPWDVADFVT

SEQ ID NO: 2819834 - protein, 34 aa, Entamoeba invadens
IYSKKAKICFFFFFLFSTILFLQGIITYFEVNNV

SEQ ID NO: 2819835 - protein, 21 aa, Entamoeba invadens
IYSLFLGWRNLCSSVFIAQSV

SEQ ID NO: 2819836 - protein, 23 aa, Entamoeba invadens
IYTIQTLAYCGFGCLGCYTPENK

SEQ ID NO: 2819837 - protein, 20 aa, Entamoeba invadens
IYTIVWDTIRYFLRSPNEAI

SEQ ID NO: 2819838 - protein, 25 aa, Entamoeba invadens
IYTKRFSILVVLSFVASIILYIIIY

SEQ ID NO: 2819839 - protein, 25 aa, Entamoeba invadens
IYTSGILDIFIQLTTKWKATKTGLM

SEQ ID NO: 2819840 - protein, 19 aa, Entamoeba invadens
IYTSWVLCDAILLELGYSP

SEQ ID NO: 2819841 - protein, 25 aa, Entamoeba invadens
IYVKEWYSMIFKLNQKYRVFGIDSN

SEQ ID NO: 2819842 - protein, 19 aa, Entamoeba invadens
IYVLMYSNYIFTVKNLNGC

SEQ ID NO: 2819843 - protein, 24 aa, Entamoeba invadens
IYVSLSFPFPVRISKHFKSFRTVF

SEQ ID NO: 2819844 - protein, 19 aa, Entamoeba invadens
IYVVVAELLYIPDNTKELV

SEQ ID NO: 2819845 - protein, 19 aa, Entamoeba invadens
IYYFFAHITGFTKKFTFSL

SEQ ID NO: 2819846 - protein, 31 aa, Entamoeba invadens
IYYISEFAFVGCPLLVRIHLLNVTSIGKKVF

SEQ ID NO: 2819847 - protein, 25 aa, Entamoeba invadens
KAADIFSFGVTMYEAFGWSEAYQND

SEQ ID NO: 2819848 - protein, 26 aa, Entamoeba invadens
KAADIFSFGVTMYEVFGWSEAYQNDT

SEQ ID NO: 2819849 - protein, 45 aa, Entamoeba invadens
KAADIYSLAVTFFETLIWGEAYPLKLFPFPWNVADYIASGRRREL

SEQ ID NO: 2819850 - protein, 53 aa, Entamoeba invadens
KAANWKIELYFLDLTLMFWIAIAMTIALVILGIIMLALFIRDKRKEANSHFLN

SEQ ID NO: 2819851 - protein, 24 aa, Entamoeba invadens
KACEFELFIKPLCSCQIKENILVI

SEQ ID NO: 2819852 - protein, 24 aa, Entamoeba invadens
KACEFELFIKPLCSCQIKENIMVI

SEQ ID NO: 2819853 - protein, 24 aa, Entamoeba invadens
KADAYQVFFKTKSSGKIFSLQTSE

SEQ ID NO: 2819854 - protein, 31 aa, Entamoeba invadens
KADDTITLHLRLKMMLDASKGILYLHSNGIL

SEQ ID NO: 2819855 - protein, 30 aa, Entamoeba invadens
KADIFSFSIVMFEIFHWGNPYSKDKFPFPW

SEQ ID NO: 2819856 - protein, 27 aa, Entamoeba invadens
KADLLKNVIFFFVFIVAFCSIVRYSYK

SEQ ID NO: 2819857 - protein, 20 aa, Entamoeba invadens
KADLRIFVTEKFKANKFGDN

SEQ ID NO: 2819858 - protein, 27 aa, Entamoeba invadens
KADNQTLIDFYMFFSIVAGNTPTDLTR

SEQ ID NO: 2819859 - protein, 27 aa, Entamoeba invadens
KAEKEYDAIFYAAIYVKLITVCEAVKE

SEQ ID NO: 2819860 - protein, 25 aa, Entamoeba invadens
KAFIILPLMLLFPIAVSFGVCLSYY

SEQ ID NO: 2819861 - protein, 22 aa, Entamoeba invadens
KAFPLWFCKQWTRTDPEGASLF

SEQ ID NO: 2819862 - protein, 22 aa, Entamoeba invadens
KAFYQCYSLGEFTLGNKLTQVG

SEQ ID NO: 2819863 - protein, 17 aa, Entamoeba invadens
KAGFSQKNNLCYPPLNN

SEQ ID NO: 2819864 - protein, 32 aa, Entamoeba invadens
KAGTKFFDVGKGDIKVWFRKPEMKMVCRCKQH

SEQ ID NO: 2819865 - protein, 27 aa, Entamoeba invadens
KAHRNLNILRIGFVASLLARSGAIVVC

SEQ ID NO: 2819866 - protein, 20 aa, Entamoeba invadens
KAICYVSPSKFFIHKDSLNV

SEQ ID NO: 2819867 - protein, 21 aa, Entamoeba invadens
KAITWFLQKNCMFQADLEGIV

SEQ ID NO: 2819868 - protein, 21 aa, Entamoeba invadens
KAKAWYFYLIGIALIICAQFL

SEQ ID NO: 2819869 - protein, 25 aa, Entamoeba invadens
KAKINRYLRKYLYTNYQAIQCDKVD

SEQ ID NO: 2819870 - protein, 27 aa, Entamoeba invadens
KAKSDINYFVFLGRRINYFDVKDTMFL

SEQ ID NO: 2819871 - protein, 20 aa, Entamoeba invadens
KALARSLLELGLKKGDVVGF

SEQ ID NO: 2819872 - protein, 25 aa, Entamoeba invadens
KALVYCLVLILFTYPTKDFIVWCFT

SEQ ID NO: 2819873 - protein, 29 aa, Entamoeba invadens
KAMKYLTSFLFFVLSFLLNASHTGAAPIL

SEQ ID NO: 2819874 - protein, 20 aa, Entamoeba invadens
KANGFYWDTLKSSCQLTSTL

SEQ ID NO: 2819875 - protein, 22 aa, Entamoeba invadens
KANITLFSLVYESGKKAINTDM

SEQ ID NO: 2819876 - protein, 27 aa, Entamoeba invadens
KANPFIVSLVLKIYFTSLPQPFFQKGV

SEQ ID NO: 2819877 - protein, 33 aa, Entamoeba invadens
KASGFKVSFEGGPLPWYMDKGLYFTNMSTTNSI

SEQ ID NO: 2819878 - protein, 43 aa, Entamoeba invadens
KASSKFLCIGLIVVAIVMVIIVLAILAPIIYKAIKNKNDTSDG

SEQ ID NO: 2819879 - protein, 19 aa, Entamoeba invadens
KATITIKYSPTDKFLQVIV

SEQ ID NO: 2819880 - protein, 25 aa, Entamoeba invadens
KATKSHLQYLLLTITTASGTIDTVR

SEQ ID NO: 2819881 - protein, 29 aa, Entamoeba invadens
KATRVKIIVLILLLLIVGGVIVLVLKVAL

SEQ ID NO: 2819882 - protein, 23 aa, Entamoeba invadens
KAVDIFTLGCLFYYIGCRKHPYG

SEQ ID NO: 2819883 - protein, 23 aa, Entamoeba invadens
KAVDSIYIIKATFTPDVSGFYRA

SEQ ID NO: 2819884 - protein, 26 aa, Entamoeba invadens
KAYGKPMDVFAFAITMYETFVEHPAY

SEQ ID NO: 2819885 - protein, 17 aa, Entamoeba invadens
KCALCESGYGLFNNKCN

SEQ ID NO: 2819886 - protein, 26 aa, Entamoeba invadens
KCAVFLFFSLILLALIISSLLGFLSS

SEQ ID NO: 2819887 - protein, 24 aa, Entamoeba invadens
KCDGCNEGYYWDADKQNCFPCFKN

SEQ ID NO: 2819888 - protein, 17 aa, Entamoeba invadens
KCDKCKLGFWIEDFECV

SEQ ID NO: 2819889 - protein, 28 aa, Entamoeba invadens
KCDKCSFWYKPSPDGLYCESTPVWWVIM

SEQ ID NO: 2819890 - protein, 24 aa, Entamoeba invadens
KCDKCVSSYYLLENTLTCSSTCDI

SEQ ID NO: 2819891 - protein, 23 aa, Entamoeba invadens
KCDNEFCFITLDLTGSTTDPAKI

SEQ ID NO: 2819892 - protein, 18 aa, Entamoeba invadens
KCDPIFVGYISSEGVCTA

SEQ ID NO: 2819893 - protein, 17 aa, Entamoeba invadens
KCEKCKPGFWIEDFECV

SEQ ID NO: 2819894 - protein, 17 aa, Entamoeba invadens
KCEKCKPGFWIEKFECV

SEQ ID NO: 2819895 - protein, 22 aa, Entamoeba invadens
KCEKCLPGYYSTGGILACSPCS

SEQ ID NO: 2819896 - protein, 17 aa, Entamoeba invadens
KCELCSSGKYPKSTESY

SEQ ID NO: 2819897 - protein, 20 aa, Entamoeba invadens
KCEYPCTYCSNLTFCTKCDQ

SEQ ID NO: 2819898 - protein, 18 aa, Entamoeba invadens
KCEYPCVYCLNQTFCTKC

SEQ ID NO: 2819899 - protein, 19 aa, Entamoeba invadens
KCEYPCVYCSNRTFCTKCD

SEQ ID NO: 2819900 - protein, 17 aa, Entamoeba invadens
KCFLVVVGTFIKFTKHP

SEQ ID NO: 2819901 - protein, 19 aa, Entamoeba invadens
KCFMPIDNCLFYQNSICLE

SEQ ID NO: 2819902 - protein, 22 aa, Entamoeba invadens
KCFSCVDGYYLNTSECILCSKT

SEQ ID NO: 2819903 - protein, 21 aa, Entamoeba invadens
KCGICEDGYFALNGECNLFAN

SEQ ID NO: 2819904 - protein, 31 aa, Entamoeba invadens
KCGNLKFTLKIFAFFLGLVIENVFVFARTKE

SEQ ID NO: 2819905 - protein, 20 aa, Entamoeba invadens
KCGYSCIFCNFTKPEYCLFC

SEQ ID NO: 2819906 - protein, 20 aa, Entamoeba invadens
KCIEGYFPQNYRCTKCGVTC

SEQ ID NO: 2819907 - protein, 19 aa, Entamoeba invadens
KCIIVFVCLAFDKMKRQKN

SEQ ID NO: 2819908 - protein, 18 aa, Entamoeba invadens
KCIKCLPMYIKVEKNTID

SEQ ID NO: 2819909 - protein, 20 aa, Entamoeba invadens
KCIRCASGFFLNGLVPICEA

SEQ ID NO: 2819910 - protein, 18 aa, Entamoeba invadens
KCISCKPNYYIKTSGDYK

SEQ ID NO: 2819911 - protein, 33 aa, Entamoeba invadens
KCITVPLNMFWKNNITFICSEGYYLSNENICKM

SEQ ID NO: 2819912 - protein, 17 aa, Entamoeba invadens
KCIVCRSNYYPVYSSST

SEQ ID NO: 2819913 - protein, 22 aa, Entamoeba invadens
KCIVNGFLYLKGSLQCDLLICT

SEQ ID NO: 2819914 - protein, 25 aa, Entamoeba invadens
KCKGHFMDCLTADTPMPGSSLYDNW

SEQ ID NO: 2819915 - protein, 25 aa, Entamoeba invadens
KCKGHFMECLTADTPMPGSSLYDNW

SEQ ID NO: 2819916 - protein, 17 aa, Entamoeba invadens
KCKLCMNGYYYSNKKCF

SEQ ID NO: 2819917 - protein, 20 aa, Entamoeba invadens
KCKLGFWIEDFECVTCETCG

SEQ ID NO: 2819918 - protein, 25 aa, Entamoeba invadens
KCKNQYLPKFYGAVFVTTKISFVVE

SEQ ID NO: 2819919 - protein, 22 aa, Entamoeba invadens
KCKVCAIGFYPDETSGKCVACS

SEQ ID NO: 2819920 - protein, 23 aa, Entamoeba invadens
KCLDGYVLYYGGCSMCGNGVLDE

SEQ ID NO: 2819921 - protein, 18 aa, Entamoeba invadens
KCLICKKDYYYYSSNSSC

SEQ ID NO: 2819922 - protein, 21 aa, Entamoeba invadens
KCLKCFAPYVISNQMCVLGYS

SEQ ID NO: 2819923 - protein, 17 aa, Entamoeba invadens
KCLLCNSGFMLSLSGTC

SEQ ID NO: 2819924 - protein, 24 aa, Entamoeba invadens
KCLLQDILKLILMLNEEFSTMSQT

SEQ ID NO: 2819925 - protein, 30 aa, Entamoeba invadens
KCLMHYKDNLEGVLKFMRENGILDNIVSQD

SEQ ID NO: 2819926 - protein, 24 aa, Entamoeba invadens
KCLNGFDIYFENKCLQKCPSGYFK

SEQ ID NO: 2819927 - protein, 17 aa, Entamoeba invadens
KCLQCYDGYLLIDETCF

SEQ ID NO: 2819928 - protein, 19 aa, Entamoeba invadens
KCLQKCPSGYFKSQTICEK

SEQ ID NO: 2819929 - protein, 17 aa, Entamoeba invadens
KCLSCISGYVLQPMGEC

SEQ ID NO: 2819930 - protein, 19 aa, Entamoeba invadens
KCLSCKYGFYQGENHTCLP

SEQ ID NO: 2819931 - protein, 31 aa, Entamoeba invadens
KCLSCVDNYFLIPSEFALCQPFDLLTNCLNK

SEQ ID NO: 2819932 - protein, 19 aa, Entamoeba invadens
KCLTCNSSYYLTITGMCKP

SEQ ID NO: 2819933 - protein, 19 aa, Entamoeba invadens
KCLYSYALIPDCSCYINSS

SEQ ID NO: 2819934 - protein, 18 aa, Entamoeba invadens
KCMEMLSKCKYQQSFKQS

SEQ ID NO: 2819935 - protein, 20 aa, Entamoeba invadens
KCNDAFWFDFTTQKCEECSS

SEQ ID NO: 2819936 - protein, 31 aa, Entamoeba invadens
KCPEQSFQWFYKLWRVQGYFNLVITKLYPII

SEQ ID NO: 2819937 - protein, 22 aa, Entamoeba invadens
KCPQASISELWGIKCINGRYNT

SEQ ID NO: 2819938 - protein, 20 aa, Entamoeba invadens
KCQQGYYYKNGICNQCNGCF

SEQ ID NO: 2819939 - protein, 17 aa, Entamoeba invadens
KCQSCISGTYLYNGKCV

SEQ ID NO: 2819940 - protein, 17 aa, Entamoeba invadens
KCRCVVGYVYNETLDAC

SEQ ID NO: 2819941 - protein, 23 aa, Entamoeba invadens
KCREEIFLLHKILNNSLESQEMK

SEQ ID NO: 2819942 - protein, 33 aa, Entamoeba invadens
KCRENSGFYLLNGICIPCDSTCKPNTCDSTSGF

SEQ ID NO: 2819943 - protein, 18 aa, Entamoeba invadens
KCSFTRLRKRIPTIINEL

SEQ ID NO: 2819944 - protein, 18 aa, Entamoeba invadens
KCSFWHTPSANGTFCKIK

SEQ ID NO: 2819945 - protein, 59 aa, Entamoeba invadens
KCSKCLFWYSPNKDGTMCRSQTVWWVILIVVMFVLIVLFVLIVTIVIVTKIILNKAHTH

SEQ ID NO: 2819946 - protein, 35 aa, Entamoeba invadens
KCSLKTNLPRLGKIYIFNLHVCFWPQVMKSNAEVW

SEQ ID NO: 2819947 - protein, 17 aa, Entamoeba invadens
KCSNWPEKAPYYGKNQN

SEQ ID NO: 2819948 - protein, 20 aa, Entamoeba invadens
KCSSPLQVMLPYTAVHTFDL

SEQ ID NO: 2819949 - protein, 28 aa, Entamoeba invadens
KCSYNNSYWLGWEYLSFQSNTDIFQIQN

SEQ ID NO: 2819950 - protein, 23 aa, Entamoeba invadens
KCTACLSGYYLDDNNNKCTKCTI

SEQ ID NO: 2819951 - protein, 17 aa, Entamoeba invadens
KCTACVLEYGLNNNKCE

SEQ ID NO: 2819952 - protein, 20 aa, Entamoeba invadens
KCTEGFYIDNQYCSSCSSQT

SEQ ID NO: 2819953 - protein, 17 aa, Entamoeba invadens
KCTFTLEEPTLIMICDY

SEQ ID NO: 2819954 - protein, 17 aa, Entamoeba invadens
KCTFWHVPSESGTFCNT

SEQ ID NO: 2819955 - protein, 22 aa, Entamoeba invadens
KCTKCKTDFNLVSDNLKCVEKC

SEQ ID NO: 2819956 - protein, 22 aa, Entamoeba invadens
KCTLCFSPYFIENGKCVLSYSN

SEQ ID NO: 2819957 - protein, 25 aa, Entamoeba invadens
KCTSCGILFVLLTNGSCVNYSKIMK

SEQ ID NO: 2819958 - protein, 21 aa, Entamoeba invadens
KCVDKCELGFFKKNDTNCDKC

SEQ ID NO: 2819959 - protein, 24 aa, Entamoeba invadens
KCVHYTHFMFCIAAFNGECLKCSQ

SEQ ID NO: 2819960 - protein, 17 aa, Entamoeba invadens
KCVLCENGYIYDNTNET

SEQ ID NO: 2819961 - protein, 20 aa, Entamoeba invadens
KCVLCEYNHFFNKTTFSCET

SEQ ID NO: 2819962 - protein, 18 aa, Entamoeba invadens
KCVLCTLYGECRECISGH

SEQ ID NO: 2819963 - protein, 21 aa, Entamoeba invadens
KCVPNFVGYISKGVCTPCFSD

SEQ ID NO: 2819964 - protein, 35 aa, Entamoeba invadens
KCWDLTLVILAVAPLMFITIVILAVSITKATSKGQ

SEQ ID NO: 2819965 - protein, 18 aa, Entamoeba invadens
KCYAKHFSLVLDNITLLK

SEQ ID NO: 2819966 - protein, 19 aa, Entamoeba invadens
KCYEGTLLMVKSVLYVIKN

SEQ ID NO: 2819967 - protein, 24 aa, Entamoeba invadens
KCYKCVIPIFPCALVFGSFAIMMV

SEQ ID NO: 2819968 - protein, 23 aa, Entamoeba invadens
KCYSCMNGYYLFNESCLKCPFPC

SEQ ID NO: 2819969 - protein, 21 aa, Entamoeba invadens
KCYTSFYLHQYTCTRCSSPCN

SEQ ID NO: 2819970 - protein, 17 aa, Entamoeba invadens
KDAFYVNNKMCSPCNSN

SEQ ID NO: 2819971 - protein, 30 aa, Entamoeba invadens
KDAKMNGMFQYFLTLIPKKNNFINGTKFVY

SEQ ID NO: 2819972 - protein, 18 aa, Entamoeba invadens
KDATLLFERTALSHATII

SEQ ID NO: 2819973 - protein, 26 aa, Entamoeba invadens
KDAYDKIEFKYPWKIADFVTGGNRLN

SEQ ID NO: 2819974 - protein, 24 aa, Entamoeba invadens
KDCAKLENLNLYAPLTTLSDTLTG

SEQ ID NO: 2819975 - protein, 32 aa, Entamoeba invadens
KDCAQLENLNLYAPLTTLLDTLPNVKNLFFHG

SEQ ID NO: 2819976 - protein, 31 aa, Entamoeba invadens
KDCAQLENLNLYAPLTTLSDTLSNVINLFFH

SEQ ID NO: 2819977 - protein, 24 aa, Entamoeba invadens
KDCNKLENLNLYAPLTSLSDTLTS

SEQ ID NO: 2819978 - protein, 17 aa, Entamoeba invadens
KDCVCKEGYYTTSWEAC

SEQ ID NO: 2819979 - protein, 24 aa, Entamoeba invadens
KDDERFLHVWNIADFITSGKKLER

SEQ ID NO: 2819980 - protein, 24 aa, Entamoeba invadens
KDDGKRWWCGFKNENYLDDSKNCY

SEQ ID NO: 2819981 - protein, 22 aa, Entamoeba invadens
KDDLILLQGVCNPLYTVQNCAH

SEQ ID NO: 2819982 - protein, 22 aa, Entamoeba invadens
KDDLKKAPNFVFFPFASNCAKK

SEQ ID NO: 2819983 - protein, 30 aa, Entamoeba invadens
KDEQLIKTAHRKVLRKFRTAGTKTLKQIQN

SEQ ID NO: 2819984 - protein, 24 aa, Entamoeba invadens
KDETVFMILLVMVTVYFSGVMTRL

SEQ ID NO: 2819985 - protein, 19 aa, Entamoeba invadens
KDFGENVFKNCLNLVSIDF

SEQ ID NO: 2819986 - protein, 21 aa, Entamoeba invadens
KDFLSCDNLMLFTKKSTNCEM

SEQ ID NO: 2819987 - protein, 28 aa, Entamoeba invadens
KDFPSNMVFVFLFNDLLIETKVVKYNKV

SEQ ID NO: 2819988 - protein, 25 aa, Entamoeba invadens
KDFVIILFLVILSSTSYFWGVHYEK

SEQ ID NO: 2819989 - protein, 21 aa, Entamoeba invadens
KDFWKLVLSCVLIITNVVPPE

SEQ ID NO: 2819990 - protein, 19 aa, Entamoeba invadens
KDGICLYYTEIEFCTSAHN

SEQ ID NO: 2819991 - protein, 28 aa, Entamoeba invadens
KDGLKGVYYTFKANYSLILLVSTDDLTS

SEQ ID NO: 2819992 - protein, 43 aa, Entamoeba invadens
KDGTLCELQIVWWVIFVVVMCVLIVFIVLIVSIVIITKTTINK

SEQ ID NO: 2819993 - protein, 19 aa, Entamoeba invadens
KDGVEFTLKCNYDTFIEAS

SEQ ID NO: 2819994 - protein, 17 aa, Entamoeba invadens
KDGYYRVGLNCFECLLN

SEQ ID NO: 2819995 - protein, 23 aa, Entamoeba invadens
KDHRILHFSLPENQIKNFKELVC

SEQ ID NO: 2819996 - protein, 30 aa, Entamoeba invadens
KDIFSYIYLGFTIYLIFKGGYTKQWRAWRI

SEQ ID NO: 2819997 - protein, 21 aa, Entamoeba invadens
KDIRSFLVWTSRGTAIGILVS

SEQ ID NO: 2819998 - protein, 26 aa, Entamoeba invadens
KDIVDFYNIIIIQNIILYSSNNEIVW

SEQ ID NO: 2819999 - protein, 24 aa, Entamoeba invadens
KDKDGYYCVKGEEHKYLWCTDTYK

SEQ ID NO: 2820000 - protein, 22 aa, Entamoeba invadens
KDKFKFCWNVVDFVTKGSRLEQ

SEQ ID NO: 2820001 - protein, 23 aa, Entamoeba invadens
KDKLRIKFMYDAAKGILYLHNNG

SEQ ID NO: 2820002 - protein, 27 aa, Entamoeba invadens
KDKNNIMRLKIQSGIYSKGAVFWNSLE

SEQ ID NO: 2820003 - protein, 51 aa, Entamoeba invadens
KDKPNLALYIALPVVLFVVLLIVIAISIILLFFLYLHLKEKKKMINVCVFQ

SEQ ID NO: 2820004 - protein, 25 aa, Entamoeba invadens
KDKRGGAILLRFLKYYATEFDSRKF

SEQ ID NO: 2820005 - protein, 17 aa, Entamoeba invadens
KDKSLFEFLSPDESFEF

SEQ ID NO: 2820006 - protein, 23 aa, Entamoeba invadens
KDLATRIMLIYHICNPSLQRPSE

SEQ ID NO: 2820007 - protein, 36 aa, Entamoeba invadens
KDLMKRYPTKILSYSMTLKFLLDGAKGILYLHENGI

SEQ ID NO: 2820008 - protein, 18 aa, Entamoeba invadens
KDLTIQSGIPLYSAMAFD

SEQ ID NO: 2820009 - protein, 25 aa, Entamoeba invadens
KDMGFKMGISYLPTLPLNESDLVPN

SEQ ID NO: 2820010 - protein, 19 aa, Entamoeba invadens
KDMKIPYSVWFSRSKKTLE

SEQ ID NO: 2820011 - protein, 28 aa, Entamoeba invadens
KDMNKTVFFMKRANMVFFDLNSVIKVNT

SEQ ID NO: 2820012 - protein, 32 aa, Entamoeba invadens
KDNIVFHSVIFPSTLLGSGMPWTMVRKLATTE

SEQ ID NO: 2820013 - protein, 28 aa, Entamoeba invadens
KDNKPSLHHLFTLYPPILDSANKKQRIL

SEQ ID NO: 2820014 - protein, 26 aa, Entamoeba invadens
KDNLVFGILSVLLECGYILDIQKPSK

SEQ ID NO: 2820015 - protein, 22 aa, Entamoeba invadens
KDNTLKHRAILLNAIKVNNDNV

SEQ ID NO: 2820016 - protein, 25 aa, Entamoeba invadens
KDPHHLIGQLFLRVNSHFNPLCSKK

SEQ ID NO: 2820017 - protein, 24 aa, Entamoeba invadens
KDPVYRYFLRELKPASRKPSGRYF

SEQ ID NO: 2820018 - protein, 22 aa, Entamoeba invadens
KDQLIIFAIFMTIIASFEKALN

SEQ ID NO: 2820019 - protein, 25 aa, Entamoeba invadens
KDRDLDIPFYLFHGSGDTLIDVKGA

SEQ ID NO: 2820020 - protein, 26 aa, Entamoeba invadens
KDRNLQIFTMSLYLGRKILRICPKEY

SEQ ID NO: 2820021 - protein, 21 aa, Entamoeba invadens
KDRQPIPMKLRIKMVTDAARG

SEQ ID NO: 2820022 - protein, 24 aa, Entamoeba invadens
KDSCQNNIYYFKTELSKCKCILKQ

SEQ ID NO: 2820023 - protein, 28 aa, Entamoeba invadens
KDSCQTSVYYFKTSLSNCFCILTGNTLD

SEQ ID NO: 2820024 - protein, 23 aa, Entamoeba invadens
KDSSNVLPIFYASVANTISNTTP

SEQ ID NO: 2820025 - protein, 17 aa, Entamoeba invadens
KDTFKGCIFLNEVDGFE

SEQ ID NO: 2820026 - protein, 17 aa, Entamoeba invadens
KDTFVYGTLYESSISTL

SEQ ID NO: 2820027 - protein, 35 aa, Entamoeba invadens
KDTGTLICFQVVLGLQLLLIFSKLGVHRALLTQDM

SEQ ID NO: 2820028 - protein, 23 aa, Entamoeba invadens
KDTLIYHVLLIQCLIKYKEIIAF

SEQ ID NO: 2820029 - protein, 25 aa, Entamoeba invadens
KDTRLPLPVFTFQVSSLKLTTNKEI

SEQ ID NO: 2820030 - protein, 21 aa, Entamoeba invadens
KDTSIFFRLPVEIITLEVNSP

SEQ ID NO: 2820031 - protein, 20 aa, Entamoeba invadens
KDVCIPFTVWFSKQRKTLTA

SEQ ID NO: 2820032 - protein, 20 aa, Entamoeba invadens
KDVGLPLRIKMMSDAANGLL

SEQ ID NO: 2820033 - protein, 23 aa, Entamoeba invadens
KDVKLRYHHYLTLTTDAASSTYL

SEQ ID NO: 2820034 - protein, 27 aa, Entamoeba invadens
KDWILLHQKIEILLLGKEAPYLLVYQL

SEQ ID NO: 2820035 - protein, 19 aa, Entamoeba invadens
KDYVLFNSKCLYFKEIDYC

SEQ ID NO: 2820036 - protein, 18 aa, Entamoeba invadens
KEAAPSLLVALVALLIAL

SEQ ID NO: 2820037 - protein, 24 aa, Entamoeba invadens
KEAYDHIIVFDPIKIFGVIEKEAD

SEQ ID NO: 2820038 - protein, 24 aa, Entamoeba invadens
KEAYKGLKFKFAWNIADFIIKGKR

SEQ ID NO: 2820039 - protein, 27 aa, Entamoeba invadens
KECAKNTFIYFFFPSSGFKPTCASDGK

SEQ ID NO: 2820040 - protein, 17 aa, Entamoeba invadens
KECDKEHFTIGNGLTQC

SEQ ID NO: 2820041 - protein, 27 aa, Entamoeba invadens
KECEEGYFLNFPIPLCVKCLNNCTSCE

SEQ ID NO: 2820042 - protein, 19 aa, Entamoeba invadens
KECLRCKDPYYLSSPLECN

SEQ ID NO: 2820043 - protein, 17 aa, Entamoeba invadens
KECLTCQDPYYLSSQKC

SEQ ID NO: 2820044 - protein, 24 aa, Entamoeba invadens
KECNKLENLNLYAPLTSLSDTLTS

SEQ ID NO: 2820045 - protein, 49 aa, Entamoeba invadens
KECTKINLALIIPLSVVGLVVIIAIIIAIIVLIWLRLRSGEKEEKKTIR

SEQ ID NO: 2820046 - protein, 20 aa, Entamoeba invadens
KECYLCESGYILNDNNECKK

SEQ ID NO: 2820047 - protein, 22 aa, Entamoeba invadens
KEDAMFMMPIANILIKTFYEMW

SEQ ID NO: 2820048 - protein, 23 aa, Entamoeba invadens
KEDPIPHSLLFPQPKEPVSTDKI

SEQ ID NO: 2820049 - protein, 26 aa, Entamoeba invadens
KEDSAMMLQILFKKSINEQKYVHLYV

SEQ ID NO: 2820050 - protein, 25 aa, Entamoeba invadens
KEEHWKMMIDIFLDFSMQDISKAVS

SEQ ID NO: 2820051 - protein, 21 aa, Entamoeba invadens
KEEKIITFVFEPKLRKRVIVV

SEQ ID NO: 2820052 - protein, 37 aa, Entamoeba invadens
KEEMVILFDFLVATRPSYFIYIICAELLLSREELLRS

SEQ ID NO: 2820053 - protein, 18 aa, Entamoeba invadens
KEFAYYKSRIWKCSKHYS

SEQ ID NO: 2820054 - protein, 25 aa, Entamoeba invadens
KEFPTLLQFFGYFYFFPACFSGPCL

SEQ ID NO: 2820055 - protein, 22 aa, Entamoeba invadens
KEGEWIIIFIGIAILVFCELVT

SEQ ID NO: 2820056 - protein, 24 aa, Entamoeba invadens
KEGFCKKLIPAALIQYVEQNPFDS

SEQ ID NO: 2820057 - protein, 18 aa, Entamoeba invadens
KEGFYMNNNICNECPIGC

SEQ ID NO: 2820058 - protein, 26 aa, Entamoeba invadens
KEGKSFFPSFLGWELYQIVTWYIIFS

SEQ ID NO: 2820059 - protein, 24 aa, Entamoeba invadens
KEGNYHFCLPLSLAQIEDCKYSII

SEQ ID NO: 2820060 - protein, 22 aa, Entamoeba invadens
KEGSSFVFWKRFSVSQRSTFVI

SEQ ID NO: 2820061 - protein, 31 aa, Entamoeba invadens
KEGYKDIYILFVRLFILHIKVLIMSGTFNVD

SEQ ID NO: 2820062 - protein, 18 aa, Entamoeba invadens
KEHMSLGYGLTQCSQCVD

SEQ ID NO: 2820063 - protein, 24 aa, Entamoeba invadens
KEHTSFETIFWERAKKYPQDSEIY

SEQ ID NO: 2820064 - protein, 24 aa, Entamoeba invadens
KEHWIYIIVGYFIMPVFSLLGVFT

SEQ ID NO: 2820065 - protein, 20 aa, Entamoeba invadens
KEIAVFMYEPMDLEAPILTG

SEQ ID NO: 2820066 - protein, 27 aa, Entamoeba invadens
KEIIAFILTALLFPISLGHPILMFVVV

SEQ ID NO: 2820067 - protein, 24 aa, Entamoeba invadens
KEIRRKWHRLSSDKKFYINTKMIE

SEQ ID NO: 2820068 - protein, 26 aa, Entamoeba invadens
KEKEEYLEQIKQLTGMKEAMEKQNTE

SEQ ID NO: 2820069 - protein, 22 aa, Entamoeba invadens
KEKLMWTGVTLLIFLVCSQIPL

SEQ ID NO: 2820070 - protein, 28 aa, Entamoeba invadens
KEKPNYVEFLFKYLDIYGQQYSQLRFLF

SEQ ID NO: 2820071 - protein, 22 aa, Entamoeba invadens
KELFLPSTLEKADKYLFCNNKN

SEQ ID NO: 2820072 - protein, 25 aa, Entamoeba invadens
KELIETQFFMLFYNANANLNQTLDK

SEQ ID NO: 2820073 - protein, 17 aa, Entamoeba invadens
KELKQLLYPLEDDFLIV

SEQ ID NO: 2820074 - protein, 24 aa, Entamoeba invadens
KELTLKMKMKVVLDATRGILYLHE

SEQ ID NO: 2820075 - protein, 20 aa, Entamoeba invadens
KEMRYIHRWLETKYINKTVF

SEQ ID NO: 2820076 - protein, 21 aa, Entamoeba invadens
KENICFTCNDPYYLSNQTCLS

SEQ ID NO: 2820077 - protein, 20 aa, Entamoeba invadens
KENLGFLMPVKYNDSIGGRD

SEQ ID NO: 2820078 - protein, 32 aa, Entamoeba invadens
KENTLNVSKLFKLFILPMSQNIIISATKSLNI

SEQ ID NO: 2820079 - protein, 19 aa, Entamoeba invadens
KEPYPKNEFKFAWSIANFV

SEQ ID NO: 2820080 - protein, 27 aa, Entamoeba invadens
KEPYSKDQFKFPWKIAEFVMGGNRLKK

SEQ ID NO: 2820081 - protein, 27 aa, Entamoeba invadens
KEPYSKDQFKYPWKIADFVMAGNRLKK

SEQ ID NO: 2820082 - protein, 49 aa, Entamoeba invadens
KESCETKAVWWVIVIIVILSIVVLIVVFVVIGWLIWAVSKKISEVKRDK

SEQ ID NO: 2820083 - protein, 22 aa, Entamoeba invadens
KESDQYWYGIQFQNTDPSEVTY

SEQ ID NO: 2820084 - protein, 17 aa, Entamoeba invadens
KESLRNKVLFSVDGKLV

SEQ ID NO: 2820085 - protein, 31 aa, Entamoeba invadens
KESNFVIQALKWYELFLPRYFDYHFTVTEAM

SEQ ID NO: 2820086 - protein, 26 aa, Entamoeba invadens
KESRIFTIRHFLFNTLIQPTVSTDVV

SEQ ID NO: 2820087 - protein, 23 aa, Entamoeba invadens
KETGYVQWLKLLEADFNVIQPVI

SEQ ID NO: 2820088 - protein, 20 aa, Entamoeba invadens
KETMLTPLYDFLVNLQVVSQ

SEQ ID NO: 2820089 - protein, 49 aa, Entamoeba invadens
KETNLGLAIGLPIALVFVVIVVVLLGSFALFLAIRKWRQKKIRDATVCE

SEQ ID NO: 2820090 - protein, 23 aa, Entamoeba invadens
KETPSIIKAITGGLDPIFIGNAD

SEQ ID NO: 2820091 - protein, 32 aa, Entamoeba invadens
KETYNCEIIFLNKCIKCLLMYIRVEKNTDDSQ

SEQ ID NO: 2820092 - protein, 36 aa, Entamoeba invadens
KEVAMLAKFVSPYVIRFYGASFIPNRICMVTELAKY

SEQ ID NO: 2820093 - protein, 35 aa, Entamoeba invadens
KEVAMLEKFRCGYIVHFYGAVFIPSKICLVTEFAN

SEQ ID NO: 2820094 - protein, 17 aa, Entamoeba invadens
KEVFLHERFSEIVPGIL

SEQ ID NO: 2820095 - protein, 20 aa, Entamoeba invadens
KEVSLLDKLRGPYIVSFVGA

SEQ ID NO: 2820096 - protein, 26 aa, Entamoeba invadens
KEVVEVKLIIRKSPIKRISLLKNVLT

SEQ ID NO: 2820097 - protein, 39 aa, Entamoeba invadens
KEWKSMLFGYFTIAVYELFSLAFPLLTQFIIKWLNNKEA

SEQ ID NO: 2820098 - protein, 20 aa, Entamoeba invadens
KEWMRICHELLDTFKAHKKS

SEQ ID NO: 2820099 - protein, 19 aa, Entamoeba invadens
KEYAVTLQYLFTATETFIT

SEQ ID NO: 2820100 - protein, 25 aa, Entamoeba invadens
KEYCGYYFFPYDIVEQQISYYGGFN

SEQ ID NO: 2820101 - protein, 17 aa, Entamoeba invadens
KEYGYPIQKFEIDWMAN

SEQ ID NO: 2820102 - protein, 21 aa, Entamoeba invadens
KEYILINLQCLHFTKVEHCVS

SEQ ID NO: 2820103 - protein, 23 aa, Entamoeba invadens
KEYTLSMTFYNKYYYQFNADTTY

SEQ ID NO: 2820104 - protein, 28 aa, Entamoeba invadens
KEYYIQLIKMLIMSMALIRAFVDKKQTE

SEQ ID NO: 2820105 - protein, 21 aa, Entamoeba invadens
KFADVMYGWMKDSIVDLDIDN

SEQ ID NO: 2820106 - protein, 18 aa, Entamoeba invadens
KFAWSIADFVTSGKRLEC

SEQ ID NO: 2820107 - protein, 18 aa, Entamoeba invadens
KFCLDAAKGILYLHENDI

SEQ ID NO: 2820108 - protein, 20 aa, Entamoeba invadens
KFDTLVVDSPIYFGTQIALN

SEQ ID NO: 2820109 - protein, 19 aa, Entamoeba invadens
KFEWTMWLLMTSTTVFMIL

SEQ ID NO: 2820110 - protein, 24 aa, Entamoeba invadens
KFEYPWLIADFVTSGKRIGKPDNM

SEQ ID NO: 2820111 - protein, 21 aa, Entamoeba invadens
KFFGIINMKHFFLMTRPEKEK

SEQ ID NO: 2820112 - protein, 18 aa, Entamoeba invadens
KFFIFTEQPIGLSVDEYY

SEQ ID NO: 2820113 - protein, 21 aa, Entamoeba invadens
KFGLAFVFFVAISCTTLIEGD

SEQ ID NO: 2820114 - protein, 20 aa, Entamoeba invadens
KFHFNPIPLDYKTIGYYSNI

SEQ ID NO: 2820115 - protein, 19 aa, Entamoeba invadens
KFHFNPIPLNYKTIKYFTN

SEQ ID NO: 2820116 - protein, 19 aa, Entamoeba invadens
KFHSIMYPDLIPPEKGDPI

SEQ ID NO: 2820117 - protein, 29 aa, Entamoeba invadens
KFIKSADIFQTFKFPWKIAEFVMSGKRLE

SEQ ID NO: 2820118 - protein, 17 aa, Entamoeba invadens
KFISECAKGILYLHSNG

SEQ ID NO: 2820119 - protein, 18 aa, Entamoeba invadens
KFKFPWEIVNFVVAEKRL

SEQ ID NO: 2820120 - protein, 34 aa, Entamoeba invadens
KFKLSHYVMWFFVFSYFFIAIILSTCFGIKVSLF

SEQ ID NO: 2820121 - protein, 17 aa, Entamoeba invadens
KFKNEYIVHFYGAVFIP

SEQ ID NO: 2820122 - protein, 26 aa, Entamoeba invadens
KFKPTILVGVPRLYEKLLFRINEALK

SEQ ID NO: 2820123 - protein, 26 aa, Entamoeba invadens
KFKPTLVVGVPRFYEKILMRLNEVLK

SEQ ID NO: 2820124 - protein, 20 aa, Entamoeba invadens
KFLELLKMKGVEEITIQYGR

SEQ ID NO: 2820125 - protein, 25 aa, Entamoeba invadens
KFLPVLFSIFWFICCGYWNSVFQVF

SEQ ID NO: 2820126 - protein, 43 aa, Entamoeba invadens
KFMSKVGYIWLLVCCLVLSDVLVFFFILGISYVSERKLNSIIS

SEQ ID NO: 2820127 - protein, 21 aa, Entamoeba invadens
KFNFFTLNKHISSNKKLITFA

SEQ ID NO: 2820128 - protein, 25 aa, Entamoeba invadens
KFNKTIIGVFMWDGMYSALNKVAMK

SEQ ID NO: 2820129 - protein, 20 aa, Entamoeba invadens
KFNLKIRPEVVCFKKGYACE

SEQ ID NO: 2820130 - protein, 26 aa, Entamoeba invadens
KFNLTFIYHEAAVIGLIYTETNELLF

SEQ ID NO: 2820131 - protein, 26 aa, Entamoeba invadens
KFRCDQIIHFFGSVRMARIVGLVVEY

SEQ ID NO: 2820132 - protein, 24 aa, Entamoeba invadens
KFRCDYIIHFYGAVFIPNKMCMVT

SEQ ID NO: 2820133 - protein, 24 aa, Entamoeba invadens
KFRCDYIIHFYGAVFIPNKVCMVT

SEQ ID NO: 2820134 - protein, 23 aa, Entamoeba invadens
KFRCDYIIHFYGSVRSKMNIGIV

SEQ ID NO: 2820135 - protein, 20 aa, Entamoeba invadens
KFRCDYIVHFYGAVFIINKM

SEQ ID NO: 2820136 - protein, 26 aa, Entamoeba invadens
KFRCDYIVHFYGAVFIPNKICMVTEF

SEQ ID NO: 2820137 - protein, 21 aa, Entamoeba invadens
KFRCDYIVHFYGAVFIPNKMC

SEQ ID NO: 2820138 - protein, 24 aa, Entamoeba invadens
KFRCDYIVHFYGAVFIPNKRCMVT

SEQ ID NO: 2820139 - protein, 20 aa, Entamoeba invadens
KFRCDYIVHFYGAVFIPNKV

SEQ ID NO: 2820140 - protein, 25 aa, Entamoeba invadens
KFRCDYIVHFYGAVFVPNKICMVTE

SEQ ID NO: 2820141 - protein, 26 aa, Entamoeba invadens
KFRCDYIVHFYGAVLIPNKLCLVTEF

SEQ ID NO: 2820142 - protein, 23 aa, Entamoeba invadens
KFRCEFIIHFYGAVFIKSQICIV

SEQ ID NO: 2820143 - protein, 20 aa, Entamoeba invadens
KFRCEYIIHFYGACFMPNKI

SEQ ID NO: 2820144 - protein, 23 aa, Entamoeba invadens
KFRCEYIIHFYGAVFIPNKMCMV

SEQ ID NO: 2820145 - protein, 24 aa, Entamoeba invadens
KFRCEYIIHFYGAVFIPNKMCMVT

SEQ ID NO: 2820146 - protein, 24 aa, Entamoeba invadens
KFRCEYIIHFYGAVFIPSKVCMVT

SEQ ID NO: 2820147 - protein, 18 aa, Entamoeba invadens
KFRCEYIVHFYGAVFIPS

SEQ ID NO: 2820148 - protein, 20 aa, Entamoeba invadens
KFRCEYIVHFYGAVFVPNKM

SEQ ID NO: 2820149 - protein, 25 aa, Entamoeba invadens
KFRCEYIVHFYGAVTIPNKVCMVTE

SEQ ID NO: 2820150 - protein, 17 aa, Entamoeba invadens
KFRDDYIVYFYGAVMNT

SEQ ID NO: 2820151 - protein, 24 aa, Entamoeba invadens
KFRENHIVHFYGAVLIPNKYCMVT

SEQ ID NO: 2820152 - protein, 17 aa, Entamoeba invadens
KFRIGKWFKINMDNLIT

SEQ ID NO: 2820153 - protein, 17 aa, Entamoeba invadens
KFRSDFIVHFYGAVMIP

SEQ ID NO: 2820154 - protein, 17 aa, Entamoeba invadens
KFRSDFVVHFYGAVFIP

SEQ ID NO: 2820155 - protein, 17 aa, Entamoeba invadens
KFRSDYITHFYGAVFIR

SEQ ID NO: 2820156 - protein, 24 aa, Entamoeba invadens
KFRSDYIVHFYGAVFIISKVCLVT

SEQ ID NO: 2820157 - protein, 25 aa, Entamoeba invadens
KFRSDYIVHFYGAVFIPNKICMVTE

SEQ ID NO: 2820158 - protein, 17 aa, Entamoeba invadens
KFRSDYIVHFYGAVFVP

SEQ ID NO: 2820159 - protein, 25 aa, Entamoeba invadens
KFRSDYIVHFYGAVFVPKKICMVTE

SEQ ID NO: 2820160 - protein, 24 aa, Entamoeba invadens
KFRSDYIVHFYGAVFVPNKVCMVT

SEQ ID NO: 2820161 - protein, 25 aa, Entamoeba invadens
KFRSDYIVHFYGAVFVPSKVCMVTE

SEQ ID NO: 2820162 - protein, 24 aa, Entamoeba invadens
KFRSEYIVHFYGAVFIPNHICMVT

SEQ ID NO: 2820163 - protein, 24 aa, Entamoeba invadens
KFRSEYIVHFYGAVFIPNKICMVT

SEQ ID NO: 2820164 - protein, 23 aa, Entamoeba invadens
KFRSEYIVHFYGAVFIPNKMCIV

SEQ ID NO: 2820165 - protein, 24 aa, Entamoeba invadens
KFRSEYIVHFYGAVFIPNKVCMVT

SEQ ID NO: 2820166 - protein, 23 aa, Entamoeba invadens
KFRSEYIVHFYGAVFIPSKFCEV

SEQ ID NO: 2820167 - protein, 25 aa, Entamoeba invadens
KFRSEYIVHFYGAVFIPSKICMVTE

SEQ ID NO: 2820168 - protein, 24 aa, Entamoeba invadens
KFRSEYIVHFYGAVFIPSKVCMVT

SEQ ID NO: 2820169 - protein, 26 aa, Entamoeba invadens
KFRSEYIVHFYGAVFIPSRICMVTEF

SEQ ID NO: 2820170 - protein, 24 aa, Entamoeba invadens
KFRSEYIVHFYGAVFVPNKICMVT

SEQ ID NO: 2820171 - protein, 26 aa, Entamoeba invadens
KFRSEYIVHFYGAVFVPNRICIVTEF

SEQ ID NO: 2820172 - protein, 25 aa, Entamoeba invadens
KFRSEYIVHFYGAVFVPSKICMVTE

SEQ ID NO: 2820173 - protein, 26 aa, Entamoeba invadens
KFRSEYIVHFYGAVFVPSKICMVTEF

SEQ ID NO: 2820174 - protein, 23 aa, Entamoeba invadens
KFRSEYIVYFYGAVLVRKRLAIV

SEQ ID NO: 2820175 - protein, 17 aa, Entamoeba invadens
KFRSEYVVHFYGAVFIP

SEQ ID NO: 2820176 - protein, 19 aa, Entamoeba invadens
KFRYRRGLPMVLKGINAKI

SEQ ID NO: 2820177 - protein, 19 aa, Entamoeba invadens
KFSDFFKADLLKNVIFFFV

SEQ ID NO: 2820178 - protein, 24 aa, Entamoeba invadens
KFSLLSLTFIFFTTLSLYPHFLNA

SEQ ID NO: 2820179 - protein, 25 aa, Entamoeba invadens
KFSLQVTPSLITLKKGRACEFEIFI

SEQ ID NO: 2820180 - protein, 18 aa, Entamoeba invadens
KFTTVAAALYLFEADKMN

SEQ ID NO: 2820181 - protein, 17 aa, Entamoeba invadens
KFVCVLGYSNTTHFNSE

SEQ ID NO: 2820182 - protein, 18 aa, Entamoeba invadens
KFVFDFVNSYVLCKVPES

SEQ ID NO: 2820183 - protein, 21 aa, Entamoeba invadens
KFVLIVLLIVSTFSRDIYVDN

SEQ ID NO: 2820184 - protein, 19 aa, Entamoeba invadens
KFVLRAFDYLLGKKSNLNI

SEQ ID NO: 2820185 - protein, 22 aa, Entamoeba invadens
KFVTIPFLWISKMYTDKVPLVV

SEQ ID NO: 2820186 - protein, 18 aa, Entamoeba invadens
KFYVIHRTSLRVSSQCPT

SEQ ID NO: 2820187 - protein, 17 aa, Entamoeba invadens
KGATKLSAFTAKAGIKT

SEQ ID NO: 2820188 - protein, 17 aa, Entamoeba invadens
KGAVIPAFSFQSAVSKP

SEQ ID NO: 2820189 - protein, 46 aa, Entamoeba invadens
KGCEYRYTVLFIYLAVFVFVYVLLYTILFIVIYSKTKVMRMLFKVN

SEQ ID NO: 2820190 - protein, 35 aa, Entamoeba invadens
KGCGFITVGGFLFLRFITPILVMPKRFLSNVTEPS

SEQ ID NO: 2820191 - protein, 19 aa, Entamoeba invadens
KGCIHCLNGFYYNHINTND

SEQ ID NO: 2820192 - protein, 19 aa, Entamoeba invadens
KGCLKCIDGYYLSVKNECV

SEQ ID NO: 2820193 - protein, 26 aa, Entamoeba invadens
KGCLKCSNRYFLQNMLLISTCEKCSS

SEQ ID NO: 2820194 - protein, 20 aa, Entamoeba invadens
KGCLKCVNGFYLDNSKNCVK

SEQ ID NO: 2820195 - protein, 20 aa, Entamoeba invadens
KGCLRCLDGFYLSNSICHPC

SEQ ID NO: 2820196 - protein, 24 aa, Entamoeba invadens
KGCLSCNDGYYLEDNKCVKCANNC

SEQ ID NO: 2820197 - protein, 18 aa, Entamoeba invadens
KGCLSCVSGYYLNTSLTC

SEQ ID NO: 2820198 - protein, 25 aa, Entamoeba invadens
KGCVSCLNGFYLNHETCVKCINDCL

SEQ ID NO: 2820199 - protein, 25 aa, Entamoeba invadens
KGDGDVMLSFIYGSAFFMSQEYTQL

SEQ ID NO: 2820200 - protein, 37 aa, Entamoeba invadens
KGDQNFKILRQMSLLLVLFLFFLKAQSDCWSSQEDNV

SEQ ID NO: 2820201 - protein, 23 aa, Entamoeba invadens
KGDQNLIYVFLKNNQPIEIDVEN

SEQ ID NO: 2820202 - protein, 24 aa, Entamoeba invadens
KGDSRAICYCTYNPEIKQDCSLAC

SEQ ID NO: 2820203 - protein, 24 aa, Entamoeba invadens
KGDWNMFNSTWLLPKNHTAKIAAS

SEQ ID NO: 2820204 - protein, 26 aa, Entamoeba invadens
KGEEHKYLWCTDTYKGYMNCPKGTHC

SEQ ID NO: 2820205 - protein, 26 aa, Entamoeba invadens
KGEEHKYLWCTDTYKGYMNCSKGTHC

SEQ ID NO: 2820206 - protein, 29 aa, Entamoeba invadens
KGEPWFAHQMCQFLMPYYSRTGNNKMLEE

SEQ ID NO: 2820207 - protein, 32 aa, Entamoeba invadens
KGEYWNPLFMPYVLFLCFFSRALNVFPISFLM

SEQ ID NO: 2820208 - protein, 29 aa, Entamoeba invadens
KGFACEFEVYITPYCCLNLNDKVAIISLN

SEQ ID NO: 2820209 - protein, 21 aa, Entamoeba invadens
KGFKFLPTPIAVESLELFCFL

SEQ ID NO: 2820210 - protein, 19 aa, Entamoeba invadens
KGFPVSKLIPLLILQICES

SEQ ID NO: 2820211 - protein, 23 aa, Entamoeba invadens
KGFSTIVFHYFLTAVIFSQTATS

SEQ ID NO: 2820212 - protein, 21 aa, Entamoeba invadens
KGFYRGNVVALKKLKQRIYCI

SEQ ID NO: 2820213 - protein, 25 aa, Entamoeba invadens
KGGESLGWFYGANYLAHRVFFTFYN

SEQ ID NO: 2820214 - protein, 18 aa, Entamoeba invadens
KGGRNLKVYFVCESYIAI

SEQ ID NO: 2820215 - protein, 20 aa, Entamoeba invadens
KGHCLSCRRGFAPNLSNPPV

SEQ ID NO: 2820216 - protein, 32 aa, Entamoeba invadens
KGHGRRKYILKLLYIYVLGYEVDFGIPIITEL

SEQ ID NO: 2820217 - protein, 17 aa, Entamoeba invadens
KGILYLHENGILHRDIK

SEQ ID NO: 2820218 - protein, 17 aa, Entamoeba invadens
KGILYLHSNGILHRDIK

SEQ ID NO: 2820219 - protein, 23 aa, Entamoeba invadens
KGIRLKICLNAAKGIFYLHENGI

SEQ ID NO: 2820220 - protein, 26 aa, Entamoeba invadens
KGIVFIFMLRISPIFPFPVLNYTLGP

SEQ ID NO: 2820221 - protein, 17 aa, Entamoeba invadens
KGIWTRVKRISLIPIYM

SEQ ID NO: 2820222 - protein, 25 aa, Entamoeba invadens
KGKAVEFEIFIKPLCTCTLDEQIAL

SEQ ID NO: 2820223 - protein, 37 aa, Entamoeba invadens
KGKEGFYCLEGNKYIHKYLWCTDTFKGIMDCPKGTKC

SEQ ID NO: 2820224 - protein, 24 aa, Entamoeba invadens
KGKNGYYCVKGEEHKYLWCTDTYK

SEQ ID NO: 2820225 - protein, 20 aa, Entamoeba invadens
KGKPWKFRPTSHGILSLVNY

SEQ ID NO: 2820226 - protein, 34 aa, Entamoeba invadens
KGKSVVSMRWGLLYLLPLIFTVFSAQVYTNSWCF

SEQ ID NO: 2820227 - protein, 21 aa, Entamoeba invadens
KGKVWLEPTGGTSLKILIPEI

SEQ ID NO: 2820228 - protein, 21 aa, Entamoeba invadens
KGMFRDNVVAIKKMKAGAATK

SEQ ID NO: 2820229 - protein, 23 aa, Entamoeba invadens
KGMKIPYTIFFSNTKSTLFKISE

SEQ ID NO: 2820230 - protein, 21 aa, Entamoeba invadens
KGNCPDMYFKDNAEKMCKRCT

SEQ ID NO: 2820231 - protein, 21 aa, Entamoeba invadens
KGNCPEMYFKDGAEKMCKRCT

SEQ ID NO: 2820232 - protein, 28 aa, Entamoeba invadens
KGNDSITRLYWLSKTLSLSFYAQVKYPN

SEQ ID NO: 2820233 - protein, 24 aa, Entamoeba invadens
KGNYRGNIVAIKKMKQIASPNTVT

SEQ ID NO: 2820234 - protein, 24 aa, Entamoeba invadens
KGPLKWISLGIFIIGIIMGGIGLG

SEQ ID NO: 2820235 - protein, 40 aa, Entamoeba invadens
KGQIKVFGILFTAVGLLYGLVLMFFFLQAVVEFRKIYTQV

SEQ ID NO: 2820236 - protein, 27 aa, Entamoeba invadens
KGRACEFQIFITPYCTCDLHEKIMLIA

SEQ ID NO: 2820237 - protein, 22 aa, Entamoeba invadens
KGRILIIFPLVIITLLCVFSPF

SEQ ID NO: 2820238 - protein, 25 aa, Entamoeba invadens
KGSNTLFWMSIVAIVVCLIMTTIAV

SEQ ID NO: 2820239 - protein, 22 aa, Entamoeba invadens
KGSPITFDLFPFCEEYLAMIKK

SEQ ID NO: 2820240 - protein, 25 aa, Entamoeba invadens
KGSPYSLLMNGKLLRFGESKDVFCN

SEQ ID NO: 2820241 - protein, 20 aa, Entamoeba invadens
KGSVPIKYPMTLNGITRELN

SEQ ID NO: 2820242 - protein, 47 aa, Entamoeba invadens
KGTFCQKEVVWWVVLLLVLFVFFCISILSVLVFFATKFVFAQVHKNA

SEQ ID NO: 2820243 - protein, 17 aa, Entamoeba invadens
KGTFGVYDFLRSKLVMS

SEQ ID NO: 2820244 - protein, 24 aa, Entamoeba invadens
KGTFRGNFVAIKKMKLTILDDQNK

SEQ ID NO: 2820245 - protein, 24 aa, Entamoeba invadens
KGTFRRNFVAIKKMKLTILDDQNK

SEQ ID NO: 2820246 - protein, 25 aa, Entamoeba invadens
KGTTLFLTSQFYLFDDKSTFFDTEI

SEQ ID NO: 2820247 - protein, 29 aa, Entamoeba invadens
KGTVCFLCHILYIWTLVAPIIFPKRNFSN

SEQ ID NO: 2820248 - protein, 29 aa, Entamoeba invadens
KGVEGWLRPLLEIPAFQTKLKMWVESMLL

SEQ ID NO: 2820249 - protein, 21 aa, Entamoeba invadens
KGVFYYSYFDFVYMDDKGDPF

SEQ ID NO: 2820250 - protein, 24 aa, Entamoeba invadens
KGVFYYSYFDLIRMNSTDPFEERW

SEQ ID NO: 2820251 - protein, 22 aa, Entamoeba invadens
KGVYLSLFTTIGMVLYSSKPRD

SEQ ID NO: 2820252 - protein, 27 aa, Entamoeba invadens
KGYLISNKKLIRFCPNGIQLDTNVICT

SEQ ID NO: 2820253 - protein, 17 aa, Entamoeba invadens
KGYVIATFISSQIVVFN

SEQ ID NO: 2820254 - protein, 24 aa, Entamoeba invadens
KHANTIRPYVLLVSQIQGICGTMS

SEQ ID NO: 2820255 - protein, 22 aa, Entamoeba invadens
KHIECINLLIEKTLLNVPDNYG

SEQ ID NO: 2820256 - protein, 25 aa, Entamoeba invadens
KHIHEFLVCTKDYKGYMECPKNTQC

SEQ ID NO: 2820257 - protein, 20 aa, Entamoeba invadens
KHIIPFVFSWPSCSNPFLYC

SEQ ID NO: 2820258 - protein, 38 aa, Entamoeba invadens
KHKEKILTHKMTVKFLLDGARGILYLHENGILHRDIKP

SEQ ID NO: 2820259 - protein, 32 aa, Entamoeba invadens
KHKKADEVILKMRIKLILDTAKGIQYLHANNT

SEQ ID NO: 2820260 - protein, 33 aa, Entamoeba invadens
KHKKSAEIDTKLRLKFLLDGAKGIQYLHENGIL

SEQ ID NO: 2820261 - protein, 32 aa, Entamoeba invadens
KHKPVEQKWLWTLYTVLTVMSIITLILTVTTL

SEQ ID NO: 2820262 - protein, 17 aa, Entamoeba invadens
KHLIGTYALFQHLEHRT

SEQ ID NO: 2820263 - protein, 17 aa, Entamoeba invadens
KHMLVIFHTPNNPKFVF

SEQ ID NO: 2820264 - protein, 22 aa, Entamoeba invadens
KHNDILILVGAIAELRQMFEDL

SEQ ID NO: 2820265 - protein, 40 aa, Entamoeba invadens
KHNTKEMFWTLWMIFGMLNFLLFLLVVTCCIFLSTRLDGF

SEQ ID NO: 2820266 - protein, 24 aa, Entamoeba invadens
KHPKHRFIILLDNIFRQTLLLSAY

SEQ ID NO: 2820267 - protein, 27 aa, Entamoeba invadens
KHPLILSFFIIFVLYGIYITGIAIIPS

SEQ ID NO: 2820268 - protein, 19 aa, Entamoeba invadens
KHTHTDHCNMFGLVLICCL

SEQ ID NO: 2820269 - protein, 20 aa, Entamoeba invadens
KHTHTDHCNMFGLVLICCLT

SEQ ID NO: 2820270 - protein, 23 aa, Entamoeba invadens
KHVCSYASERLYWSDMSKGVSID

SEQ ID NO: 2820271 - protein, 20 aa, Entamoeba invadens
KHVFKTRLCIFKDAVRSFNL

SEQ ID NO: 2820272 - protein, 17 aa, Entamoeba invadens
KHWMELVTMLSWVFIIV

SEQ ID NO: 2820273 - protein, 18 aa, Entamoeba invadens
KHYKKPSDIYSFAITMYE

SEQ ID NO: 2820274 - protein, 18 aa, Entamoeba invadens
KIAEFVISGKRLLKREFI

SEQ ID NO: 2820275 - protein, 32 aa, Entamoeba invadens
KIATTIVLVFILFVFVLNVCSVLVFVMYTKPE

SEQ ID NO: 2820276 - protein, 24 aa, Entamoeba invadens
KICESCPLGYWSNTSSASCYICPA

SEQ ID NO: 2820277 - protein, 20 aa, Entamoeba invadens
KICLLAEKYAKNLQWYVDIM

SEQ ID NO: 2820278 - protein, 17 aa, Entamoeba invadens
KICVFKMNRSNIAMSVL

SEQ ID NO: 2820279 - protein, 29 aa, Entamoeba invadens
KICVTIFVGFAVWAMITLAILIGMESLSA

SEQ ID NO: 2820280 - protein, 26 aa, Entamoeba invadens
KIDDKRFVLLSDKKLLRFGSNQNVEC

SEQ ID NO: 2820281 - protein, 25 aa, Entamoeba invadens
KIDERFRIVYTRNVFTTVPLVYIDG

SEQ ID NO: 2820282 - protein, 26 aa, Entamoeba invadens
KIDFYQINIWYEMTYSRTCRVTHSNC

SEQ ID NO: 2820283 - protein, 18 aa, Entamoeba invadens
KIECFINTNYGIVVGLPI

SEQ ID NO: 2820284 - protein, 38 aa, Entamoeba invadens
KIEFLIEMFVWCCLDFEWIYSFVLLDLERVLLCVIPKL

SEQ ID NO: 2820285 - protein, 23 aa, Entamoeba invadens
KIEIFETFPSYYYRAVHYGKNDC

SEQ ID NO: 2820286 - protein, 26 aa, Entamoeba invadens
KIEIIRSFILWLRKSYITGVVIVVDI

SEQ ID NO: 2820287 - protein, 25 aa, Entamoeba invadens
KIEILETFPAYYYRAVYYGKNDCNM

SEQ ID NO: 2820288 - protein, 19 aa, Entamoeba invadens
KIEIRQKGQNADKFEKLKK

SEQ ID NO: 2820289 - protein, 26 aa, Entamoeba invadens
KIEMKLRIKLMLDTLNGIIYLHTNGI

SEQ ID NO: 2820290 - protein, 21 aa, Entamoeba invadens
KIENILSGFILHEKPHMMIIT

SEQ ID NO: 2820291 - protein, 29 aa, Entamoeba invadens
KIENSTAIRWFLPLLSLSMKMSSIYQLWD

SEQ ID NO: 2820292 - protein, 17 aa, Entamoeba invadens
KIFITTLSATKSHLQRA

SEQ ID NO: 2820293 - protein, 26 aa, Entamoeba invadens
KIFLCLVLMWNDPLPIYFFSVGMSNL

SEQ ID NO: 2820294 - protein, 20 aa, Entamoeba invadens
KIFLSNSIEGPFRPFQNRTI

SEQ ID NO: 2820295 - protein, 19 aa, Entamoeba invadens
KIFRPFLTIDQKYADDLFA

SEQ ID NO: 2820296 - protein, 17 aa, Entamoeba invadens
KIFSFDKEKFNFFTLNK

SEQ ID NO: 2820297 - protein, 25 aa, Entamoeba invadens
KIFTDPEFKFPWKIAKFISSGKRPE

SEQ ID NO: 2820298 - protein, 19 aa, Entamoeba invadens
KIFTLCELFWRTSFIVIGS

SEQ ID NO: 2820299 - protein, 21 aa, Entamoeba invadens
KIFTMATVVMLIFSTAIVTFI

SEQ ID NO: 2820300 - protein, 19 aa, Entamoeba invadens
KIFTVLRVLSPINTANFEF

SEQ ID NO: 2820301 - protein, 17 aa, Entamoeba invadens
KIFYSLLIQFDPNIPGT

SEQ ID NO: 2820302 - protein, 21 aa, Entamoeba invadens
KIFYYTSLIVHLFNYGIIAIV

SEQ ID NO: 2820303 - protein, 26 aa, Entamoeba invadens
KIGFVKAVLLCVFVFGGISVMMAFSV

SEQ ID NO: 2820304 - protein, 26 aa, Entamoeba invadens
KIGKLRLPLDFIQRILLHISRNVSQI

SEQ ID NO: 2820305 - protein, 20 aa, Entamoeba invadens
KIHHFLFCGISNFCSSYKNI

SEQ ID NO: 2820306 - protein, 28 aa, Entamoeba invadens
KIHTNPYNMFFGKTFTRFVRQEKYTSIF

SEQ ID NO: 2820307 - protein, 20 aa, Entamoeba invadens
KIIETFFGFMVKTIGEVNAE

SEQ ID NO: 2820308 - protein, 18 aa, Entamoeba invadens
KIIIDASKGILYLHENGI

SEQ ID NO: 2820309 - protein, 20 aa, Entamoeba invadens
KIIIWGRAQITCSKTIFLNQ

SEQ ID NO: 2820310 - protein, 18 aa, Entamoeba invadens
KIIMLNRGKMIYFGSPKQ

SEQ ID NO: 2820311 - protein, 22 aa, Entamoeba invadens
KIITCLSGFYLTISGCSKCNEL

SEQ ID NO: 2820312 - protein, 17 aa, Entamoeba invadens
KIKIKIIIDASKGILYL

SEQ ID NO: 2820313 - protein, 18 aa, Entamoeba invadens
KIKKFCSIIRIIEVTQVN

SEQ ID NO: 2820314 - protein, 26 aa, Entamoeba invadens
KIKNSNIIFIKLLKEISTNKPELLFG

SEQ ID NO: 2820315 - protein, 24 aa, Entamoeba invadens
KIKRLDIDLILLKGGVCVDKNVVD

SEQ ID NO: 2820316 - protein, 23 aa, Entamoeba invadens
KIKTSLVVFLIPHNHAYLVRVIT

SEQ ID NO: 2820317 - protein, 37 aa, Entamoeba invadens
KIKTTPSYLVSLYKFIFIVLTTYREFLFLKPNQMCIN

SEQ ID NO: 2820318 - protein, 25 aa, Entamoeba invadens
KIKVDYNFVFTNRLTKDVLLKFEPN

SEQ ID NO: 2820319 - protein, 19 aa, Entamoeba invadens
KIKVHFDITFPFSSCPITS

SEQ ID NO: 2820320 - protein, 22 aa, Entamoeba invadens
KILDFQQPPPPLYTQPYTQFSQ

SEQ ID NO: 2820321 - protein, 18 aa, Entamoeba invadens
KILEINCLTLVDFTLRNN

SEQ ID NO: 2820322 - protein, 18 aa, Entamoeba invadens
KILFVVHNGLLISEQLES

SEQ ID NO: 2820323 - protein, 27 aa, Entamoeba invadens
KILLQTNFLYFINTLLRLGPDTLFDFD

SEQ ID NO: 2820324 - protein, 19 aa, Entamoeba invadens
KILPQKIRYKILLDATKGV

SEQ ID NO: 2820325 - protein, 23 aa, Entamoeba invadens
KILQMLNLYFTGMIVSLGDMEEE

SEQ ID NO: 2820326 - protein, 18 aa, Entamoeba invadens
KILTTIFTAFLVGGQELL

SEQ ID NO: 2820327 - protein, 23 aa, Entamoeba invadens
KILWIDVPDIKKRLWFGCEKEEE

SEQ ID NO: 2820328 - protein, 25 aa, Entamoeba invadens
KIMDDVAAAIYYLHSLEVLHRDVKG

SEQ ID NO: 2820329 - protein, 18 aa, Entamoeba invadens
KIMGMKIHYTVYWSKHLR

SEQ ID NO: 2820330 - protein, 18 aa, Entamoeba invadens
KIMIDAARGILYLHSNGI

SEQ ID NO: 2820331 - protein, 25 aa, Entamoeba invadens
KIMKNNYLYLCENYYYSKDNKCLSC

SEQ ID NO: 2820332 - protein, 20 aa, Entamoeba invadens
KIMRVIRFCIQYEGIFSIVV

SEQ ID NO: 2820333 - protein, 23 aa, Entamoeba invadens
KIMTCYFTLFCTTKVRNMKIPYT

SEQ ID NO: 2820334 - protein, 23 aa, Entamoeba invadens
KINDDIIFSVLDLHKGKVSEGAL

SEQ ID NO: 2820335 - protein, 20 aa, Entamoeba invadens
KINFFLTPLCFCKIEEKMCA

SEQ ID NO: 2820336 - protein, 22 aa, Entamoeba invadens
KINIELYEVLTKMWGQKGNDRI

SEQ ID NO: 2820337 - protein, 17 aa, Entamoeba invadens
KINLLVLKSFSFNTIEE

SEQ ID NO: 2820338 - protein, 39 aa, Entamoeba invadens
KINMTKILLIVIFGCIFLLIIFTIPMSFVGLYIIQRHHL

SEQ ID NO: 2820339 - protein, 21 aa, Entamoeba invadens
KIPFTHWYKKFYMPRTIKRTT

SEQ ID NO: 2820340 - protein, 19 aa, Entamoeba invadens
KIPILIEFVAGKGSLVVCL

SEQ ID NO: 2820341 - protein, 19 aa, Entamoeba invadens
KIPLVLLVSVHFLGVIAIH

SEQ ID NO: 2820342 - protein, 21 aa, Entamoeba invadens
KIPPVIILSYTQYGYIISADS

SEQ ID NO: 2820343 - protein, 22 aa, Entamoeba invadens
KIQDELLYKLKKYILFGEVPSG

SEQ ID NO: 2820344 - protein, 20 aa, Entamoeba invadens
KIQFKFPWKIAEFVINRNRL

SEQ ID NO: 2820345 - protein, 25 aa, Entamoeba invadens
KIRDMKIPYTIWFSKSKSTLTNISE

SEQ ID NO: 2820346 - protein, 26 aa, Entamoeba invadens
KIRELKIPYTVWFSKSLSTLKQIAEL

SEQ ID NO: 2820347 - protein, 21 aa, Entamoeba invadens
KIRFEMIYKYFDDKSLVLVVL

SEQ ID NO: 2820348 - protein, 32 aa, Entamoeba invadens
KIRGMNTLMFMIIYYLLPIVLSRPVRQPILGD

SEQ ID NO: 2820349 - protein, 28 aa, Entamoeba invadens
KIRGQSELPLIAKYLYLIGLNLGEVNTF

SEQ ID NO: 2820350 - protein, 17 aa, Entamoeba invadens
KIRLPPKRMLRVSTCNS

SEQ ID NO: 2820351 - protein, 24 aa, Entamoeba invadens
KIRRRFFIFVGILVAVLTLPVIPF

SEQ ID NO: 2820352 - protein, 32 aa, Entamoeba invadens
KIRRWVVCVIILFIFSLFTPIGALIGSYIIAS

SEQ ID NO: 2820353 - protein, 21 aa, Entamoeba invadens
KISVLFTICVLFPFVVFVCFG

SEQ ID NO: 2820354 - protein, 25 aa, Entamoeba invadens
KITHSKFLFFDSTPLGRILNRFSKD

SEQ ID NO: 2820355 - protein, 19 aa, Entamoeba invadens
KITIDIEPKFIILKSQFAC

SEQ ID NO: 2820356 - protein, 19 aa, Entamoeba invadens
KITLLVPIVNLLDSMHNCV

SEQ ID NO: 2820357 - protein, 19 aa, Entamoeba invadens
KIVAFFDKKKVPKTSLFTC

SEQ ID NO: 2820358 - protein, 23 aa, Entamoeba invadens
KIVFVLKLYYAYGFLMSVFLQIT

SEQ ID NO: 2820359 - protein, 19 aa, Entamoeba invadens
KIVKPFIVSIPPQNTPIQL

SEQ ID NO: 2820360 - protein, 18 aa, Entamoeba invadens
KIVLDASRGILYLHQNGI

SEQ ID NO: 2820361 - protein, 22 aa, Entamoeba invadens
KIVLIRHEAITVSGLENSEKFI

SEQ ID NO: 2820362 - protein, 18 aa, Entamoeba invadens
KIVTVYMTIFCTTKIRDM

SEQ ID NO: 2820363 - protein, 31 aa, Entamoeba invadens
KIVVLSIILVVIVVLIVCAITIPIAVYFTKD

SEQ ID NO: 2820364 - protein, 17 aa, Entamoeba invadens
KIVVSFLCSPGCKSGCI

SEQ ID NO: 2820365 - protein, 17 aa, Entamoeba invadens
KIWTFIEVSMRTSDVDE

SEQ ID NO: 2820366 - protein, 18 aa, Entamoeba invadens
KIYDPLYNTFYGINKDLE

SEQ ID NO: 2820367 - protein, 50 aa, Entamoeba invadens
KIYHLLTSFKMEFWFVWKWIVLLFKREFEQPQLLLIWDRFVAFPERQMSL

SEQ ID NO: 2820368 - protein, 20 aa, Entamoeba invadens
KIYTLEMTLSTPLVPDGLCT

SEQ ID NO: 2820369 - protein, 35 aa, Entamoeba invadens
KKAGFKWRIQTEKPLFPLFLVDAGLVIISRFPIVE

SEQ ID NO: 2820370 - protein, 25 aa, Entamoeba invadens
KKAKRGFSQIPHLCAFFADVITPNT

SEQ ID NO: 2820371 - protein, 28 aa, Entamoeba invadens
KKAMCWRKWKLYIIGGSIAAIVIIVILI

SEQ ID NO: 2820372 - protein, 18 aa, Entamoeba invadens
KKAVIIEDAGVKKWTLAV

SEQ ID NO: 2820373 - protein, 25 aa, Entamoeba invadens
KKCDKCKLGFWIDDFECVTCETCGS

SEQ ID NO: 2820374 - protein, 18 aa, Entamoeba invadens
KKCEAITNCLYLTKNRCL

SEQ ID NO: 2820375 - protein, 23 aa, Entamoeba invadens
KKCITCVHPYYLSGGVCNTCAVG

SEQ ID NO: 2820376 - protein, 19 aa, Entamoeba invadens
KKCLGCLSGYNLTDDGACA

SEQ ID NO: 2820377 - protein, 20 aa, Entamoeba invadens
KKCYKKFFKSKTGIIVSCVL

SEQ ID NO: 2820378 - protein, 26 aa, Entamoeba invadens
KKDEKTLLTFFTTAAQKFLGLRRNAM

SEQ ID NO: 2820379 - protein, 23 aa, Entamoeba invadens
KKDNYDICRMDFIGGKSVTFRSF

SEQ ID NO: 2820380 - protein, 27 aa, Entamoeba invadens
KKDVYTLYLNQCPMPKPLPLYPQVLQN

SEQ ID NO: 2820381 - protein, 27 aa, Entamoeba invadens
KKDYQIFRKKQQAYLLINMLRVDPQGF

SEQ ID NO: 2820382 - protein, 24 aa, Entamoeba invadens
KKEFRIPIDFFIDKRLNVLLKQYH

SEQ ID NO: 2820383 - protein, 23 aa, Entamoeba invadens
KKEIIAWILLIEYIVRLFVFICK

SEQ ID NO: 2820384 - protein, 28 aa, Entamoeba invadens
KKEKEKFYTWILASLVMLLQNLVNLRGE

SEQ ID NO: 2820385 - protein, 32 aa, Entamoeba invadens
KKEKSLVVPAYYPFFLDLLEKGQNLSTSLNNI

SEQ ID NO: 2820386 - protein, 19 aa, Entamoeba invadens
KKENLLFDYFLSEKPNPEH

SEQ ID NO: 2820387 - protein, 52 aa, Entamoeba invadens
KKEPNLALIISLPVVFFLLFVIFIALTLVIIFLLYLHLKDKKKMINICVFQM

SEQ ID NO: 2820388 - protein, 52 aa, Entamoeba invadens
KKEPNLALIISLPVVFFLLLVIFIATTIVIIFFLYLHLKEKKKMINVCIFPM

SEQ ID NO: 2820389 - protein, 23 aa, Entamoeba invadens
KKESTLPNLFTLCGSYTAFNTER

SEQ ID NO: 2820390 - protein, 21 aa, Entamoeba invadens
KKEVKRILWVIAFRSCMNFIV

SEQ ID NO: 2820391 - protein, 25 aa, Entamoeba invadens
KKEVPLPCLFSTALAFMFSRDIFSR

SEQ ID NO: 2820392 - protein, 23 aa, Entamoeba invadens
KKEYYFEFHFTPSHKYDLDITPK

SEQ ID NO: 2820393 - protein, 26 aa, Entamoeba invadens
KKFAAAIVKFLMWAEKKFGKKVSVRN

SEQ ID NO: 2820394 - protein, 24 aa, Entamoeba invadens
KKFACEFSIYLTPKCTCQINNKIC

SEQ ID NO: 2820395 - protein, 19 aa, Entamoeba invadens
KKFDIISNPQLIVLGKGEA

SEQ ID NO: 2820396 - protein, 22 aa, Entamoeba invadens
KKFNIFVFVMIVVQTVICLVLA

SEQ ID NO: 2820397 - protein, 21 aa, Entamoeba invadens
KKFQFSEYLARKYRCSMNNIF

SEQ ID NO: 2820398 - protein, 17 aa, Entamoeba invadens
KKFVIYGAKWNFAGDDS

SEQ ID NO: 2820399 - protein, 22 aa, Entamoeba invadens
KKGEACEFEVFIVPHCTMKLQD

SEQ ID NO: 2820400 - protein, 28 aa, Entamoeba invadens
KKGENFQFPLKIRALTKMTTRLDFDELI

SEQ ID NO: 2820401 - protein, 29 aa, Entamoeba invadens
KKGENFQFPLKIRALTKMTTRLDFDELIE

SEQ ID NO: 2820402 - protein, 27 aa, Entamoeba invadens
KKGFACEFEIFLTPYFSSNISDTIACV

SEQ ID NO: 2820403 - protein, 20 aa, Entamoeba invadens
KKGFACEFSIYLTPNYSSNI

SEQ ID NO: 2820404 - protein, 26 aa, Entamoeba invadens
KKGFACEFTLIITPFCTSKIDTTILI

SEQ ID NO: 2820405 - protein, 37 aa, Entamoeba invadens
KKGFEWYFGMIIGIVALVIIVIILISIVSLVIITQKR

SEQ ID NO: 2820406 - protein, 29 aa, Entamoeba invadens
KKGKNFQFPLKIRALTKMTTRLDFDELIE

SEQ ID NO: 2820407 - protein, 27 aa, Entamoeba invadens
KKHPLLLEALLLCCSLIFTSTLFESAF

SEQ ID NO: 2820408 - protein, 25 aa, Entamoeba invadens
KKHPNLFNLFLFRRSVKQIMKGRKG

SEQ ID NO: 2820409 - protein, 24 aa, Entamoeba invadens
KKIAIFFISLFYFALVLVACWTNN

SEQ ID NO: 2820410 - protein, 24 aa, Entamoeba invadens
KKIDFFRINIWFGVEYTFAQLHSD

SEQ ID NO: 2820411 - protein, 30 aa, Entamoeba invadens
KKIGEGSFGIVFKGTFRGKTVAIKKLKNSN

SEQ ID NO: 2820412 - protein, 36 aa, Entamoeba invadens
KKIGEGSFGIVYKGSFKGKIVAIKKMKNAQATKQAI

SEQ ID NO: 2820413 - protein, 20 aa, Entamoeba invadens
KKIILYLRNEKTELLLKCII

SEQ ID NO: 2820414 - protein, 21 aa, Entamoeba invadens
KKIIVIILCTTVVVITTMILI

SEQ ID NO: 2820415 - protein, 24 aa, Entamoeba invadens
KKINICKSGYYDKNFYLSCPSNSR

SEQ ID NO: 2820416 - protein, 18 aa, Entamoeba invadens
KKITPLIPILALNGNGSG

SEQ ID NO: 2820417 - protein, 23 aa, Entamoeba invadens
KKIVWILLNILLNISFDYITFFC

SEQ ID NO: 2820418 - protein, 28 aa, Entamoeba invadens
KKKINPFFKFFRTLFFRMTFDQILKGRK

SEQ ID NO: 2820419 - protein, 69 aa, Entamoeba invadens
KKKSIGKMLFFNFSFGPAIVTLFAAIFFTIFSIFVVFSLPEFPFMWGYCWFTTILSYLSLWNTRDELIS

SEQ ID NO: 2820420 - protein, 25 aa, Entamoeba invadens
KKKSLLFLVFSALTLLLAALSCLSL

SEQ ID NO: 2820421 - protein, 33 aa, Entamoeba invadens
KKKTVITVCGVLILIWFVVMVVVVMRRKHTDEP

SEQ ID NO: 2820422 - protein, 26 aa, Entamoeba invadens
KKLDKKYMYVFFSSNGYNEEMVDTIQ

SEQ ID NO: 2820423 - protein, 21 aa, Entamoeba invadens
KKLDKYLRIKFVLDSARGIMY

SEQ ID NO: 2820424 - protein, 20 aa, Entamoeba invadens
KKLDYYLRVKLMIDSAKGIQ

SEQ ID NO: 2820425 - protein, 27 aa, Entamoeba invadens
KKLGEGSFGIVFKGLYRGKTVAIKKMK

SEQ ID NO: 2820426 - protein, 17 aa, Entamoeba invadens
KKLGEGSFGIVFKGTYR

SEQ ID NO: 2820427 - protein, 25 aa, Entamoeba invadens
KKLGEGSFGIVYKGSFRGNIVAIKK

SEQ ID NO: 2820428 - protein, 25 aa, Entamoeba invadens
KKLGEGSFGIVYKGSFRGNVVAIKK

SEQ ID NO: 2820429 - protein, 29 aa, Entamoeba invadens
KKLINVWFHWIPEMIFMVCSFGYLCFLII

SEQ ID NO: 2820430 - protein, 49 aa, Entamoeba invadens
KKLNYGLVIVLPVVCVMVILFMTVVIITVALLLLFKRKEDLLVENVCVF

SEQ ID NO: 2820431 - protein, 25 aa, Entamoeba invadens
KKLQIVLPAFSRYFTTFGRYIQTRK

SEQ ID NO: 2820432 - protein, 21 aa, Entamoeba invadens
KKLRIKLLEDCACGIEYLHNN

SEQ ID NO: 2820433 - protein, 23 aa, Entamoeba invadens
KKMDFYRVIVWFNVDYSTVNNNY

SEQ ID NO: 2820434 - protein, 24 aa, Entamoeba invadens
KKNEQIPPMKIRVKMMIDGARGVL

SEQ ID NO: 2820435 - protein, 26 aa, Entamoeba invadens
KKNLKFFVLFLFYTALALLCNTALLA

SEQ ID NO: 2820436 - protein, 17 aa, Entamoeba invadens
KKNLLFVLASQNSCFGL

SEQ ID NO: 2820437 - protein, 35 aa, Entamoeba invadens
KKNRIDQSLYFICDMLFVLGFQIRWVQFNKRRDVP

SEQ ID NO: 2820438 - protein, 37 aa, Entamoeba invadens
KKPMTLKRFVFLIFFAFMLYVTFVFNKWRIVYSTPSG

SEQ ID NO: 2820439 - protein, 27 aa, Entamoeba invadens
KKQFACEFSIYLTPLCTCKIDNSIQIV

SEQ ID NO: 2820440 - protein, 20 aa, Entamoeba invadens
KKRCYQFASFKSGCVVCQDG

SEQ ID NO: 2820441 - protein, 22 aa, Entamoeba invadens
KKREEKLLGIKPSKKDRAEKAE

SEQ ID NO: 2820442 - protein, 20 aa, Entamoeba invadens
KKRNIFSDIFFLFITFIAGT

SEQ ID NO: 2820443 - protein, 30 aa, Entamoeba invadens
KKSDEISLIIKMKIIIDASKGILYLHENGI

SEQ ID NO: 2820444 - protein, 29 aa, Entamoeba invadens
KKSDEVIMKMRIKLMLDTAKGIQYLHANN

SEQ ID NO: 2820445 - protein, 29 aa, Entamoeba invadens
KKSDEVVMKMRIKLMLDTAKGIQYLHANN

SEQ ID NO: 2820446 - protein, 22 aa, Entamoeba invadens
KKSEFFIFNDISKTPKNKTSFL

SEQ ID NO: 2820447 - protein, 23 aa, Entamoeba invadens
KKSFSNFIISLHLINNYVVKTKV

SEQ ID NO: 2820448 - protein, 25 aa, Entamoeba invadens
KKSNQFALWRTLWDNFSHEYIMCTL

SEQ ID NO: 2820449 - protein, 27 aa, Entamoeba invadens
KKTFTLILFHFLVLIFLLVETFDELKS

SEQ ID NO: 2820450 - protein, 41 aa, Entamoeba invadens
KKTKTNIMPLLLPLFKKLPIHSFAILLQLICSIISVVGMEE

SEQ ID NO: 2820451 - protein, 25 aa, Entamoeba invadens
KKTKYLRFVELVKLFFVGISRGSFF

SEQ ID NO: 2820452 - protein, 41 aa, Entamoeba invadens
KKTLATYVIVLITLACVVAFLVFIGILIVIGMVILRYKEVD

SEQ ID NO: 2820453 - protein, 27 aa, Entamoeba invadens
KKTMYPKIVYPFAIVFDITLRFAWVLN

SEQ ID NO: 2820454 - protein, 48 aa, Entamoeba invadens
KKTNYGLDVVLPVVLTLLFLVFLSVVTYTNFYLFNKKQKKDRERGVCV

SEQ ID NO: 2820455 - protein, 47 aa, Entamoeba invadens
KKTNYGLVIVLPIMCIVVILFIIILLKTIILIVFNKKKENVLTENIC

SEQ ID NO: 2820456 - protein, 33 aa, Entamoeba invadens
KKTTQEMPRLFLRVKLMLDASKGILYLHSNNIL

SEQ ID NO: 2820457 - protein, 20 aa, Entamoeba invadens
KKVCDVFIFSLMTFGLTLTH

SEQ ID NO: 2820458 - protein, 25 aa, Entamoeba invadens
KKVQKLLLIIAISVTVAIPLFIIFH

SEQ ID NO: 2820459 - protein, 17 aa, Entamoeba invadens
KKWCLIFCVKRIIHIFQ

SEQ ID NO: 2820460 - protein, 19 aa, Entamoeba invadens
KKWNLDSFDPLFKEGFCKH

SEQ ID NO: 2820461 - protein, 24 aa, Entamoeba invadens
KKYKAVYLMTLAGIFMFSIAFEWK

SEQ ID NO: 2820462 - protein, 22 aa, Entamoeba invadens
KKYKMPCDIYSFAITMFEVFGW

SEQ ID NO: 2820463 - protein, 19 aa, Entamoeba invadens
KKYLLRMEPAIVTLRKGVA

SEQ ID NO: 2820464 - protein, 20 aa, Entamoeba invadens
KKYNLGQWFKLRADSITTDH

SEQ ID NO: 2820465 - protein, 24 aa, Entamoeba invadens
KKYSSAFASYKMLFQKSYNTQSEE

SEQ ID NO: 2820466 - protein, 30 aa, Entamoeba invadens
KKYTKLDVILLFLIVLFSSLFAFNVLYISR

SEQ ID NO: 2820467 - protein, 22 aa, Entamoeba invadens
KKYVILYAVLLILFGTSLVVYT

SEQ ID NO: 2820468 - protein, 17 aa, Entamoeba invadens
KLCDLFGKYSLSKCCQC

SEQ ID NO: 2820469 - protein, 20 aa, Entamoeba invadens
KLCMNGYYYSNKKCFVNDDG

SEQ ID NO: 2820470 - protein, 24 aa, Entamoeba invadens
KLCNLCKTGFYLENGDCVPCVANC

SEQ ID NO: 2820471 - protein, 19 aa, Entamoeba invadens
KLCSGNYYLLKDKITHNVT

SEQ ID NO: 2820472 - protein, 21 aa, Entamoeba invadens
KLDFTQSYTTPFIVSGDISGV

SEQ ID NO: 2820473 - protein, 21 aa, Entamoeba invadens
KLDIVDVFYFPSVALDIIGNF

SEQ ID NO: 2820474 - protein, 46 aa, Entamoeba invadens
KLECDKSFNYWLVIVLPVACVVLILLILISSIIIVINIVNKSEEKS

SEQ ID NO: 2820475 - protein, 22 aa, Entamoeba invadens
KLEGLALPYLGLVLALALIQSF

SEQ ID NO: 2820476 - protein, 27 aa, Entamoeba invadens
KLEKKMNVVFLILFIGAFSTYCNTYED

SEQ ID NO: 2820477 - protein, 25 aa, Entamoeba invadens
KLEPITLVHFVLKSGIYILNINTTD

SEQ ID NO: 2820478 - protein, 26 aa, Entamoeba invadens
KLFETYAFKDILKNPPQPAFNSSFYR

SEQ ID NO: 2820479 - protein, 24 aa, Entamoeba invadens
KLFFSLLQWSVLIVTTIAVCLLFS

SEQ ID NO: 2820480 - protein, 27 aa, Entamoeba invadens
KLFKRLQLVFFLYRILALVLMYTTLII

SEQ ID NO: 2820481 - protein, 17 aa, Entamoeba invadens
KLFLLQTYSFDFPTPNV

SEQ ID NO: 2820482 - protein, 25 aa, Entamoeba invadens
KLFPNFQIYAFEVGLPFFETYDYSY

SEQ ID NO: 2820483 - protein, 17 aa, Entamoeba invadens
KLFPVIIFDTFNSRKEN

SEQ ID NO: 2820484 - protein, 23 aa, Entamoeba invadens
KLFVGMLICQIFSEALALYGFIV

SEQ ID NO: 2820485 - protein, 23 aa, Entamoeba invadens
KLGEGSFGIVYKGSYRGNIIAIK

SEQ ID NO: 2820486 - protein, 22 aa, Entamoeba invadens
KLGEGSFGIVYKGSYRGNVVAI

SEQ ID NO: 2820487 - protein, 22 aa, Entamoeba invadens
KLGEGSFGIVYKGSYRGVCVAI

SEQ ID NO: 2820488 - protein, 24 aa, Entamoeba invadens
KLGEGSFGIVYKGTYRGKCVAIKK

SEQ ID NO: 2820489 - protein, 23 aa, Entamoeba invadens
KLGEGSFGIVYKGTYRGNVNLKM

SEQ ID NO: 2820490 - protein, 21 aa, Entamoeba invadens
KLGFFFVVPEYFFSAASIAFR

SEQ ID NO: 2820491 - protein, 17 aa, Entamoeba invadens
KLGIIIQQSWEHEPKKR

SEQ ID NO: 2820492 - protein, 28 aa, Entamoeba invadens
KLIEKRLLTLLSLIAFRLDVHVAKRNLK

SEQ ID NO: 2820493 - protein, 22 aa, Entamoeba invadens
KLIPQVILTIKTTTGLPGSAVV

SEQ ID NO: 2820494 - protein, 29 aa, Entamoeba invadens
KLISRMRSKLYSKLLIQNIGYFDYKENGV

SEQ ID NO: 2820495 - protein, 17 aa, Entamoeba invadens
KLITPFDAVWAFHSEAI

SEQ ID NO: 2820496 - protein, 22 aa, Entamoeba invadens
KLKEMQIIYDDSISELIFTLNN

SEQ ID NO: 2820497 - protein, 17 aa, Entamoeba invadens
KLKHTNMIFVDMADGLT

SEQ ID NO: 2820498 - protein, 18 aa, Entamoeba invadens
KLKHTNMIFVKMADGLTI

SEQ ID NO: 2820499 - protein, 23 aa, Entamoeba invadens
KLKKFDGLMWNTNYLFPAAEICY

SEQ ID NO: 2820500 - protein, 25 aa, Entamoeba invadens
KLKKSLVNEFLLKDLKKKGVEMVYL

SEQ ID NO: 2820501 - protein, 17 aa, Entamoeba invadens
KLKRILSHIYGPDKTCF

SEQ ID NO: 2820502 - protein, 18 aa, Entamoeba invadens
KLLDVCRGFLLADRLRHC

SEQ ID NO: 2820503 - protein, 20 aa, Entamoeba invadens
KLLECWRYSGVTKTACGFYR

SEQ ID NO: 2820504 - protein, 31 aa, Entamoeba invadens
KLLFLVGFILPPLWLVLFIVYIFMKDVRLRM

SEQ ID NO: 2820505 - protein, 18 aa, Entamoeba invadens
KLLKNCNSLLMVTITNIM

SEQ ID NO: 2820506 - protein, 20 aa, Entamoeba invadens
KLLPLLLMLLIEAMSQTIIN

SEQ ID NO: 2820507 - protein, 23 aa, Entamoeba invadens
KLMIILFVVIPEVFSLKSNNSFR

SEQ ID NO: 2820508 - protein, 20 aa, Entamoeba invadens
KLNCVSLSNLIVYLDNYKTA

SEQ ID NO: 2820509 - protein, 28 aa, Entamoeba invadens
KLNDLASFLMYFLRVFDESNKVLDFLRQ

SEQ ID NO: 2820510 - protein, 19 aa, Entamoeba invadens
KLNNIVFAPNIKKLGDNAF

SEQ ID NO: 2820511 - protein, 29 aa, Entamoeba invadens
KLNQKTLITILGFLPLEDLFKVSLVCKKL

SEQ ID NO: 2820512 - protein, 21 aa, Entamoeba invadens
KLNSILLSNKKLLKFDLDTDD

SEQ ID NO: 2820513 - protein, 20 aa, Entamoeba invadens
KLNYLVIAAIIFQLTLCTIM

SEQ ID NO: 2820514 - protein, 21 aa, Entamoeba invadens
KLPNFIFRNDLLLNSVNGLEK

SEQ ID NO: 2820515 - protein, 23 aa, Entamoeba invadens
KLQMILTFYRFFTFGIMLVTCVV

SEQ ID NO: 2820516 - protein, 20 aa, Entamoeba invadens
KLQSLNLYGKLETLLDPLES

SEQ ID NO: 2820517 - protein, 20 aa, Entamoeba invadens
KLRCKYYSPNQLKCIECLNA

SEQ ID NO: 2820518 - protein, 19 aa, Entamoeba invadens
KLRNPFIANYMGSVTYIPQ

SEQ ID NO: 2820519 - protein, 19 aa, Entamoeba invadens
KLRNPFIVNYIGNVSYTKD

SEQ ID NO: 2820520 - protein, 23 aa, Entamoeba invadens
KLRVKYCIDGAKGIFYLHENGIL

SEQ ID NO: 2820521 - protein, 32 aa, Entamoeba invadens
KLSSYGVFLVLTTDTAFIWKGRLRNEKYVEYA

SEQ ID NO: 2820522 - protein, 32 aa, Entamoeba invadens
KLSTGMIVFIVIFVIIALLVIVAGIVAVVLAV

SEQ ID NO: 2820523 - protein, 38 aa, Entamoeba invadens
KLSTLAYFQVYNYVPLRFLYSLLFVNKKNRNLISMLTE

SEQ ID NO: 2820524 - protein, 19 aa, Entamoeba invadens
KLTAITLPTTAVTAFGMHV

SEQ ID NO: 2820525 - protein, 20 aa, Entamoeba invadens
KLTDFGYQDTYMKFWNHRTE

SEQ ID NO: 2820526 - protein, 23 aa, Entamoeba invadens
KLTENVFFKCEISGVTFKNGDLS

SEQ ID NO: 2820527 - protein, 20 aa, Entamoeba invadens
KLTIRFDPEIVVLKSGFACE

SEQ ID NO: 2820528 - protein, 17 aa, Entamoeba invadens
KLTLTNYIDLSALQITS

SEQ ID NO: 2820529 - protein, 21 aa, Entamoeba invadens
KLTPLHYCCLYGMVHLMDDLL

SEQ ID NO: 2820530 - protein, 28 aa, Entamoeba invadens
KLTSVNFYAPLVTLLDQMTAQTNFFFHG

SEQ ID NO: 2820531 - protein, 30 aa, Entamoeba invadens
KLVDSPSLNYLYFLTQIGLSLSPMANHLKS

SEQ ID NO: 2820532 - protein, 22 aa, Entamoeba invadens
KLVELDFLNLLLSFNRFGYQDT

SEQ ID NO: 2820533 - protein, 30 aa, Entamoeba invadens
KLVIPRQFLSMMIVLIFVVSGRRKNYDLIL

SEQ ID NO: 2820534 - protein, 24 aa, Entamoeba invadens
KLVKGIYIRFLFDSDYTMLIDSTS

SEQ ID NO: 2820535 - protein, 24 aa, Entamoeba invadens
KLVSPDFLKYIEPLSRRSARIQVR

SEQ ID NO: 2820536 - protein, 21 aa, Entamoeba invadens
KLYIRKIVHPCSTRYIQLNWN

SEQ ID NO: 2820537 - protein, 20 aa, Entamoeba invadens
KLYVDFYEFFLRELLAPFVV

SEQ ID NO: 2820538 - protein, 28 aa, Entamoeba invadens
KMCRQVKIPFMYFVIALSLFSISCMAHT

SEQ ID NO: 2820539 - protein, 40 aa, Entamoeba invadens
KMCVYKFNTWIIVIIVLGLLVLFVLCVTLIVILTNYFFKL

SEQ ID NO: 2820540 - protein, 29 aa, Entamoeba invadens
KMDDFSCSVLFPFITKKFFINDYNMAEFD

SEQ ID NO: 2820541 - protein, 24 aa, Entamoeba invadens
KMDRMDVFWFRGYKSKKSECDEII

SEQ ID NO: 2820542 - protein, 34 aa, Entamoeba invadens
KMDRSNIQMSKLNSILLSNKKLLKFDLDTDDAIP

SEQ ID NO: 2820543 - protein, 19 aa, Entamoeba invadens
KMEEIFRSLDLFKDKKASK

SEQ ID NO: 2820544 - protein, 19 aa, Entamoeba invadens
KMEPLGVLMIRFGDAANMY

SEQ ID NO: 2820545 - protein, 19 aa, Entamoeba invadens
KMERLFLAFVAMRQISLFI

SEQ ID NO: 2820546 - protein, 29 aa, Entamoeba invadens
KMESKNIILPMFFMGHSMGGLLTSVLAGR

SEQ ID NO: 2820547 - protein, 20 aa, Entamoeba invadens
KMFSACVALKTITGFNGVVT

SEQ ID NO: 2820548 - protein, 17 aa, Entamoeba invadens
KMIKSLSFLKTTKPPKS

SEQ ID NO: 2820549 - protein, 20 aa, Entamoeba invadens
KMKIKILCDGARGIQYLHEN

SEQ ID NO: 2820550 - protein, 21 aa, Entamoeba invadens
KMKITLLRFLLQNVMEITREN

SEQ ID NO: 2820551 - protein, 17 aa, Entamoeba invadens
KMKRSNIIMTKLSDDIL

SEQ ID NO: 2820552 - protein, 17 aa, Entamoeba invadens
KMKSSVFVICLHLVNSK

SEQ ID NO: 2820553 - protein, 17 aa, Entamoeba invadens
KMKTKILLDATKGIVYL

SEQ ID NO: 2820554 - protein, 27 aa, Entamoeba invadens
KMLDKFRCDYTIYFYGAVMIRNKICMV

SEQ ID NO: 2820555 - protein, 18 aa, Entamoeba invadens
KMLNITTFKIDRSNVIFK

SEQ ID NO: 2820556 - protein, 20 aa, Entamoeba invadens
KMLYPLIVIVEQIIEKDKLS

SEQ ID NO: 2820557 - protein, 19 aa, Entamoeba invadens
KMMIDIMYGISYLHTNGIL

SEQ ID NO: 2820558 - protein, 21 aa, Entamoeba invadens
KMPCDIYSLAISFFEIIGWAE

SEQ ID NO: 2820559 - protein, 24 aa, Entamoeba invadens
KMPDWYYVVIQGCWKQAAAERYDI

SEQ ID NO: 2820560 - protein, 20 aa, Entamoeba invadens
KMPFYQFRNMIMTETNTIKI

SEQ ID NO: 2820561 - protein, 35 aa, Entamoeba invadens
KMQVPSTNPTPLPILPKLKSFPLNFSRCGKYTLNN

SEQ ID NO: 2820562 - protein, 27 aa, Entamoeba invadens
KMRNDYIIHFYGAVIIPNKLCLVTEYA

SEQ ID NO: 2820563 - protein, 23 aa, Entamoeba invadens
KMRSDYVIHFYGAVYLPGKVSMV

SEQ ID NO: 2820564 - protein, 28 aa, Entamoeba invadens
KMSDEVIMKMRIKLMLDTAKGIQYLHAN

SEQ ID NO: 2820565 - protein, 18 aa, Entamoeba invadens
KMSNWTLDFGLKSSKAIV

SEQ ID NO: 2820566 - protein, 23 aa, Entamoeba invadens
KMTKLKFMIDASKGILYLHENGI

SEQ ID NO: 2820567 - protein, 30 aa, Entamoeba invadens
KMTNFYSIALFFINLLMALVNTFLYKPYAN

SEQ ID NO: 2820568 - protein, 51 aa, Entamoeba invadens
KMVFEFFSHFVLTSYFFEFFSHFVLCFFRNLFRTFLLPPSYPQNIYQKFIT

SEQ ID NO: 2820569 - protein, 36 aa, Entamoeba invadens
KMVSTLAVQLLFSLLKTEFMFYNKTSFMALTISGVI

SEQ ID NO: 2820570 - protein, 26 aa, Entamoeba invadens
KMVSTNIFTPIRNLVLRHLFNIEWWE

SEQ ID NO: 2820571 - protein, 20 aa, Entamoeba invadens
KMWNVLIDYGELATKCLMYP

SEQ ID NO: 2820572 - protein, 25 aa, Entamoeba invadens
KMYGLTFTRFGGIKSPLVCSETDIE

SEQ ID NO: 2820573 - protein, 17 aa, Entamoeba invadens
KNAIFDRLNYFKNPFYK

SEQ ID NO: 2820574 - protein, 25 aa, Entamoeba invadens
KNAQFKALGFNYNMLSILGPQNSGK

SEQ ID NO: 2820575 - protein, 34 aa, Entamoeba invadens
KNCGFVEFDLHGLVILPLGFLEQNIHLEKLVNGN

SEQ ID NO: 2820576 - protein, 18 aa, Entamoeba invadens
KNCKTCTILFARYCNECN

SEQ ID NO: 2820577 - protein, 18 aa, Entamoeba invadens
KNCKTCTILFARYCNECS

SEQ ID NO: 2820578 - protein, 29 aa, Entamoeba invadens
KNCTCFLNDLYLPYGLTKIGYGAFQNITT

SEQ ID NO: 2820579 - protein, 20 aa, Entamoeba invadens
KNCYTCISGYYPDNEGKCQK

SEQ ID NO: 2820580 - protein, 17 aa, Entamoeba invadens
KNDSILVVYKRLHADYA

SEQ ID NO: 2820581 - protein, 23 aa, Entamoeba invadens
KNDYIRFIGLTTVFLLVKENYTN

SEQ ID NO: 2820582 - protein, 20 aa, Entamoeba invadens
KNEELENLTKVRDLAEGERT

SEQ ID NO: 2820583 - protein, 24 aa, Entamoeba invadens
KNEKEIEEMKKQLGKKIEEGNLIK

SEQ ID NO: 2820584 - protein, 17 aa, Entamoeba invadens
KNFGVCPLQLFTKNHPK

SEQ ID NO: 2820585 - protein, 17 aa, Entamoeba invadens
KNFPKRKLLPLLLMLLI

SEQ ID NO: 2820586 - protein, 20 aa, Entamoeba invadens
KNGFYLDGIYCVKCPQKCLS

SEQ ID NO: 2820587 - protein, 22 aa, Entamoeba invadens
KNGLFLNLPYSTVDLNFSTNDK

SEQ ID NO: 2820588 - protein, 26 aa, Entamoeba invadens
KNGLLFRGFSPLNYSVLTTTPSPAKF

SEQ ID NO: 2820589 - protein, 25 aa, Entamoeba invadens
KNGMNPLFVGIVKVPTTVLHVELDS

SEQ ID NO: 2820590 - protein, 21 aa, Entamoeba invadens
KNIDQVLLWVPFEARGVVTNP

SEQ ID NO: 2820591 - protein, 25 aa, Entamoeba invadens
KNIFRFVIVLIECTLKTNYYIKNTL

SEQ ID NO: 2820592 - protein, 23 aa, Entamoeba invadens
KNIITIVFFFFFGSTYLLFYNTL

SEQ ID NO: 2820593 - protein, 19 aa, Entamoeba invadens
KNIKLYWTTVNTASLAFIG

SEQ ID NO: 2820594 - protein, 30 aa, Entamoeba invadens
KNILAKVKHPFLVNLYYSFQTSSALHYVID

SEQ ID NO: 2820595 - protein, 22 aa, Entamoeba invadens
KNILIGTIPVFPAPIKQIILET

SEQ ID NO: 2820596 - protein, 19 aa, Entamoeba invadens
KNILLFQIPICSDAYVAVS

SEQ ID NO: 2820597 - protein, 22 aa, Entamoeba invadens
KNIQIPFSTLDWNLGASTSKNL

SEQ ID NO: 2820598 - protein, 26 aa, Entamoeba invadens
KNKENKFDYCLPISTTLFSNCKRIRF

SEQ ID NO: 2820599 - protein, 24 aa, Entamoeba invadens
KNKLYNLPPSFFLLTKITEINLKE

SEQ ID NO: 2820600 - protein, 30 aa, Entamoeba invadens
KNKTFVLAFYGIVVVLLIPLGVFLLYSKCG

SEQ ID NO: 2820601 - protein, 45 aa, Entamoeba invadens
KNKTPDPVITPFWKIFLEALKDKTLIILMVAALVSLILAVAVPSS

SEQ ID NO: 2820602 - protein, 24 aa, Entamoeba invadens
KNKVRIFYLIGKKTVDDYIWPLLE

SEQ ID NO: 2820603 - protein, 23 aa, Entamoeba invadens
KNLCLLCLSNLYFLDNGKCLSCQ

SEQ ID NO: 2820604 - protein, 17 aa, Entamoeba invadens
KNLFTILTRGMWYINYS

SEQ ID NO: 2820605 - protein, 22 aa, Entamoeba invadens
KNLITNLPERIVKILLTKVITL

SEQ ID NO: 2820606 - protein, 18 aa, Entamoeba invadens
KNLRDTLIDQWLVSDFLP

SEQ ID NO: 2820607 - protein, 27 aa, Entamoeba invadens
KNLRKKWMLVILHLPNSDKYVFHTEPE

SEQ ID NO: 2820608 - protein, 26 aa, Entamoeba invadens
KNLRRDFYFGMVLFSMALLFIISSVI

SEQ ID NO: 2820609 - protein, 24 aa, Entamoeba invadens
KNMGPDYWLIAARLMTNILQAVED

SEQ ID NO: 2820610 - protein, 22 aa, Entamoeba invadens
KNMIDYHIIIDMLPAIANAFVM

SEQ ID NO: 2820611 - protein, 37 aa, Entamoeba invadens
KNMYPTFTTLYRVLTWSYLFIYLLACLTHLMKVVPLS

SEQ ID NO: 2820612 - protein, 30 aa, Entamoeba invadens
KNNKENLIIVYLLLLLVYQNYTTLKESNYP

SEQ ID NO: 2820613 - protein, 25 aa, Entamoeba invadens
KNNLRSFWQLLVSIFLLSLISSMNI

SEQ ID NO: 2820614 - protein, 30 aa, Entamoeba invadens
KNNTYYFDNFYATLPFYFDIINEGKSVVLF

SEQ ID NO: 2820615 - protein, 28 aa, Entamoeba invadens
KNNVDKKWWFYDPNGYPYFMIGANAISP

SEQ ID NO: 2820616 - protein, 27 aa, Entamoeba invadens
KNNVDKKWWFYDPNGYPYFMIGANSIN

SEQ ID NO: 2820617 - protein, 26 aa, Entamoeba invadens
KNNYKYFIQFLLYTDLALVVSVTVNI

SEQ ID NO: 2820618 - protein, 25 aa, Entamoeba invadens
KNPTRNFLCYFSRLSKFFPHAKTLC

SEQ ID NO: 2820619 - protein, 19 aa, Entamoeba invadens
KNPYRLGKWFKVDMSKITK

SEQ ID NO: 2820620 - protein, 23 aa, Entamoeba invadens
KNQKFVHYIPPIQKSEKFEMECV

SEQ ID NO: 2820621 - protein, 25 aa, Entamoeba invadens
KNQKQFVLFHRMLLESPAVSKKINE

SEQ ID NO: 2820622 - protein, 20 aa, Entamoeba invadens
KNSFFITTDSTQLALFKNEI

SEQ ID NO: 2820623 - protein, 17 aa, Entamoeba invadens
KNSFYSLKFDEIGNYNY

SEQ ID NO: 2820624 - protein, 22 aa, Entamoeba invadens
KNSILLIFGLFGSLGVGVLMPL

SEQ ID NO: 2820625 - protein, 24 aa, Entamoeba invadens
KNTFTGMFHFFRKSNLWSLFCSFE

SEQ ID NO: 2820626 - protein, 31 aa, Entamoeba invadens
KNTGLNLFSWAIQGILKFNPYLTADMDSPSN

SEQ ID NO: 2820627 - protein, 20 aa, Entamoeba invadens
KNTIYLLENADFTITALTYN

SEQ ID NO: 2820628 - protein, 25 aa, Entamoeba invadens
KNTNYIPEGFLIHGFWPQSNEGSIN

SEQ ID NO: 2820629 - protein, 23 aa, Entamoeba invadens
KNTQSNCYLVIPNKVTLAPIEVS

SEQ ID NO: 2820630 - protein, 25 aa, Entamoeba invadens
KNTTSFILPLPRYPTSWEEEKSLSF

SEQ ID NO: 2820631 - protein, 24 aa, Entamoeba invadens
KNVCLKCILEFILDNGICIEDANC

SEQ ID NO: 2820632 - protein, 31 aa, Entamoeba invadens
KNVLNNFLFYDFIVNCYFLATTFYQMVLFIF

SEQ ID NO: 2820633 - protein, 23 aa, Entamoeba invadens
KNVNVFLVIPNSAVLRATKKNPQ

SEQ ID NO: 2820634 - protein, 38 aa, Entamoeba invadens
KNVSWYLGYIVDVCIPFLSMCSIAPLLEHPKIIRLRDL

SEQ ID NO: 2820635 - protein, 32 aa, Entamoeba invadens
KNVYKLSFLLLVNLLFFLCELITGIVIHSLAL

SEQ ID NO: 2820636 - protein, 28 aa, Entamoeba invadens
KNYSLFAYIEWFVYGVIQAGIFFSLFYF

SEQ ID NO: 2820637 - protein, 32 aa, Entamoeba invadens
KPADIFSFAITMYEIILWEDAFQKSDSRFKYA

SEQ ID NO: 2820638 - protein, 19 aa, Entamoeba invadens
KPADIYSFGITLLECFKWK

SEQ ID NO: 2820639 - protein, 39 aa, Entamoeba invadens
KPADVFSLAVSLFECLIWEEIYPKEEFKFAWSIADFITS

SEQ ID NO: 2820640 - protein, 29 aa, Entamoeba invadens
KPASKVIIYDGYRPEPFFISFNCSSRTSV

SEQ ID NO: 2820641 - protein, 19 aa, Entamoeba invadens
KPDNILMLSLNLNGNVNAK

SEQ ID NO: 2820642 - protein, 18 aa, Entamoeba invadens
KPDNILVFSLDLDQKING

SEQ ID NO: 2820643 - protein, 19 aa, Entamoeba invadens
KPDNILVFSLDWKDKVIAK

SEQ ID NO: 2820644 - protein, 18 aa, Entamoeba invadens
KPDNILVLNLDYTQKVSG

SEQ ID NO: 2820645 - protein, 23 aa, Entamoeba invadens
KPDNLLVFCIDQVTTRIVNCKLT

SEQ ID NO: 2820646 - protein, 19 aa, Entamoeba invadens
KPDNLLVFSINLKNNVSAK

SEQ ID NO: 2820647 - protein, 18 aa, Entamoeba invadens
KPDNLLVFSLDLDDKVNA

SEQ ID NO: 2820648 - protein, 20 aa, Entamoeba invadens
KPDNVLIFSLNYTEKINAKL

SEQ ID NO: 2820649 - protein, 24 aa, Entamoeba invadens
KPDYPIQLRLCLDAAKGVLYLHTN

SEQ ID NO: 2820650 - protein, 25 aa, Entamoeba invadens
KPFSLKLMRISIFPKSSTFIENKLN

SEQ ID NO: 2820651 - protein, 18 aa, Entamoeba invadens
KPFVLYNKCKNEFWLHIV

SEQ ID NO: 2820652 - protein, 17 aa, Entamoeba invadens
KPGFYLVDGSCYLCPKN

SEQ ID NO: 2820653 - protein, 22 aa, Entamoeba invadens
KPGQFLSKGYCWETSLYKKNCE

SEQ ID NO: 2820654 - protein, 26 aa, Entamoeba invadens
KPGYACEFEIFIKPLCTCSTKENIII

SEQ ID NO: 2820655 - protein, 25 aa, Entamoeba invadens
KPGYACEFEIFIKPLCTCTTKEDVM

SEQ ID NO: 2820656 - protein, 18 aa, Entamoeba invadens
KPGYAISVKFTIKMLCTA

SEQ ID NO: 2820657 - protein, 21 aa, Entamoeba invadens
KPIFRVVVLWVVTFMLVAFVL

SEQ ID NO: 2820658 - protein, 17 aa, Entamoeba invadens
KPIKDFGENVFKNCLNL

SEQ ID NO: 2820659 - protein, 27 aa, Entamoeba invadens
KPKPKLLRVMFRLNAKPMLIAVLPRLI

SEQ ID NO: 2820660 - protein, 26 aa, Entamoeba invadens
KPKVLVWKSLYIHLNYNFDYNKNFII

SEQ ID NO: 2820661 - protein, 20 aa, Entamoeba invadens
KPKYDIYIDKNLVTWVDGKK

SEQ ID NO: 2820662 - protein, 19 aa, Entamoeba invadens
KPLLYQHKFLHQLNSEQTE

SEQ ID NO: 2820663 - protein, 24 aa, Entamoeba invadens
KPLYNSKKVIYLYIPCGDTPTDNI

SEQ ID NO: 2820664 - protein, 23 aa, Entamoeba invadens
KPLYVYTQGYEFFNVTRLNPEAF

SEQ ID NO: 2820665 - protein, 21 aa, Entamoeba invadens
KPMERIYPIGCFKYTNDTSMK

SEQ ID NO: 2820666 - protein, 18 aa, Entamoeba invadens
KPMLPAIGEGAFGMVFRG

SEQ ID NO: 2820667 - protein, 26 aa, Entamoeba invadens
KPPEGMLSLMDNKLLRFGDSITVYCH

SEQ ID NO: 2820668 - protein, 27 aa, Entamoeba invadens
KPPIVLWQSNWLHLYTNTTDKNFYITN

SEQ ID NO: 2820669 - protein, 37 aa, Entamoeba invadens
KPPKKNIFKMFWTQLTDFIVMILIVGTIISLGIQEWI

SEQ ID NO: 2820670 - protein, 20 aa, Entamoeba invadens
KPRIVLWNSSYLHLYSKTAK

SEQ ID NO: 2820671 - protein, 29 aa, Entamoeba invadens
KPRNLPCKAFYLKGFNNPLKPIFLVKSAD

SEQ ID NO: 2820672 - protein, 26 aa, Entamoeba invadens
KPSDMPDWLFDLIAASWDQNPSQRPH

SEQ ID NO: 2820673 - protein, 21 aa, Entamoeba invadens
KPSTAVPITFKIKMLCTASVS

SEQ ID NO: 2820674 - protein, 19 aa, Entamoeba invadens
KPTFWRALAFFGLAVVFLM

SEQ ID NO: 2820675 - protein, 23 aa, Entamoeba invadens
KPVEPTFQPFDFSKEAQAPPPPP

SEQ ID NO: 2820676 - protein, 26 aa, Entamoeba invadens
KPYLKPLYLGVCFFLLFAGYQTTQNY

SEQ ID NO: 2820677 - protein, 19 aa, Entamoeba invadens
KPYLSCILNVVYAKAKDVL

SEQ ID NO: 2820678 - protein, 19 aa, Entamoeba invadens
KPYPNVFYLDDFVPTVVVL

SEQ ID NO: 2820679 - protein, 24 aa, Entamoeba invadens
KQAKLNLTIFKIKNSNSPLSFLLG

SEQ ID NO: 2820680 - protein, 18 aa, Entamoeba invadens
KQCISCEPFQVLLLNNTC

SEQ ID NO: 2820681 - protein, 18 aa, Entamoeba invadens
KQCISCYYGSFLNSKNNT

SEQ ID NO: 2820682 - protein, 24 aa, Entamoeba invadens
KQDFGRFLTLVLKACEMAASKISQ

SEQ ID NO: 2820683 - protein, 23 aa, Entamoeba invadens
KQEGKFEWLMEKESFFENILSSI

SEQ ID NO: 2820684 - protein, 23 aa, Entamoeba invadens
KQELFDRFCTIVRMLHAEITPFK

SEQ ID NO: 2820685 - protein, 23 aa, Entamoeba invadens
KQEPILFELSIKENIILGAKEGD

SEQ ID NO: 2820686 - protein, 20 aa, Entamoeba invadens
KQFRSVIALTIMASFHVIGA

SEQ ID NO: 2820687 - protein, 42 aa, Entamoeba invadens
KQFSKVSFLIFHYLKPKFISVIYCPMLIFFLAITAHSQCQKL

SEQ ID NO: 2820688 - protein, 26 aa, Entamoeba invadens
KQICLTNFEFLAPYAPTEICVCGYKS

SEQ ID NO: 2820689 - protein, 28 aa, Entamoeba invadens
KQIDLFKEGFFSVIPFDAISYFYDTELE

SEQ ID NO: 2820690 - protein, 17 aa, Entamoeba invadens
KQKFRIGKWFKINMDNL

SEQ ID NO: 2820691 - protein, 26 aa, Entamoeba invadens
KQKSCFVNLFIKGGIVGKLMALFIDD

SEQ ID NO: 2820692 - protein, 26 aa, Entamoeba invadens
KQKTKTLPLIQLYQIYDESGSCVFDR

SEQ ID NO: 2820693 - protein, 25 aa, Entamoeba invadens
KQLIQSILYRIGLLSDWYSIGFGFI

SEQ ID NO: 2820694 - protein, 33 aa, Entamoeba invadens
KQLNAWSTITQTLLPSIFFTGTSLIVPTTNTQD

SEQ ID NO: 2820695 - protein, 17 aa, Entamoeba invadens
KQLPFRFVYICEYVGPL

SEQ ID NO: 2820696 - protein, 20 aa, Entamoeba invadens
KQLRHQCVVEFIGAVYTEGE

SEQ ID NO: 2820697 - protein, 17 aa, Entamoeba invadens
KQNIPPATQWKIFKYMV

SEQ ID NO: 2820698 - protein, 32 aa, Entamoeba invadens
KQNSVLDRFGAKGIMICLLVVTACGLVVIFGM

SEQ ID NO: 2820699 - protein, 22 aa, Entamoeba invadens
KQPIFCLKIISKDHRILHFSLP

SEQ ID NO: 2820700 - protein, 24 aa, Entamoeba invadens
KQPLTLPRRCSVLTLIRISQVRLD

SEQ ID NO: 2820701 - protein, 24 aa, Entamoeba invadens
KQQCLDCINPYYLKSENSCLKCPE

SEQ ID NO: 2820702 - protein, 23 aa, Entamoeba invadens
KQQENLVRFLSNDKWRVLVFDDF

SEQ ID NO: 2820703 - protein, 26 aa, Entamoeba invadens
KQQKLLFNNYKMMFYNYISSIPKSEE

SEQ ID NO: 2820704 - protein, 24 aa, Entamoeba invadens
KQQQPIYHFYIAGSTRVFPSKEAK

SEQ ID NO: 2820705 - protein, 17 aa, Entamoeba invadens
KQQQPTYHLYISGSIRA

SEQ ID NO: 2820706 - protein, 19 aa, Entamoeba invadens
KQQSFKAFFEFVMEKFNGA

SEQ ID NO: 2820707 - protein, 26 aa, Entamoeba invadens
KQQYKVLSIIFLFLDVVMVSNINFDY

SEQ ID NO: 2820708 - protein, 32 aa, Entamoeba invadens
KQSLEIYWRNLNYLLMEIQLFDYMSPSISKIL

SEQ ID NO: 2820709 - protein, 17 aa, Entamoeba invadens
KQVGEGAFGIVFKGVFR

SEQ ID NO: 2820710 - protein, 20 aa, Entamoeba invadens
KQWNYLSFFAKEASLEHAKV

SEQ ID NO: 2820711 - protein, 26 aa, Entamoeba invadens
KQYMTTWILLCILFVVSVFVGGVCTL

SEQ ID NO: 2820712 - protein, 20 aa, Entamoeba invadens
KQYYFEFHYTPSHKYDLEIT

SEQ ID NO: 2820713 - protein, 29 aa, Entamoeba invadens
KRAEGVFKIIFNKVPKHPFAHYLRGVMLQ

SEQ ID NO: 2820714 - protein, 20 aa, Entamoeba invadens
KRDGELLKTEKEKVIKQLEE

SEQ ID NO: 2820715 - protein, 38 aa, Entamoeba invadens
KRDSSIFSVVFVLMGFLALTVVVFIVKGSISAKTKKNV

SEQ ID NO: 2820716 - protein, 27 aa, Entamoeba invadens
KRDVEALFYLPFHPVLLTLFVTPTILL

SEQ ID NO: 2820717 - protein, 26 aa, Entamoeba invadens
KREHIQALWTIIIAQSPHVSLNGDGN

SEQ ID NO: 2820718 - protein, 25 aa, Entamoeba invadens
KREIRHKIIIKLMIDTLYGISYLHT

SEQ ID NO: 2820719 - protein, 22 aa, Entamoeba invadens
KRELNFLVDRVESVIPVEIESR

SEQ ID NO: 2820720 - protein, 28 aa, Entamoeba invadens
KREQRYQQFLNWIDKNSFMMDYRFLLFP

SEQ ID NO: 2820721 - protein, 19 aa, Entamoeba invadens
KRFIKSLCGLMLTLKLYDQ

SEQ ID NO: 2820722 - protein, 25 aa, Entamoeba invadens
KRFLNQIVLIILSFKLKMDNTSENS

SEQ ID NO: 2820723 - protein, 23 aa, Entamoeba invadens
KRFMTIYHQPLLLTFDDFMDRTY

SEQ ID NO: 2820724 - protein, 17 aa, Entamoeba invadens
KRFVGNDVVVLVFKEKE

SEQ ID NO: 2820725 - protein, 29 aa, Entamoeba invadens
KRGCACEFSLYLTPLCTCKINTTIQIISK

SEQ ID NO: 2820726 - protein, 20 aa, Entamoeba invadens
KRGFYAINGFCKRCGDNCDD

SEQ ID NO: 2820727 - protein, 33 aa, Entamoeba invadens
KRGIKKFFKTILRPFVFCWKKLPSIVRFSIKNF

SEQ ID NO: 2820728 - protein, 29 aa, Entamoeba invadens
KRGRACEFSLYLTPLCTCKITTTIQIISK

SEQ ID NO: 2820729 - protein, 19 aa, Entamoeba invadens
KRIALSKNILQKIGVWSQI

SEQ ID NO: 2820730 - protein, 23 aa, Entamoeba invadens
KRIKFLWNVIPDQIALLMGVFLM

SEQ ID NO: 2820731 - protein, 26 aa, Entamoeba invadens
KRKDPIKKEQYNIISLCWCQDPKSRL

SEQ ID NO: 2820732 - protein, 23 aa, Entamoeba invadens
KRKDYILTVVLPVVGGAVLVLIV

SEQ ID NO: 2820733 - protein, 24 aa, Entamoeba invadens
KRKELPKLFLRIFEDFVFTQEHMQ

SEQ ID NO: 2820734 - protein, 17 aa, Entamoeba invadens
KRLFIDEKMPLTLKNTI

SEQ ID NO: 2820735 - protein, 28 aa, Entamoeba invadens
KRLRNKYYPFWLTIFPEGTRVKPDKLIE

SEQ ID NO: 2820736 - protein, 17 aa, Entamoeba invadens
KRLSPCFVQFALCVPNQ

SEQ ID NO: 2820737 - protein, 19 aa, Entamoeba invadens
KRLVIPKDVPNELSFLITK

SEQ ID NO: 2820738 - protein, 22 aa, Entamoeba invadens
KRNEHWNTIWKDLKFDKKGVIG

SEQ ID NO: 2820739 - protein, 31 aa, Entamoeba invadens
KRNGMEIFPNFKFWYGLPRLVLDGMEFTFCC

SEQ ID NO: 2820740 - protein, 29 aa, Entamoeba invadens
KRPLFMYSRFIFVRILVVVLIIISMILVI

SEQ ID NO: 2820741 - protein, 25 aa, Entamoeba invadens
KRPTESHFLAPTLKRLISAFFELYS

SEQ ID NO: 2820742 - protein, 41 aa, Entamoeba invadens
KRRKEKRTPWMLWIFWFCVYAGLCAVIFFALKLFNKRDHTH

SEQ ID NO: 2820743 - protein, 26 aa, Entamoeba invadens
KRSCSICKSNYYPIQGRCVPCDYGCT

SEQ ID NO: 2820744 - protein, 23 aa, Entamoeba invadens
KRSDDIPPMKLRVKMMIDGARGV

SEQ ID NO: 2820745 - protein, 18 aa, Entamoeba invadens
KRSFLKCSILYDSIMKDF

SEQ ID NO: 2820746 - protein, 23 aa, Entamoeba invadens
KRSQLTQIVLPETPITIFGNGVF

SEQ ID NO: 2820747 - protein, 20 aa, Entamoeba invadens
KRTVFFEGLLPVDEISRELL

SEQ ID NO: 2820748 - protein, 20 aa, Entamoeba invadens
KRVIGIFQALYPTIRGTKTE

SEQ ID NO: 2820749 - protein, 27 aa, Entamoeba invadens
KRVLEIIFLFFVGFSRSLFFSLAIQIG

SEQ ID NO: 2820750 - protein, 32 aa, Entamoeba invadens
KRVLMVLKTFVYFLVTFFTILYFGFYYTNFPN

SEQ ID NO: 2820751 - protein, 26 aa, Entamoeba invadens
KRVRRPVVLPLLISLAIELLSSFMLP

SEQ ID NO: 2820752 - protein, 26 aa, Entamoeba invadens
KRYAPLSSMYFARMSKALFSRVTPFW

SEQ ID NO: 2820753 - protein, 21 aa, Entamoeba invadens
KRYVYWKFHMAMCVATLFMLQ

SEQ ID NO: 2820754 - protein, 45 aa, Entamoeba invadens
KSADIFSFGITFYETLNWCEAYDKNLFKFPWKIAEFVISGKRLER

SEQ ID NO: 2820755 - protein, 26 aa, Entamoeba invadens
KSADIYSFGITFYETLKWGEAYDKKE

SEQ ID NO: 2820756 - protein, 26 aa, Entamoeba invadens
KSADIYSFGVTLYETLKWGDAYDKNV

SEQ ID NO: 2820757 - protein, 20 aa, Entamoeba invadens
KSAMGFLIFNYYGLSEKEPE

SEQ ID NO: 2820758 - protein, 21 aa, Entamoeba invadens
KSAMITVKDDTMFFGILSVSS

SEQ ID NO: 2820759 - protein, 19 aa, Entamoeba invadens
KSCATGQLRAKKFAMFLKE

SEQ ID NO: 2820760 - protein, 18 aa, Entamoeba invadens
KSCDKCELGFYLTNQHTC

SEQ ID NO: 2820761 - protein, 20 aa, Entamoeba invadens
KSCFSCKDPFYLSNQKCLSC

SEQ ID NO: 2820762 - protein, 33 aa, Entamoeba invadens
KSCFSCKDPYYLSNQKCLLCEAGTYKKTEITCD

SEQ ID NO: 2820763 - protein, 19 aa, Entamoeba invadens
KSCIKCKDGFVLLNGICEI

SEQ ID NO: 2820764 - protein, 50 aa, Entamoeba invadens
KSCSKTNWALIIPLVILGVIIIVIILVLLIAFVWWRRTKSVKAETAAIKP

SEQ ID NO: 2820765 - protein, 42 aa, Entamoeba invadens
KSDAFHMLGLCRIQFIGVLGFSPNFILFNNPKQLQLNSIEMM

SEQ ID NO: 2820766 - protein, 26 aa, Entamoeba invadens
KSDAVNFNFPLEFLKPMEPNFDELFE

SEQ ID NO: 2820767 - protein, 22 aa, Entamoeba invadens
KSDHMDFCVPLDTLTNCVNKTS

SEQ ID NO: 2820768 - protein, 24 aa, Entamoeba invadens
KSDLPDYYFVQYFYNDADNCEFGE

SEQ ID NO: 2820769 - protein, 27 aa, Entamoeba invadens
KSDMKVEFLILEILLISMDYSEVMMKV

SEQ ID NO: 2820770 - protein, 30 aa, Entamoeba invadens
KSDVFSFAICMLEIWLGSDPYPPAKFPDSD

SEQ ID NO: 2820771 - protein, 24 aa, Entamoeba invadens
KSEMNGMDLFIRSGKLRVDECTAN

SEQ ID NO: 2820772 - protein, 22 aa, Entamoeba invadens
KSEMRYPLYCNDFKLICDLYIG

SEQ ID NO: 2820773 - protein, 34 aa, Entamoeba invadens
KSENSLFLYYSSYIFFIFLSLSLIMGKGVITLVG

SEQ ID NO: 2820774 - protein, 23 aa, Entamoeba invadens
KSFDTHFYLVGFFGSVFEKMNEK

SEQ ID NO: 2820775 - protein, 20 aa, Entamoeba invadens
KSFFFQILGSIPKKSRILMT

SEQ ID NO: 2820776 - protein, 22 aa, Entamoeba invadens
KSFSNFLTLTKISIGKCVEQIG

SEQ ID NO: 2820777 - protein, 22 aa, Entamoeba invadens
KSFVFFKDFFYSKDTGTLICFQ

SEQ ID NO: 2820778 - protein, 23 aa, Entamoeba invadens
KSGCANYYCDISRLGELTISPKT

SEQ ID NO: 2820779 - protein, 21 aa, Entamoeba invadens
KSGCFFCKRGFYAINGFCKRC

SEQ ID NO: 2820780 - protein, 27 aa, Entamoeba invadens
KSGETSSLLLLFKNTSIIGLGNVAKTA

SEQ ID NO: 2820781 - protein, 26 aa, Entamoeba invadens
KSGFACEFSLYLTPQCTCHITDTIQI

SEQ ID NO: 2820782 - protein, 25 aa, Entamoeba invadens
KSGQKVMTPIKIYAKTELSTKLDYE

SEQ ID NO: 2820783 - protein, 22 aa, Entamoeba invadens
KSGRVYLKVTPLPGLRKDVKTK

SEQ ID NO: 2820784 - protein, 28 aa, Entamoeba invadens
KSGVLPIIHPFIVAKGIMYFRDFHQSFI

SEQ ID NO: 2820785 - protein, 17 aa, Entamoeba invadens
KSGYMYDDIKKTCVVQS

SEQ ID NO: 2820786 - protein, 19 aa, Entamoeba invadens
KSGYYLFNNKCTPCGDNTC

SEQ ID NO: 2820787 - protein, 17 aa, Entamoeba invadens
KSGYYREKLDCEPCSIS

SEQ ID NO: 2820788 - protein, 18 aa, Entamoeba invadens
KSIILVLWGFWLLTGFVL

SEQ ID NO: 2820789 - protein, 21 aa, Entamoeba invadens
KSILYPWRSHVYGFGFLRIVL

SEQ ID NO: 2820790 - protein, 31 aa, Entamoeba invadens
KSISKIFELSPLFIPIFSFELSVQKYVFQHN

SEQ ID NO: 2820791 - protein, 27 aa, Entamoeba invadens
KSIVIGLLVLWTALLITFSLTSKLEDM

SEQ ID NO: 2820792 - protein, 26 aa, Entamoeba invadens
KSIWKKMLHFPGWFFSQFSRTDPEGS

SEQ ID NO: 2820793 - protein, 24 aa, Entamoeba invadens
KSKEFFKILFNLVSLLQEANCLLF

SEQ ID NO: 2820794 - protein, 24 aa, Entamoeba invadens
KSKIFFENLLYMYNNSEVVITNTH

SEQ ID NO: 2820795 - protein, 50 aa, Entamoeba invadens
KSKKALVAILVVVIIVVIVVLIAIILTVAFVLLRKKKMLNITTFKIDRSN

SEQ ID NO: 2820796 - protein, 47 aa, Entamoeba invadens
KSKKNYGLIIALPVVLVFLLILLIISIIVVILVIIRKHQEVVKMRNI

SEQ ID NO: 2820797 - protein, 25 aa, Entamoeba invadens
KSKKSPRFLALFSKTKSAKIILSPR

SEQ ID NO: 2820798 - protein, 24 aa, Entamoeba invadens
KSKLTKYYTALKLKFESSLSTRLD

SEQ ID NO: 2820799 - protein, 19 aa, Entamoeba invadens
KSKLYLTAPQSLYTRVLLD

SEQ ID NO: 2820800 - protein, 21 aa, Entamoeba invadens
KSKMYSMYLKTTEPPVIITQG

SEQ ID NO: 2820801 - protein, 29 aa, Entamoeba invadens
KSKNEINLKMRVKLILDASKGLLYLHENG

SEQ ID NO: 2820802 - protein, 27 aa, Entamoeba invadens
KSKNITMFCVLLPLLFMCVVNAQTNTL

SEQ ID NO: 2820803 - protein, 25 aa, Entamoeba invadens
KSKSEIVFDLKLKILKDSTKGIQYL

SEQ ID NO: 2820804 - protein, 52 aa, Entamoeba invadens
KSKTMHIFGPVSFLIFACLFSSILSIILPIVFPSMYFLMCASVVLSVTLWIF

SEQ ID NO: 2820805 - protein, 28 aa, Entamoeba invadens
KSKYPELPYAIFFNYGTSHFGFHVRFRD

SEQ ID NO: 2820806 - protein, 24 aa, Entamoeba invadens
KSLCRIIIRDALGRWVWDVEELWV

SEQ ID NO: 2820807 - protein, 18 aa, Entamoeba invadens
KSLCVIQSPFLDFLLSWK

SEQ ID NO: 2820808 - protein, 18 aa, Entamoeba invadens
KSLDIFTMLVDEGNLAIT

SEQ ID NO: 2820809 - protein, 17 aa, Entamoeba invadens
KSLLALILCLTRMSPES

SEQ ID NO: 2820810 - protein, 25 aa, Entamoeba invadens
KSLLLLLLLIFRLLFWCVSRLVFCL

SEQ ID NO: 2820811 - protein, 24 aa, Entamoeba invadens
KSLLSLMRIKLEADVLYFLQVELE

SEQ ID NO: 2820812 - protein, 25 aa, Entamoeba invadens
KSLLYILIIIFYNIKYNIFYIIDTG

SEQ ID NO: 2820813 - protein, 20 aa, Entamoeba invadens
KSLTDWCWTDIPSQRPRAEQ

SEQ ID NO: 2820814 - protein, 23 aa, Entamoeba invadens
KSLTVKMMIVPNNKFGALTTGTF

SEQ ID NO: 2820815 - protein, 21 aa, Entamoeba invadens
KSLVFSLKQVFLILRHPPQNA

SEQ ID NO: 2820816 - protein, 30 aa, Entamoeba invadens
KSLVTYCAAPMPFIIGCLKNLYPNVQKECG

SEQ ID NO: 2820817 - protein, 21 aa, Entamoeba invadens
KSMALSRYYSVNKLEILWFDK

SEQ ID NO: 2820818 - protein, 31 aa, Entamoeba invadens
KSMLCFVTNTLLLILLTTKTNAATSCSSGQY

SEQ ID NO: 2820819 - protein, 20 aa, Entamoeba invadens
KSMLSLHATPLGISLYFKNT

SEQ ID NO: 2820820 - protein, 26 aa, Entamoeba invadens
KSNAPKLMIIALTVIGQILSVHTLPM

SEQ ID NO: 2820821 - protein, 29 aa, Entamoeba invadens
KSNEIRLKIKMKIIIDTSKGILYLHENGI

SEQ ID NO: 2820822 - protein, 18 aa, Entamoeba invadens
KSNHIICFLLSPLDVLLS

SEQ ID NO: 2820823 - protein, 26 aa, Entamoeba invadens
KSNKAGMIVGIIIAVIVVVAVVAIAV

SEQ ID NO: 2820824 - protein, 29 aa, Entamoeba invadens
KSNLPTIVLILRSIYFALKRKFGKKEVEG

SEQ ID NO: 2820825 - protein, 35 aa, Entamoeba invadens
KSNQLKTEMWWKNVKLWIILGVVVAIIVIAIIIVI

SEQ ID NO: 2820826 - protein, 25 aa, Entamoeba invadens
KSNQVHSLFKETLYYFTGDDNAENI

SEQ ID NO: 2820827 - protein, 24 aa, Entamoeba invadens
KSPSPHFLPQFLADSFLFDEFDRN

SEQ ID NO: 2820828 - protein, 26 aa, Entamoeba invadens
KSPYIKTNFLTLDFLGGIINVINRER

SEQ ID NO: 2820829 - protein, 41 aa, Entamoeba invadens
KSQSVILFKRSTSVRINAYKMFLNYINNGQYQVTNFFNDLT

SEQ ID NO: 2820830 - protein, 23 aa, Entamoeba invadens
KSQYYFEFHFTPSHKYDLNIEPM

SEQ ID NO: 2820831 - protein, 25 aa, Entamoeba invadens
KSRKKWMMVIFHTPNNPKFVFHFDP

SEQ ID NO: 2820832 - protein, 24 aa, Entamoeba invadens
KSRLLLVLDNLFYLHPELKYYQGF

SEQ ID NO: 2820833 - protein, 25 aa, Entamoeba invadens
KSSEANFVLAWKKLDFGLGYSVRFI

SEQ ID NO: 2820834 - protein, 24 aa, Entamoeba invadens
KSSEICQFLDVTKIWKGNEVIDLV

SEQ ID NO: 2820835 - protein, 27 aa, Entamoeba invadens
KSSETASLLILFTKTSYIGLGNIGNKP

SEQ ID NO: 2820836 - protein, 27 aa, Entamoeba invadens
KSSETASLLILFTKTSYIGLGNVKKDK

SEQ ID NO: 2820837 - protein, 28 aa, Entamoeba invadens
KSSETASLLILFTKTSYIGLGNVKKDKE

SEQ ID NO: 2820838 - protein, 20 aa, Entamoeba invadens
KSSFSIFLNTKINNLTISRL

SEQ ID NO: 2820839 - protein, 31 aa, Entamoeba invadens
KSTEEIIFDFINRLYIYPLDVSFGKDKKKKT

SEQ ID NO: 2820840 - protein, 23 aa, Entamoeba invadens
KSTILIPLVTKGVALKVLSTLMN

SEQ ID NO: 2820841 - protein, 26 aa, Entamoeba invadens
KSTKAPPLFLFLKCICNDLQTEDLIK

SEQ ID NO: 2820842 - protein, 19 aa, Entamoeba invadens
KSTLFLSLIIRMVNINQQD

SEQ ID NO: 2820843 - protein, 31 aa, Entamoeba invadens
KSTLLKKCFSIMLLASSFYKLHYLTLANSEN

SEQ ID NO: 2820844 - protein, 26 aa, Entamoeba invadens
KSVNTIIFQPPFTPKPYTISFYGMTE

SEQ ID NO: 2820845 - protein, 22 aa, Entamoeba invadens
KSVNVFELFLWNQKNSKSQCSN

SEQ ID NO: 2820846 - protein, 19 aa, Entamoeba invadens
KSYFLNLPVDILNHLKTVT

SEQ ID NO: 2820847 - protein, 17 aa, Entamoeba invadens
KSYIWTSIGSNILQVHM

SEQ ID NO: 2820848 - protein, 24 aa, Entamoeba invadens
KSYKLIFIGVMYIISIVLVLLLVI

SEQ ID NO: 2820849 - protein, 37 aa, Entamoeba invadens
KTAMRYDIIFGTIVGFIVLIVFVLVIVVVLCYQINLH

SEQ ID NO: 2820850 - protein, 39 aa, Entamoeba invadens
KTAQIILTKQNGIFWWFCSICWIMIIIKMIRREFIQFKL

SEQ ID NO: 2820851 - protein, 20 aa, Entamoeba invadens
KTATCMPWPPAKPKSKTSCP

SEQ ID NO: 2820852 - protein, 18 aa, Entamoeba invadens
KTAYANDDFKYLWKIADF

SEQ ID NO: 2820853 - protein, 25 aa, Entamoeba invadens
KTCKKDCPEAYFAKDKVCTACVDDC

SEQ ID NO: 2820854 - protein, 22 aa, Entamoeba invadens
KTCKKNCPEAYFAKDKVCTACV

SEQ ID NO: 2820855 - protein, 26 aa, Entamoeba invadens
KTCKSCKMIYGCELCVNLLVGNVEST

SEQ ID NO: 2820856 - protein, 21 aa, Entamoeba invadens
KTCTEGYYLVGSTCYKCPSGC

SEQ ID NO: 2820857 - protein, 20 aa, Entamoeba invadens
KTCTFCELNHFLLTNSSACI

SEQ ID NO: 2820858 - protein, 26 aa, Entamoeba invadens
KTEKQPFNALYKLLFTPMTVNDFKAV

SEQ ID NO: 2820859 - protein, 20 aa, Entamoeba invadens
KTEMFPLFNFEVKEVVKVND

SEQ ID NO: 2820860 - protein, 19 aa, Entamoeba invadens
KTEQSISVFFSFKKYIYNP

SEQ ID NO: 2820861 - protein, 25 aa, Entamoeba invadens
KTFEKNHMYYIRPSSLINTGSISFS

SEQ ID NO: 2820862 - protein, 17 aa, Entamoeba invadens
KTFLYNKLYEIFSIEKN

SEQ ID NO: 2820863 - protein, 23 aa, Entamoeba invadens
KTFQMLFMVFDADLQINVLNPVG

SEQ ID NO: 2820864 - protein, 18 aa, Entamoeba invadens
KTGKIFLSNSIEGPFRPF

SEQ ID NO: 2820865 - protein, 26 aa, Entamoeba invadens
KTGQINLLLFFTIRADFVQQAMTALY

SEQ ID NO: 2820866 - protein, 37 aa, Entamoeba invadens
KTGTPVFVILPINLLEPTYFVIQLLRRENTFIVVPVV

SEQ ID NO: 2820867 - protein, 17 aa, Entamoeba invadens
KTGYYLSNGYCLECNSN

SEQ ID NO: 2820868 - protein, 23 aa, Entamoeba invadens
KTHFTFLNLVLFIFGPKTEHELV

SEQ ID NO: 2820869 - protein, 20 aa, Entamoeba invadens
KTIKYILQYPRRCSTHIYPW

SEQ ID NO: 2820870 - protein, 23 aa, Entamoeba invadens
KTIPIYFICLIQSLGLAMFWSPS

SEQ ID NO: 2820871 - protein, 23 aa, Entamoeba invadens
KTIPIYFICLIQSLGLAMYWSPT

SEQ ID NO: 2820872 - protein, 51 aa, Entamoeba invadens
KTKCIAQVVWWVILLCVLFVIVIFIIIIALSIFIFIVILNHRKTEKLREKY

SEQ ID NO: 2820873 - protein, 43 aa, Entamoeba invadens
KTKCITQAVWWVILLCVLFVIFIFIIIIASSIFIFIAILNHRK

SEQ ID NO: 2820874 - protein, 25 aa, Entamoeba invadens
KTKKELHQLTLIRTLIPLFNDGSGF

SEQ ID NO: 2820875 - protein, 23 aa, Entamoeba invadens
KTKKMIFCIFFVGLHALFMVSSL

SEQ ID NO: 2820876 - protein, 21 aa, Entamoeba invadens
KTKLTTITIPTSVTSLGMHVF

SEQ ID NO: 2820877 - protein, 24 aa, Entamoeba invadens
KTKSGFILFNSNLPFMATIEQPPD

SEQ ID NO: 2820878 - protein, 42 aa, Entamoeba invadens
KTKSLTLSLCKLYLIPVVKTLPYFIVLALLNYSTPAIQRRIL

SEQ ID NO: 2820879 - protein, 41 aa, Entamoeba invadens
KTKVLNGLPISFYLERIFALYIPLYIKCTVAIVSRESTRKM

SEQ ID NO: 2820880 - protein, 23 aa, Entamoeba invadens
KTKVTIIFINLRTSSEKSIDIPI

SEQ ID NO: 2820881 - protein, 33 aa, Entamoeba invadens
KTKYYLKVDFAMIFHMYYSVLKFQTQNAPNAHF

SEQ ID NO: 2820882 - protein, 23 aa, Entamoeba invadens
KTLDSFFYSVKPIGDYPPEKLHD

SEQ ID NO: 2820883 - protein, 23 aa, Entamoeba invadens
KTLEVTFPFTRYGKFGYSFCAPT

SEQ ID NO: 2820884 - protein, 21 aa, Entamoeba invadens
KTLKGMLRRAITNKIFLCVII

SEQ ID NO: 2820885 - protein, 34 aa, Entamoeba invadens
KTLLGPPPFVLFAFLFSVFFLVIVPSIFTRFYFI

SEQ ID NO: 2820886 - protein, 25 aa, Entamoeba invadens
KTLLNYLEMYKNHPNVFAWYVDDET

SEQ ID NO: 2820887 - protein, 25 aa, Entamoeba invadens
KTLTRGIFVYNKLLRICKLDTINTN

SEQ ID NO: 2820888 - protein, 21 aa, Entamoeba invadens
KTLVAWMNYLYRITFWVQVLC

SEQ ID NO: 2820889 - protein, 17 aa, Entamoeba invadens
KTMCLFTMKKSNIEFMK

SEQ ID NO: 2820890 - protein, 25 aa, Entamoeba invadens
KTMFSVKRFYRIHKTGRSEILKKFV

SEQ ID NO: 2820891 - protein, 28 aa, Entamoeba invadens
KTMLCTSCESGYYLYNNTCNKCSLTGCV

SEQ ID NO: 2820892 - protein, 21 aa, Entamoeba invadens
KTMLRFLIRSSKKKAFRTIKD

SEQ ID NO: 2820893 - protein, 19 aa, Entamoeba invadens
KTMTVLVDYFIIGVTIIVV

SEQ ID NO: 2820894 - protein, 46 aa, Entamoeba invadens
KTNCEKHVVWWFILIIVIIGVMVLSLIFTIVAIVSLFVMKLKEHQK

SEQ ID NO: 2820895 - protein, 36 aa, Entamoeba invadens
KTNEKYYISFYPQIITIPPNYGCEFSLFLTPLCNST

SEQ ID NO: 2820896 - protein, 32 aa, Entamoeba invadens
KTNLFCGLNTLPFLFDLVFSSTFGGSYKISGE

SEQ ID NO: 2820897 - protein, 48 aa, Entamoeba invadens
KTNYGIVIGIPVAIFIFFIIIIALILVVVYLLILSRKEKKKMKNICVF

SEQ ID NO: 2820898 - protein, 47 aa, Entamoeba invadens
KTNYGLDVVLPVVLTLLFLVFLSVVIYTIFYLFNKKQKKDREKGICV

SEQ ID NO: 2820899 - protein, 41 aa, Entamoeba invadens
KTNYGLVVVLPIFCILLLVIILFIIIITTLIVIHRNHKNKQ

SEQ ID NO: 2820900 - protein, 17 aa, Entamoeba invadens
KTPERITLFKNLKTATL

SEQ ID NO: 2820901 - protein, 20 aa, Entamoeba invadens
KTPFLRYSGVMLGLSLIVYF

SEQ ID NO: 2820902 - protein, 21 aa, Entamoeba invadens
KTPFSIFRDSIEPKPLIEIFD

SEQ ID NO: 2820903 - protein, 27 aa, Entamoeba invadens
KTPIDVQIRLKIMIDGALGLQYLHSNG

SEQ ID NO: 2820904 - protein, 18 aa, Entamoeba invadens
KTPLPGSSIFKNTKQTKS

SEQ ID NO: 2820905 - protein, 30 aa, Entamoeba invadens
KTPSLITLIITFLWLRVKSKRVVPPHPINK

SEQ ID NO: 2820906 - protein, 22 aa, Entamoeba invadens
KTQFFIQYFDPFANEELIRIMK

SEQ ID NO: 2820907 - protein, 26 aa, Entamoeba invadens
KTQLPVVRYLLLKTQFVDCILKQDKF

SEQ ID NO: 2820908 - protein, 24 aa, Entamoeba invadens
KTQQPNYYFYINGSLRSAPSKKAK

SEQ ID NO: 2820909 - protein, 24 aa, Entamoeba invadens
KTQYYFEPLKLPNYPEELPNVITI

SEQ ID NO: 2820910 - protein, 32 aa, Entamoeba invadens
KTRFPLLKVLFFAGFILPLIWPIIVFKYIKSQ

SEQ ID NO: 2820911 - protein, 17 aa, Entamoeba invadens
KTRPELFWSMAEEIHKI

SEQ ID NO: 2820912 - protein, 25 aa, Entamoeba invadens
KTRPIKFLNEPYYICDRQIVVLKSV

SEQ ID NO: 2820913 - protein, 23 aa, Entamoeba invadens
KTSFIASLFRFGVKLKIDAPLSE

SEQ ID NO: 2820914 - protein, 33 aa, Entamoeba invadens
KTSKALIIVLCLISFLLLIGCGVAAILVFGVWR

SEQ ID NO: 2820915 - protein, 24 aa, Entamoeba invadens
KTSLRIEADPFPLFDCVWSSNGCC

SEQ ID NO: 2820916 - protein, 23 aa, Entamoeba invadens
KTSLRVFVTNFYKPEKFGEIEVK

SEQ ID NO: 2820917 - protein, 27 aa, Entamoeba invadens
KTSSEIDIKIRLKFMLDGARGIEYLHT

SEQ ID NO: 2820918 - protein, 21 aa, Entamoeba invadens
KTSTCVACDLNYVLIGKRCVK

SEQ ID NO: 2820919 - protein, 24 aa, Entamoeba invadens
KTSTGVYYYFQSPVTDVFVVETCG

SEQ ID NO: 2820920 - protein, 29 aa, Entamoeba invadens
KTSVIKLLFVFLITVLMIPVPPSLDIFGD

SEQ ID NO: 2820921 - protein, 31 aa, Entamoeba invadens
KTSWTGFPNVFSDLWKPYLEITLRDIEENKN

SEQ ID NO: 2820922 - protein, 26 aa, Entamoeba invadens
KTTCLSCTVGYYLNSNSCTKCTNGCT

SEQ ID NO: 2820923 - protein, 35 aa, Entamoeba invadens
KTTEWIIIGVCSGIFLLIIIVGVCGIVGFVIYRKK

SEQ ID NO: 2820924 - protein, 25 aa, Entamoeba invadens
KTVESLELIIVRKGIRFNTEGEVVI

SEQ ID NO: 2820925 - protein, 18 aa, Entamoeba invadens
KTVKNSFFITTDSTQLAL

SEQ ID NO: 2820926 - protein, 18 aa, Entamoeba invadens
KTVLIGLLILMLGFSLNG

SEQ ID NO: 2820927 - protein, 24 aa, Entamoeba invadens
KTVSLLLETLNSPTLTFMSLKCNS

SEQ ID NO: 2820928 - protein, 26 aa, Entamoeba invadens
KTVTFQFYTWHLLTSNDMLGCAKWEV

SEQ ID NO: 2820929 - protein, 20 aa, Entamoeba invadens
KTVYCHLYGKIIKQGNFIEE

SEQ ID NO: 2820930 - protein, 21 aa, Entamoeba invadens
KTWKFLIQNTIYAKKLASATK

SEQ ID NO: 2820931 - protein, 20 aa, Entamoeba invadens
KTWMQFLHFVGNIANIKEPD

SEQ ID NO: 2820932 - protein, 24 aa, Entamoeba invadens
KTWSKILWNALLLGFSLTNSLIGA

SEQ ID NO: 2820933 - protein, 32 aa, Entamoeba invadens
KTYPLVTKKYPFLTLFFQAIGSLICVFQALLK

SEQ ID NO: 2820934 - protein, 20 aa, Entamoeba invadens
KTYVGVLYLLGIAALQVITS

SEQ ID NO: 2820935 - protein, 22 aa, Entamoeba invadens
KVAILSIFVMTFVSLGFEHSVA

SEQ ID NO: 2820936 - protein, 24 aa, Entamoeba invadens
KVAIVKFQPFIDKLYVRGIVEKEG

SEQ ID NO: 2820937 - protein, 29 aa, Entamoeba invadens
KVAVVCYKRNIFRYMLVLTVHTEDLTNKV

SEQ ID NO: 2820938 - protein, 18 aa, Entamoeba invadens
KVCADGYYLLNSRCTKCN

SEQ ID NO: 2820939 - protein, 21 aa, Entamoeba invadens
KVCAIGFYPDETSGKCVACFT

SEQ ID NO: 2820940 - protein, 23 aa, Entamoeba invadens
KVCEWCPVTFYSDKYKCVKCLRG

SEQ ID NO: 2820941 - protein, 18 aa, Entamoeba invadens
KVCKGNCDYGNGIYVHCT

SEQ ID NO: 2820942 - protein, 19 aa, Entamoeba invadens
KVCLYCQPNYILINKKCEA

SEQ ID NO: 2820943 - protein, 20 aa, Entamoeba invadens
KVCVCIPTYYGLVDTSYNFP

SEQ ID NO: 2820944 - protein, 29 aa, Entamoeba invadens
KVDIFNLGCLFYFIALKRHPFGELIDRPK

SEQ ID NO: 2820945 - protein, 17 aa, Entamoeba invadens
KVDILAYWVAQSLYETI

SEQ ID NO: 2820946 - protein, 19 aa, Entamoeba invadens
KVDTLIVAAQRDLAPKVKS

SEQ ID NO: 2820947 - protein, 17 aa, Entamoeba invadens
KVDYFEHLLDSLSMVVD

SEQ ID NO: 2820948 - protein, 19 aa, Entamoeba invadens
KVFAIKHFDIVADQLKDKI

SEQ ID NO: 2820949 - protein, 35 aa, Entamoeba invadens
KVFDQQESYLFLSLGNFLGLLTLGLNKPIRSNQVQ

SEQ ID NO: 2820950 - protein, 17 aa, Entamoeba invadens
KVFFMFVSGIFSIVSGV

SEQ ID NO: 2820951 - protein, 20 aa, Entamoeba invadens
KVFSGYVAAIVVDKIEKQEE

SEQ ID NO: 2820952 - protein, 20 aa, Entamoeba invadens
KVFYNRLFVTNLNENFLIKA

SEQ ID NO: 2820953 - protein, 30 aa, Entamoeba invadens
KVGEIFKKFIPFFKSYFLYISHYETSNKTL

SEQ ID NO: 2820954 - protein, 21 aa, Entamoeba invadens
KVGMTFTYFAPLVFVVALSIC

SEQ ID NO: 2820955 - protein, 20 aa, Entamoeba invadens
KVIEDYAFYVSHFTSFDLAN

SEQ ID NO: 2820956 - protein, 26 aa, Entamoeba invadens
KVIYYKFIRTFFVAVFFVLSGIVGLL

SEQ ID NO: 2820957 - protein, 26 aa, Entamoeba invadens
KVKEMKIPFTVWFSKSKKTLQQIANV

SEQ ID NO: 2820958 - protein, 17 aa, Entamoeba invadens
KVKTINYVLYSGDVRMF

SEQ ID NO: 2820959 - protein, 18 aa, Entamoeba invadens
KVLGEGSFGIVYKGTFRG

SEQ ID NO: 2820960 - protein, 23 aa, Entamoeba invadens
KVLQKYKWFRPGSGLPSSFMFDT

SEQ ID NO: 2820961 - protein, 17 aa, Entamoeba invadens
KVLTVNGLNWIQLLVGA

SEQ ID NO: 2820962 - protein, 36 aa, Entamoeba invadens
KVLVLSVSLFFVLMSGALFISLFIVKVPLPDITETT

SEQ ID NO: 2820963 - protein, 17 aa, Entamoeba invadens
KVNKKILTLKKNLFTIL

SEQ ID NO: 2820964 - protein, 26 aa, Entamoeba invadens
KVNTIVSLMVSIMLNMSNATMAIVST

SEQ ID NO: 2820965 - protein, 24 aa, Entamoeba invadens
KVNVLKLAIMLFRNCIYKMGEVVE

SEQ ID NO: 2820966 - protein, 24 aa, Entamoeba invadens
KVPMNVYWQYIKSGSYMMFVLMWL

SEQ ID NO: 2820967 - protein, 29 aa, Entamoeba invadens
KVQEVKIPSQFLLPNLPPVKYQGQRSMCW

SEQ ID NO: 2820968 - protein, 23 aa, Entamoeba invadens
KVQKLLFSPQRMIDTVFTNPSTL

SEQ ID NO: 2820969 - protein, 24 aa, Entamoeba invadens
KVQKRLMKMVLNTTPFLFCKTIDE

SEQ ID NO: 2820970 - protein, 41 aa, Entamoeba invadens
KVQLFVFSIFFFYFCSSLIEIFFWGFYLSGSKLTQISTSSK

SEQ ID NO: 2820971 - protein, 30 aa, Entamoeba invadens
KVRAYKWIITTLFPSFFWVLEDNIHEITVK

SEQ ID NO: 2820972 - protein, 17 aa, Entamoeba invadens
KVRLPLCPPLDKTIEPY

SEQ ID NO: 2820973 - protein, 32 aa, Entamoeba invadens
KVSESFSMKCFNLFYGCYSRDYKLNSTIDVDN

SEQ ID NO: 2820974 - protein, 26 aa, Entamoeba invadens
KVSIEMFKQQQPIYYLYINGSSKKEP

SEQ ID NO: 2820975 - protein, 22 aa, Entamoeba invadens
KVSRKMTKLLEGMRLYGMMHPI

SEQ ID NO: 2820976 - protein, 23 aa, Entamoeba invadens
KVSYRNLLSWYLGGEIPELVEEN

SEQ ID NO: 2820977 - protein, 29 aa, Entamoeba invadens
KVTKGLTTLFLLLLQYHCPILSKKLVEIR

SEQ ID NO: 2820978 - protein, 21 aa, Entamoeba invadens
KVTKKIFEFSLKSLDVTVTER

SEQ ID NO: 2820979 - protein, 17 aa, Entamoeba invadens
KVTTTDPVFKRKGADLY

SEQ ID NO: 2820980 - protein, 25 aa, Entamoeba invadens
KVTYTIPDNTIYGGLYIGSGSVSGN

SEQ ID NO: 2820981 - protein, 32 aa, Entamoeba invadens
KVVLFNNPYNFLFLPTYIETMCLMLPNFDEKC

SEQ ID NO: 2820982 - protein, 18 aa, Entamoeba invadens
KVVLLLEGLEIPEFFKIS

SEQ ID NO: 2820983 - protein, 24 aa, Entamoeba invadens
KVVPIYQPFTYGVWLQFQTSDQEE

SEQ ID NO: 2820984 - protein, 27 aa, Entamoeba invadens
KVWMPIINTVFSQRIELVWKGSKGYSN

SEQ ID NO: 2820985 - protein, 19 aa, Entamoeba invadens
KVYLGRYRSLPVAVKQYRW

SEQ ID NO: 2820986 - protein, 21 aa, Entamoeba invadens
KVYNFFLLGFGLELSVRVLPF

SEQ ID NO: 2820987 - protein, 18 aa, Entamoeba invadens
KVYPRLIMADGMGNLVTG

SEQ ID NO: 2820988 - protein, 26 aa, Entamoeba invadens
KVYRDWFAFLMTRNPTFFITTILSVL

SEQ ID NO: 2820989 - protein, 18 aa, Entamoeba invadens
KVYRPLVIEVTKIRFNIY

SEQ ID NO: 2820990 - protein, 27 aa, Entamoeba invadens
KVYTMQYFIWWFVLLPFVVPKIVKGAL

SEQ ID NO: 2820991 - protein, 47 aa, Entamoeba invadens
KWADSGLAVLYLMQKIRRWVVCVIILFIFSLFTPIGALIGSYIIASL

SEQ ID NO: 2820992 - protein, 20 aa, Entamoeba invadens
KWFNFACMVLYIYGGLWAYV

SEQ ID NO: 2820993 - protein, 31 aa, Entamoeba invadens
KWIKLPDAHIPLWRYIIFTTAMFCCVVLCIL

SEQ ID NO: 2820994 - protein, 22 aa, Entamoeba invadens
KWKKWFYDQILHNHIYYSYYYN

SEQ ID NO: 2820995 - protein, 18 aa, Entamoeba invadens
KWLDALTPTVTLISCGKA

SEQ ID NO: 2820996 - protein, 17 aa, Entamoeba invadens
KWLVDLKEIFARRKKRV

SEQ ID NO: 2820997 - protein, 19 aa, Entamoeba invadens
KWSYIIKMTNFYSIALFFI

SEQ ID NO: 2820998 - protein, 21 aa, Entamoeba invadens
KYACQKGYYSKSGALICIICP

SEQ ID NO: 2820999 - protein, 26 aa, Entamoeba invadens
KYAKNLQWYVDIMLQLISVYGDYIAD

SEQ ID NO: 2821000 - protein, 17 aa, Entamoeba invadens
KYAPYIKRYFLATADQV

SEQ ID NO: 2821001 - protein, 23 aa, Entamoeba invadens
KYATLFTRAFDPPFIKINTSTYF

SEQ ID NO: 2821002 - protein, 20 aa, Entamoeba invadens
KYCDIDTFNIYPFVSPISGV

SEQ ID NO: 2821003 - protein, 20 aa, Entamoeba invadens
KYCDINTFNIYPFVSPISGV

SEQ ID NO: 2821004 - protein, 46 aa, Entamoeba invadens
KYCETKVVWWVILISVLVIIVFLVFIFIVIVLIIRRILAHLHQKEV

SEQ ID NO: 2821005 - protein, 20 aa, Entamoeba invadens
KYCSYLIVPAKRAPFGAVVQ

SEQ ID NO: 2821006 - protein, 24 aa, Entamoeba invadens
KYDKNHIYLCARFPGVYPDILDII

SEQ ID NO: 2821007 - protein, 26 aa, Entamoeba invadens
KYDSVWMRGYWLIFSQDQAVKGTIDK

SEQ ID NO: 2821008 - protein, 28 aa, Entamoeba invadens
KYEFDHEITMLKLLRHETTVNYIGAVYT

SEQ ID NO: 2821009 - protein, 17 aa, Entamoeba invadens
KYFIKYSYDDLVNKKFQ

SEQ ID NO: 2821010 - protein, 18 aa, Entamoeba invadens
KYFTPIISCLPPLFRFLQ

SEQ ID NO: 2821011 - protein, 29 aa, Entamoeba invadens
KYIHSPHLVFYLTQTPLYLFVHHAFGESF

SEQ ID NO: 2821012 - protein, 29 aa, Entamoeba invadens
KYIVKALAAFPPFILTALVGSLRVIFDVT

SEQ ID NO: 2821013 - protein, 30 aa, Entamoeba invadens
KYKFGRPPYFYLLLVALLTATVTAPWNGKR

SEQ ID NO: 2821014 - protein, 17 aa, Entamoeba invadens
KYKIFSFDKEKFNFFTL

SEQ ID NO: 2821015 - protein, 20 aa, Entamoeba invadens
KYKTIFESPLSEIDGCLLYD

SEQ ID NO: 2821016 - protein, 24 aa, Entamoeba invadens
KYKVDYIERLPIVMPVIMDDLVSL

SEQ ID NO: 2821017 - protein, 20 aa, Entamoeba invadens
KYLFFNRWSMLIALLICCVN

SEQ ID NO: 2821018 - protein, 19 aa, Entamoeba invadens
KYLIEPLALDFGNSSSLTA

SEQ ID NO: 2821019 - protein, 20 aa, Entamoeba invadens
KYLSFIVSWEQDGCNLGLAV

SEQ ID NO: 2821020 - protein, 24 aa, Entamoeba invadens
KYNEFLYTVAMLADIYISIGLYDS

SEQ ID NO: 2821021 - protein, 19 aa, Entamoeba invadens
KYNFTKQRYYCVQSLFSNI

SEQ ID NO: 2821022 - protein, 24 aa, Entamoeba invadens
KYNKPVLIILFFTCIFVGFIEVWS

SEQ ID NO: 2821023 - protein, 18 aa, Entamoeba invadens
KYNLGQWFKLRADSITTD

SEQ ID NO: 2821024 - protein, 43 aa, Entamoeba invadens
KYNVFTFPFKFLYYQYKLLTNVYFLINMIISCIPYISTVTPIT

SEQ ID NO: 2821025 - protein, 23 aa, Entamoeba invadens
KYPTYILFMAMLLSLLGLHIYWY

SEQ ID NO: 2821026 - protein, 21 aa, Entamoeba invadens
KYQLIHIPFINRKSAFLKSKN

SEQ ID NO: 2821027 - protein, 20 aa, Entamoeba invadens
KYRFGKWFELDMSTFGAEMN

SEQ ID NO: 2821028 - protein, 26 aa, Entamoeba invadens
KYRIGKWIKLNMTLVKAPFIAFNFSK

SEQ ID NO: 2821029 - protein, 18 aa, Entamoeba invadens
KYSCLIWKDLIGTSQKVA

SEQ ID NO: 2821030 - protein, 19 aa, Entamoeba invadens
KYSEKLLGVWYQYTAPVNG

SEQ ID NO: 2821031 - protein, 20 aa, Entamoeba invadens
KYSIRVVPDLVVLKKGEGCE

SEQ ID NO: 2821032 - protein, 30 aa, Entamoeba invadens
KYSLITLFFCYFTSLFLLPRFINTVTREAN

SEQ ID NO: 2821033 - protein, 25 aa, Entamoeba invadens
KYSPIFKILFEKWYGHDARLLYEMR

SEQ ID NO: 2821034 - protein, 22 aa, Entamoeba invadens
KYSRMIETVVGIPFIINEKVLN

SEQ ID NO: 2821035 - protein, 25 aa, Entamoeba invadens
KYSYKHLSVFLLKANAIIKKYPSLF

SEQ ID NO: 2821036 - protein, 27 aa, Entamoeba invadens
KYTERKCWAYWQHLMFGYANLKDDFEK

SEQ ID NO: 2821037 - protein, 18 aa, Entamoeba invadens
KYTKSLLALILCLTRMSP

SEQ ID NO: 2821038 - protein, 20 aa, Entamoeba invadens
KYTLLSFPLKFLYQQFTMVT

SEQ ID NO: 2821039 - protein, 23 aa, Entamoeba invadens
KYTYTFPFAQVHCPYTNCFVKTQ

SEQ ID NO: 2821040 - protein, 17 aa, Entamoeba invadens
KYVFHFEPQVAILRPNA

SEQ ID NO: 2821041 - protein, 29 aa, Entamoeba invadens
KYVGLDTFFNFLPDQYWALAVSSIFVSGF

SEQ ID NO: 2821042 - protein, 26 aa, Entamoeba invadens
KYVGWEQPLFLLVEFFYNKQMDTEKN

SEQ ID NO: 2821043 - protein, 18 aa, Entamoeba invadens
KYVKARKWRDGDTTYLLI

SEQ ID NO: 2821044 - protein, 27 aa, Entamoeba invadens
KYVPDKYISIIYFPGLSFCGEVFSSFT

SEQ ID NO: 2821045 - protein, 20 aa, Entamoeba invadens
KYVPWALILLNVLMGSQLLP

SEQ ID NO: 2821046 - protein, 19 aa, Entamoeba invadens
KYVYWNINLQNAPELIVFT

SEQ ID NO: 2821047 - protein, 20 aa, Entamoeba invadens
KYYCITCKDGYFMSSFGECL

SEQ ID NO: 2821048 - protein, 21 aa, Entamoeba invadens
KYYELPTQFPFLRVEKKFLEK

SEQ ID NO: 2821049 - protein, 17 aa, Entamoeba invadens
KYYVELYKNVPKCLFDG

SEQ ID NO: 2821050 - protein, 18 aa, Entamoeba invadens
LAAFFLYYILSNKECHDN

SEQ ID NO: 2821051 - protein, 47 aa, Entamoeba invadens
LAAPNQWKVQLFFVIFFFMLFAIFIPCLVIHIIKFYRDEQRSLATDR

SEQ ID NO: 2821052 - protein, 24 aa, Entamoeba invadens
LAAYPVDLQYPVAFWHVYVGIDTY

SEQ ID NO: 2821053 - protein, 26 aa, Entamoeba invadens
LADMLMPIVIYMIEEIDFFKGWHQTN

SEQ ID NO: 2821054 - protein, 24 aa, Entamoeba invadens
LAEERLVYKNGIFSNGYQLKASTG

SEQ ID NO: 2821055 - protein, 18 aa, Entamoeba invadens
LAEIIRRKMLILQEQIKT

SEQ ID NO: 2821056 - protein, 31 aa, Entamoeba invadens
LAEIKKYKYPTFFPFFMSYSHTYNGNKYGRT

SEQ ID NO: 2821057 - protein, 17 aa, Entamoeba invadens
LAFFWSICEYLLSNQIY

SEQ ID NO: 2821058 - protein, 18 aa, Entamoeba invadens
LAFLIELPLCYIYRFLPP

SEQ ID NO: 2821059 - protein, 30 aa, Entamoeba invadens
LAFMSMSLLNFMHLVGIYYYGKYKPDEQPK

SEQ ID NO: 2821060 - protein, 17 aa, Entamoeba invadens
LAFRKVGVNRRKKWCVE

SEQ ID NO: 2821061 - protein, 32 aa, Entamoeba invadens
LAGKKAKFIIIYAVLGIALVGILVGVVMKFMP

SEQ ID NO: 2821062 - protein, 25 aa, Entamoeba invadens
LAGKVFCLLIDCLRYIYSVHEHCTL

SEQ ID NO: 2821063 - protein, 26 aa, Entamoeba invadens
LAGNLTISYGFLISSLLDEVIELADG

SEQ ID NO: 2821064 - protein, 25 aa, Entamoeba invadens
LAICISVFMLFRFINPIQKLRKEWY

SEQ ID NO: 2821065 - protein, 43 aa, Entamoeba invadens
LAIGLPVVFVIIIVIITALSIVGIYLLYLHNKEEKKMLNVCVF

SEQ ID NO: 2821066 - protein, 36 aa, Entamoeba invadens
LAIGLPVVFVIIIVTLIALSIVGIYLLFSHNKEEKK

SEQ ID NO: 2821067 - protein, 23 aa, Entamoeba invadens
LAIIAPICAFFAIVFGVYLFVVA

SEQ ID NO: 2821068 - protein, 18 aa, Entamoeba invadens
LAIIVGYYVIWNVTSALH

SEQ ID NO: 2821069 - protein, 24 aa, Entamoeba invadens
LAITILECFTWEDPFPKTIFCYAW

SEQ ID NO: 2821070 - protein, 38 aa, Entamoeba invadens
LAITMYECFGWCKAYNTPKFKFPWKIAEFVISGNRLEK

SEQ ID NO: 2821071 - protein, 19 aa, Entamoeba invadens
LAKKAVWTAVTLSFCESPT

SEQ ID NO: 2821072 - protein, 24 aa, Entamoeba invadens
LAKPDFIAAKYFTIITQCWCERTD

SEQ ID NO: 2821073 - protein, 27 aa, Entamoeba invadens
LAKTTTIRMLLSIKLILFGCSDDPVKV

SEQ ID NO: 2821074 - protein, 19 aa, Entamoeba invadens
LALFYAFFLTLTALCIYGF

SEQ ID NO: 2821075 - protein, 19 aa, Entamoeba invadens
LALITFLGVRSDPLNEFSG

SEQ ID NO: 2821076 - protein, 17 aa, Entamoeba invadens
LALMAYFQELQMTWYAA

SEQ ID NO: 2821077 - protein, 19 aa, Entamoeba invadens
LAMKKIIHHYGSVLVAIMA

SEQ ID NO: 2821078 - protein, 28 aa, Entamoeba invadens
LAMRHNRPYYYFTSYVVFVVFSIYNHIP

SEQ ID NO: 2821079 - protein, 25 aa, Entamoeba invadens
LANGILYLHTNGILHRDIKPDNVLV

SEQ ID NO: 2821080 - protein, 20 aa, Entamoeba invadens
LAQIEDCKYSYIFKSKCVEC

SEQ ID NO: 2821081 - protein, 34 aa, Entamoeba invadens
LARDAYFGTFIRQRIDWLNKQLPKPLQIKRFGVM

SEQ ID NO: 2821082 - protein, 17 aa, Entamoeba invadens
LARLLYFVIVTYSTSKV

SEQ ID NO: 2821083 - protein, 23 aa, Entamoeba invadens
LASILKTNLGPKGTLKMLVDGAG

SEQ ID NO: 2821084 - protein, 26 aa, Entamoeba invadens
LASVKPILSDYIKLNNFSSYGRIFTG

SEQ ID NO: 2821085 - protein, 28 aa, Entamoeba invadens
LATKLVLSPKFVSLIPNYLNLISQCFKP

SEQ ID NO: 2821086 - protein, 25 aa, Entamoeba invadens
LATYGGFMRTSFYEYFKFNLHYNEE

SEQ ID NO: 2821087 - protein, 29 aa, Entamoeba invadens
LAVAQMKLLFFNRGLMYFFMIVSIINHFI

SEQ ID NO: 2821088 - protein, 27 aa, Entamoeba invadens
LAVETPFKMRKDVFQKFLMMITKLNAT

SEQ ID NO: 2821089 - protein, 42 aa, Entamoeba invadens
LAVGFTAISIWVIFALPKLPGIWTVLFLASSCLWVSFWRKYK

SEQ ID NO: 2821090 - protein, 25 aa, Entamoeba invadens
LAVGVLNPLLMLLTGKMVDNFVQSG

SEQ ID NO: 2821091 - protein, 17 aa, Entamoeba invadens
LAVTLDAKLLDVCRGFL

SEQ ID NO: 2821092 - protein, 27 aa, Entamoeba invadens
LAYINFYVMILTILYLPIGFSETFGEE

SEQ ID NO: 2821093 - protein, 21 aa, Entamoeba invadens
LAYLAIMGFGLFVVSLRLSAV

SEQ ID NO: 2821094 - protein, 22 aa, Entamoeba invadens
LAYPLFIAGWVLSLSSFMRLGF

SEQ ID NO: 2821095 - protein, 23 aa, Entamoeba invadens
LAYYLAFIFILLARLLYFVIVTY

SEQ ID NO: 2821096 - protein, 44 aa, Entamoeba invadens
LCATHAVWWVILLVVLLTLVVVSILLFFVLKLVNYLIKEYQTHR

SEQ ID NO: 2821097 - protein, 23 aa, Entamoeba invadens
LCCYLVIRPLYAWLGLTQSTREK

SEQ ID NO: 2821098 - protein, 17 aa, Entamoeba invadens
LCDMCQAGYYLVDGICV

SEQ ID NO: 2821099 - protein, 17 aa, Entamoeba invadens
LCDNLHFLSDFKCISLD

SEQ ID NO: 2821100 - protein, 22 aa, Entamoeba invadens
LCEDGFALKDNLCNKCGKNCTL

SEQ ID NO: 2821101 - protein, 44 aa, Entamoeba invadens
LCERKAVWWVVVLLVIFVVLILSGIVVLIIFGTKKVLEEMHQKN

SEQ ID NO: 2821102 - protein, 27 aa, Entamoeba invadens
LCEVHLVIYVNNLLPEDLRFDLKTIKD

SEQ ID NO: 2821103 - protein, 19 aa, Entamoeba invadens
LCFSCEPFGYYFDSYNCIE

SEQ ID NO: 2821104 - protein, 18 aa, Entamoeba invadens
LCFSLVYLDSYKNLKTRW

SEQ ID NO: 2821105 - protein, 18 aa, Entamoeba invadens
LCFYCECSVVSESGWVLA

SEQ ID NO: 2821106 - protein, 30 aa, Entamoeba invadens
LCIGINFGMWYFKMIPSDPLFFFVVCVESM

SEQ ID NO: 2821107 - protein, 18 aa, Entamoeba invadens
LCIGYKGTSIMKVQMTTR

SEQ ID NO: 2821108 - protein, 20 aa, Entamoeba invadens
LCKNGYVWNTNKCESVLNCV

SEQ ID NO: 2821109 - protein, 17 aa, Entamoeba invadens
LCKVPESVYLTFTKDDG

SEQ ID NO: 2821110 - protein, 26 aa, Entamoeba invadens
LCLCVTLMFWVLFFKSPSNVLRIDGE

SEQ ID NO: 2821111 - protein, 19 aa, Entamoeba invadens
LCLECKWGSFLEDGKCVST

SEQ ID NO: 2821112 - protein, 20 aa, Entamoeba invadens
LCLEDYYLKDLQCLKCDEIL

SEQ ID NO: 2821113 - protein, 23 aa, Entamoeba invadens
LCLGCTDGIMWEGSCYSKHLINC

SEQ ID NO: 2821114 - protein, 19 aa, Entamoeba invadens
LCLRMLLFGLSEGVGYFIL

SEQ ID NO: 2821115 - protein, 17 aa, Entamoeba invadens
LCLSCQSGFYLGVNNTC

SEQ ID NO: 2821116 - protein, 18 aa, Entamoeba invadens
LCLTNIICPPGCPSTCIA

SEQ ID NO: 2821117 - protein, 19 aa, Entamoeba invadens
LCNENYLMYNKNRCVINEQ

SEQ ID NO: 2821118 - protein, 27 aa, Entamoeba invadens
LCNTLFYFCVLMIYQVIITQYLFGIVT

SEQ ID NO: 2821119 - protein, 20 aa, Entamoeba invadens
LCPEIVWTPSMKRLFCLIVE

SEQ ID NO: 2821120 - protein, 17 aa, Entamoeba invadens
LCQNGYYISNGICVLIC

SEQ ID NO: 2821121 - protein, 19 aa, Entamoeba invadens
LCRNIINFGIRCEECFPPF

SEQ ID NO: 2821122 - protein, 17 aa, Entamoeba invadens
LCSKCKIGFVFNSKNEC

SEQ ID NO: 2821123 - protein, 24 aa, Entamoeba invadens
LCSKCYAPYILDNNTSLCVLGYSN

SEQ ID NO: 2821124 - protein, 17 aa, Entamoeba invadens
LCTACNTMYYLVATNVT

SEQ ID NO: 2821125 - protein, 18 aa, Entamoeba invadens
LCTGFACEFEVFLTPHCT

SEQ ID NO: 2821126 - protein, 22 aa, Entamoeba invadens
LCTKCYAPYIIDNNTSLCVLAY

SEQ ID NO: 2821127 - protein, 17 aa, Entamoeba invadens
LCTPCNWGEAAVVGSYN

SEQ ID NO: 2821128 - protein, 17 aa, Entamoeba invadens
LCTSCDLGYMILNTKCE

SEQ ID NO: 2821129 - protein, 24 aa, Entamoeba invadens
LCVCYIFIILLFNFAGTAVIQYSN

SEQ ID NO: 2821130 - protein, 18 aa, Entamoeba invadens
LCVIPQEPVLFRGTLRKN

SEQ ID NO: 2821131 - protein, 18 aa, Entamoeba invadens
LCVIYALVFFFMIKPPTP

SEQ ID NO: 2821132 - protein, 52 aa, Entamoeba invadens
LCVKQNKYFLYIGIPVIIVCIVIIILTIIILTLFVLIFKKKEEKKMTNICVF

SEQ ID NO: 2821133 - protein, 29 aa, Entamoeba invadens
LCVLLVLHIYWFFLILQMIYKIVTQKGRI

SEQ ID NO: 2821134 - protein, 18 aa, Entamoeba invadens
LCYLTIVAPLLVTLALTF

SEQ ID NO: 2821135 - protein, 24 aa, Entamoeba invadens
LDAFTEIVVFFFQSFNPNYTFNQG

SEQ ID NO: 2821136 - protein, 21 aa, Entamoeba invadens
LDAVKGAPNFKFFIADITDAH

SEQ ID NO: 2821137 - protein, 20 aa, Entamoeba invadens
LDAYLFSSIQGRAIGCLASL

SEQ ID NO: 2821138 - protein, 20 aa, Entamoeba invadens
LDCLIMTLAFYYASSTRVPI

SEQ ID NO: 2821139 - protein, 28 aa, Entamoeba invadens
LDDDKFVALLFFVDFITSQVKVLSDWLQ

SEQ ID NO: 2821140 - protein, 17 aa, Entamoeba invadens
LDDTFVDLTWKALPTQV

SEQ ID NO: 2821141 - protein, 18 aa, Entamoeba invadens
LDDVLFGIFPFVDLVAFA

SEQ ID NO: 2821142 - protein, 24 aa, Entamoeba invadens
LDDVLPIKGLSDKALFNLSKYNST

SEQ ID NO: 2821143 - protein, 18 aa, Entamoeba invadens
LDECGINFYVAWKLDTSI

SEQ ID NO: 2821144 - protein, 20 aa, Entamoeba invadens
LDEINLIRPPIGAGTFGTVF

SEQ ID NO: 2821145 - protein, 23 aa, Entamoeba invadens
LDENIILIHNKKISIGLVGDGFI

SEQ ID NO: 2821146 - protein, 18 aa, Entamoeba invadens
LDEQIALVVLDMSAGKQF

SEQ ID NO: 2821147 - protein, 24 aa, Entamoeba invadens
LDESEWKFLLRNIYIFMSSVSSLH

SEQ ID NO: 2821148 - protein, 17 aa, Entamoeba invadens
LDFFIPRCVSCPEMCLS

SEQ ID NO: 2821149 - protein, 20 aa, Entamoeba invadens
LDFNPTVIHLLDDPNPTQST

SEQ ID NO: 2821150 - protein, 18 aa, Entamoeba invadens
LDGKKFIMTCSEDTFIEG

SEQ ID NO: 2821151 - protein, 24 aa, Entamoeba invadens
LDGMSLFIDLPFNPLIGNYEEIII

SEQ ID NO: 2821152 - protein, 18 aa, Entamoeba invadens
LDGVFGHWKYPECLSDIK

SEQ ID NO: 2821153 - protein, 18 aa, Entamoeba invadens
LDIQITKFIWRTKYNINK

SEQ ID NO: 2821154 - protein, 17 aa, Entamoeba invadens
LDKFHSIMYPDLIPPEK

SEQ ID NO: 2821155 - protein, 23 aa, Entamoeba invadens
LDKFRCDFIVHFFGAVFIPTKIC

SEQ ID NO: 2821156 - protein, 27 aa, Entamoeba invadens
LDKFRCDFIVHFFGAVFIPTKICMVTE

SEQ ID NO: 2821157 - protein, 28 aa, Entamoeba invadens
LDKFRCDYIIHFYGAVFIPNKVCMVTEF

SEQ ID NO: 2821158 - protein, 29 aa, Entamoeba invadens
LDKFRCDYIVHFYGAVFIPTNICMVTEFA

SEQ ID NO: 2821159 - protein, 39 aa, Entamoeba invadens
LDKFRCEYIIHFYGAVFIPNHLLMVTEFARFGSINDVMK

SEQ ID NO: 2821160 - protein, 30 aa, Entamoeba invadens
LDKFRCEYIVHFYGAVFIPTKFCMVTEFAE

SEQ ID NO: 2821161 - protein, 29 aa, Entamoeba invadens
LDKFRCEYIVYFYGAVFTPKKICLVTEFA

SEQ ID NO: 2821162 - protein, 28 aa, Entamoeba invadens
LDKFRCNYIVHFYGAVFIPNKVSMVTEF

SEQ ID NO: 2821163 - protein, 27 aa, Entamoeba invadens
LDKFRCNYIVHFYGAVFVPNKICMVTE

SEQ ID NO: 2821164 - protein, 27 aa, Entamoeba invadens
LDKFRNDFVIHFYGACYIPSHICMVTE

SEQ ID NO: 2821165 - protein, 28 aa, Entamoeba invadens
LDKFRNDFVIHFYGACYIPSHICMVTEF

SEQ ID NO: 2821166 - protein, 28 aa, Entamoeba invadens
LDKFRNDFVIHFYGACYIPSHICMVTEY

SEQ ID NO: 2821167 - protein, 26 aa, Entamoeba invadens
LDKFRNEYIIHFYGACFITNHICMVT

SEQ ID NO: 2821168 - protein, 29 aa, Entamoeba invadens
LDKFRNEYIVHFFGAVLIPNKICMVTKFA

SEQ ID NO: 2821169 - protein, 26 aa, Entamoeba invadens
LDKFRNEYIVHFFGTVLIPNKICMVT

SEQ ID NO: 2821170 - protein, 28 aa, Entamoeba invadens
LDKFRNEYIVHFYGAVFIPSHICMVSEF

SEQ ID NO: 2821171 - protein, 30 aa, Entamoeba invadens
LDKFRNNYIIHFYGAVFIPNKICLVTEFAN

SEQ ID NO: 2821172 - protein, 27 aa, Entamoeba invadens
LDKFRSDFIVHFYGAVFIPSKICMVTE

SEQ ID NO: 2821173 - protein, 26 aa, Entamoeba invadens
LDKFRSDFIVHFYGAVFIPSKVCMVT

SEQ ID NO: 2821174 - protein, 30 aa, Entamoeba invadens
LDKFRSDHIVHFYGAVFIPNKICMVTEFAQ

SEQ ID NO: 2821175 - protein, 28 aa, Entamoeba invadens
LDKFRSDYIIHFYGACYIPSHVCMVTEF

SEQ ID NO: 2821176 - protein, 28 aa, Entamoeba invadens
LDKFRSDYIIHFYGACYIPSHVCMVTEY

SEQ ID NO: 2821177 - protein, 27 aa, Entamoeba invadens
LDKFRSDYIIHFYGAVFDSSKICMVTE

SEQ ID NO: 2821178 - protein, 27 aa, Entamoeba invadens
LDKFRSDYIIHFYGAVFIESKVCMVTE

SEQ ID NO: 2821179 - protein, 29 aa, Entamoeba invadens
LDKFRSDYIIHFYGAVFIPNKICMVTEFA

SEQ ID NO: 2821180 - protein, 30 aa, Entamoeba invadens
LDKFRSDYIIHFYGAVFIPNKICMVTEFAK

SEQ ID NO: 2821181 - protein, 29 aa, Entamoeba invadens
LDKFRSDYIIHFYGAVFIPNKICMVTEYA

SEQ ID NO: 2821182 - protein, 27 aa, Entamoeba invadens
LDKFRSDYIIHFYGAVFIPNKVCMVTE

SEQ ID NO: 2821183 - protein, 29 aa, Entamoeba invadens
LDKFRSDYIIHFYGAVFIPTKTCLVTEFA

SEQ ID NO: 2821184 - protein, 28 aa, Entamoeba invadens
LDKFRSDYIINFFGAVFIPKKRCMVTEF

SEQ ID NO: 2821185 - protein, 32 aa, Entamoeba invadens
LDKFRSDYIVHFYGAVFIPNKICMVTQFAQYG

SEQ ID NO: 2821186 - protein, 30 aa, Entamoeba invadens
LDKFRSDYIVHFYGAVFIPNKVCLVTEFAE

SEQ ID NO: 2821187 - protein, 27 aa, Entamoeba invadens
LDKFRSDYIVHFYGAVFIPNKVCMVTE

SEQ ID NO: 2821188 - protein, 28 aa, Entamoeba invadens
LDKFRSDYIVHFYGAVFIPNKVCMVTEF

SEQ ID NO: 2821189 - protein, 29 aa, Entamoeba invadens
LDKFRSDYIVHFYGAVFIPNKVCMVTEFA

SEQ ID NO: 2821190 - protein, 32 aa, Entamoeba invadens
LDKFRSDYIVHFYGAVFIPTKICMVTEFAKYG

SEQ ID NO: 2821191 - protein, 30 aa, Entamoeba invadens
LDKFRSDYIVYFYGAVFIPNKICLVTEFAQ

SEQ ID NO: 2821192 - protein, 28 aa, Entamoeba invadens
LDKFRSDYIVYFYGAVFVPNKICMVTEF

SEQ ID NO: 2821193 - protein, 28 aa, Entamoeba invadens
LDKFRSDYLVHFYGAVFIPNKICMVTEF

SEQ ID NO: 2821194 - protein, 27 aa, Entamoeba invadens
LDKFRSDYLVHFYGAVMIPNKICMVNE

SEQ ID NO: 2821195 - protein, 27 aa, Entamoeba invadens
LDKFRSEFIVHFYGAVFIPNKVCMVTE

SEQ ID NO: 2821196 - protein, 30 aa, Entamoeba invadens
LDKFRSEFIVKFYGAVFVVSKICFVTEFAE

SEQ ID NO: 2821197 - protein, 30 aa, Entamoeba invadens
LDKFRSEFIVYFYGAVFIPNKICLVTEFAQ

SEQ ID NO: 2821198 - protein, 28 aa, Entamoeba invadens
LDKFRSEFIVYFYGAVFIPNKICMVTEF

SEQ ID NO: 2821199 - protein, 26 aa, Entamoeba invadens
LDKFRSEFIVYFYGAVFIPTKVCLVT

SEQ ID NO: 2821200 - protein, 30 aa, Entamoeba invadens
LDKFRSEYIIHFYGACFIPNHICMVTEFAL

SEQ ID NO: 2821201 - protein, 27 aa, Entamoeba invadens
LDKFRSEYIIHFYGAVFIASKVCMVTE

SEQ ID NO: 2821202 - protein, 31 aa, Entamoeba invadens
LDKFRSEYIIHFYGAVFIPNKICMVTEFAQY

SEQ ID NO: 2821203 - protein, 27 aa, Entamoeba invadens
LDKFRSEYIIHFYGAVFIPSKVCMVTE

SEQ ID NO: 2821204 - protein, 28 aa, Entamoeba invadens
LDKFRSEYIIHFYGAVFIPSKVCMVTEF

SEQ ID NO: 2821205 - protein, 28 aa, Entamoeba invadens
LDKFRSEYIVHFFGAVLIPNKICMVTEF

SEQ ID NO: 2821206 - protein, 32 aa, Entamoeba invadens
LDKFRSEYIVHFYGAVFILNKICMVTEFAQYG

SEQ ID NO: 2821207 - protein, 28 aa, Entamoeba invadens
LDKFRSEYIVHFYGAVFIPKKECMVTEF

SEQ ID NO: 2821208 - protein, 28 aa, Entamoeba invadens
LDKFRSEYIVHFYGAVFIPNKICMVTEF

SEQ ID NO: 2821209 - protein, 30 aa, Entamoeba invadens
LDKFRSEYIVHFYGAVFIPNKICMVTEFAQ

SEQ ID NO: 2821210 - protein, 32 aa, Entamoeba invadens
LDKFRSEYIVHFYGAVFIPNKICMVTEFAQYG

SEQ ID NO: 2821211 - protein, 29 aa, Entamoeba invadens
LDKFRSEYIVHFYGAVFIPNKICMVTQFA

SEQ ID NO: 2821212 - protein, 28 aa, Entamoeba invadens
LDKFRSEYIVHFYGAVFIPNKVCMVTEY

SEQ ID NO: 2821213 - protein, 29 aa, Entamoeba invadens
LDKFRSEYIVHFYGAVFIPSKVCMVTEFA

SEQ ID NO: 2821214 - protein, 29 aa, Entamoeba invadens
LDKFRSEYIVHFYGAVIIPNKICMVTQFA

SEQ ID NO: 2821215 - protein, 26 aa, Entamoeba invadens
LDKFRSEYIVYFYGAVCIPNKVCLVT

SEQ ID NO: 2821216 - protein, 26 aa, Entamoeba invadens
LDKFRSEYIVYFYGAVFDINKTCMVT

SEQ ID NO: 2821217 - protein, 30 aa, Entamoeba invadens
LDKFRSEYIVYFYGAVFIPNKICLVTEFAQ

SEQ ID NO: 2821218 - protein, 28 aa, Entamoeba invadens
LDKFRSEYIVYFYGAVFIPNKICMVTEF

SEQ ID NO: 2821219 - protein, 27 aa, Entamoeba invadens
LDKFRSEYIVYFYGAVFIPNKTCLVTE

SEQ ID NO: 2821220 - protein, 30 aa, Entamoeba invadens
LDKFRSEYIVYFYGAVFLPNNISLVTEYAT

SEQ ID NO: 2821221 - protein, 29 aa, Entamoeba invadens
LDKFRSEYIVYFYGAVFTPKKICLVTEFA

SEQ ID NO: 2821222 - protein, 29 aa, Entamoeba invadens
LDKIKWRDLLNIPVKWRQLSEPNDQVYWI

SEQ ID NO: 2821223 - protein, 33 aa, Entamoeba invadens
LDKIRSDYIVHFYGAVFIPKKICMVTEFAQFGS

SEQ ID NO: 2821224 - protein, 19 aa, Entamoeba invadens
LDKKYILRRQQVALKNAQA

SEQ ID NO: 2821225 - protein, 20 aa, Entamoeba invadens
LDKLRGPYIVSFVGACYLPT

SEQ ID NO: 2821226 - protein, 29 aa, Entamoeba invadens
LDKLRSEFIVYFYGAVFIPSKICLVTEFA

SEQ ID NO: 2821227 - protein, 35 aa, Entamoeba invadens
LDKLSNLIYCQRRIRLFVSYSKYSFRLLQLSRNHF

SEQ ID NO: 2821228 - protein, 28 aa, Entamoeba invadens
LDKPLKEWDLESFLPSFKEGFCKKLIPA

SEQ ID NO: 2821229 - protein, 19 aa, Entamoeba invadens
LDKYLQVFCFNKDFTFSSG

SEQ ID NO: 2821230 - protein, 21 aa, Entamoeba invadens
LDLEDWYITPLKNITQLRIDT

SEQ ID NO: 2821231 - protein, 25 aa, Entamoeba invadens
LDLFEPLRMIFFNKESLCTRQQNCD

SEQ ID NO: 2821232 - protein, 30 aa, Entamoeba invadens
LDLGDNTLFFYNYFRFSSANFTIKFGKNSS

SEQ ID NO: 2821233 - protein, 18 aa, Entamoeba invadens
LDLKYKNVIFLTTKFMQH

SEQ ID NO: 2821234 - protein, 21 aa, Entamoeba invadens
LDLVKTIWFKVIDMTINFLHW

SEQ ID NO: 2821235 - protein, 26 aa, Entamoeba invadens
LDMQQTVTFLSPYIIKTLQSSVDTTV

SEQ ID NO: 2821236 - protein, 26 aa, Entamoeba invadens
LDNFPNSPFLTKLIGKVLVGNRKWVV

SEQ ID NO: 2821237 - protein, 26 aa, Entamoeba invadens
LDNQNTLQYLFILARIGIVCCPIYDK

SEQ ID NO: 2821238 - protein, 23 aa, Entamoeba invadens
LDNSMIELYWEKRLRMLKDCASG

SEQ ID NO: 2821239 - protein, 18 aa, Entamoeba invadens
LDNSNKLTLKYLGTSQKL

SEQ ID NO: 2821240 - protein, 19 aa, Entamoeba invadens
LDNSYLYVNTILVAGTNCM

SEQ ID NO: 2821241 - protein, 21 aa, Entamoeba invadens
LDNTIYALLNRMWCFEGKERI

SEQ ID NO: 2821242 - protein, 17 aa, Entamoeba invadens
LDPTKFIDFFKFKTQNN

SEQ ID NO: 2821243 - protein, 27 aa, Entamoeba invadens
LDQCYFPKMFPVLIPSFSLVEYFTKSE

SEQ ID NO: 2821244 - protein, 18 aa, Entamoeba invadens
LDQCYIKETTRNCFKYYD

SEQ ID NO: 2821245 - protein, 25 aa, Entamoeba invadens
LDQYAITYLMRLLQQSLMSFSVKEM

SEQ ID NO: 2821246 - protein, 24 aa, Entamoeba invadens
LDSHLCYKCRDNCTLCSSNDLCYN

SEQ ID NO: 2821247 - protein, 31 aa, Entamoeba invadens
LDSIYSLKDSFILPTPRLLRYCKDINKLDTT

SEQ ID NO: 2821248 - protein, 23 aa, Entamoeba invadens
LDSQNILLDGVLLIMSCITTSLY

SEQ ID NO: 2821249 - protein, 28 aa, Entamoeba invadens
LDSRITIFLRVIVPLLIFINMSIFIISN

SEQ ID NO: 2821250 - protein, 28 aa, Entamoeba invadens
LDSYVMVLMIVAFYFNIPLPIRHGDNVE

SEQ ID NO: 2821251 - protein, 33 aa, Entamoeba invadens
LDTDAFSILFLCNLIFEFVIPTLFISTNNEAKH

SEQ ID NO: 2821252 - protein, 23 aa, Entamoeba invadens
LDTLPLMFAVIYGELLVSLSYSL

SEQ ID NO: 2821253 - protein, 26 aa, Entamoeba invadens
LDTVQYLPSFDAFGLDIYPINESTVY

SEQ ID NO: 2821254 - protein, 20 aa, Entamoeba invadens
LDTYNFVYGFAQSDEFMAEA

SEQ ID NO: 2821255 - protein, 23 aa, Entamoeba invadens
LDVPLDILLKRTERVECISVAPK

SEQ ID NO: 2821256 - protein, 31 aa, Entamoeba invadens
LDVYDIYMMQCFVLCFLFVIKNLKTQTLRSY

SEQ ID NO: 2821257 - protein, 22 aa, Entamoeba invadens
LDWLGIFVSMCTLIVIVVLKIQ

SEQ ID NO: 2821258 - protein, 22 aa, Entamoeba invadens
LDYREIITERILGEGSFGVVYK

SEQ ID NO: 2821259 - protein, 21 aa, Entamoeba invadens
LEAALYFMYTTAINPDFIKTE

SEQ ID NO: 2821260 - protein, 27 aa, Entamoeba invadens
LEAGLVIFFVLVPLVRMFIPVSSAQFN

SEQ ID NO: 2821261 - protein, 52 aa, Entamoeba invadens
LECAKIFNYGLVIILPIVSAVAILFFIILLITIVLIIFNKKKEKTLTENICI

SEQ ID NO: 2821262 - protein, 24 aa, Entamoeba invadens
LECCKLGEKCSPHYQWSLSNNQVE

SEQ ID NO: 2821263 - protein, 22 aa, Entamoeba invadens
LECFPCISSCSLCQSKSICYTC

SEQ ID NO: 2821264 - protein, 34 aa, Entamoeba invadens
LECLTWKDPFDEKLFPYSWDITNLISSGKRPQIE

SEQ ID NO: 2821265 - protein, 21 aa, Entamoeba invadens
LEDEILLISLDLKSGQKVMTP

SEQ ID NO: 2821266 - protein, 34 aa, Entamoeba invadens
LEDMDIYHFVYESGYWFALLNVVFLAGVAIMTIL

SEQ ID NO: 2821267 - protein, 33 aa, Entamoeba invadens
LEDTHDMYIIFKLNVIFYVQMVFNSSTTYFVVK

SEQ ID NO: 2821268 - protein, 18 aa, Entamoeba invadens
LEEGLMKCVDKCGPGFFK

SEQ ID NO: 2821269 - protein, 17 aa, Entamoeba invadens
LEEGTGVPIFIFNTSLD

SEQ ID NO: 2821270 - protein, 33 aa, Entamoeba invadens
LEEIEQMLHFTYPLYMNSLIQSFRQLFSIGNIH

SEQ ID NO: 2821271 - protein, 26 aa, Entamoeba invadens
LEEYKKIQFLPLIDSAIENFKIQKYP

SEQ ID NO: 2821272 - protein, 18 aa, Entamoeba invadens
LEEYYLKDLKCLKCDEIL

SEQ ID NO: 2821273 - protein, 17 aa, Entamoeba invadens
LEEYYLKDLQCLKCDEI

SEQ ID NO: 2821274 - protein, 23 aa, Entamoeba invadens
LEFFLGGLFILILVHLVLAIRST

SEQ ID NO: 2821275 - protein, 22 aa, Entamoeba invadens
LEGCLLCEESYYLQNGRCINCK

SEQ ID NO: 2821276 - protein, 26 aa, Entamoeba invadens
LEGIVQLLHILIYYHNPVLAQHITEM

SEQ ID NO: 2821277 - protein, 36 aa, Entamoeba invadens
LEGSFQQIFLLVFSVVTVSLLFFLRSTQTLASAFSV

SEQ ID NO: 2821278 - protein, 19 aa, Entamoeba invadens
LEHGFFVFTQGTLKMKVFM

SEQ ID NO: 2821279 - protein, 31 aa, Entamoeba invadens
  misc_feature (29)..(30): Xaa can be any naturally occurring amino acid
LEIFATVCFGLGIALYFDWKLALCVIAKXXM

SEQ ID NO: 2821280 - protein, 19 aa, Entamoeba invadens
LEIIREIFMFLVSSLNSTN

SEQ ID NO: 2821281 - protein, 18 aa, Entamoeba invadens
LEKEVWKGLKVSGLRTGK

SEQ ID NO: 2821282 - protein, 29 aa, Entamoeba invadens
LEKFKSEYIVYFYGAVFIPNKICMVTELA

SEQ ID NO: 2821283 - protein, 27 aa, Entamoeba invadens
LEKFRSEFIVYFYGAVFIPNKICMVTE

SEQ ID NO: 2821284 - protein, 22 aa, Entamoeba invadens
LEKVPYVLERFSNVLKIPAATN

SEQ ID NO: 2821285 - protein, 18 aa, Entamoeba invadens
LELKPSYKFTINANTTNF

SEQ ID NO: 2821286 - protein, 30 aa, Entamoeba invadens
LELKSLKYFIYVQLFYTTFFKLVGFICILI

SEQ ID NO: 2821287 - protein, 17 aa, Entamoeba invadens
LELLEKLLALNPRKRIT

SEQ ID NO: 2821288 - protein, 19 aa, Entamoeba invadens
LELLYCALTPKLLTNSMIP

SEQ ID NO: 2821289 - protein, 25 aa, Entamoeba invadens
LELVGQIIIFLYLKNSDASLLILIF

SEQ ID NO: 2821290 - protein, 24 aa, Entamoeba invadens
LEMDHFFDIILSKIGKVLLDGKVT

SEQ ID NO: 2821291 - protein, 19 aa, Entamoeba invadens
LEMIIKYNQTLLNALLSFK

SEQ ID NO: 2821292 - protein, 25 aa, Entamoeba invadens
LENCINFDYLLNFSDAFLAAKMMLV

SEQ ID NO: 2821293 - protein, 25 aa, Entamoeba invadens
LENDVDWYITPLYNVTSMLIENTTK

SEQ ID NO: 2821294 - protein, 31 aa, Entamoeba invadens
LENINNWMFIFFLFLFSYALSTETPETRRIE

SEQ ID NO: 2821295 - protein, 23 aa, Entamoeba invadens
LENKKFYQLLLIGGGSIHYMENY

SEQ ID NO: 2821296 - protein, 19 aa, Entamoeba invadens
LENLNLYEPLTTLSDTLPN

SEQ ID NO: 2821297 - protein, 17 aa, Entamoeba invadens
LENLYPQCTKITLVSTY

SEQ ID NO: 2821298 - protein, 30 aa, Entamoeba invadens
LENPRKGIFKWGFFLAFFEAVNNVVYGTID

SEQ ID NO: 2821299 - protein, 28 aa, Entamoeba invadens
LENPVYIFYILLVFVFIAGVAALISSAE

SEQ ID NO: 2821300 - protein, 32 aa, Entamoeba invadens
LENRVFSFTLGFANIFYIPMAITESFIGESDI

SEQ ID NO: 2821301 - protein, 51 aa, Entamoeba invadens
LENSICVQKSLWWISLIVLGGVVLLVIILYFTITYILRKAIRLKQENTMNL

SEQ ID NO: 2821302 - protein, 32 aa, Entamoeba invadens
LENVFYLLLEMKICVTIFVGFGAWAMITLAIL

SEQ ID NO: 2821303 - protein, 24 aa, Entamoeba invadens
LEPKNIWSIVFFVLVIVAHLVIKE

SEQ ID NO: 2821304 - protein, 20 aa, Entamoeba invadens
LEPLQWIRKFAEEQTFLKTP

SEQ ID NO: 2821305 - protein, 19 aa, Entamoeba invadens
LEPPVFVEYLLIDSKGKPP

SEQ ID NO: 2821306 - protein, 17 aa, Entamoeba invadens
LEPVYLMSIVPCLGSLS

SEQ ID NO: 2821307 - protein, 27 aa, Entamoeba invadens
LEQSKDYYFFFSYHPSFKTINFNIKVV

SEQ ID NO: 2821308 - protein, 17 aa, Entamoeba invadens
LEQVTLKCVSECKTLGY

SEQ ID NO: 2821309 - protein, 22 aa, Entamoeba invadens
LERCFYGLMPYTTYFDYYSHSQ

SEQ ID NO: 2821310 - protein, 38 aa, Entamoeba invadens
LERQWSMMLYFMTLLVSLIIWFMLEGIFGMVSFGLTAS

SEQ ID NO: 2821311 - protein, 23 aa, Entamoeba invadens
LERTYHLKKKLVAKIVVLSIILV

SEQ ID NO: 2821312 - protein, 21 aa, Entamoeba invadens
LESFYLMDGICFPCSLKDSCG

SEQ ID NO: 2821313 - protein, 27 aa, Entamoeba invadens
LETEAIITIFLLIISFFKVIASQEYIG

SEQ ID NO: 2821314 - protein, 57 aa, Entamoeba invadens
LETITFILGEYFFNSLWMILCLLPPPQAFIEQFKDRKLFKTLPVGNLILHYVNWMTN

SEQ ID NO: 2821315 - protein, 19 aa, Entamoeba invadens
LETITWEHAFPKEEFKYPW

SEQ ID NO: 2821316 - protein, 17 aa, Entamoeba invadens
LETLIDEYIPKLLTFSG

SEQ ID NO: 2821317 - protein, 31 aa, Entamoeba invadens
LETLQSLFLFALFLYYIILLICMSFKYIPHR

SEQ ID NO: 2821318 - protein, 25 aa, Entamoeba invadens
LETQTMLWGDIYEANKCLDFAPTTS

SEQ ID NO: 2821319 - protein, 22 aa, Entamoeba invadens
LETSHLWALKTLKEVYLVPMSK

SEQ ID NO: 2821320 - protein, 17 aa, Entamoeba invadens
LEVGIFPNYGMVWVWTI

SEQ ID NO: 2821321 - protein, 22 aa, Entamoeba invadens
LEWCMYTSFIYCILGLIGCAAI

SEQ ID NO: 2821322 - protein, 26 aa, Entamoeba invadens
LEYPISTLCGLLKAFLMEMSPRFITE

SEQ ID NO: 2821323 - protein, 19 aa, Entamoeba invadens
LFAFSVFSSVFLCFLVPTF

SEQ ID NO: 2821324 - protein, 31 aa, Entamoeba invadens
LFCEHRVTLLVFYIHPIYSSNLTLRFDNTHN

SEQ ID NO: 2821325 - protein, 17 aa, Entamoeba invadens
LFCGIFEEFLRNSAEDE

SEQ ID NO: 2821326 - protein, 41 aa, Entamoeba invadens
LFCRMKDVLILNRYIPWITLSRIFFLSLMTLYPSKNYFSVK

SEQ ID NO: 2821327 - protein, 19 aa, Entamoeba invadens
LFCSKGYHLQTNGTCSLIN

SEQ ID NO: 2821328 - protein, 22 aa, Entamoeba invadens
LFCTSHILGMKIHYTVYISDNI

SEQ ID NO: 2821329 - protein, 31 aa, Entamoeba invadens
LFCVSSPVWWVIVLVIIFGVLVIVMIVLTLI

SEQ ID NO: 2821330 - protein, 28 aa, Entamoeba invadens
LFDGLFLFFELFLTQFALTTIHPLLFVA

SEQ ID NO: 2821331 - protein, 18 aa, Entamoeba invadens
LFEISYIFDEIGNLIFDS

SEQ ID NO: 2821332 - protein, 20 aa, Entamoeba invadens
LFEMVARIVRLMILFGKDTI

SEQ ID NO: 2821333 - protein, 20 aa, Entamoeba invadens
LFENPNTFPLLLAISTTRNG

SEQ ID NO: 2821334 - protein, 23 aa, Entamoeba invadens
LFFALYIFFYMKRTHFKSKNLVC

SEQ ID NO: 2821335 - protein, 17 aa, Entamoeba invadens
LFFATISKTLFTIDQAI

SEQ ID NO: 2821336 - protein, 17 aa, Entamoeba invadens
LFFFLSTLFIMTIPFSV

SEQ ID NO: 2821337 - protein, 17 aa, Entamoeba invadens
LFFHGTAAPATLPNDLN

SEQ ID NO: 2821338 - protein, 17 aa, Entamoeba invadens
LFFHGTVQPTTLSDSTT

SEQ ID NO: 2821339 - protein, 18 aa, Entamoeba invadens
LFFHVILSLVKSGVVLKT

SEQ ID NO: 2821340 - protein, 17 aa, Entamoeba invadens
LFFIMFLSSFLVSGVLG

SEQ ID NO: 2821341 - protein, 20 aa, Entamoeba invadens
LFFIVCLGQGLYYYLSRRNI

SEQ ID NO: 2821342 - protein, 20 aa, Entamoeba invadens
LFFIVSTVNSADCFTKDGSG

SEQ ID NO: 2821343 - protein, 18 aa, Entamoeba invadens
LFFIVSTVNSADCFTKDN

SEQ ID NO: 2821344 - protein, 19 aa, Entamoeba invadens
LFFQHIYYGAIMLKKKMCY

SEQ ID NO: 2821345 - protein, 17 aa, Entamoeba invadens
LFGFSIRDNITLGAKED

SEQ ID NO: 2821346 - protein, 18 aa, Entamoeba invadens
LFGIVLKCPLLVLSFCIF

SEQ ID NO: 2821347 - protein, 23 aa, Entamoeba invadens
LFGTLILLVVFNKALPALPISIF

SEQ ID NO: 2821348 - protein, 21 aa, Entamoeba invadens
LFGVYFSFLTGFLFDHYGTRG

SEQ ID NO: 2821349 - protein, 19 aa, Entamoeba invadens
LFHPSFMLSADYFSKKQTD

SEQ ID NO: 2821350 - protein, 34 aa, Entamoeba invadens
LFIHFLNSNVIEVFIFSLKILFILCGESEQVISI

SEQ ID NO: 2821351 - protein, 18 aa, Entamoeba invadens
LFILCVVFSFLLMDIATE

SEQ ID NO: 2821352 - protein, 17 aa, Entamoeba invadens
LFIPVAIPPNKVFRVST

SEQ ID NO: 2821353 - protein, 19 aa, Entamoeba invadens
LFISFFHAEKTFGNIACDY

SEQ ID NO: 2821354 - protein, 18 aa, Entamoeba invadens
LFISITRTKDLFSLKNDN

SEQ ID NO: 2821355 - protein, 17 aa, Entamoeba invadens
LFIYLSASQNHCVKLLS

SEQ ID NO: 2821356 - protein, 19 aa, Entamoeba invadens
LFKDSPFNLIVSPGGMTAD

SEQ ID NO: 2821357 - protein, 18 aa, Entamoeba invadens
LFKKYIGRPFQKVYFWDD

SEQ ID NO: 2821358 - protein, 25 aa, Entamoeba invadens
LFKLKPVWILTIFQFSLCVLMCVQG

SEQ ID NO: 2821359 - protein, 25 aa, Entamoeba invadens
LFKMYEGMGFLYASLKNIRNTETSY

SEQ ID NO: 2821360 - protein, 19 aa, Entamoeba invadens
LFKTVYYFIVTPIGFYLFR

SEQ ID NO: 2821361 - protein, 17 aa, Entamoeba invadens
LFKYYVELYKNVPKCLF

SEQ ID NO: 2821362 - protein, 19 aa, Entamoeba invadens
LFLALDAIDSITPCFDWIS

SEQ ID NO: 2821363 - protein, 23 aa, Entamoeba invadens
LFLDPNVFILLAFSDDCQVLDDL

SEQ ID NO: 2821364 - protein, 21 aa, Entamoeba invadens
LFLFFIFSISKGSECPDSFTG

SEQ ID NO: 2821365 - protein, 21 aa, Entamoeba invadens
LFLFIIGVTKTFGVIDCGKGQ

SEQ ID NO: 2821366 - protein, 20 aa, Entamoeba invadens
LFLLCCYFILVWFGLNQSYW

SEQ ID NO: 2821367 - protein, 27 aa, Entamoeba invadens
LFLLNFFLTFFTFKFALLPFSMIASIV

SEQ ID NO: 2821368 - protein, 17 aa, Entamoeba invadens
LFLSAMVEPFFSVESMP

SEQ ID NO: 2821369 - protein, 18 aa, Entamoeba invadens
LFLTIAPLTFNPLAASFV

SEQ ID NO: 2821370 - protein, 20 aa, Entamoeba invadens
LFLVVVFTWASPTKLETETF

SEQ ID NO: 2821371 - protein, 20 aa, Entamoeba invadens
LFMFINLSLTINNCNYDECA

SEQ ID NO: 2821372 - protein, 21 aa, Entamoeba invadens
LFMFINLSLTLNNCKYDECAR

SEQ ID NO: 2821373 - protein, 19 aa, Entamoeba invadens
LFMGVVPWLVDIFQGHIRP

SEQ ID NO: 2821374 - protein, 18 aa, Entamoeba invadens
LFMLFQSLGNQIGDEIVF

SEQ ID NO: 2821375 - protein, 23 aa, Entamoeba invadens
LFMLFTLVYSFQCSPGCPDGCIT

SEQ ID NO: 2821376 - protein, 23 aa, Entamoeba invadens
LFNKKVLFYCHHPDKLLVKKGGF

SEQ ID NO: 2821377 - protein, 23 aa, Entamoeba invadens
LFNKMCVLCDINCALNSCIDNIG

SEQ ID NO: 2821378 - protein, 17 aa, Entamoeba invadens
LFNLTFPCVIFKALANT

SEQ ID NO: 2821379 - protein, 20 aa, Entamoeba invadens
LFNVGIGFMLIFFIGTFAHF

SEQ ID NO: 2821380 - protein, 18 aa, Entamoeba invadens
LFNYKYKDTYWSALAYVD

SEQ ID NO: 2821381 - protein, 19 aa, Entamoeba invadens
LFQLLISSTKGDMVCIPIG

SEQ ID NO: 2821382 - protein, 29 aa, Entamoeba invadens
LFSDIDQYFYIWIYWEGNELPVQLFIDGY

SEQ ID NO: 2821383 - protein, 37 aa, Entamoeba invadens
LFSESYYIILLIYGFFLSVILLYRYFLFSVEYFSKTL

SEQ ID NO: 2821384 - protein, 18 aa, Entamoeba invadens
LFSFYRYANKINMKVKTA

SEQ ID NO: 2821385 - protein, 17 aa, Entamoeba invadens
LFSLVRNGTLNPKKFRK

SEQ ID NO: 2821386 - protein, 20 aa, Entamoeba invadens
LFSNTSFYWALNLVISPESR

SEQ ID NO: 2821387 - protein, 19 aa, Entamoeba invadens
LFSTDQILRLCPTNHIDTS

SEQ ID NO: 2821388 - protein, 34 aa, Entamoeba invadens
LFSTRRNFLIKYGLIVLILIAMFLVILGMFLESF

SEQ ID NO: 2821389 - protein, 67 aa, Entamoeba invadens
LFSVTIYFLSFFFLKSYFDLHFVFSWQFWWKLFVIVVLTSIPFIAKFIYQIIFPPKSLTVENRRWPV

SEQ ID NO: 2821390 - protein, 29 aa, Entamoeba invadens
LFTFEEIHLLYFFIQTRFNDSRITLERGG

SEQ ID NO: 2821391 - protein, 19 aa, Entamoeba invadens
LFTILTRGMWYINYSFTYA

SEQ ID NO: 2821392 - protein, 17 aa, Entamoeba invadens
LFTIYFIQTKEINYFCI

SEQ ID NO: 2821393 - protein, 18 aa, Entamoeba invadens
LFTLAFFLVAITAGYLFA

SEQ ID NO: 2821394 - protein, 17 aa, Entamoeba invadens
LFTLNLKDFIKRRKKEK

SEQ ID NO: 2821395 - protein, 26 aa, Entamoeba invadens
LFTNLEGKRLIRVCTIAVPVTQIQSE

SEQ ID NO: 2821396 - protein, 27 aa, Entamoeba invadens
LFVGFEEWFKLFGLGEKHLAFLAYGYI

SEQ ID NO: 2821397 - protein, 32 aa, Entamoeba invadens
LFVGVWVGMFLLILFVFYPALPPKVTPQTEVP

SEQ ID NO: 2821398 - protein, 18 aa, Entamoeba invadens
LFVHKGWTQLTCTPGNHL

SEQ ID NO: 2821399 - protein, 17 aa, Entamoeba invadens
LFVIFIVVYFVFFILRH

SEQ ID NO: 2821400 - protein, 25 aa, Entamoeba invadens
LFVIGTAMVVYPFALLMEQVSVNCP

SEQ ID NO: 2821401 - protein, 17 aa, Entamoeba invadens
LFVLKTQSYECDCQPIG

SEQ ID NO: 2821402 - protein, 18 aa, Entamoeba invadens
LFVNALSLKWCKYNDNIK

SEQ ID NO: 2821403 - protein, 22 aa, Entamoeba invadens
LFVPTLVFFLFGLDVTAEFSKT

SEQ ID NO: 2821404 - protein, 19 aa, Entamoeba invadens
LFVSLFLICFLENYTFFKT

SEQ ID NO: 2821405 - protein, 17 aa, Entamoeba invadens
LFVTAFFELVESQDQNH

SEQ ID NO: 2821406 - protein, 25 aa, Entamoeba invadens
LFVTIYIMLFCLIFFKKIGSSLVPA

SEQ ID NO: 2821407 - protein, 20 aa, Entamoeba invadens
LFVTLFYFFPTILPKRLGGA

SEQ ID NO: 2821408 - protein, 43 aa, Entamoeba invadens
LFVVDTSYIYLFEPLENKYFLIKSPVIPILDTIHLYKLSEANS

SEQ ID NO: 2821409 - protein, 19 aa, Entamoeba invadens
LFVVFFAHSQMVLTYCEVN

SEQ ID NO: 2821410 - protein, 18 aa, Entamoeba invadens
LFVVFVAHSQMVLTYCEV

SEQ ID NO: 2821411 - protein, 19 aa, Entamoeba invadens
LFVVLLYAIIVIGSLVFSV

SEQ ID NO: 2821412 - protein, 17 aa, Entamoeba invadens
LFVYKVSSFECDCYPVK

SEQ ID NO: 2821413 - protein, 17 aa, Entamoeba invadens
LFWVGERSQWEDIGACG

SEQ ID NO: 2821414 - protein, 20 aa, Entamoeba invadens
LFYEVSLIKKFDFFREMIES

SEQ ID NO: 2821415 - protein, 20 aa, Entamoeba invadens
LFYLYTLISFLNFAAIFNVK

SEQ ID NO: 2821416 - protein, 20 aa, Entamoeba invadens
LFYTDTYLCFVKNDAFLFCF

SEQ ID NO: 2821417 - protein, 27 aa, Entamoeba invadens
LFYVTIGLLFFISLLTIFHALCYIIVD

SEQ ID NO: 2821418 - protein, 44 aa, Entamoeba invadens
LGAAVGIPISILLVMIIIVLLIVITLIVIFKRNQKKEELKVCTY

SEQ ID NO: 2821419 - protein, 25 aa, Entamoeba invadens
LGAIPCLLTLYFRFSLDFPNKAHTT

SEQ ID NO: 2821420 - protein, 28 aa, Entamoeba invadens
LGAKFLLLGLMLPLLFSFPTTLQMNKCS

SEQ ID NO: 2821421 - protein, 26 aa, Entamoeba invadens
LGALAWYYPIPWPQSYWHIFAIIVIY

SEQ ID NO: 2821422 - protein, 22 aa, Entamoeba invadens
LGALSCYLILSKIAIATNCKSG

SEQ ID NO: 2821423 - protein, 19 aa, Entamoeba invadens
LGALTNGIFLLSVGLFIFL

SEQ ID NO: 2821424 - protein, 27 aa, Entamoeba invadens
LGCEDGLMHLLNYVWPNIFETSPHVIN

SEQ ID NO: 2821425 - protein, 22 aa, Entamoeba invadens
LGCGGSMWIICPTGVKRSNYVC

SEQ ID NO: 2821426 - protein, 21 aa, Entamoeba invadens
LGEGSFGIVFKGTYRRNVVAI

SEQ ID NO: 2821427 - protein, 23 aa, Entamoeba invadens
LGEGSFGIVYKGSYRKNVVAIKK

SEQ ID NO: 2821428 - protein, 18 aa, Entamoeba invadens
LGEIITTCLAMMPNYDGC

SEQ ID NO: 2821429 - protein, 18 aa, Entamoeba invadens
LGEILRSIKFIKYNAWEK

SEQ ID NO: 2821430 - protein, 27 aa, Entamoeba invadens
LGFIVIVMLIYINYIQRKMPSSVPGTP

SEQ ID NO: 2821431 - protein, 18 aa, Entamoeba invadens
LGFRIEIYRNGNIPMFGP

SEQ ID NO: 2821432 - protein, 28 aa, Entamoeba invadens
LGGIATLPKYFLFGCNELVTLTGIESLI

SEQ ID NO: 2821433 - protein, 19 aa, Entamoeba invadens
LGIGFVFIAVVVVVLYLIF

SEQ ID NO: 2821434 - protein, 27 aa, Entamoeba invadens
LGIGMGFVMFTIFCSITLGLFYGTVVL

SEQ ID NO: 2821435 - protein, 17 aa, Entamoeba invadens
LGIKICVTIFVGFAVWA

SEQ ID NO: 2821436 - protein, 17 aa, Entamoeba invadens
LGILIPKDFFIMVAIHF

SEQ ID NO: 2821437 - protein, 29 aa, Entamoeba invadens
LGIMILLVIYLFWLVFSIIRSFSEVRKLG

SEQ ID NO: 2821438 - protein, 33 aa, Entamoeba invadens
LGIPPLLLFFYFTFYFFVIKYFALTYSTLTMTL

SEQ ID NO: 2821439 - protein, 24 aa, Entamoeba invadens
LGKEAFSFTLLKTVELPNSVEVFE

SEQ ID NO: 2821440 - protein, 25 aa, Entamoeba invadens
LGKFGVLLGIFVPTLLLAQPLANTM

SEQ ID NO: 2821441 - protein, 32 aa, Entamoeba invadens
LGKMFCSCYIIFFFVIFPIYITRLVSTALKGD

SEQ ID NO: 2821442 - protein, 23 aa, Entamoeba invadens
LGKNMVFSFQHFVVRSQASLIAK

SEQ ID NO: 2821443 - protein, 29 aa, Entamoeba invadens
LGLFIGVFGFLSVGLFVGGSVLAPKRLGC

SEQ ID NO: 2821444 - protein, 27 aa, Entamoeba invadens
LGLHKRLIHKLLKCKLGFFDVTPMGRI

SEQ ID NO: 2821445 - protein, 22 aa, Entamoeba invadens
LGLIFCAIAIGFLFVRKREMKK

SEQ ID NO: 2821446 - protein, 21 aa, Entamoeba invadens
LGLNLPFSCDANFSKMAKGKI

SEQ ID NO: 2821447 - protein, 26 aa, Entamoeba invadens
LGMACGGIVFLVLTIYYMVSQLNHDP

SEQ ID NO: 2821448 - protein, 25 aa, Entamoeba invadens
LGNFIVVLLSVYWRKIVKKCMDMYL

SEQ ID NO: 2821449 - protein, 17 aa, Entamoeba invadens
LGNIICFSGIKITQFLS

SEQ ID NO: 2821450 - protein, 25 aa, Entamoeba invadens
LGNIMNVVYLILFADAFSKYCNTYE

SEQ ID NO: 2821451 - protein, 30 aa, Entamoeba invadens
LGNSYHNWPCWQVRYTVGLYYGFKIEAGKS

SEQ ID NO: 2821452 - protein, 29 aa, Entamoeba invadens
LGNTAYPIVLFFIIKFLNLVLKCTKHHKT

SEQ ID NO: 2821453 - protein, 24 aa, Entamoeba invadens
LGQNVLLDLTYFASIDMIEATSSF

SEQ ID NO: 2821454 - protein, 24 aa, Entamoeba invadens
LGRLAMLLFFLELSASFMFIILSS

SEQ ID NO: 2821455 - protein, 21 aa, Entamoeba invadens
LGRMTIWQYKLYLNMISFVVL

SEQ ID NO: 2821456 - protein, 20 aa, Entamoeba invadens
LGRQHLFDYIPQVTKKIDAT

SEQ ID NO: 2821457 - protein, 17 aa, Entamoeba invadens
LGSCIIALICERSVETC

SEQ ID NO: 2821458 - protein, 26 aa, Entamoeba invadens
LGSLIDLDRLLFKKVTKKIFEFSLKS

SEQ ID NO: 2821459 - protein, 20 aa, Entamoeba invadens
LGSPTVFCALFLLGGSLANG

SEQ ID NO: 2821460 - protein, 21 aa, Entamoeba invadens
LGTFLPLFQKVLDANLYKLDA

SEQ ID NO: 2821461 - protein, 24 aa, Entamoeba invadens
LGTFYVNFLLDNPDKFIPPLLRST

SEQ ID NO: 2821462 - protein, 25 aa, Entamoeba invadens
LGTLLIPLVIQFLIKWVQSTTFEIY

SEQ ID NO: 2821463 - protein, 24 aa, Entamoeba invadens
LGTMFYGILVLFPVVLHYGIFSLV

SEQ ID NO: 2821464 - protein, 24 aa, Entamoeba invadens
LGTPKALYFPIQSQGYFSHPVCMN

SEQ ID NO: 2821465 - protein, 18 aa, Entamoeba invadens
LGVFQLIQCDFSMLTGFG

SEQ ID NO: 2821466 - protein, 31 aa, Entamoeba invadens
LGVIIVIILFIIFVLSILVIALVFSMKRISK

SEQ ID NO: 2821467 - protein, 25 aa, Entamoeba invadens
LGVLFIIAVILIGILLTLFILSHRK

SEQ ID NO: 2821468 - protein, 25 aa, Entamoeba invadens
LGVLLIDGDWKYYLDPSLSLVVACV

SEQ ID NO: 2821469 - protein, 36 aa, Entamoeba invadens
LGVTMYEALVWGEVYPKNIFKFAWSIADFVTSGKRR

SEQ ID NO: 2821470 - protein, 45 aa, Entamoeba invadens
LGVVIGIPITVLILFVLFITMNILLIIIFLNKRQVEKMKNVRVFD

SEQ ID NO: 2821471 - protein, 35 aa, Entamoeba invadens
LGVVIGIPITVLILLVIFILLNKRQVKKKMQNVRE

SEQ ID NO: 2821472 - protein, 45 aa, Entamoeba invadens
LGVVIGIPITVLILLVIFMTMIILLLIILFNKRQVKKKMQNVCVF

SEQ ID NO: 2821473 - protein, 21 aa, Entamoeba invadens
LGYFSRLGFEPKLRKLREGLT

SEQ ID NO: 2821474 - protein, 29 aa, Entamoeba invadens
LGYPSYFQLSRYFSLLEFRFISDCAVTFE

SEQ ID NO: 2821475 - protein, 25 aa, Entamoeba invadens
LHAQLLVYKPGCGLFLDKLLEELLE

SEQ ID NO: 2821476 - protein, 17 aa, Entamoeba invadens
LHDAVLLNIERGSSSLT

SEQ ID NO: 2821477 - protein, 32 aa, Entamoeba invadens
LHDENVTLMALPRYPLMSGWKTEFMIGHDIAA

SEQ ID NO: 2821478 - protein, 20 aa, Entamoeba invadens
LHEFKLLHLNLKLSNVLMNT

SEQ ID NO: 2821479 - protein, 18 aa, Entamoeba invadens
LHENDILHRDIKPDNYLI

SEQ ID NO: 2821480 - protein, 19 aa, Entamoeba invadens
LHENGILHRDIKPDNFLIL

SEQ ID NO: 2821481 - protein, 18 aa, Entamoeba invadens
LHENGILHRDIKPDNFLV

SEQ ID NO: 2821482 - protein, 18 aa, Entamoeba invadens
LHENGILHRDIKPDNILI

SEQ ID NO: 2821483 - protein, 19 aa, Entamoeba invadens
LHENGILHRDIKPDNYLIF

SEQ ID NO: 2821484 - protein, 19 aa, Entamoeba invadens
LHENGILHRDIKSDNFLVF

SEQ ID NO: 2821485 - protein, 26 aa, Entamoeba invadens
LHEVVFPLVKILKLTKEHIRLIFSYI

SEQ ID NO: 2821486 - protein, 18 aa, Entamoeba invadens
LHFSQITPLINFAKRWIR

SEQ ID NO: 2821487 - protein, 21 aa, Entamoeba invadens
LHGFKLFHLNLKLSNVMMKSF

SEQ ID NO: 2821488 - protein, 18 aa, Entamoeba invadens
LHINGILHRDIKPDNILI

SEQ ID NO: 2821489 - protein, 26 aa, Entamoeba invadens
LHKDILSIFITLIYPQLSVTSTTLNA

SEQ ID NO: 2821490 - protein, 18 aa, Entamoeba invadens
LHKPLTLNNNFTLTIPLL

SEQ ID NO: 2821491 - protein, 24 aa, Entamoeba invadens
LHKRVVPWALHFLKCPQKDVYVSV

SEQ ID NO: 2821492 - protein, 18 aa, Entamoeba invadens
LHLNFKVIVSVQVIFLVC

SEQ ID NO: 2821493 - protein, 24 aa, Entamoeba invadens
LHLNMIVNYLFIIPCIVTLVTVFS

SEQ ID NO: 2821494 - protein, 18 aa, Entamoeba invadens
LHNNGILHRDIKPANLLI

SEQ ID NO: 2821495 - protein, 24 aa, Entamoeba invadens
LHQKKILHLNLTPSNVLITTNYDA

SEQ ID NO: 2821496 - protein, 18 aa, Entamoeba invadens
LHRDIKPDNFLVFCIDNS

SEQ ID NO: 2821497 - protein, 25 aa, Entamoeba invadens
LHRDIKPDNFLVFSLDLNDYVNAKL

SEQ ID NO: 2821498 - protein, 19 aa, Entamoeba invadens
LHRDIKPDNILIFSIEKTS

SEQ ID NO: 2821499 - protein, 24 aa, Entamoeba invadens
LHRDIKPDNILIFSLDINEKVNAK

SEQ ID NO: 2821500 - protein, 29 aa, Entamoeba invadens
LHRDIKPDNILIFSMDLTHGINAKLTDFG

SEQ ID NO: 2821501 - protein, 28 aa, Entamoeba invadens
LHRDIKPDNILIISLDLNEKVNAKLTDF

SEQ ID NO: 2821502 - protein, 27 aa, Entamoeba invadens
LHRDIKPDNILILSLEKDIITNGKLTD

SEQ ID NO: 2821503 - protein, 20 aa, Entamoeba invadens
LHRDIKPDNILVFSLETIEK

SEQ ID NO: 2821504 - protein, 24 aa, Entamoeba invadens
LHRDIKPDNILVYSLNIYDKVNAK

SEQ ID NO: 2821505 - protein, 20 aa, Entamoeba invadens
LHRDIKPDNLLIFSIESGVE

SEQ ID NO: 2821506 - protein, 23 aa, Entamoeba invadens
LHRDIKPDNLLVFSLDLNDKVNA

SEQ ID NO: 2821507 - protein, 24 aa, Entamoeba invadens
LHRDIKPDNLLVFSLDMNDKVNAK

SEQ ID NO: 2821508 - protein, 18 aa, Entamoeba invadens
LHRDIKPDNLLVISLEEN

SEQ ID NO: 2821509 - protein, 21 aa, Entamoeba invadens
LHRDIKPDNLLVMSLDITEKV

SEQ ID NO: 2821510 - protein, 21 aa, Entamoeba invadens
LHRDIKPDNLLVMSLNITEKV

SEQ ID NO: 2821511 - protein, 20 aa, Entamoeba invadens
LHRDIKPDNLLVVSLDITEK

SEQ ID NO: 2821512 - protein, 17 aa, Entamoeba invadens
LHSNDILHRDIKPDNYL

SEQ ID NO: 2821513 - protein, 18 aa, Entamoeba invadens
LHSNGILHRDIKPDNFLV

SEQ ID NO: 2821514 - protein, 18 aa, Entamoeba invadens
LHSNNILHRDIKPDNILV

SEQ ID NO: 2821515 - protein, 29 aa, Entamoeba invadens
LHSSMFVNWIFLTSVVLPSNVIKILYGCF

SEQ ID NO: 2821516 - protein, 24 aa, Entamoeba invadens
LHTHNFLHLNIKPSNILLLGEDLS

SEQ ID NO: 2821517 - protein, 17 aa, Entamoeba invadens
LHTITFGMSYPKIKIKA

SEQ ID NO: 2821518 - protein, 21 aa, Entamoeba invadens
LHTSLLFPSGAIYSTAAILLI

SEQ ID NO: 2821519 - protein, 37 aa, Entamoeba invadens
LHVRRFMLPISLLILTITFIPLIYFVVTKTTIFEHWK

SEQ ID NO: 2821520 - protein, 19 aa, Entamoeba invadens
LHYQVFVLTLGWLFNTVLV

SEQ ID NO: 2821521 - protein, 17 aa, Entamoeba invadens
LIAGRMFFILRDELRRS

SEQ ID NO: 2821522 - protein, 25 aa, Entamoeba invadens
LIAMALCFFVMLLSFTANVRENSWE

SEQ ID NO: 2821523 - protein, 21 aa, Entamoeba invadens
LIAMSIISLSWIFLPFEEKYF

SEQ ID NO: 2821524 - protein, 17 aa, Entamoeba invadens
LIASAVVSLFLAFVVPK

SEQ ID NO: 2821525 - protein, 23 aa, Entamoeba invadens
LIATNIVFLTGSTQIRVYSNSLF

SEQ ID NO: 2821526 - protein, 21 aa, Entamoeba invadens
LIAVGSFCVALLLVGIAHKPI

SEQ ID NO: 2821527 - protein, 25 aa, Entamoeba invadens
LICFLIYFILSLMNLFFTYKTGIMK

SEQ ID NO: 2821528 - protein, 18 aa, Entamoeba invadens
LICGVFCSIFTKVWMHII

SEQ ID NO: 2821529 - protein, 19 aa, Entamoeba invadens
LICMSFKYIPHRGAILLAI

SEQ ID NO: 2821530 - protein, 20 aa, Entamoeba invadens
LICYWITWLGAVFFFNHLFA

SEQ ID NO: 2821531 - protein, 21 aa, Entamoeba invadens
LIEKSWQHKVSMRPSFKEISK

SEQ ID NO: 2821532 - protein, 46 aa, Entamoeba invadens
LIFCVKRIIHIFQGGFFYFFLFKMIFYLFTKKYYIITIFNKKNRKV

SEQ ID NO: 2821533 - protein, 22 aa, Entamoeba invadens
LIFMFIFMSVSSLFILLDLNPN

SEQ ID NO: 2821534 - protein, 25 aa, Entamoeba invadens
LIFNQFHNMIYFQKTLTSHETVTCI

SEQ ID NO: 2821535 - protein, 19 aa, Entamoeba invadens
LIFSSILRVNFSGAFSMLY

SEQ ID NO: 2821536 - protein, 17 aa, Entamoeba invadens
LIGFLIVDFARAKFFPR

SEQ ID NO: 2821537 - protein, 25 aa, Entamoeba invadens
LIGIIMLYFLPFFVQFPMCLFTAEI

SEQ ID NO: 2821538 - protein, 17 aa, Entamoeba invadens
LIGILVLTEFRYYLQRE

SEQ ID NO: 2821539 - protein, 18 aa, Entamoeba invadens
LIGIMFRLDIDTPHTYLK

SEQ ID NO: 2821540 - protein, 22 aa, Entamoeba invadens
LIGKFVSLLPLAFATFVAMSRC

SEQ ID NO: 2821541 - protein, 24 aa, Entamoeba invadens
LIGSNFWLVIWTDPTKRASHDLTK

SEQ ID NO: 2821542 - protein, 24 aa, Entamoeba invadens
LIGSQLIFFDFFKVVDKLDVLIMK

SEQ ID NO: 2821543 - protein, 44 aa, Entamoeba invadens
LIGTDLYNKMKLPILFPHVSSERFFYVFISIEGYERIDFKFLVI

SEQ ID NO: 2821544 - protein, 22 aa, Entamoeba invadens
LIGTLIHCAFSLIIGLILGYLG

SEQ ID NO: 2821545 - protein, 19 aa, Entamoeba invadens
LIGVFVSFGGWICPVLSFL

SEQ ID NO: 2821546 - protein, 29 aa, Entamoeba invadens
LIGVTTMISFFFYVGLFMAAGEKMISRLR

SEQ ID NO: 2821547 - protein, 18 aa, Entamoeba invadens
LIHGWSYEALVKETCDCV

SEQ ID NO: 2821548 - protein, 17 aa, Entamoeba invadens
LIHLVLSANHVAVSINN

SEQ ID NO: 2821549 - protein, 19 aa, Entamoeba invadens
LIHSIVFILIYLLYVIFIG

SEQ ID NO: 2821550 - protein, 22 aa, Entamoeba invadens
LIIFFSFVCLFPQIYKILRLRD

SEQ ID NO: 2821551 - protein, 17 aa, Entamoeba invadens
LIIIALFLFFDHWFTYT

SEQ ID NO: 2821552 - protein, 18 aa, Entamoeba invadens
LIILFDYYFYIVKNQFAM

SEQ ID NO: 2821553 - protein, 19 aa, Entamoeba invadens
LIIPKNNQMRIEGIPNWPM

SEQ ID NO: 2821554 - protein, 17 aa, Entamoeba invadens
LIIPNFFEGVLSEKEGE

SEQ ID NO: 2821555 - protein, 23 aa, Entamoeba invadens
LIISYVLICLIVQIKIVEIIVIV

SEQ ID NO: 2821556 - protein, 17 aa, Entamoeba invadens
LIITALSCYTNDADDCV

SEQ ID NO: 2821557 - protein, 27 aa, Entamoeba invadens
LIITLVITCTVLLLTVLIISTVTTIIV

SEQ ID NO: 2821558 - protein, 18 aa, Entamoeba invadens
LIIVLIARTTNSTQLSCS

SEQ ID NO: 2821559 - protein, 21 aa, Entamoeba invadens
LIKAGMLYVDGIKLLLNDEYV

SEQ ID NO: 2821560 - protein, 31 aa, Entamoeba invadens
LIKAVRAWLNLIIFILLYYSEVDYYTVGFYR

SEQ ID NO: 2821561 - protein, 19 aa, Entamoeba invadens
LIKKCWQRKVDARPSFKEI

SEQ ID NO: 2821562 - protein, 21 aa, Entamoeba invadens
LIKKNWYYLFGTAGCWFFVDI

SEQ ID NO: 2821563 - protein, 19 aa, Entamoeba invadens
LIKTLPTICTYLYSEILSA

SEQ ID NO: 2821564 - protein, 17 aa, Entamoeba invadens
LILAMSLVQTYLIKKYF

SEQ ID NO: 2821565 - protein, 17 aa, Entamoeba invadens
LILKLVVFVLIHLENVI

SEQ ID NO: 2821566 - protein, 17 aa, Entamoeba invadens
LILNVFALDGVVNEYYK

SEQ ID NO: 2821567 - protein, 20 aa, Entamoeba invadens
LILQFLVILSSSYPCTSSCV

SEQ ID NO: 2821568 - protein, 34 aa, Entamoeba invadens; identical to SEQ ID NO: 2399374

SEQ ID NO: 2821569 - protein, 24 aa, Entamoeba invadens
LILSLIFYFISFLFFRETTARTGL

SEQ ID NO: 2821570 - protein, 22 aa, Entamoeba invadens
LILTFVIYIITGNVFIFLLFLF

SEQ ID NO: 2821571 - protein, 19 aa, Entamoeba invadens
LILVEPINVAFSENPLIVK

SEQ ID NO: 2821572 - protein, 21 aa, Entamoeba invadens
LILVIIIIIIIIIAKSKSGKN

SEQ ID NO: 2821573 - protein, 19 aa, Entamoeba invadens
LILVVMGRTIPQHAKTDKT

SEQ ID NO: 2821574 - protein, 18 aa, Entamoeba invadens
LIMKEPLPFLIDEMRVNE

SEQ ID NO: 2821575 - protein, 23 aa, Entamoeba invadens
LIMLLNNLKVLDRQLRVCTTIAI

SEQ ID NO: 2821576 - protein, 49 aa, Entamoeba invadens
LIMSGVYIVLFFFISTFLYFLHSSSFIKWNFKYLVVLLSVFLVSTVLCT

SEQ ID NO: 2821577 - protein, 17 aa, Entamoeba invadens
LIMYSSCSECAVVIQGN

SEQ ID NO: 2821578 - protein, 22 aa, Entamoeba invadens
LINGKCHMTIPFCNTYVAYSTT

SEQ ID NO: 2821579 - protein, 17 aa, Entamoeba invadens
LINLGLTIPFTPQADFK

SEQ ID NO: 2821580 - protein, 19 aa, Entamoeba invadens
LINMIALPLIYSQAPPMEY

SEQ ID NO: 2821581 - protein, 24 aa, Entamoeba invadens
LINNFLFSIFRYLLGKNIILVIFS

SEQ ID NO: 2821582 - protein, 30 aa, Entamoeba invadens
LINNKLCFFSKFRLFKVFRCKKTNYGLVIV

SEQ ID NO: 2821583 - protein, 19 aa, Entamoeba invadens
LINVNKFMDSVPATCLHAL

SEQ ID NO: 2821584 - protein, 29 aa, Entamoeba invadens
LIPINHDFIELIPPLSFLAIGQHAELALR

SEQ ID NO: 2821585 - protein, 25 aa, Entamoeba invadens
LIPKKCILFSLITILHSCSFEALGA

SEQ ID NO: 2821586 - protein, 22 aa, Entamoeba invadens
LIPLLYLMLFIPLVVARYLVYR

SEQ ID NO: 2821587 - protein, 30 aa, Entamoeba invadens
LIQLSLDVAFWLSCKWVWSLSLYLDSFADN

SEQ ID NO: 2821588 - protein, 18 aa, Entamoeba invadens
LIQNCQLCKYNNGIQTCL

SEQ ID NO: 2821589 - protein, 18 aa, Entamoeba invadens
LIQTFAYFDIYNNATVIA

SEQ ID NO: 2821590 - protein, 29 aa, Entamoeba invadens
LIRFCGIYLGILLLFWGCSVKYFFDISFM

SEQ ID NO: 2821591 - protein, 22 aa, Entamoeba invadens
LIRIDGLFELIPNKVYQFRGYD

SEQ ID NO: 2821592 - protein, 21 aa, Entamoeba invadens
LIRNNPRYYNLFYFCFRELCV

SEQ ID NO: 2821593 - protein, 17 aa, Entamoeba invadens
LISFTLFYWAHDFTNRE

SEQ ID NO: 2821594 - protein, 30 aa, Entamoeba invadens
LISGFSVLLLLIVVVIILVLIIVKVSNSYV

SEQ ID NO: 2821595 - protein, 19 aa, Entamoeba invadens
LISGTFPLTIKTLSRDKSI

SEQ ID NO: 2821596 - protein, 19 aa, Entamoeba invadens
LISHNRLIRYCPTGNVIPV

SEQ ID NO: 2821597 - protein, 17 aa, Entamoeba invadens
LISLTTSFERVKWCKLN

SEQ ID NO: 2821598 - protein, 18 aa, Entamoeba invadens
LISNKKLIRFCPNGTPLD

SEQ ID NO: 2821599 - protein, 19 aa, Entamoeba invadens
LISNKKLIRFCPNNTLLDN

SEQ ID NO: 2821600 - protein, 25 aa, Entamoeba invadens
LISNKKLIRFCPNTIPFNNEVICTL

SEQ ID NO: 2821601 - protein, 39 aa, Entamoeba invadens
LISSLTPTIGLYIFLYFVLLFVYYLRYNNLNAVITKAHK

SEQ ID NO: 2821602 - protein, 21 aa, Entamoeba invadens
LISSQRLLRFCPNGTNLANTV

SEQ ID NO: 2821603 - protein, 24 aa, Entamoeba invadens
LISTIIIFVLSFMPGIDYAAHIFG

SEQ ID NO: 2821604 - protein, 37 aa, Entamoeba invadens
LITFCGLIMAIAFSGLFLSGLLVLNLFAFVLTFSVLA

SEQ ID NO: 2821605 - protein, 18 aa, Entamoeba invadens
LITIFSKGDYWRYEVRPL

SEQ ID NO: 2821606 - protein, 20 aa, Entamoeba invadens
LITIGILIIVVIVVATGCIA

SEQ ID NO: 2821607 - protein, 17 aa, Entamoeba invadens
LITILCTTKIRGVQIPY

SEQ ID NO: 2821608 - protein, 17 aa, Entamoeba invadens
LITIPPVEKSWKNIMVE

SEQ ID NO: 2821609 - protein, 20 aa, Entamoeba invadens
LITNITFTRGIGTPAYMPPE

SEQ ID NO: 2821610 - protein, 18 aa, Entamoeba invadens
LITPLMLLKTQKADYITT

SEQ ID NO: 2821611 - protein, 18 aa, Entamoeba invadens
LITSQTPFKIHSLGLSES

SEQ ID NO: 2821612 - protein, 18 aa, Entamoeba invadens
LITVVFLNGKLNSQQSSP

SEQ ID NO: 2821613 - protein, 24 aa, Entamoeba invadens
LIVPSFVHLFGEANWWPIKYEIEV

SEQ ID NO: 2821614 - protein, 19 aa, Entamoeba invadens
LIVQALKRLENFSLFSCVV

SEQ ID NO: 2821615 - protein, 21 aa, Entamoeba invadens
LIVRFLFLPIEEVSFSLFSKM

SEQ ID NO: 2821616 - protein, 26 aa, Entamoeba invadens
LIVVVSFIFVIFLVFTFHYLERVLMN

SEQ ID NO: 2821617 - protein, 24 aa, Entamoeba invadens
LIVYKGLCFFTIKNKKRLFGTLNF

SEQ ID NO: 2821618 - protein, 18 aa, Entamoeba invadens
LIVYSQAIQWCSDDKGTL

SEQ ID NO: 2821619 - protein, 18 aa, Entamoeba invadens
LIYAFFLKYIHIVLMIFV

SEQ ID NO: 2821620 - protein, 17 aa, Entamoeba invadens
LIYIISVKSTHVKWCKY

SEQ ID NO: 2821621 - protein, 17 aa, Entamoeba invadens
LIYSEIPFTGSTPIGAI

SEQ ID NO: 2821622 - protein, 20 aa, Entamoeba invadens
LIYSVVSTKFLIVTKDGLDA

SEQ ID NO: 2821623 - protein, 19 aa, Entamoeba invadens
LIYTALDYCCRHYVMYVNY

SEQ ID NO: 2821624 - protein, 38 aa, Entamoeba invadens
LKACGMEMQLFLLRWVRLLFCQIFPPQVIKMMWDVIFA

SEQ ID NO: 2821625 - protein, 17 aa, Entamoeba invadens
LKAFLMEMSPRFITEKQ

SEQ ID NO: 2821626 - protein, 17 aa, Entamoeba invadens
LKAKCVCERNTIGRYMY

SEQ ID NO: 2821627 - protein, 22 aa, Entamoeba invadens
LKALLIEILVTESALFSSIGIV

SEQ ID NO: 2821628 - protein, 24 aa, Entamoeba invadens
LKALQMLWVNMIMDTLAALALGTE

SEQ ID NO: 2821629 - protein, 17 aa, Entamoeba invadens
LKAMREKREEMLKECEA

SEQ ID NO: 2821630 - protein, 28 aa, Entamoeba invadens
LKCDATNFEIRDTNTPYECICHPDYENI

SEQ ID NO: 2821631 - protein, 28 aa, Entamoeba invadens
LKDFPQNPFTLYIIPRPAIVNLRSVVKR

SEQ ID NO: 2821632 - protein, 28 aa, Entamoeba invadens
LKDVRSEDYCLLFDVNHNCKKCDDRAVL

SEQ ID NO: 2821633 - protein, 25 aa, Entamoeba invadens
LKEFVAIFVLMPEMSLLFLNEVLGL

SEQ ID NO: 2821634 - protein, 18 aa, Entamoeba invadens
LKEHLLSFALTNQIEYKN

SEQ ID NO: 2821635 - protein, 27 aa, Entamoeba invadens
LKEILMFPLILIYFPLFFLQKNDENTL

SEQ ID NO: 2821636 - protein, 28 aa, Entamoeba invadens
LKEKAKMKVLFSLLMYNSSSINLNGNAK

SEQ ID NO: 2821637 - protein, 32 aa, Entamoeba invadens
LKEKTAQQLLYRTSAFLALYDEMYFDKQTFYA

SEQ ID NO: 2821638 - protein, 23 aa, Entamoeba invadens
LKEQDYVLFMYGTDSVLLTIKES

SEQ ID NO: 2821639 - protein, 27 aa, Entamoeba invadens
LKESYTYDLLLRILRFDPSDVSYLQSC

SEQ ID NO: 2821640 - protein, 18 aa, Entamoeba invadens
LKFCFFVVSERQGIKIRL

SEQ ID NO: 2821641 - protein, 20 aa, Entamoeba invadens
LKFETVVSLLYKAAYYNAML

SEQ ID NO: 2821642 - protein, 25 aa, Entamoeba invadens
LKFKSFPPNMLIVGGGTRVSYSQYN

SEQ ID NO: 2821643 - protein, 27 aa, Entamoeba invadens
LKFTDVLFILFLKFLPCFLIIGMMNKP

SEQ ID NO: 2821644 - protein, 18 aa, Entamoeba invadens
LKFTLDVELLLSGPKQID

SEQ ID NO: 2821645 - protein, 21 aa, Entamoeba invadens
LKGFNCKSLLTIEIIVGIVVG

SEQ ID NO: 2821646 - protein, 23 aa, Entamoeba invadens
LKGILFHYHHHLIIKTDAASSTQ

SEQ ID NO: 2821647 - protein, 24 aa, Entamoeba invadens
LKGRLKMMFLQIPSERVWVGCDED

SEQ ID NO: 2821648 - protein, 19 aa, Entamoeba invadens
LKICIDSAKGLFYLHTNGI

SEQ ID NO: 2821649 - protein, 18 aa, Entamoeba invadens
LKIIYYRNNIRDHSSLVM

SEQ ID NO: 2821650 - protein, 24 aa, Entamoeba invadens
LKIKIPRQYIIRLETLMLKCCDQQ

SEQ ID NO: 2821651 - protein, 18 aa, Entamoeba invadens
LKILIPEILERIDYFSPN

SEQ ID NO: 2821652 - protein, 32 aa, Entamoeba invadens
LKINVFYMFGYTLLCYFLGFIPQYYPQYFSPK

SEQ ID NO: 2821653 - protein, 28 aa, Entamoeba invadens
LKKFAIFTFFMFAVPFLIYYSLHNAFGD

SEQ ID NO: 2821654 - protein, 28 aa, Entamoeba invadens
LKKGYACEFSIYLKPLCTCKFHSTIQMI

SEQ ID NO: 2821655 - protein, 21 aa, Entamoeba invadens
LKKMFIMFDEGFMKKWFGGQT

SEQ ID NO: 2821656 - protein, 41 aa, Entamoeba invadens
LKKPIKTLVYMTPLMALVCAIPVAMPFFGQAFGWSVSITFL

SEQ ID NO: 2821657 - protein, 23 aa, Entamoeba invadens
LKKQFIFCTEPFRIPFAGSVDVC

SEQ ID NO: 2821658 - protein, 17 aa, Entamoeba invadens
LKLIFNTNNYTYKYSNV

SEQ ID NO: 2821659 - protein, 22 aa, Entamoeba invadens
LKMCLGPFIDKLATLPPEEHYD

SEQ ID NO: 2821660 - protein, 17 aa, Entamoeba invadens
LKMLTLTGVDKNSPLAL

SEQ ID NO: 2821661 - protein, 19 aa, Entamoeba invadens
LKNKAMLLELYMTPNPSFV

SEQ ID NO: 2821662 - protein, 18 aa, Entamoeba invadens
LKNKGVFVSYSDLDGKVV

SEQ ID NO: 2821663 - protein, 24 aa, Entamoeba invadens
LKNKQHFFNIFRGVMRNLCFDIVP

SEQ ID NO: 2821664 - protein, 23 aa, Entamoeba invadens
LKNLGVVLVVPILREIENLNFTL

SEQ ID NO: 2821665 - protein, 25 aa, Entamoeba invadens
LKNQLKEETSKFENLKKFNESLAEK

SEQ ID NO: 2821666 - protein, 17 aa, Entamoeba invadens
LKPVVFAAVPRVLQLIY

SEQ ID NO: 2821667 - protein, 19 aa, Entamoeba invadens
LKRGFACEFEIFIRPNYTC

SEQ ID NO: 2821668 - protein, 31 aa, Entamoeba invadens
LKRGFACEFEVYLTPYCCLNLNDKVAIISLD

SEQ ID NO: 2821669 - protein, 28 aa, Entamoeba invadens
LKRGFACEFSIYLMPKYTTNINSDIAII

SEQ ID NO: 2821670 - protein, 33 aa, Entamoeba invadens
LKRGIACEFSIYIKPICTCLIKNNLQIISKNLS

SEQ ID NO: 2821671 - protein, 26 aa, Entamoeba invadens
LKRGYACEFSIYLTPHCTCQIDNSLQ

SEQ ID NO: 2821672 - protein, 26 aa, Entamoeba invadens
LKRNNKPIPLFLEPPLIKQNAKNSNL

SEQ ID NO: 2821673 - protein, 29 aa, Entamoeba invadens
LKSDYTNILVYPIVIANLTNSSLVTSQIT

SEQ ID NO: 2821674 - protein, 27 aa, Entamoeba invadens
LKSGYACEFSIYLTPHCTCKIDNSLQI

SEQ ID NO: 2821675 - protein, 31 aa, Entamoeba invadens
LKSIMSFVDFSVFVLLPYISKRVHIIAQNTT

SEQ ID NO: 2821676 - protein, 23 aa, Entamoeba invadens
LKSKYIKLQLNVKKILIVTMEKT

SEQ ID NO: 2821677 - protein, 31 aa, Entamoeba invadens
LKSLGGLMRISFLETFRWNFKFTETTPREFI

SEQ ID NO: 2821678 - protein, 25 aa, Entamoeba invadens
LKSLSFSCFNLFIEVVPLIVKVLQK

SEQ ID NO: 2821679 - protein, 22 aa, Entamoeba invadens
LKSLVRYLINNGVPFYKNVNNG

SEQ ID NO: 2821680 - protein, 28 aa, Entamoeba invadens
LKSNEACEFLIVFTALCTCKIITEIMLI

SEQ ID NO: 2821681 - protein, 53 aa, Entamoeba invadens
LKTMMTYIKYGGWFNFAMVVFFFFVSSFLLLASNFWLVLWTDPSKKDQYEFTK

SEQ ID NO: 2821682 - protein, 18 aa, Entamoeba invadens
LKTNYYIKNTLSLGFRMN

SEQ ID NO: 2821683 - protein, 25 aa, Entamoeba invadens
LKTPNIVLCESICSLTLMVNEIAGL

SEQ ID NO: 2821684 - protein, 25 aa, Entamoeba invadens
LKTYGPFFVICCVLLAIVLFCIALF

SEQ ID NO: 2821685 - protein, 27 aa, Entamoeba invadens
LKVKFMEDLVVALAFLHDNNIIHRDIK

SEQ ID NO: 2821686 - protein, 27 aa, Entamoeba invadens
LKVKFMEDLVVGLAFLHDNNIIHRDIK

SEQ ID NO: 2821687 - protein, 18 aa, Entamoeba invadens
LKVLAPDMVFMLRGNHEC

SEQ ID NO: 2821688 - protein, 21 aa, Entamoeba invadens
LKVLELIDLWFELCRTVQFQE

SEQ ID NO: 2821689 - protein, 20 aa, Entamoeba invadens
LKWCDSCIDGYYLTTEGYYR

SEQ ID NO: 2821690 - protein, 18 aa, Entamoeba invadens
LKWIPFVSVMQFLSHFQS

SEQ ID NO: 2821691 - protein, 33 aa, Entamoeba invadens
LLAERHAMMYIILRQFFLLIMNNNKNISRLALH

SEQ ID NO: 2821692 - protein, 28 aa, Entamoeba invadens
LLAGALKMFLCQIPGRLINKTLTHSLIE

SEQ ID NO: 2821693 - protein, 23 aa, Entamoeba invadens
LLAIFCIFFCIYLFVSYQHVVNH

SEQ ID NO: 2821694 - protein, 30 aa, Entamoeba invadens
LLAIIFAVFGIWCLINFLVGRRGAAILPLY

SEQ ID NO: 2821695 - protein, 18 aa, Entamoeba invadens
LLALALSAKILIIFEKHD

SEQ ID NO: 2821696 - protein, 17 aa, Entamoeba invadens
LLANADPFLKVGDTEPR

SEQ ID NO: 2821697 - protein, 17 aa, Entamoeba invadens
LLANADPFLKVGEKEPR

SEQ ID NO: 2821698 - protein, 19 aa, Entamoeba invadens
LLCLSCMNGYALLNNRCLQ

SEQ ID NO: 2821699 - protein, 29 aa, Entamoeba invadens
LLCLTILISLLIVLFLELGLSIYSSIKSQ

SEQ ID NO: 2821700 - protein, 30 aa, Entamoeba invadens
LLCVLLILHTYWFYLVLQMIFGFFKSRGTF

SEQ ID NO: 2821701 - protein, 19 aa, Entamoeba invadens
LLDALELFEVLKLPHSRKS

SEQ ID NO: 2821702 - protein, 25 aa, Entamoeba invadens
LLDALSFYFGKLYTDHALATKFLQY

SEQ ID NO: 2821703 - protein, 20 aa, Entamoeba invadens
LLDEFLKVLTVNGLNWIQLL

SEQ ID NO: 2821704 - protein, 18 aa, Entamoeba invadens
LLDHFLSLLSANYTDWFS

SEQ ID NO: 2821705 - protein, 18 aa, Entamoeba invadens
LLDKFRCKYIVHFYGAVF

SEQ ID NO: 2821706 - protein, 18 aa, Entamoeba invadens
LLECFKWKEAYGGENFRY

SEQ ID NO: 2821707 - protein, 18 aa, Entamoeba invadens
LLEHGMTLSISFAPNYPL

SEQ ID NO: 2821708 - protein, 18 aa, Entamoeba invadens
LLFFTAQSSYLEPQPITI

SEQ ID NO: 2821709 - protein, 17 aa, Entamoeba invadens
LLFKNVGHLMKTNLDEI

SEQ ID NO: 2821710 - protein, 20 aa, Entamoeba invadens
LLFLLTTTVNCATTCSGGQY

SEQ ID NO: 2821711 - protein, 20 aa, Entamoeba invadens
LLFLLYVKSEVVCSPKTNDC

SEQ ID NO: 2821712 - protein, 20 aa, Entamoeba invadens
LLFLTNADLLNDFSGDVDIY

SEQ ID NO: 2821713 - protein, 20 aa, Entamoeba invadens
LLFSLFFIVVTSQDQNHRVC

SEQ ID NO: 2821714 - protein, 30 aa, Entamoeba invadens
LLFSTKIRNHILFLSLKKRLKERVTESRYI

SEQ ID NO: 2821715 - protein, 29 aa, Entamoeba invadens
LLFVIFERISFEELFFELVYFGSIETREP

SEQ ID NO: 2821716 - protein, 18 aa, Entamoeba invadens
LLFVVNSNIVNIKWCKYS

SEQ ID NO: 2821717 - protein, 21 aa, Entamoeba invadens
LLGFVLMIATHRKKHIPFLVA

SEQ ID NO: 2821718 - protein, 24 aa, Entamoeba invadens
LLGQRQGMLLKRRYFRSLMKQDCG

SEQ ID NO: 2821719 - protein, 18 aa, Entamoeba invadens
LLGVWYQYTAPVNGKIHI

SEQ ID NO: 2821720 - protein, 29 aa, Entamoeba invadens
LLGYSAVLLLIFVVGLLSIKRFKKSNYDY

SEQ ID NO: 2821721 - protein, 20 aa, Entamoeba invadens
LLHISFTLDTLMDFVFEHYI

SEQ ID NO: 2821722 - protein, 19 aa, Entamoeba invadens
LLIFSVNSSTTKLAEDALT

SEQ ID NO: 2821723 - protein, 31 aa, Entamoeba invadens
LLIGFALVLIAVGGLIYFWATRRRRVLLVDF

SEQ ID NO: 2821724 - protein, 23 aa, Entamoeba invadens
LLILTLLLQIYSTNSLVLWMVDN

SEQ ID NO: 2821725 - protein, 24 aa, Entamoeba invadens
LLINPAYFASFGIFFSVAFSVLGA

SEQ ID NO: 2821726 - protein, 19 aa, Entamoeba invadens
LLISNKKLIRFCPTNTLSN

SEQ ID NO: 2821727 - protein, 29 aa, Entamoeba invadens
LLIVMCVATLFFLYVLRGIPFKTWSLEQK

SEQ ID NO: 2821728 - protein, 18 aa, Entamoeba invadens
LLKAIFESLSGWMGNLPE

SEQ ID NO: 2821729 - protein, 26 aa, Entamoeba invadens
LLKIVTPLLTRRPLLITNATIYDINE

SEQ ID NO: 2821730 - protein, 29 aa, Entamoeba invadens
LLKSKPDYIKLPYKLKLKMLFDASRGMQF

SEQ ID NO: 2821731 - protein, 17 aa, Entamoeba invadens
LLKYTLFWKNSSVLGYD

SEQ ID NO: 2821732 - protein, 17 aa, Entamoeba invadens
LLLCAKAFQMEIPVNGF

SEQ ID NO: 2821733 - protein, 26 aa, Entamoeba invadens
LLLESGQMFFLVYKLTDDSINGMDFL

SEQ ID NO: 2821734 - protein, 23 aa, Entamoeba invadens
LLLFDFSYGYLTSSRLSKLRLNS

SEQ ID NO: 2821735 - protein, 21 aa, Entamoeba invadens
LLLFSPILTFAGRSTWCENDG

SEQ ID NO: 2821736 - protein, 17 aa, Entamoeba invadens
LLLGFGNSTFFVIFPLL

SEQ ID NO: 2821737 - protein, 19 aa, Entamoeba invadens
LLLGSCKMLSEIHCKSIVI

SEQ ID NO: 2821738 - protein, 21 aa, Entamoeba invadens
LLLILLTTKTNAAISCSSGQY

SEQ ID NO: 2821739 - protein, 21 aa, Entamoeba invadens
LLLILLTTKTNAATSCSSGHY

SEQ ID NO: 2821740 - protein, 18 aa, Entamoeba invadens
LLLLTAVLVSGTPCDQLE

SEQ ID NO: 2821741 - protein, 17 aa, Entamoeba invadens
LLLMFPKFFRIKGMIPC

SEQ ID NO: 2821742 - protein, 36 aa, Entamoeba invadens
LLLNFFRRIVIRRKIIGRVIRFPYKLSDDMLSCIHT

SEQ ID NO: 2821743 - protein, 26 aa, Entamoeba invadens
LLLQVFFTLRFFLYFEHRWGILIFCA

SEQ ID NO: 2821744 - protein, 21 aa, Entamoeba invadens
LLLSVALSEDLMLYDDGEFYE

SEQ ID NO: 2821745 - protein, 19 aa, Entamoeba invadens
LLLVHGRYFYRQNSVVYFY

SEQ ID NO: 2821746 - protein, 19 aa, Entamoeba invadens
LLLVLFTSVQSGVIVDMGY

SEQ ID NO: 2821747 - protein, 19 aa, Entamoeba invadens
LLLVSSFDTSKFRGLTVYQ

SEQ ID NO: 2821748 - protein, 23 aa, Entamoeba invadens
LLMLFTLVYSFQCSPGCPDGCIT

SEQ ID NO: 2821749 - protein, 29 aa, Entamoeba invadens
LLMSFTFQGYFCLPMLDYVFLSENKKVSN

SEQ ID NO: 2821750 - protein, 23 aa, Entamoeba invadens
LLMTSYIFYSFMKIVIKSLSYVL

SEQ ID NO: 2821751 - protein, 17 aa, Entamoeba invadens
LLNFLNTFSLSLNSTYM

SEQ ID NO: 2821752 - protein, 18 aa, Entamoeba invadens
LLNIVRVSFFMSIRVSNF

SEQ ID NO: 2821753 - protein, 19 aa, Entamoeba invadens
LLNLKSTLLKKCFSIMLLA

SEQ ID NO: 2821754 - protein, 18 aa, Entamoeba invadens
LLNRGYWDNNNNFKWFRP

SEQ ID NO: 2821755 - protein, 29 aa, Entamoeba invadens
LLNSDNWIVFYIITYFLNKNLTMYQIKLL

SEQ ID NO: 2821756 - protein, 24 aa, Entamoeba invadens
LLNSLSMFTLYFDSILEVLKGMNM

SEQ ID NO: 2821757 - protein, 21 aa, Entamoeba invadens
LLNVPLLVISLFSMSQFPPFP

SEQ ID NO: 2821758 - protein, 20 aa, Entamoeba invadens
LLPFHEDLIVYIKTYENGAA

SEQ ID NO: 2821759 - protein, 26 aa, Entamoeba invadens
LLQDLSSACYYLVYEPAQGLTVSVGS

SEQ ID NO: 2821760 - protein, 18 aa, Entamoeba invadens
LLQILNAQFTCTEPIEID

SEQ ID NO: 2821761 - protein, 23 aa, Entamoeba invadens
LLQKLYEDLLFNLDKTNSFEKSQ

SEQ ID NO: 2821762 - protein, 25 aa, Entamoeba invadens
LLQLDSIIYQFFVLCISSKHFGTHQ

SEQ ID NO: 2821763 - protein, 18 aa, Entamoeba invadens
LLRTILWTVNEPIESNFF

SEQ ID NO: 2821764 - protein, 31 aa, Entamoeba invadens
LLRVIEIIVKKIFYFPKETLTLLDPLAQIIE

SEQ ID NO: 2821765 - protein, 23 aa, Entamoeba invadens
LLRYNVFAHFFPVLFKLDNFIEN

SEQ ID NO: 2821766 - protein, 25 aa, Entamoeba invadens
LLSCKTCFSGFYLDSNECLSCQSNC

SEQ ID NO: 2821767 - protein, 34 aa, Entamoeba invadens
LLSCSVRARKKMVMTIYLATGFVKPIGLENTNFN

SEQ ID NO: 2821768 - protein, 20 aa, Entamoeba invadens
LLSFIVYLACSVGCGYDECS

SEQ ID NO: 2821769 - protein, 20 aa, Entamoeba invadens
LLSFLATTKTFATTWCGPGQ

SEQ ID NO: 2821770 - protein, 21 aa, Entamoeba invadens
LLSHKIFCLGVTLSRFPEFLG

SEQ ID NO: 2821771 - protein, 29 aa, Entamoeba invadens
LLSILSIYGIITLYKFCYCSLKKMTIAKN

SEQ ID NO: 2821772 - protein, 27 aa, Entamoeba invadens
LLSKTPTIIGWWDQVMQYKTLLIIYTT

SEQ ID NO: 2821773 - protein, 17 aa, Entamoeba invadens
LLSLKVAGVFPAISILF

SEQ ID NO: 2821774 - protein, 25 aa, Entamoeba invadens
LLSNGKLMRFCPIKTIFDNTVTCTL

SEQ ID NO: 2821775 - protein, 25 aa, Entamoeba invadens
LLSNGKLMRFCPIKTIFNNTVTCTL

SEQ ID NO: 2821776 - protein, 18 aa, Entamoeba invadens
LLSNMTFTKGIGTPVYMA

SEQ ID NO: 2821777 - protein, 18 aa, Entamoeba invadens
LLSNNRLIRYCPTTSQYN

SEQ ID NO: 2821778 - protein, 20 aa, Entamoeba invadens
LLSNSRLMRFCPKNIPQNKT

SEQ ID NO: 2821779 - protein, 35 aa, Entamoeba invadens
LLSQIFQPWMQTIIRYIIITPFQSALLSIVGKNLD

SEQ ID NO: 2821780 - protein, 43 aa, Entamoeba invadens
LLSRPCELYPQLQALRFPIFDSFHKFAVRYCKARVGPFGWDYT

SEQ ID NO: 2821781 - protein, 18 aa, Entamoeba invadens
LLSSFLVMIFVPPTIFEK

SEQ ID NO: 2821782 - protein, 26 aa, Entamoeba invadens
LLSTCGFALGIAFYYEWKTALCILAV

SEQ ID NO: 2821783 - protein, 28 aa, Entamoeba invadens
LLSTDQILFFFVVLSHVILLQKNLVQAQ

SEQ ID NO: 2821784 - protein, 19 aa, Entamoeba invadens
LLTEFNYLIKKSGSLQAAH

SEQ ID NO: 2821785 - protein, 25 aa, Entamoeba invadens
LLTHQNVFIYLLKTLLEGIFDCNSD

SEQ ID NO: 2821786 - protein, 21 aa, Entamoeba invadens
LLTILYPLYYTFFKRESFVNS

SEQ ID NO: 2821787 - protein, 24 aa, Entamoeba invadens
LLTKYFQYVSAKVKLLSFVLSEFE

SEQ ID NO: 2821788 - protein, 17 aa, Entamoeba invadens
LLTLQFISFLRILPNRL

SEQ ID NO: 2821789 - protein, 20 aa, Entamoeba invadens
LLVDFSFFNTVDDLFSCSRS

SEQ ID NO: 2821790 - protein, 20 aa, Entamoeba invadens
LLVEHFYNCTCGGYSLQIWI

SEQ ID NO: 2821791 - protein, 20 aa, Entamoeba invadens
LLVFSSSIQWCWSNDVVTYN

SEQ ID NO: 2821792 - protein, 19 aa, Entamoeba invadens
LLVGIFCSALSRVWMHIIN

SEQ ID NO: 2821793 - protein, 17 aa, Entamoeba invadens
LLVIAEKSNIVIPNEVD

SEQ ID NO: 2821794 - protein, 17 aa, Entamoeba invadens
LLVIIYSSDMYKKKHQK

SEQ ID NO: 2821795 - protein, 18 aa, Entamoeba invadens
LLVNADPFLKVGDKEPRE

SEQ ID NO: 2821796 - protein, 18 aa, Entamoeba invadens
LLVPSYCIDFLLSNMAKN

SEQ ID NO: 2821797 - protein, 29 aa, Entamoeba invadens
LLVSILLLLLRLFFLLIPPISITEYAKLS

SEQ ID NO: 2821798 - protein, 27 aa, Entamoeba invadens
LLVYDNSLILLFDKTNIFSSLTILSSS

SEQ ID NO: 2821799 - protein, 18 aa, Entamoeba invadens
LLYASKPKTEDYANPDCT

SEQ ID NO: 2821800 - protein, 17 aa, Entamoeba invadens
LLYFSCVCVSKKYISFA

SEQ ID NO: 2821801 - protein, 22 aa, Entamoeba invadens
LLYFYLYFSNGSPVSLVSSDIN

SEQ ID NO: 2821802 - protein, 25 aa, Entamoeba invadens
LLYNFGAFLFWIVVPLIATKQNATN

SEQ ID NO: 2821803 - protein, 17 aa, Entamoeba invadens
LLYYLYFYYICSYLYLC

SEQ ID NO: 2821804 - protein, 24 aa, Entamoeba invadens
LMAILPFFMVIVIGAVVVGCYGGI

SEQ ID NO: 2821805 - protein, 22 aa, Entamoeba invadens
LMDKMRCPYIINFIGASVTPNH

SEQ ID NO: 2821806 - protein, 17 aa, Entamoeba invadens
LMEMFIGGALKSNNAFL

SEQ ID NO: 2821807 - protein, 18 aa, Entamoeba invadens
LMERMRCPYILGFIGSVT

SEQ ID NO: 2821808 - protein, 26 aa, Entamoeba invadens
LMFDMIVNCHGLLIILIHFASGNMEQ

SEQ ID NO: 2821809 - protein, 18 aa, Entamoeba invadens
LMFFYLVMHFLIINWCYL

SEQ ID NO: 2821810 - protein, 26 aa, Entamoeba invadens
LMFINDNLWILWIMGVMYAFSYVLFW

SEQ ID NO: 2821811 - protein, 28 aa, Entamoeba invadens
LMFINDNLWILWIMSIMYAISYVFFMIP

SEQ ID NO: 2821812 - protein, 25 aa, Entamoeba invadens
LMFITTLMILIVFSIAQAFSFEVPD

SEQ ID NO: 2821813 - protein, 17 aa, Entamoeba invadens
LMFKGDVSVVEFSLRGK

SEQ ID NO: 2821814 - protein, 31 aa, Entamoeba invadens
LMGSHLHILALLKFSLWWPKQKVRIHPLSER

SEQ ID NO: 2821815 - protein, 17 aa, Entamoeba invadens
LMGYVLYEVASKTCQPC

SEQ ID NO: 2821816 - protein, 21 aa, Entamoeba invadens
LMHMYSYITFLENSNLFVKDN

SEQ ID NO: 2821817 - protein, 19 aa, Entamoeba invadens
LMISLYFQAFFWSIFFCMV

SEQ ID NO: 2821818 - protein, 18 aa, Entamoeba invadens
LMISMVCLIKTIERKVLK

SEQ ID NO: 2821819 - protein, 22 aa, Entamoeba invadens
LMIVIHLFPRLHFLSESIISLT

SEQ ID NO: 2821820 - protein, 25 aa, Entamoeba invadens
LMKDEILGIRKPRKSLCIVQSPLRK

SEQ ID NO: 2821821 - protein, 17 aa, Entamoeba invadens
LMKGCARGVYYLHKLGI

SEQ ID NO: 2821822 - protein, 30 aa, Entamoeba invadens
LMKKFGAIATLFLPMTFIAALFGMNVTVPG

SEQ ID NO: 2821823 - protein, 24 aa, Entamoeba invadens
LMKLNEFIRTLILRHRHFLFEGNS

SEQ ID NO: 2821824 - protein, 18 aa, Entamoeba invadens
LMKLVCLCVYVYAINNCK

SEQ ID NO: 2821825 - protein, 28 aa, Entamoeba invadens
LMKPSTMPEWYYIIVNKCWQTNPLDRMS

SEQ ID NO: 2821826 - protein, 27 aa, Entamoeba invadens
LMKYSTLFVEYFFITLNGIMESTTKEE

SEQ ID NO: 2821827 - protein, 21 aa, Entamoeba invadens
LMLFDARWMLLAMGMFSIYVG

SEQ ID NO: 2821828 - protein, 19 aa, Entamoeba invadens
LMLMGLYSMYCGCLFNEFF

SEQ ID NO: 2821829 - protein, 19 aa, Entamoeba invadens
LMLSIPVPNGFKYTVSEIL

SEQ ID NO: 2821830 - protein, 19 aa, Entamoeba invadens
LMLVGRIVALYYYNASLTK

SEQ ID NO: 2821831 - protein, 23 aa, Entamoeba invadens
LMMNQFAFILMFAVLLDTFVIRA

SEQ ID NO: 2821832 - protein, 20 aa, Entamoeba invadens
LMMQIFSNFPNLRPLCPEVL

SEQ ID NO: 2821833 - protein, 17 aa, Entamoeba invadens
LMNEGVLGLWRGNFVNC

SEQ ID NO: 2821834 - protein, 25 aa, Entamoeba invadens
LMNKTHITIMLPYNKPNIAMLDTMN

SEQ ID NO: 2821835 - protein, 32 aa, Entamoeba invadens
LMNNDFREFIFKFRITNFEGFMLKRADLELTK

SEQ ID NO: 2821836 - protein, 18 aa, Entamoeba invadens
LMNVEWIIDKLKVVTVVD

SEQ ID NO: 2821837 - protein, 21 aa, Entamoeba invadens
LMNVILYLDSLNTLRVFLLIS

SEQ ID NO: 2821838 - protein, 26 aa, Entamoeba invadens
LMPNLRGCLWCRNGFFKASDGKNCEL

SEQ ID NO: 2821839 - protein, 21 aa, Entamoeba invadens
LMSLLDCDVPLTDDLFYILIT

SEQ ID NO: 2821840 - protein, 17 aa, Entamoeba invadens
LMSLLLQVFFTLRFFLY

SEQ ID NO: 2821841 - protein, 28 aa, Entamoeba invadens
LMSTDRLYRFDLFVAFDYIGGDAPRYWS

SEQ ID NO: 2821842 - protein, 18 aa, Entamoeba invadens
LMSTYRGFVVCKEGYMRS

SEQ ID NO: 2821843 - protein, 18 aa, Entamoeba invadens
LMTNMTFTKGIGTPVYMA

SEQ ID NO: 2821844 - protein, 24 aa, Entamoeba invadens
LMTNMTFTRGVGTPKYMAPEILNK

SEQ ID NO: 2821845 - protein, 51 aa, Entamoeba invadens
LMVISTVICSLCIAFYFFWKLALCIVVLIPIFGVLLFFDGKLNSANAVPLV

SEQ ID NO: 2821846 - protein, 17 aa, Entamoeba invadens
LMVLYVCIAEFLGFFVG

SEQ ID NO: 2821847 - protein, 17 aa, Entamoeba invadens
LMYFFMIVSIINHFICG

SEQ ID NO: 2821848 - protein, 19 aa, Entamoeba invadens
LMYSILCGPLCYALRFLPN

SEQ ID NO: 2821849 - protein, 24 aa, Entamoeba invadens
LNAALHIFHYMCLSPSMATLLIPI

SEQ ID NO: 2821850 - protein, 17 aa, Entamoeba invadens
LNAFYLDNGICSTCETI

SEQ ID NO: 2821851 - protein, 39 aa, Entamoeba invadens
LNAKMGFISIIMFVNHVIPYLIIAYLVMYQSVPCNATTC

SEQ ID NO: 2821852 - protein, 18 aa, Entamoeba invadens
LNALFCVKNFIIDVINQN

SEQ ID NO: 2821853 - protein, 25 aa, Entamoeba invadens
LNALQMLWVNMIMDTLAALALGTEK

SEQ ID NO: 2821854 - protein, 17 aa, Entamoeba invadens
LNAMVLTQLSVGELLSL

SEQ ID NO: 2821855 - protein, 32 aa, Entamoeba invadens
LNCSTKIYGTKIPYTVWFSYSSIALKSIQKLL

SEQ ID NO: 2821856 - protein, 23 aa, Entamoeba invadens
LNDDYKLLFTTHMCPLATNMKCT

SEQ ID NO: 2821857 - protein, 17 aa, Entamoeba invadens
LNDGIYPTIFDYGKFRP

SEQ ID NO: 2821858 - protein, 29 aa, Entamoeba invadens
LNDIECLYMIFFFILKNLEDNLLDQWLVA

SEQ ID NO: 2821859 - protein, 19 aa, Entamoeba invadens
LNDIFKMTISKRTIQPKIL

SEQ ID NO: 2821860 - protein, 24 aa, Entamoeba invadens
LNEKEVVLLLPFSKFSTCVDDSLL

SEQ ID NO: 2821861 - protein, 22 aa, Entamoeba invadens
LNEQGIRAFWYVENKHLDGVVF

SEQ ID NO: 2821862 - protein, 17 aa, Entamoeba invadens
LNFFFEEGGKRVKDEKV

SEQ ID NO: 2821863 - protein, 19 aa, Entamoeba invadens
LNFIYLENYVKTFTRLVEY

SEQ ID NO: 2821864 - protein, 18 aa, Entamoeba invadens
LNFKFRAMYDIAHGMYYL

SEQ ID NO: 2821865 - protein, 25 aa, Entamoeba invadens
LNGIIVFFFVLTVILFISIYLTKYD

SEQ ID NO: 2821866 - protein, 19 aa, Entamoeba invadens
LNGKVCKKCDTGCTMCVSD

SEQ ID NO: 2821867 - protein, 21 aa, Entamoeba invadens
LNGWIALVAILFIFSCFTPLG

SEQ ID NO: 2821868 - protein, 17 aa, Entamoeba invadens
LNGYYLDNNECIKCGAN

SEQ ID NO: 2821869 - protein, 34 aa, Entamoeba invadens
LNIEGKFDFCLPISPSLYPNCKRLAFSTSKCVEC

SEQ ID NO: 2821870 - protein, 20 aa, Entamoeba invadens
LNIEKLHCRLSFYDTNYIKL

SEQ ID NO: 2821871 - protein, 21 aa, Entamoeba invadens
LNIQTNFEKLLLGNKYKFSNT

SEQ ID NO: 2821872 - protein, 32 aa, Entamoeba invadens
LNKFRSEYIVHFYGAVFIPNKICMVTEFAQYG

SEQ ID NO: 2821873 - protein, 29 aa, Entamoeba invadens
LNKFRSEYIVHFYGAVFIPNRVCMVTEFA

SEQ ID NO: 2821874 - protein, 31 aa, Entamoeba invadens
LNKFRSEYIVHFYGAVFIPSKICMVTEFAQY

SEQ ID NO: 2821875 - protein, 24 aa, Entamoeba invadens
LNKKLISVFYLAKVYRDLLKNYFN

SEQ ID NO: 2821876 - protein, 17 aa, Entamoeba invadens
LNKLKMLQLSKGGRFSS

SEQ ID NO: 2821877 - protein, 32 aa, Entamoeba invadens
LNKNYTLTPILYPICEYPLMYNKTNHSCYTSV

SEQ ID NO: 2821878 - protein, 25 aa, Entamoeba invadens
LNKTANIVYLFGYTLALPSDVDEME

SEQ ID NO: 2821879 - protein, 29 aa, Entamoeba invadens
LNKTPIGLYTFLISIILPCATVVGCTKLR

SEQ ID NO: 2821880 - protein, 26 aa, Entamoeba invadens
LNKTRVPLVFHFPDIPQVVYLNKKDF

SEQ ID NO: 2821881 - protein, 20 aa, Entamoeba invadens
LNLIIQFIYVLYGHAWRMYN

SEQ ID NO: 2821882 - protein, 18 aa, Entamoeba invadens
LNLTKAQMTLLVIILVVA

SEQ ID NO: 2821883 - protein, 24 aa, Entamoeba invadens
LNLVEFDFYLFKQASWETITYKES

SEQ ID NO: 2821884 - protein, 19 aa, Entamoeba invadens
LNLVWYPRPSPPFALASSV

SEQ ID NO: 2821885 - protein, 19 aa, Entamoeba invadens
LNMKEKFIRLTTYNRYSYR

SEQ ID NO: 2821886 - protein, 48 aa, Entamoeba invadens
LNMLYNLMYKKYIYLCCMLFVNGLFFITFFRFILLNFTHFKRNSFFGV

SEQ ID NO: 2821887 - protein, 26 aa, Entamoeba invadens
LNNDKFTFLQDKRLLRYGKSTDIFCH

SEQ ID NO: 2821888 - protein, 29 aa, Entamoeba invadens
LNNGNYKLLFGTLKLFIGTNFGFEISTQK

SEQ ID NO: 2821889 - protein, 24 aa, Entamoeba invadens
LNNITMFIDFPKYIQMTSLHIVCY

SEQ ID NO: 2821890 - protein, 24 aa, Entamoeba invadens
LNNTYDLPMIWNNGHIWKSTVMCD

SEQ ID NO: 2821891 - protein, 23 aa, Entamoeba invadens
LNNVSLPKVISLTLVVKSFTSIV

SEQ ID NO: 2821892 - protein, 27 aa, Entamoeba invadens
LNNVTMHIFFPTAIPDDLFSFCLLSFN

SEQ ID NO: 2821893 - protein, 28 aa, Entamoeba invadens
LNNYRHEYILSILGLIGAIGAGAAFPFY

SEQ ID NO: 2821894 - protein, 22 aa, Entamoeba invadens
LNQCLQCQLQYYLYNGSCLSKS

SEQ ID NO: 2821895 - protein, 28 aa, Entamoeba invadens
LNQEKRYYFCLPIYTLNINNCKRVLITS

SEQ ID NO: 2821896 - protein, 24 aa, Entamoeba invadens
LNQKFQFNVIPFTIKYDAKTMNMS

SEQ ID NO: 2821897 - protein, 23 aa, Entamoeba invadens
LNSFNFVANLSFVLNMSGFSQLV

SEQ ID NO: 2821898 - protein, 17 aa, Entamoeba invadens
LNSGSLYVFVYSSTGST

SEQ ID NO: 2821899 - protein, 26 aa, Entamoeba invadens
LNSMQMLWVNLIMDTLAALALGTEKP

SEQ ID NO: 2821900 - protein, 24 aa, Entamoeba invadens
LNSNNVAFTKPWKLVLQSGKVDNN

SEQ ID NO: 2821901 - protein, 25 aa, Entamoeba invadens
LNSSLFLTFAILFQQVPSLFDTVVG

SEQ ID NO: 2821902 - protein, 32 aa, Entamoeba invadens
LNTAKLMLEFIPLKKYFALLLVMFGVETANSQ

SEQ ID NO: 2821903 - protein, 31 aa, Entamoeba invadens
LNTCLPQNLTLLKYTFKLFSKVNAFSQTNKT

SEQ ID NO: 2821904 - protein, 26 aa, Entamoeba invadens
LNTELYYHMVFSLFGLIGNFYEKSHV

SEQ ID NO: 2821905 - protein, 26 aa, Entamoeba invadens
LNTNKLPFNLFLYVDGLQLPETNSYL

SEQ ID NO: 2821906 - protein, 33 aa, Entamoeba invadens
LNTPLDYSFCRYPMKYRVGKWFKLNMTPIKNNY

SEQ ID NO: 2821907 - protein, 34 aa, Entamoeba invadens
LNVEGKFDFCLPIPPTLYPNCKRLAFSKNKCVEC

SEQ ID NO: 2821908 - protein, 34 aa, Entamoeba invadens
LNVEGKFDFCLPIPPTVYPNCKRLAFSTSKCVEC

SEQ ID NO: 2821909 - protein, 19 aa, Entamoeba invadens
LNVIPNTKLYGILSTSNKF

SEQ ID NO: 2821910 - protein, 25 aa, Entamoeba invadens
LNVLMPQVMSWRDILRYAYDLLLHK

SEQ ID NO: 2821911 - protein, 24 aa, Entamoeba invadens
LNVRLSSMGLMYPRLRIIHSVLNS

SEQ ID NO: 2821912 - protein, 32 aa, Entamoeba invadens
LNVTPLIERLLLYLLYFWDRAGLPMAIKNLLA

SEQ ID NO: 2821913 - protein, 23 aa, Entamoeba invadens
LNVWNTIIFMKSYQSLFVETGVI

SEQ ID NO: 2821914 - protein, 21 aa, Entamoeba invadens
LNYFLDLGRCFPCSSKLHCST

SEQ ID NO: 2821915 - protein, 42 aa, Entamoeba invadens
LNYGVIIGVPLAVIIICIILLIIVFIIIQKVLQARRRSKQAK

SEQ ID NO: 2821916 - protein, 24 aa, Entamoeba invadens
LNYNDFLPHFIHEAQLMETIRSQF

SEQ ID NO: 2821917 - protein, 19 aa, Entamoeba invadens
LPADKFLSILTTLIYTEDG

SEQ ID NO: 2821918 - protein, 26 aa, Entamoeba invadens
LPAGKVYYLALFANGVYRYSTQIQIT

SEQ ID NO: 2821919 - protein, 25 aa, Entamoeba invadens
LPCFTDFYAKVVIFTASFFGEYSMR

SEQ ID NO: 2821920 - protein, 17 aa, Entamoeba invadens
LPCIFQYLSRRKAIKMY

SEQ ID NO: 2821921 - protein, 17 aa, Entamoeba invadens
LPCQNSESECLTCKSST

SEQ ID NO: 2821922 - protein, 28 aa, Entamoeba invadens
LPDGKIPLWRYLVFIPAMLICVCLCILS

SEQ ID NO: 2821923 - protein, 18 aa, Entamoeba invadens
LPDLSIFSALYSLVNVQS

SEQ ID NO: 2821924 - protein, 17 aa, Entamoeba invadens
LPDNFPFTQIPFEGKDV

SEQ ID NO: 2821925 - protein, 28 aa, Entamoeba invadens
LPEGFGFEFKKKPLVWAPTTLNVTSKST

SEQ ID NO: 2821926 - protein, 25 aa, Entamoeba invadens
LPERAMIFPLISFAIILFVFNPIFR

SEQ ID NO: 2821927 - protein, 19 aa, Entamoeba invadens
LPEWLYELTSLKELKINSN

SEQ ID NO: 2821928 - protein, 19 aa, Entamoeba invadens
LPFCLSSMTLIRYVDKDRL

SEQ ID NO: 2821929 - protein, 17 aa, Entamoeba invadens
LPFDLVTFPFFTVYCMC

SEQ ID NO: 2821930 - protein, 25 aa, Entamoeba invadens
LPFILKFIYELLNPPKYMIVGKRKF

SEQ ID NO: 2821931 - protein, 19 aa, Entamoeba invadens
LPFRFVYICEYVGPLAIYV

SEQ ID NO: 2821932 - protein, 22 aa, Entamoeba invadens
LPGFEFYQWFGAMLEQFEDFGI

SEQ ID NO: 2821933 - protein, 17 aa, Entamoeba invadens
LPGYILNNGKCSICLAG

SEQ ID NO: 2821934 - protein, 19 aa, Entamoeba invadens
LPITWSYVHKMCYTPKTRY

SEQ ID NO: 2821935 - protein, 26 aa, Entamoeba invadens
LPKDVYLPYIMQFAMKLMASVRMVKE

SEQ ID NO: 2821936 - protein, 23 aa, Entamoeba invadens
LPKTWKFTTLWNGRLAILTIRII

SEQ ID NO: 2821937 - protein, 18 aa, Entamoeba invadens
LPLIITRGNNVFGPHQFP

SEQ ID NO: 2821938 - protein, 19 aa, Entamoeba invadens
LPLSVYFNYIKSGSFILFA

SEQ ID NO: 2821939 - protein, 27 aa, Entamoeba invadens
LPMVHMICMLVLWLVPMTRRIQNMMFT

SEQ ID NO: 2821940 - protein, 48 aa, Entamoeba invadens
LPNTSKTLCEEHVVWWVLFLVVLFVIIIIIVVISITILIIFKVIEMKR

SEQ ID NO: 2821941 - protein, 23 aa, Entamoeba invadens
LPNYVFAYICDSCALFDINCLTC

SEQ ID NO: 2821942 - protein, 23 aa, Entamoeba invadens
LPQVCMVIQFFALGSLGEYLRKG

SEQ ID NO: 2821943 - protein, 34 aa, Entamoeba invadens
LPSDIYSLAMIIYTSLNWALIVPSKNFNTNWEVV

SEQ ID NO: 2821944 - protein, 48 aa, Entamoeba invadens
LPSEDGMYCIYTIPLWFIIVMVLLSIFILICIVFVTYFIVQKTIKLVY

SEQ ID NO: 2821945 - protein, 25 aa, Entamoeba invadens
LPSEGITFKLFPGNHKIINKTLSAN

SEQ ID NO: 2821946 - protein, 23 aa, Entamoeba invadens
LPSIDNGFIIKCGLNTHLDVTIN

SEQ ID NO: 2821947 - protein, 20 aa, Entamoeba invadens
LPSLIRRQIIINKQLDIYMN

SEQ ID NO: 2821948 - protein, 18 aa, Entamoeba invadens
LPTKLCDLFGKYSLSKCC

SEQ ID NO: 2821949 - protein, 19 aa, Entamoeba invadens
LPTLVLQCLNTLSSIGGKL

SEQ ID NO: 2821950 - protein, 25 aa, Entamoeba invadens
LPTTLSIGSLKYIWVQSDAATSITD

SEQ ID NO: 2821951 - protein, 24 aa, Entamoeba invadens
LPVFWPILLLYFIVLFIVTMQTQI

SEQ ID NO: 2821952 - protein, 20 aa, Entamoeba invadens
LPVKICFALYSLMTHYQTTQ

SEQ ID NO: 2821953 - protein, 19 aa, Entamoeba invadens
LPVKSLHDIIFKCQLRVDG

SEQ ID NO: 2821954 - protein, 26 aa, Entamoeba invadens
LPVNYSLKFFRYFPSSVEFVVQAMSA

SEQ ID NO: 2821955 - protein, 26 aa, Entamoeba invadens
LPVPYPLLWCRYSFFIVLYPMGVSGE

SEQ ID NO: 2821956 - protein, 27 aa, Entamoeba invadens
LPVSMPIHFLVWPLEQRADICEYLINT

SEQ ID NO: 2821957 - protein, 27 aa, Entamoeba invadens
LQAIDNTCVFGYYGVCLDLIQNIHIHL

SEQ ID NO: 2821958 - protein, 23 aa, Entamoeba invadens
LQCKDEYYLFTPNNICLLECPDG

SEQ ID NO: 2821959 - protein, 23 aa, Entamoeba invadens
LQCKKLLDMFSTYAIDSSLPKIK

SEQ ID NO: 2821960 - protein, 18 aa, Entamoeba invadens
LQCSVQTDIFLSISETLK

SEQ ID NO: 2821961 - protein, 32 aa, Entamoeba invadens
LQEAYSWSTYLFIFQGILILAMSLVQTYLIKK

SEQ ID NO: 2821962 - protein, 20 aa, Entamoeba invadens
LQEDFKFSYPIVISKLNNNT

SEQ ID NO: 2821963 - protein, 24 aa, Entamoeba invadens
LQENAQCIIGKYPNTSSPFSCTFC

SEQ ID NO: 2821964 - protein, 23 aa, Entamoeba invadens
LQFSNFLFGNFDYSFCPCNNYKE

SEQ ID NO: 2821965 - protein, 23 aa, Entamoeba invadens
LQFTEYFFKQNIPPATQWKIFKY

SEQ ID NO: 2821966 - protein, 27 aa, Entamoeba invadens
LQFTIPVTKLPKNSFLKVFNLLGGHVN

SEQ ID NO: 2821967 - protein, 20 aa, Entamoeba invadens
LQHVFYLKRFLLNTENNWGR

SEQ ID NO: 2821968 - protein, 20 aa, Entamoeba invadens
LQIDIFCGQQINFKGRIEEK

SEQ ID NO: 2821969 - protein, 26 aa, Entamoeba invadens
LQIKDEIIAQYFFIDSLVITHNATNN

SEQ ID NO: 2821970 - protein, 20 aa, Entamoeba invadens
LQITILLIMNLIVSPMYFIN

SEQ ID NO: 2821971 - protein, 24 aa, Entamoeba invadens
LQKMRSLFVLEFVGAVLVGEKKMI

SEQ ID NO: 2821972 - protein, 24 aa, Entamoeba invadens
LQKNTVIILVVCGYSFPASLSLDT

SEQ ID NO: 2821973 - protein, 18 aa, Entamoeba invadens
LQLAVQTLYALVFDGSRD

SEQ ID NO: 2821974 - protein, 18 aa, Entamoeba invadens
LQLDAAYEKQDFGRFLTL

SEQ ID NO: 2821975 - protein, 20 aa, Entamoeba invadens
LQLFLVVPTLISLVKSIQRV

SEQ ID NO: 2821976 - protein, 18 aa, Entamoeba invadens
LQLVFFAIHFFFTTTHNV

SEQ ID NO: 2821977 - protein, 18 aa, Entamoeba invadens
LQMLWVNLIMDTMAALAL

SEQ ID NO: 2821978 - protein, 26 aa, Entamoeba invadens
LQNCLMYHRFMSNGNYYYVKFQNTDP

SEQ ID NO: 2821979 - protein, 30 aa, Entamoeba invadens
LQNDLVPIFLERLFAFPLDKLNISYKMLCA

SEQ ID NO: 2821980 - protein, 42 aa, Entamoeba invadens
LQNFYDKLLELFLYSIGMLFTIYFYAGLLLSSKEKLSIRIKT

SEQ ID NO: 2821981 - protein, 24 aa, Entamoeba invadens
LQNNLEIFALKIVLNEVLSLSTKN

SEQ ID NO: 2821982 - protein, 25 aa, Entamoeba invadens
LQNRNKVFKFLTNDLEISDSTLNEQ

SEQ ID NO: 2821983 - protein, 17 aa, Entamoeba invadens
LQNWGVESLPVINKIIL

SEQ ID NO: 2821984 - protein, 22 aa, Entamoeba invadens
LQQLRHQMIVNLIGAVYTEGEV

SEQ ID NO: 2821985 - protein, 20 aa, Entamoeba invadens
LQQMCSCAFHIFALVKNDPV

SEQ ID NO: 2821986 - protein, 23 aa, Entamoeba invadens
LQQPMYHFYISGSLKRVPSKKSK

SEQ ID NO: 2821987 - protein, 24 aa, Entamoeba invadens
LQSDKTCVFKRDIGCEAYTSENKC

SEQ ID NO: 2821988 - protein, 22 aa, Entamoeba invadens
LQSFLIEIFLYAIAFNYHYQGG

SEQ ID NO: 2821989 - protein, 18 aa, Entamoeba invadens
LQTLGLLNNEWKSSCDKM

SEQ ID NO: 2821990 - protein, 21 aa, Entamoeba invadens
LQTLVIFCDGNLYKNYFDLFE

SEQ ID NO: 2821991 - protein, 23 aa, Entamoeba invadens
LQTQKWRAFFKSLKGKPDAEVIG

SEQ ID NO: 2821992 - protein, 40 aa, Entamoeba invadens
LQTVIKEKTGLLINPYFSCSKIMWLFENVPEAKKLADEGN

SEQ ID NO: 2821993 - protein, 25 aa, Entamoeba invadens
LQYITELFYHGINAPTGVLGEINLN

SEQ ID NO: 2821994 - protein, 22 aa, Entamoeba invadens
LRCEDGYFLLSTWCFPCQHNCD

SEQ ID NO: 2821995 - protein, 25 aa, Entamoeba invadens
LRCTEAIYMPIPQSYTFHHAITADL

SEQ ID NO: 2821996 - protein, 25 aa, Entamoeba invadens
LREKVFKRLAFIFYAGENETLDSST

SEQ ID NO: 2821997 - protein, 17 aa, Entamoeba invadens
LRFFHYLDYLKQHINNI

SEQ ID NO: 2821998 - protein, 19 aa, Entamoeba invadens
LRFLIVYFVGGIIGNCFSV

SEQ ID NO: 2821999 - protein, 18 aa, Entamoeba invadens
LRIGLYKKIILYLRNEKT

SEQ ID NO: 2822000 - protein, 25 aa, Entamoeba invadens
LRIRNGLIGLIFNKALKLNSAGIED

SEQ ID NO: 2822001 - protein, 28 aa, Entamoeba invadens
LRKAIEKVVVLLYFGVSLPEILVYLGVS

SEQ ID NO: 2822002 - protein, 20 aa, Entamoeba invadens
LRKCKVCAIGFYPDETSGKC

SEQ ID NO: 2822003 - protein, 18 aa, Entamoeba invadens
LRLKMMRDASKGILYLHS

SEQ ID NO: 2822004 - protein, 20 aa, Entamoeba invadens
LRLVKTVVLCILLKIQNKNQ

SEQ ID NO: 2822005 - protein, 17 aa, Entamoeba invadens
LRNDIIYKCGDSVYLNI

SEQ ID NO: 2822006 - protein, 26 aa, Entamoeba invadens
LRNEKYNAILIPNASLQFSKAPALVE

SEQ ID NO: 2822007 - protein, 18 aa, Entamoeba invadens
LRNIALTKRFNLIDNIQT

SEQ ID NO: 2822008 - protein, 24 aa, Entamoeba invadens
LRNSIISMIYYKALRLNVLDIEDT

SEQ ID NO: 2822009 - protein, 39 aa, Entamoeba invadens
LRNVTLIKMCFYKNSSFFLILFWYSFFSGYSGMSMYDDY

SEQ ID NO: 2822010 - protein, 24 aa, Entamoeba invadens
LRQCQTCSKGLYPLQTSPYTCQQC

SEQ ID NO: 2822011 - protein, 27 aa, Entamoeba invadens
LRQEKTYYLKLPYKLKVRMLFDISRGM

SEQ ID NO: 2822012 - protein, 17 aa, Entamoeba invadens
LRRLHVFGEVFSENGFF

SEQ ID NO: 2822013 - protein, 17 aa, Entamoeba invadens
LRSGICTPYTLIEFCIR

SEQ ID NO: 2822014 - protein, 28 aa, Entamoeba invadens
LRSGYACEFSLFLTPKFTCKIESTVLII

SEQ ID NO: 2822015 - protein, 25 aa, Entamoeba invadens
LRTRPSLVYLPPHPGTLIVGDLHGQ

SEQ ID NO: 2822016 - protein, 20 aa, Entamoeba invadens
LRVKFISDLANGIKYLHENG

SEQ ID NO: 2822017 - protein, 19 aa, Entamoeba invadens
LRYLPVIHPVITKDKIRCC

SEQ ID NO: 2822018 - protein, 20 aa, Entamoeba invadens
LSACISCDFGLYLEGDGNCV

SEQ ID NO: 2822019 - protein, 26 aa, Entamoeba invadens
LSAEFDYFIFISSPQAQPLSIAWSIV

SEQ ID NO: 2822020 - protein, 17 aa, Entamoeba invadens
LSAKKFYVIHRTSLRVS

SEQ ID NO: 2822021 - protein, 18 aa, Entamoeba invadens
LSALIVVGLFILDLVFML

SEQ ID NO: 2822022 - protein, 24 aa, Entamoeba invadens
LSAPIIVLVVFAISFVLFIVSIIV

SEQ ID NO: 2822023 - protein, 51 aa, Entamoeba invadens
LSCDKIVRYGLIIGLPVSVVSILIIIIIIIIVITVIIIQRRKRKIEEQKIC

SEQ ID NO: 2822024 - protein, 21 aa, Entamoeba invadens
LSCFIVICVCSYYLVIVVVFS

SEQ ID NO: 2822025 - protein, 17 aa, Entamoeba invadens
LSCGLKWCKERRSLFCV

SEQ ID NO: 2822026 - protein, 20 aa, Entamoeba invadens
LSCISGYVLQPMGECVGCES

SEQ ID NO: 2822027 - protein, 18 aa, Entamoeba invadens
LSCNTRDIKWIKCDIQKA

SEQ ID NO: 2822028 - protein, 22 aa, Entamoeba invadens
LSCYDGYFLNGKICDTCSAGTY

SEQ ID NO: 2822029 - protein, 23 aa, Entamoeba invadens
LSDDNISCLLAYTTTSHYNSSTA

SEQ ID NO: 2822030 - protein, 20 aa, Entamoeba invadens
LSDEIVIISLNLNSGKQQAT

SEQ ID NO: 2822031 - protein, 29 aa, Entamoeba invadens
LSDKKSMCVLAFLNLTYYNYDTSKSDVND

SEQ ID NO: 2822032 - protein, 29 aa, Entamoeba invadens
LSDQGLTLQLSFLPTLPLNDNDMVPNEYK

SEQ ID NO: 2822033 - protein, 17 aa, Entamoeba invadens
LSDSLKWCKIENTIICV

SEQ ID NO: 2822034 - protein, 29 aa, Entamoeba invadens
LSDVLNILLFLVLFARLWAFIDQKTGGLT

SEQ ID NO: 2822035 - protein, 24 aa, Entamoeba invadens
LSECLGCLAGFYSLKNASSCTPCS

SEQ ID NO: 2822036 - protein, 25 aa, Entamoeba invadens
LSEEIHFMIEVMKSYIWTSIGSNIL

SEQ ID NO: 2822037 - protein, 20 aa, Entamoeba invadens
LSEIVWCFGPLDGLVVSFFF

SEQ ID NO: 2822038 - protein, 20 aa, Entamoeba invadens
LSELLWAKSVLRNSSLFSSQ

SEQ ID NO: 2822039 - protein, 28 aa, Entamoeba invadens
LSFDSIGMFFFPSCMPTFLSKLVVFTIT

SEQ ID NO: 2822040 - protein, 19 aa, Entamoeba invadens
LSFLFDSTVGYVMEISRAE

SEQ ID NO: 2822041 - protein, 18 aa, Entamoeba invadens
LSFLFNSTVGYVMEISRA

SEQ ID NO: 2822042 - protein, 32 aa, Entamoeba invadens
LSFVASIILYIIIYTLVMFISGLSVRGISAYG

SEQ ID NO: 2822043 - protein, 29 aa, Entamoeba invadens
LSFYSQLVDLIYFLLLESKTSWGIVPGFA

SEQ ID NO: 2822044 - protein, 22 aa, Entamoeba invadens
LSGCFVSWYFLVRNESLSKVDV

SEQ ID NO: 2822045 - protein, 20 aa, Entamoeba invadens
LSGFFCPNGKNIYPCPPGTY

SEQ ID NO: 2822046 - protein, 18 aa, Entamoeba invadens
LSGINLQSALTVNGFFHF

SEQ ID NO: 2822047 - protein, 24 aa, Entamoeba invadens
LSGLFKWYWRGHWGDEKMGLLRLI

SEQ ID NO: 2822048 - protein, 23 aa, Entamoeba invadens
LSGLFLLFVKHKDGLFKYYVELY

SEQ ID NO: 2822049 - protein, 17 aa, Entamoeba invadens
LSGLIHWTFTKTSFKSI

SEQ ID NO: 2822050 - protein, 28 aa, Entamoeba invadens
LSGTIVVLWVLYLLRQRIKVLPSFPCTC

SEQ ID NO: 2822051 - protein, 34 aa, Entamoeba invadens
LSHIRKALLLFTNFPMIFIPNSRGIYLKELLLLF

SEQ ID NO: 2822052 - protein, 19 aa, Entamoeba invadens
LSHVIIIPASCFEGCTSLK

SEQ ID NO: 2822053 - protein, 34 aa, Entamoeba invadens
LSIALPVVITVIIIIVLIVTLFVVCLLYTSHKLK

SEQ ID NO: 2822054 - protein, 29 aa, Entamoeba invadens
LSIEFPHTTPVKPIVVRPSPAEKKRTVCG

SEQ ID NO: 2822055 - protein, 19 aa, Entamoeba invadens
LSIFISMVCISLYGLLCAN

SEQ ID NO: 2822056 - protein, 37 aa, Entamoeba invadens
LSIGFGTLGLLLLLVVIVVLICVLFFKTKRTDLSVYK

SEQ ID NO: 2822057 - protein, 30 aa, Entamoeba invadens
LSIILPIIFGIFIVVIIITISCILFCIHYR

SEQ ID NO: 2822058 - protein, 27 aa, Entamoeba invadens
LSIIVFCLLFVFFITLGIFKQNNTNKI

SEQ ID NO: 2822059 - protein, 19 aa, Entamoeba invadens
LSILLSFLFFMIFSVFDVK

SEQ ID NO: 2822060 - protein, 27 aa, Entamoeba invadens
LSITFELMRLDFLSGLKDYPLVVELST

SEQ ID NO: 2822061 - protein, 18 aa, Entamoeba invadens
LSITFLVMWLGGDLTNLI

SEQ ID NO: 2822062 - protein, 18 aa, Entamoeba invadens
LSITLPAGKVYYLALFAN

SEQ ID NO: 2822063 - protein, 18 aa, Entamoeba invadens
LSITRREALALEKAKKLA

SEQ ID NO: 2822064 - protein, 23 aa, Entamoeba invadens
LSIYLLPCRPLINITYFLAVMSM

SEQ ID NO: 2822065 - protein, 20 aa, Entamoeba invadens
LSKIFPERLIKEKLPRKSSE

SEQ ID NO: 2822066 - protein, 19 aa, Entamoeba invadens
LSKLALFRDSLKKIRELNS

SEQ ID NO: 2822067 - protein, 18 aa, Entamoeba invadens
LSKLIECGTLLIKKTAES

SEQ ID NO: 2822068 - protein, 25 aa, Entamoeba invadens
LSKMEKLIFEKNELSILIIETAQQL

SEQ ID NO: 2822069 - protein, 22 aa, Entamoeba invadens
LSKSMMVIFHTPNDPKFILNFK

SEQ ID NO: 2822070 - protein, 25 aa, Entamoeba invadens
LSKTQPFHLTLFKRVPTGTNGGVSL

SEQ ID NO: 2822071 - protein, 21 aa, Entamoeba invadens
LSKWFVIPTVIFLGPALGIVY

SEQ ID NO: 2822072 - protein, 17 aa, Entamoeba invadens
LSLAILCNSQTATTSKS

SEQ ID NO: 2822073 - protein, 25 aa, Entamoeba invadens
LSLAVMFSIPYFLNPKKVNCLSNGE

SEQ ID NO: 2822074 - protein, 31 aa, Entamoeba invadens
LSLCNNINIFSLFLKLKIRQKQKTPDCGYSP

SEQ ID NO: 2822075 - protein, 24 aa, Entamoeba invadens
LSLCQFLTPKGCLRCFPTYYIDHN

SEQ ID NO: 2822076 - protein, 22 aa, Entamoeba invadens
LSLGLLLVFYVLTSFSAVYILE

SEQ ID NO: 2822077 - protein, 17 aa, Entamoeba invadens
LSLMLSQSIAFQCSEGC

SEQ ID NO: 2822078 - protein, 24 aa, Entamoeba invadens
LSLSLALQWCWERGVIQCFSDNVT

SEQ ID NO: 2822079 - protein, 30 aa, Entamoeba invadens
LSLTSSFVIIIISLNWIRASQLFYISKDTS

SEQ ID NO: 2822080 - protein, 29 aa, Entamoeba invadens
LSMHPKTLILFDKLLAFIPSTVQVVLIVF

SEQ ID NO: 2822081 - protein, 37 aa, Entamoeba invadens
LSMIFIITTLIRFFLTPYRFVILRRYFFLQGVIYFIR

SEQ ID NO: 2822082 - protein, 17 aa, Entamoeba invadens
LSNATIIGLYIVLGHSM

SEQ ID NO: 2822083 - protein, 26 aa, Entamoeba invadens
LSNDKWRVLVFDDFCSQLLSMYFVVA

SEQ ID NO: 2822084 - protein, 23 aa, Entamoeba invadens
LSNFYRLLISSFLFNFSAYFLWT

SEQ ID NO: 2822085 - protein, 26 aa, Entamoeba invadens
LSNGYCNFSLPYCKYYGKLSSVTKCL

SEQ ID NO: 2822086 - protein, 17 aa, Entamoeba invadens
LSNKRLIRFCPNGRNLN

SEQ ID NO: 2822087 - protein, 24 aa, Entamoeba invadens
LSNLPLLFLAYYAITLVVSKTMGE

SEQ ID NO: 2822088 - protein, 17 aa, Entamoeba invadens
LSNMTFTKGIGTPVYMA

SEQ ID NO: 2822089 - protein, 30 aa, Entamoeba invadens
LSNNLLKTFPLLGRVKLRYLDISNNPLTSL

SEQ ID NO: 2822090 - protein, 24 aa, Entamoeba invadens
LSNSYPVFDIFSLSLWDINSTVQS

SEQ ID NO: 2822091 - protein, 32 aa, Entamoeba invadens
LSNYMSWNLDIYKWYTIYSNNPMMWITGSNNH

SEQ ID NO: 2822092 - protein, 46 aa, Entamoeba invadens
LSPALTNFLFWGVGSISYFILYMLILIISLGVYIKLTRVIKKQTYN

SEQ ID NO: 2822093 - protein, 18 aa, Entamoeba invadens
LSPFLLTEACCSGNFVYK

SEQ ID NO: 2822094 - protein, 19 aa, Entamoeba invadens
LSPLLFTVLASVIPQAVYY

SEQ ID NO: 2822095 - protein, 17 aa, Entamoeba invadens
LSPQLIGVFVSFGGWIC

SEQ ID NO: 2822096 - protein, 27 aa, Entamoeba invadens
LSQDIAKFFRIVISDGFFVGYGLTETC

SEQ ID NO: 2822097 - protein, 30 aa, Entamoeba invadens
LSQHLLDYYERFLFCKDTMLSISIIHSIRK

SEQ ID NO: 2822098 - protein, 21 aa, Entamoeba invadens
LSQIIFWPLYPDDLTSRFLGT

SEQ ID NO: 2822099 - protein, 37 aa, Entamoeba invadens
LSRNKYMLLIFHTPNSPKYIFHFEPQVVILSARTTKT

SEQ ID NO: 2822100 - protein, 30 aa, Entamoeba invadens
LSSKGLTMGISFFPTLPLNKDDMIPNEYKV

SEQ ID NO: 2822101 - protein, 26 aa, Entamoeba invadens
LSSLSLFFLHFWKNGLLFLRGPVLVM

SEQ ID NO: 2822102 - protein, 28 aa, Entamoeba invadens
LSSLYSHYKYVFLLIVGDTADLFMKNEA

SEQ ID NO: 2822103 - protein, 26 aa, Entamoeba invadens
LSSMFPYIFMEGLGYLISNQRLIRFC

SEQ ID NO: 2822104 - protein, 23 aa, Entamoeba invadens
LSSNTKVIFCKNSFYLNYEENNC

SEQ ID NO: 2822105 - protein, 32 aa, Entamoeba invadens
LSSPFPQFKFMEEIRLFIKCGNLLQIPKSKIP

SEQ ID NO: 2822106 - protein, 18 aa, Entamoeba invadens
LSSPSLYSKICNFGAQIV

SEQ ID NO: 2822107 - protein, 27 aa, Entamoeba invadens
LSSSIFLFVIRHLPVLYFLSPVITSIN

SEQ ID NO: 2822108 - protein, 24 aa, Entamoeba invadens
LSSTPLDIDYLKTPIKIVFSNGNT

SEQ ID NO: 2822109 - protein, 19 aa, Entamoeba invadens
LSSVIPITAGVPIAIILII

SEQ ID NO: 2822110 - protein, 27 aa, Entamoeba invadens
LSTAMLVYNVLYIGGAITFTKTKQSNY

SEQ ID NO: 2822111 - protein, 35 aa, Entamoeba invadens
LSTGVAVLGVLFIIAVIIICVLLTLFVLSHKKQQE

SEQ ID NO: 2822112 - protein, 25 aa, Entamoeba invadens
LSTKRTFALKILKNKKAYFRQGLLE

SEQ ID NO: 2822113 - protein, 22 aa, Entamoeba invadens
LSTNYQILSCKKPLILRENVCE

SEQ ID NO: 2822114 - protein, 29 aa, Entamoeba invadens
LSTTFYRLCCYIIVYFSFMAKGQSSRSMQ

SEQ ID NO: 2822115 - protein, 18 aa, Entamoeba invadens
LSTVDYKYGFNSLLSPIS

SEQ ID NO: 2822116 - protein, 18 aa, Entamoeba invadens
LSTWIKKVNFVKNSPNVI

SEQ ID NO: 2822117 - protein, 31 aa, Entamoeba invadens
LSVACVVCILFIIVTIIITFIIIYTKRQENK

SEQ ID NO: 2822118 - protein, 29 aa, Entamoeba invadens
LSVGLYVLLFLLDLVYFFVVNKASKNLRR

SEQ ID NO: 2822119 - protein, 24 aa, Entamoeba invadens
LSVKEFFSYFTLSSYLIPIACAVC

SEQ ID NO: 2822120 - protein, 31 aa, Entamoeba invadens
LSVKSVVLLAPLFTMIRLVLKTQVTQLPIFE

SEQ ID NO: 2822121 - protein, 17 aa, Entamoeba invadens
LSVLATGRTAAGKVFGI

SEQ ID NO: 2822122 - protein, 24 aa, Entamoeba invadens
LSVLVNAIYFEGKWATPFDVLPDK

SEQ ID NO: 2822123 - protein, 32 aa, Entamoeba invadens
LSVNSRIGVLLYFMALLPDSLIPKGVLDAMRK

SEQ ID NO: 2822124 - protein, 25 aa, Entamoeba invadens
LSVPWTIFVFVFKPVFVISSTFSGY

SEQ ID NO: 2822125 - protein, 25 aa, Entamoeba invadens
LSVSMMFWILYFNSPSAVFRITDEW

SEQ ID NO: 2822126 - protein, 40 aa, Entamoeba invadens
LSVTFVVIVIIIGTMLLLTLYYLYIHFGTKKKMQNICVFK

SEQ ID NO: 2822127 - protein, 21 aa, Entamoeba invadens
LSVVNVIIWMIKLPFAKPKTL

SEQ ID NO: 2822128 - protein, 23 aa, Entamoeba invadens
LSVVTCIGVIQPYIDSQAPPTTD

SEQ ID NO: 2822129 - protein, 18 aa, Entamoeba invadens
LSVVYLILTLAVSVFSVC

SEQ ID NO: 2822130 - protein, 19 aa, Entamoeba invadens
LSYAKYNLSFKNTPIPFVN

SEQ ID NO: 2822131 - protein, 27 aa, Entamoeba invadens
LSYARRAWPIVIVFTSLIILLQMVIQL

SEQ ID NO: 2822132 - protein, 35 aa, Entamoeba invadens
LSYETLLHSSWIIPTILSLFSDPLAPQLHLQLSIL

SEQ ID NO: 2822133 - protein, 21 aa, Entamoeba invadens
LSYFFYRTQDLARYPLIFVNA

SEQ ID NO: 2822134 - protein, 30 aa, Entamoeba invadens
LSYKCMPPLFFQVICHLAVTITLVGLSLAS

SEQ ID NO: 2822135 - protein, 25 aa, Entamoeba invadens
LSYLGWFCYGTYQSIMYFVLMILFN

SEQ ID NO: 2822136 - protein, 26 aa, Entamoeba invadens
LSYVIFMLFTLFFCGVLVVVIYFKPE

SEQ ID NO: 2822137 - protein, 24 aa, Entamoeba invadens
LTAGQWMIVNFDSSTIFITETSNT

SEQ ID NO: 2822138 - protein, 18 aa, Entamoeba invadens
LTCDVSCELCTNRDGCLT

SEQ ID NO: 2822139 - protein, 17 aa, Entamoeba invadens
LTCQYALDKPFLQLPCE

SEQ ID NO: 2822140 - protein, 30 aa, Entamoeba invadens
LTCYKYAARPPLQNVYLLEKVYNNSNAYGE

SEQ ID NO: 2822141 - protein, 25 aa, Entamoeba invadens
LTDIFIFEIWLYITWPWMCCCMVSL

SEQ ID NO: 2822142 - protein, 22 aa, Entamoeba invadens
LTDNILLPFSYKTNVKYVNQDF

SEQ ID NO: 2822143 - protein, 24 aa, Entamoeba invadens
LTEEKQFVWISENIKLFVKNEMNV

SEQ ID NO: 2822144 - protein, 29 aa, Entamoeba invadens
LTEEPNLLYFMEYLKNNTLLRQLYKVNEI

SEQ ID NO: 2822145 - protein, 28 aa, Entamoeba invadens
LTEVPQNWMYFFLFNDRLVETEVLSYDG

SEQ ID NO: 2822146 - protein, 19 aa, Entamoeba invadens
LTFALFPHIQTIQGTISEL

SEQ ID NO: 2822147 - protein, 17 aa, Entamoeba invadens
LTFFPPSFKQQIPQFPN

SEQ ID NO: 2822148 - protein, 22 aa, Entamoeba invadens
LTFLSFFVVLCLSADLPGSICY

SEQ ID NO: 2822149 - protein, 22 aa, Entamoeba invadens
LTFQKWQVWTLNEKLEGTMFEW

SEQ ID NO: 2822150 - protein, 24 aa, Entamoeba invadens
LTFSKNLLEIAFSSKCPMIALEIK

SEQ ID NO: 2822151 - protein, 20 aa, Entamoeba invadens
LTFVPLVNFLKQFQCKKIFL

SEQ ID NO: 2822152 - protein, 37 aa, Entamoeba invadens
LTGGQIFGIVFAVVFLVIIIAAFAAFVGYLGYKKYQS

SEQ ID NO: 2822153 - protein, 17 aa, Entamoeba invadens
LTGITTMTNFPFSVETE

SEQ ID NO: 2822154 - protein, 27 aa, Entamoeba invadens
LTGITYTVDYQCDGKWIVAVPSGDSKP

SEQ ID NO: 2822155 - protein, 25 aa, Entamoeba invadens
LTGTFQIVFWAYYPDEPYARVYGAL

SEQ ID NO: 2822156 - protein, 17 aa, Entamoeba invadens
LTHIATKMFSACVALKT

SEQ ID NO: 2822157 - protein, 22 aa, Entamoeba invadens
LTHLPCFKFLRKSNDLFVQMIA

SEQ ID NO: 2822158 - protein, 21 aa, Entamoeba invadens
LTIATLATFSLLDLSNRQNIV

SEQ ID NO: 2822159 - protein, 26 aa, Entamoeba invadens
LTIEFWQKEKHLWPYIYEFSQSDLDY

SEQ ID NO: 2822160 - protein, 20 aa, Entamoeba invadens
LTIITNAYYYCDYERNGTFY

SEQ ID NO: 2822161 - protein, 22 aa, Entamoeba invadens
LTILYLMKKLNGWIALVAILFI

SEQ ID NO: 2822162 - protein, 24 aa, Entamoeba invadens
LTINFSAFVFLESLSLRACQIDDM

SEQ ID NO: 2822163 - protein, 24 aa, Entamoeba invadens
LTKAHRLTYISAIAELYMRNGIPD

SEQ ID NO: 2822164 - protein, 18 aa, Entamoeba invadens
LTKATRFLQTSLPTLFAG

SEQ ID NO: 2822165 - protein, 22 aa, Entamoeba invadens
LTKDVLLKFEPNLNELPLCVII

SEQ ID NO: 2822166 - protein, 24 aa, Entamoeba invadens
LTKKCFEVFLEHPKIVLSAYLNLT

SEQ ID NO: 2822167 - protein, 22 aa, Entamoeba invadens
LTKLLKYKLLKNCNSLLMVTIT

SEQ ID NO: 2822168 - protein, 19 aa, Entamoeba invadens
LTKRIPLIFSTALSTWIDN

SEQ ID NO: 2822169 - protein, 31 aa, Entamoeba invadens
LTKYKYHMISVFFFILVLISLASPATTSIIS

SEQ ID NO: 2822170 - protein, 23 aa, Entamoeba invadens
LTKYLPQVFFEGSPPLSHCLCVP

SEQ ID NO: 2822171 - protein, 33 aa, Entamoeba invadens
LTLECWNPLFIVYVLLLCFISRAFNIFPITFIM

SEQ ID NO: 2822172 - protein, 30 aa, Entamoeba invadens
LTLESSQLWISFLSTFYTSKLILNGNSLAD

SEQ ID NO: 2822173 - protein, 18 aa, Entamoeba invadens
LTLFALTEWFLYCFSKKE

SEQ ID NO: 2822174 - protein, 20 aa, Entamoeba invadens
LTLFGLYVTSFMLVLLVFAT

SEQ ID NO: 2822175 - protein, 19 aa, Entamoeba invadens
LTLFLKLVKFHNIGNSLFL

SEQ ID NO: 2822176 - protein, 26 aa, Entamoeba invadens
LTLKTYMSHYCFCHRLNVAEVFLWNT

SEQ ID NO: 2822177 - protein, 17 aa, Entamoeba invadens
LTLSFLENGILQGSIFS

SEQ ID NO: 2822178 - protein, 17 aa, Entamoeba invadens
LTLSTLGAEPCYSKDKD

SEQ ID NO: 2822179 - protein, 18 aa, Entamoeba invadens
LTLSTLGAEPCYVKDMDK

SEQ ID NO: 2822180 - protein, 18 aa, Entamoeba invadens
LTLTLMIVIHLFPRLHFL

SEQ ID NO: 2822181 - protein, 28 aa, Entamoeba invadens
LTLVLLCSAPFMMGAMFFLGVTATIMTS

SEQ ID NO: 2822182 - protein, 29 aa, Entamoeba invadens
LTLVVIIPLFFISYFFYCYKTIPHLHSFF

SEQ ID NO: 2822183 - protein, 17 aa, Entamoeba invadens
LTMDLLFKTCLSIDKQE

SEQ ID NO: 2822184 - protein, 19 aa, Entamoeba invadens
LTMFIVHYLSLFAYGGHCF

SEQ ID NO: 2822185 - protein, 21 aa, Entamoeba invadens
LTMIFVRIVPFLHIFSESIVS

SEQ ID NO: 2822186 - protein, 25 aa, Entamoeba invadens
LTNGEPFYYYIYISITKLCDVDIEV

SEQ ID NO: 2822187 - protein, 26 aa, Entamoeba invadens
LTNPLNYKIPVWFLNRQKDIKDGKNC

SEQ ID NO: 2822188 - protein, 25 aa, Entamoeba invadens
LTNTFYFQNITFKYLYTSPVINTDI

SEQ ID NO: 2822189 - protein, 26 aa, Entamoeba invadens
LTNTNYFNRLFSSNPKLYRYGTTEDS

SEQ ID NO: 2822190 - protein, 25 aa, Entamoeba invadens
LTPDDGILPIYRLPKNKIRKEYPED

SEQ ID NO: 2822191 - protein, 17 aa, Entamoeba invadens
LTPKQKLPEYPPLFGGS

SEQ ID NO: 2822192 - protein, 28 aa, Entamoeba invadens
LTPSILSIFPKFFARRGFIPCIKKCRVW

SEQ ID NO: 2822193 - protein, 23 aa, Entamoeba invadens
LTPTERLHRFSIFKEKIADCRHR

SEQ ID NO: 2822194 - protein, 18 aa, Entamoeba invadens
LTQEGDRCCRCETGYFVL

SEQ ID NO: 2822195 - protein, 19 aa, Entamoeba invadens
LTQILFAFLVLTESKNEEK

SEQ ID NO: 2822196 - protein, 24 aa, Entamoeba invadens
LTQRAPVFFEFFNREISTFITDCF

SEQ ID NO: 2822197 - protein, 25 aa, Entamoeba invadens
LTRKLLTLLTLIGLLNVPLLVISLF

SEQ ID NO: 2822198 - protein, 34 aa, Entamoeba invadens
LTRLQVASLFALSFLGVFRLPLKFQDAKQFPRCL

SEQ ID NO: 2822199 - protein, 31 aa, Entamoeba invadens
LTSASPLPLIHDILPFGFYVKVGGSDVQIFE

SEQ ID NO: 2822200 - protein, 32 aa, Entamoeba invadens
LTSCSVLYHCLKIMAVLMAPFTPFFSEFCYQK

SEQ ID NO: 2822201 - protein, 24 aa, Entamoeba invadens
LTSGLLCTYLYNDYIMIYVSAATV

SEQ ID NO: 2822202 - protein, 18 aa, Entamoeba invadens
LTSIEKMAFFNCYSIKTL

SEQ ID NO: 2822203 - protein, 19 aa, Entamoeba invadens
LTSLGFLPTTLTTLNMRNL

SEQ ID NO: 2822204 - protein, 22 aa, Entamoeba invadens
LTSPYILNLINNTDNLKVAPDC

SEQ ID NO: 2822205 - protein, 20 aa, Entamoeba invadens
LTSVKILSPLQFIGISCISR

SEQ ID NO: 2822206 - protein, 22 aa, Entamoeba invadens
LTTIHPLLFVALTNCSYVFLAL

SEQ ID NO: 2822207 - protein, 30 aa, Entamoeba invadens
LTTIKATVDLVWRVWGALISAEPFDPSISE

SEQ ID NO: 2822208 - protein, 18 aa, Entamoeba invadens
LTTITFPTTAVTTFGKRV

SEQ ID NO: 2822209 - protein, 31 aa, Entamoeba invadens
LTTLSPLIFVLFLIIALLTSIPPHAPTRPST

SEQ ID NO: 2822210 - protein, 33 aa, Entamoeba invadens
LTTNAMIILNDYSYYYSYCPLKLYTNSSFTLNG

SEQ ID NO: 2822211 - protein, 34 aa, Entamoeba invadens
LTTNAMIILNDYSYYYSYCSLKLYINSSFTLNRH

SEQ ID NO: 2822212 - protein, 25 aa, Entamoeba invadens
LTTNDKIFVLYVSSLVTLSGNNNAI

SEQ ID NO: 2822213 - protein, 28 aa, Entamoeba invadens
LTTQQHLLLIFTVVMVMFVYQSDNYFCV

SEQ ID NO: 2822214 - protein, 19 aa, Entamoeba invadens
LTTVLVFLGNTAYPIVLFF

SEQ ID NO: 2822215 - protein, 20 aa, Entamoeba invadens
LTVFTAYSAECSPAVVGCTS

SEQ ID NO: 2822216 - protein, 19 aa, Entamoeba invadens
LTVHFVLLSTDKLKYRVST

SEQ ID NO: 2822217 - protein, 24 aa, Entamoeba invadens
LTVIGYIGIAIVLVATVVAVLLIT

SEQ ID NO: 2822218 - protein, 26 aa, Entamoeba invadens
LTVNSLFLNLVFSFTFGKITTNQNKD

SEQ ID NO: 2822219 - protein, 27 aa, Entamoeba invadens
LTVYTLYVPFFDTLVILFSYIACVRLQ

SEQ ID NO: 2822220 - protein, 30 aa, Entamoeba invadens
LTWKDPFDEKLFPYSWDITNLISRGERPTI

SEQ ID NO: 2822221 - protein, 21 aa, Entamoeba invadens
LTWWSILELAGFIVLFFSSLI

SEQ ID NO: 2822222 - protein, 21 aa, Entamoeba invadens
LTYPVVDLLFDILVGFDVEVG

SEQ ID NO: 2822223 - protein, 26 aa, Entamoeba invadens
LVACFCLWIFLLKGQSLTQMEQLFSE

SEQ ID NO: 2822224 - protein, 19 aa, Entamoeba invadens
LVAFDVFVFFALHIFHKEK

SEQ ID NO: 2822225 - protein, 18 aa, Entamoeba invadens
LVCHKLVVPFVKFLSESA

SEQ ID NO: 2822226 - protein, 18 aa, Entamoeba invadens
LVCLLCHSGFSLKTESDR

SEQ ID NO: 2822227 - protein, 21 aa, Entamoeba invadens
LVDHICVVLIILQRGKLLEGD

SEQ ID NO: 2822228 - protein, 25 aa, Entamoeba invadens
LVDLNGFIIYCKEGCLTCTNSLSCL

SEQ ID NO: 2822229 - protein, 24 aa, Entamoeba invadens
LVDLVGYLLVERKFLFVSQSIQVL

SEQ ID NO: 2822230 - protein, 17 aa, Entamoeba invadens
LVDPQIVVLKKGFACEF

SEQ ID NO: 2822231 - protein, 26 aa, Entamoeba invadens
LVDPWKSRYPLLYKIPNDNNRIINEK

SEQ ID NO: 2822232 - protein, 26 aa, Entamoeba invadens
LVEAIYPFQFEFPIISVLTNSLYDLM

SEQ ID NO: 2822233 - protein, 26 aa, Entamoeba invadens
LVEQGILLFILFYAFLEIGVYPQSFL

SEQ ID NO: 2822234 - protein, 25 aa, Entamoeba invadens
LVERWLCLCVDVIGAFVIFGSVAAA

SEQ ID NO: 2822235 - protein, 17 aa, Entamoeba invadens
LVEYFPQIWLTFRTKEC

SEQ ID NO: 2822236 - protein, 17 aa, Entamoeba invadens
LVFAVILTMISIYVAFA

SEQ ID NO: 2822237 - protein, 18 aa, Entamoeba invadens
LVFISFKRWRIIPSLLCL

SEQ ID NO: 2822238 - protein, 17 aa, Entamoeba invadens
LVFMLPATPFTLACGYL

SEQ ID NO: 2822239 - protein, 31 aa, Entamoeba invadens
LVFPVFQMLYRLFIRPFLNPNPIKKYKNEGA

SEQ ID NO: 2822240 - protein, 20 aa, Entamoeba invadens
LVFQFPLEKIVKMYSNKKEV

SEQ ID NO: 2822241 - protein, 18 aa, Entamoeba invadens
LVFSVYAEFTGSYCYSLT

SEQ ID NO: 2822242 - protein, 27 aa, Entamoeba invadens
LVGINSQTVILYLKAPKVLRVNLDTDV

SEQ ID NO: 2822243 - protein, 26 aa, Entamoeba invadens
LVGKHYVPLFPYFKDLEGCFRVVSDD

SEQ ID NO: 2822244 - protein, 17 aa, Entamoeba invadens
LVGRRGAAILPLYAIIH

SEQ ID NO: 2822245 - protein, 20 aa, Entamoeba invadens
LVIDEVIVVSLLDFKANTVT

SEQ ID NO: 2822246 - protein, 18 aa, Entamoeba invadens
LVIFTKILITKYPVTTLS

SEQ ID NO: 2822247 - protein, 24 aa, Entamoeba invadens
LVIKKLNIEQLATATFNGFTSVTV

SEQ ID NO: 2822248 - protein, 25 aa, Entamoeba invadens
LVILCMSPFTMMSMMGLGMSAGIFT

SEQ ID NO: 2822249 - protein, 20 aa, Entamoeba invadens
LVILITIGYFMLNIFHSPIN

SEQ ID NO: 2822250 - protein, 20 aa, Entamoeba invadens
LVILWNCLYWFTTLLCWTAI

SEQ ID NO: 2822251 - protein, 18 aa, Entamoeba invadens
LVIPLVILQALAITSLVL

SEQ ID NO: 2822252 - protein, 17 aa, Entamoeba invadens
LVITALSCYTKDADGCV

SEQ ID NO: 2822253 - protein, 28 aa, Entamoeba invadens
LVITVPVVIVFILFVVVITVIVSLYIYR

SEQ ID NO: 2822254 - protein, 33 aa, Entamoeba invadens
LVIVPSIFTRFYFIIVFFIVLSAAALFGVVFNR

SEQ ID NO: 2822255 - protein, 17 aa, Entamoeba invadens
LVKFSLMRDVAKALEEL

SEQ ID NO: 2822256 - protein, 18 aa, Entamoeba invadens
LVKIDLTGLQHISQRAFY

SEQ ID NO: 2822257 - protein, 18 aa, Entamoeba invadens
LVLDAVLAFLKIASTLPS

SEQ ID NO: 2822258 - protein, 33 aa, Entamoeba invadens
LVLFPEWSVKWWRRMYLRLLDLKRWKYITGIHY

SEQ ID NO: 2822259 - protein, 19 aa, Entamoeba invadens
LVLFSTLLRAQDVAPIECD

SEQ ID NO: 2822260 - protein, 24 aa, Entamoeba invadens
LVLGAPFGIGYWGWSDVAYYSDIT

SEQ ID NO: 2822261 - protein, 21 aa, Entamoeba invadens
LVLGYLFSLIVNYLISYLSAV

SEQ ID NO: 2822262 - protein, 17 aa, Entamoeba invadens
LVLQSVVGELSYVCFNA

SEQ ID NO: 2822263 - protein, 23 aa, Entamoeba invadens
LVLSATKWLYPLGKFGVLLGIFV

SEQ ID NO: 2822264 - protein, 17 aa, Entamoeba invadens
LVNFYNLSVTHTLSLED

SEQ ID NO: 2822265 - protein, 26 aa, Entamoeba invadens
LVNKTIIMMTMVSVYHLIIQREVFNS

SEQ ID NO: 2822266 - protein, 21 aa, Entamoeba invadens
LVPLFFITILSQSCSVITEMT

SEQ ID NO: 2822267 - protein, 18 aa, Entamoeba invadens
LVPLLLLIPASCSNKYIY

SEQ ID NO: 2822268 - protein, 18 aa, Entamoeba invadens
LVQLLNCYRIAAGSFSQK

SEQ ID NO: 2822269 - protein, 25 aa, Entamoeba invadens
LVQPNFYLITLLAVSIAAFPQVLDK

SEQ ID NO: 2822270 - protein, 18 aa, Entamoeba invadens
LVQSLWKNYKIILTQGMR

SEQ ID NO: 2822271 - protein, 32 aa, Entamoeba invadens
LVSAIYFLFTWGMTTLFFLFSLTFVMDVIVLL

SEQ ID NO: 2822272 - protein, 27 aa, Entamoeba invadens
LVSFFYKSRLLVLGALLLFVFSVPHKQ

SEQ ID NO: 2822273 - protein, 25 aa, Entamoeba invadens
LVSKPLFCLLLIAFVLLSVEPKPYV

SEQ ID NO: 2822274 - protein, 21 aa, Entamoeba invadens
LVSMFLFISLLGLSLFFGYQQ

SEQ ID NO: 2822275 - protein, 28 aa, Entamoeba invadens
LVSNIYMSVVWLRKYITDFLVEILPIIP

SEQ ID NO: 2822276 - protein, 19 aa, Entamoeba invadens
LVSPFFLYGFFSMLKKIIH

SEQ ID NO: 2822277 - protein, 18 aa, Entamoeba invadens
LVSWMYYHHNLHNPYFPS

SEQ ID NO: 2822278 - protein, 24 aa, Entamoeba invadens
LVTDIIPVMYKYYTTHLFNAPSKY

SEQ ID NO: 2822279 - protein, 20 aa, Entamoeba invadens
LVTEFCPLASLRKFMKVNAM

SEQ ID NO: 2822280 - protein, 22 aa, Entamoeba invadens
LVTEFCVYGSLRNFMKNMENEM

SEQ ID NO: 2822281 - protein, 24 aa, Entamoeba invadens
LVTFPFFTVYCMCHRLNIAEGFMW

SEQ ID NO: 2822282 - protein, 23 aa, Entamoeba invadens
LVTGFILKMWYKLPPMARDIIDK

SEQ ID NO: 2822283 - protein, 28 aa, Entamoeba invadens
LVVFGSSFAFFIYKTLMGGLTAIEGEMS

SEQ ID NO: 2822284 - protein, 18 aa, Entamoeba invadens
LVVFPQSLQTISLFGEIC

SEQ ID NO: 2822285 - protein, 20 aa, Entamoeba invadens
LVVGGLILVLVILLILIFVL

SEQ ID NO: 2822286 - protein, 40 aa, Entamoeba invadens
LVVGLPISVTLVVIILIVVIIIVVILWLQNQKQKKKEQNI

SEQ ID NO: 2822287 - protein, 23 aa, Entamoeba invadens
LVVGVAYFWYRSFGFHPGFIMKC

SEQ ID NO: 2822288 - protein, 31 aa, Entamoeba invadens
LVVIIITIVTIVFLFVLRKKDNKHTKNVCVF

SEQ ID NO: 2822289 - protein, 23 aa, Entamoeba invadens
LVVIIVTIITIVVLFVLRKKDNK

SEQ ID NO: 2822290 - protein, 30 aa, Entamoeba invadens
LVVISVIIGVIMFIYFGRKNPNRSNPYNYV

SEQ ID NO: 2822291 - protein, 22 aa, Entamoeba invadens
LVVLRRYFFLMGINFLIRSVCL

SEQ ID NO: 2822292 - protein, 19 aa, Entamoeba invadens
LVVPILLFYLGMNNGLSHY

SEQ ID NO: 2822293 - protein, 17 aa, Entamoeba invadens
LVWAPTTLNVTSKSTVY

SEQ ID NO: 2822294 - protein, 18 aa, Entamoeba invadens
LVWRMYIFMADMHTKYVL

SEQ ID NO: 2822295 - protein, 19 aa, Entamoeba invadens
LVYFTATWCRPCTLICSLF

SEQ ID NO: 2822296 - protein, 22 aa, Entamoeba invadens
LVYIMILFSYVFFKVFISCAVF

SEQ ID NO: 2822297 - protein, 19 aa, Entamoeba invadens
LVYVLLFPLILVSVGMMIL

SEQ ID NO: 2822298 - protein, 19 aa, Entamoeba invadens
LVYVVIQTFLMITVRSTDV

SEQ ID NO: 2822299 - protein, 17 aa, Entamoeba invadens
LVYYLNNTPLSRLQTMF

SEQ ID NO: 2822300 - protein, 32 aa, Entamoeba invadens
LWHKFALFISNKWYSLIVIVVVICLIIPFCVF

SEQ ID NO: 2822301 - protein, 32 aa, Entamoeba invadens
LWHKFAVFISNKWYSLIVIVVVICMIIPFCVF

SEQ ID NO: 2822302 - protein, 20 aa, Entamoeba invadens
LWLLQNFFLHVHHNYSCRAF

SEQ ID NO: 2822303 - protein, 19 aa, Entamoeba invadens
LWSYYCVLTLLYCGIMFVA

SEQ ID NO: 2822304 - protein, 19 aa, Entamoeba invadens
LWVIAFRSCMNFIVWAIPP

SEQ ID NO: 2822305 - protein, 17 aa, Entamoeba invadens
LWVLAFIQMSATVSVLL

SEQ ID NO: 2822306 - protein, 18 aa, Entamoeba invadens
LYALLFPVLVGLAIEEHP

SEQ ID NO: 2822307 - protein, 18 aa, Entamoeba invadens
LYCSLFVMSFILLRPGIL

SEQ ID NO: 2822308 - protein, 18 aa, Entamoeba invadens
LYDEMYFDKQTFYAVMPL

SEQ ID NO: 2822309 - protein, 24 aa, Entamoeba invadens
LYDGMRLFLYDNSSLYFDVYDKIH

SEQ ID NO: 2822310 - protein, 28 aa, Entamoeba invadens
LYECATWKDIYPKDRFKFAWNIVDFVVS

SEQ ID NO: 2822311 - protein, 21 aa, Entamoeba invadens
LYECFGWCNAYSEKEFKFPWK

SEQ ID NO: 2822312 - protein, 17 aa, Entamoeba invadens
LYELIALIAAPPKENNT

SEQ ID NO: 2822313 - protein, 26 aa, Entamoeba invadens
LYEQVQYIYYAVPRLYLMCCVGAAAI

SEQ ID NO: 2822314 - protein, 23 aa, Entamoeba invadens
LYEREYLILCKETYFSTQTQCLQ

SEQ ID NO: 2822315 - protein, 33 aa, Entamoeba invadens
LYETLKWEEAYDKDRFKFPWKIAEFVISGKRLE

SEQ ID NO: 2822316 - protein, 30 aa, Entamoeba invadens
LYETVTWKEAFPKEKFKFPWTVANFITGGK

SEQ ID NO: 2822317 - protein, 29 aa, Entamoeba invadens
LYEVFGWCEAYQQKKFKFPWKIAEFVIKG

SEQ ID NO: 2822318 - protein, 20 aa, Entamoeba invadens
LYEVFITYIQIVFLKMEMHI

SEQ ID NO: 2822319 - protein, 25 aa, Entamoeba invadens
LYFFIFSYIIILLYYMTMYFYYYFY

SEQ ID NO: 2822320 - protein, 17 aa, Entamoeba invadens
LYFISWVCESTTNEVGA

SEQ ID NO: 2822321 - protein, 25 aa, Entamoeba invadens
LYIAPTIFCFMKGQSYMFGELRKEE

SEQ ID NO: 2822322 - protein, 26 aa, Entamoeba invadens
LYIGTRHLCFLPSKFIGKSATVVSWS

SEQ ID NO: 2822323 - protein, 20 aa, Entamoeba invadens
LYIVLTIGVIFTPATLLIKK

SEQ ID NO: 2822324 - protein, 19 aa, Entamoeba invadens
LYIVNFVILSFSVNVPVIL

SEQ ID NO: 2822325 - protein, 26 aa, Entamoeba invadens
LYKFRSEFIVHFYGAVFIPNKVCLVT

SEQ ID NO: 2822326 - protein, 25 aa, Entamoeba invadens
LYKGGEYLFIVRTSSLLVSGVSLYV

SEQ ID NO: 2822327 - protein, 25 aa, Entamoeba invadens
LYKRTITIVVCCVIVVIIIAAFLMV

SEQ ID NO: 2822328 - protein, 26 aa, Entamoeba invadens
LYLGVYISVMLFLWGGSQLLQTSFFN

SEQ ID NO: 2822329 - protein, 17 aa, Entamoeba invadens
LYLPMLCLTNIICPPGC

SEQ ID NO: 2822330 - protein, 21 aa, Entamoeba invadens
LYLQPNSLIFVFGALSIHNIV

SEQ ID NO: 2822331 - protein, 17 aa, Entamoeba invadens
LYPMLQVDNIMPWCEGV

SEQ ID NO: 2822332 - protein, 19 aa, Entamoeba invadens
LYQTIFIAKKIILKTTNNE

SEQ ID NO: 2822333 - protein, 22 aa, Entamoeba invadens
LYRFGKYFKIYIPPDKNKHYTN

SEQ ID NO: 2822334 - protein, 17 aa, Entamoeba invadens
LYRICPRIWAYSVHTEM

SEQ ID NO: 2822335 - protein, 17 aa, Entamoeba invadens
LYRMLFGLAFGLIVYFG

SEQ ID NO: 2822336 - protein, 23 aa, Entamoeba invadens
LYSCYSIYYIFATILSMQIPFIN

SEQ ID NO: 2822337 - protein, 30 aa, Entamoeba invadens
LYSDIDQKFWIWYYLPNARQPVQLFINGVV

SEQ ID NO: 2822338 - protein, 20 aa, Entamoeba invadens
LYSECKYYLKQIIKNQCLQC

SEQ ID NO: 2822339 - protein, 34 aa, Entamoeba invadens
LYSNNTIDTLLYTSPFKVLLDSHLLRYGDSDKIY

SEQ ID NO: 2822340 - protein, 17 aa, Entamoeba invadens
LYSNRAFCYIKLECFKA

SEQ ID NO: 2822341 - protein, 17 aa, Entamoeba invadens
LYSVYVSVFRLQSDTLP

SEQ ID NO: 2822342 - protein, 18 aa, Entamoeba invadens
LYTAFFWCDYVLKNVYNV

SEQ ID NO: 2822343 - protein, 19 aa, Entamoeba invadens
LYTDHALATKFLQYLTFVL

SEQ ID NO: 2822344 - protein, 27 aa, Entamoeba invadens
LYTTASFIVTPRYQLICNTLGTMDATT

SEQ ID NO: 2822345 - protein, 18 aa, Entamoeba invadens
LYTVVLPLIPLFVSLIMY

SEQ ID NO: 2822346 - protein, 19 aa, Entamoeba invadens
LYVKPVCEYTKGLKRMAIC

SEQ ID NO: 2822347 - protein, 20 aa, Entamoeba invadens
LYVYMADTLARAYPLNYINF

SEQ ID NO: 2822348 - protein, 20 aa, Entamoeba invadens
LYWVVPVITFPIIIGLSSDY

SEQ ID NO: 2822349 - protein, 22 aa, Entamoeba invadens
LYYIFFFVYAQAQMCPFQNTIT

SEQ ID NO: 2822350 - protein, 18 aa, Entamoeba invadens
MAAYAAGKPTWLCPVCRT

SEQ ID NO: 2822351 - protein, 22 aa, Entamoeba invadens
MACEFKLYLTPACTCKINDDII

SEQ ID NO: 2822352 - protein, 25 aa, Entamoeba invadens
MAEYQSVFIRFPSSYFIPTLEIAMP

SEQ ID NO: 2822353 - protein, 19 aa, Entamoeba invadens
MAFRLLTITVAQFLSNVQI

SEQ ID NO: 2822354 - protein, 19 aa, Entamoeba invadens
MAFSVWKLSILETIQMMYF

SEQ ID NO: 2822355 - protein, 26 aa, Entamoeba invadens
MAHTTWYFIILLMCGVVFILVYTYFL

SEQ ID NO: 2822356 - protein, 24 aa, Entamoeba invadens
MAKSWYSQRLDWLGIILAVATVTG

SEQ ID NO: 2822357 - protein, 20 aa, Entamoeba invadens
MALHELVLLMNKFDLDKSLS

SEQ ID NO: 2822358 - protein, 19 aa, Entamoeba invadens
MALKKIIHHYGSVLVAIQA

SEQ ID NO: 2822359 - protein, 23 aa, Entamoeba invadens
MALSMRCRVLLDAAKGIAVLHAK

SEQ ID NO: 2822360 - protein, 21 aa, Entamoeba invadens
MALVFWRNYPPAIIGTSLLLY

SEQ ID NO: 2822361 - protein, 21 aa, Entamoeba invadens
MANRELFKASKIYKKIGWDKM

SEQ ID NO: 2822362 - protein, 25 aa, Entamoeba invadens
MANTFFFEEQFALISSFFEGLKKDD

SEQ ID NO: 2822363 - protein, 47 aa, Entamoeba invadens
MARVVEKSEFPMYMIAVIVIFILILAVIVAFLIAYVVHVYIVRRKNM

SEQ ID NO: 2822364 - protein, 38 aa, Entamoeba invadens
MASTAFIFTILIWLILMWFLLYFMLRVQSIGPAVLGKP

SEQ ID NO: 2822365 - protein, 18 aa, Entamoeba invadens
MAVGFVFSLLWAVTKHWT

SEQ ID NO: 2822366 - protein, 20 aa, Entamoeba invadens
MAYFQELQMTWYAADKARCY

SEQ ID NO: 2822367 - protein, 30 aa, Entamoeba invadens
MAYKCFFFMVWLFLCFIESKLFVSFKLSCL

SEQ ID NO: 2822368 - protein, 31 aa, Entamoeba invadens
MCDSLMLAALLLYILIIFDALRKPLSQRTFK

SEQ ID NO: 2822369 - protein, 17 aa, Entamoeba invadens
MCEGCNDGYYLSEESCL

SEQ ID NO: 2822370 - protein, 24 aa, Entamoeba invadens
MCEIHMVLFIHRLLENNTRTVDCS

SEQ ID NO: 2822371 - protein, 31 aa, Entamoeba invadens
MCHNMSYYVERLFSLYLPIMVGYQVYVSTDV

SEQ ID NO: 2822372 - protein, 33 aa, Entamoeba invadens
MCIKLPLHMNKLLSFLYISLPIASTVICCKKVS

SEQ ID NO: 2822373 - protein, 25 aa, Entamoeba invadens
MCINCFELIQNCQLCKYNNGIQTCS

SEQ ID NO: 2822374 - protein, 17 aa, Entamoeba invadens
MCLSCIESTYFLKDHKC

SEQ ID NO: 2822375 - protein, 17 aa, Entamoeba invadens
MCNLAYTNTTYYNNELF

SEQ ID NO: 2822376 - protein, 18 aa, Entamoeba invadens
MCNVCKSGYYLNGGKCES

SEQ ID NO: 2822377 - protein, 17 aa, Entamoeba invadens
MCPASYYSSGGTSLCSK

SEQ ID NO: 2822378 - protein, 18 aa, Entamoeba invadens
MCQLCNENYLMYNKNRCV

SEQ ID NO: 2822379 - protein, 65 aa, Entamoeba invadens
MCVENTEGILKILNSKKIFSLIAMLVTLIRELSGVYYMYYHVIFTTFVKLHHDGEYKDIIAKFDQ

SEQ ID NO: 2822380 - protein, 18 aa, Entamoeba invadens
MCVNKYSCLIWKDLIGTS

SEQ ID NO: 2822381 - protein, 19 aa, Entamoeba invadens
MCYAGYGLGHNGNCEICVD

SEQ ID NO: 2822382 - protein, 17 aa, Entamoeba invadens
MCYRCEMGYYPISNGSC

SEQ ID NO: 2822383 - protein, 25 aa, Entamoeba invadens
MDASLLPQIPLLPLSQQYVINQQIF

SEQ ID NO: 2822384 - protein, 25 aa, Entamoeba invadens
MDGQLPIKYSLRLPPETLLKEVKAQ

SEQ ID NO: 2822385 - protein, 23 aa, Entamoeba invadens
MDHCEKFNCFVALLYMGRTAQAD

SEQ ID NO: 2822386 - protein, 19 aa, Entamoeba invadens
MDISCHMLCIALSLFDSKN

SEQ ID NO: 2822387 - protein, 28 aa, Entamoeba invadens
MDKFRSEYIVHFYGAVLVPNRISMVTEY

SEQ ID NO: 2822388 - protein, 23 aa, Entamoeba invadens
MDKSNIHFVSITKGICVSSELVD

SEQ ID NO: 2822389 - protein, 22 aa, Entamoeba invadens
MDRMIYPILIPMLTPVKKRSEN

SEQ ID NO: 2822390 - protein, 23 aa, Entamoeba invadens
MDRSNIHFVSITKGICVSSELVD

SEQ ID NO: 2822391 - protein, 26 aa, Entamoeba invadens
MDSYKSLKTLWLPEIKQYNPNTPILL

SEQ ID NO: 2822392 - protein, 18 aa, Entamoeba invadens
MDYAFYMCSSLQSIQFES

SEQ ID NO: 2822393 - protein, 27 aa, Entamoeba invadens
MDYLSRIIKLFPNIQTLYLPSYKCIIP

SEQ ID NO: 2822394 - protein, 22 aa, Entamoeba invadens
MEDIMRIWETVIPPQQFVGAPI

SEQ ID NO: 2822395 - protein, 32 aa, Entamoeba invadens
MEDTTIFKCSKYIYLFGTSQLLLNKKALYEST

SEQ ID NO: 2822396 - protein, 24 aa, Entamoeba invadens
MEDVLIYMRIVVQIFELYEPNRVT

SEQ ID NO: 2822397 - protein, 22 aa, Entamoeba invadens
MEDWKYNFISKCWEQIPEKRYS

SEQ ID NO: 2822398 - protein, 19 aa, Entamoeba invadens
MEGCTNCFFNINKCDGCVS

SEQ ID NO: 2822399 - protein, 17 aa, Entamoeba invadens
MEKICVFKMNRSNIAMS

SEQ ID NO: 2822400 - protein, 25 aa, Entamoeba invadens
MEKKGIISFTKPMKVPIINGLEDSG

SEQ ID NO: 2822401 - protein, 25 aa, Entamoeba invadens
MEKKGIISFTKPMKVPIINGLENSG

SEQ ID NO: 2822402 - protein, 29 aa, Entamoeba invadens
MEKKGVISFTKPLMIPTISGVGESGTIEV

SEQ ID NO: 2822403 - protein, 25 aa, Entamoeba invadens
MEKLKKNILAQLYYNITITTDAASS

SEQ ID NO: 2822404 - protein, 33 aa, Entamoeba invadens
MELKEFLTCKFTFDMKMNIVYQCLRGIQWVHNR

SEQ ID NO: 2822405 - protein, 30 aa, Entamoeba invadens
MELTGNFALNLKVLVIYSTLTLNGGDVTIN

SEQ ID NO: 2822406 - protein, 30 aa, Entamoeba invadens
MELTGNFTLNLKVLVIYSTLTLNGGVVTIN

SEQ ID NO: 2822407 - protein, 22 aa, Entamoeba invadens
MERGTCWDFALIGFLQSNYRQN

SEQ ID NO: 2822408 - protein, 22 aa, Entamoeba invadens
MERIRCPFIINFIGSVTTSDTL

SEQ ID NO: 2822409 - protein, 32 aa, Entamoeba invadens
MESDNYALICLLISTIYQIIPVLPGESRKRVV

SEQ ID NO: 2822410 - protein, 18 aa, Entamoeba invadens
MESLLFGLYWNFKKTKEH

SEQ ID NO: 2822411 - protein, 30 aa, Entamoeba invadens
METPMKYLNMDFYWGYSPFVNCSGNLNITL

SEQ ID NO: 2822412 - protein, 23 aa, Entamoeba invadens
MEVKCPPTFRLFASQNPLGEGSG

SEQ ID NO: 2822413 - protein, 18 aa, Entamoeba invadens
MFALSLDWCWEGDVLQCF

SEQ ID NO: 2822414 - protein, 25 aa, Entamoeba invadens
MFCWECVSPLLPCPCPFCKSPLTLH

SEQ ID NO: 2822415 - protein, 18 aa, Entamoeba invadens
MFDTFDSGLVWRMYIFMA

SEQ ID NO: 2822416 - protein, 32 aa, Entamoeba invadens
MFEAFTWQEAYPKEQFRFPWKIAEYVTHGKHP

SEQ ID NO: 2822417 - protein, 26 aa, Entamoeba invadens
MFECFSWSYAYSKDKFKFPWSTAEFV

SEQ ID NO: 2822418 - protein, 17 aa, Entamoeba invadens
MFELIKSMWPQDPKDRI

SEQ ID NO: 2822419 - protein, 19 aa, Entamoeba invadens
MFETITWKEAFPKSEFKYP

SEQ ID NO: 2822420 - protein, 32 aa, Entamoeba invadens
MFEVFGWCMAYPFTIFKFPWKIAEFVISGKRR

SEQ ID NO: 2822421 - protein, 17 aa, Entamoeba invadens
MFEVFGWQDAYNQDIFK

SEQ ID NO: 2822422 - protein, 28 aa, Entamoeba invadens
MFFDFSVYFYWLVAPVLVKELRAPAVAS

SEQ ID NO: 2822423 - protein, 20 aa, Entamoeba invadens
MFFGLLAVIVALQGSFPFMW

SEQ ID NO: 2822424 - protein, 18 aa, Entamoeba invadens
MFFILRDELRRSIPEVTM

SEQ ID NO: 2822425 - protein, 20 aa, Entamoeba invadens
MFGCVRCESGYFLNQGKCET

SEQ ID NO: 2822426 - protein, 36 aa, Entamoeba invadens
MFGGMFCSIILILLCLIAIIFFGKTDLMKAIVFCGI

SEQ ID NO: 2822427 - protein, 33 aa, Entamoeba invadens
MFKFSLYVYIAFFAVSFFFYIATFIGIGAAASA

SEQ ID NO: 2822428 - protein, 20 aa, Entamoeba invadens
MFLESFSFNFLGLAGWAFDI

SEQ ID NO: 2822429 - protein, 19 aa, Entamoeba invadens
MFLLIVSLIPEVPLTFLFY

SEQ ID NO: 2822430 - protein, 18 aa, Entamoeba invadens
MFMDGLFKAIFASEKMAI

SEQ ID NO: 2822431 - protein, 22 aa, Entamoeba invadens
MFNWSWDLFRGFPIMTVAFCGH

SEQ ID NO: 2822432 - protein, 20 aa, Entamoeba invadens
MFPALLPQLFVSVLGFFSYV

SEQ ID NO: 2822433 - protein, 18 aa, Entamoeba invadens
MFPNLMIGNHDLPRIGNL

SEQ ID NO: 2822434 - protein, 17 aa, Entamoeba invadens
MFPVFFSKRGFIPCIKK

SEQ ID NO: 2822435 - protein, 30 aa, Entamoeba invadens
MFTSAFIFKFLAFFNLIVDVRLICVCMGPI

SEQ ID NO: 2822436 - protein, 19 aa, Entamoeba invadens
MFVGIIAMTSVVQALIVVF

SEQ ID NO: 2822437 - protein, 28 aa, Entamoeba invadens
MFVNNNLWILWIMAIMYAISYVFFWVPI

SEQ ID NO: 2822438 - protein, 18 aa, Entamoeba invadens
MFVQYKVMYHPYSALLKY

SEQ ID NO: 2822439 - protein, 17 aa, Entamoeba invadens
MFWCDERKFEANCYKKK

SEQ ID NO: 2822440 - protein, 18 aa, Entamoeba invadens
MFYSTTDQIFWINTKSLT

SEQ ID NO: 2822441 - protein, 43 aa, Entamoeba invadens
MGAAIGIPISILLVMIIIVLLIVITLIVIFKRNQKKEKLKVCT

SEQ ID NO: 2822442 - protein, 26 aa, Entamoeba invadens
MGDTIIFLFKAYYLFRTLLVENVQIE

SEQ ID NO: 2822443 - protein, 25 aa, Entamoeba invadens
MGFSFDPMFITMEYFDGGSLFDMIH

SEQ ID NO: 2822444 - protein, 31 aa, Entamoeba invadens
MGGSTGLLFFFVFCAFWIGYIYGSKRVQDRN

SEQ ID NO: 2822445 - protein, 22 aa, Entamoeba invadens
MGIAVFVFFLNQIWIMGSGKTT

SEQ ID NO: 2822446 - protein, 25 aa, Entamoeba invadens
MGLSVKRWSFYLAVGFVLSFVLSIV

SEQ ID NO: 2822447 - protein, 25 aa, Entamoeba invadens
MGNYRGNFVAIKKMKQIASPNTLTN

SEQ ID NO: 2822448 - protein, 25 aa, Entamoeba invadens
MGNYRGNFVAIKKMKQIASPNTLTT

SEQ ID NO: 2822449 - protein, 23 aa, Entamoeba invadens
MGRTPFHYCVLGGHLQLVKLLRR

SEQ ID NO: 2822450 - protein, 26 aa, Entamoeba invadens
MGSLKTYLRSVPTKPLLRLRFCQDVA

SEQ ID NO: 2822451 - protein, 34 aa, Entamoeba invadens
MGSVLQIFLGIYISLMLFLWGGSQMLKTSFLNFF

SEQ ID NO: 2822452 - protein, 17 aa, Entamoeba invadens
MGSVTYIPQVSLVLQFF

SEQ ID NO: 2822453 - protein, 39 aa, Entamoeba invadens
MGTFEMDVLTLFKIISFVYFLHPWLIDELTDFLVSIANG

SEQ ID NO: 2822454 - protein, 23 aa, Entamoeba invadens
MHILRKKLRKIGLSRTRLFLNCV

SEQ ID NO: 2822455 - protein, 20 aa, Entamoeba invadens
MHLRIKFILDASKGIEYLHE

SEQ ID NO: 2822456 - protein, 26 aa, Entamoeba invadens
MHRDLKPHNLLLFSTSPKVAIAAKIS

SEQ ID NO: 2822457 - protein, 17 aa, Entamoeba invadens
MHSSLYSVFWSFGKALG

SEQ ID NO: 2822458 - protein, 18 aa, Entamoeba invadens
MHVFYVCLFIPLVTSRYL

SEQ ID NO: 2822459 - protein, 24 aa, Entamoeba invadens
MIARMRSRLYQSLLRQNISYYDRK

SEQ ID NO: 2822460 - protein, 42 aa, Entamoeba invadens
MICMSFTTIWIYMRSLIFLVQLFYLAFLFCLSMSSQPYVNWV

SEQ ID NO: 2822461 - protein, 17 aa, Entamoeba invadens
MIDGALGLQYLHSNGVL

SEQ ID NO: 2822462 - protein, 48 aa, Entamoeba invadens
MIGTVLSAIVLCFVTCWDLALVLFSSIPFIVLSLYIIGFGVSKTTQKA

SEQ ID NO: 2822463 - protein, 17 aa, Entamoeba invadens
MIIASFITYYLVPLSFL

SEQ ID NO: 2822464 - protein, 37 aa, Entamoeba invadens
MIIKIAIQVVYQLFILLTLLFFGSLMSIINAPCGYMS

SEQ ID NO: 2822465 - protein, 17 aa, Entamoeba invadens
MIKAWPKWVQMIVGVIL

SEQ ID NO: 2822466 - protein, 18 aa, Entamoeba invadens
MILMVSSEYTGSYCKTVV

SEQ ID NO: 2822467 - protein, 20 aa, Entamoeba invadens
MILPKHIPVNAFRKFLKRNC

SEQ ID NO: 2822468 - protein, 31 aa, Entamoeba invadens
MILYFGHNNFVSVYLFLMLAAIGVTVSMVMG

SEQ ID NO: 2822469 - protein, 23 aa, Entamoeba invadens
MISRLRKRFYRSILRQNIGWFDR

SEQ ID NO: 2822470 - protein, 30 aa, Entamoeba invadens
MISYVIYHIMLFLCFNFYIISIFSKDKFIH

SEQ ID NO: 2822471 - protein, 18 aa, Entamoeba invadens
MIVELCKVIKFYIPNDSE

SEQ ID NO: 2822472 - protein, 17 aa, Entamoeba invadens
MIVGMFVPLVMCIGCCM

SEQ ID NO: 2822473 - protein, 17 aa, Entamoeba invadens
MIYGYFYMPTWFDNTKS

SEQ ID NO: 2822474 - protein, 18 aa, Entamoeba invadens
MKDPQFNFPWKIAEYVMA

SEQ ID NO: 2822475 - protein, 18 aa, Entamoeba invadens
MKEKRKIWTFIEVSMRTS

SEQ ID NO: 2822476 - protein, 26 aa, Entamoeba invadens
MKENYLLVIIFVTIGSGVLLLFFIIM

SEQ ID NO: 2822477 - protein, 22 aa, Entamoeba invadens
MKESLYAFLSIPTTLPPRVKSA

SEQ ID NO: 2822478 - protein, 28 aa, Entamoeba invadens
MKHRRDTPIIFIMRTKLMLDAAKGIEYL

SEQ ID NO: 2822479 - protein, 24 aa, Entamoeba invadens
MKKKRSYSVRLPRSVLTDRPIELK

SEQ ID NO: 2822480 - protein, 22 aa, Entamoeba invadens
MKLRVIICLDAAKGILYLHENG

SEQ ID NO: 2822481 - protein, 18 aa, Entamoeba invadens
MKLRVKFCLDAAKGILYL

SEQ ID NO: 2822482 - protein, 23 aa, Entamoeba invadens
MKQCEPYLSEGIHSRLLVEGIEL

SEQ ID NO: 2822483 - protein, 26 aa, Entamoeba invadens
MKQGQTLISFFYPKKNPDLLEKAVQK

SEQ ID NO: 2822484 - protein, 18 aa, Entamoeba invadens
MKRSNIHFVFLQNGICVS

SEQ ID NO: 2822485 - protein, 22 aa, Entamoeba invadens
MKRSTFVLHVLALYVMNQAVLN

SEQ ID NO: 2822486 - protein, 21 aa, Entamoeba invadens
MKTFVVFIILDHPSTESILEM

SEQ ID NO: 2822487 - protein, 25 aa, Entamoeba invadens
MKTITSFLTLHCTCKIRELKIPYTV

SEQ ID NO: 2822488 - protein, 24 aa, Entamoeba invadens
MKWLVHFQCRGRFAIQYIKAWIEY

SEQ ID NO: 2822489 - protein, 30 aa, Entamoeba invadens
MLALVIVAIVELLLVLLQRVLCGSGRQFKN

SEQ ID NO: 2822490 - protein, 18 aa, Entamoeba invadens
MLALVSLEYPIFASFLIF

SEQ ID NO: 2822491 - protein, 29 aa, Entamoeba invadens
MLCCFSVIAFFPFDLIRYMGIGCALAVTS

SEQ ID NO: 2822492 - protein, 20 aa, Entamoeba invadens
MLCFVYCALSEEASSCLAGF

SEQ ID NO: 2822493 - protein, 26 aa, Entamoeba invadens
MLCSLLVLHIYWFSLILDMVKKLFSK

SEQ ID NO: 2822494 - protein, 30 aa, Entamoeba invadens
MLDDMPIFAFMMLVMLFVFEGMTTFTRMKN

SEQ ID NO: 2822495 - protein, 29 aa, Entamoeba invadens
MLDKFRCDYIIHFYGAVFIPSKVCMVTEF

SEQ ID NO: 2822496 - protein, 33 aa, Entamoeba invadens
MLDKFRCDYIVRFYGAVFIPNQICMVTEFAQYG

SEQ ID NO: 2822497 - protein, 30 aa, Entamoeba invadens
MLDKFRCDYIVYFYGAVFIPRKICIVSEYA

SEQ ID NO: 2822498 - protein, 31 aa, Entamoeba invadens
MLDKFRNDYIVHFYGAVFVPNKICMVTEFAQ

SEQ ID NO: 2822499 - protein, 32 aa, Entamoeba invadens
MLDKFRSDFIVHFFGAVFIPTKICLVTEFAQY

SEQ ID NO: 2822500 - protein, 35 aa, Entamoeba invadens
MLDKFRSDYIVHFYGAVFILNKICMVTEFAPFGSL

SEQ ID NO: 2822501 - protein, 30 aa, Entamoeba invadens
MLDKFRSDYLVHFYGAVFIPNKICMVSEFC

SEQ ID NO: 2822502 - protein, 39 aa, Entamoeba invadens
MLDKFRSEFIIHFYGACFIPEHICMVTEFALYGSLRDLM

SEQ ID NO: 2822503 - protein, 30 aa, Entamoeba invadens
MLDKFWNEYIVHFFGAVLIPNKICMVTEFA

SEQ ID NO: 2822504 - protein, 31 aa, Entamoeba invadens
MLDKMKYIIIIFWILVTLGLLYCVFGFLKHT

SEQ ID NO: 2822505 - protein, 19 aa, Entamoeba invadens
MLDVAMGIMYLHENGILHR

SEQ ID NO: 2822506 - protein, 24 aa, Entamoeba invadens
MLEKFHCDFIINFFGAVCVPSKMS

SEQ ID NO: 2822507 - protein, 33 aa, Entamoeba invadens
MLELTSLMAFVLYLVLILLKKKLDVGTVFACIA

SEQ ID NO: 2822508 - protein, 17 aa, Entamoeba invadens
MLFANKKMDAFAKEVAM

SEQ ID NO: 2822509 - protein, 18 aa, Entamoeba invadens
MLFVLVFGPTYSKPMLEF

SEQ ID NO: 2822510 - protein, 26 aa, Entamoeba invadens
MLGLSLIVYFLLIGMQIIVSFHVSKD

SEQ ID NO: 2822511 - protein, 17 aa, Entamoeba invadens
MLIAVASLIQFVLNPVA

SEQ ID NO: 2822512 - protein, 19 aa, Entamoeba invadens
MLINYMQGKFTFGCDQADT

SEQ ID NO: 2822513 - protein, 30 aa, Entamoeba invadens
MLITFSLQGYFCFPLIDYVFFSETSKVSTE

SEQ ID NO: 2822514 - protein, 18 aa, Entamoeba invadens
MLIVPMYSMTCRPIGVDC

SEQ ID NO: 2822515 - protein, 26 aa, Entamoeba invadens
MLKKKFACEFSIYLKPECTCRINNTI

SEQ ID NO: 2822516 - protein, 21 aa, Entamoeba invadens
MLKVLLIVEKKLEWMSKLLGD

SEQ ID NO: 2822517 - protein, 18 aa, Entamoeba invadens
MLLGSLCGLLYGEIDNYY

SEQ ID NO: 2822518 - protein, 28 aa, Entamoeba invadens
MLLSLLGLHIYWYYLIMKMLVNLLKGNG

SEQ ID NO: 2822519 - protein, 20 aa, Entamoeba invadens
MLMERQMNKLIYNNEFFPVV

SEQ ID NO: 2822520 - protein, 21 aa, Entamoeba invadens
MLMTNMTFTKMLELQFTCRLR

SEQ ID NO: 2822521 - protein, 29 aa, Entamoeba invadens
MLNSHYSLICELSIRWFLNKEKTYIYGFI

SEQ ID NO: 2822522 - protein, 22 aa, Entamoeba invadens
MLPPCNFVIFFNFSYSCSAQHT

SEQ ID NO: 2822523 - protein, 26 aa, Entamoeba invadens
MLSDKSFYLSWPRRLQMLHDVAMGMN

SEQ ID NO: 2822524 - protein, 17 aa, Entamoeba invadens
MLSLNLNGNVNAKLTDF

SEQ ID NO: 2822525 - protein, 19 aa, Entamoeba invadens
MLSMLHVLYKENEKYRNVV

SEQ ID NO: 2822526 - protein, 24 aa, Entamoeba invadens
MLSTKIKATLPLLRKIVLGRDAGQ

SEQ ID NO: 2822527 - protein, 23 aa, Entamoeba invadens
MLTQLRHQCVVEFIGAVYTEGEI

SEQ ID NO: 2822528 - protein, 20 aa, Entamoeba invadens
MLVAFVLVFLFSLIMVTVDS

SEQ ID NO: 2822529 - protein, 17 aa, Entamoeba invadens
MLVIILICTLVLQCFLQ

SEQ ID NO: 2822530 - protein, 18 aa, Entamoeba invadens
MLVVAILGLLVNVGAMFL

SEQ ID NO: 2822531 - protein, 30 aa, Entamoeba invadens
MMDKFRSEFIIHFYGAVFVPNKICMVTEFA

SEQ ID NO: 2822532 - protein, 29 aa, Entamoeba invadens
MMDLTELNFGPKLPLISLPKLIHSDKTGK

SEQ ID NO: 2822533 - protein, 26 aa, Entamoeba invadens
MMICASCCFFLPFGYQTNLMVMKDGG

SEQ ID NO: 2822534 - protein, 17 aa, Entamoeba invadens
MMIDAAKGILYLHSNGI

SEQ ID NO: 2822535 - protein, 17 aa, Entamoeba invadens
MMIVSQYFLCLNDFITL

SEQ ID NO: 2822536 - protein, 32 aa, Entamoeba invadens
MMLNKFRCDYIIHFYGAVFKANRISLVTEYAQ

SEQ ID NO: 2822537 - protein, 28 aa, Entamoeba invadens
MMNMSTYFFWLVVPLLLQDRKANSFEIA

SEQ ID NO: 2822538 - protein, 18 aa, Entamoeba invadens
MMNVFLHLKTFNDVRTFI

SEQ ID NO: 2822539 - protein, 27 aa, Entamoeba invadens
MMPLIVLFSFFIWTYDFFLFRTYGTNA

SEQ ID NO: 2822540 - protein, 23 aa, Entamoeba invadens
MMVYVLLYIIFKIALILMAVIRA

SEQ ID NO: 2822541 - protein, 18 aa, Entamoeba invadens
MNCFELIPNCQLCEYNNG

SEQ ID NO: 2822542 - protein, 27 aa, Entamoeba invadens
MNDEFRYYLLQINPRGYLLFSAKCISR

SEQ ID NO: 2822543 - protein, 26 aa, Entamoeba invadens
MNECIYCIAGYNLDSTNHKCYKCGEN

SEQ ID NO: 2822544 - protein, 25 aa, Entamoeba invadens
MNFINHKLKKFFPFQDFKEQRTKTA

SEQ ID NO: 2822545 - protein, 45 aa, Entamoeba invadens
MNFSWYGLVVLFQQPHFYLSVFAMVFMSVLPLLVNSSFKILLNPN

SEQ ID NO: 2822546 - protein, 21 aa, Entamoeba invadens
MNILIFWYQILFIKNPWNTFS

SEQ ID NO: 2822547 - protein, 26 aa, Entamoeba invadens
MNKNKNFIFIYIFKNVTFTKNDRKKF

SEQ ID NO: 2822548 - protein, 17 aa, Entamoeba invadens
MNLKANGLIVLSGKSVL

SEQ ID NO: 2822549 - protein, 21 aa, Entamoeba invadens
MNNCLVCQTNFIFTGSNQKCV

SEQ ID NO: 2822550 - protein, 27 aa, Entamoeba invadens
MNNDFREFIFKLRTTNLEGFELKRADL

SEQ ID NO: 2822551 - protein, 24 aa, Entamoeba invadens
MNNDFSEFLFKFTLSDLEGFELIR

SEQ ID NO: 2822552 - protein, 50 aa, Entamoeba invadens
MNNPIEFIRVILLTLTFLSLISFNLSLFLLFLVLFIAFPLTLTEVPTNLS

SEQ ID NO: 2822553 - protein, 22 aa, Entamoeba invadens
MNRQSVIGFFLGALIVLSTLAM

SEQ ID NO: 2822554 - protein, 30 aa, Entamoeba invadens
MNSLYVCIVLVALLFVVYPFTHPKRIREKM

SEQ ID NO: 2822555 - protein, 24 aa, Entamoeba invadens
MNTGKYFLQLFGSFGNMPDGDVKL

SEQ ID NO: 2822556 - protein, 31 aa, Entamoeba invadens
MNTISLPGLLFVGLVFLLFTTGITIVSFISP

SEQ ID NO: 2822557 - protein, 23 aa, Entamoeba invadens
MNTLALPYILIILTDINTALQDL

SEQ ID NO: 2822558 - protein, 33 aa, Entamoeba invadens
MNVQPEKWYLPRRLTINTLLKTPNIVLCESICS

SEQ ID NO: 2822559 - protein, 18 aa, Entamoeba invadens
MNVRIKMILDSAKGITYL

SEQ ID NO: 2822560 - protein, 18 aa, Entamoeba invadens
MNVVLYINTFDSFTNFVC

SEQ ID NO: 2822561 - protein, 18 aa, Entamoeba invadens
MNVVLYINTFDSLTNFVC

SEQ ID NO: 2822562 - protein, 20 aa, Entamoeba invadens
MNVVLYLPLKDVFNFVCISK

SEQ ID NO: 2822563 - protein, 35 aa, Entamoeba invadens
MPADIFSFSIMFFETMTWGLAYPYEMKSWEIANAV

SEQ ID NO: 2822564 - protein, 20 aa, Entamoeba invadens
MPAIGEGAFGLVFKGTYRGL

SEQ ID NO: 2822565 - protein, 42 aa, Entamoeba invadens
MPAYVIVAIVVSITLFFVLVVSVTCGIIIFILTRKKPEEKID

SEQ ID NO: 2822566 - protein, 29 aa, Entamoeba invadens
MPFNVLFTCLLLYKHFYITQSAQLFHPKH

SEQ ID NO: 2822567 - protein, 29 aa, Entamoeba invadens
MPLNTTFLSCGLFFKELWNNSAVSEKERN

SEQ ID NO: 2822568 - protein, 20 aa, Entamoeba invadens
MPLYCITGMFFDFSVYFYWL

SEQ ID NO: 2822569 - protein, 17 aa, Entamoeba invadens
MPPIGEGAFGMVFRGTY

SEQ ID NO: 2822570 - protein, 18 aa, Entamoeba invadens
MPRFAVRVKLMLDASKGI

SEQ ID NO: 2822571 - protein, 19 aa, Entamoeba invadens
MPRFAVRVKLMLDASKGIS

SEQ ID NO: 2822572 - protein, 32 aa, Entamoeba invadens
MPSDIFSFAITMYEIFGWKEPYPKNEFKFAWS

SEQ ID NO: 2822573 - protein, 20 aa, Entamoeba invadens
MPSDIFSFAITMYEIFNWEK

SEQ ID NO: 2822574 - protein, 25 aa, Entamoeba invadens
MPSFYLNCVIAIIMAITPNVMRLFI

SEQ ID NO: 2822575 - protein, 18 aa, Entamoeba invadens
MPTKCSPKFLLSSEGNCV

SEQ ID NO: 2822576 - protein, 25 aa, Entamoeba invadens
MPTVMMKVLTFTVQFTGPYSILLDT

SEQ ID NO: 2822577 - protein, 24 aa, Entamoeba invadens
MPVIMFFSYMMYGGSVSYFSLLSY

SEQ ID NO: 2822578 - protein, 23 aa, Entamoeba invadens
MPWKVFLYKFLNTIVDDLFSFVV

SEQ ID NO: 2822579 - protein, 18 aa, Entamoeba invadens
MQEPSLFGFSIRDNITLG

SEQ ID NO: 2822580 - protein, 24 aa, Entamoeba invadens
MQHTGLEFFFQKTSTFIVFSSPEV

SEQ ID NO: 2822581 - protein, 18 aa, Entamoeba invadens
MQIFWSIRSSRNTHLFFL

SEQ ID NO: 2822582 - protein, 18 aa, Entamoeba invadens
MQLVTMVLVETKLVFLVM

SEQ ID NO: 2822583 - protein, 27 aa, Entamoeba invadens
MQNQKSAKFMFFLIAFVLSCESTILTF

SEQ ID NO: 2822584 - protein, 19 aa, Entamoeba invadens
MQNVCVFKMKRSNITFYDI

SEQ ID NO: 2822585 - protein, 24 aa, Entamoeba invadens
MQNVCVFKMKRSNVAFYDINEWLV

SEQ ID NO: 2822586 - protein, 17 aa, Entamoeba invadens
MQRVCVVPIWLTHEDYP

SEQ ID NO: 2822587 - protein, 28 aa, Entamoeba invadens
MQSIIWFFILFIIALPFYMACIAFGGFG

SEQ ID NO: 2822588 - protein, 17 aa, Entamoeba invadens
MQTSYPLRTLAIFYFIT

SEQ ID NO: 2822589 - protein, 18 aa, Entamoeba invadens
MRCPYIINFIGASFTPEH

SEQ ID NO: 2822590 - protein, 18 aa, Entamoeba invadens
MRELGVELVFFDKKFQGD

SEQ ID NO: 2822591 - protein, 19 aa, Entamoeba invadens
MREVLCDIFQLGCLKCKQD

SEQ ID NO: 2822592 - protein, 23 aa, Entamoeba invadens
MRGDSSIIYCQKGYFVLNETFCE

SEQ ID NO: 2822593 - protein, 18 aa, Entamoeba invadens
MRGRRWRGNRRFQYGRNG

SEQ ID NO: 2822594 - protein, 21 aa, Entamoeba invadens
MRLFFNTILYFFIGSLYIIGM

SEQ ID NO: 2822595 - protein, 18 aa, Entamoeba invadens
MRTTKYTLLSFPLKFLYQ

SEQ ID NO: 2822596 - protein, 26 aa, Entamoeba invadens
MSADIYSFGITFYETLKWGEAYDKNE

SEQ ID NO: 2822597 - protein, 27 aa, Entamoeba invadens
MSAIEIGKLIRARIPQWAKGGLTQEEA

SEQ ID NO: 2822598 - protein, 46 aa, Entamoeba invadens
MSCESQVVWWVILIAVLIVILVVILVAVIIIIITKKVLEISHTKDL

SEQ ID NO: 2822599 - protein, 66 aa, Entamoeba invadens
MSCESQVVWWVILIAVLIVILVVILVAVIIIIITKKVRIFILLYFKMEFVFLLKKIDYNSDCEEIS

SEQ ID NO: 2822600 - protein, 18 aa, Entamoeba invadens
MSCFELIPNCQLCEYNNG

SEQ ID NO: 2822601 - protein, 43 aa, Entamoeba invadens
MSCKSRAVWWVILVAVLFVIIMFVILIISIIVVTKIILNKIHT

SEQ ID NO: 2822602 - protein, 52 aa, Entamoeba invadens
MSCQPYTNYGVYIGVPLTVVFVVLVIVVVLVIAVIIFLIRHKENKKLENVCV

SEQ ID NO: 2822603 - protein, 25 aa, Entamoeba invadens
MSCVYTIVFLLVSGVIFLLSKFTKR

SEQ ID NO: 2822604 - protein, 29 aa, Entamoeba invadens
MSCYEGFVKGILFAVKTFPYRTIIIDTKQ

SEQ ID NO: 2822605 - protein, 17 aa, Entamoeba invadens
MSDALYNLITSCWDADK

SEQ ID NO: 2822606 - protein, 17 aa, Entamoeba invadens
MSDVIEWVESVTGWRCQ

SEQ ID NO: 2822607 - protein, 25 aa, Entamoeba invadens
MSENFRTIIIWDLMKVFVDLMETDV

SEQ ID NO: 2822608 - protein, 24 aa, Entamoeba invadens
MSITPSLVFLRPGKAIEFVVTVHP

SEQ ID NO: 2822609 - protein, 23 aa, Entamoeba invadens
MSIWSFLDWLQQGIWQSLVIVFE

SEQ ID NO: 2822610 - protein, 28 aa, Entamoeba invadens
MSKKMSLLYMLLQPFFRIRKYQEFVEEF

SEQ ID NO: 2822611 - protein, 25 aa, Entamoeba invadens
MSKNKYMMIIFHTPNSPKYNFHFDP

SEQ ID NO: 2822612 - protein, 23 aa, Entamoeba invadens
MSLFLSHFMVFLHNYILSNPSDN

SEQ ID NO: 2822613 - protein, 20 aa, Entamoeba invadens
MSLIFLLIGLIVSIKYMKAD

SEQ ID NO: 2822614 - protein, 24 aa, Entamoeba invadens
MSNIITLLPVLPKPYADKAIEKVY

SEQ ID NO: 2822615 - protein, 23 aa, Entamoeba invadens
MSNNLFCYLAVTGYSSTTNGILE

SEQ ID NO: 2822616 - protein, 21 aa, Entamoeba invadens
MSNYCLECGKIVFFENKKRKA

SEQ ID NO: 2822617 - protein, 18 aa, Entamoeba invadens
MSPEMLLNLPYNLKTDIY

SEQ ID NO: 2822618 - protein, 27 aa, Entamoeba invadens
MSSGISIFGWFLASVLLFSAAVTYPLN

SEQ ID NO: 2822619 - protein, 17 aa, Entamoeba invadens
MSSLLLFKNMKVQTGET

SEQ ID NO: 2822620 - protein, 22 aa, Entamoeba invadens
MSSLTMMMYVQPIVGYIFEEKY

SEQ ID NO: 2822621 - protein, 24 aa, Entamoeba invadens
MSSSPVISTPRYGKDFLFQPKEGT

SEQ ID NO: 2822622 - protein, 20 aa, Entamoeba invadens
MSTLFCLNTFYINNSICLKC

SEQ ID NO: 2822623 - protein, 23 aa, Entamoeba invadens
MSTLTNFLYLYMARAFPNLKYFN

SEQ ID NO: 2822624 - protein, 36 aa, Entamoeba invadens
MSVASMFEYLRGFALCKPLIDIVWPVDVPEQNKEDT

SEQ ID NO: 2822625 - protein, 29 aa, Entamoeba invadens
MSVCAVVFYFFQKKRFFYPGVAMALLTVV

SEQ ID NO: 2822626 - protein, 18 aa, Entamoeba invadens
MSVFLQITILLIMNLIVS

SEQ ID NO: 2822627 - protein, 19 aa, Entamoeba invadens
MSVVLWVCCWRQRGELTRI

SEQ ID NO: 2822628 - protein, 17 aa, Entamoeba invadens
MSYGAILSDILPKYTTV

SEQ ID NO: 2822629 - protein, 25 aa, Entamoeba invadens
MSYIIWALILYYIPGLYMLYTYMLS

SEQ ID NO: 2822630 - protein, 25 aa, Entamoeba invadens
MSYKKGYNCITFPCVMAVAHVIALA

SEQ ID NO: 2822631 - protein, 29 aa, Entamoeba invadens
MTASLVVFYLFKIVYWLISAVQIRVGYVQ

SEQ ID NO: 2822632 - protein, 18 aa, Entamoeba invadens
MTCMFYSNKLINTYFGKD

SEQ ID NO: 2822633 - protein, 27 aa, Entamoeba invadens
MTDGELYPFYYELKQIIKDAYDLHLSV

SEQ ID NO: 2822634 - protein, 29 aa, Entamoeba invadens
MTDNNNICIQCVYPYILVGGTCIKSVSQT

SEQ ID NO: 2822635 - protein, 22 aa, Entamoeba invadens
MTDQINIKWKLINFTSICVLDT

SEQ ID NO: 2822636 - protein, 21 aa, Entamoeba invadens
MTEFGMNYYIYPKELVMKEKR

SEQ ID NO: 2822637 - protein, 33 aa, Entamoeba invadens
MTFNKLCHSFIVLILIILNLVPSCALRLLSTQP

SEQ ID NO: 2822638 - protein, 18 aa, Entamoeba invadens
MTFTKGIGTPKYMAPEIL

SEQ ID NO: 2822639 - protein, 19 aa, Entamoeba invadens
MTFTKGIGTPKYMAPEILN

SEQ ID NO: 2822640 - protein, 18 aa, Entamoeba invadens
MTFTKGVGTPKYMPPEVL

SEQ ID NO: 2822641 - protein, 28 aa, Entamoeba invadens
MTGTGNTFGIFMFYSMYGNLESGSTPDT

SEQ ID NO: 2822642 - protein, 17 aa, Entamoeba invadens
MTGYFLDGTECKLCSTE

SEQ ID NO: 2822643 - protein, 31 aa, Entamoeba invadens
MTIFCTTKLQGMKIPYTVWFSKSRKTLEQIE

SEQ ID NO: 2822644 - protein, 26 aa, Entamoeba invadens
MTIYCTTKLKGMKIPYTVWFSQSRGT

SEQ ID NO: 2822645 - protein, 33 aa, Entamoeba invadens
MTIYCTTRIRDMKLPYTIWFSESVRTLSAIAEL

SEQ ID NO: 2822646 - protein, 21 aa, Entamoeba invadens
MTKFQLCNVLRFTLFTTPDLT

SEQ ID NO: 2822647 - protein, 18 aa, Entamoeba invadens
MTLAFYYASSTRVPIVAL

SEQ ID NO: 2822648 - protein, 26 aa, Entamoeba invadens
MTLCLFIYFFQFYVLPLFKKTETKKE

SEQ ID NO: 2822649 - protein, 18 aa, Entamoeba invadens
MTLCWKKQPVFRPDFAEV

SEQ ID NO: 2822650 - protein, 17 aa, Entamoeba invadens
MTLHCTTFLKRTKLPYT

SEQ ID NO: 2822651 - protein, 25 aa, Entamoeba invadens
MTLKFYVPRALLCGLLFVFILINFM

SEQ ID NO: 2822652 - protein, 18 aa, Entamoeba invadens
MTLPTIYNALVINSSPTL

SEQ ID NO: 2822653 - protein, 26 aa, Entamoeba invadens
MTLYCTTKLKGMKIPYTVWFSHSRGT

SEQ ID NO: 2822654 - protein, 26 aa, Entamoeba invadens
MTLYCTTKLKGMKIPYTVWFSKSRGI

SEQ ID NO: 2822655 - protein, 24 aa, Entamoeba invadens
MTNIYFLCNLIICSIPQISTVTPI

SEQ ID NO: 2822656 - protein, 22 aa, Entamoeba invadens
MTNMTFTKGVGTPKYMAPEVLD

SEQ ID NO: 2822657 - protein, 19 aa, Entamoeba invadens
MTPEAFQALPTWKSDDLKK

SEQ ID NO: 2822658 - protein, 25 aa, Entamoeba invadens
MTSCCTFFLDCFFPSFEFPELFVEL

SEQ ID NO: 2822659 - protein, 27 aa, Entamoeba invadens
MTSVCAPLVFLIILSLLRDFFEQLKQY

SEQ ID NO: 2822660 - protein, 25 aa, Entamoeba invadens
MTTMYSFFDFIGDVLGMVLGYCLLF

SEQ ID NO: 2822661 - protein, 26 aa, Entamoeba invadens
MTVPVITHILPAENMLFVVGLNLNEI

SEQ ID NO: 2822662 - protein, 22 aa, Entamoeba invadens
MVAKIKEFLRWEFKRNDKISEW

SEQ ID NO: 2822663 - protein, 17 aa, Entamoeba invadens
MVALFRLYEPTSGCVII

SEQ ID NO: 2822664 - protein, 20 aa, Entamoeba invadens
MVALGLILVALCTMCWKKYQ

SEQ ID NO: 2822665 - protein, 17 aa, Entamoeba invadens
MVAPLFSLVIYILVSKF

SEQ ID NO: 2822666 - protein, 25 aa, Entamoeba invadens
MVAVSIGIFNTYQLITSAMKNVVSV

SEQ ID NO: 2822667 - protein, 23 aa, Entamoeba invadens
MVCHNVLLLLIFIALMGIFVKTH

SEQ ID NO: 2822668 - protein, 26 aa, Entamoeba invadens
MVCSFGYLCFLIIFKWCAPVQEGAPM

SEQ ID NO: 2822669 - protein, 28 aa, Entamoeba invadens
MVCTFLVHFFLNGIFCFFALKTKSMLIC

SEQ ID NO: 2822670 - protein, 17 aa, Entamoeba invadens
MVDLLKKGKIKSSILRK

SEQ ID NO: 2822671 - protein, 24 aa, Entamoeba invadens
MVESYLPFFLLSDFAQELYSNGDY

SEQ ID NO: 2822672 - protein, 19 aa, Entamoeba invadens
MVGFNWKHLTAVVDYLITA

SEQ ID NO: 2822673 - protein, 18 aa, Entamoeba invadens
MVHIILHHVIQLILLVVG

SEQ ID NO: 2822674 - protein, 25 aa, Entamoeba invadens
MVIELALCLFFLVGCVRKTILEHTH

SEQ ID NO: 2822675 - protein, 17 aa, Entamoeba invadens
MVKSYIFGTKGGIAMCV

SEQ ID NO: 2822676 - protein, 31 aa, Entamoeba invadens
MVLNGIVNLMPLYKMEFFKLLEQQRGMAYQF

SEQ ID NO: 2822677 - protein, 28 aa, Entamoeba invadens
MVLVHPTPKMKIKFMLDLARGVEYLHNN

SEQ ID NO: 2822678 - protein, 37 aa, Entamoeba invadens
MVNSLMLPVMALGLFWFFYVFKIYMKYAKQLLRLDVV

SEQ ID NO: 2822679 - protein, 17 aa, Entamoeba invadens
MVRCLFGTILYQLMDIL

SEQ ID NO: 2822680 - protein, 25 aa, Entamoeba invadens
MVSLIGLFFILPITGKFVAINKHYL

SEQ ID NO: 2822681 - protein, 29 aa, Entamoeba invadens
MVVCFKYFPIIVIVLFGIVLIITGISFQS

SEQ ID NO: 2822682 - protein, 56 aa, Entamoeba invadens
MVVGLLFSVLMFVVSICYSLLFRKIEVLVFAIVAIIFVRGIFEIGFIKMKKVTIPP

SEQ ID NO: 2822683 - protein, 17 aa, Entamoeba invadens
MVVMYYQGYKVDIPLSS

SEQ ID NO: 2822684 - protein, 18 aa, Entamoeba invadens
MVVQIVIGILCIIIVVIV

SEQ ID NO: 2822685 - protein, 19 aa, Entamoeba invadens
MVVTLKKEYMYMLFVSLNE

SEQ ID NO: 2822686 - protein, 24 aa, Entamoeba invadens
MVVVAIYAFWLVFGIIRTYSETKK

SEQ ID NO: 2822687 - protein, 29 aa, Entamoeba invadens
MVVVVIATVIIVVLIVFKKKDNKHTENIC

SEQ ID NO: 2822688 - protein, 23 aa, Entamoeba invadens
MVYRSPYTYGIYFDVPIHSPTDD

SEQ ID NO: 2822689 - protein, 18 aa, Entamoeba invadens
MWFELPLIRNLDFKQRVR

SEQ ID NO: 2822690 - protein, 17 aa, Entamoeba invadens
MWGLLSHSVIPLVLFCY

SEQ ID NO: 2822691 - protein, 21 aa, Entamoeba invadens
MWGYDQALLNVLYYTGKFENV

SEQ ID NO: 2822692 - protein, 20 aa, Entamoeba invadens
MWIVFICIVCLLAIIFAVFG

SEQ ID NO: 2822693 - protein, 17 aa, Entamoeba invadens
MWLKIVIWISCIGFCFL

SEQ ID NO: 2822694 - protein, 17 aa, Entamoeba invadens
MWLSQQPLVDHPCHNLK

SEQ ID NO: 2822695 - protein, 20 aa, Entamoeba invadens
MWRLIPVIVPFILAGIIVIS

SEQ ID NO: 2822696 - protein, 27 aa, Entamoeba invadens
MWSIGVLAFVLLTVSFPFDGSVEEVKE

SEQ ID NO: 2822697 - protein, 19 aa, Entamoeba invadens
MYCLTCQDPYIQKNGMCES

SEQ ID NO: 2822698 - protein, 20 aa, Entamoeba invadens
MYCLTCQDPYIQKNGMCESC

SEQ ID NO: 2822699 - protein, 23 aa, Entamoeba invadens
MYDFICSMWCQKAKERLGLLFNT

SEQ ID NO: 2822700 - protein, 24 aa, Entamoeba invadens
MYECFAWKRAFSKKSFKYAWDIAD

SEQ ID NO: 2822701 - protein, 28 aa, Entamoeba invadens
MYECFGWCEAYPKNTFKFPWKIAEFVTT

SEQ ID NO: 2822702 - protein, 25 aa, Entamoeba invadens
MYECFGWQEAYPSTIFVYPWDIADF

SEQ ID NO: 2822703 - protein, 26 aa, Entamoeba invadens
MYECFTWADVFPKTQFKYPWDIVNYI

SEQ ID NO: 2822704 - protein, 38 aa, Entamoeba invadens
MYECFTWTNAYPKEYFKFPWTIAEFVIKGLRLPKPDEM

SEQ ID NO: 2822705 - protein, 36 aa, Entamoeba invadens
MYECFTWTNAYPKEYFKFPWTIAEFVIKGLRMPKPD

SEQ ID NO: 2822706 - protein, 33 aa, Entamoeba invadens
MYECIGWCQAYSKHQFRFPWKIAEFVINGKRVE

SEQ ID NO: 2822707 - protein, 34 aa, Entamoeba invadens
MYECIGWCQAYTKHQFRFPWKIAEFVINGKRVEK

SEQ ID NO: 2822708 - protein, 26 aa, Entamoeba invadens
MYECLGWCTAYPPQRFKFSWNIADFV

SEQ ID NO: 2822709 - protein, 18 aa, Entamoeba invadens
MYELITWSEAYPKSQFKY

SEQ ID NO: 2822710 - protein, 29 aa, Entamoeba invadens
MYETFGWCNIYTEAQFKFPWNVVDFVLKG

SEQ ID NO: 2822711 - protein, 19 aa, Entamoeba invadens
MYETFIWGDAFPQNEYKYP

SEQ ID NO: 2822712 - protein, 34 aa, Entamoeba invadens
MYETFKWGEAYDKERFRFPWKIAEFVMSGKRLEK

SEQ ID NO: 2822713 - protein, 30 aa, Entamoeba invadens
MYETFNWGDAYPKNKFQYAWSIADFVTSGK

SEQ ID NO: 2822714 - protein, 17 aa, Entamoeba invadens
MYETFSWEDAYKGDAFE

SEQ ID NO: 2822715 - protein, 27 aa, Entamoeba invadens
MYEVFGWCEIYPKNIFKYSWKIAEFVT

SEQ ID NO: 2822716 - protein, 28 aa, Entamoeba invadens
MYEVFGWCEIYPKNIFKYSWKIAEFVTA

SEQ ID NO: 2822717 - protein, 19 aa, Entamoeba invadens
MYEVFGWSEAYQNDTFKFP

SEQ ID NO: 2822718 - protein, 28 aa, Entamoeba invadens
MYEVFGWSNAYPKETFKFPWKIAEFVTT

SEQ ID NO: 2822719 - protein, 19 aa, Entamoeba invadens
MYEVVGWKEPFNKEQFKYS

SEQ ID NO: 2822720 - protein, 28 aa, Entamoeba invadens
MYFRDFHQSFILFLDFLISHVEHSVILS

SEQ ID NO: 2822721 - protein, 17 aa, Entamoeba invadens
MYHLWRAVKFSDKESLK

SEQ ID NO: 2822722 - protein, 34 aa, Entamoeba invadens
MYIISIVLVLLLVIGLVVFYFYSNWSFAKQQNEA

SEQ ID NO: 2822723 - protein, 17 aa, Entamoeba invadens
MYKNIRIGRFEFWASMS

SEQ ID NO: 2822724 - protein, 26 aa, Entamoeba invadens
MYKRNIIIIVVCVVVAIFIVAIVMIV

SEQ ID NO: 2822725 - protein, 27 aa, Entamoeba invadens
MYLESYQFPFFVFEKLFDHQETCNLFF

SEQ ID NO: 2822726 - protein, 35 aa, Entamoeba invadens
MYLTKMAKLWMGQRMDWLGVFITSVTVLVLVITKI

SEQ ID NO: 2822727 - protein, 26 aa, Entamoeba invadens
MYLYETVLDLLIVLTSLLNLKSTLLK

SEQ ID NO: 2822728 - protein, 21 aa, Entamoeba invadens
MYNENFPFKFSVEELKFGSEK

SEQ ID NO: 2822729 - protein, 19 aa, Entamoeba invadens
MYNIFLSLSNVFFSIVEKI

SEQ ID NO: 2822730 - protein, 30 aa, Entamoeba invadens
MYNNEPVVIYYVPLLQILGLTTIFATEMGK

SEQ ID NO: 2822731 - protein, 23 aa, Entamoeba invadens
MYSNYIFTVKKLNVSYITKLNII

SEQ ID NO: 2822732 - protein, 31 aa, Entamoeba invadens
MYSSDFGDHFMLLSLFLAFRKVGVNRRKKWC

SEQ ID NO: 2822733 - protein, 22 aa, Entamoeba invadens
MYTPLLFVFVHFITSPKGDDPI

SEQ ID NO: 2822734 - protein, 24 aa, Entamoeba invadens
MYVGVEFFFFYLAQTVSMAAMSIT

SEQ ID NO: 2822735 - protein, 30 aa, Entamoeba invadens
MYVPDQFPYIQMLLIFVIASLTIVNFVGSK

SEQ ID NO: 2822736 - protein, 19 aa, Entamoeba invadens
MYVTLRDVTTCKNCLPNTG

SEQ ID NO: 2822737 - protein, 19 aa, Entamoeba invadens
MYYTLPFVYEIRTILDWVF

SEQ ID NO: 2822738 - protein, 22 aa, Entamoeba invadens
NADFIFQMTSLKSLNLSYNSIT

SEQ ID NO: 2822739 - protein, 20 aa, Entamoeba invadens
NADLHIYVTVNYTASTFGSV

SEQ ID NO: 2822740 - protein, 24 aa, Entamoeba invadens
NAELIQNAILLMLDSYKVIPLEFV

SEQ ID NO: 2822741 - protein, 26 aa, Entamoeba invadens
NAENCITCNFGYYYDLMNKDCKYVGD

SEQ ID NO: 2822742 - protein, 26 aa, Entamoeba invadens
NAFIERMMFFYFRDNATFEMGNNSSI

SEQ ID NO: 2822743 - protein, 42 aa, Entamoeba invadens
NAFTIQMYLQLYFQSFLMLRKSLLNEFLLKDLKKKGVDMVYL

SEQ ID NO: 2822744 - protein, 20 aa, Entamoeba invadens
NAFVAFLSYPVSSTAMSKPT

SEQ ID NO: 2822745 - protein, 23 aa, Entamoeba invadens
NAFYYCYKCRRECKYCTAEDVCT

SEQ ID NO: 2822746 - protein, 24 aa, Entamoeba invadens
NAIINLNRYFSIAGSLLLTNPVIN

SEQ ID NO: 2822747 - protein, 24 aa, Entamoeba invadens
NAKDQCMMCKSGYYLFNNKCTPCG

SEQ ID NO: 2822748 - protein, 28 aa, Entamoeba invadens
NAKKEDIQFLLKVKFMVDSAKGIEYLHD

SEQ ID NO: 2822749 - protein, 30 aa, Entamoeba invadens
NAKPMLIAIIPRILYDITLFIPIVAQKVMI

SEQ ID NO: 2822750 - protein, 23 aa, Entamoeba invadens
NAKYPYVIPFAKLSRSEKPISIM

SEQ ID NO: 2822751 - protein, 17 aa, Entamoeba invadens
NALFIPVAIPPNKVFRV

SEQ ID NO: 2822752 - protein, 21 aa, Entamoeba invadens
NALPALCHLFLSSNDTIANIA

SEQ ID NO: 2822753 - protein, 54 aa, Entamoeba invadens
NANGMKCDASPVWWVILLAVLAGLFVVLLVVLLIIFLVWRVVKRIHNHRLIQEQ

SEQ ID NO: 2822754 - protein, 20 aa, Entamoeba invadens
NAPELIVFTFYRTSNGPDVQ

SEQ ID NO: 2822755 - protein, 22 aa, Entamoeba invadens
NAPQVLLIDCTYFHLNKGFNGR

SEQ ID NO: 2822756 - protein, 29 aa, Entamoeba invadens
NAQLNPAITPLFYLFRGQTLYQSLVSIAA

SEQ ID NO: 2822757 - protein, 25 aa, Entamoeba invadens
NARDWAISRNRFWGTPIPIWTDDAF

SEQ ID NO: 2822758 - protein, 23 aa, Entamoeba invadens
NARLFAILSLVFFIISTVAVSLS

SEQ ID NO: 2822759 - protein, 21 aa, Entamoeba invadens
NASAFLLRAYCTMAEQFLSDK

SEQ ID NO: 2822760 - protein, 29 aa, Entamoeba invadens
  misc_feature (27)..(28): Xaa can be any naturally occurring amino acid
NASCDIWALGCLFYELFTSKMLFWIAXXR

SEQ ID NO: 2822761 - protein, 31 aa, Entamoeba invadens
NASEIIIWIEPWFLGGILGVGPSLVSEMFGI

SEQ ID NO: 2822762 - protein, 20 aa, Entamoeba invadens
NASETLWVTIVLLFIWAFLL

SEQ ID NO: 2822763 - protein, 24 aa, Entamoeba invadens
NATDEELPYLKLFIGVLNLECFSS

SEQ ID NO: 2822764 - protein, 31 aa, Entamoeba invadens
NATERLKYIWIIFALLIKSLIAFYNDHNAFN

SEQ ID NO: 2822765 - protein, 24 aa, Entamoeba invadens
NATHSLVFLIKQFSELQGAFVSVE

SEQ ID NO: 2822766 - protein, 21 aa, Entamoeba invadens
NATIIGLYIVLGHSMIVKLPS

SEQ ID NO: 2822767 - protein, 27 aa, Entamoeba invadens
NAVSCAVGCLLVIPYIAVEYISLNDYN

SEQ ID NO: 2822768 - protein, 28 aa, Entamoeba invadens
NAYGEGYTPCRLDFIGGKSITFRSASEY

SEQ ID NO: 2822769 - protein, 17 aa, Entamoeba invadens
NAYPKSVYMYPWTIADD

SEQ ID NO: 2822770 - protein, 17 aa, Entamoeba invadens
NCAKNYFMLKMGVCLFG

SEQ ID NO: 2822771 - protein, 24 aa, Entamoeba invadens
NCDGKIVNISRLDRPFYPNCTDYV

SEQ ID NO: 2822772 - protein, 23 aa, Entamoeba invadens
NCDYYSIRTLPSLVNLKKGEACE

SEQ ID NO: 2822773 - protein, 25 aa, Entamoeba invadens
NCEAYDIINLMWNPIAAERPSIEEC

SEQ ID NO: 2822774 - protein, 17 aa, Entamoeba invadens
NCEFLMSEILYTQADYV

SEQ ID NO: 2822775 - protein, 17 aa, Entamoeba invadens
NCEKLENLNLYEPLTTL

SEQ ID NO: 2822776 - protein, 17 aa, Entamoeba invadens
NCFICQAGYYSSGGTLS

SEQ ID NO: 2822777 - protein, 27 aa, Entamoeba invadens
NCFKGKFTMLLILASTFIALVCEVHML

SEQ ID NO: 2822778 - protein, 22 aa, Entamoeba invadens
NCGKCPIGYGLIRNTDSKITCV

SEQ ID NO: 2822779 - protein, 17 aa, Entamoeba invadens
NCIICKEGFYLHTNQCI

SEQ ID NO: 2822780 - protein, 24 aa, Entamoeba invadens
NCIRLPFMNFGYFVAAALTFKVSI

SEQ ID NO: 2822781 - protein, 17 aa, Entamoeba invadens
NCITCISGFGLDKKFNC

SEQ ID NO: 2822782 - protein, 24 aa, Entamoeba invadens
NCITCSPDFLRKCKVCAIGFYPDE

SEQ ID NO: 2822783 - protein, 18 aa, Entamoeba invadens
NCKSLTHTIYINSPKVSC

SEQ ID NO: 2822784 - protein, 18 aa, Entamoeba invadens
NCLLYNNTGYCTSCYQNY

SEQ ID NO: 2822785 - protein, 19 aa, Entamoeba invadens
NCLLYNSTGFCTSCKLNYL

SEQ ID NO: 2822786 - protein, 17 aa, Entamoeba invadens
NCLLYNSTGFCTSCNQN

SEQ ID NO: 2822787 - protein, 23 aa, Entamoeba invadens
NCLSCFDGYILNDGKCDTCSAGT

SEQ ID NO: 2822788 - protein, 18 aa, Entamoeba invadens
NCLSCKTGYVLSASPSQR

SEQ ID NO: 2822789 - protein, 20 aa, Entamoeba invadens
NCLSCKTGYYLSNGYCLECN

SEQ ID NO: 2822790 - protein, 24 aa, Entamoeba invadens
NCLSCYDGYFLNGKMCDTCPAGTY

SEQ ID NO: 2822791 - protein, 23 aa, Entamoeba invadens
NCLSCYDGYILDNGKCEICPAGT

SEQ ID NO: 2822792 - protein, 18 aa, Entamoeba invadens
NCLSCYNGSYLFNKMCVL

SEQ ID NO: 2822793 - protein, 17 aa, Entamoeba invadens
NCLTCKTGYYLSNGYCV

SEQ ID NO: 2822794 - protein, 22 aa, Entamoeba invadens
NCLTCLNGFTLKDGKCDTCEAG

SEQ ID NO: 2822795 - protein, 22 aa, Entamoeba invadens
NCLTCYESSTFCLSCSDNKFLS

SEQ ID NO: 2822796 - protein, 17 aa, Entamoeba invadens
NCLYCKTGFGFNATNNC

SEQ ID NO: 2822797 - protein, 18 aa, Entamoeba invadens
NCLYWFTTLLCWTAIPFL

SEQ ID NO: 2822798 - protein, 29 aa, Entamoeba invadens
NCMECYIKLYDTLDYYYTPNKKGECYIGM

SEQ ID NO: 2822799 - protein, 21 aa, Entamoeba invadens
NCMFLSGCEIFFKVPCFSLNA

SEQ ID NO: 2822800 - protein, 18 aa, Entamoeba invadens
NCPLFGIVWDIILPEDQQ

SEQ ID NO: 2822801 - protein, 18 aa, Entamoeba invadens
NCSCYFNSMYPDCRNKPN

SEQ ID NO: 2822802 - protein, 18 aa, Entamoeba invadens
NCSIFGKCSQCIIGYYLD

SEQ ID NO: 2822803 - protein, 26 aa, Entamoeba invadens
NCSKNKWMMVIFHTPNNPKYTFYFDP

SEQ ID NO: 2822804 - protein, 17 aa, Entamoeba invadens
NCSRNAKVCLACKDDFV

SEQ ID NO: 2822805 - protein, 26 aa, Entamoeba invadens
NCTGTISFILLNSNLFIYITKEVKEI

SEQ ID NO: 2822806 - protein, 24 aa, Entamoeba invadens
NCTSCYDGTYLYDNKCLPCDTSCT

SEQ ID NO: 2822807 - protein, 18 aa, Entamoeba invadens
NCVKFSRAIKKTVAVLVD

SEQ ID NO: 2822808 - protein, 18 aa, Entamoeba invadens
NCVQLTQIILYTDNGRNP

SEQ ID NO: 2822809 - protein, 25 aa, Entamoeba invadens
NDADTFEFNFRFPAIRAKNCYYVVD

SEQ ID NO: 2822810 - protein, 44 aa, Entamoeba invadens
NDATVFSVVIIVLALYIILVVAAVVGAIYWIKSKGSNSAKDDGY

SEQ ID NO: 2822811 - protein, 28 aa, Entamoeba invadens
NDCLSCKPGYLLIPKENSSYYSCEVKDN

SEQ ID NO: 2822812 - protein, 24 aa, Entamoeba invadens
NDCNLCKSGYVWNINKCESVLNCV

SEQ ID NO: 2822813 - protein, 26 aa, Entamoeba invadens
NDCSLLETEFLLDLSLNPFSVVDFGI

SEQ ID NO: 2822814 - protein, 24 aa, Entamoeba invadens
NDCVCPRGYYLNEQNWKCYVVINI

SEQ ID NO: 2822815 - protein, 24 aa, Entamoeba invadens
NDDFLLFRETPVSYFFKKGKIQRY

SEQ ID NO: 2822816 - protein, 51 aa, Entamoeba invadens
NDDGKLCIKHVVWWVILLCLLFVILLLMTFILIITLVIKKILLNIQKKRDN

SEQ ID NO: 2822817 - protein, 49 aa, Entamoeba invadens
NDDGTLCESHVVWWVILLGVIFVIIVLIIITILIVFITKIVLDRKHQKD

SEQ ID NO: 2822818 - protein, 26 aa, Entamoeba invadens
NDDMNWLWITLGVVGGLLIIAIIIVV

SEQ ID NO: 2822819 - protein, 23 aa, Entamoeba invadens
NDDRFTQPWVIPQFVIEGNRLEK

SEQ ID NO: 2822820 - protein, 25 aa, Entamoeba invadens
NDDTWIWITVGVVSGVFVLIVFLIL

SEQ ID NO: 2822821 - protein, 31 aa, Entamoeba invadens
NDECPKFKLSFFYLQAFVKTVLTIPNYTLKN

SEQ ID NO: 2822822 - protein, 38 aa, Entamoeba invadens
NDEFEKIIRAMYSFTFFWYNFMPLTRGTAAGGMVFMMA

SEQ ID NO: 2822823 - protein, 19 aa, Entamoeba invadens
NDEILTDPKLRSIIFVMLN

SEQ ID NO: 2822824 - protein, 25 aa, Entamoeba invadens
NDERFNQPWMIPQFVIEGKRLEKPN

SEQ ID NO: 2822825 - protein, 29 aa, Entamoeba invadens
NDFIRKNESYLWLLNFTGIIGQKSKHKEI

SEQ ID NO: 2822826 - protein, 20 aa, Entamoeba invadens
NDFKFPWKIAEFVNDGHRLP

SEQ ID NO: 2822827 - protein, 23 aa, Entamoeba invadens
NDFPALLEAIYIDIRQCELSDDV

SEQ ID NO: 2822828 - protein, 21 aa, Entamoeba invadens
NDFSLPTFPFTVYGGLHINGQ

SEQ ID NO: 2822829 - protein, 32 aa, Entamoeba invadens
NDFTTDVKKYTTLQFYMVFESKDNAPVTFKLD

SEQ ID NO: 2822830 - protein, 32 aa, Entamoeba invadens
NDFTTDVKKYTTLQFYMVFESKDNAPVTFTLN

SEQ ID NO: 2822831 - protein, 26 aa, Entamoeba invadens
NDGCFICGETGHWACDCPQKKYGSRG

SEQ ID NO: 2822832 - protein, 17 aa, Entamoeba invadens
NDGFYLENTKCVKCINN

SEQ ID NO: 2822833 - protein, 47 aa, Entamoeba invadens
NDGSYCVYHIKWWLLLVLILFIITVSIFIIFVVYKVSNLIMKKRHIK

SEQ ID NO: 2822834 - protein, 24 aa, Entamoeba invadens
NDGVAPFYYDWKVNFGIIQKESNG

SEQ ID NO: 2822835 - protein, 22 aa, Entamoeba invadens
NDGYLRLSHIYFDDIFSNGNQT

SEQ ID NO: 2822836 - protein, 17 aa, Entamoeba invadens
NDGYYLEDNKCVKCANN

SEQ ID NO: 2822837 - protein, 26 aa, Entamoeba invadens
NDIFVMLFDARYLLMLMGLYSMYCGC

SEQ ID NO: 2822838 - protein, 17 aa, Entamoeba invadens
NDIIYKCGDSVYLNISN

SEQ ID NO: 2822839 - protein, 34 aa, Entamoeba invadens
NDILEQYPLNWLDWLIICVMVVVHFTICETIKWI

SEQ ID NO: 2822840 - protein, 20 aa, Entamoeba invadens
NDKFWKGFTGDYFFESVCIE

SEQ ID NO: 2822841 - protein, 23 aa, Entamoeba invadens
NDKIVLKTLFLQLTNNYAKIKIW

SEQ ID NO: 2822842 - protein, 24 aa, Entamoeba invadens
NDKSPLFLQNGRLQRFFVFEQEYD

SEQ ID NO: 2822843 - protein, 17 aa, Entamoeba invadens
NDKTMLCTSCESGYYLY

SEQ ID NO: 2822844 - protein, 20 aa, Entamoeba invadens
NDLLVYFVHLLALVVFGLFC

SEQ ID NO: 2822845 - protein, 21 aa, Entamoeba invadens
NDLNILFEPILREISPLLTEH

SEQ ID NO: 2822846 - protein, 20 aa, Entamoeba invadens
NDLSFNLLLTDNSIFHIHRE

SEQ ID NO: 2822847 - protein, 34 aa, Entamoeba invadens
NDNGTFCDKKAVWWVLLIVVVFAIIVMAVVITQL

SEQ ID NO: 2822848 - protein, 54 aa, Entamoeba invadens
NDNGTFCNKKAVWWVLLIVVLFAIIVMAVVITSIVFAVLFIEKKMRQKKIEMTA

SEQ ID NO: 2822849 - protein, 18 aa, Entamoeba invadens
NDNLIIDGMVIFKGGIVV

SEQ ID NO: 2822850 - protein, 29 aa, Entamoeba invadens
NDPKHCFGPTLFLVFSAIAFSVSALIVPL

SEQ ID NO: 2822851 - protein, 26 aa, Entamoeba invadens
NDPKRTIYLCIGFTECVFVDPVNTNE

SEQ ID NO: 2822852 - protein, 24 aa, Entamoeba invadens
NDPLLIFIAIVAHKWADSGLAVLY

SEQ ID NO: 2822853 - protein, 21 aa, Entamoeba invadens
NDPRFTQPWNIPQFISEGNRL

SEQ ID NO: 2822854 - protein, 27 aa, Entamoeba invadens
NDPVGRLYDPILLLLLGMASDCCHSLI

SEQ ID NO: 2822855 - protein, 24 aa, Entamoeba invadens
NDQCIPRYPLTCQEYDLFGEILDT

SEQ ID NO: 2822856 - protein, 30 aa, Entamoeba invadens
NDSDDYIKLSYKLKLRILYDTARGMEFLHE

SEQ ID NO: 2822857 - protein, 25 aa, Entamoeba invadens
NDTEDWYITPLQNITSLTIKIGTYT

SEQ ID NO: 2822858 - protein, 23 aa, Entamoeba invadens
NDTIYNLTCQTGFILNEELTCKK

SEQ ID NO: 2822859 - protein, 26 aa, Entamoeba invadens
NDTLRLLFPFSFATKSKIFMNKNEIM

SEQ ID NO: 2822860 - protein, 27 aa, Entamoeba invadens
NDVAFKTLWTLMKKAAVFILYYVDSSR

SEQ ID NO: 2822861 - protein, 24 aa, Entamoeba invadens
NDVDWYITPLYNVTSLLIENTTKS

SEQ ID NO: 2822862 - protein, 25 aa, Entamoeba invadens
NDVGKFYMRFVGVPVGTKIFEKTIS

SEQ ID NO: 2822863 - protein, 24 aa, Entamoeba invadens
NDVPTWVIAVLVVVGVVVIVFILL

SEQ ID NO: 2822864 - protein, 32 aa, Entamoeba invadens
NDVTIFKMFIPPLVTIFRQKPMYRNQAGKCLC

SEQ ID NO: 2822865 - protein, 17 aa, Entamoeba invadens
NDYFCLNCNINFYMIIG

SEQ ID NO: 2822866 - protein, 35 aa, Entamoeba invadens
NDYGNEGFLLMMLYYLGCYITLLKPQKAGRNQKLK

SEQ ID NO: 2822867 - protein, 21 aa, Entamoeba invadens
NDYPIAVILPLNGGGFINLGL

SEQ ID NO: 2822868 - protein, 23 aa, Entamoeba invadens
NDYRACVKCASGFYKDSYNECIK

SEQ ID NO: 2822869 - protein, 26 aa, Entamoeba invadens
NECDKCRMNLLYHPDIKECGVCPSDG

SEQ ID NO: 2822870 - protein, 18 aa, Entamoeba invadens
NECFTCQSGYYLDNTNCV

SEQ ID NO: 2822871 - protein, 18 aa, Entamoeba invadens
NECILCQSGYTLRNKKCE

SEQ ID NO: 2822872 - protein, 28 aa, Entamoeba invadens
NECISIFALLFTFYMWIKAVKTGSPLRG

SEQ ID NO: 2822873 - protein, 20 aa, Entamoeba invadens
NECLKCKSSFLLLSNSTCVS

SEQ ID NO: 2822874 - protein, 29 aa, Entamoeba invadens
NECLKCNINYYLKLGKCYPCNLFDANCTE

SEQ ID NO: 2822875 - protein, 26 aa, Entamoeba invadens
NECLKCNINYYLKLGNCNPCNLFDAN

SEQ ID NO: 2822876 - protein, 26 aa, Entamoeba invadens
NECNQFNFCLQCEPNYFLLTNNTKCI

SEQ ID NO: 2822877 - protein, 17 aa, Entamoeba invadens
NECTSCIDGFYIIKGES

SEQ ID NO: 2822878 - protein, 25 aa, Entamoeba invadens
NECTYCITGYNLDSTNHKCYKCGEN

SEQ ID NO: 2822879 - protein, 19 aa, Entamoeba invadens
NECVYLWTGQRYGVLAESQ

SEQ ID NO: 2822880 - protein, 24 aa, Entamoeba invadens
NEDDLFLLPSAFNHAHLRAINING

SEQ ID NO: 2822881 - protein, 25 aa, Entamoeba invadens
NEEEMFKFLYFWKNSTVVVYDTSKS

SEQ ID NO: 2822882 - protein, 36 aa, Entamoeba invadens
NEEIEPLVYLQKKLYEFSLQLFPYKSPLENAEQNQS

SEQ ID NO: 2822883 - protein, 24 aa, Entamoeba invadens
NEENQCLLFYPNLKDGSCHLCKND

SEQ ID NO: 2822884 - protein, 34 aa, Entamoeba invadens
NEEPILDFWNTLFYLPDFTLPPDNSFIWRYDNET

SEQ ID NO: 2822885 - protein, 22 aa, Entamoeba invadens
NEEVQIAFLISSTLDVCFNNSE

SEQ ID NO: 2822886 - protein, 21 aa, Entamoeba invadens
NEFGCFSCESGNFLNTEKTCQ

SEQ ID NO: 2822887 - protein, 17 aa, Entamoeba invadens
NEFKALLGLIALGADSY

SEQ ID NO: 2822888 - protein, 25 aa, Entamoeba invadens
NEFLTLSCVFLRRGIETVKALPLVF

SEQ ID NO: 2822889 - protein, 26 aa, Entamoeba invadens
NEFNHGFLHFLIGVCAIIGGVFTVFQ

SEQ ID NO: 2822890 - protein, 19 aa, Entamoeba invadens
NEFPYPWNVATFVSDGRRQ

SEQ ID NO: 2822891 - protein, 25 aa, Entamoeba invadens
NEGKYDYCLPLSLAQIEDCKYSYIF

SEQ ID NO: 2822892 - protein, 27 aa, Entamoeba invadens
NEGSCILCNDTFYRIPSNPTKLCLPQS

SEQ ID NO: 2822893 - protein, 18 aa, Entamoeba invadens
NEGTYFQNNKCLLCSPYC

SEQ ID NO: 2822894 - protein, 19 aa, Entamoeba invadens
NEHIDLFNVYFTHTYINDK

SEQ ID NO: 2822895 - protein, 18 aa, Entamoeba invadens
NEIFFKSHTISPMTTAKL

SEQ ID NO: 2822896 - protein, 21 aa, Entamoeba invadens
NEILLFEIVNVMKTLLKMCYE

SEQ ID NO: 2822897 - protein, 29 aa, Entamoeba invadens
NEITTQRYNLFLHYLYPNAKDNEYKLETY

SEQ ID NO: 2822898 - protein, 20 aa, Entamoeba invadens
NEIYILLDERNIKTIFECDH

SEQ ID NO: 2822899 - protein, 27 aa, Entamoeba invadens
NEKDGLALFGAVLGKIYCNGFIAMSVI

SEQ ID NO: 2822900 - protein, 21 aa, Entamoeba invadens
NEKFDIISNPQLIVLGKGEAC

SEQ ID NO: 2822901 - protein, 23 aa, Entamoeba invadens
NEKKTFLNLIPSYNVIEMNVPIT

SEQ ID NO: 2822902 - protein, 17 aa, Entamoeba invadens
NEKLPDLQVYTSALIIG

SEQ ID NO: 2822903 - protein, 25 aa, Entamoeba invadens
NEKSIPLFLTLLKNVSRISIPDDSQ

SEQ ID NO: 2822904 - protein, 34 aa, Entamoeba invadens
NEKYFPYCVVWSTIPLISWFIPFVGHTGIGDSNG

SEQ ID NO: 2822905 - protein, 20 aa, Entamoeba invadens
NEKYYISFDPHIITIPPNYG

SEQ ID NO: 2822906 - protein, 20 aa, Entamoeba invadens
NELIPTILSLVVRPTAETVN

SEQ ID NO: 2822907 - protein, 19 aa, Entamoeba invadens
NELLKKLEPLCTHVLKLLE

SEQ ID NO: 2822908 - protein, 22 aa, Entamoeba invadens
NELTLFKLKYTNMTFVEMADGL

SEQ ID NO: 2822909 - protein, 18 aa, Entamoeba invadens
NEMIQKYPTITLIVFECG

SEQ ID NO: 2822910 - protein, 26 aa, Entamoeba invadens
NENEKIVLLRRKRLVILKSIEQLAKS

SEQ ID NO: 2822911 - protein, 18 aa, Entamoeba invadens
NENLILKFTKERKNIVIS

SEQ ID NO: 2822912 - protein, 25 aa, Entamoeba invadens
NENTYLPIKQFASSNYKYASNFVAL

SEQ ID NO: 2822913 - protein, 23 aa, Entamoeba invadens
NENYQIMLTFLFAKLVDTSVDFL

SEQ ID NO: 2822914 - protein, 20 aa, Entamoeba invadens
NEPILAKSADWFCKEMRIKA

SEQ ID NO: 2822915 - protein, 27 aa, Entamoeba invadens
NEQLNNKILFIILGKLTNTNNVLSSCG

SEQ ID NO: 2822916 - protein, 27 aa, Entamoeba invadens
NEQVCNVCFPPYYVTAGKKSCSLAYTD

SEQ ID NO: 2822917 - protein, 24 aa, Entamoeba invadens
NERDAIFMLKTLKGLHLSDLDTTD

SEQ ID NO: 2822918 - protein, 28 aa, Entamoeba invadens
NERKILLEIIYSFLNYNVIVDPSILKGN

SEQ ID NO: 2822919 - protein, 24 aa, Entamoeba invadens
NERKSMQWMAPLYKEYPGGESVMF

SEQ ID NO: 2822920 - protein, 24 aa, Entamoeba invadens
NERLERWWYILTDASDSYVITATC

SEQ ID NO: 2822921 - protein, 31 aa, Entamoeba invadens
NERSKKIFRLLFPYFLQSSSIEIIVIIFPFL

SEQ ID NO: 2822922 - protein, 17 aa, Entamoeba invadens
NESELYWLLECTGIDCF

SEQ ID NO: 2822923 - protein, 22 aa, Entamoeba invadens
NESSELLFIDSFVIVQMVNNGK

SEQ ID NO: 2822924 - protein, 17 aa, Entamoeba invadens
NETIPREFLLNPIDERS

SEQ ID NO: 2822925 - protein, 25 aa, Entamoeba invadens
NETKIMWNIVNLNNELLFKRHPELF

SEQ ID NO: 2822926 - protein, 32 aa, Entamoeba invadens
NETLEILSLAIWLCYFWKGYQNVIESNVAFQI

SEQ ID NO: 2822927 - protein, 20 aa, Entamoeba invadens
NEVLNWTSLTLLNLSHNKIT

SEQ ID NO: 2822928 - protein, 27 aa, Entamoeba invadens
NEVLTVQYLLAHIPLSLAAVSLVLSND

SEQ ID NO: 2822929 - protein, 23 aa, Entamoeba invadens
NEVPFVIHNVIKELLFRGSETLK

SEQ ID NO: 2822930 - protein, 45 aa, Entamoeba invadens
NEVPTWAIIVIVLGVIFIFVVIIVVAIILVMKLIKAKHIDLSIFR

SEQ ID NO: 2822931 - protein, 25 aa, Entamoeba invadens
NEVSTLFLLNNKLVRFCPIKSMNNT

SEQ ID NO: 2822932 - protein, 17 aa, Entamoeba invadens
NEYAHYVVLFLASYTQS

SEQ ID NO: 2822933 - protein, 23 aa, Entamoeba invadens
NEYKLIFGSIPFYGTNLQRQLAP

SEQ ID NO: 2822934 - protein, 31 aa, Entamoeba invadens
NEYNDCLLCQPLTVDALYSLPDDKGRCLNRD

SEQ ID NO: 2822935 - protein, 30 aa, Entamoeba invadens
NEYSFFMVELVLTVLKIFHLVPLVTQNIVL

SEQ ID NO: 2822936 - protein, 33 aa, Entamoeba invadens
NFAYKFVAISNTYMFDILYFFDKDKRVTQQKYD

SEQ ID NO: 2822937 - protein, 22 aa, Entamoeba invadens
NFCDLWRTRTVDWTSPIFFQIF

SEQ ID NO: 2822938 - protein, 18 aa, Entamoeba invadens
NFCHLFNISFCKISSNKM

SEQ ID NO: 2822939 - protein, 52 aa, Entamoeba invadens
NFCKEKTKIWVYIVILFSIILLIIIIISIIILPLYFIFKKHKNTEEKTIFKM

SEQ ID NO: 2822940 - protein, 20 aa, Entamoeba invadens
NFCTSCGVGFYLSSMKICST

SEQ ID NO: 2822941 - protein, 18 aa, Entamoeba invadens
NFCYSCNDGFMLSNNECV

SEQ ID NO: 2822942 - protein, 21 aa, Entamoeba invadens
NFDKITIFNTLSFSGTGLTEI

SEQ ID NO: 2822943 - protein, 23 aa, Entamoeba invadens
NFDLIYSLTRITVTYLAGTQLLM

SEQ ID NO: 2822944 - protein, 23 aa, Entamoeba invadens
NFEQLYCLPIHTNAKYNVYSKTT

SEQ ID NO: 2822945 - protein, 19 aa, Entamoeba invadens
NFESFIPVLLVASSIVSHL

SEQ ID NO: 2822946 - protein, 17 aa, Entamoeba invadens
NFEYLMYLNVKSGRSGL

SEQ ID NO: 2822947 - protein, 18 aa, Entamoeba invadens
NFFEFFDKKISHTDFLYS

SEQ ID NO: 2822948 - protein, 37 aa, Entamoeba invadens
NFFSVPTMATIFGIIFMLLKWIRDPLLVSGGLEYNRG

SEQ ID NO: 2822949 - protein, 42 aa, Entamoeba invadens
NFGVSVLVLFIFFLSCVFVLVLMLFVITLKPSKYRYTIIPNS

SEQ ID NO: 2822950 - protein, 18 aa, Entamoeba invadens
NFIGIVFVSVYFGKLLGT

SEQ ID NO: 2822951 - protein, 19 aa, Entamoeba invadens
NFILINEVCNPLSVVQYCV

SEQ ID NO: 2822952 - protein, 18 aa, Entamoeba invadens
NFIYIKTDAYCVIGSELG

SEQ ID NO: 2822953 - protein, 22 aa, Entamoeba invadens
NFKGKYSLRLISFDKNKLVLNN

SEQ ID NO: 2822954 - protein, 29 aa, Entamoeba invadens
NFLEDFFVHNFLHLEFLAILTNKVPSKFT

SEQ ID NO: 2822955 - protein, 27 aa, Entamoeba invadens
NFLNFGVCAIGWYLAAVFLNQDMDINV

SEQ ID NO: 2822956 - protein, 19 aa, Entamoeba invadens
NFLNLDFPTFYLSTSFRNS

SEQ ID NO: 2822957 - protein, 24 aa, Entamoeba invadens
NFLTIILCLPLLPIQMVTGYIIGF

SEQ ID NO: 2822958 - protein, 18 aa, Entamoeba invadens
NFMFRTEPESTFLRPNRE

SEQ ID NO: 2822959 - protein, 19 aa, Entamoeba invadens
NFMYRLRISTQITLPNFFV

SEQ ID NO: 2822960 - protein, 19 aa, Entamoeba invadens
NFNCFLCDDNYYLNINNTC

SEQ ID NO: 2822961 - protein, 25 aa, Entamoeba invadens
NFNDFLNFVQISIHFVLFVLVIDYS

SEQ ID NO: 2822962 - protein, 33 aa, Entamoeba invadens
NFNEGIVFLLSNGRLMRFCPSNIITPERTVTCT

SEQ ID NO: 2822963 - protein, 19 aa, Entamoeba invadens
NFNGFPFDFTNISLHSTPL

SEQ ID NO: 2822964 - protein, 24 aa, Entamoeba invadens
NFNTRVRLLRFLQFGKNEVADYKV

SEQ ID NO: 2822965 - protein, 31 aa, Entamoeba invadens
NFPAYFAQNFILLLFYFCRNIKKQQLLRLKE

SEQ ID NO: 2822966 - protein, 25 aa, Entamoeba invadens
NFPSLVCLLFFILLYSYNNYYHTLE

SEQ ID NO: 2822967 - protein, 19 aa, Entamoeba invadens
NFQQFKCLVSSFGIDLFGP

SEQ ID NO: 2822968 - protein, 45 aa, Entamoeba invadens
NFRINAVVIVIPILVFLIILIIVFVIIVIIVFKVTRYKADKKRQQ

SEQ ID NO: 2822969 - protein, 21 aa, Entamoeba invadens
NFRYNFSFFSSTQSNVFFTIN

SEQ ID NO: 2822970 - protein, 30 aa, Entamoeba invadens
NFTLNSSVLLGYYLVPLKYDNDTIKQPITF

SEQ ID NO: 2822971 - protein, 25 aa, Entamoeba invadens
NFVAWNFFILYFSQTLTFIAMSITD

SEQ ID NO: 2822972 - protein, 24 aa, Entamoeba invadens
NFVCKLQCLFTSNSFLQLSSSMSC

SEQ ID NO: 2822973 - protein, 24 aa, Entamoeba invadens
NFVEEWLLRFKAIDPLATDIKEQQ

SEQ ID NO: 2822974 - protein, 30 aa, Entamoeba invadens
NFVEVTMYILWVLFLITSIPSVVVYSMFYP

SEQ ID NO: 2822975 - protein, 18 aa, Entamoeba invadens
NFVMPFIDAFCTFSSTIK

SEQ ID NO: 2822976 - protein, 45 aa, Entamoeba invadens
NFVMVTMISLCVLCFGYLLYFLLLLFIVCVFYRKLNQKIAEELGE

SEQ ID NO: 2822977 - protein, 27 aa, Entamoeba invadens
NFYKIDPPYSLHFFMKFLAQHEEYHPY

SEQ ID NO: 2822978 - protein, 17 aa, Entamoeba invadens
NFYKLRGIGNLIKEIML

SEQ ID NO: 2822979 - protein, 17 aa, Entamoeba invadens
NFYLFNKKQKKDRERGV

SEQ ID NO: 2822980 - protein, 19 aa, Entamoeba invadens
NFYVAQNALLIFSVIDQKP

SEQ ID NO: 2822981 - protein, 24 aa, Entamoeba invadens
NFYVEIRLEPKLGFPSTGVSFLPL

SEQ ID NO: 2822982 - protein, 22 aa, Entamoeba invadens
NGACVKCHEGCQTCDSSNSESC

SEQ ID NO: 2822983 - protein, 17 aa, Entamoeba invadens
NGASYYEFFLNQNITKL

SEQ ID NO: 2822984 - protein, 25 aa, Entamoeba invadens
NGAVKFIFGLFLSIGLNIVVLTNCE

SEQ ID NO: 2822985 - protein, 19 aa, Entamoeba invadens
NGCLVCKVGYYKKGADCVL

SEQ ID NO: 2822986 - protein, 18 aa, Entamoeba invadens
NGCQKCILGYFPDEKRCS

SEQ ID NO: 2822987 - protein, 31 aa, Entamoeba invadens
NGCVKLLSVNFYAPLTKLLDSLASQNNLFFH

SEQ ID NO: 2822988 - protein, 22 aa, Entamoeba invadens
NGDGWLLIMNSIQPESASTANP

SEQ ID NO: 2822989 - protein, 23 aa, Entamoeba invadens
NGDNCLKCDVGYILSSKECVKKD

SEQ ID NO: 2822990 - protein, 22 aa, Entamoeba invadens
NGDNCLKCDVGYYLSSKTCVKK

SEQ ID NO: 2822991 - protein, 29 aa, Entamoeba invadens
NGDNLFVLRFIILLLLNMYSAFTVFLGAR

SEQ ID NO: 2822992 - protein, 34 aa, Entamoeba invadens
NGDVYTAFLIVPFLILIIGVVIMLVTHSSFFQNF

SEQ ID NO: 2822993 - protein, 25 aa, Entamoeba invadens
NGECLLCDNGFYLYISKCYSCDSSC

SEQ ID NO: 2822994 - protein, 36 aa, Entamoeba invadens
NGEECSFVLLPYDTLMRMNLLLRPTRINKLGNSFMS

SEQ ID NO: 2822995 - protein, 17 aa, Entamoeba invadens
NGEIVGLVIGCVCAFLI

SEQ ID NO: 2822996 - protein, 22 aa, Entamoeba invadens
NGENCLKCDVGYILSSNECVKT

SEQ ID NO: 2822997 - protein, 17 aa, Entamoeba invadens
NGETQMCKTCELGYYLV

SEQ ID NO: 2822998 - protein, 30 aa, Entamoeba invadens
NGFKAIFTHPLLFSIVFMVSGGLLNGLMIP

SEQ ID NO: 2822999 - protein, 19 aa, Entamoeba invadens
NGFYCKFIEFNKNDPLEDT

SEQ ID NO: 2823000 - protein, 26 aa, Entamoeba invadens
NGGARLYFDYYLSAEPVRFKLITTFA

SEQ ID NO: 2823001 - protein, 27 aa, Entamoeba invadens
NGIGFGVVFMCLFGFNALGCYYGFLVM

SEQ ID NO: 2823002 - protein, 22 aa, Entamoeba invadens
NGIIQFNMLKFLLNNTELVVNK

SEQ ID NO: 2823003 - protein, 19 aa, Entamoeba invadens
NGILAILKGHGFDFKTKNT

SEQ ID NO: 2823004 - protein, 21 aa, Entamoeba invadens
NGIVEVGGVIRPIPLNMGGVS

SEQ ID NO: 2823005 - protein, 21 aa, Entamoeba invadens
NGKCVLNDSIICKEFVGNVCK

SEQ ID NO: 2823006 - protein, 22 aa, Entamoeba invadens
NGKGYVSIAFLYVTEMMFDQDF

SEQ ID NO: 2823007 - protein, 23 aa, Entamoeba invadens
NGKKPQIYKMKYSKYPHFGNTET

SEQ ID NO: 2823008 - protein, 17 aa, Entamoeba invadens
NGKKTTSILLTAHIRLY

SEQ ID NO: 2823009 - protein, 22 aa, Entamoeba invadens
NGKLSYWAEPLYLTCVLTSTDE

SEQ ID NO: 2823010 - protein, 48 aa, Entamoeba invadens
NGKYCETHAVWWVILLSIIGVFLFFMFLIFITAFIIFKNISAKKALAD

SEQ ID NO: 2823011 - protein, 22 aa, Entamoeba invadens
NGLFIFLYCATFYFLVATISGI

SEQ ID NO: 2823012 - protein, 25 aa, Entamoeba invadens
NGLLLDLIALSIRYGAKNIWNGNKN

SEQ ID NO: 2823013 - protein, 26 aa, Entamoeba invadens
NGLQTDKLFFAISRYFQTNFIFHVTP

SEQ ID NO: 2823014 - protein, 39 aa, Entamoeba invadens
NGLSCYTQIVWWVILICVIVALLILTIKNIKKPQIYTHL

SEQ ID NO: 2823015 - protein, 18 aa, Entamoeba invadens
NGLSLILPDISIPKDISI

SEQ ID NO: 2823016 - protein, 24 aa, Entamoeba invadens
NGLSTGCYYCKQGYYPYGDTTCVS

SEQ ID NO: 2823017 - protein, 19 aa, Entamoeba invadens
NGMVQIPFFDAKKDQTPLK

SEQ ID NO: 2823018 - protein, 21 aa, Entamoeba invadens
NGNEIFLYGNFRLTGEEGIYT

SEQ ID NO: 2823019 - protein, 25 aa, Entamoeba invadens
NGNSLADFWAIRPQGFNKNGTFDIE

SEQ ID NO: 2823020 - protein, 21 aa, Entamoeba invadens
NGNVVFFDFFYSAVCIMTEKG

SEQ ID NO: 2823021 - protein, 25 aa, Entamoeba invadens
NGPDFTSVIGQYKFFRNIKLADSTS

SEQ ID NO: 2823022 - protein, 35 aa, Entamoeba invadens
NGPVWTLFFEYIGLLMFVLIIRKLKIQILSVVVFL

SEQ ID NO: 2823023 - protein, 24 aa, Entamoeba invadens
NGRAIRIPFMPPPNVEKDKKFFYY

SEQ ID NO: 2823024 - protein, 23 aa, Entamoeba invadens
NGRIDAVWIWVNGSDPTWCSNLN

SEQ ID NO: 2823025 - protein, 22 aa, Entamoeba invadens
NGRTRVFYLEKGGKREKFVTEI

SEQ ID NO: 2823026 - protein, 52 aa, Entamoeba invadens
NGSYCERSAVWWVILLIVIVCLALISIIVVVIVHILYRIISKYVRNRNLDDL

SEQ ID NO: 2823027 - protein, 42 aa, Entamoeba invadens
NGTFCEVHSVWWVILILVIVIVYFIITIVFVFSITTKKIIEK

SEQ ID NO: 2823028 - protein, 50 aa, Entamoeba invadens
NGTFCNIKAVWWMIVVIVVVCILLIILITTILFIIIKIVIKNIEMKKKEK

SEQ ID NO: 2823029 - protein, 32 aa, Entamoeba invadens
NGTLCNNKVVWWVILICVTFAIVHRKSNKQTT

SEQ ID NO: 2823030 - protein, 25 aa, Entamoeba invadens
NGVCRSCISNYVFIAGGGGTSCEKC

SEQ ID NO: 2823031 - protein, 32 aa, Entamoeba invadens
NGVEVIHLFTGKPVFHITLLPSTVSSASSFVD

SEQ ID NO: 2823032 - protein, 20 aa, Entamoeba invadens
NGVKLEFPVTLKIYSINGDY

SEQ ID NO: 2823033 - protein, 18 aa, Entamoeba invadens
NGVLLNGKCILTPTDNII

SEQ ID NO: 2823034 - protein, 26 aa, Entamoeba invadens
NGVVVPLFNMNFFKTAKRYTLNVNTL

SEQ ID NO: 2823035 - protein, 52 aa, Entamoeba invadens
NGVYCQKSAVWWVIVLFILFLLVIVTIVILVIILVIKLLLNRLRNKSVLGQM

SEQ ID NO: 2823036 - protein, 17 aa, Entamoeba invadens
NGYDCIKCDESCQMCDG

SEQ ID NO: 2823037 - protein, 17 aa, Entamoeba invadens
NGYIIINKIISTEVFAL

SEQ ID NO: 2823038 - protein, 25 aa, Entamoeba invadens
NGYNIYPTCYPHKLSKAIFFEVFLT

SEQ ID NO: 2823039 - protein, 20 aa, Entamoeba invadens
NGYPYFMIGANAISPYDGYD

SEQ ID NO: 2823040 - protein, 27 aa, Entamoeba invadens
NGYRLVMFIIIFMQIIRNVFYYLACIY

SEQ ID NO: 2823041 - protein, 26 aa, Entamoeba invadens
NGYSYAIVFFFLVFVRLLNSNDNYPQ

SEQ ID NO: 2823042 - protein, 20 aa, Entamoeba invadens
NHAYLAVDFFFLLSGYMTSY

SEQ ID NO: 2823043 - protein, 32 aa, Entamoeba invadens
NHDKEFDFALFTQPFNISTLPLGFNMLADNHL

SEQ ID NO: 2823044 - protein, 18 aa, Entamoeba invadens
NHEKYYLMELNLKEPNIG

SEQ ID NO: 2823045 - protein, 17 aa, Entamoeba invadens
NHFLSNQMCVALGKCDS

SEQ ID NO: 2823046 - protein, 36 aa, Entamoeba invadens
NHGVLIIGKIIYRNVFSRLTQWNILVLKGGNVRPLN

SEQ ID NO: 2823047 - protein, 23 aa, Entamoeba invadens
NHGYLAVDFFFLLSGFVLSFSYE

SEQ ID NO: 2823048 - protein, 22 aa, Entamoeba invadens
NHMYHTFTLLFTNSLSKNQLNF

SEQ ID NO: 2823049 - protein, 25 aa, Entamoeba invadens
NHNKDFINKILFSVDKKLTGDGILS

SEQ ID NO: 2823050 - protein, 28 aa, Entamoeba invadens
NHNVRVFFCELLLYKITVCPSWNRVKSN

SEQ ID NO: 2823051 - protein, 25 aa, Entamoeba invadens
NHPCYSVYFQYSKTVTFLPAFDAYG

SEQ ID NO: 2823052 - protein, 26 aa, Entamoeba invadens
NHSRNKWMMVIFHTPNNPKFVFHFEP

SEQ ID NO: 2823053 - protein, 24 aa, Entamoeba invadens
NHTKRFMLIIFHTPNIQKYTVHFC

SEQ ID NO: 2823054 - protein, 19 aa, Entamoeba invadens
NIANKCEYCLLGTYSSSPK

SEQ ID NO: 2823055 - protein, 26 aa, Entamoeba invadens
NIATDPFYHLSRFLRKMKLTVTNEQK

SEQ ID NO: 2823056 - protein, 33 aa, Entamoeba invadens
NIAYYASQWLGIAAFCLYLTSLVLYVPPVTSVS

SEQ ID NO: 2823057 - protein, 18 aa, Entamoeba invadens
NICEKVVSDLIFLRDFEN

SEQ ID NO: 2823058 - protein, 18 aa, Entamoeba invadens
NICFSCFTNYSLYENKCV

SEQ ID NO: 2823059 - protein, 27 aa, Entamoeba invadens
NICLQCQMGYYLFNGYCKNCTSTNPNF

SEQ ID NO: 2823060 - protein, 26 aa, Entamoeba invadens
NICMKCKSPYYLYLNEDRSTKCESTC

SEQ ID NO: 2823061 - protein, 18 aa, Entamoeba invadens
NICTACTTGYYMDKTTCK

SEQ ID NO: 2823062 - protein, 17 aa, Entamoeba invadens
NICVFKMKHSNIRFARI

SEQ ID NO: 2823063 - protein, 17 aa, Entamoeba invadens
NICVFPMKRSNIQMFQL

SEQ ID NO: 2823064 - protein, 18 aa, Entamoeba invadens
NICVLCKTGYILNEKFEC

SEQ ID NO: 2823065 - protein, 25 aa, Entamoeba invadens
NICYGCYDGYYLSNYNCYPCVLPCA

SEQ ID NO: 2823066 - protein, 21 aa, Entamoeba invadens
NIDQHWWIVFHRNETLSYSPY

SEQ ID NO: 2823067 - protein, 23 aa, Entamoeba invadens
NIDSTLVYLIYSSTSKTLFCNGN

SEQ ID NO: 2823068 - protein, 24 aa, Entamoeba invadens
NIEGKYSFCLPLVSTSIPNCKHAT

SEQ ID NO: 2823069 - protein, 18 aa, Entamoeba invadens
NIEKVILRHLRLAMRKVN

SEQ ID NO: 2823070 - protein, 25 aa, Entamoeba invadens
NIELLLYILALFILVVIQTHFKKYK

SEQ ID NO: 2823071 - protein, 17 aa, Entamoeba invadens
NIEVYKYLESLAKKLGV

SEQ ID NO: 2823072 - protein, 23 aa, Entamoeba invadens
NIFEPIFLSTLNPDKYPELTHFL

SEQ ID NO: 2823073 - protein, 21 aa, Entamoeba invadens
NIFHIGKLYIGTRHLCFLPSK

SEQ ID NO: 2823074 - protein, 22 aa, Entamoeba invadens
NIFYAFFYRKLSAQMTFLISVF

SEQ ID NO: 2823075 - protein, 20 aa, Entamoeba invadens
NIGPDYWLVAASIMKNLYEM

SEQ ID NO: 2823076 - protein, 22 aa, Entamoeba invadens
NIGQLIIITLASIVIFVSSMII

SEQ ID NO: 2823077 - protein, 19 aa, Entamoeba invadens
NIHFVFLQNGICVSSKEIN

SEQ ID NO: 2823078 - protein, 25 aa, Entamoeba invadens
NIHSPNTIYYPIVISNLNKPELVTV

SEQ ID NO: 2823079 - protein, 20 aa, Entamoeba invadens
NIICFSGIKITQFLSIETPD

SEQ ID NO: 2823080 - protein, 19 aa, Entamoeba invadens
NIIIIGAFVLSILAYVLVY

SEQ ID NO: 2823081 - protein, 26 aa, Entamoeba invadens
NIILNAISFNYGIISGFGKFTIEAYQ

SEQ ID NO: 2823082 - protein, 27 aa, Entamoeba invadens
NIINYNILCITFQIYFFINGENSNNQN

SEQ ID NO: 2823083 - protein, 19 aa, Entamoeba invadens
NIIQSYANKPLFYCNQNIE

SEQ ID NO: 2823084 - protein, 20 aa, Entamoeba invadens
NIISCQYGYYVNSDLNSCEK

SEQ ID NO: 2823085 - protein, 31 aa, Entamoeba invadens
NIISFLEVLFVTFPLDFMGEYLLTFSSQAFP

SEQ ID NO: 2823086 - protein, 18 aa, Entamoeba invadens
NIISLCWCQDPKSRLQIE

SEQ ID NO: 2823087 - protein, 17 aa, Entamoeba invadens
NIISLVNSSILKWCKVK

SEQ ID NO: 2823088 - protein, 21 aa, Entamoeba invadens
NIKDYYGIPEFIYLGPDENMH

SEQ ID NO: 2823089 - protein, 28 aa, Entamoeba invadens
NIKKPQIYTHLVLQCLKLLDGVIFIQKQ

SEQ ID NO: 2823090 - protein, 24 aa, Entamoeba invadens
NIKKYGEFYMFVTGLLISIGALCV

SEQ ID NO: 2823091 - protein, 19 aa, Entamoeba invadens
NIKSIIVSTPFIGKQFEIS

SEQ ID NO: 2823092 - protein, 21 aa, Entamoeba invadens
NIKTCTFCESNYLLLTNSSAC

SEQ ID NO: 2823093 - protein, 23 aa, Entamoeba invadens
NIKVEFLIEVFINNLTITSIGDY

SEQ ID NO: 2823094 - protein, 32 aa, Entamoeba invadens
NILDNEVVLLIKKLEAFPLMFSTGASVSWPEG

SEQ ID NO: 2823095 - protein, 19 aa, Entamoeba invadens
NILFPRIHISHTTNLKVVT

SEQ ID NO: 2823096 - protein, 25 aa, Entamoeba invadens
NILHLLRALVLHKSILMEGSPGVGK

SEQ ID NO: 2823097 - protein, 17 aa, Entamoeba invadens
NILIFSLDVNYNVNAKL

SEQ ID NO: 2823098 - protein, 17 aa, Entamoeba invadens
NILLFTLDDSSIIVSKL

SEQ ID NO: 2823099 - protein, 25 aa, Entamoeba invadens
NILLIVVIVHLFAASLLFFSICSSS

SEQ ID NO: 2823100 - protein, 18 aa, Entamoeba invadens
NILLYIAAICLGSVMYFC

SEQ ID NO: 2823101 - protein, 34 aa, Entamoeba invadens
NILNFKNNKYFFLADNKLMRWCPSAEINTTVVKC

SEQ ID NO: 2823102 - protein, 29 aa, Entamoeba invadens
NILNFKNNKYFFLADNKLMRWCPSAEKNI

SEQ ID NO: 2823103 - protein, 18 aa, Entamoeba invadens
NILTTRQYWWCGANNENM

SEQ ID NO: 2823104 - protein, 26 aa, Entamoeba invadens
NIMIIIMLYVIYLVNSYEFNCYPVGY

SEQ ID NO: 2823105 - protein, 19 aa, Entamoeba invadens
NIMITKNMFFVAANGFEYN

SEQ ID NO: 2823106 - protein, 18 aa, Entamoeba invadens
NIMYKCKTVYDGDVSSCI

SEQ ID NO: 2823107 - protein, 17 aa, Entamoeba invadens
NINDIICGCWKNEPSKR

SEQ ID NO: 2823108 - protein, 18 aa, Entamoeba invadens
NINFYRFPELRGNSTFIA

SEQ ID NO: 2823109 - protein, 24 aa, Entamoeba invadens
NINKRLLIWDRYAGITLYTSLHNL

SEQ ID NO: 2823110 - protein, 31 aa, Entamoeba invadens
NINNLSLSLLCKPNYIFTLKDSLCSDDTNCA

SEQ ID NO: 2823111 - protein, 23 aa, Entamoeba invadens
NINSLLSNMTFTKGIGTPVYMAP

SEQ ID NO: 2823112 - protein, 18 aa, Entamoeba invadens
NINVFMTLTANPVFEMYD

SEQ ID NO: 2823113 - protein, 21 aa, Entamoeba invadens
NIPDEGYIYRGFMFTAFADTT

SEQ ID NO: 2823114 - protein, 31 aa, Entamoeba invadens
NIPFDTYKVFFYFRLLLLVTAKKIFIYNFRE

SEQ ID NO: 2823115 - protein, 19 aa, Entamoeba invadens
NIPLVLYITQQTIYTTFRI

SEQ ID NO: 2823116 - protein, 18 aa, Entamoeba invadens
NIPTPILLDLNTPLDYSF

SEQ ID NO: 2823117 - protein, 21 aa, Entamoeba invadens
NIQNFDVIGISKLVTVKGSSN

SEQ ID NO: 2823118 - protein, 22 aa, Entamoeba invadens
NIQTLRLRPPFKDQQWSVNTKN

SEQ ID NO: 2823119 - protein, 27 aa, Entamoeba invadens
NIQTLYLPSYKCIIPQLSKFNISFIKV

SEQ ID NO: 2823120 - protein, 23 aa, Entamoeba invadens
NIQTNLEKLLLGNKYKFSNTIDS

SEQ ID NO: 2823121 - protein, 17 aa, Entamoeba invadens
NIRQGLFDVLYSGYFGS

SEQ ID NO: 2823122 - protein, 17 aa, Entamoeba invadens
NIRYLFIISDNQRQKFT

SEQ ID NO: 2823123 - protein, 20 aa, Entamoeba invadens
NISEGMFVGCERLKTIKGIE

SEQ ID NO: 2823124 - protein, 32 aa, Entamoeba invadens
NISICFNHDFTFTTLFSCGLLVFSSPNEITIY

SEQ ID NO: 2823125 - protein, 17 aa, Entamoeba invadens
NISICTDTLFMKKTFFN

SEQ ID NO: 2823126 - protein, 18 aa, Entamoeba invadens
NISLIFPVSGSTTKCIDF

SEQ ID NO: 2823127 - protein, 25 aa, Entamoeba invadens
NISPDKVTVPPLPTPIIKQNSDIDN

SEQ ID NO: 2823128 - protein, 23 aa, Entamoeba invadens
NISTFIHNIVVWKVSYTNSKAIK

SEQ ID NO: 2823129 - protein, 24 aa, Entamoeba invadens
NITAFPMTFKPLTLPKPKNNFKVS

SEQ ID NO: 2823130 - protein, 26 aa, Entamoeba invadens
NITDLKYYYIFIRTKDYAFADFHLEI

SEQ ID NO: 2823131 - protein, 25 aa, Entamoeba invadens
NITKWVLDALNLFDAPLVKCVFCTS

SEQ ID NO: 2823132 - protein, 38 aa, Entamoeba invadens
NITSDFLCKFLSLPRLPLPLFSALLHLTATLSFTSQSF

SEQ ID NO: 2823133 - protein, 18 aa, Entamoeba invadens
NIVLYQYLSSLGSWRRNL

SEQ ID NO: 2823134 - protein, 25 aa, Entamoeba invadens
NIVMALLFLVVVFIAVWASLENSVE

SEQ ID NO: 2823135 - protein, 23 aa, Entamoeba invadens
NIVSCLSSYFLMNNKCVLCSSKY

SEQ ID NO: 2823136 - protein, 26 aa, Entamoeba invadens
NKAEEPLYAYLISRVFPPVHSLNALT

SEQ ID NO: 2823137 - protein, 23 aa, Entamoeba invadens
NKAKPIILSLNKDSTQFKGLVEK

SEQ ID NO: 2823138 - protein, 20 aa, Entamoeba invadens
NKCDGCEDGYYWSATDKKCY

SEQ ID NO: 2823139 - protein, 32 aa, Entamoeba invadens
NKCLLCAQNYFKKNYLCVSCSSLNKCISCSDE

SEQ ID NO: 2823140 - protein, 26 aa, Entamoeba invadens
NKCLSCQDPYYLFNQTCLSCASGSYK

SEQ ID NO: 2823141 - protein, 20 aa, Entamoeba invadens
NKCNGCVPGYYLQSGDKSPC

SEQ ID NO: 2823142 - protein, 23 aa, Entamoeba invadens
NKCSSICFLGVNSILCKHEACTV

SEQ ID NO: 2823143 - protein, 27 aa, Entamoeba invadens
NKDEAKIERLLFTPQRFIDTKYVLSSG

SEQ ID NO: 2823144 - protein, 17 aa, Entamoeba invadens
NKDFTIPEKTQVTIGTL

SEQ ID NO: 2823145 - protein, 23 aa, Entamoeba invadens
NKDLFRCLLKLYQQICCSVYFWT

SEQ ID NO: 2823146 - protein, 24 aa, Entamoeba invadens
NKEDYVKLPYKLKVRMLYDTSRGM

SEQ ID NO: 2823147 - protein, 30 aa, Entamoeba invadens
NKEKEISLKMKVKIIWDGARGIKYLHENGI

SEQ ID NO: 2823148 - protein, 20 aa, Entamoeba invadens
NKEKIFTKVFKKIPNKEIQK

SEQ ID NO: 2823149 - protein, 34 aa, Entamoeba invadens
NKELSLTQFFSKCKNWFFAGEILILHVLKEQPNA

SEQ ID NO: 2823150 - protein, 44 aa, Entamoeba invadens
NKENLHENLKENLNYILNVANKELKIPLIIDGQVIVDGIIEEDI

SEQ ID NO: 2823151 - protein, 25 aa, Entamoeba invadens
NKEVVGLLLFKEKWFEKLERENPNG

SEQ ID NO: 2823152 - protein, 22 aa, Entamoeba invadens
NKFIFKVEPEVVLIKRGCACEF

SEQ ID NO: 2823153 - protein, 23 aa, Entamoeba invadens
NKFKFRYRRGLPVVLKGITAKIL

SEQ ID NO: 2823154 - protein, 28 aa, Entamoeba invadens
NKFRSDFIVHFYGAVFIPSKVCLVTEFA

SEQ ID NO: 2823155 - protein, 26 aa, Entamoeba invadens
NKFRSDYIVHFYGAVFIISKVCLVTE

SEQ ID NO: 2823156 - protein, 26 aa, Entamoeba invadens
NKFRSEYIVHFYGAVFIPNRVCMVTE

SEQ ID NO: 2823157 - protein, 20 aa, Entamoeba invadens
NKFVYTLFRNNEIAFHVAPY

SEQ ID NO: 2823158 - protein, 27 aa, Entamoeba invadens
NKGDYHLWLIPAYIACLFRLLKMLRED

SEQ ID NO: 2823159 - protein, 17 aa, Entamoeba invadens
NKGVLLLKESSTIYFQN

SEQ ID NO: 2823160 - protein, 18 aa, Entamoeba invadens
NKGYYPSQYTEKCEPCST

SEQ ID NO: 2823161 - protein, 24 aa, Entamoeba invadens
NKHTSIYITTHRIIFFSHPNKDCS

SEQ ID NO: 2823162 - protein, 20 aa, Entamoeba invadens
NKICKFSLLDALQLFGHENF

SEQ ID NO: 2823163 - protein, 20 aa, Entamoeba invadens
NKICVFNMNKSNIPFTGFSE

SEQ ID NO: 2823164 - protein, 29 aa, Entamoeba invadens
NKIQNEYPQFLYSVYQYFNYDDCKYEDSQ

SEQ ID NO: 2823165 - protein, 31 aa, Entamoeba invadens
NKITKLVIITNLTLIHTLFFSTKNTSYQYVK

SEQ ID NO: 2823166 - protein, 23 aa, Entamoeba invadens
NKKILTLKKNLFTILTRGMWYIN

SEQ ID NO: 2823167 - protein, 23 aa, Entamoeba invadens
NKKTIKFFPKIETLNLWNCDNEV

SEQ ID NO: 2823168 - protein, 43 aa, Entamoeba invadens
NKKTNYGLVVVLLVVLTLLFLVFLFVVTYTNFYLFNKKQKKDR

SEQ ID NO: 2823169 - protein, 31 aa, Entamoeba invadens
NKLFDAINGFLFPLHPFTAPPHYVYPWRIVG

SEQ ID NO: 2823170 - protein, 20 aa, Entamoeba invadens
NKLFRMCKRYKPDYDVVCQL

SEQ ID NO: 2823171 - protein, 17 aa, Entamoeba invadens
NKLGEGGFGIVYKGTFR

SEQ ID NO: 2823172 - protein, 17 aa, Entamoeba invadens
NKLTIIIFLLLVVKKDP

SEQ ID NO: 2823173 - protein, 26 aa, Entamoeba invadens
NKLVFDFSNPYILCKVPESVYETLTP

SEQ ID NO: 2823174 - protein, 21 aa, Entamoeba invadens
NKNIHLFYQNVDLGRFEVNIR

SEQ ID NO: 2823175 - protein, 35 aa, Entamoeba invadens
NKNIMYATSNFLLDVLRLCGFFFDSKYPKKSCKCV

SEQ ID NO: 2823176 - protein, 33 aa, Entamoeba invadens
NKNKAIEFELFLKPLCTMTFNETIMLVALDVSK

SEQ ID NO: 2823177 - protein, 27 aa, Entamoeba invadens
NKNQFVFKFKMYIFYSLNEIKKLINFT

SEQ ID NO: 2823178 - protein, 19 aa, Entamoeba invadens
NKPISYFISLKRGKLGLPG

SEQ ID NO: 2823179 - protein, 20 aa, Entamoeba invadens
NKPLITIDFTNQTCLLLLTS

SEQ ID NO: 2823180 - protein, 30 aa, Entamoeba invadens
NKPQLLLWNCLYLHLNYNFPNRINFEIVNP

SEQ ID NO: 2823181 - protein, 47 aa, Entamoeba invadens
NKQKKQMYVWFPIITALAGLCHFIDFGINAYGWFIGITFMEKNISTQ

SEQ ID NO: 2823182 - protein, 21 aa, Entamoeba invadens
NKQLDDVFQTKLPNMWKSDEE

SEQ ID NO: 2823183 - protein, 28 aa, Entamoeba invadens
NKQMYILNICIFVLRNIGLNTPVRSGYF

SEQ ID NO: 2823184 - protein, 27 aa, Entamoeba invadens
NKQVIFTIIELFATLLLNFENRVIIKS

SEQ ID NO: 2823185 - protein, 20 aa, Entamoeba invadens
NKQYYTFYYSKSTSGRVYIQ

SEQ ID NO: 2823186 - protein, 30 aa, Entamoeba invadens
NKSESLIGLQLFFFVLYTILGVNQMNDSYA

SEQ ID NO: 2823187 - protein, 23 aa, Entamoeba invadens
NKSNKFIITEPPKFQIQATNCVL

SEQ ID NO: 2823188 - protein, 33 aa, Entamoeba invadens
NKSTKIMLVVFIVLTIIFGLSTLGLAIYVIVDT

SEQ ID NO: 2823189 - protein, 24 aa, Entamoeba invadens
NKTECALLLLLKKLGVSCSTIRTS

SEQ ID NO: 2823190 - protein, 26 aa, Entamoeba invadens
NKTGLKHILYSFIINCQQTKRVEQSK

SEQ ID NO: 2823191 - protein, 20 aa, Entamoeba invadens
NKTIFLMEKSNIVFSNIQGG

SEQ ID NO: 2823192 - protein, 25 aa, Entamoeba invadens
NKTIKCYPVFILLNGQFNVGDGVTI

SEQ ID NO: 2823193 - protein, 45 aa, Entamoeba invadens
NKTLSIALPVVITVIIMIVLIITIFVVCLFYKSHKSKKILQKTTC

SEQ ID NO: 2823194 - protein, 31 aa, Entamoeba invadens
NKTPDPVIVPFWKIWFEALQDKTLIILIVAA

SEQ ID NO: 2823195 - protein, 29 aa, Entamoeba invadens
NKTVRVLGWVSLLLFWVVGVILCFIPAMI

SEQ ID NO: 2823196 - protein, 41 aa, Entamoeba invadens
NKTVSPLQRAFLLSYSMSFVIMTMLLTIYNNVFHQNFKLKQ

SEQ ID NO: 2823197 - protein, 22 aa, Entamoeba invadens
NKTYIYIGYILQLGIYGTSAIL

SEQ ID NO: 2823198 - protein, 17 aa, Entamoeba invadens
NKTYIYLGYILQCGVYG

SEQ ID NO: 2823199 - protein, 26 aa, Entamoeba invadens
NKVDVLLRLLQKMFPVYQPKVIHSRE

SEQ ID NO: 2823200 - protein, 20 aa, Entamoeba invadens
NKVLPFEYLTNFLIVSNGRL

SEQ ID NO: 2823201 - protein, 26 aa, Entamoeba invadens
NKVMLLVFICIVSLTFSQPTKVVLTM

SEQ ID NO: 2823202 - protein, 21 aa, Entamoeba invadens
NKVPLVCEPSYYLINNTCKLC

SEQ ID NO: 2823203 - protein, 22 aa, Entamoeba invadens
NKYACQKGYYSKSGALICVICP

SEQ ID NO: 2823204 - protein, 21 aa, Entamoeba invadens
NKYGLIFNKYPSLKAIQKGKE

SEQ ID NO: 2823205 - protein, 28 aa, Entamoeba invadens
NLCAFLILGLFVILIGLPLVTNPKSRLS

SEQ ID NO: 2823206 - protein, 18 aa, Entamoeba invadens
NLCESCFATFVLKNGKCV

SEQ ID NO: 2823207 - protein, 19 aa, Entamoeba invadens
NLCPLGTYQNFRGTTQCKE

SEQ ID NO: 2823208 - protein, 21 aa, Entamoeba invadens
NLCTRCLIGYKVSPSNPSVCV

SEQ ID NO: 2823209 - protein, 26 aa, Entamoeba invadens
NLEGCLLCNESYYLQNGRCFSCKESC

SEQ ID NO: 2823210 - protein, 28 aa, Entamoeba invadens
NLESFQQAVLIYLIATAGVKVIVKKQKK

SEQ ID NO: 2823211 - protein, 22 aa, Entamoeba invadens
NLEVTYLNLYNNATLILLENSV

SEQ ID NO: 2823212 - protein, 28 aa, Entamoeba invadens
NLFDISVYLLLFILVLAALKIQLNGMDE

SEQ ID NO: 2823213 - protein, 24 aa, Entamoeba invadens
NLFIFIFLIISVSFLLTSGLTNKT

SEQ ID NO: 2823214 - protein, 21 aa, Entamoeba invadens
NLFVDVIWRFLETPFKFRIEK

SEQ ID NO: 2823215 - protein, 43 aa, Entamoeba invadens
NLGAAIGIPMSILLVLIIIVLLIIITLIVILKKNQKKEKLKVC

SEQ ID NO: 2823216 - protein, 17 aa, Entamoeba invadens
NLGDFLLSNKQIITFGV

SEQ ID NO: 2823217 - protein, 33 aa, Entamoeba invadens
NLGIAVGIPISIVIVIIIIVTTIIVVTVILIQR

SEQ ID NO: 2823218 - protein, 43 aa, Entamoeba invadens
NLGLAIGLPVMFMLLIIITISVIIVGLFYLYQHFKEQKKMQNV

SEQ ID NO: 2823219 - protein, 22 aa, Entamoeba invadens
NLGMFVFLPFCEITEGLNSSLS

SEQ ID NO: 2823220 - protein, 18 aa, Entamoeba invadens
NLGPMYDFLENNKSICMS

SEQ ID NO: 2823221 - protein, 26 aa, Entamoeba invadens
NLGSVFELWFPFEAEGYFAKPICFPE

SEQ ID NO: 2823222 - protein, 46 aa, Entamoeba invadens
NLGVAIGVPLSLIFIILVVIATIIIVVYLLMMKKKEKVQLQNICVF

SEQ ID NO: 2823223 - protein, 31 aa, Entamoeba invadens
NLGVIIRYIYPFFVPYITQLLNDLAKMMFSN

SEQ ID NO: 2823224 - protein, 20 aa, Entamoeba invadens
NLHIKTIPKVSIYTTNSGSF

SEQ ID NO: 2823225 - protein, 17 aa, Entamoeba invadens
NLHKAGGWILNIQNILQ

SEQ ID NO: 2823226 - protein, 26 aa, Entamoeba invadens
NLHPSELLFIPYNNITALLHALGSSI

SEQ ID NO: 2823227 - protein, 28 aa, Entamoeba invadens
NLIDNIQTIILLLKILLELSDEMKDKMI

SEQ ID NO: 2823228 - protein, 22 aa, Entamoeba invadens
NLIQSSLLSYTWKCETPRKLFE

SEQ ID NO: 2823229 - protein, 18 aa, Entamoeba invadens
NLITLCWSQHQLERLEIG

SEQ ID NO: 2823230 - protein, 17 aa, Entamoeba invadens
NLIVYLDNYKTAAKLFL

SEQ ID NO: 2823231 - protein, 25 aa, Entamoeba invadens
NLKGGFFDELIWKINIGVLNSLVDA

SEQ ID NO: 2823232 - protein, 24 aa, Entamoeba invadens
NLLAFDVICFYSFFFLICCCEQNE

SEQ ID NO: 2823233 - protein, 41 aa, Entamoeba invadens
NLLFKIINPHFQICLFKINLLNYLKLLKYKKKHIYHNLILR

SEQ ID NO: 2823234 - protein, 17 aa, Entamoeba invadens
NLLFVLASQNSCFGLFQ

SEQ ID NO: 2823235 - protein, 24 aa, Entamoeba invadens
NLLLERKFIFISESLQTLSIAIHT

SEQ ID NO: 2823236 - protein, 20 aa, Entamoeba invadens
NLLMTNMTFTKGIGTPVYMA

SEQ ID NO: 2823237 - protein, 20 aa, Entamoeba invadens
NLLTLLVSVVLLYLKANKNV

SEQ ID NO: 2823238 - protein, 17 aa, Entamoeba invadens
NLLVFLEDPLDSQKNLF

SEQ ID NO: 2823239 - protein, 32 aa, Entamoeba invadens
NLMHNFGVIGLLCLPMTFLAGLWGMNVRVPGQ

SEQ ID NO: 2823240 - protein, 23 aa, Entamoeba invadens
NLNAANFYKFSLAYDVPVDISTC

SEQ ID NO: 2823241 - protein, 25 aa, Entamoeba invadens
NLNELPLCVIIKPNTTYKTLKANIT

SEQ ID NO: 2823242 - protein, 25 aa, Entamoeba invadens
NLNFTTFFAWMFVSILQGSVIMILS

SEQ ID NO: 2823243 - protein, 23 aa, Entamoeba invadens
NLNFYGRMSNTVFYYSFGEIKFD

SEQ ID NO: 2823244 - protein, 24 aa, Entamoeba invadens
NLNIPNRTFFGDTFLVTVNGFDKI

SEQ ID NO: 2823245 - protein, 27 aa, Entamoeba invadens
NLNIWKCCLYGCIYLVLFQILSIITQI

SEQ ID NO: 2823246 - protein, 24 aa, Entamoeba invadens
NLNQLIMGKLWQYVSPDFNQKIVN

SEQ ID NO: 2823247 - protein, 20 aa, Entamoeba invadens
NLNVYVIYAYGVCPTLETCW

SEQ ID NO: 2823248 - protein, 21 aa, Entamoeba invadens
NLQMYLVCVVVRRTIKALEWS

SEQ ID NO: 2823249 - protein, 25 aa, Entamoeba invadens
NLQNLTSLKVFCFCSSFTTITTLVA

SEQ ID NO: 2823250 - protein, 30 aa, Entamoeba invadens
NLREHLIIWLHYHHMILYEVFITYIQIVFL

SEQ ID NO: 2823251 - protein, 18 aa, Entamoeba invadens
NLRIGHNVSLTLFNSRWI

SEQ ID NO: 2823252 - protein, 18 aa, Entamoeba invadens
NLRIGHNVSLTLFNSRWT

SEQ ID NO: 2823253 - protein, 22 aa, Entamoeba invadens
NLRSPYLLMPNGYFLYEQQIFS

SEQ ID NO: 2823254 - protein, 29 aa, Entamoeba invadens
NLRVFQELVFTTPPLSFAFSRLGTLAVST

SEQ ID NO: 2823255 - protein, 25 aa, Entamoeba invadens
NLSDIFTFSRFIEALPGILVTQKTF

SEQ ID NO: 2823256 - protein, 20 aa, Entamoeba invadens
NLSINKWYTPLVSNYQKYIF

SEQ ID NO: 2823257 - protein, 27 aa, Entamoeba invadens
NLSKKKFMMIIFHTPNNPKYVFHFEPQ

SEQ ID NO: 2823258 - protein, 24 aa, Entamoeba invadens
NLSSHIYCLFEKGSLKQRFKVLTL

SEQ ID NO: 2823259 - protein, 21 aa, Entamoeba invadens
NLSSILTWKVPLEQKGITSMS

SEQ ID NO: 2823260 - protein, 23 aa, Entamoeba invadens
NLSTYMCWLVLPLLMKERGDADP

SEQ ID NO: 2823261 - protein, 32 aa, Entamoeba invadens
NLTEMDYFIFILQFSLLATLLIYSFTKYTGKN

SEQ ID NO: 2823262 - protein, 17 aa, Entamoeba invadens
NLTKVRDLAEGERTSAV

SEQ ID NO: 2823263 - protein, 24 aa, Entamoeba invadens
NLTVPNYSLIIPRVMNVYGSSNIT

SEQ ID NO: 2823264 - protein, 30 aa, Entamoeba invadens
NLVEYALFSVLLLLIFRVLTVEEFFGAIDI

SEQ ID NO: 2823265 - protein, 22 aa, Entamoeba invadens
NLVFGIFLVFCSFINGILSAIN

SEQ ID NO: 2823266 - protein, 25 aa, Entamoeba invadens
NLVGCLLCNESYYLQNGRCFSCKES

SEQ ID NO: 2823267 - protein, 21 aa, Entamoeba invadens
NLVLRHLFNIEWWESDKLKLE

SEQ ID NO: 2823268 - protein, 31 aa, Entamoeba invadens
NLVVDSCTIPIPLKFVSSFTFGNIALTNSNE

SEQ ID NO: 2823269 - protein, 19 aa, Entamoeba invadens
NLWNALPIKDISVADVERS

SEQ ID NO: 2823270 - protein, 22 aa, Entamoeba invadens
NLWVFIVFISSFCLLGVPLFVN

SEQ ID NO: 2823271 - protein, 45 aa, Entamoeba invadens
NMGAAIGIPISILLVMIIIVLLIVITLIVIFKRKQKKEELKVCTY

SEQ ID NO: 2823272 - protein, 23 aa, Entamoeba invadens
NMKSLWLGFLVPRIVFCSIVAVA

SEQ ID NO: 2823273 - protein, 23 aa, Entamoeba invadens
NMKYEILSNPLTIILKKGFACEF

SEQ ID NO: 2823274 - protein, 25 aa, Entamoeba invadens
NMLDFVVYTLLIYLKGNKEVIGTEK

SEQ ID NO: 2823275 - protein, 25 aa, Entamoeba invadens
NMLILILSLLLTLTTSRWCLVGNKI

SEQ ID NO: 2823276 - protein, 24 aa, Entamoeba invadens
NMLTQYRHPCIVSLVGAVYTEGEI

SEQ ID NO: 2823277 - protein, 23 aa, Entamoeba invadens
NMLTQYRHPCVVSLVGAVYTEGE

SEQ ID NO: 2823278 - protein, 19 aa, Entamoeba invadens
NMMYTKCIGTPKYMAPEIT

SEQ ID NO: 2823279 - protein, 27 aa, Entamoeba invadens
NMPTNPIRLKIRIKLMLDAARGMQYLH

SEQ ID NO: 2823280 - protein, 26 aa, Entamoeba invadens
NMQECSIFFFFILTRMTLKPICAQLF

SEQ ID NO: 2823281 - protein, 26 aa, Entamoeba invadens
NMSNATMAIVSTSIVLLSCSVRARKK

SEQ ID NO: 2823282 - protein, 19 aa, Entamoeba invadens
NMTFTKGVGTPKYMAPEIL

SEQ ID NO: 2823283 - protein, 19 aa, Entamoeba invadens
NMTFTKGVGTPKYMAPEVL

SEQ ID NO: 2823284 - protein, 17 aa, Entamoeba invadens
NMVFFDLNSVIKVNTKE

SEQ ID NO: 2823285 - protein, 39 aa, Entamoeba invadens
NMYTSTSFKLSVLYNLPLNYVISLKFVWVKNEQIETEYC

SEQ ID NO: 2823286 - protein, 20 aa, Entamoeba invadens
NNACIKCETGFYLTGNECVG

SEQ ID NO: 2823287 - protein, 19 aa, Entamoeba invadens
NNATLFYKALVPSTCVVPQ

SEQ ID NO: 2823288 - protein, 23 aa, Entamoeba invadens
NNAYFICPSGYYTTDQQNCSKCY

SEQ ID NO: 2823289 - protein, 27 aa, Entamoeba invadens
NNCINCKSFYYYLSGSCLKCSSNCSRC

SEQ ID NO: 2823290 - protein, 32 aa, Entamoeba invadens
NNCNFFLTNRTIRDFPLFFVNSFNLADNNYVT

SEQ ID NO: 2823291 - protein, 32 aa, Entamoeba invadens
NNCNFLLTNRTIRDFPLFFVNTFNLADNNYVT

SEQ ID NO: 2823292 - protein, 20 aa, Entamoeba invadens
NNCQTCFANYVLNADKTTCT

SEQ ID NO: 2823293 - protein, 25 aa, Entamoeba invadens
NNEENYVIYYYGKNSIDTPPDNDNS

SEQ ID NO: 2823294 - protein, 26 aa, Entamoeba invadens
NNEKLELSMFTLVSLLGPFLYMVSDD

SEQ ID NO: 2823295 - protein, 19 aa, Entamoeba invadens
NNELLFKRHPELFNETSQN

SEQ ID NO: 2823296 - protein, 21 aa, Entamoeba invadens
NNFCLSCPNGFYLNTQKMCIS

SEQ ID NO: 2823297 - protein, 19 aa, Entamoeba invadens
NNFDKMLVQFFFVDKTTNQ

SEQ ID NO: 2823298 - protein, 21 aa, Entamoeba invadens
NNFTFICENGYFKNKTNSCEG

SEQ ID NO: 2823299 - protein, 23 aa, Entamoeba invadens
NNFTFICENGYFKNQTNGCEGCS

SEQ ID NO: 2823300 - protein, 22 aa, Entamoeba invadens
NNFTFICENGYFKNQTNSCESC

SEQ ID NO: 2823301 - protein, 25 aa, Entamoeba invadens
NNGGVYFVPAFQGLGTPYWDDDVRG

SEQ ID NO: 2823302 - protein, 29 aa, Entamoeba invadens
NNGIIQCTLCFAPYILNDNKLSCIDANNN

SEQ ID NO: 2823303 - protein, 22 aa, Entamoeba invadens
NNGILHRDIKPDNFLIPSIEED

SEQ ID NO: 2823304 - protein, 24 aa, Entamoeba invadens
NNGSYWCISLWEGKRFGALIKEGN

SEQ ID NO: 2823305 - protein, 19 aa, Entamoeba invadens
NNICLPCDSTCKSCDGKTG

SEQ ID NO: 2823306 - protein, 28 aa, Entamoeba invadens
NNIGTPMILNFPLQAQGYFGFPVCIPHK

SEQ ID NO: 2823307 - protein, 18 aa, Entamoeba invadens
NNIIYCKDGYYIDNSECK

SEQ ID NO: 2823308 - protein, 18 aa, Entamoeba invadens
NNIIYCKNGYYIDNSECK

SEQ ID NO: 2823309 - protein, 21 aa, Entamoeba invadens
NNILSCFNGYLYNSTMCVKCN

SEQ ID NO: 2823310 - protein, 33 aa, Entamoeba invadens
NNIPPVMCTLPHKLEVWSYFRKEWNIYTNTEIR

SEQ ID NO: 2823311 - protein, 20 aa, Entamoeba invadens
NNKCLQCSPYCFTNKCDTVQ

SEQ ID NO: 2823312 - protein, 19 aa, Entamoeba invadens
NNKLKVFVTDSYTAGTFGG

SEQ ID NO: 2823313 - protein, 22 aa, Entamoeba invadens
NNKNNIYTLKCRPNTVTDVGTE

SEQ ID NO: 2823314 - protein, 33 aa, Entamoeba invadens
NNKRDLWLTTYSFEWQWTWMRYRHDVLLSFSLA

SEQ ID NO: 2823315 - protein, 23 aa, Entamoeba invadens
NNKVPLICEPSYYLINNTCKLCN

SEQ ID NO: 2823316 - protein, 23 aa, Entamoeba invadens
NNKVPLICKPSYYLFNNTCKLCN

SEQ ID NO: 2823317 - protein, 42 aa, Entamoeba invadens
NNKYNWWSFIPVAYLLQFKYTYNIFFLFTVLTQFIPSCKVGY

SEQ ID NO: 2823318 - protein, 30 aa, Entamoeba invadens
NNLESLVVILFLLVFAILASGYVFYDGIVK

SEQ ID NO: 2823319 - protein, 31 aa, Entamoeba invadens
NNLITWMDNKKFFPLGLYFDQITDTDTSLFK

SEQ ID NO: 2823320 - protein, 20 aa, Entamoeba invadens
NNLRLDLISIKDPVLKENEH

SEQ ID NO: 2823321 - protein, 26 aa, Entamoeba invadens
NNLYCVRYFTPLTEYLPALLEKEVIQ

SEQ ID NO: 2823322 - protein, 31 aa, Entamoeba invadens
NNMNQLMMLVFSYLCSYYQLNIVPVQVKKAM

SEQ ID NO: 2823323 - protein, 40 aa, Entamoeba invadens
NNNDQYFYNFIILDNTTLYFTINNYYWFTTQNLSIAEKSL

SEQ ID NO: 2823324 - protein, 21 aa, Entamoeba invadens
NNNFKWFRPSSFFAKDYMYTI

SEQ ID NO: 2823325 - protein, 21 aa, Entamoeba invadens
NNPFLVKYFGMVTMKSARYLV

SEQ ID NO: 2823326 - protein, 18 aa, Entamoeba invadens
NNPFYTYQFVFGGVFFVF

SEQ ID NO: 2823327 - protein, 23 aa, Entamoeba invadens
NNPKYTFYFDPQVLYLRPRLSSM

SEQ ID NO: 2823328 - protein, 21 aa, Entamoeba invadens
NNQIFLYGTFRNSGAKDMFQS

SEQ ID NO: 2823329 - protein, 26 aa, Entamoeba invadens
NNQMRIEGIPNWPMFIDIVGDNPVDV

SEQ ID NO: 2823330 - protein, 36 aa, Entamoeba invadens
NNQTLLPFIHPTKMYYYYLIEWYYLISFNQTQILKN

SEQ ID NO: 2823331 - protein, 31 aa, Entamoeba invadens
NNQTNIMILLLLFIRFVFPYCGNGCLECITP

SEQ ID NO: 2823332 - protein, 19 aa, Entamoeba invadens
NNRCIICNDGYYIQNDGNC

SEQ ID NO: 2823333 - protein, 35 aa, Entamoeba invadens
NNRSRLSIGLMWWMLTREILRFRGELARDKTWEVV

SEQ ID NO: 2823334 - protein, 32 aa, Entamoeba invadens
NNSTFKINPNWVIQYSYLKTSSIKKDITCGSI

SEQ ID NO: 2823335 - protein, 31 aa, Entamoeba invadens
NNSTNSIMIILLAVLLFIQFSNSKLCRIEEK

SEQ ID NO: 2823336 - protein, 25 aa, Entamoeba invadens
NNSTYFDLDLTAGTQWTFVQRSWNT

SEQ ID NO: 2823337 - protein, 25 aa, Entamoeba invadens
NNSTYFNLDLTAGTQWTFVQRSWNT

SEQ ID NO: 2823338 - protein, 19 aa, Entamoeba invadens
NNSYYLLLGSCKMLSEIHC

SEQ ID NO: 2823339 - protein, 23 aa, Entamoeba invadens
NNTQLLLNGKLLRYGSSKKIFCH

SEQ ID NO: 2823340 - protein, 27 aa, Entamoeba invadens
NNTSIWPLFLFLVIQGVGLSMFWSPDE

SEQ ID NO: 2823341 - protein, 23 aa, Entamoeba invadens
NNVCHLCNLIIFNSEICTFTNNQ

SEQ ID NO: 2823342 - protein, 21 aa, Entamoeba invadens
NNVEFIYRYLKNYDYAFSRRR

SEQ ID NO: 2823343 - protein, 33 aa, Entamoeba invadens
NNVQILIIMIKHRLYRFLKRFIKSLCGLMLTLK

SEQ ID NO: 2823344 - protein, 21 aa, Entamoeba invadens
NNYLNSLFLGTSVFVPICSDK

SEQ ID NO: 2823345 - protein, 21 aa, Entamoeba invadens
NNYLPGWLLARAGVLIYIFAC

SEQ ID NO: 2823346 - protein, 17 aa, Entamoeba invadens
NNYYYYPHSLDGPFPFD

SEQ ID NO: 2823347 - protein, 17 aa, Entamoeba invadens
NPALGIIYMAVGGVFVI

SEQ ID NO: 2823348 - protein, 21 aa, Entamoeba invadens
NPAWAFWTLFFVSTCWALPQS

SEQ ID NO: 2823349 - protein, 20 aa, Entamoeba invadens
NPDYSWKLFPPGAASVEMNM

SEQ ID NO: 2823350 - protein, 27 aa, Entamoeba invadens
NPELNNPRIVLWNSTYLHLNLNMTPRP

SEQ ID NO: 2823351 - protein, 28 aa, Entamoeba invadens
NPESKCNPLLRRSYMYKTQTKENSNYEC

SEQ ID NO: 2823352 - protein, 22 aa, Entamoeba invadens
NPFSEIPFYYLSKYISSLSDPN

SEQ ID NO: 2823353 - protein, 25 aa, Entamoeba invadens
NPFVTIYVLFIYYQFIILPDSNDRD

SEQ ID NO: 2823354 - protein, 18 aa, Entamoeba invadens
NPGFWIENFECVTCETCG

SEQ ID NO: 2823355 - protein, 28 aa, Entamoeba invadens
NPGSKCNPILRRSYMYKTQTTGKTEIEC

SEQ ID NO: 2823356 - protein, 25 aa, Entamoeba invadens
NPKTQKMPVRFLRFEKISKETSEKG

SEQ ID NO: 2823357 - protein, 22 aa, Entamoeba invadens
NPKYVFHFEPQVVIIPPRRGSV

SEQ ID NO: 2823358 - protein, 25 aa, Entamoeba invadens
NPLLNYPQILLWNSTYLHLNRNITD

SEQ ID NO: 2823359 - protein, 18 aa, Entamoeba invadens
NPLTIILKKGFACEFEVF

SEQ ID NO: 2823360 - protein, 23 aa, Entamoeba invadens
NPPSLPSFFIAAIVKFLTGCKVI

SEQ ID NO: 2823361 - protein, 24 aa, Entamoeba invadens
NPQILSLMDGYLIRYCPVNVTETE

SEQ ID NO: 2823362 - protein, 23 aa, Entamoeba invadens
NPQKVFWLYYLFQFEIEPTSNTP

SEQ ID NO: 2823363 - protein, 18 aa, Entamoeba invadens
NPRILLTWGQLPVTTHWG

SEQ ID NO: 2823364 - protein, 18 aa, Entamoeba invadens
NPSIYRPLDLPIPCVNFK

SEQ ID NO: 2823365 - protein, 25 aa, Entamoeba invadens
NPSLVTLKPNYACEFEISLKPNFTS

SEQ ID NO: 2823366 - protein, 24 aa, Entamoeba invadens
NPTDAFFFYNLGRLLFAVAMSFSA

SEQ ID NO: 2823367 - protein, 25 aa, Entamoeba invadens
NPTQSTAVFFYLSKKSTSSASWEGK

SEQ ID NO: 2823368 - protein, 23 aa, Entamoeba invadens
NPTRNLFCYYSRITKLFPRAKTL

SEQ ID NO: 2823369 - protein, 28 aa, Entamoeba invadens
NPYNKVDFKFLWKIAEFVISGKGLPNKE

SEQ ID NO: 2823370 - protein, 19 aa, Entamoeba invadens
NPYPKEQFKFAWDIVDFVV

SEQ ID NO: 2823371 - protein, 27 aa, Entamoeba invadens
NQATNIFVYIYFLLSKLMCHVHITIMD

SEQ ID NO: 2823372 - protein, 25 aa, Entamoeba invadens
NQCDDGYFLRYSICNPCIDGCNDCL

SEQ ID NO: 2823373 - protein, 20 aa, Entamoeba invadens
NQCSACQTGYYLYNSGCYQC

SEQ ID NO: 2823374 - protein, 19 aa, Entamoeba invadens
NQCTSCRLHYYYSSGSCIA

SEQ ID NO: 2823375 - protein, 21 aa, Entamoeba invadens
NQEFFYFVVSTKPFSLKLMRI

SEQ ID NO: 2823376 - protein, 17 aa, Entamoeba invadens
NQFDVFPLELDFGNRDT

SEQ ID NO: 2823377 - protein, 22 aa, Entamoeba invadens
NQIDFDPLRWVFNAPMTGVSPS

SEQ ID NO: 2823378 - protein, 25 aa, Entamoeba invadens
NQIDTMCYLCDFTAMLLNGVCNVKN

SEQ ID NO: 2823379 - protein, 27 aa, Entamoeba invadens
NQINFELLNCVFLKKFPNGNVTCFKCD

SEQ ID NO: 2823380 - protein, 20 aa, Entamoeba invadens
NQIVVFSDHFCFSACSLFTY

SEQ ID NO: 2823381 - protein, 22 aa, Entamoeba invadens
NQLLIIDSIFPLICASRDFSMR

SEQ ID NO: 2823382 - protein, 24 aa, Entamoeba invadens
NQNTAFLCSPNFALSYYNATKNCF

SEQ ID NO: 2823383 - protein, 23 aa, Entamoeba invadens
NQNYLVFITSYFLDEGSFQVNLR

SEQ ID NO: 2823384 - protein, 18 aa, Entamoeba invadens
NQRLIRFCPNGVELVKTV

SEQ ID NO: 2823385 - protein, 25 aa, Entamoeba invadens
NQSIKGWYLFNGLNTTLSFITQLKS

SEQ ID NO: 2823386 - protein, 27 aa, Entamoeba invadens
NQTGMWNICYLVLIGSIIYVFDNAISL

SEQ ID NO: 2823387 - protein, 26 aa, Entamoeba invadens
NQTRNCIQCNYKYYPVLTSGEMKCGL

SEQ ID NO: 2823388 - protein, 18 aa, Entamoeba invadens
NQVFSLFLVIVALAIVGG

SEQ ID NO: 2823389 - protein, 26 aa, Entamoeba invadens
NQWEYNGILSLPITYLITSIDDDTVN

SEQ ID NO: 2823390 - protein, 26 aa, Entamoeba invadens
NQYGLTWQGWIFSVLCGMVSILVGQI

SEQ ID NO: 2823391 - protein, 28 aa, Entamoeba invadens
NQYRFGKYFHFYFPPSSTKNYINIYVQK

SEQ ID NO: 2823392 - protein, 18 aa, Entamoeba invadens
NQYWNKINLLVNEVTILV

SEQ ID NO: 2823393 - protein, 28 aa, Entamoeba invadens
NRASLSLDVIWIYKVNIFIDDSGTLEMI

SEQ ID NO: 2823394 - protein, 18 aa, Entamoeba invadens
NRATLIVFYLVGGLIIFP

SEQ ID NO: 2823395 - protein, 23 aa, Entamoeba invadens
NRAVEFTVIVHPLCTITKTVDIT

SEQ ID NO: 2823396 - protein, 18 aa, Entamoeba invadens
NRCIICNDGYYIQNDGNC

SEQ ID NO: 2823397 - protein, 19 aa, Entamoeba invadens
NRCLKCREGFLLKEGHCTY

SEQ ID NO: 2823398 - protein, 19 aa, Entamoeba invadens
NREEIFSMFKLFKVFDVNK

SEQ ID NO: 2823399 - protein, 17 aa, Entamoeba invadens
NRERFDMPLFVTKNSTI

SEQ ID NO: 2823400 - protein, 30 aa, Entamoeba invadens
NREYYSPLNALFWLLDGLVASIGIFFISYV

SEQ ID NO: 2823401 - protein, 24 aa, Entamoeba invadens
NRGLIVKSLLVVLFFAIVFLVFFL

SEQ ID NO: 2823402 - protein, 20 aa, Entamoeba invadens
NRICVTCTAGYYPGSLGQCI

SEQ ID NO: 2823403 - protein, 26 aa, Entamoeba invadens
NRIFSNNIYLYISKWNAPFFNQRIRI

SEQ ID NO: 2823404 - protein, 40 aa, Entamoeba invadens
NRIGIPIIVIAIIVVIIMLIIICVFLYVYNHNKTKKRTQN

SEQ ID NO: 2823405 - protein, 33 aa, Entamoeba invadens
NRKRFLNSIRWVWTLVGYAIIGGVFAGLVYVSF

SEQ ID NO: 2823406 - protein, 25 aa, Entamoeba invadens
NRKVKPFITTFTKTNFKTIKQMLLI

SEQ ID NO: 2823407 - protein, 29 aa, Entamoeba invadens
NRLDKPDLVPDYYWKLLTSCWSQKEEDRP

SEQ ID NO: 2823408 - protein, 23 aa, Entamoeba invadens
NRLNTFYNNISYYTPYKSTSKSE

SEQ ID NO: 2823409 - protein, 28 aa, Entamoeba invadens
NRLTEPWKSAYPLLYKIPNNNDQIVSEN

SEQ ID NO: 2823410 - protein, 17 aa, Entamoeba invadens
NRMTVVNGWFGGVKMER

SEQ ID NO: 2823411 - protein, 29 aa, Entamoeba invadens
NRMVSGLIYFFVTPLIDIQFHDSMYVNSF

SEQ ID NO: 2823412 - protein, 26 aa, Entamoeba invadens
NRNCFVCSSSFILMNGRCLLPNEVNC

SEQ ID NO: 2823413 - protein, 31 aa, Entamoeba invadens
NRNDNLYPMYYSFFINLILSHLRALSFKNVT

SEQ ID NO: 2823414 - protein, 32 aa, Entamoeba invadens
NRNDYGNEGFLLMLCYYLGCAITLTKLQKKGK

SEQ ID NO: 2823415 - protein, 24 aa, Entamoeba invadens
NRNPTILLVITVMCIVLAGLVVLI

SEQ ID NO: 2823416 - protein, 24 aa, Entamoeba invadens
NRQGPAMIAKLTTLLSLGDHFHET

SEQ ID NO: 2823417 - protein, 28 aa, Entamoeba invadens
NRQTVFLFFFLMLFFGSTLDITKQVLAV

SEQ ID NO: 2823418 - protein, 28 aa, Entamoeba invadens
NRRRVYEGLYLITFKRDFVKASSLLVES

SEQ ID NO: 2823419 - protein, 26 aa, Entamoeba invadens
NRSRNKWMMIIFHVPDCPKYVFHFDP

SEQ ID NO: 2823420 - protein, 26 aa, Entamoeba invadens
NRSRNKWMMIIFHVPNCPKYVFHFDP

SEQ ID NO: 2823421 - protein, 18 aa, Entamoeba invadens
NRTHAVFYNITFDKTAST

SEQ ID NO: 2823422 - protein, 22 aa, Entamoeba invadens
NRVEIYYGLVLLKEFSSNVFQS

SEQ ID NO: 2823423 - protein, 22 aa, Entamoeba invadens
NRVMDILFNTKFQSPLIIWRRK

SEQ ID NO: 2823424 - protein, 26 aa, Entamoeba invadens
NRVPVLIFTFLLIVLPILGLSKVVNL

SEQ ID NO: 2823425 - protein, 24 aa, Entamoeba invadens
NRYVLHKILLIYQLSKGYEYVQGM

SEQ ID NO: 2823426 - protein, 28 aa, Entamoeba invadens
NSAFMGTKLVTLILPTTPITTFGTGVFE

SEQ ID NO: 2823427 - protein, 22 aa, Entamoeba invadens
NSARLDLLTALDTLAMAKSKTG

SEQ ID NO: 2823428 - protein, 25 aa, Entamoeba invadens
NSCSDGYYLLNGLCVKCGVNCDLCT

SEQ ID NO: 2823429 - protein, 19 aa, Entamoeba invadens
NSCVVCQAGYYSFNNQCEK

SEQ ID NO: 2823430 - protein, 32 aa, Entamoeba invadens
NSDLYSLGVILFYLLFMRIPFDVDDLDELKKV

SEQ ID NO: 2823431 - protein, 25 aa, Entamoeba invadens
NSEDLKYVVLYKNAPSQSANTIGFT

SEQ ID NO: 2823432 - protein, 26 aa, Entamoeba invadens
NSELIKLCFFKNAAFFLIMLSYSFLS

SEQ ID NO: 2823433 - protein, 26 aa, Entamoeba invadens
NSENGTFYFTLSGAIHIIFSLITFVE

SEQ ID NO: 2823434 - protein, 30 aa, Entamoeba invadens
NSENKMMFCSLNLEFKNWCKYYAPSTDLCF

SEQ ID NO: 2823435 - protein, 27 aa, Entamoeba invadens
NSFCYLAAIGYFSTINGILECMSGSLC

SEQ ID NO: 2823436 - protein, 58 aa, Entamoeba invadens
NSFEHDRFWIYILSFYYHLSINILYYPIAYWYYYKFYFLLVIYFVVIIITTKYETKII

SEQ ID NO: 2823437 - protein, 22 aa, Entamoeba invadens
NSFITPLDTLEGISFILSSLKT

SEQ ID NO: 2823438 - protein, 23 aa, Entamoeba invadens
NSFKPNIPVLKGNKFFGADLEFN

SEQ ID NO: 2823439 - protein, 30 aa, Entamoeba invadens
NSFRPKSLLYFTLSFSAASLILLILSILFL

SEQ ID NO: 2823440 - protein, 24 aa, Entamoeba invadens
NSFRVFLRAILFRMVIKQIMKGRR

SEQ ID NO: 2823441 - protein, 19 aa, Entamoeba invadens
NSGFYLLNGRCVACDSTCK

SEQ ID NO: 2823442 - protein, 19 aa, Entamoeba invadens
NSGYFLQSLYCFKCADKCG

SEQ ID NO: 2823443 - protein, 21 aa, Entamoeba invadens
NSHFYLVTLNSSTKTGKCLEC

SEQ ID NO: 2823444 - protein, 37 aa, Entamoeba invadens
NSHKEPPFVYWIYFVKSNLFVLNNLRRSLKMNTFDFK

SEQ ID NO: 2823445 - protein, 25 aa, Entamoeba invadens
NSHVELLGAFIFKLTKDIFKISSST

SEQ ID NO: 2823446 - protein, 31 aa, Entamoeba invadens
NSIDWWGLGILIYEMLFGAVPFFSEDIQELY

SEQ ID NO: 2823447 - protein, 21 aa, Entamoeba invadens
NSIEGCLTPFLDGTGCAVCEN

SEQ ID NO: 2823448 - protein, 18 aa, Entamoeba invadens
NSIGTMFWSIYEEPLHCP

SEQ ID NO: 2823449 - protein, 17 aa, Entamoeba invadens
NSILKLIGDFSLKVSGE

SEQ ID NO: 2823450 - protein, 33 aa, Entamoeba invadens
NSILPKMTFTFSSKRWYFLFVGIHEESNVEMVL

SEQ ID NO: 2823451 - protein, 26 aa, Entamoeba invadens
NSIRKFLRTILFRAAIPQIMKGRKGN

SEQ ID NO: 2823452 - protein, 19 aa, Entamoeba invadens
NSIVLFPPLFSLITSFNTE

SEQ ID NO: 2823453 - protein, 31 aa, Entamoeba invadens
NSIWGSFTLVAFLRYVILAAPMIPISLRVNL

SEQ ID NO: 2823454 - protein, 26 aa, Entamoeba invadens
NSIYCNNVIFFKSDIIRYLKIKVVNG

SEQ ID NO: 2823455 - protein, 21 aa, Entamoeba invadens
NSIYLRTYVTPAFGFGTIAVS

SEQ ID NO: 2823456 - protein, 62 aa, Entamoeba invadens
NSKCIKCSFWYTPSWDGTFCKTKAVWWLILLCIIFVLVIISALLVIIIFITKYVLKKRHKTE

SEQ ID NO: 2823457 - protein, 30 aa, Entamoeba invadens
NSKCSKCEAGYYYDYYYSTCKSGYEYCLDF

SEQ ID NO: 2823458 - protein, 24 aa, Entamoeba invadens
NSKKKMLIIFHTPTNPKFVFHFDP

SEQ ID NO: 2823459 - protein, 24 aa, Entamoeba invadens
NSKKLLSSIILFDCKDNKIKMKKG

SEQ ID NO: 2823460 - protein, 23 aa, Entamoeba invadens
NSKKYSEFLWGKAKLNLNTKKNV

SEQ ID NO: 2823461 - protein, 27 aa, Entamoeba invadens
NSKLPTVISLIHKLFNSIDFQMNLDVA

SEQ ID NO: 2823462 - protein, 31 aa, Entamoeba invadens
NSKRYVYNFALRFVPFLVTVLYSYTLAEKET

SEQ ID NO: 2823463 - protein, 32 aa, Entamoeba invadens
NSKSCVLGYTEGTYYNYDIKKSILNYDNCVKQ

SEQ ID NO: 2823464 - protein, 24 aa, Entamoeba invadens
NSKVLFSFGFYDDICVYKKGIDKN

SEQ ID NO: 2823465 - protein, 20 aa, Entamoeba invadens
NSLFTNLIFSFTFGKIVTNS

SEQ ID NO: 2823466 - protein, 34 aa, Entamoeba invadens
NSLLIKLCFYKNIAMFFVLFYLAFLNNFSCETIY

SEQ ID NO: 2823467 - protein, 24 aa, Entamoeba invadens
NSLRKKLGIFPLKVKDEEFMKQFE

SEQ ID NO: 2823468 - protein, 23 aa, Entamoeba invadens
NSMYQYFVQVVPMTYFGLDKKVV

SEQ ID NO: 2823469 - protein, 21 aa, Entamoeba invadens
NSNFQMFFESKFDFVSNIIIK

SEQ ID NO: 2823470 - protein, 25 aa, Entamoeba invadens
NSNICLECLYGYYKDSTNNCVPCSR

SEQ ID NO: 2823471 - protein, 23 aa, Entamoeba invadens
NSNKIPLYLYLNVEGLGLSETNN

SEQ ID NO: 2823472 - protein, 28 aa, Entamoeba invadens
NSNNCLTCRPYYYLSNGYCLKCDPTCNA

SEQ ID NO: 2823473 - protein, 17 aa, Entamoeba invadens
NSNTINMKMKIKLMLDA

SEQ ID NO: 2823474 - protein, 25 aa, Entamoeba invadens
NSPFPQLALTPLSFILKMLSKPSKS

SEQ ID NO: 2823475 - protein, 24 aa, Entamoeba invadens
NSPKGCLKCYPQYYLNSLNECVSC

SEQ ID NO: 2823476 - protein, 27 aa, Entamoeba invadens
NSPKYRFYFEPQIVYLSPKRNKEITVY

SEQ ID NO: 2823477 - protein, 24 aa, Entamoeba invadens
NSPKYTFYFEPQVLYIRPRMASTY

SEQ ID NO: 2823478 - protein, 27 aa, Entamoeba invadens
NSRGIYLKELLLLFNRYNSSLSQVRTA

SEQ ID NO: 2823479 - protein, 37 aa, Entamoeba invadens
NSRNKYMMVIFHTPFTPKYTFYFDPQVAILKPRTLAK

SEQ ID NO: 2823480 - protein, 30 aa, Entamoeba invadens
NSRSFAHIFQSIFLPCIIFNAGFTMKKRNF

SEQ ID NO: 2823481 - protein, 35 aa, Entamoeba invadens
NSSALLITVILLLLGSLLFGVITKLVYNYLTTQEK

SEQ ID NO: 2823482 - protein, 24 aa, Entamoeba invadens
NSSELCLFGIFKNGVLSCNQKRFL

SEQ ID NO: 2823483 - protein, 17 aa, Entamoeba invadens
NSSTILCPEGCATGCLT

SEQ ID NO: 2823484 - protein, 27 aa, Entamoeba invadens
NSSVCITCLFEYYLKEKTCKPCQSNCA

SEQ ID NO: 2823485 - protein, 26 aa, Entamoeba invadens
NSSYNNLRFQPYSHYSFNDSTLVLTT

SEQ ID NO: 2823486 - protein, 20 aa, Entamoeba invadens
NSTFCMSCRSGTFLSEHSCI

SEQ ID NO: 2823487 - protein, 20 aa, Entamoeba invadens
NSTFCYNCFFNNLIINNGVC

SEQ ID NO: 2823488 - protein, 22 aa, Entamoeba invadens
NSTFFTLKIFSGKTSGYRNISS

SEQ ID NO: 2823489 - protein, 29 aa, Entamoeba invadens
NSTKTPFLMWYFFSFKNNVPHMVNNKNLT

SEQ ID NO: 2823490 - protein, 28 aa, Entamoeba invadens
NSTKTPFLMWYFFSVKNNIPHMVNNKNL

SEQ ID NO: 2823491 - protein, 30 aa, Entamoeba invadens
NSTLYLKSVKTLCDFWIEGDARLIIEQFSY

SEQ ID NO: 2823492 - protein, 18 aa, Entamoeba invadens
NSTNIVMALLFLVVVFIA

SEQ ID NO: 2823493 - protein, 32 aa, Entamoeba invadens
NSTSQVIAWIFIIPIMIYAGVGGFILGSMLQC

SEQ ID NO: 2823494 - protein, 25 aa, Entamoeba invadens
NSTTRYICYLPLAHIFEFTIEICVL

SEQ ID NO: 2823495 - protein, 25 aa, Entamoeba invadens
NSTTSFTLYGYIGKVFVTTSTAPYI

SEQ ID NO: 2823496 - protein, 22 aa, Entamoeba invadens
NSTYCISCENGYFLNSQMECKS

SEQ ID NO: 2823497 - protein, 20 aa, Entamoeba invadens
NSVFIVCVLVAFFMFAALGN

SEQ ID NO: 2823498 - protein, 17 aa, Entamoeba invadens
NSVLTPTYFNADTRTKP

SEQ ID NO: 2823499 - protein, 23 aa, Entamoeba invadens
NSYCIQCEISYLLIGVGCIKTES

SEQ ID NO: 2823500 - protein, 26 aa, Entamoeba invadens
NSYDGLIDVLPLLLPQISIFLSHLAT

SEQ ID NO: 2823501 - protein, 19 aa, Entamoeba invadens
NSYDINCIAKVTVLPGSTL

SEQ ID NO: 2823502 - protein, 24 aa, Entamoeba invadens
NSYIELLGSFIFKLSRNNLQMSSS

SEQ ID NO: 2823503 - protein, 21 aa, Entamoeba invadens
NSYVRVAVLDLLKTAFLNEIY

SEQ ID NO: 2823504 - protein, 21 aa, Entamoeba invadens
NTAWLNIVTFPWLFGVMFSDC

SEQ ID NO: 2823505 - protein, 33 aa, Entamoeba invadens
NTCCLLYTHMPFTKILPVFQLRIARPPATVKDI

SEQ ID NO: 2823506 - protein, 18 aa, Entamoeba invadens
NTCFKCSTGFLLKDNLCV

SEQ ID NO: 2823507 - protein, 21 aa, Entamoeba invadens
NTCISGYYLEGSTCYKCYIGC

SEQ ID NO: 2823508 - protein, 33 aa, Entamoeba invadens
NTCSKRLFLQQPYAPGFWIKLSTSVDKYIAVEA

SEQ ID NO: 2823509 - protein, 19 aa, Entamoeba invadens
NTCTGCIDGYYLNGKTCKK

SEQ ID NO: 2823510 - protein, 24 aa, Entamoeba invadens
NTCTGCVDGYYKSGQTCTKCAANC

SEQ ID NO: 2823511 - protein, 24 aa, Entamoeba invadens
NTCTGCVDGYYLEGGKCNKCTNGC

SEQ ID NO: 2823512 - protein, 25 aa, Entamoeba invadens
NTCTGCVDGYYQKDKLCIKCAANCT

SEQ ID NO: 2823513 - protein, 25 aa, Entamoeba invadens
NTDNDKFVFPVWNNTCELDKDDSMN

SEQ ID NO: 2823514 - protein, 22 aa, Entamoeba invadens
NTDPIVIVLPRNGGGFVDAEDF

SEQ ID NO: 2823515 - protein, 23 aa, Entamoeba invadens
NTDPIVIVLPRNGGGFVDAEDFL

SEQ ID NO: 2823516 - protein, 25 aa, Entamoeba invadens
NTEDWYITPLQNISTLFVNLSAYNT

SEQ ID NO: 2823517 - protein, 25 aa, Entamoeba invadens
NTEEKTIFKMERSNLIFTSLDSVLS

SEQ ID NO: 2823518 - protein, 26 aa, Entamoeba invadens
NTEEKTIFKMERSNLIFTSLDSVLSS

SEQ ID NO: 2823519 - protein, 44 aa, Entamoeba invadens
NTEFPIPQDSFIFALRFFHLAKTFFRLLKIDKSFPLCYSAFPYT

SEQ ID NO: 2823520 - protein, 26 aa, Entamoeba invadens
NTEIWPIFLFLIIQGVGLAMFWSPDE

SEQ ID NO: 2823521 - protein, 18 aa, Entamoeba invadens
NTESLTMKISKDTNIPLL

SEQ ID NO: 2823522 - protein, 18 aa, Entamoeba invadens
NTEYKNHLFSKEPKLYRY

SEQ ID NO: 2823523 - protein, 24 aa, Entamoeba invadens
NTFDVLYKTIPLISGINFNMEQLQ

SEQ ID NO: 2823524 - protein, 30 aa, Entamoeba invadens
NTFDVYPILGFLNNILMLDNYFVNKKCVYL

SEQ ID NO: 2823525 - protein, 20 aa, Entamoeba invadens
NTFISLYDNLILRRCPSVID

SEQ ID NO: 2823526 - protein, 31 aa, Entamoeba invadens
NTFKGISAYVFWLVYGLYQSVVLFVMGYVII

SEQ ID NO: 2823527 - protein, 17 aa, Entamoeba invadens
NTFLDFSATILSINCGV

SEQ ID NO: 2823528 - protein, 19 aa, Entamoeba invadens
NTFLILIENINFKNDSKII

SEQ ID NO: 2823529 - protein, 20 aa, Entamoeba invadens
NTFLYSGMLLKKCGKRVVYN

SEQ ID NO: 2823530 - protein, 18 aa, Entamoeba invadens
NTFNCEYFHITGVTNYPS

SEQ ID NO: 2823531 - protein, 21 aa, Entamoeba invadens
NTFQMYEDVIFVTSGFSRVVM

SEQ ID NO: 2823532 - protein, 17 aa, Entamoeba invadens
NTFRSEYIQFNLSKNII

SEQ ID NO: 2823533 - protein, 24 aa, Entamoeba invadens
NTGCIRCNPGYFLNSMKLCEKCQI

SEQ ID NO: 2823534 - protein, 18 aa, Entamoeba invadens
NTGFFPHDAVCLLCSTKN

SEQ ID NO: 2823535 - protein, 23 aa, Entamoeba invadens
NTGLTQLVLTPSVVYAGGVFSNN

SEQ ID NO: 2823536 - protein, 17 aa, Entamoeba invadens
NTGYYLENNTCIIEAEC

SEQ ID NO: 2823537 - protein, 19 aa, Entamoeba invadens
NTHFLYSFELPPLGITRQI

SEQ ID NO: 2823538 - protein, 29 aa, Entamoeba invadens
NTHFNYQKYFLYFQGALKKGFVINILSKF

SEQ ID NO: 2823539 - protein, 17 aa, Entamoeba invadens
NTHGAIFKLLLDPNPEM

SEQ ID NO: 2823540 - protein, 22 aa, Entamoeba invadens
NTINMKMKIKLMLDASKGILYL

SEQ ID NO: 2823541 - protein, 36 aa, Entamoeba invadens
NTISAFMTLMFPFVWQHVLIPLLPKSLVTYCAAPMP

SEQ ID NO: 2823542 - protein, 25 aa, Entamoeba invadens
NTKNAMFAILFEIIELAPFIDFPEN

SEQ ID NO: 2823543 - protein, 23 aa, Entamoeba invadens
NTKPSFFFLAHFGLKAVTITNDI

SEQ ID NO: 2823544 - protein, 25 aa, Entamoeba invadens
NTKTALHVAFMIALMNWCGCCVTIH

SEQ ID NO: 2823545 - protein, 24 aa, Entamoeba invadens
NTKVTWMCYPWHAGLVIFGILYNV

SEQ ID NO: 2823546 - protein, 17 aa, Entamoeba invadens
NTLHLISNKLRKVVIKD

SEQ ID NO: 2823547 - protein, 25 aa, Entamoeba invadens
NTLLSTVILPRLPLNSFGIGTFENN

SEQ ID NO: 2823548 - protein, 39 aa, Entamoeba invadens
NTLRAITWSVLLERLPSNAQVYMILLRSTLDQGNENTIE

SEQ ID NO: 2823549 - protein, 29 aa, Entamoeba invadens
NTLSEDDGILFLRKDPPQFSTFDADRGSE

SEQ ID NO: 2823550 - protein, 32 aa, Entamoeba invadens
NTLTKTEIFMWTFWKRIGLGAFQYIGYQNVTV

SEQ ID NO: 2823551 - protein, 41 aa, Entamoeba invadens
NTMIVFVVAVVVSVLFVILVCVFFASAAWFKHEKVAVNMRK

SEQ ID NO: 2823552 - protein, 29 aa, Entamoeba invadens
NTNDQCVLPLYTNSLYKFPLEGNLYNEFD

SEQ ID NO: 2823553 - protein, 22 aa, Entamoeba invadens
NTNFLIVVLIVTVSVFGQDILS

SEQ ID NO: 2823554 - protein, 29 aa, Entamoeba invadens
NTNFTLLFTCFLIVLLAFLAGLCLLSQIF

SEQ ID NO: 2823555 - protein, 22 aa, Entamoeba invadens
NTNIVLCSQGFYYNSQNLQCES

SEQ ID NO: 2823556 - protein, 33 aa, Entamoeba invadens
NTNKLDILMTPPKKYLLILPGETTTSFCACIVR

SEQ ID NO: 2823557 - protein, 32 aa, Entamoeba invadens
NTNLFCGLKTLPFLFDLVFSSTFKGSYKISGE

SEQ ID NO: 2823558 - protein, 17 aa, Entamoeba invadens
NTNQYWCSQCNSGYFPY

SEQ ID NO: 2823559 - protein, 25 aa, Entamoeba invadens
NTNRYELFTIPKFQDFNFISDNCLV

SEQ ID NO: 2823560 - protein, 23 aa, Entamoeba invadens
NTNYFVIGMFALELTFAMISTIL

SEQ ID NO: 2823561 - protein, 31 aa, Entamoeba invadens
NTNYGIVVGLPIVCVIVLVVIIVTIITIVVL

SEQ ID NO: 2823562 - protein, 41 aa, Entamoeba invadens
NTNYGIVVGLPIVCVIVLVVIIVTIITIVVLFVLRKKDNKH

SEQ ID NO: 2823563 - protein, 19 aa, Entamoeba invadens
NTNYGMVVGLPVACVVVFV

SEQ ID NO: 2823564 - protein, 24 aa, Entamoeba invadens
NTPATGMYFALRGDNRRYAFHTCY

SEQ ID NO: 2823565 - protein, 24 aa, Entamoeba invadens
NTPKERILWCYKKDLGFSTNAKRR

SEQ ID NO: 2823566 - protein, 32 aa, Entamoeba invadens
NTPLDYSFCRYPMKYRVGKWFKLNMTPIKNNY

SEQ ID NO: 2823567 - protein, 17 aa, Entamoeba invadens
NTPTWQVLKYKLSKDLP

SEQ ID NO: 2823568 - protein, 26 aa, Entamoeba invadens
NTQCKVCELCYPGMKLVDGDCVEVTN

SEQ ID NO: 2823569 - protein, 23 aa, Entamoeba invadens
NTQFDLIFETKNTIFLYSTTDNS

SEQ ID NO: 2823570 - protein, 25 aa, Entamoeba invadens
NTRAMWNIPQIFDWTVYNKTEKLDW

SEQ ID NO: 2823571 - protein, 27 aa, Entamoeba invadens
NTRDLLRLYYICFLNAFDVTEFEKLLS

SEQ ID NO: 2823572 - protein, 24 aa, Entamoeba invadens
NTRITLTLLTMSNLVFTTIQMGNN

SEQ ID NO: 2823573 - protein, 41 aa, Entamoeba invadens
NTRYTWWNFLPMSLFNQFKYFYNLYFLLNASSQLIPAFKVG

SEQ ID NO: 2823574 - protein, 24 aa, Entamoeba invadens
NTSAYLTCFFFFIATQGCSGLFQS

SEQ ID NO: 2823575 - protein, 21 aa, Entamoeba invadens
NTSCFVLCFSLVYLDSYKNLK

SEQ ID NO: 2823576 - protein, 34 aa, Entamoeba invadens
NTSCITQAVWWVILLIVIVVVVIIILVIVAVIVL

SEQ ID NO: 2823577 - protein, 24 aa, Entamoeba invadens
NTSGFLFWIVVPLLFNEQGASAIE

SEQ ID NO: 2823578 - protein, 25 aa, Entamoeba invadens
NTSGLYWSVPLFTLPIIMGLSSDYD

SEQ ID NO: 2823579 - protein, 25 aa, Entamoeba invadens
NTSLPYIIVYPIVCTLPSLISSLWG

SEQ ID NO: 2823580 - protein, 25 aa, Entamoeba invadens
NTSRSFLHLSFKLKVKVLLDTSKGM

SEQ ID NO: 2823581 - protein, 31 aa, Entamoeba invadens
NTSTYFYTFVEPAIPLIFGGVFVKTKYGLIS

SEQ ID NO: 2823582 - protein, 19 aa, Entamoeba invadens
NTTCYLCDTKTMLLNGVCN

SEQ ID NO: 2823583 - protein, 19 aa, Entamoeba invadens
NTTDRHYLSFLSENFRVEV

SEQ ID NO: 2823584 - protein, 19 aa, Entamoeba invadens
NTTIFYNTFASRKNQIVCE

SEQ ID NO: 2823585 - protein, 28 aa, Entamoeba invadens
NTTLKIINNLLFYFSIAELSRDSKLITK

SEQ ID NO: 2823586 - protein, 27 aa, Entamoeba invadens
NTTSALLYWKPLFAEDLLLNVPDTFSI

SEQ ID NO: 2823587 - protein, 24 aa, Entamoeba invadens
NTTVLIARNLFLNSFSTLTTNRNV

SEQ ID NO: 2823588 - protein, 25 aa, Entamoeba invadens
NTTVLVIIWWVIYAVQFVLCYLVFP

SEQ ID NO: 2823589 - protein, 21 aa, Entamoeba invadens
NTTYCLTCDPQYYLSSTFTCE

SEQ ID NO: 2823590 - protein, 27 aa, Entamoeba invadens
NTTYCTSCQLGYYLSSTFTCEPLGDLF

SEQ ID NO: 2823591 - protein, 28 aa, Entamoeba invadens
NTTYCTSCQLGYYLSSTFTCEPLGDLFT

SEQ ID NO: 2823592 - protein, 22 aa, Entamoeba invadens
NTTYCTSCQPGYYLSSAFTCEP

SEQ ID NO: 2823593 - protein, 18 aa, Entamoeba invadens
NTVIPPGTLKRCDVLTLV

SEQ ID NO: 2823594 - protein, 24 aa, Entamoeba invadens
NTWKDPMHFTFHAGDYTKYEIMCK

SEQ ID NO: 2823595 - protein, 36 aa, Entamoeba invadens
NTYLKKMWMRVLSNKLIICLVGMTLLLAMATLLYYY

SEQ ID NO: 2823596 - protein, 19 aa, Entamoeba invadens
NTYLQRPFVLIESLSGKQQ

SEQ ID NO: 2823597 - protein, 20 aa, Entamoeba invadens
NTYPIEFTKDLFLTHAYKAL

SEQ ID NO: 2823598 - protein, 17 aa, Entamoeba invadens
NTYYVVYKIGKCYLTGS

SEQ ID NO: 2823599 - protein, 23 aa, Entamoeba invadens
NVACFIPSLFFFCTIVLLDIFMT

SEQ ID NO: 2823600 - protein, 29 aa, Entamoeba invadens
NVAIAFLFHFFATHYLFLVGGTLVFGMYY

SEQ ID NO: 2823601 - protein, 23 aa, Entamoeba invadens
NVALMLLSRYIGVFVKRPSKQAK

SEQ ID NO: 2823602 - protein, 25 aa, Entamoeba invadens
NVANCFTCISWNDYFCLNCNINFYM

SEQ ID NO: 2823603 - protein, 30 aa, Entamoeba invadens
NVCKYIVNYIRIDVVLPTVMISDVDRTFKS

SEQ ID NO: 2823604 - protein, 19 aa, Entamoeba invadens
NVCLECVTGFYFQLGNCVT

SEQ ID NO: 2823605 - protein, 17 aa, Entamoeba invadens
NVCLLCSLGNQVKNGVC

SEQ ID NO: 2823606 - protein, 18 aa, Entamoeba invadens
NVCVQCESGAFLTVDRQC

SEQ ID NO: 2823607 - protein, 18 aa, Entamoeba invadens
NVDLIYSEIPFTGSTPIG

SEQ ID NO: 2823608 - protein, 29 aa, Entamoeba invadens
NVDPPYIVSSFFLKLFGASLFVDVFSNLL

SEQ ID NO: 2823609 - protein, 23 aa, Entamoeba invadens
NVDSFCFFEYNNDKYFAIGDHSG

SEQ ID NO: 2823610 - protein, 20 aa, Entamoeba invadens
NVEFSYLRYLFSGNEFTQIP

SEQ ID NO: 2823611 - protein, 33 aa, Entamoeba invadens
NVEGKFDFCLPIPSTVYPNCKRLAFSTSKCVEC

SEQ ID NO: 2823612 - protein, 18 aa, Entamoeba invadens
NVENCVFYDVNHKCKTCE

SEQ ID NO: 2823613 - protein, 25 aa, Entamoeba invadens
NVENDFSVILPLFEQFENTEAELED

SEQ ID NO: 2823614 - protein, 33 aa, Entamoeba invadens
NVESKFDFCLPIPSTVYPNCKRLAFSTSKCVEC

SEQ ID NO: 2823615 - protein, 31 aa, Entamoeba invadens
NVFFGMMYGFFYYKFIYAKDKRLSFFSEILK

SEQ ID NO: 2823616 - protein, 22 aa, Entamoeba invadens
NVFQWKRRNAHIHHQAIASILN

SEQ ID NO: 2823617 - protein, 21 aa, Entamoeba invadens
NVFTRCHFLISALTFTSNNSF

SEQ ID NO: 2823618 - protein, 28 aa, Entamoeba invadens
NVGCPPSYQWSVEGLLISISKYDMYTTI

SEQ ID NO: 2823619 - protein, 25 aa, Entamoeba invadens
NVGVEFWLMNKPELLKNFLSDVAKV

SEQ ID NO: 2823620 - protein, 17 aa, Entamoeba invadens
NVHLKTQLTTRLDYDML

SEQ ID NO: 2823621 - protein, 25 aa, Entamoeba invadens
NVIALPFFLSPYSNPMYFIFMAYNT

SEQ ID NO: 2823622 - protein, 18 aa, Entamoeba invadens
NVIFACEKGKYLNENNQC

SEQ ID NO: 2823623 - protein, 25 aa, Entamoeba invadens
NVIPPQIFFEMFAPNFRFKDHANLL

SEQ ID NO: 2823624 - protein, 24 aa, Entamoeba invadens
NVIYNVMFVFLKAAKMIERELSIS

SEQ ID NO: 2823625 - protein, 27 aa, Entamoeba invadens
NVKISCTSIFLLVIDIPKDLASIWVSL

SEQ ID NO: 2823626 - protein, 26 aa, Entamoeba invadens
NVKIVIVPMYLGPLTEILLSRENDTY

SEQ ID NO: 2823627 - protein, 28 aa, Entamoeba invadens
NVKKRKTLLWILTYFLGCMTITKNVTTL

SEQ ID NO: 2823628 - protein, 18 aa, Entamoeba invadens
NVKLLKIFQCALLSANMN

SEQ ID NO: 2823629 - protein, 25 aa, Entamoeba invadens
NVKNYYNHYLLLNRQSQTTDLGTGG

SEQ ID NO: 2823630 - protein, 24 aa, Entamoeba invadens
NVKQTINILFERPINPGGKYSKMR

SEQ ID NO: 2823631 - protein, 26 aa, Entamoeba invadens
NVKVTLFSLLELYDGMRLFLYDNSSL

SEQ ID NO: 2823632 - protein, 18 aa, Entamoeba invadens
NVKVYCTFLCTSHTKDIV

SEQ ID NO: 2823633 - protein, 34 aa, Entamoeba invadens
NVKYNKIFIILFALGFLFVVPWLAGFIISRKTTN

SEQ ID NO: 2823634 - protein, 23 aa, Entamoeba invadens
NVLELWSLFDFLMPGFLGTEKEF

SEQ ID NO: 2823635 - protein, 19 aa, Entamoeba invadens
NVLHLLFILAVGSLVPSNE

SEQ ID NO: 2823636 - protein, 27 aa, Entamoeba invadens
NVLKHSWVLLNILLKAMIVMIHNKKEI

SEQ ID NO: 2823637 - protein, 30 aa, Entamoeba invadens
NVLSRLDGVDPLYLYQILGDMLKAFFEMSS

SEQ ID NO: 2823638 - protein, 32 aa, Entamoeba invadens
NVLSTEQFIVLKEYVYLLTVIAANQKLNRMGA

SEQ ID NO: 2823639 - protein, 21 aa, Entamoeba invadens
NVLVWLIPFFANPNSTESKNT

SEQ ID NO: 2823640 - protein, 19 aa, Entamoeba invadens
NVLYDPKRLLGLSLEEIPE

SEQ ID NO: 2823641 - protein, 17 aa, Entamoeba invadens
NVNLKNFFSKVSGLIAI

SEQ ID NO: 2823642 - protein, 22 aa, Entamoeba invadens
NVNNIIPMDVIIRGDMYIGYGT

SEQ ID NO: 2823643 - protein, 20 aa, Entamoeba invadens
NVNWICYAHNLKTPGSLGAV

SEQ ID NO: 2823644 - protein, 18 aa, Entamoeba invadens
NVPGLYYIFDMTEGVMYD

SEQ ID NO: 2823645 - protein, 20 aa, Entamoeba invadens
NVPKLNIGMGVWAFPDNIRI

SEQ ID NO: 2823646 - protein, 33 aa, Entamoeba invadens
NVPVGWIVFGVLFYIMCAVVIAVVVVLIILKRK

SEQ ID NO: 2823647 - protein, 17 aa, Entamoeba invadens
NVPYYMFVHTKFASSKM

SEQ ID NO: 2823648 - protein, 22 aa, Entamoeba invadens
NVQAYGLVLLRNVMSFDSGMQK

SEQ ID NO: 2823649 - protein, 26 aa, Entamoeba invadens
NVRNVLYNYTFYKPNKSYCLEQLMGN

SEQ ID NO: 2823650 - protein, 26 aa, Entamoeba invadens
NVRTLLYNFLFEVLDLVPTLESPLNM

SEQ ID NO: 2823651 - protein, 25 aa, Entamoeba invadens
NVSLFYFVPIVFYITNLITVIFLVV

SEQ ID NO: 2823652 - protein, 25 aa, Entamoeba invadens
NVSPYRLDLAITRKLLVFSSNLGLQ

SEQ ID NO: 2823653 - protein, 22 aa, Entamoeba invadens
NVSTIFDLYSPPPKFALYVNNS

SEQ ID NO: 2823654 - protein, 21 aa, Entamoeba invadens
NVTFHMSVIVKKFVVYKITDF

SEQ ID NO: 2823655 - protein, 27 aa, Entamoeba invadens
NVTHAIFEIDFKNVKRLSPMKLNSIKK

SEQ ID NO: 2823656 - protein, 25 aa, Entamoeba invadens
NVTPSIYFLMCKLIQIKQIQPMALA

SEQ ID NO: 2823657 - protein, 24 aa, Entamoeba invadens
NVTSIFTKYMYLQGESLFSLNNDT

SEQ ID NO: 2823658 - protein, 19 aa, Entamoeba invadens
NVTTLYLQRIYTLKSIQLL

SEQ ID NO: 2823659 - protein, 21 aa, Entamoeba invadens
NVVFKGLFLITMNPSESLPRY

SEQ ID NO: 2823660 - protein, 25 aa, Entamoeba invadens
NVVGWISFGLFATCFILLTLIPVFV

SEQ ID NO: 2823661 - protein, 25 aa, Entamoeba invadens
NVVGWISFGLFATCFILLTMIPVFV

SEQ ID NO: 2823662 - protein, 18 aa, Entamoeba invadens
NVVIFSMMCSGVISLICF

SEQ ID NO: 2823663 - protein, 17 aa, Entamoeba invadens
NVVIPDYFNSKLGIAYP

SEQ ID NO: 2823664 - protein, 22 aa, Entamoeba invadens
NVVIPHFINVVIGNRCMFGYET

SEQ ID NO: 2823665 - protein, 28 aa, Entamoeba invadens
NVVMIASIFFYWFFPHEFKLHDAVQGLF

SEQ ID NO: 2823666 - protein, 21 aa, Entamoeba invadens
NVYNCMFIVASLPIIFDRSET

SEQ ID NO: 2823667 - protein, 26 aa, Entamoeba invadens
NVYNIIVGFFIRFYLFKQTCFTTTLT

SEQ ID NO: 2823668 - protein, 17 aa, Entamoeba invadens
NWFLIHGAQHTILVSGS

SEQ ID NO: 2823669 - protein, 19 aa, Entamoeba invadens
NWIPPEKFITNITLNTTFS

SEQ ID NO: 2823670 - protein, 24 aa, Entamoeba invadens
NWKVMIFFVIFTTCLSLLYFVDWK

SEQ ID NO: 2823671 - protein, 17 aa, Entamoeba invadens
NWMFPNLMIGNHDLPRI

SEQ ID NO: 2823672 - protein, 34 aa, Entamoeba invadens
NWNYFICFFIITFLLIYVTYFQQNIDDRISVFKI

SEQ ID NO: 2823673 - protein, 23 aa, Entamoeba invadens
NWRCVYCDQNYFYYPSDGSCRSI

SEQ ID NO: 2823674 - protein, 19 aa, Entamoeba invadens
NWTKDAPAMLLITDSVMTT

SEQ ID NO: 2823675 - protein, 19 aa, Entamoeba invadens
NWVRQYSYLKTSSNKKDIT

SEQ ID NO: 2823676 - protein, 19 aa, Entamoeba invadens
NYCKYLASGILRIFLLIVQ

SEQ ID NO: 2823677 - protein, 26 aa, Entamoeba invadens
NYCLEPNKYLLFTKRKIFIENFSDIN

SEQ ID NO: 2823678 - protein, 32 aa, Entamoeba invadens
NYDLDFTMNVIPWYKFPWAGSKRRDYTFVTYE

SEQ ID NO: 2823679 - protein, 20 aa, Entamoeba invadens
NYDSVYILAPKYTFKSITAH

SEQ ID NO: 2823680 - protein, 26 aa, Entamoeba invadens
NYDYDFTLFEYFPLEFDTTKLTFGSE

SEQ ID NO: 2823681 - protein, 28 aa, Entamoeba invadens
NYENEIIVELYEWYRLLQSESVKYTFKP

SEQ ID NO: 2823682 - protein, 29 aa, Entamoeba invadens
NYEYVEMGFQWGFSPTLFLHGYLDVEMVN

SEQ ID NO: 2823683 - protein, 25 aa, Entamoeba invadens
NYFFKQDMYFPFNQQAYFSAFEFNN

SEQ ID NO: 2823684 - protein, 24 aa, Entamoeba invadens
NYFKLKIMIDALRGIEYLHLNGIL

SEQ ID NO: 2823685 - protein, 17 aa, Entamoeba invadens
NYFLSNKIIFTNNTLTA

SEQ ID NO: 2823686 - protein, 29 aa, Entamoeba invadens
NYFNNKNCILPYKEALPTLTVYPNGCTKL

SEQ ID NO: 2823687 - protein, 18 aa, Entamoeba invadens
NYFSVMYKKDITITVRTC

SEQ ID NO: 2823688 - protein, 23 aa, Entamoeba invadens
NYGEFPLLFREKFPEYTPVAQQP

SEQ ID NO: 2823689 - protein, 46 aa, Entamoeba invadens
NYGFVIGIPITVVVLLILTITLLTIILLYILQRYSHKQQMQNVCVF

SEQ ID NO: 2823690 - protein, 41 aa, Entamoeba invadens
NYGIIIGCPLAFLFVVFVLLILLFFIVFEIQRKRKEKNDAK

SEQ ID NO: 2823691 - protein, 26 aa, Entamoeba invadens
NYGIVVGLPIVCVIVLVVIIVTIITI

SEQ ID NO: 2823692 - protein, 25 aa, Entamoeba invadens
NYGKYIKKYFTLIFSYIVKQKEGGI

SEQ ID NO: 2823693 - protein, 43 aa, Entamoeba invadens
NYGLVVGVPISVTLVVIVLIVVIIIVVILWLQNQKQKKKEQNI

SEQ ID NO: 2823694 - protein, 37 aa, Entamoeba invadens
NYGLVVGVPLSMTFVIIVFIVAIIIIVISMIQKRKQK

SEQ ID NO: 2823695 - protein, 38 aa, Entamoeba invadens
NYGLVVGVPLSVTFVIIVFIVAIIVIVISMIQKKKQKK

SEQ ID NO: 2823696 - protein, 38 aa, Entamoeba invadens
NYGLVVGVPLSVTVVILVIIFAIILIVISMIQKRKQKK

SEQ ID NO: 2823697 - protein, 49 aa, Entamoeba invadens
NYGVVIGVPAAFFVVLFIVIGCVIFSVYLWIQAIQYRTKIRDICIFDMK

SEQ ID NO: 2823698 - protein, 24 aa, Entamoeba invadens
NYILSPYFWEPLLKYVIPPTIAPN

SEQ ID NO: 2823699 - protein, 18 aa, Entamoeba invadens
NYLFNVPFLLGEMKVNYK

SEQ ID NO: 2823700 - protein, 23 aa, Entamoeba invadens
NYMHYQPLFSQYLKDYLEFIQAT

SEQ ID NO: 2823701 - protein, 20 aa, Entamoeba invadens
NYPDCLFNSSLFDFIILSQQ

SEQ ID NO: 2823702 - protein, 20 aa, Entamoeba invadens
NYPFAFLMPCNEMFDQNNNF

SEQ ID NO: 2823703 - protein, 28 aa, Entamoeba invadens
NYPGRYPFCRYKGFNSYFEDVHPAYKFT

SEQ ID NO: 2823704 - protein, 32 aa, Entamoeba invadens
NYSCRAFGAFVIFPVVFFSKTIFLYMTVNCLK

SEQ ID NO: 2823705 - protein, 24 aa, Entamoeba invadens
NYSIKKWVLLLTEYSEIAGKINTT

SEQ ID NO: 2823706 - protein, 26 aa, Entamoeba invadens
NYSKNKWMMIIFHTPNNPEYTFYFDP

SEQ ID NO: 2823707 - protein, 18 aa, Entamoeba invadens
NYSVLTTTPSPAKFTLLR

SEQ ID NO: 2823708 - protein, 28 aa, Entamoeba invadens
NYTINIFKLFLHFFTNTSFYLPEYRNYF

SEQ ID NO: 2823709 - protein, 20 aa, Entamoeba invadens
NYTVWFSKNKSTLLQIAELL

SEQ ID NO: 2823710 - protein, 20 aa, Entamoeba invadens
NYVLLDLNCVWYTTIDKCVE

SEQ ID NO: 2823711 - protein, 30 aa, Entamoeba invadens
NYVVTPCTPYLYMKAVFFTLTLNSTYSVLV

SEQ ID NO: 2823712 - protein, 24 aa, Entamoeba invadens
NYYATIVINGPILLGATAGFGFVW

SEQ ID NO: 2823713 - protein, 20 aa, Entamoeba invadens
NYYYNFILQNYNAGAQGGMN

SEQ ID NO: 2823714 - protein, 20 aa, Entamoeba invadens
NYYYNFILQNYNAGGQGGMN

SEQ ID NO: 2823715 - protein, 19 aa, Entamoeba invadens
PADIYAFAVTIYETSIWGK

SEQ ID NO: 2823716 - protein, 30 aa, Entamoeba invadens
PADIYSFAVTMYELFKWGDAYDPDKIRSWD

SEQ ID NO: 2823717 - protein, 43 aa, Entamoeba invadens
PADIYSLAITMYEMFIWGDIFPKNEFKFAWIIADFVSSGKRKE

SEQ ID NO: 2823718 - protein, 36 aa, Entamoeba invadens
PADVFSFAITMYDIFNWGGLYPVAEFPYPWSVAEFV

SEQ ID NO: 2823719 - protein, 23 aa, Entamoeba invadens
PADVFSFGVTMYEVFGWSEAYQN

SEQ ID NO: 2823720 - protein, 17 aa, Entamoeba invadens
PADVYSFAIGMLEGISW

SEQ ID NO: 2823721 - protein, 31 aa, Entamoeba invadens
PADVYSFAITMFEILIWGEAYPGDRFKYPWD

SEQ ID NO: 2823722 - protein, 19 aa, Entamoeba invadens
PAFHKFLKLLGKSESLHEW

SEQ ID NO: 2823723 - protein, 17 aa, Entamoeba invadens
PAFRSGCGLCFNVGLFE

SEQ ID NO: 2823724 - protein, 18 aa, Entamoeba invadens
PAICIGINYLLWYYKFIP

SEQ ID NO: 2823725 - protein, 20 aa, Entamoeba invadens
PAIVLSLGQLTLSAASCGFG

SEQ ID NO: 2823726 - protein, 24 aa, Entamoeba invadens
PAKDLWNNNIIWEFAKGLSPGMDL

SEQ ID NO: 2823727 - protein, 20 aa, Entamoeba invadens
PALMFPTCAGIYRYLPKKWK

SEQ ID NO: 2823728 - protein, 18 aa, Entamoeba invadens
PAMTAKLTTLLSLGDHFH

SEQ ID NO: 2823729 - protein, 25 aa, Entamoeba invadens
PASPYTFGIYFKLTSPVTRYVVFEV

SEQ ID NO: 2823730 - protein, 28 aa, Entamoeba invadens
PAVCTAALPIKNIPFSKSVTLGVNWPTT

SEQ ID NO: 2823731 - protein, 26 aa, Entamoeba invadens
PAVDMFAFGVLVFEMFCGNISKMFKS

SEQ ID NO: 2823732 - protein, 30 aa, Entamoeba invadens
PCDGPTDFKYFYTSNYIKYYVCGTCDPNYH

SEQ ID NO: 2823733 - protein, 36 aa, Entamoeba invadens
PCDIFSLGTSMYEVFSWKSAFTEKQFKYAWDIADFI

SEQ ID NO: 2823734 - protein, 31 aa, Entamoeba invadens
PCEKVHFEPITFVCTSGVTGVALVAFLGVLA

SEQ ID NO: 2823735 - protein, 27 aa, Entamoeba invadens
PCGGTEDWYITPLPNVTSLYVEINPTK

SEQ ID NO: 2823736 - protein, 19 aa, Entamoeba invadens
PCILTLYHRIIMPMPKKKV

SEQ ID NO: 2823737 - protein, 18 aa, Entamoeba invadens
PCIYVFMSLYRFNNIKMC

SEQ ID NO: 2823738 - protein, 19 aa, Entamoeba invadens
PCKHCSNLTYCTKCDAYSY

SEQ ID NO: 2823739 - protein, 17 aa, Entamoeba invadens
PCLLNMGNALYKSDYAT

SEQ ID NO: 2823740 - protein, 17 aa, Entamoeba invadens
PCSFIYAYYFSILLTLV

SEQ ID NO: 2823741 - protein, 28 aa, Entamoeba invadens
PCVGCIGWIITCPAACGCIPFIVIGSLC

SEQ ID NO: 2823742 - protein, 29 aa, Entamoeba invadens
PCYHKQKYRLMYWYKLDYSQVTTKYIFIT

SEQ ID NO: 2823743 - protein, 40 aa, Entamoeba invadens
PCYNSPYYTPVERLLWFKSHGFIHLLMKCLSISQAIYIVL

SEQ ID NO: 2823744 - protein, 26 aa, Entamoeba invadens
PCYYKQKYRLARWFKINLNQFTEDHF

SEQ ID NO: 2823745 - protein, 19 aa, Entamoeba invadens
PDAPYLSKMQYFNDNFLLV

SEQ ID NO: 2823746 - protein, 20 aa, Entamoeba invadens
PDAYFKGDGVCTKCADKCLS

SEQ ID NO: 2823747 - protein, 27 aa, Entamoeba invadens
PDDFAFWAGVRFVIIFDPTYSQYYSLS

SEQ ID NO: 2823748 - protein, 23 aa, Entamoeba invadens
PDDQYYIVWTPLNPVFENVRSKC

SEQ ID NO: 2823749 - protein, 22 aa, Entamoeba invadens
PDELFSLFQMYKSLNVQVSHIK

SEQ ID NO: 2823750 - protein, 32 aa, Entamoeba invadens
PDFGPLRFIIFANFFLGTYIFIPYLFSSEKKS

SEQ ID NO: 2823751 - protein, 23 aa, Entamoeba invadens
PDFINWMRPAVSSTFRKLTGIIN

SEQ ID NO: 2823752 - protein, 19 aa, Entamoeba invadens
PDGLYKYFHDRFPTLLVLV

SEQ ID NO: 2823753 - protein, 39 aa, Entamoeba invadens
PDIPLIVTEWSFPALDAGLPIKFFMAQLMNMENVIGAHY

SEQ ID NO: 2823754 - protein, 21 aa, Entamoeba invadens
PDIPMMITEWSFPSLDAGLPC

SEQ ID NO: 2823755 - protein, 22 aa, Entamoeba invadens
PDITILRKFMLDMAKGISYLHN

SEQ ID NO: 2823756 - protein, 29 aa, Entamoeba invadens
PDLQYGLLVLFAFWFFHGIIDTITGVSIE

SEQ ID NO: 2823757 - protein, 24 aa, Entamoeba invadens
PDLTHLQITLLDLSLTLGLDKTDF

SEQ ID NO: 2823758 - protein, 18 aa, Entamoeba invadens
PDLYLRGALCFFTHFFNT

SEQ ID NO: 2823759 - protein, 19 aa, Entamoeba invadens
PDNFLVFSLESGIDVNAKL

SEQ ID NO: 2823760 - protein, 19 aa, Entamoeba invadens
PDNILIFSLDLNVKVNAKL

SEQ ID NO: 2823761 - protein, 20 aa, Entamoeba invadens
PDNILLVSLEYNLIANAKLT

SEQ ID NO: 2823762 - protein, 17 aa, Entamoeba invadens
PDNILVFSFDLNERVIA

SEQ ID NO: 2823763 - protein, 17 aa, Entamoeba invadens
PDNILVFSLDLYSKVNA

SEQ ID NO: 2823764 - protein, 24 aa, Entamoeba invadens
PDNILVFSLERDILVNAKLTDFGS

SEQ ID NO: 2823765 - protein, 26 aa, Entamoeba invadens
PDPNDFLRVFLTMFNIVKANTDKEIA

SEQ ID NO: 2823766 - protein, 25 aa, Entamoeba invadens
PDRQFNYYLFISVTNFCDVKLQISV

SEQ ID NO: 2823767 - protein, 17 aa, Entamoeba invadens
PDSWYPLGRNIGTTVFP

SEQ ID NO: 2823768 - protein, 29 aa, Entamoeba invadens
PDTRTLGIFFNLLLNWLKGKYEVVSETIN

SEQ ID NO: 2823769 - protein, 43 aa, Entamoeba invadens
PDTSGVYCKSSVVWWVIFLVVIFVLFMIITVLICIILAMNFFM

SEQ ID NO: 2823770 - protein, 23 aa, Entamoeba invadens
PDTVSAPLYSILSGINLQSALTV

SEQ ID NO: 2823771 - protein, 17 aa, Entamoeba invadens
PDVKAIDGLYWGVPLVC

SEQ ID NO: 2823772 - protein, 25 aa, Entamoeba invadens
PDVLTFNGVPPHLPLTIKFEKVHEF

SEQ ID NO: 2823773 - protein, 35 aa, Entamoeba invadens
PDVNLILSIFLNAISFPVLYLPHQNYREAILLSLK

SEQ ID NO: 2823774 - protein, 25 aa, Entamoeba invadens
PDYKYFPYGFLAADFFFLLSGFLAA

SEQ ID NO: 2823775 - protein, 24 aa, Entamoeba invadens
PDYLPREFIILINATLRSIIIFFS

SEQ ID NO: 2823776 - protein, 17 aa, Entamoeba invadens
PEAYFAKDKVCTACVDD

SEQ ID NO: 2823777 - protein, 20 aa, Entamoeba invadens
PECFKRAPITKFFDLEFTSL

SEQ ID NO: 2823778 - protein, 20 aa, Entamoeba invadens
PECLVAMLITPFLGAIESFR

SEQ ID NO: 2823779 - protein, 32 aa, Entamoeba invadens
PEEAFLTLGLFNIMRLPLIRFPKLLNDTMQGV

SEQ ID NO: 2823780 - protein, 25 aa, Entamoeba invadens
PEEDRLDFVYNYLSQWSDPANYSEY

SEQ ID NO: 2823781 - protein, 25 aa, Entamoeba invadens
PEEECVLLCVFGIEDPLRPEVIQAV

SEQ ID NO: 2823782 - protein, 22 aa, Entamoeba invadens
PEEMYRLFPFKNKIVEVNGRVF

SEQ ID NO: 2823783 - protein, 24 aa, Entamoeba invadens
PEENELMILIVKTVLDEFGRMNVF

SEQ ID NO: 2823784 - protein, 18 aa, Entamoeba invadens
PEFKNKILFVVHNGLLIS

SEQ ID NO: 2823785 - protein, 24 aa, Entamoeba invadens
PEFKNKILFVVHNGLLISEQLESC

SEQ ID NO: 2823786 - protein, 21 aa, Entamoeba invadens
PEGLFVYFGCRNECRKNVDDG

SEQ ID NO: 2823787 - protein, 17 aa, Entamoeba invadens
PEILDKMNYKLSADIYS

SEQ ID NO: 2823788 - protein, 55 aa, Entamoeba invadens
PEINGSYCEQHVVWWVIFIAIVFVIAVITFLFILILFGLYKLLNKIEMKKLDGEL

SEQ ID NO: 2823789 - protein, 39 aa, Entamoeba invadens
PEITFMTCTFGYLCFLILVKWIHFIPNAPMITNVFLEMF

SEQ ID NO: 2823790 - protein, 30 aa, Entamoeba invadens
PEKNVITCNLYYPTTKKFGKGALFCAFESK

SEQ ID NO: 2823791 - protein, 18 aa, Entamoeba invadens
PEKVEYISRLFKALNDSI

SEQ ID NO: 2823792 - protein, 17 aa, Entamoeba invadens
PEKVGVQTVSLVTVVMN

SEQ ID NO: 2823793 - protein, 21 aa, Entamoeba invadens
PELNNPQIVLWNTSHLHLSYN

SEQ ID NO: 2823794 - protein, 20 aa, Entamoeba invadens
PEMHFIFKEFIQRMENVFKP

SEQ ID NO: 2823795 - protein, 19 aa, Entamoeba invadens
PEMIISCLPSYFSTQTSCK

SEQ ID NO: 2823796 - protein, 31 aa, Entamoeba invadens
PEMLKKNANPFFFLCLRIRPTIFLGVPRVYE

SEQ ID NO: 2823797 - protein, 19 aa, Entamoeba invadens
PENLKLLIQNSWEQDPISR

SEQ ID NO: 2823798 - protein, 18 aa, Entamoeba invadens
PENQKLLQIFKDYVPKVL

SEQ ID NO: 2823799 - protein, 24 aa, Entamoeba invadens
PENVLKIFTMFIENVFLNLKEANL

SEQ ID NO: 2823800 - protein, 27 aa, Entamoeba invadens
PENVQPQLFMFILNNFEKYLRPKLLQQ

SEQ ID NO: 2823801 - protein, 18 aa, Entamoeba invadens
PERITLFKNLKTATLGIE

SEQ ID NO: 2823802 - protein, 26 aa, Entamoeba invadens
PERTNCTWCYDGFYLDSFHGKYNNTC

SEQ ID NO: 2823803 - protein, 17 aa, Entamoeba invadens
PESLFNTYTNCLYFCVV

SEQ ID NO: 2823804 - protein, 25 aa, Entamoeba invadens
PESPVDFPGLFPYLLQNNPSSESFT

SEQ ID NO: 2823805 - protein, 22 aa, Entamoeba invadens
PETLVADFPFFSPKMNVSSFVD

SEQ ID NO: 2823806 - protein, 25 aa, Entamoeba invadens
PETMFENVLKFPVFSPYKGVVGREN

SEQ ID NO: 2823807 - protein, 30 aa, Entamoeba invadens
PEYLADALSFLKLVYLSDAPFLYSPSIIAL

SEQ ID NO: 2823808 - protein, 25 aa, Entamoeba invadens
PEYVDEHLILYLKGLTSLKCVNIKN

SEQ ID NO: 2823809 - protein, 25 aa, Entamoeba invadens
PFCWRSDTPLIYRAIPSWFVNVESF

SEQ ID NO: 2823810 - protein, 25 aa, Entamoeba invadens
PFDEVSIMLNKIYKLFMMTNKEGSN

SEQ ID NO: 2823811 - protein, 17 aa, Entamoeba invadens
PFDRDYIGFAIFDKIKQ

SEQ ID NO: 2823812 - protein, 18 aa, Entamoeba invadens
PFDTIPLVTLLLSTLPAL

SEQ ID NO: 2823813 - protein, 22 aa, Entamoeba invadens
PFEHPMFLTFMMFVGMAICIVV

SEQ ID NO: 2823814 - protein, 21 aa, Entamoeba invadens
PFEPKYCQLIFIIDGRRDRNM

SEQ ID NO: 2823815 - protein, 24 aa, Entamoeba invadens
PFERMLRFFTYVGVRQPIICVFYK

SEQ ID NO: 2823816 - protein, 27 aa, Entamoeba invadens
PFESYGFFLIYIFGLLYTGYAFYIVVE

SEQ ID NO: 2823817 - protein, 17 aa, Entamoeba invadens
PFEWEGVIIPYIPSHLY

SEQ ID NO: 2823818 - protein, 26 aa, Entamoeba invadens
PFFAVYPFVFLLMAIASFVVNQSVEK

SEQ ID NO: 2823819 - protein, 21 aa, Entamoeba invadens
PFFFSYFITVSAWNNAGLSIN

SEQ ID NO: 2823820 - protein, 25 aa, Entamoeba invadens
PFFNQRIRIAVPLFIFRTKTTTLDL

SEQ ID NO: 2823821 - protein, 17 aa, Entamoeba invadens
PFGNKYIFDKLLFQENS

SEQ ID NO: 2823822 - protein, 19 aa, Entamoeba invadens
PFGSYSLIGATFCTACTSS

SEQ ID NO: 2823823 - protein, 19 aa, Entamoeba invadens
PFHIFMCLLFVYHILEFTS

SEQ ID NO: 2823824 - protein, 18 aa, Entamoeba invadens
PFIQLKESRYFSVESLSV

SEQ ID NO: 2823825 - protein, 17 aa, Entamoeba invadens
PFKRVYFKDFWLADQMT

SEQ ID NO: 2823826 - protein, 21 aa, Entamoeba invadens
PFLGYIPFPVIRRFGSFFSPY

SEQ ID NO: 2823827 - protein, 17 aa, Entamoeba invadens
PFLINLFGKNIVPSSKE

SEQ ID NO: 2823828 - protein, 22 aa, Entamoeba invadens
PFLVLTYLIILNPIPSCALRMN

SEQ ID NO: 2823829 - protein, 18 aa, Entamoeba invadens
PFMNRWFDLTVATNEIYN

SEQ ID NO: 2823830 - protein, 32 aa, Entamoeba invadens
PFNTEQVPLYRIPFIPSLFAQNYFYIDFANSY

SEQ ID NO: 2823831 - protein, 19 aa, Entamoeba invadens
PFPIQLSSWFWYARFKYCC

SEQ ID NO: 2823832 - protein, 46 aa, Entamoeba invadens
PFPPFVQDRWYPHGSAFSVLLLQKRLLFHIIYKCYIDVIVINAERM

SEQ ID NO: 2823833 - protein, 20 aa, Entamoeba invadens
PFQLSPFLCDGALQTITVFL

SEQ ID NO: 2823834 - protein, 30 aa, Entamoeba invadens
PFRGTLIFFIVFTIIINYLYYLDWYTHYET

SEQ ID NO: 2823835 - protein, 17 aa, Entamoeba invadens
PFTFASLKERITTYEVT

SEQ ID NO: 2823836 - protein, 18 aa, Entamoeba invadens
PFVLFMLDESDKLNEWRE

SEQ ID NO: 2823837 - protein, 21 aa, Entamoeba invadens
PFYCQTCISGFVFMRGSCRKC

SEQ ID NO: 2823838 - protein, 36 aa, Entamoeba invadens
PFYFYLVYCIYVTCFLLYLFILFDCIVGETIRWKTI

SEQ ID NO: 2823839 - protein, 20 aa, Entamoeba invadens
PGDIIEFTSGLYPPQEVPKN

SEQ ID NO: 2823840 - protein, 25 aa, Entamoeba invadens
PGDVAIIYVLLGRVPALAALYRMNQ

SEQ ID NO: 2823841 - protein, 53 aa, Entamoeba invadens
PGENGLYCKYKVPVWFIIVIIIVILLFISIVLILIFFIVNFLVRKKYSEMDNN

SEQ ID NO: 2823842 - protein, 17 aa, Entamoeba invadens
PGFIYFIQNMLLYIILQ

SEQ ID NO: 2823843 - protein, 20 aa, Entamoeba invadens
PGFLLNGIFLFKPNDMLSFD

SEQ ID NO: 2823844 - protein, 22 aa, Entamoeba invadens
PGFVGYLSSKGVCTPCYPDYKC

SEQ ID NO: 2823845 - protein, 30 aa, Entamoeba invadens
PGGCILCNEGFYLQNWKCHFCSTNCTQCDS

SEQ ID NO: 2823846 - protein, 21 aa, Entamoeba invadens
PGGFYSVYYGSSKCTECAAGT

SEQ ID NO: 2823847 - protein, 19 aa, Entamoeba invadens
PGHTFQIRCVSPVMQIVRP

SEQ ID NO: 2823848 - protein, 22 aa, Entamoeba invadens
PGHTLMVMEFAPFGSVKSAYLK

SEQ ID NO: 2823849 - protein, 35 aa, Entamoeba invadens
PGHVHMIHLIFNTPYNTILFYPTFEGTTDAPILVE

SEQ ID NO: 2823850 - protein, 21 aa, Entamoeba invadens
PGKRLINYSLTRPISDTFANT

SEQ ID NO: 2823851 - protein, 21 aa, Entamoeba invadens
PGLYSILAQAKILSAALLSVI

SEQ ID NO: 2823852 - protein, 46 aa, Entamoeba invadens
PGNCRSKPIAWWVWLLVTLLVIIAFIILVGIVIGVVRLTRSIRLDQ

SEQ ID NO: 2823853 - protein, 23 aa, Entamoeba invadens
PGNFTFVEFLKSNSIYNLKKERK

SEQ ID NO: 2823854 - protein, 18 aa, Entamoeba invadens
PGRPSFFSLLVDEEEDDG

SEQ ID NO: 2823855 - protein, 24 aa, Entamoeba invadens
PGSKCNPILRRNYMYKTQTTGNTD

SEQ ID NO: 2823856 - protein, 27 aa, Entamoeba invadens
PGSKCNPILRRSYMYKTQTTDKTEIEC

SEQ ID NO: 2823857 - protein, 33 aa, Entamoeba invadens
PGTCVPVVVSCWFLNLFRTKKTKLIYFESVCRV

SEQ ID NO: 2823858 - protein, 17 aa, Entamoeba invadens
PGTFFLVFMSISSVGEQ

SEQ ID NO: 2823859 - protein, 27 aa, Entamoeba invadens
PGTFNQFLAYTFCFPCPDGKYSIAQSQ

SEQ ID NO: 2823860 - protein, 20 aa, Entamoeba invadens
PGVFFKYELSPYIVINEMMD

SEQ ID NO: 2823861 - protein, 24 aa, Entamoeba invadens
PGVGMLNWIIALPASCGSIAFFVL

SEQ ID NO: 2823862 - protein, 23 aa, Entamoeba invadens
PGVRSTHIPLINTVVSMTAPTKD

SEQ ID NO: 2823863 - protein, 17 aa, Entamoeba invadens
PGVYIVFLLIAVIVVVA

SEQ ID NO: 2823864 - protein, 43 aa, Entamoeba invadens
PGWAIAIIVVFAVCTVIVLVLLILFVIYAKLVLLKNRKNNKVF

SEQ ID NO: 2823865 - protein, 17 aa, Entamoeba invadens
PGYAISVKFTIKMLCTA

SEQ ID NO: 2823866 - protein, 25 aa, Entamoeba invadens
PHGEVYLIHGLISRGGFSCVYTAHM

SEQ ID NO: 2823867 - protein, 26 aa, Entamoeba invadens
PHISWKHQLMLWYAGLRGAIAILLSL

SEQ ID NO: 2823868 - protein, 17 aa, Entamoeba invadens
PHPALFTLYFATLNVKI

SEQ ID NO: 2823869 - protein, 29 aa, Entamoeba invadens
PIAGSIPMGFKFLLNKRLLRYGSSTTVFC

SEQ ID NO: 2823870 - protein, 18 aa, Entamoeba invadens
PIALLILLYVVQSPVLLV

SEQ ID NO: 2823871 - protein, 19 aa, Entamoeba invadens
PIAMILPMNGGGYGDLESN

SEQ ID NO: 2823872 - protein, 18 aa, Entamoeba invadens
PICEICEKGYYTLNGKCQ

SEQ ID NO: 2823873 - protein, 20 aa, Entamoeba invadens
PICFPTYRMKYIAFDIEFVE

SEQ ID NO: 2823874 - protein, 19 aa, Entamoeba invadens
PICVLCSQTLRQCQTCSTG

SEQ ID NO: 2823875 - protein, 22 aa, Entamoeba invadens
PIDILVIFLIILYGVGKRYELT

SEQ ID NO: 2823876 - protein, 17 aa, Entamoeba invadens
PIDIQVYIISKITFMKG

SEQ ID NO: 2823877 - protein, 25 aa, Entamoeba invadens
PIEAIPEFYYLPQFTMNFNTIDFGK

SEQ ID NO: 2823878 - protein, 19 aa, Entamoeba invadens
PIFIAFLMVLVLGGYIALA

SEQ ID NO: 2823879 - protein, 18 aa, Entamoeba invadens
PIFIHFDQTLLGLSTVRT

SEQ ID NO: 2823880 - protein, 20 aa, Entamoeba invadens
PIFVLYTLYMILTNEINDIY

SEQ ID NO: 2823881 - protein, 17 aa, Entamoeba invadens
PIFVTNYSDTPLNFVTI

SEQ ID NO: 2823882 - protein, 20 aa, Entamoeba invadens
PIGFYRGFGVGFFKVVPLIS

SEQ ID NO: 2823883 - protein, 21 aa, Entamoeba invadens
PIGIITLVADKWLNALHKESK

SEQ ID NO: 2823884 - protein, 25 aa, Entamoeba invadens
PIGQLLRITISFLVSLLEACTVDDI

SEQ ID NO: 2823885 - protein, 20 aa, Entamoeba invadens
PIGVIIVCALALIITYAIGG

SEQ ID NO: 2823886 - protein, 48 aa, Entamoeba invadens
PIIKDDVPTWVIVILIIIGIFIVIVVILFIVFVVIARKILLRRRNLKV

SEQ ID NO: 2823887 - protein, 18 aa, Entamoeba invadens
PIILTSFVLFFYMGWEAE

SEQ ID NO: 2823888 - protein, 20 aa, Entamoeba invadens
PIISCLPPLFRFLQCFRSAR

SEQ ID NO: 2823889 - protein, 26 aa, Entamoeba invadens
PIISMLSSIILFWLNKRDLYKHIHNW

SEQ ID NO: 2823890 - protein, 28 aa, Entamoeba invadens
PIISNHLKFVTFLFDSTKKIKTIHNYVF

SEQ ID NO: 2823891 - protein, 18 aa, Entamoeba invadens
PIKVLSYESLYLPDNFPF

SEQ ID NO: 2823892 - protein, 17 aa, Entamoeba invadens
PILKPTRVLFCVANYKN

SEQ ID NO: 2823893 - protein, 17 aa, Entamoeba invadens
PILMDKRILFNEEGELP

SEQ ID NO: 2823894 - protein, 26 aa, Entamoeba invadens
PINANLKVYVQDSYLATTFGTLAVLK

SEQ ID NO: 2823895 - protein, 22 aa, Entamoeba invadens
PINCDYLKPEVLLLIIHRLKDG

SEQ ID NO: 2823896 - protein, 22 aa, Entamoeba invadens
PINLKRLFQVKGQRRPYVKQVE

SEQ ID NO: 2823897 - protein, 25 aa, Entamoeba invadens
PINNKLKVFVTDSYTAGTFGGLSTL

SEQ ID NO: 2823898 - protein, 23 aa, Entamoeba invadens
PINRKRLFYLAPLSFIVSVDCFL

SEQ ID NO: 2823899 - protein, 21 aa, Entamoeba invadens
PIPALLINLPFFYYCFCCYLF

SEQ ID NO: 2823900 - protein, 24 aa, Entamoeba invadens
PIPWNKWLIFIFSVSRVVFYIPVF

SEQ ID NO: 2823901 - protein, 17 aa, Entamoeba invadens
PIQALIWTIFKSVLMAI

SEQ ID NO: 2823902 - protein, 19 aa, Entamoeba invadens
PIQGICVPCDYGCTTCSST

SEQ ID NO: 2823903 - protein, 24 aa, Entamoeba invadens
PISCLKCTLVPAIFRNVDFYNHER

SEQ ID NO: 2823904 - protein, 28 aa, Entamoeba invadens
PISYVLGLFLQFLMIITDRIIYLCKSIT

SEQ ID NO: 2823905 - protein, 35 aa, Entamoeba invadens
PITKGIALYSYGNAMWWVYKHKNELFLFVNGTEAS

SEQ ID NO: 2823906 - protein, 19 aa, Entamoeba invadens
PITKLMSVVYYTSCKTRPI

SEQ ID NO: 2823907 - protein, 20 aa, Entamoeba invadens
PIVAILGIMISIPVGLLLII

SEQ ID NO: 2823908 - protein, 27 aa, Entamoeba invadens
PIVANSIFNYFYHIKTIKIGSLHVADF

SEQ ID NO: 2823909 - protein, 22 aa, Entamoeba invadens
PIVVHAVMSIVYYDGMCQLTID

SEQ ID NO: 2823910 - protein, 21 aa, Entamoeba invadens
PIWFVLLGLGAGIFLLAGGWA

SEQ ID NO: 2823911 - protein, 19 aa, Entamoeba invadens
PIYMAPEILLKEKYKKSAD

SEQ ID NO: 2823912 - protein, 26 aa, Entamoeba invadens
PKCDTSVPLQMRIKLLLDAAKGILYL

SEQ ID NO: 2823913 - protein, 24 aa, Entamoeba invadens
PKDYLKELYFALPQSFFSTYSKVS

SEQ ID NO: 2823914 - protein, 32 aa, Entamoeba invadens
PKEAFLTLGLFNIMRLPLIRFPKLLNDTMQGV

SEQ ID NO: 2823915 - protein, 24 aa, Entamoeba invadens
PKEDKWKNVFTFKNNAKELFELGE

SEQ ID NO: 2823916 - protein, 25 aa, Entamoeba invadens
PKELTIPLKVIRIVDIVAVSITVFI

SEQ ID NO: 2823917 - protein, 35 aa, Entamoeba invadens
PKERPDIAMQLFYICFTFLVFHNNNLLFKIINPHF

SEQ ID NO: 2823918 - protein, 23 aa, Entamoeba invadens
PKESVILTITFIARCTTVLNERV

SEQ ID NO: 2823919 - protein, 17 aa, Entamoeba invadens
PKFACEFSLFLNPLCTS

SEQ ID NO: 2823920 - protein, 17 aa, Entamoeba invadens
PKFKSISVKMYLSILSP

SEQ ID NO: 2823921 - protein, 22 aa, Entamoeba invadens
PKFKYHSFFDTPVSFYHLQCVS

SEQ ID NO: 2823922 - protein, 18 aa, Entamoeba invadens
PKGLLGTIGWKVGDQVTY

SEQ ID NO: 2823923 - protein, 34 aa, Entamoeba invadens
PKKFVDTLLDYLKRKIPFLVKLGGHWSVVIGYDD

SEQ ID NO: 2823924 - protein, 24 aa, Entamoeba invadens
PKKNKKLNLLKKVPKRRVGEENLL

SEQ ID NO: 2823925 - protein, 24 aa, Entamoeba invadens
PKKSKFFSIYLSYDVPDNSENDKM

SEQ ID NO: 2823926 - protein, 38 aa, Entamoeba invadens
PKLNYDVRVRYWLGGLLSILCLLTMGWMFYSEVQDYYT

SEQ ID NO: 2823927 - protein, 33 aa, Entamoeba invadens
PKLPGMWVYTWTVTILMWASCWRKRNELTQTIK

SEQ ID NO: 2823928 - protein, 23 aa, Entamoeba invadens
PKNGEFPITLKWKSIDVINIDTT

SEQ ID NO: 2823929 - protein, 39 aa, Entamoeba invadens
PKPFTQRIFSLFPTNIPFQMVVALVYIFMVSPRHTRAVF

SEQ ID NO: 2823930 - protein, 26 aa, Entamoeba invadens
PKPKLLRVMFRLNAKPMLIAIIPRIL

SEQ ID NO: 2823931 - protein, 26 aa, Entamoeba invadens
PKRAMQLMLILFFIGMAFFVMTGMRV

SEQ ID NO: 2823932 - protein, 37 aa, Entamoeba invadens
PKSLLGKIYCIFYIIMFFVIFPVYVTKLTSSLFSWKK

SEQ ID NO: 2823933 - protein, 24 aa, Entamoeba invadens
PKSPSLLRTLFRVEWKHLLLCYGC

SEQ ID NO: 2823934 - protein, 27 aa, Entamoeba invadens
PKSSPTYVLYLYLYERYYPICRTQKVN

SEQ ID NO: 2823935 - protein, 25 aa, Entamoeba invadens
PKSTPTVTTFYLFLSLSSQGENVEV

SEQ ID NO: 2823936 - protein, 22 aa, Entamoeba invadens
PKSTVLLYVYFSINGLDTVDME

SEQ ID NO: 2823937 - protein, 36 aa, Entamoeba invadens
PKTFPIIHIPFIIGFLLLSIVLFYYSYTKLFFVTLG

SEQ ID NO: 2823938 - protein, 21 aa, Entamoeba invadens
PKTITLLGTQIFDSCLKLTSV

SEQ ID NO: 2823939 - protein, 26 aa, Entamoeba invadens
PKTYLFSNVIAMTFKFSKNAKIHILS

SEQ ID NO: 2823940 - protein, 27 aa, Entamoeba invadens
PKVIKHWMFWYVFSMVIFVFSVGGLVY

SEQ ID NO: 2823941 - protein, 20 aa, Entamoeba invadens
PKVRGYILLVLDALGKWSML

SEQ ID NO: 2823942 - protein, 29 aa, Entamoeba invadens
PKVVDIKIFSLTKTFLLISETKLTYAGVQ

SEQ ID NO: 2823943 - protein, 20 aa, Entamoeba invadens
PKYTFYFDPQVMILSPRANK

SEQ ID NO: 2823944 - protein, 17 aa, Entamoeba invadens
PLASLRKFMKVNAMTDL

SEQ ID NO: 2823945 - protein, 25 aa, Entamoeba invadens
PLAVYPIILFFAMLSWLTLVVNIST

SEQ ID NO: 2823946 - protein, 25 aa, Entamoeba invadens
PLCLPCSFVFWFFGKVLDHPKRIKP

SEQ ID NO: 2823947 - protein, 20 aa, Entamoeba invadens
PLCSLAAPLMRIFTTDINFK

SEQ ID NO: 2823948 - protein, 35 aa, Entamoeba invadens
PLDYFRVFYNSESILTYVNLPWTKTNRFTQVLFIC

SEQ ID NO: 2823949 - protein, 19 aa, Entamoeba invadens
PLFAEDPVLFCYNKDACDA

SEQ ID NO: 2823950 - protein, 17 aa, Entamoeba invadens
PLFCILGASFGLSTAMV

SEQ ID NO: 2823951 - protein, 17 aa, Entamoeba invadens
PLFITKPSQMQLSVDVS

SEQ ID NO: 2823952 - protein, 18 aa, Entamoeba invadens
PLFITKPSQMQLSVDVSD

SEQ ID NO: 2823953 - protein, 27 aa, Entamoeba invadens
PLFLLTLFLLIFYWAGMFFIVTFWIFF

SEQ ID NO: 2823954 - protein, 35 aa, Entamoeba invadens
PLFMYTRFLVTKIVIPVFLFITFVLVMTGFFLTSF

SEQ ID NO: 2823955 - protein, 19 aa, Entamoeba invadens
PLFSFYDILVSVLLYIFYQ

SEQ ID NO: 2823956 - protein, 22 aa, Entamoeba invadens
PLFSHLKLIISCSLVSSVPALI

SEQ ID NO: 2823957 - protein, 19 aa, Entamoeba invadens
PLFTSNGASLFLALDAIDS

SEQ ID NO: 2823958 - protein, 27 aa, Entamoeba invadens
PLFYCVVMVFLIIVFWKSYPPSVIGLM

SEQ ID NO: 2823959 - protein, 29 aa, Entamoeba invadens
PLFYIIGLLVCMLIWSRYARPLTVKPKKA

SEQ ID NO: 2823960 - protein, 19 aa, Entamoeba invadens
PLFYSQIPSIQKANKRLLT

SEQ ID NO: 2823961 - protein, 20 aa, Entamoeba invadens
PLGFLPMLIVQWTEAKVGIE

SEQ ID NO: 2823962 - protein, 17 aa, Entamoeba invadens
PLGFRTHRCLVGDNKGL

SEQ ID NO: 2823963 - protein, 17 aa, Entamoeba invadens
PLGRLLNHFSRDLRFID

SEQ ID NO: 2823964 - protein, 25 aa, Entamoeba invadens
PLHRYAFWYLYDTLSYPLLSIFVLS

SEQ ID NO: 2823965 - protein, 25 aa, Entamoeba invadens
PLISGCRNTLLFAKGTDSYVCPAPY

SEQ ID NO: 2823966 - protein, 30 aa, Entamoeba invadens
PLITNCPFLWYLLNFLLIIATPLCVVKNLI

SEQ ID NO: 2823967 - protein, 19 aa, Entamoeba invadens
PLIVSFIQPIFGLLSDIFP

SEQ ID NO: 2823968 - protein, 18 aa, Entamoeba invadens
PLKFLYQQFTMVTNLYFL

SEQ ID NO: 2823969 - protein, 31 aa, Entamoeba invadens
PLKHTPSLMKGYFFHAVINGKNFFYPAQYYF

SEQ ID NO: 2823970 - protein, 19 aa, Entamoeba invadens
PLKLYKKLYDGESFNFNLL

SEQ ID NO: 2823971 - protein, 26 aa, Entamoeba invadens
PLLAFLTMTLLYPDYSKPLSPLMNLF

SEQ ID NO: 2823972 - protein, 18 aa, Entamoeba invadens
PLLKRTFLVITTFLITVV

SEQ ID NO: 2823973 - protein, 17 aa, Entamoeba invadens
PLLLTQLRYELLDERKS

SEQ ID NO: 2823974 - protein, 36 aa, Entamoeba invadens
PLLSTIKLYYYKIFAFFYWIVGKIPSLVFVNGSWTQ

SEQ ID NO: 2823975 - protein, 23 aa, Entamoeba invadens
PLMILSMILSVTMPWLVFEVLRP

SEQ ID NO: 2823976 - protein, 19 aa, Entamoeba invadens
PLNLKLSLSIKLLMTLEAV

SEQ ID NO: 2823977 - protein, 18 aa, Entamoeba invadens
PLPEIPYQVPDYYVVKAK

SEQ ID NO: 2823978 - protein, 18 aa, Entamoeba invadens
PLPIYFFSVGMSNLAYFV

SEQ ID NO: 2823979 - protein, 18 aa, Entamoeba invadens
PLQNLGDFLLSNKQIITF

SEQ ID NO: 2823980 - protein, 22 aa, Entamoeba invadens
PLRTKWYITAFTSVGLFLAFSI

SEQ ID NO: 2823981 - protein, 26 aa, Entamoeba invadens
PLSQETYFFFISIDDLTSFSFSFKID

SEQ ID NO: 2823982 - protein, 33 aa, Entamoeba invadens
PLSQRTFKFFYFPRFVLIILLESFVVNLYLYNA

SEQ ID NO: 2823983 - protein, 26 aa, Entamoeba invadens
PLSTYFDYFFLLIQDITIIILIVFYA

SEQ ID NO: 2823984 - protein, 21 aa, Entamoeba invadens
PLSVYFPMQNEGFFGYPACIG

SEQ ID NO: 2823985 - protein, 24 aa, Entamoeba invadens
PLTKIYTCNKCVPGFIFNTTSKMC

SEQ ID NO: 2823986 - protein, 17 aa, Entamoeba invadens
PLTLLQKGARLITSKNL

SEQ ID NO: 2823987 - protein, 40 aa, Entamoeba invadens
PLTRFIQAIPMALLLFAMYAWVTFVLTFFTGEELFSSENT

SEQ ID NO: 2823988 - protein, 26 aa, Entamoeba invadens
PLTRMFSFLMFPFTMAHLITVITCYY

SEQ ID NO: 2823989 - protein, 24 aa, Entamoeba invadens
PLVDCPFTPINFNLNLDVPDTSTS

SEQ ID NO: 2823990 - protein, 19 aa, Entamoeba invadens
PLVLIEQFRKLANVYFLII

SEQ ID NO: 2823991 - protein, 17 aa, Entamoeba invadens
PLVNLKRGFACEFEIYI

SEQ ID NO: 2823992 - protein, 18 aa, Entamoeba invadens
PLVTLKPGYACEFEIFIK

SEQ ID NO: 2823993 - protein, 27 aa, Entamoeba invadens
PLVVHNIIVLLYHKLSHRLDFFQEQTV

SEQ ID NO: 2823994 - protein, 17 aa, Entamoeba invadens
PLVYVALSEKMTAETKT

SEQ ID NO: 2823995 - protein, 21 aa, Entamoeba invadens
PLVYYNYIMSGSIFAFLAILV

SEQ ID NO: 2823996 - protein, 33 aa, Entamoeba invadens
PMHFVAFLMIVDSYMYLFPKQFGFNTKLIEFLY

SEQ ID NO: 2823997 - protein, 23 aa, Entamoeba invadens
PMKTDKWELFFGLKKGKAIVDKV

SEQ ID NO: 2823998 - protein, 17 aa, Entamoeba invadens
PMLIVQWTEAKVGIERM

SEQ ID NO: 2823999 - protein, 21 aa, Entamoeba invadens
PMLNHLKMCVENTEGILKILN

SEQ ID NO: 2824000 - protein, 36 aa, Entamoeba invadens
PMMISVFAIATYWFFYVYIWYMTYAQQLLRLDIIYR

SEQ ID NO: 2824001 - protein, 23 aa, Entamoeba invadens
PMQNLGDFLLSNKQIITFGVLNE

SEQ ID NO: 2824002 - protein, 20 aa, Entamoeba invadens
PMRYTLKPGYAISVKFTIKM

SEQ ID NO: 2824003 - protein, 21 aa, Entamoeba invadens
PMRYTLKPGYAISVKFTIKML

SEQ ID NO: 2824004 - protein, 18 aa, Entamoeba invadens
PMTAPHLLMLPTANVLTQ

SEQ ID NO: 2824005 - protein, 17 aa, Entamoeba invadens
PMVTIARMKGVHLKILG

SEQ ID NO: 2824006 - protein, 17 aa, Entamoeba invadens
PMYPQYALLIQPSLFVL

SEQ ID NO: 2824007 - protein, 25 aa, Entamoeba invadens
PNADKVLLFLPGYNYTELSTMAQSY

SEQ ID NO: 2824008 - protein, 17 aa, Entamoeba invadens
PNCKLCRNIINFGIRCE

SEQ ID NO: 2824009 - protein, 23 aa, Entamoeba invadens
PNDMYNFFGIDFHPSFSVEGFII

SEQ ID NO: 2824010 - protein, 24 aa, Entamoeba invadens
PNEFLKLLCVVFYVLKKDTKNSFL

SEQ ID NO: 2824011 - protein, 21 aa, Entamoeba invadens
PNEIYNLPNPLLRIAEMCIKL

SEQ ID NO: 2824012 - protein, 51 aa, Entamoeba invadens
PNETGTFCRNKAVWWVILLLVLFTILLLIISIILLCFITRVILRKMSQKSL

SEQ ID NO: 2824013 - protein, 20 aa, Entamoeba invadens
PNFCGVLDPTKFIDFFKFKT

SEQ ID NO: 2824014 - protein, 39 aa, Entamoeba invadens
PNFIQVTQPNQFLTWAFMILLLSLASFYAFKLARSTKKV

SEQ ID NO: 2824015 - protein, 17 aa, Entamoeba invadens
PNFPFYYRTLGLVNQVL

SEQ ID NO: 2824016 - protein, 20 aa, Entamoeba invadens
PNGCSSCNFLLSCKTCFSGF

SEQ ID NO: 2824017 - protein, 25 aa, Entamoeba invadens
PNGKKLFLEFLGLDEVYVLIKNIVT

SEQ ID NO: 2824018 - protein, 25 aa, Entamoeba invadens
PNGNGCLWLFMCKDGYYTVNGNECQ

SEQ ID NO: 2824019 - protein, 17 aa, Entamoeba invadens
PNGYYLNKNSCEKCAND

SEQ ID NO: 2824020 - protein, 17 aa, Entamoeba invadens
PNGYYLNKNSCEKCVND

SEQ ID NO: 2824021 - protein, 18 aa, Entamoeba invadens
PNHICMVTEFALYGSLQD

SEQ ID NO: 2824022 - protein, 24 aa, Entamoeba invadens
PNIIRLMCMRYFAPNYYMILQEIY

SEQ ID NO: 2824023 - protein, 24 aa, Entamoeba invadens
PNKCLLCAQNYFKKNKLCESCSTL

SEQ ID NO: 2824024 - protein, 28 aa, Entamoeba invadens
PNKDCSYYPFFSLLKIRTCGNVYTFYFK

SEQ ID NO: 2824025 - protein, 21 aa, Entamoeba invadens
PNKDYYIFVAPYNFDEEGFME

SEQ ID NO: 2824026 - protein, 21 aa, Entamoeba invadens
PNKFYVYLDLKVESALSTRLD

SEQ ID NO: 2824027 - protein, 21 aa, Entamoeba invadens
PNKLQYLMHFGPFFCDGISPT

SEQ ID NO: 2824028 - protein, 29 aa, Entamoeba invadens
PNLLKDNPIVVISFFSIAISYTFANKEGL

SEQ ID NO: 2824029 - protein, 18 aa, Entamoeba invadens
PNMSKYAKLCFYCECSVV

SEQ ID NO: 2824030 - protein, 23 aa, Entamoeba invadens
PNNPKFVFHFEPQVLFLRPSVTK

SEQ ID NO: 2824031 - protein, 24 aa, Entamoeba invadens
PNNPKYVFHFEPQVLYAAPRLGTR

SEQ ID NO: 2824032 - protein, 23 aa, Entamoeba invadens
PNNPKYVFHFEPQVVFLSPMGKD

SEQ ID NO: 2824033 - protein, 51 aa, Entamoeba invadens
PNNRFCTRKSLWWISLIVIPVFLIFVVVLYIVITFLFRRFIKIQQDNTLDL

SEQ ID NO: 2824034 - protein, 24 aa, Entamoeba invadens
PNNTQLLLNGKLLRYGSSKKIFCH

SEQ ID NO: 2824035 - protein, 17 aa, Entamoeba invadens
PNPFQLVLPLDVSLPQP

SEQ ID NO: 2824036 - protein, 24 aa, Entamoeba invadens
PNPMNLLWAIIPFAVVYALRVIFV

SEQ ID NO: 2824037 - protein, 22 aa, Entamoeba invadens
PNQPIEPFTLTSPPWNCFNPEI

SEQ ID NO: 2824038 - protein, 19 aa, Entamoeba invadens
PNRECEFKIFIQPLCTCKV

SEQ ID NO: 2824039 - protein, 29 aa, Entamoeba invadens
PNSDYARALVPFFFRAFSTPGSRGSDSLE

SEQ ID NO: 2824040 - protein, 31 aa, Entamoeba invadens
PNSILKFFNVLFFRQPLSQMIIGRRRNLRLK

SEQ ID NO: 2824041 - protein, 34 aa, Entamoeba invadens
PNSILPKMIFTFSSKRWYFLFVGIHEESNVEVVL

SEQ ID NO: 2824042 - protein, 23 aa, Entamoeba invadens
PNSNLIVTGIFYSLGNSSYNNLR

SEQ ID NO: 2824043 - protein, 23 aa, Entamoeba invadens
PNSPKYIFHFEPQVVILSARTTK

SEQ ID NO: 2824044 - protein, 33 aa, Entamoeba invadens
PNTEQKWIFPTAIRFVFLFFVASIFLNNTPIVA

SEQ ID NO: 2824045 - protein, 21 aa, Entamoeba invadens
PNTFHVLTISPFIFSSKTTDV

SEQ ID NO: 2824046 - protein, 22 aa, Entamoeba invadens
PNVMRLFIQRYIKPSNYELVQI

SEQ ID NO: 2824047 - protein, 36 aa, Entamoeba invadens
PNYGMVWVWTIITSFLCWLSYWRCDWKDDVTQWCKD

SEQ ID NO: 2824048 - protein, 21 aa, Entamoeba invadens
PPAEWAGFDWGVVESILLGSV

SEQ ID NO: 2824049 - protein, 32 aa, Entamoeba invadens
PPECLQRLSYGLPMDVFAFGVVMYETFVEHGA

SEQ ID NO: 2824050 - protein, 21 aa, Entamoeba invadens
PPFLAIFAKYFKPTKVKYQNL

SEQ ID NO: 2824051 - protein, 26 aa, Entamoeba invadens
PPFSAIMILWANLVVDIPPSICLGLD

SEQ ID NO: 2824052 - protein, 18 aa, Entamoeba invadens
PPKFACEFSLFLNPLCTS

SEQ ID NO: 2824053 - protein, 22 aa, Entamoeba invadens
PPLFLYGTHYSTPAYVVFFLVR

SEQ ID NO: 2824054 - protein, 26 aa, Entamoeba invadens
PPLISLKPHFACEFEIFLKPNFSTKI

SEQ ID NO: 2824055 - protein, 19 aa, Entamoeba invadens
PPLVTLKPGYACEFEIFIK

SEQ ID NO: 2824056 - protein, 26 aa, Entamoeba invadens
PPMNGYIRFYGFTKYTTYENYLTDLR

SEQ ID NO: 2824057 - protein, 19 aa, Entamoeba invadens
PPMPLPPQAPTYNPNTYQQ

SEQ ID NO: 2824058 - protein, 36 aa, Entamoeba invadens
PPPLREKFLSNLVAPILFFFATIATPIPLSIQNVPL

SEQ ID NO: 2824059 - protein, 18 aa, Entamoeba invadens
PPSNKITELILGNKIAVL

SEQ ID NO: 2824060 - protein, 18 aa, Entamoeba invadens
PPTFSVFFEFFGLFLTYI

SEQ ID NO: 2824061 - protein, 21 aa, Entamoeba invadens
PQAFPLLLPLLTSLSPTVLLG

SEQ ID NO: 2824062 - protein, 30 aa, Entamoeba invadens
PQDQEGCVFTCRPYNYLTKENQCCPTHCSE

SEQ ID NO: 2824063 - protein, 26 aa, Entamoeba invadens
PQELMKVMPMIPFNPAHISLLTSYVQ

SEQ ID NO: 2824064 - protein, 30 aa, Entamoeba invadens
PQFNVMWVFIVYILLLLLSLICHYKCVVTS

SEQ ID NO: 2824065 - protein, 19 aa, Entamoeba invadens
PQHKMLINYMQGKFTFGCD

SEQ ID NO: 2824066 - protein, 29 aa, Entamoeba invadens
PQHSFTTSMFPFQFTDGYAYLLSNNKLMR

SEQ ID NO: 2824067 - protein, 17 aa, Entamoeba invadens
PQIAMVMQYFVLGSLKD

SEQ ID NO: 2824068 - protein, 26 aa, Entamoeba invadens
PQIITIPPNYGCEFSLFLTPLCNSTM

SEQ ID NO: 2824069 - protein, 27 aa, Entamoeba invadens
PQIPTKKWLTVLITPFTTIYPTTPEAH

SEQ ID NO: 2824070 - protein, 17 aa, Entamoeba invadens
PQIVVLKKGFACEFKVN

SEQ ID NO: 2824071 - protein, 24 aa, Entamoeba invadens
PQKGTFYMEYLWNDPMEQNGVKPS

SEQ ID NO: 2824072 - protein, 25 aa, Entamoeba invadens
PQKIQFVTFKRKRKYILKFSPKVVV

SEQ ID NO: 2824073 - protein, 21 aa, Entamoeba invadens
PQLHLQLSILLKRVVVMRYND

SEQ ID NO: 2824074 - protein, 25 aa, Entamoeba invadens
PQLNKPRIMLWQSNRLHLYINDKKT

SEQ ID NO: 2824075 - protein, 24 aa, Entamoeba invadens
PQLNRPQIILWNSSYLHLNRNITN

SEQ ID NO: 2824076 - protein, 19 aa, Entamoeba invadens
PQLVHGVLIDLIITFFKGF

SEQ ID NO: 2824077 - protein, 19 aa, Entamoeba invadens
PQNLTADILYLYFAQVTAV

SEQ ID NO: 2824078 - protein, 26 aa, Entamoeba invadens
PQNVVWYIAIFFTLLSLLEVGIFPNY

SEQ ID NO: 2824079 - protein, 27 aa, Entamoeba invadens
PQRRKEVYTLLLNPLPQTIDPTKTVSV

SEQ ID NO: 2824080 - protein, 24 aa, Entamoeba invadens
PQTVECFGGFFPFENTCVSIQNYK

SEQ ID NO: 2824081 - protein, 33 aa, Entamoeba invadens
PQTYKCKESAVWWIILIIVIAGLSIEITTIVSV

SEQ ID NO: 2824082 - protein, 26 aa, Entamoeba invadens
PQYIVYPWLVFLVISLMTFINSFNLN

SEQ ID NO: 2824083 - protein, 19 aa, Entamoeba invadens
PRECPYRKLIKKCWQRKVD

SEQ ID NO: 2824084 - protein, 30 aa, Entamoeba invadens
PREGKDFLLFILIFVSLTTLVVSSLCIYVG

SEQ ID NO: 2824085 - protein, 18 aa, Entamoeba invadens
PRFFLMEYSLVFGRARIF

SEQ ID NO: 2824086 - protein, 19 aa, Entamoeba invadens
PRIDPIQENQFDVIEACWK

SEQ ID NO: 2824087 - protein, 17 aa, Entamoeba invadens
PRIYEGVHMVILIDLNC

SEQ ID NO: 2824088 - protein, 17 aa, Entamoeba invadens
PRKKNWLCIFPGCTQKP

SEQ ID NO: 2824089 - protein, 22 aa, Entamoeba invadens
PRKPTDFVVFTDGFCYSACSVF

SEQ ID NO: 2824090 - protein, 22 aa, Entamoeba invadens
PRKPTEIVLMSDAFCYSACSLL

SEQ ID NO: 2824091 - protein, 25 aa, Entamoeba invadens
PRLIDTDVLFLAKTNVRKINVEAFD

SEQ ID NO: 2824092 - protein, 46 aa, Entamoeba invadens
PRRLKERRTLWFLWAFWLFFYSAMCLIVFGVLKYFGKKDDFLGYHE

SEQ ID NO: 2824093 - protein, 21 aa, Entamoeba invadens
PRRWYTFAIFIILGIIPLIQL

SEQ ID NO: 2824094 - protein, 21 aa, Entamoeba invadens
PRSYVNVPLFVTKIIDLTSVT

SEQ ID NO: 2824095 - protein, 25 aa, Entamoeba invadens
PRTDPIIPGYMFGAAPNAAFFDKSN

SEQ ID NO: 2824096 - protein, 25 aa, Entamoeba invadens
PSALMKELLFTPLNYENGYLLYNSY

SEQ ID NO: 2824097 - protein, 29 aa, Entamoeba invadens
PSARFTYALTLMPFASLNRNPLTKAEFSQ

SEQ ID NO: 2824098 - protein, 47 aa, Entamoeba invadens
PSDDGTFCSKTAVWWVILLIVVVIIAILVLVTVLVFFVMVKVIKNKR

SEQ ID NO: 2824099 - protein, 17 aa, Entamoeba invadens
PSDIYSLAISFFEIIGW

SEQ ID NO: 2824100 - protein, 23 aa, Entamoeba invadens
PSDPNAYFPFSRSGGLIVRENVY

SEQ ID NO: 2824101 - protein, 18 aa, Entamoeba invadens
PSELVGCSIFLPVVSFRL

SEQ ID NO: 2824102 - protein, 26 aa, Entamoeba invadens
PSETPVFSFVYPFAINLSTFLNLEAS

SEQ ID NO: 2824103 - protein, 30 aa, Entamoeba invadens
PSETTTKHIPLINTLLPMSSTSLPTDTTLV

SEQ ID NO: 2824104 - protein, 18 aa, Entamoeba invadens
PSFFGRETFPDNIARVLG

SEQ ID NO: 2824105 - protein, 24 aa, Entamoeba invadens
PSFFQIFCRVAIPCFIWGVGTAFG

SEQ ID NO: 2824106 - protein, 30 aa, Entamoeba invadens
PSFGPLQYLLFTNFFLGGFIFMPYIFSHEK

SEQ ID NO: 2824107 - protein, 31 aa, Entamoeba invadens
PSFVLFAVGFFIPCVWFYLIYKYHNSPLKND

SEQ ID NO: 2824108 - protein, 24 aa, Entamoeba invadens
PSGYNLLMGGRLLRYGKGQKVYCH

SEQ ID NO: 2824109 - protein, 19 aa, Entamoeba invadens
PSHKYDLDITPKSATLKPS

SEQ ID NO: 2824110 - protein, 22 aa, Entamoeba invadens
PSILIPLLRKSVQSAALELFTL

SEQ ID NO: 2824111 - protein, 22 aa, Entamoeba invadens
PSIYIPIVDNSMFMDGLFKAIF

SEQ ID NO: 2824112 - protein, 22 aa, Entamoeba invadens
PSLFDTVVGFSLCYVNFLSSRF

SEQ ID NO: 2824113 - protein, 31 aa, Entamoeba invadens
PSNFPKFSCQWLELFSHRSLLYDLAKAPQNK

SEQ ID NO: 2824114 - protein, 25 aa, Entamoeba invadens
PSPAKFTLLRLLIERCGGMRRFVEK

SEQ ID NO: 2824115 - protein, 43 aa, Entamoeba invadens
PSPDGSKCLFYFEWIPVIVLLLTIIVVIIISVAISYFVIRKLV

SEQ ID NO: 2824116 - protein, 25 aa, Entamoeba invadens
PSPLNLLWAIIPFSLIYTSRKLLIE

SEQ ID NO: 2824117 - protein, 28 aa, Entamoeba invadens
PSQNVIQLLLLLFNEWYQYNPNKLQYLM

SEQ ID NO: 2824118 - protein, 17 aa, Entamoeba invadens
PSRNLQLLVNCSINLIS

SEQ ID NO: 2824119 - protein, 26 aa, Entamoeba invadens
PSRVPVTMEYFLPGLDLNCFADDNPS

SEQ ID NO: 2824120 - protein, 27 aa, Entamoeba invadens
PSSPQDMFKYLLDPRPDSPSRRICVQG

SEQ ID NO: 2824121 - protein, 30 aa, Entamoeba invadens
PSTAFPTLTLFQMLQRPLGFLPMLIVQWTE

SEQ ID NO: 2824122 - protein, 17 aa, Entamoeba invadens
PSVFLFKANTNFSFNSV

SEQ ID NO: 2824123 - protein, 18 aa, Entamoeba invadens
PSVLMWNATYLHLNYNYT

SEQ ID NO: 2824124 - protein, 29 aa, Entamoeba invadens
PSVLVNWALLMYIYYIHTMAAIKVRVPLS

SEQ ID NO: 2824125 - protein, 17 aa, Entamoeba invadens
PSYAIDVTFTIKPLCTA

SEQ ID NO: 2824126 - protein, 17 aa, Entamoeba invadens
PSYAIIISAMQLTSLTT

SEQ ID NO: 2824127 - protein, 25 aa, Entamoeba invadens
PTCKTGYYLDYNIETKIYSCKKCKG

SEQ ID NO: 2824128 - protein, 27 aa, Entamoeba invadens
PTDMFSLAHILLLLYFGEQTTEVFKVS

SEQ ID NO: 2824129 - protein, 23 aa, Entamoeba invadens
PTESRKYTLMAKGTPVDNAILVE

SEQ ID NO: 2824130 - protein, 18 aa, Entamoeba invadens
PTFDAYGLDLYPINISAI

SEQ ID NO: 2824131 - protein, 24 aa, Entamoeba invadens
PTFIKSMINERMYLVFKTKFNDTN

SEQ ID NO: 2824132 - protein, 24 aa, Entamoeba invadens
PTFIKSMINERMYLVFKTTFNDTN

SEQ ID NO: 2824133 - protein, 27 aa, Entamoeba invadens
PTFTNPQFFKLFDGKLVRFCPDTMNSN

SEQ ID NO: 2824134 - protein, 44 aa, Entamoeba invadens
PTGFVFLNKIPYWVFTLINVLLAFLIFFIQQIRHPWLIKTISRI

SEQ ID NO: 2824135 - protein, 26 aa, Entamoeba invadens
PTGRFTTLFPLCIVLTISMLKELYED

SEQ ID NO: 2824136 - protein, 21 aa, Entamoeba invadens
PTILLSIFQLLYKVGEWYVIA

SEQ ID NO: 2824137 - protein, 18 aa, Entamoeba invadens
PTITNDVTIYYLKGEAYS

SEQ ID NO: 2824138 - protein, 20 aa, Entamoeba invadens
PTIVLILLVTPLDLDLVWRV

SEQ ID NO: 2824139 - protein, 19 aa, Entamoeba invadens
PTKPYTYGAWIKLTSKKNQ

SEQ ID NO: 2824140 - protein, 36 aa, Entamoeba invadens
PTKTNPKRYLIFFLLVFIVILIAILFVVIASKNTNV

SEQ ID NO: 2824141 - protein, 19 aa, Entamoeba invadens
PTLCFPLMHDNVVTPFVNV

SEQ ID NO: 2824142 - protein, 19 aa, Entamoeba invadens
PTLINMFECFNPNAILSDI

SEQ ID NO: 2824143 - protein, 26 aa, Entamoeba invadens
PTLQELRAMNWLSFIGGAKGVFYYSY

SEQ ID NO: 2824144 - protein, 26 aa, Entamoeba invadens
PTLSNTRWFYHQLLVKFCFENFEKIE

SEQ ID NO: 2824145 - protein, 23 aa, Entamoeba invadens
PTNAYIHLQITQIIKYLTSSKSE

SEQ ID NO: 2824146 - protein, 26 aa, Entamoeba invadens
PTNFVIKYVIWWFGLGVLSSVGLGTG

SEQ ID NO: 2824147 - protein, 25 aa, Entamoeba invadens
PTNLLLIDCEMKNFWCSAHRVNLMG

SEQ ID NO: 2824148 - protein, 31 aa, Entamoeba invadens
PTNMFNFALDDPLIIRAFNDCTLKDLYVSFT

SEQ ID NO: 2824149 - protein, 25 aa, Entamoeba invadens
PTNPNTCLECYIGFFLEGTSCNTCS

SEQ ID NO: 2824150 - protein, 28 aa, Entamoeba invadens
PTNWNVYVILIHKKLLYSTFIGLHVDCF

SEQ ID NO: 2824151 - protein, 18 aa, Entamoeba invadens
PTPISFTTTLVFTIEEFG

SEQ ID NO: 2824152 - protein, 36 aa, Entamoeba invadens
PTPKYKIFNIFQEITLKYFFIQTRFNNSRITLEENN

SEQ ID NO: 2824153 - protein, 21 aa, Entamoeba invadens
PTQFPFFCAFSFLLIGGGKVV

SEQ ID NO: 2824154 - protein, 25 aa, Entamoeba invadens
PTQVPVTIEYYLPGLDLNCFTDNTQ

SEQ ID NO: 2824155 - protein, 19 aa, Entamoeba invadens
PTSPIINGILEDKYYQITV

SEQ ID NO: 2824156 - protein, 33 aa, Entamoeba invadens
PTSPITIVMTQGQMFPWVIAPAAKIIVSDGSAM

SEQ ID NO: 2824157 - protein, 18 aa, Entamoeba invadens
PTTKTFGKGALLCAFESK

SEQ ID NO: 2824158 - protein, 24 aa, Entamoeba invadens
PTTVPVSIEYYLPGQDLNCFDNEE

SEQ ID NO: 2824159 - protein, 23 aa, Entamoeba invadens
PTVLFVIVIVCAIIFAGLSTFLP

SEQ ID NO: 2824160 - protein, 24 aa, Entamoeba invadens
PTVVRATWFSIHNKTPTRLKLSLQ

SEQ ID NO: 2824161 - protein, 24 aa, Entamoeba invadens
PTYCDENYYFDFFNQKCVRDVCQA

SEQ ID NO: 2824162 - protein, 19 aa, Entamoeba invadens
PTYHLYISGSIRASPGKSS

SEQ ID NO: 2824163 - protein, 18 aa, Entamoeba invadens
PTYMAPEILKKQKYKKSA

SEQ ID NO: 2824164 - protein, 23 aa, Entamoeba invadens
PTYMAPEILKLEKYTMSSDIFSF

SEQ ID NO: 2824165 - protein, 17 aa, Entamoeba invadens
PTYPLFFFQMTPCVMIC

SEQ ID NO: 2824166 - protein, 20 aa, Entamoeba invadens
PTYVLVEMSCIYYLDIEHCT

SEQ ID NO: 2824167 - protein, 17 aa, Entamoeba invadens
PTYYFYISGSINKKLAN

SEQ ID NO: 2824168 - protein, 31 aa, Entamoeba invadens
PVAIHGNFPYIFFYLLIIGILHGVSAKEFPC

SEQ ID NO: 2824169 - protein, 36 aa, Entamoeba invadens
PVASLLFTIFLIYMGYSFYTMFFPPSAGYRSAYKPS

SEQ ID NO: 2824170 - protein, 25 aa, Entamoeba invadens
PVCTFFLGFSFIFGDYLRRMWESLV

SEQ ID NO: 2824171 - protein, 18 aa, Entamoeba invadens
PVDFSFLFSFDFADIELP

SEQ ID NO: 2824172 - protein, 26 aa, Entamoeba invadens
PVDLVYFIIPFTVISLLRIVLAQNLF

SEQ ID NO: 2824173 - protein, 20 aa, Entamoeba invadens
PVDVFAYAILTLEVMTRKVP

SEQ ID NO: 2824174 - protein, 19 aa, Entamoeba invadens
PVDVYSYGIVLYETYVERN

SEQ ID NO: 2824175 - protein, 22 aa, Entamoeba invadens
PVEWRVNFFDKFREVSLLHPES

SEQ ID NO: 2824176 - protein, 24 aa, Entamoeba invadens
PVFNPFTYLIRRIFRILPIQVFAT

SEQ ID NO: 2824177 - protein, 24 aa, Entamoeba invadens
PVFSSLTRILYYNGHLLIPNDTPF

SEQ ID NO: 2824178 - protein, 23 aa, Entamoeba invadens
PVHKWEIVLKMKRLLDLSGLFDE

SEQ ID NO: 2824179 - protein, 18 aa, Entamoeba invadens
PVIVFMYSNYIFTVKKLN

SEQ ID NO: 2824180 - protein, 18 aa, Entamoeba invadens
PVKGIYFTFTGENKDYVF

SEQ ID NO: 2824181 - protein, 26 aa, Entamoeba invadens
PVKTPTSFVFLIGNEKKRKLKFQFTT

SEQ ID NO: 2824182 - protein, 23 aa, Entamoeba invadens
PVLFPEFLIHIVLTFLFIPHMNW

SEQ ID NO: 2824183 - protein, 22 aa, Entamoeba invadens
PVLLTLVLSLLFSGISCGVIFA

SEQ ID NO: 2824184 - protein, 20 aa, Entamoeba invadens
PVNKILGVSAPLMEKAKEVS

SEQ ID NO: 2824185 - protein, 30 aa, Entamoeba invadens
PVNNQTIVCWLFSNIFITRVLYNLEIIREI

SEQ ID NO: 2824186 - protein, 24 aa, Entamoeba invadens
PVNRTILMYFNTEKGKFDCLPLPP

SEQ ID NO: 2824187 - protein, 47 aa, Entamoeba invadens
PVRMLAHIPLTYPLISLVTYILKLLPLFLFTLFIQTVSTTPKFLSQK

SEQ ID NO: 2824188 - protein, 27 aa, Entamoeba invadens
PVSDLFKLRVFYQAFVVFKIVGDKSKA

SEQ ID NO: 2824189 - protein, 44 aa, Entamoeba invadens
PVTNIVAIVLPIVFVVIFIVLIVVIFALIGFYIRNKKLENKRKE

SEQ ID NO: 2824190 - protein, 19 aa, Entamoeba invadens
PVTTLFGFCLLCLTILISL

SEQ ID NO: 2824191 - protein, 36 aa, Entamoeba invadens
PVVCVAVLVVIIISIVIIVFLFVLRKKDNKHAENVC

SEQ ID NO: 2824192 - protein, 19 aa, Entamoeba invadens
PVVIPFEQFGYFARPACIP

SEQ ID NO: 2824193 - protein, 20 aa, Entamoeba invadens
PVVLKLRVKFMLDAAKGILY

SEQ ID NO: 2824194 - protein, 18 aa, Entamoeba invadens
PVVLLKRDQACQFTVLVE

SEQ ID NO: 2824195 - protein, 23 aa, Entamoeba invadens
PVYMAFEILNKQHYKKPADVFSF

SEQ ID NO: 2824196 - protein, 17 aa, Entamoeba invadens
PVYMAPEILKQQKYKKS

SEQ ID NO: 2824197 - protein, 18 aa, Entamoeba invadens
PVYMAPEILNKEKYKKAA

SEQ ID NO: 2824198 - protein, 19 aa, Entamoeba invadens
PVYMAPEILNKEKYKKAAD

SEQ ID NO: 2824199 - protein, 19 aa, Entamoeba invadens
PVYMAPEVLKKEKYKKSAD

SEQ ID NO: 2824200 - protein, 18 aa, Entamoeba invadens
PWEWFTMSSWRCAGADST

SEQ ID NO: 2824201 - protein, 20 aa, Entamoeba invadens
PWIIGHFFDNELQWWGEREQ

SEQ ID NO: 2824202 - protein, 20 aa, Entamoeba invadens
PWNIADLISSGKRLAKPDFI

SEQ ID NO: 2824203 - protein, 29 aa, Entamoeba invadens
PWNYRSYFFLLFWSLMYLAYIMACSLAGI

SEQ ID NO: 2824204 - protein, 21 aa, Entamoeba invadens
PYAKLAVLLFTFFMPSKIVPP

SEQ ID NO: 2824205 - protein, 19 aa, Entamoeba invadens
PYCPNERLERWWFILTDMR

SEQ ID NO: 2824206 - protein, 19 aa, Entamoeba invadens
PYDYVMMKIRMLPTNYRGD

SEQ ID NO: 2824207 - protein, 17 aa, Entamoeba invadens
PYFNYRATKFLLANGLD

SEQ ID NO: 2824208 - protein, 31 aa, Entamoeba invadens
PYHEKRFKFAWDIVDFVVSGKRLEKPIYLNG

SEQ ID NO: 2824209 - protein, 18 aa, Entamoeba invadens
PYIFVIEQPPWNCMSPSL

SEQ ID NO: 2824210 - protein, 17 aa, Entamoeba invadens
PYIIEFFKRNSQHPEIS

SEQ ID NO: 2824211 - protein, 18 aa, Entamoeba invadens
PYIIVRVGFLFFIAAVAV

SEQ ID NO: 2824212 - protein, 18 aa, Entamoeba invadens
PYIKRYFLATADQVPSYL

SEQ ID NO: 2824213 - protein, 17 aa, Entamoeba invadens
PYILIDCDDEFVREDGD

SEQ ID NO: 2824214 - protein, 17 aa, Entamoeba invadens
PYLDRVMAFFYKNYNHQ

SEQ ID NO: 2824215 - protein, 23 aa, Entamoeba invadens
PYNENIPIYFPDKLELVCKEFNH

SEQ ID NO: 2824216 - protein, 24 aa, Entamoeba invadens
PYNKVDFKFPWKIAEFVISGKRLL

SEQ ID NO: 2824217 - protein, 18 aa, Entamoeba invadens
PYPKNEFPYPWNVATFVS

SEQ ID NO: 2824218 - protein, 24 aa, Entamoeba invadens
PYVGCFLGDILFTDDGLKSTTEED

SEQ ID NO: 2824219 - protein, 23 aa, Entamoeba invadens
PYVGLSIIRFFLGLGIGGEYPLS

SEQ ID NO: 2824220 - protein, 20 aa, Entamoeba invadens
PYYMFVHTKFASSKMGDLKL

SEQ ID NO: 2824221 - protein, 26 aa, Entamoeba invadens
QACEFKFTIIPKCTCAIKQDVSIVSQ

SEQ ID NO: 2824222 - protein, 21 aa, Entamoeba invadens
QAECIPCPPGTFNQFLAYTFC

SEQ ID NO: 2824223 - protein, 25 aa, Entamoeba invadens
QAFFWSIFFCMVLSYPFDFVLAVIT

SEQ ID NO: 2824224 - protein, 22 aa, Entamoeba invadens
QAGTYFNITLKSCQKCFTNCQL

SEQ ID NO: 2824225 - protein, 17 aa, Entamoeba invadens
QAIFFMLVTLSVPWTIF

SEQ ID NO: 2824226 - protein, 22 aa, Entamoeba invadens
QAISIASYYQREWPLLVICPSS

SEQ ID NO: 2824227 - protein, 24 aa, Entamoeba invadens
QAIVTISLIIRYLSLFLKSPAITQ

SEQ ID NO: 2824228 - protein, 23 aa, Entamoeba invadens
QAIYIVLHIIFFSNADVHMWQHF

SEQ ID NO: 2824229 - protein, 21 aa, Entamoeba invadens
QALIWTIFKSVLMAILPFFMV

SEQ ID NO: 2824230 - protein, 23 aa, Entamoeba invadens
QALRLYTRALLADPSNAALYSNR

SEQ ID NO: 2824231 - protein, 21 aa, Entamoeba invadens
QAVFGVFTLLFISSFVFMFVE

SEQ ID NO: 2824232 - protein, 40 aa, Entamoeba invadens
QAVLNVKIGFIWKVLFVNYVIPNLIIAYLVTRQSVLCNAT

SEQ ID NO: 2824233 - protein, 27 aa, Entamoeba invadens
QAVVIMFLCMFLFKETFLDIVSISFTA

SEQ ID NO: 2824234 - protein, 17 aa, Entamoeba invadens
QAWILFCFLFCVWNGAN

SEQ ID NO: 2824235 - protein, 21 aa, Entamoeba invadens
QCADGYKFNFVDNTCIIGVEK

SEQ ID NO: 2824236 - protein, 22 aa, Entamoeba invadens
QCAEGFYLIDSLNNEGKYNFCI

SEQ ID NO: 2824237 - protein, 18 aa, Entamoeba invadens
QCALITSLFIGDLWCDID

SEQ ID NO: 2824238 - protein, 17 aa, Entamoeba invadens
QCDLCDLKYYLKDGKCE

SEQ ID NO: 2824239 - protein, 19 aa, Entamoeba invadens
QCDTALDIKLPYTALHSFS

SEQ ID NO: 2824240 - protein, 33 aa, Entamoeba invadens
QCENSPVWWVILFIVITDIIFITSVSLLAAFVL

SEQ ID NO: 2824241 - protein, 17 aa, Entamoeba invadens
QCETCATGYYLNNNLCT

SEQ ID NO: 2824242 - protein, 17 aa, Entamoeba invadens
QCFAFVFRANRNVLVKP

SEQ ID NO: 2824243 - protein, 17 aa, Entamoeba invadens
QCILCQSGYVLKNKKCV

SEQ ID NO: 2824244 - protein, 23 aa, Entamoeba invadens
QCIMCDWWYVINASATGCEKQPK

SEQ ID NO: 2824245 - protein, 17 aa, Entamoeba invadens
QCISCNDGYYLNNGTCH

SEQ ID NO: 2824246 - protein, 25 aa, Entamoeba invadens
QCKDGNAILALPASDPTKYCTTCKE

SEQ ID NO: 2824247 - protein, 17 aa, Entamoeba invadens
QCKDGYYRVGLNCFECL

SEQ ID NO: 2824248 - protein, 17 aa, Entamoeba invadens
QCKFVILLKISQIPFRF

SEQ ID NO: 2824249 - protein, 29 aa, Entamoeba invadens
QCKPGYLLTADFLCKLPQSINSNVTSVLS

SEQ ID NO: 2824250 - protein, 22 aa, Entamoeba invadens
QCKSNYVYLEPLGLTCQECSSF

SEQ ID NO: 2824251 - protein, 18 aa, Entamoeba invadens
QCLFCSNGFYSNGPQCVQ

SEQ ID NO: 2824252 - protein, 22 aa, Entamoeba invadens
QCLIFVSHFKKFSLIYAMIDFL

SEQ ID NO: 2824253 - protein, 21 aa, Entamoeba invadens
QCMGRFLFVFGDEVPVTILYE

SEQ ID NO: 2824254 - protein, 17 aa, Entamoeba invadens
QCNNFYYPNTMGICIPC

SEQ ID NO: 2824255 - protein, 25 aa, Entamoeba invadens
QCQTCSIGLYPLHTSPYTCQQCHSS

SEQ ID NO: 2824256 - protein, 17 aa, Entamoeba invadens
QCRSGVGSLILFTPSHD

SEQ ID NO: 2824257 - protein, 18 aa, Entamoeba invadens
QCSACQTGYYLYNSGCYQ

SEQ ID NO: 2824258 - protein, 19 aa, Entamoeba invadens
QCSEGYYLDSTKNLCVKCN

SEQ ID NO: 2824259 - protein, 17 aa, Entamoeba invadens
QCSSCYDGLYLNSDFEC

SEQ ID NO: 2824260 - protein, 24 aa, Entamoeba invadens
QCTENSCLNIFILNTIIIALVMII

SEQ ID NO: 2824261 - protein, 17 aa, Entamoeba invadens
QCTKCENGYFLINGKCQ

SEQ ID NO: 2824262 - protein, 19 aa, Entamoeba invadens
QCTSCVIGIRYLENGYCKS

SEQ ID NO: 2824263 - protein, 23 aa, Entamoeba invadens
QCTTNYVLLNNFCFDYSVIPNCI

SEQ ID NO: 2824264 - protein, 20 aa, Entamoeba invadens
QCTYIALHSIIGPAYHMMIA

SEQ ID NO: 2824265 - protein, 20 aa, Entamoeba invadens
QCVFLVLSIIQWVCYTMCFV

SEQ ID NO: 2824266 - protein, 25 aa, Entamoeba invadens
QDAIKYLTQFLVKYPKVAGGYIARG

SEQ ID NO: 2824267 - protein, 21 aa, Entamoeba invadens
QDAVVFRFIAFRDYITKHIKE

SEQ ID NO: 2824268 - protein, 25 aa, Entamoeba invadens
QDENVMHALPYLGTFLSDTTFINEG

SEQ ID NO: 2824269 - protein, 19 aa, Entamoeba invadens
QDFPSIKYPCLTCQDGYLK

SEQ ID NO: 2824270 - protein, 19 aa, Entamoeba invadens
QDFPTPFPPYVFPSSQNEK

SEQ ID NO: 2824271 - protein, 18 aa, Entamoeba invadens
QDGYFIDATDHKCNSCKM

SEQ ID NO: 2824272 - protein, 18 aa, Entamoeba invadens
QDGYLFNETTETCSPCEE

SEQ ID NO: 2824273 - protein, 17 aa, Entamoeba invadens
QDGYYLENEKCKRVANC

SEQ ID NO: 2824274 - protein, 31 aa, Entamoeba invadens
QDKKENIAVMLFPIVWYAIDEKNYFERITPF

SEQ ID NO: 2824275 - protein, 23 aa, Entamoeba invadens
QDKKRLVLLLKKQGEVVAVTGDG

SEQ ID NO: 2824276 - protein, 23 aa, Entamoeba invadens
QDKTLIILIVAAIVSLILAFAIP

SEQ ID NO: 2824277 - protein, 24 aa, Entamoeba invadens
QDNFVIVSLNLLTGITTMTNFPFS

SEQ ID NO: 2824278 - protein, 17 aa, Entamoeba invadens
QDPYYFSNQTCLSCASG

SEQ ID NO: 2824279 - protein, 35 aa, Entamoeba invadens
QDSAPKILYLLATMPDLDIFPLVFQHLLGDPNSLW

SEQ ID NO: 2824280 - protein, 24 aa, Entamoeba invadens
QDVKSPIFLLIDKMPKTTKKIVGV

SEQ ID NO: 2824281 - protein, 24 aa, Entamoeba invadens
QDVTYIPIRAFTTSSTRLDYHELN

SEQ ID NO: 2824282 - protein, 21 aa, Entamoeba invadens
QEFGLPVDFIEKELERFISQG

SEQ ID NO: 2824283 - protein, 23 aa, Entamoeba invadens
QEGYSLYKEGIPLIFVLKCRRCD

SEQ ID NO: 2824284 - protein, 20 aa, Entamoeba invadens
QEILFDIIFVIFKENSQLVM

SEQ ID NO: 2824285 - protein, 25 aa, Entamoeba invadens
QEKEDYVKIPYKLKVRMLFDTSRGM

SEQ ID NO: 2824286 - protein, 19 aa, Entamoeba invadens
QEKNICVFKMKRSNISFPY

SEQ ID NO: 2824287 - protein, 25 aa, Entamoeba invadens
QELGLFIYNNLLSNSLHLPKTFAYC

SEQ ID NO: 2824288 - protein, 25 aa, Entamoeba invadens
QELVNLFVVILYLSLQEKGDTIFMY

SEQ ID NO: 2824289 - protein, 21 aa, Entamoeba invadens
QEMLNQLYFYPDTNYTVVFNF

SEQ ID NO: 2824290 - protein, 41 aa, Entamoeba invadens
QEMRSCVPLYRPITVILFFLITGLIFIPIGIAVFVVTNQCQ

SEQ ID NO: 2824291 - protein, 31 aa, Entamoeba invadens
QENDLFYIRFFAVVTIFFVLTIIGLVCVIFL

SEQ ID NO: 2824292 - protein, 25 aa, Entamoeba invadens
QEPRTFFYIMLGCLGLLILQQIVFK

SEQ ID NO: 2824293 - protein, 21 aa, Entamoeba invadens
QEQCSLCKYGYHLDGVNKKCY

SEQ ID NO: 2824294 - protein, 35 aa, Entamoeba invadens
QERNTNLFWVVFSIFVFVLLIIATTMCVYFSLKRI

SEQ ID NO: 2824295 - protein, 32 aa, Entamoeba invadens
QESKQKLFENMWIRVLSPLNLKAKLPIEFMEK

SEQ ID NO: 2824296 - protein, 17 aa, Entamoeba invadens
QEVLIMLLNNLKVLDRQ

SEQ ID NO: 2824297 - protein, 25 aa, Entamoeba invadens
QEVYILFENYIPDELYPVSSTEAYK

SEQ ID NO: 2824298 - protein, 17 aa, Entamoeba invadens
QFAVLIFIPDYLPREFI

SEQ ID NO: 2824299 - protein, 18 aa, Entamoeba invadens
QFCVKCDKSFYFNLNRQE

SEQ ID NO: 2824300 - protein, 31 aa, Entamoeba invadens
QFDDQNTFFFFYLLLIISEFSRLVIKNKKFR

SEQ ID NO: 2824301 - protein, 24 aa, Entamoeba invadens
QFDEYLQFIVPVTDIPKGTFLKVH

SEQ ID NO: 2824302 - protein, 24 aa, Entamoeba invadens
QFFTPFLVHILSPKFSLYFAGVCY

SEQ ID NO: 2824303 - protein, 19 aa, Entamoeba invadens
QFKDGLFFYLQTNSKEKVD

SEQ ID NO: 2824304 - protein, 24 aa, Entamoeba invadens
QFKSIWAYFFGYWKDPNTENFNTR

SEQ ID NO: 2824305 - protein, 17 aa, Entamoeba invadens
QFLKYTKVFTKESYYKR

SEQ ID NO: 2824306 - protein, 19 aa, Entamoeba invadens
QFLLIEKCWCHNHKSRPNA

SEQ ID NO: 2824307 - protein, 39 aa, Entamoeba invadens
QFMCGLIHANYYFAKFFRSMLYWWRIGKIAEMIENYMNQ

SEQ ID NO: 2824308 - protein, 19 aa, Entamoeba invadens
QFNFPWKIAEYVMAGKRPK

SEQ ID NO: 2824309 - protein, 26 aa, Entamoeba invadens
QFNNGLLYLIKSLGYDFTIKQTKKAK

SEQ ID NO: 2824310 - protein, 24 aa, Entamoeba invadens
QFNSSSVLYLKKTAFLMIEHGIKF

SEQ ID NO: 2824311 - protein, 23 aa, Entamoeba invadens
QFQAFALIVIFPVVLALAALCEI

SEQ ID NO: 2824312 - protein, 26 aa, Entamoeba invadens
QFQCKKIFLKDWTSPPLKFSSESFVR

SEQ ID NO: 2824313 - protein, 25 aa, Entamoeba invadens
QFQERLHEWPSYCYLLKSKKNISTF

SEQ ID NO: 2824314 - protein, 26 aa, Entamoeba invadens
QFSGTQEIWGLWRIVQYYAVNPTRRL

SEQ ID NO: 2824315 - protein, 25 aa, Entamoeba invadens
QFSVMKGCDYYTIRTEPALVNLKSG

SEQ ID NO: 2824316 - protein, 19 aa, Entamoeba invadens
QFTMFFATRSELKSEFVRI

SEQ ID NO: 2824317 - protein, 18 aa, Entamoeba invadens
QFTRTLGIIMAKNLTIEK

SEQ ID NO: 2824318 - protein, 25 aa, Entamoeba invadens
QFVDDFLHEFFFLNFPESSHLAKVM

SEQ ID NO: 2824319 - protein, 22 aa, Entamoeba invadens
QFVDLIQPHELLLPYLEKLFED

SEQ ID NO: 2824320 - protein, 19 aa, Entamoeba invadens
QFVIVQFLGILFGGVEFNP

SEQ ID NO: 2824321 - protein, 29 aa, Entamoeba invadens
QFVLSTVFFQLLICSILAALSTWRYTVVN

SEQ ID NO: 2824322 - protein, 20 aa, Entamoeba invadens
QFVTPLVIYFLTPKYSLFFA

SEQ ID NO: 2824323 - protein, 24 aa, Entamoeba invadens
QGASTFLLTFDKKEQYIFVYGDGE

SEQ ID NO: 2824324 - protein, 20 aa, Entamoeba invadens
QGELLLRGPSLFKEYFKRPE

SEQ ID NO: 2824325 - protein, 21 aa, Entamoeba invadens
QGFIAVIFFVTCMSVLFHCTT

SEQ ID NO: 2824326 - protein, 18 aa, Entamoeba invadens
QGFYIDYNNRCQKCSTGC

SEQ ID NO: 2824327 - protein, 23 aa, Entamoeba invadens
QGIKIRLLDFRSLLRQDSGWYDF

SEQ ID NO: 2824328 - protein, 18 aa, Entamoeba invadens
QGIWQSLVIVFEYHFIIG

SEQ ID NO: 2824329 - protein, 22 aa, Entamoeba invadens
QGKDNLFLRVGFDEKRLYHYKN

SEQ ID NO: 2824330 - protein, 20 aa, Entamoeba invadens
QGVYYLCSYGTIVDNNFTCL

SEQ ID NO: 2824331 - protein, 22 aa, Entamoeba invadens
QHAMISWALNMISIFSLQVLPL

SEQ ID NO: 2824332 - protein, 24 aa, Entamoeba invadens
QHCDIYYVYSFPDVTYFTENDIKR

SEQ ID NO: 2824333 - protein, 31 aa, Entamoeba invadens
QHDRERFFGMMFPFVLFFLDDSEKINEWRKK

SEQ ID NO: 2824334 - protein, 23 aa, Entamoeba invadens
QHGQFMCTMIFYYLAIKTTPGYV

SEQ ID NO: 2824335 - protein, 26 aa, Entamoeba invadens
QHIEGKLYYVVLWSGLSVLMNDKSVI

SEQ ID NO: 2824336 - protein, 27 aa, Entamoeba invadens
QHIRYTKYHIFMLKKAIHQIEYFPLNT

SEQ ID NO: 2824337 - protein, 22 aa, Entamoeba invadens
QHLKGVWYKYTATVLGKLHVNT

SEQ ID NO: 2824338 - protein, 26 aa, Entamoeba invadens
QHNTTFMVKGLFSTPTVFICYIEDIL

SEQ ID NO: 2824339 - protein, 24 aa, Entamoeba invadens
QHNYFIEDFAAVLPFTMTIETDKK

SEQ ID NO: 2824340 - protein, 34 aa, Entamoeba invadens
QHSYDNGVDIFYYLAMQPWRHFVWTQKEGNDWVT

SEQ ID NO: 2824341 - protein, 38 aa, Entamoeba invadens
QHSYDNGYDIYYYLAMQPWRHFVWTYNDNGVWVTKTMN

SEQ ID NO: 2824342 - protein, 22 aa, Entamoeba invadens
QHYGTWFKYTPAANTLGFIDTC

SEQ ID NO: 2824343 - protein, 18 aa, Entamoeba invadens
QICNTFSFLIDKGDSVIC

SEQ ID NO: 2824344 - protein, 27 aa, Entamoeba invadens
QICSLSQIILDPFYRTKLGFAVLVEKD

SEQ ID NO: 2824345 - protein, 18 aa, Entamoeba invadens
QICTLCYAPYVLSNDKQS

SEQ ID NO: 2824346 - protein, 22 aa, Entamoeba invadens
QIDFDALRLKFDKERDLLMKDE

SEQ ID NO: 2824347 - protein, 31 aa, Entamoeba invadens
QIDNFVIFIQTFIFFYHYFENGFSFFIKVCL

SEQ ID NO: 2824348 - protein, 27 aa, Entamoeba invadens
QIFDLRGYQFIPTYAFQNCKKLEYIIG

SEQ ID NO: 2824349 - protein, 40 aa, Entamoeba invadens
QIFQLRKWLLGLYDARWFKILIWMLFTMIGSTLAFLVTKY

SEQ ID NO: 2824350 - protein, 21 aa, Entamoeba invadens
QIGIFIPSLFVLLIGTITSVP

SEQ ID NO: 2824351 - protein, 25 aa, Entamoeba invadens
QIGNAMLFIPMLFVSVITDTVKGGK

SEQ ID NO: 2824352 - protein, 22 aa, Entamoeba invadens
QIGSFPVYLKIQSFEILHIDFI

SEQ ID NO: 2824353 - protein, 25 aa, Entamoeba invadens
QIGSTIFCFFNMPLEQQNILNHVIF

SEQ ID NO: 2824354 - protein, 29 aa, Entamoeba invadens
QIGTFLHKQLMFNLKKKLLEHEYVQHFIE

SEQ ID NO: 2824355 - protein, 23 aa, Entamoeba invadens
QIGTYYDSYYGKCQSCPYECTSC

SEQ ID NO: 2824356 - protein, 23 aa, Entamoeba invadens
QIGYPLRFTLIKAIILVFTTAAS

SEQ ID NO: 2824357 - protein, 18 aa, Entamoeba invadens
QIGYYLDNYVPRCRICMN

SEQ ID NO: 2824358 - protein, 29 aa, Entamoeba invadens
QIIACFMGLLYRKFFGIFPFNLCGRTSSS

SEQ ID NO: 2824359 - protein, 18 aa, Entamoeba invadens
QIIGLIAILLSKKKASPN

SEQ ID NO: 2824360 - protein, 18 aa, Entamoeba invadens
QIIINLVTLLGLQKKPKL

SEQ ID NO: 2824361 - protein, 31 aa, Entamoeba invadens
QIIMYPFHMIWTFIVFLYNKLKLYTPQSNNI

SEQ ID NO: 2824362 - protein, 25 aa, Entamoeba invadens
QIITIPPNYGCEFSLFLTPLCNSNM

SEQ ID NO: 2824363 - protein, 39 aa, Entamoeba invadens
QIKANLYLGKFMRDLMRFWKLTFVVKLLEIVMDWYASGG

SEQ ID NO: 2824364 - protein, 23 aa, Entamoeba invadens
QIKDYVKLMLLKNKAMLLELYMT

SEQ ID NO: 2824365 - protein, 19 aa, Entamoeba invadens
QIKSEKFWFTFVAHKTMKV

SEQ ID NO: 2824366 - protein, 20 aa, Entamoeba invadens
QILFVRGYITSLISNFERNV

SEQ ID NO: 2824367 - protein, 24 aa, Entamoeba invadens
QILSGLWLALYASLIFALMFLFFQ

SEQ ID NO: 2824368 - protein, 23 aa, Entamoeba invadens
QIMLLAMVYLPQIVFYLVFFPDK

SEQ ID NO: 2824369 - protein, 19 aa, Entamoeba invadens
QIMSLHRLILTGTPIQNNV

SEQ ID NO: 2824370 - protein, 20 aa, Entamoeba invadens
QIMWTVIYWLSFVVMWTVIP

SEQ ID NO: 2824371 - protein, 35 aa, Entamoeba invadens
QINLRVLPLVLKFIYKVLLFKPHTILQLLFEYQET

SEQ ID NO: 2824372 - protein, 21 aa, Entamoeba invadens
QIPHCVRLKFFIDSYICSVCE

SEQ ID NO: 2824373 - protein, 17 aa, Entamoeba invadens
QIPPMKLRVKMLIDGAR

SEQ ID NO: 2824374 - protein, 18 aa, Entamoeba invadens
QIPPMKLRVKMMMDGARG

SEQ ID NO: 2824375 - protein, 34 aa, Entamoeba invadens
QIQDMSSITLLFKEWDYWLMYDTTVKFIGSRVSW

SEQ ID NO: 2824376 - protein, 18 aa, Entamoeba invadens
QIQRWMKLDTLTKPVDYN

SEQ ID NO: 2824377 - protein, 24 aa, Entamoeba invadens
QIQTIPFFTTMNKNSFFKEGSSFV

SEQ ID NO: 2824378 - protein, 17 aa, Entamoeba invadens
QIQYAHFMLYNTNQVIA

SEQ ID NO: 2824379 - protein, 20 aa, Entamoeba invadens
QIRANTIKFLKTTTITSVTP

SEQ ID NO: 2824380 - protein, 17 aa, Entamoeba invadens
QIRGMYALYLLMKREEE

SEQ ID NO: 2824381 - protein, 17 aa, Entamoeba invadens
QIRLKFMTDAAKGISYL

SEQ ID NO: 2824382 - protein, 27 aa, Entamoeba invadens
QISFDFFNPLMLLLTQKHQQNLFEMYV

SEQ ID NO: 2824383 - protein, 18 aa, Entamoeba invadens
QISLFKTDNFVIGISAKD

SEQ ID NO: 2824384 - protein, 20 aa, Entamoeba invadens
QISPIFMYSRVMSLYVFLER

SEQ ID NO: 2824385 - protein, 26 aa, Entamoeba invadens
QISSGVISFILFKFVLKSEVLWQVQF

SEQ ID NO: 2824386 - protein, 25 aa, Entamoeba invadens
QISTLIKFCFYKNAAFFLVNMFYAF

SEQ ID NO: 2824387 - protein, 24 aa, Entamoeba invadens
QISTLIKFCFYKNAAFFLVNVFFA

SEQ ID NO: 2824388 - protein, 31 aa, Entamoeba invadens
QISVIIVLMVIISLLAHAFSVLRLVKHAKTI

SEQ ID NO: 2824389 - protein, 22 aa, Entamoeba invadens
QITIDLTFSWGFSPVVFVDENT

SEQ ID NO: 2824390 - protein, 23 aa, Entamoeba invadens
QITIGFGLIITALVLVLVAPLFS

SEQ ID NO: 2824391 - protein, 40 aa, Entamoeba invadens
QIVGWVVSLCIIFFFILLAILIFLIFMVFVAFSNHNEKVK

SEQ ID NO: 2824392 - protein, 31 aa, Entamoeba invadens
QIVQPFFAFQVFCSVLWMLDDMPIFAFMMLV

SEQ ID NO: 2824393 - protein, 43 aa, Entamoeba invadens
QKCDTTSFPVYGWILIAFGCFLFVIACVVIILVLVLKVNKRID

SEQ ID NO: 2824394 - protein, 24 aa, Entamoeba invadens
QKCKICDVGFYPNEQFRCVPCSTI

SEQ ID NO: 2824395 - protein, 20 aa, Entamoeba invadens
QKCYLELQKLFYEQFDFQNE

SEQ ID NO: 2824396 - protein, 24 aa, Entamoeba invadens
QKCYSCLNGYYLENNKCFELVNCT

SEQ ID NO: 2824397 - protein, 39 aa, Entamoeba invadens
QKDYPLFLDLTIPVLFGLYLLKTGLRIGLYKKIILYLRN

SEQ ID NO: 2824398 - protein, 32 aa, Entamoeba invadens
QKENIIGFWMWAYYLSWMRYAFELIMLSQFDG

SEQ ID NO: 2824399 - protein, 18 aa, Entamoeba invadens
QKEVEGIIPFIIDTAKNS

SEQ ID NO: 2824400 - protein, 20 aa, Entamoeba invadens
QKFVLYCLLLSYYFVCLATT

SEQ ID NO: 2824401 - protein, 26 aa, Entamoeba invadens
QKGNFYIKNGIFYKCINGEYLNINNT

SEQ ID NO: 2824402 - protein, 28 aa, Entamoeba invadens
QKHTYALTRVLYTELLKLAYSNGTKAIE

SEQ ID NO: 2824403 - protein, 27 aa, Entamoeba invadens
QKIENVILPLVFFYRKCTAPGCLLNRV

SEQ ID NO: 2824404 - protein, 24 aa, Entamoeba invadens
QKISNFELILWNKAKDRCPNVQNC

SEQ ID NO: 2824405 - protein, 47 aa, Entamoeba invadens
QKKDHNLFFLLLKFFTKGLLQFLMMFVYLFLIVFASGNILYAIDTYV

SEQ ID NO: 2824406 - protein, 34 aa, Entamoeba invadens
QKKERMVHCWSLLIFLIFGCIAYDSWCEFEENYV

SEQ ID NO: 2824407 - protein, 35 aa, Entamoeba invadens
QKKGPYSLLVKNTLFFFYCYFSVKVTTFPQFVEEF

SEQ ID NO: 2824408 - protein, 33 aa, Entamoeba invadens
QKKIRLLLPRHDLFLENLLLWSKKIFGVINASP

SEQ ID NO: 2824409 - protein, 30 aa, Entamoeba invadens
QKKLYLYTLMILLLTLVIEVLSECPFQVDS

SEQ ID NO: 2824410 - protein, 25 aa, Entamoeba invadens
QKKMNGWAIGVFVVISCLVFSIMGS

SEQ ID NO: 2824411 - protein, 22 aa, Entamoeba invadens
QKKTDFFVEEISIMSSVFPVIE

SEQ ID NO: 2824412 - protein, 24 aa, Entamoeba invadens
QKKVFDEYLPAFGFIECELFRMYF

SEQ ID NO: 2824413 - protein, 17 aa, Entamoeba invadens
QKLFFVNCLGRIWREVI

SEQ ID NO: 2824414 - protein, 20 aa, Entamoeba invadens
QKLLQIFKDYVPKVLAERHM

SEQ ID NO: 2824415 - protein, 32 aa, Entamoeba invadens
QKNGYDCGVYMLYFIKKFIIYTPDTNEKFQRL

SEQ ID NO: 2824416 - protein, 39 aa, Entamoeba invadens
QKNRTVVLGFYFFIVVILFPIGVWLLLRKFHNYDNNNLT

SEQ ID NO: 2824417 - protein, 28 aa, Entamoeba invadens
QKNSFAFFIVVLLTIYKSFPKAFEYNRT

SEQ ID NO: 2824418 - protein, 18 aa, Entamoeba invadens
QKNYGYAIQKFEIDWDRV

SEQ ID NO: 2824419 - protein, 18 aa, Entamoeba invadens
QKPLIRLLTENNSAPFTV

SEQ ID NO: 2824420 - protein, 27 aa, Entamoeba invadens
QKPVLQIYMPTMLNWMIGGLIGQKSLG

SEQ ID NO: 2824421 - protein, 24 aa, Entamoeba invadens
QKPYTYGYWFKLTSDSRRVIFIQV

SEQ ID NO: 2824422 - protein, 30 aa, Entamoeba invadens
QKSDMYSFGMLLVQVLISTKYFKPDEDDIG

SEQ ID NO: 2824423 - protein, 21 aa, Entamoeba invadens
QKSFPSFRSRFSFSLPHRSKK

SEQ ID NO: 2824424 - protein, 26 aa, Entamoeba invadens
QKSKDIFMKLFRMCPTHSYAHYVCGV

SEQ ID NO: 2824425 - protein, 26 aa, Entamoeba invadens
QKSLGVFVTFFRFALNLRNEVRDPLV

SEQ ID NO: 2824426 - protein, 19 aa, Entamoeba invadens
QKSSAVMICVLFTLLLLTA

SEQ ID NO: 2824427 - protein, 19 aa, Entamoeba invadens
QKWFVIGGHFLGIGMGFVM

SEQ ID NO: 2824428 - protein, 23 aa, Entamoeba invadens
QKYKNYILLIYQPKIFQKHCFVD

SEQ ID NO: 2824429 - protein, 25 aa, Entamoeba invadens
QKYPLFYFVCFSLVGQFILCSLIEG

SEQ ID NO: 2824430 - protein, 24 aa, Entamoeba invadens
QLALWKNYLMFFPGNLEVDMSNVD

SEQ ID NO: 2824431 - protein, 20 aa, Entamoeba invadens
QLCSFFLIGFLIVDFARAKF

SEQ ID NO: 2824432 - protein, 27 aa, Entamoeba invadens
QLCSVSSMRALIFRKVQFGLVDIIHIE

SEQ ID NO: 2824433 - protein, 19 aa, Entamoeba invadens
QLDGCKLLVAERSIRDFPL

SEQ ID NO: 2824434 - protein, 20 aa, Entamoeba invadens
QLDKPPIVLWQSDRLHLYRN

SEQ ID NO: 2824435 - protein, 19 aa, Entamoeba invadens
QLEYITIFGEDLFVRLNNT

SEQ ID NO: 2824436 - protein, 23 aa, Entamoeba invadens
QLFHPKHIMIACLCLGRKLEEFR

SEQ ID NO: 2824437 - protein, 25 aa, Entamoeba invadens
QLFPSPKFFFEWMNYTSKHSGLFNS

SEQ ID NO: 2824438 - protein, 30 aa, Entamoeba invadens
QLGGIPVAFLYLIIAVLRKGLSTIGDYTLT

SEQ ID NO: 2824439 - protein, 25 aa, Entamoeba invadens
QLGKKIEEGNLIKKQLDKIKQDADG

SEQ ID NO: 2824440 - protein, 18 aa, Entamoeba invadens
QLGSLRKFMQTNPISDFL

SEQ ID NO: 2824441 - protein, 19 aa, Entamoeba invadens
QLICLARALLKNSKILIMD

SEQ ID NO: 2824442 - protein, 17 aa, Entamoeba invadens
QLIEMMWDLVKEFNFKK

SEQ ID NO: 2824443 - protein, 20 aa, Entamoeba invadens
QLIFMIGWCFYWVVITVDDA

SEQ ID NO: 2824444 - protein, 36 aa, Entamoeba invadens
QLILTKKRLFIGCNLVLIMFTFLKENTPFLDTFSLP

SEQ ID NO: 2824445 - protein, 26 aa, Entamoeba invadens
QLKTDLLLFNFLACSFFSTLKDTNLS

SEQ ID NO: 2824446 - protein, 26 aa, Entamoeba invadens
QLKVPKRNILKWAPILSFVGAANNFM

SEQ ID NO: 2824447 - protein, 19 aa, Entamoeba invadens
QLLEIFFTELIKNTEILYP

SEQ ID NO: 2824448 - protein, 17 aa, Entamoeba invadens
QLLKLEDVFKGYKKMHD

SEQ ID NO: 2824449 - protein, 26 aa, Entamoeba invadens
QLLQTSFFNFFIVSFSFCCLACWCIF

SEQ ID NO: 2824450 - protein, 17 aa, Entamoeba invadens
QLLVIDFAGQTHNLLFT

SEQ ID NO: 2824451 - protein, 19 aa, Entamoeba invadens
QLLYPLEDDFLIVQALKRL

SEQ ID NO: 2824452 - protein, 25 aa, Entamoeba invadens
QLNMSTDIFCKYVRMLETKVQMHTA

SEQ ID NO: 2824453 - protein, 28 aa, Entamoeba invadens
QLPKNTFLMMNKTLLRYGLHNELFCHLE

SEQ ID NO: 2824454 - protein, 19 aa, Entamoeba invadens
QLPNIAFLARKPMKDSLYY

SEQ ID NO: 2824455 - protein, 17 aa, Entamoeba invadens
QLPSIYIPIVDNSMFMD

SEQ ID NO: 2824456 - protein, 19 aa, Entamoeba invadens
QLQLYVLRSYLEMEMCGNE

SEQ ID NO: 2824457 - protein, 17 aa, Entamoeba invadens
QLQTVYWADIFLLLLCY

SEQ ID NO: 2824458 - protein, 21 aa, Entamoeba invadens
QLQYRMSIWFTLDLSTSTATL

SEQ ID NO: 2824459 - protein, 18 aa, Entamoeba invadens
QLRGSIPLKWSQVPNFHY

SEQ ID NO: 2824460 - protein, 26 aa, Entamoeba invadens
QLSFDSWAVMILWGTLCMCEVILFGF

SEQ ID NO: 2824461 - protein, 23 aa, Entamoeba invadens
QLSTLIMPVLIQFMTRWVSEENP

SEQ ID NO: 2824462 - protein, 38 aa, Entamoeba invadens
QLTISLIVLGVSCLIFIGLFIFAVVRKVMTRKPAPPKD

SEQ ID NO: 2824463 - protein, 23 aa, Entamoeba invadens
QLTPSTEYILLTTAENYIKEVFE

SEQ ID NO: 2824464 - protein, 26 aa, Entamoeba invadens
QLTRVKELTELKEGLEKQNEENLKKV

SEQ ID NO: 2824465 - protein, 17 aa, Entamoeba invadens
QLTTRFGCDKYTIRTVP

SEQ ID NO: 2824466 - protein, 17 aa, Entamoeba invadens
QLVHHKMNWLRPLIIPL

SEQ ID NO: 2824467 - protein, 24 aa, Entamoeba invadens
QLVIWTILRIFPLIDWVMQFLTGS

SEQ ID NO: 2824468 - protein, 26 aa, Entamoeba invadens
QLVMAIYRIVMFTILITVVFVQLCYG

SEQ ID NO: 2824469 - protein, 19 aa, Entamoeba invadens
QMDFDDLFMLFQSLGNQIG

SEQ ID NO: 2824470 - protein, 29 aa, Entamoeba invadens
QMFFESKFNYVFTMYIRDFSTFIMNSSEI

SEQ ID NO: 2824471 - protein, 25 aa, Entamoeba invadens
QMFIIVLPMALYLIVLTPHLNFLVF

SEQ ID NO: 2824472 - protein, 22 aa, Entamoeba invadens
QMGISCTLMLSIPVPNGFKYTV

SEQ ID NO: 2824473 - protein, 25 aa, Entamoeba invadens
QMGKVFNVEYLFLGSESCTFTTSSI

SEQ ID NO: 2824474 - protein, 20 aa, Entamoeba invadens
QMICMARALLKNAKILIMDE

SEQ ID NO: 2824475 - protein, 20 aa, Entamoeba invadens
QMIDYFMFYNHICIVTEFLG

SEQ ID NO: 2824476 - protein, 25 aa, Entamoeba invadens
QMKTIRACYVFRAHMVGAGLGVIMF

SEQ ID NO: 2824477 - protein, 30 aa, Entamoeba invadens
QMLDKFRCDYIIYFYGAVLIPSRICMVTEF

SEQ ID NO: 2824478 - protein, 27 aa, Entamoeba invadens
QMLKTSFLNFFIVSFSFCCLACWCVFM

SEQ ID NO: 2824479 - protein, 31 aa, Entamoeba invadens
  misc_feature (28)..(29): Xaa can be any naturally occurring amino acid
QMLNKFRCQYIVYFYGAVLIKSRMCLVXXKM

SEQ ID NO: 2824480 - protein, 18 aa, Entamoeba invadens
QMLTLQNPQFLFITFTLL

SEQ ID NO: 2824481 - protein, 19 aa, Entamoeba invadens
QMNKLIYNNEFFPVVIHRN

SEQ ID NO: 2824482 - protein, 46 aa, Entamoeba invadens
QMPRFLRFRREQTPFFKQFFPMRQRKTRVLGFNDLGFQLPSFALFR

SEQ ID NO: 2824483 - protein, 17 aa, Entamoeba invadens
QMSFVKIVKPFIVSIPP

SEQ ID NO: 2824484 - protein, 24 aa, Entamoeba invadens
QMVLFLFCVLLVNASDCYPKYQNC

SEQ ID NO: 2824485 - protein, 18 aa, Entamoeba invadens
QMVYGTVFPLYFTGQKLV

SEQ ID NO: 2824486 - protein, 17 aa, Entamoeba invadens
QMYGIRLASSGSILVVG

SEQ ID NO: 2824487 - protein, 19 aa, Entamoeba invadens
QNCIFLSDKTYTIATNLTC

SEQ ID NO: 2824488 - protein, 22 aa, Entamoeba invadens
QNCTVLKHLTFSKSLFIIPNGC

SEQ ID NO: 2824489 - protein, 24 aa, Entamoeba invadens
QNDEKWNKIIWKKTNWKGESLQCT

SEQ ID NO: 2824490 - protein, 26 aa, Entamoeba invadens
QNDPSLVWFSLIIGICIIWTIVGIVL

SEQ ID NO: 2824491 - protein, 29 aa, Entamoeba invadens
QNDTESILILFFVFEQLNLQIRPKALKLK

SEQ ID NO: 2824492 - protein, 20 aa, Entamoeba invadens
QNECLICRNGNVIDKNGACV

SEQ ID NO: 2824493 - protein, 27 aa, Entamoeba invadens
QNERNKIFSMLFPFVLFMLDESDKLNE

SEQ ID NO: 2824494 - protein, 23 aa, Entamoeba invadens
QNEWPFEKMRWFSITTQGVPTYA

SEQ ID NO: 2824495 - protein, 31 aa, Entamoeba invadens
QNEYKDFYVVQQAILIGFLNAYYGVSVSKQK

SEQ ID NO: 2824496 - protein, 25 aa, Entamoeba invadens
QNFFTKGGFFLRSPWGNETWENLNS

SEQ ID NO: 2824497 - protein, 26 aa, Entamoeba invadens
QNFKNIPLIDTIHFLPVILQTFLESN

SEQ ID NO: 2824498 - protein, 23 aa, Entamoeba invadens
QNGFFQMGVLSNIKYLYELELRD

SEQ ID NO: 2824499 - protein, 17 aa, Entamoeba invadens
QNGYYISNGICVLICDN

SEQ ID NO: 2824500 - protein, 21 aa, Entamoeba invadens
QNISLIFPVIGSSTKCIDFVS

SEQ ID NO: 2824501 - protein, 23 aa, Entamoeba invadens
QNKHPLSIFFIKTGIILRKDQDN

SEQ ID NO: 2824502 - protein, 25 aa, Entamoeba invadens
QNKMKYAFPLFVQSNVILASSNKHT

SEQ ID NO: 2824503 - protein, 43 aa, Entamoeba invadens
QNKTLSIVFPVVITVVIIIVLIFTMFVVYLIYKSHKSKKILQK

SEQ ID NO: 2824504 - protein, 37 aa, Entamoeba invadens
QNKTQIAMYFELFNKFLQFLQPFLFVNTTATKQLITA

SEQ ID NO: 2824505 - protein, 28 aa, Entamoeba invadens
QNKWTINGWVFVCDFTFIDFSNFEKSKL

SEQ ID NO: 2824506 - protein, 54 aa, Entamoeba invadens
QNLCVKQNKYFLYIGIPVIIVCIVIIILTIIILTLFVLIFKKKEEKKMTNICVF

SEQ ID NO: 2824507 - protein, 19 aa, Entamoeba invadens
QNLFFNLTISKDSIFENYY

SEQ ID NO: 2824508 - protein, 27 aa, Entamoeba invadens
QNLFHITQLHLPILWGNQLSFGLCLDI

SEQ ID NO: 2824509 - protein, 34 aa, Entamoeba invadens
QNLSKIQFEFLVPFLPLIAWQLSHVDLSWTLTQP

SEQ ID NO: 2824510 - protein, 32 aa, Entamoeba invadens
QNLVRAYDVFSPKYIPPETLIQRTYTQKSDMY

SEQ ID NO: 2824511 - protein, 22 aa, Entamoeba invadens
QNNFYTFVSNPFTLNFDETIVN

SEQ ID NO: 2824512 - protein, 18 aa, Entamoeba invadens
QNNIAYYKFPIVSKEKTN

SEQ ID NO: 2824513 - protein, 18 aa, Entamoeba invadens
QNNLFFHGTVQPTTLSDS

SEQ ID NO: 2824514 - protein, 24 aa, Entamoeba invadens
QNPQFLFITFTLLASQRSFPERVV

SEQ ID NO: 2824515 - protein, 41 aa, Entamoeba invadens
QNRNFKWTMSQYITWYITFSLFFTMVIFSILIGSNVFLAFV

SEQ ID NO: 2824516 - protein, 26 aa, Entamoeba invadens
QNRTIRDLPLFFFEKEFSLPANMTIT

SEQ ID NO: 2824517 - protein, 26 aa, Entamoeba invadens
QNSCYYYYKELFLNTVFGFICPSKNV

SEQ ID NO: 2824518 - protein, 32 aa, Entamoeba invadens
QNSLNHPLLAFLILPFYTPSLDFIEAVQYSIG

SEQ ID NO: 2824519 - protein, 25 aa, Entamoeba invadens
QNSTPLFENIPLHLLTKIPYQNETD

SEQ ID NO: 2824520 - protein, 18 aa, Entamoeba invadens
QNTFLCNNGEYLDNNNSC

SEQ ID NO: 2824521 - protein, 21 aa, Entamoeba invadens
QNTHIIFQQFTTLLIDEDVKT

SEQ ID NO: 2824522 - protein, 25 aa, Entamoeba invadens
QNTTKSYFKFILNQLQNTQQKNYKS

SEQ ID NO: 2824523 - protein, 24 aa, Entamoeba invadens
QNTVYFGCPNGQFLRNDNTCQECR

SEQ ID NO: 2824524 - protein, 19 aa, Entamoeba invadens
QNVCIFQMKRSNIAMKILS

SEQ ID NO: 2824525 - protein, 23 aa, Entamoeba invadens
QNVEQFIVMLLQVLLAQNLNTDV

SEQ ID NO: 2824526 - protein, 25 aa, Entamoeba invadens
QNVLVLLLMFWSIFRVVETMIAFLL

SEQ ID NO: 2824527 - protein, 18 aa, Entamoeba invadens
QPDWFGHGSADCSSLSPA

SEQ ID NO: 2824528 - protein, 21 aa, Entamoeba invadens
QPEVVILKRKQGCKFTVTLSP

SEQ ID NO: 2824529 - protein, 43 aa, Entamoeba invadens
QPFKYITHFFPFTFIRKYRKMPLPYLLVFLALVLYEHFGYLII

SEQ ID NO: 2824530 - protein, 17 aa, Entamoeba invadens
QPGYYLSSAFTCEPLGD

SEQ ID NO: 2824531 - protein, 17 aa, Entamoeba invadens
QPIECENVMMSAINNDE

SEQ ID NO: 2824532 - protein, 19 aa, Entamoeba invadens
QPIHFLDHNKYSEGIIVIV

SEQ ID NO: 2824533 - protein, 20 aa, Entamoeba invadens
QPIPPKCLVDIFSTFEPLRV

SEQ ID NO: 2824534 - protein, 19 aa, Entamoeba invadens
QPIQCNTGFFMYQMKECRD

SEQ ID NO: 2824535 - protein, 33 aa, Entamoeba invadens
QPKDMPDWLYQVISLGWDQLPLNRPKIDKIVEM

SEQ ID NO: 2824536 - protein, 22 aa, Entamoeba invadens
QPKILPNNPYLNINLKIFVTEK

SEQ ID NO: 2824537 - protein, 21 aa, Entamoeba invadens
QPLIMPVHHICKTSLVFLLRY

SEQ ID NO: 2824538 - protein, 23 aa, Entamoeba invadens
QPQRIFEFIQFFIQTVLTPNEVF

SEQ ID NO: 2824539 - protein, 26 aa, Entamoeba invadens
QPRPLIFEKFTKIIMLNRGKMIYFGS

SEQ ID NO: 2824540 - protein, 17 aa, Entamoeba invadens
QPTFFTHIIQAKDNSFI

SEQ ID NO: 2824541 - protein, 25 aa, Entamoeba invadens
QPYHQVPEILPPKPITRSAKAEKNN

SEQ ID NO: 2824542 - protein, 22 aa, Entamoeba invadens
QPYVNWVLAFFGGLAGGFAYQT

SEQ ID NO: 2824543 - protein, 33 aa, Entamoeba invadens
QQCVKCIDGYFLYERIWKCIRGEINNCLVYKTE

SEQ ID NO: 2824544 - protein, 22 aa, Entamoeba invadens
QQEMRVMTWLGFIGGAKGVFYY

SEQ ID NO: 2824545 - protein, 18 aa, Entamoeba invadens
QQETFPILFRGKDGTVIE

SEQ ID NO: 2824546 - protein, 31 aa, Entamoeba invadens
QQEYLLVLLEYFHVIFVLRKQFFEKLGMSEE

SEQ ID NO: 2824547 - protein, 18 aa, Entamoeba invadens
QQGYYFKNGNCKKCAEGC

SEQ ID NO: 2824548 - protein, 17 aa, Entamoeba invadens
QQHMWKTILPDSFFSSE

SEQ ID NO: 2824549 - protein, 28 aa, Entamoeba invadens
QQKLFKNMQIKFLIDGAKGIFYLHENGI

SEQ ID NO: 2824550 - protein, 20 aa, Entamoeba invadens
QQKMVYPERPFSNGWDAATE

SEQ ID NO: 2824551 - protein, 25 aa, Entamoeba invadens
QQKYKMPCDVFSLAVSFYEGYTWIT

SEQ ID NO: 2824552 - protein, 19 aa, Entamoeba invadens
QQLRKLGLNLPFSCDANFS

SEQ ID NO: 2824553 - protein, 28 aa, Entamoeba invadens
QQLRLTKTLSFNKLTLTPPTQVIFTSTN

SEQ ID NO: 2824554 - protein, 21 aa, Entamoeba invadens
QQMWRCGVISNFEYLMYLNVK

SEQ ID NO: 2824555 - protein, 28 aa, Entamoeba invadens
QQNFKSFEFLLNIYLKLVYKNKSICIIV

SEQ ID NO: 2824556 - protein, 29 aa, Entamoeba invadens
QQPKHVLVNMRSPFRLEVFLAMIVPAFCD

SEQ ID NO: 2824557 - protein, 40 aa, Entamoeba invadens
QQQEHFFWDVLEFFHIVFVFRSEFFERLNLRDAYLSLMRR

SEQ ID NO: 2824558 - protein, 17 aa, Entamoeba invadens
QQSWKHKASERPSFKEV

SEQ ID NO: 2824559 - protein, 24 aa, Entamoeba invadens
QQSYQLFHPRCLLQMIFAGCMKQT

SEQ ID NO: 2824560 - protein, 31 aa, Entamoeba invadens
QQTILTLMIRNYMMLILRGGELQKLGVYGLS

SEQ ID NO: 2824561 - protein, 23 aa, Entamoeba invadens
QQTWRWFVCVFSREFKVEQVIMI

SEQ ID NO: 2824562 - protein, 17 aa, Entamoeba invadens
QQVLLRYKGMQLVTMVL

SEQ ID NO: 2824563 - protein, 26 aa, Entamoeba invadens
QQVVQFLMKTIFFSDIPPINKTPAIY

SEQ ID NO: 2824564 - protein, 25 aa, Entamoeba invadens
QQYFMIIGAFFWLAVCIAEFFVLLI

SEQ ID NO: 2824565 - protein, 23 aa, Entamoeba invadens
QRCYDGYFLSNTLCVKCLNDCLS

SEQ ID NO: 2824566 - protein, 18 aa, Entamoeba invadens
QRDLIPRLKDFFNSIITN

SEQ ID NO: 2824567 - protein, 23 aa, Entamoeba invadens
QRELFGKLEGEKVEILKTVEGLT

SEQ ID NO: 2824568 - protein, 24 aa, Entamoeba invadens
QREYTPLLFDSFGNFLVYGTDCGN

SEQ ID NO: 2824569 - protein, 23 aa, Entamoeba invadens
QRFEYTSLFLIIVKKLYNCFHCF

SEQ ID NO: 2824570 - protein, 18 aa, Entamoeba invadens
QRFFCFFFVLFNCKMVFL

SEQ ID NO: 2824571 - protein, 22 aa, Entamoeba invadens
QRGEITTLTFYKDAIVELGTTR

SEQ ID NO: 2824572 - protein, 20 aa, Entamoeba invadens
QRKCITCNTGYYPLSSGTCK

SEQ ID NO: 2824573 - protein, 26 aa, Entamoeba invadens
QRNMDDFYFYIFVHLGQFSKVTIELN

SEQ ID NO: 2824574 - protein, 19 aa, Entamoeba invadens
QRNYRRGFWFEADKDAYNG

SEQ ID NO: 2824575 - protein, 22 aa, Entamoeba invadens
QRPTVAFFKRGIHLFSNIDQHW

SEQ ID NO: 2824576 - protein, 28 aa, Entamoeba invadens
QRQGIKIRTLYFKALLRQDMEWYDFHEA

SEQ ID NO: 2824577 - protein, 25 aa, Entamoeba invadens
QRQKFTFFLYAEHLVTVFFDRTIPY

SEQ ID NO: 2824578 - protein, 29 aa, Entamoeba invadens
QRRCYECQIGYYPSLTTYKCTKCSLTCES

SEQ ID NO: 2824579 - protein, 35 aa, Entamoeba invadens
QRRNIKLYIAFAMFIFFVVFIGSWVFCGVRFQRCR

SEQ ID NO: 2824580 - protein, 22 aa, Entamoeba invadens
QRRNLPVFFKRDDKSYLTFESS

SEQ ID NO: 2824581 - protein, 25 aa, Entamoeba invadens
QRSEEKLFNMLYINKVKSPERVQFR

SEQ ID NO: 2824582 - protein, 28 aa, Entamoeba invadens
QRSMCWAFSTIFQLEYAYNKKLANQYIS

SEQ ID NO: 2824583 - protein, 20 aa, Entamoeba invadens
QRVFFDIRYNFLEVSSFSSE

SEQ ID NO: 2824584 - protein, 28 aa, Entamoeba invadens
QSADATLLKLFTLKQLRKMYDLATNEII

SEQ ID NO: 2824585 - protein, 20 aa, Entamoeba invadens
QSDLPDYYFVGYSYSDANDC

SEQ ID NO: 2824586 - protein, 25 aa, Entamoeba invadens
QSEELRRLAIFADKSRFIAEFNTQR

SEQ ID NO: 2824587 - protein, 22 aa, Entamoeba invadens
QSELNICFKIMYGCLKSTNMNF

SEQ ID NO: 2824588 - protein, 29 aa, Entamoeba invadens
QSEMKCLLCYDPYYQFNKTCASCPVYQYK

SEQ ID NO: 2824589 - protein, 24 aa, Entamoeba invadens
QSFALLLAKVYFKTVFIIKCSDTN

SEQ ID NO: 2824590 - protein, 21 aa, Entamoeba invadens
QSFCFFVLSQRQSIKIRILYF

SEQ ID NO: 2824591 - protein, 18 aa, Entamoeba invadens
QSFFLLVATAFDTQRIIY

SEQ ID NO: 2824592 - protein, 24 aa, Entamoeba invadens
QSFRFNTIEIFKYTDSIYLKEKNV

SEQ ID NO: 2824593 - protein, 21 aa, Entamoeba invadens
QSGIFTFPAAKCDKPLIDHQV

SEQ ID NO: 2824594 - protein, 24 aa, Entamoeba invadens
QSGLTLQSLTLYSSSRIKITGSAT

SEQ ID NO: 2824595 - protein, 54 aa, Entamoeba invadens
QSGTFCVSKAVWWVIFIIVIFVIVLVIIIFICVVILFVVIHKKLRKSEIESKMT

SEQ ID NO: 2824596 - protein, 19 aa, Entamoeba invadens
QSHLYFNISNSLNLNDCDM

SEQ ID NO: 2824597 - protein, 25 aa, Entamoeba invadens
QSKIDIFQFKKFKFGLHTQVTYYEY

SEQ ID NO: 2824598 - protein, 45 aa, Entamoeba invadens
QSKILAIVLPTVFGCLFVLVVFSIIIFAVVRYRIIKGRRLLKEYN

SEQ ID NO: 2824599 - protein, 25 aa, Entamoeba invadens
QSKKSVVLYPADSSLLFTCFSAFWV

SEQ ID NO: 2824600 - protein, 28 aa, Entamoeba invadens
QSKRCRELLPVLLNSKRTVLLSGTALLS

SEQ ID NO: 2824601 - protein, 21 aa, Entamoeba invadens
QSLINLNLWTPVKLSHFFIST

SEQ ID NO: 2824602 - protein, 20 aa, Entamoeba invadens
QSLITKCPLLLNSLATTPDA

SEQ ID NO: 2824603 - protein, 25 aa, Entamoeba invadens
QSLTFGIFLCLWFDGIDKQGKDMLT

SEQ ID NO: 2824604 - protein, 19 aa, Entamoeba invadens
QSLYFARWYRLVNRERIPI

SEQ ID NO: 2824605 - protein, 27 aa, Entamoeba invadens
QSNDIAYFLKWHILQPDYNSNLVEKTR

SEQ ID NO: 2824606 - protein, 48 aa, Entamoeba invadens
QSNTDETFLYFPLINVLIQPINLVIDGSWVKRLFSLYYSMSDFSTLFT

SEQ ID NO: 2824607 - protein, 34 aa, Entamoeba invadens
QSNTKKCIVFVILLLVVLCMAFYYFKMKQNTQTI

SEQ ID NO: 2824608 - protein, 21 aa, Entamoeba invadens
QSNWMQCFVTGAIDAKVPILS

SEQ ID NO: 2824609 - protein, 17 aa, Entamoeba invadens
QSPDFMFGLPLESPRTR

SEQ ID NO: 2824610 - protein, 43 aa, Entamoeba invadens
QSPLANRFILGILFFINEVFLQLKLLWPSYTPNDNYSYCAPQN

SEQ ID NO: 2824611 - protein, 19 aa, Entamoeba invadens
QSPLVYRLLIQHLTDNCVD

SEQ ID NO: 2824612 - protein, 26 aa, Entamoeba invadens
QSPRYYLVVIGELFYVYTSMLSEKEF

SEQ ID NO: 2824613 - protein, 24 aa, Entamoeba invadens
QSSCTPCIAGYFQNKESSTTCKPC

SEQ ID NO: 2824614 - protein, 18 aa, Entamoeba invadens
QSSFLLVATAFDTQRIIY

SEQ ID NO: 2824615 - protein, 21 aa, Entamoeba invadens
QSTEDFFLKCKKEMPNMVGCA

SEQ ID NO: 2824616 - protein, 26 aa, Entamoeba invadens
QSTHFGFVSPLRLLGTAAKLSASKIF

SEQ ID NO: 2824617 - protein, 19 aa, Entamoeba invadens
QSTLLKCKYQKNYKNQKEC

SEQ ID NO: 2824618 - protein, 27 aa, Entamoeba invadens
QSTNMWNVILWYFFEISYHFYNCLTNV

SEQ ID NO: 2824619 - protein, 25 aa, Entamoeba invadens
QSTNMWNVVLWYFFEISYHFYNCIV

SEQ ID NO: 2824620 - protein, 19 aa, Entamoeba invadens
QSTWFPEVKHYLPTVPVFL

SEQ ID NO: 2824621 - protein, 22 aa, Entamoeba invadens
QSVCILLKMCVISVSLIMFCYM

SEQ ID NO: 2824622 - protein, 17 aa, Entamoeba invadens
QSVFIESLPYILKVDRT

SEQ ID NO: 2824623 - protein, 22 aa, Entamoeba invadens
QSVNYHCFFSPYCISYKSDRCV

SEQ ID NO: 2824624 - protein, 27 aa, Entamoeba invadens
QSVQFLSPVIFINTTSVPLDVVWRNNT

SEQ ID NO: 2824625 - protein, 24 aa, Entamoeba invadens
QSVRKRVWAFFSNVLEKPQLAPIS

SEQ ID NO: 2824626 - protein, 17 aa, Entamoeba invadens
QSYVRGHNVRRFPEVQG

SEQ ID NO: 2824627 - protein, 22 aa, Entamoeba invadens
QTANIPTLLKTNPIKFIVNNIT

SEQ ID NO: 2824628 - protein, 19 aa, Entamoeba invadens
QTCSKCFAPYVINDMTSEC

SEQ ID NO: 2824629 - protein, 19 aa, Entamoeba invadens
QTDAFFAALGKTNVFRIRF

SEQ ID NO: 2824630 - protein, 29 aa, Entamoeba invadens
QTEILKHSWLPFEILKKSISQIGADQSFF

SEQ ID NO: 2824631 - protein, 26 aa, Entamoeba invadens
QTEKKIIEPLKFIGIPLNNLERWNGE

SEQ ID NO: 2824632 - protein, 22 aa, Entamoeba invadens
QTEKMVFSGFLSFCLSNLKNTM

SEQ ID NO: 2824633 - protein, 25 aa, Entamoeba invadens
QTERQLCVILKQLELTYPVVDLLFD

SEQ ID NO: 2824634 - protein, 23 aa, Entamoeba invadens
QTESVCHICDVGNFYILNGTTCE

SEQ ID NO: 2824635 - protein, 25 aa, Entamoeba invadens
QTGIPRALTLSRKVSFIFSSASYTN

SEQ ID NO: 2824636 - protein, 18 aa, Entamoeba invadens
QTGYLWQEKSCYICDVKC

SEQ ID NO: 2824637 - protein, 17 aa, Entamoeba invadens
QTGYYLYNSGCYQCDTN

SEQ ID NO: 2824638 - protein, 25 aa, Entamoeba invadens
QTHGIYWVVPLISIPIICGLSLDYD

SEQ ID NO: 2824639 - protein, 19 aa, Entamoeba invadens
QTIIKIQSYVRGHNVRRFP

SEQ ID NO: 2824640 - protein, 22 aa, Entamoeba invadens
QTILCLRFIPWYVVWINIIGHI

SEQ ID NO: 2824641 - protein, 24 aa, Entamoeba invadens
QTILLLTSSSFLGNPRGLLQDLSS

SEQ ID NO: 2824642 - protein, 28 aa, Entamoeba invadens
QTITFERCSFTFPNGSPLFNEVILTVSA

SEQ ID NO: 2824643 - protein, 22 aa, Entamoeba invadens
QTIYTTFRIYKCTQGILLLTNT

SEQ ID NO: 2824644 - protein, 29 aa, Entamoeba invadens
QTKLLFVVQLFLMFLQTSFFCLLYSKNDI

SEQ ID NO: 2824645 - protein, 17 aa, Entamoeba invadens
QTLEFVLKSLKNMKGFV

SEQ ID NO: 2824646 - protein, 23 aa, Entamoeba invadens
QTLEKRYFRLKGEPLPELVRPES

SEQ ID NO: 2824647 - protein, 21 aa, Entamoeba invadens
QTLGDLSARCSVALPTGGGCA

SEQ ID NO: 2824648 - protein, 28 aa, Entamoeba invadens
QTLNGWFNTFNFFNKFVFTRNMASTPSD

SEQ ID NO: 2824649 - protein, 18 aa, Entamoeba invadens
QTLTLVGPVHLPNASLFL

SEQ ID NO: 2824650 - protein, 31 aa, Entamoeba invadens
QTMKFLVHPFFWSLVFMIICGYWNGIFQVLT

SEQ ID NO: 2824651 - protein, 24 aa, Entamoeba invadens
QTMKKLELMLKFSKKNYSIKKWVL

SEQ ID NO: 2824652 - protein, 22 aa, Entamoeba invadens
QTNEYIVNLYKPGPSGYLAKTK

SEQ ID NO: 2824653 - protein, 44 aa, Entamoeba invadens
QTNYGILIGIPIASFVLILFIIAIIITILIFVILHKKEEHEMVN

SEQ ID NO: 2824654 - protein, 19 aa, Entamoeba invadens
QTPPPQPIQPQFTPFDFSE

SEQ ID NO: 2824655 - protein, 28 aa, Entamoeba invadens
QTPQSHVILLPLLIKHLYCLPEHMIINV

SEQ ID NO: 2824656 - protein, 21 aa, Entamoeba invadens
QTPSIPLRRAPTQPLQQPYQS

SEQ ID NO: 2824657 - protein, 20 aa, Entamoeba invadens
QTQCVEFLKMIFKTFPVEFV

SEQ ID NO: 2824658 - protein, 18 aa, Entamoeba invadens
QTQLFVYQSIRVESLNII

SEQ ID NO: 2824659 - protein, 33 aa, Entamoeba invadens
QTQVVTLGYDFGLKKYWLMPEVLSHEALEGSAT

SEQ ID NO: 2824660 - protein, 17 aa, Entamoeba invadens
QTRLKIGPIVDTLKLFW

SEQ ID NO: 2824661 - protein, 24 aa, Entamoeba invadens
QTRVWPSLLLLVTIVALLSVVIDN

SEQ ID NO: 2824662 - protein, 48 aa, Entamoeba invadens
QTSCDKHAVWWIILIIVILLLILFVIITLLILYTVYYILEKRKVHDLQ

SEQ ID NO: 2824663 - protein, 31 aa, Entamoeba invadens
QTSPMPFSMSINMLGGVALLLYLVEYSKTQK

SEQ ID NO: 2824664 - protein, 17 aa, Entamoeba invadens
QTTFKKYPIHLNHLKIG

SEQ ID NO: 2824665 - protein, 23 aa, Entamoeba invadens
QTTHKIIQMPFAHIGLGRISNYI

SEQ ID NO: 2824666 - protein, 30 aa, Entamoeba invadens
QTTNFLELDLMNRPIFYLTSVSEQVYTVKI

SEQ ID NO: 2824667 - protein, 19 aa, Entamoeba invadens
QTVIYKDHRIFYKSINTAL

SEQ ID NO: 2824668 - protein, 23 aa, Entamoeba invadens
QTVKIVQLINYKSLTLNGITLDL

SEQ ID NO: 2824669 - protein, 26 aa, Entamoeba invadens
QTVYSLLLIYFFRVLERRWSSQVFFN

SEQ ID NO: 2824670 - protein, 20 aa, Entamoeba invadens
QTYCTSCESGYYLDSINKCQ

SEQ ID NO: 2824671 - protein, 31 aa, Entamoeba invadens
QTYFCIHLITLGLFVWLTFAPPRVPKGTTTT

SEQ ID NO: 2824672 - protein, 23 aa, Entamoeba invadens
QVDGFQIDLLIKLKETRLPQQQI

SEQ ID NO: 2824673 - protein, 26 aa, Entamoeba invadens
QVEKGGIYVFNIYAKGIQISCAETGS

SEQ ID NO: 2824674 - protein, 19 aa, Entamoeba invadens
QVFLILRHPPQNAVKQYTN

SEQ ID NO: 2824675 - protein, 42 aa, Entamoeba invadens
QVFVHGDFIPMTIFGYFYIFLATIRALYLAFVAAWKSNADLY

SEQ ID NO: 2824676 - protein, 27 aa, Entamoeba invadens
QVHNQTVLFLINYCRQTKRVEQSKRQF

SEQ ID NO: 2824677 - protein, 18 aa, Entamoeba invadens
QVIIQVDGLLQIGICEST

SEQ ID NO: 2824678 - protein, 24 aa, Entamoeba invadens
QVLDLFVMLFERIGQIRLFEDIWC

SEQ ID NO: 2824679 - protein, 25 aa, Entamoeba invadens
QVLEEIVCFIVLEFKHFFPEDISDT

SEQ ID NO: 2824680 - protein, 17 aa, Entamoeba invadens
QVLFIDNDFSLPTFPFT

SEQ ID NO: 2824681 - protein, 22 aa, Entamoeba invadens
QVLGFSILGIALFLCVLGFYRG

SEQ ID NO: 2824682 - protein, 18 aa, Entamoeba invadens
QVLKLRRQLDEAEQRLKN

SEQ ID NO: 2824683 - protein, 23 aa, Entamoeba invadens
QVLLRKIHLYIHSLYKTTHFFQD

SEQ ID NO: 2824684 - protein, 18 aa, Entamoeba invadens
QVLVEDSMFGLTSKNSIY

SEQ ID NO: 2824685 - protein, 18 aa, Entamoeba invadens
QVMLPYTAVHTFDLTASH

SEQ ID NO: 2824686 - protein, 26 aa, Entamoeba invadens
QVMQYKTLLIIYTTTIVGIAVLVVAF

SEQ ID NO: 2824687 - protein, 29 aa, Entamoeba invadens
QVMSKRPIHYFWYYINSIVFHCFVTAIVG

SEQ ID NO: 2824688 - protein, 17 aa, Entamoeba invadens
QVQTDRLKSWGFNALPN

SEQ ID NO: 2824689 - protein, 21 aa, Entamoeba invadens
QVRGKLLSDTLFRMGGAAILL

SEQ ID NO: 2824690 - protein, 25 aa, Entamoeba invadens
QVSSLIKFCFYKNAAFFLLDVSYAF

SEQ ID NO: 2824691 - protein, 25 aa, Entamoeba invadens
QVTYYWSIFVYSVLVIPLSFLDVGR

SEQ ID NO: 2824692 - protein, 20 aa, Entamoeba invadens
QVVFIGNFLFSNLTIEKTES

SEQ ID NO: 2824693 - protein, 20 aa, Entamoeba invadens
QVVLSGFERGWIGNINTIYT

SEQ ID NO: 2824694 - protein, 17 aa, Entamoeba invadens
QVVPMQFLFELLDKLKV

SEQ ID NO: 2824695 - protein, 33 aa, Entamoeba invadens
QVVQVDSNLIFYQFFNMIYFQTTSTLENTVKCT

SEQ ID NO: 2824696 - protein, 40 aa, Entamoeba invadens
QVVSVFNYLMYLLQQIFNFILVVFAFMSGLLIYSLLISDV

SEQ ID NO: 2824697 - protein, 26 aa, Entamoeba invadens
QVYGLFTIFILLLYVSLLLSVFFMGY

SEQ ID NO: 2824698 - protein, 26 aa, Entamoeba invadens
QVYYYPSKFLFNAMLKRVLVSKTDAH

SEQ ID NO: 2824699 - protein, 33 aa, Entamoeba invadens
QWCSFIVINVVVFTLLVPFIVLGIFGNSKTTVA

SEQ ID NO: 2824700 - protein, 17 aa, Entamoeba invadens
QWMMCIGILIIGTFTML

SEQ ID NO: 2824701 - protein, 17 aa, Entamoeba invadens
QWTFVQRSWNTVIVKEG

SEQ ID NO: 2824702 - protein, 17 aa, Entamoeba invadens
QWYGSVLVLLAVLISFF

SEQ ID NO: 2824703 - protein, 18 aa, Entamoeba invadens
QYAAKSPLVNIILSKKRN

SEQ ID NO: 2824704 - protein, 26 aa, Entamoeba invadens
QYACCLTIVFAGRYIPFLEAPCGFAR

SEQ ID NO: 2824705 - protein, 20 aa, Entamoeba invadens
QYALAIILAVTLDAKLLDVC

SEQ ID NO: 2824706 - protein, 17 aa, Entamoeba invadens
QYASFGSLLLVKNSHIY

SEQ ID NO: 2824707 - protein, 18 aa, Entamoeba invadens
QYATLEKCLFMIVSSQCE

SEQ ID NO: 2824708 - protein, 19 aa, Entamoeba invadens
QYDIKISNLMLTCQYALDK

SEQ ID NO: 2824709 - protein, 22 aa, Entamoeba invadens
QYELWRLITPIFLHAGIIHLVC

SEQ ID NO: 2824710 - protein, 28 aa, Entamoeba invadens
QYFETLLSKSFIPKFPFHPTFLGKDKVQ

SEQ ID NO: 2824711 - protein, 31 aa, Entamoeba invadens
QYFPTKHGFKRGFWFKFTATQKTHIIDTCNK

SEQ ID NO: 2824712 - protein, 25 aa, Entamoeba invadens
QYFSLLLYHILIFIVYPSLVDKMTG

SEQ ID NO: 2824713 - protein, 21 aa, Entamoeba invadens
QYGCISCDIGYYLSNTKCHRC

SEQ ID NO: 2824714 - protein, 31 aa, Entamoeba invadens
QYGEDVLSNFFTLISWCFFSQQIQNVVDTRL

SEQ ID NO: 2824715 - protein, 18 aa, Entamoeba invadens
QYILWKDTTMQRRTVFLQ

SEQ ID NO: 2824716 - protein, 27 aa, Entamoeba invadens
QYIMKDFCPVLYIPLSSLFQLGTSDIS

SEQ ID NO: 2824717 - protein, 22 aa, Entamoeba invadens
QYITELFYHGVNAPSGVLGEIN

SEQ ID NO: 2824718 - protein, 17 aa, Entamoeba invadens
QYITGGYSLKSVGDNAF

SEQ ID NO: 2824719 - protein, 33 aa, Entamoeba invadens
QYKYPSYLTPFKWYFVSIYFIGLMVSGIFTPLG

SEQ ID NO: 2824720 - protein, 19 aa, Entamoeba invadens
QYLIKLFLIVLSALINFIG

SEQ ID NO: 2824721 - protein, 24 aa, Entamoeba invadens
QYLPFYIITCIGLFNAFLILLTPR

SEQ ID NO: 2824722 - protein, 30 aa, Entamoeba invadens
QYLVRTICFTYFLYSFIIDELDDIVYNISM

SEQ ID NO: 2824723 - protein, 25 aa, Entamoeba invadens
QYMPFYLMMILGITTSVLVFAFPLK

SEQ ID NO: 2824724 - protein, 21 aa, Entamoeba invadens
QYNIIALCWCQDPKSRPQMEI

SEQ ID NO: 2824725 - protein, 25 aa, Entamoeba invadens
QYNPNTPILLIGFKSDLRESNGNIE

SEQ ID NO: 2824726 - protein, 26 aa, Entamoeba invadens
QYPSNIPLLKFFNTKSLLKELFVKEK

SEQ ID NO: 2824727 - protein, 29 aa, Entamoeba invadens
QYQNIPLWWVILLIIITDIIFITFISLFA

SEQ ID NO: 2824728 - protein, 24 aa, Entamoeba invadens
QYSIRFRIIVYILLMNYIFCNYTL

SEQ ID NO: 2824729 - protein, 17 aa, Entamoeba invadens
QYSSYLYTITFLQVDKT

SEQ ID NO: 2824730 - protein, 27 aa, Entamoeba invadens
QYTAKSPLAYVLLSKKLNYDTRNELYD

SEQ ID NO: 2824731 - protein, 20 aa, Entamoeba invadens
QYTENFFSIKKTIEKLRQTG

SEQ ID NO: 2824732 - protein, 29 aa, Entamoeba invadens
QYVPPKAFIPILLLQAFSLFWVLNTVSGV

SEQ ID NO: 2824733 - protein, 23 aa, Entamoeba invadens
QYVPPVKLVWYPVALCIIPIVMI

SEQ ID NO: 2824734 - protein, 18 aa, Entamoeba invadens
QYYAVFMTLLKCGHIPNI

SEQ ID NO: 2824735 - protein, 28 aa, Entamoeba invadens
QYYHDFHFQIIPTILWDLTETTNRKEMT

SEQ ID NO: 2824736 - protein, 33 aa, Entamoeba invadens
RAADVTYFALNILYFVSLVLDPYIPEFGQKVRK

SEQ ID NO: 2824737 - protein, 36 aa, Entamoeba invadens
RAAFTISFILLIGYFLGVIFVLYFGYIQSLFLHSDW

SEQ ID NO: 2824738 - protein, 24 aa, Entamoeba invadens
RADKEFVKPVRLPELKIKSTQNHI

SEQ ID NO: 2824739 - protein, 21 aa, Entamoeba invadens
RAEKKTPWIAVRLSKYSDGYS

SEQ ID NO: 2824740 - protein, 25 aa, Entamoeba invadens
RAFQLSVTFMSKLLLHIAMFVSEFR

SEQ ID NO: 2824741 - protein, 22 aa, Entamoeba invadens
RAGLYFIYMVNSTSQVIAWIFI

SEQ ID NO: 2824742 - protein, 24 aa, Entamoeba invadens
RAGRKLFFTQLARSVLRIEPKDLT

SEQ ID NO: 2824743 - protein, 23 aa, Entamoeba invadens
RAKPIPIIFGMLYSQLKCLANML

SEQ ID NO: 2824744 - protein, 19 aa, Entamoeba invadens
RAKRRNMERLTLACGGVAL

SEQ ID NO: 2824745 - protein, 25 aa, Entamoeba invadens
RALFSKNIMLFSNTIAFVFGTSKGS

SEQ ID NO: 2824746 - protein, 26 aa, Entamoeba invadens
RALSALLLYIFITFLTLFLCYKDDLE

SEQ ID NO: 2824747 - protein, 27 aa, Entamoeba invadens
RALSALLMYLVIIFVVLFSIALSEDIY

SEQ ID NO: 2824748 - protein, 24 aa, Entamoeba invadens
RAMKWLYNDDLYKWFFDKSVSPDK

SEQ ID NO: 2824749 - protein, 24 aa, Entamoeba invadens
RAMQLMVIFLFIGMAFLVLTGMRV

SEQ ID NO: 2824750 - protein, 24 aa, Entamoeba invadens
RAMWAVPQIFDWTVYNDSYNLDWS

SEQ ID NO: 2824751 - protein, 24 aa, Entamoeba invadens
RAQTDFLLTRLFVENVDRSTQIAL

SEQ ID NO: 2824752 - protein, 26 aa, Entamoeba invadens
RAQVLKFYQRLFLNYQKYFKDVKMEE

SEQ ID NO: 2824753 - protein, 20 aa, Entamoeba invadens
RARMEAVCNMKYIYGWYSEQ

SEQ ID NO: 2824754 - protein, 35 aa, Entamoeba invadens
RASIYLIILAIVIAIIFIIIYMFSVKPIIELQRLE

SEQ ID NO: 2824755 - protein, 19 aa, Entamoeba invadens
RAYNVLSVPQALMPQMFEY

SEQ ID NO: 2824756 - protein, 20 aa, Entamoeba invadens
RCAFGFYYNLMTQRCEKCDS

SEQ ID NO: 2824757 - protein, 18 aa, Entamoeba invadens
RCAIIDGMFMGMPMFHVV

SEQ ID NO: 2824758 - protein, 19 aa, Entamoeba invadens
RCDVGYYLYNSKCVNCPSH

SEQ ID NO: 2824759 - protein, 25 aa, Entamoeba invadens
RCDYIVHFYGAIFIPNKICLVTEFA

SEQ ID NO: 2824760 - protein, 17 aa, Entamoeba invadens
RCDYIVHFYGAVFIPTK

SEQ ID NO: 2824761 - protein, 24 aa, Entamoeba invadens
RCDYLVHFYGAVFIPNRICMVTEF

SEQ ID NO: 2824762 - protein, 20 aa, Entamoeba invadens
RCELDYYYSYLTRSCHKCES

SEQ ID NO: 2824763 - protein, 25 aa, Entamoeba invadens
RCESRKWTIIGIAVGIVITLIIIII

SEQ ID NO: 2824764 - protein, 26 aa, Entamoeba invadens
RCEYIVHFYGACFLPNYLCLVTELAE

SEQ ID NO: 2824765 - protein, 24 aa, Entamoeba invadens
RCEYIVHFYGAVLIPSKMCLVTEF

SEQ ID NO: 2824766 - protein, 22 aa, Entamoeba invadens
RCEYIVSYFGSAWNKAECCLVT

SEQ ID NO: 2824767 - protein, 27 aa, Entamoeba invadens
RCFRVFILTSLLVFSVLYIVLTIGVIF

SEQ ID NO: 2824768 - protein, 22 aa, Entamoeba invadens
RCGFGFYYNLITQRCEKCNLNC

SEQ ID NO: 2824769 - protein, 18 aa, Entamoeba invadens
RCKDPYYLSSPLECNSCP

SEQ ID NO: 2824770 - protein, 24 aa, Entamoeba invadens
RCLTCAEVFYFDESTKQCVNCNSS

SEQ ID NO: 2824771 - protein, 17 aa, Entamoeba invadens
RCNYIKFEVLNNANGYN

SEQ ID NO: 2824772 - protein, 32 aa, Entamoeba invadens
RCSTHIYPWKATKWLCGVFVIILIINSIIEMS

SEQ ID NO: 2824773 - protein, 17 aa, Entamoeba invadens
RCTTCVNGYYPVNSGCS

SEQ ID NO: 2824774 - protein, 26 aa, Entamoeba invadens
RCVSCKPIYYLTQDSPPKCLPCSPNC

SEQ ID NO: 2824775 - protein, 25 aa, Entamoeba invadens
RCVTCSPLFVRKCVKCVAGSYPQTA

SEQ ID NO: 2824776 - protein, 17 aa, Entamoeba invadens
RCYQCITGYFLIHNQCE

SEQ ID NO: 2824777 - protein, 20 aa, Entamoeba invadens
RDCLFECFGIIIGLSRAELC

SEQ ID NO: 2824778 - protein, 44 aa, Entamoeba invadens
RDDKLFCDTLNLTKTLLIIFLGCVLVLIITSIVVSLIGYQIIHS

SEQ ID NO: 2824779 - protein, 44 aa, Entamoeba invadens
RDDKLFCDTLNLTKTLLVIFLGCVLVLIITSIVVSLIGYQIIHS

SEQ ID NO: 2824780 - protein, 28 aa, Entamoeba invadens
RDEIDMKLRIKFLLDAAKGIQYLHENGI

SEQ ID NO: 2824781 - protein, 23 aa, Entamoeba invadens
RDESFDVLFYNSSTLECSGLSLI

SEQ ID NO: 2824782 - protein, 18 aa, Entamoeba invadens
RDGFYFKDKKCVKCPDGC

SEQ ID NO: 2824783 - protein, 31 aa, Entamoeba invadens
RDGSRIHSDFIYLKPINFALFSEKTLAMMVS

SEQ ID NO: 2824784 - protein, 17 aa, Entamoeba invadens
RDGYFPHNGKCTRYLGD

SEQ ID NO: 2824785 - protein, 23 aa, Entamoeba invadens
RDIKPDNFLVFSLKENELANAKL

SEQ ID NO: 2824786 - protein, 26 aa, Entamoeba invadens
RDIKPDNILIFSFDLNVKANAKLTDF

SEQ ID NO: 2824787 - protein, 17 aa, Entamoeba invadens
RDIKPDNILIFSLDLNV

SEQ ID NO: 2824788 - protein, 18 aa, Entamoeba invadens
RDIKPDNILIFSLDNNER

SEQ ID NO: 2824789 - protein, 19 aa, Entamoeba invadens
RDIKPDNILIFSLDSNVVV

SEQ ID NO: 2824790 - protein, 18 aa, Entamoeba invadens
RDIKPDNILIFSLDVNYN

SEQ ID NO: 2824791 - protein, 27 aa, Entamoeba invadens
RDIKPDNILIVSLDFNTKVFGKLTDFG

SEQ ID NO: 2824792 - protein, 26 aa, Entamoeba invadens
RDIKPDNILVFLLDMNDKINAKLTDF

SEQ ID NO: 2824793 - protein, 22 aa, Entamoeba invadens
RDIKPDNILVFSLDLNNTVNAK

SEQ ID NO: 2824794 - protein, 18 aa, Entamoeba invadens
RDIKPDNILVFSLNINDK

SEQ ID NO: 2824795 - protein, 22 aa, Entamoeba invadens
RDIKPDNILVISLDLIEKVNAK

SEQ ID NO: 2824796 - protein, 21 aa, Entamoeba invadens
RDIKPDNILVISLDLNEKVNA

SEQ ID NO: 2824797 - protein, 25 aa, Entamoeba invadens
RDIKPDNILVITLEKNIKANGKLTD

SEQ ID NO: 2824798 - protein, 19 aa, Entamoeba invadens
RDIKPDNLLVFSLDLGATV

SEQ ID NO: 2824799 - protein, 17 aa, Entamoeba invadens
RDIKPDNLLVMSLDITE

SEQ ID NO: 2824800 - protein, 26 aa, Entamoeba invadens
RDIKPDNMLIFSLKKDILVNAKLTDF

SEQ ID NO: 2824801 - protein, 19 aa, Entamoeba invadens
RDIKPDNVLLFSLNPNDVV

SEQ ID NO: 2824802 - protein, 17 aa, Entamoeba invadens
RDIKPDNYLIFSLDSNE

SEQ ID NO: 2824803 - protein, 36 aa, Entamoeba invadens
RDILKMVGWYNIFSLLFIVLFAPQLTLFLKLVKFHN

SEQ ID NO: 2824804 - protein, 23 aa, Entamoeba invadens
RDLKIPYTVWFSKSKRTLIEISN

SEQ ID NO: 2824805 - protein, 23 aa, Entamoeba invadens
RDLLSEFFFRYEVVMSIHCQQSV

SEQ ID NO: 2824806 - protein, 25 aa, Entamoeba invadens
RDLQKEYVFPPIKYSRQILYLNYKM

SEQ ID NO: 2824807 - protein, 26 aa, Entamoeba invadens
RDLQKEYVFPPIKYSRQILYLNYKMT

SEQ ID NO: 2824808 - protein, 25 aa, Entamoeba invadens
RDLQKEYVFPPIKYSRQIRYLNYKM

SEQ ID NO: 2824809 - protein, 24 aa, Entamoeba invadens
RDLRRFMYSLKNTKIKKIHFLAHS

SEQ ID NO: 2824810 - protein, 18 aa, Entamoeba invadens
RDLWLTAVGFRDELYWQN

SEQ ID NO: 2824811 - protein, 26 aa, Entamoeba invadens
RDSIILLFGLLLYSLFAISLHSNNGD

SEQ ID NO: 2824812 - protein, 25 aa, Entamoeba invadens
RDSRKRMLYLRLPSILMQTKSNKSM

SEQ ID NO: 2824813 - protein, 24 aa, Entamoeba invadens
RDSTMLYSPYLFIDGTTYQNSTFQ

SEQ ID NO: 2824814 - protein, 35 aa, Entamoeba invadens
RDTLIDQWLVSDFLPSLLYTLLSHIRKALLLFTNF

SEQ ID NO: 2824815 - protein, 22 aa, Entamoeba invadens
RDTPLFFTKMVDLLSGSYGFSN

SEQ ID NO: 2824816 - protein, 39 aa, Entamoeba invadens
RDTYYYLPNCSYAFSSYLRFWDISVYALRDIFVLCSVGE

SEQ ID NO: 2824817 - protein, 20 aa, Entamoeba invadens
RDVFFRYPTRLQNPVLKGVS

SEQ ID NO: 2824818 - protein, 17 aa, Entamoeba invadens
RDVKCLVCKPGYYLSNK

SEQ ID NO: 2824819 - protein, 19 aa, Entamoeba invadens
RDVKPDNILLVSLEYNLIA

SEQ ID NO: 2824820 - protein, 26 aa, Entamoeba invadens
RDVKPDNMLVFSLDPTLKVNGKLTDF

SEQ ID NO: 2824821 - protein, 19 aa, Entamoeba invadens
RDYAYKYFLLKNENGAVTY

SEQ ID NO: 2824822 - protein, 23 aa, Entamoeba invadens
REAILLSLKTLFLIIETYIFVNT

SEQ ID NO: 2824823 - protein, 24 aa, Entamoeba invadens
REANLFYAEFIRDFSCLFKRGEVT

SEQ ID NO: 2824824 - protein, 18 aa, Entamoeba invadens
REASIQVLKLRRQLDEAE

SEQ ID NO: 2824825 - protein, 26 aa, Entamoeba invadens
REAYPKSEFKFPWKIADFVNGGNRLQ

SEQ ID NO: 2824826 - protein, 18 aa, Entamoeba invadens
RECIHLLEDILFEDGFVV

SEQ ID NO: 2824827 - protein, 17 aa, Entamoeba invadens
RECTKCVSGNYLDTDKT

SEQ ID NO: 2824828 - protein, 26 aa, Entamoeba invadens
REDKEFYFKLPYKLKVRMLYDTARGM

SEQ ID NO: 2824829 - protein, 46 aa, Entamoeba invadens
REEEKTPAWIIIVVVFFDLGILAFALFVVLIILKLVSNIRKVDINT

SEQ ID NO: 2824830 - protein, 18 aa, Entamoeba invadens
REEKYKIFSFDKEKFNFF

SEQ ID NO: 2824831 - protein, 27 aa, Entamoeba invadens
REENDDFIRLPYRLKVRMLYDTAKGMQ

SEQ ID NO: 2824832 - protein, 19 aa, Entamoeba invadens
REFESIFPEPGWVEQDPNM

SEQ ID NO: 2824833 - protein, 18 aa, Entamoeba invadens
REFLPYTSRHFLNVNYGH

SEQ ID NO: 2824834 - protein, 35 aa, Entamoeba invadens
REGSLLPLFFLLLQQSFALAFFWSICEYMLSNEVY

SEQ ID NO: 2824835 - protein, 23 aa, Entamoeba invadens
REILLRIVIGQKIMLLLLLKHKK

SEQ ID NO: 2824836 - protein, 23 aa, Entamoeba invadens
REKGKKIYAVLFVYRAADAKQNT

SEQ ID NO: 2824837 - protein, 37 aa, Entamoeba invadens
REKSHFMFDIAFYAFFIGVLAVYYFVLKNGGLSYIAG

SEQ ID NO: 2824838 - protein, 36 aa, Entamoeba invadens
REMVYISVLNYLGFSFLFVKPKKFIIRKTLPFLHID

SEQ ID NO: 2824839 - protein, 20 aa, Entamoeba invadens
RENCECHAELGFFSDGQGNC

SEQ ID NO: 2824840 - protein, 22 aa, Entamoeba invadens
RENEIDFLKPLDKTPFENIYSY

SEQ ID NO: 2824841 - protein, 28 aa, Entamoeba invadens
REPKSFVVLFIQVTYFITIVTLPMVHMI

SEQ ID NO: 2824842 - protein, 28 aa, Entamoeba invadens
REQEDWELWLWFGVICGVIIVFVVIVLG

SEQ ID NO: 2824843 - protein, 27 aa, Entamoeba invadens
REQRICSLSFLPLGHVFAIVVEFIMYR

SEQ ID NO: 2824844 - protein, 25 aa, Entamoeba invadens
RERGVCVFPMKKSNILMKVLGNNIF

SEQ ID NO: 2824845 - protein, 26 aa, Entamoeba invadens
RERGVCVFPMKKSNIPMKVLGNNILT

SEQ ID NO: 2824846 - protein, 20 aa, Entamoeba invadens
RESLFVLDDSKLSYYDLETN

SEQ ID NO: 2824847 - protein, 24 aa, Entamoeba invadens
RETIRLLQDLLSEFGYFVEIEKEN

SEQ ID NO: 2824848 - protein, 47 aa, Entamoeba invadens
RETLRSKVFSFWSYLKWFLLGIFQALVFFIVVFFIINKTDVTYYGKV

SEQ ID NO: 2824849 - protein, 24 aa, Entamoeba invadens
RETNWRAYAYSSLSVRLYPSSDSS

SEQ ID NO: 2824850 - protein, 32 aa, Entamoeba invadens
REWYFEHIYIIVVLFFALLFDSTYSFLYLYQS

SEQ ID NO: 2824851 - protein, 26 aa, Entamoeba invadens
RFAPTALFILYFQMPSFQELFLDHIK

SEQ ID NO: 2824852 - protein, 28 aa, Entamoeba invadens
RFAQIPVFVLLVLAFIFLCLIRNRHKEY

SEQ ID NO: 2824853 - protein, 21 aa, Entamoeba invadens
RFCYYCINGFIASNGVCVCPT

SEQ ID NO: 2824854 - protein, 19 aa, Entamoeba invadens
RFEKPWMVPQFIIEGNRLE

SEQ ID NO: 2824855 - protein, 24 aa, Entamoeba invadens
RFENVCDYGYFPYNNYCWETSIYF

SEQ ID NO: 2824856 - protein, 23 aa, Entamoeba invadens
RFETFFELHFNPNTFFLKKERIL

SEQ ID NO: 2824857 - protein, 26 aa, Entamoeba invadens
RFETPELLTYLYFTSLKDFDNTVWKS

SEQ ID NO: 2824858 - protein, 18 aa, Entamoeba invadens
RFGGFWAKQWGDKTKTNS

SEQ ID NO: 2824859 - protein, 21 aa, Entamoeba invadens
RFGKWLKLDNSKLTQPYLYVN

SEQ ID NO: 2824860 - protein, 18 aa, Entamoeba invadens
RFGYKRFLLFKEGENYEN

SEQ ID NO: 2824861 - protein, 27 aa, Entamoeba invadens
RFIDDKYIFRIWDAVFAFPSSKFYYFI

SEQ ID NO: 2824862 - protein, 18 aa, Entamoeba invadens
RFIIRKKQLKTMKLNKRI

SEQ ID NO: 2824863 - protein, 19 aa, Entamoeba invadens
RFKYAWDIADFTSAGKRLV

SEQ ID NO: 2824864 - protein, 19 aa, Entamoeba invadens
RFLLPDTPQKYIWPSALRL

SEQ ID NO: 2824865 - protein, 19 aa, Entamoeba invadens
RFNHKIRIKPIAQKALFIA

SEQ ID NO: 2824866 - protein, 19 aa, Entamoeba invadens
RFNLLLLEPGEQYLNDCAC

SEQ ID NO: 2824867 - protein, 26 aa, Entamoeba invadens
RFNQFVLFMIVFQTVVCLLLAVFSAL

SEQ ID NO: 2824868 - protein, 17 aa, Entamoeba invadens
RFNSLILKDSWLPPEKF

SEQ ID NO: 2824869 - protein, 17 aa, Entamoeba invadens
RFNVLFFATISKTLFTI

SEQ ID NO: 2824870 - protein, 17 aa, Entamoeba invadens
RFSIKNFFSVPTMATIF

SEQ ID NO: 2824871 - protein, 19 aa, Entamoeba invadens
RFSLRVTPSCAILKKGEAC

SEQ ID NO: 2824872 - protein, 17 aa, Entamoeba invadens
RFTYCAVFTLKLIGKLD

SEQ ID NO: 2824873 - protein, 31 aa, Entamoeba invadens
RFVFSAVLAQPYFYFLTFFSSVVGVAPNIIR

SEQ ID NO: 2824874 - protein, 17 aa, Entamoeba invadens
RFVIDSLLTFYSKHTLK

SEQ ID NO: 2824875 - protein, 25 aa, Entamoeba invadens
RFYEKILMRLNEVLKKSKLAAKVKD

SEQ ID NO: 2824876 - protein, 38 aa, Entamoeba invadens
RGALIYAFVMGTLGYLLYGLQVYLKYNTSAYLTCFFFF

SEQ ID NO: 2824877 - protein, 20 aa, Entamoeba invadens
RGCIQCDTGYYLFFSECNKC

SEQ ID NO: 2824878 - protein, 18 aa, Entamoeba invadens
RGCLSCKSGYYSTTKFEC

SEQ ID NO: 2824879 - protein, 23 aa, Entamoeba invadens
RGCSLCPAGYFSPGGISTCTVCR

SEQ ID NO: 2824880 - protein, 17 aa, Entamoeba invadens
RGCTKCKSGMYPQQNGR

SEQ ID NO: 2824881 - protein, 19 aa, Entamoeba invadens
RGCYSCKSGYYREKLDCEP

SEQ ID NO: 2824882 - protein, 26 aa, Entamoeba invadens
RGEACEFEVFIIPLCTMKMTDEIKIV

SEQ ID NO: 2824883 - protein, 17 aa, Entamoeba invadens
RGFACEFEIYIKPLCSC

SEQ ID NO: 2824884 - protein, 22 aa, Entamoeba invadens
RGFPHIVTALQVLLNGTFPLPE

SEQ ID NO: 2824885 - protein, 19 aa, Entamoeba invadens
RGFYLKNGVCLRCPDRCQK

SEQ ID NO: 2824886 - protein, 22 aa, Entamoeba invadens
RGGAGVIYYGMYRKSRVAVKKV

SEQ ID NO: 2824887 - protein, 31 aa, Entamoeba invadens
RGIFKDLIFMITLLLLFLSLAGKMPIGSNGQ

SEQ ID NO: 2824888 - protein, 50 aa, Entamoeba invadens
RGIIYTIMQIIFSAVFKFAPLPLFVGWYTILFTVFFNEVPIMLIVTDFDM

SEQ ID NO: 2824889 - protein, 26 aa, Entamoeba invadens
RGIRRYFFSFFVQFYHQIDCIYSLLN

SEQ ID NO: 2824890 - protein, 37 aa, Entamoeba invadens
RGISAYGWYIVLQQPSFYLICIIAVSVTTLPQIGALQ

SEQ ID NO: 2824891 - protein, 17 aa, Entamoeba invadens
RGKILYDAARGLEYLHR

SEQ ID NO: 2824892 - protein, 21 aa, Entamoeba invadens
RGLDTTMHIPQGLRLKALNIC

SEQ ID NO: 2824893 - protein, 24 aa, Entamoeba invadens
RGLTFPITKFTHKGSVVILGTGVT

SEQ ID NO: 2824894 - protein, 18 aa, Entamoeba invadens
RGNIIAIKKIKQVNNNDK

SEQ ID NO: 2824895 - protein, 17 aa, Entamoeba invadens
RGNVVAIKKMKQLDSNE

SEQ ID NO: 2824896 - protein, 23 aa, Entamoeba invadens
RGQTVVVKKFKLSWTEEARSFFV

SEQ ID NO: 2824897 - protein, 27 aa, Entamoeba invadens
RGTAVTGFVFLLGMFASFGLKLNKHIP

SEQ ID NO: 2824898 - protein, 21 aa, Entamoeba invadens
RGWDRWLYTISFYRLSHNAFS

SEQ ID NO: 2824899 - protein, 20 aa, Entamoeba invadens
RGYACEFSIYIKPVCTCNIS

SEQ ID NO: 2824900 - protein, 19 aa, Entamoeba invadens
RGYWDNNNNFKWFRPSSFF

SEQ ID NO: 2824901 - protein, 18 aa, Entamoeba invadens
RHAELFSFLSIDPNIVFD

SEQ ID NO: 2824902 - protein, 24 aa, Entamoeba invadens
RHAQSVELCWWVLCGKTANVCQQC

SEQ ID NO: 2824903 - protein, 17 aa, Entamoeba invadens
RHFVWTQKEGNDWVTKT

SEQ ID NO: 2824904 - protein, 33 aa, Entamoeba invadens
RHGSWYGVRNLLNTPFPIFVQTVALKQNRKNYN

SEQ ID NO: 2824905 - protein, 18 aa, Entamoeba invadens
RHIWKPFVLYNKCKNEFW

SEQ ID NO: 2824906 - protein, 19 aa, Entamoeba invadens
RHLGKLILFHGRCSLLRNS

SEQ ID NO: 2824907 - protein, 17 aa, Entamoeba invadens
RHLIFSFLSLVAAILTA

SEQ ID NO: 2824908 - protein, 19 aa, Entamoeba invadens
RHLLLSQNWMDFLASLPQT

SEQ ID NO: 2824909 - protein, 31 aa, Entamoeba invadens
RHLSDMPLFKLSTISIVALIISSLTQFDFGV

SEQ ID NO: 2824910 - protein, 25 aa, Entamoeba invadens
RHPCTVQYLGFWYEDNRLCVAMEYF

SEQ ID NO: 2824911 - protein, 26 aa, Entamoeba invadens
RHTTMIQPIFVLFKNSSMTLNTKCNK

SEQ ID NO: 2824912 - protein, 19 aa, Entamoeba invadens
RHYLSFLSENFRVEVKMTL

SEQ ID NO: 2824913 - protein, 26 aa, Entamoeba invadens
RIAFFCFVTLGIFWWVVTTYSVLYKT

SEQ ID NO: 2824914 - protein, 52 aa, Entamoeba invadens
RIALTEGYIFLVVFFLLSWYYQPGYYIPYLFACVLFVLFSVFVYSTELRLKR

SEQ ID NO: 2824915 - protein, 33 aa, Entamoeba invadens
RIAQSFVPEFLRLPVWMLLLGIDINESYTLYAE

SEQ ID NO: 2824916 - protein, 20 aa, Entamoeba invadens
RICIICENNYYPKQGRCVPC

SEQ ID NO: 2824917 - protein, 25 aa, Entamoeba invadens
RICKQCEFGYFLKDKDCLDCHEIHT

SEQ ID NO: 2824918 - protein, 19 aa, Entamoeba invadens
RICYNLFLTWWTNQIDEEH

SEQ ID NO: 2824919 - protein, 21 aa, Entamoeba invadens
RIDSIPVNLFNFINNSWQQDA

SEQ ID NO: 2824920 - protein, 34 aa, Entamoeba invadens
RIDSVDYLILITQKTLITKVLSHKLFKVEKYEIV

SEQ ID NO: 2824921 - protein, 23 aa, Entamoeba invadens
RIDTRFWVIFIPIYFMVFCMICI

SEQ ID NO: 2824922 - protein, 17 aa, Entamoeba invadens
RIECHTFRYTLFTILHT

SEQ ID NO: 2824923 - protein, 21 aa, Entamoeba invadens
RIEVSLPYTGIALLGNSYHNW

SEQ ID NO: 2824924 - protein, 25 aa, Entamoeba invadens
RIEYKIIRGYYWTCNKSDLLSNEMS

SEQ ID NO: 2824925 - protein, 19 aa, Entamoeba invadens
RIHEVFYNNVLLLGAEDIV

SEQ ID NO: 2824926 - protein, 23 aa, Entamoeba invadens
RIHPKIFYYTSLIVHLFNYGVIA

SEQ ID NO: 2824927 - protein, 18 aa, Entamoeba invadens
RIINPICEYPLIYNKTNH

SEQ ID NO: 2824928 - protein, 21 aa, Entamoeba invadens
RIIPLQCQTNYIFDTTTNQCV

SEQ ID NO: 2824929 - protein, 18 aa, Entamoeba invadens
RILIWKKLLTRWSTMIWR

SEQ ID NO: 2824930 - protein, 18 aa, Entamoeba invadens
RILKYLDLMVKSLVPAKW

SEQ ID NO: 2824931 - protein, 25 aa, Entamoeba invadens
RILVYFLICYCCCIELPITSLSGDQ

SEQ ID NO: 2824932 - protein, 24 aa, Entamoeba invadens
RINTLIDWWYLPLCAIMINVINFS

SEQ ID NO: 2824933 - protein, 17 aa, Entamoeba invadens
RIRNGLTGLIYEKALRL

SEQ ID NO: 2824934 - protein, 26 aa, Entamoeba invadens
RIRYSLLTIFLCYFVSFMLFPRFLST

SEQ ID NO: 2824935 - protein, 18 aa, Entamoeba invadens
RISIIPFNRKTGGVALQQ

SEQ ID NO: 2824936 - protein, 19 aa, Entamoeba invadens
RITFALFDSLLKENKPFVF

SEQ ID NO: 2824937 - protein, 27 aa, Entamoeba invadens
RITLKELLAYGMYAIAAGATILMIVAV

SEQ ID NO: 2824938 - protein, 19 aa, Entamoeba invadens
RITLPYRLKVRMLQDTARG

SEQ ID NO: 2824939 - protein, 25 aa, Entamoeba invadens
RITTYEVTLPTNLLGRETNWRAYAY

SEQ ID NO: 2824940 - protein, 20 aa, Entamoeba invadens
RIVTCYMTIYCTTKLKGMKI

SEQ ID NO: 2824941 - protein, 40 aa, Entamoeba invadens
RIVWEWRTFHFITISIFLFLFLLCLTFSVVMGAASFQSAA

SEQ ID NO: 2824942 - protein, 18 aa, Entamoeba invadens
RIVYIVFFTVISCGYLVY

SEQ ID NO: 2824943 - protein, 17 aa, Entamoeba invadens
RIYCHLVYTSNNTYRYL

SEQ ID NO: 2824944 - protein, 17 aa, Entamoeba invadens
RIYTCFDFSKELPIMNL

SEQ ID NO: 2824945 - protein, 18 aa, Entamoeba invadens
RKCEKCFTGKYPVLNLTT

SEQ ID NO: 2824946 - protein, 20 aa, Entamoeba invadens
RKCEYYTNIKYCASATNGLC

SEQ ID NO: 2824947 - protein, 18 aa, Entamoeba invadens
RKCIDCVNGYYPDSNGMC

SEQ ID NO: 2824948 - protein, 21 aa, Entamoeba invadens
RKCIVCSSGYYPKNDGDFRCR

SEQ ID NO: 2824949 - protein, 23 aa, Entamoeba invadens
RKCKVCAIGFYPDDASGKCVACA

SEQ ID NO: 2824950 - protein, 32 aa, Entamoeba invadens
RKCNKCKAGYYPQIVYPYKCILCDITCNGQCD

SEQ ID NO: 2824951 - protein, 18 aa, Entamoeba invadens
RKCTQCNAGYYLVNNKCV

SEQ ID NO: 2824952 - protein, 18 aa, Entamoeba invadens
RKCTQCNAGYYLVNNRCV

SEQ ID NO: 2824953 - protein, 19 aa, Entamoeba invadens
RKCTQCNAGYYLVNNRCVA

SEQ ID NO: 2824954 - protein, 23 aa, Entamoeba invadens
RKCTTCEMGYYPNDNFKCQKCDS

SEQ ID NO: 2824955 - protein, 18 aa, Entamoeba invadens
RKCTTCMSGYYPDTNGVC

SEQ ID NO: 2824956 - protein, 19 aa, Entamoeba invadens
RKCVECMNGYYPNLSGQCV

SEQ ID NO: 2824957 - protein, 19 aa, Entamoeba invadens
RKCVSCISNYYPNSTYKCQ

SEQ ID NO: 2824958 - protein, 18 aa, Entamoeba invadens
RKCVTCDTGYYPGSNGTC

SEQ ID NO: 2824959 - protein, 19 aa, Entamoeba invadens
RKCVTCDTGYYPSSNGTCV

SEQ ID NO: 2824960 - protein, 17 aa, Entamoeba invadens
RKCVTCRNGKYPKYGVN

SEQ ID NO: 2824961 - protein, 20 aa, Entamoeba invadens
RKCYECQIGYYPSSSTNMCI

SEQ ID NO: 2824962 - protein, 26 aa, Entamoeba invadens
RKDAIDSVLSLLLHIPPAGKNHIQIS

SEQ ID NO: 2824963 - protein, 21 aa, Entamoeba invadens
RKDDKDFKYAWNIADFTSSGK

SEQ ID NO: 2824964 - protein, 27 aa, Entamoeba invadens
RKEAQVCVFLMKRSNVTMIPLPNGIVS

SEQ ID NO: 2824965 - protein, 20 aa, Entamoeba invadens
RKEDVINEILPFVKHFALGG

SEQ ID NO: 2824966 - protein, 25 aa, Entamoeba invadens
RKEIFGELFCYLNLKRYSESNATLM

SEQ ID NO: 2824967 - protein, 26 aa, Entamoeba invadens
RKEKEDFVILPYKLKVRMLFDTARGM

SEQ ID NO: 2824968 - protein, 31 aa, Entamoeba invadens
RKEKEDYIMFSYKLKVRLLFDTARGMQFLHE

SEQ ID NO: 2824969 - protein, 26 aa, Entamoeba invadens
RKEKEYYVVLPYKLKVRMLFDTARGM

SEQ ID NO: 2824970 - protein, 26 aa, Entamoeba invadens
RKERQDYLKLPYKLKVRMLFDTSKGM

SEQ ID NO: 2824971 - protein, 33 aa, Entamoeba invadens
RKEVILELLMFFININDIFSATLLFVHINTTLF

SEQ ID NO: 2824972 - protein, 17 aa, Entamoeba invadens
RKFICCGPLLSVMNMKD

SEQ ID NO: 2824973 - protein, 19 aa, Entamoeba invadens
RKFIQFQVTVNISALALCV

SEQ ID NO: 2824974 - protein, 21 aa, Entamoeba invadens
RKGIFKWGFLLGIFEGINVFI

SEQ ID NO: 2824975 - protein, 21 aa, Entamoeba invadens
RKGYWIVLDELNLAPSEVLEA

SEQ ID NO: 2824976 - protein, 24 aa, Entamoeba invadens
RKHPLDVNFLIRSFEEFKNQKFVH

SEQ ID NO: 2824977 - protein, 26 aa, Entamoeba invadens
RKIIEFIKGFGWKLWVLAFIQMSATV

SEQ ID NO: 2824978 - protein, 19 aa, Entamoeba invadens
RKIIKKLIIILVKTGQNKN

SEQ ID NO: 2824979 - protein, 24 aa, Entamoeba invadens
RKKLKDFLIFRVMKVTWKKSQFFV

SEQ ID NO: 2824980 - protein, 21 aa, Entamoeba invadens
RKKTIDLLRLKVTAEKIIEHH

SEQ ID NO: 2824981 - protein, 23 aa, Entamoeba invadens
RKLFPLLLMLIIEAVSQTIINSY

SEQ ID NO: 2824982 - protein, 18 aa, Entamoeba invadens
RKLGEGSFGIVYKGTYRG

SEQ ID NO: 2824983 - protein, 23 aa, Entamoeba invadens
RKNEQIPPMKIRVKMMIDGARGI

SEQ ID NO: 2824984 - protein, 25 aa, Entamoeba invadens
RKNTEYMKWLRKRVVDLMAVFPSYM

SEQ ID NO: 2824985 - protein, 20 aa, Entamoeba invadens
RKQWGNLLRNFSEKPLEDTL

SEQ ID NO: 2824986 - protein, 21 aa, Entamoeba invadens
RKRWPFILCSLFIGQLLVVLG

SEQ ID NO: 2824987 - protein, 25 aa, Entamoeba invadens
RKRYATLPLYESKTPIFDRTVTVKL

SEQ ID NO: 2824988 - protein, 23 aa, Entamoeba invadens
RKSEQIPPMKIRVKMMMDGAKGV

SEQ ID NO: 2824989 - protein, 23 aa, Entamoeba invadens
RKSSVFFLVYSITSIYSFKKIQE

SEQ ID NO: 2824990 - protein, 28 aa, Entamoeba invadens
RKTIQFHCLFLPIIPSFVVAYKISQASD

SEQ ID NO: 2824991 - protein, 22 aa, Entamoeba invadens
RKTKLVTITIPTTVTTLGIHVF

SEQ ID NO: 2824992 - protein, 44 aa, Entamoeba invadens
RKVALDLGIKHIFVPTFLVYPIQRLPRYLMLIETLIKNTPDTSE

SEQ ID NO: 2824993 - protein, 19 aa, Entamoeba invadens
RKVFSTVIFQFLIPALVLS

SEQ ID NO: 2824994 - protein, 25 aa, Entamoeba invadens
RLAILTIRIIILLLTTLFASFLADI

SEQ ID NO: 2824995 - protein, 28 aa, Entamoeba invadens
RLASTAVFVILLFSYLFCYISLEDVEEM

SEQ ID NO: 2824996 - protein, 20 aa, Entamoeba invadens
RLCVAMEYFSKKSLFDVLHS

SEQ ID NO: 2824997 - protein, 19 aa, Entamoeba invadens
RLDSFIRYAVQKKPFIEQK

SEQ ID NO: 2824998 - protein, 25 aa, Entamoeba invadens
RLETSNALLQFSKELGLFLTCSAED

SEQ ID NO: 2824999 - protein, 21 aa, Entamoeba invadens
RLFYLVLLLDICIVSLLYSSS

SEQ ID NO: 2825000 - protein, 27 aa, Entamoeba invadens
RLGYDIIRGIFYLHYKGIIHYDIKPQN

SEQ ID NO: 2825001 - protein, 28 aa, Entamoeba invadens
RLIDFWGIFICCVVIATAAFFEDVNLEL

SEQ ID NO: 2825002 - protein, 28 aa, Entamoeba invadens
RLIEIDWTTAFFPLTSYTKTLSFLKEPD

SEQ ID NO: 2825003 - protein, 17 aa, Entamoeba invadens
RLISFDKNKLVLNNINL

SEQ ID NO: 2825004 - protein, 17 aa, Entamoeba invadens
RLIYWVIEALVVSALVF

SEQ ID NO: 2825005 - protein, 31 aa, Entamoeba invadens
RLKCTKVNLALILPLSIAGGLILIAVILVFI

SEQ ID NO: 2825006 - protein, 18 aa, Entamoeba invadens
RLKIGPIVDTLKLFWEQE

SEQ ID NO: 2825007 - protein, 31 aa, Entamoeba invadens
RLKKAPITVKPLLILPLYSALPPEQQLLVFQ

SEQ ID NO: 2825008 - protein, 24 aa, Entamoeba invadens
RLKKAYPIDTFKFPWKIAEFVTAG

SEQ ID NO: 2825009 - protein, 23 aa, Entamoeba invadens
RLKNLKKFRIFLKDLNSIEMLLK

SEQ ID NO: 2825010 - protein, 21 aa, Entamoeba invadens
RLKQLLLSEKSLCFDSLSRGV

SEQ ID NO: 2825011 - protein, 25 aa, Entamoeba invadens
RLKRLFGEVGMGHLLVLAVGAIVIF

SEQ ID NO: 2825012 - protein, 24 aa, Entamoeba invadens
RLKTTNRFVLFRVILNNYRHEYIL

SEQ ID NO: 2825013 - protein, 21 aa, Entamoeba invadens
RLLVEGIELGRQHLFDYIPQV

SEQ ID NO: 2825014 - protein, 22 aa, Entamoeba invadens
RLNPEAFVLFKVINEDFINNAG

SEQ ID NO: 2825015 - protein, 17 aa, Entamoeba invadens
RLNVAEVFLWNTADGRV

SEQ ID NO: 2825016 - protein, 44 aa, Entamoeba invadens
RLPFSTTPLSLVLILSPMLLCFLISFQLFFHKETLFYSSSQRQF

SEQ ID NO: 2825017 - protein, 26 aa, Entamoeba invadens
RLPKRPVDDFGEGVFLNCLNLDHVYL

SEQ ID NO: 2825018 - protein, 19 aa, Entamoeba invadens
RLPSALRTKLKDFQKDGFL

SEQ ID NO: 2825019 - protein, 27 aa, Entamoeba invadens
RLRNKYYPFLLIIFPEGTRAKPERILE

SEQ ID NO: 2825020 - protein, 17 aa, Entamoeba invadens
RLRNPFVAGYMGSVTYL

SEQ ID NO: 2825021 - protein, 21 aa, Entamoeba invadens
RLSHTQIRWNELTSVLGLSRT

SEQ ID NO: 2825022 - protein, 27 aa, Entamoeba invadens
RLSNLFMRFLAIYLPHIAIICSIVIAA

SEQ ID NO: 2825023 - protein, 17 aa, Entamoeba invadens
RLSQIYQGASLFFIEKE

SEQ ID NO: 2825024 - protein, 32 aa, Entamoeba invadens
RLSSFNLFLIKIILYLFYIYSIAVKCIRVNQN

SEQ ID NO: 2825025 - protein, 19 aa, Entamoeba invadens
RLSTTQKLCLPFSEMLNCE

SEQ ID NO: 2825026 - protein, 38 aa, Entamoeba invadens
RLSYVIIYSFYKNIVMYLTQFWFLSFNGYSGTSLFENW

SEQ ID NO: 2825027 - protein, 34 aa, Entamoeba invadens
RLTGSLCLQLFFIFLLTLLFLRGAYKTVTTPVGT

SEQ ID NO: 2825028 - protein, 30 aa, Entamoeba invadens
RLTIEKVLSQPLFWSFKKRLDFLQKASDLM

SEQ ID NO: 2825029 - protein, 21 aa, Entamoeba invadens
RLTNFFIGHISSCLIFPATLS

SEQ ID NO: 2825030 - protein, 20 aa, Entamoeba invadens
RLTPLLYQICIETTYNNVRN

SEQ ID NO: 2825031 - protein, 33 aa, Entamoeba invadens
RLVALFLALFGVKFIYRMTLLLTAFVIPEDQNK

SEQ ID NO: 2825032 - protein, 25 aa, Entamoeba invadens
RLVWKEIRGTWQWINGRTYEVKPEL

SEQ ID NO: 2825033 - protein, 30 aa, Entamoeba invadens
RLYDDYMMALYNFIFTSIPPVFISFFDSDL

SEQ ID NO: 2825034 - protein, 27 aa, Entamoeba invadens
RLYKTKENIKWFLEIGMKYIMIEIVQD

SEQ ID NO: 2825035 - protein, 20 aa, Entamoeba invadens
RLYMVLWGIIFYCCQQTEVF

SEQ ID NO: 2825036 - protein, 20 aa, Entamoeba invadens
RMCELYWDYSIRRRWDSFYT

SEQ ID NO: 2825037 - protein, 18 aa, Entamoeba invadens
RMCFLQMGSLLYNSKEKQ

SEQ ID NO: 2825038 - protein, 36 aa, Entamoeba invadens
RMDVSVIPIAIFVLLWVLKSLTLMIIPLCTISVSFA

SEQ ID NO: 2825039 - protein, 26 aa, Entamoeba invadens
RMEFSRRWMLTNLKKYKAVYLMTLAG

SEQ ID NO: 2825040 - protein, 26 aa, Entamoeba invadens
RMEWKQLLLCILAMFISQLSTLIMPV

SEQ ID NO: 2825041 - protein, 17 aa, Entamoeba invadens
RMFAFHDFVLHNREKYD

SEQ ID NO: 2825042 - protein, 27 aa, Entamoeba invadens
RMIHNILVSLRLLLLNALSNILNSMDQ

SEQ ID NO: 2825043 - protein, 20 aa, Entamoeba invadens
RMKTRTKFISECAKGILYLH

SEQ ID NO: 2825044 - protein, 26 aa, Entamoeba invadens
RMLETSKMMLYLGNKLYRICPRIWAY

SEQ ID NO: 2825045 - protein, 31 aa, Entamoeba invadens
RMMKKEINYLMNSPFRKANLSRSQKLGLSYS

SEQ ID NO: 2825046 - protein, 28 aa, Entamoeba invadens
RMNQFVFGIFVFKIIIVAIAAGLSGWYV

SEQ ID NO: 2825047 - protein, 21 aa, Entamoeba invadens
RMRIEIISELLRLIQIAFIAS

SEQ ID NO: 2825048 - protein, 20 aa, Entamoeba invadens
RMRRDLWKLNPETGFLFSPN

SEQ ID NO: 2825049 - protein, 41 aa, Entamoeba invadens
RMSLYRNTSLIKLIFFKNAAFFLHLLWYAMICQFTSQRLYD

SEQ ID NO: 2825050 - protein, 17 aa, Entamoeba invadens
RMTIVRQVFPVINGKVL

SEQ ID NO: 2825051 - protein, 32 aa, Entamoeba invadens
RMVCTIVFIAPLIFLGVLLLSVGIVTLPSTYI

SEQ ID NO: 2825052 - protein, 23 aa, Entamoeba invadens
RNADDVYLLSGITWMSEIENNEG

SEQ ID NO: 2825053 - protein, 23 aa, Entamoeba invadens
RNAIEQVCYPHYTTPPLSRYIHE

SEQ ID NO: 2825054 - protein, 19 aa, Entamoeba invadens
RNCALIHLLRTILWTVNEP

SEQ ID NO: 2825055 - protein, 18 aa, Entamoeba invadens
RNCISGYVDPYGYCEKCP

SEQ ID NO: 2825056 - protein, 32 aa, Entamoeba invadens
RNCKITLVFLIIGIIFCPFLVASFVISLRCEN

SEQ ID NO: 2825057 - protein, 18 aa, Entamoeba invadens
RNCTKCLSTYYLEDGICK

SEQ ID NO: 2825058 - protein, 31 aa, Entamoeba invadens
RNECLKCNINYYLKLGKCYPCNLFDANCVEC

SEQ ID NO: 2825059 - protein, 28 aa, Entamoeba invadens
RNFFVLCVVGIIYIVYLTKMKTIFVAPN

SEQ ID NO: 2825060 - protein, 29 aa, Entamoeba invadens
RNGNKPRYFYLFNDVLIYGIGTIKIVVSG

SEQ ID NO: 2825061 - protein, 19 aa, Entamoeba invadens
RNGYCTGCLSNYVFISSTS

SEQ ID NO: 2825062 - protein, 18 aa, Entamoeba invadens
RNGYYLTQISRCYECSYA

SEQ ID NO: 2825063 - protein, 27 aa, Entamoeba invadens
RNICGNIVYVIFPQKTLFGASCDNSNF

SEQ ID NO: 2825064 - protein, 18 aa, Entamoeba invadens
RNIHLKRLLLRIKNGTPA

SEQ ID NO: 2825065 - protein, 29 aa, Entamoeba invadens
RNINLLMTNMTFTKGIGTPKFMAPEVLKQ

SEQ ID NO: 2825066 - protein, 25 aa, Entamoeba invadens
RNISVTLFMIILPTPFVAIPGIISA

SEQ ID NO: 2825067 - protein, 29 aa, Entamoeba invadens
RNKQFARSLSLYRTYNLLRKTENAAVFGV

SEQ ID NO: 2825068 - protein, 20 aa, Entamoeba invadens
RNMMFTSLMRKDVSWYDEKN

SEQ ID NO: 2825069 - protein, 25 aa, Entamoeba invadens
RNMQPLRFYVLTNTEFIAKVADECQ

SEQ ID NO: 2825070 - protein, 22 aa, Entamoeba invadens
RNNLIWGSTFGIGYWGWSDVAY

SEQ ID NO: 2825071 - protein, 18 aa, Entamoeba invadens
RNNSYGSSLLLSLILLAL

SEQ ID NO: 2825072 - protein, 28 aa, Entamoeba invadens
RNNVFFIDWFVFYSTTFLNTLTLPQVDK

SEQ ID NO: 2825073 - protein, 24 aa, Entamoeba invadens
RNPSFFEFNQLFLEYIHHHSTSKL

SEQ ID NO: 2825074 - protein, 25 aa, Entamoeba invadens
RNQPLVYISPLFGEIPFLTYCPSQN

SEQ ID NO: 2825075 - protein, 28 aa, Entamoeba invadens
RNREAAFSNFLAFILIERGFVLNMAMTT

SEQ ID NO: 2825076 - protein, 23 aa, Entamoeba invadens
RNREELFGLFRIFRIMDKNRTDD

SEQ ID NO: 2825077 - protein, 25 aa, Entamoeba invadens
RNSTKYLINVLLLFAFSVALNRFAT

SEQ ID NO: 2825078 - protein, 26 aa, Entamoeba invadens
RNTEDFYFYIFIHLGQLSKAKIELKT

SEQ ID NO: 2825079 - protein, 27 aa, Entamoeba invadens
RNVEPIISPIIQVLLKLVLTGNQSVEL

SEQ ID NO: 2825080 - protein, 21 aa, Entamoeba invadens
RNVLFFIWIFTQDVSISLMQL

SEQ ID NO: 2825081 - protein, 23 aa, Entamoeba invadens
RNVNLLLTNMTFTKGIGTPVYMA

SEQ ID NO: 2825082 - protein, 19 aa, Entamoeba invadens
RNVVLFIGLSKIQGHICIV

SEQ ID NO: 2825083 - protein, 21 aa, Entamoeba invadens
RNWIVIVGCLIFVLMTIIAVV

SEQ ID NO: 2825084 - protein, 27 aa, Entamoeba invadens
RNYRVFYTMLIFSLTSLLYVAVTSFLA

SEQ ID NO: 2825085 - protein, 21 aa, Entamoeba invadens
RPCQIKPACGHVLPAHNCHFG

SEQ ID NO: 2825086 - protein, 20 aa, Entamoeba invadens
RPFFTEFLNCQICDVYFAKR

SEQ ID NO: 2825087 - protein, 19 aa, Entamoeba invadens
RPFMLAGNFIVFLGIILQT

SEQ ID NO: 2825088 - protein, 17 aa, Entamoeba invadens
RPLTMILDGLSFTAKEG

SEQ ID NO: 2825089 - protein, 22 aa, Entamoeba invadens
RPLWKIIIFPNVENSWRMVVKI

SEQ ID NO: 2825090 - protein, 29 aa, Entamoeba invadens
RPPIEATIKPLILYSDIDQKWWINTMRIN

SEQ ID NO: 2825091 - protein, 29 aa, Entamoeba invadens
RPTAEVVLSLPLFWDCNKKLHFIRCASDK

SEQ ID NO: 2825092 - protein, 28 aa, Entamoeba invadens
RPTFMPYYYLILILPLLCARYFIYTKNG

SEQ ID NO: 2825093 - protein, 22 aa, Entamoeba invadens
RPVQIFLWIKVAMFLNLFQEFI

SEQ ID NO: 2825094 - protein, 28 aa, Entamoeba invadens
RPYQLDGISWLLFLNKYCINGILCDDMG

SEQ ID NO: 2825095 - protein, 25 aa, Entamoeba invadens
RPYQSIFIYEFFNTVAWNIDTKHII

SEQ ID NO: 2825096 - protein, 23 aa, Entamoeba invadens
RQAELLKPIMSLCAQKKYSSAFA

SEQ ID NO: 2825097 - protein, 29 aa, Entamoeba invadens
RQALDLLFVAIHYGGFQMLWNAVKERASK

SEQ ID NO: 2825098 - protein, 26 aa, Entamoeba invadens
RQCKTCSIGLYPLHTSPYTCQQCHSS

SEQ ID NO: 2825099 - protein, 24 aa, Entamoeba invadens
RQCQTCSTGFYPLQVSPYTCQQCH

SEQ ID NO: 2825100 - protein, 18 aa, Entamoeba invadens
RQCYQCVSGMYPNTNKQC

SEQ ID NO: 2825101 - protein, 28 aa, Entamoeba invadens
RQDKEDYLKLPYKLKVRMLFDSARGMQF

SEQ ID NO: 2825102 - protein, 26 aa, Entamoeba invadens
RQDKQDYLKLPYKLKVRMLFDTAKGM

SEQ ID NO: 2825103 - protein, 20 aa, Entamoeba invadens
RQDMLFVQWEHVTLKTCDII

SEQ ID NO: 2825104 - protein, 25 aa, Entamoeba invadens
RQFGLLLDLCYYGPYGIPIWTPIIS

SEQ ID NO: 2825105 - protein, 25 aa, Entamoeba invadens
RQGFESLLLDFKRYLTSDIDDIIDV

SEQ ID NO: 2825106 - protein, 29 aa, Entamoeba invadens
RQGIKIRKLYFKTLLRQDAAWYDAHELGE

SEQ ID NO: 2825107 - protein, 29 aa, Entamoeba invadens
RQGIKIRLLYMRSLLRQDSAWYDFQEAGE

SEQ ID NO: 2825108 - protein, 17 aa, Entamoeba invadens
RQIGEGSFGIVYKGKYR

SEQ ID NO: 2825109 - protein, 17 aa, Entamoeba invadens
RQLKKIIFITLLTATSV

SEQ ID NO: 2825110 - protein, 17 aa, Entamoeba invadens
RQLLVAFLYNTSCYFYW

SEQ ID NO: 2825111 - protein, 32 aa, Entamoeba invadens
RQTLLLVLINKEMLVYFLIKTTEKHTINRIME

SEQ ID NO: 2825112 - protein, 23 aa, Entamoeba invadens
RRCELCGNFNYFNNITKSCLKNM

SEQ ID NO: 2825113 - protein, 20 aa, Entamoeba invadens
RRCFQCVSGMYPNNDKQCVN

SEQ ID NO: 2825114 - protein, 18 aa, Entamoeba invadens
RRCLICNTGFYPNDSGKC

SEQ ID NO: 2825115 - protein, 17 aa, Entamoeba invadens
RRCLTCKTTKYPDDRTK

SEQ ID NO: 2825116 - protein, 24 aa, Entamoeba invadens
RRCQKGFFLSDNYCWETSLYKTEC

SEQ ID NO: 2825117 - protein, 18 aa, Entamoeba invadens
RRCVKCLNGYYPDTNGKC

SEQ ID NO: 2825118 - protein, 18 aa, Entamoeba invadens
RRCVTCNSGFYPKQYGDF

SEQ ID NO: 2825119 - protein, 23 aa, Entamoeba invadens
RRCYECQTGYYPSLTTYKCTKCS

SEQ ID NO: 2825120 - protein, 20 aa, Entamoeba invadens
RRFFAYFNFLSKNVGKYERI

SEQ ID NO: 2825121 - protein, 23 aa, Entamoeba invadens
RRIFFTIFMPCHIILLVQAIVLF

SEQ ID NO: 2825122 - protein, 31 aa, Entamoeba invadens
RRIQSLILIYMLLSLLFFRFSQFIVSLIIFI

SEQ ID NO: 2825123 - protein, 39 aa, Entamoeba invadens
RRIRNYMVISLLFPPFLFFGAFILLRSPKTELLKKKKRQ

SEQ ID NO: 2825124 - protein, 20 aa, Entamoeba invadens
RRNIPETLFQLIVKFNKIIS

SEQ ID NO: 2825125 - protein, 27 aa, Entamoeba invadens
RRNNDFNVILPYKYKLRVMYDCARGMA

SEQ ID NO: 2825126 - protein, 22 aa, Entamoeba invadens
RRNSLIVKLSFYKNVTFIMIQF

SEQ ID NO: 2825127 - protein, 26 aa, Entamoeba invadens
RRNYRSYFFLLFWSVMYLAYIMVCSL

SEQ ID NO: 2825128 - protein, 21 aa, Entamoeba invadens
RRPAFTAIETYFLALLKNEKT

SEQ ID NO: 2825129 - protein, 17 aa, Entamoeba invadens
RRPTYMCDGDNGYYCKF

SEQ ID NO: 2825130 - protein, 18 aa, Entamoeba invadens
RRVHRAVLFFYNNTIPFF

SEQ ID NO: 2825131 - protein, 33 aa, Entamoeba invadens
RRYDKNRFIFLSNFLLDLALEFGYFFDSKLARN

SEQ ID NO: 2825132 - protein, 43 aa, Entamoeba invadens
RSAFMSFVNWFVFGIYQSLVFFFFYYITTFTCDVTMFGLNGGI

SEQ ID NO: 2825133 - protein, 25 aa, Entamoeba invadens
RSATIVIAFLMKKNRWSLKKATNFV

SEQ ID NO: 2825134 - protein, 19 aa, Entamoeba invadens
RSCLLCAAGYFSNGGTSSC

SEQ ID NO: 2825135 - protein, 19 aa, Entamoeba invadens
RSCLVCSVGYYPSSGICTE

SEQ ID NO: 2825136 - protein, 25 aa, Entamoeba invadens
RSCMNFIVWAIPTTVFFCYLFIPII

SEQ ID NO: 2825137 - protein, 23 aa, Entamoeba invadens
RSCVTCMAGYYPGTTGQCISCDT

SEQ ID NO: 2825138 - protein, 20 aa, Entamoeba invadens
RSCVTCMVGYYPGTTGKCIS

SEQ ID NO: 2825139 - protein, 21 aa, Entamoeba invadens
RSDFVVHFYGAVFIPTKTCMV

SEQ ID NO: 2825140 - protein, 23 aa, Entamoeba invadens
RSDYIVHFYGAVFVPKRICLVTE

SEQ ID NO: 2825141 - protein, 26 aa, Entamoeba invadens
RSEKDFYVEFPYKLKVRMLFDTSRGM

SEQ ID NO: 2825142 - protein, 21 aa, Entamoeba invadens
RSEYIVHFYGAVFIPNKTCMV

SEQ ID NO: 2825143 - protein, 22 aa, Entamoeba invadens
RSEYIVHFYGAVFIPSKICMVS

SEQ ID NO: 2825144 - protein, 22 aa, Entamoeba invadens
RSEYIVHFYGAVFIPSKICMVT

SEQ ID NO: 2825145 - protein, 21 aa, Entamoeba invadens
RSEYIVHFYGAVFIPSKVCMV

SEQ ID NO: 2825146 - protein, 17 aa, Entamoeba invadens
RSEYIVYFYGAVMFEKR

SEQ ID NO: 2825147 - protein, 22 aa, Entamoeba invadens
RSEYVVHFYGAVFIPNKICMVT

SEQ ID NO: 2825148 - protein, 21 aa, Entamoeba invadens
RSEYVVHFYGAVFIPSKVCMV

SEQ ID NO: 2825149 - protein, 24 aa, Entamoeba invadens
RSFDFYLVCLLVVMLSVTPLILRK

SEQ ID NO: 2825150 - protein, 33 aa, Entamoeba invadens
RSFICPFTRNFYAPYVFYLFDALMTTEMLHTHF

SEQ ID NO: 2825151 - protein, 18 aa, Entamoeba invadens
RSFLLINPAYFASFGIFF

SEQ ID NO: 2825152 - protein, 17 aa, Entamoeba invadens
RSGAIVVCAPIAPYREI

SEQ ID NO: 2825153 - protein, 32 aa, Entamoeba invadens
RSICKLVLILIFLPILVREFYIFITSLSSTKL

SEQ ID NO: 2825154 - protein, 18 aa, Entamoeba invadens
RSINLQYDFIIKGTGSLA

SEQ ID NO: 2825155 - protein, 24 aa, Entamoeba invadens
RSKHFKKFFTLEKLDPTQSEYFYQ

SEQ ID NO: 2825156 - protein, 18 aa, Entamoeba invadens
RSKYYLRNGSCVSNLDIN

SEQ ID NO: 2825157 - protein, 17 aa, Entamoeba invadens
RSLRFVVDPKKSMLRHM

SEQ ID NO: 2825158 - protein, 23 aa, Entamoeba invadens
RSLSNYEYLIYLNFQAGRSYNDL

SEQ ID NO: 2825159 - protein, 29 aa, Entamoeba invadens
RSLVYINCYPGWFGLKRTLLRSNYLVTSI

SEQ ID NO: 2825160 - protein, 18 aa, Entamoeba invadens
RSMGRYGVILKDNTMEIT

SEQ ID NO: 2825161 - protein, 26 aa, Entamoeba invadens
RSNKLNYFLLNKIIFTNDSLIALCER

SEQ ID NO: 2825162 - protein, 20 aa, Entamoeba invadens
RSNTILLLMYISASVLMSVS

SEQ ID NO: 2825163 - protein, 24 aa, Entamoeba invadens
RSPQLHFTWMCELSQKLKKTKLMI

SEQ ID NO: 2825164 - protein, 22 aa, Entamoeba invadens
RSRFSFSLPHRSKKPAPDDLQQ

SEQ ID NO: 2825165 - protein, 26 aa, Entamoeba invadens
RSRNKYMMIIFHTLNSPKYVFHFDPQ

SEQ ID NO: 2825166 - protein, 19 aa, Entamoeba invadens
RSSSQHNFLLLVFVLLWAL

SEQ ID NO: 2825167 - protein, 24 aa, Entamoeba invadens
RSTCTVVFFFFVGVVLAAVMVVVG

SEQ ID NO: 2825168 - protein, 17 aa, Entamoeba invadens
RSTQLVQSLWKNYKIIL

SEQ ID NO: 2825169 - protein, 26 aa, Entamoeba invadens
RSVCVLPTCYPLIRGVLQNIDRVNGF

SEQ ID NO: 2825170 - protein, 25 aa, Entamoeba invadens
RSVLYAIVMLYLRSGFYGRVNDMNI

SEQ ID NO: 2825171 - protein, 21 aa, Entamoeba invadens
RSVPQLFTIPKGKAVEFELFL

SEQ ID NO: 2825172 - protein, 25 aa, Entamoeba invadens
RSVQTVVVLPFRAGIVAKPGNLRIK

SEQ ID NO: 2825173 - protein, 27 aa, Entamoeba invadens
RSVSKYLPYIKHYFLVTADQVPDFIES

SEQ ID NO: 2825174 - protein, 25 aa, Entamoeba invadens
RSVTIESSFILPVSLFENCTSLESI

SEQ ID NO: 2825175 - protein, 29 aa, Entamoeba invadens
RSVVTKREYLFNKFPLQLEMCLIGGVALE

SEQ ID NO: 2825176 - protein, 30 aa, Entamoeba invadens
RSYSQKYEVFYYLTMQPWRHMEWTTIDKNM

SEQ ID NO: 2825177 - protein, 18 aa, Entamoeba invadens
RSYSTTVLVLLIVIIVMT

SEQ ID NO: 2825178 - protein, 18 aa, Entamoeba invadens
RTCISCKANMYPDATYTC

SEQ ID NO: 2825179 - protein, 23 aa, Entamoeba invadens
RTCKSYYYYSNGYCLKCSPNCNT

SEQ ID NO: 2825180 - protein, 32 aa, Entamoeba invadens
RTCVLLFAFGFVMPLCWIACGVMYLKSSVRTE

SEQ ID NO: 2825181 - protein, 25 aa, Entamoeba invadens
RTDSGIFCLLLARAIERDTQYYCNI

SEQ ID NO: 2825182 - protein, 27 aa, Entamoeba invadens
RTDYCISCVNGYYWDKQILECRRCEDG

SEQ ID NO: 2825183 - protein, 21 aa, Entamoeba invadens
RTEGLFVAFGCFDNQSFCRTT

SEQ ID NO: 2825184 - protein, 29 aa, Entamoeba invadens
RTEIGIDLLWILWLIFGVAYSYMLHISFF

SEQ ID NO: 2825185 - protein, 31 aa, Entamoeba invadens
RTEIIKQWYEYYVVLCAPYILIFENEEKFRH

SEQ ID NO: 2825186 - protein, 20 aa, Entamoeba invadens
RTFLNLHFEVSLYPTNNYTF

SEQ ID NO: 2825187 - protein, 18 aa, Entamoeba invadens
RTGSPFIEYDKDTLIKMI

SEQ ID NO: 2825188 - protein, 19 aa, Entamoeba invadens
RTIFLNDQLYKFLGGYSTS

SEQ ID NO: 2825189 - protein, 18 aa, Entamoeba invadens
RTIGDIPLFITHNFDQRN

SEQ ID NO: 2825190 - protein, 37 aa, Entamoeba invadens
RTIKQIMLDCVFSPAVNWFFKFALQTICPDTLAKLSY

SEQ ID NO: 2825191 - protein, 18 aa, Entamoeba invadens
RTIPLSLFFLVVLTSLTT

SEQ ID NO: 2825192 - protein, 33 aa, Entamoeba invadens
RTIRDFPLIITHSFLFSQWINLNSTNFDFIYSE

SEQ ID NO: 2825193 - protein, 20 aa, Entamoeba invadens
RTIRDIPFFQVNKVSNFSGT

SEQ ID NO: 2825194 - protein, 25 aa, Entamoeba invadens
RTIRDLPIFFSYQINMTIFSFQNSF

SEQ ID NO: 2825195 - protein, 24 aa, Entamoeba invadens
RTIRDLPIFFTYQINSTKFSFQSL

SEQ ID NO: 2825196 - protein, 26 aa, Entamoeba invadens
RTIRDLPIFFTYQINTTIFSFQNSYE

SEQ ID NO: 2825197 - protein, 34 aa, Entamoeba invadens
RTITCYMTIYCTTKLRGMKIPYTVWFSQSRRTLN

SEQ ID NO: 2825198 - protein, 17 aa, Entamoeba invadens
RTIYWASCEPPQSNFFC

SEQ ID NO: 2825199 - protein, 21 aa, Entamoeba invadens
RTLTSLLIIILLIALSSVLST

SEQ ID NO: 2825200 - protein, 26 aa, Entamoeba invadens
RTMLPVYSIVFFVILLVRYVVQLTET

SEQ ID NO: 2825201 - protein, 32 aa, Entamoeba invadens
RTNLLQFLVSPKKSFLRFILKSKSHMVSKNLK

SEQ ID NO: 2825202 - protein, 22 aa, Entamoeba invadens
RTNPQLITLKKGKAVEFEVFIR

SEQ ID NO: 2825203 - protein, 19 aa, Entamoeba invadens
RTQQICYHYYLTGSTSAEP

SEQ ID NO: 2825204 - protein, 23 aa, Entamoeba invadens
RTTCVFYLNDPYLRLVIVLHEDL

SEQ ID NO: 2825205 - protein, 29 aa, Entamoeba invadens
RTTRYPLCLSLLNIYNILVSLNLVNLMSV

SEQ ID NO: 2825206 - protein, 27 aa, Entamoeba invadens
RTYKDPPLFIVDNLVSIGFNFTSINEF

SEQ ID NO: 2825207 - protein, 46 aa, Entamoeba invadens
RTYLSYFNSGNFFLFFFTLFFFVLRCGCRVCYNWFLTKWTNAIDDN

SEQ ID NO: 2825208 - protein, 18 aa, Entamoeba invadens
RTYTLPYNITTRLNFTAS

SEQ ID NO: 2825209 - protein, 24 aa, Entamoeba invadens
RVAITKTLMLVNRRLARCQIVVLS

SEQ ID NO: 2825210 - protein, 17 aa, Entamoeba invadens
RVCDFYTSVSFLKEITC

SEQ ID NO: 2825211 - protein, 24 aa, Entamoeba invadens
RVDDLYCEEGLPPVLLKICNAMYL

SEQ ID NO: 2825212 - protein, 21 aa, Entamoeba invadens
RVDSCYYYNTRYYKFGEKDDQ

SEQ ID NO: 2825213 - protein, 29 aa, Entamoeba invadens
RVDSKTFAPIIITLLDTPAPQTTDPVFFY

SEQ ID NO: 2825214 - protein, 18 aa, Entamoeba invadens
RVEIWKGLIVNGLKNKVV

SEQ ID NO: 2825215 - protein, 28 aa, Entamoeba invadens
RVELMSLFNRIICWVLMISHNFVNSDDV

SEQ ID NO: 2825216 - protein, 19 aa, Entamoeba invadens
RVEPKIVVIPRGKAIEFEV

SEQ ID NO: 2825217 - protein, 26 aa, Entamoeba invadens
RVGVMGIYRIFIGRDYPLLSQFENGK

SEQ ID NO: 2825218 - protein, 27 aa, Entamoeba invadens
RVIFKLDTLVRPYAAKLLSVINPLLED

SEQ ID NO: 2825219 - protein, 35 aa, Entamoeba invadens
RVIQNVSFLPVCIAGIIALISYNIYIIAITYYKKL

SEQ ID NO: 2825220 - protein, 32 aa, Entamoeba invadens
RVIRYFCQYNRAFKLVQKLLPEQVTLKPEWAK

SEQ ID NO: 2825221 - protein, 39 aa, Entamoeba invadens
RVISLIRKMAIYPLLYIACWLIPFIDRLVPLFGDDIQVV

SEQ ID NO: 2825222 - protein, 37 aa, Entamoeba invadens
RVIVVKLMLVGIVLYPIYIVIFALFNNSSDKRVRILS

SEQ ID NO: 2825223 - protein, 23 aa, Entamoeba invadens
RVKDFIIFGIPLVFFSLVAAVGL

SEQ ID NO: 2825224 - protein, 22 aa, Entamoeba invadens
RVKHWFDFLTFSNITELLGFKR

SEQ ID NO: 2825225 - protein, 33 aa, Entamoeba invadens
RVKTGFIWPALSLLMFIILTLISLSICFGLVYA

SEQ ID NO: 2825226 - protein, 25 aa, Entamoeba invadens
RVLGWVSFLLYWVVSVIFCFIPVMV

SEQ ID NO: 2825227 - protein, 17 aa, Entamoeba invadens
RVLKYFVYSILNGGLVF

SEQ ID NO: 2825228 - protein, 30 aa, Entamoeba invadens
RVNIVIRVVIPFVILLGIALFLTSNTGVGA

SEQ ID NO: 2825229 - protein, 18 aa, Entamoeba invadens
RVPQIKLEYSREIAGGVE

SEQ ID NO: 2825230 - protein, 33 aa, Entamoeba invadens
RVQFRDICLGLLNRLLQALSVQFTLPTKKLKPS

SEQ ID NO: 2825231 - protein, 18 aa, Entamoeba invadens
RVRFSVLLSLPVVSSYPP

SEQ ID NO: 2825232 - protein, 17 aa, Entamoeba invadens
RVSAFYFVLISKVEIEG

SEQ ID NO: 2825233 - protein, 20 aa, Entamoeba invadens
RVSKFHIYLNLQVESALSTK

SEQ ID NO: 2825234 - protein, 24 aa, Entamoeba invadens
RVSKVLFCIMLALSLLMVCPDVFH

SEQ ID NO: 2825235 - protein, 18 aa, Entamoeba invadens
RVSLLTLFTPQTLFFLCT

SEQ ID NO: 2825236 - protein, 22 aa, Entamoeba invadens
RVSQNLNCYCSIQAGGNLYDES

SEQ ID NO: 2825237 - protein, 38 aa, Entamoeba invadens
RVSWRVYYKYLKYGGIIFFLLAMIPFAMRIGSMITYNL

SEQ ID NO: 2825238 - protein, 25 aa, Entamoeba invadens
RVTSFGVHAFLWSSLSSIKFGKHLK

SEQ ID NO: 2825239 - protein, 17 aa, Entamoeba invadens
RVVILFGSFWGLVPVIS

SEQ ID NO: 2825240 - protein, 24 aa, Entamoeba invadens
RVVIVPMYVGPLTEILFTQNNTTE

SEQ ID NO: 2825241 - protein, 23 aa, Entamoeba invadens
RVVLACDQVSLDSILFDCCFTQV

SEQ ID NO: 2825242 - protein, 36 aa, Entamoeba invadens
RVVRPLLVVLMFELYWFCIVFFWNEFYNSFVTIMVC

SEQ ID NO: 2825243 - protein, 22 aa, Entamoeba invadens
RVVVPLIAPFLIPLNQRTETKY

SEQ ID NO: 2825244 - protein, 18 aa, Entamoeba invadens
RWDYRGNVIKYNRIYNLT

SEQ ID NO: 2825245 - protein, 26 aa, Entamoeba invadens
RWKSWKRRFFIFDQKTLSYYKDQLLM

SEQ ID NO: 2825246 - protein, 18 aa, Entamoeba invadens
RWLGVRVELVGCLSLGAI

SEQ ID NO: 2825247 - protein, 21 aa, Entamoeba invadens
RWMLLAMGMFSIYVGLLYNEC

SEQ ID NO: 2825248 - protein, 24 aa, Entamoeba invadens
RWSKIFYWAIYLVGFICLSTVFFV

SEQ ID NO: 2825249 - protein, 30 aa, Entamoeba invadens
RYCDYNLCYDCLRGYYLYNNECYKCSSICS

SEQ ID NO: 2825250 - protein, 19 aa, Entamoeba invadens
RYCFKCSASYYLSIDQKYC

SEQ ID NO: 2825251 - protein, 21 aa, Entamoeba invadens
RYDGWYIKYEKSANGVKRYMS

SEQ ID NO: 2825252 - protein, 42 aa, Entamoeba invadens
RYEDSLLLEGWWLFIIIIGVIIVSLVWYLARPCLGGVRGTRG

SEQ ID NO: 2825253 - protein, 25 aa, Entamoeba invadens
RYENQTLFIGLQNLTKLECSEVTFI

SEQ ID NO: 2825254 - protein, 18 aa, Entamoeba invadens
RYFVQFLMLVPLNCLFGV

SEQ ID NO: 2825255 - protein, 25 aa, Entamoeba invadens
RYHFVMYHLLLLFMLCVIFTTNDMY

SEQ ID NO: 2825256 - protein, 19 aa, Entamoeba invadens
RYICDVLKYLSVMLSIQQI

SEQ ID NO: 2825257 - protein, 17 aa, Entamoeba invadens
RYIKPPQATHEPIPDVT

SEQ ID NO: 2825258 - protein, 27 aa, Entamoeba invadens
RYIPRNWKFMQIWNGTLSILVIRILIL

SEQ ID NO: 2825259 - protein, 26 aa, Entamoeba invadens
RYKRAMFFIRIAFPVPFYQIKGNVAE

SEQ ID NO: 2825260 - protein, 20 aa, Entamoeba invadens
RYLPKKWKFTTMWNGRVAIM

SEQ ID NO: 2825261 - protein, 22 aa, Entamoeba invadens
RYLYVLMALFIFLYQIADNIDG

SEQ ID NO: 2825262 - protein, 18 aa, Entamoeba invadens
RYMYYKFKSTNGDNYTNC

SEQ ID NO: 2825263 - protein, 22 aa, Entamoeba invadens
RYNPIFKNKVPPISYLRCAMAN

SEQ ID NO: 2825264 - protein, 17 aa, Entamoeba invadens
RYNTTLVFKKESPFKLF

SEQ ID NO: 2825265 - protein, 39 aa, Entamoeba invadens
RYRCFTSFIFMCLKKYYIQLIKMFIMSMTLIKAFVDKKQ

SEQ ID NO: 2825266 - protein, 30 aa, Entamoeba invadens
RYTVVNPDTGFWYLDSYLPELGYAAYAVKK

SEQ ID NO: 2825267 - protein, 20 aa, Entamoeba invadens
RYVSLCYILLQFFIMFKDVL

SEQ ID NO: 2825268 - protein, 19 aa, Entamoeba invadens
RYYSVNKLEILWFDKNAQP

SEQ ID NO: 2825269 - protein, 19 aa, Entamoeba invadens
SAAFLYPEYEYMCCFGTDC

SEQ ID NO: 2825270 - protein, 28 aa, Entamoeba invadens
SAALMLGWYFSFFLLVPLGVFGFCVLTM

SEQ ID NO: 2825271 - protein, 27 aa, Entamoeba invadens
SAASLILLILSILFLPNVPTQMETSTF

SEQ ID NO: 2825272 - protein, 25 aa, Entamoeba invadens
SACDYVFHFLVRVEPFTSMFIKMNE

SEQ ID NO: 2825273 - protein, 18 aa, Entamoeba invadens
SACVACESDYVLIGKRCV

SEQ ID NO: 2825274 - protein, 24 aa, Entamoeba invadens
SACVTGFVGYLSKDNVCTACFKDY

SEQ ID NO: 2825275 - protein, 40 aa, Entamoeba invadens
SADIFSFAITMFEVFGWSDAYLSETFKFPWKIAEFVTKGK

SEQ ID NO: 2825276 - protein, 31 aa, Entamoeba invadens
SADIFSFGVTFYQTLVWDEIYKKSDTRFTYP

SEQ ID NO: 2825277 - protein, 23 aa, Entamoeba invadens
SADIFSLAVTMLELTKWGEVYEK

SEQ ID NO: 2825278 - protein, 25 aa, Entamoeba invadens
SADIYSFGITLYETFKWGEAYEKEK

SEQ ID NO: 2825279 - protein, 24 aa, Entamoeba invadens
SADIYSFGVTFYETLKWGEAYDKE

SEQ ID NO: 2825280 - protein, 23 aa, Entamoeba invadens
SADIYSFGVTLYETLKWEEAYDK

SEQ ID NO: 2825281 - protein, 23 aa, Entamoeba invadens
SADIYSFGVTLYETLKWGEAYDK

SEQ ID NO: 2825282 - protein, 22 aa, Entamoeba invadens
SADMLKSETLLFFVGGETSRDV

SEQ ID NO: 2825283 - protein, 27 aa, Entamoeba invadens
SADNCLTCAFGYYYDYTTSDCLYVGEL

SEQ ID NO: 2825284 - protein, 43 aa, Entamoeba invadens
SADVYAFAITMYEVFGWKEAFGKETFRYPWKIAEFVTSGKHLE

SEQ ID NO: 2825285 - protein, 44 aa, Entamoeba invadens
SADVYSFGISMYEVFGWSEPYPKHEFKFPWKIAEFVMGGNRLKK

SEQ ID NO: 2825286 - protein, 25 aa, Entamoeba invadens
SAFEGTIFTTFPLGQTIKLMDDNAF

SEQ ID NO: 2825287 - protein, 17 aa, Entamoeba invadens
SAFLFWPAAVGTVGKES

SEQ ID NO: 2825288 - protein, 27 aa, Entamoeba invadens
SAFNMKVRIAFFRFLTRLLEGYDEYIN

SEQ ID NO: 2825289 - protein, 17 aa, Entamoeba invadens
SAGKRLFIPNKVPNELS

SEQ ID NO: 2825290 - protein, 18 aa, Entamoeba invadens
SAILQCDDFYYLTSNKTC

SEQ ID NO: 2825291 - protein, 23 aa, Entamoeba invadens
SAIYVFLSVLLSVSYFISKTPLT

SEQ ID NO: 2825292 - protein, 17 aa, Entamoeba invadens
SAKGTPLFITKPSQMQL

SEQ ID NO: 2825293 - protein, 20 aa, Entamoeba invadens
SAKIFQILPAYFMQIKSEES

SEQ ID NO: 2825294 - protein, 30 aa, Entamoeba invadens
SALLYNFAAFLFWIVVPLIATKQGASNLDL

SEQ ID NO: 2825295 - protein, 17 aa, Entamoeba invadens
SALQWKSLVFSSLNEIT

SEQ ID NO: 2825296 - protein, 27 aa, Entamoeba invadens
SAMFKDLVFEFYLPPRAFINNQVIKLN

SEQ ID NO: 2825297 - protein, 26 aa, Entamoeba invadens
SANARLKRLILRDDDKKMWAIICCLC

SEQ ID NO: 2825298 - protein, 20 aa, Entamoeba invadens
SANIICEVGYYVSDSSCFSC

SEQ ID NO: 2825299 - protein, 24 aa, Entamoeba invadens
SAPEFKRIVYTPRVGPRRLKERRT

SEQ ID NO: 2825300 - protein, 25 aa, Entamoeba invadens
SAQFNPYITIPLLLEGRITVINSII

SEQ ID NO: 2825301 - protein, 27 aa, Entamoeba invadens
SAQLKEHIFDFLPLESLLSLSLCCKTL

SEQ ID NO: 2825302 - protein, 33 aa, Entamoeba invadens
SARVWGSMCCLLYLFVFLVFGLGLVQGKMADFL

SEQ ID NO: 2825303 - protein, 27 aa, Entamoeba invadens
SASNVPLYFLYALTLFHFSSSLVGKIT

SEQ ID NO: 2825304 - protein, 22 aa, Entamoeba invadens
SASYFFGLFLILMSLLADGIAS

SEQ ID NO: 2825305 - protein, 51 aa, Entamoeba invadens
SATGMFCESKAAWWVIFIIIVIIIIFILAIFIVAVFIIKCVIFKLKENEIN

SEQ ID NO: 2825306 - protein, 23 aa, Entamoeba invadens
SATVILAGSFLYVYMADTLARAY

SEQ ID NO: 2825307 - protein, 46 aa, Entamoeba invadens
SAVKLKRAMWWKNVKLYLIAGAVLLIFLLVLLLAGCGITFQRCRIE

SEQ ID NO: 2825308 - protein, 25 aa, Entamoeba invadens
SAVLFVLSFIFLGMSIYFLIAEQIE

SEQ ID NO: 2825309 - protein, 36 aa, Entamoeba invadens
SAWFDNVTINLFLRTIKNFPLIFTYNVTSLNNVNPN

SEQ ID NO: 2825310 - protein, 45 aa, Entamoeba invadens
SCAKKAVWWVIFIGVFLIILVLFVVFMVTIFITLQILKKKKEHEK

SEQ ID NO: 2825311 - protein, 43 aa, Entamoeba invadens
SCAKKAVWWVILVGIFLIILVLFVVFVVTIFITLKIVKRKKEH

SEQ ID NO: 2825312 - protein, 17 aa, Entamoeba invadens
SCALCDLKYFRNSKGMC

SEQ ID NO: 2825313 - protein, 26 aa, Entamoeba invadens
SCAQTEFLVFCFNKDFTFSSGSKFYE

SEQ ID NO: 2825314 - protein, 48 aa, Entamoeba invadens
SCDKVFKYGTYIILPFSIVILIILLVVTLITITTILIHKRNRKIKMDK

SEQ ID NO: 2825315 - protein, 24 aa, Entamoeba invadens
SCEDGNFYFFNNKCLQCINCAKGF

SEQ ID NO: 2825316 - protein, 23 aa, Entamoeba invadens
SCEGRVVIWDLKSLTFSQLIHLI

SEQ ID NO: 2825317 - protein, 36 aa, Entamoeba invadens
SCEKKVVVWFVVIVVIICLFIFVGVIAGIIALSTYT

SEQ ID NO: 2825318 - protein, 46 aa, Entamoeba invadens
SCERRSIWTIILGVILITFFVIVVVIIIMFFVVVHIYNERRITKFN

SEQ ID NO: 2825319 - protein, 45 aa, Entamoeba invadens
SCESQIVWWVILIAVVFFCILLILSVVFLIVFTKKILGKIHTKSV

SEQ ID NO: 2825320 - protein, 18 aa, Entamoeba invadens
SCFLCNAGYYCPDGINKY

SEQ ID NO: 2825321 - protein, 17 aa, Entamoeba invadens
SCFLFSAGTSKYIHSPH

SEQ ID NO: 2825322 - protein, 19 aa, Entamoeba invadens
SCFSCKAGYYCPDGINKYP

SEQ ID NO: 2825323 - protein, 18 aa, Entamoeba invadens
SCFSCVTPGYFLSGFSCV

SEQ ID NO: 2825324 - protein, 18 aa, Entamoeba invadens
SCFYTPTFSLYNNGILVV

SEQ ID NO: 2825325 - protein, 28 aa, Entamoeba invadens
SCGINFLLHRLFFQFFDNHKITAKIIEK

SEQ ID NO: 2825326 - protein, 17 aa, Entamoeba invadens
SCIIALICERSVETCKD

SEQ ID NO: 2825327 - protein, 17 aa, Entamoeba invadens
SCILCTSGFVLKNEICM

SEQ ID NO: 2825328 - protein, 24 aa, Entamoeba invadens
SCILLIALLTLSNGLHFIAFVSAL

SEQ ID NO: 2825329 - protein, 19 aa, Entamoeba invadens
SCIPGYGFYNHHCYRCFSG

SEQ ID NO: 2825330 - protein, 23 aa, Entamoeba invadens
SCISCDIGYYLLIAKCYLCSENC

SEQ ID NO: 2825331 - protein, 24 aa, Entamoeba invadens
SCKDDYFALPEESKLCFPKSNLTH

SEQ ID NO: 2825332 - protein, 17 aa, Entamoeba invadens
SCKIDEHFVFRSEYIIH

SEQ ID NO: 2825333 - protein, 17 aa, Entamoeba invadens
SCKIEEDVMLIALDLEL

SEQ ID NO: 2825334 - protein, 28 aa, Entamoeba invadens
SCKIRGMKIPYTVWFSKKITVLREIEAV

SEQ ID NO: 2825335 - protein, 23 aa, Entamoeba invadens
SCKSDFVITSKFLCSLDTNCVNY

SEQ ID NO: 2825336 - protein, 45 aa, Entamoeba invadens
SCKSQAVWWVILVVVMFVLIVLFVLIVTIVIVTKIIFNKIHKHEI

SEQ ID NO: 2825337 - protein, 21 aa, Entamoeba invadens
SCKYGTYLVGSFCVTCDTNCA

SEQ ID NO: 2825338 - protein, 22 aa, Entamoeba invadens
SCLDCPSFYFTKSTTSVECQRC

SEQ ID NO: 2825339 - protein, 49 aa, Entamoeba invadens
SCLEDNKYFLKIGLPVIVIIIVLIIIIIVIATVVIYLILQHKKKKEEMK

SEQ ID NO: 2825340 - protein, 18 aa, Entamoeba invadens
SCLSCNTNYYRLSTTQKL

SEQ ID NO: 2825341 - protein, 17 aa, Entamoeba invadens
SCLSCQIGYFLTNKMCV

SEQ ID NO: 2825342 - protein, 19 aa, Entamoeba invadens
SCLVCSSGYYPLSGMCVAC

SEQ ID NO: 2825343 - protein, 20 aa, Entamoeba invadens
SCLYSLNLGIAVGIPISIVI

SEQ ID NO: 2825344 - protein, 29 aa, Entamoeba invadens
SCMNIDIFYYFIEQIKVYALPLIISDKTT

SEQ ID NO: 2825345 - protein, 17 aa, Entamoeba invadens
SCMWFELPLIRNLDFKQ

SEQ ID NO: 2825346 - protein, 18 aa, Entamoeba invadens
SCNDGYFLNGKKCDTCSA

SEQ ID NO: 2825347 - protein, 20 aa, Entamoeba invadens
SCNDGYFLNGKMCDTCSAGT

SEQ ID NO: 2825348 - protein, 20 aa, Entamoeba invadens
SCNDGYYLNNNKCTKCTIGC

SEQ ID NO: 2825349 - protein, 21 aa, Entamoeba invadens
SCNDGYYLNNNKCTKCTTGCS

SEQ ID NO: 2825350 - protein, 47 aa, Entamoeba invadens
SCNSRAVWWVIFISVLFIVIIILTLILLTLLLILKVLQHKRQEEERK

SEQ ID NO: 2825351 - protein, 25 aa, Entamoeba invadens
SCPNLLFEALFFTAFMICTSFTVTS

SEQ ID NO: 2825352 - protein, 22 aa, Entamoeba invadens
SCPVGQYFYINRCLSCPDQTYS

SEQ ID NO: 2825353 - protein, 49 aa, Entamoeba invadens
SCQRRSLLAVVFPIVLVTLLIVLLLISILLIVLITKHFDRRETLTCRTK

SEQ ID NO: 2825354 - protein, 29 aa, Entamoeba invadens
SCQTQAVWWVIFVCVFFRMIEHKRRKKAQ

SEQ ID NO: 2825355 - protein, 44 aa, Entamoeba invadens
SCQTQAVWWVIFVCVFFVLIVILLFIIMCIIITFKVIEHKRRKK

SEQ ID NO: 2825356 - protein, 46 aa, Entamoeba invadens
SCQTQAVWWVIFVCVFFVVIVILMLIIMCIIIIFKVIEHKKRKKAQ

SEQ ID NO: 2825357 - protein, 48 aa, Entamoeba invadens
SCSKTNWALIIPLVVIGILLIVAVIFVIIVIIWWKRKKSLAAESTAIK

SEQ ID NO: 2825358 - protein, 47 aa, Entamoeba invadens
SCSKVNIALIVPLVVFGVIIIGIIIIGIVWIFWRRRVRKINEENDAI

SEQ ID NO: 2825359 - protein, 20 aa, Entamoeba invadens
SCTAGYYLEGGKCKKCKTGC

SEQ ID NO: 2825360 - protein, 30 aa, Entamoeba invadens
SCTDAFPNEDFRFPWDIAMFVSSQKRPEIR

SEQ ID NO: 2825361 - protein, 17 aa, Entamoeba invadens
SCTFWYSPSDDGTFCSK

SEQ ID NO: 2825362 - protein, 17 aa, Entamoeba invadens
SCTICESNYYPKQGRCV

SEQ ID NO: 2825363 - protein, 43 aa, Entamoeba invadens
SCVDMSKLIIIIPTISVIVIFIIIIVIVVIITLVVLHKKESEE

SEQ ID NO: 2825364 - protein, 18 aa, Entamoeba invadens
SCVEGERYYFNGVCNICE

SEQ ID NO: 2825365 - protein, 20 aa, Entamoeba invadens
SCVESLFSFYRYANKINMKV

SEQ ID NO: 2825366 - protein, 18 aa, Entamoeba invadens
SCVIGYGLAVGKCAICQK

SEQ ID NO: 2825367 - protein, 25 aa, Entamoeba invadens
SCVINNLLYVVLSLVLSGFDTIIDA

SEQ ID NO: 2825368 - protein, 38 aa, Entamoeba invadens
SCVSKAVWWIILIIVIFCLLMIVLVTTTLVFLFNIIQN

SEQ ID NO: 2825369 - protein, 46 aa, Entamoeba invadens
SCVSKAVWWIILIIVTFCLLMIVLVTTTFVFLFNLIQNKQRKNELE

SEQ ID NO: 2825370 - protein, 19 aa, Entamoeba invadens
SCVTQYIMKDFCPVLYIPL

SEQ ID NO: 2825371 - protein, 18 aa, Entamoeba invadens
SCVVGYAFVVGKCAICPK

SEQ ID NO: 2825372 - protein, 57 aa, Entamoeba invadens
SCYDDFITLDLPIKYMFLNLGDWTMKNYIFFAVFPVWIIAICMLIGYGVLSRVVERQ

SEQ ID NO: 2825373 - protein, 19 aa, Entamoeba invadens
SCYDGYFTSGKICDTCSAG

SEQ ID NO: 2825374 - protein, 19 aa, Entamoeba invadens
SCYDGYTLNNGKCEICPAG

SEQ ID NO: 2825375 - protein, 17 aa, Entamoeba invadens
SCYEIIPNCQLCKYNNG

SEQ ID NO: 2825376 - protein, 37 aa, Entamoeba invadens
SCYNFNYWDSLGNSMLIFLILLHLSALALKCTVETTN

SEQ ID NO: 2825377 - protein, 17 aa, Entamoeba invadens
SCYNSTYCISCENGYFL

SEQ ID NO: 2825378 - protein, 27 aa, Entamoeba invadens
SCYRTSLSTVLIPIGLSVGLVAMCSVI

SEQ ID NO: 2825379 - protein, 19 aa, Entamoeba invadens
SCYSMYLVLKQFKGNSDPK

SEQ ID NO: 2825380 - protein, 30 aa, Entamoeba invadens
SCYTQIVRWVILICVIVALLILTTVIILVV

SEQ ID NO: 2825381 - protein, 30 aa, Entamoeba invadens
SDAGHGLFIFLLGLAFIIFAKKLQGKEMND

SEQ ID NO: 2825382 - protein, 24 aa, Entamoeba invadens
SDASLLILIFSFIGVVVNLYKISK

SEQ ID NO: 2825383 - protein, 25 aa, Entamoeba invadens
SDDCFNVFAQCHWFICSNDKRVISY

SEQ ID NO: 2825384 - protein, 25 aa, Entamoeba invadens
SDDDWLFPVDKRKWYEKIPFTHWYK

SEQ ID NO: 2825385 - protein, 27 aa, Entamoeba invadens
SDDFSEKVIFYATLPLFRNSMIVSSMT

SEQ ID NO: 2825386 - protein, 48 aa, Entamoeba invadens
SDDGTYCSKTAVWWLILLIVVIVISILVLVIVLVFFVMTKFSKYRKDS

SEQ ID NO: 2825387 - protein, 45 aa, Entamoeba invadens
SDDGTYCSKTAVWWVILLIIVIVISILVLVIVSVSFVMVKVIKHK

SEQ ID NO: 2825388 - protein, 46 aa, Entamoeba invadens
SDDGTYCSKTAVWWVILLIVVVIIAILVLVTVLVFFVMVKVIKNKR

SEQ ID NO: 2825389 - protein, 25 aa, Entamoeba invadens
SDDIKYIDFILNNTNLKILNTNDYY

SEQ ID NO: 2825390 - protein, 26 aa, Entamoeba invadens
SDEAFTSYTFLLPKELKVASIKFTDA

SEQ ID NO: 2825391 - protein, 23 aa, Entamoeba invadens
SDEEILIYLKNRNEWIGRMLEKL

SEQ ID NO: 2825392 - protein, 22 aa, Entamoeba invadens
SDEIDMKLKLKFLLDGAKGVSY

SEQ ID NO: 2825393 - protein, 18 aa, Entamoeba invadens
SDFKFRYRRGLPMVLKGI

SEQ ID NO: 2825394 - protein, 22 aa, Entamoeba invadens
SDFKFRYRRGLPMVLKGINATI

SEQ ID NO: 2825395 - protein, 18 aa, Entamoeba invadens
SDFSRKCIVCRSNYYPVY

SEQ ID NO: 2825396 - protein, 19 aa, Entamoeba invadens
SDFSRKCVTCRGGKYPKDG

SEQ ID NO: 2825397 - protein, 47 aa, Entamoeba invadens
SDGTYCITKSVWWVILLIILFIIFLLILVVVGLYLLVKKLYAKSNRK

SEQ ID NO: 2825398 - protein, 17 aa, Entamoeba invadens
SDGYYLNGKTCTACAAG

SEQ ID NO: 2825399 - protein, 22 aa, Entamoeba invadens
SDHFCFSACSLFTYHFSEKKSA

SEQ ID NO: 2825400 - protein, 27 aa, Entamoeba invadens
SDHKPVSCCFLLYPSKLFNDKLEEVQC

SEQ ID NO: 2825401 - protein, 17 aa, Entamoeba invadens
SDHYECTMCHYACKVCS

SEQ ID NO: 2825402 - protein, 20 aa, Entamoeba invadens
SDICLYLAVENKIVDLKCKR

SEQ ID NO: 2825403 - protein, 27 aa, Entamoeba invadens
SDIDQNFWIMIFRTTSQIAYLFIDGNV

SEQ ID NO: 2825404 - protein, 27 aa, Entamoeba invadens
SDIDQRFDIWLRRNLTSIPYVHVDGLV

SEQ ID NO: 2825405 - protein, 24 aa, Entamoeba invadens
SDIEQWYHLLPQSNIPFLAINAFD

SEQ ID NO: 2825406 - protein, 22 aa, Entamoeba invadens
SDIFFLFITFIAGTGIYAVVLP

SEQ ID NO: 2825407 - protein, 22 aa, Entamoeba invadens
SDIFMFHKFVIINNIKFYSNEE

SEQ ID NO: 2825408 - protein, 17 aa, Entamoeba invadens
SDIFSFAISMYECFTWK

SEQ ID NO: 2825409 - protein, 18 aa, Entamoeba invadens
SDIFSFAISMYECFTWKE

SEQ ID NO: 2825410 - protein, 26 aa, Entamoeba invadens
SDILFERNAFYEKTLLLKKDIERLNS

SEQ ID NO: 2825411 - protein, 26 aa, Entamoeba invadens
SDINAPYIFVFVIGGITLGEISMLRL

SEQ ID NO: 2825412 - protein, 22 aa, Entamoeba invadens
SDIRGHIYCKLCPAGTYSIELG

SEQ ID NO: 2825413 - protein, 32 aa, Entamoeba invadens
SDIYSFAITMYETFEWRAAYSKDKFKFAWCIA

SEQ ID NO: 2825414 - protein, 36 aa, Entamoeba invadens
SDIYSLAITFYECLIWEEPYPKQKFKFAWSVADFVT

SEQ ID NO: 2825415 - protein, 18 aa, Entamoeba invadens
SDIYYDIGNFYLRAIEVK

SEQ ID NO: 2825416 - protein, 22 aa, Entamoeba invadens
SDKCVWLDRSSKTFGYCPTPKT

SEQ ID NO: 2825417 - protein, 34 aa, Entamoeba invadens
SDLGRIFCCLYILAFFLYFPMRLSKIINALKMKD

SEQ ID NO: 2825418 - protein, 25 aa, Entamoeba invadens
SDLITRFWCVLPLLLFCVVFYVFGS

SEQ ID NO: 2825419 - protein, 22 aa, Entamoeba invadens
SDLKTCNLGYTTTTYFNINDHK

SEQ ID NO: 2825420 - protein, 32 aa, Entamoeba invadens
SDLYDIETLYVIFFFILKNLRDTLIDQWLVSD

SEQ ID NO: 2825421 - protein, 31 aa, Entamoeba invadens
SDLYTKMFTFHLVLLSIFTKALCFKEVENVI

SEQ ID NO: 2825422 - protein, 33 aa, Entamoeba invadens
SDMFLRYAPDVHLMLKVMWVVNCFMVSLDIPIG

SEQ ID NO: 2825423 - protein, 19 aa, Entamoeba invadens
SDMVIVWGISDKAVLKSAQ

SEQ ID NO: 2825424 - protein, 23 aa, Entamoeba invadens
SDNGYIYYFGVDPIWKSSNNELY

SEQ ID NO: 2825425 - protein, 25 aa, Entamoeba invadens
SDNRKYYFWVFIEEFKDTTLDISLD

SEQ ID NO: 2825426 - protein, 26 aa, Entamoeba invadens
SDNSSQKLFVWPLKKVDTIEKVPKIE

SEQ ID NO: 2825427 - protein, 30 aa, Entamoeba invadens
SDSDSTYLIFPFLCSFIAIILSFLAVPISV

SEQ ID NO: 2825428 - protein, 30 aa, Entamoeba invadens
SDSEQFLTGLLILFTIPLISELLHDIDCEK

SEQ ID NO: 2825429 - protein, 31 aa, Entamoeba invadens
SDSKKAIHVPYLIRVKFLFDAARGVEYLHKN

SEQ ID NO: 2825430 - protein, 22 aa, Entamoeba invadens
SDSSRFCTTCKIGLRPNTTSGK

SEQ ID NO: 2825431 - protein, 23 aa, Entamoeba invadens
SDSSRLCITCKSGLRPNTTSGKC

SEQ ID NO: 2825432 - protein, 26 aa, Entamoeba invadens
SDTKCTACPIGYYLTVEGKCLACDGK

SEQ ID NO: 2825433 - protein, 27 aa, Entamoeba invadens
SDTKCTACPLGYYLTVDGKCLACDGKC

SEQ ID NO: 2825434 - protein, 27 aa, Entamoeba invadens
SDTKLYLKIYDLFYGHFNIQFSYIQGV

SEQ ID NO: 2825435 - protein, 41 aa, Entamoeba invadens
SDVFSLAITMYETLIWGEAYPKKEFKYAWAIADFITSGKRR

SEQ ID NO: 2825436 - protein, 45 aa, Entamoeba invadens
SDVIGSLFFGLLLGVAILLTGKFRFGYVFGFTFVGSFAEYFVLSL

SEQ ID NO: 2825437 - protein, 32 aa, Entamoeba invadens
SDVMKLLGVLIFLLIMFYVNGFNKRIAKKLSN

SEQ ID NO: 2825438 - protein, 25 aa, Entamoeba invadens
SDVYSYGMILWELSTLSAPFPQFKF

SEQ ID NO: 2825439 - protein, 26 aa, Entamoeba invadens
SDYAIAQFRFLVKLLLVHGRYNYRRL

SEQ ID NO: 2825440 - protein, 22 aa, Entamoeba invadens
SDYITHFYGAVFIRSKECMITE

SEQ ID NO: 2825441 - protein, 22 aa, Entamoeba invadens
SDYIVHFYGAVFVPKRICLVTE

SEQ ID NO: 2825442 - protein, 18 aa, Entamoeba invadens
SDYLLYSCSQFLTVVASE

SEQ ID NO: 2825443 - protein, 20 aa, Entamoeba invadens
SDYLNIISLPSRNITFLIPT

SEQ ID NO: 2825444 - protein, 24 aa, Entamoeba invadens
SDYSVIEHYYGDIYYCTFASTVQD

SEQ ID NO: 2825445 - protein, 18 aa, Entamoeba invadens
SEALYFISWVCESTTNEV

SEQ ID NO: 2825446 - protein, 26 aa, Entamoeba invadens
SEANEALICPLTLSIKNWSPVDAECL

SEQ ID NO: 2825447 - protein, 24 aa, Entamoeba invadens
SECDSKFVGYLSDDNVCTACAANC

SEQ ID NO: 2825448 - protein, 18 aa, Entamoeba invadens
SECFVFLGDDFFFYRPTP

SEQ ID NO: 2825449 - protein, 32 aa, Entamoeba invadens
SECFVFLGDDFFFYRPTPPDFYFKGDKLIIHS

SEQ ID NO: 2825450 - protein, 31 aa, Entamoeba invadens
SECSSLLFWAYLFSTITLSLWMVVTLSLITF

SEQ ID NO: 2825451 - protein, 20 aa, Entamoeba invadens
SECTFWYEPSLDGLTCEMKS

SEQ ID NO: 2825452 - protein, 18 aa, Entamoeba invadens
SECVSCSFLYKANKTYCS

SEQ ID NO: 2825453 - protein, 39 aa, Entamoeba invadens
SEDTYGLSWQGWLFSLLLSFLTLLVGQISFFIPVPKEVP

SEQ ID NO: 2825454 - protein, 27 aa, Entamoeba invadens
SEEAIILFTLFVSLGLHKRLIHKLLKC

SEQ ID NO: 2825455 - protein, 28 aa, Entamoeba invadens
SEEIDKKLRLKFLLDGAKGIQYLHENGI

SEQ ID NO: 2825456 - protein, 28 aa, Entamoeba invadens
SEEIEKKLRLKFLLDGAKGIQYLHENGI

SEQ ID NO: 2825457 - protein, 35 aa, Entamoeba invadens
SEENMKILQIFDVRLYYFFYSTTNLHLIVSYRNNR

SEQ ID NO: 2825458 - protein, 25 aa, Entamoeba invadens
SEEVNIFFCVFVSLGLHKKLVHKLM

SEQ ID NO: 2825459 - protein, 17 aa, Entamoeba invadens
SEFELFLTPNYTTKINT

SEQ ID NO: 2825460 - protein, 22 aa, Entamoeba invadens
SEHFNLTIFDYQQLVVFKGNDA

SEQ ID NO: 2825461 - protein, 27 aa, Entamoeba invadens
SEIDMKLRIKFMLDTSQGILYLHSNGI

SEQ ID NO: 2825462 - protein, 21 aa, Entamoeba invadens
SEIFFDLRIWAGCPIDIQVYI

SEQ ID NO: 2825463 - protein, 25 aa, Entamoeba invadens
SEIIGLICRFSFDNFVVAQKKLVLG

SEQ ID NO: 2825464 - protein, 22 aa, Entamoeba invadens
SEINDFTCLFSLTKNSSFVVQP

SEQ ID NO: 2825465 - protein, 26 aa, Entamoeba invadens
SEINNNLFIFKFENSFLTLNKFSKIN

SEQ ID NO: 2825466 - protein, 23 aa, Entamoeba invadens
SEISLKLLPILRAVTKSLQTKMV

SEQ ID NO: 2825467 - protein, 39 aa, Entamoeba invadens
SEIYQFLVKWYAKNGQLFWVYQIIRMMCSIISSTFLAYF

SEQ ID NO: 2825468 - protein, 23 aa, Entamoeba invadens
SEKDLLMELLIRMSKKVDKRVGS

SEQ ID NO: 2825469 - protein, 35 aa, Entamoeba invadens
SEKELNEIYIWKVFYSTLIWVLKNINKTTLTNFCT

SEQ ID NO: 2825470 - protein, 17 aa, Entamoeba invadens
SEKFEMECVISQTLYDM

SEQ ID NO: 2825471 - protein, 23 aa, Entamoeba invadens
SEKLIFVASHPFMLHYLTKDCSG

SEQ ID NO: 2825472 - protein, 17 aa, Entamoeba invadens
SEKLRICSLCNKEFSNC

SEQ ID NO: 2825473 - protein, 25 aa, Entamoeba invadens
SEKVNPLLTWYQFKVNSVFKAEMLN

SEQ ID NO: 2825474 - protein, 23 aa, Entamoeba invadens
SEKYYNEFLFKAKSEALYFISWV

SEQ ID NO: 2825475 - protein, 18 aa, Entamoeba invadens
SELEKRIFFTSCTTKPTV

SEQ ID NO: 2825476 - protein, 32 aa, Entamoeba invadens
SELGLFNCFLILLQLFFAGLVVLLLDELLSNG

SEQ ID NO: 2825477 - protein, 24 aa, Entamoeba invadens
SELKELWICPVACAIHIVFQFLGC

SEQ ID NO: 2825478 - protein, 19 aa, Entamoeba invadens
SELLAYKCLTNCASGMRFL

SEQ ID NO: 2825479 - protein, 32 aa, Entamoeba invadens
SELTEKFVYFGNWTRYFLTCKDYPMIDVDSGI

SEQ ID NO: 2825480 - protein, 20 aa, Entamoeba invadens
SELYMAPEILKQQKYKKSAD

SEQ ID NO: 2825481 - protein, 20 aa, Entamoeba invadens
SELYWLLECTGIDCFQISNR

SEQ ID NO: 2825482 - protein, 44 aa, Entamoeba invadens
SENGTYCISKAVWWVILILAIFVIIIVTLILVATSYILKKVLKT

SEQ ID NO: 2825483 - protein, 22 aa, Entamoeba invadens
SENHTLLIFSILKEVLSLVNRK

SEQ ID NO: 2825484 - protein, 37 aa, Entamoeba invadens
SENKYDVLYYLAMQPWRHIIWTSFENGVFVTRVINED

SEQ ID NO: 2825485 - protein, 24 aa, Entamoeba invadens
SENSLISFMLPFHIGNSISIDNNS

SEQ ID NO: 2825486 - protein, 19 aa, Entamoeba invadens
SEPYCPCGGTEDWYITPLP

SEQ ID NO: 2825487 - protein, 25 aa, Entamoeba invadens
  misc_feature (23)..(24): Xaa can be any naturally occurring amino acid
SERGHSFWKRLLTYNNYFNVKEXXF

SEQ ID NO: 2825488 - protein, 30 aa, Entamoeba invadens
SERICGLLFHLRQALTISSLPILKKFNVNV

SEQ ID NO: 2825489 - protein, 21 aa, Entamoeba invadens
SERKCIVCKTGFYPDSNGVCF

SEQ ID NO: 2825490 - protein, 18 aa, Entamoeba invadens
SERLQYFETLLSKSFIPK

SEQ ID NO: 2825491 - protein, 32 aa, Entamoeba invadens
SERQGIKIRLLYFRALLRQDSGWYDFHESGEL

SEQ ID NO: 2825492 - protein, 42 aa, Entamoeba invadens
SESGEYCYLKAVWWVFFISSLIFVIILVVALVIIKQIGEGSF

SEQ ID NO: 2825493 - protein, 53 aa, Entamoeba invadens
SESGTFCNTKAVWWFILIIIIFVLVIITMFVVCIYIILIKIQKNRHKKIIEKT

SEQ ID NO: 2825494 - protein, 22 aa, Entamoeba invadens
SESKYTFCLPLSKTNISNCKHA

SEQ ID NO: 2825495 - protein, 17 aa, Entamoeba invadens
SESLQDFPSIKYPCLTC

SEQ ID NO: 2825496 - protein, 30 aa, Entamoeba invadens
SESSDDLTWLWITLGVVGGLVVVALVIGAI

SEQ ID NO: 2825497 - protein, 35 aa, Entamoeba invadens
SESTSHLYTITYPKLYKRSFSNTLCSSFSVAYTEE

SEQ ID NO: 2825498 - protein, 26 aa, Entamoeba invadens
SESTYQYVFAYAYSSFQYEMIAVKFI

SEQ ID NO: 2825499 - protein, 25 aa, Entamoeba invadens
SETFSRTCIKCISGFYPNKVTGICN

SEQ ID NO: 2825500 - protein, 33 aa, Entamoeba invadens
SETPLDYSFCRYPMKYRVGKWFKINMTDITNRF

SEQ ID NO: 2825501 - protein, 28 aa, Entamoeba invadens
SETVFTLRNLFNKPPLIIKQLVNGKLEE

SEQ ID NO: 2825502 - protein, 22 aa, Entamoeba invadens
SEVSLKIKIKMMTDAAKGIQYL

SEQ ID NO: 2825503 - protein, 28 aa, Entamoeba invadens
SEWLRIRATPAFWLKKGTLVVKPNYNDV

SEQ ID NO: 2825504 - protein, 22 aa, Entamoeba invadens
SEYITHFYGAVFIRSKECMVTE

SEQ ID NO: 2825505 - protein, 20 aa, Entamoeba invadens
SEYIVHFYGAVFIPNKICMV

SEQ ID NO: 2825506 - protein, 20 aa, Entamoeba invadens
SEYIVHFYGAVFIPNKVCMV

SEQ ID NO: 2825507 - protein, 20 aa, Entamoeba invadens
SEYIVHFYGAVFIPNKVCVV

SEQ ID NO: 2825508 - protein, 20 aa, Entamoeba invadens
SEYIVHFYGAVFIPSKICMV

SEQ ID NO: 2825509 - protein, 20 aa, Entamoeba invadens
SEYIVHFYGAVFIPSKVCIV

SEQ ID NO: 2825510 - protein, 20 aa, Entamoeba invadens
SEYIVHFYGAVFIQNKVCMV

SEQ ID NO: 2825511 - protein, 21 aa, Entamoeba invadens
SEYIVHFYGAVFVPNKVCMVT

SEQ ID NO: 2825512 - protein, 20 aa, Entamoeba invadens
SEYVVHFYGAVFVPTQMCMV

SEQ ID NO: 2825513 - protein, 27 aa, Entamoeba invadens
SFAADFVLMYFTITVMLFYGASSSIHL

SEQ ID NO: 2825514 - protein, 23 aa, Entamoeba invadens
SFAICMLEIWLTRDPYPIIEFRD

SEQ ID NO: 2825515 - protein, 26 aa, Entamoeba invadens
SFAIGYLLFYFLVVFDSLRKNMKAMN

SEQ ID NO: 2825516 - protein, 21 aa, Entamoeba invadens
SFAIIMFELLAKHPAYDNTEL

SEQ ID NO: 2825517 - protein, 30 aa, Entamoeba invadens
SFAISMYECFTWKEPYPIENFKFAWSIADF

SEQ ID NO: 2825518 - protein, 31 aa, Entamoeba invadens
SFAITMFETIFWKEAFPKSEFKYPWKIADFV

SEQ ID NO: 2825519 - protein, 17 aa, Entamoeba invadens
SFAITMFEVFGWQDAYN

SEQ ID NO: 2825520 - protein, 40 aa, Entamoeba invadens
SFAITMYECFGWTDPYPKQSFMFAWSIADFISSGKRLEII

SEQ ID NO: 2825521 - protein, 19 aa, Entamoeba invadens
SFAITMYECFTWGDAFVSF

SEQ ID NO: 2825522 - protein, 31 aa, Entamoeba invadens
SFAITMYECFVWGEAYPKSTFKFPWEIPEFV

SEQ ID NO: 2825523 - protein, 20 aa, Entamoeba invadens
SFAITMYETFSWEDAYKGDA

SEQ ID NO: 2825524 - protein, 38 aa, Entamoeba invadens
SFAITMYEVLTWKDPFPKEKFRFPWSIADFISAGKRFD

SEQ ID NO: 2825525 - protein, 24 aa, Entamoeba invadens
SFAVTMFETFIWDKSYPETNKKFE

SEQ ID NO: 2825526 - protein, 24 aa, Entamoeba invadens
SFCCLACWCVFMLQPTFECSVTTP

SEQ ID NO: 2825527 - protein, 31 aa, Entamoeba invadens
SFCENPPNALYPLFNFLLTFIDNKKQDAPCY

SEQ ID NO: 2825528 - protein, 28 aa, Entamoeba invadens
SFCFQMSIKWMFVLSLRLRNGLIAMIYA

SEQ ID NO: 2825529 - protein, 19 aa, Entamoeba invadens
SFCLTCQNGFYLNNQHECI

SEQ ID NO: 2825530 - protein, 20 aa, Entamoeba invadens
SFDLVRELPFTLGQCVFKPI

SEQ ID NO: 2825531 - protein, 25 aa, Entamoeba invadens
SFEFPELFVELFPKFSVLPKKIDII

SEQ ID NO: 2825532 - protein, 25 aa, Entamoeba invadens
SFEITLICILLIYPLSFSRTLDALK

SEQ ID NO: 2825533 - protein, 18 aa, Entamoeba invadens
SFEKWVRFLTQELCVFLR

SEQ ID NO: 2825534 - protein, 21 aa, Entamoeba invadens
SFFAPSHLFFINAFDEKNCPN

SEQ ID NO: 2825535 - protein, 20 aa, Entamoeba invadens
SFFEIWKEALSDQTLLILIA

SEQ ID NO: 2825536 - protein, 20 aa, Entamoeba invadens
SFFKVNWFFSYAVASMLFVG

SEQ ID NO: 2825537 - protein, 19 aa, Entamoeba invadens
SFFLLTKITEINLKENPLR

SEQ ID NO: 2825538 - protein, 30 aa, Entamoeba invadens
SFFNIPMQFFFILYFFLFTPTDESFEEEHY

SEQ ID NO: 2825539 - protein, 19 aa, Entamoeba invadens
SFFSEILRNIKFIKYNAWE

SEQ ID NO: 2825540 - protein, 25 aa, Entamoeba invadens
SFGEIHCYYGYFKENFFHCRNAMDC

SEQ ID NO: 2825541 - protein, 17 aa, Entamoeba invadens
SFGFYKKSGKCYSCDKN

SEQ ID NO: 2825542 - protein, 24 aa, Entamoeba invadens
SFGISLVCVFYIGAVLAILCTIGC

SEQ ID NO: 2825543 - protein, 35 aa, Entamoeba invadens
SFGITIFEVISWKEPYLKDQFKYPWKIAEFVMGGN

SEQ ID NO: 2825544 - protein, 19 aa, Entamoeba invadens
SFGITLLECFKWKEAYGGE

SEQ ID NO: 2825545 - protein, 24 aa, Entamoeba invadens
SFGITMFEVISWKEPYSKDQFKYP

SEQ ID NO: 2825546 - protein, 25 aa, Entamoeba invadens
SFGITMFEVISWKEPYSKDQFKYPW

SEQ ID NO: 2825547 - protein, 42 aa, Entamoeba invadens
SFGITMYECFMWKEAYPKSIFKFPWMIAEQVINGKRPVFPNC

SEQ ID NO: 2825548 - protein, 17 aa, Entamoeba invadens
SFGITMYETFGWSEPYN

SEQ ID NO: 2825549 - protein, 23 aa, Entamoeba invadens
SFGIVLWEFLTRKRPYGKMDPHE

SEQ ID NO: 2825550 - protein, 22 aa, Entamoeba invadens
SFGIVYLGRYRGEKVAIKEMKE

SEQ ID NO: 2825551 - protein, 20 aa, Entamoeba invadens
SFGIVYLGTFRGNKVAIKKL

SEQ ID NO: 2825552 - protein, 38 aa, Entamoeba invadens
SFGMTMYQTFKWNKIYDKTTFPWIIADKICKGERPSLD

SEQ ID NO: 2825553 - protein, 25 aa, Entamoeba invadens
SFGVTLFECYKWGEAYPKNEFKYAW

SEQ ID NO: 2825554 - protein, 24 aa, Entamoeba invadens
SFGVTLFNVLVWHNPYQGSCFKYP

SEQ ID NO: 2825555 - protein, 17 aa, Entamoeba invadens
SFGVTMYETFGWSEAYN

SEQ ID NO: 2825556 - protein, 23 aa, Entamoeba invadens
SFGVVFKGGFRNNIFGCEYIVHF

SEQ ID NO: 2825557 - protein, 17 aa, Entamoeba invadens
SFGYYLEHTNINCVQCS

SEQ ID NO: 2825558 - protein, 39 aa, Entamoeba invadens
SFIEYNILYLLIMNYYFNSILYLLYINYYSLCSIGEDEK

SEQ ID NO: 2825559 - protein, 31 aa, Entamoeba invadens
SFIICFCYLLFRHIFLYFNMYLIWTVDFTTT

SEQ ID NO: 2825560 - protein, 17 aa, Entamoeba invadens
SFILALTASKTIQISLT

SEQ ID NO: 2825561 - protein, 25 aa, Entamoeba invadens
SFITYYLVPLSFLNTNFTLLFTCFL

SEQ ID NO: 2825562 - protein, 30 aa, Entamoeba invadens
SFKCDVFSFAICLLEIWLTKSPYDPEVFVT

SEQ ID NO: 2825563 - protein, 18 aa, Entamoeba invadens
SFKFPWKIAEFVIAGSRL

SEQ ID NO: 2825564 - protein, 32 aa, Entamoeba invadens
SFKIRDPAFLAFLGFFFYLLTGAKCLCDALQE

SEQ ID NO: 2825565 - protein, 28 aa, Entamoeba invadens
SFKQETFLSFFLLLVVTVIFGFIVPMTS

SEQ ID NO: 2825566 - protein, 17 aa, Entamoeba invadens
SFKTEMFPLFNFEVKEV

SEQ ID NO: 2825567 - protein, 17 aa, Entamoeba invadens
SFLALMAYFQELQMTWY

SEQ ID NO: 2825568 - protein, 22 aa, Entamoeba invadens
SFLFFMIFSVFDVKFIFNIWKS

SEQ ID NO: 2825569 - protein, 19 aa, Entamoeba invadens
SFLFYTEGSDLCGPLDSCV

SEQ ID NO: 2825570 - protein, 27 aa, Entamoeba invadens
SFLHHNNFFFMVYPSKIGFYTVDLNPT

SEQ ID NO: 2825571 - protein, 18 aa, Entamoeba invadens
SFLIFTATSRIVASNVEV

SEQ ID NO: 2825572 - protein, 31 aa, Entamoeba invadens
SFLINTRKLNQMVLILILKKFENRQQVIEKI

SEQ ID NO: 2825573 - protein, 18 aa, Entamoeba invadens
SFLKMRLFRLHPTAVCGG

SEQ ID NO: 2825574 - protein, 17 aa, Entamoeba invadens
SFLLEKLVRIVRDFHSK

SEQ ID NO: 2825575 - protein, 20 aa, Entamoeba invadens
SFLLFTPTRIVCYIWRVLFT

SEQ ID NO: 2825576 - protein, 20 aa, Entamoeba invadens
SFLSYSAFNTLKKLFILIPE

SEQ ID NO: 2825577 - protein, 20 aa, Entamoeba invadens
SFLTGFLFDHYGTRGALIYA

SEQ ID NO: 2825578 - protein, 28 aa, Entamoeba invadens
SFLTNYTYYFGFTEKKKTVITVCGVLIL

SEQ ID NO: 2825579 - protein, 24 aa, Entamoeba invadens
SFLVALWSLLFWDSPHAVFPILIL

SEQ ID NO: 2825580 - protein, 18 aa, Entamoeba invadens
SFLVTDMISISLVSIYLS

SEQ ID NO: 2825581 - protein, 17 aa, Entamoeba invadens
SFMHCGLSDVSLNPKSL

SEQ ID NO: 2825582 - protein, 20 aa, Entamoeba invadens
SFMLFRTYKWYVPVLAILHH

SEQ ID NO: 2825583 - protein, 26 aa, Entamoeba invadens
SFMLKYNVLSYWKKGAILILNSKEKD

SEQ ID NO: 2825584 - protein, 30 aa, Entamoeba invadens
SFMMDYRFLLFPCILDSHWFLIIVCNKTEK

SEQ ID NO: 2825585 - protein, 23 aa, Entamoeba invadens
SFNDLLPMCLFIVIVVSILFLFI

SEQ ID NO: 2825586 - protein, 26 aa, Entamoeba invadens
SFNNNSLIMFSAMNSLLVSTTPLIFT

SEQ ID NO: 2825587 - protein, 29 aa, Entamoeba invadens
SFNNSNLPPGFLFLFGVRANVWAPTNLTV

SEQ ID NO: 2825588 - protein, 26 aa, Entamoeba invadens
SFNWNTKMIFVWVKASFETEKTPMNI

SEQ ID NO: 2825589 - protein, 20 aa, Entamoeba invadens
SFPHYIMSDCKFIASTLLYS

SEQ ID NO: 2825590 - protein, 29 aa, Entamoeba invadens
SFPNFLIFVILFFVFHILEFMFNAVNFPK

SEQ ID NO: 2825591 - protein, 18 aa, Entamoeba invadens
SFPYAWDIVDFVVNGKRH

SEQ ID NO: 2825592 - protein, 17 aa, Entamoeba invadens
SFQFFLPIVFPLNDSKL

SEQ ID NO: 2825593 - protein, 21 aa, Entamoeba invadens
SFQIVAKYFYFYEDYVNAVQI

SEQ ID NO: 2825594 - protein, 18 aa, Entamoeba invadens
SFQLLNPRPTFSPPLQQM

SEQ ID NO: 2825595 - protein, 18 aa, Entamoeba invadens
SFQYEMIAVKFITNMVKT

SEQ ID NO: 2825596 - protein, 22 aa, Entamoeba invadens
SFRGRSLVILASSQKPTIVTID

SEQ ID NO: 2825597 - protein, 26 aa, Entamoeba invadens
SFRPLEGFFTPFIILISISDSFIDNA

SEQ ID NO: 2825598 - protein, 18 aa, Entamoeba invadens
SFSALFFAILNRVPEITL

SEQ ID NO: 2825599 - protein, 25 aa, Entamoeba invadens
SFSGLSTIKYLYTKSFYECSSMIRI

SEQ ID NO: 2825600 - protein, 22 aa, Entamoeba invadens
SFSLMFWKNYPPAISAIVIMLM

SEQ ID NO: 2825601 - protein, 18 aa, Entamoeba invadens
SFSLTMLEIAMWKEVFRK

SEQ ID NO: 2825602 - protein, 17 aa, Entamoeba invadens
SFSRLKKCQKCQTSYSL

SEQ ID NO: 2825603 - protein, 17 aa, Entamoeba invadens
SFTIGMLEGISWKDPYP

SEQ ID NO: 2825604 - protein, 20 aa, Entamoeba invadens
SFTNIFFHGDAQPKTVTTSL

SEQ ID NO: 2825605 - protein, 27 aa, Entamoeba invadens
SFTNLFAFSGFVPIGSYIILRSAYLTR

SEQ ID NO: 2825606 - protein, 27 aa, Entamoeba invadens
SFTSTMLKMLPIKQFEKIKVVLRNFAM

SEQ ID NO: 2825607 - protein, 43 aa, Entamoeba invadens
SFVANLVIYFVVSIVIYYILYGTILLFILIGDRQLKKAIRKDL

SEQ ID NO: 2825608 - protein, 29 aa, Entamoeba invadens
SFVDISQYYIFPWVTFSFNKSFNYVYNNT

SEQ ID NO: 2825609 - protein, 26 aa, Entamoeba invadens
SFVGNIFVYFCLIKMFNVNFVLILIF

SEQ ID NO: 2825610 - protein, 19 aa, Entamoeba invadens
SFVLVFLVPCLYQLMSIKM

SEQ ID NO: 2825611 - protein, 21 aa, Entamoeba invadens
SFVNFMCTLLFIVNYPRMAEE

SEQ ID NO: 2825612 - protein, 18 aa, Entamoeba invadens
SFVPAFLVFCSVELIVGT

SEQ ID NO: 2825613 - protein, 20 aa, Entamoeba invadens
SFVPVMFLAYILGSYVAIPV

SEQ ID NO: 2825614 - protein, 23 aa, Entamoeba invadens
SFVTYLILIIIQHGSADAIGPKE

SEQ ID NO: 2825615 - protein, 29 aa, Entamoeba invadens
SGAFNYYFFFITNILFFIVCLGQGLYYYL

SEQ ID NO: 2825616 - protein, 19 aa, Entamoeba invadens
SGAFPFYPFVTSKTDYLAT

SEQ ID NO: 2825617 - protein, 19 aa, Entamoeba invadens
SGALYPLPDIIYTSLGCID

SEQ ID NO: 2825618 - protein, 20 aa, Entamoeba invadens
SGALYPLPDIIYTSLGCIDM

SEQ ID NO: 2825619 - protein, 18 aa, Entamoeba invadens
SGCIICATGYYLDENNCE

SEQ ID NO: 2825620 - protein, 18 aa, Entamoeba invadens
SGCLLCDTGFYIDNQRCL

SEQ ID NO: 2825621 - protein, 23 aa, Entamoeba invadens
SGCLLCNTGFYIDNQKCLPCNTK

SEQ ID NO: 2825622 - protein, 20 aa, Entamoeba invadens
SGCLVMMIGFMYLSSYPTTV

SEQ ID NO: 2825623 - protein, 26 aa, Entamoeba invadens
SGCRTCISGYYLYDGLCVKCGEGCSK

SEQ ID NO: 2825624 - protein, 23 aa, Entamoeba invadens
SGCTTCIPGYYISKGKCVSCEQI

SEQ ID NO: 2825625 - protein, 19 aa, Entamoeba invadens
SGCYLCQPGYYVSAGNCKQ

SEQ ID NO: 2825626 - protein, 26 aa, Entamoeba invadens
SGDFDGFLTLSCVFLRCGIETVKALP

SEQ ID NO: 2825627 - protein, 26 aa, Entamoeba invadens
SGDIQQLLSLPLNSLLPLFAAVFNER

SEQ ID NO: 2825628 - protein, 24 aa, Entamoeba invadens
SGDVIVAAVIFLLSRKRDVEYPTS

SEQ ID NO: 2825629 - protein, 19 aa, Entamoeba invadens
SGDVLIYNFSRIRNVTALP

SEQ ID NO: 2825630 - protein, 25 aa, Entamoeba invadens
SGEFNGDVLYLVRTEIQNFVTQFGV

SEQ ID NO: 2825631 - protein, 26 aa, Entamoeba invadens
SGEKPKIMKMKYTKYPYWATTEKFTT

SEQ ID NO: 2825632 - protein, 25 aa, Entamoeba invadens
SGEVKIRALFSKKIKLFSNTVSFVF

SEQ ID NO: 2825633 - protein, 28 aa, Entamoeba invadens
SGFACEFEIFLTPYCTMNLSDKIMIISL

SEQ ID NO: 2825634 - protein, 26 aa, Entamoeba invadens
SGFACEFEVFLTPLCTMDLSDEVMIV

SEQ ID NO: 2825635 - protein, 24 aa, Entamoeba invadens
SGFACEFSIYLTPQCTCHITDIIQ

SEQ ID NO: 2825636 - protein, 22 aa, Entamoeba invadens
SGFACFPCDLNCKICDPHQCIT

SEQ ID NO: 2825637 - protein, 24 aa, Entamoeba invadens
SGFGKFTIEAYQFTNGGYLKSGTK

SEQ ID NO: 2825638 - protein, 22 aa, Entamoeba invadens
SGFIFTERLPMYTTVKDSTLKV

SEQ ID NO: 2825639 - protein, 21 aa, Entamoeba invadens
SGFKWSVVTVIVPCAVGTAVS

SEQ ID NO: 2825640 - protein, 17 aa, Entamoeba invadens
SGFLEFVKTAQPLFSIF

SEQ ID NO: 2825641 - protein, 26 aa, Entamoeba invadens
SGFSSSLNILLMRLNMIYNSFSNLDE

SEQ ID NO: 2825642 - protein, 21 aa, Entamoeba invadens
SGFSVYFDVETVIKKLTITSK

SEQ ID NO: 2825643 - protein, 40 aa, Entamoeba invadens
SGGAIFGIVFAVIVFVVIIAAIIGVVVFFIVKKGPKTSSH

SEQ ID NO: 2825644 - protein, 26 aa, Entamoeba invadens
SGGFGWCDGLLLRAMKSGSWVLLDEL

SEQ ID NO: 2825645 - protein, 43 aa, Entamoeba invadens
SGGFVLFTFVFLTSLIRCGFRLCYFIFLIQWTNTINTTLPQGE

SEQ ID NO: 2825646 - protein, 23 aa, Entamoeba invadens
SGHYFTYVFLYVVLFHLLNTIQY

SEQ ID NO: 2825647 - protein, 20 aa, Entamoeba invadens
SGIAFISTYLHKAFFEMSGQ

SEQ ID NO: 2825648 - protein, 36 aa, Entamoeba invadens
SGIFTPLGMMIIALLGVLIYWVIYDIQFNFIDRILP

SEQ ID NO: 2825649 - protein, 28 aa, Entamoeba invadens
SGILLKDLLIIFYYFNLNFSVVINNIYN

SEQ ID NO: 2825650 - protein, 22 aa, Entamoeba invadens
SGILRIFLLIVQQKELMEYRDD

SEQ ID NO: 2825651 - protein, 19 aa, Entamoeba invadens
SGIPLYSAMAFDYSDKKEC

SEQ ID NO: 2825652 - protein, 25 aa, Entamoeba invadens
SGKCLICLSGTRSLFSRCVSCEEMT

SEQ ID NO: 2825653 - protein, 41 aa, Entamoeba invadens
SGKFVGKWRHSQFITWIVIFSIIHISLAISLIMGYGGLIMS

SEQ ID NO: 2825654 - protein, 28 aa, Entamoeba invadens
SGKSTLLNHLFYTQFRILNESLGRSRTT

SEQ ID NO: 2825655 - protein, 22 aa, Entamoeba invadens
SGKSTLLNYLFDTNFAVLDEKK

SEQ ID NO: 2825656 - protein, 39 aa, Entamoeba invadens
SGLEDWAIALIFLSCVVVIAIILALIVIVAIYLTKKKEK

SEQ ID NO: 2825657 - protein, 20 aa, Entamoeba invadens
SGLYFWSQNSACVPTNCLLY

SEQ ID NO: 2825658 - protein, 25 aa, Entamoeba invadens
SGNCTLCFVGNYLFEGKCLSCKLGT

SEQ ID NO: 2825659 - protein, 29 aa, Entamoeba invadens
SGNDDVEIYFWYNTALLFSQDFFEFEAHF

SEQ ID NO: 2825660 - protein, 23 aa, Entamoeba invadens
SGNDFYFSQITPLLSFDSTYNFN

SEQ ID NO: 2825661 - protein, 24 aa, Entamoeba invadens
SGNKWMMVIIHTPNNPKYVFHFEP

SEQ ID NO: 2825662 - protein, 26 aa, Entamoeba invadens
SGNLQGIITKLPYISNLGFNAIWMTP

SEQ ID NO: 2825663 - protein, 17 aa, Entamoeba invadens
SGNVKPILQFLCSQKPN

SEQ ID NO: 2825664 - protein, 17 aa, Entamoeba invadens
SGNYYKELFYTGSDKVK

SEQ ID NO: 2825665 - protein, 20 aa, Entamoeba invadens
SGSILLAYFGIEDPLRVEVP

SEQ ID NO: 2825666 - protein, 25 aa, Entamoeba invadens
SGSKNVITMPYKLKIKILIDCARGM

SEQ ID NO: 2825667 - protein, 36 aa, Entamoeba invadens
SGSLVMFVIMWICLAGRICALYYYNTYFTKWAQTIR

SEQ ID NO: 2825668 - protein, 27 aa, Entamoeba invadens
SGSSKILLAIFFVLTGVTVAVVGFVYF

SEQ ID NO: 2825669 - protein, 23 aa, Entamoeba invadens
SGSTIAEGVFKDCKKLKTVTITG

SEQ ID NO: 2825670 - protein, 47 aa, Entamoeba invadens
SGSVAPVLFLVLCAILFGYVRLWAFIPIILCLLFVFANLLSSQVIGY

SEQ ID NO: 2825671 - protein, 24 aa, Entamoeba invadens
SGSVCITCEDGCKRCFIKDNLTNE

SEQ ID NO: 2825672 - protein, 24 aa, Entamoeba invadens
SGTCTPWPPVNPKQKVKCPSNCIG

SEQ ID NO: 2825673 - protein, 47 aa, Entamoeba invadens
SGTFCNTKAVWWVIILIVLFLLIIIVMCIVSIVFIFNSIQRTIHKKE

SEQ ID NO: 2825674 - protein, 39 aa, Entamoeba invadens
SGTFCQNSPVWWLIVIIIIIILLVVVLLIIGTCIALSQL

SEQ ID NO: 2825675 - protein, 48 aa, Entamoeba invadens
SGTLCNKKAVWWVLIIIVLLAILLLTMAILLIIFAVLYIEKKVRQKEI

SEQ ID NO: 2825676 - protein, 17 aa, Entamoeba invadens
SGTLKVLVVALVFVLMI

SEQ ID NO: 2825677 - protein, 18 aa, Entamoeba invadens
SGTLKVLVVVVVFVLMIA

SEQ ID NO: 2825678 - protein, 23 aa, Entamoeba invadens
SGTMNRYYTGTLGLDCNCASATA

SEQ ID NO: 2825679 - protein, 26 aa, Entamoeba invadens
SGTQANFLWKILYDKIGSMGNDGKNI

SEQ ID NO: 2825680 - protein, 24 aa, Entamoeba invadens
SGTSCLSCYSSCSYCSGPNSNQCT

SEQ ID NO: 2825681 - protein, 25 aa, Entamoeba invadens
SGVCLSCTSGYYLDATKKCVLGTVE

SEQ ID NO: 2825682 - protein, 43 aa, Entamoeba invadens
SGVCQKQSLWYVYLIIAIIVLGIICLVVLIVAYYIVNKKVKVK

SEQ ID NO: 2825683 - protein, 27 aa, Entamoeba invadens
SGVERACFKCDLGYYPINGKCTPCHET

SEQ ID NO: 2825684 - protein, 22 aa, Entamoeba invadens
SGVFDGLRKGFYSLGWGVWDGV

SEQ ID NO: 2825685 - protein, 18 aa, Entamoeba invadens
SGVIPAYSNLFKTNFRKV

SEQ ID NO: 2825686 - protein, 25 aa, Entamoeba invadens
SGVKAMYILLFFGYSLIVYIFSDFI

SEQ ID NO: 2825687 - protein, 29 aa, Entamoeba invadens
SGVLLNAILLLSLSYFLFSKSRFVSHVVI

SEQ ID NO: 2825688 - protein, 26 aa, Entamoeba invadens
SGVTTIFLLLMTNLKIIVFAQSQTLL

SEQ ID NO: 2825689 - protein, 43 aa, Entamoeba invadens
SGVVIGMYYDWRLGLCSLAIFPILVFFMYMDGYLNSEQSSPAI

SEQ ID NO: 2825690 - protein, 36 aa, Entamoeba invadens
SGVVLFFTELLKEDFRFFSLYNYSIVFMTVGLIGFG

SEQ ID NO: 2825691 - protein, 17 aa, Entamoeba invadens
SGWTKLGLLFLGASFYG

SEQ ID NO: 2825692 - protein, 17 aa, Entamoeba invadens
SGYFFALTQFRLPHVLL

SEQ ID NO: 2825693 - protein, 25 aa, Entamoeba invadens
SGYFVMRFLAIYIPHISVICAIVIA

SEQ ID NO: 2825694 - protein, 23 aa, Entamoeba invadens
SGYTLFFIFVIWRVCVLQEEVEN

SEQ ID NO: 2825695 - protein, 27 aa, Entamoeba invadens
SHASWKLLLFIMPWIIASVVAISRTRD

SEQ ID NO: 2825696 - protein, 28 aa, Entamoeba invadens
SHEFDQMMIILILLFTHVISQNYDDLLI

SEQ ID NO: 2825697 - protein, 20 aa, Entamoeba invadens
SHFLFAVLMFVLCTAVSYAA

SEQ ID NO: 2825698 - protein, 21 aa, Entamoeba invadens
SHHLLCKFFVWGNPQGLPKDI

SEQ ID NO: 2825699 - protein, 24 aa, Entamoeba invadens
SHILIHLLILYVMGINDWCEVNGV

SEQ ID NO: 2825700 - protein, 31 aa, Entamoeba invadens
SHKDIYHSIRKIPQFPFFPTIPIEGFLDDYT

SEQ ID NO: 2825701 - protein, 30 aa, Entamoeba invadens
SHKTDYSRRAFYRLGLFSLLLHEVMLEFNM

SEQ ID NO: 2825702 - protein, 32 aa, Entamoeba invadens
SHLTLSVLSFVLFLDFLYLDVNMLRLKLFTNY

SEQ ID NO: 2825703 - protein, 33 aa, Entamoeba invadens
SHLTTLLDSLNSLKYLFFHGKEAPKIIPSDPTL

SEQ ID NO: 2825704 - protein, 51 aa, Entamoeba invadens
SHLTVHFNYFIHFTLSLGQLKKVWFFTNIKVKYIIFCYKFKNSRRVKNKKL

SEQ ID NO: 2825705 - protein, 37 aa, Entamoeba invadens
SHMILTVCCIGVGVFIYIVILIVLLDGYYEALSDTGA

SEQ ID NO: 2825706 - protein, 24 aa, Entamoeba invadens
SHPKSYLNFLIKSTNHYVIKQFKQ

SEQ ID NO: 2825707 - protein, 24 aa, Entamoeba invadens
SHPMSLGTFMLIYSLMLQQEGFEL

SEQ ID NO: 2825708 - protein, 17 aa, Entamoeba invadens
SHPSLIIPNFFEGVLSE

SEQ ID NO: 2825709 - protein, 18 aa, Entamoeba invadens
SHTQALLLRALYTETKEA

SEQ ID NO: 2825710 - protein, 21 aa, Entamoeba invadens
SHVCLLCEIGFYQDGTNQTFC

SEQ ID NO: 2825711 - protein, 28 aa, Entamoeba invadens
SHVYGFGFLRIVLVVDLFVPVSELFWTG

SEQ ID NO: 2825712 - protein, 22 aa, Entamoeba invadens
SIAFRLFYVLAAFNIPFAMLIA

SEQ ID NO: 2825713 - protein, 31 aa, Entamoeba invadens
SIASYYLIIVLVVVFIVFMIFHNFFIRSSIE

SEQ ID NO: 2825714 - protein, 28 aa, Entamoeba invadens
SIAVQIVFLCYIIFSALPKFIFGSLLQK

SEQ ID NO: 2825715 - protein, 18 aa, Entamoeba invadens
SICALCHINYFRDADGKC

SEQ ID NO: 2825716 - protein, 20 aa, Entamoeba invadens
SICFWMSHQFAPKGSFTTVA

SEQ ID NO: 2825717 - protein, 24 aa, Entamoeba invadens
SICIACNEGYYLEKSNCIAEVECS

SEQ ID NO: 2825718 - protein, 26 aa, Entamoeba invadens
SICIAMVFVVYLITQILILKRHNQFI

SEQ ID NO: 2825719 - protein, 19 aa, Entamoeba invadens
SICMSCISGYYFEDDTCSK

SEQ ID NO: 2825720 - protein, 20 aa, Entamoeba invadens
SIDLSFPRSIFFEQEALLEE

SEQ ID NO: 2825721 - protein, 35 aa, Entamoeba invadens
SIDNLGCYSPPVPWWAFLIIAVVVVFLVVVIIITL

SEQ ID NO: 2825722 - protein, 20 aa, Entamoeba invadens
SIDPLALLPFIVESLKDLSS

SEQ ID NO: 2825723 - protein, 22 aa, Entamoeba invadens
SIFAFLAILVFLSGRIAALFYF

SEQ ID NO: 2825724 - protein, 21 aa, Entamoeba invadens
SIFGCISCEIGYYLSNVECHQ

SEQ ID NO: 2825725 - protein, 26 aa, Entamoeba invadens
SIFIEKKLMRVCPNSIFPFQKTCCNF

SEQ ID NO: 2825726 - protein, 25 aa, Entamoeba invadens
SIFQTLLLPLIIFNAGFTMKKRNFF

SEQ ID NO: 2825727 - protein, 22 aa, Entamoeba invadens
SIFSLQVLPLEESILKTPIVVT

SEQ ID NO: 2825728 - protein, 25 aa, Entamoeba invadens
SIGCAMYLSLLLEPNWRKSQINVNH

SEQ ID NO: 2825729 - protein, 23 aa, Entamoeba invadens
SIGLFIITFFITSSILTKVGKDK

SEQ ID NO: 2825730 - protein, 18 aa, Entamoeba invadens
SIGRSFLVVDKKVLQFAL

SEQ ID NO: 2825731 - protein, 26 aa, Entamoeba invadens
SIHETSSHFFTFYMPAIPVEISTCHK

SEQ ID NO: 2825732 - protein, 27 aa, Entamoeba invadens
SIHMTLFIIVIVILTTSFLVSLIGFYL

SEQ ID NO: 2825733 - protein, 20 aa, Entamoeba invadens
SIHQCVLYTTIPRCLTVENN

SEQ ID NO: 2825734 - protein, 30 aa, Entamoeba invadens
SIIFITIVFIWIIFMFFTSYQSIRKHNSIV

SEQ ID NO: 2825735 - protein, 27 aa, Entamoeba invadens
SIIICVLYLVFWGFMLFPGGGVVSVWY

SEQ ID NO: 2825736 - protein, 19 aa, Entamoeba invadens
SIIKLIKYGGLKNSILLIF

SEQ ID NO: 2825737 - protein, 25 aa, Entamoeba invadens
SIISYAIIGILIFNEAYNFMNPNWV

SEQ ID NO: 2825738 - protein, 33 aa, Entamoeba invadens
SIKREYLSFKNIYIFSVLDLVANFNFFGLYNSM

SEQ ID NO: 2825739 - protein, 17 aa, Entamoeba invadens
SILFFLKSVVPVFTSNR

SEQ ID NO: 2825740 - protein, 21 aa, Entamoeba invadens
SILFGLSLGFILFFFSAFSSE

SEQ ID NO: 2825741 - protein, 19 aa, Entamoeba invadens
SILFIILSLVFVASFFTGI

SEQ ID NO: 2825742 - protein, 22 aa, Entamoeba invadens
SILFPQVLTYKELLKYGIDYIK

SEQ ID NO: 2825743 - protein, 27 aa, Entamoeba invadens
SILLIMHLLFLIFFLDTNQYSSLSHMN

SEQ ID NO: 2825744 - protein, 28 aa, Entamoeba invadens
SILQLVLTFYRFLSFLVMFITCTVQIAY

SEQ ID NO: 2825745 - protein, 26 aa, Entamoeba invadens
SILRRPLPVFLFALIIPLPQNNISLL

SEQ ID NO: 2825746 - protein, 24 aa, Entamoeba invadens
SILVICLALMFKRTRKLFLYLILF

SEQ ID NO: 2825747 - protein, 22 aa, Entamoeba invadens
SILVLILFVVYGQISDVCQCTP

SEQ ID NO: 2825748 - protein, 18 aa, Entamoeba invadens
SILVTPYFNLTNSKISLA

SEQ ID NO: 2825749 - protein, 29 aa, Entamoeba invadens
SILVYAVFLWVPFKYRSFINLFLIVLAYS

SEQ ID NO: 2825750 - protein, 18 aa, Entamoeba invadens
SILYFALGFICFCIWIAG

SEQ ID NO: 2825751 - protein, 18 aa, Entamoeba invadens
SIMFFTYFVSGHLEIFRV

SEQ ID NO: 2825752 - protein, 31 aa, Entamoeba invadens
SIMQAVFSMVFYFTPITLFTGILLVGYSTFY

SEQ ID NO: 2825753 - protein, 22 aa, Entamoeba invadens
SINLNNIYLIDESAFAGLTSLQ

SEQ ID NO: 2825754 - protein, 17 aa, Entamoeba invadens
SIPAVCTAALPIKNIPF

SEQ ID NO: 2825755 - protein, 20 aa, Entamoeba invadens
SIPDFTFNGCTLLATVTGIE

SEQ ID NO: 2825756 - protein, 24 aa, Entamoeba invadens
SIPDVPLTLLPFDRDYIGFAIFDK

SEQ ID NO: 2825757 - protein, 25 aa, Entamoeba invadens
SIPSILIPMFFPSVVYPLVIVLTLV

SEQ ID NO: 2825758 - protein, 27 aa, Entamoeba invadens
SIPTDKFTLLQSGHLLRYGTSTAVYCH

SEQ ID NO: 2825759 - protein, 24 aa, Entamoeba invadens
SIQKFSHLGKLLLFYGKNAKTQIS

SEQ ID NO: 2825760 - protein, 24 aa, Entamoeba invadens
SIQLLLLSVFLLVCLFNGFLQIEA

SEQ ID NO: 2825761 - protein, 18 aa, Entamoeba invadens
SIRFVPQSGTLSPGVGIN

SEQ ID NO: 2825762 - protein, 19 aa, Entamoeba invadens
SIRVVGIYLVLVLGMWLWG

SEQ ID NO: 2825763 - protein, 24 aa, Entamoeba invadens
SISISLGYIIIYSVTSRTSFENIE

SEQ ID NO: 2825764 - protein, 24 aa, Entamoeba invadens
SISKPTITLFKLTKTVLFISENYM

SEQ ID NO: 2825765 - protein, 17 aa, Entamoeba invadens
SISLLFCGLLIVIYAVT

SEQ ID NO: 2825766 - protein, 22 aa, Entamoeba invadens
SISNFKFYFLKKTNNNFDTVRC

SEQ ID NO: 2825767 - protein, 29 aa, Entamoeba invadens
SISVFFSFKKYIYNPTKNAFFPLEYPNKN

SEQ ID NO: 2825768 - protein, 26 aa, Entamoeba invadens
SITHCNTCLPGFFKSDYYSCSACSAG

SEQ ID NO: 2825769 - protein, 39 aa, Entamoeba invadens
SITLAWTYKRSLFLIFQTGYILFLLVIGVSRNAYLNWFM

SEQ ID NO: 2825770 - protein, 32 aa, Entamoeba invadens
SITMYECFGWCKAYPMELFRYSWMIAEFVSDN

SEQ ID NO: 2825771 - protein, 18 aa, Entamoeba invadens
SITWLIAMSIISLSWIFL

SEQ ID NO: 2825772 - protein, 22 aa, Entamoeba invadens
SIVCSFLVLGLSFLAVVTVSIS

SEQ ID NO: 2825773 - protein, 17 aa, Entamoeba invadens
SIVDLPVFFTNYFQMTT

SEQ ID NO: 2825774 - protein, 24 aa, Entamoeba invadens
SIVFSIIYLIYGVTIPIFHDMYFN

SEQ ID NO: 2825775 - protein, 21 aa, Entamoeba invadens
SIVFYVWQVFPRVLAKYVGLD

SEQ ID NO: 2825776 - protein, 33 aa, Entamoeba invadens
SIVGLVIIIGLVSLILIFAMRYVKVDFNIYKTQ

SEQ ID NO: 2825777 - protein, 31 aa, Entamoeba invadens
SIVICFKYFPIIVVVLFCIVLIITSISFQSL

SEQ ID NO: 2825778 - protein, 29 aa, Entamoeba invadens
SIVIGFIHLFIIVWIVIVITVVVSSNTST

SEQ ID NO: 2825779 - protein, 17 aa, Entamoeba invadens
SIVILKRNFACEFEVFI

SEQ ID NO: 2825780 - protein, 21 aa, Entamoeba invadens
SIVISYIMKKMKMTFPEAFQT

SEQ ID NO: 2825781 - protein, 25 aa, Entamoeba invadens
SIVLYHILILVYFPSLVKTESKMMT

SEQ ID NO: 2825782 - protein, 19 aa, Entamoeba invadens
SIVPICIMLTFSCIRELFD

SEQ ID NO: 2825783 - protein, 24 aa, Entamoeba invadens
SIVSAANGFIYFVNKKGSYNKTKT

SEQ ID NO: 2825784 - protein, 20 aa, Entamoeba invadens
SIVTKMMYLYQDTGLEIIQW

SEQ ID NO: 2825785 - protein, 40 aa, Entamoeba invadens
SIWVTLFIYTKRLNIYVFAAFIISVILYAVVYTAVMFIPN

SEQ ID NO: 2825786 - protein, 29 aa, Entamoeba invadens
SIYKENYLPKYSILWLQTMSVVMRVLSNL

SEQ ID NO: 2825787 - protein, 29 aa, Entamoeba invadens
SIYQTTLYLLYLYMLLFASAAVVAIIFGF

SEQ ID NO: 2825788 - protein, 27 aa, Entamoeba invadens
SKAWMNAFQLFYISKDITVVLNGSFHS

SEQ ID NO: 2825789 - protein, 23 aa, Entamoeba invadens
SKCAACVEVTKKQTIKCTKCATQ

SEQ ID NO: 2825790 - protein, 20 aa, Entamoeba invadens
SKCAFWYLPTNDGILCKKKV

SEQ ID NO: 2825791 - protein, 21 aa, Entamoeba invadens
SKCDIGYLLVDGECQKTDVNC

SEQ ID NO: 2825792 - protein, 19 aa, Entamoeba invadens
SKCDPGFVGYLSSKGMCTP

SEQ ID NO: 2825793 - protein, 23 aa, Entamoeba invadens
SKCFYCSMGYYLSNNSCVDCEET

SEQ ID NO: 2825794 - protein, 17 aa, Entamoeba invadens
SKCILCDKSYYSYEGNC

SEQ ID NO: 2825795 - protein, 23 aa, Entamoeba invadens
SKCISCVFGYYLDKNDCLKCPDV

SEQ ID NO: 2825796 - protein, 20 aa, Entamoeba invadens
SKCMEMLSKCKYQKSFKQST

SEQ ID NO: 2825797 - protein, 26 aa, Entamoeba invadens
SKCSKCVFWYITSKDGTLCELQIVWW

SEQ ID NO: 2825798 - protein, 24 aa, Entamoeba invadens
SKCTNCIFGFYLENGECKPCSSIE

SEQ ID NO: 2825799 - protein, 25 aa, Entamoeba invadens
SKCTNCIFGFYLENSECKPCYSIEG

SEQ ID NO: 2825800 - protein, 21 aa, Entamoeba invadens
SKDAVPFIFVTLFALFILLAL

SEQ ID NO: 2825801 - protein, 27 aa, Entamoeba invadens
SKDLKTILLVYGPFISTIRVDDGIQGY

SEQ ID NO: 2825802 - protein, 26 aa, Entamoeba invadens
SKEDFCEWFLDVLIPSIERKKRLNKY

SEQ ID NO: 2825803 - protein, 20 aa, Entamoeba invadens
SKEKTMIESLRLLANSSLVS

SEQ ID NO: 2825804 - protein, 19 aa, Entamoeba invadens
SKFFYTFKMPSFVGMIMTI

SEQ ID NO: 2825805 - protein, 25 aa, Entamoeba invadens
SKFGESLLFFGDRLFVGSPDFSVVG

SEQ ID NO: 2825806 - protein, 26 aa, Entamoeba invadens
SKFHDDYIVHFYGAVFIPKKICMVTE

SEQ ID NO: 2825807 - protein, 23 aa, Entamoeba invadens
SKGCLKCFDGYYLTIKNECVSCE

SEQ ID NO: 2825808 - protein, 26 aa, Entamoeba invadens
SKGFSGMLYWCNFHVIFFVDRVIVEH

SEQ ID NO: 2825809 - protein, 19 aa, Entamoeba invadens
SKGILYLHSNNILHRDIKP

SEQ ID NO: 2825810 - protein, 29 aa, Entamoeba invadens
SKGSRAFSNLLMITFFTSKGNKLSIKNAY

SEQ ID NO: 2825811 - protein, 20 aa, Entamoeba invadens
SKIAFYYNELKLGKEFGDEK

SEQ ID NO: 2825812 - protein, 45 aa, Entamoeba invadens
SKIAIYISIGIVCVFVILVIISIIVLIIILFRMHHKKTKELRKVC

SEQ ID NO: 2825813 - protein, 45 aa, Entamoeba invadens
SKIAIYISMGIVCAFVILVIVSIIVLIIILLRMHHKKTKELRKVC

SEQ ID NO: 2825814 - protein, 29 aa, Entamoeba invadens
SKICEACTTPYLLEDLSLKCVTSCSDGYF

SEQ ID NO: 2825815 - protein, 23 aa, Entamoeba invadens
SKILIINKHQVDRKWWLCELKRW

SEQ ID NO: 2825816 - protein, 21 aa, Entamoeba invadens
SKILSCQRGYFLDGDKCILCE

SEQ ID NO: 2825817 - protein, 21 aa, Entamoeba invadens
SKIMPMYGVVTFVGNFISKSD

SEQ ID NO: 2825818 - protein, 36 aa, Entamoeba invadens
SKIPQFYRSFKLYEAILYHFTKFGISFKILENTLNC

SEQ ID NO: 2825819 - protein, 20 aa, Entamoeba invadens
SKIVYNMTLFLSLSKTTTGL

SEQ ID NO: 2825820 - protein, 18 aa, Entamoeba invadens
SKIWKKQTLNYQLKVKIL

SEQ ID NO: 2825821 - protein, 23 aa, Entamoeba invadens
SKKHMMIIFHTPNTKKFVFHFEP

SEQ ID NO: 2825822 - protein, 44 aa, Entamoeba invadens
SKKNYGLIIALPVVLVFMLILLIISIIVVILVIIRKLQEVVKMR

SEQ ID NO: 2825823 - protein, 50 aa, Entamoeba invadens
SKKTNYGLVIVLPIMCIVVILFIIILLITIILIIFNKKKENILTENICIF

SEQ ID NO: 2825824 - protein, 17 aa, Entamoeba invadens
SKKWILGSKFGFTTTTK

SEQ ID NO: 2825825 - protein, 22 aa, Entamoeba invadens
SKLCLVKYFGYTGAQFKALISQ

SEQ ID NO: 2825826 - protein, 29 aa, Entamoeba invadens
SKLFFPYNALVIIVLIMGALATVLCFSFV

SEQ ID NO: 2825827 - protein, 17 aa, Entamoeba invadens
SKLFWVGERSQWEDIGA

SEQ ID NO: 2825828 - protein, 21 aa, Entamoeba invadens
SKLRNPFIVNYVGSITYIPQV

SEQ ID NO: 2825829 - protein, 27 aa, Entamoeba invadens
SKLTSVKILSPLQFIGISCFARCSGLK

SEQ ID NO: 2825830 - protein, 24 aa, Entamoeba invadens
SKMKWMMVIFHTTNSPKFVFHFSP

SEQ ID NO: 2825831 - protein, 21 aa, Entamoeba invadens
SKMPGVCFKIEAVKKVMCLKY

SEQ ID NO: 2825832 - protein, 56 aa, Entamoeba invadens
SKNGMYCQEAPNWYLLVPLIVLVLVGLNVLIVLFLFLLRRLFRKMQKRNIEQNYTI

SEQ ID NO: 2825833 - protein, 22 aa, Entamoeba invadens
SKNKWMMVIFHTSNSPKYTFYF

SEQ ID NO: 2825834 - protein, 23 aa, Entamoeba invadens
SKNKWMMVIFHTTNSPKYTFYFE

SEQ ID NO: 2825835 - protein, 24 aa, Entamoeba invadens
SKNKYMMIIIHTPNCPKYVFHFEP

SEQ ID NO: 2825836 - protein, 26 aa, Entamoeba invadens
SKNSVWVGGLFGPHYNYLYDDQSYSI

SEQ ID NO: 2825837 - protein, 22 aa, Entamoeba invadens
SKPEMFFLHFPRKQELVVPIGI

SEQ ID NO: 2825838 - protein, 22 aa, Entamoeba invadens
SKPLRILTYNMYLRPMLVSAAG

SEQ ID NO: 2825839 - protein, 23 aa, Entamoeba invadens
SKPSIWKVIFKREWKNFLFMYIM

SEQ ID NO: 2825840 - protein, 18 aa, Entamoeba invadens
SKQLIAIVTELAPYGSLR

SEQ ID NO: 2825841 - protein, 19 aa, Entamoeba invadens
SKRYAALYIAPTIFCFMKG

SEQ ID NO: 2825842 - protein, 38 aa, Entamoeba invadens
SKSHIDSRWIVLLVILVVIIFFVVVLTGLGIFIRKKKQ

SEQ ID NO: 2825843 - protein, 24 aa, Entamoeba invadens
SKSPFKGLYGSTPLFQNLEYNNLT

SEQ ID NO: 2825844 - protein, 24 aa, Entamoeba invadens
SKTCLYIALFFLASPWRQCILICR

SEQ ID NO: 2825845 - protein, 33 aa, Entamoeba invadens
SKTELLSFDMLFFALLFIQSLSFVIGPTPNDLT

SEQ ID NO: 2825846 - protein, 25 aa, Entamoeba invadens
SKTHPLYFVFHSGDYTKYIILSKPF

SEQ ID NO: 2825847 - protein, 24 aa, Entamoeba invadens
SKTKMIPLQCQTNYIFDTTTNQCV

SEQ ID NO: 2825848 - protein, 23 aa, Entamoeba invadens
SKTKVMRMLFKVNDMSFVGSVVP

SEQ ID NO: 2825849 - protein, 22 aa, Entamoeba invadens
SKTKYIHFMKLLKDLYDVHCPT

SEQ ID NO: 2825850 - protein, 23 aa, Entamoeba invadens
SKTLQKSLLLKKWKREIKQTVGV

SEQ ID NO: 2825851 - protein, 50 aa, Entamoeba invadens
SKTNYGIVIGIPVAIFIFFIIIIALILVVVYLLILSRKEKKKMKNICVFE

SEQ ID NO: 2825852 - protein, 45 aa, Entamoeba invadens
SKTNYGMVIGIPVALIFIMIFLLFLLVYLTLRIHQKRIQHKVDKK

SEQ ID NO: 2825853 - protein, 21 aa, Entamoeba invadens
SKTVTFLPAFDAYGMDIYPVN

SEQ ID NO: 2825854 - protein, 29 aa, Entamoeba invadens
SKVEKVLKLILLLLYHRRDFNMSSLTMMM

SEQ ID NO: 2825855 - protein, 76 aa, Entamoeba invadens
SKYKKIVVSVYFFKFFSIFFKFFQFLPNSRYFKQLFVYKLMKRTTILIWNCRIIFVFFFFLTNQIKAINRIQKRKI

SEQ ID NO: 2825856 - protein, 25 aa, Entamoeba invadens
SKYLANFFEPLFLASTTPEKYPELT

SEQ ID NO: 2825857 - protein, 18 aa, Entamoeba invadens
SKYLPYIKNHFLVTADQV

SEQ ID NO: 2825858 - protein, 29 aa, Entamoeba invadens
SKYLQQQFKLYLPDYLIKQLIGEKVMSIT

SEQ ID NO: 2825859 - protein, 21 aa, Entamoeba invadens
SLACMFIISLFLVPLTTTVTF

SEQ ID NO: 2825860 - protein, 26 aa, Entamoeba invadens
SLAITMYEVFSWKEAYNKTEFKFPWK

SEQ ID NO: 2825861 - protein, 21 aa, Entamoeba invadens
SLALFVIVAFLLSVIMVVSGI

SEQ ID NO: 2825862 - protein, 19 aa, Entamoeba invadens
SLALPLLKLFIKINSKKYD

SEQ ID NO: 2825863 - protein, 18 aa, Entamoeba invadens
SLALPPHCEFLFGVNQNN

SEQ ID NO: 2825864 - protein, 20 aa, Entamoeba invadens
SLAMIAIPLNVLSTARGAAF

SEQ ID NO: 2825865 - protein, 26 aa, Entamoeba invadens
SLANNQLTYLPSLEKLPLKYLDISSN

SEQ ID NO: 2825866 - protein, 26 aa, Entamoeba invadens
SLAQTVFMRFFLKRKLEGVKTEYVVA

SEQ ID NO: 2825867 - protein, 37 aa, Entamoeba invadens
SLAVSFYEGYTWITPYPVSDFKFPWHIANFVIEGKRL

SEQ ID NO: 2825868 - protein, 37 aa, Entamoeba invadens
SLAVTMYEALVWGEAFPKSEFKYAWSIADFITSGNRR

SEQ ID NO: 2825869 - protein, 20 aa, Entamoeba invadens
SLCADTYFYYKRDSDLCITY

SEQ ID NO: 2825870 - protein, 25 aa, Entamoeba invadens
SLCDQIVIISLQLKSGKTSTDNFMI

SEQ ID NO: 2825871 - protein, 18 aa, Entamoeba invadens
SLCFSCDQNFYLHENKCY

SEQ ID NO: 2825872 - protein, 22 aa, Entamoeba invadens
SLCGLMLTLKLYDQNKSRNIEF

SEQ ID NO: 2825873 - protein, 38 aa, Entamoeba invadens
SLCILDVSFRTIRDIPLFITRNFVFRIITITTTYDFDL

SEQ ID NO: 2825874 - protein, 25 aa, Entamoeba invadens
SLCVSCMSGYILKKFGCVSLSQVSH

SEQ ID NO: 2825875 - protein, 24 aa, Entamoeba invadens
SLDFYYYNGYHDFGDFRFKSLTQS

SEQ ID NO: 2825876 - protein, 30 aa, Entamoeba invadens
SLDMLDPILTVFMSFFGVCYLSLSKQELLF

SEQ ID NO: 2825877 - protein, 25 aa, Entamoeba invadens
SLDYSRKCLICKTGYYPGSDGVCKL

SEQ ID NO: 2825878 - protein, 22 aa, Entamoeba invadens
SLEISYLFDIFAKIANLNKDPT

SEQ ID NO: 2825879 - protein, 18 aa, Entamoeba invadens
SLELLMKLVREKAERKDG

SEQ ID NO: 2825880 - protein, 19 aa, Entamoeba invadens
SLESFTFPHTLVTLGDYSF

SEQ ID NO: 2825881 - protein, 28 aa, Entamoeba invadens
SLESMTEQPLRFFKISNYGSLSLKNAEI

SEQ ID NO: 2825882 - protein, 26 aa, Entamoeba invadens
  misc_feature (26)..(26): Xaa can be any naturally occurring amino acid
SLESNVINFRLLFHSEYLFQLKQKSX

SEQ ID NO: 2825883 - protein, 24 aa, Entamoeba invadens
SLEYPIFASFLIFYKDKKKPTFWR

SEQ ID NO: 2825884 - protein, 22 aa, Entamoeba invadens
SLFFVFLISPSRGLEGCKTMFS

SEQ ID NO: 2825885 - protein, 24 aa, Entamoeba invadens
SLFIFWPGILLCKLTVPFDLFYGS

SEQ ID NO: 2825886 - protein, 34 aa, Entamoeba invadens
SLFLIGLVALVFGLLFAYYSTSSPHRISIFDAFW

SEQ ID NO: 2825887 - protein, 17 aa, Entamoeba invadens
SLFLSITLSFTDYILFA

SEQ ID NO: 2825888 - protein, 17 aa, Entamoeba invadens
SLFNGVCTSCSGIFNSC

SEQ ID NO: 2825889 - protein, 19 aa, Entamoeba invadens
SLFSIFNELKKIGKLRLPL

SEQ ID NO: 2825890 - protein, 18 aa, Entamoeba invadens
SLFSLTFANIFVAKSKIS

SEQ ID NO: 2825891 - protein, 30 aa, Entamoeba invadens
SLFVLFFYYLLFYIIIIYNYYLLLLFTINV

SEQ ID NO: 2825892 - protein, 27 aa, Entamoeba invadens
SLGGFFTLLFLYKPLVNYLGLRYTFIL

SEQ ID NO: 2825893 - protein, 29 aa, Entamoeba invadens
SLGIDDIIFHALITLLYISVRDKKSLNEC

SEQ ID NO: 2825894 - protein, 22 aa, Entamoeba invadens
SLGITFFEAFTWKDAFEDIKYF

SEQ ID NO: 2825895 - protein, 20 aa, Entamoeba invadens
SLGKLCFFSCRKLSSVIIPS

SEQ ID NO: 2825896 - protein, 38 aa, Entamoeba invadens
SLGMTIYTTMLWKEPFPKILFPYAWSVADFVTSGQMLG

SEQ ID NO: 2825897 - protein, 23 aa, Entamoeba invadens
SLGNVFERCDLFIPNSMGCAFCK

SEQ ID NO: 2825898 - protein, 39 aa, Entamoeba invadens
SLHIKRFMLPISFITLIVTFIPLVYYLITGDTMFKNWKN

SEQ ID NO: 2825899 - protein, 28 aa, Entamoeba invadens
SLHQPTLFVFILPITIRRWVGFKTQSDL

SEQ ID NO: 2825900 - protein, 19 aa, Entamoeba invadens
SLHVVKPISFGPNIKVTVT

SEQ ID NO: 2825901 - protein, 22 aa, Entamoeba invadens
SLIFLTYFVNSNQWCELGSTIL

SEQ ID NO: 2825902 - protein, 21 aa, Entamoeba invadens
SLIFQNECLLVFNKELYVNFI

SEQ ID NO: 2825903 - protein, 20 aa, Entamoeba invadens
SLIFVFGALSIHNIVPVDFG

SEQ ID NO: 2825904 - protein, 24 aa, Entamoeba invadens
SLIGGFIPFLIKLVKHQKLAARII

SEQ ID NO: 2825905 - protein, 17 aa, Entamoeba invadens
SLIVNYLISYLSAVPMT

SEQ ID NO: 2825906 - protein, 30 aa, Entamoeba invadens
SLIVSMHLLRTFFITLDPPLIPLSVCKKLE

SEQ ID NO: 2825907 - protein, 25 aa, Entamoeba invadens
SLKCSLIPILLYLVVTLISINSQRY

SEQ ID NO: 2825908 - protein, 28 aa, Entamoeba invadens
SLKDGLESITTIFYHGLHEPIVQSGVSV

SEQ ID NO: 2825909 - protein, 30 aa, Entamoeba invadens
SLKSVYIDPKFTTLLGIKILLDVSKGMDFL

SEQ ID NO: 2825910 - protein, 31 aa, Entamoeba invadens
SLKYKIRFDPPVIIIPHGYACELRMYITVFC

SEQ ID NO: 2825911 - protein, 23 aa, Entamoeba invadens
SLLAIGYSVWWFYHKQHFQQVHA

SEQ ID NO: 2825912 - protein, 17 aa, Entamoeba invadens
SLLFGIIFKCLVCLYVC

SEQ ID NO: 2825913 - protein, 19 aa, Entamoeba invadens
SLLGPFLYMVSDDLVFIVL

SEQ ID NO: 2825914 - protein, 24 aa, Entamoeba invadens
SLLHSFHFVYRQLTPLSVLVSSVK

SEQ ID NO: 2825915 - protein, 18 aa, Entamoeba invadens
SLLIFLFGITVGTFVVAM

SEQ ID NO: 2825916 - protein, 17 aa, Entamoeba invadens
SLLILISEATKFVLSGL

SEQ ID NO: 2825917 - protein, 20 aa, Entamoeba invadens
SLLLFFTRCLSLKWCGNGSQ

SEQ ID NO: 2825918 - protein, 19 aa, Entamoeba invadens
SLLLFIKGFGWKLMGLVFL

SEQ ID NO: 2825919 - protein, 18 aa, Entamoeba invadens
SLLLFLIGVSSEKCEAGY

SEQ ID NO: 2825920 - protein, 20 aa, Entamoeba invadens
SLLLFLISTSSEICEAGYYL

SEQ ID NO: 2825921 - protein, 18 aa, Entamoeba invadens
SLLLLVACLKEIPTTVLK

SEQ ID NO: 2825922 - protein, 20 aa, Entamoeba invadens
SLLPRMVVTLKKEYMYMLFV

SEQ ID NO: 2825923 - protein, 18 aa, Entamoeba invadens
SLLRATRPIPVYLQHLKG

SEQ ID NO: 2825924 - protein, 30 aa, Entamoeba invadens
SLLSPKMIRSILSQTLWQYACCLTIVFAGR

SEQ ID NO: 2825925 - protein, 17 aa, Entamoeba invadens
SLLTFVPLVNFLKQFQC

SEQ ID NO: 2825926 - protein, 19 aa, Entamoeba invadens
SLLTIEIIVGIVVGICFFF

SEQ ID NO: 2825927 - protein, 25 aa, Entamoeba invadens
SLLVSLMMIVTGVPLLYSCVCIVMQ

SEQ ID NO: 2825928 - protein, 21 aa, Entamoeba invadens
SLLWIVQLVIWTILRIFPLID

SEQ ID NO: 2825929 - protein, 26 aa, Entamoeba invadens
SLLYALLFRHLNFFVLLFLNYKAGHI

SEQ ID NO: 2825930 - protein, 20 aa, Entamoeba invadens
SLLYTLTYSFECSSGCKGDC

SEQ ID NO: 2825931 - protein, 24 aa, Entamoeba invadens
SLMETRFLNIFRNEKDGLPHKWKA

SEQ ID NO: 2825932 - protein, 18 aa, Entamoeba invadens
SLMLMIFCHIAFNLMAFS

SEQ ID NO: 2825933 - protein, 33 aa, Entamoeba invadens
SLMLPVMALGQFWFFYVFKIYMKYAKQLLRLDV

SEQ ID NO: 2825934 - protein, 21 aa, Entamoeba invadens
SLNDYFKVTKPMSSALKKFGA

SEQ ID NO: 2825935 - protein, 23 aa, Entamoeba invadens
SLNIYTMNVVEISSIAFTGVSLN

SEQ ID NO: 2825936 - protein, 29 aa, Entamoeba invadens
SLNLKGRGVMFISKNYYRIHALSLAAVGA

SEQ ID NO: 2825937 - protein, 17 aa, Entamoeba invadens
SLNLKWLRNQIGLVGQE

SEQ ID NO: 2825938 - protein, 21 aa, Entamoeba invadens
SLNLNLYDLGYSFYPPCMPDK

SEQ ID NO: 2825939 - protein, 28 aa, Entamoeba invadens
SLNPMIVPKIFDLLYLLQQTLSRQMQST

SEQ ID NO: 2825940 - protein, 20 aa, Entamoeba invadens
SLNQFVYLKSNRLSKSFQAM

SEQ ID NO: 2825941 - protein, 23 aa, Entamoeba invadens
SLNVRITIDSPILAPHVYLQASY

SEQ ID NO: 2825942 - protein, 22 aa, Entamoeba invadens
SLNWYYMLIDPINKIQNILESY

SEQ ID NO: 2825943 - protein, 17 aa, Entamoeba invadens
SLPKRYVLRILEDVKRH

SEQ ID NO: 2825944 - protein, 34 aa, Entamoeba invadens
SLPQKILLGVLFILHYLFLKEVIPIKFSYNKLTD

SEQ ID NO: 2825945 - protein, 17 aa, Entamoeba invadens
SLPQTDYKIFYSKAPKL

SEQ ID NO: 2825946 - protein, 27 aa, Entamoeba invadens
SLPSLPNIIRLSKYTFYIGHKQFIHFH

SEQ ID NO: 2825947 - protein, 24 aa, Entamoeba invadens
SLQIDVCVACALGYYPNGEECIPC

SEQ ID NO: 2825948 - protein, 17 aa, Entamoeba invadens
SLQLPNIAFLARKPMKD

SEQ ID NO: 2825949 - protein, 17 aa, Entamoeba invadens
SLRTYLSYFNSGNFFLF

SEQ ID NO: 2825950 - protein, 20 aa, Entamoeba invadens
SLSCLLTVLFNIMSIGYISF

SEQ ID NO: 2825951 - protein, 25 aa, Entamoeba invadens
SLSIVVLLVLLFIPNSPVKAGLITV

SEQ ID NO: 2825952 - protein, 26 aa, Entamoeba invadens
SLSKIWGKYLINLELKVKLLDDLAVA

SEQ ID NO: 2825953 - protein, 26 aa, Entamoeba invadens
SLSKVWGKHPITYQLKVKILDDMAVA

SEQ ID NO: 2825954 - protein, 26 aa, Entamoeba invadens
SLSMVFFVFLFPLFYTDTYLCFVKND

SEQ ID NO: 2825955 - protein, 26 aa, Entamoeba invadens
SLSMWIYLYIVMVFVPMVFGYSCWKL

SEQ ID NO: 2825956 - protein, 19 aa, Entamoeba invadens
SLSSGRLLRYCKEQYEAEV

SEQ ID NO: 2825957 - protein, 30 aa, Entamoeba invadens
SLSVIFFQLFLLFFLIQSVSAPLSIGYCIS

SEQ ID NO: 2825958 - protein, 32 aa, Entamoeba invadens
SLSVLLVNKDLILFPFFNFTRTKELQYPITNY

SEQ ID NO: 2825959 - protein, 17 aa, Entamoeba invadens
SLSWIFLPFEEKYFVVE

SEQ ID NO: 2825960 - protein, 22 aa, Entamoeba invadens
SLTFFFVFINIVLSTLYIFDSM

SEQ ID NO: 2825961 - protein, 25 aa, Entamoeba invadens
SLTSIWVTMLIYTKRFSILVVLSFV

SEQ ID NO: 2825962 - protein, 25 aa, Entamoeba invadens
SLTTTTPILFKTWMQFLHFVGNIAN

SEQ ID NO: 2825963 - protein, 27 aa, Entamoeba invadens
SLVIHETIPWMLFVSTINFLKCTEKLL

SEQ ID NO: 2825964 - protein, 19 aa, Entamoeba invadens
SLVILSIAPFMILGTIFMG

SEQ ID NO: 2825965 - protein, 19 aa, Entamoeba invadens
SLVIVFEYHFIIGQTDIFA

SEQ ID NO: 2825966 - protein, 19 aa, Entamoeba invadens
SLVKELKLSFDSIGMFFFP

SEQ ID NO: 2825967 - protein, 24 aa, Entamoeba invadens
SLVLVLIFFFPKIGKYFLYFSVFF

SEQ ID NO: 2825968 - protein, 28 aa, Entamoeba invadens
SLVNIPLYIFLLFFIVNYASSTIGKITG

SEQ ID NO: 2825969 - protein, 36 aa, Entamoeba invadens
SLVNRKVIFVPPLDWSALLVLLALLFHFSDISQQHE

SEQ ID NO: 2825970 - protein, 23 aa, Entamoeba invadens
SLVNSSILKWCKVKAIITCVNQN

SEQ ID NO: 2825971 - protein, 23 aa, Entamoeba invadens
SLVPAFLVFLALSVLLGTIPIVY

SEQ ID NO: 2825972 - protein, 28 aa, Entamoeba invadens
SLVQSIYTNLFLYAYSNVIINTDCNIYG

SEQ ID NO: 2825973 - protein, 18 aa, Entamoeba invadens
SLVSLKPGYACEFEIFIK

SEQ ID NO: 2825974 - protein, 18 aa, Entamoeba invadens
SLVTPIIEFESCQFDLNS

SEQ ID NO: 2825975 - protein, 20 aa, Entamoeba invadens
SLVYFLMILTIQCVFLLINK

SEQ ID NO: 2825976 - protein, 26 aa, Entamoeba invadens
SLWKNHPDLPFLPKSKQLKGVSLLYQ

SEQ ID NO: 2825977 - protein, 17 aa, Entamoeba invadens
SLYFSELIFQGKELLTL

SEQ ID NO: 2825978 - protein, 17 aa, Entamoeba invadens
SLYGGVLIEKIASFTLV

SEQ ID NO: 2825979 - protein, 30 aa, Entamoeba invadens
SLYLACAEAFLLFFIITRFPQNNHLKEETV

SEQ ID NO: 2825980 - protein, 20 aa, Entamoeba invadens
SLYMDGTLKSGFYPDKVNIT

SEQ ID NO: 2825981 - protein, 21 aa, Entamoeba invadens
SMCTMCNVGLFLTPEGECIPC

SEQ ID NO: 2825982 - protein, 30 aa, Entamoeba invadens
SMDIFIFPIAILIFLYVIRNIVLVIIPIIN

SEQ ID NO: 2825983 - protein, 41 aa, Entamoeba invadens
SMEKYVMSIYVMDLVSSFVIFSIISCTYRQTYRKEEDAKTL

SEQ ID NO: 2825984 - protein, 31 aa, Entamoeba invadens
SMEVTTPFQIIWFYKMYTHFLCSLLDNAFPS

SEQ ID NO: 2825985 - protein, 30 aa, Entamoeba invadens
SMGIAIYEIITWKFPYQNMRSWDVADFVAS

SEQ ID NO: 2825986 - protein, 20 aa, Entamoeba invadens
SMILKFWKEACEFAKNGDFD

SEQ ID NO: 2825987 - protein, 17 aa, Entamoeba invadens
SMKKSNIPMKVLGNKIL

SEQ ID NO: 2825988 - protein, 17 aa, Entamoeba invadens
SMKLLTLEKNSTVYSSD

SEQ ID NO: 2825989 - protein, 31 aa, Entamoeba invadens
SMLDKFRNDYIIHFYGACFIPSHIEMVTEFA

SEQ ID NO: 2825990 - protein, 30 aa, Entamoeba invadens
SMLDKFRSDYLVHFYGAVMIPNRICMVNEF

SEQ ID NO: 2825991 - protein, 28 aa, Entamoeba invadens
SMLDKFRSPFIVHFFGAVFIPGKMCMVT

SEQ ID NO: 2825992 - protein, 25 aa, Entamoeba invadens
SMLTGFGISRILLSLTLVFFGIFTC

SEQ ID NO: 2825993 - protein, 25 aa, Entamoeba invadens
SMNLKMKWRCWINLDVSISSISMAP

SEQ ID NO: 2825994 - protein, 23 aa, Entamoeba invadens
SMNVPSVLLPYPTKQHSIDYTIE

SEQ ID NO: 2825995 - protein, 24 aa, Entamoeba invadens
SMRSVFTYLPYIKNYFIITDNQIP

SEQ ID NO: 2825996 - protein, 23 aa, Entamoeba invadens
SMRSVSKYLPYIKNHFLVTADQI

SEQ ID NO: 2825997 - protein, 37 aa, Entamoeba invadens
SMRYFGVVVIALFIVILLLVLLFFKSLMVPVRVVLTT

SEQ ID NO: 2825998 - protein, 33 aa, Entamoeba invadens
SMWWISASVMVFLIFVALFGASLYIAIKYFKKK

SEQ ID NO: 2825999 - protein, 18 aa, Entamoeba invadens
SMYCGCLFNEFFGFSIDF

SEQ ID NO: 2826000 - protein, 25 aa, Entamoeba invadens
SNAARTMLFNIYELHWDEEILDECH

SEQ ID NO: 2826001 - protein, 24 aa, Entamoeba invadens
SNAEDTFFSPLYNKNIPADGLSCF

SEQ ID NO: 2826002 - protein, 23 aa, Entamoeba invadens
SNAPVCDPLFTKELMTLCPTYIY

SEQ ID NO: 2826003 - protein, 20 aa, Entamoeba invadens
SNCIFITCKIGYTLNSKTGV

SEQ ID NO: 2826004 - protein, 20 aa, Entamoeba invadens
SNCKSCLSGYVFTTPLSEKC

SEQ ID NO: 2826005 - protein, 19 aa, Entamoeba invadens
SNCLSCNLGRYLKYNNNCE

SEQ ID NO: 2826006 - protein, 34 aa, Entamoeba invadens
SNDKGFIVIVVFIIFGIVLIVVVIGFLIYNKLKN

SEQ ID NO: 2826007 - protein, 27 aa, Entamoeba invadens
SNDPLLIFIAIVAHKWADSGLAVLYLM

SEQ ID NO: 2826008 - protein, 18 aa, Entamoeba invadens
SNDSQIYSFIFVLVMIFF

SEQ ID NO: 2826009 - protein, 24 aa, Entamoeba invadens
SNDVISTRKYLCSGPLFVVEKLTE

SEQ ID NO: 2826010 - protein, 20 aa, Entamoeba invadens
SNEGFDMSSLLLFKNMKVQT

SEQ ID NO: 2826011 - protein, 24 aa, Entamoeba invadens
SNEKRGWYLQFVVSIVALICFVSN

SEQ ID NO: 2826012 - protein, 23 aa, Entamoeba invadens
SNEPKIWLGFVYAIIVLATQLTD

SEQ ID NO: 2826013 - protein, 17 aa, Entamoeba invadens
SNESICKYVLLNGYEDL

SEQ ID NO: 2826014 - protein, 24 aa, Entamoeba invadens
SNFACEFSVFVKPLCSCKINNTIQ

SEQ ID NO: 2826015 - protein, 17 aa, Entamoeba invadens
SNFAPDIPLMVTEWSFP

SEQ ID NO: 2826016 - protein, 17 aa, Entamoeba invadens
SNFEITKSKFKNMKFSD

SEQ ID NO: 2826017 - protein, 26 aa, Entamoeba invadens
SNFMSQGIIYFYSNSSFLIVNDARLV

SEQ ID NO: 2826018 - protein, 24 aa, Entamoeba invadens
SNFSYLVGLILFFVRLDIGGDTSY

SEQ ID NO: 2826019 - protein, 20 aa, Entamoeba invadens
SNFTLFKLKHTNMTFVEMAN

SEQ ID NO: 2826020 - protein, 28 aa, Entamoeba invadens
SNGETQMCKTCELGYYLVSDTNECVASC

SEQ ID NO: 2826021 - protein, 22 aa, Entamoeba invadens
SNGKLYHEALLHIFDDVQCDGI

SEQ ID NO: 2826022 - protein, 26 aa, Entamoeba invadens
SNGNCVLCPLITYYSNLTKGCRPNTI

SEQ ID NO: 2826023 - protein, 24 aa, Entamoeba invadens
SNGRKFFEYALDEPIRYASGDQVE

SEQ ID NO: 2826024 - protein, 27 aa, Entamoeba invadens
SNGYRPKVNLVIPLAIFNVIDGCWAQN

SEQ ID NO: 2826025 - protein, 17 aa, Entamoeba invadens
SNGYYESIGKCNKCTPG

SEQ ID NO: 2826026 - protein, 27 aa, Entamoeba invadens
SNIFALLLYFELSLVSIFYLCGSMALL

SEQ ID NO: 2826027 - protein, 21 aa, Entamoeba invadens
SNILLMLVFLPPVVFVHTPAV

SEQ ID NO: 2826028 - protein, 19 aa, Entamoeba invadens
SNINFVFLQGGVCVSSNLI

SEQ ID NO: 2826029 - protein, 18 aa, Entamoeba invadens
SNIQFFKVNEWLVSNKKV

SEQ ID NO: 2826030 - protein, 25 aa, Entamoeba invadens
SNKFACLQCFPLFYTNNNNTTTIEN

SEQ ID NO: 2826031 - protein, 23 aa, Entamoeba invadens
SNKKFKYFLNVRIYLENFKNFFE

SEQ ID NO: 2826032 - protein, 23 aa, Entamoeba invadens
SNKSMNLLSLLLSPTSSFNIYKP

SEQ ID NO: 2826033 - protein, 19 aa, Entamoeba invadens
SNLFEYFNPKLTAGDLLYS

SEQ ID NO: 2826034 - protein, 25 aa, Entamoeba invadens
SNLGFNAIWMTPIFDQGYNNSQSSI

SEQ ID NO: 2826035 - protein, 28 aa, Entamoeba invadens
SNLIIKYKFFVHLIQKVKSLKTPLSQVF

SEQ ID NO: 2826036 - protein, 24 aa, Entamoeba invadens
SNLLKLRFCLDVAKGMLYLHSNNV

SEQ ID NO: 2826037 - protein, 24 aa, Entamoeba invadens
SNLQKICFYLKHSEIIMLMNTSKK

SEQ ID NO: 2826038 - protein, 25 aa, Entamoeba invadens
SNMKRKWYFCPRKVSKTNWVESVDN

SEQ ID NO: 2826039 - protein, 20 aa, Entamoeba invadens
SNMLLDILKKCFGFILTEDV

SEQ ID NO: 2826040 - protein, 29 aa, Entamoeba invadens
SNMYMEELFDTWKRFPKALDAKHMWVLTD

SEQ ID NO: 2826041 - protein, 28 aa, Entamoeba invadens
SNPINTKWFRVVPSFHTILLSLCESSFT

SEQ ID NO: 2826042 - protein, 22 aa, Entamoeba invadens
SNPKFPYFVVGTEDGLILIFKY

SEQ ID NO: 2826043 - protein, 29 aa, Entamoeba invadens
SNPKKIVFKFKGTPFARLTFNITIEEYNP

SEQ ID NO: 2826044 - protein, 42 aa, Entamoeba invadens
SNPMYFIFMAYNTIIFLVFPLLVVVLYFFLKKYQLITRERPY

SEQ ID NO: 2826045 - protein, 26 aa, Entamoeba invadens
SNPTVSIRRLFLSSLTLPSEIINVNS

SEQ ID NO: 2826046 - protein, 24 aa, Entamoeba invadens
SNQKFYILVVYTFNSDFDKFLALT

SEQ ID NO: 2826047 - protein, 17 aa, Entamoeba invadens
SNRIYTCFDFSKELPIM

SEQ ID NO: 2826048 - protein, 25 aa, Entamoeba invadens
SNRKCTLCIAGYYFDLESNTCERGN

SEQ ID NO: 2826049 - protein, 30 aa, Entamoeba invadens
SNSIDFPNFLRTIPVDSFSFSSIVAFVDAF

SEQ ID NO: 2826050 - protein, 27 aa, Entamoeba invadens
SNSPYYSFTPYCYVHFFLNKSVTENMG

SEQ ID NO: 2826051 - protein, 32 aa, Entamoeba invadens
SNTDKKVTFFYVKLPLLFSSEISPFLDMEEIE

SEQ ID NO: 2826052 - protein, 22 aa, Entamoeba invadens
SNTLPAVLTLNSLFGYQIVTEN

SEQ ID NO: 2826053 - protein, 26 aa, Entamoeba invadens
SNTPSLMFFYLVMYFLIINWLPSFDN

SEQ ID NO: 2826054 - protein, 22 aa, Entamoeba invadens
SNTQIRIARTAELLIDKGQGEF

SEQ ID NO: 2826055 - protein, 49 aa, Entamoeba invadens
SNTSCHTKVVWWVILIGVIFVLIIITIVVSFVLFFSVKISHHYQTKKVY

SEQ ID NO: 2826056 - protein, 50 aa, Entamoeba invadens
SNTSCQTKVVWWVILIVVIFVLIIITLVLFIVLFILIQINRHYQIKKVQQ

SEQ ID NO: 2826057 - protein, 36 aa, Entamoeba invadens
SNTSRGFPYITFIILFMIFIVYTLVATLVLKRTKDC

SEQ ID NO: 2826058 - protein, 20 aa, Entamoeba invadens
SNVLYDPKRLLGLSLEEIPE

SEQ ID NO: 2826059 - protein, 24 aa, Entamoeba invadens
SNVLYFDGLKYIVVRDDFLVVINS

SEQ ID NO: 2826060 - protein, 22 aa, Entamoeba invadens
SNVTINAFLYNALKPVVICEGC

SEQ ID NO: 2826061 - protein, 18 aa, Entamoeba invadens
SNWKWTASYIVLMTQTKK

SEQ ID NO: 2826062 - protein, 20 aa, Entamoeba invadens
SNWVRQFNYFKTSSIKTDIT

SEQ ID NO: 2826063 - protein, 24 aa, Entamoeba invadens
SNYCEECYAGYYLELGKCMVCTES

SEQ ID NO: 2826064 - protein, 22 aa, Entamoeba invadens
SNYEVPFMQFIGEFMKSFINMQ

SEQ ID NO: 2826065 - protein, 18 aa, Entamoeba invadens
SNYSIGVTILLVIVTLLS

SEQ ID NO: 2826066 - protein, 17 aa, Entamoeba invadens
SNYSLTLHLYKLSNGKT

SEQ ID NO: 2826067 - protein, 17 aa, Entamoeba invadens
SNYTVMIIVIVIGTVFL

SEQ ID NO: 2826068 - protein, 20 aa, Entamoeba invadens
SNYVFLTTNSLICDSCATFD

SEQ ID NO: 2826069 - protein, 20 aa, Entamoeba invadens
SNYYITAYQFDSPLYTKIHI

SEQ ID NO: 2826070 - protein, 17 aa, Entamoeba invadens
SNYYPIQGICVPCDYGC

SEQ ID NO: 2826071 - protein, 24 aa, Entamoeba invadens
SPAIPPMLSPSYLSYGYPSGDAPL

SEQ ID NO: 2826072 - protein, 24 aa, Entamoeba invadens
SPDFSRNCYICNSGFYPLISGKCT

SEQ ID NO: 2826073 - protein, 24 aa, Entamoeba invadens
SPDFTRKCVICVSGYFVFENRCKK

SEQ ID NO: 2826074 - protein, 31 aa, Entamoeba invadens
SPEKFRIYFTRFCQLLAFYGPKVAPKMSFIK

SEQ ID NO: 2826075 - protein, 30 aa, Entamoeba invadens
SPFVDPVFFVLDDFSFCYLIFQNIGVCESD

SEQ ID NO: 2826076 - protein, 29 aa, Entamoeba invadens
SPFVLFHDGYWFFKIVLVTLLSTMTFLLP

SEQ ID NO: 2826077 - protein, 30 aa, Entamoeba invadens
SPGIGFVQWIICIALALVTLPLGLLNGVFN

SEQ ID NO: 2826078 - protein, 23 aa, Entamoeba invadens
SPGPALFTLLVAMVLSVLSVGVV

SEQ ID NO: 2826079 - protein, 24 aa, Entamoeba invadens
SPGYIKINSFCTKCFWGCATCYSQ

SEQ ID NO: 2826080 - protein, 25 aa, Entamoeba invadens
SPHRISIFDAFWNTKYEHSAPLQKA

SEQ ID NO: 2826081 - protein, 26 aa, Entamoeba invadens
SPIEIESFMNLRFKSKSSVKFFECFV

SEQ ID NO: 2826082 - protein, 26 aa, Entamoeba invadens
SPIYQSFILLPISLVLFFIKFNTMDT

SEQ ID NO: 2826083 - protein, 18 aa, Entamoeba invadens
SPKHIAWLNPRPGSHAQH

SEQ ID NO: 2826084 - protein, 25 aa, Entamoeba invadens
SPKKRGMFIAYFELESLFVPMNCNK

SEQ ID NO: 2826085 - protein, 18 aa, Entamoeba invadens
SPLFIVHTIAEIQNFSIQ

SEQ ID NO: 2826086 - protein, 22 aa, Entamoeba invadens
SPLFSQMYFRGTGVKWYTIKVM

SEQ ID NO: 2826087 - protein, 23 aa, Entamoeba invadens
SPLMNLFIAFSIAWFWVADSVDG

SEQ ID NO: 2826088 - protein, 27 aa, Entamoeba invadens
SPLRQLPRFMFVQCVVLTIVFDASSKK

SEQ ID NO: 2826089 - protein, 19 aa, Entamoeba invadens
SPLVYVVLSAKRDDVKKDN

SEQ ID NO: 2826090 - protein, 28 aa, Entamoeba invadens
SPLYKTRFFWFTLFTSILLIMHLLFLIF

SEQ ID NO: 2826091 - protein, 62 aa, Entamoeba invadens
SPNKDGVYCEKKALWWFVLIVIIASIFVLVIIGLMITKFTRKILHIFYSKTFEKKTLFEMNI

SEQ ID NO: 2826092 - protein, 54 aa, Entamoeba invadens
SPNTDGTLCVKKVVWWVIFIVILLVLMLMVGTIVLVWFLVKRYIKAEGKTVKHT

SEQ ID NO: 2826093 - protein, 18 aa, Entamoeba invadens
SPPPQPKVQTPPPQPIQP

SEQ ID NO: 2826094 - protein, 19 aa, Entamoeba invadens
SPRLIKCVTFITLYLLLIV

SEQ ID NO: 2826095 - protein, 24 aa, Entamoeba invadens
SPRLNEFFGHKLDFSNIGVLGDRE

SEQ ID NO: 2826096 - protein, 47 aa, Entamoeba invadens
SPSDDGTFCSKTAVWWVILLIIVIVISILVLITALVLFVMVKVIKHK

SEQ ID NO: 2826097 - protein, 52 aa, Entamoeba invadens
SPSDDGTFCSKTAVWWVILLIVVIIILITVLFIVLVLFVMVKVIKHKRDTSK

SEQ ID NO: 2826098 - protein, 48 aa, Entamoeba invadens
SPSDDGTFCSKTAVWWVILLIVVVIIAILVLIIVLVSFVMVKVIKYKR

SEQ ID NO: 2826099 - protein, 21 aa, Entamoeba invadens
SPSGVLLNGKCILTPTDNILE

SEQ ID NO: 2826100 - protein, 26 aa, Entamoeba invadens
SPSKKRIFQILPTCDWEFDYPYYQLA

SEQ ID NO: 2826101 - protein, 25 aa, Entamoeba invadens
SPSNSTFLFTLIAPTQTQTKVVLTT

SEQ ID NO: 2826102 - protein, 22 aa, Entamoeba invadens
SPSSCATLGLLYRSCFACGSGC

SEQ ID NO: 2826103 - protein, 25 aa, Entamoeba invadens
SPTCKAGYYLDYNIETKVYSCKKCK

SEQ ID NO: 2826104 - protein, 27 aa, Entamoeba invadens
SPTHLKIPVISDFPYFSPVLSVGNFHN

SEQ ID NO: 2826105 - protein, 17 aa, Entamoeba invadens
SPTPLKMLTLTGVDKNS

SEQ ID NO: 2826106 - protein, 18 aa, Entamoeba invadens
SPTYPRNVSFPKIPDEYN

SEQ ID NO: 2826107 - protein, 32 aa, Entamoeba invadens
SPVDIFAFGIVMYEVWTWKTAYANDDFKYLWK

SEQ ID NO: 2826108 - protein, 27 aa, Entamoeba invadens
SPVFVEHITYMWYISHFSPNTINLGNA

SEQ ID NO: 2826109 - protein, 24 aa, Entamoeba invadens
SQCISCLPGYYFSEDQKNCFDCSL

SEQ ID NO: 2826110 - protein, 24 aa, Entamoeba invadens
SQDQLYLRTYVTPAFGFGTIVVKK

SEQ ID NO: 2826111 - protein, 25 aa, Entamoeba invadens
SQEEMNAMKLITQKLEEEKSEVLVQ

SEQ ID NO: 2826112 - protein, 30 aa, Entamoeba invadens
SQGGIIPILFFLTSQVLFITPRKLFIYING

SEQ ID NO: 2826113 - protein, 24 aa, Entamoeba invadens
SQHKYSIAIAFFFLGEAIQEAVNV

SEQ ID NO: 2826114 - protein, 23 aa, Entamoeba invadens
SQIDAKIDLLFTTKKHTLPVKSE

SEQ ID NO: 2826115 - protein, 30 aa, Entamoeba invadens
SQIGVYFVMILIIYKMGVVLIVKRVVQHVK

SEQ ID NO: 2826116 - protein, 21 aa, Entamoeba invadens
SQIGYCVFMFPKRDYHWFLLG

SEQ ID NO: 2826117 - protein, 25 aa, Entamoeba invadens
SQIVVYIYREISIQNLLQASLQYDE

SEQ ID NO: 2826118 - protein, 25 aa, Entamoeba invadens
SQKLPIEQILSFSVVLAAKSSLNFS

SEQ ID NO: 2826119 - protein, 17 aa, Entamoeba invadens
SQKLVHLSVLPLVIHAM

SEQ ID NO: 2826120 - protein, 33 aa, Entamoeba invadens
SQLLEDEKLQLERSLLLLSQEKERIAQEAKERE

SEQ ID NO: 2826121 - protein, 20 aa, Entamoeba invadens
SQLMSSCYLIFKCLEDILSR

SEQ ID NO: 2826122 - protein, 29 aa, Entamoeba invadens
SQLTPLLTPLVIDSLIRLLQSGLGLEVDI

SEQ ID NO: 2826123 - protein, 25 aa, Entamoeba invadens
SQMLLERKFLFVSEYLMTLSNTISA

SEQ ID NO: 2826124 - protein, 18 aa, Entamoeba invadens
SQMQYYVDSIRYAATGYF

SEQ ID NO: 2826125 - protein, 18 aa, Entamoeba invadens
SQNWMDFLASLPQTTRSP

SEQ ID NO: 2826126 - protein, 32 aa, Entamoeba invadens
SQQLHHEILRRLDLTLLPNEFLKLLCVVFYVL

SEQ ID NO: 2826127 - protein, 49 aa, Entamoeba invadens
SQQLTLTEFVLILVVCLLFVVLIIMTILFVIVYFTRPRQRSLKNYIFDM

SEQ ID NO: 2826128 - protein, 27 aa, Entamoeba invadens
SQRQSIKIRILYFTALMRQDMGWYDHQ

SEQ ID NO: 2826129 - protein, 37 aa, Entamoeba invadens
SQRSAMLLYLRLYATLFVLFILSVFSIHYFLFVCFSL

SEQ ID NO: 2826130 - protein, 20 aa, Entamoeba invadens
SQSHFIYFKTSPSVAMFSQG

SEQ ID NO: 2826131 - protein, 29 aa, Entamoeba invadens
SQSYPNQYYPYYGAFIIYVTVKNSDKGNS

SEQ ID NO: 2826132 - protein, 28 aa, Entamoeba invadens
SQTAMLAFPVLLIFIVRWVNSNEPKIWL

SEQ ID NO: 2826133 - protein, 26 aa, Entamoeba invadens
SQTFAYKFFYFRLTGDVPLGSRILFS

SEQ ID NO: 2826134 - protein, 25 aa, Entamoeba invadens
SQTIFFFIFGLFHHWQYVQTLNIIV

SEQ ID NO: 2826135 - protein, 19 aa, Entamoeba invadens
SQTIPPVSLFVRISTMCPT

SEQ ID NO: 2826136 - protein, 36 aa, Entamoeba invadens
SQTNIYLVILVLILVILFIGLYFFTSKAVIALVRLD

SEQ ID NO: 2826137 - protein, 23 aa, Entamoeba invadens
SQTPDYFHFLGDVFVERGLDTTM

SEQ ID NO: 2826138 - protein, 33 aa, Entamoeba invadens
SQTQCEPGYFPSNFLCIKCPAGTYKNEIGNSTC

SEQ ID NO: 2826139 - protein, 21 aa, Entamoeba invadens
SQVRIYTMTFTNSGIFSLYDN

SEQ ID NO: 2826140 - protein, 26 aa, Entamoeba invadens
SRCVTCSPLFVRKCVKCVAGSYPQTA

SEQ ID NO: 2826141 - protein, 28 aa, Entamoeba invadens
SRDYVKLPYRVKVKMMFDAARGMRFLHE

SEQ ID NO: 2826142 - protein, 28 aa, Entamoeba invadens
SRESTRKMMVFYLKAIEKYKPTILFSTP

SEQ ID NO: 2826143 - protein, 24 aa, Entamoeba invadens
SRETQPLIVGRLLMVMDKRMVSSI

SEQ ID NO: 2826144 - protein, 42 aa, Entamoeba invadens
SRFPVTQRVSVVVLFLALLVQIATVMYFRFSPVLKTSDSYSS

SEQ ID NO: 2826145 - protein, 18 aa, Entamoeba invadens
SRGILYLHQNGILHRDIK

SEQ ID NO: 2826146 - protein, 30 aa, Entamoeba invadens
SRGVYIAFSGFAALHYIYISIYACPYACTA

SEQ ID NO: 2826147 - protein, 24 aa, Entamoeba invadens
SRHKFLYTYSFIPTLLVGAFAMLT

SEQ ID NO: 2826148 - protein, 21 aa, Entamoeba invadens
SRIASLVGIKVFVTGGLGGVH

SEQ ID NO: 2826149 - protein, 21 aa, Entamoeba invadens
SRIFMIIVVTMSFPALMFPTC

SEQ ID NO: 2826150 - protein, 18 aa, Entamoeba invadens
SRILTFHLNSLLLVFYYK

SEQ ID NO: 2826151 - protein, 22 aa, Entamoeba invadens
SRKAMLIYMNLKLDLPLTETQI

SEQ ID NO: 2826152 - protein, 25 aa, Entamoeba invadens
SRKCILCKEGYYINTATNRCVPCES

SEQ ID NO: 2826153 - protein, 24 aa, Entamoeba invadens
SRKCKVCVIGFYPDDASGKCVACS

SEQ ID NO: 2826154 - protein, 20 aa, Entamoeba invadens
SRLRNPFIANYMGAVTYLPQ

SEQ ID NO: 2826155 - protein, 22 aa, Entamoeba invadens
SRLVALFSFVQLKQPIICVMVR

SEQ ID NO: 2826156 - protein, 25 aa, Entamoeba invadens
SRNAYLNWFMAFIGGLAGGFAYQTS

SEQ ID NO: 2826157 - protein, 25 aa, Entamoeba invadens
SRNAYLNWFMAFVGGLAAGFSYQTS

SEQ ID NO: 2826158 - protein, 24 aa, Entamoeba invadens
SRNCTKCESGYYPVLQSNESKMCE

SEQ ID NO: 2826159 - protein, 18 aa, Entamoeba invadens
SRNFNMLITNMTFTKGIG

SEQ ID NO: 2826160 - protein, 24 aa, Entamoeba invadens
SRNKYMLLVFHTPNSPKYIFHFEP

SEQ ID NO: 2826161 - protein, 23 aa, Entamoeba invadens
SRNKYMMVIFHTPNTPKYVFHFD

SEQ ID NO: 2826162 - protein, 17 aa, Entamoeba invadens
SRTFFGCSKLAQVNSFD

SEQ ID NO: 2826163 - protein, 17 aa, Entamoeba invadens
SRVLLFLESLDSKDSYG

SEQ ID NO: 2826164 - protein, 26 aa, Entamoeba invadens
SRVLNNLLKYPFRFACQMDGREIPIP

SEQ ID NO: 2826165 - protein, 20 aa, Entamoeba invadens
SRYCNNCIMGYFFENGKCLN

SEQ ID NO: 2826166 - protein, 18 aa, Entamoeba invadens
SRYQPFFISFGCFNKEQV

SEQ ID NO: 2826167 - protein, 31 aa, Entamoeba invadens
SSAGGVLLLLILIVVVVIVAILIPKRKKSSK

SEQ ID NO: 2826168 - protein, 26 aa, Entamoeba invadens
SSAKNLLFASLPFLRQIVLNMPHVSN

SEQ ID NO: 2826169 - protein, 18 aa, Entamoeba invadens
SSCALCDFKYFRNAKGMC

SEQ ID NO: 2826170 - protein, 18 aa, Entamoeba invadens
SSCLLEHLPTLITKLTNL

SEQ ID NO: 2826171 - protein, 23 aa, Entamoeba invadens
SSCLSFFDITPLLEINANSTLKL

SEQ ID NO: 2826172 - protein, 22 aa, Entamoeba invadens
SSCLTCDAGYYSSIRASSCSIC

SEQ ID NO: 2826173 - protein, 28 aa, Entamoeba invadens
SSCRPKTALGWWFLLRGADRSVLISTCD

SEQ ID NO: 2826174 - protein, 20 aa, Entamoeba invadens
SSCSFNYKFVDGVCTQCAEV

SEQ ID NO: 2826175 - protein, 21 aa, Entamoeba invadens
SSCSPKYDLSIDKLSCIKHQN

SEQ ID NO: 2826176 - protein, 22 aa, Entamoeba invadens
SSCTIRCMIINFLVVFASTYKS

SEQ ID NO: 2826177 - protein, 22 aa, Entamoeba invadens
SSDIFMFHKFVIINNIKFYSHE

SEQ ID NO: 2826178 - protein, 21 aa, Entamoeba invadens
SSDILIFTNYISTTVVLNDFN

SEQ ID NO: 2826179 - protein, 18 aa, Entamoeba invadens
SSDNSILKLIGDFSLKVS

SEQ ID NO: 2826180 - protein, 38 aa, Entamoeba invadens
SSDVFSLAITFYETLVWGEIYPKSEFKFAWSIADYVTS

SEQ ID NO: 2826181 - protein, 27 aa, Entamoeba invadens
SSDVRRGFIHLLLYRGTVNRRSHLNWD

SEQ ID NO: 2826182 - protein, 38 aa, Entamoeba invadens
SSDVYSLGVAFYETLIWGEAYPKKDFKFAWSVADFVSS

SEQ ID NO: 2826183 - protein, 44 aa, Entamoeba invadens
SSDVYSLGVTFYEALIWGEAFPKQRFNFAWSIADFVTSGKRLEC

SEQ ID NO: 2826184 - protein, 40 aa, Entamoeba invadens
SSDVYSLGVTFYEALIWGEAYPKQKFKFAWSIADFVTSGK

SEQ ID NO: 2826185 - protein, 44 aa, Entamoeba invadens
SSDVYSLGVTFYEALIWGEAYPKQRFKFAWSIADFVTSGKRLEC

SEQ ID NO: 2826186 - protein, 26 aa, Entamoeba invadens
SSEIDMKLRLKFMLDVAMGIMYLHEN

SEQ ID NO: 2826187 - protein, 24 aa, Entamoeba invadens
SSEKIFSNLPYYLLGEEETLCTFL

SEQ ID NO: 2826188 - protein, 20 aa, Entamoeba invadens
SSEMFLIFILASFSLICGTM

SEQ ID NO: 2826189 - protein, 51 aa, Entamoeba invadens
SSESGFDFLPVYITLGVFAGIVLLLIFVVGSYFTYYIIIKKRNEKYQLFET

SEQ ID NO: 2826190 - protein, 21 aa, Entamoeba invadens
SSEYIVHFYGAVFVPNEVCMV

SEQ ID NO: 2826191 - protein, 19 aa, Entamoeba invadens
SSFLFGDIVYSSSAISNLV

SEQ ID NO: 2826192 - protein, 25 aa, Entamoeba invadens
SSFLFNFSAYFLWTVIPLRANDLGA

SEQ ID NO: 2826193 - protein, 17 aa, Entamoeba invadens
SSFLLMVAIPTVALLYS

SEQ ID NO: 2826194 - protein, 28 aa, Entamoeba invadens
SSFNIIDLKKRVIGAFPLFIVDTIEHIE

SEQ ID NO: 2826195 - protein, 23 aa, Entamoeba invadens
SSFNIVVIPLYKQSVYPARTDPQ

SEQ ID NO: 2826196 - protein, 25 aa, Entamoeba invadens
SSFSMGIVYYYKYTATTGFVFKMYT

SEQ ID NO: 2826197 - protein, 24 aa, Entamoeba invadens
SSGDLLRELFTVTALKLQSLVNKL

SEQ ID NO: 2826198 - protein, 25 aa, Entamoeba invadens
SSGSPICKTGYYLDYDKETKVYSCK

SEQ ID NO: 2826199 - protein, 17 aa, Entamoeba invadens
SSGYILTDGRCTPCWAG

SEQ ID NO: 2826200 - protein, 29 aa, Entamoeba invadens
SSHTQFWSCFLLLLQYYINSQKRLTQRAK

SEQ ID NO: 2826201 - protein, 39 aa, Entamoeba invadens
SSICFSTLFRFNFNDYIFFKLIILDNTMFYSTTDQIFWI

SEQ ID NO: 2826202 - protein, 17 aa, Entamoeba invadens
SSICINYKSISIVLSCG

SEQ ID NO: 2826203 - protein, 34 aa, Entamoeba invadens
SSIDYHCVVTMLFEGFLDFFKKFLVDYKSNEGII

SEQ ID NO: 2826204 - protein, 23 aa, Entamoeba invadens
SSIFIFIAILNHRKTEKLREKYC

SEQ ID NO: 2826205 - protein, 23 aa, Entamoeba invadens
SSIHVSPLDYLPPKFVVVKIEDN

SEQ ID NO: 2826206 - protein, 24 aa, Entamoeba invadens
SSISMAPYLYQVRSVWSPNSLNLG

SEQ ID NO: 2826207 - protein, 21 aa, Entamoeba invadens
SSITLEYIAQPPKDVGDYDTT

SEQ ID NO: 2826208 - protein, 24 aa, Entamoeba invadens
SSITPAWLRLFYDTPNSPTMSFVV

SEQ ID NO: 2826209 - protein, 17 aa, Entamoeba invadens
SSIVPVSFPSLPWNCYD

SEQ ID NO: 2826210 - protein, 25 aa, Entamoeba invadens
SSIVVLFLAYLHLSLERKYMALLEK

SEQ ID NO: 2826211 - protein, 23 aa, Entamoeba invadens
SSKLTFVIIDCNGYIYNVTTEQR

SEQ ID NO: 2826212 - protein, 25 aa, Entamoeba invadens
SSKTSLWYKLKGDGYMYVANTCNYY

SEQ ID NO: 2826213 - protein, 24 aa, Entamoeba invadens
SSKTYYFEFLINPSHCYELEINPI

SEQ ID NO: 2826214 - protein, 18 aa, Entamoeba invadens
SSLEFNLAYVRNGFTQQI

SEQ ID NO: 2826215 - protein, 21 aa, Entamoeba invadens
SSLIAFLVEAIYPFQFEFPII

SEQ ID NO: 2826216 - protein, 35 aa, Entamoeba invadens
SSLIFQNECKLVFNKYLYINFITVNSSTIPYGSKL

SEQ ID NO: 2826217 - protein, 25 aa, Entamoeba invadens
SSLILIFSGIWPYTKLVMMLVCWLM

SEQ ID NO: 2826218 - protein, 22 aa, Entamoeba invadens
SSLLFTCFSAFWVDSKLDVSFN

SEQ ID NO: 2826219 - protein, 32 aa, Entamoeba invadens
SSLQVVSWSIVITAIFCSFTISFIVGVMGILI

SEQ ID NO: 2826220 - protein, 20 aa, Entamoeba invadens
SSLRHPCVLQFFGSGMDEKF

SEQ ID NO: 2826221 - protein, 24 aa, Entamoeba invadens
SSMKILEIFFVVVSLIAMALCFFV

SEQ ID NO: 2826222 - protein, 26 aa, Entamoeba invadens
SSMPNAHIVLLLFSLPNPKCTDDLPR

SEQ ID NO: 2826223 - protein, 24 aa, Entamoeba invadens
SSNKVFCHLMNKNGFYSEPYCPCS

SEQ ID NO: 2826224 - protein, 23 aa, Entamoeba invadens
SSNLMCQSALPLSFDILISIFDE

SEQ ID NO: 2826225 - protein, 23 aa, Entamoeba invadens
SSNPYIKFYINKTSYETRCKMMT

SEQ ID NO: 2826226 - protein, 22 aa, Entamoeba invadens
SSNTKVIFCKNSFYLNYEENVC

SEQ ID NO: 2826227 - protein, 26 aa, Entamoeba invadens
SSPFYIVIGLIAFFITSFKPINTLFV

SEQ ID NO: 2826228 - protein, 30 aa, Entamoeba invadens
SSPNPITIDPLPNGTFLLQERRLLRYGNAS

SEQ ID NO: 2826229 - protein, 29 aa, Entamoeba invadens
SSPTLFHNMSVNCYLVIPSGVTLSVTDIY

SEQ ID NO: 2826230 - protein, 24 aa, Entamoeba invadens
SSRKPYYFTLYYLNNLVIHFTVYG

SEQ ID NO: 2826231 - protein, 27 aa, Entamoeba invadens
SSSIEIIVIIFPFLDIEIIPLDHIQKV

SEQ ID NO: 2826232 - protein, 28 aa, Entamoeba invadens
SSSIKDKFYFFYKTSSLDLINSLVVDPV

SEQ ID NO: 2826233 - protein, 26 aa, Entamoeba invadens
SSSIQTYPLLFFIGGVENSAGLIKVD

SEQ ID NO: 2826234 - protein, 48 aa, Entamoeba invadens
SSSLDIVFSFKSQGFFGFPICLKDKLFKVILFTVNFTGNFNLALDGRK

SEQ ID NO: 2826235 - protein, 25 aa, Entamoeba invadens
SSSLLSALIHLFSAFWESSSKRGFK

SEQ ID NO: 2826236 - protein, 25 aa, Entamoeba invadens
SSSVCITCENGCKRCFIKDNPTKEQ

SEQ ID NO: 2826237 - protein, 31 aa, Entamoeba invadens
SSSVSILFIFMELFLYQIMCNISYLHKNEIL

SEQ ID NO: 2826238 - protein, 23 aa, Entamoeba invadens
SSSYVVFGDLYPEGLFVSMGCFN

SEQ ID NO: 2826239 - protein, 24 aa, Entamoeba invadens
SSTFERKCIACKPNYYPNASGKCG

SEQ ID NO: 2826240 - protein, 17 aa, Entamoeba invadens
SSTFLAYFLAPNHLDGI

SEQ ID NO: 2826241 - protein, 17 aa, Entamoeba invadens
SSTLTNCQLRFPNPVNI

SEQ ID NO: 2826242 - protein, 24 aa, Entamoeba invadens
SSTNDMVLFYLKGLLEGSTNKLSV

SEQ ID NO: 2826243 - protein, 19 aa, Entamoeba invadens
SSTPWLRNSSVLENILFGE

SEQ ID NO: 2826244 - protein, 26 aa, Entamoeba invadens
SSTVLIGLTLFLNFNSELLLIENSRV

SEQ ID NO: 2826245 - protein, 25 aa, Entamoeba invadens
SSVDKKPIYLLIKDVRQILNEMSLS

SEQ ID NO: 2826246 - protein, 34 aa, Entamoeba invadens
SSVFGLAFLITLTILLFFVIQYKKTDIELFKQQQ

SEQ ID NO: 2826247 - protein, 32 aa, Entamoeba invadens
SSVFGLLTLMYPFIWQGVLIPFVPVALQEFLE

SEQ ID NO: 2826248 - protein, 18 aa, Entamoeba invadens
SSVFLCFLVPTFSQFTMF

SEQ ID NO: 2826249 - protein, 29 aa, Entamoeba invadens
SSVIKKHLYLKIYDLFWGHTNIPFKFIEN

SEQ ID NO: 2826250 - protein, 32 aa, Entamoeba invadens
SSVNCYITPLKNITLFNLFIETPPINSYRKND

SEQ ID NO: 2826251 - protein, 28 aa, Entamoeba invadens
SSVNTLILRMLYITLGSTFGKFLYRFCF

SEQ ID NO: 2826252 - protein, 46 aa, Entamoeba invadens
SSVNTLILRMLYITLGSTFGKFLYRFCFFILSERIGLKIRKLYFSS

SEQ ID NO: 2826253 - protein, 21 aa, Entamoeba invadens
SSVPVKWLFYSLNAFCWNLVS

SEQ ID NO: 2826254 - protein, 20 aa, Entamoeba invadens
SSVYLLDKYIPIAASFGGMC

SEQ ID NO: 2826255 - protein, 17 aa, Entamoeba invadens
SSWDYLNVLNPVVSIIS

SEQ ID NO: 2826256 - protein, 26 aa, Entamoeba invadens
SSYIASFILSIDFILSLSLCVTHVIT

SEQ ID NO: 2826257 - protein, 25 aa, Entamoeba invadens
SSYLHLHYNFIYNKNFYITNPDGKT

SEQ ID NO: 2826258 - protein, 26 aa, Entamoeba invadens
SSYVAWPILIVSIICFSFALVQFADE

SEQ ID NO: 2826259 - protein, 28 aa, Entamoeba invadens
STAAIIGGVWIIFGWISRFLNRKTEEQT

SEQ ID NO: 2826260 - protein, 19 aa, Entamoeba invadens
STAAILLIFFSTHNHFPSL

SEQ ID NO: 2826261 - protein, 19 aa, Entamoeba invadens
STAFPICVLCSQTLRQCQT

SEQ ID NO: 2826262 - protein, 20 aa, Entamoeba invadens
STALEDVSLLKTTTLREYAF

SEQ ID NO: 2826263 - protein, 18 aa, Entamoeba invadens
STALVVPILLFYLGMNNG

SEQ ID NO: 2826264 - protein, 22 aa, Entamoeba invadens
STCLTCKVGYYITDESTCLLCN

SEQ ID NO: 2826265 - protein, 29 aa, Entamoeba invadens
STCSFVCGKKQWYYLDDKLTCMPQNCQTI

SEQ ID NO: 2826266 - protein, 30 aa, Entamoeba invadens
STDLKRTMWWKNMKLWLIIGGVIALILVII

SEQ ID NO: 2826267 - protein, 19 aa, Entamoeba invadens
STDPLFFQHIYYGAIMLKK

SEQ ID NO: 2826268 - protein, 25 aa, Entamoeba invadens
STDSDLADLLLFKSNNNAFPDYVLS

SEQ ID NO: 2826269 - protein, 34 aa, Entamoeba invadens
STDTMSWILGFERFYICPLRGPIQSFRFNTIEIF

SEQ ID NO: 2826270 - protein, 27 aa, Entamoeba invadens
STDTQYILELYYQFAMDYISAPQLHMT

SEQ ID NO: 2826271 - protein, 27 aa, Entamoeba invadens
STDYTFYKIIVWYIVSLNEYKLITNNN

SEQ ID NO: 2826272 - protein, 25 aa, Entamoeba invadens
STEGWNPFFLTFDNLGLTPRINYGE

SEQ ID NO: 2826273 - protein, 25 aa, Entamoeba invadens
STEPRICFYIIFNTKECLINDLIEL

SEQ ID NO: 2826274 - protein, 19 aa, Entamoeba invadens
STFCMSCRSGTFLSEHNCI

SEQ ID NO: 2826275 - protein, 21 aa, Entamoeba invadens
STFECVSCEKGTFKNTEKGCT

SEQ ID NO: 2826276 - protein, 29 aa, Entamoeba invadens
STFEDDMLFKWYILHTKMDGLGKIYDSAL

SEQ ID NO: 2826277 - protein, 19 aa, Entamoeba invadens
STFFLLAYCIVFRNKPIVY

SEQ ID NO: 2826278 - protein, 18 aa, Entamoeba invadens
STFGWKIVLVQPNFYLIT

SEQ ID NO: 2826279 - protein, 23 aa, Entamoeba invadens
STFIIFIRDNLVKMIFYFVSVGL

SEQ ID NO: 2826280 - protein, 20 aa, Entamoeba invadens
STFKFPWEIPEFVTSGKRLA

SEQ ID NO: 2826281 - protein, 24 aa, Entamoeba invadens
STFREKYLILTSNAIKTIYECQST

SEQ ID NO: 2826282 - protein, 25 aa, Entamoeba invadens
STFREKYLILTSNAIRTIYECQSTY

SEQ ID NO: 2826283 - protein, 25 aa, Entamoeba invadens
STFVSFLVYLLIGLFGYFSLNPNLT

SEQ ID NO: 2826284 - protein, 20 aa, Entamoeba invadens
STGFYGLRYTPSEMKNSRLD

SEQ ID NO: 2826285 - protein, 18 aa, Entamoeba invadens
STGLFMGVVPWLVDIFQG

SEQ ID NO: 2826286 - protein, 25 aa, Entamoeba invadens
STGNWNPFFLTFDNLGLAPRINYGE

SEQ ID NO: 2826287 - protein, 48 aa, Entamoeba invadens
STGRSCQFTIPWWCILLLVIFILLVVILCTTLLFYSVKIAIQKRYMKQ

SEQ ID NO: 2826288 - protein, 20 aa, Entamoeba invadens
STHLIVCRKAKYTMWEFFVF

SEQ ID NO: 2826289 - protein, 21 aa, Entamoeba invadens
STHQYIYSVLLMSEDFKALCA

SEQ ID NO: 2826290 - protein, 24 aa, Entamoeba invadens
STHVKWCKYRYELLCVGLDDECSS

SEQ ID NO: 2826291 - protein, 24 aa, Entamoeba invadens
STIDSTFVVSYLFTTSDGISCAHH

SEQ ID NO: 2826292 - protein, 20 aa, Entamoeba invadens
STIERKCVECKPNMYPYSTT

SEQ ID NO: 2826293 - protein, 28 aa, Entamoeba invadens
STIFNDFIWTFRLFTTPRDLLSEFFFRY

SEQ ID NO: 2826294 - protein, 22 aa, Entamoeba invadens
STIIALPFYPIKNFFRLVRFIV

SEQ ID NO: 2826295 - protein, 20 aa, Entamoeba invadens
STILLNNYILIIKDAEYIKS

SEQ ID NO: 2826296 - protein, 17 aa, Entamoeba invadens
STILYCATSYYKDTSSN

SEQ ID NO: 2826297 - protein, 30 aa, Entamoeba invadens
STINDLVLKMLYFAIGTTVATFLNQFCFFV

SEQ ID NO: 2826298 - protein, 22 aa, Entamoeba invadens
STINNIILLDTGTLVKLMINGA

SEQ ID NO: 2826299 - protein, 18 aa, Entamoeba invadens
STIWCYDTFYIANGICND

SEQ ID NO: 2826300 - protein, 31 aa, Entamoeba invadens
STKKKVLQLILFVLHGWVIYNPNLKEVTLQF

SEQ ID NO: 2826301 - protein, 17 aa, Entamoeba invadens
STKPFSLKLMRISIFPK

SEQ ID NO: 2826302 - protein, 52 aa, Entamoeba invadens
STKPYTHELLIQKTRLILFRLMKIVNDPFSLEALLFCFNKFFMDYISRSSDS

SEQ ID NO: 2826303 - protein, 19 aa, Entamoeba invadens
STKQIAFSLPLTPNAFLAQ

SEQ ID NO: 2826304 - protein, 33 aa, Entamoeba invadens
STKTVAIIIGSLLGVVCVFAIGSVIAGVAIFIK

SEQ ID NO: 2826305 - protein, 26 aa, Entamoeba invadens
STKTVGIPVYTTCYSPYQINSELNVC

SEQ ID NO: 2826306 - protein, 25 aa, Entamoeba invadens
STKVLCAFGYYTTSFGSTGLMYGSS

SEQ ID NO: 2826307 - protein, 18 aa, Entamoeba invadens
STLFIKDTGYIRLNLDCV

SEQ ID NO: 2826308 - protein, 18 aa, Entamoeba invadens
STLFTRAVHFCHIPLCSL

SEQ ID NO: 2826309 - protein, 43 aa, Entamoeba invadens
STLRMFSLVFFAVLSVSFFVGFLVLVFLIFFTDKESPIEMKGI

SEQ ID NO: 2826310 - protein, 27 aa, Entamoeba invadens
STLTNLQCALLAFLSIRANVIIAKPQK

SEQ ID NO: 2826311 - protein, 30 aa, Entamoeba invadens
STLYAFVGLLFLIIMVIRILVPEIFTVASD

SEQ ID NO: 2826312 - protein, 25 aa, Entamoeba invadens
STMGVALIVYFFDDPKKQYADPAFS

SEQ ID NO: 2826313 - protein, 24 aa, Entamoeba invadens
STNCLSCVQGERYLWNNQCLSCSN

SEQ ID NO: 2826314 - protein, 17 aa, Entamoeba invadens
STNLVTIVLPQKIEEFG

SEQ ID NO: 2826315 - protein, 19 aa, Entamoeba invadens
STPLNSVALLVKTTSKHPN

SEQ ID NO: 2826316 - protein, 23 aa, Entamoeba invadens
STPRTFQSIKTKQLTLALTTVKI

SEQ ID NO: 2826317 - protein, 18 aa, Entamoeba invadens
STPSFPLELSKTTLLFGG

SEQ ID NO: 2826318 - protein, 18 aa, Entamoeba invadens
STQDFCQKDYGYPIRKFE

SEQ ID NO: 2826319 - protein, 25 aa, Entamoeba invadens
STQPNSYYCYSCEPGTYQDLTGQTE

SEQ ID NO: 2826320 - protein, 23 aa, Entamoeba invadens
STQSIVFPYIIKSGAESFDLNCI

SEQ ID NO: 2826321 - protein, 26 aa, Entamoeba invadens
STRICTKCLSGYYLQDGECLQIKNCV

SEQ ID NO: 2826322 - protein, 17 aa, Entamoeba invadens
STRQDMLFVQWEHVTLK

SEQ ID NO: 2826323 - protein, 19 aa, Entamoeba invadens
STSCISCEPPYFVSNSKCV

SEQ ID NO: 2826324 - protein, 25 aa, Entamoeba invadens
STSCKQCIMGYYPDIGTCERGRMDN

SEQ ID NO: 2826325 - protein, 26 aa, Entamoeba invadens
STSCPDYIFVKPTTSMWWISASVMVF

SEQ ID NO: 2826326 - protein, 25 aa, Entamoeba invadens
STSFMPFPMFQIYSSTKAFVRQFHD

SEQ ID NO: 2826327 - protein, 26 aa, Entamoeba invadens
STSTSFPLGWFYPIIYHYGKKELNGL

SEQ ID NO: 2826328 - protein, 24 aa, Entamoeba invadens
STSVDWLIILSRIFMIIVVTMSFP

SEQ ID NO: 2826329 - protein, 27 aa, Entamoeba invadens
STTFNRICTTCNIGYYPSPNTGACMTC

SEQ ID NO: 2826330 - protein, 23 aa, Entamoeba invadens
STTKGCLRCLSGYYLADHMCVKC

SEQ ID NO: 2826331 - protein, 18 aa, Entamoeba invadens
STTKGCLRCLSGYYLADR

SEQ ID NO: 2826332 - protein, 22 aa, Entamoeba invadens
STTKGCLRCLSGYYLTDRMCVK

SEQ ID NO: 2826333 - protein, 24 aa, Entamoeba invadens
STTKNSLLILRETSKLYLLENATV

SEQ ID NO: 2826334 - protein, 32 aa, Entamoeba invadens
STTNIFTLNSPRNLIFQDLTISKIVKINSPIT

SEQ ID NO: 2826335 - protein, 27 aa, Entamoeba invadens
STTRNGCLVLLRQGIFSIFQTTVVLTP

SEQ ID NO: 2826336 - protein, 23 aa, Entamoeba invadens
STTTIITVILLFINYKQIDIEVF

SEQ ID NO: 2826337 - protein, 27 aa, Entamoeba invadens
STTVDNLILDVLKYFFGLVFDEEVKKK

SEQ ID NO: 2826338 - protein, 28 aa, Entamoeba invadens
STVLCTLVLICLQPFVFLAINGEEKSFN

SEQ ID NO: 2826339 - protein, 21 aa, Entamoeba invadens
STVLRAFFELSFEVKKRLYVE

SEQ ID NO: 2826340 - protein, 25 aa, Entamoeba invadens
STVLYALAAWYFFYDRIPIEESYLT

SEQ ID NO: 2826341 - protein, 24 aa, Entamoeba invadens
STVSTVLWIYGLASFVFCNDYFDF

SEQ ID NO: 2826342 - protein, 20 aa, Entamoeba invadens
STYCISCENGYFLNSQMECK

SEQ ID NO: 2826343 - protein, 25 aa, Entamoeba invadens
STYGCLICGDGYYLHTNVCDKCDDN

SEQ ID NO: 2826344 - protein, 23 aa, Entamoeba invadens
SVAADVFALGITIFECMKWGEAY

SEQ ID NO: 2826345 - protein, 26 aa, Entamoeba invadens
SVADLPWRVFIYKFLNTIVDDLFAFI

SEQ ID NO: 2826346 - protein, 22 aa, Entamoeba invadens
SVAKRWSAVFSLSNLLLHQYNK

SEQ ID NO: 2826347 - protein, 18 aa, Entamoeba invadens
SVANFKFLFFNRWNMIVF

SEQ ID NO: 2826348 - protein, 23 aa, Entamoeba invadens
SVASFSFGFGMPGFFMSYGNNNN

SEQ ID NO: 2826349 - protein, 25 aa, Entamoeba invadens
SVCGIVFLLLRWFLSKQTTFLDKYG

SEQ ID NO: 2826350 - protein, 29 aa, Entamoeba invadens
SVCIKCKIGYILRNGLCSMYYNIFDCMTY

SEQ ID NO: 2826351 - protein, 22 aa, Entamoeba invadens
SVCKTGFLLEQVTLKCVSECKT

SEQ ID NO: 2826352 - protein, 23 aa, Entamoeba invadens
SVCRPSGMYPSDSTYTCVSCDAT

SEQ ID NO: 2826353 - protein, 25 aa, Entamoeba invadens
SVCSIDLVKGFWFKIPGADETLEIS

SEQ ID NO: 2826354 - protein, 18 aa, Entamoeba invadens
SVCSSCYDGLYLNSDSEC

SEQ ID NO: 2826355 - protein, 24 aa, Entamoeba invadens
SVCTGCIANYYMPNTLSICKPFEE

SEQ ID NO: 2826356 - protein, 18 aa, Entamoeba invadens
SVCTSCQSGYYLSNGICN

SEQ ID NO: 2826357 - protein, 26 aa, Entamoeba invadens
SVDDKRFVLLSDKKLLRFGSNQNVEC

SEQ ID NO: 2826358 - protein, 24 aa, Entamoeba invadens
SVDFDTICSLPIDKLSRDLLCVGN

SEQ ID NO: 2826359 - protein, 35 aa, Entamoeba invadens
SVDGLYCMNSPVWWVILLAVIGGVVLLIGLILAFF

SEQ ID NO: 2826360 - protein, 23 aa, Entamoeba invadens
SVDLLMQIFNFYAVLCRPFNDEN

SEQ ID NO: 2826361 - protein, 22 aa, Entamoeba invadens
SVDMDFQWGFSPSVFVNGNFDI

SEQ ID NO: 2826362 - protein, 29 aa, Entamoeba invadens
SVDRRKPYTYGYWFKLVSDTTRKLFVQVD

SEQ ID NO: 2826363 - protein, 38 aa, Entamoeba invadens
SVDRRVGIQSLYFAMLTTLGFTLLLEKPKKQKTKTLPL

SEQ ID NO: 2826364 - protein, 20 aa, Entamoeba invadens
SVDYIGVIPILVEALKEINR

SEQ ID NO: 2826365 - protein, 25 aa, Entamoeba invadens
SVECLTCAPGYFRPKEWANDSQFML

SEQ ID NO: 2826366 - protein, 29 aa, Entamoeba invadens
SVELRAEEIIWILCFMNFISRQSANDVRD

SEQ ID NO: 2826367 - protein, 24 aa, Entamoeba invadens
SVEPPLMIGLLGYSAVLLLIFVVG

SEQ ID NO: 2826368 - protein, 24 aa, Entamoeba invadens
SVFFIIFPLSMITSVRASCPSNLV

SEQ ID NO: 2826369 - protein, 17 aa, Entamoeba invadens
SVFLIGRNIPLVTDCAL

SEQ ID NO: 2826370 - protein, 24 aa, Entamoeba invadens
SVFNRGLLLFLRQCVHKVQDPFYL

SEQ ID NO: 2826371 - protein, 24 aa, Entamoeba invadens
SVGEHSILLFVRTLNHFKDVISTF

SEQ ID NO: 2826372 - protein, 24 aa, Entamoeba invadens
SVGKPKCITCYPPYKVSSNGDCVI

SEQ ID NO: 2826373 - protein, 26 aa, Entamoeba invadens
SVGKPKCITCYPPYKVSSNGDCVICD

SEQ ID NO: 2826374 - protein, 23 aa, Entamoeba invadens
SVGLFPTLYQRRIFPTSKPQQNG

SEQ ID NO: 2826375 - protein, 46 aa, Entamoeba invadens
SVGLLIITCGILYWVTKKFKLGWKIPTLTLVLLLTSFVIVSSTLII

SEQ ID NO: 2826376 - protein, 23 aa, Entamoeba invadens
SVGNTFTFYPLPISMMFDERVDA

SEQ ID NO: 2826377 - protein, 28 aa, Entamoeba invadens
SVGWVLLFPALYYGFFPHFLWCWGCFTQ

SEQ ID NO: 2826378 - protein, 24 aa, Entamoeba invadens
SVIALIFWRTYPPAIIGISLLLCG

SEQ ID NO: 2826379 - protein, 24 aa, Entamoeba invadens
SVIALIFWRTYPPTIIGISLLLCG

SEQ ID NO: 2826380 - protein, 18 aa, Entamoeba invadens
SVIECYYHILLPTEGITS

SEQ ID NO: 2826381 - protein, 22 aa, Entamoeba invadens
SVIEGCDCYQIRTVPSIVTLKK

SEQ ID NO: 2826382 - protein, 18 aa, Entamoeba invadens
SVIEGCELYSIRTVPSLV

SEQ ID NO: 2826383 - protein, 24 aa, Entamoeba invadens
SVIEPILIQWNPKPSIYIYVMYEY

SEQ ID NO: 2826384 - protein, 37 aa, Entamoeba invadens
SVIKSIYRINLYNKSIFIFKTLGFTKAYFTISIGDNA

SEQ ID NO: 2826385 - protein, 24 aa, Entamoeba invadens
SVILISVIAVVILLVLRRVNSVHV

SEQ ID NO: 2826386 - protein, 25 aa, Entamoeba invadens
SVILRKALLLFGCSFSPILFDFSFQ

SEQ ID NO: 2826387 - protein, 20 aa, Entamoeba invadens
SVISFLVLCGSLSFIVTCLL

SEQ ID NO: 2826388 - protein, 26 aa, Entamoeba invadens
SVISNSHIKYLPFLKGVTGSKCQIRD

SEQ ID NO: 2826389 - protein, 18 aa, Entamoeba invadens
SVISPFINAIFMASLNLV

SEQ ID NO: 2826390 - protein, 32 aa, Entamoeba invadens
SVITVIPALMFLWRMVIRPLLFKPTTKVYKGT

SEQ ID NO: 2826391 - protein, 18 aa, Entamoeba invadens
SVIVTCQKGYYINNDINN

SEQ ID NO: 2826392 - protein, 24 aa, Entamoeba invadens
SVIYLLCVFVLVSFGLVTILYSYQ

SEQ ID NO: 2826393 - protein, 23 aa, Entamoeba invadens
SVKDFILRLVSKLGEYFAYTDFE

SEQ ID NO: 2826394 - protein, 29 aa, Entamoeba invadens
SVKKDLTRILLITLIYYSPTCVASNYESS

SEQ ID NO: 2826395 - protein, 23 aa, Entamoeba invadens
SVKLELYSLTKKVLFISETKLVY

SEQ ID NO: 2826396 - protein, 35 aa, Entamoeba invadens
SVKMFFFIGFVFPFSWIFLFFWKVYDKEDMYRMWA

SEQ ID NO: 2826397 - protein, 26 aa, Entamoeba invadens
SVLCDQLQLLTCEKGYFIKKNRCVGC

SEQ ID NO: 2826398 - protein, 25 aa, Entamoeba invadens
SVLCDQLQLVTCEKGYFIKKNRCVG

SEQ ID NO: 2826399 - protein, 29 aa, Entamoeba invadens
SVLCLLPLLIVMIFLILPSLIKCIKKIKR

SEQ ID NO: 2826400 - protein, 25 aa, Entamoeba invadens
SVLDGCDYYEIRTVPSLISLKKGEA

SEQ ID NO: 2826401 - protein, 18 aa, Entamoeba invadens
SVLFLSASIFRILEGFKV

SEQ ID NO: 2826402 - protein, 26 aa, Entamoeba invadens
SVLHSIILSFFFINYFKLKQKQKEDE

SEQ ID NO: 2826403 - protein, 25 aa, Entamoeba invadens
SVLLDHFEWSLKIISMPISSVFSPI

SEQ ID NO: 2826404 - protein, 20 aa, Entamoeba invadens
SVLLLLSITLLLINHLYNIG

SEQ ID NO: 2826405 - protein, 39 aa, Entamoeba invadens
SVLLYAMVLTLLTFHLISFFIFFALFGVVIVLYSAQKNT

SEQ ID NO: 2826406 - protein, 27 aa, Entamoeba invadens
SVLNNDFTICRFDFIGGKSITFRSFNG

SEQ ID NO: 2826407 - protein, 24 aa, Entamoeba invadens
SVLPYETIFQFKTPNRFKIESSDD

SEQ ID NO: 2826408 - protein, 25 aa, Entamoeba invadens
SVLQFNGFPFDFTNTSLLGTPFDLY

SEQ ID NO: 2826409 - protein, 29 aa, Entamoeba invadens
SVLSCLTFCVFLSTYMILRNYKSRPHGCD

SEQ ID NO: 2826410 - protein, 21 aa, Entamoeba invadens
SVLSVMTGILLKVVCAKELTE

SEQ ID NO: 2826411 - protein, 24 aa, Entamoeba invadens
SVMDGCDFYEIRTVPSLVTLKKDE

SEQ ID NO: 2826412 - protein, 34 aa, Entamoeba invadens
SVMEGCDFYEIRTVPSLLSLKPGYACEFEIFIKP

SEQ ID NO: 2826413 - protein, 17 aa, Entamoeba invadens
SVMKGCDYYTIRTEPAL

SEQ ID NO: 2826414 - protein, 19 aa, Entamoeba invadens
SVMNGCDYYEIRTVPSIVS

SEQ ID NO: 2826415 - protein, 20 aa, Entamoeba invadens
SVMNGCDYYEIRTVPSLVSL

SEQ ID NO: 2826416 - protein, 21 aa, Entamoeba invadens
SVMNGCDYYEIRTVPSLVSLK

SEQ ID NO: 2826417 - protein, 23 aa, Entamoeba invadens
SVMNGCDYYTIRSEPSLVTLHKG

SEQ ID NO: 2826418 - protein, 25 aa, Entamoeba invadens
SVMNGCDYYTIRSIPSLVTLHKGEA

SEQ ID NO: 2826419 - protein, 18 aa, Entamoeba invadens
SVMYNFVMTKSCLSAFDV

SEQ ID NO: 2826420 - protein, 28 aa, Entamoeba invadens
SVNCYITPLKNIALFNLYIDTPPINSHQ

SEQ ID NO: 2826421 - protein, 21 aa, Entamoeba invadens
SVNSLCNCSYTINGWYPVGYY

SEQ ID NO: 2826422 - protein, 22 aa, Entamoeba invadens
SVNSLGCYLFATSVNTLAYQPN

SEQ ID NO: 2826423 - protein, 19 aa, Entamoeba invadens
SVPAILLYEALMTTSVIYV

SEQ ID NO: 2826424 - protein, 21 aa, Entamoeba invadens
SVPALIYFFQNILSQVALSNI

SEQ ID NO: 2826425 - protein, 20 aa, Entamoeba invadens
SVPALIYFFQNMLIQVSLSN

SEQ ID NO: 2826426 - protein, 25 aa, Entamoeba invadens
SVPATCLHALPVSKLPFSHKVSIPD

SEQ ID NO: 2826427 - protein, 18 aa, Entamoeba invadens
SVPDKLGIIIQQSWEHEP

SEQ ID NO: 2826428 - protein, 24 aa, Entamoeba invadens
SVQFENIVFPQTKYIHILSGMAYK

SEQ ID NO: 2826429 - protein, 23 aa, Entamoeba invadens
SVQLLSENLTLFDNARAVFKDNM

SEQ ID NO: 2826430 - protein, 24 aa, Entamoeba invadens
SVQLYWLQIARKCSEGYYTSSTTC

SEQ ID NO: 2826431 - protein, 18 aa, Entamoeba invadens
SVRHFFFLRREKSYLSGK

SEQ ID NO: 2826432 - protein, 19 aa, Entamoeba invadens
SVRSVSKYLPYIKNHFLVT

SEQ ID NO: 2826433 - protein, 27 aa, Entamoeba invadens
SVSFCEFLLRIHPKLYTHLLKSTTDDL

SEQ ID NO: 2826434 - protein, 30 aa, Entamoeba invadens
SVSIRKLYRYINWFDGLMLLLGLCGSLAAG

SEQ ID NO: 2826435 - protein, 22 aa, Entamoeba invadens
SVSRWFYYYFTSLLSTQLNNAM

SEQ ID NO: 2826436 - protein, 29 aa, Entamoeba invadens
SVSSVINIIFFVIAVMGVAFYSNEVRNFL

SEQ ID NO: 2826437 - protein, 19 aa, Entamoeba invadens
SVTALKFVKIMLTNNTSIN

SEQ ID NO: 2826438 - protein, 17 aa, Entamoeba invadens
SVTIVDLLKTAVQTLRF

SEQ ID NO: 2826439 - protein, 25 aa, Entamoeba invadens
SVTYIPQVSLVLQFFVLGALGEYLR

SEQ ID NO: 2826440 - protein, 17 aa, Entamoeba invadens
SVVFEDINYLFTTRQTN

SEQ ID NO: 2826441 - protein, 26 aa, Entamoeba invadens
SVVIRARITRMLSVFSTKILPLLSHI

SEQ ID NO: 2826442 - protein, 34 aa, Entamoeba invadens
SVVLKKKYWWKNAKLWVMIVICLIVVLCLVGGVV

SEQ ID NO: 2826443 - protein, 27 aa, Entamoeba invadens
SVVLSFIVFILFVLITPTQHDLSFTYS

SEQ ID NO: 2826444 - protein, 28 aa, Entamoeba invadens
SVVLSFIVFILFVLITPTQHDLSFTYSF

SEQ ID NO: 2826445 - protein, 29 aa, Entamoeba invadens
SVVLSLPIFFAIFLLQCVLPTAVIYLNSL

SEQ ID NO: 2826446 - protein, 20 aa, Entamoeba invadens
SVVLTITFIARCTTVLNEKV

SEQ ID NO: 2826447 - protein, 32 aa, Entamoeba invadens
SVVTLMLELSPFLAFALFLSFIITKKTLDVSE

SEQ ID NO: 2826448 - protein, 20 aa, Entamoeba invadens
SVYAPLTRNVGCGDAAVTRA

SEQ ID NO: 2826449 - protein, 24 aa, Entamoeba invadens
SVYHALVLLFLIFSNQISTLIRLF

SEQ ID NO: 2826450 - protein, 17 aa, Entamoeba invadens
SVYVKPLCSCKINSTIQ

SEQ ID NO: 2826451 - protein, 26 aa, Entamoeba invadens
SWDASFLIFLSLIGVTYFSPVHTPIG

SEQ ID NO: 2826452 - protein, 17 aa, Entamoeba invadens
SWDLTLVLLCSAPFMMG

SEQ ID NO: 2826453 - protein, 24 aa, Entamoeba invadens
SWIPVVIIVLIFGCLFFVYGTFIM

SEQ ID NO: 2826454 - protein, 36 aa, Entamoeba invadens
SWKDFCNNILFPYRAKILAILKLLIHTFPEDFQRDE

SEQ ID NO: 2826455 - protein, 23 aa, Entamoeba invadens
SWSGISLFSFKVNSNYYRVTNLA

SEQ ID NO: 2826456 - protein, 44 aa, Entamoeba invadens
SWVICKREWKWFLIMYILTVIFDLFCISFPLMCQYFTKWLNTEN

SEQ ID NO: 2826457 - protein, 26 aa, Entamoeba invadens
SWYSQRLDWLGIIVSIITVLVIVILK

SEQ ID NO: 2826458 - protein, 22 aa, Entamoeba invadens
SYAQSVSLLWVKYDVMGDSVTM

SEQ ID NO: 2826459 - protein, 22 aa, Entamoeba invadens
SYDLPLVITQLPFTAVDQFHTT

SEQ ID NO: 2826460 - protein, 19 aa, Entamoeba invadens
SYEYILTGTALGYSLICKR

SEQ ID NO: 2826461 - protein, 28 aa, Entamoeba invadens
SYFLSRFVWDIFCLFAILVHILCMRNRG

SEQ ID NO: 2826462 - protein, 21 aa, Entamoeba invadens
SYFVANLTKSFIYLSVGNRSI

SEQ ID NO: 2826463 - protein, 18 aa, Entamoeba invadens
SYGFLVVYSITDRVLFDE

SEQ ID NO: 2826464 - protein, 18 aa, Entamoeba invadens
SYIKNDPITPKLSPRKTE

SEQ ID NO: 2826465 - protein, 18 aa, Entamoeba invadens
SYILFQNETIQTDLLITC

SEQ ID NO: 2826466 - protein, 28 aa, Entamoeba invadens
SYIQARYWNQGFLKYWRLIEIPNFLLCA

SEQ ID NO: 2826467 - protein, 38 aa, Entamoeba invadens
SYITGVVCFVTTLVIIIVLIFIGGGFEFVKAGREGGYQ

SEQ ID NO: 2826468 - protein, 26 aa, Entamoeba invadens
SYIVASKALFFLLKTSVMISQKHIVT

SEQ ID NO: 2826469 - protein, 36 aa, Entamoeba invadens
SYIVVYTYKVWAKDMVLLYFWQGRTCAVLDKGTCAR

SEQ ID NO: 2826470 - protein, 27 aa, Entamoeba invadens
SYKEMIRFAIFFIKQKLGKIPEKETFL

SEQ ID NO: 2826471 - protein, 33 aa, Entamoeba invadens
SYKGNIENFWYFVFLCILFLVHFPYNEGVFQSQ

SEQ ID NO: 2826472 - protein, 23 aa, Entamoeba invadens
SYKTKQFLKIKDITFNRFDTINI

SEQ ID NO: 2826473 - protein, 24 aa, Entamoeba invadens
SYKVVVYFLAPLAPVGFLFYALYF

SEQ ID NO: 2826474 - protein, 26 aa, Entamoeba invadens
SYKYFPVMYPVLFTIVLLITAISFQS

SEQ ID NO: 2826475 - protein, 19 aa, Entamoeba invadens
SYLRQLYYFSKKRSWFHLL

SEQ ID NO: 2826476 - protein, 27 aa, Entamoeba invadens
SYLVIIPPLLIWTLIWIFFGCFTFSRR

SEQ ID NO: 2826477 - protein, 26 aa, Entamoeba invadens
SYNDLTQYPVFPWVLSNYTSDSLDLN

SEQ ID NO: 2826478 - protein, 26 aa, Entamoeba invadens
SYNDMSHYPIFPWVIQDYTSTHLDLN

SEQ ID NO: 2826479 - protein, 19 aa, Entamoeba invadens
SYNEFVCNAAYYTESIFQC

SEQ ID NO: 2826480 - protein, 20 aa, Entamoeba invadens
SYPDGFYQYYQSKFPSLCVV

SEQ ID NO: 2826481 - protein, 19 aa, Entamoeba invadens
SYPFITPNCPCSGQMCFVH

SEQ ID NO: 2826482 - protein, 23 aa, Entamoeba invadens
SYPLFLTHWNFCLLFKEWTNKNK

SEQ ID NO: 2826483 - protein, 23 aa, Entamoeba invadens
SYPLRTLAIFYFITVADIMRKLQ

SEQ ID NO: 2826484 - protein, 24 aa, Entamoeba invadens
SYQNTRGYWFTFTAEQEKIYINTC

SEQ ID NO: 2826485 - protein, 25 aa, Entamoeba invadens
SYRDMINFVIFFIKKKLGKTAKGEE

SEQ ID NO: 2826486 - protein, 17 aa, Entamoeba invadens
SYRLVFIPSVTLDASRK

SEQ ID NO: 2826487 - protein, 24 aa, Entamoeba invadens
SYSKEDFRYPWDIVDYVMSGKRQG

SEQ ID NO: 2826488 - protein, 25 aa, Entamoeba invadens
SYSKINGVAFLHLYKSHITLNNNSE

SEQ ID NO: 2826489 - protein, 19 aa, Entamoeba invadens
SYSNSFIISCNEGHFSNGT

SEQ ID NO: 2826490 - protein, 26 aa, Entamoeba invadens
SYSRAYKWLPLIYGLTSQDFLCAIVH

SEQ ID NO: 2826491 - protein, 25 aa, Entamoeba invadens
SYTDRNFIYLALTYCTCTLEEHVNT

SEQ ID NO: 2826492 - protein, 18 aa, Entamoeba invadens
SYTREYFGYLFSSNSNDI

SEQ ID NO: 2826493 - protein, 17 aa, Entamoeba invadens
SYVVGQLVFFDYLVMFN

SEQ ID NO: 2826494 - protein, 19 aa, Entamoeba invadens
SYYEFFLNQNITKLNIDCT

SEQ ID NO: 2826495 - protein, 24 aa, Entamoeba invadens
SYYETYLLNYLHSQGIFKNRCIPN

SEQ ID NO: 2826496 - protein, 18 aa, Entamoeba invadens
SYYYVKKDWSWAFNTKYN

SEQ ID NO: 2826497 - protein, 24 aa, Entamoeba invadens
TAAIKPFHVSSDLELILLGADNEK

SEQ ID NO: 2826498 - protein, 23 aa, Entamoeba invadens
TAALFLCAMFWYHYDEKAPLWHI

SEQ ID NO: 2826499 - protein, 29 aa, Entamoeba invadens
TAAVVYSPHMFLFWGFGSVGVLSLYCVAV

SEQ ID NO: 2826500 - protein, 40 aa, Entamoeba invadens
TACDTKAVWWVLLIVIVISVLFVILSILVVIVTTNHIITK

SEQ ID NO: 2826501 - protein, 19 aa, Entamoeba invadens
TACITNYAFTDPPGLYCIP

SEQ ID NO: 2826502 - protein, 21 aa, Entamoeba invadens
TACTPGYYLDSSSCKKCTNGC

SEQ ID NO: 2826503 - protein, 41 aa, Entamoeba invadens
TACVKEVVWWLILIIVIVFLIILITILMITGISLKCVLERR

SEQ ID NO: 2826504 - protein, 17 aa, Entamoeba invadens
TAFLALTNAGTCDEAVP

SEQ ID NO: 2826505 - protein, 20 aa, Entamoeba invadens
TAFMICTSFTVTSVLLCVAA

SEQ ID NO: 2826506 - protein, 18 aa, Entamoeba invadens
TAFTMLRINPFYSHKTLE

SEQ ID NO: 2826507 - protein, 24 aa, Entamoeba invadens
TAFYKLSFNQLTKEKLEKIANDMV

SEQ ID NO: 2826508 - protein, 25 aa, Entamoeba invadens
TAGDDYIKLLLLPATKISISFGFLL

SEQ ID NO: 2826509 - protein, 27 aa, Entamoeba invadens
TAGTQWTFIQRYWYTLIVKENVENLIY

SEQ ID NO: 2826510 - protein, 20 aa, Entamoeba invadens
TAGTWFLFDIAFYGNSMSNA

SEQ ID NO: 2826511 - protein, 17 aa, Entamoeba invadens
TAGVPIAIILIIAATRE

SEQ ID NO: 2826512 - protein, 24 aa, Entamoeba invadens
TAICTKCIFGYYLSSGECISCETF

SEQ ID NO: 2826513 - protein, 25 aa, Entamoeba invadens
TAIKPFHVSSDLQMLLLGADNEKFP

SEQ ID NO: 2826514 - protein, 22 aa, Entamoeba invadens
TAILLVVVVLHFLFFQDVNPNT

SEQ ID NO: 2826515 - protein, 31 aa, Entamoeba invadens
TAITNTTLAGIKLLLGGKLLRYGTSNKFFCH

SEQ ID NO: 2826516 - protein, 17 aa, Entamoeba invadens
TAKALARSLLELGLKKG

SEQ ID NO: 2826517 - protein, 33 aa, Entamoeba invadens
TAKIMHFAVYFFALVVFVGYIVGLFTNNYIVLP

SEQ ID NO: 2826518 - protein, 20 aa, Entamoeba invadens
TAKVYALSSLILIFSGIWPY

SEQ ID NO: 2826519 - protein, 33 aa, Entamoeba invadens
TAKYNIFTFIPKFLFFQYKQLTNVYFLVNFIIC

SEQ ID NO: 2826520 - protein, 26 aa, Entamoeba invadens
TALFDKPPFKNLIVNGLVLASDGKKM

SEQ ID NO: 2826521 - protein, 22 aa, Entamoeba invadens
TALITLCGKYLIYRNMVGVSRT

SEQ ID NO: 2826522 - protein, 30 aa, Entamoeba invadens
TALLYFVGYIFPLIWMVQLFYIFSKDENTK

SEQ ID NO: 2826523 - protein, 19 aa, Entamoeba invadens
TALVEQRVFFDDDVVLYCF

SEQ ID NO: 2826524 - protein, 27 aa, Entamoeba invadens
TAMFAIFAVFILFLLIGSVMLCLNVTP

SEQ ID NO: 2826525 - protein, 38 aa, Entamoeba invadens
TAMRYDIIFVTNVAVVILIILVLVIVVVLCYQINLHNK

SEQ ID NO: 2826526 - protein, 25 aa, Entamoeba invadens
TANCIALLILFVVDLILVPVSSFTT

SEQ ID NO: 2826527 - protein, 17 aa, Entamoeba invadens
TANCYVCDKDGKCSKCK

SEQ ID NO: 2826528 - protein, 18 aa, Entamoeba invadens
TANEMVYIFIGPENFADE

SEQ ID NO: 2826529 - protein, 23 aa, Entamoeba invadens
TANMDTLFRCAPNTAFLNKASQC

SEQ ID NO: 2826530 - protein, 25 aa, Entamoeba invadens
TANPLKLSILFSTMTGLKVITNNTT

SEQ ID NO: 2826531 - protein, 17 aa, Entamoeba invadens
TAPHCPCTTYDGFTCTI

SEQ ID NO: 2826532 - protein, 36 aa, Entamoeba invadens
TAPLCSIALRPLRLLSTIGITPPLFRSIMKTLHPAL

SEQ ID NO: 2826533 - protein, 23 aa, Entamoeba invadens
TAQCWISIMFLNLGTNYIIRSDG

SEQ ID NO: 2826534 - protein, 22 aa, Entamoeba invadens
TAQFTLKKFIESILKELKTEPM

SEQ ID NO: 2826535 - protein, 26 aa, Entamoeba invadens
TAQGFLLKYLIINYHKFLFKNETFST

SEQ ID NO: 2826536 - protein, 27 aa, Entamoeba invadens
TARKCETCNLGYYPATTSPFKCKECDI

SEQ ID NO: 2826537 - protein, 21 aa, Entamoeba invadens
TARNYFLTMKKLIEELSESER

SEQ ID NO: 2826538 - protein, 25 aa, Entamoeba invadens
TASCTPWPPAKPKEKVSCPADCVGD

SEQ ID NO: 2826539 - protein, 28 aa, Entamoeba invadens
TASIVLLFVVLVFHVLLYLNTEWSTKFN

SEQ ID NO: 2826540 - protein, 27 aa, Entamoeba invadens
TASNEFLPTFFDLFFKKMTSQEIDTFV

SEQ ID NO: 2826541 - protein, 24 aa, Entamoeba invadens
TASTFVLCVFIVFSTIIGLIELQQ

SEQ ID NO: 2826542 - protein, 19 aa, Entamoeba invadens
TATCMPWPPAKPKAKTSCP

SEQ ID NO: 2826543 - protein, 26 aa, Entamoeba invadens
TATIPLIWVCIVALLFLVIPNFHTVN

SEQ ID NO: 2826544 - protein, 26 aa, Entamoeba invadens
TATLYDYYKFILKTPLQSPTLYIDIT

SEQ ID NO: 2826545 - protein, 21 aa, Entamoeba invadens
TAVIFLIASTFWIGLSVGLMV

SEQ ID NO: 2826546 - protein, 19 aa, Entamoeba invadens
TAVLSFASTEPSFCIDLDL

SEQ ID NO: 2826547 - protein, 44 aa, Entamoeba invadens
TAYLYAFVMSLFTLFMFGPLMYRLFYVLFLPKTTTPKSISWLFI

SEQ ID NO: 2826548 - protein, 26 aa, Entamoeba invadens
TAYVTIKMRNPLYPMLQVDNIMPWCE

SEQ ID NO: 2826549 - protein, 23 aa, Entamoeba invadens
TCAENYLFVEYTKKCVKDKCPEN

SEQ ID NO: 2826550 - protein, 23 aa, Entamoeba invadens
TCDSIRCLTCKSGYYMKGDGCEL

SEQ ID NO: 2826551 - protein, 22 aa, Entamoeba invadens
TCDSIRCLTCKSGYYMKGDVCE

SEQ ID NO: 2826552 - protein, 25 aa, Entamoeba invadens
TCDWEFDYPYYQLALISKMCGNEIK

SEQ ID NO: 2826553 - protein, 22 aa, Entamoeba invadens
TCEGGYYLESGSCTECVAGCSA

SEQ ID NO: 2826554 - protein, 18 aa, Entamoeba invadens
TCEKCVKGYYLDTDKCKQ

SEQ ID NO: 2826555 - protein, 25 aa, Entamoeba invadens
TCEPLGDLFTKCDLTLPTGGGCAIC

SEQ ID NO: 2826556 - protein, 17 aa, Entamoeba invadens
TCESCYVGFYKYNETCY

SEQ ID NO: 2826557 - protein, 19 aa, Entamoeba invadens
TCEYGYTQVGTGCRYVPYC

SEQ ID NO: 2826558 - protein, 20 aa, Entamoeba invadens
TCFEGFYLKEEKCANCAERG

SEQ ID NO: 2826559 - protein, 31 aa, Entamoeba invadens
TCFGIKVSLFAIIYLILAFVATVGCYFVAKA

SEQ ID NO: 2826560 - protein, 17 aa, Entamoeba invadens
TCFKCSTGFLLQDNLCV

SEQ ID NO: 2826561 - protein, 19 aa, Entamoeba invadens
TCFNATYCLSCRPTLEFLN

SEQ ID NO: 2826562 - protein, 23 aa, Entamoeba invadens
TCGECIPQFYLKNGICTSDDFNC

SEQ ID NO: 2826563 - protein, 29 aa, Entamoeba invadens
TCGNSLVEQFLKLKYSRIFLNPEKDAMDA

SEQ ID NO: 2826564 - protein, 19 aa, Entamoeba invadens
TCGSRYEAYKYECVSCNTG

SEQ ID NO: 2826565 - protein, 18 aa, Entamoeba invadens
TCHILKLNQKTLITILGF

SEQ ID NO: 2826566 - protein, 27 aa, Entamoeba invadens
TCHKCEKWLYNILVGCLEKTPFGCKKC

SEQ ID NO: 2826567 - protein, 18 aa, Entamoeba invadens
TCIRCQFGYQLDAAMNCV

SEQ ID NO: 2826568 - protein, 19 aa, Entamoeba invadens
TCISGFGLDKKFNCNICPT

SEQ ID NO: 2826569 - protein, 24 aa, Entamoeba invadens
TCITCFDGYYLYKNYCRACPSTCL

SEQ ID NO: 2826570 - protein, 25 aa, Entamoeba invadens
TCKISSLLKLIYIDFKTAKETVFDY

SEQ ID NO: 2826571 - protein, 20 aa, Entamoeba invadens
TCKKDCPEAYFAKDKVCTAC

SEQ ID NO: 2826572 - protein, 20 aa, Entamoeba invadens
TCKKDCPEAYFANDKVCTAC

SEQ ID NO: 2826573 - protein, 25 aa, Entamoeba invadens
TCKKSRLFLVSIYDFIRSIVSFHRN

SEQ ID NO: 2826574 - protein, 20 aa, Entamoeba invadens
TCKPNCPEAYFAKDKVCTAC

SEQ ID NO: 2826575 - protein, 24 aa, Entamoeba invadens
TCKSCKMIYGCELCVNLLVGNVES

SEQ ID NO: 2826576 - protein, 24 aa, Entamoeba invadens
TCKSCRMIYGCELCVNLLVGNVES

SEQ ID NO: 2826577 - protein, 23 aa, Entamoeba invadens
TCKSNYFLIPSEQLLCQSYTSLV

SEQ ID NO: 2826578 - protein, 23 aa, Entamoeba invadens
TCKTCAYGYALNGKVCKKCDTGC

SEQ ID NO: 2826579 - protein, 17 aa, Entamoeba invadens
TCLAMMPNYDGCAICKD

SEQ ID NO: 2826580 - protein, 19 aa, Entamoeba invadens
TCLEGYILVGTTCTKCADS

SEQ ID NO: 2826581 - protein, 17 aa, Entamoeba invadens
TCLFNSTFCLTCKNGYF

SEQ ID NO: 2826582 - protein, 46 aa, Entamoeba invadens
TCLKDKKYFLKIGVPVIVIAIFLIVMVILIIYLTNHIYHRKNVKEL

SEQ ID NO: 2826583 - protein, 21 aa, Entamoeba invadens
TCLLCGNGFYSTKGSLNCLSC

SEQ ID NO: 2826584 - protein, 18 aa, Entamoeba invadens
TCLMCKDSFILSPNACNQ

SEQ ID NO: 2826585 - protein, 21 aa, Entamoeba invadens
TCLNGYYLSDYHCKKCISGCA

SEQ ID NO: 2826586 - protein, 19 aa, Entamoeba invadens
TCLSCFTNYFLLTNNTQCI

SEQ ID NO: 2826587 - protein, 20 aa, Entamoeba invadens
TCLSCFTNYFLLTNNTQCIS

SEQ ID NO: 2826588 - protein, 23 aa, Entamoeba invadens
TCLSCTDGYYLNSNSCTKCKNGC

SEQ ID NO: 2826589 - protein, 17 aa, Entamoeba invadens
TCLSCTSGYYLGSGSCT

SEQ ID NO: 2826590 - protein, 20 aa, Entamoeba invadens
TCLSQFLITIPPVEKSWKNI

SEQ ID NO: 2826591 - protein, 38 aa, Entamoeba invadens
TCNKKAVWWVILFCVIFTICVLIILMISMVCLIKTIER

SEQ ID NO: 2826592 - protein, 17 aa, Entamoeba invadens
TCNSCKPGFYFSNKACH

SEQ ID NO: 2826593 - protein, 25 aa, Entamoeba invadens
TCNSFVDLYLPHGLTKIGYGAFENI

SEQ ID NO: 2826594 - protein, 20 aa, Entamoeba invadens
TCNTCLTCNSTTSYCLTCKV

SEQ ID NO: 2826595 - protein, 19 aa, Entamoeba invadens
TCNTGYYPDPSTHRCIPCH

SEQ ID NO: 2826596 - protein, 17 aa, Entamoeba invadens
TCPAGYYKDAATKKCVK

SEQ ID NO: 2826597 - protein, 23 aa, Entamoeba invadens
TCPEMTYTLSYGSFACLLCNSSC

SEQ ID NO: 2826598 - protein, 17 aa, Entamoeba invadens
TCPITPPEPCRGKGCNP

SEQ ID NO: 2826599 - protein, 18 aa, Entamoeba invadens
TCQYFLYKNTNNTISVLL

SEQ ID NO: 2826600 - protein, 24 aa, Entamoeba invadens
TCRENSGFYLLNGRCVACDSTCKA

SEQ ID NO: 2826601 - protein, 24 aa, Entamoeba invadens
TCRENSGFYLLNGRCVVCDSTCKA

SEQ ID NO: 2826602 - protein, 24 aa, Entamoeba invadens
TCSACSNGYYLDNNSCNKCTNGCS

SEQ ID NO: 2826603 - protein, 24 aa, Entamoeba invadens
TCSKTIKMCLSCAANMISTGTSCV

SEQ ID NO: 2826604 - protein, 21 aa, Entamoeba invadens
TCSPLFERKCIKCVAGSYPQT

SEQ ID NO: 2826605 - protein, 26 aa, Entamoeba invadens
TCSPYGCLYCQRDLLYDPTLSKCVEQ

SEQ ID NO: 2826606 - protein, 24 aa, Entamoeba invadens
TCTACLDGYYKYTTGCLACPSPCL

SEQ ID NO: 2826607 - protein, 18 aa, Entamoeba invadens
TCTACMAEYKLEGGKCNG

SEQ ID NO: 2826608 - protein, 19 aa, Entamoeba invadens
TCTACYTPFYLKDGVCIHC

SEQ ID NO: 2826609 - protein, 22 aa, Entamoeba invadens
TCTECIYGYYLSSLTCKKCTTS

SEQ ID NO: 2826610 - protein, 17 aa, Entamoeba invadens
TCTGCIDGYYKSGQTCT

SEQ ID NO: 2826611 - protein, 21 aa, Entamoeba invadens
TCTKCTIGYYLTKGSCIACPS

SEQ ID NO: 2826612 - protein, 27 aa, Entamoeba invadens
TCTLCLPTDYVLVNSMCQFYSSVENCE

SEQ ID NO: 2826613 - protein, 22 aa, Entamoeba invadens
TCTLCYSGYYLQNGACNSCSQK

SEQ ID NO: 2826614 - protein, 21 aa, Entamoeba invadens
TCTLNCPSNMGPNSNFDGCET

SEQ ID NO: 2826615 - protein, 19 aa, Entamoeba invadens
TCTPCNDLYFSLGGISKCT

SEQ ID NO: 2826616 - protein, 26 aa, Entamoeba invadens
TCTPKEINLIPLAQEDIKCRGGPPLR

SEQ ID NO: 2826617 - protein, 23 aa, Entamoeba invadens
TCTQTLLYPSYLAVGSGSCSEML

SEQ ID NO: 2826618 - protein, 22 aa, Entamoeba invadens
TCVFKRDLFCEETFENQCTKCT

SEQ ID NO: 2826619 - protein, 18 aa, Entamoeba invadens
TCVIKNKIMIFSKGLKTN

SEQ ID NO: 2826620 - protein, 18 aa, Entamoeba invadens
TCVITPTYCLSCPPGFYI

SEQ ID NO: 2826621 - protein, 24 aa, Entamoeba invadens
TCVNGFDIYFENKCLQECPSGYFK

SEQ ID NO: 2826622 - protein, 22 aa, Entamoeba invadens
TCVSSCPDGFYENIKVCSICSK

SEQ ID NO: 2826623 - protein, 34 aa, Entamoeba invadens
TCYAPVKFIFLAFQLFYHLLFKMPACSHILIQNP

SEQ ID NO: 2826624 - protein, 23 aa, Entamoeba invadens
TCYDMSPLYPGKYAKFSISADNT

SEQ ID NO: 2826625 - protein, 18 aa, Entamoeba invadens
TCYECDVGYYLLNNVCNS

SEQ ID NO: 2826626 - protein, 19 aa, Entamoeba invadens
TCYKKGTQCLSCHNGKFLT

SEQ ID NO: 2826627 - protein, 23 aa, Entamoeba invadens
TCYLCLDGYFLSNGICVSIIANC

SEQ ID NO: 2826628 - protein, 36 aa, Entamoeba invadens
TCYMTLYCTTKLRGMKIPYTVWFSKSKIIFSEIALL

SEQ ID NO: 2826629 - protein, 17 aa, Entamoeba invadens
TCYNCETGYFINDFNEC

SEQ ID NO: 2826630 - protein, 34 aa, Entamoeba invadens
TCYSQQPYYCLSCFTGYVLMSNFCRKCPKGCTTC

SEQ ID NO: 2826631 - protein, 23 aa, Entamoeba invadens
TDASRNCILCNTGYYPVNNNNTK

SEQ ID NO: 2826632 - protein, 19 aa, Entamoeba invadens
TDCYYCVDGYYISSFECLS

SEQ ID NO: 2826633 - protein, 26 aa, Entamoeba invadens
TDDDKLPDIIPSVKKTKLRLPQKFEK

SEQ ID NO: 2826634 - protein, 25 aa, Entamoeba invadens
TDEIKLELPFPLTPTHHLLFCVRDI

SEQ ID NO: 2826635 - protein, 23 aa, Entamoeba invadens
TDEKIFDQPWKIPQFVIEGNRLP

SEQ ID NO: 2826636 - protein, 19 aa, Entamoeba invadens
TDFDLFYSETPYTGTLPNN

SEQ ID NO: 2826637 - protein, 22 aa, Entamoeba invadens
TDFFLSDLLKTKSLTLSLCKLY

SEQ ID NO: 2826638 - protein, 28 aa, Entamoeba invadens
TDFSSLTPELLLRFLEKISATKCHVPFP

SEQ ID NO: 2826639 - protein, 17 aa, Entamoeba invadens
TDFTRKCVECNSMFYPK

SEQ ID NO: 2826640 - protein, 25 aa, Entamoeba invadens
TDGDTRQICFCTYDPAIKQDCSLAC

SEQ ID NO: 2826641 - protein, 17 aa, Entamoeba invadens
TDGTGVIFVMMVMALAF

SEQ ID NO: 2826642 - protein, 23 aa, Entamoeba invadens
TDGVFCMMCSDGFYLSPESRRCL

SEQ ID NO: 2826643 - protein, 20 aa, Entamoeba invadens
TDGYLLEQNGFCTKCSKGCS

SEQ ID NO: 2826644 - protein, 20 aa, Entamoeba invadens
TDHFKMFFTLPSTYTEKIYL

SEQ ID NO: 2826645 - protein, 23 aa, Entamoeba invadens
TDIEITPNIFFLRANEGCVVSVS

SEQ ID NO: 2826646 - protein, 43 aa, Entamoeba invadens
TDITEKFLFITWGIFFLLTIPSVVVFSIFLPTMKYPLDELKNT

SEQ ID NO: 2826647 - protein, 17 aa, Entamoeba invadens
TDITIALPDFIITKFIA

SEQ ID NO: 2826648 - protein, 23 aa, Entamoeba invadens
TDKIDMFAIEYFVNNTYYVVYKI

SEQ ID NO: 2826649 - protein, 22 aa, Entamoeba invadens
TDKILPTKTLPKVPPPKVPSKE

SEQ ID NO: 2826650 - protein, 23 aa, Entamoeba invadens
TDKKLLVAYPMALYFILFVLLVM

SEQ ID NO: 2826651 - protein, 25 aa, Entamoeba invadens
TDKKVYLPALNIITAFDLTMPPEVV

SEQ ID NO: 2826652 - protein, 18 aa, Entamoeba invadens
TDKYGAFCLLCDSSSCLK

SEQ ID NO: 2826653 - protein, 23 aa, Entamoeba invadens
TDLFLFVLMKIVLTPKSKNITMF

SEQ ID NO: 2826654 - protein, 23 aa, Entamoeba invadens
TDLKLTYFDTIQSTLGMIISKKG

SEQ ID NO: 2826655 - protein, 19 aa, Entamoeba invadens
TDLLLRLRCPNVVSYMGSA

SEQ ID NO: 2826656 - protein, 21 aa, Entamoeba invadens
TDLRELNLRWLRNQIGLVGQE

SEQ ID NO: 2826657 - protein, 36 aa, Entamoeba invadens
TDMQPLCEGAFMDNVLITSFVYMPAQKVEIGAKAFK

SEQ ID NO: 2826658 - protein, 24 aa, Entamoeba invadens
TDNILEIVGTYDTTYKFCKYKGVN

SEQ ID NO: 2826659 - protein, 21 aa, Entamoeba invadens
TDNLVLYIKNNNLIPIEIENV

SEQ ID NO: 2826660 - protein, 23 aa, Entamoeba invadens
TDNPLSLELRIKIVLDASRGILY

SEQ ID NO: 2826661 - protein, 25 aa, Entamoeba invadens
TDNSKLYVGDIWSFFTYAQSKMSGQ

SEQ ID NO: 2826662 - protein, 26 aa, Entamoeba invadens
TDQPKDTFLAFHPLLMDGKMNENFTS

SEQ ID NO: 2826663 - protein, 25 aa, Entamoeba invadens
TDSKYFYIHACLTYLALNHHYSFII

SEQ ID NO: 2826664 - protein, 17 aa, Entamoeba invadens
TDSNGFLATFDCTPLDE

SEQ ID NO: 2826665 - protein, 21 aa, Entamoeba invadens
TDSSIILTRNFSLIKGGKIKI

SEQ ID NO: 2826666 - protein, 18 aa, Entamoeba invadens
TDSTCPAGYYKDAATKKC

SEQ ID NO: 2826667 - protein, 29 aa, Entamoeba invadens
TDSVLYWKPLFIEELFFNTPITFNVTKTM

SEQ ID NO: 2826668 - protein, 24 aa, Entamoeba invadens
TDSVVSPMVFFLSSTKTTAKYSGS

SEQ ID NO: 2826669 - protein, 40 aa, Entamoeba invadens
TDTFIQRHFLFILVILLFGLFFVVIYSFNLTFYSIQSLVT

SEQ ID NO: 2826670 - protein, 22 aa, Entamoeba invadens
TDTRLYVIFIAPTLLGVVVGVG

SEQ ID NO: 2826671 - protein, 21 aa, Entamoeba invadens
TDVIFKDLWLENDVFASLCEI

SEQ ID NO: 2826672 - protein, 17 aa, Entamoeba invadens
TDVLYFIQNYRKNGQKI

SEQ ID NO: 2826673 - protein, 23 aa, Entamoeba invadens
TDVNLLINKWYTPLVSNYQKYIF

SEQ ID NO: 2826674 - protein, 19 aa, Entamoeba invadens
TDYGFCYYTQRTRLGKWFS

SEQ ID NO: 2826675 - protein, 17 aa, Entamoeba invadens
TDYKIFYSKAPKLEAGS

SEQ ID NO: 2826676 - protein, 19 aa, Entamoeba invadens
TDYLYSLSNLYFSLTEDIK

SEQ ID NO: 2826677 - protein, 23 aa, Entamoeba invadens
TDYNLTMGYVKLATPTVSHAQIL

SEQ ID NO: 2826678 - protein, 30 aa, Entamoeba invadens
TEAFALFSQLLYSKIVSIKLNITRYANSQI

SEQ ID NO: 2826679 - protein, 21 aa, Entamoeba invadens
TEAFIKFIHVVAFAVKCVERL

SEQ ID NO: 2826680 - protein, 31 aa, Entamoeba invadens
TEAKERLKYMWIIFSIYLKSLIGFYQENGVF

SEQ ID NO: 2826681 - protein, 54 aa, Entamoeba invadens
TECLYHTNLFLAVGVPIIGVFVLVVLLFILISILVFYIYQRKKKLQKEAKICEF

SEQ ID NO: 2826682 - protein, 52 aa, Entamoeba invadens
TECLYTPNMFVFVGIPVIVIVVVIILLIIISFLIYVLYKHLKQKQLAEKTVT

SEQ ID NO: 2826683 - protein, 23 aa, Entamoeba invadens
TECSTGYYPSPPTHKCVTCHSTC

SEQ ID NO: 2826684 - protein, 29 aa, Entamoeba invadens
TECTTCQVLYYRPLNWKELGWKLCHPQSE

SEQ ID NO: 2826685 - protein, 24 aa, Entamoeba invadens
TECVACEFAYVLYNGSCYSNSCKG

SEQ ID NO: 2826686 - protein, 24 aa, Entamoeba invadens
TEDFEIKCLISLPLKIGCSVCNKK

SEQ ID NO: 2826687 - protein, 18 aa, Entamoeba invadens
TEDFFLKCKKEMPNMVGC

SEQ ID NO: 2826688 - protein, 40 aa, Entamoeba invadens
TEEDKESDLLWLWIFLGVLAGLLIIIGISGIVTGVILYNR

SEQ ID NO: 2826689 - protein, 22 aa, Entamoeba invadens
TEFAKFGSFLDLIKKRRNDPID

SEQ ID NO: 2826690 - protein, 18 aa, Entamoeba invadens
TEFAPFGSLKDVLKSKRL

SEQ ID NO: 2826691 - protein, 21 aa, Entamoeba invadens
TEFCPLFSLRKYMKTNYMTKI

SEQ ID NO: 2826692 - protein, 29 aa, Entamoeba invadens
TEFEFLHFNIPFGVIGLWGIYFGEAVSQN

SEQ ID NO: 2826693 - protein, 18 aa, Entamoeba invadens
TEFLLMDAAIMKADAEAM

SEQ ID NO: 2826694 - protein, 22 aa, Entamoeba invadens
TEGKMWYIPKINNIYLSAFLRA

SEQ ID NO: 2826695 - protein, 23 aa, Entamoeba invadens
TEHSILLALFLIKSFSFSTDGIT

SEQ ID NO: 2826696 - protein, 24 aa, Entamoeba invadens
TEIDIFINKWYTPLVSNYQTYIFK

SEQ ID NO: 2826697 - protein, 22 aa, Entamoeba invadens
TEIRDWVLIPLFVVTVCSNYIR

SEQ ID NO: 2826698 - protein, 18 aa, Entamoeba invadens
TEIRPFRVSSDLELALLS

SEQ ID NO: 2826699 - protein, 23 aa, Entamoeba invadens
TEIRYVLRWLQRSLPEKMPFEKG

SEQ ID NO: 2826700 - protein, 27 aa, Entamoeba invadens
TEKDTLIPFVKRYVVWFTVSLTDSYFP

SEQ ID NO: 2826701 - protein, 23 aa, Entamoeba invadens
TEKDVFWCSFTPLNGPEDDDEFF

SEQ ID NO: 2826702 - protein, 28 aa, Entamoeba invadens
TEKMKCTKCIYGYYPDTNKNCVLGTLEH

SEQ ID NO: 2826703 - protein, 32 aa, Entamoeba invadens
TELIKNTEILYPFFKHILSYLVPNYCKAIFLD

SEQ ID NO: 2826704 - protein, 32 aa, Entamoeba invadens
TELILSPNGVFLNTLFSLLLTAFVGIGYEEAM

SEQ ID NO: 2826705 - protein, 19 aa, Entamoeba invadens
TELISYQTQLFVYQSIRVE

SEQ ID NO: 2826706 - protein, 31 aa, Entamoeba invadens
TELKPIMPPIGEGAFGLVFRGTYRGTEVAIK

SEQ ID NO: 2826707 - protein, 26 aa, Entamoeba invadens
TELQKRWLVTYSINWLPFVSLSKDFS

SEQ ID NO: 2826708 - protein, 18 aa, Entamoeba invadens
TEMCKYVRLFRSFCPSES

SEQ ID NO: 2826709 - protein, 24 aa, Entamoeba invadens
TEMSSIFIGSASQLVFTPNAKLHV

SEQ ID NO: 2826710 - protein, 28 aa, Entamoeba invadens
TENITVCVDCMYGYFLNTEYQCEKCDDV

SEQ ID NO: 2826711 - protein, 24 aa, Entamoeba invadens
TENKYDFCLPISTLNINNCKHVQS

SEQ ID NO: 2826712 - protein, 30 aa, Entamoeba invadens
TENLSYPIINVIVFILMIFRHSAFSDSASF

SEQ ID NO: 2826713 - protein, 23 aa, Entamoeba invadens
TENVIKFRKFYVSSIDVNCTTFT

SEQ ID NO: 2826714 - protein, 24 aa, Entamoeba invadens
TENVIPFDVYFFVSVRGFQTVNVT

SEQ ID NO: 2826715 - protein, 23 aa, Entamoeba invadens
TENYLIKFNRIGIPIIVIAIIVV

SEQ ID NO: 2826716 - protein, 43 aa, Entamoeba invadens
TEPNTPYLLGGILLAIFMTTFSIFLLVMCFTPNHIIQPVIEST

SEQ ID NO: 2826717 - protein, 19 aa, Entamoeba invadens
TERFVKITVLKTPLGVILD

SEQ ID NO: 2826718 - protein, 18 aa, Entamoeba invadens
TERILGEGSFGVVYKGKY

SEQ ID NO: 2826719 - protein, 37 aa, Entamoeba invadens
TERYLGLAEKYRASPLLHLLWIDNIIKKQIEIGNFLE

SEQ ID NO: 2826720 - protein, 17 aa, Entamoeba invadens
TESPSVFVILIPTTFDL

SEQ ID NO: 2826721 - protein, 23 aa, Entamoeba invadens
TESSLFDMISWASTYLFGGNSSL

SEQ ID NO: 2826722 - protein, 25 aa, Entamoeba invadens
TETFKEIVLFLRFVVDTFFLTQNER

SEQ ID NO: 2826723 - protein, 25 aa, Entamoeba invadens
TETNILLFVFMLFGAISSFLAMASI

SEQ ID NO: 2826724 - protein, 22 aa, Entamoeba invadens
TEVYMMYFPIMFYYLMGNRVVE

SEQ ID NO: 2826725 - protein, 20 aa, Entamoeba invadens
TEYIYYVLLIFYTLLFMDDN

SEQ ID NO: 2826726 - protein, 29 aa, Entamoeba invadens
TEYKPLLYSLLAIFSIIVVLALEIVPELN

SEQ ID NO: 2826727 - protein, 21 aa, Entamoeba invadens
TEYLVRRCCAFYLGSNINFTV

SEQ ID NO: 2826728 - protein, 37 aa, Entamoeba invadens
TEYNYHGVPSPWLQVRILRILRYIPPKKGAEENYLSD

SEQ ID NO: 2826729 - protein, 17 aa, Entamoeba invadens
TFAKYYTTNGILYGSNA

SEQ ID NO: 2826730 - protein, 26 aa, Entamoeba invadens
TFAVLSLVFFIISLLVLLVCMGFIIF

SEQ ID NO: 2826731 - protein, 30 aa, Entamoeba invadens
TFCDKKAVWWVLLIVVVFAIIVMAVVITSI

SEQ ID NO: 2826732 - protein, 19 aa, Entamoeba invadens
TFCLKCDVNFFLSQNKCFS

SEQ ID NO: 2826733 - protein, 49 aa, Entamoeba invadens
TFCNKRTVWWVVLLVVFFLLFICIGIILITMFGLWKIKEKFGERSHASR

SEQ ID NO: 2826734 - protein, 31 aa, Entamoeba invadens
TFCQIFFLCILIFGVLFWNLAILTMNTNWRA

SEQ ID NO: 2826735 - protein, 23 aa, Entamoeba invadens
TFCSIFMDFAWIGPVIADFVINL

SEQ ID NO: 2826736 - protein, 26 aa, Entamoeba invadens
TFDEFKRRWTNPTPLQLLNDRLNKQK

SEQ ID NO: 2826737 - protein, 24 aa, Entamoeba invadens
TFERTKWASVLFSSSKKYQLLSQN

SEQ ID NO: 2826738 - protein, 21 aa, Entamoeba invadens
TFFFSFVLLLLVSLSLWTAFQ

SEQ ID NO: 2826739 - protein, 26 aa, Entamoeba invadens
TFFKFLYYMMIAPLGIYLFRNEDWMP

SEQ ID NO: 2826740 - protein, 20 aa, Entamoeba invadens
TFFLIVKSCNFEMDVYGCLT

SEQ ID NO: 2826741 - protein, 29 aa, Entamoeba invadens
TFFPSNGCAFCKSGYYWKDRDCNKCAFEC

SEQ ID NO: 2826742 - protein, 19 aa, Entamoeba invadens
TFFTLCLSEIDPWIDNTKL

SEQ ID NO: 2826743 - protein, 26 aa, Entamoeba invadens
TFFTLNYEYIFFNGSFVIGDNLIDIT

SEQ ID NO: 2826744 - protein, 24 aa, Entamoeba invadens
TFGANGFLRLITTDATTFPSTYPS

SEQ ID NO: 2826745 - protein, 22 aa, Entamoeba invadens
TFGIEFVKSLQFLKMASQYIGN

SEQ ID NO: 2826746 - protein, 18 aa, Entamoeba invadens
TFGIVHRDLKPQNILINV

SEQ ID NO: 2826747 - protein, 26 aa, Entamoeba invadens
TFGKYALSTLNFDNFVLPSGSTIAEG

SEQ ID NO: 2826748 - protein, 37 aa, Entamoeba invadens
TFGMFSNLFFFSIFNGIFFPFYLKTGSLAFTKCEGNY

SEQ ID NO: 2826749 - protein, 27 aa, Entamoeba invadens
TFGVSLILFCVLMARLWEGIYTIVVRL

SEQ ID NO: 2826750 - protein, 19 aa, Entamoeba invadens
TFHAFLFMGSIVFPLCTYV

SEQ ID NO: 2826751 - protein, 27 aa, Entamoeba invadens
TFHIMGGLTSFYKFSFVPSSSNIIDSS

SEQ ID NO: 2826752 - protein, 26 aa, Entamoeba invadens
TFKCVKCVFWYIPSADGTFCMKKNVW

SEQ ID NO: 2826753 - protein, 18 aa, Entamoeba invadens
TFKFPWKIAEFVIHNNRL

SEQ ID NO: 2826754 - protein, 21 aa, Entamoeba invadens
TFKSLTVASEFKLLTVLNTMT

SEQ ID NO: 2826755 - protein, 27 aa, Entamoeba invadens
TFKSNPQSVIPFAWVSPSLSREIILEG

SEQ ID NO: 2826756 - protein, 24 aa, Entamoeba invadens
TFKTYFESALVNIKKRKTFKWNAE

SEQ ID NO: 2826757 - protein, 30 aa, Entamoeba invadens
TFLASMLPNTILPLLFSFLQNPNVSNGQLE

SEQ ID NO: 2826758 - protein, 40 aa, Entamoeba invadens
TFLHDGIARPAFVQLLLKVNPLLYTFTLQSKPIGDCTSII

SEQ ID NO: 2826759 - protein, 19 aa, Entamoeba invadens
TFLKSVDQLILLTGKHEDK

SEQ ID NO: 2826760 - protein, 29 aa, Entamoeba invadens
TFLSILSSFLLPNFPFTVYGGLNVTEELT

SEQ ID NO: 2826761 - protein, 26 aa, Entamoeba invadens
TFLVGVPIWFMHFANIYEIPFLDPKK

SEQ ID NO: 2826762 - protein, 33 aa, Entamoeba invadens
TFNDYYPFIYVMFLCYILLKLMVMLFVSHFDIS

SEQ ID NO: 2826763 - protein, 19 aa, Entamoeba invadens
TFNIYPFVSPISGVPDYTI

SEQ ID NO: 2826764 - protein, 21 aa, Entamoeba invadens
TFNLVAFLLPLIVGPISDKLN

SEQ ID NO: 2826765 - protein, 34 aa, Entamoeba invadens
TFNTIDAFIDHYYRYIPLLTFNSPSPLVKKAKLL

SEQ ID NO: 2826766 - protein, 23 aa, Entamoeba invadens
TFNTTFSVFTKKRAFPLCHIVSS

SEQ ID NO: 2826767 - protein, 35 aa, Entamoeba invadens
TFNVNWKHLLIAFLLLIGFIVCVKTLRTPFIRSSY

SEQ ID NO: 2826768 - protein, 29 aa, Entamoeba invadens
TFPDKNFFQKIFWFPVRYSCTQFNNYKNE

SEQ ID NO: 2826769 - protein, 21 aa, Entamoeba invadens
TFPKNLNGLLPYYTTTRFLQN

SEQ ID NO: 2826770 - protein, 25 aa, Entamoeba invadens
TFPLFYNWFNFLVAIILTVLASFLK

SEQ ID NO: 2826771 - protein, 27 aa, Entamoeba invadens
TFPSPFNLLWFVPFFTMIYTLRVILAE

SEQ ID NO: 2826772 - protein, 24 aa, Entamoeba invadens
TFPTTFFFHFNETVYFNVMEIRMR

SEQ ID NO: 2826773 - protein, 28 aa, Entamoeba invadens
TFQEYFITIILFVYHLRHNLLATLGLAI

SEQ ID NO: 2826774 - protein, 19 aa, Entamoeba invadens
TFQYLTILEVFKDGVPLNF

SEQ ID NO: 2826775 - protein, 23 aa, Entamoeba invadens
TFRPKEIAALFFKTLMNQIKMEV

SEQ ID NO: 2826776 - protein, 25 aa, Entamoeba invadens
TFSDPFDLILYFNKVEFDSSEVIEQ

SEQ ID NO: 2826777 - protein, 26 aa, Entamoeba invadens
TFSIEGYFCFPMVDYIFFDETSKVST

SEQ ID NO: 2826778 - protein, 24 aa, Entamoeba invadens
TFSLFCVLCFFIILGYYLDGKLGT

SEQ ID NO: 2826779 - protein, 25 aa, Entamoeba invadens
TFSSNFDFFFPFLNDSYSVAYKTQM

SEQ ID NO: 2826780 - protein, 18 aa, Entamoeba invadens
TFSTLRFIQALSPQEKNT

SEQ ID NO: 2826781 - protein, 27 aa, Entamoeba invadens
TFTCEPLGDLFTKCDLTLPTGGGCAIC

SEQ ID NO: 2826782 - protein, 28 aa, Entamoeba invadens
TFTCEPLGNLFTKCDLTLPTGGGCAICK

SEQ ID NO: 2826783 - protein, 21 aa, Entamoeba invadens
TFTDMCFSAFITVPDLIVKDG

SEQ ID NO: 2826784 - protein, 27 aa, Entamoeba invadens
TFTFLRFFFTPYRVIIVKRFFLLQGVI

SEQ ID NO: 2826785 - protein, 28 aa, Entamoeba invadens
TFTKDDGILPIYRLPKNKIKKDYPKDSN

SEQ ID NO: 2826786 - protein, 27 aa, Entamoeba invadens
TFTKDDGILPIYRLPKNKIKKDYPKES

SEQ ID NO: 2826787 - protein, 17 aa, Entamoeba invadens
TFTKGIGTPKYMAPEIL

SEQ ID NO: 2826788 - protein, 17 aa, Entamoeba invadens
TFTKGIGTPKYMAPEVL

SEQ ID NO: 2826789 - protein, 20 aa, Entamoeba invadens
TFTKYEFGFCYLFTANKGTS

SEQ ID NO: 2826790 - protein, 17 aa, Entamoeba invadens
TFTLEEPTLIMICDYTH

SEQ ID NO: 2826791 - protein, 18 aa, Entamoeba invadens
TFTLGPFHDFSWTAFLMV

SEQ ID NO: 2826792 - protein, 18 aa, Entamoeba invadens
TFTLGPFHDFSWTAFVMV

SEQ ID NO: 2826793 - protein, 23 aa, Entamoeba invadens
TFTLLSLFVFLTAAVILVLFDPN

SEQ ID NO: 2826794 - protein, 18 aa, Entamoeba invadens
TFTLPLYNENIYVSLIAL

SEQ ID NO: 2826795 - protein, 19 aa, Entamoeba invadens
TFTLPLYNENIYVSLIALD

SEQ ID NO: 2826796 - protein, 22 aa, Entamoeba invadens
TFTPISQLSFSIKSNVKSISFS

SEQ ID NO: 2826797 - protein, 25 aa, Entamoeba invadens
TFTVSLMSLIFFKLKMESTYQTFQQ

SEQ ID NO: 2826798 - protein, 24 aa, Entamoeba invadens
TFVATMFQLILSLSVLILDLKEKN

SEQ ID NO: 2826799 - protein, 26 aa, Entamoeba invadens
TFVEFNNIILLRNFSAPIYFAESTEN

SEQ ID NO: 2826800 - protein, 18 aa, Entamoeba invadens
TFVHVEPFVIFRRKSRTI

SEQ ID NO: 2826801 - protein, 19 aa, Entamoeba invadens
TFVPWNIMVMTILTGITGA

SEQ ID NO: 2826802 - protein, 19 aa, Entamoeba invadens
TFVQIFERGCVIDFTGYND

SEQ ID NO: 2826803 - protein, 19 aa, Entamoeba invadens
TFVSLISMLYFSSSVFHFL

SEQ ID NO: 2826804 - protein, 21 aa, Entamoeba invadens
TFVTTFSVLFLSASIFRILEG

SEQ ID NO: 2826805 - protein, 20 aa, Entamoeba invadens
TFVYSFQIPDFINKGNRLPK

SEQ ID NO: 2826806 - protein, 31 aa, Entamoeba invadens
TFYFDLHIICFLIPLGIYFLLKDLKDETVFM

SEQ ID NO: 2826807 - protein, 17 aa, Entamoeba invadens
TFYLSICVVPILCVAKD

SEQ ID NO: 2826808 - protein, 39 aa, Entamoeba invadens
TGATAPILFFIVCIILLVLVIYWALIPIALCLVCVAINI

SEQ ID NO: 2826809 - protein, 23 aa, Entamoeba invadens
TGCAICRDGYYYHNKDCIKCDSS

SEQ ID NO: 2826810 - protein, 35 aa, Entamoeba invadens
TGCEKQPKWEIFLIIFLFVFEVSKIVVIFGTAITK

SEQ ID NO: 2826811 - protein, 47 aa, Entamoeba invadens
TGCKTHVVWWVLFIVIVIFLIFILLIIFAIFRLNLLIIKMRRNAKLR

SEQ ID NO: 2826812 - protein, 23 aa, Entamoeba invadens
TGCLFLYSNFYGMKIRSMYLAAL

SEQ ID NO: 2826813 - protein, 17 aa, Entamoeba invadens
TGCPGGFYSVYYGSSKC

SEQ ID NO: 2826814 - protein, 19 aa, Entamoeba invadens
TGCVRCRPGYYLNSLKLCE

SEQ ID NO: 2826815 - protein, 21 aa, Entamoeba invadens
TGCYIYICNVPFCSTCKTNKE

SEQ ID NO: 2826816 - protein, 26 aa, Entamoeba invadens
TGDAELLVTILWALANMIYFNDDYIK

SEQ ID NO: 2826817 - protein, 22 aa, Entamoeba invadens
TGDGLFFQFALSVGIFLTSIFL

SEQ ID NO: 2826818 - protein, 24 aa, Entamoeba invadens
TGEEWTLLFAWKNVDIKNFMYRVA

SEQ ID NO: 2826819 - protein, 25 aa, Entamoeba invadens
TGFCTSCKLNYLLYDGKCYPKATNC

SEQ ID NO: 2826820 - protein, 17 aa, Entamoeba invadens
TGFLLRVGLIMYGMYQD

SEQ ID NO: 2826821 - protein, 24 aa, Entamoeba invadens
TGFTYLVFHYKTQLTPIVIGSVKK

SEQ ID NO: 2826822 - protein, 24 aa, Entamoeba invadens
TGGAYLFFDKYLVTQRERFERVWS

SEQ ID NO: 2826823 - protein, 31 aa, Entamoeba invadens
TGGRQLEYVGDRAFFFCPINAICLDENAISY

SEQ ID NO: 2826824 - protein, 24 aa, Entamoeba invadens
TGIFAFLLSYVFPCAFVLAARRIG

SEQ ID NO: 2826825 - protein, 17 aa, Entamoeba invadens
TGIFFGFANTFYSVFLD

SEQ ID NO: 2826826 - protein, 25 aa, Entamoeba invadens
TGIFGFVLILILPAMFQIFSKKTYR

SEQ ID NO: 2826827 - protein, 23 aa, Entamoeba invadens
TGIIILAIILLIPYMFVKEHVSK

SEQ ID NO: 2826828 - protein, 42 aa, Entamoeba invadens
TGIIVSCVLISLFLILIGAIIVVLLLWYFKKPTTKKDEKTEI

SEQ ID NO: 2826829 - protein, 23 aa, Entamoeba invadens
TGIQSGIVLIAKSASLSGLTKTC

SEQ ID NO: 2826830 - protein, 26 aa, Entamoeba invadens
TGKCFKCLDGFYLVSGQCALCNKTIQ

SEQ ID NO: 2826831 - protein, 26 aa, Entamoeba invadens
TGKCFKCLDGFYLVSGQCALCNNTIQ

SEQ ID NO: 2826832 - protein, 26 aa, Entamoeba invadens
TGKCFKCLDGFYLVSGQCALCNNTMQ

SEQ ID NO: 2826833 - protein, 23 aa, Entamoeba invadens
TGKKIFVFSKWEQNIQRVTKCIE

SEQ ID NO: 2826834 - protein, 24 aa, Entamoeba invadens
TGLFPICEIGRYRRYTQCDTNTTP

SEQ ID NO: 2826835 - protein, 26 aa, Entamoeba invadens
TGLLTVVYMFWLVFAVIRSFSEARKL

SEQ ID NO: 2826836 - protein, 19 aa, Entamoeba invadens
TGLQHISQRAFYGCPGLTT

SEQ ID NO: 2826837 - protein, 41 aa, Entamoeba invadens
TGLTLIIVGVFLFVVICVGIILVVLLFVVKYKKTDINIYKT

SEQ ID NO: 2826838 - protein, 31 aa, Entamoeba invadens
TGMFFDFSVYFYWLVIPVLMKNLGASPMVIG

SEQ ID NO: 2826839 - protein, 17 aa, Entamoeba invadens
TGMFLSPTAQTFLPFQF

SEQ ID NO: 2826840 - protein, 19 aa, Entamoeba invadens
TGSVKLLHLYENTNIFITK

SEQ ID NO: 2826841 - protein, 24 aa, Entamoeba invadens
TGSYVIFISWVYQKLWSYFEKYGF

SEQ ID NO: 2826842 - protein, 23 aa, Entamoeba invadens
TGTCVKFPTEAPMLKLKCSSSDC

SEQ ID NO: 2826843 - protein, 25 aa, Entamoeba invadens
TGTTLLPIFFLLIQESFALAFFWSI

SEQ ID NO: 2826844 - protein, 21 aa, Entamoeba invadens
TGVCLTCYSGYQLNALQSCEI

SEQ ID NO: 2826845 - protein, 23 aa, Entamoeba invadens
TGVCLTCYSGYQLNALQSCEICR

SEQ ID NO: 2826846 - protein, 23 aa, Entamoeba invadens
TGVCLTCYTGYQLNASQSCEICQ

SEQ ID NO: 2826847 - protein, 21 aa, Entamoeba invadens
TGVLKAFAFLFEYIGEKSKDY

SEQ ID NO: 2826848 - protein, 21 aa, Entamoeba invadens
TGVLVITLIRFLCPPMQEEES

SEQ ID NO: 2826849 - protein, 26 aa, Entamoeba invadens
TGYAMGFALCWDLTLVILCMSPFTMM

SEQ ID NO: 2826850 - protein, 18 aa, Entamoeba invadens
TGYLITFCGIIMAIAFSG

SEQ ID NO: 2826851 - protein, 19 aa, Entamoeba invadens
THCLSCAPTYFFKTNTSEC

SEQ ID NO: 2826852 - protein, 18 aa, Entamoeba invadens
THCLSCKTGYYFDSNMTC

SEQ ID NO: 2826853 - protein, 21 aa, Entamoeba invadens
THCLSCRPILEFLNKDNKCQS

SEQ ID NO: 2826854 - protein, 20 aa, Entamoeba invadens
THDGILCDVGYITGDKLKCL

SEQ ID NO: 2826855 - protein, 24 aa, Entamoeba invadens
THDSLSDGVLAVSFVLSLIALFAF

SEQ ID NO: 2826856 - protein, 27 aa, Entamoeba invadens
THDSYRRSFWMTYPFTQLNLDTQNVNF

SEQ ID NO: 2826857 - protein, 25 aa, Entamoeba invadens
THFKEKSFYISKLSSITFGSSVAEL

SEQ ID NO: 2826858 - protein, 22 aa, Entamoeba invadens
THHLYFYSEKIKKEFILTCIKG

SEQ ID NO: 2826859 - protein, 35 aa, Entamoeba invadens
THILAFIVISLSILFVVVLLTLLAVFILKNILKKK

SEQ ID NO: 2826860 - protein, 17 aa, Entamoeba invadens
THILTIGNIVLVVTAES

SEQ ID NO: 2826861 - protein, 23 aa, Entamoeba invadens
THKLLTLSNNGLLRYCPIDDINN

SEQ ID NO: 2826862 - protein, 24 aa, Entamoeba invadens
THQDLLWGSIFNHDLFYLNDTFSL

SEQ ID NO: 2826863 - protein, 22 aa, Entamoeba invadens
THSCRFWRCYSHRQSTVLQVPL

SEQ ID NO: 2826864 - protein, 24 aa, Entamoeba invadens
THSKTYFFISLLDKLKETSYKIST

SEQ ID NO: 2826865 - protein, 18 aa, Entamoeba invadens
THTFGKNTIYLLENADFT

SEQ ID NO: 2826866 - protein, 23 aa, Entamoeba invadens
THWSLLYVNVVMKVAFYYDSVAS

SEQ ID NO: 2826867 - protein, 24 aa, Entamoeba invadens
THYSKYIMPFIKDEFFSTLSMVAP

SEQ ID NO: 2826868 - protein, 25 aa, Entamoeba invadens
TIALLILMTILLKYVFDPQRHHFVL

SEQ ID NO: 2826869 - protein, 17 aa, Entamoeba invadens
TIALLLCGLGYLALHQL

SEQ ID NO: 2826870 - protein, 34 aa, Entamoeba invadens
TIAQRHTLMFIILRQFFVLILDQDKLISKMALHE

SEQ ID NO: 2826871 - protein, 28 aa, Entamoeba invadens
TIAWVATIFVPFIVFNTYIQLSISVGFA

SEQ ID NO: 2826872 - protein, 45 aa, Entamoeba invadens
TICEKRSLWWISLIAIFFVILVVGVVAIILWQVIGRIAFIHAVET

SEQ ID NO: 2826873 - protein, 17 aa, Entamoeba invadens
TICESNYYPKQGRCVPC

SEQ ID NO: 2826874 - protein, 40 aa, Entamoeba invadens
TICKASIYLIVLVLVIVIIFIFIYLFVSKSIIELQRLEGI

SEQ ID NO: 2826875 - protein, 41 aa, Entamoeba invadens
TICPVKGYWYLAVDIQLSLPLYFIKKFFGFFNVTSYMIPIS

SEQ ID NO: 2826876 - protein, 24 aa, Entamoeba invadens
TIDNPILGDFFVDPVYGPLVVKMS

SEQ ID NO: 2826877 - protein, 19 aa, Entamoeba invadens
TIDSYMFYVGFKIVKKRFN

SEQ ID NO: 2826878 - protein, 24 aa, Entamoeba invadens
TIEENYMVCIFNMLASFLDSTDNS

SEQ ID NO: 2826879 - protein, 26 aa, Entamoeba invadens
TIELKKPLFIIGLPRSGTTFLHHLLA

SEQ ID NO: 2826880 - protein, 23 aa, Entamoeba invadens
TIEQLLTVFWLRANVAKSQLVQD

SEQ ID NO: 2826881 - protein, 25 aa, Entamoeba invadens
TIESLDKILLILMKREYLFVGFEEW

SEQ ID NO: 2826882 - protein, 19 aa, Entamoeba invadens
TIFALLYVLNVPTTYILSL

SEQ ID NO: 2826883 - protein, 20 aa, Entamoeba invadens
TIFECDITHFLFDNSCELLI

SEQ ID NO: 2826884 - protein, 29 aa, Entamoeba invadens
TIFFSLMYLIIQLLITLLIITLKGKLTKK

SEQ ID NO: 2826885 - protein, 32 aa, Entamoeba invadens
TIFGLGCGIFLAMYFLFGLSFISGEKLISRMR

SEQ ID NO: 2826886 - protein, 19 aa, Entamoeba invadens
TIFIDSFIFLNSCCNSTLL

SEQ ID NO: 2826887 - protein, 30 aa, Entamoeba invadens
TIFKVSIILYVAFFVNVIFVILAFIFAYSI

SEQ ID NO: 2826888 - protein, 19 aa, Entamoeba invadens
TIFNWELLSVGTFLQYCIS

SEQ ID NO: 2826889 - protein, 25 aa, Entamoeba invadens
TIFVDSPILVIKKSGVLITVSENSF

SEQ ID NO: 2826890 - protein, 20 aa, Entamoeba invadens
TIFVYPWDIADFVNAGNRRP

SEQ ID NO: 2826891 - protein, 33 aa, Entamoeba invadens
TIGFFSLYRYANWVDIFLFVFGTFGSFASGALK

SEQ ID NO: 2826892 - protein, 17 aa, Entamoeba invadens
TIGQVYQILVSWGLDIT

SEQ ID NO: 2826893 - protein, 24 aa, Entamoeba invadens
TIGRLVFYLALLEPIFLEKSVEDI

SEQ ID NO: 2826894 - protein, 26 aa, Entamoeba invadens
TIGYTYLLFGWVSLTFYFVAVIVVDF

SEQ ID NO: 2826895 - protein, 30 aa, Entamoeba invadens
TIHCTTRIRGMKIPYTVWFSKSKTTLHSIA

SEQ ID NO: 2826896 - protein, 19 aa, Entamoeba invadens
TIIAIMSLLLNVRFDLFEQ

SEQ ID NO: 2826897 - protein, 38 aa, Entamoeba invadens
TIIDNMVSLLFPFPPTQKVFPILPYKNLNVLSGSDTFI

SEQ ID NO: 2826898 - protein, 40 aa, Entamoeba invadens
TIIKRYTWFHFGSLLFTFLVIILYLFIQQAILYTDWMWYN

SEQ ID NO: 2826899 - protein, 19 aa, Entamoeba invadens
TIILILIVELRRLSLRHLI

SEQ ID NO: 2826900 - protein, 21 aa, Entamoeba invadens
TIILWIITFLLSLTSFILSLT

SEQ ID NO: 2826901 - protein, 19 aa, Entamoeba invadens
TIILYLITAVASYFFKIVY

SEQ ID NO: 2826902 - protein, 22 aa, Entamoeba invadens
TIIPHDTFKGCKSLLLLNGTEF

SEQ ID NO: 2826903 - protein, 17 aa, Entamoeba invadens
TIIPRCYPCQSNCSLCV

SEQ ID NO: 2826904 - protein, 26 aa, Entamoeba invadens
TIITLVEWWFLPFAGVIVFVIAFPAM

SEQ ID NO: 2826905 - protein, 20 aa, Entamoeba invadens
TIIVNRLWINKGVNMSMNGN

SEQ ID NO: 2826906 - protein, 28 aa, Entamoeba invadens
TIKNFINWRLILLFPLALVFGFSRSYYY

SEQ ID NO: 2826907 - protein, 21 aa, Entamoeba invadens
TILFIPYVFTPVVLLVCLLSC

SEQ ID NO: 2826908 - protein, 17 aa, Entamoeba invadens
TILIHKRNRKIKMDKIC

SEQ ID NO: 2826909 - protein, 17 aa, Entamoeba invadens
TILLAEYVSTISGSLVT

SEQ ID NO: 2826910 - protein, 18 aa, Entamoeba invadens
TILRGKAIEFEVLLSPLC

SEQ ID NO: 2826911 - protein, 20 aa, Entamoeba invadens
TILTNIDKFIFKVEPEVVLI

SEQ ID NO: 2826912 - protein, 20 aa, Entamoeba invadens
TILTNINKFIFKVEPEVVLI

SEQ ID NO: 2826913 - protein, 23 aa, Entamoeba invadens
TIMFGFSFNFWWAVVCRFISGFV

SEQ ID NO: 2826914 - protein, 17 aa, Entamoeba invadens
TINALPFIQLKESRYFS

SEQ ID NO: 2826915 - protein, 20 aa, Entamoeba invadens
TINALPFIQLKESRYFSVES

SEQ ID NO: 2826916 - protein, 18 aa, Entamoeba invadens
TINGLQVTTLKLPTTYKS

SEQ ID NO: 2826917 - protein, 25 aa, Entamoeba invadens
TINITNFMHVYFAILIMNSNTIING

SEQ ID NO: 2826918 - protein, 23 aa, Entamoeba invadens
TINKLLRCKLGFFDITPIGRIQN

SEQ ID NO: 2826919 - protein, 17 aa, Entamoeba invadens
TINLNIPLVINGDKCYS

SEQ ID NO: 2826920 - protein, 22 aa, Entamoeba invadens
TINLNNIYLIDESAFAGLTSLQ

SEQ ID NO: 2826921 - protein, 17 aa, Entamoeba invadens
TINLRFNYDIFKEGFDC

SEQ ID NO: 2826922 - protein, 21 aa, Entamoeba invadens
TIPDFTFKGCTILATVTGINA

SEQ ID NO: 2826923 - protein, 25 aa, Entamoeba invadens
TIPSETWSWSFLTLIGGGAYVFKFV

SEQ ID NO: 2826924 - protein, 33 aa, Entamoeba invadens
TIPTTNTLVINKLFKFFVMKMSQNINIRATKSL

SEQ ID NO: 2826925 - protein, 17 aa, Entamoeba invadens
TIQFTYRPKGAFPVLLS

SEQ ID NO: 2826926 - protein, 26 aa, Entamoeba invadens
TIQIKAKFYFFNGKMPAFLINNSTTS

SEQ ID NO: 2826927 - protein, 24 aa, Entamoeba invadens
TIQITFDMLVIAKNGYYVNGDKST

SEQ ID NO: 2826928 - protein, 24 aa, Entamoeba invadens
TIRDLPIFFTNQINTTIFSFQSSF

SEQ ID NO: 2826929 - protein, 19 aa, Entamoeba invadens
TIRDLYVKYYILNDDEFKN

SEQ ID NO: 2826930 - protein, 26 aa, Entamoeba invadens
TIRFELSIVTIPPKFACEFSLFLNPL

SEQ ID NO: 2826931 - protein, 31 aa, Entamoeba invadens
TIRFEPSIATIPPKFACEFSLFLNPLCTSTI

SEQ ID NO: 2826932 - protein, 28 aa, Entamoeba invadens
TIRKKYVNVYVIVSPPLLLVFENKEDVV

SEQ ID NO: 2826933 - protein, 19 aa, Entamoeba invadens
TIRLSFFDYSHFKLNGYIH

SEQ ID NO: 2826934 - protein, 19 aa, Entamoeba invadens
TIRNLLNTCLPQNLTLLKY

SEQ ID NO: 2826935 - protein, 25 aa, Entamoeba invadens
TISLLFLIYTMVIYLFNNTVTNFSR

SEQ ID NO: 2826936 - protein, 26 aa, Entamoeba invadens
TISPNQLWNGFALPKVSSPNGLKLAT

SEQ ID NO: 2826937 - protein, 26 aa, Entamoeba invadens
TISWKDPYPEEKFKFPWKIAEIISSG

SEQ ID NO: 2826938 - protein, 25 aa, Entamoeba invadens
TITALCLGFIYSWDVSLVILSFVPI

SEQ ID NO: 2826939 - protein, 24 aa, Entamoeba invadens
TITLAKYINLIGNKLIRICPQNVT

SEQ ID NO: 2826940 - protein, 22 aa, Entamoeba invadens
TITPQLRHLYPDCTDYIQPINN

SEQ ID NO: 2826941 - protein, 26 aa, Entamoeba invadens
TITVQMRSIIDFALFETGDITLNTIV

SEQ ID NO: 2826942 - protein, 36 aa, Entamoeba invadens
TIVALPMVHLIVMLLLWIFPFNRKFQNWVFNTCEIL

SEQ ID NO: 2826943 - protein, 39 aa, Entamoeba invadens
TIVCFINISLAIFFFWKILLVVFFVLFELSFAIVHNSFK

SEQ ID NO: 2826944 - protein, 17 aa, Entamoeba invadens
TIVCSKGYYIFKGVCVS

SEQ ID NO: 2826945 - protein, 25 aa, Entamoeba invadens
TIVGKEYFIHLASSPKKRGMFIAYF

SEQ ID NO: 2826946 - protein, 17 aa, Entamoeba invadens
TIVLPQKIEEFGTNVFD

SEQ ID NO: 2826947 - protein, 25 aa, Entamoeba invadens
TIVNEYIHQILGLLLEQLTLIKQAL

SEQ ID NO: 2826948 - protein, 23 aa, Entamoeba invadens
TIVNYYIYNISVCKGNILTLINL

SEQ ID NO: 2826949 - protein, 37 aa, Entamoeba invadens
TIVSVICLLLLVIFMLFMPSMFVTAVMSFVLAIIVGY

SEQ ID NO: 2826950 - protein, 17 aa, Entamoeba invadens
TIVVQPEVVILKRKQGC

SEQ ID NO: 2826951 - protein, 25 aa, Entamoeba invadens
TIVVRLHAVFIVLPLLAIGSNVLSH

SEQ ID NO: 2826952 - protein, 28 aa, Entamoeba invadens
TIYALIMSVVLTFKLKPDVLLCNGPGTC

SEQ ID NO: 2826953 - protein, 21 aa, Entamoeba invadens
TIYSLLNKMWCFEFKVRIVID

SEQ ID NO: 2826954 - protein, 25 aa, Entamoeba invadens
TKAQMTLLVIILVVAVTKGYLCSVG

SEQ ID NO: 2826955 - protein, 21 aa, Entamoeba invadens
TKCFWGCATCYSQQPYYCLSC

SEQ ID NO: 2826956 - protein, 21 aa, Entamoeba invadens
TKCIQCPIGQKLFNNVCTIIM

SEQ ID NO: 2826957 - protein, 24 aa, Entamoeba invadens
TKCISWHQCKNTIVLALVCALCVF

SEQ ID NO: 2826958 - protein, 18 aa, Entamoeba invadens
TKCKFWNSPNLEGKCCET

SEQ ID NO: 2826959 - protein, 20 aa, Entamoeba invadens
TKCKTCEDGYYLLSGRCILG

SEQ ID NO: 2826960 - protein, 19 aa, Entamoeba invadens
TKCKTKFNLMADNLKCVEK

SEQ ID NO: 2826961 - protein, 37 aa, Entamoeba invadens
TKCLAILGFGFAILAAIYLYLGLFLAAGEKMIARMRS

SEQ ID NO: 2826962 - protein, 18 aa, Entamoeba invadens
TKCLEYKKIEHCSKFSLT

SEQ ID NO: 2826963 - protein, 23 aa, Entamoeba invadens
TKCLLCVFGYYQGDNYTCLPSTE

SEQ ID NO: 2826964 - protein, 20 aa, Entamoeba invadens
TKCLSCIDGFYLADEGKCSA

SEQ ID NO: 2826965 - protein, 20 aa, Entamoeba invadens
TKCLSCIDGFYLAGEGKCSA

SEQ ID NO: 2826966 - protein, 19 aa, Entamoeba invadens
TKCSFWHTPSANGTFCNIK

SEQ ID NO: 2826967 - protein, 20 aa, Entamoeba invadens
TKCTFWHLPNTSKTLCEEHV

SEQ ID NO: 2826968 - protein, 60 aa, Entamoeba invadens
TKCTFWHRPVSYGQYCEAHVVWWVVLLIILFFILLVFSIITLIIYILRVLTDRKRRKIQE

SEQ ID NO: 2826969 - protein, 19 aa, Entamoeba invadens
TKCYTCDGGFYLFNYACFE

SEQ ID NO: 2826970 - protein, 26 aa, Entamoeba invadens
TKDKQDYLPLSYKLKVRMLFDTARGM

SEQ ID NO: 2826971 - protein, 20 aa, Entamoeba invadens
TKELLKRKPFGKYNSLLSPK

SEQ ID NO: 2826972 - protein, 23 aa, Entamoeba invadens
TKELMTLCPTYIYPQSMSSDKLL

SEQ ID NO: 2826973 - protein, 18 aa, Entamoeba invadens
TKEQLTYATLSSIEPSKG

SEQ ID NO: 2826974 - protein, 18 aa, Entamoeba invadens
TKEQYELIDKCWKTRESE

SEQ ID NO: 2826975 - protein, 20 aa, Entamoeba invadens
TKEVLYNACLLFKKLKENEK

SEQ ID NO: 2826976 - protein, 32 aa, Entamoeba invadens
TKFNRRYLTPANRLARLAIFRSSLKKIRERSI

SEQ ID NO: 2826977 - protein, 23 aa, Entamoeba invadens
TKFQSPLIIWRRKAPLDPNTNNQ

SEQ ID NO: 2826978 - protein, 20 aa, Entamoeba invadens
TKGCLRCFSGYYLADRMCVK

SEQ ID NO: 2826979 - protein, 18 aa, Entamoeba invadens
TKGCLTCDATKCLSCALG

SEQ ID NO: 2826980 - protein, 22 aa, Entamoeba invadens
TKHILFVLCPLLLIVTTTVLLF

SEQ ID NO: 2826981 - protein, 31 aa, Entamoeba invadens
TKHSCIHVTWGYYLLYAKYGYYRVGMDCVEC

SEQ ID NO: 2826982 - protein, 24 aa, Entamoeba invadens
TKIIFDIFTFLKVFCSFNVKRSNE

SEQ ID NO: 2826983 - protein, 24 aa, Entamoeba invadens
TKILKVMFSVGWFPHIFMSIAKMC

SEQ ID NO: 2826984 - protein, 22 aa, Entamoeba invadens
TKINGMPRFSVRVKIMMDLANG

SEQ ID NO: 2826985 - protein, 19 aa, Entamoeba invadens
TKIPLWIDENDKTKVRIMR

SEQ ID NO: 2826986 - protein, 27 aa, Entamoeba invadens
TKIRDMKIPFTLWFSKNRQTLTEIASL

SEQ ID NO: 2826987 - protein, 20 aa, Entamoeba invadens
TKIREMKIPYTVWFSESKHT

SEQ ID NO: 2826988 - protein, 25 aa, Entamoeba invadens
TKITTLNIKQGCELILDAIPELKNV

SEQ ID NO: 2826989 - protein, 29 aa, Entamoeba invadens
TKIVGIWDFCWTLFGLPQIGLNSKLLEWD

SEQ ID NO: 2826990 - protein, 24 aa, Entamoeba invadens
TKIVNDLVFSFTFGKVAISLFDDY

SEQ ID NO: 2826991 - protein, 42 aa, Entamoeba invadens
TKKGRFKKAFYIICSCMIIFVIIVCVGSIVLPILIKAAEFTL

SEQ ID NO: 2826992 - protein, 19 aa, Entamoeba invadens
TKKLPVVIPFEQFGYFARP

SEQ ID NO: 2826993 - protein, 22 aa, Entamoeba invadens
TKKRPPIHIVVERLDSFMRSAQ

SEQ ID NO: 2826994 - protein, 25 aa, Entamoeba invadens
TKKSGVPFYYQFVPVDGRCVVDSSS

SEQ ID NO: 2826995 - protein, 21 aa, Entamoeba invadens
TKKYNFFSLFPKIIVEHFYRL

SEQ ID NO: 2826996 - protein, 30 aa, Entamoeba invadens
TKKYNRMVLQCFLKMLLELSNVLLLESGQM

SEQ ID NO: 2826997 - protein, 18 aa, Entamoeba invadens
TKLEPVFMMSIIPHFISL

SEQ ID NO: 2826998 - protein, 41 aa, Entamoeba invadens
TKLFPRAKTLYLPSYLCLIPQLIYFNFSFIEVKDFNDDKPI

SEQ ID NO: 2826999 - protein, 17 aa, Entamoeba invadens
TKLIYFESVCRVTSLSL

SEQ ID NO: 2827000 - protein, 20 aa, Entamoeba invadens
TKLLEMCKIGKYVRYGLCRN

SEQ ID NO: 2827001 - protein, 17 aa, Entamoeba invadens
TKLLIDGHLLRLGSSNK

SEQ ID NO: 2827002 - protein, 24 aa, Entamoeba invadens
TKLRNPFVVGYLGSVTYLPQIAMV

SEQ ID NO: 2827003 - protein, 24 aa, Entamoeba invadens
TKMGLVTCDLPPPPALMMEQKQDI

SEQ ID NO: 2827004 - protein, 17 aa, Entamoeba invadens
TKNLREHLIIWLHYHHM

SEQ ID NO: 2827005 - protein, 17 aa, Entamoeba invadens
TKPLLRLRFCQDVARGM

SEQ ID NO: 2827006 - protein, 23 aa, Entamoeba invadens
TKQADHVLLVNTISITGGALGDK

SEQ ID NO: 2827007 - protein, 25 aa, Entamoeba invadens
TKQFVKFATVCGVSFILRSILFTIG

SEQ ID NO: 2827008 - protein, 26 aa, Entamoeba invadens
TKQTVKIKMFLLTKTVLLVSETILTY

SEQ ID NO: 2827009 - protein, 20 aa, Entamoeba invadens
TKRNYLSHITILMLSSRICL

SEQ ID NO: 2827010 - protein, 23 aa, Entamoeba invadens
TKSEYSLLRRMVSTLGPIPDTML

SEQ ID NO: 2827011 - protein, 18 aa, Entamoeba invadens
TKSFIYLSVGNRSIGFSS

SEQ ID NO: 2827012 - protein, 22 aa, Entamoeba invadens
TKSKITLPFYNIDSVKFADNDE

SEQ ID NO: 2827013 - protein, 22 aa, Entamoeba invadens
TKTATCMPWPPAKPKAKTSCPA

SEQ ID NO: 2827014 - protein, 26 aa, Entamoeba invadens
TKTENYDICRFDFIGGKTITFRSFNG

SEQ ID NO: 2827015 - protein, 47 aa, Entamoeba invadens
TKTKCIAQAVWWVILLCVLFIISIFVIIIAMSIYFFIAILNHHKTEK

SEQ ID NO: 2827016 - protein, 50 aa, Entamoeba invadens
TKTKCIAQAVWWVILLCVLFVMVIFIIFIALSIFVFIVILNHRKTEKLQE

SEQ ID NO: 2827017 - protein, 44 aa, Entamoeba invadens
TKTKCITQAVWWVILLCVLFVIFIFIIIIASSIFIFIAILNHRK

SEQ ID NO: 2827018 - protein, 42 aa, Entamoeba invadens
TKTNFKTIKQMLLIRALALLITFFPLFVRTFPLKSSCSCTYS

SEQ ID NO: 2827019 - protein, 20 aa, Entamoeba invadens
TKTVAIIIGSLLGVVCVFAI

SEQ ID NO: 2827020 - protein, 20 aa, Entamoeba invadens
TKVCDFYLTSFLYLINYNLI

SEQ ID NO: 2827021 - protein, 26 aa, Entamoeba invadens
TKVDDEIFITLRYGKLRTLLMDLNNQ

SEQ ID NO: 2827022 - protein, 24 aa, Entamoeba invadens
TKVFYYFISLLVLLLMLVDSYQFP

SEQ ID NO: 2827023 - protein, 30 aa, Entamoeba invadens
TKVVITKVLLMQIAKFLQLPQSADATLLKL

SEQ ID NO: 2827024 - protein, 32 aa, Entamoeba invadens
TKWDKCFMITFFIVGIFFPPLLLVGLIAKRKY

SEQ ID NO: 2827025 - protein, 17 aa, Entamoeba invadens
TKWKVITIYIYEAFCIT

SEQ ID NO: 2827026 - protein, 28 aa, Entamoeba invadens
TKYSIFSFIFVFLYNQFKHVTNIYFLLV

SEQ ID NO: 2827027 - protein, 21 aa, Entamoeba invadens
TKYYNLLRVFIIKKMTNLMSK

SEQ ID NO: 2827028 - protein, 21 aa, Entamoeba invadens
TLAKWIVEKIQKLGLNTYRIV

SEQ ID NO: 2827029 - protein, 18 aa, Entamoeba invadens
TLASFSVISLLIFAIVNA

SEQ ID NO: 2827030 - protein, 19 aa, Entamoeba invadens
TLCDEGFYLDLNSSNCVSC

SEQ ID NO: 2827031 - protein, 35 aa, Entamoeba invadens
TLCDKKAVWWVLLIVVLFAIIVMAVVITSIVFVVY

SEQ ID NO: 2827032 - protein, 21 aa, Entamoeba invadens
TLCEINFILLNGVCSHFSILE

SEQ ID NO: 2827033 - protein, 18 aa, Entamoeba invadens
TLCESCIDNYILTNKQCV

SEQ ID NO: 2827034 - protein, 40 aa, Entamoeba invadens
TLCESRAVWWVILVVVLFVLIVLLVLIVLSVIATKIIFNK

SEQ ID NO: 2827035 - protein, 45 aa, Entamoeba invadens
TLCNKKIVWWVLLVIILFTIIMMIFLILLIIFTVKCIENKVHQKQ

SEQ ID NO: 2827036 - protein, 21 aa, Entamoeba invadens
TLDLNLPTITKFFLTVLTTST

SEQ ID NO: 2827037 - protein, 30 aa, Entamoeba invadens
TLDTPIEITFKLLTIEKPIIFGNGVSVRIE

SEQ ID NO: 2827038 - protein, 32 aa, Entamoeba invadens
TLEIITTIVIAFLVLLFLITGGMILTQPGFEC

SEQ ID NO: 2827039 - protein, 19 aa, Entamoeba invadens
TLEKKFVLRAFDYLLGKKS

SEQ ID NO: 2827040 - protein, 19 aa, Entamoeba invadens
TLELSSTYKYLYISTGKET

SEQ ID NO: 2827041 - protein, 27 aa, Entamoeba invadens
TLERDIDWLDYLWMASSFIVPCRFEIQ

SEQ ID NO: 2827042 - protein, 23 aa, Entamoeba invadens
TLEVIVSIVWLFCVVQWTACAGL

SEQ ID NO: 2827043 - protein, 23 aa, Entamoeba invadens
TLEWTDPYPKEYFKFAWSIADFV

SEQ ID NO: 2827044 - protein, 23 aa, Entamoeba invadens
TLFAFVVFPLFPSKNNLTERPKK

SEQ ID NO: 2827045 - protein, 19 aa, Entamoeba invadens
TLFALMFGAPGVYIVFLLI

SEQ ID NO: 2827046 - protein, 18 aa, Entamoeba invadens
TLFALSLADYGFLEGNYY

SEQ ID NO: 2827047 - protein, 20 aa, Entamoeba invadens
TLFALYFVAWIVFSIFLIVM

SEQ ID NO: 2827048 - protein, 21 aa, Entamoeba invadens
TLFENVSLIISSPLHFNKTLN

SEQ ID NO: 2827049 - protein, 19 aa, Entamoeba invadens
TLFFLIVEIITMFKPSPRF

SEQ ID NO: 2827050 - protein, 19 aa, Entamoeba invadens
TLFLFSLALQDAREKDTDS

SEQ ID NO: 2827051 - protein, 29 aa, Entamoeba invadens
TLFLLLRIPVWILEVLIGFLMLKIHYTDP

SEQ ID NO: 2827052 - protein, 48 aa, Entamoeba invadens
TLFQGVTFLENIFDDFKFERAKLTDFYLYKGVFIKFKVKESQITNMTI

SEQ ID NO: 2827053 - protein, 31 aa, Entamoeba invadens
TLFQLIVKFNKIISIFFLFGLCNVEGFMRII

SEQ ID NO: 2827054 - protein, 21 aa, Entamoeba invadens
TLFRVWIFTIKDYFFTAILLL

SEQ ID NO: 2827055 - protein, 26 aa, Entamoeba invadens
TLFSRGIPCFIRKSGKVYAVFNNEEI

SEQ ID NO: 2827056 - protein, 19 aa, Entamoeba invadens
TLFVFSALSIYNSVAFKSA

SEQ ID NO: 2827057 - protein, 17 aa, Entamoeba invadens
TLFVNNICRSPIGYMIL

SEQ ID NO: 2827058 - protein, 18 aa, Entamoeba invadens
TLGAFGYILSVSKVGSLN

SEQ ID NO: 2827059 - protein, 26 aa, Entamoeba invadens
TLGDVVFQYMFLADFELIKADNFISQ

SEQ ID NO: 2827060 - protein, 27 aa, Entamoeba invadens
TLGKGSFGIVYLGTFRGNKVAIKKMKT

SEQ ID NO: 2827061 - protein, 17 aa, Entamoeba invadens
TLGYIVGEVWKGGIDDL

SEQ ID NO: 2827062 - protein, 24 aa, Entamoeba invadens
TLHAPKKMLLKNAPILSGINGTVN

SEQ ID NO: 2827063 - protein, 32 aa, Entamoeba invadens
TLHCTTRLRGLKIPYTVWFSKSRKPLVQVSEL

SEQ ID NO: 2827064 - protein, 23 aa, Entamoeba invadens
TLIKNFMSKIKDSNFWTVSCDGS

SEQ ID NO: 2827065 - protein, 23 aa, Entamoeba invadens
TLILICILLLFSIIVLPIICCCC

SEQ ID NO: 2827066 - protein, 19 aa, Entamoeba invadens
TLILTITISFVLFAGAAFS

SEQ ID NO: 2827067 - protein, 31 aa, Entamoeba invadens; identical to SEQ ID NO: 2806218

SEQ ID NO: 2827068 - protein, 20 aa, Entamoeba invadens
TLISAIVFFRGELGQVIVTN

SEQ ID NO: 2827069 - protein, 17 aa, Entamoeba invadens
TLIVFYLVGGLIIFPMC

SEQ ID NO: 2827070 - protein, 20 aa, Entamoeba invadens
TLIVILTNYFFKLNSKTTRE

SEQ ID NO: 2827071 - protein, 22 aa, Entamoeba invadens
TLIVLLMLYLVFFLSHWEEYHT

SEQ ID NO: 2827072 - protein, 25 aa, Entamoeba invadens
TLIVPSFVHLFKEFNWWPIKYKTDV

SEQ ID NO: 2827073 - protein, 17 aa, Entamoeba invadens
TLIVVITLFHKYLMPFV

SEQ ID NO: 2827074 - protein, 31 aa, Entamoeba invadens
TLKELISSIFLPWFNTMKYLQQSFKPGMKIM

SEQ ID NO: 2827075 - protein, 30 aa, Entamoeba invadens
TLKKGGVPVLLFKQVIDFPLKVLSKLQTLG

SEQ ID NO: 2827076 - protein, 17 aa, Entamoeba invadens
TLKLKIFKEVGPFTRDG

SEQ ID NO: 2827077 - protein, 21 aa, Entamoeba invadens
TLLAVFILKNILKKKTDVLQD

SEQ ID NO: 2827078 - protein, 17 aa, Entamoeba invadens
TLLCFTSADLLNEFSGD

SEQ ID NO: 2827079 - protein, 21 aa, Entamoeba invadens
TLLFLVKGKVLVIFDSANDKV

SEQ ID NO: 2827080 - protein, 17 aa, Entamoeba invadens
TLLLILSVSSQFSSCNN

SEQ ID NO: 2827081 - protein, 26 aa, Entamoeba invadens
TLLPTSPYTYGIFFKLTSAVKQNIYI

SEQ ID NO: 2827082 - protein, 26 aa, Entamoeba invadens
TLLRARPFPMRSLVKLAQVIILESKK

SEQ ID NO: 2827083 - protein, 18 aa, Entamoeba invadens
TLLSFFDVTPLGRLLNYF

SEQ ID NO: 2827084 - protein, 20 aa, Entamoeba invadens
TLLSFVVLGLFFEWKNKTRV

SEQ ID NO: 2827085 - protein, 33 aa, Entamoeba invadens
TLLYLDVVSFLPFLFYIIPAFSKCRMSSFLNLI

SEQ ID NO: 2827086 - protein, 20 aa, Entamoeba invadens
TLMEEYLNKLTWPYDVLVRG

SEQ ID NO: 2827087 - protein, 31 aa, Entamoeba invadens
TLMLAPKVFTLDSYRLPPPAEWAGFDWGVVE

SEQ ID NO: 2827088 - protein, 31 aa, Entamoeba invadens
TLMMGIASPPMFIVLYSYLGTYVGKWVYVSL

SEQ ID NO: 2827089 - protein, 20 aa, Entamoeba invadens
TLNILSKILIQTTSFNSNDV

SEQ ID NO: 2827090 - protein, 18 aa, Entamoeba invadens
TLNMFLPTRIAFTDLEVI

SEQ ID NO: 2827091 - protein, 23 aa, Entamoeba invadens
TLNNNFTLTIPLLNQSNDAFITM

SEQ ID NO: 2827092 - protein, 19 aa, Entamoeba invadens
TLNNNLTLTIPLLNQSNDA

SEQ ID NO: 2827093 - protein, 25 aa, Entamoeba invadens
TLNQNFTVFLIGGLSYTPKIKEIVE

SEQ ID NO: 2827094 - protein, 19 aa, Entamoeba invadens
TLPLFRNSMIVSSMTYSLP

SEQ ID NO: 2827095 - protein, 26 aa, Entamoeba invadens
TLQTIIFNTFVFCQIFNEVNSRRVNG

SEQ ID NO: 2827096 - protein, 19 aa, Entamoeba invadens
TLRCKLFNYNTLLLTDTNI

SEQ ID NO: 2827097 - protein, 18 aa, Entamoeba invadens
TLRVFLLISKDCNTAFTM

SEQ ID NO: 2827098 - protein, 18 aa, Entamoeba invadens
TLRVSPELISLKKGFACE

SEQ ID NO: 2827099 - protein, 19 aa, Entamoeba invadens
TLRVSPELISLKKGFACEF

SEQ ID NO: 2827100 - protein, 17 aa, Entamoeba invadens
TLSAPFPQFKFMEEVRS

SEQ ID NO: 2827101 - protein, 24 aa, Entamoeba invadens
TLSFIFKLWFFRDNVRIHSGLIMK

SEQ ID NO: 2827102 - protein, 26 aa, Entamoeba invadens
TLSIEPLAFIPFVIESIKILKRELNN

SEQ ID NO: 2827103 - protein, 32 aa, Entamoeba invadens
TLSIKRMSDFIFLLYGVFLLLYSVYVSVFRLQ

SEQ ID NO: 2827104 - protein, 28 aa, Entamoeba invadens
TLSLTDKILFLIIRKFANEFPKMPFVAS

SEQ ID NO: 2827105 - protein, 25 aa, Entamoeba invadens
TLSNEAFFFFFDESKFRATEFVFKK

SEQ ID NO: 2827106 - protein, 25 aa, Entamoeba invadens
TLSPRIPIFSVFLKDMISIQQFDTF

SEQ ID NO: 2827107 - protein, 25 aa, Entamoeba invadens
TLSSTTINLSVGLFANCVHLRTVAL

SEQ ID NO: 2827108 - protein, 25 aa, Entamoeba invadens
TLSVDVLGIIPFLVESLKQLNKEIG

SEQ ID NO: 2827109 - protein, 25 aa, Entamoeba invadens
TLTDPMKLYQISEGLYRISTSDGYY

SEQ ID NO: 2827110 - protein, 24 aa, Entamoeba invadens
TLTKLPISRLLDSLGKFSNTPLIK

SEQ ID NO: 2827111 - protein, 20 aa, Entamoeba invadens
TLTLLFLVVYLLIMTRKPHH

SEQ ID NO: 2827112 - protein, 24 aa, Entamoeba invadens
TLTNACVLRFSPHTKFIVSRGAYI

SEQ ID NO: 2827113 - protein, 20 aa, Entamoeba invadens
TLTNCQLRFPNPVNILTYKQ

SEQ ID NO: 2827114 - protein, 20 aa, Entamoeba invadens
TLVEPSFSLFLECFTKKGSD

SEQ ID NO: 2827115 - protein, 20 aa, Entamoeba invadens
TLVEQFTCSSGCQSTCIANY

SEQ ID NO: 2827116 - protein, 24 aa, Entamoeba invadens
TLVFGMYYFIVEVIMVHVVLPQQS

SEQ ID NO: 2827117 - protein, 21 aa, Entamoeba invadens
TLVFNTFVFCQVFNMFNSRKV

SEQ ID NO: 2827118 - protein, 17 aa, Entamoeba invadens
TLVLIVTILIVLIAFVI

SEQ ID NO: 2827119 - protein, 25 aa, Entamoeba invadens
TLVLRLLFISLGCAVGRLISRFCLF

SEQ ID NO: 2827120 - protein, 17 aa, Entamoeba invadens
TLVLSLRTCNNPFCTSC

SEQ ID NO: 2827121 - protein, 24 aa, Entamoeba invadens
TLVNMLVIGIYNILMFYINQNVMP

SEQ ID NO: 2827122 - protein, 19 aa, Entamoeba invadens
TLVQLLKTDFLKCVGSFVY

SEQ ID NO: 2827123 - protein, 25 aa, Entamoeba invadens
TLWIFVFINRKEAVKFLMSKRAFFP

SEQ ID NO: 2827124 - protein, 27 aa, Entamoeba invadens
TLYIVGFISLFIFFVVPRKFNDIKKGS

SEQ ID NO: 2827125 - protein, 26 aa, Entamoeba invadens
TMAAILGIIFMLVKWIRDPLLIRGDW

SEQ ID NO: 2827126 - protein, 30 aa, Entamoeba invadens
TMAETFRWGNVFPLELYPKAWDIADEIASG

SEQ ID NO: 2827127 - protein, 27 aa, Entamoeba invadens
TMAKEEILFVVWSVLMGLSTINTFGLV

SEQ ID NO: 2827128 - protein, 18 aa, Entamoeba invadens
TMCLSCKSGFYQGDNYTC

SEQ ID NO: 2827129 - protein, 18 aa, Entamoeba invadens
TMCLSCVDGFFLSDHICK

SEQ ID NO: 2827130 - protein, 18 aa, Entamoeba invadens
TMCYLCNTTTMLLNGVCN

SEQ ID NO: 2827131 - protein, 29 aa, Entamoeba invadens
TMDISFMESVWWVFKQLYEKQLVYRGLKV

SEQ ID NO: 2827132 - protein, 34 aa, Entamoeba invadens
TMFEAFTWQEAYPKEQFRFPWKIAEYVTHGKHPR

SEQ ID NO: 2827133 - protein, 35 aa, Entamoeba invadens
TMFECFGWCQAYPKTQFKFPWTIAEFVIEGKRLDK

SEQ ID NO: 2827134 - protein, 38 aa, Entamoeba invadens
TMFECFGWCQAYPKTQFKYPWVIAKFVIEGKRLDKKEN

SEQ ID NO: 2827135 - protein, 35 aa, Entamoeba invadens
TMFECFSWENAYPSNQFKFPWKIAEFVTGGNRLKR

SEQ ID NO: 2827136 - protein, 27 aa, Entamoeba invadens
TMFEVFGWCEAYPKEMFKFPWNIAEMV

SEQ ID NO: 2827137 - protein, 26 aa, Entamoeba invadens
TMGEYAIVTEFIPFGALSKLHQKENF

SEQ ID NO: 2827138 - protein, 18 aa, Entamoeba invadens
TMIPEGTFLGCTKLNNVS

SEQ ID NO: 2827139 - protein, 18 aa, Entamoeba invadens
TMKISKDTNIPLLTLVTS

SEQ ID NO: 2827140 - protein, 27 aa, Entamoeba invadens
TMKLNKRIFLLKFTKHKFQTICKGVGV

SEQ ID NO: 2827141 - protein, 24 aa, Entamoeba invadens
TMKYKEYISMVLYLLDDIDRVNYL

SEQ ID NO: 2827142 - protein, 31 aa, Entamoeba invadens
TMLDDLLWVRHLPIAFLMRQHLFLLNKNEEI

SEQ ID NO: 2827143 - protein, 26 aa, Entamoeba invadens
TMLEIAMWKEVFRKDDKDFKYAWNIA

SEQ ID NO: 2827144 - protein, 32 aa, Entamoeba invadens
TMLSCFAWDNPFPKTIYPFAWSIADEISVGKR

SEQ ID NO: 2827145 - protein, 20 aa, Entamoeba invadens
TMLSQLRHQTTVNLIGAVYT

SEQ ID NO: 2827146 - protein, 22 aa, Entamoeba invadens
TMMLVPFTLFFFTAIPQIDWNA

SEQ ID NO: 2827147 - protein, 19 aa, Entamoeba invadens
TMPTTIGLASRFKAVRPKN

SEQ ID NO: 2827148 - protein, 28 aa, Entamoeba invadens
TMQFKSMHLFMILQVLGSIVFYHSSGEM

SEQ ID NO: 2827149 - protein, 20 aa, Entamoeba invadens
TMQYKTWMKKVEGKMLRGIV

SEQ ID NO: 2827150 - protein, 20 aa, Entamoeba invadens
TMSHLKVCGVYWGLMVLHML

SEQ ID NO: 2827151 - protein, 26 aa, Entamoeba invadens
TMSKACKWRFGFTVVTFLIALVLVLI

SEQ ID NO: 2827152 - protein, 32 aa, Entamoeba invadens
TMSVAKTTKILFFDILKITTLILPNEEHTNKG

SEQ ID NO: 2827153 - protein, 34 aa, Entamoeba invadens
TMTNLRIRIQLYKAFYKFAAVYIRAYKMSPDKAK

SEQ ID NO: 2827154 - protein, 33 aa, Entamoeba invadens
TMVITSLFVLLVTAVIYFLTKKLKKSSKRTSLM

SEQ ID NO: 2827155 - protein, 33 aa, Entamoeba invadens
TMYECFAWRCAYVDLAFKFPWKIAEFVVGGHRL

SEQ ID NO: 2827156 - protein, 36 aa, Entamoeba invadens
TMYECFGWCNAFSEKQFKFPWKIAEFVTRGEHLEKQ

SEQ ID NO: 2827157 - protein, 36 aa, Entamoeba invadens
TMYECFGWCNAFSEKQFKFPWKIAEFVTRGERLEKT

SEQ ID NO: 2827158 - protein, 36 aa, Entamoeba invadens
TMYECFGWCNAFSEKQFKFPWKITEFVTRGEHLEKQ

SEQ ID NO: 2827159 - protein, 34 aa, Entamoeba invadens
TMYECFGWCNAYSEKQFKFPWKIAEFVTNGKRLE

SEQ ID NO: 2827160 - protein, 34 aa, Entamoeba invadens
TMYECFGWCNAYSEKQFKFPWKIAEFVTTGKRLE

SEQ ID NO: 2827161 - protein, 38 aa, Entamoeba invadens
TMYEVFGWCDVYPKEIFKYPWKIADFVVIGKRVDKKES

SEQ ID NO: 2827162 - protein, 20 aa, Entamoeba invadens
TMYFYYYFYSDYFISSLRLL

SEQ ID NO: 2827163 - protein, 38 aa, Entamoeba invadens
TMYSVMIWDDPYPKELFSYPWIVATFIAEGKRRPKANL

SEQ ID NO: 2827164 - protein, 19 aa, Entamoeba invadens
TNALTLKYLGTQTTIPIVN

SEQ ID NO: 2827165 - protein, 24 aa, Entamoeba invadens
TNANIKFPLILANKSDFLDIGNVD

SEQ ID NO: 2827166 - protein, 22 aa, Entamoeba invadens
TNATPYVFMFDATTIKITCMID

SEQ ID NO: 2827167 - protein, 17 aa, Entamoeba invadens
TNCFFVPHSNVLKTPQS

SEQ ID NO: 2827168 - protein, 24 aa, Entamoeba invadens
TNCFICKEGFYLHTNQCISCENNC

SEQ ID NO: 2827169 - protein, 23 aa, Entamoeba invadens
TNCINFFVLLAASFVFILFGCGS

SEQ ID NO: 2827170 - protein, 17 aa, Entamoeba invadens
TNCKLCRNIINFGIRCE

SEQ ID NO: 2827171 - protein, 47 aa, Entamoeba invadens
TNCKSHVVWWVILLLTIVAVVILIVTILIVIYIAIVIMRHKEQHIRY

SEQ ID NO: 2827172 - protein, 25 aa, Entamoeba invadens
TNCLKLVLIVLFWVFVLAPEETMVG

SEQ ID NO: 2827173 - protein, 23 aa, Entamoeba invadens
TNCLSCVQGERYLWNNQCLSCSN

SEQ ID NO: 2827174 - protein, 27 aa, Entamoeba invadens
TNCLTCNNYYYYYSYGYCVKCDYSCNT

SEQ ID NO: 2827175 - protein, 25 aa, Entamoeba invadens
TNCNDGYYLDISSCKKCATGCSKCS

SEQ ID NO: 2827176 - protein, 19 aa, Entamoeba invadens
TNCYLYLNQNISNFNFQLV

SEQ ID NO: 2827177 - protein, 20 aa, Entamoeba invadens
TNCYLYLNQNISNFNFQLVE

SEQ ID NO: 2827178 - protein, 19 aa, Entamoeba invadens
TNCYMYYYRELTIQSNNLT

SEQ ID NO: 2827179 - protein, 22 aa, Entamoeba invadens
TNEACTFHLSFTPLCSLKIEDK

SEQ ID NO: 2827180 - protein, 24 aa, Entamoeba invadens
TNEGYAYYLIIPNAILSIEWLIVM

SEQ ID NO: 2827181 - protein, 26 aa, Entamoeba invadens
TNEIRRKLVFLKNLKDIQLKNSQRES

SEQ ID NO: 2827182 - protein, 30 aa, Entamoeba invadens
TNENTPITILLLFALLCILCNTTQPPQSLK

SEQ ID NO: 2827183 - protein, 23 aa, Entamoeba invadens
TNFIQRYIITIPSTVNDVIQLED

SEQ ID NO: 2827184 - protein, 25 aa, Entamoeba invadens
TNFTPFFTFLLVQYLDGLYNKNSSF

SEQ ID NO: 2827185 - protein, 33 aa, Entamoeba invadens
TNFTTSWKDGKAFCALFHYYHPEVIDFEKTKTQ

SEQ ID NO: 2827186 - protein, 26 aa, Entamoeba invadens
TNGIFLLSVGLFIFLEAVERFIQIQV

SEQ ID NO: 2827187 - protein, 22 aa, Entamoeba invadens
TNGIFPLKYCDVQLTPYPTTPS

SEQ ID NO: 2827188 - protein, 17 aa, Entamoeba invadens
TNGIYCISVKELANCLK

SEQ ID NO: 2827189 - protein, 28 aa, Entamoeba invadens
TNGLNHLYLINEKLIRYCPNGLNSVDCK

SEQ ID NO: 2827190 - protein, 20 aa, Entamoeba invadens
TNGNCLTCRAGSGFVGNNKC

SEQ ID NO: 2827191 - protein, 24 aa, Entamoeba invadens
TNGVEWYAQPYLIAESIPSDYSVI

SEQ ID NO: 2827192 - protein, 24 aa, Entamoeba invadens
TNIGKIIHLFLHCKYIDPETATTL

SEQ ID NO: 2827193 - protein, 35 aa, Entamoeba invadens
TNIISSLHWRRIIKKYFAPLQILQLNVPSIITAHK

SEQ ID NO: 2827194 - protein, 20 aa, Entamoeba invadens
TNIPLLTLVTSFSIRENQIS

SEQ ID NO: 2827195 - protein, 20 aa, Entamoeba invadens
TNITYKETLATILKIVMVTT

SEQ ID NO: 2827196 - protein, 43 aa, Entamoeba invadens
TNIVAVVLPIVFVVIFIVLVVVTLALIVFYIRNKKLENKRKEL

SEQ ID NO: 2827197 - protein, 23 aa, Entamoeba invadens
TNKALRLLIIGNKIQFIFYMRQT

SEQ ID NO: 2827198 - protein, 21 aa, Entamoeba invadens
TNKCILCNTGYYLNDDSVCEI

SEQ ID NO: 2827199 - protein, 26 aa, Entamoeba invadens
TNKKTCLECYLVIDYCQLCEYNNGSP

SEQ ID NO: 2827200 - protein, 27 aa, Entamoeba invadens
TNKNTALKCQIGYGFTLGGTCKPCEAG

SEQ ID NO: 2827201 - protein, 24 aa, Entamoeba invadens
TNKQYFFEFHFTPSHRYELTIDPI

SEQ ID NO: 2827202 - protein, 23 aa, Entamoeba invadens
TNKTYFFEFYTDPSHRFDLEIEP

SEQ ID NO: 2827203 - protein, 19 aa, Entamoeba invadens
TNLFAFTAPHCPCTTYDGF

SEQ ID NO: 2827204 - protein, 45 aa, Entamoeba invadens
TNLGAAIGIPMSILLVLIIIVLLIIITLIVILKKNQKKEKLKVCT

SEQ ID NO: 2827205 - protein, 24 aa, Entamoeba invadens
TNLIKALIILYKFDDTTPQTEILK

SEQ ID NO: 2827206 - protein, 19 aa, Entamoeba invadens
TNMIFVKMADGLTIHTRNE

SEQ ID NO: 2827207 - protein, 31 aa, Entamoeba invadens
TNMLFMIVYINIMYALIIYTFSQNCSFPNTI

SEQ ID NO: 2827208 - protein, 18 aa, Entamoeba invadens
TNMTIFNSNFYTVTIENT

SEQ ID NO: 2827209 - protein, 19 aa, Entamoeba invadens
TNMTLLSNNRLIRYCPTTS

SEQ ID NO: 2827210 - protein, 25 aa, Entamoeba invadens
TNNKVPLICKPSYYLFNNTCKLCNE

SEQ ID NO: 2827211 - protein, 21 aa, Entamoeba invadens
TNPQLVTLKKGKAVEFEIFIK

SEQ ID NO: 2827212 - protein, 24 aa, Entamoeba invadens
TNQAPTFPNNWFEQVPLGEVSSMC

SEQ ID NO: 2827213 - protein, 21 aa, Entamoeba invadens
TNQCINFWIGQRYGALAESQN

SEQ ID NO: 2827214 - protein, 26 aa, Entamoeba invadens
TNSIELVLIRAQTLLQIYRISEDSIE

SEQ ID NO: 2827215 - protein, 26 aa, Entamoeba invadens
TNSPKYTFYFEPQVLYIRPRMASTYT

SEQ ID NO: 2827216 - protein, 24 aa, Entamoeba invadens
TNSPPLICPPGYFYVKGECVQSTH

SEQ ID NO: 2827217 - protein, 23 aa, Entamoeba invadens
TNSWKLMVIAFIGIAAIGLNGIS

SEQ ID NO: 2827218 - protein, 24 aa, Entamoeba invadens
TNTGYPQFLWRYSSLSNKVIPHSV

SEQ ID NO: 2827219 - protein, 27 aa, Entamoeba invadens
TNVYFLVNFIICCIPFLSSVIPITAGV

SEQ ID NO: 2827220 - protein, 24 aa, Entamoeba invadens
TNWGTLSMLWLIATQSKYVSSKEI

SEQ ID NO: 2827221 - protein, 20 aa, Entamoeba invadens
TNYCISCKQNYLLYDGKCYP

SEQ ID NO: 2827222 - protein, 40 aa, Entamoeba invadens
TNYGLVVGVPISVTFVIIVFIVAIILIAISMIQKRKQKKK

SEQ ID NO: 2827223 - protein, 17 aa, Entamoeba invadens
TNYGVVFGIPIVSVFII

SEQ ID NO: 2827224 - protein, 43 aa, Entamoeba invadens
TNYGVVIGIPISIFVVLIILIAIIIVVGYLFAMRKKEEKKMIN

SEQ ID NO: 2827225 - protein, 20 aa, Entamoeba invadens
TNYSFVKIPDSPLGVTKTRL

SEQ ID NO: 2827226 - protein, 33 aa, Entamoeba invadens
TNYTAVYVAVIIIFGAVFIATVAAITTFLITMR

SEQ ID NO: 2827227 - protein, 31 aa, Entamoeba invadens
TNYYEYYVITFLFSFLFIQALHYGISNIIYF

SEQ ID NO: 2827228 - protein, 19 aa, Entamoeba invadens
TNYYYYDNLCYRCPDRCKT

SEQ ID NO: 2827229 - protein, 20 aa, Entamoeba invadens
TPAFMAPEILRREKYQTPAD

SEQ ID NO: 2827230 - protein, 25 aa, Entamoeba invadens
TPAYMPPEILLQRRYEKMADVYSFG

SEQ ID NO: 2827231 - protein, 23 aa, Entamoeba invadens
TPAYMPPEVLKQEKYKKSADVYA

SEQ ID NO: 2827232 - protein, 35 aa, Entamoeba invadens
TPCCLQRIKYMRMFFFIIFFWSTSSQVLCSSGCSS

SEQ ID NO: 2827233 - protein, 17 aa, Entamoeba invadens
TPCDSTCKTCDATNGVC

SEQ ID NO: 2827234 - protein, 22 aa, Entamoeba invadens
TPCQGGYYSLIGYSGCVHCDDV

SEQ ID NO: 2827235 - protein, 25 aa, Entamoeba invadens
TPCTLKRWKLYDKELEACWRQIVLL

SEQ ID NO: 2827236 - protein, 26 aa, Entamoeba invadens
TPDKSDFIKMPYKLKVRMLFDTSRGM

SEQ ID NO: 2827237 - protein, 21 aa, Entamoeba invadens
TPDSSVLTFVLFAFAIIAFFF

SEQ ID NO: 2827238 - protein, 23 aa, Entamoeba invadens
TPDTLVKILCDVIRFTIKNCMKT

SEQ ID NO: 2827239 - protein, 22 aa, Entamoeba invadens
TPEIPILNFLKEKVPDKNIFSY

SEQ ID NO: 2827240 - protein, 17 aa, Entamoeba invadens
TPFISNCKYLITVDLKE

SEQ ID NO: 2827241 - protein, 26 aa, Entamoeba invadens
TPFSLYFPSMLQKLSLKSYFFPTNIS

SEQ ID NO: 2827242 - protein, 41 aa, Entamoeba invadens
TPGGFVAGMFFLVLFILVLIVITTFFVTKYILKVLKRRDVE

SEQ ID NO: 2827243 - protein, 39 aa, Entamoeba invadens
TPIAIVCVVGSLAFWVICCSVILIINKFRNPTRVESFPE

SEQ ID NO: 2827244 - protein, 25 aa, Entamoeba invadens
TPIMILCTLIIGFSSVFFTNQNAVF

SEQ ID NO: 2827245 - protein, 25 aa, Entamoeba invadens
TPIYMAPEILFKRKYKTPADIYSFA

SEQ ID NO: 2827246 - protein, 20 aa, Entamoeba invadens
TPIYMAPEILKQQKYKKSAD

SEQ ID NO: 2827247 - protein, 27 aa, Entamoeba invadens
TPKLIHRNIKRPIPIKKTVFALESDEP

SEQ ID NO: 2827248 - protein, 17 aa, Entamoeba invadens
TPKMCTSFYRPPELFLG

SEQ ID NO: 2827249 - protein, 17 aa, Entamoeba invadens
TPKPYTISFYGMTEFPE

SEQ ID NO: 2827250 - protein, 39 aa, Entamoeba invadens
TPKSISWLFIIRICSMLILFVISFIHALVPLCYKLLDTS

SEQ ID NO: 2827251 - protein, 24 aa, Entamoeba invadens
TPKYMAPEILNKQHYKKAADIYSL

SEQ ID NO: 2827252 - protein, 23 aa, Entamoeba invadens
TPKYMAPEILNKQHYKKAADVYS

SEQ ID NO: 2827253 - protein, 24 aa, Entamoeba invadens
TPLHIACLCGYQQITEILLVFGLT

SEQ ID NO: 2827254 - protein, 18 aa, Entamoeba invadens
TPLKDKKLIRYGHSTRIY

SEQ ID NO: 2827255 - protein, 25 aa, Entamoeba invadens
TPLKLFDFDYLRLSSFNLFLIKIIL

SEQ ID NO: 2827256 - protein, 17 aa, Entamoeba invadens
TPMLLYIGDSAFSNCTA

SEQ ID NO: 2827257 - protein, 25 aa, Entamoeba invadens
TPMLYFSFLFLRYDTLGQVFNAIGE

SEQ ID NO: 2827258 - protein, 17 aa, Entamoeba invadens
TPNFVIQIIPTTSELFL

SEQ ID NO: 2827259 - protein, 24 aa, Entamoeba invadens
TPNNPKFIFHFDPQVLFVRPNGKK

SEQ ID NO: 2827260 - protein, 25 aa, Entamoeba invadens
TPNNPKFVFHFDPLVLLVRPNHTTT

SEQ ID NO: 2827261 - protein, 25 aa, Entamoeba invadens
TPNNPKYIFHFDPQIVFVSPKTRKV

SEQ ID NO: 2827262 - protein, 29 aa, Entamoeba invadens
TPNNPKYIFHFEPQVMFLSPHTGMKLETI

SEQ ID NO: 2827263 - protein, 24 aa, Entamoeba invadens
TPNSPKYVFYFDPQVVIIGPHSPM

SEQ ID NO: 2827264 - protein, 20 aa, Entamoeba invadens
TPQKYIWPSALRLFPFVMLV

SEQ ID NO: 2827265 - protein, 17 aa, Entamoeba invadens
TPQQHMWKTILPDSFFS

SEQ ID NO: 2827266 - protein, 38 aa, Entamoeba invadens
TPQTWYGRLFCALYILSFLIYFPLKLGQIFTALNERGQ

SEQ ID NO: 2827267 - protein, 24 aa, Entamoeba invadens
TPRISTVFPLFSNVFYNFAEDAKK

SEQ ID NO: 2827268 - protein, 24 aa, Entamoeba invadens
TPRIVEFIHIIGKIAYGYTGYSVC

SEQ ID NO: 2827269 - protein, 24 aa, Entamoeba invadens
TPRKPTLVPLFNFSVEHQYYTFLI

SEQ ID NO: 2827270 - protein, 18 aa, Entamoeba invadens
TPSCAILKKGEACEFHIE

SEQ ID NO: 2827271 - protein, 51 aa, Entamoeba invadens
TPSDTGLECKKHLPWWLTFIIVLLLIIILITIVFLTLSLTKVITSRLHTYR

SEQ ID NO: 2827272 - protein, 53 aa, Entamoeba invadens
TPSEAGTFCENKAVWWIILLIVVFIVLVLLSTSGLIVYFTKLILNKMHQKIQH

SEQ ID NO: 2827273 - protein, 45 aa, Entamoeba invadens
TPSKNGMYCQEAIIWWVILIIVLFIIFVTIFLVNGIVLASKFIEK

SEQ ID NO: 2827274 - protein, 28 aa, Entamoeba invadens
TPSNTVNIWLIISTGIFCAILVITATTT

SEQ ID NO: 2827275 - protein, 26 aa, Entamoeba invadens
TPSQYPQRIILNFSPHQLPGWSKNST

SEQ ID NO: 2827276 - protein, 24 aa, Entamoeba invadens
TPTKPYAPNQIWSEGLVTAGKEVA

SEQ ID NO: 2827277 - protein, 24 aa, Entamoeba invadens
TPTYMAPEVLKKEKYKKPADVYSF

SEQ ID NO: 2827278 - protein, 17 aa, Entamoeba invadens
TPTYNNEPFLKCSTFIP

SEQ ID NO: 2827279 - protein, 20 aa, Entamoeba invadens
TPVYMAPEILKKDKYKKPAD

SEQ ID NO: 2827280 - protein, 24 aa, Entamoeba invadens
TPVYMAPEILKKDKYKKPADIYSF

SEQ ID NO: 2827281 - protein, 23 aa, Entamoeba invadens
TPVYMAPEILKKEKYKKSADVFS

SEQ ID NO: 2827282 - protein, 20 aa, Entamoeba invadens
TPVYMAPEILNKEKYKKAAD

SEQ ID NO: 2827283 - protein, 18 aa, Entamoeba invadens
TPYLCAEFNLRPASWTTD

SEQ ID NO: 2827284 - protein, 25 aa, Entamoeba invadens
TQCDMCISGFYLNITTYTCEQGNIK

SEQ ID NO: 2827285 - protein, 21 aa, Entamoeba invadens
TQCFDPFILKSGTCSLCPTGQ

SEQ ID NO: 2827286 - protein, 25 aa, Entamoeba invadens
TQCKYGYYPYGRYCYSCGNMYQYIV

SEQ ID NO: 2827287 - protein, 20 aa, Entamoeba invadens
TQCLLCSNGFYSNGPQCVKC

SEQ ID NO: 2827288 - protein, 17 aa, Entamoeba invadens
TQCLSCHNGKFLTNYEC

SEQ ID NO: 2827289 - protein, 19 aa, Entamoeba invadens
TQCYSCVDGYYLSSYECLS

SEQ ID NO: 2827290 - protein, 21 aa, Entamoeba invadens
TQFFSMLFHRMNTLAFILSRT

SEQ ID NO: 2827291 - protein, 23 aa, Entamoeba invadens
TQFIQILIPKLSPWSFHPFSILC

SEQ ID NO: 2827292 - protein, 27 aa, Entamoeba invadens
TQFISSTLLFFSFLSSNALFAQACLQT

SEQ ID NO: 2827293 - protein, 26 aa, Entamoeba invadens
TQFTNVFIIIRPHKLGFRIEIYRNGN

SEQ ID NO: 2827294 - protein, 21 aa, Entamoeba invadens
TQGIVLPTTIPSYAIIISAMQ

SEQ ID NO: 2827295 - protein, 22 aa, Entamoeba invadens
TQGSYVFAFTPAHKAEFVISTC

SEQ ID NO: 2827296 - protein, 32 aa, Entamoeba invadens
TQHTPSFVTLSFYKIFGFPTGIGALLVRKDVI

SEQ ID NO: 2827297 - protein, 19 aa, Entamoeba invadens
TQILILKRHNQFIVEFVLV

SEQ ID NO: 2827298 - protein, 33 aa, Entamoeba invadens
TQIMNGWFDTFNFFNDFVFTRKFDFDPNSVLQP

SEQ ID NO: 2827299 - protein, 21 aa, Entamoeba invadens
TQIPIIQWEFSWHQDLKVKVV

SEQ ID NO: 2827300 - protein, 17 aa, Entamoeba invadens
TQIYYALRPLKFSEKGV

SEQ ID NO: 2827301 - protein, 33 aa, Entamoeba invadens
TQKEWFDGVQYLSLFYHVFLNKALRAKANVITV

SEQ ID NO: 2827302 - protein, 30 aa, Entamoeba invadens
TQKIVLLVFSVLFIIELIFRTPATVFGGLF

SEQ ID NO: 2827303 - protein, 18 aa, Entamoeba invadens
TQLCVLCILLRRKCDKRR

SEQ ID NO: 2827304 - protein, 26 aa, Entamoeba invadens
TQLDVTEFSIVKPLILKNVEVSVVPE

SEQ ID NO: 2827305 - protein, 19 aa, Entamoeba invadens
TQLIMFNRSLFNTPTLEMY

SEQ ID NO: 2827306 - protein, 21 aa, Entamoeba invadens
TQLKSLFPERSLKEKLAKKNG

SEQ ID NO: 2827307 - protein, 20 aa, Entamoeba invadens
TQLRHNCVVELIGAVYTEGE

SEQ ID NO: 2827308 - protein, 20 aa, Entamoeba invadens
TQLRHSCVVELIGAVYTEGE

SEQ ID NO: 2827309 - protein, 19 aa, Entamoeba invadens
TQLRHTCVVELIGAVYTEG

SEQ ID NO: 2827310 - protein, 23 aa, Entamoeba invadens
TQNEFCYLAIQNYYTTVEKFGQT

SEQ ID NO: 2827311 - protein, 22 aa, Entamoeba invadens
TQNPNFLLSFYSDFFHASVKMV

SEQ ID NO: 2827312 - protein, 19 aa, Entamoeba invadens
TQPIYTFQQAIFKTFLTAK

SEQ ID NO: 2827313 - protein, 22 aa, Entamoeba invadens
TQQDLYYMYISGSKKFYPEQNT

SEQ ID NO: 2827314 - protein, 17 aa, Entamoeba invadens
TQRKGFKFLPTPIAVES

SEQ ID NO: 2827315 - protein, 18 aa, Entamoeba invadens
TQRPYFYIEATTLTQDIN

SEQ ID NO: 2827316 - protein, 29 aa, Entamoeba invadens
TQSHIERIWGIHPILLFPPCDFKSEECPK

SEQ ID NO: 2827317 - protein, 24 aa, Entamoeba invadens
TQSILPIYFLLIQQSAALAFFWSP

SEQ ID NO: 2827318 - protein, 30 aa, Entamoeba invadens
TQSTNPSYFIYMYYLYVNITTLNLYRMSRG

SEQ ID NO: 2827319 - protein, 18 aa, Entamoeba invadens
TQTFGFLSNCGTLIFSES

SEQ ID NO: 2827320 - protein, 27 aa, Entamoeba invadens
TQTIKLLMFTELIVNCYLLLSWVYEFI

SEQ ID NO: 2827321 - protein, 26 aa, Entamoeba invadens
TQTISGTIRYLYLPNGIVVQGITTDM

SEQ ID NO: 2827322 - protein, 29 aa, Entamoeba invadens
TQTKLLLVIFFLLLFVQTMFFVLLNRDCQ

SEQ ID NO: 2827323 - protein, 42 aa, Entamoeba invadens
TQVKTWNWWTVFSFVISFLLFILFVLLIAYFPGLSNRDLSRF

SEQ ID NO: 2827324 - protein, 24 aa, Entamoeba invadens
TQVTLFEVAFDLGVSPSLYVLNRT

SEQ ID NO: 2827325 - protein, 23 aa, Entamoeba invadens
TRAVHFCHIPLCSLAAPLMRIFT

SEQ ID NO: 2827326 - protein, 25 aa, Entamoeba invadens
TRCHPYYFLVSPFCISCPKNCMKCS

SEQ ID NO: 2827327 - protein, 22 aa, Entamoeba invadens
TRCKDGYYLNESQSACIRVPNC

SEQ ID NO: 2827328 - protein, 20 aa, Entamoeba invadens
TRDIKWIKCDIQKALLCSEN

SEQ ID NO: 2827329 - protein, 21 aa, Entamoeba invadens
TREKLIFFTLNMFKVEKGQTL

SEQ ID NO: 2827330 - protein, 22 aa, Entamoeba invadens
TRESLYFLFFNSNVLNNTLEKY

SEQ ID NO: 2827331 - protein, 20 aa, Entamoeba invadens
TRFFMPIFHTNKCPLPLDFA

SEQ ID NO: 2827332 - protein, 34 aa, Entamoeba invadens
TRGIYVVTPCTPRIYMKAIFFTLTLNSSYSVLVS

SEQ ID NO: 2827333 - protein, 26 aa, Entamoeba invadens
TRICNECKLPFYPSQSGQNIGQCIEC

SEQ ID NO: 2827334 - protein, 20 aa, Entamoeba invadens
TRIRDLRIPYSVWFAHSKST

SEQ ID NO: 2827335 - protein, 17 aa, Entamoeba invadens
TRKKEVKRILWVIAFRS

SEQ ID NO: 2827336 - protein, 30 aa, Entamoeba invadens
TRKNIQKAFSKYLLPLLIETKNLKFKKFAI

SEQ ID NO: 2827337 - protein, 26 aa, Entamoeba invadens
TRLDWDELFLFQPPIGQGTFGIVFRA

SEQ ID NO: 2827338 - protein, 19 aa, Entamoeba invadens
TRLHVNVYCFLISVVVGVA

SEQ ID NO: 2827339 - protein, 25 aa, Entamoeba invadens
TRLTPFLLFFFTMAILFVFANETYL

SEQ ID NO: 2827340 - protein, 37 aa, Entamoeba invadens
TRMEVFLIHIRRALMLFSHYPFLPKDPIVEIQILIAT

SEQ ID NO: 2827341 - protein, 25 aa, Entamoeba invadens
TRMTRFWTYFGMWSCGLYFAINFLF

SEQ ID NO: 2827342 - protein, 24 aa, Entamoeba invadens
TRNVDVLFEFTSNIRYLFIISDNQ

SEQ ID NO: 2827343 - protein, 20 aa, Entamoeba invadens
TRRDYSFPVDVYSYGIVLYE

SEQ ID NO: 2827344 - protein, 38 aa, Entamoeba invadens
TRRFLKLKFITATNYFVYFRFLWIKLGLENDEGKQIVW

SEQ ID NO: 2827345 - protein, 19 aa, Entamoeba invadens
TRSCLECQKGWYPTQQNDE

SEQ ID NO: 2827346 - protein, 17 aa, Entamoeba invadens
TRTIYGRAVYSGCTRLQ

SEQ ID NO: 2827347 - protein, 31 aa, Entamoeba invadens
TRVKRISLIPIYMLRVFFAKNDTVKCLRKKL

SEQ ID NO: 2827348 - protein, 27 aa, Entamoeba invadens
TRVLLNNIYQSLPVEWRVNFFDKFREV

SEQ ID NO: 2827349 - protein, 17 aa, Entamoeba invadens
TRVVICCMYAVSVLFGI

SEQ ID NO: 2827350 - protein, 23 aa, Entamoeba invadens
TRWKVFLSCLPPQPEAWGLIDTN

SEQ ID NO: 2827351 - protein, 26 aa, Entamoeba invadens
TRWYVTLFVFIGWGLSFSIPLLLPID

SEQ ID NO: 2827352 - protein, 19 aa, Entamoeba invadens
TSACIACDSDFVLIGKRCV

SEQ ID NO: 2827353 - protein, 45 aa, Entamoeba invadens
TSADIYSFSISLTEVLLWDEPYPKAQFKFPWNVATGVVNGLRPNI

SEQ ID NO: 2827354 - protein, 23 aa, Entamoeba invadens
TSAYLDFMVPQQNLYVYTTESHP

SEQ ID NO: 2827355 - protein, 24 aa, Entamoeba invadens
TSCASKYVFIIPPSGVCQKCSEFD

SEQ ID NO: 2827356 - protein, 47 aa, Entamoeba invadens
TSCDKHAVWWIILIIVMFIVLIIIISTVLILYTVYYILEKGKVRDLQ

SEQ ID NO: 2827357 - protein, 48 aa, Entamoeba invadens
TSCDKHAVWWIILIIVMFLVLIIIISTVLILYIVFLILENRKVCDLQK

SEQ ID NO: 2827358 - protein, 44 aa, Entamoeba invadens
TSCESQIVWWVIFVAVMCVLIVFIILIVSLVIVTKNILKKLHIH

SEQ ID NO: 2827359 - protein, 30 aa, Entamoeba invadens
TSCETKAVWWAIIIVVIVSVIIITLSITVI

SEQ ID NO: 2827360 - protein, 44 aa, Entamoeba invadens
TSCHTKVVWWVILIVVIFVIIIITLIVFIVLFVSVQINRHYHIK

SEQ ID NO: 2827361 - protein, 18 aa, Entamoeba invadens
TSCILCDSSYYLFNETCI

SEQ ID NO: 2827362 - protein, 19 aa, Entamoeba invadens
TSCISCKFGYYNDSNGDCV

SEQ ID NO: 2827363 - protein, 20 aa, Entamoeba invadens
TSCISCKFGYYNDSNGDCVP

SEQ ID NO: 2827364 - protein, 21 aa, Entamoeba invadens
TSCKLGYFQNGFFICQNHLPC

SEQ ID NO: 2827365 - protein, 25 aa, Entamoeba invadens
TSCKSGFYLDKLGNCKSLGALQESC

SEQ ID NO: 2827366 - protein, 42 aa, Entamoeba invadens
TSCKTKVVWWVILLCVLFMVFIGVLLITIGIFSMFKILEHRR

SEQ ID NO: 2827367 - protein, 19 aa, Entamoeba invadens
TSCLSCYSGFYKQEKTCIS

SEQ ID NO: 2827368 - protein, 48 aa, Entamoeba invadens
TSCNKKVMWWVILMGVILILIVISIIVLIIYFTISKIQRKLRQKEIEE

SEQ ID NO: 2827369 - protein, 45 aa, Entamoeba invadens
TSCNKKVVWWVILIVIILILIVISIVVLIIYFIVSKIQRKCLQRE

SEQ ID NO: 2827370 - protein, 48 aa, Entamoeba invadens
TSCNVHVVWWVIFISVLFVVIIILTLVILTIIIILKILEHKRHEKERK

SEQ ID NO: 2827371 - protein, 41 aa, Entamoeba invadens
TSCQSKAVWWVILLIVLVILLIIVILTITIGYMINKGLKRV

SEQ ID NO: 2827372 - protein, 47 aa, Entamoeba invadens
TSCRKKVVWWVVFLLVLFVLFVFVTLIFVFIAVVLFLMKKHRENKIR

SEQ ID NO: 2827373 - protein, 19 aa, Entamoeba invadens
TSCSDGYYKNGNVCMKCAA

SEQ ID NO: 2827374 - protein, 49 aa, Entamoeba invadens
TSCSKTNWALIIPLIIVGVIIIIIIFVIIIGIIWWRRVKSVKAETAAIK

SEQ ID NO: 2827375 - protein, 36 aa, Entamoeba invadens
TSCTKKAVWWVLFIIVLFVIVVLTGLILSIVFVVLY

SEQ ID NO: 2827376 - protein, 41 aa, Entamoeba invadens
TSCVKKAVWWVILIIILFIILNIIIVYLKYSKEQQTRYDIS

SEQ ID NO: 2827377 - protein, 19 aa, Entamoeba invadens
TSCYYCKYGYHLNSKGICE

SEQ ID NO: 2827378 - protein, 20 aa, Entamoeba invadens
TSDEYYLFNNVCYHCTSISK

SEQ ID NO: 2827379 - protein, 41 aa, Entamoeba invadens
TSDGDNDLTWLWITLGVIGGLLVIIVIVGAVIGGVYCMNKS

SEQ ID NO: 2827380 - protein, 31 aa, Entamoeba invadens
TSEALFILKLVFLFLVFFSVPLLAFVALLSL

SEQ ID NO: 2827381 - protein, 25 aa, Entamoeba invadens
TSEKYLVYFSTIPPPSSTLHLLSRR

SEQ ID NO: 2827382 - protein, 28 aa, Entamoeba invadens
TSENSILFLLLIYIWESILTARNRTKLE

SEQ ID NO: 2827383 - protein, 27 aa, Entamoeba invadens
TSESQFMYFHFGSGFPMPSHLIMKGVD

SEQ ID NO: 2827384 - protein, 19 aa, Entamoeba invadens
TSFAFLIRLGDDTYGRSLS

SEQ ID NO: 2827385 - protein, 21 aa, Entamoeba invadens
TSFDLLNVVKISNSVFESVAT

SEQ ID NO: 2827386 - protein, 27 aa, Entamoeba invadens
TSFGKGVITIIRSLPKVSFSKKQETAS

SEQ ID NO: 2827387 - protein, 23 aa, Entamoeba invadens
TSFLGWTTTPWTLPSNLALCVNA

SEQ ID NO: 2827388 - protein, 17 aa, Entamoeba invadens
TSFWFKMFCIWYTGEIC

SEQ ID NO: 2827389 - protein, 21 aa, Entamoeba invadens
TSFYAPINFIYIKTDAYCVIG

SEQ ID NO: 2827390 - protein, 17 aa, Entamoeba invadens
TSFYIVGILLSMQVPFI

SEQ ID NO: 2827391 - protein, 25 aa, Entamoeba invadens
TSGGEINWFYSFPGLYKETVPDSVC

SEQ ID NO: 2827392 - protein, 25 aa, Entamoeba invadens
TSGIFVTIFIFKPLMKLTNLRHVFA

SEQ ID NO: 2827393 - protein, 18 aa, Entamoeba invadens
TSGILLLLLSLQCGMTQQ

SEQ ID NO: 2827394 - protein, 18 aa, Entamoeba invadens
TSGKPVDTPIKKCDKCAT

SEQ ID NO: 2827395 - protein, 17 aa, Entamoeba invadens
TSGYYLDAGNCHTCNEF

SEQ ID NO: 2827396 - protein, 23 aa, Entamoeba invadens
TSHAFQFITLLNNDPILPDFVKS

SEQ ID NO: 2827397 - protein, 25 aa, Entamoeba invadens
TSHKKYMLLLIHTPNTPKYVFHFSP

SEQ ID NO: 2827398 - protein, 19 aa, Entamoeba invadens
TSIGIRFIIRKKQLKTMKL

SEQ ID NO: 2827399 - protein, 24 aa, Entamoeba invadens
TSISKFGFPRLLINTAGIAHPGFL

SEQ ID NO: 2827400 - protein, 28 aa, Entamoeba invadens
TSIYTKYLVLTDLLLNILICILYCGETY

SEQ ID NO: 2827401 - protein, 23 aa, Entamoeba invadens
TSKKTLILTDYIFSTVVLNDFNY

SEQ ID NO: 2827402 - protein, 24 aa, Entamoeba invadens
TSKLQLHVLTLIKCLMKLSDISES

SEQ ID NO: 2827403 - protein, 25 aa, Entamoeba invadens
TSKQRLALLWKTFLVQQVTIKEKLG

SEQ ID NO: 2827404 - protein, 29 aa, Entamoeba invadens
TSKRYTMMNLLIIMIFVKSTFSVCPSGTL

SEQ ID NO: 2827405 - protein, 18 aa, Entamoeba invadens
TSLICPMSMYLTKSCQVV

SEQ ID NO: 2827406 - protein, 29 aa, Entamoeba invadens
TSLINFIFGAFFLFIGIILIITTAIRLFE

SEQ ID NO: 2827407 - protein, 29 aa, Entamoeba invadens
TSLKPLLQSYVFKDILLNPPQPSFDNTFF

SEQ ID NO: 2827408 - protein, 17 aa, Entamoeba invadens
TSLMRKDVSWYDEKNHM

SEQ ID NO: 2827409 - protein, 39 aa, Entamoeba invadens
TSLSVTFIVIVIIVVIVLLFTLSYLYNYFGNKKKMQNVC

SEQ ID NO: 2827410 - protein, 29 aa, Entamoeba invadens
TSLTRNILFLLFYIVILRSAAVVLIKFHL

SEQ ID NO: 2827411 - protein, 23 aa, Entamoeba invadens
TSLVENWFFYVKGVYQDNSVLLR

SEQ ID NO: 2827412 - protein, 21 aa, Entamoeba invadens
TSLVLVLTNKYYRSFGGFIEV

SEQ ID NO: 2827413 - protein, 25 aa, Entamoeba invadens
TSMFVLVKIVFFFIEIRLVLCSMVG

SEQ ID NO: 2827414 - protein, 26 aa, Entamoeba invadens
TSMPHSHFVFIIYNFPKLNCHDLERL

SEQ ID NO: 2827415 - protein, 20 aa, Entamoeba invadens
TSMSVCFPFVTLKSVPFSIQ

SEQ ID NO: 2827416 - protein, 20 aa, Entamoeba invadens
TSNFYIYSNLIMNSYSKING

SEQ ID NO: 2827417 - protein, 23 aa, Entamoeba invadens
TSNKVFCHLINMKSDYSEPYCPC

SEQ ID NO: 2827418 - protein, 21 aa, Entamoeba invadens
TSNLLDLLLILLNPQKEKEVS

SEQ ID NO: 2827419 - protein, 27 aa, Entamoeba invadens
TSNMCVGCETGYYPYLGKCETCSTKFC

SEQ ID NO: 2827420 - protein, 21 aa, Entamoeba invadens
TSNVLYDPKRLLGLSLEEIPE

SEQ ID NO: 2827421 - protein, 21 aa, Entamoeba invadens
TSNVYIICKDIKQFKFNCDEN

SEQ ID NO: 2827422 - protein, 38 aa, Entamoeba invadens
TSPEIVGMLFLFLSSLTRPLFGYLVGDLAYMKNIIFSD

SEQ ID NO: 2827423 - protein, 17 aa, Entamoeba invadens
TSPIFFQFLHCVHVLLI

SEQ ID NO: 2827424 - protein, 25 aa, Entamoeba invadens
TSPQTLMIFFWSFCKSLILFVTVLV

SEQ ID NO: 2827425 - protein, 21 aa, Entamoeba invadens
TSPRIIFQNIPGIKRIDLDEE

SEQ ID NO: 2827426 - protein, 22 aa, Entamoeba invadens
TSQFSYISDLFLWHGRTAYKRT

SEQ ID NO: 2827427 - protein, 23 aa, Entamoeba invadens
TSQKTLILTDYIFSTVVLNDFNY

SEQ ID NO: 2827428 - protein, 30 aa, Entamoeba invadens
TSQSVFVTIAYWIVKGLLFHEGKNKQMYQN

SEQ ID NO: 2827429 - protein, 25 aa, Entamoeba invadens
TSQTWEKIIFYIDNVTLITSNQNFI

SEQ ID NO: 2827430 - protein, 23 aa, Entamoeba invadens
TSQVKVLSDWLQKSCLSLVVAYQ

SEQ ID NO: 2827431 - protein, 43 aa, Entamoeba invadens
TSSAFVPLLVIMFIIGIIVLIIILLVVWYFKRRRNSTNATHAD

SEQ ID NO: 2827432 - protein, 31 aa, Entamoeba invadens
TSSEELYVSNLILLKDFYLQKLVEYKDEELI

SEQ ID NO: 2827433 - protein, 18 aa, Entamoeba invadens
TSSHFHFLNPAFEGFFRS

SEQ ID NO: 2827434 - protein, 17 aa, Entamoeba invadens
TSSLRFPRSSLLGIQAS

SEQ ID NO: 2827435 - protein, 34 aa, Entamoeba invadens
TSSNFMEILPDHFSFFLKALERLLIVMQQNTKAV

SEQ ID NO: 2827436 - protein, 24 aa, Entamoeba invadens
TSSPLYEKIFTDIYMFLNDSMEGG

SEQ ID NO: 2827437 - protein, 22 aa, Entamoeba invadens
TSSTIICEKMYFLNFSNTCEKC

SEQ ID NO: 2827438 - protein, 30 aa, Entamoeba invadens
TSSTPTSIYLFPYDFKFEQQLTFYIINVAN

SEQ ID NO: 2827439 - protein, 26 aa, Entamoeba invadens
TSTEGKGLWYKFIGTTALPNKAGYNI

SEQ ID NO: 2827440 - protein, 19 aa, Entamoeba invadens
TSTFDYGILCVLLKSDMNN

SEQ ID NO: 2827441 - protein, 27 aa, Entamoeba invadens
TSTFTTLFANKLDLLVKLQLVYRQNNS

SEQ ID NO: 2827442 - protein, 26 aa, Entamoeba invadens
TSTIDSTFIVSYLFTTSDNISCAHHV

SEQ ID NO: 2827443 - protein, 22 aa, Entamoeba invadens
TSTLKILHILESSPQVKWTYKL

SEQ ID NO: 2827444 - protein, 33 aa, Entamoeba invadens
TSTMLRKLNYDMVFSMLYFPEIQTKFENISHST

SEQ ID NO: 2827445 - protein, 40 aa, Entamoeba invadens
TSTTMMRKLIINVLYPSVKWTFNYAFVPSSFLLEINSTRE

SEQ ID NO: 2827446 - protein, 25 aa, Entamoeba invadens
TSTYTIFELFWRLVFIIFSCLCTIV

SEQ ID NO: 2827447 - protein, 25 aa, Entamoeba invadens
TSVFQLFLVFFFSSQMIPIPPQYDI

SEQ ID NO: 2827448 - protein, 31 aa, Entamoeba invadens
TSVHFYSLLLILFTFAVLISIVIVLAIKATI

SEQ ID NO: 2827449 - protein, 17 aa, Entamoeba invadens
TSVIIIESTSRLYFNCE

SEQ ID NO: 2827450 - protein, 25 aa, Entamoeba invadens
TSVMMGIIAMIQPQLHTYARSVSQN

SEQ ID NO: 2827451 - protein, 26 aa, Entamoeba invadens
TSVVFLISLLIYFIGIVVKFFVERRE

SEQ ID NO: 2827452 - protein, 20 aa, Entamoeba invadens
TSVWWFSFVVSEHTLGVKSV

SEQ ID NO: 2827453 - protein, 29 aa, Entamoeba invadens
TSWTGFPNVFSDLWKPYLEITLRDFEENK

SEQ ID NO: 2827454 - protein, 20 aa, Entamoeba invadens
TSYFGGVFKLALADTSGDNV

SEQ ID NO: 2827455 - protein, 33 aa, Entamoeba invadens
TSYQFERFVQCVKLLPVLILGKANDQIVLFYKE

SEQ ID NO: 2827456 - protein, 21 aa, Entamoeba invadens
TSYQWCVEGLLISISKFDMNT

SEQ ID NO: 2827457 - protein, 21 aa, Entamoeba invadens
TSYTITQVCNIYIALVKTGFT

SEQ ID NO: 2827458 - protein, 43 aa, Entamoeba invadens
TTAAYFFAYMLHSLPFLILYPTIYLAIAYPMLNLRPGFVNWLC

SEQ ID NO: 2827459 - protein, 24 aa, Entamoeba invadens
TTAPIVRLFSLFTIPYSIAHFIVA

SEQ ID NO: 2827460 - protein, 22 aa, Entamoeba invadens
TTASCTPWPPANPKQKIVCPST

SEQ ID NO: 2827461 - protein, 24 aa, Entamoeba invadens
TTCISCLVGMYQPEYNQTSCKKCP

SEQ ID NO: 2827462 - protein, 25 aa, Entamoeba invadens
TTCISCYFGYKISCAKFLSDGGCAI

SEQ ID NO: 2827463 - protein, 19 aa, Entamoeba invadens
TTCLAMMPNYDGCAICKDG

SEQ ID NO: 2827464 - protein, 25 aa, Entamoeba invadens
TTCLSCTAGYYLGSGSCTECAAGCS

SEQ ID NO: 2827465 - protein, 27 aa, Entamoeba invadens
TTCLSCTTGYYLRSGSCTRCETGCSAC

SEQ ID NO: 2827466 - protein, 24 aa, Entamoeba invadens
TTCQLCLNGFSLVNGSCVSLSNCL

SEQ ID NO: 2827467 - protein, 20 aa, Entamoeba invadens
TTCRSCLNAFYLDNGICSTC

SEQ ID NO: 2827468 - protein, 23 aa, Entamoeba invadens
TTCRSCLNAFYLDNGICSTCETI

SEQ ID NO: 2827469 - protein, 24 aa, Entamoeba invadens
TTCTACSDGYYKKDKTCTACFADY

SEQ ID NO: 2827470 - protein, 20 aa, Entamoeba invadens
TTCTYKRDLGCESFSGDKCL

SEQ ID NO: 2827471 - protein, 19 aa, Entamoeba invadens
TTCVSCTAGYYLEGGKCKK

SEQ ID NO: 2827472 - protein, 24 aa, Entamoeba invadens
TTCVSCTVGYYLEGGKCKTCATGC

SEQ ID NO: 2827473 - protein, 18 aa, Entamoeba invadens
TTCYVPHYLFYKVHESSY

SEQ ID NO: 2827474 - protein, 18 aa, Entamoeba invadens
TTDLCKVIIFEDFAFADS

SEQ ID NO: 2827475 - protein, 21 aa, Entamoeba invadens
TTDRGCLLCIAGYYLSHRECQ

SEQ ID NO: 2827476 - protein, 22 aa, Entamoeba invadens
TTDVFGYLFYITSLAMSVCAVV

SEQ ID NO: 2827477 - protein, 27 aa, Entamoeba invadens
TTEDIHPFLSVFALLFAKSYASLPTNV

SEQ ID NO: 2827478 - protein, 23 aa, Entamoeba invadens
TTEYYLENNKCIAKAACGASATG

SEQ ID NO: 2827479 - protein, 17 aa, Entamoeba invadens
TTFGMWCNDKGIVKCFE

SEQ ID NO: 2827480 - protein, 24 aa, Entamoeba invadens
TTFPTTFFFHFNKTVYFNSMELRM

SEQ ID NO: 2827481 - protein, 25 aa, Entamoeba invadens
TTFQQFHLFNFCSIFLQMLRNTTDV

SEQ ID NO: 2827482 - protein, 19 aa, Entamoeba invadens
TTFTLHPTEKVYITHHATV

SEQ ID NO: 2827483 - protein, 18 aa, Entamoeba invadens
TTFYFQQGLNIKSFIIKI

SEQ ID NO: 2827484 - protein, 24 aa, Entamoeba invadens
TTFYQMVLFIFKRQASAFVAMIMC

SEQ ID NO: 2827485 - protein, 24 aa, Entamoeba invadens
TTHDRFLAIFDLKSGDLVKKVFPE

SEQ ID NO: 2827486 - protein, 28 aa, Entamoeba invadens
TTHKIGDFLVINPFTFQLTKDAVYIKVP

SEQ ID NO: 2827487 - protein, 24 aa, Entamoeba invadens
TTIKTIYEAAPLSTLKLSDKWVTS

SEQ ID NO: 2827488 - protein, 17 aa, Entamoeba invadens
TTIPVISWFLPFIGHPA

SEQ ID NO: 2827489 - protein, 32 aa, Entamoeba invadens
TTKDAYGCIGCEDGFFLLDHLCVPCNTSTENC

SEQ ID NO: 2827490 - protein, 25 aa, Entamoeba invadens
TTKFATFLVAYFPLKNDEMTQIKDL

SEQ ID NO: 2827491 - protein, 23 aa, Entamoeba invadens
TTKGMANFFYNDSLYPQLVIEGM

SEQ ID NO: 2827492 - protein, 26 aa, Entamoeba invadens
TTKIAYLIDTLFSPTYHGAPASLRSK

SEQ ID NO: 2827493 - protein, 17 aa, Entamoeba invadens
TTKKLYFLNNGNFEVYN

SEQ ID NO: 2827494 - protein, 25 aa, Entamoeba invadens
TTKKSYFFEILATPSHRYNLEMNPP

SEQ ID NO: 2827495 - protein, 23 aa, Entamoeba invadens
TTKQFYYEILANPSHRYNLQITP

SEQ ID NO: 2827496 - protein, 31 aa, Entamoeba invadens
TTKTAIFIFVFIIMMFVLLLEIWHAGIVIMT

SEQ ID NO: 2827497 - protein, 34 aa, Entamoeba invadens
TTKTFATTWCGPGQYLLIDSCLICLAGTYSYGGT

SEQ ID NO: 2827498 - protein, 24 aa, Entamoeba invadens
TTKTYLFMFTFDVMLTLLLAEIVH

SEQ ID NO: 2827499 - protein, 23 aa, Entamoeba invadens
TTKYAYPLFVSTSSFNGLNSIQC

SEQ ID NO: 2827500 - protein, 45 aa, Entamoeba invadens
TTKYKWWSFVFVFLFNQFKYFINMFFLIVAILACIPQLNAGSPVA

SEQ ID NO: 2827501 - protein, 32 aa, Entamoeba invadens
TTKYNLFTFVPKFMRFYLSQMTNIYFLCNLII

SEQ ID NO: 2827502 - protein, 25 aa, Entamoeba invadens
TTLGNWMWTFFVLLVLMVHFQHCPY

SEQ ID NO: 2827503 - protein, 30 aa, Entamoeba invadens
TTLLFILLTMTLSITCDPGYFYPGVEQAGC

SEQ ID NO: 2827504 - protein, 22 aa, Entamoeba invadens
TTLLTSQIFRIFGSATIIDSEI

SEQ ID NO: 2827505 - protein, 24 aa, Entamoeba invadens
TTLPAELFLGCKKLVVVSTTNGLT

SEQ ID NO: 2827506 - protein, 20 aa, Entamoeba invadens
TTLPFAYIELKNNSTLYLKS

SEQ ID NO: 2827507 - protein, 29 aa, Entamoeba invadens
TTLPLLFSTVLSLLIYLLTCHWNVISEIE

SEQ ID NO: 2827508 - protein, 18 aa, Entamoeba invadens
TTLSVKYLTLLDGTGFQN

SEQ ID NO: 2827509 - protein, 18 aa, Entamoeba invadens
TTLVFKKESPFKLFVSIQ

SEQ ID NO: 2827510 - protein, 26 aa, Entamoeba invadens
TTLYLTKMAKLYFSQRMDFLSVFICF

SEQ ID NO: 2827511 - protein, 18 aa, Entamoeba invadens
TTMAFITASFVLLFKGKY

SEQ ID NO: 2827512 - protein, 24 aa, Entamoeba invadens
TTNGICTNVFWKVFNEPKGLTCID

SEQ ID NO: 2827513 - protein, 22 aa, Entamoeba invadens
TTNIHLSVDRFSIEKLSLLETQ

SEQ ID NO: 2827514 - protein, 23 aa, Entamoeba invadens
TTNKYWDFFTLYIVVAIVAVIVF

SEQ ID NO: 2827515 - protein, 25 aa, Entamoeba invadens
TTNVYIFRFCVISKKFQKLKFTKFS

SEQ ID NO: 2827516 - protein, 24 aa, Entamoeba invadens
TTPKLYHIKITNNHYRYYGKTGGD

SEQ ID NO: 2827517 - protein, 29 aa, Entamoeba invadens
TTPPNRLLEFYFYGTLYARDYLNITIEEY

SEQ ID NO: 2827518 - protein, 26 aa, Entamoeba invadens
TTQKTLTFNVLIIKDLVNINNFITIN

SEQ ID NO: 2827519 - protein, 27 aa, Entamoeba invadens
TTQQVKLITPKKLVFQLFKAEYGIEVD

SEQ ID NO: 2827520 - protein, 22 aa, Entamoeba invadens
TTRGVWFKFTATDTKIFLNSAN

SEQ ID NO: 2827521 - protein, 27 aa, Entamoeba invadens
TTRKCIKCKIGFRPDIYYPNNCIPCNE

SEQ ID NO: 2827522 - protein, 21 aa, Entamoeba invadens
TTRLRDTRIPYTVWFAESKGH

SEQ ID NO: 2827523 - protein, 25 aa, Entamoeba invadens
TTRTGFFLVSKFPLTNTNYFNRLFS

SEQ ID NO: 2827524 - protein, 27 aa, Entamoeba invadens
TTSCGLYFLQNKLLLRYGKSQEIYCHL

SEQ ID NO: 2827525 - protein, 31 aa, Entamoeba invadens
TTSEMYGHTLILPTRYPLLGGWKTSFEVNYH

SEQ ID NO: 2827526 - protein, 20 aa, Entamoeba invadens
TTSIFYYLFELLSLLCVTCV

SEQ ID NO: 2827527 - protein, 22 aa, Entamoeba invadens
TTSIYFKEYIPPSTLPDGPYTY

SEQ ID NO: 2827528 - protein, 23 aa, Entamoeba invadens
TTSLNYCIELISFESLHQFDAFT

SEQ ID NO: 2827529 - protein, 22 aa, Entamoeba invadens
TTSLNYCIELISFESLHQFEAF

SEQ ID NO: 2827530 - protein, 20 aa, Entamoeba invadens
TTSMFPFQFSTGTGYLLSNN

SEQ ID NO: 2827531 - protein, 26 aa, Entamoeba invadens
TTSNPRLIYIYPYSSTSKFMNIQFIK

SEQ ID NO: 2827532 - protein, 26 aa, Entamoeba invadens
TTTCLSCTAGYYLASGSCTECAAGCS

SEQ ID NO: 2827533 - protein, 31 aa, Entamoeba invadens
TTTDPGWFCAYGVTHQFYFTKDYYKSEYKIF

SEQ ID NO: 2827534 - protein, 22 aa, Entamoeba invadens
TTTIFAMKLSNVNFILLRGGIS

SEQ ID NO: 2827535 - protein, 37 aa, Entamoeba invadens
TTTILVTVSIVLLILFIICLVIIGVVTFIHFSRIKKE

SEQ ID NO: 2827536 - protein, 20 aa, Entamoeba invadens
TTTLLAWKYIFPAYGTCSAN

SEQ ID NO: 2827537 - protein, 27 aa, Entamoeba invadens
TTTLNLLRRILPYLIDFDYVALYTQIV

SEQ ID NO: 2827538 - protein, 18 aa, Entamoeba invadens
TTTLPPLRVTLKGSVQFE

SEQ ID NO: 2827539 - protein, 24 aa, Entamoeba invadens
TTTPKLISVYPELLPVVGDVIQLI

SEQ ID NO: 2827540 - protein, 18 aa, Entamoeba invadens
TTTVIYIIIKYKRTKRVP

SEQ ID NO: 2827541 - protein, 20 aa, Entamoeba invadens
TTTYFNINDHKLRTNMDGCI

SEQ ID NO: 2827542 - protein, 46 aa, Entamoeba invadens
TTVEFPIHADFYRYIPEAIIIPFFVFCITVVYLLSDYWKLKVDVEV

SEQ ID NO: 2827543 - protein, 26 aa, Entamoeba invadens
TTVFFHGAIAPTFTKDLDVSVAVYVS

SEQ ID NO: 2827544 - protein, 18 aa, Entamoeba invadens
TTVLLGFIVIVMLIYINY

SEQ ID NO: 2827545 - protein, 24 aa, Entamoeba invadens
TTVPTLPCYIGLHKYSVGTFNVKY

SEQ ID NO: 2827546 - protein, 21 aa, Entamoeba invadens
TTVTICKRYSLKNTKCVECLD

SEQ ID NO: 2827547 - protein, 25 aa, Entamoeba invadens
TTVVLMELLYTYPADKIFGKRSYGV

SEQ ID NO: 2827548 - protein, 20 aa, Entamoeba invadens
TTVYIIIRNIIKQREIIEIE

SEQ ID NO: 2827549 - protein, 20 aa, Entamoeba invadens
TTYCLTCDPQYYLSSTFTCE

SEQ ID NO: 2827550 - protein, 32 aa, Entamoeba invadens
TVAALTLVALLIFLHKIMNLSFCFVSTTLLGF

SEQ ID NO: 2827551 - protein, 26 aa, Entamoeba invadens
TVACNGHWILANLKTSKAKCISKGIN

SEQ ID NO: 2827552 - protein, 33 aa, Entamoeba invadens
TVAFVVILGVLLFVVIFLLKYKKIDINIYKTQQ

SEQ ID NO: 2827553 - protein, 34 aa, Entamoeba invadens
TVALFKEVLNIPAGYSVLFLGGGASLQFLMVAMN

SEQ ID NO: 2827554 - protein, 30 aa, Entamoeba invadens
TVAMTITYSLFPLIVALCCGLGCGAAWMDD

SEQ ID NO: 2827555 - protein, 28 aa, Entamoeba invadens
TVANKIQLSVWLFYKLSDSIKVETMNKT

SEQ ID NO: 2827556 - protein, 27 aa, Entamoeba invadens
TVANPTKQIFVLYFLQHEDSKKNFMFR

SEQ ID NO: 2827557 - protein, 24 aa, Entamoeba invadens
TVCNRGYFLDLSMKCQTLGELAKK

SEQ ID NO: 2827558 - protein, 23 aa, Entamoeba invadens
TVCTACTDGYYKDVDSCTKCAEN

SEQ ID NO: 2827559 - protein, 31 aa, Entamoeba invadens
TVCVFKGFLRIRCILRIKTILIKKYFSEDTK

SEQ ID NO: 2827560 - protein, 21 aa, Entamoeba invadens
TVCVFVFLGALSFLIEVITHK

SEQ ID NO: 2827561 - protein, 29 aa, Entamoeba invadens
TVDILKWFYAFEMLLVVANIVYSCVTVST

SEQ ID NO: 2827562 - protein, 19 aa, Entamoeba invadens
TVDLNFVMPFIDAFCTFSS

SEQ ID NO: 2827563 - protein, 17 aa, Entamoeba invadens
TVDNFDKITIFNTLSFS

SEQ ID NO: 2827564 - protein, 25 aa, Entamoeba invadens
TVDQTYAFVVFNKGLDLAKKTGTST

SEQ ID NO: 2827565 - protein, 22 aa, Entamoeba invadens
TVEDILFLIFKSPFTLQEIKKD

SEQ ID NO: 2827566 - protein, 23 aa, Entamoeba invadens
TVELKVIIQAYTKLKITSNNPLN

SEQ ID NO: 2827567 - protein, 22 aa, Entamoeba invadens
TVESIPFLFLHASYLQNKTPSS

SEQ ID NO: 2827568 - protein, 19 aa, Entamoeba invadens
TVETINVPFYLANETRLSS

SEQ ID NO: 2827569 - protein, 30 aa, Entamoeba invadens
TVFGFNASLLKFLFYTIHSFRFNDELLQQF

SEQ ID NO: 2827570 - protein, 21 aa, Entamoeba invadens
TVFIVLFSRKRGNKTYLITVL

SEQ ID NO: 2827571 - protein, 17 aa, Entamoeba invadens
TVFLTKYPKNMSFTRRM

SEQ ID NO: 2827572 - protein, 21 aa, Entamoeba invadens
TVFMILLWFIGMIGAPAHEKN

SEQ ID NO: 2827573 - protein, 17 aa, Entamoeba invadens
TVFVGMSNAFECEITVT

SEQ ID NO: 2827574 - protein, 19 aa, Entamoeba invadens
TVFYFVLFFVICLVFNTLL

SEQ ID NO: 2827575 - protein, 17 aa, Entamoeba invadens
TVGSIIQLLDNFNFFMK

SEQ ID NO: 2827576 - protein, 27 aa, Entamoeba invadens
TVHNLNIDKLILDFKWINTEFTEIDST

SEQ ID NO: 2827577 - protein, 26 aa, Entamoeba invadens
TVHTLVLKMLYFGLGNMAAGFLQSFC

SEQ ID NO: 2827578 - protein, 19 aa, Entamoeba invadens
TVIAPFTGPFAPAFAAVGA

SEQ ID NO: 2827579 - protein, 21 aa, Entamoeba invadens
TVIDALYYFDIRQSIMTLTVT

SEQ ID NO: 2827580 - protein, 18 aa, Entamoeba invadens
TVIDIVRLLLPDNKQFLK

SEQ ID NO: 2827581 - protein, 27 aa, Entamoeba invadens
TVIILLMILIIIVFIPVGITVAQLSTI

SEQ ID NO: 2827582 - protein, 17 aa, Entamoeba invadens
TVITLGTQIFDGCYRLT

SEQ ID NO: 2827583 - protein, 28 aa, Entamoeba invadens
TVITLLSFSWFLFTLSAALMLGWYFSFF

SEQ ID NO: 2827584 - protein, 37 aa, Entamoeba invadens
TVITLMLELTPLMAFILYLVFILRKDKLEVGTVFATI

SEQ ID NO: 2827585 - protein, 26 aa, Entamoeba invadens
TVITNWFKNRIVLETNLVLPGVLRRQ

SEQ ID NO: 2827586 - protein, 31 aa, Entamoeba invadens
TVIVITVVAAFLLLIAYFYTRPSFTQNEYVP

SEQ ID NO: 2827587 - protein, 27 aa, Entamoeba invadens
TVIVVTQFIVIVFLLTRRKQNNQIESK

SEQ ID NO: 2827588 - protein, 20 aa, Entamoeba invadens
TVKAIFGLIQQFITYRMDSL

SEQ ID NO: 2827589 - protein, 19 aa, Entamoeba invadens
TVKALPLVFSTELPTWIDS

SEQ ID NO: 2827590 - protein, 26 aa, Entamoeba invadens
TVKFIVLFIVSLVFNPVFILSAASIG

SEQ ID NO: 2827591 - protein, 25 aa, Entamoeba invadens
TVKKPTSLVFLIGNEKKRKLKFQFT

SEQ ID NO: 2827592 - protein, 31 aa, Entamoeba invadens
TVKPTMNALWCLLVMLLIGVSSKTCEAGYFQ

SEQ ID NO: 2827593 - protein, 39 aa, Entamoeba invadens
TVKRWNGLLIFGFIVSVTSFFFTYAFLASFTGATRENMS

SEQ ID NO: 2827594 - protein, 17 aa, Entamoeba invadens
TVLLCGELMKQCEPYLS

SEQ ID NO: 2827595 - protein, 18 aa, Entamoeba invadens
TVLNIYTKQPTKLTFNVP

SEQ ID NO: 2827596 - protein, 20 aa, Entamoeba invadens
TVLVKKIAMLFIATSNGMIH

SEQ ID NO: 2827597 - protein, 27 aa, Entamoeba invadens
TVLVLFFVVVCVVVGVLFIIQPDFRCS

SEQ ID NO: 2827598 - protein, 26 aa, Entamoeba invadens
TVLYEGKCIFAIRDCLKYLSVDVCET

SEQ ID NO: 2827599 - protein, 18 aa, Entamoeba invadens
TVLYEYIAALLFTTVFRF

SEQ ID NO: 2827600 - protein, 28 aa, Entamoeba invadens
TVLYPDLYTEMIHFLPSVLHRCLRILQD

SEQ ID NO: 2827601 - protein, 34 aa, Entamoeba invadens
TVMAFTSLITPFQWQHVFIPVLPVSLLTYCSAPM

SEQ ID NO: 2827602 - protein, 32 aa, Entamoeba invadens
TVMSIMLGFVRGFFLVWVLIVVIVVSVNVTRD

SEQ ID NO: 2827603 - protein, 19 aa, Entamoeba invadens
TVMTCEACNKPIIGSAPLE

SEQ ID NO: 2827604 - protein, 36 aa, Entamoeba invadens
TVNEVLNIVFVLSDVLLILIYLVKSIHHKVIKFYTV

SEQ ID NO: 2827605 - protein, 25 aa, Entamoeba invadens
TVNTLKIIPSTLNSYLIATASDINY

SEQ ID NO: 2827606 - protein, 18 aa, Entamoeba invadens
TVNVPLPELKWNKIVPKG

SEQ ID NO: 2827607 - protein, 23 aa, Entamoeba invadens
TVPGTFLRYLPGDGLRITAVTQI

SEQ ID NO: 2827608 - protein, 17 aa, Entamoeba invadens
TVPIIRMIGISLGISLW

SEQ ID NO: 2827609 - protein, 25 aa, Entamoeba invadens
TVPSVFGWCLLYYKASMLIQELHRG

SEQ ID NO: 2827610 - protein, 33 aa, Entamoeba invadens
TVQNLEIPFLVYLLCIWAFYFIDSELTGMSIIK

SEQ ID NO: 2827611 - protein, 32 aa, Entamoeba invadens
TVQTTFKKTYAFRFWLRVLHLVGNLTLIQDNK

SEQ ID NO: 2827612 - protein, 23 aa, Entamoeba invadens
TVSACAVVLFLVQPDYTCNINDN

SEQ ID NO: 2827613 - protein, 18 aa, Entamoeba invadens
TVSFILTAIYFNLCNTNK

SEQ ID NO: 2827614 - protein, 24 aa, Entamoeba invadens
TVSKLLSFTPPDPNDFLRVFLTMF

SEQ ID NO: 2827615 - protein, 31 aa, Entamoeba invadens
TVSQTPLTVPLFTPLLIPKVNMKPSNPVILS

SEQ ID NO: 2827616 - protein, 33 aa, Entamoeba invadens
TVTKLNLIGLTKIFTITSPPTFPIRATNCVLKI

SEQ ID NO: 2827617 - protein, 27 aa, Entamoeba invadens
TVTSLKVFFRLFSKILEETWNIKLAIL

SEQ ID NO: 2827618 - protein, 26 aa, Entamoeba invadens
TVTVYMTLFTTTKIRNLKIPYTVWLS

SEQ ID NO: 2827619 - protein, 20 aa, Entamoeba invadens
TVVLCILLKIQNKNQFVFKF

SEQ ID NO: 2827620 - protein, 21 aa, Entamoeba invadens
TVVLFFVMTLYFTGKKNRVSG

SEQ ID NO: 2827621 - protein, 23 aa, Entamoeba invadens
TVVLLTFLIWENNPLFPYEFLMD

SEQ ID NO: 2827622 - protein, 27 aa, Entamoeba invadens
TVVLVIVVIIVIIGVTICWLRKNKNVA

SEQ ID NO: 2827623 - protein, 26 aa, Entamoeba invadens
TVVSMFWFMWLMLMSQLWQMSTQMVL

SEQ ID NO: 2827624 - protein, 27 aa, Entamoeba invadens
TVYECLGWCNAYPISEFKFPWSIAEFV

SEQ ID NO: 2827625 - protein, 18 aa, Entamoeba invadens
TVYPYKCILCDITCNGQC

SEQ ID NO: 2827626 - protein, 17 aa, Entamoeba invadens
TWEFQMLQPGKTYFYSL

SEQ ID NO: 2827627 - protein, 19 aa, Entamoeba invadens
TWELFKKEASNILFPQIIF

SEQ ID NO: 2827628 - protein, 31 aa, Entamoeba invadens
TWKKSQFFVWFGIVVLIHISFIISTVLGFGG

SEQ ID NO: 2827629 - protein, 19 aa, Entamoeba invadens
TWLLAFICAPSFLFCVLTL

SEQ ID NO: 2827630 - protein, 31 aa, Entamoeba invadens
TWQTTKIIDWTTAFFPLTNYTKTLSFLEEPD

SEQ ID NO: 2827631 - protein, 38 aa, Entamoeba invadens
TYANYVFKCLFNQFKYFYNLYFLVTALSQFIPILQVGY

SEQ ID NO: 2827632 - protein, 19 aa, Entamoeba invadens
TYARPMKITFNTLGLYQKV

SEQ ID NO: 2827633 - protein, 24 aa, Entamoeba invadens
TYCFECSMGYFRYDYNICLKCSEG

SEQ ID NO: 2827634 - protein, 54 aa, Entamoeba invadens
TYCHSKAVWWVIIISFLFIIFIITLLIGLTVLLTKKIMLIIHHKNIEKVTAVFE

SEQ ID NO: 2827635 - protein, 18 aa, Entamoeba invadens
TYCISCHSRYFLDLFMKC

SEQ ID NO: 2827636 - protein, 20 aa, Entamoeba invadens
TYCISCKNGYYLSSSKTCES

SEQ ID NO: 2827637 - protein, 18 aa, Entamoeba invadens
TYCISCNSGYFLDSSMKC

SEQ ID NO: 2827638 - protein, 38 aa, Entamoeba invadens
TYCKTQVVWWIIVIIVLFIICIFIVTTLVIVLIAKHVS

SEQ ID NO: 2827639 - protein, 48 aa, Entamoeba invadens
TYCLKKAEWWVITLIVIVVLFFIVIICILLYYFTVHVVKAIHLKKIQK

SEQ ID NO: 2827640 - protein, 26 aa, Entamoeba invadens
TYCLSCRPILEFLNKDNKCELTEDFF

SEQ ID NO: 2827641 - protein, 20 aa, Entamoeba invadens
TYCLSCSRGYYLDSKKTCQS

SEQ ID NO: 2827642 - protein, 19 aa, Entamoeba invadens
TYCLTCDPQYYLSSTFTCE

SEQ ID NO: 2827643 - protein, 46 aa, Entamoeba invadens
TYCTKKAVWWVIVLCLLVFLVLSIALLILVYLSFGWMYAKRVEKKQ

SEQ ID NO: 2827644 - protein, 23 aa, Entamoeba invadens
TYCTQCDLGFYLDGTGSCTTKDV

SEQ ID NO: 2827645 - protein, 18 aa, Entamoeba invadens
TYCTSCESGYYLDSKNRC

SEQ ID NO: 2827646 - protein, 18 aa, Entamoeba invadens
TYCTSCKSGFYIDSTNKC

SEQ ID NO: 2827647 - protein, 28 aa, Entamoeba invadens
TYCTSCKSGFYLDKLGNCKSLGALQESC

SEQ ID NO: 2827648 - protein, 19 aa, Entamoeba invadens
TYCTSCQPGYYLSSTFTCE

SEQ ID NO: 2827649 - protein, 19 aa, Entamoeba invadens
TYCTSCQSGFYLDSKNRCQ

SEQ ID NO: 2827650 - protein, 17 aa, Entamoeba invadens
TYCYACDKGYYTISNNT

SEQ ID NO: 2827651 - protein, 18 aa, Entamoeba invadens
TYDEINCGLFTYTCKRCE

SEQ ID NO: 2827652 - protein, 48 aa, Entamoeba invadens
TYEDQYVIWGFFIFTTVGIYFSLVLKWRELWEMVRYRRIVWEWRTFHF

SEQ ID NO: 2827653 - protein, 17 aa, Entamoeba invadens
TYFLNYNSTVRTLSLYP

SEQ ID NO: 2827654 - protein, 27 aa, Entamoeba invadens
TYFVMPFVWLYMLARCYLFVQFVAYFF

SEQ ID NO: 2827655 - protein, 23 aa, Entamoeba invadens
TYFYIFTDVQKYLPFPVCIGLCV

SEQ ID NO: 2827656 - protein, 20 aa, Entamoeba invadens
TYGCLQCESGRYFSASLECL

SEQ ID NO: 2827657 - protein, 20 aa, Entamoeba invadens
TYGCLQCKTGYFFDSNLECA

SEQ ID NO: 2827658 - protein, 20 aa, Entamoeba invadens
TYGIFPEKPFFVYNLIEELD

SEQ ID NO: 2827659 - protein, 18 aa, Entamoeba invadens
TYGIKYLHENGILHRDIK

SEQ ID NO: 2827660 - protein, 25 aa, Entamoeba invadens
TYGTTIPSGYLKRCNDNWKYNESTG

SEQ ID NO: 2827661 - protein, 36 aa, Entamoeba invadens
TYHINQYWCNTCNSGYFPYYYNCVPCGYMEGCTSCN

SEQ ID NO: 2827662 - protein, 21 aa, Entamoeba invadens
TYHSWRYISLTGNSSLIPPVD

SEQ ID NO: 2827663 - protein, 24 aa, Entamoeba invadens
TYIHLHRHYNGRLDFQILNPISGA

SEQ ID NO: 2827664 - protein, 18 aa, Entamoeba invadens
TYIIPRIKDYINIQMVSF

SEQ ID NO: 2827665 - protein, 22 aa, Entamoeba invadens
TYIPQVSMVIQFFILGSLGEYL

SEQ ID NO: 2827666 - protein, 19 aa, Entamoeba invadens
TYKLPYDKYVKARKWRDGD

SEQ ID NO: 2827667 - protein, 26 aa, Entamoeba invadens
TYLILPILCSIIAIALILLAVPIFAI

SEQ ID NO: 2827668 - protein, 26 aa, Entamoeba invadens
TYLITVLICFWFSFALNEFLTNIFKL

SEQ ID NO: 2827669 - protein, 19 aa, Entamoeba invadens
TYLPLTHQPFCLAILAFCF

SEQ ID NO: 2827670 - protein, 19 aa, Entamoeba invadens
TYLPRPFHQYPFKTTMALS

SEQ ID NO: 2827671 - protein, 27 aa, Entamoeba invadens
TYMSQYLTFKIQPFQETIPFETFWNTL

SEQ ID NO: 2827672 - protein, 19 aa, Entamoeba invadens
TYMTIFPLLMIASVGKGGF

SEQ ID NO: 2827673 - protein, 18 aa, Entamoeba invadens
TYPLIKYRKTGTKYVIYF

SEQ ID NO: 2827674 - protein, 31 aa, Entamoeba invadens
TYQKKASRKLLFILLIVGAVFIVLAVIVAII

SEQ ID NO: 2827675 - protein, 17 aa, Entamoeba invadens
TYRVMFTPNVKLNNSRK

SEQ ID NO: 2827676 - protein, 23 aa, Entamoeba invadens
TYSLFMMVFCFFREKGSDLKDKR

SEQ ID NO: 2827677 - protein, 25 aa, Entamoeba invadens
TYVEQYFYVYFAFSILFGILDRKIY

SEQ ID NO: 2827678 - protein, 23 aa, Entamoeba invadens
TYVPQVLKVIQFFVLGSLTDYLR

SEQ ID NO: 2827679 - protein, 23 aa, Entamoeba invadens
TYYDEPPIWLLIASFVLIGMVGT

SEQ ID NO: 2827680 - protein, 19 aa, Entamoeba invadens
TYYIYTTNGTYYLSTRSDC

SEQ ID NO: 2827681 - protein, 36 aa, Entamoeba invadens
TYYTNQYWCSQCNPGYFPYYYNCVPCGYMDGCTSCS

SEQ ID NO: 2827682 - protein, 17 aa, Entamoeba invadens
VAAFVTGFSLGFTKSWD

SEQ ID NO: 2827683 - protein, 23 aa, Entamoeba invadens
VAALVIGLVIIGITIKKTYDVVR

SEQ ID NO: 2827684 - protein, 32 aa, Entamoeba invadens
VAAVVVLCIIIIALSLVLYFGFGRKKIDMNVF

SEQ ID NO: 2827685 - protein, 24 aa, Entamoeba invadens
VACAIWFFILACLSFFMTGIFGLI

SEQ ID NO: 2827686 - protein, 48 aa, Entamoeba invadens
VACERKLSVWWVILVAVLFLLIVLFVLILLIVILTKIIFNKYHSHEIV

SEQ ID NO: 2827687 - protein, 37 aa, Entamoeba invadens
VACLVNLQFILFLQLPFVFAFPWINAVVVYVLAFVVS

SEQ ID NO: 2827688 - protein, 21 aa, Entamoeba invadens
VACSQGFFLHDTKCDLCDTLT

SEQ ID NO: 2827689 - protein, 25 aa, Entamoeba invadens
VACTLNIVPYWRSLVLWKQNRNKKF

SEQ ID NO: 2827690 - protein, 37 aa, Entamoeba invadens
VADDSWRLLFKTESLRLKKFPDYYPLYQDALLEQTAS

SEQ ID NO: 2827691 - protein, 21 aa, Entamoeba invadens
VADYYIERLVFNTISVDKYID

SEQ ID NO: 2827692 - protein, 20 aa, Entamoeba invadens
VAFGFPTVCKNAVECPSETL

SEQ ID NO: 2827693 - protein, 29 aa, Entamoeba invadens
VAFQTSDTLLWYVLHSRYTKWIIHQSVAT

SEQ ID NO: 2827694 - protein, 26 aa, Entamoeba invadens
VAGFLQTFCFFVLSQRQGIKIRTLYF

SEQ ID NO: 2827695 - protein, 22 aa, Entamoeba invadens
VAGIILYFVIGISLNIFVFKRN

SEQ ID NO: 2827696 - protein, 25 aa, Entamoeba invadens
VAHFEFNSIFFLRPNSKVMAQNDSM

SEQ ID NO: 2827697 - protein, 18 aa, Entamoeba invadens
VAINIFVSRIISHFFRKS

SEQ ID NO: 2827698 - protein, 26 aa, Entamoeba invadens
VAIVLNFVLLNLLLVSVSASVLIGSV

SEQ ID NO: 2827699 - protein, 30 aa, Entamoeba invadens
VAKKRIVIDSLPIYLIVHLNRFTEVAGSWS

SEQ ID NO: 2827700 - protein, 17 aa, Entamoeba invadens
VAKTQRDLIPRLKDFFN

SEQ ID NO: 2827701 - protein, 24 aa, Entamoeba invadens
VALAQILLPLLSLNISNDILVGIT

SEQ ID NO: 2827702 - protein, 19 aa, Entamoeba invadens
VALQFLHHNQIIHRDIKGE

SEQ ID NO: 2827703 - protein, 36 aa, Entamoeba invadens
VALSVVALFIILTIILLIYYFSRLINKVSPSESQSY

SEQ ID NO: 2827704 - protein, 27 aa, Entamoeba invadens
VALVVAFVVILVFVVVYFVRRNKNYGT

SEQ ID NO: 2827705 - protein, 17 aa, Entamoeba invadens
VALVVALVAVSIGVFKT

SEQ ID NO: 2827706 - protein, 19 aa, Entamoeba invadens
VAMKLPQPLTIEKHDLLIP

SEQ ID NO: 2827707 - protein, 29 aa, Entamoeba invadens
VAMKNYRIVFYLFQPSLPTLQQVLIPLTR

SEQ ID NO: 2827708 - protein, 28 aa, Entamoeba invadens
VAMLAKFVSPYVIRFYGACFIPNKICMV

SEQ ID NO: 2827709 - protein, 29 aa, Entamoeba invadens
VAMLDKFRNAYIVHFYGAVFVPTKICIVT

SEQ ID NO: 2827710 - protein, 21 aa, Entamoeba invadens
VAMLTFFFFLKTAINVLIYHL

SEQ ID NO: 2827711 - protein, 21 aa, Entamoeba invadens
VAMNPLSTWLPTDEFFDILHL

SEQ ID NO: 2827712 - protein, 25 aa, Entamoeba invadens
VAMVFYILCYIPPISLTIWSYYRTV

SEQ ID NO: 2827713 - protein, 19 aa, Entamoeba invadens
VAPGWFYFCPTSLLLWLFT

SEQ ID NO: 2827714 - protein, 19 aa, Entamoeba invadens
VAPVQLFPSPKFFFEWMNY

SEQ ID NO: 2827715 - protein, 19 aa, Entamoeba invadens
VAQCLSCRFGSILHLNDKT

SEQ ID NO: 2827716 - protein, 32 aa, Entamoeba invadens
VAQVDSTYFFSQYYNVITFYKTTNPQQPYVKC

SEQ ID NO: 2827717 - protein, 25 aa, Entamoeba invadens
VASFIACLCLFVFQPTFKCDVSTPM

SEQ ID NO: 2827718 - protein, 19 aa, Entamoeba invadens
VASLSFFVVCDVLYPIMGV

SEQ ID NO: 2827719 - protein, 34 aa, Entamoeba invadens
VASVIVVLLLVVAIVLIIVFVRKSSKKSKYSSLD

SEQ ID NO: 2827720 - protein, 25 aa, Entamoeba invadens
VATLDKVLIFFNTYASPILLHTITF

SEQ ID NO: 2827721 - protein, 28 aa, Entamoeba invadens
VATMIGSFVLFIPLYLIQAKSCKKTEKV

SEQ ID NO: 2827722 - protein, 29 aa, Entamoeba invadens
VATNWARYVMLIQTALFKWLYSEVGGDTV

SEQ ID NO: 2827723 - protein, 24 aa, Entamoeba invadens
VATVRFNLYAIPLEDISYEYFKLE

SEQ ID NO: 2827724 - protein, 23 aa, Entamoeba invadens
VATVVAVLLITFLNDDRYSDGSQ

SEQ ID NO: 2827725 - protein, 35 aa, Entamoeba invadens
VAVGFIFFSIIIPSVFGYAIWRPLTLIHAFTPTAS

SEQ ID NO: 2827726 - protein, 23 aa, Entamoeba invadens
VAVTKFRCYMAYFSTIGIAVINN

SEQ ID NO: 2827727 - protein, 29 aa, Entamoeba invadens
VAVVLNFVLLNLFLVSISASVLMGSVLQI

SEQ ID NO: 2827728 - protein, 17 aa, Entamoeba invadens
VAWIVFSIFLIVMAFFR

SEQ ID NO: 2827729 - protein, 22 aa, Entamoeba invadens
VCAAGYCDDGFKWDFYNQECVV

SEQ ID NO: 2827730 - protein, 34 aa, Entamoeba invadens
VCANVTIPVFLWIVTFIVLVIILSVVNVIIWMIK

SEQ ID NO: 2827731 - protein, 19 aa, Entamoeba invadens
VCAPTKLMKGLYFTIETNS

SEQ ID NO: 2827732 - protein, 21 aa, Entamoeba invadens
VCCPIYDKFLYDIVDHPFYKY

SEQ ID NO: 2827733 - protein, 26 aa, Entamoeba invadens
VCDANRWETLRLLIWRVSRGFAIVRS

SEQ ID NO: 2827734 - protein, 17 aa, Entamoeba invadens
VCDTCEPGYYLLNNLCD

SEQ ID NO: 2827735 - protein, 17 aa, Entamoeba invadens
VCEDSEFDFYLANDTYS

SEQ ID NO: 2827736 - protein, 21 aa, Entamoeba invadens
VCEHALPIQKLPFAKTVNVVE

SEQ ID NO: 2827737 - protein, 18 aa, Entamoeba invadens
VCEYTKGLKRMAICSKYT

SEQ ID NO: 2827738 - protein, 19 aa, Entamoeba invadens
VCFFFMAFFESIVLDNVPY

SEQ ID NO: 2827739 - protein, 34 aa, Entamoeba invadens
VCFIVVLGAIMVLPLYPMFEKAPQMVLYPSQMNY

SEQ ID NO: 2827740 - protein, 17 aa, Entamoeba invadens
VCFLCDPLYYNRFGCIP

SEQ ID NO: 2827741 - protein, 36 aa, Entamoeba invadens
VCFQQRFLATFLVYQTLHLVLFHKGDIRVMASLVLL

SEQ ID NO: 2827742 - protein, 23 aa, Entamoeba invadens
VCGIFLVMFLIWNENGDWYGIAI

SEQ ID NO: 2827743 - protein, 18 aa, Entamoeba invadens
VCGILIGILVLTEFRYYL

SEQ ID NO: 2827744 - protein, 20 aa, Entamoeba invadens
VCGKCKAGFSQKNNLCYPPL

SEQ ID NO: 2827745 - protein, 19 aa, Entamoeba invadens
VCIHCEYGYYAFNGRCQQC

SEQ ID NO: 2827746 - protein, 19 aa, Entamoeba invadens
VCIPSFIRYYRLKQIIPPS

SEQ ID NO: 2827747 - protein, 17 aa, Entamoeba invadens
VCITCENGYMFSNKKCV

SEQ ID NO: 2827748 - protein, 27 aa, Entamoeba invadens
VCKKFCCILDRFRYNPIPISSKRLFPY

SEQ ID NO: 2827749 - protein, 24 aa, Entamoeba invadens
VCKKLHEVLVFNVDIWKNFYTIYY

SEQ ID NO: 2827750 - protein, 19 aa, Entamoeba invadens
VCKTGYLLEQVTLKCVNEC

SEQ ID NO: 2827751 - protein, 17 aa, Entamoeba invadens
VCLDFREGKEEVNFIKL

SEQ ID NO: 2827752 - protein, 17 aa, Entamoeba invadens
VCLLCHPGYQINITTRN

SEQ ID NO: 2827753 - protein, 27 aa, Entamoeba invadens
VCLTQIGVFVFVLFSGNFVIFADFISA

SEQ ID NO: 2827754 - protein, 22 aa, Entamoeba invadens
VCMSCPAGHYFYLNECLDCPDN

SEQ ID NO: 2827755 - protein, 17 aa, Entamoeba invadens
VCNMKYIYGWYSEQCST

SEQ ID NO: 2827756 - protein, 20 aa, Entamoeba invadens
VCNQCLSNYPYYYDNNCHQC

SEQ ID NO: 2827757 - protein, 18 aa, Entamoeba invadens
VCPTLFFLIVEIITMFKP

SEQ ID NO: 2827758 - protein, 24 aa, Entamoeba invadens
VCQECELNYFLSEDKTKCIQCEKN

SEQ ID NO: 2827759 - protein, 17 aa, Entamoeba invadens
VCQSCMGGYKLVNGECF

SEQ ID NO: 2827760 - protein, 18 aa, Entamoeba invadens
VCRKCMTGYFLDGTECKL

SEQ ID NO: 2827761 - protein, 18 aa, Entamoeba invadens
VCSYYLVIVVVFSIIVFL

SEQ ID NO: 2827762 - protein, 17 aa, Entamoeba invadens
VCTACYSPYAFDSQTNF

SEQ ID NO: 2827763 - protein, 25 aa, Entamoeba invadens
VCTCLSIIMTWLRYTNKLDMGSGII

SEQ ID NO: 2827764 - protein, 23 aa, Entamoeba invadens
VCTKCPVGYFGVGGILTCQKCGV

SEQ ID NO: 2827765 - protein, 17 aa, Entamoeba invadens
VCTSCKFGYYLENTQCY

SEQ ID NO: 2827766 - protein, 18 aa, Entamoeba invadens
VCTSISLNFCFCGMSEIS

SEQ ID NO: 2827767 - protein, 17 aa, Entamoeba invadens
VCVLCEDSLILKGEKCI

SEQ ID NO: 2827768 - protein, 19 aa, Entamoeba invadens
VCYLCPNGFYTSKTGSSIC

SEQ ID NO: 2827769 - protein, 22 aa, Entamoeba invadens
VCYSGWSDIKWLPVYFADEESD

SEQ ID NO: 2827770 - protein, 24 aa, Entamoeba invadens
VDAEDFLYKIISPSTNYEKANVAR

SEQ ID NO: 2827771 - protein, 27 aa, Entamoeba invadens
VDAEFYPDFIHFLPLVMKRVVNILEER

SEQ ID NO: 2827772 - protein, 26 aa, Entamoeba invadens
VDAIQPMSFYLITPIQRIPRYELLIR

SEQ ID NO: 2827773 - protein, 29 aa, Entamoeba invadens
VDASHTYPSLFFLINPFSGTGKGVSIFKG

SEQ ID NO: 2827774 - protein, 18 aa, Entamoeba invadens
VDAYVTFLSLHWLSDEWV

SEQ ID NO: 2827775 - protein, 27 aa, Entamoeba invadens
VDCVYNTELFLINFPSCFLVNFTSSKT

SEQ ID NO: 2827776 - protein, 21 aa, Entamoeba invadens
VDDKRFRVARYPNYEYTDTSH

SEQ ID NO: 2827777 - protein, 48 aa, Entamoeba invadens
VDDKTLFLKVGVPILVIFFVIIFGTISVILLLIYLHQRQKTKKEEAKV

SEQ ID NO: 2827778 - protein, 18 aa, Entamoeba invadens
VDDNLLIVNVPRVRTIVI

SEQ ID NO: 2827779 - protein, 17 aa, Entamoeba invadens
VDEAYQCDSCVTGYYLD

SEQ ID NO: 2827780 - protein, 30 aa, Entamoeba invadens
VDFEMTRIVPLFLAVYIFVDSPCKALNLYV

SEQ ID NO: 2827781 - protein, 20 aa, Entamoeba invadens
VDFTKYFVFSSNTLGFSRKK

SEQ ID NO: 2827782 - protein, 22 aa, Entamoeba invadens
VDGDPLLTCAYLEAIKTSSEAE

SEQ ID NO: 2827783 - protein, 24 aa, Entamoeba invadens
VDGKKFFPIGAYMNDLNQFDIDHF

SEQ ID NO: 2827784 - protein, 23 aa, Entamoeba invadens
VDGKLIIHLKPVDVFIIKFESSA

SEQ ID NO: 2827785 - protein, 24 aa, Entamoeba invadens
VDGTSHSFMFFVQDANYLIEGCGL

SEQ ID NO: 2827786 - protein, 19 aa, Entamoeba invadens
VDINLFTLTKIVLVVSETI

SEQ ID NO: 2827787 - protein, 27 aa, Entamoeba invadens
VDIRMKLRVKMMLDCSKGILYLHSNDI

SEQ ID NO: 2827788 - protein, 24 aa, Entamoeba invadens
VDITKLILESFLMKFDPKKGDEYK

SEQ ID NO: 2827789 - protein, 21 aa, Entamoeba invadens
VDIYEVICDCWKQYSSKRLTT

SEQ ID NO: 2827790 - protein, 26 aa, Entamoeba invadens
VDKCKTYMVRINKTCTLNCPSNMGPN

SEQ ID NO: 2827791 - protein, 27 aa, Entamoeba invadens
VDKDKRTFVDGKLYFPLGSYMNSITDL

SEQ ID NO: 2827792 - protein, 23 aa, Entamoeba invadens
VDKKALCILNLLHVTVKLSETRK

SEQ ID NO: 2827793 - protein, 23 aa, Entamoeba invadens
VDKLHRLLLSHILLGITAALFGL

SEQ ID NO: 2827794 - protein, 29 aa, Entamoeba invadens
VDKSKTGVLYALIRLPLGTSLDMQIDIID

SEQ ID NO: 2827795 - protein, 23 aa, Entamoeba invadens
VDKTKIYHSYNCKTKVVVTDITD

SEQ ID NO: 2827796 - protein, 21 aa, Entamoeba invadens
VDLCNQVCLKLVYIGVGLFFS

SEQ ID NO: 2827797 - protein, 24 aa, Entamoeba invadens
VDLIKILHDFRITISPLGCTDTDI

SEQ ID NO: 2827798 - protein, 28 aa, Entamoeba invadens
VDLINVKIPTLVFTPTFVYGTCLTSIVG

SEQ ID NO: 2827799 - protein, 17 aa, Entamoeba invadens
VDLLLPTTLNGNDILRF

SEQ ID NO: 2827800 - protein, 25 aa, Entamoeba invadens
VDLTWKALPTQVIGLYFTPIESQLK

SEQ ID NO: 2827801 - protein, 25 aa, Entamoeba invadens
VDMKLRVKMLLDAAKGILYLHENGI

SEQ ID NO: 2827802 - protein, 28 aa, Entamoeba invadens
VDNAVTKLIFNKFYLNKDFTIPEKTQVT

SEQ ID NO: 2827803 - protein, 22 aa, Entamoeba invadens
VDNPLFFFNNTRMYLKDSKAGF

SEQ ID NO: 2827804 - protein, 48 aa, Entamoeba invadens
VDQINLPLVIALPISLVFVIVLVTIALFLLWYFIRQHNKRVEEMKKIC

SEQ ID NO: 2827805 - protein, 48 aa, Entamoeba invadens
VDQPNYILIISVTVVSIFIVIVIPLTSTLIVYLIKLNHKKNKEKKKVC

SEQ ID NO: 2827806 - protein, 24 aa, Entamoeba invadens
VDRKWWLCELKRWGSLHFLSQFFI

SEQ ID NO: 2827807 - protein, 29 aa, Entamoeba invadens
VDRYTSPWKDQFPEWALLPKTSEELMKEE

SEQ ID NO: 2827808 - protein, 29 aa, Entamoeba invadens
VDSESYLMAILHTFYLRSALKVVIDVVMR

SEQ ID NO: 2827809 - protein, 25 aa, Entamoeba invadens
VDSFLCLITFVLVYFYIFDNNVNGQ

SEQ ID NO: 2827810 - protein, 23 aa, Entamoeba invadens
VDSKYEPLPFDSFTRISRIAITD

SEQ ID NO: 2827811 - protein, 17 aa, Entamoeba invadens
VDSLKIVLKSKAAFHGY

SEQ ID NO: 2827812 - protein, 20 aa, Entamoeba invadens
VDSNGYIIHCKEGCLTCANS

SEQ ID NO: 2827813 - protein, 31 aa, Entamoeba invadens
VDSNMYETVWKKMFDILYIYNGNVMTDISLI

SEQ ID NO: 2827814 - protein, 23 aa, Entamoeba invadens
VDSSVCILFNNKLKILECSKDLV

SEQ ID NO: 2827815 - protein, 26 aa, Entamoeba invadens
VDTCVFCPIGYYCPLDGIKIPCNPGN

SEQ ID NO: 2827816 - protein, 19 aa, Entamoeba invadens
VDTQCLHFTKVKFCVSALN

SEQ ID NO: 2827817 - protein, 25 aa, Entamoeba invadens
VDVEPAYIPTLFHLVIDAIVCRRML

SEQ ID NO: 2827818 - protein, 23 aa, Entamoeba invadens
VDVQFTITLKCSCKQYPPINVVS

SEQ ID NO: 2827819 - protein, 25 aa, Entamoeba invadens
VDWTSPIFFQIFVKGVTHTFYDENI

SEQ ID NO: 2827820 - protein, 23 aa, Entamoeba invadens
VDYGDTRSVMWATQNLVRAYDVF

SEQ ID NO: 2827821 - protein, 21 aa, Entamoeba invadens
VDYLEKCATCYLFFVTKRQLE

SEQ ID NO: 2827822 - protein, 20 aa, Entamoeba invadens
VDYLGVLPVLLESLKQIRRN

SEQ ID NO: 2827823 - protein, 19 aa, Entamoeba invadens
VDYLGVVPYIVEALKTIHQ

SEQ ID NO: 2827824 - protein, 18 aa, Entamoeba invadens
VDYQLASVKPILSDYIKL

SEQ ID NO: 2827825 - protein, 31 aa, Entamoeba invadens
VDYSFCYFRQKFRLGQWFKIDLSKVTKDYVM

SEQ ID NO: 2827826 - protein, 24 aa, Entamoeba invadens
VDYTSFFKKLLSGNGALFGTSPDV

SEQ ID NO: 2827827 - protein, 37 aa, Entamoeba invadens
VDYVYIIREVLVDLVFFLPIIAFVLYVFGAFCKCYKC

SEQ ID NO: 2827828 - protein, 26 aa, Entamoeba invadens
VEALWSVLYVPLAKERLYIPLGVNNT

SEQ ID NO: 2827829 - protein, 23 aa, Entamoeba invadens
VEAMVYLWYNFDGLITGITKLPE

SEQ ID NO: 2827830 - protein, 27 aa, Entamoeba invadens
VECNNEWVFLNFFKAKVVVLEQLDATT

SEQ ID NO: 2827831 - protein, 25 aa, Entamoeba invadens
VECTEPYPMLWYKMKGDGKYYVAHT

SEQ ID NO: 2827832 - protein, 24 aa, Entamoeba invadens
VECVECYPPYFWDSIGKTCKLCID

SEQ ID NO: 2827833 - protein, 19 aa, Entamoeba invadens
VEDEIFYVMLTLSTRNSVI

SEQ ID NO: 2827834 - protein, 18 aa, Entamoeba invadens
VEDFLDICEKHNLNFNYH

SEQ ID NO: 2827835 - protein, 20 aa, Entamoeba invadens
VEDIVFLCLNLSKGIQTKES

SEQ ID NO: 2827836 - protein, 23 aa, Entamoeba invadens
VEDMYLTVICKNYLALLADVNDG

SEQ ID NO: 2827837 - protein, 28 aa, Entamoeba invadens
VEEGNAHFSYFIRSILELGYNSEAVTLM

SEQ ID NO: 2827838 - protein, 29 aa, Entamoeba invadens
VEFFNKFNEYLQAYAFRDIAKQPPQPPEN

SEQ ID NO: 2827839 - protein, 24 aa, Entamoeba invadens
VEFKFPWTIAEFVSLGKRLEKPDY

SEQ ID NO: 2827840 - protein, 37 aa, Entamoeba invadens
VEGIKPKSLLFTPKATYYLPYFLMGGSTDLKVKCVAP

SEQ ID NO: 2827841 - protein, 25 aa, Entamoeba invadens
VEGLILELQVYFPKSFVTGGLFSRC

SEQ ID NO: 2827842 - protein, 23 aa, Entamoeba invadens
VEGLSILLFLMSTIANVFYSISI

SEQ ID NO: 2827843 - protein, 20 aa, Entamoeba invadens
VEGWNLDIKYALLLESDSPE

SEQ ID NO: 2827844 - protein, 18 aa, Entamoeba invadens
VEHPEFLQYIKSLPVYHD

SEQ ID NO: 2827845 - protein, 18 aa, Entamoeba invadens
VEIFLTRKDFPLSVDYSP

SEQ ID NO: 2827846 - protein, 18 aa, Entamoeba invadens
VEILPIIPADQCALITSL

SEQ ID NO: 2827847 - protein, 19 aa, Entamoeba invadens
VEIRPKFVIQSKGLHLYSD

SEQ ID NO: 2827848 - protein, 28 aa, Entamoeba invadens
VEITKLNINFWEFNCRHIKLSEVVGNVY

SEQ ID NO: 2827849 - protein, 24 aa, Entamoeba invadens
VEKDLIFGGFILFTSPLKKESKEN

SEQ ID NO: 2827850 - protein, 24 aa, Entamoeba invadens
VEKMLIDQLIWTPLYMSHFNYWAN

SEQ ID NO: 2827851 - protein, 44 aa, Entamoeba invadens
VELATIPIVFGVAVIVILLVAVVVTLIIVFRFKQREKEANVGKV

SEQ ID NO: 2827852 - protein, 30 aa, Entamoeba invadens
VELLRKTLQLIPPYLVHRPGFEGYDSWVIS

SEQ ID NO: 2827853 - protein, 23 aa, Entamoeba invadens
VEMHLRIKFILDASKGIEYLHEN

SEQ ID NO: 2827854 - protein, 36 aa, Entamoeba invadens
VEMNLRIKLILDASKGFYIYIKMEFYIEISNQTIFL

SEQ ID NO: 2827855 - protein, 21 aa, Entamoeba invadens
VENGHFKILFDTLCGINGDDE

SEQ ID NO: 2827856 - protein, 23 aa, Entamoeba invadens
VENGKCMYGLSPLDGYCHNCSEE

SEQ ID NO: 2827857 - protein, 28 aa, Entamoeba invadens
VENNIFICLEYLRCPFGFRNSTSKTCER

SEQ ID NO: 2827858 - protein, 18 aa, Entamoeba invadens
VEQERVLRIYYHNKLLLT

SEQ ID NO: 2827859 - protein, 18 aa, Entamoeba invadens
VEQREFESIFPEPGWVEQ

SEQ ID NO: 2827860 - protein, 19 aa, Entamoeba invadens
VERCLGIVSLLSTSSFFPN

SEQ ID NO: 2827861 - protein, 20 aa, Entamoeba invadens
VESRELLCIGNSLKGVLKIQ

SEQ ID NO: 2827862 - protein, 29 aa, Entamoeba invadens
VESTRICTKCLSGFYLQDGECLQIKNCVA

SEQ ID NO: 2827863 - protein, 29 aa, Entamoeba invadens
VESTRICTKCLSGYYLQDGECLQIKNCVA

SEQ ID NO: 2827864 - protein, 26 aa, Entamoeba invadens
VESWKKHAMFWLITLTPASVIGCVTY

SEQ ID NO: 2827865 - protein, 18 aa, Entamoeba invadens
VETEFKIRLPPKRMLRVS

SEQ ID NO: 2827866 - protein, 20 aa, Entamoeba invadens
VETKIGYYISGLLTQSCGNS

SEQ ID NO: 2827867 - protein, 19 aa, Entamoeba invadens
VETLVRIPQLFEKRFPGIE

SEQ ID NO: 2827868 - protein, 26 aa, Entamoeba invadens
VEVLANSMLIIPKTLIENSGYDVTER

SEQ ID NO: 2827869 - protein, 17 aa, Entamoeba invadens
VEVNLSFLFDSTVGYVM

SEQ ID NO: 2827870 - protein, 26 aa, Entamoeba invadens
VEVRMKLRFKVCLDAAQGIQYLHTNG

SEQ ID NO: 2827871 - protein, 17 aa, Entamoeba invadens
VEYILTISDSTKLWIDS

SEQ ID NO: 2827872 - protein, 18 aa, Entamoeba invadens
VEYTIVCFINISLAIFFF

SEQ ID NO: 2827873 - protein, 17 aa, Entamoeba invadens
VFATALFEYYKCGDGKV

SEQ ID NO: 2827874 - protein, 32 aa, Entamoeba invadens
VFAYSIVCYEVWLRAVPYTSFKYKWEVSAYVA

SEQ ID NO: 2827875 - protein, 19 aa, Entamoeba invadens
VFCGLPFIETTGFIALNRE

SEQ ID NO: 2827876 - protein, 38 aa, Entamoeba invadens
VFCRMKETLLQNKYIPWITLARLVFLSLSSLNTNKRYF

SEQ ID NO: 2827877 - protein, 18 aa, Entamoeba invadens
VFCYKPLVHLLGIRYGYF

SEQ ID NO: 2827878 - protein, 17 aa, Entamoeba invadens
VFCYTLGIVTCSPGCQG

SEQ ID NO: 2827879 - protein, 18 aa, Entamoeba invadens
VFDIWNIIPSYITMAEVQ

SEQ ID NO: 2827880 - protein, 20 aa, Entamoeba invadens
VFDRIPALIGVVWMLHCEKT

SEQ ID NO: 2827881 - protein, 20 aa, Entamoeba invadens
VFEAINKFPSNFQKISLESV

SEQ ID NO: 2827882 - protein, 28 aa, Entamoeba invadens
VFECITWIEAYLKKQFKFAWDIVDFVVN

SEQ ID NO: 2827883 - protein, 29 aa, Entamoeba invadens
VFEIAYGCFLCGIIPLFVSPRTPKEDIKT

SEQ ID NO: 2827884 - protein, 25 aa, Entamoeba invadens
VFELLKNFLTYNFYNTIYTSTFKTI

SEQ ID NO: 2827885 - protein, 18 aa, Entamoeba invadens
VFENFFSNYMFVGIIAMT

SEQ ID NO: 2827886 - protein, 20 aa, Entamoeba invadens
VFEPIPPWDSAPTEGAIVDG

SEQ ID NO: 2827887 - protein, 17 aa, Entamoeba invadens
VFEQKSFPSFRSRFSFS

SEQ ID NO: 2827888 - protein, 32 aa, Entamoeba invadens
VFFATFLWSVSISRFILIIPFNTYEDTTNVVR

SEQ ID NO: 2827889 - protein, 18 aa, Entamoeba invadens
VFFDNILDKGYTPRIVEF

SEQ ID NO: 2827890 - protein, 26 aa, Entamoeba invadens
VFFGVKKFFGFFTLMNNMIPISCQVT

SEQ ID NO: 2827891 - protein, 17 aa, Entamoeba invadens
VFFHGAIAPTFTKDLST

SEQ ID NO: 2827892 - protein, 30 aa, Entamoeba invadens
VFFPVAIGFVSPYPLYEVMRRMLLVIYENC

SEQ ID NO: 2827893 - protein, 17 aa, Entamoeba invadens
VFGLDVYPVTNGGYIED

SEQ ID NO: 2827894 - protein, 54 aa, Entamoeba invadens
VFGRVFRMNIKELPWMCFGFIGSMIYGALFPTFSYFLVESIVTLVKIYLTGVKD

SEQ ID NO: 2827895 - protein, 26 aa, Entamoeba invadens
VFGWCKAYPITTFKFPWKIAEFVTAG

SEQ ID NO: 2827896 - protein, 25 aa, Entamoeba invadens
VFGWSQAYLIDTFKFAWKIAEFVSS

SEQ ID NO: 2827897 - protein, 20 aa, Entamoeba invadens
VFHMIFGIILSLFNYIHMKK

SEQ ID NO: 2827898 - protein, 26 aa, Entamoeba invadens
VFIALVMGTIFLYTWIKHKKKHNDDV

SEQ ID NO: 2827899 - protein, 17 aa, Entamoeba invadens
VFIEEYLGNLLPSTEMV

SEQ ID NO: 2827900 - protein, 24 aa, Entamoeba invadens
VFIISQLLFRSFPNNFFVNMFGSW

SEQ ID NO: 2827901 - protein, 17 aa, Entamoeba invadens
VFIQVLYYITLPGECDP

SEQ ID NO: 2827902 - protein, 33 aa, Entamoeba invadens
VFISSLLCIGLLLLLLIFLRRRYRTTPSFPCEC

SEQ ID NO: 2827903 - protein, 27 aa, Entamoeba invadens
VFKDNMQVLVYLFSLLDQYSGMVLSLY

SEQ ID NO: 2827904 - protein, 23 aa, Entamoeba invadens
VFKFRFLLVIIISIILQLAASSF

SEQ ID NO: 2827905 - protein, 18 aa, Entamoeba invadens
VFKGVFRGKTVAIKKMKI

SEQ ID NO: 2827906 - protein, 18 aa, Entamoeba invadens
VFKIPVFVKKHCAELNIS

SEQ ID NO: 2827907 - protein, 17 aa, Entamoeba invadens
VFKLFAQATICNLNVFE

SEQ ID NO: 2827908 - protein, 19 aa, Entamoeba invadens
VFKMSRSNIRFIMKLSSSL

SEQ ID NO: 2827909 - protein, 18 aa, Entamoeba invadens
VFKNLYFFVTAPLGVLLF

SEQ ID NO: 2827910 - protein, 17 aa, Entamoeba invadens
VFKRLLMTVVPYAFRGD

SEQ ID NO: 2827911 - protein, 22 aa, Entamoeba invadens
VFLALILVNAINNCYYDECGHC

SEQ ID NO: 2827912 - protein, 25 aa, Entamoeba invadens
VFLDGVLCVAFRKDLHKISFTEFIE

SEQ ID NO: 2827913 - protein, 19 aa, Entamoeba invadens
VFLEGNGILYFWSQIVVTD

SEQ ID NO: 2827914 - protein, 20 aa, Entamoeba invadens
VFLFFSCVLSLVWCDAGSAI

SEQ ID NO: 2827915 - protein, 25 aa, Entamoeba invadens
VFLGDDFFFYRPTPPDFYVKGDKLV

SEQ ID NO: 2827916 - protein, 25 aa, Entamoeba invadens
VFLGTVFIFIPYIPSKKVLFAFSVF

SEQ ID NO: 2827917 - protein, 24 aa, Entamoeba invadens
VFLIIATPFLFVWNKLPSIVRFSI

SEQ ID NO: 2827918 - protein, 24 aa, Entamoeba invadens
VFLIVYLGLYLLKALLTKADNIGK

SEQ ID NO: 2827919 - protein, 17 aa, Entamoeba invadens
VFLLFSSIPSTCVGNFK

SEQ ID NO: 2827920 - protein, 21 aa, Entamoeba invadens
VFLLLFVFFTPRIGGANYGWE

SEQ ID NO: 2827921 - protein, 35 aa, Entamoeba invadens
VFLLLVVVVLLFLVFFIRSVFLPMPTLFKQLTSPF

SEQ ID NO: 2827922 - protein, 18 aa, Entamoeba invadens
VFLMNVVLYLPLSDVKTF

SEQ ID NO: 2827923 - protein, 26 aa, Entamoeba invadens
VFLTFFVLFLHICALYLYASGFLITS

SEQ ID NO: 2827924 - protein, 17 aa, Entamoeba invadens
VFLTPFCTMNLCDEIMI

SEQ ID NO: 2827925 - protein, 19 aa, Entamoeba invadens
VFMAWVFYYFSILNQEDPK

SEQ ID NO: 2827926 - protein, 20 aa, Entamoeba invadens
VFMKAMLFTLEYKGRGYVFI

SEQ ID NO: 2827927 - protein, 19 aa, Entamoeba invadens
VFMNCVELNSFTLGSLTIL

SEQ ID NO: 2827928 - protein, 29 aa, Entamoeba invadens
VFMNYVVKSPLFLGIWKFVVWDSMDCKIA

SEQ ID NO: 2827929 - protein, 26 aa, Entamoeba invadens
VFMSGLFLLAFFFFNVKLNIFGYIAC

SEQ ID NO: 2827930 - protein, 24 aa, Entamoeba invadens
VFNASAFLFLLLCGEFKIFGGEGS

SEQ ID NO: 2827931 - protein, 31 aa, Entamoeba invadens
VFNDTKLFELKPLQLYIQWCTIRNSTLINID

SEQ ID NO: 2827932 - protein, 25 aa, Entamoeba invadens
VFNFANYFYWLVVPLIMNDKGGSTF

SEQ ID NO: 2827933 - protein, 25 aa, Entamoeba invadens
VFNKATLLFLRYYNHQQYDPYFLDF

SEQ ID NO: 2827934 - protein, 19 aa, Entamoeba invadens
VFNPIFRHYLHKRSNIVYI

SEQ ID NO: 2827935 - protein, 17 aa, Entamoeba invadens
VFNPNFVTKLALCLTKD

SEQ ID NO: 2827936 - protein, 25 aa, Entamoeba invadens
VFPAISILFVYMMQHVKNVFFIESF

SEQ ID NO: 2827937 - protein, 23 aa, Entamoeba invadens
VFPILLGLFDRFFSAPQLTKSLS

SEQ ID NO: 2827938 - protein, 18 aa, Entamoeba invadens
VFPVIFSVILIVLSILSF

SEQ ID NO: 2827939 - protein, 26 aa, Entamoeba invadens
VFQTKSILIVLLSEFFKFTLEKKFVL

SEQ ID NO: 2827940 - protein, 36 aa, Entamoeba invadens
VFSFAITMYEVFGWNYAYPKKTFKFPWKIAEFVTLG

SEQ ID NO: 2827941 - protein, 36 aa, Entamoeba invadens
VFSFGVTMFEVFGWCKAYPLDTFKFPWKIAEFVISG

SEQ ID NO: 2827942 - protein, 38 aa, Entamoeba invadens
VFSFSTYLLFSVKLFHFPLYFGLMCFTLEIALDVFHFT

SEQ ID NO: 2827943 - protein, 26 aa, Entamoeba invadens
VFSNVFTNYIFLGIILGTVVVQFVIV

SEQ ID NO: 2827944 - protein, 30 aa, Entamoeba invadens
VFSVFQFVLLFIFVFIFIINVNNIPKVYKN

SEQ ID NO: 2827945 - protein, 19 aa, Entamoeba invadens
VFSVTGIFFGFANTFYSVF

SEQ ID NO: 2827946 - protein, 26 aa, Entamoeba invadens
VFSYAITILEIWIGKCPYSPLLFPDN

SEQ ID NO: 2827947 - protein, 30 aa, Entamoeba invadens
VFSYICGLINIMFWMFAQFPQIYQTFKSKK

SEQ ID NO: 2827948 - protein, 18 aa, Entamoeba invadens
VFTQLPLGHIIDNSIFVV

SEQ ID NO: 2827949 - protein, 24 aa, Entamoeba invadens
VFTRFDFYLVIFSVALAAGPSLSL

SEQ ID NO: 2827950 - protein, 29 aa, Entamoeba invadens
VFTSFCFQLSIKWTFVLSLRLRNGLISMI

SEQ ID NO: 2827951 - protein, 18 aa, Entamoeba invadens
VFTVENTFLYSGMLLKKC

SEQ ID NO: 2827952 - protein, 18 aa, Entamoeba invadens
VFTVFQLIDAFVFDSIHT

SEQ ID NO: 2827953 - protein, 26 aa, Entamoeba invadens
VFVFFVLVFFIVQIQFLFNHQHLRYN

SEQ ID NO: 2827954 - protein, 21 aa, Entamoeba invadens
VFVIGFFIVYFVIIFTVIASL

SEQ ID NO: 2827955 - protein, 19 aa, Entamoeba invadens
VFVIWYCVVPLIGAVVFCV

SEQ ID NO: 2827956 - protein, 24 aa, Entamoeba invadens
VFVLLLVLIFLNNPFYTYQFVFGG

SEQ ID NO: 2827957 - protein, 23 aa, Entamoeba invadens
VFVLMYIGWLLFSVIRTFSEAKK

SEQ ID NO: 2827958 - protein, 25 aa, Entamoeba invadens
VFVLNKEKLFYFNYSSPNKIITLNE

SEQ ID NO: 2827959 - protein, 21 aa, Entamoeba invadens
VFVPMVFGYSCWKLFDVPVRN

SEQ ID NO: 2827960 - protein, 19 aa, Entamoeba invadens
VFVQHLLIDILSEKGFFFE

SEQ ID NO: 2827961 - protein, 30 aa, Entamoeba invadens
VFVVVVLVVVSIFMGLYFYGKKKPEDKGYS

SEQ ID NO: 2827962 - protein, 17 aa, Entamoeba invadens
VFWYTPSKNGMYCQEAI

SEQ ID NO: 2827963 - protein, 26 aa, Entamoeba invadens
VGAGLGVIMFLILGSFSLGVWYGTMI

SEQ ID NO: 2827964 - protein, 18 aa, Entamoeba invadens
VGALVPFTNDYQPALETF

SEQ ID NO: 2827965 - protein, 19 aa, Entamoeba invadens
VGAMIMICVIFFIVLGILI

SEQ ID NO: 2827966 - protein, 17 aa, Entamoeba invadens
VGCEDGFYLGTAILRCY

SEQ ID NO: 2827967 - protein, 23 aa, Entamoeba invadens
VGCLLCQNGYYTNEYNKCTKCGD

SEQ ID NO: 2827968 - protein, 23 aa, Entamoeba invadens
VGCLLCQNGYYTNEYNKCTKCGN

SEQ ID NO: 2827969 - protein, 18 aa, Entamoeba invadens
VGCMLCESGYYLSNNLCA

SEQ ID NO: 2827970 - protein, 17 aa, Entamoeba invadens
VGDTEPRTTHPNCKKFT

SEQ ID NO: 2827971 - protein, 25 aa, Entamoeba invadens
VGDTTKFVWVHNSAVDTSPQCRKVN

SEQ ID NO: 2827972 - protein, 28 aa, Entamoeba invadens
VGDVHGQFFDLLHLFQVNGIPSENNMYL

SEQ ID NO: 2827973 - protein, 20 aa, Entamoeba invadens
VGFVVLIFLFRHQKLEFKND

SEQ ID NO: 2827974 - protein, 25 aa, Entamoeba invadens
VGGCSLCLSGYYLKDGKCHPLSESN

SEQ ID NO: 2827975 - protein, 24 aa, Entamoeba invadens
VGGGYICTFLLAATVIYWIFGYSF

SEQ ID NO: 2827976 - protein, 27 aa, Entamoeba invadens
VGGKCVSCRPGYYFKIMNECELCDAGF

SEQ ID NO: 2827977 - protein, 24 aa, Entamoeba invadens
VGGRTWILLVFGIVSLAINIVGMI

SEQ ID NO: 2827978 - protein, 32 aa, Entamoeba invadens
VGGVLLIAVIILVVVVVIITIKKKKGSEYSKI

SEQ ID NO: 2827979 - protein, 36 aa, Entamoeba invadens
VGGVSSIIIAIVCVFVLILLVGFISVMYNKWSKKGK

SEQ ID NO: 2827980 - protein, 26 aa, Entamoeba invadens
VGIGFGAMMFVMMCSLALGSWYGSLV

SEQ ID NO: 2827981 - protein, 17 aa, Entamoeba invadens
VGIIYIVLIKKYSNLCI

SEQ ID NO: 2827982 - protein, 18 aa, Entamoeba invadens
VGILLFIVNISQLFAYLI

SEQ ID NO: 2827983 - protein, 25 aa, Entamoeba invadens
VGILQPLIMLLFGELVDTFDTQNLK

SEQ ID NO: 2827984 - protein, 17 aa, Entamoeba invadens
VGILSIVFLILGSLYSQ

SEQ ID NO: 2827985 - protein, 32 aa, Entamoeba invadens
VGIPIVSVFVIVLVIIGIIVITIVFLQKRKET

SEQ ID NO: 2827986 - protein, 23 aa, Entamoeba invadens
VGISYAKIDYAIYQLSGCGDWGT

SEQ ID NO: 2827987 - protein, 25 aa, Entamoeba invadens
VGIVYTFLRFRLVTLGGFIIPAAFQ

SEQ ID NO: 2827988 - protein, 26 aa, Entamoeba invadens
VGKIGMYTLVLLLVHFNYDSRFQEMN

SEQ ID NO: 2827989 - protein, 24 aa, Entamoeba invadens
VGKNMEQLLVNKLPWNCWSDGMTI

SEQ ID NO: 2827990 - protein, 33 aa, Entamoeba invadens
VGKWVYVSLVILAVYLIVNFIYGKTNDFFYNKF

SEQ ID NO: 2827991 - protein, 26 aa, Entamoeba invadens
VGLIGLFVFIIRGKLFLIIFIVFNCF

SEQ ID NO: 2827992 - protein, 25 aa, Entamoeba invadens
VGLIVICVLFIGTIVFIVRYRKMKG

SEQ ID NO: 2827993 - protein, 26 aa, Entamoeba invadens
VGLQKQLSIPLSCEITPFAKMFPGEK

SEQ ID NO: 2827994 - protein, 24 aa, Entamoeba invadens
VGLQKVLFGFFFSLGLNVVVFSGS

SEQ ID NO: 2827995 - protein, 17 aa, Entamoeba invadens
VGLVYIMILFSYVFFKV

SEQ ID NO: 2827996 - protein, 26 aa, Entamoeba invadens
VGLYAFAAFLSLALVFFIWNNTQKCL

SEQ ID NO: 2827997 - protein, 18 aa, Entamoeba invadens
VGMFVLFLSAMVEPFFSV

SEQ ID NO: 2827998 - protein, 21 aa, Entamoeba invadens
VGMFYLTIVYIPLVSIAICNA

SEQ ID NO: 2827999 - protein, 25 aa, Entamoeba invadens
VGMGILWIALTILFQLITTLSSEFT

SEQ ID NO: 2828000 - protein, 17 aa, Entamoeba invadens
VGMILWLALFFANNISE

SEQ ID NO: 2828001 - protein, 28 aa, Entamoeba invadens
VGMTLYETFKWGYAYDPEKIKSWDIADN

SEQ ID NO: 2828002 - protein, 22 aa, Entamoeba invadens
VGNVIFVTSLFKLSENARLSVK

SEQ ID NO: 2828003 - protein, 24 aa, Entamoeba invadens
VGPLAIYVLCYFISIALGFPNLVQ

SEQ ID NO: 2828004 - protein, 32 aa, Entamoeba invadens
VGQKNYKYFILFLWYAPLMLSLGVCWHANGFW

SEQ ID NO: 2828005 - protein, 17 aa, Entamoeba invadens
VGQLSYVGFALSAIETL

SEQ ID NO: 2828006 - protein, 25 aa, Entamoeba invadens
VGRRTWILLIFSIIGLAINIVGMIL

SEQ ID NO: 2828007 - protein, 23 aa, Entamoeba invadens
VGRSLQNLLIKLYTPPKLARSTN

SEQ ID NO: 2828008 - protein, 48 aa, Entamoeba invadens
VGSCPGYLLVLFIFIFIVFAVIIIVVAFLIWKYFPRKIKSENIFTPKG

SEQ ID NO: 2828009 - protein, 22 aa, Entamoeba invadens
VGSDPFPIPTYAIEITEDWAAY

SEQ ID NO: 2828010 - protein, 25 aa, Entamoeba invadens
VGTEDGLILIFKYSQDEAIIITAIH

SEQ ID NO: 2828011 - protein, 24 aa, Entamoeba invadens
VGTELALIFGISDKAALKSVQSAF

SEQ ID NO: 2828012 - protein, 32 aa, Entamoeba invadens
VGTPSLTFAVIIIAIILVIVFVFVCCHKKTND

SEQ ID NO: 2828013 - protein, 26 aa, Entamoeba invadens
VGTVKQFVVIFDKNNFEYKLKAKIIN

SEQ ID NO: 2828014 - protein, 33 aa, Entamoeba invadens
VGVIVGVLIIIVIVGVIILIGVIVIVRNKKNEE

SEQ ID NO: 2828015 - protein, 34 aa, Entamoeba invadens
VGVPFYSILLNGILILFNTMFFPCSVVLAVAYVS

SEQ ID NO: 2828016 - protein, 39 aa, Entamoeba invadens
VGVPISIIVVIIVIIIMIIILVLVLHQLKIESDKMQNVC

SEQ ID NO: 2828017 - protein, 31 aa, Entamoeba invadens
VGVPITVTFVIIVFIIALIPIVISMIQKRKQ

SEQ ID NO: 2828018 - protein, 33 aa, Entamoeba invadens
VGVPLSVTFVIIMFIVALIIIVISMIQKRKQKK

SEQ ID NO: 2828019 - protein, 26 aa, Entamoeba invadens
VGYINGIIFVYLFNTEKLTVKNVNGG

SEQ ID NO: 2828020 - protein, 18 aa, Entamoeba invadens
VGYISKGVCTPCFSDYKC

SEQ ID NO: 2828021 - protein, 18 aa, Entamoeba invadens
VGYLSSKGVCTACFADYN

SEQ ID NO: 2828022 - protein, 24 aa, Entamoeba invadens
VGYNGKFLWNSKVSRLFLAKEDQT

SEQ ID NO: 2828023 - protein, 37 aa, Entamoeba invadens
VHAKSSILLLPEALKLLPIFVLGAMKTPAFMAFGQMN

SEQ ID NO: 2828024 - protein, 23 aa, Entamoeba invadens
VHAWLNLFIFILCLFVVGLCRNI

SEQ ID NO: 2828025 - protein, 21 aa, Entamoeba invadens
VHFEPITFVCTSGVTGVALVA

SEQ ID NO: 2828026 - protein, 17 aa, Entamoeba invadens
VHFFGAVFIPTKICMVT

SEQ ID NO: 2828027 - protein, 25 aa, Entamoeba invadens
VHFTRGKWLLFTREERLYHVEAIYK

SEQ ID NO: 2828028 - protein, 18 aa, Entamoeba invadens
VHFYGACFIPGRVCMVTE

SEQ ID NO: 2828029 - protein, 17 aa, Entamoeba invadens
VHFYGAVFIPTKICMVT

SEQ ID NO: 2828030 - protein, 26 aa, Entamoeba invadens
VHGFACIYIWMFLYTVGHSYKKNLKR

SEQ ID NO: 2828031 - protein, 22 aa, Entamoeba invadens
VHKISCGVTLRYPTCANPYGLV

SEQ ID NO: 2828032 - protein, 50 aa, Entamoeba invadens
VHKTNVLAIVLPIIFTIILIVVIIIAIGCVLFYIHYKKEEKLRNSLVNEF

SEQ ID NO: 2828033 - protein, 32 aa, Entamoeba invadens
VHLSVLPLVIHAMIMRLVRKTILPLNPIIARK

SEQ ID NO: 2828034 - protein, 19 aa, Entamoeba invadens
VHMVILIDLNCPALEFVIQ

SEQ ID NO: 2828035 - protein, 19 aa, Entamoeba invadens
VHNSLKFLKEFFSDTGRLK

SEQ ID NO: 2828036 - protein, 34 aa, Entamoeba invadens
VHRDIKPDNLLYKMPSDIFPLQSAFMNALHGKNH

SEQ ID NO: 2828037 - protein, 41 aa, Entamoeba invadens
VHTLIFEFDIACYPFFVIPPKAVYYVVYLCSALGLFVVTIL

SEQ ID NO: 2828038 - protein, 24 aa, Entamoeba invadens
VHTTTIPIPSKLMEFPIVEDSPID

SEQ ID NO: 2828039 - protein, 27 aa, Entamoeba invadens
VHYYGGVTLFEKWSIVLELAPLGSLRT

SEQ ID NO: 2828040 - protein, 24 aa, Entamoeba invadens
VIAANQPFDFVYSFDPITVDKTSL

SEQ ID NO: 2828041 - protein, 23 aa, Entamoeba invadens
VIANILALWAFYPSFRGPSHTHS

SEQ ID NO: 2828042 - protein, 20 aa, Entamoeba invadens
VICCMYAVSVLFGIVGLIIL

SEQ ID NO: 2828043 - protein, 24 aa, Entamoeba invadens
VICHPITCVYKFKGFNMKSCPMAE

SEQ ID NO: 2828044 - protein, 18 aa, Entamoeba invadens
VIDIFPYVRYETIPFYSM

SEQ ID NO: 2828045 - protein, 28 aa, Entamoeba invadens
VIDQTLSLPGFFFSYTYDLTRSFYEQPK

SEQ ID NO: 2828046 - protein, 18 aa, Entamoeba invadens
VIENIEVYKYLESLAKKL

SEQ ID NO: 2828047 - protein, 39 aa, Entamoeba invadens
VIEPILLVLVIISLILMFVPKPAILYYRLRKHQKALPEC

SEQ ID NO: 2828048 - protein, 29 aa, Entamoeba invadens
VIETPKYYVVWITLMFWLCVGVICFANME

SEQ ID NO: 2828049 - protein, 22 aa, Entamoeba invadens
VIEWDCINTYDLSVRTFKCTKE

SEQ ID NO: 2828050 - protein, 18 aa, Entamoeba invadens
VIFIARIFYRDTDTYHRI

SEQ ID NO: 2828051 - protein, 18 aa, Entamoeba invadens
VIFSGFPLQNISIYVKEG

SEQ ID NO: 2828052 - protein, 31 aa, Entamoeba invadens
VIFVSSMIILVLAYRSWALASPAIPPMLSPS

SEQ ID NO: 2828053 - protein, 21 aa, Entamoeba invadens
VIGCLSCISPYFSREAKCESC

SEQ ID NO: 2828054 - protein, 28 aa, Entamoeba invadens
VIGGVVFFVILVIILVIIIVFGLEYKKQ

SEQ ID NO: 2828055 - protein, 26 aa, Entamoeba invadens
VIGIPISVVFVLIIKKEQNICNFKMS

SEQ ID NO: 2828056 - protein, 42 aa, Entamoeba invadens
VIGIPITVVVLLILTVTLLIVILFYILQRYSRKQQMQNVCVF

SEQ ID NO: 2828057 - protein, 24 aa, Entamoeba invadens
VIGKEIIMKLGNNVWDFCLQKFKK

SEQ ID NO: 2828058 - protein, 18 aa, Entamoeba invadens
VIGKNAFKGATKLVSFTA

SEQ ID NO: 2828059 - protein, 27 aa, Entamoeba invadens
VIGTVFLLIMLIISTVTIIIVSRKDHY

SEQ ID NO: 2828060 - protein, 25 aa, Entamoeba invadens
VIGYVIRYLILTFPIINILNEYPLV

SEQ ID NO: 2828061 - protein, 20 aa, Entamoeba invadens
VIHELFLRRLGDAQSKYGSV

SEQ ID NO: 2828062 - protein, 26 aa, Entamoeba invadens
VIIDFFLFFLFIVGKMSFVFVVIPIF

SEQ ID NO: 2828063 - protein, 20 aa, Entamoeba invadens
VIIDFRDVLFFADFFRTFGA

SEQ ID NO: 2828064 - protein, 29 aa, Entamoeba invadens
VIIGIPITVVIIMKNVCVFKINRSNISMS

SEQ ID NO: 2828065 - protein, 26 aa, Entamoeba invadens
VIIILVIVAVIVLVIKYLNHQKIEKT

SEQ ID NO: 2828066 - protein, 25 aa, Entamoeba invadens
VIIITLSITVIILTTKKILDIVHGN

SEQ ID NO: 2828067 - protein, 23 aa, Entamoeba invadens
VIILFVILIWFFTIGTAVNNVND

SEQ ID NO: 2828068 - protein, 33 aa, Entamoeba invadens
VIIMNALITFLYLFTLCFFKIRWSKIFYWAIYL

SEQ ID NO: 2828069 - protein, 17 aa, Entamoeba invadens
VIINFKFIKSEIYTSTT

SEQ ID NO: 2828070 - protein, 17 aa, Entamoeba invadens
VIIPIINLIVIVSVSFG

SEQ ID NO: 2828071 - protein, 26 aa, Entamoeba invadens
VIITILVMNVYLGITFRMMECVLSLE

SEQ ID NO: 2828072 - protein, 27 aa, Entamoeba invadens
VIKHFTLYFWLAIMVIDIVISLIFVPF

SEQ ID NO: 2828073 - protein, 23 aa, Entamoeba invadens
VIKIPFLQIFKNVITIQAIIPDG

SEQ ID NO: 2828074 - protein, 24 aa, Entamoeba invadens
VIKLVWLLVCVTIVFMIFHKNQQK

SEQ ID NO: 2828075 - protein, 21 aa, Entamoeba invadens
VIKMMWDVIFAFSGRLSLVDH

SEQ ID NO: 2828076 - protein, 26 aa, Entamoeba invadens
VIKSGYVLRVCVCGYIIVIVTKDEIK

SEQ ID NO: 2828077 - protein, 17 aa, Entamoeba invadens
VIKVQFTILTNINKFIF

SEQ ID NO: 2828078 - protein, 28 aa, Entamoeba invadens
VILAIYFTIYFIFTILSGKWAMWVIYTI

SEQ ID NO: 2828079 - protein, 18 aa, Entamoeba invadens
VILFVIVTSKYSTPSQYP

SEQ ID NO: 2828080 - protein, 27 aa, Entamoeba invadens
VILKKNPPIIPPPPQSPFPFSQTQHSL

SEQ ID NO: 2828081 - protein, 33 aa, Entamoeba invadens
VILKQLELAYPVVGLFVLFVHFTKKGSRLNRLW

SEQ ID NO: 2828082 - protein, 23 aa, Entamoeba invadens
VILLGVMFFAIGVVYFFLSLVLD

SEQ ID NO: 2828083 - protein, 21 aa, Entamoeba invadens
VILPFIVCFFIATPHLDLSQL

SEQ ID NO: 2828084 - protein, 24 aa, Entamoeba invadens
VILRLDDVLAILIPIHNKLIGNIC

SEQ ID NO: 2828085 - protein, 18 aa, Entamoeba invadens
VILSFVPITFISSMFIGG

SEQ ID NO: 2828086 - protein, 17 aa, Entamoeba invadens
VIMHVLFILVTSSFYRV

SEQ ID NO: 2828087 - protein, 23 aa, Entamoeba invadens
VIMSAFPFVTFLVRSNDIQNSIL

SEQ ID NO: 2828088 - protein, 25 aa, Entamoeba invadens
VINAQFNRYYIETLGLDCNCEDGTS

SEQ ID NO: 2828089 - protein, 21 aa, Entamoeba invadens
VINHMLWTWNTHLISWKISLK

SEQ ID NO: 2828090 - protein, 26 aa, Entamoeba invadens
VINIFVPLFFLPIFLMDFCPSVFLIF

SEQ ID NO: 2828091 - protein, 29 aa, Entamoeba invadens
VINKIVFPEVIPQIYFIGNITVYNADINE

SEQ ID NO: 2828092 - protein, 26 aa, Entamoeba invadens
VINTIICILIRQFGAVATFRKSKKTK

SEQ ID NO: 2828093 - protein, 37 aa, Entamoeba invadens
VINVSLLGFFVWKMLLFLFFILYEASYVLVYKGFKTE

SEQ ID NO: 2828094 - protein, 18 aa, Entamoeba invadens
VIPFESTGIFTYPACMRN

SEQ ID NO: 2828095 - protein, 29 aa, Entamoeba invadens
VIPIAFVILLWVIKSLPLMIIPLCTMITS

SEQ ID NO: 2828096 - protein, 17 aa, Entamoeba invadens
VIQFFILGSLGEYIRPT

SEQ ID NO: 2828097 - protein, 18 aa, Entamoeba invadens
VIQIIPTTSELFLIRSSR

SEQ ID NO: 2828098 - protein, 17 aa, Entamoeba invadens
VIQKCWSTIPTERIEIG

SEQ ID NO: 2828099 - protein, 26 aa, Entamoeba invadens
VISCGYLVYYFVYLMVRRIYPNNLNI

SEQ ID NO: 2828100 - protein, 19 aa, Entamoeba invadens
VISIFTTLPFCVFCVASFP

SEQ ID NO: 2828101 - protein, 25 aa, Entamoeba invadens
VISITIIITVILLVLNYKQIDIELF

SEQ ID NO: 2828102 - protein, 24 aa, Entamoeba invadens
VISIYTINQTLKWVKKMGGVEAIH

SEQ ID NO: 2828103 - protein, 29 aa, Entamoeba invadens
VISKCKWFIVVFWILLAIATAYFALTLFS

SEQ ID NO: 2828104 - protein, 36 aa, Entamoeba invadens
VISKKFQKLKFTKFSFFFSFFFRFQETDNLFEISPG

SEQ ID NO: 2828105 - protein, 28 aa, Entamoeba invadens
VISKRPIHYFWYYINSIVFHCFVTAIVG

SEQ ID NO: 2828106 - protein, 25 aa, Entamoeba invadens
VISLIFVPFILPLFYEKKPLEESEL

SEQ ID NO: 2828107 - protein, 17 aa, Entamoeba invadens
VISMIYKSNAEIKCLPK

SEQ ID NO: 2828108 - protein, 25 aa, Entamoeba invadens
VISQNNYCYIPTEGFYIANISVEKC

SEQ ID NO: 2828109 - protein, 17 aa, Entamoeba invadens
VISRWMPDRLFTYGYAR

SEQ ID NO: 2828110 - protein, 20 aa, Entamoeba invadens
VISSYQKLLMNTPVFLHVVI

SEQ ID NO: 2828111 - protein, 34 aa, Entamoeba invadens
VISTVTCLLGLIPDIFFLIQRKSIFTSWEYHSHM

SEQ ID NO: 2828112 - protein, 17 aa, Entamoeba invadens
VISWGAALLARHSQTKI

SEQ ID NO: 2828113 - protein, 25 aa, Entamoeba invadens
VITAVCIGLLFALVLLMTICNSIWG

SEQ ID NO: 2828114 - protein, 21 aa, Entamoeba invadens
VITCLLLFYLFALIKMFVIRG

SEQ ID NO: 2828115 - protein, 20 aa, Entamoeba invadens
VITKLGEGSFGIVYKGNYRG

SEQ ID NO: 2828116 - protein, 17 aa, Entamoeba invadens
VITKLYPIIQTVVILML

SEQ ID NO: 2828117 - protein, 28 aa, Entamoeba invadens
VITNPVYQLIIPETMNIDLYLNSLTIEE

SEQ ID NO: 2828118 - protein, 29 aa, Entamoeba invadens
VITWFVCGFFFPPLFLYTSNRYKNSENPF

SEQ ID NO: 2828119 - protein, 37 aa, Entamoeba invadens
VIVAIVVIIVIIIVVIILIMVLLRYLRKHAEKVEQET

SEQ ID NO: 2828120 - protein, 28 aa, Entamoeba invadens
VIVALFSVIFIFFDPWKLYDAIISKFTK

SEQ ID NO: 2828121 - protein, 30 aa, Entamoeba invadens
VIVATLMLLMVPLVLFLLGKDRYSFTITQM

SEQ ID NO: 2828122 - protein, 23 aa, Entamoeba invadens
VIVFVGCVIALVWITYQNRSTEK

SEQ ID NO: 2828123 - protein, 18 aa, Entamoeba invadens
VIVIDIIMNLILCGFSII

SEQ ID NO: 2828124 - protein, 22 aa, Entamoeba invadens
VIVIFIIMCIVLYLFTKLFSNY

SEQ ID NO: 2828125 - protein, 30 aa, Entamoeba invadens
VIVMEKLHRQVLPFILRRLKESVLQDLPPK

SEQ ID NO: 2828126 - protein, 17 aa, Entamoeba invadens
VIVMNYAGFSALRSLQA

SEQ ID NO: 2828127 - protein, 17 aa, Entamoeba invadens
VIVMNYAVFSAVSSLQA

SEQ ID NO: 2828128 - protein, 32 aa, Entamoeba invadens
VIVTTLIIVMLTWIILFLPGNKDILPVVINET

SEQ ID NO: 2828129 - protein, 21 aa, Entamoeba invadens
VIVVSILFLFIDYRKIFNIVV

SEQ ID NO: 2828130 - protein, 17 aa, Entamoeba invadens
VIVVSSQTTPYCANVIG

SEQ ID NO: 2828131 - protein, 18 aa, Entamoeba invadens
VIYLVFLVLVGISLGVAT

SEQ ID NO: 2828132 - protein, 31 aa, Entamoeba invadens
VIYVLKNYFLLYFTVIWIGLNVTSITSVIVN

SEQ ID NO: 2828133 - protein, 28 aa, Entamoeba invadens
VKALFTIFTLLFFSSNLFHFLEGFDPES

SEQ ID NO: 2828134 - protein, 25 aa, Entamoeba invadens
VKALLLKRKYLIVVLEQVTIVHKIS

SEQ ID NO: 2828135 - protein, 17 aa, Entamoeba invadens
VKALPLIFSTELSTWID

SEQ ID NO: 2828136 - protein, 21 aa, Entamoeba invadens
VKAPFIAFNFSKTAPVDVTVD

SEQ ID NO: 2828137 - protein, 17 aa, Entamoeba invadens
VKCLNNCTSCEILKSCI

SEQ ID NO: 2828138 - protein, 26 aa, Entamoeba invadens
VKCMKRGYWLLMENVNFCNPTVLDRL

SEQ ID NO: 2828139 - protein, 18 aa, Entamoeba invadens
VKCTFWHVPTDEGTGCKT

SEQ ID NO: 2828140 - protein, 35 aa, Entamoeba invadens
VKCWDLALVVISALPFMFLALFAIGKTTAYSNGKQ

SEQ ID NO: 2828141 - protein, 24 aa, Entamoeba invadens
VKDKMPIDIYPLHLKTKLMVDAAK

SEQ ID NO: 2828142 - protein, 22 aa, Entamoeba invadens
VKEKYIALYSQWKLKGNQKPKE

SEQ ID NO: 2828143 - protein, 24 aa, Entamoeba invadens
VKEMLEIFGFRNCISLLPYNKRKT

SEQ ID NO: 2828144 - protein, 17 aa, Entamoeba invadens
VKETIACQFIIGNKSKN

SEQ ID NO: 2828145 - protein, 26 aa, Entamoeba invadens
VKFKLFSHQLYLFYEYKAVPETTFIY

SEQ ID NO: 2828146 - protein, 25 aa, Entamoeba invadens
VKFRSEYIVHFFGAVFVPNKVCMVT

SEQ ID NO: 2828147 - protein, 24 aa, Entamoeba invadens
VKGENLLVFSLNPHSPVCAKLTDF

SEQ ID NO: 2828148 - protein, 23 aa, Entamoeba invadens
VKGNCPDMYFKDGAEKMCKRCTG

SEQ ID NO: 2828149 - protein, 23 aa, Entamoeba invadens
VKGYLVFFDIKMSGTAKIYSEGT

SEQ ID NO: 2828150 - protein, 26 aa, Entamoeba invadens
VKHLGDFPIFTIKSVQIFSGNLALKT

SEQ ID NO: 2828151 - protein, 28 aa, Entamoeba invadens
VKIATVLILFFFFHTLIAICFTPLVYVM

SEQ ID NO: 2828152 - protein, 18 aa, Entamoeba invadens
VKIDKFDFFKKATKQRLL

SEQ ID NO: 2828153 - protein, 40 aa, Entamoeba invadens
VKIGLIVGLVLLAVFLLIVIIAIIVVINIVMMVLKKRKGI

SEQ ID NO: 2828154 - protein, 27 aa, Entamoeba invadens
VKILLTKVITLLRYPSYDIINLMMQIF

SEQ ID NO: 2828155 - protein, 25 aa, Entamoeba invadens
VKKFDWNVVIISVITVVLVIVVIIV

SEQ ID NO: 2828156 - protein, 17 aa, Entamoeba invadens
VKKLLGNYIVILSTTTN

SEQ ID NO: 2828157 - protein, 25 aa, Entamoeba invadens
VKKNTWTYYKFLFSELNITNNSFWG

SEQ ID NO: 2828158 - protein, 41 aa, Entamoeba invadens
VKKRRTMYLLISGGLFYVIVYIVLLVCCICKYIILCKEINF

SEQ ID NO: 2828159 - protein, 23 aa, Entamoeba invadens
VKKYTNMFDLLCAIFKLVPPKRN

SEQ ID NO: 2828160 - protein, 17 aa, Entamoeba invadens
VKLLLVHGRYFYRQNSV

SEQ ID NO: 2828161 - protein, 26 aa, Entamoeba invadens
VKLTSVNFYAPLTSLLDQMTAQVNLF

SEQ ID NO: 2828162 - protein, 25 aa, Entamoeba invadens
VKLVYFPWILLLLDTLLFHDGMDDI

SEQ ID NO: 2828163 - protein, 20 aa, Entamoeba invadens
VKMLATCLGYFFAEVLLFVP

SEQ ID NO: 2828164 - protein, 18 aa, Entamoeba invadens
VKMLEMVVMWFLEEVLNR

SEQ ID NO: 2828165 - protein, 38 aa, Entamoeba invadens
VKNQTVFSYLILPVQRIPRYELFIKQLIKNIPSYHKER

SEQ ID NO: 2828166 - protein, 42 aa, Entamoeba invadens
VKNRKIEFYWFHEHSVFYYISAVILVLFLAVSLVMGTSIITF

SEQ ID NO: 2828167 - protein, 25 aa, Entamoeba invadens
VKNVSFLCLACESNYYLLNITFCQQ

SEQ ID NO: 2828168 - protein, 25 aa, Entamoeba invadens
VKPKELTVFFDNSSLILKYNQTVNY

SEQ ID NO: 2828169 - protein, 18 aa, Entamoeba invadens
VKPKSRFNLLLLEPGEQY

SEQ ID NO: 2828170 - protein, 27 aa, Entamoeba invadens
VKQKYPNFLVVQPPIVLQTFYGPDYVP

SEQ ID NO: 2828171 - protein, 34 aa, Entamoeba invadens
VKQLYLFFLLYYILLFILILCRSASRSKDFEVID

SEQ ID NO: 2828172 - protein, 17 aa, Entamoeba invadens
VKRLHVFGEVFAENGFL

SEQ ID NO: 2828173 - protein, 31 aa, Entamoeba invadens
VKRTVITFFLNFILFIFAVICVKVYNFFLLG

SEQ ID NO: 2828174 - protein, 23 aa, Entamoeba invadens
VKSGCLSCRSKCRRCVSGTCIQC

SEQ ID NO: 2828175 - protein, 21 aa, Entamoeba invadens
VKSGLFMMSVLNIKYLQTKDE

SEQ ID NO: 2828176 - protein, 32 aa, Entamoeba invadens
VKSMQVILDHMWFYLEIAEKCIIVFVCLAFDK

SEQ ID NO: 2828177 - protein, 27 aa, Entamoeba invadens
VKSSHNKWLIQLPRHFVSRKSNEGGFT

SEQ ID NO: 2828178 - protein, 23 aa, Entamoeba invadens
VKTAYTTLILNNVKLTTLIGTEL

SEQ ID NO: 2828179 - protein, 29 aa, Entamoeba invadens
VKTDEFFTLVWWRWTIFSFIATLFMISFI

SEQ ID NO: 2828180 - protein, 17 aa, Entamoeba invadens
VKTLKLKIFKEVGPFTR

SEQ ID NO: 2828181 - protein, 18 aa, Entamoeba invadens
VKTMKDAELLLKAEIDKR

SEQ ID NO: 2828182 - protein, 27 aa, Entamoeba invadens
VKTVSVPLFRLFILNHLFELSVEIYKD

SEQ ID NO: 2828183 - protein, 22 aa, Entamoeba invadens
VKVEFLIEVFINNLTITSIGDY

SEQ ID NO: 2828184 - protein, 23 aa, Entamoeba invadens
VKVHRIHAIELLPIENSIGISVG

SEQ ID NO: 2828185 - protein, 17 aa, Entamoeba invadens
VKVLIRCTTIIKDKKIP

SEQ ID NO: 2828186 - protein, 19 aa, Entamoeba invadens
VKWVLYLQMSFVVFVFSCA

SEQ ID NO: 2828187 - protein, 33 aa, Entamoeba invadens
VKYERRNMMAATVNFIIGMLTKLGVVFKEKGTK

SEQ ID NO: 2828188 - protein, 35 aa, Entamoeba invadens
VKYSEPYCPCYDTEDWYITPLQNITSLYVKIDLTK

SEQ ID NO: 2828189 - protein, 20 aa, Entamoeba invadens
VKYSFDTIGIYYYPTCMPTF

SEQ ID NO: 2828190 - protein, 46 aa, Entamoeba invadens
VLAISLLVTFVVMLIIIVFVLSFVLYFLYLYFRNKKKMQNVCVFDM

SEQ ID NO: 2828191 - protein, 28 aa, Entamoeba invadens
VLALDVAIPKHFYLNEIYVSFSLTKTII

SEQ ID NO: 2828192 - protein, 19 aa, Entamoeba invadens
VLCDECYPPYVAINGICVS

SEQ ID NO: 2828193 - protein, 17 aa, Entamoeba invadens
VLCKNLVVLGTVSPSTQ

SEQ ID NO: 2828194 - protein, 19 aa, Entamoeba invadens
VLCLSLRPISRLHYLTSTS

SEQ ID NO: 2828195 - protein, 19 aa, Entamoeba invadens
VLCPLFTCIIVKQTTLLSN

SEQ ID NO: 2828196 - protein, 18 aa, Entamoeba invadens
VLCQCKTGYLPYETPRRN

SEQ ID NO: 2828197 - protein, 45 aa, Entamoeba invadens
VLDKRHYKFPADIYSYAVSMFEIVKWGPAFPKGKFKHAWDIANFV

SEQ ID NO: 2828198 - protein, 17 aa, Entamoeba invadens
VLDSVCIFLIYRISYIY

SEQ ID NO: 2828199 - protein, 17 aa, Entamoeba invadens
VLDYFSGICNLFNVWLD

SEQ ID NO: 2828200 - protein, 34 aa, Entamoeba invadens
VLECLTWKDPFDEKLFPYSWDITNLISKGERPAI

SEQ ID NO: 2828201 - protein, 35 aa, Entamoeba invadens
VLECLTWKDTFDEKLFPYSWDITNLISRGERPAIE

SEQ ID NO: 2828202 - protein, 17 aa, Entamoeba invadens
VLEGCDCYKIRTVPSIV

SEQ ID NO: 2828203 - protein, 19 aa, Entamoeba invadens
VLEKLFLHTTNTQERFYIN

SEQ ID NO: 2828204 - protein, 20 aa, Entamoeba invadens
VLETIYLAIELLQGLFLNDK

SEQ ID NO: 2828205 - protein, 32 aa, Entamoeba invadens
VLEVRELTLFKIATIKKLTFLENAKLDMNNYE

SEQ ID NO: 2828206 - protein, 19 aa, Entamoeba invadens
VLFGIFPFVDLVAFADKYI

SEQ ID NO: 2828207 - protein, 19 aa, Entamoeba invadens
VLFGIFPFVDLVAFADKYL

SEQ ID NO: 2828208 - protein, 18 aa, Entamoeba invadens
VLFGKDLLEKVYHASIVI

SEQ ID NO: 2828209 - protein, 18 aa, Entamoeba invadens
VLFGYKLSWFYLLCLVCL

SEQ ID NO: 2828210 - protein, 24 aa, Entamoeba invadens
VLFSMCTFLFWRSIVFAMVLSCVV

SEQ ID NO: 2828211 - protein, 17 aa, Entamoeba invadens
VLFSMLFASILLSFGVY

SEQ ID NO: 2828212 - protein, 17 aa, Entamoeba invadens
VLFVSETILQFGDVQFN

SEQ ID NO: 2828213 - protein, 19 aa, Entamoeba invadens
VLFYKEACQFGFNLPRMND

SEQ ID NO: 2828214 - protein, 22 aa, Entamoeba invadens
VLGCVYIIFVNKFLLPSNVKTE

SEQ ID NO: 2828215 - protein, 20 aa, Entamoeba invadens
VLGFVSLFFLFNCSIFPPFL

SEQ ID NO: 2828216 - protein, 17 aa, Entamoeba invadens
VLGHWLDKYWNVCQNKP

SEQ ID NO: 2828217 - protein, 27 aa, Entamoeba invadens
VLGKGSFGIVWKGIYRHNIVAIKKMKE

SEQ ID NO: 2828218 - protein, 17 aa, Entamoeba invadens
VLGLSFLAVVTVSISSV

SEQ ID NO: 2828219 - protein, 28 aa, Entamoeba invadens
VLGLVIILTFIIFIAYQVLKYKSIDVDI

SEQ ID NO: 2828220 - protein, 18 aa, Entamoeba invadens
VLGMVLGYCLLFALCFSC

SEQ ID NO: 2828221 - protein, 21 aa, Entamoeba invadens
VLGQFLIYRLIHLANTLLLTA

SEQ ID NO: 2828222 - protein, 26 aa, Entamoeba invadens
VLGVLFIVAVIIIGVLFTLFVLSRRK

SEQ ID NO: 2828223 - protein, 20 aa, Entamoeba invadens
VLHAKNFLHYNIKPANVMLM

SEQ ID NO: 2828224 - protein, 20 aa, Entamoeba invadens
VLHDLWNDISKFAVYVLRSI

SEQ ID NO: 2828225 - protein, 18 aa, Entamoeba invadens
VLIILALSTCPLNEIEGT

SEQ ID NO: 2828226 - protein, 19 aa, Entamoeba invadens
VLIILSVVGVQTLMKRRRM

SEQ ID NO: 2828227 - protein, 18 aa, Entamoeba invadens
VLIKFHLFWDEFNINLHK

SEQ ID NO: 2828228 - protein, 27 aa, Entamoeba invadens
VLILILQVFTMLGFYVATQTTFLTPLQ

SEQ ID NO: 2828229 - protein, 29 aa, Entamoeba invadens
VLILLIPDWLTFKVLIPALLYQIAAHFYL

SEQ ID NO: 2828230 - protein, 17 aa, Entamoeba invadens
VLIMEKMLMCGKINGIQ

SEQ ID NO: 2828231 - protein, 17 aa, Entamoeba invadens
VLIRIRNVDLQPLVLLS

SEQ ID NO: 2828232 - protein, 25 aa, Entamoeba invadens
VLISFFTVYLFYRINLQAQFDSIYE

SEQ ID NO: 2828233 - protein, 18 aa, Entamoeba invadens
VLISIAMVVIMTIVLIKN

SEQ ID NO: 2828234 - protein, 17 aa, Entamoeba invadens
VLITLALSICPPNDIEG

SEQ ID NO: 2828235 - protein, 44 aa, Entamoeba invadens
VLITSLSVTFVVIVIIVVIVLLFTLSYLYNYFGNKKKMQNVCVF

SEQ ID NO: 2828236 - protein, 27 aa, Entamoeba invadens
VLKLSRLYYFIQPNPVEYYFAPYKSMR

SEQ ID NO: 2828237 - protein, 23 aa, Entamoeba invadens
VLKRMFWGLIPFFGNFFKQTETN

SEQ ID NO: 2828238 - protein, 28 aa, Entamoeba invadens
VLKTQPKQFLVLPKGAVIPAFSFQSAVS

SEQ ID NO: 2828239 - protein, 18 aa, Entamoeba invadens
VLKYIHCFTIPLLGFMNC

SEQ ID NO: 2828240 - protein, 27 aa, Entamoeba invadens
VLLATTLTILYCATSYYKDTSSNSCKR

SEQ ID NO: 2828241 - protein, 19 aa, Entamoeba invadens
VLLCVFLILFILVMIPPFK

SEQ ID NO: 2828242 - protein, 22 aa, Entamoeba invadens
VLLDFPTLYFKSCALNSDPGVC

SEQ ID NO: 2828243 - protein, 17 aa, Entamoeba invadens
VLLEGHLLRYGASDKIY

SEQ ID NO: 2828244 - protein, 45 aa, Entamoeba invadens
VLLEIIVEWTKHWFFNILEFDTAIRVFDFIIWNGFDCGALTVIVT

SEQ ID NO: 2828245 - protein, 30 aa, Entamoeba invadens
VLLEKIETKLLWFLSLMNSLLGRGVSSYRN

SEQ ID NO: 2828246 - protein, 20 aa, Entamoeba invadens
VLLFTFFMPSKIVPPKVRGY

SEQ ID NO: 2828247 - protein, 26 aa, Entamoeba invadens
VLLILILVAIYFLRKAMRYTTDKVRK

SEQ ID NO: 2828248 - protein, 19 aa, Entamoeba invadens
VLLIVILKSWFTVDTGFAA

SEQ ID NO: 2828249 - protein, 17 aa, Entamoeba invadens
VLLLKESSTIYFQNLSN

SEQ ID NO: 2828250 - protein, 17 aa, Entamoeba invadens
VLLLLILFIMLFKLFLI

SEQ ID NO: 2828251 - protein, 29 aa, Entamoeba invadens
VLLVLLVNTFLLGFAPFSINLFTLGNTCG

SEQ ID NO: 2828252 - protein, 17 aa, Entamoeba invadens
VLMIIFMILSKCLCKHK

SEQ ID NO: 2828253 - protein, 24 aa, Entamoeba invadens
VLMLNQFAFILMFSVLLDTFVVRS

SEQ ID NO: 2828254 - protein, 35 aa, Entamoeba invadens
VLNATKVLIVVLVVAFIFVINMLNNQRKLGLAENK

SEQ ID NO: 2828255 - protein, 25 aa, Entamoeba invadens
VLNDGFVLVNKLLDHFLSLLSANYT

SEQ ID NO: 2828256 - protein, 28 aa, Entamoeba invadens
VLNDILTWVFEFLCVVEVVLFWVFVIVW

SEQ ID NO: 2828257 - protein, 25 aa, Entamoeba invadens
VLNEMLFIPDLVKVYMIYRFRKIIG

SEQ ID NO: 2828258 - protein, 25 aa, Entamoeba invadens
VLNFTRIPCNFLVQIKSTDYMRVGV

SEQ ID NO: 2828259 - protein, 21 aa, Entamoeba invadens
VLNIPNVTTPLTLSLSLAQKN

SEQ ID NO: 2828260 - protein, 20 aa, Entamoeba invadens
VLNITNSILLYDFSQLNIAS

SEQ ID NO: 2828261 - protein, 17 aa, Entamoeba invadens
VLNIYTKQPTKLTFNVP

SEQ ID NO: 2828262 - protein, 25 aa, Entamoeba invadens
VLNLPLSRTIIASRTWMKIQSNEET

SEQ ID NO: 2828263 - protein, 26 aa, Entamoeba invadens
VLNNDYLECLLAYSNNTHFGCDTSES

SEQ ID NO: 2828264 - protein, 25 aa, Entamoeba invadens
VLNNDYTICRFDFIGGKSITFRSFN

SEQ ID NO: 2828265 - protein, 26 aa, Entamoeba invadens
VLNNDYTICRFDFIGGKSITFRSFNG

SEQ ID NO: 2828266 - protein, 18 aa, Entamoeba invadens
VLNNSLCVPFNQIKYCTS

SEQ ID NO: 2828267 - protein, 27 aa, Entamoeba invadens
VLNTGLHFLVLYRYYLRRVPKNISVMC

SEQ ID NO: 2828268 - protein, 25 aa, Entamoeba invadens
VLNTIRAYYVMCEILEFNEMKESES

SEQ ID NO: 2828269 - protein, 30 aa, Entamoeba invadens
VLNVIAPVVWFMLTPTMYVIIPIYAVCNFD

SEQ ID NO: 2828270 - protein, 38 aa, Entamoeba invadens
VLNVSSSILFLPFLILLSLFYFELMRFYLSSSQNLERL

SEQ ID NO: 2828271 - protein, 26 aa, Entamoeba invadens
VLPDRFGVYTILINYTKPLLSRLEFN

SEQ ID NO: 2828272 - protein, 27 aa, Entamoeba invadens
VLPVTKSLYFLYRDTAFSRPYQSIFIY

SEQ ID NO: 2828273 - protein, 27 aa, Entamoeba invadens
VLQCDDIILPLTIRYKILLDATKGVNY

SEQ ID NO: 2828274 - protein, 19 aa, Entamoeba invadens
VLQCFQKKIKQCDSSFIIY

SEQ ID NO: 2828275 - protein, 42 aa, Entamoeba invadens
VLQIRECFSLFLYHFGLLLATNIPYRALSLRLPILSVSANEE

SEQ ID NO: 2828276 - protein, 19 aa, Entamoeba invadens
VLRIYYHNKLLLTKEDINS

SEQ ID NO: 2828277 - protein, 25 aa, Entamoeba invadens
VLRQELGTWFFLNGTNNTLYITTLE

SEQ ID NO: 2828278 - protein, 35 aa, Entamoeba invadens
VLSDGTYGILLWDTKTSLIYFRKVSHKGKEEFTKP

SEQ ID NO: 2828279 - protein, 25 aa, Entamoeba invadens
VLSFIPFICIFTYKTSSNFKVTFNP

SEQ ID NO: 2828280 - protein, 18 aa, Entamoeba invadens
VLSFLDFSNITFYPSTVV

SEQ ID NO: 2828281 - protein, 22 aa, Entamoeba invadens
VLSLYCVAVLGGKYLGKYGAVG

SEQ ID NO: 2828282 - protein, 26 aa, Entamoeba invadens
VLSVKQLGWLNYKYGIYFNGTGTFNF

SEQ ID NO: 2828283 - protein, 17 aa, Entamoeba invadens
VLTDFFKVLRKMSQRSV

SEQ ID NO: 2828284 - protein, 25 aa, Entamoeba invadens
VLTEAFFPFIMSFIFMWTVAYSLVY

SEQ ID NO: 2828285 - protein, 24 aa, Entamoeba invadens
VLTELFKFLPVCDLSIREEVIVKI

SEQ ID NO: 2828286 - protein, 17 aa, Entamoeba invadens
VLTFDIVLYIGVSEEKR

SEQ ID NO: 2828287 - protein, 28 aa, Entamoeba invadens
VLTFVVYCCLILPLIMQCYLVFAHSNEI

SEQ ID NO: 2828288 - protein, 19 aa, Entamoeba invadens
VLTFWRFFCFSLMALTCLV

SEQ ID NO: 2828289 - protein, 18 aa, Entamoeba invadens
VLTLYLWIEAVHNNSPIL

SEQ ID NO: 2828290 - protein, 23 aa, Entamoeba invadens
VLTNFFGLLMPFIQHKFPVLKKL

SEQ ID NO: 2828291 - protein, 27 aa, Entamoeba invadens
VLTPKILLLYFLTFLSMTAFGGLGINI

SEQ ID NO: 2828292 - protein, 26 aa, Entamoeba invadens
VLTQLSVGELLSLKDGLESITTIFYH

SEQ ID NO: 2828293 - protein, 27 aa, Entamoeba invadens
VLTTFAENFIRFPYPGLPSTDLDGKKD

SEQ ID NO: 2828294 - protein, 25 aa, Entamoeba invadens
VLTTKKEIYFWKYSQLTIGDSATIY

SEQ ID NO: 2828295 - protein, 28 aa, Entamoeba invadens
VLVETKLVFLVMLDKKFRMLEAFPVKDL

SEQ ID NO: 2828296 - protein, 27 aa, Entamoeba invadens
VLVFANCVVLVFFLWSLRKVMLKQWPF

SEQ ID NO: 2828297 - protein, 25 aa, Entamoeba invadens
VLVFIAFLVFYLYQIHVASSFIIAF

SEQ ID NO: 2828298 - protein, 19 aa, Entamoeba invadens
VLVFSLDKNIPVFAKLTDF

SEQ ID NO: 2828299 - protein, 26 aa, Entamoeba invadens
VLVIVTIAILIITFTIPRKNKKQTFS

SEQ ID NO: 2828300 - protein, 20 aa, Entamoeba invadens
VLVLYERGLQLYVLPVPNVI

SEQ ID NO: 2828301 - protein, 25 aa, Entamoeba invadens
VLVSDFLFQFLRDSFNFYPTKIEID

SEQ ID NO: 2828302 - protein, 24 aa, Entamoeba invadens
VLVSLTRFMILFSSIIPISMRVNL

SEQ ID NO: 2828303 - protein, 24 aa, Entamoeba invadens
VLVSNRCVYYLDIPHCVKSGHSMC

SEQ ID NO: 2828304 - protein, 20 aa, Entamoeba invadens
VLVVGQWLTALFSINFQRDV

SEQ ID NO: 2828305 - protein, 20 aa, Entamoeba invadens
VLWGFWLLTGFVLSIGEVFQ

SEQ ID NO: 2828306 - protein, 25 aa, Entamoeba invadens
VLYELQSIRKCIIGYYSSLVKCLPC

SEQ ID NO: 2828307 - protein, 28 aa, Entamoeba invadens
VLYHARYIIVAFWFITFLGLCYPAVKFM

SEQ ID NO: 2828308 - protein, 27 aa, Entamoeba invadens
VLYNDFEGVLYFFAFGDELPETGDVIS

SEQ ID NO: 2828309 - protein, 18 aa, Entamoeba invadens
VLYNIPYIQNKWARSIFD

SEQ ID NO: 2828310 - protein, 18 aa, Entamoeba invadens
VLYNSTFFTLKIFSGKTS

SEQ ID NO: 2828311 - protein, 22 aa, Entamoeba invadens
VLYPIMGVYALYLAFYQEKGQP

SEQ ID NO: 2828312 - protein, 26 aa, Entamoeba invadens
VMAIKKIIHMYGPILVAIDASRSGLK

SEQ ID NO: 2828313 - protein, 18 aa, Entamoeba invadens
VMALKLRLLVNKLGKEKV

SEQ ID NO: 2828314 - protein, 22 aa, Entamoeba invadens
VMATVMFYRHQEDWYLDLGERS

SEQ ID NO: 2828315 - protein, 27 aa, Entamoeba invadens
VMAVVITSIVFVVYFIEKKIRQKKIEM

SEQ ID NO: 2828316 - protein, 38 aa, Entamoeba invadens
VMEGCDYYEIRSVPPLVTLKPGYACEFEIIIKPLCTCV

SEQ ID NO: 2828317 - protein, 28 aa, Entamoeba invadens
VMEKVMVLVPMTLSMRIKMSLDGAKGIL

SEQ ID NO: 2828318 - protein, 32 aa, Entamoeba invadens
VMETYTWQQVSLKLKIKMMLDCSLGISYLHNN

SEQ ID NO: 2828319 - protein, 25 aa, Entamoeba invadens
VMFGLYIIYFIYIITLTVIFMLLSG

SEQ ID NO: 2828320 - protein, 48 aa, Entamoeba invadens
VMFIVLFVMIGIYIGKWVFVPLIVFVVFLVFNILFGVLYGLFYTQFIR

SEQ ID NO: 2828321 - protein, 18 aa, Entamoeba invadens
VMFVSIYLYIHAYNAHAF

SEQ ID NO: 2828322 - protein, 28 aa, Entamoeba invadens
VMGTRSTWPVIQAMNWMSYALKNPEKYG

SEQ ID NO: 2828323 - protein, 21 aa, Entamoeba invadens
VMHFLKYCHFNGFFGEGAVTE

SEQ ID NO: 2828324 - protein, 20 aa, Entamoeba invadens
VMIIDQCNFGLLKTAQLVVT

SEQ ID NO: 2828325 - protein, 18 aa, Entamoeba invadens
VMIYVSFVDVLYGGIATS

SEQ ID NO: 2828326 - protein, 19 aa, Entamoeba invadens
VMKDNTFLILIENINFKND

SEQ ID NO: 2828327 - protein, 23 aa, Entamoeba invadens
VMKGCDYYEIRSVPPLVTLKPGY

SEQ ID NO: 2828328 - protein, 21 aa, Entamoeba invadens
VMKLRMKFLLDAAKGIQYLDE

SEQ ID NO: 2828329 - protein, 46 aa, Entamoeba invadens
VMKNSAIIVLSIISGLAVLFIIVAVIVCIVVTVLWRRKKSSEYQNL

SEQ ID NO: 2828330 - protein, 24 aa, Entamoeba invadens
VMKVLFNLAFPCVIFRSLSNTRTL

SEQ ID NO: 2828331 - protein, 19 aa, Entamoeba invadens
VMLEIVPLSMGLVKSVKAE

SEQ ID NO: 2828332 - protein, 17 aa, Entamoeba invadens
VMLLFIVVAISDQVWLL

SEQ ID NO: 2828333 - protein, 24 aa, Entamoeba invadens
VMMFVVIVIIISTTIFYVSSHKKI

SEQ ID NO: 2828334 - protein, 28 aa, Entamoeba invadens
VMNNETLFILILSFTTVLLGFIVIVMLI

SEQ ID NO: 2828335 - protein, 24 aa, Entamoeba invadens
VMRCLFRLRPFTDLIYKEMSGRCL

SEQ ID NO: 2828336 - protein, 23 aa, Entamoeba invadens
VMRPKLFPVFENCADDMWAQVRK

SEQ ID NO: 2828337 - protein, 40 aa, Entamoeba invadens
VMSDTEISIYFLYTTKFMVWSTYRFLLCDFSATSQVVLDR

SEQ ID NO: 2828338 - protein, 18 aa, Entamoeba invadens
VMSKYLTFVPLHIQEETP

SEQ ID NO: 2828339 - protein, 24 aa, Entamoeba invadens
VMSSILTVVLKYIKSNAPKLMIIA

SEQ ID NO: 2828340 - protein, 24 aa, Entamoeba invadens
VMTTKPVSLILPTSLTALTVDSCT

SEQ ID NO: 2828341 - protein, 25 aa, Entamoeba invadens
VMTYTFWLFFSFIRTFTERKKLGEK

SEQ ID NO: 2828342 - protein, 24 aa, Entamoeba invadens
VMVQQMIFLFSEFFCYMSSFGFDE

SEQ ID NO: 2828343 - protein, 27 aa, Entamoeba invadens
VMYTLVCQFIVFMIIFIDCYCNKNTYD

SEQ ID NO: 2828344 - protein, 32 aa, Entamoeba invadens
VNAFGVSPLFFKICNFLYLHFNFKNENFFTNQ

SEQ ID NO: 2828345 - protein, 23 aa, Entamoeba invadens
VNANNVLFVFRPDRICFSSSGNT

SEQ ID NO: 2828346 - protein, 40 aa, Entamoeba invadens
VNASMYYFIFILVILVVVVLLLVLIFFKSLLVALRVVFTT

SEQ ID NO: 2828347 - protein, 34 aa, Entamoeba invadens
VNASNEWNTLVFWETIMNYLKPNSINKENLHENL

SEQ ID NO: 2828348 - protein, 24 aa, Entamoeba invadens
VNCCHSLISIIQFLLDVDGRGETL

SEQ ID NO: 2828349 - protein, 24 aa, Entamoeba invadens
VNCLGRIWREVILQEFPIPNEQKE

SEQ ID NO: 2828350 - protein, 21 aa, Entamoeba invadens
VNCLLLSSYCPTLINYNLERC

SEQ ID NO: 2828351 - protein, 20 aa, Entamoeba invadens
VNDLISTTDFEFLKNCFVHM

SEQ ID NO: 2828352 - protein, 25 aa, Entamoeba invadens
VNDSLIYFVSSTYFKKGYFTNSEIR

SEQ ID NO: 2828353 - protein, 20 aa, Entamoeba invadens
VNFCILLARIIFNKEKIKQN

SEQ ID NO: 2828354 - protein, 20 aa, Entamoeba invadens
VNFPLKAIMDLQVEKDKDGK

SEQ ID NO: 2828355 - protein, 20 aa, Entamoeba invadens
VNFYCMVLAILYLPSSSGDE

SEQ ID NO: 2828356 - protein, 27 aa, Entamoeba invadens
VNGAVTYFIRSFTGCPYYSVPIKAEDT

SEQ ID NO: 2828357 - protein, 17 aa, Entamoeba invadens
VNGFYFDYNTQTCVLTP

SEQ ID NO: 2828358 - protein, 23 aa, Entamoeba invadens
VNGIVFEFLISKLQIWWMKKYNK

SEQ ID NO: 2828359 - protein, 30 aa, Entamoeba invadens
VNGIVFLIALFFLCFYWAGMFFIVCFWIMF

SEQ ID NO: 2828360 - protein, 25 aa, Entamoeba invadens
VNGKTCYQYAAKSPLVYVVLSAKRD

SEQ ID NO: 2828361 - protein, 24 aa, Entamoeba invadens
VNGKYYYLYKNDSSYWTLSTRFDC

SEQ ID NO: 2828362 - protein, 26 aa, Entamoeba invadens
VNGNDSLLFVIRKNLWSYNCFMVYLH

SEQ ID NO: 2828363 - protein, 23 aa, Entamoeba invadens
VNGNVVCFNLLGKVIWETNVGGP

SEQ ID NO: 2828364 - protein, 23 aa, Entamoeba invadens
VNGSGHYFLFTTYDASEYSEEIV

SEQ ID NO: 2828365 - protein, 26 aa, Entamoeba invadens
VNIEKLVFLVQSLTKALFTQKNYFRY

SEQ ID NO: 2828366 - protein, 24 aa, Entamoeba invadens
VNIENYLETPWRYGQTDNSLYVEF

SEQ ID NO: 2828367 - protein, 41 aa, Entamoeba invadens
VNIKLAISLPVAIIILLIVLLIVLIVFIRMSDKYNNNYKKM

SEQ ID NO: 2828368 - protein, 26 aa, Entamoeba invadens
VNIMVLKTFYPEDFVPSFFKTLNTCI

SEQ ID NO: 2828369 - protein, 31 aa, Entamoeba invadens
VNIQITKWYSIIFSTFKYYVLNSIQITNSLL

SEQ ID NO: 2828370 - protein, 18 aa, Entamoeba invadens
VNITGTEFLLMDAAIMKA

SEQ ID NO: 2828371 - protein, 17 aa, Entamoeba invadens
VNITKMFFLVQLEPKLS

SEQ ID NO: 2828372 - protein, 24 aa, Entamoeba invadens
VNITSLYNGYIIKFSFGIVTIKNS

SEQ ID NO: 2828373 - protein, 46 aa, Entamoeba invadens
VNLGAAIGIPMSILLVMIIIFLLIVITLIVIFKRNQKKEKLKVCTY

SEQ ID NO: 2828374 - protein, 32 aa, Entamoeba invadens
VNLHDFVFSRTTLVDVFAFRNSGIRAVITRAS

SEQ ID NO: 2828375 - protein, 27 aa, Entamoeba invadens
VNLSINKWYIPLVSNYQTYIFKSSLNV

SEQ ID NO: 2828376 - protein, 21 aa, Entamoeba invadens
VNLYSPFLFSTNSLSLDGSAD

SEQ ID NO: 2828377 - protein, 34 aa, Entamoeba invadens
VNMCRKKIGYPMRKFVIDWSLVPSDTSRIEKSTI

SEQ ID NO: 2828378 - protein, 25 aa, Entamoeba invadens
VNMKLKIKFMLDASKGLLYLHENGI

SEQ ID NO: 2828379 - protein, 24 aa, Entamoeba invadens
VNMLFDICLELGFFFTLKKSRKTS

SEQ ID NO: 2828380 - protein, 25 aa, Entamoeba invadens
VNMNQTCFDLIQKTWRQVPESRIDI

SEQ ID NO: 2828381 - protein, 24 aa, Entamoeba invadens
VNMSMIFLTVFVVPVGLNVAQLLS

SEQ ID NO: 2828382 - protein, 25 aa, Entamoeba invadens
VNNFPDILMPSAEDIKMMVACRVHI

SEQ ID NO: 2828383 - protein, 22 aa, Entamoeba invadens
VNNICRSPIGYMILENKIFGCQ

SEQ ID NO: 2828384 - protein, 26 aa, Entamoeba invadens
VNNRSVLWSFRILRKVRIILRDETHI

SEQ ID NO: 2828385 - protein, 25 aa, Entamoeba invadens
VNNVVFINVFLFLEILEIEESKNIL

SEQ ID NO: 2828386 - protein, 25 aa, Entamoeba invadens
VNPGFLYLVTFPWLFGIMFGDVGHG

SEQ ID NO: 2828387 - protein, 30 aa, Entamoeba invadens
VNSIIYPILYSIVLFCILALYTHSDFFNEH

SEQ ID NO: 2828388 - protein, 29 aa, Entamoeba invadens
VNSKTYYIYTINGTYYLSPRSDCKAPAIA

SEQ ID NO: 2828389 - protein, 25 aa, Entamoeba invadens
VNSNKIPLYLYLNVVGLELPETNNY

SEQ ID NO: 2828390 - protein, 24 aa, Entamoeba invadens
VNSPFEIVDFIPFDVSIKMNGAES

SEQ ID NO: 2828391 - protein, 26 aa, Entamoeba invadens
VNSRVIACKPGFYTQYFKLCNVCPDK

SEQ ID NO: 2828392 - protein, 34 aa, Entamoeba invadens
VNTFFEAFFLGYMMFYILAFFNLLRRPEKAKGFI

SEQ ID NO: 2828393 - protein, 17 aa, Entamoeba invadens
VNTFKTSFLLILLSTPL

SEQ ID NO: 2828394 - protein, 29 aa, Entamoeba invadens
VNTKRVEYPMWFLCLYDAAGKAAKTLETN

SEQ ID NO: 2828395 - protein, 22 aa, Entamoeba invadens
VNTLFMIYTFINFIATFATPAT

SEQ ID NO: 2828396 - protein, 47 aa, Entamoeba invadens
VNTNYGVVIGFPIACVVVFVIVIIAIVTVVLLLVFQKKDNKDAENVC

SEQ ID NO: 2828397 - protein, 28 aa, Entamoeba invadens
VNTPPVTLLYVFLFNDVMLETLPTTVDG

SEQ ID NO: 2828398 - protein, 17 aa, Entamoeba invadens
VNTSLMIAISLVVFVVV

SEQ ID NO: 2828399 - protein, 31 aa, Entamoeba invadens
VNTSSQFILYLFFEGILVPFLSQPVYYGMME

SEQ ID NO: 2828400 - protein, 22 aa, Entamoeba invadens
VNVALIVPLSIAGLVIVVVVVV

SEQ ID NO: 2828401 - protein, 31 aa, Entamoeba invadens
VNVEYYMDSFPFPHYILLNNLNELPNVLAEA

SEQ ID NO: 2828402 - protein, 27 aa, Entamoeba invadens
VNVGYWLVVLLFLPLLIVLTIVPMTNF

SEQ ID NO: 2828403 - protein, 20 aa, Entamoeba invadens
VNYITPCASFIYPQTLQTYT

SEQ ID NO: 2828404 - protein, 18 aa, Entamoeba invadens
VNYPIIYLEMAWVYRNQE

SEQ ID NO: 2828405 - protein, 25 aa, Entamoeba invadens
VNYSVLFSVLFWLINGVDAAGNISS

SEQ ID NO: 2828406 - protein, 28 aa, Entamoeba invadens
VPAFVMAFAMLIFFITRYKKTNIEVFKE

SEQ ID NO: 2828407 - protein, 22 aa, Entamoeba invadens
VPALIYFFQNILCQVSLANIQP

SEQ ID NO: 2828408 - protein, 19 aa, Entamoeba invadens
VPCNGSMIHFDLSENAFPY

SEQ ID NO: 2828409 - protein, 21 aa, Entamoeba invadens
VPDSSAINFILLALAIFAFLF

SEQ ID NO: 2828410 - protein, 24 aa, Entamoeba invadens
VPEEGIIMQEPNLRNFLLNVEEVR

SEQ ID NO: 2828411 - protein, 25 aa, Entamoeba invadens
VPERIFWYWIMLHLTYYEMIWSLFK

SEQ ID NO: 2828412 - protein, 24 aa, Entamoeba invadens
VPETIEFLIRGGIKVWMITGDKVE

SEQ ID NO: 2828413 - protein, 24 aa, Entamoeba invadens
VPFEPAFCYPLNIPNEFFNIQPTE

SEQ ID NO: 2828414 - protein, 18 aa, Entamoeba invadens
VPILFFVPTLLSNIAPFV

SEQ ID NO: 2828415 - protein, 18 aa, Entamoeba invadens
VPIRPFLSYLKASINNKS

SEQ ID NO: 2828416 - protein, 19 aa, Entamoeba invadens
VPIYIGEFGITKYCFWDRQ

SEQ ID NO: 2828417 - protein, 24 aa, Entamoeba invadens
VPKCYSECFTFFKSVLYCLIEVIG

SEQ ID NO: 2828418 - protein, 24 aa, Entamoeba invadens
VPKTLPSDPLLKADLRIFVTEKFK

SEQ ID NO: 2828419 - protein, 19 aa, Entamoeba invadens
VPLSRLKQLLLSEKSLCFD

SEQ ID NO: 2828420 - protein, 30 aa, Entamoeba invadens
VPLSVTFVMIVFIVAIIMIIISMIQKRKQK

SEQ ID NO: 2828421 - protein, 31 aa, Entamoeba invadens
VPLSVTVVIIVFIVAIILIVISMIQKRKQKK

SEQ ID NO: 2828422 - protein, 23 aa, Entamoeba invadens
VPLTFLFYEFILGSKVFNLFKRT

SEQ ID NO: 2828423 - protein, 17 aa, Entamoeba invadens
VPMQFLFELLDKLKVSK

SEQ ID NO: 2828424 - protein, 34 aa, Entamoeba invadens
VPMTFIPVWQSIVLPFLLGLILPVVSNIVPIRRV

SEQ ID NO: 2828425 - protein, 34 aa, Entamoeba invadens
VPNIITLKRGFACEFELFIKPLCSCQMKEEIRVI

SEQ ID NO: 2828426 - protein, 28 aa, Entamoeba invadens
VPSFVRAITFDLLFLIDFTLPKEQEERG

SEQ ID NO: 2828427 - protein, 31 aa, Entamoeba invadens
VPSGTPLLKFWAKIPNAFWWSDKMRARMEAV

SEQ ID NO: 2828428 - protein, 21 aa, Entamoeba invadens
VPSIVSLKPGYACEFEIFIKP

SEQ ID NO: 2828429 - protein, 23 aa, Entamoeba invadens
VPSNTNLSLCILCQAFDVNCESC

SEQ ID NO: 2828430 - protein, 21 aa, Entamoeba invadens
VPSTKYFNTMYSYSSRRVCGE

SEQ ID NO: 2828431 - protein, 21 aa, Entamoeba invadens
VPSVTRQIYFGKDAKINLLEN

SEQ ID NO: 2828432 - protein, 30 aa, Entamoeba invadens
VPVACHVFINLIRIQLLQFHVQNATIIALR

SEQ ID NO: 2828433 - protein, 31 aa, Entamoeba invadens
VPVVFGSMYFVICGCFLFTIVLWVFVICNKN

SEQ ID NO: 2828434 - protein, 19 aa, Entamoeba invadens
VPYLAQFNLFPLSTPEVKV

SEQ ID NO: 2828435 - protein, 23 aa, Entamoeba invadens
VPYPLPVIIGIDWGYDNIVVSTK

SEQ ID NO: 2828436 - protein, 31 aa, Entamoeba invadens
VPYVFLFFILFYLCFFLHTNGRHRFVYEEIL

SEQ ID NO: 2828437 - protein, 23 aa, Entamoeba invadens
VQAAIRFVLYFYKLVSISTRSTT

SEQ ID NO: 2828438 - protein, 29 aa, Entamoeba invadens
VQAHTFIDVPLRYWPFTYIAEIAFKYCAF

SEQ ID NO: 2828439 - protein, 25 aa, Entamoeba invadens
VQCGTPWYWILTGVGAPLMLTVTLI

SEQ ID NO: 2828440 - protein, 31 aa, Entamoeba invadens; identical to SEQ ID NO: 2808015

SEQ ID NO: 2828441 - protein, 19 aa, Entamoeba invadens
VQFDGKKIVFHVIEFTPNG

SEQ ID NO: 2828442 - protein, 22 aa, Entamoeba invadens
VQGFWLKFDLSTLENDTLYIDF

SEQ ID NO: 2828443 - protein, 22 aa, Entamoeba invadens
VQGWLGFAIFFGTTGLISVLFV

SEQ ID NO: 2828444 - protein, 19 aa, Entamoeba invadens
VQHFVLVRQPLLDSMTEPI

SEQ ID NO: 2828445 - protein, 25 aa, Entamoeba invadens
VQISKWYSVIFSTFNNYFLNSISKT

SEQ ID NO: 2828446 - protein, 20 aa, Entamoeba invadens
VQITFRITMLCTASVYDHIG

SEQ ID NO: 2828447 - protein, 26 aa, Entamoeba invadens
VQIVERMLLLLIKKDSALSRRVNFYL

SEQ ID NO: 2828448 - protein, 18 aa, Entamoeba invadens
VQLDLTQAYPILSTKIMA

SEQ ID NO: 2828449 - protein, 18 aa, Entamoeba invadens
VQLMKKLRHPCVLQFFGS

SEQ ID NO: 2828450 - protein, 23 aa, Entamoeba invadens
VQQRGLWLSMDGYNLMIYIDTCS

SEQ ID NO: 2828451 - protein, 23 aa, Entamoeba invadens
VQRSEFNLLLKYIKDNQPTLEAM

SEQ ID NO: 2828452 - protein, 26 aa, Entamoeba invadens
VQRVDRYFQRFIGWVQLHGVLEGKQY

SEQ ID NO: 2828453 - protein, 21 aa, Entamoeba invadens
VQSCMCFINAPYSVVNFKDFT

SEQ ID NO: 2828454 - protein, 29 aa, Entamoeba invadens
VQSDQWSNFLPLIIERFPVTIPENVPILL

SEQ ID NO: 2828455 - protein, 26 aa, Entamoeba invadens
VQSKYEIIVLPAMKFIGALSTKSDRV

SEQ ID NO: 2828456 - protein, 44 aa, Entamoeba invadens
VQSTHWILGVSITCSLLLALVMVLIIVVWFLSRKKTTSSRDRYS

SEQ ID NO: 2828457 - protein, 29 aa, Entamoeba invadens
VQSTSTFVYLVALSLQALTAYFVYIIIFK

SEQ ID NO: 2828458 - protein, 19 aa, Entamoeba invadens
VQTCQKCPYGFYKDVYSCK

SEQ ID NO: 2828459 - protein, 26 aa, Entamoeba invadens
VQTMIFNAFVFCQIFNEINSRKVNGE

SEQ ID NO: 2828460 - protein, 31 aa, Entamoeba invadens
VQTSIYLVIMVLAILIIFVAIYSFVIKPVIE

SEQ ID NO: 2828461 - protein, 24 aa, Entamoeba invadens
VQTTLLRWYTHIHKNLNEVIENSV

SEQ ID NO: 2828462 - protein, 26 aa, Entamoeba invadens
VQTWDILHFLVFLTTMLCLISKRGFN

SEQ ID NO: 2828463 - protein, 29 aa, Entamoeba invadens
VQVIFLVCVVIVSYSLFGSQPGYKCYINN

SEQ ID NO: 2828464 - protein, 25 aa, Entamoeba invadens
VQVMDRFRILLLSSTEDKNLVSVIH

SEQ ID NO: 2828465 - protein, 17 aa, Entamoeba invadens
VQYLYIAGYVKQSPNFA

SEQ ID NO: 2828466 - protein, 28 aa, Entamoeba invadens
VQYYFFYGFYILFSIILCLLGWMIYPSI

SEQ ID NO: 2828467 - protein, 22 aa, Entamoeba invadens
VQYYLHLPDIFDVTPTAGPISG

SEQ ID NO: 2828468 - protein, 28 aa, Entamoeba invadens
VRAGWSKMIFTFFLPATVFYQTATAINE

SEQ ID NO: 2828469 - protein, 24 aa, Entamoeba invadens
VRATFPFVLLLTGGTFMYMSKSIT

SEQ ID NO: 2828470 - protein, 20 aa, Entamoeba invadens
VRCVAVVFSVIPWVFSYPQR

SEQ ID NO: 2828471 - protein, 25 aa, Entamoeba invadens
VRDLKIPYTVWFSKSKRTLIEISNL

SEQ ID NO: 2828472 - protein, 17 aa, Entamoeba invadens
VRDTGILLLHKFCSKFS

SEQ ID NO: 2828473 - protein, 24 aa, Entamoeba invadens
VREHSIGFLLFKFSMKLIFQIMML

SEQ ID NO: 2828474 - protein, 22 aa, Entamoeba invadens
VRGVYGFQLLKYSVPDLSDQDL

SEQ ID NO: 2828475 - protein, 34 aa, Entamoeba invadens
VRHFFGYFFFGLFLFILLAFYLCVPFSYVTGLNL

SEQ ID NO: 2828476 - protein, 25 aa, Entamoeba invadens
VRISMTFPYPIIISKHFKSFRVVFD

SEQ ID NO: 2828477 - protein, 21 aa, Entamoeba invadens
VRKCVVCNTKYYPNSIGVCIN

SEQ ID NO: 2828478 - protein, 25 aa, Entamoeba invadens
VRKDLSLFWYLLPYTPTRGINTEEL

SEQ ID NO: 2828479 - protein, 23 aa, Entamoeba invadens
VRKTPLPPIYLYDEKKNKKFPGN

SEQ ID NO: 2828480 - protein, 20 aa, Entamoeba invadens
VRLKVFNTFFSSKIYSICSI

SEQ ID NO: 2828481 - protein, 29 aa, Entamoeba invadens
VRLLLPDNKQFLKFLLSLISLYICEGECH

SEQ ID NO: 2828482 - protein, 24 aa, Entamoeba invadens
VRNCALIHLLRTIYWASCEPPQSN

SEQ ID NO: 2828483 - protein, 23 aa, Entamoeba invadens
VRQCTHIHITSNFLFDENCGTIF

SEQ ID NO: 2828484 - protein, 18 aa, Entamoeba invadens
VRQMAGVLLRKKICRLWS

SEQ ID NO: 2828485 - protein, 22 aa, Entamoeba invadens
VRVYIFSLMFIVSTLCLESSLI

SEQ ID NO: 2828486 - protein, 19 aa, Entamoeba invadens
VRYRILYVLDALGKWSFLD

SEQ ID NO: 2828487 - protein, 26 aa, Entamoeba invadens
VSAFAILKLVFIAFIGFVGARWCGFN

SEQ ID NO: 2828488 - protein, 32 aa, Entamoeba invadens
VSAFCLNFSVYFFWLIIPIMMRDLGASPMEIG

SEQ ID NO: 2828489 - protein, 24 aa, Entamoeba invadens
VSAFWHGVYPGYYLTFLLVGFHKD

SEQ ID NO: 2828490 - protein, 33 aa, Entamoeba invadens
VSASLFVFLVLVIIFGFLIYYGLRYKKVDIDIY

SEQ ID NO: 2828491 - protein, 18 aa, Entamoeba invadens
VSCDAFWGRSSYGVWDGS

SEQ ID NO: 2828492 - protein, 24 aa, Entamoeba invadens
VSCNALPVFLISTLARMGSVWRRS

SEQ ID NO: 2828493 - protein, 19 aa, Entamoeba invadens
VSCNLDCDIAYSPIGIKYD

SEQ ID NO: 2828494 - protein, 21 aa, Entamoeba invadens
VSCSFWYVPSTDGTFCKNAPV

SEQ ID NO: 2828495 - protein, 50 aa, Entamoeba invadens
VSCSKTNWALIVPLVIVAIIIIIVLLLLFIGLIWWRRTKSVKAETAAIKP

SEQ ID NO: 2828496 - protein, 30 aa, Entamoeba invadens
VSDFLEFVLLFWVVLLILFSFTEVTNPINR

SEQ ID NO: 2828497 - protein, 19 aa, Entamoeba invadens
VSDFLINTQKLSFKLRKAR

SEQ ID NO: 2828498 - protein, 27 aa, Entamoeba invadens
VSDLHKPLIGIYKWGPSLAITQALNNL

SEQ ID NO: 2828499 - protein, 27 aa, Entamoeba invadens
VSDTEAIALCYLLKKKKLRFSISNLQN

SEQ ID NO: 2828500 - protein, 56 aa, Entamoeba invadens
VSDTGLYCEKAVVWWVILLIVLFCVLFIALFVILVMFLTLFVMRKTMKNKRPDNVN

SEQ ID NO: 2828501 - protein, 27 aa, Entamoeba invadens
VSDVGVFGLMIRLLPPPENTQCPKAIE

SEQ ID NO: 2828502 - protein, 22 aa, Entamoeba invadens
VSELPFITRVFAPTPKQAGNYA

SEQ ID NO: 2828503 - protein, 26 aa, Entamoeba invadens
VSFHDFYVKLIRLMGGPRDLHLSISM

SEQ ID NO: 2828504 - protein, 17 aa, Entamoeba invadens
VSFNFAFPQEKFEYPWK

SEQ ID NO: 2828505 - protein, 17 aa, Entamoeba invadens
VSFRTIGDIPLFITHNF

SEQ ID NO: 2828506 - protein, 23 aa, Entamoeba invadens
VSGFWCIVFCQLGVMKFFEVGAT

SEQ ID NO: 2828507 - protein, 26 aa, Entamoeba invadens
VSGKRLEKPIYLNGDIYNFVNDMWCQ

SEQ ID NO: 2828508 - protein, 21 aa, Entamoeba invadens
VSGLLVYFLLIKKKKSEFNQF

SEQ ID NO: 2828509 - protein, 29 aa, Entamoeba invadens
VSGVFVLIVFLILVGVIVFFVMKKKKSKS

SEQ ID NO: 2828510 - protein, 41 aa, Entamoeba invadens
VSGVIFLLSKFTKRWNFLWTLVFYSGFLVITIITTIVLVFV

SEQ ID NO: 2828511 - protein, 20 aa, Entamoeba invadens
VSHRTSIRFVPQSGTLSPGV

SEQ ID NO: 2828512 - protein, 41 aa, Entamoeba invadens
VSIAVCGVGLWIILYIFLMIGFFARYNYLTDLILYEQQKDE

SEQ ID NO: 2828513 - protein, 29 aa, Entamoeba invadens
VSICLYFCYWYLYHLVAFPILVCISMKYF

SEQ ID NO: 2828514 - protein, 21 aa, Entamoeba invadens
VSICTCAFLYLLMAISGNVSF

SEQ ID NO: 2828515 - protein, 22 aa, Entamoeba invadens
VSIGISIIWCNDEFFIDNNMCN

SEQ ID NO: 2828516 - protein, 29 aa, Entamoeba invadens
VSIGIVEAFLLIFAAWDLTTKESVLKCWL

SEQ ID NO: 2828517 - protein, 27 aa, Entamoeba invadens
VSIKPNCTYFFRGQLKFSRLDMKKGKY

SEQ ID NO: 2828518 - protein, 18 aa, Entamoeba invadens
VSISFTVLILIELLNIGF

SEQ ID NO: 2828519 - protein, 21 aa, Entamoeba invadens
VSIYMLYKYQILPQNKVMYFV

SEQ ID NO: 2828520 - protein, 25 aa, Entamoeba invadens
VSKLPFSHKVSIPDAWPLTKAACGK

SEQ ID NO: 2828521 - protein, 17 aa, Entamoeba invadens
VSKVLIRSAMKIAPFNL

SEQ ID NO: 2828522 - protein, 28 aa, Entamoeba invadens
VSLALFTGIFLLFLNYVFVIGRNETSME

SEQ ID NO: 2828523 - protein, 18 aa, Entamoeba invadens
VSLCFFPIDVIFSLGFSA

SEQ ID NO: 2828524 - protein, 26 aa, Entamoeba invadens
VSLGVRVLMMYVLQGLFHPARSVREP

SEQ ID NO: 2828525 - protein, 24 aa, Entamoeba invadens
VSLILLIMVLFILLKPFLLVVYGV

SEQ ID NO: 2828526 - protein, 41 aa, Entamoeba invadens
VSLLKCAVNLSFLFIAVVYQRNMFGVFIKKPIDGTPNPMND

SEQ ID NO: 2828527 - protein, 27 aa, Entamoeba invadens
VSLLLLIPLMFFFLGVNFFPVFKPVKS

SEQ ID NO: 2828528 - protein, 22 aa, Entamoeba invadens
VSLTMLGSVVAISFFTGEAIKI

SEQ ID NO: 2828529 - protein, 28 aa, Entamoeba invadens
VSLTSLFAWVYFLFGVLLFCMTHLHYFV

SEQ ID NO: 2828530 - protein, 17 aa, Entamoeba invadens
VSLVFGSCDVSYDSSSN

SEQ ID NO: 2828531 - protein, 25 aa, Entamoeba invadens
VSLYFDFLYYVMLSDLIIGVGMVFV

SEQ ID NO: 2828532 - protein, 24 aa, Entamoeba invadens
VSMGLFLFMLSLYITLFFLCVYVF

SEQ ID NO: 2828533 - protein, 32 aa, Entamoeba invadens
VSMLDKFRSDFIIHFYGACFIPSHIAMITEFA

SEQ ID NO: 2828534 - protein, 24 aa, Entamoeba invadens
VSMTYFLLKIPTIVMFLCLLVTVN

SEQ ID NO: 2828535 - protein, 24 aa, Entamoeba invadens
VSMVISFITILFSLVVYQYIPHFC

SEQ ID NO: 2828536 - protein, 19 aa, Entamoeba invadens
VSNALYALLFPVLVGLAIE

SEQ ID NO: 2828537 - protein, 24 aa, Entamoeba invadens
VSNEILLFDYITISKTVSITHINV

SEQ ID NO: 2828538 - protein, 27 aa, Entamoeba invadens
VSNPAWALWSLLVVALLWALPQSMTMA

SEQ ID NO: 2828539 - protein, 45 aa, Entamoeba invadens
VSNTKYGVVIGIPIALIIIIIIFVFIVLYLALKIHQRRIKHKVDK

SEQ ID NO: 2828540 - protein, 26 aa, Entamoeba invadens
VSPFVECKLPFLISFYPQHLNDINGT

SEQ ID NO: 2828541 - protein, 19 aa, Entamoeba invadens
VSPSYLYIVNFVILSFSVN

SEQ ID NO: 2828542 - protein, 28 aa, Entamoeba invadens
VSPTMECPLNYQWSLIGDILKLQQHIKN

SEQ ID NO: 2828543 - protein, 25 aa, Entamoeba invadens
VSQMQHIFTVNLIFCQLNAICLVQD

SEQ ID NO: 2828544 - protein, 32 aa, Entamoeba invadens
VSQRILQILFLFYTIVVFFPFNGVYVPIEQNI

SEQ ID NO: 2828545 - protein, 32 aa, Entamoeba invadens
VSQRKLASRKMLFSGLLVLVVLTSTLFMFVNK

SEQ ID NO: 2828546 - protein, 40 aa, Entamoeba invadens
VSSFLNSFFFERIMSLYLALLFRFHVFISTPEMLKKNANP

SEQ ID NO: 2828547 - protein, 29 aa, Entamoeba invadens
VSSHTVFLIYFYLEVLPIMKINFTVFKVS

SEQ ID NO: 2828548 - protein, 18 aa, Entamoeba invadens
VSSLFILLDLNPNSTRFK

SEQ ID NO: 2828549 - protein, 26 aa, Entamoeba invadens
VSSPNGCYFYYNADGVLCCNVSYIVV

SEQ ID NO: 2828550 - protein, 31 aa, Entamoeba invadens
VSSTYQSTYLLWFFLKFLHLGGNLCDVEKAD

SEQ ID NO: 2828551 - protein, 45 aa, Entamoeba invadens
VSTGHLQIVIWSDFLLNHLIFYFVLFTIIYVKYKKLNKKIKEQIA

SEQ ID NO: 2828552 - protein, 25 aa, Entamoeba invadens
VSTLVDWWYLPLCAVVINAIAFPSI

SEQ ID NO: 2828553 - protein, 23 aa, Entamoeba invadens
VSTTKGCLRCFGGYYLSDRMCVK

SEQ ID NO: 2828554 - protein, 24 aa, Entamoeba invadens
VSTTKGCLRCFSGYYLADRTCVKC

SEQ ID NO: 2828555 - protein, 24 aa, Entamoeba invadens
VSTTKGCLRCLSGYYLADHMCVKC

SEQ ID NO: 2828556 - protein, 23 aa, Entamoeba invadens
VSTYAFDQCYIKETTRNCFKYYD

SEQ ID NO: 2828557 - protein, 20 aa, Entamoeba invadens
VSTYALDQCYIKETTRNCFK

SEQ ID NO: 2828558 - protein, 22 aa, Entamoeba invadens
VSVCIWPFCTAVFWPVATGTIG

SEQ ID NO: 2828559 - protein, 25 aa, Entamoeba invadens
VSVFTMFRYATWYEVVFNLIAVVVS

SEQ ID NO: 2828560 - protein, 18 aa, Entamoeba invadens
VSVGLFVAYLCVFGWHEV

SEQ ID NO: 2828561 - protein, 18 aa, Entamoeba invadens
VSVGLIDTFLSYFPLNHE

SEQ ID NO: 2828562 - protein, 32 aa, Entamoeba invadens
VSVIPIAFLVLLWVLKSLTLMIIPLCTISVSF

SEQ ID NO: 2828563 - protein, 21 aa, Entamoeba invadens
VSVISNFEYPLNLKGVTELKC

SEQ ID NO: 2828564 - protein, 25 aa, Entamoeba invadens
VSVISSTIPLVFMSKNGYIVGNKVY

SEQ ID NO: 2828565 - protein, 24 aa, Entamoeba invadens
VSVKLMKKALTYKALLKERPDIII

SEQ ID NO: 2828566 - protein, 21 aa, Entamoeba invadens
VSVLTFYFISVNFYCSIRQST

SEQ ID NO: 2828567 - protein, 32 aa, Entamoeba invadens
VSVRKLYRYANWLDLVLLITGILGALASGILS

SEQ ID NO: 2828568 - protein, 20 aa, Entamoeba invadens
VSVTWRKNWTKDAPAMLLIT

SEQ ID NO: 2828569 - protein, 24 aa, Entamoeba invadens
VSYARFRLWVLPRYIIPAAINAGN

SEQ ID NO: 2828570 - protein, 17 aa, Entamoeba invadens
VTALKFVKIMLTNNTSI

SEQ ID NO: 2828571 - protein, 22 aa, Entamoeba invadens
VTALSFFTHFFAVNAPIIRRKT

SEQ ID NO: 2828572 - protein, 24 aa, Entamoeba invadens
VTAQPLFHTLFNSKEFITKCKEFE

SEQ ID NO: 2828573 - protein, 24 aa, Entamoeba invadens
VTATLSCVILIKKQPTLECSLYGF

SEQ ID NO: 2828574 - protein, 60 aa, Entamoeba invadens
VTCLALTLLIGSLLQMFLCIYSGILITIWIARIWLEKTFKWFFSVSLVASFIACLCLFVF

SEQ ID NO: 2828575 - protein, 23 aa, Entamoeba invadens
VTDAFVYYCRILKKIPVECPLED

SEQ ID NO: 2828576 - protein, 27 aa, Entamoeba invadens
VTDIFSLSFAFGGIYFVTSRMVIKDTI

SEQ ID NO: 2828577 - protein, 18 aa, Entamoeba invadens
VTDLFIGNVKYNAALNTK

SEQ ID NO: 2828578 - protein, 24 aa, Entamoeba invadens
VTDLLLFGHLSCEKVLIGASTRVV

SEQ ID NO: 2828579 - protein, 25 aa, Entamoeba invadens
VTECKSVGYYQANGRWNICGTGCST

SEQ ID NO: 2828580 - protein, 24 aa, Entamoeba invadens
VTEFAKFGSFLDLIKKRKNDPIDF

SEQ ID NO: 2828581 - protein, 23 aa, Entamoeba invadens
VTEFALYGSLADLLKRMKTDEVC

SEQ ID NO: 2828582 - protein, 23 aa, Entamoeba invadens
VTEKLRIKFLLDAAKGVFYLHEN

SEQ ID NO: 2828583 - protein, 24 aa, Entamoeba invadens
VTELLPRYGAFLEKHYLSVLNLLN

SEQ ID NO: 2828584 - protein, 18 aa, Entamoeba invadens
VTEMSWFGILLGVLIIFF

SEQ ID NO: 2828585 - protein, 17 aa, Entamoeba invadens
VTICYLNFLTTLSKIDL

SEQ ID NO: 2828586 - protein, 17 aa, Entamoeba invadens
VTILFALSLAVPVVRIF

SEQ ID NO: 2828587 - protein, 24 aa, Entamoeba invadens
VTIVIVIVIVRCGMRYRRTDIDVF

SEQ ID NO: 2828588 - protein, 26 aa, Entamoeba invadens
VTIVTFTFIDIVKNQILFYINSTYDN

SEQ ID NO: 2828589 - protein, 17 aa, Entamoeba invadens
VTIYTSTMLRKLNYDMV

SEQ ID NO: 2828590 - protein, 25 aa, Entamoeba invadens
VTKLEHFVLGFRLSLQCGVAASEAG

SEQ ID NO: 2828591 - protein, 18 aa, Entamoeba invadens
VTKPVDKCILEDTTYFIY

SEQ ID NO: 2828592 - protein, 24 aa, Entamoeba invadens
VTLDFLFDIDPSIGSIPVGQESRD

SEQ ID NO: 2828593 - protein, 19 aa, Entamoeba invadens
VTLFVFALSVCPPENIITT

SEQ ID NO: 2828594 - protein, 19 aa, Entamoeba invadens
VTLKPQETVMIFITAPQDE

SEQ ID NO: 2828595 - protein, 37 aa, Entamoeba invadens
VTLLVFVGVVALFLIIGVVVLGVQIFRRGKGKSFRGG

SEQ ID NO: 2828596 - protein, 23 aa, Entamoeba invadens
VTLRAALLIIYRTTTNSLLVKSC

SEQ ID NO: 2828597 - protein, 18 aa, Entamoeba invadens
VTLSNWYIKLNRKRFRGE

SEQ ID NO: 2828598 - protein, 17 aa, Entamoeba invadens
VTLVVAVKWCHFSDQIV

SEQ ID NO: 2828599 - protein, 27 aa, Entamoeba invadens
VTLYECLSWSLAYQPPQFKFPWEIADF

SEQ ID NO: 2828600 - protein, 35 aa, Entamoeba invadens
VTMFECFMWKEAYKGKIFKFPWGIAEFVVSGKRLK

SEQ ID NO: 2828601 - protein, 23 aa, Entamoeba invadens
VTMKLRLKIMLDAAKGISYLHEN

SEQ ID NO: 2828602 - protein, 17 aa, Entamoeba invadens
VTMVLVETKLVFLVMLD

SEQ ID NO: 2828603 - protein, 18 aa, Entamoeba invadens
VTNDLSKCLLCELNNSIT

SEQ ID NO: 2828604 - protein, 26 aa, Entamoeba invadens
VTNFFALLVMFISIIHFSFYNLVLSA

SEQ ID NO: 2828605 - protein, 32 aa, Entamoeba invadens
VTNFLFGFSFNFWFIFALRFLNGMLNGNIGVV

SEQ ID NO: 2828606 - protein, 22 aa, Entamoeba invadens
VTNHLFVSVEYFEGVLTVDLKN

SEQ ID NO: 2828607 - protein, 42 aa, Entamoeba invadens
VTNIVAVVLPIVFVVIFIVLVVVTLALIGFYIRNKKLENKRK

SEQ ID NO: 2828608 - protein, 18 aa, Entamoeba invadens
VTNLCLPCQNSESECLTC

SEQ ID NO: 2828609 - protein, 23 aa, Entamoeba invadens
VTNLLLFGLFISHVYLLASGKTT

SEQ ID NO: 2828610 - protein, 24 aa, Entamoeba invadens
VTNPSLFELKKMSNNRLIRICPSS

SEQ ID NO: 2828611 - protein, 17 aa, Entamoeba invadens
VTPILITVVFLNGKLNS

SEQ ID NO: 2828612 - protein, 23 aa, Entamoeba invadens
VTPVLMVIVFINGKLNKQQSSPA

SEQ ID NO: 2828613 - protein, 26 aa, Entamoeba invadens
VTRTKPRFIVGMEQLYPFTKFVEKKD

SEQ ID NO: 2828614 - protein, 20 aa, Entamoeba invadens
VTRYLQCFWSKGQFTDCTCK

SEQ ID NO: 2828615 - protein, 25 aa, Entamoeba invadens
VTSEWVFGLLSKRAGRKLFFTQLAR

SEQ ID NO: 2828616 - protein, 21 aa, Entamoeba invadens
VTSFMLVLLVFATCTMHYQMS

SEQ ID NO: 2828617 - protein, 25 aa, Entamoeba invadens
VTSFYHHFFTPFLSAVNRETKRNYL

SEQ ID NO: 2828618 - protein, 25 aa, Entamoeba invadens
VTSRLKIKFMLDGAKGLFYLHENGI

SEQ ID NO: 2828619 - protein, 25 aa, Entamoeba invadens
VTSTLLVDLTLSPALLLAFPRFFKL

SEQ ID NO: 2828620 - protein, 24 aa, Entamoeba invadens
VTTIAVCLLFSTFVYYSVVQPISK

SEQ ID NO: 2828621 - protein, 27 aa, Entamoeba invadens
VTTLVSLFVLVFLNKTKEMKMQIIKYN

SEQ ID NO: 2828622 - protein, 17 aa, Entamoeba invadens
VTTYRVMFTPNVKLNNS

SEQ ID NO: 2828623 - protein, 25 aa, Entamoeba invadens
VTVFQTSENCKLLRFPKGESGYAAS

SEQ ID NO: 2828624 - protein, 23 aa, Entamoeba invadens
VTVRLRYLLSRRTAYFVMKLQVE

SEQ ID NO: 2828625 - protein, 20 aa, Entamoeba invadens
VTVRYHHYFIISTNAESSTH

SEQ ID NO: 2828626 - protein, 29 aa, Entamoeba invadens
VTVVMNCLFIVWIYWNRYDIEGWKKLHQD

SEQ ID NO: 2828627 - protein, 27 aa, Entamoeba invadens
VTVVVGVLLIICILGSFVAFSFAVPHY

SEQ ID NO: 2828628 - protein, 22 aa, Entamoeba invadens
VVAAIFVLFVVALLVLGFVIDV

SEQ ID NO: 2828629 - protein, 36 aa, Entamoeba invadens
VVADLRKCHITMLLFVIFYWYTLTYRNIEVERQQIS

SEQ ID NO: 2828630 - protein, 25 aa, Entamoeba invadens
VVAFILFKFVLKCEVPWQIEFGGCV

SEQ ID NO: 2828631 - protein, 29 aa, Entamoeba invadens
VVAFSIFIACLIAFLVYTYNFGRIDIMEF

SEQ ID NO: 2828632 - protein, 28 aa, Entamoeba invadens
VVAIFIVAIVMIVLGQKLIKMHIRKKER

SEQ ID NO: 2828633 - protein, 17 aa, Entamoeba invadens
VVAPFVPWVLLSTSTSI

SEQ ID NO: 2828634 - protein, 22 aa, Entamoeba invadens
VVASFILILLFMRKVFAVYEAK

SEQ ID NO: 2828635 - protein, 19 aa, Entamoeba invadens
VVCDACKDGFFMDDTKTKC

SEQ ID NO: 2828636 - protein, 24 aa, Entamoeba invadens
VVCDACKDGFFMDDTKTKCITCDR

SEQ ID NO: 2828637 - protein, 23 aa, Entamoeba invadens
VVCVCVFVFWIIYYKFIKGIIEV

SEQ ID NO: 2828638 - protein, 18 aa, Entamoeba invadens
VVCVVVMVVVVIATVIIV

SEQ ID NO: 2828639 - protein, 20 aa, Entamoeba invadens
VVCVYPCVYCSNSTFCTKCD

SEQ ID NO: 2828640 - protein, 26 aa, Entamoeba invadens
VVDDLLLFPSAILNNLPISFLTEVAR

SEQ ID NO: 2828641 - protein, 27 aa, Entamoeba invadens
VVDLMAVFPSYMRVKRFIIVKDAPTEE

SEQ ID NO: 2828642 - protein, 32 aa, Entamoeba invadens
VVDQKIHLSDKLKLKFLWDASKGILYLHENGI

SEQ ID NO: 2828643 - protein, 20 aa, Entamoeba invadens
VVDSSSSLFFTFFAIILLML

SEQ ID NO: 2828644 - protein, 31 aa, Entamoeba invadens
VVECFLRLLLMLLLSLLLKSRPFVFKPLEID

SEQ ID NO: 2828645 - protein, 18 aa, Entamoeba invadens
VVEFIMYRMGGRIGFMSS

SEQ ID NO: 2828646 - protein, 26 aa, Entamoeba invadens
VVEGCDYYEIRTIPALVTLKKGEACE

SEQ ID NO: 2828647 - protein, 17 aa, Entamoeba invadens
VVELFCFSFWISVTVYF

SEQ ID NO: 2828648 - protein, 20 aa, Entamoeba invadens
VVEPKMTILPKKKACSVLAK

SEQ ID NO: 2828649 - protein, 24 aa, Entamoeba invadens
VVEVNLSFLFDLTEGYVMEISRAE

SEQ ID NO: 2828650 - protein, 18 aa, Entamoeba invadens
VVFALKALLPFVCSEACV

SEQ ID NO: 2828651 - protein, 18 aa, Entamoeba invadens
VVFCPKKQSFSFIDLQSK

SEQ ID NO: 2828652 - protein, 19 aa, Entamoeba invadens
VVFEFMTRSDVWASSVVLI

SEQ ID NO: 2828653 - protein, 34 aa, Entamoeba invadens
VVFFGCFYWIGVFFVIMFWITLVLHIIIIALQML

SEQ ID NO: 2828654 - protein, 17 aa, Entamoeba invadens
VVFKRGPNSPYNLIVDG

SEQ ID NO: 2828655 - protein, 25 aa, Entamoeba invadens
VVFNPYVIFAIAFFAGLAAGFGYQT

SEQ ID NO: 2828656 - protein, 17 aa, Entamoeba invadens
VVFTYACDKGLYENNGK

SEQ ID NO: 2828657 - protein, 18 aa, Entamoeba invadens
VVFVILYEEFGDKPFRVL

SEQ ID NO: 2828658 - protein, 17 aa, Entamoeba invadens
VVFVVVIGVVLLEAVKC

SEQ ID NO: 2828659 - protein, 17 aa, Entamoeba invadens
VVFYPYFLLHVFGFGKF

SEQ ID NO: 2828660 - protein, 36 aa, Entamoeba invadens
VVGAVVVFIVILAILIFVLTFLLRYEKIDINIFKQQ

SEQ ID NO: 2828661 - protein, 26 aa, Entamoeba invadens
VVGGLLIIAIIIVVIIIITVIIKKKK

SEQ ID NO: 2828662 - protein, 34 aa, Entamoeba invadens
VVGIPIVSVFIIVLIIISIIVVTIIVLQKRKETK

SEQ ID NO: 2828663 - protein, 29 aa, Entamoeba invadens
VVGKIRSHLFVFTVFLETVVGDKSFDLHQ

SEQ ID NO: 2828664 - protein, 24 aa, Entamoeba invadens
VVGLIGFLFFGGAVWSFFKTATTN

SEQ ID NO: 2828665 - protein, 39 aa, Entamoeba invadens
VVGLPVACVVVFVVIFISIITIIVLFVLKKNTNEHTENI

SEQ ID NO: 2828666 - protein, 28 aa, Entamoeba invadens
VVGQFAIRFLPAEKFTHLKDLILGAEKE

SEQ ID NO: 2828667 - protein, 23 aa, Entamoeba invadens
VVGVIAFVALILGTIVFIVRHRR

SEQ ID NO: 2828668 - protein, 32 aa, Entamoeba invadens
VVGVLLLILVISIIVAIIVWKYKMRKTEDKAK

SEQ ID NO: 2828669 - protein, 31 aa, Entamoeba invadens
VVGVVVIVFILLLVVFVIVARTIILKNKKNV

SEQ ID NO: 2828670 - protein, 30 aa, Entamoeba invadens
VVHFTICETIKWILRIIIKKKENKAMLFHE

SEQ ID NO: 2828671 - protein, 19 aa, Entamoeba invadens
VVHITKFTFGANGFLRLIT

SEQ ID NO: 2828672 - protein, 25 aa, Entamoeba invadens
VVHVIHFVLDFPPPTPFLTQDKIFE

SEQ ID NO: 2828673 - protein, 25 aa, Entamoeba invadens
VVICMFIVSVIFLVVTFTLKCKDFT

SEQ ID NO: 2828674 - protein, 24 aa, Entamoeba invadens
VVICMIIPFCVFIKDFSWNENDNE

SEQ ID NO: 2828675 - protein, 18 aa, Entamoeba invadens
VVIFCVFGAIVVVSICMI

SEQ ID NO: 2828676 - protein, 17 aa, Entamoeba invadens
VVIFGTAITKKIVKRVY

SEQ ID NO: 2828677 - protein, 19 aa, Entamoeba invadens
VVIFMRQFKRRQIDFKKYL

SEQ ID NO: 2828678 - protein, 33 aa, Entamoeba invadens
VVIGIPITVLILLVIFILLNKRQVKKNKMSVFL

SEQ ID NO: 2828679 - protein, 43 aa, Entamoeba invadens
VVIGIPITVVVLLILTITLLIIILFFILQRYNHKQQMQNVCVF

SEQ ID NO: 2828680 - protein, 43 aa, Entamoeba invadens
VVIGIPITVVVLLILTITLLIVILFYILQRYSHKQQMQNVCVF

SEQ ID NO: 2828681 - protein, 41 aa, Entamoeba invadens
VVIGIPVAVFIVFIILIAIVLVVVFLIIMKKKEKKKMKNIC

SEQ ID NO: 2828682 - protein, 17 aa, Entamoeba invadens
VVILLPGGYPKEFSKIT

SEQ ID NO: 2828683 - protein, 17 aa, Entamoeba invadens
VVINLSCVHYSQIKFCV

SEQ ID NO: 2828684 - protein, 24 aa, Entamoeba invadens
VVIPLCAIPFWYVQIPLVCVGCAL

SEQ ID NO: 2828685 - protein, 30 aa, Entamoeba invadens
VVISFQMREIIISTFPFLEKYKYTTLKLSQ

SEQ ID NO: 2828686 - protein, 17 aa, Entamoeba invadens
VVISIASTGKEPDPHCS

SEQ ID NO: 2828687 - protein, 26 aa, Entamoeba invadens
VVITLFHKYLMPFVQKYILSRITALR

SEQ ID NO: 2828688 - protein, 28 aa, Entamoeba invadens
VVIVPHMKMIFWWILTNFGSNKEVLSLV

SEQ ID NO: 2828689 - protein, 19 aa, Entamoeba invadens
VVIWTFCFCISIPVYMKPC

SEQ ID NO: 2828690 - protein, 18 aa, Entamoeba invadens
VVIYECNNGFLLYDGICI

SEQ ID NO: 2828691 - protein, 30 aa, Entamoeba invadens
VVKDMGFKMGISYLPTLPLNESDLVPNEYK

SEQ ID NO: 2828692 - protein, 18 aa, Entamoeba invadens
VVKKLIVVPNAISAYPIT

SEQ ID NO: 2828693 - protein, 18 aa, Entamoeba invadens
VVKLPKIVKIGNAIYENC

SEQ ID NO: 2828694 - protein, 23 aa, Entamoeba invadens
VVKPHPQFMLFATQNPPNTYGGR

SEQ ID NO: 2828695 - protein, 17 aa, Entamoeba invadens
VVLDATRGILYLHENGI

SEQ ID NO: 2828696 - protein, 18 aa, Entamoeba invadens
VVLELIRRWYNTSTQLLC

SEQ ID NO: 2828697 - protein, 18 aa, Entamoeba invadens
VVLKKAYLKRITSLKNGE

SEQ ID NO: 2828698 - protein, 27 aa, Entamoeba invadens
VVLKKEFFRIIVWFNVEFETVDRNKSP

SEQ ID NO: 2828699 - protein, 34 aa, Entamoeba invadens
VVLNSGYDALITAPLILLYARSRKITGASLRCDN

SEQ ID NO: 2828700 - protein, 23 aa, Entamoeba invadens
VVLPTTILFYPHPDFAIACIAIT

SEQ ID NO: 2828701 - protein, 24 aa, Entamoeba invadens
VVLSLFYVVASYKKSLKPLCVGIS

SEQ ID NO: 2828702 - protein, 23 aa, Entamoeba invadens
VVLTLLVFIVLSFYPNLSMMNFS

SEQ ID NO: 2828703 - protein, 25 aa, Entamoeba invadens
VVLTPNQYIWRVLRNVSENCTEDDL

SEQ ID NO: 2828704 - protein, 37 aa, Entamoeba invadens
VVLYWEQENWVSNYIFLFLGILALGMSVIMGNSIIAL

SEQ ID NO: 2828705 - protein, 37 aa, Entamoeba invadens
VVMSVMYITLPFLWIYMMILSGGLWYSAMRKGNKKAS

SEQ ID NO: 2828706 - protein, 17 aa, Entamoeba invadens
VVMVLMESLLFGLYWNF

SEQ ID NO: 2828707 - protein, 17 aa, Entamoeba invadens
VVNFYGSVFIPNKICMV

SEQ ID NO: 2828708 - protein, 26 aa, Entamoeba invadens
VVNKQLMYNQLLWGPMHELNHHYEGS

SEQ ID NO: 2828709 - protein, 25 aa, Entamoeba invadens
VVNQHLLLLDYLQTSIILDLLGQSE

SEQ ID NO: 2828710 - protein, 26 aa, Entamoeba invadens
VVPHKQFYKQYLVLNRLAFKTELTDI

SEQ ID NO: 2828711 - protein, 41 aa, Entamoeba invadens
VVPITVICLLAALFCCIFLPDLPFILLGLTLTAICCIISIA

SEQ ID NO: 2828712 - protein, 18 aa, Entamoeba invadens
VVPTAILLSIVSAGIAVV

SEQ ID NO: 2828713 - protein, 35 aa, Entamoeba invadens
VVQATYQLFVLLFLLYCGRYITFLGAPCAYVKHGD

SEQ ID NO: 2828714 - protein, 26 aa, Entamoeba invadens
VVQNSIKWKLPFTALKISESFVDVKN

SEQ ID NO: 2828715 - protein, 25 aa, Entamoeba invadens
VVQRKAFVFLFGYILISICMIRVGI

SEQ ID NO: 2828716 - protein, 18 aa, Entamoeba invadens
VVSLFKSAFLIVTMTEGP

SEQ ID NO: 2828717 - protein, 22 aa, Entamoeba invadens
VVSSTYYLFKYLMVGWGTPSIG

SEQ ID NO: 2828718 - protein, 35 aa, Entamoeba invadens
VVSSVFAFFVFVIIFGVLLFFSLRYKKVDINIYKT

SEQ ID NO: 2828719 - protein, 33 aa, Entamoeba invadens
VVSVSVSVVVLVALFFLTIAVVGVIISHRQDKK

SEQ ID NO: 2828720 - protein, 24 aa, Entamoeba invadens
VVSVVLILVRLFFQLPGFCIKPNA

SEQ ID NO: 2828721 - protein, 22 aa, Entamoeba invadens
VVTAQICHFWGRADLRAKAEDN

SEQ ID NO: 2828722 - protein, 20 aa, Entamoeba invadens
VVTRYFFFRNDFTNSILVCK

SEQ ID NO: 2828723 - protein, 37 aa, Entamoeba invadens
VVTVSVCVFVLILLCVVTLLCVVLLKCVKKNKVQKLV

SEQ ID NO: 2828724 - protein, 34 aa, Entamoeba invadens
VVTVVVLIVIILIIFIILISWKMIHKNSATKNIK

SEQ ID NO: 2828725 - protein, 19 aa, Entamoeba invadens
VVTWIVSGTTQYLFIHSKY

SEQ ID NO: 2828726 - protein, 31 aa, Entamoeba invadens
VVVALVVALIAVSIGLFKTYQLVSSAMKNVV

SEQ ID NO: 2828727 - protein, 30 aa, Entamoeba invadens
VVVALVVALIAVSIGLFNNYQLVSSAMKNV

SEQ ID NO: 2828728 - protein, 17 aa, Entamoeba invadens
VVVFLCSVLLFGISQNF

SEQ ID NO: 2828729 - protein, 40 aa, Entamoeba invadens
VVVFQKLIGMWLYVWGITALLWICVWWQRWELKEIYQHRH

SEQ ID NO: 2828730 - protein, 26 aa, Entamoeba invadens
VVVFSIIVFLIFHTYFVRSSIEMQRI

SEQ ID NO: 2828731 - protein, 18 aa, Entamoeba invadens
VVVGFYFFAWKSIPVTFV

SEQ ID NO: 2828732 - protein, 38 aa, Entamoeba invadens
VVVGIPIVSVFIIILIIISIIVITIVVLQKRKETKKME

SEQ ID NO: 2828733 - protein, 39 aa, Entamoeba invadens
VVVGIPIVSVFIIVLIIIGIIVITIIVLQKRKETKKMEN

SEQ ID NO: 2828734 - protein, 40 aa, Entamoeba invadens
VVVGIPIVSVFIIVLIIIGIIVITIIVLQKRKETKKMENI

SEQ ID NO: 2828735 - protein, 35 aa, Entamoeba invadens
VVVGIPIVSVFIIVLIIIGIIVITIVVLQKRKETK

SEQ ID NO: 2828736 - protein, 40 aa, Entamoeba invadens
VVVGIPIVSVFIIVLIIISIIVIIIVVLQKRKETKKMENV

SEQ ID NO: 2828737 - protein, 37 aa, Entamoeba invadens
VVVGIPIVSVFIIVLINISIIVVTIIVLQKRKETKKM

SEQ ID NO: 2828738 - protein, 40 aa, Entamoeba invadens
VVVGIPIVSVFIIVLVIISIIIITIVVLQKRKETKKMENI

SEQ ID NO: 2828739 - protein, 37 aa, Entamoeba invadens
VVVGIPIVSVFVIILIIISIIVITIVVLQKRKETKKM

SEQ ID NO: 2828740 - protein, 37 aa, Entamoeba invadens
VVVGIPIVSVIILILIIICIIVVTIIVIQKRKETKKM

SEQ ID NO: 2828741 - protein, 40 aa, Entamoeba invadens
VVVGVPIVSVFIIVLIIIGIIIITIFVIQKRKETKKMENI

SEQ ID NO: 2828742 - protein, 25 aa, Entamoeba invadens
VVVICLIIPFCVFIKDFSWNEEDNE

SEQ ID NO: 2828743 - protein, 26 aa, Entamoeba invadens
VVVILLVIMVIIVIASTRYKKVDINI

SEQ ID NO: 2828744 - protein, 27 aa, Entamoeba invadens
VVVITTMILIVILGLFIFSMYRKNQKV

SEQ ID NO: 2828745 - protein, 17 aa, Entamoeba invadens
VVVLLLVIPFMVVGVVG

SEQ ID NO: 2828746 - protein, 20 aa, Entamoeba invadens
VVVLPKIFHAFQSNVIYNDF

SEQ ID NO: 2828747 - protein, 27 aa, Entamoeba invadens
VVVQQKLHFTELLSVELLPLSKDLCSK

SEQ ID NO: 2828748 - protein, 25 aa, Entamoeba invadens
VVVVVISLLVLLVVLFVVFKQNNQH

SEQ ID NO: 2828749 - protein, 28 aa, Entamoeba invadens
VVVYIFFPKQWLSLITYILIGLSIIAGL

SEQ ID NO: 2828750 - protein, 27 aa, Entamoeba invadens
VVVYIFNLGILLTRIKALLALKAPRGK

SEQ ID NO: 2828751 - protein, 17 aa, Entamoeba invadens
VVYDYYYYDIKPYPFMD

SEQ ID NO: 2828752 - protein, 19 aa, Entamoeba invadens
VVYFKTESFPYKNILRNLL

SEQ ID NO: 2828753 - protein, 21 aa, Entamoeba invadens
VVYICPMSIMMLWPRVEKFGS

SEQ ID NO: 2828754 - protein, 19 aa, Entamoeba invadens
VVYQTVDEIPLREFLKKDN

SEQ ID NO: 2828755 - protein, 32 aa, Entamoeba invadens
VVYSKGHFVTNLLLIWFPIKINNFQAYMLDMA

SEQ ID NO: 2828756 - protein, 23 aa, Entamoeba invadens
VVYSKTPFSFKPPEGMLSLMDNK

SEQ ID NO: 2828757 - protein, 26 aa, Entamoeba invadens
VVYSTHSMFLAFSLLYLGAEGETKNE

SEQ ID NO: 2828758 - protein, 24 aa, Entamoeba invadens
VWENFYYLLVPLMVSLVGCFFSTY

SEQ ID NO: 2828759 - protein, 22 aa, Entamoeba invadens
VWNNKKIWYRAFNQGMVQFKRT

SEQ ID NO: 2828760 - protein, 28 aa, Entamoeba invadens
VWTGPQYGAFMYWMLAKESLGHTFSDAY

SEQ ID NO: 2828761 - protein, 17 aa, Entamoeba invadens
VWYSFFLNHPVASLLFT

SEQ ID NO: 2828762 - protein, 21 aa, Entamoeba invadens
VYAGLVFAWPKYIEKYVKDYM

SEQ ID NO: 2828763 - protein, 21 aa, Entamoeba invadens
VYAVLFYFFELVSLKFKKLDD

SEQ ID NO: 2828764 - protein, 18 aa, Entamoeba invadens
VYGEIFAENGFLQRSDRK

SEQ ID NO: 2828765 - protein, 19 aa, Entamoeba invadens
VYICPMSIMMLWPRVEKFG

SEQ ID NO: 2828766 - protein, 34 aa, Entamoeba invadens
VYISTDVLYRENLKYFIEIAKKFKPTILVGVPRL

SEQ ID NO: 2828767 - protein, 19 aa, Entamoeba invadens
VYIVFLLIAVIVVVAHASL

SEQ ID NO: 2828768 - protein, 26 aa, Entamoeba invadens
VYKNGNMTYLRLPFNLSSYEYSNSIG

SEQ ID NO: 2828769 - protein, 21 aa, Entamoeba invadens
VYLCIPAIVLFLFKIVRYGVS

SEQ ID NO: 2828770 - protein, 18 aa, Entamoeba invadens
VYLGEFRGYKVAIKKMKE

SEQ ID NO: 2828771 - protein, 19 aa, Entamoeba invadens
VYLSLQFYVYYQADDNNTR

SEQ ID NO: 2828772 - protein, 26 aa, Entamoeba invadens
VYMHSMGYQFFYYVKQNIEAFVYFKG

SEQ ID NO: 2828773 - protein, 18 aa, Entamoeba invadens
VYMIYRFRKIIGSNMDKL

SEQ ID NO: 2828774 - protein, 18 aa, Entamoeba invadens
VYNFDFSIFAKLLTKYTV

SEQ ID NO: 2828775 - protein, 30 aa, Entamoeba invadens
VYPDNITFPAYYWHFKIGIKGTYGTERNQG

SEQ ID NO: 2828776 - protein, 23 aa, Entamoeba invadens
VYPKMETNFFKARVAFVLGVLFN

SEQ ID NO: 2828777 - protein, 25 aa, Entamoeba invadens
VYQPILKYLIPKWIAPNIISIFGLV

SEQ ID NO: 2828778 - protein, 25 aa, Entamoeba invadens
VYQQGKFLYLFDVVTQKSFVLQDLP

SEQ ID NO: 2828779 - protein, 24 aa, Entamoeba invadens
VYQYIPHFCIYLLSTAIGHFLVTS

SEQ ID NO: 2828780 - protein, 25 aa, Entamoeba invadens
VYRIPPRYFYLMLNPRFVAEKITEA

SEQ ID NO: 2828781 - protein, 21 aa, Entamoeba invadens
VYSFAICMLEIWLGRDPYDPA

SEQ ID NO: 2828782 - protein, 22 aa, Entamoeba invadens
VYSFAICMLEIWLGRDPYDPAK

SEQ ID NO: 2828783 - protein, 23 aa, Entamoeba invadens
VYSFAICMLEIWLGRDPYDPAKF

SEQ ID NO: 2828784 - protein, 24 aa, Entamoeba invadens
VYSFAITMFEIDVWGEAFPSEEFA

SEQ ID NO: 2828785 - protein, 34 aa, Entamoeba invadens
VYSFAMTMFEVFLWEFSFKEEQFKYAWSIADYTS

SEQ ID NO: 2828786 - protein, 39 aa, Entamoeba invadens
VYSFAMTMYEAFTWDFAFKNTDVQFKYAWSIADFTSSGK

SEQ ID NO: 2828787 - protein, 27 aa, Entamoeba invadens
VYSFAVSMFEIITWNEVFKKEDSRFKY

SEQ ID NO: 2828788 - protein, 38 aa, Entamoeba invadens
VYSFSITMYEAFTWDFAFKNTDVQFKYAWSIADFTSSG

SEQ ID NO: 2828789 - protein, 21 aa, Entamoeba invadens
VYSFTITMYEVFGWSNAYPKE

SEQ ID NO: 2828790 - protein, 17 aa, Entamoeba invadens
VYSIFGCISCEIGYYLS

SEQ ID NO: 2828791 - protein, 17 aa, Entamoeba invadens
VYSIMPIRTTLPRGTKL

SEQ ID NO: 2828792 - protein, 32 aa, Entamoeba invadens
VYSKNTIHFIGTKLFLFNSASLVTPIIEFESC

SEQ ID NO: 2828793 - protein, 24 aa, Entamoeba invadens
VYSLKNIFEFFKQSNLVLNSSQST

SEQ ID NO: 2828794 - protein, 17 aa, Entamoeba invadens
VYSLSIDWCWEGDVLNC

SEQ ID NO: 2828795 - protein, 24 aa, Entamoeba invadens
VYSRSNFTFGFFPFSCCVSGADEE

SEQ ID NO: 2828796 - protein, 27 aa, Entamoeba invadens
VYTFLWAEIAVLFLLLVPLPAILARQI

SEQ ID NO: 2828797 - protein, 27 aa, Entamoeba invadens
VYTLTSLPQIVLLKPNFACEFEMFLTP

SEQ ID NO: 2828798 - protein, 27 aa, Entamoeba invadens
VYTMGRCLSCKLSFYLTQDSPPKCLPC

SEQ ID NO: 2828799 - protein, 25 aa, Entamoeba invadens
VYTNPYLMFFIMLVFSVSHGYFGSW

SEQ ID NO: 2828800 - protein, 17 aa, Entamoeba invadens
VYTPITSTFLILKDKMC

SEQ ID NO: 2828801 - protein, 26 aa, Entamoeba invadens
VYTSVTFFLCFLVCCLVSNLFVEEEQ

SEQ ID NO: 2828802 - protein, 18 aa, Entamoeba invadens
VYVHCPYCPNERLERWWF

SEQ ID NO: 2828803 - protein, 19 aa, Entamoeba invadens
VYVPLVVFVVFVALNVFFG

SEQ ID NO: 2828804 - protein, 34 aa, Entamoeba invadens
VYVSTDVLYRENLKYFIEIAKKFKPTLVVGVPRF

SEQ ID NO: 2828805 - protein, 18 aa, Entamoeba invadens
VYWGLMVLHMLNKVTEED

SEQ ID NO: 2828806 - protein, 17 aa, Entamoeba invadens
WACDCPQKKYGSRGDRY

SEQ ID NO: 2828807 - protein, 27 aa, Entamoeba invadens
WADSGLAVLYLMQKIRRWVVCVIILFI

SEQ ID NO: 2828808 - protein, 19 aa, Entamoeba invadens
WCGEGFYLDTYHGKYNYTC

SEQ ID NO: 2828809 - protein, 27 aa, Entamoeba invadens
WCIYATAIRFMFTPLRLVILRRYCFMQ

SEQ ID NO: 2828810 - protein, 25 aa, Entamoeba invadens
WCQTLKLFMLVLVGVGSQKIENVIL

SEQ ID NO: 2828811 - protein, 20 aa, Entamoeba invadens
WCRPCTLICSLFEKLSSQNK

SEQ ID NO: 2828812 - protein, 18 aa, Entamoeba invadens
WCWTDIPSQRPRAEQVCE

SEQ ID NO: 2828813 - protein, 20 aa, Entamoeba invadens
WCYPCYAVVTSLLLCVTSFS

SEQ ID NO: 2828814 - protein, 23 aa, Entamoeba invadens
WDEAYPKNKFKFPWEIVNFVVAE

SEQ ID NO: 2828815 - protein, 20 aa, Entamoeba invadens
WDGHKMLVIAPNSSLKKLTI

SEQ ID NO: 2828816 - protein, 18 aa, Entamoeba invadens
WDKAYKEIKFAFQIANYV

SEQ ID NO: 2828817 - protein, 27 aa, Entamoeba invadens
WDNFSHEYILAFFGIIGGIGGGAVFPF

SEQ ID NO: 2828818 - protein, 24 aa, Entamoeba invadens
WDVKPYCFVPHKESILYHNGVYVG

SEQ ID NO: 2828819 - protein, 18 aa, Entamoeba invadens
WECKILEKYPKFVPSKCV

SEQ ID NO: 2828820 - protein, 25 aa, Entamoeba invadens
WEDGRLYLTNYRLMWIVSNEIINPV

SEQ ID NO: 2828821 - protein, 17 aa, Entamoeba invadens
WEIIPIEEVLLVSCVVY

SEQ ID NO: 2828822 - protein, 35 aa, Entamoeba invadens
WENERFFVNKLFSFVIMYLIRELSTTFYRLCCYII

SEQ ID NO: 2828823 - protein, 45 aa, Entamoeba invadens
WESLPYGEFVFLFDFMHTINIIYLLYISSILFLNYINSKKTINQY

SEQ ID NO: 2828824 - protein, 17 aa, Entamoeba invadens
WEVPFEQKGIITIPVCF

SEQ ID NO: 2828825 - protein, 20 aa, Entamoeba invadens
WEWMNCFMTAGTFKAFLNLL

SEQ ID NO: 2828826 - protein, 20 aa, Entamoeba invadens
WFKMFCIWYTGEICLSKYIG

SEQ ID NO: 2828827 - protein, 19 aa, Entamoeba invadens
WFLATFAYATLMNTIPICG

SEQ ID NO: 2828828 - protein, 18 aa, Entamoeba invadens
WFSIQKFPEYKVPTVPIL

SEQ ID NO: 2828829 - protein, 19 aa, Entamoeba invadens
WFTFIEVFGFIFLTGGFLL

SEQ ID NO: 2828830 - protein, 20 aa, Entamoeba invadens
WFVFAVSVVPILFFVPTLLS

SEQ ID NO: 2828831 - protein, 28 aa, Entamoeba invadens
WFYFCPTSLLLWLFTGGITYFLGTLFFS

SEQ ID NO: 2828832 - protein, 19 aa, Entamoeba invadens
WFYGLWVIYGIIFLVMKLF

SEQ ID NO: 2828833 - protein, 31 aa, Entamoeba invadens
WGAYVFVINIIPLHVFILLITGKYSNRVYRA

SEQ ID NO: 2828834 - protein, 27 aa, Entamoeba invadens
WGDSYPKSEFKFPWKIAEFVTNGNRLK

SEQ ID NO: 2828835 - protein, 27 aa, Entamoeba invadens
WGDVYDKNIFKFPWKIAEFVNDGKRIE

SEQ ID NO: 2828836 - protein, 21 aa, Entamoeba invadens
WGIFVVTLLLFIYRMVHFHKY

SEQ ID NO: 2828837 - protein, 19 aa, Entamoeba invadens
WGKSLHPLLKLPQGDRAAF

SEQ ID NO: 2828838 - protein, 24 aa, Entamoeba invadens
WGREELNWNWSDKLPLLLIQSESD

SEQ ID NO: 2828839 - protein, 19 aa, Entamoeba invadens
WGYDQALLNVLYYNGSFDE

SEQ ID NO: 2828840 - protein, 25 aa, Entamoeba invadens
WGYDQALLNVLYYNGTFKELGLETV

SEQ ID NO: 2828841 - protein, 17 aa, Entamoeba invadens
WGYRALSALLMYLVIIF

SEQ ID NO: 2828842 - protein, 26 aa, Entamoeba invadens
WHLKNLQKIRIFLKDLNFIEMLQKFT

SEQ ID NO: 2828843 - protein, 27 aa, Entamoeba invadens
WHYIILYLVAVILNFPLIIPRSVKFLS

SEQ ID NO: 2828844 - protein, 20 aa, Entamoeba invadens
WIDQIERHANWNCVLDAAAY

SEQ ID NO: 2828845 - protein, 20 aa, Entamoeba invadens
WINALQLFYITENTSVVFNG

SEQ ID NO: 2828846 - protein, 22 aa, Entamoeba invadens
WISFSFLLFNFGVLGVVTVFYT

SEQ ID NO: 2828847 - protein, 21 aa, Entamoeba invadens
WISVTVYFYDGLLLSSKEKLN

SEQ ID NO: 2828848 - protein, 18 aa, Entamoeba invadens
WITKLWWCTNNLINNTVV

SEQ ID NO: 2828849 - protein, 28 aa, Entamoeba invadens
WKKDNGPIALLRFFVKFSQRKQMPDDMN

SEQ ID NO: 2828850 - protein, 26 aa, Entamoeba invadens
WKKEFVLGFLHTSDLIEWSALLKEHL

SEQ ID NO: 2828851 - protein, 22 aa, Entamoeba invadens
WKPEEYFNVPKLNIGMGVWAFP

SEQ ID NO: 2828852 - protein, 19 aa, Entamoeba invadens
WKQNPLERYAIEDIVLVLQ

SEQ ID NO: 2828853 - protein, 28 aa, Entamoeba invadens
WKRFIYVSILILFFQLLDLNSFFLKAEL

SEQ ID NO: 2828854 - protein, 26 aa, Entamoeba invadens
WKTDALHLFGPVPILLLGCIVSSLVS

SEQ ID NO: 2828855 - protein, 28 aa, Entamoeba invadens
WKVFKSPAMLLLFPLFIYSGITQCYIYG

SEQ ID NO: 2828856 - protein, 31 aa, Entamoeba invadens
WKYTKNMWVKGYFKYMWADNTAQIVSIDTTK

SEQ ID NO: 2828857 - protein, 19 aa, Entamoeba invadens
WLFVFVDIAVGLVTQKEAE

SEQ ID NO: 2828858 - protein, 19 aa, Entamoeba invadens
WLQYDRNLTLYSLTKQPPQ

SEQ ID NO: 2828859 - protein, 17 aa, Entamoeba invadens
WLRNSSVLENILFGEEY

SEQ ID NO: 2828860 - protein, 19 aa, Entamoeba invadens
WLYNDDLYKWFFDKSVSPD

SEQ ID NO: 2828861 - protein, 18 aa, Entamoeba invadens
WLYTAAHPIFIVLSIILF

SEQ ID NO: 2828862 - protein, 25 aa, Entamoeba invadens
WMGNFSLMIFTTEVLISFIFMCIYA

SEQ ID NO: 2828863 - protein, 35 aa, Entamoeba invadens
WMKYVKIPFPVLLQHNVIQIIFLGLKDKTLFQYVT

SEQ ID NO: 2828864 - protein, 33 aa, Entamoeba invadens
WMLKIDIMVQFKIKIYIRKMNYKTRKRENEKTR

SEQ ID NO: 2828865 - protein, 36 aa, Entamoeba invadens
WNDISKFAVYVLRSIARFILYVYKNVRHVFVDEYNT

SEQ ID NO: 2828866 - protein, 18 aa, Entamoeba invadens
WNFFMRRHSIWVRINEVA

SEQ ID NO: 2828867 - protein, 24 aa, Entamoeba invadens
WNKMGFLAIFIIFAMALGGFALTL

SEQ ID NO: 2828868 - protein, 20 aa, Entamoeba invadens
WNLDIYEWYTIYSNNPMMWI

SEQ ID NO: 2828869 - protein, 22 aa, Entamoeba invadens
WNLTPILLMLIAVASLIQFVLN

SEQ ID NO: 2828870 - protein, 29 aa, Entamoeba invadens
WNLVSLFCITLIFVRVFFSLPGFCIDTKT

SEQ ID NO: 2828871 - protein, 17 aa, Entamoeba invadens
WNNFKEVLGPTPIDCIC

SEQ ID NO: 2828872 - protein, 25 aa, Entamoeba invadens
WNVHIQRLQLFQKNTLWDIVKECDK

SEQ ID NO: 2828873 - protein, 19 aa, Entamoeba invadens
WPKWVQMIVGVILAVVAGV

SEQ ID NO: 2828874 - protein, 23 aa, Entamoeba invadens
WPSALRLFPFVMLVSLFLNNTPV

SEQ ID NO: 2828875 - protein, 38 aa, Entamoeba invadens
WQHSYEGGYDIFYYLAMQPWRHFVWTRKEGDTWVKKIM

SEQ ID NO: 2828876 - protein, 19 aa, Entamoeba invadens
WQKFSAHFLVFGRVFRMNI

SEQ ID NO: 2828877 - protein, 17 aa, Entamoeba invadens
WQVLKYKLSKDLPRTEV

SEQ ID NO: 2828878 - protein, 17 aa, Entamoeba invadens
WRCYASGVSQKSKATIM

SEQ ID NO: 2828879 - protein, 26 aa, Entamoeba invadens
WRDILRYAYDLLLHKIGKRGKQDMFK

SEQ ID NO: 2828880 - protein, 17 aa, Entamoeba invadens
WRIAYSDVEFKFPWTIA

SEQ ID NO: 2828881 - protein, 23 aa, Entamoeba invadens
WSAAFIVTCQIIVLAGLTIIALI

SEQ ID NO: 2828882 - protein, 33 aa, Entamoeba invadens
WSCTLEVILSLIWLFYLVQWSACAGLLVMLISV

SEQ ID NO: 2828883 - protein, 20 aa, Entamoeba invadens
WSEAYNKIQFKFPWKIAEFV

SEQ ID NO: 2828884 - protein, 21 aa, Entamoeba invadens
WSICMGIFLHYFILNGSSLAA

SEQ ID NO: 2828885 - protein, 20 aa, Entamoeba invadens
WSIVLELAPLGSLRTFIEKK

SEQ ID NO: 2828886 - protein, 20 aa, Entamoeba invadens
WSTHIFGKLVKRIDCGEIAI

SEQ ID NO: 2828887 - protein, 28 aa, Entamoeba invadens
WSVGCIVAEMFLGIPLFPANSEYDLLLR

SEQ ID NO: 2828888 - protein, 18 aa, Entamoeba invadens
WSYTEPYCPLGNDVDWYI

SEQ ID NO: 2828889 - protein, 19 aa, Entamoeba invadens
WSYTEPYCPLGNDVDWYIT

SEQ ID NO: 2828890 - protein, 21 aa, Entamoeba invadens
WTDFLFSPIPPPFPLLRSKPK

SEQ ID NO: 2828891 - protein, 29 aa, Entamoeba invadens
WTESDWKTLRLSFYKTRKLSDIIMCVVGV

SEQ ID NO: 2828892 - protein, 20 aa, Entamoeba invadens
WTESYTKDKFKFCWNVVDFV

SEQ ID NO: 2828893 - protein, 27 aa, Entamoeba invadens
WTGFVFPWLFYIAWQILYLIITEVFKR

SEQ ID NO: 2828894 - protein, 17 aa, Entamoeba invadens
WTILFSFIAICISQTAM

SEQ ID NO: 2828895 - protein, 18 aa, Entamoeba invadens
WTIPLLCNRSYDSHIPLD

SEQ ID NO: 2828896 - protein, 25 aa, Entamoeba invadens
WTLSIYNVFFTFFPIVVFGVFDRDV

SEQ ID NO: 2828897 - protein, 18 aa, Entamoeba invadens
WTTEFFDQRVAFLGTTIV

SEQ ID NO: 2828898 - protein, 30 aa, Entamoeba invadens
WTTVNTASLAFIGFITLISVALSLVIGTLG

SEQ ID NO: 2828899 - protein, 21 aa, Entamoeba invadens
WTTWMLLIGMAIYDLIAVLCP

SEQ ID NO: 2828900 - protein, 34 aa, Entamoeba invadens
WTVNPALISPVRRFFLWKFYLANKTSTFNFDTTV

SEQ ID NO: 2828901 - protein, 30 aa, Entamoeba invadens
WTYNIYVFGILLFFTAWLPQAAVSLHGSQV

SEQ ID NO: 2828902 - protein, 18 aa, Entamoeba invadens
WTYQTICLCWKTNPKERL

SEQ ID NO: 2828903 - protein, 20 aa, Entamoeba invadens
WVCKKCENGLYLDNNNCILC

SEQ ID NO: 2828904 - protein, 19 aa, Entamoeba invadens
WVCNKCENGLYLNNNNCIL

SEQ ID NO: 2828905 - protein, 19 aa, Entamoeba invadens
WVCSSCNSGYFLQSLYCFK

SEQ ID NO: 2828906 - protein, 24 aa, Entamoeba invadens
WVESCLFDEAFLKHFKVFLHKLNC

SEQ ID NO: 2828907 - protein, 22 aa, Entamoeba invadens
WVILIWFCFYFVKPTTVYRNRY

SEQ ID NO: 2828908 - protein, 20 aa, Entamoeba invadens
WVLCDAILLELGYSPVTFTK

SEQ ID NO: 2828909 - protein, 19 aa, Entamoeba invadens
WVMEVIGKGLSFPYSEIET

SEQ ID NO: 2828910 - protein, 32 aa, Entamoeba invadens
WWVILIVVLIVILVVILVAVITIVITKKVLEI

SEQ ID NO: 2828911 - protein, 18 aa, Entamoeba invadens
WYEKIPFTHWYKKFYMPR

SEQ ID NO: 2828912 - protein, 25 aa, Entamoeba invadens
WYGLVTANVLIPYYIEKRTIKELGK

SEQ ID NO: 2828913 - protein, 17 aa, Entamoeba invadens
WYNYTINIFKLFLHFFT

SEQ ID NO: 2828914 - protein, 48 aa, Entamoeba invadens
WYTPSKNGMYCQEAIIWWVILIIVLFIIFVTIFLVNGIVLASKFIEKK

SEQ ID NO: 2828915 - protein, 17 aa, Entamoeba invadens
  misc_feature (1)..(1): Xaa can be any naturally occurring amino acid
XLKYLTVYFWQKSLIKM

SEQ ID NO: 2828916 - protein, 25 aa, Entamoeba invadens
  misc_feature (1)..(2): Xaa can be any naturally occurring amino acid
XXEMLLFTVFQMLLNAKMGSLLCSF

SEQ ID NO: 2828917 - protein, 29 aa, Entamoeba invadens
  misc_feature (1)..(2): Xaa can be any naturally occurring amino acid
XXFVFAYKWIVLLFRRFIDDKYIFRIWDA

SEQ ID NO: 2828918 - protein, 35 aa, Entamoeba invadens
  misc_feature (1)..(2): Xaa can be any naturally occurring amino acid
XXIRELFRYASVSDLLLLFTGILGSLAVGVLNPLL

SEQ ID NO: 2828919 - protein, 20 aa, Entamoeba invadens
YACEFEIFITPKCTLKTQDN

SEQ ID NO: 2828920 - protein, 22 aa, Entamoeba invadens
YACEFEIFLKPRCTMKLCDDIV

SEQ ID NO: 2828921 - protein, 25 aa, Entamoeba invadens
YADIYSFSIMLYETVTWEEMYPKDV

SEQ ID NO: 2828922 - protein, 17 aa, Entamoeba invadens
YAEFTGSYCYSLTSDKN

SEQ ID NO: 2828923 - protein, 33 aa, Entamoeba invadens
YAEMVMHLVGITTFKFLPEPIAALLSMKTMMSE

SEQ ID NO: 2828924 - protein, 26 aa, Entamoeba invadens
YAFGITCYECFIWDKAYKEIKFAFQI

SEQ ID NO: 2828925 - protein, 22 aa, Entamoeba invadens
YAFGLVNILFWLVAQAPQIIKT

SEQ ID NO: 2828926 - protein, 19 aa, Entamoeba invadens
YAFIPIYVLQFYLLFICLF

SEQ ID NO: 2828927 - protein, 41 aa, Entamoeba invadens
YAFVIVWNFYFIDFAFWLFRGKSLLPFTWIAGIVQFGLAVV

SEQ ID NO: 2828928 - protein, 25 aa, Entamoeba invadens
YAKEMFGMFMMSYAPLTKEYLETPI

SEQ ID NO: 2828929 - protein, 33 aa, Entamoeba invadens
YAKKLYRNVFLSVYFDLFHFLISIALCVISYVV

SEQ ID NO: 2828930 - protein, 19 aa, Entamoeba invadens
YALTVIKKCTPKFIGCKMY

SEQ ID NO: 2828931 - protein, 24 aa, Entamoeba invadens
YAMGEYYITQYKGFFAILMEWAVI

SEQ ID NO: 2828932 - protein, 30 aa, Entamoeba invadens
YAPDLYVPLMSFITYVLFVGFYYGSKGTFT

SEQ ID NO: 2828933 - protein, 19 aa, Entamoeba invadens
YARRGFYISVHRNNIFQDS

SEQ ID NO: 2828934 - protein, 28 aa, Entamoeba invadens
YASLIFALMFLFFQAFWEVSALTFIIML

SEQ ID NO: 2828935 - protein, 17 aa, Entamoeba invadens
YASMYYGDKAKLIELQK

SEQ ID NO: 2828936 - protein, 27 aa, Entamoeba invadens
YAYSVMCPYFFFPPASFDEITTAGWFN

SEQ ID NO: 2828937 - protein, 44 aa, Entamoeba invadens
YCAERKTWWICVTFSICIVLFIILILLFIVVMSKVMMIRRFKNT

SEQ ID NO: 2828938 - protein, 17 aa, Entamoeba invadens
YCCRHYVMYVNYTEQMN

SEQ ID NO: 2828939 - protein, 25 aa, Entamoeba invadens
YCDTFNGCTLCKPNYFPKNKTCHLC

SEQ ID NO: 2828940 - protein, 18 aa, Entamoeba invadens
YCDYLCECLFSASGILKN

SEQ ID NO: 2828941 - protein, 31 aa, Entamoeba invadens
YCESLVITSHFLIYCKLFNTSVNYITPCASF

SEQ ID NO: 2828942 - protein, 17 aa, Entamoeba invadens
YCFACAEDYYFTDATNG

SEQ ID NO: 2828943 - protein, 19 aa, Entamoeba invadens
YCGNTFSFDSWISYFDELK

SEQ ID NO: 2828944 - protein, 27 aa, Entamoeba invadens
YCISSGFIPTFLQLILQILSEYNPMDP

SEQ ID NO: 2828945 - protein, 17 aa, Entamoeba invadens
YCITCKEGYFLSIYGEC

SEQ ID NO: 2828946 - protein, 17 aa, Entamoeba invadens
YCLSCNPQYYLSSSFTC

SEQ ID NO: 2828947 - protein, 18 aa, Entamoeba invadens
YCLTCFAGYGFNSGICTQ

SEQ ID NO: 2828948 - protein, 17 aa, Entamoeba invadens
YCLTCFEGYMLVDGRCI

SEQ ID NO: 2828949 - protein, 43 aa, Entamoeba invadens
YCNAFVTYHPLLNNFPRVSFYTFVIFFSIKTLIVFFCVKNTVK

SEQ ID NO: 2828950 - protein, 22 aa, Entamoeba invadens
YCNDFKLICDLYIGSVQPEIDK

SEQ ID NO: 2828951 - protein, 17 aa, Entamoeba invadens
YCNLCYQNYLFDNGKCY

SEQ ID NO: 2828952 - protein, 39 aa, Entamoeba invadens
YCNSHIVWWMIIVIVIICIMTFIVLTTIVFVCIKKIIKK

SEQ ID NO: 2828953 - protein, 19 aa, Entamoeba invadens
YCNVFEMCPLLSHVEIVKT

SEQ ID NO: 2828954 - protein, 19 aa, Entamoeba invadens
YCPLGNDVDWYITPLYNVT

SEQ ID NO: 2828955 - protein, 26 aa, Entamoeba invadens
YCPNGSPLPCKLGYYSTGGTTICTAC

SEQ ID NO: 2828956 - protein, 29 aa, Entamoeba invadens
YCPPSSMPYYLTPLKNITSFLLTINTTNE

SEQ ID NO: 2828957 - protein, 18 aa, Entamoeba invadens
YCRLCSTLNNCQLCNNKE

SEQ ID NO: 2828958 - protein, 27 aa, Entamoeba invadens
YCTCDLHEKIMLIALDMRKAQQYEVPI

SEQ ID NO: 2828959 - protein, 30 aa, Entamoeba invadens
YCTGCLNGFYPLIGLCKPCDFNEGCALCDV

SEQ ID NO: 2828960 - protein, 27 aa, Entamoeba invadens
YCTKCKPTYYLIILENVCLKCKENCLT

SEQ ID NO: 2828961 - protein, 17 aa, Entamoeba invadens
YCTLFCTTKVRNMKIPF

SEQ ID NO: 2828962 - protein, 25 aa, Entamoeba invadens
YCTSCAPGYVLVLNKDSLTCQTCFL

SEQ ID NO: 2828963 - protein, 17 aa, Entamoeba invadens
YCTSCKSGFYLDKLGNC

SEQ ID NO: 2828964 - protein, 18 aa, Entamoeba invadens
YCTSCMKGYYKTGGYCYA

SEQ ID NO: 2828965 - protein, 18 aa, Entamoeba invadens
YCTSCSFNYVLYDENNLK

SEQ ID NO: 2828966 - protein, 48 aa, Entamoeba invadens
YCVDQINLKLVIALPVVLVLVTFVIFSVFIFVFYIMRVHRKEKNQMKN

SEQ ID NO: 2828967 - protein, 19 aa, Entamoeba invadens
YCVKLQLVYIHRKSYKITI

SEQ ID NO: 2828968 - protein, 23 aa, Entamoeba invadens
YDADTFAFLLQTAEKISLCGKEP

SEQ ID NO: 2828969 - protein, 24 aa, Entamoeba invadens
YDADTFAFLLQTAEKISLCGKEPF

SEQ ID NO: 2828970 - protein, 21 aa, Entamoeba invadens
YDAVICIITLFSTSAICRLKK

SEQ ID NO: 2828971 - protein, 23 aa, Entamoeba invadens
YDEKRKFLYVGWSSGEIQKWSVE

SEQ ID NO: 2828972 - protein, 25 aa, Entamoeba invadens
YDENMAVILLRLLVYFHEHVSDRDQ

SEQ ID NO: 2828973 - protein, 17 aa, Entamoeba invadens
YDFACEFSVFVTPLCSC

SEQ ID NO: 2828974 - protein, 28 aa, Entamoeba invadens
YDFAKEFLKYFRGFVKIESYITPLVQKI

SEQ ID NO: 2828975 - protein, 29 aa, Entamoeba invadens
YDFCYYRQKFRIGKWFRLKIMEIDSKFVE

SEQ ID NO: 2828976 - protein, 32 aa, Entamoeba invadens
YDFERTYLICQSFLLRMLYLGIYPLDCIQFDC

SEQ ID NO: 2828977 - protein, 24 aa, Entamoeba invadens
YDFNSKVLINYWSSPYSGSQEYST

SEQ ID NO: 2828978 - protein, 25 aa, Entamoeba invadens
YDGESFNFNLLQLRPSFEFTKDFII

SEQ ID NO: 2828979 - protein, 18 aa, Entamoeba invadens
YDGYYTFNYHCYTCSSIC

SEQ ID NO: 2828980 - protein, 20 aa, Entamoeba invadens
YDHTYFCYSPLDIPTKVFVF

SEQ ID NO: 2828981 - protein, 18 aa, Entamoeba invadens
YDIINLMMQIFSNFPNLR

SEQ ID NO: 2828982 - protein, 26 aa, Entamoeba invadens
YDIVDHPFYKYFMRGMLVTLSTDSPM

SEQ ID NO: 2828983 - protein, 24 aa, Entamoeba invadens
YDNIALFWVGVICGPIFVLYTLYM

SEQ ID NO: 2828984 - protein, 25 aa, Entamoeba invadens
YDNINRFFTLQGMRVLAFGYKNVER

SEQ ID NO: 2828985 - protein, 26 aa, Entamoeba invadens
YDNIRKFLQFQLTVNVVALALCVIGA

SEQ ID NO: 2828986 - protein, 19 aa, Entamoeba invadens
YDNKCLPCDTSCTFDFCDT

SEQ ID NO: 2828987 - protein, 24 aa, Entamoeba invadens
YDNNRGRILIYFDHKLTDLTPRFE

SEQ ID NO: 2828988 - protein, 19 aa, Entamoeba invadens
YDNSSFLVTDMISISLVSI

SEQ ID NO: 2828989 - protein, 25 aa, Entamoeba invadens
YDNYTSLLLDWSRFANTRLGPNGEN

SEQ ID NO: 2828990 - protein, 24 aa, Entamoeba invadens
YDQSVHNYLLYTGKFDELNITKEY

SEQ ID NO: 2828991 - protein, 24 aa, Entamoeba invadens
YDRVKIYLMFFISGSDAMDVALTL

SEQ ID NO: 2828992 - protein, 25 aa, Entamoeba invadens
YDSAYQLLSLKFVPVKQLNDSNISA

SEQ ID NO: 2828993 - protein, 44 aa, Entamoeba invadens
YDSGMTYWLMAVCSFVFVAFVVFIIAVLVVVIFMRQFKRRQIDF

SEQ ID NO: 2828994 - protein, 20 aa, Entamoeba invadens
YDTTYKFCKYKGVNSFFEEL

SEQ ID NO: 2828995 - protein, 21 aa, Entamoeba invadens
YDTTYKFCKYKGVNSFFEELV

SEQ ID NO: 2828996 - protein, 20 aa, Entamoeba invadens
YDVIFYPLADFKPSVSRWFY

SEQ ID NO: 2828997 - protein, 25 aa, Entamoeba invadens
YEANFRTYFPPKIDVLLTTEMKVFL

SEQ ID NO: 2828998 - protein, 17 aa, Entamoeba invadens
YEAYKYECVSCNTGGAT

SEQ ID NO: 2828999 - protein, 25 aa, Entamoeba invadens
YEAYRLFVPIILSPSLMSLLLQVFF

SEQ ID NO: 2829000 - protein, 17 aa, Entamoeba invadens
YECFAWENAYPNDLFKF

SEQ ID NO: 2829001 - protein, 22 aa, Entamoeba invadens
YECFGWGNAFPKEHFSYPWKIA

SEQ ID NO: 2829002 - protein, 25 aa, Entamoeba invadens
YECFTWKEPYPKENFKFAWSIADFV

SEQ ID NO: 2829003 - protein, 18 aa, Entamoeba invadens
YECFTWKEPYPKSEFKFA

SEQ ID NO: 2829004 - protein, 19 aa, Entamoeba invadens
YECFTWTESYTKDKFKFCW

SEQ ID NO: 2829005 - protein, 18 aa, Entamoeba invadens
YECLRWKEAYDKQTFKFP

SEQ ID NO: 2829006 - protein, 18 aa, Entamoeba invadens
YECLSWKDPYPGDDPKFK

SEQ ID NO: 2829007 - protein, 18 aa, Entamoeba invadens
YECSKTFKGYRPCAPGTK

SEQ ID NO: 2829008 - protein, 32 aa, Entamoeba invadens
YECVGWCEAYPKDEFKFPWKIAEFVISGKRVN

SEQ ID NO: 2829009 - protein, 18 aa, Entamoeba invadens
YEGFGWVEAFADVEYTFQ

SEQ ID NO: 2829010 - protein, 20 aa, Entamoeba invadens
YEGFLPCPKGERCNGKKYMN

SEQ ID NO: 2829011 - protein, 40 aa, Entamoeba invadens
YEGVWSGPFLFFLHWFALFFQFIFEIFWPKDTMEKAYEIP

SEQ ID NO: 2829012 - protein, 22 aa, Entamoeba invadens
YEIFGFILTGMDGLRKYCYCRR

SEQ ID NO: 2829013 - protein, 20 aa, Entamoeba invadens
YEIRTVPSIVSLKPGYACEF

SEQ ID NO: 2829014 - protein, 27 aa, Entamoeba invadens
YEIYTLCQSYWTFLDEQNLFGEVQREC

SEQ ID NO: 2829015 - protein, 20 aa, Entamoeba invadens
YEKRSWLNGMIVALVIVILL

SEQ ID NO: 2829016 - protein, 17 aa, Entamoeba invadens
YEKVKIMIDAARGILYL

SEQ ID NO: 2829017 - protein, 19 aa, Entamoeba invadens
YELAVEPYLVILKHGDYTT

SEQ ID NO: 2829018 - protein, 26 aa, Entamoeba invadens
YENAMPARWYRFVGDGKMYLIDTCST

SEQ ID NO: 2829019 - protein, 23 aa, Entamoeba invadens
YENGYLLYNSYFIGHAPFSRNDK

SEQ ID NO: 2829020 - protein, 22 aa, Entamoeba invadens
YERLMILMKYFTTVKNEILSPL

SEQ ID NO: 2829021 - protein, 20 aa, Entamoeba invadens
YESAKLFKVVMKDSFIIFNN

SEQ ID NO: 2829022 - protein, 19 aa, Entamoeba invadens
YESLYLPDNFPFTQIPFEG

SEQ ID NO: 2829023 - protein, 32 aa, Entamoeba invadens
YETFGWCEAYDKTEFKFPWKIAEFVINRNRLP

SEQ ID NO: 2829024 - protein, 33 aa, Entamoeba invadens
YETFGWSEAYNKIQFKFPWKIAEFVINRNRLPK

SEQ ID NO: 2829025 - protein, 23 aa, Entamoeba invadens
YETVSWSHAFKKEDFGFPWEIAQ

SEQ ID NO: 2829026 - protein, 28 aa, Entamoeba invadens
YEVFGWTNVYPLDAFKFPWKIAEFVMSG

SEQ ID NO: 2829027 - protein, 24 aa, Entamoeba invadens
YEVIGWCSAFSECRYVWNIASKTS

SEQ ID NO: 2829028 - protein, 23 aa, Entamoeba invadens
YEVKQVCNIYVALVKKGYTVTEC

SEQ ID NO: 2829029 - protein, 32 aa, Entamoeba invadens
YEVSSPYSGIFPLGPALMRPLCTHQSFPNLGQ

SEQ ID NO: 2829030 - protein, 21 aa, Entamoeba invadens
YEVVGWCTAFVECRYVWNIAE

SEQ ID NO: 2829031 - protein, 20 aa, Entamoeba invadens
YEYCLDFTVDPLTKIYTCNK

SEQ ID NO: 2829032 - protein, 18 aa, Entamoeba invadens
YFCICYIPTFVNFIFSMA

SEQ ID NO: 2829033 - protein, 17 aa, Entamoeba invadens
YFCLKTLTLLVLLSLLV

SEQ ID NO: 2829034 - protein, 23 aa, Entamoeba invadens
YFCLNCNINFYMIIGVCYSCEGC

SEQ ID NO: 2829035 - protein, 18 aa, Entamoeba invadens
YFCTSCETTKVLLSDGSC

SEQ ID NO: 2829036 - protein, 18 aa, Entamoeba invadens
YFCYLLVSHILLFVLSPF

SEQ ID NO: 2829037 - protein, 27 aa, Entamoeba invadens
YFDKQTFYAVMPLYTSSVLEILARRTM

SEQ ID NO: 2829038 - protein, 21 aa, Entamoeba invadens
YFDTCYGLIANWTFHSINVDL

SEQ ID NO: 2829039 - protein, 17 aa, Entamoeba invadens
YFDYLRLKRCVQQFSVF

SEQ ID NO: 2829040 - protein, 23 aa, Entamoeba invadens
YFEALRMAFGTQAIFPGPITVYY

SEQ ID NO: 2829041 - protein, 17 aa, Entamoeba invadens
YFEILFLDNKVSTQFET

SEQ ID NO: 2829042 - protein, 19 aa, Entamoeba invadens
YFGLLNIIFTCVCFGIALF

SEQ ID NO: 2829043 - protein, 56 aa, Entamoeba invadens
YFGQTRIFYLKIKHFLYLQNKSLLLRSLILFFISVKIMLILYLIALTLSQPHKTGS

SEQ ID NO: 2829044 - protein, 20 aa, Entamoeba invadens
YFIAPSAMKLQITSLSSLLA

SEQ ID NO: 2829045 - protein, 21 aa, Entamoeba invadens
YFIHFYLVYSLLYFYFKAVFS

SEQ ID NO: 2829046 - protein, 30 aa, Entamoeba invadens
YFKGKILNLPIQTYIYKIYLRFKKGDIDEN

SEQ ID NO: 2829047 - protein, 29 aa, Entamoeba invadens
YFKKVDPLCPFVPFKIVEPLLTNTLFKNT

SEQ ID NO: 2829048 - protein, 18 aa, Entamoeba invadens
YFLLNGVLFLMRSFSIFF

SEQ ID NO: 2829049 - protein, 18 aa, Entamoeba invadens
YFLSVTKPEDGSALVYDK

SEQ ID NO: 2829050 - protein, 34 aa, Entamoeba invadens
YFNFEQIPNFLKLTLLFVDFCLLLVSVKSQTKDT

SEQ ID NO: 2829051 - protein, 22 aa, Entamoeba invadens
YFNKFLLIISIPFQVVMEYTTP

SEQ ID NO: 2829052 - protein, 27 aa, Entamoeba invadens
YFNMDKCIFVRCADKYFYNNKTKACQI

SEQ ID NO: 2829053 - protein, 18 aa, Entamoeba invadens
YFNQITFKNLRKKWMLVI

SEQ ID NO: 2829054 - protein, 25 aa, Entamoeba invadens
YFQTNFIFHVTPDNVFYIVIEESVN

SEQ ID NO: 2829055 - protein, 18 aa, Entamoeba invadens
YFRFTSGINMKCLFYRNR

SEQ ID NO: 2829056 - protein, 35 aa, Entamoeba invadens
YFRKPLFFNFLMFFAMALCTFPYLLLKYMFNPEMG

SEQ ID NO: 2829057 - protein, 28 aa, Entamoeba invadens
YFRYLEFENVLLFKFFERYLYCESLVIT

SEQ ID NO: 2829058 - protein, 18 aa, Entamoeba invadens
YFSELIFQGKELLTLSKN

SEQ ID NO: 2829059 - protein, 19 aa, Entamoeba invadens
YFSSKLFPVIIFDTFNSRK

SEQ ID NO: 2829060 - protein, 34 aa, Entamoeba invadens
YFSVKTVIFFTLRQWFYTYAATIVLIVYKGLCFF

SEQ ID NO: 2829061 - protein, 21 aa, Entamoeba invadens
YFTFLDLDYTVRRKLPATQLN

SEQ ID NO: 2829062 - protein, 18 aa, Entamoeba invadens
YFTLSFLSALLFSVLLFV

SEQ ID NO: 2829063 - protein, 21 aa, Entamoeba invadens
YFVFLILETESYICPSGCKTP

SEQ ID NO: 2829064 - protein, 24 aa, Entamoeba invadens
YFVGFAIFYFPHWVQHQTGWMIFG

SEQ ID NO: 2829065 - protein, 18 aa, Entamoeba invadens
YFVHTIIRMIDDVKIRDK

SEQ ID NO: 2829066 - protein, 29 aa, Entamoeba invadens
YFVILGVSAFVAYYLYNGLFLAAGEKMAG

SEQ ID NO: 2829067 - protein, 17 aa, Entamoeba invadens
YFVLISKVEIEGSFQID

SEQ ID NO: 2829068 - protein, 25 aa, Entamoeba invadens
YFWATRRRRVLLVDFACCWPSDELK

SEQ ID NO: 2829069 - protein, 20 aa, Entamoeba invadens
YFYDLTLGYPSKPTAALCFF

SEQ ID NO: 2829070 - protein, 20 aa, Entamoeba invadens
YFYRQNSVVYFYSLYKNFIV

SEQ ID NO: 2829071 - protein, 21 aa, Entamoeba invadens
YGAIANCLIYNKDHTCKTCAN

SEQ ID NO: 2829072 - protein, 17 aa, Entamoeba invadens
YGAILSDILPKYTTVTD

SEQ ID NO: 2829073 - protein, 19 aa, Entamoeba invadens
YGAPLLNDVAFKTLWTLMK

SEQ ID NO: 2829074 - protein, 29 aa, Entamoeba invadens
YGARVIYAAFGFGGILLEKSMREKGDFWI

SEQ ID NO: 2829075 - protein, 17 aa, Entamoeba invadens
YGAVFIISKVCLVTEFA

SEQ ID NO: 2829076 - protein, 23 aa, Entamoeba invadens
YGCAVCYDGYIQNKYYKCTKCND

SEQ ID NO: 2829077 - protein, 24 aa, Entamoeba invadens
YGCAVCYDGYYQNKYYKCTKCNDL

SEQ ID NO: 2829078 - protein, 18 aa, Entamoeba invadens
YGCEKCISGYYLTNGRCS

SEQ ID NO: 2829079 - protein, 22 aa, Entamoeba invadens
YGCICCIIFFVAFYFMKFLPEA

SEQ ID NO: 2829080 - protein, 18 aa, Entamoeba invadens
YGCISCDIGYYLSNTKCR

SEQ ID NO: 2829081 - protein, 18 aa, Entamoeba invadens
YGCISCVIGYYLSNAVCF

SEQ ID NO: 2829082 - protein, 18 aa, Entamoeba invadens
YGCLTCKDGKYLTQKTKC

SEQ ID NO: 2829083 - protein, 24 aa, Entamoeba invadens
YGERQLLISFQKFLYEKMFLTDEE

SEQ ID NO: 2829084 - protein, 26 aa, Entamoeba invadens
YGGFLIYIFIIFQLGYCFHYIMDRYI

SEQ ID NO: 2829085 - protein, 18 aa, Entamoeba invadens
YGGRVLCGINRQLRMYEI

SEQ ID NO: 2829086 - protein, 32 aa, Entamoeba invadens
YGISNIIYFTGILYAFVYIYTLTRNIVIVQND

SEQ ID NO: 2829087 - protein, 30 aa, Entamoeba invadens
YGLCIMFIALWILLYFFRAVSKAVVAVRPV

SEQ ID NO: 2829088 - protein, 20 aa, Entamoeba invadens
YGLVMTLFCIWKLLNSFIHL

SEQ ID NO: 2829089 - protein, 42 aa, Entamoeba invadens
YGLVVGIPISVTLIVIILIIVIIIVVILWLQNQKQKKKEQNI

SEQ ID NO: 2829090 - protein, 43 aa, Entamoeba invadens
YGLVVGTPISIVIVLIIIFVILFFVFFKIYQTNKKRKDLKNIC

SEQ ID NO: 2829091 - protein, 28 aa, Entamoeba invadens
YGNLNIELRLPLKYSLPSFNTTIYPMFS

SEQ ID NO: 2829092 - protein, 26 aa, Entamoeba invadens
YGNQKFFYLTLMYCFILMVCNIIISF

SEQ ID NO: 2829093 - protein, 37 aa, Entamoeba invadens
YGTKQWCIFLILMIVSSLLLVPFFIVGIIGNSSMTVA

SEQ ID NO: 2829094 - protein, 17 aa, Entamoeba invadens
YGTSYFGGVFKLALADT

SEQ ID NO: 2829095 - protein, 24 aa, Entamoeba invadens
YGTTIPSGYLKRCNDNWKYNESTG

SEQ ID NO: 2829096 - protein, 17 aa, Entamoeba invadens
YGVIIGIPITVVIIMKN

SEQ ID NO: 2829097 - protein, 24 aa, Entamoeba invadens
YGVIVLIVLVLITVRFICLGAFNG

SEQ ID NO: 2829098 - protein, 20 aa, Entamoeba invadens
YGVSYLLNGLCNPCDSTCST

SEQ ID NO: 2829099 - protein, 23 aa, Entamoeba invadens
YGVVAFELFFQKKVKLLVVDGKE

SEQ ID NO: 2829100 - protein, 40 aa, Entamoeba invadens
YGVVIGIPIASFILLVIIILLLIIIIYIISHKTRKEKEKE

SEQ ID NO: 2829101 - protein, 46 aa, Entamoeba invadens
YGVVIGIPVAIFIFFIIIIALILVVVYLLILSRKEKKKMKNICVFE

SEQ ID NO: 2829102 - protein, 35 aa, Entamoeba invadens
YGVVVGIPITIVILLLIIALVVVLITLQVINKHKE

SEQ ID NO: 2829103 - protein, 17 aa, Entamoeba invadens
YGYFLSVTKPEDGSALV

SEQ ID NO: 2829104 - protein, 17 aa, Entamoeba invadens
YGYPIDVYAFSIVMYET

SEQ ID NO: 2829105 - protein, 24 aa, Entamoeba invadens
YGYTKPNWAWQFGEKFNLTFIYHE

SEQ ID NO: 2829106 - protein, 26 aa, Entamoeba invadens
YGYYNQNGLWHLFNVSGFTAKKYIDR

SEQ ID NO: 2829107 - protein, 17 aa, Entamoeba invadens
YHELIVDKLINNFKDFD

SEQ ID NO: 2829108 - protein, 17 aa, Entamoeba invadens
YHFRVDPPFVTLRKGYC

SEQ ID NO: 2829109 - protein, 29 aa, Entamoeba invadens
YHILRIVTSTFLVLTFLADDDIFRAVDAC

SEQ ID NO: 2829110 - protein, 30 aa, Entamoeba invadens
YHINQYWCSQCNPGYFPYNKNCVPCGYMEG

SEQ ID NO: 2829111 - protein, 25 aa, Entamoeba invadens
YHNYRYFFLFLFYVEVGLLCLDFNV

SEQ ID NO: 2829112 - protein, 28 aa, Entamoeba invadens
YHQIYLTCSPFLDLFQKYLQTTKTDLDI

SEQ ID NO: 2829113 - protein, 22 aa, Entamoeba invadens
YHRRLEIFVHLFKETKIDIEHI

SEQ ID NO: 2829114 - protein, 19 aa, Entamoeba invadens
YICSSCRVGFFPNAQKCEA

SEQ ID NO: 2829115 - protein, 24 aa, Entamoeba invadens
YICTFILMSTLIYWVFGYSYIQKN

SEQ ID NO: 2829116 - protein, 25 aa, Entamoeba invadens
YIDAKKLVPLALLNQYLLSERSLCF

SEQ ID NO: 2829117 - protein, 37 aa, Entamoeba invadens
YIDVIIEAYFHLFPAFCLPWFVKQKKNIPMLNEAIKK

SEQ ID NO: 2829118 - protein, 30 aa, Entamoeba invadens
YIFGLLLTILMLWKFRVGQPALLYLVPSMF

SEQ ID NO: 2829119 - protein, 17 aa, Entamoeba invadens
YIFITLNRKGQSNDEIY

SEQ ID NO: 2829120 - protein, 18 aa, Entamoeba invadens
YIFKSIEAISFMVRIYTK

SEQ ID NO: 2829121 - protein, 24 aa, Entamoeba invadens
YIFLCFTFIYFTYSQSCSFPNIIL

SEQ ID NO: 2829122 - protein, 19 aa, Entamoeba invadens
YIFVEPYCPCDGCFITPFK

SEQ ID NO: 2829123 - protein, 32 aa, Entamoeba invadens
YIGDHAFEMSFLPNFKLSYSPSLHVGISAFAN

SEQ ID NO: 2829124 - protein, 26 aa, Entamoeba invadens
YIGDYAFSMVLVEHFAFSIVSDKLVT

SEQ ID NO: 2829125 - protein, 21 aa, Entamoeba invadens
YIGSYLIVRSLKIPWIGETTN

SEQ ID NO: 2829126 - protein, 21 aa, Entamoeba invadens
YIHCFTIPLLGFMNCLYYAKD

SEQ ID NO: 2829127 - protein, 27 aa, Entamoeba invadens
YIHEQPVKYVIPWSALTPPKNEGEREM

SEQ ID NO: 2829128 - protein, 20 aa, Entamoeba invadens
YIHLSEILKFEFFDSPKGEG

SEQ ID NO: 2829129 - protein, 24 aa, Entamoeba invadens
YIIFHKFFFFYTTLLALVGMVVEF

SEQ ID NO: 2829130 - protein, 21 aa, Entamoeba invadens
YIIHFYGACFMPNKICMVTEY

SEQ ID NO: 2829131 - protein, 19 aa, Entamoeba invadens
YIIKFFGAVHVGNSRMIVM

SEQ ID NO: 2829132 - protein, 18 aa, Entamoeba invadens
YIILVVVFTGWAAWTPLN

SEQ ID NO: 2829133 - protein, 31 aa, Entamoeba invadens
YIITGNVFIFLLFLFISFLYTHTAQFHTIKE

SEQ ID NO: 2829134 - protein, 18 aa, Entamoeba invadens
YIKTVINPKFRGGVVWFR

SEQ ID NO: 2829135 - protein, 38 aa, Entamoeba invadens
YIKYSRIAMLFQKNVDYYIFVHKPFGSLFLADEVTKIL

SEQ ID NO: 2829136 - protein, 32 aa, Entamoeba invadens
YILAGVGIGLLLLFLIIIVVIIVVMSKRNEKK

SEQ ID NO: 2829137 - protein, 26 aa, Entamoeba invadens
YILAPYLWEPLLQKYIPRYIAPNILT

SEQ ID NO: 2829138 - protein, 28 aa, Entamoeba invadens
YILDTETEMFLWLGNKCSLKIRQKITKY

SEQ ID NO: 2829139 - protein, 18 aa, Entamoeba invadens
YILFFVTCVYSLENTCEC

SEQ ID NO: 2829140 - protein, 18 aa, Entamoeba invadens
YILIIKDAEYIKSNVIWG

SEQ ID NO: 2829141 - protein, 17 aa, Entamoeba invadens
YILITSTIICFSSPQNC

SEQ ID NO: 2829142 - protein, 18 aa, Entamoeba invadens
YILQDHICLPEAFYSDSC

SEQ ID NO: 2829143 - protein, 18 aa, Entamoeba invadens
YILTNRKCEYYTNIKYCA

SEQ ID NO: 2829144 - protein, 19 aa, Entamoeba invadens
YILVIVVFYVMAITVFNIA

SEQ ID NO: 2829145 - protein, 19 aa, Entamoeba invadens
YIMGFALEIVPSAKFIPVC

SEQ ID NO: 2829146 - protein, 17 aa, Entamoeba invadens
YINIIFCVFVTLVLLAS

SEQ ID NO: 2829147 - protein, 18 aa, Entamoeba invadens
YINPVFLAKYEFALRRYQ

SEQ ID NO: 2829148 - protein, 18 aa, Entamoeba invadens
YIPKCRESVYYKITNEYI

SEQ ID NO: 2829149 - protein, 25 aa, Entamoeba invadens
YIPKISMVIQFFQLGSLGDYVRHEK

SEQ ID NO: 2829150 - protein, 19 aa, Entamoeba invadens
YIPMFICEVICFVFLIVFQ

SEQ ID NO: 2829151 - protein, 20 aa, Entamoeba invadens
YIPMLLSEVLCFLFLVIFQG

SEQ ID NO: 2829152 - protein, 29 aa, Entamoeba invadens
YIPNKRQLSLFGRLLAPFGKRFAVVARGG

SEQ ID NO: 2829153 - protein, 26 aa, Entamoeba invadens
YIPQISLVMQYLVLGALSEFLHNTSR

SEQ ID NO: 2829154 - protein, 28 aa, Entamoeba invadens
YIPQVSMVMQFFLLGSLGEYVRNDSDDY

SEQ ID NO: 2829155 - protein, 25 aa, Entamoeba invadens
YIPRNWKFMQIWNGTLSILVIRILI

SEQ ID NO: 2829156 - protein, 26 aa, Entamoeba invadens
YIPVVLLTVMFFYDIFWVFGSVLVPV

SEQ ID NO: 2829157 - protein, 18 aa, Entamoeba invadens
YIRILFLVVGVFFVFKAP

SEQ ID NO: 2829158 - protein, 28 aa, Entamoeba invadens
YIRRWNTRRRLRLIEFGLNGFDSQKKNA

SEQ ID NO: 2829159 - protein, 17 aa, Entamoeba invadens
YISAKRWIPMRYDCFKS

SEQ ID NO: 2829160 - protein, 21 aa, Entamoeba invadens
YISALYFFLFETVGLVIGYII

SEQ ID NO: 2829161 - protein, 38 aa, Entamoeba invadens
YISFVYDNIFYSIFIWIAFTLLFVTLAFFWTRIVSPAA

SEQ ID NO: 2829162 - protein, 25 aa, Entamoeba invadens
YISPKLVLLYFAKKEFRIPIDFFID

SEQ ID NO: 2829163 - protein, 31 aa, Entamoeba invadens
YISTHLFMFSLLFWILGYIYINLNKEKEEVL

SEQ ID NO: 2829164 - protein, 20 aa, Entamoeba invadens
YISWYTIFLGIFGTAYGIMT

SEQ ID NO: 2829165 - protein, 24 aa, Entamoeba invadens
YISYTFNMKYACSLQFESLPFFEI

SEQ ID NO: 2829166 - protein, 20 aa, Entamoeba invadens
YITDFLVEILPIIPADQCAL

SEQ ID NO: 2829167 - protein, 19 aa, Entamoeba invadens
YITTHPKMPWSTRLNIAVS

SEQ ID NO: 2829168 - protein, 19 aa, Entamoeba invadens
YIVCLYFLTQVLPLYFGAL

SEQ ID NO: 2829169 - protein, 22 aa, Entamoeba invadens
YIVFILLIDMVVSYDQCNLTSP

SEQ ID NO: 2829170 - protein, 17 aa, Entamoeba invadens
YIVHFYGACFILNKICM

SEQ ID NO: 2829171 - protein, 18 aa, Entamoeba invadens
YIVHFYGAVFILSRICMV

SEQ ID NO: 2829172 - protein, 22 aa, Entamoeba invadens
YIVHFYGAVFIPNKICLVTEFA

SEQ ID NO: 2829173 - protein, 17 aa, Entamoeba invadens
YIVHFYGAVFIPNKVCM

SEQ ID NO: 2829174 - protein, 20 aa, Entamoeba invadens
YIVHFYGAVFIPSKFCMVTE

SEQ ID NO: 2829175 - protein, 20 aa, Entamoeba invadens
YIVHFYGAVFIPTKICMVTE

SEQ ID NO: 2829176 - protein, 18 aa, Entamoeba invadens
YIVHFYGAVFVPNKMCIV

SEQ ID NO: 2829177 - protein, 17 aa, Entamoeba invadens
YIVHFYGAVFVPNKVCL

SEQ ID NO: 2829178 - protein, 19 aa, Entamoeba invadens
YIVHFYGAVFVPNKVCMVT

SEQ ID NO: 2829179 - protein, 19 aa, Entamoeba invadens
YIVHFYGAVVIPNKICMVT

SEQ ID NO: 2829180 - protein, 19 aa, Entamoeba invadens
YIVMMIFRIIFGVLAILSS

SEQ ID NO: 2829181 - protein, 17 aa, Entamoeba invadens
YIVNYPIIYLEMAWVYR

SEQ ID NO: 2829182 - protein, 21 aa, Entamoeba invadens
YIYTFFFVPVYFNFFGNVIPL

SEQ ID NO: 2829183 - protein, 29 aa, Entamoeba invadens
YKAFGTFVLLFNFFLTLLCMIVTFCVDFS

SEQ ID NO: 2829184 - protein, 31 aa, Entamoeba invadens
YKAREALVDLILILPFIAVIVALIGAFCKLH

SEQ ID NO: 2829185 - protein, 17 aa, Entamoeba invadens
YKDMTGCLPIREKYLDC

SEQ ID NO: 2829186 - protein, 19 aa, Entamoeba invadens
YKEWFYKMIGLKTCYITST

SEQ ID NO: 2829187 - protein, 20 aa, Entamoeba invadens
YKFDQCYYMMLNNYVKFEEN

SEQ ID NO: 2829188 - protein, 23 aa, Entamoeba invadens
YKFKMFKMSFWYTSNKDGTMCRS

SEQ ID NO: 2829189 - protein, 26 aa, Entamoeba invadens
YKGFFAILMEWAVIVFVGCVIALVWI

SEQ ID NO: 2829190 - protein, 20 aa, Entamoeba invadens
YKGIVYVYKYTTEGVILVHI

SEQ ID NO: 2829191 - protein, 31 aa, Entamoeba invadens
YKIDITASTLLWYPNIIFFGKVSLDNPFTIE

SEQ ID NO: 2829192 - protein, 40 aa, Entamoeba invadens
YKIKSYVEWYLYGVLQSILFFVLFYFLIAGSDVTNFDGKV

SEQ ID NO: 2829193 - protein, 26 aa, Entamoeba invadens
YKKIIRFVLPVFAVIFFVVLVVRYLA

SEQ ID NO: 2829194 - protein, 23 aa, Entamoeba invadens
YKKTLPVREIIGMIVVFGGLTIV

SEQ ID NO: 2829195 - protein, 17 aa, Entamoeba invadens
YKKYFIKYSYDDLVNKK

SEQ ID NO: 2829196 - protein, 30 aa, Entamoeba invadens
YKLFTFEEIHLLYFFIQTQFSDSRICIEEG

SEQ ID NO: 2829197 - protein, 24 aa, Entamoeba invadens
YKLGLLIEAFAIPITGFVIGFIEC

SEQ ID NO: 2829198 - protein, 34 aa, Entamoeba invadens
YKMPCDIYSLAISFFEIIGWAEPFPKKRFKHPWE

SEQ ID NO: 2829199 - protein, 20 aa, Entamoeba invadens
YKNHLFSKEPKLYRYGTTEN

SEQ ID NO: 2829200 - protein, 18 aa, Entamoeba invadens
YKNKSICIIVFITKIYNV

SEQ ID NO: 2829201 - protein, 29 aa, Entamoeba invadens
YKNSLILKSLLFLLESLLLNYKSFSMSDA

SEQ ID NO: 2829202 - protein, 26 aa, Entamoeba invadens
YKNVTFIMIQFWFGIMSKFSCTSLYE

SEQ ID NO: 2829203 - protein, 25 aa, Entamoeba invadens
YKPDAFTFEWSLLYIIDTANHTIKN

SEQ ID NO: 2829204 - protein, 32 aa, Entamoeba invadens
YKRIGFYLWLAVCAVLAIVFFLIDTTDYYKVL

SEQ ID NO: 2829205 - protein, 23 aa, Entamoeba invadens
YKRMKLVTQWYLSGFAHAMKVVR

SEQ ID NO: 2829206 - protein, 18 aa, Entamoeba invadens
YKSKTPERITLFKNLKTA

SEQ ID NO: 2829207 - protein, 17 aa, Entamoeba invadens
YKTAYLANYLVALGILK

SEQ ID NO: 2829208 - protein, 25 aa, Entamoeba invadens
YKTKYFFCTLGGYIFGLLLTILMLW

SEQ ID NO: 2829209 - protein, 24 aa, Entamoeba invadens
YKTPADIFSFAITILEIMKGYEVY

SEQ ID NO: 2829210 - protein, 24 aa, Entamoeba invadens
YKTQQPIYHFYINGATKSTGSKFS

SEQ ID NO: 2829211 - protein, 25 aa, Entamoeba invadens
YKTQQPIYHFYITGATRALSGKQSR

SEQ ID NO: 2829212 - protein, 24 aa, Entamoeba invadens
YKTQQPMFHFYISGSTRTPPCKMA

SEQ ID NO: 2829213 - protein, 35 aa, Entamoeba invadens
YKVDFMFVDLILQQTQIFIDTLKVNKLTLSDQTSC

SEQ ID NO: 2829214 - protein, 25 aa, Entamoeba invadens
YKVPINIIYEPFLSNGLITNKGIFF

SEQ ID NO: 2829215 - protein, 34 aa, Entamoeba invadens
YKVRTYGPGCLLWGLLIVLQFAIIGVILKVNINV

SEQ ID NO: 2829216 - protein, 17 aa, Entamoeba invadens
YKYPWNIADLISSGKRL

SEQ ID NO: 2829217 - protein, 23 aa, Entamoeba invadens
YKYQFYSFMTRRCPTSNNVIGVV

SEQ ID NO: 2829218 - protein, 26 aa, Entamoeba invadens
YLAALLPLIVFVIFPRLPKYKNDKTN

SEQ ID NO: 2829219 - protein, 19 aa, Entamoeba invadens
YLAIRWKAYLKKRDVEALF

SEQ ID NO: 2829220 - protein, 19 aa, Entamoeba invadens
YLATTFGTLAVLKAHCSTL

SEQ ID NO: 2829221 - protein, 22 aa, Entamoeba invadens
YLDKLFELFSILPSYSFAIYQY

SEQ ID NO: 2829222 - protein, 20 aa, Entamoeba invadens
YLDTYHGKYNYTCQPCATNC

SEQ ID NO: 2829223 - protein, 17 aa, Entamoeba invadens
YLEEGVCKRCSNSISNC

SEQ ID NO: 2829224 - protein, 17 aa, Entamoeba invadens
YLETNLLDDLILKTFEV

SEQ ID NO: 2829225 - protein, 20 aa, Entamoeba invadens
YLFESNGVFKLFVGYSVSEE

SEQ ID NO: 2829226 - protein, 27 aa, Entamoeba invadens
YLFGTAGCWFFFDIAFYGNSMFNSTVL

SEQ ID NO: 2829227 - protein, 25 aa, Entamoeba invadens
YLGAAFVFWVLFNVKVFEELLYCRE

SEQ ID NO: 2829228 - protein, 20 aa, Entamoeba invadens
YLGLFRGTQVALKILKQINL

SEQ ID NO: 2829229 - protein, 20 aa, Entamoeba invadens
YLGWRMFRKNNKDYILIVNV

SEQ ID NO: 2829230 - protein, 20 aa, Entamoeba invadens
YLHENGILHRDIKPDNFLVT

SEQ ID NO: 2829231 - protein, 19 aa, Entamoeba invadens
YLHENGILHRDIKPDNILI

SEQ ID NO: 2829232 - protein, 18 aa, Entamoeba invadens
YLHFNFKNENFFTNQNLR

SEQ ID NO: 2829233 - protein, 22 aa, Entamoeba invadens
YLHGFKLFHLNLKLSNVMMKSF

SEQ ID NO: 2829234 - protein, 19 aa, Entamoeba invadens
YLHSNGILHRDIKPDNILI

SEQ ID NO: 2829235 - protein, 19 aa, Entamoeba invadens
YLHSNGILHRDIKPDNILV

SEQ ID NO: 2829236 - protein, 26 aa, Entamoeba invadens
YLHSNNILHRDIKPDNFLVFCIDNSM

SEQ ID NO: 2829237 - protein, 22 aa, Entamoeba invadens
YLIRALCLILMFLSNASGGFFF

SEQ ID NO: 2829238 - protein, 22 aa, Entamoeba invadens
YLIYYCHLLPTEIIAYNTMLLY

SEQ ID NO: 2829239 - protein, 23 aa, Entamoeba invadens
YLIYYFLLFSVVYGQICSLTTQV

SEQ ID NO: 2829240 - protein, 27 aa, Entamoeba invadens
YLLCVFWWINPIIGCTYFLTVKPYKGP

SEQ ID NO: 2829241 - protein, 22 aa, Entamoeba invadens
YLLISYFVTLPMYFIVNTLNTD

SEQ ID NO: 2829242 - protein, 17 aa, Entamoeba invadens
YLLKSLKLKLAMQVFSI

SEQ ID NO: 2829243 - protein, 17 aa, Entamoeba invadens
YLLNFWMKQSMGLLHSS

SEQ ID NO: 2829244 - protein, 17 aa, Entamoeba invadens
YLLNITFCQQCDTTCGG

SEQ ID NO: 2829245 - protein, 21 aa, Entamoeba invadens
YLMNVVLYLPTTECVYTFFLI

SEQ ID NO: 2829246 - protein, 19 aa, Entamoeba invadens
YLMVFIAIAAHKWADSGLT

SEQ ID NO: 2829247 - protein, 31 aa, Entamoeba invadens
YLNERKVLQYWVYNSYLYSQFLRDVCTSETT

SEQ ID NO: 2829248 - protein, 28 aa, Entamoeba invadens
YLNIIYTCLSCKLGYYPTNYGCALCNAG

SEQ ID NO: 2829249 - protein, 26 aa, Entamoeba invadens
YLNKKTYFMSCLLMDICLELGYFFEC

SEQ ID NO: 2829250 - protein, 19 aa, Entamoeba invadens
YLNKLTWPYDVLVRGKKYT

SEQ ID NO: 2829251 - protein, 27 aa, Entamoeba invadens
YLNNDQNFFIFSLFNRNHDEPQRFKRK

SEQ ID NO: 2829252 - protein, 17 aa, Entamoeba invadens
YLNVLNPVVSIISCGEG

SEQ ID NO: 2829253 - protein, 53 aa, Entamoeba invadens
YLPTNDGILCKKKVVWWVVLIVVIFIVVIVVILIILIYFIVSKIQQKMRQKEI

SEQ ID NO: 2829254 - protein, 25 aa, Entamoeba invadens
YLPVHPLVLTFFVFPTIGFSMFELV

SEQ ID NO: 2829255 - protein, 19 aa, Entamoeba invadens
YLQGYSLGFQSCGNCPSNC

SEQ ID NO: 2829256 - protein, 17 aa, Entamoeba invadens
YLQSLFANKYTLFRVWI

SEQ ID NO: 2829257 - protein, 21 aa, Entamoeba invadens
YLQYLLTCYFMFIGSVGVSEL

SEQ ID NO: 2829258 - protein, 18 aa, Entamoeba invadens
YLRDILDDTVRLLEKLSS

SEQ ID NO: 2829259 - protein, 22 aa, Entamoeba invadens
YLRKNSLLVKSFYDVAENIRCF

SEQ ID NO: 2829260 - protein, 21 aa, Entamoeba invadens
YLRLWEKIVIPVVFILVLGLM

SEQ ID NO: 2829261 - protein, 22 aa, Entamoeba invadens
YLRNGWILCVLAIPVGFISGFD

SEQ ID NO: 2829262 - protein, 17 aa, Entamoeba invadens
YLRNNIIYICDVYDYLS

SEQ ID NO: 2829263 - protein, 20 aa, Entamoeba invadens
YLSDSICLPCSPNWCDVCDG

SEQ ID NO: 2829264 - protein, 25 aa, Entamoeba invadens
YLSNVLFGQIPKPFTQRIFSLFPTN

SEQ ID NO: 2829265 - protein, 20 aa, Entamoeba invadens
YLSQYFDFKALPKQDKVPYE

SEQ ID NO: 2829266 - protein, 24 aa, Entamoeba invadens
YLSSALRQCYIEDLFYGSCIKYYD

SEQ ID NO: 2829267 - protein, 17 aa, Entamoeba invadens
YLSSTFTCEPLGNLFTK

SEQ ID NO: 2829268 - protein, 17 aa, Entamoeba invadens
YLTAPQSLYTRVLLDRV

SEQ ID NO: 2829269 - protein, 18 aa, Entamoeba invadens
YLTCLLDQYKNSDAPSVL

SEQ ID NO: 2829270 - protein, 29 aa, Entamoeba invadens
YLTNITVQTLKFTPVFVYGTCLSSKIASV

SEQ ID NO: 2829271 - protein, 17 aa, Entamoeba invadens
YLTSFQNSSLFINPYAT

SEQ ID NO: 2829272 - protein, 24 aa, Entamoeba invadens
YLTTEGYYRICKKCPLGCSTCFLE

SEQ ID NO: 2829273 - protein, 20 aa, Entamoeba invadens
YLTVYFWQKSLIKMYTPPKV

SEQ ID NO: 2829274 - protein, 21 aa, Entamoeba invadens
YLVHFYSAVFIPNMICMSTEF

SEQ ID NO: 2829275 - protein, 19 aa, Entamoeba invadens
YLVIKKCWCHAPIDRIEIE

SEQ ID NO: 2829276 - protein, 17 aa, Entamoeba invadens
YLVIVVVFSIIVFLIFH

SEQ ID NO: 2829277 - protein, 24 aa, Entamoeba invadens
YLVLFLLFFKINSKSFNFDCSPGC

SEQ ID NO: 2829278 - protein, 18 aa, Entamoeba invadens
YLVMLFFPTQTGANVSFI

SEQ ID NO: 2829279 - protein, 24 aa, Entamoeba invadens
YLVSEALCYFWIGENNRLFNLADK

SEQ ID NO: 2829280 - protein, 19 aa, Entamoeba invadens
YLVYLSTLKCQVGHLVDNE

SEQ ID NO: 2829281 - protein, 22 aa, Entamoeba invadens
YMAPEVLLGFKYKTPADVYSFG

SEQ ID NO: 2829282 - protein, 30 aa, Entamoeba invadens
YMCALQTVSFLLFLLVFRPDQTYGEIEGNW

SEQ ID NO: 2829283 - protein, 17 aa, Entamoeba invadens
YMFIFSFTSPYACNISE

SEQ ID NO: 2829284 - protein, 20 aa, Entamoeba invadens
YMFSEGAFEVFAFLALFIAF

SEQ ID NO: 2829285 - protein, 18 aa, Entamoeba invadens
YMGLLSIDYTFNPLLFKD

SEQ ID NO: 2829286 - protein, 27 aa, Entamoeba invadens
YMKEVSLYSHHLLDKPLKEWDLESFLP

SEQ ID NO: 2829287 - protein, 25 aa, Entamoeba invadens
YMKFSYKLKVRLLFDTARGMQFLHE

SEQ ID NO: 2829288 - protein, 19 aa, Entamoeba invadens
YMLVLFTSICFSSSPSCSF

SEQ ID NO: 2829289 - protein, 22 aa, Entamoeba invadens
YMMNFDITITDFAIYDAKNYTV

SEQ ID NO: 2829290 - protein, 18 aa, Entamoeba invadens
YMNFKYVPFITGSLLYSS

SEQ ID NO: 2829291 - protein, 18 aa, Entamoeba invadens
YMNQLALAILPISDKPIK

SEQ ID NO: 2829292 - protein, 23 aa, Entamoeba invadens
YMNVDVVLLCFSISNKPTFRSIQ

SEQ ID NO: 2829293 - protein, 28 aa, Entamoeba invadens
YMSITMAVNFDVPCMLGMRLEALENIGV

SEQ ID NO: 2829294 - protein, 27 aa, Entamoeba invadens
YMTIFCTTKIRDMKLPYTVWTSSSKYT

SEQ ID NO: 2829295 - protein, 32 aa, Entamoeba invadens
YMYEDRMYFCYTFIIRGIMTLVFTSSLSKTYE

SEQ ID NO: 2829296 - protein, 19 aa, Entamoeba invadens
YMYMLFVSLNEEYKSRVKL

SEQ ID NO: 2829297 - protein, 18 aa, Entamoeba invadens
YNAISFFPLVLIEQFRKL

SEQ ID NO: 2829298 - protein, 26 aa, Entamoeba invadens
YNANNPFMVPLLQKICEFSLSEQFAS

SEQ ID NO: 2829299 - protein, 17 aa, Entamoeba invadens
YNCIQLNLRFQTANDSQ

SEQ ID NO: 2829300 - protein, 17 aa, Entamoeba invadens
YNDLKNGFWYLSKEDIS

SEQ ID NO: 2829301 - protein, 35 aa, Entamoeba invadens
YNEQYLPHIKDRIVKKFIVLYEMDLGLNHVVRKSA

SEQ ID NO: 2829302 - protein, 23 aa, Entamoeba invadens
YNETYCISCLYGNYLTSSMTCLT

SEQ ID NO: 2829303 - protein, 17 aa, Entamoeba invadens
YNFDGILCVPQTLPNET

SEQ ID NO: 2829304 - protein, 18 aa, Entamoeba invadens
YNFDGILCVPQTLPNETT

SEQ ID NO: 2829305 - protein, 25 aa, Entamoeba invadens
YNFGAFLFWIVVPLLATQQGATNLD

SEQ ID NO: 2829306 - protein, 19 aa, Entamoeba invadens
YNFLRKKTMYPKIVYPFAI

SEQ ID NO: 2829307 - protein, 37 aa, Entamoeba invadens
YNFNKPQLFITTVVVLALTVILYFVNKKRGMSDVALA

SEQ ID NO: 2829308 - protein, 17 aa, Entamoeba invadens
YNFYTFTILPESFPKGL

SEQ ID NO: 2829309 - protein, 20 aa, Entamoeba invadens
YNIFLECNNPIMLFVSTGCE

SEQ ID NO: 2829310 - protein, 26 aa, Entamoeba invadens
YNILFTSIPIFIFGIADRDIPPYVLY

SEQ ID NO: 2829311 - protein, 18 aa, Entamoeba invadens
YNILLRITGDLLHDSTNV

SEQ ID NO: 2829312 - protein, 17 aa, Entamoeba invadens
YNIRTEPTLVILKKGEA

SEQ ID NO: 2829313 - protein, 27 aa, Entamoeba invadens
YNISWHGYYLVFRSFDFYLVCLLVVML

SEQ ID NO: 2829314 - protein, 24 aa, Entamoeba invadens
YNITGKALIIFAFRNVASFERLQE

SEQ ID NO: 2829315 - protein, 22 aa, Entamoeba invadens
YNIYESWFMLRENAPGPVQLNF

SEQ ID NO: 2829316 - protein, 20 aa, Entamoeba invadens
YNKFILPENAVLQSSATSSI

SEQ ID NO: 2829317 - protein, 26 aa, Entamoeba invadens
YNKKMRLYENSLMSIIIYLRSPRVEK

SEQ ID NO: 2829318 - protein, 23 aa, Entamoeba invadens
YNKQKYRIGKWFKYDMDNLTTDV

SEQ ID NO: 2829319 - protein, 19 aa, Entamoeba invadens
YNKTPKCLMHYKDNLEGVL

SEQ ID NO: 2829320 - protein, 21 aa, Entamoeba invadens
YNLLGFQCYLKYHFDPNEGHI

SEQ ID NO: 2829321 - protein, 25 aa, Entamoeba invadens
YNLMTEVNTFFWRQQREVKTYIECK

SEQ ID NO: 2829322 - protein, 19 aa, Entamoeba invadens
YNLQITPMHQVLNPGYAIE

SEQ ID NO: 2829323 - protein, 26 aa, Entamoeba invadens
YNLRYFIQFLMLLPSNALFGAIINIT

SEQ ID NO: 2829324 - protein, 24 aa, Entamoeba invadens
YNLVPMIVFGLFTAVFDLFIAIPN

SEQ ID NO: 2829325 - protein, 20 aa, Entamoeba invadens
YNNIIYCKNGYYIDNSECKN

SEQ ID NO: 2829326 - protein, 17 aa, Entamoeba invadens
YNNNIVIYIMLSQNGYA

SEQ ID NO: 2829327 - protein, 29 aa, Entamoeba invadens
YNNSEIYMGGYFYIYWSGSVELFDNSVMR

SEQ ID NO: 2829328 - protein, 26 aa, Entamoeba invadens
YNPVKGGFIIKNSWGLVGHSIQYWMQ

SEQ ID NO: 2829329 - protein, 17 aa, Entamoeba invadens
YNRFHHEPFLSVGGISM

SEQ ID NO: 2829330 - protein, 26 aa, Entamoeba invadens
YNSKAVQQLPLFVGKKGIQLGSFCDN

SEQ ID NO: 2829331 - protein, 37 aa, Entamoeba invadens
YNSVFINMAILMVVTIISFFIGWHLVMAIGGADMPVV

SEQ ID NO: 2829332 - protein, 25 aa, Entamoeba invadens
YNTSCFVLCFSLVYMDSYKSLKTLW

SEQ ID NO: 2829333 - protein, 25 aa, Entamoeba invadens
YNTSCYFYWIVVPLLFNEQGASALM

SEQ ID NO: 2829334 - protein, 29 aa, Entamoeba invadens
YNTTMVCYWLLFIIAMITGLIPATEDLKI

SEQ ID NO: 2829335 - protein, 25 aa, Entamoeba invadens
YNTTTWADFLIPQRMNSLTFEVDVT

SEQ ID NO: 2829336 - protein, 22 aa, Entamoeba invadens
YNTTYCLSCDPQYYLSSTFTCE

SEQ ID NO: 2829337 - protein, 22 aa, Entamoeba invadens
YNTTYCLTCDPQYYLSSTFTCE

SEQ ID NO: 2829338 - protein, 29 aa, Entamoeba invadens
YNYRDDQCMWWNVPNCISYIERGVCATCE

SEQ ID NO: 2829339 - protein, 25 aa, Entamoeba invadens
YNYVNLGDLLLYIEQKYTNLFKPTH

SEQ ID NO: 2829340 - protein, 37 aa, Entamoeba invadens
YPACMPGIFMKIYVFHIKYIGNYYLLFDSRENNRVNL

SEQ ID NO: 2829341 - protein, 22 aa, Entamoeba invadens
YPCLTCQDGYLKTSKGSCVSEC

SEQ ID NO: 2829342 - protein, 28 aa, Entamoeba invadens
YPDCELYLNYFDIYLKCTFEVINNYEVN

SEQ ID NO: 2829343 - protein, 18 aa, Entamoeba invadens
YPDCLYNNTLFDFTIKSG

SEQ ID NO: 2829344 - protein, 23 aa, Entamoeba invadens
YPDVALFTIMQNIENIIIENGVE

SEQ ID NO: 2829345 - protein, 21 aa, Entamoeba invadens
YPHPVFNIFKGFFSLSGDKIK

SEQ ID NO: 2829346 - protein, 18 aa, Entamoeba invadens
YPIDVYAFSIVMYETYTE

SEQ ID NO: 2829347 - protein, 29 aa, Entamoeba invadens
YPIIKKLKNILLFRVFGYKGTLVHVMALY

SEQ ID NO: 2829348 - protein, 32 aa, Entamoeba invadens
YPIIQTVVILMLLAFLIYIDYGKVVGYPLKTM

SEQ ID NO: 2829349 - protein, 22 aa, Entamoeba invadens
YPISFYILWQALYLLITEVILR

SEQ ID NO: 2829350 - protein, 17 aa, Entamoeba invadens
YPITTFKFPWKIAEFVS

SEQ ID NO: 2829351 - protein, 21 aa, Entamoeba invadens
YPKLKIEFMFFDINGKEKHVK

SEQ ID NO: 2829352 - protein, 28 aa, Entamoeba invadens
YPLEPSRTYYYYFFVSVTNFCNMQIQLN

SEQ ID NO: 2829353 - protein, 17 aa, Entamoeba invadens
YPLFFFQMTPCVMICTL

SEQ ID NO: 2829354 - protein, 17 aa, Entamoeba invadens
YPLLSSLSTQIGSTIFC

SEQ ID NO: 2829355 - protein, 18 aa, Entamoeba invadens
YPMDILGKTYCAPPTCNN

SEQ ID NO: 2829356 - protein, 29 aa, Entamoeba invadens
YPNDLQYSVPFWHVYVGIDTHLGKSLNYE

SEQ ID NO: 2829357 - protein, 27 aa, Entamoeba invadens
YPNILDFFSFIFFFPGLFSGPALEYND

SEQ ID NO: 2829358 - protein, 20 aa, Entamoeba invadens
YPNLSMMNFSWYGLVVLFQQ

SEQ ID NO: 2829359 - protein, 17 aa, Entamoeba invadens
YPPLQSPIDLLLSKSEC

SEQ ID NO: 2829360 - protein, 17 aa, Entamoeba invadens
YPRNCISGYVDPYGYCE

SEQ ID NO: 2829361 - protein, 22 aa, Entamoeba invadens
YPTLLEFFGYTFFYPAFFSGPA

SEQ ID NO: 2829362 - protein, 33 aa, Entamoeba invadens
YPTPTLYVNAFLLLRVLLLKCSFTRLRKRIPTI

SEQ ID NO: 2829363 - protein, 30 aa, Entamoeba invadens
YPYHGRFYLVIWGLYFFFSRQTEALVQVIF

SEQ ID NO: 2829364 - protein, 37 aa, Entamoeba invadens
YQENVLPFTFPVKYFYVFYQQRRLFVPTILRSIEHFE

SEQ ID NO: 2829365 - protein, 24 aa, Entamoeba invadens
YQFNIMFHVALLLKLLEEEQVLER

SEQ ID NO: 2829366 - protein, 17 aa, Entamoeba invadens
YQFYLLHWTNDGCFALD

SEQ ID NO: 2829367 - protein, 17 aa, Entamoeba invadens
YQIKVDPLVVILHKGEA

SEQ ID NO: 2829368 - protein, 27 aa, Entamoeba invadens
YQKETYRPYLYLSMTSLSYSTKVLYIN

SEQ ID NO: 2829369 - protein, 24 aa, Entamoeba invadens
YQKSVCLCYFILVNINLLSIALSF

SEQ ID NO: 2829370 - protein, 30 aa, Entamoeba invadens
YQLGWTLFGLTFFFIFFIDRVIVPHHHSSF

SEQ ID NO: 2829371 - protein, 17 aa, Entamoeba invadens
YQLICLLNFQESPVMFL

SEQ ID NO: 2829372 - protein, 18 aa, Entamoeba invadens
YQLKIEPSIVILKKGVAC

SEQ ID NO: 2829373 - protein, 45 aa, Entamoeba invadens
YQLNVFVIIGPIIGAVLFITIILLMFVFVTYKLYSRIPADERNKQ

SEQ ID NO: 2829374 - protein, 18 aa, Entamoeba invadens
YQLRIDPNIVILKKGVAC

SEQ ID NO: 2829375 - protein, 17 aa, Entamoeba invadens
YQLRIEPDIVILKKGVA

SEQ ID NO: 2829376 - protein, 27 aa, Entamoeba invadens
YQNDTFKFPWKIAEFVIHNNRLKRKDP

SEQ ID NO: 2829377 - protein, 23 aa, Entamoeba invadens
YQNSICLECLKPKKLFNGNCVDV

SEQ ID NO: 2829378 - protein, 27 aa, Entamoeba invadens
YQQFTMVTNLYFLAIMIICCIPSISTV

SEQ ID NO: 2829379 - protein, 21 aa, Entamoeba invadens
YQQICCSVYFWTGPSVETTSD

SEQ ID NO: 2829380 - protein, 28 aa, Entamoeba invadens
YQQKLDSFPLPIFKFIAASTGVVVSTLI

SEQ ID NO: 2829381 - protein, 25 aa, Entamoeba invadens
YQSIMYFVLMILFNANDVLVMDGRT

SEQ ID NO: 2829382 - protein, 25 aa, Entamoeba invadens
YQTCLSCISGYYLDNYSCIKCAPDC

SEQ ID NO: 2829383 - protein, 17 aa, Entamoeba invadens
YQTIPIVQLSSNTQRFV

SEQ ID NO: 2829384 - protein, 33 aa, Entamoeba invadens
YQYIIYIHSLWYLLPLFFFLHLYVLIAMPKCKE

SEQ ID NO: 2829385 - protein, 35 aa, Entamoeba invadens
YQYKTGLCLFAIVPLALLVIYLNGKLNSAQSSPAL

SEQ ID NO: 2829386 - protein, 20 aa, Entamoeba invadens
YQYPAKSPLVSIILSKKRTS

SEQ ID NO: 2829387 - protein, 19 aa, Entamoeba invadens
YRDGLTIATLATFSLLDLS

SEQ ID NO: 2829388 - protein, 33 aa, Entamoeba invadens
YREANPFIVILVIKLYFLSLSQSFFCVKLVDEI

SEQ ID NO: 2829389 - protein, 21 aa, Entamoeba invadens
YRESDKVIEWFWNVFGEMEQR

SEQ ID NO: 2829390 - protein, 35 aa, Entamoeba invadens
YRHCFFLICGIVVLLLILYGVLFKMDWGTKPQITP

SEQ ID NO: 2829391 - protein, 24 aa, Entamoeba invadens
YRHTNLFSFILRKGKGQLKDKVQQ

SEQ ID NO: 2829392 - protein, 23 aa, Entamoeba invadens
YRITLCIMCLAPFGVGSFILDAK

SEQ ID NO: 2829393 - protein, 29 aa, Entamoeba invadens
YRKKWDVLLLDDLLVEYFAFYLSFDFTKK

SEQ ID NO: 2829394 - protein, 18 aa, Entamoeba invadens
YRMKYIAFDIEFVETGKL

SEQ ID NO: 2829395 - protein, 24 aa, Entamoeba invadens
YRMNKWHYFLLDFCYYTNATLIIT

SEQ ID NO: 2829396 - protein, 25 aa, Entamoeba invadens
YRNHKFFVLFLVYAFITSLIVMIFS

SEQ ID NO: 2829397 - protein, 20 aa, Entamoeba invadens
YRNTIVAVKKVKFVLNTPGE

SEQ ID NO: 2829398 - protein, 22 aa, Entamoeba invadens
YRTFALIYLNATYPQNNARTTT

SEQ ID NO: 2829399 - protein, 17 aa, Entamoeba invadens
YRTYFLGILVPAAIYCW

SEQ ID NO: 2829400 - protein, 25 aa, Entamoeba invadens
YSAALLIMFVVSFLAIKRFKKGNYD

SEQ ID NO: 2829401 - protein, 38 aa, Entamoeba invadens
YSAVVLTVLQMLVVLPDRELYVLANTKIPYTVFTMKRS

SEQ ID NO: 2829402 - protein, 18 aa, Entamoeba invadens
YSCGNMYQYIVQSALMGI

SEQ ID NO: 2829403 - protein, 21 aa, Entamoeba invadens
YSDFVTTGFYLTLAKELPVPT

SEQ ID NO: 2829404 - protein, 27 aa, Entamoeba invadens
YSDINEKFILNIWRYSNQTNPVQLYIE

SEQ ID NO: 2829405 - protein, 20 aa, Entamoeba invadens
YSDKFDPFNFGYGYPQSEEF

SEQ ID NO: 2829406 - protein, 18 aa, Entamoeba invadens
YSDMANCILFSVNKTRRV

SEQ ID NO: 2829407 - protein, 23 aa, Entamoeba invadens
YSEFNIPLLFKTETTNRISADEI

SEQ ID NO: 2829408 - protein, 17 aa, Entamoeba invadens
YSEIPFTGSTPIGAIKL

SEQ ID NO: 2829409 - protein, 25 aa, Entamoeba invadens
YSFAICMLEIWLTKDVYDPMKFPDS

SEQ ID NO: 2829410 - protein, 32 aa, Entamoeba invadens
YSFAITMFETFSWKDPFPKVKFGYAWNVANFV

SEQ ID NO: 2829411 - protein, 19 aa, Entamoeba invadens
YSFAITMFEVFGWCEAYPK

SEQ ID NO: 2829412 - protein, 19 aa, Entamoeba invadens
YSFAITMFEVFGWSQAYLI

SEQ ID NO: 2829413 - protein, 26 aa, Entamoeba invadens
YSFAITMFEVLQWDFVFKKDDERFQH

SEQ ID NO: 2829414 - protein, 35 aa, Entamoeba invadens
YSFAITMLECFLWSNAYPKSIYMYPWTIADDVASG

SEQ ID NO: 2829415 - protein, 37 aa, Entamoeba invadens
YSFAITMLECLIWEDAFSKVLYPHPWCIADDVAVGKR

SEQ ID NO: 2829416 - protein, 19 aa, Entamoeba invadens
YSFAITMYELITWSEAYPK

SEQ ID NO: 2829417 - protein, 21 aa, Entamoeba invadens
YSFAMLMLSVVKWGKIFTDPE

SEQ ID NO: 2829418 - protein, 26 aa, Entamoeba invadens
YSFAMTMFEVFQWDFVFKKDDERFQH

SEQ ID NO: 2829419 - protein, 26 aa, Entamoeba invadens
YSFAMTMYECFAWRIAYSDVEFKFPW

SEQ ID NO: 2829420 - protein, 28 aa, Entamoeba invadens
YSFAMTMYECFAWRIAYSDVEFKFPWKI

SEQ ID NO: 2829421 - protein, 34 aa, Entamoeba invadens
YSFAVTMFEVLGWCEAFDKNDERFKFAWNIADFT

SEQ ID NO: 2829422 - protein, 39 aa, Entamoeba invadens
YSFAVTMYEVFGWQDPYSLKRFKYPWTIADFVTSGNRLE

SEQ ID NO: 2829423 - protein, 40 aa, Entamoeba invadens
YSFDITMFEVLGWCEAYPIENFKFPWKIADFIMSGKRLER

SEQ ID NO: 2829424 - protein, 25 aa, Entamoeba invadens
YSFERKISLFSLTVCSVLMVNIWSH

SEQ ID NO: 2829425 - protein, 25 aa, Entamoeba invadens
YSFGIAMYEIIGWKAAFSMKDPQFN

SEQ ID NO: 2829426 - protein, 24 aa, Entamoeba invadens
YSFGILCWEFFYEQRTFGKYKTLF

SEQ ID NO: 2829427 - protein, 37 aa, Entamoeba invadens
YSFGITMFECLLWEEAYPKTLFPFTWCIADKVVLGIR

SEQ ID NO: 2829428 - protein, 26 aa, Entamoeba invadens
YSFGITMFEIFSWKEAYPKEEFKFPW

SEQ ID NO: 2829429 - protein, 18 aa, Entamoeba invadens
YSFGITMFETFSWSCAYP

SEQ ID NO: 2829430 - protein, 27 aa, Entamoeba invadens
YSFGITMFEVISWKEPYSKDQFKFPWK

SEQ ID NO: 2829431 - protein, 26 aa, Entamoeba invadens
YSFGITMFEVISWKEPYSKDQFKYPW

SEQ ID NO: 2829432 - protein, 39 aa, Entamoeba invadens
YSFGITMYEIFAWKEAYPTKKFKFPWKIAEFVMSGKRVE

SEQ ID NO: 2829433 - protein, 25 aa, Entamoeba invadens
YSFGMTMYEVFGWKSSYPKDEFKYP

SEQ ID NO: 2829434 - protein, 29 aa, Entamoeba invadens
YSFSVIGSLLQWFFNIEKVRVYIFSLMFI

SEQ ID NO: 2829435 - protein, 20 aa, Entamoeba invadens
YSFVISILAGLVYTFGFVQM

SEQ ID NO: 2829436 - protein, 25 aa, Entamoeba invadens
YSFYSFKLFDLPVPYPLLWCRYSFF

SEQ ID NO: 2829437 - protein, 17 aa, Entamoeba invadens
YSGFYKQEKTCISNSEL

SEQ ID NO: 2829438 - protein, 23 aa, Entamoeba invadens
YSGNPYFTLLSPSSVSTIQNGEI

SEQ ID NO: 2829439 - protein, 17 aa, Entamoeba invadens
YSGYYINNNVCTPCTDT

SEQ ID NO: 2829440 - protein, 23 aa, Entamoeba invadens
YSHFDILDIIANPPRNLLELKIT

SEQ ID NO: 2829441 - protein, 20 aa, Entamoeba invadens
YSHYISLADDYPYYSGTSPS

SEQ ID NO: 2829442 - protein, 18 aa, Entamoeba invadens
YSIFLEYYYKRDESEMAE

SEQ ID NO: 2829443 - protein, 21 aa, Entamoeba invadens
YSIGPCSFPIRKQVQYRPSFW

SEQ ID NO: 2829444 - protein, 19 aa, Entamoeba invadens
YSITRFLYIATISNMVFDN

SEQ ID NO: 2829445 - protein, 22 aa, Entamoeba invadens
YSKGILFFPNETSVVLQCSVQT

SEQ ID NO: 2829446 - protein, 23 aa, Entamoeba invadens
YSKILLLESFKKLKYQLICCDNL

SEQ ID NO: 2829447 - protein, 19 aa, Entamoeba invadens
YSKMRYLFTGPETNTVTFY

SEQ ID NO: 2829448 - protein, 24 aa, Entamoeba invadens
YSKNKWMMIIFHTPNNPEYTFYFD

SEQ ID NO: 2829449 - protein, 41 aa, Entamoeba invadens
YSKNKYMMIIFHTPICPKYVFYFDPQVLIIPPRRTDREITS

SEQ ID NO: 2829450 - protein, 25 aa, Entamoeba invadens
YSKNKYMMVIFHTPNNPKYVFHFDK

SEQ ID NO: 2829451 - protein, 32 aa, Entamoeba invadens
YSKNRIFMAQAIFIILAMALRMATYKKMTSAD

SEQ ID NO: 2829452 - protein, 24 aa, Entamoeba invadens
YSKNYEFIFGLTGSLAGLFLVCLS

SEQ ID NO: 2829453 - protein, 37 aa, Entamoeba invadens
YSKTKYLMIIFHAPLSPKYIFHFEPQVLFISPHSTIK

SEQ ID NO: 2829454 - protein, 33 aa, Entamoeba invadens
YSKTLKSLFVPYYTFFLTNLVKILAELPISLAT

SEQ ID NO: 2829455 - protein, 26 aa, Entamoeba invadens
YSLAISFFEIIGWAEPFAKSTFKYPW

SEQ ID NO: 2829456 - protein, 26 aa, Entamoeba invadens
YSLAISFFEIIGWAEPFPKKRFKHPW

SEQ ID NO: 2829457 - protein, 41 aa, Entamoeba invadens
YSLAITMYEIFTWNEAYPKDHFKFPWKIAEFVSNGYRPKVN

SEQ ID NO: 2829458 - protein, 26 aa, Entamoeba invadens
YSLAVTMFSVLKWTEPFDGDDFKYPW

SEQ ID NO: 2829459 - protein, 19 aa, Entamoeba invadens
YSLCFIRIIYVDYLVSEAL

SEQ ID NO: 2829460 - protein, 27 aa, Entamoeba invadens
YSLGFWGNWKHFLFSPLPPPCVNQKVI

SEQ ID NO: 2829461 - protein, 27 aa, Entamoeba invadens
YSLGITIWELFYQRYPFEEYYDAFEDD

SEQ ID NO: 2829462 - protein, 34 aa, Entamoeba invadens
YSLHLNGQFLIYYETTLIWIQITHLYIHTNSVIN

SEQ ID NO: 2829463 - protein, 20 aa, Entamoeba invadens
YSLIPLYFGSFIFTIVCVFV

SEQ ID NO: 2829464 - protein, 17 aa, Entamoeba invadens
YSLLYFYFKAVFSTPSV

SEQ ID NO: 2829465 - protein, 18 aa, Entamoeba invadens
YSMFYPTIKFTLDELSYT

SEQ ID NO: 2829466 - protein, 25 aa, Entamoeba invadens
YSMMKILVHLMLFVLVFGPTYSKPM

SEQ ID NO: 2829467 - protein, 21 aa, Entamoeba invadens
YSNCEERYLWNANLVKRFPND

SEQ ID NO: 2829468 - protein, 24 aa, Entamoeba invadens
YSNKIMMVIFHTPNNPKYIFHFDP

SEQ ID NO: 2829469 - protein, 26 aa, Entamoeba invadens
YSNMKKKWYFAPRKVSNTFYSDDHDV

SEQ ID NO: 2829470 - protein, 24 aa, Entamoeba invadens
YSNNWINALQLFYITENTSVVFNG

SEQ ID NO: 2829471 - protein, 19 aa, Entamoeba invadens
YSNSWINALQLFYITENTS

SEQ ID NO: 2829472 - protein, 50 aa, Entamoeba invadens
YSNTSCHTKVVWWVILIGVIFVLIILTIVVSFVLFFSVKISHHYQTKKVY

SEQ ID NO: 2829473 - protein, 17 aa, Entamoeba invadens
YSNVFDKFILIEQTLQN

SEQ ID NO: 2829474 - protein, 21 aa, Entamoeba invadens
YSNYWKMLYTRGSGCSPVLRH

SEQ ID NO: 2829475 - protein, 17 aa, Entamoeba invadens
YSQDIKCNPGCPYSNCL

SEQ ID NO: 2829476 - protein, 17 aa, Entamoeba invadens
YSRIFLNPEKDAMDASK

SEQ ID NO: 2829477 - protein, 24 aa, Entamoeba invadens
YSRKQFLQYIFPSVMEVLLEARSL

SEQ ID NO: 2829478 - protein, 26 aa, Entamoeba invadens
YSRNKYLMIIFHTPNNPKFIFHFDPQ

SEQ ID NO: 2829479 - protein, 26 aa, Entamoeba invadens
YSRNKYLMIIFHTPNSPKFIFHFDPQ

SEQ ID NO: 2829480 - protein, 34 aa, Entamoeba invadens
YSSFFHINVKMLLNYGFLLLTKTTSPKIEFLIEM

SEQ ID NO: 2829481 - protein, 46 aa, Entamoeba invadens
YSSGITIALVVPLVFFVILFIVVICALLLMYFQHRATIKAKELLVN

SEQ ID NO: 2829482 - protein, 18 aa, Entamoeba invadens
YSSLKFFLVYVWSKRNRD

SEQ ID NO: 2829483 - protein, 18 aa, Entamoeba invadens
YSSQGAPKRRATVASAAE

SEQ ID NO: 2829484 - protein, 19 aa, Entamoeba invadens
YSSTKTAMLAAVGVAIVSL

SEQ ID NO: 2829485 - protein, 21 aa, Entamoeba invadens
YSSTLVKLALTKKFDFMDERS

SEQ ID NO: 2829486 - protein, 32 aa, Entamoeba invadens
YSSYIFRHQTLQQKGYWYRVSPEKPELIVIDT

SEQ ID NO: 2829487 - protein, 41 aa, Entamoeba invadens
YSTGHLTLYILVPGVLLYTLLYIIVLIVGWSEHKRLLTKLR

SEQ ID NO: 2829488 - protein, 17 aa, Entamoeba invadens
YSTLLLDSVMRYDISDN

SEQ ID NO: 2829489 - protein, 19 aa, Entamoeba invadens
YSTLVFIYNTAMAKLREEL

SEQ ID NO: 2829490 - protein, 26 aa, Entamoeba invadens
YSVHSMPTFILFKNGSEFDRFSGADR

SEQ ID NO: 2829491 - protein, 18 aa, Entamoeba invadens
YSVMIWGDPYPKNEFPYP

SEQ ID NO: 2829492 - protein, 18 aa, Entamoeba invadens
YSVPIPDFSCYRVKCVER

SEQ ID NO: 2829493 - protein, 19 aa, Entamoeba invadens
YSYAITLLELWKGKEIYNK

SEQ ID NO: 2829494 - protein, 21 aa, Entamoeba invadens
YSYCLPIPREDNCKYLTTSNS

SEQ ID NO: 2829495 - protein, 38 aa, Entamoeba invadens
YSYMLHISFFFFSPLSFIQFILLVIAKYICWYNSKYKP

SEQ ID NO: 2829496 - protein, 18 aa, Entamoeba invadens
YTCFDFSKELPIMNLEDC

SEQ ID NO: 2829497 - protein, 19 aa, Entamoeba invadens
YTCLILYSVIVLSLSFVDL

SEQ ID NO: 2829498 - protein, 26 aa, Entamoeba invadens
YTCTIDSIFILFMKLYHSNKEKKISI

SEQ ID NO: 2829499 - protein, 25 aa, Entamoeba invadens
YTDFYNTLFIFPTEIVVPKEKKKNC

SEQ ID NO: 2829500 - protein, 22 aa, Entamoeba invadens
YTDKPRLAPPFYKTDFACEYPE

SEQ ID NO: 2829501 - protein, 23 aa, Entamoeba invadens
YTDRFETPFLFLTGGTKNECDSN

SEQ ID NO: 2829502 - protein, 25 aa, Entamoeba invadens
YTEKSFLLLIELKNCMFSNLMNVSI

SEQ ID NO: 2829503 - protein, 23 aa, Entamoeba invadens
YTFKIDSNWVIQYSSFKTSYNKK

SEQ ID NO: 2829504 - protein, 22 aa, Entamoeba invadens
YTFKQIINTFTFPLLTTHLIYS

SEQ ID NO: 2829505 - protein, 26 aa, Entamoeba invadens
YTFNQGCLDLLPIFLGLTMDDSDPNF

SEQ ID NO: 2829506 - protein, 19 aa, Entamoeba invadens
YTFPAIRYREIGIGLLMGV

SEQ ID NO: 2829507 - protein, 24 aa, Entamoeba invadens
YTFVTYEYNLLRKGFLEAGTQSKE

SEQ ID NO: 2829508 - protein, 32 aa, Entamoeba invadens
YTFYSFPFKFMLEQLMRFSNIFFIVNTVFTCI

SEQ ID NO: 2829509 - protein, 23 aa, Entamoeba invadens
YTGCYTCTPGYYLNGNSTCNSCA

SEQ ID NO: 2829510 - protein, 22 aa, Entamoeba invadens
YTGDPMLLSLFPKKVKSDFVAL

SEQ ID NO: 2829511 - protein, 20 aa, Entamoeba invadens
YTGGELYYYPKFQGMESLKL

SEQ ID NO: 2829512 - protein, 24 aa, Entamoeba invadens
YTGRRWDWPGTVIKYNYIYNITGW

SEQ ID NO: 2829513 - protein, 20 aa, Entamoeba invadens
YTIRDSAMTLSFLLVAVLAF

SEQ ID NO: 2829514 - protein, 25 aa, Entamoeba invadens
YTKLVMMLVCWLMPSTLLTPKYRGK

SEQ ID NO: 2829515 - protein, 18 aa, Entamoeba invadens
YTKSMFKYPWKIAEFVCS

SEQ ID NO: 2829516 - protein, 26 aa, Entamoeba invadens
YTLDDILFVGYYNESLILPKSIKVGC

SEQ ID NO: 2829517 - protein, 26 aa, Entamoeba invadens
YTLQMAKIWYSQRLEWLGFTISTLTV

SEQ ID NO: 2829518 - protein, 27 aa, Entamoeba invadens
YTLSQPVYFIKKFFGFFNATINMVPIS

SEQ ID NO: 2829519 - protein, 29 aa, Entamoeba invadens
YTLTLTPIPLIMYITFHALSSLSVVCKCT

SEQ ID NO: 2829520 - protein, 25 aa, Entamoeba invadens
YTLVLPFLMMKIPRSVFSGMMMVYS

SEQ ID NO: 2829521 - protein, 22 aa, Entamoeba invadens
YTNNYLIKTLTKGQTYIIHAFC

SEQ ID NO: 2829522 - protein, 17 aa, Entamoeba invadens
YTPFSMSLIYVMFCFDK

SEQ ID NO: 2829523 - protein, 30 aa, Entamoeba invadens
YTPPPQQPNFPFFGLPFNGASVASFSFGFG

SEQ ID NO: 2829524 - protein, 27 aa, Entamoeba invadens
YTPQWRNYLYPMSALWFGLIHFVNIGT

SEQ ID NO: 2829525 - protein, 17 aa, Entamoeba invadens
YTPRHKGTYCTKKAVWW

SEQ ID NO: 2829526 - protein, 20 aa, Entamoeba invadens
YTQFHVYTLLRLTDLCISLY

SEQ ID NO: 2829527 - protein, 17 aa, Entamoeba invadens
YTQNFNLTRTNSLLNVA

SEQ ID NO: 2829528 - protein, 35 aa, Entamoeba invadens
YTQTRQLDCVLIVIMLLMVSLSVPKIVYMEKTSTS

SEQ ID NO: 2829529 - protein, 26 aa, Entamoeba invadens
YTRFAYKLFIKIYYKNVWTQDDIRVL

SEQ ID NO: 2829530 - protein, 18 aa, Entamoeba invadens
YTSGLFTLGIILTILITM

SEQ ID NO: 2829531 - protein, 25 aa, Entamoeba invadens
YTSVHWIFFNLLPVTLGNFVGGTFL

SEQ ID NO: 2829532 - protein, 25 aa, Entamoeba invadens
YTTCLSCISGYYLNNNSCIKCAPDC

SEQ ID NO: 2829533 - protein, 19 aa, Entamoeba invadens
YTTDFFGVLSIGAQLFLFE

SEQ ID NO: 2829534 - protein, 17 aa, Entamoeba invadens
YTTSWGACVPCDRHISG

SEQ ID NO: 2829535 - protein, 29 aa, Entamoeba invadens
YTVEHLLWFPFNLLLSFFDLLIISIEIAL

SEQ ID NO: 2829536 - protein, 23 aa, Entamoeba invadens
YTVENWLEVYTRIDALLGITSEG

SEQ ID NO: 2829537 - protein, 20 aa, Entamoeba invadens
YTVMIIVIVIGTVFLLIMLI

SEQ ID NO: 2829538 - protein, 18 aa, Entamoeba invadens
YTVYFYGACFIEKHVCMV

SEQ ID NO: 2829539 - protein, 29 aa, Entamoeba invadens
YVCEFACGDTLIICNIPIQKYSCGSKTCV

SEQ ID NO: 2829540 - protein, 20 aa, Entamoeba invadens
YVCENGYYLSLGRCIKCYIN

SEQ ID NO: 2829541 - protein, 29 aa, Entamoeba invadens
YVCHLFDSFTLFIIIISRNTSIQTKDLIT

SEQ ID NO: 2829542 - protein, 19 aa, Entamoeba invadens
YVCQSLGDLFKKCLVTLPN

SEQ ID NO: 2829543 - protein, 29 aa, Entamoeba invadens
YVDDVVNAFDLILRKGIVGQIYNIGTTRE

SEQ ID NO: 2829544 - protein, 18 aa, Entamoeba invadens
YVDFYLLSSKIVVGMFVL

SEQ ID NO: 2829545 - protein, 17 aa, Entamoeba invadens
YVDSIRYAATGYFNKIE

SEQ ID NO: 2829546 - protein, 37 aa, Entamoeba invadens
YVEEYYQLFILFFGQLLTSLQVFMFVQYKVMYHPYSA

SEQ ID NO: 2829547 - protein, 18 aa, Entamoeba invadens
YVEFNGCEFVYNTETKKC

SEQ ID NO: 2829548 - protein, 27 aa, Entamoeba invadens
YVEITTKIFTYLIFSNQQSTFDFPLTT

SEQ ID NO: 2829549 - protein, 18 aa, Entamoeba invadens
YVEKITDVLYFIQNYRKN

SEQ ID NO: 2829550 - protein, 20 aa, Entamoeba invadens
YVFKNCKYLETIDLNGILNI

SEQ ID NO: 2829551 - protein, 19 aa, Entamoeba invadens
YVFSIVFISFWVGSFFISL

SEQ ID NO: 2829552 - protein, 37 aa, Entamoeba invadens
YVFSPLPFCVVFGLPLKFLIIPFIISAGFVIVLHYTK

SEQ ID NO: 2829553 - protein, 26 aa, Entamoeba invadens
YVGGPVLLLVAWFLSAFAMYLLTYVC

SEQ ID NO: 2829554 - protein, 25 aa, Entamoeba invadens
YVGLFTYRPLYGDYYIFNFTLNNLT

SEQ ID NO: 2829555 - protein, 25 aa, Entamoeba invadens
YVGTYYRLIPIFCILFGMAAVSIYG

SEQ ID NO: 2829556 - protein, 20 aa, Entamoeba invadens
YVIVIGLFVRMVIVPALCIG

SEQ ID NO: 2829557 - protein, 18 aa, Entamoeba invadens
YVKLLMASFVQIGIQFTY

SEQ ID NO: 2829558 - protein, 18 aa, Entamoeba invadens
YVKMPYKLKVRMLFDTSR

SEQ ID NO: 2829559 - protein, 32 aa, Entamoeba invadens
YVKMQMRPRLLYYPLLEMLDILIFSKIKNEIF

SEQ ID NO: 2829560 - protein, 20 aa, Entamoeba invadens
YVKRVQWGTPNKLSTVFNVS

SEQ ID NO: 2829561 - protein, 18 aa, Entamoeba invadens
YVKTIIIFSLCLHQKLHL

SEQ ID NO: 2829562 - protein, 23 aa, Entamoeba invadens
YVLFICYILSMITSVRASCPSNL

SEQ ID NO: 2829563 - protein, 17 aa, Entamoeba invadens
YVLFWIPIQTSISREST

SEQ ID NO: 2829564 - protein, 19 aa, Entamoeba invadens
YVLSPRVVTWIVSGTTQYL

SEQ ID NO: 2829565 - protein, 26 aa, Entamoeba invadens
YVMTLMTMAFFFDLKLPLHHPENVHS

SEQ ID NO: 2829566 - protein, 26 aa, Entamoeba invadens
YVNGDFLGFLYLSQTVPAKYYKVVQH

SEQ ID NO: 2829567 - protein, 27 aa, Entamoeba invadens
YVNGKEIIFFTFFISTDTLKTVNATFT

SEQ ID NO: 2829568 - protein, 17 aa, Entamoeba invadens
YVPFITGSLLYSSEVCQ

SEQ ID NO: 2829569 - protein, 19 aa, Entamoeba invadens
YVPIFIYYYNVYTNPYLMF

SEQ ID NO: 2829570 - protein, 57 aa, Entamoeba invadens
YVPSTDGTFCKNAPVWWVIFLVVVWCFIVMVVAILILIFILYKIISKYIRNKKLDML

SEQ ID NO: 2829571 - protein, 17 aa, Entamoeba invadens
YVQYVCHLFDSFTLFII

SEQ ID NO: 2829572 - protein, 20 aa, Entamoeba invadens
YVRAFITIRALIEIARDEEF

SEQ ID NO: 2829573 - protein, 26 aa, Entamoeba invadens
YVSKITRLAVLPLSLKGKIYSHQELR

SEQ ID NO: 2829574 - protein, 25 aa, Entamoeba invadens
YVSSISWYILVFAGGRYIMKLFDSD

SEQ ID NO: 2829575 - protein, 18 aa, Entamoeba invadens
YVTEYYTASVFGKLTVLK

SEQ ID NO: 2829576 - protein, 23 aa, Entamoeba invadens
YVVELMKYTKLPCLLINGVMNDG

SEQ ID NO: 2829577 - protein, 26 aa, Entamoeba invadens
YVVKTFFRYFGLMSYLIPISCAVSLE

SEQ ID NO: 2829578 - protein, 18 aa, Entamoeba invadens
YVVLIGTPTIFIYIDIKT

SEQ ID NO: 2829579 - protein, 18 aa, Entamoeba invadens
YVWNIAEKAARGERPPFS

SEQ ID NO: 2829580 - protein, 20 aa, Entamoeba invadens
YVYPFGVDPIWKSSNNELYF

SEQ ID NO: 2829581 - protein, 19 aa, Entamoeba invadens
YVYPLPFESQGQVLFTTCM

SEQ ID NO: 2829582 - protein, 22 aa, Entamoeba invadens
YWEFASYQMFCLYSFPNRVMDI

SEQ ID NO: 2829583 - protein, 17 aa, Entamoeba invadens
YYEILTKNIEYHPFTDI

SEQ ID NO: 2829584 - protein, 17 aa, Entamoeba invadens
YYESEIPVKKPTSLVFL

SEQ ID NO: 2829585 - protein, 26 aa, Entamoeba invadens
YYEWKTALCILAVTPVLMVIVFINGK

SEQ ID NO: 2829586 - protein, 25 aa, Entamoeba invadens
  misc_feature (23)..(24): Xaa can be any naturally occurring amino acid
YYGDYSTSWTVLLLVLHVIKIVXXL

SEQ ID NO: 2829587 - protein, 26 aa, Entamoeba invadens
YYGPYGIPIWTPIISPVVTLFTILPV

SEQ ID NO: 2829588 - protein, 18 aa, Entamoeba invadens
YYIHYYILSFTNLFTKQQ

SEQ ID NO: 2829589 - protein, 19 aa, Entamoeba invadens
YYILLKRLVDGDAQFHVSK

SEQ ID NO: 2829590 - protein, 27 aa, Entamoeba invadens
YYIMNSICVPCKSPCYYCSNETYCSKC

SEQ ID NO: 2829591 - protein, 17 aa, Entamoeba invadens
YYKELFYTGSDKVKKSL

SEQ ID NO: 2829592 - protein, 17 aa, Entamoeba invadens
YYKFIPTDNMFFFIVSI

SEQ ID NO: 2829593 - protein, 19 aa, Entamoeba invadens
YYKLHKEVYDWFDIAFNYF

SEQ ID NO: 2829594 - protein, 25 aa, Entamoeba invadens
YYKYQYLNLAWIILCTSWAIANGAN

SEQ ID NO: 2829595 - protein, 18 aa, Entamoeba invadens
YYLDLTDKCGLDCPEGSK

SEQ ID NO: 2829596 - protein, 27 aa, Entamoeba invadens
YYLFGTAGCWFFVDIAFYGNSMFNSTV

SEQ ID NO: 2829597 - protein, 17 aa, Entamoeba invadens
YYLLNNLCDRCNIRFVD

SEQ ID NO: 2829598 - protein, 18 aa, Entamoeba invadens
YYLNADYECKKCSEECLE

SEQ ID NO: 2829599 - protein, 18 aa, Entamoeba invadens
YYMTMYFYYYFYSDYFIS

SEQ ID NO: 2829600 - protein, 26 aa, Entamoeba invadens
YYRTITGFVVLLQKEFIQFKFFANGD

SEQ ID NO: 2829601 - protein, 17 aa, Entamoeba invadens
YYRYGFQFLWETYLYHA

SEQ ID NO: 2829602 - protein, 30 aa, Entamoeba invadens
YYTCRSCIVSILWKYLAFSVKCALKQQEEP

SEQ ID NO: 2829603 - protein, 18 aa, Entamoeba invadens
YYTPNKKGECYIGMDYII

SEQ ID NO: 2829604 - protein, 18 aa, Entamoeba invadens
YYTQIINQTILLLTSSSF

SEQ ID NO: 2829605 - protein, 17 aa, Entamoeba invadens
YYTQQFPDLYPKTAFKK

SEQ ID NO: 2829606 - protein, 23 aa, Entamoeba invadens
YYVFPSAMRFLPFVMALSLFLNN

SEQ ID NO: 2829607 - protein, 25 aa, Entamoeba invadens
YYVIHSLLTLTYPKETYFVNNPCAS

SEQ ID NO: 2829608 - protein, 17 aa, Entamoeba invadens
YYVVKAKINRYLRKYLY

SEQ ID NO: 2829609 - protein, 19 aa, Entamoeba invadens
YYYNFILQNYNAGAQGGMN

SEQ ID NO: 2829610 - protein, 25 aa, Entamoeba invadens
YYYQQDMYFPFTQQAYFDTFVCNDS

SEQ ID NO: 2829611 - protein, 17 aa, Entamoeba invadens
KFRSEFIVYFYGAVFIP

SEQ ID NO: 2829612 - protein, 20 aa, Entamoeba invadens
KYKYPTFFPFFMSYSHTYNG

SEQ ID NO: 2829613 - protein, 34 aa, Entamoeba invadens
AAIGIPMSILLVLIIIVLLIIITLIVILKKNQKK

SEQ ID NO: 2829614 - protein, 18 aa, Entamoeba invadens
AIIFVCLYIFVSKPIIEL

SEQ ID NO: 2829615 - protein, 26 aa, Entamoeba invadens
CESQVVWWVILIAVLIVILVVILVAV

SEQ ID NO: 2829616 - protein, 34 aa, Entamoeba invadens
CETQAVWWFIVLVLLFVFFVVFVVIVALYFTVKK

SEQ ID NO: 2829617 - protein, 20 aa, Entamoeba invadens
DTQYYCNIFKWAIDANILAE

SEQ ID NO: 2829618 - protein, 18 aa, Entamoeba invadens
FFFLLEGLFLYNGYLRIA

SEQ ID NO: 2829619 - protein, 20 aa, Entamoeba invadens
FGWCEIYPKNIFKYSWKIAE

SEQ ID NO: 2829620 - protein, 30 aa, Entamoeba invadens
FVVIVIIVVIVLLFTLSYLYNYFGNKKKMQ

SEQ ID NO: 2829621 - protein, 30 aa, Entamoeba invadens
GIPISILLVMIIIVLLIVITLIVIFKRNQK

SEQ ID NO: 2829622 - protein, 23 aa, Entamoeba invadens
IINKPFFFVIVDPHSLPIFFGKC

SEQ ID NO: 2829623 - protein, 18 aa, Entamoeba invadens
ILPSIGLYWCKDKHKIVC

SEQ ID NO: 2829624 - protein, 30 aa, Entamoeba invadens
IPIVSVFIIVLIIIGIIVITIIVLQKRKET

SEQ ID NO: 2829625 - protein, 41 aa, Entamoeba invadens
KKDVPTWVIVILIIIGVFIVIILILFVVFIVVARKILLRRR

SEQ ID NO: 2829626 - protein, 24 aa, Entamoeba invadens
KRFLFMYLMVAIYDLFSIAFPLEC

SEQ ID NO: 2829627 - protein, 23 aa, Entamoeba invadens
KYPPLTITFPMKLRLKFLIDAAK

SEQ ID NO: 2829628 - protein, 27 aa, Entamoeba invadens
LCESHVVWWVILLGVIFVIIVLIIITI

SEQ ID NO: 2829629 - protein, 18 aa, Entamoeba invadens
LVLVIAIIFVCLYIFVSK

SEQ ID NO: 2829630 - protein, 24 aa, Entamoeba invadens
MFGLGFLLLFPWLVAFIISRKTKN

SEQ ID NO: 2829631 - protein, 26 aa, Entamoeba invadens
NLCLFLSVLCFILLAILSVSEKRNKR

SEQ ID NO: 2829632 - protein, 28 aa, Entamoeba invadens
PDASRRMLLLVSWLLSGFYLMPTGIKKP

SEQ ID NO: 2829633 - protein, 24 aa, Entamoeba invadens
SETASLLILFTKTSYIGLGNVKKD

SEQ ID NO: 2829634 - protein, 24 aa, Entamoeba invadens
SKTAVWWVILLIVVVIIAILVLVT

SEQ ID NO: 2829635 - protein, 23 aa, Entamoeba invadens
SLISLIFFIILTFDTTSHLSKNK

SEQ ID NO: 2829636 - protein, 27 aa, Entamoeba invadens
SVSSRFCWILIFVLLNSLLVMYLIGVG

SEQ ID NO: 2829637 - protein, 22 aa, Entamoeba invadens
TGNWNPFFLTFDNLGLAPRINY

SEQ ID NO: 2829638 - protein, 21 aa, Entamoeba invadens
TNWALIIPLVVVGVIIIVLIF

SEQ ID NO: 2829639 - protein, 39 aa, Entamoeba invadens
TNYGLVVVLPILCILLLVIILFIIIITTLIVIHRNHKKE

SEQ ID NO: 2829640 - protein, 19 aa, Entamoeba invadens
TYEPIAYCLIYNKDHTCKT

SEQ ID NO: 2829641 - protein, 31 aa, Entamoeba invadens
VEKFEFPMYMIAVIIIFVLVLAVIVALLIAY

SEQ ID NO: 2829642 - protein, 24 aa, Entamoeba invadens
VFSTHSIFVAFLLLYVGSMAETKK

SEQ ID NO: 2829643 - protein, 32 aa, Entamoeba invadens
VVGVIIIVLIFIAIIAIIWWRRAKSVKAETAA

SEQ ID NO: 2829644 - protein, 21 aa, Entamoeba invadens
AAIILIIVAVVFFMKKKSSKY

SEQ ID NO: 2829645 - protein, 17 aa, Entamoeba invadens
AALLLYILIIFDALRKP

SEQ ID NO: 2829646 - protein, 32 aa, Entamoeba invadens
ACDLKAVWWVLLFVIVISILVVILIIAVVVVT

SEQ ID NO: 2829647 - protein, 17 aa, Entamoeba invadens
ACFKCDLGYYPINGKCT

SEQ ID NO: 2829648 - protein, 18 aa, Entamoeba invadens
ACFVMVWLAFVTMIIFLY

SEQ ID NO: 2829649 - protein, 17 aa, Entamoeba invadens
ACWLIPFIDRLVPLFGD

SEQ ID NO: 2829650 - protein, 26 aa, Entamoeba invadens
ADVTYFALNILYFVSLVLDPYIPEFG

SEQ ID NO: 2829651 - protein, 24 aa, Entamoeba invadens
AERKTWWICVTFSICIVLFIILIL

SEQ ID NO: 2829652 - protein, 18 aa, Entamoeba invadens
AFALFVVLIILKLVSNIR

SEQ ID NO: 2829653 - protein, 24 aa, Entamoeba invadens
AFEMSFLPNFKLSYSPSLHVGISA

SEQ ID NO: 2829654 - protein, 20 aa, Entamoeba invadens
AFEWKMIWVMLTWLCIYNTI

SEQ ID NO: 2829655 - protein, 21 aa, Entamoeba invadens
AFFHLPLVFFLTTPIPLFTFA

SEQ ID NO: 2829656 - protein, 20 aa, Entamoeba invadens
AFFLGYMMFYILAFFNLLRR

SEQ ID NO: 2829657 - protein, 26 aa, Entamoeba invadens
AFQSIFLFLVFFISSLPFLILCLAVG

SEQ ID NO: 2829658 - protein, 24 aa, Entamoeba invadens
AFTISFILLIGYFLGVIFVLYFGY

SEQ ID NO: 2829659 - protein, 19 aa, Entamoeba invadens
AFVVFISFTAVVIGLAVGL

SEQ ID NO: 2829660 - protein, 26 aa, Entamoeba invadens
AGFIILLIVGIIIIVLFVIFHSLRNE

SEQ ID NO: 2829661 - protein, 27 aa, Entamoeba invadens
AGGFFWLFLLIVPFILRCGTRICYNLF

SEQ ID NO: 2829662 - protein, 25 aa, Entamoeba invadens
AGGVLLLLILIVVVVIVAILIPKRK

SEQ ID NO: 2829663 - protein, 19 aa, Entamoeba invadens
AGKVYYLALFANGVYRYST

SEQ ID NO: 2829664 - protein, 17 aa, Entamoeba invadens
AGRICALYYYNSYLTLW

SEQ ID NO: 2829665 - protein, 20 aa, Entamoeba invadens
AHFSYFIRSILELGYNSEAV

SEQ ID NO: 2829666 - protein, 17 aa, Entamoeba invadens
AHILLLLYFGEQTTEVF

SEQ ID NO: 2829667 - protein, 23 aa, Entamoeba invadens
AIFPILVFFMYMDGYLNSEQSSP

SEQ ID NO: 2829668 - protein, 38 aa, Entamoeba invadens
AIGIPISILLVMIIIVLLIVITLIVIFKRKQKKEELKV

SEQ ID NO: 2829669 - protein, 35 aa, Entamoeba invadens
AIGIPMSILLVMIIIFLLIVITLIVIFKRNQKKEK

SEQ ID NO: 2829670 - protein, 33 aa, Entamoeba invadens
AIGLPVMFMLLIIITISVIIVGLFYLYQHFKEQ

SEQ ID NO: 2829671 - protein, 17 aa, Entamoeba invadens
AIIFLLTFALKMFFALP

SEQ ID NO: 2829672 - protein, 22 aa, Entamoeba invadens
AILAAIYLYLGLFLAAGEKMIA

SEQ ID NO: 2829673 - protein, 19 aa, Entamoeba invadens
AILILLFSCIWPYTKLILL

SEQ ID NO: 2829674 - protein, 24 aa, Entamoeba invadens
AILTALLLGILYWFNNRKKVNYGH

SEQ ID NO: 2829675 - protein, 23 aa, Entamoeba invadens
AINGFLFPLHPFTAPPHYVYPWR

SEQ ID NO: 2829676 - protein, 17 aa, Entamoeba invadens
AITMLECFLWSNAYPKS

SEQ ID NO: 2829677 - protein, 24 aa, Entamoeba invadens
AIVIAIIFIIIYMFSVKPIIELQR

SEQ ID NO: 2829678 - protein, 30 aa, Entamoeba invadens
AIVLPIVFVVIFIVLIVVIFALIGFYIRNK

SEQ ID NO: 2829679 - protein, 27 aa, Entamoeba invadens
AKERLKYMWIIFSIYLKSLIGFYQENG

SEQ ID NO: 2829680 - protein, 24 aa, Entamoeba invadens
AKKAVWWVIFIGVFLIILVLFVVF

SEQ ID NO: 2829681 - protein, 23 aa, Entamoeba invadens
AKKAVWWVILVGIFLIILVLFVV

SEQ ID NO: 2829682 - protein, 26 aa, Entamoeba invadens
AKTTKILFFDILKITTLILPNEEHTN

SEQ ID NO: 2829683 - protein, 22 aa, Entamoeba invadens
AKVKHPFLVNLYYSFQTSSALH

SEQ ID NO: 2829684 - protein, 18 aa, Entamoeba invadens
ALCIVVLIPIFGVLLFFD

SEQ ID NO: 2829685 - protein, 18 aa, Entamoeba invadens
ALFGVKFIYRMTLLLTAF

SEQ ID NO: 2829686 - protein, 25 aa, Entamoeba invadens
ALFLPKFRVFRIIKKIIKKIQIRGF

SEQ ID NO: 2829687 - protein, 29 aa, Entamoeba invadens
ALIIIAIAIFIALLIVLCIMLYVYYQYRS

SEQ ID NO: 2829688 - protein, 29 aa, Entamoeba invadens
ALISVLIPILVLIFLCVVAIIILIPTIYL

SEQ ID NO: 2829689 - protein, 20 aa, Entamoeba invadens
ALKMFLCQIPGRLINKTLTH

SEQ ID NO: 2829690 - protein, 23 aa, Entamoeba invadens
ALLLVLYFIFLFCVSAIITLVVL

SEQ ID NO: 2829691 - protein, 17 aa, Entamoeba invadens
ALMLFSHYPFLPKDPIV

SEQ ID NO: 2829692 - protein, 24 aa, Entamoeba invadens
ALPDFIITKFIALAIRLYLKLMKQ

SEQ ID NO: 2829693 - protein, 21 aa, Entamoeba invadens
ALSFTFCVLLVGIALILLIKY

SEQ ID NO: 2829694 - protein, 25 aa, Entamoeba invadens
ALSLYLFFTMIYLNLIKLTILERIV

SEQ ID NO: 2829695 - protein, 37 aa, Entamoeba invadens
ALVVPLVFFVILFIVVICALLLMYFQHRATIKAKELL

SEQ ID NO: 2829696 - protein, 19 aa, Entamoeba invadens
ALYPLFNFLLTFIDNKKQD

SEQ ID NO: 2829697 - protein, 17 aa, Entamoeba invadens
AMTITYSLFPLIVALCC

SEQ ID NO: 2829698 - protein, 21 aa, Entamoeba invadens
APIKLVHLVIVLFPTFIDIKN

SEQ ID NO: 2829699 - protein, 25 aa, Entamoeba invadens
APITVKPLLILPLYSALPPEQQLLV

SEQ ID NO: 2829700 - protein, 17 aa, Entamoeba invadens
APLIFLGVLLLSVGIVT

SEQ ID NO: 2829701 - protein, 19 aa, Entamoeba invadens
APPLFLFLKCICNDLQTED

SEQ ID NO: 2829702 - protein, 18 aa, Entamoeba invadens
AQMKLLFFNRGLMYFFMI

SEQ ID NO: 2829703 - protein, 25 aa, Entamoeba invadens
AREALVDLILILPFIAVIVALIGAF

SEQ ID NO: 2829704 - protein, 19 aa, Entamoeba invadens
ASIFFYWFFPHEFKLHDAV

SEQ ID NO: 2829705 - protein, 23 aa, Entamoeba invadens
ASLSLDVIWIYKVNIFIDDSGTL

SEQ ID NO: 2829706 - protein, 19 aa, Entamoeba invadens
ASRKMLFSGLLVLVVLTST

SEQ ID NO: 2829707 - protein, 25 aa, Entamoeba invadens
ASVMVFLIFVALFGASLYIAIKYFK

SEQ ID NO: 2829708 - protein, 25 aa, Entamoeba invadens
ATDKIIMVLIILCVVVIILCSLLYI

SEQ ID NO: 2829709 - protein, 22 aa, Entamoeba invadens
ATDPFYHLSRFLRKMKLTVTNE

SEQ ID NO: 2829710 - protein, 28 aa, Entamoeba invadens
ATERLKYIWIIFALLIKSLIAFYNDHNA

SEQ ID NO: 2829711 - protein, 41 aa, Entamoeba invadens
ATHAVWWVILLVVLLTLVVVSILLFFVLKLVNYLIKEYQTH

SEQ ID NO: 2829712 - protein, 17 aa, Entamoeba invadens
ATKVLIVVLVVAFIFVI

SEQ ID NO: 2829713 - protein, 23 aa, Entamoeba invadens
ATLIPINLYQPFLEKFLSAVEVR

SEQ ID NO: 2829714 - protein, 21 aa, Entamoeba invadens
ATLLWRLVDIFFTIPVTYSFG

SEQ ID NO: 2829715 - protein, 20 aa, Entamoeba invadens
ATMAIVSTSIVLLSCSVRAR

SEQ ID NO: 2829716 - protein, 25 aa, Entamoeba invadens
ATNYFVYFRFLWIKLGLENDEGKQI

SEQ ID NO: 2829717 - protein, 20 aa, Entamoeba invadens
ATPLVFLFRAEPYTYMHMKL

SEQ ID NO: 2829718 - protein, 18 aa, Entamoeba invadens
ATSNFLLDVLRLCGFFFD

SEQ ID NO: 2829719 - protein, 22 aa, Entamoeba invadens
ATVLILFFFFHTLIAICFTPLV

SEQ ID NO: 2829720 - protein, 24 aa, Entamoeba invadens
ATYNLLILLLRYFGMLLTPSSLTD

SEQ ID NO: 2829721 - protein, 19 aa, Entamoeba invadens
AVFLLIVINIGLIGFIIYS

SEQ ID NO: 2829722 - protein, 25 aa, Entamoeba invadens
AVLFVIIMFVILIISIIVVTKIILN

SEQ ID NO: 2829723 - protein, 22 aa, Entamoeba invadens
AVLLLIFVVGLLSIKRFKKSNY

SEQ ID NO: 2829724 - protein, 23 aa, Entamoeba invadens
AVQIVFLCYIIFSALPKFIFGSL

SEQ ID NO: 2829725 - protein, 23 aa, Entamoeba invadens
AVTIVLLLLIISIIIVVIVLVQR

SEQ ID NO: 2829726 - protein, 17 aa, Entamoeba invadens
AVVVTLIIVFRFKQREK

SEQ ID NO: 2829727 - protein, 19 aa, Entamoeba invadens
AWRCAYVDLAFKFPWKIAE

SEQ ID NO: 2829728 - protein, 23 aa, Entamoeba invadens
AYFGSLIFYFLWGMGYGIVAAIP

SEQ ID NO: 2829729 - protein, 25 aa, Entamoeba invadens
AYMLHSLPFLILYPTIYLAIAYPML

SEQ ID NO: 2829730 - protein, 21 aa, Entamoeba invadens
CADDYFLYAPLNPLCQSYDTL

SEQ ID NO: 2829731 - protein, 17 aa, Entamoeba invadens
CAFGYYYDDTTSDCLYV

SEQ ID NO: 2829732 - protein, 17 aa, Entamoeba invadens
CAFGYYYDYTTSDCLYV

SEQ ID NO: 2829733 - protein, 31 aa, Entamoeba invadens
CAILFGYVRLWAFIPIILCLLFVFANLLSSQ

SEQ ID NO: 2829734 - protein, 24 aa, Entamoeba invadens
CAKNTFIYFFFPSSGFKPTCASDG

SEQ ID NO: 2829735 - protein, 38 aa, Entamoeba invadens
CASQVVWWVILIIVVFIIVLLIVVITVVYFVLNSISKL

SEQ ID NO: 2829736 - protein, 26 aa, Entamoeba invadens
CATLTYTTFLLLFLISAASSWCLTVM

SEQ ID NO: 2829737 - protein, 21 aa, Entamoeba invadens
CCFVLFFIIIAIVGVLLAYMM

SEQ ID NO: 2829738 - protein, 24 aa, Entamoeba invadens
CCLLYLFVFLVFGLGLVQGKMADF

SEQ ID NO: 2829739 - protein, 18 aa, Entamoeba invadens
CDGLLLRAMKSGSWVLLD

SEQ ID NO: 2829740 - protein, 29 aa, Entamoeba invadens
CDKHAVWWIILIIVMFIVLIIIISTVLIL

SEQ ID NO: 2829741 - protein, 34 aa, Entamoeba invadens
CDKHAVWWIILIIVMFLVLIIIISTVLILYIVFL

SEQ ID NO: 2829742 - protein, 26 aa, Entamoeba invadens
CDKKAVWWVLLIVVLFAIIVMAVVIT

SEQ ID NO: 2829743 - protein, 37 aa, Entamoeba invadens
CDKKVVWWVLLVIILFTIIMMILYVLLIVFTVKYIEK

SEQ ID NO: 2829744 - protein, 39 aa, Entamoeba invadens
CDKSFNYWLVIVLPVACVVLILLILISSIIIVINIVNKS

SEQ ID NO: 2829745 - protein, 33 aa, Entamoeba invadens
CDTHAVWWFILIWVLFVIIVVIIITLIICFSVK

SEQ ID NO: 2829746 - protein, 18 aa, Entamoeba invadens
CEDLFTNNYYLADGKGHC

SEQ ID NO: 2829747 - protein, 23 aa, Entamoeba invadens
CEEGYFLNFPIPLCVKCLNNCTS

SEQ ID NO: 2829748 - protein, 17 aa, Entamoeba invadens
CEFEVYLTPYCCLNLND

SEQ ID NO: 2829749 - protein, 20 aa, Entamoeba invadens
CEFSLYLTPLCTCKINTTIQ

SEQ ID NO: 2829750 - protein, 20 aa, Entamoeba invadens
CEFSLYLTPLCTCKITTTIQ

SEQ ID NO: 2829751 - protein, 43 aa, Entamoeba invadens
CEKAVVWWVILLIVLFCVLFIALFVILVMFLTLFVMRKTMKNK

SEQ ID NO: 2829752 - protein, 42 aa, Entamoeba invadens
CEKHTVWWVILVIVLFIIIVLTLFIIILVFTVKHILKKIHTK

SEQ ID NO: 2829753 - protein, 42 aa, Entamoeba invadens
CEKHTVWWVILVIVLFIIIVLTLFIIILVYTVKHILKKIHTK

SEQ ID NO: 2829754 - protein, 42 aa, Entamoeba invadens
CEKHTVWWVILVIVLFIIIVLTLFIIILVYTVKYILKNIHTK

SEQ ID NO: 2829755 - protein, 42 aa, Entamoeba invadens
CEKHTVWWVILVIVLFIIIVLTLFIILLVFTVKHILKKIHTK

SEQ ID NO: 2829756 - protein, 40 aa, Entamoeba invadens
CEKKAVWWVILLIVLFLLILLILLFVVLFSIIIKVLYVVE

SEQ ID NO: 2829757 - protein, 38 aa, Entamoeba invadens
CEKKIVLWVVLVIVLFIIFVLSILVIALIFSMKRILKM

SEQ ID NO: 2829758 - protein, 31 aa, Entamoeba invadens
CEKRAVWWVILVVVLFIIFVLSILVIVLIFS

SEQ ID NO: 2829759 - protein, 32 aa, Entamoeba invadens
CEKRAVWWVILVVVLFIIFVLSILVIVLIFST

SEQ ID NO: 2829760 - protein, 25 aa, Entamoeba invadens
CELQIVWWVIFVVVMCVLIVFIVLI

SEQ ID NO: 2829761 - protein, 27 aa, Entamoeba invadens
CELQVTWILLIVFSILITLLGIFAVTT

SEQ ID NO: 2829762 - protein, 33 aa, Entamoeba invadens
CENKAVWWIILLIVVFIVLVLLSTSGLIVYFTK

SEQ ID NO: 2829763 - protein, 27 aa, Entamoeba invadens
CENSPVWWVILFIVITDIIFITSVSLL

SEQ ID NO: 2829764 - protein, 42 aa, Entamoeba invadens
CEQQIVWWVVLISILFCFLSIVFILISLYYFIKKIVKKNKMI

SEQ ID NO: 2829765 - protein, 32 aa, Entamoeba invadens
CERKAVWWVVVLLVIFVVLILSGIVVLIIFGT

SEQ ID NO: 2829766 - protein, 42 aa, Entamoeba invadens
CERKLSVWWVILVAVLFLLIVLFVLILLIVILTKIIFNKYHS

SEQ ID NO: 2829767 - protein, 40 aa, Entamoeba invadens
CESKAAWWVIFIIIVIIIIFILAIFIVAVFIIKCVIFKLK

SEQ ID NO: 2829768 - protein, 25 aa, Entamoeba invadens
CESQAVWWVILVAVLFVFGVLFVLI

SEQ ID NO: 2829769 - protein, 28 aa, Entamoeba invadens
CESQIVWWVIFVLVICVLIVFIILIVSI

SEQ ID NO: 2829770 - protein, 36 aa, Entamoeba invadens
CESQIVWWVILIAVVFFCILLILSVVFLIVFTKKIL

SEQ ID NO: 2829771 - protein, 26 aa, Entamoeba invadens
CESRAVWWVILVVVLFVLIVLLVLIV

SEQ ID NO: 2829772 - protein, 24 aa, Entamoeba invadens
CESTPVWWVIMLCVVVGVFMFVVI

SEQ ID NO: 2829773 - protein, 27 aa, Entamoeba invadens
CETHIVWWVIILVVILSIVILISFIVI

SEQ ID NO: 2829774 - protein, 28 aa, Entamoeba invadens
CETKAVWWVIVIIVILSIVVLIVVFVVI

SEQ ID NO: 2829775 - protein, 37 aa, Entamoeba invadens
CETKVVWWVILISVLIIIVIFVVMFIVIVLIIRTILA

SEQ ID NO: 2829776 - protein, 38 aa, Entamoeba invadens
CETKVVWWVILISVLVIIVFLFFTFVAIFLITRTILAH

SEQ ID NO: 2829777 - protein, 35 aa, Entamoeba invadens
CETQAVWWVIFLMVLLFIIIFVSLIVIIIITTKKI

SEQ ID NO: 2829778 - protein, 21 aa, Entamoeba invadens
CFFFMVWLFLCFIESKLFVSF

SEQ ID NO: 2829779 - protein, 20 aa, Entamoeba invadens
CFGWCNAFSEKQFKFPWKIA

SEQ ID NO: 2829780 - protein, 19 aa, Entamoeba invadens
CFYKNIAMFFVLFYLAFLN

SEQ ID NO: 2829781 - protein, 21 aa, Entamoeba invadens
CGIGLLFVLIFYYYTYANQII

SEQ ID NO: 2829782 - protein, 24 aa, Entamoeba invadens
CGLLFHLRQALTISSLPILKKFNV

SEQ ID NO: 2829783 - protein, 30 aa, Entamoeba invadens
CGMEMQLFLLRWVRLLFCQIFPPQVIKMMW

SEQ ID NO: 2829784 - protein, 23 aa, Entamoeba invadens
CGNSLVEQFLKLKYSRIFLNPEK

SEQ ID NO: 2829785 - protein, 24 aa, Entamoeba invadens
CHNLKVFCLLLQKTFITYTEKVLK

SEQ ID NO: 2829786 - protein, 37 aa, Entamoeba invadens
CHSKAVWWVIIISFLFIIFIITLLIGLTVLLTKKIML

SEQ ID NO: 2829787 - protein, 25 aa, Entamoeba invadens
CHTKVVWWVILIGVIFVLIIITIVV

SEQ ID NO: 2829788 - protein, 27 aa, Entamoeba invadens
CIAQAVWWVILLCVLFIISIFVIIIAM

SEQ ID NO: 2829789 - protein, 38 aa, Entamoeba invadens
CIAQAVWWVILLCVLFVMVIFIIFIALSIFVFIVILNH

SEQ ID NO: 2829790 - protein, 38 aa, Entamoeba invadens
CIAQVVWWVILLCVLFVIVIFIIIIALSIFIFIVILNH

SEQ ID NO: 2829791 - protein, 17 aa, Entamoeba invadens
CIIYYSVGQETPCYTID

SEQ ID NO: 2829792 - protein, 18 aa, Entamoeba invadens
CIKGFFLTAYFKCDSCSK

SEQ ID NO: 2829793 - protein, 41 aa, Entamoeba invadens
CIKHVVWWVILLCLLFVILLLMTFILIITLVIKKILLNIQK

SEQ ID NO: 2829794 - protein, 28 aa, Entamoeba invadens
CIRWLGAFRFILWTLWYCVKLMCTKMVV

SEQ ID NO: 2829795 - protein, 19 aa, Entamoeba invadens
CISCYFWFVLNVQTSHCDL

SEQ ID NO: 2829796 - protein, 35 aa, Entamoeba invadens
CITKSVWWVILLIILFIIFLLILVVVGLYLLVKKL

SEQ ID NO: 2829797 - protein, 38 aa, Entamoeba invadens
CITQAVWWVILLCVLFVIFIFIIIIASSIFIFIAILNH

SEQ ID NO: 2829798 - protein, 46 aa, Entamoeba invadens
CITQAVWWVILLIVIFIVFIIICLIILMIIALTKYFDYLRLKRCVQ

SEQ ID NO: 2829799 - protein, 26 aa, Entamoeba invadens
CITQAVWWVILLIVIVVVVIIILVIV

SEQ ID NO: 2829800 - protein, 21 aa, Entamoeba invadens
CIVCEDLFTNNYYLADGKGHC

SEQ ID NO: 2829801 - protein, 25 aa, Entamoeba invadens
CKFLSLLRLYLLLFSALLHLTTTFS

SEQ ID NO: 2829802 - protein, 17 aa, Entamoeba invadens
CKKIFLKDWTSPPLKFS

SEQ ID NO: 2829803 - protein, 25 aa, Entamoeba invadens
CKKKVVWWVVLIVVIFIVVIVVILI

SEQ ID NO: 2829804 - protein, 26 aa, Entamoeba invadens
CKNAPVWWVIFLVVVWCFIVMVVAIL

SEQ ID NO: 2829805 - protein, 19 aa, Entamoeba invadens
CKPTYYLIILENVCLKCKE

SEQ ID NO: 2829806 - protein, 32 aa, Entamoeba invadens
CKREWKWFLIMYILTVIFDLFCISFPLMCQYF

SEQ ID NO: 2829807 - protein, 26 aa, Entamoeba invadens
CKSRAVWWVILVAVLFVIIMFVILII

SEQ ID NO: 2829808 - protein, 33 aa, Entamoeba invadens
CKSSVVWWVIFLVVIFVLFMIITVLICIILAMN

SEQ ID NO: 2829809 - protein, 42 aa, Entamoeba invadens
CKTHVVWWVLFIVIVIFLIFILLIIFAIFRLNLLIIKMRRNA

SEQ ID NO: 2829810 - protein, 34 aa, Entamoeba invadens
CKTKVVWWVILLCVLFMVFIGVLLITIGIFSMFK

SEQ ID NO: 2829811 - protein, 19 aa, Entamoeba invadens
CLCLILFFSEFKNIYFQIN

SEQ ID NO: 2829812 - protein, 26 aa, Entamoeba invadens
CLEGNKYIHKYLWCTDTFKGIMDCPK

SEQ ID NO: 2829813 - protein, 18 aa, Entamoeba invadens
CLFIQMYSIIFLSLVLSV

SEQ ID NO: 2829814 - protein, 24 aa, Entamoeba invadens
CLKDKLFKVILFTVNFTGNFNLAL

SEQ ID NO: 2829815 - protein, 21 aa, Entamoeba invadens
CLPLQFFHSTIFIFSLIFIVL

SEQ ID NO: 2829816 - protein, 32 aa, Entamoeba invadens
CLVNLQFILFLQLPFVFAFPWINAVVVYVLAF

SEQ ID NO: 2829817 - protein, 23 aa, Entamoeba invadens
CMCMYVYNYYLYPSPLKGVAPLD

SEQ ID NO: 2829818 - protein, 36 aa, Entamoeba invadens
CMKKNVWWVILLIIFLLFIISFIIICIVVYEILKIL

SEQ ID NO: 2829819 - protein, 17 aa, Entamoeba invadens
CMKRGYWLLMENVNFCN

SEQ ID NO: 2829820 - protein, 18 aa, Entamoeba invadens
CNEGFYLQNWKCHFCSTN

SEQ ID NO: 2829821 - protein, 18 aa, Entamoeba invadens
CNGALKMVIILLAIALTL

SEQ ID NO: 2829822 - protein, 27 aa, Entamoeba invadens
CNKKAVWWVLFIVVLFVIIVMAAVITS

SEQ ID NO: 2829823 - protein, 26 aa, Entamoeba invadens
CNKKAVWWVLLIVVLFAIIVMAVVIT

SEQ ID NO: 2829824 - protein, 40 aa, Entamoeba invadens
CNKKIVWWVLFIIILFTIIMMIFLILLIVFTVKCIEKKVH

SEQ ID NO: 2829825 - protein, 39 aa, Entamoeba invadens
CNKKIVWWVLLVIILFTIIMMIFLILLIIFTVKCIENKV

SEQ ID NO: 2829826 - protein, 28 aa, Entamoeba invadens
CNKKVMWWVILMGVILILIVISIIVLII

SEQ ID NO: 2829827 - protein, 31 aa, Entamoeba invadens
CNKKVVWWVLLIIVLFIIGVLIILILTIVFV

SEQ ID NO: 2829828 - protein, 23 aa, Entamoeba invadens
CNNILFPYRAKILAILKLLIHTF

SEQ ID NO: 2829829 - protein, 35 aa, Entamoeba invadens
CNSHVVWWVILIGVLLIIVILIVTILVIVLIVKHV

SEQ ID NO: 2829830 - protein, 41 aa, Entamoeba invadens
CNSRAVWWVIFISVLFIVIIILTLILLTLLLILKVLQHKRQ

SEQ ID NO: 2829831 - protein, 29 aa, Entamoeba invadens
CNTKAVWWVIILIVLFLLIIIVMCIVSIV

SEQ ID NO: 2829832 - protein, 33 aa, Entamoeba invadens
CNVHVVWWVIFISVLFVVIIILTLVILTIIIIL

SEQ ID NO: 2829833 - protein, 32 aa, Entamoeba invadens
CQEAIIWWVILIIVLFIIFVTIFLVNGIVLAS

SEQ ID NO: 2829834 - protein, 26 aa, Entamoeba invadens
CQKQSLWYVYLIIAIIVLGIICLVVL

SEQ ID NO: 2829835 - protein, 32 aa, Entamoeba invadens
CQNSPVWWLIVIIIIIILLVVVLLIIGTCIAL

SEQ ID NO: 2829836 - protein, 39 aa, Entamoeba invadens
CQRRSLLAVVFPIVLVTLLIVLLLISILLIVLITKHFDR

SEQ ID NO: 2829837 - protein, 33 aa, Entamoeba invadens
CQSKAVWWVILLIVLVILLIIVILTITIGYMIN

SEQ ID NO: 2829838 - protein, 40 aa, Entamoeba invadens
CQTKVVWWVILIVVIFVLIIITLVLFIVLFILIQINRHYQ

SEQ ID NO: 2829839 - protein, 39 aa, Entamoeba invadens
CRKKVVWWVVFLLVLFVLFVFVTLIFVFIAVVLFLMKKH

SEQ ID NO: 2829840 - protein, 27 aa, Entamoeba invadens
CRSQTVWWVILIVVMFVLIVLFVLIVT

SEQ ID NO: 2829841 - protein, 27 aa, Entamoeba invadens
CSAFGIICSHFYYYSYNRFFNIFNTPQ

SEQ ID NO: 2829842 - protein, 21 aa, Entamoeba invadens
CSGIFLLIIIVGVCGIVGFVI

SEQ ID NO: 2829843 - protein, 35 aa, Entamoeba invadens
CSHQRDIFILEFLSLLFQFPLCVKLAGLILLCGTL

SEQ ID NO: 2829844 - protein, 27 aa, Entamoeba invadens
CSKKAVWWVILLIIVIVISIPVLVIVL

SEQ ID NO: 2829845 - protein, 29 aa, Entamoeba invadens
CSKTAVWWVILLIIVIVISILVLITALVL

SEQ ID NO: 2829846 - protein, 34 aa, Entamoeba invadens
CSKTAVWWVILLIVVIIILITVLFIVLVLFVMVK

SEQ ID NO: 2829847 - protein, 25 aa, Entamoeba invadens
CSKTAVWWVILLIVVVIIAILVLII

SEQ ID NO: 2829848 - protein, 23 aa, Entamoeba invadens
CSSLLFWAYLFSTITLSLWMVVT

SEQ ID NO: 2829849 - protein, 29 aa, Entamoeba invadens
CTKKAVWWVLFIIVLFVIVVLTGLILSIV

SEQ ID NO: 2829850 - protein, 43 aa, Entamoeba invadens
CTRKSLWWISLIVIPVFLIFVVVLYIVITFLFRRFIKIQQDNT

SEQ ID NO: 2829851 - protein, 26 aa, Entamoeba invadens
CVAFFIILVVVFIIVFIFAMQFKKVD

SEQ ID NO: 2829852 - protein, 23 aa, Entamoeba invadens
CVIILFIFSLFTPIGALIGSYII

SEQ ID NO: 2829853 - protein, 35 aa, Entamoeba invadens
CVKEVVWWLILIIVIVFLIILITILMITGISLKCV

SEQ ID NO: 2829854 - protein, 33 aa, Entamoeba invadens
CVKKAVWWVILIIILFIILNIIIVYLKYSKEQQ

SEQ ID NO: 2829855 - protein, 28 aa, Entamoeba invadens
CVKKAVWWVILIIIVFTIAIIVGVFLIF

SEQ ID NO: 2829856 - protein, 25 aa, Entamoeba invadens
CVLLFINYFIYIIINIYVIILIIII

SEQ ID NO: 2829857 - protein, 25 aa, Entamoeba invadens
CVQKSLWWISLIVLGGVVLLVIILY

SEQ ID NO: 2829858 - protein, 27 aa, Entamoeba invadens
CVSKAVWWIILIIVTFCLLMIVLVTTT

SEQ ID NO: 2829859 - protein, 26 aa, Entamoeba invadens
CVSSPVWWVIVLVIIFGVLVIVMIVL

SEQ ID NO: 2829860 - protein, 27 aa, Entamoeba invadens
CVTKAVWWVIFIIVLIVILLFIILLIV

SEQ ID NO: 2829861 - protein, 29 aa, Entamoeba invadens
CVTKAVWWVIFIIVLIVILLLIILLIVII

SEQ ID NO: 2829862 - protein, 22 aa, Entamoeba invadens
CVYNTELFLINFPSCFLVNFTS

SEQ ID NO: 2829863 - protein, 17 aa, Entamoeba invadens
CYFHKWYKFFNFHGKNI

SEQ ID NO: 2829864 - protein, 22 aa, Entamoeba invadens
CYMRFLYYTVVVLVILFTCVQS

SEQ ID NO: 2829865 - protein, 17 aa, Entamoeba invadens
CYNGYYQNKYYKCTKCN

SEQ ID NO: 2829866 - protein, 19 aa, Entamoeba invadens
CYPKKLFHFPWDIATFIAK

SEQ ID NO: 2829867 - protein, 27 aa, Entamoeba invadens
CYTQIVWWVILICVIVALLILTIKNIK

SEQ ID NO: 2829868 - protein, 19 aa, Entamoeba invadens
DAFIDHYYRYIPLLTFNSP

SEQ ID NO: 2829869 - protein, 33 aa, Entamoeba invadens
DANHLIWLVVIPAFLVVVLLLLAAVFLSFKLRK

SEQ ID NO: 2829870 - protein, 22 aa, Entamoeba invadens
DDRYFYNFIILKNTTLYSTIDI

SEQ ID NO: 2829871 - protein, 22 aa, Entamoeba invadens
DEFFTLVWWRWTIFSFIATLFM

SEQ ID NO: 2829872 - protein, 18 aa, Entamoeba invadens
DEKLFPYSWDITNLISRG

SEQ ID NO: 2829873 - protein, 26 aa, Entamoeba invadens
DEKRELYHMLYYNKGYYRVFENLKGE

SEQ ID NO: 2829874 - protein, 22 aa, Entamoeba invadens
DEKTLLTFFTTAAQKFLGLRRN

SEQ ID NO: 2829875 - protein, 26 aa, Entamoeba invadens
DENVTLMALPRYPLMSGWKTEFMIGH

SEQ ID NO: 2829876 - protein, 17 aa, Entamoeba invadens
DFCEWFLDVLIPSIERK

SEQ ID NO: 2829877 - protein, 17 aa, Entamoeba invadens
DFEWIYSFVLLDLERVL

SEQ ID NO: 2829878 - protein, 25 aa, Entamoeba invadens
DFGDHFMLLSLFLAFRKVGVNRRKK

SEQ ID NO: 2829879 - protein, 18 aa, Entamoeba invadens
DFIVHFFGAVFIPTKICL

SEQ ID NO: 2829880 - protein, 21 aa, Entamoeba invadens
DFNMLFLIIYSVSVFYFSCVM

SEQ ID NO: 2829881 - protein, 19 aa, Entamoeba invadens
DFTICRFDFIGGKSITFRS

SEQ ID NO: 2829882 - protein, 22 aa, Entamoeba invadens
DFYRKFPIFKLPTEVWYIEPYG

SEQ ID NO: 2829883 - protein, 17 aa, Entamoeba invadens
DFYYLKCDLPAPINPSD

SEQ ID NO: 2829884 - protein, 21 aa, Entamoeba invadens
DFYYYLLPPLVLYLFDVLLRI

SEQ ID NO: 2829885 - protein, 22 aa, Entamoeba invadens
DGLESITTIFYHGLHEPIVQSG

SEQ ID NO: 2829886 - protein, 21 aa, Entamoeba invadens
DGLFLFFELFLTQFALTTIHP

SEQ ID NO: 2829887 - protein, 32 aa, Entamoeba invadens
DGMYCIYTIPLWFIIVMVLLSIFILICIVFVT

SEQ ID NO: 2829888 - protein, 30 aa, Entamoeba invadens
DGVYCEKKALWWFVLIVIIASIFVLVIIGL

SEQ ID NO: 2829889 - protein, 18 aa, Entamoeba invadens
DGYYIFNSLCVKCEYPCK

SEQ ID NO: 2829890 - protein, 24 aa, Entamoeba invadens
DIDQNFWIMIFRTTSQIAYLFIDG

SEQ ID NO: 2829891 - protein, 24 aa, Entamoeba invadens
DIDQYFYIWIYWEGNELPVQLFID

SEQ ID NO: 2829892 - protein, 20 aa, Entamoeba invadens
DIFNLGCLFYFIALKRHPFG

SEQ ID NO: 2829893 - protein, 17 aa, Entamoeba invadens
DIKYIDFILNNTNLKIL

SEQ ID NO: 2829894 - protein, 23 aa, Entamoeba invadens
DILRFFCDVLYQTVIYKDHRIFY

SEQ ID NO: 2829895 - protein, 23 aa, Entamoeba invadens
DILRYAYDLLLHKIGKRGKQDMF

SEQ ID NO: 2829896 - protein, 34 aa, Entamoeba invadens
DISYLFMSLVFIALLLIFFACVFIATSIGIRFII

SEQ ID NO: 2829897 - protein, 31 aa, Entamoeba invadens
DITEKFLFITWGIFFLLTIPSVVVFSIFLPT

SEQ ID NO: 2829898 - protein, 24 aa, Entamoeba invadens
DIYMMQCFVLCFLFVIKNLKTQTL

SEQ ID NO: 2829899 - protein, 17 aa, Entamoeba invadens
DKAFGFVMFFVVVILVI

SEQ ID NO: 2829900 - protein, 19 aa, Entamoeba invadens
DKFRIDYVVNFYGSVFIPN

SEQ ID NO: 2829901 - protein, 20 aa, Entamoeba invadens
DKFRSGYIIYFYGAVLFKNR

SEQ ID NO: 2829902 - protein, 23 aa, Entamoeba invadens
DKFRSPFIVHFFGAVFIPGKMCM

SEQ ID NO: 2829903 - protein, 31 aa, Entamoeba invadens
DKISLKTIYFAFFVSFFVTYNVMRVITQISS

SEQ ID NO: 2829904 - protein, 17 aa, Entamoeba invadens
DKLKLKFLWDASKGILY

SEQ ID NO: 2829905 - protein, 26 aa, Entamoeba invadens
DKMKYIIIIFWILVTLGLLYCVFGFL

SEQ ID NO: 2829906 - protein, 21 aa, Entamoeba invadens
DKPDLVPDYYWKLLTSCWSQK

SEQ ID NO: 2829907 - protein, 17 aa, Entamoeba invadens
DKRDYIKLPYKLKVRML

SEQ ID NO: 2829908 - protein, 20 aa, Entamoeba invadens
DKVLLGFLYVGLLCTGVLAT

SEQ ID NO: 2829909 - protein, 25 aa, Entamoeba invadens
DLVPIFLERLFAFPLDKLNISYKML

SEQ ID NO: 2829910 - protein, 17 aa, Entamoeba invadens
DLWGPMFVCYLLALLLS

SEQ ID NO: 2829911 - protein, 25 aa, Entamoeba invadens
DMPKPILATWQFYVGMLSVIVAAMA

SEQ ID NO: 2829912 - protein, 22 aa, Entamoeba invadens
DMSKLIIIIPTISVIVIFIIII

SEQ ID NO: 2829913 - protein, 27 aa, Entamoeba invadens
DNGVDIFYYLAMQPWRHFVWTQKEGND

SEQ ID NO: 2829914 - protein, 24 aa, Entamoeba invadens
DNLYPMYYSFFINLILSHLRALSF

SEQ ID NO: 2829915 - protein, 20 aa, Entamoeba invadens
DNWIVFYIITYFLNKNLTMY

SEQ ID NO: 2829916 - protein, 25 aa, Entamoeba invadens
DQNVVLWSWFFFDIIIRSTVEYLHE

SEQ ID NO: 2829917 - protein, 22 aa, Entamoeba invadens
DQSLYFICDMLFVLGFQIRWVQ

SEQ ID NO: 2829918 - protein, 24 aa, Entamoeba invadens
DSALSFMFSVSWSSVLYLAQDLGI

SEQ ID NO: 2829919 - protein, 27 aa, Entamoeba invadens
DSLGNSMLIFLILLHLSALALKCTVET

SEQ ID NO: 2829920 - protein, 17 aa, Entamoeba invadens
DSTYFFSQYYNVITFYK

SEQ ID NO: 2829921 - protein, 23 aa, Entamoeba invadens
DTEAIALCYLLKKKKLRFSISNL

SEQ ID NO: 2829922 - protein, 19 aa, Entamoeba invadens
DTFKYKLVFRPKSGRLKPH

SEQ ID NO: 2829923 - protein, 26 aa, Entamoeba invadens
DTKAVWWMLLIVIVISILVVILIVAV

SEQ ID NO: 2829924 - protein, 28 aa, Entamoeba invadens
DTKAVWWVLLIVIVISVLFVILSILVVI

SEQ ID NO: 2829925 - protein, 19 aa, Entamoeba invadens
DTMFLAFAGFYYDILNITK

SEQ ID NO: 2829926 - protein, 32 aa, Entamoeba invadens
DTPVAWIVVGVLTFILFLVIIGGAMGAVLFMY

SEQ ID NO: 2829927 - protein, 23 aa, Entamoeba invadens
DTQLFPSQFYLLSLFGFISDQLL

SEQ ID NO: 2829928 - protein, 20 aa, Entamoeba invadens
DTQYYCNIFKWAIDTKILAE

SEQ ID NO: 2829929 - protein, 17 aa, Entamoeba invadens
DTRQICFCTYDPAIKQD

SEQ ID NO: 2829930 - protein, 30 aa, Entamoeba invadens
DTYGLSWQGWLFSLLLSFLTLLVGQISFFI

SEQ ID NO: 2829931 - protein, 29 aa, Entamoeba invadens
DVMKLLGVLIFLLIMFYVNGFNKRIAKKL

SEQ ID NO: 2829932 - protein, 17 aa, Entamoeba invadens
DVRVRYWLGGLLSILCL

SEQ ID NO: 2829933 - protein, 19 aa, Entamoeba invadens
DVYMWAMVIWFIATSIHPF

SEQ ID NO: 2829934 - protein, 26 aa, Entamoeba invadens
DVYTAFLIVPFLILIIGVVIMLVTHS

SEQ ID NO: 2829935 - protein, 20 aa, Entamoeba invadens
DYAYKYFLLKNVNGAVTYFI

SEQ ID NO: 2829936 - protein, 18 aa, Entamoeba invadens
DYIFFKLIILDNTMFYST

SEQ ID NO: 2829937 - protein, 17 aa, Entamoeba invadens
DYYLYAPLNPLCQSYDT

SEQ ID NO: 2829938 - protein, 17 aa, Entamoeba invadens
EAGYYYDYYYSTCKSGY

SEQ ID NO: 2829939 - protein, 23 aa, Entamoeba invadens
EALIWGEAFPKQRFNFAWSIADF

SEQ ID NO: 2829940 - protein, 27 aa, Entamoeba invadens
EAYSWSTYLFIFQGILILAMSLVQTYL

SEQ ID NO: 2829941 - protein, 22 aa, Entamoeba invadens
ECFGWCQAYPKTQFKFPWTIAE

SEQ ID NO: 2829942 - protein, 22 aa, Entamoeba invadens
ECFGWCQAYPKTQFKYPWVIAK

SEQ ID NO: 2829943 - protein, 17 aa, Entamoeba invadens
ECLIWANPFPKDKFKYP

SEQ ID NO: 2829944 - protein, 25 aa, Entamoeba invadens
ECPKFKLSFFYLQAFVKTVLTIPNY

SEQ ID NO: 2829945 - protein, 25 aa, Entamoeba invadens
ECYRTRWELIIPFVVIGVLILIVIV

SEQ ID NO: 2829946 - protein, 26 aa, Entamoeba invadens
EDIKLMYLAMFYILKHLSYDIFKSWF

SEQ ID NO: 2829947 - protein, 20 aa, Entamoeba invadens
EDILYYVTPIEQLVFVGQNY

SEQ ID NO: 2829948 - protein, 23 aa, Entamoeba invadens
EDKEFYFKLPYKLKVRMLYDTAR

SEQ ID NO: 2829949 - protein, 30 aa, Entamoeba invadens
EDKESDLLWLWIFLGVLAGLLIIIGISGIV

SEQ ID NO: 2829950 - protein, 35 aa, Entamoeba invadens
EDKYNRTVWIKTNWWWILIIFVVLALCVFVCGWYY

SEQ ID NO: 2829951 - protein, 22 aa, Entamoeba invadens
EDSLWIFTFFMKDLNLYGLFSD

SEQ ID NO: 2829952 - protein, 21 aa, Entamoeba invadens
EDVVLYFITYLKNMKPKLFKK

SEQ ID NO: 2829953 - protein, 20 aa, Entamoeba invadens
EDWELWLWFGVICGVIIVFV

SEQ ID NO: 2829954 - protein, 25 aa, Entamoeba invadens
EDWELWMWFGIITAVIIVFIALVMG

SEQ ID NO: 2829955 - protein, 32 aa, Entamoeba invadens
EEQFPLYDLFIRLFKMFALPKDLHFALNIQSN

SEQ ID NO: 2829956 - protein, 17 aa, Entamoeba invadens
EEYTWCFPPTKASGFFV

SEQ ID NO: 2829957 - protein, 24 aa, Entamoeba invadens
EEYYQLFILFFGQLLTSLQVFMFV

SEQ ID NO: 2829958 - protein, 17 aa, Entamoeba invadens
EFDLHGLVILPLGFLEQ

SEQ ID NO: 2829959 - protein, 17 aa, Entamoeba invadens
EFENVLLFKFFERYLYC

SEQ ID NO: 2829960 - protein, 20 aa, Entamoeba invadens
EFFFLILTQTFQLNLQLVCM

SEQ ID NO: 2829961 - protein, 17 aa, Entamoeba invadens
EFGYFIYQNECQKCKDN

SEQ ID NO: 2829962 - protein, 19 aa, Entamoeba invadens
EFIINFYGAVFIPGRVCIV

SEQ ID NO: 2829963 - protein, 18 aa, Entamoeba invadens
EFIVYFYGAVFIPNKICM

SEQ ID NO: 2829964 - protein, 32 aa, Entamoeba invadens
EFQKTQIFGLRAIFLCFFFILNEVSYEQKQQY

SEQ ID NO: 2829965 - protein, 17 aa, Entamoeba invadens
EFSWYLTPLCTCQIFSS

SEQ ID NO: 2829966 - protein, 17 aa, Entamoeba invadens
EFYPDFIHFLPLVMKRV

SEQ ID NO: 2829967 - protein, 28 aa, Entamoeba invadens
EGKFDFCLPIPPTLYPNCKRLAFSKNKC

SEQ ID NO: 2829968 - protein, 21 aa, Entamoeba invadens
EGKLYYVVLWSGLSVLMNDKS

SEQ ID NO: 2829969 - protein, 17 aa, Entamoeba invadens
EGVYVILLLLLFGICAI

SEQ ID NO: 2829970 - protein, 17 aa, Entamoeba invadens
EGYTWITPYPVSDFKFP

SEQ ID NO: 2829971 - protein, 17 aa, Entamoeba invadens
EIDFKNVKRLSPMKLNS

SEQ ID NO: 2829972 - protein, 25 aa, Entamoeba invadens
EIFNHLYLLLQSFKYFILPTNKKLC

SEQ ID NO: 2829973 - protein, 22 aa, Entamoeba invadens
EILQQSLLLALLSWYGEITLRK

SEQ ID NO: 2829974 - protein, 17 aa, Entamoeba invadens
EINYLMNSPFRKANLSR

SEQ ID NO: 2829975 - protein, 20 aa, Entamoeba invadens
EIVFLYFTGFFRAMFFTFTI

SEQ ID NO: 2829976 - protein, 23 aa, Entamoeba invadens
EIVGMLFLFLSSLTRPLFGYLVG

SEQ ID NO: 2829977 - protein, 17 aa, Entamoeba invadens
EIYFWYNTALLFSQDFF

SEQ ID NO: 2829978 - protein, 20 aa, Entamoeba invadens
EIYMGGYFYIYWSGSVELFD

SEQ ID NO: 2829979 - protein, 22 aa, Entamoeba invadens
EKEYDAIFYAAIYVKLITVCEA

SEQ ID NO: 2829980 - protein, 25 aa, Entamoeba invadens
EKFEFPMYMIAVIVVFVLVLAVIVV

SEQ ID NO: 2829981 - protein, 25 aa, Entamoeba invadens
EKFVNSLVIILYNSVWYFIISNKYY

SEQ ID NO: 2829982 - protein, 23 aa, Entamoeba invadens
EKGGIYVFNIYAKGIQISCAETG

SEQ ID NO: 2829983 - protein, 31 aa, Entamoeba invadens
EKIIRAMYSFTFFWYNFMPLTRGTAAGGMVF

SEQ ID NO: 2829984 - protein, 18 aa, Entamoeba invadens
EKLFPYSWDITNLISRGE

SEQ ID NO: 2829985 - protein, 17 aa, Entamoeba invadens
EKQFKFPWKIAEFVTRG

SEQ ID NO: 2829986 - protein, 28 aa, Entamoeba invadens
EKQPKWEIFLIIFLFVFEVSKIVVIFGT

SEQ ID NO: 2829987 - protein, 28 aa, Entamoeba invadens
EKSGWKWYYYFLLIVGIFIVVIVLIIAI

SEQ ID NO: 2829988 - protein, 24 aa, Entamoeba invadens
EKTFKWFFSVSLVASFIACLCLFV

SEQ ID NO: 2829989 - protein, 41 aa, Entamoeba invadens
EKTKIWVYIVILFSIILLIIIIISIIILPLYFIFKKHKNTE

SEQ ID NO: 2829990 - protein, 42 aa, Entamoeba invadens
EKTKIWVYIVILFSIILLIIIIISIIILPLYFIFKKHKNTEE

SEQ ID NO: 2829991 - protein, 23 aa, Entamoeba invadens
EKTKKLWNFNWCSAFGIICSHFY

SEQ ID NO: 2829992 - protein, 24 aa, Entamoeba invadens
ELLFLLLHHMSKIHHFLFCGISNF

SEQ ID NO: 2829993 - protein, 27 aa, Entamoeba invadens
ELNEIYIWKVFYSTLIWVLKNINKTTL

SEQ ID NO: 2829994 - protein, 25 aa, Entamoeba invadens
ELTERFVMYYIFIFEVEGMNVVMYN

SEQ ID NO: 2829995 - protein, 17 aa, Entamoeba invadens
ELVFFSIKFLDVLATKL

SEQ ID NO: 2829996 - protein, 26 aa, Entamoeba invadens
ELYSLYTFFMFLLLTKTVQSNTFDCA

SEQ ID NO: 2829997 - protein, 23 aa, Entamoeba invadens
EMLGLIFVWVLKNLKKEVLVEWI

SEQ ID NO: 2829998 - protein, 25 aa, Entamoeba invadens
EMSLWPLVVLFVFIATTGAIVLFVI

SEQ ID NO: 2829999 - protein, 18 aa, Entamoeba invadens
ENCITCNFGYYYDLMNKD

SEQ ID NO: 2830000 - protein, 20 aa, Entamoeba invadens
ENIIGFWMWAYYLSWMRYAF

SEQ ID NO: 2830001 - protein, 31 aa, Entamoeba invadens
ENMKILQIFDVRLYYFFYSTTNLHLIVSYRN

SEQ ID NO: 2830002 - protein, 18 aa, Entamoeba invadens
ERCYSCELNYILLDGICI

SEQ ID NO: 2830003 - protein, 30 aa, Entamoeba invadens
ERNTNLFWVVFSIFVFVLLIIATTMCVYFS

SEQ ID NO: 2830004 - protein, 26 aa, Entamoeba invadens
ERSAVWWVILLIVIVCLALISIIVVV

SEQ ID NO: 2830005 - protein, 17 aa, Entamoeba invadens
ERYIILCVMLRSLHPTY

SEQ ID NO: 2830006 - protein, 17 aa, Entamoeba invadens
ESILTYVNLPWTKTNRF

SEQ ID NO: 2830007 - protein, 24 aa, Entamoeba invadens
ESMTEQPLRFFKISNYGSLSLKNA

SEQ ID NO: 2830008 - protein, 28 aa, Entamoeba invadens
ESNHTFFWTVFFVMQFSTVFIAAYLLMK

SEQ ID NO: 2830009 - protein, 21 aa, Entamoeba invadens
ESQIVWWVIFVAVMCVLIVFI

SEQ ID NO: 2830010 - protein, 25 aa, Entamoeba invadens
ESRAVWWVILVVVLFVLIVFVILII

SEQ ID NO: 2830011 - protein, 26 aa, Entamoeba invadens
ESSDDLTWLWITLGVVGGLVVVALVI

SEQ ID NO: 2830012 - protein, 22 aa, Entamoeba invadens
ESTRKMMVFYLKAIEKYKPTIL

SEQ ID NO: 2830013 - protein, 20 aa, Entamoeba invadens
ESVIVLNFFLNNTKVIFQNT

SEQ ID NO: 2830014 - protein, 21 aa, Entamoeba invadens
ETGWFYFIIGLFTLIVVITLF

SEQ ID NO: 2830015 - protein, 48 aa, Entamoeba invadens
ETKEFPKWTIALIVIFVVALVVVVLIFIIYCVIVYLQRKRNLKVFEEG

SEQ ID NO: 2830016 - protein, 20 aa, Entamoeba invadens
ETKLLWFLSLMNSLLGRGVS

SEQ ID NO: 2830017 - protein, 40 aa, Entamoeba invadens
ETKVVWWVILISVLVIIVFLVFIFIVIVLIIRRILAHLHQ

SEQ ID NO: 2830018 - protein, 23 aa, Entamoeba invadens
ETTTKHIPLINTLLPMSSTSLPT

SEQ ID NO: 2830019 - protein, 19 aa, Entamoeba invadens
ETVFILWTAAVIVLLLTTP

SEQ ID NO: 2830020 - protein, 17 aa, Entamoeba invadens
ETYFFFISIDDLTSFSF

SEQ ID NO: 2830021 - protein, 27 aa, Entamoeba invadens
EVATIMWFVLLIGSSLLWLGAGIFFFK

SEQ ID NO: 2830022 - protein, 17 aa, Entamoeba invadens
EVFYYLTMQPWRHMEWT

SEQ ID NO: 2830023 - protein, 28 aa, Entamoeba invadens
EVHSVWWVILILVIVIVYFIITIVFVFS

SEQ ID NO: 2830024 - protein, 24 aa, Entamoeba invadens
EVILELLMFFININDIFSATLLFV

SEQ ID NO: 2830025 - protein, 19 aa, Entamoeba invadens
EVMKYFYIFVGMSGIAFIS

SEQ ID NO: 2830026 - protein, 24 aa, Entamoeba invadens
EVPQNWMYFFLFNDRLVETEVLSY

SEQ ID NO: 2830027 - protein, 26 aa, Entamoeba invadens
EVTTPFQIIWFYKMYTHFLCSLLDNA

SEQ ID NO: 2830028 - protein, 22 aa, Entamoeba invadens
EWDCTNTYYLNKKIFKCTNTNV

SEQ ID NO: 2830029 - protein, 17 aa, Entamoeba invadens
EWYLYGVLQSILFFVLF

SEQ ID NO: 2830030 - protein, 19 aa, Entamoeba invadens
EYIVHFYGAVFIPKKECMV

SEQ ID NO: 2830031 - protein, 18 aa, Entamoeba invadens
EYIVHFYGAVFIPSHICM

SEQ ID NO: 2830032 - protein, 18 aa, Entamoeba invadens
EYIVHFYGAVFIPSKICM

SEQ ID NO: 2830033 - protein, 18 aa, Entamoeba invadens
EYIVHFYGAVFIPSKVCM

SEQ ID NO: 2830034 - protein, 19 aa, Entamoeba invadens
EYIVHFYGAVLIPNRLCIV

SEQ ID NO: 2830035 - protein, 17 aa, Entamoeba invadens
EYIVYFYGAVFIPNKIC

SEQ ID NO: 2830036 - protein, 18 aa, Entamoeba invadens
EYKKIQFLPLIDSAIENF

SEQ ID NO: 2830037 - protein, 18 aa, Entamoeba invadens
FAAFVIFLLIIVVFEGVK

SEQ ID NO: 2830038 - protein, 21 aa, Entamoeba invadens
FAEFTVCYYILYYKTISVEVP

SEQ ID NO: 2830039 - protein, 17 aa, Entamoeba invadens
FAICLLEIWLTKSPYDP

SEQ ID NO: 2830040 - protein, 19 aa, Entamoeba invadens
FAILFFPIEHKIACLLPLF

SEQ ID NO: 2830041 - protein, 18 aa, Entamoeba invadens
FAILWFPLLLMSSAAPNF

SEQ ID NO: 2830042 - protein, 19 aa, Entamoeba invadens
FAIRFLPAEKFTHLKDLIL

SEQ ID NO: 2830043 - protein, 27 aa, Entamoeba invadens
FAITMYETFSWFEAYRKDQFKFPWKIA

SEQ ID NO: 2830044 - protein, 19 aa, Entamoeba invadens
FALLFFVFPINFNLSPTQI

SEQ ID NO: 2830045 - protein, 17 aa, Entamoeba invadens
FALLLYFELSLVSIFYL

SEQ ID NO: 2830046 - protein, 22 aa, Entamoeba invadens
FALVLYWFAFPYNFMNYRVDAT

SEQ ID NO: 2830047 - protein, 26 aa, Entamoeba invadens
FAMTMFEVFLWEFSFKEEQFKYAWSI

SEQ ID NO: 2830048 - protein, 20 aa, Entamoeba invadens
FAMYAWVTFVLTFFTGEELF

SEQ ID NO: 2830049 - protein, 21 aa, Entamoeba invadens
FANYPVYFIEAIKLYLLVSES

SEQ ID NO: 2830050 - protein, 21 aa, Entamoeba invadens
FAVMLIFVIFGIVSTFGMLFL

SEQ ID NO: 2830051 - protein, 20 aa, Entamoeba invadens
FAVYPFVFLLMAIASFVVNQ

SEQ ID NO: 2830052 - protein, 25 aa, Entamoeba invadens
FCCIFLPDLPFILLGLTLTAICCII

SEQ ID NO: 2830053 - protein, 35 aa, Entamoeba invadens
FCDLSPVWWVILLIILFILFVLIILATTIGIIFKK

SEQ ID NO: 2830054 - protein, 17 aa, Entamoeba invadens
FCLLLIAFVLLSVEPKP

SEQ ID NO: 2830055 - protein, 35 aa, Entamoeba invadens
FCNKRTVWWVVLLVVFFLLFICIGIILITMFGLWK

SEQ ID NO: 2830056 - protein, 29 aa, Entamoeba invadens
FCNTKAVWWFILIIIIFVLVIITMFVVCI

SEQ ID NO: 2830057 - protein, 31 aa, Entamoeba invadens
FCNTKAVWWFILIIIIFVLVIITMFVVCIYI

SEQ ID NO: 2830058 - protein, 38 aa, Entamoeba invadens
FCRNKAVWWVILLLVLFTILLLIISIILLCFITRVILR

SEQ ID NO: 2830059 - protein, 24 aa, Entamoeba invadens
FCSIILILLCLIAIIFFGKTDLMK

SEQ ID NO: 2830060 - protein, 17 aa, Entamoeba invadens
FCVKRIIHIFQGGFFYF

SEQ ID NO: 2830061 - protein, 43 aa, Entamoeba invadens
FCVSKAVWWVIFIIVIFVIVLVIIIFICVVILFVVIHKKLRKS

SEQ ID NO: 2830062 - protein, 25 aa, Entamoeba invadens
FCVVLIIVIVFLAATFYLVTHYIKF

SEQ ID NO: 2830063 - protein, 21 aa, Entamoeba invadens
FDISFMRLFYILTLICVTATL

SEQ ID NO: 2830064 - protein, 25 aa, Entamoeba invadens
FDNVTINLFLRTIKNFPLIFTYNVT

SEQ ID NO: 2830065 - protein, 18 aa, Entamoeba invadens
FDTWKRFPKALDAKHMWV

SEQ ID NO: 2830066 - protein, 26 aa, Entamoeba invadens
FDTYKVFFYFRLLLLVTAKKIFIYNF

SEQ ID NO: 2830067 - protein, 24 aa, Entamoeba invadens
FECFGWCQAYPKTQFKFPWTIAEF

SEQ ID NO: 2830068 - protein, 24 aa, Entamoeba invadens
FECVTWKEPYPKIRFKFAWDIVDF

SEQ ID NO: 2830069 - protein, 25 aa, Entamoeba invadens
FEFGKYYIIMILPKFMKEAYVTIYI

SEQ ID NO: 2830070 - protein, 25 aa, Entamoeba invadens
FEHDRFWIYILSFYYHLSINILYYP

SEQ ID NO: 2830071 - protein, 17 aa, Entamoeba invadens
FELFLSTTDIRYVFYNE

SEQ ID NO: 2830072 - protein, 23 aa, Entamoeba invadens
FELYWFCIVFFWNEFYNSFVTIM

SEQ ID NO: 2830073 - protein, 23 aa, Entamoeba invadens
FENKVFYVWFDAPIGYLSITANY

SEQ ID NO: 2830074 - protein, 26 aa, Entamoeba invadens
FERAKLTDFYLYKGVFIKFKVKESQI

SEQ ID NO: 2830075 - protein, 25 aa, Entamoeba invadens
FETIDQILLFWGLVGSLLVGILDPL

SEQ ID NO: 2830076 - protein, 19 aa, Entamoeba invadens
FFFALSYSLYWCQSGEDKV

SEQ ID NO: 2830077 - protein, 17 aa, Entamoeba invadens
FFFLLVALPLVYMFAPL

SEQ ID NO: 2830078 - protein, 18 aa, Entamoeba invadens
FFFQIIFVHFVTAFCGDG

SEQ ID NO: 2830079 - protein, 19 aa, Entamoeba invadens
FFGMMFPFVLFFLDDSEKI

SEQ ID NO: 2830080 - protein, 24 aa, Entamoeba invadens
FFGYFFFGLFLFILLAFYLCVPFS

SEQ ID NO: 2830081 - protein, 26 aa, Entamoeba invadens
FFHLAKTFFRLLKIDKSFPLCYSAFP

SEQ ID NO: 2830082 - protein, 20 aa, Entamoeba invadens
FFIGFYLSTILSLIINVYGC

SEQ ID NO: 2830083 - protein, 19 aa, Entamoeba invadens
FFIVFFFVLFVICFNAFSL

SEQ ID NO: 2830084 - protein, 18 aa, Entamoeba invadens
FFLFYITYAVTTKHCYAF

SEQ ID NO: 2830085 - protein, 18 aa, Entamoeba invadens
FFLLYATFFITAYAGKDH

SEQ ID NO: 2830086 - protein, 18 aa, Entamoeba invadens
FFQKIFWFPVRYSCTQFN

SEQ ID NO: 2830087 - protein, 17 aa, Entamoeba invadens
FFRVLLQTQFYTIVGNY

SEQ ID NO: 2830088 - protein, 19 aa, Entamoeba invadens
FFTWWNTIMQNVSGWLLLA

SEQ ID NO: 2830089 - protein, 18 aa, Entamoeba invadens
FFVWFGIVVLIHISFIIS

SEQ ID NO: 2830090 - protein, 24 aa, Entamoeba invadens
FGAFVIFPVVFFSKTIFLYMTVNC

SEQ ID NO: 2830091 - protein, 21 aa, Entamoeba invadens
FGIVFAVVFLVIIIAAFAAFV

SEQ ID NO: 2830092 - protein, 17 aa, Entamoeba invadens
FGMTLCYIIKWNDPFDG

SEQ ID NO: 2830093 - protein, 24 aa, Entamoeba invadens
FGRPPYFYLLLVALLTATVTAPWN

SEQ ID NO: 2830094 - protein, 17 aa, Entamoeba invadens
FGTLAILQFLKNRKHAG

SEQ ID NO: 2830095 - protein, 18 aa, Entamoeba invadens
FGVKKFFGFFTLMNNMIP

SEQ ID NO: 2830096 - protein, 19 aa, Entamoeba invadens
FGVTMFEVFGWCKAYPLDT

SEQ ID NO: 2830097 - protein, 24 aa, Entamoeba invadens
FGWCKAYPLDTFKFPWKIAEFVIS

SEQ ID NO: 2830098 - protein, 20 aa, Entamoeba invadens
FGWCMAYPFTIFKFPWKIAE

SEQ ID NO: 2830099 - protein, 19 aa, Entamoeba invadens
FGWCNAFSEKQFKFPWKIA

SEQ ID NO: 2830100 - protein, 20 aa, Entamoeba invadens
FHFSFITLCCLFSYAVSQTQ

SEQ ID NO: 2830101 - protein, 17 aa, Entamoeba invadens
FHLFMYPGTAPLLKFLV

SEQ ID NO: 2830102 - protein, 18 aa, Entamoeba invadens
FHMIWTFIVFLYNKLKLY

SEQ ID NO: 2830103 - protein, 18 aa, Entamoeba invadens
FIADYAYKYFLLKNVNGA

SEQ ID NO: 2830104 - protein, 20 aa, Entamoeba invadens
FIDLCRTLYFVIPNLSVPHI

SEQ ID NO: 2830105 - protein, 20 aa, Entamoeba invadens
FIFALRFFHLAKTFFRLLKI

SEQ ID NO: 2830106 - protein, 20 aa, Entamoeba invadens
FIFFVFFNVVFSANIICEVG

SEQ ID NO: 2830107 - protein, 19 aa, Entamoeba invadens
FIFFVFFNVVFSANMICEV

SEQ ID NO: 2830108 - protein, 18 aa, Entamoeba invadens
FIFMCLKKYYIQLIKMFI

SEQ ID NO: 2830109 - protein, 30 aa, Entamoeba invadens
FIFTILIWLILMWFLLYFMLRVQSIGPAVL

SEQ ID NO: 2830110 - protein, 18 aa, Entamoeba invadens
FIIHFYGAVFVPNKICMV

SEQ ID NO: 2830111 - protein, 20 aa, Entamoeba invadens
FIIIIVIVVIITLVVLHKKE

SEQ ID NO: 2830112 - protein, 18 aa, Entamoeba invadens
FILILSFTTVLLGFIVIV

SEQ ID NO: 2830113 - protein, 24 aa, Entamoeba invadens
FISSTLLFFSFLSSNALFAQACLQ

SEQ ID NO: 2830114 - protein, 27 aa, Entamoeba invadens
FIVCIILLVLVIYWALIPIALCLVCVA

SEQ ID NO: 2830115 - protein, 19 aa, Entamoeba invadens
FIVFKIIEIFLFKKTLYKD

SEQ ID NO: 2830116 - protein, 20 aa, Entamoeba invadens
FIVIVIIVVIVLLFTLSYLY

SEQ ID NO: 2830117 - protein, 18 aa, Entamoeba invadens
FIWKVLFVNYVIPNLIIA

SEQ ID NO: 2830118 - protein, 23 aa, Entamoeba invadens
FKGKFTMLLILASTFIALVCEVH

SEQ ID NO: 2830119 - protein, 30 aa, Entamoeba invadens
FKILRQMSLLLVLFLFFLKAQSDCWSSQED

SEQ ID NO: 2830120 - protein, 20 aa, Entamoeba invadens
FKKAFYIICSCMIIFVIIVC

SEQ ID NO: 2830121 - protein, 34 aa, Entamoeba invadens
FKTIKQMLLIRALALLITFFPLFVRTFPLKSSCS

SEQ ID NO: 2830122 - protein, 23 aa, Entamoeba invadens
FKYFPIIVIVLFGIVLIITGISF

SEQ ID NO: 2830123 - protein, 19 aa, Entamoeba invadens
FLAVFVNVLIIFRYDPTLF

SEQ ID NO: 2830124 - protein, 19 aa, Entamoeba invadens
FLAYLIFFVIAFFQYLRID

SEQ ID NO: 2830125 - protein, 19 aa, Entamoeba invadens
FLCILIFGVLFWNLAILTM

SEQ ID NO: 2830126 - protein, 17 aa, Entamoeba invadens
FLCIPLVLYFLPNVGFF

SEQ ID NO: 2830127 - protein, 19 aa, Entamoeba invadens
FLCIYSGILITIWIARIWL

SEQ ID NO: 2830128 - protein, 18 aa, Entamoeba invadens
FLCLFFVSPVSSHDFESF

SEQ ID NO: 2830129 - protein, 17 aa, Entamoeba invadens
FLEFLGLDEVYVLIKNI

SEQ ID NO: 2830130 - protein, 21 aa, Entamoeba invadens
FLFFFLLLSKYIFFKKVFFPI

SEQ ID NO: 2830131 - protein, 22 aa, Entamoeba invadens
FLFFSAIITFFFLFRTSNNTLK

SEQ ID NO: 2830132 - protein, 21 aa, Entamoeba invadens
FLFLCCLFTFSCSMYCGGGQY

SEQ ID NO: 2830133 - protein, 18 aa, Entamoeba invadens
FLFTLFNVPISGTEVTEL

SEQ ID NO: 2830134 - protein, 23 aa, Entamoeba invadens
FLGDDFFFYRPTPPDFYFKGDKL

SEQ ID NO: 2830135 - protein, 21 aa, Entamoeba invadens
FLGILFLFLIACAMILFGAFV

SEQ ID NO: 2830136 - protein, 17 aa, Entamoeba invadens
FLIIRKFANEFPKMPFV

SEQ ID NO: 2830137 - protein, 19 aa, Entamoeba invadens
FLILCLLNRTLSVVCNSGQ

SEQ ID NO: 2830138 - protein, 18 aa, Entamoeba invadens
FLIQYLYIRIQALTIKPV

SEQ ID NO: 2830139 - protein, 17 aa, Entamoeba invadens
FLIYFYLEVLPIMKINF

SEQ ID NO: 2830140 - protein, 18 aa, Entamoeba invadens
FLLAMIPFAMRIGSMITY

SEQ ID NO: 2830141 - protein, 19 aa, Entamoeba invadens
FLLDVLRLCGFFFDSKYPK

SEQ ID NO: 2830142 - protein, 21 aa, Entamoeba invadens
FLLFLFFRLIPCVASLTSLNN

SEQ ID NO: 2830143 - protein, 17 aa, Entamoeba invadens
FLLIIFPEGTRAKPERI

SEQ ID NO: 2830144 - protein, 19 aa, Entamoeba invadens
FLLLFCYTTLSIDNWCQRT

SEQ ID NO: 2830145 - protein, 21 aa, Entamoeba invadens
FLLLILCCLVIFTPTYPVYSY

SEQ ID NO: 2830146 - protein, 29 aa, Entamoeba invadens
FLLLVVVVLLFLVFFIRSVFLPMPTLFKQ

SEQ ID NO: 2830147 - protein, 17 aa, Entamoeba invadens
FLMAFLAVCAYFATLYI

SEQ ID NO: 2830148 - protein, 17 aa, Entamoeba invadens
FLNDLYLPYGLTKIGYG

SEQ ID NO: 2830149 - protein, 17 aa, Entamoeba invadens
FLNYINNGQYQVTNFFN

SEQ ID NO: 2830150 - protein, 17 aa, Entamoeba invadens
FLPLQRKFQSWLYHACE

SEQ ID NO: 2830151 - protein, 21 aa, Entamoeba invadens
FLRLLLMLLLSLLLKSRPFVF

SEQ ID NO: 2830152 - protein, 18 aa, Entamoeba invadens
FLRLPVWMLLLGIDINES

SEQ ID NO: 2830153 - protein, 31 aa, Entamoeba invadens
FLTTSKMFFLLFILIIVVTFLIIWGACGITF

SEQ ID NO: 2830154 - protein, 21 aa, Entamoeba invadens
FMFILIPSLLLTLTTSRWCIV

SEQ ID NO: 2830155 - protein, 22 aa, Entamoeba invadens
FMPYYYLILILPLLCARYFIYT

SEQ ID NO: 2830156 - protein, 24 aa, Entamoeba invadens
FNCFLILLQLFFAGLVVLLLDELL

SEQ ID NO: 2830157 - protein, 18 aa, Entamoeba invadens
FNFPLEFLKPMEPNFDEL

SEQ ID NO: 2830158 - protein, 19 aa, Entamoeba invadens
FNHDFTFTTLFSCGLLVFS

SEQ ID NO: 2830159 - protein, 25 aa, Entamoeba invadens
FNLFLIKIILYLFYIYSIAVKCIRV

SEQ ID NO: 2830160 - protein, 26 aa, Entamoeba invadens
FNLSLFLLFLVLFIAFPLTLTEVPTN

SEQ ID NO: 2830161 - protein, 21 aa, Entamoeba invadens
FNNKVLYCKPTFYFKKTKCDY

SEQ ID NO: 2830162 - protein, 24 aa, Entamoeba invadens
FNQFKYFINMFFLIVAILACIPQL

SEQ ID NO: 2830163 - protein, 18 aa, Entamoeba invadens
FNYPFIFSVFPYSNLFFS

SEQ ID NO: 2830164 - protein, 23 aa, Entamoeba invadens
FPFSWIFLFFWKVYDKEDMYRMW

SEQ ID NO: 2830165 - protein, 21 aa, Entamoeba invadens
FPFTFIRKYRKMPLPYLLVFL

SEQ ID NO: 2830166 - protein, 20 aa, Entamoeba invadens
FPILNTYLQPAQTLYIFVKL

SEQ ID NO: 2830167 - protein, 17 aa, Entamoeba invadens
FPILPYKNLNVLSGSDT

SEQ ID NO: 2830168 - protein, 17 aa, Entamoeba invadens
FPKFFARRGFIPCIKKC

SEQ ID NO: 2830169 - protein, 27 aa, Entamoeba invadens
FPKTDPLMRYLIVLHILFGELQNWETV

SEQ ID NO: 2830170 - protein, 18 aa, Entamoeba invadens
FPRVFMFFFNLITPPKIA

SEQ ID NO: 2830171 - protein, 24 aa, Entamoeba invadens
FPSNMVFVFLFNDLLIETKVVKYN

SEQ ID NO: 2830172 - protein, 20 aa, Entamoeba invadens
FPSYLLTIWDRCFEFCMSLK

SEQ ID NO: 2830173 - protein, 24 aa, Entamoeba invadens
FPTKHGFKRGFWFKFTATQKTHII

SEQ ID NO: 2830174 - protein, 25 aa, Entamoeba invadens
FPVYGWILIAFGCFLFVIACVVIIL

SEQ ID NO: 2830175 - protein, 17 aa, Entamoeba invadens
FQLFYSSFSFFCEKGNY

SEQ ID NO: 2830176 - protein, 17 aa, Entamoeba invadens
FQRFIGWVQLHGVLEGK

SEQ ID NO: 2830177 - protein, 19 aa, Entamoeba invadens
FRCDYIVYFYGAVFIPRKI

SEQ ID NO: 2830178 - protein, 18 aa, Entamoeba invadens
FRCEYIVYFYGAVFTPKK

SEQ ID NO: 2830179 - protein, 18 aa, Entamoeba invadens
FRFNFNDYIFFKLIILDN

SEQ ID NO: 2830180 - protein, 17 aa, Entamoeba invadens
FRNLIIVYLITFMSIDY

SEQ ID NO: 2830181 - protein, 24 aa, Entamoeba invadens
FSDIMFFVLFFFYGFVNFAYDKNG

SEQ ID NO: 2830182 - protein, 24 aa, Entamoeba invadens
FSFNFWFIFALRFLNGMLNGNIGV

SEQ ID NO: 2830183 - protein, 18 aa, Entamoeba invadens
FSIFTIIVPFLLPELIIL

SEQ ID NO: 2830184 - protein, 25 aa, Entamoeba invadens
FSISLTEVLLWDEPYPKAQFKFPWN

SEQ ID NO: 2830185 - protein, 23 aa, Entamoeba invadens
FSIVLLVLFFLLNKELLPELQNE

SEQ ID NO: 2830186 - protein, 25 aa, Entamoeba invadens
FSLQGYFCFPLIDYVFFSETSKVST

SEQ ID NO: 2830187 - protein, 19 aa, Entamoeba invadens
FSLSRRFIMLFTELSKLTG

SEQ ID NO: 2830188 - protein, 18 aa, Entamoeba invadens
FSRGIPCFIRKSGKVYAV

SEQ ID NO: 2830189 - protein, 24 aa, Entamoeba invadens
FSSLTPELLLRFLEKISATKCHVP

SEQ ID NO: 2830190 - protein, 19 aa, Entamoeba invadens
FSTMFFFLVSSPYYTTLRY

SEQ ID NO: 2830191 - protein, 17 aa, Entamoeba invadens
FSVFLLIAASLAAYPVD

SEQ ID NO: 2830192 - protein, 37 aa, Entamoeba invadens
FSVVIIVLALYIILVVAAVVGAIYWIKSKGSNSAKDD

SEQ ID NO: 2830193 - protein, 22 aa, Entamoeba invadens
FTDVLFILFLKFLPCFLIIGMM

SEQ ID NO: 2830194 - protein, 19 aa, Entamoeba invadens
FTFILSFILWPYGGFWIVS

SEQ ID NO: 2830195 - protein, 25 aa, Entamoeba invadens
FTMNVIPWYKFPWAGSKRRDYTFVT

SEQ ID NO: 2830196 - protein, 24 aa, Entamoeba invadens
FTRFYFIIVFFIVLSAAALFGVVF

SEQ ID NO: 2830197 - protein, 38 aa, Entamoeba invadens
FTSCPILRHVLYFTIYILFQLLLTFLLDRLNTILLAEY

SEQ ID NO: 2830198 - protein, 26 aa, Entamoeba invadens
FTSLLSIWITFLYIVIVCIFRVKCSN

SEQ ID NO: 2830199 - protein, 22 aa, Entamoeba invadens
FTTFLYIILWTFYSLYAWVAYK

SEQ ID NO: 2830200 - protein, 25 aa, Entamoeba invadens
FVFAYKWIVLLFRRFIDDKYIFRIW

SEQ ID NO: 2830201 - protein, 25 aa, Entamoeba invadens
FVFSWQFWWKLFVIVVLTSIPFIAK

SEQ ID NO: 2830202 - protein, 20 aa, Entamoeba invadens
FVGIPFWYLHISTIYRIPFI

SEQ ID NO: 2830203 - protein, 17 aa, Entamoeba invadens
FVIAVMGVAFYSNEVRN

SEQ ID NO: 2830204 - protein, 29 aa, Entamoeba invadens
FVKVGVPILVIFFVLIIGITITIIFLFFF

SEQ ID NO: 2830205 - protein, 26 aa, Entamoeba invadens
FVLILLIIMFFTFQAILLLPTIQRLI

SEQ ID NO: 2830206 - protein, 17 aa, Entamoeba invadens
FVLIVTIVIVTKIIFNK

SEQ ID NO: 2830207 - protein, 17 aa, Entamoeba invadens
FVLLSDKKLLRFGSNQN

SEQ ID NO: 2830208 - protein, 17 aa, Entamoeba invadens
FVLLSRYPKFLTFEAKA

SEQ ID NO: 2830209 - protein, 19 aa, Entamoeba invadens
FVLSILVIVLIFSTKRILK

SEQ ID NO: 2830210 - protein, 17 aa, Entamoeba invadens
FVNHVIPYLIIAYLVMY

SEQ ID NO: 2830211 - protein, 26 aa, Entamoeba invadens
FVPPLDWSALLVLLALLFHFSDISQQ

SEQ ID NO: 2830212 - protein, 19 aa, Entamoeba invadens
FVPTFLVYPIQRLPRYLML

SEQ ID NO: 2830213 - protein, 21 aa, Entamoeba invadens
FVRAITFDLLFLIDFTLPKEQ

SEQ ID NO: 2830214 - protein, 23 aa, Entamoeba invadens
FVTLSFYKIFGFPTGIGALLVRK

SEQ ID NO: 2830215 - protein, 29 aa, Entamoeba invadens
FVVFSLPEFPFMWGYCWFTTILSYLSLWN

SEQ ID NO: 2830216 - protein, 20 aa, Entamoeba invadens
FVVICVGIILVVLLFVVKYK

SEQ ID NO: 2830217 - protein, 17 aa, Entamoeba invadens
FVVILGVLLFVVIFLLK

SEQ ID NO: 2830218 - protein, 20 aa, Entamoeba invadens
FVVIVILMLIIMCIIIIFKV

SEQ ID NO: 2830219 - protein, 18 aa, Entamoeba invadens
FVVMLFTFVCASIPLNHF

SEQ ID NO: 2830220 - protein, 25 aa, Entamoeba invadens
FVVMLIIIVFVLSFVLYFLYLYFRN

SEQ ID NO: 2830221 - protein, 18 aa, Entamoeba invadens
FVVYLFILAFMVMAVRTH

SEQ ID NO: 2830222 - protein, 17 aa, Entamoeba invadens
FVYFCLIKMFNVNFVLI

SEQ ID NO: 2830223 - protein, 17 aa, Entamoeba invadens
FVYLVALSLQALTAYFV

SEQ ID NO: 2830224 - protein, 18 aa, Entamoeba invadens
FWCLVLGDWCLIETGVYT

SEQ ID NO: 2830225 - protein, 24 aa, Entamoeba invadens
FWLIFHFFLFQLFIFSEGACPSNY

SEQ ID NO: 2830226 - protein, 25 aa, Entamoeba invadens
FWLIFNFFLFQLFIFSKGACPSNYN

SEQ ID NO: 2830227 - protein, 17 aa, Entamoeba invadens
FWYNIQLTESVDLIATT

SEQ ID NO: 2830228 - protein, 17 aa, Entamoeba invadens
FYDFIVNCYFLATTFYQ

SEQ ID NO: 2830229 - protein, 18 aa, Entamoeba invadens
FYEVVFTKEYYLMKNENG

SEQ ID NO: 2830230 - protein, 17 aa, Entamoeba invadens
FYFCSSLIEIFFWGFYL

SEQ ID NO: 2830231 - protein, 17 aa, Entamoeba invadens
FYFISLNSIGSLILSSS

SEQ ID NO: 2830232 - protein, 20 aa, Entamoeba invadens
FYIMLNWFMTLLEYLSIMSG

SEQ ID NO: 2830233 - protein, 26 aa, Entamoeba invadens
FYKNSSFFLILFWYSFFSGYSGMSMY

SEQ ID NO: 2830234 - protein, 20 aa, Entamoeba invadens
FYLIFRVPFWTFISAFMSAL

SEQ ID NO: 2830235 - protein, 17 aa, Entamoeba invadens
FYLTFSTQILSTTIDTP

SEQ ID NO: 2830236 - protein, 19 aa, Entamoeba invadens
FYNIIIIQNIILYSSNNEI

SEQ ID NO: 2830237 - protein, 17 aa, Entamoeba invadens
FYNYFRFSSANFTIKFG

SEQ ID NO: 2830238 - protein, 23 aa, Entamoeba invadens
FYSIFIWIAFTLLFVTLAFFWTR

SEQ ID NO: 2830239 - protein, 18 aa, Entamoeba invadens
FYVMSIITALWVLENMAR

SEQ ID NO: 2830240 - protein, 18 aa, Entamoeba invadens
FYVVQQAILIGFLNAYYG

SEQ ID NO: 2830241 - protein, 22 aa, Entamoeba invadens
GAPQIFIVSHLLGGISALIPLN

SEQ ID NO: 2830242 - protein, 17 aa, Entamoeba invadens
GASSLYIISFLLTFIFF

SEQ ID NO: 2830243 - protein, 21 aa, Entamoeba invadens
GAVTYFIRSFTGCPYYSVPIK

SEQ ID NO: 2830244 - protein, 26 aa, Entamoeba invadens
GCDAMFTLPWYLTWFIHSISSVEVGV

SEQ ID NO: 2830245 - protein, 40 aa, Entamoeba invadens
GCKSHAVWWIILLVILFLIICVVFVIFIAFYFTKFVSKII

SEQ ID NO: 2830246 - protein, 36 aa, Entamoeba invadens
GCNTKIVWWVLLLVVLFVVMILILLIVVTALFTNKM

SEQ ID NO: 2830247 - protein, 17 aa, Entamoeba invadens
GCSLCLSGYFLKDGKCH

SEQ ID NO: 2830248 - protein, 17 aa, Entamoeba invadens
GCSLCLSGYYLKDGKCH

SEQ ID NO: 2830249 - protein, 17 aa, Entamoeba invadens
GCVLIPQNILPWVVTKA

SEQ ID NO: 2830250 - protein, 23 aa, Entamoeba invadens
GDSMYRLMLLFNDPQFVQYNKTR

SEQ ID NO: 2830251 - protein, 32 aa, Entamoeba invadens
GDWTMKNYIFFAVFPVWIIAICMLIGYGVLSR

SEQ ID NO: 2830252 - protein, 20 aa, Entamoeba invadens
GDYLYFFVPINWSFPLTSDE

SEQ ID NO: 2830253 - protein, 20 aa, Entamoeba invadens
GEIEWMYYFRKYNSKFFYPT

SEQ ID NO: 2830254 - protein, 25 aa, Entamoeba invadens
GEIFKKFIPFFKSYFLYISHYETSN

SEQ ID NO: 2830255 - protein, 24 aa, Entamoeba invadens
GETSSLLLLFKNTSIIGLGNVAKT

SEQ ID NO: 2830256 - protein, 18 aa, Entamoeba invadens
GEVYLIHGLISRGGFSCV

SEQ ID NO: 2830257 - protein, 38 aa, Entamoeba invadens
GEYCYLKAVWWVFFISSLIFVIILVVALVIIVLSVQYF

SEQ ID NO: 2830258 - protein, 26 aa, Entamoeba invadens
GFDSLFRFLGLNPLVFLAIRPVVSDI

SEQ ID NO: 2830259 - protein, 25 aa, Entamoeba invadens
GFDTNEYFIYFWASNMKSGYALFDD

SEQ ID NO: 2830260 - protein, 20 aa, Entamoeba invadens
GFFIVLFAIRFILTRGRLVV

SEQ ID NO: 2830261 - protein, 17 aa, Entamoeba invadens
GFFYYKFIYAKDKRLSF

SEQ ID NO: 2830262 - protein, 23 aa, Entamoeba invadens
GFIHLFIIVWIVIVITVVVSSNT

SEQ ID NO: 2830263 - protein, 35 aa, Entamoeba invadens
GFSSGNLWKFIFLILNFLFLNIIYNKPNKINMFRQ

SEQ ID NO: 2830264 - protein, 30 aa, Entamoeba invadens
GFVAGMFFLVLFILVLIVITTFFVTKYILK

SEQ ID NO: 2830265 - protein, 27 aa, Entamoeba invadens
GFVVLLLLVIFVALISWRIMRQKSSGK

SEQ ID NO: 2830266 - protein, 24 aa, Entamoeba invadens
GGAIFPFFTLKFIDIIMVLMVLSP

SEQ ID NO: 2830267 - protein, 26 aa, Entamoeba invadens
GGFDSLFRFLGLNPLVFLAIIPVVSD

SEQ ID NO: 2830268 - protein, 18 aa, Entamoeba invadens
GGIIFFLLAMIPFAMRIG

SEQ ID NO: 2830269 - protein, 19 aa, Entamoeba invadens
GGVLLILLLLVTFLYIVYS

SEQ ID NO: 2830270 - protein, 30 aa, Entamoeba invadens
GGVVLLVIILYFTITYILRKAIRLKQENTM

SEQ ID NO: 2830271 - protein, 19 aa, Entamoeba invadens
GIFKWGFFLAFFEAVNNVV

SEQ ID NO: 2830272 - protein, 26 aa, Entamoeba invadens
GIFMKIYVFHIKYIGNYYLLFDSREN

SEQ ID NO: 2830273 - protein, 19 aa, Entamoeba invadens
GIFVRIWCLIPLGVLIVGL

SEQ ID NO: 2830274 - protein, 25 aa, Entamoeba invadens
GIFWWFCSICWIMIIIKMIRREFIQ

SEQ ID NO: 2830275 - protein, 17 aa, Entamoeba invadens
GILVVIFLKTKKAGYST

SEQ ID NO: 2830276 - protein, 25 aa, Entamoeba invadens
GINFVQWMFCLFLSAMSLVVGQFAI

SEQ ID NO: 2830277 - protein, 32 aa, Entamoeba invadens
GIPIASFILLVIIILLLIIIIYIISHKTRKEK

SEQ ID NO: 2830278 - protein, 32 aa, Entamoeba invadens
GIPIASFVLILFIIAIIITILIFVILHKKEEH

SEQ ID NO: 2830279 - protein, 32 aa, Entamoeba invadens
GIPISIFVVLIILIAIIIVVGYLFAMRKKEEK

SEQ ID NO: 2830280 - protein, 37 aa, Entamoeba invadens
GIPITVLILFVLFITMNILLIIIFLNKRQVEKMKNVR

SEQ ID NO: 2830281 - protein, 37 aa, Entamoeba invadens
GIPITVVVLLILTITLLIVILFYILQRYSHKQQMQNV

SEQ ID NO: 2830282 - protein, 32 aa, Entamoeba invadens
GIPIVSVFIIVFIIIGFLIITIVVLQKRKETK

SEQ ID NO: 2830283 - protein, 31 aa, Entamoeba invadens
GIPVAVFIVFIILIAIVLVVVFLIIMKKKEK

SEQ ID NO: 2830284 - protein, 36 aa, Entamoeba invadens
GISGWGIWGILFYGIYFVLIVVIAIALIIFYKRKNS

SEQ ID NO: 2830285 - protein, 18 aa, Entamoeba invadens
GIVFAVIVFVVIIAAIIG

SEQ ID NO: 2830286 - protein, 20 aa, Entamoeba invadens
GKCVSCRPGYYFKIMNECEL

SEQ ID NO: 2830287 - protein, 23 aa, Entamoeba invadens
GKELWFAYIIKYLILFFPVLNLT

SEQ ID NO: 2830288 - protein, 20 aa, Entamoeba invadens
GKFVGKWRHSQFITWIVIFS

SEQ ID NO: 2830289 - protein, 23 aa, Entamoeba invadens
GKTTWWAFIIKYLILLFPIVNLT

SEQ ID NO: 2830290 - protein, 22 aa, Entamoeba invadens
GKVFLFCYAPIILVTTSALAIL

SEQ ID NO: 2830291 - protein, 21 aa, Entamoeba invadens
GLAIGLPIALVFVVIVVVLLG

SEQ ID NO: 2830292 - protein, 40 aa, Entamoeba invadens
GLALGLPISLVFILIIMIMFGLFVIIFFIRKHQYKKMKER

SEQ ID NO: 2830293 - protein, 20 aa, Entamoeba invadens
GLCRIQFIGVLGFSPNFILF

SEQ ID NO: 2830294 - protein, 39 aa, Entamoeba invadens
GLECKKHLPWWLTFIIVLLLIIILITIVFLTLSLTKVIT

SEQ ID NO: 2830295 - protein, 26 aa, Entamoeba invadens
GLGCGIFLAMYFLFGLSFISGEKLIS

SEQ ID NO: 2830296 - protein, 28 aa, Entamoeba invadens
GLILIAVILVFIFLLWRRRRRTEKERET

SEQ ID NO: 2830297 - protein, 20 aa, Entamoeba invadens
GLIYFFVTPLIDIQFHDSMY

SEQ ID NO: 2830298 - protein, 25 aa, Entamoeba invadens
GLLIITCGILYWVTKKFKLGWKIPT

SEQ ID NO: 2830299 - protein, 19 aa, Entamoeba invadens
GLMILSRMPLLNRDQYVFK

SEQ ID NO: 2830300 - protein, 26 aa, Entamoeba invadens
GLVIVLPVVIVFLSILGIVMVVIIIL

SEQ ID NO: 2830301 - protein, 21 aa, Entamoeba invadens
GMIVFIVIFVIIALLVIVAGI

SEQ ID NO: 2830302 - protein, 20 aa, Entamoeba invadens
GMSFINWPFNYLVIACFCKK

SEQ ID NO: 2830303 - protein, 31 aa, Entamoeba invadens
GMTIYTTMLWKEPFPKILFPYAWSVADFVTS

SEQ ID NO: 2830304 - protein, 26 aa, Entamoeba invadens
GNEGFLLMMLYYLGCYITLLKPQKAG

SEQ ID NO: 2830305 - protein, 27 aa, Entamoeba invadens
GNIENFWYFVFLCILFLVHFPYNEGVF

SEQ ID NO: 2830306 - protein, 24 aa, Entamoeba invadens
GNKPRYFYLFNDVLIYGIGTIKIV

SEQ ID NO: 2830307 - protein, 24 aa, Entamoeba invadens
GPGCLLWGLLIVLQFAIIGVILKV

SEQ ID NO: 2830308 - protein, 18 aa, Entamoeba invadens
GPIYTKQAFKFPWNVAEF

SEQ ID NO: 2830309 - protein, 25 aa, Entamoeba invadens
GPLMYRLFYVLFLPKTTTPKSISWL

SEQ ID NO: 2830310 - protein, 21 aa, Entamoeba invadens
GPTDFKYFYTSNYIKYYVCGT

SEQ ID NO: 2830311 - protein, 24 aa, Entamoeba invadens
GQLKKVWFFTNIKVKYIIFCYKFK

SEQ ID NO: 2830312 - protein, 24 aa, Entamoeba invadens
GRPPVYMVSFLLFSCPRHFLFIIE

SEQ ID NO: 2830313 - protein, 24 aa, Entamoeba invadens
GRRKYILKLLYIYVLGYEVDFGIP

SEQ ID NO: 2830314 - protein, 21 aa, Entamoeba invadens
GSFVLFIPLYLIQAKSCKKTE

SEQ ID NO: 2830315 - protein, 25 aa, Entamoeba invadens
GSVKPFFRTLPFQPLITFVAMHSGL

SEQ ID NO: 2830316 - protein, 37 aa, Entamoeba invadens
GSVWNFVLWWFYGAYQSLIFFLVFYWIILPTDVNGPN

SEQ ID NO: 2830317 - protein, 35 aa, Entamoeba invadens
GSYCVYHIKWWLLLVLILFIITVSIFIIFVVYKVS

SEQ ID NO: 2830318 - protein, 23 aa, Entamoeba invadens
GSYMMFVLMWLCLAGRICALYYY

SEQ ID NO: 2830319 - protein, 32 aa, Entamoeba invadens
GTFCKTKAVWWLILLCIIFVLVIISALLVIII

SEQ ID NO: 2830320 - protein, 21 aa, Entamoeba invadens
GTISVILLLIYLHQRQKTKKE

SEQ ID NO: 2830321 - protein, 23 aa, Entamoeba invadens
GTKIPYTVWFSRNRFVLKQIAEL

SEQ ID NO: 2830322 - protein, 29 aa, Entamoeba invadens
GTRTLKIILLHMQVLLILSVAIAAIATPK

SEQ ID NO: 2830323 - protein, 23 aa, Entamoeba invadens
GTVFLLIMLIISTVTIIIVSRKD

SEQ ID NO: 2830324 - protein, 25 aa, Entamoeba invadens
GVFAGIVLLLIFVVGSYFTYYIIIK

SEQ ID NO: 2830325 - protein, 23 aa, Entamoeba invadens
GVFVLIVFLILVGVIVFFVMKKK

SEQ ID NO: 2830326 - protein, 25 aa, Entamoeba invadens
GVIFVIIVLIIITILIVFITKIVLD

SEQ ID NO: 2830327 - protein, 18 aa, Entamoeba invadens
GVILLCCGVAVIILKLKK

SEQ ID NO: 2830328 - protein, 29 aa, Entamoeba invadens
GVPLSIVFVIIVLIAIIIVIVYLLFMRHK

SEQ ID NO: 2830329 - protein, 22 aa, Entamoeba invadens
GVSCLIFIGLFIFAVVRKVMTR

SEQ ID NO: 2830330 - protein, 23 aa, Entamoeba invadens
GVVLVLFYYWQLGLCIIAIFPVL

SEQ ID NO: 2830331 - protein, 24 aa, Entamoeba invadens
GVYFVMILIIYKMGVVLIVKRVVQ

SEQ ID NO: 2830332 - protein, 17 aa, Entamoeba invadens
GWCNAFSEKQFKFPWKI

SEQ ID NO: 2830333 - protein, 21 aa, Entamoeba invadens
GWCQAYSKHQFRFPWKIAEFV

SEQ ID NO: 2830334 - protein, 27 aa, Entamoeba invadens
GWEDVFPKSMFPFPWKIAEFVINGRRL

SEQ ID NO: 2830335 - protein, 19 aa, Entamoeba invadens
GWKLYWDGLCDWVLFTGEC

SEQ ID NO: 2830336 - protein, 17 aa, Entamoeba invadens
GWSKMIFTFFLPATVFY

SEQ ID NO: 2830337 - protein, 18 aa, Entamoeba invadens
GWTNVYPLDAFKFPWKIA

SEQ ID NO: 2830338 - protein, 26 aa, Entamoeba invadens
GWYNIFSLLFIVLFAPQLTLFLKLVK

SEQ ID NO: 2830339 - protein, 19 aa, Entamoeba invadens
GYIWLLVCCLVLSDVLVFF

SEQ ID NO: 2830340 - protein, 17 aa, Entamoeba invadens
GYPANMLIPLDNPIMGK

SEQ ID NO: 2830341 - protein, 22 aa, Entamoeba invadens
GYPANMLIPLDNPIMGKFVVDT

SEQ ID NO: 2830342 - protein, 17 aa, Entamoeba invadens
GYSAYWLIPLENPIMGK

SEQ ID NO: 2830343 - protein, 26 aa, Entamoeba invadens
GYSLQIWIHPGVYLGLPFPYPISNKN

SEQ ID NO: 2830344 - protein, 22 aa, Entamoeba invadens
GYYIPYLFACVLFVLFSVFVYS

SEQ ID NO: 2830345 - protein, 17 aa, Entamoeba invadens
GYYLLNGLCVKCGVNCD

SEQ ID NO: 2830346 - protein, 22 aa, Entamoeba invadens
HAIILLLLYVVTLFLIKRFDRN

SEQ ID NO: 2830347 - protein, 35 aa, Entamoeba invadens
HCDTHAVWWFILIWVLFVIIVVIIVTLIICFSVKY

SEQ ID NO: 2830348 - protein, 26 aa, Entamoeba invadens
HFLVIVPPIFLMIFALPFCLSSMTLI

SEQ ID NO: 2830349 - protein, 17 aa, Entamoeba invadens
HFLVWPLEQRADICEYL

SEQ ID NO: 2830350 - protein, 18 aa, Entamoeba invadens
HFTELLSVELLPLSKDLC

SEQ ID NO: 2830351 - protein, 18 aa, Entamoeba invadens
HFTYPLYMNSLIQSFRQL

SEQ ID NO: 2830352 - protein, 21 aa, Entamoeba invadens
HFWARYFKLLFVLSKREKDFQ

SEQ ID NO: 2830353 - protein, 31 aa, Entamoeba invadens
HIDSRWIVLLVILVVIIFFVVVLTGLGIFIR

SEQ ID NO: 2830354 - protein, 18 aa, Entamoeba invadens
HIFDFLPLESLLSLSLCC

SEQ ID NO: 2830355 - protein, 18 aa, Entamoeba invadens
HIPLWRYIIFTTAMFCCV

SEQ ID NO: 2830356 - protein, 21 aa, Entamoeba invadens
HISFFFFSPLSFIQFILLVIA

SEQ ID NO: 2830357 - protein, 24 aa, Entamoeba invadens
HLLDYYERFLFCKDTMLSISIIHS

SEQ ID NO: 2830358 - protein, 17 aa, Entamoeba invadens
HLNIIYTCLSCNLGYYP

SEQ ID NO: 2830359 - protein, 26 aa, Entamoeba invadens
HLNKNKLIWVYKRFYQLDYHSMRTLI

SEQ ID NO: 2830360 - protein, 18 aa, Entamoeba invadens
HLYLINEKLIRYCPNGLN

SEQ ID NO: 2830361 - protein, 21 aa, Entamoeba invadens
HMLFWGIVIVVHIGVVLALAY

SEQ ID NO: 2830362 - protein, 27 aa, Entamoeba invadens
HNFRYFFLFLFYLWVSVLFVVFNIYEI

SEQ ID NO: 2830363 - protein, 24 aa, Entamoeba invadens
HNLFFLLLKFFTKGLLQFLMMFVY

SEQ ID NO: 2830364 - protein, 23 aa, Entamoeba invadens
HNLKFFFLFLLYAFAIVSIHFRL

SEQ ID NO: 2830365 - protein, 27 aa, Entamoeba invadens
HNMSALGCLLCCLFTWMGCCCIGLIFC

SEQ ID NO: 2830366 - protein, 17 aa, Entamoeba invadens
HNRPYYYFTSYVVFVVF

SEQ ID NO: 2830367 - protein, 20 aa, Entamoeba invadens
HRILFIFLIKMFFEDRFLIF

SEQ ID NO: 2830368 - protein, 27 aa, Entamoeba invadens
HRQVFNTLFLLFPKPNVKLLVLTFCEL

SEQ ID NO: 2830369 - protein, 24 aa, Entamoeba invadens
HRRDTPIIFIMRTKLMLDAAKGIE

SEQ ID NO: 2830370 - protein, 19 aa, Entamoeba invadens
HSFPFLLLLTCLATSQSCW

SEQ ID NO: 2830371 - protein, 19 aa, Entamoeba invadens
HSIRKIPQFPFFPTIPIEG

SEQ ID NO: 2830372 - protein, 17 aa, Entamoeba invadens
HSKYFLDLFMKCQTLGE

SEQ ID NO: 2830373 - protein, 22 aa, Entamoeba invadens
HSPHLVFYLTQTPLYLFVHHAF

SEQ ID NO: 2830374 - protein, 20 aa, Entamoeba invadens
HTFFFFLFINVLVQPITVAV

SEQ ID NO: 2830375 - protein, 17 aa, Entamoeba invadens
HTFPFLFLLIDCLLFAQ

SEQ ID NO: 2830376 - protein, 25 aa, Entamoeba invadens
HTKVVWWVILIVVIFVIIIITLIVF

SEQ ID NO: 2830377 - protein, 18 aa, Entamoeba invadens
HTYWFYLVLQMIFGFFKS

SEQ ID NO: 2830378 - protein, 19 aa, Entamoeba invadens
HVNIWIAVIVPLAAIAIIS

SEQ ID NO: 2830379 - protein, 27 aa, Entamoeba invadens
HYEIIVFVLLTVLFFFIRTYSFTKLKV

SEQ ID NO: 2830380 - protein, 19 aa, Entamoeba invadens
HYIILYLVAVLLNFPLIIP

SEQ ID NO: 2830381 - protein, 17 aa, Entamoeba invadens
HYPIFPWVIQDYTSTHL

SEQ ID NO: 2830382 - protein, 21 aa, Entamoeba invadens
IAFVILLWVIKSLPLMIIPLC

SEQ ID NO: 2830383 - protein, 23 aa, Entamoeba invadens
IAIFVLLWVLKSLTLMIIPLCTI

SEQ ID NO: 2830384 - protein, 18 aa, Entamoeba invadens
IAIIGLVIAFIMFKRKEK

SEQ ID NO: 2830385 - protein, 23 aa, Entamoeba invadens
IAIIIAIIVLIWLRLRSGEKEEK

SEQ ID NO: 2830386 - protein, 19 aa, Entamoeba invadens
IALLPYTFRIIDSKYYLIP

SEQ ID NO: 2830387 - protein, 27 aa, Entamoeba invadens
IAMYFELFNKFLQFLQPFLFVNTTATK

SEQ ID NO: 2830388 - protein, 26 aa, Entamoeba invadens
IAQRHTLMFIILRQFFVLILDQDKLI

SEQ ID NO: 2830389 - protein, 17 aa, Entamoeba invadens
IATLFLPMTFIAALFGM

SEQ ID NO: 2830390 - protein, 26 aa, Entamoeba invadens
IAVVLFLFIFRFFFLGALNGKASIKI

SEQ ID NO: 2830391 - protein, 21 aa, Entamoeba invadens
IAWIFIIPIMIYAGVGGFILG

SEQ ID NO: 2830392 - protein, 20 aa, Entamoeba invadens
ICCVIALFVFLLAGFLIVLV

SEQ ID NO: 2830393 - protein, 30 aa, Entamoeba invadens
ICEKRSLWWISLIAIFFVILVVGVVAIILW

SEQ ID NO: 2830394 - protein, 18 aa, Entamoeba invadens
ICGNIVYVIFPQKTLFGA

SEQ ID NO: 2830395 - protein, 25 aa, Entamoeba invadens
ICIVLFIILILLFIVVMSKVMMIRR

SEQ ID NO: 2830396 - protein, 26 aa, Entamoeba invadens
ICLLLLVIFMLFMPSMFVTAVMSFVL

SEQ ID NO: 2830397 - protein, 18 aa, Entamoeba invadens
ICLTCPSPYIFNASTKAC

SEQ ID NO: 2830398 - protein, 27 aa, Entamoeba invadens
ICSLCIAFYFFWKLALCIVVLIPIFGV

SEQ ID NO: 2830399 - protein, 18 aa, Entamoeba invadens
ICTKCLSGYYLQDGECLQ

SEQ ID NO: 2830400 - protein, 26 aa, Entamoeba invadens
IDKLKWLILIFWLVTTLGLAYCAFEF

SEQ ID NO: 2830401 - protein, 29 aa, Entamoeba invadens
IDKYGYIIAFLLFVAISLPFLVIPVVIWI

SEQ ID NO: 2830402 - protein, 17 aa, Entamoeba invadens
IDYIYIIHSFFKRYLVP

SEQ ID NO: 2830403 - protein, 25 aa, Entamoeba invadens
IEEYNPLIYWAINTYYILSGSTITF

SEQ ID NO: 2830404 - protein, 23 aa, Entamoeba invadens
IESFFNIILYNKSIFIFKTLGFT

SEQ ID NO: 2830405 - protein, 17 aa, Entamoeba invadens
IETLLSCLIAKKTMLRF

SEQ ID NO: 2830406 - protein, 23 aa, Entamoeba invadens
IEYKSFWYVLFTNVLHFLAMGIE

SEQ ID NO: 2830407 - protein, 25 aa, Entamoeba invadens
IFCCLYILAFFLYFPMRLSKIINAL

SEQ ID NO: 2830408 - protein, 18 aa, Entamoeba invadens
IFFTYNILNIEKLILNAN

SEQ ID NO: 2830409 - protein, 18 aa, Entamoeba invadens
IFFVIAFFQYLRIDNGLF

SEQ ID NO: 2830410 - protein, 20 aa, Entamoeba invadens
IFICLEYLRCPFGFRNSTSK

SEQ ID NO: 2830411 - protein, 20 aa, Entamoeba invadens
IFIILFALGFLFVIPWLVGF

SEQ ID NO: 2830412 - protein, 20 aa, Entamoeba invadens
IFLAFQLFYHLLFKMPACSH

SEQ ID NO: 2830413 - protein, 21 aa, Entamoeba invadens
IFLCVIIIVFLVIIGLVIYFG

SEQ ID NO: 2830414 - protein, 25 aa, Entamoeba invadens
IFLGIYISLMLFLWGGSQMLKTSFL

SEQ ID NO: 2830415 - protein, 19 aa, Entamoeba invadens
IFLLTFALKMFFALPKIRF

SEQ ID NO: 2830416 - protein, 19 aa, Entamoeba invadens
IFLVSVIFPFVGYYGLFAL

SEQ ID NO: 2830417 - protein, 22 aa, Entamoeba invadens
IFNFILVVFAFMSGLLIYSLLI

SEQ ID NO: 2830418 - protein, 26 aa, Entamoeba invadens
IFNYGLVIILPIVSAVAILFFIILLI

SEQ ID NO: 2830419 - protein, 20 aa, Entamoeba invadens
IFPVVWIFQLFLIFNPAPQT

SEQ ID NO: 2830420 - protein, 18 aa, Entamoeba invadens
IFSIPFAQFPLLKNPCVD

SEQ ID NO: 2830421 - protein, 18 aa, Entamoeba invadens
IFSMLFPFVLFMLDESDK

SEQ ID NO: 2830422 - protein, 21 aa, Entamoeba invadens
IFTFIPKFLFFQYKQLTNVYF

SEQ ID NO: 2830423 - protein, 21 aa, Entamoeba invadens
IFVIILFILLYVVLKTRKISS

SEQ ID NO: 2830424 - protein, 19 aa, Entamoeba invadens
IFVINILYDIALELGFFFD

SEQ ID NO: 2830425 - protein, 20 aa, Entamoeba invadens
IFVLSILVIVLIFSTKRILK

SEQ ID NO: 2830426 - protein, 17 aa, Entamoeba invadens
IFVYNKLLRICKLDTIN

SEQ ID NO: 2830427 - protein, 27 aa, Entamoeba invadens
IGAVLFITIILLMFVFVTYKLYSRIPA

SEQ ID NO: 2830428 - protein, 31 aa, Entamoeba invadens
IGCPLAFLFVVFVLLILLFFIVFEIQRKRKE

SEQ ID NO: 2830429 - protein, 22 aa, Entamoeba invadens
IGDFLVINPFTFQLTKDAVYIK

SEQ ID NO: 2830430 - protein, 20 aa, Entamoeba invadens
IGEFILLFLALISGASAFSI

SEQ ID NO: 2830431 - protein, 24 aa, Entamoeba invadens
IGFVQWIICIALALVTLPLGLLNG

SEQ ID NO: 2830432 - protein, 22 aa, Entamoeba invadens
IGGLLVIIVIVGAVIGGVYCMN

SEQ ID NO: 2830433 - protein, 24 aa, Entamoeba invadens
IGIDLLWILWLIFGVAYSYMLHIS

SEQ ID NO: 2830434 - protein, 24 aa, Entamoeba invadens
IGIPISVLILIKIVVSTIIVTIII

SEQ ID NO: 2830435 - protein, 38 aa, Entamoeba invadens
IGIPITVLILLVIFMTMIILLLIILFNKRQVKKKMQNV

SEQ ID NO: 2830436 - protein, 35 aa, Entamoeba invadens
IGIPVAIFIFFIIIIALILVVVYLLILSRKEKKKM

SEQ ID NO: 2830437 - protein, 36 aa, Entamoeba invadens
IGIPVAIFIFFIIIIALILVVVYLLILSRKEKKKMK

SEQ ID NO: 2830438 - protein, 37 aa, Entamoeba invadens
IGIPVAIFIFFIIIIALILVVVYLLILSRKEKKKMKN

SEQ ID NO: 2830439 - protein, 35 aa, Entamoeba invadens
IGIPVALIFIMIFLLFLLVYLTLRIHQKRIQHKVD

SEQ ID NO: 2830440 - protein, 18 aa, Entamoeba invadens
IGMGFVMFTIFCSITLGL

SEQ ID NO: 2830441 - protein, 25 aa, Entamoeba invadens
IGTMLLLTLYYLYIHFGTKKKMQNI

SEQ ID NO: 2830442 - protein, 25 aa, Entamoeba invadens
IGVIFVLIIITIVVSFVLFFSVKIS

SEQ ID NO: 2830443 - protein, 17 aa, Entamoeba invadens
IGVIIMLIIFQVIMHRY

SEQ ID NO: 2830444 - protein, 26 aa, Entamoeba invadens
IGVPLFILVALIIVISLIIVIIYLLI

SEQ ID NO: 2830445 - protein, 33 aa, Entamoeba invadens
IGVPLSLIFIILVVIATIIIVVYLLMMKKKEKV

SEQ ID NO: 2830446 - protein, 25 aa, Entamoeba invadens
IGVPLTVVFVVLVIVVVLVIAVIIF

SEQ ID NO: 2830447 - protein, 17 aa, Entamoeba invadens
IGVVLALAYLYYFNQQK

SEQ ID NO: 2830448 - protein, 23 aa, Entamoeba invadens
IGWCQAYTKHQFRFPWKIAEFVI

SEQ ID NO: 2830449 - protein, 17 aa, Entamoeba invadens
IGWIITCPAACGCIPFI

SEQ ID NO: 2830450 - protein, 18 aa, Entamoeba invadens
IGYLLFYFLVVFDSLRKN

SEQ ID NO: 2830451 - protein, 30 aa, Entamoeba invadens
IHANYYFAKFFRSMLYWWRIGKIAEMIENY

SEQ ID NO: 2830452 - protein, 18 aa, Entamoeba invadens
IHFFPLLPNFPTGNNTTR

SEQ ID NO: 2830453 - protein, 27 aa, Entamoeba invadens
IHGNFPYIFFYLLIIGILHGVSAKEFP

SEQ ID NO: 2830454 - protein, 24 aa, Entamoeba invadens
IHSLWYLLPLFFFLHLYVLIAMPK

SEQ ID NO: 2830455 - protein, 18 aa, Entamoeba invadens
IHTLNYLYIYGATLLMNS

SEQ ID NO: 2830456 - protein, 30 aa, Entamoeba invadens
IIALPVVLVFMLILLIISIIVVILVIIRKL

SEQ ID NO: 2830457 - protein, 32 aa, Entamoeba invadens
IICSPFHLAVTLFWLLFPLRSFSQTYCAAGTY

SEQ ID NO: 2830458 - protein, 19 aa, Entamoeba invadens
IIFIFIYLFVSKSIIELQR

SEQ ID NO: 2830459 - protein, 27 aa, Entamoeba invadens
IIFLVFPLLVVVLYFFLKKYQLITRER

SEQ ID NO: 2830460 - protein, 17 aa, Entamoeba invadens
IIFSLISLIFFIILTFD

SEQ ID NO: 2830461 - protein, 23 aa, Entamoeba invadens
IIGIIIIGIVWIFWRRRVRKINE

SEQ ID NO: 2830462 - protein, 27 aa, Entamoeba invadens
IIGITITIIFLFFFRQHKKAQIEASKV

SEQ ID NO: 2830463 - protein, 20 aa, Entamoeba invadens
IIHTLNYLYIYGATLLMNSY

SEQ ID NO: 2830464 - protein, 22 aa, Entamoeba invadens
IIIFPLFVVPYYRYKKTKKSLE

SEQ ID NO: 2830465 - protein, 27 aa, Entamoeba invadens
IIIIIIFVIIIGIIWWRRVKSVKAETA

SEQ ID NO: 2830466 - protein, 25 aa, Entamoeba invadens
IIINIYVIILIIIIVNFNTLIILIY

SEQ ID NO: 2830467 - protein, 26 aa, Entamoeba invadens
IILFIVFVTLLAFFPILTLCPKKVLP

SEQ ID NO: 2830468 - protein, 19 aa, Entamoeba invadens
IILTVACIVIFKISNKLRK

SEQ ID NO: 2830469 - protein, 20 aa, Entamoeba invadens
IINLLYLTLFVVIFVLFVAN

SEQ ID NO: 2830470 - protein, 18 aa, Entamoeba invadens
IINNLLFYFSIAELSRDS

SEQ ID NO: 2830471 - protein, 18 aa, Entamoeba invadens
IIRLKIMIDAFKGILIII

SEQ ID NO: 2830472 - protein, 23 aa, Entamoeba invadens
IISIFVIIIAMSIYFFIAILNHH

SEQ ID NO: 2830473 - protein, 19 aa, Entamoeba invadens
IISIVIIVFLFVLRKKDNK

SEQ ID NO: 2830474 - protein, 31 aa, Entamoeba invadens
IISLPVVFFLLFVIFIALTLVIIFLLYLHLK

SEQ ID NO: 2830475 - protein, 26 aa, Entamoeba invadens
IISVIFFLIIINYLTYYILSINIYYI

SEQ ID NO: 2830476 - protein, 31 aa, Entamoeba invadens
IISVPILSLILLLVITFFIVLIPVIVISKRK

SEQ ID NO: 2830477 - protein, 19 aa, Entamoeba invadens
IITMFVVCIYIILIKIQKN

SEQ ID NO: 2830478 - protein, 17 aa, Entamoeba invadens
IIVFLVGVGLLIWRERR

SEQ ID NO: 2830479 - protein, 17 aa, Entamoeba invadens
IIVIVISIPVLVIVLVL

SEQ ID NO: 2830480 - protein, 17 aa, Entamoeba invadens
IIVLSIISGLAVLFIIV

SEQ ID NO: 2830481 - protein, 17 aa, Entamoeba invadens
IIYAVLGIALVGILVGV

SEQ ID NO: 2830482 - protein, 25 aa, Entamoeba invadens
IKAVWWMIVVIVVVCILLIILITTI

SEQ ID NO: 2830483 - protein, 19 aa, Entamoeba invadens
IKLTLLWSGLQTLPALGCC

SEQ ID NO: 2830484 - protein, 17 aa, Entamoeba invadens
ILFAAFVIFLLIIVVFE

SEQ ID NO: 2830485 - protein, 20 aa, Entamoeba invadens
ILGFERFYICPLRGPIQSFR

SEQ ID NO: 2830486 - protein, 21 aa, Entamoeba invadens
ILGILFFINEVFLQLKLLWPS

SEQ ID NO: 2830487 - protein, 30 aa, Entamoeba invadens
ILGVILITFFVIVVVIIIMFFVVVHIYNER

SEQ ID NO: 2830488 - protein, 18 aa, Entamoeba invadens
ILIFLSILPFTVSKVIQV

SEQ ID NO: 2830489 - protein, 18 aa, Entamoeba invadens
ILIQKPFLVKLLYSKNRI

SEQ ID NO: 2830490 - protein, 20 aa, Entamoeba invadens
ILKHMIFFKMLFMDFLKDDS

SEQ ID NO: 2830491 - protein, 25 aa, Entamoeba invadens
ILKIDKLFRYFVMSMSQKLNIVATK

SEQ ID NO: 2830492 - protein, 17 aa, Entamoeba invadens
ILKILNSKKIFSLIAML

SEQ ID NO: 2830493 - protein, 17 aa, Entamoeba invadens
ILLFFTWTTPPTIMSTK

SEQ ID NO: 2830494 - protein, 25 aa, Entamoeba invadens
ILLKDLLIIFYYFNLNFSVVINNIY

SEQ ID NO: 2830495 - protein, 18 aa, Entamoeba invadens
ILLLLVTFLYIVYSILFQ

SEQ ID NO: 2830496 - protein, 28 aa, Entamoeba invadens
ILLLPEALKLLPIFVLGAMKTPAFMAFG

SEQ ID NO: 2830497 - protein, 17 aa, Entamoeba invadens
ILMIVSSLLLVPFFIVG

SEQ ID NO: 2830498 - protein, 20 aa, Entamoeba invadens
ILMLIIMCIIIIFKVIEHKK

SEQ ID NO: 2830499 - protein, 17 aa, Entamoeba invadens
ILMLWKFRVGQPALLYL

SEQ ID NO: 2830500 - protein, 17 aa, Entamoeba invadens
ILPLVFFYRKCTAPGCL

SEQ ID NO: 2830501 - protein, 17 aa, Entamoeba invadens
ILQPLIMLLFGELVDTF

SEQ ID NO: 2830502 - protein, 24 aa, Entamoeba invadens
ILSLAIWLCYFWKGYQNVIESNVA

SEQ ID NO: 2830503 - protein, 23 aa, Entamoeba invadens
ILSLCMLLRYFYLRFVNKLETST

SEQ ID NO: 2830504 - protein, 26 aa, Entamoeba invadens
ILTITLLTIILLYILQRYSHKQQMQN

SEQ ID NO: 2830505 - protein, 17 aa, Entamoeba invadens
ILVIILVIKLLLNRLRN

SEQ ID NO: 2830506 - protein, 20 aa, Entamoeba invadens
ILVISIIVAIIVWKYKMRKT

SEQ ID NO: 2830507 - protein, 31 aa, Entamoeba invadens
ILVTVSIVLLILFIICLVIIGVVTFIHFSRI

SEQ ID NO: 2830508 - protein, 20 aa, Entamoeba invadens
ILVYFLICYCCCIELPITSL

SEQ ID NO: 2830509 - protein, 24 aa, Entamoeba invadens
ILWLIIQLSASLMWCQIGKEIIQC

SEQ ID NO: 2830510 - protein, 18 aa, Entamoeba invadens
IMFSYKLKVRLLFDTARG

SEQ ID NO: 2830511 - protein, 25 aa, Entamoeba invadens
IMILLNVFLMVYFVQSWIVMASDSN

SEQ ID NO: 2830512 - protein, 26 aa, Entamoeba invadens
IMLDCVFSPAVNWFFKFALQTICPDT

SEQ ID NO: 2830513 - protein, 17 aa, Entamoeba invadens
IMLLTKYPIFIEDYINY

SEQ ID NO: 2830514 - protein, 20 aa, Entamoeba invadens
IMVLPLYPMFEKAPQMVLYP

SEQ ID NO: 2830515 - protein, 23 aa, Entamoeba invadens
INEKFILNIWRYSNQTNPVQLYI

SEQ ID NO: 2830516 - protein, 17 aa, Entamoeba invadens
INFLLHRLFFQFFDNHK

SEQ ID NO: 2830517 - protein, 19 aa, Entamoeba invadens
INGWVFVCDFTFIDFSNFE

SEQ ID NO: 2830518 - protein, 24 aa, Entamoeba invadens
INIFKLFLHFFTNTSFYLPEYRNY

SEQ ID NO: 2830519 - protein, 25 aa, Entamoeba invadens
INKALFISLLTIGLVIFVSIIIAII

SEQ ID NO: 2830520 - protein, 23 aa, Entamoeba invadens
INSGLILNGIFFISCFLFNKNNY

SEQ ID NO: 2830521 - protein, 17 aa, Entamoeba invadens
IPIFSFELSVQKYVFQH

SEQ ID NO: 2830522 - protein, 23 aa, Entamoeba invadens
IPISIVIVIIIIVTTIIVVTVIL

SEQ ID NO: 2830523 - protein, 36 aa, Entamoeba invadens
IPITVRILLVIFITMIILLIIILLNKRQVKKKMQNV

SEQ ID NO: 2830524 - protein, 30 aa, Entamoeba invadens
IPIVSVFIIILIIISIIVITIVVLQKRKET

SEQ ID NO: 2830525 - protein, 30 aa, Entamoeba invadens
IPIVSVFIIVLIIISIIVIIIVVLQKRKET

SEQ ID NO: 2830526 - protein, 25 aa, Entamoeba invadens
IPIVSVFIIVLINISIIVVTIIVLQ

SEQ ID NO: 2830527 - protein, 31 aa, Entamoeba invadens
IPIVSVIILILIIICIIVVTIIVIQKRKETK

SEQ ID NO: 2830528 - protein, 34 aa, Entamoeba invadens
IPLEEFVLTTLIPFFKMLFLKCNLLYAKYAKKTI

SEQ ID NO: 2830529 - protein, 25 aa, Entamoeba invadens
IPLIILWVILFILQIGIFIVSVISF

SEQ ID NO: 2830530 - protein, 20 aa, Entamoeba invadens
IPLLWMIYTNAFNLEKNYNF

SEQ ID NO: 2830531 - protein, 17 aa, Entamoeba invadens
IPLTVLGVVLIIVFLVG

SEQ ID NO: 2830532 - protein, 24 aa, Entamoeba invadens
IPMTIFGYFYIFLATIRALYLAFV

SEQ ID NO: 2830533 - protein, 17 aa, Entamoeba invadens
IPQFTFLSCGSLSLLTG

SEQ ID NO: 2830534 - protein, 20 aa, Entamoeba invadens
IPRKVRGFVWYALLLKPEDA

SEQ ID NO: 2830535 - protein, 25 aa, Entamoeba invadens
IPSQDFFPLFWQTLLPMLQVNDTGV

SEQ ID NO: 2830536 - protein, 30 aa, Entamoeba invadens
IPVAVLIVFFILIAIILVVVLFINTKKKEK

SEQ ID NO: 2830537 - protein, 17 aa, Entamoeba invadens
IPVFLWIVTFIVLVIIL

SEQ ID NO: 2830538 - protein, 17 aa, Entamoeba invadens
IPWRRLVITPNPKKPTI

SEQ ID NO: 2830539 - protein, 20 aa, Entamoeba invadens
IQIFAFDKLSLVLKSTRAPH

SEQ ID NO: 2830540 - protein, 19 aa, Entamoeba invadens
IQLQYFWFAEDAQLYADAY

SEQ ID NO: 2830541 - protein, 17 aa, Entamoeba invadens
IQMLFFVLFITLSFAEE

SEQ ID NO: 2830542 - protein, 26 aa, Entamoeba invadens
IQTEKPLFPLFLVDAGLVIISRFPIV

SEQ ID NO: 2830543 - protein, 22 aa, Entamoeba invadens
IQTSLIKLLLGNKYKFANTINS

SEQ ID NO: 2830544 - protein, 25 aa, Entamoeba invadens
IQVFNFISLIFFPITLVVNSFGCNI

SEQ ID NO: 2830545 - protein, 23 aa, Entamoeba invadens
IQYFIYFNFIVNKTNFWLLCIFQ

SEQ ID NO: 2830546 - protein, 24 aa, Entamoeba invadens
IRDLPIFFIYQINTTIFTFQSSYE

SEQ ID NO: 2830547 - protein, 18 aa, Entamoeba invadens
IRDMKIPFTLWFSKNRQT

SEQ ID NO: 2830548 - protein, 27 aa, Entamoeba invadens
IRDPAFLAFLGFFFYLLTGAKCLCDAL

SEQ ID NO: 2830549 - protein, 20 aa, Entamoeba invadens
IRFFLTPYRFVILRRYFFLQ

SEQ ID NO: 2830550 - protein, 17 aa, Entamoeba invadens
IRIPWRRLVITPNPKKP

SEQ ID NO: 2830551 - protein, 22 aa, Entamoeba invadens
IRKALLLFTNFPMIFIPNSRGI

SEQ ID NO: 2830552 - protein, 22 aa, Entamoeba invadens
IRKLYRYINWFDGLMLLLGLCG

SEQ ID NO: 2830553 - protein, 18 aa, Entamoeba invadens
IRLKIRIKLMLDAARGMQ

SEQ ID NO: 2830554 - protein, 18 aa, Entamoeba invadens
IRVILLTLTFLSLISFNL

SEQ ID NO: 2830555 - protein, 21 aa, Entamoeba invadens
IRYIYPFFVPYITQLLNDLAK

SEQ ID NO: 2830556 - protein, 23 aa, Entamoeba invadens
IRYTKYHIFMLKKAIHQIEYFPL

SEQ ID NO: 2830557 - protein, 24 aa, Entamoeba invadens
ISALPFMFLALFAIGKTTAYSNGK

SEQ ID NO: 2830558 - protein, 17 aa, Entamoeba invadens
ISFILFYIHYRKEEKLR

SEQ ID NO: 2830559 - protein, 18 aa, Entamoeba invadens
ISFVYFLHPWLIDELTDF

SEQ ID NO: 2830560 - protein, 25 aa, Entamoeba invadens
ISGRGIFIILVLMVVLVLFMVIVYF

SEQ ID NO: 2830561 - protein, 25 aa, Entamoeba invadens
ISIILLFFLYLHLKEKKKMINVCVF

SEQ ID NO: 2830562 - protein, 24 aa, Entamoeba invadens
ISISYFFQFLFPEEFLKQKVIHNY

SEQ ID NO: 2830563 - protein, 17 aa, Entamoeba invadens
ISKLYKQTFLSFSFGEI

SEQ ID NO: 2830564 - protein, 26 aa, Entamoeba invadens
ISLAIFFFWKILLVVFFVLFELSFAI

SEQ ID NO: 2830565 - protein, 25 aa, Entamoeba invadens
ISLICFFSAFFFDQVLLYAVSVLSC

SEQ ID NO: 2830566 - protein, 29 aa, Entamoeba invadens
ISLPVVFFLLLVIFIATTIVIIFFLYLHL

SEQ ID NO: 2830567 - protein, 18 aa, Entamoeba invadens
ISLYLIVLVVFFGFDEMI

SEQ ID NO: 2830568 - protein, 17 aa, Entamoeba invadens
ISNLIMQLIFKTAVEHP

SEQ ID NO: 2830569 - protein, 22 aa, Entamoeba invadens
ISWIHLLFYLLGVGCGPFLSSM

SEQ ID NO: 2830570 - protein, 25 aa, Entamoeba invadens
ISYFYIMFLAIILALIILAAVWYFL

SEQ ID NO: 2830571 - protein, 27 aa, Entamoeba invadens
ITFILGEYFFNSLWMILCLLPPPQAFI

SEQ ID NO: 2830572 - protein, 17 aa, Entamoeba invadens
ITHFFPFTFIRKYRKMP

SEQ ID NO: 2830573 - protein, 23 aa, Entamoeba invadens
ITLVFLIIGIIFCPFLVASFVIS

SEQ ID NO: 2830574 - protein, 19 aa, Entamoeba invadens
ITMFCVLLPLLFMCVVNAQ

SEQ ID NO: 2830575 - protein, 27 aa, Entamoeba invadens
ITMKYLLLYLLIVVIIFIILPSYSLLF

SEQ ID NO: 2830576 - protein, 17 aa, Entamoeba invadens
ITPIVIGVILILIIIFV

SEQ ID NO: 2830577 - protein, 37 aa, Entamoeba invadens
ITQAVWWVILLCVLFVIFIFIIIIASSIFIFIAILNH

SEQ ID NO: 2830578 - protein, 27 aa, Entamoeba invadens
ITSFGEMSFLLTSLPKLNFSPKLEKLG

SEQ ID NO: 2830579 - protein, 29 aa, Entamoeba invadens
ITSKQWDFVYFWQYYLKLLVPGKTRIYVC

SEQ ID NO: 2830580 - protein, 28 aa, Entamoeba invadens
ITVIPALMFLWRMVIRPLLFKPTTKVYK

SEQ ID NO: 2830581 - protein, 19 aa, Entamoeba invadens
ITVLILLVIFILLNKRQVK

SEQ ID NO: 2830582 - protein, 30 aa, Entamoeba invadens
ITVLSIFIALIFIVVVVLITLFVIKKCKKS

SEQ ID NO: 2830583 - protein, 17 aa, Entamoeba invadens
ITVLTNPLLFILCLIIG

SEQ ID NO: 2830584 - protein, 24 aa, Entamoeba invadens
ITVTFVIIVFIIALIPIVISMIQK

SEQ ID NO: 2830585 - protein, 21 aa, Entamoeba invadens
ITWIEAYLKKQFKFAWDIVDF

SEQ ID NO: 2830586 - protein, 18 aa, Entamoeba invadens
ITYTVDYQCDGKWIVAVP

SEQ ID NO: 2830587 - protein, 32 aa, Entamoeba invadens
IVAIIIIIVLLLLFIGLIWWRRTKSVKAETAA

SEQ ID NO: 2830588 - protein, 26 aa, Entamoeba invadens
IVAVIFVIIVIIWWKRKKSLAAESTA

SEQ ID NO: 2830589 - protein, 18 aa, Entamoeba invadens
IVDFYNIIIIQNIILYSS

SEQ ID NO: 2830590 - protein, 18 aa, Entamoeba invadens
IVFCLLFVFFITLGIFKQ

SEQ ID NO: 2830591 - protein, 20 aa, Entamoeba invadens
IVFLVIIGLVIYFGFFFFKK

SEQ ID NO: 2830592 - protein, 19 aa, Entamoeba invadens
IVFLYFTGFFRAMFFTFTI

SEQ ID NO: 2830593 - protein, 17 aa, Entamoeba invadens
IVIFIIIIVIVVIITLV

SEQ ID NO: 2830594 - protein, 30 aa, Entamoeba invadens
IVIGCVIFSVYLWIQAIQYRTKIRDICIFD

SEQ ID NO: 2830595 - protein, 34 aa, Entamoeba invadens
IVIGVILILIIIFVFLLVYFLVKKHNSKYYKNLT

SEQ ID NO: 2830596 - protein, 25 aa, Entamoeba invadens
IVIIIVLIIIIIVIATVVIYLILQH

SEQ ID NO: 2830597 - protein, 27 aa, Entamoeba invadens
IVIIIVVIILIMVLLRYLRKHAEKVEQ

SEQ ID NO: 2830598 - protein, 22 aa, Entamoeba invadens
IVILTILYFYRPPRLSKDLYGV

SEQ ID NO: 2830599 - protein, 19 aa, Entamoeba invadens
IVIVYFIITIVFVFSITTK

SEQ ID NO: 2830600 - protein, 22 aa, Entamoeba invadens
IVLGIICLVVLIVAYYIVNKKV

SEQ ID NO: 2830601 - protein, 26 aa, Entamoeba invadens
IVLIIIVSIIIVLLYLLVLKKKEEVK

SEQ ID NO: 2830602 - protein, 24 aa, Entamoeba invadens
IVLIVILLFIILLIVIVVITKMIL

SEQ ID NO: 2830603 - protein, 36 aa, Entamoeba invadens
IVLPIVFGFLIIILLIIVIALLLFYKHFKTEQKVWK

SEQ ID NO: 2830604 - protein, 22 aa, Entamoeba invadens
IVLYPIYIVIFALFNNSSDKRV

SEQ ID NO: 2830605 - protein, 23 aa, Entamoeba invadens
IVNDLVFFFTFGKVKISLFDDSS

SEQ ID NO: 2830606 - protein, 23 aa, Entamoeba invadens
IVNMIFEWVVAKLKIRNLFADGI

SEQ ID NO: 2830607 - protein, 22 aa, Entamoeba invadens
IVQLLHILIYYHNPVLAQHITE

SEQ ID NO: 2830608 - protein, 17 aa, Entamoeba invadens
IVRWVILICVIVALLIL

SEQ ID NO: 2830609 - protein, 19 aa, Entamoeba invadens
IVSILWKYLAFSVKCALKQ

SEQ ID NO: 2830610 - protein, 22 aa, Entamoeba invadens
IVSVILFLIIFFGLTHKKIDID

SEQ ID NO: 2830611 - protein, 21 aa, Entamoeba invadens
IVVAFLIWKYFPRKIKSENIF

SEQ ID NO: 2830612 - protein, 20 aa, Entamoeba invadens
IVVPINYWKIAIVASTVMVC

SEQ ID NO: 2830613 - protein, 23 aa, Entamoeba invadens
IVVTQFIVIVFLLTRRKQNNQIE

SEQ ID NO: 2830614 - protein, 28 aa, Entamoeba invadens
IVVVIILLIIISFLIYVLYKHLKQKQLA

SEQ ID NO: 2830615 - protein, 24 aa, Entamoeba invadens
IVVVIVILIILVVAGILGFYISKK

SEQ ID NO: 2830616 - protein, 27 aa, Entamoeba invadens
IVVVVVVLILFLIWRRRLAVEKERKKS

SEQ ID NO: 2830617 - protein, 18 aa, Entamoeba invadens
IVYFFMYFLASNKSPFAT

SEQ ID NO: 2830618 - protein, 22 aa, Entamoeba invadens
IWDMFLLEGFVWLVKVSAAFLL

SEQ ID NO: 2830619 - protein, 33 aa, Entamoeba invadens
IWSDFLLNHLIFYFVLFTIIYVKYKKLNKKIKE

SEQ ID NO: 2830620 - protein, 24 aa, Entamoeba invadens
IYCIFYIIMFFVIFPVYVTKLTSS

SEQ ID NO: 2830621 - protein, 32 aa, Entamoeba invadens
IYFVVSIVIYYILYGTILLFILIGDRQLKKAI

SEQ ID NO: 2830622 - protein, 27 aa, Entamoeba invadens
IYLVILVLILVILFIGLYFFTSKAVIA

SEQ ID NO: 2830623 - protein, 23 aa, Entamoeba invadens
IYPILYSIVLFCILALYTHSDFF

SEQ ID NO: 2830624 - protein, 17 aa, Entamoeba invadens
IYTWFYFNKAIYLTGAA

SEQ ID NO: 2830625 - protein, 26 aa, Entamoeba invadens
IYVLKNYFLLYFTVIWIGLNVTSITS

SEQ ID NO: 2830626 - protein, 17 aa, Entamoeba invadens
IYYETTLIWIQITHLYI

SEQ ID NO: 2830627 - protein, 24 aa, Entamoeba invadens
KAEWWVITLIVIVVLFFIVIICIL

SEQ ID NO: 2830628 - protein, 23 aa, Entamoeba invadens
KAIEKVVVLLYFGVSLPEILVYL

SEQ ID NO: 2830629 - protein, 23 aa, Entamoeba invadens
KAQRVIYVIFWPLLMLLAYTIPD

SEQ ID NO: 2830630 - protein, 19 aa, Entamoeba invadens
KAVWWAIIIVVIVSVIIIT

SEQ ID NO: 2830631 - protein, 25 aa, Entamoeba invadens
KAVWWVILFCVIFTICVLIILMISM

SEQ ID NO: 2830632 - protein, 22 aa, Entamoeba invadens
KAVWWVLLIVVVFAIIVMAVVI

SEQ ID NO: 2830633 - protein, 20 aa, Entamoeba invadens
KCFKCLDGFYLVSGQCALCN

SEQ ID NO: 2830634 - protein, 18 aa, Entamoeba invadens
KCHFLTIPMFPTAIVFAV

SEQ ID NO: 2830635 - protein, 17 aa, Entamoeba invadens
KCKTNFYLVADTLKCVE

SEQ ID NO: 2830636 - protein, 22 aa, Entamoeba invadens
KCKWFIVVFWILLAIATAYFAL

SEQ ID NO: 2830637 - protein, 19 aa, Entamoeba invadens
KCWAYWQHLMFGYANLKDD

SEQ ID NO: 2830638 - protein, 38 aa, Entamoeba invadens
KDDVPTWVIVILIIIGIFIVIVVILFIVFVVIARKILL

SEQ ID NO: 2830639 - protein, 19 aa, Entamoeba invadens
KDGSFSIFVSIFGFIILAI

SEQ ID NO: 2830640 - protein, 19 aa, Entamoeba invadens
KDIYILFVRLFILHIKVLI

SEQ ID NO: 2830641 - protein, 23 aa, Entamoeba invadens
KDLSIVYFLVLVRLLQTFDQKNL

SEQ ID NO: 2830642 - protein, 20 aa, Entamoeba invadens
KDLVFEFYLPPRAFINNQVI

SEQ ID NO: 2830643 - protein, 23 aa, Entamoeba invadens
KDMPDWLYQVISLGWDQLPLNRP

SEQ ID NO: 2830644 - protein, 25 aa, Entamoeba invadens
KDPFDEKLFPYSWDITNLISSGKRP

SEQ ID NO: 2830645 - protein, 22 aa, Entamoeba invadens
KDTLIPFVKRYVVWFTVSLTDS

SEQ ID NO: 2830646 - protein, 20 aa, Entamoeba invadens
KEFVLLFFHLYKTLQEFLNN

SEQ ID NO: 2830647 - protein, 20 aa, Entamoeba invadens
KEGFYCLEGNKYIHKYLWCT

SEQ ID NO: 2830648 - protein, 23 aa, Entamoeba invadens
KEMIRFAIFFIKQKLGKIPEKET

SEQ ID NO: 2830649 - protein, 23 aa, Entamoeba invadens
KENLIIVYLLLLLVYQNYTTLKE

SEQ ID NO: 2830650 - protein, 27 aa, Entamoeba invadens
KEVKGVDMKVAVLGATVVVLLGVVAYL

SEQ ID NO: 2830651 - protein, 21 aa, Entamoeba invadens
KEYKILFKWYDGPLIEAMKTG

SEQ ID NO: 2830652 - protein, 17 aa, Entamoeba invadens
KFAIITTLFTPLIFAST

SEQ ID NO: 2830653 - protein, 22 aa, Entamoeba invadens
KFAPLPLFVGWYTILFTVFFNE

SEQ ID NO: 2830654 - protein, 22 aa, Entamoeba invadens
KFDFCLPISPSLYPNCKRLAFS

SEQ ID NO: 2830655 - protein, 24 aa, Entamoeba invadens
KFISVIYCPMLIFFLAITAHSQCQ

SEQ ID NO: 2830656 - protein, 28 aa, Entamoeba invadens
KFLSNLVAPILFFFATIATPIPLSIQNV

SEQ ID NO: 2830657 - protein, 23 aa, Entamoeba invadens
KFMFDRLFYLEDVGLFIAMIFGL

SEQ ID NO: 2830658 - protein, 23 aa, Entamoeba invadens
KFRCDYIIYFYGAVLIPSRICMV

SEQ ID NO: 2830659 - protein, 17 aa, Entamoeba invadens
KFRSDFIIHFYGACFIP

SEQ ID NO: 2830660 - protein, 17 aa, Entamoeba invadens
KFRSDYIVHFYGAVFIL

SEQ ID NO: 2830661 - protein, 17 aa, Entamoeba invadens
KFRSEFIIHFYGACFIP

SEQ ID NO: 2830662 - protein, 17 aa, Entamoeba invadens
KFRSEFIVHFYGAVFIP

SEQ ID NO: 2830663 - protein, 24 aa, Entamoeba invadens
KFRSEYIIHFYGAVFIPNKICMVT

SEQ ID NO: 2830664 - protein, 24 aa, Entamoeba invadens
KFRSEYIVHFYGAVFILNKICMVT

SEQ ID NO: 2830665 - protein, 21 aa, Entamoeba invadens
KFSFFFSFFFRFQETDNLFEI

SEQ ID NO: 2830666 - protein, 17 aa, Entamoeba invadens
KFTLLRLLIERCGGMRR

SEQ ID NO: 2830667 - protein, 18 aa, Entamoeba invadens
KFTRKILHIFYSKTFEKK

SEQ ID NO: 2830668 - protein, 18 aa, Entamoeba invadens
KFVFYFDPQVIFLRPKQK

SEQ ID NO: 2830669 - protein, 19 aa, Entamoeba invadens
KFVLIVLLIVSTFSRDIYV

SEQ ID NO: 2830670 - protein, 23 aa, Entamoeba invadens
KGFIVIVVFIIFGIVLIVVVIGF

SEQ ID NO: 2830671 - protein, 26 aa, Entamoeba invadens
KGHFVTNLLLIWFPIKINNFQAYMLD

SEQ ID NO: 2830672 - protein, 28 aa, Entamoeba invadens
KHLNKNKLIWVYKRFYQLDYHSMRTLIF

SEQ ID NO: 2830673 - protein, 23 aa, Entamoeba invadens
KHSFTFFIVALILIYKRNPSFFE

SEQ ID NO: 2830674 - protein, 18 aa, Entamoeba invadens
KICNFLYLHFNFKNENFF

SEQ ID NO: 2830675 - protein, 22 aa, Entamoeba invadens
KIFIILFALGFLFVIPWLVGFI

SEQ ID NO: 2830676 - protein, 22 aa, Entamoeba invadens
KIFIILFALGFLFVVPWLAGFI

SEQ ID NO: 2830677 - protein, 26 aa, Entamoeba invadens
KIKAVWWMIIVIVVVCILLIILITTI

SEQ ID NO: 2830678 - protein, 18 aa, Entamoeba invadens
KIMKMKYTKYPYWATTEK

SEQ ID NO: 2830679 - protein, 19 aa, Entamoeba invadens
KIPSQFLLPNLPPVKYQGQ

SEQ ID NO: 2830680 - protein, 29 aa, Entamoeba invadens
KIQFEFLVPFLPLIAWQLSHVDLSWTLTQ

SEQ ID NO: 2830681 - protein, 17 aa, Entamoeba invadens
KIQFLPLIDSAIENFKI

SEQ ID NO: 2830682 - protein, 34 aa, Entamoeba invadens
KIVVSVYFFKFFSIFFKFFQFLPNSRYFKQLFVY

SEQ ID NO: 2830683 - protein, 27 aa, Entamoeba invadens
KKASRKLLFILLIVGAVFIVLAVIVAI

SEQ ID NO: 2830684 - protein, 36 aa, Entamoeba invadens
KKAVWWVLIIIVLLAILLLTMAILLIIFAVLYIEKK

SEQ ID NO: 2830685 - protein, 24 aa, Entamoeba invadens
KKAVWWVLLIVVVFAIIVMAVVIT

SEQ ID NO: 2830686 - protein, 42 aa, Entamoeba invadens
KKDVPTWVIVILIIIGIFIVIILILFVVFVIVARKILLKRKA

SEQ ID NO: 2830687 - protein, 18 aa, Entamoeba invadens
KKIGYPMRKFVIDWSLVP

SEQ ID NO: 2830688 - protein, 26 aa, Entamoeba invadens
KKLYLYTLMILLLTLVIEVLSECPFQ

SEQ ID NO: 2830689 - protein, 25 aa, Entamoeba invadens
KKTTFKWTYIIVAVPVLAAVVFIIY

SEQ ID NO: 2830690 - protein, 22 aa, Entamoeba invadens
KKYKYPTFFPFFMSYSHTYNGN

SEQ ID NO: 2830691 - protein, 22 aa, Entamoeba invadens
KKYPFLTLFFQAIGSLICVFQA

SEQ ID NO: 2830692 - protein, 17 aa, Entamoeba invadens
KLALCIVVLIPIFGVLL

SEQ ID NO: 2830693 - protein, 19 aa, Entamoeba invadens
KLCHSFIVLILIILNLVPS

SEQ ID NO: 2830694 - protein, 23 aa, Entamoeba invadens
KLDSFPLPIFKFIAASTGVVVST

SEQ ID NO: 2830695 - protein, 21 aa, Entamoeba invadens
KLFFSLLQWSVLIVTTIAVCL

SEQ ID NO: 2830696 - protein, 30 aa, Entamoeba invadens
KLFLKVGVPILVIFFVIIFGTISVILLQKT

SEQ ID NO: 2830697 - protein, 20 aa, Entamoeba invadens
KLFYYFLINLLFMFVEVAYG

SEQ ID NO: 2830698 - protein, 18 aa, Entamoeba invadens
KLHFLVIPIFPCSIFFAV

SEQ ID NO: 2830699 - protein, 18 aa, Entamoeba invadens
KLLFFNRGLMYFFMIVSI

SEQ ID NO: 2830700 - protein, 20 aa, Entamoeba invadens
KLMIILFVVIPEVFSLKSNN

SEQ ID NO: 2830701 - protein, 24 aa, Entamoeba invadens
KLNKRIFLLKFTKHKFQTICKGVG

SEQ ID NO: 2830702 - protein, 25 aa, Entamoeba invadens
KLPFHYPLWKAMIAITLLLTPIALD

SEQ ID NO: 2830703 - protein, 18 aa, Entamoeba invadens
KLPFPLTVKHHLLFTVSL

SEQ ID NO: 2830704 - protein, 18 aa, Entamoeba invadens
KLQLERSLLLLSQEKERI

SEQ ID NO: 2830705 - protein, 22 aa, Entamoeba invadens
KLSFLLLVNLLFFLCELITGIV

SEQ ID NO: 2830706 - protein, 27 aa, Entamoeba invadens
KLSHYVMWFFVFSYFFIAIILSTCFGI

SEQ ID NO: 2830707 - protein, 22 aa, Entamoeba invadens
KLSPTFWWYVGGLVFCLLFCTP

SEQ ID NO: 2830708 - protein, 20 aa, Entamoeba invadens
KLVFLVMLDKKFRMLEAFPV

SEQ ID NO: 2830709 - protein, 23 aa, Entamoeba invadens
KLYETFIYLKFKTNSIVLCLDSE

SEQ ID NO: 2830710 - protein, 25 aa, Entamoeba invadens
KLYYYKIFAFFYWIVGKIPSLVFVN

SEQ ID NO: 2830711 - protein, 17 aa, Entamoeba invadens
KMFLLTKTVLLVSETIL

SEQ ID NO: 2830712 - protein, 17 aa, Entamoeba invadens
KMFLNYINNGQYQVTNF

SEQ ID NO: 2830713 - protein, 24 aa, Entamoeba invadens
KMKCTKCIYGYYPDTNKNCVLGTL

SEQ ID NO: 2830714 - protein, 25 aa, Entamoeba invadens
KMNWLRPLIIPLIKLRPYELLQHLM

SEQ ID NO: 2830715 - protein, 20 aa, Entamoeba invadens
KMSLLYMLLQPFFRIRKYQE

SEQ ID NO: 2830716 - protein, 21 aa, Entamoeba invadens
KMTFFVSTLLVILSMSKTLYV

SEQ ID NO: 2830717 - protein, 25 aa, Entamoeba invadens
KMVKYNFIYFTFTMVSKLLIISCYF

SEQ ID NO: 2830718 - protein, 34 aa, Entamoeba invadens
KNEKTILMVFKSIIKRFWFKGVELKPKNFNVWLQ

SEQ ID NO: 2830719 - protein, 20 aa, Entamoeba invadens
KNFLFMYIMIAIAIYFQLHF

SEQ ID NO: 2830720 - protein, 17 aa, Entamoeba invadens
KNFYFISLNSIGSLILS

SEQ ID NO: 2830721 - protein, 19 aa, Entamoeba invadens
KNIFKMFWTQLTDFIVMIL

SEQ ID NO: 2830722 - protein, 23 aa, Entamoeba invadens
KNIVMYLTQFWFLSFNGYSGTSL

SEQ ID NO: 2830723 - protein, 22 aa, Entamoeba invadens
KNKNFIFIYIFKNVTFTKNDRK

SEQ ID NO: 2830724 - protein, 26 aa, Entamoeba invadens
KNKYIIDNIFYFLPFNFNIDENKNTR

SEQ ID NO: 2830725 - protein, 17 aa, Entamoeba invadens
KNLLIACALIVIVLVLF

SEQ ID NO: 2830726 - protein, 25 aa, Entamoeba invadens
KNNMKFFLQFMFYASITLFFAIIIN

SEQ ID NO: 2830727 - protein, 28 aa, Entamoeba invadens
KNPRVDLYLMIFLKFLTTVIPTMEYDYG

SEQ ID NO: 2830728 - protein, 23 aa, Entamoeba invadens
KNVILVHLFLLLMYSFVIDKKDG

SEQ ID NO: 2830729 - protein, 17 aa, Entamoeba invadens
KNYFMIIGVPVIVVVIV

SEQ ID NO: 2830730 - protein, 23 aa, Entamoeba invadens
KNYTLTPILYPICEYPLMYNKTN

SEQ ID NO: 2830731 - protein, 20 aa, Entamoeba invadens
KPDNFLILSLDLYEKVNAKL

SEQ ID NO: 2830732 - protein, 23 aa, Entamoeba invadens
KPDNLLIFSLYFSTQIIAKLTDF

SEQ ID NO: 2830733 - protein, 22 aa, Entamoeba invadens
KPKSLLFTPKATYYLPYFLMGG

SEQ ID NO: 2830734 - protein, 25 aa, Entamoeba invadens
KPPVGWIVFGVIVFVVFVVVIAGIL

SEQ ID NO: 2830735 - protein, 22 aa, Entamoeba invadens
KQKYRLMYWYKLDYSQVTTKYI

SEQ ID NO: 2830736 - protein, 24 aa, Entamoeba invadens
KQWYEYYVVLCAPYILIFENEEKF

SEQ ID NO: 2830737 - protein, 24 aa, Entamoeba invadens
KQYRVKFYLKAILIFSIILTVILA

SEQ ID NO: 2830738 - protein, 25 aa, Entamoeba invadens
KRFPKFFHCIVALAPIKLVHLVIVL

SEQ ID NO: 2830739 - protein, 24 aa, Entamoeba invadens
KRFVFLIFFAFMLYVTFVFNKWRI

SEQ ID NO: 2830740 - protein, 23 aa, Entamoeba invadens
KRIFNWLILFWGYTAFECFEQES

SEQ ID NO: 2830741 - protein, 21 aa, Entamoeba invadens
KRPIHYFWYYINSIVFHCFVT

SEQ ID NO: 2830742 - protein, 19 aa, Entamoeba invadens
KRRLEWHYLFLACGYTGIV

SEQ ID NO: 2830743 - protein, 24 aa, Entamoeba invadens
KRWNFLWTLVFYSGFLVITIITTI

SEQ ID NO: 2830744 - protein, 19 aa, Entamoeba invadens
KRYVFFFFYNFVVNQISHE

SEQ ID NO: 2830745 - protein, 18 aa, Entamoeba invadens
KSCGLFHYLYLHKDIFGK

SEQ ID NO: 2830746 - protein, 25 aa, Entamoeba invadens
KSDGWLIWSIWVMMTIVAVITFTVS

SEQ ID NO: 2830747 - protein, 17 aa, Entamoeba invadens
KSGFYLDKLGNCKSLGA

SEQ ID NO: 2830748 - protein, 24 aa, Entamoeba invadens
KSIGKMLFFNFSFGPAIVTLFAAI

SEQ ID NO: 2830749 - protein, 25 aa, Entamoeba invadens
KSKPDYIKLPYKLKLKMLFDASRGM

SEQ ID NO: 2830750 - protein, 21 aa, Entamoeba invadens
KSPVWWVIVIVVIVALVILIV

SEQ ID NO: 2830751 - protein, 25 aa, Entamoeba invadens
KSQTYDFFFYRPTPPDFYVKEDKLV

SEQ ID NO: 2830752 - protein, 18 aa, Entamoeba invadens
KSRKLFYYFLINLLFMFV

SEQ ID NO: 2830753 - protein, 24 aa, Entamoeba invadens
KSSPTYVLYLYLYERYYPICRTQK

SEQ ID NO: 2830754 - protein, 24 aa, Entamoeba invadens
KSTKIMLVVFIVLTIIFGLSTLGL

SEQ ID NO: 2830755 - protein, 20 aa, Entamoeba invadens
KSTRFLLPRYILNNLRHEHI

SEQ ID NO: 2830756 - protein, 22 aa, Entamoeba invadens
KTIEILWRQLFFVFFVEDGNLI

SEQ ID NO: 2830757 - protein, 18 aa, Entamoeba invadens
KTKDKVLLGFLYVGLLCT

SEQ ID NO: 2830758 - protein, 25 aa, Entamoeba invadens
KTKLSIKLLFFLGFIIPLIWPVIVV

SEQ ID NO: 2830759 - protein, 28 aa, Entamoeba invadens
KTKTNIMPLLLPLFKKLPIHSFAILLQL

SEQ ID NO: 2830760 - protein, 22 aa, Entamoeba invadens
KTLFSFLKRFTSMQFLYFLPFN

SEQ ID NO: 2830761 - protein, 19 aa, Entamoeba invadens
KTLNILFLIVICSGIFILL

SEQ ID NO: 2830762 - protein, 17 aa, Entamoeba invadens
KTLPFLFDLVFSSTFKG

SEQ ID NO: 2830763 - protein, 21 aa, Entamoeba invadens
KTLPYFIVLALLNYSTPAIQR

SEQ ID NO: 2830764 - protein, 19 aa, Entamoeba invadens
KTLQLIPPYLVHRPGFEGY

SEQ ID NO: 2830765 - protein, 19 aa, Entamoeba invadens
KTLRLSFYKTRKLSDIIMC

SEQ ID NO: 2830766 - protein, 32 aa, Entamoeba invadens
KTNPKRYLIFFLLVFIVILIAILFVVIASKNT

SEQ ID NO: 2830767 - protein, 30 aa, Entamoeba invadens
KTNVLAIIFPIIFGILMVVLIIITISCILF

SEQ ID NO: 2830768 - protein, 43 aa, Entamoeba invadens
KTNWALIIPLVILGVIIIVIILVLLIAFVWWRRTKSVKAETAA

SEQ ID NO: 2830769 - protein, 33 aa, Entamoeba invadens
KTQVVWWIIVIIVLFIICIFIVTTLVIVLIAKH

SEQ ID NO: 2830770 - protein, 21 aa, Entamoeba invadens
KTRFFWFTLFTSILLIMHLLF

SEQ ID NO: 2830771 - protein, 20 aa, Entamoeba invadens
KTRLILFRLMKIVNDPFSLE

SEQ ID NO: 2830772 - protein, 17 aa, Entamoeba invadens
KTSWRYFLLSFLALAFA

SEQ ID NO: 2830773 - protein, 29 aa, Entamoeba invadens
KTTWVYVNLFFLVFLCPLLNTPQLFVEGI

SEQ ID NO: 2830774 - protein, 24 aa, Entamoeba invadens
KTVDDYIWPLLEKKLYITGEALDG

SEQ ID NO: 2830775 - protein, 24 aa, Entamoeba invadens
KTWNWYMVLGYIGSLAFIFGIFYI

SEQ ID NO: 2830776 - protein, 26 aa, Entamoeba invadens
KVLIVVLVVAFIFVINMLNNQRKLGL

SEQ ID NO: 2830777 - protein, 17 aa, Entamoeba invadens
KVLKLILLLLYHRRDFN

SEQ ID NO: 2830778 - protein, 17 aa, Entamoeba invadens
KVLQLILFVLHGWVIYN

SEQ ID NO: 2830779 - protein, 22 aa, Entamoeba invadens
KVNLHNPILMKLRIKFMSDSAK

SEQ ID NO: 2830780 - protein, 22 aa, Entamoeba invadens
KVSFEGGPLPWYMDKGLYFTNM

SEQ ID NO: 2830781 - protein, 24 aa, Entamoeba invadens
KVSFLIFHYLKPKFISVIYCPMLI

SEQ ID NO: 2830782 - protein, 25 aa, Entamoeba invadens
KVWAKDMVLLYFWQGRTCAVLDKGT

SEQ ID NO: 2830783 - protein, 19 aa, Entamoeba invadens
KWFAVVVISFVVLFLVIMW

SEQ ID NO: 2830784 - protein, 19 aa, Entamoeba invadens
KWRHSQFITWIVIFSIIHI

SEQ ID NO: 2830785 - protein, 20 aa, Entamoeba invadens
KWYSIIFSTFKYYVLNSIQI

SEQ ID NO: 2830786 - protein, 26 aa, Entamoeba invadens
KYDVLYYLAMQPWRHIIWTSFENGVF

SEQ ID NO: 2830787 - protein, 20 aa, Entamoeba invadens
KYFILLLLYNTLMSSFVVFI

SEQ ID NO: 2830788 - protein, 18 aa, Entamoeba invadens
KYILFYFINALILHFHVY

SEQ ID NO: 2830789 - protein, 27 aa, Entamoeba invadens
KYKWWSFVFVFLFNQFKYFINMFFLIV

SEQ ID NO: 2830790 - protein, 17 aa, Entamoeba invadens
KYLMIIFHTPNNPKFIF

SEQ ID NO: 2830791 - protein, 18 aa, Entamoeba invadens
KYMLLIFHTPNSPKYIFH

SEQ ID NO: 2830792 - protein, 19 aa, Entamoeba invadens
KYMMIIFHTLNSPKYVFHF

SEQ ID NO: 2830793 - protein, 21 aa, Entamoeba invadens
KYNRMVLQCFLKMLLELSNVL

SEQ ID NO: 2830794 - protein, 20 aa, Entamoeba invadens
KYTPAWLVIVIVFAILVMFV

SEQ ID NO: 2830795 - protein, 22 aa, Entamoeba invadens
KYYYDDFYAYLPFVIDIVEGEY

SEQ ID NO: 2830796 - protein, 17 aa, Entamoeba invadens
LAALFCCIFLPDLPFIL

SEQ ID NO: 2830797 - protein, 24 aa, Entamoeba invadens
LAERHAMMYIILRQFFLLIMNNNK

SEQ ID NO: 2830798 - protein, 32 aa, Entamoeba invadens
LAGLFVVLLVVLLIIFLVWRVVKRIHNHRLIQ

SEQ ID NO: 2830799 - protein, 34 aa, Entamoeba invadens
LAIILPIIFGILIVVIIIITISFILFYIHYRKEE

SEQ ID NO: 2830800 - protein, 32 aa, Entamoeba invadens
LAIVLPIIFTIILIVVIIIAIGCVLFYIHYKK

SEQ ID NO: 2830801 - protein, 22 aa, Entamoeba invadens
LALYIALPVVLFVVLLIVIAIS

SEQ ID NO: 2830802 - protein, 17 aa, Entamoeba invadens
LAVGAIVIFIVIYIIAF

SEQ ID NO: 2830803 - protein, 30 aa, Entamoeba invadens
LAVIIICIILLIIVFIIIQKVLQARRRSKQ

SEQ ID NO: 2830804 - protein, 39 aa, Entamoeba invadens
LCDEHVVWWVLFIIILFAIFVIIIFILSFVLTIKHIDNK

SEQ ID NO: 2830805 - protein, 39 aa, Entamoeba invadens
LCEEHVVWWVLFLVVLFVIIIIIVVISITILIIFKVIEM

SEQ ID NO: 2830806 - protein, 20 aa, Entamoeba invadens
LCIGLLLLLLIFLRRRYRTT

SEQ ID NO: 2830807 - protein, 19 aa, Entamoeba invadens
LCLAGRICALYYYNTYLTK

SEQ ID NO: 2830808 - protein, 17 aa, Entamoeba invadens
LCLPMTFLAGLWGMNVR

SEQ ID NO: 2830809 - protein, 20 aa, Entamoeba invadens
LCTYGYYLDNNSCTRCAPGC

SEQ ID NO: 2830810 - protein, 17 aa, Entamoeba invadens
LCYDCLRGYYLYNNECY

SEQ ID NO: 2830811 - protein, 19 aa, Entamoeba invadens
LCYPIFFLFLVFYKDKKSK

SEQ ID NO: 2830812 - protein, 17 aa, Entamoeba invadens
LDGFYLVSGQCALCNNT

SEQ ID NO: 2830813 - protein, 19 aa, Entamoeba invadens
LDHMWFYLEIAEKCIIVFV

SEQ ID NO: 2830814 - protein, 17 aa, Entamoeba invadens
LDKKYMYVFFSSNGYNE

SEQ ID NO: 2830815 - protein, 19 aa, Entamoeba invadens
LDTFYMYPPIEFIVKNEEK

SEQ ID NO: 2830816 - protein, 22 aa, Entamoeba invadens
LDYHSMRTLIFLSITVFTAFSD

SEQ ID NO: 2830817 - protein, 17 aa, Entamoeba invadens
LECYLVIDYCQLCEYNN

SEQ ID NO: 2830818 - protein, 25 aa, Entamoeba invadens
LEDNKYFLKIGLPVIVIIIVLIIII

SEQ ID NO: 2830819 - protein, 19 aa, Entamoeba invadens
LEMATLFFLFIFSGTFKNS

SEQ ID NO: 2830820 - protein, 29 aa, Entamoeba invadens
LENINNWMFIFFLFLFSYALSTETPETRR

SEQ ID NO: 2830821 - protein, 17 aa, Entamoeba invadens
LEVLFVTFPLDFMGEYL

SEQ ID NO: 2830822 - protein, 17 aa, Entamoeba invadens
LEYGKCYWCYIKEHCVE

SEQ ID NO: 2830823 - protein, 28 aa, Entamoeba invadens
LFCALYILSFLIYFPLKLGQIFTALNER

SEQ ID NO: 2830824 - protein, 17 aa, Entamoeba invadens
LFFCYFTSLFLLPRFIN

SEQ ID NO: 2830825 - protein, 17 aa, Entamoeba invadens
LFFFIRTYSFTKLKVTF

SEQ ID NO: 2830826 - protein, 17 aa, Entamoeba invadens
LFFIVSTVNSADCFTKD

SEQ ID NO: 2830827 - protein, 17 aa, Entamoeba invadens
LFFYNYFRFSSANFTIK

SEQ ID NO: 2830828 - protein, 19 aa, Entamoeba invadens
LFHFPWDIATFIAKGGRRP

SEQ ID NO: 2830829 - protein, 24 aa, Entamoeba invadens
LFICGFFFVLLWPFAFIASRKSRN

SEQ ID NO: 2830830 - protein, 25 aa, Entamoeba invadens
LFICGFFFVLLWPFAFIASRKSRNQ

SEQ ID NO: 2830831 - protein, 25 aa, Entamoeba invadens
LFIVILLLVLLFFKSLMVPVRVVLT

SEQ ID NO: 2830832 - protein, 32 aa, Entamoeba invadens
LFLDLTIPVLFGLYLLKTGLRIGLYKKIVLYL

SEQ ID NO: 2830833 - protein, 19 aa, Entamoeba invadens
LFLFFIFSISKGSECPDSF

SEQ ID NO: 2830834 - protein, 19 aa, Entamoeba invadens
LFLFIIGVTKTFGVIDCGK

SEQ ID NO: 2830835 - protein, 18 aa, Entamoeba invadens
LFLLIYNSVLCQAIVAES

SEQ ID NO: 2830836 - protein, 17 aa, Entamoeba invadens
LFLVVVFTWASPTKLET

SEQ ID NO: 2830837 - protein, 18 aa, Entamoeba invadens
LFMFINLSLTINNCNYDE

SEQ ID NO: 2830838 - protein, 19 aa, Entamoeba invadens
LFMFINLSLTLNNCKYDEC

SEQ ID NO: 2830839 - protein, 18 aa, Entamoeba invadens
LFRYASVSDLLLLFTGIL

SEQ ID NO: 2830840 - protein, 20 aa, Entamoeba invadens
LFSCIWPYTKLILLFFTWTT

SEQ ID NO: 2830841 - protein, 17 aa, Entamoeba invadens
LFTIFTLLFFSSNLFHF

SEQ ID NO: 2830842 - protein, 21 aa, Entamoeba invadens
LFTLFMFGPLMYRLFYVLFLP

SEQ ID NO: 2830843 - protein, 17 aa, Entamoeba invadens
LFTTLIYCWFKAKKINI

SEQ ID NO: 2830844 - protein, 18 aa, Entamoeba invadens
LFVLIVFVILIISIIVVT

SEQ ID NO: 2830845 - protein, 18 aa, Entamoeba invadens
LFVLRFIILLLLNMYSAF

SEQ ID NO: 2830846 - protein, 17 aa, Entamoeba invadens
LFVVFFAHSQMVLTYCE

SEQ ID NO: 2830847 - protein, 17 aa, Entamoeba invadens
LFVVFMVTIFITLQILK

SEQ ID NO: 2830848 - protein, 17 aa, Entamoeba invadens
LGDDFFFYRPTPPDYYF

SEQ ID NO: 2830849 - protein, 17 aa, Entamoeba invadens
LGFLFVIPWLVGFIISR

SEQ ID NO: 2830850 - protein, 17 aa, Entamoeba invadens
LGFLFVVPWLAGFIISR

SEQ ID NO: 2830851 - protein, 19 aa, Entamoeba invadens
LGFYLPIIPNTNPVRYEPT

SEQ ID NO: 2830852 - protein, 17 aa, Entamoeba invadens
LGHFQLHIFFLRLVAEQ

SEQ ID NO: 2830853 - protein, 22 aa, Entamoeba invadens
LGITIWELFYQRYPFEEYYDAF

SEQ ID NO: 2830854 - protein, 19 aa, Entamoeba invadens
LGIVMVVIIILVILRKHQE

SEQ ID NO: 2830855 - protein, 25 aa, Entamoeba invadens
LGKFMRDLMRFWKLTFVVKLLEIVM

SEQ ID NO: 2830856 - protein, 17 aa, Entamoeba invadens
LGLFIYNNLLSNSLHLP

SEQ ID NO: 2830857 - protein, 18 aa, Entamoeba invadens
LGMIADTLLVIIYSSDMY

SEQ ID NO: 2830858 - protein, 20 aa, Entamoeba invadens
LGMWLWGQFFCQWKNVFYLF

SEQ ID NO: 2830859 - protein, 19 aa, Entamoeba invadens
LGPFWYTFGLAVMCGVLSI

SEQ ID NO: 2830860 - protein, 24 aa, Entamoeba invadens
LGSFLIIFIFVFRYKKIDINIYKT

SEQ ID NO: 2830861 - protein, 17 aa, Entamoeba invadens
LGVFVTFFRFALNLRNE

SEQ ID NO: 2830862 - protein, 20 aa, Entamoeba invadens
LGVRVLMMYVLQGLFHPARS

SEQ ID NO: 2830863 - protein, 23 aa, Entamoeba invadens
LHHNNFFFMVYPSKIGFYTVDLN

SEQ ID NO: 2830864 - protein, 22 aa, Entamoeba invadens
LHKPLIGIYKWGPSLAITQALN

SEQ ID NO: 2830865 - protein, 17 aa, Entamoeba invadens
LHVAFMIALMNWCGCCV

SEQ ID NO: 2830866 - protein, 18 aa, Entamoeba invadens
LIALFFLCFYWAGMFFIV

SEQ ID NO: 2830867 - protein, 21 aa, Entamoeba invadens
LIEIFFWGFYLSGSKLTQIST

SEQ ID NO: 2830868 - protein, 23 aa, Entamoeba invadens
LIFIVFAIIITSILIVYLTKLKH

SEQ ID NO: 2830869 - protein, 20 aa, Entamoeba invadens
LIFMFIFMSVSSLFILLDLN

SEQ ID NO: 2830870 - protein, 18 aa, Entamoeba invadens
LIGLAILTALLLGILYWF

SEQ ID NO: 2830871 - protein, 23 aa, Entamoeba invadens
LIGMWLYVWGITALLWICVWWQR

SEQ ID NO: 2830872 - protein, 18 aa, Entamoeba invadens
LIHIRRALMLFSHYPFLP

SEQ ID NO: 2830873 - protein, 34 aa, Entamoeba invadens
LIIALPVVLVFLLILLIISIIVVILVIIRKHQEV

SEQ ID NO: 2830874 - protein, 26 aa, Entamoeba invadens
LIIMIKHRLYRFLKRFIKSLCGLMLT

SEQ ID NO: 2830875 - protein, 17 aa, Entamoeba invadens
LIIPLTVLGVVLIIVFL

SEQ ID NO: 2830876 - protein, 25 aa, Entamoeba invadens
LIIVMLTWIILFLPGNKDILPVVIN

SEQ ID NO: 2830877 - protein, 17 aa, Entamoeba invadens
LILQFLVILSSSYPCTS

SEQ ID NO: 2830878 - protein, 27 aa, Entamoeba invadens
LILSIVLFLVLAYWLFMLSKQCYITEL

SEQ ID NO: 2830879 - protein, 27 aa, Entamoeba invadens
LILTITLLIIILFFILQRYNHKQQMQN

SEQ ID NO: 2830880 - protein, 27 aa, Entamoeba invadens
LILTVTLLIVILFYILQRYSRKQQMQN

SEQ ID NO: 2830881 - protein, 19 aa, Entamoeba invadens
LIMHLLFLIFFLDTNQYSS

SEQ ID NO: 2830882 - protein, 18 aa, Entamoeba invadens
LIRPLLFIIKTVLSSYEL

SEQ ID NO: 2830883 - protein, 20 aa, Entamoeba invadens
LISFERFVFIASISGILCFD

SEQ ID NO: 2830884 - protein, 20 aa, Entamoeba invadens
LISFIVIIIIITKSVFEKFQ

SEQ ID NO: 2830885 - protein, 26 aa, Entamoeba invadens
LISPVRRFFLWKFYLANKTSTFNFDT

SEQ ID NO: 2830886 - protein, 18 aa, Entamoeba invadens
LISYVRMPIRLQSYVFND

SEQ ID NO: 2830887 - protein, 27 aa, Entamoeba invadens
LIVIFGCIILLILITIIMSFVGLYIIQ

SEQ ID NO: 2830888 - protein, 26 aa, Entamoeba invadens
LIVIILIIFIILISWKMIHKNSATKN

SEQ ID NO: 2830889 - protein, 24 aa, Entamoeba invadens
LIVISIIVLIIYFTISKIQRKLRQ

SEQ ID NO: 2830890 - protein, 19 aa, Entamoeba invadens
LIVISIVVLIIYFIVSKIQ

SEQ ID NO: 2830891 - protein, 21 aa, Entamoeba invadens
LIVPLIKPLYLIESVLIVIAC

SEQ ID NO: 2830892 - protein, 22 aa, Entamoeba invadens
LIVVFTVFALVAFLLSHLTKKK

SEQ ID NO: 2830893 - protein, 20 aa, Entamoeba invadens
LIVVMISLIFLPYSKKFFDY

SEQ ID NO: 2830894 - protein, 20 aa, Entamoeba invadens
LIWANPFPKDKFKYPWSIAD

SEQ ID NO: 2830895 - protein, 27 aa, Entamoeba invadens
LIWNCRIIFVFFFFLTNQIKAINRIQK

SEQ ID NO: 2830896 - protein, 19 aa, Entamoeba invadens
LIWVCIVALLFLVIPNFHT

SEQ ID NO: 2830897 - protein, 17 aa, Entamoeba invadens
LKCTLVPAIFRNVDFYN

SEQ ID NO: 2830898 - protein, 18 aa, Entamoeba invadens
LKDSFILPTPRLLRYCKD

SEQ ID NO: 2830899 - protein, 18 aa, Entamoeba invadens
LKELISSIFLPWFNTMKY

SEQ ID NO: 2830900 - protein, 31 aa, Entamoeba invadens
LKERRTLWFLWAFWLFFYSAMCLIVFGVLKY

SEQ ID NO: 2830901 - protein, 24 aa, Entamoeba invadens
LKHSWLPFEILKKSISQIGADQSF

SEQ ID NO: 2830902 - protein, 23 aa, Entamoeba invadens
LKKEFFRIIVWFNVEFETVDRNK

SEQ ID NO: 2830903 - protein, 23 aa, Entamoeba invadens
LKLLPLFLFTLFIQTVSTTPKFL

SEQ ID NO: 2830904 - protein, 21 aa, Entamoeba invadens
LKPKFLPLVPLLFLNDDKAET

SEQ ID NO: 2830905 - protein, 24 aa, Entamoeba invadens
LKTSFLNFFIVSFSFCCLACWCVF

SEQ ID NO: 2830906 - protein, 24 aa, Entamoeba invadens
LKVPKRNILKWAPILSFVGAANNF

SEQ ID NO: 2830907 - protein, 19 aa, Entamoeba invadens
LLAIFMTTFSIFLLVMCFT

SEQ ID NO: 2830908 - protein, 19 aa, Entamoeba invadens
LLCFLISFQLFFHKETLFY

SEQ ID NO: 2830909 - protein, 18 aa, Entamoeba invadens
LLFFYFTFYFFVIKYFAL

SEQ ID NO: 2830910 - protein, 29 aa, Entamoeba invadens
LLFLIVCIILLVLITYWALIPIGVCLLFV

SEQ ID NO: 2830911 - protein, 18 aa, Entamoeba invadens
LLFLLYVKSEVVCSPKTN

SEQ ID NO: 2830912 - protein, 17 aa, Entamoeba invadens
LLFSLFFIVVTSQDQNH

SEQ ID NO: 2830913 - protein, 20 aa, Entamoeba invadens
LLFTCFLIVLLAFLAGLCLL

SEQ ID NO: 2830914 - protein, 23 aa, Entamoeba invadens
LLFTFLVIILYLFIQQAILYTDW

SEQ ID NO: 2830915 - protein, 20 aa, Entamoeba invadens
LLFTLFVVGFVLFQSRFKCS

SEQ ID NO: 2830916 - protein, 30 aa, Entamoeba invadens
LLGFFVWKMLLFLFFILYEASYVLVYKGFK

SEQ ID NO: 2830917 - protein, 21 aa, Entamoeba invadens
LLGILFFVLLIFFLPCSFIYA

SEQ ID NO: 2830918 - protein, 19 aa, Entamoeba invadens
LLGSFALFLAIRKWRQKKI

SEQ ID NO: 2830919 - protein, 21 aa, Entamoeba invadens
LLIACALIVIVLVLFLIIYIK

SEQ ID NO: 2830920 - protein, 17 aa, Entamoeba invadens
LLIFLRRRYRTTPSFPC

SEQ ID NO: 2830921 - protein, 17 aa, Entamoeba invadens
LLIFSVNSSTTKLAEDA

SEQ ID NO: 2830922 - protein, 17 aa, Entamoeba invadens
LLIVGYFINRIVFRIKM

SEQ ID NO: 2830923 - protein, 31 aa, Entamoeba invadens
LLIVIFGCIILLLFFTIIMILVGLYIIQTHH

SEQ ID NO: 2830924 - protein, 17 aa, Entamoeba invadens
LLIYCEIPTILNVIFEG

SEQ ID NO: 2830925 - protein, 24 aa, Entamoeba invadens
LLKCAVNLSFLFIAVVYQRNMFGV

SEQ ID NO: 2830926 - protein, 25 aa, Entamoeba invadens
LLLEGWWLFIIIIGVIIVSLVWYLA

SEQ ID NO: 2830927 - protein, 17 aa, Entamoeba invadens
LLLFDFSYGYLTSSRLS

SEQ ID NO: 2830928 - protein, 20 aa, Entamoeba invadens
LLLFFIIMTVFIILITQKER

SEQ ID NO: 2830929 - protein, 17 aa, Entamoeba invadens
LLLFSPILTFAGRSTWC

SEQ ID NO: 2830930 - protein, 19 aa, Entamoeba invadens
LLLILLTTKTNAAISCSSG

SEQ ID NO: 2830931 - protein, 19 aa, Entamoeba invadens
LLLILLTTKTNAATSCSSG

SEQ ID NO: 2830932 - protein, 20 aa, Entamoeba invadens
LLLLLRLFFLLIPPISITEY

SEQ ID NO: 2830933 - protein, 18 aa, Entamoeba invadens
LLLVLFTSVQSGVIVDMG

SEQ ID NO: 2830934 - protein, 17 aa, Entamoeba invadens
LLMLFTLVYSFQCSPGC

SEQ ID NO: 2830935 - protein, 19 aa, Entamoeba invadens
LLNGICIPCDSTCKPNTCD

SEQ ID NO: 2830936 - protein, 19 aa, Entamoeba invadens
LLNHLFYTQFRILNESLGR

SEQ ID NO: 2830937 - protein, 22 aa, Entamoeba invadens
LLQFLMMFVYLFLIVFASGNIL

SEQ ID NO: 2830938 - protein, 24 aa, Entamoeba invadens
LLQKRLLFHIIYKCYIDVIVINAE

SEQ ID NO: 2830939 - protein, 22 aa, Entamoeba invadens
LLQSLNLFFLFPETIKKVKQSL

SEQ ID NO: 2830940 - protein, 18 aa, Entamoeba invadens
LLSFSWFLFTLSAALMLG

SEQ ID NO: 2830941 - protein, 17 aa, Entamoeba invadens
LLSILCLLTMGWMFYSE

SEQ ID NO: 2830942 - protein, 22 aa, Entamoeba invadens
LLTLMYPFIWQGVLIPFVPVAL

SEQ ID NO: 2830943 - protein, 17 aa, Entamoeba invadens
LLVFSSSIQWCWSNDVV

SEQ ID NO: 2830944 - protein, 18 aa, Entamoeba invadens
LLVIFFLLLFVQTMFFVL

SEQ ID NO: 2830945 - protein, 25 aa, Entamoeba invadens
LLVNKDLILFPFFNFTRTKELQYPI

SEQ ID NO: 2830946 - protein, 20 aa, Entamoeba invadens
LLYFYLYFSNGSPVSLVSSD

SEQ ID NO: 2830947 - protein, 22 aa, Entamoeba invadens
LLYGLVLMFFFLQAVVEFRKIY

SEQ ID NO: 2830948 - protein, 25 aa, Entamoeba invadens
LMAFVLYLVLILLKKKLDVGTVFAC

SEQ ID NO: 2830949 - protein, 19 aa, Entamoeba invadens
LMDYGWQTSFFPLPDFFNS

SEQ ID NO: 2830950 - protein, 17 aa, Entamoeba invadens
  misc_feature (6)..(7): Xaa can be any naturally occurring amino acid
LMFGWXXLNCAVVIAQF

SEQ ID NO: 2830951 - protein, 18 aa, Entamoeba invadens
LMIIFHTPNNPKFIFHFD

SEQ ID NO: 2830952 - protein, 31 aa, Entamoeba invadens
LMLPVMALGLFWFFYVFKIYMKYAKQLLRLD

SEQ ID NO: 2830953 - protein, 18 aa, Entamoeba invadens
LMPLYKMEFFKLLEQQRG

SEQ ID NO: 2830954 - protein, 17 aa, Entamoeba invadens
LMRISFLETFRWNFKFT

SEQ ID NO: 2830955 - protein, 21 aa, Entamoeba invadens
LMTKLIYWISGMSFVPMVLVD

SEQ ID NO: 2830956 - protein, 18 aa, Entamoeba invadens
LNCLQCEPGWYLIGQNCY

SEQ ID NO: 2830957 - protein, 24 aa, Entamoeba invadens
LNFSVYFFWLIVPIMMRNLGASPL

SEQ ID NO: 2830958 - protein, 34 aa, Entamoeba invadens
LNGLPISFYLERIFALYIPLYIKCTVAIVSREST

SEQ ID NO: 2830959 - protein, 27 aa, Entamoeba invadens
LNHPLLAFLILPFYTPSLDFIEAVQYS

SEQ ID NO: 2830960 - protein, 19 aa, Entamoeba invadens
LNIISFIFRLFRAKGYKRF

SEQ ID NO: 2830961 - protein, 19 aa, Entamoeba invadens
LNINFWEFNCRHIKLSEVV

SEQ ID NO: 2830962 - protein, 17 aa, Entamoeba invadens
LNLFFLFPETIKNVKQS

SEQ ID NO: 2830963 - protein, 24 aa, Entamoeba invadens
LNSIRWVWTLVGYAIIGGVFAGLV

SEQ ID NO: 2830964 - protein, 19 aa, Entamoeba invadens
LNSLLVMYLIGVGQNRVFA

SEQ ID NO: 2830965 - protein, 23 aa, Entamoeba invadens
LNTLPFLFDLVFSSTFGGSYKIS

SEQ ID NO: 2830966 - protein, 26 aa, Entamoeba invadens
LNVSKLFKLFILPMSQNIIISATKSL

SEQ ID NO: 2830967 - protein, 24 aa, Entamoeba invadens
LNVTQWFSIIFKTNRKYILNGIDV

SEQ ID NO: 2830968 - protein, 17 aa, Entamoeba invadens
LNYDMVFSMLYFPEIQT

SEQ ID NO: 2830969 - protein, 19 aa, Entamoeba invadens
LPIVFPSMYFLMCASVVLS

SEQ ID NO: 2830970 - protein, 34 aa, Entamoeba invadens
LPLIATLFIIFFVVFIILLVLFLREKNHKNQLEK

SEQ ID NO: 2830971 - protein, 18 aa, Entamoeba invadens
LPLIHDILPFGFYVKVGG

SEQ ID NO: 2830972 - protein, 25 aa, Entamoeba invadens
LPTTIALGIFILPTSVANPPGAYNC

SEQ ID NO: 2830973 - protein, 30 aa, Entamoeba invadens
LPVVLTLLFLVFLSVVIYTIFYLFNKKQKK

SEQ ID NO: 2830974 - protein, 24 aa, Entamoeba invadens
LQILFLFYTIVVFFPFNGVYVPIE

SEQ ID NO: 2830975 - protein, 20 aa, Entamoeba invadens
LQLILFVLHGWVIYNPNLKE

SEQ ID NO: 2830976 - protein, 30 aa, Entamoeba invadens
LQRIKYMRMFFFIIFFWSTSSQVLCSSGCS

SEQ ID NO: 2830977 - protein, 23 aa, Entamoeba invadens
LQTSFFNFFIVSFSFCCLACWCI

SEQ ID NO: 2830978 - protein, 20 aa, Entamoeba invadens
LRIRIQLYKAFYKFAAVYIR

SEQ ID NO: 2830979 - protein, 19 aa, Entamoeba invadens
LRQLPRFMFVQCVVLTIVF

SEQ ID NO: 2830980 - protein, 28 aa, Entamoeba invadens
LRTMLRRILRMFLYFHPHGYFQGLNDIV

SEQ ID NO: 2830981 - protein, 17 aa, Entamoeba invadens
LRVMFRLNAKPMLIAVL

SEQ ID NO: 2830982 - protein, 25 aa, Entamoeba invadens
LSEDDGILFLRKDPPQFSTFDADRG

SEQ ID NO: 2830983 - protein, 25 aa, Entamoeba invadens
LSFVLYFLYLYFRNKKKMQNVCVFD

SEQ ID NO: 2830984 - protein, 23 aa, Entamoeba invadens
LSIFILICIVFVTYFIVQKTIKL

SEQ ID NO: 2830985 - protein, 30 aa, Entamoeba invadens
LSIIGVFLFFMFLIFITAFIIFKNISAKKA

SEQ ID NO: 2830986 - protein, 29 aa, Entamoeba invadens
LSIILPIIFCILIVVIIIITISCILFYIH

SEQ ID NO: 2830987 - protein, 24 aa, Entamoeba invadens
LSIISGLAVLFIIVAVIVCIVVTV

SEQ ID NO: 2830988 - protein, 21 aa, Entamoeba invadens
LSILFVVVLLTLLAVFILKNI

SEQ ID NO: 2830989 - protein, 18 aa, Entamoeba invadens
LSIQGFFCFPMVDYIFFG

SEQ ID NO: 2830990 - protein, 26 aa, Entamoeba invadens
LSIVVLIVVFVVIGWLIWAVSKKISE

SEQ ID NO: 2830991 - protein, 20 aa, Entamoeba invadens
LSIYGIITLYKFCYCSLKKM

SEQ ID NO: 2830992 - protein, 20 aa, Entamoeba invadens
LSLIWLFYLVQWSACAGLLV

SEQ ID NO: 2830993 - protein, 17 aa, Entamoeba invadens
LSLSLALQWCWERGVIQ

SEQ ID NO: 2830994 - protein, 17 aa, Entamoeba invadens
LSPFLMCMFSVLVMLVF

SEQ ID NO: 2830995 - protein, 22 aa, Entamoeba invadens
LSPLIFVLFLIIALLTSIPPHA

SEQ ID NO: 2830996 - protein, 25 aa, Entamoeba invadens
LSRDSRILYMRKLFKIILNAPVKIN

SEQ ID NO: 2830997 - protein, 24 aa, Entamoeba invadens
LSVTFVIIVFIVAIIVIVISMIQK

SEQ ID NO: 2830998 - protein, 24 aa, Entamoeba invadens
LSVTFVMIVFIVAIIMIIISMIQK

SEQ ID NO: 2830999 - protein, 42 aa, Entamoeba invadens
LTEFVLILVVCLLFVVLIIMTILFVIVYFTRPRQRSLKNYIF

SEQ ID NO: 2831000 - protein, 31 aa, Entamoeba invadens
LTEGYIFLVVFFLLSWYYQPGYYIPYLFACV

SEQ ID NO: 2831001 - protein, 17 aa, Entamoeba invadens
LTELKEGLEKQNEENLK

SEQ ID NO: 2831002 - protein, 20 aa, Entamoeba invadens
LTGIYCKSGYYYNKTLFDCV

SEQ ID NO: 2831003 - protein, 23 aa, Entamoeba invadens
LTKTLLVIFLGCVLVLIITSIVV

SEQ ID NO: 2831004 - protein, 30 aa, Entamoeba invadens
LTLYILVPGVLLYTLLYIIVLIVGWSEHKR

SEQ ID NO: 2831005 - protein, 17 aa, Entamoeba invadens
LTNFLFWGVGSISYFIL

SEQ ID NO: 2831006 - protein, 24 aa, Entamoeba invadens
LTNPLLFILCLIIGGFGFTAYKLG

SEQ ID NO: 2831007 - protein, 19 aa, Entamoeba invadens
LTQFFSKCKNWFFAGEILI

SEQ ID NO: 2831008 - protein, 19 aa, Entamoeba invadens
LTRILLITLIYYSPTCVAS

SEQ ID NO: 2831009 - protein, 17 aa, Entamoeba invadens
LTRYILLFSYFPINETI

SEQ ID NO: 2831010 - protein, 19 aa, Entamoeba invadens
LTVPLFTPLLIPKVNMKPS

SEQ ID NO: 2831011 - protein, 23 aa, Entamoeba invadens
LVACFCLWIFLLKGQSLTQMEQL

SEQ ID NO: 2831012 - protein, 25 aa, Entamoeba invadens
LVAMMPFIMIILFFLEFGVSKLTQK

SEQ ID NO: 2831013 - protein, 17 aa, Entamoeba invadens
LVEPLKYDKLMKTSKVV

SEQ ID NO: 2831014 - protein, 18 aa, Entamoeba invadens
LVICKYYFDIYDNTTFTL

SEQ ID NO: 2831015 - protein, 23 aa, Entamoeba invadens
LVIISIIVLIIILFRMHHKKTKE

SEQ ID NO: 2831016 - protein, 24 aa, Entamoeba invadens
LVIVFIVIFIIIVVVIISAIIWKK

SEQ ID NO: 2831017 - protein, 35 aa, Entamoeba invadens
LVIVLPIMCIVVILFIIILLITIILIIFNKKKENI

SEQ ID NO: 2831018 - protein, 25 aa, Entamoeba invadens
LVKNTLFFFYCYFSVKVTTFPQFVE

SEQ ID NO: 2831019 - protein, 27 aa, Entamoeba invadens
LVLAVIVVLLIVYMVHVYIVRRKNMKV

SEQ ID NO: 2831020 - protein, 17 aa, Entamoeba invadens
LVLFCYIIKPDYSIWKE

SEQ ID NO: 2831021 - protein, 17 aa, Entamoeba invadens
LVLFSTLLRAQDVAPIE

SEQ ID NO: 2831022 - protein, 20 aa, Entamoeba invadens
LVLFVVFVVTIFITLKIVKR

SEQ ID NO: 2831023 - protein, 19 aa, Entamoeba invadens
LVLIACVLCLFVVALLVTW

SEQ ID NO: 2831024 - protein, 22 aa, Entamoeba invadens
LVLIVIVVIFIFVIRIVTKNKR

SEQ ID NO: 2831025 - protein, 27 aa, Entamoeba invadens
LVLVTFVIFSVFIFVFYIMRVHRKEKN

SEQ ID NO: 2831026 - protein, 18 aa, Entamoeba invadens
LVLYFLPNVGFFSSFFGV

SEQ ID NO: 2831027 - protein, 23 aa, Entamoeba invadens
LVMQFFMLGYIDALVYLLEINPT

SEQ ID NO: 2831028 - protein, 24 aa, Entamoeba invadens
LVNWALLMYIYYIHTMAAIKVRVP

SEQ ID NO: 2831029 - protein, 19 aa, Entamoeba invadens
LVQIATVMYFRFSPVLKTS

SEQ ID NO: 2831030 - protein, 23 aa, Entamoeba invadens
LVSLFCITLIFVRVFFSLPGFCI

SEQ ID NO: 2831031 - protein, 30 aa, Entamoeba invadens
LVVIISIFFVILVIVLYFLLTFISKKVLKV

SEQ ID NO: 2831032 - protein, 22 aa, Entamoeba invadens
LVVPAYYPFFLDLLEKGQNLST

SEQ ID NO: 2831033 - protein, 27 aa, Entamoeba invadens
LVVVGLILIIIIIAVIIFFVWRRKRQT

SEQ ID NO: 2831034 - protein, 32 aa, Entamoeba invadens
LVVVLLVVLTLLFLVFLFVVTYTNFYLFNKKQ

SEQ ID NO: 2831035 - protein, 20 aa, Entamoeba invadens
LVYMHLYIRLMRKIFKHSPK

SEQ ID NO: 2831036 - protein, 17 aa, Entamoeba invadens
LWLLQNFFLHVHHNYSC

SEQ ID NO: 2831037 - protein, 19 aa, Entamoeba invadens
LWVRHLPIAFLMRQHLFLL

SEQ ID NO: 2831038 - protein, 17 aa, Entamoeba invadens
LYAFFFSGILLGAIPEI

SEQ ID NO: 2831039 - protein, 20 aa, Entamoeba invadens
LYECLSWSLAYQPPQFKFPW

SEQ ID NO: 2831040 - protein, 19 aa, Entamoeba invadens
LYETFKWGYAYDPEKIKSW

SEQ ID NO: 2831041 - protein, 20 aa, Entamoeba invadens
LYFIFSIMVLPFLPTCPLHV

SEQ ID NO: 2831042 - protein, 19 aa, Entamoeba invadens
LYILLFFYMLNLPNTRLGK

SEQ ID NO: 2831043 - protein, 18 aa, Entamoeba invadens
LYLALLFRFHVFISTPEM

SEQ ID NO: 2831044 - protein, 18 aa, Entamoeba invadens
LYMKAVFFTLTLNSTYSV

SEQ ID NO: 2831045 - protein, 23 aa, Entamoeba invadens
LYNNWFDICLLFACLLFGTLIID

SEQ ID NO: 2831046 - protein, 20 aa, Entamoeba invadens
LYWKPLFIEELFFNTPITFN

SEQ ID NO: 2831047 - protein, 21 aa, Entamoeba invadens
LYYIFFFVYAQAQMCPFQNTI

SEQ ID NO: 2831048 - protein, 26 aa, Entamoeba invadens
LYYSSYIFFIFLSLSLIMGKGVITLV

SEQ ID NO: 2831049 - protein, 24 aa, Entamoeba invadens
MAFILYLVFILRKDKLEVGTVFAT

SEQ ID NO: 2831050 - protein, 21 aa, Entamoeba invadens
MATLFFLFIGLFKSSVLIEND

SEQ ID NO: 2831051 - protein, 23 aa, Entamoeba invadens
MATYFCWLILPYLIKEQGGSSFM

SEQ ID NO: 2831052 - protein, 25 aa, Entamoeba invadens
MCMSIVGYYYFWWLDAVGGIVLSFY

SEQ ID NO: 2831053 - protein, 19 aa, Entamoeba invadens
MCWRKWKLYIIGGSIAAIV

SEQ ID NO: 2831054 - protein, 24 aa, Entamoeba invadens
MDSFPFPHYILLNNLNELPNVLAE

SEQ ID NO: 2831055 - protein, 23 aa, Entamoeba invadens
MDYRFLLFPCILDSHWFLIIVCN

SEQ ID NO: 2831056 - protein, 17 aa, Entamoeba invadens
MEIFPNFKFWYGLPRLV

SEQ ID NO: 2831057 - protein, 17 aa, Entamoeba invadens
MFALSLDWCWEGDVLQC

SEQ ID NO: 2831058 - protein, 19 aa, Entamoeba invadens
MFEIFIWGEAYPGDRFKYP

SEQ ID NO: 2831059 - protein, 18 aa, Entamoeba invadens
MFEILIWGEAYPGDRFKY

SEQ ID NO: 2831060 - protein, 18 aa, Entamoeba invadens
MFEIVKWGPAFPKGKFKH

SEQ ID NO: 2831061 - protein, 18 aa, Entamoeba invadens
MFETIFWKEAFPKSEFKY

SEQ ID NO: 2831062 - protein, 19 aa, Entamoeba invadens
MFIPPLVTIFRQKPMYRNQ

SEQ ID NO: 2831063 - protein, 18 aa, Entamoeba invadens
MFLHLPATLTTLGEDWIK

SEQ ID NO: 2831064 - protein, 23 aa, Entamoeba invadens
MFLKMTFMRLFSLPYKLSALQQT

SEQ ID NO: 2831065 - protein, 19 aa, Entamoeba invadens
MFSLAHILLLLYFGEQTTE

SEQ ID NO: 2831066 - protein, 32 aa, Entamoeba invadens
MFSNLFFFSIFNGIFFPFYLKTGSLAFTKCEG

SEQ ID NO: 2831067 - protein, 18 aa, Entamoeba invadens
MFVWCCLDFEWIYSFVLL

SEQ ID NO: 2831068 - protein, 21 aa, Entamoeba invadens
MGIVGFFLWNIATIVYFLITW

SEQ ID NO: 2831069 - protein, 25 aa, Entamoeba invadens
MGSHLHILALLKFSLWWPKQKVRIH

SEQ ID NO: 2831070 - protein, 17 aa, Entamoeba invadens
MHLRIKFILDASKGILY

SEQ ID NO: 2831071 - protein, 19 aa, Entamoeba invadens
MIFTFSSKRWYFLFVGIHE

SEQ ID NO: 2831072 - protein, 19 aa, Entamoeba invadens
MISFFFYVGLFMAAGEKMI

SEQ ID NO: 2831073 - protein, 28 aa, Entamoeba invadens
MKCDASPVWWVILLAVLAGLFVVLLVVL

SEQ ID NO: 2831074 - protein, 27 aa, Entamoeba invadens
MLCFVTNTLLLILLTTKTNAATSCSSG

SEQ ID NO: 2831075 - protein, 19 aa, Entamoeba invadens
MLECFLWSNAYPKSIYMYP

SEQ ID NO: 2831076 - protein, 21 aa, Entamoeba invadens
MLEVLMWGPIYTKQAFKFPWN

SEQ ID NO: 2831077 - protein, 22 aa, Entamoeba invadens
MLKYNVLSYWKKGAILILNSKE

SEQ ID NO: 2831078 - protein, 18 aa, Entamoeba invadens
MMCLVDYFVIIGVPIIVT

SEQ ID NO: 2831079 - protein, 17 aa, Entamoeba invadens
MMFLLKFPEYQPTLIQI

SEQ ID NO: 2831080 - protein, 19 aa, Entamoeba invadens
MPIALLCVFLLLAEALFLN

SEQ ID NO: 2831081 - protein, 20 aa, Entamoeba invadens
MRRKFVRRPFWLNRILRMRG

SEQ ID NO: 2831082 - protein, 22 aa, Entamoeba invadens
MRWGLLYLLPLIFTVFSAQVYT

SEQ ID NO: 2831083 - protein, 28 aa, Entamoeba invadens
MSGVYIVLFFFISTFLYFLHSSSFIKWN

SEQ ID NO: 2831084 - protein, 22 aa, Entamoeba invadens
MSKNFMFLVFQDGLFRYYVNSK

SEQ ID NO: 2831085 - protein, 29 aa, Entamoeba invadens
MSLPLLKPHRRCALLYALSYFKKTKMCGE

SEQ ID NO: 2831086 - protein, 32 aa, Entamoeba invadens
MSVMYITLPFLWIYMMILSGGLWYSAMRKGNK

SEQ ID NO: 2831087 - protein, 24 aa, Entamoeba invadens
MSYYVERLFSLYLPIMVGYQVYVS

SEQ ID NO: 2831088 - protein, 19 aa, Entamoeba invadens
MTAATIWFFQKYKIKFAIV

SEQ ID NO: 2831089 - protein, 17 aa, Entamoeba invadens
MTLFIIVIVILTTSFLV

SEQ ID NO: 2831090 - protein, 23 aa, Entamoeba invadens
MTVTFVIIVFIVAIIMVIISMIQ

SEQ ID NO: 2831091 - protein, 17 aa, Entamoeba invadens
MVGWYNIFSLLFIVLFA

SEQ ID NO: 2831092 - protein, 25 aa, Entamoeba invadens
MVHCWSLLIFLIFGCIAYDSWCEFE

SEQ ID NO: 2831093 - protein, 18 aa, Entamoeba invadens
MVHMICMLVLWLVPMTRR

SEQ ID NO: 2831094 - protein, 24 aa, Entamoeba invadens
MWLNAIILTLLFLFSFGFVGYQMN

SEQ ID NO: 2831095 - protein, 26 aa, Entamoeba invadens
MYEMFIWGDIFPKNEFKFAWIIADFV

SEQ ID NO: 2831096 - protein, 22 aa, Entamoeba invadens
MYIGIVFFFYFLAQTVVMVGMS

SEQ ID NO: 2831097 - protein, 23 aa, Entamoeba invadens
NANPFFFLCLRIRPTIFLGVPRV

SEQ ID NO: 2831098 - protein, 21 aa, Entamoeba invadens
NAPYIFVFVIGGITLGEISML

SEQ ID NO: 2831099 - protein, 21 aa, Entamoeba invadens
NASLLKFLFYTIHSFRFNDEL

SEQ ID NO: 2831100 - protein, 25 aa, Entamoeba invadens
NAVTKLIFNKFYLNKDFTIPEKTQV

SEQ ID NO: 2831101 - protein, 18 aa, Entamoeba invadens
NAYKMFLNYINNGQYQVT

SEQ ID NO: 2831102 - protein, 28 aa, Entamoeba invadens
NCKSHVVWWVILLLTIVAVVILIVTILI

SEQ ID NO: 2831103 - protein, 29 aa, Entamoeba invadens
NCRSKPIAWWVWLLVTLLVIIAFIILVGI

SEQ ID NO: 2831104 - protein, 17 aa, Entamoeba invadens
NCSYAFSSYLRFWDISV

SEQ ID NO: 2831105 - protein, 21 aa, Entamoeba invadens
NDFIWTFRLFTTPRDLLSEFF

SEQ ID NO: 2831106 - protein, 26 aa, Entamoeba invadens
NDIECLYMIFFFILKNLEDNLLDQWL

SEQ ID NO: 2831107 - protein, 23 aa, Entamoeba invadens
NDQYFYNFIILDNTTLYFTINNY

SEQ ID NO: 2831108 - protein, 24 aa, Entamoeba invadens
NEITHYYFAFLIGTFGYFFKKKKL

SEQ ID NO: 2831109 - protein, 24 aa, Entamoeba invadens
NEPVVIYYVPLLQILGLTTIFATE

SEQ ID NO: 2831110 - protein, 26 aa, Entamoeba invadens
NEWNTLVFWETIMNYLKPNSINKENL

SEQ ID NO: 2831111 - protein, 23 aa, Entamoeba invadens
NFLPLQFMMMFLSIFAVKHKLIN

SEQ ID NO: 2831112 - protein, 17 aa, Entamoeba invadens
NFMHLVGIYYYGKYKPD

SEQ ID NO: 2831113 - protein, 23 aa, Entamoeba invadens
NFSVYFFWLIIPIMMRDLGASPM

SEQ ID NO: 2831114 - protein, 17 aa, Entamoeba invadens
NGQFLIYYETTLIWIQI

SEQ ID NO: 2831115 - protein, 23 aa, Entamoeba invadens
NGVALLALLLYYIFKVHKKQVQL

SEQ ID NO: 2831116 - protein, 25 aa, Entamoeba invadens
NGVDIFYYLAMQPWRHFVWTQKENN

SEQ ID NO: 2831117 - protein, 27 aa, Entamoeba invadens
NGYDIYYYLAMQPWRHFVWTYNDNGVW

SEQ ID NO: 2831118 - protein, 22 aa, Entamoeba invadens
NHDFIELIPPLSFLAIGQHAEL

SEQ ID NO: 2831119 - protein, 23 aa, Entamoeba invadens
NIAVMLFPIVWYAIDEKNYFERI

SEQ ID NO: 2831120 - protein, 19 aa, Entamoeba invadens
NIILPMFFMGHSMGGLLTS

SEQ ID NO: 2831121 - protein, 17 aa, Entamoeba invadens
NILLMRLNMIYNSFSNL

SEQ ID NO: 2831122 - protein, 20 aa, Entamoeba invadens
NIMIIIMLYVIYLVNSYEFN

SEQ ID NO: 2831123 - protein, 20 aa, Entamoeba invadens
NINIFSLFLKLKIRQKQKTP

SEQ ID NO: 2831124 - protein, 21 aa, Entamoeba invadens
NIPLWWVILLIIITDIIFITF

SEQ ID NO: 2831125 - protein, 21 aa, Entamoeba invadens
NIQTIILLLKILLELSDEMKD

SEQ ID NO: 2831126 - protein, 24 aa, Entamoeba invadens
NKFRCQYIVYFYGAVLIKSRMCLV

SEQ ID NO: 2831127 - protein, 18 aa, Entamoeba invadens
NKKIFVINILYDIALELG

SEQ ID NO: 2831128 - protein, 29 aa, Entamoeba invadens
NKKVVWWVILIVIILILIVISIVVLIIYF

SEQ ID NO: 2831129 - protein, 24 aa, Entamoeba invadens
NKNNYFIDNIYYLLPFTFDIDENK

SEQ ID NO: 2831130 - protein, 17 aa, Entamoeba invadens
NKYYPFWLTIFPEGTRV

SEQ ID NO: 2831131 - protein, 21 aa, Entamoeba invadens
NLALIIPLVVVGLILIIIIIA

SEQ ID NO: 2831132 - protein, 17 aa, Entamoeba invadens
NLCAFLILGLFVILIGL

SEQ ID NO: 2831133 - protein, 18 aa, Entamoeba invadens
NLDIYKWYTIYSNNPMMW

SEQ ID NO: 2831134 - protein, 26 aa, Entamoeba invadens
NLEIPFLVYLLCIWAFYFIDSELTGM

SEQ ID NO: 2831135 - protein, 22 aa, Entamoeba invadens
NLFIFIFLIISVSFLLTSGLTN

SEQ ID NO: 2831136 - protein, 19 aa, Entamoeba invadens
NLKMKLICWTNFEMNILST

SEQ ID NO: 2831137 - protein, 20 aa, Entamoeba invadens
NLPPGFLFLFGVRANVWAPT

SEQ ID NO: 2831138 - protein, 27 aa, Entamoeba invadens
NLPYLLRFDFLAILRDFDFLFQKDCPK

SEQ ID NO: 2831139 - protein, 25 aa, Entamoeba invadens
NLTKTLLIIFLGCVLVLIITSIVVS

SEQ ID NO: 2831140 - protein, 18 aa, Entamoeba invadens
NMCVGCETGYYPYLGKCE

SEQ ID NO: 2831141 - protein, 21 aa, Entamoeba invadens
NMLILILSLLLTLTTSRWCLV

SEQ ID NO: 2831142 - protein, 18 aa, Entamoeba invadens
NMLIPLDNPIMGKFVVDT

SEQ ID NO: 2831143 - protein, 24 aa, Entamoeba invadens
NMSTYFFWLVVPLLLQDRKANSFE

SEQ ID NO: 2831144 - protein, 34 aa, Entamoeba invadens
NMTKILLIVIFGCIFLLIIFTIPMSFVGLYIIQR

SEQ ID NO: 2831145 - protein, 23 aa, Entamoeba invadens
NNDPIVIFFPMNAGGFIGAEDFL

SEQ ID NO: 2831146 - protein, 22 aa, Entamoeba invadens
NNEWVFLNFFKAKVVVLEQLDA

SEQ ID NO: 2831147 - protein, 17 aa, Entamoeba invadens
NNFLFYDFIVNCYFLAT

SEQ ID NO: 2831148 - protein, 20 aa, Entamoeba invadens
NNICIQCVYPYILVGGTCIK

SEQ ID NO: 2831149 - protein, 21 aa, Entamoeba invadens
NNPFMVPLLQKICEFSLSEQF

SEQ ID NO: 2831150 - protein, 24 aa, Entamoeba invadens
NNVDKKWWFYDPNGYPYFMIGANA

SEQ ID NO: 2831151 - protein, 24 aa, Entamoeba invadens
NNVDKKWWFYDPNGYPYFMIGANS

SEQ ID NO: 2831152 - protein, 23 aa, Entamoeba invadens
NNYKYFIQFLLYTDLALVVSVTV

SEQ ID NO: 2831153 - protein, 17 aa, Entamoeba invadens
NNYLLLFIIIIIYINTN

SEQ ID NO: 2831154 - protein, 23 aa, Entamoeba invadens
NPAWALWSLLVVALLWALPQSMT

SEQ ID NO: 2831155 - protein, 26 aa, Entamoeba invadens
NPHFQICLFKINLLNYLKLLKYKKKH

SEQ ID NO: 2831156 - protein, 20 aa, Entamoeba invadens
NPWMVPFIQLVCAFAIYPEF

SEQ ID NO: 2831157 - protein, 25 aa, Entamoeba invadens
NQEKRYYFCLPIYTLNINNCKRVLI

SEQ ID NO: 2831158 - protein, 21 aa, Entamoeba invadens
NQLKTEMWWKNVKLWIILGVV

SEQ ID NO: 2831159 - protein, 25 aa, Entamoeba invadens
NQTNIMILLLLFIRFVFPYCGNGCL

SEQ ID NO: 2831160 - protein, 22 aa, Entamoeba invadens
NQYPNWLIAVISICVILFCVFI

SEQ ID NO: 2831161 - protein, 19 aa, Entamoeba invadens
NQYYPYYGAFIIYVTVKNS

SEQ ID NO: 2831162 - protein, 17 aa, Entamoeba invadens
NRFILGILFFINEVFLQ

SEQ ID NO: 2831163 - protein, 25 aa, Entamoeba invadens
NSAWKLWDFPIFYTTASVDYFASEG

SEQ ID NO: 2831164 - protein, 26 aa, Entamoeba invadens
NSGNFFLFFFTLFFFVLRCGCRVCYN

SEQ ID NO: 2831165 - protein, 22 aa, Entamoeba invadens
NSTAIRWFLPLLSLSMKMSSIY

SEQ ID NO: 2831166 - protein, 25 aa, Entamoeba invadens
NTDETFLYFPLINVLIQPINLVIDG

SEQ ID NO: 2831167 - protein, 25 aa, Entamoeba invadens
NTDKKVTFFYVKLPLLFSSEISPFL

SEQ ID NO: 2831168 - protein, 22 aa, Entamoeba invadens
NTFFFFYLLLIISEFSRLVIKN

SEQ ID NO: 2831169 - protein, 22 aa, Entamoeba invadens
NTGLHFLVLYRYYLRRVPKNIS

SEQ ID NO: 2831170 - protein, 23 aa, Entamoeba invadens
NTKLYLRIYKLGRIPYFYLFLVA

SEQ ID NO: 2831171 - protein, 20 aa, Entamoeba invadens
NTLVLLQFFFKDGKLLKKRN

SEQ ID NO: 2831172 - protein, 23 aa, Entamoeba invadens
NTMSLWMMIFVIGTVIASSLYQV

SEQ ID NO: 2831173 - protein, 26 aa, Entamoeba invadens
NTQVVWWVILIIVIIILIIIVTIFII

SEQ ID NO: 2831174 - protein, 17 aa, Entamoeba invadens
NVDYYIFVHKPFGSLFL

SEQ ID NO: 2831175 - protein, 31 aa, Entamoeba invadens
NVEGKFDFCLPIPPSLYPNCKRLAFSTSKCV

SEQ ID NO: 2831176 - protein, 23 aa, Entamoeba invadens
NVFFIDWFVFYSTTFLNTLTLPQ

SEQ ID NO: 2831177 - protein, 24 aa, Entamoeba invadens
NVFVQQIMFILILSLILDVSSYNC

SEQ ID NO: 2831178 - protein, 19 aa, Entamoeba invadens
NVILPYKYKLRVMYDCARG

SEQ ID NO: 2831179 - protein, 21 aa, Entamoeba invadens
NVINLFFHGTAAPAALPTDLN

SEQ ID NO: 2831180 - protein, 22 aa, Entamoeba invadens
NVLRPFLFYVVFKKNMIVTIRF

SEQ ID NO: 2831181 - protein, 29 aa, Entamoeba invadens
NVNWKHLLIAFLLLIGFIVCVKTLRTPFI

SEQ ID NO: 2831182 - protein, 23 aa, Entamoeba invadens
NVQPQLFMFILNNFEKYLRPKLL

SEQ ID NO: 2831183 - protein, 23 aa, Entamoeba invadens
NVRVFFCELLLYKITVCPSWNRV

SEQ ID NO: 2831184 - protein, 22 aa, Entamoeba invadens
NVTFIMIQFWFGIMSKFSCTSL

SEQ ID NO: 2831185 - protein, 24 aa, Entamoeba invadens
NVTTQIRYNLIWCKDFIPGVNANI

SEQ ID NO: 2831186 - protein, 18 aa, Entamoeba invadens
NVVDTRLFFGILASFHAN

SEQ ID NO: 2831187 - protein, 24 aa, Entamoeba invadens
NWALIIPLVVIGILLIVAVIFVII

SEQ ID NO: 2831188 - protein, 32 aa, Entamoeba invadens
NWKIELYFLDLTLMFWIAIAMTIALVILGIIM

SEQ ID NO: 2831189 - protein, 18 aa, Entamoeba invadens
NWNTKMIFVWVKASFETE

SEQ ID NO: 2831190 - protein, 30 aa, Entamoeba invadens
NWNYFICFFIITFLLIYVTYFQQNIDDRIS

SEQ ID NO: 2831191 - protein, 21 aa, Entamoeba invadens
NYLGFSFLFVKPKKFIIRKTL

SEQ ID NO: 2831192 - protein, 17 aa, Entamoeba invadens
PANMLIPLDNPIMGKFV

SEQ ID NO: 2831193 - protein, 20 aa, Entamoeba invadens
PCTPYLYMKAVFFTLTLNST

SEQ ID NO: 2831194 - protein, 30 aa, Entamoeba invadens
PDGSKCLFYFEWIPVIVLLLTIIVVIIISV

SEQ ID NO: 2831195 - protein, 22 aa, Entamoeba invadens
PELPYAIFFNYGTSHFGFHVRF

SEQ ID NO: 2831196 - protein, 21 aa, Entamoeba invadens
PFDEKLFPYSWDITNLISKGE

SEQ ID NO: 2831197 - protein, 17 aa, Entamoeba invadens
PFFLTFDNLGLTPRINY

SEQ ID NO: 2831198 - protein, 19 aa, Entamoeba invadens
PFLFLLIDCLLFAQGSKHI

SEQ ID NO: 2831199 - protein, 19 aa, Entamoeba invadens
PFMWGFFMVSSLCFWTSFQ

SEQ ID NO: 2831200 - protein, 18 aa, Entamoeba invadens
PFNLFLYVDGLQLPETNS

SEQ ID NO: 2831201 - protein, 24 aa, Entamoeba invadens
PFNVLFTCLLLYKHFYITQSAQLF

SEQ ID NO: 2831202 - protein, 20 aa, Entamoeba invadens
PFQFLFATLYWAYKKLILCQ

SEQ ID NO: 2831203 - protein, 20 aa, Entamoeba invadens
PFVWQHILIPILPPKMLDLA

SEQ ID NO: 2831204 - protein, 20 aa, Entamoeba invadens
PGQYLLIDSCLICLAGTYSY

SEQ ID NO: 2831205 - protein, 26 aa, Entamoeba invadens
PHIMYFLSFLIVAILFFAPLIMLPVP

SEQ ID NO: 2831206 - protein, 24 aa, Entamoeba invadens
PIAFLVLLWVLKSLTLMIIPLCTI

SEQ ID NO: 2831207 - protein, 21 aa, Entamoeba invadens
PIEHKIACLLPLFGPVTLLFA

SEQ ID NO: 2831208 - protein, 35 aa, Entamoeba invadens
PIHADFYRYIPEAIIIPFFVFCITVVYLLSDYWKL

SEQ ID NO: 2831209 - protein, 36 aa, Entamoeba invadens
PIIGVFVLVVLLFILISILVFYIYQRKKKLQKEAKI

SEQ ID NO: 2831210 - protein, 18 aa, Entamoeba invadens
PILFFIVCIILLVLVIYW

SEQ ID NO: 2831211 - protein, 23 aa, Entamoeba invadens
PINTKWFRVVPSFHTILLSLCES

SEQ ID NO: 2831212 - protein, 19 aa, Entamoeba invadens
PIQKFKFPWSISQWVIEGK

SEQ ID NO: 2831213 - protein, 19 aa, Entamoeba invadens
PIQKFKFPWSISQWVMEGK

SEQ ID NO: 2831214 - protein, 34 aa, Entamoeba invadens
PISIVIVLIIIFVILFFVFFKIYQTNKKRKDLKN

SEQ ID NO: 2831215 - protein, 27 aa, Entamoeba invadens
PISVTFVIIVFIVAIILIAISMIQKRK

SEQ ID NO: 2831216 - protein, 32 aa, Entamoeba invadens
PISVTLIVIILIIVIIIVVILWLQNQKQKKKE

SEQ ID NO: 2831217 - protein, 23 aa, Entamoeba invadens
PITIIIVLIIVITVGIIITIFFI

SEQ ID NO: 2831218 - protein, 28 aa, Entamoeba invadens
PIVSVFIIVLIIIGIIVITIVVLQKRKE

SEQ ID NO: 2831219 - protein, 28 aa, Entamoeba invadens
PIVSVFIIVLIIVGIIIITIIVLQKRKE

SEQ ID NO: 2831220 - protein, 26 aa, Entamoeba invadens
PIVSVFIIVLVIISIIIITIVVLQKR

SEQ ID NO: 2831221 - protein, 29 aa, Entamoeba invadens
PIVSVFVIILIIISIIVITIVVLQKRKET

SEQ ID NO: 2831222 - protein, 22 aa, Entamoeba invadens
PKFETWWLTRVVPFMFFVFVSM

SEQ ID NO: 2831223 - protein, 21 aa, Entamoeba invadens
PKNFNVWLQRVFHKEVNASNE

SEQ ID NO: 2831224 - protein, 20 aa, Entamoeba invadens
PKYVFYFDPQVLIIPPRRTD

SEQ ID NO: 2831225 - protein, 21 aa, Entamoeba invadens
PLFMPYVLFLCFFSRALNVFP

SEQ ID NO: 2831226 - protein, 20 aa, Entamoeba invadens
PLIPFWRSVFYLIFRVPFWT

SEQ ID NO: 2831227 - protein, 29 aa, Entamoeba invadens
PLMKAVTTFLFYWYNFMPLSRGTAVTGFV

SEQ ID NO: 2831228 - protein, 25 aa, Entamoeba invadens
PLSMTFVIIVFIVAIIIIVISMIQK

SEQ ID NO: 2831229 - protein, 26 aa, Entamoeba invadens
PLSVTFVIIMFIVALIIIVISMIQKR

SEQ ID NO: 2831230 - protein, 41 aa, Entamoeba invadens
PLVIALPISLVFVIVLVTIALFLLWYFIRQHNKRVEEMKKI

SEQ ID NO: 2831231 - protein, 20 aa, Entamoeba invadens
PLVLKFIYKVLLFKPHTILQ

SEQ ID NO: 2831232 - protein, 17 aa, Entamoeba invadens
PLVPSKYYTFISSLVLQ

SEQ ID NO: 2831233 - protein, 18 aa, Entamoeba invadens
PLYRIPFIPSLFAQNYFY

SEQ ID NO: 2831234 - protein, 27 aa, Entamoeba invadens
PLYRPITVILFFLITGLIFIPIGIAVF

SEQ ID NO: 2831235 - protein, 19 aa, Entamoeba invadens
PMQFFFILYFFLFTPTDES

SEQ ID NO: 2831236 - protein, 25 aa, Entamoeba invadens
PMTVTFVIIVFIVAIIMVIISMIQK

SEQ ID NO: 2831237 - protein, 22 aa, Entamoeba invadens
PNDPKFILNFKPQVLFLSPISK

SEQ ID NO: 2831238 - protein, 39 aa, Entamoeba invadens
PNQWKVQLFFVIFFFMLFAIFIPCLVIHIIKFYRDEQRS

SEQ ID NO: 2831239 - protein, 17 aa, Entamoeba invadens
PPKYILFYFINALILHF

SEQ ID NO: 2831240 - protein, 23 aa, Entamoeba invadens
PPVTLLYVFLFNDVMLETLPTTV

SEQ ID NO: 2831241 - protein, 17 aa, Entamoeba invadens
PQAILPQLLAFLPVVGD

SEQ ID NO: 2831242 - protein, 23 aa, Entamoeba invadens
PQLLLWNCLYLHLNYNFPNRINF

SEQ ID NO: 2831243 - protein, 22 aa, Entamoeba invadens
PQYGAFMYWMLAKESLGHTFSD

SEQ ID NO: 2831244 - protein, 20 aa, Entamoeba invadens
PRHDLFLENLLLWSKKIFGV

SEQ ID NO: 2831245 - protein, 23 aa, Entamoeba invadens
PRISLFFFFSLVSVGLFVAYLCV

SEQ ID NO: 2831246 - protein, 17 aa, Entamoeba invadens
PSFWYNIQLTESVDLIA

SEQ ID NO: 2831247 - protein, 17 aa, Entamoeba invadens
PSIHLYPSLVTLNDDLS

SEQ ID NO: 2831248 - protein, 26 aa, Entamoeba invadens
PSMATLLIPIFPLLITPFLSVMNSNH

SEQ ID NO: 2831249 - protein, 30 aa, Entamoeba invadens
PSYLVSLYKFIFIVLTTYREFLFLKPNQMC

SEQ ID NO: 2831250 - protein, 18 aa, Entamoeba invadens
PTAFLVVLFGITALVLTT

SEQ ID NO: 2831251 - protein, 31 aa, Entamoeba invadens
PTIGLYIFLYFVLLFVYYLRYNNLNAVITKA

SEQ ID NO: 2831252 - protein, 23 aa, Entamoeba invadens
PTTMFLLYFNLIMNRKMTITKGL

SEQ ID NO: 2831253 - protein, 23 aa, Entamoeba invadens
PVAIIILLIVLLIVLIVFIRMSD

SEQ ID NO: 2831254 - protein, 24 aa, Entamoeba invadens
PVEQKWLWTLYTVLTVMSIITLIL

SEQ ID NO: 2831255 - protein, 23 aa, Entamoeba invadens
PVFQMLYRLFIRPFLNPNPIKKY

SEQ ID NO: 2831256 - protein, 17 aa, Entamoeba invadens
PVFTFQVSSLKLTTNKE

SEQ ID NO: 2831257 - protein, 20 aa, Entamoeba invadens
PVITPFWKIFLEALKDKTLI

SEQ ID NO: 2831258 - protein, 21 aa, Entamoeba invadens
PVMQIVRPLGVIRLWGAQIVN

SEQ ID NO: 2831259 - protein, 31 aa, Entamoeba invadens
PVVITVIIMIVLIITIFVVCLFYKSHKSKKI

SEQ ID NO: 2831260 - protein, 22 aa, Entamoeba invadens
PWFAHQMCQFLMPYYSRTGNNK

SEQ ID NO: 2831261 - protein, 18 aa, Entamoeba invadens
PWLFYIAWQILYLIITEV

SEQ ID NO: 2831262 - protein, 19 aa, Entamoeba invadens
PWMCFGFIGSMIYGALFPT

SEQ ID NO: 2831263 - protein, 18 aa, Entamoeba invadens
PWYMFFIMLLFSFTNGYV

SEQ ID NO: 2831264 - protein, 23 aa, Entamoeba invadens
PYDTLMRMNLLLRPTRINKLGNS

SEQ ID NO: 2831265 - protein, 19 aa, Entamoeba invadens
PYFYLFLVALFTAVVTSPW

SEQ ID NO: 2831266 - protein, 20 aa, Entamoeba invadens
PYFYLLVILITFLLTAKDLL

SEQ ID NO: 2831267 - protein, 26 aa, Entamoeba invadens
PYTKLIFLLFSWFTPASILKPSIRGG

SEQ ID NO: 2831268 - protein, 18 aa, Entamoeba invadens
PYTYGYWFKLVSDTTRKL

SEQ ID NO: 2831269 - protein, 20 aa, Entamoeba invadens
PYVIRFYGASFIPNRICMVT

SEQ ID NO: 2831270 - protein, 23 aa, Entamoeba invadens
QAVWWVILVVVMFVLIVLFVLIV

SEQ ID NO: 2831271 - protein, 19 aa, Entamoeba invadens
QCKSCVTGFYLNTSTYTCE

SEQ ID NO: 2831272 - protein, 26 aa, Entamoeba invadens
QCVKCIDGYFLYERIWKCIRGEINNC

SEQ ID NO: 2831273 - protein, 29 aa, Entamoeba invadens
QEAPNWYLLVPLIVLVLVGLGVLIVLFLF

SEQ ID NO: 2831274 - protein, 28 aa, Entamoeba invadens
QEAPNWYLLVPLIVLVLVGLNVLIVLFL

SEQ ID NO: 2831275 - protein, 22 aa, Entamoeba invadens
QEIFFFYVFFTLFVFFLCVVIC

SEQ ID NO: 2831276 - protein, 28 aa, Entamoeba invadens
QENWVSNYIFLFLGILALGMSVIMGNSI

SEQ ID NO: 2831277 - protein, 23 aa, Entamoeba invadens
QESYLFLSLGNFLGLLTLGLNKP

SEQ ID NO: 2831278 - protein, 23 aa, Entamoeba invadens
QETFLSFFLLLVVTVIFGFIVPM

SEQ ID NO: 2831279 - protein, 26 aa, Entamoeba invadens
QEVSWWMILIIFVLSFVTFIIFLLIV

SEQ ID NO: 2831280 - protein, 21 aa, Entamoeba invadens
QFFYNAFIFLTATDSLLSLQG

SEQ ID NO: 2831281 - protein, 20 aa, Entamoeba invadens
QFGLILHELFIKITFTLDDL

SEQ ID NO: 2831282 - protein, 17 aa, Entamoeba invadens
QFKFPWIIAEYVSNGLR

SEQ ID NO: 2831283 - protein, 21 aa, Entamoeba invadens
QGFFCFPMVDYIFFGETSKIS

SEQ ID NO: 2831284 - protein, 18 aa, Entamoeba invadens
QIFLLVFSVVTVSLLFFL

SEQ ID NO: 2831285 - protein, 33 aa, Entamoeba invadens
QINNFLVLWFYYFFALIVYFFPFLSVPGKVTRA

SEQ ID NO: 2831286 - protein, 25 aa, Entamoeba invadens
QITFYKYFPSIIRKNAFRNSGLQSI

SEQ ID NO: 2831287 - protein, 18 aa, Entamoeba invadens
QITKWYSIIFSTFKYYVL

SEQ ID NO: 2831288 - protein, 24 aa, Entamoeba invadens
QKDNYFLYYIYLIAVVYSIYIIAF

SEQ ID NO: 2831289 - protein, 20 aa, Entamoeba invadens
QKDYPLFLDLTIPVLFGLYL

SEQ ID NO: 2831290 - protein, 31 aa, Entamoeba invadens
QKEVVWWVVLLLVLFVFFCISILSVLVFFAT

SEQ ID NO: 2831291 - protein, 21 aa, Entamoeba invadens
QKLFENMWIRVLSPLNLKAKL

SEQ ID NO: 2831292 - protein, 26 aa, Entamoeba invadens
QKNYKYFILFLWYAPLMLSLGVCWHA

SEQ ID NO: 2831293 - protein, 31 aa, Entamoeba invadens
QKSAVWWVIVLFILFLLVIVTIVILVIILVI

SEQ ID NO: 2831294 - protein, 19 aa, Entamoeba invadens
QKYFLYFQGALKKGFVINI

SEQ ID NO: 2831295 - protein, 25 aa, Entamoeba invadens
QKYVHLYVKFFIRITQLMETMENKK

SEQ ID NO: 2831296 - protein, 19 aa, Entamoeba invadens
QLFLLFFLIQSVSAPLSIG

SEQ ID NO: 2831297 - protein, 17 aa, Entamoeba invadens
QLNNKILFIILGKLTNT

SEQ ID NO: 2831298 - protein, 20 aa, Entamoeba invadens
QLSLPLYFIKKFFGFFNVTS

SEQ ID NO: 2831299 - protein, 18 aa, Entamoeba invadens
QMREIIISTFPFLEKYKY

SEQ ID NO: 2831300 - protein, 18 aa, Entamoeba invadens
QMRYFYDAVPYPIYLRSL

SEQ ID NO: 2831301 - protein, 19 aa, Entamoeba invadens
QMSIKWMFVLSLRLRNGLI

SEQ ID NO: 2831302 - protein, 20 aa, Entamoeba invadens
QMVLFLFCVLLVNASDCYPK

SEQ ID NO: 2831303 - protein, 20 aa, Entamoeba invadens
QNDFVWLLQSLYQAKFRRIH

SEQ ID NO: 2831304 - protein, 23 aa, Entamoeba invadens
QPFFAFQVFCSVLWMLDDMPIFA

SEQ ID NO: 2831305 - protein, 29 aa, Entamoeba invadens
QPNQFLTWAFMILLLSLASFYAFKLARST

SEQ ID NO: 2831306 - protein, 23 aa, Entamoeba invadens
QQRMIFLWMVWLVMNQHTTVFGF

SEQ ID NO: 2831307 - protein, 18 aa, Entamoeba invadens
QQSALLCLLYHEGYNIQF

SEQ ID NO: 2831308 - protein, 21 aa, Entamoeba invadens
QRFDIWLRRNLTSIPYVHVDG

SEQ ID NO: 2831309 - protein, 26 aa, Entamoeba invadens
QRHFLFILVILLFGLFFVVIYSFNLT

SEQ ID NO: 2831310 - protein, 18 aa, Entamoeba invadens
QRLPRYRLLLSDLLKHTE

SEQ ID NO: 2831311 - protein, 23 aa, Entamoeba invadens
QRTFKFFYFPRFVLIILLESFVV

SEQ ID NO: 2831312 - protein, 22 aa, Entamoeba invadens
QSIVLLSFVLLLCPLLSALFRA

SEQ ID NO: 2831313 - protein, 24 aa, Entamoeba invadens
QSKDYYFFFSYHPSFKTINFNIKV

SEQ ID NO: 2831314 - protein, 27 aa, Entamoeba invadens
QSKSLQMAVLLLLLIGLSYGYWGEVNN

SEQ ID NO: 2831315 - protein, 17 aa, Entamoeba invadens
QSLNLFFLFPETIKNVK

SEQ ID NO: 2831316 - protein, 23 aa, Entamoeba invadens
QSLVFFFFYYITTFTCDVTMFGL

SEQ ID NO: 2831317 - protein, 20 aa, Entamoeba invadens
QTKIMAFFMYVLCSFGYSFV

SEQ ID NO: 2831318 - protein, 35 aa, Entamoeba invadens
QTQAVWWVIFVCVFFVLIVILLFIIMCIIITFKVI

SEQ ID NO: 2831319 - protein, 25 aa, Entamoeba invadens
QTQAVWWVIFVCVFFVVIVILMLII

SEQ ID NO: 2831320 - protein, 29 aa, Entamoeba invadens
QTRQLDCVLIVIMLLMVSLSVPKIVYMEK

SEQ ID NO: 2831321 - protein, 24 aa, Entamoeba invadens
QTVFLFFFLMLFFGSTLDITKQVL

SEQ ID NO: 2831322 - protein, 21 aa, Entamoeba invadens
QTVSFLLFLLVFRPDQTYGEI

SEQ ID NO: 2831323 - protein, 28 aa, Entamoeba invadens
QVDSNLIFYQFFNMIYFQTTSTLENTVK

SEQ ID NO: 2831324 - protein, 23 aa, Entamoeba invadens
QVNHFYYIFISIQGFVHTDIDFT

SEQ ID NO: 2831325 - protein, 21 aa, Entamoeba invadens
QWCIFLILMIVSSLLLVPFFI

SEQ ID NO: 2831326 - protein, 20 aa, Entamoeba invadens
QWLELFSHRSLLYDLAKAPQ

SEQ ID NO: 2831327 - protein, 42 aa, Entamoeba invadens
QWLYKNIFFTVGIVIIFLFIVNLFIYIIAKRIVYRRAKQIAR

SEQ ID NO: 2831328 - protein, 19 aa, Entamoeba invadens
QWQHVFIPVLPVSLLTYCS

SEQ ID NO: 2831329 - protein, 20 aa, Entamoeba invadens
QWTIYVWFNALLLLGSALCS

SEQ ID NO: 2831330 - protein, 17 aa, Entamoeba invadens
QYFIWWFVLLPFVVPKI

SEQ ID NO: 2831331 - protein, 24 aa, Entamoeba invadens
QYGLLVLFAFWFFHGIIDTITGVS

SEQ ID NO: 2831332 - protein, 23 aa, Entamoeba invadens
QYLHDFHFWSLPTILWNHVNQNQ

SEQ ID NO: 2831333 - protein, 24 aa, Entamoeba invadens
QYVIWGFFIFTTVGIYFSLVLKWR

SEQ ID NO: 2831334 - protein, 17 aa, Entamoeba invadens
RANLLYAFFFSGILLGA

SEQ ID NO: 2831335 - protein, 24 aa, Entamoeba invadens
RAQMVLLLFHFPPIWCIGDMERFK

SEQ ID NO: 2831336 - protein, 24 aa, Entamoeba invadens
RAWLNLIIFILLYYSEVDYYTVGF

SEQ ID NO: 2831337 - protein, 22 aa, Entamoeba invadens
RCDYIIHFYGAVFKANRISLVT

SEQ ID NO: 2831338 - protein, 23 aa, Entamoeba invadens
RDEKKIYVIFYKTPKEIWISHST

SEQ ID NO: 2831339 - protein, 18 aa, Entamoeba invadens
RDYVFPVLGEVYKVLYKV

SEQ ID NO: 2831340 - protein, 27 aa, Entamoeba invadens
REANPFIVILVIKLYFLSLSQSFFCVK

SEQ ID NO: 2831341 - protein, 27 aa, Entamoeba invadens
REGKDFLLFILIFVSLTTLVVSSLCIY

SEQ ID NO: 2831342 - protein, 17 aa, Entamoeba invadens
RFGKYFHFYFPPSSTKN

SEQ ID NO: 2831343 - protein, 18 aa, Entamoeba invadens
RFIVGMEQLYPFTKFVEK

SEQ ID NO: 2831344 - protein, 23 aa, Entamoeba invadens
RFMLPISLLILTITFIPLIYFVV

SEQ ID NO: 2831345 - protein, 22 aa, Entamoeba invadens
RFNSLPLQFCMIFLSLFSVKYN

SEQ ID NO: 2831346 - protein, 18 aa, Entamoeba invadens
RFTSMQFLYFLPFNHSPQ

SEQ ID NO: 2831347 - protein, 19 aa, Entamoeba invadens
RFVLLSDKKLLRFGSNQNV

SEQ ID NO: 2831348 - protein, 27 aa, Entamoeba invadens
RGMNTLMFMIIYYLLPIVLSRPVRQPI

SEQ ID NO: 2831349 - protein, 18 aa, Entamoeba invadens
RGVCVFPMKKSNIPMKVL

SEQ ID NO: 2831350 - protein, 19 aa, Entamoeba invadens
RICTKCLSGFYLQDGECLQ

SEQ ID NO: 2831351 - protein, 20 aa, Entamoeba invadens
RICTKCLSGYYLQDGECLQI

SEQ ID NO: 2831352 - protein, 20 aa, Entamoeba invadens
RIGVLLYFMALLPDSLIPKG

SEQ ID NO: 2831353 - protein, 36 aa, Entamoeba invadens
RIIHIFQGGFFYFFLFKMIFYLFTKKYYIITIFNKK

SEQ ID NO: 2831354 - protein, 26 aa, Entamoeba invadens
RISVFKIFHVFQSLMILHIICSPFHL

SEQ ID NO: 2831355 - protein, 21 aa, Entamoeba invadens
RIYFTRFCQLLAFYGPKVAPK

SEQ ID NO: 2831356 - protein, 29 aa, Entamoeba invadens
RKCHITMLLFVIFYWYTLTYRNIEVERQQ

SEQ ID NO: 2831357 - protein, 24 aa, Entamoeba invadens
RKCLKCFAPYYLSSDGLLCILAYS

SEQ ID NO: 2831358 - protein, 23 aa, Entamoeba invadens
RKDYLWKEIPPLVSPPLYNMRSR

SEQ ID NO: 2831359 - protein, 27 aa, Entamoeba invadens
RKLYRYANWLDLVLLITGILGALASGI

SEQ ID NO: 2831360 - protein, 21 aa, Entamoeba invadens
RKNESYLWLLNFTGIIGQKSK

SEQ ID NO: 2831361 - protein, 18 aa, Entamoeba invadens
RKYSWCLLITNETIKIQC

SEQ ID NO: 2831362 - protein, 17 aa, Entamoeba invadens
RLILRDDDKKMWAIICC

SEQ ID NO: 2831363 - protein, 23 aa, Entamoeba invadens
RLQILVNILTRYILLFSYFPINE

SEQ ID NO: 2831364 - protein, 21 aa, Entamoeba invadens
RLQLVFFLYRILALVLMYTTL

SEQ ID NO: 2831365 - protein, 19 aa, Entamoeba invadens
RLRGLKIPYTVWFSKSRKP

SEQ ID NO: 2831366 - protein, 20 aa, Entamoeba invadens
RLYRFDLFVAFDYIGGDAPR

SEQ ID NO: 2831367 - protein, 22 aa, Entamoeba invadens
RMWESLVLVLFLRPFDIGDRIS

SEQ ID NO: 2831368 - protein, 22 aa, Entamoeba invadens
RNGFHIILLYFLTLGRFSKLDC

SEQ ID NO: 2831369 - protein, 18 aa, Entamoeba invadens
RNGVYKIFILIAMVVLLF

SEQ ID NO: 2831370 - protein, 17 aa, Entamoeba invadens
RNKYLMIIFHTPNNPKF

SEQ ID NO: 2831371 - protein, 20 aa, Entamoeba invadens
RNKYYPFLLIIFPEGTRAKP

SEQ ID NO: 2831372 - protein, 18 aa, Entamoeba invadens
RNNDFNVILPYKYKLRVM

SEQ ID NO: 2831373 - protein, 21 aa, Entamoeba invadens
RPKSLLYFTLSFSAASLILLI

SEQ ID NO: 2831374 - protein, 25 aa, Entamoeba invadens
RQEKTYYLKLPYKLKVRMLFDISRG

SEQ ID NO: 2831375 - protein, 25 aa, Entamoeba invadens
RQGIKIRLLYFRALLRQDSGWYDFH

SEQ ID NO: 2831376 - protein, 22 aa, Entamoeba invadens
RQVKIPFMYFVIALSLFSISCM

SEQ ID NO: 2831377 - protein, 32 aa, Entamoeba invadens
RRKEKRTPWMLWIFWFCVYAGLCAVIFFALKL

SEQ ID NO: 2831378 - protein, 27 aa, Entamoeba invadens
RRVIINKPFFFILVDSKSLPLFFGKCT

SEQ ID NO: 2831379 - protein, 40 aa, Entamoeba invadens
RSCQFTIPWWCILLLVIFILLVVILCTTLLFYSVKIAIQK

SEQ ID NO: 2831380 - protein, 21 aa, Entamoeba invadens
RSDYIVHFYGAVFILNKICMV

SEQ ID NO: 2831381 - protein, 21 aa, Entamoeba invadens
RSEYIVHFYGAVFIPNKICMV

SEQ ID NO: 2831382 - protein, 17 aa, Entamoeba invadens
RSKLYSKLLIQNIGYFD

SEQ ID NO: 2831383 - protein, 27 aa, Entamoeba invadens
RSRLSIGLMWWMLTREILRFRGELARD

SEQ ID NO: 2831384 - protein, 30 aa, Entamoeba invadens
RTFHFITISIFLFLFLLCLTFSVVMGAASF

SEQ ID NO: 2831385 - protein, 21 aa, Entamoeba invadens
RTFKLSPLHNLVLGTSIFEST

SEQ ID NO: 2831386 - protein, 17 aa, Entamoeba invadens
RTKPYPCLYLLNSSRIN

SEQ ID NO: 2831387 - protein, 27 aa, Entamoeba invadens
RTRKLFLYLILFVFLSGALTLLTLVLV

SEQ ID NO: 2831388 - protein, 21 aa, Entamoeba invadens
RVEYPMWFLCLYDAAGKAAKT

SEQ ID NO: 2831389 - protein, 18 aa, Entamoeba invadens
RVLVFDDFCSQLLSMYFV

SEQ ID NO: 2831390 - protein, 17 aa, Entamoeba invadens
RVRYWLGGLLSILCLLT

SEQ ID NO: 2831391 - protein, 19 aa, Entamoeba invadens
RYMLLSNYLYTYAYNNINC

SEQ ID NO: 2831392 - protein, 39 aa, Entamoeba invadens
SAFVPLLVIMFIIGIIVLIIILLVVWYFKRRRNSTNATH

SEQ ID NO: 2831393 - protein, 23 aa, Entamoeba invadens
SAVWWIILIIVIAGLSIEITTIV

SEQ ID NO: 2831394 - protein, 18 aa, Entamoeba invadens
SCCFLLYPSKLFNDKLEE

SEQ ID NO: 2831395 - protein, 39 aa, Entamoeba invadens
SCDKHAVWWIILIIVILLLILFVIITLLILYTVYYILEK

SEQ ID NO: 2831396 - protein, 29 aa, Entamoeba invadens
SCENAPVWWVFFVLFLVVLGVIGLLVLIG

SEQ ID NO: 2831397 - protein, 27 aa, Entamoeba invadens
SCETKAVWWVLLLVVLCALFIVVVLMV

SEQ ID NO: 2831398 - protein, 38 aa, Entamoeba invadens
SCHTKVVWWVILIGVIFVLIILTIVVSFVLFFSVKISH

SEQ ID NO: 2831399 - protein, 20 aa, Entamoeba invadens
SCIEGYYLEYGKCYWCYIKE

SEQ ID NO: 2831400 - protein, 29 aa, Entamoeba invadens
SCITQAVWWVILLIVIVVVVIIILVIVAV

SEQ ID NO: 2831401 - protein, 17 aa, Entamoeba invadens
SCLTFCVFLSTYMILRN

SEQ ID NO: 2831402 - protein, 30 aa, Entamoeba invadens
SCPGYLLVLFIFIFIVFAVIIIVVAFLIWK

SEQ ID NO: 2831403 - protein, 19 aa, Entamoeba invadens
SCVLFLLLIIIVLIILIFV

SEQ ID NO: 2831404 - protein, 23 aa, Entamoeba invadens
SCYIIFFFVIFPIYITRLVSTAL

SEQ ID NO: 2831405 - protein, 25 aa, Entamoeba invadens
SDDLTWLWITLGVVGGVVLIAAIIL

SEQ ID NO: 2831406 - protein, 20 aa, Entamoeba invadens
SDFIFLLYGVFLLLYSVYVS

SEQ ID NO: 2831407 - protein, 31 aa, Entamoeba invadens
SDGDNDLTWLWITLGVIGGLLVIIVIVGAVI

SEQ ID NO: 2831408 - protein, 26 aa, Entamoeba invadens
SDIDQKFWIWYYLPNARQPVQLFING

SEQ ID NO: 2831409 - protein, 24 aa, Entamoeba invadens
SDIYSLAMIIYTSLNWALIVPSKN

SEQ ID NO: 2831410 - protein, 29 aa, Entamoeba invadens
SDLYSLGVILFYLLFMRIPFDVDDLDELK

SEQ ID NO: 2831411 - protein, 24 aa, Entamoeba invadens
SDNYALICLLISTIYQIIPVLPGE

SEQ ID NO: 2831412 - protein, 23 aa, Entamoeba invadens
SDSAYLIFPFLCSFIAIILSFLA

SEQ ID NO: 2831413 - protein, 24 aa, Entamoeba invadens
SDSTYLIFPFLCSFIAIILSFLAV

SEQ ID NO: 2831414 - protein, 23 aa, Entamoeba invadens
SDTEISIYFLYTTKFMVWSTYRF

SEQ ID NO: 2831415 - protein, 26 aa, Entamoeba invadens
SEEDLTWLWITLGVVGGVLLIAVIIL

SEQ ID NO: 2831416 - protein, 22 aa, Entamoeba invadens
SEELRRLAIFADKSRFIAEFNT

SEQ ID NO: 2831417 - protein, 19 aa, Entamoeba invadens
SEFIVHFYGAVFIPNKVCM

SEQ ID NO: 2831418 - protein, 19 aa, Entamoeba invadens
SEFIVYFYGAVFIPNKICL

SEQ ID NO: 2831419 - protein, 19 aa, Entamoeba invadens
SEFIVYFYGAVFIPNKICM

SEQ ID NO: 2831420 - protein, 33 aa, Entamoeba invadens
SEFPMYMIAVIVIFILILAVIVAFLIAYVVHVY

SEQ ID NO: 2831421 - protein, 21 aa, Entamoeba invadens
SEKQFKFPWKIAEFVTRGEHL

SEQ ID NO: 2831422 - protein, 17 aa, Entamoeba invadens
SELPLIAKYLYLIGLNL

SEQ ID NO: 2831423 - protein, 25 aa, Entamoeba invadens
SENSILFLLLIYIWESILTARNRTK

SEQ ID NO: 2831424 - protein, 24 aa, Entamoeba invadens
SETASLLILFTKTSYIGLGNIGNK

SEQ ID NO: 2831425 - protein, 20 aa, Entamoeba invadens
SEYIIHFYGAVFIPTRMCLV

SEQ ID NO: 2831426 - protein, 20 aa, Entamoeba invadens
SEYIVHFYGAVFIPNKICMV

SEQ ID NO: 2831427 - protein, 20 aa, Entamoeba invadens
SEYIVHFYGAVFIPNRVCMV

SEQ ID NO: 2831428 - protein, 19 aa, Entamoeba invadens
SEYIVYFYGAVFDINKTCM

SEQ ID NO: 2831429 - protein, 19 aa, Entamoeba invadens
SEYIVYFYGAVFTPKKICL

SEQ ID NO: 2831430 - protein, 19 aa, Entamoeba invadens
SEYLFLPKNIGLSPNALFL

SEQ ID NO: 2831431 - protein, 18 aa, Entamoeba invadens
SFAITMFEIFIWGEAYPG

SEQ ID NO: 2831432 - protein, 18 aa, Entamoeba invadens
SFAITMFEILIWGEAYPG

SEQ ID NO: 2831433 - protein, 18 aa, Entamoeba invadens
SFAVVMYEIFVWGPPYPK

SEQ ID NO: 2831434 - protein, 17 aa, Entamoeba invadens
SFEYYFFANLRGLSPVT

SEQ ID NO: 2831435 - protein, 21 aa, Entamoeba invadens
SFFRKYWPWLLGAGVLFFFLS

SEQ ID NO: 2831436 - protein, 23 aa, Entamoeba invadens
SFGTIMLFMMLSLALSGWYGSLL

SEQ ID NO: 2831437 - protein, 27 aa, Entamoeba invadens
SFITTLKFWLLLVWGKCKTLNILFLIV

SEQ ID NO: 2831438 - protein, 18 aa, Entamoeba invadens
SFKLSVLYNLPLNYVISL

SEQ ID NO: 2831439 - protein, 24 aa, Entamoeba invadens
SFLIQYLYIRIQALTIKPVHFNWI

SEQ ID NO: 2831440 - protein, 24 aa, Entamoeba invadens
SFLNSFFFERIMSLYLALLFRFHV

SEQ ID NO: 2831441 - protein, 23 aa, Entamoeba invadens
SFSMKCFNLFYGCYSRDYKLNST

SEQ ID NO: 2831442 - protein, 19 aa, Entamoeba invadens
SFTALFLLYLGPITFHILE

SEQ ID NO: 2831443 - protein, 20 aa, Entamoeba invadens
SFVDFSVFVLLPYISKRVHI

SEQ ID NO: 2831444 - protein, 18 aa, Entamoeba invadens
SFYSVNRFLPFKAPIVFS

SEQ ID NO: 2831445 - protein, 31 aa, Entamoeba invadens
SGFLLSKIFWVIFGYILIGLAILTALLLGIL

SEQ ID NO: 2831446 - protein, 18 aa, Entamoeba invadens
SGIFPLGPALMRPLCTHQ

SEQ ID NO: 2831447 - protein, 20 aa, Entamoeba invadens
SGLWYLFEKLEFKTGKFIDR

SEQ ID NO: 2831448 - protein, 17 aa, Entamoeba invadens
SGNAFELFLSTTDIRYV

SEQ ID NO: 2831449 - protein, 24 aa, Entamoeba invadens
SGVYYMYYHVIFTTFVKLHHDGEY

SEQ ID NO: 2831450 - protein, 21 aa, Entamoeba invadens
SHILIHLLILYVMGINDWCEV

SEQ ID NO: 2831451 - protein, 23 aa, Entamoeba invadens
SHIVWWMIIVIVIICIMTFIVLT

SEQ ID NO: 2831452 - protein, 27 aa, Entamoeba invadens
SHKEPPFVYWIYFVKSNLFVLNNLRRS

SEQ ID NO: 2831453 - protein, 17 aa, Entamoeba invadens
SHKNYFMIIGVPVIVVV

SEQ ID NO: 2831454 - protein, 20 aa, Entamoeba invadens
SHNKWLIQLPRHFVSRKSNE

SEQ ID NO: 2831455 - protein, 18 aa, Entamoeba invadens
SIALFFINLLMALVNTFL

SEQ ID NO: 2831456 - protein, 27 aa, Entamoeba invadens
SIAVLVFLLVVLFLLSVIALILFKKKK

SEQ ID NO: 2831457 - protein, 17 aa, Entamoeba invadens
SIFSFIFVFLYNQFKHV

SEQ ID NO: 2831458 - protein, 21 aa, Entamoeba invadens
SIFYFFYVIICFIIFANKTYR

SEQ ID NO: 2831459 - protein, 24 aa, Entamoeba invadens
SIIWFFILFIIALPFYMACIAFGG

SEQ ID NO: 2831460 - protein, 20 aa, Entamoeba invadens
SILFLCNLIFEFVIPTLFIS

SEQ ID NO: 2831461 - protein, 17 aa, Entamoeba invadens
SILLIVLITKHFDRRET

SEQ ID NO: 2831462 - protein, 19 aa, Entamoeba invadens
SILVLILFVVYGQISDVCQ

SEQ ID NO: 2831463 - protein, 36 aa, Entamoeba invadens
SINILYYPIAYWYYYKFYFLLVIYFVVIIITTKYET

SEQ ID NO: 2831464 - protein, 28 aa, Entamoeba invadens
SISAFIVLLLLVVILTMIVFFLLRKKKE

SEQ ID NO: 2831465 - protein, 25 aa, Entamoeba invadens
SITPYKFTLTLLWLDVELTSTSINP

SEQ ID NO: 2831466 - protein, 29 aa, Entamoeba invadens
SITVFITLFLLFDYFLRPSPNIPTIFPLE

SEQ ID NO: 2831467 - protein, 29 aa, Entamoeba invadens
SIVLPFFVPYLFFTLGVLVILTIVLWTVV

SEQ ID NO: 2831468 - protein, 26 aa, Entamoeba invadens
SKKAIHVPYLIRVKFLFDAARGVEYL

SEQ ID NO: 2831469 - protein, 29 aa, Entamoeba invadens
SKKAKICFFFFFLFSTILFLQGIITYFEV

SEQ ID NO: 2831470 - protein, 25 aa, Entamoeba invadens
SKKIFRLLFPYFLQSSSIEIIVIIF

SEQ ID NO: 2831471 - protein, 23 aa, Entamoeba invadens
SKKKFMMIIFHTPNNPKYVFHFE

SEQ ID NO: 2831472 - protein, 22 aa, Entamoeba invadens
SKPVWWVIMISCFISVFIVVCV

SEQ ID NO: 2831473 - protein, 22 aa, Entamoeba invadens
SKRPIHYFWYYINSIVFHCFVT

SEQ ID NO: 2831474 - protein, 26 aa, Entamoeba invadens
SKSQTYDFFFYRPTPPTFYAKEDKLV

SEQ ID NO: 2831475 - protein, 25 aa, Entamoeba invadens
SKTAVWWVILLIIVIVISILVLVIV

SEQ ID NO: 2831476 - protein, 26 aa, Entamoeba invadens
SKTAVWWVILLIVVIIAILVLVTVLV

SEQ ID NO: 2831477 - protein, 26 aa, Entamoeba invadens
SKTNWALIIPLIIVGVIIIIIIFVII

SEQ ID NO: 2831478 - protein, 28 aa, Entamoeba invadens
SKVFSFWSYLKWFLLGIFQALVFFIVVF

SEQ ID NO: 2831479 - protein, 28 aa, Entamoeba invadens
SLCLQLFFIFLLTLLFLRGAYKTVTTPV

SEQ ID NO: 2831480 - protein, 19 aa, Entamoeba invadens
SLEGFLVLYRTYFKFTDTQ

SEQ ID NO: 2831481 - protein, 20 aa, Entamoeba invadens
SLFALWFLPLQRKFQSWLYH

SEQ ID NO: 2831482 - protein, 19 aa, Entamoeba invadens
SLFAWVYFLFGVLLFCMTH

SEQ ID NO: 2831483 - protein, 19 aa, Entamoeba invadens
SLFFVFLISPSRGLEGCKT

SEQ ID NO: 2831484 - protein, 23 aa, Entamoeba invadens
SLFLIGLVALVFGLLFAYYSTSS

SEQ ID NO: 2831485 - protein, 25 aa, Entamoeba invadens
SLFVFLVLVIIFGFLIYYGLRYKKV

SEQ ID NO: 2831486 - protein, 20 aa, Entamoeba invadens
SLFVLVFLNKTKEMKMQIIK

SEQ ID NO: 2831487 - protein, 18 aa, Entamoeba invadens
SLIIVIIYLLIMKQKEKK

SEQ ID NO: 2831488 - protein, 18 aa, Entamoeba invadens
SLIIWFMLEGIFGMVSFG

SEQ ID NO: 2831489 - protein, 27 aa, Entamoeba invadens
SLIRCGFRLCYFIFLIQWTNTINTTLP

SEQ ID NO: 2831490 - protein, 25 aa, Entamoeba invadens
SLITLIITFLWLRVKSKRVVPPHPI

SEQ ID NO: 2831491 - protein, 21 aa, Entamoeba invadens
SLITPFQWQHVFIPVLPVSLL

SEQ ID NO: 2831492 - protein, 23 aa, Entamoeba invadens
SLKYFIYVQLFYTTFFKLVGFIC

SEQ ID NO: 2831493 - protein, 17 aa, Entamoeba invadens
SLLLFLISTSSEICEAG

SEQ ID NO: 2831494 - protein, 23 aa, Entamoeba invadens
SLLMFFIMWLCLAGRICALYFYN

SEQ ID NO: 2831495 - protein, 23 aa, Entamoeba invadens
SLLMFFIMWLCLAGRICALYYYN

SEQ ID NO: 2831496 - protein, 29 aa, Entamoeba invadens
SLLVQLFFWVFYILAFFFPQIIIKTTPPD

SEQ ID NO: 2831497 - protein, 23 aa, Entamoeba invadens
SLPIFFAIFLLQCVLPTAVIYLN

SEQ ID NO: 2831498 - protein, 23 aa, Entamoeba invadens
SLTPILPCFLCDGGLMILSRMPL

SEQ ID NO: 2831499 - protein, 23 aa, Entamoeba invadens
SLYTLLSLLLPFVTPLFVFLIGS

SEQ ID NO: 2831500 - protein, 20 aa, Entamoeba invadens
SMMFWILYFNSPSAVFRITD

SEQ ID NO: 2831501 - protein, 22 aa, Entamoeba invadens
SMQFLYFLPFNHSPQNILHSGR

SEQ ID NO: 2831502 - protein, 17 aa, Entamoeba invadens
SMYFARMSKALFSRVTP

SEQ ID NO: 2831503 - protein, 17 aa, Entamoeba invadens
SNATMAIVSTSIVLLSC

SEQ ID NO: 2831504 - protein, 17 aa, Entamoeba invadens
SNDFYYLKCDLPAPINP

SEQ ID NO: 2831505 - protein, 18 aa, Entamoeba invadens
SNFFTLISWCFFSQQIQN

SEQ ID NO: 2831506 - protein, 24 aa, Entamoeba invadens
SNGINFFFPPLKLNSIFALKVTSD

SEQ ID NO: 2831507 - protein, 21 aa, Entamoeba invadens
SNHLKFVTFLFDSTKKIKTIH

SEQ ID NO: 2831508 - protein, 19 aa, Entamoeba invadens
SNPRLIYIYPYSSTSKFMN

SEQ ID NO: 2831509 - protein, 24 aa, Entamoeba invadens
SNVPLYFLYALTLFHFSSSLVGKI

SEQ ID NO: 2831510 - protein, 24 aa, Entamoeba invadens
SPAMTNFLFWGIGAIVYMVMYILG

SEQ ID NO: 2831511 - protein, 20 aa, Entamoeba invadens
SPMYIALTFVLILIWLLCYS

SEQ ID NO: 2831512 - protein, 23 aa, Entamoeba invadens
SPNGVFLNTLFSLLLTAFVGIGY

SEQ ID NO: 2831513 - protein, 23 aa, Entamoeba invadens
SPPVPWWAFLIIAVVVVFLVVVI

SEQ ID NO: 2831514 - protein, 18 aa, Entamoeba invadens
SPWKDQFPEWALLPKTSE

SEQ ID NO: 2831515 - protein, 17 aa, Entamoeba invadens
SQLLSLFFLLPNYPDNF

SEQ ID NO: 2831516 - protein, 45 aa, Entamoeba invadens
SQPEAWFIVILIVIILLIILLLVLAIYVLSRMYLIYDKRKRLSKK

SEQ ID NO: 2831517 - protein, 23 aa, Entamoeba invadens
SQTVWWVILIVVVFVVIVLFVLI

SEQ ID NO: 2831518 - protein, 18 aa, Entamoeba invadens
SRLLPYTLFRLGGAAILL

SEQ ID NO: 2831519 - protein, 18 aa, Entamoeba invadens
SRLVSCGCIPLLFKTLEN

SEQ ID NO: 2831520 - protein, 19 aa, Entamoeba invadens
SRRAFYRLGLFSLLLHEVM

SEQ ID NO: 2831521 - protein, 28 aa, Entamoeba invadens
SRRKWFCFVFLIGFVIFSFAIYYGDWKK

SEQ ID NO: 2831522 - protein, 19 aa, Entamoeba invadens
SRVIACKPGFYTQYFKLCN

SEQ ID NO: 2831523 - protein, 24 aa, Entamoeba invadens
SSAKNLWIKGYFKYLWSDSTIAVD

SEQ ID NO: 2831524 - protein, 25 aa, Entamoeba invadens
SSALLITVILLLLGSLLFGVITKLV

SEQ ID NO: 2831525 - protein, 44 aa, Entamoeba invadens
SSALRNFLFWGIGCIAYLLLYLFLLFLIVILYVRITQKIKKELD

SEQ ID NO: 2831526 - protein, 20 aa, Entamoeba invadens
SSFVIIIISLNWIRASQLFY

SEQ ID NO: 2831527 - protein, 24 aa, Entamoeba invadens
SSIFSVVFVLMGFLALTVVVFIVK

SEQ ID NO: 2831528 - protein, 27 aa, Entamoeba invadens
SSIIIAIVCVFVLILLVGFISVMYNKW

SEQ ID NO: 2831529 - protein, 25 aa, Entamoeba invadens
SSIKDKFYFFYKTSSLDLINSLVVD

SEQ ID NO: 2831530 - protein, 23 aa, Entamoeba invadens
SSKILLAIFFVLTGVTVAVVGFV

SEQ ID NO: 2831531 - protein, 27 aa, Entamoeba invadens
SSLDKKFWFYDPNGYPFFLLGTDHINF

SEQ ID NO: 2831532 - protein, 30 aa, Entamoeba invadens
SSSILFLPFLILLSLFYFELMRFYLSSSQN

SEQ ID NO: 2831533 - protein, 17 aa, Entamoeba invadens
SSSLWMRVPLYFVQQYP

SEQ ID NO: 2831534 - protein, 23 aa, Entamoeba invadens
SSSPVNRYFVWTPYLNVSGISKQ

SEQ ID NO: 2831535 - protein, 28 aa, Entamoeba invadens
SSTYQSTYLLWFFLKFLHLGGNLCDVEK

SEQ ID NO: 2831536 - protein, 28 aa, Entamoeba invadens
SSVFAFFVFVIIFGVLLFFSLRYKKVDI

SEQ ID NO: 2831537 - protein, 22 aa, Entamoeba invadens
SSVFLMFIYLLVLSLWNLFASV

SEQ ID NO: 2831538 - protein, 27 aa, Entamoeba invadens
SSYKWPYIKFIFKMSYAALFFTNKKTY

SEQ ID NO: 2831539 - protein, 24 aa, Entamoeba invadens
SSYPAYMVIPLDNPIMGNMCYILG

SEQ ID NO: 2831540 - protein, 23 aa, Entamoeba invadens
STAVFVILLFSYLFCYISLEDVE

SEQ ID NO: 2831541 - protein, 24 aa, Entamoeba invadens
STGLLFFFVFCAFWIGYIYGSKRV

SEQ ID NO: 2831542 - protein, 23 aa, Entamoeba invadens
STHLFMFSLLFWILGYIYINLNK

SEQ ID NO: 2831543 - protein, 26 aa, Entamoeba invadens
STITQTLLPSIFFTGTSLIVPTTNTQ

SEQ ID NO: 2831544 - protein, 26 aa, Entamoeba invadens
STKTPFLMWYFFSFKNNVPHMVNNKN

SEQ ID NO: 2831545 - protein, 25 aa, Entamoeba invadens
STKTPFLMWYFFSVKNNIPHMVNNK

SEQ ID NO: 2831546 - protein, 22 aa, Entamoeba invadens
STLTFFGVFAEFIIGFTIAAEQ

SEQ ID NO: 2831547 - protein, 23 aa, Entamoeba invadens
STLVFSLLLLFYSTLGYGIATLT

SEQ ID NO: 2831548 - protein, 25 aa, Entamoeba invadens
STNPSYFIYMYYLYVNITTLNLYRM

SEQ ID NO: 2831549 - protein, 24 aa, Entamoeba invadens
STNPTPLPILPKLKSFPLNFSRCG

SEQ ID NO: 2831550 - protein, 24 aa, Entamoeba invadens
STNSIMIILLAVLLFIQFSNSKLC

SEQ ID NO: 2831551 - protein, 18 aa, Entamoeba invadens
STRIPQFTFLSCGSLSLL

SEQ ID NO: 2831552 - protein, 23 aa, Entamoeba invadens
STSHLYTITYPKLYKRSFSNTLC

SEQ ID NO: 2831553 - protein, 22 aa, Entamoeba invadens
STYQYCHIILDDLKIISTYETI

SEQ ID NO: 2831554 - protein, 27 aa, Entamoeba invadens
SVFAIATYWFFYVYIWYMTYAQQLLRL

SEQ ID NO: 2831555 - protein, 20 aa, Entamoeba invadens
SVFFIIFPLSMITSVRASCP

SEQ ID NO: 2831556 - protein, 24 aa, Entamoeba invadens
SVFIIVLIIISIIVVTIIVLQKRK

SEQ ID NO: 2831557 - protein, 26 aa, Entamoeba invadens
SVGHPILHWPLFSGKMRKFALLLFGN

SEQ ID NO: 2831558 - protein, 18 aa, Entamoeba invadens
SVGILLQTFFSIILFCFI

SEQ ID NO: 2831559 - protein, 24 aa, Entamoeba invadens
SVIKLLFVFLITVLMIPVPPSLDI

SEQ ID NO: 2831560 - protein, 17 aa, Entamoeba invadens
SVIMAFVLALLLLIIFR

SEQ ID NO: 2831561 - protein, 33 aa, Entamoeba invadens
SVLFVIIVVVIILLIVFFWFVEKKLQKHRLTTV

SEQ ID NO: 2831562 - protein, 27 aa, Entamoeba invadens
SVLFVILVCVFFASAAWFKHEKVAVNM

SEQ ID NO: 2831563 - protein, 21 aa, Entamoeba invadens
SVLLLLIVVVIILVLIIVKVS

SEQ ID NO: 2831564 - protein, 26 aa, Entamoeba invadens
SVRARKKMVMTIYLATGFVKPIGLEN

SEQ ID NO: 2831565 - protein, 25 aa, Entamoeba invadens
SVTIYFLSFFFLKSYFDLHFVFSWQ

SEQ ID NO: 2831566 - protein, 23 aa, Entamoeba invadens
SVTSFFFTYAFLASFTGATRENM

SEQ ID NO: 2831567 - protein, 30 aa, Entamoeba invadens
SVVALFIILTIILLIYYFSRLINKVSPSES

SEQ ID NO: 2831568 - protein, 18 aa, Entamoeba invadens
SVYFYWLVAPVLVKELRA

SEQ ID NO: 2831569 - protein, 21 aa, Entamoeba invadens
SVYFYWLVIPVLMKNLGASPM

SEQ ID NO: 2831570 - protein, 17 aa, Entamoeba invadens
SYYVERLFSLYLPIMVG

SEQ ID NO: 2831571 - protein, 22 aa, Entamoeba invadens
TAIRVFDFIIWNGFDCGALTVI

SEQ ID NO: 2831572 - protein, 24 aa, Entamoeba invadens
TAKLMLEFIPLKKYFALLLVMFGV

SEQ ID NO: 2831573 - protein, 18 aa, Entamoeba invadens
TAKSPLAYVLLSKKLNYD

SEQ ID NO: 2831574 - protein, 23 aa, Entamoeba invadens
TAKTFYQTMYWINGIPSVAVEYT

SEQ ID NO: 2831575 - protein, 17 aa, Entamoeba invadens
TALLWICVWWQRWELKE

SEQ ID NO: 2831576 - protein, 18 aa, Entamoeba invadens
TCFLLYLFILFDCIVGET

SEQ ID NO: 2831577 - protein, 20 aa, Entamoeba invadens
TCQVLYYRPLNWKELGWKLC

SEQ ID NO: 2831578 - protein, 25 aa, Entamoeba invadens
TCSKRLFLQQPYAPGFWIKLSTSVD

SEQ ID NO: 2831579 - protein, 30 aa, Entamoeba invadens
TCSLLLALVMVLIIVVWFLSRKKTTSSRDR

SEQ ID NO: 2831580 - protein, 18 aa, Entamoeba invadens
TCSRCYYGYYLTSSTNTC

SEQ ID NO: 2831581 - protein, 26 aa, Entamoeba invadens
TCTFGYLCFLILVKWIHFIPNAPMIT

SEQ ID NO: 2831582 - protein, 18 aa, Entamoeba invadens
TCYLCDFTTLLKGVCNEM

SEQ ID NO: 2831583 - protein, 21 aa, Entamoeba invadens
TDKFFLYAPDPQSPLATKIEF

SEQ ID NO: 2831584 - protein, 21 aa, Entamoeba invadens
TDLFLFVLMKIVLTPKSKNIT

SEQ ID NO: 2831585 - protein, 17 aa, Entamoeba invadens
TDRLYRFDLFVAFDYIG

SEQ ID NO: 2831586 - protein, 23 aa, Entamoeba invadens
TEIWPIFLFLIIQGVGLAMFWSP

SEQ ID NO: 2831587 - protein, 28 aa, Entamoeba invadens
TELLSFDMLFFALLFIQSLSFVIGPTPN

SEQ ID NO: 2831588 - protein, 27 aa, Entamoeba invadens
TEMDYFIFILQFSLLATLLIYSFTKYT

SEQ ID NO: 2831589 - protein, 24 aa, Entamoeba invadens
TEPVFDPLIFFYARNIELLNQTKG

SEQ ID NO: 2831590 - protein, 17 aa, Entamoeba invadens
TEQVPLYRIPFIPSLFA

SEQ ID NO: 2831591 - protein, 18 aa, Entamoeba invadens
TERPHCILLFSDVILLIP

SEQ ID NO: 2831592 - protein, 21 aa, Entamoeba invadens
TESILILFFVFEQLNLQIRPK

SEQ ID NO: 2831593 - protein, 17 aa, Entamoeba invadens
TFGYGFFFLLSGSVALL

SEQ ID NO: 2831594 - protein, 19 aa, Entamoeba invadens
TFPAYYWHFKIGIKGTYGT

SEQ ID NO: 2831595 - protein, 22 aa, Entamoeba invadens
TFPFLICCILFWGINIVFIVYF

SEQ ID NO: 2831596 - protein, 19 aa, Entamoeba invadens
TFQFYTWHLLTSNDMLGCA

SEQ ID NO: 2831597 - protein, 22 aa, Entamoeba invadens
TFTTLYRVLTWSYLFIYLLACL

SEQ ID NO: 2831598 - protein, 19 aa, Entamoeba invadens
TFVIFVLLQFGLLACICMH

SEQ ID NO: 2831599 - protein, 17 aa, Entamoeba invadens
TGAIIFLLTFALKMFFA

SEQ ID NO: 2831600 - protein, 30 aa, Entamoeba invadens
TGIVLTVLILVILIIVVSGLLVYFLLIKKK

SEQ ID NO: 2831601 - protein, 23 aa, Entamoeba invadens
TGMWNICYLVLIGSIIYVFDNAI

SEQ ID NO: 2831602 - protein, 24 aa, Entamoeba invadens
TGNVFIFLLFLFISFLYTHTAQFH

SEQ ID NO: 2831603 - protein, 22 aa, Entamoeba invadens
THCNTCLPGFFKSDYYSCSACS

SEQ ID NO: 2831604 - protein, 18 aa, Entamoeba invadens
THLDFFKYFLSDKSKETQ

SEQ ID NO: 2831605 - protein, 17 aa, Entamoeba invadens
THSKFLFFDSTPLGRIL

SEQ ID NO: 2831606 - protein, 21 aa, Entamoeba invadens
THSMFLAFAMLYIGSVGSTKK

SEQ ID NO: 2831607 - protein, 20 aa, Entamoeba invadens
THSMFLAFSLLYLGAEGETK

SEQ ID NO: 2831608 - protein, 23 aa, Entamoeba invadens
TIEKVLSQPLFWSFKKRLDFLQK

SEQ ID NO: 2831609 - protein, 29 aa, Entamoeba invadens
TIHSKTPMWLILLIVFLGFDNIVQLFKSP

SEQ ID NO: 2831610 - protein, 25 aa, Entamoeba invadens
TIIAYLFPVLYLIQLIFSIAVICFF

SEQ ID NO: 2831611 - protein, 18 aa, Entamoeba invadens
TIIGWWDQVMQYKTLLII

SEQ ID NO: 2831612 - protein, 22 aa, Entamoeba invadens
TIILRLLLSTWFNKLFLHWSSD

SEQ ID NO: 2831613 - protein, 30 aa, Entamoeba invadens
TIMQNVSGWLLLAWWFFCVFKLRCHVCGDT

SEQ ID NO: 2831614 - protein, 18 aa, Entamoeba invadens
TIPTLIVLKIFKFWKSYL

SEQ ID NO: 2831615 - protein, 34 aa, Entamoeba invadens
TIQMYLQLYFQSFLMLRKSLLNEFLLKDLKKKGV

SEQ ID NO: 2831616 - protein, 20 aa, Entamoeba invadens
TIRMLLSIKLILFGCSDDPV

SEQ ID NO: 2831617 - protein, 32 aa, Entamoeba invadens
TISAFMTLMFPFVWQHVLIPLLPKSLVTYCAA

SEQ ID NO: 2831618 - protein, 17 aa, Entamoeba invadens
TISLLFLIYTMVIYLFN

SEQ ID NO: 2831619 - protein, 21 aa, Entamoeba invadens
TITYSLFPLIVALCCGLGCGA

SEQ ID NO: 2831620 - protein, 20 aa, Entamoeba invadens
TIVFIWIIFMFFTSYQSIRK

SEQ ID NO: 2831621 - protein, 25 aa, Entamoeba invadens
TIVIAFLVLLFLITGGMILTQPGFE

SEQ ID NO: 2831622 - protein, 22 aa, Entamoeba invadens
TIVVLWVLYLLRQRIKVLPSFP

SEQ ID NO: 2831623 - protein, 18 aa, Entamoeba invadens
TIVYFIYTWFYFNKAIYL

SEQ ID NO: 2831624 - protein, 19 aa, Entamoeba invadens
TIVYFIYTWFYFNKAIYLT

SEQ ID NO: 2831625 - protein, 19 aa, Entamoeba invadens
TIWFFQKYKIKFAIVFSLF

SEQ ID NO: 2831626 - protein, 35 aa, Entamoeba invadens
TKEMFWTLWMIFGMLNFLLFLLVVTCCIFLSTRLD

SEQ ID NO: 2831627 - protein, 23 aa, Entamoeba invadens
TKEPFYLISIVSFLFRYDNIVSL

SEQ ID NO: 2831628 - protein, 41 aa, Entamoeba invadens
TKKAVWWVIVLCLLVFLVLSIALLILVYLSFGWMYAKRVEK

SEQ ID NO: 2831629 - protein, 22 aa, Entamoeba invadens
TKKCIVFVILLLVVLCMAFYYF

SEQ ID NO: 2831630 - protein, 27 aa, Entamoeba invadens
TKTEIFMWTFWKRIGLGAFQYIGYQNV

SEQ ID NO: 2831631 - protein, 17 aa, Entamoeba invadens
TKTLSFNKLTLTPPTQV

SEQ ID NO: 2831632 - protein, 19 aa, Entamoeba invadens
TKVLLMQIAKFLQLPQSAD

SEQ ID NO: 2831633 - protein, 24 aa, Entamoeba invadens
TKVNLALILPLSIAGGLILIAVIL

SEQ ID NO: 2831634 - protein, 17 aa, Entamoeba invadens
TLAILQFLKNRKHAGTE

SEQ ID NO: 2831635 - protein, 24 aa, Entamoeba invadens
TLAYFQVYNYVPLRFLYSLLFVNK

SEQ ID NO: 2831636 - protein, 45 aa, Entamoeba invadens
TLCVKKVVWWVIFIVILLVLMLMVGTIVLVWFLVKRYIKAEGKTV

SEQ ID NO: 2831637 - protein, 18 aa, Entamoeba invadens
TLFDAFYILRSEDWYMHL

SEQ ID NO: 2831638 - protein, 19 aa, Entamoeba invadens
TLFKIATIKKLTFLENAKL

SEQ ID NO: 2831639 - protein, 17 aa, Entamoeba invadens
TLFLFSLALQDAREKDT

SEQ ID NO: 2831640 - protein, 31 aa, Entamoeba invadens
TLFLKVGVPILVIFFVIIFGTISVILLLIYL

SEQ ID NO: 2831641 - protein, 18 aa, Entamoeba invadens
TLGLFNIMRLPLIRFPKL

SEQ ID NO: 2831642 - protein, 37 aa, Entamoeba invadens
TLIITVVPLFLYFFGAFFRLHFFVAVIFPFAVIFACI

SEQ ID NO: 2831643 - protein, 23 aa, Entamoeba invadens
TLIVTFIPLVYYLITGDTMFKNW

SEQ ID NO: 2831644 - protein, 20 aa, Entamoeba invadens
TLMIRNYMMLILRGGELQKL

SEQ ID NO: 2831645 - protein, 17 aa, Entamoeba invadens
TLTLFQMLQRPLGFLPM

SEQ ID NO: 2831646 - protein, 23 aa, Entamoeba invadens
TLVALLIFLHKIMNLSFCFVSTT

SEQ ID NO: 2831647 - protein, 23 aa, Entamoeba invadens
TLVIIFLLYLHLKDKKKMINICV

SEQ ID NO: 2831648 - protein, 18 aa, Entamoeba invadens
TLVSLFVLVFLNKTKEMK

SEQ ID NO: 2831649 - protein, 25 aa, Entamoeba invadens
TLVTISCIFLFFVLIITVCLTIIIS

SEQ ID NO: 2831650 - protein, 21 aa, Entamoeba invadens
TLVWIICCVLCIIGLPCCACI

SEQ ID NO: 2831651 - protein, 29 aa, Entamoeba invadens
TLYLPSYLCLIPQLIYFNFSFIEVKDFND

SEQ ID NO: 2831652 - protein, 27 aa, Entamoeba invadens
TMATIFGIIFMLLKWIRDPLLVSGGLE

SEQ ID NO: 2831653 - protein, 18 aa, Entamoeba invadens
TMGISFFPTLPLNKDDMI

SEQ ID NO: 2831654 - protein, 30 aa, Entamoeba invadens
TMYECFMWKEAYPKSIFKFPWMIAEQVING

SEQ ID NO: 2831655 - protein, 19 aa, Entamoeba invadens
TMYLLISGGLFYVIVYIVL

SEQ ID NO: 2831656 - protein, 29 aa, Entamoeba invadens
TNCEKHVVWWFILIIVIIGVMVLSLIFTI

SEQ ID NO: 2831657 - protein, 23 aa, Entamoeba invadens
TNIPFQMVVALVYIFMVSPRHTR

SEQ ID NO: 2831658 - protein, 17 aa, Entamoeba invadens
TNKLPFNLFLYVDGLQL

SEQ ID NO: 2831659 - protein, 18 aa, Entamoeba invadens
TNLFAFSGFVPIGSYIIL

SEQ ID NO: 2831660 - protein, 21 aa, Entamoeba invadens
TNLQCALLAFLSIRANVIIAK

SEQ ID NO: 2831661 - protein, 24 aa, Entamoeba invadens
TNMLFMIVYINIMYALIIYTFSQN

SEQ ID NO: 2831662 - protein, 21 aa, Entamoeba invadens
TNPHIFKLFDGHLVKYCPEGI

SEQ ID NO: 2831663 - protein, 22 aa, Entamoeba invadens
TNPYNMFFGKTFTRFVRQEKYT

SEQ ID NO: 2831664 - protein, 26 aa, Entamoeba invadens
TNSRTMWFSILTMIIVVLLTLFQVNS

SEQ ID NO: 2831665 - protein, 24 aa, Entamoeba invadens
TNWARYVMLIQTALFKWLYSEVGG

SEQ ID NO: 2831666 - protein, 25 aa, Entamoeba invadens
TPAWIIIVVVFFDLGILAFALFVVL

SEQ ID NO: 2831667 - protein, 20 aa, Entamoeba invadens
TPFGFMKLLEKKLVGIHTFL

SEQ ID NO: 2831668 - protein, 25 aa, Entamoeba invadens
TPLIERLLLYLLYFWDRAGLPMAIK

SEQ ID NO: 2831669 - protein, 24 aa, Entamoeba invadens
TPMKYLNMDFYWGYSPFVNCSGNL

SEQ ID NO: 2831670 - protein, 39 aa, Entamoeba invadens
TQAEWWVILIIIISLILLIIIIILIVYFFTKRVLEKIHL

SEQ ID NO: 2831671 - protein, 18 aa, Entamoeba invadens
TQANFLWKILYDKIGSMG

SEQ ID NO: 2831672 - protein, 24 aa, Entamoeba invadens
TQAVWWVIFVCVFFRMIEHKRRKK

SEQ ID NO: 2831673 - protein, 22 aa, Entamoeba invadens
TQEMPRLFLRVKLMLDASKGIL

SEQ ID NO: 2831674 - protein, 23 aa, Entamoeba invadens
TQENDLMIIIFKTLLEEFRRVNE

SEQ ID NO: 2831675 - protein, 19 aa, Entamoeba invadens
TQRYNLFLHYLYPNAKDNE

SEQ ID NO: 2831676 - protein, 24 aa, Entamoeba invadens
TQYFHDYHFWSLPTVLWNFINSNQ

SEQ ID NO: 2831677 - protein, 18 aa, Entamoeba invadens
TQYYCNIFKWAIDANILA

SEQ ID NO: 2831678 - protein, 23 aa, Entamoeba invadens
TRGWFYSLLVLSTALFDKPPFKN

SEQ ID NO: 2831679 - protein, 17 aa, Entamoeba invadens
TSALLYWKPLFAEDLLL

SEQ ID NO: 2831680 - protein, 27 aa, Entamoeba invadens
TSDFLCKFLSLPRLPLPLFSALLHLTA

SEQ ID NO: 2831681 - protein, 31 aa, Entamoeba invadens
TSFKMEFWFVWKWIVLLFKREFEQPQLLLIW

SEQ ID NO: 2831682 - protein, 25 aa, Entamoeba invadens
TSKMARFWFLQRMDWLGAIVSVATV

SEQ ID NO: 2831683 - protein, 33 aa, Entamoeba invadens
TSKVDLFYLFFLLLPFLVLVVIIPLILCIIKGY

SEQ ID NO: 2831684 - protein, 22 aa, Entamoeba invadens
TSLIKLIFFKNAAFFLHLLWYA

SEQ ID NO: 2831685 - protein, 18 aa, Entamoeba invadens
TSPILIPQFPFNGVYQTA

SEQ ID NO: 2831686 - protein, 18 aa, Entamoeba invadens
TSQNQLLIYCEIPTILNV

SEQ ID NO: 2831687 - protein, 32 aa, Entamoeba invadens
TSRGFPYITFIILFMIFIVYTLVATLVLKRTK

SEQ ID NO: 2831688 - protein, 23 aa, Entamoeba invadens
TSSQFILYLFFEGILVPFLSQPV

SEQ ID NO: 2831689 - protein, 22 aa, Entamoeba invadens
TSYQLWLVPFYVGVLFSVITHV

SEQ ID NO: 2831690 - protein, 19 aa, Entamoeba invadens
TTCLLCKYGYHWDNNSCTR

SEQ ID NO: 2831691 - protein, 24 aa, Entamoeba invadens
TTEMKVFLFLLDGFGNYRTHFNFS

SEQ ID NO: 2831692 - protein, 18 aa, Entamoeba invadens
TTFSIFLLVMCFTPNHII

SEQ ID NO: 2831693 - protein, 18 aa, Entamoeba invadens
TTFYGYLVKKFLYKLTGA

SEQ ID NO: 2831694 - protein, 23 aa, Entamoeba invadens
TTFYRLCCYIIVYFSFMAKGQSS

SEQ ID NO: 2831695 - protein, 29 aa, Entamoeba invadens
TTIVIFIIIIVIVVLIYFLQKRRKEIEKR

SEQ ID NO: 2831696 - protein, 25 aa, Entamoeba invadens
TTIVIIFFLYLHLKEKKKMINVCIF

SEQ ID NO: 2831697 - protein, 19 aa, Entamoeba invadens
TTKILPELFLKIPMLIKAN

SEQ ID NO: 2831698 - protein, 17 aa, Entamoeba invadens
TTLFFYVMSIITALWVL

SEQ ID NO: 2831699 - protein, 19 aa, Entamoeba invadens
TTLFLLLLQYHCPILSKKL

SEQ ID NO: 2831700 - protein, 23 aa, Entamoeba invadens
TTLLFILLTMTLSITCDPGYFYP

SEQ ID NO: 2831701 - protein, 24 aa, Entamoeba invadens
TTLVIIIVLIFIGGGFEFVKAGRE

SEQ ID NO: 2831702 - protein, 17 aa, Entamoeba invadens
TTPSYLVSLYKFIFIVL

SEQ ID NO: 2831703 - protein, 23 aa, Entamoeba invadens
TTTYLLILLWISLFIYVMYIITF

SEQ ID NO: 2831704 - protein, 18 aa, Entamoeba invadens
TTVIILVVILFVKIFNHL

SEQ ID NO: 2831705 - protein, 17 aa, Entamoeba invadens
TTVTLVVLILVFNKKDD

SEQ ID NO: 2831706 - protein, 19 aa, Entamoeba invadens
TVCLAAYILQTNGTCLMSS

SEQ ID NO: 2831707 - protein, 19 aa, Entamoeba invadens
TVCVDCMYGYFLNTEYQCE

SEQ ID NO: 2831708 - protein, 18 aa, Entamoeba invadens
TVDLVWRVWGALISAEPF

SEQ ID NO: 2831709 - protein, 17 aa, Entamoeba invadens
TVFIAAYLLMKTKIYYS

SEQ ID NO: 2831710 - protein, 24 aa, Entamoeba invadens
TVGGFLFLRFITPILVMPKRFLSN

SEQ ID NO: 2831711 - protein, 19 aa, Entamoeba invadens
TVIPILRFILKPTQYTGLL

SEQ ID NO: 2831712 - protein, 28 aa, Entamoeba invadens
TVITVCGVLILIWFVVMVVVVMRRKHTD

SEQ ID NO: 2831713 - protein, 25 aa, Entamoeba invadens
TVIVLIVVIIIILITMIQKKKIAKK

SEQ ID NO: 2831714 - protein, 28 aa, Entamoeba invadens
TVKPTMNALWCLLVMLLIGVSSKTCEAG

SEQ ID NO: 2831715 - protein, 24 aa, Entamoeba invadens
TVSVPLFRLFILNHLFELSVEIYK

SEQ ID NO: 2831716 - protein, 28 aa, Entamoeba invadens
TVVLGFYFFIVVILFPIGVWLLLRKFHN

SEQ ID NO: 2831717 - protein, 17 aa, Entamoeba invadens
TWIVIFSIIHISLAISL

SEQ ID NO: 2831718 - protein, 18 aa, Entamoeba invadens
TWSYLFIYLLACLTHLMK

SEQ ID NO: 2831719 - protein, 18 aa, Entamoeba invadens
TYEPIAYCLIYNKDHTCK

SEQ ID NO: 2831720 - protein, 42 aa, Entamoeba invadens
TYIKYGGWFNFAMVVFFFFVSSFLLLASNFWLVLWTDPSKKD

SEQ ID NO: 2831721 - protein, 26 aa, Entamoeba invadens
TYLICQSFLLRMLYLGIYPLDCIQFD

SEQ ID NO: 2831722 - protein, 17 aa, Entamoeba invadens
VAALFVGFLIVCALLLT

SEQ ID NO: 2831723 - protein, 23 aa, Entamoeba invadens
VAATIIFGPIPFGADITLTNHSV

SEQ ID NO: 2831724 - protein, 18 aa, Entamoeba invadens
VAFIAAWFCQLPVYWEEP

SEQ ID NO: 2831725 - protein, 17 aa, Entamoeba invadens
VAIAVVVGVVFFLKKRN

SEQ ID NO: 2831726 - protein, 25 aa, Entamoeba invadens
VAIFVFLFIVLLLVVGLVLSGTMNV

SEQ ID NO: 2831727 - protein, 24 aa, Entamoeba invadens
VAIIILIPTIYLLRLYLKQKKVDK

SEQ ID NO: 2831728 - protein, 31 aa, Entamoeba invadens
VAIVLPIVFVMIFIVLIVVIFALIGFYIRNK

SEQ ID NO: 2831729 - protein, 24 aa, Entamoeba invadens
VASIILYIIIYTLVMFISGLSVRG

SEQ ID NO: 2831730 - protein, 38 aa, Entamoeba invadens
VAVIIIIITKKVRIFILLYFKMEFVFLLKKIDYNSDCE

SEQ ID NO: 2831731 - protein, 17 aa, Entamoeba invadens
VCFIVVLGAIMVLPLYP

SEQ ID NO: 2831732 - protein, 19 aa, Entamoeba invadens
VCGFFFPPLFLYTSNRYKN

SEQ ID NO: 2831733 - protein, 30 aa, Entamoeba invadens
VCGVGLWIILYIFLMIGFFARYNYLTDLIL

SEQ ID NO: 2831734 - protein, 32 aa, Entamoeba invadens
VCGVLFICIVLLILFVLYRYYEKRQIIIQYKR

SEQ ID NO: 2831735 - protein, 23 aa, Entamoeba invadens
VCILFIIVTIIITFIIIYTKRQE

SEQ ID NO: 2831736 - protein, 19 aa, Entamoeba invadens
VCNVCFPPYYVTAGKKSCS

SEQ ID NO: 2831737 - protein, 18 aa, Entamoeba invadens
VCQFIVFMIIFIDCYCNK

SEQ ID NO: 2831738 - protein, 25 aa, Entamoeba invadens
VCVIILFIFSLFTPIGALIGSYIIA

SEQ ID NO: 2831739 - protein, 17 aa, Entamoeba invadens
VDDEIFITLRYGKLRTL

SEQ ID NO: 2831740 - protein, 20 aa, Entamoeba invadens
VDFDTICSLPIDKPSRDLLC

SEQ ID NO: 2831741 - protein, 24 aa, Entamoeba invadens
VDPAYLLPLLYRLVNLYINNTKLK

SEQ ID NO: 2831742 - protein, 25 aa, Entamoeba invadens
VDSCTIPIPLKFVSSFTFGNIALTN

SEQ ID NO: 2831743 - protein, 22 aa, Entamoeba invadens
VDTLLDYLKRKIPFLVKLGGHW

SEQ ID NO: 2831744 - protein, 27 aa, Entamoeba invadens
VECVLTLFLFMIAFPNSLYLARGNHET

SEQ ID NO: 2831745 - protein, 29 aa, Entamoeba invadens
VEGKFDFCLPIPPSLYPNCKRLAFSTSKC

SEQ ID NO: 2831746 - protein, 29 aa, Entamoeba invadens
VEGKFDFCLPIPPTVYPNCKRLAFSTSKC

SEQ ID NO: 2831747 - protein, 22 aa, Entamoeba invadens
VEKNVFVFIILSYFLIMAGVVY

SEQ ID NO: 2831748 - protein, 18 aa, Entamoeba invadens
VETKLVFLVMLDKKFRML

SEQ ID NO: 2831749 - protein, 27 aa, Entamoeba invadens
VEVTMYILWVLFLITSIPSVVVYSMFY

SEQ ID NO: 2831750 - protein, 25 aa, Entamoeba invadens
VEWKSFLFCYLFLLISQLGTLLIPL

SEQ ID NO: 2831751 - protein, 19 aa, Entamoeba invadens
VFFINFLVDLATLMDFELV

SEQ ID NO: 2831752 - protein, 19 aa, Entamoeba invadens
VFGLLFAYYSTSSPHRISI

SEQ ID NO: 2831753 - protein, 18 aa, Entamoeba invadens
VFGVIIIGIIIIGIVWIF

SEQ ID NO: 2831754 - protein, 18 aa, Entamoeba invadens
VFGVLFYIMCAVVIAVVV

SEQ ID NO: 2831755 - protein, 23 aa, Entamoeba invadens
VFGWCDVYPKEIFKYPWKIADFV

SEQ ID NO: 2831756 - protein, 20 aa, Entamoeba invadens
VFILLLVVFVIVARTIILKN

SEQ ID NO: 2831757 - protein, 18 aa, Entamoeba invadens
VFITYFFIIKLPKIDLSV

SEQ ID NO: 2831758 - protein, 34 aa, Entamoeba invadens
VFKYGTYIILPFSIVILIILLVVTLITITTILIH

SEQ ID NO: 2831759 - protein, 17 aa, Entamoeba invadens
VFLFFSCVLSLVWCDAG

SEQ ID NO: 2831760 - protein, 23 aa, Entamoeba invadens
VFLTFFVLFLHICALYLYASGFL

SEQ ID NO: 2831761 - protein, 29 aa, Entamoeba invadens
VFLVFFSFIPLYYRFFVFIVRFSEQEILT

SEQ ID NO: 2831762 - protein, 27 aa, Entamoeba invadens
VFMFVVILVMIIWMTIVVLRNAIRNKA

SEQ ID NO: 2831763 - protein, 22 aa, Entamoeba invadens
VFSLKHCDILLTPYPTLPTILS

SEQ ID NO: 2831764 - protein, 18 aa, Entamoeba invadens
VFSYLILPVQRIPRYELF

SEQ ID NO: 2831765 - protein, 26 aa, Entamoeba invadens
VFTFPFKFLYYQYKLLTNVYFLINMI

SEQ ID NO: 2831766 - protein, 24 aa, Entamoeba invadens
VFVFFVLVFFIVQIQFLFNHQHLR

SEQ ID NO: 2831767 - protein, 18 aa, Entamoeba invadens
VFVVFLVFNILFGVLYGL

SEQ ID NO: 2831768 - protein, 22 aa, Entamoeba invadens
VFVVLSLWWFYKAVTFNGYVLK

SEQ ID NO: 2831769 - protein, 28 aa, Entamoeba invadens
VGFIVFIVLLIVLIIVIIYRIKLHKTEE

SEQ ID NO: 2831770 - protein, 25 aa, Entamoeba invadens
VGIGLLLLFLIIIVVIIVVMSKRNE

SEQ ID NO: 2831771 - protein, 27 aa, Entamoeba invadens
VGIPITIVILLLIIALVVVLITLQVIN

SEQ ID NO: 2831772 - protein, 34 aa, Entamoeba invadens
VGIPIVIVLILLLVIISIIIIIVLVFHKQEKTKK

SEQ ID NO: 2831773 - protein, 28 aa, Entamoeba invadens
VGIQSLYFAMLTTLGFTLLLEKPKKQKT

SEQ ID NO: 2831774 - protein, 23 aa, Entamoeba invadens
VGIWDFCWTLFGLPQIGLNSKLL

SEQ ID NO: 2831775 - protein, 30 aa, Entamoeba invadens
VGLGVLIVLFLFLLRRLFRKMQKRNIEQNY

SEQ ID NO: 2831776 - protein, 30 aa, Entamoeba invadens
VGLNVLIVLFLFLLRRLFRKMQKRNIEQNY

SEQ ID NO: 2831777 - protein, 26 aa, Entamoeba invadens
VGLVLLAVFLLIVIIAIIVVINIVMM

SEQ ID NO: 2831778 - protein, 27 aa, Entamoeba invadens
VHLIVMLLLWIFPFNRKFQNWVFNTCE

SEQ ID NO: 2831779 - protein, 21 aa, Entamoeba invadens
VHTTFPFKLLVTGGNFLFMET

SEQ ID NO: 2831780 - protein, 24 aa, Entamoeba invadens
VIAIFLIVMVILIIYLTNHIYHRK

SEQ ID NO: 2831781 - protein, 17 aa, Entamoeba invadens
VIALFIVILLLVLLFFK

SEQ ID NO: 2831782 - protein, 28 aa, Entamoeba invadens
VIAVITFLFILILFGLYKLLNKIEMKKL

SEQ ID NO: 2831783 - protein, 23 aa, Entamoeba invadens
VIAVLAVLIATLLFFVCQKRGNN

SEQ ID NO: 2831784 - protein, 19 aa, Entamoeba invadens
VIFIQTFIFFYHYFENGFS

SEQ ID NO: 2831785 - protein, 24 aa, Entamoeba invadens
VIFVIIVLIIITILIVFITKIVLD

SEQ ID NO: 2831786 - protein, 29 aa, Entamoeba invadens
VIGIPITVLILLVIFILLNKRQVKKKMQN

SEQ ID NO: 2831787 - protein, 23 aa, Entamoeba invadens
VIGSLFFGLLLGVAILLTGKFRF

SEQ ID NO: 2831788 - protein, 28 aa, Entamoeba invadens
VIIEAYFHLFPAFCLPWFVKQKKNIPML

SEQ ID NO: 2831789 - protein, 18 aa, Entamoeba invadens
VIIFIILPSYSLLFISVR

SEQ ID NO: 2831790 - protein, 27 aa, Entamoeba invadens
VIILCFLLIVFIFVFRYKKIDINIYKT

SEQ ID NO: 2831791 - protein, 20 aa, Entamoeba invadens
VIILFIIFVLSILVIALVFS

SEQ ID NO: 2831792 - protein, 18 aa, Entamoeba invadens
VIIVFIVAIILIVISMIQ

SEQ ID NO: 2831793 - protein, 26 aa, Entamoeba invadens
VIIVIIIMIIILVLVLHQLKIESDKM

SEQ ID NO: 2831794 - protein, 18 aa, Entamoeba invadens
VILFKRSTSVRINAYKMF

SEQ ID NO: 2831795 - protein, 23 aa, Entamoeba invadens
VILYTLFCFVAIIIAIVVIAQKL

SEQ ID NO: 2831796 - protein, 20 aa, Entamoeba invadens
VINIIFFVIAVMGVAFYSNE

SEQ ID NO: 2831797 - protein, 17 aa, Entamoeba invadens
VINKLFKFFVMKMSQNI

SEQ ID NO: 2831798 - protein, 18 aa, Entamoeba invadens
VIPVLYIINTFFTIDRKM

SEQ ID NO: 2831799 - protein, 17 aa, Entamoeba invadens
VIQLLLLLFNEWYQYNP

SEQ ID NO: 2831800 - protein, 25 aa, Entamoeba invadens
VISFLLFILFVLLIAYFPGLSNRDL

SEQ ID NO: 2831801 - protein, 22 aa, Entamoeba invadens
VITAIPLFYFVFASKSILYPWR

SEQ ID NO: 2831802 - protein, 25 aa, Entamoeba invadens
VITSLFVLLVTAVIYFLTKKLKKSS

SEQ ID NO: 2831803 - protein, 33 aa, Entamoeba invadens
VIVDGIIEEDIIALYLVFFALADNTLSEDDGIL

SEQ ID NO: 2831804 - protein, 27 aa, Entamoeba invadens
VIVFAILVMFVLFVALLLIASLVLLKK

SEQ ID NO: 2831805 - protein, 18 aa, Entamoeba invadens
VIVLLFTLSYLYNYFGNK

SEQ ID NO: 2831806 - protein, 33 aa, Entamoeba invadens
VIVLPIMCIVVILFIIILLKTIILIVFNKKKEN

SEQ ID NO: 2831807 - protein, 19 aa, Entamoeba invadens
VIVPFWKIWFEALQDKTLI

SEQ ID NO: 2831808 - protein, 21 aa, Entamoeba invadens
VIVSIIVLIIILLRMHHKKTK

SEQ ID NO: 2831809 - protein, 29 aa, Entamoeba invadens
VIVVLFFIVIICILLYYFTVHVVKAIHLK

SEQ ID NO: 2831810 - protein, 21 aa, Entamoeba invadens
VIVVVLVIAVIIFLIRHKENK

SEQ ID NO: 2831811 - protein, 21 aa, Entamoeba invadens
VIYHIMLFLCFNFYIISIFSK

SEQ ID NO: 2831812 - protein, 18 aa, Entamoeba invadens
VIYIYYFLTQLKPFFFSF

SEQ ID NO: 2831813 - protein, 18 aa, Entamoeba invadens
VIYLLCVFVLVSFGLVTI

SEQ ID NO: 2831814 - protein, 22 aa, Entamoeba invadens
VKFKSEFIVHFFGAVFVPNKVC

SEQ ID NO: 2831815 - protein, 29 aa, Entamoeba invadens
VKLKRAMWWKNVKLYLIAGAVLLIFLLVL

SEQ ID NO: 2831816 - protein, 23 aa, Entamoeba invadens
VKNWNPFFLTFSNLGLAPRINYG

SEQ ID NO: 2831817 - protein, 30 aa, Entamoeba invadens
VKQLYLFFLLYYILLFILILCRSASRSKDF

SEQ ID NO: 2831818 - protein, 43 aa, Entamoeba invadens
VKQNKYFLYIGIPVIIVCIVIIILTIIILTLFVLIFKKKEEKK

SEQ ID NO: 2831819 - protein, 45 aa, Entamoeba invadens
VKQNKYFLYIGIPVIIVCIVIIILTIIILTLFVLIFKKKEEKKMT

SEQ ID NO: 2831820 - protein, 33 aa, Entamoeba invadens
VLAIVLPIIFAIILIVVIIIAIGCVLFYIHYKK

SEQ ID NO: 2831821 - protein, 31 aa, Entamoeba invadens
VLCFGYLLYFLLLLFIVCVFYRKLNQKIAEE

SEQ ID NO: 2831822 - protein, 18 aa, Entamoeba invadens
VLCLISFLLLIGCGVAAI

SEQ ID NO: 2831823 - protein, 32 aa, Entamoeba invadens
VLCVFVLLCVMLGIIFLAFYFLKKSMKNQRPK

SEQ ID NO: 2831824 - protein, 17 aa, Entamoeba invadens
VLFLCFFSRALNVFPIS

SEQ ID NO: 2831825 - protein, 18 aa, Entamoeba invadens
VLFLLSKPVSKGTISPLS

SEQ ID NO: 2831826 - protein, 25 aa, Entamoeba invadens
VLGSFLIIFIFVFRYKKIDINIYKT

SEQ ID NO: 2831827 - protein, 25 aa, Entamoeba invadens
VLGTLLLFIFLFVGIWIVLFLAKLD

SEQ ID NO: 2831828 - protein, 24 aa, Entamoeba invadens
VLGWVHSFIFWKYAVLMYVAGQQL

SEQ ID NO: 2831829 - protein, 17 aa, Entamoeba invadens
VLIFKKKEEKKMTNICV

SEQ ID NO: 2831830 - protein, 26 aa, Entamoeba invadens
VLIGCLLCFVISFLLVRFAKIGFVKA

SEQ ID NO: 2831831 - protein, 20 aa, Entamoeba invadens
VLILILQVFTMLGFYVATQT

SEQ ID NO: 2831832 - protein, 19 aa, Entamoeba invadens
VLISPRPLEWIHNNRIPLF

SEQ ID NO: 2831833 - protein, 18 aa, Entamoeba invadens
VLKMLYFAIGTTVATFLN

SEQ ID NO: 2831834 - protein, 18 aa, Entamoeba invadens
VLLFLLDLVYFFVVNKAS

SEQ ID NO: 2831835 - protein, 24 aa, Entamoeba invadens
VLLIGLILAFFFASLKIMKVQKMK

SEQ ID NO: 2831836 - protein, 21 aa, Entamoeba invadens
VLLILILVAIYFLRKAMRYTT

SEQ ID NO: 2831837 - protein, 17 aa, Entamoeba invadens
VLLLILVISIIVAIIVW

SEQ ID NO: 2831838 - protein, 18 aa, Entamoeba invadens
VLLVLLVNTFLLGFAPFS

SEQ ID NO: 2831839 - protein, 23 aa, Entamoeba invadens
VLNILLFLVLFARLWAFIDQKTG

SEQ ID NO: 2831840 - protein, 20 aa, Entamoeba invadens
VLSFVLFLDFLYLDVNMLRL

SEQ ID NO: 2831841 - protein, 17 aa, Entamoeba invadens
VLSFVTFIIFLLIVGYF

SEQ ID NO: 2831842 - protein, 29 aa, Entamoeba invadens
VLSIILPIIFCILMVVIIIITISCILFYI

SEQ ID NO: 2831843 - protein, 25 aa, Entamoeba invadens
VLSVSFFVGFLVLVFLIFFTDKESP

SEQ ID NO: 2831844 - protein, 26 aa, Entamoeba invadens
VLVDLVFFLPIIAFVLYVFGAFCKCY

SEQ ID NO: 2831845 - protein, 18 aa, Entamoeba invadens
VLVFFFILGISYVSERKL

SEQ ID NO: 2831846 - protein, 19 aa, Entamoeba invadens
VLVLFITIIIIYFTVKLDR

SEQ ID NO: 2831847 - protein, 17 aa, Entamoeba invadens
VLYALIRLPLGTSLDMQ

SEQ ID NO: 2831848 - protein, 24 aa, Entamoeba invadens
VLYEGKCIFAIRDCLKYLSVDVCE

SEQ ID NO: 2831849 - protein, 26 aa, Entamoeba invadens
VMALGQFWFFYVFKIYMKYAKQLLRL

SEQ ID NO: 2831850 - protein, 25 aa, Entamoeba invadens
VMCVLIVFIILIVSLVIVTKNILKK

SEQ ID NO: 2831851 - protein, 28 aa, Entamoeba invadens
VMSTWTYLILINLITFLITLHSMVYFVT

SEQ ID NO: 2831852 - protein, 24 aa, Entamoeba invadens
VMTQGQMFPWVIAPAAKIIVSDGS

SEQ ID NO: 2831853 - protein, 20 aa, Entamoeba invadens
VMVILFMTVVIITVALLLLF

SEQ ID NO: 2831854 - protein, 27 aa, Entamoeba invadens
VMVVAILILIFILYKIISKYIRNKKLD

SEQ ID NO: 2831855 - protein, 18 aa, Entamoeba invadens
VMVWDAPYQGSLFKYPWN

SEQ ID NO: 2831856 - protein, 18 aa, Entamoeba invadens
VNAFLLLRVLLLKCSFTR

SEQ ID NO: 2831857 - protein, 24 aa, Entamoeba invadens
VNAPFLFMGGLFLGAAGVFVRPFD

SEQ ID NO: 2831858 - protein, 17 aa, Entamoeba invadens
VNFCILLARIIFNKEKI

SEQ ID NO: 2831859 - protein, 26 aa, Entamoeba invadens
VNGLFFITFFRFILLNFTHFKRNSFF

SEQ ID NO: 2831860 - protein, 23 aa, Entamoeba invadens
VNITLLFNYFSIKFSFGILTVTD

SEQ ID NO: 2831861 - protein, 42 aa, Entamoeba invadens
VNLALIIPLVVVGLLLIIIVIAIIIFFVWRRKRKTMKEREKE

SEQ ID NO: 2831862 - protein, 18 aa, Entamoeba invadens
VNSSQSIFTILLFAVFLI

SEQ ID NO: 2831863 - protein, 23 aa, Entamoeba invadens
VNTLILRMLYITLGSTFGKFLYR

SEQ ID NO: 2831864 - protein, 30 aa, Entamoeba invadens
VPIVSVFIIVLIIIGIIIITIFVIQKRKET

SEQ ID NO: 2831865 - protein, 18 aa, Entamoeba invadens
VPLHVYWQYIKSGSLLMF

SEQ ID NO: 2831866 - protein, 19 aa, Entamoeba invadens
VPLHVYWQYIKSGSLLMFF

SEQ ID NO: 2831867 - protein, 17 aa, Entamoeba invadens
VPLIVFVVFLVFNILFG

SEQ ID NO: 2831868 - protein, 28 aa, Entamoeba invadens
VPYVFLFFILFYLCFFLHTNGRHRFVYE

SEQ ID NO: 2831869 - protein, 27 aa, Entamoeba invadens
VQATYQLFVLLFLLYCGRYITFLGAPC

SEQ ID NO: 2831870 - protein, 29 aa, Entamoeba invadens
VQCRLPLFTLFFLLFFLQRVFSMCPQGYF

SEQ ID NO: 2831871 - protein, 27 aa, Entamoeba invadens
VQPEKWYLPRRLTINTLLKTPNIVLCE

SEQ ID NO: 2831872 - protein, 18 aa, Entamoeba invadens
VQQKLHFTELLSVELLPL

SEQ ID NO: 2831873 - protein, 19 aa, Entamoeba invadens
VQYLSLFYHVFLNKALRAK

SEQ ID NO: 2831874 - protein, 25 aa, Entamoeba invadens
VRAYKWIITTLFPSFFWVLEDNIHE

SEQ ID NO: 2831875 - protein, 27 aa, Entamoeba invadens
VRGPDKMLLTIMGVCLFIGVGSIIAMI

SEQ ID NO: 2831876 - protein, 20 aa, Entamoeba invadens
VRRPFWLNRILRMRGRRWRG

SEQ ID NO: 2831877 - protein, 28 aa, Entamoeba invadens
VSAVAILFFIILLITIVLIIFNKKKEKT

SEQ ID NO: 2831878 - protein, 25 aa, Entamoeba invadens
VSCAIFVFFIIFVGAALIVGLVVRS

SEQ ID NO: 2831879 - protein, 36 aa, Entamoeba invadens
VSCVLISLFLILIGAIIVVLLLWYFKKPTTKKDEKT

SEQ ID NO: 2831880 - protein, 32 aa, Entamoeba invadens
VSEAVWWVILLCVFFVVILLVLLVVLTTVIIN

SEQ ID NO: 2831881 - protein, 23 aa, Entamoeba invadens
VSHKNYFMIIGVPVIVVVLVILI

SEQ ID NO: 2831882 - protein, 25 aa, Entamoeba invadens
VSIIIVLIYFLLMKKQEEVKMRNIC

SEQ ID NO: 2831883 - protein, 26 aa, Entamoeba invadens
VSKAVWWIILIIVIFCLLMIVLVTTT

SEQ ID NO: 2831884 - protein, 23 aa, Entamoeba invadens
VSLSFFVWYLHEVQSLFKILPNS

SEQ ID NO: 2831885 - protein, 23 aa, Entamoeba invadens
VSMFWFMWLMLMSQLWQMSTQMV

SEQ ID NO: 2831886 - protein, 22 aa, Entamoeba invadens
VSQPFIFLWSKLPEIVRFSIKN

SEQ ID NO: 2831887 - protein, 24 aa, Entamoeba invadens
VSVFNYLMYLLQQIFNFILVVFAF

SEQ ID NO: 2831888 - protein, 32 aa, Entamoeba invadens
VSVLVLFIFFLSCVFVLVLMLFVITLKPSKYR

SEQ ID NO: 2831889 - protein, 18 aa, Entamoeba invadens
VTFCLLMIVLVTTTFVFL

SEQ ID NO: 2831890 - protein, 24 aa, Entamoeba invadens
VTFISLTTLLLFSATFYALVFNEK

SEQ ID NO: 2831891 - protein, 26 aa, Entamoeba invadens
VTGRFPFLWIFFVLAAICFWMSHQFS

SEQ ID NO: 2831892 - protein, 19 aa, Entamoeba invadens
VTLLVIIAFIILVGIVIGV

SEQ ID NO: 2831893 - protein, 18 aa, Entamoeba invadens
VTLSVIMAFVLALLLLII

SEQ ID NO: 2831894 - protein, 27 aa, Entamoeba invadens
VTLVVIILIVVIIIVVILWLQNQKQKK

SEQ ID NO: 2831895 - protein, 29 aa, Entamoeba invadens
VTLVVIVLIVVIIIVVILWLQNQKQKKKE

SEQ ID NO: 2831896 - protein, 21 aa, Entamoeba invadens
VTMHIFFPTAIPDDLFSFCLL

SEQ ID NO: 2831897 - protein, 27 aa, Entamoeba invadens
VTSVIVFIFILGLISLLLYFALRYKKA

SEQ ID NO: 2831898 - protein, 22 aa, Entamoeba invadens
VVCVVVFVIIIITTVTLVVLIL

SEQ ID NO: 2831899 - protein, 26 aa, Entamoeba invadens
VVDTSYIYLFEPLENKYFLIKSPVIP

SEQ ID NO: 2831900 - protein, 33 aa, Entamoeba invadens
VVEKFEFPMYMIAVIIIFVLVLAVIVALLIAYV

SEQ ID NO: 2831901 - protein, 33 aa, Entamoeba invadens
VVFAVCTVIVLVLLILFVIYAKLVLLKNRKNNK

SEQ ID NO: 2831902 - protein, 18 aa, Entamoeba invadens
VVFIVILAILIFVLTFLL

SEQ ID NO: 2831903 - protein, 27 aa, Entamoeba invadens
VVGICFFFIVFITIALVLLFVVLRRNK

SEQ ID NO: 2831904 - protein, 26 aa, Entamoeba invadens
VVGKFPFIWIFLVFASICFWMSHQFA

SEQ ID NO: 2831905 - protein, 18 aa, Entamoeba invadens
VVGSLAFWVICCSVILII

SEQ ID NO: 2831906 - protein, 22 aa, Entamoeba invadens
VVGSYLIFYFVVCIWVFVAHHK

SEQ ID NO: 2831907 - protein, 36 aa, Entamoeba invadens
VVGVPISVVLLLVLLIVCVIVTILYILMKRKEKVKM

SEQ ID NO: 2831908 - protein, 23 aa, Entamoeba invadens
VVHNIIVLLYHKLSHRLDFFQEQ

SEQ ID NO: 2831909 - protein, 19 aa, Entamoeba invadens
VVIAGILVVIFLKTKKAGY

SEQ ID NO: 2831910 - protein, 35 aa, Entamoeba invadens
VVIGIPIALIIIIIIFVFIVLYLALKIHQRRIKHK

SEQ ID NO: 2831911 - protein, 17 aa, Entamoeba invadens
VVIIFAILWFPLLLMSS

SEQ ID NO: 2831912 - protein, 24 aa, Entamoeba invadens
VVIITVALLLLFKRKEDLLVENVC

SEQ ID NO: 2831913 - protein, 26 aa, Entamoeba invadens
VVIIVIILIMILFNYLLQRKHEKKLE

SEQ ID NO: 2831914 - protein, 20 aa, Entamoeba invadens
VVILFLLVFAILASGYVFYD

SEQ ID NO: 2831915 - protein, 20 aa, Entamoeba invadens
VVILVIIFAIILIVISMIQK

SEQ ID NO: 2831916 - protein, 34 aa, Entamoeba invadens
VVIVIPILVFLIILIIVFVIIVIIVFKVTRYKAD

SEQ ID NO: 2831917 - protein, 20 aa, Entamoeba invadens
VVKSPLFLGIWKFVVWDSMD

SEQ ID NO: 2831918 - protein, 19 aa, Entamoeba invadens
VVLFVVLLIVIAISIILLF

SEQ ID NO: 2831919 - protein, 20 aa, Entamoeba invadens
VVLILIVSIIIVLIYFLLMK

SEQ ID NO: 2831920 - protein, 18 aa, Entamoeba invadens
VVLLILTITLLIIILFFI

SEQ ID NO: 2831921 - protein, 17 aa, Entamoeba invadens
VVLLILTVTLLIVILFY

SEQ ID NO: 2831922 - protein, 18 aa, Entamoeba invadens
VVLLLIILLIVIVVIIKM

SEQ ID NO: 2831923 - protein, 29 aa, Entamoeba invadens
VVLPIVFVVIFIVLVVVTLALIGFYIRNK

SEQ ID NO: 2831924 - protein, 29 aa, Entamoeba invadens
VVLPIVFVVIFIVLVVVTLALIVFYIRNK

SEQ ID NO: 2831925 - protein, 22 aa, Entamoeba invadens
VVLSFIVFILFVLITPTQHDLS

SEQ ID NO: 2831926 - protein, 17 aa, Entamoeba invadens
VVLSLPLFWDCNKKLHF

SEQ ID NO: 2831927 - protein, 24 aa, Entamoeba invadens
VVLTLLFLVFLSVVTYTNFYLFNK

SEQ ID NO: 2831928 - protein, 22 aa, Entamoeba invadens
VVLVALFFLTIAVVGVIISHRQ

SEQ ID NO: 2831929 - protein, 18 aa, Entamoeba invadens
VVLVPRKWRKTKDKVLLG

SEQ ID NO: 2831930 - protein, 24 aa, Entamoeba invadens
VVMNCLFIVWIYWNRYDIEGWKKL

SEQ ID NO: 2831931 - protein, 22 aa, Entamoeba invadens
VVNAFDLILRKGIVGQIYNIGT

SEQ ID NO: 2831932 - protein, 32 aa, Entamoeba invadens
VVSIFFLSVFCIILLLALLIGSAVLISYNVIK

SEQ ID NO: 2831933 - protein, 26 aa, Entamoeba invadens
VVSILIIIIIIIIVITVIIIQRRKRK

SEQ ID NO: 2831934 - protein, 26 aa, Entamoeba invadens
VVVCILLIILITTILFIIIKIVIKNI

SEQ ID NO: 2831935 - protein, 30 aa, Entamoeba invadens
VVVCILLIILITTILFIIIKIVIKNIIMKK

SEQ ID NO: 2831936 - protein, 17 aa, Entamoeba invadens
VVVIIAILVLIIVLVSF

SEQ ID NO: 2831937 - protein, 23 aa, Entamoeba invadens
VVVLLLVLIFFKSLLVALRVVFT

SEQ ID NO: 2831938 - protein, 31 aa, Entamoeba invadens
VVVLPIFCILLLVIILFIIIITTLIVIHRNH

SEQ ID NO: 2831939 - protein, 20 aa, Entamoeba invadens
VVVSCWFLNLFRTKKTKLIY

SEQ ID NO: 2831940 - protein, 26 aa, Entamoeba invadens
VVYQLFILLTLLFFGSLMSIINAPCG

SEQ ID NO: 2831941 - protein, 17 aa, Entamoeba invadens
VWEWRTFHFITISIFLF

SEQ ID NO: 2831942 - protein, 18 aa, Entamoeba invadens
VWLAFVTMIIFLYVKYHK

SEQ ID NO: 2831943 - protein, 25 aa, Entamoeba invadens
VWVGMFLLILFVFYPALPPKVTPQT

SEQ ID NO: 2831944 - protein, 19 aa, Entamoeba invadens
VYFGNWTRYFLTCKDYPMI

SEQ ID NO: 2831945 - protein, 18 aa, Entamoeba invadens
VYIVRRWFALKDNLCYKC

SEQ ID NO: 2831946 - protein, 21 aa, Entamoeba invadens
VYSPHMFLFWGFGSVGVLSLY

SEQ ID NO: 2831947 - protein, 23 aa, Entamoeba invadens
VYVLRSIARFILYVYKNVRHVFV

SEQ ID NO: 2831948 - protein, 17 aa, Entamoeba invadens
WCGPGQYLLIDSCLICL

SEQ ID NO: 2831949 - protein, 19 aa, Entamoeba invadens
WCKAYPTETFKFPWKIAEF

SEQ ID NO: 2831950 - protein, 23 aa, Entamoeba invadens
WDSMYLHLYHNYPGRLDFEIKNP

SEQ ID NO: 2831951 - protein, 25 aa, Entamoeba invadens
WFDNVTINLFLRTIKNFPLIFTYNV

SEQ ID NO: 2831952 - protein, 19 aa, Entamoeba invadens
WFNFAMVVFFFFVSSFLLL

SEQ ID NO: 2831953 - protein, 20 aa, Entamoeba invadens
WFVVIVVIICLFIFVGVIAG

SEQ ID NO: 2831954 - protein, 31 aa, Entamoeba invadens
WGVGSISYFILYMLILIISLGVYIKLTRVIK

SEQ ID NO: 2831955 - protein, 22 aa, Entamoeba invadens
WHQKVPFFWTYKPYYEPRTLRM

SEQ ID NO: 2831956 - protein, 26 aa, Entamoeba invadens
WHYIILYLVALLLNLPLIIPKSVKFL

SEQ ID NO: 2831957 - protein, 18 aa, Entamoeba invadens
WIPRILFFLLFFVSVEVT

SEQ ID NO: 2831958 - protein, 24 aa, Entamoeba invadens
WISCIGFCFLVLLLTLLLLYLDVL

SEQ ID NO: 2831959 - protein, 25 aa, Entamoeba invadens
WKGFMLHFFFCFLHKWVASLFGNHL

SEQ ID NO: 2831960 - protein, 18 aa, Entamoeba invadens
WKLTFVVKLLEIVMDWYA

SEQ ID NO: 2831961 - protein, 21 aa, Entamoeba invadens
WKNVKLWIILGVVVAIIVIAI

SEQ ID NO: 2831962 - protein, 17 aa, Entamoeba invadens
WLFRGKSLLPFTWIAGI

SEQ ID NO: 2831963 - protein, 22 aa, Entamoeba invadens
WLQVRILRILRYIPPKKGAEEN

SEQ ID NO: 2831964 - protein, 30 aa, Entamoeba invadens; identical to SEQ ID NO: 2808662

SEQ ID NO: 2831965 - protein, 19 aa, Entamoeba invadens
WMPIINTVFSQRIELVWKG

SEQ ID NO: 2831966 - protein, 17 aa, Entamoeba invadens
WMRVPLYFVQQYPRREQ

SEQ ID NO: 2831967 - protein, 18 aa, Entamoeba invadens
WNEIFLIHFKTNNLMKVV

SEQ ID NO: 2831968 - protein, 17 aa, Entamoeba invadens
WNPFFLTFDNLGLTPRI

SEQ ID NO: 2831969 - protein, 23 aa, Entamoeba invadens
WNPLFIVYVLLLCFISRAFNIFP

SEQ ID NO: 2831970 - protein, 21 aa, Entamoeba invadens
WNTLFYLPDFTLPPDNSFIWR

SEQ ID NO: 2831971 - protein, 18 aa, Entamoeba invadens
WSCFLLLLQYYINSQKRL

SEQ ID NO: 2831972 - protein, 30 aa, Entamoeba invadens
WSGPFLFFLHWFALFFQFIFEIFWPKDTME

SEQ ID NO: 2831973 - protein, 17 aa, Entamoeba invadens
WSMAYPKEQFVFPWDIA

SEQ ID NO: 2831974 - protein, 18 aa, Entamoeba invadens
WTNAYPKEYFKFPWTIAE

SEQ ID NO: 2831975 - protein, 18 aa, Entamoeba invadens
WVICCSVILIINKFRNPT

SEQ ID NO: 2831976 - protein, 34 aa, Entamoeba invadens
WVVSLCIIFFFILLAILIFLIFMVFVAFSNHNEK

SEQ ID NO: 2831977 - protein, 17 aa, Entamoeba invadens
WVYFNYSLQIFEQPKHH

SEQ ID NO: 2831978 - protein, 18 aa, Entamoeba invadens
WVYTWTVTILMWASCWRK

SEQ ID NO: 2831979 - protein, 25 aa, Entamoeba invadens
WWGLGILIYEMLFGAVPFFSEDIQE

SEQ ID NO: 2831980 - protein, 19 aa, Entamoeba invadens
WWRITDLVDYFIIAVTIVV

SEQ ID NO: 2831981 - protein, 18 aa, Entamoeba invadens
WWVIKHLYELFLFVKGTE

SEQ ID NO: 2831982 - protein, 21 aa, Entamoeba invadens
WWVILIVVLIVILVVILVAVI

SEQ ID NO: 2831983 - protein, 19 aa, Entamoeba invadens
WYAYIIRYLILAFPLVNLT

SEQ ID NO: 2831984 - protein, 20 aa, Entamoeba invadens
WYLLMYPIFLKFIKPNTHLF

SEQ ID NO: 2831985 - protein, 19 aa, Entamoeba invadens
WYSVIFAPDKFWTFIREYE

SEQ ID NO: 2831986 - protein, 21 aa, Entamoeba invadens
YAFFIGVLAVYYFVLKNGGLS

SEQ ID NO: 2831987 - protein, 21 aa, Entamoeba invadens
YALAFLIIRIFISLFTIIAII

SEQ ID NO: 2831988 - protein, 20 aa, Entamoeba invadens
YAPLSSMYFARMSKALFSRV

SEQ ID NO: 2831989 - protein, 43 aa, Entamoeba invadens
YCEAHVVWWVVLLIILFFILLVFSIITLIIYILRVLTDRKRRK

SEQ ID NO: 2831990 - protein, 38 aa, Entamoeba invadens
YCEKRAVWWVILVIVLFILFVLTFLIIVLVFSVKNVLK

SEQ ID NO: 2831991 - protein, 30 aa, Entamoeba invadens
YCEKSPVWWVIFLIVIFCLVILVFVLTLII

SEQ ID NO: 2831992 - protein, 27 aa, Entamoeba invadens
YCEQHVVWWVIFIAIVFVIAVITFLFI

SEQ ID NO: 2831993 - protein, 23 aa, Entamoeba invadens
YCISCVNGYYWDKQILECRRCED

SEQ ID NO: 2831994 - protein, 34 aa, Entamoeba invadens
YCISKAVWWVILILAIFVIIIVTLILVATSYILK

SEQ ID NO: 2831995 - protein, 43 aa, Entamoeba invadens
YCKYKVPVWFIIVIIIVILLFISIVLILIFFIVNFLVRKKYSE

SEQ ID NO: 2831996 - protein, 28 aa, Entamoeba invadens
YCLRHSVWWVIFICVMFLVGVTSLMVLI

SEQ ID NO: 2831997 - protein, 25 aa, Entamoeba invadens
YCMNSPVWWVILLAVIGGVVLLIGL

SEQ ID NO: 2831998 - protein, 36 aa, Entamoeba invadens
YCNSHVVWWVILIGVLLIIVIFIVTTLVIVLIVKHV

SEQ ID NO: 2831999 - protein, 33 aa, Entamoeba invadens
YCNSKAVWWVILIIVLFILLVVIIVIILIMILF

SEQ ID NO: 2832000 - protein, 46 aa, Entamoeba invadens
YCNSKAVWWVILIIVLFLLLVVIIVIILIMILFNYLLQRKHEKKLE

SEQ ID NO: 2832001 - protein, 36 aa, Entamoeba invadens
YCQEAIIWWVILIIVLFIIFVTIFLVNGIVLASKFI

SEQ ID NO: 2832002 - protein, 19 aa, Entamoeba invadens
YCQRRIRLFVSYSKYSFRL

SEQ ID NO: 2832003 - protein, 29 aa, Entamoeba invadens
YCSKTAVWWLILLIVVIVISILVLVIVLV

SEQ ID NO: 2832004 - protein, 29 aa, Entamoeba invadens
YCVTKAVWWVIFIIVLIVVLLLIILLIVI

SEQ ID NO: 2832005 - protein, 35 aa, Entamoeba invadens
YCYLKAVWWVFFISSLIFVIILVVALVIIKQIGEG

SEQ ID NO: 2832006 - protein, 26 aa, Entamoeba invadens
YDALITAPLILLYARSRKITGASLRC

SEQ ID NO: 2832007 - protein, 17 aa, Entamoeba invadens
YDICRFDFIGGKTITFR

SEQ ID NO: 2832008 - protein, 26 aa, Entamoeba invadens
YDIETLYVIFFFILKNLRDTLIDQWL

SEQ ID NO: 2832009 - protein, 33 aa, Entamoeba invadens
YDKLLELFLYSIGMLFTIYFYAGLLLSSKEKLS

SEQ ID NO: 2832010 - protein, 25 aa, Entamoeba invadens
YDKNRFIFLSNFLLDLALEFGYFFD

SEQ ID NO: 2832011 - protein, 20 aa, Entamoeba invadens
YDMVFSMLYFPEIQTKFENI

SEQ ID NO: 2832012 - protein, 25 aa, Entamoeba invadens
YEALIWGEAYPKQKFKFAWSIADFV

SEQ ID NO: 2832013 - protein, 25 aa, Entamoeba invadens
YEALIWGEAYPKQRFKFAWSIADFV

SEQ ID NO: 2832014 - protein, 21 aa, Entamoeba invadens
YECFIWQRPFLDKGFKYPWNI

SEQ ID NO: 2832015 - protein, 18 aa, Entamoeba invadens
YECFVWGEAYPKSTFKFP

SEQ ID NO: 2832016 - protein, 26 aa, Entamoeba invadens
YECLGWCNAYPKTFFKFPWKIAEFVT

SEQ ID NO: 2832017 - protein, 28 aa, Entamoeba invadens
YECLGWCNAYPKTFFKFPWKIAEFVTSG

SEQ ID NO: 2832018 - protein, 23 aa, Entamoeba invadens
YECLIWEEPYPKQKFKFAWSVAD

SEQ ID NO: 2832019 - protein, 18 aa, Entamoeba invadens
YECLSWSLAYQPPQFKFP

SEQ ID NO: 2832020 - protein, 28 aa, Entamoeba invadens
YEGGYDIFYYLAMQPWRHFVWTRKEGDT

SEQ ID NO: 2832021 - protein, 19 aa, Entamoeba invadens
YEIIVLPAMKFIGALSTKS

SEQ ID NO: 2832022 - protein, 29 aa, Entamoeba invadens
YENLWMFGGFYFLSFLWMIAGMLYFKFTR

SEQ ID NO: 2832023 - protein, 19 aa, Entamoeba invadens
YETVWKKMFDILYIYNGNV

SEQ ID NO: 2832024 - protein, 18 aa, Entamoeba invadens
YEVFIWKDPFPKDKFIFP

SEQ ID NO: 2832025 - protein, 19 aa, Entamoeba invadens
YFDMIFFYDSGNVKKYSVC

SEQ ID NO: 2832026 - protein, 20 aa, Entamoeba invadens
YFDNFYATLPFYFDIINEGK

SEQ ID NO: 2832027 - protein, 18 aa, Entamoeba invadens
YFFFISIDDLTSFSFSFK

SEQ ID NO: 2832028 - protein, 17 aa, Entamoeba invadens
YFFLLFWSVMYLAYIMV

SEQ ID NO: 2832029 - protein, 18 aa, Entamoeba invadens
YFFSQYYNVITFYKTTNP

SEQ ID NO: 2832030 - protein, 17 aa, Entamoeba invadens
YFGWFWWSIATQIVMLN

SEQ ID NO: 2832031 - protein, 18 aa, Entamoeba invadens
YFNFEQIPNFLKLTLLFV

SEQ ID NO: 2832032 - protein, 18 aa, Entamoeba invadens
YFVFLILETESYICPSGC

SEQ ID NO: 2832033 - protein, 19 aa, Entamoeba invadens
YFYFAMVVFFFFISSFMLI

SEQ ID NO: 2832034 - protein, 17 aa, Entamoeba invadens
YFYIYWSGSVELFDNSV

SEQ ID NO: 2832035 - protein, 19 aa, Entamoeba invadens
YFYKFQRLIFDLHDLHISI

SEQ ID NO: 2832036 - protein, 20 aa, Entamoeba invadens
YGALFPTFSYFLVESIVTLV

SEQ ID NO: 2832037 - protein, 20 aa, Entamoeba invadens
YGCFLCGIIPLFVSPRTPKE

SEQ ID NO: 2832038 - protein, 19 aa, Entamoeba invadens
YGCIGCEDGFFLLDHLCVP

SEQ ID NO: 2832039 - protein, 35 aa, Entamoeba invadens
YGEFVFLFDFMHTINIIYLLYISSILFLNYINSKK

SEQ ID NO: 2832040 - protein, 20 aa, Entamoeba invadens
YGHTLILPTRYPLLGGWKTS

SEQ ID NO: 2832041 - protein, 18 aa, Entamoeba invadens
YGLLILSIVLFLVLAYWL

SEQ ID NO: 2832042 - protein, 26 aa, Entamoeba invadens
YGNEGFLLMLCYYLGCAITLTKLQKK

SEQ ID NO: 2832043 - protein, 19 aa, Entamoeba invadens
YGNGKWWVIKHLYELFLFV

SEQ ID NO: 2832044 - protein, 27 aa, Entamoeba invadens
YGSLFFVFCALLVAIYWWAKQPQHVYL

SEQ ID NO: 2832045 - protein, 27 aa, Entamoeba invadens
YGVLQSILFFVLFYFLIAGSDVTNFDG

SEQ ID NO: 2832046 - protein, 19 aa, Entamoeba invadens
YGYLVKKFLYKLTGANVRM

SEQ ID NO: 2832047 - protein, 20 aa, Entamoeba invadens
YHPYLLSILTPLLTKAPPKD

SEQ ID NO: 2832048 - protein, 25 aa, Entamoeba invadens
YIAFAMFIFFVVFIGSWVFCGVRFQ

SEQ ID NO: 2832049 - protein, 21 aa, Entamoeba invadens
YIFGFFCFGLWILCFLLFYKS

SEQ ID NO: 2832050 - protein, 22 aa, Entamoeba invadens
YIFLCFTFIYFTYSQSCSFPNI

SEQ ID NO: 2832051 - protein, 17 aa, Entamoeba invadens
YIGLPVDPLCECKSLGS

SEQ ID NO: 2832052 - protein, 18 aa, Entamoeba invadens
YIIHFYGAVFDSSKICMV

SEQ ID NO: 2832053 - protein, 17 aa, Entamoeba invadens
YIIHFYGAVFIASKVCM

SEQ ID NO: 2832054 - protein, 18 aa, Entamoeba invadens
YIKLPYKLKVRMLFDTTR

SEQ ID NO: 2832055 - protein, 17 aa, Entamoeba invadens
YILKFFFFKLVGEIPNK

SEQ ID NO: 2832056 - protein, 26 aa, Entamoeba invadens
YIQSFKYKTWFPFYNLYSHSWNGNKY

SEQ ID NO: 2832057 - protein, 19 aa, Entamoeba invadens
YISIIYFPGLSFCGEVFSS

SEQ ID NO: 2832058 - protein, 18 aa, Entamoeba invadens
YIVFILLIDMVVSYDQCN

SEQ ID NO: 2832059 - protein, 19 aa, Entamoeba invadens
YIVHFYGAVFIPKKICMVT

SEQ ID NO: 2832060 - protein, 17 aa, Entamoeba invadens
YIVHFYGAVFIPNKICM

SEQ ID NO: 2832061 - protein, 18 aa, Entamoeba invadens
YIVHFYGAVFIPNKICMV

SEQ ID NO: 2832062 - protein, 17 aa, Entamoeba invadens
YIVHFYGAVFIPNKVCM

SEQ ID NO: 2832063 - protein, 24 aa, Entamoeba invadens
YIVLPIIVVLIFLTLVVIISTLLV

SEQ ID NO: 2832064 - protein, 25 aa, Entamoeba invadens
YKFNTWIIVIIVLGLLVLFVLCVTL

SEQ ID NO: 2832065 - protein, 24 aa, Entamoeba invadens
YKYIVTSLKTDLFLIGPKGLTFYS

SEQ ID NO: 2832066 - protein, 17 aa, Entamoeba invadens
YLEFENVLLFKFFERYL

SEQ ID NO: 2832067 - protein, 27 aa, Entamoeba invadens
YLIAGAVLLIFLLVLLLAGCGITFQRC

SEQ ID NO: 2832068 - protein, 19 aa, Entamoeba invadens
YLIDTLFSPTYHGAPASLR

SEQ ID NO: 2832069 - protein, 17 aa, Entamoeba invadens
YLITFKRDFVKASSLLV

SEQ ID NO: 2832070 - protein, 17 aa, Entamoeba invadens
YLIYYCHLLPTEIIAYN

SEQ ID NO: 2832071 - protein, 21 aa, Entamoeba invadens
YLIYYFLLFSVVYGQICSLTT

SEQ ID NO: 2832072 - protein, 26 aa, Entamoeba invadens
YLLGNAIFYGLFALFLCFILILCLSK

SEQ ID NO: 2832073 - protein, 18 aa, Entamoeba invadens
YLLYLYMLLFASAAVVAI

SEQ ID NO: 2832074 - protein, 19 aa, Entamoeba invadens
YLMAILHTFYLRSALKVVI

SEQ ID NO: 2832075 - protein, 17 aa, Entamoeba invadens
YLMNSPFRKANLSRSQK

SEQ ID NO: 2832076 - protein, 17 aa, Entamoeba invadens
YLNIIYTCLSCKLGYYP

SEQ ID NO: 2832077 - protein, 22 aa, Entamoeba invadens
YLVLFLLFFKINSKSFNFDCSP

SEQ ID NO: 2832078 - protein, 18 aa, Entamoeba invadens
YMRLYPRMSLLVNTFYAI

SEQ ID NO: 2832079 - protein, 27 aa, Entamoeba invadens
YMVISLLFPPFLFFGAFILLRSPKTEL

SEQ ID NO: 2832080 - protein, 20 aa, Entamoeba invadens
YNFNIWIFPGITLGLPFPYI

SEQ ID NO: 2832081 - protein, 22 aa, Entamoeba invadens
YNHIPFFIVIAPLLVFILSLFI

SEQ ID NO: 2832082 - protein, 25 aa, Entamoeba invadens
YNILYLLIMNYYFNSILYLLYINYY

SEQ ID NO: 2832083 - protein, 21 aa, Entamoeba invadens
YNLPLNYVISLKFVWVKNEQI

SEQ ID NO: 2832084 - protein, 17 aa, Entamoeba invadens
YPCLYLLNSSRINGSSF

SEQ ID NO: 2832085 - protein, 20 aa, Entamoeba invadens
YPIINVIVFILMIFRHSAFS

SEQ ID NO: 2832086 - protein, 25 aa, Entamoeba invadens
YPIQKFKFPWSISQWMMEGKRPEIL

SEQ ID NO: 2832087 - protein, 20 aa, Entamoeba invadens
YPLCLSLLNIYNILVSLNLV

SEQ ID NO: 2832088 - protein, 18 aa, Entamoeba invadens
YPQLQALRFPIFDSFHKF

SEQ ID NO: 2832089 - protein, 23 aa, Entamoeba invadens
YPSLLILILFFFLNNITAGYVLE

SEQ ID NO: 2832090 - protein, 22 aa, Entamoeba invadens
YQFLVKWYAKNGQLFWVYQIIR

SEQ ID NO: 2832091 - protein, 23 aa, Entamoeba invadens
YQNALFMKLFHLCKPTIFANLVK

SEQ ID NO: 2832092 - protein, 24 aa, Entamoeba invadens
YRASPLLHLLWIDNIIKKQIEIGN

SEQ ID NO: 2832093 - protein, 19 aa, Entamoeba invadens
YRIVFIPDTLPTLVQKRFL

SEQ ID NO: 2832094 - protein, 19 aa, Entamoeba invadens
YRIVFYLFQPSLPTLQQVL

SEQ ID NO: 2832095 - protein, 18 aa, Entamoeba invadens
YRVPFKEVFFFSTLKIVS

SEQ ID NO: 2832096 - protein, 21 aa, Entamoeba invadens
YSFAIIMWEVVMTKIPFGETD

SEQ ID NO: 2832097 - protein, 18 aa, Entamoeba invadens
YSFGMLLVQVLISTKYFK

SEQ ID NO: 2832098 - protein, 39 aa, Entamoeba invadens
YSLAVTFFETLIWGEAYPLKLFPFPWNVADYIASGRRRE

SEQ ID NO: 2832099 - protein, 44 aa, Entamoeba invadens
YSLRNFLFWGIGCIAYLLLYLLLLFLIVILYIKLTGKIKKELDD

SEQ ID NO: 2832100 - protein, 42 aa, Entamoeba invadens
YSLRNFLFWGIGCIVYLLLYLMLLFLINILYVKLTQKIKKEL

SEQ ID NO: 2832101 - protein, 21 aa, Entamoeba invadens
YSTLFVEYFFITLNGIMESTT

SEQ ID NO: 2832102 - protein, 22 aa, Entamoeba invadens
YSVMCPYFFFPPASFDEITTAG

SEQ ID NO: 2832103 - protein, 19 aa, Entamoeba invadens
YTFVIFFSIKTLIVFFCVK

SEQ ID NO: 2832104 - protein, 17 aa, Entamoeba invadens
YTICRFDFIGGKSITFR

SEQ ID NO: 2832105 - protein, 24 aa, Entamoeba invadens
YTKLDVILLFLIVLFSSLFAFNVL

SEQ ID NO: 2832106 - protein, 19 aa, Entamoeba invadens
YTKLILLFFTWTTPPTIMS

SEQ ID NO: 2832107 - protein, 24 aa, Entamoeba invadens
YTMMNLLIIMIFVKSTFSVCPSGT

SEQ ID NO: 2832108 - protein, 24 aa, Entamoeba invadens
YTMWEFFVFGLPVFVWVVLCGALL

SEQ ID NO: 2832109 - protein, 17 aa, Entamoeba invadens
YTPCRLDFIGGKSITFR

SEQ ID NO: 2832110 - protein, 31 aa, Entamoeba invadens
YTVLFIYLAVFVFVYVLLYTILFIVIYSKTK

SEQ ID NO: 2832111 - protein, 17 aa, Entamoeba invadens
YVEFPYKLKVRMLFDTS

SEQ ID NO: 2832112 - protein, 20 aa, Entamoeba invadens
YVERLFSLYLPIMVGYHVYI

SEQ ID NO: 2832113 - protein, 17 aa, Entamoeba invadens
YVIFPQKTLFGASCDNS

SEQ ID NO: 2832114 - protein, 19 aa, Entamoeba invadens
YVLFICYILSMITSVRASC

SEQ ID NO: 2832115 - protein, 19 aa, Entamoeba invadens
YVLVNFKCLFYSKVDNCIS

SEQ ID NO: 2832116 - protein, 21 aa, Entamoeba invadens
YVMTLMIMAFYFDVPLPIHHP

SEQ ID NO: 2832117 - protein, 19 aa, Entamoeba invadens
YVNKSGLWYLFEKLEFKTG

SEQ ID NO: 2832118 - protein, 19 aa, Entamoeba invadens
YVPLFPYFKDLEGCFRVVS

SEQ ID NO: 2832119 - protein, 17 aa, Entamoeba invadens
YYIFLRTKDYAFADFYL

SEQ ID NO: 2832120 - protein, 19 aa, Entamoeba invadens
YYRQKFRIGKWFRLKIMEI

SEQ ID NO: 2832121 - protein, 19 aa, Entamoeba invadens
YYVFFLVDIEILCTCKPDE

SEQ ID NO: 2832122 - protein, 24 aa, Entamoeba invadens
YYVITFLFSFLFIQALHYGISNII

SEQ ID NO: 2832123 - protein, 18 aa, Entamoeba invadens
YYVVWITLMFWLCVGVIC

SEQ ID NO: 2832124 - protein, 17 aa, Entamoeba invadens
YYYFTSYVVFVVFSIYN

SEQ ID NO: 2832125 - protein, 17 aa, Entamoeba invadens
YYYYLIEWYYLISFNQT

SEQ ID NO: 2832126 - protein, 7 aa, Entamoeba invadens
GIGTPKY

SEQ ID NO: 2832127 - protein, 7 aa, Entamoeba invadens
GIHETTY

SEQ ID NO: 2832128 - protein, 6 aa, Entamoeba invadens
APPERK

SEQ ID NO: 2832129 - protein, 4 aa, Entamoeba invadens
APPT

SEQ ID NO: 2832130 - protein, 19 aa, Entamoeba invadens
EMQKAASSSELEKSYELPD

SEQ ID NO: 2832131 - protein, 9 aa, Entamoeba invadens
ITPNAHDSF

SEQ ID NO: 2832132 - protein, 7 aa, Entamoeba invadens
YSDRDFR

SEQ ID NO: 2832133 - protein, 12 aa, Entamoeba invadens
APMNPKANREKM

SEQ ID NO: 2832134 - protein, 10 aa, Entamoeba invadens
CGGKEDNQGF

SEQ ID NO: 2832135 - protein, 8 aa, Entamoeba invadens
DLSEEQLR

SEQ ID NO: 2832136 - protein, 15 aa, Entamoeba invadens
EEYDESGPAIVHRKC

SEQ ID NO: 2832137 - protein, 9 aa, Entamoeba invadens
FAGDDAPRA

SEQ ID NO: 2832138 - protein, 8 aa, Entamoeba invadens
GGTSMYPG

SEQ ID NO: 2832139 - protein, 6 aa, Entamoeba invadens
MGGVDT

SEQ ID NO: 2832140 - protein, 5 aa, Entamoeba invadens
NGSGM

SEQ ID NO: 2832141 - protein, 4 aa, Entamoeba invadens
RPKQ

SEQ ID NO: 2832142 - protein, 5 aa, Entamoeba invadens
SGDGV

SEQ ID NO: 2832143 - protein, 7 aa, Entamoeba invadens
ASGRTTG

SEQ ID NO: 2832144 - protein, 16 aa, Entamoeba invadens
GNKDTYVGDEAQSKRG

SEQ ID NO: 2832145 - protein, 7 aa, Entamoeba invadens
SKPGRYG

SEQ ID NO: 2832146 - protein, 4 aa, Entamoeba invadens
GAVG

SEQ ID NO: 2832147 - protein, 10 aa, Entamoeba invadens
YYKPSNSVSV

SEQ ID NO: 2832148 - protein, 5 aa, Entamoeba invadens
DENFG

SEQ ID NO: 2832149 - protein, 4 aa, Entamoeba invadens
EKVN

SEQ ID NO: 2832150 - protein, 6 aa, Entamoeba invadens
KDENFG

SEQ ID NO: 2832151 - protein, 9 aa, Entamoeba invadens
KERDGLNGF

SEQ ID NO: 2832152 - protein, 5 aa, Entamoeba invadens
QTTRT

SEQ ID NO: 2832153 - protein, 10 aa, Entamoeba invadens
TVDRNKNRNI

SEQ ID NO: 2832154 - protein, 7 aa, Entamoeba invadens
FTTTAER

SEQ ID NO: 2832155 - protein, 7 aa, Entamoeba invadens
IPSSVTS

SEQ ID NO: 2832156 - protein, 4 aa, Entamoeba invadens
RNSM

SEQ ID NO: 2832157 - protein, 5 aa, Entamoeba invadens
RSETR

SEQ ID NO: 2832158 - protein, 10 aa, Entamoeba invadens
TVDRNKSRNI

SEQ ID NO: 2832159 - protein, 5 aa, Entamoeba invadens
GGLSG

SEQ ID NO: 2832160 - protein, 9 aa, Entamoeba invadens
GKAGAAGVS

SEQ ID NO: 2832161 - protein, 17 aa, Entamoeba invadens
KELPDEAKTIKGRTPDT

SEQ ID NO: 2832162 - protein, 8 aa, Entamoeba invadens
KGVGTPKY

SEQ ID NO: 2832163 - protein, 10 aa, Entamoeba invadens
SVSAGQNSDA

SEQ ID NO: 2832164 - protein, 12 aa, Entamoeba invadens
VTRADKDEGTVF

SEQ ID NO: 2832165 - protein, 10 aa, Entamoeba invadens
ATMGGVDSAD

SEQ ID NO: 2832166 - protein, 6 aa, Entamoeba invadens
DNQIAD

SEQ ID NO: 2832167 - protein, 4 aa, Entamoeba invadens
EAED

SEQ ID NO: 2832168 - protein, 12 aa, Entamoeba invadens
EREQYQKPFGPR

SEQ ID NO: 2832169 - protein, 7 aa, Entamoeba invadens
GAGKGHG

SEQ ID NO: 2832170 - protein, 7 aa, Entamoeba invadens
GIGTPTY

SEQ ID NO: 2832171 - protein, 7 aa, Entamoeba invadens
KKLGEGS

SEQ ID NO: 2832172 - protein, 9 aa, Entamoeba invadens
KLTDFGSAR

SEQ ID NO: 2832173 - protein, 4 aa, Entamoeba invadens
RRTS

SEQ ID NO: 2832174 - protein, 9 aa, Entamoeba invadens
RTNKATEKC

SEQ ID NO: 2832175 - protein, 4 aa, Entamoeba invadens
VTIP

SEQ ID NO: 2832176 - protein, 7 aa, Entamoeba invadens
YKTYSNY

SEQ ID NO: 2832177 - protein, 4 aa, Entamoeba invadens
AEEM

SEQ ID NO: 2832178 - protein, 6 aa, Entamoeba invadens
EDENFG

SEQ ID NO: 2832179 - protein, 10 aa, Entamoeba invadens
ENQVKGTNMA

SEQ ID NO: 2832180 - protein, 6 aa, Entamoeba invadens
KASAPM

SEQ ID NO: 2832181 - protein, 8 aa, Entamoeba invadens
LTDFGSSR

SEQ ID NO: 2832182 - protein, 5 aa, Entamoeba invadens
VTSIG

SEQ ID NO: 2832183 - protein, 6 aa, Entamoeba invadens
AGQERF

SEQ ID NO: 2832184 - protein, 9 aa, Entamoeba invadens
AQKADYEAQ

SEQ ID NO: 2832185 - protein, 4 aa, Entamoeba invadens
DGES

SEQ ID NO: 2832186 - protein, 9 aa, Entamoeba invadens
DKKEENQGF

SEQ ID NO: 2832187 - protein, 7 aa, Entamoeba invadens
GAVGKSA

SEQ ID NO: 2832188 - protein, 7 aa, Entamoeba invadens
LSGDVTS

SEQ ID NO: 2832189 - protein, 7 aa, Entamoeba invadens
QAEATTI

SEQ ID NO: 2832190 - protein, 9 aa, Entamoeba invadens
QVRGKDGKL

SEQ ID NO: 2832191 - protein, 6 aa, Entamoeba invadens
RKLKGK

SEQ ID NO: 2832192 - protein, 7 aa, Entamoeba invadens
SRKMTKE

SEQ ID NO: 2832193 - protein, 5 aa, Entamoeba invadens
SVTSI

SEQ ID NO: 2832194 - protein, 11 aa, Entamoeba invadens
SYGKTIQKPIK

SEQ ID NO: 2832195 - protein, 8 aa, Entamoeba invadens
TDFGSSRN

SEQ ID NO: 2832196 - protein, 4 aa, Entamoeba invadens
VKNE

SEQ ID NO: 2832197 - protein, 9 aa, Entamoeba invadens
ATTATDYAA

SEQ ID NO: 2832198 - protein, 9 aa, Entamoeba invadens
GVSPSTARL

SEQ ID NO: 2832199 - protein, 16 aa, Entamoeba invadens
IAKEHKTDDNKLSKTS

SEQ ID NO: 2832200 - protein, 10 aa, Entamoeba invadens
IEDGLNDSDM

SEQ ID NO: 2832201 - protein, 4 aa, Entamoeba invadens
ITIP

SEQ ID NO: 2832202 - protein, 6 aa, Entamoeba invadens
ITPKTK

SEQ ID NO: 2832203 - protein, 7 aa, Entamoeba invadens
KDENFGN

SEQ ID NO: 2832204 - protein, 8 aa, Entamoeba invadens
KKQGNPVQ

SEQ ID NO: 2832205 - protein, 7 aa, Entamoeba invadens
KNPEGNI

SEQ ID NO: 2832206 - protein, 7 aa, Entamoeba invadens
KQTIENN

SEQ ID NO: 2832207 - protein, 7 aa, Entamoeba invadens
LEPTNER

SEQ ID NO: 2832208 - protein, 7 aa, Entamoeba invadens
LKEYGGK

SEQ ID NO: 2832209 - protein, 5 aa, Entamoeba invadens
LSYPQ

SEQ ID NO: 2832210 - protein, 10 aa, Entamoeba invadens
NAKSPTTCPV

SEQ ID NO: 2832211 - protein, 8 aa, Entamoeba invadens
NKSDLLSN

SEQ ID NO: 2832212 - protein, 4 aa, Entamoeba invadens
NMSV

SEQ ID NO: 2832213 - protein, 6 aa, Entamoeba invadens
QEEKNQ

SEQ ID NO: 2832214 - protein, 10 aa, Entamoeba invadens
SESTQEALDN

SEQ ID NO: 2832215 - protein, 6 aa, Entamoeba invadens
SGVGKT

SEQ ID NO: 2832216 - protein, 5 aa, Entamoeba invadens
SSVTS

SEQ ID NO: 2832217 - protein, 4 aa, Entamoeba invadens
SVTI

SEQ ID NO: 2832218 - protein, 4 aa, Entamoeba invadens
SVTS

SEQ ID NO: 2832219 - protein, 7 aa, Entamoeba invadens
TDFGSSR

SEQ ID NO: 2832220 - protein, 4 aa, Entamoeba invadens
TIPS

SEQ ID NO: 2832221 - protein, 6 aa, Entamoeba invadens
AAGKTT

SEQ ID NO: 2832222 - protein, 5 aa, Entamoeba invadens
ASCTT

SEQ ID NO: 2832223 - protein, 9 aa, Entamoeba invadens
ATTATEYAA

SEQ ID NO: 2832224 - protein, 4 aa, Entamoeba invadens
DEHT

SEQ ID NO: 2832225 - protein, 7 aa, Entamoeba invadens
DTYKKDG

SEQ ID NO: 2832226 - protein, 15 aa, Entamoeba invadens
DVEGKSGRKREINQS

SEQ ID NO: 2832227 - protein, 14 aa, Entamoeba invadens
ELESQLRQTSYTTF

SEQ ID NO: 2832228 - protein, 7 aa, Entamoeba invadens
GKYEKDI

SEQ ID NO: 2832229 - protein, 8 aa, Entamoeba invadens
GPPGTGKT

SEQ ID NO: 2832230 - protein, 4 aa, Entamoeba invadens
GTPD

SEQ ID NO: 2832231 - protein, 5 aa, Entamoeba invadens
GVGTP

SEQ ID NO: 2832232 - protein, 11 aa, Entamoeba invadens
ITIPSSVTSIG

SEQ ID NO: 2832233 - protein, 13 aa, Entamoeba invadens
KASNTPNSNDKFG

SEQ ID NO: 2832234 - protein, 7 aa, Entamoeba invadens
KYAEGEL

SEQ ID NO: 2832235 - protein, 6 aa, Entamoeba invadens
LDEEGE

SEQ ID NO: 2832236 - protein, 9 aa, Entamoeba invadens
LTDFGSSRN

SEQ ID NO: 2832237 - protein, 15 aa, Entamoeba invadens
RDRTAKDKKKIADLE

SEQ ID NO: 2832238 - protein, 4 aa, Entamoeba invadens
RSGV

SEQ ID NO: 2832239 - protein, 10 aa, Entamoeba invadens
SKNSTGIVDS

SEQ ID NO: 2832240 - protein, 6 aa, Entamoeba invadens
SKPQRY

SEQ ID NO: 2832241 - protein, 9 aa, Entamoeba invadens
TAGQEDYDR

SEQ ID NO: 2832242 - protein, 9 aa, Entamoeba invadens
TAGQEEYSA

SEQ ID NO: 2832243 - protein, 7 aa, Entamoeba invadens
TEAYKPE

SEQ ID NO: 2832244 - protein, 8 aa, Entamoeba invadens
TEDLDDNE

SEQ ID NO: 2832245 - protein, 4 aa, Entamoeba invadens
TELN

SEQ ID NO: 2832246 - protein, 5 aa, Entamoeba invadens
TIANN

SEQ ID NO: 2832247 - protein, 8 aa, Entamoeba invadens
TLTSEQQT

SEQ ID NO: 2832248 - protein, 4 aa, Entamoeba invadens
TYRG

SEQ ID NO: 2832249 - protein, 9 aa, Entamoeba invadens
VTIPSSVTS

SEQ ID NO: 2832250 - protein, 6 aa, Entamoeba invadens
AAGKTS

SEQ ID NO: 2832251 - protein, 8 aa, Entamoeba invadens
AKTGEGVN

SEQ ID NO: 2832252 - protein, 5 aa, Entamoeba invadens
ALEAQ

SEQ ID NO: 2832253 - protein, 8 aa, Entamoeba invadens
CATNGDGL

SEQ ID NO: 2832254 - protein, 6 aa, Entamoeba invadens
CGAEGK

SEQ ID NO: 2832255 - protein, 27 aa, Entamoeba invadens
DEEESEDSASDEEENPENKEETEEEDY

SEQ ID NO: 2832256 - protein, 6 aa, Entamoeba invadens
DFGSAR

SEQ ID NO: 2832257 - protein, 4 aa, Entamoeba invadens
DKVN

SEQ ID NO: 2832258 - protein, 14 aa, Entamoeba invadens
DKVNAKLTDFGSAR

SEQ ID NO: 2832259 - protein, 5 aa, Entamoeba invadens
EEKDI

SEQ ID NO: 2832260 - protein, 5 aa, Entamoeba invadens
EKYKM

SEQ ID NO: 2832261 - protein, 4 aa, Entamoeba invadens
ENET

SEQ ID NO: 2832262 - protein, 4 aa, Entamoeba invadens
ENFG

SEQ ID NO: 2832263 - protein, 11 aa, Entamoeba invadens
ENYDGKTDAAG

SEQ ID NO: 2832264 - protein, 7 aa, Entamoeba invadens
ESGVGKS

SEQ ID NO: 2832265 - protein, 4 aa, Entamoeba invadens
FDHT

SEQ ID NO: 2832266 - protein, 10 aa, Entamoeba invadens
FSDYDDEEIS

SEQ ID NO: 2832267 - protein, 8 aa, Entamoeba invadens
FTPSTTLS

SEQ ID NO: 2832268 - protein, 5 aa, Entamoeba invadens
GFEPY

SEQ ID NO: 2832269 - protein, 9 aa, Entamoeba invadens
GMHSDDGKM

SEQ ID NO: 2832270 - protein, 5 aa, Entamoeba invadens
IPKSV

SEQ ID NO: 2832271 - protein, 8 aa, Entamoeba invadens
IPSSVTSI

SEQ ID NO: 2832272 - protein, 9 aa, Entamoeba invadens
KEKYKKSAD

SEQ ID NO: 2832273 - protein, 18 aa, Entamoeba invadens
KELPDEAKAIKGRTPDTT

SEQ ID NO: 2832274 - protein, 9 aa, Entamoeba invadens
KESVTDARK

SEQ ID NO: 2832275 - protein, 4 aa, Entamoeba invadens
KGAY

SEQ ID NO: 2832276 - protein, 7 aa, Entamoeba invadens
KGGVSGS

SEQ ID NO: 2832277 - protein, 6 aa, Entamoeba invadens
KGKISE

SEQ ID NO: 2832278 - protein, 14 aa, Entamoeba invadens
KNDLGRTKAELDQL

SEQ ID NO: 2832279 - protein, 9 aa, Entamoeba invadens
KPENKYSAE

SEQ ID NO: 2832280 - protein, 14 aa, Entamoeba invadens
KSFEESDDQELKAE

SEQ ID NO: 2832281 - protein, 4 aa, Entamoeba invadens
KSIY

SEQ ID NO: 2832282 - protein, 6 aa, Entamoeba invadens
KSLNKW

SEQ ID NO: 2832283 - protein, 7 aa, Entamoeba invadens
KTSEELM

SEQ ID NO: 2832284 - protein, 8 aa, Entamoeba invadens
LTDFGSAR

SEQ ID NO: 2832285 - protein, 10 aa, Entamoeba invadens
LTPGTVVPNK

SEQ ID NO: 2832286 - protein, 5 aa, Entamoeba invadens
MRSGD

SEQ ID NO: 2832287 - protein, 5 aa, Entamoeba invadens
NAFPN

SEQ ID NO: 2832288 - protein, 4 aa, Entamoeba invadens
NMKG

SEQ ID NO: 2832289 - protein, 4 aa, Entamoeba invadens
NNQI

SEQ ID NO: 2832290 - protein, 4 aa, Entamoeba invadens
NVTS

SEQ ID NO: 2832291 - protein, 9 aa, Entamoeba invadens
PMGDAGLTG

SEQ ID NO: 2832292 - protein, 7 aa, Entamoeba invadens
PNAEAPT

SEQ ID NO: 2832293 - protein, 4 aa, Entamoeba invadens
PNSV

SEQ ID NO: 2832294 - protein, 4 aa, Entamoeba invadens
PPEL

SEQ ID NO: 2832295 - protein, 5 aa, Entamoeba invadens
PPELQ

SEQ ID NO: 2832296 - protein, 7 aa, Entamoeba invadens
PPSFDNV

SEQ ID NO: 2832297 - protein, 6 aa, Entamoeba invadens
PSLNGK

SEQ ID NO: 2832298 - protein, 6 aa, Entamoeba invadens
PSSVTS

SEQ ID NO: 2832299 - protein, 8 aa, Entamoeba invadens
QGAGGNSM

SEQ ID NO: 2832300 - protein, 17 aa, Entamoeba invadens
QKDDVEDEVKKATKRRK

SEQ ID NO: 2832301 - protein, 5 aa, Entamoeba invadens
SEEHK

SEQ ID NO: 2832302 - protein, 4 aa, Entamoeba invadens
SETN

SEQ ID NO: 2832303 - protein, 7 aa, Entamoeba invadens
SGYRGVG

SEQ ID NO: 2832304 - protein, 7 aa, Entamoeba invadens
SQLTPEA

SEQ ID NO: 2832305 - protein, 5 aa, Entamoeba invadens
SRNSF

SEQ ID NO: 2832306 - protein, 4 aa, Entamoeba invadens
SSQY

SEQ ID NO: 2832307 - protein, 6 aa, Entamoeba invadens
SSVTSI

SEQ ID NO: 2832308 - protein, 20 aa, Entamoeba invadens
STTATQKTVDGPSGKDWRAG

SEQ ID NO: 2832309 - protein, 4 aa, Entamoeba invadens
STTS

SEQ ID NO: 2832310 - protein, 5 aa, Entamoeba invadens
STYSA

SEQ ID NO: 2832311 - protein, 9 aa, Entamoeba invadens
THNPQSGCS

SEQ ID NO: 2832312 - protein, 8 aa, Entamoeba invadens
TIPSSVTS

SEQ ID NO: 2832313 - protein, 8 aa, Entamoeba invadens
TLPDEVEK

SEQ ID NO: 2832314 - protein, 7 aa, Entamoeba invadens
TLRGGEL

SEQ ID NO: 2832315 - protein, 4 aa, Entamoeba invadens
TNKF

SEQ ID NO: 2832316 - protein, 4 aa, Entamoeba invadens
TSIG

SEQ ID NO: 2832317 - protein, 19 aa, Entamoeba invadens
VAKKAPGSPDALKEIIGMS

SEQ ID NO: 2832318 - protein, 4 aa, Entamoeba invadens
VHRI

SEQ ID NO: 2832319 - protein, 18 aa, Entamoeba invadens
VKKAPGSSEVLEEILKMV

SEQ ID NO: 2832320 - protein, 11 aa, Entamoeba invadens
VKNKKGDIQYD

SEQ ID NO: 2832321 - protein, 6 aa, Entamoeba invadens
VTERDA

SEQ ID NO: 2832322 - protein, 8 aa, Entamoeba invadens
YGESDGES

SEQ ID NO: 2832323 - protein, 14 aa, Entamoeba invadens
YQKGVGSIREQSNK

SEQ ID NO: 2832324 - protein, 5 aa, Entamoeba invadens
YSETK

SEQ ID NO: 2832325 - protein, 9 aa, Entamoeba invadens
YSFTTTAER

SEQ ID NO: 2832326 - protein, 9 aa, Entamoeba invadens
AAGKQNNGS

SEQ ID NO: 2832327 - protein, 18 aa, Entamoeba invadens
ADANGDGYITMEEFCAFS

SEQ ID NO: 2832328 - protein, 12 aa, Entamoeba invadens
ADGDGKLTKDEV

SEQ ID NO: 2832329 - protein, 15 aa, Entamoeba invadens
AGGQAKDFGKTRITP

SEQ ID NO: 2832330 - protein, 6 aa, Entamoeba invadens
AGQERY

SEQ ID NO: 2832331 - protein, 22 aa, Entamoeba invadens
AIKEKDLKTVEEITKETKAGSF

SEQ ID NO: 2832332 - protein, 7 aa, Entamoeba invadens
AIPGDNV

SEQ ID NO: 2832333 - protein, 9 aa, Entamoeba invadens
AISSQTQNL

SEQ ID NO: 2832334 - protein, 4 aa, Entamoeba invadens
AKID

SEQ ID NO: 2832335 - protein, 7 aa, Entamoeba invadens
AKNKINI

SEQ ID NO: 2832336 - protein, 5 aa, Entamoeba invadens
ALKTS

SEQ ID NO: 2832337 - protein, 7 aa, Entamoeba invadens
ANKGYNM

SEQ ID NO: 2832338 - protein, 7 aa, Entamoeba invadens
ANVDDET

SEQ ID NO: 2832339 - protein, 8 aa, Entamoeba invadens
APREHGGI

SEQ ID NO: 2832340 - protein, 8 aa, Entamoeba invadens
APSDDATK

SEQ ID NO: 2832341 - protein, 12 aa, Entamoeba invadens
AQETNKEVQRRL

SEQ ID NO: 2832342 - protein, 6 aa, Entamoeba invadens
ATKATI

SEQ ID NO: 2832343 - protein, 4 aa, Entamoeba invadens
ATND

SEQ ID NO: 2832344 - protein, 4 aa, Entamoeba invadens
ATNN

SEQ ID NO: 2832345 - protein, 12 aa, Entamoeba invadens
AVTNSDKEEGVV

SEQ ID NO: 2832346 - protein, 19 aa, Entamoeba invadens
AYSSGKPALGVGPGNVPSY

SEQ ID NO: 2832347 - protein, 7 aa, Entamoeba invadens
DEEQQAD

SEQ ID NO: 2832348 - protein, 5 aa, Entamoeba invadens
DEHGE

SEQ ID NO: 2832349 - protein, 6 aa, Entamoeba invadens
DEKGFD

SEQ ID NO: 2832350 - protein, 5 aa, Entamoeba invadens
DGKVL

SEQ ID NO: 2832351 - protein, 7 aa, Entamoeba invadens
DITNNYE

SEQ ID NO: 2832352 - protein, 6 aa, Entamoeba invadens
DKESIS

SEQ ID NO: 2832353 - protein, 8 aa, Entamoeba invadens
DKKTEREK

SEQ ID NO: 2832354 - protein, 10 aa, Entamoeba invadens
DKLTNENNEI

SEQ ID NO: 2832355 - protein, 8 aa, Entamoeba invadens
DKPYSDTY

SEQ ID NO: 2832356 - protein, 4 aa, Entamoeba invadens
DLPQ

SEQ ID NO: 2832357 - protein, 13 aa, Entamoeba invadens
DNGIGRNTDETKR

SEQ ID NO: 2832358 - protein, 4 aa, Entamoeba invadens
DPTE

SEQ ID NO: 2832359 - protein, 8 aa, Entamoeba invadens
DQDGAIDA

SEQ ID NO: 2832360 - protein, 5 aa, Entamoeba invadens
DRHSD

SEQ ID NO: 2832361 - protein, 6 aa, Entamoeba invadens
DSGVGK

SEQ ID NO: 2832362 - protein, 15 aa, Entamoeba invadens
DSSKDEKVTTQQQRK

SEQ ID NO: 2832363 - protein, 35 aa, Entamoeba invadens
DVGQPDDVCDDASDTSDDGDVEEKEEAENGPEGEY

SEQ ID NO: 2832364 - protein, 7 aa, Entamoeba invadens
DVSNSTY

SEQ ID NO: 2832365 - protein, 11 aa, Entamoeba invadens
EDETNNLNGSI

SEQ ID NO: 2832366 - protein, 4 aa, Entamoeba invadens
EDTT

SEQ ID NO: 2832367 - protein, 5 aa, Entamoeba invadens
EGSEA

SEQ ID NO: 2832368 - protein, 13 aa, Entamoeba invadens
EGYYDEAKNSLKD

SEQ ID NO: 2832369 - protein, 23 aa, Entamoeba invadens
EHGEATKAAAKGGKAGAKAAPAK

SEQ ID NO: 2832370 - protein, 4 aa, Entamoeba invadens
EHPE

SEQ ID NO: 2832371 - protein, 12 aa, Entamoeba invadens
EIGQDAYNKGEY

SEQ ID NO: 2832372 - protein, 4 aa, Entamoeba invadens
EKNE

SEQ ID NO: 2832373 - protein, 6 aa, Entamoeba invadens
ELPPRE

SEQ ID NO: 2832374 - protein, 7 aa, Entamoeba invadens
ENNLRQY

SEQ ID NO: 2832375 - protein, 7 aa, Entamoeba invadens
ENREGIG

SEQ ID NO: 2832376 - protein, 17 aa, Entamoeba invadens
EQVQTPSNKTIENNPIT

SEQ ID NO: 2832377 - protein, 6 aa, Entamoeba invadens
ERPIPI

SEQ ID NO: 2832378 - protein, 14 aa, Entamoeba invadens
ERQNTTKPITTKEM

SEQ ID NO: 2832379 - protein, 11 aa, Entamoeba invadens
ERTNNRSESFH

SEQ ID NO: 2832380 - protein, 5 aa, Entamoeba invadens
ETAQE

SEQ ID NO: 2832381 - protein, 4 aa, Entamoeba invadens
ETLE

SEQ ID NO: 2832382 - protein, 5 aa, Entamoeba invadens
EYPPL

SEQ ID NO: 2832383 - protein, 8 aa, Entamoeba invadens
EYTDGLAK

SEQ ID NO: 2832384 - protein, 5 aa, Entamoeba invadens
FEGTL

SEQ ID NO: 2832385 - protein, 12 aa, Entamoeba invadens
FGTRGFENNKDI

SEQ ID NO: 2832386 - protein, 6 aa, Entamoeba invadens
GAVGKT

SEQ ID NO: 2832387 - protein, 4 aa, Entamoeba invadens
GEKV

SEQ ID NO: 2832388 - protein, 7 aa, Entamoeba invadens
GGSAMDA

SEQ ID NO: 2832389 - protein, 13 aa, Entamoeba invadens
GHEDETNNLNGSI

SEQ ID NO: 2832390 - protein, 7 aa, Entamoeba invadens
GKPSSEN

SEQ ID NO: 2832391 - protein, 6 aa, Entamoeba invadens
GKYEKD

SEQ ID NO: 2832392 - protein, 7 aa, Entamoeba invadens
GNSSRAI

SEQ ID NO: 2832393 - protein, 4 aa, Entamoeba invadens
GPED

SEQ ID NO: 2832394 - protein, 5 aa, Entamoeba invadens
GRGTE

SEQ ID NO: 2832395 - protein, 11 aa, Entamoeba invadens
GSSALKTNPLE

SEQ ID NO: 2832396 - protein, 13 aa, Entamoeba invadens
GSTQDGASANMGC

SEQ ID NO: 2832397 - protein, 11 aa, Entamoeba invadens
GSYGGNSVSAN

SEQ ID NO: 2832398 - protein, 10 aa, Entamoeba invadens
GTRSRKQCRE

SEQ ID NO: 2832399 - protein, 4 aa, Entamoeba invadens
HDQN

SEQ ID NO: 2832400 - protein, 4 aa, Entamoeba invadens
HQIQ

SEQ ID NO: 2832401 - protein, 4 aa, Entamoeba invadens
HYRS

SEQ ID NO: 2832402 - protein, 10 aa, Entamoeba invadens
IAAKKEIKNE

SEQ ID NO: 2832403 - protein, 8 aa, Entamoeba invadens
IATNPSKI

SEQ ID NO: 2832404 - protein, 13 aa, Entamoeba invadens
IDRRTGKAEEGVP

SEQ ID NO: 2832405 - protein, 12 aa, Entamoeba invadens
IENYDGKTDAAG

SEQ ID NO: 2832406 - protein, 4 aa, Entamoeba invadens
IETK

SEQ ID NO: 2832407 - protein, 6 aa, Entamoeba invadens
IEVPSS

SEQ ID NO: 2832408 - protein, 9 aa, Entamoeba invadens
IGDAAKNQI

SEQ ID NO: 2832409 - protein, 4 aa, Entamoeba invadens
IKPD

SEQ ID NO: 2832410 - protein, 20 aa, Entamoeba invadens
IKRGNVASDSKNKPASKTEY

SEQ ID NO: 2832411 - protein, 5 aa, Entamoeba invadens
INLTD

SEQ ID NO: 2832412 - protein, 4 aa, Entamoeba invadens
IPQT

SEQ ID NO: 2832413 - protein, 6 aa, Entamoeba invadens
IPSSVT

SEQ ID NO: 2832414 - protein, 4 aa, Entamoeba invadens
IPVK

SEQ ID NO: 2832415 - protein, 4 aa, Entamoeba invadens
IPVT

SEQ ID NO: 2832416 - protein, 4 aa, Entamoeba invadens
ISNS

SEQ ID NO: 2832417 - protein, 10 aa, Entamoeba invadens
KALPPKSARY

SEQ ID NO: 2832418 - protein, 7 aa, Entamoeba invadens
KDETFGN

SEQ ID NO: 2832419 - protein, 13 aa, Entamoeba invadens
KDIEDKEGEISDL

SEQ ID NO: 2832420 - protein, 30 aa, Entamoeba invadens
KEGEAPKSSRHVKASPDPTYSFDPKGSNLT

SEQ ID NO: 2832421 - protein, 4 aa, Entamoeba invadens
KEGK

SEQ ID NO: 2832422 - protein, 4 aa, Entamoeba invadens
KELK

SEQ ID NO: 2832423 - protein, 12 aa, Entamoeba invadens
KELQEPKLPKDK

SEQ ID NO: 2832424 - protein, 6 aa, Entamoeba invadens
KETAEA

SEQ ID NO: 2832425 - protein, 4 aa, Entamoeba invadens
KGCD

SEQ ID NO: 2832426 - protein, 7 aa, Entamoeba invadens
KGRYGEH

SEQ ID NO: 2832427 - protein, 4 aa, Entamoeba invadens
KKEK

SEQ ID NO: 2832428 - protein, 8 aa, Entamoeba invadens
KKPSKYSN

SEQ ID NO: 2832429 - protein, 8 aa, Entamoeba invadens
KKQAKSEH

SEQ ID NO: 2832430 - protein, 15 aa, Entamoeba invadens
KKQTHKKAQNLSAAE

SEQ ID NO: 2832431 - protein, 6 aa, Entamoeba invadens
KKSRYD

SEQ ID NO: 2832432 - protein, 9 aa, Entamoeba invadens
KLTDFGSSR

SEQ ID NO: 2832433 - protein, 6 aa, Entamoeba invadens
KNGDSA

SEQ ID NO: 2832434 - protein, 5 aa, Entamoeba invadens
KNTNL

SEQ ID NO: 2832435 - protein, 5 aa, Entamoeba invadens
KQPIK

SEQ ID NO: 2832436 - protein, 13 aa, Entamoeba invadens
KQVDDDNENMRKT

SEQ ID NO: 2832437 - protein, 14 aa, Entamoeba invadens
KRGEDKIYNKYGKD

SEQ ID NO: 2832438 - protein, 6 aa, Entamoeba invadens
KSCEKT

SEQ ID NO: 2832439 - protein, 6 aa, Entamoeba invadens
KTCEEW

SEQ ID NO: 2832440 - protein, 7 aa, Entamoeba invadens
KVEEDIK

SEQ ID NO: 2832441 - protein, 7 aa, Entamoeba invadens
KYDETSF

SEQ ID NO: 2832442 - protein, 6 aa, Entamoeba invadens
LDEYAK

SEQ ID NO: 2832443 - protein, 8 aa, Entamoeba invadens
LDTTKTAE

SEQ ID NO: 2832444 - protein, 7 aa, Entamoeba invadens
LNNDDES

SEQ ID NO: 2832445 - protein, 4 aa, Entamoeba invadens
LSDT

SEQ ID NO: 2832446 - protein, 4 aa, Entamoeba invadens
LSDY

SEQ ID NO: 2832447 - protein, 4 aa, Entamoeba invadens
LTPK

SEQ ID NO: 2832448 - protein, 27 aa, Entamoeba invadens
MALDDKAEAEKTAADQSDRRKKMEDQV

SEQ ID NO: 2832449 - protein, 6 aa, Entamoeba invadens
MEPENI

SEQ ID NO: 2832450 - protein, 11 aa, Entamoeba invadens
MISEEGGLSGK

SEQ ID NO: 2832451 - protein, 5 aa, Entamoeba invadens
NENFG

SEQ ID NO: 2832452 - protein, 4 aa, Entamoeba invadens
NETE

SEQ ID NO: 2832453 - protein, 9 aa, Entamoeba invadens
NFEKGNQYV

SEQ ID NO: 2832454 - protein, 5 aa, Entamoeba invadens
NFPTT

SEQ ID NO: 2832455 - protein, 4 aa, Entamoeba invadens
NKDL

SEQ ID NO: 2832456 - protein, 9 aa, Entamoeba invadens
NNKRDTKEL

SEQ ID NO: 2832457 - protein, 9 aa, Entamoeba invadens
NPIRKNGGC

SEQ ID NO: 2832458 - protein, 8 aa, Entamoeba invadens
NQGSGKRE

SEQ ID NO: 2832459 - protein, 6 aa, Entamoeba invadens
NSAVTS

SEQ ID NO: 2832460 - protein, 7 aa, Entamoeba invadens
NSSSAIL

SEQ ID NO: 2832461 - protein, 10 aa, Entamoeba invadens
NTALSSSTMQ

SEQ ID NO: 2832462 - protein, 5 aa, Entamoeba invadens
NTTCR

SEQ ID NO: 2832463 - protein, 7 aa, Entamoeba invadens
NVLNATS

SEQ ID NO: 2832464 - protein, 8 aa, Entamoeba invadens
NVTAPGVK

SEQ ID NO: 2832465 - protein, 10 aa, Entamoeba invadens
PATTGAAKAV

SEQ ID NO: 2832466 - protein, 7 aa, Entamoeba invadens
PDPSIQT

SEQ ID NO: 2832467 - protein, 4 aa, Entamoeba invadens
PESV

SEQ ID NO: 2832468 - protein, 10 aa, Entamoeba invadens
PGGTKDVEQM

SEQ ID NO: 2832469 - protein, 4 aa, Entamoeba invadens
PGHR

SEQ ID NO: 2832470 - protein, 4 aa, Entamoeba invadens
PGVS

SEQ ID NO: 2832471 - protein, 6 aa, Entamoeba invadens
PPGCGK

SEQ ID NO: 2832472 - protein, 17 aa, Entamoeba invadens
PTAVNTKGKKKPAQSQV

SEQ ID NO: 2832473 - protein, 5 aa, Entamoeba invadens
PTDST

SEQ ID NO: 2832474 - protein, 9 aa, Entamoeba invadens
PVTNPTSTA

SEQ ID NO: 2832475 - protein, 10 aa, Entamoeba invadens
PYPKTGKNEQ

SEQ ID NO: 2832476 - protein, 17 aa, Entamoeba invadens
QAAKTYKQSKNTYEKKL

SEQ ID NO: 2832477 - protein, 17 aa, Entamoeba invadens
QDLEDRPVGTSNIDQTE

SEQ ID NO: 2832478 - protein, 6 aa, Entamoeba invadens
QERATR

SEQ ID NO: 2832479 - protein, 7 aa, Entamoeba invadens
QIRKGYT

SEQ ID NO: 2832480 - protein, 9 aa, Entamoeba invadens
QQLEPTESK

SEQ ID NO: 2832481 - protein, 14 aa, Entamoeba invadens
QRDLEANNTELTEL

SEQ ID NO: 2832482 - protein, 5 aa, Entamoeba invadens
RKLKG

SEQ ID NO: 2832483 - protein, 13 aa, Entamoeba invadens
RRRLKSENSITST

SEQ ID NO: 2832484 - protein, 6 aa, Entamoeba invadens
RSGSTF

SEQ ID NO: 2832485 - protein, 33 aa, Entamoeba invadens
RVEVPEEAKQIKRYDPNDDKKATTREADTTEVY

SEQ ID NO: 2832486 - protein, 4 aa, Entamoeba invadens
SAEG

SEQ ID NO: 2832487 - protein, 8 aa, Entamoeba invadens
SAPSADAP

SEQ ID NO: 2832488 - protein, 5 aa, Entamoeba invadens
SCDVS

SEQ ID NO: 2832489 - protein, 9 aa, Entamoeba invadens
SCPKAGGKY

SEQ ID NO: 2832490 - protein, 6 aa, Entamoeba invadens
SDESDV

SEQ ID NO: 2832491 - protein, 8 aa, Entamoeba invadens
SDNPTVSS

SEQ ID NO: 2832492 - protein, 8 aa, Entamoeba invadens
SENGATSR

SEQ ID NO: 2832493 - protein, 7 aa, Entamoeba invadens
SESKYTE

SEQ ID NO: 2832494 - protein, 5 aa, Entamoeba invadens
SGEYH

SEQ ID NO: 2832495 - protein, 5 aa, Entamoeba invadens
SHESP

SEQ ID NO: 2832496 - protein, 5 aa, Entamoeba invadens
SILDT

SEQ ID NO: 2832497 - protein, 12 aa, Entamoeba invadens
SKDKKPEEIEKE

SEQ ID NO: 2832498 - protein, 5 aa, Entamoeba invadens
SKHPL

SEQ ID NO: 2832499 - protein, 5 aa, Entamoeba invadens
SLINT

SEQ ID NO: 2832500 - protein, 13 aa, Entamoeba invadens
SQDITATCSRSQE

SEQ ID NO: 2832501 - protein, 7 aa, Entamoeba invadens
SRAGRRT

SEQ ID NO: 2832502 - protein, 8 aa, Entamoeba invadens
SRDTLNRA

SEQ ID NO: 2832503 - protein, 5 aa, Entamoeba invadens
SSVGK

SEQ ID NO: 2832504 - protein, 6 aa, Entamoeba invadens
STGEPL

SEQ ID NO: 2832505 - protein, 7 aa, Entamoeba invadens
STGKSTG

SEQ ID NO: 2832506 - protein, 4 aa, Entamoeba invadens
STPL

SEQ ID NO: 2832507 - protein, 5 aa, Entamoeba invadens
SVTFD

SEQ ID NO: 2832508 - protein, 10 aa, Entamoeba invadens
SVTIPSSVNS

SEQ ID NO: 2832509 - protein, 6 aa, Entamoeba invadens
SYDKTS

SEQ ID NO: 2832510 - protein, 12 aa, Entamoeba invadens
SYGKTIQKPIKS

SEQ ID NO: 2832511 - protein, 15 aa, Entamoeba invadens
TAEHKRRGSIERAKE

SEQ ID NO: 2832512 - protein, 7 aa, Entamoeba invadens
TAGQEEY

SEQ ID NO: 2832513 - protein, 9 aa, Entamoeba invadens
TAPFDETYE

SEQ ID NO: 2832514 - protein, 10 aa, Entamoeba invadens
TARSVNKRPN

SEQ ID NO: 2832515 - protein, 7 aa, Entamoeba invadens
TDFGSAR

SEQ ID NO: 2832516 - protein, 11 aa, Entamoeba invadens
TEDNEDENPEM

SEQ ID NO: 2832517 - protein, 13 aa, Entamoeba invadens
TEPHSSTTNELVD

SEQ ID NO: 2832518 - protein, 5 aa, Entamoeba invadens
TGGGA

SEQ ID NO: 2832519 - protein, 8 aa, Entamoeba invadens
TGVTSECK

SEQ ID NO: 2832520 - protein, 12 aa, Entamoeba invadens
TIEDSYKTSISV

SEQ ID NO: 2832521 - protein, 5 aa, Entamoeba invadens
TIPSS

SEQ ID NO: 2832522 - protein, 10 aa, Entamoeba invadens
TIPSSVTSIG

SEQ ID NO: 2832523 - protein, 4 aa, Entamoeba invadens
TKHY

SEQ ID NO: 2832524 - protein, 4 aa, Entamoeba invadens
TKIG

SEQ ID NO: 2832525 - protein, 7 aa, Entamoeba invadens
TKKNGGV

SEQ ID NO: 2832526 - protein, 4 aa, Entamoeba invadens
TPKY

SEQ ID NO: 2832527 - protein, 8 aa, Entamoeba invadens
TPNPLRNR

SEQ ID NO: 2832528 - protein, 4 aa, Entamoeba invadens
TRAQ

SEQ ID NO: 2832529 - protein, 4 aa, Entamoeba invadens
TREL

SEQ ID NO: 2832530 - protein, 8 aa, Entamoeba invadens
TRLDPDEL

SEQ ID NO: 2832531 - protein, 4 aa, Entamoeba invadens
TSEE

SEQ ID NO: 2832532 - protein, 10 aa, Entamoeba invadens
TTSGTGSEVT

SEQ ID NO: 2832533 - protein, 21 aa, Entamoeba invadens
TYTQNDRKKFGNNIPSSVTSI

SEQ ID NO: 2832534 - protein, 11 aa, Entamoeba invadens
VAKEDEKVDLN

SEQ ID NO: 2832535 - protein, 8 aa, Entamoeba invadens
VDNDGTID

SEQ ID NO: 2832536 - protein, 6 aa, Entamoeba invadens
VGDFQS

SEQ ID NO: 2832537 - protein, 8 aa, Entamoeba invadens
VGEEAPEI

SEQ ID NO: 2832538 - protein, 8 aa, Entamoeba invadens
VKNDGQNI

SEQ ID NO: 2832539 - protein, 4 aa, Entamoeba invadens
VKSI

SEQ ID NO: 2832540 - protein, 8 aa, Entamoeba invadens
VNEPVRPV

SEQ ID NO: 2832541 - protein, 9 aa, Entamoeba invadens
VNIPSSVTS

SEQ ID NO: 2832542 - protein, 8 aa, Entamoeba invadens
VSLTSSKN

SEQ ID NO: 2832543 - protein, 5 aa, Entamoeba invadens
VTIPS

SEQ ID NO: 2832544 - protein, 10 aa, Entamoeba invadens
VTIPSSVTSI

SEQ ID NO: 2832545 - protein, 4 aa, Entamoeba invadens
VTSI

SEQ ID NO: 2832546 - protein, 4 aa, Entamoeba invadens
VTSL

SEQ ID NO: 2832547 - protein, 8 aa, Entamoeba invadens
YDSNPAHL

SEQ ID NO: 2832548 - protein, 9 aa, Entamoeba invadens
YKGSTDAKT

SEQ ID NO: 2832549 - protein, 7 aa, Entamoeba invadens
YKTTGGS

SEQ ID NO: 2832550 - protein, 8 aa, Entamoeba invadens
YKTTSEKY

SEQ ID NO: 2832551 - protein, 4 aa, Entamoeba invadens
YNGD

SEQ ID NO: 2832552 - protein, 4 aa, Entamoeba invadens
YTFT

SEQ ID NO: 2832553 - protein, 6 aa, Entamoeba invadens
YTQTDR

SEQ ID NO: 2832554 - protein, 4 aa, Entamoeba invadens
AALD

SEQ ID NO: 2832555 - protein, 11 aa, Entamoeba invadens
AATRESLNSRI

SEQ ID NO: 2832556 - protein, 7 aa, Entamoeba invadens
AATTRQN

SEQ ID NO: 2832557 - protein, 4 aa, Entamoeba invadens
ADIS

SEQ ID NO: 2832558 - protein, 5 aa, Entamoeba invadens
ADLSH

SEQ ID NO: 2832559 - protein, 12 aa, Entamoeba invadens
ADRKTKKNEDAQ

SEQ ID NO: 2832560 - protein, 8 aa, Entamoeba invadens
ADTEKNFS

SEQ ID NO: 2832561 - protein, 6 aa, Entamoeba invadens
AEATTI

SEQ ID NO: 2832562 - protein, 24 aa, Entamoeba invadens
AEEIAKRKQTYTPEQLAKKRQEAI

SEQ ID NO: 2832563 - protein, 8 aa, Entamoeba invadens
AEPSEEDT

SEQ ID NO: 2832564 - protein, 7 aa, Entamoeba invadens
AERGDDN

SEQ ID NO: 2832565 - protein, 12 aa, Entamoeba invadens
AFSGNKNLSDKY

SEQ ID NO: 2832566 - protein, 10 aa, Entamoeba invadens
AGATGEGAMD

SEQ ID NO: 2832567 - protein, 7 aa, Entamoeba invadens
AGQERYR

SEQ ID NO: 2832568 - protein, 7 aa, Entamoeba invadens
AGRGRTG

SEQ ID NO: 2832569 - protein, 6 aa, Entamoeba invadens
AHFSCS

SEQ ID NO: 2832570 - protein, 4 aa, Entamoeba invadens
AILS

SEQ ID NO: 2832571 - protein, 23 aa, Entamoeba invadens
AKAMRAQKDIKEAESRKKKAEAI

SEQ ID NO: 2832572 - protein, 10 aa, Entamoeba invadens
AKCDGRKNIA

SEQ ID NO: 2832573 - protein, 7 aa, Entamoeba invadens
AKENELS

SEQ ID NO: 2832574 - protein, 6 aa, Entamoeba invadens
AKENGR

SEQ ID NO: 2832575 - protein, 5 aa, Entamoeba invadens
AKKAY

SEQ ID NO: 2832576 - protein, 8 aa, Entamoeba invadens
ANGQCTRC

SEQ ID NO: 2832577 - protein, 13 aa, Entamoeba invadens
ANKTIEKGKELKA

SEQ ID NO: 2832578 - protein, 5 aa, Entamoeba invadens
ANSND

SEQ ID NO: 2832579 - protein, 11 aa, Entamoeba invadens
ANTDNAKKTLE

SEQ ID NO: 2832580 - protein, 6 aa, Entamoeba invadens
APDEEI

SEQ ID NO: 2832581 - protein, 6 aa, Entamoeba invadens
APEKMG

SEQ ID NO: 2832582 - protein, 13 aa, Entamoeba invadens
AQETNKEVQRRLG

SEQ ID NO: 2832583 - protein, 5 aa, Entamoeba invadens
AQQTF

SEQ ID NO: 2832584 - protein, 13 aa, Entamoeba invadens
ARERGRKYIEGNK

SEQ ID NO: 2832585 - protein, 4 aa, Entamoeba invadens
ASTM

SEQ ID NO: 2832586 - protein, 6 aa, Entamoeba invadens
ASTQGI

SEQ ID NO: 2832587 - protein, 7 aa, Entamoeba invadens
ASTQGYH

SEQ ID NO: 2832588 - protein, 8 aa, Entamoeba invadens
ASTQGYHN

SEQ ID NO: 2832589 - protein, 5 aa, Entamoeba invadens
ATFEN

SEQ ID NO: 2832590 - protein, 7 aa, Entamoeba invadens
ATLRNGQ

SEQ ID NO: 2832591 - protein, 5 aa, Entamoeba invadens
ATTLE

SEQ ID NO: 2832592 - protein, 5 aa, Entamoeba invadens
AVGKT

SEQ ID NO: 2832593 - protein, 10 aa, Entamoeba invadens
CADRDSNETL

SEQ ID NO: 2832594 - protein, 7 aa, Entamoeba invadens
CQEGNEY

SEQ ID NO: 2832595 - protein, 14 aa, Entamoeba invadens
CQKEASSGCCCGKT

SEQ ID NO: 2832596 - protein, 5 aa, Entamoeba invadens
CTRAS

SEQ ID NO: 2832597 - protein, 6 aa, Entamoeba invadens
DAANYQ

SEQ ID NO: 2832598 - protein, 6 aa, Entamoeba invadens
DDETFG

SEQ ID NO: 2832599 - protein, 5 aa, Entamoeba invadens
DDFAD

SEQ ID NO: 2832600 - protein, 13 aa, Entamoeba invadens
DEEKIQKELDKKN

SEQ ID NO: 2832601 - protein, 6 aa, Entamoeba invadens
DEENFG

SEQ ID NO: 2832602 - protein, 6 aa, Entamoeba invadens
DELPPF

SEQ ID NO: 2832603 - protein, 11 aa, Entamoeba invadens
DEMGTQPFADR

SEQ ID NO: 2832604 - protein, 7 aa, Entamoeba invadens
DENDSER

SEQ ID NO: 2832605 - protein, 5 aa, Entamoeba invadens
DETFG

SEQ ID NO: 2832606 - protein, 6 aa, Entamoeba invadens
DETTTY

SEQ ID NO: 2832607 - protein, 12 aa, Entamoeba invadens
DGDYSTPIGTTP

SEQ ID NO: 2832608 - protein, 4 aa, Entamoeba invadens
DGVQ

SEQ ID NO: 2832609 - protein, 4 aa, Entamoeba invadens
DINN

SEQ ID NO: 2832610 - protein, 6 aa, Entamoeba invadens
DIPEGA

SEQ ID NO: 2832611 - protein, 4 aa, Entamoeba invadens
DKEV

SEQ ID NO: 2832612 - protein, 5 aa, Entamoeba invadens
DKHGD

SEQ ID NO: 2832613 - protein, 6 aa, Entamoeba invadens
DKNTRK

SEQ ID NO: 2832614 - protein, 7 aa, Entamoeba invadens
DKPFTSL

SEQ ID NO: 2832615 - protein, 8 aa, Entamoeba invadens
DKSEDDVK

SEQ ID NO: 2832616 - protein, 14 aa, Entamoeba invadens
DKVNAKLTDFGSSR

SEQ ID NO: 2832617 - protein, 6 aa, Entamoeba invadens
DLKENK

SEQ ID NO: 2832618 - protein, 6 aa, Entamoeba invadens
DLPNAL

SEQ ID NO: 2832619 - protein, 5 aa, Entamoeba invadens
DLPQA

SEQ ID NO: 2832620 - protein, 33 aa, Entamoeba invadens
DMREDKDQLKRLEEKKISPITTEQGEAKAKDIN

SEQ ID NO: 2832621 - protein, 6 aa, Entamoeba invadens
DNCRTD

SEQ ID NO: 2832622 - protein, 13 aa, Entamoeba invadens
DNGIGRNTEETKR

SEQ ID NO: 2832623 - protein, 17 aa, Entamoeba invadens
DNKQKNTKLKQESTNSK

SEQ ID NO: 2832624 - protein, 7 aa, Entamoeba invadens
DNNEVNQ

SEQ ID NO: 2832625 - protein, 5 aa, Entamoeba invadens
DNRGK

SEQ ID NO: 2832626 - protein, 5 aa, Entamoeba invadens
DPAIQ

SEQ ID NO: 2832627 - protein, 5 aa, Entamoeba invadens
DPPLN

SEQ ID NO: 2832628 - protein, 6 aa, Entamoeba invadens
DQNGNH

SEQ ID NO: 2832629 - protein, 9 aa, Entamoeba invadens
DRDKNADLH

SEQ ID NO: 2832630 - protein, 5 aa, Entamoeba invadens
DRGEY

SEQ ID NO: 2832631 - protein, 6 aa, Entamoeba invadens
DRGPRS

SEQ ID NO: 2832632 - protein, 12 aa, Entamoeba invadens
DRSYQKGKVLFL

SEQ ID NO: 2832633 - protein, 4 aa, Entamoeba invadens
DRVQ

SEQ ID NO: 2832634 - protein, 9 aa, Entamoeba invadens
DSGKSTTTG

SEQ ID NO: 2832635 - protein, 8 aa, Entamoeba invadens
DSGVGKTS

SEQ ID NO: 2832636 - protein, 6 aa, Entamoeba invadens
DSLNKE

SEQ ID NO: 2832637 - protein, 7 aa, Entamoeba invadens
DSNYLSE

SEQ ID NO: 2832638 - protein, 14 aa, Entamoeba invadens
DSQRQATKDAGTIA

SEQ ID NO: 2832639 - protein, 8 aa, Entamoeba invadens
DSTTKGDQ

SEQ ID NO: 2832640 - protein, 4 aa, Entamoeba invadens
DSTV

SEQ ID NO: 2832641 - protein, 13 aa, Entamoeba invadens
DSVEKRAWTQEED

SEQ ID NO: 2832642 - protein, 4 aa, Entamoeba invadens
DSVH

SEQ ID NO: 2832643 - protein, 10 aa, Entamoeba invadens
DTAKYSQARF

SEQ ID NO: 2832644 - protein, 7 aa, Entamoeba invadens
DTETITG

SEQ ID NO: 2832645 - protein, 9 aa, Entamoeba invadens
DTKKSDEFG

SEQ ID NO: 2832646 - protein, 8 aa, Entamoeba invadens
DTNGENPR

SEQ ID NO: 2832647 - protein, 35 aa, Entamoeba invadens
DVGQPDDVCDDASDTSDDGDVEEKEEADNGPEGEY

SEQ ID NO: 2832648 - protein, 9 aa, Entamoeba invadens
DVKTTDGNT

SEQ ID NO: 2832649 - protein, 4 aa, Entamoeba invadens
DVNG

SEQ ID NO: 2832650 - protein, 34 aa, Entamoeba invadens
DYQQSSSVSNTQETQSSGIDEKQTDTSVQTNSLS

SEQ ID NO: 2832651 - protein, 6 aa, Entamoeba invadens
EAKEAG

SEQ ID NO: 2832652 - protein, 4 aa, Entamoeba invadens
EASN

SEQ ID NO: 2832653 - protein, 12 aa, Entamoeba invadens
ECTGNSEKCQSC

SEQ ID NO: 2832654 - protein, 6 aa, Entamoeba invadens
EDKDSI

SEQ ID NO: 2832655 - protein, 7 aa, Entamoeba invadens
EDLRQDE

SEQ ID NO: 2832656 - protein, 12 aa, Entamoeba invadens
EDTKTLSAPKIK

SEQ ID NO: 2832657 - protein, 8 aa, Entamoeba invadens
EDTNNKES

SEQ ID NO: 2832658 - protein, 7 aa, Entamoeba invadens
EEDESFG

SEQ ID NO: 2832659 - protein, 4 aa, Entamoeba invadens
EEDV

SEQ ID NO: 2832660 - protein, 5 aa, Entamoeba invadens
EEFEE

SEQ ID NO: 2832661 - protein, 4 aa, Entamoeba invadens
EEIG

SEQ ID NO: 2832662 - protein, 18 aa, Entamoeba invadens
EENDYTPEEIEELKKKYA

SEQ ID NO: 2832663 - protein, 4 aa, Entamoeba invadens
EENG

SEQ ID NO: 2832664 - protein, 4 aa, Entamoeba invadens
EEQI

SEQ ID NO: 2832665 - protein, 12 aa, Entamoeba invadens
EFKKNVKKDHKK

SEQ ID NO: 2832666 - protein, 4 aa, Entamoeba invadens
EGEN

SEQ ID NO: 2832667 - protein, 5 aa, Entamoeba invadens
EGGEF

SEQ ID NO: 2832668 - protein, 4 aa, Entamoeba invadens
EGIP

SEQ ID NO: 2832669 - protein, 4 aa, Entamoeba invadens
EGKE

SEQ ID NO: 2832670 - protein, 10 aa, Entamoeba invadens
EGLTSGAQEW

SEQ ID NO: 2832671 - protein, 38 aa, Entamoeba invadens
EHPHGGGNHQHVGHPTTIKRSSPPGQKCGKVAARRTGL

SEQ ID NO: 2832672 - protein, 7 aa, Entamoeba invadens
EKDPAFE

SEQ ID NO: 2832673 - protein, 8 aa, Entamoeba invadens
EKELENRT

SEQ ID NO: 2832674 - protein, 11 aa, Entamoeba invadens
EKESAEMGKGS

SEQ ID NO: 2832675 - protein, 10 aa, Entamoeba invadens
EKINNYNGEV

SEQ ID NO: 2832676 - protein, 7 aa, Entamoeba invadens
EKKDTKE

SEQ ID NO: 2832677 - protein, 6 aa, Entamoeba invadens
EKKRYN

SEQ ID NO: 2832678 - protein, 5 aa, Entamoeba invadens
EKRLS

SEQ ID NO: 2832679 - protein, 6 aa, Entamoeba invadens
EKRRYQ

SEQ ID NO: 2832680 - protein, 4 aa, Entamoeba invadens
EKSD

SEQ ID NO: 2832681 - protein, 9 aa, Entamoeba invadens
EKYKKEADV

SEQ ID NO: 2832682 - protein, 8 aa, Entamoeba invadens
ENGKVRSE

SEQ ID NO: 2832683 - protein, 4 aa, Entamoeba invadens
ENGY

SEQ ID NO: 2832684 - protein, 7 aa, Entamoeba invadens
ENNENPI

SEQ ID NO: 2832685 - protein, 8 aa, Entamoeba invadens
ENQFTHPP

SEQ ID NO: 2832686 - protein, 4 aa, Entamoeba invadens
ENSF

SEQ ID NO: 2832687 - protein, 9 aa, Entamoeba invadens
ENSVVGAGS

SEQ ID NO: 2832688 - protein, 7 aa, Entamoeba invadens
EQERYYK

SEQ ID NO: 2832689 - protein, 7 aa, Entamoeba invadens
EQKRNEQ

SEQ ID NO: 2832690 - protein, 12 aa, Entamoeba invadens
ERAFPNTVKINR

SEQ ID NO: 2832691 - protein, 4 aa, Entamoeba invadens
ERDD

SEQ ID NO: 2832692 - protein, 6 aa, Entamoeba invadens
ESACAS

SEQ ID NO: 2832693 - protein, 9 aa, Entamoeba invadens
ESCYTNTKK

SEQ ID NO: 2832694 - protein, 5 aa, Entamoeba invadens
ESIES

SEQ ID NO: 2832695 - protein, 9 aa, Entamoeba invadens
ESKEEKEKC

SEQ ID NO: 2832696 - protein, 6 aa, Entamoeba invadens
ESNNNI

SEQ ID NO: 2832697 - protein, 5 aa, Entamoeba invadens
ESVTK

SEQ ID NO: 2832698 - protein, 6 aa, Entamoeba invadens
ETATKT

SEQ ID NO: 2832699 - protein, 4 aa, Entamoeba invadens
ETDD

SEQ ID NO: 2832700 - protein, 9 aa, Entamoeba invadens
ETEADDGEC

SEQ ID NO: 2832701 - protein, 5 aa, Entamoeba invadens
ETEDG

SEQ ID NO: 2832702 - protein, 9 aa, Entamoeba invadens
ETVEQGPAW

SEQ ID NO: 2832703 - protein, 4 aa, Entamoeba invadens
EVEE

SEQ ID NO: 2832704 - protein, 17 aa, Entamoeba invadens
EVENSKKVIEEKINQSF

SEQ ID NO: 2832705 - protein, 7 aa, Entamoeba invadens
EVNDSID

SEQ ID NO: 2832706 - protein, 26 aa, Entamoeba invadens
EYNDEDEVNDDNEEPNCGTDDCGDDH

SEQ ID NO: 2832707 - protein, 6 aa, Entamoeba invadens
FDQTPD

SEQ ID NO: 2832708 - protein, 4 aa, Entamoeba invadens
FEEE

SEQ ID NO: 2832709 - protein, 10 aa, Entamoeba invadens
FEETKEIEAA

SEQ ID NO: 2832710 - protein, 7 aa, Entamoeba invadens
FEKEKPK

SEQ ID NO: 2832711 - protein, 4 aa, Entamoeba invadens
FGTS

SEQ ID NO: 2832712 - protein, 10 aa, Entamoeba invadens
FGVKRERTPF

SEQ ID NO: 2832713 - protein, 4 aa, Entamoeba invadens
FPES

SEQ ID NO: 2832714 - protein, 9 aa, Entamoeba invadens
FTNPKSLEQ

SEQ ID NO: 2832715 - protein, 8 aa, Entamoeba invadens
GAKYGSSE

SEQ ID NO: 2832716 - protein, 12 aa, Entamoeba invadens
GALGEEDSLEGQ

SEQ ID NO: 2832717 - protein, 5 aa, Entamoeba invadens
GDDLR

SEQ ID NO: 2832718 - protein, 11 aa, Entamoeba invadens
GDFDNSDTEKT

SEQ ID NO: 2832719 - protein, 4 aa, Entamoeba invadens
GDGT

SEQ ID NO: 2832720 - protein, 4 aa, Entamoeba invadens
GETY

SEQ ID NO: 2832721 - protein, 5 aa, Entamoeba invadens
GFPIK

SEQ ID NO: 2832722 - protein, 9 aa, Entamoeba invadens
GGGRTEKPI

SEQ ID NO: 2832723 - protein, 6 aa, Entamoeba invadens
GGVGKT

SEQ ID NO: 2832724 - protein, 4 aa, Entamoeba invadens
GHSK

SEQ ID NO: 2832725 - protein, 4 aa, Entamoeba invadens
GIAR

SEQ ID NO: 2832726 - protein, 7 aa, Entamoeba invadens
GIGTPSY

SEQ ID NO: 2832727 - protein, 5 aa, Entamoeba invadens
GIQDE

SEQ ID NO: 2832728 - protein, 4 aa, Entamoeba invadens
GKEI

SEQ ID NO: 2832729 - protein, 5 aa, Entamoeba invadens
GKNEH

SEQ ID NO: 2832730 - protein, 7 aa, Entamoeba invadens
GKNNWRS

SEQ ID NO: 2832731 - protein, 4 aa, Entamoeba invadens
GKSA

SEQ ID NO: 2832732 - protein, 7 aa, Entamoeba invadens
GKSVKNS

SEQ ID NO: 2832733 - protein, 4 aa, Entamoeba invadens
GKTT

SEQ ID NO: 2832734 - protein, 4 aa, Entamoeba invadens
GKYQ

SEQ ID NO: 2832735 - protein, 5 aa, Entamoeba invadens
GLPIK

SEQ ID NO: 2832736 - protein, 21 aa, Entamoeba invadens
GLPQNTHKNMNDTIQRNTQHE

SEQ ID NO: 2832737 - protein, 4 aa, Entamoeba invadens
GLSR

SEQ ID NO: 2832738 - protein, 4 aa, Entamoeba invadens
GNEK

SEQ ID NO: 2832739 - protein, 4 aa, Entamoeba invadens
GNFT

SEQ ID NO: 2832740 - protein, 4 aa, Entamoeba invadens
GNKT

SEQ ID NO: 2832741 - protein, 9 aa, Entamoeba invadens
GNPANLNPL

SEQ ID NO: 2832742 - protein, 5 aa, Entamoeba invadens
GNTDK

SEQ ID NO: 2832743 - protein, 4 aa, Entamoeba invadens
GNVE

SEQ ID NO: 2832744 - protein, 16 aa, Entamoeba invadens
GNVKKGNKRKIAEPFS

SEQ ID NO: 2832745 - protein, 5 aa, Entamoeba invadens
GQDKI

SEQ ID NO: 2832746 - protein, 5 aa, Entamoeba invadens
GRPIP

SEQ ID NO: 2832747 - protein, 11 aa, Entamoeba invadens
GRRLDKPANMD

SEQ ID NO: 2832748 - protein, 5 aa, Entamoeba invadens
GSANA

SEQ ID NO: 2832749 - protein, 6 aa, Entamoeba invadens
GSFEEK

SEQ ID NO: 2832750 - protein, 15 aa, Entamoeba invadens
GSGGGHANAVGSRVP

SEQ ID NO: 2832751 - protein, 7 aa, Entamoeba invadens
GSSQIPK

SEQ ID NO: 2832752 - protein, 17 aa, Entamoeba invadens
GTGEFEAGISKNGQTRE

SEQ ID NO: 2832753 - protein, 14 aa, Entamoeba invadens
GTIAIKENTPPSVD

SEQ ID NO: 2832754 - protein, 6 aa, Entamoeba invadens
GTPLPV

SEQ ID NO: 2832755 - protein, 7 aa, Entamoeba invadens
GTPPDGM

SEQ ID NO: 2832756 - protein, 7 aa, Entamoeba invadens
GTSMYSG

SEQ ID NO: 2832757 - protein, 13 aa, Entamoeba invadens
GTTKDGNLKSGVK

SEQ ID NO: 2832758 - protein, 7 aa, Entamoeba invadens
GWDRTSQ

SEQ ID NO: 2832759 - protein, 4 aa, Entamoeba invadens
GYKT

SEQ ID NO: 2832760 - protein, 14 aa, Entamoeba invadens
GYYSVNRESEVERT

SEQ ID NO: 2832761 - protein, 12 aa, Entamoeba invadens
GYYTDKSNKCSP

SEQ ID NO: 2832762 - protein, 5 aa, Entamoeba invadens
HETKE

SEQ ID NO: 2832763 - protein, 8 aa, Entamoeba invadens
HGDGDGVC

SEQ ID NO: 2832764 - protein, 5 aa, Entamoeba invadens
HGRDK

SEQ ID NO: 2832765 - protein, 9 aa, Entamoeba invadens
HKQNGSCGT

SEQ ID NO: 2832766 - protein, 7 aa, Entamoeba invadens
HLKGGAK

SEQ ID NO: 2832767 - protein, 16 aa, Entamoeba invadens
HPDKNPGNKQAEEKFK

SEQ ID NO: 2832768 - protein, 6 aa, Entamoeba invadens
HPSSQQ

SEQ ID NO: 2832769 - protein, 11 aa, Entamoeba invadens
HQNSGKCSTTE

SEQ ID NO: 2832770 - protein, 4 aa, Entamoeba invadens
IDNG

SEQ ID NO: 2832771 - protein, 5 aa, Entamoeba invadens
IDQST

SEQ ID NO: 2832772 - protein, 7 aa, Entamoeba invadens
IDSLEEQ

SEQ ID NO: 2832773 - protein, 8 aa, Entamoeba invadens
IEAGAPKN

SEQ ID NO: 2832774 - protein, 8 aa, Entamoeba invadens
IEVPSSVT

SEQ ID NO: 2832775 - protein, 4 aa, Entamoeba invadens
IGES

SEQ ID NO: 2832776 - protein, 6 aa, Entamoeba invadens
IGGTGA

SEQ ID NO: 2832777 - protein, 13 aa, Entamoeba invadens
IGQEVDASGLGDE

SEQ ID NO: 2832778 - protein, 10 aa, Entamoeba invadens
IKENKRKEVD

SEQ ID NO: 2832779 - protein, 20 aa, Entamoeba invadens
INSRDGGDEYDGEIKGSKQD

SEQ ID NO: 2832780 - protein, 4 aa, Entamoeba invadens
INVP

SEQ ID NO: 2832781 - protein, 4 aa, Entamoeba invadens
IPES

SEQ ID NO: 2832782 - protein, 4 aa, Entamoeba invadens
IPLT

SEQ ID NO: 2832783 - protein, 4 aa, Entamoeba invadens
IPPS

SEQ ID NO: 2832784 - protein, 4 aa, Entamoeba invadens
IPRS

SEQ ID NO: 2832785 - protein, 5 aa, Entamoeba invadens
IPSSI

SEQ ID NO: 2832786 - protein, 6 aa, Entamoeba invadens
IPSSIT

SEQ ID NO: 2832787 - protein, 5 aa, Entamoeba invadens
IPSSV

SEQ ID NO: 2832788 - protein, 9 aa, Entamoeba invadens
IPSSVKSIG

SEQ ID NO: 2832789 - protein, 5 aa, Entamoeba invadens
IPSTV

SEQ ID NO: 2832790 - protein, 5 aa, Entamoeba invadens
IPTSV

SEQ ID NO: 2832791 - protein, 4 aa, Entamoeba invadens
IQSI

SEQ ID NO: 2832792 - protein, 10 aa, Entamoeba invadens
IRCTKDQKDI

SEQ ID NO: 2832793 - protein, 7 aa, Entamoeba invadens
IRERTGI

SEQ ID NO: 2832794 - protein, 13 aa, Entamoeba invadens
ISESKGVEEMNNN

SEQ ID NO: 2832795 - protein, 4 aa, Entamoeba invadens
ISGF

SEQ ID NO: 2832796 - protein, 7 aa, Entamoeba invadens
ISSSEDI

SEQ ID NO: 2832797 - protein, 12 aa, Entamoeba invadens
ISTNIRDDNDSS

SEQ ID NO: 2832798 - protein, 6 aa, Entamoeba invadens
ISVPNS

SEQ ID NO: 2832799 - protein, 9 aa, Entamoeba invadens
ITESKRNYE

SEQ ID NO: 2832800 - protein, 10 aa, Entamoeba invadens
ITIPSSVTSI

SEQ ID NO: 2832801 - protein, 12 aa, Entamoeba invadens
ITNTSNNGQTNY

SEQ ID NO: 2832802 - protein, 5 aa, Entamoeba invadens
ITRKT

SEQ ID NO: 2832803 - protein, 4 aa, Entamoeba invadens
ITSE

SEQ ID NO: 2832804 - protein, 11 aa, Entamoeba invadens
ITSESSTPNLN

SEQ ID NO: 2832805 - protein, 6 aa, Entamoeba invadens
ITSQRE

SEQ ID NO: 2832806 - protein, 8 aa, Entamoeba invadens
KAERERGI

SEQ ID NO: 2832807 - protein, 5 aa, Entamoeba invadens
KAIKR

SEQ ID NO: 2832808 - protein, 12 aa, Entamoeba invadens
KAQVGEEAPTFK

SEQ ID NO: 2832809 - protein, 8 aa, Entamoeba invadens
KARQSFPN

SEQ ID NO: 2832810 - protein, 5 aa, Entamoeba invadens
KCDRS

SEQ ID NO: 2832811 - protein, 4 aa, Entamoeba invadens
KDGE

SEQ ID NO: 2832812 - protein, 4 aa, Entamoeba invadens
KDGK

SEQ ID NO: 2832813 - protein, 4 aa, Entamoeba invadens
KDKK

SEQ ID NO: 2832814 - protein, 9 aa, Entamoeba invadens
KDKKGNHNV

SEQ ID NO: 2832815 - protein, 12 aa, Entamoeba invadens
KDKTGNHNTNEP

SEQ ID NO: 2832816 - protein, 7 aa, Entamoeba invadens
KDPAQIG

SEQ ID NO: 2832817 - protein, 8 aa, Entamoeba invadens
KEEKMNEK

SEQ ID NO: 2832818 - protein, 4 aa, Entamoeba invadens
KEEL

SEQ ID NO: 2832819 - protein, 4 aa, Entamoeba invadens
KEHE

SEQ ID NO: 2832820 - protein, 8 aa, Entamoeba invadens
KEKKEEKL

SEQ ID NO: 2832821 - protein, 11 aa, Entamoeba invadens
KEKKSKKYDVQ

SEQ ID NO: 2832822 - protein, 6 aa, Entamoeba invadens
KEMQEN

SEQ ID NO: 2832823 - protein, 6 aa, Entamoeba invadens
KENSEA

SEQ ID NO: 2832824 - protein, 4 aa, Entamoeba invadens
KEQN

SEQ ID NO: 2832825 - protein, 4 aa, Entamoeba invadens
KESE

SEQ ID NO: 2832826 - protein, 4 aa, Entamoeba invadens
KESL

SEQ ID NO: 2832827 - protein, 4 aa, Entamoeba invadens
KETL

SEQ ID NO: 2832828 - protein, 5 aa, Entamoeba invadens
KEVGG

SEQ ID NO: 2832829 - protein, 4 aa, Entamoeba invadens
KEYE

SEQ ID NO: 2832830 - protein, 5 aa, Entamoeba invadens
KFTEK

SEQ ID NO: 2832831 - protein, 14 aa, Entamoeba invadens
KGDAELDGVTNNPL

SEQ ID NO: 2832832 - protein, 7 aa, Entamoeba invadens
KGEQRMH

SEQ ID NO: 2832833 - protein, 4 aa, Entamoeba invadens
KGGF

SEQ ID NO: 2832834 - protein, 11 aa, Entamoeba invadens
KGKKKNGGKDV

SEQ ID NO: 2832835 - protein, 4 aa, Entamoeba invadens
KGNI

SEQ ID NO: 2832836 - protein, 5 aa, Entamoeba invadens
KGRAV

SEQ ID NO: 2832837 - protein, 8 aa, Entamoeba invadens
KGRLPTKA

SEQ ID NO: 2832838 - protein, 12 aa, Entamoeba invadens
KGVTTTITESTV

SEQ ID NO: 2832839 - protein, 9 aa, Entamoeba invadens
KHDPGRGAP

SEQ ID NO: 2832840 - protein, 8 aa, Entamoeba invadens
KHGKPNIY

SEQ ID NO: 2832841 - protein, 17 aa, Entamoeba invadens
KHPKEGKSKIRSKAPKI

SEQ ID NO: 2832842 - protein, 4 aa, Entamoeba invadens
KHPQ

SEQ ID NO: 2832843 - protein, 8 aa, Entamoeba invadens
KIGKEEKA

SEQ ID NO: 2832844 - protein, 5 aa, Entamoeba invadens
KIGQN

SEQ ID NO: 2832845 - protein, 7 aa, Entamoeba invadens
KINTNNS

SEQ ID NO: 2832846 - protein, 7 aa, Entamoeba invadens
KKDFESK

SEQ ID NO: 2832847 - protein, 16 aa, Entamoeba invadens
KKGLQQEVVGKKKAKR

SEQ ID NO: 2832848 - protein, 7 aa, Entamoeba invadens
KKGRGHV

SEQ ID NO: 2832849 - protein, 6 aa, Entamoeba invadens
KKHSEK

SEQ ID NO: 2832850 - protein, 8 aa, Entamoeba invadens
KKKYTKSA

SEQ ID NO: 2832851 - protein, 7 aa, Entamoeba invadens
KKSDEVD

SEQ ID NO: 2832852 - protein, 7 aa, Entamoeba invadens
KKTSVSW

SEQ ID NO: 2832853 - protein, 4 aa, Entamoeba invadens
KKVG

SEQ ID NO: 2832854 - protein, 8 aa, Entamoeba invadens
KKVGKIPN

SEQ ID NO: 2832855 - protein, 6 aa, Entamoeba invadens
KLAEKE

SEQ ID NO: 2832856 - protein, 8 aa, Entamoeba invadens
KLGENAVG

SEQ ID NO: 2832857 - protein, 7 aa, Entamoeba invadens
KLKEGAS

SEQ ID NO: 2832858 - protein, 5 aa, Entamoeba invadens
KLREG

SEQ ID NO: 2832859 - protein, 28 aa, Entamoeba invadens
KNADTDAADKKKLNGTVNESNKKIEELS

SEQ ID NO: 2832860 - protein, 9 aa, Entamoeba invadens
KNDLENKRE

SEQ ID NO: 2832861 - protein, 6 aa, Entamoeba invadens
KNFKRR

SEQ ID NO: 2832862 - protein, 6 aa, Entamoeba invadens
KNGDDI

SEQ ID NO: 2832863 - protein, 23 aa, Entamoeba invadens
KNLANDKDQLSSEKKKLQDEYDQ

SEQ ID NO: 2832864 - protein, 7 aa, Entamoeba invadens
KNNTPQK

SEQ ID NO: 2832865 - protein, 6 aa, Entamoeba invadens
KNQLTY

SEQ ID NO: 2832866 - protein, 4 aa, Entamoeba invadens
KNST

SEQ ID NO: 2832867 - protein, 6 aa, Entamoeba invadens
KNTFSE

SEQ ID NO: 2832868 - protein, 5 aa, Entamoeba invadens
KNTKI

SEQ ID NO: 2832869 - protein, 18 aa, Entamoeba invadens
KNVDSYSTTNDAGNERGS

SEQ ID NO: 2832870 - protein, 16 aa, Entamoeba invadens
KPGDRGHLARASGNYA

SEQ ID NO: 2832871 - protein, 20 aa, Entamoeba invadens
KPGKDTMKPSPEGVADYLVK

SEQ ID NO: 2832872 - protein, 20 aa, Entamoeba invadens
KPGKDTMKPTPEGVAAYLTK

SEQ ID NO: 2832873 - protein, 8 aa, Entamoeba invadens
KPSAELES

SEQ ID NO: 2832874 - protein, 4 aa, Entamoeba invadens
KPSK

SEQ ID NO: 2832875 - protein, 17 aa, Entamoeba invadens
KQKLETAKLTKGMQQNN

SEQ ID NO: 2832876 - protein, 9 aa, Entamoeba invadens
KQNRSERGR

SEQ ID NO: 2832877 - protein, 5 aa, Entamoeba invadens
KQYSN

SEQ ID NO: 2832878 - protein, 4 aa, Entamoeba invadens
KREE

SEQ ID NO: 2832879 - protein, 4 aa, Entamoeba invadens
KRIK

SEQ ID NO: 2832880 - protein, 8 aa, Entamoeba invadens
KRKSPKEL

SEQ ID NO: 2832881 - protein, 6 aa, Entamoeba invadens
KRPPKI

SEQ ID NO: 2832882 - protein, 8 aa, Entamoeba invadens
KRSDEIET

SEQ ID NO: 2832883 - protein, 10 aa, Entamoeba invadens
KSDMREDKDE

SEQ ID NO: 2832884 - protein, 7 aa, Entamoeba invadens
KSDPIHR

SEQ ID NO: 2832885 - protein, 4 aa, Entamoeba invadens
KSEL

SEQ ID NO: 2832886 - protein, 6 aa, Entamoeba invadens
KSESAF

SEQ ID NO: 2832887 - protein, 13 aa, Entamoeba invadens
KSFEESDDQELKA

SEQ ID NO: 2832888 - protein, 8 aa, Entamoeba invadens
KSGEDAVN

SEQ ID NO: 2832889 - protein, 6 aa, Entamoeba invadens
KSGKID

SEQ ID NO: 2832890 - protein, 4 aa, Entamoeba invadens
KSRS

SEQ ID NO: 2832891 - protein, 4 aa, Entamoeba invadens
KSVE

SEQ ID NO: 2832892 - protein, 5 aa, Entamoeba invadens
KSVKK

SEQ ID NO: 2832893 - protein, 4 aa, Entamoeba invadens
KSVS

SEQ ID NO: 2832894 - protein, 6 aa, Entamoeba invadens
KSYPTC

SEQ ID NO: 2832895 - protein, 17 aa, Entamoeba invadens
KTAQKKIQDVGGACELT

SEQ ID NO: 2832896 - protein, 12 aa, Entamoeba invadens
KTASKNTNPKIQ

SEQ ID NO: 2832897 - protein, 13 aa, Entamoeba invadens
KTCSSTSKKCHTC

SEQ ID NO: 2832898 - protein, 8 aa, Entamoeba invadens
KTDPKTAF

SEQ ID NO: 2832899 - protein, 22 aa, Entamoeba invadens
KTELDEKQDECDKLEDDMSEMK

SEQ ID NO: 2832900 - protein, 6 aa, Entamoeba invadens
KTGTVT

SEQ ID NO: 2832901 - protein, 6 aa, Entamoeba invadens
KTNPRK

SEQ ID NO: 2832902 - protein, 4 aa, Entamoeba invadens
KTPI

SEQ ID NO: 2832903 - protein, 4 aa, Entamoeba invadens
KTRY

SEQ ID NO: 2832904 - protein, 13 aa, Entamoeba invadens
KTTGTKVASDQLR

SEQ ID NO: 2832905 - protein, 6 aa, Entamoeba invadens
KVGADY

SEQ ID NO: 2832906 - protein, 4 aa, Entamoeba invadens
KVGE

SEQ ID NO: 2832907 - protein, 4 aa, Entamoeba invadens
KVKT

SEQ ID NO: 2832908 - protein, 4 aa, Entamoeba invadens
KYES

SEQ ID NO: 2832909 - protein, 11 aa, Entamoeba invadens
KYPNEDPPVIT

SEQ ID NO: 2832910 - protein, 6 aa, Entamoeba invadens
KYQDNM

SEQ ID NO: 2832911 - protein, 16 aa, Entamoeba invadens
LAEEIAKREAAEKALS

SEQ ID NO: 2832912 - protein, 4 aa, Entamoeba invadens
LAPL

SEQ ID NO: 2832913 - protein, 9 aa, Entamoeba invadens
LDNEDDLPL

SEQ ID NO: 2832914 - protein, 10 aa, Entamoeba invadens
LDNEDDLPMR

SEQ ID NO: 2832915 - protein, 16 aa, Entamoeba invadens
LDSKPNFDFKTNENEC

SEQ ID NO: 2832916 - protein, 14 aa, Entamoeba invadens
LEDAEREKAALNEE

SEQ ID NO: 2832917 - protein, 4 aa, Entamoeba invadens
LEDE

SEQ ID NO: 2832918 - protein, 4 aa, Entamoeba invadens
LEEE

SEQ ID NO: 2832919 - protein, 13 aa, Entamoeba invadens
LKAKQKRKKHKTQ

SEQ ID NO: 2832920 - protein, 10 aa, Entamoeba invadens
LKGRSPNAVK

SEQ ID NO: 2832921 - protein, 4 aa, Entamoeba invadens
LKKR

SEQ ID NO: 2832922 - protein, 7 aa, Entamoeba invadens
LKKRDEI

SEQ ID NO: 2832923 - protein, 17 aa, Entamoeba invadens
LNDSSTVEHQNEMESED

SEQ ID NO: 2832924 - protein, 4 aa, Entamoeba invadens
LNEL

SEQ ID NO: 2832925 - protein, 4 aa, Entamoeba invadens
LNEQ

SEQ ID NO: 2832926 - protein, 9 aa, Entamoeba invadens
LNKTDKQTF

SEQ ID NO: 2832927 - protein, 4 aa, Entamoeba invadens
LPES

SEQ ID NO: 2832928 - protein, 7 aa, Entamoeba invadens
LPESVTK

SEQ ID NO: 2832929 - protein, 7 aa, Entamoeba invadens
LPKSVTK

SEQ ID NO: 2832930 - protein, 4 aa, Entamoeba invadens
LPNN

SEQ ID NO: 2832931 - protein, 5 aa, Entamoeba invadens
LPNTL

SEQ ID NO: 2832932 - protein, 4 aa, Entamoeba invadens
LPPT

SEQ ID NO: 2832933 - protein, 10 aa, Entamoeba invadens
LPRDDENEAL

SEQ ID NO: 2832934 - protein, 4 aa, Entamoeba invadens
LPSD

SEQ ID NO: 2832935 - protein, 6 aa, Entamoeba invadens
LPTGGG

SEQ ID NO: 2832936 - protein, 6 aa, Entamoeba invadens
LPTSVT

SEQ ID NO: 2832937 - protein, 4 aa, Entamoeba invadens
LPTT

SEQ ID NO: 2832938 - protein, 5 aa, Entamoeba invadens
LPTTL

SEQ ID NO: 2832939 - protein, 4 aa, Entamoeba invadens
LRNE

SEQ ID NO: 2832940 - protein, 4 aa, Entamoeba invadens
LSDE

SEQ ID NO: 2832941 - protein, 8 aa, Entamoeba invadens
LSDFGSAR

SEQ ID NO: 2832942 - protein, 6 aa, Entamoeba invadens
LSKQRV

SEQ ID NO: 2832943 - protein, 17 aa, Entamoeba invadens
LSQKPNLTESQEFKPSS

SEQ ID NO: 2832944 - protein, 19 aa, Entamoeba invadens
LSRDSLEKAKTLALSSRTV

SEQ ID NO: 2832945 - protein, 6 aa, Entamoeba invadens
LSYPST

SEQ ID NO: 2832946 - protein, 4 aa, Entamoeba invadens
LTPE

SEQ ID NO: 2832947 - protein, 5 aa, Entamoeba invadens
LTPKT

SEQ ID NO: 2832948 - protein, 11 aa, Entamoeba invadens
LTSADIPSTVT

SEQ ID NO: 2832949 - protein, 10 aa, Entamoeba invadens
MIGDKGYKGI

SEQ ID NO: 2832950 - protein, 8 aa, Entamoeba invadens
MKGNSGIN

SEQ ID NO: 2832951 - protein, 8 aa, Entamoeba invadens
MKNTNSSV

SEQ ID NO: 2832952 - protein, 4 aa, Entamoeba invadens
NAQV

SEQ ID NO: 2832953 - protein, 8 aa, Entamoeba invadens
NDGNDKPL

SEQ ID NO: 2832954 - protein, 8 aa, Entamoeba invadens
NDKKPRDF

SEQ ID NO: 2832955 - protein, 4 aa, Entamoeba invadens
NEIP

SEQ ID NO: 2832956 - protein, 6 aa, Entamoeba invadens
NELEDE

SEQ ID NO: 2832957 - protein, 4 aa, Entamoeba invadens
NEQI

SEQ ID NO: 2832958 - protein, 7 aa, Entamoeba invadens
NESETCE

SEQ ID NO: 2832959 - protein, 5 aa, Entamoeba invadens
NFPTE

SEQ ID NO: 2832960 - protein, 6 aa, Entamoeba invadens
NFSSEE

SEQ ID NO: 2832961 - protein, 4 aa, Entamoeba invadens
NGKT

SEQ ID NO: 2832962 - protein, 4 aa, Entamoeba invadens
NGTS

SEQ ID NO: 2832963 - protein, 6 aa, Entamoeba invadens
NITESD

SEQ ID NO: 2832964 - protein, 8 aa, Entamoeba invadens
NKDEPSGI

SEQ ID NO: 2832965 - protein, 4 aa, Entamoeba invadens
NKKG

SEQ ID NO: 2832966 - protein, 4 aa, Entamoeba invadens
NKPF

SEQ ID NO: 2832967 - protein, 4 aa, Entamoeba invadens
NKTL

SEQ ID NO: 2832968 - protein, 9 aa, Entamoeba invadens
NNDGKLQYE

SEQ ID NO: 2832969 - protein, 6 aa, Entamoeba invadens
NNHKCH

SEQ ID NO: 2832970 - protein, 6 aa, Entamoeba invadens
NNQIDT

SEQ ID NO: 2832971 - protein, 4 aa, Entamoeba invadens
NNRN

SEQ ID NO: 2832972 - protein, 5 aa, Entamoeba invadens
NNSFE

SEQ ID NO: 2832973 - protein, 7 aa, Entamoeba invadens
NNSKHTV

SEQ ID NO: 2832974 - protein, 5 aa, Entamoeba invadens
NNTPV

SEQ ID NO: 2832975 - protein, 4 aa, Entamoeba invadens
NNTS

SEQ ID NO: 2832976 - protein, 5 aa, Entamoeba invadens
NPIED

SEQ ID NO: 2832977 - protein, 7 aa, Entamoeba invadens
NQFPNAQ

SEQ ID NO: 2832978 - protein, 4 aa, Entamoeba invadens
NQGY

SEQ ID NO: 2832979 - protein, 4 aa, Entamoeba invadens
NQNN

SEQ ID NO: 2832980 - protein, 7 aa, Entamoeba invadens
NRKLQTD

SEQ ID NO: 2832981 - protein, 8 aa, Entamoeba invadens
NRPPPPPM

SEQ ID NO: 2832982 - protein, 5 aa, Entamoeba invadens
NRSST

SEQ ID NO: 2832983 - protein, 4 aa, Entamoeba invadens
NSNT

SEQ ID NO: 2832984 - protein, 12 aa, Entamoeba invadens
NSTLKKKVGVEA

SEQ ID NO: 2832985 - protein, 4 aa, Entamoeba invadens
NTEK

SEQ ID NO: 2832986 - protein, 4 aa, Entamoeba invadens
NTNI

SEQ ID NO: 2832987 - protein, 8 aa, Entamoeba invadens
NTNSSQDP

SEQ ID NO: 2832988 - protein, 8 aa, Entamoeba invadens
NTPKKRDH

SEQ ID NO: 2832989 - protein, 6 aa, Entamoeba invadens
NTSKHN

SEQ ID NO: 2832990 - protein, 11 aa, Entamoeba invadens
NTSKPVTAGQN

SEQ ID NO: 2832991 - protein, 4 aa, Entamoeba invadens
NTSL

SEQ ID NO: 2832992 - protein, 6 aa, Entamoeba invadens
NTSSHI

SEQ ID NO: 2832993 - protein, 5 aa, Entamoeba invadens
NTTQF

SEQ ID NO: 2832994 - protein, 5 aa, Entamoeba invadens
NTVES

SEQ ID NO: 2832995 - protein, 8 aa, Entamoeba invadens
NVSNTFGR

SEQ ID NO: 2832996 - protein, 9 aa, Entamoeba invadens
NVTPNTTKL

SEQ ID NO: 2832997 - protein, 16 aa, Entamoeba invadens
NYKTPKSQGPSKSVTS

SEQ ID NO: 2832998 - protein, 8 aa, Entamoeba invadens
NYNQPKSY

SEQ ID NO: 2832999 - protein, 4 aa, Entamoeba invadens
PAAL

SEQ ID NO: 2833000 - protein, 4 aa, Entamoeba invadens
PAVN

SEQ ID NO: 2833001 - protein, 4 aa, Entamoeba invadens
PDGE

SEQ ID NO: 2833002 - protein, 4 aa, Entamoeba invadens
PDTF

SEQ ID NO: 2833003 - protein, 4 aa, Entamoeba invadens
PEKL

SEQ ID NO: 2833004 - protein, 4 aa, Entamoeba invadens
PETL

SEQ ID NO: 2833005 - protein, 16 aa, Entamoeba invadens
PGRRSNLNIDKNEGTS

SEQ ID NO: 2833006 - protein, 10 aa, Entamoeba invadens
PHEHDSTSYY

SEQ ID NO: 2833007 - protein, 6 aa, Entamoeba invadens
PKDQTK

SEQ ID NO: 2833008 - protein, 4 aa, Entamoeba invadens
PKIP

SEQ ID NO: 2833009 - protein, 7 aa, Entamoeba invadens
PKRASNI

SEQ ID NO: 2833010 - protein, 4 aa, Entamoeba invadens
PKTL

SEQ ID NO: 2833011 - protein, 6 aa, Entamoeba invadens
PKVPFD

SEQ ID NO: 2833012 - protein, 14 aa, Entamoeba invadens
PLRKGDRKRKTVRG

SEQ ID NO: 2833013 - protein, 7 aa, Entamoeba invadens
PNCKNYT

SEQ ID NO: 2833014 - protein, 24 aa, Entamoeba invadens
PNTPLTNPEKLGRRKRKARKDAKG

SEQ ID NO: 2833015 - protein, 12 aa, Entamoeba invadens
PNYEYTDTSHQT

SEQ ID NO: 2833016 - protein, 8 aa, Entamoeba invadens
PPCGKSKA

SEQ ID NO: 2833017 - protein, 5 aa, Entamoeba invadens
PPPGM

SEQ ID NO: 2833018 - protein, 7 aa, Entamoeba invadens
PPPPPMM

SEQ ID NO: 2833019 - protein, 5 aa, Entamoeba invadens
PQEEI

SEQ ID NO: 2833020 - protein, 4 aa, Entamoeba invadens
PQES

SEQ ID NO: 2833021 - protein, 4 aa, Entamoeba invadens
PQKT

SEQ ID NO: 2833022 - protein, 5 aa, Entamoeba invadens
PQRIQ

SEQ ID NO: 2833023 - protein, 5 aa, Entamoeba invadens
PQSNQ

SEQ ID NO: 2833024 - protein, 10 aa, Entamoeba invadens
PQSYNKQYSN

SEQ ID NO: 2833025 - protein, 7 aa, Entamoeba invadens
PQYGARP

SEQ ID NO: 2833026 - protein, 4 aa, Entamoeba invadens
PSEV

SEQ ID NO: 2833027 - protein, 9 aa, Entamoeba invadens
PSNKHPTLT

SEQ ID NO: 2833028 - protein, 8 aa, Entamoeba invadens
PSSQGGIG

SEQ ID NO: 2833029 - protein, 7 aa, Entamoeba invadens
PTDNYTN

SEQ ID NO: 2833030 - protein, 11 aa, Entamoeba invadens
PTDTSVQLTPN

SEQ ID NO: 2833031 - protein, 4 aa, Entamoeba invadens
PTGH

SEQ ID NO: 2833032 - protein, 6 aa, Entamoeba invadens
PTIPSG

SEQ ID NO: 2833033 - protein, 14 aa, Entamoeba invadens
PTTRAISNIKTNAY

SEQ ID NO: 2833034 - protein, 14 aa, Entamoeba invadens
QALGSSNSHSALYS

SEQ ID NO: 2833035 - protein, 15 aa, Entamoeba invadens
QAVKGKIDKNKRTVT

SEQ ID NO: 2833036 - protein, 5 aa, Entamoeba invadens
QCPEG

SEQ ID NO: 2833037 - protein, 9 aa, Entamoeba invadens
QEKYKKSAD

SEQ ID NO: 2833038 - protein, 8 aa, Entamoeba invadens
QEKYTKSA

SEQ ID NO: 2833039 - protein, 4 aa, Entamoeba invadens
QEQN

SEQ ID NO: 2833040 - protein, 9 aa, Entamoeba invadens
QGRPTPVRP

SEQ ID NO: 2833041 - protein, 8 aa, Entamoeba invadens
QHQDANEV

SEQ ID NO: 2833042 - protein, 23 aa, Entamoeba invadens
QHRNAREDQSGEDETEIEADFRD

SEQ ID NO: 2833043 - protein, 6 aa, Entamoeba invadens
QKKFQD

SEQ ID NO: 2833044 - protein, 20 aa, Entamoeba invadens
QKNSQPEEIDNLERKDTQLT

SEQ ID NO: 2833045 - protein, 7 aa, Entamoeba invadens
QKQVDET

SEQ ID NO: 2833046 - protein, 12 aa, Entamoeba invadens
QKVDVSKVNTEG

SEQ ID NO: 2833047 - protein, 4 aa, Entamoeba invadens
QKYF

SEQ ID NO: 2833048 - protein, 8 aa, Entamoeba invadens
QKYKESAD

SEQ ID NO: 2833049 - protein, 8 aa, Entamoeba invadens
QLDNPDDL

SEQ ID NO: 2833050 - protein, 6 aa, Entamoeba invadens
QLPENR

SEQ ID NO: 2833051 - protein, 5 aa, Entamoeba invadens
QNEGR

SEQ ID NO: 2833052 - protein, 4 aa, Entamoeba invadens
QNKF

SEQ ID NO: 2833053 - protein, 4 aa, Entamoeba invadens
QNTL

SEQ ID NO: 2833054 - protein, 5 aa, Entamoeba invadens
QPAIN

SEQ ID NO: 2833055 - protein, 4 aa, Entamoeba invadens
QPNE

SEQ ID NO: 2833056 - protein, 10 aa, Entamoeba invadens
QRDLTEEAAK

SEQ ID NO: 2833057 - protein, 4 aa, Entamoeba invadens
QSNE

SEQ ID NO: 2833058 - protein, 12 aa, Entamoeba invadens
QTLNDNPLSRSN

SEQ ID NO: 2833059 - protein, 16 aa, Entamoeba invadens
QVQISTDNNDDDVEDE

SEQ ID NO: 2833060 - protein, 8 aa, Entamoeba invadens
RAQDLSTS

SEQ ID NO: 2833061 - protein, 7 aa, Entamoeba invadens
RDDISQE

SEQ ID NO: 2833062 - protein, 8 aa, Entamoeba invadens
RDISDNSA

SEQ ID NO: 2833063 - protein, 10 aa, Entamoeba invadens
RGDNLTVSSE

SEQ ID NO: 2833064 - protein, 4 aa, Entamoeba invadens
RGLP

SEQ ID NO: 2833065 - protein, 4 aa, Entamoeba invadens
RGSI

SEQ ID NO: 2833066 - protein, 8 aa, Entamoeba invadens
RKDAGSLM

SEQ ID NO: 2833067 - protein, 6 aa, Entamoeba invadens
RKEKEV

SEQ ID NO: 2833068 - protein, 8 aa, Entamoeba invadens
RKKETKEH

SEQ ID NO: 2833069 - protein, 9 aa, Entamoeba invadens
RKLHRESNR

SEQ ID NO: 2833070 - protein, 6 aa, Entamoeba invadens
RKQCRE

SEQ ID NO: 2833071 - protein, 19 aa, Entamoeba invadens
RKRRNLSQESVNRNKSRLE

SEQ ID NO: 2833072 - protein, 13 aa, Entamoeba invadens
RLPSGAKKTLKSA

SEQ ID NO: 2833073 - protein, 5 aa, Entamoeba invadens
RLTPH

SEQ ID NO: 2833074 - protein, 21 aa, Entamoeba invadens
RMPSENETDIERIEREDANAV

SEQ ID NO: 2833075 - protein, 9 aa, Entamoeba invadens
RNAPEKKLS

SEQ ID NO: 2833076 - protein, 5 aa, Entamoeba invadens
RNLKG

SEQ ID NO: 2833077 - protein, 7 aa, Entamoeba invadens
RNSMPRD

SEQ ID NO: 2833078 - protein, 5 aa, Entamoeba invadens
RNYSN

SEQ ID NO: 2833079 - protein, 9 aa, Entamoeba invadens
RPENKYSAE

SEQ ID NO: 2833080 - protein, 5 aa, Entamoeba invadens
RQYGV

SEQ ID NO: 2833081 - protein, 6 aa, Entamoeba invadens
RRGGVK

SEQ ID NO: 2833082 - protein, 5 aa, Entamoeba invadens
RRQND

SEQ ID NO: 2833083 - protein, 4 aa, Entamoeba invadens
RSGS

SEQ ID NO: 2833084 - protein, 34 aa, Entamoeba invadens
RVEVPEEAKQIKRYDPNDDKKATTREADSTEVYT

SEQ ID NO: 2833085 - protein, 8 aa, Entamoeba invadens
SAETQTTR

SEQ ID NO: 2833086 - protein, 11 aa, Entamoeba invadens
SALSKKYSQDL

SEQ ID NO: 2833087 - protein, 8 aa, Entamoeba invadens
SATDPKRI

SEQ ID NO: 2833088 - protein, 6 aa, Entamoeba invadens
SDEHGD

SEQ ID NO: 2833089 - protein, 6 aa, Entamoeba invadens
SDIDTS

SEQ ID NO: 2833090 - protein, 4 aa, Entamoeba invadens
SDSL

SEQ ID NO: 2833091 - protein, 9 aa, Entamoeba invadens
SECSSEDFD

SEQ ID NO: 2833092 - protein, 7 aa, Entamoeba invadens
SEEESLP

SEQ ID NO: 2833093 - protein, 19 aa, Entamoeba invadens
SEITSNGKELTRGQRDAEL

SEQ ID NO: 2833094 - protein, 6 aa, Entamoeba invadens
SEPMPQ

SEQ ID NO: 2833095 - protein, 8 aa, Entamoeba invadens
SETTAEGV

SEQ ID NO: 2833096 - protein, 10 aa, Entamoeba invadens
SEVSDTSGVC

SEQ ID NO: 2833097 - protein, 5 aa, Entamoeba invadens
SFPSQ

SEQ ID NO: 2833098 - protein, 7 aa, Entamoeba invadens
SGDVYSK

SEQ ID NO: 2833099 - protein, 5 aa, Entamoeba invadens
SGKKY

SEQ ID NO: 2833100 - protein, 7 aa, Entamoeba invadens
SGVGKTS

SEQ ID NO: 2833101 - protein, 13 aa, Entamoeba invadens
SHEDRKIRTPPKR

SEQ ID NO: 2833102 - protein, 4 aa, Entamoeba invadens
SIPN

SEQ ID NO: 2833103 - protein, 4 aa, Entamoeba invadens
SITI

SEQ ID NO: 2833104 - protein, 6 aa, Entamoeba invadens
SKDDVE

SEQ ID NO: 2833105 - protein, 6 aa, Entamoeba invadens
SKEEDV

SEQ ID NO: 2833106 - protein, 8 aa, Entamoeba invadens
SKQADFGQ

SEQ ID NO: 2833107 - protein, 7 aa, Entamoeba invadens
SKQRPRK

SEQ ID NO: 2833108 - protein, 4 aa, Entamoeba invadens
SKWQ

SEQ ID NO: 2833109 - protein, 9 aa, Entamoeba invadens
SLPSTLKKA

SEQ ID NO: 2833110 - protein, 19 aa, Entamoeba invadens
SLYGRKADENERGKKSPCY

SEQ ID NO: 2833111 - protein, 6 aa, Entamoeba invadens
SNAQIQ

SEQ ID NO: 2833112 - protein, 11 aa, Entamoeba invadens
SNGTKMPEYYP

SEQ ID NO: 2833113 - protein, 4 aa, Entamoeba invadens
SNGV

SEQ ID NO: 2833114 - protein, 6 aa, Entamoeba invadens
SNLPTN

SEQ ID NO: 2833115 - protein, 4 aa, Entamoeba invadens
SNPD

SEQ ID NO: 2833116 - protein, 9 aa, Entamoeba invadens
SNPTGKIKE

SEQ ID NO: 2833117 - protein, 4 aa, Entamoeba invadens
SNSI

SEQ ID NO: 2833118 - protein, 8 aa, Entamoeba invadens
SNTTYPQN

SEQ ID NO: 2833119 - protein, 10 aa, Entamoeba invadens
SQKFDDQKEA

SEQ ID NO: 2833120 - protein, 7 aa, Entamoeba invadens
SQQLPPE

SEQ ID NO: 2833121 - protein, 5 aa, Entamoeba invadens
SRGKL

SEQ ID NO: 2833122 - protein, 7 aa, Entamoeba invadens
SSAFSNC

SEQ ID NO: 2833123 - protein, 4 aa, Entamoeba invadens
SSFD

SEQ ID NO: 2833124 - protein, 4 aa, Entamoeba invadens
SSHT

SEQ ID NO: 2833125 - protein, 4 aa, Entamoeba invadens
SSNE

SEQ ID NO: 2833126 - protein, 4 aa, Entamoeba invadens
SSTV

SEQ ID NO: 2833127 - protein, 4 aa, Entamoeba invadens
SSVR

SEQ ID NO: 2833128 - protein, 6 aa, Entamoeba invadens
SSYPNT

SEQ ID NO: 2833129 - protein, 6 aa, Entamoeba invadens
STEESY

SEQ ID NO: 2833130 - protein, 4 aa, Entamoeba invadens
STFE

SEQ ID NO: 2833131 - protein, 4 aa, Entamoeba invadens
STNE

SEQ ID NO: 2833132 - protein, 13 aa, Entamoeba invadens
STPQPDALEPGQS

SEQ ID NO: 2833133 - protein, 16 aa, Entamoeba invadens
STRVLGDGDVTPAGGL

SEQ ID NO: 2833134 - protein, 5 aa, Entamoeba invadens
STSSF

SEQ ID NO: 2833135 - protein, 8 aa, Entamoeba invadens
STSVSQSY

SEQ ID NO: 2833136 - protein, 4 aa, Entamoeba invadens
SVAA

SEQ ID NO: 2833137 - protein, 6 aa, Entamoeba invadens
SVNIPS

SEQ ID NO: 2833138 - protein, 9 aa, Entamoeba invadens
SVNIPSSVT

SEQ ID NO: 2833139 - protein, 12 aa, Entamoeba invadens
SVSENNEVNESK

SEQ ID NO: 2833140 - protein, 5 aa, Entamoeba invadens
SVTIP

SEQ ID NO: 2833141 - protein, 12 aa, Entamoeba invadens
SVTIPSSVTSIG

SEQ ID NO: 2833142 - protein, 11 aa, Entamoeba invadens
SVTIPSTVTSI

SEQ ID NO: 2833143 - protein, 5 aa, Entamoeba invadens
SVTKI

SEQ ID NO: 2833144 - protein, 13 aa, Entamoeba invadens
SWRNNSNERNDAC

SEQ ID NO: 2833145 - protein, 5 aa, Entamoeba invadens
SYYRG

SEQ ID NO: 2833146 - protein, 5 aa, Entamoeba invadens
TAIGN

SEQ ID NO: 2833147 - protein, 6 aa, Entamoeba invadens
TAKTIA

SEQ ID NO: 2833148 - protein, 7 aa, Entamoeba invadens
TATESEK

SEQ ID NO: 2833149 - protein, 14 aa, Entamoeba invadens
TCNGNCDQTTGKCT

SEQ ID NO: 2833150 - protein, 7 aa, Entamoeba invadens
TDESKEM

SEQ ID NO: 2833151 - protein, 4 aa, Entamoeba invadens
TDHN

SEQ ID NO: 2833152 - protein, 4 aa, Entamoeba invadens
TDKL

SEQ ID NO: 2833153 - protein, 5 aa, Entamoeba invadens
TDRTT

SEQ ID NO: 2833154 - protein, 11 aa, Entamoeba invadens
TEAPKEHGGVG

SEQ ID NO: 2833155 - protein, 6 aa, Entamoeba invadens
TEDESF

SEQ ID NO: 2833156 - protein, 4 aa, Entamoeba invadens
TEEY

SEQ ID NO: 2833157 - protein, 7 aa, Entamoeba invadens
TEPDHSG

SEQ ID NO: 2833158 - protein, 11 aa, Entamoeba invadens
TETTNGHGGAV

SEQ ID NO: 2833159 - protein, 4 aa, Entamoeba invadens
TFEQ

SEQ ID NO: 2833160 - protein, 5 aa, Entamoeba invadens
TFTEQ

SEQ ID NO: 2833161 - protein, 16 aa, Entamoeba invadens
TGDGSFEGLGWLYSKF

SEQ ID NO: 2833162 - protein, 4 aa, Entamoeba invadens
TGEC

SEQ ID NO: 2833163 - protein, 10 aa, Entamoeba invadens
TGEGLDKEPE

SEQ ID NO: 2833164 - protein, 7 aa, Entamoeba invadens
TGFNPDK

SEQ ID NO: 2833165 - protein, 10 aa, Entamoeba invadens
TGGSDKDGFP

SEQ ID NO: 2833166 - protein, 4 aa, Entamoeba invadens
TGKT

SEQ ID NO: 2833167 - protein, 4 aa, Entamoeba invadens
TGKW

SEQ ID NO: 2833168 - protein, 6 aa, Entamoeba invadens
TGTSQA

SEQ ID NO: 2833169 - protein, 6 aa, Entamoeba invadens
THYARR

SEQ ID NO: 2833170 - protein, 11 aa, Entamoeba invadens
TIEDSYRTSIS

SEQ ID NO: 2833171 - protein, 15 aa, Entamoeba invadens
TIKAASTKINNKECR

SEQ ID NO: 2833172 - protein, 8 aa, Entamoeba invadens
TIPPSVTS

SEQ ID NO: 2833173 - protein, 6 aa, Entamoeba invadens
TIPSSV

SEQ ID NO: 2833174 - protein, 7 aa, Entamoeba invadens
TIPSSVT

SEQ ID NO: 2833175 - protein, 9 aa, Entamoeba invadens
TIPSSVTSI

SEQ ID NO: 2833176 - protein, 4 aa, Entamoeba invadens
TISS

SEQ ID NO: 2833177 - protein, 4 aa, Entamoeba invadens
TKEK

SEQ ID NO: 2833178 - protein, 4 aa, Entamoeba invadens
TKEV

SEQ ID NO: 2833179 - protein, 5 aa, Entamoeba invadens
TKIPF

SEQ ID NO: 2833180 - protein, 16 aa, Entamoeba invadens
TKNDRLKYGSTIPKEV

SEQ ID NO: 2833181 - protein, 7 aa, Entamoeba invadens
TKNNTKV

SEQ ID NO: 2833182 - protein, 8 aa, Entamoeba invadens
TKPTQAIY

SEQ ID NO: 2833183 - protein, 5 aa, Entamoeba invadens
TLPKS

SEQ ID NO: 2833184 - protein, 6 aa, Entamoeba invadens
TLRGGE

SEQ ID NO: 2833185 - protein, 6 aa, Entamoeba invadens
TNEGKC

SEQ ID NO: 2833186 - protein, 11 aa, Entamoeba invadens
TNLDKKQTTFG

SEQ ID NO: 2833187 - protein, 4 aa, Entamoeba invadens
TNNS

SEQ ID NO: 2833188 - protein, 5 aa, Entamoeba invadens
TNSEN

SEQ ID NO: 2833189 - protein, 4 aa, Entamoeba invadens
TNVG

SEQ ID NO: 2833190 - protein, 7 aa, Entamoeba invadens
TPHNRNR

SEQ ID NO: 2833191 - protein, 4 aa, Entamoeba invadens
TPIT

SEQ ID NO: 2833192 - protein, 4 aa, Entamoeba invadens
TPSY

SEQ ID NO: 2833193 - protein, 4 aa, Entamoeba invadens
TQSV

SEQ ID NO: 2833194 - protein, 7 aa, Entamoeba invadens
TQTSNKG

SEQ ID NO: 2833195 - protein, 9 aa, Entamoeba invadens
TQVEKDSEL

SEQ ID NO: 2833196 - protein, 19 aa, Entamoeba invadens
TRKPSQIKKTSYAKKGQAK

SEQ ID NO: 2833197 - protein, 6 aa, Entamoeba invadens
TRNNRA

SEQ ID NO: 2833198 - protein, 4 aa, Entamoeba invadens
TRPL

SEQ ID NO: 2833199 - protein, 4 aa, Entamoeba invadens
TRYP

SEQ ID NO: 2833200 - protein, 5 aa, Entamoeba invadens
TSKHN

SEQ ID NO: 2833201 - protein, 4 aa, Entamoeba invadens
TSPL

SEQ ID NO: 2833202 - protein, 9 aa, Entamoeba invadens
TSQGSDPYS

SEQ ID NO: 2833203 - protein, 4 aa, Entamoeba invadens
TSQY

SEQ ID NO: 2833204 - protein, 5 aa, Entamoeba invadens
TSVTS

SEQ ID NO: 2833205 - protein, 14 aa, Entamoeba invadens
TTDGASVCSGLDGG

SEQ ID NO: 2833206 - protein, 5 aa, Entamoeba invadens
TTGCY

SEQ ID NO: 2833207 - protein, 4 aa, Entamoeba invadens
TTIG

SEQ ID NO: 2833208 - protein, 6 aa, Entamoeba invadens
TTPQCP

SEQ ID NO: 2833209 - protein, 8 aa, Entamoeba invadens
TTQKEENK

SEQ ID NO: 2833210 - protein, 10 aa, Entamoeba invadens
TTQNDKEKFE

SEQ ID NO: 2833211 - protein, 6 aa, Entamoeba invadens
TTQPQL

SEQ ID NO: 2833212 - protein, 11 aa, Entamoeba invadens
TVDKNKSRNIE

SEQ ID NO: 2833213 - protein, 7 aa, Entamoeba invadens
TVGGDGS

SEQ ID NO: 2833214 - protein, 12 aa, Entamoeba invadens
TYTEHGKRRTVT

SEQ ID NO: 2833215 - protein, 20 aa, Entamoeba invadens
TYTQNDREKFGNNIPSSVTS

SEQ ID NO: 2833216 - protein, 15 aa, Entamoeba invadens
TYTQNDRKKFGNNIP

SEQ ID NO: 2833217 - protein, 6 aa, Entamoeba invadens
VAPPED

SEQ ID NO: 2833218 - protein, 8 aa, Entamoeba invadens
VDRYTSPW

SEQ ID NO: 2833219 - protein, 16 aa, Entamoeba invadens
VEGRSSSTEGKINAKH

SEQ ID NO: 2833220 - protein, 4 aa, Entamoeba invadens
VEKE

SEQ ID NO: 2833221 - protein, 4 aa, Entamoeba invadens
VEYR

SEQ ID NO: 2833222 - protein, 4 aa, Entamoeba invadens
VITT

SEQ ID NO: 2833223 - protein, 7 aa, Entamoeba invadens
VKEIGTD

SEQ ID NO: 2833224 - protein, 10 aa, Entamoeba invadens
VKEPLTKEKL

SEQ ID NO: 2833225 - protein, 16 aa, Entamoeba invadens
VKKDNKSDSESESESF

SEQ ID NO: 2833226 - protein, 5 aa, Entamoeba invadens
VKSIG

SEQ ID NO: 2833227 - protein, 5 aa, Entamoeba invadens
VNEEI

SEQ ID NO: 2833228 - protein, 5 aa, Entamoeba invadens
VNPMA

SEQ ID NO: 2833229 - protein, 9 aa, Entamoeba invadens
VPVQDPAPV

SEQ ID NO: 2833230 - protein, 13 aa, Entamoeba invadens
VQEQYKNAKLGEQ

SEQ ID NO: 2833231 - protein, 10 aa, Entamoeba invadens
VQRNSDQKEV

SEQ ID NO: 2833232 - protein, 10 aa, Entamoeba invadens
VSENGKCTES

SEQ ID NO: 2833233 - protein, 11 aa, Entamoeba invadens
VSKSDKDARRA

SEQ ID NO: 2833234 - protein, 14 aa, Entamoeba invadens
VSQYTTKKITDIES

SEQ ID NO: 2833235 - protein, 10 aa, Entamoeba invadens
VSSHMSEEQI

SEQ ID NO: 2833236 - protein, 5 aa, Entamoeba invadens
VTEKK

SEQ ID NO: 2833237 - protein, 10 aa, Entamoeba invadens
VTKEKSEPIA

SEQ ID NO: 2833238 - protein, 4 aa, Entamoeba invadens
VTPN

SEQ ID NO: 2833239 - protein, 8 aa, Entamoeba invadens
VVNNEDKS

SEQ ID NO: 2833240 - protein, 10 aa, Entamoeba invadens
WNPQNDLQAQ

SEQ ID NO: 2833241 - protein, 4 aa, Entamoeba invadens
YAGK

SEQ ID NO: 2833242 - protein, 5 aa, Entamoeba invadens
YDPRC

SEQ ID NO: 2833243 - protein, 15 aa, Entamoeba invadens
YDYTNSYSVDRSQKR

SEQ ID NO: 2833244 - protein, 4 aa, Entamoeba invadens
YEEV

SEQ ID NO: 2833245 - protein, 4 aa, Entamoeba invadens
YESY

SEQ ID NO: 2833246 - protein, 4 aa, Entamoeba invadens
YGSG

SEQ ID NO: 2833247 - protein, 13 aa, Entamoeba invadens
YKGETKKFTPEEI

SEQ ID NO: 2833248 - protein, 7 aa, Entamoeba invadens
YKRNPDY

SEQ ID NO: 2833249 - protein, 5 aa, Entamoeba invadens
YMRSG

SEQ ID NO: 2833250 - protein, 4 aa, Entamoeba invadens
YNET

SEQ ID NO: 2833251 - protein, 5 aa, Entamoeba invadens
YNGNM

SEQ ID NO: 2833252 - protein, 14 aa, Entamoeba invadens
YPGSNIGPEPTTDG

SEQ ID NO: 2833253 - protein, 12 aa, Entamoeba invadens
YSDGNNDLGGNN

SEQ ID NO: 2833254 - protein, 5 aa, Entamoeba invadens
YSSKL

SEQ ID NO: 2833255 - protein, 7 aa, Entamoeba invadens
YSTGKTT

SEQ ID NO: 2833256 - protein, 4 aa, Entamoeba invadens
YTEH

SEQ ID NO: 2833257 - protein, 7 aa, Entamoeba invadens
AAAPGYF

SEQ ID NO: 2833258 - protein, 9 aa, Entamoeba invadens
AAAPSYYKP

SEQ ID NO: 2833259 - protein, 9 aa, Entamoeba invadens
AADSAKLPK

SEQ ID NO: 2833260 - protein, 4 aa, Entamoeba invadens
AADT

SEQ ID NO: 2833261 - protein, 6 aa, Entamoeba invadens
AAGQIG

SEQ ID NO: 2833262 - protein, 9 aa, Entamoeba invadens
AAKAPGAER

SEQ ID NO: 2833263 - protein, 9 aa, Entamoeba invadens
AAKQKDDKL

SEQ ID NO: 2833264 - protein, 5 aa, Entamoeba invadens
AAPDQ

SEQ ID NO: 2833265 - protein, 7 aa, Entamoeba invadens
AAQDVAK

SEQ ID NO: 2833266 - protein, 20 aa, Entamoeba invadens
AARPGQADKSEYKPISRTRK

SEQ ID NO: 2833267 - protein, 31 aa, Entamoeba invadens
AASGATEEKKEEVQEEKKEEAEEDFGGFGDL

SEQ ID NO: 2833268 - protein, 4 aa, Entamoeba invadens
ACGN

SEQ ID NO: 2833269 - protein, 7 aa, Entamoeba invadens
ACTNKKC

SEQ ID NO: 2833270 - protein, 4 aa, Entamoeba invadens
ADAE

SEQ ID NO: 2833271 - protein, 5 aa, Entamoeba invadens
ADCAQ

SEQ ID NO: 2833272 - protein, 6 aa, Entamoeba invadens
ADDKNY

SEQ ID NO: 2833273 - protein, 5 aa, Entamoeba invadens
ADEQG

SEQ ID NO: 2833274 - protein, 5 aa, Entamoeba invadens
ADFDA

SEQ ID NO: 2833275 - protein, 9 aa, Entamoeba invadens
ADGQTRNDL

SEQ ID NO: 2833276 - protein, 4 aa, Entamoeba invadens
ADIK

SEQ ID NO: 2833277 - protein, 8 aa, Entamoeba invadens
ADKDVKNP

SEQ ID NO: 2833278 - protein, 7 aa, Entamoeba invadens
ADPILPA

SEQ ID NO: 2833279 - protein, 9 aa, Entamoeba invadens
ADRLQTGMR

SEQ ID NO: 2833280 - protein, 18 aa, Entamoeba invadens
ADTNSKISKISHPSDPSI

SEQ ID NO: 2833281 - protein, 13 aa, Entamoeba invadens
ADVNKKEFNDGTT

SEQ ID NO: 2833282 - protein, 4 aa, Entamoeba invadens
AEAE

SEQ ID NO: 2833283 - protein, 6 aa, Entamoeba invadens
AEEHND

SEQ ID NO: 2833284 - protein, 4 aa, Entamoeba invadens
AEGE

SEQ ID NO: 2833285 - protein, 12 aa, Entamoeba invadens
AEGVKADGFKQD

SEQ ID NO: 2833286 - protein, 20 aa, Entamoeba invadens
AEIGTDGGSNTRDGGKGMAG

SEQ ID NO: 2833287 - protein, 6 aa, Entamoeba invadens
AEIQQQ

SEQ ID NO: 2833288 - protein, 5 aa, Entamoeba invadens
AEKEK

SEQ ID NO: 2833289 - protein, 45 aa, Entamoeba invadens
AELEKNKAANKELQAKLDETADNKDKLEADAENMNRKKDAQEKQL

SEQ ID NO: 2833290 - protein, 20 aa, Entamoeba invadens
AELKKTKNRLKKMQKDDSDS

SEQ ID NO: 2833291 - protein, 8 aa, Entamoeba invadens
AELKNPDI

SEQ ID NO: 2833292 - protein, 14 aa, Entamoeba invadens
AELKSPSPAKAGII

SEQ ID NO: 2833293 - protein, 4 aa, Entamoeba invadens
AEMY

SEQ ID NO: 2833294 - protein, 5 aa, Entamoeba invadens
AENNK

SEQ ID NO: 2833295 - protein, 17 aa, Entamoeba invadens
AENSPSVEENGFIQHSG

SEQ ID NO: 2833296 - protein, 8 aa, Entamoeba invadens
AEQYARGI

SEQ ID NO: 2833297 - protein, 5 aa, Entamoeba invadens
AERKN

SEQ ID NO: 2833298 - protein, 5 aa, Entamoeba invadens
AERRN

SEQ ID NO: 2833299 - protein, 5 aa, Entamoeba invadens
AERRT

SEQ ID NO: 2833300 - protein, 7 aa, Entamoeba invadens
AESAQLK

SEQ ID NO: 2833301 - protein, 9 aa, Entamoeba invadens
AESGSTSKQ

SEQ ID NO: 2833302 - protein, 8 aa, Entamoeba invadens
AESGTAAF

SEQ ID NO: 2833303 - protein, 4 aa, Entamoeba invadens
AEYN

SEQ ID NO: 2833304 - protein, 7 aa, Entamoeba invadens
AFEKQNE

SEQ ID NO: 2833305 - protein, 5 aa, Entamoeba invadens
AFPET

SEQ ID NO: 2833306 - protein, 8 aa, Entamoeba invadens
AFPGLKGT

SEQ ID NO: 2833307 - protein, 4 aa, Entamoeba invadens
AFRA

SEQ ID NO: 2833308 - protein, 7 aa, Entamoeba invadens
AGADPKK

SEQ ID NO: 2833309 - protein, 10 aa, Entamoeba invadens
AGDDSFQLDS

SEQ ID NO: 2833310 - protein, 4 aa, Entamoeba invadens
AGES

SEQ ID NO: 2833311 - protein, 6 aa, Entamoeba invadens
AGIKEE

SEQ ID NO: 2833312 - protein, 20 aa, Entamoeba invadens
AGKENTSEKNEAAKENSTGI

SEQ ID NO: 2833313 - protein, 8 aa, Entamoeba invadens
AGKGRTGL

SEQ ID NO: 2833314 - protein, 4 aa, Entamoeba invadens
AGQE

SEQ ID NO: 2833315 - protein, 8 aa, Entamoeba invadens
AGQEEYES

SEQ ID NO: 2833316 - protein, 7 aa, Entamoeba invadens
AGQEKYR

SEQ ID NO: 2833317 - protein, 7 aa, Entamoeba invadens
AGQERFR

SEQ ID NO: 2833318 - protein, 5 aa, Entamoeba invadens
AGSKM

SEQ ID NO: 2833319 - protein, 5 aa, Entamoeba invadens
AGTTD

SEQ ID NO: 2833320 - protein, 5 aa, Entamoeba invadens
AGVGD

SEQ ID NO: 2833321 - protein, 5 aa, Entamoeba invadens
AGVPW

SEQ ID NO: 2833322 - protein, 11 aa, Entamoeba invadens
AGYNGNNKAGA

SEQ ID NO: 2833323 - protein, 9 aa, Entamoeba invadens
AHPPTDGIY

SEQ ID NO: 2833324 - protein, 4 aa, Entamoeba invadens
AIET

SEQ ID NO: 2833325 - protein, 6 aa, Entamoeba invadens
AIGGEE

SEQ ID NO: 2833326 - protein, 10 aa, Entamoeba invadens
AIKSEGKGHG

SEQ ID NO: 2833327 - protein, 9 aa, Entamoeba invadens
AKCKENDTI

SEQ ID NO: 2833328 - protein, 4 aa, Entamoeba invadens
AKEN

SEQ ID NO: 2833329 - protein, 4 aa, Entamoeba invadens
AKEY

SEQ ID NO: 2833330 - protein, 6 aa, Entamoeba invadens
AKIANA

SEQ ID NO: 2833331 - protein, 6 aa, Entamoeba invadens
AKKANY

SEQ ID NO: 2833332 - protein, 8 aa, Entamoeba invadens
AKKSQASG

SEQ ID NO: 2833333 - protein, 13 aa, Entamoeba invadens
AKLSGKKGKPQIT

SEQ ID NO: 2833334 - protein, 9 aa, Entamoeba invadens
AKLTDFGSA

SEQ ID NO: 2833335 - protein, 6 aa, Entamoeba invadens
AKNTKI

SEQ ID NO: 2833336 - protein, 21 aa, Entamoeba invadens
AKPMDKERAELSKDELRSYET

SEQ ID NO: 2833337 - protein, 11 aa, Entamoeba invadens
AKRGRPEERNY

SEQ ID NO: 2833338 - protein, 10 aa, Entamoeba invadens
AKRNSEDKLE

SEQ ID NO: 2833339 - protein, 8 aa, Entamoeba invadens
AKSPNTSL

SEQ ID NO: 2833340 - protein, 6 aa, Entamoeba invadens
AKSSQH

SEQ ID NO: 2833341 - protein, 16 aa, Entamoeba invadens
AKTIADTFNEQKVSSM

SEQ ID NO: 2833342 - protein, 15 aa, Entamoeba invadens
AKTKLGDYNKYKTTM

SEQ ID NO: 2833343 - protein, 7 aa, Entamoeba invadens
AKTQMTT

SEQ ID NO: 2833344 - protein, 5 aa, Entamoeba invadens
AKVPG

SEQ ID NO: 2833345 - protein, 7 aa, Entamoeba invadens
AKVRSGK

SEQ ID NO: 2833346 - protein, 12 aa, Entamoeba invadens
AKVTGGQPAKLS

SEQ ID NO: 2833347 - protein, 7 aa, Entamoeba invadens
AKYETEL

SEQ ID NO: 2833348 - protein, 5 aa, Entamoeba invadens
ALADF

SEQ ID NO: 2833349 - protein, 4 aa, Entamoeba invadens
ALAG

SEQ ID NO: 2833350 - protein, 6 aa, Entamoeba invadens
ALEAQK

SEQ ID NO: 2833351 - protein, 11 aa, Entamoeba invadens
ALENASKGRTT

SEQ ID NO: 2833352 - protein, 11 aa, Entamoeba invadens
ALGGGDYEGMT

SEQ ID NO: 2833353 - protein, 11 aa, Entamoeba invadens
ALKDQNTQLDA

SEQ ID NO: 2833354 - protein, 16 aa, Entamoeba invadens
ALKKTKGDLVNAFFEF

SEQ ID NO: 2833355 - protein, 7 aa, Entamoeba invadens
ALPEPDD

SEQ ID NO: 2833356 - protein, 10 aa, Entamoeba invadens
ALSPGSCTAL

SEQ ID NO: 2833357 - protein, 5 aa, Entamoeba invadens
ALTGR

SEQ ID NO: 2833358 - protein, 5 aa, Entamoeba invadens
AMAQK

SEQ ID NO: 2833359 - protein, 4 aa, Entamoeba invadens
AMPE

SEQ ID NO: 2833360 - protein, 11 aa, Entamoeba invadens
ANADRAKYTAS

SEQ ID NO: 2833361 - protein, 4 aa, Entamoeba invadens
ANAG

SEQ ID NO: 2833362 - protein, 6 aa, Entamoeba invadens
ANENEM

SEQ ID NO: 2833363 - protein, 4 aa, Entamoeba invadens
ANET

SEQ ID NO: 2833364 - protein, 6 aa, Entamoeba invadens
ANETAG

SEQ ID NO: 2833365 - protein, 10 aa, Entamoeba invadens
ANGDEMTSRM

SEQ ID NO: 2833366 - protein, 7 aa, Entamoeba invadens
ANGEYDH

SEQ ID NO: 2833367 - protein, 5 aa, Entamoeba invadens
ANGTI

SEQ ID NO: 2833368 - protein, 7 aa, Entamoeba invadens
ANIPTEA

SEQ ID NO: 2833369 - protein, 5 aa, Entamoeba invadens
ANKER

SEQ ID NO: 2833370 - protein, 10 aa, Entamoeba invadens
ANKGYTPNEI

SEQ ID NO: 2833371 - protein, 6 aa, Entamoeba invadens
ANPEQA

SEQ ID NO: 2833372 - protein, 15 aa, Entamoeba invadens
ANPPPLPKKPRALDS

SEQ ID NO: 2833373 - protein, 21 aa, Entamoeba invadens
ANQDDRADNVIPGNKQNHLDT

SEQ ID NO: 2833374 - protein, 5 aa, Entamoeba invadens
ANQKI

SEQ ID NO: 2833375 - protein, 14 aa, Entamoeba invadens
ANRVSIDRIVNLLT

SEQ ID NO: 2833376 - protein, 9 aa, Entamoeba invadens
ANTTHEKAY

SEQ ID NO: 2833377 - protein, 7 aa, Entamoeba invadens
ANVGKTS

SEQ ID NO: 2833378 - protein, 4 aa, Entamoeba invadens
ANYQ

SEQ ID NO: 2833379 - protein, 13 aa, Entamoeba invadens
APAFKAGKVHTKK

SEQ ID NO: 2833380 - protein, 6 aa, Entamoeba invadens
APDRYG

SEQ ID NO: 2833381 - protein, 4 aa, Entamoeba invadens
APEI

SEQ ID NO: 2833382 - protein, 9 aa, Entamoeba invadens
APGSKTSQL

SEQ ID NO: 2833383 - protein, 5 aa, Entamoeba invadens
APKLP

SEQ ID NO: 2833384 - protein, 16 aa, Entamoeba invadens
APLPLKKPEAPTFKTP

SEQ ID NO: 2833385 - protein, 4 aa, Entamoeba invadens
APNE

SEQ ID NO: 2833386 - protein, 10 aa, Entamoeba invadens
APNSIYSNSG

SEQ ID NO: 2833387 - protein, 5 aa, Entamoeba invadens
APPHG

SEQ ID NO: 2833388 - protein, 5 aa, Entamoeba invadens
APPTY

SEQ ID NO: 2833389 - protein, 6 aa, Entamoeba invadens
APQFED

SEQ ID NO: 2833390 - protein, 9 aa, Entamoeba invadens
APSASNKQE

SEQ ID NO: 2833391 - protein, 4 aa, Entamoeba invadens
APSE

SEQ ID NO: 2833392 - protein, 15 aa, Entamoeba invadens
APTDTRQTKFANEEL

SEQ ID NO: 2833393 - protein, 12 aa, Entamoeba invadens
APVTQNTTSVSI

SEQ ID NO: 2833394 - protein, 9 aa, Entamoeba invadens
AQAAAKEGH

SEQ ID NO: 2833395 - protein, 7 aa, Entamoeba invadens
AQENGIP

SEQ ID NO: 2833396 - protein, 4 aa, Entamoeba invadens
AQES

SEQ ID NO: 2833397 - protein, 9 aa, Entamoeba invadens
AQETNKEIH

SEQ ID NO: 2833398 - protein, 10 aa, Entamoeba invadens
AQKEKEKEIN

SEQ ID NO: 2833399 - protein, 9 aa, Entamoeba invadens
AQKKKTRVS

SEQ ID NO: 2833400 - protein, 4 aa, Entamoeba invadens
AQQK

SEQ ID NO: 2833401 - protein, 9 aa, Entamoeba invadens
AQTGSGKTA

SEQ ID NO: 2833402 - protein, 8 aa, Entamoeba invadens
AQTKLTTR

SEQ ID NO: 2833403 - protein, 17 aa, Entamoeba invadens
AQTNNTTKHHSNVSCGI

SEQ ID NO: 2833404 - protein, 8 aa, Entamoeba invadens
ARIGGENK

SEQ ID NO: 2833405 - protein, 7 aa, Entamoeba invadens
ARIPGVK

SEQ ID NO: 2833406 - protein, 9 aa, Entamoeba invadens
ARPTDVAEE

SEQ ID NO: 2833407 - protein, 7 aa, Entamoeba invadens
ARQTTAN

SEQ ID NO: 2833408 - protein, 4 aa, Entamoeba invadens
ARTD

SEQ ID NO: 2833409 - protein, 4 aa, Entamoeba invadens
ASDF

SEQ ID NO: 2833410 - protein, 4 aa, Entamoeba invadens
ASDT

SEQ ID NO: 2833411 - protein, 8 aa, Entamoeba invadens
ASEIETKI

SEQ ID NO: 2833412 - protein, 7 aa, Entamoeba invadens
ASKLGDI

SEQ ID NO: 2833413 - protein, 4 aa, Entamoeba invadens
ASKT

SEQ ID NO: 2833414 - protein, 7 aa, Entamoeba invadens
ASKTGKT

SEQ ID NO: 2833415 - protein, 9 aa, Entamoeba invadens
ASNNDYVRT

SEQ ID NO: 2833416 - protein, 6 aa, Entamoeba invadens
ASNRSI

SEQ ID NO: 2833417 - protein, 22 aa, Entamoeba invadens
ASPCEDSTRVGTGGNAKRQAVD

SEQ ID NO: 2833418 - protein, 7 aa, Entamoeba invadens
ASQMRKG

SEQ ID NO: 2833419 - protein, 7 aa, Entamoeba invadens
ASQTTFR

SEQ ID NO: 2833420 - protein, 5 aa, Entamoeba invadens
ASQTV

SEQ ID NO: 2833421 - protein, 13 aa, Entamoeba invadens
ASRPNRKNYSREI

SEQ ID NO: 2833422 - protein, 7 aa, Entamoeba invadens
ASSCKSK

SEQ ID NO: 2833423 - protein, 5 aa, Entamoeba invadens
ASTIK

SEQ ID NO: 2833424 - protein, 5 aa, Entamoeba invadens
ASTSV

SEQ ID NO: 2833425 - protein, 7 aa, Entamoeba invadens
ATAEKHY

SEQ ID NO: 2833426 - protein, 4 aa, Entamoeba invadens
ATCT

SEQ ID NO: 2833427 - protein, 4 aa, Entamoeba invadens
ATEK

SEQ ID NO: 2833428 - protein, 6 aa, Entamoeba invadens
ATENGK

SEQ ID NO: 2833429 - protein, 13 aa, Entamoeba invadens
ATERGAKETEKTL

SEQ ID NO: 2833430 - protein, 7 aa, Entamoeba invadens
ATESEQE

SEQ ID NO: 2833431 - protein, 13 aa, Entamoeba invadens
ATGDINKDTISDS

SEQ ID NO: 2833432 - protein, 5 aa, Entamoeba invadens
ATGSP

SEQ ID NO: 2833433 - protein, 4 aa, Entamoeba invadens
ATHP

SEQ ID NO: 2833434 - protein, 9 aa, Entamoeba invadens
ATIAKRDSV

SEQ ID NO: 2833435 - protein, 7 aa, Entamoeba invadens
ATKCNGR

SEQ ID NO: 2833436 - protein, 6 aa, Entamoeba invadens
ATLDDD

SEQ ID NO: 2833437 - protein, 8 aa, Entamoeba invadens
ATNELKGD

SEQ ID NO: 2833438 - protein, 7 aa, Entamoeba invadens
ATNEYDS

SEQ ID NO: 2833439 - protein, 7 aa, Entamoeba invadens
ATNKGYG

SEQ ID NO: 2833440 - protein, 5 aa, Entamoeba invadens
ATPNE

SEQ ID NO: 2833441 - protein, 5 aa, Entamoeba invadens
ATPQQ

SEQ ID NO: 2833442 - protein, 19 aa, Entamoeba invadens
ATQNSESDSSSEEIEKEDE

SEQ ID NO: 2833443 - protein, 8 aa, Entamoeba invadens
ATSGNTGI

SEQ ID NO: 2833444 - protein, 4 aa, Entamoeba invadens
ATTH

SEQ ID NO: 2833445 - protein, 4 aa, Entamoeba invadens
ATTL

SEQ ID NO: 2833446 - protein, 12 aa, Entamoeba invadens
AVDNAKAKGLNT

SEQ ID NO: 2833447 - protein, 8 aa, Entamoeba invadens
AVGNEDTP

SEQ ID NO: 2833448 - protein, 7 aa, Entamoeba invadens
AVKPGEV

SEQ ID NO: 2833449 - protein, 9 aa, Entamoeba invadens
AVPKGVEPY

SEQ ID NO: 2833450 - protein, 15 aa, Entamoeba invadens
AVPSNTLPHPGSPNL

SEQ ID NO: 2833451 - protein, 8 aa, Entamoeba invadens
AVPTPRNV

SEQ ID NO: 2833452 - protein, 12 aa, Entamoeba invadens
AYGQDKKTEREK

SEQ ID NO: 2833453 - protein, 4 aa, Entamoeba invadens
AYGY

SEQ ID NO: 2833454 - protein, 10 aa, Entamoeba invadens
AYNEKQFKYP

SEQ ID NO: 2833455 - protein, 7 aa, Entamoeba invadens
CAPSIDN

SEQ ID NO: 2833456 - protein, 10 aa, Entamoeba invadens
CDNKEENQGF

SEQ ID NO: 2833457 - protein, 5 aa, Entamoeba invadens
CDTYN

SEQ ID NO: 2833458 - protein, 6 aa, Entamoeba invadens
CEKGEK

SEQ ID NO: 2833459 - protein, 4 aa, Entamoeba invadens
CENG

SEQ ID NO: 2833460 - protein, 8 aa, Entamoeba invadens
CERRVESP

SEQ ID NO: 2833461 - protein, 22 aa, Entamoeba invadens
CGASGRVEGKKVDGKYETTVTS

SEQ ID NO: 2833462 - protein, 5 aa, Entamoeba invadens
CGDGS

SEQ ID NO: 2833463 - protein, 11 aa, Entamoeba invadens
CGGREENQGFR

SEQ ID NO: 2833464 - protein, 9 aa, Entamoeba invadens
CGGSSAQEI

SEQ ID NO: 2833465 - protein, 9 aa, Entamoeba invadens
CGGSSAQKI

SEQ ID NO: 2833466 - protein, 9 aa, Entamoeba invadens
CGKSPEVDT

SEQ ID NO: 2833467 - protein, 6 aa, Entamoeba invadens
CGNQVG

SEQ ID NO: 2833468 - protein, 4 aa, Entamoeba invadens
CGTI

SEQ ID NO: 2833469 - protein, 4 aa, Entamoeba invadens
CHPT

SEQ ID NO: 2833470 - protein, 5 aa, Entamoeba invadens
CINNP

SEQ ID NO: 2833471 - protein, 10 aa, Entamoeba invadens
CNDPDIEPTE

SEQ ID NO: 2833472 - protein, 5 aa, Entamoeba invadens
CNSTA

SEQ ID NO: 2833473 - protein, 5 aa, Entamoeba invadens
CPAKK

SEQ ID NO: 2833474 - protein, 5 aa, Entamoeba invadens
CPKRE

SEQ ID NO: 2833475 - protein, 5 aa, Entamoeba invadens
CPSLE

SEQ ID NO: 2833476 - protein, 6 aa, Entamoeba invadens
CQDAVT

SEQ ID NO: 2833477 - protein, 4 aa, Entamoeba invadens
CQPS

SEQ ID NO: 2833478 - protein, 20 aa, Entamoeba invadens
CQTKGIGGKTVNSHSTVSCE

SEQ ID NO: 2833479 - protein, 10 aa, Entamoeba invadens
CRDNTKQHVT

SEQ ID NO: 2833480 - protein, 7 aa, Entamoeba invadens
CRGVPDP

SEQ ID NO: 2833481 - protein, 6 aa, Entamoeba invadens
CSNDKS

SEQ ID NO: 2833482 - protein, 5 aa, Entamoeba invadens
CSPCN

SEQ ID NO: 2833483 - protein, 6 aa, Entamoeba invadens
CSPCNP

SEQ ID NO: 2833484 - protein, 5 aa, Entamoeba invadens
CSPDF

SEQ ID NO: 2833485 - protein, 13 aa, Entamoeba invadens
CSSGTYNNTETSC

SEQ ID NO: 2833486 - protein, 6 aa, Entamoeba invadens
CTESDN

SEQ ID NO: 2833487 - protein, 7 aa, Entamoeba invadens
CTKNTEK

SEQ ID NO: 2833488 - protein, 57 aa, Entamoeba invadens
CTKQQQEELEKVRQENLKANEEGKTEKIEKKESGVVREHPEKTSQTADTHKKSIDVK

SEQ ID NO: 2833489 - protein, 10 aa, Entamoeba invadens
CTSPNNTHNT

SEQ ID NO: 2833490 - protein, 7 aa, Entamoeba invadens
CTTYNGP

SEQ ID NO: 2833491 - protein, 5 aa, Entamoeba invadens
DACPT

SEQ ID NO: 2833492 - protein, 6 aa, Entamoeba invadens
DAGEIK

SEQ ID NO: 2833493 - protein, 8 aa, Entamoeba invadens
DAINTKKI

SEQ ID NO: 2833494 - protein, 7 aa, Entamoeba invadens
DAKTQVT

SEQ ID NO: 2833495 - protein, 5 aa, Entamoeba invadens
DALTQ

SEQ ID NO: 2833496 - protein, 6 aa, Entamoeba invadens
DAPFYS

SEQ ID NO: 2833497 - protein, 7 aa, Entamoeba invadens
DAPFYSS

SEQ ID NO: 2833498 - protein, 14 aa, Entamoeba invadens
DARSECKKASGEVE

SEQ ID NO: 2833499 - protein, 9 aa, Entamoeba invadens
DASNNQDIG

SEQ ID NO: 2833500 - protein, 7 aa, Entamoeba invadens
DASVTSV

SEQ ID NO: 2833501 - protein, 7 aa, Entamoeba invadens
DAVTARP

SEQ ID NO: 2833502 - protein, 12 aa, Entamoeba invadens
DCDQASKKEIEA

SEQ ID NO: 2833503 - protein, 6 aa, Entamoeba invadens
DCSRTG

SEQ ID NO: 2833504 - protein, 4 aa, Entamoeba invadens
DDAA

SEQ ID NO: 2833505 - protein, 6 aa, Entamoeba invadens
DDEHFG

SEQ ID NO: 2833506 - protein, 4 aa, Entamoeba invadens
DDEL

SEQ ID NO: 2833507 - protein, 6 aa, Entamoeba invadens
DDENFG

SEQ ID NO: 2833508 - protein, 19 aa, Entamoeba invadens
DDFGSEGELKSDRKYTTLD

SEQ ID NO: 2833509 - protein, 10 aa, Entamoeba invadens
DDGTGITLPE

SEQ ID NO: 2833510 - protein, 4 aa, Entamoeba invadens
DDIK

SEQ ID NO: 2833511 - protein, 14 aa, Entamoeba invadens
DDLNKDGLLFEKEN

SEQ ID NO: 2833512 - protein, 4 aa, Entamoeba invadens
DDLQ

SEQ ID NO: 2833513 - protein, 4 aa, Entamoeba invadens
DDLR

SEQ ID NO: 2833514 - protein, 8 aa, Entamoeba invadens
DDMEKTEK

SEQ ID NO: 2833515 - protein, 21 aa, Entamoeba invadens
DDMEKTEKDLAGAKSNMNQKD

SEQ ID NO: 2833516 - protein, 4 aa, Entamoeba invadens
DDNF

SEQ ID NO: 2833517 - protein, 10 aa, Entamoeba invadens
DDNKSMDEFE

SEQ ID NO: 2833518 - protein, 17 aa, Entamoeba invadens
DDNTENESNNSQLVKSK

SEQ ID NO: 2833519 - protein, 8 aa, Entamoeba invadens
DDNYEEQV

SEQ ID NO: 2833520 - protein, 4 aa, Entamoeba invadens
DDPN

SEQ ID NO: 2833521 - protein, 17 aa, Entamoeba invadens
DDQRTATREMKGENRAT

SEQ ID NO: 2833522 - protein, 8 aa, Entamoeba invadens
DDQVKNAK

SEQ ID NO: 2833523 - protein, 7 aa, Entamoeba invadens
DDSEQFH

SEQ ID NO: 2833524 - protein, 4 aa, Entamoeba invadens
DDSF

SEQ ID NO: 2833525 - protein, 5 aa, Entamoeba invadens
DDTKL

SEQ ID NO: 2833526 - protein, 10 aa, Entamoeba invadens
DDWSKDTSVF

SEQ ID NO: 2833527 - protein, 8 aa, Entamoeba invadens
DEASETVR

SEQ ID NO: 2833528 - protein, 18 aa, Entamoeba invadens
DECPPNYTNEEDKIADEK

SEQ ID NO: 2833529 - protein, 13 aa, Entamoeba invadens
DEDENVNEESGLL

SEQ ID NO: 2833530 - protein, 9 aa, Entamoeba invadens
DEDLEEKTG

SEQ ID NO: 2833531 - protein, 6 aa, Entamoeba invadens
DEDPNM

SEQ ID NO: 2833532 - protein, 6 aa, Entamoeba invadens
DEDSVT

SEQ ID NO: 2833533 - protein, 4 aa, Entamoeba invadens
DEEA

SEQ ID NO: 2833534 - protein, 4 aa, Entamoeba invadens
DEEE

SEQ ID NO: 2833535 - protein, 6 aa, Entamoeba invadens
DEEKAK

SEQ ID NO: 2833536 - protein, 5 aa, Entamoeba invadens
DEEME

SEQ ID NO: 2833537 - protein, 7 aa, Entamoeba invadens
DEEVQTE

SEQ ID NO: 2833538 - protein, 4 aa, Entamoeba invadens
DEFG

SEQ ID NO: 2833539 - protein, 4 aa, Entamoeba invadens
DEHG

SEQ ID NO: 2833540 - protein, 4 aa, Entamoeba invadens
DEHR

SEQ ID NO: 2833541 - protein, 5 aa, Entamoeba invadens
DEIEE

SEQ ID NO: 2833542 - protein, 4 aa, Entamoeba invadens
DEKK

SEQ ID NO: 2833543 - protein, 6 aa, Entamoeba invadens
DEKTFR

SEQ ID NO: 2833544 - protein, 8 aa, Entamoeba invadens
DELYNDGK

SEQ ID NO: 2833545 - protein, 4 aa, Entamoeba invadens
DEND

SEQ ID NO: 2833546 - protein, 36 aa, Entamoeba invadens
DENEGKEFDRKDGSKDAKGKKPKSAPKEHKAETEKK

SEQ ID NO: 2833547 - protein, 5 aa, Entamoeba invadens
DENGL

SEQ ID NO: 2833548 - protein, 4 aa, Entamoeba invadens
DENI

SEQ ID NO: 2833549 - protein, 4 aa, Entamoeba invadens
DENM

SEQ ID NO: 2833550 - protein, 4 aa, Entamoeba invadens
DERE

SEQ ID NO: 2833551 - protein, 8 aa, Entamoeba invadens
DERKPNDC

SEQ ID NO: 2833552 - protein, 4 aa, Entamoeba invadens
DESE

SEQ ID NO: 2833553 - protein, 7 aa, Entamoeba invadens
DESGQLY

SEQ ID NO: 2833554 - protein, 9 aa, Entamoeba invadens
DESKISKDS

SEQ ID NO: 2833555 - protein, 12 aa, Entamoeba invadens
DESPNETHIIGK

SEQ ID NO: 2833556 - protein, 5 aa, Entamoeba invadens
DESVS

SEQ ID NO: 2833557 - protein, 4 aa, Entamoeba invadens
DETF

SEQ ID NO: 2833558 - protein, 6 aa, Entamoeba invadens
DETFGN

SEQ ID NO: 2833559 - protein, 5 aa, Entamoeba invadens
DETGI

SEQ ID NO: 2833560 - protein, 15 aa, Entamoeba invadens
DETGRGVMEDKATKN

SEQ ID NO: 2833561 - protein, 6 aa, Entamoeba invadens
DETPGM

SEQ ID NO: 2833562 - protein, 11 aa, Entamoeba invadens
DEVDIDTNVND

SEQ ID NO: 2833563 - protein, 17 aa, Entamoeba invadens
DEVNGKLTDFGASRNVN

SEQ ID NO: 2833564 - protein, 4 aa, Entamoeba invadens
DEVV

SEQ ID NO: 2833565 - protein, 16 aa, Entamoeba invadens
DFGSEGELKSDRKYTT

SEQ ID NO: 2833566 - protein, 9 aa, Entamoeba invadens
DFKTGQTKI

SEQ ID NO: 2833567 - protein, 4 aa, Entamoeba invadens
DFQS

SEQ ID NO: 2833568 - protein, 7 aa, Entamoeba invadens
DFSGEDY

SEQ ID NO: 2833569 - protein, 7 aa, Entamoeba invadens
DFTRNQK

SEQ ID NO: 2833570 - protein, 13 aa, Entamoeba invadens
DGDYSTPVGTTPI

SEQ ID NO: 2833571 - protein, 7 aa, Entamoeba invadens
DGEKIAE

SEQ ID NO: 2833572 - protein, 4 aa, Entamoeba invadens
DGEL

SEQ ID NO: 2833573 - protein, 4 aa, Entamoeba invadens
DGFD

SEQ ID NO: 2833574 - protein, 7 aa, Entamoeba invadens
DGFQGNE

SEQ ID NO: 2833575 - protein, 8 aa, Entamoeba invadens
DGFQGNEK

SEQ ID NO: 2833576 - protein, 8 aa, Entamoeba invadens
DGGVGKSA

SEQ ID NO: 2833577 - protein, 5 aa, Entamoeba invadens
DGGYA

SEQ ID NO: 2833578 - protein, 5 aa, Entamoeba invadens
DGIAR

SEQ ID NO: 2833579 - protein, 5 aa, Entamoeba invadens
DGKQF

SEQ ID NO: 2833580 - protein, 4 aa, Entamoeba invadens
DGKS

SEQ ID NO: 2833581 - protein, 4 aa, Entamoeba invadens
DGLN

SEQ ID NO: 2833582 - protein, 6 aa, Entamoeba invadens
DGLTPI

SEQ ID NO: 2833583 - protein, 8 aa, Entamoeba invadens
DGNLPQDN

SEQ ID NO: 2833584 - protein, 15 aa, Entamoeba invadens
DGNLTPPNIGAGKSG

SEQ ID NO: 2833585 - protein, 6 aa, Entamoeba invadens
DGNVGK

SEQ ID NO: 2833586 - protein, 6 aa, Entamoeba invadens
DGPFDT

SEQ ID NO: 2833587 - protein, 5 aa, Entamoeba invadens
DGRTI

SEQ ID NO: 2833588 - protein, 7 aa, Entamoeba invadens
DGSCDTC

SEQ ID NO: 2833589 - protein, 11 aa, Entamoeba invadens
DGSGSDGGSCI

SEQ ID NO: 2833590 - protein, 15 aa, Entamoeba invadens
DGSIGTDPYLYTCKK

SEQ ID NO: 2833591 - protein, 4 aa, Entamoeba invadens
DGSK

SEQ ID NO: 2833592 - protein, 4 aa, Entamoeba invadens
DGTC

SEQ ID NO: 2833593 - protein, 4 aa, Entamoeba invadens
DGTN

SEQ ID NO: 2833594 - protein, 5 aa, Entamoeba invadens
DHATN

SEQ ID NO: 2833595 - protein, 5 aa, Entamoeba invadens
DHHRS

SEQ ID NO: 2833596 - protein, 8 aa, Entamoeba invadens
DHKKREIG

SEQ ID NO: 2833597 - protein, 8 aa, Entamoeba invadens
DHNKKVRD

SEQ ID NO: 2833598 - protein, 10 aa, Entamoeba invadens
DHPPQDDTFA

SEQ ID NO: 2833599 - protein, 6 aa, Entamoeba invadens
DHRSGK

SEQ ID NO: 2833600 - protein, 8 aa, Entamoeba invadens
DHTNQREM

SEQ ID NO: 2833601 - protein, 8 aa, Entamoeba invadens
DIEDNDDL

SEQ ID NO: 2833602 - protein, 12 aa, Entamoeba invadens
DIGKETEDQENI

SEQ ID NO: 2833603 - protein, 13 aa, Entamoeba invadens
DIKENSKVTQKKL

SEQ ID NO: 2833604 - protein, 4 aa, Entamoeba invadens
DIKP

SEQ ID NO: 2833605 - protein, 4 aa, Entamoeba invadens
DIPQ

SEQ ID NO: 2833606 - protein, 7 aa, Entamoeba invadens
DIPTQQL

SEQ ID NO: 2833607 - protein, 4 aa, Entamoeba invadens
DISD

SEQ ID NO: 2833608 - protein, 10 aa, Entamoeba invadens
DIVKEEEIDG

SEQ ID NO: 2833609 - protein, 5 aa, Entamoeba invadens
DKACQ

SEQ ID NO: 2833610 - protein, 8 aa, Entamoeba invadens
DKAEEAKV

SEQ ID NO: 2833611 - protein, 15 aa, Entamoeba invadens
DKANAKLTDFGSSRN

SEQ ID NO: 2833612 - protein, 8 aa, Entamoeba invadens
DKAPQLKA

SEQ ID NO: 2833613 - protein, 4 aa, Entamoeba invadens
DKDF

SEQ ID NO: 2833614 - protein, 10 aa, Entamoeba invadens
DKDKSGTLEL

SEQ ID NO: 2833615 - protein, 8 aa, Entamoeba invadens
DKEAADTL

SEQ ID NO: 2833616 - protein, 5 aa, Entamoeba invadens
DKEFY

SEQ ID NO: 2833617 - protein, 6 aa, Entamoeba invadens
DKEGLQ

SEQ ID NO: 2833618 - protein, 7 aa, Entamoeba invadens
DKEHKGY

SEQ ID NO: 2833619 - protein, 5 aa, Entamoeba invadens
DKEIK

SEQ ID NO: 2833620 - protein, 8 aa, Entamoeba invadens
DKETPNNQ

SEQ ID NO: 2833621 - protein, 5 aa, Entamoeba invadens
DKETR

SEQ ID NO: 2833622 - protein, 4 aa, Entamoeba invadens
DKGN

SEQ ID NO: 2833623 - protein, 6 aa, Entamoeba invadens
DKIPAV

SEQ ID NO: 2833624 - protein, 4 aa, Entamoeba invadens
DKIT

SEQ ID NO: 2833625 - protein, 9 aa, Entamoeba invadens
DKKKENQGF

SEQ ID NO: 2833626 - protein, 12 aa, Entamoeba invadens
DKKNGTKEVKRV

SEQ ID NO: 2833627 - protein, 10 aa, Entamoeba invadens
DKLSNEKNEV

SEQ ID NO: 2833628 - protein, 5 aa, Entamoeba invadens
DKNEG

SEQ ID NO: 2833629 - protein, 6 aa, Entamoeba invadens
DKNLGG

SEQ ID NO: 2833630 - protein, 8 aa, Entamoeba invadens
DKQGMDTH

SEQ ID NO: 2833631 - protein, 7 aa, Entamoeba invadens
DKRGKKS

SEQ ID NO: 2833632 - protein, 13 aa, Entamoeba invadens
DKRNGTKTYSTTG

SEQ ID NO: 2833633 - protein, 7 aa, Entamoeba invadens
DKSVNEE

SEQ ID NO: 2833634 - protein, 4 aa, Entamoeba invadens
DKVT

SEQ ID NO: 2833635 - protein, 8 aa, Entamoeba invadens
DKYNNGNI

SEQ ID NO: 2833636 - protein, 6 aa, Entamoeba invadens
DLDDNE

SEQ ID NO: 2833637 - protein, 6 aa, Entamoeba invadens
DLESER

SEQ ID NO: 2833638 - protein, 26 aa, Entamoeba invadens
DLKNQNETLQTEKGELVKKSEEMQNN

SEQ ID NO: 2833639 - protein, 4 aa, Entamoeba invadens
DLPP

SEQ ID NO: 2833640 - protein, 5 aa, Entamoeba invadens
DLPPD

SEQ ID NO: 2833641 - protein, 4 aa, Entamoeba invadens
DLSD

SEQ ID NO: 2833642 - protein, 5 aa, Entamoeba invadens
DLSTS

SEQ ID NO: 2833643 - protein, 7 aa, Entamoeba invadens
DLTDENY

SEQ ID NO: 2833644 - protein, 13 aa, Entamoeba invadens
DMREDKDQLKRLE

SEQ ID NO: 2833645 - protein, 4 aa, Entamoeba invadens
DNAE

SEQ ID NO: 2833646 - protein, 4 aa, Entamoeba invadens
DNDG

SEQ ID NO: 2833647 - protein, 16 aa, Entamoeba invadens
DNFSQDKSTFGKKISK

SEQ ID NO: 2833648 - protein, 7 aa, Entamoeba invadens
DNGDNNY

SEQ ID NO: 2833649 - protein, 9 aa, Entamoeba invadens
DNKNDEQNR

SEQ ID NO: 2833650 - protein, 9 aa, Entamoeba invadens
DNPSIPKEA

SEQ ID NO: 2833651 - protein, 5 aa, Entamoeba invadens
DNSGL

SEQ ID NO: 2833652 - protein, 13 aa, Entamoeba invadens
DNSQPETQTKERE

SEQ ID NO: 2833653 - protein, 4 aa, Entamoeba invadens
DNTK

SEQ ID NO: 2833654 - protein, 10 aa, Entamoeba invadens
DNTKGGLKEV

SEQ ID NO: 2833655 - protein, 11 aa, Entamoeba invadens
DNTTKKSTVEG

SEQ ID NO: 2833656 - protein, 6 aa, Entamoeba invadens
DPDNTE

SEQ ID NO: 2833657 - protein, 4 aa, Entamoeba invadens
DPER

SEQ ID NO: 2833658 - protein, 8 aa, Entamoeba invadens
DPGTAKSQ

SEQ ID NO: 2833659 - protein, 4 aa, Entamoeba invadens
DPNI

SEQ ID NO: 2833660 - protein, 5 aa, Entamoeba invadens
DPQYV

SEQ ID NO: 2833661 - protein, 4 aa, Entamoeba invadens
DPSL

SEQ ID NO: 2833662 - protein, 8 aa, Entamoeba invadens
DPSTAKSQ

SEQ ID NO: 2833663 - protein, 5 aa, Entamoeba invadens
DPTIE

SEQ ID NO: 2833664 - protein, 6 aa, Entamoeba invadens
DPTIQE

SEQ ID NO: 2833665 - protein, 10 aa, Entamoeba invadens
DPTPMQDEKL

SEQ ID NO: 2833666 - protein, 4 aa, Entamoeba invadens
DPTQ

SEQ ID NO: 2833667 - protein, 7 aa, Entamoeba invadens
DQELKAE

SEQ ID NO: 2833668 - protein, 4 aa, Entamoeba invadens
DQGI

SEQ ID NO: 2833669 - protein, 8 aa, Entamoeba invadens
DQQGTASV

SEQ ID NO: 2833670 - protein, 5 aa, Entamoeba invadens
DQQRL

SEQ ID NO: 2833671 - protein, 4 aa, Entamoeba invadens
DQST

SEQ ID NO: 2833672 - protein, 15 aa, Entamoeba invadens
DQVRKAGEDLNNKQL

SEQ ID NO: 2833673 - protein, 4 aa, Entamoeba invadens
DREQ

SEQ ID NO: 2833674 - protein, 12 aa, Entamoeba invadens
DREQYQKPFGPR

SEQ ID NO: 2833675 - protein, 5 aa, Entamoeba invadens
DRGKY

SEQ ID NO: 2833676 - protein, 6 aa, Entamoeba invadens
DRGKYS

SEQ ID NO: 2833677 - protein, 5 aa, Entamoeba invadens
DRHPS

SEQ ID NO: 2833678 - protein, 7 aa, Entamoeba invadens
DRNSFES

SEQ ID NO: 2833679 - protein, 9 aa, Entamoeba invadens
DRQHLSSQI

SEQ ID NO: 2833680 - protein, 12 aa, Entamoeba invadens
DRSYGKLLVNLL

SEQ ID NO: 2833681 - protein, 5 aa, Entamoeba invadens
DRYSG

SEQ ID NO: 2833682 - protein, 17 aa, Entamoeba invadens
DSASNNNKLSEINGNKT

SEQ ID NO: 2833683 - protein, 11 aa, Entamoeba invadens
DSDKDGKISKD

SEQ ID NO: 2833684 - protein, 7 aa, Entamoeba invadens
DSEDENC

SEQ ID NO: 2833685 - protein, 4 aa, Entamoeba invadens
DSEG

SEQ ID NO: 2833686 - protein, 7 aa, Entamoeba invadens
DSERVTG

SEQ ID NO: 2833687 - protein, 6 aa, Entamoeba invadens
DSETYG

SEQ ID NO: 2833688 - protein, 15 aa, Entamoeba invadens
DSFSTTNDAGNERGS

SEQ ID NO: 2833689 - protein, 8 aa, Entamoeba invadens
DSGKEGCL

SEQ ID NO: 2833690 - protein, 4 aa, Entamoeba invadens
DSIE

SEQ ID NO: 2833691 - protein, 8 aa, Entamoeba invadens
DSIQSVTN

SEQ ID NO: 2833692 - protein, 6 aa, Entamoeba invadens
DSLGQS

SEQ ID NO: 2833693 - protein, 4 aa, Entamoeba invadens
DSLK

SEQ ID NO: 2833694 - protein, 7 aa, Entamoeba invadens
DSLNGDR

SEQ ID NO: 2833695 - protein, 4 aa, Entamoeba invadens
DSPF

SEQ ID NO: 2833696 - protein, 5 aa, Entamoeba invadens
DSPYD

SEQ ID NO: 2833697 - protein, 11 aa, Entamoeba invadens
DSSKTGTDEHY

SEQ ID NO: 2833698 - protein, 4 aa, Entamoeba invadens
DSTE

SEQ ID NO: 2833699 - protein, 8 aa, Entamoeba invadens
DSTEPEKV

SEQ ID NO: 2833700 - protein, 4 aa, Entamoeba invadens
DSTF

SEQ ID NO: 2833701 - protein, 7 aa, Entamoeba invadens
DSTTKDD

SEQ ID NO: 2833702 - protein, 8 aa, Entamoeba invadens
DSTTKKHK

SEQ ID NO: 2833703 - protein, 8 aa, Entamoeba invadens
DSTTKNDQ

SEQ ID NO: 2833704 - protein, 8 aa, Entamoeba invadens
DSTTKNEQ

SEQ ID NO: 2833705 - protein, 5 aa, Entamoeba invadens
DSVHI

SEQ ID NO: 2833706 - protein, 5 aa, Entamoeba invadens
DSVKT

SEQ ID NO: 2833707 - protein, 8 aa, Entamoeba invadens
DTAKTERE

SEQ ID NO: 2833708 - protein, 4 aa, Entamoeba invadens
DTAT

SEQ ID NO: 2833709 - protein, 7 aa, Entamoeba invadens
DTDPLYT

SEQ ID NO: 2833710 - protein, 7 aa, Entamoeba invadens
DTDQNDD

SEQ ID NO: 2833711 - protein, 4 aa, Entamoeba invadens
DTEI

SEQ ID NO: 2833712 - protein, 4 aa, Entamoeba invadens
DTIP

SEQ ID NO: 2833713 - protein, 11 aa, Entamoeba invadens
DTKDNGKMDHD

SEQ ID NO: 2833714 - protein, 14 aa, Entamoeba invadens
DTKPFDDSYYNTNY

SEQ ID NO: 2833715 - protein, 6 aa, Entamoeba invadens
DTLSER

SEQ ID NO: 2833716 - protein, 4 aa, Entamoeba invadens
DTMS

SEQ ID NO: 2833717 - protein, 6 aa, Entamoeba invadens
DTPFGN

SEQ ID NO: 2833718 - protein, 6 aa, Entamoeba invadens
DTPKSK

SEQ ID NO: 2833719 - protein, 12 aa, Entamoeba invadens
DTPLPPTPKDFA

SEQ ID NO: 2833720 - protein, 4 aa, Entamoeba invadens
DTSA

SEQ ID NO: 2833721 - protein, 8 aa, Entamoeba invadens
DTSTLPDK

SEQ ID NO: 2833722 - protein, 4 aa, Entamoeba invadens
DTTK

SEQ ID NO: 2833723 - protein, 6 aa, Entamoeba invadens
DTTNKY

SEQ ID NO: 2833724 - protein, 6 aa, Entamoeba invadens
DTTSEK

SEQ ID NO: 2833725 - protein, 5 aa, Entamoeba invadens
DTVSD

SEQ ID NO: 2833726 - protein, 7 aa, Entamoeba invadens
DTYNDEY

SEQ ID NO: 2833727 - protein, 21 aa, Entamoeba invadens
DVDDESPPVYNNDEEKLADEK

SEQ ID NO: 2833728 - protein, 6 aa, Entamoeba invadens
DVEKRG

SEQ ID NO: 2833729 - protein, 12 aa, Entamoeba invadens
DVEQVVEAKEDK

SEQ ID NO: 2833730 - protein, 8 aa, Entamoeba invadens
DVERVGES

SEQ ID NO: 2833731 - protein, 4 aa, Entamoeba invadens
DVGD

SEQ ID NO: 2833732 - protein, 4 aa, Entamoeba invadens
DVGG

SEQ ID NO: 2833733 - protein, 6 aa, Entamoeba invadens
DVGGEQ

SEQ ID NO: 2833734 - protein, 34 aa, Entamoeba invadens
DVGQPDDVCDDAPDTSDDGDVEEKEEADIGPEGE

SEQ ID NO: 2833735 - protein, 35 aa, Entamoeba invadens
DVGQPDDVCDDASDTSDDGDVEEKEEVDNGPEGEY

SEQ ID NO: 2833736 - protein, 6 aa, Entamoeba invadens
DVKETQ

SEQ ID NO: 2833737 - protein, 13 aa, Entamoeba invadens
DVNTKENYTGNKV

SEQ ID NO: 2833738 - protein, 5 aa, Entamoeba invadens
DVPKE

SEQ ID NO: 2833739 - protein, 12 aa, Entamoeba invadens
DVSYNGKTYAGR

SEQ ID NO: 2833740 - protein, 5 aa, Entamoeba invadens
DVTKY

SEQ ID NO: 2833741 - protein, 7 aa, Entamoeba invadens
DVTPENV

SEQ ID NO: 2833742 - protein, 8 aa, Entamoeba invadens
DYDPTIED

SEQ ID NO: 2833743 - protein, 5 aa, Entamoeba invadens
DYDTQ

SEQ ID NO: 2833744 - protein, 8 aa, Entamoeba invadens
DYGGESAM

SEQ ID NO: 2833745 - protein, 7 aa, Entamoeba invadens
DYISESY

SEQ ID NO: 2833746 - protein, 9 aa, Entamoeba invadens
DYKKEGDEF

SEQ ID NO: 2833747 - protein, 14 aa, Entamoeba invadens
DYKRKEMKKASRKK

SEQ ID NO: 2833748 - protein, 9 aa, Entamoeba invadens
DYKTASEEL

SEQ ID NO: 2833749 - protein, 5 aa, Entamoeba invadens
DYVSN

SEQ ID NO: 2833750 - protein, 15 aa, Entamoeba invadens
EAAKSINFKNKTTAE

SEQ ID NO: 2833751 - protein, 10 aa, Entamoeba invadens
EAATGDKQKL

SEQ ID NO: 2833752 - protein, 17 aa, Entamoeba invadens
EAEKRLTELKNQTKETS

SEQ ID NO: 2833753 - protein, 7 aa, Entamoeba invadens
EAESYNG

SEQ ID NO: 2833754 - protein, 10 aa, Entamoeba invadens
EAKELKESYT

SEQ ID NO: 2833755 - protein, 4 aa, Entamoeba invadens
EAKK

SEQ ID NO: 2833756 - protein, 4 aa, Entamoeba invadens
EAQA

SEQ ID NO: 2833757 - protein, 8 aa, Entamoeba invadens
EAQARRQQ

SEQ ID NO: 2833758 - protein, 5 aa, Entamoeba invadens
EASMT

SEQ ID NO: 2833759 - protein, 4 aa, Entamoeba invadens
EAVP

SEQ ID NO: 2833760 - protein, 5 aa, Entamoeba invadens
EAYDK

SEQ ID NO: 2833761 - protein, 7 aa, Entamoeba invadens
ECEKGEK

SEQ ID NO: 2833762 - protein, 7 aa, Entamoeba invadens
ECPETVN

SEQ ID NO: 2833763 - protein, 7 aa, Entamoeba invadens
ECQSTQQ

SEQ ID NO: 2833764 - protein, 15 aa, Entamoeba invadens
ECTDNNKKHDKNRKI

SEQ ID NO: 2833765 - protein, 10 aa, Entamoeba invadens
EDADADESGV

SEQ ID NO: 2833766 - protein, 7 aa, Entamoeba invadens
EDDQTPV

SEQ ID NO: 2833767 - protein, 4 aa, Entamoeba invadens
EDDV

SEQ ID NO: 2833768 - protein, 6 aa, Entamoeba invadens
EDENFD

SEQ ID NO: 2833769 - protein, 7 aa, Entamoeba invadens
EDENFGN

SEQ ID NO: 2833770 - protein, 6 aa, Entamoeba invadens
EDETFG

SEQ ID NO: 2833771 - protein, 8 aa, Entamoeba invadens
EDGDKAEE

SEQ ID NO: 2833772 - protein, 7 aa, Entamoeba invadens
EDGITQD

SEQ ID NO: 2833773 - protein, 8 aa, Entamoeba invadens
EDGKSEEV

SEQ ID NO: 2833774 - protein, 8 aa, Entamoeba invadens
EDGLNDSD

SEQ ID NO: 2833775 - protein, 4 aa, Entamoeba invadens
EDGS

SEQ ID NO: 2833776 - protein, 11 aa, Entamoeba invadens
EDGTVEGACPP

SEQ ID NO: 2833777 - protein, 5 aa, Entamoeba invadens
EDKNF

SEQ ID NO: 2833778 - protein, 9 aa, Entamoeba invadens
EDKQGALEA

SEQ ID NO: 2833779 - protein, 4 aa, Entamoeba invadens
EDNN

SEQ ID NO: 2833780 - protein, 8 aa, Entamoeba invadens
EDNNNLDG

SEQ ID NO: 2833781 - protein, 7 aa, Entamoeba invadens
EDRDKTQ

SEQ ID NO: 2833782 - protein, 4 aa, Entamoeba invadens
EDVT

SEQ ID NO: 2833783 - protein, 12 aa, Entamoeba invadens
EDVVETTSEEIE

SEQ ID NO: 2833784 - protein, 12 aa, Entamoeba invadens
EEAAKQSKQVEN

SEQ ID NO: 2833785 - protein, 4 aa, Entamoeba invadens
EEEA

SEQ ID NO: 2833786 - protein, 18 aa, Entamoeba invadens
EEECPKYDSEDLINEYIN

SEQ ID NO: 2833787 - protein, 4 aa, Entamoeba invadens
EEEE

SEQ ID NO: 2833788 - protein, 4 aa, Entamoeba invadens
EEEG

SEQ ID NO: 2833789 - protein, 5 aa, Entamoeba invadens
EEEGP

SEQ ID NO: 2833790 - protein, 20 aa, Entamoeba invadens
EEELDEVEGETITKKVREKR

SEQ ID NO: 2833791 - protein, 6 aa, Entamoeba invadens
EEERNS

SEQ ID NO: 2833792 - protein, 6 aa, Entamoeba invadens
EEESFE

SEQ ID NO: 2833793 - protein, 6 aa, Entamoeba invadens
EEEVNQ

SEQ ID NO: 2833794 - protein, 4 aa, Entamoeba invadens
EEFG

SEQ ID NO: 2833795 - protein, 6 aa, Entamoeba invadens
EEIGDS

SEQ ID NO: 2833796 - protein, 4 aa, Entamoeba invadens
EEIN

SEQ ID NO: 2833797 - protein, 7 aa, Entamoeba invadens
EEINRTQ

SEQ ID NO: 2833798 - protein, 8 aa, Entamoeba invadens
EEIPPTVT

SEQ ID NO: 2833799 - protein, 8 aa, Entamoeba invadens
EEKCRSDY

SEQ ID NO: 2833800 - protein, 4 aa, Entamoeba invadens
EEKD

SEQ ID NO: 2833801 - protein, 8 aa, Entamoeba invadens
EEKKSQIE

SEQ ID NO: 2833802 - protein, 8 aa, Entamoeba invadens
EEKTGRKY

SEQ ID NO: 2833803 - protein, 4 aa, Entamoeba invadens
EELK

SEQ ID NO: 2833804 - protein, 4 aa, Entamoeba invadens
EENE

SEQ ID NO: 2833805 - protein, 4 aa, Entamoeba invadens
EENI

SEQ ID NO: 2833806 - protein, 7 aa, Entamoeba invadens
EENKRNR

SEQ ID NO: 2833807 - protein, 6 aa, Entamoeba invadens
EENSTE

SEQ ID NO: 2833808 - protein, 4 aa, Entamoeba invadens
EENT

SEQ ID NO: 2833809 - protein, 4 aa, Entamoeba invadens
EEQF

SEQ ID NO: 2833810 - protein, 4 aa, Entamoeba invadens
EEQT

SEQ ID NO: 2833811 - protein, 22 aa, Entamoeba invadens
EESKINTNQTEEYKKKAKETLK

SEQ ID NO: 2833812 - protein, 4 aa, Entamoeba invadens
EESL

SEQ ID NO: 2833813 - protein, 5 aa, Entamoeba invadens
EESSF

SEQ ID NO: 2833814 - protein, 4 aa, Entamoeba invadens
EETD

SEQ ID NO: 2833815 - protein, 5 aa, Entamoeba invadens
EETDD

SEQ ID NO: 2833816 - protein, 4 aa, Entamoeba invadens
EETF

SEQ ID NO: 2833817 - protein, 6 aa, Entamoeba invadens
EETPTF

SEQ ID NO: 2833818 - protein, 4 aa, Entamoeba invadens
EETT

SEQ ID NO: 2833819 - protein, 7 aa, Entamoeba invadens
EETTEEI

SEQ ID NO: 2833820 - protein, 12 aa, Entamoeba invadens
EEVAKDCAEAHP

SEQ ID NO: 2833821 - protein, 4 aa, Entamoeba invadens
EEVP

SEQ ID NO: 2833822 - protein, 6 aa, Entamoeba invadens
EEVQSY

SEQ ID NO: 2833823 - protein, 5 aa, Entamoeba invadens
EEVTR

SEQ ID NO: 2833824 - protein, 4 aa, Entamoeba invadens
EFPA

SEQ ID NO: 2833825 - protein, 12 aa, Entamoeba invadens
EFPNNTELGESI

SEQ ID NO: 2833826 - protein, 5 aa, Entamoeba invadens
EFQSE

SEQ ID NO: 2833827 - protein, 23 aa, Entamoeba invadens
EFSNEKVSKKSVDVGNALDDTTY

SEQ ID NO: 2833828 - protein, 5 aa, Entamoeba invadens
EGCNE

SEQ ID NO: 2833829 - protein, 10 aa, Entamoeba invadens
EGGKTADGRC

SEQ ID NO: 2833830 - protein, 8 aa, Entamoeba invadens
EGKKCQPG

SEQ ID NO: 2833831 - protein, 6 aa, Entamoeba invadens
EGKPVK

SEQ ID NO: 2833832 - protein, 8 aa, Entamoeba invadens
EGKSQMGS

SEQ ID NO: 2833833 - protein, 5 aa, Entamoeba invadens
EGNAF

SEQ ID NO: 2833834 - protein, 7 aa, Entamoeba invadens
EGRGTYR

SEQ ID NO: 2833835 - protein, 4 aa, Entamoeba invadens
EGTY

SEQ ID NO: 2833836 - protein, 6 aa, Entamoeba invadens
EGVKSD

SEQ ID NO: 2833837 - protein, 5 aa, Entamoeba invadens
EGVNS

SEQ ID NO: 2833838 - protein, 7 aa, Entamoeba invadens
EHKDDPI

SEQ ID NO: 2833839 - protein, 10 aa, Entamoeba invadens
EHNQSKPTII

SEQ ID NO: 2833840 - protein, 12 aa, Entamoeba invadens
EHPNDLNGKCTT

SEQ ID NO: 2833841 - protein, 9 aa, Entamoeba invadens
EHYKKPADV

SEQ ID NO: 2833842 - protein, 28 aa, Entamoeba invadens
EIEAAKKEIADAKSSGYSTSDIQKTDDR

SEQ ID NO: 2833843 - protein, 4 aa, Entamoeba invadens
EIER

SEQ ID NO: 2833844 - protein, 9 aa, Entamoeba invadens
EIESDAVRQ

SEQ ID NO: 2833845 - protein, 10 aa, Entamoeba invadens
EIGSSELGKM

SEQ ID NO: 2833846 - protein, 9 aa, Entamoeba invadens
EIPNNNKKV

SEQ ID NO: 2833847 - protein, 4 aa, Entamoeba invadens
EIPS

SEQ ID NO: 2833848 - protein, 6 aa, Entamoeba invadens
EIPSSV

SEQ ID NO: 2833849 - protein, 5 aa, Entamoeba invadens
EIRND

SEQ ID NO: 2833850 - protein, 4 aa, Entamoeba invadens
EITD

SEQ ID NO: 2833851 - protein, 4 aa, Entamoeba invadens
EITT

SEQ ID NO: 2833852 - protein, 5 aa, Entamoeba invadens
EKAEN

SEQ ID NO: 2833853 - protein, 6 aa, Entamoeba invadens
EKCDKC

SEQ ID NO: 2833854 - protein, 4 aa, Entamoeba invadens
EKDA

SEQ ID NO: 2833855 - protein, 6 aa, Entamoeba invadens
EKDDSL

SEQ ID NO: 2833856 - protein, 6 aa, Entamoeba invadens
EKDLSD

SEQ ID NO: 2833857 - protein, 7 aa, Entamoeba invadens
EKEEVKE

SEQ ID NO: 2833858 - protein, 17 aa, Entamoeba invadens
EKFDSNPNVVKESADVK

SEQ ID NO: 2833859 - protein, 4 aa, Entamoeba invadens
EKFG

SEQ ID NO: 2833860 - protein, 7 aa, Entamoeba invadens
EKGIEKE

SEQ ID NO: 2833861 - protein, 6 aa, Entamoeba invadens
EKGNFD

SEQ ID NO: 2833862 - protein, 9 aa, Entamoeba invadens
EKGTKTDNF

SEQ ID NO: 2833863 - protein, 4 aa, Entamoeba invadens
EKHK

SEQ ID NO: 2833864 - protein, 4 aa, Entamoeba invadens
EKHT

SEQ ID NO: 2833865 - protein, 11 aa, Entamoeba invadens
EKIKSTVKNTM

SEQ ID NO: 2833866 - protein, 8 aa, Entamoeba invadens
EKKDEHKV

SEQ ID NO: 2833867 - protein, 7 aa, Entamoeba invadens
EKLESTD

SEQ ID NO: 2833868 - protein, 4 aa, Entamoeba invadens
EKLG

SEQ ID NO: 2833869 - protein, 8 aa, Entamoeba invadens
EKNEFNTS

SEQ ID NO: 2833870 - protein, 4 aa, Entamoeba invadens
EKNK

SEQ ID NO: 2833871 - protein, 6 aa, Entamoeba invadens
EKNTEI

SEQ ID NO: 2833872 - protein, 13 aa, Entamoeba invadens
EKPYDGESKIKGE

SEQ ID NO: 2833873 - protein, 7 aa, Entamoeba invadens
EKQKKTI

SEQ ID NO: 2833874 - protein, 14 aa, Entamoeba invadens
EKQKNTKDLNYKND

SEQ ID NO: 2833875 - protein, 18 aa, Entamoeba invadens
EKQSKTQTRTAKDTKKLS

SEQ ID NO: 2833876 - protein, 11 aa, Entamoeba invadens
EKQTKNKKTNL

SEQ ID NO: 2833877 - protein, 4 aa, Entamoeba invadens
EKRA

SEQ ID NO: 2833878 - protein, 8 aa, Entamoeba invadens
EKRAHKKV

SEQ ID NO: 2833879 - protein, 5 aa, Entamoeba invadens
EKRAR

SEQ ID NO: 2833880 - protein, 20 aa, Entamoeba invadens
EKREAEKQRIENEEKLKTDF

SEQ ID NO: 2833881 - protein, 9 aa, Entamoeba invadens
EKRGITPDN

SEQ ID NO: 2833882 - protein, 7 aa, Entamoeba invadens
EKRTSGQ

SEQ ID NO: 2833883 - protein, 7 aa, Entamoeba invadens
EKRTYSL

SEQ ID NO: 2833884 - protein, 6 aa, Entamoeba invadens
EKRYQT

SEQ ID NO: 2833885 - protein, 16 aa, Entamoeba invadens
EKSEISRHVQTPFSQE

SEQ ID NO: 2833886 - protein, 4 aa, Entamoeba invadens
EKSL

SEQ ID NO: 2833887 - protein, 5 aa, Entamoeba invadens
EKTDT

SEQ ID NO: 2833888 - protein, 4 aa, Entamoeba invadens
EKTI

SEQ ID NO: 2833889 - protein, 7 aa, Entamoeba invadens
EKTQNPR

SEQ ID NO: 2833890 - protein, 21 aa, Entamoeba invadens
EKTVPMEDDSEEEKTDNETYT

SEQ ID NO: 2833891 - protein, 4 aa, Entamoeba invadens
EKVE

SEQ ID NO: 2833892 - protein, 9 aa, Entamoeba invadens
EKVECENKG

SEQ ID NO: 2833893 - protein, 8 aa, Entamoeba invadens
EKVGGGDV

SEQ ID NO: 2833894 - protein, 7 aa, Entamoeba invadens
EKVGKTS

SEQ ID NO: 2833895 - protein, 6 aa, Entamoeba invadens
EKVGPV

SEQ ID NO: 2833896 - protein, 11 aa, Entamoeba invadens
EKVSKKTAERR

SEQ ID NO: 2833897 - protein, 9 aa, Entamoeba invadens
EKYENGDIN

SEQ ID NO: 2833898 - protein, 9 aa, Entamoeba invadens
EKYKKPADV

SEQ ID NO: 2833899 - protein, 13 aa, Entamoeba invadens
EKYTGQCLSDENR

SEQ ID NO: 2833900 - protein, 9 aa, Entamoeba invadens
ELEKRQRPI

SEQ ID NO: 2833901 - protein, 9 aa, Entamoeba invadens
ELESQLRQT

SEQ ID NO: 2833902 - protein, 4 aa, Entamoeba invadens
ELKG

SEQ ID NO: 2833903 - protein, 5 aa, Entamoeba invadens
ELKKD

SEQ ID NO: 2833904 - protein, 8 aa, Entamoeba invadens
ELNEEELK

SEQ ID NO: 2833905 - protein, 13 aa, Entamoeba invadens
ELNESNLRGDGVY

SEQ ID NO: 2833906 - protein, 4 aa, Entamoeba invadens
ELNN

SEQ ID NO: 2833907 - protein, 21 aa, Entamoeba invadens
ELNPSVSVNAETRELNDESLY

SEQ ID NO: 2833908 - protein, 4 aa, Entamoeba invadens
ELPD

SEQ ID NO: 2833909 - protein, 4 aa, Entamoeba invadens
ELPK

SEQ ID NO: 2833910 - protein, 9 aa, Entamoeba invadens
ELQDESESL

SEQ ID NO: 2833911 - protein, 4 aa, Entamoeba invadens
ELQN

SEQ ID NO: 2833912 - protein, 5 aa, Entamoeba invadens
ELSEG

SEQ ID NO: 2833913 - protein, 10 aa, Entamoeba invadens
ELSNNTDKLT

SEQ ID NO: 2833914 - protein, 4 aa, Entamoeba invadens
ELTD

SEQ ID NO: 2833915 - protein, 4 aa, Entamoeba invadens
ELTN

SEQ ID NO: 2833916 - protein, 7 aa, Entamoeba invadens
ELTPTDP

SEQ ID NO: 2833917 - protein, 5 aa, Entamoeba invadens
EMKNS

SEQ ID NO: 2833918 - protein, 4 aa, Entamoeba invadens
EMTN

SEQ ID NO: 2833919 - protein, 5 aa, Entamoeba invadens
ENAEA

SEQ ID NO: 2833920 - protein, 17 aa, Entamoeba invadens
ENAKKTTPGEQGKTIDV

SEQ ID NO: 2833921 - protein, 6 aa, Entamoeba invadens
ENASHK

SEQ ID NO: 2833922 - protein, 5 aa, Entamoeba invadens
ENATG

SEQ ID NO: 2833923 - protein, 4 aa, Entamoeba invadens
ENDD

SEQ ID NO: 2833924 - protein, 4 aa, Entamoeba invadens
ENDY

SEQ ID NO: 2833925 - protein, 7 aa, Entamoeba invadens
ENEEEIG

SEQ ID NO: 2833926 - protein, 5 aa, Entamoeba invadens
ENEGK

SEQ ID NO: 2833927 - protein, 4 aa, Entamoeba invadens
ENEM

SEQ ID NO: 2833928 - protein, 9 aa, Entamoeba invadens
ENENKGTYV

SEQ ID NO: 2833929 - protein, 4 aa, Entamoeba invadens
ENGR

SEQ ID NO: 2833930 - protein, 8 aa, Entamoeba invadens
ENGSGKSA

SEQ ID NO: 2833931 - protein, 4 aa, Entamoeba invadens
ENGV

SEQ ID NO: 2833932 - protein, 9 aa, Entamoeba invadens
ENIEDTKAI

SEQ ID NO: 2833933 - protein, 9 aa, Entamoeba invadens
ENISSEAME

SEQ ID NO: 2833934 - protein, 6 aa, Entamoeba invadens
ENITDA

SEQ ID NO: 2833935 - protein, 4 aa, Entamoeba invadens
ENKE

SEQ ID NO: 2833936 - protein, 4 aa, Entamoeba invadens
ENKG

SEQ ID NO: 2833937 - protein, 7 aa, Entamoeba invadens
ENKRTFG

SEQ ID NO: 2833938 - protein, 4 aa, Entamoeba invadens
ENLS

SEQ ID NO: 2833939 - protein, 7 aa, Entamoeba invadens
ENNNPQK

SEQ ID NO: 2833940 - protein, 4 aa, Entamoeba invadens
ENNS

SEQ ID NO: 2833941 - protein, 5 aa, Entamoeba invadens
ENPDD

SEQ ID NO: 2833942 - protein, 4 aa, Entamoeba invadens
ENPQ

SEQ ID NO: 2833943 - protein, 4 aa, Entamoeba invadens
ENPS

SEQ ID NO: 2833944 - protein, 9 aa, Entamoeba invadens
ENQVKGTNM

SEQ ID NO: 2833945 - protein, 11 aa, Entamoeba invadens
ENRLEEDNDEA

SEQ ID NO: 2833946 - protein, 9 aa, Entamoeba invadens
ENSGLDATE

SEQ ID NO: 2833947 - protein, 4 aa, Entamoeba invadens
ENSK

SEQ ID NO: 2833948 - protein, 4 aa, Entamoeba invadens
ENSL

SEQ ID NO: 2833949 - protein, 12 aa, Entamoeba invadens
ENSQKSGVYNED

SEQ ID NO: 2833950 - protein, 13 aa, Entamoeba invadens
ENSSGINNLKEVN

SEQ ID NO: 2833951 - protein, 4 aa, Entamoeba invadens
ENST

SEQ ID NO: 2833952 - protein, 10 aa, Entamoeba invadens
ENTADGFDKA

SEQ ID NO: 2833953 - protein, 4 aa, Entamoeba invadens
ENTE

SEQ ID NO: 2833954 - protein, 4 aa, Entamoeba invadens
ENTN

SEQ ID NO: 2833955 - protein, 6 aa, Entamoeba invadens
ENTQSV

SEQ ID NO: 2833956 - protein, 8 aa, Entamoeba invadens
ENVPEGHK

SEQ ID NO: 2833957 - protein, 11 aa, Entamoeba invadens
ENYKKETKTTF

SEQ ID NO: 2833958 - protein, 11 aa, Entamoeba invadens
ENYTKDKKLTD

SEQ ID NO: 2833959 - protein, 9 aa, Entamoeba invadens
EPELRRPEA

SEQ ID NO: 2833960 - protein, 4 aa, Entamoeba invadens
EPFT

SEQ ID NO: 2833961 - protein, 7 aa, Entamoeba invadens
EPGVGKT

SEQ ID NO: 2833962 - protein, 10 aa, Entamoeba invadens
EPKSEVNENN

SEQ ID NO: 2833963 - protein, 4 aa, Entamoeba invadens
EPLS

SEQ ID NO: 2833964 - protein, 4 aa, Entamoeba invadens
EPSI

SEQ ID NO: 2833965 - protein, 5 aa, Entamoeba invadens
EPTAA

SEQ ID NO: 2833966 - protein, 7 aa, Entamoeba invadens
EPTAAAY

SEQ ID NO: 2833967 - protein, 4 aa, Entamoeba invadens
EPYP

SEQ ID NO: 2833968 - protein, 39 aa, Entamoeba invadens
EQAEKSINSLTAQKADLQKELEKERAMKQEADKETQKLR

SEQ ID NO: 2833969 - protein, 5 aa, Entamoeba invadens
EQDSF

SEQ ID NO: 2833970 - protein, 7 aa, Entamoeba invadens
EQDSTYK

SEQ ID NO: 2833971 - protein, 4 aa, Entamoeba invadens
EQEF

SEQ ID NO: 2833972 - protein, 6 aa, Entamoeba invadens
EQNERR

SEQ ID NO: 2833973 - protein, 4 aa, Entamoeba invadens
EQQR

SEQ ID NO: 2833974 - protein, 10 aa, Entamoeba invadens
EQQSLKASTF

SEQ ID NO: 2833975 - protein, 4 aa, Entamoeba invadens
EQRR

SEQ ID NO: 2833976 - protein, 8 aa, Entamoeba invadens
EQSFEGSQ

SEQ ID NO: 2833977 - protein, 7 aa, Entamoeba invadens
EQSTRLD

SEQ ID NO: 2833978 - protein, 4 aa, Entamoeba invadens
EQTL

SEQ ID NO: 2833979 - protein, 4 aa, Entamoeba invadens
EQTT

SEQ ID NO: 2833980 - protein, 8 aa, Entamoeba invadens
EQYGVPEN

SEQ ID NO: 2833981 - protein, 8 aa, Entamoeba invadens
ERANAEEA

SEQ ID NO: 2833982 - protein, 7 aa, Entamoeba invadens
ERASQNF

SEQ ID NO: 2833983 - protein, 12 aa, Entamoeba invadens
EREQCQKPFGPR

SEQ ID NO: 2833984 - protein, 22 aa, Entamoeba invadens
ERIQTESEDMKKKKDYIESFLS

SEQ ID NO: 2833985 - protein, 6 aa, Entamoeba invadens
ERNENN

SEQ ID NO: 2833986 - protein, 9 aa, Entamoeba invadens
ERNKKDKIS

SEQ ID NO: 2833987 - protein, 9 aa, Entamoeba invadens
ERNVSSHEE

SEQ ID NO: 2833988 - protein, 5 aa, Entamoeba invadens
ERPAY

SEQ ID NO: 2833989 - protein, 6 aa, Entamoeba invadens
ERPMTS

SEQ ID NO: 2833990 - protein, 10 aa, Entamoeba invadens
ERSGSEEEFN

SEQ ID NO: 2833991 - protein, 8 aa, Entamoeba invadens
ERTKMRDG

SEQ ID NO: 2833992 - protein, 4 aa, Entamoeba invadens
ERTT

SEQ ID NO: 2833993 - protein, 4 aa, Entamoeba invadens
ERVG

SEQ ID NO: 2833994 - protein, 5 aa, Entamoeba invadens
ESDKI

SEQ ID NO: 2833995 - protein, 4 aa, Entamoeba invadens
ESDL

SEQ ID NO: 2833996 - protein, 12 aa, Entamoeba invadens
ESDSKLKLDEET

SEQ ID NO: 2833997 - protein, 4 aa, Entamoeba invadens
ESEE

SEQ ID NO: 2833998 - protein, 4 aa, Entamoeba invadens
ESEK

SEQ ID NO: 2833999 - protein, 6 aa, Entamoeba invadens
ESETQL

SEQ ID NO: 2834000 - protein, 5 aa, Entamoeba invadens
ESGLS

SEQ ID NO: 2834001 - protein, 7 aa, Entamoeba invadens
ESGVGKT

SEQ ID NO: 2834002 - protein, 10 aa, Entamoeba invadens
ESGVGKTSIT

SEQ ID NO: 2834003 - protein, 7 aa, Entamoeba invadens
ESIGSDE

SEQ ID NO: 2834004 - protein, 13 aa, Entamoeba invadens
ESINNNNISVSNK

SEQ ID NO: 2834005 - protein, 9 aa, Entamoeba invadens
ESKKELPRT

SEQ ID NO: 2834006 - protein, 4 aa, Entamoeba invadens
ESKT

SEQ ID NO: 2834007 - protein, 5 aa, Entamoeba invadens
ESKVI

SEQ ID NO: 2834008 - protein, 9 aa, Entamoeba invadens
ESNGFDDSG

SEQ ID NO: 2834009 - protein, 24 aa, Entamoeba invadens
ESNKTQNPSVVTKPNSTTSIGERR

SEQ ID NO: 2834010 - protein, 4 aa, Entamoeba invadens
ESNP

SEQ ID NO: 2834011 - protein, 8 aa, Entamoeba invadens
ESNSVTTA

SEQ ID NO: 2834012 - protein, 8 aa, Entamoeba invadens
ESQEYSVS

SEQ ID NO: 2834013 - protein, 4 aa, Entamoeba invadens
ESSD

SEQ ID NO: 2834014 - protein, 4 aa, Entamoeba invadens
ESTD

SEQ ID NO: 2834015 - protein, 15 aa, Entamoeba invadens
ESTPASVHDSTSVKQ

SEQ ID NO: 2834016 - protein, 7 aa, Entamoeba invadens
ESTSPTH

SEQ ID NO: 2834017 - protein, 13 aa, Entamoeba invadens
ESTSTNTGKISQL

SEQ ID NO: 2834018 - protein, 6 aa, Entamoeba invadens
ESYKNK

SEQ ID NO: 2834019 - protein, 4 aa, Entamoeba invadens
ETAI

SEQ ID NO: 2834020 - protein, 6 aa, Entamoeba invadens
ETCDSN

SEQ ID NO: 2834021 - protein, 4 aa, Entamoeba invadens
ETDE

SEQ ID NO: 2834022 - protein, 7 aa, Entamoeba invadens
ETDTTAV

SEQ ID NO: 2834023 - protein, 4 aa, Entamoeba invadens
ETED

SEQ ID NO: 2834024 - protein, 4 aa, Entamoeba invadens
ETEE

SEQ ID NO: 2834025 - protein, 6 aa, Entamoeba invadens
ETEETF

SEQ ID NO: 2834026 - protein, 4 aa, Entamoeba invadens
ETEF

SEQ ID NO: 2834027 - protein, 7 aa, Entamoeba invadens
ETEFNQK

SEQ ID NO: 2834028 - protein, 4 aa, Entamoeba invadens
ETEL

SEQ ID NO: 2834029 - protein, 8 aa, Entamoeba invadens
ETEQTTKL

SEQ ID NO: 2834030 - protein, 6 aa, Entamoeba invadens
ETFGQN

SEQ ID NO: 2834031 - protein, 4 aa, Entamoeba invadens
ETGY

SEQ ID NO: 2834032 - protein, 4 aa, Entamoeba invadens
ETIE

SEQ ID NO: 2834033 - protein, 5 aa, Entamoeba invadens
ETKAQ

SEQ ID NO: 2834034 - protein, 8 aa, Entamoeba invadens
ETKQWNKD

SEQ ID NO: 2834035 - protein, 5 aa, Entamoeba invadens
ETKRN

SEQ ID NO: 2834036 - protein, 13 aa, Entamoeba invadens
ETLDEKDQVKTVS

SEQ ID NO: 2834037 - protein, 6 aa, Entamoeba invadens
ETNGKL

SEQ ID NO: 2834038 - protein, 6 aa, Entamoeba invadens
ETNHEE

SEQ ID NO: 2834039 - protein, 4 aa, Entamoeba invadens
ETNK

SEQ ID NO: 2834040 - protein, 5 aa, Entamoeba invadens
ETNKP

SEQ ID NO: 2834041 - protein, 6 aa, Entamoeba invadens
ETPNGK

SEQ ID NO: 2834042 - protein, 5 aa, Entamoeba invadens
ETRDN

SEQ ID NO: 2834043 - protein, 4 aa, Entamoeba invadens
ETRG

SEQ ID NO: 2834044 - protein, 9 aa, Entamoeba invadens
ETSAKNKIN

SEQ ID NO: 2834045 - protein, 4 aa, Entamoeba invadens
ETSI

SEQ ID NO: 2834046 - protein, 4 aa, Entamoeba invadens
ETTL

SEQ ID NO: 2834047 - protein, 4 aa, Entamoeba invadens
ETTQ

SEQ ID NO: 2834048 - protein, 5 aa, Entamoeba invadens
ETTQQ

SEQ ID NO: 2834049 - protein, 4 aa, Entamoeba invadens
EVDE

SEQ ID NO: 2834050 - protein, 11 aa, Entamoeba invadens
EVEHNEESMEE

SEQ ID NO: 2834051 - protein, 15 aa, Entamoeba invadens
EVEKTKEEVERYGTG

SEQ ID NO: 2834052 - protein, 5 aa, Entamoeba invadens
EVGNS

SEQ ID NO: 2834053 - protein, 9 aa, Entamoeba invadens
EVKDSKKKG

SEQ ID NO: 2834054 - protein, 12 aa, Entamoeba invadens
EVKSEIEKKEFR

SEQ ID NO: 2834055 - protein, 9 aa, Entamoeba invadens
EVKTNSKCN

SEQ ID NO: 2834056 - protein, 9 aa, Entamoeba invadens
EVKTNSNCN

SEQ ID NO: 2834057 - protein, 4 aa, Entamoeba invadens
EVLE

SEQ ID NO: 2834058 - protein, 4 aa, Entamoeba invadens
EVNE

SEQ ID NO: 2834059 - protein, 4 aa, Entamoeba invadens
EVPE

SEQ ID NO: 2834060 - protein, 7 aa, Entamoeba invadens
EVPNQNE

SEQ ID NO: 2834061 - protein, 4 aa, Entamoeba invadens
EVPS

SEQ ID NO: 2834062 - protein, 5 aa, Entamoeba invadens
EVSTN

SEQ ID NO: 2834063 - protein, 79 aa, Entamoeba invadens
EVTKKEVTKKEVPKKEEPVKKEEVPKKEVAKKEAPKKETKPVEHTKKDVHAKKDTKDTKKDAKKGEKKEEEQKEQKKEK

SEQ ID NO: 2834064 - protein, 12 aa, Entamoeba invadens
EVTVKGPRGELK

SEQ ID NO: 2834065 - protein, 5 aa, Entamoeba invadens
EVWTP

SEQ ID NO: 2834066 - protein, 12 aa, Entamoeba invadens
EVYEKSKAPNGD

SEQ ID NO: 2834067 - protein, 4 aa, Entamoeba invadens
EYEP

SEQ ID NO: 2834068 - protein, 13 aa, Entamoeba invadens
EYKEYKDNENSTC

SEQ ID NO: 2834069 - protein, 8 aa, Entamoeba invadens
EYPQSVTS

SEQ ID NO: 2834070 - protein, 21 aa, Entamoeba invadens
FDEDDGNNEKHGDINKNKETV

SEQ ID NO: 2834071 - protein, 4 aa, Entamoeba invadens
FDGC

SEQ ID NO: 2834072 - protein, 7 aa, Entamoeba invadens
FDSENQS

SEQ ID NO: 2834073 - protein, 6 aa, Entamoeba invadens
FDVPQK

SEQ ID NO: 2834074 - protein, 4 aa, Entamoeba invadens
FEDE

SEQ ID NO: 2834075 - protein, 8 aa, Entamoeba invadens
FEGAGEVT

SEQ ID NO: 2834076 - protein, 6 aa, Entamoeba invadens
FEGSEN

SEQ ID NO: 2834077 - protein, 4 aa, Entamoeba invadens
FENN

SEQ ID NO: 2834078 - protein, 4 aa, Entamoeba invadens
FESH

SEQ ID NO: 2834079 - protein, 4 aa, Entamoeba invadens
FESR

SEQ ID NO: 2834080 - protein, 7 aa, Entamoeba invadens
FESTSGL

SEQ ID NO: 2834081 - protein, 8 aa, Entamoeba invadens
FETRSDRY

SEQ ID NO: 2834082 - protein, 6 aa, Entamoeba invadens
FEYDNQ

SEQ ID NO: 2834083 - protein, 8 aa, Entamoeba invadens
FGGGKTTG

SEQ ID NO: 2834084 - protein, 5 aa, Entamoeba invadens
FGKEN

SEQ ID NO: 2834085 - protein, 4 aa, Entamoeba invadens
FGSS

SEQ ID NO: 2834086 - protein, 14 aa, Entamoeba invadens
FGTESFSGTQTPQD

SEQ ID NO: 2834087 - protein, 6 aa, Entamoeba invadens
FHSNPI

SEQ ID NO: 2834088 - protein, 8 aa, Entamoeba invadens
FIDNEQRE

SEQ ID NO: 2834089 - protein, 7 aa, Entamoeba invadens
FKDISED

SEQ ID NO: 2834090 - protein, 5 aa, Entamoeba invadens
FKEDG

SEQ ID NO: 2834091 - protein, 13 aa, Entamoeba invadens
FKGQKSEDRPPEV

SEQ ID NO: 2834092 - protein, 4 aa, Entamoeba invadens
FKKT

SEQ ID NO: 2834093 - protein, 9 aa, Entamoeba invadens
FNDETEKKI

SEQ ID NO: 2834094 - protein, 12 aa, Entamoeba invadens
FNENNTKEGTIK

SEQ ID NO: 2834095 - protein, 8 aa, Entamoeba invadens
FNGKRTIG

SEQ ID NO: 2834096 - protein, 4 aa, Entamoeba invadens
FNGN

SEQ ID NO: 2834097 - protein, 8 aa, Entamoeba invadens
FNGTKHSV

SEQ ID NO: 2834098 - protein, 4 aa, Entamoeba invadens
FNHP

SEQ ID NO: 2834099 - protein, 7 aa, Entamoeba invadens
FNQESIS

SEQ ID NO: 2834100 - protein, 6 aa, Entamoeba invadens
FPDEVE

SEQ ID NO: 2834101 - protein, 4 aa, Entamoeba invadens
FPDG

SEQ ID NO: 2834102 - protein, 6 aa, Entamoeba invadens
FPDMTQ

SEQ ID NO: 2834103 - protein, 4 aa, Entamoeba invadens
FPPN

SEQ ID NO: 2834104 - protein, 4 aa, Entamoeba invadens
FPPR

SEQ ID NO: 2834105 - protein, 4 aa, Entamoeba invadens
FPQT

SEQ ID NO: 2834106 - protein, 4 aa, Entamoeba invadens
FPSS

SEQ ID NO: 2834107 - protein, 4 aa, Entamoeba invadens
FPTG

SEQ ID NO: 2834108 - protein, 4 aa, Entamoeba invadens
FPTT

SEQ ID NO: 2834109 - protein, 4 aa, Entamoeba invadens
FQDS

SEQ ID NO: 2834110 - protein, 6 aa, Entamoeba invadens
FQNRDD

SEQ ID NO: 2834111 - protein, 7 aa, Entamoeba invadens
FQSGKST

SEQ ID NO: 2834112 - protein, 6 aa, Entamoeba invadens
FQTGKS

SEQ ID NO: 2834113 - protein, 5 aa, Entamoeba invadens
FRKQN

SEQ ID NO: 2834114 - protein, 6 aa, Entamoeba invadens
FRNSKT

SEQ ID NO: 2834115 - protein, 4 aa, Entamoeba invadens
FRSN

SEQ ID NO: 2834116 - protein, 6 aa, Entamoeba invadens
FSDTGN

SEQ ID NO: 2834117 - protein, 8 aa, Entamoeba invadens
FSGNSKGV

SEQ ID NO: 2834118 - protein, 4 aa, Entamoeba invadens
FSPI

SEQ ID NO: 2834119 - protein, 10 aa, Entamoeba invadens
FSPPTYHGGS

SEQ ID NO: 2834120 - protein, 4 aa, Entamoeba invadens
FSQA

SEQ ID NO: 2834121 - protein, 6 aa, Entamoeba invadens
FSQKTQ

SEQ ID NO: 2834122 - protein, 11 aa, Entamoeba invadens
FSTTYNKCSDT

SEQ ID NO: 2834123 - protein, 11 aa, Entamoeba invadens
FSVTNSDSIDG

SEQ ID NO: 2834124 - protein, 13 aa, Entamoeba invadens
FTARSDAKLSYKN

SEQ ID NO: 2834125 - protein, 4 aa, Entamoeba invadens
FTDE

SEQ ID NO: 2834126 - protein, 5 aa, Entamoeba invadens
FTDGK

SEQ ID NO: 2834127 - protein, 6 aa, Entamoeba invadens
FTEDGN

SEQ ID NO: 2834128 - protein, 4 aa, Entamoeba invadens
FTEK

SEQ ID NO: 2834129 - protein, 6 aa, Entamoeba invadens
FTIPDE

SEQ ID NO: 2834130 - protein, 8 aa, Entamoeba invadens
FTNPQSLE

SEQ ID NO: 2834131 - protein, 10 aa, Entamoeba invadens
FTQQDDKTSV

SEQ ID NO: 2834132 - protein, 7 aa, Entamoeba invadens
FTSSGKR

SEQ ID NO: 2834133 - protein, 4 aa, Entamoeba invadens
FTTS

SEQ ID NO: 2834134 - protein, 4 aa, Entamoeba invadens
FTTT

SEQ ID NO: 2834135 - protein, 4 aa, Entamoeba invadens
FVQQ

SEQ ID NO: 2834136 - protein, 6 aa, Entamoeba invadens
FYPNQS

SEQ ID NO: 2834137 - protein, 5 aa, Entamoeba invadens
GAAEK

SEQ ID NO: 2834138 - protein, 4 aa, Entamoeba invadens
GAFD

SEQ ID NO: 2834139 - protein, 8 aa, Entamoeba invadens
GAKVRSGK

SEQ ID NO: 2834140 - protein, 8 aa, Entamoeba invadens
GANPAQAF

SEQ ID NO: 2834141 - protein, 17 aa, Entamoeba invadens
GAPPGYVGHDEGGQLTE

SEQ ID NO: 2834142 - protein, 10 aa, Entamoeba invadens
GAQPTPQPSL

SEQ ID NO: 2834143 - protein, 8 aa, Entamoeba invadens
GARIPGVK

SEQ ID NO: 2834144 - protein, 5 aa, Entamoeba invadens
GASGI

SEQ ID NO: 2834145 - protein, 9 aa, Entamoeba invadens
GAVGKSALT

SEQ ID NO: 2834146 - protein, 8 aa, Entamoeba invadens
GCSSVSSG

SEQ ID NO: 2834147 - protein, 7 aa, Entamoeba invadens
GDAAHEK

SEQ ID NO: 2834148 - protein, 4 aa, Entamoeba invadens
GDED

SEQ ID NO: 2834149 - protein, 14 aa, Entamoeba invadens
GDEEDQKPSKEIYD

SEQ ID NO: 2834150 - protein, 4 aa, Entamoeba invadens
GDFN

SEQ ID NO: 2834151 - protein, 15 aa, Entamoeba invadens
GDIKRGKEDLSKLTT

SEQ ID NO: 2834152 - protein, 6 aa, Entamoeba invadens
GDIMRP

SEQ ID NO: 2834153 - protein, 4 aa, Entamoeba invadens
GDIP

SEQ ID NO: 2834154 - protein, 7 aa, Entamoeba invadens
GDPKLGG

SEQ ID NO: 2834155 - protein, 10 aa, Entamoeba invadens
GDSKRAMDEY

SEQ ID NO: 2834156 - protein, 12 aa, Entamoeba invadens
GDTSSPKSTFTK

SEQ ID NO: 2834157 - protein, 6 aa, Entamoeba invadens
GDVPSN

SEQ ID NO: 2834158 - protein, 4 aa, Entamoeba invadens
GEED

SEQ ID NO: 2834159 - protein, 5 aa, Entamoeba invadens
GEELK

SEQ ID NO: 2834160 - protein, 4 aa, Entamoeba invadens
GEER

SEQ ID NO: 2834161 - protein, 17 aa, Entamoeba invadens
GEEWPTRNQEGTTGYDE

SEQ ID NO: 2834162 - protein, 8 aa, Entamoeba invadens
GEGDRLKY

SEQ ID NO: 2834163 - protein, 17 aa, Entamoeba invadens
GEGGVYSKTPGPGAQAA

SEQ ID NO: 2834164 - protein, 9 aa, Entamoeba invadens
GEGLDKEPE

SEQ ID NO: 2834165 - protein, 4 aa, Entamoeba invadens
GEGS

SEQ ID NO: 2834166 - protein, 4 aa, Entamoeba invadens
GEGV

SEQ ID NO: 2834167 - protein, 6 aa, Entamoeba invadens
GEISRQ

SEQ ID NO: 2834168 - protein, 8 aa, Entamoeba invadens
GEKDHSSY

SEQ ID NO: 2834169 - protein, 13 aa, Entamoeba invadens
GEKSERYLGRGKN

SEQ ID NO: 2834170 - protein, 6 aa, Entamoeba invadens
GEKVGV

SEQ ID NO: 2834171 - protein, 6 aa, Entamoeba invadens
GELDAE

SEQ ID NO: 2834172 - protein, 4 aa, Entamoeba invadens
GELE

SEQ ID NO: 2834173 - protein, 14 aa, Entamoeba invadens
GEMKGSAITGPVSK

SEQ ID NO: 2834174 - protein, 9 aa, Entamoeba invadens
GEPKPESQG

SEQ ID NO: 2834175 - protein, 6 aa, Entamoeba invadens
GEQKKT

SEQ ID NO: 2834176 - protein, 12 aa, Entamoeba invadens
GERQKLEEITKK

SEQ ID NO: 2834177 - protein, 13 aa, Entamoeba invadens
GESENKETGAERI

SEQ ID NO: 2834178 - protein, 13 aa, Entamoeba invadens
GESGAGKTENTKR

SEQ ID NO: 2834179 - protein, 6 aa, Entamoeba invadens
GETNVN

SEQ ID NO: 2834180 - protein, 11 aa, Entamoeba invadens
GEVNGKGGQKY

SEQ ID NO: 2834181 - protein, 8 aa, Entamoeba invadens
GFDDEHDK

SEQ ID NO: 2834182 - protein, 8 aa, Entamoeba invadens
GFDNKERD

SEQ ID NO: 2834183 - protein, 7 aa, Entamoeba invadens
GFEHEKK

SEQ ID NO: 2834184 - protein, 4 aa, Entamoeba invadens
GFGG

SEQ ID NO: 2834185 - protein, 11 aa, Entamoeba invadens
GFKNTNNITTQ

SEQ ID NO: 2834186 - protein, 5 aa, Entamoeba invadens
GFKSY

SEQ ID NO: 2834187 - protein, 7 aa, Entamoeba invadens
GFPDGCP

SEQ ID NO: 2834188 - protein, 12 aa, Entamoeba invadens
GFQDDKKDGEVL

SEQ ID NO: 2834189 - protein, 9 aa, Entamoeba invadens
GGAGDKGSF

SEQ ID NO: 2834190 - protein, 19 aa, Entamoeba invadens
GGAGQPKIPPAKKAEMDKR

SEQ ID NO: 2834191 - protein, 10 aa, Entamoeba invadens
GGDDGNSIVS

SEQ ID NO: 2834192 - protein, 8 aa, Entamoeba invadens
GGGANELE

SEQ ID NO: 2834193 - protein, 9 aa, Entamoeba invadens
GGGPQPVFP

SEQ ID NO: 2834194 - protein, 7 aa, Entamoeba invadens
GGKEMTP

SEQ ID NO: 2834195 - protein, 8 aa, Entamoeba invadens
GGKEYNQG

SEQ ID NO: 2834196 - protein, 5 aa, Entamoeba invadens
GGKGV

SEQ ID NO: 2834197 - protein, 5 aa, Entamoeba invadens
GGKST

SEQ ID NO: 2834198 - protein, 4 aa, Entamoeba invadens
GGLK

SEQ ID NO: 2834199 - protein, 6 aa, Entamoeba invadens
GGNLSI

SEQ ID NO: 2834200 - protein, 8 aa, Entamoeba invadens
GGQGSRLG

SEQ ID NO: 2834201 - protein, 20 aa, Entamoeba invadens
GGQKGGHLTPTKRTNGSQKV

SEQ ID NO: 2834202 - protein, 26 aa, Entamoeba invadens
GGRGGNRGGRGGRSDFHNRDQAPQGA

SEQ ID NO: 2834203 - protein, 4 aa, Entamoeba invadens
GGSL

SEQ ID NO: 2834204 - protein, 6 aa, Entamoeba invadens
GGSTPI

SEQ ID NO: 2834205 - protein, 6 aa, Entamoeba invadens
GGSWKS

SEQ ID NO: 2834206 - protein, 5 aa, Entamoeba invadens
GGTLD

SEQ ID NO: 2834207 - protein, 11 aa, Entamoeba invadens
GGTTKLPKDTF

SEQ ID NO: 2834208 - protein, 5 aa, Entamoeba invadens
GGVDT

SEQ ID NO: 2834209 - protein, 7 aa, Entamoeba invadens
GGYTVSN

SEQ ID NO: 2834210 - protein, 15 aa, Entamoeba invadens
GHPKFRKPRVASTAG

SEQ ID NO: 2834211 - protein, 8 aa, Entamoeba invadens
GHPYPKSK

SEQ ID NO: 2834212 - protein, 9 aa, Entamoeba invadens
GHSTLPKSV

SEQ ID NO: 2834213 - protein, 7 aa, Entamoeba invadens
GIGTPAY

SEQ ID NO: 2834214 - protein, 7 aa, Entamoeba invadens
GIGTPKF

SEQ ID NO: 2834215 - protein, 8 aa, Entamoeba invadens
GIGTPKYM

SEQ ID NO: 2834216 - protein, 5 aa, Entamoeba invadens
GIKVN

SEQ ID NO: 2834217 - protein, 4 aa, Entamoeba invadens
GITP

SEQ ID NO: 2834218 - protein, 8 aa, Entamoeba invadens
GKAETEAA

SEQ ID NO: 2834219 - protein, 4 aa, Entamoeba invadens
GKDA

SEQ ID NO: 2834220 - protein, 5 aa, Entamoeba invadens
GKDEP

SEQ ID NO: 2834221 - protein, 5 aa, Entamoeba invadens
GKDTY

SEQ ID NO: 2834222 - protein, 7 aa, Entamoeba invadens
GKDTYTF

SEQ ID NO: 2834223 - protein, 4 aa, Entamoeba invadens
GKEV

SEQ ID NO: 2834224 - protein, 39 aa, Entamoeba invadens
GKFNKSTKEPKQLNQNKPVAKKEEKAEVEGEKKETTQHK

SEQ ID NO: 2834225 - protein, 6 aa, Entamoeba invadens
GKFPGT

SEQ ID NO: 2834226 - protein, 7 aa, Entamoeba invadens
GKFPGTI

SEQ ID NO: 2834227 - protein, 7 aa, Entamoeba invadens
GKFPGTV

SEQ ID NO: 2834228 - protein, 20 aa, Entamoeba invadens
GKGSFSGEVTFEEKKKLEKC

SEQ ID NO: 2834229 - protein, 33 aa, Entamoeba invadens
GKGSKGAKASKGGKRIRSKPGQQDALKGITKPA

SEQ ID NO: 2834230 - protein, 17 aa, Entamoeba invadens
GKHRKERGGRGNAGGLN

SEQ ID NO: 2834231 - protein, 4 aa, Entamoeba invadens
GKKI

SEQ ID NO: 2834232 - protein, 10 aa, Entamoeba invadens
GKKQGGAVKT

SEQ ID NO: 2834233 - protein, 9 aa, Entamoeba invadens
GKKSTEKSK

SEQ ID NO: 2834234 - protein, 8 aa, Entamoeba invadens
GKKTEGFK

SEQ ID NO: 2834235 - protein, 9 aa, Entamoeba invadens
GKLANKGGV

SEQ ID NO: 2834236 - protein, 10 aa, Entamoeba invadens
GKNDRNSDLS

SEQ ID NO: 2834237 - protein, 7 aa, Entamoeba invadens
GKNSFEN

SEQ ID NO: 2834238 - protein, 4 aa, Entamoeba invadens
GKNT

SEQ ID NO: 2834239 - protein, 8 aa, Entamoeba invadens
GKPAPFTP

SEQ ID NO: 2834240 - protein, 6 aa, Entamoeba invadens
GKPNSM

SEQ ID NO: 2834241 - protein, 5 aa, Entamoeba invadens
GKQRD

SEQ ID NO: 2834242 - protein, 10 aa, Entamoeba invadens
GKRQKRPSYL

SEQ ID NO: 2834243 - protein, 4 aa, Entamoeba invadens
GKRT

SEQ ID NO: 2834244 - protein, 13 aa, Entamoeba invadens
GKRVQRDKNIPEP

SEQ ID NO: 2834245 - protein, 5 aa, Entamoeba invadens
GKSLE

SEQ ID NO: 2834246 - protein, 6 aa, Entamoeba invadens
GKSTNT

SEQ ID NO: 2834247 - protein, 8 aa, Entamoeba invadens
GKTEFNEE

SEQ ID NO: 2834248 - protein, 5 aa, Entamoeba invadens
GKTGH

SEQ ID NO: 2834249 - protein, 4 aa, Entamoeba invadens
GKTI

SEQ ID NO: 2834250 - protein, 7 aa, Entamoeba invadens
GKTKDKT

SEQ ID NO: 2834251 - protein, 4 aa, Entamoeba invadens
GKTS

SEQ ID NO: 2834252 - protein, 6 aa, Entamoeba invadens
GKTTAD

SEQ ID NO: 2834253 - protein, 5 aa, Entamoeba invadens
GKTTD

SEQ ID NO: 2834254 - protein, 7 aa, Entamoeba invadens
GKVLTEA

SEQ ID NO: 2834255 - protein, 7 aa, Entamoeba invadens
GKVRDRV

SEQ ID NO: 2834256 - protein, 5 aa, Entamoeba invadens
GKVTL

SEQ ID NO: 2834257 - protein, 10 aa, Entamoeba invadens
GLEGERETYK

SEQ ID NO: 2834258 - protein, 8 aa, Entamoeba invadens
GLNDTADN

SEQ ID NO: 2834259 - protein, 6 aa, Entamoeba invadens
GLTDTT

SEQ ID NO: 2834260 - protein, 4 aa, Entamoeba invadens
GLYE

SEQ ID NO: 2834261 - protein, 6 aa, Entamoeba invadens
GMESKK

SEQ ID NO: 2834262 - protein, 8 aa, Entamoeba invadens
GMVPTDPF

SEQ ID NO: 2834263 - protein, 9 aa, Entamoeba invadens
GNAGNPKLL

SEQ ID NO: 2834264 - protein, 8 aa, Entamoeba invadens
GNDENESY

SEQ ID NO: 2834265 - protein, 4 aa, Entamoeba invadens
GNGD

SEQ ID NO: 2834266 - protein, 8 aa, Entamoeba invadens
GNNGTTVT

SEQ ID NO: 2834267 - protein, 4 aa, Entamoeba invadens
GNQS

SEQ ID NO: 2834268 - protein, 14 aa, Entamoeba invadens
GNRETMINKLLRTM

SEQ ID NO: 2834269 - protein, 7 aa, Entamoeba invadens
GNSLPTL

SEQ ID NO: 2834270 - protein, 10 aa, Entamoeba invadens
GNSPFAPRDG

SEQ ID NO: 2834271 - protein, 4 aa, Entamoeba invadens
GNSY

SEQ ID NO: 2834272 - protein, 6 aa, Entamoeba invadens
GNTGVS

SEQ ID NO: 2834273 - protein, 4 aa, Entamoeba invadens
GNTN

SEQ ID NO: 2834274 - protein, 6 aa, Entamoeba invadens
GNVGGG

SEQ ID NO: 2834275 - protein, 4 aa, Entamoeba invadens
GPFD

SEQ ID NO: 2834276 - protein, 4 aa, Entamoeba invadens
GPFK

SEQ ID NO: 2834277 - protein, 8 aa, Entamoeba invadens
GPFSEKGF

SEQ ID NO: 2834278 - protein, 15 aa, Entamoeba invadens
GPFTMTSQSRKNFGN

SEQ ID NO: 2834279 - protein, 8 aa, Entamoeba invadens
GPGGSGKT

SEQ ID NO: 2834280 - protein, 13 aa, Entamoeba invadens
GPINKEKKKFKRK

SEQ ID NO: 2834281 - protein, 9 aa, Entamoeba invadens
GPNMGGKST

SEQ ID NO: 2834282 - protein, 4 aa, Entamoeba invadens
GPPE

SEQ ID NO: 2834283 - protein, 7 aa, Entamoeba invadens
GPPGCGK

SEQ ID NO: 2834284 - protein, 10 aa, Entamoeba invadens
GPPGTGKTKC

SEQ ID NO: 2834285 - protein, 10 aa, Entamoeba invadens
GPPGTGKTLS

SEQ ID NO: 2834286 - protein, 10 aa, Entamoeba invadens
GPPGTGKTSV

SEQ ID NO: 2834287 - protein, 4 aa, Entamoeba invadens
GPQG

SEQ ID NO: 2834288 - protein, 6 aa, Entamoeba invadens
GPSSEV

SEQ ID NO: 2834289 - protein, 9 aa, Entamoeba invadens
GPTKGHGGA

SEQ ID NO: 2834290 - protein, 8 aa, Entamoeba invadens
GQDEAVTA

SEQ ID NO: 2834291 - protein, 4 aa, Entamoeba invadens
GQEV

SEQ ID NO: 2834292 - protein, 23 aa, Entamoeba invadens
GQHTKTTGRRGRTVGVSRTKAPS

SEQ ID NO: 2834293 - protein, 9 aa, Entamoeba invadens
GQKKEGESN

SEQ ID NO: 2834294 - protein, 6 aa, Entamoeba invadens
GQLLGQ

SEQ ID NO: 2834295 - protein, 7 aa, Entamoeba invadens
GQQIAED

SEQ ID NO: 2834296 - protein, 7 aa, Entamoeba invadens
GQVRQNK

SEQ ID NO: 2834297 - protein, 5 aa, Entamoeba invadens
GRDEE

SEQ ID NO: 2834298 - protein, 11 aa, Entamoeba invadens
GRGDFPNQVNN

SEQ ID NO: 2834299 - protein, 4 aa, Entamoeba invadens
GRLG

SEQ ID NO: 2834300 - protein, 12 aa, Entamoeba invadens
GRLTDGRGRTVD

SEQ ID NO: 2834301 - protein, 7 aa, Entamoeba invadens
GRNSGKK

SEQ ID NO: 2834302 - protein, 6 aa, Entamoeba invadens
GRRGHA

SEQ ID NO: 2834303 - protein, 5 aa, Entamoeba invadens
GRSNT

SEQ ID NO: 2834304 - protein, 4 aa, Entamoeba invadens
GRYA

SEQ ID NO: 2834305 - protein, 6 aa, Entamoeba invadens
GSEYEN

SEQ ID NO: 2834306 - protein, 6 aa, Entamoeba invadens
GSFDTQ

SEQ ID NO: 2834307 - protein, 5 aa, Entamoeba invadens
GSGGF

SEQ ID NO: 2834308 - protein, 8 aa, Entamoeba invadens
GSGNEIYQ

SEQ ID NO: 2834309 - protein, 5 aa, Entamoeba invadens
GSGTF

SEQ ID NO: 2834310 - protein, 4 aa, Entamoeba invadens
GSIS

SEQ ID NO: 2834311 - protein, 5 aa, Entamoeba invadens
GSIST

SEQ ID NO: 2834312 - protein, 7 aa, Entamoeba invadens
GSLSRSY

SEQ ID NO: 2834313 - protein, 18 aa, Entamoeba invadens
GSMGSQPTDKNGKTMNGT

SEQ ID NO: 2834314 - protein, 18 aa, Entamoeba invadens
GSMGSRPTDKNGKTLNNT

SEQ ID NO: 2834315 - protein, 11 aa, Entamoeba invadens
GSMYGKGITSL

SEQ ID NO: 2834316 - protein, 9 aa, Entamoeba invadens
GSNKIRDKA

SEQ ID NO: 2834317 - protein, 9 aa, Entamoeba invadens
GSRRGKSAT

SEQ ID NO: 2834318 - protein, 6 aa, Entamoeba invadens
GSTQNV

SEQ ID NO: 2834319 - protein, 9 aa, Entamoeba invadens
GSVTISSSV

SEQ ID NO: 2834320 - protein, 10 aa, Entamoeba invadens
GTEGNDKQKM

SEQ ID NO: 2834321 - protein, 4 aa, Entamoeba invadens
GTEK

SEQ ID NO: 2834322 - protein, 4 aa, Entamoeba invadens
GTET

SEQ ID NO: 2834323 - protein, 10 aa, Entamoeba invadens
GTETKDVSEN

SEQ ID NO: 2834324 - protein, 14 aa, Entamoeba invadens
GTFAPKPSGGPHGM

SEQ ID NO: 2834325 - protein, 4 aa, Entamoeba invadens
GTIQ

SEQ ID NO: 2834326 - protein, 10 aa, Entamoeba invadens
GTISEAGEYE

SEQ ID NO: 2834327 - protein, 14 aa, Entamoeba invadens
GTKSTLKSIREGKS

SEQ ID NO: 2834328 - protein, 4 aa, Entamoeba invadens
GTNE

SEQ ID NO: 2834329 - protein, 4 aa, Entamoeba invadens
GTNG

SEQ ID NO: 2834330 - protein, 17 aa, Entamoeba invadens
GTNPYTVNAEGRGPAWG

SEQ ID NO: 2834331 - protein, 4 aa, Entamoeba invadens
GTPE

SEQ ID NO: 2834332 - protein, 5 aa, Entamoeba invadens
GTPIY

SEQ ID NO: 2834333 - protein, 15 aa, Entamoeba invadens
GTRSIEESKIAAKKY

SEQ ID NO: 2834334 - protein, 4 aa, Entamoeba invadens
GTSN

SEQ ID NO: 2834335 - protein, 6 aa, Entamoeba invadens
GTSTAN

SEQ ID NO: 2834336 - protein, 7 aa, Entamoeba invadens
GTTTSPG

SEQ ID NO: 2834337 - protein, 9 aa, Entamoeba invadens
GVDDNGQCQ

SEQ ID NO: 2834338 - protein, 4 aa, Entamoeba invadens
GVDP

SEQ ID NO: 2834339 - protein, 8 aa, Entamoeba invadens
GVDSTNKK

SEQ ID NO: 2834340 - protein, 5 aa, Entamoeba invadens
GVGKS

SEQ ID NO: 2834341 - protein, 5 aa, Entamoeba invadens
GVPGM

SEQ ID NO: 2834342 - protein, 9 aa, Entamoeba invadens
GVPSAIANS

SEQ ID NO: 2834343 - protein, 4 aa, Entamoeba invadens
GVTD

SEQ ID NO: 2834344 - protein, 4 aa, Entamoeba invadens
GVTE

SEQ ID NO: 2834345 - protein, 5 aa, Entamoeba invadens
GVTIP

SEQ ID NO: 2834346 - protein, 6 aa, Entamoeba invadens
GVTIPS

SEQ ID NO: 2834347 - protein, 10 aa, Entamoeba invadens
GVTIPSSVTS

SEQ ID NO: 2834348 - protein, 5 aa, Entamoeba invadens
GVTKE

SEQ ID NO: 2834349 - protein, 4 aa, Entamoeba invadens
GVTQ

SEQ ID NO: 2834350 - protein, 4 aa, Entamoeba invadens
GVTS

SEQ ID NO: 2834351 - protein, 5 aa, Entamoeba invadens
GWDRT

SEQ ID NO: 2834352 - protein, 7 aa, Entamoeba invadens
GWDRTAQ

SEQ ID NO: 2834353 - protein, 23 aa, Entamoeba invadens
GWGAHGGGAFSGKDSSKVDRSGA

SEQ ID NO: 2834354 - protein, 9 aa, Entamoeba invadens
GYDDTSKGF

SEQ ID NO: 2834355 - protein, 4 aa, Entamoeba invadens
GYDG

SEQ ID NO: 2834356 - protein, 13 aa, Entamoeba invadens
GYEKPKSYYSKFW

SEQ ID NO: 2834357 - protein, 4 aa, Entamoeba invadens
GYGD

SEQ ID NO: 2834358 - protein, 19 aa, Entamoeba invadens
GYSTDSANARLNPKCPGMS

SEQ ID NO: 2834359 - protein, 8 aa, Entamoeba invadens
GYTKDSNS

SEQ ID NO: 2834360 - protein, 8 aa, Entamoeba invadens
GYYSTNNE

SEQ ID NO: 2834361 - protein, 7 aa, Entamoeba invadens
HADRNED

SEQ ID NO: 2834362 - protein, 6 aa, Entamoeba invadens
HANITT

SEQ ID NO: 2834363 - protein, 13 aa, Entamoeba invadens
HEAKVTPMILMPL

SEQ ID NO: 2834364 - protein, 5 aa, Entamoeba invadens
HERTV

SEQ ID NO: 2834365 - protein, 4 aa, Entamoeba invadens
HESL

SEQ ID NO: 2834366 - protein, 5 aa, Entamoeba invadens
HESRM

SEQ ID NO: 2834367 - protein, 8 aa, Entamoeba invadens
HGGAESSN

SEQ ID NO: 2834368 - protein, 5 aa, Entamoeba invadens
HGKTG

SEQ ID NO: 2834369 - protein, 10 aa, Entamoeba invadens
HHGGGRENNI

SEQ ID NO: 2834370 - protein, 9 aa, Entamoeba invadens
HKAETTRDL

SEQ ID NO: 2834371 - protein, 7 aa, Entamoeba invadens
HKKSKLA

SEQ ID NO: 2834372 - protein, 9 aa, Entamoeba invadens
HKQSSEVDM

SEQ ID NO: 2834373 - protein, 5 aa, Entamoeba invadens
HKRDL

SEQ ID NO: 2834374 - protein, 8 aa, Entamoeba invadens
HKTSEEVD

SEQ ID NO: 2834375 - protein, 7 aa, Entamoeba invadens
HKTSEKV

SEQ ID NO: 2834376 - protein, 6 aa, Entamoeba invadens
HLKGGA

SEQ ID NO: 2834377 - protein, 9 aa, Entamoeba invadens
HLKKGGKLE

SEQ ID NO: 2834378 - protein, 4 aa, Entamoeba invadens
HNAP

SEQ ID NO: 2834379 - protein, 4 aa, Entamoeba invadens
HNFN

SEQ ID NO: 2834380 - protein, 6 aa, Entamoeba invadens
HNQKQM

SEQ ID NO: 2834381 - protein, 4 aa, Entamoeba invadens
HNTQ

SEQ ID NO: 2834382 - protein, 6 aa, Entamoeba invadens
HPAGVT

SEQ ID NO: 2834383 - protein, 9 aa, Entamoeba invadens
HPKQPVDKE

SEQ ID NO: 2834384 - protein, 4 aa, Entamoeba invadens
HPNE

SEQ ID NO: 2834385 - protein, 27 aa, Entamoeba invadens
HPVDPTEEKLKKDVEVRQKVNDEETIE

SEQ ID NO: 2834386 - protein, 32 aa, Entamoeba invadens
HQKSSFESITANTKIETIKGTKRNIAKLINGP

SEQ ID NO: 2834387 - protein, 5 aa, Entamoeba invadens
HQNSC

SEQ ID NO: 2834388 - protein, 4 aa, Entamoeba invadens
HQTK

SEQ ID NO: 2834389 - protein, 7 aa, Entamoeba invadens
HRANKRR

SEQ ID NO: 2834390 - protein, 9 aa, Entamoeba invadens
HSGKQNTTL

SEQ ID NO: 2834391 - protein, 8 aa, Entamoeba invadens
HSGSCTAL

SEQ ID NO: 2834392 - protein, 6 aa, Entamoeba invadens
HTDADM

SEQ ID NO: 2834393 - protein, 5 aa, Entamoeba invadens
HTEIN

SEQ ID NO: 2834394 - protein, 4 aa, Entamoeba invadens
HTSA

SEQ ID NO: 2834395 - protein, 6 aa, Entamoeba invadens
HVENPD

SEQ ID NO: 2834396 - protein, 7 aa, Entamoeba invadens
HYKKPAD

SEQ ID NO: 2834397 - protein, 4 aa, Entamoeba invadens
IAAR

SEQ ID NO: 2834398 - protein, 8 aa, Entamoeba invadens
IAEAKKNN

SEQ ID NO: 2834399 - protein, 19 aa, Entamoeba invadens
IAEKTGSNKQRLESAEEWY

SEQ ID NO: 2834400 - protein, 8 aa, Entamoeba invadens
IAERGTHE

SEQ ID NO: 2834401 - protein, 10 aa, Entamoeba invadens
IAGKVTGVRR

SEQ ID NO: 2834402 - protein, 7 aa, Entamoeba invadens
IAPKKIT

SEQ ID NO: 2834403 - protein, 4 aa, Entamoeba invadens
ICQS

SEQ ID NO: 2834404 - protein, 4 aa, Entamoeba invadens
ICSE

SEQ ID NO: 2834405 - protein, 4 aa, Entamoeba invadens
IDDD

SEQ ID NO: 2834406 - protein, 9 aa, Entamoeba invadens
IDEARSHNE

SEQ ID NO: 2834407 - protein, 4 aa, Entamoeba invadens
IDIP

SEQ ID NO: 2834408 - protein, 6 aa, Entamoeba invadens
IDKPSR

SEQ ID NO: 2834409 - protein, 5 aa, Entamoeba invadens
IDPPR

SEQ ID NO: 2834410 - protein, 9 aa, Entamoeba invadens
IDPSNPNPY

SEQ ID NO: 2834411 - protein, 4 aa, Entamoeba invadens
IDVN

SEQ ID NO: 2834412 - protein, 27 aa, Entamoeba invadens
IEAAKKEIADAKSSGYSTSDIQKTDDR

SEQ ID NO: 2834413 - protein, 12 aa, Entamoeba invadens
IEDDEKGEETEF

SEQ ID NO: 2834414 - protein, 21 aa, Entamoeba invadens
IEDQGKDDEKRVAPTKGIPSD

SEQ ID NO: 2834415 - protein, 28 aa, Entamoeba invadens
IEEEKYKSKLSELSKMTKPDVSKDKNTI

SEQ ID NO: 2834416 - protein, 8 aa, Entamoeba invadens
IEEGKGEI

SEQ ID NO: 2834417 - protein, 4 aa, Entamoeba invadens
IEEN

SEQ ID NO: 2834418 - protein, 7 aa, Entamoeba invadens
IEKDSPW

SEQ ID NO: 2834419 - protein, 4 aa, Entamoeba invadens
IEKK

SEQ ID NO: 2834420 - protein, 5 aa, Entamoeba invadens
IEKSA

SEQ ID NO: 2834421 - protein, 7 aa, Entamoeba invadens
IENNPIT

SEQ ID NO: 2834422 - protein, 12 aa, Entamoeba invadens
IEQQKRDRISNA

SEQ ID NO: 2834423 - protein, 15 aa, Entamoeba invadens
IERDSTEKPSTSGVV

SEQ ID NO: 2834424 - protein, 12 aa, Entamoeba invadens
IERGRNGAEEYV

SEQ ID NO: 2834425 - protein, 4 aa, Entamoeba invadens
IERP

SEQ ID NO: 2834426 - protein, 4 aa, Entamoeba invadens
IESS

SEQ ID NO: 2834427 - protein, 9 aa, Entamoeba invadens
IETEQTTKL

SEQ ID NO: 2834428 - protein, 10 aa, Entamoeba invadens
IETKQPNSGI

SEQ ID NO: 2834429 - protein, 8 aa, Entamoeba invadens
IFNEEEST

SEQ ID NO: 2834430 - protein, 5 aa, Entamoeba invadens
IGEGS

SEQ ID NO: 2834431 - protein, 9 aa, Entamoeba invadens
IGEQNNDHD

SEQ ID NO: 2834432 - protein, 5 aa, Entamoeba invadens
IGESR

SEQ ID NO: 2834433 - protein, 4 aa, Entamoeba invadens
IGKE

SEQ ID NO: 2834434 - protein, 9 aa, Entamoeba invadens
IGNEKEKYQ

SEQ ID NO: 2834435 - protein, 5 aa, Entamoeba invadens
IGNGG

SEQ ID NO: 2834436 - protein, 9 aa, Entamoeba invadens
IGNNTQNDF

SEQ ID NO: 2834437 - protein, 5 aa, Entamoeba invadens
IGPSE

SEQ ID NO: 2834438 - protein, 6 aa, Entamoeba invadens
IGQKKE

SEQ ID NO: 2834439 - protein, 14 aa, Entamoeba invadens
IGSKPKSKKFAGTT

SEQ ID NO: 2834440 - protein, 13 aa, Entamoeba invadens
IGTEAFSDSPSLT

SEQ ID NO: 2834441 - protein, 6 aa, Entamoeba invadens
IKEAEK

SEQ ID NO: 2834442 - protein, 6 aa, Entamoeba invadens
IKEKYN

SEQ ID NO: 2834443 - protein, 8 aa, Entamoeba invadens
IKGNVSGL

SEQ ID NO: 2834444 - protein, 6 aa, Entamoeba invadens
IKQAEA

SEQ ID NO: 2834445 - protein, 6 aa, Entamoeba invadens
IKQDGD

SEQ ID NO: 2834446 - protein, 4 aa, Entamoeba invadens
IKQS

SEQ ID NO: 2834447 - protein, 10 aa, Entamoeba invadens
IKREKNPFNT

SEQ ID NO: 2834448 - protein, 6 aa, Entamoeba invadens
IKRQHD

SEQ ID NO: 2834449 - protein, 7 aa, Entamoeba invadens
IKSDNTL

SEQ ID NO: 2834450 - protein, 8 aa, Entamoeba invadens
IKSSNAEV

SEQ ID NO: 2834451 - protein, 4 aa, Entamoeba invadens
IKTI

SEQ ID NO: 2834452 - protein, 17 aa, Entamoeba invadens
IKTPTGKYLSAQPNGVL

SEQ ID NO: 2834453 - protein, 4 aa, Entamoeba invadens
INED

SEQ ID NO: 2834454 - protein, 8 aa, Entamoeba invadens
INEKKTNS

SEQ ID NO: 2834455 - protein, 8 aa, Entamoeba invadens
INGGNDKF

SEQ ID NO: 2834456 - protein, 9 aa, Entamoeba invadens
INKKTSDAM

SEQ ID NO: 2834457 - protein, 10 aa, Entamoeba invadens
INKKTSDAMP

SEQ ID NO: 2834458 - protein, 4 aa, Entamoeba invadens
INNF

SEQ ID NO: 2834459 - protein, 9 aa, Entamoeba invadens
INPITGKTE

SEQ ID NO: 2834460 - protein, 4 aa, Entamoeba invadens
INPS

SEQ ID NO: 2834461 - protein, 6 aa, Entamoeba invadens
INPSEI

SEQ ID NO: 2834462 - protein, 16 aa, Entamoeba invadens
INSAKSVKYKNGDVKD

SEQ ID NO: 2834463 - protein, 6 aa, Entamoeba invadens
INSEDK

SEQ ID NO: 2834464 - protein, 8 aa, Entamoeba invadens
INSLGESS

SEQ ID NO: 2834465 - protein, 10 aa, Entamoeba invadens
IPAEEPVEEE

SEQ ID NO: 2834466 - protein, 4 aa, Entamoeba invadens
IPDE

SEQ ID NO: 2834467 - protein, 4 aa, Entamoeba invadens
IPEQ

SEQ ID NO: 2834468 - protein, 6 aa, Entamoeba invadens
IPESVS

SEQ ID NO: 2834469 - protein, 4 aa, Entamoeba invadens
IPET

SEQ ID NO: 2834470 - protein, 5 aa, Entamoeba invadens
IPETV

SEQ ID NO: 2834471 - protein, 8 aa, Entamoeba invadens
IPIESNSS

SEQ ID NO: 2834472 - protein, 5 aa, Entamoeba invadens
IPKPE

SEQ ID NO: 2834473 - protein, 4 aa, Entamoeba invadens
IPNL

SEQ ID NO: 2834474 - protein, 11 aa, Entamoeba invadens
IPNSVKSLGDG

SEQ ID NO: 2834475 - protein, 8 aa, Entamoeba invadens
IPNSVNNF

SEQ ID NO: 2834476 - protein, 4 aa, Entamoeba invadens
IPNT

SEQ ID NO: 2834477 - protein, 7 aa, Entamoeba invadens
IPPGDSV

SEQ ID NO: 2834478 - protein, 10 aa, Entamoeba invadens
IPPSSLEDTP

SEQ ID NO: 2834479 - protein, 6 aa, Entamoeba invadens
IPPSVK

SEQ ID NO: 2834480 - protein, 4 aa, Entamoeba invadens
IPPT

SEQ ID NO: 2834481 - protein, 4 aa, Entamoeba invadens
IPQS

SEQ ID NO: 2834482 - protein, 5 aa, Entamoeba invadens
IPQSV

SEQ ID NO: 2834483 - protein, 17 aa, Entamoeba invadens
IPQTSTNPLTGKPNSEK

SEQ ID NO: 2834484 - protein, 4 aa, Entamoeba invadens
IPSE

SEQ ID NO: 2834485 - protein, 4 aa, Entamoeba invadens
IPSG

SEQ ID NO: 2834486 - protein, 5 aa, Entamoeba invadens
IPSGV

SEQ ID NO: 2834487 - protein, 6 aa, Entamoeba invadens
IPSGVT

SEQ ID NO: 2834488 - protein, 4 aa, Entamoeba invadens
IPSK

SEQ ID NO: 2834489 - protein, 4 aa, Entamoeba invadens
IPSN

SEQ ID NO: 2834490 - protein, 8 aa, Entamoeba invadens
IPSSVKSI

SEQ ID NO: 2834491 - protein, 9 aa, Entamoeba invadens
IPSSVTSIG

SEQ ID NO: 2834492 - protein, 5 aa, Entamoeba invadens
IPTET

SEQ ID NO: 2834493 - protein, 12 aa, Entamoeba invadens
IPTNKKGKPKSC

SEQ ID NO: 2834494 - protein, 6 aa, Entamoeba invadens
IPTSVT

SEQ ID NO: 2834495 - protein, 4 aa, Entamoeba invadens
IPYR

SEQ ID NO: 2834496 - protein, 6 aa, Entamoeba invadens
IQANDT

SEQ ID NO: 2834497 - protein, 18 aa, Entamoeba invadens
IQFTTEERKQQTEEKKKR

SEQ ID NO: 2834498 - protein, 9 aa, Entamoeba invadens
IQGGAGTSF

SEQ ID NO: 2834499 - protein, 4 aa, Entamoeba invadens
IQIP

SEQ ID NO: 2834500 - protein, 4 aa, Entamoeba invadens
IQNA

SEQ ID NO: 2834501 - protein, 21 aa, Entamoeba invadens
IQSYSEAKATEDVLKKSKDQV

SEQ ID NO: 2834502 - protein, 5 aa, Entamoeba invadens
IRGGD

SEQ ID NO: 2834503 - protein, 20 aa, Entamoeba invadens
IRKNEKAKLKRRNAVNLESE

SEQ ID NO: 2834504 - protein, 4 aa, Entamoeba invadens
IRPD

SEQ ID NO: 2834505 - protein, 4 aa, Entamoeba invadens
IRQT

SEQ ID NO: 2834506 - protein, 6 aa, Entamoeba invadens
IRTEPS

SEQ ID NO: 2834507 - protein, 4 aa, Entamoeba invadens
IRTS

SEQ ID NO: 2834508 - protein, 5 aa, Entamoeba invadens
ISEEP

SEQ ID NO: 2834509 - protein, 4 aa, Entamoeba invadens
ISEG

SEQ ID NO: 2834510 - protein, 7 aa, Entamoeba invadens
ISGEQDD

SEQ ID NO: 2834511 - protein, 4 aa, Entamoeba invadens
ISGN

SEQ ID NO: 2834512 - protein, 4 aa, Entamoeba invadens
ISIP

SEQ ID NO: 2834513 - protein, 4 aa, Entamoeba invadens
ISNE

SEQ ID NO: 2834514 - protein, 14 aa, Entamoeba invadens
ISNSTLKKKVGVEA

SEQ ID NO: 2834515 - protein, 6 aa, Entamoeba invadens
ISNTFG

SEQ ID NO: 2834516 - protein, 5 aa, Entamoeba invadens
ISNTG

SEQ ID NO: 2834517 - protein, 7 aa, Entamoeba invadens
ISPDSKR

SEQ ID NO: 2834518 - protein, 4 aa, Entamoeba invadens
ISQE

SEQ ID NO: 2834519 - protein, 4 aa, Entamoeba invadens
ISRS

SEQ ID NO: 2834520 - protein, 8 aa, Entamoeba invadens
ISRSGLGT

SEQ ID NO: 2834521 - protein, 7 aa, Entamoeba invadens
ISSNSQA

SEQ ID NO: 2834522 - protein, 12 aa, Entamoeba invadens
ISSPKDSYISEE

SEQ ID NO: 2834523 - protein, 13 aa, Entamoeba invadens
ISSSDIKKQNITT

SEQ ID NO: 2834524 - protein, 12 aa, Entamoeba invadens
ITAEPKDRNVAD

SEQ ID NO: 2834525 - protein, 10 aa, Entamoeba invadens
ITAKRSGFAG

SEQ ID NO: 2834526 - protein, 5 aa, Entamoeba invadens
ITASD

SEQ ID NO: 2834527 - protein, 8 aa, Entamoeba invadens
ITASSSKA

SEQ ID NO: 2834528 - protein, 8 aa, Entamoeba invadens
ITDETTPY

SEQ ID NO: 2834529 - protein, 5 aa, Entamoeba invadens
ITEMT

SEQ ID NO: 2834530 - protein, 9 aa, Entamoeba invadens
ITESDTNTL

SEQ ID NO: 2834531 - protein, 4 aa, Entamoeba invadens
ITGS

SEQ ID NO: 2834532 - protein, 9 aa, Entamoeba invadens
ITIPSSVKS

SEQ ID NO: 2834533 - protein, 10 aa, Entamoeba invadens
ITIPSSVKSI

SEQ ID NO: 2834534 - protein, 8 aa, Entamoeba invadens
ITIPSSVR

SEQ ID NO: 2834535 - protein, 10 aa, Entamoeba invadens
ITIPTSVTSL

SEQ ID NO: 2834536 - protein, 4 aa, Entamoeba invadens
ITIT

SEQ ID NO: 2834537 - protein, 12 aa, Entamoeba invadens
ITKGGKLEKENG

SEQ ID NO: 2834538 - protein, 20 aa, Entamoeba invadens
ITLTGNNEEFDVTKTPSGFD

SEQ ID NO: 2834539 - protein, 4 aa, Entamoeba invadens
ITNK

SEQ ID NO: 2834540 - protein, 5 aa, Entamoeba invadens
ITPGK

SEQ ID NO: 2834541 - protein, 5 aa, Entamoeba invadens
ITPQN

SEQ ID NO: 2834542 - protein, 4 aa, Entamoeba invadens
ITSD

SEQ ID NO: 2834543 - protein, 4 aa, Entamoeba invadens
ITTK

SEQ ID NO: 2834544 - protein, 10 aa, Entamoeba invadens
IVSQAKEDRN

SEQ ID NO: 2834545 - protein, 23 aa, Entamoeba invadens
KAADDATNISTKKRVKKESRNNY

SEQ ID NO: 2834546 - protein, 6 aa, Entamoeba invadens
KAAPKD

SEQ ID NO: 2834547 - protein, 9 aa, Entamoeba invadens
KAASGKYTP

SEQ ID NO: 2834548 - protein, 4 aa, Entamoeba invadens
KAEE

SEQ ID NO: 2834549 - protein, 5 aa, Entamoeba invadens
KAIAE

SEQ ID NO: 2834550 - protein, 5 aa, Entamoeba invadens
KAIEE

SEQ ID NO: 2834551 - protein, 6 aa, Entamoeba invadens
KAKAGE

SEQ ID NO: 2834552 - protein, 19 aa, Entamoeba invadens
KAKGVTDVKGGKIPQNTCE

SEQ ID NO: 2834553 - protein, 7 aa, Entamoeba invadens
KAKIGED

SEQ ID NO: 2834554 - protein, 23 aa, Entamoeba invadens
KALKYAKKQLGTHKRGLAKREEL

SEQ ID NO: 2834555 - protein, 21 aa, Entamoeba invadens
KAMAQGKKGFRVPKAQAAVPD

SEQ ID NO: 2834556 - protein, 8 aa, Entamoeba invadens
KAPTGKDT

SEQ ID NO: 2834557 - protein, 8 aa, Entamoeba invadens
KAQNPTEH

SEQ ID NO: 2834558 - protein, 11 aa, Entamoeba invadens
KARNAEYNPKR

SEQ ID NO: 2834559 - protein, 7 aa, Entamoeba invadens
KASGRKI

SEQ ID NO: 2834560 - protein, 15 aa, Entamoeba invadens
KATNGNTHLGGEDFD

SEQ ID NO: 2834561 - protein, 36 aa, Entamoeba invadens
KAVTVDKSAPAISNKPSGGMGGGMGGGMGGMGGNPL

SEQ ID NO: 2834562 - protein, 7 aa, Entamoeba invadens
KCEGNTV

SEQ ID NO: 2834563 - protein, 7 aa, Entamoeba invadens
KCEVEEE

SEQ ID NO: 2834564 - protein, 5 aa, Entamoeba invadens
KCGEK

SEQ ID NO: 2834565 - protein, 6 aa, Entamoeba invadens
KCQETL

SEQ ID NO: 2834566 - protein, 4 aa, Entamoeba invadens
KCSL

SEQ ID NO: 2834567 - protein, 5 aa, Entamoeba invadens
KCTKC

SEQ ID NO: 2834568 - protein, 13 aa, Entamoeba invadens
KCVSSGGCESPTL

SEQ ID NO: 2834569 - protein, 13 aa, Entamoeba invadens
KDANGRGPTYGNS

SEQ ID NO: 2834570 - protein, 7 aa, Entamoeba invadens
KDARAEE

SEQ ID NO: 2834571 - protein, 7 aa, Entamoeba invadens
KDATNVE

SEQ ID NO: 2834572 - protein, 7 aa, Entamoeba invadens
KDDDTNH

SEQ ID NO: 2834573 - protein, 9 aa, Entamoeba invadens
KDDTALDDE

SEQ ID NO: 2834574 - protein, 6 aa, Entamoeba invadens
KDDVNG

SEQ ID NO: 2834575 - protein, 14 aa, Entamoeba invadens
KDEDDIENKSTENV

SEQ ID NO: 2834576 - protein, 4 aa, Entamoeba invadens
KDEE

SEQ ID NO: 2834577 - protein, 6 aa, Entamoeba invadens
KDEEQI

SEQ ID NO: 2834578 - protein, 29 aa, Entamoeba invadens
KDEIDKEKENNKKLKEENKAQRESISELT

SEQ ID NO: 2834579 - protein, 19 aa, Entamoeba invadens
KDERQENQEQPDKRVRYES

SEQ ID NO: 2834580 - protein, 6 aa, Entamoeba invadens
KDETFG

SEQ ID NO: 2834581 - protein, 6 aa, Entamoeba invadens
KDFPDL

SEQ ID NO: 2834582 - protein, 7 aa, Entamoeba invadens
KDHTKTQ

SEQ ID NO: 2834583 - protein, 7 aa, Entamoeba invadens
KDIASKD

SEQ ID NO: 2834584 - protein, 8 aa, Entamoeba invadens
KDIKDGKN

SEQ ID NO: 2834585 - protein, 10 aa, Entamoeba invadens
KDIKEAREGA

SEQ ID NO: 2834586 - protein, 8 aa, Entamoeba invadens
KDINKNKK

SEQ ID NO: 2834587 - protein, 4 aa, Entamoeba invadens
KDKA

SEQ ID NO: 2834588 - protein, 10 aa, Entamoeba invadens
KDKSGTLDAK

SEQ ID NO: 2834589 - protein, 9 aa, Entamoeba invadens
KDKYKKPAD

SEQ ID NO: 2834590 - protein, 10 aa, Entamoeba invadens
KDKYKKPADI

SEQ ID NO: 2834591 - protein, 63 aa, Entamoeba invadens
KDLKAEAKPVLAETKAEKRAEKKNEKKADKKVEKKVEKKTEKKVEKKTEKKAEKKVEKKQTKK

SEQ ID NO: 2834592 - protein, 7 aa, Entamoeba invadens
KDNGKMS

SEQ ID NO: 2834593 - protein, 4 aa, Entamoeba invadens
KDNL

SEQ ID NO: 2834594 - protein, 6 aa, Entamoeba invadens
KDPHIS

SEQ ID NO: 2834595 - protein, 8 aa, Entamoeba invadens
KDPIGETK

SEQ ID NO: 2834596 - protein, 8 aa, Entamoeba invadens
KDPKYNIP

SEQ ID NO: 2834597 - protein, 5 aa, Entamoeba invadens
KDPQT

SEQ ID NO: 2834598 - protein, 5 aa, Entamoeba invadens
KDPSL

SEQ ID NO: 2834599 - protein, 5 aa, Entamoeba invadens
KDPTR

SEQ ID NO: 2834600 - protein, 4 aa, Entamoeba invadens
KDQF

SEQ ID NO: 2834601 - protein, 7 aa, Entamoeba invadens
KDSPDLE

SEQ ID NO: 2834602 - protein, 4 aa, Entamoeba invadens
KDTL

SEQ ID NO: 2834603 - protein, 9 aa, Entamoeba invadens
KDTPNYEDK

SEQ ID NO: 2834604 - protein, 4 aa, Entamoeba invadens
KDTQ

SEQ ID NO: 2834605 - protein, 4 aa, Entamoeba invadens
KEAK

SEQ ID NO: 2834606 - protein, 22 aa, Entamoeba invadens
KEDAQKAIDKNRLQNGLFVAPK

SEQ ID NO: 2834607 - protein, 4 aa, Entamoeba invadens
KEDE

SEQ ID NO: 2834608 - protein, 7 aa, Entamoeba invadens
KEDGTYE

SEQ ID NO: 2834609 - protein, 8 aa, Entamoeba invadens
KEDIESKK

SEQ ID NO: 2834610 - protein, 9 aa, Entamoeba invadens
KEDPKREKQ

SEQ ID NO: 2834611 - protein, 12 aa, Entamoeba invadens
KEDRLKYGNTIP

SEQ ID NO: 2834612 - protein, 10 aa, Entamoeba invadens
KEDSALYDDY

SEQ ID NO: 2834613 - protein, 12 aa, Entamoeba invadens
KEEAFNNEEKKQ

SEQ ID NO: 2834614 - protein, 6 aa, Entamoeba invadens
KEEEEI

SEQ ID NO: 2834615 - protein, 5 aa, Entamoeba invadens
KEEGT

SEQ ID NO: 2834616 - protein, 9 aa, Entamoeba invadens
KEEITSQTI

SEQ ID NO: 2834617 - protein, 10 aa, Entamoeba invadens
KEEKKLGEGS

SEQ ID NO: 2834618 - protein, 5 aa, Entamoeba invadens
KEETY

SEQ ID NO: 2834619 - protein, 6 aa, Entamoeba invadens
KEEVNE

SEQ ID NO: 2834620 - protein, 6 aa, Entamoeba invadens
KEFEGQ

SEQ ID NO: 2834621 - protein, 7 aa, Entamoeba invadens
KEGCNDE

SEQ ID NO: 2834622 - protein, 5 aa, Entamoeba invadens
KEHSN

SEQ ID NO: 2834623 - protein, 4 aa, Entamoeba invadens
KEHY

SEQ ID NO: 2834624 - protein, 4 aa, Entamoeba invadens
KEIA

SEQ ID NO: 2834625 - protein, 4 aa, Entamoeba invadens
KEIE

SEQ ID NO: 2834626 - protein, 6 aa, Entamoeba invadens
KEIGHG

SEQ ID NO: 2834627 - protein, 4 aa, Entamoeba invadens
KEIN

SEQ ID NO: 2834628 - protein, 10 aa, Entamoeba invadens
KEINEYRNNG

SEQ ID NO: 2834629 - protein, 11 aa, Entamoeba invadens
KEKEQYENNME

SEQ ID NO: 2834630 - protein, 11 aa, Entamoeba invadens
KEKEQYENNMK

SEQ ID NO: 2834631 - protein, 10 aa, Entamoeba invadens
KEKETEQQEQ

SEQ ID NO: 2834632 - protein, 8 aa, Entamoeba invadens
KEKIKTNM

SEQ ID NO: 2834633 - protein, 7 aa, Entamoeba invadens
KEKNAQK

SEQ ID NO: 2834634 - protein, 8 aa, Entamoeba invadens
KEKVGSYQ

SEQ ID NO: 2834635 - protein, 8 aa, Entamoeba invadens
KEKYKKAA

SEQ ID NO: 2834636 - protein, 10 aa, Entamoeba invadens
KEKYKKSADI

SEQ ID NO: 2834637 - protein, 9 aa, Entamoeba invadens
KEKYTDKDI

SEQ ID NO: 2834638 - protein, 9 aa, Entamoeba invadens
KEKYTKSAD

SEQ ID NO: 2834639 - protein, 7 aa, Entamoeba invadens
KEKYTKY

SEQ ID NO: 2834640 - protein, 4 aa, Entamoeba invadens
KELE

SEQ ID NO: 2834641 - protein, 10 aa, Entamoeba invadens
KENEKSENGQ

SEQ ID NO: 2834642 - protein, 7 aa, Entamoeba invadens
KENGGEK

SEQ ID NO: 2834643 - protein, 11 aa, Entamoeba invadens
KENGKNIGEIP

SEQ ID NO: 2834644 - protein, 5 aa, Entamoeba invadens
KENIN

SEQ ID NO: 2834645 - protein, 7 aa, Entamoeba invadens
KENISGI

SEQ ID NO: 2834646 - protein, 8 aa, Entamoeba invadens
KENKDIEN

SEQ ID NO: 2834647 - protein, 5 aa, Entamoeba invadens
KEPLI

SEQ ID NO: 2834648 - protein, 6 aa, Entamoeba invadens
KEQSTI

SEQ ID NO: 2834649 - protein, 5 aa, Entamoeba invadens
KERDT

SEQ ID NO: 2834650 - protein, 7 aa, Entamoeba invadens
KERKGGV

SEQ ID NO: 2834651 - protein, 8 aa, Entamoeba invadens
KERSEENI

SEQ ID NO: 2834652 - protein, 4 aa, Entamoeba invadens
KESC

SEQ ID NO: 2834653 - protein, 6 aa, Entamoeba invadens
KESEKI

SEQ ID NO: 2834654 - protein, 10 aa, Entamoeba invadens
KESIENKTEL

SEQ ID NO: 2834655 - protein, 6 aa, Entamoeba invadens
KESKNS

SEQ ID NO: 2834656 - protein, 8 aa, Entamoeba invadens
KESKSSCE

SEQ ID NO: 2834657 - protein, 56 aa, Entamoeba invadens
KETADQSTDIEPSKTPEESKTLEQSKTPEENKSEGSTTTSENGDQNNNNNGEDNAF

SEQ ID NO: 2834658 - protein, 5 aa, Entamoeba invadens
KETDK

SEQ ID NO: 2834659 - protein, 9 aa, Entamoeba invadens
KETEIEPNN

SEQ ID NO: 2834660 - protein, 6 aa, Entamoeba invadens
KETLAD

SEQ ID NO: 2834661 - protein, 5 aa, Entamoeba invadens
KETNS

SEQ ID NO: 2834662 - protein, 7 aa, Entamoeba invadens
KEVNEEN

SEQ ID NO: 2834663 - protein, 4 aa, Entamoeba invadens
KEVT

SEQ ID NO: 2834664 - protein, 6 aa, Entamoeba invadens
KFDETK

SEQ ID NO: 2834665 - protein, 5 aa, Entamoeba invadens
KFDGR

SEQ ID NO: 2834666 - protein, 5 aa, Entamoeba invadens
KFESQ

SEQ ID NO: 2834667 - protein, 22 aa, Entamoeba invadens
KFPHDPPLSPEGLQQGKDLAKR

SEQ ID NO: 2834668 - protein, 14 aa, Entamoeba invadens
KFQNNEKEKETQIE

SEQ ID NO: 2834669 - protein, 5 aa, Entamoeba invadens
KFSSN

SEQ ID NO: 2834670 - protein, 11 aa, Entamoeba invadens
KFTAGPGYEDI

SEQ ID NO: 2834671 - protein, 8 aa, Entamoeba invadens
KGANGKTL

SEQ ID NO: 2834672 - protein, 9 aa, Entamoeba invadens
KGEFSYPDK

SEQ ID NO: 2834673 - protein, 6 aa, Entamoeba invadens
KGEHPD

SEQ ID NO: 2834674 - protein, 5 aa, Entamoeba invadens
KGENF

SEQ ID NO: 2834675 - protein, 6 aa, Entamoeba invadens
KGEQRM

SEQ ID NO: 2834676 - protein, 10 aa, Entamoeba invadens
KGFGQPGGGS

SEQ ID NO: 2834677 - protein, 11 aa, Entamoeba invadens
KGFKDAKQLAP

SEQ ID NO: 2834678 - protein, 4 aa, Entamoeba invadens
KGGP

SEQ ID NO: 2834679 - protein, 7 aa, Entamoeba invadens
KGGQEEY

SEQ ID NO: 2834680 - protein, 6 aa, Entamoeba invadens
KGGRTL

SEQ ID NO: 2834681 - protein, 8 aa, Entamoeba invadens
KGIGSPKY

SEQ ID NO: 2834682 - protein, 6 aa, Entamoeba invadens
KGIGTP

SEQ ID NO: 2834683 - protein, 4 aa, Entamoeba invadens
KGIP

SEQ ID NO: 2834684 - protein, 4 aa, Entamoeba invadens
KGKA

SEQ ID NO: 2834685 - protein, 18 aa, Entamoeba invadens
KGKETYEKVKAAKEEALK

SEQ ID NO: 2834686 - protein, 9 aa, Entamoeba invadens
KGKGGLNEV

SEQ ID NO: 2834687 - protein, 13 aa, Entamoeba invadens
KGKQTKNFKGNEM

SEQ ID NO: 2834688 - protein, 11 aa, Entamoeba invadens
KGKTYNRSKSD

SEQ ID NO: 2834689 - protein, 5 aa, Entamoeba invadens
KGLTQ

SEQ ID NO: 2834690 - protein, 13 aa, Entamoeba invadens
KGRAATKEGRKDI

SEQ ID NO: 2834691 - protein, 4 aa, Entamoeba invadens
KGRG

SEQ ID NO: 2834692 - protein, 8 aa, Entamoeba invadens
KGRGTYRI

SEQ ID NO: 2834693 - protein, 5 aa, Entamoeba invadens
KGRIP

SEQ ID NO: 2834694 - protein, 4 aa, Entamoeba invadens
KGRW

SEQ ID NO: 2834695 - protein, 4 aa, Entamoeba invadens
KGSF

SEQ ID NO: 2834696 - protein, 4 aa, Entamoeba invadens
KGSK

SEQ ID NO: 2834697 - protein, 11 aa, Entamoeba invadens
KGTGENITERF

SEQ ID NO: 2834698 - protein, 5 aa, Entamoeba invadens
KGTIE

SEQ ID NO: 2834699 - protein, 5 aa, Entamoeba invadens
KGTQI

SEQ ID NO: 2834700 - protein, 14 aa, Entamoeba invadens
KGTVNDPQKLANLP

SEQ ID NO: 2834701 - protein, 9 aa, Entamoeba invadens
KGVNEASEA

SEQ ID NO: 2834702 - protein, 4 aa, Entamoeba invadens
KGYG

SEQ ID NO: 2834703 - protein, 4 aa, Entamoeba invadens
KHEN

SEQ ID NO: 2834704 - protein, 7 aa, Entamoeba invadens
KHRAPKA

SEQ ID NO: 2834705 - protein, 9 aa, Entamoeba invadens
KHSKTTFSR

SEQ ID NO: 2834706 - protein, 7 aa, Entamoeba invadens
KIAAYGG

SEQ ID NO: 2834707 - protein, 8 aa, Entamoeba invadens
KIAPESRK

SEQ ID NO: 2834708 - protein, 24 aa, Entamoeba invadens
KIDDATPEEQMHSSEDTEGDDEAA

SEQ ID NO: 2834709 - protein, 5 aa, Entamoeba invadens
KIEDE

SEQ ID NO: 2834710 - protein, 10 aa, Entamoeba invadens
KIEKTTADQN

SEQ ID NO: 2834711 - protein, 4 aa, Entamoeba invadens
KIEL

SEQ ID NO: 2834712 - protein, 23 aa, Entamoeba invadens
KIENDRLEKEKKEKEEAEEAERQ

SEQ ID NO: 2834713 - protein, 5 aa, Entamoeba invadens
KIENG

SEQ ID NO: 2834714 - protein, 5 aa, Entamoeba invadens
KIGIS

SEQ ID NO: 2834715 - protein, 18 aa, Entamoeba invadens
KIKSQNKCSNVTQQEYQD

SEQ ID NO: 2834716 - protein, 5 aa, Entamoeba invadens
KINNY

SEQ ID NO: 2834717 - protein, 7 aa, Entamoeba invadens
KIPKTTK

SEQ ID NO: 2834718 - protein, 6 aa, Entamoeba invadens
KIPSGV

SEQ ID NO: 2834719 - protein, 8 aa, Entamoeba invadens
KIRTESGR

SEQ ID NO: 2834720 - protein, 4 aa, Entamoeba invadens
KISD

SEQ ID NO: 2834721 - protein, 9 aa, Entamoeba invadens
KISDNPPLK

SEQ ID NO: 2834722 - protein, 18 aa, Entamoeba invadens
KITPITTEQGMAKAKDIG

SEQ ID NO: 2834723 - protein, 17 aa, Entamoeba invadens
KKAPGSSEVLEEILKMV

SEQ ID NO: 2834724 - protein, 14 aa, Entamoeba invadens
KKARSGDKSSENEM

SEQ ID NO: 2834725 - protein, 5 aa, Entamoeba invadens
KKATV

SEQ ID NO: 2834726 - protein, 13 aa, Entamoeba invadens
KKDAQHNENAQHE

SEQ ID NO: 2834727 - protein, 4 aa, Entamoeba invadens
KKDE

SEQ ID NO: 2834728 - protein, 11 aa, Entamoeba invadens
KKDEDIGAGDQ

SEQ ID NO: 2834729 - protein, 8 aa, Entamoeba invadens
KKDETKEF

SEQ ID NO: 2834730 - protein, 4 aa, Entamoeba invadens
KKDG

SEQ ID NO: 2834731 - protein, 7 aa, Entamoeba invadens
KKDGKTM

SEQ ID NO: 2834732 - protein, 16 aa, Entamoeba invadens
KKDKVNAKLTDFGSAR

SEQ ID NO: 2834733 - protein, 5 aa, Entamoeba invadens
KKDYE

SEQ ID NO: 2834734 - protein, 12 aa, Entamoeba invadens
KKEDMERVAKSN

SEQ ID NO: 2834735 - protein, 7 aa, Entamoeba invadens
KKEGKNV

SEQ ID NO: 2834736 - protein, 5 aa, Entamoeba invadens
KKENF

SEQ ID NO: 2834737 - protein, 9 aa, Entamoeba invadens
KKESIESMA

SEQ ID NO: 2834738 - protein, 8 aa, Entamoeba invadens
KKETETEK

SEQ ID NO: 2834739 - protein, 11 aa, Entamoeba invadens
KKFNAKEINDI

SEQ ID NO: 2834740 - protein, 4 aa, Entamoeba invadens
KKGE

SEQ ID NO: 2834741 - protein, 30 aa, Entamoeba invadens
KKGEAPKSSRHVKASPDPTYSFDPKGSNLT

SEQ ID NO: 2834742 - protein, 4 aa, Entamoeba invadens
KKGK

SEQ ID NO: 2834743 - protein, 10 aa, Entamoeba invadens
KKGKPEYRKK

SEQ ID NO: 2834744 - protein, 8 aa, Entamoeba invadens
KKGKTTSQ

SEQ ID NO: 2834745 - protein, 9 aa, Entamoeba invadens
KKGMPPSQI

SEQ ID NO: 2834746 - protein, 7 aa, Entamoeba invadens
KKGMSQD

SEQ ID NO: 2834747 - protein, 10 aa, Entamoeba invadens
KKGSKKPAVR

SEQ ID NO: 2834748 - protein, 9 aa, Entamoeba invadens
KKGSLNGIS

SEQ ID NO: 2834749 - protein, 8 aa, Entamoeba invadens
KKIAKKHK

SEQ ID NO: 2834750 - protein, 7 aa, Entamoeba invadens
KKIGEGS

SEQ ID NO: 2834751 - protein, 19 aa, Entamoeba invadens
KKKEHTEKKRSEKRRTVEK

SEQ ID NO: 2834752 - protein, 9 aa, Entamoeba invadens
KKKYKKAAD

SEQ ID NO: 2834753 - protein, 11 aa, Entamoeba invadens
KKLAAKNAEKV

SEQ ID NO: 2834754 - protein, 4 aa, Entamoeba invadens
KKLG

SEQ ID NO: 2834755 - protein, 10 aa, Entamoeba invadens
KKLGNSSIQN

SEQ ID NO: 2834756 - protein, 4 aa, Entamoeba invadens
KKLP

SEQ ID NO: 2834757 - protein, 5 aa, Entamoeba invadens
KKLTK

SEQ ID NO: 2834758 - protein, 4 aa, Entamoeba invadens
KKLV

SEQ ID NO: 2834759 - protein, 5 aa, Entamoeba invadens
KKNEK

SEQ ID NO: 2834760 - protein, 8 aa, Entamoeba invadens
KKNRTTES

SEQ ID NO: 2834761 - protein, 6 aa, Entamoeba invadens
KKPETP

SEQ ID NO: 2834762 - protein, 23 aa, Entamoeba invadens
KKRGDAAKAYKESVAKKNEQVEE

SEQ ID NO: 2834763 - protein, 4 aa, Entamoeba invadens
KKRV

SEQ ID NO: 2834764 - protein, 4 aa, Entamoeba invadens
KKSE

SEQ ID NO: 2834765 - protein, 9 aa, Entamoeba invadens
KKSEEKIKQ

SEQ ID NO: 2834766 - protein, 8 aa, Entamoeba invadens
KKSENEYH

SEQ ID NO: 2834767 - protein, 7 aa, Entamoeba invadens
KKSSIPE

SEQ ID NO: 2834768 - protein, 4 aa, Entamoeba invadens
KKST

SEQ ID NO: 2834769 - protein, 7 aa, Entamoeba invadens
KKSTGDY

SEQ ID NO: 2834770 - protein, 7 aa, Entamoeba invadens
KKSTIEE

SEQ ID NO: 2834771 - protein, 7 aa, Entamoeba invadens
KKSTRAA

SEQ ID NO: 2834772 - protein, 4 aa, Entamoeba invadens
KKTA

SEQ ID NO: 2834773 - protein, 4 aa, Entamoeba invadens
KKTI

SEQ ID NO: 2834774 - protein, 17 aa, Entamoeba invadens
KKTKMIGEEEKKAPINV

SEQ ID NO: 2834775 - protein, 8 aa, Entamoeba invadens
KKTNEIDE

SEQ ID NO: 2834776 - protein, 4 aa, Entamoeba invadens
KKTT

SEQ ID NO: 2834777 - protein, 5 aa, Entamoeba invadens
KKVPK

SEQ ID NO: 2834778 - protein, 7 aa, Entamoeba invadens
KKVRARD

SEQ ID NO: 2834779 - protein, 11 aa, Entamoeba invadens
KKVTKDEEATT

SEQ ID NO: 2834780 - protein, 13 aa, Entamoeba invadens
KKYNKTEAEASTQ

SEQ ID NO: 2834781 - protein, 15 aa, Entamoeba invadens
KKYNMGRQPANTRLG

SEQ ID NO: 2834782 - protein, 4 aa, Entamoeba invadens
KLAT

SEQ ID NO: 2834783 - protein, 11 aa, Entamoeba invadens
KLDETTENENE

SEQ ID NO: 2834784 - protein, 27 aa, Entamoeba invadens
KLEAEEDNSKDLETQLHEKEDDIADLE

SEQ ID NO: 2834785 - protein, 5 aa, Entamoeba invadens
KLESD

SEQ ID NO: 2834786 - protein, 6 aa, Entamoeba invadens
KLNNEY

SEQ ID NO: 2834787 - protein, 4 aa, Entamoeba invadens
KLPE

SEQ ID NO: 2834788 - protein, 9 aa, Entamoeba invadens
KLPESPVTE

SEQ ID NO: 2834789 - protein, 38 aa, Entamoeba invadens
KLQNTISDVNAQNEDTGAVLNDTKDDLANTKNDLKKTQ

SEQ ID NO: 2834790 - protein, 12 aa, Entamoeba invadens
KLREEGKIIPDG

SEQ ID NO: 2834791 - protein, 8 aa, Entamoeba invadens
KLSKNNDD

SEQ ID NO: 2834792 - protein, 13 aa, Entamoeba invadens
KMKGDRQKITSNE

SEQ ID NO: 2834793 - protein, 10 aa, Entamoeba invadens
KMRGTNDNRV

SEQ ID NO: 2834794 - protein, 5 aa, Entamoeba invadens
KMRNK

SEQ ID NO: 2834795 - protein, 9 aa, Entamoeba invadens
KMTEEEAKA

SEQ ID NO: 2834796 - protein, 8 aa, Entamoeba invadens
KMTTEDRE

SEQ ID NO: 2834797 - protein, 12 aa, Entamoeba invadens
KNAKPEDAIEAT

SEQ ID NO: 2834798 - protein, 7 aa, Entamoeba invadens
KNARDQL

SEQ ID NO: 2834799 - protein, 8 aa, Entamoeba invadens
KNASGTRP

SEQ ID NO: 2834800 - protein, 7 aa, Entamoeba invadens
KNCEEPG

SEQ ID NO: 2834801 - protein, 5 aa, Entamoeba invadens
KNDGN

SEQ ID NO: 2834802 - protein, 13 aa, Entamoeba invadens
KNDLGRTKAEFDQ

SEQ ID NO: 2834803 - protein, 13 aa, Entamoeba invadens
KNDLGRTKAELDQ

SEQ ID NO: 2834804 - protein, 13 aa, Entamoeba invadens
KNDLGRTKTELDQ

SEQ ID NO: 2834805 - protein, 4 aa, Entamoeba invadens
KNDS

SEQ ID NO: 2834806 - protein, 6 aa, Entamoeba invadens
KNEGIN

SEQ ID NO: 2834807 - protein, 7 aa, Entamoeba invadens
KNEGNDY

SEQ ID NO: 2834808 - protein, 4 aa, Entamoeba invadens
KNES

SEQ ID NO: 2834809 - protein, 8 aa, Entamoeba invadens
KNFGQNDV

SEQ ID NO: 2834810 - protein, 5 aa, Entamoeba invadens
KNFND

SEQ ID NO: 2834811 - protein, 7 aa, Entamoeba invadens
KNGNGAL

SEQ ID NO: 2834812 - protein, 8 aa, Entamoeba invadens
KNGNQVGA

SEQ ID NO: 2834813 - protein, 16 aa, Entamoeba invadens
KNHEQEDRDDGDYITD

SEQ ID NO: 2834814 - protein, 22 aa, Entamoeba invadens
KNIAKAVSGIAKGAKKVAATKK

SEQ ID NO: 2834815 - protein, 4 aa, Entamoeba invadens
KNIT

SEQ ID NO: 2834816 - protein, 5 aa, Entamoeba invadens
KNKIN

SEQ ID NO: 2834817 - protein, 11 aa, Entamoeba invadens
KNKKALSPNDI

SEQ ID NO: 2834818 - protein, 6 aa, Entamoeba invadens
KNKNLS

SEQ ID NO: 2834819 - protein, 14 aa, Entamoeba invadens
KNKVEAIKEKKPLR

SEQ ID NO: 2834820 - protein, 21 aa, Entamoeba invadens
KNLANDKDQLSSEKKKLQDQY

SEQ ID NO: 2834821 - protein, 6 aa, Entamoeba invadens
KNLKQG

SEQ ID NO: 2834822 - protein, 5 aa, Entamoeba invadens
KNLND

SEQ ID NO: 2834823 - protein, 6 aa, Entamoeba invadens
KNLRRE

SEQ ID NO: 2834824 - protein, 5 aa, Entamoeba invadens
KNNET

SEQ ID NO: 2834825 - protein, 5 aa, Entamoeba invadens
KNNIN

SEQ ID NO: 2834826 - protein, 10 aa, Entamoeba invadens
KNPASDKTKH

SEQ ID NO: 2834827 - protein, 6 aa, Entamoeba invadens
KNPSIR

SEQ ID NO: 2834828 - protein, 6 aa, Entamoeba invadens
KNPTNG

SEQ ID NO: 2834829 - protein, 5 aa, Entamoeba invadens
KNPTV

SEQ ID NO: 2834830 - protein, 4 aa, Entamoeba invadens
KNQG

SEQ ID NO: 2834831 - protein, 5 aa, Entamoeba invadens
KNRGK

SEQ ID NO: 2834832 - protein, 5 aa, Entamoeba invadens
KNRRR

SEQ ID NO: 2834833 - protein, 4 aa, Entamoeba invadens
KNSF

SEQ ID NO: 2834834 - protein, 7 aa, Entamoeba invadens
KNSNGMT

SEQ ID NO: 2834835 - protein, 4 aa, Entamoeba invadens
KNSP

SEQ ID NO: 2834836 - protein, 6 aa, Entamoeba invadens
KNSYDI

SEQ ID NO: 2834837 - protein, 5 aa, Entamoeba invadens
KNTAA

SEQ ID NO: 2834838 - protein, 14 aa, Entamoeba invadens
KNTISKRESTQREY

SEQ ID NO: 2834839 - protein, 4 aa, Entamoeba invadens
KNTT

SEQ ID NO: 2834840 - protein, 11 aa, Entamoeba invadens
KNVRKTNERLT

SEQ ID NO: 2834841 - protein, 4 aa, Entamoeba invadens
KNVT

SEQ ID NO: 2834842 - protein, 18 aa, Entamoeba invadens
KNYDNNCGLSTTQTNVTT

SEQ ID NO: 2834843 - protein, 5 aa, Entamoeba invadens
KPAEV

SEQ ID NO: 2834844 - protein, 23 aa, Entamoeba invadens
KPAGGPKMPSQRMSGPMDQNDAG

SEQ ID NO: 2834845 - protein, 7 aa, Entamoeba invadens
KPDLSTD

SEQ ID NO: 2834846 - protein, 4 aa, Entamoeba invadens
KPDV

SEQ ID NO: 2834847 - protein, 4 aa, Entamoeba invadens
KPED

SEQ ID NO: 2834848 - protein, 4 aa, Entamoeba invadens
KPEE

SEQ ID NO: 2834849 - protein, 8 aa, Entamoeba invadens
KPEESAVR

SEQ ID NO: 2834850 - protein, 6 aa, Entamoeba invadens
KPEKQD

SEQ ID NO: 2834851 - protein, 4 aa, Entamoeba invadens
KPEY

SEQ ID NO: 2834852 - protein, 9 aa, Entamoeba invadens
KPGCSKTTS

SEQ ID NO: 2834853 - protein, 4 aa, Entamoeba invadens
KPLD

SEQ ID NO: 2834854 - protein, 6 aa, Entamoeba invadens
KPLQEE

SEQ ID NO: 2834855 - protein, 4 aa, Entamoeba invadens
KPNK

SEQ ID NO: 2834856 - protein, 8 aa, Entamoeba invadens
KPQEQKTT

SEQ ID NO: 2834857 - protein, 4 aa, Entamoeba invadens
KPTL

SEQ ID NO: 2834858 - protein, 5 aa, Entamoeba invadens
KPTVG

SEQ ID NO: 2834859 - protein, 5 aa, Entamoeba invadens
KQEKV

SEQ ID NO: 2834860 - protein, 4 aa, Entamoeba invadens
KQFE

SEQ ID NO: 2834861 - protein, 4 aa, Entamoeba invadens
KQGI

SEQ ID NO: 2834862 - protein, 7 aa, Entamoeba invadens
KQGKQLV

SEQ ID NO: 2834863 - protein, 19 aa, Entamoeba invadens
KQHTKDIPTNKKELDNSID

SEQ ID NO: 2834864 - protein, 12 aa, Entamoeba invadens
KQIGTGHSGQYD

SEQ ID NO: 2834865 - protein, 4 aa, Entamoeba invadens
KQIN

SEQ ID NO: 2834866 - protein, 15 aa, Entamoeba invadens
KQKNEKEEKELAKQA

SEQ ID NO: 2834867 - protein, 22 aa, Entamoeba invadens
KQLSENGYKTLSGPRTTGDGYY

SEQ ID NO: 2834868 - protein, 9 aa, Entamoeba invadens
KQNEKTATV

SEQ ID NO: 2834869 - protein, 6 aa, Entamoeba invadens
KQNITT

SEQ ID NO: 2834870 - protein, 6 aa, Entamoeba invadens
KQNKSY

SEQ ID NO: 2834871 - protein, 4 aa, Entamoeba invadens
KQNV

SEQ ID NO: 2834872 - protein, 5 aa, Entamoeba invadens
KQPKM

SEQ ID NO: 2834873 - protein, 9 aa, Entamoeba invadens
KQPTESKDK

SEQ ID NO: 2834874 - protein, 7 aa, Entamoeba invadens
KQRKAGY

SEQ ID NO: 2834875 - protein, 10 aa, Entamoeba invadens
KQRNKNYEDV

SEQ ID NO: 2834876 - protein, 8 aa, Entamoeba invadens
KQRTETQT

SEQ ID NO: 2834877 - protein, 4 aa, Entamoeba invadens
KQSG

SEQ ID NO: 2834878 - protein, 7 aa, Entamoeba invadens
KQSITIP

SEQ ID NO: 2834879 - protein, 6 aa, Entamoeba invadens
KQTNIL

SEQ ID NO: 2834880 - protein, 9 aa, Entamoeba invadens
KRCSDGETC

SEQ ID NO: 2834881 - protein, 4 aa, Entamoeba invadens
KRDE

SEQ ID NO: 2834882 - protein, 7 aa, Entamoeba invadens
KRDETNP

SEQ ID NO: 2834883 - protein, 10 aa, Entamoeba invadens
KREKSVKELN

SEQ ID NO: 2834884 - protein, 5 aa, Entamoeba invadens
KRGRD

SEQ ID NO: 2834885 - protein, 4 aa, Entamoeba invadens
KRID

SEQ ID NO: 2834886 - protein, 12 aa, Entamoeba invadens
KRIEDGLNDSDM

SEQ ID NO: 2834887 - protein, 12 aa, Entamoeba invadens
KRKERADATEAI

SEQ ID NO: 2834888 - protein, 7 aa, Entamoeba invadens
KRKGEIS

SEQ ID NO: 2834889 - protein, 8 aa, Entamoeba invadens
KRKKTDAI

SEQ ID NO: 2834890 - protein, 7 aa, Entamoeba invadens
KRNAESF

SEQ ID NO: 2834891 - protein, 12 aa, Entamoeba invadens
KRPASKKVTKDL

SEQ ID NO: 2834892 - protein, 4 aa, Entamoeba invadens
KRPD

SEQ ID NO: 2834893 - protein, 12 aa, Entamoeba invadens
KRRETEKDDGKC

SEQ ID NO: 2834894 - protein, 4 aa, Entamoeba invadens
KRRP

SEQ ID NO: 2834895 - protein, 5 aa, Entamoeba invadens
KRRTV

SEQ ID NO: 2834896 - protein, 5 aa, Entamoeba invadens
KRTLG

SEQ ID NO: 2834897 - protein, 8 aa, Entamoeba invadens
KSDDEIQQ

SEQ ID NO: 2834898 - protein, 18 aa, Entamoeba invadens
KSDGTVSIADASGESPVE

SEQ ID NO: 2834899 - protein, 10 aa, Entamoeba invadens
KSDIRDNAKS

SEQ ID NO: 2834900 - protein, 7 aa, Entamoeba invadens
KSDLESA

SEQ ID NO: 2834901 - protein, 7 aa, Entamoeba invadens
KSDLESV

SEQ ID NO: 2834902 - protein, 6 aa, Entamoeba invadens
KSDNPI

SEQ ID NO: 2834903 - protein, 8 aa, Entamoeba invadens
KSDNSNMH

SEQ ID NO: 2834904 - protein, 4 aa, Entamoeba invadens
KSDV

SEQ ID NO: 2834905 - protein, 4 aa, Entamoeba invadens
KSEF

SEQ ID NO: 2834906 - protein, 10 aa, Entamoeba invadens
KSEMGGDEDF

SEQ ID NO: 2834907 - protein, 8 aa, Entamoeba invadens
KSFEANGC

SEQ ID NO: 2834908 - protein, 5 aa, Entamoeba invadens
KSFEE

SEQ ID NO: 2834909 - protein, 6 aa, Entamoeba invadens
KSGGIT

SEQ ID NO: 2834910 - protein, 4 aa, Entamoeba invadens
KSGT

SEQ ID NO: 2834911 - protein, 7 aa, Entamoeba invadens
KSGYTLK

SEQ ID NO: 2834912 - protein, 6 aa, Entamoeba invadens
KSIEDD

SEQ ID NO: 2834913 - protein, 11 aa, Entamoeba invadens
KSKASLKRDTP

SEQ ID NO: 2834914 - protein, 4 aa, Entamoeba invadens
KSKG

SEQ ID NO: 2834915 - protein, 9 aa, Entamoeba invadens
KSKHTTAIK

SEQ ID NO: 2834916 - protein, 4 aa, Entamoeba invadens
KSKL

SEQ ID NO: 2834917 - protein, 5 aa, Entamoeba invadens
KSKRV

SEQ ID NO: 2834918 - protein, 9 aa, Entamoeba invadens
KSKTRKGDT

SEQ ID NO: 2834919 - protein, 9 aa, Entamoeba invadens
KSKTRKSDT

SEQ ID NO: 2834920 - protein, 12 aa, Entamoeba invadens
KSLAEKNAAKRK

SEQ ID NO: 2834921 - protein, 5 aa, Entamoeba invadens
KSLKS

SEQ ID NO: 2834922 - protein, 4 aa, Entamoeba invadens
KSLS

SEQ ID NO: 2834923 - protein, 9 aa, Entamoeba invadens
KSNKPSNSQ

SEQ ID NO: 2834924 - protein, 10 aa, Entamoeba invadens
KSPAENQTMN

SEQ ID NO: 2834925 - protein, 4 aa, Entamoeba invadens
KSPI

SEQ ID NO: 2834926 - protein, 5 aa, Entamoeba invadens
KSPNT

SEQ ID NO: 2834927 - protein, 10 aa, Entamoeba invadens
KSPRINPPEE

SEQ ID NO: 2834928 - protein, 14 aa, Entamoeba invadens
KSPTTSYDSTNPNK

SEQ ID NO: 2834929 - protein, 6 aa, Entamoeba invadens
KSQDTN

SEQ ID NO: 2834930 - protein, 4 aa, Entamoeba invadens
KSRE

SEQ ID NO: 2834931 - protein, 9 aa, Entamoeba invadens
KSRENRNNF

SEQ ID NO: 2834932 - protein, 5 aa, Entamoeba invadens
KSRID

SEQ ID NO: 2834933 - protein, 6 aa, Entamoeba invadens
KSSKVY

SEQ ID NO: 2834934 - protein, 4 aa, Entamoeba invadens
KSSL

SEQ ID NO: 2834935 - protein, 10 aa, Entamoeba invadens
KSSTTHDEFT

SEQ ID NO: 2834936 - protein, 4 aa, Entamoeba invadens
KSTE

SEQ ID NO: 2834937 - protein, 6 aa, Entamoeba invadens
KSTERV

SEQ ID NO: 2834938 - protein, 17 aa, Entamoeba invadens
KSTKCDSLSEMNTNKTC

SEQ ID NO: 2834939 - protein, 11 aa, Entamoeba invadens
KSTKVETDSVK

SEQ ID NO: 2834940 - protein, 8 aa, Entamoeba invadens
KSTPKTFG

SEQ ID NO: 2834941 - protein, 5 aa, Entamoeba invadens
KSVES

SEQ ID NO: 2834942 - protein, 4 aa, Entamoeba invadens
KSVK

SEQ ID NO: 2834943 - protein, 4 aa, Entamoeba invadens
KSVR

SEQ ID NO: 2834944 - protein, 5 aa, Entamoeba invadens
KSVSP

SEQ ID NO: 2834945 - protein, 13 aa, Entamoeba invadens
KTAEQAITKAGGK

SEQ ID NO: 2834946 - protein, 8 aa, Entamoeba invadens
KTAQGKAI

SEQ ID NO: 2834947 - protein, 7 aa, Entamoeba invadens
KTATSAK

SEQ ID NO: 2834948 - protein, 6 aa, Entamoeba invadens
KTCSLQ

SEQ ID NO: 2834949 - protein, 10 aa, Entamoeba invadens
KTDEGKQRIA

SEQ ID NO: 2834950 - protein, 13 aa, Entamoeba invadens
KTDQEREGPSPSD

SEQ ID NO: 2834951 - protein, 22 aa, Entamoeba invadens
KTEEKQKEKGGKITLEDFINLS

SEQ ID NO: 2834952 - protein, 4 aa, Entamoeba invadens
KTEG

SEQ ID NO: 2834953 - protein, 4 aa, Entamoeba invadens
KTEK

SEQ ID NO: 2834954 - protein, 23 aa, Entamoeba invadens
KTELDEKQDECDKLEDDLSEMKT

SEQ ID NO: 2834955 - protein, 10 aa, Entamoeba invadens
KTEQNNKNIE

SEQ ID NO: 2834956 - protein, 10 aa, Entamoeba invadens
KTESKYKSAQ

SEQ ID NO: 2834957 - protein, 20 aa, Entamoeba invadens
KTFPPTCSESERIERYKTKG

SEQ ID NO: 2834958 - protein, 11 aa, Entamoeba invadens
KTGEGKADKVL

SEQ ID NO: 2834959 - protein, 4 aa, Entamoeba invadens
KTGN

SEQ ID NO: 2834960 - protein, 7 aa, Entamoeba invadens
KTGNVSQ

SEQ ID NO: 2834961 - protein, 4 aa, Entamoeba invadens
KTGV

SEQ ID NO: 2834962 - protein, 5 aa, Entamoeba invadens
KTIEG

SEQ ID NO: 2834963 - protein, 4 aa, Entamoeba invadens
KTIQ

SEQ ID NO: 2834964 - protein, 7 aa, Entamoeba invadens
KTISPTA

SEQ ID NO: 2834965 - protein, 4 aa, Entamoeba invadens
KTKE

SEQ ID NO: 2834966 - protein, 8 aa, Entamoeba invadens
KTKEEIET

SEQ ID NO: 2834967 - protein, 6 aa, Entamoeba invadens
KTKEHI

SEQ ID NO: 2834968 - protein, 12 aa, Entamoeba invadens
KTKEPGANGEPL

SEQ ID NO: 2834969 - protein, 4 aa, Entamoeba invadens
KTKL

SEQ ID NO: 2834970 - protein, 10 aa, Entamoeba invadens
KTKVGKHGHA

SEQ ID NO: 2834971 - protein, 11 aa, Entamoeba invadens
KTKYYKTDKKV

SEQ ID NO: 2834972 - protein, 13 aa, Entamoeba invadens
KTMNEENKKIANE

SEQ ID NO: 2834973 - protein, 10 aa, Entamoeba invadens
KTNAQNCDEA

SEQ ID NO: 2834974 - protein, 7 aa, Entamoeba invadens
KTNMADA

SEQ ID NO: 2834975 - protein, 13 aa, Entamoeba invadens
KTNNKKHIKRGFP

SEQ ID NO: 2834976 - protein, 5 aa, Entamoeba invadens
KTNPV

SEQ ID NO: 2834977 - protein, 7 aa, Entamoeba invadens
KTNRDNN

SEQ ID NO: 2834978 - protein, 6 aa, Entamoeba invadens
KTNRVA

SEQ ID NO: 2834979 - protein, 8 aa, Entamoeba invadens
KTPEDYKE

SEQ ID NO: 2834980 - protein, 7 aa, Entamoeba invadens
KTPEGTK

SEQ ID NO: 2834981 - protein, 6 aa, Entamoeba invadens
KTRGNG

SEQ ID NO: 2834982 - protein, 4 aa, Entamoeba invadens
KTRR

SEQ ID NO: 2834983 - protein, 18 aa, Entamoeba invadens
KTRRSTRSFKGPIPKEEL

SEQ ID NO: 2834984 - protein, 11 aa, Entamoeba invadens
KTSISENELSQ

SEQ ID NO: 2834985 - protein, 10 aa, Entamoeba invadens
KTSKSSIGSL

SEQ ID NO: 2834986 - protein, 7 aa, Entamoeba invadens
KTSLPRK

SEQ ID NO: 2834987 - protein, 6 aa, Entamoeba invadens
KTSNEI

SEQ ID NO: 2834988 - protein, 10 aa, Entamoeba invadens
KTSTKNECTS

SEQ ID NO: 2834989 - protein, 7 aa, Entamoeba invadens
KTTKGTL

SEQ ID NO: 2834990 - protein, 11 aa, Entamoeba invadens
KTTKKTNTADK

SEQ ID NO: 2834991 - protein, 4 aa, Entamoeba invadens
KTTS

SEQ ID NO: 2834992 - protein, 6 aa, Entamoeba invadens
KTTTDA

SEQ ID NO: 2834993 - protein, 7 aa, Entamoeba invadens
KTTYYSG

SEQ ID NO: 2834994 - protein, 6 aa, Entamoeba invadens
KTVETQ

SEQ ID NO: 2834995 - protein, 8 aa, Entamoeba invadens
KTVSQKEM

SEQ ID NO: 2834996 - protein, 4 aa, Entamoeba invadens
KTVT

SEQ ID NO: 2834997 - protein, 6 aa, Entamoeba invadens
KTYTSG

SEQ ID NO: 2834998 - protein, 9 aa, Entamoeba invadens
KVDKTTDYA

SEQ ID NO: 2834999 - protein, 10 aa, Entamoeba invadens
KVDNSTRKIT

SEQ ID NO: 2835000 - protein, 16 aa, Entamoeba invadens
KVDTKVDSSDLSKRKI

SEQ ID NO: 2835001 - protein, 5 aa, Entamoeba invadens
KVEEE

SEQ ID NO: 2835002 - protein, 11 aa, Entamoeba invadens
KVEEESEKVID

SEQ ID NO: 2835003 - protein, 6 aa, Entamoeba invadens
KVEETL

SEQ ID NO: 2835004 - protein, 7 aa, Entamoeba invadens
KVGKTSL

SEQ ID NO: 2835005 - protein, 7 aa, Entamoeba invadens
KVGNTTR

SEQ ID NO: 2835006 - protein, 4 aa, Entamoeba invadens
KVPE

SEQ ID NO: 2835007 - protein, 16 aa, Entamoeba invadens
KVPQSPPPHQQKEKPI

SEQ ID NO: 2835008 - protein, 10 aa, Entamoeba invadens
KVSKRTIANS

SEQ ID NO: 2835009 - protein, 8 aa, Entamoeba invadens
KVSNELYK

SEQ ID NO: 2835010 - protein, 4 aa, Entamoeba invadens
KVSP

SEQ ID NO: 2835011 - protein, 15 aa, Entamoeba invadens
KVTDNTNSKDKPLTC

SEQ ID NO: 2835012 - protein, 10 aa, Entamoeba invadens
KWGSGAYKGD

SEQ ID NO: 2835013 - protein, 10 aa, Entamoeba invadens
KYDGATHLKG

SEQ ID NO: 2835014 - protein, 15 aa, Entamoeba invadens
KYDNKTNFKTTQEDY

SEQ ID NO: 2835015 - protein, 11 aa, Entamoeba invadens
KYEAEKPERDL

SEQ ID NO: 2835016 - protein, 5 aa, Entamoeba invadens
KYGES

SEQ ID NO: 2835017 - protein, 17 aa, Entamoeba invadens
KYGNDLTAQAESGKMDP

SEQ ID NO: 2835018 - protein, 6 aa, Entamoeba invadens
KYKKDI

SEQ ID NO: 2835019 - protein, 7 aa, Entamoeba invadens
KYKKNAD

SEQ ID NO: 2835020 - protein, 17 aa, Entamoeba invadens
KYKQKQVDDKYNKTCVV

SEQ ID NO: 2835021 - protein, 4 aa, Entamoeba invadens
KYNN

SEQ ID NO: 2835022 - protein, 5 aa, Entamoeba invadens
KYNYE

SEQ ID NO: 2835023 - protein, 11 aa, Entamoeba invadens
KYPNESPPVIT

SEQ ID NO: 2835024 - protein, 4 aa, Entamoeba invadens
KYPT

SEQ ID NO: 2835025 - protein, 5 aa, Entamoeba invadens
KYRGT

SEQ ID NO: 2835026 - protein, 14 aa, Entamoeba invadens
KYSYDGNASCVESS

SEQ ID NO: 2835027 - protein, 5 aa, Entamoeba invadens
KYTGK

SEQ ID NO: 2835028 - protein, 7 aa, Entamoeba invadens
KYVESSK

SEQ ID NO: 2835029 - protein, 16 aa, Entamoeba invadens
LANEGLGSQGSQNEKA

SEQ ID NO: 2835030 - protein, 4 aa, Entamoeba invadens
LASG

SEQ ID NO: 2835031 - protein, 13 aa, Entamoeba invadens
LATDSTQSIEERD

SEQ ID NO: 2835032 - protein, 9 aa, Entamoeba invadens
LATLSSEKA

SEQ ID NO: 2835033 - protein, 7 aa, Entamoeba invadens
LDDDQEG

SEQ ID NO: 2835034 - protein, 7 aa, Entamoeba invadens
LDEEGEY

SEQ ID NO: 2835035 - protein, 20 aa, Entamoeba invadens
LDEKHQQKLPEEVAKNYNEK

SEQ ID NO: 2835036 - protein, 8 aa, Entamoeba invadens
LDENGDGV

SEQ ID NO: 2835037 - protein, 4 aa, Entamoeba invadens
LDKE

SEQ ID NO: 2835038 - protein, 9 aa, Entamoeba invadens
LDNGAKKVT

SEQ ID NO: 2835039 - protein, 7 aa, Entamoeba invadens
LDNTEEF

SEQ ID NO: 2835040 - protein, 4 aa, Entamoeba invadens
LDPK

SEQ ID NO: 2835041 - protein, 10 aa, Entamoeba invadens
LDPSRAEEYK

SEQ ID NO: 2835042 - protein, 16 aa, Entamoeba invadens
LDSTVDSTKIENLKQS

SEQ ID NO: 2835043 - protein, 4 aa, Entamoeba invadens
LEAE

SEQ ID NO: 2835044 - protein, 23 aa, Entamoeba invadens
LEDAEREKAALNEEVEAANEKLR

SEQ ID NO: 2835045 - protein, 6 aa, Entamoeba invadens
LEDEKK

SEQ ID NO: 2835046 - protein, 5 aa, Entamoeba invadens
LEDGE

SEQ ID NO: 2835047 - protein, 9 aa, Entamoeba invadens
LEDKGTNSM

SEQ ID NO: 2835048 - protein, 4 aa, Entamoeba invadens
LEDV

SEQ ID NO: 2835049 - protein, 4 aa, Entamoeba invadens
LEEI

SEQ ID NO: 2835050 - protein, 4 aa, Entamoeba invadens
LEGE

SEQ ID NO: 2835051 - protein, 7 aa, Entamoeba invadens
LEGEEGK

SEQ ID NO: 2835052 - protein, 25 aa, Entamoeba invadens
LEGGKNKKSKKKDASKPKHKKHVNK

SEQ ID NO: 2835053 - protein, 4 aa, Entamoeba invadens
LEKE

SEQ ID NO: 2835054 - protein, 5 aa, Entamoeba invadens
LEKKD

SEQ ID NO: 2835055 - protein, 5 aa, Entamoeba invadens
LEKYP

SEQ ID NO: 2835056 - protein, 4 aa, Entamoeba invadens
LENV

SEQ ID NO: 2835057 - protein, 13 aa, Entamoeba invadens
LEREERADANEAI

SEQ ID NO: 2835058 - protein, 13 aa, Entamoeba invadens
LEREERADATEAI

SEQ ID NO: 2835059 - protein, 4 aa, Entamoeba invadens
LERL

SEQ ID NO: 2835060 - protein, 5 aa, Entamoeba invadens
LESIG

SEQ ID NO: 2835061 - protein, 4 aa, Entamoeba invadens
LETY

SEQ ID NO: 2835062 - protein, 7 aa, Entamoeba invadens
LGEKVRK

SEQ ID NO: 2835063 - protein, 6 aa, Entamoeba invadens
LGGSDY

SEQ ID NO: 2835064 - protein, 25 aa, Entamoeba invadens
LGNNDGKNLSSPNQFRSKEISKSNV

SEQ ID NO: 2835065 - protein, 43 aa, Entamoeba invadens
LGPNEKNEKEDTKQDEKETLKDGVSGGESKDEVMKEEKQQLTM

SEQ ID NO: 2835066 - protein, 9 aa, Entamoeba invadens
LGPNPTSMN

SEQ ID NO: 2835067 - protein, 4 aa, Entamoeba invadens
LGPT

SEQ ID NO: 2835068 - protein, 21 aa, Entamoeba invadens
LGRHSGHGKRKGTKNARTPQK

SEQ ID NO: 2835069 - protein, 6 aa, Entamoeba invadens
LGSGSF

SEQ ID NO: 2835070 - protein, 4 aa, Entamoeba invadens
LGTE

SEQ ID NO: 2835071 - protein, 5 aa, Entamoeba invadens
LGTKN

SEQ ID NO: 2835072 - protein, 5 aa, Entamoeba invadens
LGTTI

SEQ ID NO: 2835073 - protein, 10 aa, Entamoeba invadens
LIGDTAKNQI

SEQ ID NO: 2835074 - protein, 11 aa, Entamoeba invadens
LITQENDALPP

SEQ ID NO: 2835075 - protein, 9 aa, Entamoeba invadens
LKDEEKRRK

SEQ ID NO: 2835076 - protein, 4 aa, Entamoeba invadens
LKED

SEQ ID NO: 2835077 - protein, 4 aa, Entamoeba invadens
LKEE

SEQ ID NO: 2835078 - protein, 9 aa, Entamoeba invadens
LKEESKEEI

SEQ ID NO: 2835079 - protein, 6 aa, Entamoeba invadens
LKEMDT

SEQ ID NO: 2835080 - protein, 18 aa, Entamoeba invadens
LKEYGGKVREFIQGAIYG

SEQ ID NO: 2835081 - protein, 11 aa, Entamoeba invadens
LKGGDRKNGQY

SEQ ID NO: 2835082 - protein, 11 aa, Entamoeba invadens
LKGGSPKYKTL

SEQ ID NO: 2835083 - protein, 4 aa, Entamoeba invadens
LKGS

SEQ ID NO: 2835084 - protein, 4 aa, Entamoeba invadens
LKIP

SEQ ID NO: 2835085 - protein, 8 aa, Entamoeba invadens
LKKDDGSV

SEQ ID NO: 2835086 - protein, 10 aa, Entamoeba invadens
LKKEGKQTLA

SEQ ID NO: 2835087 - protein, 10 aa, Entamoeba invadens
LKKEGNPLQN

SEQ ID NO: 2835088 - protein, 79 aa, Entamoeba invadens
LKNPPPPRRGGAPRGGRGGGRGGFSSRGGSGFGNRGGRGGRGGFGDRNGSDRSSGFGGRGGRGGFGNRDSRPRDSNRGG

SEQ ID NO: 2835089 - protein, 9 aa, Entamoeba invadens
LKPGDIPAE

SEQ ID NO: 2835090 - protein, 15 aa, Entamoeba invadens
LKQTTEDQKGNIKKR

SEQ ID NO: 2835091 - protein, 8 aa, Entamoeba invadens
LKQYSGKV

SEQ ID NO: 2835092 - protein, 4 aa, Entamoeba invadens
LKSK

SEQ ID NO: 2835093 - protein, 13 aa, Entamoeba invadens
LKSVNEKKAFEGC

SEQ ID NO: 2835094 - protein, 4 aa, Entamoeba invadens
LKTG

SEQ ID NO: 2835095 - protein, 9 aa, Entamoeba invadens
LKTPITGPV

SEQ ID NO: 2835096 - protein, 52 aa, Entamoeba invadens
LNDENFDDNEYDIESRDDENDDITDDDNEKENDISNDQNDIEEVDSQDEKIR

SEQ ID NO: 2835097 - protein, 4 aa, Entamoeba invadens
LNEE

SEQ ID NO: 2835098 - protein, 15 aa, Entamoeba invadens
LNEENFKEEAEDGVL

SEQ ID NO: 2835099 - protein, 7 aa, Entamoeba invadens
LNEQQNV

SEQ ID NO: 2835100 - protein, 6 aa, Entamoeba invadens
LNGKKE

SEQ ID NO: 2835101 - protein, 12 aa, Entamoeba invadens
LNNLENNKNDIN

SEQ ID NO: 2835102 - protein, 4 aa, Entamoeba invadens
LNNP

SEQ ID NO: 2835103 - protein, 4 aa, Entamoeba invadens
LNYN

SEQ ID NO: 2835104 - protein, 5 aa, Entamoeba invadens
LNYSD

SEQ ID NO: 2835105 - protein, 6 aa, Entamoeba invadens
LPEDRD

SEQ ID NO: 2835106 - protein, 4 aa, Entamoeba invadens
LPET

SEQ ID NO: 2835107 - protein, 4 aa, Entamoeba invadens
LPIN

SEQ ID NO: 2835108 - protein, 4 aa, Entamoeba invadens
LPKG

SEQ ID NO: 2835109 - protein, 4 aa, Entamoeba invadens
LPKL

SEQ ID NO: 2835110 - protein, 5 aa, Entamoeba invadens
LPKSL

SEQ ID NO: 2835111 - protein, 4 aa, Entamoeba invadens
LPPI

SEQ ID NO: 2835112 - protein, 19 aa, Entamoeba invadens
LPPIKREPPPQPELQPPEK

SEQ ID NO: 2835113 - protein, 4 aa, Entamoeba invadens
LPPK

SEQ ID NO: 2835114 - protein, 6 aa, Entamoeba invadens
LPPNDQ

SEQ ID NO: 2835115 - protein, 11 aa, Entamoeba invadens
LPPPGGLAPPG

SEQ ID NO: 2835116 - protein, 13 aa, Entamoeba invadens
LPPRQPGSSIMPG

SEQ ID NO: 2835117 - protein, 4 aa, Entamoeba invadens
LPQN

SEQ ID NO: 2835118 - protein, 7 aa, Entamoeba invadens
LPQTVTS

SEQ ID NO: 2835119 - protein, 6 aa, Entamoeba invadens
LPRGSG

SEQ ID NO: 2835120 - protein, 4 aa, Entamoeba invadens
LPRS

SEQ ID NO: 2835121 - protein, 5 aa, Entamoeba invadens
LPSSL

SEQ ID NO: 2835122 - protein, 4 aa, Entamoeba invadens
LPTS

SEQ ID NO: 2835123 - protein, 6 aa, Entamoeba invadens
LQNYDA

SEQ ID NO: 2835124 - protein, 9 aa, Entamoeba invadens
LQTQNQQIT

SEQ ID NO: 2835125 - protein, 7 aa, Entamoeba invadens
LQYTGNR

SEQ ID NO: 2835126 - protein, 4 aa, Entamoeba invadens
LREE

SEQ ID NO: 2835127 - protein, 4 aa, Entamoeba invadens
LRGF

SEQ ID NO: 2835128 - protein, 8 aa, Entamoeba invadens
LRKNPDNK

SEQ ID NO: 2835129 - protein, 4 aa, Entamoeba invadens
LSDG

SEQ ID NO: 2835130 - protein, 7 aa, Entamoeba invadens
LSDGRTI

SEQ ID NO: 2835131 - protein, 8 aa, Entamoeba invadens
LSDNQQEE

SEQ ID NO: 2835132 - protein, 7 aa, Entamoeba invadens
LSERSGV

SEQ ID NO: 2835133 - protein, 9 aa, Entamoeba invadens
LSESQVNAV

SEQ ID NO: 2835134 - protein, 6 aa, Entamoeba invadens
LSESTF

SEQ ID NO: 2835135 - protein, 5 aa, Entamoeba invadens
LSETS

SEQ ID NO: 2835136 - protein, 8 aa, Entamoeba invadens
LSEYGDSI

SEQ ID NO: 2835137 - protein, 9 aa, Entamoeba invadens
LSGTPTPTE

SEQ ID NO: 2835138 - protein, 4 aa, Entamoeba invadens
LSIP

SEQ ID NO: 2835139 - protein, 4 aa, Entamoeba invadens
LSKD

SEQ ID NO: 2835140 - protein, 11 aa, Entamoeba invadens
LSKKDAKNNDV

SEQ ID NO: 2835141 - protein, 5 aa, Entamoeba invadens
LSNAE

SEQ ID NO: 2835142 - protein, 8 aa, Entamoeba invadens
LSNGELEK

SEQ ID NO: 2835143 - protein, 7 aa, Entamoeba invadens
LSNSSEK

SEQ ID NO: 2835144 - protein, 6 aa, Entamoeba invadens
LSPNAF

SEQ ID NO: 2835145 - protein, 12 aa, Entamoeba invadens
LSPRDPRRDELK

SEQ ID NO: 2835146 - protein, 9 aa, Entamoeba invadens
LSQDDSPLV

SEQ ID NO: 2835147 - protein, 9 aa, Entamoeba invadens
LSRDANGYL

SEQ ID NO: 2835148 - protein, 12 aa, Entamoeba invadens
LSTAKKEVKEFR

SEQ ID NO: 2835149 - protein, 8 aa, Entamoeba invadens
LSTDKPLR

SEQ ID NO: 2835150 - protein, 8 aa, Entamoeba invadens
LSTEETKH

SEQ ID NO: 2835151 - protein, 4 aa, Entamoeba invadens
LSTS

SEQ ID NO: 2835152 - protein, 4 aa, Entamoeba invadens
LSYK

SEQ ID NO: 2835153 - protein, 5 aa, Entamoeba invadens
LSYPG

SEQ ID NO: 2835154 - protein, 5 aa, Entamoeba invadens
LSYPN

SEQ ID NO: 2835155 - protein, 4 aa, Entamoeba invadens
LSYS

SEQ ID NO: 2835156 - protein, 5 aa, Entamoeba invadens
LTDEP

SEQ ID NO: 2835157 - protein, 11 aa, Entamoeba invadens
LTDSKPTTASD

SEQ ID NO: 2835158 - protein, 6 aa, Entamoeba invadens
LTEGDM

SEQ ID NO: 2835159 - protein, 10 aa, Entamoeba invadens
LTKDDTPVFK

SEQ ID NO: 2835160 - protein, 35 aa, Entamoeba invadens
LTKTTPTAPAVTTQTNVSTPNAPQNSASAAPQAPV

SEQ ID NO: 2835161 - protein, 5 aa, Entamoeba invadens
LTPNK

SEQ ID NO: 2835162 - protein, 7 aa, Entamoeba invadens
LTPSNEK

SEQ ID NO: 2835163 - protein, 4 aa, Entamoeba invadens
LTSD

SEQ ID NO: 2835164 - protein, 4 aa, Entamoeba invadens
LTSL

SEQ ID NO: 2835165 - protein, 31 aa, Entamoeba invadens
LTSTDQTEATDIAEDCSSSEIVKEKRANAIQ

SEQ ID NO: 2835166 - protein, 32 aa, Entamoeba invadens
LTSTDQTEATDIAEDCSSSEIVKEKRANAIQH

SEQ ID NO: 2835167 - protein, 4 aa, Entamoeba invadens
LTSV

SEQ ID NO: 2835168 - protein, 6 aa, Entamoeba invadens
LTTKTR

SEQ ID NO: 2835169 - protein, 10 aa, Entamoeba invadens
LTTSEIETKI

SEQ ID NO: 2835170 - protein, 5 aa, Entamoeba invadens
LVESE

SEQ ID NO: 2835171 - protein, 19 aa, Entamoeba invadens
LVSRTGKSSNLSSKDSDTI

SEQ ID NO: 2835172 - protein, 5 aa, Entamoeba invadens
LYGTK

SEQ ID NO: 2835173 - protein, 20 aa, Entamoeba invadens
MAEQEKVKTMRDYKAASEEL

SEQ ID NO: 2835174 - protein, 20 aa, Entamoeba invadens
MAEQEKVKTVRDYKAASEEL

SEQ ID NO: 2835175 - protein, 7 aa, Entamoeba invadens
MAPECNT

SEQ ID NO: 2835176 - protein, 12 aa, Entamoeba invadens
MDDQQDTNFSSH

SEQ ID NO: 2835177 - protein, 12 aa, Entamoeba invadens
MDEEDKRREEIK

SEQ ID NO: 2835178 - protein, 8 aa, Entamoeba invadens
MDTTVQGI

SEQ ID NO: 2835179 - protein, 7 aa, Entamoeba invadens
MEAQNTL

SEQ ID NO: 2835180 - protein, 59 aa, Entamoeba invadens
MEDGKEKDKDKKGKKDDKKDKKAQKEKEKKEKEEKKKREKEEKKKEGKGEKHGLFGFLK

SEQ ID NO: 2835181 - protein, 4 aa, Entamoeba invadens
MEER

SEQ ID NO: 2835182 - protein, 16 aa, Entamoeba invadens
MEKKTKAPRKQRKEIK

SEQ ID NO: 2835183 - protein, 5 aa, Entamoeba invadens
MERTQ

SEQ ID NO: 2835184 - protein, 10 aa, Entamoeba invadens
MGATPPRQSE

SEQ ID NO: 2835185 - protein, 10 aa, Entamoeba invadens
MGDRDETSEM

SEQ ID NO: 2835186 - protein, 4 aa, Entamoeba invadens
MGER

SEQ ID NO: 2835187 - protein, 8 aa, Entamoeba invadens
MGGVDTAD

SEQ ID NO: 2835188 - protein, 5 aa, Entamoeba invadens
MGRGS

SEQ ID NO: 2835189 - protein, 8 aa, Entamoeba invadens
MKNPDPDL

SEQ ID NO: 2835190 - protein, 20 aa, Entamoeba invadens
MKPTIGGPDTSDVYTSNGTK

SEQ ID NO: 2835191 - protein, 9 aa, Entamoeba invadens
MKQSNDTDK

SEQ ID NO: 2835192 - protein, 7 aa, Entamoeba invadens
MNADSGE

SEQ ID NO: 2835193 - protein, 7 aa, Entamoeba invadens
MNAPYNK

SEQ ID NO: 2835194 - protein, 6 aa, Entamoeba invadens
MNDDLA

SEQ ID NO: 2835195 - protein, 4 aa, Entamoeba invadens
MNED

SEQ ID NO: 2835196 - protein, 29 aa, Entamoeba invadens
MNEESTQQEVTQQTLQSNDSNNTQMQTTQ

SEQ ID NO: 2835197 - protein, 8 aa, Entamoeba invadens
MNPDQQNE

SEQ ID NO: 2835198 - protein, 8 aa, Entamoeba invadens
MNPGTTSD

SEQ ID NO: 2835199 - protein, 7 aa, Entamoeba invadens
MNTSDAE

SEQ ID NO: 2835200 - protein, 14 aa, Entamoeba invadens
MPTFGKDKKKAELV

SEQ ID NO: 2835201 - protein, 8 aa, Entamoeba invadens
MQSDECGK

SEQ ID NO: 2835202 - protein, 5 aa, Entamoeba invadens
MQTTN

SEQ ID NO: 2835203 - protein, 5 aa, Entamoeba invadens
MRSSP

SEQ ID NO: 2835204 - protein, 11 aa, Entamoeba invadens
MSGKAGNTKGI

SEQ ID NO: 2835205 - protein, 5 aa, Entamoeba invadens
MSGQE

SEQ ID NO: 2835206 - protein, 7 aa, Entamoeba invadens
MSQRNKE

SEQ ID NO: 2835207 - protein, 11 aa, Entamoeba invadens
MSTALDPDELK

SEQ ID NO: 2835208 - protein, 4 aa, Entamoeba invadens
MTET

SEQ ID NO: 2835209 - protein, 4 aa, Entamoeba invadens
MTKT

SEQ ID NO: 2835210 - protein, 7 aa, Entamoeba invadens
MTQSEKT

SEQ ID NO: 2835211 - protein, 4 aa, Entamoeba invadens
MTTQ

SEQ ID NO: 2835212 - protein, 9 aa, Entamoeba invadens
MYPSTTSPF

SEQ ID NO: 2835213 - protein, 23 aa, Entamoeba invadens
NAATENSLLNPTNPYSATKAGAE

SEQ ID NO: 2835214 - protein, 10 aa, Entamoeba invadens
NADKTYSNYH

SEQ ID NO: 2835215 - protein, 5 aa, Entamoeba invadens
NAFNS

SEQ ID NO: 2835216 - protein, 7 aa, Entamoeba invadens
NAGVGKT

SEQ ID NO: 2835217 - protein, 7 aa, Entamoeba invadens
NAHKSSM

SEQ ID NO: 2835218 - protein, 13 aa, Entamoeba invadens
NAKTVKNNNSSRF

SEQ ID NO: 2835219 - protein, 14 aa, Entamoeba invadens
NANPNLYFDIITVY

SEQ ID NO: 2835220 - protein, 7 aa, Entamoeba invadens
NANVGKT

SEQ ID NO: 2835221 - protein, 11 aa, Entamoeba invadens
NANYPRRVEKN

SEQ ID NO: 2835222 - protein, 4 aa, Entamoeba invadens
NAPK

SEQ ID NO: 2835223 - protein, 4 aa, Entamoeba invadens
NAPR

SEQ ID NO: 2835224 - protein, 5 aa, Entamoeba invadens
NARPS

SEQ ID NO: 2835225 - protein, 12 aa, Entamoeba invadens
NASEETNSKQKV

SEQ ID NO: 2835226 - protein, 10 aa, Entamoeba invadens
NASKKNTASF

SEQ ID NO: 2835227 - protein, 15 aa, Entamoeba invadens
NASTVNCADNTGAKT

SEQ ID NO: 2835228 - protein, 7 aa, Entamoeba invadens
NATETGC

SEQ ID NO: 2835229 - protein, 6 aa, Entamoeba invadens
NCSSEV

SEQ ID NO: 2835230 - protein, 9 aa, Entamoeba invadens
NDDDKTKQL

SEQ ID NO: 2835231 - protein, 4 aa, Entamoeba invadens
NDDG

SEQ ID NO: 2835232 - protein, 7 aa, Entamoeba invadens
NDDNFGN

SEQ ID NO: 2835233 - protein, 5 aa, Entamoeba invadens
NDETF

SEQ ID NO: 2835234 - protein, 8 aa, Entamoeba invadens
NDGSSITP

SEQ ID NO: 2835235 - protein, 4 aa, Entamoeba invadens
NDIT

SEQ ID NO: 2835236 - protein, 20 aa, Entamoeba invadens
NDKDDVTDDSITEEQSNEFG

SEQ ID NO: 2835237 - protein, 6 aa, Entamoeba invadens
NDKQEH

SEQ ID NO: 2835238 - protein, 8 aa, Entamoeba invadens
NDKQYAGE

SEQ ID NO: 2835239 - protein, 4 aa, Entamoeba invadens
NDKT

SEQ ID NO: 2835240 - protein, 6 aa, Entamoeba invadens
NDMTGA

SEQ ID NO: 2835241 - protein, 5 aa, Entamoeba invadens
NDNEF

SEQ ID NO: 2835242 - protein, 11 aa, Entamoeba invadens
NDNQNTPETIE

SEQ ID NO: 2835243 - protein, 4 aa, Entamoeba invadens
NDPI

SEQ ID NO: 2835244 - protein, 39 aa, Entamoeba invadens
NDPIDGSLETEHSGGEDEAHENEEYEGSECSECNEIEDT

SEQ ID NO: 2835245 - protein, 7 aa, Entamoeba invadens
NDPNFGN

SEQ ID NO: 2835246 - protein, 9 aa, Entamoeba invadens
NDQDRINEA

SEQ ID NO: 2835247 - protein, 9 aa, Entamoeba invadens
NDQERINEA

SEQ ID NO: 2835248 - protein, 11 aa, Entamoeba invadens
NDQGNRTTPSY

SEQ ID NO: 2835249 - protein, 11 aa, Entamoeba invadens
NDRDRISEAKE

SEQ ID NO: 2835250 - protein, 10 aa, Entamoeba invadens
NDRERLSEAK

SEQ ID NO: 2835251 - protein, 7 aa, Entamoeba invadens
NDRESDI

SEQ ID NO: 2835252 - protein, 7 aa, Entamoeba invadens
NDSESLE

SEQ ID NO: 2835253 - protein, 16 aa, Entamoeba invadens
NDSSTVEHQNEMESED

SEQ ID NO: 2835254 - protein, 9 aa, Entamoeba invadens
NDSTRASPI

SEQ ID NO: 2835255 - protein, 8 aa, Entamoeba invadens
NDTDPDVI

SEQ ID NO: 2835256 - protein, 4 aa, Entamoeba invadens
NDVV

SEQ ID NO: 2835257 - protein, 6 aa, Entamoeba invadens
NEAKAK

SEQ ID NO: 2835258 - protein, 5 aa, Entamoeba invadens
NEAKF

SEQ ID NO: 2835259 - protein, 9 aa, Entamoeba invadens
NEAQNPVEI

SEQ ID NO: 2835260 - protein, 20 aa, Entamoeba invadens
NEEDAQKALTAPKNNVLGQG

SEQ ID NO: 2835261 - protein, 15 aa, Entamoeba invadens
NEELSNAIQNNNNVA

SEQ ID NO: 2835262 - protein, 12 aa, Entamoeba invadens
NEFKTSETTSKA

SEQ ID NO: 2835263 - protein, 4 aa, Entamoeba invadens
NEGY

SEQ ID NO: 2835264 - protein, 5 aa, Entamoeba invadens
NEINT

SEQ ID NO: 2835265 - protein, 4 aa, Entamoeba invadens
NEKV

SEQ ID NO: 2835266 - protein, 4 aa, Entamoeba invadens
NELK

SEQ ID NO: 2835267 - protein, 4 aa, Entamoeba invadens
NENE

SEQ ID NO: 2835268 - protein, 9 aa, Entamoeba invadens
NENPDRASR

SEQ ID NO: 2835269 - protein, 9 aa, Entamoeba invadens
NENPKNLSN

SEQ ID NO: 2835270 - protein, 6 aa, Entamoeba invadens
NENPQQ

SEQ ID NO: 2835271 - protein, 6 aa, Entamoeba invadens
NENSNK

SEQ ID NO: 2835272 - protein, 5 aa, Entamoeba invadens
NENVN

SEQ ID NO: 2835273 - protein, 4 aa, Entamoeba invadens
NEST

SEQ ID NO: 2835274 - protein, 7 aa, Entamoeba invadens
NETDDDF

SEQ ID NO: 2835275 - protein, 13 aa, Entamoeba invadens
NETTFKSEQSVNG

SEQ ID NO: 2835276 - protein, 14 aa, Entamoeba invadens
NEVIDESDGTTKCE

SEQ ID NO: 2835277 - protein, 8 aa, Entamoeba invadens
NEWKDQKE

SEQ ID NO: 2835278 - protein, 13 aa, Entamoeba invadens
NEYNTNFKDSNTA

SEQ ID NO: 2835279 - protein, 4 aa, Entamoeba invadens
NFEE

SEQ ID NO: 2835280 - protein, 5 aa, Entamoeba invadens
NFPDT

SEQ ID NO: 2835281 - protein, 4 aa, Entamoeba invadens
NFPN

SEQ ID NO: 2835282 - protein, 7 aa, Entamoeba invadens
NFRGKSA

SEQ ID NO: 2835283 - protein, 9 aa, Entamoeba invadens
NGDFSSTEN

SEQ ID NO: 2835284 - protein, 4 aa, Entamoeba invadens
NGEK

SEQ ID NO: 2835285 - protein, 8 aa, Entamoeba invadens
NGELPKEI

SEQ ID NO: 2835286 - protein, 4 aa, Entamoeba invadens
NGEN

SEQ ID NO: 2835287 - protein, 4 aa, Entamoeba invadens
NGEV

SEQ ID NO: 2835288 - protein, 10 aa, Entamoeba invadens
NGFEPSVGSG

SEQ ID NO: 2835289 - protein, 7 aa, Entamoeba invadens
NGFKPYS

SEQ ID NO: 2835290 - protein, 7 aa, Entamoeba invadens
NGFTPNS

SEQ ID NO: 2835291 - protein, 5 aa, Entamoeba invadens
NGGCD

SEQ ID NO: 2835292 - protein, 13 aa, Entamoeba invadens
NGGFDDDEDEAEF

SEQ ID NO: 2835293 - protein, 8 aa, Entamoeba invadens
NGGFGKIS

SEQ ID NO: 2835294 - protein, 7 aa, Entamoeba invadens
NGHGNEL

SEQ ID NO: 2835295 - protein, 8 aa, Entamoeba invadens
NGHSEKIA

SEQ ID NO: 2835296 - protein, 8 aa, Entamoeba invadens
NGIGTPKY

SEQ ID NO: 2835297 - protein, 4 aa, Entamoeba invadens
NGIP

SEQ ID NO: 2835298 - protein, 6 aa, Entamoeba invadens
NGKEKM

SEQ ID NO: 2835299 - protein, 10 aa, Entamoeba invadens
NGKSSNYGLK

SEQ ID NO: 2835300 - protein, 15 aa, Entamoeba invadens
NGLKKEKLKAESSEY

SEQ ID NO: 2835301 - protein, 4 aa, Entamoeba invadens
NGQI

SEQ ID NO: 2835302 - protein, 4 aa, Entamoeba invadens
NGRL

SEQ ID NO: 2835303 - protein, 4 aa, Entamoeba invadens
NGRV

SEQ ID NO: 2835304 - protein, 4 aa, Entamoeba invadens
NGTG

SEQ ID NO: 2835305 - protein, 5 aa, Entamoeba invadens
NGTSF

SEQ ID NO: 2835306 - protein, 4 aa, Entamoeba invadens
NGTT

SEQ ID NO: 2835307 - protein, 4 aa, Entamoeba invadens
NGTY

SEQ ID NO: 2835308 - protein, 6 aa, Entamoeba invadens
NGVDSD

SEQ ID NO: 2835309 - protein, 7 aa, Entamoeba invadens
NGVSTDP

SEQ ID NO: 2835310 - protein, 7 aa, Entamoeba invadens
NGYDDSS

SEQ ID NO: 2835311 - protein, 7 aa, Entamoeba invadens
NGYGGDF

SEQ ID NO: 2835312 - protein, 9 aa, Entamoeba invadens
NHDETIEKL

SEQ ID NO: 2835313 - protein, 4 aa, Entamoeba invadens
NHED

SEQ ID NO: 2835314 - protein, 7 aa, Entamoeba invadens
NHESRQI

SEQ ID NO: 2835315 - protein, 7 aa, Entamoeba invadens
NHETRKM

SEQ ID NO: 2835316 - protein, 4 aa, Entamoeba invadens
NHLT

SEQ ID NO: 2835317 - protein, 7 aa, Entamoeba invadens
NIDDNNE

SEQ ID NO: 2835318 - protein, 5 aa, Entamoeba invadens
NIGAS

SEQ ID NO: 2835319 - protein, 5 aa, Entamoeba invadens
NIGPK

SEQ ID NO: 2835320 - protein, 4 aa, Entamoeba invadens
NIKN

SEQ ID NO: 2835321 - protein, 4 aa, Entamoeba invadens
NINE

SEQ ID NO: 2835322 - protein, 4 aa, Entamoeba invadens
NIPE

SEQ ID NO: 2835323 - protein, 7 aa, Entamoeba invadens
NIPSNVK

SEQ ID NO: 2835324 - protein, 8 aa, Entamoeba invadens
NIPSSVTS

SEQ ID NO: 2835325 - protein, 6 aa, Entamoeba invadens
NIQSRK

SEQ ID NO: 2835326 - protein, 4 aa, Entamoeba invadens
NIQT

SEQ ID NO: 2835327 - protein, 6 aa, Entamoeba invadens
NIRSYG

SEQ ID NO: 2835328 - protein, 4 aa, Entamoeba invadens
NITE

SEQ ID NO: 2835329 - protein, 8 aa, Entamoeba invadens
NITTSPHY

SEQ ID NO: 2835330 - protein, 5 aa, Entamoeba invadens
NKAPL

SEQ ID NO: 2835331 - protein, 8 aa, Entamoeba invadens
NKDAKDVD

SEQ ID NO: 2835332 - protein, 8 aa, Entamoeba invadens
NKDGYLEG

SEQ ID NO: 2835333 - protein, 9 aa, Entamoeba invadens
NKDPLEPQI

SEQ ID NO: 2835334 - protein, 8 aa, Entamoeba invadens
NKDQKSFK

SEQ ID NO: 2835335 - protein, 5 aa, Entamoeba invadens
NKEIN

SEQ ID NO: 2835336 - protein, 4 aa, Entamoeba invadens
NKEN

SEQ ID NO: 2835337 - protein, 8 aa, Entamoeba invadens
NKESQNDI

SEQ ID NO: 2835338 - protein, 4 aa, Entamoeba invadens
NKEV

SEQ ID NO: 2835339 - protein, 5 aa, Entamoeba invadens
NKGIA

SEQ ID NO: 2835340 - protein, 10 aa, Entamoeba invadens
NKGKCDSDRY

SEQ ID NO: 2835341 - protein, 6 aa, Entamoeba invadens
NKITIQ

SEQ ID NO: 2835342 - protein, 7 aa, Entamoeba invadens
NKKAIND

SEQ ID NO: 2835343 - protein, 4 aa, Entamoeba invadens
NKKS

SEQ ID NO: 2835344 - protein, 8 aa, Entamoeba invadens
NKKTEREK

SEQ ID NO: 2835345 - protein, 8 aa, Entamoeba invadens
NKMDASTQ

SEQ ID NO: 2835346 - protein, 7 aa, Entamoeba invadens
NKNERLS

SEQ ID NO: 2835347 - protein, 21 aa, Entamoeba invadens
NKNQIEKAGEKFEHVVNIFKT

SEQ ID NO: 2835348 - protein, 6 aa, Entamoeba invadens
NKNRNI

SEQ ID NO: 2835349 - protein, 4 aa, Entamoeba invadens
NKNT

SEQ ID NO: 2835350 - protein, 4 aa, Entamoeba invadens
NKNV

SEQ ID NO: 2835351 - protein, 4 aa, Entamoeba invadens
NKPI

SEQ ID NO: 2835352 - protein, 6 aa, Entamoeba invadens
NKRQPL

SEQ ID NO: 2835353 - protein, 9 aa, Entamoeba invadens
NKSNTHYHP

SEQ ID NO: 2835354 - protein, 4 aa, Entamoeba invadens
NKTD

SEQ ID NO: 2835355 - protein, 5 aa, Entamoeba invadens
NKTEL

SEQ ID NO: 2835356 - protein, 5 aa, Entamoeba invadens
NKTKE

SEQ ID NO: 2835357 - protein, 4 aa, Entamoeba invadens
NKTN

SEQ ID NO: 2835358 - protein, 6 aa, Entamoeba invadens
NKTTET

SEQ ID NO: 2835359 - protein, 6 aa, Entamoeba invadens
NKVSTM

SEQ ID NO: 2835360 - protein, 6 aa, Entamoeba invadens
NKYSAE

SEQ ID NO: 2835361 - protein, 14 aa, Entamoeba invadens
NKYVPPPIKKECVL

SEQ ID NO: 2835362 - protein, 10 aa, Entamoeba invadens
NLAKPTSRTF

SEQ ID NO: 2835363 - protein, 5 aa, Entamoeba invadens
NLEDT

SEQ ID NO: 2835364 - protein, 4 aa, Entamoeba invadens
NLEG

SEQ ID NO: 2835365 - protein, 13 aa, Entamoeba invadens
NLETYTRNGQSQY

SEQ ID NO: 2835366 - protein, 10 aa, Entamoeba invadens
NLKTNEEKYN

SEQ ID NO: 2835367 - protein, 9 aa, Entamoeba invadens
NLNQEEATL

SEQ ID NO: 2835368 - protein, 7 aa, Entamoeba invadens
NLPTNDQ

SEQ ID NO: 2835369 - protein, 6 aa, Entamoeba invadens
NLYDSN

SEQ ID NO: 2835370 - protein, 9 aa, Entamoeba invadens
NMDKQYKDV

SEQ ID NO: 2835371 - protein, 11 aa, Entamoeba invadens
NMSQSTNDAFP

SEQ ID NO: 2835372 - protein, 6 aa, Entamoeba invadens
NNAQNQ

SEQ ID NO: 2835373 - protein, 6 aa, Entamoeba invadens
NNDNGK

SEQ ID NO: 2835374 - protein, 13 aa, Entamoeba invadens
NNEDSSYTEEDST

SEQ ID NO: 2835375 - protein, 5 aa, Entamoeba invadens
NNEKY

SEQ ID NO: 2835376 - protein, 10 aa, Entamoeba invadens
NNEPKEEKRD

SEQ ID NO: 2835377 - protein, 4 aa, Entamoeba invadens
NNES

SEQ ID NO: 2835378 - protein, 4 aa, Entamoeba invadens
NNFE

SEQ ID NO: 2835379 - protein, 7 aa, Entamoeba invadens
NNGKCYK

SEQ ID NO: 2835380 - protein, 8 aa, Entamoeba invadens
NNGSTQMC

SEQ ID NO: 2835381 - protein, 11 aa, Entamoeba invadens
NNIDGNKLKND

SEQ ID NO: 2835382 - protein, 8 aa, Entamoeba invadens
NNKEDPVE

SEQ ID NO: 2835383 - protein, 4 aa, Entamoeba invadens
NNKF

SEQ ID NO: 2835384 - protein, 8 aa, Entamoeba invadens
NNKGGENW

SEQ ID NO: 2835385 - protein, 5 aa, Entamoeba invadens
NNKGR

SEQ ID NO: 2835386 - protein, 9 aa, Entamoeba invadens
NNKKEHENF

SEQ ID NO: 2835387 - protein, 25 aa, Entamoeba invadens
NNKKPIDKISPPPVFPSKTREIKNG

SEQ ID NO: 2835388 - protein, 8 aa, Entamoeba invadens
NNKSSERN

SEQ ID NO: 2835389 - protein, 17 aa, Entamoeba invadens
NNMEEEDVNEDPKQMQM

SEQ ID NO: 2835390 - protein, 7 aa, Entamoeba invadens
NNNSDEL

SEQ ID NO: 2835391 - protein, 5 aa, Entamoeba invadens
NNPAH

SEQ ID NO: 2835392 - protein, 4 aa, Entamoeba invadens
NNPN

SEQ ID NO: 2835393 - protein, 4 aa, Entamoeba invadens
NNPS

SEQ ID NO: 2835394 - protein, 12 aa, Entamoeba invadens
NNQKGKLARKNK

SEQ ID NO: 2835395 - protein, 4 aa, Entamoeba invadens
NNQV

SEQ ID NO: 2835396 - protein, 4 aa, Entamoeba invadens
NNSI

SEQ ID NO: 2835397 - protein, 13 aa, Entamoeba invadens
NNTEENGDCENKG

SEQ ID NO: 2835398 - protein, 4 aa, Entamoeba invadens
NNTI

SEQ ID NO: 2835399 - protein, 16 aa, Entamoeba invadens
NNTQEGIKANNCKYTQ

SEQ ID NO: 2835400 - protein, 4 aa, Entamoeba invadens
NNTR

SEQ ID NO: 2835401 - protein, 5 aa, Entamoeba invadens
NNVES

SEQ ID NO: 2835402 - protein, 4 aa, Entamoeba invadens
NPAL

SEQ ID NO: 2835403 - protein, 6 aa, Entamoeba invadens
NPANTN

SEQ ID NO: 2835404 - protein, 5 aa, Entamoeba invadens
NPDAS

SEQ ID NO: 2835405 - protein, 8 aa, Entamoeba invadens
NPDDNDKP

SEQ ID NO: 2835406 - protein, 4 aa, Entamoeba invadens
NPEP

SEQ ID NO: 2835407 - protein, 7 aa, Entamoeba invadens
NPIPAGT

SEQ ID NO: 2835408 - protein, 6 aa, Entamoeba invadens
NPIPVD

SEQ ID NO: 2835409 - protein, 9 aa, Entamoeba invadens
NPISEGKAR

SEQ ID NO: 2835410 - protein, 4 aa, Entamoeba invadens
NPKF

SEQ ID NO: 2835411 - protein, 4 aa, Entamoeba invadens
NPKS

SEQ ID NO: 2835412 - protein, 9 aa, Entamoeba invadens
NPNKYGKDM

SEQ ID NO: 2835413 - protein, 4 aa, Entamoeba invadens
NPPE

SEQ ID NO: 2835414 - protein, 5 aa, Entamoeba invadens
NPPFY

SEQ ID NO: 2835415 - protein, 4 aa, Entamoeba invadens
NPQT

SEQ ID NO: 2835416 - protein, 19 aa, Entamoeba invadens
NPSLQSSSYTAKLGDLTDG

SEQ ID NO: 2835417 - protein, 4 aa, Entamoeba invadens
NPTF

SEQ ID NO: 2835418 - protein, 5 aa, Entamoeba invadens
NPTPG

SEQ ID NO: 2835419 - protein, 4 aa, Entamoeba invadens
NPTQ

SEQ ID NO: 2835420 - protein, 4 aa, Entamoeba invadens
NPTW

SEQ ID NO: 2835421 - protein, 9 aa, Entamoeba invadens
NQFKNKKAL

SEQ ID NO: 2835422 - protein, 13 aa, Entamoeba invadens
NQIDKDGKKVKKV

SEQ ID NO: 2835423 - protein, 4 aa, Entamoeba invadens
NQNL

SEQ ID NO: 2835424 - protein, 5 aa, Entamoeba invadens
NQSAV

SEQ ID NO: 2835425 - protein, 5 aa, Entamoeba invadens
NQSGI

SEQ ID NO: 2835426 - protein, 5 aa, Entamoeba invadens
NQSGS

SEQ ID NO: 2835427 - protein, 17 aa, Entamoeba invadens
NQTASKWSMKKAKKFSG

SEQ ID NO: 2835428 - protein, 9 aa, Entamoeba invadens
NQVDGNVKT

SEQ ID NO: 2835429 - protein, 5 aa, Entamoeba invadens
NRESF

SEQ ID NO: 2835430 - protein, 5 aa, Entamoeba invadens
NRETR

SEQ ID NO: 2835431 - protein, 6 aa, Entamoeba invadens
NRGAQA

SEQ ID NO: 2835432 - protein, 4 aa, Entamoeba invadens
NRGV

SEQ ID NO: 2835433 - protein, 7 aa, Entamoeba invadens
NRKDNSK

SEQ ID NO: 2835434 - protein, 7 aa, Entamoeba invadens
NRLNDSK

SEQ ID NO: 2835435 - protein, 4 aa, Entamoeba invadens
NRNI

SEQ ID NO: 2835436 - protein, 5 aa, Entamoeba invadens
NRNSF

SEQ ID NO: 2835437 - protein, 6 aa, Entamoeba invadens
NRPAYY

SEQ ID NO: 2835438 - protein, 5 aa, Entamoeba invadens
NRPFD

SEQ ID NO: 2835439 - protein, 13 aa, Entamoeba invadens
NRPIQNKNIKDNQ

SEQ ID NO: 2835440 - protein, 7 aa, Entamoeba invadens
NRPSTDF

SEQ ID NO: 2835441 - protein, 8 aa, Entamoeba invadens
NRQASVDE

SEQ ID NO: 2835442 - protein, 17 aa, Entamoeba invadens
NRRPTTFNTKDYSRPYK

SEQ ID NO: 2835443 - protein, 5 aa, Entamoeba invadens
NRSIS

SEQ ID NO: 2835444 - protein, 4 aa, Entamoeba invadens
NRTD

SEQ ID NO: 2835445 - protein, 9 aa, Entamoeba invadens
NRTNNFSEG

SEQ ID NO: 2835446 - protein, 7 aa, Entamoeba invadens
NRTPQSD

SEQ ID NO: 2835447 - protein, 9 aa, Entamoeba invadens
NRTPSTDES

SEQ ID NO: 2835448 - protein, 8 aa, Entamoeba invadens
NRTSNNVD

SEQ ID NO: 2835449 - protein, 12 aa, Entamoeba invadens
NSATCTMKKVFS

SEQ ID NO: 2835450 - protein, 5 aa, Entamoeba invadens
NSDAI

SEQ ID NO: 2835451 - protein, 4 aa, Entamoeba invadens
NSEG

SEQ ID NO: 2835452 - protein, 4 aa, Entamoeba invadens
NSEL

SEQ ID NO: 2835453 - protein, 7 aa, Entamoeba invadens
NSEMDEG

SEQ ID NO: 2835454 - protein, 6 aa, Entamoeba invadens
NSETYG

SEQ ID NO: 2835455 - protein, 7 aa, Entamoeba invadens
NSGNNTI

SEQ ID NO: 2835456 - protein, 5 aa, Entamoeba invadens
NSIDT

SEQ ID NO: 2835457 - protein, 4 aa, Entamoeba invadens
NSKC

SEQ ID NO: 2835458 - protein, 9 aa, Entamoeba invadens
NSKPYYPSK

SEQ ID NO: 2835459 - protein, 8 aa, Entamoeba invadens
NSKSQAKL

SEQ ID NO: 2835460 - protein, 6 aa, Entamoeba invadens
NSLTSI

SEQ ID NO: 2835461 - protein, 4 aa, Entamoeba invadens
NSNI

SEQ ID NO: 2835462 - protein, 6 aa, Entamoeba invadens
NSNRGT

SEQ ID NO: 2835463 - protein, 7 aa, Entamoeba invadens
NSNSFNY

SEQ ID NO: 2835464 - protein, 6 aa, Entamoeba invadens
NSNTQS

SEQ ID NO: 2835465 - protein, 4 aa, Entamoeba invadens
NSPD

SEQ ID NO: 2835466 - protein, 6 aa, Entamoeba invadens
NSPTFR

SEQ ID NO: 2835467 - protein, 7 aa, Entamoeba invadens
NSQTLQD

SEQ ID NO: 2835468 - protein, 15 aa, Entamoeba invadens
NSSKEQNTDEQFNED

SEQ ID NO: 2835469 - protein, 8 aa, Entamoeba invadens
NSSKSNVK

SEQ ID NO: 2835470 - protein, 4 aa, Entamoeba invadens
NSSS

SEQ ID NO: 2835471 - protein, 6 aa, Entamoeba invadens
NSSTDY

SEQ ID NO: 2835472 - protein, 5 aa, Entamoeba invadens
NSTEI

SEQ ID NO: 2835473 - protein, 7 aa, Entamoeba invadens
NSTIPRP

SEQ ID NO: 2835474 - protein, 6 aa, Entamoeba invadens
NSTKHN

SEQ ID NO: 2835475 - protein, 5 aa, Entamoeba invadens
NSTYC

SEQ ID NO: 2835476 - protein, 4 aa, Entamoeba invadens
NSVQ

SEQ ID NO: 2835477 - protein, 5 aa, Entamoeba invadens
NSVTS

SEQ ID NO: 2835478 - protein, 4 aa, Entamoeba invadens
NSYI

SEQ ID NO: 2835479 - protein, 4 aa, Entamoeba invadens
NSYV

SEQ ID NO: 2835480 - protein, 5 aa, Entamoeba invadens
NTAAA

SEQ ID NO: 2835481 - protein, 15 aa, Entamoeba invadens
NTAQHEEGSKEEVPI

SEQ ID NO: 2835482 - protein, 17 aa, Entamoeba invadens
NTEARAKHTGGKILGFF

SEQ ID NO: 2835483 - protein, 9 aa, Entamoeba invadens
NTESESNTV

SEQ ID NO: 2835484 - protein, 10 aa, Entamoeba invadens
NTETGKKCPL

SEQ ID NO: 2835485 - protein, 6 aa, Entamoeba invadens
NTEWGT

SEQ ID NO: 2835486 - protein, 9 aa, Entamoeba invadens
NTFASSPSH

SEQ ID NO: 2835487 - protein, 4 aa, Entamoeba invadens
NTGG

SEQ ID NO: 2835488 - protein, 7 aa, Entamoeba invadens
NTGSDQT

SEQ ID NO: 2835489 - protein, 18 aa, Entamoeba invadens
NTKERATIQQIVDALQNM

SEQ ID NO: 2835490 - protein, 5 aa, Entamoeba invadens
NTKFS

SEQ ID NO: 2835491 - protein, 4 aa, Entamoeba invadens
NTLE

SEQ ID NO: 2835492 - protein, 6 aa, Entamoeba invadens
NTLPGL

SEQ ID NO: 2835493 - protein, 7 aa, Entamoeba invadens
NTNPTPI

SEQ ID NO: 2835494 - protein, 8 aa, Entamoeba invadens
NTNPTPID

SEQ ID NO: 2835495 - protein, 6 aa, Entamoeba invadens
NTNSIS

SEQ ID NO: 2835496 - protein, 7 aa, Entamoeba invadens
NTNSSQQ

SEQ ID NO: 2835497 - protein, 10 aa, Entamoeba invadens
NTNSSQTTTF

SEQ ID NO: 2835498 - protein, 6 aa, Entamoeba invadens
NTPIDS

SEQ ID NO: 2835499 - protein, 4 aa, Entamoeba invadens
NTPT

SEQ ID NO: 2835500 - protein, 5 aa, Entamoeba invadens
NTQKP

SEQ ID NO: 2835501 - protein, 5 aa, Entamoeba invadens
NTQKR

SEQ ID NO: 2835502 - protein, 8 aa, Entamoeba invadens
NTRSDAER

SEQ ID NO: 2835503 - protein, 9 aa, Entamoeba invadens
NTSHPDFDT

SEQ ID NO: 2835504 - protein, 6 aa, Entamoeba invadens
NTTFAM

SEQ ID NO: 2835505 - protein, 5 aa, Entamoeba invadens
NTTNY

SEQ ID NO: 2835506 - protein, 5 aa, Entamoeba invadens
NTVTN

SEQ ID NO: 2835507 - protein, 4 aa, Entamoeba invadens
NTYS

SEQ ID NO: 2835508 - protein, 6 aa, Entamoeba invadens
NTYSED

SEQ ID NO: 2835509 - protein, 5 aa, Entamoeba invadens
NVEEE

SEQ ID NO: 2835510 - protein, 5 aa, Entamoeba invadens
NVGGG

SEQ ID NO: 2835511 - protein, 5 aa, Entamoeba invadens
NVGKS

SEQ ID NO: 2835512 - protein, 5 aa, Entamoeba invadens
NVGNT

SEQ ID NO: 2835513 - protein, 7 aa, Entamoeba invadens
NVGTPTY

SEQ ID NO: 2835514 - protein, 8 aa, Entamoeba invadens
NVNTKTQI

SEQ ID NO: 2835515 - protein, 4 aa, Entamoeba invadens
NVPE

SEQ ID NO: 2835516 - protein, 10 aa, Entamoeba invadens
NVPEGRKTVS

SEQ ID NO: 2835517 - protein, 8 aa, Entamoeba invadens
NVQEEDLP

SEQ ID NO: 2835518 - protein, 7 aa, Entamoeba invadens
NVSPKIR

SEQ ID NO: 2835519 - protein, 14 aa, Entamoeba invadens
NVTEVGREAFKGTK

SEQ ID NO: 2835520 - protein, 4 aa, Entamoeba invadens
NVTT

SEQ ID NO: 2835521 - protein, 5 aa, Entamoeba invadens
NVTYG

SEQ ID NO: 2835522 - protein, 6 aa, Entamoeba invadens
NYQSEQ

SEQ ID NO: 2835523 - protein, 4 aa, Entamoeba invadens
NYRG

SEQ ID NO: 2835524 - protein, 7 aa, Entamoeba invadens
NYRKESS

SEQ ID NO: 2835525 - protein, 4 aa, Entamoeba invadens
NYTE

SEQ ID NO: 2835526 - protein, 7 aa, Entamoeba invadens
NYTEGTN

SEQ ID NO: 2835527 - protein, 13 aa, Entamoeba invadens
PAGDTGLDPTQTS

SEQ ID NO: 2835528 - protein, 6 aa, Entamoeba invadens
PAKTEK

SEQ ID NO: 2835529 - protein, 7 aa, Entamoeba invadens
PAPYDKM

SEQ ID NO: 2835530 - protein, 9 aa, Entamoeba invadens
PAVDPNANF

SEQ ID NO: 2835531 - protein, 7 aa, Entamoeba invadens
PAYTRSG

SEQ ID NO: 2835532 - protein, 8 aa, Entamoeba invadens
PDAPMEKE

SEQ ID NO: 2835533 - protein, 4 aa, Entamoeba invadens
PDDG

SEQ ID NO: 2835534 - protein, 10 aa, Entamoeba invadens
PDEPEDVPIP

SEQ ID NO: 2835535 - protein, 10 aa, Entamoeba invadens
PDFEPESERQ

SEQ ID NO: 2835536 - protein, 4 aa, Entamoeba invadens
PDFS

SEQ ID NO: 2835537 - protein, 9 aa, Entamoeba invadens
PDGTTTEQV

SEQ ID NO: 2835538 - protein, 5 aa, Entamoeba invadens
PDGVQ

SEQ ID NO: 2835539 - protein, 4 aa, Entamoeba invadens
PDKY

SEQ ID NO: 2835540 - protein, 10 aa, Entamoeba invadens
PDLENKNRTY

SEQ ID NO: 2835541 - protein, 4 aa, Entamoeba invadens
PDNY

SEQ ID NO: 2835542 - protein, 4 aa, Entamoeba invadens
PDQF

SEQ ID NO: 2835543 - protein, 6 aa, Entamoeba invadens
PDSVTS

SEQ ID NO: 2835544 - protein, 6 aa, Entamoeba invadens
PDTVTS

SEQ ID NO: 2835545 - protein, 10 aa, Entamoeba invadens
PEAKTIKESE

SEQ ID NO: 2835546 - protein, 4 aa, Entamoeba invadens
PEEV

SEQ ID NO: 2835547 - protein, 4 aa, Entamoeba invadens
PEFE

SEQ ID NO: 2835548 - protein, 4 aa, Entamoeba invadens
PEFT

SEQ ID NO: 2835549 - protein, 10 aa, Entamoeba invadens
PEGTKTLTKN

SEQ ID NO: 2835550 - protein, 4 aa, Entamoeba invadens
PEIV

SEQ ID NO: 2835551 - protein, 4 aa, Entamoeba invadens
PELP

SEQ ID NO: 2835552 - protein, 4 aa, Entamoeba invadens
PENV

SEQ ID NO: 2835553 - protein, 4 aa, Entamoeba invadens
PEPL

SEQ ID NO: 2835554 - protein, 4 aa, Entamoeba invadens
PEPT

SEQ ID NO: 2835555 - protein, 4 aa, Entamoeba invadens
PEQH

SEQ ID NO: 2835556 - protein, 4 aa, Entamoeba invadens
PESF

SEQ ID NO: 2835557 - protein, 4 aa, Entamoeba invadens
PETS

SEQ ID NO: 2835558 - protein, 4 aa, Entamoeba invadens
PETT

SEQ ID NO: 2835559 - protein, 5 aa, Entamoeba invadens
PFPPN

SEQ ID NO: 2835560 - protein, 4 aa, Entamoeba invadens
PGGH

SEQ ID NO: 2835561 - protein, 8 aa, Entamoeba invadens
PGHSPGSS

SEQ ID NO: 2835562 - protein, 5 aa, Entamoeba invadens
PGNSE

SEQ ID NO: 2835563 - protein, 8 aa, Entamoeba invadens
PGPEEENE

SEQ ID NO: 2835564 - protein, 4 aa, Entamoeba invadens
PGRT

SEQ ID NO: 2835565 - protein, 7 aa, Entamoeba invadens
PGSSEYN

SEQ ID NO: 2835566 - protein, 4 aa, Entamoeba invadens
PGTP

SEQ ID NO: 2835567 - protein, 4 aa, Entamoeba invadens
PHSP

SEQ ID NO: 2835568 - protein, 4 aa, Entamoeba invadens
PIKS

SEQ ID NO: 2835569 - protein, 4 aa, Entamoeba invadens
PIKT

SEQ ID NO: 2835570 - protein, 4 aa, Entamoeba invadens
PIPL

SEQ ID NO: 2835571 - protein, 5 aa, Entamoeba invadens
PIPLT

SEQ ID NO: 2835572 - protein, 7 aa, Entamoeba invadens
PISIDGR

SEQ ID NO: 2835573 - protein, 7 aa, Entamoeba invadens
PKDGSLN

SEQ ID NO: 2835574 - protein, 5 aa, Entamoeba invadens
PKDYN

SEQ ID NO: 2835575 - protein, 9 aa, Entamoeba invadens
PKEKQKEEY

SEQ ID NO: 2835576 - protein, 4 aa, Entamoeba invadens
PKFR

SEQ ID NO: 2835577 - protein, 7 aa, Entamoeba invadens
PKHGDEY

SEQ ID NO: 2835578 - protein, 5 aa, Entamoeba invadens
PKIAP

SEQ ID NO: 2835579 - protein, 5 aa, Entamoeba invadens
PKIKT

SEQ ID NO: 2835580 - protein, 4 aa, Entamoeba invadens
PKIT

SEQ ID NO: 2835581 - protein, 12 aa, Entamoeba invadens
PKKNGISTIETK

SEQ ID NO: 2835582 - protein, 6 aa, Entamoeba invadens
PKLGTN

SEQ ID NO: 2835583 - protein, 4 aa, Entamoeba invadens
PKNE

SEQ ID NO: 2835584 - protein, 7 aa, Entamoeba invadens
PKNVTKL

SEQ ID NO: 2835585 - protein, 4 aa, Entamoeba invadens
PKPS

SEQ ID NO: 2835586 - protein, 4 aa, Entamoeba invadens
PKPV

SEQ ID NO: 2835587 - protein, 7 aa, Entamoeba invadens
PKQATVR

SEQ ID NO: 2835588 - protein, 10 aa, Entamoeba invadens
PKQTGDSVIE

SEQ ID NO: 2835589 - protein, 9 aa, Entamoeba invadens
PKSLDSKVK

SEQ ID NO: 2835590 - protein, 7 aa, Entamoeba invadens
PKSLTDM

SEQ ID NO: 2835591 - protein, 8 aa, Entamoeba invadens
PKSPSDHL

SEQ ID NO: 2835592 - protein, 4 aa, Entamoeba invadens
PKSV

SEQ ID NO: 2835593 - protein, 8 aa, Entamoeba invadens
PKSVTKIE

SEQ ID NO: 2835594 - protein, 7 aa, Entamoeba invadens
PKSVTSQ

SEQ ID NO: 2835595 - protein, 8 aa, Entamoeba invadens
PKTEITEN

SEQ ID NO: 2835596 - protein, 4 aa, Entamoeba invadens
PKTK

SEQ ID NO: 2835597 - protein, 4 aa, Entamoeba invadens
PKTQ

SEQ ID NO: 2835598 - protein, 42 aa, Entamoeba invadens
PKVEPPKVKQTVTPKIEPQKTTPQSVPKDEAPKVSEEFDTKR

SEQ ID NO: 2835599 - protein, 12 aa, Entamoeba invadens
PLADDKTAIKKG

SEQ ID NO: 2835600 - protein, 9 aa, Entamoeba invadens
PLDKKKERD

SEQ ID NO: 2835601 - protein, 11 aa, Entamoeba invadens
PLGGASHAKGL

SEQ ID NO: 2835602 - protein, 13 aa, Entamoeba invadens
PLQTTNQPTPKKI

SEQ ID NO: 2835603 - protein, 8 aa, Entamoeba invadens
PLSSNGRL

SEQ ID NO: 2835604 - protein, 5 aa, Entamoeba invadens
PLTSR

SEQ ID NO: 2835605 - protein, 8 aa, Entamoeba invadens
PNDKTQVG

SEQ ID NO: 2835606 - protein, 4 aa, Entamoeba invadens
PNDN

SEQ ID NO: 2835607 - protein, 4 aa, Entamoeba invadens
PNKA

SEQ ID NO: 2835608 - protein, 4 aa, Entamoeba invadens
PNNN

SEQ ID NO: 2835609 - protein, 9 aa, Entamoeba invadens
PNPHERYSN

SEQ ID NO: 2835610 - protein, 6 aa, Entamoeba invadens
PNPTKQ

SEQ ID NO: 2835611 - protein, 5 aa, Entamoeba invadens
PNPWE

SEQ ID NO: 2835612 - protein, 12 aa, Entamoeba invadens
PNSKGNKIVSGG

SEQ ID NO: 2835613 - protein, 4 aa, Entamoeba invadens
PNSR

SEQ ID NO: 2835614 - protein, 4 aa, Entamoeba invadens
PNTF

SEQ ID NO: 2835615 - protein, 4 aa, Entamoeba invadens
PNTL

SEQ ID NO: 2835616 - protein, 13 aa, Entamoeba invadens
PNYEYTDTSHQTE

SEQ ID NO: 2835617 - protein, 4 aa, Entamoeba invadens
PNYP

SEQ ID NO: 2835618 - protein, 7 aa, Entamoeba invadens
PPFTPLE

SEQ ID NO: 2835619 - protein, 6 aa, Entamoeba invadens
PPKAIG

SEQ ID NO: 2835620 - protein, 5 aa, Entamoeba invadens
PPKKA

SEQ ID NO: 2835621 - protein, 7 aa, Entamoeba invadens
PPPPPFG

SEQ ID NO: 2835622 - protein, 28 aa, Entamoeba invadens
PPPPPNMPPPPSGGDAPSAPPSSAGRGD

SEQ ID NO: 2835623 - protein, 6 aa, Entamoeba invadens
PPTDNT

SEQ ID NO: 2835624 - protein, 7 aa, Entamoeba invadens
PQAITGV

SEQ ID NO: 2835625 - protein, 4 aa, Entamoeba invadens
PQFR

SEQ ID NO: 2835626 - protein, 16 aa, Entamoeba invadens
PQIDDPELDHLNFYKF

SEQ ID NO: 2835627 - protein, 4 aa, Entamoeba invadens
PQML

SEQ ID NO: 2835628 - protein, 4 aa, Entamoeba invadens
PQNY

SEQ ID NO: 2835629 - protein, 16 aa, Entamoeba invadens
PQQNNNPQNGQTKTSV

SEQ ID NO: 2835630 - protein, 4 aa, Entamoeba invadens
PQRF

SEQ ID NO: 2835631 - protein, 6 aa, Entamoeba invadens
PQRVTG

SEQ ID NO: 2835632 - protein, 5 aa, Entamoeba invadens
PQSVT

SEQ ID NO: 2835633 - protein, 4 aa, Entamoeba invadens
PQTG

SEQ ID NO: 2835634 - protein, 5 aa, Entamoeba invadens
PRAGC

SEQ ID NO: 2835635 - protein, 5 aa, Entamoeba invadens
PREAL

SEQ ID NO: 2835636 - protein, 6 aa, Entamoeba invadens
PRSGST

SEQ ID NO: 2835637 - protein, 4 aa, Entamoeba invadens
PRTS

SEQ ID NO: 2835638 - protein, 5 aa, Entamoeba invadens
PRVNS

SEQ ID NO: 2835639 - protein, 12 aa, Entamoeba invadens
PSDDGTHCSKTA

SEQ ID NO: 2835640 - protein, 7 aa, Entamoeba invadens
PSEELDN

SEQ ID NO: 2835641 - protein, 8 aa, Entamoeba invadens
PSEEVKKE

SEQ ID NO: 2835642 - protein, 9 aa, Entamoeba invadens
PSFKTGKEV

SEQ ID NO: 2835643 - protein, 5 aa, Entamoeba invadens
PSGST

SEQ ID NO: 2835644 - protein, 6 aa, Entamoeba invadens
PSGVSK

SEQ ID NO: 2835645 - protein, 5 aa, Entamoeba invadens
PSIPV

SEQ ID NO: 2835646 - protein, 20 aa, Entamoeba invadens
PSKNQSERRTRTAKDPNKLS

SEQ ID NO: 2835647 - protein, 7 aa, Entamoeba invadens
PSKTKTL

SEQ ID NO: 2835648 - protein, 4 aa, Entamoeba invadens
PSLK

SEQ ID NO: 2835649 - protein, 4 aa, Entamoeba invadens
PSNH

SEQ ID NO: 2835650 - protein, 5 aa, Entamoeba invadens
PSPKQ

SEQ ID NO: 2835651 - protein, 4 aa, Entamoeba invadens
PSPL

SEQ ID NO: 2835652 - protein, 5 aa, Entamoeba invadens
PSSGL

SEQ ID NO: 2835653 - protein, 10 aa, Entamoeba invadens
PSSNGQPKYY

SEQ ID NO: 2835654 - protein, 4 aa, Entamoeba invadens
PSSV

SEQ ID NO: 2835655 - protein, 5 aa, Entamoeba invadens
PSSVT

SEQ ID NO: 2835656 - protein, 13 aa, Entamoeba invadens
PSTPATGKENENY

SEQ ID NO: 2835657 - protein, 4 aa, Entamoeba invadens
PSVT

SEQ ID NO: 2835658 - protein, 11 aa, Entamoeba invadens
PSYSESKKIPQ

SEQ ID NO: 2835659 - protein, 11 aa, Entamoeba invadens
PTDPPLQDGEL

SEQ ID NO: 2835660 - protein, 4 aa, Entamoeba invadens
PTEK

SEQ ID NO: 2835661 - protein, 9 aa, Entamoeba invadens
PTESDSAEY

SEQ ID NO: 2835662 - protein, 4 aa, Entamoeba invadens
PTGI

SEQ ID NO: 2835663 - protein, 10 aa, Entamoeba invadens
PTGKARLGKT

SEQ ID NO: 2835664 - protein, 13 aa, Entamoeba invadens
PTIDNSKWSTEED

SEQ ID NO: 2835665 - protein, 21 aa, Entamoeba invadens
PTLKRRRVDEELAAKDKEIEA

SEQ ID NO: 2835666 - protein, 13 aa, Entamoeba invadens
PTLPPNVTTESVT

SEQ ID NO: 2835667 - protein, 4 aa, Entamoeba invadens
PTPE

SEQ ID NO: 2835668 - protein, 4 aa, Entamoeba invadens
PTPH

SEQ ID NO: 2835669 - protein, 4 aa, Entamoeba invadens
PTSL

SEQ ID NO: 2835670 - protein, 4 aa, Entamoeba invadens
PTSV

SEQ ID NO: 2835671 - protein, 4 aa, Entamoeba invadens
PTTD

SEQ ID NO: 2835672 - protein, 8 aa, Entamoeba invadens
PTTDKPHP

SEQ ID NO: 2835673 - protein, 4 aa, Entamoeba invadens
PTTN

SEQ ID NO: 2835674 - protein, 6 aa, Entamoeba invadens
PTTSPL

SEQ ID NO: 2835675 - protein, 4 aa, Entamoeba invadens
PTTT

SEQ ID NO: 2835676 - protein, 4 aa, Entamoeba invadens
PVPD

SEQ ID NO: 2835677 - protein, 4 aa, Entamoeba invadens
PVPK

SEQ ID NO: 2835678 - protein, 4 aa, Entamoeba invadens
PVVP

SEQ ID NO: 2835679 - protein, 13 aa, Entamoeba invadens
PWGGPGAFRNKQS

SEQ ID NO: 2835680 - protein, 5 aa, Entamoeba invadens
PYKDL

SEQ ID NO: 2835681 - protein, 6 aa, Entamoeba invadens
QAGRKL

SEQ ID NO: 2835682 - protein, 8 aa, Entamoeba invadens
QAHPQNNS

SEQ ID NO: 2835683 - protein, 11 aa, Entamoeba invadens
QAKYPKDQLKY

SEQ ID NO: 2835684 - protein, 10 aa, Entamoeba invadens
QANLGTTINE

SEQ ID NO: 2835685 - protein, 8 aa, Entamoeba invadens
QAQGPFQR

SEQ ID NO: 2835686 - protein, 5 aa, Entamoeba invadens
QARNY

SEQ ID NO: 2835687 - protein, 7 aa, Entamoeba invadens
QATCDSE

SEQ ID NO: 2835688 - protein, 8 aa, Entamoeba invadens
QATERQKK

SEQ ID NO: 2835689 - protein, 4 aa, Entamoeba invadens
QATK

SEQ ID NO: 2835690 - protein, 15 aa, Entamoeba invadens
QAVKGKIDKNKRTLT

SEQ ID NO: 2835691 - protein, 6 aa, Entamoeba invadens
QDGESY

SEQ ID NO: 2835692 - protein, 10 aa, Entamoeba invadens
QDGREKLSKI

SEQ ID NO: 2835693 - protein, 4 aa, Entamoeba invadens
QDGV

SEQ ID NO: 2835694 - protein, 9 aa, Entamoeba invadens
QDKYKKSAD

SEQ ID NO: 2835695 - protein, 12 aa, Entamoeba invadens
QDLTEAAKLGGF

SEQ ID NO: 2835696 - protein, 18 aa, Entamoeba invadens
QDNKEKNAKLKRDSTDSK

SEQ ID NO: 2835697 - protein, 8 aa, Entamoeba invadens
QDNKNSFG

SEQ ID NO: 2835698 - protein, 9 aa, Entamoeba invadens
QDRPAPDTI

SEQ ID NO: 2835699 - protein, 9 aa, Entamoeba invadens
QDSSNQQES

SEQ ID NO: 2835700 - protein, 9 aa, Entamoeba invadens
QEDAGNNKT

SEQ ID NO: 2835701 - protein, 22 aa, Entamoeba invadens
QEEERERRDNFIPEKSEVQTDN

SEQ ID NO: 2835702 - protein, 4 aa, Entamoeba invadens
QEET

SEQ ID NO: 2835703 - protein, 7 aa, Entamoeba invadens
QEKLQGR

SEQ ID NO: 2835704 - protein, 5 aa, Entamoeba invadens
QEKYR

SEQ ID NO: 2835705 - protein, 4 aa, Entamoeba invadens
QENK

SEQ ID NO: 2835706 - protein, 7 aa, Entamoeba invadens
QEPPEDG

SEQ ID NO: 2835707 - protein, 5 aa, Entamoeba invadens
QEPYD

SEQ ID NO: 2835708 - protein, 8 aa, Entamoeba invadens
QEQYTKKG

SEQ ID NO: 2835709 - protein, 4 aa, Entamoeba invadens
QESF

SEQ ID NO: 2835710 - protein, 8 aa, Entamoeba invadens
QESRIDAQ

SEQ ID NO: 2835711 - protein, 21 aa, Entamoeba invadens
QGETEPNQEEPEQPEQQEHPV

SEQ ID NO: 2835712 - protein, 4 aa, Entamoeba invadens
QGGY

SEQ ID NO: 2835713 - protein, 7 aa, Entamoeba invadens
QGSGRSN

SEQ ID NO: 2835714 - protein, 8 aa, Entamoeba invadens
QGSTKDAF

SEQ ID NO: 2835715 - protein, 6 aa, Entamoeba invadens
QGSYIQ

SEQ ID NO: 2835716 - protein, 5 aa, Entamoeba invadens
QGTTV

SEQ ID NO: 2835717 - protein, 16 aa, Entamoeba invadens
QGYEDNKIMNKNDAQD

SEQ ID NO: 2835718 - protein, 9 aa, Entamoeba invadens
QHKKSTNYK

SEQ ID NO: 2835719 - protein, 19 aa, Entamoeba invadens
QHSPEVTNEEISKTLEEEV

SEQ ID NO: 2835720 - protein, 9 aa, Entamoeba invadens
QINDSEDNA

SEQ ID NO: 2835721 - protein, 14 aa, Entamoeba invadens
QINNSDEKKSIDEF

SEQ ID NO: 2835722 - protein, 17 aa, Entamoeba invadens
QISKPQNDSTDNDKEIQ

SEQ ID NO: 2835723 - protein, 4 aa, Entamoeba invadens
QKCT

SEQ ID NO: 2835724 - protein, 9 aa, Entamoeba invadens
QKDQPNYNP

SEQ ID NO: 2835725 - protein, 4 aa, Entamoeba invadens
QKGD

SEQ ID NO: 2835726 - protein, 15 aa, Entamoeba invadens
QKGKKTKHMKNKCNI

SEQ ID NO: 2835727 - protein, 12 aa, Entamoeba invadens
QKGTLSKPTDLA

SEQ ID NO: 2835728 - protein, 9 aa, Entamoeba invadens
QKIKKADAS

SEQ ID NO: 2835729 - protein, 9 aa, Entamoeba invadens
QKKFVEKSK

SEQ ID NO: 2835730 - protein, 10 aa, Entamoeba invadens
QKKQKKSDYL

SEQ ID NO: 2835731 - protein, 8 aa, Entamoeba invadens
QKKRDRVP

SEQ ID NO: 2835732 - protein, 9 aa, Entamoeba invadens
QKKTPKQIR

SEQ ID NO: 2835733 - protein, 12 aa, Entamoeba invadens
QKLESNKKKLDK

SEQ ID NO: 2835734 - protein, 5 aa, Entamoeba invadens
QKLPS

SEQ ID NO: 2835735 - protein, 4 aa, Entamoeba invadens
QKPF

SEQ ID NO: 2835736 - protein, 4 aa, Entamoeba invadens
QKQN

SEQ ID NO: 2835737 - protein, 10 aa, Entamoeba invadens
QKSGGCESCP

SEQ ID NO: 2835738 - protein, 4 aa, Entamoeba invadens
QKSL

SEQ ID NO: 2835739 - protein, 17 aa, Entamoeba invadens
QKYFKKKRGASENYEED

SEQ ID NO: 2835740 - protein, 18 aa, Entamoeba invadens
QLEKHRQRRLSPHNPTTQ

SEQ ID NO: 2835741 - protein, 8 aa, Entamoeba invadens
QLKEKIAS

SEQ ID NO: 2835742 - protein, 15 aa, Entamoeba invadens
QLTDEKKKNDNDLEE

SEQ ID NO: 2835743 - protein, 13 aa, Entamoeba invadens
QMNKEDVDRLKTE

SEQ ID NO: 2835744 - protein, 14 aa, Entamoeba invadens
QMQAQGGGDTPESV

SEQ ID NO: 2835745 - protein, 4 aa, Entamoeba invadens
QNCS

SEQ ID NO: 2835746 - protein, 18 aa, Entamoeba invadens
QNDEEEEKEEPTAQAEDK

SEQ ID NO: 2835747 - protein, 6 aa, Entamoeba invadens
QNGPVR

SEQ ID NO: 2835748 - protein, 22 aa, Entamoeba invadens
QNKNARHPEAVSTEAGKQHSAI

SEQ ID NO: 2835749 - protein, 5 aa, Entamoeba invadens
QNNKN

SEQ ID NO: 2835750 - protein, 4 aa, Entamoeba invadens
QNNM

SEQ ID NO: 2835751 - protein, 6 aa, Entamoeba invadens
QNNPNM

SEQ ID NO: 2835752 - protein, 10 aa, Entamoeba invadens
QNNSTEPSAT

SEQ ID NO: 2835753 - protein, 9 aa, Entamoeba invadens
QNPKTRTTT

SEQ ID NO: 2835754 - protein, 6 aa, Entamoeba invadens
QNRDES

SEQ ID NO: 2835755 - protein, 6 aa, Entamoeba invadens
QNVASK

SEQ ID NO: 2835756 - protein, 26 aa, Entamoeba invadens
QPEQPDDENLSDDTSKYTPYNLQGKS

SEQ ID NO: 2835757 - protein, 5 aa, Entamoeba invadens
QPERR

SEQ ID NO: 2835758 - protein, 4 aa, Entamoeba invadens
QPLS

SEQ ID NO: 2835759 - protein, 4 aa, Entamoeba invadens
QPPL

SEQ ID NO: 2835760 - protein, 4 aa, Entamoeba invadens
QQAF

SEQ ID NO: 2835761 - protein, 4 aa, Entamoeba invadens
QQAS

SEQ ID NO: 2835762 - protein, 12 aa, Entamoeba invadens
QQHRNPSQQEME

SEQ ID NO: 2835763 - protein, 57 aa, Entamoeba invadens
QQLEETTKQKEEVEKKIKQQEEQLNNTKQEKDELENKFKDKDDIIETTKKQKEEVEQ

SEQ ID NO: 2835764 - protein, 7 aa, Entamoeba invadens
QQLESSK

SEQ ID NO: 2835765 - protein, 4 aa, Entamoeba invadens
QQRR

SEQ ID NO: 2835766 - protein, 4 aa, Entamoeba invadens
QQSI

SEQ ID NO: 2835767 - protein, 8 aa, Entamoeba invadens
QQSPDIAN

SEQ ID NO: 2835768 - protein, 4 aa, Entamoeba invadens
QQSY

SEQ ID NO: 2835769 - protein, 6 aa, Entamoeba invadens
QQVSKQ

SEQ ID NO: 2835770 - protein, 30 aa, Entamoeba invadens
QQVSKQEMQSEYNTYADDMEDKLEENNDEA

SEQ ID NO: 2835771 - protein, 22 aa, Entamoeba invadens
QRDLEANNTELRDRTTKSYEKD

SEQ ID NO: 2835772 - protein, 10 aa, Entamoeba invadens
QRITNTRTTQ

SEQ ID NO: 2835773 - protein, 10 aa, Entamoeba invadens
QRNKEGKWSE

SEQ ID NO: 2835774 - protein, 5 aa, Entamoeba invadens
QRPPR

SEQ ID NO: 2835775 - protein, 9 aa, Entamoeba invadens
QRYNKNKQC

SEQ ID NO: 2835776 - protein, 4 aa, Entamoeba invadens
QSEI

SEQ ID NO: 2835777 - protein, 4 aa, Entamoeba invadens
QSGL

SEQ ID NO: 2835778 - protein, 5 aa, Entamoeba invadens
QSIKN

SEQ ID NO: 2835779 - protein, 4 aa, Entamoeba invadens
QSIT

SEQ ID NO: 2835780 - protein, 9 aa, Entamoeba invadens
QSKGLPAEK

SEQ ID NO: 2835781 - protein, 5 aa, Entamoeba invadens
QSNEM

SEQ ID NO: 2835782 - protein, 4 aa, Entamoeba invadens
QSSI

SEQ ID NO: 2835783 - protein, 6 aa, Entamoeba invadens
QSSVTL

SEQ ID NO: 2835784 - protein, 4 aa, Entamoeba invadens
QSVE

SEQ ID NO: 2835785 - protein, 6 aa, Entamoeba invadens
QSVPQS

SEQ ID NO: 2835786 - protein, 5 aa, Entamoeba invadens
QSVTS

SEQ ID NO: 2835787 - protein, 4 aa, Entamoeba invadens
QTFN

SEQ ID NO: 2835788 - protein, 4 aa, Entamoeba invadens
QTIQ

SEQ ID NO: 2835789 - protein, 8 aa, Entamoeba invadens
QTNPKNEE

SEQ ID NO: 2835790 - protein, 4 aa, Entamoeba invadens
QTRE

SEQ ID NO: 2835791 - protein, 4 aa, Entamoeba invadens
QTTR

SEQ ID NO: 2835792 - protein, 10 aa, Entamoeba invadens
QVADKSASVG

SEQ ID NO: 2835793 - protein, 15 aa, Entamoeba invadens
QVNDSNNTQLQTTQK

SEQ ID NO: 2835794 - protein, 7 aa, Entamoeba invadens
QVNGKRE

SEQ ID NO: 2835795 - protein, 8 aa, Entamoeba invadens
QYDETYDD

SEQ ID NO: 2835796 - protein, 9 aa, Entamoeba invadens
QYGKASGLN

SEQ ID NO: 2835797 - protein, 6 aa, Entamoeba invadens
QYRGQF

SEQ ID NO: 2835798 - protein, 6 aa, Entamoeba invadens
QYSEVQ

SEQ ID NO: 2835799 - protein, 4 aa, Entamoeba invadens
RAEL

SEQ ID NO: 2835800 - protein, 5 aa, Entamoeba invadens
RAGHF

SEQ ID NO: 2835801 - protein, 6 aa, Entamoeba invadens
RAIADT

SEQ ID NO: 2835802 - protein, 6 aa, Entamoeba invadens
RAKPEQ

SEQ ID NO: 2835803 - protein, 4 aa, Entamoeba invadens
RAND

SEQ ID NO: 2835804 - protein, 9 aa, Entamoeba invadens
RANKATIKR

SEQ ID NO: 2835805 - protein, 12 aa, Entamoeba invadens
RANNSFNTITRS

SEQ ID NO: 2835806 - protein, 15 aa, Entamoeba invadens
RANYEKEKGGSEELK

SEQ ID NO: 2835807 - protein, 17 aa, Entamoeba invadens
RAQERMSSYNKKNSSGK

SEQ ID NO: 2835808 - protein, 18 aa, Entamoeba invadens
RAQERMSSYNKKNSSGKW

SEQ ID NO: 2835809 - protein, 8 aa, Entamoeba invadens
RASGPHCS

SEQ ID NO: 2835810 - protein, 5 aa, Entamoeba invadens
RATNE

SEQ ID NO: 2835811 - protein, 4 aa, Entamoeba invadens
RATQ

SEQ ID NO: 2835812 - protein, 6 aa, Entamoeba invadens
RCEQGP

SEQ ID NO: 2835813 - protein, 4 aa, Entamoeba invadens
RDAA

SEQ ID NO: 2835814 - protein, 6 aa, Entamoeba invadens
RDENFG

SEQ ID NO: 2835815 - protein, 19 aa, Entamoeba invadens
RDERRTAKGKNKPKRKSSL

SEQ ID NO: 2835816 - protein, 8 aa, Entamoeba invadens
RDESDAPI

SEQ ID NO: 2835817 - protein, 10 aa, Entamoeba invadens
RDFGKNPDFQ

SEQ ID NO: 2835818 - protein, 5 aa, Entamoeba invadens
RDNEG

SEQ ID NO: 2835819 - protein, 15 aa, Entamoeba invadens
RDPIGDETKLPKTAK

SEQ ID NO: 2835820 - protein, 7 aa, Entamoeba invadens
RDRSGTL

SEQ ID NO: 2835821 - protein, 4 aa, Entamoeba invadens
RDTF

SEQ ID NO: 2835822 - protein, 7 aa, Entamoeba invadens
RDYKDST

SEQ ID NO: 2835823 - protein, 7 aa, Entamoeba invadens
RDYKEGQ

SEQ ID NO: 2835824 - protein, 9 aa, Entamoeba invadens
REAAGFSPY

SEQ ID NO: 2835825 - protein, 6 aa, Entamoeba invadens
REEGII

SEQ ID NO: 2835826 - protein, 5 aa, Entamoeba invadens
REELN

SEQ ID NO: 2835827 - protein, 13 aa, Entamoeba invadens
REENDDKVPPSSL

SEQ ID NO: 2835828 - protein, 6 aa, Entamoeba invadens
REISTN

SEQ ID NO: 2835829 - protein, 4 aa, Entamoeba invadens
REKE

SEQ ID NO: 2835830 - protein, 6 aa, Entamoeba invadens
REKEQL

SEQ ID NO: 2835831 - protein, 15 aa, Entamoeba invadens
RENTDKSNKHKNRKI

SEQ ID NO: 2835832 - protein, 4 aa, Entamoeba invadens
RESG

SEQ ID NO: 2835833 - protein, 9 aa, Entamoeba invadens
RESVSGAIP

SEQ ID NO: 2835834 - protein, 9 aa, Entamoeba invadens
RFPSDKGGN

SEQ ID NO: 2835835 - protein, 5 aa, Entamoeba invadens
RFQNN

SEQ ID NO: 2835836 - protein, 10 aa, Entamoeba invadens
RFVDESKNLE

SEQ ID NO: 2835837 - protein, 5 aa, Entamoeba invadens
RGAHQ

SEQ ID NO: 2835838 - protein, 4 aa, Entamoeba invadens
RGEL

SEQ ID NO: 2835839 - protein, 5 aa, Entamoeba invadens
RGLSD

SEQ ID NO: 2835840 - protein, 8 aa, Entamoeba invadens
RGVHEPNY

SEQ ID NO: 2835841 - protein, 4 aa, Entamoeba invadens
RHIG

SEQ ID NO: 2835842 - protein, 6 aa, Entamoeba invadens
RIAGSQ

SEQ ID NO: 2835843 - protein, 18 aa, Entamoeba invadens
RIGNSHTQTDSATSKDGS

SEQ ID NO: 2835844 - protein, 13 aa, Entamoeba invadens
RIPTQADTTSKYP

SEQ ID NO: 2835845 - protein, 17 aa, Entamoeba invadens
RIRGGGYHSFDAKRSHK

SEQ ID NO: 2835846 - protein, 15 aa, Entamoeba invadens
RISGSGSGRNGQGAF

SEQ ID NO: 2835847 - protein, 7 aa, Entamoeba invadens
RKARKAF

SEQ ID NO: 2835848 - protein, 8 aa, Entamoeba invadens
RKDGDTSI

SEQ ID NO: 2835849 - protein, 4 aa, Entamoeba invadens
RKDT

SEQ ID NO: 2835850 - protein, 4 aa, Entamoeba invadens
RKEK

SEQ ID NO: 2835851 - protein, 9 aa, Entamoeba invadens
RKIPTSKDK

SEQ ID NO: 2835852 - protein, 10 aa, Entamoeba invadens
RKKEGTKRMS

SEQ ID NO: 2835853 - protein, 4 aa, Entamoeba invadens
RKKL

SEQ ID NO: 2835854 - protein, 4 aa, Entamoeba invadens
RKKQ

SEQ ID NO: 2835855 - protein, 21 aa, Entamoeba invadens
RKLRTKKGPKQTPLDKPAANL

SEQ ID NO: 2835856 - protein, 11 aa, Entamoeba invadens
RKNREGKNKGV

SEQ ID NO: 2835857 - protein, 4 aa, Entamoeba invadens
RLEN

SEQ ID NO: 2835858 - protein, 7 aa, Entamoeba invadens
RLERKEK

SEQ ID NO: 2835859 - protein, 8 aa, Entamoeba invadens
RLKRPSYL

SEQ ID NO: 2835860 - protein, 7 aa, Entamoeba invadens
RLNKRSR

SEQ ID NO: 2835861 - protein, 4 aa, Entamoeba invadens
RLSE

SEQ ID NO: 2835862 - protein, 12 aa, Entamoeba invadens
RLSKDKETGKVQ

SEQ ID NO: 2835863 - protein, 11 aa, Entamoeba invadens
RMEDNKKSTIK

SEQ ID NO: 2835864 - protein, 16 aa, Entamoeba invadens
RNAVKARDSKRGKDVT

SEQ ID NO: 2835865 - protein, 9 aa, Entamoeba invadens
RNDKGQCEN

SEQ ID NO: 2835866 - protein, 4 aa, Entamoeba invadens
RNDL

SEQ ID NO: 2835867 - protein, 5 aa, Entamoeba invadens
RNDNS

SEQ ID NO: 2835868 - protein, 4 aa, Entamoeba invadens
RNDY

SEQ ID NO: 2835869 - protein, 6 aa, Entamoeba invadens
RNEHYD

SEQ ID NO: 2835870 - protein, 4 aa, Entamoeba invadens
RNEK

SEQ ID NO: 2835871 - protein, 10 aa, Entamoeba invadens
RNGDEEKQIQ

SEQ ID NO: 2835872 - protein, 10 aa, Entamoeba invadens
RNGFGREKEI

SEQ ID NO: 2835873 - protein, 7 aa, Entamoeba invadens
RNGKDWS

SEQ ID NO: 2835874 - protein, 4 aa, Entamoeba invadens
RNGN

SEQ ID NO: 2835875 - protein, 10 aa, Entamoeba invadens
RNISPNSTNK

SEQ ID NO: 2835876 - protein, 7 aa, Entamoeba invadens
RNKSRNI

SEQ ID NO: 2835877 - protein, 6 aa, Entamoeba invadens
RNPKTH

SEQ ID NO: 2835878 - protein, 5 aa, Entamoeba invadens
RNPLK

SEQ ID NO: 2835879 - protein, 8 aa, Entamoeba invadens
RNTSRDRF

SEQ ID NO: 2835880 - protein, 4 aa, Entamoeba invadens
RPDL

SEQ ID NO: 2835881 - protein, 4 aa, Entamoeba invadens
RPEE

SEQ ID NO: 2835882 - protein, 4 aa, Entamoeba invadens
RPEN

SEQ ID NO: 2835883 - protein, 5 aa, Entamoeba invadens
RPIPK

SEQ ID NO: 2835884 - protein, 4 aa, Entamoeba invadens
RPKK

SEQ ID NO: 2835885 - protein, 5 aa, Entamoeba invadens
RPLAL

SEQ ID NO: 2835886 - protein, 6 aa, Entamoeba invadens
RPVVST

SEQ ID NO: 2835887 - protein, 10 aa, Entamoeba invadens
RPYKDKKSAF

SEQ ID NO: 2835888 - protein, 10 aa, Entamoeba invadens
RQETSGTKGW

SEQ ID NO: 2835889 - protein, 4 aa, Entamoeba invadens
RQGT

SEQ ID NO: 2835890 - protein, 4 aa, Entamoeba invadens
RQKL

SEQ ID NO: 2835891 - protein, 11 aa, Entamoeba invadens
RQKQTGPSPRR

SEQ ID NO: 2835892 - protein, 4 aa, Entamoeba invadens
RQNN

SEQ ID NO: 2835893 - protein, 10 aa, Entamoeba invadens
RQPEFSNNTK

SEQ ID NO: 2835894 - protein, 5 aa, Entamoeba invadens
RQTRR

SEQ ID NO: 2835895 - protein, 12 aa, Entamoeba invadens
RQTTSQITDATQ

SEQ ID NO: 2835896 - protein, 4 aa, Entamoeba invadens
RQVT

SEQ ID NO: 2835897 - protein, 8 aa, Entamoeba invadens
RREETLQN

SEQ ID NO: 2835898 - protein, 40 aa, Entamoeba invadens
RREQEVAEANEELETVKKDKFAKEKEAKKLKAENDEIKEK

SEQ ID NO: 2835899 - protein, 40 aa, Entamoeba invadens
RREQEVAEANEELETVKKDKFAKEKEAKKLKAENDEIKEN

SEQ ID NO: 2835900 - protein, 5 aa, Entamoeba invadens
RRGLS

SEQ ID NO: 2835901 - protein, 12 aa, Entamoeba invadens
RRKEEDDRRERS

SEQ ID NO: 2835902 - protein, 10 aa, Entamoeba invadens
RRKRGQNRIG

SEQ ID NO: 2835903 - protein, 12 aa, Entamoeba invadens
RRRCDNTNKCCI

SEQ ID NO: 2835904 - protein, 4 aa, Entamoeba invadens
RRRP

SEQ ID NO: 2835905 - protein, 13 aa, Entamoeba invadens
RRRSGQAFGRGEY

SEQ ID NO: 2835906 - protein, 20 aa, Entamoeba invadens
RRYKGTGPMPRIGYGSDKKT

SEQ ID NO: 2835907 - protein, 5 aa, Entamoeba invadens
RSFED

SEQ ID NO: 2835908 - protein, 5 aa, Entamoeba invadens
RSGST

SEQ ID NO: 2835909 - protein, 4 aa, Entamoeba invadens
RSIG

SEQ ID NO: 2835910 - protein, 4 aa, Entamoeba invadens
RSIP

SEQ ID NO: 2835911 - protein, 4 aa, Entamoeba invadens
RSNF

SEQ ID NO: 2835912 - protein, 5 aa, Entamoeba invadens
RSPPG

SEQ ID NO: 2835913 - protein, 6 aa, Entamoeba invadens
RSQKKR

SEQ ID NO: 2835914 - protein, 7 aa, Entamoeba invadens
RSQSQFY

SEQ ID NO: 2835915 - protein, 12 aa, Entamoeba invadens
RSTGGKKNMMQK

SEQ ID NO: 2835916 - protein, 11 aa, Entamoeba invadens
RSYARSPKLKH

SEQ ID NO: 2835917 - protein, 22 aa, Entamoeba invadens
RTAPVPKKGAKGKKVAGRKVAK

SEQ ID NO: 2835918 - protein, 7 aa, Entamoeba invadens
RTEKEVS

SEQ ID NO: 2835919 - protein, 7 aa, Entamoeba invadens
RTEKEVT

SEQ ID NO: 2835920 - protein, 6 aa, Entamoeba invadens
RTFNKK

SEQ ID NO: 2835921 - protein, 4 aa, Entamoeba invadens
RTFT

SEQ ID NO: 2835922 - protein, 4 aa, Entamoeba invadens
RTGE

SEQ ID NO: 2835923 - protein, 15 aa, Entamoeba invadens
RTKAIQSAKKVELPE

SEQ ID NO: 2835924 - protein, 6 aa, Entamoeba invadens
RTKNNP

SEQ ID NO: 2835925 - protein, 5 aa, Entamoeba invadens
RTKTT

SEQ ID NO: 2835926 - protein, 4 aa, Entamoeba invadens
RTNF

SEQ ID NO: 2835927 - protein, 6 aa, Entamoeba invadens
RTPRKI

SEQ ID NO: 2835928 - protein, 7 aa, Entamoeba invadens
RTQSKFA

SEQ ID NO: 2835929 - protein, 7 aa, Entamoeba invadens
RTSEQTI

SEQ ID NO: 2835930 - protein, 13 aa, Entamoeba invadens
RTSPNIATIPKGK

SEQ ID NO: 2835931 - protein, 5 aa, Entamoeba invadens
RVDEL

SEQ ID NO: 2835932 - protein, 15 aa, Entamoeba invadens
RVNADNGNDNTTQLD

SEQ ID NO: 2835933 - protein, 20 aa, Entamoeba invadens
RVNKNGNCKIETEDKMTTVS

SEQ ID NO: 2835934 - protein, 18 aa, Entamoeba invadens
RVNTNPLRGPYHQRSPSK

SEQ ID NO: 2835935 - protein, 6 aa, Entamoeba invadens
RYDDSS

SEQ ID NO: 2835936 - protein, 6 aa, Entamoeba invadens
RYEKRH

SEQ ID NO: 2835937 - protein, 6 aa, Entamoeba invadens
RYHPAR

SEQ ID NO: 2835938 - protein, 5 aa, Entamoeba invadens
RYTNA

SEQ ID NO: 2835939 - protein, 8 aa, Entamoeba invadens
SACSPDKK

SEQ ID NO: 2835940 - protein, 7 aa, Entamoeba invadens
SAEQAEE

SEQ ID NO: 2835941 - protein, 21 aa, Entamoeba invadens
SAERKTEEVAKPVEKKEFKKH

SEQ ID NO: 2835942 - protein, 5 aa, Entamoeba invadens
SAGAY

SEQ ID NO: 2835943 - protein, 4 aa, Entamoeba invadens
SAGN

SEQ ID NO: 2835944 - protein, 7 aa, Entamoeba invadens
SAGQERF

SEQ ID NO: 2835945 - protein, 12 aa, Entamoeba invadens
SAITNNDWQNYE

SEQ ID NO: 2835946 - protein, 6 aa, Entamoeba invadens
SAKIET

SEQ ID NO: 2835947 - protein, 7 aa, Entamoeba invadens
SAKNNIN

SEQ ID NO: 2835948 - protein, 9 aa, Entamoeba invadens
SAPSGHDMS

SEQ ID NO: 2835949 - protein, 17 aa, Entamoeba invadens
SAQRRANRWADKEWKKG

SEQ ID NO: 2835950 - protein, 10 aa, Entamoeba invadens
SAQSGDGTLS

SEQ ID NO: 2835951 - protein, 7 aa, Entamoeba invadens
SASDCGA

SEQ ID NO: 2835952 - protein, 4 aa, Entamoeba invadens
SATC

SEQ ID NO: 2835953 - protein, 4 aa, Entamoeba invadens
SATN

SEQ ID NO: 2835954 - protein, 13 aa, Entamoeba invadens
SATSRAGQGKMRG

SEQ ID NO: 2835955 - protein, 7 aa, Entamoeba invadens
SATYYSE

SEQ ID NO: 2835956 - protein, 4 aa, Entamoeba invadens
SCEN

SEQ ID NO: 2835957 - protein, 4 aa, Entamoeba invadens
SCGE

SEQ ID NO: 2835958 - protein, 10 aa, Entamoeba invadens
SCKQSNERQS

SEQ ID NO: 2835959 - protein, 5 aa, Entamoeba invadens
SCRRP

SEQ ID NO: 2835960 - protein, 7 aa, Entamoeba invadens
SCSTREN

SEQ ID NO: 2835961 - protein, 4 aa, Entamoeba invadens
SDEP

SEQ ID NO: 2835962 - protein, 4 aa, Entamoeba invadens
SDFG

SEQ ID NO: 2835963 - protein, 25 aa, Entamoeba invadens
SDGEGYSHGYNTTKEVFSKKEKHDW

SEQ ID NO: 2835964 - protein, 15 aa, Entamoeba invadens
SDGINNKENGKCAPQ

SEQ ID NO: 2835965 - protein, 4 aa, Entamoeba invadens
SDGN

SEQ ID NO: 2835966 - protein, 9 aa, Entamoeba invadens
SDGTVGANH

SEQ ID NO: 2835967 - protein, 7 aa, Entamoeba invadens
SDHKPVS

SEQ ID NO: 2835968 - protein, 4 aa, Entamoeba invadens
SDIT

SEQ ID NO: 2835969 - protein, 39 aa, Entamoeba invadens
SDKDATEELTNTAEKVEKKEEVEQSKNSNQHKNNSDGKY

SEQ ID NO: 2835970 - protein, 4 aa, Entamoeba invadens
SDKI

SEQ ID NO: 2835971 - protein, 5 aa, Entamoeba invadens
SDKPL

SEQ ID NO: 2835972 - protein, 8 aa, Entamoeba invadens
SDKSIAPT

SEQ ID NO: 2835973 - protein, 4 aa, Entamoeba invadens
SDKY

SEQ ID NO: 2835974 - protein, 20 aa, Entamoeba invadens
SDLPGSDDGSSATEGSLESK

SEQ ID NO: 2835975 - protein, 4 aa, Entamoeba invadens
SDNV

SEQ ID NO: 2835976 - protein, 7 aa, Entamoeba invadens
SDPVDGR

SEQ ID NO: 2835977 - protein, 5 aa, Entamoeba invadens
SDSGV

SEQ ID NO: 2835978 - protein, 12 aa, Entamoeba invadens
SDTDTGKKYPLA

SEQ ID NO: 2835979 - protein, 12 aa, Entamoeba invadens
SDTETGKKYPLA

SEQ ID NO: 2835980 - protein, 4 aa, Entamoeba invadens
SDTI

SEQ ID NO: 2835981 - protein, 4 aa, Entamoeba invadens
SDTY

SEQ ID NO: 2835982 - protein, 21 aa, Entamoeba invadens
SDVKVSKKSVDVGNALDDTTY

SEQ ID NO: 2835983 - protein, 9 aa, Entamoeba invadens
SDWNTGDTL

SEQ ID NO: 2835984 - protein, 19 aa, Entamoeba invadens
SDWSDEGNANTIEKFNTGG

SEQ ID NO: 2835985 - protein, 5 aa, Entamoeba invadens
SDYQS

SEQ ID NO: 2835986 - protein, 6 aa, Entamoeba invadens
SECDQT

SEQ ID NO: 2835987 - protein, 4 aa, Entamoeba invadens
SEEA

SEQ ID NO: 2835988 - protein, 9 aa, Entamoeba invadens
SEGAGATPV

SEQ ID NO: 2835989 - protein, 4 aa, Entamoeba invadens
SEGF

SEQ ID NO: 2835990 - protein, 15 aa, Entamoeba invadens
SEGKTNDSESTGRFG

SEQ ID NO: 2835991 - protein, 10 aa, Entamoeba invadens
SEIENSSDSA

SEQ ID NO: 2835992 - protein, 6 aa, Entamoeba invadens
SEIPNV

SEQ ID NO: 2835993 - protein, 4 aa, Entamoeba invadens
SEKE

SEQ ID NO: 2835994 - protein, 5 aa, Entamoeba invadens
SEKSS

SEQ ID NO: 2835995 - protein, 9 aa, Entamoeba invadens
SEKSSHLDA

SEQ ID NO: 2835996 - protein, 7 aa, Entamoeba invadens
SEKYGAY

SEQ ID NO: 2835997 - protein, 4 aa, Entamoeba invadens
SELD

SEQ ID NO: 2835998 - protein, 5 aa, Entamoeba invadens
SENET

SEQ ID NO: 2835999 - protein, 5 aa, Entamoeba invadens
SENFG

SEQ ID NO: 2836000 - protein, 4 aa, Entamoeba invadens
SENN

SEQ ID NO: 2836001 - protein, 4 aa, Entamoeba invadens
SENP

SEQ ID NO: 2836002 - protein, 9 aa, Entamoeba invadens
SENSSTEKC

SEQ ID NO: 2836003 - protein, 5 aa, Entamoeba invadens
SEPHV

SEQ ID NO: 2836004 - protein, 12 aa, Entamoeba invadens
SEPITSGLSGTL

SEQ ID NO: 2836005 - protein, 14 aa, Entamoeba invadens
SEQIKVEKKQPTYL

SEQ ID NO: 2836006 - protein, 4 aa, Entamoeba invadens
SERT

SEQ ID NO: 2836007 - protein, 5 aa, Entamoeba invadens
SESGV

SEQ ID NO: 2836008 - protein, 6 aa, Entamoeba invadens
SESLTN

SEQ ID NO: 2836009 - protein, 10 aa, Entamoeba invadens
SESPNENDTK

SEQ ID NO: 2836010 - protein, 7 aa, Entamoeba invadens
SESQMNG

SEQ ID NO: 2836011 - protein, 5 aa, Entamoeba invadens
SESRE

SEQ ID NO: 2836012 - protein, 6 aa, Entamoeba invadens
SESSIG

SEQ ID NO: 2836013 - protein, 11 aa, Entamoeba invadens
SESTQEALDNI

SEQ ID NO: 2836014 - protein, 8 aa, Entamoeba invadens
SETDVNKE

SEQ ID NO: 2836015 - protein, 6 aa, Entamoeba invadens
SETLPS

SEQ ID NO: 2836016 - protein, 4 aa, Entamoeba invadens
SETR

SEQ ID NO: 2836017 - protein, 4 aa, Entamoeba invadens
SETS

SEQ ID NO: 2836018 - protein, 5 aa, Entamoeba invadens
SETTC

SEQ ID NO: 2836019 - protein, 4 aa, Entamoeba invadens
SEVI

SEQ ID NO: 2836020 - protein, 5 aa, Entamoeba invadens
SEVTS

SEQ ID NO: 2836021 - protein, 6 aa, Entamoeba invadens
SEYKKS

SEQ ID NO: 2836022 - protein, 9 aa, Entamoeba invadens
SEYNTYADD

SEQ ID NO: 2836023 - protein, 4 aa, Entamoeba invadens
SFKN

SEQ ID NO: 2836024 - protein, 5 aa, Entamoeba invadens
SFNGK

SEQ ID NO: 2836025 - protein, 6 aa, Entamoeba invadens
SFPSQT

SEQ ID NO: 2836026 - protein, 5 aa, Entamoeba invadens
SFTSQ

SEQ ID NO: 2836027 - protein, 17 aa, Entamoeba invadens
SGAGAIKGAIATSGLGT

SEQ ID NO: 2836028 - protein, 6 aa, Entamoeba invadens
SGDGIT

SEQ ID NO: 2836029 - protein, 9 aa, Entamoeba invadens
SGDKEAENI

SEQ ID NO: 2836030 - protein, 12 aa, Entamoeba invadens
SGDLQNNYSYKE

SEQ ID NO: 2836031 - protein, 12 aa, Entamoeba invadens
SGDSSSKNDEEK

SEQ ID NO: 2836032 - protein, 4 aa, Entamoeba invadens
SGEA

SEQ ID NO: 2836033 - protein, 8 aa, Entamoeba invadens
SGELTSKN

SEQ ID NO: 2836034 - protein, 8 aa, Entamoeba invadens
SGFDPREL

SEQ ID NO: 2836035 - protein, 6 aa, Entamoeba invadens
SGGNNL

SEQ ID NO: 2836036 - protein, 14 aa, Entamoeba invadens
SGHEDETNNLNGSI

SEQ ID NO: 2836037 - protein, 4 aa, Entamoeba invadens
SGIT

SEQ ID NO: 2836038 - protein, 5 aa, Entamoeba invadens
SGKAN

SEQ ID NO: 2836039 - protein, 11 aa, Entamoeba invadens
SGKGKYEVPNT

SEQ ID NO: 2836040 - protein, 4 aa, Entamoeba invadens
SGKS

SEQ ID NO: 2836041 - protein, 11 aa, Entamoeba invadens
SGLKDGKKVPI

SEQ ID NO: 2836042 - protein, 17 aa, Entamoeba invadens
SGLKKDKQVLDTTTNSL

SEQ ID NO: 2836043 - protein, 4 aa, Entamoeba invadens
SGLT

SEQ ID NO: 2836044 - protein, 7 aa, Entamoeba invadens
SGLTNKI

SEQ ID NO: 2836045 - protein, 6 aa, Entamoeba invadens
SGNCDE

SEQ ID NO: 2836046 - protein, 4 aa, Entamoeba invadens
SGNE

SEQ ID NO: 2836047 - protein, 6 aa, Entamoeba invadens
SGPRCG

SEQ ID NO: 2836048 - protein, 9 aa, Entamoeba invadens
SGQQFSEKD

SEQ ID NO: 2836049 - protein, 4 aa, Entamoeba invadens
SGRA

SEQ ID NO: 2836050 - protein, 13 aa, Entamoeba invadens
SGRDNWAKNTSVF

SEQ ID NO: 2836051 - protein, 4 aa, Entamoeba invadens
SGRE

SEQ ID NO: 2836052 - protein, 4 aa, Entamoeba invadens
SGSA

SEQ ID NO: 2836053 - protein, 6 aa, Entamoeba invadens
SGSHPD

SEQ ID NO: 2836054 - protein, 5 aa, Entamoeba invadens
SGSMS

SEQ ID NO: 2836055 - protein, 7 aa, Entamoeba invadens
SGSQDGT

SEQ ID NO: 2836056 - protein, 10 aa, Entamoeba invadens
SGTENTISSA

SEQ ID NO: 2836057 - protein, 4 aa, Entamoeba invadens
SGTQ

SEQ ID NO: 2836058 - protein, 7 aa, Entamoeba invadens
SGVDGTL

SEQ ID NO: 2836059 - protein, 9 aa, Entamoeba invadens
SGVGKTELA

SEQ ID NO: 2836060 - protein, 4 aa, Entamoeba invadens
SGVS

SEQ ID NO: 2836061 - protein, 8 aa, Entamoeba invadens
SGYYPNQS

SEQ ID NO: 2836062 - protein, 7 aa, Entamoeba invadens
SGYYPSN

SEQ ID NO: 2836063 - protein, 12 aa, Entamoeba invadens
SHASKNPPENIE

SEQ ID NO: 2836064 - protein, 4 aa, Entamoeba invadens
SHDT

SEQ ID NO: 2836065 - protein, 4 aa, Entamoeba invadens
SHIP

SEQ ID NO: 2836066 - protein, 6 aa, Entamoeba invadens
SHSRSD

SEQ ID NO: 2836067 - protein, 6 aa, Entamoeba invadens
SHTSTL

SEQ ID NO: 2836068 - protein, 10 aa, Entamoeba invadens
SIEEGEKLAE

SEQ ID NO: 2836069 - protein, 5 aa, Entamoeba invadens
SIEEI

SEQ ID NO: 2836070 - protein, 6 aa, Entamoeba invadens
SIEENK

SEQ ID NO: 2836071 - protein, 4 aa, Entamoeba invadens
SIGG

SEQ ID NO: 2836072 - protein, 5 aa, Entamoeba invadens
SIGNS

SEQ ID NO: 2836073 - protein, 10 aa, Entamoeba invadens
SIKEQKTNTW

SEQ ID NO: 2836074 - protein, 4 aa, Entamoeba invadens
SIKK

SEQ ID NO: 2836075 - protein, 4 aa, Entamoeba invadens
SINI

SEQ ID NO: 2836076 - protein, 4 aa, Entamoeba invadens
SIPD

SEQ ID NO: 2836077 - protein, 6 aa, Entamoeba invadens
SIPDSI

SEQ ID NO: 2836078 - protein, 7 aa, Entamoeba invadens
SIQHATQ

SEQ ID NO: 2836079 - protein, 4 aa, Entamoeba invadens
SIQS

SEQ ID NO: 2836080 - protein, 8 aa, Entamoeba invadens
SISDTPRN

SEQ ID NO: 2836081 - protein, 4 aa, Entamoeba invadens
SITH

SEQ ID NO: 2836082 - protein, 5 aa, Entamoeba invadens
SITIP

SEQ ID NO: 2836083 - protein, 10 aa, Entamoeba invadens
SITIPSSVTS

SEQ ID NO: 2836084 - protein, 11 aa, Entamoeba invadens
SITNAERAGKR

SEQ ID NO: 2836085 - protein, 4 aa, Entamoeba invadens
SKAL

SEQ ID NO: 2836086 - protein, 5 aa, Entamoeba invadens
SKDEL

SEQ ID NO: 2836087 - protein, 4 aa, Entamoeba invadens
SKEE

SEQ ID NO: 2836088 - protein, 5 aa, Entamoeba invadens
SKEEA

SEQ ID NO: 2836089 - protein, 5 aa, Entamoeba invadens
SKEEQ

SEQ ID NO: 2836090 - protein, 5 aa, Entamoeba invadens
SKEIE

SEQ ID NO: 2836091 - protein, 4 aa, Entamoeba invadens
SKET

SEQ ID NO: 2836092 - protein, 5 aa, Entamoeba invadens
SKETQ

SEQ ID NO: 2836093 - protein, 6 aa, Entamoeba invadens
SKETTM

SEQ ID NO: 2836094 - protein, 12 aa, Entamoeba invadens
SKEVASLEGDEV

SEQ ID NO: 2836095 - protein, 4 aa, Entamoeba invadens
SKGL

SEQ ID NO: 2836096 - protein, 4 aa, Entamoeba invadens
SKGN

SEQ ID NO: 2836097 - protein, 6 aa, Entamoeba invadens
SKIGKG

SEQ ID NO: 2836098 - protein, 5 aa, Entamoeba invadens
SKIPE

SEQ ID NO: 2836099 - protein, 7 aa, Entamoeba invadens
SKITKGQ

SEQ ID NO: 2836100 - protein, 13 aa, Entamoeba invadens
SKKAGGDSTNFTT

SEQ ID NO: 2836101 - protein, 8 aa, Entamoeba invadens
SKKELGKV

SEQ ID NO: 2836102 - protein, 12 aa, Entamoeba invadens
SKKIKAQDDKTV

SEQ ID NO: 2836103 - protein, 7 aa, Entamoeba invadens
SKKQEVV

SEQ ID NO: 2836104 - protein, 10 aa, Entamoeba invadens
SKKSDPYTKV

SEQ ID NO: 2836105 - protein, 7 aa, Entamoeba invadens
SKKTEKS

SEQ ID NO: 2836106 - protein, 5 aa, Entamoeba invadens
SKLPP

SEQ ID NO: 2836107 - protein, 11 aa, Entamoeba invadens
SKMTQKEQNEF

SEQ ID NO: 2836108 - protein, 4 aa, Entamoeba invadens
SKNN

SEQ ID NO: 2836109 - protein, 6 aa, Entamoeba invadens
SKPGRY

SEQ ID NO: 2836110 - protein, 8 aa, Entamoeba invadens
SKQAEHME

SEQ ID NO: 2836111 - protein, 6 aa, Entamoeba invadens
SKQKAS

SEQ ID NO: 2836112 - protein, 9 aa, Entamoeba invadens
SKRENCSYD

SEQ ID NO: 2836113 - protein, 15 aa, Entamoeba invadens
SKRGEDKIYNKYGKD

SEQ ID NO: 2836114 - protein, 8 aa, Entamoeba invadens
SKRNSNQI

SEQ ID NO: 2836115 - protein, 5 aa, Entamoeba invadens
SKSFE

SEQ ID NO: 2836116 - protein, 12 aa, Entamoeba invadens
SKSPSYDRRKTA

SEQ ID NO: 2836117 - protein, 8 aa, Entamoeba invadens
SKTNTDIQ

SEQ ID NO: 2836118 - protein, 6 aa, Entamoeba invadens
SKTSFN

SEQ ID NO: 2836119 - protein, 20 aa, Entamoeba invadens
SKTYTNLPLPNNDANEKFDE

SEQ ID NO: 2836120 - protein, 8 aa, Entamoeba invadens
SKVPKNKL

SEQ ID NO: 2836121 - protein, 9 aa, Entamoeba invadens
SKVPPPSLT

SEQ ID NO: 2836122 - protein, 12 aa, Entamoeba invadens
SLDMTDDDCAKP

SEQ ID NO: 2836123 - protein, 4 aa, Entamoeba invadens
SLED

SEQ ID NO: 2836124 - protein, 6 aa, Entamoeba invadens
SLEKTN

SEQ ID NO: 2836125 - protein, 4 aa, Entamoeba invadens
SLGS

SEQ ID NO: 2836126 - protein, 13 aa, Entamoeba invadens
SLGTSNEGESICS

SEQ ID NO: 2836127 - protein, 4 aa, Entamoeba invadens
SLNE

SEQ ID NO: 2836128 - protein, 13 aa, Entamoeba invadens
SLNEDHKKNKNVR

SEQ ID NO: 2836129 - protein, 4 aa, Entamoeba invadens
SLPE

SEQ ID NO: 2836130 - protein, 5 aa, Entamoeba invadens
SLPGI

SEQ ID NO: 2836131 - protein, 9 aa, Entamoeba invadens
SLPNTVNNI

SEQ ID NO: 2836132 - protein, 9 aa, Entamoeba invadens
SLPSTLEKA

SEQ ID NO: 2836133 - protein, 5 aa, Entamoeba invadens
SLPSV

SEQ ID NO: 2836134 - protein, 5 aa, Entamoeba invadens
SLRED

SEQ ID NO: 2836135 - protein, 5 aa, Entamoeba invadens
SLSEF

SEQ ID NO: 2836136 - protein, 5 aa, Entamoeba invadens
SMCPQ

SEQ ID NO: 2836137 - protein, 5 aa, Entamoeba invadens
SMKGK

SEQ ID NO: 2836138 - protein, 4 aa, Entamoeba invadens
SMKT

SEQ ID NO: 2836139 - protein, 9 aa, Entamoeba invadens
SMNDSNVNS

SEQ ID NO: 2836140 - protein, 25 aa, Entamoeba invadens
SMTGASPSIFGAGSEGALTKGPFNS

SEQ ID NO: 2836141 - protein, 5 aa, Entamoeba invadens
SNAEI

SEQ ID NO: 2836142 - protein, 14 aa, Entamoeba invadens
SNAITSSQNNEIQT

SEQ ID NO: 2836143 - protein, 7 aa, Entamoeba invadens
SNATDCQ

SEQ ID NO: 2836144 - protein, 9 aa, Entamoeba invadens
SNCENANKV

SEQ ID NO: 2836145 - protein, 4 aa, Entamoeba invadens
SNDR

SEQ ID NO: 2836146 - protein, 11 aa, Entamoeba invadens
SNDRVTDKTTV

SEQ ID NO: 2836147 - protein, 7 aa, Entamoeba invadens
SNDTAVP

SEQ ID NO: 2836148 - protein, 5 aa, Entamoeba invadens
SNEKA

SEQ ID NO: 2836149 - protein, 4 aa, Entamoeba invadens
SNES

SEQ ID NO: 2836150 - protein, 5 aa, Entamoeba invadens
SNETL

SEQ ID NO: 2836151 - protein, 4 aa, Entamoeba invadens
SNEY

SEQ ID NO: 2836152 - protein, 5 aa, Entamoeba invadens
SNFND

SEQ ID NO: 2836153 - protein, 7 aa, Entamoeba invadens
SNHREQL

SEQ ID NO: 2836154 - protein, 5 aa, Entamoeba invadens
SNIHT

SEQ ID NO: 2836155 - protein, 4 aa, Entamoeba invadens
SNIT

SEQ ID NO: 2836156 - protein, 14 aa, Entamoeba invadens
SNKDVREVNDDKKM

SEQ ID NO: 2836157 - protein, 4 aa, Entamoeba invadens
SNKI

SEQ ID NO: 2836158 - protein, 5 aa, Entamoeba invadens
SNKKL

SEQ ID NO: 2836159 - protein, 8 aa, Entamoeba invadens
SNKQCSKC

SEQ ID NO: 2836160 - protein, 4 aa, Entamoeba invadens
SNND

SEQ ID NO: 2836161 - protein, 4 aa, Entamoeba invadens
SNNK

SEQ ID NO: 2836162 - protein, 7 aa, Entamoeba invadens
SNPFPID

SEQ ID NO: 2836163 - protein, 4 aa, Entamoeba invadens
SNPL

SEQ ID NO: 2836164 - protein, 8 aa, Entamoeba invadens
SNPQKQLQ

SEQ ID NO: 2836165 - protein, 18 aa, Entamoeba invadens
SNSFGSNAFGTTTNGPIN

SEQ ID NO: 2836166 - protein, 8 aa, Entamoeba invadens
SNSTEGDL

SEQ ID NO: 2836167 - protein, 5 aa, Entamoeba invadens
SNSVI

SEQ ID NO: 2836168 - protein, 13 aa, Entamoeba invadens
SNTASTNEIPPEM

SEQ ID NO: 2836169 - protein, 8 aa, Entamoeba invadens
SNTPQESY

SEQ ID NO: 2836170 - protein, 4 aa, Entamoeba invadens
SNVS

SEQ ID NO: 2836171 - protein, 5 aa, Entamoeba invadens
SNVTE

SEQ ID NO: 2836172 - protein, 6 aa, Entamoeba invadens
SNVTSI

SEQ ID NO: 2836173 - protein, 4 aa, Entamoeba invadens
SPCP

SEQ ID NO: 2836174 - protein, 5 aa, Entamoeba invadens
SPDGS

SEQ ID NO: 2836175 - protein, 6 aa, Entamoeba invadens
SPDNRE

SEQ ID NO: 2836176 - protein, 4 aa, Entamoeba invadens
SPDY

SEQ ID NO: 2836177 - protein, 4 aa, Entamoeba invadens
SPEC

SEQ ID NO: 2836178 - protein, 4 aa, Entamoeba invadens
SPED

SEQ ID NO: 2836179 - protein, 6 aa, Entamoeba invadens
SPEKKM

SEQ ID NO: 2836180 - protein, 9 aa, Entamoeba invadens
SPGSKTMCR

SEQ ID NO: 2836181 - protein, 18 aa, Entamoeba invadens
SPKNDAHSKKPTQNRCSL

SEQ ID NO: 2836182 - protein, 8 aa, Entamoeba invadens
SPKNNCQQ

SEQ ID NO: 2836183 - protein, 11 aa, Entamoeba invadens
SPKQNSFDDSL

SEQ ID NO: 2836184 - protein, 4 aa, Entamoeba invadens
SPNF

SEQ ID NO: 2836185 - protein, 4 aa, Entamoeba invadens
SPPI

SEQ ID NO: 2836186 - protein, 6 aa, Entamoeba invadens
SPSFNP

SEQ ID NO: 2836187 - protein, 13 aa, Entamoeba invadens
SPSGLSTKTKSVE

SEQ ID NO: 2836188 - protein, 4 aa, Entamoeba invadens
SPTI

SEQ ID NO: 2836189 - protein, 4 aa, Entamoeba invadens
SPVN

SEQ ID NO: 2836190 - protein, 15 aa, Entamoeba invadens
SPVSYDNPRYEKDTP

SEQ ID NO: 2836191 - protein, 15 aa, Entamoeba invadens
SQDNTKIISGSRDKT

SEQ ID NO: 2836192 - protein, 6 aa, Entamoeba invadens
SQDPNA

SEQ ID NO: 2836193 - protein, 4 aa, Entamoeba invadens
SQDY

SEQ ID NO: 2836194 - protein, 7 aa, Entamoeba invadens
SQIGEGS

SEQ ID NO: 2836195 - protein, 13 aa, Entamoeba invadens
SQKALDKAKKNAF

SEQ ID NO: 2836196 - protein, 11 aa, Entamoeba invadens
SQKVEGTEKRG

SEQ ID NO: 2836197 - protein, 15 aa, Entamoeba invadens
SQLTGGQYAALSSAS

SEQ ID NO: 2836198 - protein, 15 aa, Entamoeba invadens
SQMSPNGGGDGPESV

SEQ ID NO: 2836199 - protein, 5 aa, Entamoeba invadens
SQNLD

SEQ ID NO: 2836200 - protein, 9 aa, Entamoeba invadens
SQNTTNTIF

SEQ ID NO: 2836201 - protein, 12 aa, Entamoeba invadens
SQNVWANDDGTI

SEQ ID NO: 2836202 - protein, 12 aa, Entamoeba invadens
SQQPKPNTFRPK

SEQ ID NO: 2836203 - protein, 9 aa, Entamoeba invadens
SQQQTPTRH

SEQ ID NO: 2836204 - protein, 5 aa, Entamoeba invadens
SQRNM

SEQ ID NO: 2836205 - protein, 5 aa, Entamoeba invadens
SQSEL

SEQ ID NO: 2836206 - protein, 4 aa, Entamoeba invadens
SQSL

SEQ ID NO: 2836207 - protein, 5 aa, Entamoeba invadens
SQSSF

SEQ ID NO: 2836208 - protein, 9 aa, Entamoeba invadens
SQSSGKSSV

SEQ ID NO: 2836209 - protein, 4 aa, Entamoeba invadens
SQTS

SEQ ID NO: 2836210 - protein, 13 aa, Entamoeba invadens
SQVPREDVPIIFL

SEQ ID NO: 2836211 - protein, 4 aa, Entamoeba invadens
SQYK

SEQ ID NO: 2836212 - protein, 9 aa, Entamoeba invadens
SQYKTRQDK

SEQ ID NO: 2836213 - protein, 5 aa, Entamoeba invadens
SRDPS

SEQ ID NO: 2836214 - protein, 7 aa, Entamoeba invadens
SREDYDM

SEQ ID NO: 2836215 - protein, 8 aa, Entamoeba invadens
SRKETKEW

SEQ ID NO: 2836216 - protein, 9 aa, Entamoeba invadens
SRPGQTGRV

SEQ ID NO: 2836217 - protein, 15 aa, Entamoeba invadens
SRPNVEKFTDSSSSM

SEQ ID NO: 2836218 - protein, 4 aa, Entamoeba invadens
SRSA

SEQ ID NO: 2836219 - protein, 14 aa, Entamoeba invadens
SRSGLGSDKRPTGS

SEQ ID NO: 2836220 - protein, 8 aa, Entamoeba invadens
SRTSKDGT

SEQ ID NO: 2836221 - protein, 9 aa, Entamoeba invadens
SSAKETLIT

SEQ ID NO: 2836222 - protein, 4 aa, Entamoeba invadens
SSAL

SEQ ID NO: 2836223 - protein, 7 aa, Entamoeba invadens
SSANKCG

SEQ ID NO: 2836224 - protein, 6 aa, Entamoeba invadens
SSASFE

SEQ ID NO: 2836225 - protein, 4 aa, Entamoeba invadens
SSCS

SEQ ID NO: 2836226 - protein, 6 aa, Entamoeba invadens
SSDGEI

SEQ ID NO: 2836227 - protein, 16 aa, Entamoeba invadens
SSEGNQANNANDGVDL

SEQ ID NO: 2836228 - protein, 21 aa, Entamoeba invadens
SSENTSESNSITVDSDEWEEV

SEQ ID NO: 2836229 - protein, 7 aa, Entamoeba invadens
SSFKNCS

SEQ ID NO: 2836230 - protein, 4 aa, Entamoeba invadens
SSGV

SEQ ID NO: 2836231 - protein, 21 aa, Entamoeba invadens
SSKFTEKLNEAKENMNGQVNG

SEQ ID NO: 2836232 - protein, 22 aa, Entamoeba invadens
SSKITTVKGKKIESINGTKKAI

SEQ ID NO: 2836233 - protein, 6 aa, Entamoeba invadens
SSKTFH

SEQ ID NO: 2836234 - protein, 5 aa, Entamoeba invadens
SSKWQ

SEQ ID NO: 2836235 - protein, 19 aa, Entamoeba invadens
SSLDEKNKDQDTPKQQEIS

SEQ ID NO: 2836236 - protein, 5 aa, Entamoeba invadens
SSLDG

SEQ ID NO: 2836237 - protein, 4 aa, Entamoeba invadens
SSLE

SEQ ID NO: 2836238 - protein, 8 aa, Entamoeba invadens
SSNQTENC

SEQ ID NO: 2836239 - protein, 5 aa, Entamoeba invadens
SSPIE

SEQ ID NO: 2836240 - protein, 6 aa, Entamoeba invadens
SSPKST

SEQ ID NO: 2836241 - protein, 6 aa, Entamoeba invadens
SSQAFN

SEQ ID NO: 2836242 - protein, 5 aa, Entamoeba invadens
SSQMP

SEQ ID NO: 2836243 - protein, 11 aa, Entamoeba invadens
SSQPDSTPKGM

SEQ ID NO: 2836244 - protein, 10 aa, Entamoeba invadens
SSRGGDINGN

SEQ ID NO: 2836245 - protein, 6 aa, Entamoeba invadens
SSSFTK

SEQ ID NO: 2836246 - protein, 4 aa, Entamoeba invadens
SSSQ

SEQ ID NO: 2836247 - protein, 4 aa, Entamoeba invadens
SSSS

SEQ ID NO: 2836248 - protein, 26 aa, Entamoeba invadens
SSSTSSLSSSSSSKSDKDNSVSLSPK

SEQ ID NO: 2836249 - protein, 35 aa, Entamoeba invadens
SSTSSYSSQSNAKHTKSSSTSTSSDLSSDSDYQFS

SEQ ID NO: 2836250 - protein, 6 aa, Entamoeba invadens
SSVSSI

SEQ ID NO: 2836251 - protein, 12 aa, Entamoeba invadens
SSVTIPSSVTSI

SEQ ID NO: 2836252 - protein, 4 aa, Entamoeba invadens
STAD

SEQ ID NO: 2836253 - protein, 10 aa, Entamoeba invadens
STCGGTCDGV

SEQ ID NO: 2836254 - protein, 4 aa, Entamoeba invadens
STDT

SEQ ID NO: 2836255 - protein, 13 aa, Entamoeba invadens
STETVKDETDAEV

SEQ ID NO: 2836256 - protein, 4 aa, Entamoeba invadens
STGD

SEQ ID NO: 2836257 - protein, 9 aa, Entamoeba invadens
STGFGQPGG

SEQ ID NO: 2836258 - protein, 10 aa, Entamoeba invadens
STGKRGTLKA

SEQ ID NO: 2836259 - protein, 5 aa, Entamoeba invadens
STHDV

SEQ ID NO: 2836260 - protein, 6 aa, Entamoeba invadens
STIRGK

SEQ ID NO: 2836261 - protein, 4 aa, Entamoeba invadens
STIS

SEQ ID NO: 2836262 - protein, 5 aa, Entamoeba invadens
STKEN

SEQ ID NO: 2836263 - protein, 9 aa, Entamoeba invadens
STKETTRCE

SEQ ID NO: 2836264 - protein, 8 aa, Entamoeba invadens
STKSGRGC

SEQ ID NO: 2836265 - protein, 6 aa, Entamoeba invadens
STLEPN

SEQ ID NO: 2836266 - protein, 7 aa, Entamoeba invadens
STLGSKA

SEQ ID NO: 2836267 - protein, 5 aa, Entamoeba invadens
STLNV

SEQ ID NO: 2836268 - protein, 4 aa, Entamoeba invadens
STLQ

SEQ ID NO: 2836269 - protein, 4 aa, Entamoeba invadens
STLS

SEQ ID NO: 2836270 - protein, 4 aa, Entamoeba invadens
STND

SEQ ID NO: 2836271 - protein, 18 aa, Entamoeba invadens
STNEAEEIARHDTTGSHD

SEQ ID NO: 2836272 - protein, 17 aa, Entamoeba invadens
STNNSMDDDENRIGVDS

SEQ ID NO: 2836273 - protein, 4 aa, Entamoeba invadens
STNT

SEQ ID NO: 2836274 - protein, 5 aa, Entamoeba invadens
STPIP

SEQ ID NO: 2836275 - protein, 6 aa, Entamoeba invadens
STQQGA

SEQ ID NO: 2836276 - protein, 4 aa, Entamoeba invadens
STQY

SEQ ID NO: 2836277 - protein, 15 aa, Entamoeba invadens
STRTYGTVYPTADQV

SEQ ID NO: 2836278 - protein, 4 aa, Entamoeba invadens
STSE

SEQ ID NO: 2836279 - protein, 6 aa, Entamoeba invadens
STSIGN

SEQ ID NO: 2836280 - protein, 8 aa, Entamoeba invadens
STSNEFDT

SEQ ID NO: 2836281 - protein, 13 aa, Entamoeba invadens
STSQSDNNTNNDA

SEQ ID NO: 2836282 - protein, 8 aa, Entamoeba invadens
STSTETTN

SEQ ID NO: 2836283 - protein, 4 aa, Entamoeba invadens
STTF

SEQ ID NO: 2836284 - protein, 6 aa, Entamoeba invadens
STVNNT

SEQ ID NO: 2836285 - protein, 6 aa, Entamoeba invadens
SVEGAQ

SEQ ID NO: 2836286 - protein, 5 aa, Entamoeba invadens
SVEGT

SEQ ID NO: 2836287 - protein, 19 aa, Entamoeba invadens
SVEKSNKTTTFKEMNSTKQ

SEQ ID NO: 2836288 - protein, 4 aa, Entamoeba invadens
SVEY

SEQ ID NO: 2836289 - protein, 8 aa, Entamoeba invadens
SVKTTKKL

SEQ ID NO: 2836290 - protein, 4 aa, Entamoeba invadens
SVND

SEQ ID NO: 2836291 - protein, 5 aa, Entamoeba invadens
SVNDK

SEQ ID NO: 2836292 - protein, 6 aa, Entamoeba invadens
SVPPTL

SEQ ID NO: 2836293 - protein, 4 aa, Entamoeba invadens
SVSE

SEQ ID NO: 2836294 - protein, 6 aa, Entamoeba invadens
SVSEIG

SEQ ID NO: 2836295 - protein, 4 aa, Entamoeba invadens
SVSK

SEQ ID NO: 2836296 - protein, 4 aa, Entamoeba invadens
SVSQ

SEQ ID NO: 2836297 - protein, 5 aa, Entamoeba invadens
SVSSM

SEQ ID NO: 2836298 - protein, 6 aa, Entamoeba invadens
SVTIPS

SEQ ID NO: 2836299 - protein, 8 aa, Entamoeba invadens
SVTIPSSV

SEQ ID NO: 2836300 - protein, 11 aa, Entamoeba invadens
SVTIPSSVKSI

SEQ ID NO: 2836301 - protein, 9 aa, Entamoeba invadens
SVTIPSSVT

SEQ ID NO: 2836302 - protein, 18 aa, Entamoeba invadens
SVTQLDSTAFDKNVVIIR

SEQ ID NO: 2836303 - protein, 6 aa, Entamoeba invadens
SVTSIG

SEQ ID NO: 2836304 - protein, 5 aa, Entamoeba invadens
SVTSL

SEQ ID NO: 2836305 - protein, 4 aa, Entamoeba invadens
SYET

SEQ ID NO: 2836306 - protein, 4 aa, Entamoeba invadens
SYLQ

SEQ ID NO: 2836307 - protein, 5 aa, Entamoeba invadens
SYNGD

SEQ ID NO: 2836308 - protein, 6 aa, Entamoeba invadens
SYNGMT

SEQ ID NO: 2836309 - protein, 11 aa, Entamoeba invadens
SYNPTGGKMDE

SEQ ID NO: 2836310 - protein, 7 aa, Entamoeba invadens
SYNTRSN

SEQ ID NO: 2836311 - protein, 12 aa, Entamoeba invadens
SYPSLSPPSHNK

SEQ ID NO: 2836312 - protein, 6 aa, Entamoeba invadens
SYSNYK

SEQ ID NO: 2836313 - protein, 9 aa, Entamoeba invadens
SYSSTKSSH

SEQ ID NO: 2836314 - protein, 6 aa, Entamoeba invadens
SYYRGT

SEQ ID NO: 2836315 - protein, 11 aa, Entamoeba invadens
TAAGGHFGRND

SEQ ID NO: 2836316 - protein, 8 aa, Entamoeba invadens
TAEGKVER

SEQ ID NO: 2836317 - protein, 9 aa, Entamoeba invadens
TAGQDEYSA

SEQ ID NO: 2836318 - protein, 9 aa, Entamoeba invadens
TAGQEDYEQ

SEQ ID NO: 2836319 - protein, 8 aa, Entamoeba invadens
TAGQEEYA

SEQ ID NO: 2836320 - protein, 7 aa, Entamoeba invadens
TAGQERF

SEQ ID NO: 2836321 - protein, 8 aa, Entamoeba invadens
TAGQERYR

SEQ ID NO: 2836322 - protein, 8 aa, Entamoeba invadens
TAGSDEYS

SEQ ID NO: 2836323 - protein, 7 aa, Entamoeba invadens
TAGSERF

SEQ ID NO: 2836324 - protein, 7 aa, Entamoeba invadens
TAGTEQF

SEQ ID NO: 2836325 - protein, 8 aa, Entamoeba invadens
TAKAISNG

SEQ ID NO: 2836326 - protein, 4 aa, Entamoeba invadens
TALE

SEQ ID NO: 2836327 - protein, 6 aa, Entamoeba invadens
TANGFE

SEQ ID NO: 2836328 - protein, 9 aa, Entamoeba invadens
TAPAWQKKT

SEQ ID NO: 2836329 - protein, 8 aa, Entamoeba invadens
TASSNNAV

SEQ ID NO: 2836330 - protein, 14 aa, Entamoeba invadens
TATPAGDISATAPH

SEQ ID NO: 2836331 - protein, 5 aa, Entamoeba invadens
TATTN

SEQ ID NO: 2836332 - protein, 14 aa, Entamoeba invadens
TCASTGCNTQTGAC

SEQ ID NO: 2836333 - protein, 5 aa, Entamoeba invadens
TCESN

SEQ ID NO: 2836334 - protein, 4 aa, Entamoeba invadens
TCET

SEQ ID NO: 2836335 - protein, 9 aa, Entamoeba invadens
TCITQDDQH

SEQ ID NO: 2836336 - protein, 9 aa, Entamoeba invadens
TCNSSSVCT

SEQ ID NO: 2836337 - protein, 8 aa, Entamoeba invadens
TCPHTKKD

SEQ ID NO: 2836338 - protein, 15 aa, Entamoeba invadens
TCQQNECNAANGQCT

SEQ ID NO: 2836339 - protein, 34 aa, Entamoeba invadens
TDDISQDSEDVLEEDHQEEQEISPITRTSTPEVD

SEQ ID NO: 2836340 - protein, 7 aa, Entamoeba invadens
TDEEGIR

SEQ ID NO: 2836341 - protein, 8 aa, Entamoeba invadens
TDELDDNE

SEQ ID NO: 2836342 - protein, 7 aa, Entamoeba invadens
TDFGTSR

SEQ ID NO: 2836343 - protein, 9 aa, Entamoeba invadens
TDKDRLNDF

SEQ ID NO: 2836344 - protein, 20 aa, Entamoeba invadens
TDKNGDDLPDDVEFPDVILT

SEQ ID NO: 2836345 - protein, 4 aa, Entamoeba invadens
TDLD

SEQ ID NO: 2836346 - protein, 5 aa, Entamoeba invadens
TDMRN

SEQ ID NO: 2836347 - protein, 6 aa, Entamoeba invadens
TDPTWI

SEQ ID NO: 2836348 - protein, 10 aa, Entamoeba invadens
TDQYQTPQET

SEQ ID NO: 2836349 - protein, 11 aa, Entamoeba invadens
TDSERNSIDQS

SEQ ID NO: 2836350 - protein, 16 aa, Entamoeba invadens
TDSTPSVYSRKTQKKS

SEQ ID NO: 2836351 - protein, 6 aa, Entamoeba invadens
TDVPND

SEQ ID NO: 2836352 - protein, 6 aa, Entamoeba invadens
TDYATD

SEQ ID NO: 2836353 - protein, 4 aa, Entamoeba invadens
TDYD

SEQ ID NO: 2836354 - protein, 4 aa, Entamoeba invadens
TEDC

SEQ ID NO: 2836355 - protein, 29 aa, Entamoeba invadens
TEDDKEDIKFDTNRKRKMGKSQQKTKHSK

SEQ ID NO: 2836356 - protein, 5 aa, Entamoeba invadens
TEDKT

SEQ ID NO: 2836357 - protein, 4 aa, Entamoeba invadens
TEDV

SEQ ID NO: 2836358 - protein, 6 aa, Entamoeba invadens
TEEIET

SEQ ID NO: 2836359 - protein, 11 aa, Entamoeba invadens
TEEKVECENKG

SEQ ID NO: 2836360 - protein, 4 aa, Entamoeba invadens
TEEL

SEQ ID NO: 2836361 - protein, 5 aa, Entamoeba invadens
TEESY

SEQ ID NO: 2836362 - protein, 9 aa, Entamoeba invadens
TEGEQAPIE

SEQ ID NO: 2836363 - protein, 5 aa, Entamoeba invadens
TEHEC

SEQ ID NO: 2836364 - protein, 5 aa, Entamoeba invadens
TEHTG

SEQ ID NO: 2836365 - protein, 10 aa, Entamoeba invadens
TEIEKSEYCP

SEQ ID NO: 2836366 - protein, 15 aa, Entamoeba invadens
TEIEPLQSEPPKCPS

SEQ ID NO: 2836367 - protein, 6 aa, Entamoeba invadens
TEIHDD

SEQ ID NO: 2836368 - protein, 5 aa, Entamoeba invadens
TEINT

SEQ ID NO: 2836369 - protein, 4 aa, Entamoeba invadens
TEIP

SEQ ID NO: 2836370 - protein, 4 aa, Entamoeba invadens
TEIQ

SEQ ID NO: 2836371 - protein, 4 aa, Entamoeba invadens
TEIT

SEQ ID NO: 2836372 - protein, 4 aa, Entamoeba invadens
TEKD

SEQ ID NO: 2836373 - protein, 4 aa, Entamoeba invadens
TEKG

SEQ ID NO: 2836374 - protein, 7 aa, Entamoeba invadens
TEKIDSN

SEQ ID NO: 2836375 - protein, 14 aa, Entamoeba invadens
TEKLTDVESPKTGI

SEQ ID NO: 2836376 - protein, 18 aa, Entamoeba invadens
TEKMDSNPNVVKESADVK

SEQ ID NO: 2836377 - protein, 4 aa, Entamoeba invadens
TELK

SEQ ID NO: 2836378 - protein, 5 aa, Entamoeba invadens
TENPH

SEQ ID NO: 2836379 - protein, 4 aa, Entamoeba invadens
TENV

SEQ ID NO: 2836380 - protein, 5 aa, Entamoeba invadens
TERNE

SEQ ID NO: 2836381 - protein, 5 aa, Entamoeba invadens
TESES

SEQ ID NO: 2836382 - protein, 8 aa, Entamoeba invadens
TETPKPIP

SEQ ID NO: 2836383 - protein, 4 aa, Entamoeba invadens
TETV

SEQ ID NO: 2836384 - protein, 4 aa, Entamoeba invadens
TEYG

SEQ ID NO: 2836385 - protein, 14 aa, Entamoeba invadens
TFANTTSATDKALG

SEQ ID NO: 2836386 - protein, 9 aa, Entamoeba invadens
TFEKDSDQY

SEQ ID NO: 2836387 - protein, 4 aa, Entamoeba invadens
TFEN

SEQ ID NO: 2836388 - protein, 9 aa, Entamoeba invadens
TFPNSPRNM

SEQ ID NO: 2836389 - protein, 4 aa, Entamoeba invadens
TFQG

SEQ ID NO: 2836390 - protein, 9 aa, Entamoeba invadens
TFQSAKTEL

SEQ ID NO: 2836391 - protein, 8 aa, Entamoeba invadens
TGADKKEL

SEQ ID NO: 2836392 - protein, 12 aa, Entamoeba invadens
TGAKDDESLNTA

SEQ ID NO: 2836393 - protein, 4 aa, Entamoeba invadens
TGCS

SEQ ID NO: 2836394 - protein, 6 aa, Entamoeba invadens
TGETFG

SEQ ID NO: 2836395 - protein, 8 aa, Entamoeba invadens
TGKDFGNE

SEQ ID NO: 2836396 - protein, 5 aa, Entamoeba invadens
TGKYD

SEQ ID NO: 2836397 - protein, 4 aa, Entamoeba invadens
TGLN

SEQ ID NO: 2836398 - protein, 16 aa, Entamoeba invadens
TGNHSFDEADYKGGMY

SEQ ID NO: 2836399 - protein, 10 aa, Entamoeba invadens
TGQSQFNKRR

SEQ ID NO: 2836400 - protein, 13 aa, Entamoeba invadens
TGRCLSGDSNAYD

SEQ ID NO: 2836401 - protein, 9 aa, Entamoeba invadens
TGRRKEEVA

SEQ ID NO: 2836402 - protein, 5 aa, Entamoeba invadens
TGSMG

SEQ ID NO: 2836403 - protein, 5 aa, Entamoeba invadens
TGSMS

SEQ ID NO: 2836404 - protein, 7 aa, Entamoeba invadens
TGSNDMT

SEQ ID NO: 2836405 - protein, 4 aa, Entamoeba invadens
TGSP

SEQ ID NO: 2836406 - protein, 7 aa, Entamoeba invadens
TGTIPNT

SEQ ID NO: 2836407 - protein, 6 aa, Entamoeba invadens
TGVIPD

SEQ ID NO: 2836408 - protein, 13 aa, Entamoeba invadens
TGWGDRDDSFRKL

SEQ ID NO: 2836409 - protein, 12 aa, Entamoeba invadens
THEAAKKAIETM

SEQ ID NO: 2836410 - protein, 14 aa, Entamoeba invadens
THPGWTTQDRNVPI

SEQ ID NO: 2836411 - protein, 5 aa, Entamoeba invadens
THQSV

SEQ ID NO: 2836412 - protein, 10 aa, Entamoeba invadens
THRDNKTIND

SEQ ID NO: 2836413 - protein, 7 aa, Entamoeba invadens
THTTFDG

SEQ ID NO: 2836414 - protein, 5 aa, Entamoeba invadens
THTYD

SEQ ID NO: 2836415 - protein, 12 aa, Entamoeba invadens
TIDTKRTPLDEQ

SEQ ID NO: 2836416 - protein, 5 aa, Entamoeba invadens
TIDTS

SEQ ID NO: 2836417 - protein, 10 aa, Entamoeba invadens
TIEDSYRTSI

SEQ ID NO: 2836418 - protein, 9 aa, Entamoeba invadens
TIEETESDY

SEQ ID NO: 2836419 - protein, 4 aa, Entamoeba invadens
TIPK

SEQ ID NO: 2836420 - protein, 7 aa, Entamoeba invadens
TIPQSVT

SEQ ID NO: 2836421 - protein, 6 aa, Entamoeba invadens
TIPSNV

SEQ ID NO: 2836422 - protein, 8 aa, Entamoeba invadens
TIPSNVKS

SEQ ID NO: 2836423 - protein, 7 aa, Entamoeba invadens
TIPSSVK

SEQ ID NO: 2836424 - protein, 9 aa, Entamoeba invadens
TIPSSVRSI

SEQ ID NO: 2836425 - protein, 10 aa, Entamoeba invadens
TIPSSVSSLE

SEQ ID NO: 2836426 - protein, 10 aa, Entamoeba invadens
TIPSSVTSIS

SEQ ID NO: 2836427 - protein, 4 aa, Entamoeba invadens
TIQQ

SEQ ID NO: 2836428 - protein, 4 aa, Entamoeba invadens
TITN

SEQ ID NO: 2836429 - protein, 4 aa, Entamoeba invadens
TITP

SEQ ID NO: 2836430 - protein, 8 aa, Entamoeba invadens
TKAAGERL

SEQ ID NO: 2836431 - protein, 9 aa, Entamoeba invadens
TKDPIGETK

SEQ ID NO: 2836432 - protein, 13 aa, Entamoeba invadens
TKEDRKKYGNTIP

SEQ ID NO: 2836433 - protein, 7 aa, Entamoeba invadens
TKGEKWE

SEQ ID NO: 2836434 - protein, 4 aa, Entamoeba invadens
TKGF

SEQ ID NO: 2836435 - protein, 4 aa, Entamoeba invadens
TKGN

SEQ ID NO: 2836436 - protein, 10 aa, Entamoeba invadens
TKIDKDAFQN

SEQ ID NO: 2836437 - protein, 12 aa, Entamoeba invadens
TKIESRARIDGS

SEQ ID NO: 2836438 - protein, 9 aa, Entamoeba invadens
TKIETNGVD

SEQ ID NO: 2836439 - protein, 6 aa, Entamoeba invadens
TKIGNG

SEQ ID NO: 2836440 - protein, 8 aa, Entamoeba invadens
TKKDRKHH

SEQ ID NO: 2836441 - protein, 5 aa, Entamoeba invadens
TKKEM

SEQ ID NO: 2836442 - protein, 16 aa, Entamoeba invadens
TKKSSKNRRNKKDVRT

SEQ ID NO: 2836443 - protein, 4 aa, Entamoeba invadens
TKMD

SEQ ID NO: 2836444 - protein, 4 aa, Entamoeba invadens
TKPS

SEQ ID NO: 2836445 - protein, 8 aa, Entamoeba invadens
TKPTKRPM

SEQ ID NO: 2836446 - protein, 4 aa, Entamoeba invadens
TKRL

SEQ ID NO: 2836447 - protein, 4 aa, Entamoeba invadens
TKSE

SEQ ID NO: 2836448 - protein, 7 aa, Entamoeba invadens
TKSEATT

SEQ ID NO: 2836449 - protein, 8 aa, Entamoeba invadens
TKSEATTI

SEQ ID NO: 2836450 - protein, 4 aa, Entamoeba invadens
TKSK

SEQ ID NO: 2836451 - protein, 11 aa, Entamoeba invadens
TKSTPKEGEKD

SEQ ID NO: 2836452 - protein, 4 aa, Entamoeba invadens
TKSV

SEQ ID NO: 2836453 - protein, 11 aa, Entamoeba invadens
TKTKNNGQTVQ

SEQ ID NO: 2836454 - protein, 5 aa, Entamoeba invadens
TKTPI

SEQ ID NO: 2836455 - protein, 6 aa, Entamoeba invadens
TKTPIK

SEQ ID NO: 2836456 - protein, 9 aa, Entamoeba invadens
TKTSMARGD

SEQ ID NO: 2836457 - protein, 4 aa, Entamoeba invadens
TKYE

SEQ ID NO: 2836458 - protein, 8 aa, Entamoeba invadens
TLDSASIK

SEQ ID NO: 2836459 - protein, 11 aa, Entamoeba invadens
TLEDSYQTSIN

SEQ ID NO: 2836460 - protein, 4 aa, Entamoeba invadens
TLEK

SEQ ID NO: 2836461 - protein, 8 aa, Entamoeba invadens
TLETNQQY

SEQ ID NO: 2836462 - protein, 9 aa, Entamoeba invadens
TLETSSEKI

SEQ ID NO: 2836463 - protein, 4 aa, Entamoeba invadens
TLPD

SEQ ID NO: 2836464 - protein, 11 aa, Entamoeba invadens
TLPPNLQSLGN

SEQ ID NO: 2836465 - protein, 5 aa, Entamoeba invadens
TLPQS

SEQ ID NO: 2836466 - protein, 6 aa, Entamoeba invadens
TLPQSL

SEQ ID NO: 2836467 - protein, 4 aa, Entamoeba invadens
TLSA

SEQ ID NO: 2836468 - protein, 5 aa, Entamoeba invadens
TLSAK

SEQ ID NO: 2836469 - protein, 5 aa, Entamoeba invadens
TLSEV

SEQ ID NO: 2836470 - protein, 5 aa, Entamoeba invadens
TLSKE

SEQ ID NO: 2836471 - protein, 5 aa, Entamoeba invadens
TLSTT

SEQ ID NO: 2836472 - protein, 9 aa, Entamoeba invadens
TLTGQTPVL

SEQ ID NO: 2836473 - protein, 5 aa, Entamoeba invadens
TLTRI

SEQ ID NO: 2836474 - protein, 5 aa, Entamoeba invadens
TLTSK

SEQ ID NO: 2836475 - protein, 8 aa, Entamoeba invadens
TNAGNDKQ

SEQ ID NO: 2836476 - protein, 9 aa, Entamoeba invadens
TNCETKTPI

SEQ ID NO: 2836477 - protein, 4 aa, Entamoeba invadens
TNDE

SEQ ID NO: 2836478 - protein, 10 aa, Entamoeba invadens
TNDSYPQGTS

SEQ ID NO: 2836479 - protein, 8 aa, Entamoeba invadens
TNDTKKCG

SEQ ID NO: 2836480 - protein, 8 aa, Entamoeba invadens
TNEGTTFP

SEQ ID NO: 2836481 - protein, 10 aa, Entamoeba invadens
TNEKYDESGL

SEQ ID NO: 2836482 - protein, 5 aa, Entamoeba invadens
TNGDI

SEQ ID NO: 2836483 - protein, 6 aa, Entamoeba invadens
TNGEPM

SEQ ID NO: 2836484 - protein, 4 aa, Entamoeba invadens
TNGT

SEQ ID NO: 2836485 - protein, 8 aa, Entamoeba invadens
TNHYSSNN

SEQ ID NO: 2836486 - protein, 4 aa, Entamoeba invadens
TNIE

SEQ ID NO: 2836487 - protein, 4 aa, Entamoeba invadens
TNIQ

SEQ ID NO: 2836488 - protein, 4 aa, Entamoeba invadens
TNIT

SEQ ID NO: 2836489 - protein, 4 aa, Entamoeba invadens
TNKD

SEQ ID NO: 2836490 - protein, 9 aa, Entamoeba invadens
TNKPRRNEQ

SEQ ID NO: 2836491 - protein, 4 aa, Entamoeba invadens
TNKR

SEQ ID NO: 2836492 - protein, 4 aa, Entamoeba invadens
TNKT

SEQ ID NO: 2836493 - protein, 12 aa, Entamoeba invadens
TNLDGKKKVPYA

SEQ ID NO: 2836494 - protein, 5 aa, Entamoeba invadens
TNNQI

SEQ ID NO: 2836495 - protein, 4 aa, Entamoeba invadens
TNSA

SEQ ID NO: 2836496 - protein, 4 aa, Entamoeba invadens
TNTE

SEQ ID NO: 2836497 - protein, 12 aa, Entamoeba invadens
TNTEENEDNGDI

SEQ ID NO: 2836498 - protein, 4 aa, Entamoeba invadens
TNTF

SEQ ID NO: 2836499 - protein, 8 aa, Entamoeba invadens
TNTHFEEK

SEQ ID NO: 2836500 - protein, 4 aa, Entamoeba invadens
TNTI

SEQ ID NO: 2836501 - protein, 6 aa, Entamoeba invadens
TNYNTI

SEQ ID NO: 2836502 - protein, 6 aa, Entamoeba invadens
TPDIGA

SEQ ID NO: 2836503 - protein, 4 aa, Entamoeba invadens
TPEI

SEQ ID NO: 2836504 - protein, 4 aa, Entamoeba invadens
TPEN

SEQ ID NO: 2836505 - protein, 6 aa, Entamoeba invadens
TPETMT

SEQ ID NO: 2836506 - protein, 4 aa, Entamoeba invadens
TPFS

SEQ ID NO: 2836507 - protein, 6 aa, Entamoeba invadens
TPGEKE

SEQ ID NO: 2836508 - protein, 15 aa, Entamoeba invadens
TPGNIKYTKNTIRGI

SEQ ID NO: 2836509 - protein, 4 aa, Entamoeba invadens
TPGY

SEQ ID NO: 2836510 - protein, 8 aa, Entamoeba invadens
TPHNKKNY

SEQ ID NO: 2836511 - protein, 18 aa, Entamoeba invadens
TPIPTDCTKRKGGRRGRR

SEQ ID NO: 2836512 - protein, 14 aa, Entamoeba invadens
TPIQSNTDDIEKQI

SEQ ID NO: 2836513 - protein, 8 aa, Entamoeba invadens
TPKSQDYK

SEQ ID NO: 2836514 - protein, 4 aa, Entamoeba invadens
TPNI

SEQ ID NO: 2836515 - protein, 13 aa, Entamoeba invadens
TPNKKYHNPKTGL

SEQ ID NO: 2836516 - protein, 8 aa, Entamoeba invadens
TPNTEAPA

SEQ ID NO: 2836517 - protein, 4 aa, Entamoeba invadens
TPNV

SEQ ID NO: 2836518 - protein, 9 aa, Entamoeba invadens
TPPGTSDEH

SEQ ID NO: 2836519 - protein, 4 aa, Entamoeba invadens
TPPS

SEQ ID NO: 2836520 - protein, 16 aa, Entamoeba invadens
TPPTTLDENISESTPN

SEQ ID NO: 2836521 - protein, 4 aa, Entamoeba invadens
TPQD

SEQ ID NO: 2836522 - protein, 4 aa, Entamoeba invadens
TPSG

SEQ ID NO: 2836523 - protein, 5 aa, Entamoeba invadens
TPSGC

SEQ ID NO: 2836524 - protein, 4 aa, Entamoeba invadens
TPSL

SEQ ID NO: 2836525 - protein, 7 aa, Entamoeba invadens
TPTHETQ

SEQ ID NO: 2836526 - protein, 4 aa, Entamoeba invadens
TPTP

SEQ ID NO: 2836527 - protein, 6 aa, Entamoeba invadens
TPYRQE

SEQ ID NO: 2836528 - protein, 7 aa, Entamoeba invadens
TQAPKNC

SEQ ID NO: 2836529 - protein, 11 aa, Entamoeba invadens
TQCSYSSSGDC

SEQ ID NO: 2836530 - protein, 15 aa, Entamoeba invadens
TQDAGQFALNFKIST

SEQ ID NO: 2836531 - protein, 4 aa, Entamoeba invadens
TQDD

SEQ ID NO: 2836532 - protein, 4 aa, Entamoeba invadens
TQEV

SEQ ID NO: 2836533 - protein, 4 aa, Entamoeba invadens
TQIE

SEQ ID NO: 2836534 - protein, 5 aa, Entamoeba invadens
TQIEA

SEQ ID NO: 2836535 - protein, 6 aa, Entamoeba invadens
TQKEKC

SEQ ID NO: 2836536 - protein, 9 aa, Entamoeba invadens
TQLETNEKI

SEQ ID NO: 2836537 - protein, 11 aa, Entamoeba invadens
TQLNEEPTEIG

SEQ ID NO: 2836538 - protein, 18 aa, Entamoeba invadens
TQNDRKKFGNNIPSSVTS

SEQ ID NO: 2836539 - protein, 9 aa, Entamoeba invadens
TQNNTTNKV

SEQ ID NO: 2836540 - protein, 4 aa, Entamoeba invadens
TQNW

SEQ ID NO: 2836541 - protein, 4 aa, Entamoeba invadens
TQQS

SEQ ID NO: 2836542 - protein, 6 aa, Entamoeba invadens
TQSETC

SEQ ID NO: 2836543 - protein, 13 aa, Entamoeba invadens
TQSQTIEDGNTSM

SEQ ID NO: 2836544 - protein, 4 aa, Entamoeba invadens
TQTD

SEQ ID NO: 2836545 - protein, 5 aa, Entamoeba invadens
TQVSK

SEQ ID NO: 2836546 - protein, 8 aa, Entamoeba invadens
TRAYGGNK

SEQ ID NO: 2836547 - protein, 7 aa, Entamoeba invadens
TRDNPHK

SEQ ID NO: 2836548 - protein, 5 aa, Entamoeba invadens
TREVP

SEQ ID NO: 2836549 - protein, 4 aa, Entamoeba invadens
TRNA

SEQ ID NO: 2836550 - protein, 5 aa, Entamoeba invadens
TRSGL

SEQ ID NO: 2836551 - protein, 4 aa, Entamoeba invadens
TRSK

SEQ ID NO: 2836552 - protein, 6 aa, Entamoeba invadens
TRTAGT

SEQ ID NO: 2836553 - protein, 7 aa, Entamoeba invadens
TRVPYPS

SEQ ID NO: 2836554 - protein, 4 aa, Entamoeba invadens
TSAF

SEQ ID NO: 2836555 - protein, 12 aa, Entamoeba invadens
TSAKNNTNITET

SEQ ID NO: 2836556 - protein, 8 aa, Entamoeba invadens
TSAKSRIN

SEQ ID NO: 2836557 - protein, 10 aa, Entamoeba invadens
TSALDSVSEK

SEQ ID NO: 2836558 - protein, 4 aa, Entamoeba invadens
TSCE

SEQ ID NO: 2836559 - protein, 5 aa, Entamoeba invadens
TSDIK

SEQ ID NO: 2836560 - protein, 10 aa, Entamoeba invadens
TSDKNENCQL

SEQ ID NO: 2836561 - protein, 4 aa, Entamoeba invadens
TSEG

SEQ ID NO: 2836562 - protein, 4 aa, Entamoeba invadens
TSEI

SEQ ID NO: 2836563 - protein, 11 aa, Entamoeba invadens
TSERNNSGAQL

SEQ ID NO: 2836564 - protein, 15 aa, Entamoeba invadens
TSGAAKPIERDTRTT

SEQ ID NO: 2836565 - protein, 7 aa, Entamoeba invadens
TSGDERF

SEQ ID NO: 2836566 - protein, 4 aa, Entamoeba invadens
TSGE

SEQ ID NO: 2836567 - protein, 10 aa, Entamoeba invadens
TSGSDDLDEM

SEQ ID NO: 2836568 - protein, 5 aa, Entamoeba invadens
TSKGC

SEQ ID NO: 2836569 - protein, 4 aa, Entamoeba invadens
TSKI

SEQ ID NO: 2836570 - protein, 5 aa, Entamoeba invadens
TSKTK

SEQ ID NO: 2836571 - protein, 4 aa, Entamoeba invadens
TSKY

SEQ ID NO: 2836572 - protein, 4 aa, Entamoeba invadens
TSND

SEQ ID NO: 2836573 - protein, 5 aa, Entamoeba invadens
TSNGN

SEQ ID NO: 2836574 - protein, 7 aa, Entamoeba invadens
TSNTPNM

SEQ ID NO: 2836575 - protein, 7 aa, Entamoeba invadens
TSPPSTV

SEQ ID NO: 2836576 - protein, 8 aa, Entamoeba invadens
TSPSSVEI

SEQ ID NO: 2836577 - protein, 8 aa, Entamoeba invadens
TSQEVTHK

SEQ ID NO: 2836578 - protein, 11 aa, Entamoeba invadens
TSQLSGEETSI

SEQ ID NO: 2836579 - protein, 13 aa, Entamoeba invadens
TSRGSADKKQFAI

SEQ ID NO: 2836580 - protein, 6 aa, Entamoeba invadens
TSRGTE

SEQ ID NO: 2836581 - protein, 5 aa, Entamoeba invadens
TSSFD

SEQ ID NO: 2836582 - protein, 6 aa, Entamoeba invadens
TSSLDK

SEQ ID NO: 2836583 - protein, 4 aa, Entamoeba invadens
TSSS

SEQ ID NO: 2836584 - protein, 9 aa, Entamoeba invadens
TSSTDSTVD

SEQ ID NO: 2836585 - protein, 5 aa, Entamoeba invadens
TSSTI

SEQ ID NO: 2836586 - protein, 6 aa, Entamoeba invadens
TSTQGS

SEQ ID NO: 2836587 - protein, 4 aa, Entamoeba invadens
TSYK

SEQ ID NO: 2836588 - protein, 4 aa, Entamoeba invadens
TSYT

SEQ ID NO: 2836589 - protein, 12 aa, Entamoeba invadens
TTCGGSCDATNG

SEQ ID NO: 2836590 - protein, 4 aa, Entamoeba invadens
TTDN

SEQ ID NO: 2836591 - protein, 8 aa, Entamoeba invadens
TTDTQCNS

SEQ ID NO: 2836592 - protein, 4 aa, Entamoeba invadens
TTEA

SEQ ID NO: 2836593 - protein, 8 aa, Entamoeba invadens
TTEGEEIY

SEQ ID NO: 2836594 - protein, 4 aa, Entamoeba invadens
TTEN

SEQ ID NO: 2836595 - protein, 8 aa, Entamoeba invadens
TTENPSFE

SEQ ID NO: 2836596 - protein, 6 aa, Entamoeba invadens
TTEPYF

SEQ ID NO: 2836597 - protein, 4 aa, Entamoeba invadens
TTEV

SEQ ID NO: 2836598 - protein, 6 aa, Entamoeba invadens
TTHNKE

SEQ ID NO: 2836599 - protein, 5 aa, Entamoeba invadens
TTKEH

SEQ ID NO: 2836600 - protein, 7 aa, Entamoeba invadens
TTKSGAI

SEQ ID NO: 2836601 - protein, 9 aa, Entamoeba invadens
TTKYEKRGI

SEQ ID NO: 2836602 - protein, 5 aa, Entamoeba invadens
TTLNR

SEQ ID NO: 2836603 - protein, 7 aa, Entamoeba invadens
TTNEKVE

SEQ ID NO: 2836604 - protein, 9 aa, Entamoeba invadens
TTNKCDTIQ

SEQ ID NO: 2836605 - protein, 13 aa, Entamoeba invadens
TTNPNINTKQDAF

SEQ ID NO: 2836606 - protein, 4 aa, Entamoeba invadens
TTPE

SEQ ID NO: 2836607 - protein, 4 aa, Entamoeba invadens
TTPS

SEQ ID NO: 2836608 - protein, 5 aa, Entamoeba invadens
TTQKE

SEQ ID NO: 2836609 - protein, 5 aa, Entamoeba invadens
TTQNV

SEQ ID NO: 2836610 - protein, 7 aa, Entamoeba invadens
TTQPNIN

SEQ ID NO: 2836611 - protein, 11 aa, Entamoeba invadens
TTQTQKVKSKQ

SEQ ID NO: 2836612 - protein, 5 aa, Entamoeba invadens
TTSAK

SEQ ID NO: 2836613 - protein, 5 aa, Entamoeba invadens
TTTHI

SEQ ID NO: 2836614 - protein, 4 aa, Entamoeba invadens
TTYS

SEQ ID NO: 2836615 - protein, 4 aa, Entamoeba invadens
TVCE

SEQ ID NO: 2836616 - protein, 6 aa, Entamoeba invadens
TVDGEQ

SEQ ID NO: 2836617 - protein, 10 aa, Entamoeba invadens
TVDKNKGRNI

SEQ ID NO: 2836618 - protein, 10 aa, Entamoeba invadens
TVDKNKSRNI

SEQ ID NO: 2836619 - protein, 10 aa, Entamoeba invadens
TVDQNKSRNI

SEQ ID NO: 2836620 - protein, 5 aa, Entamoeba invadens
TVETA

SEQ ID NO: 2836621 - protein, 10 aa, Entamoeba invadens
TVHDNGSYYS

SEQ ID NO: 2836622 - protein, 5 aa, Entamoeba invadens
TVSPG

SEQ ID NO: 2836623 - protein, 20 aa, Entamoeba invadens
TYTKNDRKKFGNNIPSSVTS

SEQ ID NO: 2836624 - protein, 20 aa, Entamoeba invadens
TYTNNDRNKYGNNLPPNVTS

SEQ ID NO: 2836625 - protein, 20 aa, Entamoeba invadens
TYTQKDREEFGNNIPQNIGS

SEQ ID NO: 2836626 - protein, 16 aa, Entamoeba invadens
TYTQNNREKYGNNIPS

SEQ ID NO: 2836627 - protein, 10 aa, Entamoeba invadens
TYTRDDREKF

SEQ ID NO: 2836628 - protein, 14 aa, Entamoeba invadens
TYTSNNINKYGNTI

SEQ ID NO: 2836629 - protein, 17 aa, Entamoeba invadens
VAGGVDQVSSVSPQQYS

SEQ ID NO: 2836630 - protein, 9 aa, Entamoeba invadens
VAGKADAGA

SEQ ID NO: 2836631 - protein, 8 aa, Entamoeba invadens
VAKTTSMS

SEQ ID NO: 2836632 - protein, 4 aa, Entamoeba invadens
VAPE

SEQ ID NO: 2836633 - protein, 37 aa, Entamoeba invadens
VAQHEKKERAKEDADIKKEAEDKAQEEEESLESVTDP

SEQ ID NO: 2836634 - protein, 4 aa, Entamoeba invadens
VARK

SEQ ID NO: 2836635 - protein, 5 aa, Entamoeba invadens
VARKS

SEQ ID NO: 2836636 - protein, 7 aa, Entamoeba invadens
VASQTVK

SEQ ID NO: 2836637 - protein, 7 aa, Entamoeba invadens
VASRGLD

SEQ ID NO: 2836638 - protein, 50 aa, Entamoeba invadens
VATDKKAAEEAKKVKKEKVEKKPRKSTDKKTKKVDEEGKKNTLSKKAGLQ

SEQ ID NO: 2836639 - protein, 4 aa, Entamoeba invadens
VDDA

SEQ ID NO: 2836640 - protein, 6 aa, Entamoeba invadens
VDDENK

SEQ ID NO: 2836641 - protein, 5 aa, Entamoeba invadens
VDEET

SEQ ID NO: 2836642 - protein, 5 aa, Entamoeba invadens
VDEKT

SEQ ID NO: 2836643 - protein, 10 aa, Entamoeba invadens
VDENASYASE

SEQ ID NO: 2836644 - protein, 6 aa, Entamoeba invadens
VDGYEE

SEQ ID NO: 2836645 - protein, 4 aa, Entamoeba invadens
VDLG

SEQ ID NO: 2836646 - protein, 25 aa, Entamoeba invadens
VDLTEEKLKKDVEVRQKVNDEETIE

SEQ ID NO: 2836647 - protein, 5 aa, Entamoeba invadens
VDNSF

SEQ ID NO: 2836648 - protein, 8 aa, Entamoeba invadens
VDPNKPNI

SEQ ID NO: 2836649 - protein, 9 aa, Entamoeba invadens
VDRNKSRNI

SEQ ID NO: 2836650 - protein, 9 aa, Entamoeba invadens
VDSEKDDLR

SEQ ID NO: 2836651 - protein, 8 aa, Entamoeba invadens
VDSTTKDD

SEQ ID NO: 2836652 - protein, 11 aa, Entamoeba invadens
VEDASKIENYE

SEQ ID NO: 2836653 - protein, 4 aa, Entamoeba invadens
VEDG

SEQ ID NO: 2836654 - protein, 10 aa, Entamoeba invadens
VEDPGMTKYQ

SEQ ID NO: 2836655 - protein, 16 aa, Entamoeba invadens
VEEEKNKSSGLTDNEI

SEQ ID NO: 2836656 - protein, 16 aa, Entamoeba invadens
VEEEKNKSSGLTDNEM

SEQ ID NO: 2836657 - protein, 5 aa, Entamoeba invadens
VEEIG

SEQ ID NO: 2836658 - protein, 5 aa, Entamoeba invadens
VEETA

SEQ ID NO: 2836659 - protein, 8 aa, Entamoeba invadens
VEETANTF

SEQ ID NO: 2836660 - protein, 5 aa, Entamoeba invadens
VEEVE

SEQ ID NO: 2836661 - protein, 4 aa, Entamoeba invadens
VEGA

SEQ ID NO: 2836662 - protein, 14 aa, Entamoeba invadens
VEGTGLKKARNLNG

SEQ ID NO: 2836663 - protein, 7 aa, Entamoeba invadens
VEIDSTQ

SEQ ID NO: 2836664 - protein, 5 aa, Entamoeba invadens
VEIPP

SEQ ID NO: 2836665 - protein, 5 aa, Entamoeba invadens
VEKGK

SEQ ID NO: 2836666 - protein, 10 aa, Entamoeba invadens
VEKNGEYITD

SEQ ID NO: 2836667 - protein, 6 aa, Entamoeba invadens
VENAAE

SEQ ID NO: 2836668 - protein, 22 aa, Entamoeba invadens
VENTATPHFGKQSHSKENKCVL

SEQ ID NO: 2836669 - protein, 14 aa, Entamoeba invadens
VEQKVQTPATTQKV

SEQ ID NO: 2836670 - protein, 8 aa, Entamoeba invadens
VERPTRIT

SEQ ID NO: 2836671 - protein, 4 aa, Entamoeba invadens
VESG

SEQ ID NO: 2836672 - protein, 4 aa, Entamoeba invadens
VESI

SEQ ID NO: 2836673 - protein, 5 aa, Entamoeba invadens
VESLG

SEQ ID NO: 2836674 - protein, 5 aa, Entamoeba invadens
VESLS

SEQ ID NO: 2836675 - protein, 4 aa, Entamoeba invadens
VETK

SEQ ID NO: 2836676 - protein, 5 aa, Entamoeba invadens
VETTL

SEQ ID NO: 2836677 - protein, 6 aa, Entamoeba invadens
VGDDTM

SEQ ID NO: 2836678 - protein, 10 aa, Entamoeba invadens
VGESGDRLTR

SEQ ID NO: 2836679 - protein, 9 aa, Entamoeba invadens
VGGGTGSGF

SEQ ID NO: 2836680 - protein, 7 aa, Entamoeba invadens
VGGSIKT

SEQ ID NO: 2836681 - protein, 4 aa, Entamoeba invadens
VGKS

SEQ ID NO: 2836682 - protein, 6 aa, Entamoeba invadens
VGKSSI

SEQ ID NO: 2836683 - protein, 6 aa, Entamoeba invadens
VGPDVT

SEQ ID NO: 2836684 - protein, 7 aa, Entamoeba invadens
VGPETEN

SEQ ID NO: 2836685 - protein, 5 aa, Entamoeba invadens
VGSSQ

SEQ ID NO: 2836686 - protein, 8 aa, Entamoeba invadens
VGVATNKT

SEQ ID NO: 2836687 - protein, 4 aa, Entamoeba invadens
VHPD

SEQ ID NO: 2836688 - protein, 4 aa, Entamoeba invadens
VHPG

SEQ ID NO: 2836689 - protein, 11 aa, Entamoeba invadens
VHTETDEVEDK

SEQ ID NO: 2836690 - protein, 13 aa, Entamoeba invadens
VKADKDESSPYAA

SEQ ID NO: 2836691 - protein, 8 aa, Entamoeba invadens
VKCDSDRY

SEQ ID NO: 2836692 - protein, 11 aa, Entamoeba invadens
VKDNDNGAAVA

SEQ ID NO: 2836693 - protein, 5 aa, Entamoeba invadens
VKESK

SEQ ID NO: 2836694 - protein, 7 aa, Entamoeba invadens
VKESKNP

SEQ ID NO: 2836695 - protein, 12 aa, Entamoeba invadens
VKIDGKVRTDSR

SEQ ID NO: 2836696 - protein, 6 aa, Entamoeba invadens
VKKAEE

SEQ ID NO: 2836697 - protein, 19 aa, Entamoeba invadens
VKNDPQKQFGKKKENPFKI

SEQ ID NO: 2836698 - protein, 11 aa, Entamoeba invadens
VKNNKGDIQYD

SEQ ID NO: 2836699 - protein, 8 aa, Entamoeba invadens
VKNTSAKL

SEQ ID NO: 2836700 - protein, 5 aa, Entamoeba invadens
VKPAK

SEQ ID NO: 2836701 - protein, 4 aa, Entamoeba invadens
VKSE

SEQ ID NO: 2836702 - protein, 10 aa, Entamoeba invadens
VKSNKGDIQY

SEQ ID NO: 2836703 - protein, 8 aa, Entamoeba invadens
VKTLENGT

SEQ ID NO: 2836704 - protein, 5 aa, Entamoeba invadens
VKTQI

SEQ ID NO: 2836705 - protein, 6 aa, Entamoeba invadens
VKVPGI

SEQ ID NO: 2836706 - protein, 8 aa, Entamoeba invadens
VNDGQNEN

SEQ ID NO: 2836707 - protein, 10 aa, Entamoeba invadens
VNENGASNGF

SEQ ID NO: 2836708 - protein, 7 aa, Entamoeba invadens
VNERNGT

SEQ ID NO: 2836709 - protein, 9 aa, Entamoeba invadens
VNIPSNVTS

SEQ ID NO: 2836710 - protein, 11 aa, Entamoeba invadens
VNIPSSVKSIG

SEQ ID NO: 2836711 - protein, 8 aa, Entamoeba invadens
VNIPSSVT

SEQ ID NO: 2836712 - protein, 10 aa, Entamoeba invadens
VNIPSSVTSI

SEQ ID NO: 2836713 - protein, 7 aa, Entamoeba invadens
VNLPPPL

SEQ ID NO: 2836714 - protein, 7 aa, Entamoeba invadens
VNNRDKR

SEQ ID NO: 2836715 - protein, 7 aa, Entamoeba invadens
VNQNGLN

SEQ ID NO: 2836716 - protein, 4 aa, Entamoeba invadens
VNSN

SEQ ID NO: 2836717 - protein, 16 aa, Entamoeba invadens
VNTTLNDQKKSNDSFT

SEQ ID NO: 2836718 - protein, 4 aa, Entamoeba invadens
VPEE

SEQ ID NO: 2836719 - protein, 5 aa, Entamoeba invadens
VPGSS

SEQ ID NO: 2836720 - protein, 12 aa, Entamoeba invadens
VPGTYKAQNINN

SEQ ID NO: 2836721 - protein, 4 aa, Entamoeba invadens
VPKN

SEQ ID NO: 2836722 - protein, 4 aa, Entamoeba invadens
VPLP

SEQ ID NO: 2836723 - protein, 4 aa, Entamoeba invadens
VPPQ

SEQ ID NO: 2836724 - protein, 4 aa, Entamoeba invadens
VPRK

SEQ ID NO: 2836725 - protein, 6 aa, Entamoeba invadens
VPSSVT

SEQ ID NO: 2836726 - protein, 6 aa, Entamoeba invadens
VPSTTE

SEQ ID NO: 2836727 - protein, 4 aa, Entamoeba invadens
VPTM

SEQ ID NO: 2836728 - protein, 8 aa, Entamoeba invadens
VPTQNDGA

SEQ ID NO: 2836729 - protein, 8 aa, Entamoeba invadens
VPTQSDGA

SEQ ID NO: 2836730 - protein, 4 aa, Entamoeba invadens
VPTS

SEQ ID NO: 2836731 - protein, 11 aa, Entamoeba invadens
VPVPTDKIECP

SEQ ID NO: 2836732 - protein, 22 aa, Entamoeba invadens
VQAVSQSAANLHQANQVKNKDI

SEQ ID NO: 2836733 - protein, 4 aa, Entamoeba invadens
VQNE

SEQ ID NO: 2836734 - protein, 9 aa, Entamoeba invadens
VQPKSQQIR

SEQ ID NO: 2836735 - protein, 4 aa, Entamoeba invadens
VQQA

SEQ ID NO: 2836736 - protein, 11 aa, Entamoeba invadens
VQSGTTGDVQT

SEQ ID NO: 2836737 - protein, 6 aa, Entamoeba invadens
VRGSTT

SEQ ID NO: 2836738 - protein, 4 aa, Entamoeba invadens
VRQI

SEQ ID NO: 2836739 - protein, 12 aa, Entamoeba invadens
VRQKEDKSFQRE

SEQ ID NO: 2836740 - protein, 4 aa, Entamoeba invadens
VRSI

SEQ ID NO: 2836741 - protein, 7 aa, Entamoeba invadens
VRSQKKR

SEQ ID NO: 2836742 - protein, 15 aa, Entamoeba invadens
VSANPNGKMEKCSTN

SEQ ID NO: 2836743 - protein, 14 aa, Entamoeba invadens
VSAPASVAQEEEKN

SEQ ID NO: 2836744 - protein, 6 aa, Entamoeba invadens
VSATGK

SEQ ID NO: 2836745 - protein, 7 aa, Entamoeba invadens
VSDEDKE

SEQ ID NO: 2836746 - protein, 10 aa, Entamoeba invadens
VSEDELASYQ

SEQ ID NO: 2836747 - protein, 4 aa, Entamoeba invadens
VSEY

SEQ ID NO: 2836748 - protein, 9 aa, Entamoeba invadens
VSGESERGK

SEQ ID NO: 2836749 - protein, 4 aa, Entamoeba invadens
VSGR

SEQ ID NO: 2836750 - protein, 20 aa, Entamoeba invadens
VSGSISPRFDTSMSPKSHDY

SEQ ID NO: 2836751 - protein, 8 aa, Entamoeba invadens
VSHNTRAQ

SEQ ID NO: 2836752 - protein, 8 aa, Entamoeba invadens
VSIPPSVK

SEQ ID NO: 2836753 - protein, 6 aa, Entamoeba invadens
VSLPPT

SEQ ID NO: 2836754 - protein, 6 aa, Entamoeba invadens
VSNKTT

SEQ ID NO: 2836755 - protein, 4 aa, Entamoeba invadens
VSNL

SEQ ID NO: 2836756 - protein, 4 aa, Entamoeba invadens
VSRK

SEQ ID NO: 2836757 - protein, 8 aa, Entamoeba invadens
VSSGHPDK

SEQ ID NO: 2836758 - protein, 4 aa, Entamoeba invadens
VSSI

SEQ ID NO: 2836759 - protein, 5 aa, Entamoeba invadens
VSSIG

SEQ ID NO: 2836760 - protein, 19 aa, Entamoeba invadens
VTDSEAKLADAGATGASIA

SEQ ID NO: 2836761 - protein, 4 aa, Entamoeba invadens
VTEK

SEQ ID NO: 2836762 - protein, 20 aa, Entamoeba invadens
VTEMRKGQKVDSKDSETQYE

SEQ ID NO: 2836763 - protein, 8 aa, Entamoeba invadens
VTGGGQVS

SEQ ID NO: 2836764 - protein, 19 aa, Entamoeba invadens
VTHGRPGVGATHSSKFVPL

SEQ ID NO: 2836765 - protein, 7 aa, Entamoeba invadens
VTIPSSV

SEQ ID NO: 2836766 - protein, 10 aa, Entamoeba invadens
VTIPSSVSSL

SEQ ID NO: 2836767 - protein, 8 aa, Entamoeba invadens
VTIPSSVT

SEQ ID NO: 2836768 - protein, 11 aa, Entamoeba invadens
VTIPSSVTSIG

SEQ ID NO: 2836769 - protein, 6 aa, Entamoeba invadens
VTIPTN

SEQ ID NO: 2836770 - protein, 9 aa, Entamoeba invadens
VTITTQKEG

SEQ ID NO: 2836771 - protein, 17 aa, Entamoeba invadens
VTKDVPDNTVVAGNPAR

SEQ ID NO: 2836772 - protein, 6 aa, Entamoeba invadens
VTKGRV

SEQ ID NO: 2836773 - protein, 5 aa, Entamoeba invadens
VTLPN

SEQ ID NO: 2836774 - protein, 7 aa, Entamoeba invadens
VTLPTTV

SEQ ID NO: 2836775 - protein, 7 aa, Entamoeba invadens
VTNEDEK

SEQ ID NO: 2836776 - protein, 13 aa, Entamoeba invadens
VTNTTKNTDSSKC

SEQ ID NO: 2836777 - protein, 17 aa, Entamoeba invadens
VTPPLQTRPTSNGNKHQ

SEQ ID NO: 2836778 - protein, 5 aa, Entamoeba invadens
VTPPT

SEQ ID NO: 2836779 - protein, 4 aa, Entamoeba invadens
VTPS

SEQ ID NO: 2836780 - protein, 4 aa, Entamoeba invadens
VTQH

SEQ ID NO: 2836781 - protein, 4 aa, Entamoeba invadens
VTQT

SEQ ID NO: 2836782 - protein, 7 aa, Entamoeba invadens
VTRAPTL

SEQ ID NO: 2836783 - protein, 12 aa, Entamoeba invadens
VTSNTQKREDEQ

SEQ ID NO: 2836784 - protein, 4 aa, Entamoeba invadens
VTSS

SEQ ID NO: 2836785 - protein, 4 aa, Entamoeba invadens
VTTS

SEQ ID NO: 2836786 - protein, 8 aa, Entamoeba invadens
VVPKGTPV

SEQ ID NO: 2836787 - protein, 6 aa, Entamoeba invadens
VVSTEE

SEQ ID NO: 2836788 - protein, 10 aa, Entamoeba invadens
VYSPDEKNES

SEQ ID NO: 2836789 - protein, 22 aa, Entamoeba invadens
WGAHGGGAFSGKDSSKVDRSGA

SEQ ID NO: 2836790 - protein, 8 aa, Entamoeba invadens
WGKSYGTC

SEQ ID NO: 2836791 - protein, 5 aa, Entamoeba invadens
WGTGR

SEQ ID NO: 2836792 - protein, 4 aa, Entamoeba invadens
WPTW

SEQ ID NO: 2836793 - protein, 5 aa, Entamoeba invadens
WRHPR

SEQ ID NO: 2836794 - protein, 9 aa, Entamoeba invadens
WRRKDGTTL

SEQ ID NO: 2836795 - protein, 21 aa, Entamoeba invadens
WTSPEVAKEGDNHLKYNEKSD

SEQ ID NO: 2836796 - protein, 8 aa, Entamoeba invadens
YAADPRVK

SEQ ID NO: 2836797 - protein, 27 aa, Entamoeba invadens
YADTDAADKKKLNGTVNESNKKIEELS

SEQ ID NO: 2836798 - protein, 5 aa, Entamoeba invadens
YAETD

SEQ ID NO: 2836799 - protein, 5 aa, Entamoeba invadens
YANNG

SEQ ID NO: 2836800 - protein, 7 aa, Entamoeba invadens
YANNNTA

SEQ ID NO: 2836801 - protein, 20 aa, Entamoeba invadens
YDAAEKAKNAQKGMHASYEQ

SEQ ID NO: 2836802 - protein, 4 aa, Entamoeba invadens
YDEL

SEQ ID NO: 2836803 - protein, 4 aa, Entamoeba invadens
YDGP

SEQ ID NO: 2836804 - protein, 5 aa, Entamoeba invadens
YDKNE

SEQ ID NO: 2836805 - protein, 4 aa, Entamoeba invadens
YDKS

SEQ ID NO: 2836806 - protein, 9 aa, Entamoeba invadens
YDPKNGNQV

SEQ ID NO: 2836807 - protein, 4 aa, Entamoeba invadens
YDSN

SEQ ID NO: 2836808 - protein, 6 aa, Entamoeba invadens
YDSNTD

SEQ ID NO: 2836809 - protein, 8 aa, Entamoeba invadens
YDSTYTFP

SEQ ID NO: 2836810 - protein, 4 aa, Entamoeba invadens
YDTD

SEQ ID NO: 2836811 - protein, 4 aa, Entamoeba invadens
YEAP

SEQ ID NO: 2836812 - protein, 9 aa, Entamoeba invadens
YEDNDGHLT

SEQ ID NO: 2836813 - protein, 5 aa, Entamoeba invadens
YEEKG

SEQ ID NO: 2836814 - protein, 9 aa, Entamoeba invadens
YEEKSRTCL

SEQ ID NO: 2836815 - protein, 10 aa, Entamoeba invadens
YEKNKNPNIK

SEQ ID NO: 2836816 - protein, 5 aa, Entamoeba invadens
YEKPD

SEQ ID NO: 2836817 - protein, 9 aa, Entamoeba invadens
YELKGSNNQ

SEQ ID NO: 2836818 - protein, 6 aa, Entamoeba invadens
YENEAK

SEQ ID NO: 2836819 - protein, 9 aa, Entamoeba invadens
YENKEFTKC

SEQ ID NO: 2836820 - protein, 12 aa, Entamoeba invadens
YENTRSQETEPT

SEQ ID NO: 2836821 - protein, 4 aa, Entamoeba invadens
YEPN

SEQ ID NO: 2836822 - protein, 14 aa, Entamoeba invadens
YETNLQKSRQSNLS

SEQ ID NO: 2836823 - protein, 10 aa, Entamoeba invadens
YETTQVEVKP

SEQ ID NO: 2836824 - protein, 12 aa, Entamoeba invadens
YEVKDKNSSSIK

SEQ ID NO: 2836825 - protein, 11 aa, Entamoeba invadens
YEVKPGAKTTI

SEQ ID NO: 2836826 - protein, 4 aa, Entamoeba invadens
YEVP

SEQ ID NO: 2836827 - protein, 10 aa, Entamoeba invadens
YGAERENDQD

SEQ ID NO: 2836828 - protein, 12 aa, Entamoeba invadens
YGEEMGGHKGYG

SEQ ID NO: 2836829 - protein, 6 aa, Entamoeba invadens
YGGPRE

SEQ ID NO: 2836830 - protein, 7 aa, Entamoeba invadens
YGKPSDS

SEQ ID NO: 2836831 - protein, 4 aa, Entamoeba invadens
YGPF

SEQ ID NO: 2836832 - protein, 7 aa, Entamoeba invadens
YGPNTKR

SEQ ID NO: 2836833 - protein, 17 aa, Entamoeba invadens
YGQEGQNEQEEHNGQYG

SEQ ID NO: 2836834 - protein, 4 aa, Entamoeba invadens
YGSL

SEQ ID NO: 2836835 - protein, 7 aa, Entamoeba invadens
YGSTETF

SEQ ID NO: 2836836 - protein, 9 aa, Entamoeba invadens
YGSYTQSAT

SEQ ID NO: 2836837 - protein, 6 aa, Entamoeba invadens
YHQPTT

SEQ ID NO: 2836838 - protein, 10 aa, Entamoeba invadens
YHSTAQSDNI

SEQ ID NO: 2836839 - protein, 30 aa, Entamoeba invadens
YIKEAQSAAEKYIEEPRHQRPKKGSKKQLD

SEQ ID NO: 2836840 - protein, 7 aa, Entamoeba invadens
YIPTDSK

SEQ ID NO: 2836841 - protein, 9 aa, Entamoeba invadens
YKDDRNTKE

SEQ ID NO: 2836842 - protein, 4 aa, Entamoeba invadens
YKEN

SEQ ID NO: 2836843 - protein, 6 aa, Entamoeba invadens
YKENDE

SEQ ID NO: 2836844 - protein, 9 aa, Entamoeba invadens
YKENKYEKT

SEQ ID NO: 2836845 - protein, 4 aa, Entamoeba invadens
YKFE

SEQ ID NO: 2836846 - protein, 9 aa, Entamoeba invadens
YKGQTDAKT

SEQ ID NO: 2836847 - protein, 6 aa, Entamoeba invadens
YKGRTV

SEQ ID NO: 2836848 - protein, 4 aa, Entamoeba invadens
YKGY

SEQ ID NO: 2836849 - protein, 12 aa, Entamoeba invadens
YKKDGKPRVNTE

SEQ ID NO: 2836850 - protein, 14 aa, Entamoeba invadens
YKPRESDDYDDSRF

SEQ ID NO: 2836851 - protein, 4 aa, Entamoeba invadens
YKPT

SEQ ID NO: 2836852 - protein, 9 aa, Entamoeba invadens
YKQNSTVDV

SEQ ID NO: 2836853 - protein, 4 aa, Entamoeba invadens
YKQT

SEQ ID NO: 2836854 - protein, 9 aa, Entamoeba invadens
YKRETSKVD

SEQ ID NO: 2836855 - protein, 22 aa, Entamoeba invadens
YKSTGVSKSTHGNVVWYDMILQ

SEQ ID NO: 2836856 - protein, 4 aa, Entamoeba invadens
YKTR

SEQ ID NO: 2836857 - protein, 15 aa, Entamoeba invadens
YLEEQKKKAEGAGQG

SEQ ID NO: 2836858 - protein, 9 aa, Entamoeba invadens
YNANKNQRR

SEQ ID NO: 2836859 - protein, 4 aa, Entamoeba invadens
YNGN

SEQ ID NO: 2836860 - protein, 6 aa, Entamoeba invadens
YNGNTK

SEQ ID NO: 2836861 - protein, 19 aa, Entamoeba invadens
YNPEPTITENNGKVSTNTS

SEQ ID NO: 2836862 - protein, 10 aa, Entamoeba invadens
YNPNYAAKNY

SEQ ID NO: 2836863 - protein, 7 aa, Entamoeba invadens
YNPTRKR

SEQ ID NO: 2836864 - protein, 6 aa, Entamoeba invadens
YNTKGD

SEQ ID NO: 2836865 - protein, 4 aa, Entamoeba invadens
YPKD

SEQ ID NO: 2836866 - protein, 9 aa, Entamoeba invadens
YPNDSGKCV

SEQ ID NO: 2836867 - protein, 15 aa, Entamoeba invadens
YPNFAQEDPRSDDTY

SEQ ID NO: 2836868 - protein, 11 aa, Entamoeba invadens
YPPNGYNKSDY

SEQ ID NO: 2836869 - protein, 8 aa, Entamoeba invadens
YPYNPNSV

SEQ ID NO: 2836870 - protein, 5 aa, Entamoeba invadens
YQEVE

SEQ ID NO: 2836871 - protein, 19 aa, Entamoeba invadens
YQQNAQPRDLTKDYSVCRI

SEQ ID NO: 2836872 - protein, 9 aa, Entamoeba invadens
YQSEDTENR

SEQ ID NO: 2836873 - protein, 4 aa, Entamoeba invadens
YRDT

SEQ ID NO: 2836874 - protein, 4 aa, Entamoeba invadens
YRDV

SEQ ID NO: 2836875 - protein, 7 aa, Entamoeba invadens
YREKQIS

SEQ ID NO: 2836876 - protein, 9 aa, Entamoeba invadens
YREKQNSQN

SEQ ID NO: 2836877 - protein, 8 aa, Entamoeba invadens
YRNEKDKN

SEQ ID NO: 2836878 - protein, 5 aa, Entamoeba invadens
YRQNA

SEQ ID NO: 2836879 - protein, 8 aa, Entamoeba invadens
YRRGQRNI

SEQ ID NO: 2836880 - protein, 12 aa, Entamoeba invadens
YRRNCDEDAKYE

SEQ ID NO: 2836881 - protein, 15 aa, Entamoeba invadens
YSDTEKCTKTDEQQY

SEQ ID NO: 2836882 - protein, 4 aa, Entamoeba invadens
YSES

SEQ ID NO: 2836883 - protein, 5 aa, Entamoeba invadens
YSETL

SEQ ID NO: 2836884 - protein, 12 aa, Entamoeba invadens
YSKITDNVTINS

SEQ ID NO: 2836885 - protein, 4 aa, Entamoeba invadens
YSNP

SEQ ID NO: 2836886 - protein, 15 aa, Entamoeba invadens
YSNTGGQKSKATNLG

SEQ ID NO: 2836887 - protein, 12 aa, Entamoeba invadens
YSPNGAPKVDTN

SEQ ID NO: 2836888 - protein, 4 aa, Entamoeba invadens
YSQG

SEQ ID NO: 2836889 - protein, 4 aa, Entamoeba invadens
YSSD

SEQ ID NO: 2836890 - protein, 4 aa, Entamoeba invadens
YSSN

SEQ ID NO: 2836891 - protein, 13 aa, Entamoeba invadens
YSTNKTPRGKTHK

SEQ ID NO: 2836892 - protein, 4 aa, Entamoeba invadens
YTEL

SEQ ID NO: 2836893 - protein, 8 aa, Entamoeba invadens
YTENGKEK

SEQ ID NO: 2836894 - protein, 9 aa, Entamoeba invadens
YTENGKEKY

SEQ ID NO: 2836895 - protein, 23 aa, Entamoeba invadens
YTEQDTNDSYKDVSNGDENGVTK

SEQ ID NO: 2836896 - protein, 6 aa, Entamoeba invadens
YTGEGI

SEQ ID NO: 2836897 - protein, 8 aa, Entamoeba invadens
YTGTETDA

SEQ ID NO: 2836898 - protein, 7 aa, Entamoeba invadens
YTIEEEK

SEQ ID NO: 2836899 - protein, 5 aa, Entamoeba invadens
YTNCE

SEQ ID NO: 2836900 - protein, 4 aa, Entamoeba invadens
YTPI

SEQ ID NO: 2836901 - protein, 15 aa, Entamoeba invadens
YTPQSYPALPDTSNH

SEQ ID NO: 2836902 - protein, 14 aa, Entamoeba invadens
YTPRGAQARNGKDW

SEQ ID NO: 2836903 - protein, 6 aa, Entamoeba invadens
YTPSNS

SEQ ID NO: 2836904 - protein, 4 aa, Entamoeba invadens
YTSD

SEQ ID NO: 2836905 - protein, 8 aa, Entamoeba invadens
YTSETTRT

SEQ ID NO: 2836906 - protein, 7 aa, Entamoeba invadens
YTYNETS

SEQ ID NO: 2836907 - protein, 10 aa, Entamoeba invadens
YYKDTKRAEL

SEQ ID NO: 2836908 - protein, 6 aa, Entamoeba invadens
YYKRET

SEQ ID NO: 2836909 - protein, 8 aa, Entamoeba invadens
YYPDDGKC

SEQ ID NO: 2836910 - protein, 8 aa, Entamoeba invadens
YYPDEGKC

SEQ ID NO: 2836911 - protein, 4 aa, Entamoeba invadens
YYPK

SEQ ID NO: 2836912 - protein, 4 aa, Entamoeba invadens
YYTP

SEQ ID NO: 2836913 - protein, 24 aa, Entamoeba invadens
AAAAAKKYGKDEIGFGSAKGRDQQ

SEQ ID NO: 2836914 - protein, 7 aa, Entamoeba invadens
AAAADGV

SEQ ID NO: 2836915 - protein, 7 aa, Entamoeba invadens
AAADKLS

SEQ ID NO: 2836916 - protein, 24 aa, Entamoeba invadens
AAADPNNTYADGAGVTECQAGTGP

SEQ ID NO: 2836917 - protein, 4 aa, Entamoeba invadens
AAAE

SEQ ID NO: 2836918 - protein, 7 aa, Entamoeba invadens
AAAENHD

SEQ ID NO: 2836919 - protein, 7 aa, Entamoeba invadens
AAAKEGL

SEQ ID NO: 2836920 - protein, 14 aa, Entamoeba invadens
AAAKEKDKKFSNTV

SEQ ID NO: 2836921 - protein, 26 aa, Entamoeba invadens
AAAKELAEKLAKKEKAPKVTKNTAVK

SEQ ID NO: 2836922 - protein, 27 aa, Entamoeba invadens
AAAKELAEKLAKKEKAPKVTKNTEVKP

SEQ ID NO: 2836923 - protein, 7 aa, Entamoeba invadens
AAALGAK

SEQ ID NO: 2836924 - protein, 4 aa, Entamoeba invadens
AAAN

SEQ ID NO: 2836925 - protein, 11 aa, Entamoeba invadens
AAANEEKDSSA

SEQ ID NO: 2836926 - protein, 6 aa, Entamoeba invadens
AAANYG

SEQ ID NO: 2836927 - protein, 10 aa, Entamoeba invadens
AAAPAESDTY

SEQ ID NO: 2836928 - protein, 25 aa, Entamoeba invadens
AAAPGNSTLQAPSAPISAASQYVPK

SEQ ID NO: 2836929 - protein, 28 aa, Entamoeba invadens
AAAPPLTEQEEEREKEIELGTAGYTVST

SEQ ID NO: 2836930 - protein, 7 aa, Entamoeba invadens
AAAPQPP

SEQ ID NO: 2836931 - protein, 8 aa, Entamoeba invadens
AAAPTYYK

SEQ ID NO: 2836932 - protein, 8 aa, Entamoeba invadens
AAAQGDSD

SEQ ID NO: 2836933 - protein, 8 aa, Entamoeba invadens
AAARNPSF

SEQ ID NO: 2836934 - protein, 11 aa, Entamoeba invadens
AAASNTDSGKY

SEQ ID NO: 2836935 - protein, 7 aa, Entamoeba invadens
AAATEAA

SEQ ID NO: 2836936 - protein, 6 aa, Entamoeba invadens
AAATGI

SEQ ID NO: 2836937 - protein, 7 aa, Entamoeba invadens
AACENAK

SEQ ID NO: 2836938 - protein, 4 aa, Entamoeba invadens
AADE

SEQ ID NO: 2836939 - protein, 10 aa, Entamoeba invadens
AADEPRKPEM

SEQ ID NO: 2836940 - protein, 14 aa, Entamoeba invadens
AADGRDNVTCVVCK

SEQ ID NO: 2836941 - protein, 7 aa, Entamoeba invadens
AADKAQV

SEQ ID NO: 2836942 - protein, 19 aa, Entamoeba invadens
AADKESSDETKATMDKEQH

SEQ ID NO: 2836943 - protein, 24 aa, Entamoeba invadens
AADKGNTSGNPQRPPVPQSQVAQG

SEQ ID NO: 2836944 - protein, 9 aa, Entamoeba invadens
AADNSRNRD

SEQ ID NO: 2836945 - protein, 4 aa, Entamoeba invadens
AADP

SEQ ID NO: 2836946 - protein, 17 aa, Entamoeba invadens
AADREQLKNLKGEERTK

SEQ ID NO: 2836947 - protein, 10 aa, Entamoeba invadens
AAEAADSRDT

SEQ ID NO: 2836948 - protein, 9 aa, Entamoeba invadens
AAEAKHKTL

SEQ ID NO: 2836949 - protein, 16 aa, Entamoeba invadens
AAECAKTQQTPQTAQL

SEQ ID NO: 2836950 - protein, 22 aa, Entamoeba invadens
AAEDEKKRKEREEKKKEQEASI

SEQ ID NO: 2836951 - protein, 9 aa, Entamoeba invadens
AAEDKEKYY

SEQ ID NO: 2836952 - protein, 7 aa, Entamoeba invadens
AAEDNDT

SEQ ID NO: 2836953 - protein, 20 aa, Entamoeba invadens
AAEEAESAVEEANAKVAEAE

SEQ ID NO: 2836954 - protein, 7 aa, Entamoeba invadens
AAEEEKL

SEQ ID NO: 2836955 - protein, 7 aa, Entamoeba invadens
AAEEHCN

SEQ ID NO: 2836956 - protein, 5 aa, Entamoeba invadens
AAEFE

SEQ ID NO: 2836957 - protein, 5 aa, Entamoeba invadens
AAEGE

SEQ ID NO: 2836958 - protein, 9 aa, Entamoeba invadens
AAEGEELAT

SEQ ID NO: 2836959 - protein, 7 aa, Entamoeba invadens
AAEGSFD

SEQ ID NO: 2836960 - protein, 10 aa, Entamoeba invadens
AAEIDGKKEK

SEQ ID NO: 2836961 - protein, 7 aa, Entamoeba invadens
AAEKDKN

SEQ ID NO: 2836962 - protein, 8 aa, Entamoeba invadens
AAEKDKSA

SEQ ID NO: 2836963 - protein, 13 aa, Entamoeba invadens
AAEKNTPKRNEKF

SEQ ID NO: 2836964 - protein, 9 aa, Entamoeba invadens
AAEKTKELR

SEQ ID NO: 2836965 - protein, 8 aa, Entamoeba invadens
AAEQKGME

SEQ ID NO: 2836966 - protein, 5 aa, Entamoeba invadens
AAEQT

SEQ ID NO: 2836967 - protein, 8 aa, Entamoeba invadens
AAESQDGW

SEQ ID NO: 2836968 - protein, 8 aa, Entamoeba invadens
AAESRPEI

SEQ ID NO: 2836969 - protein, 7 aa, Entamoeba invadens
AAETNSA

SEQ ID NO: 2836970 - protein, 6 aa, Entamoeba invadens
AAFPGN

SEQ ID NO: 2836971 - protein, 7 aa, Entamoeba invadens
AAFSGNS

SEQ ID NO: 2836972 - protein, 9 aa, Entamoeba invadens
AAFSKQSRN

SEQ ID NO: 2836973 - protein, 20 aa, Entamoeba invadens
AAGAKAPEVVTETKPVAQST

SEQ ID NO: 2836974 - protein, 5 aa, Entamoeba invadens
AAGDE

SEQ ID NO: 2836975 - protein, 9 aa, Entamoeba invadens
AAGEEQPRK

SEQ ID NO: 2836976 - protein, 15 aa, Entamoeba invadens
AAGEIRDEVSSSISN

SEQ ID NO: 2836977 - protein, 11 aa, Entamoeba invadens
AAGEKEQEAFN

SEQ ID NO: 2836978 - protein, 4 aa, Entamoeba invadens
AAGG

SEQ ID NO: 2836979 - protein, 12 aa, Entamoeba invadens
AAGGNRRPKKDL

SEQ ID NO: 2836980 - protein, 12 aa, Entamoeba invadens
AAGHFGNTEEVK

SEQ ID NO: 2836981 - protein, 9 aa, Entamoeba invadens
AAGKEKEDY

SEQ ID NO: 2836982 - protein, 9 aa, Entamoeba invadens
AAGKGSPVL

SEQ ID NO: 2836983 - protein, 6 aa, Entamoeba invadens
AAGLES

SEQ ID NO: 2836984 - protein, 10 aa, Entamoeba invadens
AAGNGYKENK

SEQ ID NO: 2836985 - protein, 5 aa, Entamoeba invadens
AAGSE

SEQ ID NO: 2836986 - protein, 4 aa, Entamoeba invadens
AAGT

SEQ ID NO: 2836987 - protein, 7 aa, Entamoeba invadens
AAGTDDG

SEQ ID NO: 2836988 - protein, 7 aa, Entamoeba invadens
AAGTGKS

SEQ ID NO: 2836989 - protein, 8 aa, Entamoeba invadens
AAGTGKSY

SEQ ID NO: 2836990 - protein, 8 aa, Entamoeba invadens
AAGTKAAT

SEQ ID NO: 2836991 - protein, 4 aa, Entamoeba invadens
AAGV

SEQ ID NO: 2836992 - protein, 13 aa, Entamoeba invadens
AAGVGSLKGYENT

SEQ ID NO: 2836993 - protein, 7 aa, Entamoeba invadens
AAHAQPV

SEQ ID NO: 2836994 - protein, 7 aa, Entamoeba invadens
AAHEGTK

SEQ ID NO: 2836995 - protein, 34 aa, Entamoeba invadens
AAHKADTTSSTKSEASSKKNTKKRTLKGVDSDSD

SEQ ID NO: 2836996 - protein, 11 aa, Entamoeba invadens
AAHSTDDTTSL

SEQ ID NO: 2836997 - protein, 6 aa, Entamoeba invadens
AAIGED

SEQ ID NO: 2836998 - protein, 8 aa, Entamoeba invadens
AAIPAESS

SEQ ID NO: 2836999 - protein, 7 aa, Entamoeba invadens
AAISQKI

SEQ ID NO: 2837000 - protein, 8 aa, Entamoeba invadens
AAITRGKQ

SEQ ID NO: 2837001 - protein, 8 aa, Entamoeba invadens
AAKAEAAL

SEQ ID NO: 2837002 - protein, 8 aa, Entamoeba invadens
AAKAGFTG

SEQ ID NO: 2837003 - protein, 9 aa, Entamoeba invadens
AAKANVSQD

SEQ ID NO: 2837004 - protein, 13 aa, Entamoeba invadens
AAKDCYYKKAVET

SEQ ID NO: 2837005 - protein, 10 aa, Entamoeba invadens
AAKDYQKQNI

SEQ ID NO: 2837006 - protein, 9 aa, Entamoeba invadens
AAKEHAKTV

SEQ ID NO: 2837007 - protein, 22 aa, Entamoeba invadens
AAKEKKKIIKKANEELTTSKKF

SEQ ID NO: 2837008 - protein, 6 aa, Entamoeba invadens
AAKESF

SEQ ID NO: 2837009 - protein, 23 aa, Entamoeba invadens
AAKETIEKNTAEAEKTETNTEAL

SEQ ID NO: 2837010 - protein, 7 aa, Entamoeba invadens
AAKGRIS

SEQ ID NO: 2837011 - protein, 13 aa, Entamoeba invadens
AAKISGLSTRIKN

SEQ ID NO: 2837012 - protein, 7 aa, Entamoeba invadens
AAKKEGL

SEQ ID NO: 2837013 - protein, 10 aa, Entamoeba invadens
AAKKKKKPIK

SEQ ID NO: 2837014 - protein, 10 aa, Entamoeba invadens
AAKKNQEFEG

SEQ ID NO: 2837015 - protein, 13 aa, Entamoeba invadens
AAKKSKKLAKKRK

SEQ ID NO: 2837016 - protein, 18 aa, Entamoeba invadens
AAKKVQKKKKNTTKTENF

SEQ ID NO: 2837017 - protein, 10 aa, Entamoeba invadens
AAKLSQKSGI

SEQ ID NO: 2837018 - protein, 6 aa, Entamoeba invadens
AAKNNS

SEQ ID NO: 2837019 - protein, 4 aa, Entamoeba invadens
AAKQ

SEQ ID NO: 2837020 - protein, 5 aa, Entamoeba invadens
AAKRI

SEQ ID NO: 2837021 - protein, 6 aa, Entamoeba invadens
AAKRNC

SEQ ID NO: 2837022 - protein, 13 aa, Entamoeba invadens
AAKRSGFAGRSFG

SEQ ID NO: 2837023 - protein, 6 aa, Entamoeba invadens
AAKSGV

SEQ ID NO: 2837024 - protein, 9 aa, Entamoeba invadens
AAKSSDLSK

SEQ ID NO: 2837025 - protein, 10 aa, Entamoeba invadens
AAKTGSGKTL

SEQ ID NO: 2837026 - protein, 16 aa, Entamoeba invadens
AAKTYKQSKNTYEKEL

SEQ ID NO: 2837027 - protein, 16 aa, Entamoeba invadens
AALEPPKELDKSKSVN

SEQ ID NO: 2837028 - protein, 7 aa, Entamoeba invadens
AALGDES

SEQ ID NO: 2837029 - protein, 9 aa, Entamoeba invadens
AALGSGGLG

SEQ ID NO: 2837030 - protein, 6 aa, Entamoeba invadens
AALNDK

SEQ ID NO: 2837031 - protein, 6 aa, Entamoeba invadens
AALSTE

SEQ ID NO: 2837032 - protein, 11 aa, Entamoeba invadens
AALTGHPLDSK

SEQ ID NO: 2837033 - protein, 7 aa, Entamoeba invadens
AALTQKP

SEQ ID NO: 2837034 - protein, 6 aa, Entamoeba invadens
AAMTET

SEQ ID NO: 2837035 - protein, 9 aa, Entamoeba invadens
AANADAIKD

SEQ ID NO: 2837036 - protein, 9 aa, Entamoeba invadens
AANAVANPE

SEQ ID NO: 2837037 - protein, 20 aa, Entamoeba invadens
AANAVDKKECTESEYANSKL

SEQ ID NO: 2837038 - protein, 6 aa, Entamoeba invadens
AANDQG

SEQ ID NO: 2837039 - protein, 4 aa, Entamoeba invadens
AANE

SEQ ID NO: 2837040 - protein, 15 aa, Entamoeba invadens
AANEEFKKKDNKEDI

SEQ ID NO: 2837041 - protein, 9 aa, Entamoeba invadens
AANEVNNKQ

SEQ ID NO: 2837042 - protein, 5 aa, Entamoeba invadens
AANGI

SEQ ID NO: 2837043 - protein, 27 aa, Entamoeba invadens
AANKQKRIDEDRKEIEEAAKRKQEAID

SEQ ID NO: 2837044 - protein, 6 aa, Entamoeba invadens
AANNTE

SEQ ID NO: 2837045 - protein, 4 aa, Entamoeba invadens
AANP

SEQ ID NO: 2837046 - protein, 18 aa, Entamoeba invadens
AANPKGGKYNPSKNLQEN

SEQ ID NO: 2837047 - protein, 11 aa, Entamoeba invadens
AANPKSSRYNL

SEQ ID NO: 2837048 - protein, 16 aa, Entamoeba invadens
AANPSNGNYNVKKSPM

SEQ ID NO: 2837049 - protein, 5 aa, Entamoeba invadens
AANPT

SEQ ID NO: 2837050 - protein, 7 aa, Entamoeba invadens
AANPTNI

SEQ ID NO: 2837051 - protein, 29 aa, Entamoeba invadens
AANQKGGKKGKEKKDAKDKKDGKSGKCLL

SEQ ID NO: 2837052 - protein, 14 aa, Entamoeba invadens
AANQKKQKQQKEVN

SEQ ID NO: 2837053 - protein, 8 aa, Entamoeba invadens
AANRKNTF

SEQ ID NO: 2837054 - protein, 5 aa, Entamoeba invadens
AANRT

SEQ ID NO: 2837055 - protein, 7 aa, Entamoeba invadens
AANSALN

SEQ ID NO: 2837056 - protein, 9 aa, Entamoeba invadens
AANSGEVDS

SEQ ID NO: 2837057 - protein, 18 aa, Entamoeba invadens
AANSSDLEKMDWSSLRKY

SEQ ID NO: 2837058 - protein, 17 aa, Entamoeba invadens
AANVPQQNQFGAPTGFA

SEQ ID NO: 2837059 - protein, 27 aa, Entamoeba invadens
AANVPQQNQFGAPTGFAQNAFRGGFGF

SEQ ID NO: 2837060 - protein, 39 aa, Entamoeba invadens
AAPAASATSAEAPKEENTEEKKEEKKEEAEEDFGGFGDL

SEQ ID NO: 2837061 - protein, 38 aa, Entamoeba invadens
AAPAATSAEAPKEENKEEEKKEEKKEEAEEDFGGFGDL

SEQ ID NO: 2837062 - protein, 20 aa, Entamoeba invadens
AAPAKGGKPADEKVKGASKI

SEQ ID NO: 2837063 - protein, 8 aa, Entamoeba invadens
AAPATKTI

SEQ ID NO: 2837064 - protein, 5 aa, Entamoeba invadens
AAPEN

SEQ ID NO: 2837065 - protein, 8 aa, Entamoeba invadens
AAPETKPV

SEQ ID NO: 2837066 - protein, 9 aa, Entamoeba invadens
AAPGNKTTH

SEQ ID NO: 2837067 - protein, 47 aa, Entamoeba invadens
AAPINQKVQEEEEYYDEQGEEQYPEDQQYVEGEGEEEYEDDNIGDDE

SEQ ID NO: 2837068 - protein, 8 aa, Entamoeba invadens
AAPLSDAT

SEQ ID NO: 2837069 - protein, 12 aa, Entamoeba invadens
AAPNMEKADAQL

SEQ ID NO: 2837070 - protein, 27 aa, Entamoeba invadens
AAPPPPARNSVATSAPPPPPVQQRGYA

SEQ ID NO: 2837071 - protein, 9 aa, Entamoeba invadens
AAPPPTSQV

SEQ ID NO: 2837072 - protein, 19 aa, Entamoeba invadens
AAPQDTNGFVSKRNLPECF

SEQ ID NO: 2837073 - protein, 38 aa, Entamoeba invadens
AAPSATTATEEKHEEKAEEQKEEKKEEAEEDFGGFGDL

SEQ ID NO: 2837074 - protein, 8 aa, Entamoeba invadens
AAPSPIDN

SEQ ID NO: 2837075 - protein, 22 aa, Entamoeba invadens
AAPTTGASLDSPKTTKPVPSAE

SEQ ID NO: 2837076 - protein, 5 aa, Entamoeba invadens
AAPTY

SEQ ID NO: 2837077 - protein, 44 aa, Entamoeba invadens
AAPVAAAPAAAGAAAEEKKEENKEEKKEEKKDEPEEDFGGFGDL

SEQ ID NO: 2837078 - protein, 4 aa, Entamoeba invadens
AAQA

SEQ ID NO: 2837079 - protein, 5 aa, Entamoeba invadens
AAQED

SEQ ID NO: 2837080 - protein, 9 aa, Entamoeba invadens
AAQFSNGKW

SEQ ID NO: 2837081 - protein, 5 aa, Entamoeba invadens
AAQKG

SEQ ID NO: 2837082 - protein, 8 aa, Entamoeba invadens
AAQKNNSK

SEQ ID NO: 2837083 - protein, 17 aa, Entamoeba invadens
AAQNDRSVSKEPENFDY

SEQ ID NO: 2837084 - protein, 31 aa, Entamoeba invadens
AAQNTERKTVNDAEKKISELEKENTYEPKTM

SEQ ID NO: 2837085 - protein, 7 aa, Entamoeba invadens
AAQPKSL

SEQ ID NO: 2837086 - protein, 12 aa, Entamoeba invadens
AAQQGKRKTELE

SEQ ID NO: 2837087 - protein, 6 aa, Entamoeba invadens
AAQQPI

SEQ ID NO: 2837088 - protein, 9 aa, Entamoeba invadens
AAQRNYQVQ

SEQ ID NO: 2837089 - protein, 7 aa, Entamoeba invadens
AAQRTQV

SEQ ID NO: 2837090 - protein, 9 aa, Entamoeba invadens
AAQSIEPET

SEQ ID NO: 2837091 - protein, 9 aa, Entamoeba invadens
AAQSLEPET

SEQ ID NO: 2837092 - protein, 9 aa, Entamoeba invadens
AAQSSASGI

SEQ ID NO: 2837093 - protein, 6 aa, Entamoeba invadens
AAQTKS

SEQ ID NO: 2837094 - protein, 16 aa, Entamoeba invadens
AAQTNNSSSIPSTPTH

SEQ ID NO: 2837095 - protein, 7 aa, Entamoeba invadens
AAQVKRE

SEQ ID NO: 2837096 - protein, 8 aa, Entamoeba invadens
AAQYSGNT

SEQ ID NO: 2837097 - protein, 17 aa, Entamoeba invadens
AARAREAARKAREMTRR

SEQ ID NO: 2837098 - protein, 13 aa, Entamoeba invadens
AAREAANRRGAGN

SEQ ID NO: 2837099 - protein, 10 aa, Entamoeba invadens
AARKEEERRV

SEQ ID NO: 2837100 - protein, 9 aa, Entamoeba invadens
AARRRQSFY

SEQ ID NO: 2837101 - protein, 21 aa, Entamoeba invadens
AARYSTNTQDEPIYPRQDRFE

SEQ ID NO: 2837102 - protein, 8 aa, Entamoeba invadens
AASAEVRK

SEQ ID NO: 2837103 - protein, 10 aa, Entamoeba invadens
AASAGNHAQG

SEQ ID NO: 2837104 - protein, 13 aa, Entamoeba invadens
AASDDIGTIIVFS

SEQ ID NO: 2837105 - protein, 6 aa, Entamoeba invadens
AASESY

SEQ ID NO: 2837106 - protein, 29 aa, Entamoeba invadens
AASGDRLGGQRSPRSPRTPSEGKADDALG

SEQ ID NO: 2837107 - protein, 5 aa, Entamoeba invadens
AASIY

SEQ ID NO: 2837108 - protein, 8 aa, Entamoeba invadens
AASKEQNV

SEQ ID NO: 2837109 - protein, 9 aa, Entamoeba invadens
AASKKQSDA

SEQ ID NO: 2837110 - protein, 18 aa, Entamoeba invadens
AASNKGEMKEGKEGEKNI

SEQ ID NO: 2837111 - protein, 9 aa, Entamoeba invadens
AASNPGNVK

SEQ ID NO: 2837112 - protein, 13 aa, Entamoeba invadens
AASPSYPHNMPPN

SEQ ID NO: 2837113 - protein, 20 aa, Entamoeba invadens
AASQSAETKGTTLKETQRTF

SEQ ID NO: 2837114 - protein, 24 aa, Entamoeba invadens
AASQSSLQQNCETEKSETLETTTC

SEQ ID NO: 2837115 - protein, 16 aa, Entamoeba invadens
AASSASGTIAKAKPLM

SEQ ID NO: 2837116 - protein, 8 aa, Entamoeba invadens
AASSDVKK

SEQ ID NO: 2837117 - protein, 10 aa, Entamoeba invadens
AASSTPVDSM

SEQ ID NO: 2837118 - protein, 5 aa, Entamoeba invadens
AASTR

SEQ ID NO: 2837119 - protein, 6 aa, Entamoeba invadens
AATADL

SEQ ID NO: 2837120 - protein, 14 aa, Entamoeba invadens
AATAKEAISTGRPV

SEQ ID NO: 2837121 - protein, 6 aa, Entamoeba invadens
AATAQA

SEQ ID NO: 2837122 - protein, 8 aa, Entamoeba invadens
AATAQQAL

SEQ ID NO: 2837123 - protein, 10 aa, Entamoeba invadens
AATDDDLKKT

SEQ ID NO: 2837124 - protein, 8 aa, Entamoeba invadens
AATGKHEN

SEQ ID NO: 2837125 - protein, 6 aa, Entamoeba invadens
AATGQK

SEQ ID NO: 2837126 - protein, 8 aa, Entamoeba invadens
AATHSEAR

SEQ ID NO: 2837127 - protein, 11 aa, Entamoeba invadens
AATKEGLERER

SEQ ID NO: 2837128 - protein, 10 aa, Entamoeba invadens
AATKESGIAQ

SEQ ID NO: 2837129 - protein, 10 aa, Entamoeba invadens
AATKPTKTLK

SEQ ID NO: 2837130 - protein, 6 aa, Entamoeba invadens
AATKRV

SEQ ID NO: 2837131 - protein, 9 aa, Entamoeba invadens
AATKTERKT

SEQ ID NO: 2837132 - protein, 5 aa, Entamoeba invadens
AATLE

SEQ ID NO: 2837133 - protein, 4 aa, Entamoeba invadens
AATN

SEQ ID NO: 2837134 - protein, 11 aa, Entamoeba invadens
AATNLRRNTDG

SEQ ID NO: 2837135 - protein, 5 aa, Entamoeba invadens
AATNP

SEQ ID NO: 2837136 - protein, 7 aa, Entamoeba invadens
AATNRQN

SEQ ID NO: 2837137 - protein, 6 aa, Entamoeba invadens
AATNTA

SEQ ID NO: 2837138 - protein, 12 aa, Entamoeba invadens
AATPYSSVGNQE

SEQ ID NO: 2837139 - protein, 13 aa, Entamoeba invadens
AATSRQKYKQLPE

SEQ ID NO: 2837140 - protein, 9 aa, Entamoeba invadens
AATSTKDKI

SEQ ID NO: 2837141 - protein, 5 aa, Entamoeba invadens
AATSY

SEQ ID NO: 2837142 - protein, 12 aa, Entamoeba invadens
AATTAPAETVEP

SEQ ID NO: 2837143 - protein, 7 aa, Entamoeba invadens
AATTKDE

SEQ ID NO: 2837144 - protein, 8 aa, Entamoeba invadens
AATVNGTS

SEQ ID NO: 2837145 - protein, 6 aa, Entamoeba invadens
AAVGKT

SEQ ID NO: 2837146 - protein, 6 aa, Entamoeba invadens
AAVGQS

SEQ ID NO: 2837147 - protein, 29 aa, Entamoeba invadens
AAVPPQVEASTTSSTEESVDDKPAPSIPN

SEQ ID NO: 2837148 - protein, 7 aa, Entamoeba invadens
AAYERGE

SEQ ID NO: 2837149 - protein, 6 aa, Entamoeba invadens
AAYTPY

SEQ ID NO: 2837150 - protein, 12 aa, Entamoeba invadens
ACDAPTVSSNPE

SEQ ID NO: 2837151 - protein, 6 aa, Entamoeba invadens
ACDENT

SEQ ID NO: 2837152 - protein, 7 aa, Entamoeba invadens
ACDPTSG

SEQ ID NO: 2837153 - protein, 11 aa, Entamoeba invadens
ACEESTKKSLE

SEQ ID NO: 2837154 - protein, 29 aa, Entamoeba invadens
ACEKTIKEKSAADSLKRASDLGDSANILT

SEQ ID NO: 2837155 - protein, 6 aa, Entamoeba invadens
ACGNNG

SEQ ID NO: 2837156 - protein, 7 aa, Entamoeba invadens
ACGYEDK

SEQ ID NO: 2837157 - protein, 7 aa, Entamoeba invadens
ACKPSNS

SEQ ID NO: 2837158 - protein, 8 aa, Entamoeba invadens
ACKSGYTL

SEQ ID NO: 2837159 - protein, 9 aa, Entamoeba invadens
ACNEPPYSA

SEQ ID NO: 2837160 - protein, 5 aa, Entamoeba invadens
ACNNQ

SEQ ID NO: 2837161 - protein, 7 aa, Entamoeba invadens
ACNTESK

SEQ ID NO: 2837162 - protein, 11 aa, Entamoeba invadens
ACNTSKLPRNF

SEQ ID NO: 2837163 - protein, 6 aa, Entamoeba invadens
ACPNNS

SEQ ID NO: 2837164 - protein, 8 aa, Entamoeba invadens
ACPSNPSE

SEQ ID NO: 2837165 - protein, 12 aa, Entamoeba invadens
ACQESTESIKSV

SEQ ID NO: 2837166 - protein, 11 aa, Entamoeba invadens
ACQTSAKDIRN

SEQ ID NO: 2837167 - protein, 9 aa, Entamoeba invadens
ACSKPQGTF

SEQ ID NO: 2837168 - protein, 6 aa, Entamoeba invadens
ACSSCS

SEQ ID NO: 2837169 - protein, 8 aa, Entamoeba invadens
ACSSDAKK

SEQ ID NO: 2837170 - protein, 26 aa, Entamoeba invadens
ACTDANFKKEQESKINEQKSSSETQI

SEQ ID NO: 2837171 - protein, 5 aa, Entamoeba invadens
ACTDE

SEQ ID NO: 2837172 - protein, 4 aa, Entamoeba invadens
ACTS

SEQ ID NO: 2837173 - protein, 27 aa, Entamoeba invadens
ADAASENKKMGMASPSYPAVKPTGAVS

SEQ ID NO: 2837174 - protein, 10 aa, Entamoeba invadens
ADADTMNRRE

SEQ ID NO: 2837175 - protein, 11 aa, Entamoeba invadens
ADAEAEKIDKK

SEQ ID NO: 2837176 - protein, 35 aa, Entamoeba invadens
ADAENTNRKKDAQEKQLSQLKADNDNLTKAKSVVD

SEQ ID NO: 2837177 - protein, 11 aa, Entamoeba invadens
ADAGATGASIA

SEQ ID NO: 2837178 - protein, 13 aa, Entamoeba invadens
ADAGEKLSPDQSK

SEQ ID NO: 2837179 - protein, 9 aa, Entamoeba invadens
ADAKLKRKT

SEQ ID NO: 2837180 - protein, 8 aa, Entamoeba invadens
ADAKQEDI

SEQ ID NO: 2837181 - protein, 8 aa, Entamoeba invadens
ADAKYPVV

SEQ ID NO: 2837182 - protein, 5 aa, Entamoeba invadens
ADALA

SEQ ID NO: 2837183 - protein, 6 aa, Entamoeba invadens
ADANGA

SEQ ID NO: 2837184 - protein, 6 aa, Entamoeba invadens
ADANTK

SEQ ID NO: 2837185 - protein, 4 aa, Entamoeba invadens
ADAR

SEQ ID NO: 2837186 - protein, 18 aa, Entamoeba invadens
ADARNENIPGGEERAKEI

SEQ ID NO: 2837187 - protein, 6 aa, Entamoeba invadens
ADASEP

SEQ ID NO: 2837188 - protein, 29 aa, Entamoeba invadens
ADASSTTDTESSLKNENITRENAEQLSSG

SEQ ID NO: 2837189 - protein, 7 aa, Entamoeba invadens
ADATTAV

SEQ ID NO: 2837190 - protein, 15 aa, Entamoeba invadens
ADCDKLTNEKKEYAN

SEQ ID NO: 2837191 - protein, 8 aa, Entamoeba invadens
ADCPDEDG

SEQ ID NO: 2837192 - protein, 19 aa, Entamoeba invadens
ADCTPEQKKTGNERSKELT

SEQ ID NO: 2837193 - protein, 8 aa, Entamoeba invadens
ADDALKNK

SEQ ID NO: 2837194 - protein, 50 aa, Entamoeba invadens
ADDDEEEVGEEEEAEETPEEKQRRLEEKQKRKEEREKKRAEKEQKKKKRR

SEQ ID NO: 2837195 - protein, 21 aa, Entamoeba invadens
ADDIEDANEEQQNYSNDTKPH

SEQ ID NO: 2837196 - protein, 10 aa, Entamoeba invadens
ADDKDLPDAY

SEQ ID NO: 2837197 - protein, 7 aa, Entamoeba invadens
ADDKKMT

SEQ ID NO: 2837198 - protein, 6 aa, Entamoeba invadens
ADDLEA

SEQ ID NO: 2837199 - protein, 10 aa, Entamoeba invadens
ADDTPDTPQK

SEQ ID NO: 2837200 - protein, 32 aa, Entamoeba invadens
ADDTTPTTSKTETTTEGSAEEIKPKKPIGGQQ

SEQ ID NO: 2837201 - protein, 16 aa, Entamoeba invadens
ADDTTTPKKSTMTPRR

SEQ ID NO: 2837202 - protein, 7 aa, Entamoeba invadens
ADEAQNF

SEQ ID NO: 2837203 - protein, 12 aa, Entamoeba invadens
ADEDKKFTEARE

SEQ ID NO: 2837204 - protein, 6 aa, Entamoeba invadens
ADEEEM

SEQ ID NO: 2837205 - protein, 23 aa, Entamoeba invadens
ADEELAQENSQEGADQDSQGSQQ

SEQ ID NO: 2837206 - protein, 17 aa, Entamoeba invadens
ADEEQDLKQQAREKMWD

SEQ ID NO: 2837207 - protein, 6 aa, Entamoeba invadens
ADEKEV

SEQ ID NO: 2837208 - protein, 7 aa, Entamoeba invadens
ADEKQRD

SEQ ID NO: 2837209 - protein, 12 aa, Entamoeba invadens
ADEKRMNESTTK

SEQ ID NO: 2837210 - protein, 6 aa, Entamoeba invadens
ADEKSG

SEQ ID NO: 2837211 - protein, 6 aa, Entamoeba invadens
ADEKSS

SEQ ID NO: 2837212 - protein, 8 aa, Entamoeba invadens
ADEKTRDE

SEQ ID NO: 2837213 - protein, 14 aa, Entamoeba invadens
ADELAGKSNPNFSD

SEQ ID NO: 2837214 - protein, 9 aa, Entamoeba invadens
ADELKNENK

SEQ ID NO: 2837215 - protein, 8 aa, Entamoeba invadens
ADEMKEHK

SEQ ID NO: 2837216 - protein, 7 aa, Entamoeba invadens
ADEMKSI

SEQ ID NO: 2837217 - protein, 9 aa, Entamoeba invadens
ADENGVSCS

SEQ ID NO: 2837218 - protein, 9 aa, Entamoeba invadens
ADENIEKRG

SEQ ID NO: 2837219 - protein, 10 aa, Entamoeba invadens
ADEPKLGTNP

SEQ ID NO: 2837220 - protein, 10 aa, Entamoeba invadens
ADEPQGESTF

SEQ ID NO: 2837221 - protein, 4 aa, Entamoeba invadens
ADEQ

SEQ ID NO: 2837222 - protein, 5 aa, Entamoeba invadens
ADERL

SEQ ID NO: 2837223 - protein, 6 aa, Entamoeba invadens
ADESRM

SEQ ID NO: 2837224 - protein, 5 aa, Entamoeba invadens
ADESV

SEQ ID NO: 2837225 - protein, 5 aa, Entamoeba invadens
ADETK

SEQ ID NO: 2837226 - protein, 6 aa, Entamoeba invadens
ADETKT

SEQ ID NO: 2837227 - protein, 4 aa, Entamoeba invadens
ADEY

SEQ ID NO: 2837228 - protein, 14 aa, Entamoeba invadens
ADEYLKSKASDVDK

SEQ ID NO: 2837229 - protein, 16 aa, Entamoeba invadens
ADFDKSKKSKKPGMVT

SEQ ID NO: 2837230 - protein, 5 aa, Entamoeba invadens
ADFEA

SEQ ID NO: 2837231 - protein, 13 aa, Entamoeba invadens
ADFEGGSGDGSVG

SEQ ID NO: 2837232 - protein, 7 aa, Entamoeba invadens
ADFEKRK

SEQ ID NO: 2837233 - protein, 9 aa, Entamoeba invadens
ADFGKSGYE

SEQ ID NO: 2837234 - protein, 8 aa, Entamoeba invadens
ADGDGRNA

SEQ ID NO: 2837235 - protein, 6 aa, Entamoeba invadens
ADGDIQ

SEQ ID NO: 2837236 - protein, 12 aa, Entamoeba invadens
ADGEYKKSTTLA

SEQ ID NO: 2837237 - protein, 21 aa, Entamoeba invadens
ADGFGNAQVADAQVKPRSTRH

SEQ ID NO: 2837238 - protein, 4 aa, Entamoeba invadens
ADGH

SEQ ID NO: 2837239 - protein, 6 aa, Entamoeba invadens
ADGIES

SEQ ID NO: 2837240 - protein, 25 aa, Entamoeba invadens
ADGIKDDEFPSKPVVEEKSAPRNFQ

SEQ ID NO: 2837241 - protein, 9 aa, Entamoeba invadens
ADGIKSSRE

SEQ ID NO: 2837242 - protein, 4 aa, Entamoeba invadens
ADGK

SEQ ID NO: 2837243 - protein, 7 aa, Entamoeba invadens
ADGKYNP

SEQ ID NO: 2837244 - protein, 5 aa, Entamoeba invadens
ADGLC

SEQ ID NO: 2837245 - protein, 8 aa, Entamoeba invadens
ADGNQISS

SEQ ID NO: 2837246 - protein, 4 aa, Entamoeba invadens
ADGP

SEQ ID NO: 2837247 - protein, 11 aa, Entamoeba invadens
ADGPGVEGGCK

SEQ ID NO: 2837248 - protein, 24 aa, Entamoeba invadens
ADGQRITKDFEKQKDVLKKDKDTF

SEQ ID NO: 2837249 - protein, 5 aa, Entamoeba invadens
ADGRI

SEQ ID NO: 2837250 - protein, 5 aa, Entamoeba invadens
ADGSC

SEQ ID NO: 2837251 - protein, 5 aa, Entamoeba invadens
ADGSK

SEQ ID NO: 2837252 - protein, 6 aa, Entamoeba invadens
ADGTAR

SEQ ID NO: 2837253 - protein, 5 aa, Entamoeba invadens
ADGVA

SEQ ID NO: 2837254 - protein, 6 aa, Entamoeba invadens
ADGVDH

SEQ ID NO: 2837255 - protein, 14 aa, Entamoeba invadens
ADGVKNCKKAAITV

SEQ ID NO: 2837256 - protein, 6 aa, Entamoeba invadens
ADHKNL

SEQ ID NO: 2837257 - protein, 4 aa, Entamoeba invadens
ADHQ

SEQ ID NO: 2837258 - protein, 11 aa, Entamoeba invadens
ADHQNDKIRDA

SEQ ID NO: 2837259 - protein, 9 aa, Entamoeba invadens
ADHSGAIGE

SEQ ID NO: 2837260 - protein, 6 aa, Entamoeba invadens
ADHTSL

SEQ ID NO: 2837261 - protein, 5 aa, Entamoeba invadens
ADIES

SEQ ID NO: 2837262 - protein, 15 aa, Entamoeba invadens
ADIKANGKKKGVAVK

SEQ ID NO: 2837263 - protein, 14 aa, Entamoeba invadens
ADINKRNKIGETPL

SEQ ID NO: 2837264 - protein, 4 aa, Entamoeba invadens
ADIR

SEQ ID NO: 2837265 - protein, 32 aa, Entamoeba invadens
ADISPPQMPTEKLKPKSKTKDKVSLQPKQPLS

SEQ ID NO: 2837266 - protein, 20 aa, Entamoeba invadens
ADITTPPNQENSCKANEMED

SEQ ID NO: 2837267 - protein, 9 aa, Entamoeba invadens
ADKAPWEKS

SEQ ID NO: 2837268 - protein, 10 aa, Entamoeba invadens
ADKEAAEKYH

SEQ ID NO: 2837269 - protein, 6 aa, Entamoeba invadens
ADKEKV

SEQ ID NO: 2837270 - protein, 8 aa, Entamoeba invadens
ADKETQKT

SEQ ID NO: 2837271 - protein, 7 aa, Entamoeba invadens
ADKIATE

SEQ ID NO: 2837272 - protein, 14 aa, Entamoeba invadens
ADKKADDNVRAQGK

SEQ ID NO: 2837273 - protein, 13 aa, Entamoeba invadens
ADKKESDQKGTVD

SEQ ID NO: 2837274 - protein, 9 aa, Entamoeba invadens
ADKKINTNC

SEQ ID NO: 2837275 - protein, 10 aa, Entamoeba invadens
ADKKTPVDQS

SEQ ID NO: 2837276 - protein, 17 aa, Entamoeba invadens
ADKKYEEKVKILKQFGY

SEQ ID NO: 2837277 - protein, 5 aa, Entamoeba invadens
ADKLG

SEQ ID NO: 2837278 - protein, 8 aa, Entamoeba invadens
ADKLNEEN

SEQ ID NO: 2837279 - protein, 12 aa, Entamoeba invadens
ADKMKEKKKKIK

SEQ ID NO: 2837280 - protein, 4 aa, Entamoeba invadens
ADKN

SEQ ID NO: 2837281 - protein, 7 aa, Entamoeba invadens
ADKNGDG

SEQ ID NO: 2837282 - protein, 13 aa, Entamoeba invadens
ADKNKENGNDVEA

SEQ ID NO: 2837283 - protein, 18 aa, Entamoeba invadens
ADKNSEESEKDDENINHT

SEQ ID NO: 2837284 - protein, 5 aa, Entamoeba invadens
ADKNV

SEQ ID NO: 2837285 - protein, 9 aa, Entamoeba invadens
ADKPGKMTN

SEQ ID NO: 2837286 - protein, 8 aa, Entamoeba invadens
ADKQAEYQ

SEQ ID NO: 2837287 - protein, 7 aa, Entamoeba invadens
ADKQKFE

SEQ ID NO: 2837288 - protein, 4 aa, Entamoeba invadens
ADKR

SEQ ID NO: 2837289 - protein, 8 aa, Entamoeba invadens
ADKSEQLR

SEQ ID NO: 2837290 - protein, 11 aa, Entamoeba invadens
ADKSSQSSDPY

SEQ ID NO: 2837291 - protein, 48 aa, Entamoeba invadens
ADKSTGKLPQVAQPKPQEQQQTKEQTEEQKSQPQVKRQASKNFKPRPK

SEQ ID NO: 2837292 - protein, 8 aa, Entamoeba invadens
ADKSYGYG

SEQ ID NO: 2837293 - protein, 4 aa, Entamoeba invadens
ADKT

SEQ ID NO: 2837294 - protein, 5 aa, Entamoeba invadens
ADKTA

SEQ ID NO: 2837295 - protein, 7 aa, Entamoeba invadens
ADKTELN

SEQ ID NO: 2837296 - protein, 29 aa, Entamoeba invadens
ADKTLESRETAIQQATQKQERVAKTKQID

SEQ ID NO: 2837297 - protein, 6 aa, Entamoeba invadens
ADLDGK

SEQ ID NO: 2837298 - protein, 7 aa, Entamoeba invadens
ADLGGTN

SEQ ID NO: 2837299 - protein, 12 aa, Entamoeba invadens
ADLGKTQKKENY

SEQ ID NO: 2837300 - protein, 7 aa, Entamoeba invadens
ADLGSAT

SEQ ID NO: 2837301 - protein, 11 aa, Entamoeba invadens
ADLKENEYEKN

SEQ ID NO: 2837302 - protein, 24 aa, Entamoeba invadens
ADLQKELEKERAMKQEADKETQRL

SEQ ID NO: 2837303 - protein, 23 aa, Entamoeba invadens
ADLQKELEKERAMKQEVDKEIQR

SEQ ID NO: 2837304 - protein, 29 aa, Entamoeba invadens
ADLQKELEKERTIKQNSDKETQKLGTKVT

SEQ ID NO: 2837305 - protein, 8 aa, Entamoeba invadens
ADLREDQD

SEQ ID NO: 2837306 - protein, 4 aa, Entamoeba invadens
ADLS

SEQ ID NO: 2837307 - protein, 8 aa, Entamoeba invadens
ADLSENTM

SEQ ID NO: 2837308 - protein, 9 aa, Entamoeba invadens
ADLSKPTAN

SEQ ID NO: 2837309 - protein, 8 aa, Entamoeba invadens
ADLSTTKE

SEQ ID NO: 2837310 - protein, 6 aa, Entamoeba invadens
ADMGRY

SEQ ID NO: 2837311 - protein, 19 aa, Entamoeba invadens
ADMKNKDEIDVDQENDMDE

SEQ ID NO: 2837312 - protein, 12 aa, Entamoeba invadens
ADMKSQEDQEHI

SEQ ID NO: 2837313 - protein, 48 aa, Entamoeba invadens
ADMTEKKKTLEKEVESASEKYERLDKNYKELERTYKENFEEKTQYKNK

SEQ ID NO: 2837314 - protein, 6 aa, Entamoeba invadens
ADNEVT

SEQ ID NO: 2837315 - protein, 4 aa, Entamoeba invadens
ADNG

SEQ ID NO: 2837316 - protein, 5 aa, Entamoeba invadens
ADNIP

SEQ ID NO: 2837317 - protein, 8 aa, Entamoeba invadens
ADNKCSTC

SEQ ID NO: 2837318 - protein, 15 aa, Entamoeba invadens
ADNKVTPVRNQGDCG

SEQ ID NO: 2837319 - protein, 5 aa, Entamoeba invadens
ADNMK

SEQ ID NO: 2837320 - protein, 7 aa, Entamoeba invadens
ADNNGID

SEQ ID NO: 2837321 - protein, 8 aa, Entamoeba invadens
ADNNGINT

SEQ ID NO: 2837322 - protein, 6 aa, Entamoeba invadens
ADNNKD

SEQ ID NO: 2837323 - protein, 7 aa, Entamoeba invadens
ADNNNIP

SEQ ID NO: 2837324 - protein, 5 aa, Entamoeba invadens
ADNNV

SEQ ID NO: 2837325 - protein, 6 aa, Entamoeba invadens
ADNPMT

SEQ ID NO: 2837326 - protein, 9 aa, Entamoeba invadens
ADNQKLQDG

SEQ ID NO: 2837327 - protein, 6 aa, Entamoeba invadens
ADNQPG

SEQ ID NO: 2837328 - protein, 7 aa, Entamoeba invadens
ADNQRLQ

SEQ ID NO: 2837329 - protein, 13 aa, Entamoeba invadens
ADNQRLQDEITEH

SEQ ID NO: 2837330 - protein, 25 aa, Entamoeba invadens
ADNQRLQNDITEHKATIAKKDSVIT

SEQ ID NO: 2837331 - protein, 5 aa, Entamoeba invadens
ADNTL

SEQ ID NO: 2837332 - protein, 13 aa, Entamoeba invadens
ADNYSPNNNTTSL

SEQ ID NO: 2837333 - protein, 9 aa, Entamoeba invadens
ADPDEQNEN

SEQ ID NO: 2837334 - protein, 4 aa, Entamoeba invadens
ADPE

SEQ ID NO: 2837335 - protein, 34 aa, Entamoeba invadens
ADPEELEKQLTKSRLKKTSLPERERNTSPETLTG

SEQ ID NO: 2837336 - protein, 10 aa, Entamoeba invadens
ADPELGNKPW

SEQ ID NO: 2837337 - protein, 4 aa, Entamoeba invadens
ADPK

SEQ ID NO: 2837338 - protein, 5 aa, Entamoeba invadens
ADPLG

SEQ ID NO: 2837339 - protein, 10 aa, Entamoeba invadens
ADPNKGNSDG

SEQ ID NO: 2837340 - protein, 15 aa, Entamoeba invadens
ADPRLCKSTPSVNHF

SEQ ID NO: 2837341 - protein, 8 aa, Entamoeba invadens
ADPSDDDI

SEQ ID NO: 2837342 - protein, 9 aa, Entamoeba invadens
ADPSKLGND

SEQ ID NO: 2837343 - protein, 14 aa, Entamoeba invadens
ADPSRKNGIAIIKL

SEQ ID NO: 2837344 - protein, 4 aa, Entamoeba invadens
ADPT

SEQ ID NO: 2837345 - protein, 12 aa, Entamoeba invadens
ADPTVLNNDGIS

SEQ ID NO: 2837346 - protein, 5 aa, Entamoeba invadens
ADPVI

SEQ ID NO: 2837347 - protein, 5 aa, Entamoeba invadens
ADPVL

SEQ ID NO: 2837348 - protein, 10 aa, Entamoeba invadens
ADQDVTAPID

SEQ ID NO: 2837349 - protein, 4 aa, Entamoeba invadens
ADQG

SEQ ID NO: 2837350 - protein, 4 aa, Entamoeba invadens
ADQH

SEQ ID NO: 2837351 - protein, 4 aa, Entamoeba invadens
ADQI

SEQ ID NO: 2837352 - protein, 9 aa, Entamoeba invadens
ADQKEERNA

SEQ ID NO: 2837353 - protein, 14 aa, Entamoeba invadens
ADQNNMSKNAAERR

SEQ ID NO: 2837354 - protein, 8 aa, Entamoeba invadens
ADQSECSD

SEQ ID NO: 2837355 - protein, 4 aa, Entamoeba invadens
ADQT

SEQ ID NO: 2837356 - protein, 17 aa, Entamoeba invadens
ADQTQYKSQNNDDIREA

SEQ ID NO: 2837357 - protein, 5 aa, Entamoeba invadens
ADQVA

SEQ ID NO: 2837358 - protein, 8 aa, Entamoeba invadens
ADQYDPSN

SEQ ID NO: 2837359 - protein, 11 aa, Entamoeba invadens
ADRALKNERMN

SEQ ID NO: 2837360 - protein, 9 aa, Entamoeba invadens
ADRGDYDLS

SEQ ID NO: 2837361 - protein, 8 aa, Entamoeba invadens
ADRGSHTV

SEQ ID NO: 2837362 - protein, 16 aa, Entamoeba invadens
ADRIGASAGIAILDGM

SEQ ID NO: 2837363 - protein, 5 aa, Entamoeba invadens
ADRKE

SEQ ID NO: 2837364 - protein, 7 aa, Entamoeba invadens
ADRKKNA

SEQ ID NO: 2837365 - protein, 4 aa, Entamoeba invadens
ADRN

SEQ ID NO: 2837366 - protein, 12 aa, Entamoeba invadens
ADRTNFQKKGGR

SEQ ID NO: 2837367 - protein, 7 aa, Entamoeba invadens
ADRTNTF

SEQ ID NO: 2837368 - protein, 19 aa, Entamoeba invadens
ADRVREAIRQKEKSVEDAD

SEQ ID NO: 2837369 - protein, 6 aa, Entamoeba invadens
ADRYIK

SEQ ID NO: 2837370 - protein, 4 aa, Entamoeba invadens
ADSD

SEQ ID NO: 2837371 - protein, 9 aa, Entamoeba invadens
ADSEEDEED

SEQ ID NO: 2837372 - protein, 7 aa, Entamoeba invadens
ADSEERR

SEQ ID NO: 2837373 - protein, 6 aa, Entamoeba invadens
ADSEIP

SEQ ID NO: 2837374 - protein, 5 aa, Entamoeba invadens
ADSEL

SEQ ID NO: 2837375 - protein, 11 aa, Entamoeba invadens
ADSESKEDQTY

SEQ ID NO: 2837376 - protein, 7 aa, Entamoeba invadens
ADSETGM

SEQ ID NO: 2837377 - protein, 5 aa, Entamoeba invadens
ADSGE

SEQ ID NO: 2837378 - protein, 7 aa, Entamoeba invadens
ADSGEFT

SEQ ID NO: 2837379 - protein, 4 aa, Entamoeba invadens
ADSI

SEQ ID NO: 2837380 - protein, 7 aa, Entamoeba invadens
ADSITPQ

SEQ ID NO: 2837381 - protein, 31 aa, Entamoeba invadens
ADSKTEKLKERKRTKDEEKKPRKSEEQDKYH

SEQ ID NO: 2837382 - protein, 5 aa, Entamoeba invadens
ADSLG

SEQ ID NO: 2837383 - protein, 7 aa, Entamoeba invadens
ADSMTTA

SEQ ID NO: 2837384 - protein, 8 aa, Entamoeba invadens
ADSPLEGN

SEQ ID NO: 2837385 - protein, 8 aa, Entamoeba invadens
ADSPSPSV

SEQ ID NO: 2837386 - protein, 8 aa, Entamoeba invadens
ADSPTTEL

SEQ ID NO: 2837387 - protein, 8 aa, Entamoeba invadens
ADSPVKPV

SEQ ID NO: 2837388 - protein, 9 aa, Entamoeba invadens
ADSQKQAND

SEQ ID NO: 2837389 - protein, 6 aa, Entamoeba invadens
ADSQQA

SEQ ID NO: 2837390 - protein, 11 aa, Entamoeba invadens
ADSRTSSGSLV

SEQ ID NO: 2837391 - protein, 5 aa, Entamoeba invadens
ADSRV

SEQ ID NO: 2837392 - protein, 9 aa, Entamoeba invadens
ADSTCEKYQ

SEQ ID NO: 2837393 - protein, 8 aa, Entamoeba invadens
ADSTDFDG

SEQ ID NO: 2837394 - protein, 18 aa, Entamoeba invadens
ADSTDTSNSISRSASTQI

SEQ ID NO: 2837395 - protein, 34 aa, Entamoeba invadens
ADSTNPYVPTSPRGTNRTSGWTRTSVTRRSPPQF

SEQ ID NO: 2837396 - protein, 8 aa, Entamoeba invadens
ADSTRTKE

SEQ ID NO: 2837397 - protein, 6 aa, Entamoeba invadens
ADSTVE

SEQ ID NO: 2837398 - protein, 6 aa, Entamoeba invadens
ADSTVS

SEQ ID NO: 2837399 - protein, 8 aa, Entamoeba invadens
ADSVDGNG

SEQ ID NO: 2837400 - protein, 5 aa, Entamoeba invadens
ADSYS

SEQ ID NO: 2837401 - protein, 12 aa, Entamoeba invadens
ADTATDIEEQDS

SEQ ID NO: 2837402 - protein, 106 aa, Entamoeba invadens
ADTDFSNSQNEGSDKESIDDDVENMSEESKDDENSEGESEMSDADSENQDQNDGTSGSEMDEKEGSDDSISQGDGTTEEKSEEVESQKPKKKKNTKKAEPKPEDVT

SEQ ID NO: 2837403 - protein, 9 aa, Entamoeba invadens
ADTDNSGKI

SEQ ID NO: 2837404 - protein, 6 aa, Entamoeba invadens
ADTEMT

SEQ ID NO: 2837405 - protein, 7 aa, Entamoeba invadens
ADTERAV

SEQ ID NO: 2837406 - protein, 13 aa, Entamoeba invadens
ADTEYEEENQTGF

SEQ ID NO: 2837407 - protein, 7 aa, Entamoeba invadens
ADTGKTS

SEQ ID NO: 2837408 - protein, 14 aa, Entamoeba invadens
ADTHETDRSGERTH

SEQ ID NO: 2837409 - protein, 7 aa, Entamoeba invadens
ADTITDE

SEQ ID NO: 2837410 - protein, 8 aa, Entamoeba invadens
ADTLRNAA

SEQ ID NO: 2837411 - protein, 9 aa, Entamoeba invadens
ADTNGTDQK

SEQ ID NO: 2837412 - protein, 10 aa, Entamoeba invadens
ADTPNAEKSL

SEQ ID NO: 2837413 - protein, 11 aa, Entamoeba invadens
ADTQKNEPDNI

SEQ ID NO: 2837414 - protein, 12 aa, Entamoeba invadens
ADTQLPQSIQDA

SEQ ID NO: 2837415 - protein, 11 aa, Entamoeba invadens
ADTSNTIKETL

SEQ ID NO: 2837416 - protein, 21 aa, Entamoeba invadens
ADTTETIEGKGMPIKRTGKYG

SEQ ID NO: 2837417 - protein, 6 aa, Entamoeba invadens
ADTTEY

SEQ ID NO: 2837418 - protein, 7 aa, Entamoeba invadens
ADTVGDE

SEQ ID NO: 2837419 - protein, 42 aa, Entamoeba invadens
ADTVSNPPPPKTRSPNPFLTSPRSPPPTLSKSTNPFETTSEV

SEQ ID NO: 2837420 - protein, 8 aa, Entamoeba invadens
ADVANYSG

SEQ ID NO: 2837421 - protein, 14 aa, Entamoeba invadens
ADVDGAKLKAQYHD

SEQ ID NO: 2837422 - protein, 15 aa, Entamoeba invadens
ADVEEDEAKYEKGCK

SEQ ID NO: 2837423 - protein, 6 aa, Entamoeba invadens
ADVGKT

SEQ ID NO: 2837424 - protein, 13 aa, Entamoeba invadens
ADVKKDFYEVMRL

SEQ ID NO: 2837425 - protein, 10 aa, Entamoeba invadens
ADVKSEDINN

SEQ ID NO: 2837426 - protein, 4 aa, Entamoeba invadens
ADVN

SEQ ID NO: 2837427 - protein, 14 aa, Entamoeba invadens
ADVSNNSSKPKHTL

SEQ ID NO: 2837428 - protein, 8 aa, Entamoeba invadens
ADVSSKLG

SEQ ID NO: 2837429 - protein, 8 aa, Entamoeba invadens
ADVTGNGF

SEQ ID NO: 2837430 - protein, 13 aa, Entamoeba invadens
ADVTGTENVATVQ

SEQ ID NO: 2837431 - protein, 4 aa, Entamoeba invadens
ADYA

SEQ ID NO: 2837432 - protein, 34 aa, Entamoeba invadens
ADYDNEGNDDDFRREFSDDYDKNMAEDDDESSLE

SEQ ID NO: 2837433 - protein, 14 aa, Entamoeba invadens
ADYKGPESASSFGK

SEQ ID NO: 2837434 - protein, 8 aa, Entamoeba invadens
ADYNPKRS

SEQ ID NO: 2837435 - protein, 8 aa, Entamoeba invadens
ADYPTAEP

SEQ ID NO: 2837436 - protein, 7 aa, Entamoeba invadens
ADYSKDG

SEQ ID NO: 2837437 - protein, 4 aa, Entamoeba invadens
ADYT

SEQ ID NO: 2837438 - protein, 11 aa, Entamoeba invadens
ADYTETVTRNT

SEQ ID NO: 2837439 - protein, 34 aa, Entamoeba invadens
AEADEELKTVKKDKFAKEKEAKKLKAENDEIKEK

SEQ ID NO: 2837440 - protein, 5 aa, Entamoeba invadens
AEADV

SEQ ID NO: 2837441 - protein, 8 aa, Entamoeba invadens
AEAEAPKV

SEQ ID NO: 2837442 - protein, 8 aa, Entamoeba invadens
AEAEKNAP

SEQ ID NO: 2837443 - protein, 6 aa, Entamoeba invadens
AEAEVN

SEQ ID NO: 2837444 - protein, 7 aa, Entamoeba invadens
AEAGAEG

SEQ ID NO: 2837445 - protein, 6 aa, Entamoeba invadens
AEAGEI

SEQ ID NO: 2837446 - protein, 8 aa, Entamoeba invadens
AEAGEKCE

SEQ ID NO: 2837447 - protein, 5 aa, Entamoeba invadens
AEAGK

SEQ ID NO: 2837448 - protein, 6 aa, Entamoeba invadens
AEAGQV

SEQ ID NO: 2837449 - protein, 11 aa, Entamoeba invadens
AEAKKSNRFSE

SEQ ID NO: 2837450 - protein, 6 aa, Entamoeba invadens
AEALGA

SEQ ID NO: 2837451 - protein, 5 aa, Entamoeba invadens
AEALR

SEQ ID NO: 2837452 - protein, 6 aa, Entamoeba invadens
AEANPQ

SEQ ID NO: 2837453 - protein, 9 aa, Entamoeba invadens
AEAPPRGVN

SEQ ID NO: 2837454 - protein, 8 aa, Entamoeba invadens
AEAQESNL

SEQ ID NO: 2837455 - protein, 4 aa, Entamoeba invadens
AEAS

SEQ ID NO: 2837456 - protein, 14 aa, Entamoeba invadens
AEASMKESDLDGDG

SEQ ID NO: 2837457 - protein, 10 aa, Entamoeba invadens
AEATQKTTFK

SEQ ID NO: 2837458 - protein, 5 aa, Entamoeba invadens
AECTK

SEQ ID NO: 2837459 - protein, 8 aa, Entamoeba invadens
AEDASDVN

SEQ ID NO: 2837460 - protein, 14 aa, Entamoeba invadens
AEDASVKRPDLPPD

SEQ ID NO: 2837461 - protein, 4 aa, Entamoeba invadens
AEDE

SEQ ID NO: 2837462 - protein, 6 aa, Entamoeba invadens
AEDEVR

SEQ ID NO: 2837463 - protein, 5 aa, Entamoeba invadens
AEDEY

SEQ ID NO: 2837464 - protein, 4 aa, Entamoeba invadens
AEDF

SEQ ID NO: 2837465 - protein, 12 aa, Entamoeba invadens
AEDFKESQNINR

SEQ ID NO: 2837466 - protein, 14 aa, Entamoeba invadens
AEDGGDKDESEKYK

SEQ ID NO: 2837467 - protein, 19 aa, Entamoeba invadens
AEDGPKKVKKSKPQAPQTA

SEQ ID NO: 2837468 - protein, 4 aa, Entamoeba invadens
AEDI

SEQ ID NO: 2837469 - protein, 7 aa, Entamoeba invadens
AEDIGLE

SEQ ID NO: 2837470 - protein, 4 aa, Entamoeba invadens
AEDK

SEQ ID NO: 2837471 - protein, 10 aa, Entamoeba invadens
AEDKISQGAE

SEQ ID NO: 2837472 - protein, 25 aa, Entamoeba invadens
AEDKTTGKKNKITITNDKGRLSKEQ

SEQ ID NO: 2837473 - protein, 4 aa, Entamoeba invadens
AEDL

SEQ ID NO: 2837474 - protein, 7 aa, Entamoeba invadens
AEDLNNR

SEQ ID NO: 2837475 - protein, 6 aa, Entamoeba invadens
AEDNNW

SEQ ID NO: 2837476 - protein, 18 aa, Entamoeba invadens
AEDNQKPLTTEDGERLAK

SEQ ID NO: 2837477 - protein, 4 aa, Entamoeba invadens
AEDP

SEQ ID NO: 2837478 - protein, 10 aa, Entamoeba invadens
AEDPKPPKVV

SEQ ID NO: 2837479 - protein, 5 aa, Entamoeba invadens
AEDPT

SEQ ID NO: 2837480 - protein, 14 aa, Entamoeba invadens
AEDQFDKKKGPVKC

SEQ ID NO: 2837481 - protein, 10 aa, Entamoeba invadens
AEDRNKNTAD

SEQ ID NO: 2837482 - protein, 6 aa, Entamoeba invadens
AEDSGQ

SEQ ID NO: 2837483 - protein, 10 aa, Entamoeba invadens
AEDSNKTIVG

SEQ ID NO: 2837484 - protein, 11 aa, Entamoeba invadens
AEDSSATVYSN

SEQ ID NO: 2837485 - protein, 15 aa, Entamoeba invadens
AEDSSVKRPDAPPDL

SEQ ID NO: 2837486 - protein, 33 aa, Entamoeba invadens
AEDTNRKKDAQEKQLSQLKADNDNLTKAKSVVD

SEQ ID NO: 2837487 - protein, 10 aa, Entamoeba invadens
AEDTQDPSNK

SEQ ID NO: 2837488 - protein, 6 aa, Entamoeba invadens
AEDTTK

SEQ ID NO: 2837489 - protein, 5 aa, Entamoeba invadens
AEDVE

SEQ ID NO: 2837490 - protein, 6 aa, Entamoeba invadens
AEDVGD

SEQ ID NO: 2837491 - protein, 10 aa, Entamoeba invadens
AEDVSPDAQN

SEQ ID NO: 2837492 - protein, 7 aa, Entamoeba invadens
AEEAESV

SEQ ID NO: 2837493 - protein, 26 aa, Entamoeba invadens
AEEAKKSGRKEDIEDVKKAKEEYEDA

SEQ ID NO: 2837494 - protein, 12 aa, Entamoeba invadens
AEEAKSSYEPFK

SEQ ID NO: 2837495 - protein, 22 aa, Entamoeba invadens
AEEAVSNTSKFQDAVEYCEDYV

SEQ ID NO: 2837496 - protein, 5 aa, Entamoeba invadens
AEECD

SEQ ID NO: 2837497 - protein, 4 aa, Entamoeba invadens
AEEE

SEQ ID NO: 2837498 - protein, 7 aa, Entamoeba invadens
AEEEAKK

SEQ ID NO: 2837499 - protein, 6 aa, Entamoeba invadens
AEEECK

SEQ ID NO: 2837500 - protein, 14 aa, Entamoeba invadens
AEEEIKKKTGHTPR

SEQ ID NO: 2837501 - protein, 5 aa, Entamoeba invadens
AEEEK

SEQ ID NO: 2837502 - protein, 8 aa, Entamoeba invadens
AEEEKDEM

SEQ ID NO: 2837503 - protein, 10 aa, Entamoeba invadens
AEEELNKSSS

SEQ ID NO: 2837504 - protein, 8 aa, Entamoeba invadens
AEEENDDV

SEQ ID NO: 2837505 - protein, 15 aa, Entamoeba invadens
AEEERIKREEEEIQR

SEQ ID NO: 2837506 - protein, 72 aa, Entamoeba invadens
AEEESKKAEAIEKEKQEQLANAKKQKEEEERRTKEKEEQDRIEKEKREQQKAEEDRLEQEKAEKKRAEEERA

SEQ ID NO: 2837507 - protein, 14 aa, Entamoeba invadens
AEEEVDDEELKKIE

SEQ ID NO: 2837508 - protein, 6 aa, Entamoeba invadens
AEEFKK

SEQ ID NO: 2837509 - protein, 7 aa, Entamoeba invadens
AEEGGVK

SEQ ID NO: 2837510 - protein, 8 aa, Entamoeba invadens
AEEGTPVA

SEQ ID NO: 2837511 - protein, 6 aa, Entamoeba invadens
AEEHAP

SEQ ID NO: 2837512 - protein, 12 aa, Entamoeba invadens
AEEIAKREAAEK

SEQ ID NO: 2837513 - protein, 28 aa, Entamoeba invadens
AEEIKNKNQTVPKIPSDKKKIPFPEPPT

SEQ ID NO: 2837514 - protein, 45 aa, Entamoeba invadens
AEEKAKAEAERERLRKEQEEKDRLEKERIAREKMEQEVKERAEKM

SEQ ID NO: 2837515 - protein, 5 aa, Entamoeba invadens
AEEKM

SEQ ID NO: 2837516 - protein, 6 aa, Entamoeba invadens
AEEKVN

SEQ ID NO: 2837517 - protein, 11 aa, Entamoeba invadens
AEELKKDETEM

SEQ ID NO: 2837518 - protein, 5 aa, Entamoeba invadens
AEELS

SEQ ID NO: 2837519 - protein, 6 aa, Entamoeba invadens
AEEMES

SEQ ID NO: 2837520 - protein, 7 aa, Entamoeba invadens
AEENHHA

SEQ ID NO: 2837521 - protein, 8 aa, Entamoeba invadens
AEENHHAR

SEQ ID NO: 2837522 - protein, 9 aa, Entamoeba invadens
AEENKRIRK

SEQ ID NO: 2837523 - protein, 19 aa, Entamoeba invadens
AEENQKPITTEEGEKLAKE

SEQ ID NO: 2837524 - protein, 8 aa, Entamoeba invadens
AEEPNTHT

SEQ ID NO: 2837525 - protein, 16 aa, Entamoeba invadens
AEEQDLSETLAWIKKY

SEQ ID NO: 2837526 - protein, 11 aa, Entamoeba invadens
AEEQEKRPAAA

SEQ ID NO: 2837527 - protein, 9 aa, Entamoeba invadens
AEEQGTQLD

SEQ ID NO: 2837528 - protein, 12 aa, Entamoeba invadens
AEEQLKNTRPDI

SEQ ID NO: 2837529 - protein, 10 aa, Entamoeba invadens
AEEQNESGHC

SEQ ID NO: 2837530 - protein, 11 aa, Entamoeba invadens
AEESGNTSKPL

SEQ ID NO: 2837531 - protein, 9 aa, Entamoeba invadens
AEESKDRKR

SEQ ID NO: 2837532 - protein, 6 aa, Entamoeba invadens
AEESNL

SEQ ID NO: 2837533 - protein, 7 aa, Entamoeba invadens
AEETKAK

SEQ ID NO: 2837534 - protein, 5 aa, Entamoeba invadens
AEETR

SEQ ID NO: 2837535 - protein, 7 aa, Entamoeba invadens
AEETVKG

SEQ ID NO: 2837536 - protein, 14 aa, Entamoeba invadens
AEEVARADRAYEKC

SEQ ID NO: 2837537 - protein, 7 aa, Entamoeba invadens
AEEVGNE

SEQ ID NO: 2837538 - protein, 5 aa, Entamoeba invadens
AEFEE

SEQ ID NO: 2837539 - protein, 8 aa, Entamoeba invadens
AEFGGGAD

SEQ ID NO: 2837540 - protein, 5 aa, Entamoeba invadens
AEFQS

SEQ ID NO: 2837541 - protein, 11 aa, Entamoeba invadens
AEFSQDQETQE

SEQ ID NO: 2837542 - protein, 5 aa, Entamoeba invadens
AEFTE

SEQ ID NO: 2837543 - protein, 6 aa, Entamoeba invadens
AEGDES

SEQ ID NO: 2837544 - protein, 9 aa, Entamoeba invadens
AEGEEEGQY

SEQ ID NO: 2837545 - protein, 6 aa, Entamoeba invadens
AEGEER

SEQ ID NO: 2837546 - protein, 8 aa, Entamoeba invadens
AEGETFSL

SEQ ID NO: 2837547 - protein, 8 aa, Entamoeba invadens
AEGETPLQ

SEQ ID NO: 2837548 - protein, 4 aa, Entamoeba invadens
AEGF

SEQ ID NO: 2837549 - protein, 4 aa, Entamoeba invadens
AEGG

SEQ ID NO: 2837550 - protein, 4 aa, Entamoeba invadens
AEGH

SEQ ID NO: 2837551 - protein, 9 aa, Entamoeba invadens
AEGIGTGWS

SEQ ID NO: 2837552 - protein, 7 aa, Entamoeba invadens
AEGKERS

SEQ ID NO: 2837553 - protein, 20 aa, Entamoeba invadens
AEGKKLNKYAYGGKAFGQRE

SEQ ID NO: 2837554 - protein, 5 aa, Entamoeba invadens
AEGKR

SEQ ID NO: 2837555 - protein, 4 aa, Entamoeba invadens
AEGM

SEQ ID NO: 2837556 - protein, 4 aa, Entamoeba invadens
AEGP

SEQ ID NO: 2837557 - protein, 65 aa, Entamoeba invadens
AEGQTMTKNIAKQKEVLKKDRDNYVSCGKDDESAKASYQKSFNNPSSKAAKTVQLKEKQQQTNAK

SEQ ID NO: 2837558 - protein, 5 aa, Entamoeba invadens
AEGRI

SEQ ID NO: 2837559 - protein, 12 aa, Entamoeba invadens
AEGRTTKQIPKA

SEQ ID NO: 2837560 - protein, 18 aa, Entamoeba invadens
AEGSRPAESYGGIPGTEI

SEQ ID NO: 2837561 - protein, 7 aa, Entamoeba invadens
AEGTTMD

SEQ ID NO: 2837562 - protein, 14 aa, Entamoeba invadens
AEGYDLDDIRFVVL

SEQ ID NO: 2837563 - protein, 9 aa, Entamoeba invadens
AEHAEGSAA

SEQ ID NO: 2837564 - protein, 8 aa, Entamoeba invadens
AEHAEGTA

SEQ ID NO: 2837565 - protein, 8 aa, Entamoeba invadens
AEHAGTYP

SEQ ID NO: 2837566 - protein, 6 aa, Entamoeba invadens
AEHDDN

SEQ ID NO: 2837567 - protein, 6 aa, Entamoeba invadens
AEHKKS

SEQ ID NO: 2837568 - protein, 5 aa, Entamoeba invadens
AEHSE

SEQ ID NO: 2837569 - protein, 6 aa, Entamoeba invadens
AEIAPP

SEQ ID NO: 2837570 - protein, 7 aa, Entamoeba invadens
AEIEGRV

SEQ ID NO: 2837571 - protein, 6 aa, Entamoeba invadens
AEIEKS

SEQ ID NO: 2837572 - protein, 14 aa, Entamoeba invadens
AEIESEKIKKQKRL

SEQ ID NO: 2837573 - protein, 11 aa, Entamoeba invadens
AEIKEQQQKEL

SEQ ID NO: 2837574 - protein, 5 aa, Entamoeba invadens
AEINP

SEQ ID NO: 2837575 - protein, 6 aa, Entamoeba invadens
AEIQKM

SEQ ID NO: 2837576 - protein, 14 aa, Entamoeba invadens
AEISESKESKITRE

SEQ ID NO: 2837577 - protein, 7 aa, Entamoeba invadens
AEISPEA

SEQ ID NO: 2837578 - protein, 8 aa, Entamoeba invadens
AEISPEAF

SEQ ID NO: 2837579 - protein, 13 aa, Entamoeba invadens
AEITSDGSTYSIE

SEQ ID NO: 2837580 - protein, 8 aa, Entamoeba invadens
AEKAHNDL

SEQ ID NO: 2837581 - protein, 29 aa, Entamoeba invadens
AEKAKTAADPAKTYAEGPGVEGGCKTCDT

SEQ ID NO: 2837582 - protein, 8 aa, Entamoeba invadens
AEKAQRQT

SEQ ID NO: 2837583 - protein, 11 aa, Entamoeba invadens
AEKASAAKKGM

SEQ ID NO: 2837584 - protein, 6 aa, Entamoeba invadens
AEKAVS

SEQ ID NO: 2837585 - protein, 4 aa, Entamoeba invadens
AEKE

SEQ ID NO: 2837586 - protein, 7 aa, Entamoeba invadens
AEKEDKV

SEQ ID NO: 2837587 - protein, 14 aa, Entamoeba invadens
AEKEKEGDAPVYQD

SEQ ID NO: 2837588 - protein, 6 aa, Entamoeba invadens
AEKEKF

SEQ ID NO: 2837589 - protein, 9 aa, Entamoeba invadens
AEKENLNTE

SEQ ID NO: 2837590 - protein, 15 aa, Entamoeba invadens
AEKEQINSCTTDKEA

SEQ ID NO: 2837591 - protein, 10 aa, Entamoeba invadens
AEKFKEEKKQ

SEQ ID NO: 2837592 - protein, 7 aa, Entamoeba invadens
AEKFTVK

SEQ ID NO: 2837593 - protein, 10 aa, Entamoeba invadens
AEKGGKGLSI

SEQ ID NO: 2837594 - protein, 17 aa, Entamoeba invadens
AEKGGVGPAVQSVEDTY

SEQ ID NO: 2837595 - protein, 10 aa, Entamoeba invadens
AEKGKTIEQR

SEQ ID NO: 2837596 - protein, 6 aa, Entamoeba invadens
AEKGNE

SEQ ID NO: 2837597 - protein, 5 aa, Entamoeba invadens
AEKHG

SEQ ID NO: 2837598 - protein, 5 aa, Entamoeba invadens
AEKIG

SEQ ID NO: 2837599 - protein, 18 aa, Entamoeba invadens
AEKIKKEEDECKKPTEVI

SEQ ID NO: 2837600 - protein, 8 aa, Entamoeba invadens
AEKISGQR

SEQ ID NO: 2837601 - protein, 10 aa, Entamoeba invadens
AEKKEEEEDD

SEQ ID NO: 2837602 - protein, 16 aa, Entamoeba invadens
AEKKEKPKKDKKKCQI

SEQ ID NO: 2837603 - protein, 9 aa, Entamoeba invadens
AEKKGVYDP

SEQ ID NO: 2837604 - protein, 14 aa, Entamoeba invadens
AEKKKQLDDKNRDI

SEQ ID NO: 2837605 - protein, 7 aa, Entamoeba invadens
AEKKKTV

SEQ ID NO: 2837606 - protein, 7 aa, Entamoeba invadens
AEKKTQI

SEQ ID NO: 2837607 - protein, 5 aa, Entamoeba invadens
AEKLG

SEQ ID NO: 2837608 - protein, 14 aa, Entamoeba invadens
AEKLKNNGKSNKEI

SEQ ID NO: 2837609 - protein, 16 aa, Entamoeba invadens
AEKMERNKLKNQSQTN

SEQ ID NO: 2837610 - protein, 19 aa, Entamoeba invadens
AEKNESQKRLQRSKESEMN

SEQ ID NO: 2837611 - protein, 6 aa, Entamoeba invadens
AEKNIE

SEQ ID NO: 2837612 - protein, 12 aa, Entamoeba invadens
AEKNNERRKRRN

SEQ ID NO: 2837613 - protein, 7 aa, Entamoeba invadens
AEKNSET

SEQ ID NO: 2837614 - protein, 5 aa, Entamoeba invadens
AEKNT

SEQ ID NO: 2837615 - protein, 16 aa, Entamoeba invadens
AEKPKEDVTVENTQNL

SEQ ID NO: 2837616 - protein, 19 aa, Entamoeba invadens
AEKRKARCSGIRGKNERRY

SEQ ID NO: 2837617 - protein, 11 aa, Entamoeba invadens
AEKRKRTELPK

SEQ ID NO: 2837618 - protein, 12 aa, Entamoeba invadens
AEKRSKKGKGVC

SEQ ID NO: 2837619 - protein, 5 aa, Entamoeba invadens
AEKRY

SEQ ID NO: 2837620 - protein, 5 aa, Entamoeba invadens
AEKSI

SEQ ID NO: 2837621 - protein, 9 aa, Entamoeba invadens
AEKSKNGSF

SEQ ID NO: 2837622 - protein, 7 aa, Entamoeba invadens
AEKSNKM

SEQ ID NO: 2837623 - protein, 8 aa, Entamoeba invadens
AEKSRSIP

SEQ ID NO: 2837624 - protein, 8 aa, Entamoeba invadens
AEKSRTDF

SEQ ID NO: 2837625 - protein, 8 aa, Entamoeba invadens
AEKSTTFV

SEQ ID NO: 2837626 - protein, 7 aa, Entamoeba invadens
AEKTEKG

SEQ ID NO: 2837627 - protein, 7 aa, Entamoeba invadens
AEKTGGK

SEQ ID NO: 2837628 - protein, 30 aa, Entamoeba invadens
AEKTLMSKSPSGSQSDVSSTGTKRSPTTER

SEQ ID NO: 2837629 - protein, 7 aa, Entamoeba invadens
AEKTWGN

SEQ ID NO: 2837630 - protein, 4 aa, Entamoeba invadens
AEKV

SEQ ID NO: 2837631 - protein, 10 aa, Entamoeba invadens
AEKVENAKRK

SEQ ID NO: 2837632 - protein, 5 aa, Entamoeba invadens
AEKVT

SEQ ID NO: 2837633 - protein, 9 aa, Entamoeba invadens
AEKVTPRDE

SEQ ID NO: 2837634 - protein, 8 aa, Entamoeba invadens
AEKYGHDG

SEQ ID NO: 2837635 - protein, 6 aa, Entamoeba invadens
AEKYSE

SEQ ID NO: 2837636 - protein, 10 aa, Entamoeba invadens
AELAAEDYSA

SEQ ID NO: 2837637 - protein, 17 aa, Entamoeba invadens
AELASAKLSREYGTQID

SEQ ID NO: 2837638 - protein, 13 aa, Entamoeba invadens
AELDDALFPHPFM

SEQ ID NO: 2837639 - protein, 10 aa, Entamoeba invadens
AELDETKQLE

SEQ ID NO: 2837640 - protein, 15 aa, Entamoeba invadens
AELDKKLAGTPEEVK

SEQ ID NO: 2837641 - protein, 23 aa, Entamoeba invadens
AELEKKSVARSSLSSSIQKQKEL

SEQ ID NO: 2837642 - protein, 12 aa, Entamoeba invadens
AELEQEVAQKKH

SEQ ID NO: 2837643 - protein, 25 aa, Entamoeba invadens
AELEQKSKEEYIAQEEANLKKQELE

SEQ ID NO: 2837644 - protein, 6 aa, Entamoeba invadens
AELGKR

SEQ ID NO: 2837645 - protein, 9 aa, Entamoeba invadens
AELGNVKGQ

SEQ ID NO: 2837646 - protein, 6 aa, Entamoeba invadens
AELGTK

SEQ ID NO: 2837647 - protein, 14 aa, Entamoeba invadens
AELKKKQIKGKKSL

SEQ ID NO: 2837648 - protein, 20 aa, Entamoeba invadens
AELKKTKNGLKKMQKDTIRK

SEQ ID NO: 2837649 - protein, 8 aa, Entamoeba invadens
AELNDEKT

SEQ ID NO: 2837650 - protein, 9 aa, Entamoeba invadens
AELNEQSEK

SEQ ID NO: 2837651 - protein, 19 aa, Entamoeba invadens
AELPDRSDIGDLNKDGVDE

SEQ ID NO: 2837652 - protein, 40 aa, Entamoeba invadens
AELPQRKGNTNCNAKIDKKQNQSNETKKEDTNKDNSKNIV

SEQ ID NO: 2837653 - protein, 14 aa, Entamoeba invadens
AELPTEEKKTEEVS

SEQ ID NO: 2837654 - protein, 11 aa, Entamoeba invadens
AELSEGDEEEI

SEQ ID NO: 2837655 - protein, 6 aa, Entamoeba invadens
AELSEK

SEQ ID NO: 2837656 - protein, 8 aa, Entamoeba invadens
AELSKTKV

SEQ ID NO: 2837657 - protein, 14 aa, Entamoeba invadens
AELSSVSQSSKKVD

SEQ ID NO: 2837658 - protein, 23 aa, Entamoeba invadens
AELTEAKKMSETRKDQALRSTDA

SEQ ID NO: 2837659 - protein, 13 aa, Entamoeba invadens
AEMAEKGKSIVDP

SEQ ID NO: 2837660 - protein, 10 aa, Entamoeba invadens
AEMKKKATLS

SEQ ID NO: 2837661 - protein, 9 aa, Entamoeba invadens
AEMKPHKSG

SEQ ID NO: 2837662 - protein, 13 aa, Entamoeba invadens
AEMPEEGQTTATL

SEQ ID NO: 2837663 - protein, 27 aa, Entamoeba invadens
AEMREKRKLEKEAKHVQPSSSKDMSTA

SEQ ID NO: 2837664 - protein, 34 aa, Entamoeba invadens
AEMRRQKELREEKEAKQEAARQQREHERRQKELE

SEQ ID NO: 2837665 - protein, 12 aa, Entamoeba invadens
AEMRTKKEGEIE

SEQ ID NO: 2837666 - protein, 4 aa, Entamoeba invadens
AENA

SEQ ID NO: 2837667 - protein, 11 aa, Entamoeba invadens
AENDESSSESI

SEQ ID NO: 2837668 - protein, 5 aa, Entamoeba invadens
AENDI

SEQ ID NO: 2837669 - protein, 7 aa, Entamoeba invadens
AENEKLK

SEQ ID NO: 2837670 - protein, 6 aa, Entamoeba invadens
AENEKQ

SEQ ID NO: 2837671 - protein, 6 aa, Entamoeba invadens
AENEMQ

SEQ ID NO: 2837672 - protein, 4 aa, Entamoeba invadens
AENF

SEQ ID NO: 2837673 - protein, 5 aa, Entamoeba invadens
AENFG

SEQ ID NO: 2837674 - protein, 10 aa, Entamoeba invadens
AENGPNEEKK

SEQ ID NO: 2837675 - protein, 13 aa, Entamoeba invadens
AENGQDVELPEGQ

SEQ ID NO: 2837676 - protein, 5 aa, Entamoeba invadens
AENIE

SEQ ID NO: 2837677 - protein, 5 aa, Entamoeba invadens
AENII

SEQ ID NO: 2837678 - protein, 10 aa, Entamoeba invadens
AENKDDNDNK

SEQ ID NO: 2837679 - protein, 9 aa, Entamoeba invadens
AENKTDSTK

SEQ ID NO: 2837680 - protein, 17 aa, Entamoeba invadens
AENNGKFQGKKTNPDFP

SEQ ID NO: 2837681 - protein, 7 aa, Entamoeba invadens
AENPRES

SEQ ID NO: 2837682 - protein, 5 aa, Entamoeba invadens
AENQF

SEQ ID NO: 2837683 - protein, 17 aa, Entamoeba invadens
AENQQARQKVLEQGQKI

SEQ ID NO: 2837684 - protein, 7 aa, Entamoeba invadens
AENSGLN

SEQ ID NO: 2837685 - protein, 6 aa, Entamoeba invadens
AENSMK

SEQ ID NO: 2837686 - protein, 8 aa, Entamoeba invadens
AENSNTQI

SEQ ID NO: 2837687 - protein, 9 aa, Entamoeba invadens
AENSNTRRH

SEQ ID NO: 2837688 - protein, 9 aa, Entamoeba invadens
AENSTDDVQ

SEQ ID NO: 2837689 - protein, 11 aa, Entamoeba invadens
AENTADGLDKA

SEQ ID NO: 2837690 - protein, 16 aa, Entamoeba invadens
AENTVNKKEPQRPIEA

SEQ ID NO: 2837691 - protein, 9 aa, Entamoeba invadens
AENTVNNTK

SEQ ID NO: 2837692 - protein, 14 aa, Entamoeba invadens
AENVSGEKDEWGES

SEQ ID NO: 2837693 - protein, 12 aa, Entamoeba invadens
AENYDDKTGCGS

SEQ ID NO: 2837694 - protein, 9 aa, Entamoeba invadens
AENYGPSDK

SEQ ID NO: 2837695 - protein, 6 aa, Entamoeba invadens
AEPADG

SEQ ID NO: 2837696 - protein, 5 aa, Entamoeba invadens
AEPDG

SEQ ID NO: 2837697 - protein, 19 aa, Entamoeba invadens
AEPDKRTKINEIINALKSL

SEQ ID NO: 2837698 - protein, 6 aa, Entamoeba invadens
AEPGLP

SEQ ID NO: 2837699 - protein, 6 aa, Entamoeba invadens
AEPGRY

SEQ ID NO: 2837700 - protein, 23 aa, Entamoeba invadens
AEPINTPMNAKQERRSREAEVSN

SEQ ID NO: 2837701 - protein, 19 aa, Entamoeba invadens
AEPNQLPKIAQKTQESDSQ

SEQ ID NO: 2837702 - protein, 4 aa, Entamoeba invadens
AEPS

SEQ ID NO: 2837703 - protein, 6 aa, Entamoeba invadens
AEPSAL

SEQ ID NO: 2837704 - protein, 10 aa, Entamoeba invadens
AEPSNENKKE

SEQ ID NO: 2837705 - protein, 7 aa, Entamoeba invadens
AEPTAMP

SEQ ID NO: 2837706 - protein, 4 aa, Entamoeba invadens
AEPV

SEQ ID NO: 2837707 - protein, 19 aa, Entamoeba invadens
AEPVNGKAVTLGSVKGSEL

SEQ ID NO: 2837708 - protein, 18 aa, Entamoeba invadens
AEQEAAKTGQKKRPTTAG

SEQ ID NO: 2837709 - protein, 8 aa, Entamoeba invadens
AEQEGKDK

SEQ ID NO: 2837710 - protein, 19 aa, Entamoeba invadens
AEQEKVKTIRDYKAASEEL

SEQ ID NO: 2837711 - protein, 12 aa, Entamoeba invadens
AEQENTTKTQQK

SEQ ID NO: 2837712 - protein, 8 aa, Entamoeba invadens
AEQGKSNL

SEQ ID NO: 2837713 - protein, 4 aa, Entamoeba invadens
AEQI

SEQ ID NO: 2837714 - protein, 11 aa, Entamoeba invadens
AEQINTSEESL

SEQ ID NO: 2837715 - protein, 23 aa, Entamoeba invadens
AEQISASREKQEPSPWRNRSVEE

SEQ ID NO: 2837716 - protein, 10 aa, Entamoeba invadens
AEQKDNDKFK

SEQ ID NO: 2837717 - protein, 10 aa, Entamoeba invadens
AEQKKIQGNE

SEQ ID NO: 2837718 - protein, 6 aa, Entamoeba invadens
AEQKKK

SEQ ID NO: 2837719 - protein, 7 aa, Entamoeba invadens
AEQKLGE

SEQ ID NO: 2837720 - protein, 42 aa, Entamoeba invadens
AEQKRRAEEEARRKAELAERERQEIERKRLEEQKRIEEEERI

SEQ ID NO: 2837721 - protein, 11 aa, Entamoeba invadens
AEQQIRATTQN

SEQ ID NO: 2837722 - protein, 13 aa, Entamoeba invadens
AEQQQKATGAGQG

SEQ ID NO: 2837723 - protein, 14 aa, Entamoeba invadens
AEQQTQQPCYSPRT

SEQ ID NO: 2837724 - protein, 6 aa, Entamoeba invadens
AEQRNK

SEQ ID NO: 2837725 - protein, 7 aa, Entamoeba invadens
AEQRNKE

SEQ ID NO: 2837726 - protein, 13 aa, Entamoeba invadens
AEQRRKEKEDMEK

SEQ ID NO: 2837727 - protein, 7 aa, Entamoeba invadens
AEQSERY

SEQ ID NO: 2837728 - protein, 8 aa, Entamoeba invadens
AEQSERYE

SEQ ID NO: 2837729 - protein, 23 aa, Entamoeba invadens
AEQSTKSSSQTLPKKIKEEEIPR

SEQ ID NO: 2837730 - protein, 11 aa, Entamoeba invadens
AEQSVSRISAQ

SEQ ID NO: 2837731 - protein, 10 aa, Entamoeba invadens
AERAAQDSLT

SEQ ID NO: 2837732 - protein, 12 aa, Entamoeba invadens
AERAAQDSPTFR

SEQ ID NO: 2837733 - protein, 30 aa, Entamoeba invadens
AERARNEVLKGDKTAAQQMQKKQRRTRRSL

SEQ ID NO: 2837734 - protein, 8 aa, Entamoeba invadens
AERDPAQI

SEQ ID NO: 2837735 - protein, 9 aa, Entamoeba invadens
AERDSSNYA

SEQ ID NO: 2837736 - protein, 6 aa, Entamoeba invadens
AEREKF

SEQ ID NO: 2837737 - protein, 5 aa, Entamoeba invadens
AERES

SEQ ID NO: 2837738 - protein, 6 aa, Entamoeba invadens
AERGEI

SEQ ID NO: 2837739 - protein, 8 aa, Entamoeba invadens
AERGGDGR

SEQ ID NO: 2837740 - protein, 16 aa, Entamoeba invadens
AERKESEEKIENARKI

SEQ ID NO: 2837741 - protein, 16 aa, Entamoeba invadens
AERKGDDKIKEDRTAW

SEQ ID NO: 2837742 - protein, 8 aa, Entamoeba invadens
AERKRQNF

SEQ ID NO: 2837743 - protein, 6 aa, Entamoeba invadens
AERNAY

SEQ ID NO: 2837744 - protein, 7 aa, Entamoeba invadens
AERPNMD

SEQ ID NO: 2837745 - protein, 9 aa, Entamoeba invadens
AERPSRTDF

SEQ ID NO: 2837746 - protein, 8 aa, Entamoeba invadens
AERREENE

SEQ ID NO: 2837747 - protein, 6 aa, Entamoeba invadens
AERRNI

SEQ ID NO: 2837748 - protein, 10 aa, Entamoeba invadens
AERSAQDSLT

SEQ ID NO: 2837749 - protein, 9 aa, Entamoeba invadens
AERSKPLAK

SEQ ID NO: 2837750 - protein, 12 aa, Entamoeba invadens
AERSKQENYKTN

SEQ ID NO: 2837751 - protein, 5 aa, Entamoeba invadens
AERSL

SEQ ID NO: 2837752 - protein, 6 aa, Entamoeba invadens
AERSRR

SEQ ID NO: 2837753 - protein, 12 aa, Entamoeba invadens
AERSSKRFEIGE

SEQ ID NO: 2837754 - protein, 29 aa, Entamoeba invadens
AERTAMKNPPFKTNAENTRKQQIVCLAAE

SEQ ID NO: 2837755 - protein, 6 aa, Entamoeba invadens
AERTKV

SEQ ID NO: 2837756 - protein, 15 aa, Entamoeba invadens
AERVESLKRKDRTKR

SEQ ID NO: 2837757 - protein, 20 aa, Entamoeba invadens
AERVPNSKKMNVTAPENRDI

SEQ ID NO: 2837758 - protein, 12 aa, Entamoeba invadens
AERVPTTFTGNP

SEQ ID NO: 2837759 - protein, 9 aa, Entamoeba invadens
AERYPTKNT

SEQ ID NO: 2837760 - protein, 13 aa, Entamoeba invadens
AESAQKVQEINAH

SEQ ID NO: 2837761 - protein, 6 aa, Entamoeba invadens
AESCEV

SEQ ID NO: 2837762 - protein, 18 aa, Entamoeba invadens
AESDKGYGIGDSRVNYGD

SEQ ID NO: 2837763 - protein, 9 aa, Entamoeba invadens
AESEDSREA

SEQ ID NO: 2837764 - protein, 9 aa, Entamoeba invadens
AESEKRYKE

SEQ ID NO: 2837765 - protein, 6 aa, Entamoeba invadens
AESERE

SEQ ID NO: 2837766 - protein, 7 aa, Entamoeba invadens
AESETAA

SEQ ID NO: 2837767 - protein, 6 aa, Entamoeba invadens
AESGKK

SEQ ID NO: 2837768 - protein, 10 aa, Entamoeba invadens
AESGSTNEYV

SEQ ID NO: 2837769 - protein, 8 aa, Entamoeba invadens
AESGSTSK

SEQ ID NO: 2837770 - protein, 10 aa, Entamoeba invadens
AESGSTSKQR

SEQ ID NO: 2837771 - protein, 8 aa, Entamoeba invadens
AESGTASF

SEQ ID NO: 2837772 - protein, 4 aa, Entamoeba invadens
AESI

SEQ ID NO: 2837773 - protein, 7 aa, Entamoeba invadens
AESIERL

SEQ ID NO: 2837774 - protein, 19 aa, Entamoeba invadens
AESIRTELDQEKKDHTKTQ

SEQ ID NO: 2837775 - protein, 17 aa, Entamoeba invadens
AESKETQQGPRPGSIPN

SEQ ID NO: 2837776 - protein, 20 aa, Entamoeba invadens
AESKQPQKEENGDLKLSAKS

SEQ ID NO: 2837777 - protein, 9 aa, Entamoeba invadens
AESKYQNAV

SEQ ID NO: 2837778 - protein, 15 aa, Entamoeba invadens
AESMESEQLEKEYKE

SEQ ID NO: 2837779 - protein, 11 aa, Entamoeba invadens
AESNDRSKPVI

SEQ ID NO: 2837780 - protein, 5 aa, Entamoeba invadens
AESPN

SEQ ID NO: 2837781 - protein, 5 aa, Entamoeba invadens
AESRE

SEQ ID NO: 2837782 - protein, 6 aa, Entamoeba invadens
AESRPD

SEQ ID NO: 2837783 - protein, 20 aa, Entamoeba invadens
AESRTANEEHEREKEKLREE

SEQ ID NO: 2837784 - protein, 10 aa, Entamoeba invadens
AESSKQFTQD

SEQ ID NO: 2837785 - protein, 13 aa, Entamoeba invadens
AESSQIEEWSGKR

SEQ ID NO: 2837786 - protein, 8 aa, Entamoeba invadens
AESSRIKK

SEQ ID NO: 2837787 - protein, 10 aa, Entamoeba invadens
AESVAKEGAL

SEQ ID NO: 2837788 - protein, 7 aa, Entamoeba invadens
AESVGGQ

SEQ ID NO: 2837789 - protein, 8 aa, Entamoeba invadens
AESVPESV

SEQ ID NO: 2837790 - protein, 5 aa, Entamoeba invadens
AESVS

SEQ ID NO: 2837791 - protein, 7 aa, Entamoeba invadens
AESVSGQ

SEQ ID NO: 2837792 - protein, 8 aa, Entamoeba invadens
AESYESVA

SEQ ID NO: 2837793 - protein, 6 aa, Entamoeba invadens
AESYNH

SEQ ID NO: 2837794 - protein, 7 aa, Entamoeba invadens
AETAAEG

SEQ ID NO: 2837795 - protein, 8 aa, Entamoeba invadens
AETAAEGV

SEQ ID NO: 2837796 - protein, 6 aa, Entamoeba invadens
AETASE

SEQ ID NO: 2837797 - protein, 8 aa, Entamoeba invadens
AETASRHK

SEQ ID NO: 2837798 - protein, 8 aa, Entamoeba invadens
AETATEGV

SEQ ID NO: 2837799 - protein, 6 aa, Entamoeba invadens
AETDAP

SEQ ID NO: 2837800 - protein, 10 aa, Entamoeba invadens
AETDGKVSRS

SEQ ID NO: 2837801 - protein, 17 aa, Entamoeba invadens
AETDSDIQFDKKESTDV

SEQ ID NO: 2837802 - protein, 7 aa, Entamoeba invadens
AETEDQL

SEQ ID NO: 2837803 - protein, 7 aa, Entamoeba invadens
AETERQL

SEQ ID NO: 2837804 - protein, 25 aa, Entamoeba invadens
AETETRTKSMRRPTRKGGRKPPTKE

SEQ ID NO: 2837805 - protein, 5 aa, Entamoeba invadens
AETFA

SEQ ID NO: 2837806 - protein, 11 aa, Entamoeba invadens
AETGKTTTKLN

SEQ ID NO: 2837807 - protein, 8 aa, Entamoeba invadens
AETGMGDF

SEQ ID NO: 2837808 - protein, 10 aa, Entamoeba invadens
AETGTGKTAA

SEQ ID NO: 2837809 - protein, 9 aa, Entamoeba invadens
AETGTQSPF

SEQ ID NO: 2837810 - protein, 6 aa, Entamoeba invadens
AETIEK

SEQ ID NO: 2837811 - protein, 13 aa, Entamoeba invadens
AETIKDSFREPPK

SEQ ID NO: 2837812 - protein, 6 aa, Entamoeba invadens
AETKDD

SEQ ID NO: 2837813 - protein, 18 aa, Entamoeba invadens
AETKDGTRGWVSAHFVKF

SEQ ID NO: 2837814 - protein, 11 aa, Entamoeba invadens
AETKNAPASYT

SEQ ID NO: 2837815 - protein, 17 aa, Entamoeba invadens
AETKREKMRDSRRSKRS

SEQ ID NO: 2837816 - protein, 24 aa, Entamoeba invadens
AETKTNSTKEELNESKKEETPKRS

SEQ ID NO: 2837817 - protein, 13 aa, Entamoeba invadens
AETKYSKENAPEK

SEQ ID NO: 2837818 - protein, 11 aa, Entamoeba invadens
AETLDKDSKTV

SEQ ID NO: 2837819 - protein, 5 aa, Entamoeba invadens
AETLE

SEQ ID NO: 2837820 - protein, 6 aa, Entamoeba invadens
AETLEK

SEQ ID NO: 2837821 - protein, 6 aa, Entamoeba invadens
AETLPK

SEQ ID NO: 2837822 - protein, 7 aa, Entamoeba invadens
AETMDQS

SEQ ID NO: 2837823 - protein, 9 aa, Entamoeba invadens
AETNDDEVK

SEQ ID NO: 2837824 - protein, 6 aa, Entamoeba invadens
AETNKM

SEQ ID NO: 2837825 - protein, 9 aa, Entamoeba invadens
AETPEGEQC

SEQ ID NO: 2837826 - protein, 27 aa, Entamoeba invadens
AETPEKNVQMAEQEKTMRDYKAASEEL

SEQ ID NO: 2837827 - protein, 15 aa, Entamoeba invadens
AETQKRGKMFLVVKT

SEQ ID NO: 2837828 - protein, 7 aa, Entamoeba invadens
AETRDKT

SEQ ID NO: 2837829 - protein, 5 aa, Entamoeba invadens
AETRE

SEQ ID NO: 2837830 - protein, 15 aa, Entamoeba invadens
AETRKDAKALVERGA

SEQ ID NO: 2837831 - protein, 6 aa, Entamoeba invadens
AETSDV

SEQ ID NO: 2837832 - protein, 5 aa, Entamoeba invadens
AETSE

SEQ ID NO: 2837833 - protein, 5 aa, Entamoeba invadens
AETSL

SEQ ID NO: 2837834 - protein, 6 aa, Entamoeba invadens
AETSLT

SEQ ID NO: 2837835 - protein, 6 aa, Entamoeba invadens
AETSSV

SEQ ID NO: 2837836 - protein, 8 aa, Entamoeba invadens
AETSVTIP

SEQ ID NO: 2837837 - protein, 4 aa, Entamoeba invadens
AETT

SEQ ID NO: 2837838 - protein, 10 aa, Entamoeba invadens
AETTANSGEL

SEQ ID NO: 2837839 - protein, 17 aa, Entamoeba invadens
AETTDTQQEKDEDETQV

SEQ ID NO: 2837840 - protein, 13 aa, Entamoeba invadens
AETTEEEEDPTKI

SEQ ID NO: 2837841 - protein, 7 aa, Entamoeba invadens
AETTNPL

SEQ ID NO: 2837842 - protein, 8 aa, Entamoeba invadens
AETTSSEF

SEQ ID NO: 2837843 - protein, 4 aa, Entamoeba invadens
AETV

SEQ ID NO: 2837844 - protein, 6 aa, Entamoeba invadens
AETVST

SEQ ID NO: 2837845 - protein, 4 aa, Entamoeba invadens
AETY

SEQ ID NO: 2837846 - protein, 7 aa, Entamoeba invadens
AETYRGN

SEQ ID NO: 2837847 - protein, 29 aa, Entamoeba invadens
AEVDKAQKQFDTANDEKDGNEAMKQKYQD

SEQ ID NO: 2837848 - protein, 29 aa, Entamoeba invadens
AEVDKAQKQLDTANDDKDGNEAMKQKYQD

SEQ ID NO: 2837849 - protein, 31 aa, Entamoeba invadens
AEVDKAQKQLDTANDDKDGNEAMKQKYQDEL

SEQ ID NO: 2837850 - protein, 32 aa, Entamoeba invadens
AEVDKAQKQLDTANDDKDGNEAMKQKYQDELK

SEQ ID NO: 2837851 - protein, 50 aa, Entamoeba invadens
AEVDKAQKQLDTANDDKDGNEEMKQKYQDELKSVRTELDQKKKDHTKTQL

SEQ ID NO: 2837852 - protein, 50 aa, Entamoeba invadens
AEVDKAQKQLDTANDDKDGNKAMKQKYQDELKSVRTELDQEKKDHSKTQL

SEQ ID NO: 2837853 - protein, 29 aa, Entamoeba invadens
AEVDNAQKQLDTANDDKDGNEAMKQKYKD

SEQ ID NO: 2837854 - protein, 4 aa, Entamoeba invadens
AEVE

SEQ ID NO: 2837855 - protein, 23 aa, Entamoeba invadens
AEVEKPKKDLKKERREKEKQKEE

SEQ ID NO: 2837856 - protein, 7 aa, Entamoeba invadens
AEVERAK

SEQ ID NO: 2837857 - protein, 12 aa, Entamoeba invadens
AEVGGTVETNDY

SEQ ID NO: 2837858 - protein, 12 aa, Entamoeba invadens
AEVKKDVKTEQE

SEQ ID NO: 2837859 - protein, 19 aa, Entamoeba invadens
AEVKKGAEEQLKTQTTVND

SEQ ID NO: 2837860 - protein, 8 aa, Entamoeba invadens
AEVQQRAS

SEQ ID NO: 2837861 - protein, 8 aa, Entamoeba invadens
AEVSNDSL

SEQ ID NO: 2837862 - protein, 6 aa, Entamoeba invadens
AEVTSD

SEQ ID NO: 2837863 - protein, 14 aa, Entamoeba invadens
AEVTTTSAVDAKNT

SEQ ID NO: 2837864 - protein, 7 aa, Entamoeba invadens
AEVVEKD

SEQ ID NO: 2837865 - protein, 9 aa, Entamoeba invadens
AEVYDEDKV

SEQ ID NO: 2837866 - protein, 6 aa, Entamoeba invadens
AEWEKT

SEQ ID NO: 2837867 - protein, 5 aa, Entamoeba invadens
AEWTP

SEQ ID NO: 2837868 - protein, 4 aa, Entamoeba invadens
AEYA

SEQ ID NO: 2837869 - protein, 9 aa, Entamoeba invadens
AEYEDPDGN

SEQ ID NO: 2837870 - protein, 9 aa, Entamoeba invadens
AEYEKTNEI

SEQ ID NO: 2837871 - protein, 8 aa, Entamoeba invadens
AEYERENN

SEQ ID NO: 2837872 - protein, 33 aa, Entamoeba invadens
AEYESGEQNTEQQQSGENKEGDAVEQNDTTQNY

SEQ ID NO: 2837873 - protein, 11 aa, Entamoeba invadens
AEYKDEAEDII

SEQ ID NO: 2837874 - protein, 6 aa, Entamoeba invadens
AEYKTE

SEQ ID NO: 2837875 - protein, 18 aa, Entamoeba invadens
AEYNNHPVRHEDDNHCRT

SEQ ID NO: 2837876 - protein, 12 aa, Entamoeba invadens
AEYNSKKAKAAA

SEQ ID NO: 2837877 - protein, 5 aa, Entamoeba invadens
AEYPD

SEQ ID NO: 2837878 - protein, 9 aa, Entamoeba invadens
AEYRNQQDK

SEQ ID NO: 2837879 - protein, 7 aa, Entamoeba invadens
AEYRNSD

SEQ ID NO: 2837880 - protein, 8 aa, Entamoeba invadens
AEYTPQYS

SEQ ID NO: 2837881 - protein, 16 aa, Entamoeba invadens
AFAEGDKKDSYKPKTF

SEQ ID NO: 2837882 - protein, 6 aa, Entamoeba invadens
AFANNQ

SEQ ID NO: 2837883 - protein, 9 aa, Entamoeba invadens
AFAQDGSSF

SEQ ID NO: 2837884 - protein, 7 aa, Entamoeba invadens
AFAQNSA

SEQ ID NO: 2837885 - protein, 5 aa, Entamoeba invadens
AFDDS

SEQ ID NO: 2837886 - protein, 4 aa, Entamoeba invadens
AFDE

SEQ ID NO: 2837887 - protein, 6 aa, Entamoeba invadens
AFDEDE

SEQ ID NO: 2837888 - protein, 5 aa, Entamoeba invadens
AFDGN

SEQ ID NO: 2837889 - protein, 77 aa, Entamoeba invadens
AFDNEKPKEISSSLNTMTKKSTYQHPNKKSTEHSTKENSRWKDTKTREYKGNEKKMNDTRRHDREGGEKYNKKHSKI

SEQ ID NO: 2837890 - protein, 5 aa, Entamoeba invadens
AFDPA

SEQ ID NO: 2837891 - protein, 10 aa, Entamoeba invadens
AFDPSERETV

SEQ ID NO: 2837892 - protein, 6 aa, Entamoeba invadens
AFDPST

SEQ ID NO: 2837893 - protein, 9 aa, Entamoeba invadens
AFDSPSEEL

SEQ ID NO: 2837894 - protein, 22 aa, Entamoeba invadens
AFDSQTKETLKTQSSKFGSKPV

SEQ ID NO: 2837895 - protein, 17 aa, Entamoeba invadens
AFDTKNKDSLMTGINPW

SEQ ID NO: 2837896 - protein, 29 aa, Entamoeba invadens
AFDTRAEKEKEATPFHGTANTKPTKETHE

SEQ ID NO: 2837897 - protein, 29 aa, Entamoeba invadens
AFDTSDETFEMSKSGDVRSEMEKQTERME

SEQ ID NO: 2837898 - protein, 21 aa, Entamoeba invadens
AFDYGGSTKNIVGDVNDNKTV

SEQ ID NO: 2837899 - protein, 5 aa, Entamoeba invadens
AFEEC

SEQ ID NO: 2837900 - protein, 6 aa, Entamoeba invadens
AFEEKT

SEQ ID NO: 2837901 - protein, 5 aa, Entamoeba invadens
AFEGC

SEQ ID NO: 2837902 - protein, 5 aa, Entamoeba invadens
AFENS

SEQ ID NO: 2837903 - protein, 8 aa, Entamoeba invadens
AFERGDKA

SEQ ID NO: 2837904 - protein, 6 aa, Entamoeba invadens
AFESGE

SEQ ID NO: 2837905 - protein, 13 aa, Entamoeba invadens
AFESLSTKTDIKS

SEQ ID NO: 2837906 - protein, 10 aa, Entamoeba invadens
AFESTKNSSY

SEQ ID NO: 2837907 - protein, 4 aa, Entamoeba invadens
AFGE

SEQ ID NO: 2837908 - protein, 5 aa, Entamoeba invadens
AFGES

SEQ ID NO: 2837909 - protein, 6 aa, Entamoeba invadens
AFGGNR

SEQ ID NO: 2837910 - protein, 6 aa, Entamoeba invadens
AFGSQA

SEQ ID NO: 2837911 - protein, 4 aa, Entamoeba invadens
AFGT

SEQ ID NO: 2837912 - protein, 6 aa, Entamoeba invadens
AFKNEN

SEQ ID NO: 2837913 - protein, 8 aa, Entamoeba invadens
AFKNSKEL

SEQ ID NO: 2837914 - protein, 7 aa, Entamoeba invadens
AFKPKDT

SEQ ID NO: 2837915 - protein, 7 aa, Entamoeba invadens
AFKPSKL

SEQ ID NO: 2837916 - protein, 16 aa, Entamoeba invadens
AFKQANKDIAFVVIQN

SEQ ID NO: 2837917 - protein, 9 aa, Entamoeba invadens
AFKQKGRGM

SEQ ID NO: 2837918 - protein, 10 aa, Entamoeba invadens
AFKSNVDKAV

SEQ ID NO: 2837919 - protein, 9 aa, Entamoeba invadens
AFKTESKRP

SEQ ID NO: 2837920 - protein, 31 aa, Entamoeba invadens
AFNKEKDELEKIRKTNPAAFSTRKSSQIDSN

SEQ ID NO: 2837921 - protein, 14 aa, Entamoeba invadens
AFPAERKCKEESLA

SEQ ID NO: 2837922 - protein, 5 aa, Entamoeba invadens
AFPKE

SEQ ID NO: 2837923 - protein, 12 aa, Entamoeba invadens
AFPPGATETPTF

SEQ ID NO: 2837924 - protein, 6 aa, Entamoeba invadens
AFPSED

SEQ ID NO: 2837925 - protein, 4 aa, Entamoeba invadens
AFPT

SEQ ID NO: 2837926 - protein, 12 aa, Entamoeba invadens
AFPTNYDGTISL

SEQ ID NO: 2837927 - protein, 4 aa, Entamoeba invadens
AFQD

SEQ ID NO: 2837928 - protein, 16 aa, Entamoeba invadens
AFQEDKPTTSKKERTV

SEQ ID NO: 2837929 - protein, 6 aa, Entamoeba invadens
AFQGKS

SEQ ID NO: 2837930 - protein, 6 aa, Entamoeba invadens
AFRDDN

SEQ ID NO: 2837931 - protein, 7 aa, Entamoeba invadens
AFRNSGL

SEQ ID NO: 2837932 - protein, 5 aa, Entamoeba invadens
AFRRY

SEQ ID NO: 2837933 - protein, 4 aa, Entamoeba invadens
AFRT

SEQ ID NO: 2837934 - protein, 13 aa, Entamoeba invadens
AFSATGSTFGLSI

SEQ ID NO: 2837935 - protein, 25 aa, Entamoeba invadens
AFSDGTDASYNIQPPCTPRGDQNAS

SEQ ID NO: 2837936 - protein, 9 aa, Entamoeba invadens
AFSDNTSLE

SEQ ID NO: 2837937 - protein, 12 aa, Entamoeba invadens
AFSDTPDDTNFD

SEQ ID NO: 2837938 - protein, 5 aa, Entamoeba invadens
AFSEC

SEQ ID NO: 2837939 - protein, 8 aa, Entamoeba invadens
AFSEDKKN

SEQ ID NO: 2837940 - protein, 5 aa, Entamoeba invadens
AFSGD

SEQ ID NO: 2837941 - protein, 6 aa, Entamoeba invadens
AFSGQK

SEQ ID NO: 2837942 - protein, 8 aa, Entamoeba invadens
AFSGSTQL

SEQ ID NO: 2837943 - protein, 6 aa, Entamoeba invadens
AFSGTK

SEQ ID NO: 2837944 - protein, 7 aa, Entamoeba invadens
AFSKDNS

SEQ ID NO: 2837945 - protein, 4 aa, Entamoeba invadens
AFSN

SEQ ID NO: 2837946 - protein, 8 aa, Entamoeba invadens
AFSNGSID

SEQ ID NO: 2837947 - protein, 7 aa, Entamoeba invadens
AFSNNKK

SEQ ID NO: 2837948 - protein, 17 aa, Entamoeba invadens
AFSPAQTKCTVVYSTFY

SEQ ID NO: 2837949 - protein, 7 aa, Entamoeba invadens
AFSPEGM

SEQ ID NO: 2837950 - protein, 8 aa, Entamoeba invadens
AFSPSDSE

SEQ ID NO: 2837951 - protein, 7 aa, Entamoeba invadens
AFSPTSS

SEQ ID NO: 2837952 - protein, 12 aa, Entamoeba invadens
AFSQASKTQQEI

SEQ ID NO: 2837953 - protein, 10 aa, Entamoeba invadens
AFSQQSPQIT

SEQ ID NO: 2837954 - protein, 6 aa, Entamoeba invadens
AFSSCD

SEQ ID NO: 2837955 - protein, 8 aa, Entamoeba invadens
AFSSLGSR

SEQ ID NO: 2837956 - protein, 5 aa, Entamoeba invadens
AFSSN

SEQ ID NO: 2837957 - protein, 7 aa, Entamoeba invadens
AFSSNSN

SEQ ID NO: 2837958 - protein, 7 aa, Entamoeba invadens
AFSSSKL

SEQ ID NO: 2837959 - protein, 8 aa, Entamoeba invadens
AFSSSRAT

SEQ ID NO: 2837960 - protein, 4 aa, Entamoeba invadens
AFSY

SEQ ID NO: 2837961 - protein, 17 aa, Entamoeba invadens
AFTKRESPFEASSYTGN

SEQ ID NO: 2837962 - protein, 5 aa, Entamoeba invadens
AFTKS

SEQ ID NO: 2837963 - protein, 7 aa, Entamoeba invadens
AFTPDSS

SEQ ID NO: 2837964 - protein, 5 aa, Entamoeba invadens
AFTQE

SEQ ID NO: 2837965 - protein, 5 aa, Entamoeba invadens
AFTSG

SEQ ID NO: 2837966 - protein, 6 aa, Entamoeba invadens
AFTSSE

SEQ ID NO: 2837967 - protein, 11 aa, Entamoeba invadens
AFVPDAPKSEQ

SEQ ID NO: 2837968 - protein, 9 aa, Entamoeba invadens
AFVSPKNKN

SEQ ID NO: 2837969 - protein, 10 aa, Entamoeba invadens
AGADKGNLRE

SEQ ID NO: 2837970 - protein, 6 aa, Entamoeba invadens
AGADPK

SEQ ID NO: 2837971 - protein, 4 aa, Entamoeba invadens
AGAE

SEQ ID NO: 2837972 - protein, 6 aa, Entamoeba invadens
AGAESI

SEQ ID NO: 2837973 - protein, 8 aa, Entamoeba invadens
AGAEVDDA

SEQ ID NO: 2837974 - protein, 6 aa, Entamoeba invadens
AGAGDI

SEQ ID NO: 2837975 - protein, 7 aa, Entamoeba invadens
AGAGEAY

SEQ ID NO: 2837976 - protein, 8 aa, Entamoeba invadens
AGAIDPEL

SEQ ID NO: 2837977 - protein, 6 aa, Entamoeba invadens
AGAKGP

SEQ ID NO: 2837978 - protein, 6 aa, Entamoeba invadens
AGAKSV

SEQ ID NO: 2837979 - protein, 9 aa, Entamoeba invadens
AGAKTTGKY

SEQ ID NO: 2837980 - protein, 4 aa, Entamoeba invadens
AGAL

SEQ ID NO: 2837981 - protein, 5 aa, Entamoeba invadens
AGALI

SEQ ID NO: 2837982 - protein, 11 aa, Entamoeba invadens
AGANKEGAMDA

SEQ ID NO: 2837983 - protein, 8 aa, Entamoeba invadens
AGAQEMKE

SEQ ID NO: 2837984 - protein, 8 aa, Entamoeba invadens
AGASSENL

SEQ ID NO: 2837985 - protein, 4 aa, Entamoeba invadens
AGAT

SEQ ID NO: 2837986 - protein, 9 aa, Entamoeba invadens
AGATKEGVM

SEQ ID NO: 2837987 - protein, 10 aa, Entamoeba invadens
AGATVDDSKI

SEQ ID NO: 2837988 - protein, 8 aa, Entamoeba invadens
AGATVDEA

SEQ ID NO: 2837989 - protein, 6 aa, Entamoeba invadens
AGAVES

SEQ ID NO: 2837990 - protein, 6 aa, Entamoeba invadens
AGAYGI

SEQ ID NO: 2837991 - protein, 5 aa, Entamoeba invadens
AGCDT

SEQ ID NO: 2837992 - protein, 5 aa, Entamoeba invadens
AGCGD

SEQ ID NO: 2837993 - protein, 8 aa, Entamoeba invadens
AGCGKTSL

SEQ ID NO: 2837994 - protein, 7 aa, Entamoeba invadens
AGCGKTT

SEQ ID NO: 2837995 - protein, 4 aa, Entamoeba invadens
AGCV

SEQ ID NO: 2837996 - protein, 9 aa, Entamoeba invadens
AGDAAHSET

SEQ ID NO: 2837997 - protein, 10 aa, Entamoeba invadens
AGDADTNKAV

SEQ ID NO: 2837998 - protein, 12 aa, Entamoeba invadens
AGDADTNSAVAG

SEQ ID NO: 2837999 - protein, 5 aa, Entamoeba invadens
AGDAF

SEQ ID NO: 2838000 - protein, 8 aa, Entamoeba invadens
AGDASNQL

SEQ ID NO: 2838001 - protein, 14 aa, Entamoeba invadens
AGDDAKDSPTQTEM

SEQ ID NO: 2838002 - protein, 7 aa, Entamoeba invadens
AGDDCPR

SEQ ID NO: 2838003 - protein, 5 aa, Entamoeba invadens
AGDDG

SEQ ID NO: 2838004 - protein, 7 aa, Entamoeba invadens
AGDDRDV

SEQ ID NO: 2838005 - protein, 7 aa, Entamoeba invadens
AGDDTSK

SEQ ID NO: 2838006 - protein, 8 aa, Entamoeba invadens
AGDEKYDS

SEQ ID NO: 2838007 - protein, 17 aa, Entamoeba invadens
AGDFDGSDASARPDEAI

SEQ ID NO: 2838008 - protein, 8 aa, Entamoeba invadens
AGDGAFYG

SEQ ID NO: 2838009 - protein, 9 aa, Entamoeba invadens
AGDGTVPLD

SEQ ID NO: 2838010 - protein, 4 aa, Entamoeba invadens
AGDI

SEQ ID NO: 2838011 - protein, 5 aa, Entamoeba invadens
AGDKY

SEQ ID NO: 2838012 - protein, 5 aa, Entamoeba invadens
AGDLT

SEQ ID NO: 2838013 - protein, 8 aa, Entamoeba invadens
AGDMSDDY

SEQ ID NO: 2838014 - protein, 8 aa, Entamoeba invadens
AGDPAAPG

SEQ ID NO: 2838015 - protein, 9 aa, Entamoeba invadens
AGDPAAPGL

SEQ ID NO: 2838016 - protein, 7 aa, Entamoeba invadens
AGDQNAD

SEQ ID NO: 2838017 - protein, 9 aa, Entamoeba invadens
AGDSESNLR

SEQ ID NO: 2838018 - protein, 8 aa, Entamoeba invadens
AGDSKGIA

SEQ ID NO: 2838019 - protein, 5 aa, Entamoeba invadens
AGDSM

SEQ ID NO: 2838020 - protein, 7 aa, Entamoeba invadens
AGDSVTP

SEQ ID NO: 2838021 - protein, 7 aa, Entamoeba invadens
AGDVKNA

SEQ ID NO: 2838022 - protein, 7 aa, Entamoeba invadens
AGEAPKL

SEQ ID NO: 2838023 - protein, 6 aa, Entamoeba invadens
AGEDPM

SEQ ID NO: 2838024 - protein, 6 aa, Entamoeba invadens
AGEDST

SEQ ID NO: 2838025 - protein, 8 aa, Entamoeba invadens
AGEEEPRS

SEQ ID NO: 2838026 - protein, 7 aa, Entamoeba invadens
AGEETNG

SEQ ID NO: 2838027 - protein, 7 aa, Entamoeba invadens
AGEFRKA

SEQ ID NO: 2838028 - protein, 5 aa, Entamoeba invadens
AGEGD

SEQ ID NO: 2838029 - protein, 6 aa, Entamoeba invadens
AGEGQT

SEQ ID NO: 2838030 - protein, 6 aa, Entamoeba invadens
AGEIEP

SEQ ID NO: 2838031 - protein, 7 aa, Entamoeba invadens
AGEKCKA

SEQ ID NO: 2838032 - protein, 8 aa, Entamoeba invadens
AGEKSQKK

SEQ ID NO: 2838033 - protein, 9 aa, Entamoeba invadens
AGEKWDPSK

SEQ ID NO: 2838034 - protein, 27 aa, Entamoeba invadens
AGEMPQQQQQLETDYQKQQYQQQQQQM

SEQ ID NO: 2838035 - protein, 8 aa, Entamoeba invadens
AGEMVPSE

SEQ ID NO: 2838036 - protein, 7 aa, Entamoeba invadens
AGENPEQ

SEQ ID NO: 2838037 - protein, 15 aa, Entamoeba invadens
AGERPAINPTQFPNG

SEQ ID NO: 2838038 - protein, 11 aa, Entamoeba invadens
AGESAGYTSVD

SEQ ID NO: 2838039 - protein, 11 aa, Entamoeba invadens
AGESDQAPDMV

SEQ ID NO: 2838040 - protein, 9 aa, Entamoeba invadens
AGESEGNLR

SEQ ID NO: 2838041 - protein, 8 aa, Entamoeba invadens
AGESQARN

SEQ ID NO: 2838042 - protein, 8 aa, Entamoeba invadens
AGESSAIR

SEQ ID NO: 2838043 - protein, 17 aa, Entamoeba invadens
AGESSDKNDISSRVPQL

SEQ ID NO: 2838044 - protein, 9 aa, Entamoeba invadens
AGESTTQKL

SEQ ID NO: 2838045 - protein, 5 aa, Entamoeba invadens
AGESY

SEQ ID NO: 2838046 - protein, 9 aa, Entamoeba invadens
AGEVKKENP

SEQ ID NO: 2838047 - protein, 6 aa, Entamoeba invadens
AGEVNK

SEQ ID NO: 2838048 - protein, 12 aa, Entamoeba invadens
AGFGGPEKTLQL

SEQ ID NO: 2838049 - protein, 11 aa, Entamoeba invadens
AGFPAKGSERQ

SEQ ID NO: 2838050 - protein, 8 aa, Entamoeba invadens
AGFSRSNP

SEQ ID NO: 2838051 - protein, 5 aa, Entamoeba invadens
AGFSV

SEQ ID NO: 2838052 - protein, 6 aa, Entamoeba invadens
AGGAAD

SEQ ID NO: 2838053 - protein, 7 aa, Entamoeba invadens
AGGAPIK

SEQ ID NO: 2838054 - protein, 5 aa, Entamoeba invadens
AGGAT

SEQ ID NO: 2838055 - protein, 13 aa, Entamoeba invadens
AGGCDGGGDGGGG

SEQ ID NO: 2838056 - protein, 6 aa, Entamoeba invadens
AGGDGC

SEQ ID NO: 2838057 - protein, 10 aa, Entamoeba invadens
AGGDNTSSYQ

SEQ ID NO: 2838058 - protein, 11 aa, Entamoeba invadens
AGGGKNPYVSN

SEQ ID NO: 2838059 - protein, 6 aa, Entamoeba invadens
AGGGSE

SEQ ID NO: 2838060 - protein, 9 aa, Entamoeba invadens
AGGIANAPL

SEQ ID NO: 2838061 - protein, 9 aa, Entamoeba invadens
AGGKDGREK

SEQ ID NO: 2838062 - protein, 9 aa, Entamoeba invadens
AGGKEITHD

SEQ ID NO: 2838063 - protein, 9 aa, Entamoeba invadens
AGGKHPKKY

SEQ ID NO: 2838064 - protein, 6 aa, Entamoeba invadens
AGGKMS

SEQ ID NO: 2838065 - protein, 4 aa, Entamoeba invadens
AGGL

SEQ ID NO: 2838066 - protein, 17 aa, Entamoeba invadens
AGGLASAAETAVARKER

SEQ ID NO: 2838067 - protein, 9 aa, Entamoeba invadens
AGGLDTKNR

SEQ ID NO: 2838068 - protein, 7 aa, Entamoeba invadens
AGGLGSP

SEQ ID NO: 2838069 - protein, 9 aa, Entamoeba invadens
AGGMADDNL

SEQ ID NO: 2838070 - protein, 6 aa, Entamoeba invadens
AGGNAQ

SEQ ID NO: 2838071 - protein, 6 aa, Entamoeba invadens
AGGNVT

SEQ ID NO: 2838072 - protein, 8 aa, Entamoeba invadens
AGGPGVIS

SEQ ID NO: 2838073 - protein, 6 aa, Entamoeba invadens
AGGPVH

SEQ ID NO: 2838074 - protein, 13 aa, Entamoeba invadens
AGGRMEQDNKYPK

SEQ ID NO: 2838075 - protein, 6 aa, Entamoeba invadens
AGGRNC

SEQ ID NO: 2838076 - protein, 10 aa, Entamoeba invadens
AGGSPNEDVY

SEQ ID NO: 2838077 - protein, 14 aa, Entamoeba invadens
AGGTIEKTPLVPNG

SEQ ID NO: 2838078 - protein, 5 aa, Entamoeba invadens
AGHER

SEQ ID NO: 2838079 - protein, 8 aa, Entamoeba invadens
AGHPNRKV

SEQ ID NO: 2838080 - protein, 5 aa, Entamoeba invadens
AGHQY

SEQ ID NO: 2838081 - protein, 8 aa, Entamoeba invadens
AGHTDNAI

SEQ ID NO: 2838082 - protein, 4 aa, Entamoeba invadens
AGIE

SEQ ID NO: 2838083 - protein, 10 aa, Entamoeba invadens
AGIKPIEPAP

SEQ ID NO: 2838084 - protein, 6 aa, Entamoeba invadens
AGIPVH

SEQ ID NO: 2838085 - protein, 6 aa, Entamoeba invadens
AGISTS

SEQ ID NO: 2838086 - protein, 7 aa, Entamoeba invadens
AGITSDT

SEQ ID NO: 2838087 - protein, 13 aa, Entamoeba invadens
AGITTSDKEMPDV

SEQ ID NO: 2838088 - protein, 7 aa, Entamoeba invadens
AGITTSL

SEQ ID NO: 2838089 - protein, 16 aa, Entamoeba invadens
AGKASEHKTEEEIDES

SEQ ID NO: 2838090 - protein, 7 aa, Entamoeba invadens
AGKDEME

SEQ ID NO: 2838091 - protein, 10 aa, Entamoeba invadens
AGKDKDDEEV

SEQ ID NO: 2838092 - protein, 7 aa, Entamoeba invadens
AGKDKKV

SEQ ID NO: 2838093 - protein, 9 aa, Entamoeba invadens
AGKDQTKYV

SEQ ID NO: 2838094 - protein, 6 aa, Entamoeba invadens
AGKDRE

SEQ ID NO: 2838095 - protein, 6 aa, Entamoeba invadens
AGKEKL

SEQ ID NO: 2838096 - protein, 7 aa, Entamoeba invadens
AGKGRTG

SEQ ID NO: 2838097 - protein, 11 aa, Entamoeba invadens
AGKKMKVKEGN

SEQ ID NO: 2838098 - protein, 9 aa, Entamoeba invadens
AGKKTTQIS

SEQ ID NO: 2838099 - protein, 22 aa, Entamoeba invadens
AGKLPDEFQKRGGAAERPVEQK

SEQ ID NO: 2838100 - protein, 8 aa, Entamoeba invadens
AGKLTGKY

SEQ ID NO: 2838101 - protein, 7 aa, Entamoeba invadens
AGKPDPY

SEQ ID NO: 2838102 - protein, 11 aa, Entamoeba invadens
AGKPEEQRKQA

SEQ ID NO: 2838103 - protein, 24 aa, Entamoeba invadens
AGKPIVENKGKPKFVKTSHKKGGK

SEQ ID NO: 2838104 - protein, 9 aa, Entamoeba invadens
AGKQDDDGI

SEQ ID NO: 2838105 - protein, 8 aa, Entamoeba invadens
AGKQKNGK

SEQ ID NO: 2838106 - protein, 6 aa, Entamoeba invadens
AGKQQN

SEQ ID NO: 2838107 - protein, 4 aa, Entamoeba invadens
AGKR

SEQ ID NO: 2838108 - protein, 6 aa, Entamoeba invadens
AGKRTD

SEQ ID NO: 2838109 - protein, 7 aa, Entamoeba invadens
AGKSEME

SEQ ID NO: 2838110 - protein, 16 aa, Entamoeba invadens
AGKSLGNQLDNKAQGM

SEQ ID NO: 2838111 - protein, 8 aa, Entamoeba invadens
AGKSQIAA

SEQ ID NO: 2838112 - protein, 9 aa, Entamoeba invadens
AGKSTTSGN

SEQ ID NO: 2838113 - protein, 8 aa, Entamoeba invadens
AGKSVEGY

SEQ ID NO: 2838114 - protein, 9 aa, Entamoeba invadens
AGKSVEGYV

SEQ ID NO: 2838115 - protein, 4 aa, Entamoeba invadens
AGKT

SEQ ID NO: 2838116 - protein, 5 aa, Entamoeba invadens
AGKTC

SEQ ID NO: 2838117 - protein, 5 aa, Entamoeba invadens
AGKTE

SEQ ID NO: 2838118 - protein, 36 aa, Entamoeba invadens
AGKTLKKQKAKEDKKEGKLTAKKEAVSEKDLLGSDS

SEQ ID NO: 2838119 - protein, 4 aa, Entamoeba invadens
AGKY

SEQ ID NO: 2838120 - protein, 5 aa, Entamoeba invadens
AGKYD

SEQ ID NO: 2838121 - protein, 16 aa, Entamoeba invadens
AGKYEEHVKNTSNTTE

SEQ ID NO: 2838122 - protein, 8 aa, Entamoeba invadens
AGKYGDEN

SEQ ID NO: 2838123 - protein, 12 aa, Entamoeba invadens
AGLDTKHGCTGK

SEQ ID NO: 2838124 - protein, 13 aa, Entamoeba invadens
AGLEKKKAELTKR

SEQ ID NO: 2838125 - protein, 15 aa, Entamoeba invadens
AGLHTTKGSAPNVGH

SEQ ID NO: 2838126 - protein, 4 aa, Entamoeba invadens
AGLM

SEQ ID NO: 2838127 - protein, 6 aa, Entamoeba invadens
AGLPIP

SEQ ID NO: 2838128 - protein, 4 aa, Entamoeba invadens
AGLQ

SEQ ID NO: 2838129 - protein, 13 aa, Entamoeba invadens
AGLRTDLDEETAK

SEQ ID NO: 2838130 - protein, 11 aa, Entamoeba invadens
AGLSEDERSVS

SEQ ID NO: 2838131 - protein, 8 aa, Entamoeba invadens
AGLSESQI

SEQ ID NO: 2838132 - protein, 9 aa, Entamoeba invadens
AGLSTDEEQ

SEQ ID NO: 2838133 - protein, 5 aa, Entamoeba invadens
AGMDG

SEQ ID NO: 2838134 - protein, 5 aa, Entamoeba invadens
AGMEY

SEQ ID NO: 2838135 - protein, 5 aa, Entamoeba invadens
AGMKR

SEQ ID NO: 2838136 - protein, 4 aa, Entamoeba invadens
AGMP

SEQ ID NO: 2838137 - protein, 4 aa, Entamoeba invadens
AGMS

SEQ ID NO: 2838138 - protein, 7 aa, Entamoeba invadens
AGNALKN

SEQ ID NO: 2838139 - protein, 8 aa, Entamoeba invadens
AGNDSNKF

SEQ ID NO: 2838140 - protein, 7 aa, Entamoeba invadens
AGNDYTK

SEQ ID NO: 2838141 - protein, 7 aa, Entamoeba invadens
AGNEENY

SEQ ID NO: 2838142 - protein, 5 aa, Entamoeba invadens
AGNER

SEQ ID NO: 2838143 - protein, 7 aa, Entamoeba invadens
AGNFDTS

SEQ ID NO: 2838144 - protein, 7 aa, Entamoeba invadens
AGNGDVT

SEQ ID NO: 2838145 - protein, 7 aa, Entamoeba invadens
AGNGTKR

SEQ ID NO: 2838146 - protein, 16 aa, Entamoeba invadens
AGNKTVDVPQKEMTNE

SEQ ID NO: 2838147 - protein, 8 aa, Entamoeba invadens
AGNKVEGK

SEQ ID NO: 2838148 - protein, 9 aa, Entamoeba invadens
AGNKVEGKF

SEQ ID NO: 2838149 - protein, 17 aa, Entamoeba invadens
AGNLPKQFTQKEKIPYG

SEQ ID NO: 2838150 - protein, 8 aa, Entamoeba invadens
AGNPHGIS

SEQ ID NO: 2838151 - protein, 13 aa, Entamoeba invadens
AGNPKENPTLPAK

SEQ ID NO: 2838152 - protein, 6 aa, Entamoeba invadens
AGNPVV

SEQ ID NO: 2838153 - protein, 7 aa, Entamoeba invadens
AGNPYLS

SEQ ID NO: 2838154 - protein, 4 aa, Entamoeba invadens
AGNS

SEQ ID NO: 2838155 - protein, 8 aa, Entamoeba invadens
AGNSETSN

SEQ ID NO: 2838156 - protein, 10 aa, Entamoeba invadens
AGNTDNVSTR

SEQ ID NO: 2838157 - protein, 6 aa, Entamoeba invadens
AGNTEA

SEQ ID NO: 2838158 - protein, 20 aa, Entamoeba invadens
AGNTQVGEVTANLSKNTALD

SEQ ID NO: 2838159 - protein, 23 aa, Entamoeba invadens
AGPAKQPKGYPSGSFGPTTSARM

SEQ ID NO: 2838160 - protein, 9 aa, Entamoeba invadens
AGPATSGAV

SEQ ID NO: 2838161 - protein, 10 aa, Entamoeba invadens
AGPDNSPWEG

SEQ ID NO: 2838162 - protein, 8 aa, Entamoeba invadens
AGPDRNTL

SEQ ID NO: 2838163 - protein, 12 aa, Entamoeba invadens
AGPEDGNPPTLH

SEQ ID NO: 2838164 - protein, 10 aa, Entamoeba invadens
AGPEKEEEVK

SEQ ID NO: 2838165 - protein, 6 aa, Entamoeba invadens
AGPELE

SEQ ID NO: 2838166 - protein, 8 aa, Entamoeba invadens
AGPHPSSE

SEQ ID NO: 2838167 - protein, 8 aa, Entamoeba invadens
AGPNHSST

SEQ ID NO: 2838168 - protein, 8 aa, Entamoeba invadens
AGPRPTFG

SEQ ID NO: 2838169 - protein, 13 aa, Entamoeba invadens
AGPSASGKTTFSK

SEQ ID NO: 2838170 - protein, 9 aa, Entamoeba invadens
AGPTSSGAV

SEQ ID NO: 2838171 - protein, 7 aa, Entamoeba invadens
AGPTVEK

SEQ ID NO: 2838172 - protein, 12 aa, Entamoeba invadens
AGQAGTPKTITG

SEQ ID NO: 2838173 - protein, 6 aa, Entamoeba invadens
AGQDNE

SEQ ID NO: 2838174 - protein, 6 aa, Entamoeba invadens
AGQDRF

SEQ ID NO: 2838175 - protein, 7 aa, Entamoeba invadens
AGQDTAS

SEQ ID NO: 2838176 - protein, 9 aa, Entamoeba invadens
AGQDVNDSL

SEQ ID NO: 2838177 - protein, 7 aa, Entamoeba invadens
AGQEDFD

SEQ ID NO: 2838178 - protein, 6 aa, Entamoeba invadens
AGQEEF

SEQ ID NO: 2838179 - protein, 8 aa, Entamoeba invadens
AGQEEYDK

SEQ ID NO: 2838180 - protein, 8 aa, Entamoeba invadens
AGQEEYDR

SEQ ID NO: 2838181 - protein, 5 aa, Entamoeba invadens
AGQEK

SEQ ID NO: 2838182 - protein, 9 aa, Entamoeba invadens
AGQEKFGGL

SEQ ID NO: 2838183 - protein, 9 aa, Entamoeba invadens
AGQEKFRSV

SEQ ID NO: 2838184 - protein, 6 aa, Entamoeba invadens
AGQEKY

SEQ ID NO: 2838185 - protein, 5 aa, Entamoeba invadens
AGQER

SEQ ID NO: 2838186 - protein, 7 aa, Entamoeba invadens
AGQERFA

SEQ ID NO: 2838187 - protein, 7 aa, Entamoeba invadens
AGQERFK

SEQ ID NO: 2838188 - protein, 8 aa, Entamoeba invadens
AGQERYNS

SEQ ID NO: 2838189 - protein, 9 aa, Entamoeba invadens
AGQESFRSQ

SEQ ID NO: 2838190 - protein, 4 aa, Entamoeba invadens
AGQF

SEQ ID NO: 2838191 - protein, 7 aa, Entamoeba invadens
AGQHEYD

SEQ ID NO: 2838192 - protein, 4 aa, Entamoeba invadens
AGQN

SEQ ID NO: 2838193 - protein, 8 aa, Entamoeba invadens
AGQNTTRR

SEQ ID NO: 2838194 - protein, 11 aa, Entamoeba invadens
AGQSMGEPSTQ

SEQ ID NO: 2838195 - protein, 12 aa, Entamoeba invadens
AGQSPVPSTQSW

SEQ ID NO: 2838196 - protein, 7 aa, Entamoeba invadens
AGQTTED

SEQ ID NO: 2838197 - protein, 12 aa, Entamoeba invadens
AGRAGRDGKPAE

SEQ ID NO: 2838198 - protein, 5 aa, Entamoeba invadens
AGRCT

SEQ ID NO: 2838199 - protein, 8 aa, Entamoeba invadens
AGRDDRIE

SEQ ID NO: 2838200 - protein, 5 aa, Entamoeba invadens
AGREG

SEQ ID NO: 2838201 - protein, 15 aa, Entamoeba invadens
AGRENSVASTKSFSS

SEQ ID NO: 2838202 - protein, 7 aa, Entamoeba invadens
AGRFGTK

SEQ ID NO: 2838203 - protein, 9 aa, Entamoeba invadens
AGRGNESIE

SEQ ID NO: 2838204 - protein, 5 aa, Entamoeba invadens
AGRGP

SEQ ID NO: 2838205 - protein, 8 aa, Entamoeba invadens
AGRKEASY

SEQ ID NO: 2838206 - protein, 7 aa, Entamoeba invadens
AGRLSEL

SEQ ID NO: 2838207 - protein, 25 aa, Entamoeba invadens
AGRMERKVKGKKVKKDFSCSDRNFA

SEQ ID NO: 2838208 - protein, 8 aa, Entamoeba invadens
AGRMQGND

SEQ ID NO: 2838209 - protein, 7 aa, Entamoeba invadens
AGRNDIA

SEQ ID NO: 2838210 - protein, 13 aa, Entamoeba invadens
AGRPQFDKEGSGY

SEQ ID NO: 2838211 - protein, 9 aa, Entamoeba invadens
AGRPQFDNE

SEQ ID NO: 2838212 - protein, 10 aa, Entamoeba invadens
AGRPQFDTEG

SEQ ID NO: 2838213 - protein, 9 aa, Entamoeba invadens
AGRPTPAHL

SEQ ID NO: 2838214 - protein, 10 aa, Entamoeba invadens
AGRQATKNEE

SEQ ID NO: 2838215 - protein, 6 aa, Entamoeba invadens
AGRQDV

SEQ ID NO: 2838216 - protein, 13 aa, Entamoeba invadens
AGRREAIKQKRKD

SEQ ID NO: 2838217 - protein, 7 aa, Entamoeba invadens
AGRSDGW

SEQ ID NO: 2838218 - protein, 6 aa, Entamoeba invadens
AGRSFN

SEQ ID NO: 2838219 - protein, 10 aa, Entamoeba invadens
AGRSNAAMGD

SEQ ID NO: 2838220 - protein, 10 aa, Entamoeba invadens
AGRSSATMGD

SEQ ID NO: 2838221 - protein, 12 aa, Entamoeba invadens
AGRTEVSPNTKT

SEQ ID NO: 2838222 - protein, 5 aa, Entamoeba invadens
AGRTN

SEQ ID NO: 2838223 - protein, 7 aa, Entamoeba invadens
AGRTTGT

SEQ ID NO: 2838224 - protein, 10 aa, Entamoeba invadens
AGRVNGRVGS

SEQ ID NO: 2838225 - protein, 9 aa, Entamoeba invadens
AGSADESFR

SEQ ID NO: 2838226 - protein, 10 aa, Entamoeba invadens
AGSASAPNDY

SEQ ID NO: 2838227 - protein, 4 aa, Entamoeba invadens
AGSD

SEQ ID NO: 2838228 - protein, 7 aa, Entamoeba invadens
AGSDGTI

SEQ ID NO: 2838229 - protein, 5 aa, Entamoeba invadens
AGSDI

SEQ ID NO: 2838230 - protein, 7 aa, Entamoeba invadens
AGSDIGN

SEQ ID NO: 2838231 - protein, 4 aa, Entamoeba invadens
AGSE

SEQ ID NO: 2838232 - protein, 5 aa, Entamoeba invadens
AGSEK

SEQ ID NO: 2838233 - protein, 8 aa, Entamoeba invadens
AGSEKGSY

SEQ ID NO: 2838234 - protein, 5 aa, Entamoeba invadens
AGSER

SEQ ID NO: 2838235 - protein, 7 aa, Entamoeba invadens
AGSESKR

SEQ ID NO: 2838236 - protein, 7 aa, Entamoeba invadens
AGSFEGM

SEQ ID NO: 2838237 - protein, 17 aa, Entamoeba invadens
AGSGCKAALDCEKWLQT

SEQ ID NO: 2838238 - protein, 10 aa, Entamoeba invadens
AGSGDKGVDE

SEQ ID NO: 2838239 - protein, 5 aa, Entamoeba invadens
AGSGI

SEQ ID NO: 2838240 - protein, 8 aa, Entamoeba invadens
AGSGKSTY

SEQ ID NO: 2838241 - protein, 7 aa, Entamoeba invadens
AGSGLSQ

SEQ ID NO: 2838242 - protein, 6 aa, Entamoeba invadens
AGSLTN

SEQ ID NO: 2838243 - protein, 24 aa, Entamoeba invadens
AGSMPSMGSEPETPQQNTTESSGI

SEQ ID NO: 2838244 - protein, 9 aa, Entamoeba invadens
AGSNRKSSL

SEQ ID NO: 2838245 - protein, 24 aa, Entamoeba invadens
AGSPGEDIYSRAGPSGSGAEGEDI

SEQ ID NO: 2838246 - protein, 7 aa, Entamoeba invadens
AGSPLKS

SEQ ID NO: 2838247 - protein, 9 aa, Entamoeba invadens
AGSQDESLV

SEQ ID NO: 2838248 - protein, 8 aa, Entamoeba invadens
AGSQLDKL

SEQ ID NO: 2838249 - protein, 9 aa, Entamoeba invadens
AGSRKRKEL

SEQ ID NO: 2838250 - protein, 10 aa, Entamoeba invadens
AGSRLTGAGF

SEQ ID NO: 2838251 - protein, 5 aa, Entamoeba invadens
AGSRQ

SEQ ID NO: 2838252 - protein, 10 aa, Entamoeba invadens
AGSSGPQRTE

SEQ ID NO: 2838253 - protein, 6 aa, Entamoeba invadens
AGSSTC

SEQ ID NO: 2838254 - protein, 4 aa, Entamoeba invadens
AGST

SEQ ID NO: 2838255 - protein, 6 aa, Entamoeba invadens
AGSTEF

SEQ ID NO: 2838256 - protein, 9 aa, Entamoeba invadens
AGSTGYSRS

SEQ ID NO: 2838257 - protein, 4 aa, Entamoeba invadens
AGSV

SEQ ID NO: 2838258 - protein, 7 aa, Entamoeba invadens
AGTAEPH

SEQ ID NO: 2838259 - protein, 9 aa, Entamoeba invadens
AGTAEPHTI

SEQ ID NO: 2838260 - protein, 6 aa, Entamoeba invadens
AGTEVS

SEQ ID NO: 2838261 - protein, 7 aa, Entamoeba invadens
AGTGQTA

SEQ ID NO: 2838262 - protein, 7 aa, Entamoeba invadens
AGTGSTL

SEQ ID NO: 2838263 - protein, 15 aa, Entamoeba invadens
AGTKMDKRGVCVAPG

SEQ ID NO: 2838264 - protein, 15 aa, Entamoeba invadens
AGTLPKQYTEKPKFQ

SEQ ID NO: 2838265 - protein, 8 aa, Entamoeba invadens
AGTPDPID

SEQ ID NO: 2838266 - protein, 7 aa, Entamoeba invadens
AGTPLAN

SEQ ID NO: 2838267 - protein, 7 aa, Entamoeba invadens
AGTPPET

SEQ ID NO: 2838268 - protein, 8 aa, Entamoeba invadens
AGTQATRA

SEQ ID NO: 2838269 - protein, 5 aa, Entamoeba invadens
AGTQT

SEQ ID NO: 2838270 - protein, 13 aa, Entamoeba invadens
AGTSEATVTEGVP

SEQ ID NO: 2838271 - protein, 25 aa, Entamoeba invadens
AGTSENDPQQAVETQDEKKTKIGVR

SEQ ID NO: 2838272 - protein, 8 aa, Entamoeba invadens
AGTSEPHT

SEQ ID NO: 2838273 - protein, 5 aa, Entamoeba invadens
AGTSR

SEQ ID NO: 2838274 - protein, 6 aa, Entamoeba invadens
AGTTTG

SEQ ID NO: 2838275 - protein, 4 aa, Entamoeba invadens
AGTY

SEQ ID NO: 2838276 - protein, 11 aa, Entamoeba invadens
AGTYSKNQSRT

SEQ ID NO: 2838277 - protein, 5 aa, Entamoeba invadens
AGVAE

SEQ ID NO: 2838278 - protein, 5 aa, Entamoeba invadens
AGVDS

SEQ ID NO: 2838279 - protein, 4 aa, Entamoeba invadens
AGVG

SEQ ID NO: 2838280 - protein, 13 aa, Entamoeba invadens
AGVKRKDLADPDT

SEQ ID NO: 2838281 - protein, 7 aa, Entamoeba invadens
AGVNPSV

SEQ ID NO: 2838282 - protein, 6 aa, Entamoeba invadens
AGVNSD

SEQ ID NO: 2838283 - protein, 8 aa, Entamoeba invadens
AGVPEKVE

SEQ ID NO: 2838284 - protein, 23 aa, Entamoeba invadens
AGVPSIKGGEYTAPSLARRTTQM

SEQ ID NO: 2838285 - protein, 21 aa, Entamoeba invadens
AGVPTSHSAAVPADLSKAKIT

SEQ ID NO: 2838286 - protein, 6 aa, Entamoeba invadens
AGVSAV

SEQ ID NO: 2838287 - protein, 8 aa, Entamoeba invadens
AGVSDAKS

SEQ ID NO: 2838288 - protein, 17 aa, Entamoeba invadens
AGVSEKAKQVVKDNGYE

SEQ ID NO: 2838289 - protein, 10 aa, Entamoeba invadens
AGVSEKGQYQ

SEQ ID NO: 2838290 - protein, 14 aa, Entamoeba invadens
AGVSLKPKTPVSSV

SEQ ID NO: 2838291 - protein, 12 aa, Entamoeba invadens
AGVTITSDGNSV

SEQ ID NO: 2838292 - protein, 4 aa, Entamoeba invadens
AGWG

SEQ ID NO: 2838293 - protein, 6 aa, Entamoeba invadens
AGWVGT

SEQ ID NO: 2838294 - protein, 10 aa, Entamoeba invadens
AGYDNKERDL

SEQ ID NO: 2838295 - protein, 14 aa, Entamoeba invadens
AGYETDSGDDDQVQ

SEQ ID NO: 2838296 - protein, 11 aa, Entamoeba invadens
AGYNGTNRGGS

SEQ ID NO: 2838297 - protein, 29 aa, Entamoeba invadens
AGYNPNDKFGIEGNAKFGKENGKKINSYG

SEQ ID NO: 2838298 - protein, 28 aa, Entamoeba invadens
AGYNPNDKFGIEGNAKFGKENRKKINSY

SEQ ID NO: 2838299 - protein, 7 aa, Entamoeba invadens
AGYPAAP

SEQ ID NO: 2838300 - protein, 6 aa, Entamoeba invadens
AGYVTG

SEQ ID NO: 2838301 - protein, 7 aa, Entamoeba invadens
AHATGKV

SEQ ID NO: 2838302 - protein, 6 aa, Entamoeba invadens
AHDNRE

SEQ ID NO: 2838303 - protein, 13 aa, Entamoeba invadens
AHDQAKQIQGERK

SEQ ID NO: 2838304 - protein, 11 aa, Entamoeba invadens
AHDTAKASQRQ

SEQ ID NO: 2838305 - protein, 7 aa, Entamoeba invadens
AHEAQKK

SEQ ID NO: 2838306 - protein, 72 aa, Entamoeba invadens
AHEDAKNGEIREDHSDEDIIGNNGEENVEIEEEKEAKSEEEIDEEDEDEFEEGSEEKKEQSNEQEGSDEEDD

SEQ ID NO: 2838307 - protein, 12 aa, Entamoeba invadens
AHEDETNSLNGT

SEQ ID NO: 2838308 - protein, 7 aa, Entamoeba invadens
AHEDPEF

SEQ ID NO: 2838309 - protein, 30 aa, Entamoeba invadens
AHEEDKDESQKESQKVQQVKADEQDDELNE

SEQ ID NO: 2838310 - protein, 13 aa, Entamoeba invadens
AHEEETNNLNGSI

SEQ ID NO: 2838311 - protein, 29 aa, Entamoeba invadens
AHEKSLKDETEKARQQRLDREKAEEDARL

SEQ ID NO: 2838312 - protein, 36 aa, Entamoeba invadens
AHEQNAQVPLQNTYQTDFSKPQNTPFTQTRVPPPVP

SEQ ID NO: 2838313 - protein, 10 aa, Entamoeba invadens
AHETQSEQDV

SEQ ID NO: 2838314 - protein, 4 aa, Entamoeba invadens
AHEV

SEQ ID NO: 2838315 - protein, 11 aa, Entamoeba invadens
AHEVDQNEQKE

SEQ ID NO: 2838316 - protein, 4 aa, Entamoeba invadens
AHEY

SEQ ID NO: 2838317 - protein, 13 aa, Entamoeba invadens
AHFTTSRPSQSVD

SEQ ID NO: 2838318 - protein, 4 aa, Entamoeba invadens
AHGE

SEQ ID NO: 2838319 - protein, 8 aa, Entamoeba invadens
AHGGRRHN

SEQ ID NO: 2838320 - protein, 4 aa, Entamoeba invadens
AHGR

SEQ ID NO: 2838321 - protein, 24 aa, Entamoeba invadens
AHGSDSSQRLNEELQTEKETNRRL

SEQ ID NO: 2838322 - protein, 9 aa, Entamoeba invadens
AHHDKNGKL

SEQ ID NO: 2838323 - protein, 17 aa, Entamoeba invadens
AHHSNKAKAKQKGGKHQ

SEQ ID NO: 2838324 - protein, 27 aa, Entamoeba invadens
AHIKKTPTLKKVKKDGKAKENKMDTTT

SEQ ID NO: 2838325 - protein, 16 aa, Entamoeba invadens
AHKKSKEYEYLPSPPM

SEQ ID NO: 2838326 - protein, 10 aa, Entamoeba invadens
AHKNSGDDVV

SEQ ID NO: 2838327 - protein, 21 aa, Entamoeba invadens
AHKRGLNPIHPSERGTSQGPD

SEQ ID NO: 2838328 - protein, 21 aa, Entamoeba invadens
AHKRGLNPIHPTQRGTSQGPD

SEQ ID NO: 2838329 - protein, 5 aa, Entamoeba invadens
AHKSG

SEQ ID NO: 2838330 - protein, 5 aa, Entamoeba invadens
AHLGQ

SEQ ID NO: 2838331 - protein, 7 aa, Entamoeba invadens
AHNAEDS

SEQ ID NO: 2838332 - protein, 6 aa, Entamoeba invadens
AHNGTV

SEQ ID NO: 2838333 - protein, 14 aa, Entamoeba invadens
AHNPSTSLVNQHGQ

SEQ ID NO: 2838334 - protein, 4 aa, Entamoeba invadens
AHNT

SEQ ID NO: 2838335 - protein, 12 aa, Entamoeba invadens
AHNTTPIDWKIT

SEQ ID NO: 2838336 - protein, 4 aa, Entamoeba invadens
AHPE

SEQ ID NO: 2838337 - protein, 7 aa, Entamoeba invadens
AHPEKKR

SEQ ID NO: 2838338 - protein, 12 aa, Entamoeba invadens
AHPEMDFSNAKI

SEQ ID NO: 2838339 - protein, 5 aa, Entamoeba invadens
AHPGA

SEQ ID NO: 2838340 - protein, 12 aa, Entamoeba invadens
AHPKRDVKHTQF

SEQ ID NO: 2838341 - protein, 6 aa, Entamoeba invadens
AHPNEF

SEQ ID NO: 2838342 - protein, 7 aa, Entamoeba invadens
AHPNGAV

SEQ ID NO: 2838343 - protein, 6 aa, Entamoeba invadens
AHPPIS

SEQ ID NO: 2838344 - protein, 10 aa, Entamoeba invadens
AHPPTDGIYT

SEQ ID NO: 2838345 - protein, 5 aa, Entamoeba invadens
AHPYS

SEQ ID NO: 2838346 - protein, 27 aa, Entamoeba invadens
AHQKSEKKAEEKAKKEKNDKKKKGYKG

SEQ ID NO: 2838347 - protein, 38 aa, Entamoeba invadens
AHQPNGDNKTVTETDVKNVAKAESNSTQPTVPQQPVET

SEQ ID NO: 2838348 - protein, 6 aa, Entamoeba invadens
AHRDLK

SEQ ID NO: 2838349 - protein, 4 aa, Entamoeba invadens
AHSE

SEQ ID NO: 2838350 - protein, 13 aa, Entamoeba invadens
AHSENPKDQTAKA

SEQ ID NO: 2838351 - protein, 8 aa, Entamoeba invadens
AHSGAGKT

SEQ ID NO: 2838352 - protein, 29 aa, Entamoeba invadens
AHSSEDDENENEDDEEDDEDEENSEEETN

SEQ ID NO: 2838353 - protein, 8 aa, Entamoeba invadens
AHSSGCNA

SEQ ID NO: 2838354 - protein, 12 aa, Entamoeba invadens
AHTDEEDKTKIR

SEQ ID NO: 2838355 - protein, 10 aa, Entamoeba invadens
AHTKPGDSYQ

SEQ ID NO: 2838356 - protein, 7 aa, Entamoeba invadens
AHTQDTL

SEQ ID NO: 2838357 - protein, 11 aa, Entamoeba invadens
AHTQSGGERSV

SEQ ID NO: 2838358 - protein, 6 aa, Entamoeba invadens
AHTTLP

SEQ ID NO: 2838359 - protein, 16 aa, Entamoeba invadens
AHYAPDDDKIVPEIKT

SEQ ID NO: 2838360 - protein, 5 aa, Entamoeba invadens
AIADG

SEQ ID NO: 2838361 - protein, 11 aa, Entamoeba invadens
AIADSNTSNIN

SEQ ID NO: 2838362 - protein, 10 aa, Entamoeba invadens
AIAPSDDDKY

SEQ ID NO: 2838363 - protein, 6 aa, Entamoeba invadens
AIASEN

SEQ ID NO: 2838364 - protein, 10 aa, Entamoeba invadens
AIDAAKSEEL

SEQ ID NO: 2838365 - protein, 5 aa, Entamoeba invadens
AIDGT

SEQ ID NO: 2838366 - protein, 8 aa, Entamoeba invadens
AIDKKTKN

SEQ ID NO: 2838367 - protein, 7 aa, Entamoeba invadens
AIDKTGT

SEQ ID NO: 2838368 - protein, 4 aa, Entamoeba invadens
AIDQ

SEQ ID NO: 2838369 - protein, 7 aa, Entamoeba invadens
AIDQKGC

SEQ ID NO: 2838370 - protein, 8 aa, Entamoeba invadens
AIDRNVEK

SEQ ID NO: 2838371 - protein, 15 aa, Entamoeba invadens
AIDTDYQTLTPKPFP

SEQ ID NO: 2838372 - protein, 6 aa, Entamoeba invadens
AIDTGK

SEQ ID NO: 2838373 - protein, 35 aa, Entamoeba invadens
AIEDDEDESEEMQMTEQQRKAEEEARQRYNQPNRA

SEQ ID NO: 2838374 - protein, 20 aa, Entamoeba invadens
AIEERRKKREEERKARLASA

SEQ ID NO: 2838375 - protein, 14 aa, Entamoeba invadens
AIEGMDKSEYEEIS

SEQ ID NO: 2838376 - protein, 18 aa, Entamoeba invadens
AIEKQTTTLSARTNKSTI

SEQ ID NO: 2838377 - protein, 7 aa, Entamoeba invadens
AIEKTGF

SEQ ID NO: 2838378 - protein, 4 aa, Entamoeba invadens
AIEN

SEQ ID NO: 2838379 - protein, 32 aa, Entamoeba invadens
AIEPQDEGAVGGYDSDRRSYSVPKSPSLSEDY

SEQ ID NO: 2838380 - protein, 60 aa, Entamoeba invadens
AIEQKEQEEKKVKEERERQQAEKVQQQAAEKENSTKRGGYKPFNKPINNIKKKGKRGGYY

SEQ ID NO: 2838381 - protein, 8 aa, Entamoeba invadens
AIEQNEVA

SEQ ID NO: 2838382 - protein, 8 aa, Entamoeba invadens
AIESEKQK

SEQ ID NO: 2838383 - protein, 8 aa, Entamoeba invadens
AIETPSNI

SEQ ID NO: 2838384 - protein, 19 aa, Entamoeba invadens
AIETQKDIKRKRDTAESEC

SEQ ID NO: 2838385 - protein, 5 aa, Entamoeba invadens
AIGGE

SEQ ID NO: 2838386 - protein, 6 aa, Entamoeba invadens
AIGGED

SEQ ID NO: 2838387 - protein, 9 aa, Entamoeba invadens
AIGKGKNKI

SEQ ID NO: 2838388 - protein, 10 aa, Entamoeba invadens
AIGKGSKAFN

SEQ ID NO: 2838389 - protein, 5 aa, Entamoeba invadens
AIGKR

SEQ ID NO: 2838390 - protein, 11 aa, Entamoeba invadens
AIGNEKGAENI

SEQ ID NO: 2838391 - protein, 15 aa, Entamoeba invadens
AIGNTSQLAEKTAKA

SEQ ID NO: 2838392 - protein, 7 aa, Entamoeba invadens
AIGQNSK

SEQ ID NO: 2838393 - protein, 13 aa, Entamoeba invadens
AIGSAKSSIAPSI

SEQ ID NO: 2838394 - protein, 6 aa, Entamoeba invadens
AIGSDG

SEQ ID NO: 2838395 - protein, 12 aa, Entamoeba invadens
AIGTKRNNVEHL

SEQ ID NO: 2838396 - protein, 9 aa, Entamoeba invadens
AIKAKGTKV

SEQ ID NO: 2838397 - protein, 22 aa, Entamoeba invadens
AIKEKDLKTVEEITKETNAGSF

SEQ ID NO: 2838398 - protein, 11 aa, Entamoeba invadens
AIKNDDDSIEN

SEQ ID NO: 2838399 - protein, 8 aa, Entamoeba invadens
AIKRSASS

SEQ ID NO: 2838400 - protein, 9 aa, Entamoeba invadens
AIKSDTGDI

SEQ ID NO: 2838401 - protein, 6 aa, Entamoeba invadens
AIKSGK

SEQ ID NO: 2838402 - protein, 8 aa, Entamoeba invadens
AIKSPQRN

SEQ ID NO: 2838403 - protein, 8 aa, Entamoeba invadens
AIKTKQTP

SEQ ID NO: 2838404 - protein, 14 aa, Entamoeba invadens
AILGTSEEITPTLK

SEQ ID NO: 2838405 - protein, 4 aa, Entamoeba invadens
AIMS

SEQ ID NO: 2838406 - protein, 10 aa, Entamoeba invadens
AINEKQQRTI

SEQ ID NO: 2838407 - protein, 16 aa, Entamoeba invadens
AINGNTDNYHKADAKT

SEQ ID NO: 2838408 - protein, 7 aa, Entamoeba invadens
AINKENG

SEQ ID NO: 2838409 - protein, 6 aa, Entamoeba invadens
AINNEN

SEQ ID NO: 2838410 - protein, 10 aa, Entamoeba invadens
AINPKEQNFA

SEQ ID NO: 2838411 - protein, 6 aa, Entamoeba invadens
AINPNT

SEQ ID NO: 2838412 - protein, 21 aa, Entamoeba invadens
AINQEKSKTGTLKRQKVEGDD

SEQ ID NO: 2838413 - protein, 5 aa, Entamoeba invadens
AINRA

SEQ ID NO: 2838414 - protein, 18 aa, Entamoeba invadens
AINSTVENLKSENDKMKE

SEQ ID NO: 2838415 - protein, 4 aa, Entamoeba invadens
AINT

SEQ ID NO: 2838416 - protein, 15 aa, Entamoeba invadens
AINTNIDKEPGKELD

SEQ ID NO: 2838417 - protein, 8 aa, Entamoeba invadens
AINTQNID

SEQ ID NO: 2838418 - protein, 7 aa, Entamoeba invadens
AINTQNV

SEQ ID NO: 2838419 - protein, 8 aa, Entamoeba invadens
AIPDQNKD

SEQ ID NO: 2838420 - protein, 13 aa, Entamoeba invadens
AIPEGTSQKDVDE

SEQ ID NO: 2838421 - protein, 6 aa, Entamoeba invadens
AIPERL

SEQ ID NO: 2838422 - protein, 34 aa, Entamoeba invadens
AIPGEEKLGPKAAAFSSGLAKKSTKKKVVKKTMD

SEQ ID NO: 2838423 - protein, 8 aa, Entamoeba invadens
AIPIEKES

SEQ ID NO: 2838424 - protein, 13 aa, Entamoeba invadens
AIPIKERRRRSSE

SEQ ID NO: 2838425 - protein, 9 aa, Entamoeba invadens
AIPNPTQQF

SEQ ID NO: 2838426 - protein, 25 aa, Entamoeba invadens
AIPNRSSGYDALSEEEKEVSDKKRL

SEQ ID NO: 2838427 - protein, 23 aa, Entamoeba invadens
AIPPSSQIPEKPDEHKENPPLSD

SEQ ID NO: 2838428 - protein, 16 aa, Entamoeba invadens
AIPPSTPTPLPDTITN

SEQ ID NO: 2838429 - protein, 7 aa, Entamoeba invadens
AIPPTKR

SEQ ID NO: 2838430 - protein, 7 aa, Entamoeba invadens
AIPQNEK

SEQ ID NO: 2838431 - protein, 6 aa, Entamoeba invadens
AIPSDT

SEQ ID NO: 2838432 - protein, 8 aa, Entamoeba invadens
AIPSSVTS

SEQ ID NO: 2838433 - protein, 10 aa, Entamoeba invadens
AIQAENDDLA

SEQ ID NO: 2838434 - protein, 33 aa, Entamoeba invadens
AIQDEDNLTAKLQEEIGKLENESSNTTSPRSPL

SEQ ID NO: 2838435 - protein, 12 aa, Entamoeba invadens
AIQKKTKELVTE

SEQ ID NO: 2838436 - protein, 6 aa, Entamoeba invadens
AIQPNV

SEQ ID NO: 2838437 - protein, 15 aa, Entamoeba invadens
AIQRAETNKVRSQCQ

SEQ ID NO: 2838438 - protein, 23 aa, Entamoeba invadens
AIQSDFGSSNTDDNSSRTWTEKA

SEQ ID NO: 2838439 - protein, 11 aa, Entamoeba invadens
AIQSGIGDGAV

SEQ ID NO: 2838440 - protein, 44 aa, Entamoeba invadens
AIRSTSKIDSKKRTKFEELKKKEEKKPRSMSKNRSSEEKMEQRS

SEQ ID NO: 2838441 - protein, 7 aa, Entamoeba invadens
AISEEAE

SEQ ID NO: 2838442 - protein, 61 aa, Entamoeba invadens
AISGTTDDDYEKSAPKKRKALNAKKPKSKNAKKKMRSTKIDESDSLTTSTEMSDTANTNDE

SEQ ID NO: 2838443 - protein, 10 aa, Entamoeba invadens
AISNESQSTF

SEQ ID NO: 2838444 - protein, 6 aa, Entamoeba invadens
AISNEV

SEQ ID NO: 2838445 - protein, 8 aa, Entamoeba invadens
AISNPKSI

SEQ ID NO: 2838446 - protein, 7 aa, Entamoeba invadens
AISPKEE

SEQ ID NO: 2838447 - protein, 15 aa, Entamoeba invadens
AISPSTSQPKKSSSQ

SEQ ID NO: 2838448 - protein, 17 aa, Entamoeba invadens
AISQEEQPTTVNGDTSI

SEQ ID NO: 2838449 - protein, 20 aa, Entamoeba invadens
AISQRDESAKFNPKLPQKMN

SEQ ID NO: 2838450 - protein, 15 aa, Entamoeba invadens
AISQRTSVNQIKETN

SEQ ID NO: 2838451 - protein, 15 aa, Entamoeba invadens
AISQRTSVNQIKKTN

SEQ ID NO: 2838452 - protein, 6 aa, Entamoeba invadens
AISRAS

SEQ ID NO: 2838453 - protein, 8 aa, Entamoeba invadens
AISRKSEG

SEQ ID NO: 2838454 - protein, 7 aa, Entamoeba invadens
AISSNEK

SEQ ID NO: 2838455 - protein, 7 aa, Entamoeba invadens
AISSQSG

SEQ ID NO: 2838456 - protein, 6 aa, Entamoeba invadens
AISTAR

SEQ ID NO: 2838457 - protein, 7 aa, Entamoeba invadens
AISTGTM

SEQ ID NO: 2838458 - protein, 15 aa, Entamoeba invadens
AISTKEDQKAHLKSS

SEQ ID NO: 2838459 - protein, 10 aa, Entamoeba invadens
AITASGNENF

SEQ ID NO: 2838460 - protein, 9 aa, Entamoeba invadens
AITDKSIQE

SEQ ID NO: 2838461 - protein, 10 aa, Entamoeba invadens
AITGAGLEPG

SEQ ID NO: 2838462 - protein, 11 aa, Entamoeba invadens
AITKEKDESQV

SEQ ID NO: 2838463 - protein, 6 aa, Entamoeba invadens
AITNTN

SEQ ID NO: 2838464 - protein, 4 aa, Entamoeba invadens
AITP

SEQ ID NO: 2838465 - protein, 6 aa, Entamoeba invadens
AITPRE

SEQ ID NO: 2838466 - protein, 7 aa, Entamoeba invadens
AITQPTH

SEQ ID NO: 2838467 - protein, 7 aa, Entamoeba invadens
AITRNDV

SEQ ID NO: 2838468 - protein, 10 aa, Entamoeba invadens
AITSKEKALS

SEQ ID NO: 2838469 - protein, 23 aa, Entamoeba invadens
AITSSSGLSEALPGSDSLRNSIQ

SEQ ID NO: 2838470 - protein, 6 aa, Entamoeba invadens
AITSSW

SEQ ID NO: 2838471 - protein, 5 aa, Entamoeba invadens
AITTN

SEQ ID NO: 2838472 - protein, 6 aa, Entamoeba invadens
AITTNS

SEQ ID NO: 2838473 - protein, 7 aa, Entamoeba invadens
AITYPSA

SEQ ID NO: 2838474 - protein, 8 aa, Entamoeba invadens
AIVETQRK

SEQ ID NO: 2838475 - protein, 7 aa, Entamoeba invadens
AIVSEDS

SEQ ID NO: 2838476 - protein, 6 aa, Entamoeba invadens
AIVSND

SEQ ID NO: 2838477 - protein, 7 aa, Entamoeba invadens
AIYEDGE

SEQ ID NO: 2838478 - protein, 4 aa, Entamoeba invadens
AIYS

SEQ ID NO: 2838479 - protein, 19 aa, Entamoeba invadens
AKAAVTGKTLDDRKGDNFN

SEQ ID NO: 2838480 - protein, 4 aa, Entamoeba invadens
AKAD

SEQ ID NO: 2838481 - protein, 6 aa, Entamoeba invadens
AKAEDV

SEQ ID NO: 2838482 - protein, 8 aa, Entamoeba invadens
AKAGEDEL

SEQ ID NO: 2838483 - protein, 9 aa, Entamoeba invadens
AKAGKRANL

SEQ ID NO: 2838484 - protein, 18 aa, Entamoeba invadens
AKAIAKTKEEKAPELTTS

SEQ ID NO: 2838485 - protein, 9 aa, Entamoeba invadens
AKAKTGEEG

SEQ ID NO: 2838486 - protein, 9 aa, Entamoeba invadens
AKALADKNE

SEQ ID NO: 2838487 - protein, 12 aa, Entamoeba invadens
AKAPSGTNESYA

SEQ ID NO: 2838488 - protein, 6 aa, Entamoeba invadens
AKAQKE

SEQ ID NO: 2838489 - protein, 19 aa, Entamoeba invadens
AKAQKKVAKKDKKVATEPI

SEQ ID NO: 2838490 - protein, 18 aa, Entamoeba invadens
AKAQTAKTKEGKTISPVE

SEQ ID NO: 2838491 - protein, 8 aa, Entamoeba invadens
AKARGTQF

SEQ ID NO: 2838492 - protein, 13 aa, Entamoeba invadens
AKASDKKKVLNNQ

SEQ ID NO: 2838493 - protein, 47 aa, Entamoeba invadens
AKATEASTAAADKKGAKGKVAAKKDAKKDAKKEEEKKEEPKKEAAKK

SEQ ID NO: 2838494 - protein, 25 aa, Entamoeba invadens
AKATNDQVDTAIQSTNALRNRIENL

SEQ ID NO: 2838495 - protein, 7 aa, Entamoeba invadens
AKATQIK

SEQ ID NO: 2838496 - protein, 15 aa, Entamoeba invadens
AKATSELSQKTQEDA

SEQ ID NO: 2838497 - protein, 12 aa, Entamoeba invadens
AKAVSSDSYSNL

SEQ ID NO: 2838498 - protein, 6 aa, Entamoeba invadens
AKCDKA

SEQ ID NO: 2838499 - protein, 9 aa, Entamoeba invadens
AKCDSYQTL

SEQ ID NO: 2838500 - protein, 9 aa, Entamoeba invadens
AKCDTTNGR

SEQ ID NO: 2838501 - protein, 12 aa, Entamoeba invadens
AKCEEKIEVTPK

SEQ ID NO: 2838502 - protein, 18 aa, Entamoeba invadens
AKCEKKQEEINKERIDYD

SEQ ID NO: 2838503 - protein, 7 aa, Entamoeba invadens
AKCGKTT

SEQ ID NO: 2838504 - protein, 6 aa, Entamoeba invadens
AKCGRL

SEQ ID NO: 2838505 - protein, 11 aa, Entamoeba invadens
AKDDGDSASNE

SEQ ID NO: 2838506 - protein, 8 aa, Entamoeba invadens
AKDDTNEN

SEQ ID NO: 2838507 - protein, 10 aa, Entamoeba invadens
AKDDTTNDIT

SEQ ID NO: 2838508 - protein, 14 aa, Entamoeba invadens
AKDEAVQKKKEAEK

SEQ ID NO: 2838509 - protein, 14 aa, Entamoeba invadens
AKDEDTSKKSLEKQ

SEQ ID NO: 2838510 - protein, 31 aa, Entamoeba invadens
AKDEEQRKRDAAEQALRDKEEADKQAERDRL

SEQ ID NO: 2838511 - protein, 7 aa, Entamoeba invadens
AKDEKYR

SEQ ID NO: 2838512 - protein, 20 aa, Entamoeba invadens
AKDESSDEKQEKNEKQERYS

SEQ ID NO: 2838513 - protein, 5 aa, Entamoeba invadens
AKDFT

SEQ ID NO: 2838514 - protein, 106 aa, Entamoeba invadens
AKDGAKTLSEDTKAKTKKDETKDQKNKKNVKDEKQVKPSSEKEFKTPSRKTSKKKVKKVSKVKNEKEIENDKTNEHLSDENSEETSSDGDSIKSTKPKKSSKTKST

SEQ ID NO: 2838515 - protein, 10 aa, Entamoeba invadens
AKDIGGTSDA

SEQ ID NO: 2838516 - protein, 15 aa, Entamoeba invadens
AKDIKEERENQKRLD

SEQ ID NO: 2838517 - protein, 7 aa, Entamoeba invadens
AKDINAN

SEQ ID NO: 2838518 - protein, 83 aa, Entamoeba invadens
AKDISTSGSSEVKDEKSSERTEKTREQSRDASGYSSRLSDSKKPIPKSEQSQKPEKTKTKKDDGDKKERKERTVEPTKLTDGE

SEQ ID NO: 2838519 - protein, 5 aa, Entamoeba invadens
AKDIY

SEQ ID NO: 2838520 - protein, 6 aa, Entamoeba invadens
AKDKEA

SEQ ID NO: 2838521 - protein, 18 aa, Entamoeba invadens
AKDKEGLTDPDHPADFFF

SEQ ID NO: 2838522 - protein, 8 aa, Entamoeba invadens
AKDKKDGI

SEQ ID NO: 2838523 - protein, 10 aa, Entamoeba invadens
AKDKNDGTSI

SEQ ID NO: 2838524 - protein, 6 aa, Entamoeba invadens
AKDKRS

SEQ ID NO: 2838525 - protein, 7 aa, Entamoeba invadens
AKDLEHR

SEQ ID NO: 2838526 - protein, 24 aa, Entamoeba invadens
AKDLGTGKESGIQIKSDGGLSEEE

SEQ ID NO: 2838527 - protein, 8 aa, Entamoeba invadens
AKDLPSPV

SEQ ID NO: 2838528 - protein, 8 aa, Entamoeba invadens
AKDLREEL

SEQ ID NO: 2838529 - protein, 9 aa, Entamoeba invadens
AKDNEKKTL

SEQ ID NO: 2838530 - protein, 9 aa, Entamoeba invadens
AKDPLDDTQ

SEQ ID NO: 2838531 - protein, 8 aa, Entamoeba invadens
AKDPNTVR

SEQ ID NO: 2838532 - protein, 8 aa, Entamoeba invadens
AKDPRLKV

SEQ ID NO: 2838533 - protein, 9 aa, Entamoeba invadens
AKDPSRYAK

SEQ ID NO: 2838534 - protein, 7 aa, Entamoeba invadens
AKDQIQK

SEQ ID NO: 2838535 - protein, 8 aa, Entamoeba invadens
AKDRRQQY

SEQ ID NO: 2838536 - protein, 7 aa, Entamoeba invadens
AKDSAEM

SEQ ID NO: 2838537 - protein, 7 aa, Entamoeba invadens
AKDSAPS

SEQ ID NO: 2838538 - protein, 14 aa, Entamoeba invadens
AKDSDTQEEKITKV

SEQ ID NO: 2838539 - protein, 9 aa, Entamoeba invadens
AKDSEKKTL

SEQ ID NO: 2838540 - protein, 8 aa, Entamoeba invadens
AKDSIAGI

SEQ ID NO: 2838541 - protein, 14 aa, Entamoeba invadens
AKDSISQTGQKSVD

SEQ ID NO: 2838542 - protein, 7 aa, Entamoeba invadens
AKDSKKV

SEQ ID NO: 2838543 - protein, 14 aa, Entamoeba invadens
AKDSLSQTGQKGVD

SEQ ID NO: 2838544 - protein, 9 aa, Entamoeba invadens
AKDSSDDYL

SEQ ID NO: 2838545 - protein, 7 aa, Entamoeba invadens
AKDSSVY

SEQ ID NO: 2838546 - protein, 8 aa, Entamoeba invadens
AKDTDEDV

SEQ ID NO: 2838547 - protein, 7 aa, Entamoeba invadens
AKDTDTH

SEQ ID NO: 2838548 - protein, 10 aa, Entamoeba invadens
AKDTEKKSLE

SEQ ID NO: 2838549 - protein, 5 aa, Entamoeba invadens
AKDTI

SEQ ID NO: 2838550 - protein, 12 aa, Entamoeba invadens
AKDTQQSDNPSF

SEQ ID NO: 2838551 - protein, 5 aa, Entamoeba invadens
AKDVS

SEQ ID NO: 2838552 - protein, 7 aa, Entamoeba invadens
AKDYEEM

SEQ ID NO: 2838553 - protein, 11 aa, Entamoeba invadens
AKEAEKSERGI

SEQ ID NO: 2838554 - protein, 6 aa, Entamoeba invadens
AKEANT

SEQ ID NO: 2838555 - protein, 57 aa, Entamoeba invadens
AKEATQKLEKEKAEKMRAERVSTGETAKKRPEPKTNKEKYEAYEKAKEKGTKAFKDT

SEQ ID NO: 2838556 - protein, 6 aa, Entamoeba invadens
AKEAYK

SEQ ID NO: 2838557 - protein, 4 aa, Entamoeba invadens
AKEC

SEQ ID NO: 2838558 - protein, 4 aa, Entamoeba invadens
AKED

SEQ ID NO: 2838559 - protein, 9 aa, Entamoeba invadens
AKEDAASNF

SEQ ID NO: 2838560 - protein, 99 aa, Entamoeba invadens
AKEDELKITQSNQEQKQDENSHNEISKTEEKSEQKVDKQSEDTSPTESEQKVVDSSIEAKSNSKFSEKEDESKHPKQDFTSPKDTKSEKKASPIPDDHP

SEQ ID NO: 2838561 - protein, 12 aa, Entamoeba invadens
AKEDFDQATENL

SEQ ID NO: 2838562 - protein, 18 aa, Entamoeba invadens
AKEDKRAPPEVHNQTAEL

SEQ ID NO: 2838563 - protein, 8 aa, Entamoeba invadens
AKEDTASF

SEQ ID NO: 2838564 - protein, 7 aa, Entamoeba invadens
AKEDTAT

SEQ ID NO: 2838565 - protein, 15 aa, Entamoeba invadens
AKEDTDILPKKTTKA

SEQ ID NO: 2838566 - protein, 6 aa, Entamoeba invadens
AKEDVK

SEQ ID NO: 2838567 - protein, 13 aa, Entamoeba invadens
AKEDYEESGSNLK

SEQ ID NO: 2838568 - protein, 13 aa, Entamoeba invadens
AKEEAKDKGVDTK

SEQ ID NO: 2838569 - protein, 11 aa, Entamoeba invadens
AKEEDASNGGL

SEQ ID NO: 2838570 - protein, 50 aa, Entamoeba invadens
AKEEDESLKENEDKVRSAEDKNSPKNTQSTSVEQVEKNSEDEKKEKIEKM

SEQ ID NO: 2838571 - protein, 11 aa, Entamoeba invadens
AKEEELPPVPL

SEQ ID NO: 2838572 - protein, 9 aa, Entamoeba invadens
AKEEEQQKV

SEQ ID NO: 2838573 - protein, 7 aa, Entamoeba invadens
AKEEGHT

SEQ ID NO: 2838574 - protein, 20 aa, Entamoeba invadens
AKEEIQKTLKKTSESVDKTE

SEQ ID NO: 2838575 - protein, 8 aa, Entamoeba invadens
AKEEMGNV

SEQ ID NO: 2838576 - protein, 39 aa, Entamoeba invadens
AKEENAHKPADQKVEEKKTEDPKEVTQTTSEAKSGCCVL

SEQ ID NO: 2838577 - protein, 11 aa, Entamoeba invadens
AKEEPISPSKI

SEQ ID NO: 2838578 - protein, 6 aa, Entamoeba invadens
AKEEQI

SEQ ID NO: 2838579 - protein, 13 aa, Entamoeba invadens
AKEETERKEKERL

SEQ ID NO: 2838580 - protein, 4 aa, Entamoeba invadens
AKEF

SEQ ID NO: 2838581 - protein, 11 aa, Entamoeba invadens
AKEFKANNTEN

SEQ ID NO: 2838582 - protein, 5 aa, Entamoeba invadens
AKEGD

SEQ ID NO: 2838583 - protein, 7 aa, Entamoeba invadens
AKEGDLI

SEQ ID NO: 2838584 - protein, 17 aa, Entamoeba invadens
AKEGDRQGAHGRMAKNK

SEQ ID NO: 2838585 - protein, 5 aa, Entamoeba invadens
AKEGL

SEQ ID NO: 2838586 - protein, 6 aa, Entamoeba invadens
AKEGNA

SEQ ID NO: 2838587 - protein, 8 aa, Entamoeba invadens
AKEGNSEA

SEQ ID NO: 2838588 - protein, 8 aa, Entamoeba invadens
AKEGNSIL

SEQ ID NO: 2838589 - protein, 7 aa, Entamoeba invadens
AKEGRPE

SEQ ID NO: 2838590 - protein, 8 aa, Entamoeba invadens
AKEGTGVT

SEQ ID NO: 2838591 - protein, 6 aa, Entamoeba invadens
AKEGVG

SEQ ID NO: 2838592 - protein, 7 aa, Entamoeba invadens
AKEHNGK

SEQ ID NO: 2838593 - protein, 5 aa, Entamoeba invadens
AKEHQ

SEQ ID NO: 2838594 - protein, 5 aa, Entamoeba invadens
AKEID

SEQ ID NO: 2838595 - protein, 14 aa, Entamoeba invadens
AKEISDAKQQLEQM

SEQ ID NO: 2838596 - protein, 24 aa, Entamoeba invadens
AKEKFNKEKMEKEQKEKEEKEAAL

SEQ ID NO: 2838597 - protein, 8 aa, Entamoeba invadens
AKEKGDIT

SEQ ID NO: 2838598 - protein, 27 aa, Entamoeba invadens
AKEKKVEIASTRTKTYAKELTQKPRAI

SEQ ID NO: 2838599 - protein, 13 aa, Entamoeba invadens
AKEKLDKITQVTD

SEQ ID NO: 2838600 - protein, 10 aa, Entamoeba invadens
AKEKQKISEY

SEQ ID NO: 2838601 - protein, 6 aa, Entamoeba invadens
AKEKRD

SEQ ID NO: 2838602 - protein, 7 aa, Entamoeba invadens
AKEKRKF

SEQ ID NO: 2838603 - protein, 7 aa, Entamoeba invadens
AKEKSLG

SEQ ID NO: 2838604 - protein, 29 aa, Entamoeba invadens
AKEKTNETKTSKVEEKSESSNKSLKPSQL

SEQ ID NO: 2838605 - protein, 10 aa, Entamoeba invadens
AKEKTNSTQF

SEQ ID NO: 2838606 - protein, 5 aa, Entamoeba invadens
AKEKV

SEQ ID NO: 2838607 - protein, 7 aa, Entamoeba invadens
AKEKVYT

SEQ ID NO: 2838608 - protein, 7 aa, Entamoeba invadens
AKEKYTD

SEQ ID NO: 2838609 - protein, 4 aa, Entamoeba invadens
AKEL

SEQ ID NO: 2838610 - protein, 27 aa, Entamoeba invadens
AKELEDKVEQLEKEKNEKDEKINNLEE

SEQ ID NO: 2838611 - protein, 14 aa, Entamoeba invadens
AKEMPATPNEVEEA

SEQ ID NO: 2838612 - protein, 6 aa, Entamoeba invadens
AKEMVS

SEQ ID NO: 2838613 - protein, 5 aa, Entamoeba invadens
AKENA

SEQ ID NO: 2838614 - protein, 15 aa, Entamoeba invadens
AKENEDDESSGYMGK

SEQ ID NO: 2838615 - protein, 36 aa, Entamoeba invadens
AKENEDKEKQKKEKKEERVKKIEEKMEEEVENEDKC

SEQ ID NO: 2838616 - protein, 14 aa, Entamoeba invadens
AKENGKSTSETKKF

SEQ ID NO: 2838617 - protein, 6 aa, Entamoeba invadens
AKENHI

SEQ ID NO: 2838618 - protein, 5 aa, Entamoeba invadens
AKENI

SEQ ID NO: 2838619 - protein, 20 aa, Entamoeba invadens
AKENKKRDLELEGNKSNVVG

SEQ ID NO: 2838620 - protein, 10 aa, Entamoeba invadens
AKENLKYGEQ

SEQ ID NO: 2838621 - protein, 6 aa, Entamoeba invadens
AKENMN

SEQ ID NO: 2838622 - protein, 29 aa, Entamoeba invadens
AKENNLQTTTAAVPTQNPEDALPADASRC

SEQ ID NO: 2838623 - protein, 9 aa, Entamoeba invadens
AKENPDKYT

SEQ ID NO: 2838624 - protein, 7 aa, Entamoeba invadens
AKENTNL

SEQ ID NO: 2838625 - protein, 15 aa, Entamoeba invadens
AKEPANTPKKQLTTK

SEQ ID NO: 2838626 - protein, 14 aa, Entamoeba invadens
AKEPATSMGYTKGN

SEQ ID NO: 2838627 - protein, 8 aa, Entamoeba invadens
AKEPGKTH

SEQ ID NO: 2838628 - protein, 6 aa, Entamoeba invadens
AKEPNL

SEQ ID NO: 2838629 - protein, 8 aa, Entamoeba invadens
AKEQDSLH

SEQ ID NO: 2838630 - protein, 6 aa, Entamoeba invadens
AKEQQR

SEQ ID NO: 2838631 - protein, 7 aa, Entamoeba invadens
AKEQRSV

SEQ ID NO: 2838632 - protein, 6 aa, Entamoeba invadens
AKEQSV

SEQ ID NO: 2838633 - protein, 5 aa, Entamoeba invadens
AKERD

SEQ ID NO: 2838634 - protein, 7 aa, Entamoeba invadens
AKERGIS

SEQ ID NO: 2838635 - protein, 13 aa, Entamoeba invadens
AKERKTSKQKVQT

SEQ ID NO: 2838636 - protein, 15 aa, Entamoeba invadens
AKERNGFGQSTIAED

SEQ ID NO: 2838637 - protein, 8 aa, Entamoeba invadens
AKESGMDK

SEQ ID NO: 2838638 - protein, 10 aa, Entamoeba invadens
AKESNPDDPM

SEQ ID NO: 2838639 - protein, 6 aa, Entamoeba invadens
AKESYD

SEQ ID NO: 2838640 - protein, 9 aa, Entamoeba invadens
AKESYNPRE

SEQ ID NO: 2838641 - protein, 7 aa, Entamoeba invadens
AKETEEL

SEQ ID NO: 2838642 - protein, 8 aa, Entamoeba invadens
AKETEIEA

SEQ ID NO: 2838643 - protein, 8 aa, Entamoeba invadens
AKETESKG

SEQ ID NO: 2838644 - protein, 10 aa, Entamoeba invadens
AKETHKTFRS

SEQ ID NO: 2838645 - protein, 8 aa, Entamoeba invadens
AKETHRPE

SEQ ID NO: 2838646 - protein, 12 aa, Entamoeba invadens
AKETSPTSGTFK

SEQ ID NO: 2838647 - protein, 8 aa, Entamoeba invadens
AKETTDYE

SEQ ID NO: 2838648 - protein, 6 aa, Entamoeba invadens
AKETTF

SEQ ID NO: 2838649 - protein, 4 aa, Entamoeba invadens
AKEV

SEQ ID NO: 2838650 - protein, 7 aa, Entamoeba invadens
AKEVKST

SEQ ID NO: 2838651 - protein, 6 aa, Entamoeba invadens
AKEVRL

SEQ ID NO: 2838652 - protein, 15 aa, Entamoeba invadens
AKEVRNSLEHRESNP

SEQ ID NO: 2838653 - protein, 11 aa, Entamoeba invadens
AKEYARHHGEQ

SEQ ID NO: 2838654 - protein, 6 aa, Entamoeba invadens
AKFGSS

SEQ ID NO: 2838655 - protein, 9 aa, Entamoeba invadens
AKFNEESKA

SEQ ID NO: 2838656 - protein, 6 aa, Entamoeba invadens
AKFNKD

SEQ ID NO: 2838657 - protein, 6 aa, Entamoeba invadens
AKFPAN

SEQ ID NO: 2838658 - protein, 12 aa, Entamoeba invadens
AKFTPKSKNYSN

SEQ ID NO: 2838659 - protein, 17 aa, Entamoeba invadens
AKFTQKPKKIQKKDRVN

SEQ ID NO: 2838660 - protein, 8 aa, Entamoeba invadens
AKGATAMK

SEQ ID NO: 2838661 - protein, 7 aa, Entamoeba invadens
AKGCENA

SEQ ID NO: 2838662 - protein, 9 aa, Entamoeba invadens
AKGDKLRTL

SEQ ID NO: 2838663 - protein, 7 aa, Entamoeba invadens
AKGDQVV

SEQ ID NO: 2838664 - protein, 7 aa, Entamoeba invadens
AKGDSQC

SEQ ID NO: 2838665 - protein, 5 aa, Entamoeba invadens
AKGDY

SEQ ID NO: 2838666 - protein, 10 aa, Entamoeba invadens
AKGEAVKGDL

SEQ ID NO: 2838667 - protein, 7 aa, Entamoeba invadens
AKGEEEI

SEQ ID NO: 2838668 - protein, 7 aa, Entamoeba invadens
AKGEGQQ

SEQ ID NO: 2838669 - protein, 51 aa, Entamoeba invadens; identical to SEQ ID NO: 2743679

SEQ ID NO: 2838670 - protein, 19 aa, Entamoeba invadens
AKGGALPEHPTQEAPQPLQ

SEQ ID NO: 2838671 - protein, 34 aa, Entamoeba invadens
AKGGKKDTMKPKSKSAGKVQKKSWAKSKVKEKLN

SEQ ID NO: 2838672 - protein, 6 aa, Entamoeba invadens
AKGGNL

SEQ ID NO: 2838673 - protein, 10 aa, Entamoeba invadens
AKGGQNDEVE

SEQ ID NO: 2838674 - protein, 4 aa, Entamoeba invadens
AKGH

SEQ ID NO: 2838675 - protein, 7 aa, Entamoeba invadens
AKGKNIT

SEQ ID NO: 2838676 - protein, 9 aa, Entamoeba invadens
AKGNNAREA

SEQ ID NO: 2838677 - protein, 19 aa, Entamoeba invadens
AKGNTLKSGLLSQKDDSSF

SEQ ID NO: 2838678 - protein, 5 aa, Entamoeba invadens
AKGPF

SEQ ID NO: 2838679 - protein, 4 aa, Entamoeba invadens
AKGQ

SEQ ID NO: 2838680 - protein, 8 aa, Entamoeba invadens
AKGQWTKE

SEQ ID NO: 2838681 - protein, 6 aa, Entamoeba invadens
AKGRQE

SEQ ID NO: 2838682 - protein, 8 aa, Entamoeba invadens
AKGRSTPL

SEQ ID NO: 2838683 - protein, 4 aa, Entamoeba invadens
AKGS

SEQ ID NO: 2838684 - protein, 10 aa, Entamoeba invadens
AKGSAKKRSC

SEQ ID NO: 2838685 - protein, 9 aa, Entamoeba invadens
AKGTNPNYH

SEQ ID NO: 2838686 - protein, 4 aa, Entamoeba invadens
AKGV

SEQ ID NO: 2838687 - protein, 13 aa, Entamoeba invadens
AKGVKPEKTEEEI

SEQ ID NO: 2838688 - protein, 6 aa, Entamoeba invadens
AKGVPN

SEQ ID NO: 2838689 - protein, 6 aa, Entamoeba invadens
AKGYDG

SEQ ID NO: 2838690 - protein, 34 aa, Entamoeba invadens
AKHETELEEAQDAAAKAKKQAKQYAKKVEKAERK

SEQ ID NO: 2838691 - protein, 5 aa, Entamoeba invadens
AKHFP

SEQ ID NO: 2838692 - protein, 17 aa, Entamoeba invadens
AKHNPDNKPWLTFAEPE

SEQ ID NO: 2838693 - protein, 7 aa, Entamoeba invadens
AKHNRVR

SEQ ID NO: 2838694 - protein, 8 aa, Entamoeba invadens
AKHSEHPT

SEQ ID NO: 2838695 - protein, 8 aa, Entamoeba invadens
AKHYSPDT

SEQ ID NO: 2838696 - protein, 6 aa, Entamoeba invadens
AKHYTP

SEQ ID NO: 2838697 - protein, 5 aa, Entamoeba invadens
AKIDK

SEQ ID NO: 2838698 - protein, 7 aa, Entamoeba invadens
AKIDNNS

SEQ ID NO: 2838699 - protein, 4 aa, Entamoeba invadens
AKIE

SEQ ID NO: 2838700 - protein, 74 aa, Entamoeba invadens
AKIEESPNSNEVVAPKPTDKISKVKTEKVDDVKTGKVGKRSTSKPKGEEPEKPQENSETVESVSSSRPTLSGKI

SEQ ID NO: 2838701 - protein, 6 aa, Entamoeba invadens
AKIEGD

SEQ ID NO: 2838702 - protein, 9 aa, Entamoeba invadens
AKIEGGSSL

SEQ ID NO: 2838703 - protein, 10 aa, Entamoeba invadens
AKIESDAKAE

SEQ ID NO: 2838704 - protein, 22 aa, Entamoeba invadens
AKIESKEKIGIAGRTGSGKSTL

SEQ ID NO: 2838705 - protein, 26 aa, Entamoeba invadens
AKIGGETTSTKKESEKPKEQEKPATI

SEQ ID NO: 2838706 - protein, 7 aa, Entamoeba invadens
AKIGQPV

SEQ ID NO: 2838707 - protein, 30 aa, Entamoeba invadens
AKIKEQKSLDMKNAEEEVKSLQTKETQLDE

SEQ ID NO: 2838708 - protein, 7 aa, Entamoeba invadens
AKIKGRN

SEQ ID NO: 2838709 - protein, 6 aa, Entamoeba invadens
AKIKNS

SEQ ID NO: 2838710 - protein, 27 aa, Entamoeba invadens
AKIQEELDEEANKEEEEYKKAENERLG

SEQ ID NO: 2838711 - protein, 6 aa, Entamoeba invadens
AKIQNI

SEQ ID NO: 2838712 - protein, 10 aa, Entamoeba invadens
AKIQTTVSEL

SEQ ID NO: 2838713 - protein, 10 aa, Entamoeba invadens
AKIREQQEKY

SEQ ID NO: 2838714 - protein, 9 aa, Entamoeba invadens
AKIRRNATN

SEQ ID NO: 2838715 - protein, 8 aa, Entamoeba invadens
AKITAPSD

SEQ ID NO: 2838716 - protein, 14 aa, Entamoeba invadens
AKKAAELKIPGPLR

SEQ ID NO: 2838717 - protein, 19 aa, Entamoeba invadens
AKKAEAARIAKQREEEIRE

SEQ ID NO: 2838718 - protein, 7 aa, Entamoeba invadens
AKKAELV

SEQ ID NO: 2838719 - protein, 11 aa, Entamoeba invadens
AKKAKEDGEFK

SEQ ID NO: 2838720 - protein, 8 aa, Entamoeba invadens
AKKATEKY

SEQ ID NO: 2838721 - protein, 7 aa, Entamoeba invadens
AKKCTTV

SEQ ID NO: 2838722 - protein, 12 aa, Entamoeba invadens
AKKDEVSDECVD

SEQ ID NO: 2838723 - protein, 9 aa, Entamoeba invadens
AKKDGGRLK

SEQ ID NO: 2838724 - protein, 7 aa, Entamoeba invadens
AKKDGVV

SEQ ID NO: 2838725 - protein, 19 aa, Entamoeba invadens
AKKDTAIKTITEKPVEVPL

SEQ ID NO: 2838726 - protein, 10 aa, Entamoeba invadens
AKKEAKYDDL

SEQ ID NO: 2838727 - protein, 17 aa, Entamoeba invadens
AKKEAVQCKDKAESCVV

SEQ ID NO: 2838728 - protein, 5 aa, Entamoeba invadens
AKKED

SEQ ID NO: 2838729 - protein, 26 aa, Entamoeba invadens
AKKEEEHPKEKTNLPPPTFKKEKSVR

SEQ ID NO: 2838730 - protein, 39 aa, Entamoeba invadens
AKKEEKKPTPRAETMEKAKEKGKEKKGTTVSNKKEPKKL

SEQ ID NO: 2838731 - protein, 7 aa, Entamoeba invadens
AKKEGAN

SEQ ID NO: 2838732 - protein, 12 aa, Entamoeba invadens
AKKEITKRSPPV

SEQ ID NO: 2838733 - protein, 7 aa, Entamoeba invadens
AKKEKDI

SEQ ID NO: 2838734 - protein, 15 aa, Entamoeba invadens
AKKEKDPKATFTKPS

SEQ ID NO: 2838735 - protein, 9 aa, Entamoeba invadens
AKKEKEKIS

SEQ ID NO: 2838736 - protein, 26 aa, Entamoeba invadens
AKKERQAMAKKKPKVVTSTNLSSALS

SEQ ID NO: 2838737 - protein, 5 aa, Entamoeba invadens
AKKES

SEQ ID NO: 2838738 - protein, 10 aa, Entamoeba invadens
AKKESRSIEV

SEQ ID NO: 2838739 - protein, 5 aa, Entamoeba invadens
AKKEV

SEQ ID NO: 2838740 - protein, 12 aa, Entamoeba invadens
AKKGDISAKQNI

SEQ ID NO: 2838741 - protein, 6 aa, Entamoeba invadens
AKKGEL

SEQ ID NO: 2838742 - protein, 8 aa, Entamoeba invadens
AKKGRLDN

SEQ ID NO: 2838743 - protein, 5 aa, Entamoeba invadens
AKKHG

SEQ ID NO: 2838744 - protein, 6 aa, Entamoeba invadens
AKKHGL

SEQ ID NO: 2838745 - protein, 5 aa, Entamoeba invadens
AKKIG

SEQ ID NO: 2838746 - protein, 15 aa, Entamoeba invadens
AKKITETKLTTLEEQ

SEQ ID NO: 2838747 - protein, 8 aa, Entamoeba invadens
AKKKGEEC

SEQ ID NO: 2838748 - protein, 11 aa, Entamoeba invadens
AKKKLLQPSQT

SEQ ID NO: 2838749 - protein, 9 aa, Entamoeba invadens
AKKKSKDLE

SEQ ID NO: 2838750 - protein, 9 aa, Entamoeba invadens
AKKKSKDLK

SEQ ID NO: 2838751 - protein, 12 aa, Entamoeba invadens
AKKKVSDSMKDL

SEQ ID NO: 2838752 - protein, 16 aa, Entamoeba invadens
AKKNDSANELRPVDSK

SEQ ID NO: 2838753 - protein, 7 aa, Entamoeba invadens
AKKNGKK

SEQ ID NO: 2838754 - protein, 7 aa, Entamoeba invadens
AKKNGKT

SEQ ID NO: 2838755 - protein, 14 aa, Entamoeba invadens
AKKNKERVPTMNPT

SEQ ID NO: 2838756 - protein, 12 aa, Entamoeba invadens
AKKNKKGAEIKP

SEQ ID NO: 2838757 - protein, 8 aa, Entamoeba invadens
AKKNQQIV

SEQ ID NO: 2838758 - protein, 9 aa, Entamoeba invadens
AKKNSPTNV

SEQ ID NO: 2838759 - protein, 8 aa, Entamoeba invadens
AKKPGGMQ

SEQ ID NO: 2838760 - protein, 8 aa, Entamoeba invadens
AKKQEGKE

SEQ ID NO: 2838761 - protein, 9 aa, Entamoeba invadens
AKKQKRTKL

SEQ ID NO: 2838762 - protein, 6 aa, Entamoeba invadens
AKKQRN

SEQ ID NO: 2838763 - protein, 6 aa, Entamoeba invadens
AKKQRV

SEQ ID NO: 2838764 - protein, 11 aa, Entamoeba invadens
AKKREDLMETG

SEQ ID NO: 2838765 - protein, 13 aa, Entamoeba invadens
AKKREKARQRRKT

SEQ ID NO: 2838766 - protein, 14 aa, Entamoeba invadens
AKKRGGYVTNEEEV

SEQ ID NO: 2838767 - protein, 7 aa, Entamoeba invadens
AKKRGLG

SEQ ID NO: 2838768 - protein, 10 aa, Entamoeba invadens
AKKRQNASVN

SEQ ID NO: 2838769 - protein, 8 aa, Entamoeba invadens
AKKRRELE

SEQ ID NO: 2838770 - protein, 8 aa, Entamoeba invadens
AKKSASDI

SEQ ID NO: 2838771 - protein, 7 aa, Entamoeba invadens
AKKSHLD

SEQ ID NO: 2838772 - protein, 8 aa, Entamoeba invadens
AKKSISPI

SEQ ID NO: 2838773 - protein, 11 aa, Entamoeba invadens
AKKSKDEDKIG

SEQ ID NO: 2838774 - protein, 11 aa, Entamoeba invadens
AKKSNSGNAQL

SEQ ID NO: 2838775 - protein, 4 aa, Entamoeba invadens
AKKT

SEQ ID NO: 2838776 - protein, 7 aa, Entamoeba invadens
AKKTEKA

SEQ ID NO: 2838777 - protein, 10 aa, Entamoeba invadens
AKKTPQTQMN

SEQ ID NO: 2838778 - protein, 7 aa, Entamoeba invadens
AKKTQNK

SEQ ID NO: 2838779 - protein, 7 aa, Entamoeba invadens
AKKTQVT

SEQ ID NO: 2838780 - protein, 7 aa, Entamoeba invadens
AKKTRAH

SEQ ID NO: 2838781 - protein, 8 aa, Entamoeba invadens
AKKTTAVS

SEQ ID NO: 2838782 - protein, 16 aa, Entamoeba invadens
AKKTTVVHQNPINCKF

SEQ ID NO: 2838783 - protein, 16 aa, Entamoeba invadens
AKKVGSVVKGDDQTNV

SEQ ID NO: 2838784 - protein, 8 aa, Entamoeba invadens
AKKVPKDR

SEQ ID NO: 2838785 - protein, 9 aa, Entamoeba invadens
AKKVSGKLG

SEQ ID NO: 2838786 - protein, 10 aa, Entamoeba invadens
AKKVSKKEKY

SEQ ID NO: 2838787 - protein, 7 aa, Entamoeba invadens
AKKWPDY

SEQ ID NO: 2838788 - protein, 6 aa, Entamoeba invadens
AKKYES

SEQ ID NO: 2838789 - protein, 5 aa, Entamoeba invadens
AKKYG

SEQ ID NO: 2838790 - protein, 26 aa, Entamoeba invadens
AKKYRKDKKRAQRKAKAEKEHGDEYN

SEQ ID NO: 2838791 - protein, 4 aa, Entamoeba invadens
AKLA

SEQ ID NO: 2838792 - protein, 12 aa, Entamoeba invadens
AKLAAGKSEEIH

SEQ ID NO: 2838793 - protein, 5 aa, Entamoeba invadens
AKLDD

SEQ ID NO: 2838794 - protein, 7 aa, Entamoeba invadens
AKLDDSA

SEQ ID NO: 2838795 - protein, 7 aa, Entamoeba invadens
AKLDTTL

SEQ ID NO: 2838796 - protein, 10 aa, Entamoeba invadens
AKLENEKAEM

SEQ ID NO: 2838797 - protein, 6 aa, Entamoeba invadens
AKLEVE

SEQ ID NO: 2838798 - protein, 7 aa, Entamoeba invadens
AKLGDFG

SEQ ID NO: 2838799 - protein, 11 aa, Entamoeba invadens
AKLKASTKTIV

SEQ ID NO: 2838800 - protein, 9 aa, Entamoeba invadens
AKLKKGRWS

SEQ ID NO: 2838801 - protein, 65 aa, Entamoeba invadens
AKLKQKAEEEEQAKRNKEDKKKTRHRFTSDSKSSSGESSASKKQKKSSDKSGSEKSKKIKNVQPK

SEQ ID NO: 2838802 - protein, 7 aa, Entamoeba invadens
AKLNNVE

SEQ ID NO: 2838803 - protein, 8 aa, Entamoeba invadens
AKLPKTDE

SEQ ID NO: 2838804 - protein, 5 aa, Entamoeba invadens
AKLQD

SEQ ID NO: 2838805 - protein, 22 aa, Entamoeba invadens
AKLQEDKKKCYATCPSGTYATA

SEQ ID NO: 2838806 - protein, 14 aa, Entamoeba invadens
AKLQEDKKNVTQRK

SEQ ID NO: 2838807 - protein, 13 aa, Entamoeba invadens
AKLQNELQTVESE

SEQ ID NO: 2838808 - protein, 18 aa, Entamoeba invadens
AKLQSESVVEKGNGNEEL

SEQ ID NO: 2838809 - protein, 13 aa, Entamoeba invadens
AKLRKQNDENDKL

SEQ ID NO: 2838810 - protein, 13 aa, Entamoeba invadens
AKLSGKKGKSQIT

SEQ ID NO: 2838811 - protein, 9 aa, Entamoeba invadens
AKLTEFGSA

SEQ ID NO: 2838812 - protein, 11 aa, Entamoeba invadens
AKLTGRRNSIE

SEQ ID NO: 2838813 - protein, 7 aa, Entamoeba invadens
AKLTPEE

SEQ ID NO: 2838814 - protein, 12 aa, Entamoeba invadens
AKMAEKKANARI

SEQ ID NO: 2838815 - protein, 5 aa, Entamoeba invadens
AKMDN

SEQ ID NO: 2838816 - protein, 15 aa, Entamoeba invadens
AKMEEQNVANPANLA

SEQ ID NO: 2838817 - protein, 5 aa, Entamoeba invadens
AKMET

SEQ ID NO: 2838818 - protein, 12 aa, Entamoeba invadens
AKMKRSKKLYNT

SEQ ID NO: 2838819 - protein, 6 aa, Entamoeba invadens
AKMSDK

SEQ ID NO: 2838820 - protein, 11 aa, Entamoeba invadens
AKMTPEPSSVG

SEQ ID NO: 2838821 - protein, 7 aa, Entamoeba invadens
AKNAFED

SEQ ID NO: 2838822 - protein, 8 aa, Entamoeba invadens
AKNAFNEV

SEQ ID NO: 2838823 - protein, 9 aa, Entamoeba invadens
AKNANAEYK

SEQ ID NO: 2838824 - protein, 9 aa, Entamoeba invadens
AKNANDKKI

SEQ ID NO: 2838825 - protein, 4 aa, Entamoeba invadens
AKNC

SEQ ID NO: 2838826 - protein, 7 aa, Entamoeba invadens
AKNCGSG

SEQ ID NO: 2838827 - protein, 6 aa, Entamoeba invadens
AKNDAN

SEQ ID NO: 2838828 - protein, 26 aa, Entamoeba invadens
AKNDEKDKNEKVEKRCTNEIETNEKV

SEQ ID NO: 2838829 - protein, 6 aa, Entamoeba invadens
AKNDIE

SEQ ID NO: 2838830 - protein, 11 aa, Entamoeba invadens
AKNDKMKSESW

SEQ ID NO: 2838831 - protein, 4 aa, Entamoeba invadens
AKNE

SEQ ID NO: 2838832 - protein, 6 aa, Entamoeba invadens
AKNEEI

SEQ ID NO: 2838833 - protein, 10 aa, Entamoeba invadens
AKNEESLKTS

SEQ ID NO: 2838834 - protein, 7 aa, Entamoeba invadens
AKNEETV

SEQ ID NO: 2838835 - protein, 11 aa, Entamoeba invadens
AKNEKPSKATI

SEQ ID NO: 2838836 - protein, 9 aa, Entamoeba invadens
AKNENLPNK

SEQ ID NO: 2838837 - protein, 4 aa, Entamoeba invadens
AKNF

SEQ ID NO: 2838838 - protein, 5 aa, Entamoeba invadens
AKNGL

SEQ ID NO: 2838839 - protein, 8 aa, Entamoeba invadens
AKNINGDM

SEQ ID NO: 2838840 - protein, 7 aa, Entamoeba invadens
AKNINTT

SEQ ID NO: 2838841 - protein, 4 aa, Entamoeba invadens
AKNK

SEQ ID NO: 2838842 - protein, 7 aa, Entamoeba invadens
AKNKDKI

SEQ ID NO: 2838843 - protein, 11 aa, Entamoeba invadens
AKNKEKAEEYQ

SEQ ID NO: 2838844 - protein, 16 aa, Entamoeba invadens
AKNKLTGLETSQKNLE

SEQ ID NO: 2838845 - protein, 8 aa, Entamoeba invadens
AKNLGTSV

SEQ ID NO: 2838846 - protein, 4 aa, Entamoeba invadens
AKNN

SEQ ID NO: 2838847 - protein, 7 aa, Entamoeba invadens
AKNNINV

SEQ ID NO: 2838848 - protein, 8 aa, Entamoeba invadens
AKNNNEEL

SEQ ID NO: 2838849 - protein, 9 aa, Entamoeba invadens
AKNNRDVTK

SEQ ID NO: 2838850 - protein, 26 aa, Entamoeba invadens
AKNNTKSSKNSSTATSEDNTKYEKYN

SEQ ID NO: 2838851 - protein, 20 aa, Entamoeba invadens
AKNNTKSSKNSSTATSEHDM

SEQ ID NO: 2838852 - protein, 8 aa, Entamoeba invadens
AKNNTNID

SEQ ID NO: 2838853 - protein, 8 aa, Entamoeba invadens
AKNNTNIT

SEQ ID NO: 2838854 - protein, 8 aa, Entamoeba invadens
AKNNTNVQ

SEQ ID NO: 2838855 - protein, 6 aa, Entamoeba invadens
AKNPKK

SEQ ID NO: 2838856 - protein, 7 aa, Entamoeba invadens
AKNPPGM

SEQ ID NO: 2838857 - protein, 7 aa, Entamoeba invadens
AKNPSEK

SEQ ID NO: 2838858 - protein, 7 aa, Entamoeba invadens
AKNPVTE

SEQ ID NO: 2838859 - protein, 10 aa, Entamoeba invadens
AKNQNTQKME

SEQ ID NO: 2838860 - protein, 15 aa, Entamoeba invadens
AKNQSKDVTSEFYNN

SEQ ID NO: 2838861 - protein, 9 aa, Entamoeba invadens
AKNRPSCES

SEQ ID NO: 2838862 - protein, 5 aa, Entamoeba invadens
AKNSA

SEQ ID NO: 2838863 - protein, 8 aa, Entamoeba invadens
AKNSNDPT

SEQ ID NO: 2838864 - protein, 6 aa, Entamoeba invadens
AKNTNV

SEQ ID NO: 2838865 - protein, 25 aa, Entamoeba invadens
AKNVDEKKEKKSKKKKRMSDDEELL

SEQ ID NO: 2838866 - protein, 7 aa, Entamoeba invadens
AKNYTEV

SEQ ID NO: 2838867 - protein, 74 aa, Entamoeba invadens
AKPASPSSSPFKDELGELKEEQKSEQNTPKEEIVGDKDGGKELSKGSPDKQSSNDNTPPQQPSEAITEEEKEVD

SEQ ID NO: 2838868 - protein, 7 aa, Entamoeba invadens
AKPERAN

SEQ ID NO: 2838869 - protein, 18 aa, Entamoeba invadens
AKPEREVEKKTASGRTFK

SEQ ID NO: 2838870 - protein, 8 aa, Entamoeba invadens
AKPGTQAS

SEQ ID NO: 2838871 - protein, 5 aa, Entamoeba invadens
AKPKE

SEQ ID NO: 2838872 - protein, 15 aa, Entamoeba invadens
AKPKELKDKHKKRSK

SEQ ID NO: 2838873 - protein, 11 aa, Entamoeba invadens
AKPKKSVEEVT

SEQ ID NO: 2838874 - protein, 9 aa, Entamoeba invadens
AKPKPKFEY

SEQ ID NO: 2838875 - protein, 25 aa, Entamoeba invadens
AKPKQTETAQQNSSMFDTPNTNNSV

SEQ ID NO: 2838876 - protein, 7 aa, Entamoeba invadens
AKPPKDI

SEQ ID NO: 2838877 - protein, 48 aa, Entamoeba invadens
AKPPKRQRNKESTPQPQSPAQEKQEKVQSPKVEKVQPKQETPPAAQNN

SEQ ID NO: 2838878 - protein, 30 aa, Entamoeba invadens
AKPPLPSKFKNTKLKNQQKKKLSQRKKDSI

SEQ ID NO: 2838879 - protein, 11 aa, Entamoeba invadens
AKPQKKAEYSR

SEQ ID NO: 2838880 - protein, 7 aa, Entamoeba invadens
AKPQLDN

SEQ ID NO: 2838881 - protein, 7 aa, Entamoeba invadens
AKPQNSN

SEQ ID NO: 2838882 - protein, 7 aa, Entamoeba invadens
AKPQQKV

SEQ ID NO: 2838883 - protein, 16 aa, Entamoeba invadens
AKPQTVFSKTNGYCFI

SEQ ID NO: 2838884 - protein, 5 aa, Entamoeba invadens
AKPRI

SEQ ID NO: 2838885 - protein, 13 aa, Entamoeba invadens
AKPRQSTTEANVS

SEQ ID NO: 2838886 - protein, 21 aa, Entamoeba invadens
AKPRSEKSKNKSNNKKKPDHI

SEQ ID NO: 2838887 - protein, 9 aa, Entamoeba invadens
AKPSATTAR

SEQ ID NO: 2838888 - protein, 14 aa, Entamoeba invadens
AKPTQGKAGDKTIY

SEQ ID NO: 2838889 - protein, 18 aa, Entamoeba invadens
AKPVQSPTKEKEDSLDSE

SEQ ID NO: 2838890 - protein, 8 aa, Entamoeba invadens
AKPYRTRK

SEQ ID NO: 2838891 - protein, 16 aa, Entamoeba invadens
AKQEANKQKEEAEKKV

SEQ ID NO: 2838892 - protein, 7 aa, Entamoeba invadens
AKQEEIR

SEQ ID NO: 2838893 - protein, 40 aa, Entamoeba invadens
AKQEGEKKIKDITSQKNSLEEKVNTTQTDLTNERNNSKQL

SEQ ID NO: 2838894 - protein, 9 aa, Entamoeba invadens
AKQEGYRAR

SEQ ID NO: 2838895 - protein, 10 aa, Entamoeba invadens
AKQHAKTEHQ

SEQ ID NO: 2838896 - protein, 8 aa, Entamoeba invadens
AKQHEADQ

SEQ ID NO: 2838897 - protein, 10 aa, Entamoeba invadens
AKQKGMSEEC

SEQ ID NO: 2838898 - protein, 7 aa, Entamoeba invadens
AKQKKDV

SEQ ID NO: 2838899 - protein, 7 aa, Entamoeba invadens
AKQKSEE

SEQ ID NO: 2838900 - protein, 19 aa, Entamoeba invadens
AKQLEDSGLVNDSEKYYNK

SEQ ID NO: 2838901 - protein, 5 aa, Entamoeba invadens
AKQLG

SEQ ID NO: 2838902 - protein, 7 aa, Entamoeba invadens
AKQLGDD

SEQ ID NO: 2838903 - protein, 42 aa, Entamoeba invadens
AKQNNKNKQPEQPKEDVPQEPPKEEIKEEISTEKGQEEPLRK

SEQ ID NO: 2838904 - protein, 7 aa, Entamoeba invadens
AKQNYRT

SEQ ID NO: 2838905 - protein, 5 aa, Entamoeba invadens
AKQPE

SEQ ID NO: 2838906 - protein, 8 aa, Entamoeba invadens
AKQPETHL

SEQ ID NO: 2838907 - protein, 14 aa, Entamoeba invadens
AKQPLKEGEKPLQR

SEQ ID NO: 2838908 - protein, 10 aa, Entamoeba invadens
AKQPNEDAKK

SEQ ID NO: 2838909 - protein, 11 aa, Entamoeba invadens
AKQPQGLREGK

SEQ ID NO: 2838910 - protein, 14 aa, Entamoeba invadens
AKQSDTTENSHHDN

SEQ ID NO: 2838911 - protein, 5 aa, Entamoeba invadens
AKQSL

SEQ ID NO: 2838912 - protein, 28 aa, Entamoeba invadens
AKQSRPPSCPVSQNPEKKKQNVVLTKLF

SEQ ID NO: 2838913 - protein, 8 aa, Entamoeba invadens
AKQTNTVE

SEQ ID NO: 2838914 - protein, 12 aa, Entamoeba invadens
AKQYGENESSYI

SEQ ID NO: 2838915 - protein, 8 aa, Entamoeba invadens
AKRAEKSL

SEQ ID NO: 2838916 - protein, 9 aa, Entamoeba invadens
AKRAGDDLR

SEQ ID NO: 2838917 - protein, 7 aa, Entamoeba invadens
AKRDLAR

SEQ ID NO: 2838918 - protein, 6 aa, Entamoeba invadens
AKRDQS

SEQ ID NO: 2838919 - protein, 12 aa, Entamoeba invadens
AKRDVKQDEKTL

SEQ ID NO: 2838920 - protein, 9 aa, Entamoeba invadens
AKREDESDV

SEQ ID NO: 2838921 - protein, 9 aa, Entamoeba invadens
AKREDKKND

SEQ ID NO: 2838922 - protein, 16 aa, Entamoeba invadens
AKREEIKAGLKEGENL

SEQ ID NO: 2838923 - protein, 8 aa, Entamoeba invadens
AKRESQNR

SEQ ID NO: 2838924 - protein, 14 aa, Entamoeba invadens
AKREVTKVEGENLA

SEQ ID NO: 2838925 - protein, 17 aa, Entamoeba invadens
AKRGGIPKQKKIKKVEV

SEQ ID NO: 2838926 - protein, 15 aa, Entamoeba invadens
AKRGTNLEATDRAIS

SEQ ID NO: 2838927 - protein, 12 aa, Entamoeba invadens
AKRIKDYQYNRE

SEQ ID NO: 2838928 - protein, 6 aa, Entamoeba invadens
AKRITP

SEQ ID NO: 2838929 - protein, 7 aa, Entamoeba invadens
AKRKCKS

SEQ ID NO: 2838930 - protein, 9 aa, Entamoeba invadens
AKRKGEESV

SEQ ID NO: 2838931 - protein, 24 aa, Entamoeba invadens
AKRKINQSGRAAIGSPNDNNNEGC

SEQ ID NO: 2838932 - protein, 8 aa, Entamoeba invadens
AKRKSAIE

SEQ ID NO: 2838933 - protein, 9 aa, Entamoeba invadens
AKRKTEDKK

SEQ ID NO: 2838934 - protein, 8 aa, Entamoeba invadens
AKRNCRST

SEQ ID NO: 2838935 - protein, 10 aa, Entamoeba invadens
AKRNGDDKLD

SEQ ID NO: 2838936 - protein, 10 aa, Entamoeba invadens
AKRNGDDKLE

SEQ ID NO: 2838937 - protein, 7 aa, Entamoeba invadens
AKRNIQT

SEQ ID NO: 2838938 - protein, 12 aa, Entamoeba invadens
AKRNSKNRDAAQ

SEQ ID NO: 2838939 - protein, 6 aa, Entamoeba invadens
AKRPEM

SEQ ID NO: 2838940 - protein, 11 aa, Entamoeba invadens
AKRPPNKQSGL

SEQ ID NO: 2838941 - protein, 26 aa, Entamoeba invadens
AKRQAAEKTEKTDDQNSGAKNEKKKQ

SEQ ID NO: 2838942 - protein, 9 aa, Entamoeba invadens
AKRQEEVKK

SEQ ID NO: 2838943 - protein, 6 aa, Entamoeba invadens
AKRQQE

SEQ ID NO: 2838944 - protein, 22 aa, Entamoeba invadens
AKRRKKERARKVRERRQRKERM

SEQ ID NO: 2838945 - protein, 9 aa, Entamoeba invadens
AKRRPRRLS

SEQ ID NO: 2838946 - protein, 15 aa, Entamoeba invadens
AKRRQMAEKRNKALG

SEQ ID NO: 2838947 - protein, 11 aa, Entamoeba invadens
AKRSRTGRASF

SEQ ID NO: 2838948 - protein, 29 aa, Entamoeba invadens
AKRSSQQQRDRWSEYRDSRDDPKRAEKRA

SEQ ID NO: 2838949 - protein, 4 aa, Entamoeba invadens
AKRT

SEQ ID NO: 2838950 - protein, 6 aa, Entamoeba invadens
AKRTEK

SEQ ID NO: 2838951 - protein, 7 aa, Entamoeba invadens
AKRTEKV

SEQ ID NO: 2838952 - protein, 6 aa, Entamoeba invadens
AKRTEL

SEQ ID NO: 2838953 - protein, 8 aa, Entamoeba invadens
AKRTNAVK

SEQ ID NO: 2838954 - protein, 31 aa, Entamoeba invadens
AKRTTLQNNEIEMKKEDKSESKTKKECDDIS

SEQ ID NO: 2838955 - protein, 7 aa, Entamoeba invadens
AKRVGSE

SEQ ID NO: 2838956 - protein, 24 aa, Entamoeba invadens
AKRVQREKPWTVKDAQGRVDNGVK

SEQ ID NO: 2838957 - protein, 8 aa, Entamoeba invadens
AKSAKNGI

SEQ ID NO: 2838958 - protein, 23 aa, Entamoeba invadens
AKSAPPSYTKGKKRGKKEKKEVP

SEQ ID NO: 2838959 - protein, 7 aa, Entamoeba invadens
AKSDEKV

SEQ ID NO: 2838960 - protein, 17 aa, Entamoeba invadens
AKSDENLGVMYEGWCPW

SEQ ID NO: 2838961 - protein, 9 aa, Entamoeba invadens
AKSDKGGRC

SEQ ID NO: 2838962 - protein, 10 aa, Entamoeba invadens
AKSDYKQTPM

SEQ ID NO: 2838963 - protein, 7 aa, Entamoeba invadens
AKSDYQS

SEQ ID NO: 2838964 - protein, 17 aa, Entamoeba invadens
AKSEEIEKEREKKKEEF

SEQ ID NO: 2838965 - protein, 9 aa, Entamoeba invadens
AKSEHSAID

SEQ ID NO: 2838966 - protein, 14 aa, Entamoeba invadens
AKSEISTKLDPDEI

SEQ ID NO: 2838967 - protein, 7 aa, Entamoeba invadens
AKSEYER

SEQ ID NO: 2838968 - protein, 5 aa, Entamoeba invadens
AKSFD

SEQ ID NO: 2838969 - protein, 7 aa, Entamoeba invadens
AKSFEKI

SEQ ID NO: 2838970 - protein, 6 aa, Entamoeba invadens
AKSFQT

SEQ ID NO: 2838971 - protein, 4 aa, Entamoeba invadens
AKSG

SEQ ID NO: 2838972 - protein, 7 aa, Entamoeba invadens
AKSGDII

SEQ ID NO: 2838973 - protein, 6 aa, Entamoeba invadens
AKSGFG

SEQ ID NO: 2838974 - protein, 8 aa, Entamoeba invadens
AKSGNGVQ

SEQ ID NO: 2838975 - protein, 12 aa, Entamoeba invadens
AKSGQKYEGEKY

SEQ ID NO: 2838976 - protein, 6 aa, Entamoeba invadens
AKSIKE

SEQ ID NO: 2838977 - protein, 8 aa, Entamoeba invadens
AKSIPSRS

SEQ ID NO: 2838978 - protein, 9 aa, Entamoeba invadens
AKSKDSIRV

SEQ ID NO: 2838979 - protein, 12 aa, Entamoeba invadens
AKSKEQQRTNLE

SEQ ID NO: 2838980 - protein, 10 aa, Entamoeba invadens
AKSKIGPKEI

SEQ ID NO: 2838981 - protein, 11 aa, Entamoeba invadens
AKSKKPTQEGL

SEQ ID NO: 2838982 - protein, 7 aa, Entamoeba invadens
AKSKLKG

SEQ ID NO: 2838983 - protein, 8 aa, Entamoeba invadens
AKSKQGEL

SEQ ID NO: 2838984 - protein, 37 aa, Entamoeba invadens
AKSKQQLQSTKRSTPRSRTPRHSNSLERQDDSIKKLQ

SEQ ID NO: 2838985 - protein, 9 aa, Entamoeba invadens
AKSKSTKAI

SEQ ID NO: 2838986 - protein, 10 aa, Entamoeba invadens
AKSKTFSKNC

SEQ ID NO: 2838987 - protein, 6 aa, Entamoeba invadens
AKSLDG

SEQ ID NO: 2838988 - protein, 8 aa, Entamoeba invadens
AKSLKSVK

SEQ ID NO: 2838989 - protein, 7 aa, Entamoeba invadens
AKSLPRS

SEQ ID NO: 2838990 - protein, 14 aa, Entamoeba invadens
AKSLPTLPRQQEEI

SEQ ID NO: 2838991 - protein, 8 aa, Entamoeba invadens
AKSLSDGF

SEQ ID NO: 2838992 - protein, 4 aa, Entamoeba invadens
AKSN

SEQ ID NO: 2838993 - protein, 7 aa, Entamoeba invadens
AKSNYNF

SEQ ID NO: 2838994 - protein, 11 aa, Entamoeba invadens
AKSPKTTNYSV

SEQ ID NO: 2838995 - protein, 5 aa, Entamoeba invadens
AKSPL

SEQ ID NO: 2838996 - protein, 5 aa, Entamoeba invadens
AKSPQ

SEQ ID NO: 2838997 - protein, 8 aa, Entamoeba invadens
AKSPRKPK

SEQ ID NO: 2838998 - protein, 11 aa, Entamoeba invadens
AKSPSRANAQA

SEQ ID NO: 2838999 - protein, 7 aa, Entamoeba invadens
AKSQDVH

SEQ ID NO: 2839000 - protein, 8 aa, Entamoeba invadens
AKSQGVAV

SEQ ID NO: 2839001 - protein, 8 aa, Entamoeba invadens
AKSQNATD

SEQ ID NO: 2839002 - protein, 7 aa, Entamoeba invadens
AKSQNDL

SEQ ID NO: 2839003 - protein, 9 aa, Entamoeba invadens
AKSQPQLVE

SEQ ID NO: 2839004 - protein, 8 aa, Entamoeba invadens
AKSQSDLK

SEQ ID NO: 2839005 - protein, 16 aa, Entamoeba invadens
AKSQTFNDLVHDYMHY

SEQ ID NO: 2839006 - protein, 16 aa, Entamoeba invadens
AKSQTFNDLVHDYVHY

SEQ ID NO: 2839007 - protein, 16 aa, Entamoeba invadens
AKSRGHQQVGTLGSGN

SEQ ID NO: 2839008 - protein, 5 aa, Entamoeba invadens
AKSRH

SEQ ID NO: 2839009 - protein, 14 aa, Entamoeba invadens
AKSRSLLQEKGDNL

SEQ ID NO: 2839010 - protein, 10 aa, Entamoeba invadens
AKSRSPMSSP

SEQ ID NO: 2839011 - protein, 4 aa, Entamoeba invadens
AKSS

SEQ ID NO: 2839012 - protein, 8 aa, Entamoeba invadens
AKSSERPT

SEQ ID NO: 2839013 - protein, 6 aa, Entamoeba invadens
AKSSGF

SEQ ID NO: 2839014 - protein, 8 aa, Entamoeba invadens
AKSSGKST

SEQ ID NO: 2839015 - protein, 12 aa, Entamoeba invadens
AKSSKLKSIYGA

SEQ ID NO: 2839016 - protein, 7 aa, Entamoeba invadens
AKSSKPH

SEQ ID NO: 2839017 - protein, 11 aa, Entamoeba invadens
AKSSTKTTNTF

SEQ ID NO: 2839018 - protein, 7 aa, Entamoeba invadens
AKSTKAP

SEQ ID NO: 2839019 - protein, 11 aa, Entamoeba invadens
AKSTKSEVKQP

SEQ ID NO: 2839020 - protein, 31 aa, Entamoeba invadens
AKSTLTTQKLENEKEKITEELDSTKEENKKI

SEQ ID NO: 2839021 - protein, 8 aa, Entamoeba invadens
AKSTQEPS

SEQ ID NO: 2839022 - protein, 29 aa, Entamoeba invadens
AKSTQIPKPLEKNETTQKVPKAPEPKDEQ

SEQ ID NO: 2839023 - protein, 18 aa, Entamoeba invadens
AKSTYDAKGGLEKWHKII

SEQ ID NO: 2839024 - protein, 4 aa, Entamoeba invadens
AKSY

SEQ ID NO: 2839025 - protein, 4 aa, Entamoeba invadens
AKTA

SEQ ID NO: 2839026 - protein, 19 aa, Entamoeba invadens
AKTCKTGKVNKDTKKCEEC

SEQ ID NO: 2839027 - protein, 8 aa, Entamoeba invadens
AKTDETKA

SEQ ID NO: 2839028 - protein, 8 aa, Entamoeba invadens
AKTEDGLK

SEQ ID NO: 2839029 - protein, 7 aa, Entamoeba invadens
AKTEDKC

SEQ ID NO: 2839030 - protein, 7 aa, Entamoeba invadens
AKTENEI

SEQ ID NO: 2839031 - protein, 14 aa, Entamoeba invadens
AKTETDEAKKNTNG

SEQ ID NO: 2839032 - protein, 13 aa, Entamoeba invadens
AKTFEKKKKGDLV

SEQ ID NO: 2839033 - protein, 7 aa, Entamoeba invadens
AKTGDNI

SEQ ID NO: 2839034 - protein, 7 aa, Entamoeba invadens
AKTGENV

SEQ ID NO: 2839035 - protein, 8 aa, Entamoeba invadens
AKTGERVD

SEQ ID NO: 2839036 - protein, 5 aa, Entamoeba invadens
AKTGF

SEQ ID NO: 2839037 - protein, 7 aa, Entamoeba invadens
AKTGKGV

SEQ ID NO: 2839038 - protein, 8 aa, Entamoeba invadens
AKTGKNIP

SEQ ID NO: 2839039 - protein, 9 aa, Entamoeba invadens
AKTGKSKVS

SEQ ID NO: 2839040 - protein, 6 aa, Entamoeba invadens
AKTHSK

SEQ ID NO: 2839041 - protein, 7 aa, Entamoeba invadens
AKTIASG

SEQ ID NO: 2839042 - protein, 8 aa, Entamoeba invadens
AKTIRGAT

SEQ ID NO: 2839043 - protein, 22 aa, Entamoeba invadens
AKTKEENENITQKLQTTTNEKI

SEQ ID NO: 2839044 - protein, 7 aa, Entamoeba invadens
AKTKEGC

SEQ ID NO: 2839045 - protein, 7 aa, Entamoeba invadens
AKTKEKI

SEQ ID NO: 2839046 - protein, 7 aa, Entamoeba invadens
AKTKENA

SEQ ID NO: 2839047 - protein, 12 aa, Entamoeba invadens
AKTKERDGLNGF

SEQ ID NO: 2839048 - protein, 7 aa, Entamoeba invadens
AKTKGVS

SEQ ID NO: 2839049 - protein, 11 aa, Entamoeba invadens
AKTKLNAYNKY

SEQ ID NO: 2839050 - protein, 8 aa, Entamoeba invadens
AKTKTPEM

SEQ ID NO: 2839051 - protein, 6 aa, Entamoeba invadens
AKTKYN

SEQ ID NO: 2839052 - protein, 8 aa, Entamoeba invadens
AKTLAEQS

SEQ ID NO: 2839053 - protein, 12 aa, Entamoeba invadens
AKTLRNNNSSRF

SEQ ID NO: 2839054 - protein, 20 aa, Entamoeba invadens
AKTLSTSDYSNLTSETTRKY

SEQ ID NO: 2839055 - protein, 4 aa, Entamoeba invadens
AKTM

SEQ ID NO: 2839056 - protein, 4 aa, Entamoeba invadens
AKTN

SEQ ID NO: 2839057 - protein, 25 aa, Entamoeba invadens
AKTNELQKENEKEKTKQPENPTKEQ

SEQ ID NO: 2839058 - protein, 7 aa, Entamoeba invadens
AKTNFNT

SEQ ID NO: 2839059 - protein, 11 aa, Entamoeba invadens
AKTNKTEQIQE

SEQ ID NO: 2839060 - protein, 8 aa, Entamoeba invadens
AKTPAMDK

SEQ ID NO: 2839061 - protein, 6 aa, Entamoeba invadens
AKTPER

SEQ ID NO: 2839062 - protein, 6 aa, Entamoeba invadens
AKTPKS

SEQ ID NO: 2839063 - protein, 8 aa, Entamoeba invadens
AKTPPMET

SEQ ID NO: 2839064 - protein, 7 aa, Entamoeba invadens
AKTPQEV

SEQ ID NO: 2839065 - protein, 5 aa, Entamoeba invadens
AKTPT

SEQ ID NO: 2839066 - protein, 13 aa, Entamoeba invadens
AKTPTKPRETFTR

SEQ ID NO: 2839067 - protein, 4 aa, Entamoeba invadens
AKTQ

SEQ ID NO: 2839068 - protein, 7 aa, Entamoeba invadens
AKTQNYQ

SEQ ID NO: 2839069 - protein, 12 aa, Entamoeba invadens
AKTQSQTRFNQT

SEQ ID NO: 2839070 - protein, 8 aa, Entamoeba invadens
AKTREGIS

SEQ ID NO: 2839071 - protein, 8 aa, Entamoeba invadens
AKTSDIPS

SEQ ID NO: 2839072 - protein, 8 aa, Entamoeba invadens
AKTSKFNV

SEQ ID NO: 2839073 - protein, 8 aa, Entamoeba invadens
AKTSKNID

SEQ ID NO: 2839074 - protein, 8 aa, Entamoeba invadens
AKTSSVYE

SEQ ID NO: 2839075 - protein, 8 aa, Entamoeba invadens
AKTSTHID

SEQ ID NO: 2839076 - protein, 8 aa, Entamoeba invadens
AKTTCSDP

SEQ ID NO: 2839077 - protein, 6 aa, Entamoeba invadens
AKTTKI

SEQ ID NO: 2839078 - protein, 5 aa, Entamoeba invadens
AKTVE

SEQ ID NO: 2839079 - protein, 6 aa, Entamoeba invadens
AKTVHP

SEQ ID NO: 2839080 - protein, 7 aa, Entamoeba invadens
AKTVTQG

SEQ ID NO: 2839081 - protein, 14 aa, Entamoeba invadens
AKTYLGQETLNTDN

SEQ ID NO: 2839082 - protein, 6 aa, Entamoeba invadens
AKTYSN

SEQ ID NO: 2839083 - protein, 10 aa, Entamoeba invadens
AKVAQPAVST

SEQ ID NO: 2839084 - protein, 8 aa, Entamoeba invadens
AKVDPQPE

SEQ ID NO: 2839085 - protein, 6 aa, Entamoeba invadens
AKVGNE

SEQ ID NO: 2839086 - protein, 39 aa, Entamoeba invadens
AKVQADGYADVDDEDIADIKKRKKTTKEIDEEEGDQRVQ

SEQ ID NO: 2839087 - protein, 12 aa, Entamoeba invadens
AKVQKEENQKLK

SEQ ID NO: 2839088 - protein, 6 aa, Entamoeba invadens
AKVRSG

SEQ ID NO: 2839089 - protein, 8 aa, Entamoeba invadens
AKVSELNK

SEQ ID NO: 2839090 - protein, 5 aa, Entamoeba invadens
AKVSG

SEQ ID NO: 2839091 - protein, 12 aa, Entamoeba invadens
AKVSSSTIRNSE

SEQ ID NO: 2839092 - protein, 10 aa, Entamoeba invadens
AKVTDSEAKL

SEQ ID NO: 2839093 - protein, 21 aa, Entamoeba invadens
AKVTDSEAKLADAGATGASIA

SEQ ID NO: 2839094 - protein, 20 aa, Entamoeba invadens
AKVTDSEAKLADASATGASF

SEQ ID NO: 2839095 - protein, 21 aa, Entamoeba invadens
AKVTDSEAKLAETAATGASIA

SEQ ID NO: 2839096 - protein, 21 aa, Entamoeba invadens
AKVTNSEAKLADAGATGASIA

SEQ ID NO: 2839097 - protein, 4 aa, Entamoeba invadens
AKVV

SEQ ID NO: 2839098 - protein, 11 aa, Entamoeba invadens
AKWAEKSTDVD

SEQ ID NO: 2839099 - protein, 6 aa, Entamoeba invadens
AKYAKK

SEQ ID NO: 2839100 - protein, 14 aa, Entamoeba invadens
AKYAKVPKNLRPIS

SEQ ID NO: 2839101 - protein, 6 aa, Entamoeba invadens
AKYDET

SEQ ID NO: 2839102 - protein, 7 aa, Entamoeba invadens
AKYEDNV

SEQ ID NO: 2839103 - protein, 6 aa, Entamoeba invadens
AKYETE

SEQ ID NO: 2839104 - protein, 7 aa, Entamoeba invadens
AKYETEF

SEQ ID NO: 2839105 - protein, 41 aa, Entamoeba invadens
AKYETELEGIETEKEEAQNAAAKAKKQAKQYAKKVEEAERK

SEQ ID NO: 2839106 - protein, 41 aa, Entamoeba invadens
AKYETELEGIETEKEEAQNAAAKAKKQAKQYARKVEEAERK

SEQ ID NO: 2839107 - protein, 42 aa, Entamoeba invadens
AKYETELEGIETEKEEAQNAAAKAKKQAKQYARKVEEAERKL

SEQ ID NO: 2839108 - protein, 41 aa, Entamoeba invadens
AKYETELEGIETEKEEAQNAAAKAKKQVKQYARKVEEAERK

SEQ ID NO: 2839109 - protein, 41 aa, Entamoeba invadens
AKYETELEGIETEKEEAQNAADKAKKQAKQYARNVEEAERK

SEQ ID NO: 2839110 - protein, 41 aa, Entamoeba invadens
AKYETELEGIETEKKEAHNAAVKAKKQAKQYARKVEEAERK

SEQ ID NO: 2839111 - protein, 41 aa, Entamoeba invadens
AKYETELEGIETEKVEAQNLATEPKKQAKQYARKVEEAERK

SEQ ID NO: 2839112 - protein, 6 aa, Entamoeba invadens
AKYKNY

SEQ ID NO: 2839113 - protein, 74 aa, Entamoeba invadens
AKYNQELESVEQEKEEAQNAAAKAKKQAKQYARKVEEAERKLAEYEQKESTFNTQIGKTQADLKKTQQSVRDSE

SEQ ID NO: 2839114 - protein, 7 aa, Entamoeba invadens
AKYSPSG

SEQ ID NO: 2839115 - protein, 4 aa, Entamoeba invadens
AKYT

SEQ ID NO: 2839116 - protein, 11 aa, Entamoeba invadens
AKYTENAVENA

SEQ ID NO: 2839117 - protein, 8 aa, Entamoeba invadens
AKYTYDDQ

SEQ ID NO: 2839118 - protein, 8 aa, Entamoeba invadens
ALANKGGV

SEQ ID NO: 2839119 - protein, 5 aa, Entamoeba invadens
ALASK

SEQ ID NO: 2839120 - protein, 5 aa, Entamoeba invadens
ALATE

SEQ ID NO: 2839121 - protein, 12 aa, Entamoeba invadens
ALAVSKNANIEE

SEQ ID NO: 2839122 - protein, 4 aa, Entamoeba invadens
ALDD

SEQ ID NO: 2839123 - protein, 8 aa, Entamoeba invadens
ALDDEHQN

SEQ ID NO: 2839124 - protein, 13 aa, Entamoeba invadens
ALDDKAEAEKTAA

SEQ ID NO: 2839125 - protein, 25 aa, Entamoeba invadens
ALDDKTDDEKTAADQFNRRKNVEDQ

SEQ ID NO: 2839126 - protein, 26 aa, Entamoeba invadens
ALDDKTEAEKTAADQSDKRKKMEDQV

SEQ ID NO: 2839127 - protein, 35 aa, Entamoeba invadens
ALDDKTEDEKTAADQSDRRKKMEDQVKAFNAQVLS

SEQ ID NO: 2839128 - protein, 9 aa, Entamoeba invadens
ALDDTEKKL

SEQ ID NO: 2839129 - protein, 13 aa, Entamoeba invadens
ALDEEKQNGKDVS

SEQ ID NO: 2839130 - protein, 30 aa, Entamoeba invadens
ALDNKTDDEKIAADQSDRRKKMEDQVKALN

SEQ ID NO: 2839131 - protein, 79 aa, Entamoeba invadens
ALDNTEKKLDQQVAQNKKVSDERDGYNQQLQAAKTKTAALTSAKNASDKKISTLNSEKDELEDKNRKLDSSNKDAQRKL

SEQ ID NO: 2839132 - protein, 79 aa, Entamoeba invadens
ALDNTEKKLDQQVAQNKKVSDERDGYNQQLQAGKTKTAALTSAKNASDKKISALNSEKDELEDKNRKLDSSNKDAQRKI

SEQ ID NO: 2839133 - protein, 5 aa, Entamoeba invadens
ALDTR

SEQ ID NO: 2839134 - protein, 5 aa, Entamoeba invadens
ALDVN

SEQ ID NO: 2839135 - protein, 4 aa, Entamoeba invadens
ALDY

SEQ ID NO: 2839136 - protein, 12 aa, Entamoeba invadens
ALEASKQKAEVA

SEQ ID NO: 2839137 - protein, 47 aa, Entamoeba invadens
ALEDKADKSEDEDDSYQRMKDQYDDLKKKTDETIKQLNQQNDELKRK

SEQ ID NO: 2839138 - protein, 8 aa, Entamoeba invadens
ALEDSKKD

SEQ ID NO: 2839139 - protein, 4 aa, Entamoeba invadens
ALEE

SEQ ID NO: 2839140 - protein, 6 aa, Entamoeba invadens
ALEEKT

SEQ ID NO: 2839141 - protein, 22 aa, Entamoeba invadens
ALEKENAELNQDLDDEEEELNA

SEQ ID NO: 2839142 - protein, 9 aa, Entamoeba invadens
ALENGAGDL

SEQ ID NO: 2839143 - protein, 5 aa, Entamoeba invadens
ALERN

SEQ ID NO: 2839144 - protein, 7 aa, Entamoeba invadens
ALERTGL

SEQ ID NO: 2839145 - protein, 4 aa, Entamoeba invadens
ALES

SEQ ID NO: 2839146 - protein, 5 aa, Entamoeba invadens
ALESE

SEQ ID NO: 2839147 - protein, 4 aa, Entamoeba invadens
ALET

SEQ ID NO: 2839148 - protein, 10 aa, Entamoeba invadens
ALGATGRGIT

SEQ ID NO: 2839149 - protein, 5 aa, Entamoeba invadens
ALGES

SEQ ID NO: 2839150 - protein, 10 aa, Entamoeba invadens
ALGKEDALKT

SEQ ID NO: 2839151 - protein, 9 aa, Entamoeba invadens
ALGKKISKN

SEQ ID NO: 2839152 - protein, 6 aa, Entamoeba invadens
ALGNGA

SEQ ID NO: 2839153 - protein, 18 aa, Entamoeba invadens
ALGNGTQQANTNNTFSGL

SEQ ID NO: 2839154 - protein, 8 aa, Entamoeba invadens
ALGPNPLS

SEQ ID NO: 2839155 - protein, 9 aa, Entamoeba invadens
ALGPNTLER

SEQ ID NO: 2839156 - protein, 5 aa, Entamoeba invadens
ALGQF

SEQ ID NO: 2839157 - protein, 9 aa, Entamoeba invadens
ALGQQQNSM

SEQ ID NO: 2839158 - protein, 11 aa, Entamoeba invadens
ALGSPYSASKH

SEQ ID NO: 2839159 - protein, 12 aa, Entamoeba invadens
ALHPPLSSTPSL

SEQ ID NO: 2839160 - protein, 6 aa, Entamoeba invadens
ALKDDQ

SEQ ID NO: 2839161 - protein, 6 aa, Entamoeba invadens
ALKDEE

SEQ ID NO: 2839162 - protein, 9 aa, Entamoeba invadens
ALKDQNTQL

SEQ ID NO: 2839163 - protein, 10 aa, Entamoeba invadens
ALKDQNTQLD

SEQ ID NO: 2839164 - protein, 17 aa, Entamoeba invadens
ALKDQNTQLDAAKKDIK

SEQ ID NO: 2839165 - protein, 33 aa, Entamoeba invadens
ALKDQNTQLDAAKKDIKKQAVEDASKIGDYESQ

SEQ ID NO: 2839166 - protein, 20 aa, Entamoeba invadens
ALKDQNTQLDAAKKDIKKQL

SEQ ID NO: 2839167 - protein, 23 aa, Entamoeba invadens
ALKDQNTQLDAAKKDMKKQSVED

SEQ ID NO: 2839168 - protein, 33 aa, Entamoeba invadens
ALKDQNTQLDAAKKDMKKQSVEDASKIENYEPQ

SEQ ID NO: 2839169 - protein, 32 aa, Entamoeba invadens
ALKDQNTQLDAAKKDMKKQSVEDASKIENYES

SEQ ID NO: 2839170 - protein, 32 aa, Entamoeba invadens
ALKDQNTQLDAAKNYMKKQSVEDASKIENYES

SEQ ID NO: 2839171 - protein, 5 aa, Entamoeba invadens
ALKEE

SEQ ID NO: 2839172 - protein, 9 aa, Entamoeba invadens
ALKEGEKLL

SEQ ID NO: 2839173 - protein, 14 aa, Entamoeba invadens
ALKEKTEKEYESKK

SEQ ID NO: 2839174 - protein, 7 aa, Entamoeba invadens
ALKEQEE

SEQ ID NO: 2839175 - protein, 10 aa, Entamoeba invadens
ALKETKGDVE

SEQ ID NO: 2839176 - protein, 13 aa, Entamoeba invadens
ALKGEKENVTNEL

SEQ ID NO: 2839177 - protein, 9 aa, Entamoeba invadens
ALKKTPHKE

SEQ ID NO: 2839178 - protein, 5 aa, Entamoeba invadens
ALKKV

SEQ ID NO: 2839179 - protein, 7 aa, Entamoeba invadens
ALKNKED

SEQ ID NO: 2839180 - protein, 8 aa, Entamoeba invadens
ALKNTNDD

SEQ ID NO: 2839181 - protein, 10 aa, Entamoeba invadens
ALKQASSIKD

SEQ ID NO: 2839182 - protein, 13 aa, Entamoeba invadens
ALKQEKQNTANVD

SEQ ID NO: 2839183 - protein, 6 aa, Entamoeba invadens
ALKRGS

SEQ ID NO: 2839184 - protein, 6 aa, Entamoeba invadens
ALKRPN

SEQ ID NO: 2839185 - protein, 7 aa, Entamoeba invadens
ALKSHPT

SEQ ID NO: 2839186 - protein, 6 aa, Entamoeba invadens
ALKSKS

SEQ ID NO: 2839187 - protein, 26 aa, Entamoeba invadens
ALKTGATTTDAKVENKVDEIKPSEKV

SEQ ID NO: 2839188 - protein, 21 aa, Entamoeba invadens
ALKTNKEYQNMSGKESGEIED

SEQ ID NO: 2839189 - protein, 12 aa, Entamoeba invadens
ALKTSKKIPALP

SEQ ID NO: 2839190 - protein, 12 aa, Entamoeba invadens
ALKTSKKIPPLP

SEQ ID NO: 2839191 - protein, 7 aa, Entamoeba invadens
ALNASNV

SEQ ID NO: 2839192 - protein, 12 aa, Entamoeba invadens
ALNEENDNLKEQ

SEQ ID NO: 2839193 - protein, 16 aa, Entamoeba invadens
ALNEENKKLKEEISDL

SEQ ID NO: 2839194 - protein, 5 aa, Entamoeba invadens
ALNER

SEQ ID NO: 2839195 - protein, 5 aa, Entamoeba invadens
ALNGE

SEQ ID NO: 2839196 - protein, 5 aa, Entamoeba invadens
ALNGN

SEQ ID NO: 2839197 - protein, 9 aa, Entamoeba invadens
ALNKFNSKY

SEQ ID NO: 2839198 - protein, 9 aa, Entamoeba invadens
ALNNGSNKE

SEQ ID NO: 2839199 - protein, 12 aa, Entamoeba invadens
ALNNSAAKKYDL

SEQ ID NO: 2839200 - protein, 5 aa, Entamoeba invadens
ALNRT

SEQ ID NO: 2839201 - protein, 8 aa, Entamoeba invadens
ALNSTSLA

SEQ ID NO: 2839202 - protein, 5 aa, Entamoeba invadens
ALNTN

SEQ ID NO: 2839203 - protein, 16 aa, Entamoeba invadens
ALPEKSERSPRAKEVT

SEQ ID NO: 2839204 - protein, 7 aa, Entamoeba invadens
ALPEPDE

SEQ ID NO: 2839205 - protein, 7 aa, Entamoeba invadens
ALPETNK

SEQ ID NO: 2839206 - protein, 19 aa, Entamoeba invadens
ALPGGVEKAELNHSTTSAS

SEQ ID NO: 2839207 - protein, 5 aa, Entamoeba invadens
ALPGL

SEQ ID NO: 2839208 - protein, 5 aa, Entamoeba invadens
ALPKD

SEQ ID NO: 2839209 - protein, 8 aa, Entamoeba invadens
ALPKENAF

SEQ ID NO: 2839210 - protein, 15 aa, Entamoeba invadens
ALPKGALVEVECTAA

SEQ ID NO: 2839211 - protein, 9 aa, Entamoeba invadens
ALPKNTEIP

SEQ ID NO: 2839212 - protein, 5 aa, Entamoeba invadens
ALPKQ

SEQ ID NO: 2839213 - protein, 6 aa, Entamoeba invadens
ALPKSV

SEQ ID NO: 2839214 - protein, 5 aa, Entamoeba invadens
ALPND

SEQ ID NO: 2839215 - protein, 6 aa, Entamoeba invadens
ALPNEG

SEQ ID NO: 2839216 - protein, 5 aa, Entamoeba invadens
ALPPD

SEQ ID NO: 2839217 - protein, 18 aa, Entamoeba invadens
ALPPLSSCPPPPPAAPGC

SEQ ID NO: 2839218 - protein, 8 aa, Entamoeba invadens
ALPPSTQN

SEQ ID NO: 2839219 - protein, 8 aa, Entamoeba invadens
ALPPTDET

SEQ ID NO: 2839220 - protein, 14 aa, Entamoeba invadens
ALPRKPKNSVNEET

SEQ ID NO: 2839221 - protein, 4 aa, Entamoeba invadens
ALPT

SEQ ID NO: 2839222 - protein, 10 aa, Entamoeba invadens
ALPTNGNPTF

SEQ ID NO: 2839223 - protein, 5 aa, Entamoeba invadens
ALPTT

SEQ ID NO: 2839224 - protein, 15 aa, Entamoeba invadens
ALPYKTNKNIYSSGQ

SEQ ID NO: 2839225 - protein, 6 aa, Entamoeba invadens
ALQARQ

SEQ ID NO: 2839226 - protein, 7 aa, Entamoeba invadens
ALQDGRD

SEQ ID NO: 2839227 - protein, 11 aa, Entamoeba invadens
ALQDSTHGQQL

SEQ ID NO: 2839228 - protein, 7 aa, Entamoeba invadens
ALQEASE

SEQ ID NO: 2839229 - protein, 4 aa, Entamoeba invadens
ALQG

SEQ ID NO: 2839230 - protein, 9 aa, Entamoeba invadens
ALQKAKEAG

SEQ ID NO: 2839231 - protein, 14 aa, Entamoeba invadens
ALQKEAKENNEHFD

SEQ ID NO: 2839232 - protein, 13 aa, Entamoeba invadens
ALQKGKKIKENKV

SEQ ID NO: 2839233 - protein, 5 aa, Entamoeba invadens
ALQNG

SEQ ID NO: 2839234 - protein, 18 aa, Entamoeba invadens
ALQPSRTSLPTQKEQKYS

SEQ ID NO: 2839235 - protein, 9 aa, Entamoeba invadens
ALQSTDNKD

SEQ ID NO: 2839236 - protein, 11 aa, Entamoeba invadens
ALQTDDVENAN

SEQ ID NO: 2839237 - protein, 14 aa, Entamoeba invadens
ALQTSNNELITNGA

SEQ ID NO: 2839238 - protein, 10 aa, Entamoeba invadens
ALRDKTVGDF

SEQ ID NO: 2839239 - protein, 7 aa, Entamoeba invadens
ALRDNSM

SEQ ID NO: 2839240 - protein, 6 aa, Entamoeba invadens
ALREGG

SEQ ID NO: 2839241 - protein, 13 aa, Entamoeba invadens
ALRGKSPSDLNGV

SEQ ID NO: 2839242 - protein, 13 aa, Entamoeba invadens
ALRGKTPSDLNGV

SEQ ID NO: 2839243 - protein, 8 aa, Entamoeba invadens
ALRKRDES

SEQ ID NO: 2839244 - protein, 17 aa, Entamoeba invadens
ALRKSESLYEKEKLQGR

SEQ ID NO: 2839245 - protein, 10 aa, Entamoeba invadens
ALRNANTEFD

SEQ ID NO: 2839246 - protein, 6 aa, Entamoeba invadens
ALRNPQ

SEQ ID NO: 2839247 - protein, 5 aa, Entamoeba invadens
ALRNV

SEQ ID NO: 2839248 - protein, 17 aa, Entamoeba invadens
ALRQEKKDKKEKKLTRK

SEQ ID NO: 2839249 - protein, 4 aa, Entamoeba invadens
ALRS

SEQ ID NO: 2839250 - protein, 4 aa, Entamoeba invadens
ALSA

SEQ ID NO: 2839251 - protein, 8 aa, Entamoeba invadens
ALSADEDA

SEQ ID NO: 2839252 - protein, 26 aa, Entamoeba invadens
ALSAKTRKTQVMTNNTAQRNQIEEER

SEQ ID NO: 2839253 - protein, 26 aa, Entamoeba invadens
ALSAKTSKTQLMSNNTAQRNQIKAER

SEQ ID NO: 2839254 - protein, 5 aa, Entamoeba invadens
ALSDL

SEQ ID NO: 2839255 - protein, 11 aa, Entamoeba invadens
ALSDTQNQEIT

SEQ ID NO: 2839256 - protein, 6 aa, Entamoeba invadens
ALSETY

SEQ ID NO: 2839257 - protein, 4 aa, Entamoeba invadens
ALSG

SEQ ID NO: 2839258 - protein, 7 aa, Entamoeba invadens
ALSGDGI

SEQ ID NO: 2839259 - protein, 6 aa, Entamoeba invadens
ALSKNE

SEQ ID NO: 2839260 - protein, 15 aa, Entamoeba invadens
ALSKRNKKVSELENE

SEQ ID NO: 2839261 - protein, 7 aa, Entamoeba invadens
ALSKSTN

SEQ ID NO: 2839262 - protein, 8 aa, Entamoeba invadens
ALSKTERV

SEQ ID NO: 2839263 - protein, 10 aa, Entamoeba invadens
ALSNASHVDQ

SEQ ID NO: 2839264 - protein, 11 aa, Entamoeba invadens
ALSNPESPVEP

SEQ ID NO: 2839265 - protein, 7 aa, Entamoeba invadens
ALSNQKF

SEQ ID NO: 2839266 - protein, 7 aa, Entamoeba invadens
ALSNQKY

SEQ ID NO: 2839267 - protein, 7 aa, Entamoeba invadens
ALSNSSK

SEQ ID NO: 2839268 - protein, 7 aa, Entamoeba invadens
ALSPHIS

SEQ ID NO: 2839269 - protein, 8 aa, Entamoeba invadens
ALSPQNSR

SEQ ID NO: 2839270 - protein, 14 aa, Entamoeba invadens
ALSREKSEASLDTV

SEQ ID NO: 2839271 - protein, 8 aa, Entamoeba invadens
ALSRESTE

SEQ ID NO: 2839272 - protein, 19 aa, Entamoeba invadens
ALSRNSGKATVTQKEIETA

SEQ ID NO: 2839273 - protein, 9 aa, Entamoeba invadens
ALSSDREPV

SEQ ID NO: 2839274 - protein, 6 aa, Entamoeba invadens
ALSSSN

SEQ ID NO: 2839275 - protein, 7 aa, Entamoeba invadens
ALSSSTM

SEQ ID NO: 2839276 - protein, 6 aa, Entamoeba invadens
ALSSYE

SEQ ID NO: 2839277 - protein, 7 aa, Entamoeba invadens
ALSTGVS

SEQ ID NO: 2839278 - protein, 19 aa, Entamoeba invadens
ALSTQKSIKQKSTQKTATE

SEQ ID NO: 2839279 - protein, 6 aa, Entamoeba invadens
ALSYEK

SEQ ID NO: 2839280 - protein, 30 aa, Entamoeba invadens
ALSYSGSVVPPNKALPQRPAPPKKSAEHQL

SEQ ID NO: 2839281 - protein, 11 aa, Entamoeba invadens
ALTDYDHSTEL

SEQ ID NO: 2839282 - protein, 11 aa, Entamoeba invadens
ALTEASFPPAV

SEQ ID NO: 2839283 - protein, 6 aa, Entamoeba invadens
ALTEEQ

SEQ ID NO: 2839284 - protein, 8 aa, Entamoeba invadens
ALTGNNVE

SEQ ID NO: 2839285 - protein, 20 aa, Entamoeba invadens
ALTGTTKSKLKRISVYKLVD

SEQ ID NO: 2839286 - protein, 8 aa, Entamoeba invadens
ALTGVGGN

SEQ ID NO: 2839287 - protein, 11 aa, Entamoeba invadens
ALTKDDVSVNP

SEQ ID NO: 2839288 - protein, 6 aa, Entamoeba invadens
ALTKPV

SEQ ID NO: 2839289 - protein, 10 aa, Entamoeba invadens
ALTKSNKSSD

SEQ ID NO: 2839290 - protein, 6 aa, Entamoeba invadens
ALTNES

SEQ ID NO: 2839291 - protein, 42 aa, Entamoeba invadens
ALTNSSPKRVPKKAPKRSPKKKALPKKRKLPAPKKPVQKRKK

SEQ ID NO: 2839292 - protein, 16 aa, Entamoeba invadens
ALTPKKSSKKTPEPPA

SEQ ID NO: 2839293 - protein, 6 aa, Entamoeba invadens
ALTPMR

SEQ ID NO: 2839294 - protein, 6 aa, Entamoeba invadens
ALTQGI

SEQ ID NO: 2839295 - protein, 9 aa, Entamoeba invadens
ALTRPPRVK

SEQ ID NO: 2839296 - protein, 4 aa, Entamoeba invadens
ALTS

SEQ ID NO: 2839297 - protein, 18 aa, Entamoeba invadens
ALTSPSTPTHNDYHDNSK

SEQ ID NO: 2839298 - protein, 10 aa, Entamoeba invadens
ALTSTPDKSL

SEQ ID NO: 2839299 - protein, 14 aa, Entamoeba invadens
ALTVEDTKKCVKDK

SEQ ID NO: 2839300 - protein, 4 aa, Entamoeba invadens
ALVP

SEQ ID NO: 2839301 - protein, 7 aa, Entamoeba invadens
ALVTTPK

SEQ ID NO: 2839302 - protein, 12 aa, Entamoeba invadens
AMAEPSKRRSLR

SEQ ID NO: 2839303 - protein, 18 aa, Entamoeba invadens
AMAGQKSKKSLKKEPTEV

SEQ ID NO: 2839304 - protein, 8 aa, Entamoeba invadens
AMAKGKKM

SEQ ID NO: 2839305 - protein, 5 aa, Entamoeba invadens
AMDND

SEQ ID NO: 2839306 - protein, 12 aa, Entamoeba invadens
AMDPPSRPLDHT

SEQ ID NO: 2839307 - protein, 11 aa, Entamoeba invadens
AMEEDDCAPIT

SEQ ID NO: 2839308 - protein, 8 aa, Entamoeba invadens
AMEEEPTI

SEQ ID NO: 2839309 - protein, 17 aa, Entamoeba invadens
AMEEKENETETSEDDDS

SEQ ID NO: 2839310 - protein, 10 aa, Entamoeba invadens
AMENKNKEVP

SEQ ID NO: 2839311 - protein, 8 aa, Entamoeba invadens
AMKADNED

SEQ ID NO: 2839312 - protein, 9 aa, Entamoeba invadens
AMKESGKTI

SEQ ID NO: 2839313 - protein, 11 aa, Entamoeba invadens
AMKETQQSNES

SEQ ID NO: 2839314 - protein, 8 aa, Entamoeba invadens
AMKREGVS

SEQ ID NO: 2839315 - protein, 7 aa, Entamoeba invadens
AMNEVSK

SEQ ID NO: 2839316 - protein, 8 aa, Entamoeba invadens
AMNKKDLD

SEQ ID NO: 2839317 - protein, 11 aa, Entamoeba invadens
AMNNAKPETLS

SEQ ID NO: 2839318 - protein, 14 aa, Entamoeba invadens
AMNRTELSDYRKQL

SEQ ID NO: 2839319 - protein, 5 aa, Entamoeba invadens
AMNSG

SEQ ID NO: 2839320 - protein, 14 aa, Entamoeba invadens
AMNSSTFNKKLSGK

SEQ ID NO: 2839321 - protein, 10 aa, Entamoeba invadens
AMPDNSDKTL

SEQ ID NO: 2839322 - protein, 6 aa, Entamoeba invadens
AMPPDW

SEQ ID NO: 2839323 - protein, 8 aa, Entamoeba invadens
AMPPSTAI

SEQ ID NO: 2839324 - protein, 21 aa, Entamoeba invadens
AMPSPGVSSKGDASSNTGEAF

SEQ ID NO: 2839325 - protein, 7 aa, Entamoeba invadens
AMPSSTP

SEQ ID NO: 2839326 - protein, 10 aa, Entamoeba invadens
AMQDQTTKVN

SEQ ID NO: 2839327 - protein, 13 aa, Entamoeba invadens
AMQNEKPKDLDMG

SEQ ID NO: 2839328 - protein, 5 aa, Entamoeba invadens
AMQTN

SEQ ID NO: 2839329 - protein, 14 aa, Entamoeba invadens
AMRDDPNTPAVPPQ

SEQ ID NO: 2839330 - protein, 11 aa, Entamoeba invadens
AMRGGATGVST

SEQ ID NO: 2839331 - protein, 5 aa, Entamoeba invadens
AMRSD

SEQ ID NO: 2839332 - protein, 7 aa, Entamoeba invadens
AMRTDPR

SEQ ID NO: 2839333 - protein, 9 aa, Entamoeba invadens
AMSDSPIKP

SEQ ID NO: 2839334 - protein, 8 aa, Entamoeba invadens
AMSGQSGL

SEQ ID NO: 2839335 - protein, 16 aa, Entamoeba invadens
AMSRGQNQLGTLGSGN

SEQ ID NO: 2839336 - protein, 9 aa, Entamoeba invadens
AMSSKNDEK

SEQ ID NO: 2839337 - protein, 12 aa, Entamoeba invadens
AMSSKRMRRQKA

SEQ ID NO: 2839338 - protein, 9 aa, Entamoeba invadens
AMSSRNLKE

SEQ ID NO: 2839339 - protein, 7 aa, Entamoeba invadens
AMSTRNP

SEQ ID NO: 2839340 - protein, 4 aa, Entamoeba invadens
AMTD

SEQ ID NO: 2839341 - protein, 5 aa, Entamoeba invadens
AMTDP

SEQ ID NO: 2839342 - protein, 4 aa, Entamoeba invadens
AMTG

SEQ ID NO: 2839343 - protein, 5 aa, Entamoeba invadens
AMTGG

SEQ ID NO: 2839344 - protein, 6 aa, Entamoeba invadens
AMTRRS

SEQ ID NO: 2839345 - protein, 29 aa, Entamoeba invadens
AMTSSSGSSNTPQNPSQKPSAQSQQYSAQ

SEQ ID NO: 2839346 - protein, 15 aa, Entamoeba invadens
ANAANSGMRGGGGVD

SEQ ID NO: 2839347 - protein, 6 aa, Entamoeba invadens
ANAAQN

SEQ ID NO: 2839348 - protein, 12 aa, Entamoeba invadens
ANADKNKRESEH

SEQ ID NO: 2839349 - protein, 8 aa, Entamoeba invadens
ANADQGEI

SEQ ID NO: 2839350 - protein, 4 aa, Entamoeba invadens
ANAH

SEQ ID NO: 2839351 - protein, 9 aa, Entamoeba invadens
ANAKKSFDA

SEQ ID NO: 2839352 - protein, 5 aa, Entamoeba invadens
ANAKT

SEQ ID NO: 2839353 - protein, 6 aa, Entamoeba invadens
ANANTK

SEQ ID NO: 2839354 - protein, 15 aa, Entamoeba invadens
ANAPQGDNTEQLSAA

SEQ ID NO: 2839355 - protein, 14 aa, Entamoeba invadens
ANAPREKGGLGGSK

SEQ ID NO: 2839356 - protein, 5 aa, Entamoeba invadens
ANAPY

SEQ ID NO: 2839357 - protein, 12 aa, Entamoeba invadens
ANAQQRAGRAGR

SEQ ID NO: 2839358 - protein, 5 aa, Entamoeba invadens
ANASD

SEQ ID NO: 2839359 - protein, 7 aa, Entamoeba invadens
ANATQKG

SEQ ID NO: 2839360 - protein, 15 aa, Entamoeba invadens
ANCAQRSGRVGRVSA

SEQ ID NO: 2839361 - protein, 5 aa, Entamoeba invadens
ANCSA

SEQ ID NO: 2839362 - protein, 8 aa, Entamoeba invadens
ANCSAPES

SEQ ID NO: 2839363 - protein, 44 aa, Entamoeba invadens
ANDAYTPPREQREYREKRPEPEGPTEADTADSWRRKDGDSYVPR

SEQ ID NO: 2839364 - protein, 7 aa, Entamoeba invadens
ANDDGTI

SEQ ID NO: 2839365 - protein, 8 aa, Entamoeba invadens
ANDDYKTS

SEQ ID NO: 2839366 - protein, 8 aa, Entamoeba invadens
ANDEEEVS

SEQ ID NO: 2839367 - protein, 11 aa, Entamoeba invadens
ANDEEEVSPST

SEQ ID NO: 2839368 - protein, 9 aa, Entamoeba invadens
ANDEESAHK

SEQ ID NO: 2839369 - protein, 6 aa, Entamoeba invadens
ANDEGF

SEQ ID NO: 2839370 - protein, 5 aa, Entamoeba invadens
ANDEQ

SEQ ID NO: 2839371 - protein, 9 aa, Entamoeba invadens
ANDESDCSK

SEQ ID NO: 2839372 - protein, 5 aa, Entamoeba invadens
ANDGT

SEQ ID NO: 2839373 - protein, 7 aa, Entamoeba invadens
ANDIPSL

SEQ ID NO: 2839374 - protein, 5 aa, Entamoeba invadens
ANDKQ

SEQ ID NO: 2839375 - protein, 8 aa, Entamoeba invadens
ANDKSTVS

SEQ ID NO: 2839376 - protein, 7 aa, Entamoeba invadens
ANDLERK

SEQ ID NO: 2839377 - protein, 7 aa, Entamoeba invadens
ANDLRAK

SEQ ID NO: 2839378 - protein, 8 aa, Entamoeba invadens
ANDMDDEM

SEQ ID NO: 2839379 - protein, 6 aa, Entamoeba invadens
ANDNKT

SEQ ID NO: 2839380 - protein, 8 aa, Entamoeba invadens
ANDNLNTN

SEQ ID NO: 2839381 - protein, 8 aa, Entamoeba invadens
ANDNPSPA

SEQ ID NO: 2839382 - protein, 8 aa, Entamoeba invadens
ANDQERRK

SEQ ID NO: 2839383 - protein, 14 aa, Entamoeba invadens
ANDSNIDKGSKDKI

SEQ ID NO: 2839384 - protein, 7 aa, Entamoeba invadens
ANDSNIE

SEQ ID NO: 2839385 - protein, 4 aa, Entamoeba invadens
ANDT

SEQ ID NO: 2839386 - protein, 6 aa, Entamoeba invadens
ANDTEI

SEQ ID NO: 2839387 - protein, 14 aa, Entamoeba invadens
ANDTTQCKNTITFI

SEQ ID NO: 2839388 - protein, 6 aa, Entamoeba invadens
ANDWRE

SEQ ID NO: 2839389 - protein, 5 aa, Entamoeba invadens
ANDYT

SEQ ID NO: 2839390 - protein, 6 aa, Entamoeba invadens
ANECEL

SEQ ID NO: 2839391 - protein, 5 aa, Entamoeba invadens
ANECQ

SEQ ID NO: 2839392 - protein, 14 aa, Entamoeba invadens
ANEEDKQRERERNR

SEQ ID NO: 2839393 - protein, 7 aa, Entamoeba invadens
ANEEEFS

SEQ ID NO: 2839394 - protein, 5 aa, Entamoeba invadens
ANEEF

SEQ ID NO: 2839395 - protein, 8 aa, Entamoeba invadens
ANEEKQLH

SEQ ID NO: 2839396 - protein, 15 aa, Entamoeba invadens
ANEELENTKNEKEKL

SEQ ID NO: 2839397 - protein, 34 aa, Entamoeba invadens
ANEELETVNKDKFAKEKEAKRLKAKTTKLKRRRN

SEQ ID NO: 2839398 - protein, 39 aa, Entamoeba invadens
ANEEMDKKAKENADLAEKALKDKKLKDRAKESQKITGES

SEQ ID NO: 2839399 - protein, 11 aa, Entamoeba invadens
ANEENSSKIEE

SEQ ID NO: 2839400 - protein, 6 aa, Entamoeba invadens
ANEETP

SEQ ID NO: 2839401 - protein, 14 aa, Entamoeba invadens
ANEGLGSSGSQNEK

SEQ ID NO: 2839402 - protein, 16 aa, Entamoeba invadens
ANEGLGSSGSQNEKSF

SEQ ID NO: 2839403 - protein, 6 aa, Entamoeba invadens
ANEGTQ

SEQ ID NO: 2839404 - protein, 5 aa, Entamoeba invadens
ANEGV

SEQ ID NO: 2839405 - protein, 12 aa, Entamoeba invadens
ANEIDKQTHDVN

SEQ ID NO: 2839406 - protein, 11 aa, Entamoeba invadens
ANEKDKFDEIT

SEQ ID NO: 2839407 - protein, 12 aa, Entamoeba invadens
ANEKEKTFGGSP

SEQ ID NO: 2839408 - protein, 12 aa, Entamoeba invadens
ANEKERKNSEAQ

SEQ ID NO: 2839409 - protein, 5 aa, Entamoeba invadens
ANEKG

SEQ ID NO: 2839410 - protein, 5 aa, Entamoeba invadens
ANEKI

SEQ ID NO: 2839411 - protein, 7 aa, Entamoeba invadens
ANEKQQP

SEQ ID NO: 2839412 - protein, 7 aa, Entamoeba invadens
ANEKRPY

SEQ ID NO: 2839413 - protein, 7 aa, Entamoeba invadens
ANENMQD

SEQ ID NO: 2839414 - protein, 4 aa, Entamoeba invadens
ANEP

SEQ ID NO: 2839415 - protein, 7 aa, Entamoeba invadens
ANEQKNE

SEQ ID NO: 2839416 - protein, 8 aa, Entamoeba invadens
ANEQPVTF

SEQ ID NO: 2839417 - protein, 43 aa, Entamoeba invadens
ANERDAIKTDSPISSTEPKLQINSQKGTSFGNPQLSEVTMKAQ

SEQ ID NO: 2839418 - protein, 14 aa, Entamoeba invadens
ANESETKRSAFTER

SEQ ID NO: 2839419 - protein, 7 aa, Entamoeba invadens
ANESLPQ

SEQ ID NO: 2839420 - protein, 5 aa, Entamoeba invadens
ANETT

SEQ ID NO: 2839421 - protein, 12 aa, Entamoeba invadens
ANETTQNKKRKE

SEQ ID NO: 2839422 - protein, 6 aa, Entamoeba invadens
ANETVR

SEQ ID NO: 2839423 - protein, 10 aa, Entamoeba invadens
ANEVSRAATA

SEQ ID NO: 2839424 - protein, 8 aa, Entamoeba invadens
ANEYTTVE

SEQ ID NO: 2839425 - protein, 9 aa, Entamoeba invadens
ANFDENNYS

SEQ ID NO: 2839426 - protein, 6 aa, Entamoeba invadens
ANFRTG

SEQ ID NO: 2839427 - protein, 10 aa, Entamoeba invadens
ANFTNRGKRA

SEQ ID NO: 2839428 - protein, 6 aa, Entamoeba invadens
ANGANY

SEQ ID NO: 2839429 - protein, 17 aa, Entamoeba invadens
ANGATMNEGTSYNSTQK

SEQ ID NO: 2839430 - protein, 12 aa, Entamoeba invadens
ANGCNSSTGNCT

SEQ ID NO: 2839431 - protein, 6 aa, Entamoeba invadens
ANGDIA

SEQ ID NO: 2839432 - protein, 8 aa, Entamoeba invadens
ANGDSRSF

SEQ ID NO: 2839433 - protein, 7 aa, Entamoeba invadens
ANGDVKR

SEQ ID NO: 2839434 - protein, 17 aa, Entamoeba invadens
ANGEKVDFNKTDAFERN

SEQ ID NO: 2839435 - protein, 7 aa, Entamoeba invadens
ANGFEEV

SEQ ID NO: 2839436 - protein, 4 aa, Entamoeba invadens
ANGG

SEQ ID NO: 2839437 - protein, 12 aa, Entamoeba invadens
ANGGDKHFGGDD

SEQ ID NO: 2839438 - protein, 9 aa, Entamoeba invadens
ANGGNPNDW

SEQ ID NO: 2839439 - protein, 6 aa, Entamoeba invadens
ANGGNY

SEQ ID NO: 2839440 - protein, 14 aa, Entamoeba invadens
ANGGRIEEASGVRR

SEQ ID NO: 2839441 - protein, 7 aa, Entamoeba invadens
ANGGVIG

SEQ ID NO: 2839442 - protein, 14 aa, Entamoeba invadens
ANGKPAPLCFGDNP

SEQ ID NO: 2839443 - protein, 16 aa, Entamoeba invadens
ANGLEGEERADATEAI

SEQ ID NO: 2839444 - protein, 8 aa, Entamoeba invadens
ANGLNPKP

SEQ ID NO: 2839445 - protein, 9 aa, Entamoeba invadens
ANGLSEKQR

SEQ ID NO: 2839446 - protein, 4 aa, Entamoeba invadens
ANGN

SEQ ID NO: 2839447 - protein, 5 aa, Entamoeba invadens
ANGND

SEQ ID NO: 2839448 - protein, 7 aa, Entamoeba invadens
ANGNGQW

SEQ ID NO: 2839449 - protein, 7 aa, Entamoeba invadens
ANGNKFG

SEQ ID NO: 2839450 - protein, 6 aa, Entamoeba invadens
ANGNKV

SEQ ID NO: 2839451 - protein, 44 aa, Entamoeba invadens
ANGNQTTLAANASAAAPISQNQQTNIPQKPKVPKQSTTASRTAY

SEQ ID NO: 2839452 - protein, 19 aa, Entamoeba invadens
ANGPIQKQDNYSVNTPITT

SEQ ID NO: 2839453 - protein, 8 aa, Entamoeba invadens
ANGPNAAN

SEQ ID NO: 2839454 - protein, 9 aa, Entamoeba invadens
ANGQLNTAS

SEQ ID NO: 2839455 - protein, 28 aa, Entamoeba invadens
ANGSKSIAEKRERAATVSVSQQQTSQVP

SEQ ID NO: 2839456 - protein, 7 aa, Entamoeba invadens
ANGSTKT

SEQ ID NO: 2839457 - protein, 7 aa, Entamoeba invadens
ANGTPEQ

SEQ ID NO: 2839458 - protein, 7 aa, Entamoeba invadens
ANGVNGH

SEQ ID NO: 2839459 - protein, 10 aa, Entamoeba invadens
ANGVSTKTAM

SEQ ID NO: 2839460 - protein, 8 aa, Entamoeba invadens
ANGVTSDA

SEQ ID NO: 2839461 - protein, 12 aa, Entamoeba invadens
ANGYTFNSNESS

SEQ ID NO: 2839462 - protein, 4 aa, Entamoeba invadens
ANHK

SEQ ID NO: 2839463 - protein, 12 aa, Entamoeba invadens
ANHSKENGMNQK

SEQ ID NO: 2839464 - protein, 5 aa, Entamoeba invadens
ANIDI

SEQ ID NO: 2839465 - protein, 8 aa, Entamoeba invadens
ANIDIQTD

SEQ ID NO: 2839466 - protein, 11 aa, Entamoeba invadens
ANIDIQTDKNI

SEQ ID NO: 2839467 - protein, 9 aa, Entamoeba invadens
ANIDKANEV

SEQ ID NO: 2839468 - protein, 5 aa, Entamoeba invadens
ANIEE

SEQ ID NO: 2839469 - protein, 13 aa, Entamoeba invadens
ANIEKSGFVPESG

SEQ ID NO: 2839470 - protein, 5 aa, Entamoeba invadens
ANIGG

SEQ ID NO: 2839471 - protein, 9 aa, Entamoeba invadens
ANINPNSYS

SEQ ID NO: 2839472 - protein, 7 aa, Entamoeba invadens
ANIPATK

SEQ ID NO: 2839473 - protein, 7 aa, Entamoeba invadens
ANIPDDK

SEQ ID NO: 2839474 - protein, 9 aa, Entamoeba invadens
ANIPDQEKA

SEQ ID NO: 2839475 - protein, 18 aa, Entamoeba invadens
ANIQERKDSIFDAITDLI

SEQ ID NO: 2839476 - protein, 10 aa, Entamoeba invadens
ANKATESALQ

SEQ ID NO: 2839477 - protein, 6 aa, Entamoeba invadens
ANKATI

SEQ ID NO: 2839478 - protein, 4 aa, Entamoeba invadens
ANKD

SEQ ID NO: 2839479 - protein, 7 aa, Entamoeba invadens
ANKDKVD

SEQ ID NO: 2839480 - protein, 8 aa, Entamoeba invadens
ANKEDPLR

SEQ ID NO: 2839481 - protein, 7 aa, Entamoeba invadens
ANKEKVK

SEQ ID NO: 2839482 - protein, 7 aa, Entamoeba invadens
ANKETID

SEQ ID NO: 2839483 - protein, 4 aa, Entamoeba invadens
ANKG

SEQ ID NO: 2839484 - protein, 8 aa, Entamoeba invadens
ANKGDVPK

SEQ ID NO: 2839485 - protein, 6 aa, Entamoeba invadens
ANKGIT

SEQ ID NO: 2839486 - protein, 10 aa, Entamoeba invadens
ANKGYSPNEI

SEQ ID NO: 2839487 - protein, 9 aa, Entamoeba invadens
ANKGYTPNE

SEQ ID NO: 2839488 - protein, 4 aa, Entamoeba invadens
ANKK

SEQ ID NO: 2839489 - protein, 13 aa, Entamoeba invadens
ANKKASKANLHKI

SEQ ID NO: 2839490 - protein, 8 aa, Entamoeba invadens
ANKKEGVE

SEQ ID NO: 2839491 - protein, 11 aa, Entamoeba invadens
ANKKETNRQLA

SEQ ID NO: 2839492 - protein, 10 aa, Entamoeba invadens
ANKKQIPSTI

SEQ ID NO: 2839493 - protein, 4 aa, Entamoeba invadens
ANKL

SEQ ID NO: 2839494 - protein, 12 aa, Entamoeba invadens
ANKLSDNVAERL

SEQ ID NO: 2839495 - protein, 10 aa, Entamoeba invadens
ANKNAARKIG

SEQ ID NO: 2839496 - protein, 9 aa, Entamoeba invadens
ANKNNNNDY

SEQ ID NO: 2839497 - protein, 7 aa, Entamoeba invadens
ANKNPKV

SEQ ID NO: 2839498 - protein, 7 aa, Entamoeba invadens
ANKNPYK

SEQ ID NO: 2839499 - protein, 13 aa, Entamoeba invadens
ANKNSPKSTPQNT

SEQ ID NO: 2839500 - protein, 9 aa, Entamoeba invadens
ANKNVQRNS

SEQ ID NO: 2839501 - protein, 9 aa, Entamoeba invadens
ANKPQITLN

SEQ ID NO: 2839502 - protein, 7 aa, Entamoeba invadens
ANKPVEA

SEQ ID NO: 2839503 - protein, 8 aa, Entamoeba invadens
ANKREIEK

SEQ ID NO: 2839504 - protein, 6 aa, Entamoeba invadens
ANKRIE

SEQ ID NO: 2839505 - protein, 5 aa, Entamoeba invadens
ANKRS

SEQ ID NO: 2839506 - protein, 14 aa, Entamoeba invadens
ANKSVESLNGLTPA

SEQ ID NO: 2839507 - protein, 11 aa, Entamoeba invadens
ANKSVGRLTKQ

SEQ ID NO: 2839508 - protein, 7 aa, Entamoeba invadens
ANKTDVR

SEQ ID NO: 2839509 - protein, 6 aa, Entamoeba invadens
ANKTPE

SEQ ID NO: 2839510 - protein, 15 aa, Entamoeba invadens
ANKTPQSDCGSTKSI

SEQ ID NO: 2839511 - protein, 14 aa, Entamoeba invadens
ANKTRTEVDKTIES

SEQ ID NO: 2839512 - protein, 4 aa, Entamoeba invadens
ANKY

SEQ ID NO: 2839513 - protein, 7 aa, Entamoeba invadens
ANKYEDA

SEQ ID NO: 2839514 - protein, 4 aa, Entamoeba invadens
ANLA

SEQ ID NO: 2839515 - protein, 4 aa, Entamoeba invadens
ANLE

SEQ ID NO: 2839516 - protein, 5 aa, Entamoeba invadens
ANLEE

SEQ ID NO: 2839517 - protein, 9 aa, Entamoeba invadens
ANLEGSNKF

SEQ ID NO: 2839518 - protein, 7 aa, Entamoeba invadens
ANLGDAE

SEQ ID NO: 2839519 - protein, 9 aa, Entamoeba invadens
ANLKAKAEK

SEQ ID NO: 2839520 - protein, 6 aa, Entamoeba invadens
ANLNGL

SEQ ID NO: 2839521 - protein, 9 aa, Entamoeba invadens
ANLNTKTDL

SEQ ID NO: 2839522 - protein, 8 aa, Entamoeba invadens
ANLPTPEE

SEQ ID NO: 2839523 - protein, 4 aa, Entamoeba invadens
ANLS

SEQ ID NO: 2839524 - protein, 5 aa, Entamoeba invadens
ANLSK

SEQ ID NO: 2839525 - protein, 12 aa, Entamoeba invadens
ANMQSSDTESVA

SEQ ID NO: 2839526 - protein, 4 aa, Entamoeba invadens
ANMT

SEQ ID NO: 2839527 - protein, 4 aa, Entamoeba invadens
ANNE

SEQ ID NO: 2839528 - protein, 8 aa, Entamoeba invadens
ANNESNTE

SEQ ID NO: 2839529 - protein, 7 aa, Entamoeba invadens
ANNEVDK

SEQ ID NO: 2839530 - protein, 5 aa, Entamoeba invadens
ANNKC

SEQ ID NO: 2839531 - protein, 6 aa, Entamoeba invadens
ANNKLK

SEQ ID NO: 2839532 - protein, 6 aa, Entamoeba invadens
ANNKRD

SEQ ID NO: 2839533 - protein, 6 aa, Entamoeba invadens
ANNKSH

SEQ ID NO: 2839534 - protein, 13 aa, Entamoeba invadens
ANNLQTKEAVSKN

SEQ ID NO: 2839535 - protein, 7 aa, Entamoeba invadens
ANNPKIA

SEQ ID NO: 2839536 - protein, 10 aa, Entamoeba invadens
ANNPKNIKRM

SEQ ID NO: 2839537 - protein, 14 aa, Entamoeba invadens
ANNQQNNLLPRQQQ

SEQ ID NO: 2839538 - protein, 17 aa, Entamoeba invadens
ANNRQPRVWEGAIDINS

SEQ ID NO: 2839539 - protein, 6 aa, Entamoeba invadens
ANNSFT

SEQ ID NO: 2839540 - protein, 14 aa, Entamoeba invadens
ANNTAHQPDNSQEI

SEQ ID NO: 2839541 - protein, 12 aa, Entamoeba invadens
ANNTAQNREKTT

SEQ ID NO: 2839542 - protein, 8 aa, Entamoeba invadens
ANNTENIA

SEQ ID NO: 2839543 - protein, 8 aa, Entamoeba invadens
ANNTKVGD

SEQ ID NO: 2839544 - protein, 5 aa, Entamoeba invadens
ANNVD

SEQ ID NO: 2839545 - protein, 8 aa, Entamoeba invadens
ANNYPNSM

SEQ ID NO: 2839546 - protein, 9 aa, Entamoeba invadens
ANPANLNPL

SEQ ID NO: 2839547 - protein, 17 aa, Entamoeba invadens
ANPANLNPLTPTKLGEK

SEQ ID NO: 2839548 - protein, 7 aa, Entamoeba invadens
ANPDTIS

SEQ ID NO: 2839549 - protein, 5 aa, Entamoeba invadens
ANPEW

SEQ ID NO: 2839550 - protein, 6 aa, Entamoeba invadens
ANPGGI

SEQ ID NO: 2839551 - protein, 5 aa, Entamoeba invadens
ANPHT

SEQ ID NO: 2839552 - protein, 4 aa, Entamoeba invadens
ANPI

SEQ ID NO: 2839553 - protein, 19 aa, Entamoeba invadens
ANPIKGRYDRNKSVKQNLN

SEQ ID NO: 2839554 - protein, 8 aa, Entamoeba invadens
ANPKGLSH

SEQ ID NO: 2839555 - protein, 16 aa, Entamoeba invadens
ANPKKGEVGYKHAGSE

SEQ ID NO: 2839556 - protein, 7 aa, Entamoeba invadens
ANPKQHE

SEQ ID NO: 2839557 - protein, 4 aa, Entamoeba invadens
ANPL

SEQ ID NO: 2839558 - protein, 5 aa, Entamoeba invadens
ANPLE

SEQ ID NO: 2839559 - protein, 10 aa, Entamoeba invadens
ANPNADQEKI

SEQ ID NO: 2839560 - protein, 12 aa, Entamoeba invadens
ANPNEIEKNDKT

SEQ ID NO: 2839561 - protein, 19 aa, Entamoeba invadens
ANPNKKDNEDNQPKQQEDA

SEQ ID NO: 2839562 - protein, 7 aa, Entamoeba invadens
ANPNPTL

SEQ ID NO: 2839563 - protein, 6 aa, Entamoeba invadens
ANPPED

SEQ ID NO: 2839564 - protein, 5 aa, Entamoeba invadens
ANPPL

SEQ ID NO: 2839565 - protein, 19 aa, Entamoeba invadens
ANPPTSTNGISQTIGSTNN

SEQ ID NO: 2839566 - protein, 7 aa, Entamoeba invadens
ANPPTYN

SEQ ID NO: 2839567 - protein, 6 aa, Entamoeba invadens
ANPPVG

SEQ ID NO: 2839568 - protein, 10 aa, Entamoeba invadens
ANPQNRPTAA

SEQ ID NO: 2839569 - protein, 4 aa, Entamoeba invadens
ANPT

SEQ ID NO: 2839570 - protein, 6 aa, Entamoeba invadens
ANPTIK

SEQ ID NO: 2839571 - protein, 8 aa, Entamoeba invadens
ANPTWASA

SEQ ID NO: 2839572 - protein, 7 aa, Entamoeba invadens
ANPVEGH

SEQ ID NO: 2839573 - protein, 7 aa, Entamoeba invadens
ANPVNEI

SEQ ID NO: 2839574 - protein, 9 aa, Entamoeba invadens
ANPVNEIND

SEQ ID NO: 2839575 - protein, 6 aa, Entamoeba invadens
ANQEQV

SEQ ID NO: 2839576 - protein, 7 aa, Entamoeba invadens
ANQGHSI

SEQ ID NO: 2839577 - protein, 17 aa, Entamoeba invadens
ANQHSERGKLENQKKDA

SEQ ID NO: 2839578 - protein, 13 aa, Entamoeba invadens
ANQIAQNPEDKAK

SEQ ID NO: 2839579 - protein, 6 aa, Entamoeba invadens
ANQKKG

SEQ ID NO: 2839580 - protein, 8 aa, Entamoeba invadens
ANQKKRLP

SEQ ID NO: 2839581 - protein, 6 aa, Entamoeba invadens
ANQMQQ

SEQ ID NO: 2839582 - protein, 9 aa, Entamoeba invadens
ANQNASRVT

SEQ ID NO: 2839583 - protein, 5 aa, Entamoeba invadens
ANQNF

SEQ ID NO: 2839584 - protein, 8 aa, Entamoeba invadens
ANQNGTTF

SEQ ID NO: 2839585 - protein, 9 aa, Entamoeba invadens
ANQPPEPFK

SEQ ID NO: 2839586 - protein, 4 aa, Entamoeba invadens
ANQT

SEQ ID NO: 2839587 - protein, 8 aa, Entamoeba invadens
ANQTAFDK

SEQ ID NO: 2839588 - protein, 30 aa, Entamoeba invadens
ANQTFEQKRADIQSAGKEADVEKVKEDATA

SEQ ID NO: 2839589 - protein, 9 aa, Entamoeba invadens
ANQTVRRER

SEQ ID NO: 2839590 - protein, 20 aa, Entamoeba invadens
ANQYDNDERWKQADATAQMK

SEQ ID NO: 2839591 - protein, 12 aa, Entamoeba invadens
ANRCEKTTGEGM

SEQ ID NO: 2839592 - protein, 5 aa, Entamoeba invadens
ANRES

SEQ ID NO: 2839593 - protein, 16 aa, Entamoeba invadens
ANRFNGGGTESTNSYK

SEQ ID NO: 2839594 - protein, 6 aa, Entamoeba invadens
ANRGIE

SEQ ID NO: 2839595 - protein, 8 aa, Entamoeba invadens
ANRPEKEL

SEQ ID NO: 2839596 - protein, 10 aa, Entamoeba invadens
ANRSQKSDPI

SEQ ID NO: 2839597 - protein, 7 aa, Entamoeba invadens
ANRTEST

SEQ ID NO: 2839598 - protein, 10 aa, Entamoeba invadens
ANRTIDLSNK

SEQ ID NO: 2839599 - protein, 15 aa, Entamoeba invadens
ANRVNGGGYENTNTY

SEQ ID NO: 2839600 - protein, 14 aa, Entamoeba invadens
ANRVSIDEIVNMLI

SEQ ID NO: 2839601 - protein, 7 aa, Entamoeba invadens
ANRVTGG

SEQ ID NO: 2839602 - protein, 8 aa, Entamoeba invadens
ANRYRNTD

SEQ ID NO: 2839603 - protein, 9 aa, Entamoeba invadens
ANSCDGSTG

SEQ ID NO: 2839604 - protein, 19 aa, Entamoeba invadens
ANSDRNTPLDATNSDKNKK

SEQ ID NO: 2839605 - protein, 12 aa, Entamoeba invadens
ANSEEDEEDEED

SEQ ID NO: 2839606 - protein, 9 aa, Entamoeba invadens
ANSEGDKTT

SEQ ID NO: 2839607 - protein, 40 aa, Entamoeba invadens
ANSEISEVRDSSQKTNEQPKETIKNEVKKTEEKNDKTTFK

SEQ ID NO: 2839608 - protein, 19 aa, Entamoeba invadens
ANSEKNDCINEDAEKHNES

SEQ ID NO: 2839609 - protein, 5 aa, Entamoeba invadens
ANSET

SEQ ID NO: 2839610 - protein, 25 aa, Entamoeba invadens
ANSFTSQKNSDTVTEDIPQRSALEG

SEQ ID NO: 2839611 - protein, 15 aa, Entamoeba invadens
ANSGIQSLGTSAFEG

SEQ ID NO: 2839612 - protein, 9 aa, Entamoeba invadens
ANSGKNFMG

SEQ ID NO: 2839613 - protein, 15 aa, Entamoeba invadens
ANSHSHNEFSSNTDN

SEQ ID NO: 2839614 - protein, 4 aa, Entamoeba invadens
ANSI

SEQ ID NO: 2839615 - protein, 5 aa, Entamoeba invadens
ANSKE

SEQ ID NO: 2839616 - protein, 6 aa, Entamoeba invadens
ANSKID

SEQ ID NO: 2839617 - protein, 18 aa, Entamoeba invadens
ANSKKDDRIKEAQNQAID

SEQ ID NO: 2839618 - protein, 12 aa, Entamoeba invadens
ANSKKVNSNEKV

SEQ ID NO: 2839619 - protein, 9 aa, Entamoeba invadens
ANSKLSEKK

SEQ ID NO: 2839620 - protein, 21 aa, Entamoeba invadens
ANSKRQEIQSNAEQECERDKA

SEQ ID NO: 2839621 - protein, 12 aa, Entamoeba invadens
ANSKTQQLNISK

SEQ ID NO: 2839622 - protein, 7 aa, Entamoeba invadens
ANSKYEN

SEQ ID NO: 2839623 - protein, 9 aa, Entamoeba invadens
ANSNKLRNI

SEQ ID NO: 2839624 - protein, 10 aa, Entamoeba invadens
ANSNKTTDGI

SEQ ID NO: 2839625 - protein, 4 aa, Entamoeba invadens
ANSP

SEQ ID NO: 2839626 - protein, 10 aa, Entamoeba invadens
ANSPEKKPIA

SEQ ID NO: 2839627 - protein, 8 aa, Entamoeba invadens
ANSPGELI

SEQ ID NO: 2839628 - protein, 6 aa, Entamoeba invadens
ANSPMY

SEQ ID NO: 2839629 - protein, 18 aa, Entamoeba invadens
ANSQGRIGNFTNNQPDLR

SEQ ID NO: 2839630 - protein, 15 aa, Entamoeba invadens
ANSQRESLFQNISNF

SEQ ID NO: 2839631 - protein, 7 aa, Entamoeba invadens
ANSREPE

SEQ ID NO: 2839632 - protein, 6 aa, Entamoeba invadens
ANSRKA

SEQ ID NO: 2839633 - protein, 4 aa, Entamoeba invadens
ANSS

SEQ ID NO: 2839634 - protein, 5 aa, Entamoeba invadens
ANSSE

SEQ ID NO: 2839635 - protein, 7 aa, Entamoeba invadens
ANSSELE

SEQ ID NO: 2839636 - protein, 14 aa, Entamoeba invadens
ANSSGAKISSENDC

SEQ ID NO: 2839637 - protein, 12 aa, Entamoeba invadens
ANSSKNPLTGRA

SEQ ID NO: 2839638 - protein, 9 aa, Entamoeba invadens
ANSTAEEIE

SEQ ID NO: 2839639 - protein, 23 aa, Entamoeba invadens
ANSTHRPKQREIKDRKPTYEEIN

SEQ ID NO: 2839640 - protein, 5 aa, Entamoeba invadens
ANSTK

SEQ ID NO: 2839641 - protein, 4 aa, Entamoeba invadens
ANTA

SEQ ID NO: 2839642 - protein, 8 aa, Entamoeba invadens
ANTAEEAY

SEQ ID NO: 2839643 - protein, 6 aa, Entamoeba invadens
ANTEFS

SEQ ID NO: 2839644 - protein, 10 aa, Entamoeba invadens
ANTENECTKC

SEQ ID NO: 2839645 - protein, 6 aa, Entamoeba invadens
ANTENI

SEQ ID NO: 2839646 - protein, 8 aa, Entamoeba invadens
ANTESFQQ

SEQ ID NO: 2839647 - protein, 5 aa, Entamoeba invadens
ANTEV

SEQ ID NO: 2839648 - protein, 10 aa, Entamoeba invadens
ANTGKEDDMN

SEQ ID NO: 2839649 - protein, 9 aa, Entamoeba invadens
ANTGKSTMV

SEQ ID NO: 2839650 - protein, 7 aa, Entamoeba invadens
ANTIQTA

SEQ ID NO: 2839651 - protein, 9 aa, Entamoeba invadens
ANTKRTTYC

SEQ ID NO: 2839652 - protein, 9 aa, Entamoeba invadens
ANTKTFEAK

SEQ ID NO: 2839653 - protein, 4 aa, Entamoeba invadens
ANTL

SEQ ID NO: 2839654 - protein, 8 aa, Entamoeba invadens
ANTNSNNT

SEQ ID NO: 2839655 - protein, 8 aa, Entamoeba invadens
ANTPANDY

SEQ ID NO: 2839656 - protein, 9 aa, Entamoeba invadens
ANTPFQKQQ

SEQ ID NO: 2839657 - protein, 11 aa, Entamoeba invadens
ANTPQEKRTQV

SEQ ID NO: 2839658 - protein, 9 aa, Entamoeba invadens
ANTPSLSSI

SEQ ID NO: 2839659 - protein, 11 aa, Entamoeba invadens
ANTQENGPIEN

SEQ ID NO: 2839660 - protein, 10 aa, Entamoeba invadens
ANTQQTEHQV

SEQ ID NO: 2839661 - protein, 6 aa, Entamoeba invadens
ANTSEV

SEQ ID NO: 2839662 - protein, 9 aa, Entamoeba invadens
ANTSKKLTE

SEQ ID NO: 2839663 - protein, 6 aa, Entamoeba invadens
ANTSSQ

SEQ ID NO: 2839664 - protein, 9 aa, Entamoeba invadens
ANTSTSPQY

SEQ ID NO: 2839665 - protein, 4 aa, Entamoeba invadens
ANTT

SEQ ID NO: 2839666 - protein, 7 aa, Entamoeba invadens
ANTTDGF

SEQ ID NO: 2839667 - protein, 13 aa, Entamoeba invadens
ANTTETPLQPQTV

SEQ ID NO: 2839668 - protein, 6 aa, Entamoeba invadens
ANTTNA

SEQ ID NO: 2839669 - protein, 6 aa, Entamoeba invadens
ANTTQR

SEQ ID NO: 2839670 - protein, 6 aa, Entamoeba invadens
ANTTSQ

SEQ ID NO: 2839671 - protein, 9 aa, Entamoeba invadens
ANTTTSPQY

SEQ ID NO: 2839672 - protein, 5 aa, Entamoeba invadens
ANTVD

SEQ ID NO: 2839673 - protein, 7 aa, Entamoeba invadens
ANTVERL

SEQ ID NO: 2839674 - protein, 15 aa, Entamoeba invadens
ANVEAQKRNSMTSTD

SEQ ID NO: 2839675 - protein, 6 aa, Entamoeba invadens
ANVKGA

SEQ ID NO: 2839676 - protein, 11 aa, Entamoeba invadens
ANVNQMTESGT

SEQ ID NO: 2839677 - protein, 18 aa, Entamoeba invadens
ANVNRKPRELKTTSAYDN

SEQ ID NO: 2839678 - protein, 26 aa, Entamoeba invadens
ANVPQQNQFGAPTGFAQNAFRGGFGF

SEQ ID NO: 2839679 - protein, 11 aa, Entamoeba invadens
ANVPVPSSTED

SEQ ID NO: 2839680 - protein, 22 aa, Entamoeba invadens
ANVQGGIQKVGQNGMVQTQGGI

SEQ ID NO: 2839681 - protein, 5 aa, Entamoeba invadens
ANVQQ

SEQ ID NO: 2839682 - protein, 6 aa, Entamoeba invadens
ANVTED

SEQ ID NO: 2839683 - protein, 10 aa, Entamoeba invadens
ANVTKSLPRP

SEQ ID NO: 2839684 - protein, 8 aa, Entamoeba invadens
ANVTNPKD

SEQ ID NO: 2839685 - protein, 6 aa, Entamoeba invadens
ANWDLE

SEQ ID NO: 2839686 - protein, 13 aa, Entamoeba invadens
ANWDLEEEESLEV

SEQ ID NO: 2839687 - protein, 14 aa, Entamoeba invadens
ANWKGCDGENGNEF

SEQ ID NO: 2839688 - protein, 7 aa, Entamoeba invadens
ANWKRRE

SEQ ID NO: 2839689 - protein, 6 aa, Entamoeba invadens
ANYETE

SEQ ID NO: 2839690 - protein, 9 aa, Entamoeba invadens
ANYKPNDKW

SEQ ID NO: 2839691 - protein, 9 aa, Entamoeba invadens
ANYKYDSET

SEQ ID NO: 2839692 - protein, 17 aa, Entamoeba invadens
ANYQQKYTQQGGSRPFG

SEQ ID NO: 2839693 - protein, 7 aa, Entamoeba invadens
ANYQTIG

SEQ ID NO: 2839694 - protein, 9 aa, Entamoeba invadens
ANYSPPDEM

SEQ ID NO: 2839695 - protein, 5 aa, Entamoeba invadens
ANYSS

SEQ ID NO: 2839696 - protein, 9 aa, Entamoeba invadens
APAAKGFSP

SEQ ID NO: 2839697 - protein, 7 aa, Entamoeba invadens
APADEGD

SEQ ID NO: 2839698 - protein, 6 aa, Entamoeba invadens
APADKL

SEQ ID NO: 2839699 - protein, 6 aa, Entamoeba invadens
APADQQ

SEQ ID NO: 2839700 - protein, 16 aa, Entamoeba invadens
APADRRAAARAVGTEG

SEQ ID NO: 2839701 - protein, 6 aa, Entamoeba invadens
APAGRI

SEQ ID NO: 2839702 - protein, 8 aa, Entamoeba invadens
APAIQKNK

SEQ ID NO: 2839703 - protein, 4 aa, Entamoeba invadens
APAQ

SEQ ID NO: 2839704 - protein, 14 aa, Entamoeba invadens
APATPLEDDEKPEI

SEQ ID NO: 2839705 - protein, 5 aa, Entamoeba invadens
APAVS

SEQ ID NO: 2839706 - protein, 9 aa, Entamoeba invadens
APAYSASPM

SEQ ID NO: 2839707 - protein, 5 aa, Entamoeba invadens
APCNG

SEQ ID NO: 2839708 - protein, 5 aa, Entamoeba invadens
APCSD

SEQ ID NO: 2839709 - protein, 5 aa, Entamoeba invadens
APDCP

SEQ ID NO: 2839710 - protein, 5 aa, Entamoeba invadens
APDEQ

SEQ ID NO: 2839711 - protein, 12 aa, Entamoeba invadens
APDGISKNAKEI

SEQ ID NO: 2839712 - protein, 6 aa, Entamoeba invadens
APDGVF

SEQ ID NO: 2839713 - protein, 10 aa, Entamoeba invadens
APDKIQTGAF

SEQ ID NO: 2839714 - protein, 6 aa, Entamoeba invadens
APDKMG

SEQ ID NO: 2839715 - protein, 8 aa, Entamoeba invadens
APDLTDTM

SEQ ID NO: 2839716 - protein, 6 aa, Entamoeba invadens
APDNEN

SEQ ID NO: 2839717 - protein, 8 aa, Entamoeba invadens
APDPGTIN

SEQ ID NO: 2839718 - protein, 5 aa, Entamoeba invadens
APDRL

SEQ ID NO: 2839719 - protein, 8 aa, Entamoeba invadens
APDSPLTE

SEQ ID NO: 2839720 - protein, 7 aa, Entamoeba invadens
APDTTRL

SEQ ID NO: 2839721 - protein, 6 aa, Entamoeba invadens
APDVTG

SEQ ID NO: 2839722 - protein, 7 aa, Entamoeba invadens
APEAVGA

SEQ ID NO: 2839723 - protein, 10 aa, Entamoeba invadens
APEDEIEKSP

SEQ ID NO: 2839724 - protein, 5 aa, Entamoeba invadens
APEDR

SEQ ID NO: 2839725 - protein, 4 aa, Entamoeba invadens
APEE

SEQ ID NO: 2839726 - protein, 10 aa, Entamoeba invadens
APEEYKNSEL

SEQ ID NO: 2839727 - protein, 6 aa, Entamoeba invadens
APEFTD

SEQ ID NO: 2839728 - protein, 7 aa, Entamoeba invadens
APEGATQ

SEQ ID NO: 2839729 - protein, 6 aa, Entamoeba invadens
APEGTN

SEQ ID NO: 2839730 - protein, 7 aa, Entamoeba invadens
APEGVTK

SEQ ID NO: 2839731 - protein, 12 aa, Entamoeba invadens
APEIEDEIPKTP

SEQ ID NO: 2839732 - protein, 4 aa, Entamoeba invadens
APEK

SEQ ID NO: 2839733 - protein, 7 aa, Entamoeba invadens
APEKIDP

SEQ ID NO: 2839734 - protein, 7 aa, Entamoeba invadens
APENEID

SEQ ID NO: 2839735 - protein, 23 aa, Entamoeba invadens
APENERTKESHQESYKTFLTMDH

SEQ ID NO: 2839736 - protein, 7 aa, Entamoeba invadens
APEPELT

SEQ ID NO: 2839737 - protein, 25 aa, Entamoeba invadens
APESERNRTAHQASSKMFSVFNSFV

SEQ ID NO: 2839738 - protein, 4 aa, Entamoeba invadens
APET

SEQ ID NO: 2839739 - protein, 5 aa, Entamoeba invadens
APETC

SEQ ID NO: 2839740 - protein, 8 aa, Entamoeba invadens
APETEYKK

SEQ ID NO: 2839741 - protein, 14 aa, Entamoeba invadens
APETFRDEYTYSGD

SEQ ID NO: 2839742 - protein, 15 aa, Entamoeba invadens
APETPQLKRKEIEAT

SEQ ID NO: 2839743 - protein, 5 aa, Entamoeba invadens
APETT

SEQ ID NO: 2839744 - protein, 8 aa, Entamoeba invadens
APETTDNL

SEQ ID NO: 2839745 - protein, 10 aa, Entamoeba invadens
APETTPGRTI

SEQ ID NO: 2839746 - protein, 11 aa, Entamoeba invadens
APEVKREDDHN

SEQ ID NO: 2839747 - protein, 12 aa, Entamoeba invadens
APEVNRNEKYSY

SEQ ID NO: 2839748 - protein, 7 aa, Entamoeba invadens
APEVTSK

SEQ ID NO: 2839749 - protein, 5 aa, Entamoeba invadens
APEYS

SEQ ID NO: 2839750 - protein, 4 aa, Entamoeba invadens
APFF

SEQ ID NO: 2839751 - protein, 14 aa, Entamoeba invadens
APFKPKQEQATAGF

SEQ ID NO: 2839752 - protein, 17 aa, Entamoeba invadens
APFKQKQEDMTSGIHQE

SEQ ID NO: 2839753 - protein, 27 aa, Entamoeba invadens
APGFGEKAAKALRNLAEESGEKIGSYQ

SEQ ID NO: 2839754 - protein, 9 aa, Entamoeba invadens
APGFGETRK

SEQ ID NO: 2839755 - protein, 10 aa, Entamoeba invadens
APGLGQPGLG

SEQ ID NO: 2839756 - protein, 82 aa, Entamoeba invadens
APGLGQPGLGMGAPQPGLGAKPPVLGQPGLGGMGQPGLGMGAPQGGLGGMGQPGLGAKPPGLGLGAQPAGLGSQSTQQPGLG

SEQ ID NO: 2839757 - protein, 9 aa, Entamoeba invadens
APGPNSGKM

SEQ ID NO: 2839758 - protein, 7 aa, Entamoeba invadens
APGQTKE

SEQ ID NO: 2839759 - protein, 5 aa, Entamoeba invadens
APGRI

SEQ ID NO: 2839760 - protein, 15 aa, Entamoeba invadens
APGSIDELREEGRRL

SEQ ID NO: 2839761 - protein, 8 aa, Entamoeba invadens
APGSKTTQ

SEQ ID NO: 2839762 - protein, 6 aa, Entamoeba invadens
APGSWS

SEQ ID NO: 2839763 - protein, 15 aa, Entamoeba invadens
APHAGIKKPENNGAF

SEQ ID NO: 2839764 - protein, 11 aa, Entamoeba invadens
APHKVAAPEEA

SEQ ID NO: 2839765 - protein, 6 aa, Entamoeba invadens
APHNEI

SEQ ID NO: 2839766 - protein, 14 aa, Entamoeba invadens
APHPSPLAKGFDGN

SEQ ID NO: 2839767 - protein, 5 aa, Entamoeba invadens
APHSK

SEQ ID NO: 2839768 - protein, 6 aa, Entamoeba invadens
APIEPK

SEQ ID NO: 2839769 - protein, 5 aa, Entamoeba invadens
APIKE

SEQ ID NO: 2839770 - protein, 8 aa, Entamoeba invadens
APIPQQMQ

SEQ ID NO: 2839771 - protein, 11 aa, Entamoeba invadens
APIPTGKEVGT

SEQ ID NO: 2839772 - protein, 11 aa, Entamoeba invadens
APIQTRPPPRI

SEQ ID NO: 2839773 - protein, 14 aa, Entamoeba invadens
APISETNGSPNNEI

SEQ ID NO: 2839774 - protein, 5 aa, Entamoeba invadens
APITP

SEQ ID NO: 2839775 - protein, 6 aa, Entamoeba invadens
APITPT

SEQ ID NO: 2839776 - protein, 13 aa, Entamoeba invadens
APKAQRAVPRSVD

SEQ ID NO: 2839777 - protein, 6 aa, Entamoeba invadens
APKDNW

SEQ ID NO: 2839778 - protein, 8 aa, Entamoeba invadens
APKEIGGI

SEQ ID NO: 2839779 - protein, 5 aa, Entamoeba invadens
APKEQ

SEQ ID NO: 2839780 - protein, 7 aa, Entamoeba invadens
APKFQQY

SEQ ID NO: 2839781 - protein, 6 aa, Entamoeba invadens
APKGAP

SEQ ID NO: 2839782 - protein, 10 aa, Entamoeba invadens
APKGTKELAE

SEQ ID NO: 2839783 - protein, 8 aa, Entamoeba invadens
APKGVTKE

SEQ ID NO: 2839784 - protein, 8 aa, Entamoeba invadens
APKLSRTK

SEQ ID NO: 2839785 - protein, 8 aa, Entamoeba invadens
APKLTSDE

SEQ ID NO: 2839786 - protein, 8 aa, Entamoeba invadens
APKMKSLE

SEQ ID NO: 2839787 - protein, 10 aa, Entamoeba invadens
APKNAKSVGI

SEQ ID NO: 2839788 - protein, 16 aa, Entamoeba invadens
APKQEPKTNEIPKKVE

SEQ ID NO: 2839789 - protein, 16 aa, Entamoeba invadens
APKRGYTTSGTTVKPI

SEQ ID NO: 2839790 - protein, 4 aa, Entamoeba invadens
APKS

SEQ ID NO: 2839791 - protein, 9 aa, Entamoeba invadens
APKSDNNYF

SEQ ID NO: 2839792 - protein, 6 aa, Entamoeba invadens
APKSFN

SEQ ID NO: 2839793 - protein, 13 aa, Entamoeba invadens
APKSGQVSPHTPH

SEQ ID NO: 2839794 - protein, 6 aa, Entamoeba invadens
APKSIQ

SEQ ID NO: 2839795 - protein, 8 aa, Entamoeba invadens
APKSSDDI

SEQ ID NO: 2839796 - protein, 17 aa, Entamoeba invadens
APKSSSNEPLNNTTAEL

SEQ ID NO: 2839797 - protein, 8 aa, Entamoeba invadens
APKSTTQF

SEQ ID NO: 2839798 - protein, 14 aa, Entamoeba invadens
APKSTVNTIKRNED

SEQ ID NO: 2839799 - protein, 5 aa, Entamoeba invadens
APKSV

SEQ ID NO: 2839800 - protein, 6 aa, Entamoeba invadens
APKTEG

SEQ ID NO: 2839801 - protein, 7 aa, Entamoeba invadens
APLKEKK

SEQ ID NO: 2839802 - protein, 22 aa, Entamoeba invadens
APLKPKINEDSLSIDETTGKGC

SEQ ID NO: 2839803 - protein, 7 aa, Entamoeba invadens
APLNPAE

SEQ ID NO: 2839804 - protein, 6 aa, Entamoeba invadens
APLPEG

SEQ ID NO: 2839805 - protein, 12 aa, Entamoeba invadens
APLPHPLPGNRD

SEQ ID NO: 2839806 - protein, 13 aa, Entamoeba invadens
APLPHPPPGNKDY

SEQ ID NO: 2839807 - protein, 26 aa, Entamoeba invadens
APLPPQPPRQKMERAPPEYPSAPPHA

SEQ ID NO: 2839808 - protein, 7 aa, Entamoeba invadens
APLPQDE

SEQ ID NO: 2839809 - protein, 4 aa, Entamoeba invadens
APLQ

SEQ ID NO: 2839810 - protein, 5 aa, Entamoeba invadens
APLQP

SEQ ID NO: 2839811 - protein, 6 aa, Entamoeba invadens
APLRGA

SEQ ID NO: 2839812 - protein, 31 aa, Entamoeba invadens
APLRTKSKKSISKFDGKMKESLAQNEENENY

SEQ ID NO: 2839813 - protein, 4 aa, Entamoeba invadens
APLS

SEQ ID NO: 2839814 - protein, 10 aa, Entamoeba invadens
APLSATPQEM

SEQ ID NO: 2839815 - protein, 5 aa, Entamoeba invadens
APLSS

SEQ ID NO: 2839816 - protein, 4 aa, Entamoeba invadens
APLT

SEQ ID NO: 2839817 - protein, 7 aa, Entamoeba invadens
APLTGAP

SEQ ID NO: 2839818 - protein, 6 aa, Entamoeba invadens
APLTNK

SEQ ID NO: 2839819 - protein, 11 aa, Entamoeba invadens
APLTREDRQQK

SEQ ID NO: 2839820 - protein, 5 aa, Entamoeba invadens
APLTS

SEQ ID NO: 2839821 - protein, 14 aa, Entamoeba invadens
APLTSTSKKMKEDH

SEQ ID NO: 2839822 - protein, 5 aa, Entamoeba invadens
APNAC

SEQ ID NO: 2839823 - protein, 11 aa, Entamoeba invadens
APNDPNSPPIG

SEQ ID NO: 2839824 - protein, 6 aa, Entamoeba invadens
APNEHK

SEQ ID NO: 2839825 - protein, 6 aa, Entamoeba invadens
APNETI

SEQ ID NO: 2839826 - protein, 7 aa, Entamoeba invadens
APNGHGG

SEQ ID NO: 2839827 - protein, 5 aa, Entamoeba invadens
APNGN

SEQ ID NO: 2839828 - protein, 5 aa, Entamoeba invadens
APNIE

SEQ ID NO: 2839829 - protein, 10 aa, Entamoeba invadens
APNKEGEKTS

SEQ ID NO: 2839830 - protein, 8 aa, Entamoeba invadens
APNKGQLP

SEQ ID NO: 2839831 - protein, 5 aa, Entamoeba invadens
APNKK

SEQ ID NO: 2839832 - protein, 16 aa, Entamoeba invadens
APNNDPKQKKNLLSTE

SEQ ID NO: 2839833 - protein, 8 aa, Entamoeba invadens
APNNTKEK

SEQ ID NO: 2839834 - protein, 9 aa, Entamoeba invadens
APNPAAAAK

SEQ ID NO: 2839835 - protein, 7 aa, Entamoeba invadens
APNPSFS

SEQ ID NO: 2839836 - protein, 26 aa, Entamoeba invadens
APNQAKQFKDESSDFKRKLHSFFGFS

SEQ ID NO: 2839837 - protein, 4 aa, Entamoeba invadens
APNS

SEQ ID NO: 2839838 - protein, 6 aa, Entamoeba invadens
APNSPI

SEQ ID NO: 2839839 - protein, 8 aa, Entamoeba invadens
APNTDEND

SEQ ID NO: 2839840 - protein, 11 aa, Entamoeba invadens
APNTDIKKQKI

SEQ ID NO: 2839841 - protein, 18 aa, Entamoeba invadens
APNTFGATDKWKEDLESK

SEQ ID NO: 2839842 - protein, 13 aa, Entamoeba invadens
APNTLSPAQPEAF

SEQ ID NO: 2839843 - protein, 8 aa, Entamoeba invadens
APNTPRSY

SEQ ID NO: 2839844 - protein, 6 aa, Entamoeba invadens
APNYET

SEQ ID NO: 2839845 - protein, 4 aa, Entamoeba invadens
APPE

SEQ ID NO: 2839846 - protein, 12 aa, Entamoeba invadens
APPFKAKKRNSM

SEQ ID NO: 2839847 - protein, 10 aa, Entamoeba invadens
APPFSKREEV

SEQ ID NO: 2839848 - protein, 5 aa, Entamoeba invadens
APPFT

SEQ ID NO: 2839849 - protein, 6 aa, Entamoeba invadens
APPFTC

SEQ ID NO: 2839850 - protein, 7 aa, Entamoeba invadens
APPGKVY

SEQ ID NO: 2839851 - protein, 16 aa, Entamoeba invadens
APPHGFSKSGDGFPNG

SEQ ID NO: 2839852 - protein, 17 aa, Entamoeba invadens
APPHGLGGDSDNFEDGC

SEQ ID NO: 2839853 - protein, 8 aa, Entamoeba invadens
APPIGEDY

SEQ ID NO: 2839854 - protein, 8 aa, Entamoeba invadens
APPIPNEE

SEQ ID NO: 2839855 - protein, 4 aa, Entamoeba invadens
APPK

SEQ ID NO: 2839856 - protein, 8 aa, Entamoeba invadens
APPKASQL

SEQ ID NO: 2839857 - protein, 12 aa, Entamoeba invadens
APPKKATKEEME

SEQ ID NO: 2839858 - protein, 10 aa, Entamoeba invadens
APPKSKRSPM

SEQ ID NO: 2839859 - protein, 5 aa, Entamoeba invadens
APPLG

SEQ ID NO: 2839860 - protein, 9 aa, Entamoeba invadens
APPLPNGVN

SEQ ID NO: 2839861 - protein, 7 aa, Entamoeba invadens
APPNTRK

SEQ ID NO: 2839862 - protein, 9 aa, Entamoeba invadens
APPPEEMTK

SEQ ID NO: 2839863 - protein, 7 aa, Entamoeba invadens
APPPFKK

SEQ ID NO: 2839864 - protein, 42 aa, Entamoeba invadens
APPPPMREEYSYDDDRKEQNSMSEEKEQDESYSESIDTEEEE

SEQ ID NO: 2839865 - protein, 12 aa, Entamoeba invadens
APPPSKGQPLRI

SEQ ID NO: 2839866 - protein, 7 aa, Entamoeba invadens
APPPSPR

SEQ ID NO: 2839867 - protein, 5 aa, Entamoeba invadens
APPPV

SEQ ID NO: 2839868 - protein, 8 aa, Entamoeba invadens
APPPVGQK

SEQ ID NO: 2839869 - protein, 8 aa, Entamoeba invadens
APPRPKRN

SEQ ID NO: 2839870 - protein, 10 aa, Entamoeba invadens
APPSKNLPQT

SEQ ID NO: 2839871 - protein, 8 aa, Entamoeba invadens
APPSPLPV

SEQ ID NO: 2839872 - protein, 7 aa, Entamoeba invadens
APPSPST

SEQ ID NO: 2839873 - protein, 5 aa, Entamoeba invadens
APPTF

SEQ ID NO: 2839874 - protein, 10 aa, Entamoeba invadens
APPTTTSAYK

SEQ ID NO: 2839875 - protein, 5 aa, Entamoeba invadens
APPYM

SEQ ID NO: 2839876 - protein, 4 aa, Entamoeba invadens
APQD

SEQ ID NO: 2839877 - protein, 12 aa, Entamoeba invadens
APQGGNQENIEK

SEQ ID NO: 2839878 - protein, 7 aa, Entamoeba invadens
APQIGKA

SEQ ID NO: 2839879 - protein, 6 aa, Entamoeba invadens
APQIPQ

SEQ ID NO: 2839880 - protein, 37 aa, Entamoeba invadens
APQMKTENEKPSTEIPNKKAEELQKNERIDELQNGAN

SEQ ID NO: 2839881 - protein, 5 aa, Entamoeba invadens
APQNG

SEQ ID NO: 2839882 - protein, 6 aa, Entamoeba invadens
APQNKV

SEQ ID NO: 2839883 - protein, 4 aa, Entamoeba invadens
APQP

SEQ ID NO: 2839884 - protein, 7 aa, Entamoeba invadens
APQPNER

SEQ ID NO: 2839885 - protein, 8 aa, Entamoeba invadens
APQQDGVP

SEQ ID NO: 2839886 - protein, 8 aa, Entamoeba invadens
APQQFGAQ

SEQ ID NO: 2839887 - protein, 7 aa, Entamoeba invadens
APQQTSL

SEQ ID NO: 2839888 - protein, 6 aa, Entamoeba invadens
APQRNV

SEQ ID NO: 2839889 - protein, 6 aa, Entamoeba invadens
APQSQS

SEQ ID NO: 2839890 - protein, 18 aa, Entamoeba invadens
APQSRSESYQSIPQNPFL

SEQ ID NO: 2839891 - protein, 8 aa, Entamoeba invadens
APQSYPKN

SEQ ID NO: 2839892 - protein, 6 aa, Entamoeba invadens
APQTEI

SEQ ID NO: 2839893 - protein, 8 aa, Entamoeba invadens
APRENNKH

SEQ ID NO: 2839894 - protein, 9 aa, Entamoeba invadens
APREQKYTD

SEQ ID NO: 2839895 - protein, 4 aa, Entamoeba invadens
APRG

SEQ ID NO: 2839896 - protein, 6 aa, Entamoeba invadens
APRGSG

SEQ ID NO: 2839897 - protein, 5 aa, Entamoeba invadens
APRKR

SEQ ID NO: 2839898 - protein, 5 aa, Entamoeba invadens
APRPV

SEQ ID NO: 2839899 - protein, 5 aa, Entamoeba invadens
APRSE

SEQ ID NO: 2839900 - protein, 18 aa, Entamoeba invadens
APRSIYTTGKGSSGAGLT

SEQ ID NO: 2839901 - protein, 4 aa, Entamoeba invadens
APRT

SEQ ID NO: 2839902 - protein, 8 aa, Entamoeba invadens
APRVEPMR

SEQ ID NO: 2839903 - protein, 7 aa, Entamoeba invadens
APSADAP

SEQ ID NO: 2839904 - protein, 7 aa, Entamoeba invadens
APSADIP

SEQ ID NO: 2839905 - protein, 7 aa, Entamoeba invadens
APSAGAP

SEQ ID NO: 2839906 - protein, 10 aa, Entamoeba invadens
APSALQPTTE

SEQ ID NO: 2839907 - protein, 17 aa, Entamoeba invadens
APSAVPSYKQNCEKERP

SEQ ID NO: 2839908 - protein, 7 aa, Entamoeba invadens
APSDDPY

SEQ ID NO: 2839909 - protein, 8 aa, Entamoeba invadens
APSDKEEK

SEQ ID NO: 2839910 - protein, 9 aa, Entamoeba invadens
APSEEAAFN

SEQ ID NO: 2839911 - protein, 25 aa, Entamoeba invadens
APSEENVSERLRDSDKTERTEQTEV

SEQ ID NO: 2839912 - protein, 5 aa, Entamoeba invadens
APSEK

SEQ ID NO: 2839913 - protein, 7 aa, Entamoeba invadens
APSEKMP

SEQ ID NO: 2839914 - protein, 5 aa, Entamoeba invadens
APSEV

SEQ ID NO: 2839915 - protein, 4 aa, Entamoeba invadens
APSF

SEQ ID NO: 2839916 - protein, 11 aa, Entamoeba invadens
APSGATTTCES

SEQ ID NO: 2839917 - protein, 20 aa, Entamoeba invadens
APSGEELKSEIKDNGDGTYT

SEQ ID NO: 2839918 - protein, 10 aa, Entamoeba invadens
APSKNYSKEG

SEQ ID NO: 2839919 - protein, 6 aa, Entamoeba invadens
APSNLA

SEQ ID NO: 2839920 - protein, 7 aa, Entamoeba invadens
APSPLQQ

SEQ ID NO: 2839921 - protein, 5 aa, Entamoeba invadens
APSPQ

SEQ ID NO: 2839922 - protein, 4 aa, Entamoeba invadens
APSQ

SEQ ID NO: 2839923 - protein, 25 aa, Entamoeba invadens
APSQSKKSTQSSKRCEPKLPPSEKE

SEQ ID NO: 2839924 - protein, 8 aa, Entamoeba invadens
APSSAQMG

SEQ ID NO: 2839925 - protein, 17 aa, Entamoeba invadens
APSSSTATNALDGKRIR

SEQ ID NO: 2839926 - protein, 8 aa, Entamoeba invadens
APSSSVPV

SEQ ID NO: 2839927 - protein, 5 aa, Entamoeba invadens
APSTF

SEQ ID NO: 2839928 - protein, 10 aa, Entamoeba invadens
APSTRRAKES

SEQ ID NO: 2839929 - protein, 28 aa, Entamoeba invadens
APSVERQQIGEIDGERTTQGNAITTKTM

SEQ ID NO: 2839930 - protein, 35 aa, Entamoeba invadens
APSYPSDQQQAFRGGYNSAPASTQSPQSIQSPQNV

SEQ ID NO: 2839931 - protein, 9 aa, Entamoeba invadens
APSYTPVSA

SEQ ID NO: 2839932 - protein, 7 aa, Entamoeba invadens
APTALNP

SEQ ID NO: 2839933 - protein, 6 aa, Entamoeba invadens
APTDGI

SEQ ID NO: 2839934 - protein, 12 aa, Entamoeba invadens
APTDSLSRRTLD

SEQ ID NO: 2839935 - protein, 15 aa, Entamoeba invadens
APTDTSQTKFANEEL

SEQ ID NO: 2839936 - protein, 5 aa, Entamoeba invadens
APTGA

SEQ ID NO: 2839937 - protein, 4 aa, Entamoeba invadens
APTI

SEQ ID NO: 2839938 - protein, 6 aa, Entamoeba invadens
APTIDV

SEQ ID NO: 2839939 - protein, 8 aa, Entamoeba invadens
APTKEVAS

SEQ ID NO: 2839940 - protein, 13 aa, Entamoeba invadens
APTKKQPKSPKYA

SEQ ID NO: 2839941 - protein, 13 aa, Entamoeba invadens
APTKQQKPQQQQD

SEQ ID NO: 2839942 - protein, 6 aa, Entamoeba invadens
APTNSI

SEQ ID NO: 2839943 - protein, 6 aa, Entamoeba invadens
APTNVA

SEQ ID NO: 2839944 - protein, 5 aa, Entamoeba invadens
APTPK

SEQ ID NO: 2839945 - protein, 7 aa, Entamoeba invadens
APTPQLG

SEQ ID NO: 2839946 - protein, 7 aa, Entamoeba invadens
APTPTDF

SEQ ID NO: 2839947 - protein, 11 aa, Entamoeba invadens
APTPTQSNTTF

SEQ ID NO: 2839948 - protein, 7 aa, Entamoeba invadens
APTQENV

SEQ ID NO: 2839949 - protein, 13 aa, Entamoeba invadens
APTQLTQSTTHDT

SEQ ID NO: 2839950 - protein, 7 aa, Entamoeba invadens
APTRRMK

SEQ ID NO: 2839951 - protein, 11 aa, Entamoeba invadens
APTSETIQTHN

SEQ ID NO: 2839952 - protein, 31 aa, Entamoeba invadens
APTSPVLQDSDDSHTDDEETSQDSYLKEDTH

SEQ ID NO: 2839953 - protein, 23 aa, Entamoeba invadens
APTSQRDIRSAKKLRTKINRENR

SEQ ID NO: 2839954 - protein, 13 aa, Entamoeba invadens
APTTDNKSGDKKL

SEQ ID NO: 2839955 - protein, 12 aa, Entamoeba invadens
APTYPELTNKRR

SEQ ID NO: 2839956 - protein, 22 aa, Entamoeba invadens
APTYVPKAKKRSNKEVSQTQSA

SEQ ID NO: 2839957 - protein, 4 aa, Entamoeba invadens
APVA

SEQ ID NO: 2839958 - protein, 10 aa, Entamoeba invadens
APVAKAPVKC

SEQ ID NO: 2839959 - protein, 7 aa, Entamoeba invadens
APVDSTQ

SEQ ID NO: 2839960 - protein, 7 aa, Entamoeba invadens
APVDTTQ

SEQ ID NO: 2839961 - protein, 11 aa, Entamoeba invadens
APVGNKDEILK

SEQ ID NO: 2839962 - protein, 52 aa, Entamoeba invadens
APVKAEGEKKPEGAEGAENAAPAEQEKKLEEDGTAPAEGEKKEGEPKKEMQS

SEQ ID NO: 2839963 - protein, 29 aa, Entamoeba invadens
APVMQQKKERKKRGERKDDHRVDRHEENL

SEQ ID NO: 2839964 - protein, 5 aa, Entamoeba invadens
APVPP

SEQ ID NO: 2839965 - protein, 5 aa, Entamoeba invadens
APVSA

SEQ ID NO: 2839966 - protein, 5 aa, Entamoeba invadens
APVSE

SEQ ID NO: 2839967 - protein, 6 aa, Entamoeba invadens
APVYDK

SEQ ID NO: 2839968 - protein, 4 aa, Entamoeba invadens
APYG

SEQ ID NO: 2839969 - protein, 6 aa, Entamoeba invadens
APYQEH

SEQ ID NO: 2839970 - protein, 4 aa, Entamoeba invadens
APYS

SEQ ID NO: 2839971 - protein, 4 aa, Entamoeba invadens
AQAC

SEQ ID NO: 2839972 - protein, 4 aa, Entamoeba invadens
AQAE

SEQ ID NO: 2839973 - protein, 18 aa, Entamoeba invadens
AQAEKEEDEVTPEKGEEI

SEQ ID NO: 2839974 - protein, 6 aa, Entamoeba invadens
AQAGGF

SEQ ID NO: 2839975 - protein, 9 aa, Entamoeba invadens
AQANLSNEI

SEQ ID NO: 2839976 - protein, 14 aa, Entamoeba invadens
AQAQLDQSNVTSHD

SEQ ID NO: 2839977 - protein, 24 aa, Entamoeba invadens
AQAQQSTKKTPDNLSPRSPRVSNK

SEQ ID NO: 2839978 - protein, 4 aa, Entamoeba invadens
AQAT

SEQ ID NO: 2839979 - protein, 6 aa, Entamoeba invadens
AQATDS

SEQ ID NO: 2839980 - protein, 8 aa, Entamoeba invadens
AQDAAKEA

SEQ ID NO: 2839981 - protein, 10 aa, Entamoeba invadens
AQDAEPKYSS

SEQ ID NO: 2839982 - protein, 8 aa, Entamoeba invadens
AQDAPFYS

SEQ ID NO: 2839983 - protein, 5 aa, Entamoeba invadens
AQDDI

SEQ ID NO: 2839984 - protein, 9 aa, Entamoeba invadens
AQDDTKGYL

SEQ ID NO: 2839985 - protein, 16 aa, Entamoeba invadens
AQDEDINKMKENGKTM

SEQ ID NO: 2839986 - protein, 7 aa, Entamoeba invadens
AQDHGAK

SEQ ID NO: 2839987 - protein, 4 aa, Entamoeba invadens
AQDI

SEQ ID NO: 2839988 - protein, 10 aa, Entamoeba invadens
AQDIDKEIER

SEQ ID NO: 2839989 - protein, 43 aa, Entamoeba invadens
AQDKSAPKFENLENTNPFAEPNISSSTPIDSSHQKKESKDSVV

SEQ ID NO: 2839990 - protein, 6 aa, Entamoeba invadens
AQDLEK

SEQ ID NO: 2839991 - protein, 6 aa, Entamoeba invadens
AQDNRD

SEQ ID NO: 2839992 - protein, 11 aa, Entamoeba invadens
AQDPSARPTAK

SEQ ID NO: 2839993 - protein, 7 aa, Entamoeba invadens
AQECESK

SEQ ID NO: 2839994 - protein, 32 aa, Entamoeba invadens
AQEDFVDDEDSQGFEEDQDDMEDSDDQNENIQ

SEQ ID NO: 2839995 - protein, 6 aa, Entamoeba invadens
AQEDLD

SEQ ID NO: 2839996 - protein, 5 aa, Entamoeba invadens
AQEDR

SEQ ID NO: 2839997 - protein, 29 aa, Entamoeba invadens
AQEDRLEQTAKCERLESELSKVKKETVGL

SEQ ID NO: 2839998 - protein, 10 aa, Entamoeba invadens
AQEDVKQKEI

SEQ ID NO: 2839999 - protein, 6 aa, Entamoeba invadens
AQEEKP

SEQ ID NO: 2840000 - protein, 6 aa, Entamoeba invadens
AQEERR

SEQ ID NO: 2840001 - protein, 7 aa, Entamoeba invadens
AQEGRMC

SEQ ID NO: 2840002 - protein, 8 aa, Entamoeba invadens
AQEHDPDI

SEQ ID NO: 2840003 - protein, 7 aa, Entamoeba invadens
AQEHDQD

SEQ ID NO: 2840004 - protein, 7 aa, Entamoeba invadens
AQEHGYD

SEQ ID NO: 2840005 - protein, 7 aa, Entamoeba invadens
AQEISQH

SEQ ID NO: 2840006 - protein, 10 aa, Entamoeba invadens
AQEKKRINQN

SEQ ID NO: 2840007 - protein, 6 aa, Entamoeba invadens
AQEKLK

SEQ ID NO: 2840008 - protein, 4 aa, Entamoeba invadens
AQEL

SEQ ID NO: 2840009 - protein, 57 aa, Entamoeba invadens
AQEQAQKAEAAKKERKPKEKKAPKEKKEAKPKAPKAQKEGEKTDLRKRLDKDKDFSE

SEQ ID NO: 2840010 - protein, 5 aa, Entamoeba invadens
AQEQV

SEQ ID NO: 2840011 - protein, 6 aa, Entamoeba invadens
AQERLG

SEQ ID NO: 2840012 - protein, 5 aa, Entamoeba invadens
AQESI

SEQ ID NO: 2840013 - protein, 10 aa, Entamoeba invadens
AQESTGEKTQ

SEQ ID NO: 2840014 - protein, 5 aa, Entamoeba invadens
AQESV

SEQ ID NO: 2840015 - protein, 5 aa, Entamoeba invadens
AQETA

SEQ ID NO: 2840016 - protein, 5 aa, Entamoeba invadens
AQETE

SEQ ID NO: 2840017 - protein, 16 aa, Entamoeba invadens
AQETEGEAKDKNSVVD

SEQ ID NO: 2840018 - protein, 33 aa, Entamoeba invadens
AQETNKEVQRRLGKNRQLYNDDGCIDDGNVWVD

SEQ ID NO: 2840019 - protein, 5 aa, Entamoeba invadens
AQEVL

SEQ ID NO: 2840020 - protein, 6 aa, Entamoeba invadens
AQFKNT

SEQ ID NO: 2840021 - protein, 11 aa, Entamoeba invadens
AQFRPKASQVT

SEQ ID NO: 2840022 - protein, 10 aa, Entamoeba invadens
AQFSPSGDTL

SEQ ID NO: 2840023 - protein, 6 aa, Entamoeba invadens
AQFSSP

SEQ ID NO: 2840024 - protein, 9 aa, Entamoeba invadens
AQGAENKHD

SEQ ID NO: 2840025 - protein, 4 aa, Entamoeba invadens
AQGD

SEQ ID NO: 2840026 - protein, 12 aa, Entamoeba invadens
AQGDGKGPGTKV

SEQ ID NO: 2840027 - protein, 16 aa, Entamoeba invadens
AQGEYNTQSGLGGQKN

SEQ ID NO: 2840028 - protein, 12 aa, Entamoeba invadens
AQGFSRSSSVAS

SEQ ID NO: 2840029 - protein, 6 aa, Entamoeba invadens
AQGGAH

SEQ ID NO: 2840030 - protein, 9 aa, Entamoeba invadens
AQGKDEITQ

SEQ ID NO: 2840031 - protein, 10 aa, Entamoeba invadens
AQGLPETKPR

SEQ ID NO: 2840032 - protein, 14 aa, Entamoeba invadens
AQGNTLDKQRASEV

SEQ ID NO: 2840033 - protein, 14 aa, Entamoeba invadens
AQGRDWSYSRKDKV

SEQ ID NO: 2840034 - protein, 10 aa, Entamoeba invadens
AQGRKMSKSL

SEQ ID NO: 2840035 - protein, 9 aa, Entamoeba invadens
AQGSAFAEK

SEQ ID NO: 2840036 - protein, 16 aa, Entamoeba invadens
AQGSGLISNGKCEKCQ

SEQ ID NO: 2840037 - protein, 7 aa, Entamoeba invadens
AQGYGMP

SEQ ID NO: 2840038 - protein, 15 aa, Entamoeba invadens
AQHGSEDVTAPDGVK

SEQ ID NO: 2840039 - protein, 9 aa, Entamoeba invadens
AQHIKQSQH

SEQ ID NO: 2840040 - protein, 8 aa, Entamoeba invadens
AQHKGSCG

SEQ ID NO: 2840041 - protein, 10 aa, Entamoeba invadens
AQHNQLTRSN

SEQ ID NO: 2840042 - protein, 6 aa, Entamoeba invadens
AQHQKS

SEQ ID NO: 2840043 - protein, 6 aa, Entamoeba invadens
AQHSGT

SEQ ID NO: 2840044 - protein, 9 aa, Entamoeba invadens
AQHSSTEVR

SEQ ID NO: 2840045 - protein, 4 aa, Entamoeba invadens
AQIE

SEQ ID NO: 2840046 - protein, 6 aa, Entamoeba invadens
AQIESQ

SEQ ID NO: 2840047 - protein, 16 aa, Entamoeba invadens
AQIESQKNDKLREAED

SEQ ID NO: 2840048 - protein, 10 aa, Entamoeba invadens
AQIGLNGEEN

SEQ ID NO: 2840049 - protein, 10 aa, Entamoeba invadens
AQIRENEEHI

SEQ ID NO: 2840050 - protein, 10 aa, Entamoeba invadens
AQIRKEDAEL

SEQ ID NO: 2840051 - protein, 16 aa, Entamoeba invadens
AQISSTPKDKHTIETD

SEQ ID NO: 2840052 - protein, 4 aa, Entamoeba invadens
AQIT

SEQ ID NO: 2840053 - protein, 7 aa, Entamoeba invadens
AQITDSS

SEQ ID NO: 2840054 - protein, 16 aa, Entamoeba invadens
AQKAAQSGLSIKTTKN

SEQ ID NO: 2840055 - protein, 8 aa, Entamoeba invadens
AQKADYEA

SEQ ID NO: 2840056 - protein, 10 aa, Entamoeba invadens
AQKADYESQI

SEQ ID NO: 2840057 - protein, 9 aa, Entamoeba invadens
AQKADYKAQ

SEQ ID NO: 2840058 - protein, 6 aa, Entamoeba invadens
AQKANE

SEQ ID NO: 2840059 - protein, 9 aa, Entamoeba invadens
AQKANYKAQ

SEQ ID NO: 2840060 - protein, 22 aa, Entamoeba invadens
AQKAPNALSEEKSEKLETQVQN

SEQ ID NO: 2840061 - protein, 14 aa, Entamoeba invadens
AQKDCPKDAIETYP

SEQ ID NO: 2840062 - protein, 8 aa, Entamoeba invadens
AQKEHLPM

SEQ ID NO: 2840063 - protein, 10 aa, Entamoeba invadens
AQKERTQKAP

SEQ ID NO: 2840064 - protein, 4 aa, Entamoeba invadens
AQKF

SEQ ID NO: 2840065 - protein, 8 aa, Entamoeba invadens
AQKHKKTV

SEQ ID NO: 2840066 - protein, 10 aa, Entamoeba invadens
AQKHPQNAPW

SEQ ID NO: 2840067 - protein, 4 aa, Entamoeba invadens
AQKI

SEQ ID NO: 2840068 - protein, 138 aa, Entamoeba invadens
AQKKAEEAKAAAEESKNRTAEAKKAFEDSAQKAEESKAAAEEATKKAEEASAAKDEATQKAEESAQKANEATQKAEESAAAAEDARKKVEEAAQKLEESVKTAKVATDAAEVAKKDEDEAIERQKEAQAAEDEVTKAL

SEQ ID NO: 2840069 - protein, 13 aa, Entamoeba invadens
AQKKEEDKIQRDQ

SEQ ID NO: 2840070 - protein, 10 aa, Entamoeba invadens
AQKKGRNRAY

SEQ ID NO: 2840071 - protein, 9 aa, Entamoeba invadens
AQKKKTRVG

SEQ ID NO: 2840072 - protein, 10 aa, Entamoeba invadens
AQKKQTTKTI

SEQ ID NO: 2840073 - protein, 8 aa, Entamoeba invadens
AQKLAQDK

SEQ ID NO: 2840074 - protein, 14 aa, Entamoeba invadens
AQKLKNDGKSNKEI

SEQ ID NO: 2840075 - protein, 11 aa, Entamoeba invadens
AQKNRQKINND

SEQ ID NO: 2840076 - protein, 10 aa, Entamoeba invadens
AQKNTRKNFN

SEQ ID NO: 2840077 - protein, 14 aa, Entamoeba invadens
AQKQIDTKKEGIPA

SEQ ID NO: 2840078 - protein, 44 aa, Entamoeba invadens
AQKQLDTANDDKDGNETMKQKYQDELKSVRTELDQEKKDHAKTQ

SEQ ID NO: 2840079 - protein, 9 aa, Entamoeba invadens
AQKQTKREL

SEQ ID NO: 2840080 - protein, 25 aa, Entamoeba invadens
AQKRDKESKQTEFGKTKVSESSVPN

SEQ ID NO: 2840081 - protein, 11 aa, Entamoeba invadens
AQKREEVEKER

SEQ ID NO: 2840082 - protein, 10 aa, Entamoeba invadens
AQKSQTSSGV

SEQ ID NO: 2840083 - protein, 7 aa, Entamoeba invadens
AQKTKDI

SEQ ID NO: 2840084 - protein, 5 aa, Entamoeba invadens
AQKTM

SEQ ID NO: 2840085 - protein, 19 aa, Entamoeba invadens
AQKVQNKMNRQNEKRKRQQ

SEQ ID NO: 2840086 - protein, 11 aa, Entamoeba invadens
AQKYTETAKDE

SEQ ID NO: 2840087 - protein, 8 aa, Entamoeba invadens
AQKYVEES

SEQ ID NO: 2840088 - protein, 4 aa, Entamoeba invadens
AQLA

SEQ ID NO: 2840089 - protein, 4 aa, Entamoeba invadens
AQLG

SEQ ID NO: 2840090 - protein, 13 aa, Entamoeba invadens
AQLGSKGGENREH

SEQ ID NO: 2840091 - protein, 7 aa, Entamoeba invadens
AQLPQLG

SEQ ID NO: 2840092 - protein, 6 aa, Entamoeba invadens
AQLPSH

SEQ ID NO: 2840093 - protein, 12 aa, Entamoeba invadens
AQLSAKAKSAGI

SEQ ID NO: 2840094 - protein, 14 aa, Entamoeba invadens
AQLSNTKNPTNDAD

SEQ ID NO: 2840095 - protein, 9 aa, Entamoeba invadens
AQMKSEDQL

SEQ ID NO: 2840096 - protein, 6 aa, Entamoeba invadens
AQMQAE

SEQ ID NO: 2840097 - protein, 5 aa, Entamoeba invadens
AQNAL

SEQ ID NO: 2840098 - protein, 13 aa, Entamoeba invadens
AQNASENQMNPTN

SEQ ID NO: 2840099 - protein, 16 aa, Entamoeba invadens
AQNCNSPSSLSPASCD

SEQ ID NO: 2840100 - protein, 4 aa, Entamoeba invadens
AQND

SEQ ID NO: 2840101 - protein, 22 aa, Entamoeba invadens
AQNDAEQKKKSEEKKKETTRVL

SEQ ID NO: 2840102 - protein, 7 aa, Entamoeba invadens
AQNDGEF

SEQ ID NO: 2840103 - protein, 5 aa, Entamoeba invadens
AQNEK

SEQ ID NO: 2840104 - protein, 4 aa, Entamoeba invadens
AQNG

SEQ ID NO: 2840105 - protein, 19 aa, Entamoeba invadens
AQNGKLKKRTTDLEDGGKA

SEQ ID NO: 2840106 - protein, 13 aa, Entamoeba invadens
AQNGMKQTDNKTV

SEQ ID NO: 2840107 - protein, 9 aa, Entamoeba invadens
AQNGSAGEW

SEQ ID NO: 2840108 - protein, 7 aa, Entamoeba invadens
AQNITTN

SEQ ID NO: 2840109 - protein, 46 aa, Entamoeba invadens
AQNKKVSDERDGYNQQLQAEKTKTAALTSAKNANDKKILSLNQRKT

SEQ ID NO: 2840110 - protein, 9 aa, Entamoeba invadens
AQNNKSDLR

SEQ ID NO: 2840111 - protein, 5 aa, Entamoeba invadens
AQNPT

SEQ ID NO: 2840112 - protein, 5 aa, Entamoeba invadens
AQNQN

SEQ ID NO: 2840113 - protein, 14 aa, Entamoeba invadens
AQNSETHKNENQSC

SEQ ID NO: 2840114 - protein, 5 aa, Entamoeba invadens
AQNTE

SEQ ID NO: 2840115 - protein, 7 aa, Entamoeba invadens
AQNTETT

SEQ ID NO: 2840116 - protein, 15 aa, Entamoeba invadens
AQNTISIEEDNTTQL

SEQ ID NO: 2840117 - protein, 8 aa, Entamoeba invadens
AQNTITKN

SEQ ID NO: 2840118 - protein, 9 aa, Entamoeba invadens
AQNTKIPAS

SEQ ID NO: 2840119 - protein, 11 aa, Entamoeba invadens
AQPAKKSTVTQ

SEQ ID NO: 2840120 - protein, 9 aa, Entamoeba invadens
AQPDELRRN

SEQ ID NO: 2840121 - protein, 27 aa, Entamoeba invadens
AQPDIPDNSKLDVSQQSKTKEDDDDEL

SEQ ID NO: 2840122 - protein, 15 aa, Entamoeba invadens
AQPFEETKEEEQITD

SEQ ID NO: 2840123 - protein, 7 aa, Entamoeba invadens
AQPGESL

SEQ ID NO: 2840124 - protein, 8 aa, Entamoeba invadens
AQPIRNSD

SEQ ID NO: 2840125 - protein, 4 aa, Entamoeba invadens
AQPK

SEQ ID NO: 2840126 - protein, 6 aa, Entamoeba invadens
AQPLPG

SEQ ID NO: 2840127 - protein, 32 aa, Entamoeba invadens
AQPMSQQQVPPKMYNPTSQPQPQQTQVQQQEY

SEQ ID NO: 2840128 - protein, 6 aa, Entamoeba invadens
AQPNAA

SEQ ID NO: 2840129 - protein, 5 aa, Entamoeba invadens
AQPNK

SEQ ID NO: 2840130 - protein, 22 aa, Entamoeba invadens
AQPNTKSIPTTNPFTNQPQQIS

SEQ ID NO: 2840131 - protein, 4 aa, Entamoeba invadens
AQPQ

SEQ ID NO: 2840132 - protein, 13 aa, Entamoeba invadens
AQPQQNVAQPLDT

SEQ ID NO: 2840133 - protein, 14 aa, Entamoeba invadens
AQPRQGEVKKQSHF

SEQ ID NO: 2840134 - protein, 29 aa, Entamoeba invadens
AQPSEQIPQPTEQKKEKMQQQQNNTNPKA

SEQ ID NO: 2840135 - protein, 9 aa, Entamoeba invadens
AQPTEGAMK

SEQ ID NO: 2840136 - protein, 4 aa, Entamoeba invadens
AQPV

SEQ ID NO: 2840137 - protein, 15 aa, Entamoeba invadens
AQPVDKNFQQQGYTQ

SEQ ID NO: 2840138 - protein, 25 aa, Entamoeba invadens
AQQAADALAKGTPLPASKKEMDSNC

SEQ ID NO: 2840139 - protein, 8 aa, Entamoeba invadens
AQQDDQNE

SEQ ID NO: 2840140 - protein, 46 aa, Entamoeba invadens
AQQDKPLQKTKEELKKAEKETKEQKKAEKEMKKQEEKKQKQELKQK

SEQ ID NO: 2840141 - protein, 12 aa, Entamoeba invadens
AQQEKEKEMNEN

SEQ ID NO: 2840142 - protein, 6 aa, Entamoeba invadens
AQQERE

SEQ ID NO: 2840143 - protein, 33 aa, Entamoeba invadens
AQQKQEEKKIKETKKAEKTSKKRRAESLQSPGY

SEQ ID NO: 2840144 - protein, 10 aa, Entamoeba invadens
AQQKSNPASL

SEQ ID NO: 2840145 - protein, 6 aa, Entamoeba invadens
AQQNGF

SEQ ID NO: 2840146 - protein, 9 aa, Entamoeba invadens
AQQNTKNAI

SEQ ID NO: 2840147 - protein, 12 aa, Entamoeba invadens
AQQNYSDAKDKY

SEQ ID NO: 2840148 - protein, 28 aa, Entamoeba invadens
AQQPQATNELSGGMRQKQQRRQHTPMDC

SEQ ID NO: 2840149 - protein, 10 aa, Entamoeba invadens
AQQQGASQKI

SEQ ID NO: 2840150 - protein, 26 aa, Entamoeba invadens
AQQQGNSLFGNNTNNMSGLQNTGLMG

SEQ ID NO: 2840151 - protein, 7 aa, Entamoeba invadens
AQQQLSE

SEQ ID NO: 2840152 - protein, 14 aa, Entamoeba invadens
AQQQNVTPPQIEPK

SEQ ID NO: 2840153 - protein, 22 aa, Entamoeba invadens
AQQRNCSVNPTLPPNVTTESVT

SEQ ID NO: 2840154 - protein, 7 aa, Entamoeba invadens
AQQSEEK

SEQ ID NO: 2840155 - protein, 9 aa, Entamoeba invadens
AQQSKTDLR

SEQ ID NO: 2840156 - protein, 10 aa, Entamoeba invadens
AQQSSTNPLT

SEQ ID NO: 2840157 - protein, 6 aa, Entamoeba invadens
AQQSTF

SEQ ID NO: 2840158 - protein, 5 aa, Entamoeba invadens
AQQTM

SEQ ID NO: 2840159 - protein, 11 aa, Entamoeba invadens
AQQTNTQSQPN

SEQ ID NO: 2840160 - protein, 5 aa, Entamoeba invadens
AQQVQ

SEQ ID NO: 2840161 - protein, 17 aa, Entamoeba invadens
AQRAEKKLNDDNGTEHV

SEQ ID NO: 2840162 - protein, 53 aa, Entamoeba invadens
AQRAPRPESRMGPAPQQQPTPTAGQIQQRAQRQQQTQQGSQQMAQQPQTITEE

SEQ ID NO: 2840163 - protein, 6 aa, Entamoeba invadens
AQRDGR

SEQ ID NO: 2840164 - protein, 8 aa, Entamoeba invadens
AQRGKKLP

SEQ ID NO: 2840165 - protein, 4 aa, Entamoeba invadens
AQRK

SEQ ID NO: 2840166 - protein, 4 aa, Entamoeba invadens
AQRN

SEQ ID NO: 2840167 - protein, 10 aa, Entamoeba invadens
AQRNAELSQL

SEQ ID NO: 2840168 - protein, 5 aa, Entamoeba invadens
AQRPE

SEQ ID NO: 2840169 - protein, 8 aa, Entamoeba invadens
AQRPGIPE

SEQ ID NO: 2840170 - protein, 24 aa, Entamoeba invadens
AQRQLDTANDDKDGNEAMKQKYQD

SEQ ID NO: 2840171 - protein, 48 aa, Entamoeba invadens
AQRRKREKERKRRDGAKKKDRKDRNETFDGRKFEGGQSIGGNSLKSGD

SEQ ID NO: 2840172 - protein, 17 aa, Entamoeba invadens
AQRSLRREDRERRRRAR

SEQ ID NO: 2840173 - protein, 8 aa, Entamoeba invadens
AQRSNEVT

SEQ ID NO: 2840174 - protein, 7 aa, Entamoeba invadens
AQRSSKQ

SEQ ID NO: 2840175 - protein, 6 aa, Entamoeba invadens
AQRSTF

SEQ ID NO: 2840176 - protein, 4 aa, Entamoeba invadens
AQSA

SEQ ID NO: 2840177 - protein, 9 aa, Entamoeba invadens
AQSAGKSSV

SEQ ID NO: 2840178 - protein, 42 aa, Entamoeba invadens
AQSDGYTESHSKEVPTTPLPPTPTKKESENSKQNEDDDSGIM

SEQ ID NO: 2840179 - protein, 7 aa, Entamoeba invadens
AQSEIDK

SEQ ID NO: 2840180 - protein, 5 aa, Entamoeba invadens
AQSEK

SEQ ID NO: 2840181 - protein, 15 aa, Entamoeba invadens
AQSEVTKKKKKNNFE

SEQ ID NO: 2840182 - protein, 6 aa, Entamoeba invadens
AQSGAN

SEQ ID NO: 2840183 - protein, 9 aa, Entamoeba invadens
AQSGSKKKG

SEQ ID NO: 2840184 - protein, 16 aa, Entamoeba invadens
AQSKCGTDGLKTKVEE

SEQ ID NO: 2840185 - protein, 9 aa, Entamoeba invadens
AQSNQSPKI

SEQ ID NO: 2840186 - protein, 14 aa, Entamoeba invadens
AQSNVSKGSSVDKE

SEQ ID NO: 2840187 - protein, 7 aa, Entamoeba invadens
AQSPKRR

SEQ ID NO: 2840188 - protein, 23 aa, Entamoeba invadens
AQSQRKKTQAYYEEQRKNGGTSI

SEQ ID NO: 2840189 - protein, 15 aa, Entamoeba invadens
AQSQSGTGKTATFST

SEQ ID NO: 2840190 - protein, 12 aa, Entamoeba invadens
AQSRTNKGKGLE

SEQ ID NO: 2840191 - protein, 4 aa, Entamoeba invadens
AQST

SEQ ID NO: 2840192 - protein, 8 aa, Entamoeba invadens
AQSTISPK

SEQ ID NO: 2840193 - protein, 9 aa, Entamoeba invadens
AQSTNKKTT

SEQ ID NO: 2840194 - protein, 16 aa, Entamoeba invadens
AQSTPITTKKVPSQKI

SEQ ID NO: 2840195 - protein, 8 aa, Entamoeba invadens
AQSTPLTN

SEQ ID NO: 2840196 - protein, 27 aa, Entamoeba invadens
AQSTPTNITTTKDQNKPLVDEKKSNMT

SEQ ID NO: 2840197 - protein, 10 aa, Entamoeba invadens
AQSVDDVRDA

SEQ ID NO: 2840198 - protein, 7 aa, Entamoeba invadens
AQSVSVR

SEQ ID NO: 2840199 - protein, 9 aa, Entamoeba invadens
AQTALTTAQ

SEQ ID NO: 2840200 - protein, 7 aa, Entamoeba invadens
AQTANEA

SEQ ID NO: 2840201 - protein, 20 aa, Entamoeba invadens
AQTDAQEEGSEDYGFTGTPE

SEQ ID NO: 2840202 - protein, 5 aa, Entamoeba invadens
AQTDG

SEQ ID NO: 2840203 - protein, 6 aa, Entamoeba invadens
AQTEGE

SEQ ID NO: 2840204 - protein, 12 aa, Entamoeba invadens
AQTESLNNSNNF

SEQ ID NO: 2840205 - protein, 8 aa, Entamoeba invadens
AQTGSGKT

SEQ ID NO: 2840206 - protein, 9 aa, Entamoeba invadens
AQTHDPDCR

SEQ ID NO: 2840207 - protein, 13 aa, Entamoeba invadens
AQTISGLESSALH

SEQ ID NO: 2840208 - protein, 5 aa, Entamoeba invadens
AQTKL

SEQ ID NO: 2840209 - protein, 5 aa, Entamoeba invadens
AQTLT

SEQ ID NO: 2840210 - protein, 25 aa, Entamoeba invadens
AQTNIVKKEPKRWETVEQKDKTKNV

SEQ ID NO: 2840211 - protein, 5 aa, Entamoeba invadens
AQTNP

SEQ ID NO: 2840212 - protein, 26 aa, Entamoeba invadens
AQTNQAGRLQSELERTKEEKTLTEAN

SEQ ID NO: 2840213 - protein, 5 aa, Entamoeba invadens
AQTNT

SEQ ID NO: 2840214 - protein, 7 aa, Entamoeba invadens
AQTPEIK

SEQ ID NO: 2840215 - protein, 16 aa, Entamoeba invadens
AQTPSPTTLESTPKLS

SEQ ID NO: 2840216 - protein, 6 aa, Entamoeba invadens
AQTQGT

SEQ ID NO: 2840217 - protein, 6 aa, Entamoeba invadens
AQTRGL

SEQ ID NO: 2840218 - protein, 6 aa, Entamoeba invadens
AQVAGT

SEQ ID NO: 2840219 - protein, 9 aa, Entamoeba invadens
AQVDGKDYN

SEQ ID NO: 2840220 - protein, 6 aa, Entamoeba invadens
AQVEDD

SEQ ID NO: 2840221 - protein, 24 aa, Entamoeba invadens
AQVEKSTKLDYDEIKEDKKLGEGS

SEQ ID NO: 2840222 - protein, 11 aa, Entamoeba invadens
AQVKPTKGGNY

SEQ ID NO: 2840223 - protein, 6 aa, Entamoeba invadens
AQVNRK

SEQ ID NO: 2840224 - protein, 7 aa, Entamoeba invadens
AQVPTQC

SEQ ID NO: 2840225 - protein, 9 aa, Entamoeba invadens
AQVQEQKSE

SEQ ID NO: 2840226 - protein, 18 aa, Entamoeba invadens
AQVRKAQKAGSDGDSPAG

SEQ ID NO: 2840227 - protein, 10 aa, Entamoeba invadens
AQVRNGKDWS

SEQ ID NO: 2840228 - protein, 7 aa, Entamoeba invadens
AQVTVEQ

SEQ ID NO: 2840229 - protein, 5 aa, Entamoeba invadens
AQYAP

SEQ ID NO: 2840230 - protein, 4 aa, Entamoeba invadens
AQYG

SEQ ID NO: 2840231 - protein, 6 aa, Entamoeba invadens
ARADEE

SEQ ID NO: 2840232 - protein, 6 aa, Entamoeba invadens
ARADQY

SEQ ID NO: 2840233 - protein, 5 aa, Entamoeba invadens
ARAGC

SEQ ID NO: 2840234 - protein, 6 aa, Entamoeba invadens
ARAGKK

SEQ ID NO: 2840235 - protein, 4 aa, Entamoeba invadens
ARAI

SEQ ID NO: 2840236 - protein, 5 aa, Entamoeba invadens
ARAMR

SEQ ID NO: 2840237 - protein, 71 aa, Entamoeba invadens
ARANRAGGAHAPPSRGGMQRSAPPPAAQPPMHRGAPAPRGAPRGGRGGMPPPQQREEPQEEQQEEEQPQQF

SEQ ID NO: 2840238 - protein, 74 aa, Entamoeba invadens
ARANRAGGAHAPPSRGGMSQSAPRPAAQPPMHRGAPAPRGAPRGAPRGGRGGMPPPQQYEEPQEEQQEEEQPQQ

SEQ ID NO: 2840239 - protein, 4 aa, Entamoeba invadens
ARAP

SEQ ID NO: 2840240 - protein, 14 aa, Entamoeba invadens
ARAQQQQTEGDNPL

SEQ ID NO: 2840241 - protein, 24 aa, Entamoeba invadens
ARARGPKSSLTRQPTEGRSRDGGL

SEQ ID NO: 2840242 - protein, 4 aa, Entamoeba invadens
ARAT

SEQ ID NO: 2840243 - protein, 7 aa, Entamoeba invadens
ARDATNV

SEQ ID NO: 2840244 - protein, 4 aa, Entamoeba invadens
ARDC

SEQ ID NO: 2840245 - protein, 7 aa, Entamoeba invadens
ARDDQYV

SEQ ID NO: 2840246 - protein, 27 aa, Entamoeba invadens
ARDEKRKRTTGIAKSEQLKDGNDINSV

SEQ ID NO: 2840247 - protein, 10 aa, Entamoeba invadens
ARDESRKDEI

SEQ ID NO: 2840248 - protein, 10 aa, Entamoeba invadens
ARDGSSGGNI

SEQ ID NO: 2840249 - protein, 12 aa, Entamoeba invadens
ARDKKVEGFSGA

SEQ ID NO: 2840250 - protein, 9 aa, Entamoeba invadens
ARDKNGTAV

SEQ ID NO: 2840251 - protein, 9 aa, Entamoeba invadens
ARDKPAGNF

SEQ ID NO: 2840252 - protein, 28 aa, Entamoeba invadens
ARDNPPSKDKEQEPTEVCPPTRKIIKFM

SEQ ID NO: 2840253 - protein, 10 aa, Entamoeba invadens
ARDNSSHSTT

SEQ ID NO: 2840254 - protein, 14 aa, Entamoeba invadens
ARDPGTSMGYSKGN

SEQ ID NO: 2840255 - protein, 7 aa, Entamoeba invadens
ARDPKYT

SEQ ID NO: 2840256 - protein, 20 aa, Entamoeba invadens
ARDSAKASNTLKTQLEEQDK

SEQ ID NO: 2840257 - protein, 7 aa, Entamoeba invadens
ARDTQKR

SEQ ID NO: 2840258 - protein, 17 aa, Entamoeba invadens
AREDSAKGILDSKGPEE

SEQ ID NO: 2840259 - protein, 11 aa, Entamoeba invadens
AREDYSKQELS

SEQ ID NO: 2840260 - protein, 11 aa, Entamoeba invadens
AREEDESPHSI

SEQ ID NO: 2840261 - protein, 12 aa, Entamoeba invadens
AREEEETTQNKE

SEQ ID NO: 2840262 - protein, 16 aa, Entamoeba invadens
AREEKRVVQSNEQMTD

SEQ ID NO: 2840263 - protein, 14 aa, Entamoeba invadens
AREGCGESEFDKEW

SEQ ID NO: 2840264 - protein, 8 aa, Entamoeba invadens
AREGGPKM

SEQ ID NO: 2840265 - protein, 11 aa, Entamoeba invadens
AREGKGNTKNK

SEQ ID NO: 2840266 - protein, 34 aa, Entamoeba invadens
AREGKSDIKSCEGTPLYSAPETFEKDGKTHGKEV

SEQ ID NO: 2840267 - protein, 7 aa, Entamoeba invadens
AREGSEF

SEQ ID NO: 2840268 - protein, 6 aa, Entamoeba invadens
AREITN

SEQ ID NO: 2840269 - protein, 7 aa, Entamoeba invadens
AREKGEN

SEQ ID NO: 2840270 - protein, 34 aa, Entamoeba invadens
AREKKTSKGKIAQALKQEQQQAEQQQNIQPTPPV

SEQ ID NO: 2840271 - protein, 8 aa, Entamoeba invadens
ARENRTAL

SEQ ID NO: 2840272 - protein, 12 aa, Entamoeba invadens
ARERGRKYIENN

SEQ ID NO: 2840273 - protein, 6 aa, Entamoeba invadens
ARESGD

SEQ ID NO: 2840274 - protein, 9 aa, Entamoeba invadens
ARESSSFAK

SEQ ID NO: 2840275 - protein, 5 aa, Entamoeba invadens
ARGAA

SEQ ID NO: 2840276 - protein, 11 aa, Entamoeba invadens
ARGDSDTKSTI

SEQ ID NO: 2840277 - protein, 17 aa, Entamoeba invadens
ARGEKVGEFRRGKNAAE

SEQ ID NO: 2840278 - protein, 7 aa, Entamoeba invadens
ARGEYKS

SEQ ID NO: 2840279 - protein, 6 aa, Entamoeba invadens
ARGKCT

SEQ ID NO: 2840280 - protein, 9 aa, Entamoeba invadens
ARGKTGRQF

SEQ ID NO: 2840281 - protein, 5 aa, Entamoeba invadens
ARGNV

SEQ ID NO: 2840282 - protein, 11 aa, Entamoeba invadens
ARGRKGVKMST

SEQ ID NO: 2840283 - protein, 7 aa, Entamoeba invadens
ARGSARK

SEQ ID NO: 2840284 - protein, 13 aa, Entamoeba invadens
ARGSDVITGGGDG

SEQ ID NO: 2840285 - protein, 8 aa, Entamoeba invadens
ARGTSYTF

SEQ ID NO: 2840286 - protein, 4 aa, Entamoeba invadens
ARGY

SEQ ID NO: 2840287 - protein, 5 aa, Entamoeba invadens
ARHSA

SEQ ID NO: 2840288 - protein, 4 aa, Entamoeba invadens
ARHT

SEQ ID NO: 2840289 - protein, 7 aa, Entamoeba invadens
ARIESQK

SEQ ID NO: 2840290 - protein, 8 aa, Entamoeba invadens
ARIPTRED

SEQ ID NO: 2840291 - protein, 7 aa, Entamoeba invadens
ARISDSV

SEQ ID NO: 2840292 - protein, 7 aa, Entamoeba invadens
ARISSQI

SEQ ID NO: 2840293 - protein, 10 aa, Entamoeba invadens
ARKDKKRHLP

SEQ ID NO: 2840294 - protein, 4 aa, Entamoeba invadens
ARKE

SEQ ID NO: 2840295 - protein, 6 aa, Entamoeba invadens
ARKEDV

SEQ ID NO: 2840296 - protein, 10 aa, Entamoeba invadens
ARKEGSYPHT

SEQ ID NO: 2840297 - protein, 6 aa, Entamoeba invadens
ARKEIP

SEQ ID NO: 2840298 - protein, 25 aa, Entamoeba invadens
ARKEPTVIEDGSSSEKEKEETKKME

SEQ ID NO: 2840299 - protein, 15 aa, Entamoeba invadens
ARKEVRDPKELTKEQ

SEQ ID NO: 2840300 - protein, 7 aa, Entamoeba invadens
ARKGEEY

SEQ ID NO: 2840301 - protein, 7 aa, Entamoeba invadens
ARKIPTG

SEQ ID NO: 2840302 - protein, 13 aa, Entamoeba invadens
ARKNTTSDEQIQP

SEQ ID NO: 2840303 - protein, 15 aa, Entamoeba invadens
ARKQAKKDMAAEKDE

SEQ ID NO: 2840304 - protein, 9 aa, Entamoeba invadens
ARKQDNVVA

SEQ ID NO: 2840305 - protein, 8 aa, Entamoeba invadens
ARKRLPAM

SEQ ID NO: 2840306 - protein, 10 aa, Entamoeba invadens
ARKSESETRL

SEQ ID NO: 2840307 - protein, 9 aa, Entamoeba invadens
ARKSGKAMQ

SEQ ID NO: 2840308 - protein, 8 aa, Entamoeba invadens
ARKSILDP

SEQ ID NO: 2840309 - protein, 11 aa, Entamoeba invadens
ARKSKKTKRLD

SEQ ID NO: 2840310 - protein, 15 aa, Entamoeba invadens
ARKSPDNVTVLVAFF

SEQ ID NO: 2840311 - protein, 4 aa, Entamoeba invadens
ARKT

SEQ ID NO: 2840312 - protein, 10 aa, Entamoeba invadens
ARKTKASQLS

SEQ ID NO: 2840313 - protein, 8 aa, Entamoeba invadens
ARKTTTND

SEQ ID NO: 2840314 - protein, 4 aa, Entamoeba invadens
ARKV

SEQ ID NO: 2840315 - protein, 6 aa, Entamoeba invadens
ARLETV

SEQ ID NO: 2840316 - protein, 5 aa, Entamoeba invadens
ARLKS

SEQ ID NO: 2840317 - protein, 10 aa, Entamoeba invadens
ARLSFSEKKQ

SEQ ID NO: 2840318 - protein, 12 aa, Entamoeba invadens
ARLSSVDSALRQ

SEQ ID NO: 2840319 - protein, 12 aa, Entamoeba invadens
ARMKSRHIKNKH

SEQ ID NO: 2840320 - protein, 5 aa, Entamoeba invadens
ARMTA

SEQ ID NO: 2840321 - protein, 5 aa, Entamoeba invadens
ARNAD

SEQ ID NO: 2840322 - protein, 8 aa, Entamoeba invadens
ARNASNSA

SEQ ID NO: 2840323 - protein, 10 aa, Entamoeba invadens
ARNKYERYPR

SEQ ID NO: 2840324 - protein, 12 aa, Entamoeba invadens
ARNQISKSDFGK

SEQ ID NO: 2840325 - protein, 9 aa, Entamoeba invadens
ARNQKKEEL

SEQ ID NO: 2840326 - protein, 5 aa, Entamoeba invadens
ARNRL

SEQ ID NO: 2840327 - protein, 6 aa, Entamoeba invadens
ARNSEK

SEQ ID NO: 2840328 - protein, 15 aa, Entamoeba invadens
ARNSGDNISCVVCKL

SEQ ID NO: 2840329 - protein, 9 aa, Entamoeba invadens
ARNSTIGQK

SEQ ID NO: 2840330 - protein, 10 aa, Entamoeba invadens
ARNSVNESAL

SEQ ID NO: 2840331 - protein, 8 aa, Entamoeba invadens
ARNTGGAI

SEQ ID NO: 2840332 - protein, 11 aa, Entamoeba invadens
ARNTNVGSTTI

SEQ ID NO: 2840333 - protein, 10 aa, Entamoeba invadens
ARPARRARHA

SEQ ID NO: 2840334 - protein, 8 aa, Entamoeba invadens
ARPFNTSM

SEQ ID NO: 2840335 - protein, 7 aa, Entamoeba invadens
ARPFPKD

SEQ ID NO: 2840336 - protein, 6 aa, Entamoeba invadens
ARPGDN

SEQ ID NO: 2840337 - protein, 9 aa, Entamoeba invadens
ARPGSLSRG

SEQ ID NO: 2840338 - protein, 6 aa, Entamoeba invadens
ARPKKV

SEQ ID NO: 2840339 - protein, 36 aa, Entamoeba invadens
ARPLHTNTSGKAHNSSSQESDDVESSSVKGKPTGRM

SEQ ID NO: 2840340 - protein, 4 aa, Entamoeba invadens
ARPN

SEQ ID NO: 2840341 - protein, 5 aa, Entamoeba invadens
ARPPK

SEQ ID NO: 2840342 - protein, 65 aa, Entamoeba invadens
ARPPRERHESAQQGSQEGDNERRDERSGAPRRYGGYRNYENRYNRNYERSYERPYQRNDGEVREY

SEQ ID NO: 2840343 - protein, 48 aa, Entamoeba invadens
ARPPVDRSQRQPRQPRAPRQPREAAPRAEGEKAEAQAQEGSTQPRGYR

SEQ ID NO: 2840344 - protein, 23 aa, Entamoeba invadens
ARPVDKDKIRSSIYGNSSVDSTN

SEQ ID NO: 2840345 - protein, 42 aa, Entamoeba invadens
ARPVGAPRQPVSQTTNSISPEAKQNPTYQLTSSQKPSFEGQL

SEQ ID NO: 2840346 - protein, 5 aa, Entamoeba invadens
ARQAA

SEQ ID NO: 2840347 - protein, 8 aa, Entamoeba invadens
ARQHTRRQ

SEQ ID NO: 2840348 - protein, 18 aa, Entamoeba invadens
ARQKENKQNSLTSNNQQK

SEQ ID NO: 2840349 - protein, 5 aa, Entamoeba invadens
ARQNA

SEQ ID NO: 2840350 - protein, 7 aa, Entamoeba invadens
ARQPTEL

SEQ ID NO: 2840351 - protein, 6 aa, Entamoeba invadens
ARQQIK

SEQ ID NO: 2840352 - protein, 7 aa, Entamoeba invadens
ARQSTDC

SEQ ID NO: 2840353 - protein, 6 aa, Entamoeba invadens
ARQTGK

SEQ ID NO: 2840354 - protein, 4 aa, Entamoeba invadens
ARRD

SEQ ID NO: 2840355 - protein, 8 aa, Entamoeba invadens
ARRDGKVD

SEQ ID NO: 2840356 - protein, 9 aa, Entamoeba invadens
ARRDQDEQK

SEQ ID NO: 2840357 - protein, 6 aa, Entamoeba invadens
ARRNKP

SEQ ID NO: 2840358 - protein, 6 aa, Entamoeba invadens
ARRPRY

SEQ ID NO: 2840359 - protein, 11 aa, Entamoeba invadens
ARRQQERMEKG

SEQ ID NO: 2840360 - protein, 10 aa, Entamoeba invadens
ARRQSRGWTV

SEQ ID NO: 2840361 - protein, 22 aa, Entamoeba invadens
ARRRVESAKDLDNAVKSEVNDC

SEQ ID NO: 2840362 - protein, 6 aa, Entamoeba invadens
ARSDYN

SEQ ID NO: 2840363 - protein, 11 aa, Entamoeba invadens
ARSENNKMDSK

SEQ ID NO: 2840364 - protein, 5 aa, Entamoeba invadens
ARSGD

SEQ ID NO: 2840365 - protein, 5 aa, Entamoeba invadens
ARSGF

SEQ ID NO: 2840366 - protein, 6 aa, Entamoeba invadens
ARSLDE

SEQ ID NO: 2840367 - protein, 6 aa, Entamoeba invadens
ARSLRQ

SEQ ID NO: 2840368 - protein, 9 aa, Entamoeba invadens
ARSMPTSAA

SEQ ID NO: 2840369 - protein, 14 aa, Entamoeba invadens
ARSRIEKSIRERRG

SEQ ID NO: 2840370 - protein, 9 aa, Entamoeba invadens
ARSSTEGIS

SEQ ID NO: 2840371 - protein, 5 aa, Entamoeba invadens
ARSTG

SEQ ID NO: 2840372 - protein, 5 aa, Entamoeba invadens
ARSYK

SEQ ID NO: 2840373 - protein, 10 aa, Entamoeba invadens
ARTDETQERL

SEQ ID NO: 2840374 - protein, 14 aa, Entamoeba invadens
ARTETKEEKSQRNK

SEQ ID NO: 2840375 - protein, 5 aa, Entamoeba invadens
ARTGI

SEQ ID NO: 2840376 - protein, 8 aa, Entamoeba invadens
ARTGKSSI

SEQ ID NO: 2840377 - protein, 8 aa, Entamoeba invadens
ARTHDQSS

SEQ ID NO: 2840378 - protein, 10 aa, Entamoeba invadens
ARTKIEQANP

SEQ ID NO: 2840379 - protein, 15 aa, Entamoeba invadens
ARTKKGQAVKPGNAT

SEQ ID NO: 2840380 - protein, 4 aa, Entamoeba invadens
ARTN

SEQ ID NO: 2840381 - protein, 7 aa, Entamoeba invadens
ARTNAYS

SEQ ID NO: 2840382 - protein, 8 aa, Entamoeba invadens
ARTNSRNG

SEQ ID NO: 2840383 - protein, 6 aa, Entamoeba invadens
ARTSKI

SEQ ID NO: 2840384 - protein, 13 aa, Entamoeba invadens
ARTSKSEKRLIDE

SEQ ID NO: 2840385 - protein, 10 aa, Entamoeba invadens
ARTSPEEDGL

SEQ ID NO: 2840386 - protein, 5 aa, Entamoeba invadens
ARTST

SEQ ID NO: 2840387 - protein, 5 aa, Entamoeba invadens
ARTTT

SEQ ID NO: 2840388 - protein, 7 aa, Entamoeba invadens
ARTTTGA

SEQ ID NO: 2840389 - protein, 8 aa, Entamoeba invadens
ARVEPELP

SEQ ID NO: 2840390 - protein, 4 aa, Entamoeba invadens
ARVG

SEQ ID NO: 2840391 - protein, 8 aa, Entamoeba invadens
ARVGEEVN

SEQ ID NO: 2840392 - protein, 8 aa, Entamoeba invadens
ARVGNEAS

SEQ ID NO: 2840393 - protein, 12 aa, Entamoeba invadens
ARVNENASIENG

SEQ ID NO: 2840394 - protein, 7 aa, Entamoeba invadens
ARVPQNY

SEQ ID NO: 2840395 - protein, 4 aa, Entamoeba invadens
ARVT

SEQ ID NO: 2840396 - protein, 10 aa, Entamoeba invadens
ARYGATKITA

SEQ ID NO: 2840397 - protein, 6 aa, Entamoeba invadens
ARYPNM

SEQ ID NO: 2840398 - protein, 31 aa, Entamoeba invadens
ASAAGGSNVSVKKPQKARPKETASSSSNVDW

SEQ ID NO: 2840399 - protein, 9 aa, Entamoeba invadens
ASAANPTKI

SEQ ID NO: 2840400 - protein, 7 aa, Entamoeba invadens
ASADESS

SEQ ID NO: 2840401 - protein, 8 aa, Entamoeba invadens
ASAEQEDV

SEQ ID NO: 2840402 - protein, 7 aa, Entamoeba invadens
ASAGGEK

SEQ ID NO: 2840403 - protein, 4 aa, Entamoeba invadens
ASAK

SEQ ID NO: 2840404 - protein, 10 aa, Entamoeba invadens
ASAKTGNGVK

SEQ ID NO: 2840405 - protein, 7 aa, Entamoeba invadens
ASALKQT

SEQ ID NO: 2840406 - protein, 17 aa, Entamoeba invadens
ASAMDGRGSVYTRAGSA

SEQ ID NO: 2840407 - protein, 14 aa, Entamoeba invadens
ASANEKSRVTKSSL

SEQ ID NO: 2840408 - protein, 9 aa, Entamoeba invadens
ASANSESDA

SEQ ID NO: 2840409 - protein, 4 aa, Entamoeba invadens
ASAP

SEQ ID NO: 2840410 - protein, 5 aa, Entamoeba invadens
ASAPM

SEQ ID NO: 2840411 - protein, 9 aa, Entamoeba invadens
ASAPSFTAA

SEQ ID NO: 2840412 - protein, 16 aa, Entamoeba invadens
ASAQATAEATAKMQQE

SEQ ID NO: 2840413 - protein, 9 aa, Entamoeba invadens
ASASADKTV

SEQ ID NO: 2840414 - protein, 16 aa, Entamoeba invadens
ASASKIDGTLQTDEAT

SEQ ID NO: 2840415 - protein, 8 aa, Entamoeba invadens
ASASSDGY

SEQ ID NO: 2840416 - protein, 15 aa, Entamoeba invadens
ASATAKEAIKSGRPV

SEQ ID NO: 2840417 - protein, 11 aa, Entamoeba invadens
ASATGKYESVA

SEQ ID NO: 2840418 - protein, 6 aa, Entamoeba invadens
ASATPV

SEQ ID NO: 2840419 - protein, 7 aa, Entamoeba invadens
ASATTEG

SEQ ID NO: 2840420 - protein, 4 aa, Entamoeba invadens
ASCG

SEQ ID NO: 2840421 - protein, 19 aa, Entamoeba invadens
ASCHTPKPQTAVSENINST

SEQ ID NO: 2840422 - protein, 6 aa, Entamoeba invadens
ASCKEK

SEQ ID NO: 2840423 - protein, 5 aa, Entamoeba invadens
ASCPD

SEQ ID NO: 2840424 - protein, 9 aa, Entamoeba invadens
ASDDEDFID

SEQ ID NO: 2840425 - protein, 6 aa, Entamoeba invadens
ASDDHK

SEQ ID NO: 2840426 - protein, 7 aa, Entamoeba invadens
ASDDTRL

SEQ ID NO: 2840427 - protein, 7 aa, Entamoeba invadens
ASDEKWK

SEQ ID NO: 2840428 - protein, 7 aa, Entamoeba invadens
ASDERGI

SEQ ID NO: 2840429 - protein, 10 aa, Entamoeba invadens
ASDERGIDTI

SEQ ID NO: 2840430 - protein, 5 aa, Entamoeba invadens
ASDEY

SEQ ID NO: 2840431 - protein, 14 aa, Entamoeba invadens
ASDGENSRATYSAP

SEQ ID NO: 2840432 - protein, 7 aa, Entamoeba invadens
ASDGTGA

SEQ ID NO: 2840433 - protein, 12 aa, Entamoeba invadens
ASDIAAKPIQPP

SEQ ID NO: 2840434 - protein, 9 aa, Entamoeba invadens
ASDKEKADL

SEQ ID NO: 2840435 - protein, 6 aa, Entamoeba invadens
ASDKES

SEQ ID NO: 2840436 - protein, 6 aa, Entamoeba invadens
ASDKKS

SEQ ID NO: 2840437 - protein, 8 aa, Entamoeba invadens
ASDKNHDK

SEQ ID NO: 2840438 - protein, 5 aa, Entamoeba invadens
ASDLS

SEQ ID NO: 2840439 - protein, 6 aa, Entamoeba invadens
ASDLSV

SEQ ID NO: 2840440 - protein, 8 aa, Entamoeba invadens
ASDNKFTT

SEQ ID NO: 2840441 - protein, 5 aa, Entamoeba invadens
ASDNR

SEQ ID NO: 2840442 - protein, 25 aa, Entamoeba invadens
ASDPTRKCKQCNTGYYPKTSGDYKC

SEQ ID NO: 2840443 - protein, 7 aa, Entamoeba invadens
ASDREVH

SEQ ID NO: 2840444 - protein, 9 aa, Entamoeba invadens
ASDRPESVG

SEQ ID NO: 2840445 - protein, 12 aa, Entamoeba invadens
ASDRSISTNPQC

SEQ ID NO: 2840446 - protein, 6 aa, Entamoeba invadens
ASDSFD

SEQ ID NO: 2840447 - protein, 15 aa, Entamoeba invadens
ASDSSRNCTKCESGY

SEQ ID NO: 2840448 - protein, 24 aa, Entamoeba invadens
ASDTSDDGDVEEKEEADNGPEGEY

SEQ ID NO: 2840449 - protein, 9 aa, Entamoeba invadens
ASDTSQISP

SEQ ID NO: 2840450 - protein, 13 aa, Entamoeba invadens
ASDVRNKKSVSAE

SEQ ID NO: 2840451 - protein, 7 aa, Entamoeba invadens
ASDYKEK

SEQ ID NO: 2840452 - protein, 12 aa, Entamoeba invadens
ASDYSEKQKAME

SEQ ID NO: 2840453 - protein, 8 aa, Entamoeba invadens
ASEAAAGI

SEQ ID NO: 2840454 - protein, 21 aa, Entamoeba invadens
ASEAKNKIMKEKAGESYAQLF

SEQ ID NO: 2840455 - protein, 26 aa, Entamoeba invadens
ASEAQKDSKENKEDNKRQSKTLSQRL

SEQ ID NO: 2840456 - protein, 4 aa, Entamoeba invadens
ASEC

SEQ ID NO: 2840457 - protein, 10 aa, Entamoeba invadens
ASECDEEQKN

SEQ ID NO: 2840458 - protein, 7 aa, Entamoeba invadens
ASEDSKE

SEQ ID NO: 2840459 - protein, 10 aa, Entamoeba invadens
ASEDTNWEQR

SEQ ID NO: 2840460 - protein, 6 aa, Entamoeba invadens
ASEECK

SEQ ID NO: 2840461 - protein, 8 aa, Entamoeba invadens
ASEEKKGC

SEQ ID NO: 2840462 - protein, 16 aa, Entamoeba invadens
ASEELSEAEKALNTEV

SEQ ID NO: 2840463 - protein, 9 aa, Entamoeba invadens
ASEENLEPL

SEQ ID NO: 2840464 - protein, 7 aa, Entamoeba invadens
ASEESQF

SEQ ID NO: 2840465 - protein, 10 aa, Entamoeba invadens
ASEETKKKYP

SEQ ID NO: 2840466 - protein, 11 aa, Entamoeba invadens
ASEFTSPTPEV

SEQ ID NO: 2840467 - protein, 6 aa, Entamoeba invadens
ASEGVT

SEQ ID NO: 2840468 - protein, 15 aa, Entamoeba invadens
ASEKEEEKTEKPNDF

SEQ ID NO: 2840469 - protein, 19 aa, Entamoeba invadens
ASEKEQEIEKEIDSDLSQM

SEQ ID NO: 2840470 - protein, 10 aa, Entamoeba invadens
ASEKTNERTK

SEQ ID NO: 2840471 - protein, 4 aa, Entamoeba invadens
ASEL

SEQ ID NO: 2840472 - protein, 5 aa, Entamoeba invadens
ASELN

SEQ ID NO: 2840473 - protein, 6 aa, Entamoeba invadens
ASENFQ

SEQ ID NO: 2840474 - protein, 9 aa, Entamoeba invadens
ASENNDLDK

SEQ ID NO: 2840475 - protein, 5 aa, Entamoeba invadens
ASENS

SEQ ID NO: 2840476 - protein, 6 aa, Entamoeba invadens
ASENTD

SEQ ID NO: 2840477 - protein, 11 aa, Entamoeba invadens
ASERGKVGYGD

SEQ ID NO: 2840478 - protein, 12 aa, Entamoeba invadens
ASERISKTPQNL

SEQ ID NO: 2840479 - protein, 10 aa, Entamoeba invadens
ASERKDYEKR

SEQ ID NO: 2840480 - protein, 15 aa, Entamoeba invadens
ASERTDLSHTTTQQT

SEQ ID NO: 2840481 - protein, 10 aa, Entamoeba invadens
ASESDPQHDH

SEQ ID NO: 2840482 - protein, 9 aa, Entamoeba invadens
ASESSMIET

SEQ ID NO: 2840483 - protein, 53 aa, Entamoeba invadens
ASESTKNDNNVSKEKEQPKLSFKDESTKKVTKQKEQPKLSFAGESTKKETRPV

SEQ ID NO: 2840484 - protein, 12 aa, Entamoeba invadens
ASETIEIKTEKP

SEQ ID NO: 2840485 - protein, 7 aa, Entamoeba invadens
ASETTVV

SEQ ID NO: 2840486 - protein, 6 aa, Entamoeba invadens
ASETYN

SEQ ID NO: 2840487 - protein, 4 aa, Entamoeba invadens
ASEV

SEQ ID NO: 2840488 - protein, 13 aa, Entamoeba invadens
ASEVGRDNARTPM

SEQ ID NO: 2840489 - protein, 9 aa, Entamoeba invadens
ASEYAATNK

SEQ ID NO: 2840490 - protein, 12 aa, Entamoeba invadens
ASEYATNNKVAL

SEQ ID NO: 2840491 - protein, 8 aa, Entamoeba invadens
ASEYPKEY

SEQ ID NO: 2840492 - protein, 21 aa, Entamoeba invadens
ASFAPGAKPVCAPKRPCDPQK

SEQ ID NO: 2840493 - protein, 5 aa, Entamoeba invadens
ASFEK

SEQ ID NO: 2840494 - protein, 4 aa, Entamoeba invadens
ASFG

SEQ ID NO: 2840495 - protein, 14 aa, Entamoeba invadens
ASFGDKEKAATQAA

SEQ ID NO: 2840496 - protein, 8 aa, Entamoeba invadens
ASFKKTDY

SEQ ID NO: 2840497 - protein, 18 aa, Entamoeba invadens
ASFKPDLTNKENNFDQET

SEQ ID NO: 2840498 - protein, 7 aa, Entamoeba invadens
ASFQPNN

SEQ ID NO: 2840499 - protein, 6 aa, Entamoeba invadens
ASGAVN

SEQ ID NO: 2840500 - protein, 5 aa, Entamoeba invadens
ASGDE

SEQ ID NO: 2840501 - protein, 6 aa, Entamoeba invadens
ASGDFA

SEQ ID NO: 2840502 - protein, 9 aa, Entamoeba invadens
ASGDNSRGV

SEQ ID NO: 2840503 - protein, 35 aa, Entamoeba invadens
ASGDVPTEALDNSLNKNGSFTRKKTSDVKEERSAV

SEQ ID NO: 2840504 - protein, 10 aa, Entamoeba invadens
ASGDYSLNAS

SEQ ID NO: 2840505 - protein, 9 aa, Entamoeba invadens
ASGEETLQV

SEQ ID NO: 2840506 - protein, 9 aa, Entamoeba invadens
ASGERGGGV

SEQ ID NO: 2840507 - protein, 8 aa, Entamoeba invadens
ASGETAKC

SEQ ID NO: 2840508 - protein, 7 aa, Entamoeba invadens
ASGFDKK

SEQ ID NO: 2840509 - protein, 6 aa, Entamoeba invadens
ASGGYG

SEQ ID NO: 2840510 - protein, 5 aa, Entamoeba invadens
ASGHP

SEQ ID NO: 2840511 - protein, 7 aa, Entamoeba invadens
ASGHTAK

SEQ ID NO: 2840512 - protein, 16 aa, Entamoeba invadens
ASGKDGEITQLENATK

SEQ ID NO: 2840513 - protein, 23 aa, Entamoeba invadens
ASGLKKTSSVSSTSIAIGGTSAW

SEQ ID NO: 2840514 - protein, 6 aa, Entamoeba invadens
ASGLQK

SEQ ID NO: 2840515 - protein, 5 aa, Entamoeba invadens
ASGLR

SEQ ID NO: 2840516 - protein, 5 aa, Entamoeba invadens
ASGMK

SEQ ID NO: 2840517 - protein, 4 aa, Entamoeba invadens
ASGN

SEQ ID NO: 2840518 - protein, 6 aa, Entamoeba invadens
ASGNCE

SEQ ID NO: 2840519 - protein, 14 aa, Entamoeba invadens
ASGNGFKGKGSEYM

SEQ ID NO: 2840520 - protein, 15 aa, Entamoeba invadens
ASGNTSGVSIDSGDG

SEQ ID NO: 2840521 - protein, 10 aa, Entamoeba invadens
ASGQPKNEKS

SEQ ID NO: 2840522 - protein, 15 aa, Entamoeba invadens
ASGQSVSKRDEQKVY

SEQ ID NO: 2840523 - protein, 10 aa, Entamoeba invadens
ASGQTYKEKV

SEQ ID NO: 2840524 - protein, 5 aa, Entamoeba invadens
ASGRL

SEQ ID NO: 2840525 - protein, 6 aa, Entamoeba invadens
ASGRTD

SEQ ID NO: 2840526 - protein, 8 aa, Entamoeba invadens
ASGSLSSV

SEQ ID NO: 2840527 - protein, 5 aa, Entamoeba invadens
ASGSQ

SEQ ID NO: 2840528 - protein, 7 aa, Entamoeba invadens
ASGSTMT

SEQ ID NO: 2840529 - protein, 6 aa, Entamoeba invadens
ASGSTP

SEQ ID NO: 2840530 - protein, 6 aa, Entamoeba invadens
ASGSYD

SEQ ID NO: 2840531 - protein, 9 aa, Entamoeba invadens
ASGTIKPSS

SEQ ID NO: 2840532 - protein, 7 aa, Entamoeba invadens
ASGTTVS

SEQ ID NO: 2840533 - protein, 15 aa, Entamoeba invadens
ASHDKDGKAPTPDEI

SEQ ID NO: 2840534 - protein, 8 aa, Entamoeba invadens
ASHGEQMK

SEQ ID NO: 2840535 - protein, 9 aa, Entamoeba invadens
ASHLNRTGD

SEQ ID NO: 2840536 - protein, 9 aa, Entamoeba invadens
ASHNNLKPK

SEQ ID NO: 2840537 - protein, 7 aa, Entamoeba invadens
ASHSPIR

SEQ ID NO: 2840538 - protein, 6 aa, Entamoeba invadens
ASIDEQ

SEQ ID NO: 2840539 - protein, 17 aa, Entamoeba invadens
ASIDGTSQRLNTKLKSQ

SEQ ID NO: 2840540 - protein, 9 aa, Entamoeba invadens
ASIEGNRKD

SEQ ID NO: 2840541 - protein, 7 aa, Entamoeba invadens
ASIEQPS

SEQ ID NO: 2840542 - protein, 10 aa, Entamoeba invadens
ASIETTSIQT

SEQ ID NO: 2840543 - protein, 6 aa, Entamoeba invadens
ASIGHQ

SEQ ID NO: 2840544 - protein, 14 aa, Entamoeba invadens
ASINKYATSSLTAT

SEQ ID NO: 2840545 - protein, 4 aa, Entamoeba invadens
ASIS

SEQ ID NO: 2840546 - protein, 7 aa, Entamoeba invadens
ASISGNL

SEQ ID NO: 2840547 - protein, 13 aa, Entamoeba invadens
ASISYNSASKGAL

SEQ ID NO: 2840548 - protein, 6 aa, Entamoeba invadens
ASITSN

SEQ ID NO: 2840549 - protein, 10 aa, Entamoeba invadens
ASKADSMPEI

SEQ ID NO: 2840550 - protein, 13 aa, Entamoeba invadens
ASKASNQSELSSR

SEQ ID NO: 2840551 - protein, 49 aa, Entamoeba invadens
ASKCPEKKHGGDKKVENKGNNEKKKFGVKKNEKQSVKRTLTTKKFGAKK

SEQ ID NO: 2840552 - protein, 8 aa, Entamoeba invadens
ASKDEDVR

SEQ ID NO: 2840553 - protein, 6 aa, Entamoeba invadens
ASKDKV

SEQ ID NO: 2840554 - protein, 7 aa, Entamoeba invadens
ASKDNRV

SEQ ID NO: 2840555 - protein, 7 aa, Entamoeba invadens
ASKDSTV

SEQ ID NO: 2840556 - protein, 26 aa, Entamoeba invadens
ASKEEERKKLKEEEMKKPKAAKPVYN

SEQ ID NO: 2840557 - protein, 12 aa, Entamoeba invadens
ASKEKTKEKYAQ

SEQ ID NO: 2840558 - protein, 10 aa, Entamoeba invadens
ASKEKTLKKA

SEQ ID NO: 2840559 - protein, 6 aa, Entamoeba invadens
ASKEKY

SEQ ID NO: 2840560 - protein, 6 aa, Entamoeba invadens
ASKENR

SEQ ID NO: 2840561 - protein, 6 aa, Entamoeba invadens
ASKETY

SEQ ID NO: 2840562 - protein, 9 aa, Entamoeba invadens
ASKEYDLGD

SEQ ID NO: 2840563 - protein, 9 aa, Entamoeba invadens
ASKGGNADA

SEQ ID NO: 2840564 - protein, 5 aa, Entamoeba invadens
ASKGI

SEQ ID NO: 2840565 - protein, 8 aa, Entamoeba invadens
ASKINPRE

SEQ ID NO: 2840566 - protein, 8 aa, Entamoeba invadens
ASKITKND

SEQ ID NO: 2840567 - protein, 8 aa, Entamoeba invadens
ASKKDDQI

SEQ ID NO: 2840568 - protein, 9 aa, Entamoeba invadens
ASKKDERFE

SEQ ID NO: 2840569 - protein, 11 aa, Entamoeba invadens
ASKKEEETKGI

SEQ ID NO: 2840570 - protein, 8 aa, Entamoeba invadens
ASKKELYD

SEQ ID NO: 2840571 - protein, 20 aa, Entamoeba invadens
ASKKGHVQASQRITFLDHDI

SEQ ID NO: 2840572 - protein, 10 aa, Entamoeba invadens
ASKKQRDNEN

SEQ ID NO: 2840573 - protein, 14 aa, Entamoeba invadens
ASKKRTDKKSDASD

SEQ ID NO: 2840574 - protein, 10 aa, Entamoeba invadens
ASKKVDNQRI

SEQ ID NO: 2840575 - protein, 6 aa, Entamoeba invadens
ASKLNN

SEQ ID NO: 2840576 - protein, 5 aa, Entamoeba invadens
ASKLS

SEQ ID NO: 2840577 - protein, 8 aa, Entamoeba invadens
ASKNIEKL

SEQ ID NO: 2840578 - protein, 12 aa, Entamoeba invadens
ASKNKERENRNI

SEQ ID NO: 2840579 - protein, 7 aa, Entamoeba invadens
ASKNRKI

SEQ ID NO: 2840580 - protein, 9 aa, Entamoeba invadens
ASKQRKKNL

SEQ ID NO: 2840581 - protein, 22 aa, Entamoeba invadens
ASKQTAETSTAKKGVKRRRQID

SEQ ID NO: 2840582 - protein, 5 aa, Entamoeba invadens
ASKQY

SEQ ID NO: 2840583 - protein, 8 aa, Entamoeba invadens
ASKRSALE

SEQ ID NO: 2840584 - protein, 8 aa, Entamoeba invadens
ASKSEHIT

SEQ ID NO: 2840585 - protein, 11 aa, Entamoeba invadens
ASKSETLSSRS

SEQ ID NO: 2840586 - protein, 21 aa, Entamoeba invadens
ASKSLKVSNPYKFTRSPTTTV

SEQ ID NO: 2840587 - protein, 6 aa, Entamoeba invadens
ASKSLN

SEQ ID NO: 2840588 - protein, 11 aa, Entamoeba invadens
ASKSPNEDRRA

SEQ ID NO: 2840589 - protein, 14 aa, Entamoeba invadens
ASKSSENAKKGYSD

SEQ ID NO: 2840590 - protein, 7 aa, Entamoeba invadens
ASKSSTL

SEQ ID NO: 2840591 - protein, 12 aa, Entamoeba invadens
ASKSYTINSDGV

SEQ ID NO: 2840592 - protein, 19 aa, Entamoeba invadens
ASKTDSVEQLKENTKRMKE

SEQ ID NO: 2840593 - protein, 8 aa, Entamoeba invadens
ASKTEYIK

SEQ ID NO: 2840594 - protein, 5 aa, Entamoeba invadens
ASKTM

SEQ ID NO: 2840595 - protein, 13 aa, Entamoeba invadens
ASKTPDGKPLELE

SEQ ID NO: 2840596 - protein, 7 aa, Entamoeba invadens
ASKTQIG

SEQ ID NO: 2840597 - protein, 12 aa, Entamoeba invadens
ASKTSKKKNERK

SEQ ID NO: 2840598 - protein, 12 aa, Entamoeba invadens
ASKTTQLTVNSE

SEQ ID NO: 2840599 - protein, 14 aa, Entamoeba invadens
ASKYKNSAKFSDIE

SEQ ID NO: 2840600 - protein, 7 aa, Entamoeba invadens
ASLDAGK

SEQ ID NO: 2840601 - protein, 11 aa, Entamoeba invadens
ASLDAYDGDHS

SEQ ID NO: 2840602 - protein, 18 aa, Entamoeba invadens
ASLDNISGKWKPEVEQHC

SEQ ID NO: 2840603 - protein, 7 aa, Entamoeba invadens
ASLDPKA

SEQ ID NO: 2840604 - protein, 4 aa, Entamoeba invadens
ASLE

SEQ ID NO: 2840605 - protein, 11 aa, Entamoeba invadens
ASLEPQTQSGT

SEQ ID NO: 2840606 - protein, 12 aa, Entamoeba invadens
ASLERSKVHTNT

SEQ ID NO: 2840607 - protein, 4 aa, Entamoeba invadens
ASLG

SEQ ID NO: 2840608 - protein, 9 aa, Entamoeba invadens
ASLGDKSSN

SEQ ID NO: 2840609 - protein, 14 aa, Entamoeba invadens
ASLGDTNSGESKIS

SEQ ID NO: 2840610 - protein, 5 aa, Entamoeba invadens
ASLGK

SEQ ID NO: 2840611 - protein, 56 aa, Entamoeba invadens
ASLKSPALPEKGVQQITEKEKLQPTLQKTPEKVTTTLQNTPVATVTKTTQQTQNTV

SEQ ID NO: 2840612 - protein, 9 aa, Entamoeba invadens
ASLKTQEAT

SEQ ID NO: 2840613 - protein, 12 aa, Entamoeba invadens
ASLNATAKTAGV

SEQ ID NO: 2840614 - protein, 5 aa, Entamoeba invadens
ASLNN

SEQ ID NO: 2840615 - protein, 12 aa, Entamoeba invadens
ASLNPDKPNYFG

SEQ ID NO: 2840616 - protein, 4 aa, Entamoeba invadens
ASLP

SEQ ID NO: 2840617 - protein, 5 aa, Entamoeba invadens
ASLPD

SEQ ID NO: 2840618 - protein, 18 aa, Entamoeba invadens
ASLPSSPLTHSSSPKLEK

SEQ ID NO: 2840619 - protein, 7 aa, Entamoeba invadens
ASLPTKS

SEQ ID NO: 2840620 - protein, 10 aa, Entamoeba invadens
ASLQKPYSSD

SEQ ID NO: 2840621 - protein, 26 aa, Entamoeba invadens
ASLRSAGTSASSATKQSTTSSNEDVD

SEQ ID NO: 2840622 - protein, 10 aa, Entamoeba invadens
ASLSKSKSFD

SEQ ID NO: 2840623 - protein, 8 aa, Entamoeba invadens
ASLSQEDV

SEQ ID NO: 2840624 - protein, 12 aa, Entamoeba invadens
ASLSSDEDAEVY

SEQ ID NO: 2840625 - protein, 4 aa, Entamoeba invadens
ASLT

SEQ ID NO: 2840626 - protein, 6 aa, Entamoeba invadens
ASLTSI

SEQ ID NO: 2840627 - protein, 16 aa, Entamoeba invadens
ASMGEGNATYNEEEEL

SEQ ID NO: 2840628 - protein, 7 aa, Entamoeba invadens
ASMGGVG

SEQ ID NO: 2840629 - protein, 9 aa, Entamoeba invadens
ASMKDGPHR

SEQ ID NO: 2840630 - protein, 5 aa, Entamoeba invadens
ASMQA

SEQ ID NO: 2840631 - protein, 7 aa, Entamoeba invadens
ASMTSSI

SEQ ID NO: 2840632 - protein, 22 aa, Entamoeba invadens
ASNADEDAEEGAAGEGLDAPGV

SEQ ID NO: 2840633 - protein, 49 aa, Entamoeba invadens
ASNAGSQPMAQQPASYSQPQMGGAVSQPVAQQQEPEAAGDQKTTTSTQV

SEQ ID NO: 2840634 - protein, 5 aa, Entamoeba invadens
ASNDS

SEQ ID NO: 2840635 - protein, 7 aa, Entamoeba invadens
ASNEEED

SEQ ID NO: 2840636 - protein, 7 aa, Entamoeba invadens
ASNEETL

SEQ ID NO: 2840637 - protein, 7 aa, Entamoeba invadens
ASNEIND

SEQ ID NO: 2840638 - protein, 6 aa, Entamoeba invadens
ASNERG

SEQ ID NO: 2840639 - protein, 7 aa, Entamoeba invadens
ASNETDV

SEQ ID NO: 2840640 - protein, 7 aa, Entamoeba invadens
ASNETEK

SEQ ID NO: 2840641 - protein, 4 aa, Entamoeba invadens
ASNG

SEQ ID NO: 2840642 - protein, 6 aa, Entamoeba invadens
ASNGER

SEQ ID NO: 2840643 - protein, 9 aa, Entamoeba invadens
ASNGPTKLR

SEQ ID NO: 2840644 - protein, 5 aa, Entamoeba invadens
ASNGV

SEQ ID NO: 2840645 - protein, 13 aa, Entamoeba invadens
ASNIIGDKGRRIR

SEQ ID NO: 2840646 - protein, 4 aa, Entamoeba invadens
ASNK

SEQ ID NO: 2840647 - protein, 8 aa, Entamoeba invadens
ASNKQTLS

SEQ ID NO: 2840648 - protein, 10 aa, Entamoeba invadens
ASNKRTTGMS

SEQ ID NO: 2840649 - protein, 8 aa, Entamoeba invadens
ASNKSPPF

SEQ ID NO: 2840650 - protein, 8 aa, Entamoeba invadens
ASNKTDVA

SEQ ID NO: 2840651 - protein, 8 aa, Entamoeba invadens
ASNKTEVA

SEQ ID NO: 2840652 - protein, 6 aa, Entamoeba invadens
ASNNET

SEQ ID NO: 2840653 - protein, 15 aa, Entamoeba invadens
ASNNPSNRAGSKAYM

SEQ ID NO: 2840654 - protein, 7 aa, Entamoeba invadens
ASNPNTT

SEQ ID NO: 2840655 - protein, 5 aa, Entamoeba invadens
ASNPQ

SEQ ID NO: 2840656 - protein, 9 aa, Entamoeba invadens
ASNSATSTH

SEQ ID NO: 2840657 - protein, 5 aa, Entamoeba invadens
ASNSN

SEQ ID NO: 2840658 - protein, 6 aa, Entamoeba invadens
ASNTGD

SEQ ID NO: 2840659 - protein, 6 aa, Entamoeba invadens
ASNTGS

SEQ ID NO: 2840660 - protein, 12 aa, Entamoeba invadens
ASNTPNSNDKFG

SEQ ID NO: 2840661 - protein, 7 aa, Entamoeba invadens
ASNTSLE

SEQ ID NO: 2840662 - protein, 8 aa, Entamoeba invadens
ASNYEPEE

SEQ ID NO: 2840663 - protein, 6 aa, Entamoeba invadens
ASNYGN

SEQ ID NO: 2840664 - protein, 5 aa, Entamoeba invadens
ASNYS

SEQ ID NO: 2840665 - protein, 11 aa, Entamoeba invadens
ASPDADNGYDI

SEQ ID NO: 2840666 - protein, 9 aa, Entamoeba invadens
ASPEIKEEI

SEQ ID NO: 2840667 - protein, 4 aa, Entamoeba invadens
ASPF

SEQ ID NO: 2840668 - protein, 5 aa, Entamoeba invadens
ASPHE

SEQ ID NO: 2840669 - protein, 7 aa, Entamoeba invadens
ASPKPDV

SEQ ID NO: 2840670 - protein, 4 aa, Entamoeba invadens
ASPL

SEQ ID NO: 2840671 - protein, 38 aa, Entamoeba invadens
ASPLFRSGPSPYQMSSPQNFASPNFASPQLSRPTPPFT

SEQ ID NO: 2840672 - protein, 8 aa, Entamoeba invadens
ASPNQNTL

SEQ ID NO: 2840673 - protein, 7 aa, Entamoeba invadens
ASPNSDV

SEQ ID NO: 2840674 - protein, 7 aa, Entamoeba invadens
ASPQGKN

SEQ ID NO: 2840675 - protein, 21 aa, Entamoeba invadens
ASPRFAEAKNNDVANEKRPVE

SEQ ID NO: 2840676 - protein, 10 aa, Entamoeba invadens
ASPSLGGASP

SEQ ID NO: 2840677 - protein, 6 aa, Entamoeba invadens
ASPSQR

SEQ ID NO: 2840678 - protein, 10 aa, Entamoeba invadens
ASPSRQLPGN

SEQ ID NO: 2840679 - protein, 13 aa, Entamoeba invadens
ASPSTAEYPHPST

SEQ ID NO: 2840680 - protein, 6 aa, Entamoeba invadens
ASPSVA

SEQ ID NO: 2840681 - protein, 6 aa, Entamoeba invadens
ASPTME

SEQ ID NO: 2840682 - protein, 10 aa, Entamoeba invadens
ASPTPEQKIS

SEQ ID NO: 2840683 - protein, 4 aa, Entamoeba invadens
ASPV

SEQ ID NO: 2840684 - protein, 5 aa, Entamoeba invadens
ASPYD

SEQ ID NO: 2840685 - protein, 7 aa, Entamoeba invadens
ASQANTV

SEQ ID NO: 2840686 - protein, 7 aa, Entamoeba invadens
ASQASAV

SEQ ID NO: 2840687 - protein, 4 aa, Entamoeba invadens
ASQC

SEQ ID NO: 2840688 - protein, 14 aa, Entamoeba invadens
ASQDPFKEDTFDPQ

SEQ ID NO: 2840689 - protein, 5 aa, Entamoeba invadens
ASQDS

SEQ ID NO: 2840690 - protein, 5 aa, Entamoeba invadens
ASQEM

SEQ ID NO: 2840691 - protein, 11 aa, Entamoeba invadens
ASQKGNDKNTD

SEQ ID NO: 2840692 - protein, 6 aa, Entamoeba invadens
ASQKPL

SEQ ID NO: 2840693 - protein, 8 aa, Entamoeba invadens
ASQKRKNI

SEQ ID NO: 2840694 - protein, 5 aa, Entamoeba invadens
ASQKT

SEQ ID NO: 2840695 - protein, 8 aa, Entamoeba invadens
ASQKTALR

SEQ ID NO: 2840696 - protein, 6 aa, Entamoeba invadens
ASQMSS

SEQ ID NO: 2840697 - protein, 4 aa, Entamoeba invadens
ASQN

SEQ ID NO: 2840698 - protein, 8 aa, Entamoeba invadens
ASQNASSI

SEQ ID NO: 2840699 - protein, 7 aa, Entamoeba invadens
ASQNGSG

SEQ ID NO: 2840700 - protein, 6 aa, Entamoeba invadens
ASQNNN

SEQ ID NO: 2840701 - protein, 5 aa, Entamoeba invadens
ASQPT

SEQ ID NO: 2840702 - protein, 19 aa, Entamoeba invadens
ASQPTSKNQIDSAKRLSQK

SEQ ID NO: 2840703 - protein, 10 aa, Entamoeba invadens
ASQQEQRPAI

SEQ ID NO: 2840704 - protein, 13 aa, Entamoeba invadens
ASQQGQAAPPPVP

SEQ ID NO: 2840705 - protein, 20 aa, Entamoeba invadens
ASQQKEPPKDLQVKSPREDI

SEQ ID NO: 2840706 - protein, 23 aa, Entamoeba invadens
ASQQNQNRRTQDQQERRRDEGPT

SEQ ID NO: 2840707 - protein, 5 aa, Entamoeba invadens
ASQQS

SEQ ID NO: 2840708 - protein, 5 aa, Entamoeba invadens
ASQQT

SEQ ID NO: 2840709 - protein, 4 aa, Entamoeba invadens
ASQR

SEQ ID NO: 2840710 - protein, 15 aa, Entamoeba invadens
ASQRPQQNANARNIT

SEQ ID NO: 2840711 - protein, 5 aa, Entamoeba invadens
ASQSV

SEQ ID NO: 2840712 - protein, 15 aa, Entamoeba invadens
ASQTEESSDCQLRLR

SEQ ID NO: 2840713 - protein, 8 aa, Entamoeba invadens
ASQTKSIE

SEQ ID NO: 2840714 - protein, 6 aa, Entamoeba invadens
ASQTQN

SEQ ID NO: 2840715 - protein, 7 aa, Entamoeba invadens
ASQYTQN

SEQ ID NO: 2840716 - protein, 68 aa, Entamoeba invadens
ASRANRGGGAHAPPSRGGMQRSAPPPSRAMPPRGGAPRGGRGGRGGMPPPQQYEEPQEEQQEEEQPQQ

SEQ ID NO: 2840717 - protein, 4 aa, Entamoeba invadens
ASRE

SEQ ID NO: 2840718 - protein, 9 aa, Entamoeba invadens
ASREQRNLQ

SEQ ID NO: 2840719 - protein, 9 aa, Entamoeba invadens
ASRESRNFQ

SEQ ID NO: 2840720 - protein, 5 aa, Entamoeba invadens
ASRGK

SEQ ID NO: 2840721 - protein, 6 aa, Entamoeba invadens
ASRGLD

SEQ ID NO: 2840722 - protein, 9 aa, Entamoeba invadens
ASRKKAGKK

SEQ ID NO: 2840723 - protein, 7 aa, Entamoeba invadens
ASRKRKS

SEQ ID NO: 2840724 - protein, 4 aa, Entamoeba invadens
ASRL

SEQ ID NO: 2840725 - protein, 5 aa, Entamoeba invadens
ASRMS

SEQ ID NO: 2840726 - protein, 6 aa, Entamoeba invadens
ASRNDG

SEQ ID NO: 2840727 - protein, 5 aa, Entamoeba invadens
ASRNE

SEQ ID NO: 2840728 - protein, 6 aa, Entamoeba invadens
ASRNGH

SEQ ID NO: 2840729 - protein, 9 aa, Entamoeba invadens
ASRNGSSIT

SEQ ID NO: 2840730 - protein, 10 aa, Entamoeba invadens
ASRPDRISGA

SEQ ID NO: 2840731 - protein, 15 aa, Entamoeba invadens
ASRQKDVPQQEPLPS

SEQ ID NO: 2840732 - protein, 9 aa, Entamoeba invadens
ASRQQAQGN

SEQ ID NO: 2840733 - protein, 17 aa, Entamoeba invadens
ASRSAAKYINGRKYKGH

SEQ ID NO: 2840734 - protein, 5 aa, Entamoeba invadens
ASRSF

SEQ ID NO: 2840735 - protein, 8 aa, Entamoeba invadens
ASRSSLDE

SEQ ID NO: 2840736 - protein, 10 aa, Entamoeba invadens
ASRTAMKKGP

SEQ ID NO: 2840737 - protein, 7 aa, Entamoeba invadens
ASRTDKL

SEQ ID NO: 2840738 - protein, 26 aa, Entamoeba invadens
ASRVSSVSRQSSFSTNLKDPRRQQYT

SEQ ID NO: 2840739 - protein, 4 aa, Entamoeba invadens
ASSA

SEQ ID NO: 2840740 - protein, 13 aa, Entamoeba invadens
ASSAAQKQQMAQQ

SEQ ID NO: 2840741 - protein, 7 aa, Entamoeba invadens
ASSAFDE

SEQ ID NO: 2840742 - protein, 7 aa, Entamoeba invadens
ASSAFPE

SEQ ID NO: 2840743 - protein, 12 aa, Entamoeba invadens
ASSAQGDSVTTV

SEQ ID NO: 2840744 - protein, 4 aa, Entamoeba invadens
ASSC

SEQ ID NO: 2840745 - protein, 7 aa, Entamoeba invadens
ASSDGYL

SEQ ID NO: 2840746 - protein, 19 aa, Entamoeba invadens
ASSDPNRAVPPNIPLPEAF

SEQ ID NO: 2840747 - protein, 4 aa, Entamoeba invadens
ASSE

SEQ ID NO: 2840748 - protein, 6 aa, Entamoeba invadens
ASSEAW

SEQ ID NO: 2840749 - protein, 6 aa, Entamoeba invadens
ASSEGT

SEQ ID NO: 2840750 - protein, 6 aa, Entamoeba invadens
ASSELL

SEQ ID NO: 2840751 - protein, 7 aa, Entamoeba invadens
ASSEPIP

SEQ ID NO: 2840752 - protein, 8 aa, Entamoeba invadens
ASSEQCKK

SEQ ID NO: 2840753 - protein, 10 aa, Entamoeba invadens
ASSEQPFVST

SEQ ID NO: 2840754 - protein, 21 aa, Entamoeba invadens
ASSGERKCNTCTNKTHTDDTG

SEQ ID NO: 2840755 - protein, 12 aa, Entamoeba invadens
ASSGKKADQAMS

SEQ ID NO: 2840756 - protein, 7 aa, Entamoeba invadens
ASSGYIP

SEQ ID NO: 2840757 - protein, 8 aa, Entamoeba invadens
ASSHSTTQ

SEQ ID NO: 2840758 - protein, 7 aa, Entamoeba invadens
ASSINGS

SEQ ID NO: 2840759 - protein, 6 aa, Entamoeba invadens
ASSISD

SEQ ID NO: 2840760 - protein, 5 aa, Entamoeba invadens
ASSKD

SEQ ID NO: 2840761 - protein, 6 aa, Entamoeba invadens
ASSKER

SEQ ID NO: 2840762 - protein, 6 aa, Entamoeba invadens
ASSKGL

SEQ ID NO: 2840763 - protein, 5 aa, Entamoeba invadens
ASSKP

SEQ ID NO: 2840764 - protein, 7 aa, Entamoeba invadens
ASSKTQQ

SEQ ID NO: 2840765 - protein, 6 aa, Entamoeba invadens
ASSLLG

SEQ ID NO: 2840766 - protein, 7 aa, Entamoeba invadens
ASSMQTV

SEQ ID NO: 2840767 - protein, 4 aa, Entamoeba invadens
ASSP

SEQ ID NO: 2840768 - protein, 6 aa, Entamoeba invadens
ASSPLT

SEQ ID NO: 2840769 - protein, 8 aa, Entamoeba invadens
ASSPYTST

SEQ ID NO: 2840770 - protein, 20 aa, Entamoeba invadens
ASSQARESKSRPQTPQSPPS

SEQ ID NO: 2840771 - protein, 10 aa, Entamoeba invadens
ASSQDCARNG

SEQ ID NO: 2840772 - protein, 16 aa, Entamoeba invadens
ASSQDKPDYKKVEAET

SEQ ID NO: 2840773 - protein, 10 aa, Entamoeba invadens
ASSQDVTLQP

SEQ ID NO: 2840774 - protein, 6 aa, Entamoeba invadens
ASSQTG

SEQ ID NO: 2840775 - protein, 13 aa, Entamoeba invadens
ASSQTIYSSGKPI

SEQ ID NO: 2840776 - protein, 7 aa, Entamoeba invadens
ASSSDLL

SEQ ID NO: 2840777 - protein, 7 aa, Entamoeba invadens
ASSSPRR

SEQ ID NO: 2840778 - protein, 6 aa, Entamoeba invadens
ASSSQL

SEQ ID NO: 2840779 - protein, 18 aa, Entamoeba invadens
ASSSSATEHKNTKKRGTL

SEQ ID NO: 2840780 - protein, 27 aa, Entamoeba invadens
ASSSSPQFTTPQKSQQKEMRQSTPNTF

SEQ ID NO: 2840781 - protein, 7 aa, Entamoeba invadens
ASSSSQV

SEQ ID NO: 2840782 - protein, 8 aa, Entamoeba invadens
ASSSTLSF

SEQ ID NO: 2840783 - protein, 7 aa, Entamoeba invadens
ASSSWKE

SEQ ID NO: 2840784 - protein, 11 aa, Entamoeba invadens
ASSTATGARYS

SEQ ID NO: 2840785 - protein, 11 aa, Entamoeba invadens
ASSTKRNDAEL

SEQ ID NO: 2840786 - protein, 9 aa, Entamoeba invadens
ASSTNELLG

SEQ ID NO: 2840787 - protein, 9 aa, Entamoeba invadens
ASSVGGPDD

SEQ ID NO: 2840788 - protein, 20 aa, Entamoeba invadens
ASSVKGKKMIQTDGHINESD

SEQ ID NO: 2840789 - protein, 8 aa, Entamoeba invadens
ASSVKGRK

SEQ ID NO: 2840790 - protein, 4 aa, Entamoeba invadens
ASTD

SEQ ID NO: 2840791 - protein, 5 aa, Entamoeba invadens
ASTDG

SEQ ID NO: 2840792 - protein, 8 aa, Entamoeba invadens
ASTDTTAK

SEQ ID NO: 2840793 - protein, 9 aa, Entamoeba invadens
ASTEALSPC

SEQ ID NO: 2840794 - protein, 27 aa, Entamoeba invadens
ASTEEDRSTRSSETRRINKEKKPRREI

SEQ ID NO: 2840795 - protein, 13 aa, Entamoeba invadens
ASTEKLDDDDKDE

SEQ ID NO: 2840796 - protein, 6 aa, Entamoeba invadens
ASTEQL

SEQ ID NO: 2840797 - protein, 7 aa, Entamoeba invadens
ASTFTNT

SEQ ID NO: 2840798 - protein, 6 aa, Entamoeba invadens
ASTGAH

SEQ ID NO: 2840799 - protein, 8 aa, Entamoeba invadens
ASTGGGPV

SEQ ID NO: 2840800 - protein, 5 aa, Entamoeba invadens
ASTGK

SEQ ID NO: 2840801 - protein, 6 aa, Entamoeba invadens
ASTGNR

SEQ ID NO: 2840802 - protein, 6 aa, Entamoeba invadens
ASTGYY

SEQ ID NO: 2840803 - protein, 5 aa, Entamoeba invadens
ASTHQ

SEQ ID NO: 2840804 - protein, 4 aa, Entamoeba invadens
ASTI

SEQ ID NO: 2840805 - protein, 13 aa, Entamoeba invadens
ASTINTTNNDLSE

SEQ ID NO: 2840806 - protein, 7 aa, Entamoeba invadens
ASTIPNA

SEQ ID NO: 2840807 - protein, 6 aa, Entamoeba invadens
ASTITE

SEQ ID NO: 2840808 - protein, 7 aa, Entamoeba invadens
ASTKGSE

SEQ ID NO: 2840809 - protein, 8 aa, Entamoeba invadens
ASTKNGIR

SEQ ID NO: 2840810 - protein, 8 aa, Entamoeba invadens
ASTKQSHD

SEQ ID NO: 2840811 - protein, 4 aa, Entamoeba invadens
ASTL

SEQ ID NO: 2840812 - protein, 8 aa, Entamoeba invadens
ASTLGGMT

SEQ ID NO: 2840813 - protein, 9 aa, Entamoeba invadens
ASTNDKDYQ

SEQ ID NO: 2840814 - protein, 6 aa, Entamoeba invadens
ASTNID

SEQ ID NO: 2840815 - protein, 8 aa, Entamoeba invadens
ASTNNNTT

SEQ ID NO: 2840816 - protein, 6 aa, Entamoeba invadens
ASTPSV

SEQ ID NO: 2840817 - protein, 18 aa, Entamoeba invadens
ASTPTHPSQQYQTQPSFQ

SEQ ID NO: 2840818 - protein, 10 aa, Entamoeba invadens
ASTQGKSEAI

SEQ ID NO: 2840819 - protein, 5 aa, Entamoeba invadens
ASTQK

SEQ ID NO: 2840820 - protein, 8 aa, Entamoeba invadens
ASTQNTEY

SEQ ID NO: 2840821 - protein, 10 aa, Entamoeba invadens
ASTQPLPDIG

SEQ ID NO: 2840822 - protein, 8 aa, Entamoeba invadens
ASTRDKIA

SEQ ID NO: 2840823 - protein, 5 aa, Entamoeba invadens
ASTRL

SEQ ID NO: 2840824 - protein, 6 aa, Entamoeba invadens
ASTRRE

SEQ ID NO: 2840825 - protein, 5 aa, Entamoeba invadens
ASTSD

SEQ ID NO: 2840826 - protein, 10 aa, Entamoeba invadens
ASTSDSEQQY

SEQ ID NO: 2840827 - protein, 14 aa, Entamoeba invadens
ASTSESVDTNFTPL

SEQ ID NO: 2840828 - protein, 9 aa, Entamoeba invadens
ASTSHNPDM

SEQ ID NO: 2840829 - protein, 13 aa, Entamoeba invadens
ASTSLNSKVVNQS

SEQ ID NO: 2840830 - protein, 7 aa, Entamoeba invadens
ASTTDGK

SEQ ID NO: 2840831 - protein, 10 aa, Entamoeba invadens
ASTTDPKKYP

SEQ ID NO: 2840832 - protein, 6 aa, Entamoeba invadens
ASTTKT

SEQ ID NO: 2840833 - protein, 16 aa, Entamoeba invadens
ASTTSVSSATGFKNGT

SEQ ID NO: 2840834 - protein, 4 aa, Entamoeba invadens
ASTY

SEQ ID NO: 2840835 - protein, 34 aa, Entamoeba invadens
ASVAKEKEKDKDKKRERKGSQSEDERKENEKKEM

SEQ ID NO: 2840836 - protein, 10 aa, Entamoeba invadens
ASVDRDAAQQ

SEQ ID NO: 2840837 - protein, 4 aa, Entamoeba invadens
ASVE

SEQ ID NO: 2840838 - protein, 7 aa, Entamoeba invadens
ASVEEGK

SEQ ID NO: 2840839 - protein, 10 aa, Entamoeba invadens
ASVEEISDAK

SEQ ID NO: 2840840 - protein, 7 aa, Entamoeba invadens
ASVENDK

SEQ ID NO: 2840841 - protein, 7 aa, Entamoeba invadens
ASVGALD

SEQ ID NO: 2840842 - protein, 5 aa, Entamoeba invadens
ASVGC

SEQ ID NO: 2840843 - protein, 5 aa, Entamoeba invadens
ASVGK

SEQ ID NO: 2840844 - protein, 22 aa, Entamoeba invadens
ASVGQTYKGKPLSDVAAEKGQM

SEQ ID NO: 2840845 - protein, 8 aa, Entamoeba invadens
ASVGRSKH

SEQ ID NO: 2840846 - protein, 10 aa, Entamoeba invadens
ASVGSTSDSL

SEQ ID NO: 2840847 - protein, 20 aa, Entamoeba invadens
ASVKNQKTKEIVQKIKTAVG

SEQ ID NO: 2840848 - protein, 7 aa, Entamoeba invadens
ASVKSSL

SEQ ID NO: 2840849 - protein, 6 aa, Entamoeba invadens
ASVLPP

SEQ ID NO: 2840850 - protein, 4 aa, Entamoeba invadens
ASVN

SEQ ID NO: 2840851 - protein, 9 aa, Entamoeba invadens
ASVPGEGEH

SEQ ID NO: 2840852 - protein, 8 aa, Entamoeba invadens
ASVSLENG

SEQ ID NO: 2840853 - protein, 8 aa, Entamoeba invadens
ASVSTKAA

SEQ ID NO: 2840854 - protein, 6 aa, Entamoeba invadens
ASVTFS

SEQ ID NO: 2840855 - protein, 7 aa, Entamoeba invadens
ASVYTAT

SEQ ID NO: 2840856 - protein, 7 aa, Entamoeba invadens
ASWQNPY

SEQ ID NO: 2840857 - protein, 5 aa, Entamoeba invadens
ASYAA

SEQ ID NO: 2840858 - protein, 6 aa, Entamoeba invadens
ASYDKK

SEQ ID NO: 2840859 - protein, 6 aa, Entamoeba invadens
ASYDRA

SEQ ID NO: 2840860 - protein, 4 aa, Entamoeba invadens
ASYE

SEQ ID NO: 2840861 - protein, 14 aa, Entamoeba invadens
ASYEKAIRKAKDKV

SEQ ID NO: 2840862 - protein, 10 aa, Entamoeba invadens
ASYGTPSTFQ

SEQ ID NO: 2840863 - protein, 6 aa, Entamoeba invadens
ASYKKH

SEQ ID NO: 2840864 - protein, 4 aa, Entamoeba invadens
ASYN

SEQ ID NO: 2840865 - protein, 5 aa, Entamoeba invadens
ASYNY

SEQ ID NO: 2840866 - protein, 5 aa, Entamoeba invadens
ASYPS

SEQ ID NO: 2840867 - protein, 6 aa, Entamoeba invadens
ASYQAS

SEQ ID NO: 2840868 - protein, 12 aa, Entamoeba invadens
ASYQEFKNGDIE

SEQ ID NO: 2840869 - protein, 9 aa, Entamoeba invadens
ASYTSNNQS

SEQ ID NO: 2840870 - protein, 11 aa, Entamoeba invadens
ASYVASNPNID

SEQ ID NO: 2840871 - protein, 15 aa, Entamoeba invadens
ATAAALKNEINASPI

SEQ ID NO: 2840872 - protein, 12 aa, Entamoeba invadens
ATAARKRCNSTD

SEQ ID NO: 2840873 - protein, 5 aa, Entamoeba invadens
ATADP

SEQ ID NO: 2840874 - protein, 9 aa, Entamoeba invadens
ATAEENGPT

SEQ ID NO: 2840875 - protein, 5 aa, Entamoeba invadens
ATAER

SEQ ID NO: 2840876 - protein, 10 aa, Entamoeba invadens
ATAGKDNIEN

SEQ ID NO: 2840877 - protein, 9 aa, Entamoeba invadens
ATAGPEITS

SEQ ID NO: 2840878 - protein, 9 aa, Entamoeba invadens
ATAGQDKTA

SEQ ID NO: 2840879 - protein, 5 aa, Entamoeba invadens
ATAHP

SEQ ID NO: 2840880 - protein, 8 aa, Entamoeba invadens
ATAIKAYS

SEQ ID NO: 2840881 - protein, 6 aa, Entamoeba invadens
ATAKKI

SEQ ID NO: 2840882 - protein, 5 aa, Entamoeba invadens
ATANE

SEQ ID NO: 2840883 - protein, 6 aa, Entamoeba invadens
ATAPEN

SEQ ID NO: 2840884 - protein, 7 aa, Entamoeba invadens
ATAPHEP

SEQ ID NO: 2840885 - protein, 19 aa, Entamoeba invadens
ATAPITPTQPSPAPNSKEV

SEQ ID NO: 2840886 - protein, 18 aa, Entamoeba invadens
ATAPITPTRSSPAPNTRD

SEQ ID NO: 2840887 - protein, 13 aa, Entamoeba invadens
ATAPIVQRKKSAE

SEQ ID NO: 2840888 - protein, 19 aa, Entamoeba invadens
ATAQKKVTKKEKKVATEPI

SEQ ID NO: 2840889 - protein, 6 aa, Entamoeba invadens
ATAQLP

SEQ ID NO: 2840890 - protein, 10 aa, Entamoeba invadens
ATASDFQGAR

SEQ ID NO: 2840891 - protein, 7 aa, Entamoeba invadens
ATASEEI

SEQ ID NO: 2840892 - protein, 9 aa, Entamoeba invadens
ATASGKSSV

SEQ ID NO: 2840893 - protein, 9 aa, Entamoeba invadens
ATASKTDLR

SEQ ID NO: 2840894 - protein, 17 aa, Entamoeba invadens
ATASSDRSARISTAQSG

SEQ ID NO: 2840895 - protein, 10 aa, Entamoeba invadens
ATASSFPGYK

SEQ ID NO: 2840896 - protein, 7 aa, Entamoeba invadens
ATATDGT

SEQ ID NO: 2840897 - protein, 6 aa, Entamoeba invadens
ATATED

SEQ ID NO: 2840898 - protein, 9 aa, Entamoeba invadens
ATATEKVKD

SEQ ID NO: 2840899 - protein, 15 aa, Entamoeba invadens
ATATFRKTKKSKQTV

SEQ ID NO: 2840900 - protein, 8 aa, Entamoeba invadens
ATATTPKK

SEQ ID NO: 2840901 - protein, 4 aa, Entamoeba invadens
ATAV

SEQ ID NO: 2840902 - protein, 8 aa, Entamoeba invadens
ATAVSQTK

SEQ ID NO: 2840903 - protein, 8 aa, Entamoeba invadens
ATAYANHA

SEQ ID NO: 2840904 - protein, 13 aa, Entamoeba invadens
ATCNGSCNTRNGY

SEQ ID NO: 2840905 - protein, 6 aa, Entamoeba invadens
ATCREE

SEQ ID NO: 2840906 - protein, 15 aa, Entamoeba invadens
ATCSNDGDSVQPTDR

SEQ ID NO: 2840907 - protein, 6 aa, Entamoeba invadens
ATDDDT

SEQ ID NO: 2840908 - protein, 6 aa, Entamoeba invadens
ATDDEL

SEQ ID NO: 2840909 - protein, 10 aa, Entamoeba invadens
ATDDEMKTQM

SEQ ID NO: 2840910 - protein, 14 aa, Entamoeba invadens
ATDDTLKDGTPTLK

SEQ ID NO: 2840911 - protein, 9 aa, Entamoeba invadens
ATDDYIPTE

SEQ ID NO: 2840912 - protein, 18 aa, Entamoeba invadens
ATDEIEQEEEEEEYPQQR

SEQ ID NO: 2840913 - protein, 7 aa, Entamoeba invadens
ATDGNTH

SEQ ID NO: 2840914 - protein, 8 aa, Entamoeba invadens
ATDHPLPY

SEQ ID NO: 2840915 - protein, 9 aa, Entamoeba invadens
ATDKDHPDA

SEQ ID NO: 2840916 - protein, 6 aa, Entamoeba invadens
ATDKGP

SEQ ID NO: 2840917 - protein, 24 aa, Entamoeba invadens
ATDKPAKEEKGGKKKGEKKGGCAF

SEQ ID NO: 2840918 - protein, 8 aa, Entamoeba invadens
ATDKPSWS

SEQ ID NO: 2840919 - protein, 10 aa, Entamoeba invadens
ATDKRQSVDS

SEQ ID NO: 2840920 - protein, 6 aa, Entamoeba invadens
ATDNDA

SEQ ID NO: 2840921 - protein, 10 aa, Entamoeba invadens
ATDNGPFRDS

SEQ ID NO: 2840922 - protein, 11 aa, Entamoeba invadens
ATDNHGQTSLH

SEQ ID NO: 2840923 - protein, 6 aa, Entamoeba invadens
ATDPLT

SEQ ID NO: 2840924 - protein, 5 aa, Entamoeba invadens
ATDSK

SEQ ID NO: 2840925 - protein, 11 aa, Entamoeba invadens
ATDSSGYEDSL

SEQ ID NO: 2840926 - protein, 8 aa, Entamoeba invadens
ATDSTRKC

SEQ ID NO: 2840927 - protein, 16 aa, Entamoeba invadens
ATDTDANGKVTQEELD

SEQ ID NO: 2840928 - protein, 4 aa, Entamoeba invadens
ATDY

SEQ ID NO: 2840929 - protein, 4 aa, Entamoeba invadens
ATEA

SEQ ID NO: 2840930 - protein, 14 aa, Entamoeba invadens
ATEATQASETTSTC

SEQ ID NO: 2840931 - protein, 10 aa, Entamoeba invadens
ATEDPDDTHF

SEQ ID NO: 2840932 - protein, 6 aa, Entamoeba invadens
ATEEER

SEQ ID NO: 2840933 - protein, 9 aa, Entamoeba invadens
ATEELYDEN

SEQ ID NO: 2840934 - protein, 7 aa, Entamoeba invadens
ATEGDNS

SEQ ID NO: 2840935 - protein, 4 aa, Entamoeba invadens
ATEI

SEQ ID NO: 2840936 - protein, 5 aa, Entamoeba invadens
ATEIR

SEQ ID NO: 2840937 - protein, 7 aa, Entamoeba invadens
ATEITAK

SEQ ID NO: 2840938 - protein, 65 aa, Entamoeba invadens
ATEKAQTSKAAAAESKKRADEAKKTAEACKEKQATATAAAEVAKKDEEVATQRQSEAQAAEEEVT

SEQ ID NO: 2840939 - protein, 8 aa, Entamoeba invadens
ATEKDPFL

SEQ ID NO: 2840940 - protein, 8 aa, Entamoeba invadens
ATEKPKEL

SEQ ID NO: 2840941 - protein, 8 aa, Entamoeba invadens
ATEKQNSV

SEQ ID NO: 2840942 - protein, 9 aa, Entamoeba invadens
ATEKTDEMS

SEQ ID NO: 2840943 - protein, 7 aa, Entamoeba invadens
ATEKTGV

SEQ ID NO: 2840944 - protein, 7 aa, Entamoeba invadens
ATEKTIK

SEQ ID NO: 2840945 - protein, 8 aa, Entamoeba invadens
ATEKTTPK

SEQ ID NO: 2840946 - protein, 10 aa, Entamoeba invadens
ATEKVEEMNK

SEQ ID NO: 2840947 - protein, 10 aa, Entamoeba invadens
ATEMEKKGKV

SEQ ID NO: 2840948 - protein, 6 aa, Entamoeba invadens
ATEMKE

SEQ ID NO: 2840949 - protein, 4 aa, Entamoeba invadens
ATEN

SEQ ID NO: 2840950 - protein, 15 aa, Entamoeba invadens
ATENARSVSPSRSVG

SEQ ID NO: 2840951 - protein, 16 aa, Entamoeba invadens
ATENESQNTNNSTKEE

SEQ ID NO: 2840952 - protein, 16 aa, Entamoeba invadens
ATENGKRIGEVPDGVK

SEQ ID NO: 2840953 - protein, 30 aa, Entamoeba invadens
ATENNLKNSLQKDAENRIFGSDKQESSVNN

SEQ ID NO: 2840954 - protein, 8 aa, Entamoeba invadens
ATENPDEQ

SEQ ID NO: 2840955 - protein, 6 aa, Entamoeba invadens
ATENSK

SEQ ID NO: 2840956 - protein, 9 aa, Entamoeba invadens
ATEPQHDTI

SEQ ID NO: 2840957 - protein, 7 aa, Entamoeba invadens
ATEQGWD

SEQ ID NO: 2840958 - protein, 16 aa, Entamoeba invadens
ATEREAFKNSKSLEEQ

SEQ ID NO: 2840959 - protein, 8 aa, Entamoeba invadens
ATERNELN

SEQ ID NO: 2840960 - protein, 6 aa, Entamoeba invadens
ATERVK

SEQ ID NO: 2840961 - protein, 6 aa, Entamoeba invadens
ATERVQ

SEQ ID NO: 2840962 - protein, 4 aa, Entamoeba invadens
ATES

SEQ ID NO: 2840963 - protein, 6 aa, Entamoeba invadens
ATESLT

SEQ ID NO: 2840964 - protein, 8 aa, Entamoeba invadens
ATESLTTI

SEQ ID NO: 2840965 - protein, 15 aa, Entamoeba invadens
ATESRPKKQSSRCVL

SEQ ID NO: 2840966 - protein, 6 aa, Entamoeba invadens
ATESSQ

SEQ ID NO: 2840967 - protein, 8 aa, Entamoeba invadens
ATESTKGY

SEQ ID NO: 2840968 - protein, 4 aa, Entamoeba invadens
ATET

SEQ ID NO: 2840969 - protein, 10 aa, Entamoeba invadens
ATETGQSYDQ

SEQ ID NO: 2840970 - protein, 17 aa, Entamoeba invadens
ATEVPSKYEPTKIREET

SEQ ID NO: 2840971 - protein, 11 aa, Entamoeba invadens
ATEWAKKNNRA

SEQ ID NO: 2840972 - protein, 4 aa, Entamoeba invadens
ATFE

SEQ ID NO: 2840973 - protein, 8 aa, Entamoeba invadens
ATFEESSK

SEQ ID NO: 2840974 - protein, 9 aa, Entamoeba invadens
ATFGDCGKK

SEQ ID NO: 2840975 - protein, 9 aa, Entamoeba invadens
ATFNQSEGI

SEQ ID NO: 2840976 - protein, 5 aa, Entamoeba invadens
ATFPI

SEQ ID NO: 2840977 - protein, 8 aa, Entamoeba invadens
ATFPPQEK

SEQ ID NO: 2840978 - protein, 5 aa, Entamoeba invadens
ATFPV

SEQ ID NO: 2840979 - protein, 5 aa, Entamoeba invadens
ATFRG

SEQ ID NO: 2840980 - protein, 5 aa, Entamoeba invadens
ATFSG

SEQ ID NO: 2840981 - protein, 7 aa, Entamoeba invadens
ATFSPKS

SEQ ID NO: 2840982 - protein, 12 aa, Entamoeba invadens
ATFSSRQSLEST

SEQ ID NO: 2840983 - protein, 12 aa, Entamoeba invadens
ATFTKENTFKQK

SEQ ID NO: 2840984 - protein, 10 aa, Entamoeba invadens
ATFTYPNRSP

SEQ ID NO: 2840985 - protein, 7 aa, Entamoeba invadens
ATFYGDQ

SEQ ID NO: 2840986 - protein, 10 aa, Entamoeba invadens
ATGAGTEAAQ

SEQ ID NO: 2840987 - protein, 13 aa, Entamoeba invadens
ATGCDGTTGAYSH

SEQ ID NO: 2840988 - protein, 7 aa, Entamoeba invadens
ATGCGNP

SEQ ID NO: 2840989 - protein, 11 aa, Entamoeba invadens
ATGDATRNIPP

SEQ ID NO: 2840990 - protein, 14 aa, Entamoeba invadens
ATGDINKDTLSDSL

SEQ ID NO: 2840991 - protein, 8 aa, Entamoeba invadens
ATGDRSGA

SEQ ID NO: 2840992 - protein, 10 aa, Entamoeba invadens
ATGDTTKPYK

SEQ ID NO: 2840993 - protein, 5 aa, Entamoeba invadens
ATGEN

SEQ ID NO: 2840994 - protein, 6 aa, Entamoeba invadens
ATGERY

SEQ ID NO: 2840995 - protein, 6 aa, Entamoeba invadens
ATGESK

SEQ ID NO: 2840996 - protein, 5 aa, Entamoeba invadens
ATGFR

SEQ ID NO: 2840997 - protein, 4 aa, Entamoeba invadens
ATGG

SEQ ID NO: 2840998 - protein, 8 aa, Entamoeba invadens
ATGGEDGY

SEQ ID NO: 2840999 - protein, 5 aa, Entamoeba invadens
ATGHG

SEQ ID NO: 2841000 - protein, 6 aa, Entamoeba invadens
ATGHGV

SEQ ID NO: 2841001 - protein, 8 aa, Entamoeba invadens
ATGIKGMK

SEQ ID NO: 2841002 - protein, 15 aa, Entamoeba invadens
ATGITSQWRNSRDEI

SEQ ID NO: 2841003 - protein, 5 aa, Entamoeba invadens
ATGKA

SEQ ID NO: 2841004 - protein, 6 aa, Entamoeba invadens
ATGKIE

SEQ ID NO: 2841005 - protein, 21 aa, Entamoeba invadens
ATGKKTGVTSKTKQSKFEGSR

SEQ ID NO: 2841006 - protein, 6 aa, Entamoeba invadens
ATGKNL

SEQ ID NO: 2841007 - protein, 6 aa, Entamoeba invadens
ATGNCP

SEQ ID NO: 2841008 - protein, 24 aa, Entamoeba invadens
ATGPTKYGVKKDYKEQKKGAAIVD

SEQ ID NO: 2841009 - protein, 22 aa, Entamoeba invadens
ATGQSVESQNIKDMDEDQMNEL

SEQ ID NO: 2841010 - protein, 18 aa, Entamoeba invadens
ATGSEPITKLASTRDGRR

SEQ ID NO: 2841011 - protein, 8 aa, Entamoeba invadens
ATGSGKSM

SEQ ID NO: 2841012 - protein, 9 aa, Entamoeba invadens
ATGSTPTEI

SEQ ID NO: 2841013 - protein, 12 aa, Entamoeba invadens
ATGSVHEGAEKS

SEQ ID NO: 2841014 - protein, 5 aa, Entamoeba invadens
ATGSY

SEQ ID NO: 2841015 - protein, 7 aa, Entamoeba invadens
ATGTETN

SEQ ID NO: 2841016 - protein, 7 aa, Entamoeba invadens
ATGTKEE

SEQ ID NO: 2841017 - protein, 6 aa, Entamoeba invadens
ATGTLH

SEQ ID NO: 2841018 - protein, 8 aa, Entamoeba invadens
ATGYAGGQ

SEQ ID NO: 2841019 - protein, 17 aa, Entamoeba invadens
ATHGGKTDTNAHPHVDQ

SEQ ID NO: 2841020 - protein, 7 aa, Entamoeba invadens
ATHKEAQ

SEQ ID NO: 2841021 - protein, 6 aa, Entamoeba invadens
ATIAQR

SEQ ID NO: 2841022 - protein, 7 aa, Entamoeba invadens
ATIDDGV

SEQ ID NO: 2841023 - protein, 10 aa, Entamoeba invadens
ATIDGGDYDI

SEQ ID NO: 2841024 - protein, 4 aa, Entamoeba invadens
ATIE

SEQ ID NO: 2841025 - protein, 10 aa, Entamoeba invadens
ATIEKGNARD

SEQ ID NO: 2841026 - protein, 10 aa, Entamoeba invadens
ATIETARQTL

SEQ ID NO: 2841027 - protein, 5 aa, Entamoeba invadens
ATIEY

SEQ ID NO: 2841028 - protein, 4 aa, Entamoeba invadens
ATIG

SEQ ID NO: 2841029 - protein, 6 aa, Entamoeba invadens
ATIGIG

SEQ ID NO: 2841030 - protein, 10 aa, Entamoeba invadens
ATIKKDSAEF

SEQ ID NO: 2841031 - protein, 10 aa, Entamoeba invadens
ATIKNDSAEF

SEQ ID NO: 2841032 - protein, 10 aa, Entamoeba invadens
ATIKNNSAEF

SEQ ID NO: 2841033 - protein, 4 aa, Entamoeba invadens
ATIN

SEQ ID NO: 2841034 - protein, 19 aa, Entamoeba invadens
ATIPALPPGEADNRSDFER

SEQ ID NO: 2841035 - protein, 12 aa, Entamoeba invadens
ATIPSEMKGPED

SEQ ID NO: 2841036 - protein, 4 aa, Entamoeba invadens
ATIQ

SEQ ID NO: 2841037 - protein, 13 aa, Entamoeba invadens
ATISGRKNRTASV

SEQ ID NO: 2841038 - protein, 5 aa, Entamoeba invadens
ATKAC

SEQ ID NO: 2841039 - protein, 9 aa, Entamoeba invadens
ATKANEGRT

SEQ ID NO: 2841040 - protein, 7 aa, Entamoeba invadens
ATKATDK

SEQ ID NO: 2841041 - protein, 4 aa, Entamoeba invadens
ATKD

SEQ ID NO: 2841042 - protein, 25 aa, Entamoeba invadens
ATKDATKPKKVGDEEAKKREVKKNF

SEQ ID NO: 2841043 - protein, 21 aa, Entamoeba invadens
ATKDERVRESITSKRSRWGRR

SEQ ID NO: 2841044 - protein, 9 aa, Entamoeba invadens
ATKDVTSQA

SEQ ID NO: 2841045 - protein, 9 aa, Entamoeba invadens
ATKEAIRDN

SEQ ID NO: 2841046 - protein, 5 aa, Entamoeba invadens
ATKEE

SEQ ID NO: 2841047 - protein, 12 aa, Entamoeba invadens
ATKEENNIIQYV

SEQ ID NO: 2841048 - protein, 23 aa, Entamoeba invadens
ATKEENTKQIDDIRKQKETINEN

SEQ ID NO: 2841049 - protein, 13 aa, Entamoeba invadens
ATKEIKKQSEKSP

SEQ ID NO: 2841050 - protein, 14 aa, Entamoeba invadens
ATKELSKKTRSESF

SEQ ID NO: 2841051 - protein, 8 aa, Entamoeba invadens
ATKESNDL

SEQ ID NO: 2841052 - protein, 4 aa, Entamoeba invadens
ATKF

SEQ ID NO: 2841053 - protein, 7 aa, Entamoeba invadens
ATKGEKV

SEQ ID NO: 2841054 - protein, 10 aa, Entamoeba invadens
ATKGKKETMK

SEQ ID NO: 2841055 - protein, 15 aa, Entamoeba invadens
ATKGSQKKENESEVS

SEQ ID NO: 2841056 - protein, 38 aa, Entamoeba invadens
ATKHNGSRHRSHKKDKNCSNQLSDDETEINSDPDTETL

SEQ ID NO: 2841057 - protein, 12 aa, Entamoeba invadens
ATKIKSEGRFSS

SEQ ID NO: 2841058 - protein, 13 aa, Entamoeba invadens
ATKKAARLFYILW

SEQ ID NO: 2841059 - protein, 8 aa, Entamoeba invadens
ATKKSTGI

SEQ ID NO: 2841060 - protein, 7 aa, Entamoeba invadens
ATKLGRD

SEQ ID NO: 2841061 - protein, 4 aa, Entamoeba invadens
ATKN

SEQ ID NO: 2841062 - protein, 7 aa, Entamoeba invadens
ATKNAPN

SEQ ID NO: 2841063 - protein, 9 aa, Entamoeba invadens
ATKNPEKYP

SEQ ID NO: 2841064 - protein, 7 aa, Entamoeba invadens
ATKNTPV

SEQ ID NO: 2841065 - protein, 19 aa, Entamoeba invadens
ATKPEQKPAEIKPKPIPFS

SEQ ID NO: 2841066 - protein, 9 aa, Entamoeba invadens
ATKPSKLRQ

SEQ ID NO: 2841067 - protein, 10 aa, Entamoeba invadens
ATKQDTPLHK

SEQ ID NO: 2841068 - protein, 10 aa, Entamoeba invadens
ATKQGGSWKS

SEQ ID NO: 2841069 - protein, 10 aa, Entamoeba invadens
ATKQKGKHMN

SEQ ID NO: 2841070 - protein, 7 aa, Entamoeba invadens
ATKQWDD

SEQ ID NO: 2841071 - protein, 13 aa, Entamoeba invadens
ATKRTQKSSELEK

SEQ ID NO: 2841072 - protein, 4 aa, Entamoeba invadens
ATKS

SEQ ID NO: 2841073 - protein, 15 aa, Entamoeba invadens
ATKSKPQTAQSSYVG

SEQ ID NO: 2841074 - protein, 6 aa, Entamoeba invadens
ATKSNA

SEQ ID NO: 2841075 - protein, 6 aa, Entamoeba invadens
ATKSPE

SEQ ID NO: 2841076 - protein, 16 aa, Entamoeba invadens
ATKSRPSLNSKNSVVS

SEQ ID NO: 2841077 - protein, 7 aa, Entamoeba invadens
ATKSSVP

SEQ ID NO: 2841078 - protein, 5 aa, Entamoeba invadens
ATKTG

SEQ ID NO: 2841079 - protein, 5 aa, Entamoeba invadens
ATKTL

SEQ ID NO: 2841080 - protein, 7 aa, Entamoeba invadens
ATKTMGE

SEQ ID NO: 2841081 - protein, 6 aa, Entamoeba invadens
ATKTMV

SEQ ID NO: 2841082 - protein, 8 aa, Entamoeba invadens
ATKTSIRI

SEQ ID NO: 2841083 - protein, 10 aa, Entamoeba invadens
ATKTSSDWQT

SEQ ID NO: 2841084 - protein, 9 aa, Entamoeba invadens
ATKVENKGK

SEQ ID NO: 2841085 - protein, 25 aa, Entamoeba invadens
ATLADKEEKKEELLQQRKKDRKSQR

SEQ ID NO: 2841086 - protein, 9 aa, Entamoeba invadens
ATLAEGNSN

SEQ ID NO: 2841087 - protein, 4 aa, Entamoeba invadens
ATLD

SEQ ID NO: 2841088 - protein, 4 aa, Entamoeba invadens
ATLE

SEQ ID NO: 2841089 - protein, 7 aa, Entamoeba invadens
ATLEEKT

SEQ ID NO: 2841090 - protein, 6 aa, Entamoeba invadens
ATLGAR

SEQ ID NO: 2841091 - protein, 10 aa, Entamoeba invadens
ATLGGVDSAD

SEQ ID NO: 2841092 - protein, 5 aa, Entamoeba invadens
ATLGK

SEQ ID NO: 2841093 - protein, 5 aa, Entamoeba invadens
ATLGT

SEQ ID NO: 2841094 - protein, 4 aa, Entamoeba invadens
ATLK

SEQ ID NO: 2841095 - protein, 5 aa, Entamoeba invadens
ATLKG

SEQ ID NO: 2841096 - protein, 9 aa, Entamoeba invadens
ATLKGESGV

SEQ ID NO: 2841097 - protein, 13 aa, Entamoeba invadens
ATLKNPDEYSSKM

SEQ ID NO: 2841098 - protein, 4 aa, Entamoeba invadens
ATLN

SEQ ID NO: 2841099 - protein, 9 aa, Entamoeba invadens
ATLNGTNPK

SEQ ID NO: 2841100 - protein, 6 aa, Entamoeba invadens
ATLNVT

SEQ ID NO: 2841101 - protein, 13 aa, Entamoeba invadens
ATLRQANETKATL

SEQ ID NO: 2841102 - protein, 7 aa, Entamoeba invadens
ATLRSSA

SEQ ID NO: 2841103 - protein, 6 aa, Entamoeba invadens
ATLSES

SEQ ID NO: 2841104 - protein, 9 aa, Entamoeba invadens
ATLSTSQNN

SEQ ID NO: 2841105 - protein, 19 aa, Entamoeba invadens
ATLTASAHNSNRTTPNLTP

SEQ ID NO: 2841106 - protein, 10 aa, Entamoeba invadens
ATMEGVDSAD

SEQ ID NO: 2841107 - protein, 7 aa, Entamoeba invadens
ATMGGVD

SEQ ID NO: 2841108 - protein, 17 aa, Entamoeba invadens
ATMGGVDSADQMIHTYT

SEQ ID NO: 2841109 - protein, 10 aa, Entamoeba invadens
ATMGNVDSAD

SEQ ID NO: 2841110 - protein, 8 aa, Entamoeba invadens
ATMKKTSP

SEQ ID NO: 2841111 - protein, 14 aa, Entamoeba invadens
ATMKTQTEIDEDDT

SEQ ID NO: 2841112 - protein, 4 aa, Entamoeba invadens
ATMT

SEQ ID NO: 2841113 - protein, 14 aa, Entamoeba invadens
ATMTIEADGKEKKN

SEQ ID NO: 2841114 - protein, 19 aa, Entamoeba invadens
ATNAQDCGAKLKTTEIGGK

SEQ ID NO: 2841115 - protein, 6 aa, Entamoeba invadens
ATNATI

SEQ ID NO: 2841116 - protein, 9 aa, Entamoeba invadens
ATNCESNRQ

SEQ ID NO: 2841117 - protein, 17 aa, Entamoeba invadens
ATNCESNRQILDTERKL

SEQ ID NO: 2841118 - protein, 10 aa, Entamoeba invadens
ATNCTSCKDG

SEQ ID NO: 2841119 - protein, 9 aa, Entamoeba invadens
ATNDFNTSP

SEQ ID NO: 2841120 - protein, 7 aa, Entamoeba invadens
ATNDGNE

SEQ ID NO: 2841121 - protein, 11 aa, Entamoeba invadens
ATNDRCTKCKS

SEQ ID NO: 2841122 - protein, 6 aa, Entamoeba invadens
ATNEEM

SEQ ID NO: 2841123 - protein, 6 aa, Entamoeba invadens
ATNEEV

SEQ ID NO: 2841124 - protein, 6 aa, Entamoeba invadens
ATNENL

SEQ ID NO: 2841125 - protein, 9 aa, Entamoeba invadens
ATNEQNKGL

SEQ ID NO: 2841126 - protein, 6 aa, Entamoeba invadens
ATNESE

SEQ ID NO: 2841127 - protein, 6 aa, Entamoeba invadens
ATNFAS

SEQ ID NO: 2841128 - protein, 7 aa, Entamoeba invadens
ATNGEGV

SEQ ID NO: 2841129 - protein, 10 aa, Entamoeba invadens
ATNGPSRPLN

SEQ ID NO: 2841130 - protein, 11 aa, Entamoeba invadens
ATNGSKKISTI

SEQ ID NO: 2841131 - protein, 5 aa, Entamoeba invadens
ATNIT

SEQ ID NO: 2841132 - protein, 7 aa, Entamoeba invadens
ATNKAEK

SEQ ID NO: 2841133 - protein, 7 aa, Entamoeba invadens
ATNKARA

SEQ ID NO: 2841134 - protein, 8 aa, Entamoeba invadens
ATNKTTGV

SEQ ID NO: 2841135 - protein, 34 aa, Entamoeba invadens
ATNLSRDNSATDSFTETATESISKSTTPSSSKMS

SEQ ID NO: 2841136 - protein, 10 aa, Entamoeba invadens
ATNNGLRQDE

SEQ ID NO: 2841137 - protein, 9 aa, Entamoeba invadens
ATNPAREKL

SEQ ID NO: 2841138 - protein, 5 aa, Entamoeba invadens
ATNPD

SEQ ID NO: 2841139 - protein, 8 aa, Entamoeba invadens
ATNPERVA

SEQ ID NO: 2841140 - protein, 6 aa, Entamoeba invadens
ATNPKA

SEQ ID NO: 2841141 - protein, 67 aa, Entamoeba invadens
ATNPKAEKPICSASRETSSYSPRQQQQTSYSKPSTFSSTKSACEKRDQQVRKEYKPSQPYRATNTEV

SEQ ID NO: 2841142 - protein, 13 aa, Entamoeba invadens
ATNPKGKYDCSKS

SEQ ID NO: 2841143 - protein, 8 aa, Entamoeba invadens
ATNPRAHK

SEQ ID NO: 2841144 - protein, 5 aa, Entamoeba invadens
ATNQA

SEQ ID NO: 2841145 - protein, 10 aa, Entamoeba invadens
ATNQGDSATR

SEQ ID NO: 2841146 - protein, 10 aa, Entamoeba invadens
ATNQLNDAPE

SEQ ID NO: 2841147 - protein, 4 aa, Entamoeba invadens
ATNS

SEQ ID NO: 2841148 - protein, 27 aa, Entamoeba invadens
ATNSMSAYRKSKPSASSEGVRKSKDMN

SEQ ID NO: 2841149 - protein, 28 aa, Entamoeba invadens
ATNSSSSANTGEGSGESLPNINETENGR

SEQ ID NO: 2841150 - protein, 9 aa, Entamoeba invadens
ATNSTQSID

SEQ ID NO: 2841151 - protein, 10 aa, Entamoeba invadens
ATNTSVRTQL

SEQ ID NO: 2841152 - protein, 6 aa, Entamoeba invadens
ATNTVR

SEQ ID NO: 2841153 - protein, 7 aa, Entamoeba invadens
ATPAGSI

SEQ ID NO: 2841154 - protein, 9 aa, Entamoeba invadens
ATPAGYRTA

SEQ ID NO: 2841155 - protein, 9 aa, Entamoeba invadens
ATPEEDNIG

SEQ ID NO: 2841156 - protein, 6 aa, Entamoeba invadens
ATPENV

SEQ ID NO: 2841157 - protein, 15 aa, Entamoeba invadens
ATPEPETGDVDGDIH

SEQ ID NO: 2841158 - protein, 8 aa, Entamoeba invadens
ATPETVKN

SEQ ID NO: 2841159 - protein, 4 aa, Entamoeba invadens
ATPF

SEQ ID NO: 2841160 - protein, 4 aa, Entamoeba invadens
ATPI

SEQ ID NO: 2841161 - protein, 8 aa, Entamoeba invadens
ATPIPLPP

SEQ ID NO: 2841162 - protein, 15 aa, Entamoeba invadens
ATPIPRPRTVGYSET

SEQ ID NO: 2841163 - protein, 7 aa, Entamoeba invadens
ATPKEEE

SEQ ID NO: 2841164 - protein, 5 aa, Entamoeba invadens
ATPKL

SEQ ID NO: 2841165 - protein, 4 aa, Entamoeba invadens
ATPL

SEQ ID NO: 2841166 - protein, 14 aa, Entamoeba invadens
ATPLEEASDSLEAS

SEQ ID NO: 2841167 - protein, 14 aa, Entamoeba invadens
ATPLNKTQDFTKPK

SEQ ID NO: 2841168 - protein, 11 aa, Entamoeba invadens
ATPNFTNEYGQ

SEQ ID NO: 2841169 - protein, 7 aa, Entamoeba invadens
ATPPGLN

SEQ ID NO: 2841170 - protein, 7 aa, Entamoeba invadens
ATPPIEE

SEQ ID NO: 2841171 - protein, 9 aa, Entamoeba invadens
ATPPKETDT

SEQ ID NO: 2841172 - protein, 9 aa, Entamoeba invadens
ATPPPPTPL

SEQ ID NO: 2841173 - protein, 6 aa, Entamoeba invadens
ATPPSI

SEQ ID NO: 2841174 - protein, 6 aa, Entamoeba invadens
ATPPWD

SEQ ID NO: 2841175 - protein, 21 aa, Entamoeba invadens
ATPQKDDKVGSPKQKSQLNQL

SEQ ID NO: 2841176 - protein, 9 aa, Entamoeba invadens
ATPQTHPEY

SEQ ID NO: 2841177 - protein, 19 aa, Entamoeba invadens
ATPQTSNYTNAQQKKYISP

SEQ ID NO: 2841178 - protein, 5 aa, Entamoeba invadens
ATPQV

SEQ ID NO: 2841179 - protein, 14 aa, Entamoeba invadens
ATPRGKSKKREYTV

SEQ ID NO: 2841180 - protein, 15 aa, Entamoeba invadens
ATPRTQRKMKEDQQA

SEQ ID NO: 2841181 - protein, 4 aa, Entamoeba invadens
ATPS

SEQ ID NO: 2841182 - protein, 6 aa, Entamoeba invadens
ATPSDV

SEQ ID NO: 2841183 - protein, 7 aa, Entamoeba invadens
ATPSHKK

SEQ ID NO: 2841184 - protein, 10 aa, Entamoeba invadens
ATPSPGVTQQ

SEQ ID NO: 2841185 - protein, 9 aa, Entamoeba invadens
ATPSPNSYL

SEQ ID NO: 2841186 - protein, 9 aa, Entamoeba invadens
ATPSVGPKV

SEQ ID NO: 2841187 - protein, 5 aa, Entamoeba invadens
ATPTA

SEQ ID NO: 2841188 - protein, 9 aa, Entamoeba invadens
ATPTGESAR

SEQ ID NO: 2841189 - protein, 5 aa, Entamoeba invadens
ATPTL

SEQ ID NO: 2841190 - protein, 5 aa, Entamoeba invadens
ATPTQ

SEQ ID NO: 2841191 - protein, 17 aa, Entamoeba invadens
ATPTQLPVAGENDIPES

SEQ ID NO: 2841192 - protein, 8 aa, Entamoeba invadens
ATPTRQKH

SEQ ID NO: 2841193 - protein, 6 aa, Entamoeba invadens
ATPVRE

SEQ ID NO: 2841194 - protein, 6 aa, Entamoeba invadens
ATQAGV

SEQ ID NO: 2841195 - protein, 7 aa, Entamoeba invadens
ATQAKDR

SEQ ID NO: 2841196 - protein, 7 aa, Entamoeba invadens
ATQDDQP

SEQ ID NO: 2841197 - protein, 9 aa, Entamoeba invadens
ATQDNNPQQ

SEQ ID NO: 2841198 - protein, 12 aa, Entamoeba invadens
ATQDQENKSEVS

SEQ ID NO: 2841199 - protein, 23 aa, Entamoeba invadens
ATQENDVAKSLPLPQTSYVAFRL

SEQ ID NO: 2841200 - protein, 12 aa, Entamoeba invadens
ATQENELSLTEG

SEQ ID NO: 2841201 - protein, 6 aa, Entamoeba invadens
ATQENI

SEQ ID NO: 2841202 - protein, 5 aa, Entamoeba invadens
ATQEV

SEQ ID NO: 2841203 - protein, 7 aa, Entamoeba invadens
ATQFGSS

SEQ ID NO: 2841204 - protein, 5 aa, Entamoeba invadens
ATQGL

SEQ ID NO: 2841205 - protein, 4 aa, Entamoeba invadens
ATQH

SEQ ID NO: 2841206 - protein, 54 aa, Entamoeba invadens
ATQKDKEKEINEKLENAKNENDELKTTFNSQEQKLKEAETTQNEMQSNIKTWKN

SEQ ID NO: 2841207 - protein, 17 aa, Entamoeba invadens
ATQKTVDGPSGKDWRAG

SEQ ID NO: 2841208 - protein, 7 aa, Entamoeba invadens
ATQNERA

SEQ ID NO: 2841209 - protein, 6 aa, Entamoeba invadens
ATQPDS

SEQ ID NO: 2841210 - protein, 25 aa, Entamoeba invadens
ATQPGAPTNLNGTQAMTPSTPSTGF

SEQ ID NO: 2841211 - protein, 8 aa, Entamoeba invadens
ATQPLKPG

SEQ ID NO: 2841212 - protein, 7 aa, Entamoeba invadens
ATQPTQM

SEQ ID NO: 2841213 - protein, 5 aa, Entamoeba invadens
ATQPV

SEQ ID NO: 2841214 - protein, 14 aa, Entamoeba invadens
ATQPVRISKEAKDI

SEQ ID NO: 2841215 - protein, 7 aa, Entamoeba invadens
ATQQRRA

SEQ ID NO: 2841216 - protein, 8 aa, Entamoeba invadens
ATQRGEGQ

SEQ ID NO: 2841217 - protein, 18 aa, Entamoeba invadens
ATQRVGTTPAQRANNISK

SEQ ID NO: 2841218 - protein, 5 aa, Entamoeba invadens
ATQTI

SEQ ID NO: 2841219 - protein, 7 aa, Entamoeba invadens
ATQTNTE

SEQ ID NO: 2841220 - protein, 7 aa, Entamoeba invadens
ATQTSIR

SEQ ID NO: 2841221 - protein, 5 aa, Entamoeba invadens
ATQYN

SEQ ID NO: 2841222 - protein, 7 aa, Entamoeba invadens
ATRAEDK

SEQ ID NO: 2841223 - protein, 5 aa, Entamoeba invadens
ATRAI

SEQ ID NO: 2841224 - protein, 16 aa, Entamoeba invadens
ATRATAKKEAFERSAT

SEQ ID NO: 2841225 - protein, 13 aa, Entamoeba invadens
ATRAVPQKSNLAY

SEQ ID NO: 2841226 - protein, 4 aa, Entamoeba invadens
ATRD

SEQ ID NO: 2841227 - protein, 5 aa, Entamoeba invadens
ATRDV

SEQ ID NO: 2841228 - protein, 13 aa, Entamoeba invadens
ATRESKRIEDEKS

SEQ ID NO: 2841229 - protein, 14 aa, Entamoeba invadens
ATRESKRIEDEKSM

SEQ ID NO: 2841230 - protein, 10 aa, Entamoeba invadens
ATRKERMENM

SEQ ID NO: 2841231 - protein, 10 aa, Entamoeba invadens
ATRKSDGYPV

SEQ ID NO: 2841232 - protein, 10 aa, Entamoeba invadens
ATRKTIDSGN

SEQ ID NO: 2841233 - protein, 20 aa, Entamoeba invadens
ATRNTRKGSASVKDKKQCLL

SEQ ID NO: 2841234 - protein, 15 aa, Entamoeba invadens
ATRPNPEKENTDTTR

SEQ ID NO: 2841235 - protein, 11 aa, Entamoeba invadens
ATRQPKKYREY

SEQ ID NO: 2841236 - protein, 4 aa, Entamoeba invadens
ATRR

SEQ ID NO: 2841237 - protein, 6 aa, Entamoeba invadens
ATRRRR

SEQ ID NO: 2841238 - protein, 8 aa, Entamoeba invadens
ATRRTDGF

SEQ ID NO: 2841239 - protein, 15 aa, Entamoeba invadens
ATRSVDIEKRNDNLK

SEQ ID NO: 2841240 - protein, 8 aa, Entamoeba invadens
ATRTRDQD

SEQ ID NO: 2841241 - protein, 9 aa, Entamoeba invadens
ATSAAGRGV

SEQ ID NO: 2841242 - protein, 9 aa, Entamoeba invadens
ATSADELDT

SEQ ID NO: 2841243 - protein, 6 aa, Entamoeba invadens
ATSAEV

SEQ ID NO: 2841244 - protein, 9 aa, Entamoeba invadens
ATSAKQPQM

SEQ ID NO: 2841245 - protein, 5 aa, Entamoeba invadens
ATSAL

SEQ ID NO: 2841246 - protein, 9 aa, Entamoeba invadens
ATSANSLDK

SEQ ID NO: 2841247 - protein, 8 aa, Entamoeba invadens
ATSARDKA

SEQ ID NO: 2841248 - protein, 9 aa, Entamoeba invadens
ATSATDYAA

SEQ ID NO: 2841249 - protein, 9 aa, Entamoeba invadens
ATSDINSGR

SEQ ID NO: 2841250 - protein, 17 aa, Entamoeba invadens
ATSDLRPTIPPSTPQKM

SEQ ID NO: 2841251 - protein, 9 aa, Entamoeba invadens
ATSEESLKA

SEQ ID NO: 2841252 - protein, 8 aa, Entamoeba invadens
ATSEGDLI

SEQ ID NO: 2841253 - protein, 15 aa, Entamoeba invadens
ATSESKNKLSKAREM

SEQ ID NO: 2841254 - protein, 6 aa, Entamoeba invadens
ATSGTF

SEQ ID NO: 2841255 - protein, 5 aa, Entamoeba invadens
ATSGV

SEQ ID NO: 2841256 - protein, 8 aa, Entamoeba invadens
ATSHEETK

SEQ ID NO: 2841257 - protein, 8 aa, Entamoeba invadens
ATSHSKNF

SEQ ID NO: 2841258 - protein, 12 aa, Entamoeba invadens
ATSIGETCEEMS

SEQ ID NO: 2841259 - protein, 24 aa, Entamoeba invadens
ATSKLTTRLDPDELQEDTKLGEGS

SEQ ID NO: 2841260 - protein, 17 aa, Entamoeba invadens
ATSKLTTRLDPNELQED

SEQ ID NO: 2841261 - protein, 24 aa, Entamoeba invadens
ATSKNTTVDDTEKAFSPTTRPSTS

SEQ ID NO: 2841262 - protein, 9 aa, Entamoeba invadens
ATSKSRNLS

SEQ ID NO: 2841263 - protein, 10 aa, Entamoeba invadens
ATSMTETQIN

SEQ ID NO: 2841264 - protein, 10 aa, Entamoeba invadens
ATSNKQPTKA

SEQ ID NO: 2841265 - protein, 11 aa, Entamoeba invadens
ATSNLSKSKKF

SEQ ID NO: 2841266 - protein, 7 aa, Entamoeba invadens
ATSPDAD

SEQ ID NO: 2841267 - protein, 5 aa, Entamoeba invadens
ATSPF

SEQ ID NO: 2841268 - protein, 17 aa, Entamoeba invadens
ATSPKTFSARCVFGIQW

SEQ ID NO: 2841269 - protein, 5 aa, Entamoeba invadens
ATSPP

SEQ ID NO: 2841270 - protein, 13 aa, Entamoeba invadens
ATSPQNVSKNRYT

SEQ ID NO: 2841271 - protein, 6 aa, Entamoeba invadens
ATSPSN

SEQ ID NO: 2841272 - protein, 11 aa, Entamoeba invadens
ATSQAKADDEL

SEQ ID NO: 2841273 - protein, 7 aa, Entamoeba invadens
ATSRFNS

SEQ ID NO: 2841274 - protein, 6 aa, Entamoeba invadens
ATSRIK

SEQ ID NO: 2841275 - protein, 7 aa, Entamoeba invadens
ATSRWAS

SEQ ID NO: 2841276 - protein, 8 aa, Entamoeba invadens
ATSSADAT

SEQ ID NO: 2841277 - protein, 8 aa, Entamoeba invadens
ATSSAGIY

SEQ ID NO: 2841278 - protein, 9 aa, Entamoeba invadens
ATSSDEEKE

SEQ ID NO: 2841279 - protein, 5 aa, Entamoeba invadens
ATSSP

SEQ ID NO: 2841280 - protein, 8 aa, Entamoeba invadens
ATSSQQGM

SEQ ID NO: 2841281 - protein, 20 aa, Entamoeba invadens
ATSSQSLEDSSERTAPLNKQ

SEQ ID NO: 2841282 - protein, 8 aa, Entamoeba invadens
ATSSTSQK

SEQ ID NO: 2841283 - protein, 10 aa, Entamoeba invadens
ATSTDKPEIR

SEQ ID NO: 2841284 - protein, 9 aa, Entamoeba invadens
ATSTGKTEL

SEQ ID NO: 2841285 - protein, 7 aa, Entamoeba invadens
ATSTHGV

SEQ ID NO: 2841286 - protein, 13 aa, Entamoeba invadens
ATSTLEANSYAKK

SEQ ID NO: 2841287 - protein, 5 aa, Entamoeba invadens
ATSTN

SEQ ID NO: 2841288 - protein, 20 aa, Entamoeba invadens
ATSVAPLPKPPKQKVVPSTP

SEQ ID NO: 2841289 - protein, 4 aa, Entamoeba invadens
ATTA

SEQ ID NO: 2841290 - protein, 7 aa, Entamoeba invadens
ATTAEDL

SEQ ID NO: 2841291 - protein, 6 aa, Entamoeba invadens
ATTATE

SEQ ID NO: 2841292 - protein, 7 aa, Entamoeba invadens
ATTATHY

SEQ ID NO: 2841293 - protein, 9 aa, Entamoeba invadens
ATTEERSKA

SEQ ID NO: 2841294 - protein, 11 aa, Entamoeba invadens
ATTETAKKGIK

SEQ ID NO: 2841295 - protein, 8 aa, Entamoeba invadens
ATTGIGGK

SEQ ID NO: 2841296 - protein, 8 aa, Entamoeba invadens
ATTHADNT

SEQ ID NO: 2841297 - protein, 5 aa, Entamoeba invadens
ATTHD

SEQ ID NO: 2841298 - protein, 5 aa, Entamoeba invadens
ATTKL

SEQ ID NO: 2841299 - protein, 11 aa, Entamoeba invadens
ATTKSEGGDGM

SEQ ID NO: 2841300 - protein, 5 aa, Entamoeba invadens
ATTNG

SEQ ID NO: 2841301 - protein, 5 aa, Entamoeba invadens
ATTNN

SEQ ID NO: 2841302 - protein, 7 aa, Entamoeba invadens
ATTNPEA

SEQ ID NO: 2841303 - protein, 7 aa, Entamoeba invadens
ATTNQEK

SEQ ID NO: 2841304 - protein, 6 aa, Entamoeba invadens
ATTPHL

SEQ ID NO: 2841305 - protein, 5 aa, Entamoeba invadens
ATTPR

SEQ ID NO: 2841306 - protein, 20 aa, Entamoeba invadens
ATTPRKALSPRTPRSPQKPL

SEQ ID NO: 2841307 - protein, 6 aa, Entamoeba invadens
ATTPTR

SEQ ID NO: 2841308 - protein, 6 aa, Entamoeba invadens
ATTPVE

SEQ ID NO: 2841309 - protein, 24 aa, Entamoeba invadens
ATTQISTRLDPEELNEEKKIGEGS

SEQ ID NO: 2841310 - protein, 5 aa, Entamoeba invadens
ATTQN

SEQ ID NO: 2841311 - protein, 12 aa, Entamoeba invadens
ATTREKQRKGIA

SEQ ID NO: 2841312 - protein, 5 aa, Entamoeba invadens
ATTRG

SEQ ID NO: 2841313 - protein, 16 aa, Entamoeba invadens
ATTRPMSQERQRKEKV

SEQ ID NO: 2841314 - protein, 10 aa, Entamoeba invadens
ATTRSKISST

SEQ ID NO: 2841315 - protein, 8 aa, Entamoeba invadens
ATTSAMQE

SEQ ID NO: 2841316 - protein, 10 aa, Entamoeba invadens
ATTSNTPIFD

SEQ ID NO: 2841317 - protein, 8 aa, Entamoeba invadens
ATTSSEGT

SEQ ID NO: 2841318 - protein, 9 aa, Entamoeba invadens
ATTTEEPKD

SEQ ID NO: 2841319 - protein, 7 aa, Entamoeba invadens
ATTTGTF

SEQ ID NO: 2841320 - protein, 5 aa, Entamoeba invadens
ATTTL

SEQ ID NO: 2841321 - protein, 4 aa, Entamoeba invadens
ATTV

SEQ ID NO: 2841322 - protein, 11 aa, Entamoeba invadens
ATTVPYQAPAR

SEQ ID NO: 2841323 - protein, 17 aa, Entamoeba invadens
ATTWNAKKAKKYSTFSS

SEQ ID NO: 2841324 - protein, 7 aa, Entamoeba invadens
ATTYGET

SEQ ID NO: 2841325 - protein, 5 aa, Entamoeba invadens
ATTYQ

SEQ ID NO: 2841326 - protein, 9 aa, Entamoeba invadens
ATVAQGNPF

SEQ ID NO: 2841327 - protein, 7 aa, Entamoeba invadens
ATVDDET

SEQ ID NO: 2841328 - protein, 14 aa, Entamoeba invadens
ATVDGVSRADTAEA

SEQ ID NO: 2841329 - protein, 9 aa, Entamoeba invadens
ATVDVSDYN

SEQ ID NO: 2841330 - protein, 13 aa, Entamoeba invadens
ATVENADVTTVGK

SEQ ID NO: 2841331 - protein, 12 aa, Entamoeba invadens
ATVGNGDMDADD

SEQ ID NO: 2841332 - protein, 7 aa, Entamoeba invadens
ATVGTDF

SEQ ID NO: 2841333 - protein, 6 aa, Entamoeba invadens
ATVKRE

SEQ ID NO: 2841334 - protein, 6 aa, Entamoeba invadens
ATVQAS

SEQ ID NO: 2841335 - protein, 10 aa, Entamoeba invadens
ATVQQEDETR

SEQ ID NO: 2841336 - protein, 21 aa, Entamoeba invadens
ATVRTAKKNATGNVGERGNKV

SEQ ID NO: 2841337 - protein, 5 aa, Entamoeba invadens
ATVTQ

SEQ ID NO: 2841338 - protein, 17 aa, Entamoeba invadens
ATVTTTNKIKSLGDEAF

SEQ ID NO: 2841339 - protein, 28 aa, Entamoeba invadens
ATVYGDPETVPVSEDTPLQKPSNPYGQT

SEQ ID NO: 2841340 - protein, 6 aa, Entamoeba invadens
ATYKER

SEQ ID NO: 2841341 - protein, 7 aa, Entamoeba invadens
ATYPSEV

SEQ ID NO: 2841342 - protein, 4 aa, Entamoeba invadens
ATYS

SEQ ID NO: 2841343 - protein, 16 aa, Entamoeba invadens
AVAKPQRSKATSMSTR

SEQ ID NO: 2841344 - protein, 8 aa, Entamoeba invadens
AVAKTQER

SEQ ID NO: 2841345 - protein, 9 aa, Entamoeba invadens
AVAPGQNKN

SEQ ID NO: 2841346 - protein, 15 aa, Entamoeba invadens
AVASAEENMTEEAKE

SEQ ID NO: 2841347 - protein, 5 aa, Entamoeba invadens
AVASK

SEQ ID NO: 2841348 - protein, 9 aa, Entamoeba invadens
AVASKDREK

SEQ ID NO: 2841349 - protein, 20 aa, Entamoeba invadens
AVDAHGKSTESHEWEKDGES

SEQ ID NO: 2841350 - protein, 4 aa, Entamoeba invadens
AVDD

SEQ ID NO: 2841351 - protein, 13 aa, Entamoeba invadens
AVDEAEKQGAKYK

SEQ ID NO: 2841352 - protein, 34 aa, Entamoeba invadens
AVDEEKSQRITKSSRPIVGKEKQSISFLDTPMED

SEQ ID NO: 2841353 - protein, 11 aa, Entamoeba invadens
AVDELKNRERA

SEQ ID NO: 2841354 - protein, 6 aa, Entamoeba invadens
AVDKDG

SEQ ID NO: 2841355 - protein, 8 aa, Entamoeba invadens
AVDQGPLS

SEQ ID NO: 2841356 - protein, 13 aa, Entamoeba invadens
AVDTEASEGVELD

SEQ ID NO: 2841357 - protein, 18 aa, Entamoeba invadens
AVDTPPNEGNTNNPDNTF

SEQ ID NO: 2841358 - protein, 5 aa, Entamoeba invadens
AVDVN

SEQ ID NO: 2841359 - protein, 13 aa, Entamoeba invadens
AVEAEEEDRQRRA

SEQ ID NO: 2841360 - protein, 9 aa, Entamoeba invadens
AVEAKKEEI

SEQ ID NO: 2841361 - protein, 6 aa, Entamoeba invadens
AVEDQQ

SEQ ID NO: 2841362 - protein, 6 aa, Entamoeba invadens
AVEDQY

SEQ ID NO: 2841363 - protein, 4 aa, Entamoeba invadens
AVEE

SEQ ID NO: 2841364 - protein, 35 aa, Entamoeba invadens
AVEEFKRQEKEAQSVATEVKAETVEEKNEQKIEQT

SEQ ID NO: 2841365 - protein, 11 aa, Entamoeba invadens
AVEEKSDMATT

SEQ ID NO: 2841366 - protein, 14 aa, Entamoeba invadens
AVEESGAKGSPVLQ

SEQ ID NO: 2841367 - protein, 11 aa, Entamoeba invadens
AVEKSGNLTTP

SEQ ID NO: 2841368 - protein, 6 aa, Entamoeba invadens
AVENNE

SEQ ID NO: 2841369 - protein, 13 aa, Entamoeba invadens
AVENQSLALEQVI

SEQ ID NO: 2841370 - protein, 9 aa, Entamoeba invadens
AVEQAEVRR

SEQ ID NO: 2841371 - protein, 41 aa, Entamoeba invadens
AVEQNRKMKEAAEKEAKKEAEKKKKAEMAAARKAGGKVDAL

SEQ ID NO: 2841372 - protein, 15 aa, Entamoeba invadens
AVESAVRGEGATYLE

SEQ ID NO: 2841373 - protein, 16 aa, Entamoeba invadens
AVETTKTNNNMSYDVV

SEQ ID NO: 2841374 - protein, 20 aa, Entamoeba invadens
AVETTLKADPREKKHTKFSG

SEQ ID NO: 2841375 - protein, 5 aa, Entamoeba invadens
AVEYG

SEQ ID NO: 2841376 - protein, 6 aa, Entamoeba invadens
AVGDDI

SEQ ID NO: 2841377 - protein, 5 aa, Entamoeba invadens
AVGDI

SEQ ID NO: 2841378 - protein, 12 aa, Entamoeba invadens
AVGFDTDEMKKE

SEQ ID NO: 2841379 - protein, 5 aa, Entamoeba invadens
AVGGF

SEQ ID NO: 2841380 - protein, 8 aa, Entamoeba invadens
AVGGKNGK

SEQ ID NO: 2841381 - protein, 10 aa, Entamoeba invadens
AVGKKQERTD

SEQ ID NO: 2841382 - protein, 10 aa, Entamoeba invadens
AVGKKYEDTD

SEQ ID NO: 2841383 - protein, 27 aa, Entamoeba invadens
  misc_feature (13)..(14): Xaa can be any naturally occurring amino acid
AVGKTSLSNQLVXXLYDKKCGQEQYKS

SEQ ID NO: 2841384 - protein, 4 aa, Entamoeba invadens
AVGR

SEQ ID NO: 2841385 - protein, 5 aa, Entamoeba invadens
AVGSL

SEQ ID NO: 2841386 - protein, 8 aa, Entamoeba invadens
AVHQTTPR

SEQ ID NO: 2841387 - protein, 6 aa, Entamoeba invadens
AVIESR

SEQ ID NO: 2841388 - protein, 11 aa, Entamoeba invadens
AVIPNETYTSL

SEQ ID NO: 2841389 - protein, 12 aa, Entamoeba invadens
AVKAKRKNVSFG

SEQ ID NO: 2841390 - protein, 11 aa, Entamoeba invadens
AVKDAKEKFPK

SEQ ID NO: 2841391 - protein, 10 aa, Entamoeba invadens
AVKDTSPYIR

SEQ ID NO: 2841392 - protein, 8 aa, Entamoeba invadens
AVKEEQRI

SEQ ID NO: 2841393 - protein, 10 aa, Entamoeba invadens
AVKEKKDGIA

SEQ ID NO: 2841394 - protein, 18 aa, Entamoeba invadens
AVKERADGKYTSSCDKET

SEQ ID NO: 2841395 - protein, 23 aa, Entamoeba invadens
AVKETIEKEKERKEMNGKKYQER

SEQ ID NO: 2841396 - protein, 6 aa, Entamoeba invadens
AVKNET

SEQ ID NO: 2841397 - protein, 22 aa, Entamoeba invadens
AVKPKTMNADDWSAAKETPERI

SEQ ID NO: 2841398 - protein, 35 aa, Entamoeba invadens
AVKPTKTKQKKDVTTKNAEGDEKIEKVGTEEEESF

SEQ ID NO: 2841399 - protein, 6 aa, Entamoeba invadens
AVKRSR

SEQ ID NO: 2841400 - protein, 16 aa, Entamoeba invadens
AVKSAANKLRKKLSGK

SEQ ID NO: 2841401 - protein, 18 aa, Entamoeba invadens
AVKSEQKSEEKTEEKEEV

SEQ ID NO: 2841402 - protein, 5 aa, Entamoeba invadens
AVKYG

SEQ ID NO: 2841403 - protein, 8 aa, Entamoeba invadens
AVNEKENV

SEQ ID NO: 2841404 - protein, 5 aa, Entamoeba invadens
AVNEQ

SEQ ID NO: 2841405 - protein, 5 aa, Entamoeba invadens
AVNGE

SEQ ID NO: 2841406 - protein, 6 aa, Entamoeba invadens
AVNGEF

SEQ ID NO: 2841407 - protein, 8 aa, Entamoeba invadens
AVNGRDKK

SEQ ID NO: 2841408 - protein, 10 aa, Entamoeba invadens
AVNPNQQQEE

SEQ ID NO: 2841409 - protein, 7 aa, Entamoeba invadens
AVNTEES

SEQ ID NO: 2841410 - protein, 5 aa, Entamoeba invadens
AVPAD

SEQ ID NO: 2841411 - protein, 6 aa, Entamoeba invadens
AVPEST

SEQ ID NO: 2841412 - protein, 7 aa, Entamoeba invadens
AVPGQPS

SEQ ID NO: 2841413 - protein, 10 aa, Entamoeba invadens
AVPKDGDELK

SEQ ID NO: 2841414 - protein, 13 aa, Entamoeba invadens
AVPNTNGSKPQTR

SEQ ID NO: 2841415 - protein, 9 aa, Entamoeba invadens
AVPQNGQPG

SEQ ID NO: 2841416 - protein, 11 aa, Entamoeba invadens
AVPSGASTGVH

SEQ ID NO: 2841417 - protein, 18 aa, Entamoeba invadens
AVPSLSQSDIQSTSPNIL

SEQ ID NO: 2841418 - protein, 6 aa, Entamoeba invadens
AVPSSL

SEQ ID NO: 2841419 - protein, 10 aa, Entamoeba invadens
AVPTPRNVSC

SEQ ID NO: 2841420 - protein, 17 aa, Entamoeba invadens
AVPVQPSGSPISSPEIQ

SEQ ID NO: 2841421 - protein, 24 aa, Entamoeba invadens
AVQAQEDAKNKKRAELQKKIETAG

SEQ ID NO: 2841422 - protein, 6 aa, Entamoeba invadens
AVQASI

SEQ ID NO: 2841423 - protein, 7 aa, Entamoeba invadens
AVQENSI

SEQ ID NO: 2841424 - protein, 13 aa, Entamoeba invadens
AVQESGAKGNPML

SEQ ID NO: 2841425 - protein, 17 aa, Entamoeba invadens
AVQESGAKGNPVVQPPN

SEQ ID NO: 2841426 - protein, 7 aa, Entamoeba invadens
AVQGADH

SEQ ID NO: 2841427 - protein, 7 aa, Entamoeba invadens
AVQGGLT

SEQ ID NO: 2841428 - protein, 6 aa, Entamoeba invadens
AVQGNS

SEQ ID NO: 2841429 - protein, 8 aa, Entamoeba invadens
AVQKTSQL

SEQ ID NO: 2841430 - protein, 7 aa, Entamoeba invadens
AVQNNTI

SEQ ID NO: 2841431 - protein, 5 aa, Entamoeba invadens
AVQPL

SEQ ID NO: 2841432 - protein, 12 aa, Entamoeba invadens
AVQSRISSRTNI

SEQ ID NO: 2841433 - protein, 4 aa, Entamoeba invadens
AVQT

SEQ ID NO: 2841434 - protein, 9 aa, Entamoeba invadens
AVQTKSKEL

SEQ ID NO: 2841435 - protein, 9 aa, Entamoeba invadens
AVRDPTEKE

SEQ ID NO: 2841436 - protein, 4 aa, Entamoeba invadens
AVRE

SEQ ID NO: 2841437 - protein, 33 aa, Entamoeba invadens
AVRECKRQEEEAQSVATEVKTDKEKDEKKIEQT

SEQ ID NO: 2841438 - protein, 5 aa, Entamoeba invadens
AVREN

SEQ ID NO: 2841439 - protein, 8 aa, Entamoeba invadens
AVRENELP

SEQ ID NO: 2841440 - protein, 6 aa, Entamoeba invadens
AVRGKG

SEQ ID NO: 2841441 - protein, 16 aa, Entamoeba invadens
AVRKEKAEQDEAEKQF

SEQ ID NO: 2841442 - protein, 16 aa, Entamoeba invadens
AVRQSRRRVTRSMTPA

SEQ ID NO: 2841443 - protein, 31 aa, Entamoeba invadens
AVRRGTEKQYLSPEPPRGEGTQTVKKTKTRY

SEQ ID NO: 2841444 - protein, 8 aa, Entamoeba invadens
AVSAKDVG

SEQ ID NO: 2841445 - protein, 7 aa, Entamoeba invadens
AVSCDKN

SEQ ID NO: 2841446 - protein, 4 aa, Entamoeba invadens
AVSD

SEQ ID NO: 2841447 - protein, 9 aa, Entamoeba invadens
AVSDDNDGV

SEQ ID NO: 2841448 - protein, 9 aa, Entamoeba invadens
AVSEDEVKI

SEQ ID NO: 2841449 - protein, 6 aa, Entamoeba invadens
AVSEED

SEQ ID NO: 2841450 - protein, 5 aa, Entamoeba invadens
AVSEL

SEQ ID NO: 2841451 - protein, 8 aa, Entamoeba invadens
AVSHDQEK

SEQ ID NO: 2841452 - protein, 7 aa, Entamoeba invadens
AVSKDGK

SEQ ID NO: 2841453 - protein, 7 aa, Entamoeba invadens
AVSKESD

SEQ ID NO: 2841454 - protein, 16 aa, Entamoeba invadens
AVSKKTKVDFMVALQL

SEQ ID NO: 2841455 - protein, 9 aa, Entamoeba invadens
AVSKQDGLK

SEQ ID NO: 2841456 - protein, 14 aa, Entamoeba invadens
AVSNNQKTHSPNDK

SEQ ID NO: 2841457 - protein, 10 aa, Entamoeba invadens
AVSNSTPVNA

SEQ ID NO: 2841458 - protein, 8 aa, Entamoeba invadens
AVSPGTQF

SEQ ID NO: 2841459 - protein, 9 aa, Entamoeba invadens
AVSPNNSSW

SEQ ID NO: 2841460 - protein, 8 aa, Entamoeba invadens
AVSQQQQL

SEQ ID NO: 2841461 - protein, 12 aa, Entamoeba invadens
AVSSHMSEEPIR

SEQ ID NO: 2841462 - protein, 7 aa, Entamoeba invadens
AVSSPEK

SEQ ID NO: 2841463 - protein, 4 aa, Entamoeba invadens
AVST

SEQ ID NO: 2841464 - protein, 33 aa, Entamoeba invadens
AVSTPSLPEIPKTPSPASCDEKSMKKACEEKKE

SEQ ID NO: 2841465 - protein, 5 aa, Entamoeba invadens
AVSTQ

SEQ ID NO: 2841466 - protein, 11 aa, Entamoeba invadens
AVTDTKRVNGI

SEQ ID NO: 2841467 - protein, 4 aa, Entamoeba invadens
AVTE

SEQ ID NO: 2841468 - protein, 9 aa, Entamoeba invadens
AVTKKSGKD

SEQ ID NO: 2841469 - protein, 8 aa, Entamoeba invadens
AVTMSEGK

SEQ ID NO: 2841470 - protein, 5 aa, Entamoeba invadens
AVTND

SEQ ID NO: 2841471 - protein, 9 aa, Entamoeba invadens
AVTNSDAEM

SEQ ID NO: 2841472 - protein, 13 aa, Entamoeba invadens
AVTNSDDKKGVVT

SEQ ID NO: 2841473 - protein, 12 aa, Entamoeba invadens
AVTNSDKDEGVV

SEQ ID NO: 2841474 - protein, 9 aa, Entamoeba invadens
AVTPGASQK

SEQ ID NO: 2841475 - protein, 11 aa, Entamoeba invadens
AVTPKKSLLSP

SEQ ID NO: 2841476 - protein, 6 aa, Entamoeba invadens
AVTPTI

SEQ ID NO: 2841477 - protein, 5 aa, Entamoeba invadens
AVTQN

SEQ ID NO: 2841478 - protein, 26 aa, Entamoeba invadens
AVTRPSVARRPGRGGKGRKAASKNLI

SEQ ID NO: 2841479 - protein, 15 aa, Entamoeba invadens
AVTRQQHESSGSHKR

SEQ ID NO: 2841480 - protein, 4 aa, Entamoeba invadens
AVTT

SEQ ID NO: 2841481 - protein, 5 aa, Entamoeba invadens
AVTTA

SEQ ID NO: 2841482 - protein, 32 aa, Entamoeba invadens
AVTTTPIEQPKNDQPIPIPPVNPTIAPTVAPP

SEQ ID NO: 2841483 - protein, 16 aa, Entamoeba invadens
AVTTVTEKSNEELEQI

SEQ ID NO: 2841484 - protein, 15 aa, Entamoeba invadens
AVTYAEGKKFADEGG

SEQ ID NO: 2841485 - protein, 7 aa, Entamoeba invadens
AVVTESN

SEQ ID NO: 2841486 - protein, 13 aa, Entamoeba invadens
AVVTQPKETSTWI

SEQ ID NO: 2841487 - protein, 7 aa, Entamoeba invadens
AVYGSVQ

SEQ ID NO: 2841488 - protein, 17 aa, Entamoeba invadens
AVYGTKSEKPDEEEAKK

SEQ ID NO: 2841489 - protein, 5 aa, Entamoeba invadens
AWEET

SEQ ID NO: 2841490 - protein, 14 aa, Entamoeba invadens
AWNAKDGKLNKSEF

SEQ ID NO: 2841491 - protein, 5 aa, Entamoeba invadens
AWSPE

SEQ ID NO: 2841492 - protein, 15 aa, Entamoeba invadens
AWYPESTDMAEEDDS

SEQ ID NO: 2841493 - protein, 9 aa, Entamoeba invadens
AYAAGYTKS

SEQ ID NO: 2841494 - protein, 5 aa, Entamoeba invadens
AYARQ

SEQ ID NO: 2841495 - protein, 9 aa, Entamoeba invadens
AYASGALKE

SEQ ID NO: 2841496 - protein, 9 aa, Entamoeba invadens
AYASGQLKD

SEQ ID NO: 2841497 - protein, 5 aa, Entamoeba invadens
AYATQ

SEQ ID NO: 2841498 - protein, 10 aa, Entamoeba invadens
AYDDDQEVRD

SEQ ID NO: 2841499 - protein, 10 aa, Entamoeba invadens
AYDKDGNYNT

SEQ ID NO: 2841500 - protein, 9 aa, Entamoeba invadens
AYDKTEENN

SEQ ID NO: 2841501 - protein, 10 aa, Entamoeba invadens
AYDKTGNCNT

SEQ ID NO: 2841502 - protein, 9 aa, Entamoeba invadens
AYDKTSSGM

SEQ ID NO: 2841503 - protein, 8 aa, Entamoeba invadens
AYDRPADS

SEQ ID NO: 2841504 - protein, 5 aa, Entamoeba invadens
AYEDN

SEQ ID NO: 2841505 - protein, 7 aa, Entamoeba invadens
AYEGDLE

SEQ ID NO: 2841506 - protein, 27 aa, Entamoeba invadens
AYEPNNPYSPFTNSHKDKFDLDKPTYT

SEQ ID NO: 2841507 - protein, 8 aa, Entamoeba invadens
AYETNGNK

SEQ ID NO: 2841508 - protein, 7 aa, Entamoeba invadens
AYETSNP

SEQ ID NO: 2841509 - protein, 5 aa, Entamoeba invadens
AYETY

SEQ ID NO: 2841510 - protein, 13 aa, Entamoeba invadens
AYETYKSDWEGVG

SEQ ID NO: 2841511 - protein, 10 aa, Entamoeba invadens
AYFPKKDKQL

SEQ ID NO: 2841512 - protein, 9 aa, Entamoeba invadens
AYGEGTPSA

SEQ ID NO: 2841513 - protein, 25 aa, Entamoeba invadens
AYGGPLDKFDQKEKPALPGKATQLN

SEQ ID NO: 2841514 - protein, 10 aa, Entamoeba invadens
AYGKRPNSRY

SEQ ID NO: 2841515 - protein, 9 aa, Entamoeba invadens
AYGNCSNES

SEQ ID NO: 2841516 - protein, 5 aa, Entamoeba invadens
AYGPC

SEQ ID NO: 2841517 - protein, 14 aa, Entamoeba invadens
AYGPGCPGLKAPVS

SEQ ID NO: 2841518 - protein, 15 aa, Entamoeba invadens
AYGPGVEGKTSIDKT

SEQ ID NO: 2841519 - protein, 4 aa, Entamoeba invadens
AYGT

SEQ ID NO: 2841520 - protein, 5 aa, Entamoeba invadens
AYGTG

SEQ ID NO: 2841521 - protein, 10 aa, Entamoeba invadens
AYGYSKQSTT

SEQ ID NO: 2841522 - protein, 15 aa, Entamoeba invadens
AYKDAKTLCEGKDSQ

SEQ ID NO: 2841523 - protein, 14 aa, Entamoeba invadens
AYKKGGNDEGLEPI

SEQ ID NO: 2841524 - protein, 5 aa, Entamoeba invadens
AYKNS

SEQ ID NO: 2841525 - protein, 9 aa, Entamoeba invadens
AYKPEPFQY

SEQ ID NO: 2841526 - protein, 16 aa, Entamoeba invadens
AYKQKRVVTDSTLESR

SEQ ID NO: 2841527 - protein, 15 aa, Entamoeba invadens
AYKVTQPNDKTPRFS

SEQ ID NO: 2841528 - protein, 8 aa, Entamoeba invadens
AYNDDDFA

SEQ ID NO: 2841529 - protein, 5 aa, Entamoeba invadens
AYNDK

SEQ ID NO: 2841530 - protein, 4 aa, Entamoeba invadens
AYNE

SEQ ID NO: 2841531 - protein, 5 aa, Entamoeba invadens
AYNEK

SEQ ID NO: 2841532 - protein, 5 aa, Entamoeba invadens
AYNTS

SEQ ID NO: 2841533 - protein, 12 aa, Entamoeba invadens
AYNVGDAKVKEN

SEQ ID NO: 2841534 - protein, 8 aa, Entamoeba invadens
AYPGVEED

SEQ ID NO: 2841535 - protein, 4 aa, Entamoeba invadens
AYPH

SEQ ID NO: 2841536 - protein, 13 aa, Entamoeba invadens
AYPIERTNAGGKD

SEQ ID NO: 2841537 - protein, 13 aa, Entamoeba invadens
AYPIERTTAGGKD

SEQ ID NO: 2841538 - protein, 6 aa, Entamoeba invadens
AYPKED

SEQ ID NO: 2841539 - protein, 5 aa, Entamoeba invadens
AYPKT

SEQ ID NO: 2841540 - protein, 6 aa, Entamoeba invadens
AYPKTE

SEQ ID NO: 2841541 - protein, 9 aa, Entamoeba invadens
AYPKTTSEA

SEQ ID NO: 2841542 - protein, 4 aa, Entamoeba invadens
AYPM

SEQ ID NO: 2841543 - protein, 9 aa, Entamoeba invadens
AYPPMGAPG

SEQ ID NO: 2841544 - protein, 37 aa, Entamoeba invadens
AYPPPMGAYPPPMGAYPPPMGAYPPPMGAYPPPMGGY

SEQ ID NO: 2841545 - protein, 8 aa, Entamoeba invadens
AYPPYDQQ

SEQ ID NO: 2841546 - protein, 5 aa, Entamoeba invadens
AYPQS

SEQ ID NO: 2841547 - protein, 9 aa, Entamoeba invadens
AYPSTEDGK

SEQ ID NO: 2841548 - protein, 6 aa, Entamoeba invadens
AYPTEN

SEQ ID NO: 2841549 - protein, 5 aa, Entamoeba invadens
AYPTN

SEQ ID NO: 2841550 - protein, 10 aa, Entamoeba invadens
AYQESDRNDW

SEQ ID NO: 2841551 - protein, 15 aa, Entamoeba invadens
AYQKKQNESLEQTDE

SEQ ID NO: 2841552 - protein, 6 aa, Entamoeba invadens
AYQNKA

SEQ ID NO: 2841553 - protein, 85 aa, Entamoeba invadens
AYQQQQQSAQQGAAAQKPAAGAQPQQQPAQQPQAAAQQQYPQQSYPGYPQQQQPAAQQQPGSQKPAAGQTPATGAQQQYDPQQYA

SEQ ID NO: 2841554 - protein, 175 aa, Entamoeba invadens
AYQQQQQSAQQGAAAQKPAAGAQPQQQPAQQQYPQQSYPGYPQQQQPAAQQQPGASTQQAYPGHPQQQTTQPQQPYPQQAYPGYPQQPAQQPQQGASAQQAYPGYPQQQPGTAAGQYGAQQAYPGYPQQAGACAQQPQGAAQTAKAQQPGAAAQQYPGAQAGANPYGMQQPGMNQ

SEQ ID NO: 2841555 - protein, 5 aa, Entamoeba invadens
AYQSD

SEQ ID NO: 2841556 - protein, 67 aa, Entamoeba invadens
AYRPTDKVTIGANGKYSKTNGVASKEVNVKGSYTGDKLSVNGALSSGKNGNDKTKSLSVDGKYKVND

SEQ ID NO: 2841557 - protein, 13 aa, Entamoeba invadens
AYSDPVIDEEERS

SEQ ID NO: 2841558 - protein, 11 aa, Entamoeba invadens
AYSEDEKVKLT

SEQ ID NO: 2841559 - protein, 19 aa, Entamoeba invadens
AYSENGEDEKERKEKERQK

SEQ ID NO: 2841560 - protein, 11 aa, Entamoeba invadens
AYSGNTTNNAN

SEQ ID NO: 2841561 - protein, 5 aa, Entamoeba invadens
AYSGQ

SEQ ID NO: 2841562 - protein, 5 aa, Entamoeba invadens
AYSNS

SEQ ID NO: 2841563 - protein, 6 aa, Entamoeba invadens
AYSNSE

SEQ ID NO: 2841564 - protein, 9 aa, Entamoeba invadens
AYSNSNGKV

SEQ ID NO: 2841565 - protein, 7 aa, Entamoeba invadens
AYSPQMK

SEQ ID NO: 2841566 - protein, 5 aa, Entamoeba invadens
AYSQK

SEQ ID NO: 2841567 - protein, 8 aa, Entamoeba invadens
AYSQKTQQ

SEQ ID NO: 2841568 - protein, 7 aa, Entamoeba invadens
AYSRDQQ

SEQ ID NO: 2841569 - protein, 7 aa, Entamoeba invadens
AYSSGQL

SEQ ID NO: 2841570 - protein, 16 aa, Entamoeba invadens
AYSSQDQEYEKNEFYG

SEQ ID NO: 2841571 - protein, 29 aa, Entamoeba invadens
AYSSTEARKAREQTKKQNEGKFSESQFPK

SEQ ID NO: 2841572 - protein, 4 aa, Entamoeba invadens
AYTA

SEQ ID NO: 2841573 - protein, 8 aa, Entamoeba invadens
AYTESRLK

SEQ ID NO: 2841574 - protein, 16 aa, Entamoeba invadens
AYTEVDDALKSGDKEL

SEQ ID NO: 2841575 - protein, 13 aa, Entamoeba invadens
AYTFGEKQNTCPY

SEQ ID NO: 2841576 - protein, 6 aa, Entamoeba invadens
AYTGTV

SEQ ID NO: 2841577 - protein, 10 aa, Entamoeba invadens
AYTKDGNAST

SEQ ID NO: 2841578 - protein, 7 aa, Entamoeba invadens
AYTKSSF

SEQ ID NO: 2841579 - protein, 5 aa, Entamoeba invadens
AYTLS

SEQ ID NO: 2841580 - protein, 4 aa, Entamoeba invadens
AYTQ

SEQ ID NO: 2841581 - protein, 5 aa, Entamoeba invadens
AYTSI

SEQ ID NO: 2841582 - protein, 14 aa, Entamoeba invadens
CADGEDSSDKEDEV

SEQ ID NO: 2841583 - protein, 4 aa, Entamoeba invadens
CADP

SEQ ID NO: 2841584 - protein, 6 aa, Entamoeba invadens
CAEEIT

SEQ ID NO: 2841585 - protein, 5 aa, Entamoeba invadens
CAEKH

SEQ ID NO: 2841586 - protein, 9 aa, Entamoeba invadens
CAENDRKGL

SEQ ID NO: 2841587 - protein, 8 aa, Entamoeba invadens
CAENKDDL

SEQ ID NO: 2841588 - protein, 4 aa, Entamoeba invadens
CAGG

SEQ ID NO: 2841589 - protein, 9 aa, Entamoeba invadens
CAGGALPEQ

SEQ ID NO: 2841590 - protein, 9 aa, Entamoeba invadens
CAGGDTSVY

SEQ ID NO: 2841591 - protein, 9 aa, Entamoeba invadens
CAGRDSNET

SEQ ID NO: 2841592 - protein, 7 aa, Entamoeba invadens
CAGSDNY

SEQ ID NO: 2841593 - protein, 4 aa, Entamoeba invadens
CAIK

SEQ ID NO: 2841594 - protein, 9 aa, Entamoeba invadens
CAINTQDGE

SEQ ID NO: 2841595 - protein, 11 aa, Entamoeba invadens
CAISDRKGISI

SEQ ID NO: 2841596 - protein, 19 aa, Entamoeba invadens
CAKPPTASEGKKDVGSSMT

SEQ ID NO: 2841597 - protein, 7 aa, Entamoeba invadens
CAKSNSS

SEQ ID NO: 2841598 - protein, 6 aa, Entamoeba invadens
CAKTTI

SEQ ID NO: 2841599 - protein, 9 aa, Entamoeba invadens
CANSKYENV

SEQ ID NO: 2841600 - protein, 8 aa, Entamoeba invadens
CANTEERI

SEQ ID NO: 2841601 - protein, 16 aa, Entamoeba invadens
CAPDGKTVVTASAQGT

SEQ ID NO: 2841602 - protein, 8 aa, Entamoeba invadens
CAPDTGKK

SEQ ID NO: 2841603 - protein, 5 aa, Entamoeba invadens
CAPEG

SEQ ID NO: 2841604 - protein, 8 aa, Entamoeba invadens
CAPGETPK

SEQ ID NO: 2841605 - protein, 20 aa, Entamoeba invadens
CAPNTCNTSNGNCDKCTENK

SEQ ID NO: 2841606 - protein, 7 aa, Entamoeba invadens
CAPTEEE

SEQ ID NO: 2841607 - protein, 6 aa, Entamoeba invadens
CAPTPL

SEQ ID NO: 2841608 - protein, 11 aa, Entamoeba invadens
CAQCADDGETC

SEQ ID NO: 2841609 - protein, 12 aa, Entamoeba invadens
CARTDKGVSAAN

SEQ ID NO: 2841610 - protein, 10 aa, Entamoeba invadens
CASCSEKQME

SEQ ID NO: 2841611 - protein, 13 aa, Entamoeba invadens
CASERKHKELTQK

SEQ ID NO: 2841612 - protein, 10 aa, Entamoeba invadens
CASGQSKSGI

SEQ ID NO: 2841613 - protein, 5 aa, Entamoeba invadens
CASLS

SEQ ID NO: 2841614 - protein, 30 aa, Entamoeba invadens
CASPPQLPPPRKSTLVKPQQTSQSPQKTER

SEQ ID NO: 2841615 - protein, 16 aa, Entamoeba invadens
CASQRSGRAGRTGPGK

SEQ ID NO: 2841616 - protein, 17 aa, Entamoeba invadens
CASTSQQTSAQNSKMNE

SEQ ID NO: 2841617 - protein, 5 aa, Entamoeba invadens
CATGG

SEQ ID NO: 2841618 - protein, 10 aa, Entamoeba invadens
CATKVNESTL

SEQ ID NO: 2841619 - protein, 8 aa, Entamoeba invadens
CATPTQLS

SEQ ID NO: 2841620 - protein, 23 aa, Entamoeba invadens
CATSHETNKSSSSDSESSNNSAT

SEQ ID NO: 2841621 - protein, 6 aa, Entamoeba invadens
CAVDGR

SEQ ID NO: 2841622 - protein, 11 aa, Entamoeba invadens
CCGEDSKEQCE

SEQ ID NO: 2841623 - protein, 13 aa, Entamoeba invadens
CCGGGDSANTKEL

SEQ ID NO: 2841624 - protein, 18 aa, Entamoeba invadens
CCGGNSGIAIEGQPTYSL

SEQ ID NO: 2841625 - protein, 12 aa, Entamoeba invadens
CCPGRGNSTSDI

SEQ ID NO: 2841626 - protein, 18 aa, Entamoeba invadens
CCQDDSASNTSYTYNTDV

SEQ ID NO: 2841627 - protein, 6 aa, Entamoeba invadens
CDACDE

SEQ ID NO: 2841628 - protein, 12 aa, Entamoeba invadens
CDARDRKVKPRQ

SEQ ID NO: 2841629 - protein, 26 aa, Entamoeba invadens
CDDAPDTSDNGDVEEKEEVDNGPEGE

SEQ ID NO: 2841630 - protein, 10 aa, Entamoeba invadens
CDDEIEKSGM

SEQ ID NO: 2841631 - protein, 8 aa, Entamoeba invadens
CDDPEQSS

SEQ ID NO: 2841632 - protein, 9 aa, Entamoeba invadens
CDDQPDYDP

SEQ ID NO: 2841633 - protein, 8 aa, Entamoeba invadens
CDDRYGSS

SEQ ID NO: 2841634 - protein, 14 aa, Entamoeba invadens
CDDVDKSNKTINYE

SEQ ID NO: 2841635 - protein, 6 aa, Entamoeba invadens
CDEEDY

SEQ ID NO: 2841636 - protein, 6 aa, Entamoeba invadens
CDEEKS

SEQ ID NO: 2841637 - protein, 7 aa, Entamoeba invadens
CDEEKSP

SEQ ID NO: 2841638 - protein, 9 aa, Entamoeba invadens
CDESPQSKI

SEQ ID NO: 2841639 - protein, 6 aa, Entamoeba invadens
CDETNK

SEQ ID NO: 2841640 - protein, 7 aa, Entamoeba invadens
CDEYNKN

SEQ ID NO: 2841641 - protein, 12 aa, Entamoeba invadens
CDGADKKDKYPV

SEQ ID NO: 2841642 - protein, 9 aa, Entamoeba invadens
CDGDFGGKT

SEQ ID NO: 2841643 - protein, 11 aa, Entamoeba invadens
CDGDVPKEVAQ

SEQ ID NO: 2841644 - protein, 4 aa, Entamoeba invadens
CDGK

SEQ ID NO: 2841645 - protein, 8 aa, Entamoeba invadens
CDGSEVVT

SEQ ID NO: 2841646 - protein, 7 aa, Entamoeba invadens
CDGYEGQ

SEQ ID NO: 2841647 - protein, 32 aa, Entamoeba invadens
CDKAKRQKIEKSKSSEKVEKNKNLKKTEKIEN

SEQ ID NO: 2841648 - protein, 9 aa, Entamoeba invadens
CDKCASDYT

SEQ ID NO: 2841649 - protein, 8 aa, Entamoeba invadens
CDKDTPDE

SEQ ID NO: 2841650 - protein, 12 aa, Entamoeba invadens
CDKEEERKVSQN

SEQ ID NO: 2841651 - protein, 18 aa, Entamoeba invadens
CDKKDKKASKVDEKEKEV

SEQ ID NO: 2841652 - protein, 6 aa, Entamoeba invadens
CDKSPL

SEQ ID NO: 2841653 - protein, 29 aa, Entamoeba invadens
CDKSTQAISPRSRGNTIPSQQEDSPFDNM

SEQ ID NO: 2841654 - protein, 6 aa, Entamoeba invadens
CDKTNG

SEQ ID NO: 2841655 - protein, 28 aa, Entamoeba invadens
CDLDDKDKTVSADDAKKFAEEHNCTFME

SEQ ID NO: 2841656 - protein, 6 aa, Entamoeba invadens
CDLEDQ

SEQ ID NO: 2841657 - protein, 10 aa, Entamoeba invadens
CDLEEDQKTV

SEQ ID NO: 2841658 - protein, 14 aa, Entamoeba invadens
CDLEEQRAISTEEI

SEQ ID NO: 2841659 - protein, 21 aa, Entamoeba invadens
CDLEEQRQIPTDEAKKQAEEW

SEQ ID NO: 2841660 - protein, 4 aa, Entamoeba invadens
CDLR

SEQ ID NO: 2841661 - protein, 7 aa, Entamoeba invadens
CDLTSER

SEQ ID NO: 2841662 - protein, 5 aa, Entamoeba invadens
CDMRP

SEQ ID NO: 2841663 - protein, 4 aa, Entamoeba invadens
CDNC

SEQ ID NO: 2841664 - protein, 11 aa, Entamoeba invadens
CDNCDGVTGKC

SEQ ID NO: 2841665 - protein, 6 aa, Entamoeba invadens
CDNDQN

SEQ ID NO: 2841666 - protein, 7 aa, Entamoeba invadens
CDNEAQE

SEQ ID NO: 2841667 - protein, 10 aa, Entamoeba invadens
CDNELERNTF

SEQ ID NO: 2841668 - protein, 13 aa, Entamoeba invadens
CDNELERNTFRKT

SEQ ID NO: 2841669 - protein, 8 aa, Entamoeba invadens
CDNENNEI

SEQ ID NO: 2841670 - protein, 10 aa, Entamoeba invadens
CDNKERKTIN

SEQ ID NO: 2841671 - protein, 12 aa, Entamoeba invadens
CDNYESEHDLEN

SEQ ID NO: 2841672 - protein, 5 aa, Entamoeba invadens
CDPKH

SEQ ID NO: 2841673 - protein, 6 aa, Entamoeba invadens
CDPKSV

SEQ ID NO: 2841674 - protein, 10 aa, Entamoeba invadens
CDPNNRPNFN

SEQ ID NO: 2841675 - protein, 8 aa, Entamoeba invadens
CDPTSTTV

SEQ ID NO: 2841676 - protein, 11 aa, Entamoeba invadens
CDQCNGQTGAC

SEQ ID NO: 2841677 - protein, 7 aa, Entamoeba invadens
CDQTNGQ

SEQ ID NO: 2841678 - protein, 7 aa, Entamoeba invadens
CDQTNGY

SEQ ID NO: 2841679 - protein, 8 aa, Entamoeba invadens
CDSAIKGK

SEQ ID NO: 2841680 - protein, 20 aa, Entamoeba invadens
CDSCPSKSSCSQAGSSGCTH

SEQ ID NO: 2841681 - protein, 4 aa, Entamoeba invadens
CDSD

SEQ ID NO: 2841682 - protein, 5 aa, Entamoeba invadens
CDSGN

SEQ ID NO: 2841683 - protein, 10 aa, Entamoeba invadens
CDSLDGDGHI

SEQ ID NO: 2841684 - protein, 21 aa, Entamoeba invadens
CDSNSTSGPKQSDSGNKDQLS

SEQ ID NO: 2841685 - protein, 8 aa, Entamoeba invadens
CDSPHTPT

SEQ ID NO: 2841686 - protein, 11 aa, Entamoeba invadens
CDSTCGGSCNT

SEQ ID NO: 2841687 - protein, 10 aa, Entamoeba invadens
CDSVSSSKLI

SEQ ID NO: 2841688 - protein, 9 aa, Entamoeba invadens
CDTAQNETQ

SEQ ID NO: 2841689 - protein, 8 aa, Entamoeba invadens
CDTCNSNC

SEQ ID NO: 2841690 - protein, 6 aa, Entamoeba invadens
CDTEKS

SEQ ID NO: 2841691 - protein, 15 aa, Entamoeba invadens
CDTPRSNYLTGESKH

SEQ ID NO: 2841692 - protein, 4 aa, Entamoeba invadens
CDTS

SEQ ID NO: 2841693 - protein, 9 aa, Entamoeba invadens
CDTSNQTTL

SEQ ID NO: 2841694 - protein, 15 aa, Entamoeba invadens
CDTTEDKIPVNTIWT

SEQ ID NO: 2841695 - protein, 5 aa, Entamoeba invadens
CDTTL

SEQ ID NO: 2841696 - protein, 5 aa, Entamoeba invadens
CDVPN

SEQ ID NO: 2841697 - protein, 6 aa, Entamoeba invadens
CDYKGD

SEQ ID NO: 2841698 - protein, 7 aa, Entamoeba invadens
CEAEGTC

SEQ ID NO: 2841699 - protein, 4 aa, Entamoeba invadens
CEAK

SEQ ID NO: 2841700 - protein, 5 aa, Entamoeba invadens
CEAQT

SEQ ID NO: 2841701 - protein, 11 aa, Entamoeba invadens
CEATKAAEKLE

SEQ ID NO: 2841702 - protein, 6 aa, Entamoeba invadens
CEATKT

SEQ ID NO: 2841703 - protein, 13 aa, Entamoeba invadens
CEAVSKQTEDVPP

SEQ ID NO: 2841704 - protein, 4 aa, Entamoeba invadens
CEDC

SEQ ID NO: 2841705 - protein, 7 aa, Entamoeba invadens
CEDCESG

SEQ ID NO: 2841706 - protein, 7 aa, Entamoeba invadens
CEDDGKE

SEQ ID NO: 2841707 - protein, 6 aa, Entamoeba invadens
CEDDNK

SEQ ID NO: 2841708 - protein, 24 aa, Entamoeba invadens
CEDGEIKNDKKEEEKSEEEEENPY

SEQ ID NO: 2841709 - protein, 5 aa, Entamoeba invadens
CEDGG

SEQ ID NO: 2841710 - protein, 11 aa, Entamoeba invadens
CEDGGNQASLT

SEQ ID NO: 2841711 - protein, 6 aa, Entamoeba invadens
CEDGSP

SEQ ID NO: 2841712 - protein, 8 aa, Entamoeba invadens
CEDKEGNY

SEQ ID NO: 2841713 - protein, 5 aa, Entamoeba invadens
CEDRD

SEQ ID NO: 2841714 - protein, 4 aa, Entamoeba invadens
CEDT

SEQ ID NO: 2841715 - protein, 5 aa, Entamoeba invadens
CEEDE

SEQ ID NO: 2841716 - protein, 12 aa, Entamoeba invadens
CEEDEEKKREEY

SEQ ID NO: 2841717 - protein, 7 aa, Entamoeba invadens
CEEDPKS

SEQ ID NO: 2841718 - protein, 4 aa, Entamoeba invadens
CEEE

SEQ ID NO: 2841719 - protein, 5 aa, Entamoeba invadens
CEEEG

SEQ ID NO: 2841720 - protein, 18 aa, Entamoeba invadens
CEEEKKRIQITDEKPTMT

SEQ ID NO: 2841721 - protein, 28 aa, Entamoeba invadens
CEEENKNNEQNETSEVKTVQNTKKPEVV

SEQ ID NO: 2841722 - protein, 15 aa, Entamoeba invadens
CEEENNNNSRNGTRG

SEQ ID NO: 2841723 - protein, 6 aa, Entamoeba invadens
CEEKLK

SEQ ID NO: 2841724 - protein, 56 aa, Entamoeba invadens
CEEKNIENKKSEQKDEKKEENEEKENCGGTSNEQKVKEIETQPTNEEIKKTDEPLI

SEQ ID NO: 2841725 - protein, 9 aa, Entamoeba invadens
CEELKRDNR

SEQ ID NO: 2841726 - protein, 8 aa, Entamoeba invadens
CEENPKSV

SEQ ID NO: 2841727 - protein, 7 aa, Entamoeba invadens
CEEREKY

SEQ ID NO: 2841728 - protein, 5 aa, Entamoeba invadens
CEESD

SEQ ID NO: 2841729 - protein, 6 aa, Entamoeba invadens
CEESIS

SEQ ID NO: 2841730 - protein, 4 aa, Entamoeba invadens
CEET

SEQ ID NO: 2841731 - protein, 9 aa, Entamoeba invadens
CEETGHCSQ

SEQ ID NO: 2841732 - protein, 15 aa, Entamoeba invadens
CEETKEEKTKRTSFK

SEQ ID NO: 2841733 - protein, 10 aa, Entamoeba invadens
CEGDTVPISS

SEQ ID NO: 2841734 - protein, 7 aa, Entamoeba invadens
CEGEKQN

SEQ ID NO: 2841735 - protein, 5 aa, Entamoeba invadens
CEGHK

SEQ ID NO: 2841736 - protein, 4 aa, Entamoeba invadens
CEGK

SEQ ID NO: 2841737 - protein, 5 aa, Entamoeba invadens
CEGMT

SEQ ID NO: 2841738 - protein, 5 aa, Entamoeba invadens
CEGNE

SEQ ID NO: 2841739 - protein, 5 aa, Entamoeba invadens
CEGRN

SEQ ID NO: 2841740 - protein, 9 aa, Entamoeba invadens
CEGTVPPEI

SEQ ID NO: 2841741 - protein, 4 aa, Entamoeba invadens
CEGV

SEQ ID NO: 2841742 - protein, 6 aa, Entamoeba invadens
CEHPTK

SEQ ID NO: 2841743 - protein, 9 aa, Entamoeba invadens
CEITGKKND

SEQ ID NO: 2841744 - protein, 10 aa, Entamoeba invadens
CEKDKERHGR

SEQ ID NO: 2841745 - protein, 6 aa, Entamoeba invadens
CEKEES

SEQ ID NO: 2841746 - protein, 8 aa, Entamoeba invadens
CEKEKEPL

SEQ ID NO: 2841747 - protein, 16 aa, Entamoeba invadens
CEKEQNETKEENDTKE

SEQ ID NO: 2841748 - protein, 8 aa, Entamoeba invadens
CEKEQPSA

SEQ ID NO: 2841749 - protein, 9 aa, Entamoeba invadens
CEKETFKNS

SEQ ID NO: 2841750 - protein, 6 aa, Entamoeba invadens
CEKGEQ

SEQ ID NO: 2841751 - protein, 15 aa, Entamoeba invadens
CEKIEGNEKVFEPQK

SEQ ID NO: 2841752 - protein, 13 aa, Entamoeba invadens
CEKKTKEVKENGA

SEQ ID NO: 2841753 - protein, 17 aa, Entamoeba invadens
CEKMDESLKSSKIKSEY

SEQ ID NO: 2841754 - protein, 11 aa, Entamoeba invadens
CEKNERPDINE

SEQ ID NO: 2841755 - protein, 9 aa, Entamoeba invadens
CEKPDPKSV

SEQ ID NO: 2841756 - protein, 21 aa, Entamoeba invadens
CEKRMKKEVQEGVSQKTALRR

SEQ ID NO: 2841757 - protein, 14 aa, Entamoeba invadens
CELEETPKAPEIAQ

SEQ ID NO: 2841758 - protein, 5 aa, Entamoeba invadens
CELPS

SEQ ID NO: 2841759 - protein, 30 aa, Entamoeba invadens; identical to SEQ ID NO: 2747960

SEQ ID NO: 2841760 - protein, 21 aa, Entamoeba invadens
CENCKNAKPIDPKQKEKMMKE

SEQ ID NO: 2841761 - protein, 4 aa, Entamoeba invadens
CENE

SEQ ID NO: 2841762 - protein, 24 aa, Entamoeba invadens
CENEGDLDAISGELKDYQTKNKDA

SEQ ID NO: 2841763 - protein, 21 aa, Entamoeba invadens
CENEGETEEMDEYKQKEEEEE

SEQ ID NO: 2841764 - protein, 5 aa, Entamoeba invadens
CENGG

SEQ ID NO: 2841765 - protein, 6 aa, Entamoeba invadens
CENGIG

SEQ ID NO: 2841766 - protein, 9 aa, Entamoeba invadens
CENGQKGNL

SEQ ID NO: 2841767 - protein, 8 aa, Entamoeba invadens
CENKEDRI

SEQ ID NO: 2841768 - protein, 11 aa, Entamoeba invadens
CENNCNTTNGK

SEQ ID NO: 2841769 - protein, 10 aa, Entamoeba invadens
CENNDSQNIE

SEQ ID NO: 2841770 - protein, 5 aa, Entamoeba invadens
CENRF

SEQ ID NO: 2841771 - protein, 6 aa, Entamoeba invadens
CENTPQ

SEQ ID NO: 2841772 - protein, 8 aa, Entamoeba invadens
CEPDLNKA

SEQ ID NO: 2841773 - protein, 10 aa, Entamoeba invadens
CEPNNGNFTY

SEQ ID NO: 2841774 - protein, 11 aa, Entamoeba invadens
CEPPETKEKYK

SEQ ID NO: 2841775 - protein, 19 aa, Entamoeba invadens
CEPPKNEKVNTPENAPNTI

SEQ ID NO: 2841776 - protein, 22 aa, Entamoeba invadens
CEPSTTKEKPDTVAPSSTTEKK

SEQ ID NO: 2841777 - protein, 45 aa, Entamoeba invadens
CEQAATTNPASNPTQLQSQSTTQQQAQPQTTSTTQATIVLGENLQ

SEQ ID NO: 2841778 - protein, 4 aa, Entamoeba invadens
CEQD

SEQ ID NO: 2841779 - protein, 8 aa, Entamoeba invadens
CEQNGKVE

SEQ ID NO: 2841780 - protein, 5 aa, Entamoeba invadens
CEQNR

SEQ ID NO: 2841781 - protein, 4 aa, Entamoeba invadens
CEQT

SEQ ID NO: 2841782 - protein, 7 aa, Entamoeba invadens
CEQVKKE

SEQ ID NO: 2841783 - protein, 17 aa, Entamoeba invadens
CERKALKESTEHFNPSN

SEQ ID NO: 2841784 - protein, 18 aa, Entamoeba invadens
CERKYNSRKRKSIHANYS

SEQ ID NO: 2841785 - protein, 7 aa, Entamoeba invadens
CERQNTR

SEQ ID NO: 2841786 - protein, 5 aa, Entamoeba invadens
CERRD

SEQ ID NO: 2841787 - protein, 4 aa, Entamoeba invadens
CERS

SEQ ID NO: 2841788 - protein, 15 aa, Entamoeba invadens
CERSSKSEVVVLSQS

SEQ ID NO: 2841789 - protein, 9 aa, Entamoeba invadens
CERTRDPLT

SEQ ID NO: 2841790 - protein, 4 aa, Entamoeba invadens
CESD

SEQ ID NO: 2841791 - protein, 11 aa, Entamoeba invadens
CESDLKNATNL

SEQ ID NO: 2841792 - protein, 11 aa, Entamoeba invadens
CESEGQTEEMG

SEQ ID NO: 2841793 - protein, 18 aa, Entamoeba invadens
CESFDPNCQTCSPTLQEN

SEQ ID NO: 2841794 - protein, 6 aa, Entamoeba invadens
CESGVT

SEQ ID NO: 2841795 - protein, 5 aa, Entamoeba invadens
CESGY

SEQ ID NO: 2841796 - protein, 10 aa, Entamoeba invadens
CESKPEEGGI

SEQ ID NO: 2841797 - protein, 7 aa, Entamoeba invadens
CESPANV

SEQ ID NO: 2841798 - protein, 7 aa, Entamoeba invadens
CESPNNT

SEQ ID NO: 2841799 - protein, 15 aa, Entamoeba invadens
CESPQKIQDGTSSHI

SEQ ID NO: 2841800 - protein, 6 aa, Entamoeba invadens
CESPTF

SEQ ID NO: 2841801 - protein, 52 aa, Entamoeba invadens
CESSSGDVSPRGVCTPGRNVESNEVSRDSSPKLEEFSPRTRTLKKENKKSFN

SEQ ID NO: 2841802 - protein, 16 aa, Entamoeba invadens
CESSTTRKMEDEKYEV

SEQ ID NO: 2841803 - protein, 8 aa, Entamoeba invadens
CETCNSNC

SEQ ID NO: 2841804 - protein, 17 aa, Entamoeba invadens
CETCPGGNEKKCTTCKT

SEQ ID NO: 2841805 - protein, 11 aa, Entamoeba invadens
CETCQNGGNRS

SEQ ID NO: 2841806 - protein, 12 aa, Entamoeba invadens
CETCQNGGNRSC

SEQ ID NO: 2841807 - protein, 15 aa, Entamoeba invadens
CETCSSSSSRNCTKC

SEQ ID NO: 2841808 - protein, 12 aa, Entamoeba invadens
CETDMKRQKEDI

SEQ ID NO: 2841809 - protein, 15 aa, Entamoeba invadens
CETGEEVDLKSQESG

SEQ ID NO: 2841810 - protein, 10 aa, Entamoeba invadens
CETGSEAYKN

SEQ ID NO: 2841811 - protein, 8 aa, Entamoeba invadens
CETKEEAE

SEQ ID NO: 2841812 - protein, 5 aa, Entamoeba invadens
CETKN

SEQ ID NO: 2841813 - protein, 9 aa, Entamoeba invadens
CETNENPTS

SEQ ID NO: 2841814 - protein, 5 aa, Entamoeba invadens
CETQE

SEQ ID NO: 2841815 - protein, 5 aa, Entamoeba invadens
CETTY

SEQ ID NO: 2841816 - protein, 7 aa, Entamoeba invadens
CETYNKN

SEQ ID NO: 2841817 - protein, 11 aa, Entamoeba invadens
CETYNKNNKGV

SEQ ID NO: 2841818 - protein, 10 aa, Entamoeba invadens
CEYGGSDVTK

SEQ ID NO: 2841819 - protein, 6 aa, Entamoeba invadens
CEYGSF

SEQ ID NO: 2841820 - protein, 4 aa, Entamoeba invadens
CEYS

SEQ ID NO: 2841821 - protein, 6 aa, Entamoeba invadens
CEYSDG

SEQ ID NO: 2841822 - protein, 5 aa, Entamoeba invadens
CFPPQ

SEQ ID NO: 2841823 - protein, 5 aa, Entamoeba invadens
CFTER

SEQ ID NO: 2841824 - protein, 7 aa, Entamoeba invadens
CGAEGKC

SEQ ID NO: 2841825 - protein, 24 aa, Entamoeba invadens
CGASGRVEGKKVDGKYETTVTSDR

SEQ ID NO: 2841826 - protein, 22 aa, Entamoeba invadens
CGASGRVEGKKVDGKYKTTVTS

SEQ ID NO: 2841827 - protein, 4 aa, Entamoeba invadens
CGCE

SEQ ID NO: 2841828 - protein, 8 aa, Entamoeba invadens
CGDEKRSV

SEQ ID NO: 2841829 - protein, 13 aa, Entamoeba invadens
CGDGYGLSPNNDN

SEQ ID NO: 2841830 - protein, 6 aa, Entamoeba invadens
CGDNKT

SEQ ID NO: 2841831 - protein, 6 aa, Entamoeba invadens
CGDNKY

SEQ ID NO: 2841832 - protein, 5 aa, Entamoeba invadens
CGDSN

SEQ ID NO: 2841833 - protein, 9 aa, Entamoeba invadens
CGDSPDPNY

SEQ ID NO: 2841834 - protein, 4 aa, Entamoeba invadens
CGDT

SEQ ID NO: 2841835 - protein, 6 aa, Entamoeba invadens
CGDYNK

SEQ ID NO: 2841836 - protein, 9 aa, Entamoeba invadens
CGEAGDPMH

SEQ ID NO: 2841837 - protein, 27 aa, Entamoeba invadens
CGEHKDGDLDRGCSEKTANRRFQTNKK

SEQ ID NO: 2841838 - protein, 7 aa, Entamoeba invadens
CGEKDEQ

SEQ ID NO: 2841839 - protein, 9 aa, Entamoeba invadens
CGEKERRKD

SEQ ID NO: 2841840 - protein, 4 aa, Entamoeba invadens
CGEM

SEQ ID NO: 2841841 - protein, 8 aa, Entamoeba invadens
CGEPEMSS

SEQ ID NO: 2841842 - protein, 6 aa, Entamoeba invadens
CGEPFK

SEQ ID NO: 2841843 - protein, 12 aa, Entamoeba invadens
CGEPVKNNEGVH

SEQ ID NO: 2841844 - protein, 9 aa, Entamoeba invadens
CGEQNNSTF

SEQ ID NO: 2841845 - protein, 11 aa, Entamoeba invadens
CGERDKVRTMS

SEQ ID NO: 2841846 - protein, 8 aa, Entamoeba invadens
CGETGDPM

SEQ ID NO: 2841847 - protein, 6 aa, Entamoeba invadens
CGETKE

SEQ ID NO: 2841848 - protein, 6 aa, Entamoeba invadens
CGGEEE

SEQ ID NO: 2841849 - protein, 10 aa, Entamoeba invadens
CGGKENNQGF

SEQ ID NO: 2841850 - protein, 17 aa, Entamoeba invadens
CGGKNVKVENKEDVRGK

SEQ ID NO: 2841851 - protein, 10 aa, Entamoeba invadens
CGGNCNGTTG

SEQ ID NO: 2841852 - protein, 6 aa, Entamoeba invadens
CGGSDG

SEQ ID NO: 2841853 - protein, 8 aa, Entamoeba invadens
CGGSSAQE

SEQ ID NO: 2841854 - protein, 6 aa, Entamoeba invadens
CGIGPS

SEQ ID NO: 2841855 - protein, 4 aa, Entamoeba invadens
CGKD

SEQ ID NO: 2841856 - protein, 9 aa, Entamoeba invadens
CGKEEEALS

SEQ ID NO: 2841857 - protein, 8 aa, Entamoeba invadens
CGKERKEI

SEQ ID NO: 2841858 - protein, 7 aa, Entamoeba invadens
CGKETSV

SEQ ID NO: 2841859 - protein, 7 aa, Entamoeba invadens
CGKPIDG

SEQ ID NO: 2841860 - protein, 7 aa, Entamoeba invadens
CGKPISR

SEQ ID NO: 2841861 - protein, 11 aa, Entamoeba invadens
CGKRGGTKTAE

SEQ ID NO: 2841862 - protein, 21 aa, Entamoeba invadens
CGKRKDKKGAEKQQQHEEEDR

SEQ ID NO: 2841863 - protein, 6 aa, Entamoeba invadens
CGKSIE

SEQ ID NO: 2841864 - protein, 7 aa, Entamoeba invadens
CGKTFNS

SEQ ID NO: 2841865 - protein, 10 aa, Entamoeba invadens
CGLPTGNPLK

SEQ ID NO: 2841866 - protein, 12 aa, Entamoeba invadens
CGMGSRPAKSAH

SEQ ID NO: 2841867 - protein, 10 aa, Entamoeba invadens
CGMPQSDKNV

SEQ ID NO: 2841868 - protein, 8 aa, Entamoeba invadens
CGNAGDTP

SEQ ID NO: 2841869 - protein, 5 aa, Entamoeba invadens
CGNEA

SEQ ID NO: 2841870 - protein, 10 aa, Entamoeba invadens
CGNNQKRGNV

SEQ ID NO: 2841871 - protein, 7 aa, Entamoeba invadens
CGNRDQM

SEQ ID NO: 2841872 - protein, 5 aa, Entamoeba invadens
CGNTI

SEQ ID NO: 2841873 - protein, 16 aa, Entamoeba invadens
CGPDGADGYAGPNTVN

SEQ ID NO: 2841874 - protein, 14 aa, Entamoeba invadens
CGPDGADGYAGVNT

SEQ ID NO: 2841875 - protein, 17 aa, Entamoeba invadens
CGPKGADGKLGPDTTNA

SEQ ID NO: 2841876 - protein, 27 aa, Entamoeba invadens
CGPKGADGKLGPDTTNAVKSFQQKNGL

SEQ ID NO: 2841877 - protein, 7 aa, Entamoeba invadens
CGQAGDR

SEQ ID NO: 2841878 - protein, 7 aa, Entamoeba invadens
CGQEKKW

SEQ ID NO: 2841879 - protein, 9 aa, Entamoeba invadens
CGQKQGETV

SEQ ID NO: 2841880 - protein, 10 aa, Entamoeba invadens
CGQNKRDRFE

SEQ ID NO: 2841881 - protein, 11 aa, Entamoeba invadens
CGQSGHNSRNS

SEQ ID NO: 2841882 - protein, 4 aa, Entamoeba invadens
CGQT

SEQ ID NO: 2841883 - protein, 10 aa, Entamoeba invadens
CGRAGRTEEG

SEQ ID NO: 2841884 - protein, 5 aa, Entamoeba invadens
CGRPI

SEQ ID NO: 2841885 - protein, 9 aa, Entamoeba invadens
CGRPPPERV

SEQ ID NO: 2841886 - protein, 10 aa, Entamoeba invadens
CGSCGPRGFY

SEQ ID NO: 2841887 - protein, 4 aa, Entamoeba invadens
CGSE

SEQ ID NO: 2841888 - protein, 11 aa, Entamoeba invadens
CGSESVGKEVS

SEQ ID NO: 2841889 - protein, 4 aa, Entamoeba invadens
CGSM

SEQ ID NO: 2841890 - protein, 5 aa, Entamoeba invadens
CGSNC

SEQ ID NO: 2841891 - protein, 7 aa, Entamoeba invadens
CGSNNSQ

SEQ ID NO: 2841892 - protein, 7 aa, Entamoeba invadens
CGSNTLS

SEQ ID NO: 2841893 - protein, 5 aa, Entamoeba invadens
CGSPE

SEQ ID NO: 2841894 - protein, 6 aa, Entamoeba invadens
CGSSES

SEQ ID NO: 2841895 - protein, 11 aa, Entamoeba invadens
CGSSGCSNKTN

SEQ ID NO: 2841896 - protein, 6 aa, Entamoeba invadens
CGSTGG

SEQ ID NO: 2841897 - protein, 10 aa, Entamoeba invadens
CGTASVGNAR

SEQ ID NO: 2841898 - protein, 6 aa, Entamoeba invadens
CGTATP

SEQ ID NO: 2841899 - protein, 5 aa, Entamoeba invadens
CGTCV

SEQ ID NO: 2841900 - protein, 11 aa, Entamoeba invadens
CGTDNPKAPCM

SEQ ID NO: 2841901 - protein, 15 aa, Entamoeba invadens
CGTDNPKAPCMSEKG

SEQ ID NO: 2841902 - protein, 8 aa, Entamoeba invadens
CGTPLDQK

SEQ ID NO: 2841903 - protein, 8 aa, Entamoeba invadens
CGTYEEAT

SEQ ID NO: 2841904 - protein, 12 aa, Entamoeba invadens
CGVNDERDLSKT

SEQ ID NO: 2841905 - protein, 17 aa, Entamoeba invadens
CGVSESVANYNANRVKT

SEQ ID NO: 2841906 - protein, 9 aa, Entamoeba invadens
CGVSKEQEE

SEQ ID NO: 2841907 - protein, 12 aa, Entamoeba invadens
CGWGTKSSIAAR

SEQ ID NO: 2841908 - protein, 7 aa, Entamoeba invadens
CGYHSDD

SEQ ID NO: 2841909 - protein, 7 aa, Entamoeba invadens
CHDENGF

SEQ ID NO: 2841910 - protein, 10 aa, Entamoeba invadens
CHEEDKENPY

SEQ ID NO: 2841911 - protein, 7 aa, Entamoeba invadens
CHNPAPS

SEQ ID NO: 2841912 - protein, 12 aa, Entamoeba invadens
CHNPKTHALDGG

SEQ ID NO: 2841913 - protein, 7 aa, Entamoeba invadens
CHNTGGL

SEQ ID NO: 2841914 - protein, 15 aa, Entamoeba invadens
CHPGPCGPCTAGGKT

SEQ ID NO: 2841915 - protein, 6 aa, Entamoeba invadens
CHPSDV

SEQ ID NO: 2841916 - protein, 13 aa, Entamoeba invadens
CHSGPCGDCPTPI

SEQ ID NO: 2841917 - protein, 5 aa, Entamoeba invadens
CHSNT

SEQ ID NO: 2841918 - protein, 4 aa, Entamoeba invadens
CIES

SEQ ID NO: 2841919 - protein, 14 aa, Entamoeba invadens
CIGQDSDDEDEQHN

SEQ ID NO: 2841920 - protein, 9 aa, Entamoeba invadens
CIKDGKGVC

SEQ ID NO: 2841921 - protein, 5 aa, Entamoeba invadens
CIPES

SEQ ID NO: 2841922 - protein, 15 aa, Entamoeba invadens
CISGTTKEYSQNEKD

SEQ ID NO: 2841923 - protein, 8 aa, Entamoeba invadens
CKANEERF

SEQ ID NO: 2841924 - protein, 14 aa, Entamoeba invadens
CKANEESRISGNFS

SEQ ID NO: 2841925 - protein, 7 aa, Entamoeba invadens
CKAPTKS

SEQ ID NO: 2841926 - protein, 8 aa, Entamoeba invadens
CKCEGSEA

SEQ ID NO: 2841927 - protein, 7 aa, Entamoeba invadens
CKDENNC

SEQ ID NO: 2841928 - protein, 7 aa, Entamoeba invadens
CKDGDSC

SEQ ID NO: 2841929 - protein, 8 aa, Entamoeba invadens
CKDGQYLD

SEQ ID NO: 2841930 - protein, 12 aa, Entamoeba invadens
CKDNCDSTTGYC

SEQ ID NO: 2841931 - protein, 8 aa, Entamoeba invadens
CKDPQEKA

SEQ ID NO: 2841932 - protein, 4 aa, Entamoeba invadens
CKEA

SEQ ID NO: 2841933 - protein, 8 aa, Entamoeba invadens
CKECSGAT

SEQ ID NO: 2841934 - protein, 6 aa, Entamoeba invadens
CKEEGF

SEQ ID NO: 2841935 - protein, 4 aa, Entamoeba invadens
CKEF

SEQ ID NO: 2841936 - protein, 9 aa, Entamoeba invadens
CKEGKGKET

SEQ ID NO: 2841937 - protein, 7 aa, Entamoeba invadens
CKEMEDK

SEQ ID NO: 2841938 - protein, 10 aa, Entamoeba invadens
CKENEEPQKD

SEQ ID NO: 2841939 - protein, 7 aa, Entamoeba invadens
CKEPAKL

SEQ ID NO: 2841940 - protein, 10 aa, Entamoeba invadens
CKEQGSTVAK

SEQ ID NO: 2841941 - protein, 9 aa, Entamoeba invadens
CKERTEHTK

SEQ ID NO: 2841942 - protein, 22 aa, Entamoeba invadens
CKESAIKRNRKELKAINEVLRH

SEQ ID NO: 2841943 - protein, 7 aa, Entamoeba invadens
CKETERE

SEQ ID NO: 2841944 - protein, 18 aa, Entamoeba invadens
CKETGKGEDVLSDTDYAM

SEQ ID NO: 2841945 - protein, 16 aa, Entamoeba invadens
CKETGNREDVLSETDY

SEQ ID NO: 2841946 - protein, 6 aa, Entamoeba invadens
CKETPV

SEQ ID NO: 2841947 - protein, 6 aa, Entamoeba invadens
CKETVE

SEQ ID NO: 2841948 - protein, 6 aa, Entamoeba invadens
CKEYTT

SEQ ID NO: 2841949 - protein, 11 aa, Entamoeba invadens
CKFSESNAYPS

SEQ ID NO: 2841950 - protein, 19 aa, Entamoeba invadens
CKFSPTQTNKSSVRVTSKD

SEQ ID NO: 2841951 - protein, 7 aa, Entamoeba invadens
CKGDSHT

SEQ ID NO: 2841952 - protein, 8 aa, Entamoeba invadens
CKGDTTNF

SEQ ID NO: 2841953 - protein, 15 aa, Entamoeba invadens
CKGERPKNKNLTEKE

SEQ ID NO: 2841954 - protein, 14 aa, Entamoeba invadens
CKGGRRKVEDTKTI

SEQ ID NO: 2841955 - protein, 17 aa, Entamoeba invadens
CKGKGEQVDDKDKCPSC

SEQ ID NO: 2841956 - protein, 15 aa, Entamoeba invadens
CKGKGTKSGKDVKKC

SEQ ID NO: 2841957 - protein, 4 aa, Entamoeba invadens
CKGQ

SEQ ID NO: 2841958 - protein, 8 aa, Entamoeba invadens
CKGTLEGS

SEQ ID NO: 2841959 - protein, 6 aa, Entamoeba invadens
CKHSDG

SEQ ID NO: 2841960 - protein, 44 aa, Entamoeba invadens
CKIEAKPRRPTCVQPGKKKMTKAGFEKQKKLTTETKEKPRPAVL

SEQ ID NO: 2841961 - protein, 10 aa, Entamoeba invadens
CKKEGEEEEF

SEQ ID NO: 2841962 - protein, 7 aa, Entamoeba invadens
CKKESDV

SEQ ID NO: 2841963 - protein, 7 aa, Entamoeba invadens
CKKETNL

SEQ ID NO: 2841964 - protein, 4 aa, Entamoeba invadens
CKKG

SEQ ID NO: 2841965 - protein, 8 aa, Entamoeba invadens
CKKGDNCT

SEQ ID NO: 2841966 - protein, 8 aa, Entamoeba invadens
CKKGENCT

SEQ ID NO: 2841967 - protein, 12 aa, Entamoeba invadens
CKKSEESTREEL

SEQ ID NO: 2841968 - protein, 24 aa, Entamoeba invadens
CKKTRKITKNITNSNGQTSQKENV

SEQ ID NO: 2841969 - protein, 7 aa, Entamoeba invadens
CKKYSEA

SEQ ID NO: 2841970 - protein, 11 aa, Entamoeba invadens
CKLSDDTKCES

SEQ ID NO: 2841971 - protein, 6 aa, Entamoeba invadens
CKNGNN

SEQ ID NO: 2841972 - protein, 12 aa, Entamoeba invadens
CKNKRNPPKCEY

SEQ ID NO: 2841973 - protein, 7 aa, Entamoeba invadens
CKNPESD

SEQ ID NO: 2841974 - protein, 7 aa, Entamoeba invadens
CKNPNKV

SEQ ID NO: 2841975 - protein, 4 aa, Entamoeba invadens
CKNQ

SEQ ID NO: 2841976 - protein, 14 aa, Entamoeba invadens
CKPAGAAAQKPTEA

SEQ ID NO: 2841977 - protein, 7 aa, Entamoeba invadens
CKPATRA

SEQ ID NO: 2841978 - protein, 6 aa, Entamoeba invadens
CKPEDH

SEQ ID NO: 2841979 - protein, 6 aa, Entamoeba invadens
CKPENM

SEQ ID NO: 2841980 - protein, 5 aa, Entamoeba invadens
CKPFD

SEQ ID NO: 2841981 - protein, 6 aa, Entamoeba invadens
CKPGYF

SEQ ID NO: 2841982 - protein, 10 aa, Entamoeba invadens
CKPKRRKNAS

SEQ ID NO: 2841983 - protein, 29 aa, Entamoeba invadens
CKPNYTKTATNQCTATPCGDGKFGTQPNC

SEQ ID NO: 2841984 - protein, 9 aa, Entamoeba invadens
CKPSATKEG

SEQ ID NO: 2841985 - protein, 6 aa, Entamoeba invadens
CKPSGV

SEQ ID NO: 2841986 - protein, 6 aa, Entamoeba invadens
CKPSSA

SEQ ID NO: 2841987 - protein, 14 aa, Entamoeba invadens
CKPTKTKRDEETRR

SEQ ID NO: 2841988 - protein, 4 aa, Entamoeba invadens
CKPV

SEQ ID NO: 2841989 - protein, 21 aa, Entamoeba invadens
CKQDYKKEINGGLKDKQAYRR

SEQ ID NO: 2841990 - protein, 10 aa, Entamoeba invadens
CKQESQGPNE

SEQ ID NO: 2841991 - protein, 16 aa, Entamoeba invadens
CKQGKSRRTQDEHSKP

SEQ ID NO: 2841992 - protein, 9 aa, Entamoeba invadens
CKQNELENE

SEQ ID NO: 2841993 - protein, 4 aa, Entamoeba invadens
CKQT

SEQ ID NO: 2841994 - protein, 4 aa, Entamoeba invadens
CKRA

SEQ ID NO: 2841995 - protein, 5 aa, Entamoeba invadens
CKRCS

SEQ ID NO: 2841996 - protein, 10 aa, Entamoeba invadens
CKRCSDGETC

SEQ ID NO: 2841997 - protein, 10 aa, Entamoeba invadens
CKRKDTLKGK

SEQ ID NO: 2841998 - protein, 9 aa, Entamoeba invadens
CKRSTAQKP

SEQ ID NO: 2841999 - protein, 6 aa, Entamoeba invadens
CKSANE

SEQ ID NO: 2842000 - protein, 8 aa, Entamoeba invadens
CKSDDKDA

SEQ ID NO: 2842001 - protein, 9 aa, Entamoeba invadens
CKSDQKIKV

SEQ ID NO: 2842002 - protein, 16 aa, Entamoeba invadens
CKSESEGTQPNSDEIA

SEQ ID NO: 2842003 - protein, 7 aa, Entamoeba invadens
CKSGEQV

SEQ ID NO: 2842004 - protein, 10 aa, Entamoeba invadens
CKSHGAEAVK

SEQ ID NO: 2842005 - protein, 19 aa, Entamoeba invadens
CKSNDALNDSCARKVPNGN

SEQ ID NO: 2842006 - protein, 11 aa, Entamoeba invadens
CKSNDALNDTC

SEQ ID NO: 2842007 - protein, 8 aa, Entamoeba invadens
CKSPENEK

SEQ ID NO: 2842008 - protein, 7 aa, Entamoeba invadens
CKSPKEL

SEQ ID NO: 2842009 - protein, 8 aa, Entamoeba invadens
CKSQEMRK

SEQ ID NO: 2842010 - protein, 9 aa, Entamoeba invadens
CKTAEEERK

SEQ ID NO: 2842011 - protein, 11 aa, Entamoeba invadens
CKTAGKNKEIS

SEQ ID NO: 2842012 - protein, 16 aa, Entamoeba invadens
CKTAGLNSKQTDQIRT

SEQ ID NO: 2842013 - protein, 8 aa, Entamoeba invadens
CKTCGKNV

SEQ ID NO: 2842014 - protein, 10 aa, Entamoeba invadens
CKTCGTNKTN

SEQ ID NO: 2842015 - protein, 16 aa, Entamoeba invadens
CKTEDTSSLSKTEQLQ

SEQ ID NO: 2842016 - protein, 8 aa, Entamoeba invadens
CKTEIERN

SEQ ID NO: 2842017 - protein, 7 aa, Entamoeba invadens
CKTEKDA

SEQ ID NO: 2842018 - protein, 7 aa, Entamoeba invadens
CKTENSR

SEQ ID NO: 2842019 - protein, 4 aa, Entamoeba invadens
CKTK

SEQ ID NO: 2842020 - protein, 8 aa, Entamoeba invadens
CKTKPTQQ

SEQ ID NO: 2842021 - protein, 17 aa, Entamoeba invadens
CKTQQNANKRIERRGSQ

SEQ ID NO: 2842022 - protein, 7 aa, Entamoeba invadens
CKTTTDV

SEQ ID NO: 2842023 - protein, 19 aa, Entamoeba invadens
CKTVTQEDVERVKEEEKEL

SEQ ID NO: 2842024 - protein, 11 aa, Entamoeba invadens
CKYQKSENGVP

SEQ ID NO: 2842025 - protein, 5 aa, Entamoeba invadens
CKYSM

SEQ ID NO: 2842026 - protein, 6 aa, Entamoeba invadens
CKYSTA

SEQ ID NO: 2842027 - protein, 4 aa, Entamoeba invadens
CLED

SEQ ID NO: 2842028 - protein, 4 aa, Entamoeba invadens
CLGP

SEQ ID NO: 2842029 - protein, 6 aa, Entamoeba invadens
CLNGDE

SEQ ID NO: 2842030 - protein, 6 aa, Entamoeba invadens
CLPESE

SEQ ID NO: 2842031 - protein, 62 aa, Entamoeba invadens
CLQDDTDTEEDSSHSTSVKTNNQLDTPRSGIDENEDKNENTIQSNSTGLFSSGSLGNSSGEE

SEQ ID NO: 2842032 - protein, 5 aa, Entamoeba invadens
CLQTA

SEQ ID NO: 2842033 - protein, 4 aa, Entamoeba invadens
CLSS

SEQ ID NO: 2842034 - protein, 4 aa, Entamoeba invadens
CLTK

SEQ ID NO: 2842035 - protein, 7 aa, Entamoeba invadens
CLTPPPK

SEQ ID NO: 2842036 - protein, 4 aa, Entamoeba invadens
CLTS

SEQ ID NO: 2842037 - protein, 11 aa, Entamoeba invadens
CMEKNSSLEEV

SEQ ID NO: 2842038 - protein, 4 aa, Entamoeba invadens
CMKN

SEQ ID NO: 2842039 - protein, 6 aa, Entamoeba invadens
CMNPKE

SEQ ID NO: 2842040 - protein, 7 aa, Entamoeba invadens
CNAKEDV

SEQ ID NO: 2842041 - protein, 6 aa, Entamoeba invadens
CNAVTS

SEQ ID NO: 2842042 - protein, 8 aa, Entamoeba invadens
CNDDNKKS

SEQ ID NO: 2842043 - protein, 8 aa, Entamoeba invadens
CNDENEVN

SEQ ID NO: 2842044 - protein, 8 aa, Entamoeba invadens
CNDGSDVT

SEQ ID NO: 2842045 - protein, 16 aa, Entamoeba invadens
CNDKCKTCNPTNTNNC

SEQ ID NO: 2842046 - protein, 6 aa, Entamoeba invadens
CNDSIS

SEQ ID NO: 2842047 - protein, 6 aa, Entamoeba invadens
CNDSYT

SEQ ID NO: 2842048 - protein, 4 aa, Entamoeba invadens
CNDT

SEQ ID NO: 2842049 - protein, 8 aa, Entamoeba invadens
CNEDIQTM

SEQ ID NO: 2842050 - protein, 6 aa, Entamoeba invadens
CNEETY

SEQ ID NO: 2842051 - protein, 13 aa, Entamoeba invadens
CNEKEKDSAESFS

SEQ ID NO: 2842052 - protein, 10 aa, Entamoeba invadens
CNENSVRTNF

SEQ ID NO: 2842053 - protein, 5 aa, Entamoeba invadens
CNETE

SEQ ID NO: 2842054 - protein, 10 aa, Entamoeba invadens
CNGADRVSSG

SEQ ID NO: 2842055 - protein, 6 aa, Entamoeba invadens
CNGDND

SEQ ID NO: 2842056 - protein, 9 aa, Entamoeba invadens
CNGEQKDAA

SEQ ID NO: 2842057 - protein, 6 aa, Entamoeba invadens
CNGGHY

SEQ ID NO: 2842058 - protein, 9 aa, Entamoeba invadens
CNGGSIQGN

SEQ ID NO: 2842059 - protein, 16 aa, Entamoeba invadens
CNGKCNTENGECTGCQ

SEQ ID NO: 2842060 - protein, 4 aa, Entamoeba invadens
CNGN

SEQ ID NO: 2842061 - protein, 21 aa, Entamoeba invadens
CNGSHKQDEENKEKTEGVTNQ

SEQ ID NO: 2842062 - protein, 9 aa, Entamoeba invadens
CNGSSSQNC

SEQ ID NO: 2842063 - protein, 8 aa, Entamoeba invadens
CNGSTGVY

SEQ ID NO: 2842064 - protein, 12 aa, Entamoeba invadens
CNGTNASIEPLT

SEQ ID NO: 2842065 - protein, 6 aa, Entamoeba invadens
CNGYAN

SEQ ID NO: 2842066 - protein, 4 aa, Entamoeba invadens
CNIT

SEQ ID NO: 2842067 - protein, 4 aa, Entamoeba invadens
CNKC

SEQ ID NO: 2842068 - protein, 5 aa, Entamoeba invadens
CNKCN

SEQ ID NO: 2842069 - protein, 10 aa, Entamoeba invadens
CNKKGGPGFM

SEQ ID NO: 2842070 - protein, 5 aa, Entamoeba invadens
CNKKK

SEQ ID NO: 2842071 - protein, 6 aa, Entamoeba invadens
CNKNEP

SEQ ID NO: 2842072 - protein, 7 aa, Entamoeba invadens
CNKNKNE

SEQ ID NO: 2842073 - protein, 6 aa, Entamoeba invadens
CNKNLP

SEQ ID NO: 2842074 - protein, 4 aa, Entamoeba invadens
CNKP

SEQ ID NO: 2842075 - protein, 9 aa, Entamoeba invadens
CNKSRRQKC

SEQ ID NO: 2842076 - protein, 5 aa, Entamoeba invadens
CNNGV

SEQ ID NO: 2842077 - protein, 7 aa, Entamoeba invadens
CNNLPNP

SEQ ID NO: 2842078 - protein, 5 aa, Entamoeba invadens
CNNNC

SEQ ID NO: 2842079 - protein, 12 aa, Entamoeba invadens
CNNSKSTCNTKN

SEQ ID NO: 2842080 - protein, 4 aa, Entamoeba invadens
CNNV

SEQ ID NO: 2842081 - protein, 33 aa, Entamoeba invadens
CNNVNKEEKNAPCPHKSTQQQRTSKKEKRCTSQ

SEQ ID NO: 2842082 - protein, 10 aa, Entamoeba invadens
CNPDTRQNAE

SEQ ID NO: 2842083 - protein, 6 aa, Entamoeba invadens
CNPNHP

SEQ ID NO: 2842084 - protein, 7 aa, Entamoeba invadens
CNPQSVP

SEQ ID NO: 2842085 - protein, 11 aa, Entamoeba invadens
CNPSTTRIAQE

SEQ ID NO: 2842086 - protein, 13 aa, Entamoeba invadens
CNQCTSQTTCQTC

SEQ ID NO: 2842087 - protein, 4 aa, Entamoeba invadens
CNQP

SEQ ID NO: 2842088 - protein, 13 aa, Entamoeba invadens
CNRGHSVKDCTDT

SEQ ID NO: 2842089 - protein, 7 aa, Entamoeba invadens
CNSEASF

SEQ ID NO: 2842090 - protein, 6 aa, Entamoeba invadens
CNSEKE

SEQ ID NO: 2842091 - protein, 6 aa, Entamoeba invadens
CNSKTM

SEQ ID NO: 2842092 - protein, 8 aa, Entamoeba invadens
CNSNPSVC

SEQ ID NO: 2842093 - protein, 12 aa, Entamoeba invadens
CNSNYSLNNEGK

SEQ ID NO: 2842094 - protein, 7 aa, Entamoeba invadens
CNSPQAA

SEQ ID NO: 2842095 - protein, 6 aa, Entamoeba invadens
CNSRGE

SEQ ID NO: 2842096 - protein, 8 aa, Entamoeba invadens
CNSSSDNV

SEQ ID NO: 2842097 - protein, 7 aa, Entamoeba invadens
CNSSTGY

SEQ ID NO: 2842098 - protein, 6 aa, Entamoeba invadens
CNTNED

SEQ ID NO: 2842099 - protein, 7 aa, Entamoeba invadens
CNTNNDL

SEQ ID NO: 2842100 - protein, 6 aa, Entamoeba invadens
CNTNNG

SEQ ID NO: 2842101 - protein, 7 aa, Entamoeba invadens
CNTPEKW

SEQ ID NO: 2842102 - protein, 8 aa, Entamoeba invadens
CNTPETKE

SEQ ID NO: 2842103 - protein, 13 aa, Entamoeba invadens
CNTPSTISKVPRD

SEQ ID NO: 2842104 - protein, 15 aa, Entamoeba invadens
CNTPTKNERSPLAKE

SEQ ID NO: 2842105 - protein, 23 aa, Entamoeba invadens
CNTQTGNCETCSSQYTPAITQPS

SEQ ID NO: 2842106 - protein, 8 aa, Entamoeba invadens
CNTQTGYC

SEQ ID NO: 2842107 - protein, 7 aa, Entamoeba invadens
CNTSGVP

SEQ ID NO: 2842108 - protein, 13 aa, Entamoeba invadens
CNTSNSLKDGKCE

SEQ ID NO: 2842109 - protein, 9 aa, Entamoeba invadens
CNTSNSPLL

SEQ ID NO: 2842110 - protein, 6 aa, Entamoeba invadens
CNTTDC

SEQ ID NO: 2842111 - protein, 6 aa, Entamoeba invadens
CNTTKT

SEQ ID NO: 2842112 - protein, 7 aa, Entamoeba invadens
CNTTNGE

SEQ ID NO: 2842113 - protein, 12 aa, Entamoeba invadens
CNVDENSKEGRM

SEQ ID NO: 2842114 - protein, 9 aa, Entamoeba invadens
CNYNNGTPK

SEQ ID NO: 2842115 - protein, 4 aa, Entamoeba invadens
CPAS

SEQ ID NO: 2842116 - protein, 13 aa, Entamoeba invadens
CPDGYNPDNEKTI

SEQ ID NO: 2842117 - protein, 6 aa, Entamoeba invadens
CPDTVN

SEQ ID NO: 2842118 - protein, 5 aa, Entamoeba invadens
CPEGQ

SEQ ID NO: 2842119 - protein, 4 aa, Entamoeba invadens
CPEI

SEQ ID NO: 2842120 - protein, 9 aa, Entamoeba invadens
CPGGAERKC

SEQ ID NO: 2842121 - protein, 5 aa, Entamoeba invadens
CPINR

SEQ ID NO: 2842122 - protein, 6 aa, Entamoeba invadens
CPKEET

SEQ ID NO: 2842123 - protein, 11 aa, Entamoeba invadens
CPKITDKSISE

SEQ ID NO: 2842124 - protein, 9 aa, Entamoeba invadens
CPKKFSSDD

SEQ ID NO: 2842125 - protein, 6 aa, Entamoeba invadens
CPKSER

SEQ ID NO: 2842126 - protein, 5 aa, Entamoeba invadens
CPLGS

SEQ ID NO: 2842127 - protein, 5 aa, Entamoeba invadens
CPLSQ

SEQ ID NO: 2842128 - protein, 5 aa, Entamoeba invadens
CPMDP

SEQ ID NO: 2842129 - protein, 8 aa, Entamoeba invadens
CPNAKEKL

SEQ ID NO: 2842130 - protein, 4 aa, Entamoeba invadens
CPND

SEQ ID NO: 2842131 - protein, 12 aa, Entamoeba invadens
CPNGQYPNANKQ

SEQ ID NO: 2842132 - protein, 7 aa, Entamoeba invadens
CPNHGPH

SEQ ID NO: 2842133 - protein, 9 aa, Entamoeba invadens
CPNKERDTY

SEQ ID NO: 2842134 - protein, 4 aa, Entamoeba invadens
CPNP

SEQ ID NO: 2842135 - protein, 4 aa, Entamoeba invadens
CPNT

SEQ ID NO: 2842136 - protein, 11 aa, Entamoeba invadens
CPPNKTNLKTA

SEQ ID NO: 2842137 - protein, 14 aa, Entamoeba invadens
CPPPNSYSQYQPTD

SEQ ID NO: 2842138 - protein, 10 aa, Entamoeba invadens
CPPPSKVPPQ

SEQ ID NO: 2842139 - protein, 6 aa, Entamoeba invadens
CPPQGV

SEQ ID NO: 2842140 - protein, 4 aa, Entamoeba invadens
CPQS

SEQ ID NO: 2842141 - protein, 9 aa, Entamoeba invadens
CPSDPTKLK

SEQ ID NO: 2842142 - protein, 11 aa, Entamoeba invadens
CPSLGSGNDIK

SEQ ID NO: 2842143 - protein, 6 aa, Entamoeba invadens
CPSNSE

SEQ ID NO: 2842144 - protein, 44 aa, Entamoeba invadens
CPSPKNLSENTPTDQTDQISEDNSDTSDNLVESEEEEHNESCPL

SEQ ID NO: 2842145 - protein, 9 aa, Entamoeba invadens
CPSPPPLNK

SEQ ID NO: 2842146 - protein, 15 aa, Entamoeba invadens
CPSRNTRKSFDNDFK

SEQ ID NO: 2842147 - protein, 6 aa, Entamoeba invadens
CPSTSG

SEQ ID NO: 2842148 - protein, 4 aa, Entamoeba invadens
CPSV

SEQ ID NO: 2842149 - protein, 10 aa, Entamoeba invadens
CPSVKGKKTI

SEQ ID NO: 2842150 - protein, 5 aa, Entamoeba invadens
CPTLD

SEQ ID NO: 2842151 - protein, 6 aa, Entamoeba invadens
CPTNHT

SEQ ID NO: 2842152 - protein, 4 aa, Entamoeba invadens
CPTP

SEQ ID NO: 2842153 - protein, 5 aa, Entamoeba invadens
CPTSY

SEQ ID NO: 2842154 - protein, 4 aa, Entamoeba invadens
CPTT

SEQ ID NO: 2842155 - protein, 4 aa, Entamoeba invadens
CPVT

SEQ ID NO: 2842156 - protein, 20 aa, Entamoeba invadens
CPVTPRSHKHSSDDISLQDS

SEQ ID NO: 2842157 - protein, 12 aa, Entamoeba invadens
CPYNRKNMEEYA

SEQ ID NO: 2842158 - protein, 13 aa, Entamoeba invadens
CQAEKKDPSPKEF

SEQ ID NO: 2842159 - protein, 4 aa, Entamoeba invadens
CQAT

SEQ ID NO: 2842160 - protein, 4 aa, Entamoeba invadens
CQDA

SEQ ID NO: 2842161 - protein, 4 aa, Entamoeba invadens
CQDE

SEQ ID NO: 2842162 - protein, 8 aa, Entamoeba invadens
CQDESGMV

SEQ ID NO: 2842163 - protein, 4 aa, Entamoeba invadens
CQEE

SEQ ID NO: 2842164 - protein, 8 aa, Entamoeba invadens
CQEEDKDL

SEQ ID NO: 2842165 - protein, 8 aa, Entamoeba invadens
CQEGEYQK

SEQ ID NO: 2842166 - protein, 6 aa, Entamoeba invadens
CQERNE

SEQ ID NO: 2842167 - protein, 15 aa, Entamoeba invadens
CQERNEYFNVARSRK

SEQ ID NO: 2842168 - protein, 9 aa, Entamoeba invadens
CQESGKNKC

SEQ ID NO: 2842169 - protein, 6 aa, Entamoeba invadens
CQGESE

SEQ ID NO: 2842170 - protein, 13 aa, Entamoeba invadens
CQGSNYDKKIDES

SEQ ID NO: 2842171 - protein, 18 aa, Entamoeba invadens
CQHKPDKYNENDIEAEQK

SEQ ID NO: 2842172 - protein, 14 aa, Entamoeba invadens
CQKEASSGCCCRKT

SEQ ID NO: 2842173 - protein, 14 aa, Entamoeba invadens
CQKEASSGCYCGKT

SEQ ID NO: 2842174 - protein, 14 aa, Entamoeba invadens
CQKKTSSGCCCGKT

SEQ ID NO: 2842175 - protein, 14 aa, Entamoeba invadens
CQKPISSSSVQNSS

SEQ ID NO: 2842176 - protein, 6 aa, Entamoeba invadens
CQKSDD

SEQ ID NO: 2842177 - protein, 10 aa, Entamoeba invadens
CQKSGFKGKT

SEQ ID NO: 2842178 - protein, 9 aa, Entamoeba invadens
CQKTESIGR

SEQ ID NO: 2842179 - protein, 10 aa, Entamoeba invadens
CQKTKNSPLL

SEQ ID NO: 2842180 - protein, 16 aa, Entamoeba invadens
CQNNKEDQNSADKKRI

SEQ ID NO: 2842181 - protein, 6 aa, Entamoeba invadens
CQNPSD

SEQ ID NO: 2842182 - protein, 22 aa, Entamoeba invadens
CQNTSISQLKETSSPNHRMTTT

SEQ ID NO: 2842183 - protein, 10 aa, Entamoeba invadens
CQPKPSDLSE

SEQ ID NO: 2842184 - protein, 6 aa, Entamoeba invadens
CQPPKD

SEQ ID NO: 2842185 - protein, 9 aa, Entamoeba invadens
CQPQTQKCA

SEQ ID NO: 2842186 - protein, 6 aa, Entamoeba invadens
CQPSTE

SEQ ID NO: 2842187 - protein, 5 aa, Entamoeba invadens
CQPYN

SEQ ID NO: 2842188 - protein, 10 aa, Entamoeba invadens
CQQKDALEQC

SEQ ID NO: 2842189 - protein, 12 aa, Entamoeba invadens
CQQNTPVPTTHS

SEQ ID NO: 2842190 - protein, 25 aa, Entamoeba invadens
CQQRRNHDITSGVSMSAAKQRVGKN

SEQ ID NO: 2842191 - protein, 8 aa, Entamoeba invadens
CQSDPSVK

SEQ ID NO: 2842192 - protein, 8 aa, Entamoeba invadens
CQSETHRR

SEQ ID NO: 2842193 - protein, 4 aa, Entamoeba invadens
CQSG

SEQ ID NO: 2842194 - protein, 8 aa, Entamoeba invadens
CQSKGPFS

SEQ ID NO: 2842195 - protein, 19 aa, Entamoeba invadens
CQSLKPKDLDLGKDKSGNA

SEQ ID NO: 2842196 - protein, 4 aa, Entamoeba invadens
CQSP

SEQ ID NO: 2842197 - protein, 23 aa, Entamoeba invadens
CQSSPSAGCKSSREASLSSGTSR

SEQ ID NO: 2842198 - protein, 6 aa, Entamoeba invadens
CQTGPN

SEQ ID NO: 2842199 - protein, 4 aa, Entamoeba invadens
CQTQ

SEQ ID NO: 2842200 - protein, 5 aa, Entamoeba invadens
CQTQF

SEQ ID NO: 2842201 - protein, 11 aa, Entamoeba invadens
CQTTDKKSIGA

SEQ ID NO: 2842202 - protein, 5 aa, Entamoeba invadens
CQYSN

SEQ ID NO: 2842203 - protein, 10 aa, Entamoeba invadens
CRADTLQREA

SEQ ID NO: 2842204 - protein, 13 aa, Entamoeba invadens
CRAESGERDVTEF

SEQ ID NO: 2842205 - protein, 4 aa, Entamoeba invadens
CRAP

SEQ ID NO: 2842206 - protein, 6 aa, Entamoeba invadens
CRATSS

SEQ ID NO: 2842207 - protein, 7 aa, Entamoeba invadens
CRDEVSV

SEQ ID NO: 2842208 - protein, 10 aa, Entamoeba invadens
CRDNSKQHVT

SEQ ID NO: 2842209 - protein, 9 aa, Entamoeba invadens
CRDNTKQYV

SEQ ID NO: 2842210 - protein, 9 aa, Entamoeba invadens
CRDTRTREV

SEQ ID NO: 2842211 - protein, 8 aa, Entamoeba invadens
CREGQSSY

SEQ ID NO: 2842212 - protein, 9 aa, Entamoeba invadens
CRENGENCG

SEQ ID NO: 2842213 - protein, 7 aa, Entamoeba invadens
CRENNTN

SEQ ID NO: 2842214 - protein, 9 aa, Entamoeba invadens
CRENSKESV

SEQ ID NO: 2842215 - protein, 7 aa, Entamoeba invadens
CRESKFG

SEQ ID NO: 2842216 - protein, 13 aa, Entamoeba invadens
CRGDDKKFSFGTT

SEQ ID NO: 2842217 - protein, 7 aa, Entamoeba invadens
CRGDQCR

SEQ ID NO: 2842218 - protein, 8 aa, Entamoeba invadens
CRGKALQE

SEQ ID NO: 2842219 - protein, 7 aa, Entamoeba invadens
CRGPQTR

SEQ ID NO: 2842220 - protein, 7 aa, Entamoeba invadens
CRKNNKE

SEQ ID NO: 2842221 - protein, 10 aa, Entamoeba invadens
CRNASSPPAV

SEQ ID NO: 2842222 - protein, 9 aa, Entamoeba invadens
CRNKDEVPK

SEQ ID NO: 2842223 - protein, 10 aa, Entamoeba invadens
CRNNNGLSDV

SEQ ID NO: 2842224 - protein, 7 aa, Entamoeba invadens
CRNTSGL

SEQ ID NO: 2842225 - protein, 6 aa, Entamoeba invadens
CRNYSN

SEQ ID NO: 2842226 - protein, 5 aa, Entamoeba invadens
CRSTS

SEQ ID NO: 2842227 - protein, 18 aa, Entamoeba invadens
CRTENEIEKIGRTREINP

SEQ ID NO: 2842228 - protein, 5 aa, Entamoeba invadens
CRTGY

SEQ ID NO: 2842229 - protein, 10 aa, Entamoeba invadens
CRTNNRPATI

SEQ ID NO: 2842230 - protein, 6 aa, Entamoeba invadens
CRTTQK

SEQ ID NO: 2842231 - protein, 6 aa, Entamoeba invadens
CSADPT

SEQ ID NO: 2842232 - protein, 14 aa, Entamoeba invadens
CSADRNVKAKITKD

SEQ ID NO: 2842233 - protein, 9 aa, Entamoeba invadens
CSAKTQKGL

SEQ ID NO: 2842234 - protein, 14 aa, Entamoeba invadens
CSANEPRQMFTQVF

SEQ ID NO: 2842235 - protein, 14 aa, Entamoeba invadens
CSATEPRQIFIPIY

SEQ ID NO: 2842236 - protein, 38 aa, Entamoeba invadens
CSATGEKKKKAETKEEPKEKKGEKEKKGDGEKKGKCQI

SEQ ID NO: 2842237 - protein, 25 aa, Entamoeba invadens
CSCDGDDGDGVDIGDVGGTDNGGGW

SEQ ID NO: 2842238 - protein, 15 aa, Entamoeba invadens
CSDAGSEIEADRTKG

SEQ ID NO: 2842239 - protein, 10 aa, Entamoeba invadens
CSDDPEISKI

SEQ ID NO: 2842240 - protein, 12 aa, Entamoeba invadens
CSDGKDKYRSLT

SEQ ID NO: 2842241 - protein, 33 aa, Entamoeba invadens
CSDGTDETFEGRNSKVETDVPSTVSEGTTPNLP

SEQ ID NO: 2842242 - protein, 8 aa, Entamoeba invadens
CSDKAALD

SEQ ID NO: 2842243 - protein, 11 aa, Entamoeba invadens
CSDNSVDNSDI

SEQ ID NO: 2842244 - protein, 7 aa, Entamoeba invadens
CSDPSNI

SEQ ID NO: 2842245 - protein, 6 aa, Entamoeba invadens
CSDTVE

SEQ ID NO: 2842246 - protein, 6 aa, Entamoeba invadens
CSEEKQ

SEQ ID NO: 2842247 - protein, 13 aa, Entamoeba invadens
CSEKSQQQLGEDE

SEQ ID NO: 2842248 - protein, 10 aa, Entamoeba invadens
CSENEEKQQP

SEQ ID NO: 2842249 - protein, 8 aa, Entamoeba invadens
CSENPVEI

SEQ ID NO: 2842250 - protein, 4 aa, Entamoeba invadens
CSEQ

SEQ ID NO: 2842251 - protein, 7 aa, Entamoeba invadens
CSEQDVR

SEQ ID NO: 2842252 - protein, 7 aa, Entamoeba invadens
CSEQNLE

SEQ ID NO: 2842253 - protein, 8 aa, Entamoeba invadens
CSESGERK

SEQ ID NO: 2842254 - protein, 9 aa, Entamoeba invadens
CSETGFSEQ

SEQ ID NO: 2842255 - protein, 6 aa, Entamoeba invadens
CSETPV

SEQ ID NO: 2842256 - protein, 10 aa, Entamoeba invadens
CSETSPTSAP

SEQ ID NO: 2842257 - protein, 8 aa, Entamoeba invadens
CSETSSEV

SEQ ID NO: 2842258 - protein, 12 aa, Entamoeba invadens
CSFSPGELKTSV

SEQ ID NO: 2842259 - protein, 16 aa, Entamoeba invadens
CSGDGTIRKNADSRTK

SEQ ID NO: 2842260 - protein, 11 aa, Entamoeba invadens
CSGDGTIRKNV

SEQ ID NO: 2842261 - protein, 15 aa, Entamoeba invadens
CSGEKTQESPQLEKK

SEQ ID NO: 2842262 - protein, 11 aa, Entamoeba invadens
CSGGGKMADGR

SEQ ID NO: 2842263 - protein, 9 aa, Entamoeba invadens
CSGGRPDLE

SEQ ID NO: 2842264 - protein, 4 aa, Entamoeba invadens
CSGI

SEQ ID NO: 2842265 - protein, 10 aa, Entamoeba invadens
CSGKEDNQGF

SEQ ID NO: 2842266 - protein, 4 aa, Entamoeba invadens
CSGS

SEQ ID NO: 2842267 - protein, 8 aa, Entamoeba invadens
CSGSGEEL

SEQ ID NO: 2842268 - protein, 4 aa, Entamoeba invadens
CSHP

SEQ ID NO: 2842269 - protein, 5 aa, Entamoeba invadens
CSIEE

SEQ ID NO: 2842270 - protein, 4 aa, Entamoeba invadens
CSIG

SEQ ID NO: 2842271 - protein, 9 aa, Entamoeba invadens
CSKCNENCS

SEQ ID NO: 2842272 - protein, 8 aa, Entamoeba invadens
CSKCQTTN

SEQ ID NO: 2842273 - protein, 11 aa, Entamoeba invadens
CSKDSDVDTME

SEQ ID NO: 2842274 - protein, 8 aa, Entamoeba invadens
CSKGKKYI

SEQ ID NO: 2842275 - protein, 4 aa, Entamoeba invadens
CSKH

SEQ ID NO: 2842276 - protein, 10 aa, Entamoeba invadens
CSKHPEKHDP

SEQ ID NO: 2842277 - protein, 7 aa, Entamoeba invadens
CSKISVT

SEQ ID NO: 2842278 - protein, 15 aa, Entamoeba invadens
CSKNRLKTSGTTLER

SEQ ID NO: 2842279 - protein, 7 aa, Entamoeba invadens
CSKPNDI

SEQ ID NO: 2842280 - protein, 10 aa, Entamoeba invadens
CSKPTNKTGR

SEQ ID NO: 2842281 - protein, 5 aa, Entamoeba invadens
CSKQT

SEQ ID NO: 2842282 - protein, 5 aa, Entamoeba invadens
CSKSE

SEQ ID NO: 2842283 - protein, 9 aa, Entamoeba invadens
CSKSKGDFL

SEQ ID NO: 2842284 - protein, 15 aa, Entamoeba invadens
CSKSQCTSPSDPVDY

SEQ ID NO: 2842285 - protein, 10 aa, Entamoeba invadens
CSKTGTTGEK

SEQ ID NO: 2842286 - protein, 12 aa, Entamoeba invadens
CSKTGTTGKKMI

SEQ ID NO: 2842287 - protein, 8 aa, Entamoeba invadens
CSKTISTQ

SEQ ID NO: 2842288 - protein, 8 aa, Entamoeba invadens
CSLESEVD

SEQ ID NO: 2842289 - protein, 11 aa, Entamoeba invadens
CSLSKEGTLYS

SEQ ID NO: 2842290 - protein, 6 aa, Entamoeba invadens
CSNDSN

SEQ ID NO: 2842291 - protein, 4 aa, Entamoeba invadens
CSNE

SEQ ID NO: 2842292 - protein, 5 aa, Entamoeba invadens
CSNEN

SEQ ID NO: 2842293 - protein, 7 aa, Entamoeba invadens
CSNGDQM

SEQ ID NO: 2842294 - protein, 6 aa, Entamoeba invadens
CSNGID

SEQ ID NO: 2842295 - protein, 17 aa, Entamoeba invadens
CSNKNTIVQKTGASITV

SEQ ID NO: 2842296 - protein, 5 aa, Entamoeba invadens
CSNNR

SEQ ID NO: 2842297 - protein, 7 aa, Entamoeba invadens
CSNPSQM

SEQ ID NO: 2842298 - protein, 7 aa, Entamoeba invadens
CSNPSYR

SEQ ID NO: 2842299 - protein, 6 aa, Entamoeba invadens
CSNRAN

SEQ ID NO: 2842300 - protein, 6 aa, Entamoeba invadens
CSNSRE

SEQ ID NO: 2842301 - protein, 15 aa, Entamoeba invadens
CSNTNCGNSTTSNIE

SEQ ID NO: 2842302 - protein, 18 aa, Entamoeba invadens
CSPCNQEFQSRNSIKRFI

SEQ ID NO: 2842303 - protein, 4 aa, Entamoeba invadens
CSPD

SEQ ID NO: 2842304 - protein, 5 aa, Entamoeba invadens
CSPEN

SEQ ID NO: 2842305 - protein, 6 aa, Entamoeba invadens
CSPENT

SEQ ID NO: 2842306 - protein, 6 aa, Entamoeba invadens
CSPGTK

SEQ ID NO: 2842307 - protein, 10 aa, Entamoeba invadens
CSPKTTNGLS

SEQ ID NO: 2842308 - protein, 17 aa, Entamoeba invadens
CSPQSELTSCANKTTAG

SEQ ID NO: 2842309 - protein, 4 aa, Entamoeba invadens
CSPS

SEQ ID NO: 2842310 - protein, 6 aa, Entamoeba invadens
CSPSRR

SEQ ID NO: 2842311 - protein, 12 aa, Entamoeba invadens
CSPTNKKCTTCS

SEQ ID NO: 2842312 - protein, 15 aa, Entamoeba invadens
CSQEENTTGMDLEQD

SEQ ID NO: 2842313 - protein, 11 aa, Entamoeba invadens
CSQMSEGLRTV

SEQ ID NO: 2842314 - protein, 7 aa, Entamoeba invadens
CSQNAFE

SEQ ID NO: 2842315 - protein, 5 aa, Entamoeba invadens
CSQTA

SEQ ID NO: 2842316 - protein, 7 aa, Entamoeba invadens
CSQTEKK

SEQ ID NO: 2842317 - protein, 13 aa, Entamoeba invadens
CSQTEQKCTTCTS

SEQ ID NO: 2842318 - protein, 5 aa, Entamoeba invadens
CSQTI

SEQ ID NO: 2842319 - protein, 11 aa, Entamoeba invadens
CSQTSNEMKME

SEQ ID NO: 2842320 - protein, 5 aa, Entamoeba invadens
CSQTT

SEQ ID NO: 2842321 - protein, 7 aa, Entamoeba invadens
CSRAGPL

SEQ ID NO: 2842322 - protein, 5 aa, Entamoeba invadens
CSRAR

SEQ ID NO: 2842323 - protein, 19 aa, Entamoeba invadens
CSRCDPSCANNGCDKKTGI

SEQ ID NO: 2842324 - protein, 4 aa, Entamoeba invadens
CSRD

SEQ ID NO: 2842325 - protein, 5 aa, Entamoeba invadens
CSRDE

SEQ ID NO: 2842326 - protein, 4 aa, Entamoeba invadens
CSRE

SEQ ID NO: 2842327 - protein, 10 aa, Entamoeba invadens
CSRPESKVSF

SEQ ID NO: 2842328 - protein, 6 aa, Entamoeba invadens
CSRTQT

SEQ ID NO: 2842329 - protein, 6 aa, Entamoeba invadens
CSSATR

SEQ ID NO: 2842330 - protein, 11 aa, Entamoeba invadens
CSSCSKNAESC

SEQ ID NO: 2842331 - protein, 11 aa, Entamoeba invadens
CSSCSKNAGSC

SEQ ID NO: 2842332 - protein, 4 aa, Entamoeba invadens
CSSD

SEQ ID NO: 2842333 - protein, 9 aa, Entamoeba invadens
CSSDDATPY

SEQ ID NO: 2842334 - protein, 5 aa, Entamoeba invadens
CSSDT

SEQ ID NO: 2842335 - protein, 9 aa, Entamoeba invadens
CSSEGGSNI

SEQ ID NO: 2842336 - protein, 6 aa, Entamoeba invadens
CSSEVV

SEQ ID NO: 2842337 - protein, 14 aa, Entamoeba invadens
CSSQENNTGSCDYS

SEQ ID NO: 2842338 - protein, 13 aa, Entamoeba invadens
CSSQYTPAITQPS

SEQ ID NO: 2842339 - protein, 15 aa, Entamoeba invadens
CSSRGDGETEASRRV

SEQ ID NO: 2842340 - protein, 10 aa, Entamoeba invadens
CSSRKIQETQ

SEQ ID NO: 2842341 - protein, 6 aa, Entamoeba invadens
CSSSPV

SEQ ID NO: 2842342 - protein, 8 aa, Entamoeba invadens
CSSSRNHH

SEQ ID NO: 2842343 - protein, 7 aa, Entamoeba invadens
CSSSSNK

SEQ ID NO: 2842344 - protein, 10 aa, Entamoeba invadens
CSSTGCSSSI

SEQ ID NO: 2842345 - protein, 6 aa, Entamoeba invadens
CSSTIN

SEQ ID NO: 2842346 - protein, 11 aa, Entamoeba invadens
CSTCNEDGTCN

SEQ ID NO: 2842347 - protein, 5 aa, Entamoeba invadens
CSTDE

SEQ ID NO: 2842348 - protein, 12 aa, Entamoeba invadens
CSTEGSITTQYN

SEQ ID NO: 2842349 - protein, 8 aa, Entamoeba invadens
CSTFSPEG

SEQ ID NO: 2842350 - protein, 6 aa, Entamoeba invadens
CSTKTV

SEQ ID NO: 2842351 - protein, 13 aa, Entamoeba invadens
CSTLKKFDTQTPI

SEQ ID NO: 2842352 - protein, 13 aa, Entamoeba invadens
CSTPKSFNVQTSV

SEQ ID NO: 2842353 - protein, 10 aa, Entamoeba invadens
CSTQFQSDFD

SEQ ID NO: 2842354 - protein, 4 aa, Entamoeba invadens
CSTS

SEQ ID NO: 2842355 - protein, 6 aa, Entamoeba invadens
CSTTER

SEQ ID NO: 2842356 - protein, 4 aa, Entamoeba invadens
CSVE

SEQ ID NO: 2842357 - protein, 10 aa, Entamoeba invadens
CSVEDEEDKK

SEQ ID NO: 2842358 - protein, 4 aa, Entamoeba invadens
CSVS

SEQ ID NO: 2842359 - protein, 8 aa, Entamoeba invadens
CSVSTKEN

SEQ ID NO: 2842360 - protein, 12 aa, Entamoeba invadens
CSVTSANHTNKN

SEQ ID NO: 2842361 - protein, 12 aa, Entamoeba invadens
CSVTSANHTNSN

SEQ ID NO: 2842362 - protein, 5 aa, Entamoeba invadens
CSWDN

SEQ ID NO: 2842363 - protein, 7 aa, Entamoeba invadens
CSYQTQE

SEQ ID NO: 2842364 - protein, 38 aa, Entamoeba invadens
CSYSEEEINKSRQHSQTVSLSKPTPKYGQKKEEKEEEL

SEQ ID NO: 2842365 - protein, 14 aa, Entamoeba invadens
CSYTSSNVQAPTIS

SEQ ID NO: 2842366 - protein, 20 aa, Entamoeba invadens
CTADGEGLKTAETKTPAPFK

SEQ ID NO: 2842367 - protein, 6 aa, Entamoeba invadens
CTADKG

SEQ ID NO: 2842368 - protein, 18 aa, Entamoeba invadens
CTAEGPGLNEAETKTPAP

SEQ ID NO: 2842369 - protein, 5 aa, Entamoeba invadens
CTAKI

SEQ ID NO: 2842370 - protein, 6 aa, Entamoeba invadens
CTDGLA

SEQ ID NO: 2842371 - protein, 8 aa, Entamoeba invadens
CTDYQSRE

SEQ ID NO: 2842372 - protein, 4 aa, Entamoeba invadens
CTEA

SEQ ID NO: 2842373 - protein, 9 aa, Entamoeba invadens
CTEEDSNKI

SEQ ID NO: 2842374 - protein, 15 aa, Entamoeba invadens
CTEEEELHSSQITET

SEQ ID NO: 2842375 - protein, 6 aa, Entamoeba invadens
CTEEPA

SEQ ID NO: 2842376 - protein, 17 aa, Entamoeba invadens
CTEKTEKQRIKNEGGVV

SEQ ID NO: 2842377 - protein, 27 aa, Entamoeba invadens
CTEKTETLEKEKQSKENEITKKKTNLV

SEQ ID NO: 2842378 - protein, 21 aa, Entamoeba invadens
CTEPHSAETHTTSNDKHHLTT

SEQ ID NO: 2842379 - protein, 6 aa, Entamoeba invadens
CTEPNK

SEQ ID NO: 2842380 - protein, 5 aa, Entamoeba invadens
CTESD

SEQ ID NO: 2842381 - protein, 5 aa, Entamoeba invadens
CTFKS

SEQ ID NO: 2842382 - protein, 8 aa, Entamoeba invadens
CTGAPTNV

SEQ ID NO: 2842383 - protein, 7 aa, Entamoeba invadens
CTGDGTL

SEQ ID NO: 2842384 - protein, 5 aa, Entamoeba invadens
CTGET

SEQ ID NO: 2842385 - protein, 9 aa, Entamoeba invadens
CTGNTGHRE

SEQ ID NO: 2842386 - protein, 11 aa, Entamoeba invadens
CTGPQRTASQF

SEQ ID NO: 2842387 - protein, 8 aa, Entamoeba invadens
CTGPSNGL

SEQ ID NO: 2842388 - protein, 8 aa, Entamoeba invadens
CTGSPHNE

SEQ ID NO: 2842389 - protein, 25 aa, Entamoeba invadens
CTHTKGTLSGESTPRLSETKTFGTR

SEQ ID NO: 2842390 - protein, 10 aa, Entamoeba invadens
CTIHNSSGDR

SEQ ID NO: 2842391 - protein, 6 aa, Entamoeba invadens
CTKASG

SEQ ID NO: 2842392 - protein, 15 aa, Entamoeba invadens
CTKDEIEKTNSKIQE

SEQ ID NO: 2842393 - protein, 10 aa, Entamoeba invadens
CTKDSNGFEH

SEQ ID NO: 2842394 - protein, 6 aa, Entamoeba invadens
CTKEEF

SEQ ID NO: 2842395 - protein, 27 aa, Entamoeba invadens
CTKGRSLLDGEDSDDNYPSNETTTYRS

SEQ ID NO: 2842396 - protein, 25 aa, Entamoeba invadens
CTKNRKVTKNITDDYGRTSQETNNI

SEQ ID NO: 2842397 - protein, 7 aa, Entamoeba invadens
CTKNSRH

SEQ ID NO: 2842398 - protein, 7 aa, Entamoeba invadens
CTKPSID

SEQ ID NO: 2842399 - protein, 10 aa, Entamoeba invadens
CTKQQQEELE

SEQ ID NO: 2842400 - protein, 8 aa, Entamoeba invadens
CTKSEERI

SEQ ID NO: 2842401 - protein, 8 aa, Entamoeba invadens
CTKTSDGD

SEQ ID NO: 2842402 - protein, 18 aa, Entamoeba invadens
CTLETSEEKRRSAGMDHP

SEQ ID NO: 2842403 - protein, 17 aa, Entamoeba invadens
CTLGNPTPNLVKAKSKE

SEQ ID NO: 2842404 - protein, 8 aa, Entamoeba invadens
CTLSPNKT

SEQ ID NO: 2842405 - protein, 6 aa, Entamoeba invadens
CTNCDE

SEQ ID NO: 2842406 - protein, 11 aa, Entamoeba invadens
CTNKRPEKRPD

SEQ ID NO: 2842407 - protein, 6 aa, Entamoeba invadens
CTPANI

SEQ ID NO: 2842408 - protein, 14 aa, Entamoeba invadens
CTPKKKSKGKQKNY

SEQ ID NO: 2842409 - protein, 8 aa, Entamoeba invadens
CTPTAYDD

SEQ ID NO: 2842410 - protein, 6 aa, Entamoeba invadens
CTPTRG

SEQ ID NO: 2842411 - protein, 7 aa, Entamoeba invadens
CTPTSKR

SEQ ID NO: 2842412 - protein, 7 aa, Entamoeba invadens
CTQAERD

SEQ ID NO: 2842413 - protein, 4 aa, Entamoeba invadens
CTQC

SEQ ID NO: 2842414 - protein, 8 aa, Entamoeba invadens
CTQNDNQI

SEQ ID NO: 2842415 - protein, 9 aa, Entamoeba invadens
CTQQTQTCN

SEQ ID NO: 2842416 - protein, 14 aa, Entamoeba invadens
CTQSKSDVLTTRGE

SEQ ID NO: 2842417 - protein, 4 aa, Entamoeba invadens
CTRD

SEQ ID NO: 2842418 - protein, 6 aa, Entamoeba invadens
CTRDSD

SEQ ID NO: 2842419 - protein, 10 aa, Entamoeba invadens
CTRQDAEKCT

SEQ ID NO: 2842420 - protein, 5 aa, Entamoeba invadens
CTRRR

SEQ ID NO: 2842421 - protein, 24 aa, Entamoeba invadens
CTRSNQNSYEQNARSVCSSQTQTT

SEQ ID NO: 2842422 - protein, 5 aa, Entamoeba invadens
CTRTK

SEQ ID NO: 2842423 - protein, 12 aa, Entamoeba invadens
CTSDNKCAKCQS

SEQ ID NO: 2842424 - protein, 16 aa, Entamoeba invadens
CTSEELEQSMQSNPGF

SEQ ID NO: 2842425 - protein, 8 aa, Entamoeba invadens
CTSKGNGV

SEQ ID NO: 2842426 - protein, 5 aa, Entamoeba invadens
CTSQR

SEQ ID NO: 2842427 - protein, 6 aa, Entamoeba invadens
CTSQRC

SEQ ID NO: 2842428 - protein, 4 aa, Entamoeba invadens
CTSS

SEQ ID NO: 2842429 - protein, 5 aa, Entamoeba invadens
CTSSP

SEQ ID NO: 2842430 - protein, 30 aa, Entamoeba invadens
CTSSQQTEHFTSSESDQEQDIQSVTSVDPT

SEQ ID NO: 2842431 - protein, 4 aa, Entamoeba invadens
CTST

SEQ ID NO: 2842432 - protein, 5 aa, Entamoeba invadens
CTSTA

SEQ ID NO: 2842433 - protein, 11 aa, Entamoeba invadens
CTTCDSATQCT

SEQ ID NO: 2842434 - protein, 11 aa, Entamoeba invadens
CTTCGSATQCT

SEQ ID NO: 2842435 - protein, 6 aa, Entamoeba invadens
CTTCKT

SEQ ID NO: 2842436 - protein, 12 aa, Entamoeba invadens
CTTCSSTDISPH

SEQ ID NO: 2842437 - protein, 11 aa, Entamoeba invadens
CTTCTQPEKCS

SEQ ID NO: 2842438 - protein, 5 aa, Entamoeba invadens
CTTDD

SEQ ID NO: 2842439 - protein, 10 aa, Entamoeba invadens
CTTGCNGQTG

SEQ ID NO: 2842440 - protein, 10 aa, Entamoeba invadens
CTTKGPNTEL

SEQ ID NO: 2842441 - protein, 8 aa, Entamoeba invadens
CTTKNTKD

SEQ ID NO: 2842442 - protein, 13 aa, Entamoeba invadens
CTTKQAKDADKCK

SEQ ID NO: 2842443 - protein, 4 aa, Entamoeba invadens
CTTL

SEQ ID NO: 2842444 - protein, 4 aa, Entamoeba invadens
CTTN

SEQ ID NO: 2842445 - protein, 36 aa, Entamoeba invadens
CTTPPPKQKQTPPFQPMSPSLSSNQSQQKRLPEIAE

SEQ ID NO: 2842446 - protein, 6 aa, Entamoeba invadens
CTTPTT

SEQ ID NO: 2842447 - protein, 14 aa, Entamoeba invadens
CTTQEKKLTTEQYT

SEQ ID NO: 2842448 - protein, 5 aa, Entamoeba invadens
CTTSV

SEQ ID NO: 2842449 - protein, 6 aa, Entamoeba invadens
CTTTGK

SEQ ID NO: 2842450 - protein, 17 aa, Entamoeba invadens
CTTTPTRPSLGSRLNPS

SEQ ID NO: 2842451 - protein, 4 aa, Entamoeba invadens
CTTV

SEQ ID NO: 2842452 - protein, 7 aa, Entamoeba invadens
CTTYNNG

SEQ ID NO: 2842453 - protein, 17 aa, Entamoeba invadens
CTVSSTETAEVTDDEID

SEQ ID NO: 2842454 - protein, 7 aa, Entamoeba invadens
CTYTQNS

SEQ ID NO: 2842455 - protein, 15 aa, Entamoeba invadens
CTYTTESPQNITKNN

SEQ ID NO: 2842456 - protein, 10 aa, Entamoeba invadens
CVAANDSDVV

SEQ ID NO: 2842457 - protein, 9 aa, Entamoeba invadens
CVDDTASAF

SEQ ID NO: 2842458 - protein, 8 aa, Entamoeba invadens
CVDGNNRV

SEQ ID NO: 2842459 - protein, 27 aa, Entamoeba invadens
CVDHTSNSEVKSQKKKVSQWSKDEDER

SEQ ID NO: 2842460 - protein, 14 aa, Entamoeba invadens
CVEENEKEKERITQ

SEQ ID NO: 2842461 - protein, 13 aa, Entamoeba invadens
CVEKTQEKRENLS

SEQ ID NO: 2842462 - protein, 5 aa, Entamoeba invadens
CVEPE

SEQ ID NO: 2842463 - protein, 9 aa, Entamoeba invadens
CVERKKRKE

SEQ ID NO: 2842464 - protein, 6 aa, Entamoeba invadens
CVGDKR

SEQ ID NO: 2842465 - protein, 6 aa, Entamoeba invadens
CVKQAN

SEQ ID NO: 2842466 - protein, 8 aa, Entamoeba invadens
CVRKSENE

SEQ ID NO: 2842467 - protein, 8 aa, Entamoeba invadens
CVSGGDDK

SEQ ID NO: 2842468 - protein, 21 aa, Entamoeba invadens
CVTGERKCTKCSTPNMYPNDT

SEQ ID NO: 2842469 - protein, 16 aa, Entamoeba invadens
CVTPDGKNVVAGYEDG

SEQ ID NO: 2842470 - protein, 9 aa, Entamoeba invadens
CVTSGDNTK

SEQ ID NO: 2842471 - protein, 16 aa, Entamoeba invadens
CVTSSESKEIKEMNNN

SEQ ID NO: 2842472 - protein, 5 aa, Entamoeba invadens
CYDEN

SEQ ID NO: 2842473 - protein, 11 aa, Entamoeba invadens
CYDNSKIASLN

SEQ ID NO: 2842474 - protein, 22 aa, Entamoeba invadens
CYDPNDDKKATTREADSTEVYT

SEQ ID NO: 2842475 - protein, 7 aa, Entamoeba invadens
CYGGSNA

SEQ ID NO: 2842476 - protein, 19 aa, Entamoeba invadens
CYGKDTKKEEKEDKEEIHQ

SEQ ID NO: 2842477 - protein, 9 aa, Entamoeba invadens
CYKSEKQNI

SEQ ID NO: 2842478 - protein, 7 aa, Entamoeba invadens
CYNPAQT

SEQ ID NO: 2842479 - protein, 5 aa, Entamoeba invadens
CYNTN

SEQ ID NO: 2842480 - protein, 9 aa, Entamoeba invadens
CYPPNTGNK

SEQ ID NO: 2842481 - protein, 5 aa, Entamoeba invadens
CYPQD

SEQ ID NO: 2842482 - protein, 8 aa, Entamoeba invadens
CYPSEGSP

SEQ ID NO: 2842483 - protein, 6 aa, Entamoeba invadens
CYRGAT

SEQ ID NO: 2842484 - protein, 9 aa, Entamoeba invadens
CYSDNEEKN

SEQ ID NO: 2842485 - protein, 10 aa, Entamoeba invadens
CYSDTSKCKE

SEQ ID NO: 2842486 - protein, 7 aa, Entamoeba invadens
CYSPDGR

SEQ ID NO: 2842487 - protein, 28 aa, Entamoeba invadens
CYSPQAKAPQVLNPPTQQRQSCPPPSIL

SEQ ID NO: 2842488 - protein, 8 aa, Entamoeba invadens
CYSSDNDK

SEQ ID NO: 2842489 - protein, 9 aa, Entamoeba invadens
CYSSDTNSA

SEQ ID NO: 2842490 - protein, 7 aa, Entamoeba invadens
CYTEGSH

SEQ ID NO: 2842491 - protein, 8 aa, Entamoeba invadens
DAAENGAM

SEQ ID NO: 2842492 - protein, 5 aa, Entamoeba invadens
DAAEV

SEQ ID NO: 2842493 - protein, 7 aa, Entamoeba invadens
DAAKGIS

SEQ ID NO: 2842494 - protein, 10 aa, Entamoeba invadens
DAAKQTSTRQ

SEQ ID NO: 2842495 - protein, 4 aa, Entamoeba invadens
DAAN

SEQ ID NO: 2842496 - protein, 11 aa, Entamoeba invadens
DAANATSDNYY

SEQ ID NO: 2842497 - protein, 8 aa, Entamoeba invadens
DAAQERNY

SEQ ID NO: 2842498 - protein, 7 aa, Entamoeba invadens
DAAREQN

SEQ ID NO: 2842499 - protein, 8 aa, Entamoeba invadens
DAASGKTQ

SEQ ID NO: 2842500 - protein, 9 aa, Entamoeba invadens
DAASGSAMN

SEQ ID NO: 2842501 - protein, 16 aa, Entamoeba invadens
DAASRTKDLPKEFKGT

SEQ ID NO: 2842502 - protein, 8 aa, Entamoeba invadens
DAATGNDW

SEQ ID NO: 2842503 - protein, 9 aa, Entamoeba invadens
DAATKYPEW

SEQ ID NO: 2842504 - protein, 6 aa, Entamoeba invadens
DACGRT

SEQ ID NO: 2842505 - protein, 8 aa, Entamoeba invadens
DACPDEDD

SEQ ID NO: 2842506 - protein, 4 aa, Entamoeba invadens
DADA

SEQ ID NO: 2842507 - protein, 18 aa, Entamoeba invadens
DADATKSFKEIYKQIIAN

SEQ ID NO: 2842508 - protein, 16 aa, Entamoeba invadens
DADDEVVATRSKLRSG

SEQ ID NO: 2842509 - protein, 7 aa, Entamoeba invadens
DADDGEE

SEQ ID NO: 2842510 - protein, 12 aa, Entamoeba invadens
DADEGGSARTSL

SEQ ID NO: 2842511 - protein, 6 aa, Entamoeba invadens
DADENC

SEQ ID NO: 2842512 - protein, 19 aa, Entamoeba invadens
DADESTTTVQVKKPEQDIV

SEQ ID NO: 2842513 - protein, 9 aa, Entamoeba invadens
DADEVSDMG

SEQ ID NO: 2842514 - protein, 7 aa, Entamoeba invadens
DADGAKK

SEQ ID NO: 2842515 - protein, 7 aa, Entamoeba invadens
DADGLSK

SEQ ID NO: 2842516 - protein, 15 aa, Entamoeba invadens
DADGTWQKKESAILE

SEQ ID NO: 2842517 - protein, 8 aa, Entamoeba invadens
DADIANKE

SEQ ID NO: 2842518 - protein, 12 aa, Entamoeba invadens
DADIGPSPNEIK

SEQ ID NO: 2842519 - protein, 15 aa, Entamoeba invadens
DADLSDSGSVNEKNT

SEQ ID NO: 2842520 - protein, 6 aa, Entamoeba invadens
DADPVD

SEQ ID NO: 2842521 - protein, 7 aa, Entamoeba invadens
DADSKKC

SEQ ID NO: 2842522 - protein, 9 aa, Entamoeba invadens
DADSNSEIY

SEQ ID NO: 2842523 - protein, 7 aa, Entamoeba invadens
DADSQTK

SEQ ID NO: 2842524 - protein, 9 aa, Entamoeba invadens
DADTKTPYE

SEQ ID NO: 2842525 - protein, 27 aa, Entamoeba invadens
DADTPEPKKDQNAKKKKVFKQKSEISE

SEQ ID NO: 2842526 - protein, 46 aa, Entamoeba invadens
DADYPGNNKMEEEENEEEKEVKENHTEHVKKEEQKDEKKSNSYRVE

SEQ ID NO: 2842527 - protein, 7 aa, Entamoeba invadens
DADYSEQ

SEQ ID NO: 2842528 - protein, 24 aa, Entamoeba invadens
DAEADKAQKQLDTANDDKDGNEVM

SEQ ID NO: 2842529 - protein, 8 aa, Entamoeba invadens
DAEASVRD

SEQ ID NO: 2842530 - protein, 17 aa, Entamoeba invadens
DAEDETLRNNIKNTDKS

SEQ ID NO: 2842531 - protein, 11 aa, Entamoeba invadens
DAEENKGSANF

SEQ ID NO: 2842532 - protein, 15 aa, Entamoeba invadens
DAEKAFKTKQKRKLN

SEQ ID NO: 2842533 - protein, 5 aa, Entamoeba invadens
DAEKE

SEQ ID NO: 2842534 - protein, 6 aa, Entamoeba invadens
DAEKEN

SEQ ID NO: 2842535 - protein, 9 aa, Entamoeba invadens
DAEKGKYKV

SEQ ID NO: 2842536 - protein, 27 aa, Entamoeba invadens
DAEKNEKQKRENMKKEFDDELKKTSDA

SEQ ID NO: 2842537 - protein, 5 aa, Entamoeba invadens
DAEKR

SEQ ID NO: 2842538 - protein, 25 aa, Entamoeba invadens
DAEKRDSPKLENRTINTNPTKDEEE

SEQ ID NO: 2842539 - protein, 34 aa, Entamoeba invadens
DAENTNRKKDAQEKQLSQLKADNDNLTKAKSVVD

SEQ ID NO: 2842540 - protein, 34 aa, Entamoeba invadens
DAENTNRKKDAREKQLSQLNADNDNLTKAKSVVD

SEQ ID NO: 2842541 - protein, 4 aa, Entamoeba invadens
DAEP

SEQ ID NO: 2842542 - protein, 9 aa, Entamoeba invadens
DAERAARRG

SEQ ID NO: 2842543 - protein, 11 aa, Entamoeba invadens
DAESDDEEPNI

SEQ ID NO: 2842544 - protein, 6 aa, Entamoeba invadens
DAETGV

SEQ ID NO: 2842545 - protein, 8 aa, Entamoeba invadens
DAEVNQHP

SEQ ID NO: 2842546 - protein, 6 aa, Entamoeba invadens
DAEVPS

SEQ ID NO: 2842547 - protein, 14 aa, Entamoeba invadens
DAFDEDKEKYGWNT

SEQ ID NO: 2842548 - protein, 11 aa, Entamoeba invadens
DAFDKSKVSEQ

SEQ ID NO: 2842549 - protein, 6 aa, Entamoeba invadens
DAFETE

SEQ ID NO: 2842550 - protein, 7 aa, Entamoeba invadens
DAFGSGD

SEQ ID NO: 2842551 - protein, 9 aa, Entamoeba invadens
DAFPSPQEA

SEQ ID NO: 2842552 - protein, 19 aa, Entamoeba invadens
DAGDGVEDANFAKETADTG

SEQ ID NO: 2842553 - protein, 8 aa, Entamoeba invadens
DAGENQDQ

SEQ ID NO: 2842554 - protein, 7 aa, Entamoeba invadens
DAGESES

SEQ ID NO: 2842555 - protein, 8 aa, Entamoeba invadens
DAGEVQTK

SEQ ID NO: 2842556 - protein, 11 aa, Entamoeba invadens
DAGGGLPALRG

SEQ ID NO: 2842557 - protein, 9 aa, Entamoeba invadens
DAGHRLQDR

SEQ ID NO: 2842558 - protein, 5 aa, Entamoeba invadens
DAGKD

SEQ ID NO: 2842559 - protein, 9 aa, Entamoeba invadens
DAGKDYSGL

SEQ ID NO: 2842560 - protein, 7 aa, Entamoeba invadens
DAGNIKQ

SEQ ID NO: 2842561 - protein, 7 aa, Entamoeba invadens
DAGNTSL

SEQ ID NO: 2842562 - protein, 8 aa, Entamoeba invadens
DAGSNVSE

SEQ ID NO: 2842563 - protein, 9 aa, Entamoeba invadens
DAGSQITRK

SEQ ID NO: 2842564 - protein, 5 aa, Entamoeba invadens
DAHDK

SEQ ID NO: 2842565 - protein, 6 aa, Entamoeba invadens
DAHPIE

SEQ ID NO: 2842566 - protein, 7 aa, Entamoeba invadens
DAHSGYG

SEQ ID NO: 2842567 - protein, 53 aa, Entamoeba invadens
DAHYTADDDYVKEEKPRKVLNPAKKTKKTKQSKKATKSDKVDLSPQQQQPQLD

SEQ ID NO: 2842568 - protein, 6 aa, Entamoeba invadens
DAIADS

SEQ ID NO: 2842569 - protein, 23 aa, Entamoeba invadens
DAIDADADINTFATTKATNGHMP

SEQ ID NO: 2842570 - protein, 20 aa, Entamoeba invadens
DAIDDEVKNKTLKEKTKTQF

SEQ ID NO: 2842571 - protein, 23 aa, Entamoeba invadens
DAIGVKESKDKVGKEENEETVAK

SEQ ID NO: 2842572 - protein, 9 aa, Entamoeba invadens
DAIKKTNEL

SEQ ID NO: 2842573 - protein, 64 aa, Entamoeba invadens
DAIKPPSPVPQKQRSSSYEKTNSLSSASLSKTSKESNLKDAKKPTKHREKTEKKHHKKTVKSKG

SEQ ID NO: 2842574 - protein, 8 aa, Entamoeba invadens
DAIQGDQY

SEQ ID NO: 2842575 - protein, 4 aa, Entamoeba invadens
DAIS

SEQ ID NO: 2842576 - protein, 6 aa, Entamoeba invadens
DAISEK

SEQ ID NO: 2842577 - protein, 11 aa, Entamoeba invadens
DAISKDSPHGE

SEQ ID NO: 2842578 - protein, 5 aa, Entamoeba invadens
DAIYT

SEQ ID NO: 2842579 - protein, 5 aa, Entamoeba invadens
DAKDA

SEQ ID NO: 2842580 - protein, 19 aa, Entamoeba invadens
DAKDAIASYEKQRKIYEDQ

SEQ ID NO: 2842581 - protein, 8 aa, Entamoeba invadens
DAKDEEKK

SEQ ID NO: 2842582 - protein, 8 aa, Entamoeba invadens
DAKDSPNR

SEQ ID NO: 2842583 - protein, 6 aa, Entamoeba invadens
DAKDVS

SEQ ID NO: 2842584 - protein, 5 aa, Entamoeba invadens
DAKEA

SEQ ID NO: 2842585 - protein, 7 aa, Entamoeba invadens
DAKEVTE

SEQ ID NO: 2842586 - protein, 8 aa, Entamoeba invadens
DAKGPRDL

SEQ ID NO: 2842587 - protein, 18 aa, Entamoeba invadens
DAKGSKDYEVKYGPSVAD

SEQ ID NO: 2842588 - protein, 12 aa, Entamoeba invadens
DAKIAGTSLMQH

SEQ ID NO: 2842589 - protein, 19 aa, Entamoeba invadens
DAKKIGEDFTQEEVKERRP

SEQ ID NO: 2842590 - protein, 10 aa, Entamoeba invadens
DAKKPLESAG

SEQ ID NO: 2842591 - protein, 6 aa, Entamoeba invadens
DAKKRE

SEQ ID NO: 2842592 - protein, 9 aa, Entamoeba invadens
DAKLDKGSI

SEQ ID NO: 2842593 - protein, 4 aa, Entamoeba invadens
DAKN

SEQ ID NO: 2842594 - protein, 16 aa, Entamoeba invadens
DAKPTKHRPPPPQKQG

SEQ ID NO: 2842595 - protein, 13 aa, Entamoeba invadens
DAKQDDTEDKIAD

SEQ ID NO: 2842596 - protein, 10 aa, Entamoeba invadens
DAKQNSKKDF

SEQ ID NO: 2842597 - protein, 10 aa, Entamoeba invadens
DAKRPNLSAA

SEQ ID NO: 2842598 - protein, 10 aa, Entamoeba invadens
DAKSALKTTR

SEQ ID NO: 2842599 - protein, 33 aa, Entamoeba invadens
DAKSEMTKSTNVKRYTTKQVNRPLPPVPQNRCK

SEQ ID NO: 2842600 - protein, 11 aa, Entamoeba invadens
DAKTKQETINQ

SEQ ID NO: 2842601 - protein, 15 aa, Entamoeba invadens
DAKTPNDTRGKSYDQ

SEQ ID NO: 2842602 - protein, 7 aa, Entamoeba invadens
DAKTREV

SEQ ID NO: 2842603 - protein, 6 aa, Entamoeba invadens
DAKTTW

SEQ ID NO: 2842604 - protein, 8 aa, Entamoeba invadens
DAKVSDNA

SEQ ID NO: 2842605 - protein, 13 aa, Entamoeba invadens
DALAPETSNIFIV

SEQ ID NO: 2842606 - protein, 19 aa, Entamoeba invadens
DALEKDQTATTSVLFSKSF

SEQ ID NO: 2842607 - protein, 4 aa, Entamoeba invadens
DALG

SEQ ID NO: 2842608 - protein, 20 aa, Entamoeba invadens
DALKKEKRSLEAMGKSKSLF

SEQ ID NO: 2842609 - protein, 9 aa, Entamoeba invadens
DALKKEQEI

SEQ ID NO: 2842610 - protein, 16 aa, Entamoeba invadens
DALKPTNTWGETYSSF

SEQ ID NO: 2842611 - protein, 10 aa, Entamoeba invadens
DALKQNEEDM

SEQ ID NO: 2842612 - protein, 9 aa, Entamoeba invadens
DALNEENDK

SEQ ID NO: 2842613 - protein, 6 aa, Entamoeba invadens
DALNNL

SEQ ID NO: 2842614 - protein, 6 aa, Entamoeba invadens
DALNSD

SEQ ID NO: 2842615 - protein, 12 aa, Entamoeba invadens
DALNSKARSTNL

SEQ ID NO: 2842616 - protein, 8 aa, Entamoeba invadens
DALPPANA

SEQ ID NO: 2842617 - protein, 4 aa, Entamoeba invadens
DALQ

SEQ ID NO: 2842618 - protein, 6 aa, Entamoeba invadens
DALQNT

SEQ ID NO: 2842619 - protein, 4 aa, Entamoeba invadens
DALS

SEQ ID NO: 2842620 - protein, 8 aa, Entamoeba invadens
DALSGSDL

SEQ ID NO: 2842621 - protein, 10 aa, Entamoeba invadens
DALTPDAQTA

SEQ ID NO: 2842622 - protein, 7 aa, Entamoeba invadens
DALTPTQ

SEQ ID NO: 2842623 - protein, 5 aa, Entamoeba invadens
DALTS

SEQ ID NO: 2842624 - protein, 12 aa, Entamoeba invadens
DAMEDEKRSTIS

SEQ ID NO: 2842625 - protein, 6 aa, Entamoeba invadens
DAMEGL

SEQ ID NO: 2842626 - protein, 4 aa, Entamoeba invadens
DAMK

SEQ ID NO: 2842627 - protein, 37 aa, Entamoeba invadens
DANDKPKTNDKPVENKEEPQPKKEEDKPNKNKEGVQV

SEQ ID NO: 2842628 - protein, 11 aa, Entamoeba invadens
DANDNGVDVSN

SEQ ID NO: 2842629 - protein, 4 aa, Entamoeba invadens
DANE

SEQ ID NO: 2842630 - protein, 6 aa, Entamoeba invadens
DANENA

SEQ ID NO: 2842631 - protein, 18 aa, Entamoeba invadens
DANGNGKVQLEEFMKWLL

SEQ ID NO: 2842632 - protein, 4 aa, Entamoeba invadens
DANI

SEQ ID NO: 2842633 - protein, 11 aa, Entamoeba invadens
DANKDGKISKD

SEQ ID NO: 2842634 - protein, 10 aa, Entamoeba invadens
DANKEENMTT

SEQ ID NO: 2842635 - protein, 8 aa, Entamoeba invadens
DANKPNAI

SEQ ID NO: 2842636 - protein, 4 aa, Entamoeba invadens
DANL

SEQ ID NO: 2842637 - protein, 4 aa, Entamoeba invadens
DANN

SEQ ID NO: 2842638 - protein, 9 aa, Entamoeba invadens
DANQNRKKV

SEQ ID NO: 2842639 - protein, 7 aa, Entamoeba invadens
DANRNGL

SEQ ID NO: 2842640 - protein, 16 aa, Entamoeba invadens
DANSIKQSNEVFTDNT

SEQ ID NO: 2842641 - protein, 7 aa, Entamoeba invadens
DANSKTI

SEQ ID NO: 2842642 - protein, 9 aa, Entamoeba invadens
DANSQVSAR

SEQ ID NO: 2842643 - protein, 6 aa, Entamoeba invadens
DANTEI

SEQ ID NO: 2842644 - protein, 7 aa, Entamoeba invadens
DANYSNW

SEQ ID NO: 2842645 - protein, 4 aa, Entamoeba invadens
DAPE

SEQ ID NO: 2842646 - protein, 7 aa, Entamoeba invadens
DAPEQCK

SEQ ID NO: 2842647 - protein, 12 aa, Entamoeba invadens
DAPEQEVVQRKT

SEQ ID NO: 2842648 - protein, 4 aa, Entamoeba invadens
DAPF

SEQ ID NO: 2842649 - protein, 11 aa, Entamoeba invadens
DAPKSESLGDK

SEQ ID NO: 2842650 - protein, 8 aa, Entamoeba invadens
DAPKSLPT

SEQ ID NO: 2842651 - protein, 14 aa, Entamoeba invadens
DAPKTGAEIDSGEI

SEQ ID NO: 2842652 - protein, 6 aa, Entamoeba invadens
DAPLPD

SEQ ID NO: 2842653 - protein, 5 aa, Entamoeba invadens
DAPLT

SEQ ID NO: 2842654 - protein, 6 aa, Entamoeba invadens
DAPLTK

SEQ ID NO: 2842655 - protein, 13 aa, Entamoeba invadens
DAPMHSHTTKQPL

SEQ ID NO: 2842656 - protein, 29 aa, Entamoeba invadens
DAPMKEADATEPQANTEENKSKVNATNMS

SEQ ID NO: 2842657 - protein, 4 aa, Entamoeba invadens
DAPN

SEQ ID NO: 2842658 - protein, 5 aa, Entamoeba invadens
DAPNG

SEQ ID NO: 2842659 - protein, 6 aa, Entamoeba invadens
DAPNRE

SEQ ID NO: 2842660 - protein, 7 aa, Entamoeba invadens
DAPNTTA

SEQ ID NO: 2842661 - protein, 11 aa, Entamoeba invadens
DAPPEVTEKKP

SEQ ID NO: 2842662 - protein, 6 aa, Entamoeba invadens
DAPPLS

SEQ ID NO: 2842663 - protein, 13 aa, Entamoeba invadens
DAPPVDGKANSEV

SEQ ID NO: 2842664 - protein, 7 aa, Entamoeba invadens
DAPQITE

SEQ ID NO: 2842665 - protein, 6 aa, Entamoeba invadens
DAPQKI

SEQ ID NO: 2842666 - protein, 9 aa, Entamoeba invadens
DAPSTQPQR

SEQ ID NO: 2842667 - protein, 22 aa, Entamoeba invadens
DAPTDETPHSNNSTDSSKSPAI

SEQ ID NO: 2842668 - protein, 31 aa, Entamoeba invadens
DAPTDKGSTEQTEQVPPTRTSTSVNDRKPPH

SEQ ID NO: 2842669 - protein, 7 aa, Entamoeba invadens
DAPTKTF

SEQ ID NO: 2842670 - protein, 6 aa, Entamoeba invadens
DAPTNP

SEQ ID NO: 2842671 - protein, 7 aa, Entamoeba invadens
DAPTSVG

SEQ ID NO: 2842672 - protein, 6 aa, Entamoeba invadens
DAPTVE

SEQ ID NO: 2842673 - protein, 6 aa, Entamoeba invadens
DAPVWP

SEQ ID NO: 2842674 - protein, 5 aa, Entamoeba invadens
DAQCT

SEQ ID NO: 2842675 - protein, 11 aa, Entamoeba invadens
DAQDENELSIK

SEQ ID NO: 2842676 - protein, 9 aa, Entamoeba invadens
DAQFNPSAH

SEQ ID NO: 2842677 - protein, 9 aa, Entamoeba invadens
DAQKEATLR

SEQ ID NO: 2842678 - protein, 14 aa, Entamoeba invadens
DAQKEATSRAAQYA

SEQ ID NO: 2842679 - protein, 12 aa, Entamoeba invadens
DAQKSDLKTTAG

SEQ ID NO: 2842680 - protein, 61 aa, Entamoeba invadens
DAQLGQKDPSKKQPTQQKQQQKGQKTQKSQKSTPIMKKDDENKEVQKEEKVEGEHQLTNKE

SEQ ID NO: 2842681 - protein, 5 aa, Entamoeba invadens
DAQPN

SEQ ID NO: 2842682 - protein, 14 aa, Entamoeba invadens
DAQRQATKDAGRIA

SEQ ID NO: 2842683 - protein, 12 aa, Entamoeba invadens
DAQSQFNSIGGV

SEQ ID NO: 2842684 - protein, 22 aa, Entamoeba invadens
DAQSTTQSVDSTCKTNHPWNAP

SEQ ID NO: 2842685 - protein, 8 aa, Entamoeba invadens
DAQTPTNL

SEQ ID NO: 2842686 - protein, 5 aa, Entamoeba invadens
DAQTV

SEQ ID NO: 2842687 - protein, 13 aa, Entamoeba invadens
DAQTVSRANETIR

SEQ ID NO: 2842688 - protein, 4 aa, Entamoeba invadens
DARE

SEQ ID NO: 2842689 - protein, 5 aa, Entamoeba invadens
DAREL

SEQ ID NO: 2842690 - protein, 85 aa, Entamoeba invadens
DARENAKDRKKAKMDEKFGKKEDKEEPKKIKENVEEPEQVEKIEKTEKPIEKQSEKQVEKPAKLDKKAKMEKIKNKNADIAEEQT

SEQ ID NO: 2842691 - protein, 29 aa, Entamoeba invadens
DARERSDRIDRSERSGVERKRNNFAPPPY

SEQ ID NO: 2842692 - protein, 7 aa, Entamoeba invadens
DARGNTP

SEQ ID NO: 2842693 - protein, 7 aa, Entamoeba invadens
DARGPYR

SEQ ID NO: 2842694 - protein, 11 aa, Entamoeba invadens
DARKSQGKTWG

SEQ ID NO: 2842695 - protein, 6 aa, Entamoeba invadens
DARNTA

SEQ ID NO: 2842696 - protein, 6 aa, Entamoeba invadens
DARNTS

SEQ ID NO: 2842697 - protein, 5 aa, Entamoeba invadens
DARQE

SEQ ID NO: 2842698 - protein, 12 aa, Entamoeba invadens
DARRANSRSTTP

SEQ ID NO: 2842699 - protein, 8 aa, Entamoeba invadens
DARRSVSD

SEQ ID NO: 2842700 - protein, 10 aa, Entamoeba invadens
DARSSGESND

SEQ ID NO: 2842701 - protein, 5 aa, Entamoeba invadens
DARTM

SEQ ID NO: 2842702 - protein, 4 aa, Entamoeba invadens
DASA

SEQ ID NO: 2842703 - protein, 7 aa, Entamoeba invadens
DASDNQT

SEQ ID NO: 2842704 - protein, 9 aa, Entamoeba invadens
DASDQFNQI

SEQ ID NO: 2842705 - protein, 6 aa, Entamoeba invadens
DASEVS

SEQ ID NO: 2842706 - protein, 8 aa, Entamoeba invadens
DASFEGDT

SEQ ID NO: 2842707 - protein, 5 aa, Entamoeba invadens
DASGI

SEQ ID NO: 2842708 - protein, 11 aa, Entamoeba invadens
DASHPENPQKI

SEQ ID NO: 2842709 - protein, 8 aa, Entamoeba invadens
DASHQSKG

SEQ ID NO: 2842710 - protein, 7 aa, Entamoeba invadens
DASKEDS

SEQ ID NO: 2842711 - protein, 6 aa, Entamoeba invadens
DASKGI

SEQ ID NO: 2842712 - protein, 11 aa, Entamoeba invadens
DASKPQQQKVH

SEQ ID NO: 2842713 - protein, 10 aa, Entamoeba invadens
DASLQTATSM

SEQ ID NO: 2842714 - protein, 5 aa, Entamoeba invadens
DASNR

SEQ ID NO: 2842715 - protein, 12 aa, Entamoeba invadens
DASQSMENSSMP

SEQ ID NO: 2842716 - protein, 5 aa, Entamoeba invadens
DASQY

SEQ ID NO: 2842717 - protein, 6 aa, Entamoeba invadens
DASRGI

SEQ ID NO: 2842718 - protein, 10 aa, Entamoeba invadens
DASRKAYEEM

SEQ ID NO: 2842719 - protein, 17 aa, Entamoeba invadens
DASSCSKCSNGSHYNNN

SEQ ID NO: 2842720 - protein, 14 aa, Entamoeba invadens
DASTEGKKEFGENI

SEQ ID NO: 2842721 - protein, 14 aa, Entamoeba invadens
DASVDLSKSDECLT

SEQ ID NO: 2842722 - protein, 7 aa, Entamoeba invadens
DASVKQN

SEQ ID NO: 2842723 - protein, 24 aa, Entamoeba invadens
DASVPQTTFKNEKAKIAKRTIPLN

SEQ ID NO: 2842724 - protein, 8 aa, Entamoeba invadens
DASVSKEK

SEQ ID NO: 2842725 - protein, 7 aa, Entamoeba invadens
DASYTTR

SEQ ID NO: 2842726 - protein, 9 aa, Entamoeba invadens
DATASTYQK

SEQ ID NO: 2842727 - protein, 13 aa, Entamoeba invadens
DATCGGKCDTTTG

SEQ ID NO: 2842728 - protein, 32 aa, Entamoeba invadens
DATDNVLSNPELSDGSSGSTLSPSPKLDKTSL

SEQ ID NO: 2842729 - protein, 20 aa, Entamoeba invadens
DATEGTVECKSKGDPDLGGN

SEQ ID NO: 2842730 - protein, 5 aa, Entamoeba invadens
DATEP

SEQ ID NO: 2842731 - protein, 7 aa, Entamoeba invadens
DATFTGK

SEQ ID NO: 2842732 - protein, 6 aa, Entamoeba invadens
DATGME

SEQ ID NO: 2842733 - protein, 14 aa, Entamoeba invadens
DATGNYTANAQDIT

SEQ ID NO: 2842734 - protein, 4 aa, Entamoeba invadens
DATI

SEQ ID NO: 2842735 - protein, 4 aa, Entamoeba invadens
DATK

SEQ ID NO: 2842736 - protein, 18 aa, Entamoeba invadens
DATKDAKQYSKIQSKVRS

SEQ ID NO: 2842737 - protein, 5 aa, Entamoeba invadens
DATKS

SEQ ID NO: 2842738 - protein, 7 aa, Entamoeba invadens
DATNKDQ

SEQ ID NO: 2842739 - protein, 9 aa, Entamoeba invadens
DATPESQKY

SEQ ID NO: 2842740 - protein, 7 aa, Entamoeba invadens
DATPSQL

SEQ ID NO: 2842741 - protein, 8 aa, Entamoeba invadens
DATQAVGK

SEQ ID NO: 2842742 - protein, 9 aa, Entamoeba invadens
DATQKENEN

SEQ ID NO: 2842743 - protein, 5 aa, Entamoeba invadens
DATRT

SEQ ID NO: 2842744 - protein, 4 aa, Entamoeba invadens
DATS

SEQ ID NO: 2842745 - protein, 16 aa, Entamoeba invadens
DATSDIAKLSKTGSET

SEQ ID NO: 2842746 - protein, 8 aa, Entamoeba invadens
DATSHFET

SEQ ID NO: 2842747 - protein, 6 aa, Entamoeba invadens
DATSIE

SEQ ID NO: 2842748 - protein, 6 aa, Entamoeba invadens
DATSKK

SEQ ID NO: 2842749 - protein, 10 aa, Entamoeba invadens
DATTHTTSLS

SEQ ID NO: 2842750 - protein, 9 aa, Entamoeba invadens
DATTPESTR

SEQ ID NO: 2842751 - protein, 8 aa, Entamoeba invadens
DAVEKKKQ

SEQ ID NO: 2842752 - protein, 7 aa, Entamoeba invadens
DAVEQRK

SEQ ID NO: 2842753 - protein, 9 aa, Entamoeba invadens
DAVEQSKAK

SEQ ID NO: 2842754 - protein, 9 aa, Entamoeba invadens
DAVGGSSQN

SEQ ID NO: 2842755 - protein, 13 aa, Entamoeba invadens
DAVKGSENAIATE

SEQ ID NO: 2842756 - protein, 5 aa, Entamoeba invadens
DAVKR

SEQ ID NO: 2842757 - protein, 4 aa, Entamoeba invadens
DAVP

SEQ ID NO: 2842758 - protein, 9 aa, Entamoeba invadens
DAVPTEEEK

SEQ ID NO: 2842759 - protein, 6 aa, Entamoeba invadens
DAVRTR

SEQ ID NO: 2842760 - protein, 6 aa, Entamoeba invadens
DAVSLG

SEQ ID NO: 2842761 - protein, 7 aa, Entamoeba invadens
DAYDITP

SEQ ID NO: 2842762 - protein, 5 aa, Entamoeba invadens
DAYDT

SEQ ID NO: 2842763 - protein, 7 aa, Entamoeba invadens
DAYESLT

SEQ ID NO: 2842764 - protein, 7 aa, Entamoeba invadens
DAYGPRA

SEQ ID NO: 2842765 - protein, 10 aa, Entamoeba invadens
DAYKRRGQVK

SEQ ID NO: 2842766 - protein, 26 aa, Entamoeba invadens
DAYLKDDKKKKSQGDKDNSKKTTNYK

SEQ ID NO: 2842767 - protein, 5 aa, Entamoeba invadens
DAYNK

SEQ ID NO: 2842768 - protein, 7 aa, Entamoeba invadens
DAYPKNK

SEQ ID NO: 2842769 - protein, 10 aa, Entamoeba invadens
DCDDAEREKI

SEQ ID NO: 2842770 - protein, 17 aa, Entamoeba invadens
DCDLTDSLTTKKRVSQE

SEQ ID NO: 2842771 - protein, 14 aa, Entamoeba invadens
DCDPNTREVSEEQA

SEQ ID NO: 2842772 - protein, 10 aa, Entamoeba invadens
DCEDEDLTGN

SEQ ID NO: 2842773 - protein, 11 aa, Entamoeba invadens
DCEDIKNSSSL

SEQ ID NO: 2842774 - protein, 18 aa, Entamoeba invadens
DCEEDRLRSGKTKGSNLY

SEQ ID NO: 2842775 - protein, 6 aa, Entamoeba invadens
DCEEKD

SEQ ID NO: 2842776 - protein, 21 aa, Entamoeba invadens
DCEEYENNTNTCSKSKNGFTL

SEQ ID NO: 2842777 - protein, 7 aa, Entamoeba invadens
DCEGNPY

SEQ ID NO: 2842778 - protein, 5 aa, Entamoeba invadens
DCENG

SEQ ID NO: 2842779 - protein, 37 aa, Entamoeba invadens
DCENGEKNIISKNQSESPQAEPIKPKDSQQNSPEKIN

SEQ ID NO: 2842780 - protein, 6 aa, Entamoeba invadens
DCENRN

SEQ ID NO: 2842781 - protein, 13 aa, Entamoeba invadens
DCEPANRAVSTEQ

SEQ ID NO: 2842782 - protein, 6 aa, Entamoeba invadens
DCETIH

SEQ ID NO: 2842783 - protein, 7 aa, Entamoeba invadens
DCGPPTC

SEQ ID NO: 2842784 - protein, 23 aa, Entamoeba invadens
DCGSSTNGGLLNGKTDQFQKPFS

SEQ ID NO: 2842785 - protein, 7 aa, Entamoeba invadens
DCHTNSK

SEQ ID NO: 2842786 - protein, 8 aa, Entamoeba invadens
DCKDPNEI

SEQ ID NO: 2842787 - protein, 5 aa, Entamoeba invadens
DCKEK

SEQ ID NO: 2842788 - protein, 8 aa, Entamoeba invadens
DCKKSDCK

SEQ ID NO: 2842789 - protein, 13 aa, Entamoeba invadens
DCNEEDEEDLGEL

SEQ ID NO: 2842790 - protein, 9 aa, Entamoeba invadens
DCNGKKERD

SEQ ID NO: 2842791 - protein, 7 aa, Entamoeba invadens
DCNKCNE

SEQ ID NO: 2842792 - protein, 58 aa, Entamoeba invadens
DCNNFNDNQTLSSDTENMSLEQNSDEESDSEFEDTNNDYIDQNENDEKEEREDEKTIK

SEQ ID NO: 2842793 - protein, 9 aa, Entamoeba invadens
DCNNRTVSL

SEQ ID NO: 2842794 - protein, 20 aa, Entamoeba invadens
DCNQTTTDSSEKQSKKPCKF

SEQ ID NO: 2842795 - protein, 20 aa, Entamoeba invadens
DCNTNRTSKRNERKQQNWAV

SEQ ID NO: 2842796 - protein, 6 aa, Entamoeba invadens
DCPWTK

SEQ ID NO: 2842797 - protein, 8 aa, Entamoeba invadens
DCQEKDPA

SEQ ID NO: 2842798 - protein, 8 aa, Entamoeba invadens
DCQESGKY

SEQ ID NO: 2842799 - protein, 6 aa, Entamoeba invadens
DCQTDG

SEQ ID NO: 2842800 - protein, 5 aa, Entamoeba invadens
DCQYD

SEQ ID NO: 2842801 - protein, 8 aa, Entamoeba invadens
DCSGNENY

SEQ ID NO: 2842802 - protein, 18 aa, Entamoeba invadens
DCSHSRVSQEDLQQSAET

SEQ ID NO: 2842803 - protein, 6 aa, Entamoeba invadens
DCSQTR

SEQ ID NO: 2842804 - protein, 4 aa, Entamoeba invadens
DCTD

SEQ ID NO: 2842805 - protein, 15 aa, Entamoeba invadens
DCTEASAALQKISKG

SEQ ID NO: 2842806 - protein, 8 aa, Entamoeba invadens
DCTSGPKN

SEQ ID NO: 2842807 - protein, 6 aa, Entamoeba invadens
DCVKEA

SEQ ID NO: 2842808 - protein, 8 aa, Entamoeba invadens
DDAAHDHM

SEQ ID NO: 2842809 - protein, 11 aa, Entamoeba invadens
DDAALGSGGLG

SEQ ID NO: 2842810 - protein, 9 aa, Entamoeba invadens
DDACPSTHN

SEQ ID NO: 2842811 - protein, 8 aa, Entamoeba invadens
DDADSKKC

SEQ ID NO: 2842812 - protein, 7 aa, Entamoeba invadens
DDAEKAE

SEQ ID NO: 2842813 - protein, 7 aa, Entamoeba invadens
DDAFDDG

SEQ ID NO: 2842814 - protein, 12 aa, Entamoeba invadens
DDAFPDKPNLQK

SEQ ID NO: 2842815 - protein, 5 aa, Entamoeba invadens
DDAFV

SEQ ID NO: 2842816 - protein, 8 aa, Entamoeba invadens
DDAGDGDV

SEQ ID NO: 2842817 - protein, 4 aa, Entamoeba invadens
DDAK

SEQ ID NO: 2842818 - protein, 5 aa, Entamoeba invadens
DDAKS

SEQ ID NO: 2842819 - protein, 21 aa, Entamoeba invadens
DDALDKRDASSNERSNTSSVS

SEQ ID NO: 2842820 - protein, 26 aa, Entamoeba invadens
DDALTGSDFKTNPEKTTIDRVIVIQM

SEQ ID NO: 2842821 - protein, 19 aa, Entamoeba invadens
DDANEKYKDFDVDKKKMEE

SEQ ID NO: 2842822 - protein, 6 aa, Entamoeba invadens
DDANKT

SEQ ID NO: 2842823 - protein, 11 aa, Entamoeba invadens
DDAPSSSTNNM

SEQ ID NO: 2842824 - protein, 7 aa, Entamoeba invadens
DDAQKYQ

SEQ ID NO: 2842825 - protein, 7 aa, Entamoeba invadens
DDASKNE

SEQ ID NO: 2842826 - protein, 8 aa, Entamoeba invadens
DDASTAGG

SEQ ID NO: 2842827 - protein, 6 aa, Entamoeba invadens
DDATLQ

SEQ ID NO: 2842828 - protein, 40 aa, Entamoeba invadens
DDAYEAESTPKHNQTEDTKSQSVDDAKKVKENKTKLEEVR

SEQ ID NO: 2842829 - protein, 9 aa, Entamoeba invadens
DDCDENEID

SEQ ID NO: 2842830 - protein, 12 aa, Entamoeba invadens
DDCEAGTYGDGA

SEQ ID NO: 2842831 - protein, 9 aa, Entamoeba invadens
DDCEKRPSI

SEQ ID NO: 2842832 - protein, 7 aa, Entamoeba invadens
DDCGSNL

SEQ ID NO: 2842833 - protein, 47 aa, Entamoeba invadens
DDCPEADKAVPKVEEQKEKKADDIKETQVPQVTEPKEKKKNGVKREK

SEQ ID NO: 2842834 - protein, 5 aa, Entamoeba invadens
DDCPR

SEQ ID NO: 2842835 - protein, 4 aa, Entamoeba invadens
DDDA

SEQ ID NO: 2842836 - protein, 12 aa, Entamoeba invadens
DDDAHKHDQIKK

SEQ ID NO: 2842837 - protein, 14 aa, Entamoeba invadens
DDDAVKRKDNSQYK

SEQ ID NO: 2842838 - protein, 26 aa, Entamoeba invadens
DDDDDDDYDDDLKENIPEKYVIVDEL

SEQ ID NO: 2842839 - protein, 22 aa, Entamoeba invadens
DDDDDLNEGLSNTNVVKGSTQT

SEQ ID NO: 2842840 - protein, 51 aa, Entamoeba invadens
DDDDEPKGTGFYNKGGTEFYANNDGVEAYKKATETALDGNGHTKKNANKND

SEQ ID NO: 2842841 - protein, 8 aa, Entamoeba invadens
DDDDGWNL

SEQ ID NO: 2842842 - protein, 40 aa, Entamoeba invadens
DDDDMDEEDDETFDKQMKETTDGKPNNDDSNQPAPQECTH

SEQ ID NO: 2842843 - protein, 10 aa, Entamoeba invadens
DDDDSSREEL

SEQ ID NO: 2842844 - protein, 11 aa, Entamoeba invadens
DDDDVKPIDVK

SEQ ID NO: 2842845 - protein, 8 aa, Entamoeba invadens
DDDEEDDD

SEQ ID NO: 2842846 - protein, 8 aa, Entamoeba invadens
DDDEENQE

SEQ ID NO: 2842847 - protein, 16 aa, Entamoeba invadens
DDDEGWNVSEDKNGTT

SEQ ID NO: 2842848 - protein, 7 aa, Entamoeba invadens
DDDEKWM

SEQ ID NO: 2842849 - protein, 8 aa, Entamoeba invadens
DDDELKTP

SEQ ID NO: 2842850 - protein, 26 aa, Entamoeba invadens
DDDEMDSSCDTQHDKVNGSPEITSYT

SEQ ID NO: 2842851 - protein, 17 aa, Entamoeba invadens
DDDENNVTNTKQNLKGA

SEQ ID NO: 2842852 - protein, 45 aa, Entamoeba invadens
DDDESKEDTPDTAKVAGDVDAGANATNEQNERESEDNEESEMEDV

SEQ ID NO: 2842853 - protein, 10 aa, Entamoeba invadens
DDDGEHAAGK

SEQ ID NO: 2842854 - protein, 7 aa, Entamoeba invadens
DDDGEID

SEQ ID NO: 2842855 - protein, 5 aa, Entamoeba invadens
DDDGL

SEQ ID NO: 2842856 - protein, 5 aa, Entamoeba invadens
DDDGW

SEQ ID NO: 2842857 - protein, 21 aa, Entamoeba invadens
DDDHYKDTTGCLPKQEKYPDC

SEQ ID NO: 2842858 - protein, 21 aa, Entamoeba invadens
DDDHYKDTTGCLPKQEKYPNC

SEQ ID NO: 2842859 - protein, 7 aa, Entamoeba invadens
DDDIAEY

SEQ ID NO: 2842860 - protein, 9 aa, Entamoeba invadens
DDDIGNSKF

SEQ ID NO: 2842861 - protein, 26 aa, Entamoeba invadens
DDDIPRSNTPPFDEKGEGVTKNLRMR

SEQ ID NO: 2842862 - protein, 8 aa, Entamoeba invadens
DDDIQKDK

SEQ ID NO: 2842863 - protein, 7 aa, Entamoeba invadens
DDDISFE

SEQ ID NO: 2842864 - protein, 10 aa, Entamoeba invadens
DDDKDDYRKS

SEQ ID NO: 2842865 - protein, 9 aa, Entamoeba invadens
DDDKENPEI

SEQ ID NO: 2842866 - protein, 4 aa, Entamoeba invadens
DDDL

SEQ ID NO: 2842867 - protein, 6 aa, Entamoeba invadens
DDDLRQ

SEQ ID NO: 2842868 - protein, 6 aa, Entamoeba invadens
DDDLTV

SEQ ID NO: 2842869 - protein, 11 aa, Entamoeba invadens
DDDNDDDMFER

SEQ ID NO: 2842870 - protein, 8 aa, Entamoeba invadens
DDDNFGNK

SEQ ID NO: 2842871 - protein, 10 aa, Entamoeba invadens
DDDNKITSKQ

SEQ ID NO: 2842872 - protein, 7 aa, Entamoeba invadens
DDDPEIK

SEQ ID NO: 2842873 - protein, 5 aa, Entamoeba invadens
DDDPI

SEQ ID NO: 2842874 - protein, 8 aa, Entamoeba invadens
DDDPTELA

SEQ ID NO: 2842875 - protein, 19 aa, Entamoeba invadens
DDDQFQPRRPKKQEKAPDV

SEQ ID NO: 2842876 - protein, 6 aa, Entamoeba invadens
DDDRTW

SEQ ID NO: 2842877 - protein, 7 aa, Entamoeba invadens
DDDRTWM

SEQ ID NO: 2842878 - protein, 11 aa, Entamoeba invadens
DDDSEDGVPDI

SEQ ID NO: 2842879 - protein, 19 aa, Entamoeba invadens
DDDSIENENKNDENEEEPL

SEQ ID NO: 2842880 - protein, 6 aa, Entamoeba invadens
DDDTDV

SEQ ID NO: 2842881 - protein, 8 aa, Entamoeba invadens
DDDTESYI

SEQ ID NO: 2842882 - protein, 7 aa, Entamoeba invadens
DDDVTET

SEQ ID NO: 2842883 - protein, 7 aa, Entamoeba invadens
DDDYRRQ

SEQ ID NO: 2842884 - protein, 4 aa, Entamoeba invadens
DDEA

SEQ ID NO: 2842885 - protein, 4 aa, Entamoeba invadens
DDED

SEQ ID NO: 2842886 - protein, 12 aa, Entamoeba invadens
DDEDDDDERATC

SEQ ID NO: 2842887 - protein, 16 aa, Entamoeba invadens
DDEDEDKEKEEEIDEN

SEQ ID NO: 2842888 - protein, 18 aa, Entamoeba invadens
DDEDEDKVKEKEEEIDEN

SEQ ID NO: 2842889 - protein, 15 aa, Entamoeba invadens
DDEDEDQEKEEEIDE

SEQ ID NO: 2842890 - protein, 26 aa, Entamoeba invadens
DDEDEKDFHGYSEESENFTDKSVTPD

SEQ ID NO: 2842891 - protein, 26 aa, Entamoeba invadens
DDEDGSDDKDDDKEDEMSEEALTKPL

SEQ ID NO: 2842892 - protein, 23 aa, Entamoeba invadens
DDEDKDVQRKIEAEKRRKMEEEQ

SEQ ID NO: 2842893 - protein, 12 aa, Entamoeba invadens
DDEDLRFESRDD

SEQ ID NO: 2842894 - protein, 8 aa, Entamoeba invadens
DDEDPTLT

SEQ ID NO: 2842895 - protein, 7 aa, Entamoeba invadens
DDEDSEV

SEQ ID NO: 2842896 - protein, 18 aa, Entamoeba invadens
DDEDVAGVASGLFGTVVK

SEQ ID NO: 2842897 - protein, 9 aa, Entamoeba invadens
DDEEAENGV

SEQ ID NO: 2842898 - protein, 8 aa, Entamoeba invadens
DDEEDTMT

SEQ ID NO: 2842899 - protein, 8 aa, Entamoeba invadens
DDEEDTRI

SEQ ID NO: 2842900 - protein, 10 aa, Entamoeba invadens
DDEEENDDDD

SEQ ID NO: 2842901 - protein, 7 aa, Entamoeba invadens
DDEEFQK

SEQ ID NO: 2842902 - protein, 8 aa, Entamoeba invadens
DDEENIEC

SEQ ID NO: 2842903 - protein, 16 aa, Entamoeba invadens
DDEEPYVPDSIDQLHE

SEQ ID NO: 2842904 - protein, 7 aa, Entamoeba invadens
DDEERQD

SEQ ID NO: 2842905 - protein, 8 aa, Entamoeba invadens
DDEETQRI

SEQ ID NO: 2842906 - protein, 11 aa, Entamoeba invadens
DDEEVTETKTV

SEQ ID NO: 2842907 - protein, 9 aa, Entamoeba invadens
DDEEYETEF

SEQ ID NO: 2842908 - protein, 51 aa, Entamoeba invadens
DDEEYSSSLRSDASDNAEEEEETGEKLENISKDSDVESDRKESDKSSFFSR

SEQ ID NO: 2842909 - protein, 4 aa, Entamoeba invadens
DDEF

SEQ ID NO: 2842910 - protein, 7 aa, Entamoeba invadens
DDEFIDD

SEQ ID NO: 2842911 - protein, 7 aa, Entamoeba invadens
DDEGGRL

SEQ ID NO: 2842912 - protein, 5 aa, Entamoeba invadens
DDEGI

SEQ ID NO: 2842913 - protein, 6 aa, Entamoeba invadens
DDEGKT

SEQ ID NO: 2842914 - protein, 7 aa, Entamoeba invadens
DDEHEPI

SEQ ID NO: 2842915 - protein, 32 aa, Entamoeba invadens
DDEIEEKISQTITKTQAKDEEFDEDNKDSSMK

SEQ ID NO: 2842916 - protein, 6 aa, Entamoeba invadens
DDEIEK

SEQ ID NO: 2842917 - protein, 9 aa, Entamoeba invadens
DDEIKDYET

SEQ ID NO: 2842918 - protein, 10 aa, Entamoeba invadens
DDEITGSKKI

SEQ ID NO: 2842919 - protein, 6 aa, Entamoeba invadens
DDEKAE

SEQ ID NO: 2842920 - protein, 34 aa, Entamoeba invadens
DDEKDAKVEKVEQKDIKETREKTETDQSTSETKI

SEQ ID NO: 2842921 - protein, 9 aa, Entamoeba invadens
DDEKKSQVV

SEQ ID NO: 2842922 - protein, 6 aa, Entamoeba invadens
DDEKNL

SEQ ID NO: 2842923 - protein, 6 aa, Entamoeba invadens
DDEKNR

SEQ ID NO: 2842924 - protein, 6 aa, Entamoeba invadens
DDEKRL

SEQ ID NO: 2842925 - protein, 9 aa, Entamoeba invadens
DDELNNDNK

SEQ ID NO: 2842926 - protein, 4 aa, Entamoeba invadens
DDEM

SEQ ID NO: 2842927 - protein, 26 aa, Entamoeba invadens
DDEMNTKRKEVEEQKEENNKLKNEIK

SEQ ID NO: 2842928 - protein, 7 aa, Entamoeba invadens
DDENENF

SEQ ID NO: 2842929 - protein, 11 aa, Entamoeba invadens
DDENRKNTQIP

SEQ ID NO: 2842930 - protein, 11 aa, Entamoeba invadens
DDENSQRKTPL

SEQ ID NO: 2842931 - protein, 5 aa, Entamoeba invadens
DDEPA

SEQ ID NO: 2842932 - protein, 41 aa, Entamoeba invadens
DDEQGDEQNEEGGSVKNEKEHKSGIEEKEPKAEEKDVVPKP

SEQ ID NO: 2842933 - protein, 7 aa, Entamoeba invadens
DDERGYY

SEQ ID NO: 2842934 - protein, 8 aa, Entamoeba invadens
DDERIQRT

SEQ ID NO: 2842935 - protein, 7 aa, Entamoeba invadens
DDERKDK

SEQ ID NO: 2842936 - protein, 9 aa, Entamoeba invadens
DDERQSKLH

SEQ ID NO: 2842937 - protein, 4 aa, Entamoeba invadens
DDES

SEQ ID NO: 2842938 - protein, 5 aa, Entamoeba invadens
DDESA

SEQ ID NO: 2842939 - protein, 12 aa, Entamoeba invadens
DDESASGKGVTF

SEQ ID NO: 2842940 - protein, 7 aa, Entamoeba invadens
DDESQSI

SEQ ID NO: 2842941 - protein, 21 aa, Entamoeba invadens
DDESSNKKDDNSENNENSQEF

SEQ ID NO: 2842942 - protein, 8 aa, Entamoeba invadens
DDETDTGY

SEQ ID NO: 2842943 - protein, 7 aa, Entamoeba invadens
DDETDTI

SEQ ID NO: 2842944 - protein, 25 aa, Entamoeba invadens
DDETEETTELTTNQPQNPPQPPTNL

SEQ ID NO: 2842945 - protein, 18 aa, Entamoeba invadens
DDETIGKKKKKEAKIKED

SEQ ID NO: 2842946 - protein, 5 aa, Entamoeba invadens
DDETK

SEQ ID NO: 2842947 - protein, 8 aa, Entamoeba invadens
DDETKNEC

SEQ ID NO: 2842948 - protein, 8 aa, Entamoeba invadens
DDETVESV

SEQ ID NO: 2842949 - protein, 4 aa, Entamoeba invadens
DDEV

SEQ ID NO: 2842950 - protein, 8 aa, Entamoeba invadens
DDEVEQRS

SEQ ID NO: 2842951 - protein, 12 aa, Entamoeba invadens
DDEVGEKREISR

SEQ ID NO: 2842952 - protein, 35 aa, Entamoeba invadens
DDFDFSQSKSKISDIASDVGSTLQGSSIGKSFASR

SEQ ID NO: 2842953 - protein, 8 aa, Entamoeba invadens
DDFDTNQI

SEQ ID NO: 2842954 - protein, 13 aa, Entamoeba invadens
DDFEDEDDKDIKS

SEQ ID NO: 2842955 - protein, 7 aa, Entamoeba invadens
DDFEPHR

SEQ ID NO: 2842956 - protein, 6 aa, Entamoeba invadens
DDFEQP

SEQ ID NO: 2842957 - protein, 5 aa, Entamoeba invadens
DDFES

SEQ ID NO: 2842958 - protein, 24 aa, Entamoeba invadens
DDFETESNDISQTEDLDVTENGEM

SEQ ID NO: 2842959 - protein, 6 aa, Entamoeba invadens
DDFKKQ

SEQ ID NO: 2842960 - protein, 7 aa, Entamoeba invadens
DDFKSEK

SEQ ID NO: 2842961 - protein, 10 aa, Entamoeba invadens
DDFKTPKDDV

SEQ ID NO: 2842962 - protein, 6 aa, Entamoeba invadens
DDFNKF

SEQ ID NO: 2842963 - protein, 8 aa, Entamoeba invadens
DDFNTANG

SEQ ID NO: 2842964 - protein, 4 aa, Entamoeba invadens
DDFP

SEQ ID NO: 2842965 - protein, 6 aa, Entamoeba invadens
DDFRGE

SEQ ID NO: 2842966 - protein, 11 aa, Entamoeba invadens
DDFSKNTFKDS

SEQ ID NO: 2842967 - protein, 14 aa, Entamoeba invadens
DDFSVSNSTEYQPI

SEQ ID NO: 2842968 - protein, 7 aa, Entamoeba invadens
DDFTTPQ

SEQ ID NO: 2842969 - protein, 6 aa, Entamoeba invadens
DDGASK

SEQ ID NO: 2842970 - protein, 6 aa, Entamoeba invadens
DDGCVE

SEQ ID NO: 2842971 - protein, 8 aa, Entamoeba invadens
DDGDFQND

SEQ ID NO: 2842972 - protein, 10 aa, Entamoeba invadens
DDGDVNSEEM

SEQ ID NO: 2842973 - protein, 21 aa, Entamoeba invadens
DDGEDDMDGEDFDEDDEDMGG

SEQ ID NO: 2842974 - protein, 10 aa, Entamoeba invadens
DDGEEPERSA

SEQ ID NO: 2842975 - protein, 7 aa, Entamoeba invadens
DDGEFDQ

SEQ ID NO: 2842976 - protein, 8 aa, Entamoeba invadens
DDGEKTHC

SEQ ID NO: 2842977 - protein, 7 aa, Entamoeba invadens
DDGEKTR

SEQ ID NO: 2842978 - protein, 11 aa, Entamoeba invadens
DDGGNIAKEEM

SEQ ID NO: 2842979 - protein, 7 aa, Entamoeba invadens
DDGKDDF

SEQ ID NO: 2842980 - protein, 6 aa, Entamoeba invadens
DDGKKY

SEQ ID NO: 2842981 - protein, 21 aa, Entamoeba invadens
DDGKLENSSPEKTSGSATSSV

SEQ ID NO: 2842982 - protein, 23 aa, Entamoeba invadens
DDGKSDTEIFTDDSESDEEPENS

SEQ ID NO: 2842983 - protein, 10 aa, Entamoeba invadens
DDGLKAEVGP

SEQ ID NO: 2842984 - protein, 11 aa, Entamoeba invadens
DDGLKGKTSSL

SEQ ID NO: 2842985 - protein, 12 aa, Entamoeba invadens
DDGLKRKTTSKT

SEQ ID NO: 2842986 - protein, 4 aa, Entamoeba invadens
DDGN

SEQ ID NO: 2842987 - protein, 12 aa, Entamoeba invadens
DDGNKKGDEAKS

SEQ ID NO: 2842988 - protein, 12 aa, Entamoeba invadens
DDGNKKGDTEKS

SEQ ID NO: 2842989 - protein, 10 aa, Entamoeba invadens
DDGNKRVGED

SEQ ID NO: 2842990 - protein, 11 aa, Entamoeba invadens
DDGPFKSERIS

SEQ ID NO: 2842991 - protein, 14 aa, Entamoeba invadens
DDGRLYTKPEVKES

SEQ ID NO: 2842992 - protein, 8 aa, Entamoeba invadens
DDGRRLAV

SEQ ID NO: 2842993 - protein, 24 aa, Entamoeba invadens
DDGSPSKNKKNEINFEKSKKMGSY

SEQ ID NO: 2842994 - protein, 6 aa, Entamoeba invadens
DDGSTV

SEQ ID NO: 2842995 - protein, 19 aa, Entamoeba invadens
DDGSVDGLPPSTNQLQNDQ

SEQ ID NO: 2842996 - protein, 8 aa, Entamoeba invadens
DDGSVNAA

SEQ ID NO: 2842997 - protein, 7 aa, Entamoeba invadens
DDGTDTK

SEQ ID NO: 2842998 - protein, 6 aa, Entamoeba invadens
DDGTLN

SEQ ID NO: 2842999 - protein, 5 aa, Entamoeba invadens
DDGTV

SEQ ID NO: 2843000 - protein, 7 aa, Entamoeba invadens
DDGVGKS

SEQ ID NO: 2843001 - protein, 6 aa, Entamoeba invadens
DDGVSK

SEQ ID NO: 2843002 - protein, 10 aa, Entamoeba invadens
DDHEPADSKF

SEQ ID NO: 2843003 - protein, 6 aa, Entamoeba invadens
DDHPNV

SEQ ID NO: 2843004 - protein, 23 aa, Entamoeba invadens
DDHVKKVKEPKQIEDTQSSDRYT

SEQ ID NO: 2843005 - protein, 6 aa, Entamoeba invadens
DDIADL

SEQ ID NO: 2843006 - protein, 7 aa, Entamoeba invadens
DDIADLE

SEQ ID NO: 2843007 - protein, 4 aa, Entamoeba invadens
DDID

SEQ ID NO: 2843008 - protein, 5 aa, Entamoeba invadens
DDIDG

SEQ ID NO: 2843009 - protein, 19 aa, Entamoeba invadens
DDIEDKPKQLETKLSHKNE

SEQ ID NO: 2843010 - protein, 6 aa, Entamoeba invadens
DDIEEA

SEQ ID NO: 2843011 - protein, 10 aa, Entamoeba invadens
DDIENTDQKY

SEQ ID NO: 2843012 - protein, 6 aa, Entamoeba invadens
DDIETP

SEQ ID NO: 2843013 - protein, 4 aa, Entamoeba invadens
DDIG

SEQ ID NO: 2843014 - protein, 9 aa, Entamoeba invadens
DDIGEEENV

SEQ ID NO: 2843015 - protein, 6 aa, Entamoeba invadens
DDIGTA

SEQ ID NO: 2843016 - protein, 8 aa, Entamoeba invadens
DDIGTKKF

SEQ ID NO: 2843017 - protein, 10 aa, Entamoeba invadens
DDIGVSSRNT

SEQ ID NO: 2843018 - protein, 7 aa, Entamoeba invadens
DDIKGGS

SEQ ID NO: 2843019 - protein, 6 aa, Entamoeba invadens
DDINNS

SEQ ID NO: 2843020 - protein, 17 aa, Entamoeba invadens
DDINTGYTTQTENSSTL

SEQ ID NO: 2843021 - protein, 7 aa, Entamoeba invadens
DDIPKVS

SEQ ID NO: 2843022 - protein, 7 aa, Entamoeba invadens
DDIPSNV

SEQ ID NO: 2843023 - protein, 18 aa, Entamoeba invadens
DDIPSSIAQVEQNKTLNF

SEQ ID NO: 2843024 - protein, 9 aa, Entamoeba invadens
DDIPSTINT

SEQ ID NO: 2843025 - protein, 10 aa, Entamoeba invadens
DDIRQENNTL

SEQ ID NO: 2843026 - protein, 5 aa, Entamoeba invadens
DDIRS

SEQ ID NO: 2843027 - protein, 5 aa, Entamoeba invadens
DDISP

SEQ ID NO: 2843028 - protein, 12 aa, Entamoeba invadens
DDISRNDFGDVE

SEQ ID NO: 2843029 - protein, 12 aa, Entamoeba invadens
DDISTIEEGYYF

SEQ ID NO: 2843030 - protein, 45 aa, Entamoeba invadens
DDITESDKTRNFSPLTSPRSDRKEKKERPSSSQAKVGKSLTPNDI

SEQ ID NO: 2843031 - protein, 12 aa, Entamoeba invadens
DDITNSRKECVV

SEQ ID NO: 2843032 - protein, 5 aa, Entamoeba invadens
DDITR

SEQ ID NO: 2843033 - protein, 5 aa, Entamoeba invadens
DDITS

SEQ ID NO: 2843034 - protein, 4 aa, Entamoeba invadens
DDIV

SEQ ID NO: 2843035 - protein, 8 aa, Entamoeba invadens
DDKADESI

SEQ ID NO: 2843036 - protein, 4 aa, Entamoeba invadens
DDKD

SEQ ID NO: 2843037 - protein, 9 aa, Entamoeba invadens
DDKDSAKID

SEQ ID NO: 2843038 - protein, 4 aa, Entamoeba invadens
DDKE

SEQ ID NO: 2843039 - protein, 31 aa, Entamoeba invadens
DDKEEEVPKAEDVKPVEETPAGEMNSQMEEV

SEQ ID NO: 2843040 - protein, 8 aa, Entamoeba invadens
DDKEENLG

SEQ ID NO: 2843041 - protein, 7 aa, Entamoeba invadens
DDKEKCQ

SEQ ID NO: 2843042 - protein, 12 aa, Entamoeba invadens
DDKEKDSTAIEP

SEQ ID NO: 2843043 - protein, 7 aa, Entamoeba invadens
DDKEKLE

SEQ ID NO: 2843044 - protein, 7 aa, Entamoeba invadens
DDKEQNE

SEQ ID NO: 2843045 - protein, 4 aa, Entamoeba invadens
DDKG

SEQ ID NO: 2843046 - protein, 12 aa, Entamoeba invadens
DDKHEPKRSAAE

SEQ ID NO: 2843047 - protein, 9 aa, Entamoeba invadens
DDKHTTLQD

SEQ ID NO: 2843048 - protein, 7 aa, Entamoeba invadens
DDKITEV

SEQ ID NO: 2843049 - protein, 4 aa, Entamoeba invadens
DDKK

SEQ ID NO: 2843050 - protein, 16 aa, Entamoeba invadens
DDKKDEQNAVLLVHSV

SEQ ID NO: 2843051 - protein, 20 aa, Entamoeba invadens
DDKKEKQKIAKKEKKEKYQK

SEQ ID NO: 2843052 - protein, 8 aa, Entamoeba invadens
DDKKESLE

SEQ ID NO: 2843053 - protein, 7 aa, Entamoeba invadens
DDKKPKW

SEQ ID NO: 2843054 - protein, 9 aa, Entamoeba invadens
DDKKPLDTI

SEQ ID NO: 2843055 - protein, 9 aa, Entamoeba invadens
DDKKSAYIS

SEQ ID NO: 2843056 - protein, 6 aa, Entamoeba invadens
DDKKSI

SEQ ID NO: 2843057 - protein, 8 aa, Entamoeba invadens
DDKKSPLS

SEQ ID NO: 2843058 - protein, 9 aa, Entamoeba invadens
DDKLGGSKF

SEQ ID NO: 2843059 - protein, 7 aa, Entamoeba invadens
DDKMQEA

SEQ ID NO: 2843060 - protein, 7 aa, Entamoeba invadens
DDKNEEV

SEQ ID NO: 2843061 - protein, 7 aa, Entamoeba invadens
DDKNETT

SEQ ID NO: 2843062 - protein, 17 aa, Entamoeba invadens
DDKNGEKAAKKSVVKKI

SEQ ID NO: 2843063 - protein, 77 aa, Entamoeba invadens
DDKNHEKNERMTTAENGEKKDEKQNEDIKRKRDGQSQKKRIPKRTQTNVKTSKEEKEVTTSEEIEIKNTKKNKEKRL

SEQ ID NO: 2843064 - protein, 8 aa, Entamoeba invadens
DDKNNRQY

SEQ ID NO: 2843065 - protein, 22 aa, Entamoeba invadens
DDKNNTSSRTNNNMNPQNNNKI

SEQ ID NO: 2843066 - protein, 8 aa, Entamoeba invadens
DDKNRNFR

SEQ ID NO: 2843067 - protein, 8 aa, Entamoeba invadens
DDKNSVSM

SEQ ID NO: 2843068 - protein, 7 aa, Entamoeba invadens
DDKNTDV

SEQ ID NO: 2843069 - protein, 10 aa, Entamoeba invadens
DDKNVSNYTN

SEQ ID NO: 2843070 - protein, 8 aa, Entamoeba invadens
DDKPAAEK

SEQ ID NO: 2843071 - protein, 7 aa, Entamoeba invadens
DDKPTNT

SEQ ID NO: 2843072 - protein, 13 aa, Entamoeba invadens
DDKQEKVDTSKNA

SEQ ID NO: 2843073 - protein, 8 aa, Entamoeba invadens
DDKQKLEP

SEQ ID NO: 2843074 - protein, 7 aa, Entamoeba invadens
DDKQKVA

SEQ ID NO: 2843075 - protein, 14 aa, Entamoeba invadens
DDKQLQKQYGKSDL

SEQ ID NO: 2843076 - protein, 10 aa, Entamoeba invadens
DDKQQTIEEV

SEQ ID NO: 2843077 - protein, 6 aa, Entamoeba invadens
DDKREE

SEQ ID NO: 2843078 - protein, 7 aa, Entamoeba invadens
DDKSFKY

SEQ ID NO: 2843079 - protein, 29 aa, Entamoeba invadens
DDKSGGEEEATEYEDSECSDTNEENDTRV

SEQ ID NO: 2843080 - protein, 9 aa, Entamoeba invadens
DDKSIGNEL

SEQ ID NO: 2843081 - protein, 8 aa, Entamoeba invadens
DDKSNIDK

SEQ ID NO: 2843082 - protein, 10 aa, Entamoeba invadens
DDKSSASTTM

SEQ ID NO: 2843083 - protein, 9 aa, Entamoeba invadens
DDKSSVTHT

SEQ ID NO: 2843084 - protein, 4 aa, Entamoeba invadens
DDKT

SEQ ID NO: 2843085 - protein, 8 aa, Entamoeba invadens
DDKTHLEK

SEQ ID NO: 2843086 - protein, 9 aa, Entamoeba invadens
DDKTKPIDE

SEQ ID NO: 2843087 - protein, 9 aa, Entamoeba invadens
DDKTKSIDI

SEQ ID NO: 2843088 - protein, 33 aa, Entamoeba invadens
DDKTLDDKSPNKTMKKTRKSRKDKSDKGKKEEY

SEQ ID NO: 2843089 - protein, 15 aa, Entamoeba invadens
DDKTQSIDSSNSPTV

SEQ ID NO: 2843090 - protein, 13 aa, Entamoeba invadens
DDKTTQIKISNQD

SEQ ID NO: 2843091 - protein, 6 aa, Entamoeba invadens
DDKTVN

SEQ ID NO: 2843092 - protein, 5 aa, Entamoeba invadens
DDKYL

SEQ ID NO: 2843093 - protein, 8 aa, Entamoeba invadens
DDLDEKAE

SEQ ID NO: 2843094 - protein, 14 aa, Entamoeba invadens
DDLEDEKLDNHEVE

SEQ ID NO: 2843095 - protein, 5 aa, Entamoeba invadens
DDLEK

SEQ ID NO: 2843096 - protein, 4 aa, Entamoeba invadens
DDLF

SEQ ID NO: 2843097 - protein, 13 aa, Entamoeba invadens
DDLKDKSKQWGHS

SEQ ID NO: 2843098 - protein, 10 aa, Entamoeba invadens
DDLKGVKEKH

SEQ ID NO: 2843099 - protein, 8 aa, Entamoeba invadens
DDLKSNPN

SEQ ID NO: 2843100 - protein, 4 aa, Entamoeba invadens
DDLL

SEQ ID NO: 2843101 - protein, 4 aa, Entamoeba invadens
DDLN

SEQ ID NO: 2843102 - protein, 7 aa, Entamoeba invadens
DDLNNEQ

SEQ ID NO: 2843103 - protein, 57 aa, Entamoeba invadens
DDLNNSTKSEKIEKEESEMSESQSESETDKVKQLQNEENTKRGFINSKDGLSTPLQQ

SEQ ID NO: 2843104 - protein, 29 aa, Entamoeba invadens
DDLPDVAAKQEETQNSQPKTSSETKLSQK

SEQ ID NO: 2843105 - protein, 8 aa, Entamoeba invadens
DDLPSSGQ

SEQ ID NO: 2843106 - protein, 12 aa, Entamoeba invadens
DDLRASTTEVSD

SEQ ID NO: 2843107 - protein, 6 aa, Entamoeba invadens
DDLRQD

SEQ ID NO: 2843108 - protein, 18 aa, Entamoeba invadens
DDLRQTQSVLSESRTELA

SEQ ID NO: 2843109 - protein, 7 aa, Entamoeba invadens
DDLSGAD

SEQ ID NO: 2843110 - protein, 14 aa, Entamoeba invadens
DDLSKQSQTGLDTK

SEQ ID NO: 2843111 - protein, 12 aa, Entamoeba invadens
DDLSPKSPQKVG

SEQ ID NO: 2843112 - protein, 10 aa, Entamoeba invadens
DDLSQTEKAW

SEQ ID NO: 2843113 - protein, 6 aa, Entamoeba invadens
DDLSSV

SEQ ID NO: 2843114 - protein, 4 aa, Entamoeba invadens
DDLT

SEQ ID NO: 2843115 - protein, 5 aa, Entamoeba invadens
DDLTI

SEQ ID NO: 2843116 - protein, 9 aa, Entamoeba invadens
DDLTTNTSH

SEQ ID NO: 2843117 - protein, 7 aa, Entamoeba invadens
DDMDEST

SEQ ID NO: 2843118 - protein, 7 aa, Entamoeba invadens
DDMEKTE

SEQ ID NO: 2843119 - protein, 21 aa, Entamoeba invadens
DDMEKTENNLAGAKSNMNQKD

SEQ ID NO: 2843120 - protein, 10 aa, Entamoeba invadens
DDMEKTGKDL

SEQ ID NO: 2843121 - protein, 19 aa, Entamoeba invadens
DDMEKTGKDLAGAKSIMNQ

SEQ ID NO: 2843122 - protein, 31 aa, Entamoeba invadens
DDMEKTGKDLAGAKSNMHQKDVEINNLNEQL

SEQ ID NO: 2843123 - protein, 15 aa, Entamoeba invadens
DDMEKTKKDLAAKSV

SEQ ID NO: 2843124 - protein, 11 aa, Entamoeba invadens
DDMKEDGEVKE

SEQ ID NO: 2843125 - protein, 13 aa, Entamoeba invadens
DDMNTSDEVSVDT

SEQ ID NO: 2843126 - protein, 10 aa, Entamoeba invadens
DDMSNSQDFP

SEQ ID NO: 2843127 - protein, 81 aa, Entamoeba invadens
DDNAETVTEYHKNSQESEESKEHTEESSSDESEESEKEEKQEEKAELKEEEKPVENEEKKEDAKAKVSEKKKGETPKTSSF

SEQ ID NO: 2843128 - protein, 7 aa, Entamoeba invadens
DDNCPNV

SEQ ID NO: 2843129 - protein, 7 aa, Entamoeba invadens
DDNDEHK

SEQ ID NO: 2843130 - protein, 5 aa, Entamoeba invadens
DDNDV

SEQ ID NO: 2843131 - protein, 46 aa, Entamoeba invadens
DDNEARSFTNPAPAAAPLPTPKASVPPMQTVTKKKDKSTKDTSDQI

SEQ ID NO: 2843132 - protein, 10 aa, Entamoeba invadens
DDNEGQNVTI

SEQ ID NO: 2843133 - protein, 23 aa, Entamoeba invadens
DDNEKGKGGNVGRGESTTNNPME

SEQ ID NO: 2843134 - protein, 6 aa, Entamoeba invadens
DDNELD

SEQ ID NO: 2843135 - protein, 15 aa, Entamoeba invadens
DDNENSDIPVGKETR

SEQ ID NO: 2843136 - protein, 8 aa, Entamoeba invadens
DDNISPKI

SEQ ID NO: 2843137 - protein, 7 aa, Entamoeba invadens
DDNKEGF

SEQ ID NO: 2843138 - protein, 14 aa, Entamoeba invadens
DDNKKSGVSPESGP

SEQ ID NO: 2843139 - protein, 5 aa, Entamoeba invadens
DDNKV

SEQ ID NO: 2843140 - protein, 6 aa, Entamoeba invadens
DDNLST

SEQ ID NO: 2843141 - protein, 8 aa, Entamoeba invadens
DDNNGKIG

SEQ ID NO: 2843142 - protein, 8 aa, Entamoeba invadens
DDNPDNDD

SEQ ID NO: 2843143 - protein, 7 aa, Entamoeba invadens
DDNPFAV

SEQ ID NO: 2843144 - protein, 7 aa, Entamoeba invadens
DDNPNSL

SEQ ID NO: 2843145 - protein, 5 aa, Entamoeba invadens
DDNPY

SEQ ID NO: 2843146 - protein, 5 aa, Entamoeba invadens
DDNQP

SEQ ID NO: 2843147 - protein, 5 aa, Entamoeba invadens
DDNSE

SEQ ID NO: 2843148 - protein, 8 aa, Entamoeba invadens
DDNSGTLE

SEQ ID NO: 2843149 - protein, 10 aa, Entamoeba invadens
DDNSGTLETN

SEQ ID NO: 2843150 - protein, 10 aa, Entamoeba invadens
DDNTHPKKPY

SEQ ID NO: 2843151 - protein, 8 aa, Entamoeba invadens
DDNTKEDL

SEQ ID NO: 2843152 - protein, 7 aa, Entamoeba invadens
DDNTPYI

SEQ ID NO: 2843153 - protein, 5 aa, Entamoeba invadens
DDNTR

SEQ ID NO: 2843154 - protein, 6 aa, Entamoeba invadens
DDNTRA

SEQ ID NO: 2843155 - protein, 5 aa, Entamoeba invadens
DDNVF

SEQ ID NO: 2843156 - protein, 4 aa, Entamoeba invadens
DDPD

SEQ ID NO: 2843157 - protein, 5 aa, Entamoeba invadens
DDPDI

SEQ ID NO: 2843158 - protein, 6 aa, Entamoeba invadens
DDPEKL

SEQ ID NO: 2843159 - protein, 8 aa, Entamoeba invadens
DDPFDGSQ

SEQ ID NO: 2843160 - protein, 7 aa, Entamoeba invadens
DDPHYSN

SEQ ID NO: 2843161 - protein, 4 aa, Entamoeba invadens
DDPK

SEQ ID NO: 2843162 - protein, 21 aa, Entamoeba invadens
DDPKEKPTELVRKGEKQNEMP

SEQ ID NO: 2843163 - protein, 18 aa, Entamoeba invadens
DDPKLDDSEEVTKHKNTR

SEQ ID NO: 2843164 - protein, 9 aa, Entamoeba invadens
DDPKPQEPK

SEQ ID NO: 2843165 - protein, 7 aa, Entamoeba invadens
DDPLASQ

SEQ ID NO: 2843166 - protein, 6 aa, Entamoeba invadens
DDPNYY

SEQ ID NO: 2843167 - protein, 5 aa, Entamoeba invadens
DDPPL

SEQ ID NO: 2843168 - protein, 8 aa, Entamoeba invadens
DDPPTKTF

SEQ ID NO: 2843169 - protein, 5 aa, Entamoeba invadens
DDPSC

SEQ ID NO: 2843170 - protein, 10 aa, Entamoeba invadens
DDPSFSEEGK

SEQ ID NO: 2843171 - protein, 5 aa, Entamoeba invadens
DDPSK

SEQ ID NO: 2843172 - protein, 8 aa, Entamoeba invadens
DDPSTDNF

SEQ ID NO: 2843173 - protein, 8 aa, Entamoeba invadens
DDPTGVGS

SEQ ID NO: 2843174 - protein, 9 aa, Entamoeba invadens
DDPVKVGVE

SEQ ID NO: 2843175 - protein, 6 aa, Entamoeba invadens
DDPVPN

SEQ ID NO: 2843176 - protein, 8 aa, Entamoeba invadens
DDPWMEED

SEQ ID NO: 2843177 - protein, 14 aa, Entamoeba invadens
DDQDMTGQIEDKPL

SEQ ID NO: 2843178 - protein, 13 aa, Entamoeba invadens
DDQDNKEKKYFAK

SEQ ID NO: 2843179 - protein, 15 aa, Entamoeba invadens
DDQEDCPRCSNPGIL

SEQ ID NO: 2843180 - protein, 8 aa, Entamoeba invadens
DDQKNQLR

SEQ ID NO: 2843181 - protein, 14 aa, Entamoeba invadens
DDQKTYGKDLPPEV

SEQ ID NO: 2843182 - protein, 10 aa, Entamoeba invadens
DDQLDDEDNI

SEQ ID NO: 2843183 - protein, 8 aa, Entamoeba invadens
DDQMNTKP

SEQ ID NO: 2843184 - protein, 10 aa, Entamoeba invadens
DDQNEVGTKE

SEQ ID NO: 2843185 - protein, 12 aa, Entamoeba invadens
DDQNHNTPTPTL

SEQ ID NO: 2843186 - protein, 22 aa, Entamoeba invadens
DDQPNREYDETGFEQGPPTEYK

SEQ ID NO: 2843187 - protein, 22 aa, Entamoeba invadens
DDQPTHSSFTAPQTPNTNAEQK

SEQ ID NO: 2843188 - protein, 8 aa, Entamoeba invadens
DDQQYDDQ

SEQ ID NO: 2843189 - protein, 8 aa, Entamoeba invadens
DDQSKMRK

SEQ ID NO: 2843190 - protein, 7 aa, Entamoeba invadens
DDQSTDV

SEQ ID NO: 2843191 - protein, 9 aa, Entamoeba invadens
DDQSVNKRE

SEQ ID NO: 2843192 - protein, 8 aa, Entamoeba invadens
DDQTGAQT

SEQ ID NO: 2843193 - protein, 7 aa, Entamoeba invadens
DDQTYNV

SEQ ID NO: 2843194 - protein, 7 aa, Entamoeba invadens
DDQYEKG

SEQ ID NO: 2843195 - protein, 5 aa, Entamoeba invadens
DDQYK

SEQ ID NO: 2843196 - protein, 4 aa, Entamoeba invadens
DDRA

SEQ ID NO: 2843197 - protein, 11 aa, Entamoeba invadens
DDRDKRERQLS

SEQ ID NO: 2843198 - protein, 4 aa, Entamoeba invadens
DDRN

SEQ ID NO: 2843199 - protein, 6 aa, Entamoeba invadens
DDRPSL

SEQ ID NO: 2843200 - protein, 22 aa, Entamoeba invadens
DDRSDRSESFEKVDRSDRYERL

SEQ ID NO: 2843201 - protein, 6 aa, Entamoeba invadens
DDRSSV

SEQ ID NO: 2843202 - protein, 7 aa, Entamoeba invadens
DDRSSVF

SEQ ID NO: 2843203 - protein, 15 aa, Entamoeba invadens
DDRSVCESGRVPSPL

SEQ ID NO: 2843204 - protein, 4 aa, Entamoeba invadens
DDRT

SEQ ID NO: 2843205 - protein, 19 aa, Entamoeba invadens
DDRTDQQVEQITNQDAAIE

SEQ ID NO: 2843206 - protein, 6 aa, Entamoeba invadens
DDRYDK

SEQ ID NO: 2843207 - protein, 16 aa, Entamoeba invadens
DDRYKAGSDSEQYENV

SEQ ID NO: 2843208 - protein, 11 aa, Entamoeba invadens
DDSCAKNYQPL

SEQ ID NO: 2843209 - protein, 4 aa, Entamoeba invadens
DDSD

SEQ ID NO: 2843210 - protein, 8 aa, Entamoeba invadens
DDSDDKPI

SEQ ID NO: 2843211 - protein, 8 aa, Entamoeba invadens
DDSDEDNI

SEQ ID NO: 2843212 - protein, 10 aa, Entamoeba invadens
DDSEAATQDT

SEQ ID NO: 2843213 - protein, 15 aa, Entamoeba invadens
DDSENSDIPVGKETR

SEQ ID NO: 2843214 - protein, 20 aa, Entamoeba invadens
DDSETKEKTPLKNSNSTNKI

SEQ ID NO: 2843215 - protein, 6 aa, Entamoeba invadens
DDSGDM

SEQ ID NO: 2843216 - protein, 8 aa, Entamoeba invadens
DDSGNSSW

SEQ ID NO: 2843217 - protein, 4 aa, Entamoeba invadens
DDSK

SEQ ID NO: 2843218 - protein, 15 aa, Entamoeba invadens
DDSKKKHGTSQNSES

SEQ ID NO: 2843219 - protein, 10 aa, Entamoeba invadens
DDSKPTEVLE

SEQ ID NO: 2843220 - protein, 14 aa, Entamoeba invadens
DDSKRDDNNNKRNL

SEQ ID NO: 2843221 - protein, 10 aa, Entamoeba invadens
DDSKTEIDRT

SEQ ID NO: 2843222 - protein, 6 aa, Entamoeba invadens
DDSKVP

SEQ ID NO: 2843223 - protein, 7 aa, Entamoeba invadens
DDSLDGI

SEQ ID NO: 2843224 - protein, 8 aa, Entamoeba invadens
DDSNLTKH

SEQ ID NO: 2843225 - protein, 12 aa, Entamoeba invadens
DDSNPKLQSQAT

SEQ ID NO: 2843226 - protein, 5 aa, Entamoeba invadens
DDSPL

SEQ ID NO: 2843227 - protein, 7 aa, Entamoeba invadens
DDSPSTD

SEQ ID NO: 2843228 - protein, 6 aa, Entamoeba invadens
DDSQST

SEQ ID NO: 2843229 - protein, 6 aa, Entamoeba invadens
DDSRGT

SEQ ID NO: 2843230 - protein, 12 aa, Entamoeba invadens
DDSRRDDRRRYD

SEQ ID NO: 2843231 - protein, 5 aa, Entamoeba invadens
DDSRT

SEQ ID NO: 2843232 - protein, 10 aa, Entamoeba invadens
DDSSEEKSLL

SEQ ID NO: 2843233 - protein, 8 aa, Entamoeba invadens
DDSSGKTS

SEQ ID NO: 2843234 - protein, 6 aa, Entamoeba invadens
DDSSIN

SEQ ID NO: 2843235 - protein, 9 aa, Entamoeba invadens
DDSSIPTSL

SEQ ID NO: 2843236 - protein, 7 aa, Entamoeba invadens
DDSSPIK

SEQ ID NO: 2843237 - protein, 46 aa, Entamoeba invadens
DDSSSASSTDDDSDKDDDNGNDTDSGDYTENGEVDKSEKCKNDGEL

SEQ ID NO: 2843238 - protein, 6 aa, Entamoeba invadens
DDSSTG

SEQ ID NO: 2843239 - protein, 7 aa, Entamoeba invadens
DDSSYRK

SEQ ID NO: 2843240 - protein, 8 aa, Entamoeba invadens
DDSTQKIN

SEQ ID NO: 2843241 - protein, 6 aa, Entamoeba invadens
DDSTSF

SEQ ID NO: 2843242 - protein, 18 aa, Entamoeba invadens
DDSTTSMQRDVNEGKISE

SEQ ID NO: 2843243 - protein, 7 aa, Entamoeba invadens
DDSVENN

SEQ ID NO: 2843244 - protein, 20 aa, Entamoeba invadens
DDSVKSDKDIEKLTADQTKK

SEQ ID NO: 2843245 - protein, 5 aa, Entamoeba invadens
DDSVQ

SEQ ID NO: 2843246 - protein, 8 aa, Entamoeba invadens
DDSYNENK

SEQ ID NO: 2843247 - protein, 7 aa, Entamoeba invadens
DDTANLN

SEQ ID NO: 2843248 - protein, 7 aa, Entamoeba invadens
DDTAPLA

SEQ ID NO: 2843249 - protein, 10 aa, Entamoeba invadens
DDTCADPESV

SEQ ID NO: 2843250 - protein, 8 aa, Entamoeba invadens
DDTCGNKC

SEQ ID NO: 2843251 - protein, 7 aa, Entamoeba invadens
DDTDKLN

SEQ ID NO: 2843252 - protein, 8 aa, Entamoeba invadens
DDTDSNKC

SEQ ID NO: 2843253 - protein, 19 aa, Entamoeba invadens
DDTESESDESEVVSDLSDS

SEQ ID NO: 2843254 - protein, 7 aa, Entamoeba invadens
DDTEYQR

SEQ ID NO: 2843255 - protein, 24 aa, Entamoeba invadens
DDTGDDTQPLIDENEKQKSEIERL

SEQ ID NO: 2843256 - protein, 5 aa, Entamoeba invadens
DDTHG

SEQ ID NO: 2843257 - protein, 6 aa, Entamoeba invadens
DDTITK

SEQ ID NO: 2843258 - protein, 13 aa, Entamoeba invadens
DDTKIHDDITKDA

SEQ ID NO: 2843259 - protein, 4 aa, Entamoeba invadens
DDTL

SEQ ID NO: 2843260 - protein, 6 aa, Entamoeba invadens
DDTLDA

SEQ ID NO: 2843261 - protein, 11 aa, Entamoeba invadens
DDTLEGNSDFT

SEQ ID NO: 2843262 - protein, 7 aa, Entamoeba invadens
DDTLNRP

SEQ ID NO: 2843263 - protein, 5 aa, Entamoeba invadens
DDTMR

SEQ ID NO: 2843264 - protein, 7 aa, Entamoeba invadens
DDTNEDF

SEQ ID NO: 2843265 - protein, 9 aa, Entamoeba invadens
DDTNISDTS

SEQ ID NO: 2843266 - protein, 13 aa, Entamoeba invadens
DDTNKNKSDGVSI

SEQ ID NO: 2843267 - protein, 11 aa, Entamoeba invadens
DDTPMDATTMT

SEQ ID NO: 2843268 - protein, 6 aa, Entamoeba invadens
DDTQKD

SEQ ID NO: 2843269 - protein, 7 aa, Entamoeba invadens
DDTRDQA

SEQ ID NO: 2843270 - protein, 5 aa, Entamoeba invadens
DDTRH

SEQ ID NO: 2843271 - protein, 11 aa, Entamoeba invadens
DDTRKENEESF

SEQ ID NO: 2843272 - protein, 6 aa, Entamoeba invadens
DDTSAQ

SEQ ID NO: 2843273 - protein, 12 aa, Entamoeba invadens
DDTSKLSENGKR

SEQ ID NO: 2843274 - protein, 8 aa, Entamoeba invadens
DDTSSQLY

SEQ ID NO: 2843275 - protein, 12 aa, Entamoeba invadens
DDTSVDSTPKIN

SEQ ID NO: 2843276 - protein, 13 aa, Entamoeba invadens
DDTTAERLPGRQK

SEQ ID NO: 2843277 - protein, 14 aa, Entamoeba invadens
DDTTAKSTFNPFSA

SEQ ID NO: 2843278 - protein, 7 aa, Entamoeba invadens
DDTTDIS

SEQ ID NO: 2843279 - protein, 14 aa, Entamoeba invadens
DDTVKRPDAKDKQE

SEQ ID NO: 2843280 - protein, 7 aa, Entamoeba invadens
DDTYDPL

SEQ ID NO: 2843281 - protein, 5 aa, Entamoeba invadens
DDVAN

SEQ ID NO: 2843282 - protein, 6 aa, Entamoeba invadens
DDVAPL

SEQ ID NO: 2843283 - protein, 27 aa, Entamoeba invadens
DDVAYSPNKNLYEEENKQYINHSSETS

SEQ ID NO: 2843284 - protein, 35 aa, Entamoeba invadens
DDVDGSAIADNNGNENQNESDEEKNDENKNKMEED

SEQ ID NO: 2843285 - protein, 5 aa, Entamoeba invadens
DDVDK

SEQ ID NO: 2843286 - protein, 6 aa, Entamoeba invadens
DDVDNI

SEQ ID NO: 2843287 - protein, 6 aa, Entamoeba invadens
DDVDSK

SEQ ID NO: 2843288 - protein, 4 aa, Entamoeba invadens
DDVE

SEQ ID NO: 2843289 - protein, 6 aa, Entamoeba invadens
DDVEDK

SEQ ID NO: 2843290 - protein, 7 aa, Entamoeba invadens
DDVEEDE

SEQ ID NO: 2843291 - protein, 10 aa, Entamoeba invadens
DDVEKGTSLA

SEQ ID NO: 2843292 - protein, 8 aa, Entamoeba invadens
DDVETPNI

SEQ ID NO: 2843293 - protein, 8 aa, Entamoeba invadens
DDVETQEQ

SEQ ID NO: 2843294 - protein, 5 aa, Entamoeba invadens
DDVIS

SEQ ID NO: 2843295 - protein, 16 aa, Entamoeba invadens
DDVKEQKVAPTNTPKK

SEQ ID NO: 2843296 - protein, 10 aa, Entamoeba invadens
DDVKGSKLTT

SEQ ID NO: 2843297 - protein, 31 aa, Entamoeba invadens
DDVKKTCDERNTFRHENDPELLTGGTKTQNT

SEQ ID NO: 2843298 - protein, 38 aa, Entamoeba invadens
DDVKNPANTPCQKADEDKEKEEQKWSYDRTNSCNDDDY

SEQ ID NO: 2843299 - protein, 14 aa, Entamoeba invadens
DDVKNYEKGQSEEF

SEQ ID NO: 2843300 - protein, 9 aa, Entamoeba invadens
DDVKTPNIA

SEQ ID NO: 2843301 - protein, 5 aa, Entamoeba invadens
DDVNK

SEQ ID NO: 2843302 - protein, 11 aa, Entamoeba invadens
DDVPEANYKDS

SEQ ID NO: 2843303 - protein, 11 aa, Entamoeba invadens
DDVPETNYKDS

SEQ ID NO: 2843304 - protein, 6 aa, Entamoeba invadens
DDVPNA

SEQ ID NO: 2843305 - protein, 8 aa, Entamoeba invadens
DDVQDDVE

SEQ ID NO: 2843306 - protein, 23 aa, Entamoeba invadens
DDVRPQRRAERKKNDEEGTTAKY

SEQ ID NO: 2843307 - protein, 5 aa, Entamoeba invadens
DDVSL

SEQ ID NO: 2843308 - protein, 5 aa, Entamoeba invadens
DDVTV

SEQ ID NO: 2843309 - protein, 6 aa, Entamoeba invadens
DDVVTE

SEQ ID NO: 2843310 - protein, 6 aa, Entamoeba invadens
DDWGKR

SEQ ID NO: 2843311 - protein, 7 aa, Entamoeba invadens
DDWGQDT

SEQ ID NO: 2843312 - protein, 6 aa, Entamoeba invadens
DDWGTS

SEQ ID NO: 2843313 - protein, 4 aa, Entamoeba invadens
DDWK

SEQ ID NO: 2843314 - protein, 9 aa, Entamoeba invadens
DDWKQNTSV

SEQ ID NO: 2843315 - protein, 10 aa, Entamoeba invadens
DDWSKNTSVF

SEQ ID NO: 2843316 - protein, 9 aa, Entamoeba invadens
DDWSNDTSV

SEQ ID NO: 2843317 - protein, 5 aa, Entamoeba invadens
DDWVT

SEQ ID NO: 2843318 - protein, 14 aa, Entamoeba invadens
DDYASLKRAKDEIS

SEQ ID NO: 2843319 - protein, 8 aa, Entamoeba invadens
DDYDETQN

SEQ ID NO: 2843320 - protein, 8 aa, Entamoeba invadens
DDYEERKD

SEQ ID NO: 2843321 - protein, 5 aa, Entamoeba invadens
DDYGK

SEQ ID NO: 2843322 - protein, 5 aa, Entamoeba invadens
DDYGM

SEQ ID NO: 2843323 - protein, 18 aa, Entamoeba invadens
DDYGQLGRSRSQKNDIPT

SEQ ID NO: 2843324 - protein, 7 aa, Entamoeba invadens
DDYKSNF

SEQ ID NO: 2843325 - protein, 20 aa, Entamoeba invadens
DDYPKDMRQSKDVTYRNEKT

SEQ ID NO: 2843326 - protein, 6 aa, Entamoeba invadens
DDYRDQ

SEQ ID NO: 2843327 - protein, 6 aa, Entamoeba invadens
DDYRGV

SEQ ID NO: 2843328 - protein, 16 aa, Entamoeba invadens
DDYSANPQRQESFPSI

SEQ ID NO: 2843329 - protein, 8 aa, Entamoeba invadens
DDYSTITT

SEQ ID NO: 2843330 - protein, 8 aa, Entamoeba invadens
DDYSTWGG

SEQ ID NO: 2843331 - protein, 7 aa, Entamoeba invadens
DDYTDDM

SEQ ID NO: 2843332 - protein, 7 aa, Entamoeba invadens
DDYTTAD

SEQ ID NO: 2843333 - protein, 11 aa, Entamoeba invadens
DEAAAQLESTV

SEQ ID NO: 2843334 - protein, 10 aa, Entamoeba invadens
DEAATKVSQV

SEQ ID NO: 2843335 - protein, 9 aa, Entamoeba invadens
DEADRRRKS

SEQ ID NO: 2843336 - protein, 6 aa, Entamoeba invadens
DEAEKA

SEQ ID NO: 2843337 - protein, 7 aa, Entamoeba invadens
DEAEKEY

SEQ ID NO: 2843338 - protein, 24 aa, Entamoeba invadens
DEAEPEPLEPPKTDEEEPPATPKM

SEQ ID NO: 2843339 - protein, 6 aa, Entamoeba invadens
DEAEYE

SEQ ID NO: 2843340 - protein, 5 aa, Entamoeba invadens
DEAGE

SEQ ID NO: 2843341 - protein, 12 aa, Entamoeba invadens
DEAIAKLDDKVD

SEQ ID NO: 2843342 - protein, 8 aa, Entamoeba invadens
DEAINGTY

SEQ ID NO: 2843343 - protein, 5 aa, Entamoeba invadens
DEAKN

SEQ ID NO: 2843344 - protein, 26 aa, Entamoeba invadens
DEAKRSGLSFKKEGLKELNNTHKKLE

SEQ ID NO: 2843345 - protein, 4 aa, Entamoeba invadens
DEAL

SEQ ID NO: 2843346 - protein, 13 aa, Entamoeba invadens
DEALKEDDKAALN

SEQ ID NO: 2843347 - protein, 7 aa, Entamoeba invadens
DEANDVK

SEQ ID NO: 2843348 - protein, 8 aa, Entamoeba invadens
DEANDVKD

SEQ ID NO: 2843349 - protein, 7 aa, Entamoeba invadens
DEANKKQ

SEQ ID NO: 2843350 - protein, 15 aa, Entamoeba invadens
DEANNTEEKLTKKAN

SEQ ID NO: 2843351 - protein, 18 aa, Entamoeba invadens
DEANNTKEKLTKKAKDLT

SEQ ID NO: 2843352 - protein, 18 aa, Entamoeba invadens
DEANNTKEKLTKKANDLS

SEQ ID NO: 2843353 - protein, 18 aa, Entamoeba invadens
DEANNTKEKLTKKANDLT

SEQ ID NO: 2843354 - protein, 26 aa, Entamoeba invadens
DEANNTKEKLTKKANDLTDLEEKDKM

SEQ ID NO: 2843355 - protein, 6 aa, Entamoeba invadens
DEANPN

SEQ ID NO: 2843356 - protein, 24 aa, Entamoeba invadens
DEAPEDPDSVKENKENIKKTMKDD

SEQ ID NO: 2843357 - protein, 12 aa, Entamoeba invadens
DEAPNEVKENFL

SEQ ID NO: 2843358 - protein, 5 aa, Entamoeba invadens
DEARD

SEQ ID NO: 2843359 - protein, 5 aa, Entamoeba invadens
DEARK

SEQ ID NO: 2843360 - protein, 9 aa, Entamoeba invadens
DEARPRSQS

SEQ ID NO: 2843361 - protein, 11 aa, Entamoeba invadens
DEARQRGATGN

SEQ ID NO: 2843362 - protein, 13 aa, Entamoeba invadens
DEASNEGAIAGEA

SEQ ID NO: 2843363 - protein, 11 aa, Entamoeba invadens
DEASQALEPET

SEQ ID NO: 2843364 - protein, 16 aa, Entamoeba invadens
DEASRQKYDIEHTNKK

SEQ ID NO: 2843365 - protein, 8 aa, Entamoeba invadens
DEASSVRQ

SEQ ID NO: 2843366 - protein, 9 aa, Entamoeba invadens
DEATLSHSS

SEQ ID NO: 2843367 - protein, 6 aa, Entamoeba invadens
DEATRQ

SEQ ID NO: 2843368 - protein, 7 aa, Entamoeba invadens
DEAVDAN

SEQ ID NO: 2843369 - protein, 5 aa, Entamoeba invadens
DEAVH

SEQ ID NO: 2843370 - protein, 5 aa, Entamoeba invadens
DEAVT

SEQ ID NO: 2843371 - protein, 9 aa, Entamoeba invadens
DEAYGRNQG

SEQ ID NO: 2843372 - protein, 9 aa, Entamoeba invadens
DECAATNDA

SEQ ID NO: 2843373 - protein, 4 aa, Entamoeba invadens
DECD

SEQ ID NO: 2843374 - protein, 6 aa, Entamoeba invadens
DECDRT

SEQ ID NO: 2843375 - protein, 6 aa, Entamoeba invadens
DECDTG

SEQ ID NO: 2843376 - protein, 10 aa, Entamoeba invadens
DECGTSYTSK

SEQ ID NO: 2843377 - protein, 8 aa, Entamoeba invadens
DECKRGDI

SEQ ID NO: 2843378 - protein, 7 aa, Entamoeba invadens
DECNQKN

SEQ ID NO: 2843379 - protein, 4 aa, Entamoeba invadens
DECQ

SEQ ID NO: 2843380 - protein, 11 aa, Entamoeba invadens
DEDAFKRAQED

SEQ ID NO: 2843381 - protein, 7 aa, Entamoeba invadens
DEDAQQS

SEQ ID NO: 2843382 - protein, 4 aa, Entamoeba invadens
DEDD

SEQ ID NO: 2843383 - protein, 31 aa, Entamoeba invadens
DEDDDIDETLEKKKKEKTYENGIPDSIGQPK

SEQ ID NO: 2843384 - protein, 6 aa, Entamoeba invadens
DEDDEI

SEQ ID NO: 2843385 - protein, 12 aa, Entamoeba invadens
DEDDFGKDGLDS

SEQ ID NO: 2843386 - protein, 9 aa, Entamoeba invadens
DEDDIDDVG

SEQ ID NO: 2843387 - protein, 7 aa, Entamoeba invadens
DEDDQVR

SEQ ID NO: 2843388 - protein, 8 aa, Entamoeba invadens
DEDDSVQS

SEQ ID NO: 2843389 - protein, 24 aa, Entamoeba invadens
DEDEKVEKKEDKIDNAEKEKSVIP

SEQ ID NO: 2843390 - protein, 7 aa, Entamoeba invadens
DEDEMTE

SEQ ID NO: 2843391 - protein, 9 aa, Entamoeba invadens
DEDERAETL

SEQ ID NO: 2843392 - protein, 6 aa, Entamoeba invadens
DEDERK

SEQ ID NO: 2843393 - protein, 9 aa, Entamoeba invadens
DEDERPDVG

SEQ ID NO: 2843394 - protein, 78 aa, Entamoeba invadens
DEDETETDTFEKKEKDKSEKVEKSETKEKQKNDAKKEKSKKRKTKKDEKKDEKEDEENEEPKNENEEAKKDEKKKERK

SEQ ID NO: 2843395 - protein, 7 aa, Entamoeba invadens
DEDETTQ

SEQ ID NO: 2843396 - protein, 11 aa, Entamoeba invadens
DEDEYRRNQKT

SEQ ID NO: 2843397 - protein, 14 aa, Entamoeba invadens
DEDFDDEEQDVDDE

SEQ ID NO: 2843398 - protein, 5 aa, Entamoeba invadens
DEDFG

SEQ ID NO: 2843399 - protein, 10 aa, Entamoeba invadens
DEDGEDDNQL

SEQ ID NO: 2843400 - protein, 14 aa, Entamoeba invadens
DEDGEEEDDDTDIK

SEQ ID NO: 2843401 - protein, 10 aa, Entamoeba invadens
DEDGKISKDE

SEQ ID NO: 2843402 - protein, 6 aa, Entamoeba invadens
DEDGTV

SEQ ID NO: 2843403 - protein, 10 aa, Entamoeba invadens
DEDHLKNDKI

SEQ ID NO: 2843404 - protein, 6 aa, Entamoeba invadens
DEDIEN

SEQ ID NO: 2843405 - protein, 20 aa, Entamoeba invadens
DEDKKFSEAREAEVEKTEEG

SEQ ID NO: 2843406 - protein, 7 aa, Entamoeba invadens
DEDKNEI

SEQ ID NO: 2843407 - protein, 5 aa, Entamoeba invadens
DEDLE

SEQ ID NO: 2843408 - protein, 8 aa, Entamoeba invadens
DEDLEEKT

SEQ ID NO: 2843409 - protein, 5 aa, Entamoeba invadens
DEDLK

SEQ ID NO: 2843410 - protein, 8 aa, Entamoeba invadens
DEDLNDAA

SEQ ID NO: 2843411 - protein, 8 aa, Entamoeba invadens
DEDNFTDD

SEQ ID NO: 2843412 - protein, 19 aa, Entamoeba invadens
DEDPNKCAECGQPLGPQRI

SEQ ID NO: 2843413 - protein, 10 aa, Entamoeba invadens
DEDPQKYADM

SEQ ID NO: 2843414 - protein, 8 aa, Entamoeba invadens
DEDQGSKY

SEQ ID NO: 2843415 - protein, 5 aa, Entamoeba invadens
DEDQT

SEQ ID NO: 2843416 - protein, 5 aa, Entamoeba invadens
DEDQY

SEQ ID NO: 2843417 - protein, 7 aa, Entamoeba invadens
DEDRIED

SEQ ID NO: 2843418 - protein, 17 aa, Entamoeba invadens
DEDSDGHVTMSEFVSFF

SEQ ID NO: 2843419 - protein, 17 aa, Entamoeba invadens
DEDSEDPLFGDESPKIN

SEQ ID NO: 2843420 - protein, 11 aa, Entamoeba invadens
DEDSGRKDGMS

SEQ ID NO: 2843421 - protein, 10 aa, Entamoeba invadens
DEDSNHLNGE

SEQ ID NO: 2843422 - protein, 8 aa, Entamoeba invadens
DEDTEDAY

SEQ ID NO: 2843423 - protein, 8 aa, Entamoeba invadens
DEDTESKT

SEQ ID NO: 2843424 - protein, 7 aa, Entamoeba invadens
DEDTGDT

SEQ ID NO: 2843425 - protein, 10 aa, Entamoeba invadens
DEDTKGVTTE

SEQ ID NO: 2843426 - protein, 6 aa, Entamoeba invadens
DEDTKK

SEQ ID NO: 2843427 - protein, 6 aa, Entamoeba invadens
DEDTKN

SEQ ID NO: 2843428 - protein, 17 aa, Entamoeba invadens
DEDVIEQGGVISIQKKT

SEQ ID NO: 2843429 - protein, 6 aa, Entamoeba invadens
DEDYRG

SEQ ID NO: 2843430 - protein, 11 aa, Entamoeba invadens
DEEALKDNDGI

SEQ ID NO: 2843431 - protein, 6 aa, Entamoeba invadens
DEEASE

SEQ ID NO: 2843432 - protein, 4 aa, Entamoeba invadens
DEEC

SEQ ID NO: 2843433 - protein, 4 aa, Entamoeba invadens
DEED

SEQ ID NO: 2843434 - protein, 30 aa, Entamoeba invadens
DEEDKDVERDKTTENKTDSNNLEDESVSGR

SEQ ID NO: 2843435 - protein, 10 aa, Entamoeba invadens
DEEDKNNHNT

SEQ ID NO: 2843436 - protein, 22 aa, Entamoeba invadens
DEEEEPKTREEKVEHESENQSV

SEQ ID NO: 2843437 - protein, 13 aa, Entamoeba invadens
DEEEEPLDREPTF

SEQ ID NO: 2843438 - protein, 18 aa, Entamoeba invadens
DEEEEVQSQIEEGFKSGQ

SEQ ID NO: 2843439 - protein, 5 aa, Entamoeba invadens
DEEEF

SEQ ID NO: 2843440 - protein, 8 aa, Entamoeba invadens
DEEEKDTV

SEQ ID NO: 2843441 - protein, 19 aa, Entamoeba invadens
DEEELSDDSESCENTETNY

SEQ ID NO: 2843442 - protein, 10 aa, Entamoeba invadens
DEEENEIDEE

SEQ ID NO: 2843443 - protein, 6 aa, Entamoeba invadens
DEEEQA

SEQ ID NO: 2843444 - protein, 8 aa, Entamoeba invadens
DEEERKEI

SEQ ID NO: 2843445 - protein, 27 aa, Entamoeba invadens
DEEESEDSASDEEANPENKEETEEEDY

SEQ ID NO: 2843446 - protein, 27 aa, Entamoeba invadens
DEEESEDSASDKEKIPENKEETEEEDY

SEQ ID NO: 2843447 - protein, 27 aa, Entamoeba invadens
DEEESEDSASDKEKNPENKEETEEEDY

SEQ ID NO: 2843448 - protein, 6 aa, Entamoeba invadens
DEEEYD

SEQ ID NO: 2843449 - protein, 20 aa, Entamoeba invadens
DEEEYNKKKQRVKKAEMPDE

SEQ ID NO: 2843450 - protein, 4 aa, Entamoeba invadens
DEEF

SEQ ID NO: 2843451 - protein, 15 aa, Entamoeba invadens
DEEFDARPEKEIAYS

SEQ ID NO: 2843452 - protein, 7 aa, Entamoeba invadens
DEEFDSQ

SEQ ID NO: 2843453 - protein, 19 aa, Entamoeba invadens
DEEFGTQNESQTEGQFGTN

SEQ ID NO: 2843454 - protein, 4 aa, Entamoeba invadens
DEEG

SEQ ID NO: 2843455 - protein, 6 aa, Entamoeba invadens
DEEGDV

SEQ ID NO: 2843456 - protein, 9 aa, Entamoeba invadens
DEEGKETVK

SEQ ID NO: 2843457 - protein, 16 aa, Entamoeba invadens
DEEGKKMKNTKNMKGQ

SEQ ID NO: 2843458 - protein, 12 aa, Entamoeba invadens
DEEGNKNTNQTK

SEQ ID NO: 2843459 - protein, 5 aa, Entamoeba invadens
DEEGY

SEQ ID NO: 2843460 - protein, 18 aa, Entamoeba invadens
DEEGYSKGGRIGCTQPRR

SEQ ID NO: 2843461 - protein, 6 aa, Entamoeba invadens
DEEHSK

SEQ ID NO: 2843462 - protein, 4 aa, Entamoeba invadens
DEEI

SEQ ID NO: 2843463 - protein, 6 aa, Entamoeba invadens
DEEIEE

SEQ ID NO: 2843464 - protein, 22 aa, Entamoeba invadens
DEEIERRVGNSKTEIAKKEKKG

SEQ ID NO: 2843465 - protein, 7 aa, Entamoeba invadens
DEEIGDK

SEQ ID NO: 2843466 - protein, 6 aa, Entamoeba invadens
DEEIGE

SEQ ID NO: 2843467 - protein, 7 aa, Entamoeba invadens
DEEIGES

SEQ ID NO: 2843468 - protein, 6 aa, Entamoeba invadens
DEEIKA

SEQ ID NO: 2843469 - protein, 11 aa, Entamoeba invadens
DEEIPDGDQRV

SEQ ID NO: 2843470 - protein, 15 aa, Entamoeba invadens
DEEIPKTEDSNESSQ

SEQ ID NO: 2843471 - protein, 7 aa, Entamoeba invadens
DEEITYE

SEQ ID NO: 2843472 - protein, 7 aa, Entamoeba invadens
DEEKAKL

SEQ ID NO: 2843473 - protein, 13 aa, Entamoeba invadens
DEEKDEANKTPHL

SEQ ID NO: 2843474 - protein, 12 aa, Entamoeba invadens
DEEKGKASKSQF

SEQ ID NO: 2843475 - protein, 9 aa, Entamoeba invadens
DEEKKAASV

SEQ ID NO: 2843476 - protein, 7 aa, Entamoeba invadens
DEEKKKQ

SEQ ID NO: 2843477 - protein, 10 aa, Entamoeba invadens
DEEKKNKISK

SEQ ID NO: 2843478 - protein, 12 aa, Entamoeba invadens
DEEKLEENRQQN

SEQ ID NO: 2843479 - protein, 13 aa, Entamoeba invadens
DEEKLEKNRQQNV

SEQ ID NO: 2843480 - protein, 19 aa, Entamoeba invadens
DEEKLKGEMSEKKKEFEEV

SEQ ID NO: 2843481 - protein, 6 aa, Entamoeba invadens
DEEKMK

SEQ ID NO: 2843482 - protein, 6 aa, Entamoeba invadens
DEEKMS

SEQ ID NO: 2843483 - protein, 6 aa, Entamoeba invadens
DEEKQE

SEQ ID NO: 2843484 - protein, 4 aa, Entamoeba invadens
DEEM

SEQ ID NO: 2843485 - protein, 46 aa, Entamoeba invadens
DEEMKKQEEEIRKQEEELARQEEENRKQEEAEEEELRRMEEELNSA

SEQ ID NO: 2843486 - protein, 17 aa, Entamoeba invadens
DEEMKSDSEEDNDEDLG

SEQ ID NO: 2843487 - protein, 8 aa, Entamoeba invadens
DEEMTPEE

SEQ ID NO: 2843488 - protein, 7 aa, Entamoeba invadens
DEENELS

SEQ ID NO: 2843489 - protein, 10 aa, Entamoeba invadens
DEENKRSTGM

SEQ ID NO: 2843490 - protein, 14 aa, Entamoeba invadens
DEENYTAETDQSIK

SEQ ID NO: 2843491 - protein, 11 aa, Entamoeba invadens
DEEPEETENWS

SEQ ID NO: 2843492 - protein, 8 aa, Entamoeba invadens
DEEPPLDY

SEQ ID NO: 2843493 - protein, 13 aa, Entamoeba invadens
DEEPYKRKSRKLA

SEQ ID NO: 2843494 - protein, 15 aa, Entamoeba invadens
DEEQEERMYGGFGDL

SEQ ID NO: 2843495 - protein, 24 aa, Entamoeba invadens
DEEQKEVKEKRNDTAKEEEAYIEP

SEQ ID NO: 2843496 - protein, 13 aa, Entamoeba invadens
DEEQKQKELEQQT

SEQ ID NO: 2843497 - protein, 6 aa, Entamoeba invadens
DEEQYD

SEQ ID NO: 2843498 - protein, 38 aa, Entamoeba invadens
DEERHREKVVDNKKDFREGYDPRNQQRDSRDQKRRDYR

SEQ ID NO: 2843499 - protein, 5 aa, Entamoeba invadens
DEERL

SEQ ID NO: 2843500 - protein, 4 aa, Entamoeba invadens
DEES

SEQ ID NO: 2843501 - protein, 5 aa, Entamoeba invadens
DEESA

SEQ ID NO: 2843502 - protein, 19 aa, Entamoeba invadens
DEESDAVSSPLQNPSPYAP

SEQ ID NO: 2843503 - protein, 12 aa, Entamoeba invadens
DEESDDKPPVVK

SEQ ID NO: 2843504 - protein, 8 aa, Entamoeba invadens
DEESEEDV

SEQ ID NO: 2843505 - protein, 5 aa, Entamoeba invadens
DEESI

SEQ ID NO: 2843506 - protein, 8 aa, Entamoeba invadens
DEESKNMW

SEQ ID NO: 2843507 - protein, 19 aa, Entamoeba invadens
DEESNKPISSNTNEDQNES

SEQ ID NO: 2843508 - protein, 9 aa, Entamoeba invadens
DEESSRSCG

SEQ ID NO: 2843509 - protein, 7 aa, Entamoeba invadens
DEETEQT

SEQ ID NO: 2843510 - protein, 5 aa, Entamoeba invadens
DEETI

SEQ ID NO: 2843511 - protein, 6 aa, Entamoeba invadens
DEETIK

SEQ ID NO: 2843512 - protein, 9 aa, Entamoeba invadens
DEETIPKEA

SEQ ID NO: 2843513 - protein, 18 aa, Entamoeba invadens
DEETKEFTKEEAQTVATN

SEQ ID NO: 2843514 - protein, 13 aa, Entamoeba invadens
DEETKKAKRLHSA

SEQ ID NO: 2843515 - protein, 33 aa, Entamoeba invadens
DEETNGNENENGNGNGNGNATSQKIPEFIRRKR

SEQ ID NO: 2843516 - protein, 33 aa, Entamoeba invadens
DEETNGNENGNENGNGNGNATSQKIPEFIRRKR

SEQ ID NO: 2843517 - protein, 9 aa, Entamoeba invadens
DEETPQPMI

SEQ ID NO: 2843518 - protein, 8 aa, Entamoeba invadens
DEETTKNV

SEQ ID NO: 2843519 - protein, 25 aa, Entamoeba invadens
DEETTRQIDEQMKKDEAEKAKPRVE

SEQ ID NO: 2843520 - protein, 5 aa, Entamoeba invadens
DEETY

SEQ ID NO: 2843521 - protein, 4 aa, Entamoeba invadens
DEEV

SEQ ID NO: 2843522 - protein, 7 aa, Entamoeba invadens
DEEVKNT

SEQ ID NO: 2843523 - protein, 8 aa, Entamoeba invadens
DEEVQTED

SEQ ID NO: 2843524 - protein, 9 aa, Entamoeba invadens
DEEVRKSVG

SEQ ID NO: 2843525 - protein, 26 aa, Entamoeba invadens
DEEWENQTHFKREKSAVAKKDDTFDP

SEQ ID NO: 2843526 - protein, 4 aa, Entamoeba invadens
DEEY

SEQ ID NO: 2843527 - protein, 9 aa, Entamoeba invadens
DEEYNESVR

SEQ ID NO: 2843528 - protein, 10 aa, Entamoeba invadens
DEEYRKAENE

SEQ ID NO: 2843529 - protein, 5 aa, Entamoeba invadens
DEFDT

SEQ ID NO: 2843530 - protein, 4 aa, Entamoeba invadens
DEFE

SEQ ID NO: 2843531 - protein, 6 aa, Entamoeba invadens
DEFPTD

SEQ ID NO: 2843532 - protein, 7 aa, Entamoeba invadens
DEFRPGD

SEQ ID NO: 2843533 - protein, 4 aa, Entamoeba invadens
DEFS

SEQ ID NO: 2843534 - protein, 7 aa, Entamoeba invadens
DEFSEKK

SEQ ID NO: 2843535 - protein, 6 aa, Entamoeba invadens
DEFTHK

SEQ ID NO: 2843536 - protein, 12 aa, Entamoeba invadens
DEFTNKDGSKGA

SEQ ID NO: 2843537 - protein, 8 aa, Entamoeba invadens
DEGCPSSR

SEQ ID NO: 2843538 - protein, 14 aa, Entamoeba invadens
DEGIQQTDSVVSTS

SEQ ID NO: 2843539 - protein, 4 aa, Entamoeba invadens
DEGK

SEQ ID NO: 2843540 - protein, 6 aa, Entamoeba invadens
DEGKEF

SEQ ID NO: 2843541 - protein, 8 aa, Entamoeba invadens
DEGKEKTL

SEQ ID NO: 2843542 - protein, 4 aa, Entamoeba invadens
DEGL

SEQ ID NO: 2843543 - protein, 8 aa, Entamoeba invadens
DEGLEKDE

SEQ ID NO: 2843544 - protein, 9 aa, Entamoeba invadens
DEGLRERAG

SEQ ID NO: 2843545 - protein, 8 aa, Entamoeba invadens
DEGMKDEQ

SEQ ID NO: 2843546 - protein, 4 aa, Entamoeba invadens
DEGN

SEQ ID NO: 2843547 - protein, 14 aa, Entamoeba invadens
DEGNPDKTEKGDVN

SEQ ID NO: 2843548 - protein, 5 aa, Entamoeba invadens
DEGNY

SEQ ID NO: 2843549 - protein, 6 aa, Entamoeba invadens
DEGQCE

SEQ ID NO: 2843550 - protein, 6 aa, Entamoeba invadens
DEGQEW

SEQ ID NO: 2843551 - protein, 4 aa, Entamoeba invadens
DEGR

SEQ ID NO: 2843552 - protein, 5 aa, Entamoeba invadens
DEGRV

SEQ ID NO: 2843553 - protein, 27 aa, Entamoeba invadens
DEGRVCSDSDNEKKDKKDKKDRKKVFD

SEQ ID NO: 2843554 - protein, 9 aa, Entamoeba invadens
DEGSGDKRP

SEQ ID NO: 2843555 - protein, 6 aa, Entamoeba invadens
DEGSIN

SEQ ID NO: 2843556 - protein, 16 aa, Entamoeba invadens
DEGSIPIPDNAQITNK

SEQ ID NO: 2843557 - protein, 6 aa, Entamoeba invadens
DEGSNG

SEQ ID NO: 2843558 - protein, 8 aa, Entamoeba invadens
DEGSTAND

SEQ ID NO: 2843559 - protein, 4 aa, Entamoeba invadens
DEGT

SEQ ID NO: 2843560 - protein, 24 aa, Entamoeba invadens
DEGTTPRTTSTPRVIPEASPNLDE

SEQ ID NO: 2843561 - protein, 13 aa, Entamoeba invadens
DEGTVDEQAFREN

SEQ ID NO: 2843562 - protein, 5 aa, Entamoeba invadens
DEGYL

SEQ ID NO: 2843563 - protein, 6 aa, Entamoeba invadens
DEHGED

SEQ ID NO: 2843564 - protein, 16 aa, Entamoeba invadens
DEHGMSAHSTGNQEKT

SEQ ID NO: 2843565 - protein, 14 aa, Entamoeba invadens
DEHKKPTGVTPEQG

SEQ ID NO: 2843566 - protein, 5 aa, Entamoeba invadens
DEHME

SEQ ID NO: 2843567 - protein, 17 aa, Entamoeba invadens
DEHNNTDKQDQKDGDII

SEQ ID NO: 2843568 - protein, 9 aa, Entamoeba invadens
DEHTTLSNE

SEQ ID NO: 2843569 - protein, 9 aa, Entamoeba invadens
DEHYKQEEQ

SEQ ID NO: 2843570 - protein, 4 aa, Entamoeba invadens
DEIA

SEQ ID NO: 2843571 - protein, 4 aa, Entamoeba invadens
DEID

SEQ ID NO: 2843572 - protein, 5 aa, Entamoeba invadens
DEIDE

SEQ ID NO: 2843573 - protein, 6 aa, Entamoeba invadens
DEIDEE

SEQ ID NO: 2843574 - protein, 20 aa, Entamoeba invadens
DEIDEKANTNINNNKTNNYT

SEQ ID NO: 2843575 - protein, 34 aa, Entamoeba invadens
DEIDNPERTSTSEEKIDNDINDKTDGKNTSNEQE

SEQ ID NO: 2843576 - protein, 7 aa, Entamoeba invadens
DEIDPKE

SEQ ID NO: 2843577 - protein, 15 aa, Entamoeba invadens
DEIDQTKEKPTELTQ

SEQ ID NO: 2843578 - protein, 7 aa, Entamoeba invadens
DEIDSRN

SEQ ID NO: 2843579 - protein, 4 aa, Entamoeba invadens
DEIE

SEQ ID NO: 2843580 - protein, 6 aa, Entamoeba invadens
DEIEET

SEQ ID NO: 2843581 - protein, 5 aa, Entamoeba invadens
DEIEK

SEQ ID NO: 2843582 - protein, 8 aa, Entamoeba invadens
DEIEKRQK

SEQ ID NO: 2843583 - protein, 27 aa, Entamoeba invadens
DEIGAAKSVDKYKTLDPSLSSERDYKT

SEQ ID NO: 2843584 - protein, 4 aa, Entamoeba invadens
DEIH

SEQ ID NO: 2843585 - protein, 4 aa, Entamoeba invadens
DEII

SEQ ID NO: 2843586 - protein, 5 aa, Entamoeba invadens
DEIIP

SEQ ID NO: 2843587 - protein, 6 aa, Entamoeba invadens
DEIKGI

SEQ ID NO: 2843588 - protein, 59 aa, Entamoeba invadens
DEIKHKNGQPVSNKEIPEQREEKVVEQKEKTEDAPKEEKIENQPVAEENDGFEDDTTQS

SEQ ID NO: 2843589 - protein, 13 aa, Entamoeba invadens
DEIKKDVKELERS

SEQ ID NO: 2843590 - protein, 14 aa, Entamoeba invadens
DEIKKEESEDVKDE

SEQ ID NO: 2843591 - protein, 5 aa, Entamoeba invadens
DEIKR

SEQ ID NO: 2843592 - protein, 10 aa, Entamoeba invadens
DEINEDTASY

SEQ ID NO: 2843593 - protein, 11 aa, Entamoeba invadens
DEINGDDVKPK

SEQ ID NO: 2843594 - protein, 13 aa, Entamoeba invadens
DEINKDKKVGEGS

SEQ ID NO: 2843595 - protein, 31 aa, Entamoeba invadens
DEINRSAVSTPFQTPLQTPKQPESSEQLTPN

SEQ ID NO: 2843596 - protein, 4 aa, Entamoeba invadens
DEIP

SEQ ID NO: 2843597 - protein, 7 aa, Entamoeba invadens
DEIPTSH

SEQ ID NO: 2843598 - protein, 4 aa, Entamoeba invadens
DEIQ

SEQ ID NO: 2843599 - protein, 12 aa, Entamoeba invadens
DEIQGTLSEQTA

SEQ ID NO: 2843600 - protein, 6 aa, Entamoeba invadens
DEIRET

SEQ ID NO: 2843601 - protein, 17 aa, Entamoeba invadens
DEIRETTLDAKKSSLEH

SEQ ID NO: 2843602 - protein, 5 aa, Entamoeba invadens
DEISG

SEQ ID NO: 2843603 - protein, 6 aa, Entamoeba invadens
DEISKE

SEQ ID NO: 2843604 - protein, 8 aa, Entamoeba invadens
DEISQEDV

SEQ ID NO: 2843605 - protein, 13 aa, Entamoeba invadens
DEISRETSNTNNN

SEQ ID NO: 2843606 - protein, 7 aa, Entamoeba invadens
DEITEDD

SEQ ID NO: 2843607 - protein, 12 aa, Entamoeba invadens
DEITEDSIRAGW

SEQ ID NO: 2843608 - protein, 7 aa, Entamoeba invadens
DEITLNR

SEQ ID NO: 2843609 - protein, 48 aa, Entamoeba invadens
DEITNNTSNETTITPQIETPRLNDTKEEIKEETKQQNTKQNESELTED

SEQ ID NO: 2843610 - protein, 15 aa, Entamoeba invadens
DEITVGTKKVERSTH

SEQ ID NO: 2843611 - protein, 14 aa, Entamoeba invadens
DEKADADDEEEGIT

SEQ ID NO: 2843612 - protein, 12 aa, Entamoeba invadens
DEKAGISGYPPQ

SEQ ID NO: 2843613 - protein, 4 aa, Entamoeba invadens
DEKC

SEQ ID NO: 2843614 - protein, 12 aa, Entamoeba invadens
DEKCRNDAKEME

SEQ ID NO: 2843615 - protein, 8 aa, Entamoeba invadens
DEKDLGPS

SEQ ID NO: 2843616 - protein, 21 aa, Entamoeba invadens
DEKEADEDKQQEKTTKKALLD

SEQ ID NO: 2843617 - protein, 6 aa, Entamoeba invadens
DEKEAQ

SEQ ID NO: 2843618 - protein, 6 aa, Entamoeba invadens
DEKEEF

SEQ ID NO: 2843619 - protein, 6 aa, Entamoeba invadens
DEKEHQ

SEQ ID NO: 2843620 - protein, 7 aa, Entamoeba invadens
DEKELSK

SEQ ID NO: 2843621 - protein, 6 aa, Entamoeba invadens
DEKEMD

SEQ ID NO: 2843622 - protein, 29 aa, Entamoeba invadens
DEKENEENSESDSEDSHSDADKSGSESEL

SEQ ID NO: 2843623 - protein, 24 aa, Entamoeba invadens
DEKENGNTSGSVLSRENRSSLTQR

SEQ ID NO: 2843624 - protein, 8 aa, Entamoeba invadens
DEKEREVE

SEQ ID NO: 2843625 - protein, 7 aa, Entamoeba invadens
DEKERIG

SEQ ID NO: 2843626 - protein, 8 aa, Entamoeba invadens
DEKETGAY

SEQ ID NO: 2843627 - protein, 10 aa, Entamoeba invadens
DEKETKNSDI

SEQ ID NO: 2843628 - protein, 4 aa, Entamoeba invadens
DEKF

SEQ ID NO: 2843629 - protein, 14 aa, Entamoeba invadens
DEKFEDYKSYKPKR

SEQ ID NO: 2843630 - protein, 8 aa, Entamoeba invadens
DEKGAAYS

SEQ ID NO: 2843631 - protein, 7 aa, Entamoeba invadens
DEKIDTV

SEQ ID NO: 2843632 - protein, 6 aa, Entamoeba invadens
DEKIEK

SEQ ID NO: 2843633 - protein, 46 aa, Entamoeba invadens
DEKIEKVENKKDANESQLTQEFKEQERSKGSKDSQDIAEKKNYKKK

SEQ ID NO: 2843634 - protein, 8 aa, Entamoeba invadens
DEKIHTKK

SEQ ID NO: 2843635 - protein, 6 aa, Entamoeba invadens
DEKIKT

SEQ ID NO: 2843636 - protein, 14 aa, Entamoeba invadens
DEKIPKQQEEKFPP

SEQ ID NO: 2843637 - protein, 32 aa, Entamoeba invadens
DEKKDGEKEKEDTDDEKDNEEEVNDEDDGADE

SEQ ID NO: 2843638 - protein, 10 aa, Entamoeba invadens
DEKKEKEFKE

SEQ ID NO: 2843639 - protein, 10 aa, Entamoeba invadens
DEKKKEDKKA

SEQ ID NO: 2843640 - protein, 6 aa, Entamoeba invadens
DEKKKK

SEQ ID NO: 2843641 - protein, 12 aa, Entamoeba invadens
DEKKKNDNDLEE

SEQ ID NO: 2843642 - protein, 8 aa, Entamoeba invadens
DEKKKSNK

SEQ ID NO: 2843643 - protein, 15 aa, Entamoeba invadens
DEKKKYMPMRKGGVA

SEQ ID NO: 2843644 - protein, 15 aa, Entamoeba invadens
DEKKPQPNEQKEEIR

SEQ ID NO: 2843645 - protein, 18 aa, Entamoeba invadens
DEKKQESVEETFNLFVNL

SEQ ID NO: 2843646 - protein, 18 aa, Entamoeba invadens
DEKKSKSVGSTKVSQNEF

SEQ ID NO: 2843647 - protein, 7 aa, Entamoeba invadens
DEKKTKS

SEQ ID NO: 2843648 - protein, 9 aa, Entamoeba invadens
DEKLGEGSF

SEQ ID NO: 2843649 - protein, 15 aa, Entamoeba invadens
DEKLQQKLPAKVDKI

SEQ ID NO: 2843650 - protein, 7 aa, Entamoeba invadens
DEKMGDK

SEQ ID NO: 2843651 - protein, 20 aa, Entamoeba invadens
DEKMKEGKKRQKKEKVTKEV

SEQ ID NO: 2843652 - protein, 11 aa, Entamoeba invadens
DEKMKSDKKKA

SEQ ID NO: 2843653 - protein, 10 aa, Entamoeba invadens
DEKMSEVTGV

SEQ ID NO: 2843654 - protein, 14 aa, Entamoeba invadens
DEKMSKGSYSSSYE

SEQ ID NO: 2843655 - protein, 4 aa, Entamoeba invadens
DEKN

SEQ ID NO: 2843656 - protein, 5 aa, Entamoeba invadens
DEKNC

SEQ ID NO: 2843657 - protein, 17 aa, Entamoeba invadens
DEKNLNEEKKMSGDNNN

SEQ ID NO: 2843658 - protein, 10 aa, Entamoeba invadens
DEKNNRNSDF

SEQ ID NO: 2843659 - protein, 22 aa, Entamoeba invadens
DEKNNTSSRTNNNMNPQNNNKM

SEQ ID NO: 2843660 - protein, 8 aa, Entamoeba invadens
DEKNPVRS

SEQ ID NO: 2843661 - protein, 10 aa, Entamoeba invadens
DEKNTNNKEI

SEQ ID NO: 2843662 - protein, 16 aa, Entamoeba invadens
DEKNVGDGDDKDPLIE

SEQ ID NO: 2843663 - protein, 5 aa, Entamoeba invadens
DEKPF

SEQ ID NO: 2843664 - protein, 6 aa, Entamoeba invadens
DEKPIN

SEQ ID NO: 2843665 - protein, 8 aa, Entamoeba invadens
DEKPKFKQ

SEQ ID NO: 2843666 - protein, 43 aa, Entamoeba invadens
DEKQNEEKNENIESDKCQNGEPKKEPPPIPKRRDSAHESQTPF

SEQ ID NO: 2843667 - protein, 4 aa, Entamoeba invadens
DEKR

SEQ ID NO: 2843668 - protein, 7 aa, Entamoeba invadens
DEKREEV

SEQ ID NO: 2843669 - protein, 31 aa, Entamoeba invadens
DEKRQEVANKSLEAYTEATKISDAELPPTHP

SEQ ID NO: 2843670 - protein, 6 aa, Entamoeba invadens
DEKRTD

SEQ ID NO: 2843671 - protein, 31 aa, Entamoeba invadens
DEKRTEVANKSLAAYTEATEISNAELPPTHP

SEQ ID NO: 2843672 - protein, 18 aa, Entamoeba invadens
DEKSANLALKNENGKKWD

SEQ ID NO: 2843673 - protein, 9 aa, Entamoeba invadens
DEKSGKTSL

SEQ ID NO: 2843674 - protein, 7 aa, Entamoeba invadens
DEKSKVT

SEQ ID NO: 2843675 - protein, 5 aa, Entamoeba invadens
DEKSL

SEQ ID NO: 2843676 - protein, 6 aa, Entamoeba invadens
DEKSLT

SEQ ID NO: 2843677 - protein, 9 aa, Entamoeba invadens
DEKSVSDKQ

SEQ ID NO: 2843678 - protein, 8 aa, Entamoeba invadens
DEKTDQVT

SEQ ID NO: 2843679 - protein, 5 aa, Entamoeba invadens
DEKTE

SEQ ID NO: 2843680 - protein, 6 aa, Entamoeba invadens
DEKTEL

SEQ ID NO: 2843681 - protein, 6 aa, Entamoeba invadens
DEKTEV

SEQ ID NO: 2843682 - protein, 8 aa, Entamoeba invadens
DEKTGKTS

SEQ ID NO: 2843683 - protein, 9 aa, Entamoeba invadens
DEKTGKTSL

SEQ ID NO: 2843684 - protein, 20 aa, Entamoeba invadens
DEKTNKSKDLKEALQKEVSG

SEQ ID NO: 2843685 - protein, 9 aa, Entamoeba invadens
DEKTPNQIT

SEQ ID NO: 2843686 - protein, 9 aa, Entamoeba invadens
DEKTPPTRL

SEQ ID NO: 2843687 - protein, 13 aa, Entamoeba invadens
DEKTPRRRLKDEK

SEQ ID NO: 2843688 - protein, 8 aa, Entamoeba invadens
DEKTYAGD

SEQ ID NO: 2843689 - protein, 6 aa, Entamoeba invadens
DEKVLA

SEQ ID NO: 2843690 - protein, 14 aa, Entamoeba invadens
DEKVTQSEKLETKL

SEQ ID NO: 2843691 - protein, 4 aa, Entamoeba invadens
DEKY

SEQ ID NO: 2843692 - protein, 5 aa, Entamoeba invadens
DEKYD

SEQ ID NO: 2843693 - protein, 5 aa, Entamoeba invadens
DEKYE

SEQ ID NO: 2843694 - protein, 10 aa, Entamoeba invadens
DEKYENGEIN

SEQ ID NO: 2843695 - protein, 13 aa, Entamoeba invadens
DEKYGKYNGRRPP

SEQ ID NO: 2843696 - protein, 5 aa, Entamoeba invadens
DEKYN

SEQ ID NO: 2843697 - protein, 13 aa, Entamoeba invadens
DEKYQTDSHETFQ

SEQ ID NO: 2843698 - protein, 7 aa, Entamoeba invadens
DEKYTQE

SEQ ID NO: 2843699 - protein, 5 aa, Entamoeba invadens
DELAE

SEQ ID NO: 2843700 - protein, 8 aa, Entamoeba invadens
DELAESEK

SEQ ID NO: 2843701 - protein, 6 aa, Entamoeba invadens
DELATA

SEQ ID NO: 2843702 - protein, 27 aa, Entamoeba invadens
DELDSYSSENNNLDEKLRRSEKSIVEK

SEQ ID NO: 2843703 - protein, 10 aa, Entamoeba invadens
DELEDSKQQC

SEQ ID NO: 2843704 - protein, 19 aa, Entamoeba invadens
DELERRKEKSGDFEYEKDD

SEQ ID NO: 2843705 - protein, 11 aa, Entamoeba invadens
DELGKKMKPLE

SEQ ID NO: 2843706 - protein, 8 aa, Entamoeba invadens
DELGSEDQ

SEQ ID NO: 2843707 - protein, 5 aa, Entamoeba invadens
DELKG

SEQ ID NO: 2843708 - protein, 17 aa, Entamoeba invadens
DELKKQSTELTQNDEKV

SEQ ID NO: 2843709 - protein, 6 aa, Entamoeba invadens
DELNDA

SEQ ID NO: 2843710 - protein, 7 aa, Entamoeba invadens
DELNPDE

SEQ ID NO: 2843711 - protein, 6 aa, Entamoeba invadens
DELNPK

SEQ ID NO: 2843712 - protein, 4 aa, Entamoeba invadens
DELP

SEQ ID NO: 2843713 - protein, 5 aa, Entamoeba invadens
DELPA

SEQ ID NO: 2843714 - protein, 6 aa, Entamoeba invadens
DELPSL

SEQ ID NO: 2843715 - protein, 4 aa, Entamoeba invadens
DELQ

SEQ ID NO: 2843716 - protein, 11 aa, Entamoeba invadens
DELRKRKDDLT

SEQ ID NO: 2843717 - protein, 9 aa, Entamoeba invadens
DELSARSFN

SEQ ID NO: 2843718 - protein, 5 aa, Entamoeba invadens
DELSD

SEQ ID NO: 2843719 - protein, 13 aa, Entamoeba invadens
DELSEDKKLGEGS

SEQ ID NO: 2843720 - protein, 10 aa, Entamoeba invadens
DELSKLKTET

SEQ ID NO: 2843721 - protein, 17 aa, Entamoeba invadens
DELSSRNFNSKVYGKSD

SEQ ID NO: 2843722 - protein, 4 aa, Entamoeba invadens
DELT

SEQ ID NO: 2843723 - protein, 13 aa, Entamoeba invadens
DELTETQKTLEKK

SEQ ID NO: 2843724 - protein, 25 aa, Entamoeba invadens
DELTPPPNTEKLPYHEEDAKALSPE

SEQ ID NO: 2843725 - protein, 5 aa, Entamoeba invadens
DEMDE

SEQ ID NO: 2843726 - protein, 6 aa, Entamoeba invadens
DEMEKE

SEQ ID NO: 2843727 - protein, 6 aa, Entamoeba invadens
DEMERN

SEQ ID NO: 2843728 - protein, 11 aa, Entamoeba invadens
DEMETQPFANR

SEQ ID NO: 2843729 - protein, 11 aa, Entamoeba invadens
DEMGTQPFTDR

SEQ ID NO: 2843730 - protein, 4 aa, Entamoeba invadens
DEMK

SEQ ID NO: 2843731 - protein, 5 aa, Entamoeba invadens
DEMNY

SEQ ID NO: 2843732 - protein, 6 aa, Entamoeba invadens
DEMPTS

SEQ ID NO: 2843733 - protein, 6 aa, Entamoeba invadens
DEMPYD

SEQ ID NO: 2843734 - protein, 16 aa, Entamoeba invadens
DEMQNETSDKAEKENE

SEQ ID NO: 2843735 - protein, 24 aa, Entamoeba invadens
DEMREEDYDGQNEPEDTNGQIPKK

SEQ ID NO: 2843736 - protein, 7 aa, Entamoeba invadens
DEMSESL

SEQ ID NO: 2843737 - protein, 8 aa, Entamoeba invadens
DEMSKGNK

SEQ ID NO: 2843738 - protein, 4 aa, Entamoeba invadens
DEMW

SEQ ID NO: 2843739 - protein, 7 aa, Entamoeba invadens
DENAECL

SEQ ID NO: 2843740 - protein, 6 aa, Entamoeba invadens
DENAKL

SEQ ID NO: 2843741 - protein, 13 aa, Entamoeba invadens
DENDDASENHSDF

SEQ ID NO: 2843742 - protein, 8 aa, Entamoeba invadens
DENDEPFS

SEQ ID NO: 2843743 - protein, 11 aa, Entamoeba invadens
DENDEPFSRDA

SEQ ID NO: 2843744 - protein, 7 aa, Entamoeba invadens
DENDESL

SEQ ID NO: 2843745 - protein, 7 aa, Entamoeba invadens
DENDETA

SEQ ID NO: 2843746 - protein, 7 aa, Entamoeba invadens
DENDGSD

SEQ ID NO: 2843747 - protein, 9 aa, Entamoeba invadens
DENDLEKKI

SEQ ID NO: 2843748 - protein, 5 aa, Entamoeba invadens
DENDN

SEQ ID NO: 2843749 - protein, 10 aa, Entamoeba invadens
DENDRQNVTI

SEQ ID NO: 2843750 - protein, 6 aa, Entamoeba invadens
DENDSN

SEQ ID NO: 2843751 - protein, 6 aa, Entamoeba invadens
DENDSV

SEQ ID NO: 2843752 - protein, 10 aa, Entamoeba invadens
DENDSVIDGT

SEQ ID NO: 2843753 - protein, 17 aa, Entamoeba invadens
DENEAAEMSKAHNVDKI

SEQ ID NO: 2843754 - protein, 13 aa, Entamoeba invadens
DENEERMEDSQSF

SEQ ID NO: 2843755 - protein, 8 aa, Entamoeba invadens
DENEIAAY

SEQ ID NO: 2843756 - protein, 10 aa, Entamoeba invadens
DENEKVNKQK

SEQ ID NO: 2843757 - protein, 5 aa, Entamoeba invadens
DENEL

SEQ ID NO: 2843758 - protein, 5 aa, Entamoeba invadens
DENEQ

SEQ ID NO: 2843759 - protein, 13 aa, Entamoeba invadens
DENERVNEMQQKN

SEQ ID NO: 2843760 - protein, 8 aa, Entamoeba invadens
DENETATY

SEQ ID NO: 2843761 - protein, 10 aa, Entamoeba invadens
DENFETAKSA

SEQ ID NO: 2843762 - protein, 6 aa, Entamoeba invadens
DENFGN

SEQ ID NO: 2843763 - protein, 9 aa, Entamoeba invadens
DENGENKYI

SEQ ID NO: 2843764 - protein, 7 aa, Entamoeba invadens
DENGFGT

SEQ ID NO: 2843765 - protein, 8 aa, Entamoeba invadens
DENGKKTV

SEQ ID NO: 2843766 - protein, 9 aa, Entamoeba invadens
DENGKLRDT

SEQ ID NO: 2843767 - protein, 8 aa, Entamoeba invadens
DENGQARI

SEQ ID NO: 2843768 - protein, 22 aa, Entamoeba invadens
DENGSSPSTFDSTLPNKQSELE

SEQ ID NO: 2843769 - protein, 7 aa, Entamoeba invadens
DENGTDV

SEQ ID NO: 2843770 - protein, 10 aa, Entamoeba invadens
DENGTEAAAA

SEQ ID NO: 2843771 - protein, 9 aa, Entamoeba invadens
DENGVEDED

SEQ ID NO: 2843772 - protein, 5 aa, Entamoeba invadens
DENGW

SEQ ID NO: 2843773 - protein, 9 aa, Entamoeba invadens
DENISDTSV

SEQ ID NO: 2843774 - protein, 40 aa, Entamoeba invadens
DENKEIAKEDKQGEEKKEVMKGEGLNNNTENKQKTPENKY

SEQ ID NO: 2843775 - protein, 12 aa, Entamoeba invadens
DENKEKHNKSQI

SEQ ID NO: 2843776 - protein, 10 aa, Entamoeba invadens
DENKKNKRII

SEQ ID NO: 2843777 - protein, 4 aa, Entamoeba invadens
DENL

SEQ ID NO: 2843778 - protein, 5 aa, Entamoeba invadens
DENMA

SEQ ID NO: 2843779 - protein, 4 aa, Entamoeba invadens
DENN

SEQ ID NO: 2843780 - protein, 5 aa, Entamoeba invadens
DENNE

SEQ ID NO: 2843781 - protein, 7 aa, Entamoeba invadens
DENNEIG

SEQ ID NO: 2843782 - protein, 5 aa, Entamoeba invadens
DENNF

SEQ ID NO: 2843783 - protein, 5 aa, Entamoeba invadens
DENNI

SEQ ID NO: 2843784 - protein, 8 aa, Entamoeba invadens
DENNIKSN

SEQ ID NO: 2843785 - protein, 9 aa, Entamoeba invadens
DENNMKTTQ

SEQ ID NO: 2843786 - protein, 9 aa, Entamoeba invadens
DENNPNCRK

SEQ ID NO: 2843787 - protein, 7 aa, Entamoeba invadens
DENNPRI

SEQ ID NO: 2843788 - protein, 6 aa, Entamoeba invadens
DENNRK

SEQ ID NO: 2843789 - protein, 7 aa, Entamoeba invadens
DENNSNY

SEQ ID NO: 2843790 - protein, 11 aa, Entamoeba invadens
DENQEDEEVER

SEQ ID NO: 2843791 - protein, 6 aa, Entamoeba invadens
DENQTG

SEQ ID NO: 2843792 - protein, 8 aa, Entamoeba invadens
DENRFEQV

SEQ ID NO: 2843793 - protein, 7 aa, Entamoeba invadens
DENSEKT

SEQ ID NO: 2843794 - protein, 8 aa, Entamoeba invadens
DENSGKTR

SEQ ID NO: 2843795 - protein, 5 aa, Entamoeba invadens
DENSL

SEQ ID NO: 2843796 - protein, 4 aa, Entamoeba invadens
DENT

SEQ ID NO: 2843797 - protein, 6 aa, Entamoeba invadens
DENTFG

SEQ ID NO: 2843798 - protein, 10 aa, Entamoeba invadens
DENTNSSKVT

SEQ ID NO: 2843799 - protein, 17 aa, Entamoeba invadens
DENTQKDKQNEDINRTV

SEQ ID NO: 2843800 - protein, 11 aa, Entamoeba invadens
DENTSVDTFDQ

SEQ ID NO: 2843801 - protein, 8 aa, Entamoeba invadens
DENTYELQ

SEQ ID NO: 2843802 - protein, 4 aa, Entamoeba invadens
DENV

SEQ ID NO: 2843803 - protein, 8 aa, Entamoeba invadens
DENVEESQ

SEQ ID NO: 2843804 - protein, 11 aa, Entamoeba invadens
DENVNETYKTY

SEQ ID NO: 2843805 - protein, 4 aa, Entamoeba invadens
DENY

SEQ ID NO: 2843806 - protein, 14 aa, Entamoeba invadens
DENYDENDADIEKM

SEQ ID NO: 2843807 - protein, 7 aa, Entamoeba invadens
DENYEDD

SEQ ID NO: 2843808 - protein, 14 aa, Entamoeba invadens
DENYTFDGSNESIA

SEQ ID NO: 2843809 - protein, 6 aa, Entamoeba invadens
DEPAPL

SEQ ID NO: 2843810 - protein, 5 aa, Entamoeba invadens
DEPCE

SEQ ID NO: 2843811 - protein, 4 aa, Entamoeba invadens
DEPD

SEQ ID NO: 2843812 - protein, 5 aa, Entamoeba invadens
DEPFD

SEQ ID NO: 2843813 - protein, 13 aa, Entamoeba invadens
DEPKCTKDDQEDL

SEQ ID NO: 2843814 - protein, 17 aa, Entamoeba invadens
DEPKLDDSEEVRHDKEI

SEQ ID NO: 2843815 - protein, 6 aa, Entamoeba invadens
DEPKQQ

SEQ ID NO: 2843816 - protein, 4 aa, Entamoeba invadens
DEPL

SEQ ID NO: 2843817 - protein, 5 aa, Entamoeba invadens
DEPLH

SEQ ID NO: 2843818 - protein, 36 aa, Entamoeba invadens
DEPNLPDDISHDTKPTKVKKEEKVEKIEKSFKTPQL

SEQ ID NO: 2843819 - protein, 5 aa, Entamoeba invadens
DEPNP

SEQ ID NO: 2843820 - protein, 9 aa, Entamoeba invadens
DEPQNEVHK

SEQ ID NO: 2843821 - protein, 36 aa, Entamoeba invadens
DEPSEKLKRSATERIDKTERMKRQTTTAAFDETKPR

SEQ ID NO: 2843822 - protein, 9 aa, Entamoeba invadens
DEPSPTTTI

SEQ ID NO: 2843823 - protein, 8 aa, Entamoeba invadens
DEPSVKQR

SEQ ID NO: 2843824 - protein, 21 aa, Entamoeba invadens
DEPTESHVPKTKKIPIGANPL

SEQ ID NO: 2843825 - protein, 6 aa, Entamoeba invadens
DEPTKL

SEQ ID NO: 2843826 - protein, 12 aa, Entamoeba invadens
DEPTKPSSQFYS

SEQ ID NO: 2843827 - protein, 23 aa, Entamoeba invadens
DEPTREKEESDEIESDPDDWSKK

SEQ ID NO: 2843828 - protein, 10 aa, Entamoeba invadens
DEPTSKSLGE

SEQ ID NO: 2843829 - protein, 33 aa, Entamoeba invadens
DEQAKNIAKKPVDPELTQEEKIKRQQESEQRAL

SEQ ID NO: 2843830 - protein, 12 aa, Entamoeba invadens
DEQALERKRHVG

SEQ ID NO: 2843831 - protein, 4 aa, Entamoeba invadens
DEQC

SEQ ID NO: 2843832 - protein, 5 aa, Entamoeba invadens
DEQDA

SEQ ID NO: 2843833 - protein, 11 aa, Entamoeba invadens
DEQDGGKGHVG

SEQ ID NO: 2843834 - protein, 7 aa, Entamoeba invadens
DEQDSSF

SEQ ID NO: 2843835 - protein, 4 aa, Entamoeba invadens
DEQE

SEQ ID NO: 2843836 - protein, 17 aa, Entamoeba invadens
DEQESDDESTTDDLSEE

SEQ ID NO: 2843837 - protein, 8 aa, Entamoeba invadens
DEQGLNKE

SEQ ID NO: 2843838 - protein, 23 aa, Entamoeba invadens
DEQHSSGKINSQKVEKSEHHEMN

SEQ ID NO: 2843839 - protein, 6 aa, Entamoeba invadens
DEQIQK

SEQ ID NO: 2843840 - protein, 5 aa, Entamoeba invadens
DEQIT

SEQ ID NO: 2843841 - protein, 24 aa, Entamoeba invadens
DEQKAEKNYEEYKAKYDGKFQSDV

SEQ ID NO: 2843842 - protein, 8 aa, Entamoeba invadens
DEQKAKSH

SEQ ID NO: 2843843 - protein, 7 aa, Entamoeba invadens
DEQKDGF

SEQ ID NO: 2843844 - protein, 10 aa, Entamoeba invadens
DEQKDSSVDW

SEQ ID NO: 2843845 - protein, 28 aa, Entamoeba invadens
DEQKKELKKIKEGDDMKPRISTTQENCK

SEQ ID NO: 2843846 - protein, 20 aa, Entamoeba invadens
DEQKKRLQKIKDEKKPRTNI

SEQ ID NO: 2843847 - protein, 22 aa, Entamoeba invadens
DEQKKRYKKIKDEKKPRTSITQ

SEQ ID NO: 2843848 - protein, 5 aa, Entamoeba invadens
DEQLE

SEQ ID NO: 2843849 - protein, 13 aa, Entamoeba invadens
DEQLRSVSPKRKI

SEQ ID NO: 2843850 - protein, 4 aa, Entamoeba invadens
DEQM

SEQ ID NO: 2843851 - protein, 6 aa, Entamoeba invadens
DEQNRA

SEQ ID NO: 2843852 - protein, 4 aa, Entamoeba invadens
DEQP

SEQ ID NO: 2843853 - protein, 6 aa, Entamoeba invadens
DEQPNS

SEQ ID NO: 2843854 - protein, 18 aa, Entamoeba invadens
DEQRRSRSRQSARSPQRR

SEQ ID NO: 2843855 - protein, 11 aa, Entamoeba invadens
DEQSELPKSTI

SEQ ID NO: 2843856 - protein, 7 aa, Entamoeba invadens
DEQSSEI

SEQ ID NO: 2843857 - protein, 19 aa, Entamoeba invadens
DEQVKKDEKMISEATKTSH

SEQ ID NO: 2843858 - protein, 4 aa, Entamoeba invadens
DEQY

SEQ ID NO: 2843859 - protein, 6 aa, Entamoeba invadens
DERAPA

SEQ ID NO: 2843860 - protein, 8 aa, Entamoeba invadens
DERARKQY

SEQ ID NO: 2843861 - protein, 8 aa, Entamoeba invadens
DERATARD

SEQ ID NO: 2843862 - protein, 4 aa, Entamoeba invadens
DERD

SEQ ID NO: 2843863 - protein, 15 aa, Entamoeba invadens
DERDGREDDFSGAGG

SEQ ID NO: 2843864 - protein, 6 aa, Entamoeba invadens
DEREKE

SEQ ID NO: 2843865 - protein, 15 aa, Entamoeba invadens
DERIDTTRMKQQSYK

SEQ ID NO: 2843866 - protein, 14 aa, Entamoeba invadens
DERISKGNFEKGDK

SEQ ID NO: 2843867 - protein, 4 aa, Entamoeba invadens
DERK

SEQ ID NO: 2843868 - protein, 7 aa, Entamoeba invadens
DERKEFA

SEQ ID NO: 2843869 - protein, 15 aa, Entamoeba invadens
DERKGCGNKIPQNVR

SEQ ID NO: 2843870 - protein, 10 aa, Entamoeba invadens
DERKPERGGR

SEQ ID NO: 2843871 - protein, 6 aa, Entamoeba invadens
DERKRY

SEQ ID NO: 2843872 - protein, 4 aa, Entamoeba invadens
DERL

SEQ ID NO: 2843873 - protein, 21 aa, Entamoeba invadens
DERLKTEKSKTVLSAAKKTQK

SEQ ID NO: 2843874 - protein, 5 aa, Entamoeba invadens
DERLQ

SEQ ID NO: 2843875 - protein, 4 aa, Entamoeba invadens
DERM

SEQ ID NO: 2843876 - protein, 5 aa, Entamoeba invadens
DERME

SEQ ID NO: 2843877 - protein, 14 aa, Entamoeba invadens
DERNSIDQASYQNT

SEQ ID NO: 2843878 - protein, 8 aa, Entamoeba invadens
DERQKGNI

SEQ ID NO: 2843879 - protein, 20 aa, Entamoeba invadens
DERRGNSRRPQPNDRIEELL

SEQ ID NO: 2843880 - protein, 8 aa, Entamoeba invadens
DERRLPGQ

SEQ ID NO: 2843881 - protein, 10 aa, Entamoeba invadens
DERSEDTISR

SEQ ID NO: 2843882 - protein, 8 aa, Entamoeba invadens
DERSKTHD

SEQ ID NO: 2843883 - protein, 7 aa, Entamoeba invadens
DERTSKM

SEQ ID NO: 2843884 - protein, 5 aa, Entamoeba invadens
DERYN

SEQ ID NO: 2843885 - protein, 7 aa, Entamoeba invadens
DERYNAY

SEQ ID NO: 2843886 - protein, 5 aa, Entamoeba invadens
DERYQ

SEQ ID NO: 2843887 - protein, 11 aa, Entamoeba invadens
DESAPSDGNSQ

SEQ ID NO: 2843888 - protein, 8 aa, Entamoeba invadens
DESATKIA

SEQ ID NO: 2843889 - protein, 18 aa, Entamoeba invadens
DESDDEFPQDSNTDCSNC

SEQ ID NO: 2843890 - protein, 7 aa, Entamoeba invadens
DESDNEL

SEQ ID NO: 2843891 - protein, 12 aa, Entamoeba invadens
DESDPVKAASAG

SEQ ID NO: 2843892 - protein, 8 aa, Entamoeba invadens
DESDTEKM

SEQ ID NO: 2843893 - protein, 11 aa, Entamoeba invadens
DESEKKAMKEE

SEQ ID NO: 2843894 - protein, 6 aa, Entamoeba invadens
DESELD

SEQ ID NO: 2843895 - protein, 6 aa, Entamoeba invadens
DESELK

SEQ ID NO: 2843896 - protein, 5 aa, Entamoeba invadens
DESEN

SEQ ID NO: 2843897 - protein, 8 aa, Entamoeba invadens
DESEQGTA

SEQ ID NO: 2843898 - protein, 25 aa, Entamoeba invadens
DESFDRRGRRVGRSSSREVGERSNS

SEQ ID NO: 2843899 - protein, 12 aa, Entamoeba invadens
DESFQVSALFKC

SEQ ID NO: 2843900 - protein, 7 aa, Entamoeba invadens
DESGGLK

SEQ ID NO: 2843901 - protein, 23 aa, Entamoeba invadens
DESGGRKRLAGTQFGETERRRYD

SEQ ID NO: 2843902 - protein, 9 aa, Entamoeba invadens
DESGKAEGV

SEQ ID NO: 2843903 - protein, 12 aa, Entamoeba invadens
DESGKTETLDGG

SEQ ID NO: 2843904 - protein, 7 aa, Entamoeba invadens
DESGNVN

SEQ ID NO: 2843905 - protein, 11 aa, Entamoeba invadens
DESGQQLKRGT

SEQ ID NO: 2843906 - protein, 6 aa, Entamoeba invadens
DESGTI

SEQ ID NO: 2843907 - protein, 6 aa, Entamoeba invadens
DESGVI

SEQ ID NO: 2843908 - protein, 8 aa, Entamoeba invadens
DESGYNEK

SEQ ID NO: 2843909 - protein, 4 aa, Entamoeba invadens
DESH

SEQ ID NO: 2843910 - protein, 74 aa, Entamoeba invadens
DESHERSKPSKKKGVKRTTAPATTKAKKVDSNDSESSSEQSSSDDECKTLSHSTSEQSEQSSEEKSEAVDSEIT

SEQ ID NO: 2843911 - protein, 8 aa, Entamoeba invadens
DESIEAAE

SEQ ID NO: 2843912 - protein, 5 aa, Entamoeba invadens
DESIR

SEQ ID NO: 2843913 - protein, 4 aa, Entamoeba invadens
DESK

SEQ ID NO: 2843914 - protein, 8 aa, Entamoeba invadens
DESKKDDL

SEQ ID NO: 2843915 - protein, 8 aa, Entamoeba invadens
DESKKSQF

SEQ ID NO: 2843916 - protein, 8 aa, Entamoeba invadens
DESKKYKK

SEQ ID NO: 2843917 - protein, 4 aa, Entamoeba invadens
DESL

SEQ ID NO: 2843918 - protein, 7 aa, Entamoeba invadens
DESMKEQ

SEQ ID NO: 2843919 - protein, 9 aa, Entamoeba invadens
DESNHTNLQ

SEQ ID NO: 2843920 - protein, 8 aa, Entamoeba invadens
DESNKVIK

SEQ ID NO: 2843921 - protein, 4 aa, Entamoeba invadens
DESP

SEQ ID NO: 2843922 - protein, 7 aa, Entamoeba invadens
DESPSEF

SEQ ID NO: 2843923 - protein, 8 aa, Entamoeba invadens
DESQCEEG

SEQ ID NO: 2843924 - protein, 9 aa, Entamoeba invadens
DESQTKECS

SEQ ID NO: 2843925 - protein, 18 aa, Entamoeba invadens
DESSEESQQFDSEDMKEF

SEQ ID NO: 2843926 - protein, 33 aa, Entamoeba invadens
DESSIKNLSEVEDDEIEGKYSPYDNCALVIWPK

SEQ ID NO: 2843927 - protein, 7 aa, Entamoeba invadens
DESSLNA

SEQ ID NO: 2843928 - protein, 13 aa, Entamoeba invadens
DESSYNKDAIGIT

SEQ ID NO: 2843929 - protein, 11 aa, Entamoeba invadens
DESTGVKGQTI

SEQ ID NO: 2843930 - protein, 15 aa, Entamoeba invadens
DESTLEREEMADEPD

SEQ ID NO: 2843931 - protein, 11 aa, Entamoeba invadens
DESTLQSLDTT

SEQ ID NO: 2843932 - protein, 5 aa, Entamoeba invadens
DESTP

SEQ ID NO: 2843933 - protein, 8 aa, Entamoeba invadens
DESTSTSK

SEQ ID NO: 2843934 - protein, 6 aa, Entamoeba invadens
DESVED

SEQ ID NO: 2843935 - protein, 16 aa, Entamoeba invadens
DESVEGKQKGKELCED

SEQ ID NO: 2843936 - protein, 8 aa, Entamoeba invadens
DESVMSGD

SEQ ID NO: 2843937 - protein, 6 aa, Entamoeba invadens
DESYDK

SEQ ID NO: 2843938 - protein, 4 aa, Entamoeba invadens
DETA

SEQ ID NO: 2843939 - protein, 9 aa, Entamoeba invadens
DETAINGDT

SEQ ID NO: 2843940 - protein, 10 aa, Entamoeba invadens
DETDESAEFK

SEQ ID NO: 2843941 - protein, 4 aa, Entamoeba invadens
DETE

SEQ ID NO: 2843942 - protein, 6 aa, Entamoeba invadens
DETEDV

SEQ ID NO: 2843943 - protein, 10 aa, Entamoeba invadens
DETENAGFTH

SEQ ID NO: 2843944 - protein, 15 aa, Entamoeba invadens
DETGELDDKDYYGNK

SEQ ID NO: 2843945 - protein, 4 aa, Entamoeba invadens
DETI

SEQ ID NO: 2843946 - protein, 6 aa, Entamoeba invadens
DETIGR

SEQ ID NO: 2843947 - protein, 5 aa, Entamoeba invadens
DETIK

SEQ ID NO: 2843948 - protein, 7 aa, Entamoeba invadens
DETISSL

SEQ ID NO: 2843949 - protein, 10 aa, Entamoeba invadens
DETKARGNYN

SEQ ID NO: 2843950 - protein, 7 aa, Entamoeba invadens
DETKEKR

SEQ ID NO: 2843951 - protein, 9 aa, Entamoeba invadens
DETKKMSSD

SEQ ID NO: 2843952 - protein, 11 aa, Entamoeba invadens
DETKNVPKSED

SEQ ID NO: 2843953 - protein, 5 aa, Entamoeba invadens
DETKV

SEQ ID NO: 2843954 - protein, 6 aa, Entamoeba invadens
DETLDG

SEQ ID NO: 2843955 - protein, 5 aa, Entamoeba invadens
DETLH

SEQ ID NO: 2843956 - protein, 15 aa, Entamoeba invadens
DETLKKKVNSKEFNP

SEQ ID NO: 2843957 - protein, 6 aa, Entamoeba invadens
DETLSE

SEQ ID NO: 2843958 - protein, 6 aa, Entamoeba invadens
DETMNV

SEQ ID NO: 2843959 - protein, 9 aa, Entamoeba invadens
DETNDTTRF

SEQ ID NO: 2843960 - protein, 7 aa, Entamoeba invadens
DETNKFK

SEQ ID NO: 2843961 - protein, 7 aa, Entamoeba invadens
DETNKTT

SEQ ID NO: 2843962 - protein, 35 aa, Entamoeba invadens
DETNSEQAESPSSNFSELSPEDDSERLPIFENLSH

SEQ ID NO: 2843963 - protein, 5 aa, Entamoeba invadens
DETNT

SEQ ID NO: 2843964 - protein, 7 aa, Entamoeba invadens
DETPNEI

SEQ ID NO: 2843965 - protein, 12 aa, Entamoeba invadens
DETQDTTKIDPG

SEQ ID NO: 2843966 - protein, 38 aa, Entamoeba invadens
DETQIPQTPQTIPTDPTADAPKALLEETESKENAARKV

SEQ ID NO: 2843967 - protein, 10 aa, Entamoeba invadens
DETQPHTEEK

SEQ ID NO: 2843968 - protein, 6 aa, Entamoeba invadens
DETQSD

SEQ ID NO: 2843969 - protein, 6 aa, Entamoeba invadens
DETSFR

SEQ ID NO: 2843970 - protein, 18 aa, Entamoeba invadens
DETSGELTFSESGNFSLS

SEQ ID NO: 2843971 - protein, 8 aa, Entamoeba invadens
DETSGKTQ

SEQ ID NO: 2843972 - protein, 7 aa, Entamoeba invadens
DETSKTH

SEQ ID NO: 2843973 - protein, 9 aa, Entamoeba invadens
DETSPSVIA

SEQ ID NO: 2843974 - protein, 7 aa, Entamoeba invadens
DETSQDT

SEQ ID NO: 2843975 - protein, 11 aa, Entamoeba invadens
DETTEGEEIEV

SEQ ID NO: 2843976 - protein, 9 aa, Entamoeba invadens
DETTEKLAK

SEQ ID NO: 2843977 - protein, 7 aa, Entamoeba invadens
DETTKLE

SEQ ID NO: 2843978 - protein, 5 aa, Entamoeba invadens
DETTN

SEQ ID NO: 2843979 - protein, 7 aa, Entamoeba invadens
DETTPSW

SEQ ID NO: 2843980 - protein, 5 aa, Entamoeba invadens
DETVK

SEQ ID NO: 2843981 - protein, 6 aa, Entamoeba invadens
DETVKE

SEQ ID NO: 2843982 - protein, 8 aa, Entamoeba invadens
DETVTDPD

SEQ ID NO: 2843983 - protein, 7 aa, Entamoeba invadens
DETYQQV

SEQ ID NO: 2843984 - protein, 5 aa, Entamoeba invadens
DETYS

SEQ ID NO: 2843985 - protein, 16 aa, Entamoeba invadens
DEVAEKEEDVKADSLS

SEQ ID NO: 2843986 - protein, 7 aa, Entamoeba invadens
DEVAQRS

SEQ ID NO: 2843987 - protein, 8 aa, Entamoeba invadens
DEVDNSVR

SEQ ID NO: 2843988 - protein, 4 aa, Entamoeba invadens
DEVG

SEQ ID NO: 2843989 - protein, 6 aa, Entamoeba invadens
DEVGAS

SEQ ID NO: 2843990 - protein, 19 aa, Entamoeba invadens
DEVGDDDNQGFNTFYNEQN

SEQ ID NO: 2843991 - protein, 7 aa, Entamoeba invadens
DEVKDTA

SEQ ID NO: 2843992 - protein, 14 aa, Entamoeba invadens
DEVKEAKVRGINLS

SEQ ID NO: 2843993 - protein, 10 aa, Entamoeba invadens
DEVKNDPKKW

SEQ ID NO: 2843994 - protein, 25 aa, Entamoeba invadens
DEVKSQEDAKNKKREQLQKKIETAG

SEQ ID NO: 2843995 - protein, 16 aa, Entamoeba invadens
DEVNGKLTDFGASRNI

SEQ ID NO: 2843996 - protein, 11 aa, Entamoeba invadens
DEVPEETYKDS

SEQ ID NO: 2843997 - protein, 6 aa, Entamoeba invadens
DEVPKS

SEQ ID NO: 2843998 - protein, 4 aa, Entamoeba invadens
DEVR

SEQ ID NO: 2843999 - protein, 5 aa, Entamoeba invadens
DEVRS

SEQ ID NO: 2844000 - protein, 6 aa, Entamoeba invadens
DEVTGN

SEQ ID NO: 2844001 - protein, 8 aa, Entamoeba invadens
DEVTKKNA

SEQ ID NO: 2844002 - protein, 7 aa, Entamoeba invadens
DEWNTDP

SEQ ID NO: 2844003 - protein, 6 aa, Entamoeba invadens
DEWTSA

SEQ ID NO: 2844004 - protein, 10 aa, Entamoeba invadens
DEYEGKEAHK

SEQ ID NO: 2844005 - protein, 7 aa, Entamoeba invadens
DEYGKGI

SEQ ID NO: 2844006 - protein, 11 aa, Entamoeba invadens
DEYIEGSEMES

SEQ ID NO: 2844007 - protein, 8 aa, Entamoeba invadens
DEYIKDNE

SEQ ID NO: 2844008 - protein, 9 aa, Entamoeba invadens
DEYIPGKDY

SEQ ID NO: 2844009 - protein, 4 aa, Entamoeba invadens
DEYK

SEQ ID NO: 2844010 - protein, 9 aa, Entamoeba invadens
DEYKDRKNI

SEQ ID NO: 2844011 - protein, 11 aa, Entamoeba invadens
DEYKPTKNTNY

SEQ ID NO: 2844012 - protein, 6 aa, Entamoeba invadens
DEYKVE

SEQ ID NO: 2844013 - protein, 22 aa, Entamoeba invadens
DEYNEQQVVQDTTEVQEKEMPP

SEQ ID NO: 2844014 - protein, 19 aa, Entamoeba invadens
DEYNHERKKENEDVGMSAS

SEQ ID NO: 2844015 - protein, 4 aa, Entamoeba invadens
DEYP

SEQ ID NO: 2844016 - protein, 6 aa, Entamoeba invadens
DEYPAI

SEQ ID NO: 2844017 - protein, 9 aa, Entamoeba invadens
DEYPQKPPV

SEQ ID NO: 2844018 - protein, 19 aa, Entamoeba invadens
DEYQKMKQNRPVEKTPNID

SEQ ID NO: 2844019 - protein, 5 aa, Entamoeba invadens
DEYQR

SEQ ID NO: 2844020 - protein, 6 aa, Entamoeba invadens
DEYQRY

SEQ ID NO: 2844021 - protein, 16 aa, Entamoeba invadens
DEYSDGDNSESSEEEV

SEQ ID NO: 2844022 - protein, 10 aa, Entamoeba invadens
DEYSPGSKFD

SEQ ID NO: 2844023 - protein, 23 aa, Entamoeba invadens
DEYTNHVQGGLKTPSFHAKDDEN

SEQ ID NO: 2844024 - protein, 9 aa, Entamoeba invadens
DFAENPEYK

SEQ ID NO: 2844025 - protein, 5 aa, Entamoeba invadens
DFATN

SEQ ID NO: 2844026 - protein, 12 aa, Entamoeba invadens
DFDADKVNAELE

SEQ ID NO: 2844027 - protein, 9 aa, Entamoeba invadens
DFDDTETLK

SEQ ID NO: 2844028 - protein, 25 aa, Entamoeba invadens
DFDDYNANKFEDYDQENDDSGAASD

SEQ ID NO: 2844029 - protein, 5 aa, Entamoeba invadens
DFDEK

SEQ ID NO: 2844030 - protein, 6 aa, Entamoeba invadens
DFDERS

SEQ ID NO: 2844031 - protein, 14 aa, Entamoeba invadens
DFDETLKNSSRTSI

SEQ ID NO: 2844032 - protein, 6 aa, Entamoeba invadens
DFDGDE

SEQ ID NO: 2844033 - protein, 6 aa, Entamoeba invadens
DFDGIE

SEQ ID NO: 2844034 - protein, 8 aa, Entamoeba invadens
DFDKKKGV

SEQ ID NO: 2844035 - protein, 9 aa, Entamoeba invadens
DFDKPSQSY

SEQ ID NO: 2844036 - protein, 8 aa, Entamoeba invadens
DFDNRKKP

SEQ ID NO: 2844037 - protein, 15 aa, Entamoeba invadens
DFDNSGELFCNLYES

SEQ ID NO: 2844038 - protein, 7 aa, Entamoeba invadens
DFDPTDG

SEQ ID NO: 2844039 - protein, 26 aa, Entamoeba invadens
DFDSAPSAAVSENKDVKKDNTSSQNF

SEQ ID NO: 2844040 - protein, 5 aa, Entamoeba invadens
DFDSK

SEQ ID NO: 2844041 - protein, 7 aa, Entamoeba invadens
DFEAKDE

SEQ ID NO: 2844042 - protein, 18 aa, Entamoeba invadens
DFEDDETYEDINKNRKTV

SEQ ID NO: 2844043 - protein, 7 aa, Entamoeba invadens
DFEDGDQ

SEQ ID NO: 2844044 - protein, 29 aa, Entamoeba invadens
DFEDKQEEKKKRSRRRRNKERNLFKEYDD

SEQ ID NO: 2844045 - protein, 4 aa, Entamoeba invadens
DFEE

SEQ ID NO: 2844046 - protein, 9 aa, Entamoeba invadens
DFEEGRDGI

SEQ ID NO: 2844047 - protein, 17 aa, Entamoeba invadens
DFEEKKKMKDTPKGESL

SEQ ID NO: 2844048 - protein, 7 aa, Entamoeba invadens
DFEEKTL

SEQ ID NO: 2844049 - protein, 7 aa, Entamoeba invadens
DFEGKED

SEQ ID NO: 2844050 - protein, 16 aa, Entamoeba invadens
DFEISKGRCSKCETEN

SEQ ID NO: 2844051 - protein, 18 aa, Entamoeba invadens
DFEKAKKIEEKVKSTLTT

SEQ ID NO: 2844052 - protein, 5 aa, Entamoeba invadens
DFEKK

SEQ ID NO: 2844053 - protein, 6 aa, Entamoeba invadens
DFEKQK

SEQ ID NO: 2844054 - protein, 8 aa, Entamoeba invadens
DFEKSEDS

SEQ ID NO: 2844055 - protein, 4 aa, Entamoeba invadens
DFEN

SEQ ID NO: 2844056 - protein, 16 aa, Entamoeba invadens
DFENTENDEIDGTNIK

SEQ ID NO: 2844057 - protein, 10 aa, Entamoeba invadens
DFERAKEERE

SEQ ID NO: 2844058 - protein, 7 aa, Entamoeba invadens
DFERPQN

SEQ ID NO: 2844059 - protein, 11 aa, Entamoeba invadens
DFESGKRFSNI

SEQ ID NO: 2844060 - protein, 21 aa, Entamoeba invadens
DFESSQSALLSTSSPLKDNNT

SEQ ID NO: 2844061 - protein, 4 aa, Entamoeba invadens
DFET

SEQ ID NO: 2844062 - protein, 7 aa, Entamoeba invadens
DFETAPK

SEQ ID NO: 2844063 - protein, 5 aa, Entamoeba invadens
DFGAS

SEQ ID NO: 2844064 - protein, 4 aa, Entamoeba invadens
DFGE

SEQ ID NO: 2844065 - protein, 7 aa, Entamoeba invadens
DFGEDDI

SEQ ID NO: 2844066 - protein, 7 aa, Entamoeba invadens
DFGETPD

SEQ ID NO: 2844067 - protein, 4 aa, Entamoeba invadens
DFGG

SEQ ID NO: 2844068 - protein, 15 aa, Entamoeba invadens
DFGGSPKKSPQLVDP

SEQ ID NO: 2844069 - protein, 10 aa, Entamoeba invadens
DFGKKDDSIG

SEQ ID NO: 2844070 - protein, 14 aa, Entamoeba invadens
DFGKSGDALPTSEV

SEQ ID NO: 2844071 - protein, 6 aa, Entamoeba invadens
DFGNDS

SEQ ID NO: 2844072 - protein, 36 aa, Entamoeba invadens
DFGPNTPTSLSGTLKDKSATKQSVTPLTKKTTAVEI

SEQ ID NO: 2844073 - protein, 5 aa, Entamoeba invadens
DFGSA

SEQ ID NO: 2844074 - protein, 9 aa, Entamoeba invadens
DFGSARNTN

SEQ ID NO: 2844075 - protein, 17 aa, Entamoeba invadens
DFGSEGELKSDSKYTTL

SEQ ID NO: 2844076 - protein, 5 aa, Entamoeba invadens
DFGSG

SEQ ID NO: 2844077 - protein, 6 aa, Entamoeba invadens
DFGSSR

SEQ ID NO: 2844078 - protein, 8 aa, Entamoeba invadens
DFGSSRNL

SEQ ID NO: 2844079 - protein, 9 aa, Entamoeba invadens
DFGTAKRSN

SEQ ID NO: 2844080 - protein, 8 aa, Entamoeba invadens
DFKDEKEA

SEQ ID NO: 2844081 - protein, 9 aa, Entamoeba invadens
DFKEEDKRG

SEQ ID NO: 2844082 - protein, 13 aa, Entamoeba invadens
DFKESEPKLESGE

SEQ ID NO: 2844083 - protein, 12 aa, Entamoeba invadens
DFKGDDVPTGGH

SEQ ID NO: 2844084 - protein, 6 aa, Entamoeba invadens
DFKGEA

SEQ ID NO: 2844085 - protein, 9 aa, Entamoeba invadens
DFKGSNSVN

SEQ ID NO: 2844086 - protein, 8 aa, Entamoeba invadens
DFKKEAAA

SEQ ID NO: 2844087 - protein, 10 aa, Entamoeba invadens
DFKKEKARNI

SEQ ID NO: 2844088 - protein, 13 aa, Entamoeba invadens
DFKKNDENTQKDM

SEQ ID NO: 2844089 - protein, 8 aa, Entamoeba invadens
DFKNSGEE

SEQ ID NO: 2844090 - protein, 6 aa, Entamoeba invadens
DFKPHN

SEQ ID NO: 2844091 - protein, 6 aa, Entamoeba invadens
DFKPKE

SEQ ID NO: 2844092 - protein, 11 aa, Entamoeba invadens
DFKQSSKQTDF

SEQ ID NO: 2844093 - protein, 20 aa, Entamoeba invadens
DFKREENEIQKTPMKEQDLK

SEQ ID NO: 2844094 - protein, 5 aa, Entamoeba invadens
DFMET

SEQ ID NO: 2844095 - protein, 7 aa, Entamoeba invadens
DFNEEES

SEQ ID NO: 2844096 - protein, 8 aa, Entamoeba invadens
DFNENTIP

SEQ ID NO: 2844097 - protein, 13 aa, Entamoeba invadens
DFNGDDIKEGGAE

SEQ ID NO: 2844098 - protein, 20 aa, Entamoeba invadens
DFNKPTQPTHNKHNTPKPKV

SEQ ID NO: 2844099 - protein, 6 aa, Entamoeba invadens
DFNKSH

SEQ ID NO: 2844100 - protein, 21 aa, Entamoeba invadens
DFNPEADGVKSNTNSYERNTL

SEQ ID NO: 2844101 - protein, 43 aa, Entamoeba invadens
DFNTKTTISNPPISDEKLSQKPTKIEKVERTEIRTEKNERKKT

SEQ ID NO: 2844102 - protein, 8 aa, Entamoeba invadens
DFPDNPPK

SEQ ID NO: 2844103 - protein, 14 aa, Entamoeba invadens
DFPEGTLDTDERVY

SEQ ID NO: 2844104 - protein, 7 aa, Entamoeba invadens
DFPGGDL

SEQ ID NO: 2844105 - protein, 7 aa, Entamoeba invadens
DFPISRP

SEQ ID NO: 2844106 - protein, 12 aa, Entamoeba invadens
DFPNESLGNDEY

SEQ ID NO: 2844107 - protein, 7 aa, Entamoeba invadens
DFPNHPP

SEQ ID NO: 2844108 - protein, 4 aa, Entamoeba invadens
DFPQ

SEQ ID NO: 2844109 - protein, 5 aa, Entamoeba invadens
DFPST

SEQ ID NO: 2844110 - protein, 4 aa, Entamoeba invadens
DFPT

SEQ ID NO: 2844111 - protein, 26 aa, Entamoeba invadens
DFPTEDLKEKGTKKSKNPTKVSSERL

SEQ ID NO: 2844112 - protein, 5 aa, Entamoeba invadens
DFPVP

SEQ ID NO: 2844113 - protein, 5 aa, Entamoeba invadens
DFQAK

SEQ ID NO: 2844114 - protein, 12 aa, Entamoeba invadens
DFQQKSDPTQCA

SEQ ID NO: 2844115 - protein, 5 aa, Entamoeba invadens
DFQTT

SEQ ID NO: 2844116 - protein, 4 aa, Entamoeba invadens
DFRE

SEQ ID NO: 2844117 - protein, 5 aa, Entamoeba invadens
DFRED

SEQ ID NO: 2844118 - protein, 10 aa, Entamoeba invadens
DFSAVSKDDT

SEQ ID NO: 2844119 - protein, 8 aa, Entamoeba invadens
DFSEQLRS

SEQ ID NO: 2844120 - protein, 7 aa, Entamoeba invadens
DFSEYED

SEQ ID NO: 2844121 - protein, 9 aa, Entamoeba invadens
DFSGESDRH

SEQ ID NO: 2844122 - protein, 13 aa, Entamoeba invadens
DFSKNASDVVKDN

SEQ ID NO: 2844123 - protein, 7 aa, Entamoeba invadens
DFSNPSI

SEQ ID NO: 2844124 - protein, 14 aa, Entamoeba invadens
DFSPIHPSEFVQIE

SEQ ID NO: 2844125 - protein, 13 aa, Entamoeba invadens
DFSPQSTNTTPAF

SEQ ID NO: 2844126 - protein, 30 aa, Entamoeba invadens
DFSPSKTDTKETKEEKPLLSKTTPPDVNNP

SEQ ID NO: 2844127 - protein, 7 aa, Entamoeba invadens
DFSPSTL

SEQ ID NO: 2844128 - protein, 16 aa, Entamoeba invadens
DFSRDKALEGEKSEEI

SEQ ID NO: 2844129 - protein, 11 aa, Entamoeba invadens
DFSRSSSKIQY

SEQ ID NO: 2844130 - protein, 5 aa, Entamoeba invadens
DFSSN

SEQ ID NO: 2844131 - protein, 15 aa, Entamoeba invadens
DFSSSQMDDSQTAEG

SEQ ID NO: 2844132 - protein, 4 aa, Entamoeba invadens
DFST

SEQ ID NO: 2844133 - protein, 10 aa, Entamoeba invadens
DFSTTKTKTD

SEQ ID NO: 2844134 - protein, 7 aa, Entamoeba invadens
DFTKASA

SEQ ID NO: 2844135 - protein, 11 aa, Entamoeba invadens
DFTKEIDQNDF

SEQ ID NO: 2844136 - protein, 8 aa, Entamoeba invadens
DFTPDSSA

SEQ ID NO: 2844137 - protein, 8 aa, Entamoeba invadens
DFTPKQKR

SEQ ID NO: 2844138 - protein, 6 aa, Entamoeba invadens
DFTSRY

SEQ ID NO: 2844139 - protein, 7 aa, Entamoeba invadens
DGAAAEK

SEQ ID NO: 2844140 - protein, 8 aa, Entamoeba invadens
DGADSKKC

SEQ ID NO: 2844141 - protein, 4 aa, Entamoeba invadens
DGAE

SEQ ID NO: 2844142 - protein, 13 aa, Entamoeba invadens
DGAETESDEMDPT

SEQ ID NO: 2844143 - protein, 4 aa, Entamoeba invadens
DGAF

SEQ ID NO: 2844144 - protein, 5 aa, Entamoeba invadens
DGAPI

SEQ ID NO: 2844145 - protein, 5 aa, Entamoeba invadens
DGAPK

SEQ ID NO: 2844146 - protein, 11 aa, Entamoeba invadens
DGASLSVPNTR

SEQ ID NO: 2844147 - protein, 7 aa, Entamoeba invadens
DGASTGI

SEQ ID NO: 2844148 - protein, 8 aa, Entamoeba invadens
DGATFTSK

SEQ ID NO: 2844149 - protein, 6 aa, Entamoeba invadens
DGAVGK

SEQ ID NO: 2844150 - protein, 5 aa, Entamoeba invadens
DGCGG

SEQ ID NO: 2844151 - protein, 10 aa, Entamoeba invadens
DGCPDNPNEE

SEQ ID NO: 2844152 - protein, 6 aa, Entamoeba invadens
DGCPPK

SEQ ID NO: 2844153 - protein, 9 aa, Entamoeba invadens
DGDARAALN

SEQ ID NO: 2844154 - protein, 46 aa, Entamoeba invadens
DGDESDENVEEYRESDPNEGKTENDNLVSEKKEERKKVNTKGQFTR

SEQ ID NO: 2844155 - protein, 7 aa, Entamoeba invadens
DGDGDRN

SEQ ID NO: 2844156 - protein, 5 aa, Entamoeba invadens
DGDGK

SEQ ID NO: 2844157 - protein, 10 aa, Entamoeba invadens
DGDGNGTLDA

SEQ ID NO: 2844158 - protein, 4 aa, Entamoeba invadens
DGDI

SEQ ID NO: 2844159 - protein, 7 aa, Entamoeba invadens
DGDINEA

SEQ ID NO: 2844160 - protein, 4 aa, Entamoeba invadens
DGDK

SEQ ID NO: 2844161 - protein, 9 aa, Entamoeba invadens
DGDKFTPKR

SEQ ID NO: 2844162 - protein, 12 aa, Entamoeba invadens
DGDKVVDTNKTV

SEQ ID NO: 2844163 - protein, 5 aa, Entamoeba invadens
DGDLD

SEQ ID NO: 2844164 - protein, 6 aa, Entamoeba invadens
DGDLTK

SEQ ID NO: 2844165 - protein, 10 aa, Entamoeba invadens
DGDMKEEKPM

SEQ ID NO: 2844166 - protein, 17 aa, Entamoeba invadens
DGDMSNEEMVGGATEGL

SEQ ID NO: 2844167 - protein, 7 aa, Entamoeba invadens
DGDPLKN

SEQ ID NO: 2844168 - protein, 19 aa, Entamoeba invadens
DGDSKRTNFKRGANTYEKA

SEQ ID NO: 2844169 - protein, 8 aa, Entamoeba invadens
DGDSKVAT

SEQ ID NO: 2844170 - protein, 12 aa, Entamoeba invadens
DGDSLSPKMSTA

SEQ ID NO: 2844171 - protein, 10 aa, Entamoeba invadens
DGDSYRSPFS

SEQ ID NO: 2844172 - protein, 8 aa, Entamoeba invadens
DGDTKSLD

SEQ ID NO: 2844173 - protein, 11 aa, Entamoeba invadens
DGDTKTTTQQL

SEQ ID NO: 2844174 - protein, 8 aa, Entamoeba invadens
DGDTRNDA

SEQ ID NO: 2844175 - protein, 4 aa, Entamoeba invadens
DGDV

SEQ ID NO: 2844176 - protein, 5 aa, Entamoeba invadens
DGDVE

SEQ ID NO: 2844177 - protein, 10 aa, Entamoeba invadens
DGDVQEKTSC

SEQ ID NO: 2844178 - protein, 9 aa, Entamoeba invadens
DGDVQSESF

SEQ ID NO: 2844179 - protein, 5 aa, Entamoeba invadens
DGDVT

SEQ ID NO: 2844180 - protein, 7 aa, Entamoeba invadens
DGDVTPA

SEQ ID NO: 2844181 - protein, 6 aa, Entamoeba invadens
DGDYEY

SEQ ID NO: 2844182 - protein, 28 aa, Entamoeba invadens
DGEAEGADDTGLPPAHVPPTREAPVYRT

SEQ ID NO: 2844183 - protein, 8 aa, Entamoeba invadens
DGEDGGEM

SEQ ID NO: 2844184 - protein, 7 aa, Entamoeba invadens
DGEEAIG

SEQ ID NO: 2844185 - protein, 11 aa, Entamoeba invadens
DGEEKPPKGYL

SEQ ID NO: 2844186 - protein, 11 aa, Entamoeba invadens
DGEERYKTKSI

SEQ ID NO: 2844187 - protein, 21 aa, Entamoeba invadens
DGEFEDSDTWSDEDSYRENTL

SEQ ID NO: 2844188 - protein, 8 aa, Entamoeba invadens
DGEFSSKD

SEQ ID NO: 2844189 - protein, 45 aa, Entamoeba invadens
DGEGAQQQTETHTDSSVLPKAETQPNLVNPPTTEEHKDEQKEAEV

SEQ ID NO: 2844190 - protein, 7 aa, Entamoeba invadens
DGEGEVE

SEQ ID NO: 2844191 - protein, 7 aa, Entamoeba invadens
DGEGLED

SEQ ID NO: 2844192 - protein, 6 aa, Entamoeba invadens
DGEGLR

SEQ ID NO: 2844193 - protein, 9 aa, Entamoeba invadens
DGEGNIGPE

SEQ ID NO: 2844194 - protein, 8 aa, Entamoeba invadens
DGEGVKAI

SEQ ID NO: 2844195 - protein, 6 aa, Entamoeba invadens
DGEHND

SEQ ID NO: 2844196 - protein, 4 aa, Entamoeba invadens
DGEI

SEQ ID NO: 2844197 - protein, 7 aa, Entamoeba invadens
DGEKFET

SEQ ID NO: 2844198 - protein, 8 aa, Entamoeba invadens
DGEKLQDS

SEQ ID NO: 2844199 - protein, 5 aa, Entamoeba invadens
DGEKQ

SEQ ID NO: 2844200 - protein, 15 aa, Entamoeba invadens
DGEKRTFNTQEPHEK

SEQ ID NO: 2844201 - protein, 8 aa, Entamoeba invadens
DGEKYGGY

SEQ ID NO: 2844202 - protein, 5 aa, Entamoeba invadens
DGEMK

SEQ ID NO: 2844203 - protein, 7 aa, Entamoeba invadens
DGEMPKV

SEQ ID NO: 2844204 - protein, 5 aa, Entamoeba invadens
DGENI

SEQ ID NO: 2844205 - protein, 7 aa, Entamoeba invadens
DGENKTD

SEQ ID NO: 2844206 - protein, 7 aa, Entamoeba invadens
DGENKVE

SEQ ID NO: 2844207 - protein, 5 aa, Entamoeba invadens
DGEPL

SEQ ID NO: 2844208 - protein, 15 aa, Entamoeba invadens
DGEQPAQPQRVAPKP

SEQ ID NO: 2844209 - protein, 11 aa, Entamoeba invadens
DGERSVNDGIS

SEQ ID NO: 2844210 - protein, 7 aa, Entamoeba invadens
DGESGSL

SEQ ID NO: 2844211 - protein, 6 aa, Entamoeba invadens
DGESYK

SEQ ID NO: 2844212 - protein, 9 aa, Entamoeba invadens
DGEYEEVKS

SEQ ID NO: 2844213 - protein, 8 aa, Entamoeba invadens
DGEYQEIR

SEQ ID NO: 2844214 - protein, 8 aa, Entamoeba invadens
DGEYSPYT

SEQ ID NO: 2844215 - protein, 6 aa, Entamoeba invadens
DGFDER

SEQ ID NO: 2844216 - protein, 7 aa, Entamoeba invadens
DGFGDWT

SEQ ID NO: 2844217 - protein, 5 aa, Entamoeba invadens
DGFGG

SEQ ID NO: 2844218 - protein, 14 aa, Entamoeba invadens
DGFKEKDKTVPPET

SEQ ID NO: 2844219 - protein, 8 aa, Entamoeba invadens
DGFPDKPR

SEQ ID NO: 2844220 - protein, 5 aa, Entamoeba invadens
DGFSP

SEQ ID NO: 2844221 - protein, 11 aa, Entamoeba invadens
DGFTDKKRSRV

SEQ ID NO: 2844222 - protein, 7 aa, Entamoeba invadens
DGFTPQQ

SEQ ID NO: 2844223 - protein, 6 aa, Entamoeba invadens
DGFTSH

SEQ ID NO: 2844224 - protein, 4 aa, Entamoeba invadens
DGGC

SEQ ID NO: 2844225 - protein, 8 aa, Entamoeba invadens
DGGDTPRK

SEQ ID NO: 2844226 - protein, 15 aa, Entamoeba invadens
DGGEEIIYDDDEEEE

SEQ ID NO: 2844227 - protein, 6 aa, Entamoeba invadens
DGGETD

SEQ ID NO: 2844228 - protein, 8 aa, Entamoeba invadens
DGGETNKN

SEQ ID NO: 2844229 - protein, 6 aa, Entamoeba invadens
DGGGMK

SEQ ID NO: 2844230 - protein, 6 aa, Entamoeba invadens
DGGGSK

SEQ ID NO: 2844231 - protein, 4 aa, Entamoeba invadens
DGGI

SEQ ID NO: 2844232 - protein, 20 aa, Entamoeba invadens
DGGISDKTIGVAKTAGATSF

SEQ ID NO: 2844233 - protein, 9 aa, Entamoeba invadens
DGGITQDGY

SEQ ID NO: 2844234 - protein, 7 aa, Entamoeba invadens
DGGKIND

SEQ ID NO: 2844235 - protein, 5 aa, Entamoeba invadens
DGGTY

SEQ ID NO: 2844236 - protein, 6 aa, Entamoeba invadens
DGGVGK

SEQ ID NO: 2844237 - protein, 8 aa, Entamoeba invadens
DGGYQQGM

SEQ ID NO: 2844238 - protein, 6 aa, Entamoeba invadens
DGHEGT

SEQ ID NO: 2844239 - protein, 25 aa, Entamoeba invadens
DGHEITGEDTSSDSVDVNGNSDDLI

SEQ ID NO: 2844240 - protein, 8 aa, Entamoeba invadens
DGHSEKIA

SEQ ID NO: 2844241 - protein, 18 aa, Entamoeba invadens
DGHSNGGGALSAVAATKS

SEQ ID NO: 2844242 - protein, 7 aa, Entamoeba invadens
DGHSPRF

SEQ ID NO: 2844243 - protein, 4 aa, Entamoeba invadens
DGHV

SEQ ID NO: 2844244 - protein, 11 aa, Entamoeba invadens
DGIAEKSKTVL

SEQ ID NO: 2844245 - protein, 6 aa, Entamoeba invadens
DGIDEF

SEQ ID NO: 2844246 - protein, 5 aa, Entamoeba invadens
DGIEQ

SEQ ID NO: 2844247 - protein, 6 aa, Entamoeba invadens
DGIGTE

SEQ ID NO: 2844248 - protein, 9 aa, Entamoeba invadens
DGIKPETFE

SEQ ID NO: 2844249 - protein, 6 aa, Entamoeba invadens
DGINDD

SEQ ID NO: 2844250 - protein, 8 aa, Entamoeba invadens
DGINDESY

SEQ ID NO: 2844251 - protein, 7 aa, Entamoeba invadens
DGISESK

SEQ ID NO: 2844252 - protein, 6 aa, Entamoeba invadens
DGISSG

SEQ ID NO: 2844253 - protein, 8 aa, Entamoeba invadens
DGITENKN

SEQ ID NO: 2844254 - protein, 72 aa, Entamoeba invadens
DGKAIRANKNEEEEMNETKIQRENERKKKVKEKERSEKNRKQGKDEEEKEVKKATKKKTTRKEEKEDSDDLK

SEQ ID NO: 2844255 - protein, 17 aa, Entamoeba invadens
DGKATKYMKRDNSSYST

SEQ ID NO: 2844256 - protein, 6 aa, Entamoeba invadens
DGKDEL

SEQ ID NO: 2844257 - protein, 8 aa, Entamoeba invadens
DGKDESVR

SEQ ID NO: 2844258 - protein, 5 aa, Entamoeba invadens
DGKDG

SEQ ID NO: 2844259 - protein, 9 aa, Entamoeba invadens
DGKDIDNVD

SEQ ID NO: 2844260 - protein, 13 aa, Entamoeba invadens
DGKDISKTSLETN

SEQ ID NO: 2844261 - protein, 5 aa, Entamoeba invadens
DGKEC

SEQ ID NO: 2844262 - protein, 9 aa, Entamoeba invadens
DGKEESKDF

SEQ ID NO: 2844263 - protein, 5 aa, Entamoeba invadens
DGKER

SEQ ID NO: 2844264 - protein, 19 aa, Entamoeba invadens
DGKERNKELEEEQKVKGDK

SEQ ID NO: 2844265 - protein, 4 aa, Entamoeba invadens
DGKF

SEQ ID NO: 2844266 - protein, 8 aa, Entamoeba invadens
DGKFIKDT

SEQ ID NO: 2844267 - protein, 4 aa, Entamoeba invadens
DGKG

SEQ ID NO: 2844268 - protein, 10 aa, Entamoeba invadens
DGKIGPKTRM

SEQ ID NO: 2844269 - protein, 10 aa, Entamoeba invadens
DGKKEKKSVV

SEQ ID NO: 2844270 - protein, 9 aa, Entamoeba invadens
DGKKFTDDE

SEQ ID NO: 2844271 - protein, 11 aa, Entamoeba invadens
DGKKIEGVQGI

SEQ ID NO: 2844272 - protein, 7 aa, Entamoeba invadens
DGKKISP

SEQ ID NO: 2844273 - protein, 7 aa, Entamoeba invadens
DGKKKRR

SEQ ID NO: 2844274 - protein, 8 aa, Entamoeba invadens
DGKKNNVQ

SEQ ID NO: 2844275 - protein, 27 aa, Entamoeba invadens
DGKKPNKKYDMKSKYSTLKKKSEEESV

SEQ ID NO: 2844276 - protein, 6 aa, Entamoeba invadens
DGKKTF

SEQ ID NO: 2844277 - protein, 15 aa, Entamoeba invadens
DGKLEKKIERTDEDY

SEQ ID NO: 2844278 - protein, 8 aa, Entamoeba invadens
DGKLTPNA

SEQ ID NO: 2844279 - protein, 11 aa, Entamoeba invadens
DGKMKSNEKYV

SEQ ID NO: 2844280 - protein, 10 aa, Entamoeba invadens
DGKNKTSIYS

SEQ ID NO: 2844281 - protein, 8 aa, Entamoeba invadens
DGKNLNES

SEQ ID NO: 2844282 - protein, 5 aa, Entamoeba invadens
DGKNN

SEQ ID NO: 2844283 - protein, 7 aa, Entamoeba invadens
DGKPTKP

SEQ ID NO: 2844284 - protein, 4 aa, Entamoeba invadens
DGKR

SEQ ID NO: 2844285 - protein, 5 aa, Entamoeba invadens
DGKRF

SEQ ID NO: 2844286 - protein, 9 aa, Entamoeba invadens
DGKRMSEVK

SEQ ID NO: 2844287 - protein, 5 aa, Entamoeba invadens
DGKRR

SEQ ID NO: 2844288 - protein, 13 aa, Entamoeba invadens
DGKRRDDNVHSDK

SEQ ID NO: 2844289 - protein, 8 aa, Entamoeba invadens
DGKSEKAI

SEQ ID NO: 2844290 - protein, 5 aa, Entamoeba invadens
DGKSF

SEQ ID NO: 2844291 - protein, 7 aa, Entamoeba invadens
DGKSHAE

SEQ ID NO: 2844292 - protein, 11 aa, Entamoeba invadens
DGKSIETGIQD

SEQ ID NO: 2844293 - protein, 5 aa, Entamoeba invadens
DGKSN

SEQ ID NO: 2844294 - protein, 6 aa, Entamoeba invadens
DGKSTI

SEQ ID NO: 2844295 - protein, 7 aa, Entamoeba invadens
DGKTDLP

SEQ ID NO: 2844296 - protein, 9 aa, Entamoeba invadens
DGKTKRSIP

SEQ ID NO: 2844297 - protein, 5 aa, Entamoeba invadens
DGKTM

SEQ ID NO: 2844298 - protein, 7 aa, Entamoeba invadens
DGKTNVG

SEQ ID NO: 2844299 - protein, 5 aa, Entamoeba invadens
DGKTR

SEQ ID NO: 2844300 - protein, 14 aa, Entamoeba invadens
DGKTVTETNDVTEY

SEQ ID NO: 2844301 - protein, 8 aa, Entamoeba invadens
DGKVGSDK

SEQ ID NO: 2844302 - protein, 6 aa, Entamoeba invadens
DGKVKT

SEQ ID NO: 2844303 - protein, 8 aa, Entamoeba invadens
DGKVPSTF

SEQ ID NO: 2844304 - protein, 10 aa, Entamoeba invadens
DGKYPSTSSP

SEQ ID NO: 2844305 - protein, 4 aa, Entamoeba invadens
DGLE

SEQ ID NO: 2844306 - protein, 8 aa, Entamoeba invadens
DGLEDDDI

SEQ ID NO: 2844307 - protein, 5 aa, Entamoeba invadens
DGLKG

SEQ ID NO: 2844308 - protein, 5 aa, Entamoeba invadens
DGLNS

SEQ ID NO: 2844309 - protein, 8 aa, Entamoeba invadens
DGLPKNTT

SEQ ID NO: 2844310 - protein, 4 aa, Entamoeba invadens
DGLS

SEQ ID NO: 2844311 - protein, 8 aa, Entamoeba invadens
DGLSAREF

SEQ ID NO: 2844312 - protein, 19 aa, Entamoeba invadens
DGLSGKKKIGDISKRKEEY

SEQ ID NO: 2844313 - protein, 6 aa, Entamoeba invadens
DGLSGY

SEQ ID NO: 2844314 - protein, 16 aa, Entamoeba invadens
DGMEEEAIRRSHSTPQ

SEQ ID NO: 2844315 - protein, 26 aa, Entamoeba invadens
DGMNDRISPDVSSSEEHSVQTNTSIV

SEQ ID NO: 2844316 - protein, 12 aa, Entamoeba invadens
DGMPGRSIERED

SEQ ID NO: 2844317 - protein, 11 aa, Entamoeba invadens
DGMSSGDRGGI

SEQ ID NO: 2844318 - protein, 4 aa, Entamoeba invadens
DGMT

SEQ ID NO: 2844319 - protein, 10 aa, Entamoeba invadens
DGMYKGETGI

SEQ ID NO: 2844320 - protein, 10 aa, Entamoeba invadens
DGNAQENDLE

SEQ ID NO: 2844321 - protein, 6 aa, Entamoeba invadens
DGNDIN

SEQ ID NO: 2844322 - protein, 12 aa, Entamoeba invadens
DGNEKESVEKHK

SEQ ID NO: 2844323 - protein, 13 aa, Entamoeba invadens
DGNFEDTGTQTVI

SEQ ID NO: 2844324 - protein, 5 aa, Entamoeba invadens
DGNFI

SEQ ID NO: 2844325 - protein, 8 aa, Entamoeba invadens
DGNHDEKL

SEQ ID NO: 2844326 - protein, 4 aa, Entamoeba invadens
DGNI

SEQ ID NO: 2844327 - protein, 8 aa, Entamoeba invadens
DGNIDDEI

SEQ ID NO: 2844328 - protein, 7 aa, Entamoeba invadens
DGNIPTR

SEQ ID NO: 2844329 - protein, 10 aa, Entamoeba invadens
DGNKPQKKVD

SEQ ID NO: 2844330 - protein, 10 aa, Entamoeba invadens
DGNKPQREKY

SEQ ID NO: 2844331 - protein, 9 aa, Entamoeba invadens
DGNLNKETL

SEQ ID NO: 2844332 - protein, 13 aa, Entamoeba invadens
DGNLNNIKTDNSG

SEQ ID NO: 2844333 - protein, 12 aa, Entamoeba invadens
DGNNDLGGNNFD

SEQ ID NO: 2844334 - protein, 7 aa, Entamoeba invadens
DGNNESL

SEQ ID NO: 2844335 - protein, 19 aa, Entamoeba invadens
DGNNGKTTTPENVEEKKNE

SEQ ID NO: 2844336 - protein, 7 aa, Entamoeba invadens
DGNPDMV

SEQ ID NO: 2844337 - protein, 8 aa, Entamoeba invadens
DGNPVGSY

SEQ ID NO: 2844338 - protein, 5 aa, Entamoeba invadens
DGNQM

SEQ ID NO: 2844339 - protein, 15 aa, Entamoeba invadens
DGNQYEKDQKKEFGE

SEQ ID NO: 2844340 - protein, 5 aa, Entamoeba invadens
DGNRK

SEQ ID NO: 2844341 - protein, 12 aa, Entamoeba invadens
DGNRVEQPKEIS

SEQ ID NO: 2844342 - protein, 10 aa, Entamoeba invadens
DGNSAKGVFN

SEQ ID NO: 2844343 - protein, 16 aa, Entamoeba invadens
DGNSLPENQQAKAPSL

SEQ ID NO: 2844344 - protein, 7 aa, Entamoeba invadens
DGNSSAT

SEQ ID NO: 2844345 - protein, 4 aa, Entamoeba invadens
DGNT

SEQ ID NO: 2844346 - protein, 5 aa, Entamoeba invadens
DGNTI

SEQ ID NO: 2844347 - protein, 8 aa, Entamoeba invadens
DGNTQSYD

SEQ ID NO: 2844348 - protein, 7 aa, Entamoeba invadens
DGNVPKI

SEQ ID NO: 2844349 - protein, 5 aa, Entamoeba invadens
DGNYN

SEQ ID NO: 2844350 - protein, 6 aa, Entamoeba invadens
DGPAGL

SEQ ID NO: 2844351 - protein, 6 aa, Entamoeba invadens
DGPALN

SEQ ID NO: 2844352 - protein, 5 aa, Entamoeba invadens
DGPFD

SEQ ID NO: 2844353 - protein, 6 aa, Entamoeba invadens
DGPFDQ

SEQ ID NO: 2844354 - protein, 7 aa, Entamoeba invadens
DGPFGKM

SEQ ID NO: 2844355 - protein, 5 aa, Entamoeba invadens
DGPGS

SEQ ID NO: 2844356 - protein, 22 aa, Entamoeba invadens
DGPIPNNFPSEIDTQRKNEKTL

SEQ ID NO: 2844357 - protein, 9 aa, Entamoeba invadens
DGPKEATPF

SEQ ID NO: 2844358 - protein, 4 aa, Entamoeba invadens
DGPL

SEQ ID NO: 2844359 - protein, 14 aa, Entamoeba invadens
DGPLREYNTPENKK

SEQ ID NO: 2844360 - protein, 6 aa, Entamoeba invadens
DGPLRY

SEQ ID NO: 2844361 - protein, 22 aa, Entamoeba invadens
DGPLSPTHQSSEKKTPRESRKK

SEQ ID NO: 2844362 - protein, 7 aa, Entamoeba invadens
DGPLTGM

SEQ ID NO: 2844363 - protein, 6 aa, Entamoeba invadens
DGPNGL

SEQ ID NO: 2844364 - protein, 12 aa, Entamoeba invadens
DGPPDTPYEGGK

SEQ ID NO: 2844365 - protein, 15 aa, Entamoeba invadens
DGPQDFAKTADDDDD

SEQ ID NO: 2844366 - protein, 4 aa, Entamoeba invadens
DGQF

SEQ ID NO: 2844367 - protein, 6 aa, Entamoeba invadens
DGQKRK

SEQ ID NO: 2844368 - protein, 6 aa, Entamoeba invadens
DGQKTI

SEQ ID NO: 2844369 - protein, 8 aa, Entamoeba invadens
DGQKTISK

SEQ ID NO: 2844370 - protein, 12 aa, Entamoeba invadens
DGQKYDGTKADV

SEQ ID NO: 2844371 - protein, 5 aa, Entamoeba invadens
DGQNT

SEQ ID NO: 2844372 - protein, 36 aa, Entamoeba invadens
DGQPLGKKASQKLEKQYKTAQKNYNSYKTEFDKDNQ

SEQ ID NO: 2844373 - protein, 8 aa, Entamoeba invadens
DGQQKDVS

SEQ ID NO: 2844374 - protein, 7 aa, Entamoeba invadens
DGQQRRA

SEQ ID NO: 2844375 - protein, 4 aa, Entamoeba invadens
DGQR

SEQ ID NO: 2844376 - protein, 10 aa, Entamoeba invadens
DGQSNRGIEM

SEQ ID NO: 2844377 - protein, 8 aa, Entamoeba invadens
DGQTQQDL

SEQ ID NO: 2844378 - protein, 6 aa, Entamoeba invadens
DGQYEE

SEQ ID NO: 2844379 - protein, 6 aa, Entamoeba invadens
DGQYGR

SEQ ID NO: 2844380 - protein, 8 aa, Entamoeba invadens
DGQYSDDT

SEQ ID NO: 2844381 - protein, 6 aa, Entamoeba invadens
DGQYSR

SEQ ID NO: 2844382 - protein, 6 aa, Entamoeba invadens
DGRARQ

SEQ ID NO: 2844383 - protein, 7 aa, Entamoeba invadens
DGRDENA

SEQ ID NO: 2844384 - protein, 9 aa, Entamoeba invadens
DGRDLTSSG

SEQ ID NO: 2844385 - protein, 8 aa, Entamoeba invadens
DGRDRAPA

SEQ ID NO: 2844386 - protein, 6 aa, Entamoeba invadens
DGRETL

SEQ ID NO: 2844387 - protein, 5 aa, Entamoeba invadens
DGRKG

SEQ ID NO: 2844388 - protein, 6 aa, Entamoeba invadens
DGRKKA

SEQ ID NO: 2844389 - protein, 6 aa, Entamoeba invadens
DGRKKM

SEQ ID NO: 2844390 - protein, 6 aa, Entamoeba invadens
DGRLKE

SEQ ID NO: 2844391 - protein, 6 aa, Entamoeba invadens
DGRLQK

SEQ ID NO: 2844392 - protein, 6 aa, Entamoeba invadens
DGRLRP

SEQ ID NO: 2844393 - protein, 6 aa, Entamoeba invadens
DGRNEA

SEQ ID NO: 2844394 - protein, 8 aa, Entamoeba invadens
DGRPPTMV

SEQ ID NO: 2844395 - protein, 6 aa, Entamoeba invadens
DGRQVE

SEQ ID NO: 2844396 - protein, 7 aa, Entamoeba invadens
DGRRKYT

SEQ ID NO: 2844397 - protein, 8 aa, Entamoeba invadens
DGRRPTEM

SEQ ID NO: 2844398 - protein, 7 aa, Entamoeba invadens
DGRRTYS

SEQ ID NO: 2844399 - protein, 7 aa, Entamoeba invadens
DGRTHGS

SEQ ID NO: 2844400 - protein, 15 aa, Entamoeba invadens
DGRTLPTSKITQSNE

SEQ ID NO: 2844401 - protein, 10 aa, Entamoeba invadens
DGRVDTPTDE

SEQ ID NO: 2844402 - protein, 8 aa, Entamoeba invadens
DGRWKSRK

SEQ ID NO: 2844403 - protein, 7 aa, Entamoeba invadens
DGRYNTD

SEQ ID NO: 2844404 - protein, 8 aa, Entamoeba invadens
DGSDEVQL

SEQ ID NO: 2844405 - protein, 7 aa, Entamoeba invadens
DGSDTSF

SEQ ID NO: 2844406 - protein, 7 aa, Entamoeba invadens
DGSEQSI

SEQ ID NO: 2844407 - protein, 6 aa, Entamoeba invadens
DGSFEM

SEQ ID NO: 2844408 - protein, 9 aa, Entamoeba invadens
DGSGADNFY

SEQ ID NO: 2844409 - protein, 7 aa, Entamoeba invadens
DGSGKTY

SEQ ID NO: 2844410 - protein, 8 aa, Entamoeba invadens
DGSGPSIY

SEQ ID NO: 2844411 - protein, 6 aa, Entamoeba invadens
DGSGSI

SEQ ID NO: 2844412 - protein, 12 aa, Entamoeba invadens
DGSHGTKSAPVR

SEQ ID NO: 2844413 - protein, 4 aa, Entamoeba invadens
DGSI

SEQ ID NO: 2844414 - protein, 6 aa, Entamoeba invadens
DGSIEA

SEQ ID NO: 2844415 - protein, 5 aa, Entamoeba invadens
DGSIK

SEQ ID NO: 2844416 - protein, 6 aa, Entamoeba invadens
DGSKGV

SEQ ID NO: 2844417 - protein, 10 aa, Entamoeba invadens
DGSKIQNQVE

SEQ ID NO: 2844418 - protein, 7 aa, Entamoeba invadens
DGSKQVE

SEQ ID NO: 2844419 - protein, 10 aa, Entamoeba invadens
DGSKTSVSKV

SEQ ID NO: 2844420 - protein, 6 aa, Entamoeba invadens
DGSKVA

SEQ ID NO: 2844421 - protein, 5 aa, Entamoeba invadens
DGSLA

SEQ ID NO: 2844422 - protein, 5 aa, Entamoeba invadens
DGSLE

SEQ ID NO: 2844423 - protein, 7 aa, Entamoeba invadens
DGSLSQI

SEQ ID NO: 2844424 - protein, 9 aa, Entamoeba invadens
DGSLSYQAN

SEQ ID NO: 2844425 - protein, 10 aa, Entamoeba invadens
DGSLTSGIPT

SEQ ID NO: 2844426 - protein, 12 aa, Entamoeba invadens
DGSMGKEPRQRA

SEQ ID NO: 2844427 - protein, 9 aa, Entamoeba invadens
DGSNATWST

SEQ ID NO: 2844428 - protein, 8 aa, Entamoeba invadens
DGSPEEPV

SEQ ID NO: 2844429 - protein, 7 aa, Entamoeba invadens
DGSPFSL

SEQ ID NO: 2844430 - protein, 8 aa, Entamoeba invadens
DGSPNMGK

SEQ ID NO: 2844431 - protein, 7 aa, Entamoeba invadens
DGSPSLI

SEQ ID NO: 2844432 - protein, 5 aa, Entamoeba invadens
DGSQI

SEQ ID NO: 2844433 - protein, 6 aa, Entamoeba invadens
DGSQVN

SEQ ID NO: 2844434 - protein, 7 aa, Entamoeba invadens
DGSRIHS

SEQ ID NO: 2844435 - protein, 9 aa, Entamoeba invadens
DGSSRAKNS

SEQ ID NO: 2844436 - protein, 7 aa, Entamoeba invadens
DGSSRQH

SEQ ID NO: 2844437 - protein, 13 aa, Entamoeba invadens
DGSSSVDDSTIDN

SEQ ID NO: 2844438 - protein, 12 aa, Entamoeba invadens
DGSTKADERGEL

SEQ ID NO: 2844439 - protein, 7 aa, Entamoeba invadens
DGSTSLV

SEQ ID NO: 2844440 - protein, 6 aa, Entamoeba invadens
DGSTTV

SEQ ID NO: 2844441 - protein, 6 aa, Entamoeba invadens
DGSVDK

SEQ ID NO: 2844442 - protein, 7 aa, Entamoeba invadens
DGSVGRS

SEQ ID NO: 2844443 - protein, 5 aa, Entamoeba invadens
DGSVK

SEQ ID NO: 2844444 - protein, 6 aa, Entamoeba invadens
DGSVKL

SEQ ID NO: 2844445 - protein, 12 aa, Entamoeba invadens
DGSVKSNDRQNA

SEQ ID NO: 2844446 - protein, 8 aa, Entamoeba invadens
DGSYGGKS

SEQ ID NO: 2844447 - protein, 8 aa, Entamoeba invadens
DGTADGTQ

SEQ ID NO: 2844448 - protein, 11 aa, Entamoeba invadens
DGTALDATEPI

SEQ ID NO: 2844449 - protein, 18 aa, Entamoeba invadens
DGTANNGLGNLEEDPDVN

SEQ ID NO: 2844450 - protein, 10 aa, Entamoeba invadens
DGTATTAKQI

SEQ ID NO: 2844451 - protein, 12 aa, Entamoeba invadens
DGTCAGYDKRTN

SEQ ID NO: 2844452 - protein, 10 aa, Entamoeba invadens
DGTDAGDEIR

SEQ ID NO: 2844453 - protein, 12 aa, Entamoeba invadens
DGTDTSQGKGQI

SEQ ID NO: 2844454 - protein, 6 aa, Entamoeba invadens
DGTEFV

SEQ ID NO: 2844455 - protein, 6 aa, Entamoeba invadens
DGTEME

SEQ ID NO: 2844456 - protein, 12 aa, Entamoeba invadens
DGTENKGKLGAN

SEQ ID NO: 2844457 - protein, 8 aa, Entamoeba invadens
DGTEPERV

SEQ ID NO: 2844458 - protein, 9 aa, Entamoeba invadens
DGTEPNKCS

SEQ ID NO: 2844459 - protein, 10 aa, Entamoeba invadens
DGTEPTTDAY

SEQ ID NO: 2844460 - protein, 8 aa, Entamoeba invadens
DGTERADL

SEQ ID NO: 2844461 - protein, 7 aa, Entamoeba invadens
DGTFDVK

SEQ ID NO: 2844462 - protein, 4 aa, Entamoeba invadens
DGTG

SEQ ID NO: 2844463 - protein, 5 aa, Entamoeba invadens
DGTGI

SEQ ID NO: 2844464 - protein, 7 aa, Entamoeba invadens
DGTGNKF

SEQ ID NO: 2844465 - protein, 6 aa, Entamoeba invadens
DGTGYS

SEQ ID NO: 2844466 - protein, 8 aa, Entamoeba invadens
DGTHPYSK

SEQ ID NO: 2844467 - protein, 6 aa, Entamoeba invadens
DGTIES

SEQ ID NO: 2844468 - protein, 11 aa, Entamoeba invadens
DGTKNTVKASD

SEQ ID NO: 2844469 - protein, 13 aa, Entamoeba invadens
DGTKTSPEKSPKQ

SEQ ID NO: 2844470 - protein, 5 aa, Entamoeba invadens
DGTLP

SEQ ID NO: 2844471 - protein, 10 aa, Entamoeba invadens
DGTPGKTVTI

SEQ ID NO: 2844472 - protein, 8 aa, Entamoeba invadens
DGTPPQDL

SEQ ID NO: 2844473 - protein, 6 aa, Entamoeba invadens
DGTPQH

SEQ ID NO: 2844474 - protein, 5 aa, Entamoeba invadens
DGTQI

SEQ ID NO: 2844475 - protein, 5 aa, Entamoeba invadens
DGTSF

SEQ ID NO: 2844476 - protein, 4 aa, Entamoeba invadens
DGTT

SEQ ID NO: 2844477 - protein, 5 aa, Entamoeba invadens
DGTTI

SEQ ID NO: 2844478 - protein, 13 aa, Entamoeba invadens
DGTTLGADDGAGM

SEQ ID NO: 2844479 - protein, 5 aa, Entamoeba invadens
DGTTN

SEQ ID NO: 2844480 - protein, 8 aa, Entamoeba invadens
DGTTRREA

SEQ ID NO: 2844481 - protein, 4 aa, Entamoeba invadens
DGTV

SEQ ID NO: 2844482 - protein, 5 aa, Entamoeba invadens
DGTVG

SEQ ID NO: 2844483 - protein, 6 aa, Entamoeba invadens
DGTVKL

SEQ ID NO: 2844484 - protein, 14 aa, Entamoeba invadens
DGTVQWTEEEQHEL

SEQ ID NO: 2844485 - protein, 6 aa, Entamoeba invadens
DGTYTD

SEQ ID NO: 2844486 - protein, 10 aa, Entamoeba invadens
DGVAQDSNTA

SEQ ID NO: 2844487 - protein, 10 aa, Entamoeba invadens
DGVAQSRDVS

SEQ ID NO: 2844488 - protein, 5 aa, Entamoeba invadens
DGVDE

SEQ ID NO: 2844489 - protein, 11 aa, Entamoeba invadens
DGVDEDDRFDE

SEQ ID NO: 2844490 - protein, 6 aa, Entamoeba invadens
DGVDSD

SEQ ID NO: 2844491 - protein, 7 aa, Entamoeba invadens
DGVESEH

SEQ ID NO: 2844492 - protein, 8 aa, Entamoeba invadens
DGVEVPNN

SEQ ID NO: 2844493 - protein, 6 aa, Entamoeba invadens
DGVGKK

SEQ ID NO: 2844494 - protein, 7 aa, Entamoeba invadens
DGVGKKS

SEQ ID NO: 2844495 - protein, 10 aa, Entamoeba invadens
DGVGQRYPPP

SEQ ID NO: 2844496 - protein, 5 aa, Entamoeba invadens
DGVGT

SEQ ID NO: 2844497 - protein, 6 aa, Entamoeba invadens
DGVKEE

SEQ ID NO: 2844498 - protein, 5 aa, Entamoeba invadens
DGVKT

SEQ ID NO: 2844499 - protein, 4 aa, Entamoeba invadens
DGVN

SEQ ID NO: 2844500 - protein, 31 aa, Entamoeba invadens
DGVNATDEIGQSQAEHQKVDNTNNEPIEISD

SEQ ID NO: 2844501 - protein, 5 aa, Entamoeba invadens
DGVNG

SEQ ID NO: 2844502 - protein, 7 aa, Entamoeba invadens
DGVNSGD

SEQ ID NO: 2844503 - protein, 5 aa, Entamoeba invadens
DGVNT

SEQ ID NO: 2844504 - protein, 97 aa, Entamoeba invadens
DGVQGKRAPNTNTFDNKEGDDLEMSQEEYNPENDSEGADNVDESDQSDTSTQSENNQMESEGGTEEEKVQEKNQNEEVKTMKENGIETVRSTPQQQS

SEQ ID NO: 2844505 - protein, 16 aa, Entamoeba invadens
DGVQNGAARLLRVLRD

SEQ ID NO: 2844506 - protein, 8 aa, Entamoeba invadens
DGVQSSDS

SEQ ID NO: 2844507 - protein, 7 aa, Entamoeba invadens
DGVRDGK

SEQ ID NO: 2844508 - protein, 10 aa, Entamoeba invadens
DGVRKERNYY

SEQ ID NO: 2844509 - protein, 5 aa, Entamoeba invadens
DGVSD

SEQ ID NO: 2844510 - protein, 6 aa, Entamoeba invadens
DGVSHT

SEQ ID NO: 2844511 - protein, 13 aa, Entamoeba invadens
DGVSNSKKFRVRD

SEQ ID NO: 2844512 - protein, 6 aa, Entamoeba invadens
DGVTDV

SEQ ID NO: 2844513 - protein, 12 aa, Entamoeba invadens
DGVTEQQRSDPR

SEQ ID NO: 2844514 - protein, 18 aa, Entamoeba invadens
DGVTSDIGEVSNYPNSLK

SEQ ID NO: 2844515 - protein, 4 aa, Entamoeba invadens
DGVV

SEQ ID NO: 2844516 - protein, 4 aa, Entamoeba invadens
DGVW

SEQ ID NO: 2844517 - protein, 5 aa, Entamoeba invadens
DGVYS

SEQ ID NO: 2844518 - protein, 9 aa, Entamoeba invadens
DGWNNKQRS

SEQ ID NO: 2844519 - protein, 10 aa, Entamoeba invadens
DGWNNKQRSI

SEQ ID NO: 2844520 - protein, 19 aa, Entamoeba invadens
DGYDETKGAYLAKKAEAEA

SEQ ID NO: 2844521 - protein, 6 aa, Entamoeba invadens
DGYEDM

SEQ ID NO: 2844522 - protein, 20 aa, Entamoeba invadens
DGYEESDDEEDLKCKTDEKV

SEQ ID NO: 2844523 - protein, 8 aa, Entamoeba invadens
DGYGGNIE

SEQ ID NO: 2844524 - protein, 24 aa, Entamoeba invadens
DGYGTSETGNIAELQSGQVKDGAD

SEQ ID NO: 2844525 - protein, 10 aa, Entamoeba invadens
DGYGTSETGS

SEQ ID NO: 2844526 - protein, 13 aa, Entamoeba invadens
DGYNDEENGMDQD

SEQ ID NO: 2844527 - protein, 9 aa, Entamoeba invadens
DGYNPRTRE

SEQ ID NO: 2844528 - protein, 7 aa, Entamoeba invadens
DGYPEGT

SEQ ID NO: 2844529 - protein, 7 aa, Entamoeba invadens
DGYSGAE

SEQ ID NO: 2844530 - protein, 8 aa, Entamoeba invadens
DGYTDKRE

SEQ ID NO: 2844531 - protein, 8 aa, Entamoeba invadens
DGYTPDFG

SEQ ID NO: 2844532 - protein, 11 aa, Entamoeba invadens
DGYVKYKDKDD

SEQ ID NO: 2844533 - protein, 6 aa, Entamoeba invadens
DGYYSG

SEQ ID NO: 2844534 - protein, 8 aa, Entamoeba invadens
DHARLGNK

SEQ ID NO: 2844535 - protein, 9 aa, Entamoeba invadens
DHDGKIKAA

SEQ ID NO: 2844536 - protein, 4 aa, Entamoeba invadens
DHEF

SEQ ID NO: 2844537 - protein, 7 aa, Entamoeba invadens
DHEKAKM

SEQ ID NO: 2844538 - protein, 9 aa, Entamoeba invadens
DHEKRRTYD

SEQ ID NO: 2844539 - protein, 8 aa, Entamoeba invadens
DHEMGPST

SEQ ID NO: 2844540 - protein, 7 aa, Entamoeba invadens
DHENEKV

SEQ ID NO: 2844541 - protein, 7 aa, Entamoeba invadens
DHENYNG

SEQ ID NO: 2844542 - protein, 17 aa, Entamoeba invadens
DHEQLTEDDKATAPSEI

SEQ ID NO: 2844543 - protein, 7 aa, Entamoeba invadens
DHEQVEG

SEQ ID NO: 2844544 - protein, 7 aa, Entamoeba invadens
DHERDAI

SEQ ID NO: 2844545 - protein, 5 aa, Entamoeba invadens
DHEST

SEQ ID NO: 2844546 - protein, 4 aa, Entamoeba invadens
DHEY

SEQ ID NO: 2844547 - protein, 6 aa, Entamoeba invadens
DHFNSN

SEQ ID NO: 2844548 - protein, 7 aa, Entamoeba invadens
DHGSLSS

SEQ ID NO: 2844549 - protein, 10 aa, Entamoeba invadens
DHHENDERKL

SEQ ID NO: 2844550 - protein, 14 aa, Entamoeba invadens
DHKDKYDEESYKEM

SEQ ID NO: 2844551 - protein, 7 aa, Entamoeba invadens
DHKDSEE

SEQ ID NO: 2844552 - protein, 7 aa, Entamoeba invadens
DHKEDDN

SEQ ID NO: 2844553 - protein, 5 aa, Entamoeba invadens
DHKET

SEQ ID NO: 2844554 - protein, 8 aa, Entamoeba invadens
DHKGENME

SEQ ID NO: 2844555 - protein, 9 aa, Entamoeba invadens
DHKGPTQQA

SEQ ID NO: 2844556 - protein, 6 aa, Entamoeba invadens
DHKHPL

SEQ ID NO: 2844557 - protein, 8 aa, Entamoeba invadens
DHKPIEPS

SEQ ID NO: 2844558 - protein, 6 aa, Entamoeba invadens
DHKPVS

SEQ ID NO: 2844559 - protein, 7 aa, Entamoeba invadens
DHKQQQI

SEQ ID NO: 2844560 - protein, 9 aa, Entamoeba invadens
DHKRAEVDK

SEQ ID NO: 2844561 - protein, 6 aa, Entamoeba invadens
DHLDEE

SEQ ID NO: 2844562 - protein, 26 aa, Entamoeba invadens
DHNATQPAPHSKSEKQQIVQQERPAY

SEQ ID NO: 2844563 - protein, 7 aa, Entamoeba invadens
DHNEECE

SEQ ID NO: 2844564 - protein, 29 aa, Entamoeba invadens
DHNKIENGQNEKMEEEGKNMEEEDGWKEK

SEQ ID NO: 2844565 - protein, 7 aa, Entamoeba invadens
DHNKKTE

SEQ ID NO: 2844566 - protein, 9 aa, Entamoeba invadens
DHNKKVRDL

SEQ ID NO: 2844567 - protein, 10 aa, Entamoeba invadens
DHNQSPRNTY

SEQ ID NO: 2844568 - protein, 4 aa, Entamoeba invadens
DHPE

SEQ ID NO: 2844569 - protein, 7 aa, Entamoeba invadens
DHPFKTN

SEQ ID NO: 2844570 - protein, 6 aa, Entamoeba invadens
DHPKCG

SEQ ID NO: 2844571 - protein, 10 aa, Entamoeba invadens
DHPNEAKLGS

SEQ ID NO: 2844572 - protein, 10 aa, Entamoeba invadens
DHPPEDSSFA

SEQ ID NO: 2844573 - protein, 7 aa, Entamoeba invadens
DHPPFPL

SEQ ID NO: 2844574 - protein, 13 aa, Entamoeba invadens
DHPPLPEVATLSS

SEQ ID NO: 2844575 - protein, 7 aa, Entamoeba invadens
DHPPQQV

SEQ ID NO: 2844576 - protein, 11 aa, Entamoeba invadens
DHPPRSDEIDS

SEQ ID NO: 2844577 - protein, 6 aa, Entamoeba invadens
DHPQGQ

SEQ ID NO: 2844578 - protein, 20 aa, Entamoeba invadens
DHPQPAQQTQAQPQQQRPSA

SEQ ID NO: 2844579 - protein, 7 aa, Entamoeba invadens
DHPSPQV

SEQ ID NO: 2844580 - protein, 5 aa, Entamoeba invadens
DHPTL

SEQ ID NO: 2844581 - protein, 4 aa, Entamoeba invadens
DHQE

SEQ ID NO: 2844582 - protein, 26 aa, Entamoeba invadens
DHQHKPGQECKPYKAKEIEGSYVDEP

SEQ ID NO: 2844583 - protein, 17 aa, Entamoeba invadens
DHQLSRKRGRKPKLTEE

SEQ ID NO: 2844584 - protein, 5 aa, Entamoeba invadens
DHQTL

SEQ ID NO: 2844585 - protein, 12 aa, Entamoeba invadens
DHQTRAAKEGKR

SEQ ID NO: 2844586 - protein, 6 aa, Entamoeba invadens
DHQTTL

SEQ ID NO: 2844587 - protein, 27 aa, Entamoeba invadens
DHRATAPEEYQRVKDNGGFIKNDRTNG

SEQ ID NO: 2844588 - protein, 9 aa, Entamoeba invadens
DHRCENETH

SEQ ID NO: 2844589 - protein, 15 aa, Entamoeba invadens
DHRETDPEKLKANKE

SEQ ID NO: 2844590 - protein, 4 aa, Entamoeba invadens
DHRS

SEQ ID NO: 2844591 - protein, 13 aa, Entamoeba invadens
DHSDNHKMKGDKI

SEQ ID NO: 2844592 - protein, 11 aa, Entamoeba invadens
DHSGDISGKEV

SEQ ID NO: 2844593 - protein, 10 aa, Entamoeba invadens
DHSGKIDKDE

SEQ ID NO: 2844594 - protein, 8 aa, Entamoeba invadens
DHSGTIEK

SEQ ID NO: 2844595 - protein, 30 aa, Entamoeba invadens
DHSHTTEVTQSSQDRVKITQQKTQEEKKGC

SEQ ID NO: 2844596 - protein, 7 aa, Entamoeba invadens
DHSKKCV

SEQ ID NO: 2844597 - protein, 6 aa, Entamoeba invadens
DHSRRA

SEQ ID NO: 2844598 - protein, 10 aa, Entamoeba invadens
DHSSDEESPV

SEQ ID NO: 2844599 - protein, 5 aa, Entamoeba invadens
DHSTK

SEQ ID NO: 2844600 - protein, 6 aa, Entamoeba invadens
DHSYKN

SEQ ID NO: 2844601 - protein, 6 aa, Entamoeba invadens
DHTAGN

SEQ ID NO: 2844602 - protein, 5 aa, Entamoeba invadens
DHTIK

SEQ ID NO: 2844603 - protein, 7 aa, Entamoeba invadens
DHTKPYE

SEQ ID NO: 2844604 - protein, 6 aa, Entamoeba invadens
DHTQLQ

SEQ ID NO: 2844605 - protein, 5 aa, Entamoeba invadens
DHTRV

SEQ ID NO: 2844606 - protein, 11 aa, Entamoeba invadens
DHTSHDDASDV

SEQ ID NO: 2844607 - protein, 4 aa, Entamoeba invadens
DHTT

SEQ ID NO: 2844608 - protein, 4 aa, Entamoeba invadens
DHVE

SEQ ID NO: 2844609 - protein, 7 aa, Entamoeba invadens
DHYKSVS

SEQ ID NO: 2844610 - protein, 9 aa, Entamoeba invadens
DHYTTKEPF

SEQ ID NO: 2844611 - protein, 11 aa, Entamoeba invadens
DIADLEKAKNM

SEQ ID NO: 2844612 - protein, 9 aa, Entamoeba invadens
DIAEAYKPG

SEQ ID NO: 2844613 - protein, 8 aa, Entamoeba invadens
DIAEYKNG

SEQ ID NO: 2844614 - protein, 4 aa, Entamoeba invadens
DIAK

SEQ ID NO: 2844615 - protein, 13 aa, Entamoeba invadens
DIAKRRYKQEDTT

SEQ ID NO: 2844616 - protein, 11 aa, Entamoeba invadens
DIANKKLGKNY

SEQ ID NO: 2844617 - protein, 8 aa, Entamoeba invadens
DIANPQQI

SEQ ID NO: 2844618 - protein, 5 aa, Entamoeba invadens
DIAPL

SEQ ID NO: 2844619 - protein, 8 aa, Entamoeba invadens
DIAPQKCE

SEQ ID NO: 2844620 - protein, 17 aa, Entamoeba invadens
DIARSGECDYEEANERA

SEQ ID NO: 2844621 - protein, 12 aa, Entamoeba invadens
DIASTENGAEKP

SEQ ID NO: 2844622 - protein, 4 aa, Entamoeba invadens
DIAT

SEQ ID NO: 2844623 - protein, 5 aa, Entamoeba invadens
DIDAQ

SEQ ID NO: 2844624 - protein, 7 aa, Entamoeba invadens
DIDASTL

SEQ ID NO: 2844625 - protein, 5 aa, Entamoeba invadens
DIDDI

SEQ ID NO: 2844626 - protein, 24 aa, Entamoeba invadens
DIDEDTKETNPTNSAIQEHTSPQF

SEQ ID NO: 2844627 - protein, 19 aa, Entamoeba invadens
DIDEEEEDDDDIDGLTDTF

SEQ ID NO: 2844628 - protein, 9 aa, Entamoeba invadens
DIDETEELS

SEQ ID NO: 2844629 - protein, 9 aa, Entamoeba invadens
DIDKGGEWE

SEQ ID NO: 2844630 - protein, 11 aa, Entamoeba invadens
DIDKQKTSFSI

SEQ ID NO: 2844631 - protein, 7 aa, Entamoeba invadens
DIDMSND

SEQ ID NO: 2844632 - protein, 6 aa, Entamoeba invadens
DIDNQE

SEQ ID NO: 2844633 - protein, 18 aa, Entamoeba invadens
DIDNSDIRNCGKVESREI

SEQ ID NO: 2844634 - protein, 8 aa, Entamoeba invadens
DIDNTDQT

SEQ ID NO: 2844635 - protein, 7 aa, Entamoeba invadens
DIDPDGA

SEQ ID NO: 2844636 - protein, 6 aa, Entamoeba invadens
DIDPQD

SEQ ID NO: 2844637 - protein, 8 aa, Entamoeba invadens
DIDQYERE

SEQ ID NO: 2844638 - protein, 6 aa, Entamoeba invadens
DIDTDY

SEQ ID NO: 2844639 - protein, 14 aa, Entamoeba invadens
DIEARTTPRSVTGS

SEQ ID NO: 2844640 - protein, 12 aa, Entamoeba invadens
DIEDKEGEISDL

SEQ ID NO: 2844641 - protein, 14 aa, Entamoeba invadens
DIEDKEGEISDSKK

SEQ ID NO: 2844642 - protein, 16 aa, Entamoeba invadens
DIEDNISASYTVPPEI

SEQ ID NO: 2844643 - protein, 6 aa, Entamoeba invadens
DIEDNN

SEQ ID NO: 2844644 - protein, 11 aa, Entamoeba invadens
DIEDREGEISD

SEQ ID NO: 2844645 - protein, 9 aa, Entamoeba invadens
DIEEPEEEL

SEQ ID NO: 2844646 - protein, 10 aa, Entamoeba invadens
DIEERRRKAL

SEQ ID NO: 2844647 - protein, 13 aa, Entamoeba invadens
DIEGNEIKEGGAE

SEQ ID NO: 2844648 - protein, 12 aa, Entamoeba invadens
DIEKETEDQENI

SEQ ID NO: 2844649 - protein, 13 aa, Entamoeba invadens
DIEKQTRNNNLSH

SEQ ID NO: 2844650 - protein, 6 aa, Entamoeba invadens
DIENKD

SEQ ID NO: 2844651 - protein, 4 aa, Entamoeba invadens
DIER

SEQ ID NO: 2844652 - protein, 8 aa, Entamoeba invadens
DIEREDSK

SEQ ID NO: 2844653 - protein, 6 aa, Entamoeba invadens
DIERQR

SEQ ID NO: 2844654 - protein, 5 aa, Entamoeba invadens
DIETT

SEQ ID NO: 2844655 - protein, 4 aa, Entamoeba invadens
DIFT

SEQ ID NO: 2844656 - protein, 4 aa, Entamoeba invadens
DIGG

SEQ ID NO: 2844657 - protein, 35 aa, Entamoeba invadens
DIGKSLSSATASKFQELNPTVSVNAETRELTNDSI

SEQ ID NO: 2844658 - protein, 11 aa, Entamoeba invadens
DIGNKAKTIET

SEQ ID NO: 2844659 - protein, 6 aa, Entamoeba invadens
DIGRCY

SEQ ID NO: 2844660 - protein, 13 aa, Entamoeba invadens
DIGSRADVEESSE

SEQ ID NO: 2844661 - protein, 5 aa, Entamoeba invadens
DIHET

SEQ ID NO: 2844662 - protein, 8 aa, Entamoeba invadens
DIHSAEEH

SEQ ID NO: 2844663 - protein, 8 aa, Entamoeba invadens
DIHSSPAT

SEQ ID NO: 2844664 - protein, 7 aa, Entamoeba invadens
DIHTGDD

SEQ ID NO: 2844665 - protein, 8 aa, Entamoeba invadens
DIIEEEPD

SEQ ID NO: 2844666 - protein, 6 aa, Entamoeba invadens
DIKDGA

SEQ ID NO: 2844667 - protein, 5 aa, Entamoeba invadens
DIKDK

SEQ ID NO: 2844668 - protein, 9 aa, Entamoeba invadens
DIKDSNKVS

SEQ ID NO: 2844669 - protein, 5 aa, Entamoeba invadens
DIKEK

SEQ ID NO: 2844670 - protein, 9 aa, Entamoeba invadens
DIKGLENPL

SEQ ID NO: 2844671 - protein, 8 aa, Entamoeba invadens
DIKGSRNR

SEQ ID NO: 2844672 - protein, 47 aa, Entamoeba invadens
DIKKEKENVDQQVHNTTEKIKEIENELKEEKEKVEIANKETENIKNE

SEQ ID NO: 2844673 - protein, 10 aa, Entamoeba invadens
DIKKQVDAKI

SEQ ID NO: 2844674 - protein, 9 aa, Entamoeba invadens
DIKNSRFEG

SEQ ID NO: 2844675 - protein, 19 aa, Entamoeba invadens
DIKPDPPKKEEKKIDPKVA

SEQ ID NO: 2844676 - protein, 7 aa, Entamoeba invadens
DIKPGDL

SEQ ID NO: 2844677 - protein, 5 aa, Entamoeba invadens
DIKPS

SEQ ID NO: 2844678 - protein, 20 aa, Entamoeba invadens
DIKPSPSVLKNASKPSETYR

SEQ ID NO: 2844679 - protein, 10 aa, Entamoeba invadens
DIKRSYQSSS

SEQ ID NO: 2844680 - protein, 8 aa, Entamoeba invadens
DIKSGKLQ

SEQ ID NO: 2844681 - protein, 7 aa, Entamoeba invadens
DILKSEP

SEQ ID NO: 2844682 - protein, 5 aa, Entamoeba invadens
DILSG

SEQ ID NO: 2844683 - protein, 9 aa, Entamoeba invadens
DILSKEPNT

SEQ ID NO: 2844684 - protein, 16 aa, Entamoeba invadens
DILSNKNEISFGDEDD

SEQ ID NO: 2844685 - protein, 19 aa, Entamoeba invadens
DINDDFEEVRKEAKNASDL

SEQ ID NO: 2844686 - protein, 8 aa, Entamoeba invadens
DINDDNKI

SEQ ID NO: 2844687 - protein, 13 aa, Entamoeba invadens
DINETGTKFKPKK

SEQ ID NO: 2844688 - protein, 5 aa, Entamoeba invadens
DINFD

SEQ ID NO: 2844689 - protein, 4 aa, Entamoeba invadens
DING

SEQ ID NO: 2844690 - protein, 18 aa, Entamoeba invadens
DINGQRKVEKEEGEKMAE

SEQ ID NO: 2844691 - protein, 5 aa, Entamoeba invadens
DINGV

SEQ ID NO: 2844692 - protein, 12 aa, Entamoeba invadens
DINKENNKKNWV

SEQ ID NO: 2844693 - protein, 10 aa, Entamoeba invadens
DINKETENQD

SEQ ID NO: 2844694 - protein, 4 aa, Entamoeba invadens
DINL

SEQ ID NO: 2844695 - protein, 5 aa, Entamoeba invadens
DINLP

SEQ ID NO: 2844696 - protein, 12 aa, Entamoeba invadens
DINNEHEKRIER

SEQ ID NO: 2844697 - protein, 5 aa, Entamoeba invadens
DINNG

SEQ ID NO: 2844698 - protein, 29 aa, Entamoeba invadens
DINNQKTSNYLDTNDIPTNATEKQRRSSF

SEQ ID NO: 2844699 - protein, 8 aa, Entamoeba invadens
DINQEKYS

SEQ ID NO: 2844700 - protein, 11 aa, Entamoeba invadens
DINRPSKKETI

SEQ ID NO: 2844701 - protein, 23 aa, Entamoeba invadens
DINSSLGKTRIKPGRGEKSLSMS

SEQ ID NO: 2844702 - protein, 13 aa, Entamoeba invadens
DINTAESSPSGNI

SEQ ID NO: 2844703 - protein, 6 aa, Entamoeba invadens
DINTIR

SEQ ID NO: 2844704 - protein, 7 aa, Entamoeba invadens
DINTNGS

SEQ ID NO: 2844705 - protein, 9 aa, Entamoeba invadens
DINTTSLPP

SEQ ID NO: 2844706 - protein, 4 aa, Entamoeba invadens
DIPA

SEQ ID NO: 2844707 - protein, 8 aa, Entamoeba invadens
DIPDESEV

SEQ ID NO: 2844708 - protein, 4 aa, Entamoeba invadens
DIPE

SEQ ID NO: 2844709 - protein, 7 aa, Entamoeba invadens
DIPEEEL

SEQ ID NO: 2844710 - protein, 5 aa, Entamoeba invadens
DIPEG

SEQ ID NO: 2844711 - protein, 5 aa, Entamoeba invadens
DIPEN

SEQ ID NO: 2844712 - protein, 5 aa, Entamoeba invadens
DIPGA

SEQ ID NO: 2844713 - protein, 9 aa, Entamoeba invadens
DIPIPSGSV

SEQ ID NO: 2844714 - protein, 4 aa, Entamoeba invadens
DIPK

SEQ ID NO: 2844715 - protein, 6 aa, Entamoeba invadens
DIPKDV

SEQ ID NO: 2844716 - protein, 7 aa, Entamoeba invadens
DIPKEEN

SEQ ID NO: 2844717 - protein, 5 aa, Entamoeba invadens
DIPKK

SEQ ID NO: 2844718 - protein, 14 aa, Entamoeba invadens
DIPKNAKRIGYNST

SEQ ID NO: 2844719 - protein, 4 aa, Entamoeba invadens
DIPN

SEQ ID NO: 2844720 - protein, 6 aa, Entamoeba invadens
DIPNET

SEQ ID NO: 2844721 - protein, 9 aa, Entamoeba invadens
DIPNGVKTI

SEQ ID NO: 2844722 - protein, 6 aa, Entamoeba invadens
DIPNSE

SEQ ID NO: 2844723 - protein, 7 aa, Entamoeba invadens
DIPNTTE

SEQ ID NO: 2844724 - protein, 7 aa, Entamoeba invadens
DIPPEKY

SEQ ID NO: 2844725 - protein, 7 aa, Entamoeba invadens
DIPPPSI

SEQ ID NO: 2844726 - protein, 5 aa, Entamoeba invadens
DIPPQ

SEQ ID NO: 2844727 - protein, 8 aa, Entamoeba invadens
DIPPSVSK

SEQ ID NO: 2844728 - protein, 5 aa, Entamoeba invadens
DIPPT

SEQ ID NO: 2844729 - protein, 9 aa, Entamoeba invadens
DIPQPSPII

SEQ ID NO: 2844730 - protein, 5 aa, Entamoeba invadens
DIPSE

SEQ ID NO: 2844731 - protein, 31 aa, Entamoeba invadens
DIPSEYSSDLCTSSDTDYSSDLSADTDVECR

SEQ ID NO: 2844732 - protein, 10 aa, Entamoeba invadens
DIPSNTVNRH

SEQ ID NO: 2844733 - protein, 5 aa, Entamoeba invadens
DIPSS

SEQ ID NO: 2844734 - protein, 11 aa, Entamoeba invadens
DIPSSITSIPD

SEQ ID NO: 2844735 - protein, 22 aa, Entamoeba invadens
DIPSSVKSIGDGCFDSHTLVNK

SEQ ID NO: 2844736 - protein, 9 aa, Entamoeba invadens
DIPSSVTEI

SEQ ID NO: 2844737 - protein, 4 aa, Entamoeba invadens
DIPT

SEQ ID NO: 2844738 - protein, 11 aa, Entamoeba invadens
DIPTKEGEDEK

SEQ ID NO: 2844739 - protein, 5 aa, Entamoeba invadens
DIPTN

SEQ ID NO: 2844740 - protein, 7 aa, Entamoeba invadens
DIPTSVS

SEQ ID NO: 2844741 - protein, 7 aa, Entamoeba invadens
DIPTTVT

SEQ ID NO: 2844742 - protein, 11 aa, Entamoeba invadens
DIPTYEADTEM

SEQ ID NO: 2844743 - protein, 4 aa, Entamoeba invadens
DIPV

SEQ ID NO: 2844744 - protein, 5 aa, Entamoeba invadens
DIPYI

SEQ ID NO: 2844745 - protein, 11 aa, Entamoeba invadens
DIQEKEKHLKE

SEQ ID NO: 2844746 - protein, 4 aa, Entamoeba invadens
DIQK

SEQ ID NO: 2844747 - protein, 5 aa, Entamoeba invadens
DIQKE

SEQ ID NO: 2844748 - protein, 10 aa, Entamoeba invadens
DIQNEENTPN

SEQ ID NO: 2844749 - protein, 18 aa, Entamoeba invadens
DIQSTPPPAYLSTQGGEF

SEQ ID NO: 2844750 - protein, 13 aa, Entamoeba invadens
DIQTNKEDINTTN

SEQ ID NO: 2844751 - protein, 6 aa, Entamoeba invadens
DIREKS

SEQ ID NO: 2844752 - protein, 7 aa, Entamoeba invadens
DIRERAK

SEQ ID NO: 2844753 - protein, 6 aa, Entamoeba invadens
DIRGSM

SEQ ID NO: 2844754 - protein, 10 aa, Entamoeba invadens
DIRGTTGTLR

SEQ ID NO: 2844755 - protein, 15 aa, Entamoeba invadens
DIRRRNSKRKTPSDA

SEQ ID NO: 2844756 - protein, 6 aa, Entamoeba invadens
DIRSSD

SEQ ID NO: 2844757 - protein, 17 aa, Entamoeba invadens
DIRTGQEFNSPENDDVR

SEQ ID NO: 2844758 - protein, 9 aa, Entamoeba invadens
DISAAEKEY

SEQ ID NO: 2844759 - protein, 11 aa, Entamoeba invadens
DISAGKRPQTL

SEQ ID NO: 2844760 - protein, 6 aa, Entamoeba invadens
DISEAE

SEQ ID NO: 2844761 - protein, 7 aa, Entamoeba invadens
DISEDGN

SEQ ID NO: 2844762 - protein, 8 aa, Entamoeba invadens
DISEEAGT

SEQ ID NO: 2844763 - protein, 7 aa, Entamoeba invadens
DISEERE

SEQ ID NO: 2844764 - protein, 9 aa, Entamoeba invadens
DISESNDNS

SEQ ID NO: 2844765 - protein, 6 aa, Entamoeba invadens
DISGEN

SEQ ID NO: 2844766 - protein, 7 aa, Entamoeba invadens
DISGINE

SEQ ID NO: 2844767 - protein, 13 aa, Entamoeba invadens
DISISTKKHKTMK

SEQ ID NO: 2844768 - protein, 4 aa, Entamoeba invadens
DISK

SEQ ID NO: 2844769 - protein, 12 aa, Entamoeba invadens
DISKDGEVDKQT

SEQ ID NO: 2844770 - protein, 7 aa, Entamoeba invadens
DISKSKE

SEQ ID NO: 2844771 - protein, 10 aa, Entamoeba invadens
DISKTAVEAI

SEQ ID NO: 2844772 - protein, 12 aa, Entamoeba invadens
DISNDSEKYHNK

SEQ ID NO: 2844773 - protein, 8 aa, Entamoeba invadens
DISNGKNC

SEQ ID NO: 2844774 - protein, 20 aa, Entamoeba invadens
DISNMEKKKGVKEKTSMRRC

SEQ ID NO: 2844775 - protein, 9 aa, Entamoeba invadens
DISNNPDNI

SEQ ID NO: 2844776 - protein, 5 aa, Entamoeba invadens
DISNP

SEQ ID NO: 2844777 - protein, 12 aa, Entamoeba invadens
DISQPTTKRSVE

SEQ ID NO: 2844778 - protein, 9 aa, Entamoeba invadens
DISQTEKDQ

SEQ ID NO: 2844779 - protein, 4 aa, Entamoeba invadens
DISS

SEQ ID NO: 2844780 - protein, 5 aa, Entamoeba invadens
DISSE

SEQ ID NO: 2844781 - protein, 7 aa, Entamoeba invadens
DISSENT

SEQ ID NO: 2844782 - protein, 9 aa, Entamoeba invadens
DISSESDKN

SEQ ID NO: 2844783 - protein, 30 aa, Entamoeba invadens
DISSGSDLSTKLNQEIESQKEINNKTNEEL

SEQ ID NO: 2844784 - protein, 7 aa, Entamoeba invadens
DISSNVD

SEQ ID NO: 2844785 - protein, 12 aa, Entamoeba invadens
DISSPKSTFTKK

SEQ ID NO: 2844786 - protein, 6 aa, Entamoeba invadens
DISSQY

SEQ ID NO: 2844787 - protein, 8 aa, Entamoeba invadens
DISSRDEI

SEQ ID NO: 2844788 - protein, 5 aa, Entamoeba invadens
DISTD

SEQ ID NO: 2844789 - protein, 32 aa, Entamoeba invadens
DISTLKSSHAQKVEEKNLERQNENTGGTTQDL

SEQ ID NO: 2844790 - protein, 8 aa, Entamoeba invadens
DISTNETA

SEQ ID NO: 2844791 - protein, 8 aa, Entamoeba invadens
DISTTRMS

SEQ ID NO: 2844792 - protein, 6 aa, Entamoeba invadens
DITAET

SEQ ID NO: 2844793 - protein, 15 aa, Entamoeba invadens
DITDNYDDVSNYINK

SEQ ID NO: 2844794 - protein, 7 aa, Entamoeba invadens
DITEGKD

SEQ ID NO: 2844795 - protein, 6 aa, Entamoeba invadens
DITHPI

SEQ ID NO: 2844796 - protein, 6 aa, Entamoeba invadens
DITKAK

SEQ ID NO: 2844797 - protein, 10 aa, Entamoeba invadens
DITKGKTAKE

SEQ ID NO: 2844798 - protein, 20 aa, Entamoeba invadens
DITKKDTKVPTRYPKMPTEI

SEQ ID NO: 2844799 - protein, 6 aa, Entamoeba invadens
DITKSA

SEQ ID NO: 2844800 - protein, 8 aa, Entamoeba invadens
DITNNYED

SEQ ID NO: 2844801 - protein, 9 aa, Entamoeba invadens
DITNPEKET

SEQ ID NO: 2844802 - protein, 7 aa, Entamoeba invadens
DITPGMS

SEQ ID NO: 2844803 - protein, 6 aa, Entamoeba invadens
DITPMG

SEQ ID NO: 2844804 - protein, 8 aa, Entamoeba invadens
DITPTDDP

SEQ ID NO: 2844805 - protein, 8 aa, Entamoeba invadens
DITQEENT

SEQ ID NO: 2844806 - protein, 5 aa, Entamoeba invadens
DITQI

SEQ ID NO: 2844807 - protein, 4 aa, Entamoeba invadens
DITS

SEQ ID NO: 2844808 - protein, 4 aa, Entamoeba invadens
DITT

SEQ ID NO: 2844809 - protein, 12 aa, Entamoeba invadens
DITTEEGKTLAE

SEQ ID NO: 2844810 - protein, 11 aa, Entamoeba invadens
DITVPPSVTSL

SEQ ID NO: 2844811 - protein, 19 aa, Entamoeba invadens
DIVEESSGSVSIQSPVTPN

SEQ ID NO: 2844812 - protein, 7 aa, Entamoeba invadens
DIVTPEE

SEQ ID NO: 2844813 - protein, 9 aa, Entamoeba invadens
DIYDDNDPI

SEQ ID NO: 2844814 - protein, 6 aa, Entamoeba invadens
DIYEGS

SEQ ID NO: 2844815 - protein, 11 aa, Entamoeba invadens
DIYESSEEEIE

SEQ ID NO: 2844816 - protein, 16 aa, Entamoeba invadens
DKADMKSRKDQKHIEE

SEQ ID NO: 2844817 - protein, 9 aa, Entamoeba invadens
DKADTKNET

SEQ ID NO: 2844818 - protein, 7 aa, Entamoeba invadens
DKAEALE

SEQ ID NO: 2844819 - protein, 8 aa, Entamoeba invadens
DKAGPGNC

SEQ ID NO: 2844820 - protein, 6 aa, Entamoeba invadens
DKAHTA

SEQ ID NO: 2844821 - protein, 22 aa, Entamoeba invadens
DKAKKQEKGSGKVTERGKEKCI

SEQ ID NO: 2844822 - protein, 8 aa, Entamoeba invadens
DKAKPGDR

SEQ ID NO: 2844823 - protein, 5 aa, Entamoeba invadens
DKALH

SEQ ID NO: 2844824 - protein, 9 aa, Entamoeba invadens
DKANAKLTD

SEQ ID NO: 2844825 - protein, 57 aa, Entamoeba invadens
DKANEEDNMVETPPSRSVSPVPDDHRNVKKEDLSNEKEDEEDQTSSDHIPEQNELKP

SEQ ID NO: 2844826 - protein, 16 aa, Entamoeba invadens
DKANGIKDTTASRRVP

SEQ ID NO: 2844827 - protein, 9 aa, Entamoeba invadens
DKANKRKVS

SEQ ID NO: 2844828 - protein, 37 aa, Entamoeba invadens
DKANNSMGSSSVALNPKEGESDSNNKEQPSEDETTEI

SEQ ID NO: 2844829 - protein, 14 aa, Entamoeba invadens
DKANSKLTDFGSSR

SEQ ID NO: 2844830 - protein, 5 aa, Entamoeba invadens
DKAPR

SEQ ID NO: 2844831 - protein, 11 aa, Entamoeba invadens
DKAQFKQKRDR

SEQ ID NO: 2844832 - protein, 14 aa, Entamoeba invadens
DKAQLQKEDEELRD

SEQ ID NO: 2844833 - protein, 8 aa, Entamoeba invadens
DKAQNVGV

SEQ ID NO: 2844834 - protein, 60 aa, Entamoeba invadens
DKAQQPQDHQQPTSQPPVNATPAKVPPKPKKEKKVKPEKKEKKEKKRKSDIDAKLSETIH

SEQ ID NO: 2844835 - protein, 5 aa, Entamoeba invadens
DKARL

SEQ ID NO: 2844836 - protein, 6 aa, Entamoeba invadens
DKASEN

SEQ ID NO: 2844837 - protein, 21 aa, Entamoeba invadens
DKASQSDKSESPSDNDATKQK

SEQ ID NO: 2844838 - protein, 13 aa, Entamoeba invadens
DKASYSYLKNFIC

SEQ ID NO: 2844839 - protein, 8 aa, Entamoeba invadens
DKATKSEA

SEQ ID NO: 2844840 - protein, 7 aa, Entamoeba invadens
DKATLID

SEQ ID NO: 2844841 - protein, 7 aa, Entamoeba invadens
DKATSGV

SEQ ID NO: 2844842 - protein, 7 aa, Entamoeba invadens
DKAVHPP

SEQ ID NO: 2844843 - protein, 21 aa, Entamoeba invadens
DKAYTSCEEIKSKDKGYTQSL

SEQ ID NO: 2844844 - protein, 7 aa, Entamoeba invadens
DKCESSH

SEQ ID NO: 2844845 - protein, 8 aa, Entamoeba invadens
DKCGEDNV

SEQ ID NO: 2844846 - protein, 9 aa, Entamoeba invadens
DKCRDDTST

SEQ ID NO: 2844847 - protein, 8 aa, Entamoeba invadens
DKCYTTQC

SEQ ID NO: 2844848 - protein, 4 aa, Entamoeba invadens
DKDA

SEQ ID NO: 2844849 - protein, 12 aa, Entamoeba invadens
DKDAFSNETEIR

SEQ ID NO: 2844850 - protein, 9 aa, Entamoeba invadens
DKDAITSVQ

SEQ ID NO: 2844851 - protein, 10 aa, Entamoeba invadens
DKDAREYAND

SEQ ID NO: 2844852 - protein, 5 aa, Entamoeba invadens
DKDDA

SEQ ID NO: 2844853 - protein, 6 aa, Entamoeba invadens
DKDDIE

SEQ ID NO: 2844854 - protein, 12 aa, Entamoeba invadens
DKDDIPADANGN

SEQ ID NO: 2844855 - protein, 5 aa, Entamoeba invadens
DKDDL

SEQ ID NO: 2844856 - protein, 9 aa, Entamoeba invadens
DKDDNCTKC

SEQ ID NO: 2844857 - protein, 24 aa, Entamoeba invadens
DKDEAVSKGKQLKTMEKVKRKMGQ

SEQ ID NO: 2844858 - protein, 8 aa, Entamoeba invadens
DKDEDGKL

SEQ ID NO: 2844859 - protein, 7 aa, Entamoeba invadens
DKDEHGM

SEQ ID NO: 2844860 - protein, 13 aa, Entamoeba invadens
DKDEKKSENKDEL

SEQ ID NO: 2844861 - protein, 20 aa, Entamoeba invadens
DKDEKRITESKPKRLNKDNN

SEQ ID NO: 2844862 - protein, 20 aa, Entamoeba invadens
DKDELSEQIEHDKKELDDLE

SEQ ID NO: 2844863 - protein, 9 aa, Entamoeba invadens
DKDEVSNTS

SEQ ID NO: 2844864 - protein, 38 aa, Entamoeba invadens
DKDEYNKYNNKDEDTKQTTTPQSDEKPKEEKNEQPEVD

SEQ ID NO: 2844865 - protein, 12 aa, Entamoeba invadens
DKDGKDTTKPLT

SEQ ID NO: 2844866 - protein, 9 aa, Entamoeba invadens
DKDGTISVS

SEQ ID NO: 2844867 - protein, 9 aa, Entamoeba invadens
DKDHNGYID

SEQ ID NO: 2844868 - protein, 4 aa, Entamoeba invadens
DKDI

SEQ ID NO: 2844869 - protein, 11 aa, Entamoeba invadens
DKDIENDPTLE

SEQ ID NO: 2844870 - protein, 6 aa, Entamoeba invadens
DKDIPF

SEQ ID NO: 2844871 - protein, 9 aa, Entamoeba invadens
DKDKDVKNE

SEQ ID NO: 2844872 - protein, 6 aa, Entamoeba invadens
DKDKEI

SEQ ID NO: 2844873 - protein, 6 aa, Entamoeba invadens
DKDKIA

SEQ ID NO: 2844874 - protein, 8 aa, Entamoeba invadens
DKDKKTVM

SEQ ID NO: 2844875 - protein, 9 aa, Entamoeba invadens
DKDKQCEDN

SEQ ID NO: 2844876 - protein, 9 aa, Entamoeba invadens
DKDKSGTLE

SEQ ID NO: 2844877 - protein, 11 aa, Entamoeba invadens
DKDKSNNLDEK

SEQ ID NO: 2844878 - protein, 11 aa, Entamoeba invadens
DKDKSNSLDEQ

SEQ ID NO: 2844879 - protein, 24 aa, Entamoeba invadens
DKDMKDMGSLSKGLQQVEKTGNNI

SEQ ID NO: 2844880 - protein, 7 aa, Entamoeba invadens
DKDNKFG

SEQ ID NO: 2844881 - protein, 16 aa, Entamoeba invadens
DKDNLGGQVEDEQLPP

SEQ ID NO: 2844882 - protein, 6 aa, Entamoeba invadens
DKDNNQ

SEQ ID NO: 2844883 - protein, 9 aa, Entamoeba invadens
DKDNQQDVI

SEQ ID NO: 2844884 - protein, 16 aa, Entamoeba invadens
DKDNSDSLSLDEAQEA

SEQ ID NO: 2844885 - protein, 8 aa, Entamoeba invadens
DKDNSSMA

SEQ ID NO: 2844886 - protein, 6 aa, Entamoeba invadens
DKDNWN

SEQ ID NO: 2844887 - protein, 8 aa, Entamoeba invadens
DKDNYAGF

SEQ ID NO: 2844888 - protein, 5 aa, Entamoeba invadens
DKDPI

SEQ ID NO: 2844889 - protein, 9 aa, Entamoeba invadens
DKDPKSLKS

SEQ ID NO: 2844890 - protein, 6 aa, Entamoeba invadens
DKDPKV

SEQ ID NO: 2844891 - protein, 7 aa, Entamoeba invadens
DKDPNHP

SEQ ID NO: 2844892 - protein, 7 aa, Entamoeba invadens
DKDRELK

SEQ ID NO: 2844893 - protein, 7 aa, Entamoeba invadens
DKDRKSI

SEQ ID NO: 2844894 - protein, 7 aa, Entamoeba invadens
DKDTFGD

SEQ ID NO: 2844895 - protein, 7 aa, Entamoeba invadens
DKDTHQH

SEQ ID NO: 2844896 - protein, 12 aa, Entamoeba invadens
DKDTNSNELDNE

SEQ ID NO: 2844897 - protein, 7 aa, Entamoeba invadens
DKDTPRL

SEQ ID NO: 2844898 - protein, 8 aa, Entamoeba invadens
DKDTPSTH

SEQ ID NO: 2844899 - protein, 5 aa, Entamoeba invadens
DKDTR

SEQ ID NO: 2844900 - protein, 8 aa, Entamoeba invadens
DKDVQEEL

SEQ ID NO: 2844901 - protein, 5 aa, Entamoeba invadens
DKDYI

SEQ ID NO: 2844902 - protein, 8 aa, Entamoeba invadens
DKDYTDTE

SEQ ID NO: 2844903 - protein, 5 aa, Entamoeba invadens
DKEAE

SEQ ID NO: 2844904 - protein, 15 aa, Entamoeba invadens
DKEALEEKEKKNIAP

SEQ ID NO: 2844905 - protein, 14 aa, Entamoeba invadens
DKEAQFKSDSIQRE

SEQ ID NO: 2844906 - protein, 7 aa, Entamoeba invadens
DKEAQKR

SEQ ID NO: 2844907 - protein, 5 aa, Entamoeba invadens
DKECA

SEQ ID NO: 2844908 - protein, 7 aa, Entamoeba invadens
DKEDDRR

SEQ ID NO: 2844909 - protein, 5 aa, Entamoeba invadens
DKEDF

SEQ ID NO: 2844910 - protein, 8 aa, Entamoeba invadens
DKEDPEFK

SEQ ID NO: 2844911 - protein, 7 aa, Entamoeba invadens
DKEDVAL

SEQ ID NO: 2844912 - protein, 7 aa, Entamoeba invadens
DKEEIDS

SEQ ID NO: 2844913 - protein, 6 aa, Entamoeba invadens
DKEEIG

SEQ ID NO: 2844914 - protein, 17 aa, Entamoeba invadens
DKEEKKNVNNTTKSNDI

SEQ ID NO: 2844915 - protein, 5 aa, Entamoeba invadens
DKEEL

SEQ ID NO: 2844916 - protein, 7 aa, Entamoeba invadens
DKEFEEM

SEQ ID NO: 2844917 - protein, 6 aa, Entamoeba invadens
DKEFKT

SEQ ID NO: 2844918 - protein, 4 aa, Entamoeba invadens
DKEG

SEQ ID NO: 2844919 - protein, 9 aa, Entamoeba invadens
DKEGGELRA

SEQ ID NO: 2844920 - protein, 9 aa, Entamoeba invadens
DKEGGETAL

SEQ ID NO: 2844921 - protein, 9 aa, Entamoeba invadens
DKEGKDEFE

SEQ ID NO: 2844922 - protein, 7 aa, Entamoeba invadens
DKEGQQK

SEQ ID NO: 2844923 - protein, 12 aa, Entamoeba invadens
DKEGVDKGIELR

SEQ ID NO: 2844924 - protein, 4 aa, Entamoeba invadens
DKEI

SEQ ID NO: 2844925 - protein, 7 aa, Entamoeba invadens
DKEIEAL

SEQ ID NO: 2844926 - protein, 8 aa, Entamoeba invadens
DKEIENKY

SEQ ID NO: 2844927 - protein, 8 aa, Entamoeba invadens
DKEIGKAM

SEQ ID NO: 2844928 - protein, 6 aa, Entamoeba invadens
DKEIKR

SEQ ID NO: 2844929 - protein, 5 aa, Entamoeba invadens
DKEIQ

SEQ ID NO: 2844930 - protein, 7 aa, Entamoeba invadens
DKEIQSR

SEQ ID NO: 2844931 - protein, 5 aa, Entamoeba invadens
DKEIT

SEQ ID NO: 2844932 - protein, 6 aa, Entamoeba invadens
DKEKAT

SEQ ID NO: 2844933 - protein, 9 aa, Entamoeba invadens
DKEKDNDAY

SEQ ID NO: 2844934 - protein, 8 aa, Entamoeba invadens
DKEKDTLR

SEQ ID NO: 2844935 - protein, 6 aa, Entamoeba invadens
DKEKEM

SEQ ID NO: 2844936 - protein, 15 aa, Entamoeba invadens
DKEKESEKTTGSVEG

SEQ ID NO: 2844937 - protein, 6 aa, Entamoeba invadens
DKEKEY

SEQ ID NO: 2844938 - protein, 8 aa, Entamoeba invadens
DKEKGGLF

SEQ ID NO: 2844939 - protein, 9 aa, Entamoeba invadens
DKEKGNSVI

SEQ ID NO: 2844940 - protein, 9 aa, Entamoeba invadens
DKEKIPSKK

SEQ ID NO: 2844941 - protein, 7 aa, Entamoeba invadens
DKEKRGF

SEQ ID NO: 2844942 - protein, 7 aa, Entamoeba invadens
DKEKRTQ

SEQ ID NO: 2844943 - protein, 10 aa, Entamoeba invadens
DKEKTSAREL

SEQ ID NO: 2844944 - protein, 10 aa, Entamoeba invadens
DKELDGSAKA

SEQ ID NO: 2844945 - protein, 13 aa, Entamoeba invadens
DKELHPPLSTEPE

SEQ ID NO: 2844946 - protein, 10 aa, Entamoeba invadens
DKELKKAEKT

SEQ ID NO: 2844947 - protein, 8 aa, Entamoeba invadens
DKEMNSSS

SEQ ID NO: 2844948 - protein, 8 aa, Entamoeba invadens
DKENEETA

SEQ ID NO: 2844949 - protein, 6 aa, Entamoeba invadens
DKENEF

SEQ ID NO: 2844950 - protein, 8 aa, Entamoeba invadens
DKENEKTF

SEQ ID NO: 2844951 - protein, 9 aa, Entamoeba invadens
DKENGENYF

SEQ ID NO: 2844952 - protein, 9 aa, Entamoeba invadens
DKENKETYD

SEQ ID NO: 2844953 - protein, 5 aa, Entamoeba invadens
DKENL

SEQ ID NO: 2844954 - protein, 7 aa, Entamoeba invadens
DKENLAE

SEQ ID NO: 2844955 - protein, 7 aa, Entamoeba invadens
DKENQSI

SEQ ID NO: 2844956 - protein, 15 aa, Entamoeba invadens
DKENRIPQTLEEKRN

SEQ ID NO: 2844957 - protein, 7 aa, Entamoeba invadens
DKENSRK

SEQ ID NO: 2844958 - protein, 19 aa, Entamoeba invadens
DKENTNKISETLNQTTSQL

SEQ ID NO: 2844959 - protein, 20 aa, Entamoeba invadens
DKENTNKISETLNQTTSQLY

SEQ ID NO: 2844960 - protein, 9 aa, Entamoeba invadens
DKEPNYQTA

SEQ ID NO: 2844961 - protein, 4 aa, Entamoeba invadens
DKEQ

SEQ ID NO: 2844962 - protein, 5 aa, Entamoeba invadens
DKEQL

SEQ ID NO: 2844963 - protein, 10 aa, Entamoeba invadens
DKEQLKTAKK

SEQ ID NO: 2844964 - protein, 12 aa, Entamoeba invadens
DKERKERKDSLV

SEQ ID NO: 2844965 - protein, 8 aa, Entamoeba invadens
DKERLPQV

SEQ ID NO: 2844966 - protein, 7 aa, Entamoeba invadens
DKERMEL

SEQ ID NO: 2844967 - protein, 7 aa, Entamoeba invadens
DKERPYI

SEQ ID NO: 2844968 - protein, 5 aa, Entamoeba invadens
DKERY

SEQ ID NO: 2844969 - protein, 9 aa, Entamoeba invadens
DKESASGKD

SEQ ID NO: 2844970 - protein, 13 aa, Entamoeba invadens
DKESESKDKNAQV

SEQ ID NO: 2844971 - protein, 16 aa, Entamoeba invadens
DKESKDNISVIVIDLT

SEQ ID NO: 2844972 - protein, 5 aa, Entamoeba invadens
DKESR

SEQ ID NO: 2844973 - protein, 8 aa, Entamoeba invadens
DKESRQGA

SEQ ID NO: 2844974 - protein, 8 aa, Entamoeba invadens
DKESYSNR

SEQ ID NO: 2844975 - protein, 7 aa, Entamoeba invadens
DKETADC

SEQ ID NO: 2844976 - protein, 12 aa, Entamoeba invadens
DKETARDIKERK

SEQ ID NO: 2844977 - protein, 6 aa, Entamoeba invadens
DKETEE

SEQ ID NO: 2844978 - protein, 9 aa, Entamoeba invadens
DKETFESAH

SEQ ID NO: 2844979 - protein, 8 aa, Entamoeba invadens
DKETHDKA

SEQ ID NO: 2844980 - protein, 9 aa, Entamoeba invadens
DKETPSSKK

SEQ ID NO: 2844981 - protein, 6 aa, Entamoeba invadens
DKETRD

SEQ ID NO: 2844982 - protein, 7 aa, Entamoeba invadens
DKETRKA

SEQ ID NO: 2844983 - protein, 9 aa, Entamoeba invadens
DKETSEYTR

SEQ ID NO: 2844984 - protein, 7 aa, Entamoeba invadens
DKEVGEN

SEQ ID NO: 2844985 - protein, 7 aa, Entamoeba invadens
DKEVGTF

SEQ ID NO: 2844986 - protein, 6 aa, Entamoeba invadens
DKEYKS

SEQ ID NO: 2844987 - protein, 7 aa, Entamoeba invadens
DKEYPAT

SEQ ID NO: 2844988 - protein, 4 aa, Entamoeba invadens
DKFD

SEQ ID NO: 2844989 - protein, 6 aa, Entamoeba invadens
DKFDYN

SEQ ID NO: 2844990 - protein, 10 aa, Entamoeba invadens
DKFEKPKEVQ

SEQ ID NO: 2844991 - protein, 6 aa, Entamoeba invadens
DKFKYA

SEQ ID NO: 2844992 - protein, 5 aa, Entamoeba invadens
DKFPG

SEQ ID NO: 2844993 - protein, 5 aa, Entamoeba invadens
DKFPN

SEQ ID NO: 2844994 - protein, 8 aa, Entamoeba invadens
DKFTATSA

SEQ ID NO: 2844995 - protein, 6 aa, Entamoeba invadens
DKFTES

SEQ ID NO: 2844996 - protein, 6 aa, Entamoeba invadens
DKFTSL

SEQ ID NO: 2844997 - protein, 4 aa, Entamoeba invadens
DKFY

SEQ ID NO: 2844998 - protein, 4 aa, Entamoeba invadens
DKGA

SEQ ID NO: 2844999 - protein, 15 aa, Entamoeba invadens
DKGDGKTEDVSTHKI

SEQ ID NO: 2845000 - protein, 6 aa, Entamoeba invadens
DKGDPF

SEQ ID NO: 2845001 - protein, 5 aa, Entamoeba invadens
DKGDS

SEQ ID NO: 2845002 - protein, 12 aa, Entamoeba invadens
DKGEEVKESMKQ

SEQ ID NO: 2845003 - protein, 6 aa, Entamoeba invadens
DKGEKL

SEQ ID NO: 2845004 - protein, 8 aa, Entamoeba invadens
DKGGRPER

SEQ ID NO: 2845005 - protein, 6 aa, Entamoeba invadens
DKGKGV

SEQ ID NO: 2845006 - protein, 8 aa, Entamoeba invadens
DKGKPVGE

SEQ ID NO: 2845007 - protein, 7 aa, Entamoeba invadens
DKGLQNR

SEQ ID NO: 2845008 - protein, 28 aa, Entamoeba invadens
DKGLSQAKHRRSVSSLAAESISKQLIPK

SEQ ID NO: 2845009 - protein, 15 aa, Entamoeba invadens
DKGNSLKKSERRESS

SEQ ID NO: 2845010 - protein, 16 aa, Entamoeba invadens
DKGNTQKRSERRGAAL

SEQ ID NO: 2845011 - protein, 7 aa, Entamoeba invadens
DKGPEFM

SEQ ID NO: 2845012 - protein, 8 aa, Entamoeba invadens
DKGPEVKA

SEQ ID NO: 2845013 - protein, 8 aa, Entamoeba invadens
DKGPNSNL

SEQ ID NO: 2845014 - protein, 6 aa, Entamoeba invadens
DKGPNV

SEQ ID NO: 2845015 - protein, 9 aa, Entamoeba invadens
DKGQGYTVA

SEQ ID NO: 2845016 - protein, 6 aa, Entamoeba invadens
DKGQKL

SEQ ID NO: 2845017 - protein, 7 aa, Entamoeba invadens
DKGSEGV

SEQ ID NO: 2845018 - protein, 6 aa, Entamoeba invadens
DKGTDA

SEQ ID NO: 2845019 - protein, 8 aa, Entamoeba invadens
DKGTFSNS

SEQ ID NO: 2845020 - protein, 7 aa, Entamoeba invadens
DKGTGIV

SEQ ID NO: 2845021 - protein, 8 aa, Entamoeba invadens
DKGTRTKE

SEQ ID NO: 2845022 - protein, 9 aa, Entamoeba invadens
DKGVNESQL

SEQ ID NO: 2845023 - protein, 19 aa, Entamoeba invadens
DKGYNLNTPEMKNAAKNIK

SEQ ID NO: 2845024 - protein, 7 aa, Entamoeba invadens
DKHASLT

SEQ ID NO: 2845025 - protein, 9 aa, Entamoeba invadens
DKHGEIKEI

SEQ ID NO: 2845026 - protein, 6 aa, Entamoeba invadens
DKHPTA

SEQ ID NO: 2845027 - protein, 18 aa, Entamoeba invadens
DKHQIARTSFEQSDSVRR

SEQ ID NO: 2845028 - protein, 10 aa, Entamoeba invadens
DKHSNEQKVT

SEQ ID NO: 2845029 - protein, 7 aa, Entamoeba invadens
DKHTITE

SEQ ID NO: 2845030 - protein, 5 aa, Entamoeba invadens
DKHTR

SEQ ID NO: 2845031 - protein, 20 aa, Entamoeba invadens
DKIAETKKSVDVTTVNDPSG

SEQ ID NO: 2845032 - protein, 10 aa, Entamoeba invadens
DKIASNTTEL

SEQ ID NO: 2845033 - protein, 4 aa, Entamoeba invadens
DKID

SEQ ID NO: 2845034 - protein, 9 aa, Entamoeba invadens
DKIDEANRT

SEQ ID NO: 2845035 - protein, 7 aa, Entamoeba invadens
DKIDKEN

SEQ ID NO: 2845036 - protein, 4 aa, Entamoeba invadens
DKIE

SEQ ID NO: 2845037 - protein, 8 aa, Entamoeba invadens
DKIEENEI

SEQ ID NO: 2845038 - protein, 24 aa, Entamoeba invadens
DKIENSPTVVSQSKKTISKTPQQF

SEQ ID NO: 2845039 - protein, 6 aa, Entamoeba invadens
DKIEPS

SEQ ID NO: 2845040 - protein, 5 aa, Entamoeba invadens
DKIGS

SEQ ID NO: 2845041 - protein, 4 aa, Entamoeba invadens
DKIN

SEQ ID NO: 2845042 - protein, 5 aa, Entamoeba invadens
DKINE

SEQ ID NO: 2845043 - protein, 6 aa, Entamoeba invadens
DKINEW

SEQ ID NO: 2845044 - protein, 9 aa, Entamoeba invadens
DKINRKTTP

SEQ ID NO: 2845045 - protein, 12 aa, Entamoeba invadens
DKIPETVQSTNR

SEQ ID NO: 2845046 - protein, 10 aa, Entamoeba invadens
DKIPNPQQNR

SEQ ID NO: 2845047 - protein, 6 aa, Entamoeba invadens
DKIQGE

SEQ ID NO: 2845048 - protein, 6 aa, Entamoeba invadens
DKIQGM

SEQ ID NO: 2845049 - protein, 11 aa, Entamoeba invadens
DKIQSSVNPSV

SEQ ID NO: 2845050 - protein, 7 aa, Entamoeba invadens
DKIRKEA

SEQ ID NO: 2845051 - protein, 19 aa, Entamoeba invadens
DKIRQEKSEIDLQRTETLS

SEQ ID NO: 2845052 - protein, 11 aa, Entamoeba invadens
DKIRSSLDTLS

SEQ ID NO: 2845053 - protein, 8 aa, Entamoeba invadens
DKITETKN

SEQ ID NO: 2845054 - protein, 6 aa, Entamoeba invadens
DKITFD

SEQ ID NO: 2845055 - protein, 5 aa, Entamoeba invadens
DKITT

SEQ ID NO: 2845056 - protein, 36 aa, Entamoeba invadens
DKITTELKTTKKRVDEITDELNTKRKENEKQKEEFE

SEQ ID NO: 2845057 - protein, 7 aa, Entamoeba invadens
DKKADSV

SEQ ID NO: 2845058 - protein, 81 aa, Entamoeba invadens
DKKAEKDRKIAEEKRKKEEAERKKKEEEERKKKEEEEKKKKEEEEKKKKEEAEKKAKEDAEKAKQPNQTENKENTQQAPQN

SEQ ID NO: 2845059 - protein, 18 aa, Entamoeba invadens
DKKAEKTTAKSLGTSNSK

SEQ ID NO: 2845060 - protein, 27 aa, Entamoeba invadens
DKKAKVEKEKKPKKEKDPNKPKKPASA

SEQ ID NO: 2845061 - protein, 14 aa, Entamoeba invadens
DKKARKKYSERKGW

SEQ ID NO: 2845062 - protein, 9 aa, Entamoeba invadens
DKKDAKLAE

SEQ ID NO: 2845063 - protein, 6 aa, Entamoeba invadens
DKKDEL

SEQ ID NO: 2845064 - protein, 10 aa, Entamoeba invadens
DKKDKDRVNK

SEQ ID NO: 2845065 - protein, 8 aa, Entamoeba invadens
DKKDSNSL

SEQ ID NO: 2845066 - protein, 7 aa, Entamoeba invadens
DKKDTDK

SEQ ID NO: 2845067 - protein, 7 aa, Entamoeba invadens
DKKEDRG

SEQ ID NO: 2845068 - protein, 11 aa, Entamoeba invadens
DKKEEIKNLET

SEQ ID NO: 2845069 - protein, 9 aa, Entamoeba invadens
DKKEENKGF

SEQ ID NO: 2845070 - protein, 8 aa, Entamoeba invadens
DKKEGVIE

SEQ ID NO: 2845071 - protein, 12 aa, Entamoeba invadens
DKKEHVERKAPV

SEQ ID NO: 2845072 - protein, 9 aa, Entamoeba invadens
DKKEIGDRK

SEQ ID NO: 2845073 - protein, 9 aa, Entamoeba invadens
DKKEKYPRV

SEQ ID NO: 2845074 - protein, 7 aa, Entamoeba invadens
DKKEPPV

SEQ ID NO: 2845075 - protein, 8 aa, Entamoeba invadens
DKKEQQRL

SEQ ID NO: 2845076 - protein, 5 aa, Entamoeba invadens
DKKER

SEQ ID NO: 2845077 - protein, 10 aa, Entamoeba invadens
DKKEVGNAFK

SEQ ID NO: 2845078 - protein, 14 aa, Entamoeba invadens
DKKEYEMKEREREN

SEQ ID NO: 2845079 - protein, 8 aa, Entamoeba invadens
DKKEYTTQ

SEQ ID NO: 2845080 - protein, 6 aa, Entamoeba invadens
DKKFGV

SEQ ID NO: 2845081 - protein, 4 aa, Entamoeba invadens
DKKG

SEQ ID NO: 2845082 - protein, 7 aa, Entamoeba invadens
DKKGAVV

SEQ ID NO: 2845083 - protein, 7 aa, Entamoeba invadens
DKKGERY

SEQ ID NO: 2845084 - protein, 7 aa, Entamoeba invadens
DKKGKDK

SEQ ID NO: 2845085 - protein, 8 aa, Entamoeba invadens
DKKGLTDI

SEQ ID NO: 2845086 - protein, 6 aa, Entamoeba invadens
DKKGMN

SEQ ID NO: 2845087 - protein, 11 aa, Entamoeba invadens
DKKGMSNFDST

SEQ ID NO: 2845088 - protein, 18 aa, Entamoeba invadens
DKKHEKIAQPKSKNVQKI

SEQ ID NO: 2845089 - protein, 4 aa, Entamoeba invadens
DKKI

SEQ ID NO: 2845090 - protein, 8 aa, Entamoeba invadens
DKKIGKDD

SEQ ID NO: 2845091 - protein, 6 aa, Entamoeba invadens
DKKIGT

SEQ ID NO: 2845092 - protein, 7 aa, Entamoeba invadens
DKKIKTA

SEQ ID NO: 2845093 - protein, 5 aa, Entamoeba invadens
DKKIW

SEQ ID NO: 2845094 - protein, 18 aa, Entamoeba invadens
DKKKDKLTRLTGRRNSIE

SEQ ID NO: 2845095 - protein, 14 aa, Entamoeba invadens
DKKKDTDKPEKVTE

SEQ ID NO: 2845096 - protein, 15 aa, Entamoeba invadens
DKKKGKKKCALPCVF

SEQ ID NO: 2845097 - protein, 9 aa, Entamoeba invadens
DKKKLTNNK

SEQ ID NO: 2845098 - protein, 18 aa, Entamoeba invadens
DKKKPLKPQDEKTKKDVI

SEQ ID NO: 2845099 - protein, 7 aa, Entamoeba invadens
DKKKYGD

SEQ ID NO: 2845100 - protein, 9 aa, Entamoeba invadens
DKKLEGTAF

SEQ ID NO: 2845101 - protein, 21 aa, Entamoeba invadens
DKKLEKPETPKVEPLKTSSAE

SEQ ID NO: 2845102 - protein, 12 aa, Entamoeba invadens
DKKLESKNNEEV

SEQ ID NO: 2845103 - protein, 8 aa, Entamoeba invadens
DKKLGEGS

SEQ ID NO: 2845104 - protein, 8 aa, Entamoeba invadens
DKKLGETS

SEQ ID NO: 2845105 - protein, 62 aa, Entamoeba invadens
DKKMRSEVQAPRERNDRPERTNDRVERKERPLNPERVDKPIERPIDRPERVDKYERSERSEI

SEQ ID NO: 2845106 - protein, 7 aa, Entamoeba invadens
DKKNEGY

SEQ ID NO: 2845107 - protein, 11 aa, Entamoeba invadens
DKKNEQRPRRV

SEQ ID NO: 2845108 - protein, 38 aa, Entamoeba invadens
DKKNKEIENLTTPSERPKSPIFGKPEKIEEPESQSENL

SEQ ID NO: 2845109 - protein, 8 aa, Entamoeba invadens
DKKNKFGG

SEQ ID NO: 2845110 - protein, 8 aa, Entamoeba invadens
DKKNNYIT

SEQ ID NO: 2845111 - protein, 12 aa, Entamoeba invadens
DKKNSLETTKKR

SEQ ID NO: 2845112 - protein, 10 aa, Entamoeba invadens
DKKPKKPSNI

SEQ ID NO: 2845113 - protein, 9 aa, Entamoeba invadens
DKKPLEELQ

SEQ ID NO: 2845114 - protein, 83 aa, Entamoeba invadens
DKKPRKDFKKGGYSDHKKPFSSGKKERSGDSAHKGQKGSRSEPTKNGFKRPNPFGEKVTTELKKEYKEKQQKKEAVDDASTQM

SEQ ID NO: 2845115 - protein, 8 aa, Entamoeba invadens
DKKPSEKI

SEQ ID NO: 2845116 - protein, 9 aa, Entamoeba invadens
DKKPTTVKT

SEQ ID NO: 2845117 - protein, 9 aa, Entamoeba invadens
DKKQEKTIE

SEQ ID NO: 2845118 - protein, 9 aa, Entamoeba invadens
DKKQLKEDV

SEQ ID NO: 2845119 - protein, 8 aa, Entamoeba invadens
DKKQRKDV

SEQ ID NO: 2845120 - protein, 27 aa, Entamoeba invadens
DKKRAIEKAMEGATAIPVTARGDFDQL

SEQ ID NO: 2845121 - protein, 8 aa, Entamoeba invadens
DKKRKIDQ

SEQ ID NO: 2845122 - protein, 15 aa, Entamoeba invadens
DKKRNAPDKEKNELL

SEQ ID NO: 2845123 - protein, 15 aa, Entamoeba invadens
DKKRPNENSVREQTR

SEQ ID NO: 2845124 - protein, 18 aa, Entamoeba invadens
DKKRSQSSREYTKKPSTF

SEQ ID NO: 2845125 - protein, 9 aa, Entamoeba invadens
DKKSKDEFY

SEQ ID NO: 2845126 - protein, 9 aa, Entamoeba invadens
DKKSKLNRL

SEQ ID NO: 2845127 - protein, 7 aa, Entamoeba invadens
DKKSSFK

SEQ ID NO: 2845128 - protein, 10 aa, Entamoeba invadens
DKKSSSDGQK

SEQ ID NO: 2845129 - protein, 9 aa, Entamoeba invadens
DKKTDEYGY

SEQ ID NO: 2845130 - protein, 6 aa, Entamoeba invadens
DKKTDI

SEQ ID NO: 2845131 - protein, 13 aa, Entamoeba invadens
DKKTENDEKLPLP

SEQ ID NO: 2845132 - protein, 9 aa, Entamoeba invadens
DKKTEREKN

SEQ ID NO: 2845133 - protein, 9 aa, Entamoeba invadens
DKKTGKTSL

SEQ ID NO: 2845134 - protein, 20 aa, Entamoeba invadens
DKKTKGTASKDSSVNSQDET

SEQ ID NO: 2845135 - protein, 21 aa, Entamoeba invadens
DKKTKSAAKEKDKDGKISELN

SEQ ID NO: 2845136 - protein, 15 aa, Entamoeba invadens
DKKTKVEDTLRKYGK

SEQ ID NO: 2845137 - protein, 7 aa, Entamoeba invadens
DKKTQQY

SEQ ID NO: 2845138 - protein, 8 aa, Entamoeba invadens
DKKTQSSL

SEQ ID NO: 2845139 - protein, 8 aa, Entamoeba invadens
DKKTVESA

SEQ ID NO: 2845140 - protein, 16 aa, Entamoeba invadens
DKKVQSKYDRRKASVE

SEQ ID NO: 2845141 - protein, 7 aa, Entamoeba invadens
DKKVSDV

SEQ ID NO: 2845142 - protein, 4 aa, Entamoeba invadens
DKKY

SEQ ID NO: 2845143 - protein, 16 aa, Entamoeba invadens
DKKYEEKVKILKQFGY

SEQ ID NO: 2845144 - protein, 4 aa, Entamoeba invadens
DKLD

SEQ ID NO: 2845145 - protein, 30 aa, Entamoeba invadens
DKLDEKLEKTGDAIQKQNETNSEKKLQQPA

SEQ ID NO: 2845146 - protein, 12 aa, Entamoeba invadens
DKLDEREREEEQ

SEQ ID NO: 2845147 - protein, 6 aa, Entamoeba invadens
DKLDKT

SEQ ID NO: 2845148 - protein, 10 aa, Entamoeba invadens
DKLDTDQDGY

SEQ ID NO: 2845149 - protein, 6 aa, Entamoeba invadens
DKLEEL

SEQ ID NO: 2845150 - protein, 18 aa, Entamoeba invadens
DKLEENLRSYETSQGGID

SEQ ID NO: 2845151 - protein, 11 aa, Entamoeba invadens
DKLEKSQGEYL

SEQ ID NO: 2845152 - protein, 6 aa, Entamoeba invadens
DKLGKE

SEQ ID NO: 2845153 - protein, 8 aa, Entamoeba invadens
DKLKEAEA

SEQ ID NO: 2845154 - protein, 7 aa, Entamoeba invadens
DKLKEAV

SEQ ID NO: 2845155 - protein, 13 aa, Entamoeba invadens
DKLKKDVKDRQEW

SEQ ID NO: 2845156 - protein, 11 aa, Entamoeba invadens
DKLKKTHKKSA

SEQ ID NO: 2845157 - protein, 5 aa, Entamoeba invadens
DKLKP

SEQ ID NO: 2845158 - protein, 19 aa, Entamoeba invadens
DKLKTQRGLYGPEETDENK

SEQ ID NO: 2845159 - protein, 12 aa, Entamoeba invadens
DKLNKSNGAITN

SEQ ID NO: 2845160 - protein, 13 aa, Entamoeba invadens
DKLNSLKKDNEEI

SEQ ID NO: 2845161 - protein, 16 aa, Entamoeba invadens
DKLPKDSTGRAEGSDC

SEQ ID NO: 2845162 - protein, 21 aa, Entamoeba invadens
DKLPSKDSKNLQHEKQGKTYS

SEQ ID NO: 2845163 - protein, 11 aa, Entamoeba invadens
DKLQEEERKRL

SEQ ID NO: 2845164 - protein, 26 aa, Entamoeba invadens
DKLQSKIEAKSDDKKSDAEIKPVNSV

SEQ ID NO: 2845165 - protein, 4 aa, Entamoeba invadens
DKLS

SEQ ID NO: 2845166 - protein, 9 aa, Entamoeba invadens
DKLSKHGDD

SEQ ID NO: 2845167 - protein, 10 aa, Entamoeba invadens
DKLSNENNEV

SEQ ID NO: 2845168 - protein, 10 aa, Entamoeba invadens
DKLSTNKQYE

SEQ ID NO: 2845169 - protein, 48 aa, Entamoeba invadens
DKLTADNLKKGIKPKRKFQPPYKKDDKDEKDQKQKPLPKEKKSGEEDI

SEQ ID NO: 2845170 - protein, 8 aa, Entamoeba invadens
DKLTDSEV

SEQ ID NO: 2845171 - protein, 10 aa, Entamoeba invadens
DKLTNEKNEV

SEQ ID NO: 2845172 - protein, 36 aa, Entamoeba invadens
DKLTNKTDGERPTVPPPRKSKKDEDNETKIAEQEHK

SEQ ID NO: 2845173 - protein, 7 aa, Entamoeba invadens
DKLTRDA

SEQ ID NO: 2845174 - protein, 12 aa, Entamoeba invadens
DKMAERSDYDYE

SEQ ID NO: 2845175 - protein, 5 aa, Entamoeba invadens
DKMAT

SEQ ID NO: 2845176 - protein, 29 aa, Entamoeba invadens
DKMCEERDDLKRANEQLQSDKTDLKNKYE

SEQ ID NO: 2845177 - protein, 9 aa, Entamoeba invadens
DKMDKTIYD

SEQ ID NO: 2845178 - protein, 7 aa, Entamoeba invadens
DKMEEDS

SEQ ID NO: 2845179 - protein, 6 aa, Entamoeba invadens
DKMKTE

SEQ ID NO: 2845180 - protein, 6 aa, Entamoeba invadens
DKMRDD

SEQ ID NO: 2845181 - protein, 10 aa, Entamoeba invadens
DKMRDSEKVF

SEQ ID NO: 2845182 - protein, 9 aa, Entamoeba invadens
DKMSPKQQE

SEQ ID NO: 2845183 - protein, 7 aa, Entamoeba invadens
DKMTDKI

SEQ ID NO: 2845184 - protein, 8 aa, Entamoeba invadens
DKMTKEDL

SEQ ID NO: 2845185 - protein, 4 aa, Entamoeba invadens
DKNA

SEQ ID NO: 2845186 - protein, 7 aa, Entamoeba invadens
DKNATSY

SEQ ID NO: 2845187 - protein, 9 aa, Entamoeba invadens
DKNDKRTKF

SEQ ID NO: 2845188 - protein, 7 aa, Entamoeba invadens
DKNDSEK

SEQ ID NO: 2845189 - protein, 9 aa, Entamoeba invadens
DKNDTKKLV

SEQ ID NO: 2845190 - protein, 7 aa, Entamoeba invadens
DKNDYTQ

SEQ ID NO: 2845191 - protein, 8 aa, Entamoeba invadens
DKNEITYN

SEQ ID NO: 2845192 - protein, 5 aa, Entamoeba invadens
DKNEK

SEQ ID NO: 2845193 - protein, 5 aa, Entamoeba invadens
DKNEL

SEQ ID NO: 2845194 - protein, 15 aa, Entamoeba invadens
DKNENLAANFLLDGF

SEQ ID NO: 2845195 - protein, 6 aa, Entamoeba invadens
DKNETI

SEQ ID NO: 2845196 - protein, 14 aa, Entamoeba invadens
DKNETKKEENVETR

SEQ ID NO: 2845197 - protein, 6 aa, Entamoeba invadens
DKNFGN

SEQ ID NO: 2845198 - protein, 9 aa, Entamoeba invadens
DKNGDGNLD

SEQ ID NO: 2845199 - protein, 8 aa, Entamoeba invadens
DKNGNKFG

SEQ ID NO: 2845200 - protein, 7 aa, Entamoeba invadens
DKNGRLY

SEQ ID NO: 2845201 - protein, 7 aa, Entamoeba invadens
DKNGRRD

SEQ ID NO: 2845202 - protein, 7 aa, Entamoeba invadens
DKNGTID

SEQ ID NO: 2845203 - protein, 8 aa, Entamoeba invadens
DKNGTIDE

SEQ ID NO: 2845204 - protein, 6 aa, Entamoeba invadens
DKNHDN

SEQ ID NO: 2845205 - protein, 5 aa, Entamoeba invadens
DKNIE

SEQ ID NO: 2845206 - protein, 7 aa, Entamoeba invadens
DKNISDK

SEQ ID NO: 2845207 - protein, 21 aa, Entamoeba invadens
DKNISEQKDAKKDDKNRFIPT

SEQ ID NO: 2845208 - protein, 8 aa, Entamoeba invadens
DKNISSTI

SEQ ID NO: 2845209 - protein, 10 aa, Entamoeba invadens
DKNKDPEKLT

SEQ ID NO: 2845210 - protein, 41 aa, Entamoeba invadens
DKNKPQTPTNTPQPPQQPTSPTLQSTQHPLPPPSPSQERRR

SEQ ID NO: 2845211 - protein, 51 aa, Entamoeba invadens
DKNKPVENQPKQEEQQVDNKNESLKPLDDVKTDLKDDKNFAEPEPKNETVI

SEQ ID NO: 2845212 - protein, 22 aa, Entamoeba invadens
DKNKQVQEKRSKKTQTKTKTIS

SEQ ID NO: 2845213 - protein, 11 aa, Entamoeba invadens
DKNKRKYTNTR

SEQ ID NO: 2845214 - protein, 7 aa, Entamoeba invadens
DKNLGGI

SEQ ID NO: 2845215 - protein, 10 aa, Entamoeba invadens
DKNNEEKTIE

SEQ ID NO: 2845216 - protein, 11 aa, Entamoeba invadens
DKNNKQMKVEE

SEQ ID NO: 2845217 - protein, 7 aa, Entamoeba invadens
DKNNLAA

SEQ ID NO: 2845218 - protein, 6 aa, Entamoeba invadens
DKNNQI

SEQ ID NO: 2845219 - protein, 46 aa, Entamoeba invadens
DKNNTKKKGGVVKRDQKEIEDSDEEGLDPAEQEDDRVHNEKREKLE

SEQ ID NO: 2845220 - protein, 8 aa, Entamoeba invadens
DKNNTMSS

SEQ ID NO: 2845221 - protein, 6 aa, Entamoeba invadens
DKNPQI

SEQ ID NO: 2845222 - protein, 8 aa, Entamoeba invadens
DKNPSVPL

SEQ ID NO: 2845223 - protein, 9 aa, Entamoeba invadens
DKNPTRNSI

SEQ ID NO: 2845224 - protein, 7 aa, Entamoeba invadens
DKNQTLK

SEQ ID NO: 2845225 - protein, 6 aa, Entamoeba invadens
DKNQYT

SEQ ID NO: 2845226 - protein, 4 aa, Entamoeba invadens
DKNR

SEQ ID NO: 2845227 - protein, 10 aa, Entamoeba invadens
DKNRFRDSQT

SEQ ID NO: 2845228 - protein, 7 aa, Entamoeba invadens
DKNRGKK

SEQ ID NO: 2845229 - protein, 8 aa, Entamoeba invadens
DKNRNTYN

SEQ ID NO: 2845230 - protein, 4 aa, Entamoeba invadens
DKNS

SEQ ID NO: 2845231 - protein, 17 aa, Entamoeba invadens
DKNSDSFEQYITSIIDK

SEQ ID NO: 2845232 - protein, 11 aa, Entamoeba invadens
DKNSKDDQMGV

SEQ ID NO: 2845233 - protein, 9 aa, Entamoeba invadens
DKNSPFKRL

SEQ ID NO: 2845234 - protein, 17 aa, Entamoeba invadens
DKNSTENYEKKNNSNYC

SEQ ID NO: 2845235 - protein, 5 aa, Entamoeba invadens
DKNTF

SEQ ID NO: 2845236 - protein, 6 aa, Entamoeba invadens
DKNTFS

SEQ ID NO: 2845237 - protein, 10 aa, Entamoeba invadens
DKNTSDCDEI

SEQ ID NO: 2845238 - protein, 23 aa, Entamoeba invadens
DKNTTEKGFEKEEEYDGKNEAKW

SEQ ID NO: 2845239 - protein, 23 aa, Entamoeba invadens
DKNTTNKDEKKEEKGDENPEEKL

SEQ ID NO: 2845240 - protein, 4 aa, Entamoeba invadens
DKNV

SEQ ID NO: 2845241 - protein, 12 aa, Entamoeba invadens
DKNVDDDGAKAI

SEQ ID NO: 2845242 - protein, 7 aa, Entamoeba invadens
DKNVKGI

SEQ ID NO: 2845243 - protein, 8 aa, Entamoeba invadens
DKNVTKEQ

SEQ ID NO: 2845244 - protein, 13 aa, Entamoeba invadens
DKNYKRKREERMR

SEQ ID NO: 2845245 - protein, 12 aa, Entamoeba invadens
DKNYREEKRRCS

SEQ ID NO: 2845246 - protein, 14 aa, Entamoeba invadens
DKPAAAAANKPTRA

SEQ ID NO: 2845247 - protein, 4 aa, Entamoeba invadens
DKPD

SEQ ID NO: 2845248 - protein, 5 aa, Entamoeba invadens
DKPDE

SEQ ID NO: 2845249 - protein, 6 aa, Entamoeba invadens
DKPDFS

SEQ ID NO: 2845250 - protein, 5 aa, Entamoeba invadens
DKPDG

SEQ ID NO: 2845251 - protein, 6 aa, Entamoeba invadens
DKPDGY

SEQ ID NO: 2845252 - protein, 7 aa, Entamoeba invadens
DKPDTQN

SEQ ID NO: 2845253 - protein, 7 aa, Entamoeba invadens
DKPEFDE

SEQ ID NO: 2845254 - protein, 10 aa, Entamoeba invadens
DKPEGKERTF

SEQ ID NO: 2845255 - protein, 5 aa, Entamoeba invadens
DKPEL

SEQ ID NO: 2845256 - protein, 20 aa, Entamoeba invadens
DKPETNLRDDKENLVGTSQA

SEQ ID NO: 2845257 - protein, 5 aa, Entamoeba invadens
DKPEV

SEQ ID NO: 2845258 - protein, 18 aa, Entamoeba invadens
DKPKDVTDIAKPKSLSTI

SEQ ID NO: 2845259 - protein, 6 aa, Entamoeba invadens
DKPKEM

SEQ ID NO: 2845260 - protein, 7 aa, Entamoeba invadens
DKPKPNH

SEQ ID NO: 2845261 - protein, 7 aa, Entamoeba invadens
DKPKQIT

SEQ ID NO: 2845262 - protein, 11 aa, Entamoeba invadens
DKPKQRKLRKN

SEQ ID NO: 2845263 - protein, 4 aa, Entamoeba invadens
DKPL

SEQ ID NO: 2845264 - protein, 24 aa, Entamoeba invadens
DKPLEEKKVAKGVKLDTELSAEDM

SEQ ID NO: 2845265 - protein, 46 aa, Entamoeba invadens
DKPLSPPANNSKNIKSAKKTKKSKKSTKRSNYFPDKKSKKLQDDDL

SEQ ID NO: 2845266 - protein, 23 aa, Entamoeba invadens
DKPNEPQGDALQETKETEKEETL

SEQ ID NO: 2845267 - protein, 8 aa, Entamoeba invadens
DKPNHGTI

SEQ ID NO: 2845268 - protein, 8 aa, Entamoeba invadens
DKPNSLSD

SEQ ID NO: 2845269 - protein, 8 aa, Entamoeba invadens
DKPPKGTI

SEQ ID NO: 2845270 - protein, 13 aa, Entamoeba invadens
DKPPLQQQKTEDG

SEQ ID NO: 2845271 - protein, 9 aa, Entamoeba invadens
DKPQPKGSP

SEQ ID NO: 2845272 - protein, 8 aa, Entamoeba invadens
DKPRNAET

SEQ ID NO: 2845273 - protein, 7 aa, Entamoeba invadens
DKPSFAA

SEQ ID NO: 2845274 - protein, 5 aa, Entamoeba invadens
DKPSH

SEQ ID NO: 2845275 - protein, 24 aa, Entamoeba invadens
DKPSKRGETKDPEEMGLDDKELKE

SEQ ID NO: 2845276 - protein, 10 aa, Entamoeba invadens
DKPSTPTTPL

SEQ ID NO: 2845277 - protein, 4 aa, Entamoeba invadens
DKPT

SEQ ID NO: 2845278 - protein, 7 aa, Entamoeba invadens
DKPTFET

SEQ ID NO: 2845279 - protein, 6 aa, Entamoeba invadens
DKPTIV

SEQ ID NO: 2845280 - protein, 6 aa, Entamoeba invadens
DKPTNV

SEQ ID NO: 2845281 - protein, 9 aa, Entamoeba invadens
DKPTPVQRQ

SEQ ID NO: 2845282 - protein, 16 aa, Entamoeba invadens
DKPTTGVFNKLKKRCE

SEQ ID NO: 2845283 - protein, 7 aa, Entamoeba invadens
DKPVDLS

SEQ ID NO: 2845284 - protein, 6 aa, Entamoeba invadens
DKPVSG

SEQ ID NO: 2845285 - protein, 5 aa, Entamoeba invadens
DKPWK

SEQ ID NO: 2845286 - protein, 8 aa, Entamoeba invadens
DKPYDPQT

SEQ ID NO: 2845287 - protein, 7 aa, Entamoeba invadens
DKPYPRL

SEQ ID NO: 2845288 - protein, 14 aa, Entamoeba invadens
DKQAFGGLDTSNNL

SEQ ID NO: 2845289 - protein, 7 aa, Entamoeba invadens
DKQDQIK

SEQ ID NO: 2845290 - protein, 5 aa, Entamoeba invadens
DKQEE

SEQ ID NO: 2845291 - protein, 10 aa, Entamoeba invadens
DKQEERNTQV

SEQ ID NO: 2845292 - protein, 6 aa, Entamoeba invadens
DKQETI

SEQ ID NO: 2845293 - protein, 6 aa, Entamoeba invadens
DKQHEQ

SEQ ID NO: 2845294 - protein, 7 aa, Entamoeba invadens
DKQINEA

SEQ ID NO: 2845295 - protein, 7 aa, Entamoeba invadens
DKQKAMA

SEQ ID NO: 2845296 - protein, 7 aa, Entamoeba invadens
DKQKCGD

SEQ ID NO: 2845297 - protein, 11 aa, Entamoeba invadens
DKQKEKTYGGH

SEQ ID NO: 2845298 - protein, 18 aa, Entamoeba invadens
DKQKLEEKMTTKDAEMQK

SEQ ID NO: 2845299 - protein, 7 aa, Entamoeba invadens
DKQLKGS

SEQ ID NO: 2845300 - protein, 4 aa, Entamoeba invadens
DKQN

SEQ ID NO: 2845301 - protein, 5 aa, Entamoeba invadens
DKQNA

SEQ ID NO: 2845302 - protein, 8 aa, Entamoeba invadens
DKQNAGTL

SEQ ID NO: 2845303 - protein, 9 aa, Entamoeba invadens
DKQNAVHNG

SEQ ID NO: 2845304 - protein, 5 aa, Entamoeba invadens
DKQNV

SEQ ID NO: 2845305 - protein, 7 aa, Entamoeba invadens
DKQNYAA

SEQ ID NO: 2845306 - protein, 6 aa, Entamoeba invadens
DKQQQN

SEQ ID NO: 2845307 - protein, 6 aa, Entamoeba invadens
DKQQVV

SEQ ID NO: 2845308 - protein, 8 aa, Entamoeba invadens
DKQRPKRL

SEQ ID NO: 2845309 - protein, 5 aa, Entamoeba invadens
DKQSD

SEQ ID NO: 2845310 - protein, 7 aa, Entamoeba invadens
DKQTEHD

SEQ ID NO: 2845311 - protein, 7 aa, Entamoeba invadens
DKQTEYD

SEQ ID NO: 2845312 - protein, 7 aa, Entamoeba invadens
DKQTSVA

SEQ ID NO: 2845313 - protein, 7 aa, Entamoeba invadens
DKQTTVS

SEQ ID NO: 2845314 - protein, 15 aa, Entamoeba invadens
DKQTVQQKSPMAYKK

SEQ ID NO: 2845315 - protein, 7 aa, Entamoeba invadens
DKQYKDV

SEQ ID NO: 2845316 - protein, 6 aa, Entamoeba invadens
DKQYPE

SEQ ID NO: 2845317 - protein, 9 aa, Entamoeba invadens
DKRDFENAE

SEQ ID NO: 2845318 - protein, 6 aa, Entamoeba invadens
DKRDRV

SEQ ID NO: 2845319 - protein, 12 aa, Entamoeba invadens
DKRDVGSSMSSL

SEQ ID NO: 2845320 - protein, 18 aa, Entamoeba invadens
DKRKFEDNAREWTRMYAR

SEQ ID NO: 2845321 - protein, 7 aa, Entamoeba invadens
DKRKVDN

SEQ ID NO: 2845322 - protein, 18 aa, Entamoeba invadens
DKRNADRRAKTTGEGMRK

SEQ ID NO: 2845323 - protein, 11 aa, Entamoeba invadens
DKRNDREGNDT

SEQ ID NO: 2845324 - protein, 11 aa, Entamoeba invadens
DKRNKTSKYTI

SEQ ID NO: 2845325 - protein, 9 aa, Entamoeba invadens
DKRNSTKDS

SEQ ID NO: 2845326 - protein, 7 aa, Entamoeba invadens
DKRQRSF

SEQ ID NO: 2845327 - protein, 12 aa, Entamoeba invadens
DKRSASLSAKVA

SEQ ID NO: 2845328 - protein, 7 aa, Entamoeba invadens
DKRSDTW

SEQ ID NO: 2845329 - protein, 9 aa, Entamoeba invadens
DKRSQNPLS

SEQ ID NO: 2845330 - protein, 4 aa, Entamoeba invadens
DKRT

SEQ ID NO: 2845331 - protein, 5 aa, Entamoeba invadens
DKRTI

SEQ ID NO: 2845332 - protein, 5 aa, Entamoeba invadens
DKRTK

SEQ ID NO: 2845333 - protein, 9 aa, Entamoeba invadens
DKRTKEKKS

SEQ ID NO: 2845334 - protein, 8 aa, Entamoeba invadens
DKRTKEQF

SEQ ID NO: 2845335 - protein, 24 aa, Entamoeba invadens
DKRTYDKLTSSSSTFGNLEGRPSF

SEQ ID NO: 2845336 - protein, 14 aa, Entamoeba invadens
DKRVENIKKQKTYF

SEQ ID NO: 2845337 - protein, 11 aa, Entamoeba invadens
DKRYSKECADA

SEQ ID NO: 2845338 - protein, 9 aa, Entamoeba invadens
DKSDANRLR

SEQ ID NO: 2845339 - protein, 8 aa, Entamoeba invadens
DKSDDTTA

SEQ ID NO: 2845340 - protein, 7 aa, Entamoeba invadens
DKSDEDL

SEQ ID NO: 2845341 - protein, 11 aa, Entamoeba invadens
DKSEAKKLDMK

SEQ ID NO: 2845342 - protein, 9 aa, Entamoeba invadens
DKSEEDVKE

SEQ ID NO: 2845343 - protein, 10 aa, Entamoeba invadens
DKSEINSMSA

SEQ ID NO: 2845344 - protein, 5 aa, Entamoeba invadens
DKSEQ

SEQ ID NO: 2845345 - protein, 6 aa, Entamoeba invadens
DKSESI

SEQ ID NO: 2845346 - protein, 9 aa, Entamoeba invadens
DKSEYCKQT

SEQ ID NO: 2845347 - protein, 7 aa, Entamoeba invadens
DKSEYEF

SEQ ID NO: 2845348 - protein, 7 aa, Entamoeba invadens
DKSGIPD

SEQ ID NO: 2845349 - protein, 17 aa, Entamoeba invadens
DKSGKCVKPTNCDRVDN

SEQ ID NO: 2845350 - protein, 12 aa, Entamoeba invadens
DKSGLKKQADDA

SEQ ID NO: 2845351 - protein, 9 aa, Entamoeba invadens
DKSGSNNEL

SEQ ID NO: 2845352 - protein, 13 aa, Entamoeba invadens
DKSIRDNWPETPI

SEQ ID NO: 2845353 - protein, 7 aa, Entamoeba invadens
DKSIRKL

SEQ ID NO: 2845354 - protein, 6 aa, Entamoeba invadens
DKSISK

SEQ ID NO: 2845355 - protein, 4 aa, Entamoeba invadens
DKSK

SEQ ID NO: 2845356 - protein, 16 aa, Entamoeba invadens
DKSKDERRFNTPTSNE

SEQ ID NO: 2845357 - protein, 9 aa, Entamoeba invadens
DKSKDKQIS

SEQ ID NO: 2845358 - protein, 8 aa, Entamoeba invadens
DKSKIDEK

SEQ ID NO: 2845359 - protein, 9 aa, Entamoeba invadens
DKSKINEKM

SEQ ID NO: 2845360 - protein, 10 aa, Entamoeba invadens
DKSKITQGTR

SEQ ID NO: 2845361 - protein, 11 aa, Entamoeba invadens
DKSKKVGRATG

SEQ ID NO: 2845362 - protein, 7 aa, Entamoeba invadens
DKSKNLH

SEQ ID NO: 2845363 - protein, 5 aa, Entamoeba invadens
DKSKP

SEQ ID NO: 2845364 - protein, 5 aa, Entamoeba invadens
DKSKY

SEQ ID NO: 2845365 - protein, 7 aa, Entamoeba invadens
DKSNDKV

SEQ ID NO: 2845366 - protein, 13 aa, Entamoeba invadens
DKSNEKVSSDLTK

SEQ ID NO: 2845367 - protein, 8 aa, Entamoeba invadens
DKSNKVPS

SEQ ID NO: 2845368 - protein, 11 aa, Entamoeba invadens
DKSNTQDIPKI

SEQ ID NO: 2845369 - protein, 17 aa, Entamoeba invadens
DKSPFLSSTDCQRREKR

SEQ ID NO: 2845370 - protein, 9 aa, Entamoeba invadens
DKSPRLQKA

SEQ ID NO: 2845371 - protein, 7 aa, Entamoeba invadens
DKSPSQR

SEQ ID NO: 2845372 - protein, 8 aa, Entamoeba invadens
DKSPVKRK

SEQ ID NO: 2845373 - protein, 4 aa, Entamoeba invadens
DKSQ

SEQ ID NO: 2845374 - protein, 6 aa, Entamoeba invadens
DKSQKE

SEQ ID NO: 2845375 - protein, 7 aa, Entamoeba invadens
DKSQYIA

SEQ ID NO: 2845376 - protein, 4 aa, Entamoeba invadens
DKSR

SEQ ID NO: 2845377 - protein, 11 aa, Entamoeba invadens
DKSRVDAITTK

SEQ ID NO: 2845378 - protein, 26 aa, Entamoeba invadens
DKSSFNTSLSDTSFSCQSSTLTTYNE

SEQ ID NO: 2845379 - protein, 8 aa, Entamoeba invadens
DKSSKNCE

SEQ ID NO: 2845380 - protein, 21 aa, Entamoeba invadens
DKSSSPSMKPIQPSPSPSIPL

SEQ ID NO: 2845381 - protein, 7 aa, Entamoeba invadens
DKSSSVS

SEQ ID NO: 2845382 - protein, 7 aa, Entamoeba invadens
DKSSTAR

SEQ ID NO: 2845383 - protein, 7 aa, Entamoeba invadens
DKSSVRP

SEQ ID NO: 2845384 - protein, 7 aa, Entamoeba invadens
DKSTASL

SEQ ID NO: 2845385 - protein, 6 aa, Entamoeba invadens
DKSTLK

SEQ ID NO: 2845386 - protein, 21 aa, Entamoeba invadens
DKSTNGTYINNERTQRGQAQE

SEQ ID NO: 2845387 - protein, 8 aa, Entamoeba invadens
DKSTTDDV

SEQ ID NO: 2845388 - protein, 15 aa, Entamoeba invadens
DKSVAGFDSRSKRST

SEQ ID NO: 2845389 - protein, 5 aa, Entamoeba invadens
DKSVF

SEQ ID NO: 2845390 - protein, 9 aa, Entamoeba invadens
DKSVNENNQ

SEQ ID NO: 2845391 - protein, 23 aa, Entamoeba invadens
DKSVQQRKLHQGGDMTIGTQEEI

SEQ ID NO: 2845392 - protein, 6 aa, Entamoeba invadens
DKSVQS

SEQ ID NO: 2845393 - protein, 9 aa, Entamoeba invadens
DKSVSVGKG

SEQ ID NO: 2845394 - protein, 29 aa, Entamoeba invadens
DKSVTKKMGKQSHKQTSSLSQENLQTKPH

SEQ ID NO: 2845395 - protein, 5 aa, Entamoeba invadens
DKSVV

SEQ ID NO: 2845396 - protein, 6 aa, Entamoeba invadens
DKSWKL

SEQ ID NO: 2845397 - protein, 15 aa, Entamoeba invadens
DKSYDIPKQKLRPSM

SEQ ID NO: 2845398 - protein, 5 aa, Entamoeba invadens
DKSYK

SEQ ID NO: 2845399 - protein, 6 aa, Entamoeba invadens
DKTAHA

SEQ ID NO: 2845400 - protein, 8 aa, Entamoeba invadens
DKTAKKTF

SEQ ID NO: 2845401 - protein, 9 aa, Entamoeba invadens
DKTAKQTKK

SEQ ID NO: 2845402 - protein, 8 aa, Entamoeba invadens
DKTAKRAQ

SEQ ID NO: 2845403 - protein, 8 aa, Entamoeba invadens
DKTALPKS

SEQ ID NO: 2845404 - protein, 7 aa, Entamoeba invadens
DKTAMRK

SEQ ID NO: 2845405 - protein, 8 aa, Entamoeba invadens
DKTASNQC

SEQ ID NO: 2845406 - protein, 7 aa, Entamoeba invadens
DKTASSI

SEQ ID NO: 2845407 - protein, 9 aa, Entamoeba invadens
DKTATPNPA

SEQ ID NO: 2845408 - protein, 22 aa, Entamoeba invadens
DKTDDEKTAANQSDRKKKMEDQ

SEQ ID NO: 2845409 - protein, 8 aa, Entamoeba invadens
DKTDESDK

SEQ ID NO: 2845410 - protein, 8 aa, Entamoeba invadens
DKTDGQKF

SEQ ID NO: 2845411 - protein, 14 aa, Entamoeba invadens
DKTDKPFPKSLEIV

SEQ ID NO: 2845412 - protein, 5 aa, Entamoeba invadens
DKTDN

SEQ ID NO: 2845413 - protein, 7 aa, Entamoeba invadens
DKTDSTI

SEQ ID NO: 2845414 - protein, 9 aa, Entamoeba invadens
DKTDTSNFN

SEQ ID NO: 2845415 - protein, 8 aa, Entamoeba invadens
DKTDVSNF

SEQ ID NO: 2845416 - protein, 6 aa, Entamoeba invadens
DKTEDI

SEQ ID NO: 2845417 - protein, 13 aa, Entamoeba invadens
DKTEGKKTVSPQG

SEQ ID NO: 2845418 - protein, 19 aa, Entamoeba invadens
DKTEKKPKLIEDEKKFPKV

SEQ ID NO: 2845419 - protein, 24 aa, Entamoeba invadens
DKTEKKRVAKMESKTTKAPEQKVY

SEQ ID NO: 2845420 - protein, 5 aa, Entamoeba invadens
DKTEN

SEQ ID NO: 2845421 - protein, 5 aa, Entamoeba invadens
DKTEP

SEQ ID NO: 2845422 - protein, 10 aa, Entamoeba invadens
DKTERDRLED

SEQ ID NO: 2845423 - protein, 6 aa, Entamoeba invadens
DKTETM

SEQ ID NO: 2845424 - protein, 5 aa, Entamoeba invadens
DKTEV

SEQ ID NO: 2845425 - protein, 4 aa, Entamoeba invadens
DKTF

SEQ ID NO: 2845426 - protein, 9 aa, Entamoeba invadens
DKTGDPIFS

SEQ ID NO: 2845427 - protein, 15 aa, Entamoeba invadens
DKTGKEVTTGSSDGH

SEQ ID NO: 2845428 - protein, 12 aa, Entamoeba invadens
DKTGNGKLDSSE

SEQ ID NO: 2845429 - protein, 8 aa, Entamoeba invadens
DKTGNGKV

SEQ ID NO: 2845430 - protein, 5 aa, Entamoeba invadens
DKTGP

SEQ ID NO: 2845431 - protein, 7 aa, Entamoeba invadens
DKTGQNQ

SEQ ID NO: 2845432 - protein, 9 aa, Entamoeba invadens
DKTGRNTTE

SEQ ID NO: 2845433 - protein, 8 aa, Entamoeba invadens
DKTGTHAR

SEQ ID NO: 2845434 - protein, 9 aa, Entamoeba invadens
DKTHKYGTQ

SEQ ID NO: 2845435 - protein, 6 aa, Entamoeba invadens
DKTHVS

SEQ ID NO: 2845436 - protein, 12 aa, Entamoeba invadens
DKTIEDSPLSDR

SEQ ID NO: 2845437 - protein, 5 aa, Entamoeba invadens
DKTIL

SEQ ID NO: 2845438 - protein, 7 aa, Entamoeba invadens
DKTIPST

SEQ ID NO: 2845439 - protein, 20 aa, Entamoeba invadens
DKTITNQKAKPVMNEEERTA

SEQ ID NO: 2845440 - protein, 10 aa, Entamoeba invadens
DKTKEERELL

SEQ ID NO: 2845441 - protein, 9 aa, Entamoeba invadens
DKTKEISEL

SEQ ID NO: 2845442 - protein, 9 aa, Entamoeba invadens
DKTKELPEV

SEQ ID NO: 2845443 - protein, 6 aa, Entamoeba invadens
DKTKER

SEQ ID NO: 2845444 - protein, 9 aa, Entamoeba invadens
DKTKIPDSG

SEQ ID NO: 2845445 - protein, 7 aa, Entamoeba invadens
DKTKKNY

SEQ ID NO: 2845446 - protein, 8 aa, Entamoeba invadens
DKTKRERD

SEQ ID NO: 2845447 - protein, 9 aa, Entamoeba invadens
DKTKSVTDA

SEQ ID NO: 2845448 - protein, 10 aa, Entamoeba invadens
DKTKTATQKV

SEQ ID NO: 2845449 - protein, 16 aa, Entamoeba invadens
DKTKTNCTSCKNGTFL

SEQ ID NO: 2845450 - protein, 9 aa, Entamoeba invadens
DKTKYSPYT

SEQ ID NO: 2845451 - protein, 4 aa, Entamoeba invadens
DKTL

SEQ ID NO: 2845452 - protein, 6 aa, Entamoeba invadens
DKTLHT

SEQ ID NO: 2845453 - protein, 29 aa, Entamoeba invadens
DKTLNAGAKIAKGVASKINDNSGDGTTTA

SEQ ID NO: 2845454 - protein, 17 aa, Entamoeba invadens
DKTLPSNSETKIDVANA

SEQ ID NO: 2845455 - protein, 14 aa, Entamoeba invadens
DKTMDGSVSRKRYV

SEQ ID NO: 2845456 - protein, 8 aa, Entamoeba invadens
DKTMLENK

SEQ ID NO: 2845457 - protein, 10 aa, Entamoeba invadens
DKTNNTKEKL

SEQ ID NO: 2845458 - protein, 9 aa, Entamoeba invadens
DKTNQKARN

SEQ ID NO: 2845459 - protein, 10 aa, Entamoeba invadens
DKTNTAVQCN

SEQ ID NO: 2845460 - protein, 6 aa, Entamoeba invadens
DKTNTD

SEQ ID NO: 2845461 - protein, 7 aa, Entamoeba invadens
DKTNTEA

SEQ ID NO: 2845462 - protein, 9 aa, Entamoeba invadens
DKTNTFPKD

SEQ ID NO: 2845463 - protein, 6 aa, Entamoeba invadens
DKTNVD

SEQ ID NO: 2845464 - protein, 5 aa, Entamoeba invadens
DKTNY

SEQ ID NO: 2845465 - protein, 8 aa, Entamoeba invadens
DKTPEEVK

SEQ ID NO: 2845466 - protein, 7 aa, Entamoeba invadens
DKTPENY

SEQ ID NO: 2845467 - protein, 19 aa, Entamoeba invadens
DKTPIEQESSVELPPPGTS

SEQ ID NO: 2845468 - protein, 9 aa, Entamoeba invadens
DKTPSRRTH

SEQ ID NO: 2845469 - protein, 7 aa, Entamoeba invadens
DKTPSRV

SEQ ID NO: 2845470 - protein, 8 aa, Entamoeba invadens
DKTQDREN

SEQ ID NO: 2845471 - protein, 15 aa, Entamoeba invadens
DKTQNELRTATERLR

SEQ ID NO: 2845472 - protein, 11 aa, Entamoeba invadens
DKTQNIDTTKE

SEQ ID NO: 2845473 - protein, 28 aa, Entamoeba invadens
DKTQQEKIKNEEELKRVQKNKEKVESDL

SEQ ID NO: 2845474 - protein, 8 aa, Entamoeba invadens
DKTQTNVH

SEQ ID NO: 2845475 - protein, 6 aa, Entamoeba invadens
DKTRAA

SEQ ID NO: 2845476 - protein, 5 aa, Entamoeba invadens
DKTRE

SEQ ID NO: 2845477 - protein, 7 aa, Entamoeba invadens
DKTREPL

SEQ ID NO: 2845478 - protein, 12 aa, Entamoeba invadens
DKTRLEESIANG

SEQ ID NO: 2845479 - protein, 8 aa, Entamoeba invadens
DKTRVERK

SEQ ID NO: 2845480 - protein, 10 aa, Entamoeba invadens
DKTSDKKLYG

SEQ ID NO: 2845481 - protein, 6 aa, Entamoeba invadens
DKTSEV

SEQ ID NO: 2845482 - protein, 8 aa, Entamoeba invadens
DKTSGKKL

SEQ ID NO: 2845483 - protein, 11 aa, Entamoeba invadens
DKTSKLNSDNV

SEQ ID NO: 2845484 - protein, 8 aa, Entamoeba invadens
DKTSLGKY

SEQ ID NO: 2845485 - protein, 8 aa, Entamoeba invadens
DKTSLTLP

SEQ ID NO: 2845486 - protein, 8 aa, Entamoeba invadens
DKTSPKTR

SEQ ID NO: 2845487 - protein, 7 aa, Entamoeba invadens
DKTSQDL

SEQ ID NO: 2845488 - protein, 10 aa, Entamoeba invadens
DKTSTPSTME

SEQ ID NO: 2845489 - protein, 7 aa, Entamoeba invadens
DKTTEEA

SEQ ID NO: 2845490 - protein, 7 aa, Entamoeba invadens
DKTTEEE

SEQ ID NO: 2845491 - protein, 11 aa, Entamoeba invadens
DKTTESLNEGQ

SEQ ID NO: 2845492 - protein, 9 aa, Entamoeba invadens
DKTTETPQI

SEQ ID NO: 2845493 - protein, 8 aa, Entamoeba invadens
DKTTGGNA

SEQ ID NO: 2845494 - protein, 6 aa, Entamoeba invadens
DKTTNV

SEQ ID NO: 2845495 - protein, 7 aa, Entamoeba invadens
DKTTPRL

SEQ ID NO: 2845496 - protein, 9 aa, Entamoeba invadens
DKTVDKSQE

SEQ ID NO: 2845497 - protein, 5 aa, Entamoeba invadens
DKTVE

SEQ ID NO: 2845498 - protein, 8 aa, Entamoeba invadens
DKTVESVY

SEQ ID NO: 2845499 - protein, 10 aa, Entamoeba invadens
DKTVKESPHF

SEQ ID NO: 2845500 - protein, 4 aa, Entamoeba invadens
DKTY

SEQ ID NO: 2845501 - protein, 7 aa, Entamoeba invadens
DKTYEPM

SEQ ID NO: 2845502 - protein, 7 aa, Entamoeba invadens
DKTYIET

SEQ ID NO: 2845503 - protein, 5 aa, Entamoeba invadens
DKTYP

SEQ ID NO: 2845504 - protein, 6 aa, Entamoeba invadens
DKTYYS

SEQ ID NO: 2845505 - protein, 10 aa, Entamoeba invadens
DKVAQRQRRF

SEQ ID NO: 2845506 - protein, 15 aa, Entamoeba invadens
DKVDDSEDFANKTNT

SEQ ID NO: 2845507 - protein, 24 aa, Entamoeba invadens
DKVEPKSEETKDEQETANPSTEIK

SEQ ID NO: 2845508 - protein, 7 aa, Entamoeba invadens
DKVEVDS

SEQ ID NO: 2845509 - protein, 9 aa, Entamoeba invadens
DKVGSDHVN

SEQ ID NO: 2845510 - protein, 15 aa, Entamoeba invadens
DKVKEIEEALKDENN

SEQ ID NO: 2845511 - protein, 8 aa, Entamoeba invadens
DKVKETNA

SEQ ID NO: 2845512 - protein, 13 aa, Entamoeba invadens
DKVNAKLTDFGSA

SEQ ID NO: 2845513 - protein, 15 aa, Entamoeba invadens
DKVNAKLTDFGSSRN

SEQ ID NO: 2845514 - protein, 21 aa, Entamoeba invadens
DKVNAKLTDYGSRRNDILLMT

SEQ ID NO: 2845515 - protein, 10 aa, Entamoeba invadens
DKVPRRTKAV

SEQ ID NO: 2845516 - protein, 9 aa, Entamoeba invadens
DKVPTTEFT

SEQ ID NO: 2845517 - protein, 6 aa, Entamoeba invadens
DKVQGE

SEQ ID NO: 2845518 - protein, 40 aa, Entamoeba invadens
DKVSDDSDAGDFDDEEKEDDDEDSQDDLPPPQNRVYTLDD

SEQ ID NO: 2845519 - protein, 5 aa, Entamoeba invadens
DKVSH

SEQ ID NO: 2845520 - protein, 17 aa, Entamoeba invadens
DKVTDNKSGTKSVSQQM

SEQ ID NO: 2845521 - protein, 6 aa, Entamoeba invadens
DKVTQD

SEQ ID NO: 2845522 - protein, 7 aa, Entamoeba invadens
DKVTSLG

SEQ ID NO: 2845523 - protein, 9 aa, Entamoeba invadens
DKVVASSKD

SEQ ID NO: 2845524 - protein, 5 aa, Entamoeba invadens
DKVVP

SEQ ID NO: 2845525 - protein, 7 aa, Entamoeba invadens
DKWAKGE

SEQ ID NO: 2845526 - protein, 14 aa, Entamoeba invadens
DKWNSAKNSVENGL

SEQ ID NO: 2845527 - protein, 12 aa, Entamoeba invadens
DKYDDDKMISED

SEQ ID NO: 2845528 - protein, 17 aa, Entamoeba invadens
DKYDDDKMISEDEVTSM

SEQ ID NO: 2845529 - protein, 16 aa, Entamoeba invadens
DKYDDDKMISEDEVTT

SEQ ID NO: 2845530 - protein, 33 aa, Entamoeba invadens
DKYDDSEMTDSDEDTDDSDQDDSEDYEELIDED

SEQ ID NO: 2845531 - protein, 11 aa, Entamoeba invadens
DKYDRELKSES

SEQ ID NO: 2845532 - protein, 10 aa, Entamoeba invadens
DKYEDEEKTY

SEQ ID NO: 2845533 - protein, 10 aa, Entamoeba invadens
DKYEDLSDKV

SEQ ID NO: 2845534 - protein, 8 aa, Entamoeba invadens
DKYEKEDY

SEQ ID NO: 2845535 - protein, 6 aa, Entamoeba invadens
DKYEPT

SEQ ID NO: 2845536 - protein, 7 aa, Entamoeba invadens
DKYETNV

SEQ ID NO: 2845537 - protein, 5 aa, Entamoeba invadens
DKYGD

SEQ ID NO: 2845538 - protein, 14 aa, Entamoeba invadens
DKYGDSDVEKVTKD

SEQ ID NO: 2845539 - protein, 4 aa, Entamoeba invadens
DKYK

SEQ ID NO: 2845540 - protein, 5 aa, Entamoeba invadens
DKYKE

SEQ ID NO: 2845541 - protein, 26 aa, Entamoeba invadens
DKYKLASTDSPNTLKEFQKKGKDTTI

SEQ ID NO: 2845542 - protein, 9 aa, Entamoeba invadens
DKYKTLKDG

SEQ ID NO: 2845543 - protein, 20 aa, Entamoeba invadens
DKYLARAGTSFSSCEEPTAV

SEQ ID NO: 2845544 - protein, 12 aa, Entamoeba invadens
DKYNEKATEKDM

SEQ ID NO: 2845545 - protein, 6 aa, Entamoeba invadens
DKYNES

SEQ ID NO: 2845546 - protein, 11 aa, Entamoeba invadens
DKYNKNQKAID

SEQ ID NO: 2845547 - protein, 43 aa, Entamoeba invadens
DKYNKRKFKKASKPVEAPKEVKKDEKKEEKVKKPKDEEKEAMK

SEQ ID NO: 2845548 - protein, 7 aa, Entamoeba invadens
DKYPKMS

SEQ ID NO: 2845549 - protein, 5 aa, Entamoeba invadens
DKYPN

SEQ ID NO: 2845550 - protein, 5 aa, Entamoeba invadens
DKYRD

SEQ ID NO: 2845551 - protein, 9 aa, Entamoeba invadens
DKYRKKTKL

SEQ ID NO: 2845552 - protein, 7 aa, Entamoeba invadens
DKYRTPK

SEQ ID NO: 2845553 - protein, 6 aa, Entamoeba invadens
DKYSSL

SEQ ID NO: 2845554 - protein, 11 aa, Entamoeba invadens
DKYTKSADISS

SEQ ID NO: 2845555 - protein, 11 aa, Entamoeba invadens
DKYTSKSDLYS

SEQ ID NO: 2845556 - protein, 8 aa, Entamoeba invadens
DKYVGEDE

SEQ ID NO: 2845557 - protein, 13 aa, Entamoeba invadens
DLAKETTSKQYEE

SEQ ID NO: 2845558 - protein, 11 aa, Entamoeba invadens
DLAKNRQVSLE

SEQ ID NO: 2845559 - protein, 9 aa, Entamoeba invadens
DLANNPQVQ

SEQ ID NO: 2845560 - protein, 9 aa, Entamoeba invadens
DLAPPGKKG

SEQ ID NO: 2845561 - protein, 8 aa, Entamoeba invadens
DLAPPPLD

SEQ ID NO: 2845562 - protein, 13 aa, Entamoeba invadens
DLAQEKISEEKKI

SEQ ID NO: 2845563 - protein, 11 aa, Entamoeba invadens
DLAQTKTFPAS

SEQ ID NO: 2845564 - protein, 5 aa, Entamoeba invadens
DLASA

SEQ ID NO: 2845565 - protein, 7 aa, Entamoeba invadens
DLASESG

SEQ ID NO: 2845566 - protein, 31 aa, Entamoeba invadens
DLDDESSDDEMLNPRYKSKSIRKVPTKRMKK

SEQ ID NO: 2845567 - protein, 6 aa, Entamoeba invadens
DLDDKY

SEQ ID NO: 2845568 - protein, 8 aa, Entamoeba invadens
DLDDSNQM

SEQ ID NO: 2845569 - protein, 22 aa, Entamoeba invadens
DLDEDEEGDEVVKRSTTPSNYK

SEQ ID NO: 2845570 - protein, 20 aa, Entamoeba invadens
DLDEDQKEIERADDEEAKER

SEQ ID NO: 2845571 - protein, 23 aa, Entamoeba invadens
DLDERLKTEKSKTVLSAAKKTQK

SEQ ID NO: 2845572 - protein, 17 aa, Entamoeba invadens
DLDGDGKIGLHDFLSIV

SEQ ID NO: 2845573 - protein, 7 aa, Entamoeba invadens
DLDGKID

SEQ ID NO: 2845574 - protein, 14 aa, Entamoeba invadens
DLDGSDKVTKQSDL

SEQ ID NO: 2845575 - protein, 12 aa, Entamoeba invadens
DLDNEATQATQM

SEQ ID NO: 2845576 - protein, 15 aa, Entamoeba invadens
DLDQVNDKKEPRPTN

SEQ ID NO: 2845577 - protein, 8 aa, Entamoeba invadens
DLDSPNLN

SEQ ID NO: 2845578 - protein, 4 aa, Entamoeba invadens
DLDT

SEQ ID NO: 2845579 - protein, 7 aa, Entamoeba invadens
DLDTDNQ

SEQ ID NO: 2845580 - protein, 11 aa, Entamoeba invadens
DLDTERQITTQ

SEQ ID NO: 2845581 - protein, 4 aa, Entamoeba invadens
DLDV

SEQ ID NO: 2845582 - protein, 8 aa, Entamoeba invadens
DLEATAKK

SEQ ID NO: 2845583 - protein, 4 aa, Entamoeba invadens
DLED

SEQ ID NO: 2845584 - protein, 18 aa, Entamoeba invadens
DLEDERAVTVEQGQELAN

SEQ ID NO: 2845585 - protein, 15 aa, Entamoeba invadens
DLEDERDSNESLKGK

SEQ ID NO: 2845586 - protein, 15 aa, Entamoeba invadens
DLEDEVKDEQDDELA

SEQ ID NO: 2845587 - protein, 5 aa, Entamoeba invadens
DLEDK

SEQ ID NO: 2845588 - protein, 9 aa, Entamoeba invadens
DLEDQRQTN

SEQ ID NO: 2845589 - protein, 8 aa, Entamoeba invadens
DLEDTGSF

SEQ ID NO: 2845590 - protein, 18 aa, Entamoeba invadens
DLEEDYDDTNSYDESERL

SEQ ID NO: 2845591 - protein, 11 aa, Entamoeba invadens
DLEEQGSTALG

SEQ ID NO: 2845592 - protein, 7 aa, Entamoeba invadens
DLEEQKE

SEQ ID NO: 2845593 - protein, 18 aa, Entamoeba invadens
DLEGSRSVTKEDAEAYAR

SEQ ID NO: 2845594 - protein, 7 aa, Entamoeba invadens
DLEKKSG

SEQ ID NO: 2845595 - protein, 6 aa, Entamoeba invadens
DLEKKT

SEQ ID NO: 2845596 - protein, 5 aa, Entamoeba invadens
DLENE

SEQ ID NO: 2845597 - protein, 17 aa, Entamoeba invadens
DLENERQVSMKQGTDLA

SEQ ID NO: 2845598 - protein, 17 aa, Entamoeba invadens
DLENKRQVSVKQGTDLA

SEQ ID NO: 2845599 - protein, 8 aa, Entamoeba invadens
DLENNLES

SEQ ID NO: 2845600 - protein, 7 aa, Entamoeba invadens
DLENQAR

SEQ ID NO: 2845601 - protein, 24 aa, Entamoeba invadens
DLENQIKADPKSADEKTKATLETY

SEQ ID NO: 2845602 - protein, 7 aa, Entamoeba invadens
DLEPDSL

SEQ ID NO: 2845603 - protein, 6 aa, Entamoeba invadens
DLEPQR

SEQ ID NO: 2845604 - protein, 7 aa, Entamoeba invadens
DLEPTQV

SEQ ID NO: 2845605 - protein, 23 aa, Entamoeba invadens
DLEQNEKAEIENVKGELKGISEL

SEQ ID NO: 2845606 - protein, 13 aa, Entamoeba invadens
DLERERKRAPETS

SEQ ID NO: 2845607 - protein, 5 aa, Entamoeba invadens
DLESE

SEQ ID NO: 2845608 - protein, 18 aa, Entamoeba invadens
DLESERQVQTSEAQKLAD

SEQ ID NO: 2845609 - protein, 18 aa, Entamoeba invadens
DLESERQVQTTEAKKLAD

SEQ ID NO: 2845610 - protein, 17 aa, Entamoeba invadens
DLESERRIQSKEAQNIA

SEQ ID NO: 2845611 - protein, 17 aa, Entamoeba invadens
DLESERRIQSNEAQNIA

SEQ ID NO: 2845612 - protein, 7 aa, Entamoeba invadens
DLESHPV

SEQ ID NO: 2845613 - protein, 5 aa, Entamoeba invadens
DLESN

SEQ ID NO: 2845614 - protein, 6 aa, Entamoeba invadens
DLESNR

SEQ ID NO: 2845615 - protein, 5 aa, Entamoeba invadens
DLESQ

SEQ ID NO: 2845616 - protein, 9 aa, Entamoeba invadens
DLESSTEIS

SEQ ID NO: 2845617 - protein, 4 aa, Entamoeba invadens
DLET

SEQ ID NO: 2845618 - protein, 20 aa, Entamoeba invadens
DLETERQVTKEEATAYAQQK

SEQ ID NO: 2845619 - protein, 7 aa, Entamoeba invadens
DLETGKR

SEQ ID NO: 2845620 - protein, 7 aa, Entamoeba invadens
DLETIGE

SEQ ID NO: 2845621 - protein, 12 aa, Entamoeba invadens
DLETKTSAEDLE

SEQ ID NO: 2845622 - protein, 6 aa, Entamoeba invadens
DLETSG

SEQ ID NO: 2845623 - protein, 4 aa, Entamoeba invadens
DLFD

SEQ ID NO: 2845624 - protein, 7 aa, Entamoeba invadens
DLGEKTS

SEQ ID NO: 2845625 - protein, 14 aa, Entamoeba invadens
DLGESAKAVQYAEG

SEQ ID NO: 2845626 - protein, 7 aa, Entamoeba invadens
DLGGYDT

SEQ ID NO: 2845627 - protein, 4 aa, Entamoeba invadens
DLGH

SEQ ID NO: 2845628 - protein, 15 aa, Entamoeba invadens
DLGKREVTQKEAIAK

SEQ ID NO: 2845629 - protein, 18 aa, Entamoeba invadens
DLGNERTVPTAKGKALAD

SEQ ID NO: 2845630 - protein, 9 aa, Entamoeba invadens
DLGSDQYKE

SEQ ID NO: 2845631 - protein, 11 aa, Entamoeba invadens
DLGVTPAGTTL

SEQ ID NO: 2845632 - protein, 13 aa, Entamoeba invadens
DLHPELTGTNENI

SEQ ID NO: 2845633 - protein, 8 aa, Entamoeba invadens
DLHTSPKQ

SEQ ID NO: 2845634 - protein, 8 aa, Entamoeba invadens
DLIGENDT

SEQ ID NO: 2845635 - protein, 14 aa, Entamoeba invadens
DLISGKKGLYQESG

SEQ ID NO: 2845636 - protein, 12 aa, Entamoeba invadens
DLKAHDKAIDEK

SEQ ID NO: 2845637 - protein, 28 aa, Entamoeba invadens
DLKDDAAKGAEREQKLKDENKTLSDELE

SEQ ID NO: 2845638 - protein, 8 aa, Entamoeba invadens
DLKDGTDF

SEQ ID NO: 2845639 - protein, 16 aa, Entamoeba invadens
DLKEKYSKKKEKSQNI

SEQ ID NO: 2845640 - protein, 7 aa, Entamoeba invadens
DLKENND

SEQ ID NO: 2845641 - protein, 4 aa, Entamoeba invadens
DLKF

SEQ ID NO: 2845642 - protein, 7 aa, Entamoeba invadens
DLKGEID

SEQ ID NO: 2845643 - protein, 14 aa, Entamoeba invadens
DLKGQSKSKEEDFS

SEQ ID NO: 2845644 - protein, 4 aa, Entamoeba invadens
DLKK

SEQ ID NO: 2845645 - protein, 9 aa, Entamoeba invadens
DLKKDNEKF

SEQ ID NO: 2845646 - protein, 38 aa, Entamoeba invadens
DLKKKTKKATKAHNEKKPRKVSDYQKTKKLRKMIRKSR

SEQ ID NO: 2845647 - protein, 9 aa, Entamoeba invadens
DLKKQEKSL

SEQ ID NO: 2845648 - protein, 4 aa, Entamoeba invadens
DLKN

SEQ ID NO: 2845649 - protein, 9 aa, Entamoeba invadens
DLKNGQHSF

SEQ ID NO: 2845650 - protein, 26 aa, Entamoeba invadens
DLKNQNETLQNEKEEVVKKNEEMQKD

SEQ ID NO: 2845651 - protein, 13 aa, Entamoeba invadens
DLKNQTPPPFEPG

SEQ ID NO: 2845652 - protein, 7 aa, Entamoeba invadens
DLKPGNI

SEQ ID NO: 2845653 - protein, 8 aa, Entamoeba invadens
DLKPNGGE

SEQ ID NO: 2845654 - protein, 6 aa, Entamoeba invadens
DLKPSV

SEQ ID NO: 2845655 - protein, 11 aa, Entamoeba invadens
DLKQEQEEHAR

SEQ ID NO: 2845656 - protein, 8 aa, Entamoeba invadens
DLKQPKFG

SEQ ID NO: 2845657 - protein, 5 aa, Entamoeba invadens
DLKSD

SEQ ID NO: 2845658 - protein, 7 aa, Entamoeba invadens
DLKSPGV

SEQ ID NO: 2845659 - protein, 14 aa, Entamoeba invadens
DLKTAQETKAVPTH

SEQ ID NO: 2845660 - protein, 7 aa, Entamoeba invadens
DLKTEES

SEQ ID NO: 2845661 - protein, 10 aa, Entamoeba invadens
DLKTGNSKAA

SEQ ID NO: 2845662 - protein, 7 aa, Entamoeba invadens
DLKTTND

SEQ ID NO: 2845663 - protein, 4 aa, Entamoeba invadens
DLMN

SEQ ID NO: 2845664 - protein, 13 aa, Entamoeba invadens
DLNARNKTGETPL

SEQ ID NO: 2845665 - protein, 10 aa, Entamoeba invadens
DLNDSQKNAV

SEQ ID NO: 2845666 - protein, 4 aa, Entamoeba invadens
DLNE

SEQ ID NO: 2845667 - protein, 11 aa, Entamoeba invadens
DLNEEGSVRTK

SEQ ID NO: 2845668 - protein, 7 aa, Entamoeba invadens
DLNEEKR

SEQ ID NO: 2845669 - protein, 5 aa, Entamoeba invadens
DLNEI

SEQ ID NO: 2845670 - protein, 6 aa, Entamoeba invadens
DLNESL

SEQ ID NO: 2845671 - protein, 12 aa, Entamoeba invadens
DLNGEKKDCQVD

SEQ ID NO: 2845672 - protein, 11 aa, Entamoeba invadens
DLNKEDNSGIS

SEQ ID NO: 2845673 - protein, 7 aa, Entamoeba invadens
DLNNEAD

SEQ ID NO: 2845674 - protein, 11 aa, Entamoeba invadens
DLNNSSLNTAL

SEQ ID NO: 2845675 - protein, 6 aa, Entamoeba invadens
DLNPRS

SEQ ID NO: 2845676 - protein, 9 aa, Entamoeba invadens
DLNPSPPVQ

SEQ ID NO: 2845677 - protein, 30 aa, Entamoeba invadens
DLNQPSSPQQEKHSQTQPEYTEGKEQNKDH

SEQ ID NO: 2845678 - protein, 4 aa, Entamoeba invadens
DLNR

SEQ ID NO: 2845679 - protein, 9 aa, Entamoeba invadens
DLNSENERF

SEQ ID NO: 2845680 - protein, 5 aa, Entamoeba invadens
DLNST

SEQ ID NO: 2845681 - protein, 16 aa, Entamoeba invadens
DLNTGKPKLIANQKTT

SEQ ID NO: 2845682 - protein, 10 aa, Entamoeba invadens
DLNTSDSDYY

SEQ ID NO: 2845683 - protein, 8 aa, Entamoeba invadens
DLPALPPE

SEQ ID NO: 2845684 - protein, 4 aa, Entamoeba invadens
DLPD

SEQ ID NO: 2845685 - protein, 24 aa, Entamoeba invadens
DLPDNPSKKKYKSIEDRLSGKQGR

SEQ ID NO: 2845686 - protein, 23 aa, Entamoeba invadens
DLPDPEEDQEEDPDNPTKQFTPT

SEQ ID NO: 2845687 - protein, 6 aa, Entamoeba invadens
DLPEDT

SEQ ID NO: 2845688 - protein, 35 aa, Entamoeba invadens
DLPEEISSKKEEPKEEEEYQKKSANTNIKRQKRHD

SEQ ID NO: 2845689 - protein, 18 aa, Entamoeba invadens
DLPERQVSKEEGEAFAKE

SEQ ID NO: 2845690 - protein, 16 aa, Entamoeba invadens
DLPERSVSTEDGQRIA

SEQ ID NO: 2845691 - protein, 9 aa, Entamoeba invadens
DLPKRTPKA

SEQ ID NO: 2845692 - protein, 7 aa, Entamoeba invadens
DLPNAFQ

SEQ ID NO: 2845693 - protein, 5 aa, Entamoeba invadens
DLPNP

SEQ ID NO: 2845694 - protein, 8 aa, Entamoeba invadens
DLPNSDET

SEQ ID NO: 2845695 - protein, 5 aa, Entamoeba invadens
DLPPE

SEQ ID NO: 2845696 - protein, 9 aa, Entamoeba invadens
DLPPSLTKI

SEQ ID NO: 2845697 - protein, 6 aa, Entamoeba invadens
DLPQNS

SEQ ID NO: 2845698 - protein, 5 aa, Entamoeba invadens
DLPQQ

SEQ ID NO: 2845699 - protein, 10 aa, Entamoeba invadens
DLPRGNLDDY

SEQ ID NO: 2845700 - protein, 4 aa, Entamoeba invadens
DLPS

SEQ ID NO: 2845701 - protein, 12 aa, Entamoeba invadens
DLPSAAKKAIEF

SEQ ID NO: 2845702 - protein, 25 aa, Entamoeba invadens
DLPSTADGKYSNIGEMKSKTQADEL

SEQ ID NO: 2845703 - protein, 5 aa, Entamoeba invadens
DLPTE

SEQ ID NO: 2845704 - protein, 5 aa, Entamoeba invadens
DLPTI

SEQ ID NO: 2845705 - protein, 6 aa, Entamoeba invadens
DLPTNL

SEQ ID NO: 2845706 - protein, 7 aa, Entamoeba invadens
DLPTPDD

SEQ ID NO: 2845707 - protein, 5 aa, Entamoeba invadens
DLPTT

SEQ ID NO: 2845708 - protein, 13 aa, Entamoeba invadens
DLPTTGNKGGRAF

SEQ ID NO: 2845709 - protein, 7 aa, Entamoeba invadens
DLPYKGE

SEQ ID NO: 2845710 - protein, 21 aa, Entamoeba invadens
DLQDQRQVQEEGREWAEQNGF

SEQ ID NO: 2845711 - protein, 6 aa, Entamoeba invadens
DLQEDG

SEQ ID NO: 2845712 - protein, 32 aa, Entamoeba invadens
DLQEKRKSNVLKESTKPTKSANALKNKTPQKL

SEQ ID NO: 2845713 - protein, 11 aa, Entamoeba invadens
DLQKPTKKRKM

SEQ ID NO: 2845714 - protein, 9 aa, Entamoeba invadens
DLQKVSPQI

SEQ ID NO: 2845715 - protein, 4 aa, Entamoeba invadens
DLQN

SEQ ID NO: 2845716 - protein, 10 aa, Entamoeba invadens
DLQNEKENVI

SEQ ID NO: 2845717 - protein, 5 aa, Entamoeba invadens
DLQQG

SEQ ID NO: 2845718 - protein, 12 aa, Entamoeba invadens
DLQQKDKLDADG

SEQ ID NO: 2845719 - protein, 5 aa, Entamoeba invadens
DLQSA

SEQ ID NO: 2845720 - protein, 8 aa, Entamoeba invadens
DLQSDNSN

SEQ ID NO: 2845721 - protein, 4 aa, Entamoeba invadens
DLRD

SEQ ID NO: 2845722 - protein, 7 aa, Entamoeba invadens
DLRDGKL

SEQ ID NO: 2845723 - protein, 8 aa, Entamoeba invadens
DLREETRE

SEQ ID NO: 2845724 - protein, 7 aa, Entamoeba invadens
DLREGKA

SEQ ID NO: 2845725 - protein, 14 aa, Entamoeba invadens
DLRESNEKAERNNP

SEQ ID NO: 2845726 - protein, 14 aa, Entamoeba invadens
DLRESNEKAERNYP

SEQ ID NO: 2845727 - protein, 14 aa, Entamoeba invadens
DLRESNEKEERKYP

SEQ ID NO: 2845728 - protein, 12 aa, Entamoeba invadens
DLRQKQSELEKA

SEQ ID NO: 2845729 - protein, 4 aa, Entamoeba invadens
DLRR

SEQ ID NO: 2845730 - protein, 11 aa, Entamoeba invadens
DLRTQKQTTEL

SEQ ID NO: 2845731 - protein, 9 aa, Entamoeba invadens
DLSDARHDI

SEQ ID NO: 2845732 - protein, 8 aa, Entamoeba invadens
DLSEDERN

SEQ ID NO: 2845733 - protein, 9 aa, Entamoeba invadens
DLSEEQLRK

SEQ ID NO: 2845734 - protein, 7 aa, Entamoeba invadens
DLSEKDV

SEQ ID NO: 2845735 - protein, 7 aa, Entamoeba invadens
DLSELQD

SEQ ID NO: 2845736 - protein, 8 aa, Entamoeba invadens
DLSESSEF

SEQ ID NO: 2845737 - protein, 9 aa, Entamoeba invadens
DLSETNTPF

SEQ ID NO: 2845738 - protein, 6 aa, Entamoeba invadens
DLSGDQ

SEQ ID NO: 2845739 - protein, 31 aa, Entamoeba invadens
DLSKAKREISTTEGQQLADSFKNSSKSTKFF

SEQ ID NO: 2845740 - protein, 9 aa, Entamoeba invadens
DLSKSTNAL

SEQ ID NO: 2845741 - protein, 36 aa, Entamoeba invadens
DLSNGSDSSKKLNEEIEKQKEQSRKLEEQNNEISQR

SEQ ID NO: 2845742 - protein, 18 aa, Entamoeba invadens
DLSNSPDSFENSPEITDK

SEQ ID NO: 2845743 - protein, 19 aa, Entamoeba invadens
DLSNSPKSKVSRKERAKTM

SEQ ID NO: 2845744 - protein, 5 aa, Entamoeba invadens
DLSNY

SEQ ID NO: 2845745 - protein, 7 aa, Entamoeba invadens
DLSPEGL

SEQ ID NO: 2845746 - protein, 33 aa, Entamoeba invadens
DLSPKDQLVDKQQQNAPVQRKVESNEPLPSATE

SEQ ID NO: 2845747 - protein, 16 aa, Entamoeba invadens
DLSPPQYSQIARGFSG

SEQ ID NO: 2845748 - protein, 5 aa, Entamoeba invadens
DLSPQ

SEQ ID NO: 2845749 - protein, 6 aa, Entamoeba invadens
DLSPST

SEQ ID NO: 2845750 - protein, 5 aa, Entamoeba invadens
DLSQE

SEQ ID NO: 2845751 - protein, 7 aa, Entamoeba invadens
DLSQTEK

SEQ ID NO: 2845752 - protein, 36 aa, Entamoeba invadens
DLSQTIDRVQEKTDEQGKRLAAASRQVDSANRVYSK

SEQ ID NO: 2845753 - protein, 4 aa, Entamoeba invadens
DLSR

SEQ ID NO: 2845754 - protein, 9 aa, Entamoeba invadens
DLSREPEKG

SEQ ID NO: 2845755 - protein, 5 aa, Entamoeba invadens
DLSRL

SEQ ID NO: 2845756 - protein, 11 aa, Entamoeba invadens
DLSSEEEKMTS

SEQ ID NO: 2845757 - protein, 6 aa, Entamoeba invadens
DLSSRP

SEQ ID NO: 2845758 - protein, 5 aa, Entamoeba invadens
DLSST

SEQ ID NO: 2845759 - protein, 9 aa, Entamoeba invadens
DLSTEASTR

SEQ ID NO: 2845760 - protein, 10 aa, Entamoeba invadens
DLSYKTISGD

SEQ ID NO: 2845761 - protein, 10 aa, Entamoeba invadens
DLTAKEDNLT

SEQ ID NO: 2845762 - protein, 7 aa, Entamoeba invadens
DLTDDEK

SEQ ID NO: 2845763 - protein, 12 aa, Entamoeba invadens
DLTDESKKTLKV

SEQ ID NO: 2845764 - protein, 11 aa, Entamoeba invadens
DLTDPHGTHRK

SEQ ID NO: 2845765 - protein, 9 aa, Entamoeba invadens
DLTDSVNKI

SEQ ID NO: 2845766 - protein, 11 aa, Entamoeba invadens
DLTEAAKLGGF

SEQ ID NO: 2845767 - protein, 25 aa, Entamoeba invadens
DLTEPSRKYIRETGKKLTSAPTPFH

SEQ ID NO: 2845768 - protein, 5 aa, Entamoeba invadens
DLTEQ

SEQ ID NO: 2845769 - protein, 9 aa, Entamoeba invadens
DLTGDEKRQ

SEQ ID NO: 2845770 - protein, 5 aa, Entamoeba invadens
DLTGE

SEQ ID NO: 2845771 - protein, 12 aa, Entamoeba invadens
DLTGSESLCSKN

SEQ ID NO: 2845772 - protein, 4 aa, Entamoeba invadens
DLTK

SEQ ID NO: 2845773 - protein, 16 aa, Entamoeba invadens
DLTKERVVKESDAQTL

SEQ ID NO: 2845774 - protein, 13 aa, Entamoeba invadens
DLTKNGIESVLKK

SEQ ID NO: 2845775 - protein, 5 aa, Entamoeba invadens
DLTKR

SEQ ID NO: 2845776 - protein, 10 aa, Entamoeba invadens
DLTKSGLPQF

SEQ ID NO: 2845777 - protein, 15 aa, Entamoeba invadens
DLTNPNQNSPVLSQR

SEQ ID NO: 2845778 - protein, 4 aa, Entamoeba invadens
DLTP

SEQ ID NO: 2845779 - protein, 15 aa, Entamoeba invadens
DLTPADETEGRKGHH

SEQ ID NO: 2845780 - protein, 28 aa, Entamoeba invadens
DLTPEEQEKLKKELEDVKKKSKDLDEKL

SEQ ID NO: 2845781 - protein, 7 aa, Entamoeba invadens
DLTPERY

SEQ ID NO: 2845782 - protein, 5 aa, Entamoeba invadens
DLTPT

SEQ ID NO: 2845783 - protein, 8 aa, Entamoeba invadens
DLTQRETI

SEQ ID NO: 2845784 - protein, 12 aa, Entamoeba invadens
DLTQTEEWILQN

SEQ ID NO: 2845785 - protein, 9 aa, Entamoeba invadens
DLTRETKPN

SEQ ID NO: 2845786 - protein, 11 aa, Entamoeba invadens
DLTRKGDKHVS

SEQ ID NO: 2845787 - protein, 8 aa, Entamoeba invadens
DLTSESCS

SEQ ID NO: 2845788 - protein, 9 aa, Entamoeba invadens
DLTTTGGDL

SEQ ID NO: 2845789 - protein, 11 aa, Entamoeba invadens
DLVDPSASIYN

SEQ ID NO: 2845790 - protein, 8 aa, Entamoeba invadens
DLVEPGKE

SEQ ID NO: 2845791 - protein, 17 aa, Entamoeba invadens
DLVETSNSLSIGKIDDD

SEQ ID NO: 2845792 - protein, 10 aa, Entamoeba invadens
DLVKDSNESI

SEQ ID NO: 2845793 - protein, 11 aa, Entamoeba invadens
DLVKSSDEEQF

SEQ ID NO: 2845794 - protein, 8 aa, Entamoeba invadens
DLVRDGTN

SEQ ID NO: 2845795 - protein, 4 aa, Entamoeba invadens
DLVT

SEQ ID NO: 2845796 - protein, 4 aa, Entamoeba invadens
DLYA

SEQ ID NO: 2845797 - protein, 6 aa, Entamoeba invadens
DLYPSL

SEQ ID NO: 2845798 - protein, 10 aa, Entamoeba invadens
DMAEKQAADI

SEQ ID NO: 2845799 - protein, 4 aa, Entamoeba invadens
DMAP

SEQ ID NO: 2845800 - protein, 5 aa, Entamoeba invadens
DMAPR

SEQ ID NO: 2845801 - protein, 13 aa, Entamoeba invadens
DMASSGENSPRTS

SEQ ID NO: 2845802 - protein, 7 aa, Entamoeba invadens
DMCSTGN

SEQ ID NO: 2845803 - protein, 5 aa, Entamoeba invadens
DMDNN

SEQ ID NO: 2845804 - protein, 8 aa, Entamoeba invadens
DMDPEEMH

SEQ ID NO: 2845805 - protein, 11 aa, Entamoeba invadens
DMEADTAESRI

SEQ ID NO: 2845806 - protein, 14 aa, Entamoeba invadens
DMEDALEKSESVAK

SEQ ID NO: 2845807 - protein, 29 aa, Entamoeba invadens
DMEDNNRRPMETEKAPEQQHNQQAPQEIE

SEQ ID NO: 2845808 - protein, 4 aa, Entamoeba invadens
DMEE

SEQ ID NO: 2845809 - protein, 7 aa, Entamoeba invadens
DMEESAK

SEQ ID NO: 2845810 - protein, 5 aa, Entamoeba invadens
DMEKG

SEQ ID NO: 2845811 - protein, 47 aa, Entamoeba invadens
DMEKTENDMADKLEADAEDTSRKKNAQEKRPAQLKADNDNLTKAKSI

SEQ ID NO: 2845812 - protein, 11 aa, Entamoeba invadens
DMEKTENDMAG

SEQ ID NO: 2845813 - protein, 11 aa, Entamoeba invadens
DMGATPPRQTD

SEQ ID NO: 2845814 - protein, 4 aa, Entamoeba invadens
DMGN

SEQ ID NO: 2845815 - protein, 8 aa, Entamoeba invadens
DMGQPDDV

SEQ ID NO: 2845816 - protein, 7 aa, Entamoeba invadens
DMGSGSR

SEQ ID NO: 2845817 - protein, 16 aa, Entamoeba invadens
DMIPPPQRAAPKPVKR

SEQ ID NO: 2845818 - protein, 19 aa, Entamoeba invadens
DMKKQSVEDASNIENNESH

SEQ ID NO: 2845819 - protein, 12 aa, Entamoeba invadens
DMKNDSSAGYTL

SEQ ID NO: 2845820 - protein, 16 aa, Entamoeba invadens
DMKPRPKPVEPSDKRK

SEQ ID NO: 2845821 - protein, 7 aa, Entamoeba invadens
DMLDPEN

SEQ ID NO: 2845822 - protein, 8 aa, Entamoeba invadens
DMLDPETT

SEQ ID NO: 2845823 - protein, 5 aa, Entamoeba invadens
DMNEE

SEQ ID NO: 2845824 - protein, 14 aa, Entamoeba invadens
DMNSSFEKTEMQKR

SEQ ID NO: 2845825 - protein, 7 aa, Entamoeba invadens
DMNSTEI

SEQ ID NO: 2845826 - protein, 4 aa, Entamoeba invadens
DMPD

SEQ ID NO: 2845827 - protein, 15 aa, Entamoeba invadens
DMPDENDKNQAVKTV

SEQ ID NO: 2845828 - protein, 5 aa, Entamoeba invadens
DMPFT

SEQ ID NO: 2845829 - protein, 17 aa, Entamoeba invadens
DMPKQVPTEKGASFAKA

SEQ ID NO: 2845830 - protein, 6 aa, Entamoeba invadens
DMPPEV

SEQ ID NO: 2845831 - protein, 15 aa, Entamoeba invadens
DMPPQDLRNSQSTYG

SEQ ID NO: 2845832 - protein, 4 aa, Entamoeba invadens
DMPT

SEQ ID NO: 2845833 - protein, 6 aa, Entamoeba invadens
DMQSTE

SEQ ID NO: 2845834 - protein, 33 aa, Entamoeba invadens
DMREDNDQLKRLKEKNTTPITTKQGAAKAKEIS

SEQ ID NO: 2845835 - protein, 4 aa, Entamoeba invadens
DMRN

SEQ ID NO: 2845836 - protein, 7 aa, Entamoeba invadens
DMRTTGS

SEQ ID NO: 2845837 - protein, 5 aa, Entamoeba invadens
DMSAQ

SEQ ID NO: 2845838 - protein, 5 aa, Entamoeba invadens
DMSEE

SEQ ID NO: 2845839 - protein, 12 aa, Entamoeba invadens
DMSEEELQRYKT

SEQ ID NO: 2845840 - protein, 5 aa, Entamoeba invadens
DMSEV

SEQ ID NO: 2845841 - protein, 12 aa, Entamoeba invadens
DMSEVQKSQIEE

SEQ ID NO: 2845842 - protein, 7 aa, Entamoeba invadens
DMSGDYA

SEQ ID NO: 2845843 - protein, 10 aa, Entamoeba invadens
DMSKEDLPQQ

SEQ ID NO: 2845844 - protein, 16 aa, Entamoeba invadens
DMSKHKSLSNFSNDTL

SEQ ID NO: 2845845 - protein, 4 aa, Entamoeba invadens
DMSL

SEQ ID NO: 2845846 - protein, 7 aa, Entamoeba invadens
DMSPERA

SEQ ID NO: 2845847 - protein, 11 aa, Entamoeba invadens
DMSSAAASLTG

SEQ ID NO: 2845848 - protein, 12 aa, Entamoeba invadens
DMTANERRRNYK

SEQ ID NO: 2845849 - protein, 9 aa, Entamoeba invadens
DMTDEEMDS

SEQ ID NO: 2845850 - protein, 13 aa, Entamoeba invadens
DMTESNWNEKKGP

SEQ ID NO: 2845851 - protein, 4 aa, Entamoeba invadens
DMTK

SEQ ID NO: 2845852 - protein, 5 aa, Entamoeba invadens
DMTPG

SEQ ID NO: 2845853 - protein, 10 aa, Entamoeba invadens
DMTPKEVEEM

SEQ ID NO: 2845854 - protein, 7 aa, Entamoeba invadens
DMTSPST

SEQ ID NO: 2845855 - protein, 5 aa, Entamoeba invadens
DMTYP

SEQ ID NO: 2845856 - protein, 8 aa, Entamoeba invadens
DNADGKKK

SEQ ID NO: 2845857 - protein, 6 aa, Entamoeba invadens
DNAEVM

SEQ ID NO: 2845858 - protein, 8 aa, Entamoeba invadens
DNAGFDPT

SEQ ID NO: 2845859 - protein, 20 aa, Entamoeba invadens
DNAINNNASLSNDNKSTLTR

SEQ ID NO: 2845860 - protein, 10 aa, Entamoeba invadens
DNAKKAYPRE

SEQ ID NO: 2845861 - protein, 9 aa, Entamoeba invadens
DNAKSLKPN

SEQ ID NO: 2845862 - protein, 12 aa, Entamoeba invadens
DNAKTAKADLSG

SEQ ID NO: 2845863 - protein, 42 aa, Entamoeba invadens
DNANDSKVESGGTKEDLRRKKVEKVRKPRKRSQSREARRETC

SEQ ID NO: 2845864 - protein, 10 aa, Entamoeba invadens
DNAPQKPTIR

SEQ ID NO: 2845865 - protein, 13 aa, Entamoeba invadens
DNAPQKPTIRLSN

SEQ ID NO: 2845866 - protein, 6 aa, Entamoeba invadens
DNAQMG

SEQ ID NO: 2845867 - protein, 8 aa, Entamoeba invadens
DNAQYMSP

SEQ ID NO: 2845868 - protein, 4 aa, Entamoeba invadens
DNAT

SEQ ID NO: 2845869 - protein, 6 aa, Entamoeba invadens
DNATHV

SEQ ID NO: 2845870 - protein, 6 aa, Entamoeba invadens
DNATKR

SEQ ID NO: 2845871 - protein, 10 aa, Entamoeba invadens
DNCEKKEKIN

SEQ ID NO: 2845872 - protein, 19 aa, Entamoeba invadens
DNCTDNSKTAVITQSEKEH

SEQ ID NO: 2845873 - protein, 4 aa, Entamoeba invadens
DNDD

SEQ ID NO: 2845874 - protein, 4 aa, Entamoeba invadens
DNDE

SEQ ID NO: 2845875 - protein, 7 aa, Entamoeba invadens
DNDEMEE

SEQ ID NO: 2845876 - protein, 81 aa, Entamoeba invadens
DNDEQNSEGSEEGSEEKSESVEEEEETGEKEETFTQGKNGVEDVEERNERNETLYDNKNSTNEGKKQNEERSEKGKENITT

SEQ ID NO: 2845877 - protein, 9 aa, Entamoeba invadens
DNDGKGNTL

SEQ ID NO: 2845878 - protein, 7 aa, Entamoeba invadens
DNDGQNP

SEQ ID NO: 2845879 - protein, 13 aa, Entamoeba invadens
DNDINAENNKMEI

SEQ ID NO: 2845880 - protein, 8 aa, Entamoeba invadens
DNDKAARY

SEQ ID NO: 2845881 - protein, 7 aa, Entamoeba invadens
DNDKNGY

SEQ ID NO: 2845882 - protein, 6 aa, Entamoeba invadens
DNDLDT

SEQ ID NO: 2845883 - protein, 4 aa, Entamoeba invadens
DNDN

SEQ ID NO: 2845884 - protein, 10 aa, Entamoeba invadens
DNDNIEKSNL

SEQ ID NO: 2845885 - protein, 13 aa, Entamoeba invadens
DNDNLKKRVSDKF

SEQ ID NO: 2845886 - protein, 6 aa, Entamoeba invadens
DNDQGK

SEQ ID NO: 2845887 - protein, 5 aa, Entamoeba invadens
DNDQN

SEQ ID NO: 2845888 - protein, 4 aa, Entamoeba invadens
DNDR

SEQ ID NO: 2845889 - protein, 5 aa, Entamoeba invadens
DNDRV

SEQ ID NO: 2845890 - protein, 6 aa, Entamoeba invadens
DNDTEN

SEQ ID NO: 2845891 - protein, 7 aa, Entamoeba invadens
DNDTIEV

SEQ ID NO: 2845892 - protein, 6 aa, Entamoeba invadens
DNDTNT

SEQ ID NO: 2845893 - protein, 6 aa, Entamoeba invadens
DNDYSA

SEQ ID NO: 2845894 - protein, 8 aa, Entamoeba invadens
DNDYTLPS

SEQ ID NO: 2845895 - protein, 5 aa, Entamoeba invadens
DNEAQ

SEQ ID NO: 2845896 - protein, 6 aa, Entamoeba invadens
DNEASN

SEQ ID NO: 2845897 - protein, 6 aa, Entamoeba invadens
DNEDID

SEQ ID NO: 2845898 - protein, 11 aa, Entamoeba invadens
DNEDKKGQLTS

SEQ ID NO: 2845899 - protein, 13 aa, Entamoeba invadens
DNEDSDDSENDIS

SEQ ID NO: 2845900 - protein, 6 aa, Entamoeba invadens
DNEEDV

SEQ ID NO: 2845901 - protein, 6 aa, Entamoeba invadens
DNEEKT

SEQ ID NO: 2845902 - protein, 5 aa, Entamoeba invadens
DNEEL

SEQ ID NO: 2845903 - protein, 6 aa, Entamoeba invadens
DNEEPC

SEQ ID NO: 2845904 - protein, 6 aa, Entamoeba invadens
DNEEVD

SEQ ID NO: 2845905 - protein, 7 aa, Entamoeba invadens
DNEGEMK

SEQ ID NO: 2845906 - protein, 6 aa, Entamoeba invadens
DNEGNK

SEQ ID NO: 2845907 - protein, 5 aa, Entamoeba invadens
DNEGT

SEQ ID NO: 2845908 - protein, 18 aa, Entamoeba invadens
DNEGVKNLTNDVKEENVK

SEQ ID NO: 2845909 - protein, 7 aa, Entamoeba invadens
DNEISEN

SEQ ID NO: 2845910 - protein, 15 aa, Entamoeba invadens
DNEISENWSEQIVMG

SEQ ID NO: 2845911 - protein, 4 aa, Entamoeba invadens
DNEK

SEQ ID NO: 2845912 - protein, 10 aa, Entamoeba invadens
DNEKDQEKLK

SEQ ID NO: 2845913 - protein, 9 aa, Entamoeba invadens
DNEKNEEIF

SEQ ID NO: 2845914 - protein, 11 aa, Entamoeba invadens
DNEKNEEIPKE

SEQ ID NO: 2845915 - protein, 8 aa, Entamoeba invadens
DNEKPPSM

SEQ ID NO: 2845916 - protein, 6 aa, Entamoeba invadens
DNEKST

SEQ ID NO: 2845917 - protein, 15 aa, Entamoeba invadens
DNEKVSKSEYDEFGT

SEQ ID NO: 2845918 - protein, 4 aa, Entamoeba invadens
DNEL

SEQ ID NO: 2845919 - protein, 11 aa, Entamoeba invadens
DNELNDSATIP

SEQ ID NO: 2845920 - protein, 10 aa, Entamoeba invadens
DNENGQQKRR

SEQ ID NO: 2845921 - protein, 7 aa, Entamoeba invadens
DNENNEM

SEQ ID NO: 2845922 - protein, 6 aa, Entamoeba invadens
DNENNK

SEQ ID NO: 2845923 - protein, 5 aa, Entamoeba invadens
DNENV

SEQ ID NO: 2845924 - protein, 71 aa, Entamoeba invadens
DNENWTDNDVENGEQNEDANNIEIDKNANSIKDDDDERQEKLEDKTVENDIQNEEEIEDETSTTEQVKSQK

SEQ ID NO: 2845925 - protein, 5 aa, Entamoeba invadens
DNENY

SEQ ID NO: 2845926 - protein, 14 aa, Entamoeba invadens
DNEPLNTTKEESNP

SEQ ID NO: 2845927 - protein, 23 aa, Entamoeba invadens
DNEPTKRSSLENVKYELGTIFNH

SEQ ID NO: 2845928 - protein, 8 aa, Entamoeba invadens
DNEPTKSV

SEQ ID NO: 2845929 - protein, 4 aa, Entamoeba invadens
DNEQ

SEQ ID NO: 2845930 - protein, 7 aa, Entamoeba invadens
DNEQKDN

SEQ ID NO: 2845931 - protein, 14 aa, Entamoeba invadens
DNEQKYSMFKCSMF

SEQ ID NO: 2845932 - protein, 9 aa, Entamoeba invadens
DNEQQTDFG

SEQ ID NO: 2845933 - protein, 9 aa, Entamoeba invadens
DNEQTTQSL

SEQ ID NO: 2845934 - protein, 4 aa, Entamoeba invadens
DNER

SEQ ID NO: 2845935 - protein, 18 aa, Entamoeba invadens
DNERERDAKTLSGGEKSF

SEQ ID NO: 2845936 - protein, 12 aa, Entamoeba invadens
DNERKRQTTFQK

SEQ ID NO: 2845937 - protein, 6 aa, Entamoeba invadens
DNESFR

SEQ ID NO: 2845938 - protein, 9 aa, Entamoeba invadens
DNESGLEEF

SEQ ID NO: 2845939 - protein, 11 aa, Entamoeba invadens
DNESNSSKALE

SEQ ID NO: 2845940 - protein, 7 aa, Entamoeba invadens
DNESSIV

SEQ ID NO: 2845941 - protein, 7 aa, Entamoeba invadens
DNESSPM

SEQ ID NO: 2845942 - protein, 6 aa, Entamoeba invadens
DNESTL

SEQ ID NO: 2845943 - protein, 5 aa, Entamoeba invadens
DNESV

SEQ ID NO: 2845944 - protein, 4 aa, Entamoeba invadens
DNET

SEQ ID NO: 2845945 - protein, 7 aa, Entamoeba invadens
DNETEIE

SEQ ID NO: 2845946 - protein, 7 aa, Entamoeba invadens
DNETGQE

SEQ ID NO: 2845947 - protein, 8 aa, Entamoeba invadens
DNETRKYE

SEQ ID NO: 2845948 - protein, 9 aa, Entamoeba invadens
DNETTLKEA

SEQ ID NO: 2845949 - protein, 9 aa, Entamoeba invadens
DNEYDPEKD

SEQ ID NO: 2845950 - protein, 9 aa, Entamoeba invadens
DNFDDAKQN

SEQ ID NO: 2845951 - protein, 19 aa, Entamoeba invadens
DNFEGKTNVDKELDGLEDE

SEQ ID NO: 2845952 - protein, 11 aa, Entamoeba invadens
DNFEKTKNDFA

SEQ ID NO: 2845953 - protein, 11 aa, Entamoeba invadens
DNFHPSGSVET

SEQ ID NO: 2845954 - protein, 4 aa, Entamoeba invadens
DNFK

SEQ ID NO: 2845955 - protein, 5 aa, Entamoeba invadens
DNFPN

SEQ ID NO: 2845956 - protein, 10 aa, Entamoeba invadens
DNGCGIPPNS

SEQ ID NO: 2845957 - protein, 6 aa, Entamoeba invadens
DNGCTQ

SEQ ID NO: 2845958 - protein, 14 aa, Entamoeba invadens
DNGDEDDFNGNDEI

SEQ ID NO: 2845959 - protein, 11 aa, Entamoeba invadens
DNGDGNVSKKE

SEQ ID NO: 2845960 - protein, 13 aa, Entamoeba invadens
DNGDLRLKDDSPV

SEQ ID NO: 2845961 - protein, 7 aa, Entamoeba invadens
DNGDTIN

SEQ ID NO: 2845962 - protein, 13 aa, Entamoeba invadens
DNGEKAEAEKQQL

SEQ ID NO: 2845963 - protein, 8 aa, Entamoeba invadens
DNGERNDE

SEQ ID NO: 2845964 - protein, 14 aa, Entamoeba invadens
DNGEVKFNSRSANA

SEQ ID NO: 2845965 - protein, 13 aa, Entamoeba invadens
DNGFEKREEDCET

SEQ ID NO: 2845966 - protein, 13 aa, Entamoeba invadens
DNGFTSNVSENGD

SEQ ID NO: 2845967 - protein, 5 aa, Entamoeba invadens
DNGGN

SEQ ID NO: 2845968 - protein, 6 aa, Entamoeba invadens
DNGIGT

SEQ ID NO: 2845969 - protein, 8 aa, Entamoeba invadens
DNGKITGG

SEQ ID NO: 2845970 - protein, 7 aa, Entamoeba invadens
DNGKNVA

SEQ ID NO: 2845971 - protein, 8 aa, Entamoeba invadens
DNGKTYCS

SEQ ID NO: 2845972 - protein, 11 aa, Entamoeba invadens
DNGKVGCGGNE

SEQ ID NO: 2845973 - protein, 10 aa, Entamoeba invadens
DNGNCENEGV

SEQ ID NO: 2845974 - protein, 9 aa, Entamoeba invadens
DNGNEEQLS

SEQ ID NO: 2845975 - protein, 12 aa, Entamoeba invadens
DNGSTTAPKDMK

SEQ ID NO: 2845976 - protein, 6 aa, Entamoeba invadens
DNGTHD

SEQ ID NO: 2845977 - protein, 6 aa, Entamoeba invadens
DNGTVE

SEQ ID NO: 2845978 - protein, 10 aa, Entamoeba invadens
DNGTVRTSGY

SEQ ID NO: 2845979 - protein, 16 aa, Entamoeba invadens
DNGTYVGSTGGVSLQV

SEQ ID NO: 2845980 - protein, 4 aa, Entamoeba invadens
DNGV

SEQ ID NO: 2845981 - protein, 7 aa, Entamoeba invadens
DNHRPAS

SEQ ID NO: 2845982 - protein, 8 aa, Entamoeba invadens
DNHSMEGD

SEQ ID NO: 2845983 - protein, 10 aa, Entamoeba invadens
DNIDDNDAIN

SEQ ID NO: 2845984 - protein, 19 aa, Entamoeba invadens
DNIEAPNALPQKTPNENLD

SEQ ID NO: 2845985 - protein, 5 aa, Entamoeba invadens
DNIEN

SEQ ID NO: 2845986 - protein, 7 aa, Entamoeba invadens
DNIEPQG

SEQ ID NO: 2845987 - protein, 25 aa, Entamoeba invadens
DNIESVEENVPASPSPSLSEKKKKM

SEQ ID NO: 2845988 - protein, 8 aa, Entamoeba invadens
DNIGATNV

SEQ ID NO: 2845989 - protein, 5 aa, Entamoeba invadens
DNIGS

SEQ ID NO: 2845990 - protein, 7 aa, Entamoeba invadens
DNIKGNK

SEQ ID NO: 2845991 - protein, 8 aa, Entamoeba invadens
DNINPYEA

SEQ ID NO: 2845992 - protein, 6 aa, Entamoeba invadens
DNIPQE

SEQ ID NO: 2845993 - protein, 7 aa, Entamoeba invadens
DNIPQNI

SEQ ID NO: 2845994 - protein, 9 aa, Entamoeba invadens
DNIQNEAFS

SEQ ID NO: 2845995 - protein, 4 aa, Entamoeba invadens
DNIS

SEQ ID NO: 2845996 - protein, 6 aa, Entamoeba invadens
DNISTN

SEQ ID NO: 2845997 - protein, 4 aa, Entamoeba invadens
DNIT

SEQ ID NO: 2845998 - protein, 7 aa, Entamoeba invadens
DNITEED

SEQ ID NO: 2845999 - protein, 8 aa, Entamoeba invadens
DNITYQPK

SEQ ID NO: 2846000 - protein, 27 aa, Entamoeba invadens
DNKANTTEKANEGEPSTLTLSSQDTDI

SEQ ID NO: 2846001 - protein, 6 aa, Entamoeba invadens
DNKDAS

SEQ ID NO: 2846002 - protein, 8 aa, Entamoeba invadens
DNKDQTNV

SEQ ID NO: 2846003 - protein, 7 aa, Entamoeba invadens
DNKDVSC

SEQ ID NO: 2846004 - protein, 5 aa, Entamoeba invadens
DNKEG

SEQ ID NO: 2846005 - protein, 11 aa, Entamoeba invadens
DNKEKKVATVK

SEQ ID NO: 2846006 - protein, 5 aa, Entamoeba invadens
DNKEL

SEQ ID NO: 2846007 - protein, 9 aa, Entamoeba invadens
DNKENSKAM

SEQ ID NO: 2846008 - protein, 8 aa, Entamoeba invadens
DNKEQDFD

SEQ ID NO: 2846009 - protein, 8 aa, Entamoeba invadens
DNKETVEL

SEQ ID NO: 2846010 - protein, 7 aa, Entamoeba invadens
DNKFGSF

SEQ ID NO: 2846011 - protein, 8 aa, Entamoeba invadens
DNKIDYPG

SEQ ID NO: 2846012 - protein, 7 aa, Entamoeba invadens
DNKIQTS

SEQ ID NO: 2846013 - protein, 11 aa, Entamoeba invadens
DNKKEDDADSI

SEQ ID NO: 2846014 - protein, 28 aa, Entamoeba invadens
DNKKIKEEKKPHKEEKSPLAKEDKAYRE

SEQ ID NO: 2846015 - protein, 8 aa, Entamoeba invadens
DNKKTNFN

SEQ ID NO: 2846016 - protein, 16 aa, Entamoeba invadens
DNKKTTFQTASTSIDA

SEQ ID NO: 2846017 - protein, 9 aa, Entamoeba invadens
DNKLDKEEF

SEQ ID NO: 2846018 - protein, 18 aa, Entamoeba invadens
DNKNQTQTFKTPKGSVGI

SEQ ID NO: 2846019 - protein, 7 aa, Entamoeba invadens
DNKPFGG

SEQ ID NO: 2846020 - protein, 6 aa, Entamoeba invadens
DNKPFK

SEQ ID NO: 2846021 - protein, 18 aa, Entamoeba invadens
DNKPKSDEELTGPPPPFV

SEQ ID NO: 2846022 - protein, 37 aa, Entamoeba invadens
DNKPVAERKKLPARKHKKGKKKKKAKITGEEGTTDEH

SEQ ID NO: 2846023 - protein, 6 aa, Entamoeba invadens
DNKQIQ

SEQ ID NO: 2846024 - protein, 11 aa, Entamoeba invadens
DNKRHDKKEIE

SEQ ID NO: 2846025 - protein, 7 aa, Entamoeba invadens
DNKSNNY

SEQ ID NO: 2846026 - protein, 11 aa, Entamoeba invadens
DNKSQGRKEIS

SEQ ID NO: 2846027 - protein, 8 aa, Entamoeba invadens
DNKSSEYP

SEQ ID NO: 2846028 - protein, 4 aa, Entamoeba invadens
DNKT

SEQ ID NO: 2846029 - protein, 27 aa, Entamoeba invadens
DNKTETKEKEELNKTDGSQKMEEEQVN

SEQ ID NO: 2846030 - protein, 10 aa, Entamoeba invadens
DNKTKDIEKQ

SEQ ID NO: 2846031 - protein, 7 aa, Entamoeba invadens
DNKTLNI

SEQ ID NO: 2846032 - protein, 7 aa, Entamoeba invadens
DNKTLTP

SEQ ID NO: 2846033 - protein, 7 aa, Entamoeba invadens
DNKVRGT

SEQ ID NO: 2846034 - protein, 5 aa, Entamoeba invadens
DNKYA

SEQ ID NO: 2846035 - protein, 12 aa, Entamoeba invadens
DNKYFEKGNARF

SEQ ID NO: 2846036 - protein, 8 aa, Entamoeba invadens
DNKYSQEE

SEQ ID NO: 2846037 - protein, 6 aa, Entamoeba invadens
DNKYSS

SEQ ID NO: 2846038 - protein, 7 aa, Entamoeba invadens
DNLAENI

SEQ ID NO: 2846039 - protein, 11 aa, Entamoeba invadens
DNLEEYSKVRG

SEQ ID NO: 2846040 - protein, 8 aa, Entamoeba invadens
DNLEKDKL

SEQ ID NO: 2846041 - protein, 8 aa, Entamoeba invadens
DNLGKEEL

SEQ ID NO: 2846042 - protein, 4 aa, Entamoeba invadens
DNLK

SEQ ID NO: 2846043 - protein, 7 aa, Entamoeba invadens
DNLKCNE

SEQ ID NO: 2846044 - protein, 7 aa, Entamoeba invadens
DNLKENV

SEQ ID NO: 2846045 - protein, 12 aa, Entamoeba invadens
DNLKNGKNSDKV

SEQ ID NO: 2846046 - protein, 9 aa, Entamoeba invadens
DNLKRNTNE

SEQ ID NO: 2846047 - protein, 10 aa, Entamoeba invadens
DNLKSKNEEA

SEQ ID NO: 2846048 - protein, 13 aa, Entamoeba invadens
DNLLPTDDLPSAL

SEQ ID NO: 2846049 - protein, 4 aa, Entamoeba invadens
DNLN

SEQ ID NO: 2846050 - protein, 7 aa, Entamoeba invadens
DNLNNQT

SEQ ID NO: 2846051 - protein, 10 aa, Entamoeba invadens
DNLNTTYSAY

SEQ ID NO: 2846052 - protein, 5 aa, Entamoeba invadens
DNLPT

SEQ ID NO: 2846053 - protein, 8 aa, Entamoeba invadens
DNLQTQYN

SEQ ID NO: 2846054 - protein, 8 aa, Entamoeba invadens
DNLSGATV

SEQ ID NO: 2846055 - protein, 21 aa, Entamoeba invadens
DNLSQQSKGVVNHNKSLSPQA

SEQ ID NO: 2846056 - protein, 16 aa, Entamoeba invadens
DNLTAKDVKDAFQSSF

SEQ ID NO: 2846057 - protein, 4 aa, Entamoeba invadens
DNLV

SEQ ID NO: 2846058 - protein, 4 aa, Entamoeba invadens
DNME

SEQ ID NO: 2846059 - protein, 11 aa, Entamoeba invadens
DNNANNATAEA

SEQ ID NO: 2846060 - protein, 13 aa, Entamoeba invadens
DNNDFEKNLRNRY

SEQ ID NO: 2846061 - protein, 10 aa, Entamoeba invadens
DNNDGTYDVN

SEQ ID NO: 2846062 - protein, 5 aa, Entamoeba invadens
DNNDL

SEQ ID NO: 2846063 - protein, 7 aa, Entamoeba invadens
DNNDPLK

SEQ ID NO: 2846064 - protein, 13 aa, Entamoeba invadens
DNNDPQKVDSETR

SEQ ID NO: 2846065 - protein, 10 aa, Entamoeba invadens
DNNDRRNSQY

SEQ ID NO: 2846066 - protein, 7 aa, Entamoeba invadens
DNNEENQ

SEQ ID NO: 2846067 - protein, 9 aa, Entamoeba invadens
DNNETVDRN

SEQ ID NO: 2846068 - protein, 11 aa, Entamoeba invadens
DNNGCNGGTGS

SEQ ID NO: 2846069 - protein, 16 aa, Entamoeba invadens
DNNGGDAFVAFLNSAF

SEQ ID NO: 2846070 - protein, 5 aa, Entamoeba invadens
DNNGK

SEQ ID NO: 2846071 - protein, 13 aa, Entamoeba invadens
DNNGKITGKGVGS

SEQ ID NO: 2846072 - protein, 6 aa, Entamoeba invadens
DNNGSN

SEQ ID NO: 2846073 - protein, 35 aa, Entamoeba invadens
DNNGVDRYNPPWSTKYPSLSRLPRTNEELKKPENQ

SEQ ID NO: 2846074 - protein, 5 aa, Entamoeba invadens
DNNIT

SEQ ID NO: 2846075 - protein, 11 aa, Entamoeba invadens
DNNKCSKCDAS

SEQ ID NO: 2846076 - protein, 6 aa, Entamoeba invadens
DNNNEI

SEQ ID NO: 2846077 - protein, 6 aa, Entamoeba invadens
DNNNIR

SEQ ID NO: 2846078 - protein, 7 aa, Entamoeba invadens
DNNNKFG

SEQ ID NO: 2846079 - protein, 7 aa, Entamoeba invadens
DNNNLTE

SEQ ID NO: 2846080 - protein, 6 aa, Entamoeba invadens
DNNPKE

SEQ ID NO: 2846081 - protein, 8 aa, Entamoeba invadens
DNNSELYN

SEQ ID NO: 2846082 - protein, 5 aa, Entamoeba invadens
DNNSG

SEQ ID NO: 2846083 - protein, 6 aa, Entamoeba invadens
DNNSLS

SEQ ID NO: 2846084 - protein, 6 aa, Entamoeba invadens
DNNSMV

SEQ ID NO: 2846085 - protein, 7 aa, Entamoeba invadens
DNNTEDV

SEQ ID NO: 2846086 - protein, 6 aa, Entamoeba invadens
DNNTIA

SEQ ID NO: 2846087 - protein, 8 aa, Entamoeba invadens
DNNTIHPP

SEQ ID NO: 2846088 - protein, 7 aa, Entamoeba invadens
DNNTISQ

SEQ ID NO: 2846089 - protein, 9 aa, Entamoeba invadens
DNNTPNKAS

SEQ ID NO: 2846090 - protein, 7 aa, Entamoeba invadens
DNNTQDE

SEQ ID NO: 2846091 - protein, 7 aa, Entamoeba invadens
DNNTTQT

SEQ ID NO: 2846092 - protein, 7 aa, Entamoeba invadens
DNNTVNR

SEQ ID NO: 2846093 - protein, 4 aa, Entamoeba invadens
DNNW

SEQ ID NO: 2846094 - protein, 7 aa, Entamoeba invadens
DNNYTPK

SEQ ID NO: 2846095 - protein, 13 aa, Entamoeba invadens
DNPANNNNNVFND

SEQ ID NO: 2846096 - protein, 6 aa, Entamoeba invadens
DNPAPI

SEQ ID NO: 2846097 - protein, 13 aa, Entamoeba invadens
DNPAVKASKPKPD

SEQ ID NO: 2846098 - protein, 10 aa, Entamoeba invadens
DNPDKIDEDK

SEQ ID NO: 2846099 - protein, 5 aa, Entamoeba invadens
DNPDV

SEQ ID NO: 2846100 - protein, 12 aa, Entamoeba invadens
DNPFEKGMTPDS

SEQ ID NO: 2846101 - protein, 7 aa, Entamoeba invadens
DNPHTTQ

SEQ ID NO: 2846102 - protein, 7 aa, Entamoeba invadens
DNPKEQL

SEQ ID NO: 2846103 - protein, 14 aa, Entamoeba invadens
DNPLDDKGSIAETR

SEQ ID NO: 2846104 - protein, 8 aa, Entamoeba invadens
DNPLKNYQ

SEQ ID NO: 2846105 - protein, 7 aa, Entamoeba invadens
DNPLSGM

SEQ ID NO: 2846106 - protein, 15 aa, Entamoeba invadens
DNPNKESPAQHPANQ

SEQ ID NO: 2846107 - protein, 7 aa, Entamoeba invadens
DNPNNNT

SEQ ID NO: 2846108 - protein, 12 aa, Entamoeba invadens
DNPNPAYSAYKS

SEQ ID NO: 2846109 - protein, 14 aa, Entamoeba invadens
DNPNVPEEEYPLKM

SEQ ID NO: 2846110 - protein, 7 aa, Entamoeba invadens
DNPPGKL

SEQ ID NO: 2846111 - protein, 8 aa, Entamoeba invadens
DNPPTGEI

SEQ ID NO: 2846112 - protein, 4 aa, Entamoeba invadens
DNPQ

SEQ ID NO: 2846113 - protein, 23 aa, Entamoeba invadens
DNPSAVKKVSDDLQQPTSRVQTS

SEQ ID NO: 2846114 - protein, 5 aa, Entamoeba invadens
DNPSC

SEQ ID NO: 2846115 - protein, 11 aa, Entamoeba invadens
DNPSIPSISGL

SEQ ID NO: 2846116 - protein, 5 aa, Entamoeba invadens
DNPTF

SEQ ID NO: 2846117 - protein, 6 aa, Entamoeba invadens
DNPTLY

SEQ ID NO: 2846118 - protein, 20 aa, Entamoeba invadens
DNPVSDIRGANNMKKESKFE

SEQ ID NO: 2846119 - protein, 6 aa, Entamoeba invadens
DNPYTN

SEQ ID NO: 2846120 - protein, 4 aa, Entamoeba invadens
DNQD

SEQ ID NO: 2846121 - protein, 5 aa, Entamoeba invadens
DNQEN

SEQ ID NO: 2846122 - protein, 5 aa, Entamoeba invadens
DNQFN

SEQ ID NO: 2846123 - protein, 21 aa, Entamoeba invadens
DNQFSSEEDILDDEDKEKENV

SEQ ID NO: 2846124 - protein, 21 aa, Entamoeba invadens
DNQGLQDKITEHKATVAKKDS

SEQ ID NO: 2846125 - protein, 5 aa, Entamoeba invadens
DNQIT

SEQ ID NO: 2846126 - protein, 4 aa, Entamoeba invadens
DNQK

SEQ ID NO: 2846127 - protein, 12 aa, Entamoeba invadens
DNQKNGIKDSMS

SEQ ID NO: 2846128 - protein, 7 aa, Entamoeba invadens
DNQKNSA

SEQ ID NO: 2846129 - protein, 7 aa, Entamoeba invadens
DNQNHKP

SEQ ID NO: 2846130 - protein, 17 aa, Entamoeba invadens
DNQNKEKSDVENENNNL

SEQ ID NO: 2846131 - protein, 20 aa, Entamoeba invadens
DNQNRYNSNQFKREMHFNHF

SEQ ID NO: 2846132 - protein, 7 aa, Entamoeba invadens
DNQPGEL

SEQ ID NO: 2846133 - protein, 7 aa, Entamoeba invadens
DNQPIPS

SEQ ID NO: 2846134 - protein, 9 aa, Entamoeba invadens
DNQQETKMT

SEQ ID NO: 2846135 - protein, 12 aa, Entamoeba invadens
DNQQNEEKTKMR

SEQ ID NO: 2846136 - protein, 7 aa, Entamoeba invadens
DNQRTRR

SEQ ID NO: 2846137 - protein, 7 aa, Entamoeba invadens
DNQSKGD

SEQ ID NO: 2846138 - protein, 4 aa, Entamoeba invadens
DNQT

SEQ ID NO: 2846139 - protein, 9 aa, Entamoeba invadens
DNQTDYEKL

SEQ ID NO: 2846140 - protein, 9 aa, Entamoeba invadens
DNQTQLPQI

SEQ ID NO: 2846141 - protein, 7 aa, Entamoeba invadens
DNQVKQA

SEQ ID NO: 2846142 - protein, 18 aa, Entamoeba invadens
DNQVSAQLTKPRIVFLNE

SEQ ID NO: 2846143 - protein, 26 aa, Entamoeba invadens
DNQYQQDQQRSQQFEPLNPPPQNPNQ

SEQ ID NO: 2846144 - protein, 7 aa, Entamoeba invadens
DNRCISK

SEQ ID NO: 2846145 - protein, 13 aa, Entamoeba invadens
DNRDGTISPTYPQ

SEQ ID NO: 2846146 - protein, 7 aa, Entamoeba invadens
DNRKTAK

SEQ ID NO: 2846147 - protein, 4 aa, Entamoeba invadens
DNRP

SEQ ID NO: 2846148 - protein, 12 aa, Entamoeba invadens
DNRQTKPKAPNM

SEQ ID NO: 2846149 - protein, 4 aa, Entamoeba invadens
DNRS

SEQ ID NO: 2846150 - protein, 8 aa, Entamoeba invadens
DNRSDESK

SEQ ID NO: 2846151 - protein, 17 aa, Entamoeba invadens
DNRTIKNSTNVLSVRLL

SEQ ID NO: 2846152 - protein, 6 aa, Entamoeba invadens
DNRVTE

SEQ ID NO: 2846153 - protein, 4 aa, Entamoeba invadens
DNRY

SEQ ID NO: 2846154 - protein, 4 aa, Entamoeba invadens
DNSA

SEQ ID NO: 2846155 - protein, 6 aa, Entamoeba invadens
DNSAER

SEQ ID NO: 2846156 - protein, 5 aa, Entamoeba invadens
DNSAR

SEQ ID NO: 2846157 - protein, 9 aa, Entamoeba invadens
DNSDALPDN

SEQ ID NO: 2846158 - protein, 7 aa, Entamoeba invadens
DNSDKVR

SEQ ID NO: 2846159 - protein, 10 aa, Entamoeba invadens
DNSDTKSWAT

SEQ ID NO: 2846160 - protein, 4 aa, Entamoeba invadens
DNSE

SEQ ID NO: 2846161 - protein, 8 aa, Entamoeba invadens
DNSEEIDP

SEQ ID NO: 2846162 - protein, 11 aa, Entamoeba invadens
DNSENAENEDF

SEQ ID NO: 2846163 - protein, 10 aa, Entamoeba invadens
DNSESANDLE

SEQ ID NO: 2846164 - protein, 8 aa, Entamoeba invadens
DNSETEVN

SEQ ID NO: 2846165 - protein, 4 aa, Entamoeba invadens
DNSF

SEQ ID NO: 2846166 - protein, 5 aa, Entamoeba invadens
DNSHT

SEQ ID NO: 2846167 - protein, 4 aa, Entamoeba invadens
DNSI

SEQ ID NO: 2846168 - protein, 7 aa, Entamoeba invadens
DNSIEKM

SEQ ID NO: 2846169 - protein, 7 aa, Entamoeba invadens
DNSIRRD

SEQ ID NO: 2846170 - protein, 9 aa, Entamoeba invadens
DNSKENLMT

SEQ ID NO: 2846171 - protein, 7 aa, Entamoeba invadens
DNSKQKF

SEQ ID NO: 2846172 - protein, 12 aa, Entamoeba invadens
DNSLSEQGKRDK

SEQ ID NO: 2846173 - protein, 5 aa, Entamoeba invadens
DNSMA

SEQ ID NO: 2846174 - protein, 9 aa, Entamoeba invadens
DNSNDIVDE

SEQ ID NO: 2846175 - protein, 6 aa, Entamoeba invadens
DNSNKS

SEQ ID NO: 2846176 - protein, 11 aa, Entamoeba invadens
DNSNNGTFQRS

SEQ ID NO: 2846177 - protein, 42 aa, Entamoeba invadens
DNSNQNDETDKDGKMEEDNKENEEKVEVNDKIETEEKVETVE

SEQ ID NO: 2846178 - protein, 6 aa, Entamoeba invadens
DNSPAR

SEQ ID NO: 2846179 - protein, 8 aa, Entamoeba invadens
DNSPFKHE

SEQ ID NO: 2846180 - protein, 7 aa, Entamoeba invadens
DNSPHSR

SEQ ID NO: 2846181 - protein, 5 aa, Entamoeba invadens
DNSPM

SEQ ID NO: 2846182 - protein, 10 aa, Entamoeba invadens
DNSQRTYFSS

SEQ ID NO: 2846183 - protein, 7 aa, Entamoeba invadens
DNSSDES

SEQ ID NO: 2846184 - protein, 7 aa, Entamoeba invadens
DNSSDRI

SEQ ID NO: 2846185 - protein, 7 aa, Entamoeba invadens
DNSSHSR

SEQ ID NO: 2846186 - protein, 11 aa, Entamoeba invadens
DNSSTLSKEEY

SEQ ID NO: 2846187 - protein, 7 aa, Entamoeba invadens
DNSTSSM

SEQ ID NO: 2846188 - protein, 8 aa, Entamoeba invadens
DNSTTKKL

SEQ ID NO: 2846189 - protein, 8 aa, Entamoeba invadens
DNSVTQET

SEQ ID NO: 2846190 - protein, 9 aa, Entamoeba invadens
DNSYGNPAH

SEQ ID NO: 2846191 - protein, 5 aa, Entamoeba invadens
DNTAT

SEQ ID NO: 2846192 - protein, 7 aa, Entamoeba invadens
DNTDTTK

SEQ ID NO: 2846193 - protein, 4 aa, Entamoeba invadens
DNTI

SEQ ID NO: 2846194 - protein, 7 aa, Entamoeba invadens
DNTIPIK

SEQ ID NO: 2846195 - protein, 6 aa, Entamoeba invadens
DNTITS

SEQ ID NO: 2846196 - protein, 8 aa, Entamoeba invadens
DNTKCKSA

SEQ ID NO: 2846197 - protein, 7 aa, Entamoeba invadens
DNTKKVA

SEQ ID NO: 2846198 - protein, 5 aa, Entamoeba invadens
DNTKL

SEQ ID NO: 2846199 - protein, 8 aa, Entamoeba invadens
DNTKTLDA

SEQ ID NO: 2846200 - protein, 4 aa, Entamoeba invadens
DNTN

SEQ ID NO: 2846201 - protein, 5 aa, Entamoeba invadens
DNTNH

SEQ ID NO: 2846202 - protein, 8 aa, Entamoeba invadens
DNTNPSIE

SEQ ID NO: 2846203 - protein, 8 aa, Entamoeba invadens
DNTNQSDF

SEQ ID NO: 2846204 - protein, 23 aa, Entamoeba invadens
DNTNTEKEENKEENPSNDLFNEL

SEQ ID NO: 2846205 - protein, 28 aa, Entamoeba invadens
DNTNTLGEAAGDNGNDDQKRVESLLLSH

SEQ ID NO: 2846206 - protein, 4 aa, Entamoeba invadens
DNTP

SEQ ID NO: 2846207 - protein, 7 aa, Entamoeba invadens
DNTPGEA

SEQ ID NO: 2846208 - protein, 14 aa, Entamoeba invadens
DNTPKQDNGSNAPI

SEQ ID NO: 2846209 - protein, 14 aa, Entamoeba invadens
DNTPPDEKGQALSL

SEQ ID NO: 2846210 - protein, 14 aa, Entamoeba invadens
DNTPQIQMPSTANR

SEQ ID NO: 2846211 - protein, 9 aa, Entamoeba invadens
DNTPYMNSS

SEQ ID NO: 2846212 - protein, 4 aa, Entamoeba invadens
DNTQ

SEQ ID NO: 2846213 - protein, 8 aa, Entamoeba invadens
DNTQEGAQ

SEQ ID NO: 2846214 - protein, 9 aa, Entamoeba invadens
DNTQTLESL

SEQ ID NO: 2846215 - protein, 9 aa, Entamoeba invadens
DNTRNYQAK

SEQ ID NO: 2846216 - protein, 14 aa, Entamoeba invadens
DNTSGKDTNPGDSK

SEQ ID NO: 2846217 - protein, 14 aa, Entamoeba invadens
DNTSGKDTNTGESK

SEQ ID NO: 2846218 - protein, 9 aa, Entamoeba invadens
DNTSGTTGE

SEQ ID NO: 2846219 - protein, 5 aa, Entamoeba invadens
DNTSL

SEQ ID NO: 2846220 - protein, 24 aa, Entamoeba invadens
DNTSQNEGCNESSNKAKKSEDTQM

SEQ ID NO: 2846221 - protein, 4 aa, Entamoeba invadens
DNTT

SEQ ID NO: 2846222 - protein, 6 aa, Entamoeba invadens
DNTTER

SEQ ID NO: 2846223 - protein, 10 aa, Entamoeba invadens
DNTTGTPSCV

SEQ ID NO: 2846224 - protein, 6 aa, Entamoeba invadens
DNTTPN

SEQ ID NO: 2846225 - protein, 6 aa, Entamoeba invadens
DNTTYI

SEQ ID NO: 2846226 - protein, 7 aa, Entamoeba invadens
DNTYGEE

SEQ ID NO: 2846227 - protein, 5 aa, Entamoeba invadens
DNVAF

SEQ ID NO: 2846228 - protein, 9 aa, Entamoeba invadens
DNVEDPESA

SEQ ID NO: 2846229 - protein, 28 aa, Entamoeba invadens
DNVGPIQKTTPQQSQQAPTQPPKQQAGN

SEQ ID NO: 2846230 - protein, 5 aa, Entamoeba invadens
DNVHI

SEQ ID NO: 2846231 - protein, 16 aa, Entamoeba invadens
DNVKKEDDLNRREKTI

SEQ ID NO: 2846232 - protein, 9 aa, Entamoeba invadens
DNVKNEGGH

SEQ ID NO: 2846233 - protein, 9 aa, Entamoeba invadens
DNVKNSRPF

SEQ ID NO: 2846234 - protein, 4 aa, Entamoeba invadens
DNVN

SEQ ID NO: 2846235 - protein, 9 aa, Entamoeba invadens
DNVNKNAEE

SEQ ID NO: 2846236 - protein, 5 aa, Entamoeba invadens
DNVPY

SEQ ID NO: 2846237 - protein, 4 aa, Entamoeba invadens
DNVS

SEQ ID NO: 2846238 - protein, 9 aa, Entamoeba invadens
DNVSAKAKD

SEQ ID NO: 2846239 - protein, 34 aa, Entamoeba invadens
DNVSDGNNDGKEMLEENKEINKRYNDEKAKENME

SEQ ID NO: 2846240 - protein, 7 aa, Entamoeba invadens
DNVSTGR

SEQ ID NO: 2846241 - protein, 4 aa, Entamoeba invadens
DNVT

SEQ ID NO: 2846242 - protein, 13 aa, Entamoeba invadens
DNVTGRSYKTSDV

SEQ ID NO: 2846243 - protein, 6 aa, Entamoeba invadens
DNWGTV

SEQ ID NO: 2846244 - protein, 10 aa, Entamoeba invadens
DNWNKDNSVF

SEQ ID NO: 2846245 - protein, 5 aa, Entamoeba invadens
DNWSR

SEQ ID NO: 2846246 - protein, 6 aa, Entamoeba invadens
DNYDNV

SEQ ID NO: 2846247 - protein, 13 aa, Entamoeba invadens
DNYGDDYDEYDDY

SEQ ID NO: 2846248 - protein, 5 aa, Entamoeba invadens
DNYGK

SEQ ID NO: 2846249 - protein, 5 aa, Entamoeba invadens
DNYLG

SEQ ID NO: 2846250 - protein, 6 aa, Entamoeba invadens
DNYPFD

SEQ ID NO: 2846251 - protein, 7 aa, Entamoeba invadens
DNYRSWD

SEQ ID NO: 2846252 - protein, 5 aa, Entamoeba invadens
DNYRT

SEQ ID NO: 2846253 - protein, 4 aa, Entamoeba invadens
DNYT

SEQ ID NO: 2846254 - protein, 14 aa, Entamoeba invadens
DNYTAARQNKFRKA

SEQ ID NO: 2846255 - protein, 13 aa, Entamoeba invadens
DNYYDPHSRSQSV

SEQ ID NO: 2846256 - protein, 8 aa, Entamoeba invadens
DNYYNSPF

SEQ ID NO: 2846257 - protein, 13 aa, Entamoeba invadens
DPADEDELDNFDP

SEQ ID NO: 2846258 - protein, 5 aa, Entamoeba invadens
DPAGE

SEQ ID NO: 2846259 - protein, 9 aa, Entamoeba invadens
DPAHNTSDA

SEQ ID NO: 2846260 - protein, 11 aa, Entamoeba invadens
DPAKRLTPSEA

SEQ ID NO: 2846261 - protein, 7 aa, Entamoeba invadens
DPANDEI

SEQ ID NO: 2846262 - protein, 8 aa, Entamoeba invadens
DPANTNAP

SEQ ID NO: 2846263 - protein, 4 aa, Entamoeba invadens
DPAP

SEQ ID NO: 2846264 - protein, 5 aa, Entamoeba invadens
DPASL

SEQ ID NO: 2846265 - protein, 7 aa, Entamoeba invadens
DPASVFP

SEQ ID NO: 2846266 - protein, 8 aa, Entamoeba invadens
DPATEGPR

SEQ ID NO: 2846267 - protein, 8 aa, Entamoeba invadens
DPAYTEDG

SEQ ID NO: 2846268 - protein, 6 aa, Entamoeba invadens
DPCASI

SEQ ID NO: 2846269 - protein, 5 aa, Entamoeba invadens
DPCEP

SEQ ID NO: 2846270 - protein, 4 aa, Entamoeba invadens
DPCY

SEQ ID NO: 2846271 - protein, 6 aa, Entamoeba invadens
DPDDGL

SEQ ID NO: 2846272 - protein, 17 aa, Entamoeba invadens
DPDDNVSGMQPKSKSVG

SEQ ID NO: 2846273 - protein, 6 aa, Entamoeba invadens
DPDDRI

SEQ ID NO: 2846274 - protein, 15 aa, Entamoeba invadens
DPDDSIDDMKPSMRG

SEQ ID NO: 2846275 - protein, 5 aa, Entamoeba invadens
DPDEC

SEQ ID NO: 2846276 - protein, 13 aa, Entamoeba invadens
DPDEKKSVLDKEL

SEQ ID NO: 2846277 - protein, 8 aa, Entamoeba invadens
DPDEMGRA

SEQ ID NO: 2846278 - protein, 8 aa, Entamoeba invadens
DPDENQLE

SEQ ID NO: 2846279 - protein, 6 aa, Entamoeba invadens
DPDESS

SEQ ID NO: 2846280 - protein, 6 aa, Entamoeba invadens
DPDHPC

SEQ ID NO: 2846281 - protein, 4 aa, Entamoeba invadens
DPDL

SEQ ID NO: 2846282 - protein, 5 aa, Entamoeba invadens
DPDLV

SEQ ID NO: 2846283 - protein, 5 aa, Entamoeba invadens
DPDMK

SEQ ID NO: 2846284 - protein, 14 aa, Entamoeba invadens
DPDNDTEKWQPSVR

SEQ ID NO: 2846285 - protein, 15 aa, Entamoeba invadens
DPDNDVETWKPSIRG

SEQ ID NO: 2846286 - protein, 17 aa, Entamoeba invadens
DPDPTTNDWKPSPRGAG

SEQ ID NO: 2846287 - protein, 9 aa, Entamoeba invadens
DPDQRARAT

SEQ ID NO: 2846288 - protein, 5 aa, Entamoeba invadens
DPDTC

SEQ ID NO: 2846289 - protein, 5 aa, Entamoeba invadens
DPDTF

SEQ ID NO: 2846290 - protein, 6 aa, Entamoeba invadens
DPDTLE

SEQ ID NO: 2846291 - protein, 5 aa, Entamoeba invadens
DPDTN

SEQ ID NO: 2846292 - protein, 4 aa, Entamoeba invadens
DPDV

SEQ ID NO: 2846293 - protein, 8 aa, Entamoeba invadens
DPDYRKTW

SEQ ID NO: 2846294 - protein, 8 aa, Entamoeba invadens
DPEAMKPG

SEQ ID NO: 2846295 - protein, 8 aa, Entamoeba invadens
DPEASGAL

SEQ ID NO: 2846296 - protein, 21 aa, Entamoeba invadens
DPEDEEIEAKIEKAEDGTYNA

SEQ ID NO: 2846297 - protein, 16 aa, Entamoeba invadens
DPEDNKGRAPQNYLKP

SEQ ID NO: 2846298 - protein, 15 aa, Entamoeba invadens
DPEEKIGWEKSPRGA

SEQ ID NO: 2846299 - protein, 9 aa, Entamoeba invadens
DPEENEKGM

SEQ ID NO: 2846300 - protein, 8 aa, Entamoeba invadens
DPEENKPY

SEQ ID NO: 2846301 - protein, 23 aa, Entamoeba invadens
DPEGASSALSSTLRRASSNDDKV

SEQ ID NO: 2846302 - protein, 20 aa, Entamoeba invadens
DPEGKEVEITQKDNGDGTYE

SEQ ID NO: 2846303 - protein, 6 aa, Entamoeba invadens
DPEKAC

SEQ ID NO: 2846304 - protein, 8 aa, Entamoeba invadens
DPEKINNY

SEQ ID NO: 2846305 - protein, 8 aa, Entamoeba invadens
DPEKNKKY

SEQ ID NO: 2846306 - protein, 7 aa, Entamoeba invadens
DPEKNRD

SEQ ID NO: 2846307 - protein, 5 aa, Entamoeba invadens
DPEKR

SEQ ID NO: 2846308 - protein, 8 aa, Entamoeba invadens
DPEKRPTF

SEQ ID NO: 2846309 - protein, 10 aa, Entamoeba invadens
DPEKRYSAEQ

SEQ ID NO: 2846310 - protein, 5 aa, Entamoeba invadens
DPELA

SEQ ID NO: 2846311 - protein, 16 aa, Entamoeba invadens
DPELAKDFERKKEFDR

SEQ ID NO: 2846312 - protein, 14 aa, Entamoeba invadens
DPELKTQVEGAISG

SEQ ID NO: 2846313 - protein, 5 aa, Entamoeba invadens
DPELS

SEQ ID NO: 2846314 - protein, 5 aa, Entamoeba invadens
DPELT

SEQ ID NO: 2846315 - protein, 6 aa, Entamoeba invadens
DPEPIN

SEQ ID NO: 2846316 - protein, 6 aa, Entamoeba invadens
DPERIA

SEQ ID NO: 2846317 - protein, 14 aa, Entamoeba invadens
DPERTEKEKQITDV

SEQ ID NO: 2846318 - protein, 6 aa, Entamoeba invadens
DPERVP

SEQ ID NO: 2846319 - protein, 8 aa, Entamoeba invadens
DPERVPKA

SEQ ID NO: 2846320 - protein, 4 aa, Entamoeba invadens
DPES

SEQ ID NO: 2846321 - protein, 14 aa, Entamoeba invadens
DPESVLPEKDTEMT

SEQ ID NO: 2846322 - protein, 11 aa, Entamoeba invadens
DPETAKTISDD

SEQ ID NO: 2846323 - protein, 5 aa, Entamoeba invadens
DPETF

SEQ ID NO: 2846324 - protein, 5 aa, Entamoeba invadens
DPETG

SEQ ID NO: 2846325 - protein, 5 aa, Entamoeba invadens
DPETK

SEQ ID NO: 2846326 - protein, 4 aa, Entamoeba invadens
DPEY

SEQ ID NO: 2846327 - protein, 8 aa, Entamoeba invadens
DPEYRATW

SEQ ID NO: 2846328 - protein, 15 aa, Entamoeba invadens
DPEYRTSWDDSMKQQ

SEQ ID NO: 2846329 - protein, 4 aa, Entamoeba invadens
DPFC

SEQ ID NO: 2846330 - protein, 8 aa, Entamoeba invadens
DPFDPPKF

SEQ ID NO: 2846331 - protein, 5 aa, Entamoeba invadens
DPFEN

SEQ ID NO: 2846332 - protein, 4 aa, Entamoeba invadens
DPFI

SEQ ID NO: 2846333 - protein, 5 aa, Entamoeba invadens
DPFKS

SEQ ID NO: 2846334 - protein, 9 aa, Entamoeba invadens
DPFPDPKGF

SEQ ID NO: 2846335 - protein, 11 aa, Entamoeba invadens
DPFPREPPLPQ

SEQ ID NO: 2846336 - protein, 8 aa, Entamoeba invadens
DPFSRDAN

SEQ ID NO: 2846337 - protein, 7 aa, Entamoeba invadens
DPFTAEE

SEQ ID NO: 2846338 - protein, 7 aa, Entamoeba invadens
DPFTGKT

SEQ ID NO: 2846339 - protein, 4 aa, Entamoeba invadens
DPFV

SEQ ID NO: 2846340 - protein, 21 aa, Entamoeba invadens
DPGEDEVKITQTSEETDGGCF

SEQ ID NO: 2846341 - protein, 7 aa, Entamoeba invadens
DPGKNSG

SEQ ID NO: 2846342 - protein, 7 aa, Entamoeba invadens
DPGLGKS

SEQ ID NO: 2846343 - protein, 6 aa, Entamoeba invadens
DPGLGR

SEQ ID NO: 2846344 - protein, 4 aa, Entamoeba invadens
DPGQ

SEQ ID NO: 2846345 - protein, 5 aa, Entamoeba invadens
DPGSI

SEQ ID NO: 2846346 - protein, 8 aa, Entamoeba invadens
DPGTGKSQ

SEQ ID NO: 2846347 - protein, 8 aa, Entamoeba invadens
DPGTSKSQ

SEQ ID NO: 2846348 - protein, 6 aa, Entamoeba invadens
DPGVGK

SEQ ID NO: 2846349 - protein, 4 aa, Entamoeba invadens
DPHI

SEQ ID NO: 2846350 - protein, 5 aa, Entamoeba invadens
DPHSL

SEQ ID NO: 2846351 - protein, 7 aa, Entamoeba invadens
DPHSSYG

SEQ ID NO: 2846352 - protein, 4 aa, Entamoeba invadens
DPHT

SEQ ID NO: 2846353 - protein, 5 aa, Entamoeba invadens
DPIES

SEQ ID NO: 2846354 - protein, 5 aa, Entamoeba invadens
DPIGN

SEQ ID NO: 2846355 - protein, 5 aa, Entamoeba invadens
DPIKS

SEQ ID NO: 2846356 - protein, 4 aa, Entamoeba invadens
DPIP

SEQ ID NO: 2846357 - protein, 11 aa, Entamoeba invadens
DPIPEDDRPPL

SEQ ID NO: 2846358 - protein, 6 aa, Entamoeba invadens
DPIPSE

SEQ ID NO: 2846359 - protein, 4 aa, Entamoeba invadens
DPIS

SEQ ID NO: 2846360 - protein, 5 aa, Entamoeba invadens
DPIST

SEQ ID NO: 2846361 - protein, 4 aa, Entamoeba invadens
DPIT

SEQ ID NO: 2846362 - protein, 14 aa, Entamoeba invadens
DPITERNNEDRNMD

SEQ ID NO: 2846363 - protein, 7 aa, Entamoeba invadens
DPKAKVI

SEQ ID NO: 2846364 - protein, 5 aa, Entamoeba invadens
DPKDF

SEQ ID NO: 2846365 - protein, 7 aa, Entamoeba invadens
DPKDFRE

SEQ ID NO: 2846366 - protein, 5 aa, Entamoeba invadens
DPKDT

SEQ ID NO: 2846367 - protein, 9 aa, Entamoeba invadens
DPKDTTTHT

SEQ ID NO: 2846368 - protein, 4 aa, Entamoeba invadens
DPKE

SEQ ID NO: 2846369 - protein, 9 aa, Entamoeba invadens
DPKEGGPTH

SEQ ID NO: 2846370 - protein, 28 aa, Entamoeba invadens
DPKENPIAGDEESIRQEIENYKSKEDIK

SEQ ID NO: 2846371 - protein, 10 aa, Entamoeba invadens
DPKETANGSV

SEQ ID NO: 2846372 - protein, 8 aa, Entamoeba invadens
DPKGEELP

SEQ ID NO: 2846373 - protein, 6 aa, Entamoeba invadens
DPKGSV

SEQ ID NO: 2846374 - protein, 11 aa, Entamoeba invadens
DPKHPAKNLGR

SEQ ID NO: 2846375 - protein, 7 aa, Entamoeba invadens
DPKIQTI

SEQ ID NO: 2846376 - protein, 12 aa, Entamoeba invadens
DPKISTPTLTPE

SEQ ID NO: 2846377 - protein, 7 aa, Entamoeba invadens
DPKKAAE

SEQ ID NO: 2846378 - protein, 11 aa, Entamoeba invadens
DPKKEEEKLKK

SEQ ID NO: 2846379 - protein, 17 aa, Entamoeba invadens
DPKKFTKSSLSNKTEVS

SEQ ID NO: 2846380 - protein, 19 aa, Entamoeba invadens
DPKKGDKLTKIQTDLDETQ

SEQ ID NO: 2846381 - protein, 15 aa, Entamoeba invadens
DPKKLKKSLGSPALG

SEQ ID NO: 2846382 - protein, 8 aa, Entamoeba invadens
DPKKNEIY

SEQ ID NO: 2846383 - protein, 19 aa, Entamoeba invadens
DPKKTRDASDKSTERSSTL

SEQ ID NO: 2846384 - protein, 9 aa, Entamoeba invadens
DPKLNGPTG

SEQ ID NO: 2846385 - protein, 6 aa, Entamoeba invadens
DPKLPN

SEQ ID NO: 2846386 - protein, 6 aa, Entamoeba invadens
DPKNDS

SEQ ID NO: 2846387 - protein, 7 aa, Entamoeba invadens
DPKPNTI

SEQ ID NO: 2846388 - protein, 5 aa, Entamoeba invadens
DPKQM

SEQ ID NO: 2846389 - protein, 6 aa, Entamoeba invadens
DPKQSI

SEQ ID NO: 2846390 - protein, 5 aa, Entamoeba invadens
DPKQY

SEQ ID NO: 2846391 - protein, 5 aa, Entamoeba invadens
DPKRK

SEQ ID NO: 2846392 - protein, 6 aa, Entamoeba invadens
DPKRKH

SEQ ID NO: 2846393 - protein, 13 aa, Entamoeba invadens
DPKSDEMNGGGSF

SEQ ID NO: 2846394 - protein, 7 aa, Entamoeba invadens
DPKSDRG

SEQ ID NO: 2846395 - protein, 9 aa, Entamoeba invadens
DPKSGEDKV

SEQ ID NO: 2846396 - protein, 10 aa, Entamoeba invadens
DPKSGKEVKP

SEQ ID NO: 2846397 - protein, 13 aa, Entamoeba invadens
DPKSKISTISPEG

SEQ ID NO: 2846398 - protein, 16 aa, Entamoeba invadens
DPKSKISTISPEGNEE

SEQ ID NO: 2846399 - protein, 16 aa, Entamoeba invadens
DPKSKISTMSTEGNEE

SEQ ID NO: 2846400 - protein, 7 aa, Entamoeba invadens
DPKSRPQ

SEQ ID NO: 2846401 - protein, 9 aa, Entamoeba invadens
DPKSVDFQG

SEQ ID NO: 2846402 - protein, 4 aa, Entamoeba invadens
DPKT

SEQ ID NO: 2846403 - protein, 5 aa, Entamoeba invadens
DPKTF

SEQ ID NO: 2846404 - protein, 6 aa, Entamoeba invadens
DPKTGV

SEQ ID NO: 2846405 - protein, 7 aa, Entamoeba invadens
DPKTKPT

SEQ ID NO: 2846406 - protein, 9 aa, Entamoeba invadens
DPKTPREDR

SEQ ID NO: 2846407 - protein, 8 aa, Entamoeba invadens
DPKTSAKT

SEQ ID NO: 2846408 - protein, 6 aa, Entamoeba invadens
DPKVCG

SEQ ID NO: 2846409 - protein, 6 aa, Entamoeba invadens
DPKVGP

SEQ ID NO: 2846410 - protein, 33 aa, Entamoeba invadens
DPKVSPRQPQEQKVEKPEAKETPQETKEDHLED

SEQ ID NO: 2846411 - protein, 4 aa, Entamoeba invadens
DPKY

SEQ ID NO: 2846412 - protein, 6 aa, Entamoeba invadens
DPLDEQ

SEQ ID NO: 2846413 - protein, 6 aa, Entamoeba invadens
DPLEDN

SEQ ID NO: 2846414 - protein, 30 aa, Entamoeba invadens
DPLEKNRYVESAKKNKLSHAPHPQSTPIQQ

SEQ ID NO: 2846415 - protein, 16 aa, Entamoeba invadens
DPLLQASTKTATTGQR

SEQ ID NO: 2846416 - protein, 5 aa, Entamoeba invadens
DPLNV

SEQ ID NO: 2846417 - protein, 20 aa, Entamoeba invadens
DPLPPIKEDEEVKNTEYQTQ

SEQ ID NO: 2846418 - protein, 16 aa, Entamoeba invadens
DPLPTNIKTSENQKEI

SEQ ID NO: 2846419 - protein, 9 aa, Entamoeba invadens
DPLQENNDN

SEQ ID NO: 2846420 - protein, 4 aa, Entamoeba invadens
DPLR

SEQ ID NO: 2846421 - protein, 8 aa, Entamoeba invadens
DPLSPITR

SEQ ID NO: 2846422 - protein, 5 aa, Entamoeba invadens
DPLTN

SEQ ID NO: 2846423 - protein, 9 aa, Entamoeba invadens
DPMNPTNFS

SEQ ID NO: 2846424 - protein, 5 aa, Entamoeba invadens
DPMPK

SEQ ID NO: 2846425 - protein, 8 aa, Entamoeba invadens
DPNAKLSS

SEQ ID NO: 2846426 - protein, 10 aa, Entamoeba invadens
DPNAKNETDF

SEQ ID NO: 2846427 - protein, 12 aa, Entamoeba invadens
DPNAPKTSTPHE

SEQ ID NO: 2846428 - protein, 4 aa, Entamoeba invadens
DPNC

SEQ ID NO: 2846429 - protein, 5 aa, Entamoeba invadens
DPNCT

SEQ ID NO: 2846430 - protein, 12 aa, Entamoeba invadens
DPNDFLDYNHFY

SEQ ID NO: 2846431 - protein, 8 aa, Entamoeba invadens
DPNDKGIK

SEQ ID NO: 2846432 - protein, 5 aa, Entamoeba invadens
DPNDL

SEQ ID NO: 2846433 - protein, 5 aa, Entamoeba invadens
DPNED

SEQ ID NO: 2846434 - protein, 5 aa, Entamoeba invadens
DPNEL

SEQ ID NO: 2846435 - protein, 5 aa, Entamoeba invadens
DPNEN

SEQ ID NO: 2846436 - protein, 38 aa, Entamoeba invadens
DPNESEKQDEHMEEEETKQIEEDEEQQKEPLKHKKSSV

SEQ ID NO: 2846437 - protein, 4 aa, Entamoeba invadens
DPNF

SEQ ID NO: 2846438 - protein, 8 aa, Entamoeba invadens
DPNKTPSL

SEQ ID NO: 2846439 - protein, 4 aa, Entamoeba invadens
DPNL

SEQ ID NO: 2846440 - protein, 12 aa, Entamoeba invadens
DPNLENQSDPSY

SEQ ID NO: 2846441 - protein, 7 aa, Entamoeba invadens
DPNNEES

SEQ ID NO: 2846442 - protein, 12 aa, Entamoeba invadens
DPNNSPTRKTEA

SEQ ID NO: 2846443 - protein, 8 aa, Entamoeba invadens
DPNPIAKA

SEQ ID NO: 2846444 - protein, 13 aa, Entamoeba invadens
DPNPNSPANGEAA

SEQ ID NO: 2846445 - protein, 12 aa, Entamoeba invadens
DPNQKNTEDLAK

SEQ ID NO: 2846446 - protein, 7 aa, Entamoeba invadens
DPNQQID

SEQ ID NO: 2846447 - protein, 9 aa, Entamoeba invadens
DPNQTQRCT

SEQ ID NO: 2846448 - protein, 7 aa, Entamoeba invadens
DPNQVDG

SEQ ID NO: 2846449 - protein, 8 aa, Entamoeba invadens
DPNRRCGQ

SEQ ID NO: 2846450 - protein, 7 aa, Entamoeba invadens
DPNRRVS

SEQ ID NO: 2846451 - protein, 7 aa, Entamoeba invadens
DPNSIKS

SEQ ID NO: 2846452 - protein, 7 aa, Entamoeba invadens
DPNSKKH

SEQ ID NO: 2846453 - protein, 9 aa, Entamoeba invadens
DPNTCSDGL

SEQ ID NO: 2846454 - protein, 23 aa, Entamoeba invadens
DPNTQPTIGNISANTKLDDGTDT

SEQ ID NO: 2846455 - protein, 8 aa, Entamoeba invadens
DPNTQQKI

SEQ ID NO: 2846456 - protein, 12 aa, Entamoeba invadens
DPNTRPSAEELS

SEQ ID NO: 2846457 - protein, 6 aa, Entamoeba invadens
DPNTRT

SEQ ID NO: 2846458 - protein, 27 aa, Entamoeba invadens
DPNTSAVKKEARRDDKDKEKHEEKKRY

SEQ ID NO: 2846459 - protein, 13 aa, Entamoeba invadens
DPNVNSPANPIAS

SEQ ID NO: 2846460 - protein, 9 aa, Entamoeba invadens
DPPAPKQKV

SEQ ID NO: 2846461 - protein, 7 aa, Entamoeba invadens
DPPASQE

SEQ ID NO: 2846462 - protein, 11 aa, Entamoeba invadens
DPPENDYTTKP

SEQ ID NO: 2846463 - protein, 9 aa, Entamoeba invadens
DPPGETSEY

SEQ ID NO: 2846464 - protein, 17 aa, Entamoeba invadens
DPPKHKAGQSAGNANLT

SEQ ID NO: 2846465 - protein, 6 aa, Entamoeba invadens
DPPKQK

SEQ ID NO: 2846466 - protein, 4 aa, Entamoeba invadens
DPPL

SEQ ID NO: 2846467 - protein, 9 aa, Entamoeba invadens
DPPQDPKTY

SEQ ID NO: 2846468 - protein, 8 aa, Entamoeba invadens
DPPSEESV

SEQ ID NO: 2846469 - protein, 9 aa, Entamoeba invadens
DPPSTSCET

SEQ ID NO: 2846470 - protein, 12 aa, Entamoeba invadens
DPPSVPKRPPTM

SEQ ID NO: 2846471 - protein, 13 aa, Entamoeba invadens
DPPVGISSGPIDE

SEQ ID NO: 2846472 - protein, 4 aa, Entamoeba invadens
DPPY

SEQ ID NO: 2846473 - protein, 6 aa, Entamoeba invadens
DPPYEG

SEQ ID NO: 2846474 - protein, 22 aa, Entamoeba invadens
DPPYGIREGARKVGKRHPDMEP

SEQ ID NO: 2846475 - protein, 4 aa, Entamoeba invadens
DPQA

SEQ ID NO: 2846476 - protein, 5 aa, Entamoeba invadens
DPQDD

SEQ ID NO: 2846477 - protein, 11 aa, Entamoeba invadens
DPQDDSDYDQL

SEQ ID NO: 2846478 - protein, 15 aa, Entamoeba invadens
DPQDESSGNDSEKWK

SEQ ID NO: 2846479 - protein, 5 aa, Entamoeba invadens
DPQFT

SEQ ID NO: 2846480 - protein, 7 aa, Entamoeba invadens
DPQGNEV

SEQ ID NO: 2846481 - protein, 8 aa, Entamoeba invadens
DPQGNEVP

SEQ ID NO: 2846482 - protein, 9 aa, Entamoeba invadens
DPQHFSPKT

SEQ ID NO: 2846483 - protein, 10 aa, Entamoeba invadens
DPQNENLSST

SEQ ID NO: 2846484 - protein, 6 aa, Entamoeba invadens
DPQNIA

SEQ ID NO: 2846485 - protein, 8 aa, Entamoeba invadens
DPQNTGTI

SEQ ID NO: 2846486 - protein, 4 aa, Entamoeba invadens
DPQP

SEQ ID NO: 2846487 - protein, 22 aa, Entamoeba invadens
DPQPGQQPQQLGQQQPSQQPQF

SEQ ID NO: 2846488 - protein, 7 aa, Entamoeba invadens
DPQQETL

SEQ ID NO: 2846489 - protein, 6 aa, Entamoeba invadens
DPQRQS

SEQ ID NO: 2846490 - protein, 4 aa, Entamoeba invadens
DPQT

SEQ ID NO: 2846491 - protein, 12 aa, Entamoeba invadens
DPQTFEDSNYPE

SEQ ID NO: 2846492 - protein, 9 aa, Entamoeba invadens
DPQTGKTTI

SEQ ID NO: 2846493 - protein, 5 aa, Entamoeba invadens
DPQTI

SEQ ID NO: 2846494 - protein, 6 aa, Entamoeba invadens
DPQYLA

SEQ ID NO: 2846495 - protein, 6 aa, Entamoeba invadens
DPQYNN

SEQ ID NO: 2846496 - protein, 7 aa, Entamoeba invadens
DPQYPTI

SEQ ID NO: 2846497 - protein, 5 aa, Entamoeba invadens
DPQYT

SEQ ID NO: 2846498 - protein, 14 aa, Entamoeba invadens
DPRAPQKPVEQSSA

SEQ ID NO: 2846499 - protein, 4 aa, Entamoeba invadens
DPRD

SEQ ID NO: 2846500 - protein, 10 aa, Entamoeba invadens
DPREAKTKVN

SEQ ID NO: 2846501 - protein, 13 aa, Entamoeba invadens
DPREGENKKKTVP

SEQ ID NO: 2846502 - protein, 7 aa, Entamoeba invadens
DPREKMR

SEQ ID NO: 2846503 - protein, 6 aa, Entamoeba invadens
DPREKR

SEQ ID NO: 2846504 - protein, 4 aa, Entamoeba invadens
DPRG

SEQ ID NO: 2846505 - protein, 7 aa, Entamoeba invadens
DPRGSIP

SEQ ID NO: 2846506 - protein, 5 aa, Entamoeba invadens
DPRKC

SEQ ID NO: 2846507 - protein, 5 aa, Entamoeba invadens
DPRNN

SEQ ID NO: 2846508 - protein, 5 aa, Entamoeba invadens
DPRQI

SEQ ID NO: 2846509 - protein, 6 aa, Entamoeba invadens
DPRQKN

SEQ ID NO: 2846510 - protein, 23 aa, Entamoeba invadens
DPRRCETKKFGGPGARAKYQKSY

SEQ ID NO: 2846511 - protein, 6 aa, Entamoeba invadens
DPRSVP

SEQ ID NO: 2846512 - protein, 6 aa, Entamoeba invadens
DPRTVS

SEQ ID NO: 2846513 - protein, 5 aa, Entamoeba invadens
DPRYR

SEQ ID NO: 2846514 - protein, 6 aa, Entamoeba invadens
DPSDFV

SEQ ID NO: 2846515 - protein, 9 aa, Entamoeba invadens
DPSDREETI

SEQ ID NO: 2846516 - protein, 6 aa, Entamoeba invadens
DPSEVA

SEQ ID NO: 2846517 - protein, 4 aa, Entamoeba invadens
DPSG

SEQ ID NO: 2846518 - protein, 7 aa, Entamoeba invadens
DPSGNSF

SEQ ID NO: 2846519 - protein, 8 aa, Entamoeba invadens
DPSGSERF

SEQ ID NO: 2846520 - protein, 12 aa, Entamoeba invadens
DPSGVETPCDSE

SEQ ID NO: 2846521 - protein, 6 aa, Entamoeba invadens
DPSGVL

SEQ ID NO: 2846522 - protein, 4 aa, Entamoeba invadens
DPSK

SEQ ID NO: 2846523 - protein, 12 aa, Entamoeba invadens
DPSKKGTGVNPL

SEQ ID NO: 2846524 - protein, 11 aa, Entamoeba invadens
DPSKKGVGVNP

SEQ ID NO: 2846525 - protein, 16 aa, Entamoeba invadens
DPSKRPSIDELQQMAC

SEQ ID NO: 2846526 - protein, 8 aa, Entamoeba invadens
DPSNGKYL

SEQ ID NO: 2846527 - protein, 8 aa, Entamoeba invadens
DPSNIQKV

SEQ ID NO: 2846528 - protein, 6 aa, Entamoeba invadens
DPSNNE

SEQ ID NO: 2846529 - protein, 8 aa, Entamoeba invadens
DPSPCDGK

SEQ ID NO: 2846530 - protein, 13 aa, Entamoeba invadens
DPSQKKEFVDKTR

SEQ ID NO: 2846531 - protein, 9 aa, Entamoeba invadens
DPSSETQDR

SEQ ID NO: 2846532 - protein, 7 aa, Entamoeba invadens
DPSSSIR

SEQ ID NO: 2846533 - protein, 4 aa, Entamoeba invadens
DPST

SEQ ID NO: 2846534 - protein, 9 aa, Entamoeba invadens
DPSTGKPEA

SEQ ID NO: 2846535 - protein, 9 aa, Entamoeba invadens
DPSTIEAPL

SEQ ID NO: 2846536 - protein, 16 aa, Entamoeba invadens
DPSTKEMLKNSEEELI

SEQ ID NO: 2846537 - protein, 8 aa, Entamoeba invadens
DPSTQSYH

SEQ ID NO: 2846538 - protein, 18 aa, Entamoeba invadens
DPSTSSSSCIAAYLPLVL

SEQ ID NO: 2846539 - protein, 5 aa, Entamoeba invadens
DPSTT

SEQ ID NO: 2846540 - protein, 4 aa, Entamoeba invadens
DPSV

SEQ ID NO: 2846541 - protein, 12 aa, Entamoeba invadens
DPSVASDTDFEG

SEQ ID NO: 2846542 - protein, 12 aa, Entamoeba invadens
DPSVDTTVKDTG

SEQ ID NO: 2846543 - protein, 5 aa, Entamoeba invadens
DPSVI

SEQ ID NO: 2846544 - protein, 5 aa, Entamoeba invadens
DPSWN

SEQ ID NO: 2846545 - protein, 10 aa, Entamoeba invadens
DPSYTSGCNE

SEQ ID NO: 2846546 - protein, 6 aa, Entamoeba invadens
DPTAPL

SEQ ID NO: 2846547 - protein, 8 aa, Entamoeba invadens
DPTAPRNF

SEQ ID NO: 2846548 - protein, 18 aa, Entamoeba invadens
DPTDGDGQFADKGESYKT

SEQ ID NO: 2846549 - protein, 9 aa, Entamoeba invadens
DPTEGSNLN

SEQ ID NO: 2846550 - protein, 7 aa, Entamoeba invadens
DPTEGVN

SEQ ID NO: 2846551 - protein, 11 aa, Entamoeba invadens
DPTEIEKCQDQ

SEQ ID NO: 2846552 - protein, 7 aa, Entamoeba invadens
DPTERRE

SEQ ID NO: 2846553 - protein, 8 aa, Entamoeba invadens
DPTESGID

SEQ ID NO: 2846554 - protein, 11 aa, Entamoeba invadens
DPTEVARRAVS

SEQ ID NO: 2846555 - protein, 6 aa, Entamoeba invadens
DPTHPE

SEQ ID NO: 2846556 - protein, 9 aa, Entamoeba invadens
DPTIENKGD

SEQ ID NO: 2846557 - protein, 5 aa, Entamoeba invadens
DPTIS

SEQ ID NO: 2846558 - protein, 16 aa, Entamoeba invadens
DPTLEDQSEQTDQQSI

SEQ ID NO: 2846559 - protein, 12 aa, Entamoeba invadens
DPTMDTPPTRAS

SEQ ID NO: 2846560 - protein, 11 aa, Entamoeba invadens
DPTNDDPYTKR

SEQ ID NO: 2846561 - protein, 8 aa, Entamoeba invadens
DPTNPKGW

SEQ ID NO: 2846562 - protein, 6 aa, Entamoeba invadens
DPTPEI

SEQ ID NO: 2846563 - protein, 8 aa, Entamoeba invadens
DPTPESVK

SEQ ID NO: 2846564 - protein, 10 aa, Entamoeba invadens
DPTPIITPGE

SEQ ID NO: 2846565 - protein, 7 aa, Entamoeba invadens
DPTPVEG

SEQ ID NO: 2846566 - protein, 6 aa, Entamoeba invadens
DPTQEY

SEQ ID NO: 2846567 - protein, 6 aa, Entamoeba invadens
DPTQNF

SEQ ID NO: 2846568 - protein, 8 aa, Entamoeba invadens
DPTQSDNE

SEQ ID NO: 2846569 - protein, 10 aa, Entamoeba invadens
DPTSFAPKNE

SEQ ID NO: 2846570 - protein, 7 aa, Entamoeba invadens
DPTSKGM

SEQ ID NO: 2846571 - protein, 12 aa, Entamoeba invadens
DPTSQEEDDKVG

SEQ ID NO: 2846572 - protein, 8 aa, Entamoeba invadens
DPTSSHLK

SEQ ID NO: 2846573 - protein, 4 aa, Entamoeba invadens
DPTT

SEQ ID NO: 2846574 - protein, 17 aa, Entamoeba invadens
DPTTNDRTWGQTKEKQL

SEQ ID NO: 2846575 - protein, 18 aa, Entamoeba invadens
DPTTSAPLCTPRREVTPR

SEQ ID NO: 2846576 - protein, 4 aa, Entamoeba invadens
DPTV

SEQ ID NO: 2846577 - protein, 5 aa, Entamoeba invadens
DPTVD

SEQ ID NO: 2846578 - protein, 6 aa, Entamoeba invadens
DPVKEE

SEQ ID NO: 2846579 - protein, 6 aa, Entamoeba invadens
DPVPSY

SEQ ID NO: 2846580 - protein, 13 aa, Entamoeba invadens
DPYCPTTTTVTEK

SEQ ID NO: 2846581 - protein, 6 aa, Entamoeba invadens
DPYDES

SEQ ID NO: 2846582 - protein, 5 aa, Entamoeba invadens
DPYEQ

SEQ ID NO: 2846583 - protein, 5 aa, Entamoeba invadens
DPYNK

SEQ ID NO: 2846584 - protein, 6 aa, Entamoeba invadens
DPYPKE

SEQ ID NO: 2846585 - protein, 7 aa, Entamoeba invadens
DPYPKSD

SEQ ID NO: 2846586 - protein, 7 aa, Entamoeba invadens
DPYQSSQ

SEQ ID NO: 2846587 - protein, 7 aa, Entamoeba invadens
DPYSSSW

SEQ ID NO: 2846588 - protein, 7 aa, Entamoeba invadens
DQAAEDA

SEQ ID NO: 2846589 - protein, 7 aa, Entamoeba invadens
DQADQIQ

SEQ ID NO: 2846590 - protein, 9 aa, Entamoeba invadens
DQAETENLA

SEQ ID NO: 2846591 - protein, 5 aa, Entamoeba invadens
DQAFQ

SEQ ID NO: 2846592 - protein, 4 aa, Entamoeba invadens
DQAI

SEQ ID NO: 2846593 - protein, 13 aa, Entamoeba invadens
DQAKRNSKNRDAF

SEQ ID NO: 2846594 - protein, 9 aa, Entamoeba invadens
DQALDGDER

SEQ ID NO: 2846595 - protein, 5 aa, Entamoeba invadens
DQANG

SEQ ID NO: 2846596 - protein, 8 aa, Entamoeba invadens
DQATSVAQ

SEQ ID NO: 2846597 - protein, 5 aa, Entamoeba invadens
DQCAK

SEQ ID NO: 2846598 - protein, 8 aa, Entamoeba invadens
DQCKAGSR

SEQ ID NO: 2846599 - protein, 54 aa, Entamoeba invadens
DQCKKEGEKLKTEYDRLTKEKVELEERVEKEKEEIQQKQIEEEKLQKEQEKEVE

SEQ ID NO: 2846600 - protein, 7 aa, Entamoeba invadens
DQCTEPV

SEQ ID NO: 2846601 - protein, 5 aa, Entamoeba invadens
DQDAT

SEQ ID NO: 2846602 - protein, 6 aa, Entamoeba invadens
DQDDSF

SEQ ID NO: 2846603 - protein, 15 aa, Entamoeba invadens
DQDEAGLLPNSVLIT

SEQ ID NO: 2846604 - protein, 7 aa, Entamoeba invadens
DQDEDNI

SEQ ID NO: 2846605 - protein, 8 aa, Entamoeba invadens
DQDETSEM

SEQ ID NO: 2846606 - protein, 15 aa, Entamoeba invadens
DQDEWTRGEAKGVTD

SEQ ID NO: 2846607 - protein, 7 aa, Entamoeba invadens
DQDGAFN

SEQ ID NO: 2846608 - protein, 9 aa, Entamoeba invadens
DQDGAIDSA

SEQ ID NO: 2846609 - protein, 11 aa, Entamoeba invadens
DQDGKPDDDFP

SEQ ID NO: 2846610 - protein, 7 aa, Entamoeba invadens
DQDGKYH

SEQ ID NO: 2846611 - protein, 6 aa, Entamoeba invadens
DQDGSD

SEQ ID NO: 2846612 - protein, 14 aa, Entamoeba invadens
DQDIQTPEFKSSEI

SEQ ID NO: 2846613 - protein, 7 aa, Entamoeba invadens
DQDLKER

SEQ ID NO: 2846614 - protein, 5 aa, Entamoeba invadens
DQDPH

SEQ ID NO: 2846615 - protein, 6 aa, Entamoeba invadens
DQDPSV

SEQ ID NO: 2846616 - protein, 9 aa, Entamoeba invadens
DQDSDPAIN

SEQ ID NO: 2846617 - protein, 8 aa, Entamoeba invadens
DQDSTQEQ

SEQ ID NO: 2846618 - protein, 4 aa, Entamoeba invadens
DQDV

SEQ ID NO: 2846619 - protein, 7 aa, Entamoeba invadens
DQDYEEI

SEQ ID NO: 2846620 - protein, 5 aa, Entamoeba invadens
DQDYN

SEQ ID NO: 2846621 - protein, 32 aa, Entamoeba invadens
DQEASNSNGSQEQKQSKKGSFLKTPRNREKQH

SEQ ID NO: 2846622 - protein, 9 aa, Entamoeba invadens
DQEEATKCD

SEQ ID NO: 2846623 - protein, 4 aa, Entamoeba invadens
DQEG

SEQ ID NO: 2846624 - protein, 5 aa, Entamoeba invadens
DQEIE

SEQ ID NO: 2846625 - protein, 9 aa, Entamoeba invadens
DQEIEEKRP

SEQ ID NO: 2846626 - protein, 7 aa, Entamoeba invadens
DQEKKDE

SEQ ID NO: 2846627 - protein, 4 aa, Entamoeba invadens
DQEN

SEQ ID NO: 2846628 - protein, 21 aa, Entamoeba invadens
DQENELQNLEEKNEQDDEDRK

SEQ ID NO: 2846629 - protein, 7 aa, Entamoeba invadens
DQENHAS

SEQ ID NO: 2846630 - protein, 10 aa, Entamoeba invadens
DQEPYDHTRG

SEQ ID NO: 2846631 - protein, 6 aa, Entamoeba invadens
DQEQDL

SEQ ID NO: 2846632 - protein, 5 aa, Entamoeba invadens
DQESR

SEQ ID NO: 2846633 - protein, 10 aa, Entamoeba invadens
DQETDGEMSI

SEQ ID NO: 2846634 - protein, 6 aa, Entamoeba invadens
DQETGD

SEQ ID NO: 2846635 - protein, 13 aa, Entamoeba invadens
DQFEANEKALDEL

SEQ ID NO: 2846636 - protein, 6 aa, Entamoeba invadens
DQFPNP

SEQ ID NO: 2846637 - protein, 4 aa, Entamoeba invadens
DQFS

SEQ ID NO: 2846638 - protein, 10 aa, Entamoeba invadens
DQFSDIDTTI

SEQ ID NO: 2846639 - protein, 8 aa, Entamoeba invadens
DQGEGEKL

SEQ ID NO: 2846640 - protein, 4 aa, Entamoeba invadens
DQGF

SEQ ID NO: 2846641 - protein, 5 aa, Entamoeba invadens
DQGIY

SEQ ID NO: 2846642 - protein, 9 aa, Entamoeba invadens
DQGKDAEKF

SEQ ID NO: 2846643 - protein, 14 aa, Entamoeba invadens
DQGLTTKEKRRTDF

SEQ ID NO: 2846644 - protein, 8 aa, Entamoeba invadens
DQGRRPFE

SEQ ID NO: 2846645 - protein, 11 aa, Entamoeba invadens
DQGTTRSNHPD

SEQ ID NO: 2846646 - protein, 50 aa, Entamoeba invadens
DQHDDDDVDITNDQQDQKENVEEKDTEDIPQPDNTPSTTTKQEKGQDELP

SEQ ID NO: 2846647 - protein, 6 aa, Entamoeba invadens
DQHLGG

SEQ ID NO: 2846648 - protein, 4 aa, Entamoeba invadens
DQHT

SEQ ID NO: 2846649 - protein, 15 aa, Entamoeba invadens
DQHTESDDAEVQQTT

SEQ ID NO: 2846650 - protein, 5 aa, Entamoeba invadens
DQHTL

SEQ ID NO: 2846651 - protein, 13 aa, Entamoeba invadens
DQIANEKKAIMDR

SEQ ID NO: 2846652 - protein, 4 aa, Entamoeba invadens
DQID

SEQ ID NO: 2846653 - protein, 27 aa, Entamoeba invadens
DQIDNTQKDQLEQQDEVPRKKAPTSET

SEQ ID NO: 2846654 - protein, 4 aa, Entamoeba invadens
DQIE

SEQ ID NO: 2846655 - protein, 5 aa, Entamoeba invadens
DQIEQ

SEQ ID NO: 2846656 - protein, 64 aa, Entamoeba invadens
DQIKESPSPQIPNPQPSSPQLEETKKSQAKTEKQKEKKSNKTEKKRETKGSQRQSAPRVGEPYD

SEQ ID NO: 2846657 - protein, 5 aa, Entamoeba invadens
DQIKN

SEQ ID NO: 2846658 - protein, 10 aa, Entamoeba invadens
DQIKNSKKLI

SEQ ID NO: 2846659 - protein, 9 aa, Entamoeba invadens
DQIKPITSS

SEQ ID NO: 2846660 - protein, 20 aa, Entamoeba invadens
DQIQMGKSTAVDKNKKKEPL

SEQ ID NO: 2846661 - protein, 4 aa, Entamoeba invadens
DQIS

SEQ ID NO: 2846662 - protein, 4 aa, Entamoeba invadens
DQIT

SEQ ID NO: 2846663 - protein, 5 aa, Entamoeba invadens
DQITE

SEQ ID NO: 2846664 - protein, 6 aa, Entamoeba invadens
DQITNR

SEQ ID NO: 2846665 - protein, 18 aa, Entamoeba invadens
DQITNSKTTLGNEAKGAN

SEQ ID NO: 2846666 - protein, 9 aa, Entamoeba invadens
DQKAIPKDY

SEQ ID NO: 2846667 - protein, 39 aa, Entamoeba invadens
DQKETQETEFKKQKESLVSKYEEEKKELTSKIDEKTKQL

SEQ ID NO: 2846668 - protein, 9 aa, Entamoeba invadens
DQKEVQKIT

SEQ ID NO: 2846669 - protein, 9 aa, Entamoeba invadens
DQKGNKDYV

SEQ ID NO: 2846670 - protein, 5 aa, Entamoeba invadens
DQKGT

SEQ ID NO: 2846671 - protein, 9 aa, Entamoeba invadens
DQKGTPEDP

SEQ ID NO: 2846672 - protein, 9 aa, Entamoeba invadens
DQKKNARIS

SEQ ID NO: 2846673 - protein, 11 aa, Entamoeba invadens
DQKMTKNERKV

SEQ ID NO: 2846674 - protein, 10 aa, Entamoeba invadens
DQKNINEKTD

SEQ ID NO: 2846675 - protein, 7 aa, Entamoeba invadens
DQKNKFG

SEQ ID NO: 2846676 - protein, 6 aa, Entamoeba invadens
DQKNVD

SEQ ID NO: 2846677 - protein, 13 aa, Entamoeba invadens
DQKPPLKGETPED

SEQ ID NO: 2846678 - protein, 13 aa, Entamoeba invadens
DQKPPLTGESSED

SEQ ID NO: 2846679 - protein, 4 aa, Entamoeba invadens
DQKR

SEQ ID NO: 2846680 - protein, 11 aa, Entamoeba invadens
DQKRAGYQDTQ

SEQ ID NO: 2846681 - protein, 5 aa, Entamoeba invadens
DQKRN

SEQ ID NO: 2846682 - protein, 4 aa, Entamoeba invadens
DQKS

SEQ ID NO: 2846683 - protein, 11 aa, Entamoeba invadens
DQKSRKEETEK

SEQ ID NO: 2846684 - protein, 7 aa, Entamoeba invadens
DQKSRQI

SEQ ID NO: 2846685 - protein, 6 aa, Entamoeba invadens
DQKSSE

SEQ ID NO: 2846686 - protein, 8 aa, Entamoeba invadens
DQKTASTE

SEQ ID NO: 2846687 - protein, 10 aa, Entamoeba invadens
DQKTKGYEGM

SEQ ID NO: 2846688 - protein, 5 aa, Entamoeba invadens
DQKTT

SEQ ID NO: 2846689 - protein, 4 aa, Entamoeba invadens
DQKV

SEQ ID NO: 2846690 - protein, 5 aa, Entamoeba invadens
DQKVD

SEQ ID NO: 2846691 - protein, 10 aa, Entamoeba invadens
DQKVSDDQYE

SEQ ID NO: 2846692 - protein, 23 aa, Entamoeba invadens
DQLDRTTGKVSKKNPPFLKSGTV

SEQ ID NO: 2846693 - protein, 13 aa, Entamoeba invadens
DQLEAENKKEPLD

SEQ ID NO: 2846694 - protein, 7 aa, Entamoeba invadens
DQLEETM

SEQ ID NO: 2846695 - protein, 26 aa, Entamoeba invadens
DQLEKPQSIKNPMSPDKSPTSSPDRR

SEQ ID NO: 2846696 - protein, 10 aa, Entamoeba invadens
DQLEKSQSLL

SEQ ID NO: 2846697 - protein, 21 aa, Entamoeba invadens
DQLKKQTKKPAIKKPTVKKDK

SEQ ID NO: 2846698 - protein, 23 aa, Entamoeba invadens
DQLKTQNENLQTEKARTENDDVD

SEQ ID NO: 2846699 - protein, 4 aa, Entamoeba invadens
DQLP

SEQ ID NO: 2846700 - protein, 8 aa, Entamoeba invadens
DQLQKSTE

SEQ ID NO: 2846701 - protein, 11 aa, Entamoeba invadens
DQLSKDQINYA

SEQ ID NO: 2846702 - protein, 8 aa, Entamoeba invadens
DQLSPKVQ

SEQ ID NO: 2846703 - protein, 7 aa, Entamoeba invadens
DQLTSEY

SEQ ID NO: 2846704 - protein, 13 aa, Entamoeba invadens
DQLTTGGLTTERK

SEQ ID NO: 2846705 - protein, 7 aa, Entamoeba invadens
DQMDRGN

SEQ ID NO: 2846706 - protein, 13 aa, Entamoeba invadens
DQMEAETKSSQVD

SEQ ID NO: 2846707 - protein, 5 aa, Entamoeba invadens
DQMGQ

SEQ ID NO: 2846708 - protein, 21 aa, Entamoeba invadens
DQMGQKETLQLNKGKEQDSGC

SEQ ID NO: 2846709 - protein, 10 aa, Entamoeba invadens
DQMRKEKDTI

SEQ ID NO: 2846710 - protein, 8 aa, Entamoeba invadens
DQNDGTDF

SEQ ID NO: 2846711 - protein, 4 aa, Entamoeba invadens
DQNG

SEQ ID NO: 2846712 - protein, 13 aa, Entamoeba invadens
DQNGRTVGKGGEP

SEQ ID NO: 2846713 - protein, 7 aa, Entamoeba invadens
DQNHNND

SEQ ID NO: 2846714 - protein, 8 aa, Entamoeba invadens
DQNKKARL

SEQ ID NO: 2846715 - protein, 15 aa, Entamoeba invadens
DQNKVGEAKKQLEEK

SEQ ID NO: 2846716 - protein, 4 aa, Entamoeba invadens
DQNL

SEQ ID NO: 2846717 - protein, 7 aa, Entamoeba invadens
DQNNKFG

SEQ ID NO: 2846718 - protein, 8 aa, Entamoeba invadens
DQNPKTTA

SEQ ID NO: 2846719 - protein, 10 aa, Entamoeba invadens
DQNPQETPKH

SEQ ID NO: 2846720 - protein, 6 aa, Entamoeba invadens
DQNSAS

SEQ ID NO: 2846721 - protein, 6 aa, Entamoeba invadens
DQNSQF

SEQ ID NO: 2846722 - protein, 6 aa, Entamoeba invadens
DQNTPF

SEQ ID NO: 2846723 - protein, 8 aa, Entamoeba invadens
DQNTPIQN

SEQ ID NO: 2846724 - protein, 7 aa, Entamoeba invadens
DQNTPLK

SEQ ID NO: 2846725 - protein, 29 aa, Entamoeba invadens
DQNTQLDAAKKEMKKSSVEDASKIENYES

SEQ ID NO: 2846726 - protein, 22 aa, Entamoeba invadens
DQNTRLDAAKKNMKKWSIERNE

SEQ ID NO: 2846727 - protein, 29 aa, Entamoeba invadens
DQNTRLNAAKKDMKKQSVEDASKIENYES

SEQ ID NO: 2846728 - protein, 4 aa, Entamoeba invadens
DQNV

SEQ ID NO: 2846729 - protein, 5 aa, Entamoeba invadens
DQNVP

SEQ ID NO: 2846730 - protein, 8 aa, Entamoeba invadens
DQNVTKEQ

SEQ ID NO: 2846731 - protein, 6 aa, Entamoeba invadens
DQPCNG

SEQ ID NO: 2846732 - protein, 16 aa, Entamoeba invadens
DQPDEQEDLGDEYQDQ

SEQ ID NO: 2846733 - protein, 5 aa, Entamoeba invadens
DQPIG

SEQ ID NO: 2846734 - protein, 12 aa, Entamoeba invadens
DQPIKEQKPIEN

SEQ ID NO: 2846735 - protein, 8 aa, Entamoeba invadens
DQPKQLVE

SEQ ID NO: 2846736 - protein, 13 aa, Entamoeba invadens
DQPKRADRCYTTN

SEQ ID NO: 2846737 - protein, 5 aa, Entamoeba invadens
DQPLS

SEQ ID NO: 2846738 - protein, 12 aa, Entamoeba invadens
DQPLSQDKTAQM

SEQ ID NO: 2846739 - protein, 6 aa, Entamoeba invadens
DQPNYA

SEQ ID NO: 2846740 - protein, 6 aa, Entamoeba invadens
DQPPEV

SEQ ID NO: 2846741 - protein, 7 aa, Entamoeba invadens
DQPQNGL

SEQ ID NO: 2846742 - protein, 13 aa, Entamoeba invadens
DQPQQQQQQPQGM

SEQ ID NO: 2846743 - protein, 13 aa, Entamoeba invadens
DQPSVRDTTDGKM

SEQ ID NO: 2846744 - protein, 10 aa, Entamoeba invadens
DQPTEEKGWE

SEQ ID NO: 2846745 - protein, 7 aa, Entamoeba invadens
DQPTFEQ

SEQ ID NO: 2846746 - protein, 6 aa, Entamoeba invadens
DQPTKH

SEQ ID NO: 2846747 - protein, 11 aa, Entamoeba invadens
DQPTQQQKSND

SEQ ID NO: 2846748 - protein, 5 aa, Entamoeba invadens
DQPTT

SEQ ID NO: 2846749 - protein, 6 aa, Entamoeba invadens
DQPVKS

SEQ ID NO: 2846750 - protein, 10 aa, Entamoeba invadens
DQPYSNTPKY

SEQ ID NO: 2846751 - protein, 5 aa, Entamoeba invadens
DQQGI

SEQ ID NO: 2846752 - protein, 8 aa, Entamoeba invadens
DQQGTAPV

SEQ ID NO: 2846753 - protein, 22 aa, Entamoeba invadens
DQQKREKKEIPNKKQNNNKNEN

SEQ ID NO: 2846754 - protein, 10 aa, Entamoeba invadens
DQQKTRRQFN

SEQ ID NO: 2846755 - protein, 5 aa, Entamoeba invadens
DQQKV

SEQ ID NO: 2846756 - protein, 6 aa, Entamoeba invadens
DQQNFN

SEQ ID NO: 2846757 - protein, 5 aa, Entamoeba invadens
DQQNR

SEQ ID NO: 2846758 - protein, 7 aa, Entamoeba invadens
DQQNSRN

SEQ ID NO: 2846759 - protein, 5 aa, Entamoeba invadens
DQQPT

SEQ ID NO: 2846760 - protein, 9 aa, Entamoeba invadens
DQQPTFEQQ

SEQ ID NO: 2846761 - protein, 8 aa, Entamoeba invadens
DQQQPQQH

SEQ ID NO: 2846762 - protein, 10 aa, Entamoeba invadens
DQQRHYTESV

SEQ ID NO: 2846763 - protein, 5 aa, Entamoeba invadens
DQQSS

SEQ ID NO: 2846764 - protein, 5 aa, Entamoeba invadens
DQQTL

SEQ ID NO: 2846765 - protein, 8 aa, Entamoeba invadens
DQQVKSNF

SEQ ID NO: 2846766 - protein, 4 aa, Entamoeba invadens
DQRE

SEQ ID NO: 2846767 - protein, 12 aa, Entamoeba invadens
DQRKESRDEATK

SEQ ID NO: 2846768 - protein, 15 aa, Entamoeba invadens
DQRKISLPGDLLYCD

SEQ ID NO: 2846769 - protein, 10 aa, Entamoeba invadens
DQRRKEMENT

SEQ ID NO: 2846770 - protein, 6 aa, Entamoeba invadens
DQRRPQ

SEQ ID NO: 2846771 - protein, 20 aa, Entamoeba invadens
DQRSKHAQESRQKREEKALQ

SEQ ID NO: 2846772 - protein, 7 aa, Entamoeba invadens
DQRTIDR

SEQ ID NO: 2846773 - protein, 6 aa, Entamoeba invadens
DQRTPG

SEQ ID NO: 2846774 - protein, 16 aa, Entamoeba invadens
DQRTYLSPDQLQNNDI

SEQ ID NO: 2846775 - protein, 5 aa, Entamoeba invadens
DQRYA

SEQ ID NO: 2846776 - protein, 6 aa, Entamoeba invadens
DQSADL

SEQ ID NO: 2846777 - protein, 5 aa, Entamoeba invadens
DQSDN

SEQ ID NO: 2846778 - protein, 8 aa, Entamoeba invadens
DQSDSPNI

SEQ ID NO: 2846779 - protein, 4 aa, Entamoeba invadens
DQSE

SEQ ID NO: 2846780 - protein, 7 aa, Entamoeba invadens
DQSEEVY

SEQ ID NO: 2846781 - protein, 6 aa, Entamoeba invadens
DQSEKK

SEQ ID NO: 2846782 - protein, 8 aa, Entamoeba invadens
DQSEKSNE

SEQ ID NO: 2846783 - protein, 17 aa, Entamoeba invadens
DQSFEDKCTKNGKRDKE

SEQ ID NO: 2846784 - protein, 10 aa, Entamoeba invadens
DQSGRTLSEE

SEQ ID NO: 2846785 - protein, 5 aa, Entamoeba invadens
DQSKN

SEQ ID NO: 2846786 - protein, 8 aa, Entamoeba invadens
DQSKRPKF

SEQ ID NO: 2846787 - protein, 29 aa, Entamoeba invadens
DQSLLDKTQKEEAIPIDKGKIKKNPSMEK

SEQ ID NO: 2846788 - protein, 7 aa, Entamoeba invadens
DQSNATF

SEQ ID NO: 2846789 - protein, 8 aa, Entamoeba invadens
DQSNTDLN

SEQ ID NO: 2846790 - protein, 9 aa, Entamoeba invadens
DQSNTYEDE

SEQ ID NO: 2846791 - protein, 8 aa, Entamoeba invadens
DQSQPKIA

SEQ ID NO: 2846792 - protein, 9 aa, Entamoeba invadens
DQSRAYEEC

SEQ ID NO: 2846793 - protein, 7 aa, Entamoeba invadens
DQSRPET

SEQ ID NO: 2846794 - protein, 4 aa, Entamoeba invadens
DQSS

SEQ ID NO: 2846795 - protein, 7 aa, Entamoeba invadens
DQSTLNP

SEQ ID NO: 2846796 - protein, 12 aa, Entamoeba invadens
DQSTPFSGNIDM

SEQ ID NO: 2846797 - protein, 25 aa, Entamoeba invadens
DQSTQEQIESDKPEKTEKKNEDNEV

SEQ ID NO: 2846798 - protein, 22 aa, Entamoeba invadens
DQSTTNLSTPTEKQNEVTTQSS

SEQ ID NO: 2846799 - protein, 11 aa, Entamoeba invadens
DQSYTANKVDG

SEQ ID NO: 2846800 - protein, 7 aa, Entamoeba invadens
DQTEEEF

SEQ ID NO: 2846801 - protein, 8 aa, Entamoeba invadens
DQTFDDIE

SEQ ID NO: 2846802 - protein, 7 aa, Entamoeba invadens
DQTGDTN

SEQ ID NO: 2846803 - protein, 11 aa, Entamoeba invadens
DQTGNTDNFDD

SEQ ID NO: 2846804 - protein, 4 aa, Entamoeba invadens
DQTK

SEQ ID NO: 2846805 - protein, 4 aa, Entamoeba invadens
DQTN

SEQ ID NO: 2846806 - protein, 8 aa, Entamoeba invadens
DQTNQSKT

SEQ ID NO: 2846807 - protein, 10 aa, Entamoeba invadens
DQTPKNPWKT

SEQ ID NO: 2846808 - protein, 8 aa, Entamoeba invadens
DQTPTQLR

SEQ ID NO: 2846809 - protein, 4 aa, Entamoeba invadens
DQTQ

SEQ ID NO: 2846810 - protein, 30 aa, Entamoeba invadens
DQTQEYNTEQQNVELKQTRAGIGAATNVHH

SEQ ID NO: 2846811 - protein, 18 aa, Entamoeba invadens
DQTQIANQATPQLGQSTL

SEQ ID NO: 2846812 - protein, 8 aa, Entamoeba invadens
DQTQTIGT

SEQ ID NO: 2846813 - protein, 9 aa, Entamoeba invadens
DQTTEDDIQ

SEQ ID NO: 2846814 - protein, 5 aa, Entamoeba invadens
DQTTQ

SEQ ID NO: 2846815 - protein, 15 aa, Entamoeba invadens
DQTTTVKQTTEITTL

SEQ ID NO: 2846816 - protein, 9 aa, Entamoeba invadens
DQVDEVPQA

SEQ ID NO: 2846817 - protein, 4 aa, Entamoeba invadens
DQVI

SEQ ID NO: 2846818 - protein, 4 aa, Entamoeba invadens
DQVP

SEQ ID NO: 2846819 - protein, 6 aa, Entamoeba invadens
DQVPQH

SEQ ID NO: 2846820 - protein, 5 aa, Entamoeba invadens
DQVPY

SEQ ID NO: 2846821 - protein, 15 aa, Entamoeba invadens
DQVRKAGEDLNNKQF

SEQ ID NO: 2846822 - protein, 16 aa, Entamoeba invadens
DQVRKANEDLNNKQLE

SEQ ID NO: 2846823 - protein, 8 aa, Entamoeba invadens
DQVSGGDI

SEQ ID NO: 2846824 - protein, 5 aa, Entamoeba invadens
DQVTE

SEQ ID NO: 2846825 - protein, 10 aa, Entamoeba invadens
DQVVPKSVDE

SEQ ID NO: 2846826 - protein, 9 aa, Entamoeba invadens
DQWSTKDTK

SEQ ID NO: 2846827 - protein, 17 aa, Entamoeba invadens
DQYEKISQANKAFSEGE

SEQ ID NO: 2846828 - protein, 5 aa, Entamoeba invadens
DQYES

SEQ ID NO: 2846829 - protein, 6 aa, Entamoeba invadens
DQYKAE

SEQ ID NO: 2846830 - protein, 5 aa, Entamoeba invadens
DQYKK

SEQ ID NO: 2846831 - protein, 10 aa, Entamoeba invadens
DQYKNNSSLN

SEQ ID NO: 2846832 - protein, 7 aa, Entamoeba invadens
DQYNNQG

SEQ ID NO: 2846833 - protein, 9 aa, Entamoeba invadens
DQYSQSSKK

SEQ ID NO: 2846834 - protein, 5 aa, Entamoeba invadens
DQYSS

SEQ ID NO: 2846835 - protein, 8 aa, Entamoeba invadens
DQYTQTIK

SEQ ID NO: 2846836 - protein, 18 aa, Entamoeba invadens
DRAGVGKQVREITESAMR

SEQ ID NO: 2846837 - protein, 15 aa, Entamoeba invadens
DRAIQDDISDQDTVS

SEQ ID NO: 2846838 - protein, 7 aa, Entamoeba invadens
DRAKTEV

SEQ ID NO: 2846839 - protein, 12 aa, Entamoeba invadens
DRAQEERRRRRE

SEQ ID NO: 2846840 - protein, 22 aa, Entamoeba invadens
DRAQLSETKSAFTVPQSTPVYS

SEQ ID NO: 2846841 - protein, 13 aa, Entamoeba invadens
DRAYETTKTLPSF

SEQ ID NO: 2846842 - protein, 9 aa, Entamoeba invadens
DRCDPNGEY

SEQ ID NO: 2846843 - protein, 4 aa, Entamoeba invadens
DRCT

SEQ ID NO: 2846844 - protein, 7 aa, Entamoeba invadens
DRDDSTA

SEQ ID NO: 2846845 - protein, 12 aa, Entamoeba invadens
DRDEEKELKEQL

SEQ ID NO: 2846846 - protein, 9 aa, Entamoeba invadens
DRDEETKNK

SEQ ID NO: 2846847 - protein, 6 aa, Entamoeba invadens
DRDEKV

SEQ ID NO: 2846848 - protein, 5 aa, Entamoeba invadens
DRDEM

SEQ ID NO: 2846849 - protein, 6 aa, Entamoeba invadens
DRDEMQ

SEQ ID NO: 2846850 - protein, 8 aa, Entamoeba invadens
DRDETSEM

SEQ ID NO: 2846851 - protein, 5 aa, Entamoeba invadens
DRDFG

SEQ ID NO: 2846852 - protein, 11 aa, Entamoeba invadens
DRDGDKPSPED

SEQ ID NO: 2846853 - protein, 8 aa, Entamoeba invadens
DRDGYLNE

SEQ ID NO: 2846854 - protein, 4 aa, Entamoeba invadens
DRDH

SEQ ID NO: 2846855 - protein, 7 aa, Entamoeba invadens
DRDPRLE

SEQ ID NO: 2846856 - protein, 7 aa, Entamoeba invadens
DRDSFND

SEQ ID NO: 2846857 - protein, 10 aa, Entamoeba invadens
DRDSKSNAPT

SEQ ID NO: 2846858 - protein, 5 aa, Entamoeba invadens
DRDSP

SEQ ID NO: 2846859 - protein, 5 aa, Entamoeba invadens
DRDSR

SEQ ID NO: 2846860 - protein, 5 aa, Entamoeba invadens
DRDVP

SEQ ID NO: 2846861 - protein, 15 aa, Entamoeba invadens
DRDVSEKEGKEKAAE

SEQ ID NO: 2846862 - protein, 16 aa, Entamoeba invadens
DRDVTEKEGKEKATEL

SEQ ID NO: 2846863 - protein, 5 aa, Entamoeba invadens
DREDL

SEQ ID NO: 2846864 - protein, 12 aa, Entamoeba invadens
DREEAQKEIEKS

SEQ ID NO: 2846865 - protein, 9 aa, Entamoeba invadens
DREKEDDQV

SEQ ID NO: 2846866 - protein, 5 aa, Entamoeba invadens
DRERL

SEQ ID NO: 2846867 - protein, 7 aa, Entamoeba invadens
DRESDYK

SEQ ID NO: 2846868 - protein, 5 aa, Entamoeba invadens
DRESF

SEQ ID NO: 2846869 - protein, 10 aa, Entamoeba invadens
DREVERTSQR

SEQ ID NO: 2846870 - protein, 4 aa, Entamoeba invadens
DREY

SEQ ID NO: 2846871 - protein, 8 aa, Entamoeba invadens
DREYEEAL

SEQ ID NO: 2846872 - protein, 22 aa, Entamoeba invadens
DRFDDRNERNERSEKRDENSFR

SEQ ID NO: 2846873 - protein, 27 aa, Entamoeba invadens
DRFGNQPQQGQPNPRVEKVERKDEKKE

SEQ ID NO: 2846874 - protein, 6 aa, Entamoeba invadens
DRFGRD

SEQ ID NO: 2846875 - protein, 6 aa, Entamoeba invadens
DRFKQT

SEQ ID NO: 2846876 - protein, 5 aa, Entamoeba invadens
DRFSE

SEQ ID NO: 2846877 - protein, 4 aa, Entamoeba invadens
DRGD

SEQ ID NO: 2846878 - protein, 6 aa, Entamoeba invadens
DRGDMS

SEQ ID NO: 2846879 - protein, 7 aa, Entamoeba invadens
DRGDYST

SEQ ID NO: 2846880 - protein, 8 aa, Entamoeba invadens
DRGERTKD

SEQ ID NO: 2846881 - protein, 7 aa, Entamoeba invadens
DRGESLD

SEQ ID NO: 2846882 - protein, 6 aa, Entamoeba invadens
DRGESS

SEQ ID NO: 2846883 - protein, 7 aa, Entamoeba invadens
DRGKSGV

SEQ ID NO: 2846884 - protein, 9 aa, Entamoeba invadens
DRGKYSTET

SEQ ID NO: 2846885 - protein, 6 aa, Entamoeba invadens
DRGNDG

SEQ ID NO: 2846886 - protein, 7 aa, Entamoeba invadens
DRGNLTD

SEQ ID NO: 2846887 - protein, 6 aa, Entamoeba invadens
DRGNNS

SEQ ID NO: 2846888 - protein, 4 aa, Entamoeba invadens
DRGQ

SEQ ID NO: 2846889 - protein, 12 aa, Entamoeba invadens
DRGQDLKNPKLF

SEQ ID NO: 2846890 - protein, 4 aa, Entamoeba invadens
DRGS

SEQ ID NO: 2846891 - protein, 5 aa, Entamoeba invadens
DRGSM

SEQ ID NO: 2846892 - protein, 6 aa, Entamoeba invadens
DRGSQA

SEQ ID NO: 2846893 - protein, 6 aa, Entamoeba invadens
DRGSRG

SEQ ID NO: 2846894 - protein, 10 aa, Entamoeba invadens
DRGTKTSKYF

SEQ ID NO: 2846895 - protein, 5 aa, Entamoeba invadens
DRGTM

SEQ ID NO: 2846896 - protein, 10 aa, Entamoeba invadens
DRHDKTKRNY

SEQ ID NO: 2846897 - protein, 7 aa, Entamoeba invadens
DRHEECN

SEQ ID NO: 2846898 - protein, 6 aa, Entamoeba invadens
DRHEKR

SEQ ID NO: 2846899 - protein, 8 aa, Entamoeba invadens
DRHGKQTE

SEQ ID NO: 2846900 - protein, 4 aa, Entamoeba invadens
DRHN

SEQ ID NO: 2846901 - protein, 5 aa, Entamoeba invadens
DRHND

SEQ ID NO: 2846902 - protein, 5 aa, Entamoeba invadens
DRHNG

SEQ ID NO: 2846903 - protein, 4 aa, Entamoeba invadens
DRHP

SEQ ID NO: 2846904 - protein, 5 aa, Entamoeba invadens
DRHPQ

SEQ ID NO: 2846905 - protein, 4 aa, Entamoeba invadens
DRHT

SEQ ID NO: 2846906 - protein, 13 aa, Entamoeba invadens
DRIDQQNLSEKEN

SEQ ID NO: 2846907 - protein, 8 aa, Entamoeba invadens
DRIKYGNT

SEQ ID NO: 2846908 - protein, 6 aa, Entamoeba invadens
DRIPAP

SEQ ID NO: 2846909 - protein, 5 aa, Entamoeba invadens
DRIPP

SEQ ID NO: 2846910 - protein, 8 aa, Entamoeba invadens
DRIQNNNI

SEQ ID NO: 2846911 - protein, 4 aa, Entamoeba invadens
DRIT

SEQ ID NO: 2846912 - protein, 5 aa, Entamoeba invadens
DRITF

SEQ ID NO: 2846913 - protein, 20 aa, Entamoeba invadens
DRITTPPKKIQPTANSANAP

SEQ ID NO: 2846914 - protein, 8 aa, Entamoeba invadens
DRKAAEGL

SEQ ID NO: 2846915 - protein, 6 aa, Entamoeba invadens
DRKDLT

SEQ ID NO: 2846916 - protein, 13 aa, Entamoeba invadens
DRKDQEKVKKELA

SEQ ID NO: 2846917 - protein, 5 aa, Entamoeba invadens
DRKEV

SEQ ID NO: 2846918 - protein, 6 aa, Entamoeba invadens
DRKHSL

SEQ ID NO: 2846919 - protein, 10 aa, Entamoeba invadens
DRKHTAPPTQ

SEQ ID NO: 2846920 - protein, 13 aa, Entamoeba invadens
DRKKALDKAEEKY

SEQ ID NO: 2846921 - protein, 40 aa, Entamoeba invadens
DRKKDEKSRQTAENCDTQTEMKVEKKQEKKATTGLAMEQK

SEQ ID NO: 2846922 - protein, 6 aa, Entamoeba invadens
DRKKME

SEQ ID NO: 2846923 - protein, 8 aa, Entamoeba invadens
DRKKYGDF

SEQ ID NO: 2846924 - protein, 5 aa, Entamoeba invadens
DRKLN

SEQ ID NO: 2846925 - protein, 14 aa, Entamoeba invadens
DRKNDIDDKTIKRR

SEQ ID NO: 2846926 - protein, 5 aa, Entamoeba invadens
DRKSF

SEQ ID NO: 2846927 - protein, 18 aa, Entamoeba invadens
DRKSGACTSCEAGNKRVD

SEQ ID NO: 2846928 - protein, 9 aa, Entamoeba invadens
DRKSNGFTI

SEQ ID NO: 2846929 - protein, 17 aa, Entamoeba invadens
DRKSNPARRETPTEAAE

SEQ ID NO: 2846930 - protein, 6 aa, Entamoeba invadens
DRKTFE

SEQ ID NO: 2846931 - protein, 7 aa, Entamoeba invadens
DRKTQEV

SEQ ID NO: 2846932 - protein, 16 aa, Entamoeba invadens
DRKTYGDTIPPISTSL

SEQ ID NO: 2846933 - protein, 4 aa, Entamoeba invadens
DRKV

SEQ ID NO: 2846934 - protein, 4 aa, Entamoeba invadens
DRLE

SEQ ID NO: 2846935 - protein, 4 aa, Entamoeba invadens
DRLG

SEQ ID NO: 2846936 - protein, 7 aa, Entamoeba invadens
DRLGRGV

SEQ ID NO: 2846937 - protein, 31 aa, Entamoeba invadens
DRLKPTERSPPTRSSSLKRALKETSPSTSME

SEQ ID NO: 2846938 - protein, 12 aa, Entamoeba invadens
DRLKTQKSRRFS

SEQ ID NO: 2846939 - protein, 43 aa, Entamoeba invadens
DRMEGEEVDKENGDHEEEYDEDDEKDLSDSELARRDEEEMMQQ

SEQ ID NO: 2846940 - protein, 13 aa, Entamoeba invadens
DRMTSESKSFENI

SEQ ID NO: 2846941 - protein, 7 aa, Entamoeba invadens
DRNDDDI

SEQ ID NO: 2846942 - protein, 8 aa, Entamoeba invadens
DRNDEVKR

SEQ ID NO: 2846943 - protein, 23 aa, Entamoeba invadens
DRNEDEDQSVEEEQQDTDEEEDE

SEQ ID NO: 2846944 - protein, 5 aa, Entamoeba invadens
DRNER

SEQ ID NO: 2846945 - protein, 5 aa, Entamoeba invadens
DRNGK

SEQ ID NO: 2846946 - protein, 5 aa, Entamoeba invadens
DRNGY

SEQ ID NO: 2846947 - protein, 9 aa, Entamoeba invadens
DRNGYGSAI

SEQ ID NO: 2846948 - protein, 11 aa, Entamoeba invadens
DRNIDKANYGE

SEQ ID NO: 2846949 - protein, 10 aa, Entamoeba invadens
DRNKEAQDML

SEQ ID NO: 2846950 - protein, 6 aa, Entamoeba invadens
DRNKGF

SEQ ID NO: 2846951 - protein, 22 aa, Entamoeba invadens
DRNKGKTESTETTAKNCLDQQN

SEQ ID NO: 2846952 - protein, 9 aa, Entamoeba invadens
DRNNGIENE

SEQ ID NO: 2846953 - protein, 7 aa, Entamoeba invadens
DRNNKFG

SEQ ID NO: 2846954 - protein, 10 aa, Entamoeba invadens
DRNNKRKEGD

SEQ ID NO: 2846955 - protein, 18 aa, Entamoeba invadens
DRNNSLTKITKTEKGDEE

SEQ ID NO: 2846956 - protein, 10 aa, Entamoeba invadens
DRNPEKRPDI

SEQ ID NO: 2846957 - protein, 5 aa, Entamoeba invadens
DRNSF

SEQ ID NO: 2846958 - protein, 66 aa, Entamoeba invadens
DRNSKSENTQRKPPKATSKSFKTSSPSQTDNSSKSKTKTNLSSSEDSSETEDTLTETSNKNDNEPF

SEQ ID NO: 2846959 - protein, 18 aa, Entamoeba invadens
DRNSNTTINISTPKRSDV

SEQ ID NO: 2846960 - protein, 8 aa, Entamoeba invadens
DRNSTPTV

SEQ ID NO: 2846961 - protein, 4 aa, Entamoeba invadens
DRNV

SEQ ID NO: 2846962 - protein, 6 aa, Entamoeba invadens
DRPEEG

SEQ ID NO: 2846963 - protein, 16 aa, Entamoeba invadens
DRPEEGEQNEEHNGHQ

SEQ ID NO: 2846964 - protein, 13 aa, Entamoeba invadens
DRPETSPHDSRIQ

SEQ ID NO: 2846965 - protein, 17 aa, Entamoeba invadens
DRPIDRDPREYPPRRDD

SEQ ID NO: 2846966 - protein, 13 aa, Entamoeba invadens
DRPIQKKDTSNWS

SEQ ID NO: 2846967 - protein, 9 aa, Entamoeba invadens
DRPKFQRRS

SEQ ID NO: 2846968 - protein, 13 aa, Entamoeba invadens
DRPLGSSPNTKAK

SEQ ID NO: 2846969 - protein, 15 aa, Entamoeba invadens
DRPSKSTSSGSPITP

SEQ ID NO: 2846970 - protein, 17 aa, Entamoeba invadens
DRPVTSPLTFDSDDTKQ

SEQ ID NO: 2846971 - protein, 9 aa, Entamoeba invadens
DRPYPPYDP

SEQ ID NO: 2846972 - protein, 15 aa, Entamoeba invadens
DRPYPPYDPTDLNEQ

SEQ ID NO: 2846973 - protein, 4 aa, Entamoeba invadens
DRQD

SEQ ID NO: 2846974 - protein, 9 aa, Entamoeba invadens
DRQDFDDSN

SEQ ID NO: 2846975 - protein, 9 aa, Entamoeba invadens
DRQFDSSDA

SEQ ID NO: 2846976 - protein, 6 aa, Entamoeba invadens
DRQLEE

SEQ ID NO: 2846977 - protein, 5 aa, Entamoeba invadens
DRQLN

SEQ ID NO: 2846978 - protein, 5 aa, Entamoeba invadens
DRQMN

SEQ ID NO: 2846979 - protein, 4 aa, Entamoeba invadens
DRQN

SEQ ID NO: 2846980 - protein, 19 aa, Entamoeba invadens
DRQPPKLSTTIKGTSPTIS

SEQ ID NO: 2846981 - protein, 7 aa, Entamoeba invadens
DRQRIDT

SEQ ID NO: 2846982 - protein, 6 aa, Entamoeba invadens
DRQSFN

SEQ ID NO: 2846983 - protein, 8 aa, Entamoeba invadens
DRQSYSEG

SEQ ID NO: 2846984 - protein, 6 aa, Entamoeba invadens
DRQTFE

SEQ ID NO: 2846985 - protein, 8 aa, Entamoeba invadens
DRQYESHP

SEQ ID NO: 2846986 - protein, 23 aa, Entamoeba invadens
DRQYKDADQKIIEQQKRDRISNA

SEQ ID NO: 2846987 - protein, 9 aa, Entamoeba invadens
DRRAKRNAF

SEQ ID NO: 2846988 - protein, 4 aa, Entamoeba invadens
DRRD

SEQ ID NO: 2846989 - protein, 10 aa, Entamoeba invadens
DRRDFEDSNK

SEQ ID NO: 2846990 - protein, 8 aa, Entamoeba invadens
DRRDQSGN

SEQ ID NO: 2846991 - protein, 16 aa, Entamoeba invadens
DRRDRIAEEEKRHREL

SEQ ID NO: 2846992 - protein, 9 aa, Entamoeba invadens
DRRKYGNKI

SEQ ID NO: 2846993 - protein, 5 aa, Entamoeba invadens
DRRPQ

SEQ ID NO: 2846994 - protein, 5 aa, Entamoeba invadens
DRRSK

SEQ ID NO: 2846995 - protein, 15 aa, Entamoeba invadens
DRRSQRAIDSDRQRD

SEQ ID NO: 2846996 - protein, 7 aa, Entamoeba invadens
DRRYKNR

SEQ ID NO: 2846997 - protein, 6 aa, Entamoeba invadens
DRSAQD

SEQ ID NO: 2846998 - protein, 6 aa, Entamoeba invadens
DRSAYR

SEQ ID NO: 2846999 - protein, 10 aa, Entamoeba invadens
DRSDDTVKRY

SEQ ID NO: 2847000 - protein, 4 aa, Entamoeba invadens
DRSE

SEQ ID NO: 2847001 - protein, 10 aa, Entamoeba invadens
DRSEQKLDKL

SEQ ID NO: 2847002 - protein, 10 aa, Entamoeba invadens
DRSGECKANI

SEQ ID NO: 2847003 - protein, 6 aa, Entamoeba invadens
DRSGIP

SEQ ID NO: 2847004 - protein, 10 aa, Entamoeba invadens
DRSKYGDVPS

SEQ ID NO: 2847005 - protein, 39 aa, Entamoeba invadens
DRSNPSSRSNSSLGNESPMSVGANESDSEKKEIKQKKRF

SEQ ID NO: 2847006 - protein, 5 aa, Entamoeba invadens
DRSPF

SEQ ID NO: 2847007 - protein, 5 aa, Entamoeba invadens
DRSQF

SEQ ID NO: 2847008 - protein, 9 aa, Entamoeba invadens
DRSRVEAQS

SEQ ID NO: 2847009 - protein, 4 aa, Entamoeba invadens
DRSS

SEQ ID NO: 2847010 - protein, 4 aa, Entamoeba invadens
DRST

SEQ ID NO: 2847011 - protein, 8 aa, Entamoeba invadens
DRSVNKEH

SEQ ID NO: 2847012 - protein, 4 aa, Entamoeba invadens
DRSY

SEQ ID NO: 2847013 - protein, 6 aa, Entamoeba invadens
DRSYKV

SEQ ID NO: 2847014 - protein, 11 aa, Entamoeba invadens
DRSYNEVTEGF

SEQ ID NO: 2847015 - protein, 14 aa, Entamoeba invadens
DRTAKDKKKIANLE

SEQ ID NO: 2847016 - protein, 14 aa, Entamoeba invadens
DRTDPNDTHKKRLM

SEQ ID NO: 2847017 - protein, 8 aa, Entamoeba invadens
DRTENDPP

SEQ ID NO: 2847018 - protein, 5 aa, Entamoeba invadens
DRTKT

SEQ ID NO: 2847019 - protein, 5 aa, Entamoeba invadens
DRTLP

SEQ ID NO: 2847020 - protein, 15 aa, Entamoeba invadens
DRTPKQTTDMREDEI

SEQ ID NO: 2847021 - protein, 10 aa, Entamoeba invadens
DRTPLQQQQV

SEQ ID NO: 2847022 - protein, 7 aa, Entamoeba invadens
DRTQSRQ

SEQ ID NO: 2847023 - protein, 5 aa, Entamoeba invadens
DRTRE

SEQ ID NO: 2847024 - protein, 8 aa, Entamoeba invadens
DRTSFGNS

SEQ ID NO: 2847025 - protein, 8 aa, Entamoeba invadens
DRTSRATE

SEQ ID NO: 2847026 - protein, 8 aa, Entamoeba invadens
DRTSRKTR

SEQ ID NO: 2847027 - protein, 7 aa, Entamoeba invadens
DRTTLTS

SEQ ID NO: 2847028 - protein, 10 aa, Entamoeba invadens
DRTTSPGKIN

SEQ ID NO: 2847029 - protein, 6 aa, Entamoeba invadens
DRVKVT

SEQ ID NO: 2847030 - protein, 6 aa, Entamoeba invadens
DRVPDN

SEQ ID NO: 2847031 - protein, 8 aa, Entamoeba invadens
DRVPSTDQ

SEQ ID NO: 2847032 - protein, 7 aa, Entamoeba invadens
DRVPVGG

SEQ ID NO: 2847033 - protein, 4 aa, Entamoeba invadens
DRVS

SEQ ID NO: 2847034 - protein, 12 aa, Entamoeba invadens
DRYERTTPGSSF

SEQ ID NO: 2847035 - protein, 12 aa, Entamoeba invadens
DRYGQTTRCETS

SEQ ID NO: 2847036 - protein, 4 aa, Entamoeba invadens
DRYH

SEQ ID NO: 2847037 - protein, 16 aa, Entamoeba invadens
DRYKDELENELKRTDN

SEQ ID NO: 2847038 - protein, 7 aa, Entamoeba invadens
DRYKDGD

SEQ ID NO: 2847039 - protein, 4 aa, Entamoeba invadens
DRYP

SEQ ID NO: 2847040 - protein, 16 aa, Entamoeba invadens
DRYTERRNQLSTEITE

SEQ ID NO: 2847041 - protein, 17 aa, Entamoeba invadens
DRYTPQLDKAPKLEPQI

SEQ ID NO: 2847042 - protein, 27 aa, Entamoeba invadens
DSAASLRKEASLKQASSMNEEGKTTFD

SEQ ID NO: 2847043 - protein, 8 aa, Entamoeba invadens
DSAEITNV

SEQ ID NO: 2847044 - protein, 11 aa, Entamoeba invadens
DSAEKGEEDKL

SEQ ID NO: 2847045 - protein, 4 aa, Entamoeba invadens
DSAF

SEQ ID NO: 2847046 - protein, 8 aa, Entamoeba invadens
DSAFSGTA

SEQ ID NO: 2847047 - protein, 6 aa, Entamoeba invadens
DSAFSN

SEQ ID NO: 2847048 - protein, 7 aa, Entamoeba invadens
DSAGLQE

SEQ ID NO: 2847049 - protein, 6 aa, Entamoeba invadens
DSAGNS

SEQ ID NO: 2847050 - protein, 13 aa, Entamoeba invadens
DSAIEKKEVRKQV

SEQ ID NO: 2847051 - protein, 5 aa, Entamoeba invadens
DSAKG

SEQ ID NO: 2847052 - protein, 10 aa, Entamoeba invadens
DSAKTQKDDC

SEQ ID NO: 2847053 - protein, 19 aa, Entamoeba invadens
DSANCPHKNDQNFSKQDRP

SEQ ID NO: 2847054 - protein, 8 aa, Entamoeba invadens
DSAPQSLS

SEQ ID NO: 2847055 - protein, 6 aa, Entamoeba invadens
DSAQRT

SEQ ID NO: 2847056 - protein, 8 aa, Entamoeba invadens
DSAQTAND

SEQ ID NO: 2847057 - protein, 12 aa, Entamoeba invadens
DSASDPPKTIPS

SEQ ID NO: 2847058 - protein, 5 aa, Entamoeba invadens
DSAVT

SEQ ID NO: 2847059 - protein, 8 aa, Entamoeba invadens
DSCKQQLR

SEQ ID NO: 2847060 - protein, 12 aa, Entamoeba invadens
DSCPADANNIPC

SEQ ID NO: 2847061 - protein, 7 aa, Entamoeba invadens
DSCTHTT

SEQ ID NO: 2847062 - protein, 9 aa, Entamoeba invadens
DSDADGSLL

SEQ ID NO: 2847063 - protein, 16 aa, Entamoeba invadens
DSDAFGATDSPNYKET

SEQ ID NO: 2847064 - protein, 7 aa, Entamoeba invadens
DSDATDF

SEQ ID NO: 2847065 - protein, 9 aa, Entamoeba invadens
DSDCSTSQK

SEQ ID NO: 2847066 - protein, 4 aa, Entamoeba invadens
DSDD

SEQ ID NO: 2847067 - protein, 9 aa, Entamoeba invadens
DSDDDYDSL

SEQ ID NO: 2847068 - protein, 19 aa, Entamoeba invadens
DSDDEMKKTPIGNLSGDEI

SEQ ID NO: 2847069 - protein, 14 aa, Entamoeba invadens
DSDDEVKEEKNEEE

SEQ ID NO: 2847070 - protein, 6 aa, Entamoeba invadens
DSDDGV

SEQ ID NO: 2847071 - protein, 12 aa, Entamoeba invadens
DSDDSSGSWETD

SEQ ID NO: 2847072 - protein, 12 aa, Entamoeba invadens
DSDEDGKMARDI

SEQ ID NO: 2847073 - protein, 17 aa, Entamoeba invadens
DSDEESEGSDQKQHTHK

SEQ ID NO: 2847074 - protein, 8 aa, Entamoeba invadens
DSDEKGYE

SEQ ID NO: 2847075 - protein, 7 aa, Entamoeba invadens
DSDEKRI

SEQ ID NO: 2847076 - protein, 6 aa, Entamoeba invadens
DSDEMP

SEQ ID NO: 2847077 - protein, 8 aa, Entamoeba invadens
DSDENGAL

SEQ ID NO: 2847078 - protein, 9 aa, Entamoeba invadens
DSDENGKMD

SEQ ID NO: 2847079 - protein, 6 aa, Entamoeba invadens
DSDERQ

SEQ ID NO: 2847080 - protein, 17 aa, Entamoeba invadens
DSDFAEADDKPTNSVSA

SEQ ID NO: 2847081 - protein, 19 aa, Entamoeba invadens
DSDFEYSTQSYTGYEPTSM

SEQ ID NO: 2847082 - protein, 17 aa, Entamoeba invadens
DSDGKKRPDINQLTESV

SEQ ID NO: 2847083 - protein, 10 aa, Entamoeba invadens
DSDGNGRLDS

SEQ ID NO: 2847084 - protein, 9 aa, Entamoeba invadens
DSDHSDSIG

SEQ ID NO: 2847085 - protein, 13 aa, Entamoeba invadens
DSDKGGSLDNKEM

SEQ ID NO: 2847086 - protein, 11 aa, Entamoeba invadens
DSDKKEEKKHH

SEQ ID NO: 2847087 - protein, 5 aa, Entamoeba invadens
DSDKL

SEQ ID NO: 2847088 - protein, 5 aa, Entamoeba invadens
DSDLE

SEQ ID NO: 2847089 - protein, 7 aa, Entamoeba invadens
DSDLSYD

SEQ ID NO: 2847090 - protein, 5 aa, Entamoeba invadens
DSDLT

SEQ ID NO: 2847091 - protein, 6 aa, Entamoeba invadens
DSDNPI

SEQ ID NO: 2847092 - protein, 9 aa, Entamoeba invadens
DSDNSGYIE

SEQ ID NO: 2847093 - protein, 6 aa, Entamoeba invadens
DSDRHN

SEQ ID NO: 2847094 - protein, 6 aa, Entamoeba invadens
DSDSFA

SEQ ID NO: 2847095 - protein, 14 aa, Entamoeba invadens
DSDSSDSYDDSNSD

SEQ ID NO: 2847096 - protein, 11 aa, Entamoeba invadens
DSDSTDDCEDV

SEQ ID NO: 2847097 - protein, 7 aa, Entamoeba invadens
DSDSTDF

SEQ ID NO: 2847098 - protein, 8 aa, Entamoeba invadens
DSDSTPSE

SEQ ID NO: 2847099 - protein, 8 aa, Entamoeba invadens
DSDSTYAA

SEQ ID NO: 2847100 - protein, 14 aa, Entamoeba invadens
DSDTASGAARGSGI

SEQ ID NO: 2847101 - protein, 9 aa, Entamoeba invadens
DSDTDGLSN

SEQ ID NO: 2847102 - protein, 7 aa, Entamoeba invadens
DSDVGKS

SEQ ID NO: 2847103 - protein, 11 aa, Entamoeba invadens
DSDWYDNESGC

SEQ ID NO: 2847104 - protein, 12 aa, Entamoeba invadens
DSDWYDNESGCS

SEQ ID NO: 2847105 - protein, 4 aa, Entamoeba invadens
DSEA

SEQ ID NO: 2847106 - protein, 8 aa, Entamoeba invadens
DSEADEQT

SEQ ID NO: 2847107 - protein, 16 aa, Entamoeba invadens
DSEARKTHSSKKQIGQ

SEQ ID NO: 2847108 - protein, 7 aa, Entamoeba invadens
DSECCSC

SEQ ID NO: 2847109 - protein, 9 aa, Entamoeba invadens
DSEDDQKIM

SEQ ID NO: 2847110 - protein, 9 aa, Entamoeba invadens
DSEDEWDKT

SEQ ID NO: 2847111 - protein, 6 aa, Entamoeba invadens
DSEDLP

SEQ ID NO: 2847112 - protein, 33 aa, Entamoeba invadens
DSEEESNGTSLRNTKSNGVRYAPRRSRSQSPLH

SEQ ID NO: 2847113 - protein, 9 aa, Entamoeba invadens
DSEESHKEN

SEQ ID NO: 2847114 - protein, 7 aa, Entamoeba invadens
DSEGDRH

SEQ ID NO: 2847115 - protein, 7 aa, Entamoeba invadens
DSEGKEV

SEQ ID NO: 2847116 - protein, 5 aa, Entamoeba invadens
DSEGY

SEQ ID NO: 2847117 - protein, 4 aa, Entamoeba invadens
DSEI

SEQ ID NO: 2847118 - protein, 7 aa, Entamoeba invadens
DSEIESI

SEQ ID NO: 2847119 - protein, 15 aa, Entamoeba invadens
DSEKDELEDKNRKLA

SEQ ID NO: 2847120 - protein, 12 aa, Entamoeba invadens
DSEKDMEKKGKV

SEQ ID NO: 2847121 - protein, 9 aa, Entamoeba invadens
DSEKETESY

SEQ ID NO: 2847122 - protein, 5 aa, Entamoeba invadens
DSEKI

SEQ ID NO: 2847123 - protein, 12 aa, Entamoeba invadens
DSEKNEKSRGKE

SEQ ID NO: 2847124 - protein, 8 aa, Entamoeba invadens
DSEKSGKL

SEQ ID NO: 2847125 - protein, 9 aa, Entamoeba invadens
DSELSDDRY

SEQ ID NO: 2847126 - protein, 10 aa, Entamoeba invadens
DSEMKRKAKE

SEQ ID NO: 2847127 - protein, 9 aa, Entamoeba invadens
DSEMPAGEI

SEQ ID NO: 2847128 - protein, 4 aa, Entamoeba invadens
DSEN

SEQ ID NO: 2847129 - protein, 17 aa, Entamoeba invadens
DSENCQNNDIILSNGIN

SEQ ID NO: 2847130 - protein, 8 aa, Entamoeba invadens
DSENDIPG

SEQ ID NO: 2847131 - protein, 6 aa, Entamoeba invadens
DSENDL

SEQ ID NO: 2847132 - protein, 5 aa, Entamoeba invadens
DSENS

SEQ ID NO: 2847133 - protein, 7 aa, Entamoeba invadens
DSENSNT

SEQ ID NO: 2847134 - protein, 9 aa, Entamoeba invadens
DSENTPKYK

SEQ ID NO: 2847135 - protein, 4 aa, Entamoeba invadens
DSEP

SEQ ID NO: 2847136 - protein, 6 aa, Entamoeba invadens
DSEQSA

SEQ ID NO: 2847137 - protein, 4 aa, Entamoeba invadens
DSER

SEQ ID NO: 2847138 - protein, 9 aa, Entamoeba invadens
DSERTDEAI

SEQ ID NO: 2847139 - protein, 6 aa, Entamoeba invadens
DSERVT

SEQ ID NO: 2847140 - protein, 6 aa, Entamoeba invadens
DSESEL

SEQ ID NO: 2847141 - protein, 14 aa, Entamoeba invadens
DSESFPINTEVHYI

SEQ ID NO: 2847142 - protein, 11 aa, Entamoeba invadens
DSESGNGFTED

SEQ ID NO: 2847143 - protein, 9 aa, Entamoeba invadens
DSESVDSAV

SEQ ID NO: 2847144 - protein, 7 aa, Entamoeba invadens
DSETPST

SEQ ID NO: 2847145 - protein, 6 aa, Entamoeba invadens
DSETTC

SEQ ID NO: 2847146 - protein, 7 aa, Entamoeba invadens
DSEVGKT

SEQ ID NO: 2847147 - protein, 10 aa, Entamoeba invadens
DSEVSQKEIT

SEQ ID NO: 2847148 - protein, 7 aa, Entamoeba invadens
DSEYREA

SEQ ID NO: 2847149 - protein, 23 aa, Entamoeba invadens
DSFDKGNKKKKFSHTWTEKEDEM

SEQ ID NO: 2847150 - protein, 8 aa, Entamoeba invadens
DSFEPDTK

SEQ ID NO: 2847151 - protein, 7 aa, Entamoeba invadens
DSFESGE

SEQ ID NO: 2847152 - protein, 8 aa, Entamoeba invadens
DSFESTED

SEQ ID NO: 2847153 - protein, 9 aa, Entamoeba invadens
DSFGENTLK

SEQ ID NO: 2847154 - protein, 8 aa, Entamoeba invadens
DSFGREQT

SEQ ID NO: 2847155 - protein, 6 aa, Entamoeba invadens
DSFHGD

SEQ ID NO: 2847156 - protein, 4 aa, Entamoeba invadens
DSFK

SEQ ID NO: 2847157 - protein, 21 aa, Entamoeba invadens
DSFKKSSKKGSGSPSNDLEKD

SEQ ID NO: 2847158 - protein, 8 aa, Entamoeba invadens
DSFKNGEY

SEQ ID NO: 2847159 - protein, 5 aa, Entamoeba invadens
DSFNA

SEQ ID NO: 2847160 - protein, 6 aa, Entamoeba invadens
DSFNEI

SEQ ID NO: 2847161 - protein, 8 aa, Entamoeba invadens
DSFNSTTF

SEQ ID NO: 2847162 - protein, 6 aa, Entamoeba invadens
DSFPNA

SEQ ID NO: 2847163 - protein, 7 aa, Entamoeba invadens
DSFQQRS

SEQ ID NO: 2847164 - protein, 6 aa, Entamoeba invadens
DSFQSG

SEQ ID NO: 2847165 - protein, 4 aa, Entamoeba invadens
DSFR

SEQ ID NO: 2847166 - protein, 5 aa, Entamoeba invadens
DSFSD

SEQ ID NO: 2847167 - protein, 11 aa, Entamoeba invadens
DSFSKSSETEQ

SEQ ID NO: 2847168 - protein, 6 aa, Entamoeba invadens
DSFSRE

SEQ ID NO: 2847169 - protein, 32 aa, Entamoeba invadens
DSFSTSKSLDSTSDSSFDSKKTDTDESKTCLS

SEQ ID NO: 2847170 - protein, 4 aa, Entamoeba invadens
DSFT

SEQ ID NO: 2847171 - protein, 5 aa, Entamoeba invadens
DSFTA

SEQ ID NO: 2847172 - protein, 13 aa, Entamoeba invadens
DSFTKETDNSTKK

SEQ ID NO: 2847173 - protein, 10 aa, Entamoeba invadens
DSGAGKSSLV

SEQ ID NO: 2847174 - protein, 8 aa, Entamoeba invadens
DSGCGKTS

SEQ ID NO: 2847175 - protein, 6 aa, Entamoeba invadens
DSGDGV

SEQ ID NO: 2847176 - protein, 12 aa, Entamoeba invadens
DSGDNGISPSQN

SEQ ID NO: 2847177 - protein, 4 aa, Entamoeba invadens
DSGE

SEQ ID NO: 2847178 - protein, 9 aa, Entamoeba invadens
DSGESECEY

SEQ ID NO: 2847179 - protein, 7 aa, Entamoeba invadens
DSGIGEE

SEQ ID NO: 2847180 - protein, 7 aa, Entamoeba invadens
DSGISSA

SEQ ID NO: 2847181 - protein, 6 aa, Entamoeba invadens
DSGIYR

SEQ ID NO: 2847182 - protein, 18 aa, Entamoeba invadens
DSGKTTLFNPKRSADAIP

SEQ ID NO: 2847183 - protein, 4 aa, Entamoeba invadens
DSGL

SEQ ID NO: 2847184 - protein, 5 aa, Entamoeba invadens
DSGLM

SEQ ID NO: 2847185 - protein, 7 aa, Entamoeba invadens
DSGLPKP

SEQ ID NO: 2847186 - protein, 9 aa, Entamoeba invadens
DSGMKTKNK

SEQ ID NO: 2847187 - protein, 13 aa, Entamoeba invadens
DSGNFMRMSSLFN

SEQ ID NO: 2847188 - protein, 5 aa, Entamoeba invadens
DSGNL

SEQ ID NO: 2847189 - protein, 6 aa, Entamoeba invadens
DSGNTI

SEQ ID NO: 2847190 - protein, 5 aa, Entamoeba invadens
DSGQI

SEQ ID NO: 2847191 - protein, 9 aa, Entamoeba invadens
DSGRNGSLN

SEQ ID NO: 2847192 - protein, 12 aa, Entamoeba invadens
DSGSKGSNSNIS

SEQ ID NO: 2847193 - protein, 14 aa, Entamoeba invadens
DSGSLEVNSLYSQS

SEQ ID NO: 2847194 - protein, 6 aa, Entamoeba invadens
DSGSTA

SEQ ID NO: 2847195 - protein, 5 aa, Entamoeba invadens
DSGSV

SEQ ID NO: 2847196 - protein, 4 aa, Entamoeba invadens
DSGV

SEQ ID NO: 2847197 - protein, 8 aa, Entamoeba invadens
DSGVGKSS

SEQ ID NO: 2847198 - protein, 8 aa, Entamoeba invadens
DSGYDGKK

SEQ ID NO: 2847199 - protein, 6 aa, Entamoeba invadens
DSHASD

SEQ ID NO: 2847200 - protein, 8 aa, Entamoeba invadens
DSHDPPDF

SEQ ID NO: 2847201 - protein, 5 aa, Entamoeba invadens
DSHGP

SEQ ID NO: 2847202 - protein, 4 aa, Entamoeba invadens
DSHM

SEQ ID NO: 2847203 - protein, 6 aa, Entamoeba invadens
DSHPSD

SEQ ID NO: 2847204 - protein, 5 aa, Entamoeba invadens
DSHSP

SEQ ID NO: 2847205 - protein, 7 aa, Entamoeba invadens
DSHSPNE

SEQ ID NO: 2847206 - protein, 13 aa, Entamoeba invadens
DSHSYTATYTKPL

SEQ ID NO: 2847207 - protein, 11 aa, Entamoeba invadens
DSHVKQDPTFK

SEQ ID NO: 2847208 - protein, 8 aa, Entamoeba invadens
DSIAPDIK

SEQ ID NO: 2847209 - protein, 5 aa, Entamoeba invadens
DSIDE

SEQ ID NO: 2847210 - protein, 24 aa, Entamoeba invadens
DSIEDKRKQPAARPQQRTTLGGTF

SEQ ID NO: 2847211 - protein, 22 aa, Entamoeba invadens
DSIETNEDGMFESTPDEQIENE

SEQ ID NO: 2847212 - protein, 12 aa, Entamoeba invadens
DSIHNATQPEEI

SEQ ID NO: 2847213 - protein, 13 aa, Entamoeba invadens
DSIHNATQPEEID

SEQ ID NO: 2847214 - protein, 13 aa, Entamoeba invadens
DSIHNPTQTEEID

SEQ ID NO: 2847215 - protein, 4 aa, Entamoeba invadens
DSIK

SEQ ID NO: 2847216 - protein, 14 aa, Entamoeba invadens
DSIKNEKEERTKTL

SEQ ID NO: 2847217 - protein, 4 aa, Entamoeba invadens
DSIN

SEQ ID NO: 2847218 - protein, 12 aa, Entamoeba invadens
DSINNRKKMDTQ

SEQ ID NO: 2847219 - protein, 4 aa, Entamoeba invadens
DSIP

SEQ ID NO: 2847220 - protein, 19 aa, Entamoeba invadens
DSIPSKPTLQDFNSFLQSL

SEQ ID NO: 2847221 - protein, 5 aa, Entamoeba invadens
DSIQE

SEQ ID NO: 2847222 - protein, 7 aa, Entamoeba invadens
DSISRTC

SEQ ID NO: 2847223 - protein, 13 aa, Entamoeba invadens
DSITTEDKEINGR

SEQ ID NO: 2847224 - protein, 9 aa, Entamoeba invadens
DSKAENDKF

SEQ ID NO: 2847225 - protein, 13 aa, Entamoeba invadens
DSKDKPEKTKEYI

SEQ ID NO: 2847226 - protein, 5 aa, Entamoeba invadens
DSKDL

SEQ ID NO: 2847227 - protein, 8 aa, Entamoeba invadens
DSKDLDTC

SEQ ID NO: 2847228 - protein, 9 aa, Entamoeba invadens
DSKEENKEP

SEQ ID NO: 2847229 - protein, 15 aa, Entamoeba invadens
DSKEERQKMGESGKI

SEQ ID NO: 2847230 - protein, 6 aa, Entamoeba invadens
DSKEKL

SEQ ID NO: 2847231 - protein, 15 aa, Entamoeba invadens
DSKEKVVSKKIGRPI

SEQ ID NO: 2847232 - protein, 18 aa, Entamoeba invadens
DSKENIEKAIRTENQKQD

SEQ ID NO: 2847233 - protein, 9 aa, Entamoeba invadens
DSKENVLKT

SEQ ID NO: 2847234 - protein, 8 aa, Entamoeba invadens
DSKETPAL

SEQ ID NO: 2847235 - protein, 6 aa, Entamoeba invadens
DSKFDK

SEQ ID NO: 2847236 - protein, 13 aa, Entamoeba invadens
DSKFGKKLKPVEE

SEQ ID NO: 2847237 - protein, 7 aa, Entamoeba invadens
DSKGLTP

SEQ ID NO: 2847238 - protein, 4 aa, Entamoeba invadens
DSKH

SEQ ID NO: 2847239 - protein, 8 aa, Entamoeba invadens
DSKHPQNA

SEQ ID NO: 2847240 - protein, 28 aa, Entamoeba invadens
DSKKDMETDSPSTRDEEKIDKSGGISAK

SEQ ID NO: 2847241 - protein, 11 aa, Entamoeba invadens
DSKKNEELETS

SEQ ID NO: 2847242 - protein, 22 aa, Entamoeba invadens
DSKKNGEMTPKSFRTSVSRSIG

SEQ ID NO: 2847243 - protein, 4 aa, Entamoeba invadens
DSKL

SEQ ID NO: 2847244 - protein, 8 aa, Entamoeba invadens
DSKLSDIG

SEQ ID NO: 2847245 - protein, 4 aa, Entamoeba invadens
DSKN

SEQ ID NO: 2847246 - protein, 9 aa, Entamoeba invadens
DSKNGENKI

SEQ ID NO: 2847247 - protein, 7 aa, Entamoeba invadens
DSKNGQL

SEQ ID NO: 2847248 - protein, 10 aa, Entamoeba invadens
DSKNPYKQRE

SEQ ID NO: 2847249 - protein, 23 aa, Entamoeba invadens
DSKPFTPKNKPKKSLRPVASAET

SEQ ID NO: 2847250 - protein, 7 aa, Entamoeba invadens
DSKPTQI

SEQ ID NO: 2847251 - protein, 8 aa, Entamoeba invadens
DSKQLKVG

SEQ ID NO: 2847252 - protein, 6 aa, Entamoeba invadens
DSKQLQ

SEQ ID NO: 2847253 - protein, 9 aa, Entamoeba invadens
DSKSDKSMK

SEQ ID NO: 2847254 - protein, 6 aa, Entamoeba invadens
DSKSGL

SEQ ID NO: 2847255 - protein, 12 aa, Entamoeba invadens
DSKSQDEAKKVT

SEQ ID NO: 2847256 - protein, 13 aa, Entamoeba invadens
DSKSVKKSKPNPD

SEQ ID NO: 2847257 - protein, 8 aa, Entamoeba invadens
DSKTDLTD

SEQ ID NO: 2847258 - protein, 6 aa, Entamoeba invadens
DSKTIG

SEQ ID NO: 2847259 - protein, 10 aa, Entamoeba invadens
DSKTPEFQTA

SEQ ID NO: 2847260 - protein, 8 aa, Entamoeba invadens
DSKTSFED

SEQ ID NO: 2847261 - protein, 108 aa, Entamoeba invadens
DSKTTQDVQEQNLEESQLKSEEKESETKVDEQIEENTTRPDLKKYESVPQIKTQQEKEIEAPQVESKDKLQTGDIQSQNKIEEKEEKQEKKSKDKKKTEEKTNGKKKE

SEQ ID NO: 2847262 - protein, 10 aa, Entamoeba invadens
DSKVDKHNIN

SEQ ID NO: 2847263 - protein, 8 aa, Entamoeba invadens
DSKVGKTS

SEQ ID NO: 2847264 - protein, 15 aa, Entamoeba invadens
DSKYTEGKSGTNKQE

SEQ ID NO: 2847265 - protein, 8 aa, Entamoeba invadens
DSLAETDK

SEQ ID NO: 2847266 - protein, 8 aa, Entamoeba invadens
DSLAGITD

SEQ ID NO: 2847267 - protein, 4 aa, Entamoeba invadens
DSLD

SEQ ID NO: 2847268 - protein, 16 aa, Entamoeba invadens
DSLDPEIQEHRETKED

SEQ ID NO: 2847269 - protein, 10 aa, Entamoeba invadens
DSLEDANEQI

SEQ ID NO: 2847270 - protein, 6 aa, Entamoeba invadens
DSLEEQ

SEQ ID NO: 2847271 - protein, 23 aa, Entamoeba invadens
DSLEKIENTEEELDNQKTLVQRR

SEQ ID NO: 2847272 - protein, 12 aa, Entamoeba invadens
DSLEKKMYPEED

SEQ ID NO: 2847273 - protein, 12 aa, Entamoeba invadens
DSLEKVEKNINQ

SEQ ID NO: 2847274 - protein, 13 aa, Entamoeba invadens
DSLEKVEKNINQL

SEQ ID NO: 2847275 - protein, 5 aa, Entamoeba invadens
DSLEN

SEQ ID NO: 2847276 - protein, 8 aa, Entamoeba invadens
DSLEPRTQ

SEQ ID NO: 2847277 - protein, 5 aa, Entamoeba invadens
DSLET

SEQ ID NO: 2847278 - protein, 4 aa, Entamoeba invadens
DSLF

SEQ ID NO: 2847279 - protein, 5 aa, Entamoeba invadens
DSLGS

SEQ ID NO: 2847280 - protein, 12 aa, Entamoeba invadens
DSLKSLQRAERY

SEQ ID NO: 2847281 - protein, 6 aa, Entamoeba invadens
DSLNHP

SEQ ID NO: 2847282 - protein, 6 aa, Entamoeba invadens
DSLNKK

SEQ ID NO: 2847283 - protein, 16 aa, Entamoeba invadens
DSLNKTQSKRINSSSS

SEQ ID NO: 2847284 - protein, 4 aa, Entamoeba invadens
DSLP

SEQ ID NO: 2847285 - protein, 6 aa, Entamoeba invadens
DSLPHT

SEQ ID NO: 2847286 - protein, 8 aa, Entamoeba invadens
DSLQPERI

SEQ ID NO: 2847287 - protein, 6 aa, Entamoeba invadens
DSLQRA

SEQ ID NO: 2847288 - protein, 6 aa, Entamoeba invadens
DSLSAK

SEQ ID NO: 2847289 - protein, 13 aa, Entamoeba invadens
DSLSDNGSAPKRL

SEQ ID NO: 2847290 - protein, 6 aa, Entamoeba invadens
DSLTSI

SEQ ID NO: 2847291 - protein, 8 aa, Entamoeba invadens
DSLVGTQT

SEQ ID NO: 2847292 - protein, 13 aa, Entamoeba invadens
DSMEKDTNVLNKR

SEQ ID NO: 2847293 - protein, 4 aa, Entamoeba invadens
DSMH

SEQ ID NO: 2847294 - protein, 6 aa, Entamoeba invadens
DSMKEE

SEQ ID NO: 2847295 - protein, 21 aa, Entamoeba invadens
DSMKQQTNVGTPQVNYSQPQK

SEQ ID NO: 2847296 - protein, 6 aa, Entamoeba invadens
DSMPLP

SEQ ID NO: 2847297 - protein, 4 aa, Entamoeba invadens
DSNA

SEQ ID NO: 2847298 - protein, 6 aa, Entamoeba invadens
DSNAEI

SEQ ID NO: 2847299 - protein, 7 aa, Entamoeba invadens
DSNARDC

SEQ ID NO: 2847300 - protein, 8 aa, Entamoeba invadens
DSNATKDN

SEQ ID NO: 2847301 - protein, 11 aa, Entamoeba invadens
DSNCERCSSTF

SEQ ID NO: 2847302 - protein, 10 aa, Entamoeba invadens
DSNCNTPNTE

SEQ ID NO: 2847303 - protein, 11 aa, Entamoeba invadens
DSNCNTPNTEV

SEQ ID NO: 2847304 - protein, 10 aa, Entamoeba invadens
DSNCVSTTNN

SEQ ID NO: 2847305 - protein, 10 aa, Entamoeba invadens
DSNDDNELRY

SEQ ID NO: 2847306 - protein, 6 aa, Entamoeba invadens
DSNDKY

SEQ ID NO: 2847307 - protein, 36 aa, Entamoeba invadens
DSNEKKKAEQQQKENEEKRKQALEEQKKIQQHNEAE

SEQ ID NO: 2847308 - protein, 13 aa, Entamoeba invadens
DSNEQSGEQSDDY

SEQ ID NO: 2847309 - protein, 16 aa, Entamoeba invadens
DSNESTETEKSEGTFA

SEQ ID NO: 2847310 - protein, 7 aa, Entamoeba invadens
DSNETER

SEQ ID NO: 2847311 - protein, 4 aa, Entamoeba invadens
DSNF

SEQ ID NO: 2847312 - protein, 6 aa, Entamoeba invadens
DSNGHK

SEQ ID NO: 2847313 - protein, 7 aa, Entamoeba invadens
DSNGYIE

SEQ ID NO: 2847314 - protein, 7 aa, Entamoeba invadens
DSNHVVD

SEQ ID NO: 2847315 - protein, 4 aa, Entamoeba invadens
DSNI

SEQ ID NO: 2847316 - protein, 26 aa, Entamoeba invadens
DSNKAIPDSKKDKSKYEKRNAISATN

SEQ ID NO: 2847317 - protein, 7 aa, Entamoeba invadens
DSNKDGV

SEQ ID NO: 2847318 - protein, 9 aa, Entamoeba invadens
DSNKQCSKC

SEQ ID NO: 2847319 - protein, 9 aa, Entamoeba invadens
DSNKTSKTL

SEQ ID NO: 2847320 - protein, 11 aa, Entamoeba invadens
DSNNSEKGEAA

SEQ ID NO: 2847321 - protein, 9 aa, Entamoeba invadens
DSNPARRPT

SEQ ID NO: 2847322 - protein, 5 aa, Entamoeba invadens
DSNPG

SEQ ID NO: 2847323 - protein, 8 aa, Entamoeba invadens
DSNPGKGL

SEQ ID NO: 2847324 - protein, 8 aa, Entamoeba invadens
DSNPRDRQ

SEQ ID NO: 2847325 - protein, 19 aa, Entamoeba invadens
DSNPRDRQPSVCSRFLVLR

SEQ ID NO: 2847326 - protein, 11 aa, Entamoeba invadens
DSNQHNNRGVS

SEQ ID NO: 2847327 - protein, 9 aa, Entamoeba invadens
DSNRQKKTE

SEQ ID NO: 2847328 - protein, 10 aa, Entamoeba invadens
DSNRREVTNT

SEQ ID NO: 2847329 - protein, 8 aa, Entamoeba invadens
DSNRRSRA

SEQ ID NO: 2847330 - protein, 4 aa, Entamoeba invadens
DSNS

SEQ ID NO: 2847331 - protein, 13 aa, Entamoeba invadens
DSNSKQRNEATQN

SEQ ID NO: 2847332 - protein, 8 aa, Entamoeba invadens
DSNSTRAE

SEQ ID NO: 2847333 - protein, 5 aa, Entamoeba invadens
DSNSV

SEQ ID NO: 2847334 - protein, 13 aa, Entamoeba invadens
DSNTMEKGKAANL

SEQ ID NO: 2847335 - protein, 5 aa, Entamoeba invadens
DSNTQ

SEQ ID NO: 2847336 - protein, 10 aa, Entamoeba invadens
DSNTQTARIE

SEQ ID NO: 2847337 - protein, 8 aa, Entamoeba invadens
DSNTTTLK

SEQ ID NO: 2847338 - protein, 5 aa, Entamoeba invadens
DSNVP

SEQ ID NO: 2847339 - protein, 6 aa, Entamoeba invadens
DSNYGQ

SEQ ID NO: 2847340 - protein, 7 aa, Entamoeba invadens
DSPDKLQ

SEQ ID NO: 2847341 - protein, 7 aa, Entamoeba invadens
DSPDNAY

SEQ ID NO: 2847342 - protein, 8 aa, Entamoeba invadens
DSPDSDII

SEQ ID NO: 2847343 - protein, 8 aa, Entamoeba invadens
DSPEKLGT

SEQ ID NO: 2847344 - protein, 7 aa, Entamoeba invadens
DSPELPR

SEQ ID NO: 2847345 - protein, 11 aa, Entamoeba invadens
DSPFPPTPEEF

SEQ ID NO: 2847346 - protein, 8 aa, Entamoeba invadens
DSPGNQEY

SEQ ID NO: 2847347 - protein, 6 aa, Entamoeba invadens
DSPIPS

SEQ ID NO: 2847348 - protein, 11 aa, Entamoeba invadens
DSPKRLTEQQI

SEQ ID NO: 2847349 - protein, 7 aa, Entamoeba invadens
DSPLNPS

SEQ ID NO: 2847350 - protein, 14 aa, Entamoeba invadens
DSPMRCENPGFSNI

SEQ ID NO: 2847351 - protein, 10 aa, Entamoeba invadens
DSPNDSNTTN

SEQ ID NO: 2847352 - protein, 6 aa, Entamoeba invadens
DSPNEE

SEQ ID NO: 2847353 - protein, 8 aa, Entamoeba invadens
DSPNHAET

SEQ ID NO: 2847354 - protein, 11 aa, Entamoeba invadens
DSPNSEERTLK

SEQ ID NO: 2847355 - protein, 10 aa, Entamoeba invadens
DSPNTSEQSI

SEQ ID NO: 2847356 - protein, 7 aa, Entamoeba invadens
DSPPDGL

SEQ ID NO: 2847357 - protein, 7 aa, Entamoeba invadens
DSPPEIR

SEQ ID NO: 2847358 - protein, 6 aa, Entamoeba invadens
DSPPFD

SEQ ID NO: 2847359 - protein, 107 aa, Entamoeba invadens
DSPQTKQDQQDKEKRVEEANKAEHKEERTHPTGYSMKKSTPLSERKSGTEQKEESQKTGEKEKTENKGKPKEAKYKQTKATRVTKEPKEDTKEKNKENTGDQHRCSK

SEQ ID NO: 2847360 - protein, 20 aa, Entamoeba invadens
DSPRYKRPTKGKSITPQNTA

SEQ ID NO: 2847361 - protein, 4 aa, Entamoeba invadens
DSPT

SEQ ID NO: 2847362 - protein, 6 aa, Entamoeba invadens
DSPTSY

SEQ ID NO: 2847363 - protein, 8 aa, Entamoeba invadens
DSPTTMES

SEQ ID NO: 2847364 - protein, 4 aa, Entamoeba invadens
DSQA

SEQ ID NO: 2847365 - protein, 7 aa, Entamoeba invadens
DSQAAEQ

SEQ ID NO: 2847366 - protein, 7 aa, Entamoeba invadens
DSQASFN

SEQ ID NO: 2847367 - protein, 8 aa, Entamoeba invadens
DSQEEATN

SEQ ID NO: 2847368 - protein, 7 aa, Entamoeba invadens
DSQEGFE

SEQ ID NO: 2847369 - protein, 9 aa, Entamoeba invadens
DSQESTSYN

SEQ ID NO: 2847370 - protein, 17 aa, Entamoeba invadens
DSQGATVYDEKNPIPLQ

SEQ ID NO: 2847371 - protein, 5 aa, Entamoeba invadens
DSQHK

SEQ ID NO: 2847372 - protein, 9 aa, Entamoeba invadens
DSQKKTDNV

SEQ ID NO: 2847373 - protein, 12 aa, Entamoeba invadens
DSQKMKRGVEEK

SEQ ID NO: 2847374 - protein, 9 aa, Entamoeba invadens
DSQKQFTSH

SEQ ID NO: 2847375 - protein, 9 aa, Entamoeba invadens
DSQKTNNIN

SEQ ID NO: 2847376 - protein, 9 aa, Entamoeba invadens
DSQNGKEEK

SEQ ID NO: 2847377 - protein, 8 aa, Entamoeba invadens
DSQNTFKS

SEQ ID NO: 2847378 - protein, 8 aa, Entamoeba invadens
DSQNTQTI

SEQ ID NO: 2847379 - protein, 5 aa, Entamoeba invadens
DSQQN

SEQ ID NO: 2847380 - protein, 11 aa, Entamoeba invadens
DSQRQATINAG

SEQ ID NO: 2847381 - protein, 13 aa, Entamoeba invadens
DSQRQATKEAGTI

SEQ ID NO: 2847382 - protein, 14 aa, Entamoeba invadens
DSQRQATKEAGTIA

SEQ ID NO: 2847383 - protein, 14 aa, Entamoeba invadens
DSQRQATKNAGTIA

SEQ ID NO: 2847384 - protein, 16 aa, Entamoeba invadens
DSQSQKRIVTQDERSY

SEQ ID NO: 2847385 - protein, 6 aa, Entamoeba invadens
DSQSVH

SEQ ID NO: 2847386 - protein, 4 aa, Entamoeba invadens
DSQT

SEQ ID NO: 2847387 - protein, 18 aa, Entamoeba invadens
DSQTSQIEQRENETYELS

SEQ ID NO: 2847388 - protein, 7 aa, Entamoeba invadens
DSRAPPE

SEQ ID NO: 2847389 - protein, 9 aa, Entamoeba invadens
DSRFGTKED

SEQ ID NO: 2847390 - protein, 8 aa, Entamoeba invadens
DSRGNPTI

SEQ ID NO: 2847391 - protein, 4 aa, Entamoeba invadens
DSRH

SEQ ID NO: 2847392 - protein, 11 aa, Entamoeba invadens
DSRKDDYSNES

SEQ ID NO: 2847393 - protein, 6 aa, Entamoeba invadens
DSRKPT

SEQ ID NO: 2847394 - protein, 23 aa, Entamoeba invadens
DSRKVEAREKQITYGKATEGYKN

SEQ ID NO: 2847395 - protein, 14 aa, Entamoeba invadens
DSRMSDEQIKEMSE

SEQ ID NO: 2847396 - protein, 10 aa, Entamoeba invadens
DSRNDPSEVE

SEQ ID NO: 2847397 - protein, 5 aa, Entamoeba invadens
DSRNI

SEQ ID NO: 2847398 - protein, 8 aa, Entamoeba invadens
DSRNTENS

SEQ ID NO: 2847399 - protein, 8 aa, Entamoeba invadens
DSRREDRV

SEQ ID NO: 2847400 - protein, 8 aa, Entamoeba invadens
DSRRLSVP

SEQ ID NO: 2847401 - protein, 13 aa, Entamoeba invadens
DSRRRLKATKNGL

SEQ ID NO: 2847402 - protein, 13 aa, Entamoeba invadens
DSRTSLYASEEMK

SEQ ID NO: 2847403 - protein, 8 aa, Entamoeba invadens
DSRVSGPW

SEQ ID NO: 2847404 - protein, 10 aa, Entamoeba invadens
DSSASFEDDY

SEQ ID NO: 2847405 - protein, 14 aa, Entamoeba invadens
DSSCNGDCNTSTGQ

SEQ ID NO: 2847406 - protein, 8 aa, Entamoeba invadens
DSSDLNPI

SEQ ID NO: 2847407 - protein, 4 aa, Entamoeba invadens
DSSE

SEQ ID NO: 2847408 - protein, 8 aa, Entamoeba invadens
DSSEEEEI

SEQ ID NO: 2847409 - protein, 14 aa, Entamoeba invadens
DSSEEESLSKNTKI

SEQ ID NO: 2847410 - protein, 7 aa, Entamoeba invadens
DSSEFTE

SEQ ID NO: 2847411 - protein, 5 aa, Entamoeba invadens
DSSEM

SEQ ID NO: 2847412 - protein, 6 aa, Entamoeba invadens
DSSEMK

SEQ ID NO: 2847413 - protein, 10 aa, Entamoeba invadens
DSSEPRKEVR

SEQ ID NO: 2847414 - protein, 7 aa, Entamoeba invadens
DSSERAI

SEQ ID NO: 2847415 - protein, 5 aa, Entamoeba invadens
DSSEV

SEQ ID NO: 2847416 - protein, 4 aa, Entamoeba invadens
DSSF

SEQ ID NO: 2847417 - protein, 15 aa, Entamoeba invadens
DSSFETSSTFSKSES

SEQ ID NO: 2847418 - protein, 6 aa, Entamoeba invadens
DSSFTP

SEQ ID NO: 2847419 - protein, 8 aa, Entamoeba invadens
DSSIANSQ

SEQ ID NO: 2847420 - protein, 15 aa, Entamoeba invadens
DSSIGSAHSKEGNAC

SEQ ID NO: 2847421 - protein, 16 aa, Entamoeba invadens
DSSKDEKVTTQQQRKK

SEQ ID NO: 2847422 - protein, 8 aa, Entamoeba invadens
DSSKESKK

SEQ ID NO: 2847423 - protein, 12 aa, Entamoeba invadens
DSSKEWCGCDIS

SEQ ID NO: 2847424 - protein, 24 aa, Entamoeba invadens
DSSKKVTRKSDDEILREKEKKSRK

SEQ ID NO: 2847425 - protein, 15 aa, Entamoeba invadens
DSSKNATLPQPTGPV

SEQ ID NO: 2847426 - protein, 6 aa, Entamoeba invadens
DSSKVQ

SEQ ID NO: 2847427 - protein, 7 aa, Entamoeba invadens
DSSKYNS

SEQ ID NO: 2847428 - protein, 4 aa, Entamoeba invadens
DSSL

SEQ ID NO: 2847429 - protein, 8 aa, Entamoeba invadens
DSSMPASI

SEQ ID NO: 2847430 - protein, 15 aa, Entamoeba invadens
DSSNAPTPKQTFTTD

SEQ ID NO: 2847431 - protein, 5 aa, Entamoeba invadens
DSSND

SEQ ID NO: 2847432 - protein, 5 aa, Entamoeba invadens
DSSNK

SEQ ID NO: 2847433 - protein, 6 aa, Entamoeba invadens
DSSNSI

SEQ ID NO: 2847434 - protein, 9 aa, Entamoeba invadens
DSSNTSRCG

SEQ ID NO: 2847435 - protein, 8 aa, Entamoeba invadens
DSSPRRVT

SEQ ID NO: 2847436 - protein, 15 aa, Entamoeba invadens
DSSQIQDEIGKNLSE

SEQ ID NO: 2847437 - protein, 9 aa, Entamoeba invadens
DSSQLPDPT

SEQ ID NO: 2847438 - protein, 9 aa, Entamoeba invadens
DSSQNKTRS

SEQ ID NO: 2847439 - protein, 14 aa, Entamoeba invadens
DSSQRVAKEKLPED

SEQ ID NO: 2847440 - protein, 5 aa, Entamoeba invadens
DSSRV

SEQ ID NO: 2847441 - protein, 11 aa, Entamoeba invadens
DSSRWGQTDGH

SEQ ID NO: 2847442 - protein, 14 aa, Entamoeba invadens
DSSRYVDDGVEEGT

SEQ ID NO: 2847443 - protein, 6 aa, Entamoeba invadens
DSSSFD

SEQ ID NO: 2847444 - protein, 8 aa, Entamoeba invadens
DSSSSSDD

SEQ ID NO: 2847445 - protein, 4 aa, Entamoeba invadens
DSST

SEQ ID NO: 2847446 - protein, 11 aa, Entamoeba invadens
DSSTIAKNKEN

SEQ ID NO: 2847447 - protein, 7 aa, Entamoeba invadens
DSSTNGV

SEQ ID NO: 2847448 - protein, 7 aa, Entamoeba invadens
DSSTTIQ

SEQ ID NO: 2847449 - protein, 6 aa, Entamoeba invadens
DSSTYN

SEQ ID NO: 2847450 - protein, 4 aa, Entamoeba invadens
DSSV

SEQ ID NO: 2847451 - protein, 6 aa, Entamoeba invadens
DSSVEM

SEQ ID NO: 2847452 - protein, 7 aa, Entamoeba invadens
DSSVGKS

SEQ ID NO: 2847453 - protein, 8 aa, Entamoeba invadens
DSSVGKTA

SEQ ID NO: 2847454 - protein, 5 aa, Entamoeba invadens
DSSYQ

SEQ ID NO: 2847455 - protein, 14 aa, Entamoeba invadens
DSSYVTENSDEKSE

SEQ ID NO: 2847456 - protein, 5 aa, Entamoeba invadens
DSTAN

SEQ ID NO: 2847457 - protein, 4 aa, Entamoeba invadens
DSTC

SEQ ID NO: 2847458 - protein, 7 aa, Entamoeba invadens
DSTCGGS

SEQ ID NO: 2847459 - protein, 16 aa, Entamoeba invadens
DSTCGNQCDGKNGHCT

SEQ ID NO: 2847460 - protein, 7 aa, Entamoeba invadens
DSTCNEI

SEQ ID NO: 2847461 - protein, 14 aa, Entamoeba invadens
DSTCNGDCNTSSGI

SEQ ID NO: 2847462 - protein, 10 aa, Entamoeba invadens
DSTDEPPERI

SEQ ID NO: 2847463 - protein, 7 aa, Entamoeba invadens
DSTEDTK

SEQ ID NO: 2847464 - protein, 6 aa, Entamoeba invadens
DSTEFE

SEQ ID NO: 2847465 - protein, 7 aa, Entamoeba invadens
DSTEQLD

SEQ ID NO: 2847466 - protein, 5 aa, Entamoeba invadens
DSTES

SEQ ID NO: 2847467 - protein, 5 aa, Entamoeba invadens
DSTFK

SEQ ID NO: 2847468 - protein, 8 aa, Entamoeba invadens
DSTGKGAD

SEQ ID NO: 2847469 - protein, 7 aa, Entamoeba invadens
DSTGNIK

SEQ ID NO: 2847470 - protein, 6 aa, Entamoeba invadens
DSTGRI

SEQ ID NO: 2847471 - protein, 19 aa, Entamoeba invadens
DSTIGGKRINDIKNSSIKS

SEQ ID NO: 2847472 - protein, 14 aa, Entamoeba invadens
DSTISTKPTEKGKE

SEQ ID NO: 2847473 - protein, 4 aa, Entamoeba invadens
DSTK

SEQ ID NO: 2847474 - protein, 12 aa, Entamoeba invadens
DSTKEECAYGNT

SEQ ID NO: 2847475 - protein, 15 aa, Entamoeba invadens
DSTKGKCQKCQDTSC

SEQ ID NO: 2847476 - protein, 10 aa, Entamoeba invadens
DSTKHCDDDG

SEQ ID NO: 2847477 - protein, 10 aa, Entamoeba invadens
DSTKQASSVG

SEQ ID NO: 2847478 - protein, 14 aa, Entamoeba invadens
DSTKRKCQKCQDTN

SEQ ID NO: 2847479 - protein, 7 aa, Entamoeba invadens
DSTLQDQ

SEQ ID NO: 2847480 - protein, 15 aa, Entamoeba invadens
DSTLQTLKNDTKTLT

SEQ ID NO: 2847481 - protein, 7 aa, Entamoeba invadens
DSTMTDD

SEQ ID NO: 2847482 - protein, 5 aa, Entamoeba invadens
DSTPE

SEQ ID NO: 2847483 - protein, 6 aa, Entamoeba invadens
DSTPSQ

SEQ ID NO: 2847484 - protein, 12 aa, Entamoeba invadens
DSTPVSEENEPY

SEQ ID NO: 2847485 - protein, 20 aa, Entamoeba invadens
DSTQKTPKKKNNNADLSKVT

SEQ ID NO: 2847486 - protein, 8 aa, Entamoeba invadens
DSTQPQEP

SEQ ID NO: 2847487 - protein, 5 aa, Entamoeba invadens
DSTQV

SEQ ID NO: 2847488 - protein, 9 aa, Entamoeba invadens
DSTRNQYTE

SEQ ID NO: 2847489 - protein, 16 aa, Entamoeba invadens
DSTRVLDDGDVTPAGG

SEQ ID NO: 2847490 - protein, 8 aa, Entamoeba invadens
DSTSDNLI

SEQ ID NO: 2847491 - protein, 21 aa, Entamoeba invadens
DSTSLSEKFGPNSTALRDNKL

SEQ ID NO: 2847492 - protein, 6 aa, Entamoeba invadens
DSTSQT

SEQ ID NO: 2847493 - protein, 8 aa, Entamoeba invadens
DSTSRKLT

SEQ ID NO: 2847494 - protein, 8 aa, Entamoeba invadens
DSTTCQGG

SEQ ID NO: 2847495 - protein, 39 aa, Entamoeba invadens
DSTTDKCEEKCEENEMQNDMQNDNEYNSTHTLKDTDIDN

SEQ ID NO: 2847496 - protein, 7 aa, Entamoeba invadens
DSTTITS

SEQ ID NO: 2847497 - protein, 7 aa, Entamoeba invadens
DSTTKGD

SEQ ID NO: 2847498 - protein, 8 aa, Entamoeba invadens
DSTTKNDK

SEQ ID NO: 2847499 - protein, 6 aa, Entamoeba invadens
DSTTNL

SEQ ID NO: 2847500 - protein, 7 aa, Entamoeba invadens
DSTTPYK

SEQ ID NO: 2847501 - protein, 5 aa, Entamoeba invadens
DSTTR

SEQ ID NO: 2847502 - protein, 7 aa, Entamoeba invadens
DSTTSSQ

SEQ ID NO: 2847503 - protein, 15 aa, Entamoeba invadens
DSTTTPTEEKRRNTT

SEQ ID NO: 2847504 - protein, 18 aa, Entamoeba invadens
DSTVSNDLDDLNEKTNYS

SEQ ID NO: 2847505 - protein, 4 aa, Entamoeba invadens
DSTY

SEQ ID NO: 2847506 - protein, 6 aa, Entamoeba invadens
DSVAGN

SEQ ID NO: 2847507 - protein, 29 aa, Entamoeba invadens
DSVDVENSKNSKDKLESEPVKRKSFSEKI

SEQ ID NO: 2847508 - protein, 7 aa, Entamoeba invadens
DSVEKSL

SEQ ID NO: 2847509 - protein, 7 aa, Entamoeba invadens
DSVEQTH

SEQ ID NO: 2847510 - protein, 9 aa, Entamoeba invadens
DSVETNQSS

SEQ ID NO: 2847511 - protein, 5 aa, Entamoeba invadens
DSVGQ

SEQ ID NO: 2847512 - protein, 15 aa, Entamoeba invadens
DSVKDAALNGDRVEK

SEQ ID NO: 2847513 - protein, 9 aa, Entamoeba invadens
DSVKEKANF

SEQ ID NO: 2847514 - protein, 7 aa, Entamoeba invadens
DSVKEKD

SEQ ID NO: 2847515 - protein, 11 aa, Entamoeba invadens
DSVKGKLTTLD

SEQ ID NO: 2847516 - protein, 16 aa, Entamoeba invadens
DSVNDANKHVNDSMTV

SEQ ID NO: 2847517 - protein, 7 aa, Entamoeba invadens
DSVNGGI

SEQ ID NO: 2847518 - protein, 7 aa, Entamoeba invadens
DSVNSHV

SEQ ID NO: 2847519 - protein, 6 aa, Entamoeba invadens
DSVNSV

SEQ ID NO: 2847520 - protein, 21 aa, Entamoeba invadens
DSVPSTVVASRSSSKTSTRSC

SEQ ID NO: 2847521 - protein, 7 aa, Entamoeba invadens
DSVPTKY

SEQ ID NO: 2847522 - protein, 11 aa, Entamoeba invadens
DSVQNTEQIQA

SEQ ID NO: 2847523 - protein, 4 aa, Entamoeba invadens
DSVR

SEQ ID NO: 2847524 - protein, 6 aa, Entamoeba invadens
DSVRQR

SEQ ID NO: 2847525 - protein, 4 aa, Entamoeba invadens
DSVS

SEQ ID NO: 2847526 - protein, 6 aa, Entamoeba invadens
DSVSVR

SEQ ID NO: 2847527 - protein, 5 aa, Entamoeba invadens
DSVTA

SEQ ID NO: 2847528 - protein, 11 aa, Entamoeba invadens
DSVTGGSFSTA

SEQ ID NO: 2847529 - protein, 6 aa, Entamoeba invadens
DSVTNS

SEQ ID NO: 2847530 - protein, 7 aa, Entamoeba invadens
DSVTRQQ

SEQ ID NO: 2847531 - protein, 5 aa, Entamoeba invadens
DSVTS

SEQ ID NO: 2847532 - protein, 6 aa, Entamoeba invadens
DSVTSI

SEQ ID NO: 2847533 - protein, 7 aa, Entamoeba invadens
DSVTTIG

SEQ ID NO: 2847534 - protein, 4 aa, Entamoeba invadens
DSWK

SEQ ID NO: 2847535 - protein, 4 aa, Entamoeba invadens
DSWN

SEQ ID NO: 2847536 - protein, 10 aa, Entamoeba invadens
DSWNGTDGMS

SEQ ID NO: 2847537 - protein, 6 aa, Entamoeba invadens
DSWNSH

SEQ ID NO: 2847538 - protein, 9 aa, Entamoeba invadens
DSWSNEEAE

SEQ ID NO: 2847539 - protein, 5 aa, Entamoeba invadens
DSYED

SEQ ID NO: 2847540 - protein, 9 aa, Entamoeba invadens
DSYESVENF

SEQ ID NO: 2847541 - protein, 7 aa, Entamoeba invadens
DSYFNGS

SEQ ID NO: 2847542 - protein, 16 aa, Entamoeba invadens
DSYGQDIKKEEEQEDD

SEQ ID NO: 2847543 - protein, 5 aa, Entamoeba invadens
DSYIS

SEQ ID NO: 2847544 - protein, 7 aa, Entamoeba invadens
DSYNPEL

SEQ ID NO: 2847545 - protein, 11 aa, Entamoeba invadens
DSYNPGTITSQ

SEQ ID NO: 2847546 - protein, 14 aa, Entamoeba invadens
DSYQGENIEEQTEL

SEQ ID NO: 2847547 - protein, 8 aa, Entamoeba invadens
DSYSGKTS

SEQ ID NO: 2847548 - protein, 13 aa, Entamoeba invadens
DSYTTRTPVDGDE

SEQ ID NO: 2847549 - protein, 9 aa, Entamoeba invadens
DSYYGDSNF

SEQ ID NO: 2847550 - protein, 13 aa, Entamoeba invadens
DTAAPSARDKVKS

SEQ ID NO: 2847551 - protein, 8 aa, Entamoeba invadens
DTAASTYR

SEQ ID NO: 2847552 - protein, 5 aa, Entamoeba invadens
DTACY

SEQ ID NO: 2847553 - protein, 5 aa, Entamoeba invadens
DTADE

SEQ ID NO: 2847554 - protein, 14 aa, Entamoeba invadens
DTAEADKKPKLPIQ

SEQ ID NO: 2847555 - protein, 11 aa, Entamoeba invadens
DTAFDSTPSVH

SEQ ID NO: 2847556 - protein, 8 aa, Entamoeba invadens
DTAGAPGY

SEQ ID NO: 2847557 - protein, 7 aa, Entamoeba invadens
DTAGQEI

SEQ ID NO: 2847558 - protein, 7 aa, Entamoeba invadens
DTAGQER

SEQ ID NO: 2847559 - protein, 30 aa, Entamoeba invadens
DTAHARDYTTNPRYPSEPKTASRQSTNRNI

SEQ ID NO: 2847560 - protein, 7 aa, Entamoeba invadens
DTAITEK

SEQ ID NO: 2847561 - protein, 6 aa, Entamoeba invadens
DTAKEQ

SEQ ID NO: 2847562 - protein, 13 aa, Entamoeba invadens
DTAKKEKGADRIR

SEQ ID NO: 2847563 - protein, 9 aa, Entamoeba invadens
DTAKPDDKI

SEQ ID NO: 2847564 - protein, 13 aa, Entamoeba invadens
DTAKSDPAKLEGE

SEQ ID NO: 2847565 - protein, 7 aa, Entamoeba invadens
DTANALE

SEQ ID NO: 2847566 - protein, 8 aa, Entamoeba invadens
DTANGKSL

SEQ ID NO: 2847567 - protein, 15 aa, Entamoeba invadens
DTAPAVNPDEPPDFN

SEQ ID NO: 2847568 - protein, 6 aa, Entamoeba invadens
DTASIA

SEQ ID NO: 2847569 - protein, 8 aa, Entamoeba invadens
DTATIKAD

SEQ ID NO: 2847570 - protein, 9 aa, Entamoeba invadens
DTATPLGIS

SEQ ID NO: 2847571 - protein, 13 aa, Entamoeba invadens
DTATQVANKSDEV

SEQ ID NO: 2847572 - protein, 7 aa, Entamoeba invadens
DTATTVE

SEQ ID NO: 2847573 - protein, 7 aa, Entamoeba invadens
DTCGSEQ

SEQ ID NO: 2847574 - protein, 4 aa, Entamoeba invadens
DTCQ

SEQ ID NO: 2847575 - protein, 6 aa, Entamoeba invadens
DTCSEE

SEQ ID NO: 2847576 - protein, 11 aa, Entamoeba invadens
DTDAKTKQNIQ

SEQ ID NO: 2847577 - protein, 11 aa, Entamoeba invadens
DTDAPKRFEVP

SEQ ID NO: 2847578 - protein, 10 aa, Entamoeba invadens
DTDCNGDTVS

SEQ ID NO: 2847579 - protein, 5 aa, Entamoeba invadens
DTDEF

SEQ ID NO: 2847580 - protein, 7 aa, Entamoeba invadens
DTDENVS

SEQ ID NO: 2847581 - protein, 6 aa, Entamoeba invadens
DTDEVE

SEQ ID NO: 2847582 - protein, 17 aa, Entamoeba invadens
DTDGDGSISKDEFLMIM

SEQ ID NO: 2847583 - protein, 7 aa, Entamoeba invadens
DTDGNKF

SEQ ID NO: 2847584 - protein, 7 aa, Entamoeba invadens
DTDGPKL

SEQ ID NO: 2847585 - protein, 7 aa, Entamoeba invadens
DTDHPQE

SEQ ID NO: 2847586 - protein, 4 aa, Entamoeba invadens
DTDI

SEQ ID NO: 2847587 - protein, 16 aa, Entamoeba invadens
DTDIIDNSEFIKIMRH

SEQ ID NO: 2847588 - protein, 9 aa, Entamoeba invadens
DTDKCNSTS

SEQ ID NO: 2847589 - protein, 13 aa, Entamoeba invadens
DTDKGTKFISGEE

SEQ ID NO: 2847590 - protein, 9 aa, Entamoeba invadens
DTDKITEED

SEQ ID NO: 2847591 - protein, 9 aa, Entamoeba invadens
DTDKITKED

SEQ ID NO: 2847592 - protein, 7 aa, Entamoeba invadens
DTDKNGY

SEQ ID NO: 2847593 - protein, 6 aa, Entamoeba invadens
DTDKNQ

SEQ ID NO: 2847594 - protein, 10 aa, Entamoeba invadens
DTDNDGKLTR

SEQ ID NO: 2847595 - protein, 8 aa, Entamoeba invadens
DTDNSQPA

SEQ ID NO: 2847596 - protein, 9 aa, Entamoeba invadens
DTDNTKLRD

SEQ ID NO: 2847597 - protein, 7 aa, Entamoeba invadens
DTDNTTT

SEQ ID NO: 2847598 - protein, 7 aa, Entamoeba invadens
DTDPLNE

SEQ ID NO: 2847599 - protein, 9 aa, Entamoeba invadens
DTDPMGGKY

SEQ ID NO: 2847600 - protein, 5 aa, Entamoeba invadens
DTDPR

SEQ ID NO: 2847601 - protein, 7 aa, Entamoeba invadens
DTDREKP

SEQ ID NO: 2847602 - protein, 8 aa, Entamoeba invadens
DTDRSGTL

SEQ ID NO: 2847603 - protein, 8 aa, Entamoeba invadens
DTDSKEGA

SEQ ID NO: 2847604 - protein, 12 aa, Entamoeba invadens
DTDSNGSINKEE

SEQ ID NO: 2847605 - protein, 7 aa, Entamoeba invadens
DTDSQLV

SEQ ID NO: 2847606 - protein, 15 aa, Entamoeba invadens
DTDYSTDLKSKVAES

SEQ ID NO: 2847607 - protein, 9 aa, Entamoeba invadens
DTEAEKRKQ

SEQ ID NO: 2847608 - protein, 11 aa, Entamoeba invadens
DTEAKDEMREH

SEQ ID NO: 2847609 - protein, 5 aa, Entamoeba invadens
DTEAP

SEQ ID NO: 2847610 - protein, 8 aa, Entamoeba invadens
DTEDNDYN

SEQ ID NO: 2847611 - protein, 4 aa, Entamoeba invadens
DTEE

SEQ ID NO: 2847612 - protein, 5 aa, Entamoeba invadens
DTEED

SEQ ID NO: 2847613 - protein, 11 aa, Entamoeba invadens
DTEEHTEETRQ

SEQ ID NO: 2847614 - protein, 6 aa, Entamoeba invadens
DTEEMK

SEQ ID NO: 2847615 - protein, 6 aa, Entamoeba invadens
DTEESL

SEQ ID NO: 2847616 - protein, 7 aa, Entamoeba invadens
DTEESYV

SEQ ID NO: 2847617 - protein, 7 aa, Entamoeba invadens
DTEGHDE

SEQ ID NO: 2847618 - protein, 5 aa, Entamoeba invadens
DTEGI

SEQ ID NO: 2847619 - protein, 6 aa, Entamoeba invadens
DTEGKY

SEQ ID NO: 2847620 - protein, 5 aa, Entamoeba invadens
DTEGV

SEQ ID NO: 2847621 - protein, 11 aa, Entamoeba invadens
DTEISKRVTAK

SEQ ID NO: 2847622 - protein, 6 aa, Entamoeba invadens
DTEKED

SEQ ID NO: 2847623 - protein, 9 aa, Entamoeba invadens
DTEKEPKLI

SEQ ID NO: 2847624 - protein, 9 aa, Entamoeba invadens
DTEKEQYER

SEQ ID NO: 2847625 - protein, 12 aa, Entamoeba invadens
DTEKKDEIAKEN

SEQ ID NO: 2847626 - protein, 5 aa, Entamoeba invadens
DTEKS

SEQ ID NO: 2847627 - protein, 14 aa, Entamoeba invadens
DTELTPPKAQKGVK

SEQ ID NO: 2847628 - protein, 4 aa, Entamoeba invadens
DTEN

SEQ ID NO: 2847629 - protein, 9 aa, Entamoeba invadens
DTENEFPEG

SEQ ID NO: 2847630 - protein, 9 aa, Entamoeba invadens
DTENSDYKM

SEQ ID NO: 2847631 - protein, 6 aa, Entamoeba invadens
DTENWR

SEQ ID NO: 2847632 - protein, 10 aa, Entamoeba invadens
DTEPEDITQR

SEQ ID NO: 2847633 - protein, 6 aa, Entamoeba invadens
DTERPM

SEQ ID NO: 2847634 - protein, 10 aa, Entamoeba invadens
DTERTPQKVQ

SEQ ID NO: 2847635 - protein, 12 aa, Entamoeba invadens
DTERYDDAKTAL

SEQ ID NO: 2847636 - protein, 4 aa, Entamoeba invadens
DTES

SEQ ID NO: 2847637 - protein, 6 aa, Entamoeba invadens
DTESEF

SEQ ID NO: 2847638 - protein, 5 aa, Entamoeba invadens
DTETR

SEQ ID NO: 2847639 - protein, 30 aa, Entamoeba invadens
DTEVKKANTVFNDANAKTIKGVDKSINDIA

SEQ ID NO: 2847640 - protein, 5 aa, Entamoeba invadens
DTEWK

SEQ ID NO: 2847641 - protein, 7 aa, Entamoeba invadens
DTEYSDP

SEQ ID NO: 2847642 - protein, 6 aa, Entamoeba invadens
DTFAKR

SEQ ID NO: 2847643 - protein, 6 aa, Entamoeba invadens
DTFDGD

SEQ ID NO: 2847644 - protein, 12 aa, Entamoeba invadens
DTFGDAETTNEY

SEQ ID NO: 2847645 - protein, 10 aa, Entamoeba invadens
DTFIRDGENL

SEQ ID NO: 2847646 - protein, 8 aa, Entamoeba invadens
DTFKPKTI

SEQ ID NO: 2847647 - protein, 4 aa, Entamoeba invadens
DTFN

SEQ ID NO: 2847648 - protein, 5 aa, Entamoeba invadens
DTFNQ

SEQ ID NO: 2847649 - protein, 20 aa, Entamoeba invadens
DTFNTNDTSPLKSPLATESG

SEQ ID NO: 2847650 - protein, 10 aa, Entamoeba invadens
DTFPKTQQTI

SEQ ID NO: 2847651 - protein, 4 aa, Entamoeba invadens
DTFS

SEQ ID NO: 2847652 - protein, 7 aa, Entamoeba invadens
DTFSDQI

SEQ ID NO: 2847653 - protein, 12 aa, Entamoeba invadens
DTFSKDDSLGNA

SEQ ID NO: 2847654 - protein, 21 aa, Entamoeba invadens
DTFSSSKRASWVERRSIGYHA

SEQ ID NO: 2847655 - protein, 7 aa, Entamoeba invadens
DTGAQSA

SEQ ID NO: 2847656 - protein, 9 aa, Entamoeba invadens
DTGAQSATL

SEQ ID NO: 2847657 - protein, 9 aa, Entamoeba invadens
DTGENDPNR

SEQ ID NO: 2847658 - protein, 25 aa, Entamoeba invadens
DTGKDDADAKKTMSAEAKKKIEEKK

SEQ ID NO: 2847659 - protein, 8 aa, Entamoeba invadens
DTGKKYPF

SEQ ID NO: 2847660 - protein, 11 aa, Entamoeba invadens
DTGKNDPKRSC

SEQ ID NO: 2847661 - protein, 6 aa, Entamoeba invadens
DTGKTK

SEQ ID NO: 2847662 - protein, 6 aa, Entamoeba invadens
DTGNYL

SEQ ID NO: 2847663 - protein, 13 aa, Entamoeba invadens
DTGRKTNDERRKT

SEQ ID NO: 2847664 - protein, 10 aa, Entamoeba invadens
DTGRSVDPTQ

SEQ ID NO: 2847665 - protein, 23 aa, Entamoeba invadens
DTGYRGAKNGITTWPYPSEPRRH

SEQ ID NO: 2847666 - protein, 11 aa, Entamoeba invadens
DTHDEARRLAP

SEQ ID NO: 2847667 - protein, 10 aa, Entamoeba invadens
DTHDKRGDEK

SEQ ID NO: 2847668 - protein, 4 aa, Entamoeba invadens
DTHE

SEQ ID NO: 2847669 - protein, 5 aa, Entamoeba invadens
DTHEG

SEQ ID NO: 2847670 - protein, 4 aa, Entamoeba invadens
DTHK

SEQ ID NO: 2847671 - protein, 7 aa, Entamoeba invadens
DTHKDNK

SEQ ID NO: 2847672 - protein, 5 aa, Entamoeba invadens
DTHPT

SEQ ID NO: 2847673 - protein, 18 aa, Entamoeba invadens
DTIATAKEEVVAGEQVNC

SEQ ID NO: 2847674 - protein, 5 aa, Entamoeba invadens
DTIDE

SEQ ID NO: 2847675 - protein, 14 aa, Entamoeba invadens
DTIDEKNGSLKENE

SEQ ID NO: 2847676 - protein, 6 aa, Entamoeba invadens
DTIDTS

SEQ ID NO: 2847677 - protein, 4 aa, Entamoeba invadens
DTIE

SEQ ID NO: 2847678 - protein, 13 aa, Entamoeba invadens
DTIKGEQTSDTLS

SEQ ID NO: 2847679 - protein, 13 aa, Entamoeba invadens
DTIKQKTGERPDP

SEQ ID NO: 2847680 - protein, 6 aa, Entamoeba invadens
DTINNS

SEQ ID NO: 2847681 - protein, 16 aa, Entamoeba invadens
DTINTYTNTQRESFDA

SEQ ID NO: 2847682 - protein, 8 aa, Entamoeba invadens
DTIPESDV

SEQ ID NO: 2847683 - protein, 10 aa, Entamoeba invadens
DTIPSDIPQR

SEQ ID NO: 2847684 - protein, 7 aa, Entamoeba invadens
DTIRSST

SEQ ID NO: 2847685 - protein, 6 aa, Entamoeba invadens
DTISNI

SEQ ID NO: 2847686 - protein, 8 aa, Entamoeba invadens
DTISPPEL

SEQ ID NO: 2847687 - protein, 10 aa, Entamoeba invadens
DTITKTVSPA

SEQ ID NO: 2847688 - protein, 10 aa, Entamoeba invadens
DTITPTHKLS

SEQ ID NO: 2847689 - protein, 4 aa, Entamoeba invadens
DTKA

SEQ ID NO: 2847690 - protein, 8 aa, Entamoeba invadens
DTKAEKQI

SEQ ID NO: 2847691 - protein, 10 aa, Entamoeba invadens
DTKANKQNVI

SEQ ID NO: 2847692 - protein, 16 aa, Entamoeba invadens
DTKDKRRYNLPTTSEV

SEQ ID NO: 2847693 - protein, 15 aa, Entamoeba invadens
DTKDMKKKVEATPND

SEQ ID NO: 2847694 - protein, 113 aa, Entamoeba invadens
DTKDNEQPNDTKEGEKDDLEEKEKVKSIEKRAGIQTEKKQKSSKEKKRKSLKIEETSKSQKCSTPLKKEEDIQKSRSKTPPLASSNPNPSTIDDTENSKRNSNGNSTTSSSSL

SEQ ID NO: 2847695 - protein, 73 aa, Entamoeba invadens
DTKDNEQPNDTKEGEKDDLEEKEKVKSIQKRAGIQTEKKQKSSKEKKRKSLKIEETSKSHKCSTSLKKRRRHS

SEQ ID NO: 2847696 - protein, 73 aa, Entamoeba invadens
DTKDNEQPNDTKEGEKDDLKEKEKVKSIEKRAGIQTEKKQKSSKEKKRKSLKIEQTSKSHKCSTSLKKRRRHS

SEQ ID NO: 2847697 - protein, 11 aa, Entamoeba invadens
DTKDQKDSKLE

SEQ ID NO: 2847698 - protein, 6 aa, Entamoeba invadens
DTKDVG

SEQ ID NO: 2847699 - protein, 8 aa, Entamoeba invadens
DTKEANMK

SEQ ID NO: 2847700 - protein, 7 aa, Entamoeba invadens
DTKEEKL

SEQ ID NO: 2847701 - protein, 6 aa, Entamoeba invadens
DTKEKM

SEQ ID NO: 2847702 - protein, 10 aa, Entamoeba invadens
DTKEKSFKTT

SEQ ID NO: 2847703 - protein, 8 aa, Entamoeba invadens
DTKESGSL

SEQ ID NO: 2847704 - protein, 7 aa, Entamoeba invadens
DTKFHRD

SEQ ID NO: 2847705 - protein, 17 aa, Entamoeba invadens
DTKFPRKTQQSNTQAET

SEQ ID NO: 2847706 - protein, 7 aa, Entamoeba invadens
DTKGRVT

SEQ ID NO: 2847707 - protein, 12 aa, Entamoeba invadens
DTKGSALTNSTY

SEQ ID NO: 2847708 - protein, 4 aa, Entamoeba invadens
DTKH

SEQ ID NO: 2847709 - protein, 6 aa, Entamoeba invadens
DTKHQL

SEQ ID NO: 2847710 - protein, 14 aa, Entamoeba invadens
DTKKCEKTDDHTRL

SEQ ID NO: 2847711 - protein, 9 aa, Entamoeba invadens
DTKKDGKID

SEQ ID NO: 2847712 - protein, 15 aa, Entamoeba invadens
DTKKQADKLMESSDG

SEQ ID NO: 2847713 - protein, 18 aa, Entamoeba invadens
DTKKRGNRTSPFSFDSSA

SEQ ID NO: 2847714 - protein, 8 aa, Entamoeba invadens
DTKLDPDA

SEQ ID NO: 2847715 - protein, 6 aa, Entamoeba invadens
DTKMEQ

SEQ ID NO: 2847716 - protein, 12 aa, Entamoeba invadens
DTKNAIKEVKEV

SEQ ID NO: 2847717 - protein, 12 aa, Entamoeba invadens
DTKNGTKEVKRV

SEQ ID NO: 2847718 - protein, 5 aa, Entamoeba invadens
DTKNI

SEQ ID NO: 2847719 - protein, 16 aa, Entamoeba invadens
DTKNKTKGRGQKYTWD

SEQ ID NO: 2847720 - protein, 8 aa, Entamoeba invadens
DTKNPTKV

SEQ ID NO: 2847721 - protein, 6 aa, Entamoeba invadens
DTKNSF

SEQ ID NO: 2847722 - protein, 4 aa, Entamoeba invadens
DTKP

SEQ ID NO: 2847723 - protein, 11 aa, Entamoeba invadens
DTKPPIAPKDV

SEQ ID NO: 2847724 - protein, 11 aa, Entamoeba invadens
DTKPSKGLFPE

SEQ ID NO: 2847725 - protein, 7 aa, Entamoeba invadens
DTKPSLQ

SEQ ID NO: 2847726 - protein, 8 aa, Entamoeba invadens
DTKPYYRT

SEQ ID NO: 2847727 - protein, 15 aa, Entamoeba invadens
DTKQGTTFGEKTKSV

SEQ ID NO: 2847728 - protein, 11 aa, Entamoeba invadens
DTKQNARRAEH

SEQ ID NO: 2847729 - protein, 8 aa, Entamoeba invadens
DTKRGKED

SEQ ID NO: 2847730 - protein, 8 aa, Entamoeba invadens
DTKRREPY

SEQ ID NO: 2847731 - protein, 9 aa, Entamoeba invadens
DTKRSPREI

SEQ ID NO: 2847732 - protein, 6 aa, Entamoeba invadens
DTKSFD

SEQ ID NO: 2847733 - protein, 10 aa, Entamoeba invadens
DTKSSQEKLP

SEQ ID NO: 2847734 - protein, 26 aa, Entamoeba invadens
DTKSTESISCTTDNLQPDKTCKPNFP

SEQ ID NO: 2847735 - protein, 7 aa, Entamoeba invadens
DTKTEIG

SEQ ID NO: 2847736 - protein, 20 aa, Entamoeba invadens
DTKTNQITSVKGNSCPRGDA

SEQ ID NO: 2847737 - protein, 16 aa, Entamoeba invadens
DTKTTTGNKSNVKETV

SEQ ID NO: 2847738 - protein, 15 aa, Entamoeba invadens
DTKTVCTKKAQEGFR

SEQ ID NO: 2847739 - protein, 6 aa, Entamoeba invadens
DTKVDS

SEQ ID NO: 2847740 - protein, 6 aa, Entamoeba invadens
DTKVTG

SEQ ID NO: 2847741 - protein, 8 aa, Entamoeba invadens
DTKVTSKV

SEQ ID NO: 2847742 - protein, 5 aa, Entamoeba invadens
DTLEE

SEQ ID NO: 2847743 - protein, 10 aa, Entamoeba invadens
DTLEEDKKPT

SEQ ID NO: 2847744 - protein, 6 aa, Entamoeba invadens
DTLEPK

SEQ ID NO: 2847745 - protein, 19 aa, Entamoeba invadens
DTLGKPPSTTPIDGSNDRV

SEQ ID NO: 2847746 - protein, 12 aa, Entamoeba invadens
DTLGSKSACLSA

SEQ ID NO: 2847747 - protein, 13 aa, Entamoeba invadens
DTLKGTTINPDVN

SEQ ID NO: 2847748 - protein, 10 aa, Entamoeba invadens
DTLKSGAKRV

SEQ ID NO: 2847749 - protein, 9 aa, Entamoeba invadens
DTLNNEKSQ

SEQ ID NO: 2847750 - protein, 21 aa, Entamoeba invadens
DTLPERKIPDLPAEHTKASVA

SEQ ID NO: 2847751 - protein, 7 aa, Entamoeba invadens
DTLPNIS

SEQ ID NO: 2847752 - protein, 6 aa, Entamoeba invadens
DTLPNT

SEQ ID NO: 2847753 - protein, 8 aa, Entamoeba invadens
DTLPSKQE

SEQ ID NO: 2847754 - protein, 6 aa, Entamoeba invadens
DTLPSQ

SEQ ID NO: 2847755 - protein, 5 aa, Entamoeba invadens
DTLPT

SEQ ID NO: 2847756 - protein, 19 aa, Entamoeba invadens
DTLREANRRKKERAKNSEC

SEQ ID NO: 2847757 - protein, 14 aa, Entamoeba invadens
DTLRKETKKSVGKP

SEQ ID NO: 2847758 - protein, 10 aa, Entamoeba invadens
DTLSGKVDER

SEQ ID NO: 2847759 - protein, 10 aa, Entamoeba invadens
DTLSKEQSHV

SEQ ID NO: 2847760 - protein, 5 aa, Entamoeba invadens
DTLST

SEQ ID NO: 2847761 - protein, 7 aa, Entamoeba invadens
DTLTEDK

SEQ ID NO: 2847762 - protein, 5 aa, Entamoeba invadens
DTLTQ

SEQ ID NO: 2847763 - protein, 6 aa, Entamoeba invadens
DTMKEN

SEQ ID NO: 2847764 - protein, 13 aa, Entamoeba invadens
DTMPDSPGRNRIA

SEQ ID NO: 2847765 - protein, 10 aa, Entamoeba invadens
DTNATNEISS

SEQ ID NO: 2847766 - protein, 4 aa, Entamoeba invadens
DTNC

SEQ ID NO: 2847767 - protein, 12 aa, Entamoeba invadens
DTNCAKGKKKDI

SEQ ID NO: 2847768 - protein, 5 aa, Entamoeba invadens
DTNDD

SEQ ID NO: 2847769 - protein, 8 aa, Entamoeba invadens
DTNDDTLE

SEQ ID NO: 2847770 - protein, 7 aa, Entamoeba invadens
DTNDNGM

SEQ ID NO: 2847771 - protein, 5 aa, Entamoeba invadens
DTNDV

SEQ ID NO: 2847772 - protein, 7 aa, Entamoeba invadens
DTNERTV

SEQ ID NO: 2847773 - protein, 4 aa, Entamoeba invadens
DTNG

SEQ ID NO: 2847774 - protein, 5 aa, Entamoeba invadens
DTNGI

SEQ ID NO: 2847775 - protein, 8 aa, Entamoeba invadens
DTNGNRFG

SEQ ID NO: 2847776 - protein, 4 aa, Entamoeba invadens
DTNH

SEQ ID NO: 2847777 - protein, 7 aa, Entamoeba invadens
DTNHKQT

SEQ ID NO: 2847778 - protein, 11 aa, Entamoeba invadens
DTNHNNKVDEK

SEQ ID NO: 2847779 - protein, 6 aa, Entamoeba invadens
DTNKAN

SEQ ID NO: 2847780 - protein, 7 aa, Entamoeba invadens
DTNKDGV

SEQ ID NO: 2847781 - protein, 6 aa, Entamoeba invadens
DTNKDN

SEQ ID NO: 2847782 - protein, 10 aa, Entamoeba invadens
DTNKGVEDEV

SEQ ID NO: 2847783 - protein, 13 aa, Entamoeba invadens
DTNKTGKVNADEY

SEQ ID NO: 2847784 - protein, 10 aa, Entamoeba invadens
DTNKYKNKSL

SEQ ID NO: 2847785 - protein, 15 aa, Entamoeba invadens
DTNNDLSEEEKSKIG

SEQ ID NO: 2847786 - protein, 13 aa, Entamoeba invadens
DTNNSGKLNKKEF

SEQ ID NO: 2847787 - protein, 5 aa, Entamoeba invadens
DTNPD

SEQ ID NO: 2847788 - protein, 9 aa, Entamoeba invadens
DTNPEKETH

SEQ ID NO: 2847789 - protein, 8 aa, Entamoeba invadens
DTNQEDRI

SEQ ID NO: 2847790 - protein, 5 aa, Entamoeba invadens
DTNQH

SEQ ID NO: 2847791 - protein, 5 aa, Entamoeba invadens
DTNRE

SEQ ID NO: 2847792 - protein, 10 aa, Entamoeba invadens
DTNRSGTMEP

SEQ ID NO: 2847793 - protein, 8 aa, Entamoeba invadens
DTNSYENI

SEQ ID NO: 2847794 - protein, 9 aa, Entamoeba invadens
DTNTGKTVT

SEQ ID NO: 2847795 - protein, 5 aa, Entamoeba invadens
DTNTI

SEQ ID NO: 2847796 - protein, 5 aa, Entamoeba invadens
DTNTP

SEQ ID NO: 2847797 - protein, 6 aa, Entamoeba invadens
DTNTTN

SEQ ID NO: 2847798 - protein, 21 aa, Entamoeba invadens
DTNVNQNTVVQQQTSQPIGTA

SEQ ID NO: 2847799 - protein, 14 aa, Entamoeba invadens
DTNVPKKPTGEPVP

SEQ ID NO: 2847800 - protein, 9 aa, Entamoeba invadens
DTNVSQDTK

SEQ ID NO: 2847801 - protein, 12 aa, Entamoeba invadens
DTNYSENPYNAN

SEQ ID NO: 2847802 - protein, 12 aa, Entamoeba invadens
DTPAGTVTTDTA

SEQ ID NO: 2847803 - protein, 8 aa, Entamoeba invadens
DTPASTTK

SEQ ID NO: 2847804 - protein, 7 aa, Entamoeba invadens
DTPDDIN

SEQ ID NO: 2847805 - protein, 22 aa, Entamoeba invadens
DTPDYDTGKATLTYGDGDGTVN

SEQ ID NO: 2847806 - protein, 7 aa, Entamoeba invadens
DTPEKEI

SEQ ID NO: 2847807 - protein, 16 aa, Entamoeba invadens
DTPENQETDLKEISGT

SEQ ID NO: 2847808 - protein, 5 aa, Entamoeba invadens
DTPFT

SEQ ID NO: 2847809 - protein, 21 aa, Entamoeba invadens
DTPGDKTLKDIKDKLKEEGYD

SEQ ID NO: 2847810 - protein, 11 aa, Entamoeba invadens
DTPGEAEDDDV

SEQ ID NO: 2847811 - protein, 5 aa, Entamoeba invadens
DTPGH

SEQ ID NO: 2847812 - protein, 8 aa, Entamoeba invadens
DTPGRKKY

SEQ ID NO: 2847813 - protein, 7 aa, Entamoeba invadens
DTPGYAI

SEQ ID NO: 2847814 - protein, 9 aa, Entamoeba invadens
DTPGYKDQP

SEQ ID NO: 2847815 - protein, 9 aa, Entamoeba invadens
DTPHDNTFK

SEQ ID NO: 2847816 - protein, 6 aa, Entamoeba invadens
DTPIIS

SEQ ID NO: 2847817 - protein, 9 aa, Entamoeba invadens
DTPISRGSA

SEQ ID NO: 2847818 - protein, 4 aa, Entamoeba invadens
DTPK

SEQ ID NO: 2847819 - protein, 10 aa, Entamoeba invadens
DTPKKARTAI

SEQ ID NO: 2847820 - protein, 12 aa, Entamoeba invadens
DTPKKRVKEIPG

SEQ ID NO: 2847821 - protein, 4 aa, Entamoeba invadens
DTPL

SEQ ID NO: 2847822 - protein, 9 aa, Entamoeba invadens
DTPLGSVTA

SEQ ID NO: 2847823 - protein, 7 aa, Entamoeba invadens
DTPLPNK

SEQ ID NO: 2847824 - protein, 6 aa, Entamoeba invadens
DTPMPG

SEQ ID NO: 2847825 - protein, 6 aa, Entamoeba invadens
DTPMTS

SEQ ID NO: 2847826 - protein, 5 aa, Entamoeba invadens
DTPPI

SEQ ID NO: 2847827 - protein, 8 aa, Entamoeba invadens
DTPPRGEV

SEQ ID NO: 2847828 - protein, 14 aa, Entamoeba invadens
DTPPSGDGNTQDNN

SEQ ID NO: 2847829 - protein, 6 aa, Entamoeba invadens
DTPQKT

SEQ ID NO: 2847830 - protein, 7 aa, Entamoeba invadens
DTPQPNV

SEQ ID NO: 2847831 - protein, 5 aa, Entamoeba invadens
DTPQR

SEQ ID NO: 2847832 - protein, 12 aa, Entamoeba invadens
DTPRELEEGEKN

SEQ ID NO: 2847833 - protein, 5 aa, Entamoeba invadens
DTPRI

SEQ ID NO: 2847834 - protein, 7 aa, Entamoeba invadens
DTPRKEA

SEQ ID NO: 2847835 - protein, 5 aa, Entamoeba invadens
DTPRM

SEQ ID NO: 2847836 - protein, 6 aa, Entamoeba invadens
DTPSFS

SEQ ID NO: 2847837 - protein, 9 aa, Entamoeba invadens
DTPSKEDIE

SEQ ID NO: 2847838 - protein, 6 aa, Entamoeba invadens
DTPSKK

SEQ ID NO: 2847839 - protein, 4 aa, Entamoeba invadens
DTPT

SEQ ID NO: 2847840 - protein, 12 aa, Entamoeba invadens
DTPTETDKQRFA

SEQ ID NO: 2847841 - protein, 6 aa, Entamoeba invadens
DTPTFR

SEQ ID NO: 2847842 - protein, 10 aa, Entamoeba invadens
DTPTKSDNLR

SEQ ID NO: 2847843 - protein, 15 aa, Entamoeba invadens
DTPTLKKTASIQKPK

SEQ ID NO: 2847844 - protein, 5 aa, Entamoeba invadens
DTPTS

SEQ ID NO: 2847845 - protein, 6 aa, Entamoeba invadens
DTPTSF

SEQ ID NO: 2847846 - protein, 7 aa, Entamoeba invadens
DTPVQEK

SEQ ID NO: 2847847 - protein, 6 aa, Entamoeba invadens
DTPVRA

SEQ ID NO: 2847848 - protein, 5 aa, Entamoeba invadens
DTPVV

SEQ ID NO: 2847849 - protein, 7 aa, Entamoeba invadens
DTPYEKK

SEQ ID NO: 2847850 - protein, 16 aa, Entamoeba invadens
DTQAKRRTVAQNEVTT

SEQ ID NO: 2847851 - protein, 19 aa, Entamoeba invadens
DTQAPAARASETAKDEAYE

SEQ ID NO: 2847852 - protein, 4 aa, Entamoeba invadens
DTQD

SEQ ID NO: 2847853 - protein, 6 aa, Entamoeba invadens
DTQDEL

SEQ ID NO: 2847854 - protein, 5 aa, Entamoeba invadens
DTQDV

SEQ ID NO: 2847855 - protein, 7 aa, Entamoeba invadens
DTQEGIK

SEQ ID NO: 2847856 - protein, 7 aa, Entamoeba invadens
DTQESLD

SEQ ID NO: 2847857 - protein, 9 aa, Entamoeba invadens
DTQGQKPTK

SEQ ID NO: 2847858 - protein, 5 aa, Entamoeba invadens
DTQHT

SEQ ID NO: 2847859 - protein, 8 aa, Entamoeba invadens
DTQIQTEL

SEQ ID NO: 2847860 - protein, 9 aa, Entamoeba invadens
DTQKGQKQL

SEQ ID NO: 2847861 - protein, 20 aa, Entamoeba invadens
DTQKHSKRAYSQSPSPNHFN

SEQ ID NO: 2847862 - protein, 15 aa, Entamoeba invadens
DTQKQELSDSIKSSE

SEQ ID NO: 2847863 - protein, 16 aa, Entamoeba invadens
DTQKVKEPPNLSTEQT

SEQ ID NO: 2847864 - protein, 8 aa, Entamoeba invadens
DTQLTTRR

SEQ ID NO: 2847865 - protein, 8 aa, Entamoeba invadens
DTQPPQHF

SEQ ID NO: 2847866 - protein, 28 aa, Entamoeba invadens
DTQQETKDKDTISSIEKNENDNKEAFEK

SEQ ID NO: 2847867 - protein, 7 aa, Entamoeba invadens
DTQQNLR

SEQ ID NO: 2847868 - protein, 4 aa, Entamoeba invadens
DTQR

SEQ ID NO: 2847869 - protein, 6 aa, Entamoeba invadens
DTQRTK

SEQ ID NO: 2847870 - protein, 29 aa, Entamoeba invadens
DTQSEKSERKVDALPQETVEKPNQNTTKI

SEQ ID NO: 2847871 - protein, 17 aa, Entamoeba invadens
DTQSSSKSTQTPSTPGQ

SEQ ID NO: 2847872 - protein, 10 aa, Entamoeba invadens
DTQTDEVTNN

SEQ ID NO: 2847873 - protein, 7 aa, Entamoeba invadens
DTQTSYN

SEQ ID NO: 2847874 - protein, 6 aa, Entamoeba invadens
DTQVGK

SEQ ID NO: 2847875 - protein, 5 aa, Entamoeba invadens
DTQYE

SEQ ID NO: 2847876 - protein, 9 aa, Entamoeba invadens
DTQYQTDEL

SEQ ID NO: 2847877 - protein, 40 aa, Entamoeba invadens
DTREFTEKYTKPTEEVVKKPSEAEATQTWDEEGLSPRRRK

SEQ ID NO: 2847878 - protein, 9 aa, Entamoeba invadens
DTREGLSEE

SEQ ID NO: 2847879 - protein, 5 aa, Entamoeba invadens
DTRGQ

SEQ ID NO: 2847880 - protein, 4 aa, Entamoeba invadens
DTRI

SEQ ID NO: 2847881 - protein, 4 aa, Entamoeba invadens
DTRK

SEQ ID NO: 2847882 - protein, 6 aa, Entamoeba invadens
DTRKKD

SEQ ID NO: 2847883 - protein, 10 aa, Entamoeba invadens
DTRKKEVSTQ

SEQ ID NO: 2847884 - protein, 5 aa, Entamoeba invadens
DTRNK

SEQ ID NO: 2847885 - protein, 8 aa, Entamoeba invadens
DTRNSPTM

SEQ ID NO: 2847886 - protein, 13 aa, Entamoeba invadens
DTRPDDFTGLSTS

SEQ ID NO: 2847887 - protein, 13 aa, Entamoeba invadens
DTRRENNTTFSKE

SEQ ID NO: 2847888 - protein, 5 aa, Entamoeba invadens
DTRRR

SEQ ID NO: 2847889 - protein, 9 aa, Entamoeba invadens
DTRSFKERT

SEQ ID NO: 2847890 - protein, 6 aa, Entamoeba invadens
DTRSGR

SEQ ID NO: 2847891 - protein, 7 aa, Entamoeba invadens
DTRSKSF

SEQ ID NO: 2847892 - protein, 6 aa, Entamoeba invadens
DTRSSM

SEQ ID NO: 2847893 - protein, 10 aa, Entamoeba invadens
DTRTNGQGVR

SEQ ID NO: 2847894 - protein, 9 aa, Entamoeba invadens
DTRTTTNQI

SEQ ID NO: 2847895 - protein, 6 aa, Entamoeba invadens
DTSDES

SEQ ID NO: 2847896 - protein, 9 aa, Entamoeba invadens
DTSDGSGIP

SEQ ID NO: 2847897 - protein, 7 aa, Entamoeba invadens
DTSDGTG

SEQ ID NO: 2847898 - protein, 9 aa, Entamoeba invadens
DTSDSTISR

SEQ ID NO: 2847899 - protein, 5 aa, Entamoeba invadens
DTSDV

SEQ ID NO: 2847900 - protein, 9 aa, Entamoeba invadens
DTSEDKETI

SEQ ID NO: 2847901 - protein, 11 aa, Entamoeba invadens
DTSEDRNTHYK

SEQ ID NO: 2847902 - protein, 9 aa, Entamoeba invadens
DTSEEVSGH

SEQ ID NO: 2847903 - protein, 9 aa, Entamoeba invadens
DTSELSQTP

SEQ ID NO: 2847904 - protein, 10 aa, Entamoeba invadens
DTSENSGNNF

SEQ ID NO: 2847905 - protein, 10 aa, Entamoeba invadens
DTSEPNSRKK

SEQ ID NO: 2847906 - protein, 8 aa, Entamoeba invadens
DTSETSAT

SEQ ID NO: 2847907 - protein, 4 aa, Entamoeba invadens
DTSF

SEQ ID NO: 2847908 - protein, 6 aa, Entamoeba invadens
DTSGNI

SEQ ID NO: 2847909 - protein, 9 aa, Entamoeba invadens
DTSGSDPNE

SEQ ID NO: 2847910 - protein, 4 aa, Entamoeba invadens
DTSH

SEQ ID NO: 2847911 - protein, 9 aa, Entamoeba invadens
DTSHKGTLE

SEQ ID NO: 2847912 - protein, 7 aa, Entamoeba invadens
DTSIEKR

SEQ ID NO: 2847913 - protein, 11 aa, Entamoeba invadens
DTSIKSRGTTS

SEQ ID NO: 2847914 - protein, 4 aa, Entamoeba invadens
DTSK

SEQ ID NO: 2847915 - protein, 8 aa, Entamoeba invadens
DTSKHTKA

SEQ ID NO: 2847916 - protein, 18 aa, Entamoeba invadens
DTSKQHEKSLKKTTRRKK

SEQ ID NO: 2847917 - protein, 5 aa, Entamoeba invadens
DTSLK

SEQ ID NO: 2847918 - protein, 9 aa, Entamoeba invadens
DTSLPPEDM

SEQ ID NO: 2847919 - protein, 15 aa, Entamoeba invadens
DTSMISQKGKTRGLP

SEQ ID NO: 2847920 - protein, 6 aa, Entamoeba invadens
DTSNLD

SEQ ID NO: 2847921 - protein, 5 aa, Entamoeba invadens
DTSNP

SEQ ID NO: 2847922 - protein, 6 aa, Entamoeba invadens
DTSPDE

SEQ ID NO: 2847923 - protein, 22 aa, Entamoeba invadens
DTSPSLTPKMSSSQKNSPKQSK

SEQ ID NO: 2847924 - protein, 7 aa, Entamoeba invadens
DTSPTYS

SEQ ID NO: 2847925 - protein, 5 aa, Entamoeba invadens
DTSQK

SEQ ID NO: 2847926 - protein, 13 aa, Entamoeba invadens
DTSQLGFRLLQHG

SEQ ID NO: 2847927 - protein, 21 aa, Entamoeba invadens
DTSRKQQKQEDKIKKKSESFK

SEQ ID NO: 2847928 - protein, 21 aa, Entamoeba invadens
DTSRTERNERKERNEVRRTEY

SEQ ID NO: 2847929 - protein, 6 aa, Entamoeba invadens
DTSSAA

SEQ ID NO: 2847930 - protein, 10 aa, Entamoeba invadens
DTSSFEDAAS

SEQ ID NO: 2847931 - protein, 5 aa, Entamoeba invadens
DTSSK

SEQ ID NO: 2847932 - protein, 22 aa, Entamoeba invadens
DTSSNGTQFNGADIGKNNKVEI

SEQ ID NO: 2847933 - protein, 8 aa, Entamoeba invadens
DTSSPIPK

SEQ ID NO: 2847934 - protein, 13 aa, Entamoeba invadens
DTSSSSQDNEEST

SEQ ID NO: 2847935 - protein, 5 aa, Entamoeba invadens
DTSSV

SEQ ID NO: 2847936 - protein, 9 aa, Entamoeba invadens
DTSTNGTCV

SEQ ID NO: 2847937 - protein, 7 aa, Entamoeba invadens
DTSVESR

SEQ ID NO: 2847938 - protein, 9 aa, Entamoeba invadens
DTSVSSDNI

SEQ ID NO: 2847939 - protein, 8 aa, Entamoeba invadens
DTTADETI

SEQ ID NO: 2847940 - protein, 5 aa, Entamoeba invadens
DTTAS

SEQ ID NO: 2847941 - protein, 13 aa, Entamoeba invadens
DTTCENPSEISED

SEQ ID NO: 2847942 - protein, 4 aa, Entamoeba invadens
DTTD

SEQ ID NO: 2847943 - protein, 11 aa, Entamoeba invadens
DTTDECTQTPY

SEQ ID NO: 2847944 - protein, 5 aa, Entamoeba invadens
DTTDG

SEQ ID NO: 2847945 - protein, 26 aa, Entamoeba invadens
DTTDPLSPRSPPPSSNDSPHSESFPK

SEQ ID NO: 2847946 - protein, 10 aa, Entamoeba invadens
DTTDQTNTTI

SEQ ID NO: 2847947 - protein, 9 aa, Entamoeba invadens
DTTDTNNTF

SEQ ID NO: 2847948 - protein, 12 aa, Entamoeba invadens
DTTEANARNNGF

SEQ ID NO: 2847949 - protein, 14 aa, Entamoeba invadens
DTTEDIIPVNTVWT

SEQ ID NO: 2847950 - protein, 20 aa, Entamoeba invadens
DTTEKTRPNIETAKSLSNEH

SEQ ID NO: 2847951 - protein, 9 aa, Entamoeba invadens
DTTELASQK

SEQ ID NO: 2847952 - protein, 8 aa, Entamoeba invadens
DTTEPEKL

SEQ ID NO: 2847953 - protein, 7 aa, Entamoeba invadens
DTTEPNK

SEQ ID NO: 2847954 - protein, 7 aa, Entamoeba invadens
DTTESGE

SEQ ID NO: 2847955 - protein, 8 aa, Entamoeba invadens
DTTETPNT

SEQ ID NO: 2847956 - protein, 16 aa, Entamoeba invadens
DTTEVQNEDTNPIDLT

SEQ ID NO: 2847957 - protein, 4 aa, Entamoeba invadens
DTTF

SEQ ID NO: 2847958 - protein, 7 aa, Entamoeba invadens
DTTGPVA

SEQ ID NO: 2847959 - protein, 8 aa, Entamoeba invadens
DTTGQEEY

SEQ ID NO: 2847960 - protein, 10 aa, Entamoeba invadens
DTTGQTDNDA

SEQ ID NO: 2847961 - protein, 11 aa, Entamoeba invadens
DTTHNKFSTQA

SEQ ID NO: 2847962 - protein, 9 aa, Entamoeba invadens
DTTHSDGNI

SEQ ID NO: 2847963 - protein, 8 aa, Entamoeba invadens
DTTKAAKQ

SEQ ID NO: 2847964 - protein, 10 aa, Entamoeba invadens
DTTKNKNTKI

SEQ ID NO: 2847965 - protein, 6 aa, Entamoeba invadens
DTTKSD

SEQ ID NO: 2847966 - protein, 10 aa, Entamoeba invadens
DTTKTAKQLL

SEQ ID NO: 2847967 - protein, 10 aa, Entamoeba invadens
DTTKTDENDE

SEQ ID NO: 2847968 - protein, 10 aa, Entamoeba invadens
DTTKYSRPSK

SEQ ID NO: 2847969 - protein, 4 aa, Entamoeba invadens
DTTL

SEQ ID NO: 2847970 - protein, 9 aa, Entamoeba invadens
DTTLDPTHQ

SEQ ID NO: 2847971 - protein, 5 aa, Entamoeba invadens
DTTMT

SEQ ID NO: 2847972 - protein, 8 aa, Entamoeba invadens
DTTNEINQ

SEQ ID NO: 2847973 - protein, 12 aa, Entamoeba invadens
DTTNEPSGDLTD

SEQ ID NO: 2847974 - protein, 10 aa, Entamoeba invadens
DTTPINPQDV

SEQ ID NO: 2847975 - protein, 6 aa, Entamoeba invadens
DTTPIT

SEQ ID NO: 2847976 - protein, 11 aa, Entamoeba invadens
DTTPKVSRPLT

SEQ ID NO: 2847977 - protein, 6 aa, Entamoeba invadens
DTTQKM

SEQ ID NO: 2847978 - protein, 5 aa, Entamoeba invadens
DTTQM

SEQ ID NO: 2847979 - protein, 7 aa, Entamoeba invadens
DTTQNEA

SEQ ID NO: 2847980 - protein, 11 aa, Entamoeba invadens
DTTQQTKETPI

SEQ ID NO: 2847981 - protein, 13 aa, Entamoeba invadens
DTTQYQETPSVSG

SEQ ID NO: 2847982 - protein, 13 aa, Entamoeba invadens
DTTRKSVITEKKN

SEQ ID NO: 2847983 - protein, 8 aa, Entamoeba invadens
DTTRVSNR

SEQ ID NO: 2847984 - protein, 9 aa, Entamoeba invadens
DTTRYTENY

SEQ ID NO: 2847985 - protein, 4 aa, Entamoeba invadens
DTTS

SEQ ID NO: 2847986 - protein, 7 aa, Entamoeba invadens
DTTSDTI

SEQ ID NO: 2847987 - protein, 6 aa, Entamoeba invadens
DTTSFS

SEQ ID NO: 2847988 - protein, 6 aa, Entamoeba invadens
DTTSIK

SEQ ID NO: 2847989 - protein, 5 aa, Entamoeba invadens
DTTSN

SEQ ID NO: 2847990 - protein, 9 aa, Entamoeba invadens
DTTSNTQKD

SEQ ID NO: 2847991 - protein, 6 aa, Entamoeba invadens
DTTSPC

SEQ ID NO: 2847992 - protein, 9 aa, Entamoeba invadens
DTTSRYPTG

SEQ ID NO: 2847993 - protein, 15 aa, Entamoeba invadens
DTTSTTCANKDKVDV

SEQ ID NO: 2847994 - protein, 5 aa, Entamoeba invadens
DTTSW

SEQ ID NO: 2847995 - protein, 5 aa, Entamoeba invadens
DTTSY

SEQ ID NO: 2847996 - protein, 7 aa, Entamoeba invadens
DTTTEDL

SEQ ID NO: 2847997 - protein, 9 aa, Entamoeba invadens
DTTTSTQDV

SEQ ID NO: 2847998 - protein, 34 aa, Entamoeba invadens
DTTVPKKTFSNKNQKAQETTQKLGITSSELQSAK

SEQ ID NO: 2847999 - protein, 12 aa, Entamoeba invadens
DTVATGTKDNSL

SEQ ID NO: 2848000 - protein, 7 aa, Entamoeba invadens
DTVGKGY

SEQ ID NO: 2848001 - protein, 5 aa, Entamoeba invadens
DTVGR

SEQ ID NO: 2848002 - protein, 7 aa, Entamoeba invadens
DTVGSDN

SEQ ID NO: 2848003 - protein, 5 aa, Entamoeba invadens
DTVKD

SEQ ID NO: 2848004 - protein, 6 aa, Entamoeba invadens
DTVKGN

SEQ ID NO: 2848005 - protein, 5 aa, Entamoeba invadens
DTVKN

SEQ ID NO: 2848006 - protein, 10 aa, Entamoeba invadens
DTVNGMSENY

SEQ ID NO: 2848007 - protein, 6 aa, Entamoeba invadens
DTVQST

SEQ ID NO: 2848008 - protein, 25 aa, Entamoeba invadens
DTVSQQDVKDPNLYQPEPNGQPEYT

SEQ ID NO: 2848009 - protein, 7 aa, Entamoeba invadens
DTVSTEV

SEQ ID NO: 2848010 - protein, 4 aa, Entamoeba invadens
DTVT

SEQ ID NO: 2848011 - protein, 53 aa, Entamoeba invadens
DTVTLPKEIDTTEKTVKSNKSEKLNDVKKAQKKLESISKSQKMQAKDPRALPD

SEQ ID NO: 2848012 - protein, 6 aa, Entamoeba invadens
DTVTSV

SEQ ID NO: 2848013 - protein, 6 aa, Entamoeba invadens
DTVYND

SEQ ID NO: 2848014 - protein, 8 aa, Entamoeba invadens
DTYDGLTQ

SEQ ID NO: 2848015 - protein, 7 aa, Entamoeba invadens
DTYENEL

SEQ ID NO: 2848016 - protein, 11 aa, Entamoeba invadens
DTYETKTTPFD

SEQ ID NO: 2848017 - protein, 10 aa, Entamoeba invadens
DTYGEEKYRE

SEQ ID NO: 2848018 - protein, 4 aa, Entamoeba invadens
DTYN

SEQ ID NO: 2848019 - protein, 11 aa, Entamoeba invadens
DTYNGKEQPTI

SEQ ID NO: 2848020 - protein, 8 aa, Entamoeba invadens
DTYNGQEG

SEQ ID NO: 2848021 - protein, 6 aa, Entamoeba invadens
DTYPGV

SEQ ID NO: 2848022 - protein, 11 aa, Entamoeba invadens
DTYQNNYYKQN

SEQ ID NO: 2848023 - protein, 5 aa, Entamoeba invadens
DTYSD

SEQ ID NO: 2848024 - protein, 6 aa, Entamoeba invadens
DTYTDT

SEQ ID NO: 2848025 - protein, 13 aa, Entamoeba invadens
DTYTNLKSNLEKY

SEQ ID NO: 2848026 - protein, 19 aa, Entamoeba invadens
DTYTPHSLRQTRSLSLGSK

SEQ ID NO: 2848027 - protein, 9 aa, Entamoeba invadens
DVAAGKRSS

SEQ ID NO: 2848028 - protein, 8 aa, Entamoeba invadens
DVAANNGF

SEQ ID NO: 2848029 - protein, 9 aa, Entamoeba invadens
DVADATVDR

SEQ ID NO: 2848030 - protein, 9 aa, Entamoeba invadens
DVAENEKQL

SEQ ID NO: 2848031 - protein, 9 aa, Entamoeba invadens
DVAGGYSPS

SEQ ID NO: 2848032 - protein, 12 aa, Entamoeba invadens
DVAGIKEELIAS

SEQ ID NO: 2848033 - protein, 8 aa, Entamoeba invadens
DVAGTRTS

SEQ ID NO: 2848034 - protein, 6 aa, Entamoeba invadens
DVAPEV

SEQ ID NO: 2848035 - protein, 5 aa, Entamoeba invadens
DVAPP

SEQ ID NO: 2848036 - protein, 7 aa, Entamoeba invadens
DVASGGN

SEQ ID NO: 2848037 - protein, 7 aa, Entamoeba invadens
DVASGKR

SEQ ID NO: 2848038 - protein, 10 aa, Entamoeba invadens
DVASGKRPCT

SEQ ID NO: 2848039 - protein, 13 aa, Entamoeba invadens
DVASGKRPNTIKT

SEQ ID NO: 2848040 - protein, 12 aa, Entamoeba invadens
DVASGKRPTTIK

SEQ ID NO: 2848041 - protein, 12 aa, Entamoeba invadens
DVASGKRPTTIN

SEQ ID NO: 2848042 - protein, 4 aa, Entamoeba invadens
DVCD

SEQ ID NO: 2848043 - protein, 47 aa, Entamoeba invadens
DVDAPGAVEVPQPPPDDKNKDDEDANCVEGAASEEGDDEEEDENREY

SEQ ID NO: 2848044 - protein, 5 aa, Entamoeba invadens
DVDDE

SEQ ID NO: 2848045 - protein, 21 aa, Entamoeba invadens
DVDDGDVEEKEEADNGPEGEY

SEQ ID NO: 2848046 - protein, 8 aa, Entamoeba invadens
DVDEKEQI

SEQ ID NO: 2848047 - protein, 7 aa, Entamoeba invadens
DVDEQFD

SEQ ID NO: 2848048 - protein, 7 aa, Entamoeba invadens
DVDESNP

SEQ ID NO: 2848049 - protein, 8 aa, Entamoeba invadens
DVDETNSW

SEQ ID NO: 2848050 - protein, 12 aa, Entamoeba invadens
DVDGEEEEPTVE

SEQ ID NO: 2848051 - protein, 6 aa, Entamoeba invadens
DVDGEK

SEQ ID NO: 2848052 - protein, 7 aa, Entamoeba invadens
DVDGETY

SEQ ID NO: 2848053 - protein, 9 aa, Entamoeba invadens
DVDGNNKVD

SEQ ID NO: 2848054 - protein, 6 aa, Entamoeba invadens
DVDGTC

SEQ ID NO: 2848055 - protein, 11 aa, Entamoeba invadens
DVDGYTKAQEE

SEQ ID NO: 2848056 - protein, 11 aa, Entamoeba invadens
DVDKDGNSLSD

SEQ ID NO: 2848057 - protein, 6 aa, Entamoeba invadens
DVDKKR

SEQ ID NO: 2848058 - protein, 6 aa, Entamoeba invadens
DVDKNS

SEQ ID NO: 2848059 - protein, 6 aa, Entamoeba invadens
DVDNQT

SEQ ID NO: 2848060 - protein, 9 aa, Entamoeba invadens
DVDNSGNTA

SEQ ID NO: 2848061 - protein, 7 aa, Entamoeba invadens
DVDPKEV

SEQ ID NO: 2848062 - protein, 5 aa, Entamoeba invadens
DVDPV

SEQ ID NO: 2848063 - protein, 39 aa, Entamoeba invadens
DVDQEEENIKMNQQKKSEEERAKKEKASKKEALDAEVQQ

SEQ ID NO: 2848064 - protein, 34 aa, Entamoeba invadens
DVDQPDDVCDDTSETSDDGDVEEKEEADNGPVGE

SEQ ID NO: 2848065 - protein, 13 aa, Entamoeba invadens
DVDSETLKALSTE

SEQ ID NO: 2848066 - protein, 8 aa, Entamoeba invadens
DVDSSEGI

SEQ ID NO: 2848067 - protein, 8 aa, Entamoeba invadens
DVDTAKSA

SEQ ID NO: 2848068 - protein, 5 aa, Entamoeba invadens
DVDTT

SEQ ID NO: 2848069 - protein, 16 aa, Entamoeba invadens
DVDYSSEENSEDQENV

SEQ ID NO: 2848070 - protein, 5 aa, Entamoeba invadens
DVEAL

SEQ ID NO: 2848071 - protein, 6 aa, Entamoeba invadens
DVEDTS

SEQ ID NO: 2848072 - protein, 24 aa, Entamoeba invadens
DVEEHTPTTDQNAMETEGNPTGKV

SEQ ID NO: 2848073 - protein, 13 aa, Entamoeba invadens
DVEGKSGRKREIN

SEQ ID NO: 2848074 - protein, 48 aa, Entamoeba invadens
DVEKEDEDEEKEDDDEDDTSDEEKIEKKENVEDEPKKVETKTKEAYGF

SEQ ID NO: 2848075 - protein, 12 aa, Entamoeba invadens
DVEKIEEWSGKK

SEQ ID NO: 2848076 - protein, 22 aa, Entamoeba invadens
DVEKLEKQDEKVENRKHKRRRD

SEQ ID NO: 2848077 - protein, 5 aa, Entamoeba invadens
DVELP

SEQ ID NO: 2848078 - protein, 10 aa, Entamoeba invadens
DVENKSRNEI

SEQ ID NO: 2848079 - protein, 8 aa, Entamoeba invadens
DVENTNDE

SEQ ID NO: 2848080 - protein, 18 aa, Entamoeba invadens
DVENYKNDLGRTKAELDQ

SEQ ID NO: 2848081 - protein, 47 aa, Entamoeba invadens
DVEPDEKPAEEVAEEAPKETEEKKEEAKPEEEIEGKKVPQKTQGSIP

SEQ ID NO: 2848082 - protein, 9 aa, Entamoeba invadens
DVEPEHNNT

SEQ ID NO: 2848083 - protein, 9 aa, Entamoeba invadens
DVEPPETKL

SEQ ID NO: 2848084 - protein, 16 aa, Entamoeba invadens
DVEPPKYSSYYETDSI

SEQ ID NO: 2848085 - protein, 4 aa, Entamoeba invadens
DVES

SEQ ID NO: 2848086 - protein, 8 aa, Entamoeba invadens
DVESDQPF

SEQ ID NO: 2848087 - protein, 6 aa, Entamoeba invadens
DVESEK

SEQ ID NO: 2848088 - protein, 4 aa, Entamoeba invadens
DVET

SEQ ID NO: 2848089 - protein, 8 aa, Entamoeba invadens
DVETETNG

SEQ ID NO: 2848090 - protein, 5 aa, Entamoeba invadens
DVETK

SEQ ID NO: 2848091 - protein, 13 aa, Entamoeba invadens
DVETPVDPENTKR

SEQ ID NO: 2848092 - protein, 6 aa, Entamoeba invadens
DVETSQ

SEQ ID NO: 2848093 - protein, 14 aa, Entamoeba invadens
DVETSQLEPNGKAL

SEQ ID NO: 2848094 - protein, 12 aa, Entamoeba invadens
DVEVETNAVNKE

SEQ ID NO: 2848095 - protein, 17 aa, Entamoeba invadens
DVFGNKKKSCFGVQWDT

SEQ ID NO: 2848096 - protein, 8 aa, Entamoeba invadens
DVFPENPE

SEQ ID NO: 2848097 - protein, 4 aa, Entamoeba invadens
DVGF

SEQ ID NO: 2848098 - protein, 9 aa, Entamoeba invadens
DVGGRTAGL

SEQ ID NO: 2848099 - protein, 5 aa, Entamoeba invadens
DVGKR

SEQ ID NO: 2848100 - protein, 6 aa, Entamoeba invadens
DVGNEV

SEQ ID NO: 2848101 - protein, 7 aa, Entamoeba invadens
DVGQPDD

SEQ ID NO: 2848102 - protein, 35 aa, Entamoeba invadens
DVGQPDDVCDDASDTSDDGDVEEKEEADKGPEGEY

SEQ ID NO: 2848103 - protein, 35 aa, Entamoeba invadens
DVGQPDDVCDDASDTSDDGDVEEKEEDDNGPEGEY

SEQ ID NO: 2848104 - protein, 35 aa, Entamoeba invadens
DVGQPDDVCDDASDTSDDGDVEEKEESENGPEGEY

SEQ ID NO: 2848105 - protein, 35 aa, Entamoeba invadens
DVGQPDDVCDDASDTSDDGDVEEKEKADNGPEGEY

SEQ ID NO: 2848106 - protein, 35 aa, Entamoeba invadens
DVGQPDDVCDDASDTSDDGEVEEKEEADNGPEGEY

SEQ ID NO: 2848107 - protein, 5 aa, Entamoeba invadens
DVGRA

SEQ ID NO: 2848108 - protein, 8 aa, Entamoeba invadens
DVGREAES

SEQ ID NO: 2848109 - protein, 5 aa, Entamoeba invadens
DVGRG

SEQ ID NO: 2848110 - protein, 10 aa, Entamoeba invadens
DVGRPKSEVA

SEQ ID NO: 2848111 - protein, 13 aa, Entamoeba invadens
DVGRYKGSMLIKY

SEQ ID NO: 2848112 - protein, 7 aa, Entamoeba invadens
DVGSALP

SEQ ID NO: 2848113 - protein, 4 aa, Entamoeba invadens
DVGT

SEQ ID NO: 2848114 - protein, 15 aa, Entamoeba invadens
DVGWKENAEHITDNQ

SEQ ID NO: 2848115 - protein, 11 aa, Entamoeba invadens
DVHEGGPNAGF

SEQ ID NO: 2848116 - protein, 8 aa, Entamoeba invadens
DVHERASK

SEQ ID NO: 2848117 - protein, 10 aa, Entamoeba invadens
DVIGPKASAQ

SEQ ID NO: 2848118 - protein, 5 aa, Entamoeba invadens
DVKDA

SEQ ID NO: 2848119 - protein, 8 aa, Entamoeba invadens
DVKDANSY

SEQ ID NO: 2848120 - protein, 8 aa, Entamoeba invadens
DVKEEKTE

SEQ ID NO: 2848121 - protein, 9 aa, Entamoeba invadens
DVKEKPKIN

SEQ ID NO: 2848122 - protein, 5 aa, Entamoeba invadens
DVKET

SEQ ID NO: 2848123 - protein, 18 aa, Entamoeba invadens
DVKFEDKREEMEKSRGDI

SEQ ID NO: 2848124 - protein, 15 aa, Entamoeba invadens
DVKGKEKYIVFNVIA

SEQ ID NO: 2848125 - protein, 6 aa, Entamoeba invadens
DVKHAS

SEQ ID NO: 2848126 - protein, 15 aa, Entamoeba invadens
DVKKRRSENARKNVE

SEQ ID NO: 2848127 - protein, 4 aa, Entamoeba invadens
DVKN

SEQ ID NO: 2848128 - protein, 16 aa, Entamoeba invadens
DVKNQSKTGYNTPQLT

SEQ ID NO: 2848129 - protein, 11 aa, Entamoeba invadens
DVKNRTRKQCR

SEQ ID NO: 2848130 - protein, 14 aa, Entamoeba invadens
DVKPEVKLDENGDV

SEQ ID NO: 2848131 - protein, 24 aa, Entamoeba invadens
DVKPNTEDLNEELNEEDEAEIERK

SEQ ID NO: 2848132 - protein, 18 aa, Entamoeba invadens
DVKQKSKCKKAQKKLNKC

SEQ ID NO: 2848133 - protein, 4 aa, Entamoeba invadens
DVKR

SEQ ID NO: 2848134 - protein, 16 aa, Entamoeba invadens
DVKSDEQRVDKKRHLG

SEQ ID NO: 2848135 - protein, 6 aa, Entamoeba invadens
DVKSDK

SEQ ID NO: 2848136 - protein, 10 aa, Entamoeba invadens
DVKSEKAFKS

SEQ ID NO: 2848137 - protein, 26 aa, Entamoeba invadens
DVKTGGAQQVEIGRKEQDKKKKACYL

SEQ ID NO: 2848138 - protein, 18 aa, Entamoeba invadens
DVKTGSTGKYSYTSHTNT

SEQ ID NO: 2848139 - protein, 9 aa, Entamoeba invadens
DVKYEDKKN

SEQ ID NO: 2848140 - protein, 26 aa, Entamoeba invadens
DVLESNSKLKNETDATEKTKTPSEIP

SEQ ID NO: 2848141 - protein, 7 aa, Entamoeba invadens
DVLNSEQ

SEQ ID NO: 2848142 - protein, 17 aa, Entamoeba invadens
DVNAAKKSSGKKVVSQE

SEQ ID NO: 2848143 - protein, 73 aa, Entamoeba invadens
DVNAQNEDSGAKVSDERDGYNQQLQAGKTKTAALTSAKNANDKKISALNSEKDELEDKNRKLDSSNKDAQRKI

SEQ ID NO: 2848144 - protein, 12 aa, Entamoeba invadens
DVNARNNKQNTA

SEQ ID NO: 2848145 - protein, 11 aa, Entamoeba invadens
DVNDESNNGYT

SEQ ID NO: 2848146 - protein, 13 aa, Entamoeba invadens
DVNDNAKKSNKQL

SEQ ID NO: 2848147 - protein, 7 aa, Entamoeba invadens
DVNEGDR

SEQ ID NO: 2848148 - protein, 6 aa, Entamoeba invadens
DVNEIA

SEQ ID NO: 2848149 - protein, 12 aa, Entamoeba invadens
DVNEKNAENETI

SEQ ID NO: 2848150 - protein, 19 aa, Entamoeba invadens
DVNGERCKMSGPSKQMSEE

SEQ ID NO: 2848151 - protein, 11 aa, Entamoeba invadens
DVNKEEATTMT

SEQ ID NO: 2848152 - protein, 9 aa, Entamoeba invadens
DVNKRKEVN

SEQ ID NO: 2848153 - protein, 8 aa, Entamoeba invadens
DVNNRTKA

SEQ ID NO: 2848154 - protein, 4 aa, Entamoeba invadens
DVNP

SEQ ID NO: 2848155 - protein, 8 aa, Entamoeba invadens
DVNPYNTN

SEQ ID NO: 2848156 - protein, 35 aa, Entamoeba invadens
DVNQPDDVCDDASDTSDDGDVEEKEEADNGPEGEY

SEQ ID NO: 2848157 - protein, 8 aa, Entamoeba invadens
DVNSAQTN

SEQ ID NO: 2848158 - protein, 10 aa, Entamoeba invadens
DVNSENIKKY

SEQ ID NO: 2848159 - protein, 7 aa, Entamoeba invadens
DVNSQQR

SEQ ID NO: 2848160 - protein, 7 aa, Entamoeba invadens
DVNTQQR

SEQ ID NO: 2848161 - protein, 4 aa, Entamoeba invadens
DVPD

SEQ ID NO: 2848162 - protein, 7 aa, Entamoeba invadens
DVPDTVT

SEQ ID NO: 2848163 - protein, 4 aa, Entamoeba invadens
DVPG

SEQ ID NO: 2848164 - protein, 27 aa, Entamoeba invadens
DVPKPQQTKPQPKAEHPKPQAPKDDLD

SEQ ID NO: 2848165 - protein, 12 aa, Entamoeba invadens
DVPKQKNGRDCG

SEQ ID NO: 2848166 - protein, 15 aa, Entamoeba invadens
DVPLGAGLSSSASIE

SEQ ID NO: 2848167 - protein, 4 aa, Entamoeba invadens
DVPN

SEQ ID NO: 2848168 - protein, 7 aa, Entamoeba invadens
DVPNAQQ

SEQ ID NO: 2848169 - protein, 24 aa, Entamoeba invadens
DVPPKYPDSFEDRPTIYRSSNRVK

SEQ ID NO: 2848170 - protein, 7 aa, Entamoeba invadens
DVPQEME

SEQ ID NO: 2848171 - protein, 8 aa, Entamoeba invadens
DVPQQPVQ

SEQ ID NO: 2848172 - protein, 10 aa, Entamoeba invadens
DVPSANAENH

SEQ ID NO: 2848173 - protein, 5 aa, Entamoeba invadens
DVPSE

SEQ ID NO: 2848174 - protein, 8 aa, Entamoeba invadens
DVPSGSGD

SEQ ID NO: 2848175 - protein, 13 aa, Entamoeba invadens
DVPSSSSKKKKHK

SEQ ID NO: 2848176 - protein, 4 aa, Entamoeba invadens
DVPT

SEQ ID NO: 2848177 - protein, 12 aa, Entamoeba invadens
DVPTKLPDLSST

SEQ ID NO: 2848178 - protein, 6 aa, Entamoeba invadens
DVPTKP

SEQ ID NO: 2848179 - protein, 13 aa, Entamoeba invadens
DVPTQADDTLKAP

SEQ ID NO: 2848180 - protein, 6 aa, Entamoeba invadens
DVPTTP

SEQ ID NO: 2848181 - protein, 8 aa, Entamoeba invadens
DVQDCTNN

SEQ ID NO: 2848182 - protein, 6 aa, Entamoeba invadens
DVQEEI

SEQ ID NO: 2848183 - protein, 23 aa, Entamoeba invadens
DVQEEKEEKVVDPKNEKTKEAPF

SEQ ID NO: 2848184 - protein, 8 aa, Entamoeba invadens
DVQERNGL

SEQ ID NO: 2848185 - protein, 6 aa, Entamoeba invadens
DVQESD

SEQ ID NO: 2848186 - protein, 7 aa, Entamoeba invadens
DVQGEPQ

SEQ ID NO: 2848187 - protein, 7 aa, Entamoeba invadens
DVQGGLE

SEQ ID NO: 2848188 - protein, 11 aa, Entamoeba invadens
DVQKELPPKKE

SEQ ID NO: 2848189 - protein, 14 aa, Entamoeba invadens
DVQKERKREGRGLF

SEQ ID NO: 2848190 - protein, 11 aa, Entamoeba invadens
DVQKKKVSGVT

SEQ ID NO: 2848191 - protein, 19 aa, Entamoeba invadens
DVQKTKKIEFTATSKLTTR

SEQ ID NO: 2848192 - protein, 9 aa, Entamoeba invadens
DVQKTPTPK

SEQ ID NO: 2848193 - protein, 12 aa, Entamoeba invadens
DVQKYGKDKARE

SEQ ID NO: 2848194 - protein, 8 aa, Entamoeba invadens
DVQMKDEK

SEQ ID NO: 2848195 - protein, 7 aa, Entamoeba invadens
DVQNSTN

SEQ ID NO: 2848196 - protein, 5 aa, Entamoeba invadens
DVQPI

SEQ ID NO: 2848197 - protein, 7 aa, Entamoeba invadens
DVQPISG

SEQ ID NO: 2848198 - protein, 8 aa, Entamoeba invadens
DVQPISGT

SEQ ID NO: 2848199 - protein, 8 aa, Entamoeba invadens
DVQQNHQS

SEQ ID NO: 2848200 - protein, 10 aa, Entamoeba invadens
DVQQQGNKGI

SEQ ID NO: 2848201 - protein, 48 aa, Entamoeba invadens
DVQRREKEVKEREGNLRQKEAEIEKRENDVKSSWNELKRNEENERKMS

SEQ ID NO: 2848202 - protein, 5 aa, Entamoeba invadens
DVQSQ

SEQ ID NO: 2848203 - protein, 9 aa, Entamoeba invadens
DVQTQIQKD

SEQ ID NO: 2848204 - protein, 7 aa, Entamoeba invadens
DVQTSEE

SEQ ID NO: 2848205 - protein, 21 aa, Entamoeba invadens
DVQTSRYKTNDEYSPSGEINE

SEQ ID NO: 2848206 - protein, 8 aa, Entamoeba invadens
DVQTTGYY

SEQ ID NO: 2848207 - protein, 5 aa, Entamoeba invadens
DVRDT

SEQ ID NO: 2848208 - protein, 4 aa, Entamoeba invadens
DVRE

SEQ ID NO: 2848209 - protein, 7 aa, Entamoeba invadens
DVRESEL

SEQ ID NO: 2848210 - protein, 8 aa, Entamoeba invadens
DVRKLGEQ

SEQ ID NO: 2848211 - protein, 6 aa, Entamoeba invadens
DVRNLR

SEQ ID NO: 2848212 - protein, 25 aa, Entamoeba invadens
DVRPKSKSKKTFTKREDSKSDTFRG

SEQ ID NO: 2848213 - protein, 5 aa, Entamoeba invadens
DVRRG

SEQ ID NO: 2848214 - protein, 13 aa, Entamoeba invadens
DVRRTDRTDSKFK

SEQ ID NO: 2848215 - protein, 7 aa, Entamoeba invadens
DVSAKDT

SEQ ID NO: 2848216 - protein, 4 aa, Entamoeba invadens
DVSD

SEQ ID NO: 2848217 - protein, 7 aa, Entamoeba invadens
DVSEGSA

SEQ ID NO: 2848218 - protein, 12 aa, Entamoeba invadens
DVSEPSSQHGIS

SEQ ID NO: 2848219 - protein, 8 aa, Entamoeba invadens
DVSESVRD

SEQ ID NO: 2848220 - protein, 4 aa, Entamoeba invadens
DVSF

SEQ ID NO: 2848221 - protein, 8 aa, Entamoeba invadens
DVSGGQHP

SEQ ID NO: 2848222 - protein, 5 aa, Entamoeba invadens
DVSGI

SEQ ID NO: 2848223 - protein, 9 aa, Entamoeba invadens
DVSGKGGKL

SEQ ID NO: 2848224 - protein, 7 aa, Entamoeba invadens
DVSGSVF

SEQ ID NO: 2848225 - protein, 4 aa, Entamoeba invadens
DVSI

SEQ ID NO: 2848226 - protein, 9 aa, Entamoeba invadens
DVSKDDKES

SEQ ID NO: 2848227 - protein, 7 aa, Entamoeba invadens
DVSKDRL

SEQ ID NO: 2848228 - protein, 11 aa, Entamoeba invadens
DVSKESRQSEN

SEQ ID NO: 2848229 - protein, 11 aa, Entamoeba invadens
DVSKSCSEKYK

SEQ ID NO: 2848230 - protein, 12 aa, Entamoeba invadens
DVSNHEKKRLKE

SEQ ID NO: 2848231 - protein, 8 aa, Entamoeba invadens
DVSNTQNF

SEQ ID NO: 2848232 - protein, 12 aa, Entamoeba invadens
DVSNYEKKRLKE

SEQ ID NO: 2848233 - protein, 8 aa, Entamoeba invadens
DVSPKSFT

SEQ ID NO: 2848234 - protein, 34 aa, Entamoeba invadens
DVSQPDDVCDDASDTSDDGDVEEKEKADNRPEGD

SEQ ID NO: 2848235 - protein, 4 aa, Entamoeba invadens
DVSR

SEQ ID NO: 2848236 - protein, 5 aa, Entamoeba invadens
DVSRG

SEQ ID NO: 2848237 - protein, 9 aa, Entamoeba invadens
DVSRGQSNG

SEQ ID NO: 2848238 - protein, 23 aa, Entamoeba invadens
DVSRRQATAHAKASVAKRAVEKI

SEQ ID NO: 2848239 - protein, 7 aa, Entamoeba invadens
DVSSNLP

SEQ ID NO: 2848240 - protein, 4 aa, Entamoeba invadens
DVST

SEQ ID NO: 2848241 - protein, 10 aa, Entamoeba invadens
DVSTKEAFTE

SEQ ID NO: 2848242 - protein, 6 aa, Entamoeba invadens
DVSTND

SEQ ID NO: 2848243 - protein, 14 aa, Entamoeba invadens
DVSTQNKSEKTREK

SEQ ID NO: 2848244 - protein, 7 aa, Entamoeba invadens
DVSTRNM

SEQ ID NO: 2848245 - protein, 8 aa, Entamoeba invadens
DVSVGKTQ

SEQ ID NO: 2848246 - protein, 5 aa, Entamoeba invadens
DVSYT

SEQ ID NO: 2848247 - protein, 12 aa, Entamoeba invadens
DVTDGKRGVSSF

SEQ ID NO: 2848248 - protein, 8 aa, Entamoeba invadens
DVTDKAVN

SEQ ID NO: 2848249 - protein, 7 aa, Entamoeba invadens
DVTDKRN

SEQ ID NO: 2848250 - protein, 17 aa, Entamoeba invadens
DVTEDEPIAKNTRSRTY

SEQ ID NO: 2848251 - protein, 13 aa, Entamoeba invadens
DVTGELSKEQEDI

SEQ ID NO: 2848252 - protein, 5 aa, Entamoeba invadens
DVTKD

SEQ ID NO: 2848253 - protein, 16 aa, Entamoeba invadens
DVTKDYKNRTSQKSVD

SEQ ID NO: 2848254 - protein, 15 aa, Entamoeba invadens
DVTKFGNKIPNSVKT

SEQ ID NO: 2848255 - protein, 10 aa, Entamoeba invadens
DVTKKDGRII

SEQ ID NO: 2848256 - protein, 8 aa, Entamoeba invadens
DVTKMNEN

SEQ ID NO: 2848257 - protein, 13 aa, Entamoeba invadens
DVTNEGGYTFSDG

SEQ ID NO: 2848258 - protein, 11 aa, Entamoeba invadens
DVTNPTDFERE

SEQ ID NO: 2848259 - protein, 4 aa, Entamoeba invadens
DVTP

SEQ ID NO: 2848260 - protein, 10 aa, Entamoeba invadens
DVTPDDTSFE

SEQ ID NO: 2848261 - protein, 7 aa, Entamoeba invadens
DVTPNSI

SEQ ID NO: 2848262 - protein, 9 aa, Entamoeba invadens
DVTPTKDSI

SEQ ID NO: 2848263 - protein, 8 aa, Entamoeba invadens
DVTQTKGF

SEQ ID NO: 2848264 - protein, 6 aa, Entamoeba invadens
DVTRQN

SEQ ID NO: 2848265 - protein, 10 aa, Entamoeba invadens
DVTRYGESFP

SEQ ID NO: 2848266 - protein, 6 aa, Entamoeba invadens
DVTSEV

SEQ ID NO: 2848267 - protein, 5 aa, Entamoeba invadens
DVTSG

SEQ ID NO: 2848268 - protein, 6 aa, Entamoeba invadens
DVTSPK

SEQ ID NO: 2848269 - protein, 5 aa, Entamoeba invadens
DVTTQ

SEQ ID NO: 2848270 - protein, 14 aa, Entamoeba invadens
DVTYNDAGNEETGA

SEQ ID NO: 2848271 - protein, 4 aa, Entamoeba invadens
DVVE

SEQ ID NO: 2848272 - protein, 11 aa, Entamoeba invadens
DVVETADEPIR

SEQ ID NO: 2848273 - protein, 11 aa, Entamoeba invadens
DVVETTSEEIE

SEQ ID NO: 2848274 - protein, 9 aa, Entamoeba invadens
DVVNKDQSV

SEQ ID NO: 2848275 - protein, 10 aa, Entamoeba invadens
DVYDETPNDA

SEQ ID NO: 2848276 - protein, 5 aa, Entamoeba invadens
DVYGE

SEQ ID NO: 2848277 - protein, 12 aa, Entamoeba invadens
DVYSTDVGNVRG

SEQ ID NO: 2848278 - protein, 4 aa, Entamoeba invadens
DVYT

SEQ ID NO: 2848279 - protein, 12 aa, Entamoeba invadens
DWDGSDEEAWKP

SEQ ID NO: 2848280 - protein, 8 aa, Entamoeba invadens
DWESGEKY

SEQ ID NO: 2848281 - protein, 5 aa, Entamoeba invadens
DWGAD

SEQ ID NO: 2848282 - protein, 5 aa, Entamoeba invadens
DWIGE

SEQ ID NO: 2848283 - protein, 11 aa, Entamoeba invadens
DWKDAGTGNIE

SEQ ID NO: 2848284 - protein, 5 aa, Entamoeba invadens
DWKSV

SEQ ID NO: 2848285 - protein, 9 aa, Entamoeba invadens
DWNPQSDIQ

SEQ ID NO: 2848286 - protein, 11 aa, Entamoeba invadens
DWQESTKRVIN

SEQ ID NO: 2848287 - protein, 14 aa, Entamoeba invadens
DWQESTRKVIKDGK

SEQ ID NO: 2848288 - protein, 7 aa, Entamoeba invadens
DWRDQTR

SEQ ID NO: 2848289 - protein, 5 aa, Entamoeba invadens
DWSHD

SEQ ID NO: 2848290 - protein, 6 aa, Entamoeba invadens
DWSPVS

SEQ ID NO: 2848291 - protein, 21 aa, Entamoeba invadens
DWSSRNNDIPYYETSAKTGMH

SEQ ID NO: 2848292 - protein, 5 aa, Entamoeba invadens
DWSVR

SEQ ID NO: 2848293 - protein, 4 aa, Entamoeba invadens
DYAK

SEQ ID NO: 2848294 - protein, 9 aa, Entamoeba invadens
DYARPTEAI

SEQ ID NO: 2848295 - protein, 9 aa, Entamoeba invadens
DYATTDPAG

SEQ ID NO: 2848296 - protein, 5 aa, Entamoeba invadens
DYCET

SEQ ID NO: 2848297 - protein, 10 aa, Entamoeba invadens
DYDAEEIGQS

SEQ ID NO: 2848298 - protein, 6 aa, Entamoeba invadens
DYDAEM

SEQ ID NO: 2848299 - protein, 13 aa, Entamoeba invadens
DYDERDVTETEVT

SEQ ID NO: 2848300 - protein, 4 aa, Entamoeba invadens
DYDG

SEQ ID NO: 2848301 - protein, 6 aa, Entamoeba invadens
DYDGSH

SEQ ID NO: 2848302 - protein, 5 aa, Entamoeba invadens
DYDHK

SEQ ID NO: 2848303 - protein, 5 aa, Entamoeba invadens
DYDIT

SEQ ID NO: 2848304 - protein, 29 aa, Entamoeba invadens
DYDKQKEAIEAEYQRKQKEEEEKANNSLQ

SEQ ID NO: 2848305 - protein, 16 aa, Entamoeba invadens
DYDKYNANKNSNPKET

SEQ ID NO: 2848306 - protein, 5 aa, Entamoeba invadens
DYDND

SEQ ID NO: 2848307 - protein, 12 aa, Entamoeba invadens
DYDNVSGSLGGF

SEQ ID NO: 2848308 - protein, 9 aa, Entamoeba invadens
DYDQTGNAV

SEQ ID NO: 2848309 - protein, 12 aa, Entamoeba invadens
DYDSSNVETPEI

SEQ ID NO: 2848310 - protein, 5 aa, Entamoeba invadens
DYDYY

SEQ ID NO: 2848311 - protein, 7 aa, Entamoeba invadens
DYEDPEE

SEQ ID NO: 2848312 - protein, 5 aa, Entamoeba invadens
DYEDS

SEQ ID NO: 2848313 - protein, 10 aa, Entamoeba invadens
DYEEEYEEDK

SEQ ID NO: 2848314 - protein, 4 aa, Entamoeba invadens
DYEG

SEQ ID NO: 2848315 - protein, 5 aa, Entamoeba invadens
DYEGA

SEQ ID NO: 2848316 - protein, 5 aa, Entamoeba invadens
DYEGT

SEQ ID NO: 2848317 - protein, 9 aa, Entamoeba invadens
DYEKSSIEV

SEQ ID NO: 2848318 - protein, 5 aa, Entamoeba invadens
DYEKY

SEQ ID NO: 2848319 - protein, 6 aa, Entamoeba invadens
DYENEQ

SEQ ID NO: 2848320 - protein, 5 aa, Entamoeba invadens
DYEPS

SEQ ID NO: 2848321 - protein, 12 aa, Entamoeba invadens
DYEQESEVGPFP

SEQ ID NO: 2848322 - protein, 10 aa, Entamoeba invadens
DYEQKDENTI

SEQ ID NO: 2848323 - protein, 17 aa, Entamoeba invadens
DYEQLTEDDKATAPSEI

SEQ ID NO: 2848324 - protein, 12 aa, Entamoeba invadens
DYETHKRETKNK

SEQ ID NO: 2848325 - protein, 10 aa, Entamoeba invadens
DYGDGRQPKW

SEQ ID NO: 2848326 - protein, 8 aa, Entamoeba invadens
DYGEEKEA

SEQ ID NO: 2848327 - protein, 9 aa, Entamoeba invadens
DYGNDIDRT

SEQ ID NO: 2848328 - protein, 7 aa, Entamoeba invadens
DYGNGND

SEQ ID NO: 2848329 - protein, 9 aa, Entamoeba invadens
DYGNGNDLN

SEQ ID NO: 2848330 - protein, 10 aa, Entamoeba invadens
DYGNKEFTKC

SEQ ID NO: 2848331 - protein, 16 aa, Entamoeba invadens
DYGNNNKLPQINPRTQ

SEQ ID NO: 2848332 - protein, 7 aa, Entamoeba invadens
DYGTTTS

SEQ ID NO: 2848333 - protein, 6 aa, Entamoeba invadens
DYHDKN

SEQ ID NO: 2848334 - protein, 9 aa, Entamoeba invadens
DYIEQQKQI

SEQ ID NO: 2848335 - protein, 8 aa, Entamoeba invadens
DYKDDIQK

SEQ ID NO: 2848336 - protein, 17 aa, Entamoeba invadens
DYKDDKTQRSDNNLADN

SEQ ID NO: 2848337 - protein, 9 aa, Entamoeba invadens
DYKEDNDFK

SEQ ID NO: 2848338 - protein, 8 aa, Entamoeba invadens
DYKEGETI

SEQ ID NO: 2848339 - protein, 9 aa, Entamoeba invadens
DYKENSDEQ

SEQ ID NO: 2848340 - protein, 13 aa, Entamoeba invadens
DYKGEDVKNGGHP

SEQ ID NO: 2848341 - protein, 6 aa, Entamoeba invadens
DYKIRD

SEQ ID NO: 2848342 - protein, 9 aa, Entamoeba invadens
DYKKKGDEF

SEQ ID NO: 2848343 - protein, 11 aa, Entamoeba invadens
DYKKKSAASVR

SEQ ID NO: 2848344 - protein, 14 aa, Entamoeba invadens
DYKKSHNKAVVSAS

SEQ ID NO: 2848345 - protein, 8 aa, Entamoeba invadens
DYKLDEEE

SEQ ID NO: 2848346 - protein, 20 aa, Entamoeba invadens
DYKNKNSKYFEKDQKTGKFR

SEQ ID NO: 2848347 - protein, 19 aa, Entamoeba invadens
DYKPESVADQKIKKSDETM

SEQ ID NO: 2848348 - protein, 4 aa, Entamoeba invadens
DYKS

SEQ ID NO: 2848349 - protein, 6 aa, Entamoeba invadens
DYKSTV

SEQ ID NO: 2848350 - protein, 4 aa, Entamoeba invadens
DYLG

SEQ ID NO: 2848351 - protein, 12 aa, Entamoeba invadens
DYMKGEKQIPDG

SEQ ID NO: 2848352 - protein, 14 aa, Entamoeba invadens
DYMNNGDYNPSRME

SEQ ID NO: 2848353 - protein, 6 aa, Entamoeba invadens
DYMSTG

SEQ ID NO: 2848354 - protein, 4 aa, Entamoeba invadens
DYNG

SEQ ID NO: 2848355 - protein, 9 aa, Entamoeba invadens
DYNGEGDEV

SEQ ID NO: 2848356 - protein, 13 aa, Entamoeba invadens
DYNKRLGKGGLDE

SEQ ID NO: 2848357 - protein, 7 aa, Entamoeba invadens
DYNLPQK

SEQ ID NO: 2848358 - protein, 5 aa, Entamoeba invadens
DYNNF

SEQ ID NO: 2848359 - protein, 6 aa, Entamoeba invadens
DYNNVD

SEQ ID NO: 2848360 - protein, 5 aa, Entamoeba invadens
DYNRY

SEQ ID NO: 2848361 - protein, 4 aa, Entamoeba invadens
DYPA

SEQ ID NO: 2848362 - protein, 9 aa, Entamoeba invadens
DYPDYAEKV

SEQ ID NO: 2848363 - protein, 4 aa, Entamoeba invadens
DYPK

SEQ ID NO: 2848364 - protein, 4 aa, Entamoeba invadens
DYPL

SEQ ID NO: 2848365 - protein, 9 aa, Entamoeba invadens
DYPNNPPKV

SEQ ID NO: 2848366 - protein, 7 aa, Entamoeba invadens
DYPNSDK

SEQ ID NO: 2848367 - protein, 6 aa, Entamoeba invadens
DYPPNK

SEQ ID NO: 2848368 - protein, 5 aa, Entamoeba invadens
DYPTA

SEQ ID NO: 2848369 - protein, 29 aa, Entamoeba invadens
DYPTRETERNGSIGSRDSLPSSKKSGMRP

SEQ ID NO: 2848370 - protein, 6 aa, Entamoeba invadens
DYPTTL

SEQ ID NO: 2848371 - protein, 5 aa, Entamoeba invadens
DYPYH

SEQ ID NO: 2848372 - protein, 12 aa, Entamoeba invadens
DYQEEKYKDAIE

SEQ ID NO: 2848373 - protein, 13 aa, Entamoeba invadens
DYQGRSDGPKKGF

SEQ ID NO: 2848374 - protein, 5 aa, Entamoeba invadens
DYQND

SEQ ID NO: 2848375 - protein, 7 aa, Entamoeba invadens
DYQPTTR

SEQ ID NO: 2848376 - protein, 10 aa, Entamoeba invadens
DYQQDGGDSF

SEQ ID NO: 2848377 - protein, 4 aa, Entamoeba invadens
DYQT

SEQ ID NO: 2848378 - protein, 14 aa, Entamoeba invadens
DYQTTSDKHENIPD

SEQ ID NO: 2848379 - protein, 8 aa, Entamoeba invadens
DYRDGEKE

SEQ ID NO: 2848380 - protein, 13 aa, Entamoeba invadens
DYRDKKQALSTTT

SEQ ID NO: 2848381 - protein, 53 aa, Entamoeba invadens
DYRDRGERRDWERRERMDDYRDDRNYLRDDKAERRRTRDDDEGYLPARGPRRF

SEQ ID NO: 2848382 - protein, 31 aa, Entamoeba invadens
DYRREERNAKLKADTLNAEDKRSKEDVRREI

SEQ ID NO: 2848383 - protein, 6 aa, Entamoeba invadens
DYRSIE

SEQ ID NO: 2848384 - protein, 5 aa, Entamoeba invadens
DYSAR

SEQ ID NO: 2848385 - protein, 7 aa, Entamoeba invadens
DYSFSST

SEQ ID NO: 2848386 - protein, 10 aa, Entamoeba invadens
DYSKLSKLSE

SEQ ID NO: 2848387 - protein, 10 aa, Entamoeba invadens
DYSKNGGKTF

SEQ ID NO: 2848388 - protein, 6 aa, Entamoeba invadens
DYSNKE

SEQ ID NO: 2848389 - protein, 7 aa, Entamoeba invadens
DYSPKKI

SEQ ID NO: 2848390 - protein, 10 aa, Entamoeba invadens
DYSPKKIGTT

SEQ ID NO: 2848391 - protein, 20 aa, Entamoeba invadens
DYSQATDNESQNTNDSTKEE

SEQ ID NO: 2848392 - protein, 20 aa, Entamoeba invadens
DYSQATENKSQNTNDSTKEE

SEQ ID NO: 2848393 - protein, 13 aa, Entamoeba invadens
DYSRTDVNLSGLF

SEQ ID NO: 2848394 - protein, 4 aa, Entamoeba invadens
DYSS

SEQ ID NO: 2848395 - protein, 18 aa, Entamoeba invadens
DYSSDPITNTSTRTARDI

SEQ ID NO: 2848396 - protein, 9 aa, Entamoeba invadens
DYSSQKEFP

SEQ ID NO: 2848397 - protein, 23 aa, Entamoeba invadens
DYSSSSPRSPSLSKLKSPKSPLK

SEQ ID NO: 2848398 - protein, 4 aa, Entamoeba invadens
DYTF

SEQ ID NO: 2848399 - protein, 25 aa, Entamoeba invadens
DYTGTEKVVGEKYREKDVTIKGETY

SEQ ID NO: 2848400 - protein, 11 aa, Entamoeba invadens
DYTKNKKDTIV

SEQ ID NO: 2848401 - protein, 5 aa, Entamoeba invadens
DYTKQ

SEQ ID NO: 2848402 - protein, 21 aa, Entamoeba invadens
DYTNELKDRRTLTKNERATLN

SEQ ID NO: 2848403 - protein, 6 aa, Entamoeba invadens
DYTNET

SEQ ID NO: 2848404 - protein, 12 aa, Entamoeba invadens
DYTPKQTQVDDK

SEQ ID NO: 2848405 - protein, 11 aa, Entamoeba invadens
DYTQPLSSPIA

SEQ ID NO: 2848406 - protein, 8 aa, Entamoeba invadens
DYTTAGPN

SEQ ID NO: 2848407 - protein, 5 aa, Entamoeba invadens
DYTTP

SEQ ID NO: 2848408 - protein, 7 aa, Entamoeba invadens
DYTTTQK

SEQ ID NO: 2848409 - protein, 13 aa, Entamoeba invadens
DYVDNGEKLCSTP

SEQ ID NO: 2848410 - protein, 11 aa, Entamoeba invadens
DYVPPKDDPRR

SEQ ID NO: 2848411 - protein, 10 aa, Entamoeba invadens
DYYGGASASL

SEQ ID NO: 2848412 - protein, 32 aa, Entamoeba invadens
DYYNDDKENDDASNESDSEERDTYDQQPGSKM

SEQ ID NO: 2848413 - protein, 7 aa, Entamoeba invadens
DYYPARY

SEQ ID NO: 2848414 - protein, 9 aa, Entamoeba invadens
EAADKKDQV

SEQ ID NO: 2848415 - protein, 72 aa, Entamoeba invadens
EAAEAEKLQKEKEEQERNDKEKAEKEAQEKERQEKERIEKDRLEKERIDREAKEQAEKERIEKERLEKERIE

SEQ ID NO: 2848416 - protein, 6 aa, Entamoeba invadens
EAAELT

SEQ ID NO: 2848417 - protein, 7 aa, Entamoeba invadens
EAAESAE

SEQ ID NO: 2848418 - protein, 17 aa, Entamoeba invadens
EAAESYKAYQTLNEKSR

SEQ ID NO: 2848419 - protein, 4 aa, Entamoeba invadens
EAAK

SEQ ID NO: 2848420 - protein, 11 aa, Entamoeba invadens
EAAKEENRTIQ

SEQ ID NO: 2848421 - protein, 7 aa, Entamoeba invadens
EAAKKDE

SEQ ID NO: 2848422 - protein, 11 aa, Entamoeba invadens
EAAKKTEGKRA

SEQ ID NO: 2848423 - protein, 8 aa, Entamoeba invadens
EAAKQSGF

SEQ ID NO: 2848424 - protein, 16 aa, Entamoeba invadens
EAAKSINFKNKTTAEI

SEQ ID NO: 2848425 - protein, 8 aa, Entamoeba invadens
EAAKSNDK

SEQ ID NO: 2848426 - protein, 5 aa, Entamoeba invadens
EAAPL

SEQ ID NO: 2848427 - protein, 8 aa, Entamoeba invadens
EAAPPGVF

SEQ ID NO: 2848428 - protein, 8 aa, Entamoeba invadens
EAAPQPTH

SEQ ID NO: 2848429 - protein, 10 aa, Entamoeba invadens
EAAPTPQNKK

SEQ ID NO: 2848430 - protein, 7 aa, Entamoeba invadens
EAAQGEL

SEQ ID NO: 2848431 - protein, 103 aa, Entamoeba invadens
EAAQKRAAKPVKIATEAREKASATAKAAEEAKEAAEASKQAAEEAHNAAETAKEQAEAALQASNEAKAQAEEALEKSNAAKAQAEEAERQAVAAKEDAEEKLR

SEQ ID NO: 2848432 - protein, 197 aa, Entamoeba invadens
EAAQKRAAKPVKIATEAREKASATAQQALEAKTAAEEAKNQAEAAQKAAEEANAQAEEAKNAAETAKQESENAKQQAEEAKQKSEDAKDASEKAKQEADDAKERAAQAKAQAEEAKEIAQKAKEDADAAKQVAAEAKEAAEKAKEEAEQALQASNEAKAQSEKAQQEAEEAEKQAVEAQEQAEQSVQDANHKVAEAE

SEQ ID NO: 2848433 - protein, 11 aa, Entamoeba invadens
EAAQKRADKAV

SEQ ID NO: 2848434 - protein, 6 aa, Entamoeba invadens
EAAQNY

SEQ ID NO: 2848435 - protein, 99 aa, Entamoeba invadens
EAAQRKAAKPVKIATEAREKASATAQQALDAKNAADEAKAQAEEAQQQAENALKASNEAKAQAEEAQAQSEEAEKQAEEAAQAAEEAVQDANNKVAEAE

SEQ ID NO: 2848436 - protein, 9 aa, Entamoeba invadens
EAARGDGTS

SEQ ID NO: 2848437 - protein, 4 aa, Entamoeba invadens
EAAS

SEQ ID NO: 2848438 - protein, 10 aa, Entamoeba invadens
EAASIPEDFA

SEQ ID NO: 2848439 - protein, 9 aa, Entamoeba invadens
EAASLEYPE

SEQ ID NO: 2848440 - protein, 10 aa, Entamoeba invadens
EAASSGAAAK

SEQ ID NO: 2848441 - protein, 12 aa, Entamoeba invadens
EAATDTPVSPDV

SEQ ID NO: 2848442 - protein, 11 aa, Entamoeba invadens
EAATKKAKFGN

SEQ ID NO: 2848443 - protein, 8 aa, Entamoeba invadens
EAATLKQP

SEQ ID NO: 2848444 - protein, 11 aa, Entamoeba invadens
EAATSKASRRC

SEQ ID NO: 2848445 - protein, 6 aa, Entamoeba invadens
EACDKN

SEQ ID NO: 2848446 - protein, 7 aa, Entamoeba invadens
EACEEAY

SEQ ID NO: 2848447 - protein, 4 aa, Entamoeba invadens
EACG

SEQ ID NO: 2848448 - protein, 4 aa, Entamoeba invadens
EADA

SEQ ID NO: 2848449 - protein, 27 aa, Entamoeba invadens
EADALKRKEELKELQKQRDIEQAKKES

SEQ ID NO: 2848450 - protein, 4 aa, Entamoeba invadens
EADC

SEQ ID NO: 2848451 - protein, 9 aa, Entamoeba invadens
EADDEDDDW

SEQ ID NO: 2848452 - protein, 11 aa, Entamoeba invadens
EADDEKDIDGA

SEQ ID NO: 2848453 - protein, 11 aa, Entamoeba invadens
EADDPSAQVTT

SEQ ID NO: 2848454 - protein, 4 aa, Entamoeba invadens
EADE

SEQ ID NO: 2848455 - protein, 8 aa, Entamoeba invadens
EADEIGKR

SEQ ID NO: 2848456 - protein, 6 aa, Entamoeba invadens
EADEQT

SEQ ID NO: 2848457 - protein, 9 aa, Entamoeba invadens
EADGKEKAF

SEQ ID NO: 2848458 - protein, 11 aa, Entamoeba invadens
EADKDRDGKIS

SEQ ID NO: 2848459 - protein, 4 aa, Entamoeba invadens
EADP

SEQ ID NO: 2848460 - protein, 14 aa, Entamoeba invadens
EADPQKTEKKRQIG

SEQ ID NO: 2848461 - protein, 5 aa, Entamoeba invadens
EADPT

SEQ ID NO: 2848462 - protein, 11 aa, Entamoeba invadens
EADQDVTAPID

SEQ ID NO: 2848463 - protein, 8 aa, Entamoeba invadens
EADRSHKM

SEQ ID NO: 2848464 - protein, 20 aa, Entamoeba invadens
EADSKSETTTKKKKNTNLWT

SEQ ID NO: 2848465 - protein, 7 aa, Entamoeba invadens
EADSYNE

SEQ ID NO: 2848466 - protein, 8 aa, Entamoeba invadens
EADTAGDE

SEQ ID NO: 2848467 - protein, 4 aa, Entamoeba invadens
EADV

SEQ ID NO: 2848468 - protein, 17 aa, Entamoeba invadens
EADVTKELEKWKANHIL

SEQ ID NO: 2848469 - protein, 42 aa, Entamoeba invadens
EAEAAKENETLRRRRKTLEKRLGDKDLEKTAKKTLQETKTKE

SEQ ID NO: 2848470 - protein, 20 aa, Entamoeba invadens
EAEAEELKNDVKESEKYEKE

SEQ ID NO: 2848471 - protein, 5 aa, Entamoeba invadens
EAECS

SEQ ID NO: 2848472 - protein, 12 aa, Entamoeba invadens
EAEDFLKSCPLK

SEQ ID NO: 2848473 - protein, 17 aa, Entamoeba invadens
EAEDQTVSSSEASVRAE

SEQ ID NO: 2848474 - protein, 14 aa, Entamoeba invadens
EAEDSSDESGSITP

SEQ ID NO: 2848475 - protein, 12 aa, Entamoeba invadens
EAEEEGSDNQFD

SEQ ID NO: 2848476 - protein, 14 aa, Entamoeba invadens
EAEEEQKAKGDDSQ

SEQ ID NO: 2848477 - protein, 8 aa, Entamoeba invadens
EAEETSDL

SEQ ID NO: 2848478 - protein, 16 aa, Entamoeba invadens
EAEGSTMKKQAKTEPI

SEQ ID NO: 2848479 - protein, 5 aa, Entamoeba invadens
EAEHL

SEQ ID NO: 2848480 - protein, 14 aa, Entamoeba invadens
EAEKEKALGEAERL

SEQ ID NO: 2848481 - protein, 23 aa, Entamoeba invadens
EAEKEKKQKYDDVLSESANNTTY

SEQ ID NO: 2848482 - protein, 10 aa, Entamoeba invadens
EAEKGDPNAL

SEQ ID NO: 2848483 - protein, 7 aa, Entamoeba invadens
EAEKNAP

SEQ ID NO: 2848484 - protein, 166 aa, Entamoeba invadens
EAEKQQKKLKAKSTSSSSSSKSSSSSKSSSSSTSSSTSGGSSSGGSSGGDSGASSGGDAGASSGGSSESNAGASSGGSSGGSSSSGGSSSSGADITPSTPTVPTPSVPTPSEPVPSVPSTPSIPTTPSEPSTPSTPYVPPPTLPSTPSVPSTPSESGSNSNANAQM

SEQ ID NO: 2848485 - protein, 15 aa, Entamoeba invadens
EAEKTLTDNTNATTT

SEQ ID NO: 2848486 - protein, 4 aa, Entamoeba invadens
EAEL

SEQ ID NO: 2848487 - protein, 7 aa, Entamoeba invadens
EAENERQ

SEQ ID NO: 2848488 - protein, 13 aa, Entamoeba invadens
EAENESKTSEERV

SEQ ID NO: 2848489 - protein, 11 aa, Entamoeba invadens
EAENETELSMK

SEQ ID NO: 2848490 - protein, 5 aa, Entamoeba invadens
EAENF

SEQ ID NO: 2848491 - protein, 7 aa, Entamoeba invadens
EAENIGS

SEQ ID NO: 2848492 - protein, 10 aa, Entamoeba invadens
EAENTTSEPV

SEQ ID NO: 2848493 - protein, 12 aa, Entamoeba invadens
EAEQAPKSYTKT

SEQ ID NO: 2848494 - protein, 14 aa, Entamoeba invadens
EAEQEKQDEIDEEN

SEQ ID NO: 2848495 - protein, 15 aa, Entamoeba invadens
EAERNGEANNFTRNN

SEQ ID NO: 2848496 - protein, 7 aa, Entamoeba invadens
EAERNKI

SEQ ID NO: 2848497 - protein, 4 aa, Entamoeba invadens
EAES

SEQ ID NO: 2848498 - protein, 7 aa, Entamoeba invadens
EAETKSV

SEQ ID NO: 2848499 - protein, 5 aa, Entamoeba invadens
EAEVK

SEQ ID NO: 2848500 - protein, 18 aa, Entamoeba invadens
EAEVSDGDVVSLISSIHG

SEQ ID NO: 2848501 - protein, 23 aa, Entamoeba invadens
EAFSRTSKEKNLRERVESEKERH

SEQ ID NO: 2848502 - protein, 25 aa, Entamoeba invadens
EAFSSEDDDDDEIPVNTTQGGSKSL

SEQ ID NO: 2848503 - protein, 16 aa, Entamoeba invadens
EAFSTKSRINQSQREE

SEQ ID NO: 2848504 - protein, 5 aa, Entamoeba invadens
EAFTK

SEQ ID NO: 2848505 - protein, 4 aa, Entamoeba invadens
EAGC

SEQ ID NO: 2848506 - protein, 10 aa, Entamoeba invadens
EAGDADTNAA

SEQ ID NO: 2848507 - protein, 11 aa, Entamoeba invadens
EAGDADTNGAV

SEQ ID NO: 2848508 - protein, 11 aa, Entamoeba invadens
EAGDADTNKAV

SEQ ID NO: 2848509 - protein, 6 aa, Entamoeba invadens
EAGDIT

SEQ ID NO: 2848510 - protein, 10 aa, Entamoeba invadens
EAGDVPEDIG

SEQ ID NO: 2848511 - protein, 8 aa, Entamoeba invadens
EAGEEIAQ

SEQ ID NO: 2848512 - protein, 7 aa, Entamoeba invadens
EAGEEIK

SEQ ID NO: 2848513 - protein, 9 aa, Entamoeba invadens
EAGEPITKV

SEQ ID NO: 2848514 - protein, 14 aa, Entamoeba invadens
EAGEYESQKWNEKQ

SEQ ID NO: 2848515 - protein, 13 aa, Entamoeba invadens
EAGEYESQKWNKK

SEQ ID NO: 2848516 - protein, 8 aa, Entamoeba invadens
EAGFTGDE

SEQ ID NO: 2848517 - protein, 11 aa, Entamoeba invadens
EAGGEENIEKR

SEQ ID NO: 2848518 - protein, 6 aa, Entamoeba invadens
EAGGTL

SEQ ID NO: 2848519 - protein, 4 aa, Entamoeba invadens
EAGK

SEQ ID NO: 2848520 - protein, 6 aa, Entamoeba invadens
EAGKRY

SEQ ID NO: 2848521 - protein, 5 aa, Entamoeba invadens
EAGLN

SEQ ID NO: 2848522 - protein, 8 aa, Entamoeba invadens
EAGNAEQV

SEQ ID NO: 2848523 - protein, 8 aa, Entamoeba invadens
EAGNINKT

SEQ ID NO: 2848524 - protein, 7 aa, Entamoeba invadens
EAGPEGF

SEQ ID NO: 2848525 - protein, 6 aa, Entamoeba invadens
EAGQES

SEQ ID NO: 2848526 - protein, 7 aa, Entamoeba invadens
EAGRGAV

SEQ ID NO: 2848527 - protein, 8 aa, Entamoeba invadens
EAGRGPVV

SEQ ID NO: 2848528 - protein, 6 aa, Entamoeba invadens
EAGRVK

SEQ ID NO: 2848529 - protein, 10 aa, Entamoeba invadens
EAGSANSEVT

SEQ ID NO: 2848530 - protein, 8 aa, Entamoeba invadens
EAGSSMGK

SEQ ID NO: 2848531 - protein, 13 aa, Entamoeba invadens
EAGTEHKEIAEDP

SEQ ID NO: 2848532 - protein, 13 aa, Entamoeba invadens
EAGTYKKTETTCN

SEQ ID NO: 2848533 - protein, 8 aa, Entamoeba invadens
EAGVRGEL

SEQ ID NO: 2848534 - protein, 9 aa, Entamoeba invadens
EAHGDETKL

SEQ ID NO: 2848535 - protein, 18 aa, Entamoeba invadens
EAHKEEDKRHKAKYTDDG

SEQ ID NO: 2848536 - protein, 6 aa, Entamoeba invadens
EAHNPG

SEQ ID NO: 2848537 - protein, 41 aa, Entamoeba invadens
EAHPQAEEKVEYAPKRRRKVYDADDVGGYVPTTKETKEEHA

SEQ ID NO: 2848538 - protein, 12 aa, Entamoeba invadens
EAHRDDPPQEVA

SEQ ID NO: 2848539 - protein, 12 aa, Entamoeba invadens
EAHRSHGAAATR

SEQ ID NO: 2848540 - protein, 4 aa, Entamoeba invadens
EAHS

SEQ ID NO: 2848541 - protein, 6 aa, Entamoeba invadens
EAHSDN

SEQ ID NO: 2848542 - protein, 13 aa, Entamoeba invadens
EAIDRYKEENREK

SEQ ID NO: 2848543 - protein, 6 aa, Entamoeba invadens
EAIEAR

SEQ ID NO: 2848544 - protein, 10 aa, Entamoeba invadens
EAIEDNQEYT

SEQ ID NO: 2848545 - protein, 6 aa, Entamoeba invadens
EAIESS

SEQ ID NO: 2848546 - protein, 5 aa, Entamoeba invadens
EAIGG

SEQ ID NO: 2848547 - protein, 8 aa, Entamoeba invadens
EAIKDNQE

SEQ ID NO: 2848548 - protein, 6 aa, Entamoeba invadens
EAINKG

SEQ ID NO: 2848549 - protein, 6 aa, Entamoeba invadens
EAINKN

SEQ ID NO: 2848550 - protein, 5 aa, Entamoeba invadens
EAIPK

SEQ ID NO: 2848551 - protein, 6 aa, Entamoeba invadens
EAISSA

SEQ ID NO: 2848552 - protein, 12 aa, Entamoeba invadens
EAISTSRRSKLE

SEQ ID NO: 2848553 - protein, 4 aa, Entamoeba invadens
EAIT

SEQ ID NO: 2848554 - protein, 8 aa, Entamoeba invadens
EAKAAGKK

SEQ ID NO: 2848555 - protein, 14 aa, Entamoeba invadens
EAKAKETVKNTQVT

SEQ ID NO: 2848556 - protein, 12 aa, Entamoeba invadens
EAKDAIKEKDNQ

SEQ ID NO: 2848557 - protein, 10 aa, Entamoeba invadens
EAKDLDSRTR

SEQ ID NO: 2848558 - protein, 8 aa, Entamoeba invadens
EAKDTVKW

SEQ ID NO: 2848559 - protein, 4 aa, Entamoeba invadens
EAKE

SEQ ID NO: 2848560 - protein, 11 aa, Entamoeba invadens
EAKEEEKGTEV

SEQ ID NO: 2848561 - protein, 13 aa, Entamoeba invadens
EAKEEKKELPKED

SEQ ID NO: 2848562 - protein, 58 aa, Entamoeba invadens
EAKEEQKKDDELKEQELTKQKEKDDQSKKDAQTTPKTDEENTKVEKVQSPETPTTPSH

SEQ ID NO: 2848563 - protein, 8 aa, Entamoeba invadens
EAKEGNKF

SEQ ID NO: 2848564 - protein, 5 aa, Entamoeba invadens
EAKEK

SEQ ID NO: 2848565 - protein, 6 aa, Entamoeba invadens
EAKENN

SEQ ID NO: 2848566 - protein, 15 aa, Entamoeba invadens
EAKEPSKVEPTKQDE

SEQ ID NO: 2848567 - protein, 16 aa, Entamoeba invadens
EAKERIPVDRFAVYSL

SEQ ID NO: 2848568 - protein, 9 aa, Entamoeba invadens
EAKESTQFD

SEQ ID NO: 2848569 - protein, 8 aa, Entamoeba invadens
EAKETGIE

SEQ ID NO: 2848570 - protein, 10 aa, Entamoeba invadens
EAKETKPDEL

SEQ ID NO: 2848571 - protein, 7 aa, Entamoeba invadens
EAKGKVT

SEQ ID NO: 2848572 - protein, 7 aa, Entamoeba invadens
EAKGNDN

SEQ ID NO: 2848573 - protein, 9 aa, Entamoeba invadens
EAKKAAIRA

SEQ ID NO: 2848574 - protein, 8 aa, Entamoeba invadens
EAKKDLAA

SEQ ID NO: 2848575 - protein, 6 aa, Entamoeba invadens
EAKKEN

SEQ ID NO: 2848576 - protein, 11 aa, Entamoeba invadens
EAKKKGSTMFT

SEQ ID NO: 2848577 - protein, 5 aa, Entamoeba invadens
EAKKM

SEQ ID NO: 2848578 - protein, 13 aa, Entamoeba invadens
EAKKPKKAEEDTL

SEQ ID NO: 2848579 - protein, 5 aa, Entamoeba invadens
EAKKQ

SEQ ID NO: 2848580 - protein, 8 aa, Entamoeba invadens
EAKKRCSI

SEQ ID NO: 2848581 - protein, 8 aa, Entamoeba invadens
EAKKYKEN

SEQ ID NO: 2848582 - protein, 9 aa, Entamoeba invadens
EAKNENEMI

SEQ ID NO: 2848583 - protein, 6 aa, Entamoeba invadens
EAKNTW

SEQ ID NO: 2848584 - protein, 6 aa, Entamoeba invadens
EAKNYD

SEQ ID NO: 2848585 - protein, 10 aa, Entamoeba invadens
EAKPEETNKF

SEQ ID NO: 2848586 - protein, 11 aa, Entamoeba invadens
EAKPEETNKFK

SEQ ID NO: 2848587 - protein, 9 aa, Entamoeba invadens
EAKPEETYK

SEQ ID NO: 2848588 - protein, 11 aa, Entamoeba invadens
EAKPNSEVTPL

SEQ ID NO: 2848589 - protein, 11 aa, Entamoeba invadens
EAKQEQEQSTM

SEQ ID NO: 2848590 - protein, 24 aa, Entamoeba invadens
EAKQEQPPQYTNPVPNTKRWNFPK

SEQ ID NO: 2848591 - protein, 10 aa, Entamoeba invadens
EAKQTQPIAQ

SEQ ID NO: 2848592 - protein, 4 aa, Entamoeba invadens
EAKR

SEQ ID NO: 2848593 - protein, 8 aa, Entamoeba invadens
EAKREEVG

SEQ ID NO: 2848594 - protein, 22 aa, Entamoeba invadens
EAKRGISLDGNELGSYSSENFN

SEQ ID NO: 2848595 - protein, 9 aa, Entamoeba invadens
EAKRIAAEN

SEQ ID NO: 2848596 - protein, 16 aa, Entamoeba invadens
EAKRPQEEQKKKKCLL

SEQ ID NO: 2848597 - protein, 7 aa, Entamoeba invadens
EAKRQIE

SEQ ID NO: 2848598 - protein, 5 aa, Entamoeba invadens
EAKRS

SEQ ID NO: 2848599 - protein, 5 aa, Entamoeba invadens
EAKSD

SEQ ID NO: 2848600 - protein, 12 aa, Entamoeba invadens
EAKSEENDKKEF

SEQ ID NO: 2848601 - protein, 11 aa, Entamoeba invadens
EAKSEESSMPG

SEQ ID NO: 2848602 - protein, 12 aa, Entamoeba invadens
EAKSKLAKIEES

SEQ ID NO: 2848603 - protein, 8 aa, Entamoeba invadens
EAKSKQVK

SEQ ID NO: 2848604 - protein, 8 aa, Entamoeba invadens
EAKSQEDL

SEQ ID NO: 2848605 - protein, 12 aa, Entamoeba invadens
EAKSSLTNYQGL

SEQ ID NO: 2848606 - protein, 16 aa, Entamoeba invadens
EAKSTFQKNQKKPVDS

SEQ ID NO: 2848607 - protein, 7 aa, Entamoeba invadens
EAKTGEL

SEQ ID NO: 2848608 - protein, 11 aa, Entamoeba invadens
EAKTKADWRNY

SEQ ID NO: 2848609 - protein, 8 aa, Entamoeba invadens
EAKTNGEI

SEQ ID NO: 2848610 - protein, 6 aa, Entamoeba invadens
EAKVKG

SEQ ID NO: 2848611 - protein, 4 aa, Entamoeba invadens
EAKY

SEQ ID NO: 2848612 - protein, 7 aa, Entamoeba invadens
EAKYETK

SEQ ID NO: 2848613 - protein, 8 aa, Entamoeba invadens
EALAESDI

SEQ ID NO: 2848614 - protein, 7 aa, Entamoeba invadens
EALENPK

SEQ ID NO: 2848615 - protein, 6 aa, Entamoeba invadens
EALGPE

SEQ ID NO: 2848616 - protein, 13 aa, Entamoeba invadens
EALKAGKPNPYPF

SEQ ID NO: 2848617 - protein, 8 aa, Entamoeba invadens
EALNTDEG

SEQ ID NO: 2848618 - protein, 13 aa, Entamoeba invadens
EALPQKSELPAKS

SEQ ID NO: 2848619 - protein, 5 aa, Entamoeba invadens
EALPS

SEQ ID NO: 2848620 - protein, 16 aa, Entamoeba invadens
EALPSTLESLRKLWGV

SEQ ID NO: 2848621 - protein, 7 aa, Entamoeba invadens
EALPSTQ

SEQ ID NO: 2848622 - protein, 5 aa, Entamoeba invadens
EALQP

SEQ ID NO: 2848623 - protein, 7 aa, Entamoeba invadens
EALSEKL

SEQ ID NO: 2848624 - protein, 6 aa, Entamoeba invadens
EALSPE

SEQ ID NO: 2848625 - protein, 8 aa, Entamoeba invadens
EALSPYKY

SEQ ID NO: 2848626 - protein, 8 aa, Entamoeba invadens
EALSTDQD

SEQ ID NO: 2848627 - protein, 7 aa, Entamoeba invadens
EALTDDR

SEQ ID NO: 2848628 - protein, 30 aa, Entamoeba invadens
EAMDQRREKHEKDNNDRKLTKSERKKKEWE

SEQ ID NO: 2848629 - protein, 69 aa, Entamoeba invadens
EAMKKQSQQKSSEHAQVTRSEQVLDNSNKQSQLSEQSLTENTESEQPSPLKRKERVVKKNKEDSDFSYP

SEQ ID NO: 2848630 - protein, 21 aa, Entamoeba invadens
EAMKSGSKQMSPKTSKSDKKT

SEQ ID NO: 2848631 - protein, 5 aa, Entamoeba invadens
EAMQS

SEQ ID NO: 2848632 - protein, 24 aa, Entamoeba invadens
EANAAPKNNSSYIGKDFDSDEDSV

SEQ ID NO: 2848633 - protein, 7 aa, Entamoeba invadens
EANDERC

SEQ ID NO: 2848634 - protein, 12 aa, Entamoeba invadens
EANDKKSEVGNL

SEQ ID NO: 2848635 - protein, 7 aa, Entamoeba invadens
EANDRQA

SEQ ID NO: 2848636 - protein, 8 aa, Entamoeba invadens
EANETRER

SEQ ID NO: 2848637 - protein, 5 aa, Entamoeba invadens
EANGM

SEQ ID NO: 2848638 - protein, 6 aa, Entamoeba invadens
EANKDE

SEQ ID NO: 2848639 - protein, 40 aa, Entamoeba invadens
EANKENKNNLEIAERKSETPKKDETITNKPTENDEDDEVQ

SEQ ID NO: 2848640 - protein, 9 aa, Entamoeba invadens
EANKETRLG

SEQ ID NO: 2848641 - protein, 7 aa, Entamoeba invadens
EANKSQN

SEQ ID NO: 2848642 - protein, 11 aa, Entamoeba invadens
EANKTNAPSSE

SEQ ID NO: 2848643 - protein, 13 aa, Entamoeba invadens
EANNLSKKYGGAG

SEQ ID NO: 2848644 - protein, 18 aa, Entamoeba invadens
EANNRQPRVWEGAIDINS

SEQ ID NO: 2848645 - protein, 6 aa, Entamoeba invadens
EANNSE

SEQ ID NO: 2848646 - protein, 7 aa, Entamoeba invadens
EANNTEI

SEQ ID NO: 2848647 - protein, 17 aa, Entamoeba invadens
EANNTKEKLTKKANDLT

SEQ ID NO: 2848648 - protein, 8 aa, Entamoeba invadens
EANPFKQA

SEQ ID NO: 2848649 - protein, 11 aa, Entamoeba invadens
EANQNSVAKAG

SEQ ID NO: 2848650 - protein, 7 aa, Entamoeba invadens
EANSRDQ

SEQ ID NO: 2848651 - protein, 18 aa, Entamoeba invadens
EANVSRKSSKYTKNAMKL

SEQ ID NO: 2848652 - protein, 6 aa, Entamoeba invadens
EAPARS

SEQ ID NO: 2848653 - protein, 4 aa, Entamoeba invadens
EAPD

SEQ ID NO: 2848654 - protein, 9 aa, Entamoeba invadens
EAPDKEVEA

SEQ ID NO: 2848655 - protein, 7 aa, Entamoeba invadens
EAPEEAY

SEQ ID NO: 2848656 - protein, 12 aa, Entamoeba invadens
EAPESAPTGQMP

SEQ ID NO: 2848657 - protein, 14 aa, Entamoeba invadens
EAPESMPPGETPQT

SEQ ID NO: 2848658 - protein, 5 aa, Entamoeba invadens
EAPIE

SEQ ID NO: 2848659 - protein, 13 aa, Entamoeba invadens
EAPKAKTPLTTST

SEQ ID NO: 2848660 - protein, 6 aa, Entamoeba invadens
EAPKDK

SEQ ID NO: 2848661 - protein, 11 aa, Entamoeba invadens
EAPKEEQKTCC

SEQ ID NO: 2848662 - protein, 7 aa, Entamoeba invadens
EAPKSKN

SEQ ID NO: 2848663 - protein, 21 aa, Entamoeba invadens
EAPKTQEVMPAKSEARPLNAL

SEQ ID NO: 2848664 - protein, 12 aa, Entamoeba invadens
EAPKTSKSPVAN

SEQ ID NO: 2848665 - protein, 8 aa, Entamoeba invadens
EAPLSNQE

SEQ ID NO: 2848666 - protein, 4 aa, Entamoeba invadens
EAPP

SEQ ID NO: 2848667 - protein, 5 aa, Entamoeba invadens
EAPPT

SEQ ID NO: 2848668 - protein, 13 aa, Entamoeba invadens
EAPQGGNLEGIEK

SEQ ID NO: 2848669 - protein, 10 aa, Entamoeba invadens
EAPQTEKEAI

SEQ ID NO: 2848670 - protein, 14 aa, Entamoeba invadens
EAPRLDQIEKTGTL

SEQ ID NO: 2848671 - protein, 30 aa, Entamoeba invadens
EAPSESERAKYSYEQERKRIEKEEEDKRNA

SEQ ID NO: 2848672 - protein, 9 aa, Entamoeba invadens
EAPSNSPKC

SEQ ID NO: 2848673 - protein, 7 aa, Entamoeba invadens
EAPSRGV

SEQ ID NO: 2848674 - protein, 4 aa, Entamoeba invadens
EAPV

SEQ ID NO: 2848675 - protein, 10 aa, Entamoeba invadens
EAPVGPEQQE

SEQ ID NO: 2848676 - protein, 5 aa, Entamoeba invadens
EAQDE

SEQ ID NO: 2848677 - protein, 5 aa, Entamoeba invadens
EAQDF

SEQ ID NO: 2848678 - protein, 5 aa, Entamoeba invadens
EAQDQ

SEQ ID NO: 2848679 - protein, 4 aa, Entamoeba invadens
EAQE

SEQ ID NO: 2848680 - protein, 7 aa, Entamoeba invadens
EAQEDEM

SEQ ID NO: 2848681 - protein, 7 aa, Entamoeba invadens
EAQEEGR

SEQ ID NO: 2848682 - protein, 10 aa, Entamoeba invadens
EAQEVGKKIG

SEQ ID NO: 2848683 - protein, 13 aa, Entamoeba invadens
EAQGIDKDVFWGS

SEQ ID NO: 2848684 - protein, 6 aa, Entamoeba invadens
EAQGRK

SEQ ID NO: 2848685 - protein, 6 aa, Entamoeba invadens
EAQIDG

SEQ ID NO: 2848686 - protein, 13 aa, Entamoeba invadens
EAQIEQEAKEKIQ

SEQ ID NO: 2848687 - protein, 203 aa, Entamoeba invadens
EAQKAAPKPQGQQPYPPQQGQCPPQQGGQYGYPPQQGYPPQGQPSYPPQQQGQYPGYPPQQGSQPQGQQGYPPQQGYPPQGQPGYPPQQYPGYPPQQGYGYPPQGQYGYPPQQGAQQPQGQAKPAQPTQPQQGQQQGYPPQGQYGYPPQGQQAYLPQQQGQYPGYPPQQAYPPQGYPPQQGYPGYPPQGQYGYPPQAQQQPPK

SEQ ID NO: 2848688 - protein, 12 aa, Entamoeba invadens
EAQKKDKENIQN

SEQ ID NO: 2848689 - protein, 6 aa, Entamoeba invadens
EAQKNA

SEQ ID NO: 2848690 - protein, 6 aa, Entamoeba invadens
EAQKYH

SEQ ID NO: 2848691 - protein, 11 aa, Entamoeba invadens
EAQNAQDTYRR

SEQ ID NO: 2848692 - protein, 26 aa, Entamoeba invadens
EAQNDTIASARDAKNAEKKKKALDSI

SEQ ID NO: 2848693 - protein, 15 aa, Entamoeba invadens
EAQRAIQKSDLQQLS

SEQ ID NO: 2848694 - protein, 8 aa, Entamoeba invadens
EAQRFEEK

SEQ ID NO: 2848695 - protein, 4 aa, Entamoeba invadens
EAQS

SEQ ID NO: 2848696 - protein, 17 aa, Entamoeba invadens
EAQSDTSTEDSVDEQPL

SEQ ID NO: 2848697 - protein, 17 aa, Entamoeba invadens
EAQSKKDQRLKGQHTAQ

SEQ ID NO: 2848698 - protein, 11 aa, Entamoeba invadens
EAQTLSRPQTR

SEQ ID NO: 2848699 - protein, 11 aa, Entamoeba invadens
EAQTTKNGTYQ

SEQ ID NO: 2848700 - protein, 9 aa, Entamoeba invadens
EARDERKDV

SEQ ID NO: 2848701 - protein, 5 aa, Entamoeba invadens
EARDG

SEQ ID NO: 2848702 - protein, 9 aa, Entamoeba invadens
EARETQGLR

SEQ ID NO: 2848703 - protein, 10 aa, Entamoeba invadens
EARGEDPTNV

SEQ ID NO: 2848704 - protein, 7 aa, Entamoeba invadens
EARHDGK

SEQ ID NO: 2848705 - protein, 9 aa, Entamoeba invadens
EARKDLTKA

SEQ ID NO: 2848706 - protein, 9 aa, Entamoeba invadens
EARKKEVEQ

SEQ ID NO: 2848707 - protein, 7 aa, Entamoeba invadens
EARKYTT

SEQ ID NO: 2848708 - protein, 8 aa, Entamoeba invadens
EARLEERE

SEQ ID NO: 2848709 - protein, 12 aa, Entamoeba invadens
EARNQNEITVTQ

SEQ ID NO: 2848710 - protein, 13 aa, Entamoeba invadens
EASADESNFASET

SEQ ID NO: 2848711 - protein, 12 aa, Entamoeba invadens
EASAETELSIQR

SEQ ID NO: 2848712 - protein, 6 aa, Entamoeba invadens
EASAPM

SEQ ID NO: 2848713 - protein, 8 aa, Entamoeba invadens
EASAQPMQ

SEQ ID NO: 2848714 - protein, 10 aa, Entamoeba invadens
EASEGSLEQF

SEQ ID NO: 2848715 - protein, 6 aa, Entamoeba invadens
EASERT

SEQ ID NO: 2848716 - protein, 8 aa, Entamoeba invadens
EASESSGF

SEQ ID NO: 2848717 - protein, 8 aa, Entamoeba invadens
EASGEHVE

SEQ ID NO: 2848718 - protein, 5 aa, Entamoeba invadens
EASGY

SEQ ID NO: 2848719 - protein, 18 aa, Entamoeba invadens
EASHETDSFRTAASRSRS

SEQ ID NO: 2848720 - protein, 15 aa, Entamoeba invadens
EASHSDQSKSKKISE

SEQ ID NO: 2848721 - protein, 6 aa, Entamoeba invadens
EASITL

SEQ ID NO: 2848722 - protein, 9 aa, Entamoeba invadens
EASKNKNVK

SEQ ID NO: 2848723 - protein, 5 aa, Entamoeba invadens
EASKS

SEQ ID NO: 2848724 - protein, 15 aa, Entamoeba invadens
EASLPTVGGDNANNR

SEQ ID NO: 2848725 - protein, 7 aa, Entamoeba invadens
EASNNSL

SEQ ID NO: 2848726 - protein, 9 aa, Entamoeba invadens
EASNPGHVD

SEQ ID NO: 2848727 - protein, 11 aa, Entamoeba invadens
EASPRSKSDSI

SEQ ID NO: 2848728 - protein, 14 aa, Entamoeba invadens
EASQQQLVSPTSQK

SEQ ID NO: 2848729 - protein, 6 aa, Entamoeba invadens
EASRGV

SEQ ID NO: 2848730 - protein, 5 aa, Entamoeba invadens
EASRM

SEQ ID NO: 2848731 - protein, 8 aa, Entamoeba invadens
EASTNASH

SEQ ID NO: 2848732 - protein, 7 aa, Entamoeba invadens
EASTQGI

SEQ ID NO: 2848733 - protein, 9 aa, Entamoeba invadens
EASTQGNHK

SEQ ID NO: 2848734 - protein, 6 aa, Entamoeba invadens
EASTQR

SEQ ID NO: 2848735 - protein, 35 aa, Entamoeba invadens
EATAKRNEAEKIQKMKEKKEEEDQLAEQKKRTKYD

SEQ ID NO: 2848736 - protein, 5 aa, Entamoeba invadens
EATAR

SEQ ID NO: 2848737 - protein, 5 aa, Entamoeba invadens
EATAT

SEQ ID NO: 2848738 - protein, 11 aa, Entamoeba invadens
EATDDTELSLN

SEQ ID NO: 2848739 - protein, 11 aa, Entamoeba invadens
EATEDDEVSLK

SEQ ID NO: 2848740 - protein, 7 aa, Entamoeba invadens
EATEPQI

SEQ ID NO: 2848741 - protein, 5 aa, Entamoeba invadens
EATFT

SEQ ID NO: 2848742 - protein, 6 aa, Entamoeba invadens
EATGED

SEQ ID NO: 2848743 - protein, 7 aa, Entamoeba invadens
EATGEQG

SEQ ID NO: 2848744 - protein, 6 aa, Entamoeba invadens
EATGEV

SEQ ID NO: 2848745 - protein, 15 aa, Entamoeba invadens
EATHGQQDITLFFYR

SEQ ID NO: 2848746 - protein, 5 aa, Entamoeba invadens
EATKA

SEQ ID NO: 2848747 - protein, 8 aa, Entamoeba invadens
EATKEQRL

SEQ ID NO: 2848748 - protein, 188 aa, Entamoeba invadens
EATKKAEESKKAAEESKQKNSEAKEALEISTKKAEESAAKAEEARQKVEEATQRDNEAAEKVEISNQRLEESKQKVEEATARDNEASEKVEISNQRLEEAKQRLEEATEADNEAAQKLEVSKQKLQESEEKLQISQQKVEEATQKLEESVNTAQISANAAEVAKKDEDDAIERQKEAQAAEDEVTKAL

SEQ ID NO: 2848749 - protein, 9 aa, Entamoeba invadens
EATNNLNKI

SEQ ID NO: 2848750 - protein, 14 aa, Entamoeba invadens
EATNRLKKSVSNMN

SEQ ID NO: 2848751 - protein, 6 aa, Entamoeba invadens
EATPLK

SEQ ID NO: 2848752 - protein, 10 aa, Entamoeba invadens
EATPQQRGER

SEQ ID NO: 2848753 - protein, 10 aa, Entamoeba invadens
EATRKEYDNV

SEQ ID NO: 2848754 - protein, 7 aa, Entamoeba invadens
EATRNAI

SEQ ID NO: 2848755 - protein, 6 aa, Entamoeba invadens
EATSTS

SEQ ID NO: 2848756 - protein, 8 aa, Entamoeba invadens
EATTDKKT

SEQ ID NO: 2848757 - protein, 5 aa, Entamoeba invadens
EATTI

SEQ ID NO: 2848758 - protein, 5 aa, Entamoeba invadens
EATTL

SEQ ID NO: 2848759 - protein, 21 aa, Entamoeba invadens
EATTLKTEKAHEDHLSPENDA

SEQ ID NO: 2848760 - protein, 10 aa, Entamoeba invadens
EATVGTQRTI

SEQ ID NO: 2848761 - protein, 4 aa, Entamoeba invadens
EAVA

SEQ ID NO: 2848762 - protein, 7 aa, Entamoeba invadens
EAVAPTT

SEQ ID NO: 2848763 - protein, 4 aa, Entamoeba invadens
EAVE

SEQ ID NO: 2848764 - protein, 14 aa, Entamoeba invadens
EAVGTSKKTDDTNV

SEQ ID NO: 2848765 - protein, 56 aa, Entamoeba invadens
EAVKEKDVKKKKVAEKMGEDLAPAVNDSKASLADKQNKEKKEKAKESIKKLKEDLE

SEQ ID NO: 2848766 - protein, 5 aa, Entamoeba invadens
EAVKT

SEQ ID NO: 2848767 - protein, 6 aa, Entamoeba invadens
EAVNGK

SEQ ID NO: 2848768 - protein, 20 aa, Entamoeba invadens
EAVNPPKGGFDYKTQYGEKV

SEQ ID NO: 2848769 - protein, 22 aa, Entamoeba invadens
EAVQTDNDTQVSFTEKDENNLY

SEQ ID NO: 2848770 - protein, 5 aa, Entamoeba invadens
EAVST

SEQ ID NO: 2848771 - protein, 14 aa, Entamoeba invadens
EAVTETTAEGNDVE

SEQ ID NO: 2848772 - protein, 61 aa, Entamoeba invadens
EAYDNDKQDLTAKAARFKKNASKYKEALAQAEEQKQKLSDDLAKAKAGGGSSAETKDLKSR

SEQ ID NO: 2848773 - protein, 5 aa, Entamoeba invadens
EAYGS

SEQ ID NO: 2848774 - protein, 9 aa, Entamoeba invadens
EAYKKDSFK

SEQ ID NO: 2848775 - protein, 27 aa, Entamoeba invadens
EAYKNKAVSVPKNAPTELFEKIKKIHG

SEQ ID NO: 2848776 - protein, 14 aa, Entamoeba invadens
EAYPDENIYNNTTN

SEQ ID NO: 2848777 - protein, 7 aa, Entamoeba invadens
EAYPKKD

SEQ ID NO: 2848778 - protein, 6 aa, Entamoeba invadens
EAYQKD

SEQ ID NO: 2848779 - protein, 6 aa, Entamoeba invadens
EAYSKS

SEQ ID NO: 2848780 - protein, 4 aa, Entamoeba invadens
ECAD

SEQ ID NO: 2848781 - protein, 18 aa, Entamoeba invadens
ECAKEAKDEMNNKNYGNT

SEQ ID NO: 2848782 - protein, 16 aa, Entamoeba invadens
ECAKEKEHLQEEVDEG

SEQ ID NO: 2848783 - protein, 16 aa, Entamoeba invadens
ECANDSKSMTTTTRPK

SEQ ID NO: 2848784 - protein, 5 aa, Entamoeba invadens
ECDGP

SEQ ID NO: 2848785 - protein, 7 aa, Entamoeba invadens
ECDRYSK

SEQ ID NO: 2848786 - protein, 10 aa, Entamoeba invadens
ECDSGKYGNC

SEQ ID NO: 2848787 - protein, 17 aa, Entamoeba invadens
ECDSTCSDGKCDNNNGN

SEQ ID NO: 2848788 - protein, 16 aa, Entamoeba invadens
ECDTSNNSIRSPRTKF

SEQ ID NO: 2848789 - protein, 19 aa, Entamoeba invadens
ECDTTETLNNDNNMDNNYN

SEQ ID NO: 2848790 - protein, 7 aa, Entamoeba invadens
ECDTTKD

SEQ ID NO: 2848791 - protein, 7 aa, Entamoeba invadens
ECDVESE

SEQ ID NO: 2848792 - protein, 14 aa, Entamoeba invadens
ECEEEDGDKSEEIV

SEQ ID NO: 2848793 - protein, 11 aa, Entamoeba invadens
ECEKKTPTGLE

SEQ ID NO: 2848794 - protein, 8 aa, Entamoeba invadens
ECEKNERR

SEQ ID NO: 2848795 - protein, 6 aa, Entamoeba invadens
ECENGY

SEQ ID NO: 2848796 - protein, 8 aa, Entamoeba invadens
ECENPKSV

SEQ ID NO: 2848797 - protein, 23 aa, Entamoeba invadens
ECENSDKVVENSECPKTSTSESW

SEQ ID NO: 2848798 - protein, 24 aa, Entamoeba invadens
ECESMKKKREDEIDTLGNEVKEKT

SEQ ID NO: 2848799 - protein, 6 aa, Entamoeba invadens
ECEVEK

SEQ ID NO: 2848800 - protein, 7 aa, Entamoeba invadens
ECEVQNS

SEQ ID NO: 2848801 - protein, 6 aa, Entamoeba invadens
ECEYGS

SEQ ID NO: 2848802 - protein, 5 aa, Entamoeba invadens
ECFTG

SEQ ID NO: 2848803 - protein, 6 aa, Entamoeba invadens
ECGEKQ

SEQ ID NO: 2848804 - protein, 6 aa, Entamoeba invadens
ECGGDI

SEQ ID NO: 2848805 - protein, 8 aa, Entamoeba invadens
ECGRGVNQ

SEQ ID NO: 2848806 - protein, 4 aa, Entamoeba invadens
ECGT

SEQ ID NO: 2848807 - protein, 12 aa, Entamoeba invadens
ECGTNDPKTRYA

SEQ ID NO: 2848808 - protein, 7 aa, Entamoeba invadens
ECGTTQH

SEQ ID NO: 2848809 - protein, 18 aa, Entamoeba invadens
ECHGNDGKEGGCTGGFKS

SEQ ID NO: 2848810 - protein, 23 aa, Entamoeba invadens
ECKDYGERKCKTCENNYYPNPLT

SEQ ID NO: 2848811 - protein, 7 aa, Entamoeba invadens
ECKEGYG

SEQ ID NO: 2848812 - protein, 4 aa, Entamoeba invadens
ECKM

SEQ ID NO: 2848813 - protein, 21 aa, Entamoeba invadens
ECKSGETKNSVDCKETSESSI

SEQ ID NO: 2848814 - protein, 16 aa, Entamoeba invadens
ECKSIENEIKHSAQSV

SEQ ID NO: 2848815 - protein, 7 aa, Entamoeba invadens
ECKTEKE

SEQ ID NO: 2848816 - protein, 6 aa, Entamoeba invadens
ECLDED

SEQ ID NO: 2848817 - protein, 10 aa, Entamoeba invadens
ECLPKGRTAE

SEQ ID NO: 2848818 - protein, 11 aa, Entamoeba invadens
ECNEPGTEAAR

SEQ ID NO: 2848819 - protein, 28 aa, Entamoeba invadens
ECNNKNGENFKDKQDQVVGQSESQSSTN

SEQ ID NO: 2848820 - protein, 9 aa, Entamoeba invadens
ECNPKMDAK

SEQ ID NO: 2848821 - protein, 5 aa, Entamoeba invadens
ECPEC

SEQ ID NO: 2848822 - protein, 10 aa, Entamoeba invadens
ECPKGKNEEL

SEQ ID NO: 2848823 - protein, 12 aa, Entamoeba invadens
ECPTDSNPSYYT

SEQ ID NO: 2848824 - protein, 16 aa, Entamoeba invadens
ECQDKEKGTESKQSCL

SEQ ID NO: 2848825 - protein, 27 aa, Entamoeba invadens
ECQHSQSKVGELKTQLEKPQLKFVVFD

SEQ ID NO: 2848826 - protein, 8 aa, Entamoeba invadens
ECQKEEEL

SEQ ID NO: 2848827 - protein, 5 aa, Entamoeba invadens
ECQRT

SEQ ID NO: 2848828 - protein, 6 aa, Entamoeba invadens
ECQTNG

SEQ ID NO: 2848829 - protein, 5 aa, Entamoeba invadens
ECREQ

SEQ ID NO: 2848830 - protein, 14 aa, Entamoeba invadens
ECSEKSGDLVKPYD

SEQ ID NO: 2848831 - protein, 5 aa, Entamoeba invadens
ECSET

SEQ ID NO: 2848832 - protein, 10 aa, Entamoeba invadens
ECSGENPDIL

SEQ ID NO: 2848833 - protein, 7 aa, Entamoeba invadens
ECSGKTS

SEQ ID NO: 2848834 - protein, 8 aa, Entamoeba invadens
ECSKEKQF

SEQ ID NO: 2848835 - protein, 5 aa, Entamoeba invadens
ECSKF

SEQ ID NO: 2848836 - protein, 11 aa, Entamoeba invadens
ECSNDEDATRE

SEQ ID NO: 2848837 - protein, 10 aa, Entamoeba invadens
ECSNEIPSGC

SEQ ID NO: 2848838 - protein, 6 aa, Entamoeba invadens
ECSQSN

SEQ ID NO: 2848839 - protein, 10 aa, Entamoeba invadens
ECSRVNRRGG

SEQ ID NO: 2848840 - protein, 4 aa, Entamoeba invadens
ECST

SEQ ID NO: 2848841 - protein, 24 aa, Entamoeba invadens
ECSTKLSKSDFNLTTRGGYRPITP

SEQ ID NO: 2848842 - protein, 7 aa, Entamoeba invadens
ECTGNRW

SEQ ID NO: 2848843 - protein, 7 aa, Entamoeba invadens
ECTPAKV

SEQ ID NO: 2848844 - protein, 12 aa, Entamoeba invadens
ECTTCDSATQCT

SEQ ID NO: 2848845 - protein, 5 aa, Entamoeba invadens
ECTTD

SEQ ID NO: 2848846 - protein, 5 aa, Entamoeba invadens
ECVSS

SEQ ID NO: 2848847 - protein, 14 aa, Entamoeba invadens
ECYSRNPSKFDGVD

SEQ ID NO: 2848848 - protein, 13 aa, Entamoeba invadens
ECYSRNPTKFDGV

SEQ ID NO: 2848849 - protein, 6 aa, Entamoeba invadens
EDAAGR

SEQ ID NO: 2848850 - protein, 17 aa, Entamoeba invadens
EDADGNQQQYNSNISNV

SEQ ID NO: 2848851 - protein, 10 aa, Entamoeba invadens
EDADPDETGV

SEQ ID NO: 2848852 - protein, 6 aa, Entamoeba invadens
EDAETA

SEQ ID NO: 2848853 - protein, 12 aa, Entamoeba invadens
EDAETGEKTGSA

SEQ ID NO: 2848854 - protein, 9 aa, Entamoeba invadens
EDAETYQDA

SEQ ID NO: 2848855 - protein, 19 aa, Entamoeba invadens
EDAFGDEGDKTRNIPPKAE

SEQ ID NO: 2848856 - protein, 8 aa, Entamoeba invadens
EDAGEIKK

SEQ ID NO: 2848857 - protein, 5 aa, Entamoeba invadens
EDAGV

SEQ ID NO: 2848858 - protein, 4 aa, Entamoeba invadens
EDAI

SEQ ID NO: 2848859 - protein, 4 aa, Entamoeba invadens
EDAK

SEQ ID NO: 2848860 - protein, 6 aa, Entamoeba invadens
EDAKKG

SEQ ID NO: 2848861 - protein, 11 aa, Entamoeba invadens
EDAKNTANQAV

SEQ ID NO: 2848862 - protein, 8 aa, Entamoeba invadens
EDAKRAID

SEQ ID NO: 2848863 - protein, 10 aa, Entamoeba invadens
EDAKRSYPRG

SEQ ID NO: 2848864 - protein, 4 aa, Entamoeba invadens
EDAL

SEQ ID NO: 2848865 - protein, 22 aa, Entamoeba invadens
EDALNGLPEGFTKEKKREDLEK

SEQ ID NO: 2848866 - protein, 4 aa, Entamoeba invadens
EDAQ

SEQ ID NO: 2848867 - protein, 9 aa, Entamoeba invadens
EDAQINTTD

SEQ ID NO: 2848868 - protein, 18 aa, Entamoeba invadens
EDARKTFENKVQQQKDEL

SEQ ID NO: 2848869 - protein, 10 aa, Entamoeba invadens
EDARPKAEGR

SEQ ID NO: 2848870 - protein, 6 aa, Entamoeba invadens
EDARSF

SEQ ID NO: 2848871 - protein, 12 aa, Entamoeba invadens
EDARVKKGLPET

SEQ ID NO: 2848872 - protein, 7 aa, Entamoeba invadens
EDASDEI

SEQ ID NO: 2848873 - protein, 27 aa, Entamoeba invadens
EDASEEIKQKYEAAEKVAKKGKKARWT

SEQ ID NO: 2848874 - protein, 8 aa, Entamoeba invadens
EDASRFSQ

SEQ ID NO: 2848875 - protein, 5 aa, Entamoeba invadens
EDATK

SEQ ID NO: 2848876 - protein, 23 aa, Entamoeba invadens
EDAVPPEQPENDGDKKHGGCCAI

SEQ ID NO: 2848877 - protein, 8 aa, Entamoeba invadens
EDCETESV

SEQ ID NO: 2848878 - protein, 4 aa, Entamoeba invadens
EDCS

SEQ ID NO: 2848879 - protein, 18 aa, Entamoeba invadens
EDCSSSEIVKEKRANAIQ

SEQ ID NO: 2848880 - protein, 7 aa, Entamoeba invadens
EDDAEVK

SEQ ID NO: 2848881 - protein, 8 aa, Entamoeba invadens
EDDAPSLT

SEQ ID NO: 2848882 - protein, 16 aa, Entamoeba invadens
EDDASSDSESSTTSKM

SEQ ID NO: 2848883 - protein, 8 aa, Entamoeba invadens
EDDDCYES

SEQ ID NO: 2848884 - protein, 26 aa, Entamoeba invadens
EDDDDDTEELEPQSPPPKLTKAASMF

SEQ ID NO: 2848885 - protein, 9 aa, Entamoeba invadens
EDDDDDWNP

SEQ ID NO: 2848886 - protein, 12 aa, Entamoeba invadens
EDDDDEGEDQNN

SEQ ID NO: 2848887 - protein, 28 aa, Entamoeba invadens
EDDDDEKKEQLGNISSDDEDDEEEEHIS

SEQ ID NO: 2848888 - protein, 10 aa, Entamoeba invadens
EDDDEQNQTF

SEQ ID NO: 2848889 - protein, 23 aa, Entamoeba invadens
EDDDESSSSSSSDESNESGEGIK

SEQ ID NO: 2848890 - protein, 11 aa, Entamoeba invadens
EDDDSDEELQK

SEQ ID NO: 2848891 - protein, 7 aa, Entamoeba invadens
EDDEELP

SEQ ID NO: 2848892 - protein, 8 aa, Entamoeba invadens
EDDEGVEK

SEQ ID NO: 2848893 - protein, 13 aa, Entamoeba invadens
EDDEKDKEGDSAY

SEQ ID NO: 2848894 - protein, 9 aa, Entamoeba invadens
EDDESHPVV

SEQ ID NO: 2848895 - protein, 8 aa, Entamoeba invadens
EDDGEEVG

SEQ ID NO: 2848896 - protein, 14 aa, Entamoeba invadens
EDDGEFAEDYNSDE

SEQ ID NO: 2848897 - protein, 15 aa, Entamoeba invadens
EDDGKTQWKLGDPKE

SEQ ID NO: 2848898 - protein, 12 aa, Entamoeba invadens
EDDGQETGNYGT

SEQ ID NO: 2848899 - protein, 5 aa, Entamoeba invadens
EDDGW

SEQ ID NO: 2848900 - protein, 12 aa, Entamoeba invadens
EDDHTPSKPLED

SEQ ID NO: 2848901 - protein, 4 aa, Entamoeba invadens
EDDI

SEQ ID NO: 2848902 - protein, 23 aa, Entamoeba invadens
EDDIADSRRRLPNATKIEDYEPQ

SEQ ID NO: 2848903 - protein, 18 aa, Entamoeba invadens
EDDIGKRVAEGELDPSTH

SEQ ID NO: 2848904 - protein, 16 aa, Entamoeba invadens
EDDKEDVDNNNETKEM

SEQ ID NO: 2848905 - protein, 5 aa, Entamoeba invadens
EDDKK

SEQ ID NO: 2848906 - protein, 7 aa, Entamoeba invadens
EDDKPIK

SEQ ID NO: 2848907 - protein, 9 aa, Entamoeba invadens
EDDKTEDIT

SEQ ID NO: 2848908 - protein, 14 aa, Entamoeba invadens
EDDKVEDGKDVTQR

SEQ ID NO: 2848909 - protein, 21 aa, Entamoeba invadens
EDDLNEWEKEDTLDEDDADLA

SEQ ID NO: 2848910 - protein, 13 aa, Entamoeba invadens
EDDMQIEKESREN

SEQ ID NO: 2848911 - protein, 17 aa, Entamoeba invadens
EDDMRMEEDEKIDDESD

SEQ ID NO: 2848912 - protein, 6 aa, Entamoeba invadens
EDDNED

SEQ ID NO: 2848913 - protein, 6 aa, Entamoeba invadens
EDDNFG

SEQ ID NO: 2848914 - protein, 6 aa, Entamoeba invadens
EDDNKN

SEQ ID NO: 2848915 - protein, 21 aa, Entamoeba invadens
EDDNPPKDSPGVRNFYSPADY

SEQ ID NO: 2848916 - protein, 9 aa, Entamoeba invadens
EDDNTTDVA

SEQ ID NO: 2848917 - protein, 7 aa, Entamoeba invadens
EDDPKEL

SEQ ID NO: 2848918 - protein, 5 aa, Entamoeba invadens
EDDRV

SEQ ID NO: 2848919 - protein, 8 aa, Entamoeba invadens
EDDSDQSF

SEQ ID NO: 2848920 - protein, 6 aa, Entamoeba invadens
EDDSMG

SEQ ID NO: 2848921 - protein, 17 aa, Entamoeba invadens
EDDSTKQKATKESHLGQ

SEQ ID NO: 2848922 - protein, 8 aa, Entamoeba invadens
EDDTIHPE

SEQ ID NO: 2848923 - protein, 16 aa, Entamoeba invadens
EDDTKRYSKMSPKPQY

SEQ ID NO: 2848924 - protein, 6 aa, Entamoeba invadens
EDDVAA

SEQ ID NO: 2848925 - protein, 20 aa, Entamoeba invadens
EDDVQSESGLSSEKKVPTTE

SEQ ID NO: 2848926 - protein, 11 aa, Entamoeba invadens
EDDYASGAVKE

SEQ ID NO: 2848927 - protein, 9 aa, Entamoeba invadens
EDDYKDTFE

SEQ ID NO: 2848928 - protein, 9 aa, Entamoeba invadens
EDEAEEKVN

SEQ ID NO: 2848929 - protein, 23 aa, Entamoeba invadens
EDEAERVRAISKGSLERYLLGKF

SEQ ID NO: 2848930 - protein, 5 aa, Entamoeba invadens
EDEAF

SEQ ID NO: 2848931 - protein, 9 aa, Entamoeba invadens
EDEDGNETK

SEQ ID NO: 2848932 - protein, 16 aa, Entamoeba invadens
EDEDPELADQIRSNPE

SEQ ID NO: 2848933 - protein, 5 aa, Entamoeba invadens
EDEDT

SEQ ID NO: 2848934 - protein, 17 aa, Entamoeba invadens
EDEEEEEPPKSTYKKKM

SEQ ID NO: 2848935 - protein, 5 aa, Entamoeba invadens
EDEEF

SEQ ID NO: 2848936 - protein, 13 aa, Entamoeba invadens
EDEEGVQKGFEEK

SEQ ID NO: 2848937 - protein, 13 aa, Entamoeba invadens
EDEELNQKRTQVV

SEQ ID NO: 2848938 - protein, 7 aa, Entamoeba invadens
EDEEPQI

SEQ ID NO: 2848939 - protein, 36 aa, Entamoeba invadens
EDEERLRKEEEERRERQELENKTSALEQDKEENLKN

SEQ ID NO: 2848940 - protein, 7 aa, Entamoeba invadens
EDEETAR

SEQ ID NO: 2848941 - protein, 11 aa, Entamoeba invadens
EDEETKHTDQF

SEQ ID NO: 2848942 - protein, 7 aa, Entamoeba invadens
EDEETKK

SEQ ID NO: 2848943 - protein, 28 aa, Entamoeba invadens
EDEETSQTATSKSSEASKLRKYTDDDVV

SEQ ID NO: 2848944 - protein, 5 aa, Entamoeba invadens
EDEEY

SEQ ID NO: 2848945 - protein, 4 aa, Entamoeba invadens
EDEF

SEQ ID NO: 2848946 - protein, 9 aa, Entamoeba invadens
EDEFENKRM

SEQ ID NO: 2848947 - protein, 14 aa, Entamoeba invadens
EDEGMNFDEQAETF

SEQ ID NO: 2848948 - protein, 6 aa, Entamoeba invadens
EDEIED

SEQ ID NO: 2848949 - protein, 10 aa, Entamoeba invadens
EDEIQAEESK

SEQ ID NO: 2848950 - protein, 6 aa, Entamoeba invadens
EDEIST

SEQ ID NO: 2848951 - protein, 8 aa, Entamoeba invadens
EDEKEAKD

SEQ ID NO: 2848952 - protein, 20 aa, Entamoeba invadens
EDEKEEKKAVKEKVEKEEEK

SEQ ID NO: 2848953 - protein, 7 aa, Entamoeba invadens
EDEKKKN

SEQ ID NO: 2848954 - protein, 6 aa, Entamoeba invadens
EDEKPY

SEQ ID NO: 2848955 - protein, 7 aa, Entamoeba invadens
EDEKTIK

SEQ ID NO: 2848956 - protein, 6 aa, Entamoeba invadens
EDELTS

SEQ ID NO: 2848957 - protein, 4 aa, Entamoeba invadens
EDEM

SEQ ID NO: 2848958 - protein, 29 aa, Entamoeba invadens
EDEMEERKEMEEKEQIDKKDDKSDEELEQ

SEQ ID NO: 2848959 - protein, 22 aa, Entamoeba invadens
EDEMKTCPKGYVGQSIKNYEAE

SEQ ID NO: 2848960 - protein, 6 aa, Entamoeba invadens
EDEMNR

SEQ ID NO: 2848961 - protein, 10 aa, Entamoeba invadens
EDENATKKRF

SEQ ID NO: 2848962 - protein, 5 aa, Entamoeba invadens
EDENE

SEQ ID NO: 2848963 - protein, 8 aa, Entamoeba invadens
EDENEESV

SEQ ID NO: 2848964 - protein, 6 aa, Entamoeba invadens
EDENKV

SEQ ID NO: 2848965 - protein, 6 aa, Entamoeba invadens
EDENLR

SEQ ID NO: 2848966 - protein, 18 aa, Entamoeba invadens
EDENQDLKNEISKTYDDL

SEQ ID NO: 2848967 - protein, 14 aa, Entamoeba invadens
EDEPKKMSQEEAKK

SEQ ID NO: 2848968 - protein, 11 aa, Entamoeba invadens
EDEQKNHTKTL

SEQ ID NO: 2848969 - protein, 12 aa, Entamoeba invadens
EDEQLKDDGEDV

SEQ ID NO: 2848970 - protein, 19 aa, Entamoeba invadens
EDEQSLDTPIIPPKNKKVI

SEQ ID NO: 2848971 - protein, 9 aa, Entamoeba invadens
EDERDNDNY

SEQ ID NO: 2848972 - protein, 10 aa, Entamoeba invadens
EDERRAHADT

SEQ ID NO: 2848973 - protein, 37 aa, Entamoeba invadens
EDERSKNEKRAEYREQKHQKQKGKNPKRIEKRVEKFD

SEQ ID NO: 2848974 - protein, 32 aa, Entamoeba invadens
EDERTLKQNQIKKNDVISGKKGMVKRKESPGF

SEQ ID NO: 2848975 - protein, 9 aa, Entamoeba invadens
EDERTNRDI

SEQ ID NO: 2848976 - protein, 16 aa, Entamoeba invadens
EDESEENKEVPMPDKE

SEQ ID NO: 2848977 - protein, 55 aa, Entamoeba invadens
EDESSSMSEESEHSEESDESKSSKEEETNQMSEDEKSTEEDSSEDTSSSDDSTQI

SEQ ID NO: 2848978 - protein, 7 aa, Entamoeba invadens
EDETFGN

SEQ ID NO: 2848979 - protein, 7 aa, Entamoeba invadens
EDETLSM

SEQ ID NO: 2848980 - protein, 9 aa, Entamoeba invadens
EDETTSSSR

SEQ ID NO: 2848981 - protein, 4 aa, Entamoeba invadens
EDEW

SEQ ID NO: 2848982 - protein, 5 aa, Entamoeba invadens
EDEYR

SEQ ID NO: 2848983 - protein, 10 aa, Entamoeba invadens
EDEYRRNSKT

SEQ ID NO: 2848984 - protein, 7 aa, Entamoeba invadens
EDEYTDV

SEQ ID NO: 2848985 - protein, 22 aa, Entamoeba invadens
EDFEPENGCDKNVYKSSVSSKV

SEQ ID NO: 2848986 - protein, 7 aa, Entamoeba invadens
EDFERPS

SEQ ID NO: 2848987 - protein, 7 aa, Entamoeba invadens
EDFGQDT

SEQ ID NO: 2848988 - protein, 5 aa, Entamoeba invadens
EDFKT

SEQ ID NO: 2848989 - protein, 5 aa, Entamoeba invadens
EDFPD

SEQ ID NO: 2848990 - protein, 13 aa, Entamoeba invadens
EDFPTLPKEEYDQ

SEQ ID NO: 2848991 - protein, 11 aa, Entamoeba invadens
EDFQDKQNEMR

SEQ ID NO: 2848992 - protein, 8 aa, Entamoeba invadens
EDFTPSKK

SEQ ID NO: 2848993 - protein, 6 aa, Entamoeba invadens
EDFTQT

SEQ ID NO: 2848994 - protein, 17 aa, Entamoeba invadens
EDGDDGSGIQEKIKNGS

SEQ ID NO: 2848995 - protein, 6 aa, Entamoeba invadens
EDGDKL

SEQ ID NO: 2848996 - protein, 7 aa, Entamoeba invadens
EDGEQKQ

SEQ ID NO: 2848997 - protein, 16 aa, Entamoeba invadens
EDGESGDVLGEPRKPL

SEQ ID NO: 2848998 - protein, 11 aa, Entamoeba invadens
EDGGVKDSVIT

SEQ ID NO: 2848999 - protein, 14 aa, Entamoeba invadens
EDGIAKPTAFRRYE

SEQ ID NO: 2849000 - protein, 4 aa, Entamoeba invadens
EDGK

SEQ ID NO: 2849001 - protein, 15 aa, Entamoeba invadens
EDGKASLQDYATNNK

SEQ ID NO: 2849002 - protein, 7 aa, Entamoeba invadens
EDGKENQ

SEQ ID NO: 2849003 - protein, 14 aa, Entamoeba invadens
EDGKFEVPNYEGNY

SEQ ID NO: 2849004 - protein, 10 aa, Entamoeba invadens
EDGKGRSTGK

SEQ ID NO: 2849005 - protein, 6 aa, Entamoeba invadens
EDGKPV

SEQ ID NO: 2849006 - protein, 9 aa, Entamoeba invadens
EDGKRHKSL

SEQ ID NO: 2849007 - protein, 13 aa, Entamoeba invadens
EDGKRNGQIPQSV

SEQ ID NO: 2849008 - protein, 16 aa, Entamoeba invadens
EDGKRSTQVQFCVYVY

SEQ ID NO: 2849009 - protein, 10 aa, Entamoeba invadens
EDGKTLDDKI

SEQ ID NO: 2849010 - protein, 7 aa, Entamoeba invadens
EDGKWRR

SEQ ID NO: 2849011 - protein, 5 aa, Entamoeba invadens
EDGKY

SEQ ID NO: 2849012 - protein, 9 aa, Entamoeba invadens
EDGLKDKLK

SEQ ID NO: 2849013 - protein, 9 aa, Entamoeba invadens
EDGLNDSDM

SEQ ID NO: 2849014 - protein, 4 aa, Entamoeba invadens
EDGN

SEQ ID NO: 2849015 - protein, 40 aa, Entamoeba invadens
EDGNDDDEKDDFPCKSPSAMSMDSGYGSNVENSREQLDNS

SEQ ID NO: 2849016 - protein, 7 aa, Entamoeba invadens
EDGNGFG

SEQ ID NO: 2849017 - protein, 7 aa, Entamoeba invadens
EDGNLTK

SEQ ID NO: 2849018 - protein, 10 aa, Entamoeba invadens
EDGNTSRLTE

SEQ ID NO: 2849019 - protein, 15 aa, Entamoeba invadens
EDGPKTQSKVDQKEL

SEQ ID NO: 2849020 - protein, 9 aa, Entamoeba invadens
EDGQDEASE

SEQ ID NO: 2849021 - protein, 7 aa, Entamoeba invadens
EDGQKYE

SEQ ID NO: 2849022 - protein, 6 aa, Entamoeba invadens
EDGRIS

SEQ ID NO: 2849023 - protein, 5 aa, Entamoeba invadens
EDGSP

SEQ ID NO: 2849024 - protein, 10 aa, Entamoeba invadens
EDGSVEAHRK

SEQ ID NO: 2849025 - protein, 7 aa, Entamoeba invadens
EDGSVFG

SEQ ID NO: 2849026 - protein, 11 aa, Entamoeba invadens
EDGTDAKKVSS

SEQ ID NO: 2849027 - protein, 4 aa, Entamoeba invadens
EDGV

SEQ ID NO: 2849028 - protein, 5 aa, Entamoeba invadens
EDGVE

SEQ ID NO: 2849029 - protein, 7 aa, Entamoeba invadens
EDGWSNE

SEQ ID NO: 2849030 - protein, 8 aa, Entamoeba invadens
EDHKENEI

SEQ ID NO: 2849031 - protein, 16 aa, Entamoeba invadens
EDHNPAEDKTYTEEDE

SEQ ID NO: 2849032 - protein, 9 aa, Entamoeba invadens
EDHQQSCSY

SEQ ID NO: 2849033 - protein, 14 aa, Entamoeba invadens
EDHRASSKTPPRTI

SEQ ID NO: 2849034 - protein, 6 aa, Entamoeba invadens
EDIARN

SEQ ID NO: 2849035 - protein, 5 aa, Entamoeba invadens
EDIDD

SEQ ID NO: 2849036 - protein, 6 aa, Entamoeba invadens
EDIDNA

SEQ ID NO: 2849037 - protein, 13 aa, Entamoeba invadens
EDIDRETKPVETK

SEQ ID NO: 2849038 - protein, 14 aa, Entamoeba invadens
EDIDTTKPEEDQHL

SEQ ID NO: 2849039 - protein, 5 aa, Entamoeba invadens
EDIDV

SEQ ID NO: 2849040 - protein, 47 aa, Entamoeba invadens
EDIDYETPKGRSVSRKRSRSNSLIRKGEETAFPTQAMRDKAEKIRRL

SEQ ID NO: 2849041 - protein, 7 aa, Entamoeba invadens
EDIENNS

SEQ ID NO: 2849042 - protein, 24 aa, Entamoeba invadens
EDIEPKKVSLDKADIKSREEQEHI

SEQ ID NO: 2849043 - protein, 12 aa, Entamoeba invadens
EDIERKESALTQ

SEQ ID NO: 2849044 - protein, 24 aa, Entamoeba invadens
EDIESKKVSLDKADMKSREEQEHI

SEQ ID NO: 2849045 - protein, 11 aa, Entamoeba invadens
EDIESSTEKDS

SEQ ID NO: 2849046 - protein, 13 aa, Entamoeba invadens
EDIETAKRISYGK

SEQ ID NO: 2849047 - protein, 7 aa, Entamoeba invadens
EDIETEG

SEQ ID NO: 2849048 - protein, 5 aa, Entamoeba invadens
EDIEY

SEQ ID NO: 2849049 - protein, 22 aa, Entamoeba invadens
EDIGDDDFEEEESVDSEEQDAI

SEQ ID NO: 2849050 - protein, 6 aa, Entamoeba invadens
EDIGSI

SEQ ID NO: 2849051 - protein, 14 aa, Entamoeba invadens
EDIIETPKNVKKRE

SEQ ID NO: 2849052 - protein, 8 aa, Entamoeba invadens
EDIKDPQI

SEQ ID NO: 2849053 - protein, 10 aa, Entamoeba invadens
EDIKHEGDIV

SEQ ID NO: 2849054 - protein, 8 aa, Entamoeba invadens
EDIKKDTR

SEQ ID NO: 2849055 - protein, 11 aa, Entamoeba invadens
EDIKNSETELA

SEQ ID NO: 2849056 - protein, 9 aa, Entamoeba invadens
EDINDEKSF

SEQ ID NO: 2849057 - protein, 4 aa, Entamoeba invadens
EDIP

SEQ ID NO: 2849058 - protein, 6 aa, Entamoeba invadens
EDIPDE

SEQ ID NO: 2849059 - protein, 23 aa, Entamoeba invadens
EDIPKVEEQKDEKKEKENKECAT

SEQ ID NO: 2849060 - protein, 6 aa, Entamoeba invadens
EDIPNA

SEQ ID NO: 2849061 - protein, 6 aa, Entamoeba invadens
EDIPNR

SEQ ID NO: 2849062 - protein, 12 aa, Entamoeba invadens
EDIQGQLEEEKV

SEQ ID NO: 2849063 - protein, 8 aa, Entamoeba invadens
EDIREKDV

SEQ ID NO: 2849064 - protein, 5 aa, Entamoeba invadens
EDIRR

SEQ ID NO: 2849065 - protein, 4 aa, Entamoeba invadens
EDIS

SEQ ID NO: 2849066 - protein, 5 aa, Entamoeba invadens
EDISR

SEQ ID NO: 2849067 - protein, 4 aa, Entamoeba invadens
EDKA

SEQ ID NO: 2849068 - protein, 11 aa, Entamoeba invadens
EDKAPQKKQSK

SEQ ID NO: 2849069 - protein, 10 aa, Entamoeba invadens
EDKDKGSPIP

SEQ ID NO: 2849070 - protein, 26 aa, Entamoeba invadens
EDKDRKDLKNNSLPSIPFGEQKRNEV

SEQ ID NO: 2849071 - protein, 11 aa, Entamoeba invadens
EDKDRYGNEIP

SEQ ID NO: 2849072 - protein, 9 aa, Entamoeba invadens
EDKDSNKLK

SEQ ID NO: 2849073 - protein, 13 aa, Entamoeba invadens
EDKDTTDERESKL

SEQ ID NO: 2849074 - protein, 21 aa, Entamoeba invadens
EDKEDSSESDSEASDEELPKD

SEQ ID NO: 2849075 - protein, 12 aa, Entamoeba invadens
EDKENLKNKVEE

SEQ ID NO: 2849076 - protein, 7 aa, Entamoeba invadens
EDKENVL

SEQ ID NO: 2849077 - protein, 10 aa, Entamoeba invadens
EDKERKMTKQ

SEQ ID NO: 2849078 - protein, 9 aa, Entamoeba invadens
EDKESANLE

SEQ ID NO: 2849079 - protein, 33 aa, Entamoeba invadens
EDKETQKRNKDSDSITKEDEKVSSLEETSSSPD

SEQ ID NO: 2849080 - protein, 5 aa, Entamoeba invadens
EDKEV

SEQ ID NO: 2849081 - protein, 7 aa, Entamoeba invadens
EDKGDTF

SEQ ID NO: 2849082 - protein, 8 aa, Entamoeba invadens
EDKGEPSY

SEQ ID NO: 2849083 - protein, 5 aa, Entamoeba invadens
EDKGK

SEQ ID NO: 2849084 - protein, 7 aa, Entamoeba invadens
EDKGSTD

SEQ ID NO: 2849085 - protein, 21 aa, Entamoeba invadens
EDKHNLENLEKEKSRTLKQNE

SEQ ID NO: 2849086 - protein, 7 aa, Entamoeba invadens
EDKITTS

SEQ ID NO: 2849087 - protein, 5 aa, Entamoeba invadens
EDKKK

SEQ ID NO: 2849088 - protein, 6 aa, Entamoeba invadens
EDKKKT

SEQ ID NO: 2849089 - protein, 19 aa, Entamoeba invadens
EDKKMKEEELQKKQEIERL

SEQ ID NO: 2849090 - protein, 9 aa, Entamoeba invadens
EDKKNLKTI

SEQ ID NO: 2849091 - protein, 23 aa, Entamoeba invadens
EDKKSIKRVKPIPTEAEVTRDRC

SEQ ID NO: 2849092 - protein, 12 aa, Entamoeba invadens
EDKKSKKKYAER

SEQ ID NO: 2849093 - protein, 6 aa, Entamoeba invadens
EDKKVR

SEQ ID NO: 2849094 - protein, 8 aa, Entamoeba invadens
EDKLSPDL

SEQ ID NO: 2849095 - protein, 4 aa, Entamoeba invadens
EDKN

SEQ ID NO: 2849096 - protein, 8 aa, Entamoeba invadens
EDKNEVAE

SEQ ID NO: 2849097 - protein, 12 aa, Entamoeba invadens
EDKNGEEPPTGA

SEQ ID NO: 2849098 - protein, 5 aa, Entamoeba invadens
EDKNI

SEQ ID NO: 2849099 - protein, 10 aa, Entamoeba invadens
EDKNYEEETK

SEQ ID NO: 2849100 - protein, 4 aa, Entamoeba invadens
EDKP

SEQ ID NO: 2849101 - protein, 14 aa, Entamoeba invadens
EDKPKEKRKRTYVK

SEQ ID NO: 2849102 - protein, 9 aa, Entamoeba invadens
EDKPRRIKP

SEQ ID NO: 2849103 - protein, 8 aa, Entamoeba invadens
EDKPTGIT

SEQ ID NO: 2849104 - protein, 6 aa, Entamoeba invadens
EDKPTL

SEQ ID NO: 2849105 - protein, 4 aa, Entamoeba invadens
EDKQ

SEQ ID NO: 2849106 - protein, 5 aa, Entamoeba invadens
EDKQV

SEQ ID NO: 2849107 - protein, 19 aa, Entamoeba invadens
EDKSEATDSSEDKREEPKI

SEQ ID NO: 2849108 - protein, 5 aa, Entamoeba invadens
EDKSP

SEQ ID NO: 2849109 - protein, 9 aa, Entamoeba invadens
EDKSSIKDD

SEQ ID NO: 2849110 - protein, 7 aa, Entamoeba invadens
EDKTFGK

SEQ ID NO: 2849111 - protein, 7 aa, Entamoeba invadens
EDKTLTI

SEQ ID NO: 2849112 - protein, 16 aa, Entamoeba invadens
EDKTNTDLEHANAENL

SEQ ID NO: 2849113 - protein, 8 aa, Entamoeba invadens
EDKTQFTA

SEQ ID NO: 2849114 - protein, 9 aa, Entamoeba invadens
EDKTQTTAI

SEQ ID NO: 2849115 - protein, 13 aa, Entamoeba invadens
EDKTRQMSRHKSD

SEQ ID NO: 2849116 - protein, 10 aa, Entamoeba invadens
EDKTSTELSK

SEQ ID NO: 2849117 - protein, 13 aa, Entamoeba invadens
EDKTVDGKTEEGY

SEQ ID NO: 2849118 - protein, 13 aa, Entamoeba invadens
EDKVGTSNIDQTE

SEQ ID NO: 2849119 - protein, 9 aa, Entamoeba invadens
EDKYEKDDY

SEQ ID NO: 2849120 - protein, 5 aa, Entamoeba invadens
EDKYN

SEQ ID NO: 2849121 - protein, 8 aa, Entamoeba invadens
EDKYTERG

SEQ ID NO: 2849122 - protein, 6 aa, Entamoeba invadens
EDLEEL

SEQ ID NO: 2849123 - protein, 16 aa, Entamoeba invadens
EDLEENTQNEKATFQQ

SEQ ID NO: 2849124 - protein, 16 aa, Entamoeba invadens
EDLEKIKKEKQRTESE

SEQ ID NO: 2849125 - protein, 7 aa, Entamoeba invadens
EDLEKQN

SEQ ID NO: 2849126 - protein, 25 aa, Entamoeba invadens
EDLEKSKEETNSEISRLKKERDDLF

SEQ ID NO: 2849127 - protein, 22 aa, Entamoeba invadens
EDLETQSESKLTKQEELAQRVE

SEQ ID NO: 2849128 - protein, 4 aa, Entamoeba invadens
EDLI

SEQ ID NO: 2849129 - protein, 5 aa, Entamoeba invadens
EDLKA

SEQ ID NO: 2849130 - protein, 6 aa, Entamoeba invadens
EDLKPT

SEQ ID NO: 2849131 - protein, 11 aa, Entamoeba invadens
EDLKSDKGLKS

SEQ ID NO: 2849132 - protein, 17 aa, Entamoeba invadens
EDLKTSGEQSDKNAYDQ

SEQ ID NO: 2849133 - protein, 5 aa, Entamoeba invadens
EDLLT

SEQ ID NO: 2849134 - protein, 6 aa, Entamoeba invadens
EDLNRN

SEQ ID NO: 2849135 - protein, 9 aa, Entamoeba invadens
EDLNTADPQ

SEQ ID NO: 2849136 - protein, 4 aa, Entamoeba invadens
EDLP

SEQ ID NO: 2849137 - protein, 7 aa, Entamoeba invadens
EDLPGSY

SEQ ID NO: 2849138 - protein, 30 aa, Entamoeba invadens
EDLPKAKTKVTKEKAKKVMSKAEEDELAEL

SEQ ID NO: 2849139 - protein, 6 aa, Entamoeba invadens
EDLPPY

SEQ ID NO: 2849140 - protein, 18 aa, Entamoeba invadens
EDLQSDDKTSESQQKEEK

SEQ ID NO: 2849141 - protein, 8 aa, Entamoeba invadens
EDLRPENA

SEQ ID NO: 2849142 - protein, 6 aa, Entamoeba invadens
EDLSPD

SEQ ID NO: 2849143 - protein, 5 aa, Entamoeba invadens
EDLTE

SEQ ID NO: 2849144 - protein, 18 aa, Entamoeba invadens
EDLTEPQEIANDATTDRK

SEQ ID NO: 2849145 - protein, 13 aa, Entamoeba invadens
EDLTKKRGEQYKM

SEQ ID NO: 2849146 - protein, 8 aa, Entamoeba invadens
EDLVTEAD

SEQ ID NO: 2849147 - protein, 28 aa, Entamoeba invadens
EDMAKGNTKLIDKESNETNNKMKEKGEA

SEQ ID NO: 2849148 - protein, 71 aa, Entamoeba invadens
EDMEDDEEEEPAAPVKVAPKKEAPKKEEKKVEKKPVPKEEKKPQHQEKKETKKADVKGKHDNKQQNKKHGK

SEQ ID NO: 2849149 - protein, 6 aa, Entamoeba invadens
EDMEPE

SEQ ID NO: 2849150 - protein, 7 aa, Entamoeba invadens
EDMESRS

SEQ ID NO: 2849151 - protein, 12 aa, Entamoeba invadens
EDMETKIADQQE

SEQ ID NO: 2849152 - protein, 4 aa, Entamoeba invadens
EDMK

SEQ ID NO: 2849153 - protein, 21 aa, Entamoeba invadens
EDMKSQAEGEAVPSDKAEMNE

SEQ ID NO: 2849154 - protein, 5 aa, Entamoeba invadens
EDMNG

SEQ ID NO: 2849155 - protein, 10 aa, Entamoeba invadens
EDMQRDNQHY

SEQ ID NO: 2849156 - protein, 14 aa, Entamoeba invadens
EDMSDDEEAQNDEF

SEQ ID NO: 2849157 - protein, 7 aa, Entamoeba invadens
EDMSEDI

SEQ ID NO: 2849158 - protein, 5 aa, Entamoeba invadens
EDMYS

SEQ ID NO: 2849159 - protein, 16 aa, Entamoeba invadens
EDNARGVVERNQEGVA

SEQ ID NO: 2849160 - protein, 6 aa, Entamoeba invadens
EDNCPG

SEQ ID NO: 2849161 - protein, 5 aa, Entamoeba invadens
EDNCT

SEQ ID NO: 2849162 - protein, 4 aa, Entamoeba invadens
EDND

SEQ ID NO: 2849163 - protein, 8 aa, Entamoeba invadens
EDNDEIKI

SEQ ID NO: 2849164 - protein, 9 aa, Entamoeba invadens
EDNDENTGI

SEQ ID NO: 2849165 - protein, 9 aa, Entamoeba invadens
EDNDNPLNC

SEQ ID NO: 2849166 - protein, 5 aa, Entamoeba invadens
EDNDV

SEQ ID NO: 2849167 - protein, 7 aa, Entamoeba invadens
EDNEIGN

SEQ ID NO: 2849168 - protein, 25 aa, Entamoeba invadens
EDNEKAGDSDEEDLKVKTKAEKNEI

SEQ ID NO: 2849169 - protein, 6 aa, Entamoeba invadens
EDNELY

SEQ ID NO: 2849170 - protein, 5 aa, Entamoeba invadens
EDNEM

SEQ ID NO: 2849171 - protein, 5 aa, Entamoeba invadens
EDNGR

SEQ ID NO: 2849172 - protein, 6 aa, Entamoeba invadens
EDNGVR

SEQ ID NO: 2849173 - protein, 4 aa, Entamoeba invadens
EDNI

SEQ ID NO: 2849174 - protein, 16 aa, Entamoeba invadens
EDNIEQRTLGDPMSDK

SEQ ID NO: 2849175 - protein, 5 aa, Entamoeba invadens
EDNIR

SEQ ID NO: 2849176 - protein, 8 aa, Entamoeba invadens
EDNKDTLE

SEQ ID NO: 2849177 - protein, 7 aa, Entamoeba invadens
EDNMPQD

SEQ ID NO: 2849178 - protein, 27 aa, Entamoeba invadens
EDNNEEMVKPPKLPKSLREDYSPIKHE

SEQ ID NO: 2849179 - protein, 12 aa, Entamoeba invadens
EDNNEMANEDNR

SEQ ID NO: 2849180 - protein, 7 aa, Entamoeba invadens
EDNNKHR

SEQ ID NO: 2849181 - protein, 9 aa, Entamoeba invadens
EDNNRKKYD

SEQ ID NO: 2849182 - protein, 5 aa, Entamoeba invadens
EDNNW

SEQ ID NO: 2849183 - protein, 7 aa, Entamoeba invadens
EDNPFAV

SEQ ID NO: 2849184 - protein, 19 aa, Entamoeba invadens
EDNPKNGKNGKNTKMKRSM

SEQ ID NO: 2849185 - protein, 18 aa, Entamoeba invadens
EDNPMKEVHEKEEKDKLN

SEQ ID NO: 2849186 - protein, 9 aa, Entamoeba invadens
EDNPPAQPK

SEQ ID NO: 2849187 - protein, 9 aa, Entamoeba invadens
EDNPTAQPK

SEQ ID NO: 2849188 - protein, 9 aa, Entamoeba invadens
EDNPTDPEM

SEQ ID NO: 2849189 - protein, 8 aa, Entamoeba invadens
EDNSGNLE

SEQ ID NO: 2849190 - protein, 6 aa, Entamoeba invadens
EDNSKL

SEQ ID NO: 2849191 - protein, 6 aa, Entamoeba invadens
EDNSMT

SEQ ID NO: 2849192 - protein, 6 aa, Entamoeba invadens
EDNTFG

SEQ ID NO: 2849193 - protein, 8 aa, Entamoeba invadens
EDNTPVKT

SEQ ID NO: 2849194 - protein, 5 aa, Entamoeba invadens
EDNTT

SEQ ID NO: 2849195 - protein, 5 aa, Entamoeba invadens
EDNVF

SEQ ID NO: 2849196 - protein, 7 aa, Entamoeba invadens
EDNVPSE

SEQ ID NO: 2849197 - protein, 8 aa, Entamoeba invadens
EDPAKADY

SEQ ID NO: 2849198 - protein, 8 aa, Entamoeba invadens
EDPAPYEF

SEQ ID NO: 2849199 - protein, 8 aa, Entamoeba invadens
EDPATRPE

SEQ ID NO: 2849200 - protein, 17 aa, Entamoeba invadens
EDPDFGKNDTQQLTKEE

SEQ ID NO: 2849201 - protein, 7 aa, Entamoeba invadens
EDPEDLA

SEQ ID NO: 2849202 - protein, 6 aa, Entamoeba invadens
EDPEDY

SEQ ID NO: 2849203 - protein, 5 aa, Entamoeba invadens
EDPEE

SEQ ID NO: 2849204 - protein, 7 aa, Entamoeba invadens
EDPFDED

SEQ ID NO: 2849205 - protein, 5 aa, Entamoeba invadens
EDPID

SEQ ID NO: 2849206 - protein, 8 aa, Entamoeba invadens
EDPIGTRG

SEQ ID NO: 2849207 - protein, 12 aa, Entamoeba invadens
EDPKEDKRPCQS

SEQ ID NO: 2849208 - protein, 7 aa, Entamoeba invadens
EDPKTTK

SEQ ID NO: 2849209 - protein, 5 aa, Entamoeba invadens
EDPKV

SEQ ID NO: 2849210 - protein, 7 aa, Entamoeba invadens
EDPKVEK

SEQ ID NO: 2849211 - protein, 4 aa, Entamoeba invadens
EDPL

SEQ ID NO: 2849212 - protein, 5 aa, Entamoeba invadens
EDPMN

SEQ ID NO: 2849213 - protein, 4 aa, Entamoeba invadens
EDPN

SEQ ID NO: 2849214 - protein, 5 aa, Entamoeba invadens
EDPNF

SEQ ID NO: 2849215 - protein, 10 aa, Entamoeba invadens
EDPQIQEDSV

SEQ ID NO: 2849216 - protein, 7 aa, Entamoeba invadens
EDPQNQK

SEQ ID NO: 2849217 - protein, 8 aa, Entamoeba invadens
EDPRVAGE

SEQ ID NO: 2849218 - protein, 5 aa, Entamoeba invadens
EDPSF

SEQ ID NO: 2849219 - protein, 9 aa, Entamoeba invadens
EDPSSKRIE

SEQ ID NO: 2849220 - protein, 8 aa, Entamoeba invadens
EDPSSSTW

SEQ ID NO: 2849221 - protein, 7 aa, Entamoeba invadens
EDPTKRI

SEQ ID NO: 2849222 - protein, 5 aa, Entamoeba invadens
EDPTN

SEQ ID NO: 2849223 - protein, 5 aa, Entamoeba invadens
EDPTS

SEQ ID NO: 2849224 - protein, 7 aa, Entamoeba invadens
EDPVAGG

SEQ ID NO: 2849225 - protein, 4 aa, Entamoeba invadens
EDPW

SEQ ID NO: 2849226 - protein, 5 aa, Entamoeba invadens
EDPYT

SEQ ID NO: 2849227 - protein, 9 aa, Entamoeba invadens
EDQAPVDAK

SEQ ID NO: 2849228 - protein, 11 aa, Entamoeba invadens
EDQDGGNGSVG

SEQ ID NO: 2849229 - protein, 14 aa, Entamoeba invadens
EDQEESKNKFAKTE

SEQ ID NO: 2849230 - protein, 9 aa, Entamoeba invadens
EDQHPTKAL

SEQ ID NO: 2849231 - protein, 7 aa, Entamoeba invadens
EDQIESD

SEQ ID NO: 2849232 - protein, 29 aa, Entamoeba invadens
EDQIQRKEEEDAIKRIEEQKEIDRKAEGI

SEQ ID NO: 2849233 - protein, 28 aa, Entamoeba invadens
EDQKKRREVEIEEKEDVENQERKERETQ

SEQ ID NO: 2849234 - protein, 5 aa, Entamoeba invadens
EDQKN

SEQ ID NO: 2849235 - protein, 5 aa, Entamoeba invadens
EDQKT

SEQ ID NO: 2849236 - protein, 7 aa, Entamoeba invadens
EDQKTER

SEQ ID NO: 2849237 - protein, 6 aa, Entamoeba invadens
EDQKTI

SEQ ID NO: 2849238 - protein, 8 aa, Entamoeba invadens
EDQNCDQV

SEQ ID NO: 2849239 - protein, 23 aa, Entamoeba invadens
EDQNKTQKCQKRKTRKSAEKVNE

SEQ ID NO: 2849240 - protein, 22 aa, Entamoeba invadens
EDQNKTQNCEKRKTRRSVEKVN

SEQ ID NO: 2849241 - protein, 4 aa, Entamoeba invadens
EDQP

SEQ ID NO: 2849242 - protein, 7 aa, Entamoeba invadens
EDQPESF

SEQ ID NO: 2849243 - protein, 8 aa, Entamoeba invadens
EDQPFAED

SEQ ID NO: 2849244 - protein, 16 aa, Entamoeba invadens
EDQPQNEKADLIEGSD

SEQ ID NO: 2849245 - protein, 7 aa, Entamoeba invadens
EDQPTEG

SEQ ID NO: 2849246 - protein, 5 aa, Entamoeba invadens
EDQQR

SEQ ID NO: 2849247 - protein, 6 aa, Entamoeba invadens
EDQSKL

SEQ ID NO: 2849248 - protein, 6 aa, Entamoeba invadens
EDQTLT

SEQ ID NO: 2849249 - protein, 5 aa, Entamoeba invadens
EDQTN

SEQ ID NO: 2849250 - protein, 6 aa, Entamoeba invadens
EDQTYF

SEQ ID NO: 2849251 - protein, 7 aa, Entamoeba invadens
EDQYDTS

SEQ ID NO: 2849252 - protein, 18 aa, Entamoeba invadens
EDRCKQLESKKEGLSGYS

SEQ ID NO: 2849253 - protein, 5 aa, Entamoeba invadens
EDRFR

SEQ ID NO: 2849254 - protein, 5 aa, Entamoeba invadens
EDRGA

SEQ ID NO: 2849255 - protein, 6 aa, Entamoeba invadens
EDRGPV

SEQ ID NO: 2849256 - protein, 34 aa, Entamoeba invadens
EDRITQPGLTVQTKSNYPFTEIGSKDKVGQPTAD

SEQ ID NO: 2849257 - protein, 43 aa, Entamoeba invadens
EDRKRGDSDDGTTTNLSEYTDDSSDSSDESSEEKNTEEYKNKQ

SEQ ID NO: 2849258 - protein, 8 aa, Entamoeba invadens
EDRKYNAL

SEQ ID NO: 2849259 - protein, 9 aa, Entamoeba invadens
EDRLDETQK

SEQ ID NO: 2849260 - protein, 15 aa, Entamoeba invadens
EDRLHGSRAKSSKKV

SEQ ID NO: 2849261 - protein, 10 aa, Entamoeba invadens
EDRLNTPEKI

SEQ ID NO: 2849262 - protein, 4 aa, Entamoeba invadens
EDRP

SEQ ID NO: 2849263 - protein, 8 aa, Entamoeba invadens
EDRPELEE

SEQ ID NO: 2849264 - protein, 4 aa, Entamoeba invadens
EDRS

SEQ ID NO: 2849265 - protein, 8 aa, Entamoeba invadens
EDRSGNIS

SEQ ID NO: 2849266 - protein, 12 aa, Entamoeba invadens
EDRSVENAIRRE

SEQ ID NO: 2849267 - protein, 6 aa, Entamoeba invadens
EDRTSS

SEQ ID NO: 2849268 - protein, 12 aa, Entamoeba invadens
EDRTTEIAKPHN

SEQ ID NO: 2849269 - protein, 4 aa, Entamoeba invadens
EDRV

SEQ ID NO: 2849270 - protein, 4 aa, Entamoeba invadens
EDRY

SEQ ID NO: 2849271 - protein, 8 aa, Entamoeba invadens
EDSAQKIN

SEQ ID NO: 2849272 - protein, 7 aa, Entamoeba invadens
EDSDEMK

SEQ ID NO: 2849273 - protein, 9 aa, Entamoeba invadens
EDSDGESST

SEQ ID NO: 2849274 - protein, 9 aa, Entamoeba invadens
EDSDGKLGK

SEQ ID NO: 2849275 - protein, 7 aa, Entamoeba invadens
EDSDNCA

SEQ ID NO: 2849276 - protein, 16 aa, Entamoeba invadens
EDSDPQNKGIMLESSE

SEQ ID NO: 2849277 - protein, 10 aa, Entamoeba invadens
EDSDSEVEEV

SEQ ID NO: 2849278 - protein, 4 aa, Entamoeba invadens
EDSE

SEQ ID NO: 2849279 - protein, 17 aa, Entamoeba invadens
EDSENKKQNEEYKDKNK

SEQ ID NO: 2849280 - protein, 47 aa, Entamoeba invadens
EDSENSKSNESNTDPKYSSYSKQHEESSEYDTSPLSDTSHSDTSQEE

SEQ ID NO: 2849281 - protein, 14 aa, Entamoeba invadens
EDSEVVSDDFPSEQ

SEQ ID NO: 2849282 - protein, 10 aa, Entamoeba invadens
EDSIQQRESV

SEQ ID NO: 2849283 - protein, 5 aa, Entamoeba invadens
EDSKI

SEQ ID NO: 2849284 - protein, 6 aa, Entamoeba invadens
EDSKIG

SEQ ID NO: 2849285 - protein, 5 aa, Entamoeba invadens
EDSKV

SEQ ID NO: 2849286 - protein, 23 aa, Entamoeba invadens
EDSLKNPVSLPDFGGKHPDPNLT

SEQ ID NO: 2849287 - protein, 21 aa, Entamoeba invadens
EDSLQTNRPQRSSSPLTELAD

SEQ ID NO: 2849288 - protein, 11 aa, Entamoeba invadens
EDSNKPFPETA

SEQ ID NO: 2849289 - protein, 9 aa, Entamoeba invadens
EDSNKVYTG

SEQ ID NO: 2849290 - protein, 19 aa, Entamoeba invadens
EDSNSEPQKKSGSEEDVDL

SEQ ID NO: 2849291 - protein, 23 aa, Entamoeba invadens
EDSNSLDNSDSPRQVKEKSCTPK

SEQ ID NO: 2849292 - protein, 9 aa, Entamoeba invadens
EDSPKPTAL

SEQ ID NO: 2849293 - protein, 4 aa, Entamoeba invadens
EDSQ

SEQ ID NO: 2849294 - protein, 7 aa, Entamoeba invadens
EDSQAQT

SEQ ID NO: 2849295 - protein, 5 aa, Entamoeba invadens
EDSQV

SEQ ID NO: 2849296 - protein, 8 aa, Entamoeba invadens
EDSRDNYN

SEQ ID NO: 2849297 - protein, 4 aa, Entamoeba invadens
EDSS

SEQ ID NO: 2849298 - protein, 10 aa, Entamoeba invadens
EDSSATVYSN

SEQ ID NO: 2849299 - protein, 10 aa, Entamoeba invadens
EDSSKKFKEL

SEQ ID NO: 2849300 - protein, 8 aa, Entamoeba invadens
EDSSNTIT

SEQ ID NO: 2849301 - protein, 9 aa, Entamoeba invadens
EDSTISGKG

SEQ ID NO: 2849302 - protein, 7 aa, Entamoeba invadens
EDSTVSQ

SEQ ID NO: 2849303 - protein, 5 aa, Entamoeba invadens
EDSVL

SEQ ID NO: 2849304 - protein, 6 aa, Entamoeba invadens
EDSVVE

SEQ ID NO: 2849305 - protein, 9 aa, Entamoeba invadens
EDSWDKGIP

SEQ ID NO: 2849306 - protein, 15 aa, Entamoeba invadens
EDTAKLSSAFQRSEI

SEQ ID NO: 2849307 - protein, 19 aa, Entamoeba invadens
EDTANSQELENNFIIDVIK

SEQ ID NO: 2849308 - protein, 15 aa, Entamoeba invadens
EDTAPINAIPPKVEE

SEQ ID NO: 2849309 - protein, 10 aa, Entamoeba invadens
EDTAVPDADD

SEQ ID NO: 2849310 - protein, 4 aa, Entamoeba invadens
EDTD

SEQ ID NO: 2849311 - protein, 19 aa, Entamoeba invadens
EDTDGDDIIENNENNENID

SEQ ID NO: 2849312 - protein, 6 aa, Entamoeba invadens
EDTDGK

SEQ ID NO: 2849313 - protein, 6 aa, Entamoeba invadens
EDTEEI

SEQ ID NO: 2849314 - protein, 6 aa, Entamoeba invadens
EDTEKV

SEQ ID NO: 2849315 - protein, 7 aa, Entamoeba invadens
EDTETSP

SEQ ID NO: 2849316 - protein, 5 aa, Entamoeba invadens
EDTHI

SEQ ID NO: 2849317 - protein, 11 aa, Entamoeba invadens
EDTKEANRTIQ

SEQ ID NO: 2849318 - protein, 6 aa, Entamoeba invadens
EDTKTE

SEQ ID NO: 2849319 - protein, 7 aa, Entamoeba invadens
EDTLETR

SEQ ID NO: 2849320 - protein, 8 aa, Entamoeba invadens
EDTLNNKD

SEQ ID NO: 2849321 - protein, 5 aa, Entamoeba invadens
EDTLS

SEQ ID NO: 2849322 - protein, 6 aa, Entamoeba invadens
EDTNGK

SEQ ID NO: 2849323 - protein, 5 aa, Entamoeba invadens
EDTNI

SEQ ID NO: 2849324 - protein, 6 aa, Entamoeba invadens
EDTPQI

SEQ ID NO: 2849325 - protein, 13 aa, Entamoeba invadens
EDTPTDRLTDDEV

SEQ ID NO: 2849326 - protein, 7 aa, Entamoeba invadens
EDTQEKR

SEQ ID NO: 2849327 - protein, 12 aa, Entamoeba invadens
EDTQNSDDNVEY

SEQ ID NO: 2849328 - protein, 6 aa, Entamoeba invadens
EDTQTA

SEQ ID NO: 2849329 - protein, 5 aa, Entamoeba invadens
EDTQV

SEQ ID NO: 2849330 - protein, 9 aa, Entamoeba invadens
EDTRFDPED

SEQ ID NO: 2849331 - protein, 8 aa, Entamoeba invadens
EDTSDMTS

SEQ ID NO: 2849332 - protein, 9 aa, Entamoeba invadens
EDTSDSSVS

SEQ ID NO: 2849333 - protein, 5 aa, Entamoeba invadens
EDTSK

SEQ ID NO: 2849334 - protein, 6 aa, Entamoeba invadens
EDTSLL

SEQ ID NO: 2849335 - protein, 11 aa, Entamoeba invadens
EDTTPEDIESG

SEQ ID NO: 2849336 - protein, 8 aa, Entamoeba invadens
EDTTQQSL

SEQ ID NO: 2849337 - protein, 13 aa, Entamoeba invadens
EDTVGSKVPRSVM

SEQ ID NO: 2849338 - protein, 9 aa, Entamoeba invadens
EDTYQGPRE

SEQ ID NO: 2849339 - protein, 11 aa, Entamoeba invadens
EDVDGRDRFDQ

SEQ ID NO: 2849340 - protein, 5 aa, Entamoeba invadens
EDVDK

SEQ ID NO: 2849341 - protein, 7 aa, Entamoeba invadens
EDVDNAR

SEQ ID NO: 2849342 - protein, 7 aa, Entamoeba invadens
EDVDPNL

SEQ ID NO: 2849343 - protein, 6 aa, Entamoeba invadens
EDVDSR

SEQ ID NO: 2849344 - protein, 17 aa, Entamoeba invadens
EDVEIESPSPVTTPQRE

SEQ ID NO: 2849345 - protein, 8 aa, Entamoeba invadens
EDVGEDED

SEQ ID NO: 2849346 - protein, 5 aa, Entamoeba invadens
EDVGR

SEQ ID NO: 2849347 - protein, 8 aa, Entamoeba invadens
EDVGVADP

SEQ ID NO: 2849348 - protein, 8 aa, Entamoeba invadens
EDVHGNQP

SEQ ID NO: 2849349 - protein, 5 aa, Entamoeba invadens
EDVKV

SEQ ID NO: 2849350 - protein, 4 aa, Entamoeba invadens
EDVN

SEQ ID NO: 2849351 - protein, 10 aa, Entamoeba invadens
EDVNETPTVV

SEQ ID NO: 2849352 - protein, 11 aa, Entamoeba invadens
EDVPSEDGKNN

SEQ ID NO: 2849353 - protein, 4 aa, Entamoeba invadens
EDVQ

SEQ ID NO: 2849354 - protein, 7 aa, Entamoeba invadens
EDVQTEK

SEQ ID NO: 2849355 - protein, 4 aa, Entamoeba invadens
EDVR

SEQ ID NO: 2849356 - protein, 6 aa, Entamoeba invadens
EDVREW

SEQ ID NO: 2849357 - protein, 6 aa, Entamoeba invadens
EDVRSE

SEQ ID NO: 2849358 - protein, 5 aa, Entamoeba invadens
EDVSG

SEQ ID NO: 2849359 - protein, 5 aa, Entamoeba invadens
EDVSM

SEQ ID NO: 2849360 - protein, 8 aa, Entamoeba invadens
EDVSNSTY

SEQ ID NO: 2849361 - protein, 9 aa, Entamoeba invadens
EDVSTSQDK

SEQ ID NO: 2849362 - protein, 6 aa, Entamoeba invadens
EDVTED

SEQ ID NO: 2849363 - protein, 18 aa, Entamoeba invadens
EDVTKKKKKDKADEDNPF

SEQ ID NO: 2849364 - protein, 5 aa, Entamoeba invadens
EDVTP

SEQ ID NO: 2849365 - protein, 8 aa, Entamoeba invadens
EDVVRERE

SEQ ID NO: 2849366 - protein, 5 aa, Entamoeba invadens
EDWEE

SEQ ID NO: 2849367 - protein, 11 aa, Entamoeba invadens
EDWNGPEDPPY

SEQ ID NO: 2849368 - protein, 12 aa, Entamoeba invadens
EDWTPTDKKNIE

SEQ ID NO: 2849369 - protein, 8 aa, Entamoeba invadens
EDYANQQK

SEQ ID NO: 2849370 - protein, 15 aa, Entamoeba invadens
EDYEEKGVAVFGNLT

SEQ ID NO: 2849371 - protein, 11 aa, Entamoeba invadens
EDYKKYQSFEG

SEQ ID NO: 2849372 - protein, 9 aa, Entamoeba invadens
EDYNKNREV

SEQ ID NO: 2849373 - protein, 34 aa, Entamoeba invadens
EDYNSVNTEPQPKQKRRNSLVDDKNEYSPPETPM

SEQ ID NO: 2849374 - protein, 12 aa, Entamoeba invadens
EDYNTNKDKFDT

SEQ ID NO: 2849375 - protein, 5 aa, Entamoeba invadens
EDYNV

SEQ ID NO: 2849376 - protein, 31 aa, Entamoeba invadens
EDYPKDDAPATTGAATEAKAENDTTPEDDVP

SEQ ID NO: 2849377 - protein, 4 aa, Entamoeba invadens
EDYS

SEQ ID NO: 2849378 - protein, 10 aa, Entamoeba invadens
EDYSSGYADI

SEQ ID NO: 2849379 - protein, 16 aa, Entamoeba invadens
EDYTDVPATIQKQRKA

SEQ ID NO: 2849380 - protein, 5 aa, Entamoeba invadens
EDYTQ

SEQ ID NO: 2849381 - protein, 21 aa, Entamoeba invadens
EDYVSDTEDAWKADPSSVVSG

SEQ ID NO: 2849382 - protein, 9 aa, Entamoeba invadens
EEAAELKQP

SEQ ID NO: 2849383 - protein, 8 aa, Entamoeba invadens
EEADGQMK

SEQ ID NO: 2849384 - protein, 25 aa, Entamoeba invadens
EEADNSGNDSSDDASDDEYSPVKIG

SEQ ID NO: 2849385 - protein, 13 aa, Entamoeba invadens
EEADPWEEISILQ

SEQ ID NO: 2849386 - protein, 9 aa, Entamoeba invadens
EEAEDVNKT

SEQ ID NO: 2849387 - protein, 6 aa, Entamoeba invadens
EEAEGA

SEQ ID NO: 2849388 - protein, 10 aa, Entamoeba invadens
EEAEKEALEK

SEQ ID NO: 2849389 - protein, 13 aa, Entamoeba invadens
EEAEKEEKKHLEQ

SEQ ID NO: 2849390 - protein, 7 aa, Entamoeba invadens
EEAEKTV

SEQ ID NO: 2849391 - protein, 6 aa, Entamoeba invadens
EEAENN

SEQ ID NO: 2849392 - protein, 6 aa, Entamoeba invadens
EEAGGT

SEQ ID NO: 2849393 - protein, 9 aa, Entamoeba invadens
EEAGPVKRD

SEQ ID NO: 2849394 - protein, 11 aa, Entamoeba invadens
EEAIDDGELSP

SEQ ID NO: 2849395 - protein, 5 aa, Entamoeba invadens
EEAKE

SEQ ID NO: 2849396 - protein, 5 aa, Entamoeba invadens
EEAKG

SEQ ID NO: 2849397 - protein, 9 aa, Entamoeba invadens
EEAKKAHER

SEQ ID NO: 2849398 - protein, 9 aa, Entamoeba invadens
EEAKKNEKV

SEQ ID NO: 2849399 - protein, 13 aa, Entamoeba invadens
EEAKKVDREKREK

SEQ ID NO: 2849400 - protein, 7 aa, Entamoeba invadens
EEAKNLG

SEQ ID NO: 2849401 - protein, 15 aa, Entamoeba invadens
EEAKNQNERQNASIT

SEQ ID NO: 2849402 - protein, 8 aa, Entamoeba invadens
EEAKSAIQ

SEQ ID NO: 2849403 - protein, 26 aa, Entamoeba invadens
EEAKSTEEEVPKKVEKKESPKEGGEL

SEQ ID NO: 2849404 - protein, 8 aa, Entamoeba invadens
EEAKTENI

SEQ ID NO: 2849405 - protein, 7 aa, Entamoeba invadens
EEAKVEN

SEQ ID NO: 2849406 - protein, 4 aa, Entamoeba invadens
EEAM

SEQ ID NO: 2849407 - protein, 13 aa, Entamoeba invadens
EEAMEYQKEHKNR

SEQ ID NO: 2849408 - protein, 20 aa, Entamoeba invadens
EEANAKATEATKKDKELETA

SEQ ID NO: 2849409 - protein, 11 aa, Entamoeba invadens
EEANEVEEEVV

SEQ ID NO: 2849410 - protein, 8 aa, Entamoeba invadens
EEANKAIN

SEQ ID NO: 2849411 - protein, 7 aa, Entamoeba invadens
EEANKAS

SEQ ID NO: 2849412 - protein, 10 aa, Entamoeba invadens
EEANKLGQDD

SEQ ID NO: 2849413 - protein, 10 aa, Entamoeba invadens
EEANKQLDEY

SEQ ID NO: 2849414 - protein, 9 aa, Entamoeba invadens
EEAPKKQVA

SEQ ID NO: 2849415 - protein, 15 aa, Entamoeba invadens
EEAQALTGVEDPYES

SEQ ID NO: 2849416 - protein, 9 aa, Entamoeba invadens
EEAQKKGEN

SEQ ID NO: 2849417 - protein, 6 aa, Entamoeba invadens
EEAQKS

SEQ ID NO: 2849418 - protein, 7 aa, Entamoeba invadens
EEAQNVN

SEQ ID NO: 2849419 - protein, 8 aa, Entamoeba invadens
EEAQRAER

SEQ ID NO: 2849420 - protein, 18 aa, Entamoeba invadens
EEAQSHKKPGLASSMTYG

SEQ ID NO: 2849421 - protein, 5 aa, Entamoeba invadens
EEASR

SEQ ID NO: 2849422 - protein, 4 aa, Entamoeba invadens
EEAT

SEQ ID NO: 2849423 - protein, 21 aa, Entamoeba invadens
EEATEDKKENRRITRRSSFKP

SEQ ID NO: 2849424 - protein, 7 aa, Entamoeba invadens
EEATGKK

SEQ ID NO: 2849425 - protein, 7 aa, Entamoeba invadens
EEATGST

SEQ ID NO: 2849426 - protein, 34 aa, Entamoeba invadens
EEATKTHKPIKERTKDTKLTMEEEPLNEGETKKI

SEQ ID NO: 2849427 - protein, 4 aa, Entamoeba invadens
EEAV

SEQ ID NO: 2849428 - protein, 5 aa, Entamoeba invadens
EEAVE

SEQ ID NO: 2849429 - protein, 11 aa, Entamoeba invadens
EEAVSQLEGRV

SEQ ID NO: 2849430 - protein, 7 aa, Entamoeba invadens
EEAYDSG

SEQ ID NO: 2849431 - protein, 16 aa, Entamoeba invadens
EEAYNTMQTEDRVRTA

SEQ ID NO: 2849432 - protein, 25 aa, Entamoeba invadens
EECASTSSCTKCSEEYTVGTDNTCH

SEQ ID NO: 2849433 - protein, 7 aa, Entamoeba invadens
EECDGGV

SEQ ID NO: 2849434 - protein, 7 aa, Entamoeba invadens
EECENAI

SEQ ID NO: 2849435 - protein, 12 aa, Entamoeba invadens
EECGGKRGTLKE

SEQ ID NO: 2849436 - protein, 6 aa, Entamoeba invadens
EECGKT

SEQ ID NO: 2849437 - protein, 17 aa, Entamoeba invadens
EECPKYDSEDLINEYIN

SEQ ID NO: 2849438 - protein, 11 aa, Entamoeba invadens
EECSPKQDIRD

SEQ ID NO: 2849439 - protein, 26 aa, Entamoeba invadens
EECVDTPQDLESYSEQHTKCDTLSPQ

SEQ ID NO: 2849440 - protein, 4 aa, Entamoeba invadens
EEDA

SEQ ID NO: 2849441 - protein, 5 aa, Entamoeba invadens
EEDAD

SEQ ID NO: 2849442 - protein, 46 aa, Entamoeba invadens
EEDAESLKREAKKCGEARKRESEEVEEHAKEERKRIEEENKKIEEL

SEQ ID NO: 2849443 - protein, 5 aa, Entamoeba invadens
EEDAL

SEQ ID NO: 2849444 - protein, 8 aa, Entamoeba invadens
EEDAQKAF

SEQ ID NO: 2849445 - protein, 8 aa, Entamoeba invadens
EEDDDGMM

SEQ ID NO: 2849446 - protein, 6 aa, Entamoeba invadens
EEDDDL

SEQ ID NO: 2849447 - protein, 21 aa, Entamoeba invadens
EEDDDTTIPFGSGTRRVRETD

SEQ ID NO: 2849448 - protein, 13 aa, Entamoeba invadens
EEDDEESNKDSTF

SEQ ID NO: 2849449 - protein, 17 aa, Entamoeba invadens
EEDDEKTKLALVFAYIN

SEQ ID NO: 2849450 - protein, 10 aa, Entamoeba invadens
EEDDTDYNGE

SEQ ID NO: 2849451 - protein, 19 aa, Entamoeba invadens
EEDDTKKEEKKTVIDESTN

SEQ ID NO: 2849452 - protein, 14 aa, Entamoeba invadens
EEDDVKEYKTTGGS

SEQ ID NO: 2849453 - protein, 19 aa, Entamoeba invadens
EEDEALLSDKEKADDENLK

SEQ ID NO: 2849454 - protein, 8 aa, Entamoeba invadens
EEDEDEVI

SEQ ID NO: 2849455 - protein, 13 aa, Entamoeba invadens
EEDEDKDEKMSHS

SEQ ID NO: 2849456 - protein, 17 aa, Entamoeba invadens
EEDENETHTTKSQIQKK

SEQ ID NO: 2849457 - protein, 6 aa, Entamoeba invadens
EEDENI

SEQ ID NO: 2849458 - protein, 4 aa, Entamoeba invadens
EEDG

SEQ ID NO: 2849459 - protein, 7 aa, Entamoeba invadens
EEDGCSE

SEQ ID NO: 2849460 - protein, 11 aa, Entamoeba invadens
EEDGDTEKDVA

SEQ ID NO: 2849461 - protein, 8 aa, Entamoeba invadens
EEDGEEDG

SEQ ID NO: 2849462 - protein, 8 aa, Entamoeba invadens
EEDGKRKI

SEQ ID NO: 2849463 - protein, 12 aa, Entamoeba invadens
EEDGVDITEGYA

SEQ ID NO: 2849464 - protein, 7 aa, Entamoeba invadens
EEDGVVG

SEQ ID NO: 2849465 - protein, 7 aa, Entamoeba invadens
EEDIPKQ

SEQ ID NO: 2849466 - protein, 4 aa, Entamoeba invadens
EEDK

SEQ ID NO: 2849467 - protein, 11 aa, Entamoeba invadens
EEDKEEDITKT

SEQ ID NO: 2849468 - protein, 12 aa, Entamoeba invadens
EEDKEIERGTDE

SEQ ID NO: 2849469 - protein, 7 aa, Entamoeba invadens
EEDKKRY

SEQ ID NO: 2849470 - protein, 9 aa, Entamoeba invadens
EEDKQANQI

SEQ ID NO: 2849471 - protein, 10 aa, Entamoeba invadens
EEDKQIGKIS

SEQ ID NO: 2849472 - protein, 7 aa, Entamoeba invadens
EEDKSKD

SEQ ID NO: 2849473 - protein, 5 aa, Entamoeba invadens
EEDKT

SEQ ID NO: 2849474 - protein, 6 aa, Entamoeba invadens
EEDKVT

SEQ ID NO: 2849475 - protein, 4 aa, Entamoeba invadens
EEDL

SEQ ID NO: 2849476 - protein, 10 aa, Entamoeba invadens
EEDLNTQSAI

SEQ ID NO: 2849477 - protein, 5 aa, Entamoeba invadens
EEDLS

SEQ ID NO: 2849478 - protein, 7 aa, Entamoeba invadens
EEDLSQK

SEQ ID NO: 2849479 - protein, 14 aa, Entamoeba invadens
EEDMKQLEDRDLKK

SEQ ID NO: 2849480 - protein, 6 aa, Entamoeba invadens
EEDNED

SEQ ID NO: 2849481 - protein, 8 aa, Entamoeba invadens
EEDNGGIK

SEQ ID NO: 2849482 - protein, 7 aa, Entamoeba invadens
EEDNIRR

SEQ ID NO: 2849483 - protein, 5 aa, Entamoeba invadens
EEDNM

SEQ ID NO: 2849484 - protein, 8 aa, Entamoeba invadens
EEDNTTSR

SEQ ID NO: 2849485 - protein, 7 aa, Entamoeba invadens
EEDNVEK

SEQ ID NO: 2849486 - protein, 12 aa, Entamoeba invadens
EEDPIENKENGL

SEQ ID NO: 2849487 - protein, 20 aa, Entamoeba invadens
EEDPKDAEWNTTMERNESLR

SEQ ID NO: 2849488 - protein, 8 aa, Entamoeba invadens
EEDPQHLD

SEQ ID NO: 2849489 - protein, 11 aa, Entamoeba invadens
EEDPTKRPTVD

SEQ ID NO: 2849490 - protein, 8 aa, Entamoeba invadens
EEDPVVPE

SEQ ID NO: 2849491 - protein, 4 aa, Entamoeba invadens
EEDQ

SEQ ID NO: 2849492 - protein, 28 aa, Entamoeba invadens
EEDQEEKKEEVEVPSGKVTKKASGKVGK

SEQ ID NO: 2849493 - protein, 19 aa, Entamoeba invadens
EEDQKIDDGEINDIIAKLD

SEQ ID NO: 2849494 - protein, 8 aa, Entamoeba invadens
EEDQRNGA

SEQ ID NO: 2849495 - protein, 7 aa, Entamoeba invadens
EEDQVEN

SEQ ID NO: 2849496 - protein, 46 aa, Entamoeba invadens
EEDSEESKEEENNKASENDEDLSQEDDKDSGIEVSNGEDDESEEID

SEQ ID NO: 2849497 - protein, 6 aa, Entamoeba invadens
EEDVDK

SEQ ID NO: 2849498 - protein, 8 aa, Entamoeba invadens
EEEADQRA

SEQ ID NO: 2849499 - protein, 18 aa, Entamoeba invadens
EEEAEEVEHSGKEKPKDL

SEQ ID NO: 2849500 - protein, 6 aa, Entamoeba invadens
EEEAEI

SEQ ID NO: 2849501 - protein, 36 aa, Entamoeba invadens
EEEAGGETLKERVENKKMEEEMEENKIPVEKREAVR

SEQ ID NO: 2849502 - protein, 12 aa, Entamoeba invadens
EEEAKKYSTNSR

SEQ ID NO: 2849503 - protein, 7 aa, Entamoeba invadens
EEEAQAT

SEQ ID NO: 2849504 - protein, 13 aa, Entamoeba invadens
EEEAQQEEAEAGI

SEQ ID NO: 2849505 - protein, 7 aa, Entamoeba invadens
EEEASKR

SEQ ID NO: 2849506 - protein, 4 aa, Entamoeba invadens
EEEC

SEQ ID NO: 2849507 - protein, 70 aa, Entamoeba invadens
EEEDDATEEETKEETKKKTKKRTKKSKKTKAKKVSEEKKRLEKIKEKELEKTRRIEEFGKSEEEAADTEL

SEQ ID NO: 2849508 - protein, 5 aa, Entamoeba invadens
EEEDE

SEQ ID NO: 2849509 - protein, 17 aa, Entamoeba invadens
EEEDEEEDDEKKKIDAK

SEQ ID NO: 2849510 - protein, 11 aa, Entamoeba invadens
EEEDKHHPEHR

SEQ ID NO: 2849511 - protein, 7 aa, Entamoeba invadens
EEEDNDL

SEQ ID NO: 2849512 - protein, 18 aa, Entamoeba invadens
EEEDNKKENDDEYEYEYD

SEQ ID NO: 2849513 - protein, 26 aa, Entamoeba invadens
EEEDPEDSDFVEKGEVDEGMECEDDD

SEQ ID NO: 2849514 - protein, 8 aa, Entamoeba invadens
EEEDRTKI

SEQ ID NO: 2849515 - protein, 19 aa, Entamoeba invadens
EEEDTNEEENTNARQTGNF

SEQ ID NO: 2849516 - protein, 8 aa, Entamoeba invadens
EEEEDDEI

SEQ ID NO: 2849517 - protein, 5 aa, Entamoeba invadens
EEEEF

SEQ ID NO: 2849518 - protein, 16 aa, Entamoeba invadens
EEEEGSDEKLDTIDDK

SEQ ID NO: 2849519 - protein, 12 aa, Entamoeba invadens
EEEEKKNLSEIE

SEQ ID NO: 2849520 - protein, 35 aa, Entamoeba invadens
EEEELQRSGGIESNGNLKGIRPHDAVEKSGNLTTP

SEQ ID NO: 2849521 - protein, 5 aa, Entamoeba invadens
EEEEM

SEQ ID NO: 2849522 - protein, 6 aa, Entamoeba invadens
EEEEMQ

SEQ ID NO: 2849523 - protein, 7 aa, Entamoeba invadens
EEEENCE

SEQ ID NO: 2849524 - protein, 21 aa, Entamoeba invadens
EEEENEQQKKECVPNGGMEKE

SEQ ID NO: 2849525 - protein, 9 aa, Entamoeba invadens
EEEEQTPEV

SEQ ID NO: 2849526 - protein, 8 aa, Entamoeba invadens
EEEETSVA

SEQ ID NO: 2849527 - protein, 22 aa, Entamoeba invadens
EEEEVDEVEGETITKNVRDKRG

SEQ ID NO: 2849528 - protein, 31 aa, Entamoeba invadens
EEEEVKEEVKDFKGKKPAAKAQKAEATKTEK

SEQ ID NO: 2849529 - protein, 11 aa, Entamoeba invadens
EEEFKNKGKEL

SEQ ID NO: 2849530 - protein, 10 aa, Entamoeba invadens
EEEGSESNEF

SEQ ID NO: 2849531 - protein, 7 aa, Entamoeba invadens
EEEHAGG

SEQ ID NO: 2849532 - protein, 29 aa, Entamoeba invadens
EEEHAGGTIARPSYDLGESCNAEKYAEGY

SEQ ID NO: 2849533 - protein, 4 aa, Entamoeba invadens
EEEI

SEQ ID NO: 2849534 - protein, 7 aa, Entamoeba invadens
EEEIEEF

SEQ ID NO: 2849535 - protein, 7 aa, Entamoeba invadens
EEEIPKE

SEQ ID NO: 2849536 - protein, 7 aa, Entamoeba invadens
EEEISLP

SEQ ID NO: 2849537 - protein, 4 aa, Entamoeba invadens
EEEK

SEQ ID NO: 2849538 - protein, 18 aa, Entamoeba invadens
EEEKAETAHKELEETKQT

SEQ ID NO: 2849539 - protein, 11 aa, Entamoeba invadens
EEEKEQERKAE

SEQ ID NO: 2849540 - protein, 6 aa, Entamoeba invadens
EEEKIN

SEQ ID NO: 2849541 - protein, 189 aa, Entamoeba invadens
EEEKKKKEEEKRKKEEAKKKAEEEKKHKKEEEKRKKEEEKEKKKLEKEKKEQEKHHKGGHETEKQKVEKEKPKDEIKEKEKTEKDEKAKKEEEEKKQKEAAEAKAKKEEEEKVAKEKEAAEQKAKEEAAEKEKLEKEKAEKDAEEAKKKEEEAAKEKEAKEKAEKEEQEKAKEAAEQKAKTEVVENDKL

SEQ ID NO: 2849542 - protein, 11 aa, Entamoeba invadens
EEEKKKLSTFK

SEQ ID NO: 2849543 - protein, 40 aa, Entamoeba invadens
EEEKKQEELKAEETKQDENEPNKTETNEEKDEKKSTESTI

SEQ ID NO: 2849544 - protein, 13 aa, Entamoeba invadens
EEEKKQGGPQNAY

SEQ ID NO: 2849545 - protein, 13 aa, Entamoeba invadens
EEEKLDGDNKAYC

SEQ ID NO: 2849546 - protein, 8 aa, Entamoeba invadens
EEEKNLKP

SEQ ID NO: 2849547 - protein, 33 aa, Entamoeba invadens
EEEKNLRKEGNYIESDDDEYYNQTKLNNTKGMT

SEQ ID NO: 2849548 - protein, 8 aa, Entamoeba invadens
EEEKNQAL

SEQ ID NO: 2849549 - protein, 29 aa, Entamoeba invadens
EEEKPNEEPPKEEKEEQDESKMEEDNGAD

SEQ ID NO: 2849550 - protein, 52 aa, Entamoeba invadens
EEEKQEQIENAERKRKEEEEELAKEELKEKELEEQQRLKQQSEVQQQTSPVI

SEQ ID NO: 2849551 - protein, 7 aa, Entamoeba invadens
EEEKQEY

SEQ ID NO: 2849552 - protein, 6 aa, Entamoeba invadens
EEEKQQ

SEQ ID NO: 2849553 - protein, 23 aa, Entamoeba invadens
EEEKRNEEKYRMEQKEKKKQKKF

SEQ ID NO: 2849554 - protein, 12 aa, Entamoeba invadens
EEEKSKGKTIDV

SEQ ID NO: 2849555 - protein, 10 aa, Entamoeba invadens
EEEKTKSALL

SEQ ID NO: 2849556 - protein, 13 aa, Entamoeba invadens
EEEKTSEEKSPYY

SEQ ID NO: 2849557 - protein, 4 aa, Entamoeba invadens
EEEL

SEQ ID NO: 2849558 - protein, 6 aa, Entamoeba invadens
EEELEN

SEQ ID NO: 2849559 - protein, 7 aa, Entamoeba invadens
EEELENL

SEQ ID NO: 2849560 - protein, 7 aa, Entamoeba invadens
EEELGEY

SEQ ID NO: 2849561 - protein, 8 aa, Entamoeba invadens
EEELTEDE

SEQ ID NO: 2849562 - protein, 8 aa, Entamoeba invadens
EEEMSRKT

SEQ ID NO: 2849563 - protein, 12 aa, Entamoeba invadens
EEENEAQRKKDG

SEQ ID NO: 2849564 - protein, 18 aa, Entamoeba invadens
EEENIEETVPQINEKEKE

SEQ ID NO: 2849565 - protein, 8 aa, Entamoeba invadens
EEENKERI

SEQ ID NO: 2849566 - protein, 14 aa, Entamoeba invadens
EEENKNKNDEIEKM

SEQ ID NO: 2849567 - protein, 7 aa, Entamoeba invadens
EEENNKI

SEQ ID NO: 2849568 - protein, 10 aa, Entamoeba invadens
EEEPEAEEVK

SEQ ID NO: 2849569 - protein, 27 aa, Entamoeba invadens
EEEPNTEKSNNLVEDNKSKDGKEIKTE

SEQ ID NO: 2849570 - protein, 10 aa, Entamoeba invadens
EEEPRLETPE

SEQ ID NO: 2849571 - protein, 7 aa, Entamoeba invadens
EEEPTIK

SEQ ID NO: 2849572 - protein, 16 aa, Entamoeba invadens
EEEQGELESSVSQAMS

SEQ ID NO: 2849573 - protein, 7 aa, Entamoeba invadens
EEEQKIR

SEQ ID NO: 2849574 - protein, 19 aa, Entamoeba invadens
EEEQKMDDDEINDIIAKLD

SEQ ID NO: 2849575 - protein, 13 aa, Entamoeba invadens
EEEQKPKIVRPRG

SEQ ID NO: 2849576 - protein, 4 aa, Entamoeba invadens
EEER

SEQ ID NO: 2849577 - protein, 13 aa, Entamoeba invadens
EEERAKPYFKSDR

SEQ ID NO: 2849578 - protein, 8 aa, Entamoeba invadens
EEEREEEV

SEQ ID NO: 2849579 - protein, 5 aa, Entamoeba invadens
EEERI

SEQ ID NO: 2849580 - protein, 13 aa, Entamoeba invadens
EEERINETKRRDI

SEQ ID NO: 2849581 - protein, 13 aa, Entamoeba invadens
EEERINETKRSDI

SEQ ID NO: 2849582 - protein, 12 aa, Entamoeba invadens
EEERIPKGQCTR

SEQ ID NO: 2849583 - protein, 15 aa, Entamoeba invadens
EEERKFEEAQKSVEN

SEQ ID NO: 2849584 - protein, 5 aa, Entamoeba invadens
EEERM

SEQ ID NO: 2849585 - protein, 6 aa, Entamoeba invadens
EEERNI

SEQ ID NO: 2849586 - protein, 11 aa, Entamoeba invadens
EEERPFTPSRR

SEQ ID NO: 2849587 - protein, 21 aa, Entamoeba invadens
EEERREEGNLKKKMNASYMEI

SEQ ID NO: 2849588 - protein, 5 aa, Entamoeba invadens
EEERV

SEQ ID NO: 2849589 - protein, 28 aa, Entamoeba invadens
EEESESTEFDTTTENKQNVKEKEQPKEL

SEQ ID NO: 2849590 - protein, 10 aa, Entamoeba invadens
EEESKTTLPA

SEQ ID NO: 2849591 - protein, 16 aa, Entamoeba invadens
EEESNESFRTSEIEES

SEQ ID NO: 2849592 - protein, 15 aa, Entamoeba invadens
EEESPRLKSSFPLKT

SEQ ID NO: 2849593 - protein, 15 aa, Entamoeba invadens
EEESQNSDETEIEHF

SEQ ID NO: 2849594 - protein, 6 aa, Entamoeba invadens
EEESYK

SEQ ID NO: 2849595 - protein, 5 aa, Entamoeba invadens
EEETA

SEQ ID NO: 2849596 - protein, 6 aa, Entamoeba invadens
EEETAV

SEQ ID NO: 2849597 - protein, 19 aa, Entamoeba invadens
EEETCKAGGASQSYNERHH

SEQ ID NO: 2849598 - protein, 10 aa, Entamoeba invadens
EEETTKIDTN

SEQ ID NO: 2849599 - protein, 10 aa, Entamoeba invadens
EEETTTPIDL

SEQ ID NO: 2849600 - protein, 5 aa, Entamoeba invadens
EEETV

SEQ ID NO: 2849601 - protein, 4 aa, Entamoeba invadens
EEEV

SEQ ID NO: 2849602 - protein, 11 aa, Entamoeba invadens
EEEVDDKITSN

SEQ ID NO: 2849603 - protein, 5 aa, Entamoeba invadens
EEEVE

SEQ ID NO: 2849604 - protein, 9 aa, Entamoeba invadens
EEEVEQQKT

SEQ ID NO: 2849605 - protein, 10 aa, Entamoeba invadens
EEEVKDENGK

SEQ ID NO: 2849606 - protein, 6 aa, Entamoeba invadens
EEEVNK

SEQ ID NO: 2849607 - protein, 6 aa, Entamoeba invadens
EEEVNR

SEQ ID NO: 2849608 - protein, 4 aa, Entamoeba invadens
EEEY

SEQ ID NO: 2849609 - protein, 8 aa, Entamoeba invadens
EEEYQSED

SEQ ID NO: 2849610 - protein, 14 aa, Entamoeba invadens
EEEYSTPEDCTAGA

SEQ ID NO: 2849611 - protein, 8 aa, Entamoeba invadens
EEFDASPE

SEQ ID NO: 2849612 - protein, 4 aa, Entamoeba invadens
EEFE

SEQ ID NO: 2849613 - protein, 13 aa, Entamoeba invadens
EEFESKESRYSSQ

SEQ ID NO: 2849614 - protein, 8 aa, Entamoeba invadens
EEFGPSTI

SEQ ID NO: 2849615 - protein, 4 aa, Entamoeba invadens
EEFK

SEQ ID NO: 2849616 - protein, 9 aa, Entamoeba invadens
EEFSPSRKL

SEQ ID NO: 2849617 - protein, 27 aa, Entamoeba invadens
EEFTDSTPQRGEQVKRANSANPHDDEI

SEQ ID NO: 2849618 - protein, 8 aa, Entamoeba invadens
EEFTSKSP

SEQ ID NO: 2849619 - protein, 4 aa, Entamoeba invadens
EEGA

SEQ ID NO: 2849620 - protein, 10 aa, Entamoeba invadens
EEGAKEAGIQ

SEQ ID NO: 2849621 - protein, 7 aa, Entamoeba invadens
EEGDEDN

SEQ ID NO: 2849622 - protein, 61 aa, Entamoeba invadens
EEGDEEPETQYDGLDASSDEGEVYNEEDEEDDDDKPIKKTKTTKKGAKTSQTKKGKKKTTN

SEQ ID NO: 2849623 - protein, 6 aa, Entamoeba invadens
EEGDVK

SEQ ID NO: 2849624 - protein, 16 aa, Entamoeba invadens
EEGEPDEDFPSLEPTS

SEQ ID NO: 2849625 - protein, 12 aa, Entamoeba invadens
EEGETTCQEDEE

SEQ ID NO: 2849626 - protein, 7 aa, Entamoeba invadens
EEGEVDI

SEQ ID NO: 2849627 - protein, 5 aa, Entamoeba invadens
EEGEW

SEQ ID NO: 2849628 - protein, 6 aa, Entamoeba invadens
EEGFGK

SEQ ID NO: 2849629 - protein, 5 aa, Entamoeba invadens
EEGFN

SEQ ID NO: 2849630 - protein, 6 aa, Entamoeba invadens
EEGGSN

SEQ ID NO: 2849631 - protein, 8 aa, Entamoeba invadens
EEGKDLAE

SEQ ID NO: 2849632 - protein, 7 aa, Entamoeba invadens
EEGKKDG

SEQ ID NO: 2849633 - protein, 8 aa, Entamoeba invadens
EEGKKREY

SEQ ID NO: 2849634 - protein, 8 aa, Entamoeba invadens
EEGKNLSV

SEQ ID NO: 2849635 - protein, 8 aa, Entamoeba invadens
EEGKSEEV

SEQ ID NO: 2849636 - protein, 5 aa, Entamoeba invadens
EEGLG

SEQ ID NO: 2849637 - protein, 5 aa, Entamoeba invadens
EEGLK

SEQ ID NO: 2849638 - protein, 6 aa, Entamoeba invadens
EEGLKM

SEQ ID NO: 2849639 - protein, 4 aa, Entamoeba invadens
EEGM

SEQ ID NO: 2849640 - protein, 5 aa, Entamoeba invadens
EEGMD

SEQ ID NO: 2849641 - protein, 7 aa, Entamoeba invadens
EEGMREK

SEQ ID NO: 2849642 - protein, 7 aa, Entamoeba invadens
EEGNAST

SEQ ID NO: 2849643 - protein, 27 aa, Entamoeba invadens
EEGNDAYGFESNQSSDSSDSLNEATFA

SEQ ID NO: 2849644 - protein, 8 aa, Entamoeba invadens
EEGNDDDV

SEQ ID NO: 2849645 - protein, 6 aa, Entamoeba invadens
EEGNEE

SEQ ID NO: 2849646 - protein, 15 aa, Entamoeba invadens
EEGNEVLRATSSPIV

SEQ ID NO: 2849647 - protein, 10 aa, Entamoeba invadens
EEGPHSKKPM

SEQ ID NO: 2849648 - protein, 10 aa, Entamoeba invadens
EEGPSETNLR

SEQ ID NO: 2849649 - protein, 7 aa, Entamoeba invadens
EEGQELA

SEQ ID NO: 2849650 - protein, 5 aa, Entamoeba invadens
EEGRD

SEQ ID NO: 2849651 - protein, 13 aa, Entamoeba invadens
EEGRLNVGGPVGD

SEQ ID NO: 2849652 - protein, 7 aa, Entamoeba invadens
EEGRSDI

SEQ ID NO: 2849653 - protein, 6 aa, Entamoeba invadens
EEGRVE

SEQ ID NO: 2849654 - protein, 4 aa, Entamoeba invadens
EEGS

SEQ ID NO: 2849655 - protein, 6 aa, Entamoeba invadens
EEGSEE

SEQ ID NO: 2849656 - protein, 7 aa, Entamoeba invadens
EEGSELH

SEQ ID NO: 2849657 - protein, 12 aa, Entamoeba invadens
EEGSELHDSVLY

SEQ ID NO: 2849658 - protein, 13 aa, Entamoeba invadens
EEGSSMSLGNIMV

SEQ ID NO: 2849659 - protein, 6 aa, Entamoeba invadens
EEGSVS

SEQ ID NO: 2849660 - protein, 9 aa, Entamoeba invadens
EEGTDGDKL

SEQ ID NO: 2849661 - protein, 43 aa, Entamoeba invadens
EEGTLNNEPKKMEEEPPKNEQLQSNNEKKEQPTNGDTESKEVL

SEQ ID NO: 2849662 - protein, 21 aa, Entamoeba invadens
EEGTNEQSKSVPQLEQQQEHQ

SEQ ID NO: 2849663 - protein, 4 aa, Entamoeba invadens
EEGV

SEQ ID NO: 2849664 - protein, 6 aa, Entamoeba invadens
EEGVDT

SEQ ID NO: 2849665 - protein, 8 aa, Entamoeba invadens
EEGVGKST

SEQ ID NO: 2849666 - protein, 5 aa, Entamoeba invadens
EEGWK

SEQ ID NO: 2849667 - protein, 9 aa, Entamoeba invadens
EEGWKGAKE

SEQ ID NO: 2849668 - protein, 6 aa, Entamoeba invadens
EEHEFS

SEQ ID NO: 2849669 - protein, 5 aa, Entamoeba invadens
EEHEI

SEQ ID NO: 2849670 - protein, 16 aa, Entamoeba invadens
EEHEKREKQKESTKKM

SEQ ID NO: 2849671 - protein, 19 aa, Entamoeba invadens
EEHGLSSDGVFSGTKLQEQ

SEQ ID NO: 2849672 - protein, 6 aa, Entamoeba invadens
EEHGNA

SEQ ID NO: 2849673 - protein, 60 aa, Entamoeba invadens
EEHKAEDDDQMKEQNSEEKRSEENELQKSVTMPKRNETKEERSSQRALEEVDKGSEDSGV

SEQ ID NO: 2849674 - protein, 6 aa, Entamoeba invadens
EEHKEE

SEQ ID NO: 2849675 - protein, 14 aa, Entamoeba invadens
EEHKHNTQKLDGRK

SEQ ID NO: 2849676 - protein, 12 aa, Entamoeba invadens
EEHKTVNELPKT

SEQ ID NO: 2849677 - protein, 7 aa, Entamoeba invadens
EEHNATN

SEQ ID NO: 2849678 - protein, 10 aa, Entamoeba invadens
EEHNKCNEVK

SEQ ID NO: 2849679 - protein, 16 aa, Entamoeba invadens
EEHNTKNSEEITRLQN

SEQ ID NO: 2849680 - protein, 8 aa, Entamoeba invadens
EEHQNENV

SEQ ID NO: 2849681 - protein, 34 aa, Entamoeba invadens
EEHQNNAFSRKKNSKRKKQTKKKNITPCIEKDVI

SEQ ID NO: 2849682 - protein, 5 aa, Entamoeba invadens
EEHTT

SEQ ID NO: 2849683 - protein, 12 aa, Entamoeba invadens
EEIAKREAAEKA

SEQ ID NO: 2849684 - protein, 7 aa, Entamoeba invadens
EEIAQDE

SEQ ID NO: 2849685 - protein, 21 aa, Entamoeba invadens
EEIASAKSAQKAKEVKDKKQT

SEQ ID NO: 2849686 - protein, 6 aa, Entamoeba invadens
EEIATK

SEQ ID NO: 2849687 - protein, 4 aa, Entamoeba invadens
EEID

SEQ ID NO: 2849688 - protein, 28 aa, Entamoeba invadens
EEIDEIDNEASDQSNEEESSDDENDEMS

SEQ ID NO: 2849689 - protein, 8 aa, Entamoeba invadens
EEIDEPKT

SEQ ID NO: 2849690 - protein, 6 aa, Entamoeba invadens
EEIDEQ

SEQ ID NO: 2849691 - protein, 13 aa, Entamoeba invadens
EEIDKKKAEEEQL

SEQ ID NO: 2849692 - protein, 5 aa, Entamoeba invadens
EEIEA

SEQ ID NO: 2849693 - protein, 8 aa, Entamoeba invadens
EEIEKAKN

SEQ ID NO: 2849694 - protein, 8 aa, Entamoeba invadens
EEIEKDGG

SEQ ID NO: 2849695 - protein, 6 aa, Entamoeba invadens
EEIEKR

SEQ ID NO: 2849696 - protein, 5 aa, Entamoeba invadens
EEIEN

SEQ ID NO: 2849697 - protein, 8 aa, Entamoeba invadens
EEIENAPN

SEQ ID NO: 2849698 - protein, 31 aa, Entamoeba invadens
EEIENQMKEKENELNETAKQLEDTNNKFNTV

SEQ ID NO: 2849699 - protein, 10 aa, Entamoeba invadens
EEIEPTESEI

SEQ ID NO: 2849700 - protein, 5 aa, Entamoeba invadens
EEIEQ

SEQ ID NO: 2849701 - protein, 10 aa, Entamoeba invadens
EEIESKEQHY

SEQ ID NO: 2849702 - protein, 34 aa, Entamoeba invadens
EEIETEKEEAQNAVAKAKKQAKQYARKVEEAERK

SEQ ID NO: 2849703 - protein, 18 aa, Entamoeba invadens
EEIGEKEPDVKPPEKEEK

SEQ ID NO: 2849704 - protein, 4 aa, Entamoeba invadens
EEII

SEQ ID NO: 2849705 - protein, 13 aa, Entamoeba invadens
EEIIKSQQKEVKK

SEQ ID NO: 2849706 - protein, 6 aa, Entamoeba invadens
EEIKAR

SEQ ID NO: 2849707 - protein, 31 aa, Entamoeba invadens
EEIKKKEKLEREQKKKKKEIEKKLKKVQDPP

SEQ ID NO: 2849708 - protein, 10 aa, Entamoeba invadens
EEIKNDDMEG

SEQ ID NO: 2849709 - protein, 13 aa, Entamoeba invadens
EEIKNEKKETEEK

SEQ ID NO: 2849710 - protein, 8 aa, Entamoeba invadens
EEIKNKKI

SEQ ID NO: 2849711 - protein, 5 aa, Entamoeba invadens
EEIKR

SEQ ID NO: 2849712 - protein, 11 aa, Entamoeba invadens
EEINEEKDRQI

SEQ ID NO: 2849713 - protein, 15 aa, Entamoeba invadens
EEINRNERGEVKEEM

SEQ ID NO: 2849714 - protein, 15 aa, Entamoeba invadens
EEINYRSSEEGRNID

SEQ ID NO: 2849715 - protein, 6 aa, Entamoeba invadens
EEIPDA

SEQ ID NO: 2849716 - protein, 11 aa, Entamoeba invadens
EEIPKLSEKEI

SEQ ID NO: 2849717 - protein, 56 aa, Entamoeba invadens
EEIQKEKEKEKPTKPKSELKTKKESQTIKPKTERRQPRIPKREKTGLQLPEDQQKV

SEQ ID NO: 2849718 - protein, 13 aa, Entamoeba invadens
EEIQNENENLQSQ

SEQ ID NO: 2849719 - protein, 5 aa, Entamoeba invadens
EEIQS

SEQ ID NO: 2849720 - protein, 8 aa, Entamoeba invadens
EEIRGDKD

SEQ ID NO: 2849721 - protein, 18 aa, Entamoeba invadens
EEIRKNEKTEQKVEEQIK

SEQ ID NO: 2849722 - protein, 4 aa, Entamoeba invadens
EEIS

SEQ ID NO: 2849723 - protein, 13 aa, Entamoeba invadens
EEISARNKKERGR

SEQ ID NO: 2849724 - protein, 6 aa, Entamoeba invadens
EEISEL

SEQ ID NO: 2849725 - protein, 6 aa, Entamoeba invadens
EEISET

SEQ ID NO: 2849726 - protein, 22 aa, Entamoeba invadens
EEISNRLEREERADATEAIRTL

SEQ ID NO: 2849727 - protein, 4 aa, Entamoeba invadens
EEIT

SEQ ID NO: 2849728 - protein, 18 aa, Entamoeba invadens
EEITNPEVPQISDEVETK

SEQ ID NO: 2849729 - protein, 8 aa, Entamoeba invadens
EEITNYTK

SEQ ID NO: 2849730 - protein, 6 aa, Entamoeba invadens
EEITQT

SEQ ID NO: 2849731 - protein, 5 aa, Entamoeba invadens
EEITR

SEQ ID NO: 2849732 - protein, 8 aa, Entamoeba invadens
EEKAGRKE

SEQ ID NO: 2849733 - protein, 6 aa, Entamoeba invadens
EEKAKL

SEQ ID NO: 2849734 - protein, 18 aa, Entamoeba invadens
EEKCQNNEVSQSYNERYH

SEQ ID NO: 2849735 - protein, 6 aa, Entamoeba invadens
EEKCRS

SEQ ID NO: 2849736 - protein, 18 aa, Entamoeba invadens
EEKDDDGLPTNEEQEKQE

SEQ ID NO: 2849737 - protein, 7 aa, Entamoeba invadens
EEKDDKV

SEQ ID NO: 2849738 - protein, 9 aa, Entamoeba invadens
EEKDDLSNG

SEQ ID NO: 2849739 - protein, 9 aa, Entamoeba invadens
EEKDEKGRT

SEQ ID NO: 2849740 - protein, 5 aa, Entamoeba invadens
EEKDH

SEQ ID NO: 2849741 - protein, 8 aa, Entamoeba invadens
EEKDHKIK

SEQ ID NO: 2849742 - protein, 18 aa, Entamoeba invadens
EEKDLDVKEVANKVYELL

SEQ ID NO: 2849743 - protein, 10 aa, Entamoeba invadens
EEKDNATKLA

SEQ ID NO: 2849744 - protein, 8 aa, Entamoeba invadens
EEKDSRQE

SEQ ID NO: 2849745 - protein, 8 aa, Entamoeba invadens
EEKDTKKW

SEQ ID NO: 2849746 - protein, 4 aa, Entamoeba invadens
EEKE

SEQ ID NO: 2849747 - protein, 11 aa, Entamoeba invadens
EEKEEKSKELR

SEQ ID NO: 2849748 - protein, 18 aa, Entamoeba invadens
EEKEENIPSQEDQYKKPA

SEQ ID NO: 2849749 - protein, 23 aa, Entamoeba invadens
EEKEESKACKTEKCTTNTNLQKE

SEQ ID NO: 2849750 - protein, 12 aa, Entamoeba invadens
EEKEEVKDDNAE

SEQ ID NO: 2849751 - protein, 9 aa, Entamoeba invadens
EEKEGKYQK

SEQ ID NO: 2849752 - protein, 16 aa, Entamoeba invadens
EEKEIATTIEQQNSDI

SEQ ID NO: 2849753 - protein, 6 aa, Entamoeba invadens
EEKEIM

SEQ ID NO: 2849754 - protein, 7 aa, Entamoeba invadens
EEKEIPT

SEQ ID NO: 2849755 - protein, 6 aa, Entamoeba invadens
EEKEKE

SEQ ID NO: 2849756 - protein, 20 aa, Entamoeba invadens
EEKEKEDVGSEKQCKEEQIE

SEQ ID NO: 2849757 - protein, 15 aa, Entamoeba invadens
EEKEKEKSKDGKAID

SEQ ID NO: 2849758 - protein, 29 aa, Entamoeba invadens
EEKEKGTKELQTQTEKNTTLENTLKEKEI

SEQ ID NO: 2849759 - protein, 19 aa, Entamoeba invadens
EEKEKSKASSYFPDTPGQM

SEQ ID NO: 2849760 - protein, 24 aa, Entamoeba invadens
EEKEKVHQTISSNPFDESAAPLQT

SEQ ID NO: 2849761 - protein, 5 aa, Entamoeba invadens
EEKEL

SEQ ID NO: 2849762 - protein, 20 aa, Entamoeba invadens
EEKENKVENDGTQEEKKMEM

SEQ ID NO: 2849763 - protein, 10 aa, Entamoeba invadens
EEKETNSESV

SEQ ID NO: 2849764 - protein, 15 aa, Entamoeba invadens
EEKETQQQDKKESEV

SEQ ID NO: 2849765 - protein, 15 aa, Entamoeba invadens
EEKEVGGNYDDPDFY

SEQ ID NO: 2849766 - protein, 7 aa, Entamoeba invadens
EEKEVGT

SEQ ID NO: 2849767 - protein, 9 aa, Entamoeba invadens
EEKEYHAKE

SEQ ID NO: 2849768 - protein, 20 aa, Entamoeba invadens
EEKEYRAKEIRSRCDKNEKK

SEQ ID NO: 2849769 - protein, 7 aa, Entamoeba invadens
EEKEYST

SEQ ID NO: 2849770 - protein, 7 aa, Entamoeba invadens
EEKGGAN

SEQ ID NO: 2849771 - protein, 11 aa, Entamoeba invadens
EEKGKNKESYQ

SEQ ID NO: 2849772 - protein, 8 aa, Entamoeba invadens
EEKGKPLR

SEQ ID NO: 2849773 - protein, 6 aa, Entamoeba invadens
EEKGKS

SEQ ID NO: 2849774 - protein, 13 aa, Entamoeba invadens
EEKGRYTTFGTTK

SEQ ID NO: 2849775 - protein, 15 aa, Entamoeba invadens
EEKGSGSESECCIEE

SEQ ID NO: 2849776 - protein, 5 aa, Entamoeba invadens
EEKGV

SEQ ID NO: 2849777 - protein, 7 aa, Entamoeba invadens
EEKGVDR

SEQ ID NO: 2849778 - protein, 14 aa, Entamoeba invadens
EEKGVSETLAFLGE

SEQ ID NO: 2849779 - protein, 12 aa, Entamoeba invadens
EEKHRKEQEELK

SEQ ID NO: 2849780 - protein, 5 aa, Entamoeba invadens
EEKHS

SEQ ID NO: 2849781 - protein, 5 aa, Entamoeba invadens
EEKHV

SEQ ID NO: 2849782 - protein, 7 aa, Entamoeba invadens
EEKIGGV

SEQ ID NO: 2849783 - protein, 9 aa, Entamoeba invadens
EEKIPEKYK

SEQ ID NO: 2849784 - protein, 8 aa, Entamoeba invadens
EEKITKKK

SEQ ID NO: 2849785 - protein, 28 aa, Entamoeba invadens
EEKKARSTKEKDAKKEIDELNEKQRQID

SEQ ID NO: 2849786 - protein, 10 aa, Entamoeba invadens
EEKKDDTYKS

SEQ ID NO: 2849787 - protein, 10 aa, Entamoeba invadens
EEKKDKIDKK

SEQ ID NO: 2849788 - protein, 9 aa, Entamoeba invadens
EEKKDYKSA

SEQ ID NO: 2849789 - protein, 28 aa, Entamoeba invadens
EEKKEAKDEKIEEHEDFSPTEKMEEDLK

SEQ ID NO: 2849790 - protein, 10 aa, Entamoeba invadens
EEKKEENPGF

SEQ ID NO: 2849791 - protein, 7 aa, Entamoeba invadens
EEKKENF

SEQ ID NO: 2849792 - protein, 23 aa, Entamoeba invadens
EEKKEPKKERPRLQKKKGIPPIQ

SEQ ID NO: 2849793 - protein, 21 aa, Entamoeba invadens
EEKKEPTKKNHQRKGAWTGGK

SEQ ID NO: 2849794 - protein, 11 aa, Entamoeba invadens
EEKKERVEGDK

SEQ ID NO: 2849795 - protein, 6 aa, Entamoeba invadens
EEKKET

SEQ ID NO: 2849796 - protein, 11 aa, Entamoeba invadens
EEKKGKSARKS

SEQ ID NO: 2849797 - protein, 5 aa, Entamoeba invadens
EEKKI

SEQ ID NO: 2849798 - protein, 12 aa, Entamoeba invadens
EEKKKEEDRIQE

SEQ ID NO: 2849799 - protein, 10 aa, Entamoeba invadens
EEKKKEEPID

SEQ ID NO: 2849800 - protein, 11 aa, Entamoeba invadens
EEKKKEMTKEM

SEQ ID NO: 2849801 - protein, 10 aa, Entamoeba invadens
EEKKKGAGFE

SEQ ID NO: 2849802 - protein, 12 aa, Entamoeba invadens
EEKKLDEFASGE

SEQ ID NO: 2849803 - protein, 5 aa, Entamoeba invadens
EEKKP

SEQ ID NO: 2849804 - protein, 14 aa, Entamoeba invadens
EEKKQEKSLRNRFQ

SEQ ID NO: 2849805 - protein, 9 aa, Entamoeba invadens
EEKKQNGDV

SEQ ID NO: 2849806 - protein, 30 aa, Entamoeba invadens
EEKKRAEEQQRVNEEERIKQEEKNRLYREK

SEQ ID NO: 2849807 - protein, 10 aa, Entamoeba invadens
EEKKSKNSIL

SEQ ID NO: 2849808 - protein, 16 aa, Entamoeba invadens
EEKKSPKRKRWSKDVR

SEQ ID NO: 2849809 - protein, 19 aa, Entamoeba invadens
EEKKSTKQITVNTSTPITR

SEQ ID NO: 2849810 - protein, 9 aa, Entamoeba invadens
EEKKSTPSL

SEQ ID NO: 2849811 - protein, 14 aa, Entamoeba invadens
EEKKSVKKAHYGEK

SEQ ID NO: 2849812 - protein, 14 aa, Entamoeba invadens
EEKKSVKQAHYGEK

SEQ ID NO: 2849813 - protein, 7 aa, Entamoeba invadens
EEKKTDV

SEQ ID NO: 2849814 - protein, 12 aa, Entamoeba invadens
EEKKTKKAKYTE

SEQ ID NO: 2849815 - protein, 12 aa, Entamoeba invadens
EEKKTKKANVTE

SEQ ID NO: 2849816 - protein, 12 aa, Entamoeba invadens
EEKKTKKSKCTE

SEQ ID NO: 2849817 - protein, 10 aa, Entamoeba invadens
EEKKTNSESV

SEQ ID NO: 2849818 - protein, 8 aa, Entamoeba invadens
EEKKTTIY

SEQ ID NO: 2849819 - protein, 10 aa, Entamoeba invadens
EEKKTTTRRN

SEQ ID NO: 2849820 - protein, 4 aa, Entamoeba invadens
EEKL

SEQ ID NO: 2849821 - protein, 22 aa, Entamoeba invadens
EEKLDEQKIEEKNEEQKDEQVE

SEQ ID NO: 2849822 - protein, 8 aa, Entamoeba invadens
EEKMEGDS

SEQ ID NO: 2849823 - protein, 8 aa, Entamoeba invadens
EEKMGMSK

SEQ ID NO: 2849824 - protein, 6 aa, Entamoeba invadens
EEKNER

SEQ ID NO: 2849825 - protein, 11 aa, Entamoeba invadens
EEKNKNKQQTK

SEQ ID NO: 2849826 - protein, 5 aa, Entamoeba invadens
EEKNQ

SEQ ID NO: 2849827 - protein, 9 aa, Entamoeba invadens
EEKPDVTYK

SEQ ID NO: 2849828 - protein, 11 aa, Entamoeba invadens
EEKPQVNVNEN

SEQ ID NO: 2849829 - protein, 13 aa, Entamoeba invadens
EEKPVAPKPVEKP

SEQ ID NO: 2849830 - protein, 7 aa, Entamoeba invadens
EEKQENN

SEQ ID NO: 2849831 - protein, 9 aa, Entamoeba invadens
EEKQGTTSD

SEQ ID NO: 2849832 - protein, 17 aa, Entamoeba invadens
EEKQKIEKEKTQRISMS

SEQ ID NO: 2849833 - protein, 8 aa, Entamoeba invadens
EEKQKTNF

SEQ ID NO: 2849834 - protein, 8 aa, Entamoeba invadens
EEKQYTEC

SEQ ID NO: 2849835 - protein, 4 aa, Entamoeba invadens
EEKR

SEQ ID NO: 2849836 - protein, 13 aa, Entamoeba invadens
EEKRAEARKDKRE

SEQ ID NO: 2849837 - protein, 11 aa, Entamoeba invadens
EEKRAKNEAPA

SEQ ID NO: 2849838 - protein, 11 aa, Entamoeba invadens
EEKRCSQRQCT

SEQ ID NO: 2849839 - protein, 40 aa, Entamoeba invadens
EEKREEKSIQKNLTEKAEEKEEGNVVEKKATKLSDEITKE

SEQ ID NO: 2849840 - protein, 20 aa, Entamoeba invadens
EEKRENQKKIEIERNEIDEE

SEQ ID NO: 2849841 - protein, 7 aa, Entamoeba invadens
EEKRFNE

SEQ ID NO: 2849842 - protein, 9 aa, Entamoeba invadens
EEKRLGEGS

SEQ ID NO: 2849843 - protein, 11 aa, Entamoeba invadens
EEKRNNENPSG

SEQ ID NO: 2849844 - protein, 14 aa, Entamoeba invadens
EEKRPNPVGKGKKK

SEQ ID NO: 2849845 - protein, 9 aa, Entamoeba invadens
EEKRQIELD

SEQ ID NO: 2849846 - protein, 11 aa, Entamoeba invadens
EEKRRIESAGG

SEQ ID NO: 2849847 - protein, 6 aa, Entamoeba invadens
EEKRSC

SEQ ID NO: 2849848 - protein, 9 aa, Entamoeba invadens
EEKRSEEMG

SEQ ID NO: 2849849 - protein, 13 aa, Entamoeba invadens
EEKRYENKKEEAA

SEQ ID NO: 2849850 - protein, 8 aa, Entamoeba invadens
EEKSAEEI

SEQ ID NO: 2849851 - protein, 5 aa, Entamoeba invadens
EEKSL

SEQ ID NO: 2849852 - protein, 8 aa, Entamoeba invadens
EEKSLKDT

SEQ ID NO: 2849853 - protein, 5 aa, Entamoeba invadens
EEKSR

SEQ ID NO: 2849854 - protein, 11 aa, Entamoeba invadens
EEKSYKDTIRA

SEQ ID NO: 2849855 - protein, 4 aa, Entamoeba invadens
EEKT

SEQ ID NO: 2849856 - protein, 11 aa, Entamoeba invadens
EEKTEKFGKSE

SEQ ID NO: 2849857 - protein, 15 aa, Entamoeba invadens
EEKTETVAKHKDTIQ

SEQ ID NO: 2849858 - protein, 15 aa, Entamoeba invadens
EEKTKASIPPTTDIT

SEQ ID NO: 2849859 - protein, 9 aa, Entamoeba invadens
EEKTKKKMS

SEQ ID NO: 2849860 - protein, 10 aa, Entamoeba invadens
EEKTNGGNQK

SEQ ID NO: 2849861 - protein, 6 aa, Entamoeba invadens
EEKTPE

SEQ ID NO: 2849862 - protein, 28 aa, Entamoeba invadens
EEKTREGYDAYKNDTSLQAKVGEGYVSD

SEQ ID NO: 2849863 - protein, 5 aa, Entamoeba invadens
EEKTV

SEQ ID NO: 2849864 - protein, 5 aa, Entamoeba invadens
EEKTY

SEQ ID NO: 2849865 - protein, 4 aa, Entamoeba invadens
EEKV

SEQ ID NO: 2849866 - protein, 19 aa, Entamoeba invadens
EEKVEKTKSVMKGSDELAG

SEQ ID NO: 2849867 - protein, 9 aa, Entamoeba invadens
EEKVKKGAF

SEQ ID NO: 2849868 - protein, 4 aa, Entamoeba invadens
EEKW

SEQ ID NO: 2849869 - protein, 4 aa, Entamoeba invadens
EEKY

SEQ ID NO: 2849870 - protein, 13 aa, Entamoeba invadens
EEKYDTPHTEPKL

SEQ ID NO: 2849871 - protein, 7 aa, Entamoeba invadens
EEKYNQI

SEQ ID NO: 2849872 - protein, 5 aa, Entamoeba invadens
EEKYS

SEQ ID NO: 2849873 - protein, 21 aa, Entamoeba invadens
EELAKKKNCKYVETGKQVDSL

SEQ ID NO: 2849874 - protein, 8 aa, Entamoeba invadens
EELAPSLK

SEQ ID NO: 2849875 - protein, 13 aa, Entamoeba invadens
EELARSTQDFNGA

SEQ ID NO: 2849876 - protein, 13 aa, Entamoeba invadens
EELASAKEQFTRN

SEQ ID NO: 2849877 - protein, 13 aa, Entamoeba invadens
EELATKDKEIEAL

SEQ ID NO: 2849878 - protein, 15 aa, Entamoeba invadens
EELDDDYKQTKTIEF

SEQ ID NO: 2849879 - protein, 28 aa, Entamoeba invadens
EELDESSDKMKEQIDKIEKGKSGLNEAR

SEQ ID NO: 2849880 - protein, 8 aa, Entamoeba invadens
EELDGDNV

SEQ ID NO: 2849881 - protein, 7 aa, Entamoeba invadens
EELDNNK

SEQ ID NO: 2849882 - protein, 4 aa, Entamoeba invadens
EELE

SEQ ID NO: 2849883 - protein, 6 aa, Entamoeba invadens
EELEAG

SEQ ID NO: 2849884 - protein, 11 aa, Entamoeba invadens
EELEEEEGHTY

SEQ ID NO: 2849885 - protein, 6 aa, Entamoeba invadens
EELEEN

SEQ ID NO: 2849886 - protein, 42 aa, Entamoeba invadens
EELEKENSELQHAKKEGVDSMDTLERNEQCEGESSNVERENK

SEQ ID NO: 2849887 - protein, 16 aa, Entamoeba invadens
EELENQNKTLEEKNTK

SEQ ID NO: 2849888 - protein, 7 aa, Entamoeba invadens
EELENTP

SEQ ID NO: 2849889 - protein, 11 aa, Entamoeba invadens
EELEREKYTTL

SEQ ID NO: 2849890 - protein, 13 aa, Entamoeba invadens
EELESPNENEIEI

SEQ ID NO: 2849891 - protein, 22 aa, Entamoeba invadens
EELESVKKEKQASDETNEKNLK

SEQ ID NO: 2849892 - protein, 5 aa, Entamoeba invadens
EELGE

SEQ ID NO: 2849893 - protein, 12 aa, Entamoeba invadens
EELKARHENEDA

SEQ ID NO: 2849894 - protein, 11 aa, Entamoeba invadens
EELKKDNVEDK

SEQ ID NO: 2849895 - protein, 17 aa, Entamoeba invadens
EELKKEEEYISEEKKFK

SEQ ID NO: 2849896 - protein, 10 aa, Entamoeba invadens
EELKKEKDEL

SEQ ID NO: 2849897 - protein, 25 aa, Entamoeba invadens
EELKKEKEPVKKKKQSQQKKNQLQK

SEQ ID NO: 2849898 - protein, 6 aa, Entamoeba invadens
EELKKQ

SEQ ID NO: 2849899 - protein, 10 aa, Entamoeba invadens
EELKRKDHAN

SEQ ID NO: 2849900 - protein, 11 aa, Entamoeba invadens
EELKRQSNANT

SEQ ID NO: 2849901 - protein, 11 aa, Entamoeba invadens
EELKSETPKTH

SEQ ID NO: 2849902 - protein, 4 aa, Entamoeba invadens
EELN

SEQ ID NO: 2849903 - protein, 7 aa, Entamoeba invadens
EELNEDA

SEQ ID NO: 2849904 - protein, 14 aa, Entamoeba invadens
EELNEHDEASEYEQ

SEQ ID NO: 2849905 - protein, 9 aa, Entamoeba invadens
EELNETDRE

SEQ ID NO: 2849906 - protein, 36 aa, Entamoeba invadens
EELNTVENTREGVTDMKKEEQQSVPLENSLNENDLK

SEQ ID NO: 2849907 - protein, 8 aa, Entamoeba invadens
EELPDTQT

SEQ ID NO: 2849908 - protein, 4 aa, Entamoeba invadens
EELQ

SEQ ID NO: 2849909 - protein, 11 aa, Entamoeba invadens
EELQAKKKRRE

SEQ ID NO: 2849910 - protein, 7 aa, Entamoeba invadens
EELQDES

SEQ ID NO: 2849911 - protein, 23 aa, Entamoeba invadens
EELQKEQQQHNDNNTKNKEEIDK

SEQ ID NO: 2849912 - protein, 5 aa, Entamoeba invadens
EELRE

SEQ ID NO: 2849913 - protein, 8 aa, Entamoeba invadens
EELRKKDN

SEQ ID NO: 2849914 - protein, 10 aa, Entamoeba invadens
EELRRTLQQT

SEQ ID NO: 2849915 - protein, 7 aa, Entamoeba invadens
EELSQEL

SEQ ID NO: 2849916 - protein, 5 aa, Entamoeba invadens
EELSR

SEQ ID NO: 2849917 - protein, 4 aa, Entamoeba invadens
EELT

SEQ ID NO: 2849918 - protein, 12 aa, Entamoeba invadens
EELTETNQLFYE

SEQ ID NO: 2849919 - protein, 13 aa, Entamoeba invadens
EELTKKNCDMSTT

SEQ ID NO: 2849920 - protein, 7 aa, Entamoeba invadens
EELTPQQ

SEQ ID NO: 2849921 - protein, 14 aa, Entamoeba invadens
EELTRGKDSSNDIV

SEQ ID NO: 2849922 - protein, 4 aa, Entamoeba invadens
EELV

SEQ ID NO: 2849923 - protein, 5 aa, Entamoeba invadens
EELVK

SEQ ID NO: 2849924 - protein, 10 aa, Entamoeba invadens
EEMDENKNRF

SEQ ID NO: 2849925 - protein, 47 aa, Entamoeba invadens
EEMEAEEAARKKKKAEEEEAERKRKEEERVASPPLMKSPTPEEKEKK

SEQ ID NO: 2849926 - protein, 31 aa, Entamoeba invadens
EEMEAEEAERKRRAQVEEMEAQEAERRRRAK

SEQ ID NO: 2849927 - protein, 5 aa, Entamoeba invadens
EEMEK

SEQ ID NO: 2849928 - protein, 5 aa, Entamoeba invadens
EEMGK

SEQ ID NO: 2849929 - protein, 9 aa, Entamoeba invadens
EEMKDQIEG

SEQ ID NO: 2849930 - protein, 21 aa, Entamoeba invadens
EEMKEEYEKRNISHDEDIKNA

SEQ ID NO: 2849931 - protein, 9 aa, Entamoeba invadens
EEMKESTGM

SEQ ID NO: 2849932 - protein, 24 aa, Entamoeba invadens
EEMKETKEKEQNKEKKPRKEIQEM

SEQ ID NO: 2849933 - protein, 11 aa, Entamoeba invadens
EEMKGDTHWRD

SEQ ID NO: 2849934 - protein, 23 aa, Entamoeba invadens
EEMKNGKDITSKCEEQSKKNRVL

SEQ ID NO: 2849935 - protein, 24 aa, Entamoeba invadens
EEMKTESVNIRTRENEVKGKASLD

SEQ ID NO: 2849936 - protein, 8 aa, Entamoeba invadens
EEMKTSES

SEQ ID NO: 2849937 - protein, 5 aa, Entamoeba invadens
EEMRR

SEQ ID NO: 2849938 - protein, 4 aa, Entamoeba invadens
EEMS

SEQ ID NO: 2849939 - protein, 21 aa, Entamoeba invadens
EEMSEEYEKRNISHDEDIKNA

SEQ ID NO: 2849940 - protein, 29 aa, Entamoeba invadens
EEMSGEGTPSLNETSHSSQSEDETEAEEY

SEQ ID NO: 2849941 - protein, 5 aa, Entamoeba invadens
EEMTE

SEQ ID NO: 2849942 - protein, 5 aa, Entamoeba invadens
EEMTK

SEQ ID NO: 2849943 - protein, 16 aa, Entamoeba invadens
EEMTQKENQTKEIEDL

SEQ ID NO: 2849944 - protein, 23 aa, Entamoeba invadens
EEMTSQVEKSQNQCKELSQQLEE

SEQ ID NO: 2849945 - protein, 8 aa, Entamoeba invadens
EENATNVE

SEQ ID NO: 2849946 - protein, 17 aa, Entamoeba invadens
EENDANDVRNGSKKKEV

SEQ ID NO: 2849947 - protein, 5 aa, Entamoeba invadens
EENDK

SEQ ID NO: 2849948 - protein, 9 aa, Entamoeba invadens
EENDKLRAQ

SEQ ID NO: 2849949 - protein, 7 aa, Entamoeba invadens
EENDNNR

SEQ ID NO: 2849950 - protein, 11 aa, Entamoeba invadens
EENDSEENKLE

SEQ ID NO: 2849951 - protein, 9 aa, Entamoeba invadens
EENEDISID

SEQ ID NO: 2849952 - protein, 12 aa, Entamoeba invadens
EENEDLKQDKEK

SEQ ID NO: 2849953 - protein, 14 aa, Entamoeba invadens
EENEEESGGEEIEE

SEQ ID NO: 2849954 - protein, 41 aa, Entamoeba invadens
EENEIQNDGTIEYKSEDFRKVQKPESQIISGKEKETDLDDL

SEQ ID NO: 2849955 - protein, 26 aa, Entamoeba invadens
EENEKNPQMEEDDEHEDEDDDEEDLI

SEQ ID NO: 2849956 - protein, 12 aa, Entamoeba invadens
EENELTQKTDNV

SEQ ID NO: 2849957 - protein, 6 aa, Entamoeba invadens
EENEQI

SEQ ID NO: 2849958 - protein, 5 aa, Entamoeba invadens
EENER

SEQ ID NO: 2849959 - protein, 5 aa, Entamoeba invadens
EENET

SEQ ID NO: 2849960 - protein, 7 aa, Entamoeba invadens
EENETLK

SEQ ID NO: 2849961 - protein, 11 aa, Entamoeba invadens
EENGDCENKGV

SEQ ID NO: 2849962 - protein, 17 aa, Entamoeba invadens
EENGIIKRGTKRHPTVG

SEQ ID NO: 2849963 - protein, 9 aa, Entamoeba invadens
EENGKKVTR

SEQ ID NO: 2849964 - protein, 6 aa, Entamoeba invadens
EENGLS

SEQ ID NO: 2849965 - protein, 5 aa, Entamoeba invadens
EENGQ

SEQ ID NO: 2849966 - protein, 7 aa, Entamoeba invadens
EENGSLN

SEQ ID NO: 2849967 - protein, 6 aa, Entamoeba invadens
EENGSM

SEQ ID NO: 2849968 - protein, 5 aa, Entamoeba invadens
EENGV

SEQ ID NO: 2849969 - protein, 7 aa, Entamoeba invadens
EENHMTK

SEQ ID NO: 2849970 - protein, 9 aa, Entamoeba invadens
EENHRPASC

SEQ ID NO: 2849971 - protein, 5 aa, Entamoeba invadens
EENIE

SEQ ID NO: 2849972 - protein, 6 aa, Entamoeba invadens
EENIGG

SEQ ID NO: 2849973 - protein, 5 aa, Entamoeba invadens
EENIP

SEQ ID NO: 2849974 - protein, 15 aa, Entamoeba invadens
EENIPKRETQKDQLS

SEQ ID NO: 2849975 - protein, 16 aa, Entamoeba invadens
EENISLTQSQPVSTSL

SEQ ID NO: 2849976 - protein, 4 aa, Entamoeba invadens
EENK

SEQ ID NO: 2849977 - protein, 5 aa, Entamoeba invadens
EENKE

SEQ ID NO: 2849978 - protein, 9 aa, Entamoeba invadens
EENKEIEAA

SEQ ID NO: 2849979 - protein, 15 aa, Entamoeba invadens
EENKEKEIQERQDQL

SEQ ID NO: 2849980 - protein, 11 aa, Entamoeba invadens
EENKGKSVEIK

SEQ ID NO: 2849981 - protein, 14 aa, Entamoeba invadens
EENKGWEDSTVQKS

SEQ ID NO: 2849982 - protein, 11 aa, Entamoeba invadens
EENKHCENKTG

SEQ ID NO: 2849983 - protein, 10 aa, Entamoeba invadens
EENKHNPKPI

SEQ ID NO: 2849984 - protein, 9 aa, Entamoeba invadens
EENKLSPIH

SEQ ID NO: 2849985 - protein, 14 aa, Entamoeba invadens
EENKLTSDRPKQET

SEQ ID NO: 2849986 - protein, 10 aa, Entamoeba invadens
EENKMNGKTQ

SEQ ID NO: 2849987 - protein, 7 aa, Entamoeba invadens
EENKSLA

SEQ ID NO: 2849988 - protein, 15 aa, Entamoeba invadens
EENLEESNESGATSD

SEQ ID NO: 2849989 - protein, 12 aa, Entamoeba invadens
EENLKKAEQKAR

SEQ ID NO: 2849990 - protein, 9 aa, Entamoeba invadens
EENNEETQG

SEQ ID NO: 2849991 - protein, 13 aa, Entamoeba invadens
EENNKMLDMVEET

SEQ ID NO: 2849992 - protein, 15 aa, Entamoeba invadens
EENNLETTTETTSSL

SEQ ID NO: 2849993 - protein, 7 aa, Entamoeba invadens
EENNNKE

SEQ ID NO: 2849994 - protein, 14 aa, Entamoeba invadens
EENNTKKLVETKGP

SEQ ID NO: 2849995 - protein, 5 aa, Entamoeba invadens
EENNY

SEQ ID NO: 2849996 - protein, 7 aa, Entamoeba invadens
EENPADT

SEQ ID NO: 2849997 - protein, 8 aa, Entamoeba invadens
EENPATER

SEQ ID NO: 2849998 - protein, 7 aa, Entamoeba invadens
EENPEET

SEQ ID NO: 2849999 - protein, 37 aa, Entamoeba invadens
EENPEIAPKYDKPKPPTKMEDDDSEDEDDDDETGNSK

SEQ ID NO: 2850000 - protein, 23 aa, Entamoeba invadens
EENPFGVSSDRVDVANESTTEVK

SEQ ID NO: 2850001 - protein, 6 aa, Entamoeba invadens
EENPFS

SEQ ID NO: 2850002 - protein, 8 aa, Entamoeba invadens
EENPPTIV

SEQ ID NO: 2850003 - protein, 15 aa, Entamoeba invadens
EENPSCGVEEPSGTV

SEQ ID NO: 2850004 - protein, 17 aa, Entamoeba invadens
EENQKMKDEFKAEQKRV

SEQ ID NO: 2850005 - protein, 4 aa, Entamoeba invadens
EENR

SEQ ID NO: 2850006 - protein, 14 aa, Entamoeba invadens
EENRKDSTKEKQFA

SEQ ID NO: 2850007 - protein, 9 aa, Entamoeba invadens
EENRKHSAC

SEQ ID NO: 2850008 - protein, 6 aa, Entamoeba invadens
EENRKK

SEQ ID NO: 2850009 - protein, 74 aa, Entamoeba invadens
EENRKREEQKLREKEEAERKEREEKKREIEEQKRKIEEERQRVEDEKKAEEAKRRAEEKWRQEENEKLKLENER

SEQ ID NO: 2850010 - protein, 9 aa, Entamoeba invadens
EENSEETKA

SEQ ID NO: 2850011 - protein, 11 aa, Entamoeba invadens
EENSKGFDFGE

SEQ ID NO: 2850012 - protein, 6 aa, Entamoeba invadens
EENSSK

SEQ ID NO: 2850013 - protein, 13 aa, Entamoeba invadens
EENSSTESKPKPV

SEQ ID NO: 2850014 - protein, 6 aa, Entamoeba invadens
EENSTY

SEQ ID NO: 2850015 - protein, 12 aa, Entamoeba invadens
EENTKGVKPQTT

SEQ ID NO: 2850016 - protein, 7 aa, Entamoeba invadens
EENTKYL

SEQ ID NO: 2850017 - protein, 6 aa, Entamoeba invadens
EENTMN

SEQ ID NO: 2850018 - protein, 12 aa, Entamoeba invadens
EENTSESDDDDL

SEQ ID NO: 2850019 - protein, 4 aa, Entamoeba invadens
EENV

SEQ ID NO: 2850020 - protein, 7 aa, Entamoeba invadens
EENVDDF

SEQ ID NO: 2850021 - protein, 12 aa, Entamoeba invadens
EENVKNDSSSYR

SEQ ID NO: 2850022 - protein, 8 aa, Entamoeba invadens
EENVPALE

SEQ ID NO: 2850023 - protein, 11 aa, Entamoeba invadens
EENVYAKPPHT

SEQ ID NO: 2850024 - protein, 8 aa, Entamoeba invadens
EENWKNET

SEQ ID NO: 2850025 - protein, 5 aa, Entamoeba invadens
EENYT

SEQ ID NO: 2850026 - protein, 5 aa, Entamoeba invadens
EEPDD

SEQ ID NO: 2850027 - protein, 4 aa, Entamoeba invadens
EEPE

SEQ ID NO: 2850028 - protein, 9 aa, Entamoeba invadens
EEPEDPNID

SEQ ID NO: 2850029 - protein, 9 aa, Entamoeba invadens
EEPEKAKEI

SEQ ID NO: 2850030 - protein, 6 aa, Entamoeba invadens
EEPENL

SEQ ID NO: 2850031 - protein, 5 aa, Entamoeba invadens
EEPEV

SEQ ID NO: 2850032 - protein, 9 aa, Entamoeba invadens
EEPIPPSER

SEQ ID NO: 2850033 - protein, 12 aa, Entamoeba invadens
EEPKATEKQQKC

SEQ ID NO: 2850034 - protein, 18 aa, Entamoeba invadens
EEPKFDSADYEDQYDSDQ

SEQ ID NO: 2850035 - protein, 10 aa, Entamoeba invadens
EEPKKSVSKK

SEQ ID NO: 2850036 - protein, 6 aa, Entamoeba invadens
EEPKPR

SEQ ID NO: 2850037 - protein, 22 aa, Entamoeba invadens
EEPKQQVKMDEEHKVKEQEVPQ

SEQ ID NO: 2850038 - protein, 7 aa, Entamoeba invadens
EEPLPTH

SEQ ID NO: 2850039 - protein, 12 aa, Entamoeba invadens
EEPNDMSALFIG

SEQ ID NO: 2850040 - protein, 8 aa, Entamoeba invadens
EEPNIGSG

SEQ ID NO: 2850041 - protein, 5 aa, Entamoeba invadens
EEPNR

SEQ ID NO: 2850042 - protein, 17 aa, Entamoeba invadens
EEPPKKKPDLPSPGFSS

SEQ ID NO: 2850043 - protein, 13 aa, Entamoeba invadens
EEPQATSSNEGRY

SEQ ID NO: 2850044 - protein, 7 aa, Entamoeba invadens
EEPQETI

SEQ ID NO: 2850045 - protein, 11 aa, Entamoeba invadens
EEPQKMSTSEA

SEQ ID NO: 2850046 - protein, 8 aa, Entamoeba invadens
EEPSGSHR

SEQ ID NO: 2850047 - protein, 5 aa, Entamoeba invadens
EEPSP

SEQ ID NO: 2850048 - protein, 8 aa, Entamoeba invadens
EEPSTPVE

SEQ ID NO: 2850049 - protein, 9 aa, Entamoeba invadens
EEPTPDTKK

SEQ ID NO: 2850050 - protein, 46 aa, Entamoeba invadens
EEPVPEVPKPVEVKEEEIQPEVSQKEEVVQEKEEPKIEEKTTNKPG

SEQ ID NO: 2850051 - protein, 4 aa, Entamoeba invadens
EEPY

SEQ ID NO: 2850052 - protein, 8 aa, Entamoeba invadens
EEQCEKDG

SEQ ID NO: 2850053 - protein, 5 aa, Entamoeba invadens
EEQCT

SEQ ID NO: 2850054 - protein, 5 aa, Entamoeba invadens
EEQDK

SEQ ID NO: 2850055 - protein, 5 aa, Entamoeba invadens
EEQEN

SEQ ID NO: 2850056 - protein, 7 aa, Entamoeba invadens
EEQERQR

SEQ ID NO: 2850057 - protein, 10 aa, Entamoeba invadens
EEQESEENEI

SEQ ID NO: 2850058 - protein, 31 aa, Entamoeba invadens
EEQGKEIPKPHEGPKSLKTKEMKAEEDEKKR

SEQ ID NO: 2850059 - protein, 18 aa, Entamoeba invadens
EEQHKDVEKTWLKTLDWM

SEQ ID NO: 2850060 - protein, 8 aa, Entamoeba invadens
EEQIKKRE

SEQ ID NO: 2850061 - protein, 6 aa, Entamoeba invadens
EEQIQL

SEQ ID NO: 2850062 - protein, 4 aa, Entamoeba invadens
EEQK

SEQ ID NO: 2850063 - protein, 5 aa, Entamoeba invadens
EEQKE

SEQ ID NO: 2850064 - protein, 8 aa, Entamoeba invadens
EEQKKDNI

SEQ ID NO: 2850065 - protein, 9 aa, Entamoeba invadens
EEQKKRKKP

SEQ ID NO: 2850066 - protein, 22 aa, Entamoeba invadens
EEQKKSKVKKVPQKLKSFDDTD

SEQ ID NO: 2850067 - protein, 32 aa, Entamoeba invadens
EEQKLQEKEAKKSRITKEREQKAKEEKKKAEQ

SEQ ID NO: 2850068 - protein, 15 aa, Entamoeba invadens
EEQKQNKKQKFDNNE

SEQ ID NO: 2850069 - protein, 6 aa, Entamoeba invadens
EEQKRG

SEQ ID NO: 2850070 - protein, 6 aa, Entamoeba invadens
EEQKTI

SEQ ID NO: 2850071 - protein, 10 aa, Entamoeba invadens
EEQKVGRPNF

SEQ ID NO: 2850072 - protein, 7 aa, Entamoeba invadens
EEQLAGD

SEQ ID NO: 2850073 - protein, 40 aa, Entamoeba invadens
EEQLKKEEERLQHERAEKEEAERLEKERLAQEEADKKAFE

SEQ ID NO: 2850074 - protein, 69 aa, Entamoeba invadens
EEQLQKERAEKQEAERLEKERLAKEEQIKKEEERLQQEKLAKEEAEKQRLQYEEELKRKQTINNKQAVY

SEQ ID NO: 2850075 - protein, 8 aa, Entamoeba invadens
EEQLSPNV

SEQ ID NO: 2850076 - protein, 6 aa, Entamoeba invadens
EEQNAI

SEQ ID NO: 2850077 - protein, 5 aa, Entamoeba invadens
EEQNC

SEQ ID NO: 2850078 - protein, 6 aa, Entamoeba invadens
EEQNEE

SEQ ID NO: 2850079 - protein, 20 aa, Entamoeba invadens
EEQNEEISGNEIAKSETKVD

SEQ ID NO: 2850080 - protein, 7 aa, Entamoeba invadens
EEQNEES

SEQ ID NO: 2850081 - protein, 30 aa, Entamoeba invadens
EEQNELEKKKQCETPKKESETKLPVRPTLS

SEQ ID NO: 2850082 - protein, 14 aa, Entamoeba invadens
EEQPIDKSDPPNLV

SEQ ID NO: 2850083 - protein, 8 aa, Entamoeba invadens
EEQQIGKE

SEQ ID NO: 2850084 - protein, 5 aa, Entamoeba invadens
EEQQK

SEQ ID NO: 2850085 - protein, 10 aa, Entamoeba invadens
EEQQKIAQEK

SEQ ID NO: 2850086 - protein, 8 aa, Entamoeba invadens
EEQQKLAQ

SEQ ID NO: 2850087 - protein, 6 aa, Entamoeba invadens
EEQRFY

SEQ ID NO: 2850088 - protein, 9 aa, Entamoeba invadens
EEQRPPVAH

SEQ ID NO: 2850089 - protein, 23 aa, Entamoeba invadens
EEQSEAKSEEDDRVKLEELVLGE

SEQ ID NO: 2850090 - protein, 7 aa, Entamoeba invadens
EEQSTED

SEQ ID NO: 2850091 - protein, 6 aa, Entamoeba invadens
EEQSYD

SEQ ID NO: 2850092 - protein, 8 aa, Entamoeba invadens
EEQTELNK

SEQ ID NO: 2850093 - protein, 8 aa, Entamoeba invadens
EEQTPTSL

SEQ ID NO: 2850094 - protein, 10 aa, Entamoeba invadens
EEQYDGTPFN

SEQ ID NO: 2850095 - protein, 5 aa, Entamoeba invadens
EEQYE

SEQ ID NO: 2850096 - protein, 4 aa, Entamoeba invadens
EERA

SEQ ID NO: 2850097 - protein, 5 aa, Entamoeba invadens
EERAK

SEQ ID NO: 2850098 - protein, 5 aa, Entamoeba invadens
EERAQ

SEQ ID NO: 2850099 - protein, 8 aa, Entamoeba invadens
EERCSQTF

SEQ ID NO: 2850100 - protein, 4 aa, Entamoeba invadens
EERD

SEQ ID NO: 2850101 - protein, 4 aa, Entamoeba invadens
EERE

SEQ ID NO: 2850102 - protein, 13 aa, Entamoeba invadens
EERECEDEWGTSK

SEQ ID NO: 2850103 - protein, 8 aa, Entamoeba invadens
EEREEDEY

SEQ ID NO: 2850104 - protein, 6 aa, Entamoeba invadens
EEREEG

SEQ ID NO: 2850105 - protein, 7 aa, Entamoeba invadens
EEREVEN

SEQ ID NO: 2850106 - protein, 6 aa, Entamoeba invadens
EERFSN

SEQ ID NO: 2850107 - protein, 7 aa, Entamoeba invadens
EERGGFD

SEQ ID NO: 2850108 - protein, 10 aa, Entamoeba invadens
EERGQKPVTL

SEQ ID NO: 2850109 - protein, 24 aa, Entamoeba invadens
EERKADNETSSELEPTSSEDEKKL

SEQ ID NO: 2850110 - protein, 25 aa, Entamoeba invadens
EERKEDKFGKMKEDEEKATVNTAEE

SEQ ID NO: 2850111 - protein, 47 aa, Entamoeba invadens
EERKEKKRKELEERQKQNQRYVKPKRTYNEQEDEEHETMKEKKNYGE

SEQ ID NO: 2850112 - protein, 7 aa, Entamoeba invadens
EERKEPV

SEQ ID NO: 2850113 - protein, 6 aa, Entamoeba invadens
EERKER

SEQ ID NO: 2850114 - protein, 8 aa, Entamoeba invadens
EERKPKPL

SEQ ID NO: 2850115 - protein, 5 aa, Entamoeba invadens
EERKS

SEQ ID NO: 2850116 - protein, 6 aa, Entamoeba invadens
EERKWD

SEQ ID NO: 2850117 - protein, 18 aa, Entamoeba invadens
EERMERKKRKSRSTSRDS

SEQ ID NO: 2850118 - protein, 8 aa, Entamoeba invadens
EERNEADD

SEQ ID NO: 2850119 - protein, 18 aa, Entamoeba invadens
EERNKKVGQNGDLMPKDT

SEQ ID NO: 2850120 - protein, 5 aa, Entamoeba invadens
EERPL

SEQ ID NO: 2850121 - protein, 6 aa, Entamoeba invadens
EERPPT

SEQ ID NO: 2850122 - protein, 11 aa, Entamoeba invadens
EERQQQNLYGQ

SEQ ID NO: 2850123 - protein, 7 aa, Entamoeba invadens
EERRNEL

SEQ ID NO: 2850124 - protein, 14 aa, Entamoeba invadens
EERRRRKESTNNTQ

SEQ ID NO: 2850125 - protein, 23 aa, Entamoeba invadens
EERRRVDEELQPRTKKLKPSRRN

SEQ ID NO: 2850126 - protein, 12 aa, Entamoeba invadens
EERSEKVRKSVQ

SEQ ID NO: 2850127 - protein, 9 aa, Entamoeba invadens
EERSESVAT

SEQ ID NO: 2850128 - protein, 24 aa, Entamoeba invadens
EERSPSPINIQESTDDDSKAYSST

SEQ ID NO: 2850129 - protein, 12 aa, Entamoeba invadens
EERSPTTSPITT

SEQ ID NO: 2850130 - protein, 4 aa, Entamoeba invadens
EERT

SEQ ID NO: 2850131 - protein, 6 aa, Entamoeba invadens
EERVEA

SEQ ID NO: 2850132 - protein, 5 aa, Entamoeba invadens
EERYK

SEQ ID NO: 2850133 - protein, 11 aa, Entamoeba invadens
EESACDKELSD

SEQ ID NO: 2850134 - protein, 6 aa, Entamoeba invadens
EESADK

SEQ ID NO: 2850135 - protein, 8 aa, Entamoeba invadens
EESAGYDG

SEQ ID NO: 2850136 - protein, 8 aa, Entamoeba invadens
EESAPEAM

SEQ ID NO: 2850137 - protein, 17 aa, Entamoeba invadens
EESARPQLEETVSSTQN

SEQ ID NO: 2850138 - protein, 11 aa, Entamoeba invadens
EESCNKEEGMN

SEQ ID NO: 2850139 - protein, 10 aa, Entamoeba invadens
EESDDQELKA

SEQ ID NO: 2850140 - protein, 11 aa, Entamoeba invadens
EESDDQELKAE

SEQ ID NO: 2850141 - protein, 6 aa, Entamoeba invadens
EESDRE

SEQ ID NO: 2850142 - protein, 7 aa, Entamoeba invadens
EESECNN

SEQ ID NO: 2850143 - protein, 6 aa, Entamoeba invadens
EESEGK

SEQ ID NO: 2850144 - protein, 25 aa, Entamoeba invadens
EESEGVTGGASLRYQPKRMTPQSGY

SEQ ID NO: 2850145 - protein, 7 aa, Entamoeba invadens
EESEIEK

SEQ ID NO: 2850146 - protein, 20 aa, Entamoeba invadens
EESEKEKKEKIEQLEEENGM

SEQ ID NO: 2850147 - protein, 9 aa, Entamoeba invadens
EESEMEKNR

SEQ ID NO: 2850148 - protein, 24 aa, Entamoeba invadens
EESEPKNPQKFQQPVHQKNPVKIG

SEQ ID NO: 2850149 - protein, 16 aa, Entamoeba invadens
EESESEESSDSDEDEV

SEQ ID NO: 2850150 - protein, 6 aa, Entamoeba invadens
EESEVK

SEQ ID NO: 2850151 - protein, 5 aa, Entamoeba invadens
EESFG

SEQ ID NO: 2850152 - protein, 7 aa, Entamoeba invadens
EESFVTS

SEQ ID NO: 2850153 - protein, 13 aa, Entamoeba invadens
EESGAGGYDASNL

SEQ ID NO: 2850154 - protein, 6 aa, Entamoeba invadens
EESGEH

SEQ ID NO: 2850155 - protein, 13 aa, Entamoeba invadens
EESGQNENNTIFE

SEQ ID NO: 2850156 - protein, 5 aa, Entamoeba invadens
EESGT

SEQ ID NO: 2850157 - protein, 5 aa, Entamoeba invadens
EESGV

SEQ ID NO: 2850158 - protein, 15 aa, Entamoeba invadens
EESHYSLSSQPSVQD

SEQ ID NO: 2850159 - protein, 6 aa, Entamoeba invadens
EESIES

SEQ ID NO: 2850160 - protein, 18 aa, Entamoeba invadens
EESIGSDEERAKIEECEK

SEQ ID NO: 2850161 - protein, 10 aa, Entamoeba invadens
EESIQKSYGD

SEQ ID NO: 2850162 - protein, 12 aa, Entamoeba invadens
EESIQKTCTEQR

SEQ ID NO: 2850163 - protein, 11 aa, Entamoeba invadens
EESISDAPGYY

SEQ ID NO: 2850164 - protein, 8 aa, Entamoeba invadens
EESKGVEA

SEQ ID NO: 2850165 - protein, 10 aa, Entamoeba invadens
EESKKLWSGD

SEQ ID NO: 2850166 - protein, 11 aa, Entamoeba invadens
EESLEEQTVQA

SEQ ID NO: 2850167 - protein, 11 aa, Entamoeba invadens
EESLKNPSKEL

SEQ ID NO: 2850168 - protein, 8 aa, Entamoeba invadens
EESNDEST

SEQ ID NO: 2850169 - protein, 8 aa, Entamoeba invadens
EESNGDYG

SEQ ID NO: 2850170 - protein, 10 aa, Entamoeba invadens
EESNKRNEKE

SEQ ID NO: 2850171 - protein, 7 aa, Entamoeba invadens
EESNLEK

SEQ ID NO: 2850172 - protein, 9 aa, Entamoeba invadens
EESPENTKK

SEQ ID NO: 2850173 - protein, 25 aa, Entamoeba invadens
EESPKNNLQQNNEAKTPERVESTGM

SEQ ID NO: 2850174 - protein, 5 aa, Entamoeba invadens
EESPN

SEQ ID NO: 2850175 - protein, 24 aa, Entamoeba invadens
EESPQEERLSEDPPKQSGKIAKKK

SEQ ID NO: 2850176 - protein, 15 aa, Entamoeba invadens
EESPRGAGHTFGQQP

SEQ ID NO: 2850177 - protein, 5 aa, Entamoeba invadens
EESPS

SEQ ID NO: 2850178 - protein, 4 aa, Entamoeba invadens
EESQ

SEQ ID NO: 2850179 - protein, 17 aa, Entamoeba invadens
EESQDKDGNIPVNKESK

SEQ ID NO: 2850180 - protein, 7 aa, Entamoeba invadens
EESQEVP

SEQ ID NO: 2850181 - protein, 42 aa, Entamoeba invadens
EESQLKKRRESALVSPDEKVEKKNTPMEEESPSETSESDNEN

SEQ ID NO: 2850182 - protein, 25 aa, Entamoeba invadens
EESQRDEEESSNDLKEDEREDKEMK

SEQ ID NO: 2850183 - protein, 6 aa, Entamoeba invadens
EESQRI

SEQ ID NO: 2850184 - protein, 59 aa, Entamoeba invadens
EESQTTKTNKSASDEKEQKQKRQKIEKPKAPNNTETKEKEKKIPSQDIKKESKPNTQIV

SEQ ID NO: 2850185 - protein, 4 aa, Entamoeba invadens
EESR

SEQ ID NO: 2850186 - protein, 12 aa, Entamoeba invadens
EESRKAEEDRVR

SEQ ID NO: 2850187 - protein, 5 aa, Entamoeba invadens
EESRT

SEQ ID NO: 2850188 - protein, 25 aa, Entamoeba invadens
EESSPEDAGASGNTGKTLTDSSTVQ

SEQ ID NO: 2850189 - protein, 14 aa, Entamoeba invadens
EESSTTATSSKLQQ

SEQ ID NO: 2850190 - protein, 10 aa, Entamoeba invadens
EESTFQEKTI

SEQ ID NO: 2850191 - protein, 9 aa, Entamoeba invadens
EESTLDDDL

SEQ ID NO: 2850192 - protein, 21 aa, Entamoeba invadens
EESTNTTTEAETSEDSDCGSV

SEQ ID NO: 2850193 - protein, 8 aa, Entamoeba invadens
EESTPKRI

SEQ ID NO: 2850194 - protein, 5 aa, Entamoeba invadens
EESTQ

SEQ ID NO: 2850195 - protein, 10 aa, Entamoeba invadens
EESTQALDRA

SEQ ID NO: 2850196 - protein, 20 aa, Entamoeba invadens
EESVEKEGRVGELRRKATDQ

SEQ ID NO: 2850197 - protein, 8 aa, Entamoeba invadens
EESVKTAE

SEQ ID NO: 2850198 - protein, 5 aa, Entamoeba invadens
EESVQ

SEQ ID NO: 2850199 - protein, 6 aa, Entamoeba invadens
EESVQK

SEQ ID NO: 2850200 - protein, 13 aa, Entamoeba invadens
EESYNQLRDESVP

SEQ ID NO: 2850201 - protein, 14 aa, Entamoeba invadens
EETASTHKTLTDEP

SEQ ID NO: 2850202 - protein, 8 aa, Entamoeba invadens
EETDAPQL

SEQ ID NO: 2850203 - protein, 85 aa, Entamoeba invadens
EETDQQYNDQNQQEEYQQQQYTENDGNDEQQQYVNQEGQEEYYDEQNEQYQQTQDTPEDQQKYEITPQQYGEEYYQEESQQDEQH

SEQ ID NO: 2850204 - protein, 6 aa, Entamoeba invadens
EETDST

SEQ ID NO: 2850205 - protein, 5 aa, Entamoeba invadens
EETDV

SEQ ID NO: 2850206 - protein, 7 aa, Entamoeba invadens
EETDVEK

SEQ ID NO: 2850207 - protein, 8 aa, Entamoeba invadens
EETEESGY

SEQ ID NO: 2850208 - protein, 23 aa, Entamoeba invadens
EETEQFPDTPQHSSEEHNSDEEL

SEQ ID NO: 2850209 - protein, 8 aa, Entamoeba invadens
EETERKER

SEQ ID NO: 2850210 - protein, 8 aa, Entamoeba invadens
EETEWEES

SEQ ID NO: 2850211 - protein, 5 aa, Entamoeba invadens
EETFG

SEQ ID NO: 2850212 - protein, 7 aa, Entamoeba invadens
EETGDFV

SEQ ID NO: 2850213 - protein, 10 aa, Entamoeba invadens
EETGNEETVE

SEQ ID NO: 2850214 - protein, 15 aa, Entamoeba invadens
EETGRGVLEDKATKN

SEQ ID NO: 2850215 - protein, 5 aa, Entamoeba invadens
EETHA

SEQ ID NO: 2850216 - protein, 43 aa, Entamoeba invadens
EETHTIKDEEKQEEIKEEIKEEINEEIKEEIESDEIDSEEALR

SEQ ID NO: 2850217 - protein, 4 aa, Entamoeba invadens
EETI

SEQ ID NO: 2850218 - protein, 6 aa, Entamoeba invadens
EETIEQ

SEQ ID NO: 2850219 - protein, 17 aa, Entamoeba invadens
EETIRTKMSSKSKSPIY

SEQ ID NO: 2850220 - protein, 5 aa, Entamoeba invadens
EETKD

SEQ ID NO: 2850221 - protein, 9 aa, Entamoeba invadens
EETKDTAKG

SEQ ID NO: 2850222 - protein, 21 aa, Entamoeba invadens
EETKKLADYGANAINDAQRDK

SEQ ID NO: 2850223 - protein, 13 aa, Entamoeba invadens
EETKLEPSHYTRV

SEQ ID NO: 2850224 - protein, 5 aa, Entamoeba invadens
EETKQ

SEQ ID NO: 2850225 - protein, 6 aa, Entamoeba invadens
EETKQK

SEQ ID NO: 2850226 - protein, 9 aa, Entamoeba invadens
EETKREEYV

SEQ ID NO: 2850227 - protein, 64 aa, Entamoeba invadens
EETKTEKKKKEKKDKKEDKKEDKKEEDKKVVTTDEKEEKKEKKEKKKHRSKKDRTEGDEKETKH

SEQ ID NO: 2850228 - protein, 25 aa, Entamoeba invadens
EETKTENERLKKEVQEHVDTSEELR

SEQ ID NO: 2850229 - protein, 13 aa, Entamoeba invadens
EETKYVKKDNTEY

SEQ ID NO: 2850230 - protein, 4 aa, Entamoeba invadens
EETL

SEQ ID NO: 2850231 - protein, 6 aa, Entamoeba invadens
EETLDR

SEQ ID NO: 2850232 - protein, 11 aa, Entamoeba invadens
EETLSKRNEKV

SEQ ID NO: 2850233 - protein, 5 aa, Entamoeba invadens
EETMK

SEQ ID NO: 2850234 - protein, 4 aa, Entamoeba invadens
EETN

SEQ ID NO: 2850235 - protein, 9 aa, Entamoeba invadens
EETNDKNEQ

SEQ ID NO: 2850236 - protein, 9 aa, Entamoeba invadens
EETNRYGDA

SEQ ID NO: 2850237 - protein, 9 aa, Entamoeba invadens
EETNSEPSQ

SEQ ID NO: 2850238 - protein, 6 aa, Entamoeba invadens
EETPEG

SEQ ID NO: 2850239 - protein, 6 aa, Entamoeba invadens
EETPFE

SEQ ID NO: 2850240 - protein, 7 aa, Entamoeba invadens
EETPQYQ

SEQ ID NO: 2850241 - protein, 7 aa, Entamoeba invadens
EETPSKE

SEQ ID NO: 2850242 - protein, 6 aa, Entamoeba invadens
EETQTE

SEQ ID NO: 2850243 - protein, 6 aa, Entamoeba invadens
EETRAK

SEQ ID NO: 2850244 - protein, 42 aa, Entamoeba invadens
EETRAKEKAERKSTQHSRRSEGTKPRRSSDPHVQGEKRTSVK

SEQ ID NO: 2850245 - protein, 8 aa, Entamoeba invadens
EETRALSG

SEQ ID NO: 2850246 - protein, 5 aa, Entamoeba invadens
EETSD

SEQ ID NO: 2850247 - protein, 9 aa, Entamoeba invadens
EETSDEEKV

SEQ ID NO: 2850248 - protein, 6 aa, Entamoeba invadens
EETSTF

SEQ ID NO: 2850249 - protein, 7 aa, Entamoeba invadens
EETTDRV

SEQ ID NO: 2850250 - protein, 22 aa, Entamoeba invadens
EETTEIRKHDETNGIGSDVHNE

SEQ ID NO: 2850251 - protein, 11 aa, Entamoeba invadens
EETTGEEKETW

SEQ ID NO: 2850252 - protein, 5 aa, Entamoeba invadens
EETTK

SEQ ID NO: 2850253 - protein, 8 aa, Entamoeba invadens
EETTNRNI

SEQ ID NO: 2850254 - protein, 8 aa, Entamoeba invadens
EETTNSNI

SEQ ID NO: 2850255 - protein, 5 aa, Entamoeba invadens
EETTR

SEQ ID NO: 2850256 - protein, 4 aa, Entamoeba invadens
EETV

SEQ ID NO: 2850257 - protein, 8 aa, Entamoeba invadens
EETVEASL

SEQ ID NO: 2850258 - protein, 6 aa, Entamoeba invadens
EETVGR

SEQ ID NO: 2850259 - protein, 23 aa, Entamoeba invadens
EETVSEKYKELNKDITNRFATLT

SEQ ID NO: 2850260 - protein, 4 aa, Entamoeba invadens
EETY

SEQ ID NO: 2850261 - protein, 5 aa, Entamoeba invadens
EEVAK

SEQ ID NO: 2850262 - protein, 10 aa, Entamoeba invadens
EEVCSKDTKK

SEQ ID NO: 2850263 - protein, 29 aa, Entamoeba invadens
EEVDDGKPVEGGLSDPRMGPFDKGDECKT

SEQ ID NO: 2850264 - protein, 28 aa, Entamoeba invadens
EEVDESASLKSFQQTQPTVQPPVGEKME

SEQ ID NO: 2850265 - protein, 15 aa, Entamoeba invadens
EEVDTTQVGDDPVDQ

SEQ ID NO: 2850266 - protein, 4 aa, Entamoeba invadens
EEVE

SEQ ID NO: 2850267 - protein, 11 aa, Entamoeba invadens
EEVEAANEKLR

SEQ ID NO: 2850268 - protein, 33 aa, Entamoeba invadens
EEVEEEDLPSPGKNVKSAAVPKRVKRKKVTEFE

SEQ ID NO: 2850269 - protein, 13 aa, Entamoeba invadens
EEVEGKSQADKEE

SEQ ID NO: 2850270 - protein, 14 aa, Entamoeba invadens
EEVESDSDVTKYTK

SEQ ID NO: 2850271 - protein, 5 aa, Entamoeba invadens
EEVGE

SEQ ID NO: 2850272 - protein, 15 aa, Entamoeba invadens
EEVGSTNRRGANSVM

SEQ ID NO: 2850273 - protein, 14 aa, Entamoeba invadens
EEVGSVTRTGAESN

SEQ ID NO: 2850274 - protein, 6 aa, Entamoeba invadens
EEVHQG

SEQ ID NO: 2850275 - protein, 24 aa, Entamoeba invadens
EEVKDKKEVQTRTPMEEEGNDTQT

SEQ ID NO: 2850276 - protein, 5 aa, Entamoeba invadens
EEVKE

SEQ ID NO: 2850277 - protein, 14 aa, Entamoeba invadens
EEVKNDASTSVVEA

SEQ ID NO: 2850278 - protein, 20 aa, Entamoeba invadens
EEVKTDAKQTGKEEAKEKTV

SEQ ID NO: 2850279 - protein, 6 aa, Entamoeba invadens
EEVKTQ

SEQ ID NO: 2850280 - protein, 7 aa, Entamoeba invadens
EEVNANE

SEQ ID NO: 2850281 - protein, 8 aa, Entamoeba invadens
EEVNGKEM

SEQ ID NO: 2850282 - protein, 6 aa, Entamoeba invadens
EEVNRL

SEQ ID NO: 2850283 - protein, 10 aa, Entamoeba invadens
EEVNRLGKNA

SEQ ID NO: 2850284 - protein, 10 aa, Entamoeba invadens
EEVNTNEESF

SEQ ID NO: 2850285 - protein, 7 aa, Entamoeba invadens
EEVNTSQ

SEQ ID NO: 2850286 - protein, 5 aa, Entamoeba invadens
EEVPA

SEQ ID NO: 2850287 - protein, 10 aa, Entamoeba invadens
EEVPDSDKQQ

SEQ ID NO: 2850288 - protein, 7 aa, Entamoeba invadens
EEVPHEG

SEQ ID NO: 2850289 - protein, 5 aa, Entamoeba invadens
EEVPK

SEQ ID NO: 2850290 - protein, 9 aa, Entamoeba invadens
EEVPKSTDI

SEQ ID NO: 2850291 - protein, 5 aa, Entamoeba invadens
EEVPN

SEQ ID NO: 2850292 - protein, 11 aa, Entamoeba invadens
EEVQDEEIEED

SEQ ID NO: 2850293 - protein, 8 aa, Entamoeba invadens
EEVQGQEC

SEQ ID NO: 2850294 - protein, 10 aa, Entamoeba invadens
EEVQKSNKKI

SEQ ID NO: 2850295 - protein, 12 aa, Entamoeba invadens
EEVQKTTEKIEK

SEQ ID NO: 2850296 - protein, 9 aa, Entamoeba invadens
EEVQSDLQG

SEQ ID NO: 2850297 - protein, 5 aa, Entamoeba invadens
EEVRS

SEQ ID NO: 2850298 - protein, 7 aa, Entamoeba invadens
EEVSKNQ

SEQ ID NO: 2850299 - protein, 8 aa, Entamoeba invadens
EEVSKSDY

SEQ ID NO: 2850300 - protein, 21 aa, Entamoeba invadens
EEVSNKEEKNGISKSTSLRRF

SEQ ID NO: 2850301 - protein, 7 aa, Entamoeba invadens
EEVSPQK

SEQ ID NO: 2850302 - protein, 8 aa, Entamoeba invadens
EEVSQRVS

SEQ ID NO: 2850303 - protein, 8 aa, Entamoeba invadens
EEVSTSSH

SEQ ID NO: 2850304 - protein, 5 aa, Entamoeba invadens
EEVTG

SEQ ID NO: 2850305 - protein, 6 aa, Entamoeba invadens
EEVTGN

SEQ ID NO: 2850306 - protein, 9 aa, Entamoeba invadens
EEVTKATPH

SEQ ID NO: 2850307 - protein, 19 aa, Entamoeba invadens
EEVTNRLEREERADANETI

SEQ ID NO: 2850308 - protein, 11 aa, Entamoeba invadens
EEVTRQKADYL

SEQ ID NO: 2850309 - protein, 6 aa, Entamoeba invadens
EEVTVS

SEQ ID NO: 2850310 - protein, 6 aa, Entamoeba invadens
EEWTEH

SEQ ID NO: 2850311 - protein, 4 aa, Entamoeba invadens
EEYA

SEQ ID NO: 2850312 - protein, 15 aa, Entamoeba invadens
EEYADGKTQCVGRAA

SEQ ID NO: 2850313 - protein, 14 aa, Entamoeba invadens
EEYDDSTDSSEEEF

SEQ ID NO: 2850314 - protein, 11 aa, Entamoeba invadens
EEYEDSGNEAV

SEQ ID NO: 2850315 - protein, 6 aa, Entamoeba invadens
EEYEKE

SEQ ID NO: 2850316 - protein, 6 aa, Entamoeba invadens
EEYEKQ

SEQ ID NO: 2850317 - protein, 13 aa, Entamoeba invadens
EEYEKSGKNPWPH

SEQ ID NO: 2850318 - protein, 6 aa, Entamoeba invadens
EEYGPI

SEQ ID NO: 2850319 - protein, 10 aa, Entamoeba invadens
EEYGSEVSKE

SEQ ID NO: 2850320 - protein, 27 aa, Entamoeba invadens
EEYIDDESSFKIKSQTYKGSVTENRAN

SEQ ID NO: 2850321 - protein, 5 aa, Entamoeba invadens
EEYKI

SEQ ID NO: 2850322 - protein, 9 aa, Entamoeba invadens
EEYKQRGSD

SEQ ID NO: 2850323 - protein, 11 aa, Entamoeba invadens
EEYKRDEPRYY

SEQ ID NO: 2850324 - protein, 12 aa, Entamoeba invadens
EEYKRDEPRYYK

SEQ ID NO: 2850325 - protein, 5 aa, Entamoeba invadens
EEYMK

SEQ ID NO: 2850326 - protein, 14 aa, Entamoeba invadens
EEYNEDDEDNEHAN

SEQ ID NO: 2850327 - protein, 9 aa, Entamoeba invadens
EEYPTQHQD

SEQ ID NO: 2850328 - protein, 10 aa, Entamoeba invadens
EEYPTRPPKC

SEQ ID NO: 2850329 - protein, 6 aa, Entamoeba invadens
EEYQPA

SEQ ID NO: 2850330 - protein, 4 aa, Entamoeba invadens
EEYR

SEQ ID NO: 2850331 - protein, 21 aa, Entamoeba invadens
EEYRSNSSKEVNSLSDKKKLK

SEQ ID NO: 2850332 - protein, 18 aa, Entamoeba invadens
EEYSENEEKYPDGNDTNK

SEQ ID NO: 2850333 - protein, 5 aa, Entamoeba invadens
EEYSI

SEQ ID NO: 2850334 - protein, 11 aa, Entamoeba invadens
EEYTIGKPSVP

SEQ ID NO: 2850335 - protein, 14 aa, Entamoeba invadens
EEYTKSTSDEVEDN

SEQ ID NO: 2850336 - protein, 7 aa, Entamoeba invadens
EEYTNST

SEQ ID NO: 2850337 - protein, 10 aa, Entamoeba invadens
EEYTPANVGT

SEQ ID NO: 2850338 - protein, 5 aa, Entamoeba invadens
EEYVN

SEQ ID NO: 2850339 - protein, 26 aa, Entamoeba invadens
EEYYDQNEEYYDQQGEGYYDEQTGEY

SEQ ID NO: 2850340 - protein, 7 aa, Entamoeba invadens
EFAKSEN

SEQ ID NO: 2850341 - protein, 10 aa, Entamoeba invadens
EFASLENDKE

SEQ ID NO: 2850342 - protein, 12 aa, Entamoeba invadens
EFCDESGDFNVQ

SEQ ID NO: 2850343 - protein, 12 aa, Entamoeba invadens
EFDAEKKSTIGV

SEQ ID NO: 2850344 - protein, 7 aa, Entamoeba invadens
EFDEESS

SEQ ID NO: 2850345 - protein, 8 aa, Entamoeba invadens
EFDPATKN

SEQ ID NO: 2850346 - protein, 10 aa, Entamoeba invadens
EFDPDKRSTI

SEQ ID NO: 2850347 - protein, 10 aa, Entamoeba invadens
EFDPEKRSTI

SEQ ID NO: 2850348 - protein, 10 aa, Entamoeba invadens
EFEAKKGLEQ

SEQ ID NO: 2850349 - protein, 7 aa, Entamoeba invadens
EFEANGN

SEQ ID NO: 2850350 - protein, 12 aa, Entamoeba invadens
EFECEESRYSSQ

SEQ ID NO: 2850351 - protein, 9 aa, Entamoeba invadens
EFEDKTRIP

SEQ ID NO: 2850352 - protein, 12 aa, Entamoeba invadens
EFEEAGKEETMD

SEQ ID NO: 2850353 - protein, 13 aa, Entamoeba invadens
EFEEEEGKKVTDK

SEQ ID NO: 2850354 - protein, 21 aa, Entamoeba invadens
EFEEESQTDLQSEDATKQEKH

SEQ ID NO: 2850355 - protein, 9 aa, Entamoeba invadens
EFEEKENAQ

SEQ ID NO: 2850356 - protein, 15 aa, Entamoeba invadens
EFEEKGRQVMLKRTA

SEQ ID NO: 2850357 - protein, 10 aa, Entamoeba invadens
EFEENEKKWE

SEQ ID NO: 2850358 - protein, 6 aa, Entamoeba invadens
EFEESK

SEQ ID NO: 2850359 - protein, 10 aa, Entamoeba invadens
EFEGKNKEKL

SEQ ID NO: 2850360 - protein, 6 aa, Entamoeba invadens
EFEGME

SEQ ID NO: 2850361 - protein, 7 aa, Entamoeba invadens
EFEGSQV

SEQ ID NO: 2850362 - protein, 19 aa, Entamoeba invadens
EFEKAQKGVSQCGGANRKH

SEQ ID NO: 2850363 - protein, 34 aa, Entamoeba invadens
EFEKPPEKPEEKEEKPTKEEATWDEESLSPRRRK

SEQ ID NO: 2850364 - protein, 12 aa, Entamoeba invadens
EFENEKAKGEKM

SEQ ID NO: 2850365 - protein, 12 aa, Entamoeba invadens
EFENENERGDFK

SEQ ID NO: 2850366 - protein, 16 aa, Entamoeba invadens
EFENPKTTGEAAGGIS

SEQ ID NO: 2850367 - protein, 30 aa, Entamoeba invadens
EFENRKNTKISEMKKSKYYKGCDDTELNIG

SEQ ID NO: 2850368 - protein, 13 aa, Entamoeba invadens
EFENSNGFPQTTA

SEQ ID NO: 2850369 - protein, 8 aa, Entamoeba invadens
EFEQKEST

SEQ ID NO: 2850370 - protein, 18 aa, Entamoeba invadens
EFEQKESTFNTHIGKTQA

SEQ ID NO: 2850371 - protein, 17 aa, Entamoeba invadens
EFEQKESTFNTQIGKTQ

SEQ ID NO: 2850372 - protein, 30 aa, Entamoeba invadens
EFEQKESTFNTQIGKTQADLKKTQQSVRDG

SEQ ID NO: 2850373 - protein, 31 aa, Entamoeba invadens
EFEQKESTFNTQIGKTQADLKKTQQSVRDGE

SEQ ID NO: 2850374 - protein, 30 aa, Entamoeba invadens
EFEQKESTFNTQIGKTQADMKKTQQSVRDG

SEQ ID NO: 2850375 - protein, 46 aa, Entamoeba invadens
EFEQKESTFNTQIGKTQSDLKKTQQSVRDGELRTAELEDISENLVN

SEQ ID NO: 2850376 - protein, 12 aa, Entamoeba invadens
EFEQKESTINTH

SEQ ID NO: 2850377 - protein, 24 aa, Entamoeba invadens
EFEQKESTINTQIGKTQADLKKAR

SEQ ID NO: 2850378 - protein, 34 aa, Entamoeba invadens
EFEQKESTINTQIGKTQADLKKTQQSVRDGETEN

SEQ ID NO: 2850379 - protein, 13 aa, Entamoeba invadens
EFEQRKKKRTLKG

SEQ ID NO: 2850380 - protein, 5 aa, Entamoeba invadens
EFEQT

SEQ ID NO: 2850381 - protein, 15 aa, Entamoeba invadens
EFESDSNTYTEPNRE

SEQ ID NO: 2850382 - protein, 16 aa, Entamoeba invadens
EFESVRDKQKNGTLSQ

SEQ ID NO: 2850383 - protein, 5 aa, Entamoeba invadens
EFGDG

SEQ ID NO: 2850384 - protein, 4 aa, Entamoeba invadens
EFGE

SEQ ID NO: 2850385 - protein, 14 aa, Entamoeba invadens
EFGEQKEKKSDDQL

SEQ ID NO: 2850386 - protein, 7 aa, Entamoeba invadens
EFGKANN

SEQ ID NO: 2850387 - protein, 8 aa, Entamoeba invadens
EFGPEEDS

SEQ ID NO: 2850388 - protein, 6 aa, Entamoeba invadens
EFGSAQ

SEQ ID NO: 2850389 - protein, 5 aa, Entamoeba invadens
EFGTH

SEQ ID NO: 2850390 - protein, 5 aa, Entamoeba invadens
EFHSE

SEQ ID NO: 2850391 - protein, 4 aa, Entamoeba invadens
EFKA

SEQ ID NO: 2850392 - protein, 28 aa, Entamoeba invadens
EFKEDEKKSTNNSESNSDNSDTGTKTNT

SEQ ID NO: 2850393 - protein, 83 aa, Entamoeba invadens
EFKEEKEKLVETDAPAGDKKEEATGVKKRKETLKKYKDKKEAKEEKLKEHKETTEKVDSKTSKEEVAKEECKEEKKEEPVEEK

SEQ ID NO: 2850394 - protein, 9 aa, Entamoeba invadens
EFKEEKRKC

SEQ ID NO: 2850395 - protein, 9 aa, Entamoeba invadens
EFKETPTNE

SEQ ID NO: 2850396 - protein, 10 aa, Entamoeba invadens
EFKGSKGDRI

SEQ ID NO: 2850397 - protein, 10 aa, Entamoeba invadens
EFKKAQDNFD

SEQ ID NO: 2850398 - protein, 12 aa, Entamoeba invadens
EFKNGVKGNKDD

SEQ ID NO: 2850399 - protein, 40 aa, Entamoeba invadens
EFKNKTKEIEKAAKGVRQDAETRTKDVEKCKDATKKEKDK

SEQ ID NO: 2850400 - protein, 10 aa, Entamoeba invadens
EFNENDLDEF

SEQ ID NO: 2850401 - protein, 6 aa, Entamoeba invadens
EFPAST

SEQ ID NO: 2850402 - protein, 5 aa, Entamoeba invadens
EFPDV

SEQ ID NO: 2850403 - protein, 4 aa, Entamoeba invadens
EFPE

SEQ ID NO: 2850404 - protein, 5 aa, Entamoeba invadens
EFPED

SEQ ID NO: 2850405 - protein, 12 aa, Entamoeba invadens
EFPEPTKKKKLE

SEQ ID NO: 2850406 - protein, 13 aa, Entamoeba invadens
EFPESKPVNPPRN

SEQ ID NO: 2850407 - protein, 5 aa, Entamoeba invadens
EFPKD

SEQ ID NO: 2850408 - protein, 5 aa, Entamoeba invadens
EFPKE

SEQ ID NO: 2850409 - protein, 7 aa, Entamoeba invadens
EFPKSEL

SEQ ID NO: 2850410 - protein, 10 aa, Entamoeba invadens
EFPKTKPNQV

SEQ ID NO: 2850411 - protein, 19 aa, Entamoeba invadens
EFPKYNEDDISEENKGGPY

SEQ ID NO: 2850412 - protein, 5 aa, Entamoeba invadens
EFPLP

SEQ ID NO: 2850413 - protein, 5 aa, Entamoeba invadens
EFPNN

SEQ ID NO: 2850414 - protein, 10 aa, Entamoeba invadens
EFPNPKEEAR

SEQ ID NO: 2850415 - protein, 11 aa, Entamoeba invadens
EFPPKSKSKYV

SEQ ID NO: 2850416 - protein, 32 aa, Entamoeba invadens
EFPPQEKQMGLTQQTQQQNDLVSQQAQPITQQ

SEQ ID NO: 2850417 - protein, 9 aa, Entamoeba invadens
EFPPSVNTI

SEQ ID NO: 2850418 - protein, 5 aa, Entamoeba invadens
EFPQA

SEQ ID NO: 2850419 - protein, 5 aa, Entamoeba invadens
EFPQN

SEQ ID NO: 2850420 - protein, 7 aa, Entamoeba invadens
EFPQNTE

SEQ ID NO: 2850421 - protein, 13 aa, Entamoeba invadens
EFPSRDQKLQNER

SEQ ID NO: 2850422 - protein, 4 aa, Entamoeba invadens
EFPT

SEQ ID NO: 2850423 - protein, 12 aa, Entamoeba invadens
EFPTPELSASTS

SEQ ID NO: 2850424 - protein, 6 aa, Entamoeba invadens
EFQQES

SEQ ID NO: 2850425 - protein, 7 aa, Entamoeba invadens
EFQTTNK

SEQ ID NO: 2850426 - protein, 4 aa, Entamoeba invadens
EFRD

SEQ ID NO: 2850427 - protein, 11 aa, Entamoeba invadens
EFRDNTPQSKV

SEQ ID NO: 2850428 - protein, 4 aa, Entamoeba invadens
EFRK

SEQ ID NO: 2850429 - protein, 13 aa, Entamoeba invadens
EFRKQQEAKTSAV

SEQ ID NO: 2850430 - protein, 4 aa, Entamoeba invadens
EFRT

SEQ ID NO: 2850431 - protein, 10 aa, Entamoeba invadens
EFSDPDPRDV

SEQ ID NO: 2850432 - protein, 15 aa, Entamoeba invadens
EFSEEKGESYQDAKK

SEQ ID NO: 2850433 - protein, 8 aa, Entamoeba invadens
EFSKDKNE

SEQ ID NO: 2850434 - protein, 10 aa, Entamoeba invadens
EFSKEEDKKI

SEQ ID NO: 2850435 - protein, 4 aa, Entamoeba invadens
EFSS

SEQ ID NO: 2850436 - protein, 4 aa, Entamoeba invadens
EFTD

SEQ ID NO: 2850437 - protein, 20 aa, Entamoeba invadens
EFTGETKPSRSNKVGTGSTC

SEQ ID NO: 2850438 - protein, 7 aa, Entamoeba invadens
EFTKAES

SEQ ID NO: 2850439 - protein, 13 aa, Entamoeba invadens
EFTKKSSKLSNDE

SEQ ID NO: 2850440 - protein, 5 aa, Entamoeba invadens
EFTKQ

SEQ ID NO: 2850441 - protein, 7 aa, Entamoeba invadens
EFTKTPS

SEQ ID NO: 2850442 - protein, 5 aa, Entamoeba invadens
EFTNA

SEQ ID NO: 2850443 - protein, 5 aa, Entamoeba invadens
EFTPE

SEQ ID NO: 2850444 - protein, 6 aa, Entamoeba invadens
EFTPES

SEQ ID NO: 2850445 - protein, 12 aa, Entamoeba invadens
EFTPTKGAPSLS

SEQ ID NO: 2850446 - protein, 15 aa, Entamoeba invadens
EFTPTKGAPSLSKNA

SEQ ID NO: 2850447 - protein, 5 aa, Entamoeba invadens
EFTQE

SEQ ID NO: 2850448 - protein, 5 aa, Entamoeba invadens
EFTQK

SEQ ID NO: 2850449 - protein, 10 aa, Entamoeba invadens
EFTQTKEGQV

SEQ ID NO: 2850450 - protein, 10 aa, Entamoeba invadens
EFTSGNTVSE

SEQ ID NO: 2850451 - protein, 9 aa, Entamoeba invadens
EFTVGPQTV

SEQ ID NO: 2850452 - protein, 11 aa, Entamoeba invadens
EFTVGTDNTCH

SEQ ID NO: 2850453 - protein, 17 aa, Entamoeba invadens
EFYGTSGKSYGNDEEKK

SEQ ID NO: 2850454 - protein, 24 aa, Entamoeba invadens
EFYKDGKYDLGKKIPAEKKDASLV

SEQ ID NO: 2850455 - protein, 8 aa, Entamoeba invadens
EGAAGSAA

SEQ ID NO: 2850456 - protein, 5 aa, Entamoeba invadens
EGAET

SEQ ID NO: 2850457 - protein, 6 aa, Entamoeba invadens
EGAFKD

SEQ ID NO: 2850458 - protein, 9 aa, Entamoeba invadens
EGAGKRTKI

SEQ ID NO: 2850459 - protein, 8 aa, Entamoeba invadens
EGAISKDT

SEQ ID NO: 2850460 - protein, 4 aa, Entamoeba invadens
EGAK

SEQ ID NO: 2850461 - protein, 22 aa, Entamoeba invadens
EGAKVTRGEGEKAKSDKATDFR

SEQ ID NO: 2850462 - protein, 4 aa, Entamoeba invadens
EGAM

SEQ ID NO: 2850463 - protein, 9 aa, Entamoeba invadens
EGANADLEK

SEQ ID NO: 2850464 - protein, 9 aa, Entamoeba invadens
EGANEERSA

SEQ ID NO: 2850465 - protein, 14 aa, Entamoeba invadens
EGASAAIEKRIGTS

SEQ ID NO: 2850466 - protein, 8 aa, Entamoeba invadens
EGASGKTQ

SEQ ID NO: 2850467 - protein, 7 aa, Entamoeba invadens
EGASQVG

SEQ ID NO: 2850468 - protein, 14 aa, Entamoeba invadens
EGATQKTKIGEKPA

SEQ ID NO: 2850469 - protein, 8 aa, Entamoeba invadens
EGCAKEDE

SEQ ID NO: 2850470 - protein, 12 aa, Entamoeba invadens
EGCETEAKVREF

SEQ ID NO: 2850471 - protein, 12 aa, Entamoeba invadens
EGCGGTIGSSGK

SEQ ID NO: 2850472 - protein, 9 aa, Entamoeba invadens
EGCKPNAFN

SEQ ID NO: 2850473 - protein, 13 aa, Entamoeba invadens
EGCPQGNLTDPAQ

SEQ ID NO: 2850474 - protein, 8 aa, Entamoeba invadens
EGCSTDGK

SEQ ID NO: 2850475 - protein, 4 aa, Entamoeba invadens
EGCT

SEQ ID NO: 2850476 - protein, 7 aa, Entamoeba invadens
EGCTQET

SEQ ID NO: 2850477 - protein, 5 aa, Entamoeba invadens
EGDCP

SEQ ID NO: 2850478 - protein, 9 aa, Entamoeba invadens
EGDDDAPAH

SEQ ID NO: 2850479 - protein, 15 aa, Entamoeba invadens
EGDDEELEKRSEEAV

SEQ ID NO: 2850480 - protein, 12 aa, Entamoeba invadens
EGDDLRTDTAAQ

SEQ ID NO: 2850481 - protein, 4 aa, Entamoeba invadens
EGDE

SEQ ID NO: 2850482 - protein, 5 aa, Entamoeba invadens
EGDEK

SEQ ID NO: 2850483 - protein, 7 aa, Entamoeba invadens
EGDEMHP

SEQ ID NO: 2850484 - protein, 8 aa, Entamoeba invadens
EGDENKMN

SEQ ID NO: 2850485 - protein, 9 aa, Entamoeba invadens
EGDEQHTDT

SEQ ID NO: 2850486 - protein, 11 aa, Entamoeba invadens
EGDEQTKRIED

SEQ ID NO: 2850487 - protein, 10 aa, Entamoeba invadens
EGDESEEETE

SEQ ID NO: 2850488 - protein, 5 aa, Entamoeba invadens
EGDEW

SEQ ID NO: 2850489 - protein, 8 aa, Entamoeba invadens
EGDFTTKK

SEQ ID NO: 2850490 - protein, 8 aa, Entamoeba invadens
EGDGDKVK

SEQ ID NO: 2850491 - protein, 12 aa, Entamoeba invadens
EGDGVDKDHPMY

SEQ ID NO: 2850492 - protein, 15 aa, Entamoeba invadens
EGDGVLESDSFDDIL

SEQ ID NO: 2850493 - protein, 21 aa, Entamoeba invadens
EGDIAEFNNETDQPDHSKAAD

SEQ ID NO: 2850494 - protein, 7 aa, Entamoeba invadens
EGDKPKL

SEQ ID NO: 2850495 - protein, 6 aa, Entamoeba invadens
EGDKVD

SEQ ID NO: 2850496 - protein, 13 aa, Entamoeba invadens
EGDLNNKINAQKK

SEQ ID NO: 2850497 - protein, 5 aa, Entamoeba invadens
EGDNL

SEQ ID NO: 2850498 - protein, 12 aa, Entamoeba invadens
EGDNSIGSGSTF

SEQ ID NO: 2850499 - protein, 6 aa, Entamoeba invadens
EGDPPY

SEQ ID NO: 2850500 - protein, 7 aa, Entamoeba invadens
EGDPPYM

SEQ ID NO: 2850501 - protein, 7 aa, Entamoeba invadens
EGDQTAP

SEQ ID NO: 2850502 - protein, 9 aa, Entamoeba invadens
EGDSAKTLA

SEQ ID NO: 2850503 - protein, 4 aa, Entamoeba invadens
EGDT

SEQ ID NO: 2850504 - protein, 7 aa, Entamoeba invadens
EGDTFSA

SEQ ID NO: 2850505 - protein, 5 aa, Entamoeba invadens
EGDVE

SEQ ID NO: 2850506 - protein, 16 aa, Entamoeba invadens
EGDVKEDVSDDTEYDD

SEQ ID NO: 2850507 - protein, 7 aa, Entamoeba invadens
EGDVTDH

SEQ ID NO: 2850508 - protein, 4 aa, Entamoeba invadens
EGEC

SEQ ID NO: 2850509 - protein, 4 aa, Entamoeba invadens
EGED

SEQ ID NO: 2850510 - protein, 20 aa, Entamoeba invadens
EGEDEQETHYKTNNKESSIF

SEQ ID NO: 2850511 - protein, 8 aa, Entamoeba invadens
EGEETKMR

SEQ ID NO: 2850512 - protein, 33 aa, Entamoeba invadens
EGEEVPAVQEEQQEENKEIEGKKVAQKEKGGIP

SEQ ID NO: 2850513 - protein, 14 aa, Entamoeba invadens
EGEEWEGKEVKVQN

SEQ ID NO: 2850514 - protein, 6 aa, Entamoeba invadens
EGEEYK

SEQ ID NO: 2850515 - protein, 7 aa, Entamoeba invadens
EGEFPTK

SEQ ID NO: 2850516 - protein, 54 aa, Entamoeba invadens
EGEGSPKLENPKSRENVRSNQTNRDYDWRNGNTEGWKKSKGKDEIYGKKEEEEL

SEQ ID NO: 2850517 - protein, 6 aa, Entamoeba invadens
EGEGTV

SEQ ID NO: 2850518 - protein, 7 aa, Entamoeba invadens
EGEIDQK

SEQ ID NO: 2850519 - protein, 9 aa, Entamoeba invadens
EGEKFRSTF

SEQ ID NO: 2850520 - protein, 9 aa, Entamoeba invadens
EGEKSERYL

SEQ ID NO: 2850521 - protein, 9 aa, Entamoeba invadens
EGEKSEYKE

SEQ ID NO: 2850522 - protein, 5 aa, Entamoeba invadens
EGELS

SEQ ID NO: 2850523 - protein, 60 aa, Entamoeba invadens
EGENDSKESVQEAQEPQQSTEVESRCTQEQQNEKQILPQTKSAKFEENKSVGNSIASEAE

SEQ ID NO: 2850524 - protein, 17 aa, Entamoeba invadens
EGENDVSELACELLSYL

SEQ ID NO: 2850525 - protein, 6 aa, Entamoeba invadens
EGENLS

SEQ ID NO: 2850526 - protein, 13 aa, Entamoeba invadens
EGEPSFGNQNMEG

SEQ ID NO: 2850527 - protein, 5 aa, Entamoeba invadens
EGEPY

SEQ ID NO: 2850528 - protein, 9 aa, Entamoeba invadens
EGEQKNKID

SEQ ID NO: 2850529 - protein, 43 aa, Entamoeba invadens
EGERKLQEEVEKEKSEQRRLSSSRKGLSEDSEHSERDDKVEKV

SEQ ID NO: 2850530 - protein, 5 aa, Entamoeba invadens
EGERN

SEQ ID NO: 2850531 - protein, 6 aa, Entamoeba invadens
EGERVN

SEQ ID NO: 2850532 - protein, 6 aa, Entamoeba invadens
EGESAA

SEQ ID NO: 2850533 - protein, 17 aa, Entamoeba invadens
EGESGDDTLTGTHDPQK

SEQ ID NO: 2850534 - protein, 9 aa, Entamoeba invadens
EGESKPANI

SEQ ID NO: 2850535 - protein, 6 aa, Entamoeba invadens
EGESKV

SEQ ID NO: 2850536 - protein, 4 aa, Entamoeba invadens
EGET

SEQ ID NO: 2850537 - protein, 5 aa, Entamoeba invadens
EGETA

SEQ ID NO: 2850538 - protein, 6 aa, Entamoeba invadens
EGETAA

SEQ ID NO: 2850539 - protein, 5 aa, Entamoeba invadens
EGETS

SEQ ID NO: 2850540 - protein, 4 aa, Entamoeba invadens
EGEY

SEQ ID NO: 2850541 - protein, 5 aa, Entamoeba invadens
EGEYS

SEQ ID NO: 2850542 - protein, 11 aa, Entamoeba invadens
EGFAATPKEWT

SEQ ID NO: 2850543 - protein, 11 aa, Entamoeba invadens
EGFDKKQRVAD

SEQ ID NO: 2850544 - protein, 7 aa, Entamoeba invadens
EGFEPYD

SEQ ID NO: 2850545 - protein, 12 aa, Entamoeba invadens
EGFIDEKEKSSL

SEQ ID NO: 2850546 - protein, 13 aa, Entamoeba invadens
EGFLEKEKNSRFQ

SEQ ID NO: 2850547 - protein, 13 aa, Entamoeba invadens
EGFMSTENAQAAL

SEQ ID NO: 2850548 - protein, 12 aa, Entamoeba invadens
EGFTSDKLGSAE

SEQ ID NO: 2850549 - protein, 5 aa, Entamoeba invadens
EGGAK

SEQ ID NO: 2850550 - protein, 14 aa, Entamoeba invadens
EGGAYDGSLSYQAN

SEQ ID NO: 2850551 - protein, 23 aa, Entamoeba invadens
EGGDEIEVTREKTFNEADEVRQE

SEQ ID NO: 2850552 - protein, 4 aa, Entamoeba invadens
EGGE

SEQ ID NO: 2850553 - protein, 10 aa, Entamoeba invadens
EGGFTGIPPE

SEQ ID NO: 2850554 - protein, 4 aa, Entamoeba invadens
EGGG

SEQ ID NO: 2850555 - protein, 13 aa, Entamoeba invadens
EGGGDIKVTSPTG

SEQ ID NO: 2850556 - protein, 8 aa, Entamoeba invadens
EGGIDSSA

SEQ ID NO: 2850557 - protein, 11 aa, Entamoeba invadens
EGGIEATDIQQ

SEQ ID NO: 2850558 - protein, 9 aa, Entamoeba invadens
EGGKCKRCN

SEQ ID NO: 2850559 - protein, 7 aa, Entamoeba invadens
EGGKISN

SEQ ID NO: 2850560 - protein, 9 aa, Entamoeba invadens
EGGKKPGSE

SEQ ID NO: 2850561 - protein, 14 aa, Entamoeba invadens
EGGLYKNERGDERR

SEQ ID NO: 2850562 - protein, 4 aa, Entamoeba invadens
EGGN

SEQ ID NO: 2850563 - protein, 28 aa, Entamoeba invadens
EGGNEKEDEEELERERNETDQSKMEEDS

SEQ ID NO: 2850564 - protein, 12 aa, Entamoeba invadens
EGGNELEIEGDT

SEQ ID NO: 2850565 - protein, 5 aa, Entamoeba invadens
EGGQI

SEQ ID NO: 2850566 - protein, 6 aa, Entamoeba invadens
EGGRNH

SEQ ID NO: 2850567 - protein, 8 aa, Entamoeba invadens
EGGSDKIK

SEQ ID NO: 2850568 - protein, 8 aa, Entamoeba invadens
EGGSGGAL

SEQ ID NO: 2850569 - protein, 9 aa, Entamoeba invadens
EGGSKHKSC

SEQ ID NO: 2850570 - protein, 9 aa, Entamoeba invadens
EGGSLQDEI

SEQ ID NO: 2850571 - protein, 7 aa, Entamoeba invadens
EGGSWKS

SEQ ID NO: 2850572 - protein, 4 aa, Entamoeba invadens
EGGT

SEQ ID NO: 2850573 - protein, 6 aa, Entamoeba invadens
EGGTIT

SEQ ID NO: 2850574 - protein, 7 aa, Entamoeba invadens
EGGVKEA

SEQ ID NO: 2850575 - protein, 11 aa, Entamoeba invadens
EGGYFKEDGYK

SEQ ID NO: 2850576 - protein, 7 aa, Entamoeba invadens
EGHESEV

SEQ ID NO: 2850577 - protein, 7 aa, Entamoeba invadens
EGHNGNL

SEQ ID NO: 2850578 - protein, 7 aa, Entamoeba invadens
EGHTNKM

SEQ ID NO: 2850579 - protein, 6 aa, Entamoeba invadens
EGHYAS

SEQ ID NO: 2850580 - protein, 6 aa, Entamoeba invadens
EGIDDT

SEQ ID NO: 2850581 - protein, 7 aa, Entamoeba invadens
EGIDKNA

SEQ ID NO: 2850582 - protein, 9 aa, Entamoeba invadens
EGIDPTTDI

SEQ ID NO: 2850583 - protein, 10 aa, Entamoeba invadens
EGIDREELNK

SEQ ID NO: 2850584 - protein, 8 aa, Entamoeba invadens
EGIDTPPQ

SEQ ID NO: 2850585 - protein, 4 aa, Entamoeba invadens
EGIE

SEQ ID NO: 2850586 - protein, 13 aa, Entamoeba invadens
EGIESPNRNNTLE

SEQ ID NO: 2850587 - protein, 34 aa, Entamoeba invadens
EGIETEKKEAQNAAVKAKKQAKQYTRKVEEAERK

SEQ ID NO: 2850588 - protein, 34 aa, Entamoeba invadens
EGIETKKEEAQNATAKAKKQAKQYARKVEEAERK

SEQ ID NO: 2850589 - protein, 4 aa, Entamoeba invadens
EGIG

SEQ ID NO: 2850590 - protein, 4 aa, Entamoeba invadens
EGIK

SEQ ID NO: 2850591 - protein, 57 aa, Entamoeba invadens
EGIKEAGSRKAALEPDEEDDEEGDEEENDEEEDEEDEESGDEDGTDESDDDQTMVIK

SEQ ID NO: 2850592 - protein, 9 aa, Entamoeba invadens
EGIKNGTAV

SEQ ID NO: 2850593 - protein, 5 aa, Entamoeba invadens
EGIKS

SEQ ID NO: 2850594 - protein, 6 aa, Entamoeba invadens
EGIKTG

SEQ ID NO: 2850595 - protein, 10 aa, Entamoeba invadens
EGIPADKTKA

SEQ ID NO: 2850596 - protein, 9 aa, Entamoeba invadens
EGIPDPTDI

SEQ ID NO: 2850597 - protein, 13 aa, Entamoeba invadens
EGIPEPKSTECGN

SEQ ID NO: 2850598 - protein, 13 aa, Entamoeba invadens
EGIPGSPEKPLSD

SEQ ID NO: 2850599 - protein, 4 aa, Entamoeba invadens
EGIQ

SEQ ID NO: 2850600 - protein, 21 aa, Entamoeba invadens
EGIQHNAGSRNEHKNLSNSLA

SEQ ID NO: 2850601 - protein, 7 aa, Entamoeba invadens
EGIQKEM

SEQ ID NO: 2850602 - protein, 6 aa, Entamoeba invadens
EGIRRG

SEQ ID NO: 2850603 - protein, 10 aa, Entamoeba invadens
EGIRSGSASL

SEQ ID NO: 2850604 - protein, 7 aa, Entamoeba invadens
EGISPEA

SEQ ID NO: 2850605 - protein, 11 aa, Entamoeba invadens
EGISRDEAKNL

SEQ ID NO: 2850606 - protein, 10 aa, Entamoeba invadens
EGISSPRQFE

SEQ ID NO: 2850607 - protein, 10 aa, Entamoeba invadens
EGISTSVEEN

SEQ ID NO: 2850608 - protein, 4 aa, Entamoeba invadens
EGIT

SEQ ID NO: 2850609 - protein, 26 aa, Entamoeba invadens
EGITPKSSKKEKNKKKGKLCGATCCI

SEQ ID NO: 2850610 - protein, 6 aa, Entamoeba invadens
EGITRE

SEQ ID NO: 2850611 - protein, 8 aa, Entamoeba invadens
EGIVEESS

SEQ ID NO: 2850612 - protein, 7 aa, Entamoeba invadens
EGIVPGG

SEQ ID NO: 2850613 - protein, 8 aa, Entamoeba invadens
EGKADMDS

SEQ ID NO: 2850614 - protein, 9 aa, Entamoeba invadens
EGKDGMSSF

SEQ ID NO: 2850615 - protein, 5 aa, Entamoeba invadens
EGKDH

SEQ ID NO: 2850616 - protein, 11 aa, Entamoeba invadens
EGKDKQEYTQE

SEQ ID NO: 2850617 - protein, 10 aa, Entamoeba invadens
EGKEFKEKGT

SEQ ID NO: 2850618 - protein, 5 aa, Entamoeba invadens
EGKEK

SEQ ID NO: 2850619 - protein, 6 aa, Entamoeba invadens
EGKELQ

SEQ ID NO: 2850620 - protein, 6 aa, Entamoeba invadens
EGKENC

SEQ ID NO: 2850621 - protein, 6 aa, Entamoeba invadens
EGKETG

SEQ ID NO: 2850622 - protein, 6 aa, Entamoeba invadens
EGKETT

SEQ ID NO: 2850623 - protein, 9 aa, Entamoeba invadens
EGKETVEKE

SEQ ID NO: 2850624 - protein, 5 aa, Entamoeba invadens
EGKEY

SEQ ID NO: 2850625 - protein, 9 aa, Entamoeba invadens
EGKGASPFE

SEQ ID NO: 2850626 - protein, 7 aa, Entamoeba invadens
EGKGISV

SEQ ID NO: 2850627 - protein, 6 aa, Entamoeba invadens
EGKGRD

SEQ ID NO: 2850628 - protein, 7 aa, Entamoeba invadens
EGKIDEG

SEQ ID NO: 2850629 - protein, 11 aa, Entamoeba invadens
EGKIKENESWD

SEQ ID NO: 2850630 - protein, 4 aa, Entamoeba invadens
EGKK

SEQ ID NO: 2850631 - protein, 9 aa, Entamoeba invadens
EGKKDQETL

SEQ ID NO: 2850632 - protein, 7 aa, Entamoeba invadens
EGKKEKN

SEQ ID NO: 2850633 - protein, 12 aa, Entamoeba invadens
EGKKLPDHFGRD

SEQ ID NO: 2850634 - protein, 13 aa, Entamoeba invadens
EGKKLPDHFGRDE

SEQ ID NO: 2850635 - protein, 4 aa, Entamoeba invadens
EGKL

SEQ ID NO: 2850636 - protein, 5 aa, Entamoeba invadens
EGKLS

SEQ ID NO: 2850637 - protein, 11 aa, Entamoeba invadens
EGKLSLSNATF

SEQ ID NO: 2850638 - protein, 5 aa, Entamoeba invadens
EGKMP

SEQ ID NO: 2850639 - protein, 5 aa, Entamoeba invadens
EGKMS

SEQ ID NO: 2850640 - protein, 4 aa, Entamoeba invadens
EGKP

SEQ ID NO: 2850641 - protein, 9 aa, Entamoeba invadens
EGKPLYDEM

SEQ ID NO: 2850642 - protein, 20 aa, Entamoeba invadens
EGKQVDPSWASKGGDTPLTD

SEQ ID NO: 2850643 - protein, 8 aa, Entamoeba invadens
EGKRLEKL

SEQ ID NO: 2850644 - protein, 6 aa, Entamoeba invadens
EGKRNR

SEQ ID NO: 2850645 - protein, 7 aa, Entamoeba invadens
EGKRRKP

SEQ ID NO: 2850646 - protein, 8 aa, Entamoeba invadens
EGKRSGVY

SEQ ID NO: 2850647 - protein, 4 aa, Entamoeba invadens
EGKS

SEQ ID NO: 2850648 - protein, 8 aa, Entamoeba invadens
EGKSDKSL

SEQ ID NO: 2850649 - protein, 5 aa, Entamoeba invadens
EGKSN

SEQ ID NO: 2850650 - protein, 8 aa, Entamoeba invadens
EGKSNIAP

SEQ ID NO: 2850651 - protein, 31 aa, Entamoeba invadens
EGKTEAVDEGTPAKNKMSMEEEIGDNAHNTV

SEQ ID NO: 2850652 - protein, 9 aa, Entamoeba invadens
EGKTKGNGS

SEQ ID NO: 2850653 - protein, 9 aa, Entamoeba invadens
EGKTKNAIE

SEQ ID NO: 2850654 - protein, 7 aa, Entamoeba invadens
EGKTRTL

SEQ ID NO: 2850655 - protein, 15 aa, Entamoeba invadens
EGKTVNPKDLKGKTV

SEQ ID NO: 2850656 - protein, 7 aa, Entamoeba invadens
EGKVDEY

SEQ ID NO: 2850657 - protein, 4 aa, Entamoeba invadens
EGKY

SEQ ID NO: 2850658 - protein, 5 aa, Entamoeba invadens
EGKYN

SEQ ID NO: 2850659 - protein, 4 aa, Entamoeba invadens
EGLD

SEQ ID NO: 2850660 - protein, 8 aa, Entamoeba invadens
EGLGETAK

SEQ ID NO: 2850661 - protein, 6 aa, Entamoeba invadens
EGLGGQ

SEQ ID NO: 2850662 - protein, 11 aa, Entamoeba invadens
EGLKKKDEILK

SEQ ID NO: 2850663 - protein, 9 aa, Entamoeba invadens
EGLNQETQD

SEQ ID NO: 2850664 - protein, 7 aa, Entamoeba invadens
EGLPEDQ

SEQ ID NO: 2850665 - protein, 6 aa, Entamoeba invadens
EGLPSV

SEQ ID NO: 2850666 - protein, 12 aa, Entamoeba invadens
EGLRRTADTEKH

SEQ ID NO: 2850667 - protein, 4 aa, Entamoeba invadens
EGLS

SEQ ID NO: 2850668 - protein, 10 aa, Entamoeba invadens
EGLSEQTAVR

SEQ ID NO: 2850669 - protein, 13 aa, Entamoeba invadens
EGLTDKDQTNTFC

SEQ ID NO: 2850670 - protein, 11 aa, Entamoeba invadens
EGLTPAIPRSQ

SEQ ID NO: 2850671 - protein, 9 aa, Entamoeba invadens
EGLTPDKSE

SEQ ID NO: 2850672 - protein, 12 aa, Entamoeba invadens
EGLTPKSPSVSI

SEQ ID NO: 2850673 - protein, 6 aa, Entamoeba invadens
EGMEES

SEQ ID NO: 2850674 - protein, 14 aa, Entamoeba invadens
EGMEKTYGKKFKGE

SEQ ID NO: 2850675 - protein, 4 aa, Entamoeba invadens
EGMI

SEQ ID NO: 2850676 - protein, 4 aa, Entamoeba invadens
EGMK

SEQ ID NO: 2850677 - protein, 10 aa, Entamoeba invadens
EGMKGEKEKL

SEQ ID NO: 2850678 - protein, 4 aa, Entamoeba invadens
EGMQ

SEQ ID NO: 2850679 - protein, 6 aa, Entamoeba invadens
EGMTQQ

SEQ ID NO: 2850680 - protein, 15 aa, Entamoeba invadens
EGNAALSTRLDPTEL

SEQ ID NO: 2850681 - protein, 6 aa, Entamoeba invadens
EGNAEL

SEQ ID NO: 2850682 - protein, 5 aa, Entamoeba invadens
EGNAK

SEQ ID NO: 2850683 - protein, 17 aa, Entamoeba invadens
EGNAKKTSETIREVGQS

SEQ ID NO: 2850684 - protein, 7 aa, Entamoeba invadens
EGNASPD

SEQ ID NO: 2850685 - protein, 10 aa, Entamoeba invadens
EGNATITPSF

SEQ ID NO: 2850686 - protein, 9 aa, Entamoeba invadens
EGNCKPQTD

SEQ ID NO: 2850687 - protein, 8 aa, Entamoeba invadens
EGNDKQKM

SEQ ID NO: 2850688 - protein, 13 aa, Entamoeba invadens
EGNDKQKMQTRRL

SEQ ID NO: 2850689 - protein, 9 aa, Entamoeba invadens
EGNDPDQKR

SEQ ID NO: 2850690 - protein, 8 aa, Entamoeba invadens
EGNDTKDL

SEQ ID NO: 2850691 - protein, 4 aa, Entamoeba invadens
EGNE

SEQ ID NO: 2850692 - protein, 32 aa, Entamoeba invadens
EGNEADDSKKYIETSESLAQQKKKDQMKRKEE

SEQ ID NO: 2850693 - protein, 13 aa, Entamoeba invadens
EGNEDKKENGDVN

SEQ ID NO: 2850694 - protein, 8 aa, Entamoeba invadens
EGNEGPGL

SEQ ID NO: 2850695 - protein, 5 aa, Entamoeba invadens
EGNEI

SEQ ID NO: 2850696 - protein, 7 aa, Entamoeba invadens
EGNEPTS

SEQ ID NO: 2850697 - protein, 6 aa, Entamoeba invadens
EGNFGA

SEQ ID NO: 2850698 - protein, 27 aa, Entamoeba invadens
EGNGLGGLSETLKSGENNKSTKGAKVT

SEQ ID NO: 2850699 - protein, 5 aa, Entamoeba invadens
EGNIQ

SEQ ID NO: 2850700 - protein, 15 aa, Entamoeba invadens
EGNIQAVQNESFKQP

SEQ ID NO: 2850701 - protein, 7 aa, Entamoeba invadens
EGNKEKE

SEQ ID NO: 2850702 - protein, 8 aa, Entamoeba invadens
EGNKETSK

SEQ ID NO: 2850703 - protein, 8 aa, Entamoeba invadens
EGNKNSVQ

SEQ ID NO: 2850704 - protein, 6 aa, Entamoeba invadens
EGNKSD

SEQ ID NO: 2850705 - protein, 10 aa, Entamoeba invadens
EGNLEEEDPL

SEQ ID NO: 2850706 - protein, 5 aa, Entamoeba invadens
EGNNI

SEQ ID NO: 2850707 - protein, 8 aa, Entamoeba invadens
EGNPESRQ

SEQ ID NO: 2850708 - protein, 5 aa, Entamoeba invadens
EGNPH

SEQ ID NO: 2850709 - protein, 9 aa, Entamoeba invadens
EGNPPNRQV

SEQ ID NO: 2850710 - protein, 8 aa, Entamoeba invadens
EGNPPYKE

SEQ ID NO: 2850711 - protein, 8 aa, Entamoeba invadens
EGNPPYRE

SEQ ID NO: 2850712 - protein, 4 aa, Entamoeba invadens
EGNR

SEQ ID NO: 2850713 - protein, 6 aa, Entamoeba invadens
EGNREP

SEQ ID NO: 2850714 - protein, 13 aa, Entamoeba invadens
EGNRLQNPGTIKS

SEQ ID NO: 2850715 - protein, 13 aa, Entamoeba invadens
EGNRPKKTSAIPS

SEQ ID NO: 2850716 - protein, 4 aa, Entamoeba invadens
EGNT

SEQ ID NO: 2850717 - protein, 7 aa, Entamoeba invadens
EGNTEAN

SEQ ID NO: 2850718 - protein, 6 aa, Entamoeba invadens
EGNTEI

SEQ ID NO: 2850719 - protein, 7 aa, Entamoeba invadens
EGNTLNK

SEQ ID NO: 2850720 - protein, 5 aa, Entamoeba invadens
EGNVP

SEQ ID NO: 2850721 - protein, 7 aa, Entamoeba invadens
EGNYRTR

SEQ ID NO: 2850722 - protein, 5 aa, Entamoeba invadens
EGNYT

SEQ ID NO: 2850723 - protein, 4 aa, Entamoeba invadens
EGPC

SEQ ID NO: 2850724 - protein, 5 aa, Entamoeba invadens
EGPDN

SEQ ID NO: 2850725 - protein, 13 aa, Entamoeba invadens
EGPEEMNVKKGDT

SEQ ID NO: 2850726 - protein, 9 aa, Entamoeba invadens
EGPEWATQK

SEQ ID NO: 2850727 - protein, 12 aa, Entamoeba invadens
EGPLKEKTKLDE

SEQ ID NO: 2850728 - protein, 4 aa, Entamoeba invadens
EGPN

SEQ ID NO: 2850729 - protein, 6 aa, Entamoeba invadens
EGPNGI

SEQ ID NO: 2850730 - protein, 12 aa, Entamoeba invadens
EGPNPKTTQVEK

SEQ ID NO: 2850731 - protein, 8 aa, Entamoeba invadens
EGPSQQPL

SEQ ID NO: 2850732 - protein, 22 aa, Entamoeba invadens
EGPTDGEDISVNDDEEDDFSTS

SEQ ID NO: 2850733 - protein, 15 aa, Entamoeba invadens
EGQAQQGVEKINEKM

SEQ ID NO: 2850734 - protein, 6 aa, Entamoeba invadens
EGQETG

SEQ ID NO: 2850735 - protein, 20 aa, Entamoeba invadens
EGQKGISSNHKDGCGITENI

SEQ ID NO: 2850736 - protein, 8 aa, Entamoeba invadens
EGQKIEAT

SEQ ID NO: 2850737 - protein, 35 aa, Entamoeba invadens
EGQMRGKIDTSKSVTNKPQTKFTDKPDNFATTYTP

SEQ ID NO: 2850738 - protein, 8 aa, Entamoeba invadens
EGQNSATI

SEQ ID NO: 2850739 - protein, 10 aa, Entamoeba invadens
EGQNTENEYF

SEQ ID NO: 2850740 - protein, 4 aa, Entamoeba invadens
EGQP

SEQ ID NO: 2850741 - protein, 17 aa, Entamoeba invadens
EGQPANKIGEENPSSIE

SEQ ID NO: 2850742 - protein, 70 aa, Entamoeba invadens
EGQPISKQQPGDKMEEENKKENKEEEGSDEEKEDTPEKMEEEDTPKEVEEKENSTDKKEKDDTESDEEDD

SEQ ID NO: 2850743 - protein, 15 aa, Entamoeba invadens
EGQSTRKSPKYSRQN

SEQ ID NO: 2850744 - protein, 4 aa, Entamoeba invadens
EGQT

SEQ ID NO: 2850745 - protein, 11 aa, Entamoeba invadens
EGQVNGNAINR

SEQ ID NO: 2850746 - protein, 6 aa, Entamoeba invadens
EGQVQG

SEQ ID NO: 2850747 - protein, 15 aa, Entamoeba invadens
EGQYQEEAESQRAIN

SEQ ID NO: 2850748 - protein, 8 aa, Entamoeba invadens
EGRAEGRS

SEQ ID NO: 2850749 - protein, 19 aa, Entamoeba invadens
EGRAGIGASKVPSKPAEHS

SEQ ID NO: 2850750 - protein, 17 aa, Entamoeba invadens
EGRDEAQGKLKGSGRKL

SEQ ID NO: 2850751 - protein, 16 aa, Entamoeba invadens
EGRDPKLEQINDPSNP

SEQ ID NO: 2850752 - protein, 9 aa, Entamoeba invadens
EGREKISTN

SEQ ID NO: 2850753 - protein, 7 aa, Entamoeba invadens
EGRGADI

SEQ ID NO: 2850754 - protein, 9 aa, Entamoeba invadens
EGRKDELTR

SEQ ID NO: 2850755 - protein, 9 aa, Entamoeba invadens
EGRKDGGNS

SEQ ID NO: 2850756 - protein, 13 aa, Entamoeba invadens
EGRKKGIASLGKA

SEQ ID NO: 2850757 - protein, 10 aa, Entamoeba invadens
EGRNGSGVNS

SEQ ID NO: 2850758 - protein, 9 aa, Entamoeba invadens
EGRPIGPSQ

SEQ ID NO: 2850759 - protein, 8 aa, Entamoeba invadens
EGRQANQL

SEQ ID NO: 2850760 - protein, 5 aa, Entamoeba invadens
EGRQI

SEQ ID NO: 2850761 - protein, 4 aa, Entamoeba invadens
EGRR

SEQ ID NO: 2850762 - protein, 12 aa, Entamoeba invadens
EGRRDERAQPNV

SEQ ID NO: 2850763 - protein, 7 aa, Entamoeba invadens
EGRTVSR

SEQ ID NO: 2850764 - protein, 9 aa, Entamoeba invadens
EGRVDKDDT

SEQ ID NO: 2850765 - protein, 8 aa, Entamoeba invadens
EGSAKDAE

SEQ ID NO: 2850766 - protein, 9 aa, Entamoeba invadens
EGSAQKIGE

SEQ ID NO: 2850767 - protein, 12 aa, Entamoeba invadens
EGSATLKNKKGI

SEQ ID NO: 2850768 - protein, 16 aa, Entamoeba invadens
EGSAVDPRKEVNEMRN

SEQ ID NO: 2850769 - protein, 4 aa, Entamoeba invadens
EGSD

SEQ ID NO: 2850770 - protein, 8 aa, Entamoeba invadens
EGSDFVGN

SEQ ID NO: 2850771 - protein, 12 aa, Entamoeba invadens
EGSDLKKREKDY

SEQ ID NO: 2850772 - protein, 8 aa, Entamoeba invadens
EGSDNNNK

SEQ ID NO: 2850773 - protein, 8 aa, Entamoeba invadens
EGSDTEPK

SEQ ID NO: 2850774 - protein, 14 aa, Entamoeba invadens
EGSDTSSSQEAEEC

SEQ ID NO: 2850775 - protein, 13 aa, Entamoeba invadens
EGSDVSSIVVENK

SEQ ID NO: 2850776 - protein, 6 aa, Entamoeba invadens
EGSDYN

SEQ ID NO: 2850777 - protein, 4 aa, Entamoeba invadens
EGSE

SEQ ID NO: 2850778 - protein, 10 aa, Entamoeba invadens
EGSEENREGY

SEQ ID NO: 2850779 - protein, 5 aa, Entamoeba invadens
EGSEK

SEQ ID NO: 2850780 - protein, 5 aa, Entamoeba invadens
EGSEN

SEQ ID NO: 2850781 - protein, 12 aa, Entamoeba invadens
EGSESQPPTPLM

SEQ ID NO: 2850782 - protein, 13 aa, Entamoeba invadens
EGSGTANKSGEKH

SEQ ID NO: 2850783 - protein, 6 aa, Entamoeba invadens
EGSHER

SEQ ID NO: 2850784 - protein, 8 aa, Entamoeba invadens
EGSIATGR

SEQ ID NO: 2850785 - protein, 10 aa, Entamoeba invadens
EGSIDSENYC

SEQ ID NO: 2850786 - protein, 8 aa, Entamoeba invadens
EGSIPNTL

SEQ ID NO: 2850787 - protein, 6 aa, Entamoeba invadens
EGSKKF

SEQ ID NO: 2850788 - protein, 7 aa, Entamoeba invadens
EGSKKSI

SEQ ID NO: 2850789 - protein, 7 aa, Entamoeba invadens
EGSKRSV

SEQ ID NO: 2850790 - protein, 13 aa, Entamoeba invadens
EGSLITRQPLTPF

SEQ ID NO: 2850791 - protein, 8 aa, Entamoeba invadens
EGSLPTNF

SEQ ID NO: 2850792 - protein, 5 aa, Entamoeba invadens
EGSLT

SEQ ID NO: 2850793 - protein, 5 aa, Entamoeba invadens
EGSNL

SEQ ID NO: 2850794 - protein, 13 aa, Entamoeba invadens
EGSPGNQSVEHTD

SEQ ID NO: 2850795 - protein, 6 aa, Entamoeba invadens
EGSPSS

SEQ ID NO: 2850796 - protein, 13 aa, Entamoeba invadens
EGSQKKKVDTEKM

SEQ ID NO: 2850797 - protein, 9 aa, Entamoeba invadens
EGSQNRSIS

SEQ ID NO: 2850798 - protein, 6 aa, Entamoeba invadens
EGSQRG

SEQ ID NO: 2850799 - protein, 16 aa, Entamoeba invadens
EGSQTQPAELSTQQGQ

SEQ ID NO: 2850800 - protein, 7 aa, Entamoeba invadens
EGSQVKS

SEQ ID NO: 2850801 - protein, 5 aa, Entamoeba invadens
EGSRL

SEQ ID NO: 2850802 - protein, 5 aa, Entamoeba invadens
EGSRY

SEQ ID NO: 2850803 - protein, 12 aa, Entamoeba invadens
EGSSDTPVSPDV

SEQ ID NO: 2850804 - protein, 5 aa, Entamoeba invadens
EGSSL

SEQ ID NO: 2850805 - protein, 5 aa, Entamoeba invadens
EGSSV

SEQ ID NO: 2850806 - protein, 8 aa, Entamoeba invadens
EGSSYDPE

SEQ ID NO: 2850807 - protein, 13 aa, Entamoeba invadens
EGSTEKINEDDQM

SEQ ID NO: 2850808 - protein, 8 aa, Entamoeba invadens
EGSTNGLD

SEQ ID NO: 2850809 - protein, 7 aa, Entamoeba invadens
EGSTNTN

SEQ ID NO: 2850810 - protein, 14 aa, Entamoeba invadens
EGSTSKLPFNDTPA

SEQ ID NO: 2850811 - protein, 6 aa, Entamoeba invadens
EGSTVS

SEQ ID NO: 2850812 - protein, 4 aa, Entamoeba invadens
EGSV

SEQ ID NO: 2850813 - protein, 5 aa, Entamoeba invadens
EGSVE

SEQ ID NO: 2850814 - protein, 6 aa, Entamoeba invadens
EGSVGK

SEQ ID NO: 2850815 - protein, 7 aa, Entamoeba invadens
EGSVGKS

SEQ ID NO: 2850816 - protein, 14 aa, Entamoeba invadens
EGSVQANPSTPDSE

SEQ ID NO: 2850817 - protein, 9 aa, Entamoeba invadens
EGSVRRGGH

SEQ ID NO: 2850818 - protein, 4 aa, Entamoeba invadens
EGSY

SEQ ID NO: 2850819 - protein, 5 aa, Entamoeba invadens
EGSYI

SEQ ID NO: 2850820 - protein, 7 aa, Entamoeba invadens
EGSYPEN

SEQ ID NO: 2850821 - protein, 19 aa, Entamoeba invadens
EGTADEKGLVSKGKDGEAD

SEQ ID NO: 2850822 - protein, 10 aa, Entamoeba invadens
EGTAKGRDGP

SEQ ID NO: 2850823 - protein, 6 aa, Entamoeba invadens
EGTEGR

SEQ ID NO: 2850824 - protein, 7 aa, Entamoeba invadens
EGTFRPE

SEQ ID NO: 2850825 - protein, 7 aa, Entamoeba invadens
EGTGRAV

SEQ ID NO: 2850826 - protein, 4 aa, Entamoeba invadens
EGTH

SEQ ID NO: 2850827 - protein, 21 aa, Entamoeba invadens
EGTHQTEEDVNKQLNDKERVA

SEQ ID NO: 2850828 - protein, 6 aa, Entamoeba invadens
EGTIDD

SEQ ID NO: 2850829 - protein, 4 aa, Entamoeba invadens
EGTK

SEQ ID NO: 2850830 - protein, 11 aa, Entamoeba invadens
EGTKANKTTQK

SEQ ID NO: 2850831 - protein, 4 aa, Entamoeba invadens
EGTL

SEQ ID NO: 2850832 - protein, 9 aa, Entamoeba invadens
EGTLPPQQQ

SEQ ID NO: 2850833 - protein, 6 aa, Entamoeba invadens
EGTMRE

SEQ ID NO: 2850834 - protein, 8 aa, Entamoeba invadens
EGTNGSIV

SEQ ID NO: 2850835 - protein, 10 aa, Entamoeba invadens
EGTPEQAEQG

SEQ ID NO: 2850836 - protein, 14 aa, Entamoeba invadens
EGTPLDKKLQDAQY

SEQ ID NO: 2850837 - protein, 7 aa, Entamoeba invadens
EGTPTIS

SEQ ID NO: 2850838 - protein, 23 aa, Entamoeba invadens
EGTQTQKFQKQRRGSTSRDPPKN

SEQ ID NO: 2850839 - protein, 10 aa, Entamoeba invadens
EGTSKSMGVE

SEQ ID NO: 2850840 - protein, 5 aa, Entamoeba invadens
EGTTI

SEQ ID NO: 2850841 - protein, 10 aa, Entamoeba invadens
EGTTKIEKEA

SEQ ID NO: 2850842 - protein, 74 aa, Entamoeba invadens
EGTTQADSDDNWRRKPGETYVPKQRGGYSDISNKRGGSSGDRNRGGRFGNDSRGRTYGDKTRGGHSPSRGGPRG

SEQ ID NO: 2850843 - protein, 5 aa, Entamoeba invadens
EGTVD

SEQ ID NO: 2850844 - protein, 12 aa, Entamoeba invadens
EGTVKSGDKTCS

SEQ ID NO: 2850845 - protein, 10 aa, Entamoeba invadens
EGTYKGNRIP

SEQ ID NO: 2850846 - protein, 7 aa, Entamoeba invadens
EGVARDM

SEQ ID NO: 2850847 - protein, 6 aa, Entamoeba invadens
EGVDGQ

SEQ ID NO: 2850848 - protein, 11 aa, Entamoeba invadens
EGVEEKRGALE

SEQ ID NO: 2850849 - protein, 12 aa, Entamoeba invadens
EGVEKSEKDPQL

SEQ ID NO: 2850850 - protein, 4 aa, Entamoeba invadens
EGVG

SEQ ID NO: 2850851 - protein, 8 aa, Entamoeba invadens
EGVGEPGM

SEQ ID NO: 2850852 - protein, 7 aa, Entamoeba invadens
EGVGKSA

SEQ ID NO: 2850853 - protein, 9 aa, Entamoeba invadens
EGVKEKNVE

SEQ ID NO: 2850854 - protein, 16 aa, Entamoeba invadens
EGVKTSAASDEIFNGN

SEQ ID NO: 2850855 - protein, 12 aa, Entamoeba invadens
EGVNDSEELKIP

SEQ ID NO: 2850856 - protein, 9 aa, Entamoeba invadens
EGVNEYQNR

SEQ ID NO: 2850857 - protein, 7 aa, Entamoeba invadens
EGVNKRE

SEQ ID NO: 2850858 - protein, 6 aa, Entamoeba invadens
EGVNPE

SEQ ID NO: 2850859 - protein, 8 aa, Entamoeba invadens
EGVPRTKS

SEQ ID NO: 2850860 - protein, 16 aa, Entamoeba invadens
EGVQNSPQRPSTQGAL

SEQ ID NO: 2850861 - protein, 15 aa, Entamoeba invadens
EGVRDSTKQLLQKYL

SEQ ID NO: 2850862 - protein, 10 aa, Entamoeba invadens
EGVRPNRKSI

SEQ ID NO: 2850863 - protein, 10 aa, Entamoeba invadens
EGVSKEKALR

SEQ ID NO: 2850864 - protein, 22 aa, Entamoeba invadens
EGVSKKQAEKLLSEKPRQDEAI

SEQ ID NO: 2850865 - protein, 8 aa, Entamoeba invadens
EGVSVDGV

SEQ ID NO: 2850866 - protein, 4 aa, Entamoeba invadens
EGVT

SEQ ID NO: 2850867 - protein, 12 aa, Entamoeba invadens
EGVTDDEKNALE

SEQ ID NO: 2850868 - protein, 6 aa, Entamoeba invadens
EGVTQP

SEQ ID NO: 2850869 - protein, 21 aa, Entamoeba invadens
EGVVSKDAKVPDLDEKLSSVG

SEQ ID NO: 2850870 - protein, 20 aa, Entamoeba invadens
EGVYTPKAVTEYKADKDNIK

SEQ ID NO: 2850871 - protein, 12 aa, Entamoeba invadens
EGWDENPHMRPN

SEQ ID NO: 2850872 - protein, 12 aa, Entamoeba invadens
EGWGNDSSDTEL

SEQ ID NO: 2850873 - protein, 6 aa, Entamoeba invadens
EGWNVT

SEQ ID NO: 2850874 - protein, 22 aa, Entamoeba invadens
EGYESDSNSQSSRVELSDDEDF

SEQ ID NO: 2850875 - protein, 10 aa, Entamoeba invadens
EGYIDSNAGE

SEQ ID NO: 2850876 - protein, 9 aa, Entamoeba invadens
EGYKEKSIN

SEQ ID NO: 2850877 - protein, 10 aa, Entamoeba invadens
EGYKTGERTD

SEQ ID NO: 2850878 - protein, 16 aa, Entamoeba invadens
EGYLKSETSQAQQTKM

SEQ ID NO: 2850879 - protein, 11 aa, Entamoeba invadens
EGYNADDEKGI

SEQ ID NO: 2850880 - protein, 36 aa, Entamoeba invadens
EGYQSLEEGRGGTRYVGRKGAKGAKAAHKGGKKPIH

SEQ ID NO: 2850881 - protein, 8 aa, Entamoeba invadens
EGYQTARN

SEQ ID NO: 2850882 - protein, 4 aa, Entamoeba invadens
EGYS

SEQ ID NO: 2850883 - protein, 9 aa, Entamoeba invadens
EGYSGGALK

SEQ ID NO: 2850884 - protein, 18 aa, Entamoeba invadens
EGYSSLSQSGGTRLKESS

SEQ ID NO: 2850885 - protein, 6 aa, Entamoeba invadens
EGYTEE

SEQ ID NO: 2850886 - protein, 4 aa, Entamoeba invadens
EGYY

SEQ ID NO: 2850887 - protein, 8 aa, Entamoeba invadens
EHAEKKKV

SEQ ID NO: 2850888 - protein, 7 aa, Entamoeba invadens
EHAEQNN

SEQ ID NO: 2850889 - protein, 6 aa, Entamoeba invadens
EHAETV

SEQ ID NO: 2850890 - protein, 16 aa, Entamoeba invadens
EHAKTEPSGSPRIQEE

SEQ ID NO: 2850891 - protein, 8 aa, Entamoeba invadens
EHANQDNC

SEQ ID NO: 2850892 - protein, 4 aa, Entamoeba invadens
EHAQ

SEQ ID NO: 2850893 - protein, 8 aa, Entamoeba invadens
EHAVASYE

SEQ ID NO: 2850894 - protein, 9 aa, Entamoeba invadens
EHCKKKPME

SEQ ID NO: 2850895 - protein, 4 aa, Entamoeba invadens
EHCP

SEQ ID NO: 2850896 - protein, 9 aa, Entamoeba invadens
EHDDRPSTQ

SEQ ID NO: 2850897 - protein, 7 aa, Entamoeba invadens
EHDELNS

SEQ ID NO: 2850898 - protein, 9 aa, Entamoeba invadens
EHDENGDGV

SEQ ID NO: 2850899 - protein, 5 aa, Entamoeba invadens
EHDEY

SEQ ID NO: 2850900 - protein, 4 aa, Entamoeba invadens
EHDG

SEQ ID NO: 2850901 - protein, 14 aa, Entamoeba invadens
EHDRAKERLEQAEE

SEQ ID NO: 2850902 - protein, 8 aa, Entamoeba invadens
EHDSTSYY

SEQ ID NO: 2850903 - protein, 4 aa, Entamoeba invadens
EHDY

SEQ ID NO: 2850904 - protein, 7 aa, Entamoeba invadens
EHEESRL

SEQ ID NO: 2850905 - protein, 7 aa, Entamoeba invadens
EHEIEGK

SEQ ID NO: 2850906 - protein, 5 aa, Entamoeba invadens
EHERS

SEQ ID NO: 2850907 - protein, 10 aa, Entamoeba invadens
EHETSKSLQR

SEQ ID NO: 2850908 - protein, 13 aa, Entamoeba invadens
EHFGGSKMGDGQK

SEQ ID NO: 2850909 - protein, 10 aa, Entamoeba invadens
EHGETTELSP

SEQ ID NO: 2850910 - protein, 8 aa, Entamoeba invadens
EHGGEPSS

SEQ ID NO: 2850911 - protein, 8 aa, Entamoeba invadens
EHGPYSKP

SEQ ID NO: 2850912 - protein, 5 aa, Entamoeba invadens
EHGSE

SEQ ID NO: 2850913 - protein, 5 aa, Entamoeba invadens
EHGSL

SEQ ID NO: 2850914 - protein, 7 aa, Entamoeba invadens
EHGTNTC

SEQ ID NO: 2850915 - protein, 5 aa, Entamoeba invadens
EHHGS

SEQ ID NO: 2850916 - protein, 12 aa, Entamoeba invadens
EHIDGNEKVETA

SEQ ID NO: 2850917 - protein, 9 aa, Entamoeba invadens
EHISGRRPL

SEQ ID NO: 2850918 - protein, 13 aa, Entamoeba invadens
EHISKSISSQSPL

SEQ ID NO: 2850919 - protein, 14 aa, Entamoeba invadens
EHISPEQKSEEDPH

SEQ ID NO: 2850920 - protein, 4 aa, Entamoeba invadens
EHKA

SEQ ID NO: 2850921 - protein, 4 aa, Entamoeba invadens
EHKD

SEQ ID NO: 2850922 - protein, 5 aa, Entamoeba invadens
EHKDE

SEQ ID NO: 2850923 - protein, 8 aa, Entamoeba invadens
EHKETIKS

SEQ ID NO: 2850924 - protein, 10 aa, Entamoeba invadens
EHKETQKDIN

SEQ ID NO: 2850925 - protein, 4 aa, Entamoeba invadens
EHKG

SEQ ID NO: 2850926 - protein, 13 aa, Entamoeba invadens
EHKKRNDLKSHQH

SEQ ID NO: 2850927 - protein, 7 aa, Entamoeba invadens
EHKNNHP

SEQ ID NO: 2850928 - protein, 12 aa, Entamoeba invadens
EHKNQEMDHNQK

SEQ ID NO: 2850929 - protein, 11 aa, Entamoeba invadens
EHKRSKSVNSN

SEQ ID NO: 2850930 - protein, 4 aa, Entamoeba invadens
EHKV

SEQ ID NO: 2850931 - protein, 6 aa, Entamoeba invadens
EHLGQA

SEQ ID NO: 2850932 - protein, 7 aa, Entamoeba invadens
EHLTGDN

SEQ ID NO: 2850933 - protein, 14 aa, Entamoeba invadens
EHNESDSNANKYST

SEQ ID NO: 2850934 - protein, 10 aa, Entamoeba invadens
EHNGDESNIG

SEQ ID NO: 2850935 - protein, 6 aa, Entamoeba invadens
EHNGST

SEQ ID NO: 2850936 - protein, 5 aa, Entamoeba invadens
EHNKN

SEQ ID NO: 2850937 - protein, 10 aa, Entamoeba invadens
EHNKTNAVKE

SEQ ID NO: 2850938 - protein, 24 aa, Entamoeba invadens
EHPEERRRTGRVEQLASENNRTKR

SEQ ID NO: 2850939 - protein, 5 aa, Entamoeba invadens
EHPEI

SEQ ID NO: 2850940 - protein, 15 aa, Entamoeba invadens
EHPGKKSKVTATSPR

SEQ ID NO: 2850941 - protein, 13 aa, Entamoeba invadens
EHPGWTPEDRNIP

SEQ ID NO: 2850942 - protein, 4 aa, Entamoeba invadens
EHPH

SEQ ID NO: 2850943 - protein, 5 aa, Entamoeba invadens
EHPKE

SEQ ID NO: 2850944 - protein, 10 aa, Entamoeba invadens
EHPKKPVQKG

SEQ ID NO: 2850945 - protein, 7 aa, Entamoeba invadens
EHPKNEF

SEQ ID NO: 2850946 - protein, 15 aa, Entamoeba invadens
EHPLENVPDKVWTKG

SEQ ID NO: 2850947 - protein, 12 aa, Entamoeba invadens
EHPLPEYPRPQL

SEQ ID NO: 2850948 - protein, 6 aa, Entamoeba invadens
EHPNTQ

SEQ ID NO: 2850949 - protein, 10 aa, Entamoeba invadens
EHPPFPPSVS

SEQ ID NO: 2850950 - protein, 5 aa, Entamoeba invadens
EHPPS

SEQ ID NO: 2850951 - protein, 9 aa, Entamoeba invadens
EHPRKKSKI

SEQ ID NO: 2850952 - protein, 4 aa, Entamoeba invadens
EHPS

SEQ ID NO: 2850953 - protein, 8 aa, Entamoeba invadens
EHPTISKG

SEQ ID NO: 2850954 - protein, 11 aa, Entamoeba invadens
EHPTTDNTEKD

SEQ ID NO: 2850955 - protein, 10 aa, Entamoeba invadens
EHPTTETSVA

SEQ ID NO: 2850956 - protein, 13 aa, Entamoeba invadens
EHPVGNLSSKNTQ

SEQ ID NO: 2850957 - protein, 7 aa, Entamoeba invadens
EHPWNAP

SEQ ID NO: 2850958 - protein, 6 aa, Entamoeba invadens
EHQDDV

SEQ ID NO: 2850959 - protein, 11 aa, Entamoeba invadens
EHQFNNPPVPQ

SEQ ID NO: 2850960 - protein, 15 aa, Entamoeba invadens
EHQNDDEKIKKLNDR

SEQ ID NO: 2850961 - protein, 9 aa, Entamoeba invadens
EHQPPQQPM

SEQ ID NO: 2850962 - protein, 5 aa, Entamoeba invadens
EHQQN

SEQ ID NO: 2850963 - protein, 11 aa, Entamoeba invadens
EHQQTSYPDVQ

SEQ ID NO: 2850964 - protein, 14 aa, Entamoeba invadens
EHQQTTPTTSTQTF

SEQ ID NO: 2850965 - protein, 4 aa, Entamoeba invadens
EHRE

SEQ ID NO: 2850966 - protein, 7 aa, Entamoeba invadens
EHREEQL

SEQ ID NO: 2850967 - protein, 4 aa, Entamoeba invadens
EHRS

SEQ ID NO: 2850968 - protein, 8 aa, Entamoeba invadens
EHRTKTYK

SEQ ID NO: 2850969 - protein, 8 aa, Entamoeba invadens
EHRTTPKV

SEQ ID NO: 2850970 - protein, 4 aa, Entamoeba invadens
EHSD

SEQ ID NO: 2850971 - protein, 6 aa, Entamoeba invadens
EHSDDY

SEQ ID NO: 2850972 - protein, 7 aa, Entamoeba invadens
EHSDELN

SEQ ID NO: 2850973 - protein, 7 aa, Entamoeba invadens
EHSDGSK

SEQ ID NO: 2850974 - protein, 15 aa, Entamoeba invadens
EHSETHKDTNTNKNI

SEQ ID NO: 2850975 - protein, 15 aa, Entamoeba invadens
EHSGTTENINKNQNI

SEQ ID NO: 2850976 - protein, 5 aa, Entamoeba invadens
EHSID

SEQ ID NO: 2850977 - protein, 9 aa, Entamoeba invadens
EHSIPNEKY

SEQ ID NO: 2850978 - protein, 7 aa, Entamoeba invadens
EHSKKVT

SEQ ID NO: 2850979 - protein, 8 aa, Entamoeba invadens
EHSKVDTT

SEQ ID NO: 2850980 - protein, 5 aa, Entamoeba invadens
EHSQK

SEQ ID NO: 2850981 - protein, 59 aa, Entamoeba invadens
EHSRGGEKRDDRDRDRDRDRRKRSRSPSRRERDRDDRRRRSRSDERRRRSRSREGKRGK

SEQ ID NO: 2850982 - protein, 6 aa, Entamoeba invadens
EHTDYN

SEQ ID NO: 2850983 - protein, 10 aa, Entamoeba invadens
EHTECTTGIP

SEQ ID NO: 2850984 - protein, 8 aa, Entamoeba invadens
EHTENNKV

SEQ ID NO: 2850985 - protein, 8 aa, Entamoeba invadens
EHTGKEIK

SEQ ID NO: 2850986 - protein, 4 aa, Entamoeba invadens
EHTN

SEQ ID NO: 2850987 - protein, 9 aa, Entamoeba invadens
EHTPEAYKD

SEQ ID NO: 2850988 - protein, 15 aa, Entamoeba invadens
EHTQTELENSTTQLP

SEQ ID NO: 2850989 - protein, 9 aa, Entamoeba invadens
EHTSHTKKT

SEQ ID NO: 2850990 - protein, 4 aa, Entamoeba invadens
EHTT

SEQ ID NO: 2850991 - protein, 5 aa, Entamoeba invadens
EHTVT

SEQ ID NO: 2850992 - protein, 6 aa, Entamoeba invadens
EHVEDK

SEQ ID NO: 2850993 - protein, 21 aa, Entamoeba invadens
EHVERENEDLKTKVKDTQELG

SEQ ID NO: 2850994 - protein, 5 aa, Entamoeba invadens
EHVQS

SEQ ID NO: 2850995 - protein, 6 aa, Entamoeba invadens
EHVTKN

SEQ ID NO: 2850996 - protein, 7 aa, Entamoeba invadens
EHYKKPA

SEQ ID NO: 2850997 - protein, 12 aa, Entamoeba invadens
EHYKKPADVYFL

SEQ ID NO: 2850998 - protein, 6 aa, Entamoeba invadens
EHYKKS

SEQ ID NO: 2850999 - protein, 5 aa, Entamoeba invadens
EHYKN

SEQ ID NO: 2851000 - protein, 5 aa, Entamoeba invadens
EHYKS

SEQ ID NO: 2851001 - protein, 14 aa, Entamoeba invadens
EIAAAKKGKTDLDG

SEQ ID NO: 2851002 - protein, 7 aa, Entamoeba invadens
EIADGSV

SEQ ID NO: 2851003 - protein, 6 aa, Entamoeba invadens
EIAEKA

SEQ ID NO: 2851004 - protein, 8 aa, Entamoeba invadens
EIAESTSE

SEQ ID NO: 2851005 - protein, 9 aa, Entamoeba invadens
EIAKDSARG

SEQ ID NO: 2851006 - protein, 60 aa, Entamoeba invadens
EIAKEEVKEVKATEKKVVEEVKKAKKEKIEKKPRKSTEKKTSKVDEEGKKNTLSKKAGLQ

SEQ ID NO: 2851007 - protein, 11 aa, Entamoeba invadens
EIAKEQKQQTE

SEQ ID NO: 2851008 - protein, 22 aa, Entamoeba invadens
EIAKKKKKEEDDWENSRQQRVT

SEQ ID NO: 2851009 - protein, 5 aa, Entamoeba invadens
EIANE

SEQ ID NO: 2851010 - protein, 8 aa, Entamoeba invadens
EIAPETGA

SEQ ID NO: 2851011 - protein, 6 aa, Entamoeba invadens
EIASAT

SEQ ID NO: 2851012 - protein, 31 aa, Entamoeba invadens
EIATSEIEKSTTNETKKSEKTPHKTTKINSE

SEQ ID NO: 2851013 - protein, 10 aa, Entamoeba invadens
EIDAKESPIE

SEQ ID NO: 2851014 - protein, 12 aa, Entamoeba invadens
EIDDKNSSLEIA

SEQ ID NO: 2851015 - protein, 10 aa, Entamoeba invadens
EIDDQRERRG

SEQ ID NO: 2851016 - protein, 15 aa, Entamoeba invadens
EIDDTTGSIPSEEEL

SEQ ID NO: 2851017 - protein, 4 aa, Entamoeba invadens
EIDE

SEQ ID NO: 2851018 - protein, 13 aa, Entamoeba invadens
EIDEDYAEESESG

SEQ ID NO: 2851019 - protein, 9 aa, Entamoeba invadens
EIDEERERL

SEQ ID NO: 2851020 - protein, 12 aa, Entamoeba invadens
EIDEESVDTPMT

SEQ ID NO: 2851021 - protein, 11 aa, Entamoeba invadens
EIDEGEGRIPR

SEQ ID NO: 2851022 - protein, 9 aa, Entamoeba invadens
EIDENGNTA

SEQ ID NO: 2851023 - protein, 4 aa, Entamoeba invadens
EIDG

SEQ ID NO: 2851024 - protein, 7 aa, Entamoeba invadens
EIDGEPV

SEQ ID NO: 2851025 - protein, 12 aa, Entamoeba invadens
EIDKDSLYIVPC

SEQ ID NO: 2851026 - protein, 63 aa, Entamoeba invadens
EIDKTVKEQTNSQTVNKTQTNQIQQTQKKQNEQLEQKDDVTPQRKSTNQMNGSYTTNVQNQEN

SEQ ID NO: 2851027 - protein, 7 aa, Entamoeba invadens
EIDNKQS

SEQ ID NO: 2851028 - protein, 8 aa, Entamoeba invadens
EIDNTKEV

SEQ ID NO: 2851029 - protein, 14 aa, Entamoeba invadens
EIDPAQAGLSFFDK

SEQ ID NO: 2851030 - protein, 9 aa, Entamoeba invadens
EIDPVSEKP

SEQ ID NO: 2851031 - protein, 13 aa, Entamoeba invadens
EIDQQIKKNNSRF

SEQ ID NO: 2851032 - protein, 9 aa, Entamoeba invadens
EIDSGAFSD

SEQ ID NO: 2851033 - protein, 5 aa, Entamoeba invadens
EIDST

SEQ ID NO: 2851034 - protein, 15 aa, Entamoeba invadens
EIDSTKNKQSQMEIK

SEQ ID NO: 2851035 - protein, 4 aa, Entamoeba invadens
EIDT

SEQ ID NO: 2851036 - protein, 10 aa, Entamoeba invadens
EIDTEERTKQ

SEQ ID NO: 2851037 - protein, 10 aa, Entamoeba invadens
EIDTENDFLG

SEQ ID NO: 2851038 - protein, 7 aa, Entamoeba invadens
EIDTTTV

SEQ ID NO: 2851039 - protein, 13 aa, Entamoeba invadens
EIEAKGLSYSPNG

SEQ ID NO: 2851040 - protein, 20 aa, Entamoeba invadens
EIEAKRAEKIEKTEKEEPHE

SEQ ID NO: 2851041 - protein, 11 aa, Entamoeba invadens
EIEDEEAETQA

SEQ ID NO: 2851042 - protein, 30 aa, Entamoeba invadens
EIEDIEEEGFKRTAQSKMDMKKKKNKLRNE

SEQ ID NO: 2851043 - protein, 8 aa, Entamoeba invadens
EIEDPQSQ

SEQ ID NO: 2851044 - protein, 8 aa, Entamoeba invadens
EIEDPTNY

SEQ ID NO: 2851045 - protein, 6 aa, Entamoeba invadens
EIEDST

SEQ ID NO: 2851046 - protein, 4 aa, Entamoeba invadens
EIEE

SEQ ID NO: 2851047 - protein, 9 aa, Entamoeba invadens
EIEEAERTR

SEQ ID NO: 2851048 - protein, 5 aa, Entamoeba invadens
EIEED

SEQ ID NO: 2851049 - protein, 10 aa, Entamoeba invadens
EIEEGNSCDT

SEQ ID NO: 2851050 - protein, 11 aa, Entamoeba invadens
EIEEKKSKGEV

SEQ ID NO: 2851051 - protein, 6 aa, Entamoeba invadens
EIEERD

SEQ ID NO: 2851052 - protein, 9 aa, Entamoeba invadens
EIEETRGDI

SEQ ID NO: 2851053 - protein, 11 aa, Entamoeba invadens
EIEETRSGKNE

SEQ ID NO: 2851054 - protein, 12 aa, Entamoeba invadens
EIEFPNDEQNIS

SEQ ID NO: 2851055 - protein, 7 aa, Entamoeba invadens
EIEKAKD

SEQ ID NO: 2851056 - protein, 7 aa, Entamoeba invadens
EIEKANE

SEQ ID NO: 2851057 - protein, 7 aa, Entamoeba invadens
EIEKDYG

SEQ ID NO: 2851058 - protein, 25 aa, Entamoeba invadens
EIEKEPPLIDEPEKLRRTSTLTSQI

SEQ ID NO: 2851059 - protein, 9 aa, Entamoeba invadens
EIEKGALDE

SEQ ID NO: 2851060 - protein, 12 aa, Entamoeba invadens
EIEKHKKQIEEL

SEQ ID NO: 2851061 - protein, 26 aa, Entamoeba invadens
EIEKNEKQQNENEKIENNERADGING

SEQ ID NO: 2851062 - protein, 9 aa, Entamoeba invadens
EIEKNGPQL

SEQ ID NO: 2851063 - protein, 23 aa, Entamoeba invadens
EIEKPEETAGGEQPKKRKRQKKK

SEQ ID NO: 2851064 - protein, 7 aa, Entamoeba invadens
EIEKPEW

SEQ ID NO: 2851065 - protein, 12 aa, Entamoeba invadens
EIEKQYNTIKDE

SEQ ID NO: 2851066 - protein, 15 aa, Entamoeba invadens
EIEKTKGNSVNDKVE

SEQ ID NO: 2851067 - protein, 7 aa, Entamoeba invadens
EIEKTNQ

SEQ ID NO: 2851068 - protein, 10 aa, Entamoeba invadens
EIEKTQTTEE

SEQ ID NO: 2851069 - protein, 5 aa, Entamoeba invadens
EIENS

SEQ ID NO: 2851070 - protein, 7 aa, Entamoeba invadens
EIENSGD

SEQ ID NO: 2851071 - protein, 15 aa, Entamoeba invadens
EIENTNEQKKLRQKE

SEQ ID NO: 2851072 - protein, 95 aa, Entamoeba invadens
EIEPEPQEKPVQLPPLTEPEDIKEQPSIPQSDKMEEEPPKEKLQEPEKNENVTMAPQEKENIEERKNEEKTENLENQIPNKENEIEKAEKIGIEK

SEQ ID NO: 2851073 - protein, 11 aa, Entamoeba invadens
EIEPNRDNTNI

SEQ ID NO: 2851074 - protein, 6 aa, Entamoeba invadens
EIEPPQ

SEQ ID NO: 2851075 - protein, 93 aa, Entamoeba invadens
EIEPVSSDALKQKEEEDAKKKQEEQTNTENTNVEGDKQEKNSNKKDDPKNRFKSDPRRDRVGGKNFKQHSKTEVKKAPRRDRDDKKKKAPYSK

SEQ ID NO: 2851076 - protein, 4 aa, Entamoeba invadens
EIEQ

SEQ ID NO: 2851077 - protein, 7 aa, Entamoeba invadens
EIEQPGY

SEQ ID NO: 2851078 - protein, 11 aa, Entamoeba invadens
EIEQRKSDNTF

SEQ ID NO: 2851079 - protein, 7 aa, Entamoeba invadens
EIERGTQ

SEQ ID NO: 2851080 - protein, 5 aa, Entamoeba invadens
EIERP

SEQ ID NO: 2851081 - protein, 7 aa, Entamoeba invadens
EIERRGE

SEQ ID NO: 2851082 - protein, 5 aa, Entamoeba invadens
EIESG

SEQ ID NO: 2851083 - protein, 15 aa, Entamoeba invadens
EIESTPRKLNSEGSV

SEQ ID NO: 2851084 - protein, 11 aa, Entamoeba invadens
EIETNPHQSTF

SEQ ID NO: 2851085 - protein, 6 aa, Entamoeba invadens
EIETPD

SEQ ID NO: 2851086 - protein, 31 aa, Entamoeba invadens
EIETQKSEESIDNLNEENDNNTTHDEDTDED

SEQ ID NO: 2851087 - protein, 30 aa, Entamoeba invadens
EIETQKSEGSNDNLNEENDNNTTHDEYTDE

SEQ ID NO: 2851088 - protein, 31 aa, Entamoeba invadens
EIETQKSEGSNDNLNEGNENNTTHDEDTDED

SEQ ID NO: 2851089 - protein, 7 aa, Entamoeba invadens
EIETTQI

SEQ ID NO: 2851090 - protein, 7 aa, Entamoeba invadens
EIEYNNE

SEQ ID NO: 2851091 - protein, 5 aa, Entamoeba invadens
EIGAS

SEQ ID NO: 2851092 - protein, 4 aa, Entamoeba invadens
EIGE

SEQ ID NO: 2851093 - protein, 21 aa, Entamoeba invadens
EIGESGSVGEPGEDEARENEI

SEQ ID NO: 2851094 - protein, 7 aa, Entamoeba invadens
EIGGNYS

SEQ ID NO: 2851095 - protein, 26 aa, Entamoeba invadens
EIGNDANISPRSTPQQTLPSAQPQNV

SEQ ID NO: 2851096 - protein, 11 aa, Entamoeba invadens
EIGNTQNCGRE

SEQ ID NO: 2851097 - protein, 4 aa, Entamoeba invadens
EIGP

SEQ ID NO: 2851098 - protein, 64 aa, Entamoeba invadens
EIGPISPKEPVEGSDVPPPVPPLSPRRTAHSEKPTGSAPLPPKKPAPKPGLKKNHSALQINPPI

SEQ ID NO: 2851099 - protein, 7 aa, Entamoeba invadens
EIGPQTI

SEQ ID NO: 2851100 - protein, 10 aa, Entamoeba invadens
EIGQQKSPMH

SEQ ID NO: 2851101 - protein, 9 aa, Entamoeba invadens
EIGSDMSNE

SEQ ID NO: 2851102 - protein, 6 aa, Entamoeba invadens
EIGSGV

SEQ ID NO: 2851103 - protein, 6 aa, Entamoeba invadens
EIGTAT

SEQ ID NO: 2851104 - protein, 5 aa, Entamoeba invadens
EIGTY

SEQ ID NO: 2851105 - protein, 4 aa, Entamoeba invadens
EIGV

SEQ ID NO: 2851106 - protein, 11 aa, Entamoeba invadens
EIHGKVSGTTL

SEQ ID NO: 2851107 - protein, 7 aa, Entamoeba invadens
EIIEPEY

SEQ ID NO: 2851108 - protein, 5 aa, Entamoeba invadens
EIIES

SEQ ID NO: 2851109 - protein, 5 aa, Entamoeba invadens
EIIET

SEQ ID NO: 2851110 - protein, 19 aa, Entamoeba invadens
EIITSSGDTLLGADDKSGV

SEQ ID NO: 2851111 - protein, 48 aa, Entamoeba invadens
EIKEGETPALSQDTLKSQKDEKLNTTAKPESIVPETKESKLEKVAEKP

SEQ ID NO: 2851112 - protein, 21 aa, Entamoeba invadens
EIKEKKPTKRRRGMAPIDDQE

SEQ ID NO: 2851113 - protein, 18 aa, Entamoeba invadens
EIKEKNKPKWNGNDNEEY

SEQ ID NO: 2851114 - protein, 6 aa, Entamoeba invadens
EIKELS

SEQ ID NO: 2851115 - protein, 5 aa, Entamoeba invadens
EIKEP

SEQ ID NO: 2851116 - protein, 10 aa, Entamoeba invadens
EIKERKSGMI

SEQ ID NO: 2851117 - protein, 11 aa, Entamoeba invadens
EIKESGKSNMV

SEQ ID NO: 2851118 - protein, 7 aa, Entamoeba invadens
EIKGNAF

SEQ ID NO: 2851119 - protein, 4 aa, Entamoeba invadens
EIKK

SEQ ID NO: 2851120 - protein, 14 aa, Entamoeba invadens
EIKKEKLKAESSEY

SEQ ID NO: 2851121 - protein, 20 aa, Entamoeba invadens
EIKNASVTSMGSEISDEDLE

SEQ ID NO: 2851122 - protein, 5 aa, Entamoeba invadens
EIKND

SEQ ID NO: 2851123 - protein, 11 aa, Entamoeba invadens
EIKNDDDEFEK

SEQ ID NO: 2851124 - protein, 10 aa, Entamoeba invadens
EIKNKRISAK

SEQ ID NO: 2851125 - protein, 10 aa, Entamoeba invadens
EIKNSSFENM

SEQ ID NO: 2851126 - protein, 6 aa, Entamoeba invadens
EIKPEN

SEQ ID NO: 2851127 - protein, 17 aa, Entamoeba invadens
EIKPESDTPHKSIDPSH

SEQ ID NO: 2851128 - protein, 37 aa, Entamoeba invadens
EIKPKIEEQKKEITSNAKMNSDKEVLNKEEDVAIKKN

SEQ ID NO: 2851129 - protein, 8 aa, Entamoeba invadens
EIKPNGVP

SEQ ID NO: 2851130 - protein, 7 aa, Entamoeba invadens
EIKPSDL

SEQ ID NO: 2851131 - protein, 19 aa, Entamoeba invadens
EIKPSSKIDEEINKTISQA

SEQ ID NO: 2851132 - protein, 4 aa, Entamoeba invadens
EIKQ

SEQ ID NO: 2851133 - protein, 13 aa, Entamoeba invadens
EIKRESKSFEGVQ

SEQ ID NO: 2851134 - protein, 16 aa, Entamoeba invadens
EIKSEDNNSVDYSESH

SEQ ID NO: 2851135 - protein, 22 aa, Entamoeba invadens
EIKSEEKRVTGAGFKKKSGGFG

SEQ ID NO: 2851136 - protein, 11 aa, Entamoeba invadens
EIKSKGTQGRL

SEQ ID NO: 2851137 - protein, 21 aa, Entamoeba invadens
EIKSPEPQNLGATEENEKLRN

SEQ ID NO: 2851138 - protein, 23 aa, Entamoeba invadens
EIKSQTVDATYVPAQKAKVETLN

SEQ ID NO: 2851139 - protein, 10 aa, Entamoeba invadens
EIKTEKKLGE

SEQ ID NO: 2851140 - protein, 12 aa, Entamoeba invadens
EIKTEKKLGEGS

SEQ ID NO: 2851141 - protein, 21 aa, Entamoeba invadens
EIKTESESKNKADLKSKEKVS

SEQ ID NO: 2851142 - protein, 13 aa, Entamoeba invadens
EIKTETKKQDKVK

SEQ ID NO: 2851143 - protein, 12 aa, Entamoeba invadens
EIKTNEKITQKI

SEQ ID NO: 2851144 - protein, 9 aa, Entamoeba invadens
EIKTNETQI

SEQ ID NO: 2851145 - protein, 9 aa, Entamoeba invadens
EIKTPKEVI

SEQ ID NO: 2851146 - protein, 32 aa, Entamoeba invadens
EIKTPQIHDGKTTAMISPQGTPTTKSESEVKE

SEQ ID NO: 2851147 - protein, 5 aa, Entamoeba invadens
EILNT

SEQ ID NO: 2851148 - protein, 6 aa, Entamoeba invadens
EILPSG

SEQ ID NO: 2851149 - protein, 5 aa, Entamoeba invadens
EIMDP

SEQ ID NO: 2851150 - protein, 6 aa, Entamoeba invadens
EINDET

SEQ ID NO: 2851151 - protein, 13 aa, Entamoeba invadens
EINDKSEIETGAK

SEQ ID NO: 2851152 - protein, 12 aa, Entamoeba invadens
EINDNGERMEEA

SEQ ID NO: 2851153 - protein, 10 aa, Entamoeba invadens
EINDQQKQEV

SEQ ID NO: 2851154 - protein, 10 aa, Entamoeba invadens
EINEDRDTMP

SEQ ID NO: 2851155 - protein, 8 aa, Entamoeba invadens
EINEETDK

SEQ ID NO: 2851156 - protein, 16 aa, Entamoeba invadens
EINENRKKISQQQKTR

SEQ ID NO: 2851157 - protein, 11 aa, Entamoeba invadens
EINFGDEERVD

SEQ ID NO: 2851158 - protein, 28 aa, Entamoeba invadens
EINGFGDKRRSVDLSGSTPQQETDNPLT

SEQ ID NO: 2851159 - protein, 11 aa, Entamoeba invadens
EINKQKEYLKK

SEQ ID NO: 2851160 - protein, 9 aa, Entamoeba invadens
EINNDGRSA

SEQ ID NO: 2851161 - protein, 5 aa, Entamoeba invadens
EINNG

SEQ ID NO: 2851162 - protein, 25 aa, Entamoeba invadens
EINNKNSSLETATDVKKKTESVTLT

SEQ ID NO: 2851163 - protein, 20 aa, Entamoeba invadens
EINNQRDIKREKWSGKQMLL

SEQ ID NO: 2851164 - protein, 4 aa, Entamoeba invadens
EINP

SEQ ID NO: 2851165 - protein, 7 aa, Entamoeba invadens
EINPDPI

SEQ ID NO: 2851166 - protein, 10 aa, Entamoeba invadens
EINRKLSEDG

SEQ ID NO: 2851167 - protein, 9 aa, Entamoeba invadens
EINRNGDVD

SEQ ID NO: 2851168 - protein, 6 aa, Entamoeba invadens
EINRRG

SEQ ID NO: 2851169 - protein, 6 aa, Entamoeba invadens
EINSDR

SEQ ID NO: 2851170 - protein, 22 aa, Entamoeba invadens
EINSNEKYSRLNELSRDSDEFK

SEQ ID NO: 2851171 - protein, 22 aa, Entamoeba invadens
EINSSKDPNVDQTAFGEFTFKR

SEQ ID NO: 2851172 - protein, 9 aa, Entamoeba invadens
EINTKNRQI

SEQ ID NO: 2851173 - protein, 9 aa, Entamoeba invadens
EINTTTRFN

SEQ ID NO: 2851174 - protein, 4 aa, Entamoeba invadens
EIPA

SEQ ID NO: 2851175 - protein, 6 aa, Entamoeba invadens
EIPAGT

SEQ ID NO: 2851176 - protein, 6 aa, Entamoeba invadens
EIPAVG

SEQ ID NO: 2851177 - protein, 4 aa, Entamoeba invadens
EIPD

SEQ ID NO: 2851178 - protein, 5 aa, Entamoeba invadens
EIPDG

SEQ ID NO: 2851179 - protein, 6 aa, Entamoeba invadens
EIPEPN

SEQ ID NO: 2851180 - protein, 24 aa, Entamoeba invadens
EIPETPKITEKIETTENDEKGEKA

SEQ ID NO: 2851181 - protein, 5 aa, Entamoeba invadens
EIPGS

SEQ ID NO: 2851182 - protein, 6 aa, Entamoeba invadens
EIPKDE

SEQ ID NO: 2851183 - protein, 7 aa, Entamoeba invadens
EIPKDES

SEQ ID NO: 2851184 - protein, 15 aa, Entamoeba invadens
EIPKEHSDAPQQLQQ

SEQ ID NO: 2851185 - protein, 9 aa, Entamoeba invadens
EIPKEQNRN

SEQ ID NO: 2851186 - protein, 9 aa, Entamoeba invadens
EIPKGVTKL

SEQ ID NO: 2851187 - protein, 7 aa, Entamoeba invadens
EIPKIPD

SEQ ID NO: 2851188 - protein, 8 aa, Entamoeba invadens
EIPKIPDN

SEQ ID NO: 2851189 - protein, 8 aa, Entamoeba invadens
EIPNNNKK

SEQ ID NO: 2851190 - protein, 8 aa, Entamoeba invadens
EIPNSMPS

SEQ ID NO: 2851191 - protein, 7 aa, Entamoeba invadens
EIPNSTT

SEQ ID NO: 2851192 - protein, 6 aa, Entamoeba invadens
EIPNSV

SEQ ID NO: 2851193 - protein, 5 aa, Entamoeba invadens
EIPNY

SEQ ID NO: 2851194 - protein, 7 aa, Entamoeba invadens
EIPPDDL

SEQ ID NO: 2851195 - protein, 7 aa, Entamoeba invadens
EIPPDEM

SEQ ID NO: 2851196 - protein, 16 aa, Entamoeba invadens
EIPPFGKTTYAHNNQR

SEQ ID NO: 2851197 - protein, 6 aa, Entamoeba invadens
EIPPGT

SEQ ID NO: 2851198 - protein, 7 aa, Entamoeba invadens
EIPPIPN

SEQ ID NO: 2851199 - protein, 8 aa, Entamoeba invadens
EIPPKTPP

SEQ ID NO: 2851200 - protein, 10 aa, Entamoeba invadens
EIPQNKQYPF

SEQ ID NO: 2851201 - protein, 6 aa, Entamoeba invadens
EIPQSY

SEQ ID NO: 2851202 - protein, 17 aa, Entamoeba invadens
EIPQVEEQKSVDEIQPP

SEQ ID NO: 2851203 - protein, 4 aa, Entamoeba invadens
EIPR

SEQ ID NO: 2851204 - protein, 22 aa, Entamoeba invadens
EIPSEPKNENCGLPPTTSPKIM

SEQ ID NO: 2851205 - protein, 7 aa, Entamoeba invadens
EIPSPIP

SEQ ID NO: 2851206 - protein, 7 aa, Entamoeba invadens
EIPSSVT

SEQ ID NO: 2851207 - protein, 6 aa, Entamoeba invadens
EIPTNL

SEQ ID NO: 2851208 - protein, 6 aa, Entamoeba invadens
EIPTNR

SEQ ID NO: 2851209 - protein, 5 aa, Entamoeba invadens
EIPTS

SEQ ID NO: 2851210 - protein, 6 aa, Entamoeba invadens
EIPTSY

SEQ ID NO: 2851211 - protein, 10 aa, Entamoeba invadens
EIPYKTPSKH

SEQ ID NO: 2851212 - protein, 4 aa, Entamoeba invadens
EIQD

SEQ ID NO: 2851213 - protein, 4 aa, Entamoeba invadens
EIQE

SEQ ID NO: 2851214 - protein, 21 aa, Entamoeba invadens
EIQEGGTKEVASRKMKKERIP

SEQ ID NO: 2851215 - protein, 6 aa, Entamoeba invadens
EIQEMG

SEQ ID NO: 2851216 - protein, 11 aa, Entamoeba invadens
EIQGEKLPKTT

SEQ ID NO: 2851217 - protein, 16 aa, Entamoeba invadens
EIQKEEEVKKEELQEE

SEQ ID NO: 2851218 - protein, 12 aa, Entamoeba invadens
EIQKKPKEETKE

SEQ ID NO: 2851219 - protein, 11 aa, Entamoeba invadens
EIQKKPKEKIK

SEQ ID NO: 2851220 - protein, 12 aa, Entamoeba invadens
EIQKNERSAERK

SEQ ID NO: 2851221 - protein, 13 aa, Entamoeba invadens
EIQKQGRKLQQRF

SEQ ID NO: 2851222 - protein, 6 aa, Entamoeba invadens
EIQKSH

SEQ ID NO: 2851223 - protein, 4 aa, Entamoeba invadens
EIQN

SEQ ID NO: 2851224 - protein, 9 aa, Entamoeba invadens
EIQNGKEGW

SEQ ID NO: 2851225 - protein, 7 aa, Entamoeba invadens
EIQPPTI

SEQ ID NO: 2851226 - protein, 17 aa, Entamoeba invadens
EIQQDPPCNCSAGPVGD

SEQ ID NO: 2851227 - protein, 5 aa, Entamoeba invadens
EIQQQ

SEQ ID NO: 2851228 - protein, 5 aa, Entamoeba invadens
EIQRE

SEQ ID NO: 2851229 - protein, 5 aa, Entamoeba invadens
EIQSR

SEQ ID NO: 2851230 - protein, 8 aa, Entamoeba invadens
EIQTRTEK

SEQ ID NO: 2851231 - protein, 5 aa, Entamoeba invadens
EIQTS

SEQ ID NO: 2851232 - protein, 6 aa, Entamoeba invadens
EIREPN

SEQ ID NO: 2851233 - protein, 10 aa, Entamoeba invadens
EIRETPNKRH

SEQ ID NO: 2851234 - protein, 14 aa, Entamoeba invadens
EIRKNEPYSSKSDL

SEQ ID NO: 2851235 - protein, 10 aa, Entamoeba invadens
EIRNENSHNE

SEQ ID NO: 2851236 - protein, 5 aa, Entamoeba invadens
EIRPG

SEQ ID NO: 2851237 - protein, 15 aa, Entamoeba invadens
EIRPNGTLSAHPFCQ

SEQ ID NO: 2851238 - protein, 7 aa, Entamoeba invadens
EIRPNKK

SEQ ID NO: 2851239 - protein, 4 aa, Entamoeba invadens
EIRR

SEQ ID NO: 2851240 - protein, 8 aa, Entamoeba invadens
EIRSTQKM

SEQ ID NO: 2851241 - protein, 12 aa, Entamoeba invadens
EIRTKGKEINKK

SEQ ID NO: 2851242 - protein, 8 aa, Entamoeba invadens
EIRTSSLT

SEQ ID NO: 2851243 - protein, 7 aa, Entamoeba invadens
EIRTTES

SEQ ID NO: 2851244 - protein, 8 aa, Entamoeba invadens
EIRVNTNK

SEQ ID NO: 2851245 - protein, 8 aa, Entamoeba invadens
EISATVES

SEQ ID NO: 2851246 - protein, 6 aa, Entamoeba invadens
EISDNT

SEQ ID NO: 2851247 - protein, 4 aa, Entamoeba invadens
EISE

SEQ ID NO: 2851248 - protein, 17 aa, Entamoeba invadens
EISEEISKREKLESENL

SEQ ID NO: 2851249 - protein, 5 aa, Entamoeba invadens
EISEG

SEQ ID NO: 2851250 - protein, 10 aa, Entamoeba invadens
EISKADSPVT

SEQ ID NO: 2851251 - protein, 14 aa, Entamoeba invadens
EISKDPLPPADESR

SEQ ID NO: 2851252 - protein, 6 aa, Entamoeba invadens
EISKKD

SEQ ID NO: 2851253 - protein, 8 aa, Entamoeba invadens
EISKNTKI

SEQ ID NO: 2851254 - protein, 7 aa, Entamoeba invadens
EISKTGN

SEQ ID NO: 2851255 - protein, 8 aa, Entamoeba invadens
EISPDAQD

SEQ ID NO: 2851256 - protein, 20 aa, Entamoeba invadens
EISPPSSITPQRQQSFRTNQ

SEQ ID NO: 2851257 - protein, 7 aa, Entamoeba invadens
EISPPWV

SEQ ID NO: 2851258 - protein, 14 aa, Entamoeba invadens
EISQSSGDSIAKQA

SEQ ID NO: 2851259 - protein, 9 aa, Entamoeba invadens
EISQSSYEF

SEQ ID NO: 2851260 - protein, 4 aa, Entamoeba invadens
EISR

SEQ ID NO: 2851261 - protein, 7 aa, Entamoeba invadens
EISRERS

SEQ ID NO: 2851262 - protein, 10 aa, Entamoeba invadens
EISSDEDIEK

SEQ ID NO: 2851263 - protein, 11 aa, Entamoeba invadens
EISSDKSTMTQ

SEQ ID NO: 2851264 - protein, 17 aa, Entamoeba invadens
EISSDSEENPKYSKKEL

SEQ ID NO: 2851265 - protein, 6 aa, Entamoeba invadens
EISSSG

SEQ ID NO: 2851266 - protein, 11 aa, Entamoeba invadens
EISSSNQETQQ

SEQ ID NO: 2851267 - protein, 15 aa, Entamoeba invadens
EISSSPELDFYVPKL

SEQ ID NO: 2851268 - protein, 9 aa, Entamoeba invadens
EISTSNEKV

SEQ ID NO: 2851269 - protein, 21 aa, Entamoeba invadens
EISTSSNTLTLTRGNDRSRSI

SEQ ID NO: 2851270 - protein, 13 aa, Entamoeba invadens
EITAEPKDDNVAD

SEQ ID NO: 2851271 - protein, 19 aa, Entamoeba invadens
EITAETQRTCPGRNVSPTP

SEQ ID NO: 2851272 - protein, 9 aa, Entamoeba invadens
EITDKDVEE

SEQ ID NO: 2851273 - protein, 4 aa, Entamoeba invadens
EITE

SEQ ID NO: 2851274 - protein, 6 aa, Entamoeba invadens
EITEAA

SEQ ID NO: 2851275 - protein, 15 aa, Entamoeba invadens
EITEEQEPKDSQPIP

SEQ ID NO: 2851276 - protein, 27 aa, Entamoeba invadens
EITEKNVKEKHSELKKTETDKQTEKIT

SEQ ID NO: 2851277 - protein, 22 aa, Entamoeba invadens
EITEYPTPYNTHDMQNNSDTTA

SEQ ID NO: 2851278 - protein, 14 aa, Entamoeba invadens
EITGEIGKRPENVP

SEQ ID NO: 2851279 - protein, 7 aa, Entamoeba invadens
EITGGVN

SEQ ID NO: 2851280 - protein, 12 aa, Entamoeba invadens
EITIGRKGRDNI

SEQ ID NO: 2851281 - protein, 10 aa, Entamoeba invadens
EITKEEEQMN

SEQ ID NO: 2851282 - protein, 6 aa, Entamoeba invadens
EITKET

SEQ ID NO: 2851283 - protein, 5 aa, Entamoeba invadens
EITKI

SEQ ID NO: 2851284 - protein, 6 aa, Entamoeba invadens
EITKKT

SEQ ID NO: 2851285 - protein, 5 aa, Entamoeba invadens
EITNN

SEQ ID NO: 2851286 - protein, 30 aa, Entamoeba invadens
EITPAKEKLKRDAESLTNLRTKKAQADAIE

SEQ ID NO: 2851287 - protein, 13 aa, Entamoeba invadens
EITPEPFKSSFDE

SEQ ID NO: 2851288 - protein, 52 aa, Entamoeba invadens
EITPETNSDDQSFSSKNSKTDKNSLENAEHSDTEKKGEKDDNKDDTKDDTLI

SEQ ID NO: 2851289 - protein, 5 aa, Entamoeba invadens
EITQE

SEQ ID NO: 2851290 - protein, 15 aa, Entamoeba invadens
EITQITNEKNELNIK

SEQ ID NO: 2851291 - protein, 10 aa, Entamoeba invadens
EITRAKSKLK

SEQ ID NO: 2851292 - protein, 12 aa, Entamoeba invadens
EITRESKRLERE

SEQ ID NO: 2851293 - protein, 15 aa, Entamoeba invadens
EITRIDERQIKVSHT

SEQ ID NO: 2851294 - protein, 7 aa, Entamoeba invadens
EITSDTT

SEQ ID NO: 2851295 - protein, 11 aa, Entamoeba invadens
EITSEKHETKM

SEQ ID NO: 2851296 - protein, 6 aa, Entamoeba invadens
EITSEN

SEQ ID NO: 2851297 - protein, 16 aa, Entamoeba invadens
EITSENVLKGNEELQE

SEQ ID NO: 2851298 - protein, 12 aa, Entamoeba invadens
EITSKTLENQNE

SEQ ID NO: 2851299 - protein, 22 aa, Entamoeba invadens
EITSQINSSPSLQSTSTDITNG

SEQ ID NO: 2851300 - protein, 22 aa, Entamoeba invadens
EITSQINSSPSLQSTSTTITNG

SEQ ID NO: 2851301 - protein, 7 aa, Entamoeba invadens
EITTEHT

SEQ ID NO: 2851302 - protein, 6 aa, Entamoeba invadens
EIVDTQ

SEQ ID NO: 2851303 - protein, 7 aa, Entamoeba invadens
EIYATTK

SEQ ID NO: 2851304 - protein, 4 aa, Entamoeba invadens
EIYT

SEQ ID NO: 2851305 - protein, 5 aa, Entamoeba invadens
EIYTP

SEQ ID NO: 2851306 - protein, 8 aa, Entamoeba invadens
EKAANEDG

SEQ ID NO: 2851307 - protein, 19 aa, Entamoeba invadens
EKAAQRKEEKKTKPIQKQD

SEQ ID NO: 2851308 - protein, 9 aa, Entamoeba invadens
EKADEINEK

SEQ ID NO: 2851309 - protein, 23 aa, Entamoeba invadens
EKADEKKEEKAEEKTEKVQTTKN

SEQ ID NO: 2851310 - protein, 6 aa, Entamoeba invadens
EKADEL

SEQ ID NO: 2851311 - protein, 8 aa, Entamoeba invadens
EKADPYTQ

SEQ ID NO: 2851312 - protein, 20 aa, Entamoeba invadens
EKAEDTPPNGNTPANPDNTF

SEQ ID NO: 2851313 - protein, 8 aa, Entamoeba invadens
EKAEEAKV

SEQ ID NO: 2851314 - protein, 28 aa, Entamoeba invadens
EKAEEKSEDKISEASQEEEENLTQRKDS

SEQ ID NO: 2851315 - protein, 24 aa, Entamoeba invadens
EKAEKALQDEEKAAQKKKEKEEQA

SEQ ID NO: 2851316 - protein, 35 aa, Entamoeba invadens
EKAEKERLEKEKKERELAAKKAQEEKERKEKLEKE

SEQ ID NO: 2851317 - protein, 24 aa, Entamoeba invadens
EKAEKNKAKLEKKKKKEESKADKV

SEQ ID NO: 2851318 - protein, 58 aa, Entamoeba invadens
EKAEMQKTGEKSKEEKPQESAEKMDIEEQNPSSSEESENSEDSKEMSEQEDEEMVTNI

SEQ ID NO: 2851319 - protein, 6 aa, Entamoeba invadens
EKAENG

SEQ ID NO: 2851320 - protein, 8 aa, Entamoeba invadens
EKAEPEIY

SEQ ID NO: 2851321 - protein, 21 aa, Entamoeba invadens
EKAEPKEPTEKPKKEVAPPED

SEQ ID NO: 2851322 - protein, 7 aa, Entamoeba invadens
EKAERTT

SEQ ID NO: 2851323 - protein, 9 aa, Entamoeba invadens
EKAESDENT

SEQ ID NO: 2851324 - protein, 8 aa, Entamoeba invadens
EKAETQDY

SEQ ID NO: 2851325 - protein, 9 aa, Entamoeba invadens
EKAEVEEKR

SEQ ID NO: 2851326 - protein, 9 aa, Entamoeba invadens
EKAFDDKEM

SEQ ID NO: 2851327 - protein, 4 aa, Entamoeba invadens
EKAG

SEQ ID NO: 2851328 - protein, 4 aa, Entamoeba invadens
EKAI

SEQ ID NO: 2851329 - protein, 7 aa, Entamoeba invadens
EKAIDPS

SEQ ID NO: 2851330 - protein, 15 aa, Entamoeba invadens
EKAIKQKRAMIEDFD

SEQ ID NO: 2851331 - protein, 16 aa, Entamoeba invadens
EKAKDLDAEEGKENFS

SEQ ID NO: 2851332 - protein, 29 aa, Entamoeba invadens
EKAKEEEKKKKEKNFEKFEKDKKEENDID

SEQ ID NO: 2851333 - protein, 31 aa, Entamoeba invadens
EKAKESGDKEEIKKQMKRTARMTKEQSDDVK

SEQ ID NO: 2851334 - protein, 14 aa, Entamoeba invadens
EKAKGKMEEEPTNV

SEQ ID NO: 2851335 - protein, 19 aa, Entamoeba invadens
EKAKKNEIAKKEQVETMEK

SEQ ID NO: 2851336 - protein, 8 aa, Entamoeba invadens
EKAKKNNM

SEQ ID NO: 2851337 - protein, 9 aa, Entamoeba invadens
EKAKNTDNT

SEQ ID NO: 2851338 - protein, 73 aa, Entamoeba invadens
EKAKPTFPDPEPETDLYPSHGVEDAAPSLSAYSSSCTATDYNKYTSSNYNKYTSSSYRNYYDDEKTKDGTKGV

SEQ ID NO: 2851339 - protein, 11 aa, Entamoeba invadens
EKAKQDEKDRF

SEQ ID NO: 2851340 - protein, 9 aa, Entamoeba invadens
EKAKTHEEP

SEQ ID NO: 2851341 - protein, 8 aa, Entamoeba invadens
EKAKTLTA

SEQ ID NO: 2851342 - protein, 10 aa, Entamoeba invadens
EKAKTRVAKS

SEQ ID NO: 2851343 - protein, 9 aa, Entamoeba invadens
EKAKTSENT

SEQ ID NO: 2851344 - protein, 27 aa, Entamoeba invadens
EKAKTSYDKLKEEKKIEQEEDSKRLEK

SEQ ID NO: 2851345 - protein, 9 aa, Entamoeba invadens
EKALGEGTP

SEQ ID NO: 2851346 - protein, 5 aa, Entamoeba invadens
EKAME

SEQ ID NO: 2851347 - protein, 14 aa, Entamoeba invadens
EKANAKLTDFGSAR

SEQ ID NO: 2851348 - protein, 16 aa, Entamoeba invadens
EKANRASIDNIINELA

SEQ ID NO: 2851349 - protein, 17 aa, Entamoeba invadens
EKANSADAARKASEGKL

SEQ ID NO: 2851350 - protein, 8 aa, Entamoeba invadens
EKAPEEYK

SEQ ID NO: 2851351 - protein, 24 aa, Entamoeba invadens
EKAPTFNETVQDEVKEEKSRLDPD

SEQ ID NO: 2851352 - protein, 13 aa, Entamoeba invadens
EKAQHSNENPEIA

SEQ ID NO: 2851353 - protein, 14 aa, Entamoeba invadens
EKAQRERADFEQKA

SEQ ID NO: 2851354 - protein, 19 aa, Entamoeba invadens
EKARDEEEARRLQEEEEFG

SEQ ID NO: 2851355 - protein, 16 aa, Entamoeba invadens
EKARRYGGVDDDYKKL

SEQ ID NO: 2851356 - protein, 6 aa, Entamoeba invadens
EKARSV

SEQ ID NO: 2851357 - protein, 7 aa, Entamoeba invadens
EKARWDQ

SEQ ID NO: 2851358 - protein, 13 aa, Entamoeba invadens
EKASESVNEELTP

SEQ ID NO: 2851359 - protein, 24 aa, Entamoeba invadens
EKASIFQKEENSTFVGSTDNKYYQ

SEQ ID NO: 2851360 - protein, 4 aa, Entamoeba invadens
EKAT

SEQ ID NO: 2851361 - protein, 41 aa, Entamoeba invadens
EKATETKKTLQTNEKKAKSEKVKKLEAEKLKNEQKKAQLLK

SEQ ID NO: 2851362 - protein, 35 aa, Entamoeba invadens
EKATHSQKPAPKQEKKPDEKPQRPAGCDGKGGCGC

SEQ ID NO: 2851363 - protein, 7 aa, Entamoeba invadens
EKATRNA

SEQ ID NO: 2851364 - protein, 8 aa, Entamoeba invadens
EKATWSTT

SEQ ID NO: 2851365 - protein, 4 aa, Entamoeba invadens
EKAV

SEQ ID NO: 2851366 - protein, 11 aa, Entamoeba invadens
EKAVGGLPERD

SEQ ID NO: 2851367 - protein, 22 aa, Entamoeba invadens
EKAVREEKEKVDKRKELEEKRR

SEQ ID NO: 2851368 - protein, 7 aa, Entamoeba invadens
EKCDKYK

SEQ ID NO: 2851369 - protein, 4 aa, Entamoeba invadens
EKCE

SEQ ID NO: 2851370 - protein, 8 aa, Entamoeba invadens
EKCKSNEI

SEQ ID NO: 2851371 - protein, 7 aa, Entamoeba invadens
EKCKTET

SEQ ID NO: 2851372 - protein, 9 aa, Entamoeba invadens
EKCLGSENS

SEQ ID NO: 2851373 - protein, 9 aa, Entamoeba invadens
EKCNAKNVE

SEQ ID NO: 2851374 - protein, 6 aa, Entamoeba invadens
EKCNSI

SEQ ID NO: 2851375 - protein, 8 aa, Entamoeba invadens
EKCPDTIN

SEQ ID NO: 2851376 - protein, 10 aa, Entamoeba invadens
EKCPSQDPTF

SEQ ID NO: 2851377 - protein, 10 aa, Entamoeba invadens
EKCQQAAQEK

SEQ ID NO: 2851378 - protein, 4 aa, Entamoeba invadens
EKCR

SEQ ID NO: 2851379 - protein, 7 aa, Entamoeba invadens
EKCSNCE

SEQ ID NO: 2851380 - protein, 7 aa, Entamoeba invadens
EKCSPNI

SEQ ID NO: 2851381 - protein, 7 aa, Entamoeba invadens
EKCTKEM

SEQ ID NO: 2851382 - protein, 14 aa, Entamoeba invadens
EKCTTCSSTDISPH

SEQ ID NO: 2851383 - protein, 16 aa, Entamoeba invadens
EKDAFDTFSNKAKNKA

SEQ ID NO: 2851384 - protein, 9 aa, Entamoeba invadens
EKDAKGEDN

SEQ ID NO: 2851385 - protein, 6 aa, Entamoeba invadens
EKDASR

SEQ ID NO: 2851386 - protein, 6 aa, Entamoeba invadens
EKDDWL

SEQ ID NO: 2851387 - protein, 5 aa, Entamoeba invadens
EKDEA

SEQ ID NO: 2851388 - protein, 5 aa, Entamoeba invadens
EKDED

SEQ ID NO: 2851389 - protein, 6 aa, Entamoeba invadens
EKDEDQ

SEQ ID NO: 2851390 - protein, 17 aa, Entamoeba invadens
EKDEEDFTNTKRHFDAF

SEQ ID NO: 2851391 - protein, 17 aa, Entamoeba invadens
EKDEEENKCIIDVYEED

SEQ ID NO: 2851392 - protein, 7 aa, Entamoeba invadens
EKDEEIE

SEQ ID NO: 2851393 - protein, 8 aa, Entamoeba invadens
EKDEERRR

SEQ ID NO: 2851394 - protein, 16 aa, Entamoeba invadens
EKDEIYNDSESNKDNA

SEQ ID NO: 2851395 - protein, 8 aa, Entamoeba invadens
EKDEKSGL

SEQ ID NO: 2851396 - protein, 8 aa, Entamoeba invadens
EKDEKVDS

SEQ ID NO: 2851397 - protein, 5 aa, Entamoeba invadens
EKDEL

SEQ ID NO: 2851398 - protein, 20 aa, Entamoeba invadens
EKDELEKEGPSVTNSEFQSQ

SEQ ID NO: 2851399 - protein, 8 aa, Entamoeba invadens
EKDENTSV

SEQ ID NO: 2851400 - protein, 6 aa, Entamoeba invadens
EKDERG

SEQ ID NO: 2851401 - protein, 7 aa, Entamoeba invadens
EKDETFG

SEQ ID NO: 2851402 - protein, 8 aa, Entamoeba invadens
EKDETFGN

SEQ ID NO: 2851403 - protein, 8 aa, Entamoeba invadens
EKDEVERL

SEQ ID NO: 2851404 - protein, 18 aa, Entamoeba invadens
EKDEWSKTNSGFKTEIKD

SEQ ID NO: 2851405 - protein, 4 aa, Entamoeba invadens
EKDF

SEQ ID NO: 2851406 - protein, 7 aa, Entamoeba invadens
EKDFGAQ

SEQ ID NO: 2851407 - protein, 8 aa, Entamoeba invadens
EKDGGGVN

SEQ ID NO: 2851408 - protein, 10 aa, Entamoeba invadens
EKDGKSYTEE

SEQ ID NO: 2851409 - protein, 10 aa, Entamoeba invadens
EKDGKYQLGK

SEQ ID NO: 2851410 - protein, 11 aa, Entamoeba invadens
EKDGMNRSSYT

SEQ ID NO: 2851411 - protein, 7 aa, Entamoeba invadens
EKDGVES

SEQ ID NO: 2851412 - protein, 7 aa, Entamoeba invadens
EKDHPEY

SEQ ID NO: 2851413 - protein, 9 aa, Entamoeba invadens
EKDIDDTSF

SEQ ID NO: 2851414 - protein, 7 aa, Entamoeba invadens
EKDIESS

SEQ ID NO: 2851415 - protein, 11 aa, Entamoeba invadens
EKDIKKNETVV

SEQ ID NO: 2851416 - protein, 30 aa, Entamoeba invadens
EKDIPQPPKTCDTLTSKIKEEAFETKTSEV

SEQ ID NO: 2851417 - protein, 5 aa, Entamoeba invadens
EKDIV

SEQ ID NO: 2851418 - protein, 7 aa, Entamoeba invadens
EKDKAYE

SEQ ID NO: 2851419 - protein, 40 aa, Entamoeba invadens
EKDKDKQQKKKEKAEEKQRKKEEKEKKKLDKKDEKKQKHR

SEQ ID NO: 2851420 - protein, 7 aa, Entamoeba invadens
EKDKECW

SEQ ID NO: 2851421 - protein, 17 aa, Entamoeba invadens
EKDKETKESVNDTSENK

SEQ ID NO: 2851422 - protein, 6 aa, Entamoeba invadens
EKDKFT

SEQ ID NO: 2851423 - protein, 6 aa, Entamoeba invadens
EKDKGV

SEQ ID NO: 2851424 - protein, 5 aa, Entamoeba invadens
EKDKI

SEQ ID NO: 2851425 - protein, 9 aa, Entamoeba invadens
EKDKPNDLN

SEQ ID NO: 2851426 - protein, 25 aa, Entamoeba invadens
EKDKTCDNDEEKKTTPPKNNNESFK

SEQ ID NO: 2851427 - protein, 26 aa, Entamoeba invadens
EKDKTKEKDALAKELDETVKASVEEC

SEQ ID NO: 2851428 - protein, 5 aa, Entamoeba invadens
EKDKV

SEQ ID NO: 2851429 - protein, 8 aa, Entamoeba invadens
EKDKVQKE

SEQ ID NO: 2851430 - protein, 52 aa, Entamoeba invadens
EKDKYKDETYYERKQRLENERREERKQKYAEKAQEKVKITNESEENEEEAEN

SEQ ID NO: 2851431 - protein, 4 aa, Entamoeba invadens
EKDL

SEQ ID NO: 2851432 - protein, 7 aa, Entamoeba invadens
EKDLEKR

SEQ ID NO: 2851433 - protein, 9 aa, Entamoeba invadens
EKDLESQGK

SEQ ID NO: 2851434 - protein, 10 aa, Entamoeba invadens
EKDLQTSTKL

SEQ ID NO: 2851435 - protein, 28 aa, Entamoeba invadens
EKDNANNSDDNDPTESMLPKTSPGSEEF

SEQ ID NO: 2851436 - protein, 7 aa, Entamoeba invadens
EKDNITR

SEQ ID NO: 2851437 - protein, 27 aa, Entamoeba invadens
EKDNKRVEDAQSTIQDDLKEKATKAKA

SEQ ID NO: 2851438 - protein, 4 aa, Entamoeba invadens
EKDP

SEQ ID NO: 2851439 - protein, 8 aa, Entamoeba invadens
EKDPAQIG

SEQ ID NO: 2851440 - protein, 8 aa, Entamoeba invadens
EKDPEKRI

SEQ ID NO: 2851441 - protein, 10 aa, Entamoeba invadens
EKDPKEIRQR

SEQ ID NO: 2851442 - protein, 16 aa, Entamoeba invadens
EKDPKSGMTEDVLNKY

SEQ ID NO: 2851443 - protein, 8 aa, Entamoeba invadens
EKDPNNPA

SEQ ID NO: 2851444 - protein, 8 aa, Entamoeba invadens
EKDPPELG

SEQ ID NO: 2851445 - protein, 9 aa, Entamoeba invadens
EKDPTKRAC

SEQ ID NO: 2851446 - protein, 7 aa, Entamoeba invadens
EKDPTVC

SEQ ID NO: 2851447 - protein, 6 aa, Entamoeba invadens
EKDQFT

SEQ ID NO: 2851448 - protein, 15 aa, Entamoeba invadens
EKDQRRERIPELEEN

SEQ ID NO: 2851449 - protein, 8 aa, Entamoeba invadens
EKDRDGCP

SEQ ID NO: 2851450 - protein, 5 aa, Entamoeba invadens
EKDRR

SEQ ID NO: 2851451 - protein, 8 aa, Entamoeba invadens
EKDSEAFN

SEQ ID NO: 2851452 - protein, 6 aa, Entamoeba invadens
EKDSNI

SEQ ID NO: 2851453 - protein, 12 aa, Entamoeba invadens
EKDSTKRRNRAV

SEQ ID NO: 2851454 - protein, 8 aa, Entamoeba invadens
EKDTEDVN

SEQ ID NO: 2851455 - protein, 7 aa, Entamoeba invadens
EKDTEQV

SEQ ID NO: 2851456 - protein, 28 aa, Entamoeba invadens
EKDTKVDVTNNEEVAQQTDAPHATEPLS

SEQ ID NO: 2851457 - protein, 7 aa, Entamoeba invadens
EKDTKVR

SEQ ID NO: 2851458 - protein, 6 aa, Entamoeba invadens
EKDTSV

SEQ ID NO: 2851459 - protein, 7 aa, Entamoeba invadens
EKDVDVE

SEQ ID NO: 2851460 - protein, 8 aa, Entamoeba invadens
EKDVETQQ

SEQ ID NO: 2851461 - protein, 5 aa, Entamoeba invadens
EKDVK

SEQ ID NO: 2851462 - protein, 11 aa, Entamoeba invadens
EKDVRSPHDKQ

SEQ ID NO: 2851463 - protein, 7 aa, Entamoeba invadens
EKDVSDL

SEQ ID NO: 2851464 - protein, 15 aa, Entamoeba invadens
EKDYKNSGVAKNTAF

SEQ ID NO: 2851465 - protein, 15 aa, Entamoeba invadens
EKDYPDQESNAAYFG

SEQ ID NO: 2851466 - protein, 26 aa, Entamoeba invadens
EKDYPYTATDGSCTVDTSKKYATITG

SEQ ID NO: 2851467 - protein, 14 aa, Entamoeba invadens
EKDYQNDTTQLTEH

SEQ ID NO: 2851468 - protein, 4 aa, Entamoeba invadens
EKEA

SEQ ID NO: 2851469 - protein, 7 aa, Entamoeba invadens
EKEAEAA

SEQ ID NO: 2851470 - protein, 14 aa, Entamoeba invadens
EKEAKEAKKGRWTN

SEQ ID NO: 2851471 - protein, 4 aa, Entamoeba invadens
EKEC

SEQ ID NO: 2851472 - protein, 14 aa, Entamoeba invadens
EKECEDDDGDEPKG

SEQ ID NO: 2851473 - protein, 7 aa, Entamoeba invadens
EKECEKT

SEQ ID NO: 2851474 - protein, 17 aa, Entamoeba invadens
EKEDEKLIPGEPLMTNF

SEQ ID NO: 2851475 - protein, 9 aa, Entamoeba invadens
EKEDETERL

SEQ ID NO: 2851476 - protein, 8 aa, Entamoeba invadens
EKEDGSVS

SEQ ID NO: 2851477 - protein, 13 aa, Entamoeba invadens
EKEDILGDTGKKS

SEQ ID NO: 2851478 - protein, 10 aa, Entamoeba invadens
EKEEENTSHD

SEQ ID NO: 2851479 - protein, 6 aa, Entamoeba invadens
EKEEGK

SEQ ID NO: 2851480 - protein, 5 aa, Entamoeba invadens
EKEEI

SEQ ID NO: 2851481 - protein, 11 aa, Entamoeba invadens
EKEEKKRQNTL

SEQ ID NO: 2851482 - protein, 34 aa, Entamoeba invadens
EKEEKKTACVKEEHGTVQLNSNDSKLQKEEQELI

SEQ ID NO: 2851483 - protein, 19 aa, Entamoeba invadens
EKEEKTNKEKEDDLKKATE

SEQ ID NO: 2851484 - protein, 10 aa, Entamoeba invadens
EKEELGYEQH

SEQ ID NO: 2851485 - protein, 8 aa, Entamoeba invadens
EKEEMNNK

SEQ ID NO: 2851486 - protein, 8 aa, Entamoeba invadens
EKEEMNRG

SEQ ID NO: 2851487 - protein, 27 aa, Entamoeba invadens
EKEENDPVQGEPQNEDHTHEKTKNVRN

SEQ ID NO: 2851488 - protein, 10 aa, Entamoeba invadens
EKEENLKGTL

SEQ ID NO: 2851489 - protein, 13 aa, Entamoeba invadens
EKEENLKKIEEKI

SEQ ID NO: 2851490 - protein, 15 aa, Entamoeba invadens
EKEENVSQISTSSQL

SEQ ID NO: 2851491 - protein, 10 aa, Entamoeba invadens
EKEEPTKMPG

SEQ ID NO: 2851492 - protein, 21 aa, Entamoeba invadens
EKEERIAKEKEAMKQKEKDEM

SEQ ID NO: 2851493 - protein, 4 aa, Entamoeba invadens
EKEF

SEQ ID NO: 2851494 - protein, 4 aa, Entamoeba invadens
EKEG

SEQ ID NO: 2851495 - protein, 6 aa, Entamoeba invadens
EKEGGF

SEQ ID NO: 2851496 - protein, 32 aa, Entamoeba invadens
EKEGKCEKCKDKYETPCKEGDKDTNFTNNVKF

SEQ ID NO: 2851497 - protein, 23 aa, Entamoeba invadens
EKEGKCEKCKDTYNTPCKQGDTE

SEQ ID NO: 2851498 - protein, 24 aa, Entamoeba invadens
EKEGKCEKCNDTYNTSRKEGDTEC

SEQ ID NO: 2851499 - protein, 9 aa, Entamoeba invadens
EKEGNTTGI

SEQ ID NO: 2851500 - protein, 5 aa, Entamoeba invadens
EKEGT

SEQ ID NO: 2851501 - protein, 5 aa, Entamoeba invadens
EKEHH

SEQ ID NO: 2851502 - protein, 5 aa, Entamoeba invadens
EKEHN

SEQ ID NO: 2851503 - protein, 8 aa, Entamoeba invadens
EKEIDQQD

SEQ ID NO: 2851504 - protein, 7 aa, Entamoeba invadens
EKEIGGK

SEQ ID NO: 2851505 - protein, 10 aa, Entamoeba invadens
EKEIHKEGNS

SEQ ID NO: 2851506 - protein, 12 aa, Entamoeba invadens
EKEIKERKEEPM

SEQ ID NO: 2851507 - protein, 6 aa, Entamoeba invadens
EKEINL

SEQ ID NO: 2851508 - protein, 4 aa, Entamoeba invadens
EKEK

SEQ ID NO: 2851509 - protein, 10 aa, Entamoeba invadens
EKEKEEAESE

SEQ ID NO: 2851510 - protein, 9 aa, Entamoeba invadens
EKEKEEAMK

SEQ ID NO: 2851511 - protein, 31 aa, Entamoeba invadens
EKEKEEMQNALNTTKSTEEEMKSKYEGTVNE

SEQ ID NO: 2851512 - protein, 7 aa, Entamoeba invadens
EKEKEGK

SEQ ID NO: 2851513 - protein, 19 aa, Entamoeba invadens
EKEKEKDKDKESKKNYKIP

SEQ ID NO: 2851514 - protein, 19 aa, Entamoeba invadens
EKEKIKKAENKNKKINKPK

SEQ ID NO: 2851515 - protein, 19 aa, Entamoeba invadens
EKEKKEKKSKDKKKKSIIP

SEQ ID NO: 2851516 - protein, 37 aa, Entamoeba invadens
EKEKKEVSKREKRRRERKEEVEKTIRGSSMEEDLTGE

SEQ ID NO: 2851517 - protein, 13 aa, Entamoeba invadens
EKEKKGKEEETDM

SEQ ID NO: 2851518 - protein, 8 aa, Entamoeba invadens
EKEKKGYK

SEQ ID NO: 2851519 - protein, 88 aa, Entamoeba invadens
EKEKLEKEQQEKREKQEKEKQQREKEEKLKAEKEKADKEKEEKLRADKLKEQKQKEEKARADKEREKIEKEKALKAQKEQEEQQKAQK

SEQ ID NO: 2851520 - protein, 8 aa, Entamoeba invadens
EKEKQNAN

SEQ ID NO: 2851521 - protein, 11 aa, Entamoeba invadens
EKEKRDKELAA

SEQ ID NO: 2851522 - protein, 10 aa, Entamoeba invadens
EKEKSQMETY

SEQ ID NO: 2851523 - protein, 13 aa, Entamoeba invadens
EKEKTHNKTLQRL

SEQ ID NO: 2851524 - protein, 7 aa, Entamoeba invadens
EKELDKN

SEQ ID NO: 2851525 - protein, 12 aa, Entamoeba invadens
EKELESVKQNMS

SEQ ID NO: 2851526 - protein, 5 aa, Entamoeba invadens
EKELI

SEQ ID NO: 2851527 - protein, 11 aa, Entamoeba invadens
EKELKSDENQV

SEQ ID NO: 2851528 - protein, 9 aa, Entamoeba invadens
EKELPGGME

SEQ ID NO: 2851529 - protein, 10 aa, Entamoeba invadens
EKELPPPPVL

SEQ ID NO: 2851530 - protein, 6 aa, Entamoeba invadens
EKELPT

SEQ ID NO: 2851531 - protein, 13 aa, Entamoeba invadens
EKELRPVQRHPRY

SEQ ID NO: 2851532 - protein, 18 aa, Entamoeba invadens
EKELRTSISEVGGFEVLD

SEQ ID NO: 2851533 - protein, 40 aa, Entamoeba invadens
EKELTESENAKKSLEEENSSLNDEIEKLSNDKRTNNTDNI

SEQ ID NO: 2851534 - protein, 26 aa, Entamoeba invadens
EKENEAKKRAAEEQARKEREKQEQLL

SEQ ID NO: 2851535 - protein, 8 aa, Entamoeba invadens
EKENEERY

SEQ ID NO: 2851536 - protein, 21 aa, Entamoeba invadens
EKENEMAKQKNENQKIEEKNK

SEQ ID NO: 2851537 - protein, 13 aa, Entamoeba invadens
EKENGNSSEQISD

SEQ ID NO: 2851538 - protein, 36 aa, Entamoeba invadens
EKENKEEKKLEHNEEKKTEKVCETKEEEKKTQKSLE

SEQ ID NO: 2851539 - protein, 8 aa, Entamoeba invadens
EKENKKLT

SEQ ID NO: 2851540 - protein, 8 aa, Entamoeba invadens
EKENKQYS

SEQ ID NO: 2851541 - protein, 8 aa, Entamoeba invadens
EKENLEKE

SEQ ID NO: 2851542 - protein, 26 aa, Entamoeba invadens
EKENNKSSDHHPTEEKEEDDGFMPSV

SEQ ID NO: 2851543 - protein, 8 aa, Entamoeba invadens
EKENNRIR

SEQ ID NO: 2851544 - protein, 11 aa, Entamoeba invadens
EKENTEDDTKL

SEQ ID NO: 2851545 - protein, 15 aa, Entamoeba invadens
EKENTTQKTAKRRTQ

SEQ ID NO: 2851546 - protein, 9 aa, Entamoeba invadens
EKEPKTKLK

SEQ ID NO: 2851547 - protein, 8 aa, Entamoeba invadens
EKEPKTTG

SEQ ID NO: 2851548 - protein, 10 aa, Entamoeba invadens
EKEPKVDDAL

SEQ ID NO: 2851549 - protein, 23 aa, Entamoeba invadens
EKEPRYNTKKNALERAEKYQTKM

SEQ ID NO: 2851550 - protein, 5 aa, Entamoeba invadens
EKEPW

SEQ ID NO: 2851551 - protein, 4 aa, Entamoeba invadens
EKEQ

SEQ ID NO: 2851552 - protein, 7 aa, Entamoeba invadens
EKEQIQR

SEQ ID NO: 2851553 - protein, 14 aa, Entamoeba invadens
EKEQKEKDLNTELE

SEQ ID NO: 2851554 - protein, 9 aa, Entamoeba invadens
EKEQNGSSV

SEQ ID NO: 2851555 - protein, 11 aa, Entamoeba invadens
EKEQQKRASDI

SEQ ID NO: 2851556 - protein, 7 aa, Entamoeba invadens
EKEQQRV

SEQ ID NO: 2851557 - protein, 24 aa, Entamoeba invadens
EKEQTFKEKPKGKIATKKVTSEKA

SEQ ID NO: 2851558 - protein, 4 aa, Entamoeba invadens
EKER

SEQ ID NO: 2851559 - protein, 5 aa, Entamoeba invadens
EKERD

SEQ ID NO: 2851560 - protein, 11 aa, Entamoeba invadens
EKERDKKKEQE

SEQ ID NO: 2851561 - protein, 27 aa, Entamoeba invadens
EKEREDHEEEELRKKQIRDRDEAMKAE

SEQ ID NO: 2851562 - protein, 13 aa, Entamoeba invadens
EKEREKEKLKEKK

SEQ ID NO: 2851563 - protein, 28 aa, Entamoeba invadens
EKERKEKQEKNELKIKTEQLKNEKKKIE

SEQ ID NO: 2851564 - protein, 6 aa, Entamoeba invadens
EKERKV

SEQ ID NO: 2851565 - protein, 9 aa, Entamoeba invadens
EKERKVTKQ

SEQ ID NO: 2851566 - protein, 5 aa, Entamoeba invadens
EKERL

SEQ ID NO: 2851567 - protein, 7 aa, Entamoeba invadens
EKERNTT

SEQ ID NO: 2851568 - protein, 14 aa, Entamoeba invadens
EKERQRSRNKTRCV

SEQ ID NO: 2851569 - protein, 27 aa, Entamoeba invadens
EKERRARLANQEKTCTACGKKTTEWKK

SEQ ID NO: 2851570 - protein, 7 aa, Entamoeba invadens
EKERRRL

SEQ ID NO: 2851571 - protein, 20 aa, Entamoeba invadens
EKERTNTVKDSDMKERRQTK

SEQ ID NO: 2851572 - protein, 13 aa, Entamoeba invadens
EKERVETKVEEKT

SEQ ID NO: 2851573 - protein, 30 aa, Entamoeba invadens
EKESAKRAIADARASGYNTSSLVQTDETSF

SEQ ID NO: 2851574 - protein, 6 aa, Entamoeba invadens
EKESDC

SEQ ID NO: 2851575 - protein, 9 aa, Entamoeba invadens
EKESDKTQM

SEQ ID NO: 2851576 - protein, 26 aa, Entamoeba invadens
EKESEKNSEHQKTEERPNGDSETKND

SEQ ID NO: 2851577 - protein, 62 aa, Entamoeba invadens
EKESELKSQVTKLSQKDSTSTFSSSEEDDNSPRYIEDESNEKIKKEERKKNVGHHSKEKNLL

SEQ ID NO: 2851578 - protein, 12 aa, Entamoeba invadens
EKESEVYKKQEN

SEQ ID NO: 2851579 - protein, 6 aa, Entamoeba invadens
EKESHN

SEQ ID NO: 2851580 - protein, 8 aa, Entamoeba invadens
EKESIAVN

SEQ ID NO: 2851581 - protein, 5 aa, Entamoeba invadens
EKESS

SEQ ID NO: 2851582 - protein, 7 aa, Entamoeba invadens
EKETAIT

SEQ ID NO: 2851583 - protein, 6 aa, Entamoeba invadens
EKETEY

SEQ ID NO: 2851584 - protein, 10 aa, Entamoeba invadens
EKETIEAKDE

SEQ ID NO: 2851585 - protein, 22 aa, Entamoeba invadens
EKETISKLEETNMNEKQSSIID

SEQ ID NO: 2851586 - protein, 8 aa, Entamoeba invadens
EKETKDIT

SEQ ID NO: 2851587 - protein, 7 aa, Entamoeba invadens
EKETLDE

SEQ ID NO: 2851588 - protein, 14 aa, Entamoeba invadens
EKETRTDNKAKKLS

SEQ ID NO: 2851589 - protein, 8 aa, Entamoeba invadens
EKETSTTI

SEQ ID NO: 2851590 - protein, 4 aa, Entamoeba invadens
EKEV

SEQ ID NO: 2851591 - protein, 10 aa, Entamoeba invadens
EKEVENSYDS

SEQ ID NO: 2851592 - protein, 12 aa, Entamoeba invadens
EKEVGNRFKQRD

SEQ ID NO: 2851593 - protein, 14 aa, Entamoeba invadens
EKEVKEKERELETT

SEQ ID NO: 2851594 - protein, 30 aa, Entamoeba invadens
EKEVQQNEENTSSKATQKTNQCKQHQINTQ

SEQ ID NO: 2851595 - protein, 8 aa, Entamoeba invadens
EKEVTDKT

SEQ ID NO: 2851596 - protein, 18 aa, Entamoeba invadens
EKEVTKTSNYKQSHITED

SEQ ID NO: 2851597 - protein, 9 aa, Entamoeba invadens
EKEVTTTQR

SEQ ID NO: 2851598 - protein, 7 aa, Entamoeba invadens
EKEYETR

SEQ ID NO: 2851599 - protein, 7 aa, Entamoeba invadens
EKEYGSY

SEQ ID NO: 2851600 - protein, 8 aa, Entamoeba invadens
EKEYKGGV

SEQ ID NO: 2851601 - protein, 5 aa, Entamoeba invadens
EKEYS

SEQ ID NO: 2851602 - protein, 14 aa, Entamoeba invadens
EKFDSEKAEIEHEE

SEQ ID NO: 2851603 - protein, 4 aa, Entamoeba invadens
EKFE

SEQ ID NO: 2851604 - protein, 5 aa, Entamoeba invadens
EKFED

SEQ ID NO: 2851605 - protein, 24 aa, Entamoeba invadens
EKFEEQADNDAEDLEGGIAQTVRI

SEQ ID NO: 2851606 - protein, 11 aa, Entamoeba invadens
EKFESNYGGTN

SEQ ID NO: 2851607 - protein, 15 aa, Entamoeba invadens
EKFGEKIPRPLTSKE

SEQ ID NO: 2851608 - protein, 6 aa, Entamoeba invadens
EKFGND

SEQ ID NO: 2851609 - protein, 11 aa, Entamoeba invadens
EKFKAEDDKMK

SEQ ID NO: 2851610 - protein, 15 aa, Entamoeba invadens
EKFKDECDKEHLNTN

SEQ ID NO: 2851611 - protein, 9 aa, Entamoeba invadens
EKFKKEPDF

SEQ ID NO: 2851612 - protein, 17 aa, Entamoeba invadens
EKFKNGSNKKIQEIEEE

SEQ ID NO: 2851613 - protein, 4 aa, Entamoeba invadens
EKFN

SEQ ID NO: 2851614 - protein, 13 aa, Entamoeba invadens
EKFNKERITEQKY

SEQ ID NO: 2851615 - protein, 6 aa, Entamoeba invadens
EKFNMT

SEQ ID NO: 2851616 - protein, 4 aa, Entamoeba invadens
EKFP

SEQ ID NO: 2851617 - protein, 15 aa, Entamoeba invadens
EKFPQDYRKELTPNH

SEQ ID NO: 2851618 - protein, 8 aa, Entamoeba invadens
EKFRTNQQ

SEQ ID NO: 2851619 - protein, 4 aa, Entamoeba invadens
EKFS

SEQ ID NO: 2851620 - protein, 11 aa, Entamoeba invadens
EKFSDEEEIEL

SEQ ID NO: 2851621 - protein, 6 aa, Entamoeba invadens
EKFSDN

SEQ ID NO: 2851622 - protein, 7 aa, Entamoeba invadens
EKFTNQN

SEQ ID NO: 2851623 - protein, 10 aa, Entamoeba invadens
EKFVDSPQGK

SEQ ID NO: 2851624 - protein, 12 aa, Entamoeba invadens
EKGAFTKKINAN

SEQ ID NO: 2851625 - protein, 10 aa, Entamoeba invadens
EKGAQKPPKH

SEQ ID NO: 2851626 - protein, 8 aa, Entamoeba invadens
EKGASAIL

SEQ ID NO: 2851627 - protein, 7 aa, Entamoeba invadens
EKGCTQC

SEQ ID NO: 2851628 - protein, 10 aa, Entamoeba invadens
EKGDDDMKRT

SEQ ID NO: 2851629 - protein, 8 aa, Entamoeba invadens
EKGDEMEL

SEQ ID NO: 2851630 - protein, 9 aa, Entamoeba invadens
EKGDERHEV

SEQ ID NO: 2851631 - protein, 6 aa, Entamoeba invadens
EKGDGL

SEQ ID NO: 2851632 - protein, 6 aa, Entamoeba invadens
EKGDRS

SEQ ID NO: 2851633 - protein, 6 aa, Entamoeba invadens
EKGDTR

SEQ ID NO: 2851634 - protein, 9 aa, Entamoeba invadens
EKGEDGSEI

SEQ ID NO: 2851635 - protein, 13 aa, Entamoeba invadens
EKGEEARAKGSQF

SEQ ID NO: 2851636 - protein, 8 aa, Entamoeba invadens
EKGEEFAE

SEQ ID NO: 2851637 - protein, 6 aa, Entamoeba invadens
EKGEEK

SEQ ID NO: 2851638 - protein, 5 aa, Entamoeba invadens
EKGEK

SEQ ID NO: 2851639 - protein, 14 aa, Entamoeba invadens
EKGEKDLGHPPMDE

SEQ ID NO: 2851640 - protein, 10 aa, Entamoeba invadens
EKGEKKKSLE

SEQ ID NO: 2851641 - protein, 7 aa, Entamoeba invadens
EKGEMSA

SEQ ID NO: 2851642 - protein, 8 aa, Entamoeba invadens
EKGETKLG

SEQ ID NO: 2851643 - protein, 11 aa, Entamoeba invadens
EKGEYTKKVEE

SEQ ID NO: 2851644 - protein, 7 aa, Entamoeba invadens
EKGGCDA

SEQ ID NO: 2851645 - protein, 11 aa, Entamoeba invadens
EKGGKKFKKQI

SEQ ID NO: 2851646 - protein, 13 aa, Entamoeba invadens
EKGGSCSFGPKTE

SEQ ID NO: 2851647 - protein, 8 aa, Entamoeba invadens
EKGGYTSE

SEQ ID NO: 2851648 - protein, 8 aa, Entamoeba invadens
EKGIGIDP

SEQ ID NO: 2851649 - protein, 7 aa, Entamoeba invadens
EKGINGE

SEQ ID NO: 2851650 - protein, 12 aa, Entamoeba invadens
EKGISDPSPIVR

SEQ ID NO: 2851651 - protein, 4 aa, Entamoeba invadens
EKGK

SEQ ID NO: 2851652 - protein, 5 aa, Entamoeba invadens
EKGKE

SEQ ID NO: 2851653 - protein, 13 aa, Entamoeba invadens
EKGKENKPITQKE

SEQ ID NO: 2851654 - protein, 22 aa, Entamoeba invadens
EKGKKKSKKMESSSSESSSEDS

SEQ ID NO: 2851655 - protein, 9 aa, Entamoeba invadens
EKGKRRMKE

SEQ ID NO: 2851656 - protein, 7 aa, Entamoeba invadens
EKGKTLA

SEQ ID NO: 2851657 - protein, 4 aa, Entamoeba invadens
EKGL

SEQ ID NO: 2851658 - protein, 5 aa, Entamoeba invadens
EKGLK

SEQ ID NO: 2851659 - protein, 8 aa, Entamoeba invadens
EKGNGGAI

SEQ ID NO: 2851660 - protein, 9 aa, Entamoeba invadens
EKGNYDEGF

SEQ ID NO: 2851661 - protein, 8 aa, Entamoeba invadens
EKGPHKLH

SEQ ID NO: 2851662 - protein, 8 aa, Entamoeba invadens
EKGQFKKI

SEQ ID NO: 2851663 - protein, 6 aa, Entamoeba invadens
EKGQIE

SEQ ID NO: 2851664 - protein, 5 aa, Entamoeba invadens
EKGQW

SEQ ID NO: 2851665 - protein, 5 aa, Entamoeba invadens
EKGRA

SEQ ID NO: 2851666 - protein, 7 aa, Entamoeba invadens
EKGREKF

SEQ ID NO: 2851667 - protein, 9 aa, Entamoeba invadens
EKGREQEQL

SEQ ID NO: 2851668 - protein, 5 aa, Entamoeba invadens
EKGSE

SEQ ID NO: 2851669 - protein, 7 aa, Entamoeba invadens
EKGSTEE

SEQ ID NO: 2851670 - protein, 19 aa, Entamoeba invadens
EKGTALPLKESSFPAQAIN

SEQ ID NO: 2851671 - protein, 9 aa, Entamoeba invadens
EKGTDDQKE

SEQ ID NO: 2851672 - protein, 7 aa, Entamoeba invadens
EKGTDGD

SEQ ID NO: 2851673 - protein, 7 aa, Entamoeba invadens
EKGTERQ

SEQ ID NO: 2851674 - protein, 5 aa, Entamoeba invadens
EKGTN

SEQ ID NO: 2851675 - protein, 8 aa, Entamoeba invadens
EKGTNIGE

SEQ ID NO: 2851676 - protein, 27 aa, Entamoeba invadens
EKGTPSNSTPSAAPKTPRGENRQEDVP

SEQ ID NO: 2851677 - protein, 10 aa, Entamoeba invadens
EKGTTQRKNI

SEQ ID NO: 2851678 - protein, 8 aa, Entamoeba invadens
EKGVCKGV

SEQ ID NO: 2851679 - protein, 6 aa, Entamoeba invadens
EKGVDG

SEQ ID NO: 2851680 - protein, 12 aa, Entamoeba invadens
EKGVHKSYSSVE

SEQ ID NO: 2851681 - protein, 11 aa, Entamoeba invadens
EKGVKDETKTL

SEQ ID NO: 2851682 - protein, 6 aa, Entamoeba invadens
EKGVPM

SEQ ID NO: 2851683 - protein, 5 aa, Entamoeba invadens
EKGVS

SEQ ID NO: 2851684 - protein, 7 aa, Entamoeba invadens
EKGYQDD

SEQ ID NO: 2851685 - protein, 8 aa, Entamoeba invadens
EKGYQDDI

SEQ ID NO: 2851686 - protein, 10 aa, Entamoeba invadens
EKGYQDDTTQ

SEQ ID NO: 2851687 - protein, 7 aa, Entamoeba invadens
EKGYQND

SEQ ID NO: 2851688 - protein, 8 aa, Entamoeba invadens
EKGYTGEG

SEQ ID NO: 2851689 - protein, 8 aa, Entamoeba invadens
EKHDTPVE

SEQ ID NO: 2851690 - protein, 16 aa, Entamoeba invadens
EKHGDFENSTTDTTVD

SEQ ID NO: 2851691 - protein, 9 aa, Entamoeba invadens
EKHGKPNIY

SEQ ID NO: 2851692 - protein, 9 aa, Entamoeba invadens
EKHGKTNIY

SEQ ID NO: 2851693 - protein, 13 aa, Entamoeba invadens
EKHNKTPKTERNS

SEQ ID NO: 2851694 - protein, 8 aa, Entamoeba invadens
EKHNNIER

SEQ ID NO: 2851695 - protein, 8 aa, Entamoeba invadens
EKHNPSAK

SEQ ID NO: 2851696 - protein, 16 aa, Entamoeba invadens
EKHPKSLQSKSEKVEY

SEQ ID NO: 2851697 - protein, 8 aa, Entamoeba invadens
EKHPTRNS

SEQ ID NO: 2851698 - protein, 15 aa, Entamoeba invadens
EKHQARPEKGGQEEA

SEQ ID NO: 2851699 - protein, 14 aa, Entamoeba invadens
EKHQEEIKRNPDLR

SEQ ID NO: 2851700 - protein, 7 aa, Entamoeba invadens
EKHQETH

SEQ ID NO: 2851701 - protein, 12 aa, Entamoeba invadens
EKHREEDEDQKH

SEQ ID NO: 2851702 - protein, 6 aa, Entamoeba invadens
EKHSEV

SEQ ID NO: 2851703 - protein, 11 aa, Entamoeba invadens
EKHSQKDDDFF

SEQ ID NO: 2851704 - protein, 7 aa, Entamoeba invadens
EKHTETD

SEQ ID NO: 2851705 - protein, 8 aa, Entamoeba invadens
EKHTPSIE

SEQ ID NO: 2851706 - protein, 8 aa, Entamoeba invadens
EKHTVDEE

SEQ ID NO: 2851707 - protein, 8 aa, Entamoeba invadens
EKIAEDEK

SEQ ID NO: 2851708 - protein, 8 aa, Entamoeba invadens
EKIAIPEE

SEQ ID NO: 2851709 - protein, 7 aa, Entamoeba invadens
EKIAKRA

SEQ ID NO: 2851710 - protein, 9 aa, Entamoeba invadens
EKIANEKRT

SEQ ID NO: 2851711 - protein, 9 aa, Entamoeba invadens
EKIANSEQP

SEQ ID NO: 2851712 - protein, 13 aa, Entamoeba invadens
EKIDIKKKSRKSV

SEQ ID NO: 2851713 - protein, 4 aa, Entamoeba invadens
EKIE

SEQ ID NO: 2851714 - protein, 16 aa, Entamoeba invadens
EKIEADKITTESTLEQ

SEQ ID NO: 2851715 - protein, 7 aa, Entamoeba invadens
EKIEAEA

SEQ ID NO: 2851716 - protein, 19 aa, Entamoeba invadens
EKIEDNKISKIEQKAPEKV

SEQ ID NO: 2851717 - protein, 11 aa, Entamoeba invadens
EKIEDSHESTS

SEQ ID NO: 2851718 - protein, 46 aa, Entamoeba invadens
EKIEEEKKTNQSDIFDDKKKKEEHPTTSLNNCNTNENNKEQKDVCN

SEQ ID NO: 2851719 - protein, 42 aa, Entamoeba invadens
EKIEEEQAPVKGKAAKPVNVQPVSNNNAKAIEDNSDDEDWNF

SEQ ID NO: 2851720 - protein, 8 aa, Entamoeba invadens
EKIEGGKF

SEQ ID NO: 2851721 - protein, 17 aa, Entamoeba invadens
EKIEKGEDKQEKTNDIS

SEQ ID NO: 2851722 - protein, 9 aa, Entamoeba invadens
EKIEKSKKD

SEQ ID NO: 2851723 - protein, 6 aa, Entamoeba invadens
EKIENE

SEQ ID NO: 2851724 - protein, 14 aa, Entamoeba invadens
EKIEQSNLPPEEKK

SEQ ID NO: 2851725 - protein, 9 aa, Entamoeba invadens
EKIESEKLE

SEQ ID NO: 2851726 - protein, 10 aa, Entamoeba invadens
EKIESNPETI

SEQ ID NO: 2851727 - protein, 9 aa, Entamoeba invadens
EKIETMTDK

SEQ ID NO: 2851728 - protein, 21 aa, Entamoeba invadens
EKIGERGSYLGSYDKTNANTF

SEQ ID NO: 2851729 - protein, 7 aa, Entamoeba invadens
EKIGGGG

SEQ ID NO: 2851730 - protein, 7 aa, Entamoeba invadens
EKIGKEH

SEQ ID NO: 2851731 - protein, 7 aa, Entamoeba invadens
EKIGSEA

SEQ ID NO: 2851732 - protein, 4 aa, Entamoeba invadens
EKIK

SEQ ID NO: 2851733 - protein, 14 aa, Entamoeba invadens
EKIKAADFGGTSDA

SEQ ID NO: 2851734 - protein, 12 aa, Entamoeba invadens
EKINEKEQEEMD

SEQ ID NO: 2851735 - protein, 19 aa, Entamoeba invadens
EKINKINGTKKNIINLKIE

SEQ ID NO: 2851736 - protein, 10 aa, Entamoeba invadens
EKINKSFGDQ

SEQ ID NO: 2851737 - protein, 6 aa, Entamoeba invadens
EKINNY

SEQ ID NO: 2851738 - protein, 12 aa, Entamoeba invadens
EKINYHSPTTCP

SEQ ID NO: 2851739 - protein, 4 aa, Entamoeba invadens
EKIP

SEQ ID NO: 2851740 - protein, 7 aa, Entamoeba invadens
EKIPDEE

SEQ ID NO: 2851741 - protein, 6 aa, Entamoeba invadens
EKIPFD

SEQ ID NO: 2851742 - protein, 7 aa, Entamoeba invadens
EKIPGGW

SEQ ID NO: 2851743 - protein, 6 aa, Entamoeba invadens
EKIPKE

SEQ ID NO: 2851744 - protein, 7 aa, Entamoeba invadens
EKIPNTN

SEQ ID NO: 2851745 - protein, 23 aa, Entamoeba invadens
EKIPPTKTPPPPPSTKPPPINSL

SEQ ID NO: 2851746 - protein, 9 aa, Entamoeba invadens
EKIPQEVTS

SEQ ID NO: 2851747 - protein, 8 aa, Entamoeba invadens
EKIPSPLT

SEQ ID NO: 2851748 - protein, 13 aa, Entamoeba invadens
EKIQADQASIKQF

SEQ ID NO: 2851749 - protein, 10 aa, Entamoeba invadens
EKIQENGGIE

SEQ ID NO: 2851750 - protein, 23 aa, Entamoeba invadens
EKIQRAEKMRQANLKREKEEMQY

SEQ ID NO: 2851751 - protein, 8 aa, Entamoeba invadens
EKIQTTKG

SEQ ID NO: 2851752 - protein, 8 aa, Entamoeba invadens
EKIRYDQE

SEQ ID NO: 2851753 - protein, 12 aa, Entamoeba invadens
EKISEAEAAQVD

SEQ ID NO: 2851754 - protein, 44 aa, Entamoeba invadens
EKISKESNAAKKKELEEQKKATHDSVEEAKKQIKNALDTGDDGD

SEQ ID NO: 2851755 - protein, 10 aa, Entamoeba invadens
EKISKEVEIS

SEQ ID NO: 2851756 - protein, 19 aa, Entamoeba invadens
EKISKINGTKKNIKNLKIK

SEQ ID NO: 2851757 - protein, 13 aa, Entamoeba invadens
EKISKKLSEDSNE

SEQ ID NO: 2851758 - protein, 18 aa, Entamoeba invadens
EKISNSQDQTQLPSAQQS

SEQ ID NO: 2851759 - protein, 5 aa, Entamoeba invadens
EKITD

SEQ ID NO: 2851760 - protein, 13 aa, Entamoeba invadens
EKITPNSQEHKYY

SEQ ID NO: 2851761 - protein, 4 aa, Entamoeba invadens
EKIY

SEQ ID NO: 2851762 - protein, 4 aa, Entamoeba invadens
EKKA

SEQ ID NO: 2851763 - protein, 14 aa, Entamoeba invadens
EKKAAEAKPAQKPF

SEQ ID NO: 2851764 - protein, 9 aa, Entamoeba invadens
EKKAKETIN

SEQ ID NO: 2851765 - protein, 5 aa, Entamoeba invadens
EKKAL

SEQ ID NO: 2851766 - protein, 4 aa, Entamoeba invadens
EKKD

SEQ ID NO: 2851767 - protein, 6 aa, Entamoeba invadens
EKKDDK

SEQ ID NO: 2851768 - protein, 28 aa, Entamoeba invadens
EKKDEQTPQATPPQISPRSGEDSPTLIS

SEQ ID NO: 2851769 - protein, 10 aa, Entamoeba invadens
EKKDGEKKNL

SEQ ID NO: 2851770 - protein, 17 aa, Entamoeba invadens
EKKDQTDKIDKSETFDG

SEQ ID NO: 2851771 - protein, 10 aa, Entamoeba invadens
EKKDSKEITL

SEQ ID NO: 2851772 - protein, 5 aa, Entamoeba invadens
EKKDT

SEQ ID NO: 2851773 - protein, 4 aa, Entamoeba invadens
EKKE

SEQ ID NO: 2851774 - protein, 24 aa, Entamoeba invadens
EKKEAKDEKSDRKRKVEKEDRIDE

SEQ ID NO: 2851775 - protein, 27 aa, Entamoeba invadens
EKKEDVTISNKELKQKKAENKVEEKQY

SEQ ID NO: 2851776 - protein, 10 aa, Entamoeba invadens
EKKEEEKQEL

SEQ ID NO: 2851777 - protein, 18 aa, Entamoeba invadens
EKKEEKKLAALPGLGDTV

SEQ ID NO: 2851778 - protein, 10 aa, Entamoeba invadens
EKKEEQIKEQ

SEQ ID NO: 2851779 - protein, 7 aa, Entamoeba invadens
EKKEFSL

SEQ ID NO: 2851780 - protein, 6 aa, Entamoeba invadens
EKKEHI

SEQ ID NO: 2851781 - protein, 30 aa, Entamoeba invadens
EKKEKAPRKMSKQEQRLKKLSEKAVTVNAA

SEQ ID NO: 2851782 - protein, 17 aa, Entamoeba invadens
EKKEKEVENLQKSGNLE

SEQ ID NO: 2851783 - protein, 7 aa, Entamoeba invadens
EKKEKNG

SEQ ID NO: 2851784 - protein, 51 aa, Entamoeba invadens
EKKEKNLEDKTENLSERISEKMDERPNESPKETTKHTRKRKLRSATERKPT

SEQ ID NO: 2851785 - protein, 56 aa, Entamoeba invadens
EKKEKQDAPKEPQHDENNEKPSEQNTSPEAGPETEKEVKEEEVEHKDDEKESSEVE

SEQ ID NO: 2851786 - protein, 47 aa, Entamoeba invadens
EKKEKVKKEAKCGSYVEKGNAMETESYSEEEQMEEESSSEEEAPQVK

SEQ ID NO: 2851787 - protein, 10 aa, Entamoeba invadens
EKKELKREKD

SEQ ID NO: 2851788 - protein, 10 aa, Entamoeba invadens
EKKENTQKEM

SEQ ID NO: 2851789 - protein, 13 aa, Entamoeba invadens
EKKESAEKAEREM

SEQ ID NO: 2851790 - protein, 9 aa, Entamoeba invadens
EKKESLKVD

SEQ ID NO: 2851791 - protein, 48 aa, Entamoeba invadens
EKKETKPRKDKEKDKDKEIVETKRKKKSDRRSKKRNQRKEESEEGNED

SEQ ID NO: 2851792 - protein, 18 aa, Entamoeba invadens
EKKGEEIQLEQTQSTIKI

SEQ ID NO: 2851793 - protein, 9 aa, Entamoeba invadens
EKKGEPKTT

SEQ ID NO: 2851794 - protein, 9 aa, Entamoeba invadens
EKKGISEDS

SEQ ID NO: 2851795 - protein, 13 aa, Entamoeba invadens
EKKGKKAEKSDLD

SEQ ID NO: 2851796 - protein, 6 aa, Entamoeba invadens
EKKGKL

SEQ ID NO: 2851797 - protein, 6 aa, Entamoeba invadens
EKKGKN

SEQ ID NO: 2851798 - protein, 9 aa, Entamoeba invadens
EKKGTLQGN

SEQ ID NO: 2851799 - protein, 5 aa, Entamoeba invadens
EKKGV

SEQ ID NO: 2851800 - protein, 12 aa, Entamoeba invadens
EKKHKRPSRNAK

SEQ ID NO: 2851801 - protein, 8 aa, Entamoeba invadens
EKKHQTTH

SEQ ID NO: 2851802 - protein, 4 aa, Entamoeba invadens
EKKI

SEQ ID NO: 2851803 - protein, 8 aa, Entamoeba invadens
EKKIGQDI

SEQ ID NO: 2851804 - protein, 8 aa, Entamoeba invadens
EKKINSEM

SEQ ID NO: 2851805 - protein, 29 aa, Entamoeba invadens
EKKIRSGEESKKPRGRNDQSKKAEKKLTR

SEQ ID NO: 2851806 - protein, 6 aa, Entamoeba invadens
EKKISD

SEQ ID NO: 2851807 - protein, 7 aa, Entamoeba invadens
EKKISGP

SEQ ID NO: 2851808 - protein, 8 aa, Entamoeba invadens
EKKITTDN

SEQ ID NO: 2851809 - protein, 4 aa, Entamoeba invadens
EKKK

SEQ ID NO: 2851810 - protein, 11 aa, Entamoeba invadens
EKKKAEQQRLE

SEQ ID NO: 2851811 - protein, 14 aa, Entamoeba invadens
EKKKEKLNELKREQ

SEQ ID NO: 2851812 - protein, 28 aa, Entamoeba invadens
EKKKENEKKKDKSDSEDDKEKEDDDELP

SEQ ID NO: 2851813 - protein, 18 aa, Entamoeba invadens
EKKKERLQKLRDKQAKLA

SEQ ID NO: 2851814 - protein, 15 aa, Entamoeba invadens
EKKKGEDFITKGSER

SEQ ID NO: 2851815 - protein, 8 aa, Entamoeba invadens
EKKKGKDA

SEQ ID NO: 2851816 - protein, 68 aa, Entamoeba invadens
EKKKKDKVDKMDKDEKKKDKEKKPRKRITMPKKGEKKKEKKKETKEDKKDDEKADKENIEKDKKSDWL

SEQ ID NO: 2851817 - protein, 7 aa, Entamoeba invadens
EKKKKLS

SEQ ID NO: 2851818 - protein, 15 aa, Entamoeba invadens
EKKKKNGKESFEKDE

SEQ ID NO: 2851819 - protein, 8 aa, Entamoeba invadens
EKKKKSQV

SEQ ID NO: 2851820 - protein, 8 aa, Entamoeba invadens
EKKKNAEK

SEQ ID NO: 2851821 - protein, 8 aa, Entamoeba invadens
EKKKNELK

SEQ ID NO: 2851822 - protein, 9 aa, Entamoeba invadens
EKKKNNEKL

SEQ ID NO: 2851823 - protein, 7 aa, Entamoeba invadens
EKKKNTR

SEQ ID NO: 2851824 - protein, 8 aa, Entamoeba invadens
EKKKPMEE

SEQ ID NO: 2851825 - protein, 9 aa, Entamoeba invadens
EKKKSGFKN

SEQ ID NO: 2851826 - protein, 9 aa, Entamoeba invadens
EKKKSSSKM

SEQ ID NO: 2851827 - protein, 11 aa, Entamoeba invadens
EKKKTKSPKFE

SEQ ID NO: 2851828 - protein, 8 aa, Entamoeba invadens
EKKKTPDI

SEQ ID NO: 2851829 - protein, 15 aa, Entamoeba invadens
EKKKTRKREEAERKR

SEQ ID NO: 2851830 - protein, 8 aa, Entamoeba invadens
EKKLGEDS

SEQ ID NO: 2851831 - protein, 20 aa, Entamoeba invadens
EKKMKETGADQKSARGVDGK

SEQ ID NO: 2851832 - protein, 7 aa, Entamoeba invadens
EKKMSEL

SEQ ID NO: 2851833 - protein, 10 aa, Entamoeba invadens
EKKNDSDVSE

SEQ ID NO: 2851834 - protein, 12 aa, Entamoeba invadens
EKKNENKSYGDY

SEQ ID NO: 2851835 - protein, 9 aa, Entamoeba invadens
EKKNINGDT

SEQ ID NO: 2851836 - protein, 10 aa, Entamoeba invadens
EKKNKEFKEA

SEQ ID NO: 2851837 - protein, 12 aa, Entamoeba invadens
EKKNPFILSLLG

SEQ ID NO: 2851838 - protein, 5 aa, Entamoeba invadens
EKKNQ

SEQ ID NO: 2851839 - protein, 16 aa, Entamoeba invadens
EKKNYSTYNTSEECKA

SEQ ID NO: 2851840 - protein, 10 aa, Entamoeba invadens
EKKPIKRNRT

SEQ ID NO: 2851841 - protein, 8 aa, Entamoeba invadens
EKKPISQA

SEQ ID NO: 2851842 - protein, 7 aa, Entamoeba invadens
EKKPIVY

SEQ ID NO: 2851843 - protein, 9 aa, Entamoeba invadens
EKKPNNENY

SEQ ID NO: 2851844 - protein, 8 aa, Entamoeba invadens
EKKPPYED

SEQ ID NO: 2851845 - protein, 8 aa, Entamoeba invadens
EKKPQKKV

SEQ ID NO: 2851846 - protein, 16 aa, Entamoeba invadens
EKKPREPKDSKLSHGQ

SEQ ID NO: 2851847 - protein, 7 aa, Entamoeba invadens
EKKQESV

SEQ ID NO: 2851848 - protein, 9 aa, Entamoeba invadens
EKKQITQSV

SEQ ID NO: 2851849 - protein, 12 aa, Entamoeba invadens
EKKQKSGNVEYT

SEQ ID NO: 2851850 - protein, 13 aa, Entamoeba invadens
EKKQNDDKQLTEL

SEQ ID NO: 2851851 - protein, 15 aa, Entamoeba invadens
EKKQPKEQKKEDNLD

SEQ ID NO: 2851852 - protein, 10 aa, Entamoeba invadens
EKKQSKQRRN

SEQ ID NO: 2851853 - protein, 7 aa, Entamoeba invadens
EKKRKEY

SEQ ID NO: 2851854 - protein, 13 aa, Entamoeba invadens
EKKRMEREENNRL

SEQ ID NO: 2851855 - protein, 6 aa, Entamoeba invadens
EKKRMN

SEQ ID NO: 2851856 - protein, 20 aa, Entamoeba invadens
EKKRNEQVGQFASEDQESYI

SEQ ID NO: 2851857 - protein, 19 aa, Entamoeba invadens
EKKRNNLERESQEKEMRSE

SEQ ID NO: 2851858 - protein, 9 aa, Entamoeba invadens
EKKRQKKKE

SEQ ID NO: 2851859 - protein, 15 aa, Entamoeba invadens
EKKRTFGNEEKKSNV

SEQ ID NO: 2851860 - protein, 8 aa, Entamoeba invadens
EKKRTKHE

SEQ ID NO: 2851861 - protein, 30 aa, Entamoeba invadens
EKKRVEDGEDQPIRKKRDKKTKKNHSTFGE

SEQ ID NO: 2851862 - protein, 6 aa, Entamoeba invadens
EKKRVN

SEQ ID NO: 2851863 - protein, 9 aa, Entamoeba invadens
EKKRYENSR

SEQ ID NO: 2851864 - protein, 13 aa, Entamoeba invadens
EKKRYQNDIQRQV

SEQ ID NO: 2851865 - protein, 16 aa, Entamoeba invadens
EKKSCKGEVFTLNPFL

SEQ ID NO: 2851866 - protein, 9 aa, Entamoeba invadens
EKKSEEIKS

SEQ ID NO: 2851867 - protein, 18 aa, Entamoeba invadens
EKKSEKKEEPITTAEDEW

SEQ ID NO: 2851868 - protein, 7 aa, Entamoeba invadens
EKKSELL

SEQ ID NO: 2851869 - protein, 5 aa, Entamoeba invadens
EKKSH

SEQ ID NO: 2851870 - protein, 10 aa, Entamoeba invadens
EKKSKNVERE

SEQ ID NO: 2851871 - protein, 19 aa, Entamoeba invadens
EKKSSSTSISKLGDEPDFS

SEQ ID NO: 2851872 - protein, 17 aa, Entamoeba invadens
EKKSVDVEEMETDNEFE

SEQ ID NO: 2851873 - protein, 9 aa, Entamoeba invadens
EKKTDTNMN

SEQ ID NO: 2851874 - protein, 7 aa, Entamoeba invadens
EKKTGID

SEQ ID NO: 2851875 - protein, 10 aa, Entamoeba invadens
EKKTIESPTF

SEQ ID NO: 2851876 - protein, 17 aa, Entamoeba invadens
EKKTLEVKKSIQLMNKK

SEQ ID NO: 2851877 - protein, 9 aa, Entamoeba invadens
EKKTPSHDT

SEQ ID NO: 2851878 - protein, 29 aa, Entamoeba invadens
EKKTSEVKEESTTETQNNKKTKEHHKNRF

SEQ ID NO: 2851879 - protein, 7 aa, Entamoeba invadens
EKKTTDV

SEQ ID NO: 2851880 - protein, 8 aa, Entamoeba invadens
EKKTVKEL

SEQ ID NO: 2851881 - protein, 9 aa, Entamoeba invadens
EKKTYGTKY

SEQ ID NO: 2851882 - protein, 9 aa, Entamoeba invadens
EKKVEGDTD

SEQ ID NO: 2851883 - protein, 5 aa, Entamoeba invadens
EKKVK

SEQ ID NO: 2851884 - protein, 15 aa, Entamoeba invadens
EKKVKELKEGERPIL

SEQ ID NO: 2851885 - protein, 12 aa, Entamoeba invadens
EKKVTESDEDKY

SEQ ID NO: 2851886 - protein, 10 aa, Entamoeba invadens
EKKYGKTTQF

SEQ ID NO: 2851887 - protein, 7 aa, Entamoeba invadens
EKKYNDT

SEQ ID NO: 2851888 - protein, 4 aa, Entamoeba invadens
EKLA

SEQ ID NO: 2851889 - protein, 6 aa, Entamoeba invadens
EKLAES

SEQ ID NO: 2851890 - protein, 20 aa, Entamoeba invadens
EKLAQSPEQQEEKTQPEKRV

SEQ ID NO: 2851891 - protein, 11 aa, Entamoeba invadens
EKLARKLNNED

SEQ ID NO: 2851892 - protein, 19 aa, Entamoeba invadens
EKLDEDRRRENNEKTIQQS

SEQ ID NO: 2851893 - protein, 7 aa, Entamoeba invadens
EKLDGVD

SEQ ID NO: 2851894 - protein, 6 aa, Entamoeba invadens
EKLDST

SEQ ID NO: 2851895 - protein, 20 aa, Entamoeba invadens
EKLEDSKTQRSDLKPIRKPV

SEQ ID NO: 2851896 - protein, 6 aa, Entamoeba invadens
EKLEED

SEQ ID NO: 2851897 - protein, 16 aa, Entamoeba invadens
EKLEEDEKAKKERDER

SEQ ID NO: 2851898 - protein, 7 aa, Entamoeba invadens
EKLEEKL

SEQ ID NO: 2851899 - protein, 18 aa, Entamoeba invadens
EKLEETQKKCDTQEEQLN

SEQ ID NO: 2851900 - protein, 31 aa, Entamoeba invadens
EKLEKEKVKAQKAEKDVKAPKTRKSSKIEKF

SEQ ID NO: 2851901 - protein, 38 aa, Entamoeba invadens
EKLENDTKDVQQKINDKNAEIQKVQGDVDKTQTEIKAK

SEQ ID NO: 2851902 - protein, 70 aa, Entamoeba invadens
EKLEQERLEQEKREQERIAKEKAEKEEQERREKERIEAERIAQEKAEAERLENERLAKEKAEKEEAERIA

SEQ ID NO: 2851903 - protein, 45 aa, Entamoeba invadens
EKLESGKSQEEKAADKEEKAEKASRVTVSSSTFTALPTSSDLPEI

SEQ ID NO: 2851904 - protein, 7 aa, Entamoeba invadens
EKLGEGG

SEQ ID NO: 2851905 - protein, 7 aa, Entamoeba invadens
EKLGEGS

SEQ ID NO: 2851906 - protein, 11 aa, Entamoeba invadens
EKLGQTSKVGK

SEQ ID NO: 2851907 - protein, 26 aa, Entamoeba invadens
EKLISASKRRSFEYGKESKTVTGKNE

SEQ ID NO: 2851908 - protein, 8 aa, Entamoeba invadens
EKLKEDGI

SEQ ID NO: 2851909 - protein, 66 aa, Entamoeba invadens
EKLKEETESLKSQLQSEKDRADGLDKKLTDEKTRTDDLDKKLQSEKDRADENTTKYTSEKDRADGL

SEQ ID NO: 2851910 - protein, 6 aa, Entamoeba invadens
EKLKEN

SEQ ID NO: 2851911 - protein, 19 aa, Entamoeba invadens
EKLKGGKTKINKKHSAADR

SEQ ID NO: 2851912 - protein, 26 aa, Entamoeba invadens
EKLKKDKEEEERLAKEEKEKELAEEA

SEQ ID NO: 2851913 - protein, 20 aa, Entamoeba invadens
EKLKKDVEVRQKVNDEETIE

SEQ ID NO: 2851914 - protein, 28 aa, Entamoeba invadens
EKLKNELEKNKEDDEKTENDLKELKGEI

SEQ ID NO: 2851915 - protein, 10 aa, Entamoeba invadens
EKLNKGSELI

SEQ ID NO: 2851916 - protein, 13 aa, Entamoeba invadens
EKLNNEKTEIEEV

SEQ ID NO: 2851917 - protein, 14 aa, Entamoeba invadens
EKLNSSKDDVRTEA

SEQ ID NO: 2851918 - protein, 5 aa, Entamoeba invadens
EKLNT

SEQ ID NO: 2851919 - protein, 10 aa, Entamoeba invadens
EKLNYTGDTA

SEQ ID NO: 2851920 - protein, 4 aa, Entamoeba invadens
EKLP

SEQ ID NO: 2851921 - protein, 7 aa, Entamoeba invadens
EKLPPER

SEQ ID NO: 2851922 - protein, 8 aa, Entamoeba invadens
EKLPPKKV

SEQ ID NO: 2851923 - protein, 39 aa, Entamoeba invadens
EKLPSKIEKVQNRVQQSAPTQCTKSPSPKLQPKQTHPFQ

SEQ ID NO: 2851924 - protein, 11 aa, Entamoeba invadens
EKLPTGKYPKD

SEQ ID NO: 2851925 - protein, 6 aa, Entamoeba invadens
EKLQEV

SEQ ID NO: 2851926 - protein, 14 aa, Entamoeba invadens
EKLQHEKSVEQLER

SEQ ID NO: 2851927 - protein, 14 aa, Entamoeba invadens
EKLQKKEEKLEKER

SEQ ID NO: 2851928 - protein, 8 aa, Entamoeba invadens
EKLQTSIN

SEQ ID NO: 2851929 - protein, 6 aa, Entamoeba invadens
EKLRAM

SEQ ID NO: 2851930 - protein, 14 aa, Entamoeba invadens
EKLRDEKQKETNVQ

SEQ ID NO: 2851931 - protein, 12 aa, Entamoeba invadens
EKLRKDSSGKKL

SEQ ID NO: 2851932 - protein, 9 aa, Entamoeba invadens
EKLSEQEVD

SEQ ID NO: 2851933 - protein, 8 aa, Entamoeba invadens
EKLSGDTF

SEQ ID NO: 2851934 - protein, 10 aa, Entamoeba invadens
EKLSNDKNEV

SEQ ID NO: 2851935 - protein, 19 aa, Entamoeba invadens
EKLSSDHRNIEKVEDKEMN

SEQ ID NO: 2851936 - protein, 10 aa, Entamoeba invadens
EKLSTDKPHQ

SEQ ID NO: 2851937 - protein, 4 aa, Entamoeba invadens
EKLT

SEQ ID NO: 2851938 - protein, 23 aa, Entamoeba invadens
EKLTNTEQQKEEIDKQKTEIEEK

SEQ ID NO: 2851939 - protein, 29 aa, Entamoeba invadens
EKMDEDKGLEGTKSQPMETQQEKMEETPS

SEQ ID NO: 2851940 - protein, 9 aa, Entamoeba invadens
EKMDESEDV

SEQ ID NO: 2851941 - protein, 10 aa, Entamoeba invadens
EKMDKDESMP

SEQ ID NO: 2851942 - protein, 6 aa, Entamoeba invadens
EKMDLK

SEQ ID NO: 2851943 - protein, 13 aa, Entamoeba invadens
EKMEDKVKELDNY

SEQ ID NO: 2851944 - protein, 7 aa, Entamoeba invadens
EKMEKPQ

SEQ ID NO: 2851945 - protein, 18 aa, Entamoeba invadens
EKMENFDDDEIEKQIEKD

SEQ ID NO: 2851946 - protein, 6 aa, Entamoeba invadens
EKMENW

SEQ ID NO: 2851947 - protein, 6 aa, Entamoeba invadens
EKMGKL

SEQ ID NO: 2851948 - protein, 20 aa, Entamoeba invadens
EKMGTQGLKTKEEPKRNVTE

SEQ ID NO: 2851949 - protein, 39 aa, Entamoeba invadens
EKMKEQITHENGSKEFQENEPVQEKSIEKVKEKKTKQVG

SEQ ID NO: 2851950 - protein, 48 aa, Entamoeba invadens
EKMKNEKKTAEEDLKGELTKTTQTNKVLEKEKEEITKELNKTKEEKLK

SEQ ID NO: 2851951 - protein, 22 aa, Entamoeba invadens
EKMKREEHEKEVEEERRRVENI

SEQ ID NO: 2851952 - protein, 13 aa, Entamoeba invadens
EKMNNKVEEQKDV

SEQ ID NO: 2851953 - protein, 4 aa, Entamoeba invadens
EKMP

SEQ ID NO: 2851954 - protein, 6 aa, Entamoeba invadens
EKMPNR

SEQ ID NO: 2851955 - protein, 5 aa, Entamoeba invadens
EKMPT

SEQ ID NO: 2851956 - protein, 10 aa, Entamoeba invadens
EKMQYRKEND

SEQ ID NO: 2851957 - protein, 7 aa, Entamoeba invadens
EKMRKEG

SEQ ID NO: 2851958 - protein, 42 aa, Entamoeba invadens
EKMRNDYESKIKSLKESNDTLSSEVSENKDLCEKNQKRNKEL

SEQ ID NO: 2851959 - protein, 7 aa, Entamoeba invadens
EKMSPKD

SEQ ID NO: 2851960 - protein, 6 aa, Entamoeba invadens
EKMSTR

SEQ ID NO: 2851961 - protein, 7 aa, Entamoeba invadens
EKMTGKK

SEQ ID NO: 2851962 - protein, 14 aa, Entamoeba invadens
EKMTNEKEKMQNNI

SEQ ID NO: 2851963 - protein, 6 aa, Entamoeba invadens
EKMTQR

SEQ ID NO: 2851964 - protein, 6 aa, Entamoeba invadens
EKMYTA

SEQ ID NO: 2851965 - protein, 5 aa, Entamoeba invadens
EKNAF

SEQ ID NO: 2851966 - protein, 9 aa, Entamoeba invadens
EKNAGPKID

SEQ ID NO: 2851967 - protein, 9 aa, Entamoeba invadens
EKNDAIDQM

SEQ ID NO: 2851968 - protein, 15 aa, Entamoeba invadens
EKNDEKGTITQTNGF

SEQ ID NO: 2851969 - protein, 6 aa, Entamoeba invadens
EKNDFK

SEQ ID NO: 2851970 - protein, 7 aa, Entamoeba invadens
EKNDMKE

SEQ ID NO: 2851971 - protein, 9 aa, Entamoeba invadens
EKNDNGNYF

SEQ ID NO: 2851972 - protein, 12 aa, Entamoeba invadens
EKNDPRLMLTKT

SEQ ID NO: 2851973 - protein, 9 aa, Entamoeba invadens
EKNDPTGDS

SEQ ID NO: 2851974 - protein, 29 aa, Entamoeba invadens
EKNDSVDSRSGSGSKAGSKSRSQSLSGSV

SEQ ID NO: 2851975 - protein, 29 aa, Entamoeba invadens
EKNDSVDSRSGSGSKAGSKSRSQSPSGSV

SEQ ID NO: 2851976 - protein, 8 aa, Entamoeba invadens
EKNEDDIK

SEQ ID NO: 2851977 - protein, 8 aa, Entamoeba invadens
EKNEDDVK

SEQ ID NO: 2851978 - protein, 8 aa, Entamoeba invadens
EKNEDEVK

SEQ ID NO: 2851979 - protein, 12 aa, Entamoeba invadens
EKNEEKKSFVTD

SEQ ID NO: 2851980 - protein, 7 aa, Entamoeba invadens
EKNEELK

SEQ ID NO: 2851981 - protein, 8 aa, Entamoeba invadens
EKNEGGLS

SEQ ID NO: 2851982 - protein, 8 aa, Entamoeba invadens
EKNEIENK

SEQ ID NO: 2851983 - protein, 5 aa, Entamoeba invadens
EKNEK

SEQ ID NO: 2851984 - protein, 17 aa, Entamoeba invadens
EKNEKIDKTEKNEKSVK

SEQ ID NO: 2851985 - protein, 9 aa, Entamoeba invadens
EKNEKTKEI

SEQ ID NO: 2851986 - protein, 8 aa, Entamoeba invadens
EKNEKVPN

SEQ ID NO: 2851987 - protein, 5 aa, Entamoeba invadens
EKNEN

SEQ ID NO: 2851988 - protein, 7 aa, Entamoeba invadens
EKNENGY

SEQ ID NO: 2851989 - protein, 11 aa, Entamoeba invadens
EKNENSENKGV

SEQ ID NO: 2851990 - protein, 7 aa, Entamoeba invadens
EKNENVG

SEQ ID NO: 2851991 - protein, 6 aa, Entamoeba invadens
EKNEPI

SEQ ID NO: 2851992 - protein, 36 aa, Entamoeba invadens
EKNESDESDEESEEEYDDMDNEENDNPNNQNNKGNK

SEQ ID NO: 2851993 - protein, 6 aa, Entamoeba invadens
EKNESL

SEQ ID NO: 2851994 - protein, 8 aa, Entamoeba invadens
EKNETEWD

SEQ ID NO: 2851995 - protein, 5 aa, Entamoeba invadens
EKNEV

SEQ ID NO: 2851996 - protein, 9 aa, Entamoeba invadens
EKNEYTQGE

SEQ ID NO: 2851997 - protein, 4 aa, Entamoeba invadens
EKNF

SEQ ID NO: 2851998 - protein, 5 aa, Entamoeba invadens
EKNFY

SEQ ID NO: 2851999 - protein, 4 aa, Entamoeba invadens
EKNG

SEQ ID NO: 2852000 - protein, 12 aa, Entamoeba invadens
EKNGDDRAREIG

SEQ ID NO: 2852001 - protein, 8 aa, Entamoeba invadens
EKNGGKTM

SEQ ID NO: 2852002 - protein, 10 aa, Entamoeba invadens
EKNGGPLSTN

SEQ ID NO: 2852003 - protein, 10 aa, Entamoeba invadens
EKNGLTSDQL

SEQ ID NO: 2852004 - protein, 35 aa, Entamoeba invadens
EKNGVDRYNPPWSTKYPSLSRLPKTNEELKKPENQ

SEQ ID NO: 2852005 - protein, 9 aa, Entamoeba invadens
EKNGYVSAT

SEQ ID NO: 2852006 - protein, 11 aa, Entamoeba invadens
EKNHKKTMSRS

SEQ ID NO: 2852007 - protein, 19 aa, Entamoeba invadens
EKNHKKTMSRSQTGLPLPN

SEQ ID NO: 2852008 - protein, 4 aa, Entamoeba invadens
EKNI

SEQ ID NO: 2852009 - protein, 16 aa, Entamoeba invadens
EKNIKEQKELATEQRI

SEQ ID NO: 2852010 - protein, 19 aa, Entamoeba invadens
EKNIKEQNELATEQRISSV

SEQ ID NO: 2852011 - protein, 14 aa, Entamoeba invadens
EKNIKGRNRKQCRE

SEQ ID NO: 2852012 - protein, 25 aa, Entamoeba invadens
EKNKEQYEKRGISHAKDFSDAEEKV

SEQ ID NO: 2852013 - protein, 9 aa, Entamoeba invadens
EKNKETEVK

SEQ ID NO: 2852014 - protein, 14 aa, Entamoeba invadens
EKNKETLQKWTGKS

SEQ ID NO: 2852015 - protein, 11 aa, Entamoeba invadens
EKNKKDVRITP

SEQ ID NO: 2852016 - protein, 8 aa, Entamoeba invadens
EKNKKENV

SEQ ID NO: 2852017 - protein, 12 aa, Entamoeba invadens
EKNKPPKPEMQA

SEQ ID NO: 2852018 - protein, 21 aa, Entamoeba invadens
EKNKTKTKPLTDEHHENKPQN

SEQ ID NO: 2852019 - protein, 9 aa, Entamoeba invadens
EKNKTRALV

SEQ ID NO: 2852020 - protein, 4 aa, Entamoeba invadens
EKNL

SEQ ID NO: 2852021 - protein, 8 aa, Entamoeba invadens
EKNLENTH

SEQ ID NO: 2852022 - protein, 14 aa, Entamoeba invadens
EKNMEDQAKALNAQ

SEQ ID NO: 2852023 - protein, 15 aa, Entamoeba invadens
EKNMKEKNWNGGENL

SEQ ID NO: 2852024 - protein, 14 aa, Entamoeba invadens
EKNMTKQEKPKVVR

SEQ ID NO: 2852025 - protein, 11 aa, Entamoeba invadens
EKNNEGRGDEN

SEQ ID NO: 2852026 - protein, 7 aa, Entamoeba invadens
EKNNFSK

SEQ ID NO: 2852027 - protein, 7 aa, Entamoeba invadens
EKNNPLA

SEQ ID NO: 2852028 - protein, 4 aa, Entamoeba invadens
EKNP

SEQ ID NO: 2852029 - protein, 6 aa, Entamoeba invadens
EKNPDY

SEQ ID NO: 2852030 - protein, 13 aa, Entamoeba invadens
EKNPGKEEMSNAQ

SEQ ID NO: 2852031 - protein, 24 aa, Entamoeba invadens
EKNPGRLQNSGYRRSARIDARLSM

SEQ ID NO: 2852032 - protein, 7 aa, Entamoeba invadens
EKNPNGL

SEQ ID NO: 2852033 - protein, 13 aa, Entamoeba invadens
EKNPNNEKTTVFQ

SEQ ID NO: 2852034 - protein, 13 aa, Entamoeba invadens
EKNPSEGKDTERI

SEQ ID NO: 2852035 - protein, 10 aa, Entamoeba invadens
EKNPSQIGAQ

SEQ ID NO: 2852036 - protein, 8 aa, Entamoeba invadens
EKNPTKRL

SEQ ID NO: 2852037 - protein, 9 aa, Entamoeba invadens
EKNPTRKPF

SEQ ID NO: 2852038 - protein, 9 aa, Entamoeba invadens
EKNRTEKVL

SEQ ID NO: 2852039 - protein, 4 aa, Entamoeba invadens
EKNS

SEQ ID NO: 2852040 - protein, 9 aa, Entamoeba invadens
EKNSAREKI

SEQ ID NO: 2852041 - protein, 5 aa, Entamoeba invadens
EKNSD

SEQ ID NO: 2852042 - protein, 19 aa, Entamoeba invadens
EKNSDEKGKKFNITKSGEK

SEQ ID NO: 2852043 - protein, 9 aa, Entamoeba invadens
EKNSIKPNR

SEQ ID NO: 2852044 - protein, 16 aa, Entamoeba invadens
EKNSLFSPPENKYIER

SEQ ID NO: 2852045 - protein, 10 aa, Entamoeba invadens
EKNSNFNKTA

SEQ ID NO: 2852046 - protein, 8 aa, Entamoeba invadens
EKNSNGSY

SEQ ID NO: 2852047 - protein, 5 aa, Entamoeba invadens
EKNSV

SEQ ID NO: 2852048 - protein, 4 aa, Entamoeba invadens
EKNT

SEQ ID NO: 2852049 - protein, 11 aa, Entamoeba invadens
EKNTADNKEIQ

SEQ ID NO: 2852050 - protein, 19 aa, Entamoeba invadens
EKNTDDSDTKHQQSTLKRR

SEQ ID NO: 2852051 - protein, 6 aa, Entamoeba invadens
EKNTDI

SEQ ID NO: 2852052 - protein, 7 aa, Entamoeba invadens
EKNTKFN

SEQ ID NO: 2852053 - protein, 13 aa, Entamoeba invadens
EKNTQEAKEVSEA

SEQ ID NO: 2852054 - protein, 9 aa, Entamoeba invadens
EKNTTNLKT

SEQ ID NO: 2852055 - protein, 5 aa, Entamoeba invadens
EKNVE

SEQ ID NO: 2852056 - protein, 63 aa, Entamoeba invadens
EKNVRPAKKSTKSGKIAKKSISEKVEISDSAEEQPKSGKVSKKAISEAVESAPKVGKTGKVSK

SEQ ID NO: 2852057 - protein, 8 aa, Entamoeba invadens
EKNVYTNG

SEQ ID NO: 2852058 - protein, 9 aa, Entamoeba invadens
EKNWKSETL

SEQ ID NO: 2852059 - protein, 7 aa, Entamoeba invadens
EKNYKDR

SEQ ID NO: 2852060 - protein, 8 aa, Entamoeba invadens
EKNYKQSI

SEQ ID NO: 2852061 - protein, 20 aa, Entamoeba invadens
EKNYNTTIENEDTSPENRKS

SEQ ID NO: 2852062 - protein, 4 aa, Entamoeba invadens
EKPA

SEQ ID NO: 2852063 - protein, 8 aa, Entamoeba invadens
EKPARVEA

SEQ ID NO: 2852064 - protein, 7 aa, Entamoeba invadens
EKPDIQQ

SEQ ID NO: 2852065 - protein, 8 aa, Entamoeba invadens
EKPDSSDF

SEQ ID NO: 2852066 - protein, 6 aa, Entamoeba invadens
EKPEEA

SEQ ID NO: 2852067 - protein, 7 aa, Entamoeba invadens
EKPEELG

SEQ ID NO: 2852068 - protein, 7 aa, Entamoeba invadens
EKPEKKM

SEQ ID NO: 2852069 - protein, 22 aa, Entamoeba invadens
EKPETHKPTIAQELSDTRMESK

SEQ ID NO: 2852070 - protein, 4 aa, Entamoeba invadens
EKPF

SEQ ID NO: 2852071 - protein, 19 aa, Entamoeba invadens
EKPHKQSPQPDRPVSTTKF

SEQ ID NO: 2852072 - protein, 18 aa, Entamoeba invadens
EKPIDKPVAEQTEEKFPS

SEQ ID NO: 2852073 - protein, 10 aa, Entamoeba invadens
EKPIELQPND

SEQ ID NO: 2852074 - protein, 5 aa, Entamoeba invadens
EKPIQ

SEQ ID NO: 2852075 - protein, 5 aa, Entamoeba invadens
EKPIT

SEQ ID NO: 2852076 - protein, 14 aa, Entamoeba invadens
EKPKEENEKSEEKK

SEQ ID NO: 2852077 - protein, 8 aa, Entamoeba invadens
EKPKKGRF

SEQ ID NO: 2852078 - protein, 8 aa, Entamoeba invadens
EKPKKKVM

SEQ ID NO: 2852079 - protein, 6 aa, Entamoeba invadens
EKPKNH

SEQ ID NO: 2852080 - protein, 16 aa, Entamoeba invadens
EKPKTAKVKEDKLKDL

SEQ ID NO: 2852081 - protein, 5 aa, Entamoeba invadens
EKPLP

SEQ ID NO: 2852082 - protein, 11 aa, Entamoeba invadens
EKPNQPNGTKM

SEQ ID NO: 2852083 - protein, 13 aa, Entamoeba invadens
EKPPKKSNVTQQI

SEQ ID NO: 2852084 - protein, 6 aa, Entamoeba invadens
EKPQCI

SEQ ID NO: 2852085 - protein, 11 aa, Entamoeba invadens
EKPQPGTDSTY

SEQ ID NO: 2852086 - protein, 4 aa, Entamoeba invadens
EKPR

SEQ ID NO: 2852087 - protein, 8 aa, Entamoeba invadens
EKPRIESD

SEQ ID NO: 2852088 - protein, 7 aa, Entamoeba invadens
EKPRNQF

SEQ ID NO: 2852089 - protein, 21 aa, Entamoeba invadens
EKPRSISKPLKIKKDKSSIGD

SEQ ID NO: 2852090 - protein, 14 aa, Entamoeba invadens
EKPSDETFKDSLGS

SEQ ID NO: 2852091 - protein, 11 aa, Entamoeba invadens
EKPSETQQQLS

SEQ ID NO: 2852092 - protein, 8 aa, Entamoeba invadens
EKPSGDGE

SEQ ID NO: 2852093 - protein, 7 aa, Entamoeba invadens
EKPSKIQ

SEQ ID NO: 2852094 - protein, 10 aa, Entamoeba invadens
EKPSKLPTKS

SEQ ID NO: 2852095 - protein, 6 aa, Entamoeba invadens
EKPSLD

SEQ ID NO: 2852096 - protein, 6 aa, Entamoeba invadens
EKPTLT

SEQ ID NO: 2852097 - protein, 8 aa, Entamoeba invadens
EKPTPVVG

SEQ ID NO: 2852098 - protein, 7 aa, Entamoeba invadens
EKPTYSI

SEQ ID NO: 2852099 - protein, 4 aa, Entamoeba invadens
EKPV

SEQ ID NO: 2852100 - protein, 9 aa, Entamoeba invadens
EKPVNDKTI

SEQ ID NO: 2852101 - protein, 14 aa, Entamoeba invadens
EKPVPIPAQNEEML

SEQ ID NO: 2852102 - protein, 9 aa, Entamoeba invadens
EKPWKKDPY

SEQ ID NO: 2852103 - protein, 11 aa, Entamoeba invadens
EKPYDGDHKIK

SEQ ID NO: 2852104 - protein, 7 aa, Entamoeba invadens
EKPYDPS

SEQ ID NO: 2852105 - protein, 25 aa, Entamoeba invadens
EKQAKQGSKHTHLSQSQSQPVDKSH

SEQ ID NO: 2852106 - protein, 4 aa, Entamoeba invadens
EKQC

SEQ ID NO: 2852107 - protein, 7 aa, Entamoeba invadens
EKQCGYT

SEQ ID NO: 2852108 - protein, 15 aa, Entamoeba invadens
EKQDKEKNLNEVQTD

SEQ ID NO: 2852109 - protein, 11 aa, Entamoeba invadens
EKQDKKSLEEL

SEQ ID NO: 2852110 - protein, 17 aa, Entamoeba invadens
EKQEELDDDTKKDIKVA

SEQ ID NO: 2852111 - protein, 20 aa, Entamoeba invadens
EKQEKSKTVGEPPKSGDSHT

SEQ ID NO: 2852112 - protein, 6 aa, Entamoeba invadens
EKQERK

SEQ ID NO: 2852113 - protein, 14 aa, Entamoeba invadens
EKQEVDINSKQTQI

SEQ ID NO: 2852114 - protein, 7 aa, Entamoeba invadens
EKQFPTD

SEQ ID NO: 2852115 - protein, 16 aa, Entamoeba invadens
EKQGDADKVSSSDRSA

SEQ ID NO: 2852116 - protein, 13 aa, Entamoeba invadens
EKQGIQGKTEATL

SEQ ID NO: 2852117 - protein, 7 aa, Entamoeba invadens
EKQGNIA

SEQ ID NO: 2852118 - protein, 16 aa, Entamoeba invadens
EKQHENREENGQWTNT

SEQ ID NO: 2852119 - protein, 16 aa, Entamoeba invadens
EKQIDEEKKDAAKQLA

SEQ ID NO: 2852120 - protein, 8 aa, Entamoeba invadens
EKQIPGSM

SEQ ID NO: 2852121 - protein, 14 aa, Entamoeba invadens
EKQIPNFEEGETVD

SEQ ID NO: 2852122 - protein, 20 aa, Entamoeba invadens
EKQKAEKQRIKNEKKLETDF

SEQ ID NO: 2852123 - protein, 7 aa, Entamoeba invadens
EKQKEEA

SEQ ID NO: 2852124 - protein, 11 aa, Entamoeba invadens
EKQKKKEIKVE

SEQ ID NO: 2852125 - protein, 7 aa, Entamoeba invadens
EKQKLEE

SEQ ID NO: 2852126 - protein, 5 aa, Entamoeba invadens
EKQKM

SEQ ID NO: 2852127 - protein, 7 aa, Entamoeba invadens
EKQKNPI

SEQ ID NO: 2852128 - protein, 10 aa, Entamoeba invadens
EKQKQMEEER

SEQ ID NO: 2852129 - protein, 13 aa, Entamoeba invadens
EKQKQRKDDAQKY

SEQ ID NO: 2852130 - protein, 8 aa, Entamoeba invadens
EKQKSDSS

SEQ ID NO: 2852131 - protein, 35 aa, Entamoeba invadens
EKQKVSDKETPPENKTEELKTEKLEEKEPKDASKM

SEQ ID NO: 2852132 - protein, 14 aa, Entamoeba invadens
EKQKYKNKNYVQDD

SEQ ID NO: 2852133 - protein, 29 aa, Entamoeba invadens
EKQLEKSEAKLEKKKAEIEKKKKKMQEEA

SEQ ID NO: 2852134 - protein, 8 aa, Entamoeba invadens
EKQLGEGS

SEQ ID NO: 2852135 - protein, 9 aa, Entamoeba invadens
EKQLPGSMK

SEQ ID NO: 2852136 - protein, 9 aa, Entamoeba invadens
EKQLQGQEF

SEQ ID NO: 2852137 - protein, 4 aa, Entamoeba invadens
EKQN

SEQ ID NO: 2852138 - protein, 16 aa, Entamoeba invadens
EKQNDEKKNNEKRPTL

SEQ ID NO: 2852139 - protein, 11 aa, Entamoeba invadens
EKQNDGIEKNV

SEQ ID NO: 2852140 - protein, 9 aa, Entamoeba invadens
EKQNDKLKK

SEQ ID NO: 2852141 - protein, 11 aa, Entamoeba invadens
EKQNFENENNE

SEQ ID NO: 2852142 - protein, 10 aa, Entamoeba invadens
EKQNKSRKTN

SEQ ID NO: 2852143 - protein, 18 aa, Entamoeba invadens
EKQNKTQTRTAKDTKKLS

SEQ ID NO: 2852144 - protein, 6 aa, Entamoeba invadens
EKQNPL

SEQ ID NO: 2852145 - protein, 6 aa, Entamoeba invadens
EKQNQT

SEQ ID NO: 2852146 - protein, 33 aa, Entamoeba invadens
EKQNRVPAQTVNSKKSKAAFQDKTQQSQNDKDK

SEQ ID NO: 2852147 - protein, 18 aa, Entamoeba invadens
EKQPISNLTQSKGPQNIE

SEQ ID NO: 2852148 - protein, 8 aa, Entamoeba invadens
EKQPPGIA

SEQ ID NO: 2852149 - protein, 11 aa, Entamoeba invadens
EKQPRKEGEEF

SEQ ID NO: 2852150 - protein, 7 aa, Entamoeba invadens
EKQQDDF

SEQ ID NO: 2852151 - protein, 15 aa, Entamoeba invadens
EKQQFRDNSGVEEIP

SEQ ID NO: 2852152 - protein, 13 aa, Entamoeba invadens
EKQQLDKKKHIGN

SEQ ID NO: 2852153 - protein, 10 aa, Entamoeba invadens
EKQQTDALKS

SEQ ID NO: 2852154 - protein, 7 aa, Entamoeba invadens
EKQRGEI

SEQ ID NO: 2852155 - protein, 10 aa, Entamoeba invadens
EKQRGELNDV

SEQ ID NO: 2852156 - protein, 19 aa, Entamoeba invadens
EKQRKRDEERKRREVERAK

SEQ ID NO: 2852157 - protein, 34 aa, Entamoeba invadens
EKQRRQKELQEKEDAERKKKAEEAAKEEAERQKS

SEQ ID NO: 2852158 - protein, 5 aa, Entamoeba invadens
EKQRT

SEQ ID NO: 2852159 - protein, 17 aa, Entamoeba invadens
EKQRTDVKSALSGVNNW

SEQ ID NO: 2852160 - protein, 9 aa, Entamoeba invadens
EKQRTRQLG

SEQ ID NO: 2852161 - protein, 14 aa, Entamoeba invadens
EKQRYEKELETNSF

SEQ ID NO: 2852162 - protein, 4 aa, Entamoeba invadens
EKQS

SEQ ID NO: 2852163 - protein, 10 aa, Entamoeba invadens
EKQSNSPTNS

SEQ ID NO: 2852164 - protein, 13 aa, Entamoeba invadens
EKQSSKKLPEDVR

SEQ ID NO: 2852165 - protein, 8 aa, Entamoeba invadens
EKQTGPAI

SEQ ID NO: 2852166 - protein, 5 aa, Entamoeba invadens
EKQTI

SEQ ID NO: 2852167 - protein, 9 aa, Entamoeba invadens
EKQTKKRVI

SEQ ID NO: 2852168 - protein, 13 aa, Entamoeba invadens
EKQTLDTQNNDFY

SEQ ID NO: 2852169 - protein, 6 aa, Entamoeba invadens
EKQTQN

SEQ ID NO: 2852170 - protein, 9 aa, Entamoeba invadens
EKQTTLPKG

SEQ ID NO: 2852171 - protein, 7 aa, Entamoeba invadens
EKQVDNN

SEQ ID NO: 2852172 - protein, 4 aa, Entamoeba invadens
EKQY

SEQ ID NO: 2852173 - protein, 20 aa, Entamoeba invadens
EKRAEVKEANPSLAPKDITK

SEQ ID NO: 2852174 - protein, 6 aa, Entamoeba invadens
EKRAFP

SEQ ID NO: 2852175 - protein, 8 aa, Entamoeba invadens
EKRAIEQV

SEQ ID NO: 2852176 - protein, 44 aa, Entamoeba invadens
EKRAMTNKNEDASTSAPETTKKRQSSQIDDGEELTTIAEKDDPK

SEQ ID NO: 2852177 - protein, 9 aa, Entamoeba invadens
EKRAPALAE

SEQ ID NO: 2852178 - protein, 7 aa, Entamoeba invadens
EKRDAPE

SEQ ID NO: 2852179 - protein, 5 aa, Entamoeba invadens
EKRDR

SEQ ID NO: 2852180 - protein, 20 aa, Entamoeba invadens
EKREAEKQRIENEKKLETDF

SEQ ID NO: 2852181 - protein, 20 aa, Entamoeba invadens
EKREAEKQRIKNEEKLKTDF

SEQ ID NO: 2852182 - protein, 26 aa, Entamoeba invadens
EKREALKQEKGELTEEDKLNLRDKNT

SEQ ID NO: 2852183 - protein, 8 aa, Entamoeba invadens
EKREEATR

SEQ ID NO: 2852184 - protein, 8 aa, Entamoeba invadens
EKREEDFG

SEQ ID NO: 2852185 - protein, 27 aa, Entamoeba invadens
EKREEQQEKEVLTQKQHQIEKTEQTIE

SEQ ID NO: 2852186 - protein, 27 aa, Entamoeba invadens
EKREERKDREDNNNDRTRRRQKGEDSS

SEQ ID NO: 2852187 - protein, 7 aa, Entamoeba invadens
EKREHSP

SEQ ID NO: 2852188 - protein, 5 aa, Entamoeba invadens
EKREK

SEQ ID NO: 2852189 - protein, 23 aa, Entamoeba invadens
EKREKSPRTIKKEVKDGKSTSPI

SEQ ID NO: 2852190 - protein, 20 aa, Entamoeba invadens
EKRESVKEDFPDLKGAEITK

SEQ ID NO: 2852191 - protein, 8 aa, Entamoeba invadens
EKRFTQEK

SEQ ID NO: 2852192 - protein, 13 aa, Entamoeba invadens
EKRGDEYFPVNYD

SEQ ID NO: 2852193 - protein, 9 aa, Entamoeba invadens
EKRGDKVEE

SEQ ID NO: 2852194 - protein, 13 aa, Entamoeba invadens
EKRGEEYFPVNYD

SEQ ID NO: 2852195 - protein, 7 aa, Entamoeba invadens
EKRGFTG

SEQ ID NO: 2852196 - protein, 11 aa, Entamoeba invadens
EKRGIGLTDND

SEQ ID NO: 2852197 - protein, 8 aa, Entamoeba invadens
EKRGINTE

SEQ ID NO: 2852198 - protein, 6 aa, Entamoeba invadens
EKRGMK

SEQ ID NO: 2852199 - protein, 30 aa, Entamoeba invadens
EKRIRYKSKALKKEDDEKKPFSSNRGDKKF

SEQ ID NO: 2852200 - protein, 11 aa, Entamoeba invadens
EKRKEAMEENR

SEQ ID NO: 2852201 - protein, 9 aa, Entamoeba invadens
EKRKELSEI

SEQ ID NO: 2852202 - protein, 7 aa, Entamoeba invadens
EKRKFEE

SEQ ID NO: 2852203 - protein, 9 aa, Entamoeba invadens
EKRKKEAAS

SEQ ID NO: 2852204 - protein, 32 aa, Entamoeba invadens
EKRKKEVEEQTRKEEEERKKAQFVEENERKEA

SEQ ID NO: 2852205 - protein, 15 aa, Entamoeba invadens
EKRKKRRSYREKGVN

SEQ ID NO: 2852206 - protein, 15 aa, Entamoeba invadens
EKRKLRKTNRGSIEP

SEQ ID NO: 2852207 - protein, 14 aa, Entamoeba invadens
EKRKPMKKSHHCTL

SEQ ID NO: 2852208 - protein, 31 aa, Entamoeba invadens
EKRKRIEDSRKERLEKQREIEENEDNERRPV

SEQ ID NO: 2852209 - protein, 16 aa, Entamoeba invadens
EKRKSNETIEERSQSQ

SEQ ID NO: 2852210 - protein, 7 aa, Entamoeba invadens
EKRKTEE

SEQ ID NO: 2852211 - protein, 8 aa, Entamoeba invadens
EKRLGEGS

SEQ ID NO: 2852212 - protein, 4 aa, Entamoeba invadens
EKRM

SEQ ID NO: 2852213 - protein, 8 aa, Entamoeba invadens
EKRNAGVK

SEQ ID NO: 2852214 - protein, 21 aa, Entamoeba invadens
EKRNKDYEETIDGKSKEIQQI

SEQ ID NO: 2852215 - protein, 6 aa, Entamoeba invadens
EKRNTP

SEQ ID NO: 2852216 - protein, 8 aa, Entamoeba invadens
EKRPPNVG

SEQ ID NO: 2852217 - protein, 14 aa, Entamoeba invadens
EKRQSKGNTVTDEL

SEQ ID NO: 2852218 - protein, 10 aa, Entamoeba invadens
EKRREAHKKS

SEQ ID NO: 2852219 - protein, 13 aa, Entamoeba invadens
EKRREQNRPKIDV

SEQ ID NO: 2852220 - protein, 7 aa, Entamoeba invadens
EKRREVK

SEQ ID NO: 2852221 - protein, 18 aa, Entamoeba invadens
EKRRLEEEEDERLEREAA

SEQ ID NO: 2852222 - protein, 15 aa, Entamoeba invadens
EKRRSQISESKEEMA

SEQ ID NO: 2852223 - protein, 6 aa, Entamoeba invadens
EKRRVK

SEQ ID NO: 2852224 - protein, 12 aa, Entamoeba invadens
EKRRYTTFDTTK

SEQ ID NO: 2852225 - protein, 4 aa, Entamoeba invadens
EKRS

SEQ ID NO: 2852226 - protein, 10 aa, Entamoeba invadens
EKRSAIEARN

SEQ ID NO: 2852227 - protein, 10 aa, Entamoeba invadens
EKRSNGAFTS

SEQ ID NO: 2852228 - protein, 11 aa, Entamoeba invadens
EKRSQEMKSAD

SEQ ID NO: 2852229 - protein, 27 aa, Entamoeba invadens
EKRSTGKIKKVGKKEDRMSGDVPSLPE

SEQ ID NO: 2852230 - protein, 5 aa, Entamoeba invadens
EKRTL

SEQ ID NO: 2852231 - protein, 19 aa, Entamoeba invadens
EKRTNPELCPTKTKPLQTP

SEQ ID NO: 2852232 - protein, 12 aa, Entamoeba invadens
EKRTPETATREI

SEQ ID NO: 2852233 - protein, 8 aa, Entamoeba invadens
EKRTSEEM

SEQ ID NO: 2852234 - protein, 4 aa, Entamoeba invadens
EKRV

SEQ ID NO: 2852235 - protein, 10 aa, Entamoeba invadens
EKRVESSKRR

SEQ ID NO: 2852236 - protein, 8 aa, Entamoeba invadens
EKRVPHNE

SEQ ID NO: 2852237 - protein, 6 aa, Entamoeba invadens
EKRWSA

SEQ ID NO: 2852238 - protein, 6 aa, Entamoeba invadens
EKRYSI

SEQ ID NO: 2852239 - protein, 7 aa, Entamoeba invadens
EKSAATK

SEQ ID NO: 2852240 - protein, 8 aa, Entamoeba invadens
EKSAATKV

SEQ ID NO: 2852241 - protein, 9 aa, Entamoeba invadens
EKSAEKHKL

SEQ ID NO: 2852242 - protein, 7 aa, Entamoeba invadens
EKSAERD

SEQ ID NO: 2852243 - protein, 16 aa, Entamoeba invadens
EKSAKRKANGDSAPTC

SEQ ID NO: 2852244 - protein, 9 aa, Entamoeba invadens
EKSAPQTEG

SEQ ID NO: 2852245 - protein, 13 aa, Entamoeba invadens
EKSCDKIEEAVSE

SEQ ID NO: 2852246 - protein, 26 aa, Entamoeba invadens
EKSDDLDEEEIEKRVQEELEREKSQL

SEQ ID NO: 2852247 - protein, 7 aa, Entamoeba invadens
EKSDEVF

SEQ ID NO: 2852248 - protein, 8 aa, Entamoeba invadens
EKSDGGEY

SEQ ID NO: 2852249 - protein, 5 aa, Entamoeba invadens
EKSDI

SEQ ID NO: 2852250 - protein, 7 aa, Entamoeba invadens
EKSDNVK

SEQ ID NO: 2852251 - protein, 4 aa, Entamoeba invadens
EKSE

SEQ ID NO: 2852252 - protein, 22 aa, Entamoeba invadens
EKSEAKKLDEEAEKTKSDAERY

SEQ ID NO: 2852253 - protein, 9 aa, Entamoeba invadens
EKSEELTRV

SEQ ID NO: 2852254 - protein, 11 aa, Entamoeba invadens
EKSEENAHSTI

SEQ ID NO: 2852255 - protein, 7 aa, Entamoeba invadens
EKSEISR

SEQ ID NO: 2852256 - protein, 7 aa, Entamoeba invadens
EKSEKGW

SEQ ID NO: 2852257 - protein, 40 aa, Entamoeba invadens
EKSEKVDESPKTGKVGKVSKKVATEKSETPRVGKVGKVSK

SEQ ID NO: 2852258 - protein, 9 aa, Entamoeba invadens
EKSENFGNT

SEQ ID NO: 2852259 - protein, 8 aa, Entamoeba invadens
EKSENYVR

SEQ ID NO: 2852260 - protein, 10 aa, Entamoeba invadens
EKSEQNNRSV

SEQ ID NO: 2852261 - protein, 18 aa, Entamoeba invadens
EKSEQTNISVDQKQNSCC

SEQ ID NO: 2852262 - protein, 8 aa, Entamoeba invadens
EKSESLDA

SEQ ID NO: 2852263 - protein, 8 aa, Entamoeba invadens
EKSESTLS

SEQ ID NO: 2852264 - protein, 4 aa, Entamoeba invadens
EKSF

SEQ ID NO: 2852265 - protein, 11 aa, Entamoeba invadens
EKSFKEKEQHL

SEQ ID NO: 2852266 - protein, 9 aa, Entamoeba invadens
EKSFQSQQQ

SEQ ID NO: 2852267 - protein, 8 aa, Entamoeba invadens
EKSGAYVE

SEQ ID NO: 2852268 - protein, 14 aa, Entamoeba invadens
EKSGCGKTNLNDSG

SEQ ID NO: 2852269 - protein, 6 aa, Entamoeba invadens
EKSGEN

SEQ ID NO: 2852270 - protein, 7 aa, Entamoeba invadens
EKSGGEK

SEQ ID NO: 2852271 - protein, 34 aa, Entamoeba invadens
EKSGIDDEKLSDKDNSSTSSPDAQPDNVANQPIT

SEQ ID NO: 2852272 - protein, 8 aa, Entamoeba invadens
EKSGLGKY

SEQ ID NO: 2852273 - protein, 9 aa, Entamoeba invadens
EKSGNNEEI

SEQ ID NO: 2852274 - protein, 8 aa, Entamoeba invadens
EKSGSKPV

SEQ ID NO: 2852275 - protein, 7 aa, Entamoeba invadens
EKSGSYQ

SEQ ID NO: 2852276 - protein, 9 aa, Entamoeba invadens
EKSHENVPT

SEQ ID NO: 2852277 - protein, 8 aa, Entamoeba invadens
EKSHHDQD

SEQ ID NO: 2852278 - protein, 14 aa, Entamoeba invadens
EKSHNEEIKRQEES

SEQ ID NO: 2852279 - protein, 4 aa, Entamoeba invadens
EKSI

SEQ ID NO: 2852280 - protein, 4 aa, Entamoeba invadens
EKSK

SEQ ID NO: 2852281 - protein, 5 aa, Entamoeba invadens
EKSKD

SEQ ID NO: 2852282 - protein, 18 aa, Entamoeba invadens
EKSKDKEHHVKGQSEHYH

SEQ ID NO: 2852283 - protein, 6 aa, Entamoeba invadens
EKSKEA

SEQ ID NO: 2852284 - protein, 10 aa, Entamoeba invadens
EKSKEKRGEI

SEQ ID NO: 2852285 - protein, 13 aa, Entamoeba invadens
EKSKENADAGQVQ

SEQ ID NO: 2852286 - protein, 29 aa, Entamoeba invadens
EKSKEYSKECCKEEEKGGKAQITSQKTVP

SEQ ID NO: 2852287 - protein, 8 aa, Entamoeba invadens
EKSKHAET

SEQ ID NO: 2852288 - protein, 10 aa, Entamoeba invadens
EKSKKKKRID

SEQ ID NO: 2852289 - protein, 26 aa, Entamoeba invadens
EKSKKNSEVVESPSAPAASPQLPKTP

SEQ ID NO: 2852290 - protein, 8 aa, Entamoeba invadens
EKSKMNAN

SEQ ID NO: 2852291 - protein, 18 aa, Entamoeba invadens
EKSKNDTSGTNQFTNENW

SEQ ID NO: 2852292 - protein, 7 aa, Entamoeba invadens
EKSKNMT

SEQ ID NO: 2852293 - protein, 10 aa, Entamoeba invadens
EKSKNYGEEI

SEQ ID NO: 2852294 - protein, 7 aa, Entamoeba invadens
EKSKPIG

SEQ ID NO: 2852295 - protein, 8 aa, Entamoeba invadens
EKSKQQKI

SEQ ID NO: 2852296 - protein, 38 aa, Entamoeba invadens
EKSKTKLEGDLEEKNKTLSSLESKAKEIDQSKTENEEM

SEQ ID NO: 2852297 - protein, 5 aa, Entamoeba invadens
EKSKW

SEQ ID NO: 2852298 - protein, 10 aa, Entamoeba invadens
EKSLDSENVG

SEQ ID NO: 2852299 - protein, 23 aa, Entamoeba invadens
EKSLETKKKQISINGTLDEEEVS

SEQ ID NO: 2852300 - protein, 7 aa, Entamoeba invadens
EKSLGTT

SEQ ID NO: 2852301 - protein, 10 aa, Entamoeba invadens
EKSLNKHEEV

SEQ ID NO: 2852302 - protein, 19 aa, Entamoeba invadens
EKSLVGAKGKLTLKGYTPG

SEQ ID NO: 2852303 - protein, 21 aa, Entamoeba invadens
EKSMEASKRWYGSGAEGRRNE

SEQ ID NO: 2852304 - protein, 4 aa, Entamoeba invadens
EKSN

SEQ ID NO: 2852305 - protein, 8 aa, Entamoeba invadens
EKSNDEKK

SEQ ID NO: 2852306 - protein, 11 aa, Entamoeba invadens
EKSNEPTLENQ

SEQ ID NO: 2852307 - protein, 9 aa, Entamoeba invadens
EKSNTPTPF

SEQ ID NO: 2852308 - protein, 8 aa, Entamoeba invadens
EKSNTTVI

SEQ ID NO: 2852309 - protein, 9 aa, Entamoeba invadens
EKSNVETLQ

SEQ ID NO: 2852310 - protein, 5 aa, Entamoeba invadens
EKSPI

SEQ ID NO: 2852311 - protein, 8 aa, Entamoeba invadens
EKSPKQIN

SEQ ID NO: 2852312 - protein, 6 aa, Entamoeba invadens
EKSPNM

SEQ ID NO: 2852313 - protein, 7 aa, Entamoeba invadens
EKSPRES

SEQ ID NO: 2852314 - protein, 49 aa, Entamoeba invadens
EKSPRNLKGDEKMVQSSPNQKLQSDTPIERKNSTGSLHMPSPSAPPINP

SEQ ID NO: 2852315 - protein, 8 aa, Entamoeba invadens
EKSPVSSA

SEQ ID NO: 2852316 - protein, 8 aa, Entamoeba invadens
EKSQTLDK

SEQ ID NO: 2852317 - protein, 39 aa, Entamoeba invadens
EKSQTLDKYERVKDENKRVKNKNESLKKNINEMSEETNI

SEQ ID NO: 2852318 - protein, 5 aa, Entamoeba invadens
EKSQV

SEQ ID NO: 2852319 - protein, 15 aa, Entamoeba invadens
EKSRCDKELATNTLR

SEQ ID NO: 2852320 - protein, 10 aa, Entamoeba invadens
EKSREKRQEK

SEQ ID NO: 2852321 - protein, 20 aa, Entamoeba invadens
EKSRETSKRKLHESFDEKGY

SEQ ID NO: 2852322 - protein, 7 aa, Entamoeba invadens
EKSRTQL

SEQ ID NO: 2852323 - protein, 62 aa, Entamoeba invadens
EKSSELNDRRGFGPRRSGRGSGYGGRRNGGGRFGGRDRRYEKKDDEYDVNRSVSTPIRPHFT

SEQ ID NO: 2852324 - protein, 7 aa, Entamoeba invadens
EKSSKGC

SEQ ID NO: 2852325 - protein, 5 aa, Entamoeba invadens
EKSSP

SEQ ID NO: 2852326 - protein, 12 aa, Entamoeba invadens
EKSSPSSDRQQF

SEQ ID NO: 2852327 - protein, 19 aa, Entamoeba invadens
EKSSQQEIEELKAQKKAIR

SEQ ID NO: 2852328 - protein, 5 aa, Entamoeba invadens
EKSSS

SEQ ID NO: 2852329 - protein, 15 aa, Entamoeba invadens
EKSSTNDLDTSGIDT

SEQ ID NO: 2852330 - protein, 5 aa, Entamoeba invadens
EKSSV

SEQ ID NO: 2852331 - protein, 4 aa, Entamoeba invadens
EKST

SEQ ID NO: 2852332 - protein, 11 aa, Entamoeba invadens
EKSTDEKRKKN

SEQ ID NO: 2852333 - protein, 7 aa, Entamoeba invadens
EKSTDNE

SEQ ID NO: 2852334 - protein, 8 aa, Entamoeba invadens
EKSTEQTV

SEQ ID NO: 2852335 - protein, 7 aa, Entamoeba invadens
EKSTKHI

SEQ ID NO: 2852336 - protein, 17 aa, Entamoeba invadens
EKSTKTETNNKKNVSEE

SEQ ID NO: 2852337 - protein, 18 aa, Entamoeba invadens
EKSTNNRGLLRGCVGVNT

SEQ ID NO: 2852338 - protein, 7 aa, Entamoeba invadens
EKSTNTI

SEQ ID NO: 2852339 - protein, 8 aa, Entamoeba invadens
EKSTRIDY

SEQ ID NO: 2852340 - protein, 17 aa, Entamoeba invadens
EKSTRLESIPNNEEVEK

SEQ ID NO: 2852341 - protein, 15 aa, Entamoeba invadens
EKSTSGQQSQTAEKL

SEQ ID NO: 2852342 - protein, 6 aa, Entamoeba invadens
EKSTVS

SEQ ID NO: 2852343 - protein, 4 aa, Entamoeba invadens
EKSV

SEQ ID NO: 2852344 - protein, 5 aa, Entamoeba invadens
EKSVD

SEQ ID NO: 2852345 - protein, 17 aa, Entamoeba invadens
EKSVGEKKEQERRQTRL

SEQ ID NO: 2852346 - protein, 5 aa, Entamoeba invadens
EKSVN

SEQ ID NO: 2852347 - protein, 4 aa, Entamoeba invadens
EKSY

SEQ ID NO: 2852348 - protein, 8 aa, Entamoeba invadens
EKSYVDED

SEQ ID NO: 2852349 - protein, 4 aa, Entamoeba invadens
EKTA

SEQ ID NO: 2852350 - protein, 6 aa, Entamoeba invadens
EKTAAN

SEQ ID NO: 2852351 - protein, 6 aa, Entamoeba invadens
EKTAEF

SEQ ID NO: 2852352 - protein, 9 aa, Entamoeba invadens
EKTAETNKA

SEQ ID NO: 2852353 - protein, 6 aa, Entamoeba invadens
EKTAEV

SEQ ID NO: 2852354 - protein, 8 aa, Entamoeba invadens
EKTAEVSE

SEQ ID NO: 2852355 - protein, 13 aa, Entamoeba invadens
EKTAKRRKETNKI

SEQ ID NO: 2852356 - protein, 13 aa, Entamoeba invadens
EKTAKRRTDTNRV

SEQ ID NO: 2852357 - protein, 11 aa, Entamoeba invadens
EKTAMDNTTTK

SEQ ID NO: 2852358 - protein, 8 aa, Entamoeba invadens
EKTARKTL

SEQ ID NO: 2852359 - protein, 10 aa, Entamoeba invadens
EKTDAELRQQ

SEQ ID NO: 2852360 - protein, 8 aa, Entamoeba invadens
EKTDDIKN

SEQ ID NO: 2852361 - protein, 9 aa, Entamoeba invadens
EKTDESHGM

SEQ ID NO: 2852362 - protein, 6 aa, Entamoeba invadens
EKTDTI

SEQ ID NO: 2852363 - protein, 9 aa, Entamoeba invadens
EKTDVSNKN

SEQ ID NO: 2852364 - protein, 8 aa, Entamoeba invadens
EKTEEKEV

SEQ ID NO: 2852365 - protein, 57 aa, Entamoeba invadens
EKTEEKREPRAPRAYREQRPQREQRPQGEENRARGYRPHRRAPRRYQHDEKRVESDT

SEQ ID NO: 2852366 - protein, 40 aa, Entamoeba invadens
EKTEEKSDVKETEKEFDDKVERVEEKKEKLKEEKDKKEEN

SEQ ID NO: 2852367 - protein, 20 aa, Entamoeba invadens
EKTEEVSQRVEEIDKNQLDA

SEQ ID NO: 2852368 - protein, 5 aa, Entamoeba invadens
EKTEG

SEQ ID NO: 2852369 - protein, 33 aa, Entamoeba invadens
EKTEGKATTGNPPNKTESKVVKPTLTNTTETQQ

SEQ ID NO: 2852370 - protein, 20 aa, Entamoeba invadens
EKTEKIEKMEKSKGGKDDLK

SEQ ID NO: 2852371 - protein, 8 aa, Entamoeba invadens
EKTEKRMQ

SEQ ID NO: 2852372 - protein, 10 aa, Entamoeba invadens
EKTENKNEAQ

SEQ ID NO: 2852373 - protein, 23 aa, Entamoeba invadens
EKTENSEGKPDDKRSVRTTRTEM

SEQ ID NO: 2852374 - protein, 8 aa, Entamoeba invadens
EKTEPSHV

SEQ ID NO: 2852375 - protein, 5 aa, Entamoeba invadens
EKTER

SEQ ID NO: 2852376 - protein, 13 aa, Entamoeba invadens
EKTESFNDSSNPR

SEQ ID NO: 2852377 - protein, 12 aa, Entamoeba invadens
EKTEVSFSDGNS

SEQ ID NO: 2852378 - protein, 4 aa, Entamoeba invadens
EKTF

SEQ ID NO: 2852379 - protein, 7 aa, Entamoeba invadens
EKTGAVT

SEQ ID NO: 2852380 - protein, 12 aa, Entamoeba invadens
EKTGDDTKQVYP

SEQ ID NO: 2852381 - protein, 10 aa, Entamoeba invadens
EKTGENDENI

SEQ ID NO: 2852382 - protein, 10 aa, Entamoeba invadens
EKTGENRDNN

SEQ ID NO: 2852383 - protein, 7 aa, Entamoeba invadens
EKTGGCV

SEQ ID NO: 2852384 - protein, 6 aa, Entamoeba invadens
EKTGHH

SEQ ID NO: 2852385 - protein, 13 aa, Entamoeba invadens
EKTGHLKGSGSNT

SEQ ID NO: 2852386 - protein, 12 aa, Entamoeba invadens
EKTGHSGTLDPA

SEQ ID NO: 2852387 - protein, 6 aa, Entamoeba invadens
EKTGIK

SEQ ID NO: 2852388 - protein, 5 aa, Entamoeba invadens
EKTGL

SEQ ID NO: 2852389 - protein, 20 aa, Entamoeba invadens
EKTHDTDLRTAKARVTENKK

SEQ ID NO: 2852390 - protein, 29 aa, Entamoeba invadens
EKTIENQKETTKQLQNELKDKNDNLEKVN

SEQ ID NO: 2852391 - protein, 15 aa, Entamoeba invadens
EKTIENQNEETEKRI

SEQ ID NO: 2852392 - protein, 17 aa, Entamoeba invadens
EKTIENQNKTTTQLQNN

SEQ ID NO: 2852393 - protein, 4 aa, Entamoeba invadens
EKTK

SEQ ID NO: 2852394 - protein, 6 aa, Entamoeba invadens
EKTKDF

SEQ ID NO: 2852395 - protein, 7 aa, Entamoeba invadens
EKTKGKT

SEQ ID NO: 2852396 - protein, 7 aa, Entamoeba invadens
EKTKGNI

SEQ ID NO: 2852397 - protein, 20 aa, Entamoeba invadens
EKTKKEKTLEEHKKDWTDYQ

SEQ ID NO: 2852398 - protein, 12 aa, Entamoeba invadens
EKTKKSSSFEQK

SEQ ID NO: 2852399 - protein, 20 aa, Entamoeba invadens
EKTKLAEESTKKAEELEKNV

SEQ ID NO: 2852400 - protein, 23 aa, Entamoeba invadens
EKTKMNELNQKTEEKTVEQPKNN

SEQ ID NO: 2852401 - protein, 10 aa, Entamoeba invadens
EKTKNESAER

SEQ ID NO: 2852402 - protein, 10 aa, Entamoeba invadens
EKTKNQETLT

SEQ ID NO: 2852403 - protein, 8 aa, Entamoeba invadens
EKTKPSPL

SEQ ID NO: 2852404 - protein, 30 aa, Entamoeba invadens
EKTKQSKRKEKKDDKKEEKKEDKKEKSVPF

SEQ ID NO: 2852405 - protein, 8 aa, Entamoeba invadens
EKTKRERD

SEQ ID NO: 2852406 - protein, 7 aa, Entamoeba invadens
EKTKSSV

SEQ ID NO: 2852407 - protein, 9 aa, Entamoeba invadens
EKTKSTVGA

SEQ ID NO: 2852408 - protein, 4 aa, Entamoeba invadens
EKTL

SEQ ID NO: 2852409 - protein, 17 aa, Entamoeba invadens
EKTLDNYTVEDGDTIDC

SEQ ID NO: 2852410 - protein, 5 aa, Entamoeba invadens
EKTLE

SEQ ID NO: 2852411 - protein, 6 aa, Entamoeba invadens
EKTLGA

SEQ ID NO: 2852412 - protein, 9 aa, Entamoeba invadens
EKTLNQSEL

SEQ ID NO: 2852413 - protein, 7 aa, Entamoeba invadens
EKTMEKD

SEQ ID NO: 2852414 - protein, 12 aa, Entamoeba invadens
EKTMKAARKSRE

SEQ ID NO: 2852415 - protein, 17 aa, Entamoeba invadens
EKTNAERLRTKSNNIAE

SEQ ID NO: 2852416 - protein, 7 aa, Entamoeba invadens
EKTNGYN

SEQ ID NO: 2852417 - protein, 7 aa, Entamoeba invadens
EKTNNDF

SEQ ID NO: 2852418 - protein, 9 aa, Entamoeba invadens
EKTNNSDTM

SEQ ID NO: 2852419 - protein, 31 aa, Entamoeba invadens
EKTNPFEGGEKTTAPIRKELNEKTSNPFDEK

SEQ ID NO: 2852420 - protein, 23 aa, Entamoeba invadens
EKTNSEKDQTKKLLDDTNTEKDK

SEQ ID NO: 2852421 - protein, 15 aa, Entamoeba invadens
EKTNSKANVFDDEDT

SEQ ID NO: 2852422 - protein, 7 aa, Entamoeba invadens
EKTNSYD

SEQ ID NO: 2852423 - protein, 33 aa, Entamoeba invadens
EKTNTGEGKETKEDKKTEEMKEEKKDVAIEVGT

SEQ ID NO: 2852424 - protein, 8 aa, Entamoeba invadens
EKTPDDTS

SEQ ID NO: 2852425 - protein, 12 aa, Entamoeba invadens
EKTPEAHGQNYT

SEQ ID NO: 2852426 - protein, 6 aa, Entamoeba invadens
EKTPGG

SEQ ID NO: 2852427 - protein, 8 aa, Entamoeba invadens
EKTPKDAE

SEQ ID NO: 2852428 - protein, 8 aa, Entamoeba invadens
EKTPKEVF

SEQ ID NO: 2852429 - protein, 6 aa, Entamoeba invadens
EKTPNG

SEQ ID NO: 2852430 - protein, 6 aa, Entamoeba invadens
EKTPSL

SEQ ID NO: 2852431 - protein, 7 aa, Entamoeba invadens
EKTPSWE

SEQ ID NO: 2852432 - protein, 6 aa, Entamoeba invadens
EKTQAE

SEQ ID NO: 2852433 - protein, 5 aa, Entamoeba invadens
EKTQF

SEQ ID NO: 2852434 - protein, 6 aa, Entamoeba invadens
EKTQLT

SEQ ID NO: 2852435 - protein, 6 aa, Entamoeba invadens
EKTQMR

SEQ ID NO: 2852436 - protein, 12 aa, Entamoeba invadens
EKTQNYQKVRSE

SEQ ID NO: 2852437 - protein, 8 aa, Entamoeba invadens
EKTQPKSV

SEQ ID NO: 2852438 - protein, 5 aa, Entamoeba invadens
EKTQY

SEQ ID NO: 2852439 - protein, 10 aa, Entamoeba invadens
EKTRDTKIET

SEQ ID NO: 2852440 - protein, 5 aa, Entamoeba invadens
EKTRK

SEQ ID NO: 2852441 - protein, 25 aa, Entamoeba invadens
EKTRQFHQNNPRQRRPDGLPGKLDH

SEQ ID NO: 2852442 - protein, 6 aa, Entamoeba invadens
EKTSFT

SEQ ID NO: 2852443 - protein, 8 aa, Entamoeba invadens
EKTSGLSL

SEQ ID NO: 2852444 - protein, 7 aa, Entamoeba invadens
EKTSQNT

SEQ ID NO: 2852445 - protein, 8 aa, Entamoeba invadens
EKTSTEIE

SEQ ID NO: 2852446 - protein, 4 aa, Entamoeba invadens
EKTT

SEQ ID NO: 2852447 - protein, 18 aa, Entamoeba invadens
EKTTAQQTKAQKKKFAEK

SEQ ID NO: 2852448 - protein, 10 aa, Entamoeba invadens
EKTTIHKPQP

SEQ ID NO: 2852449 - protein, 19 aa, Entamoeba invadens
EKTTISEDLRKKRKTFSSR

SEQ ID NO: 2852450 - protein, 15 aa, Entamoeba invadens
EKTTKRELNQSETNF

SEQ ID NO: 2852451 - protein, 5 aa, Entamoeba invadens
EKTTQ

SEQ ID NO: 2852452 - protein, 11 aa, Entamoeba invadens
EKTTSTKKKEL

SEQ ID NO: 2852453 - protein, 7 aa, Entamoeba invadens
EKTTTRN

SEQ ID NO: 2852454 - protein, 8 aa, Entamoeba invadens
EKTVDAHS

SEQ ID NO: 2852455 - protein, 8 aa, Entamoeba invadens
EKTVDANY

SEQ ID NO: 2852456 - protein, 5 aa, Entamoeba invadens
EKTVE

SEQ ID NO: 2852457 - protein, 7 aa, Entamoeba invadens
EKTVEKI

SEQ ID NO: 2852458 - protein, 5 aa, Entamoeba invadens
EKTVT

SEQ ID NO: 2852459 - protein, 5 aa, Entamoeba invadens
EKTWG

SEQ ID NO: 2852460 - protein, 4 aa, Entamoeba invadens
EKTY

SEQ ID NO: 2852461 - protein, 13 aa, Entamoeba invadens
EKVAEELSEQQTR

SEQ ID NO: 2852462 - protein, 5 aa, Entamoeba invadens
EKVDE

SEQ ID NO: 2852463 - protein, 25 aa, Entamoeba invadens
EKVDKDEDTDYQRCKNPPLSFKTFN

SEQ ID NO: 2852464 - protein, 7 aa, Entamoeba invadens
EKVDKEN

SEQ ID NO: 2852465 - protein, 14 aa, Entamoeba invadens
EKVDLSKSKIEKVE

SEQ ID NO: 2852466 - protein, 7 aa, Entamoeba invadens
EKVDPTC

SEQ ID NO: 2852467 - protein, 6 aa, Entamoeba invadens
EKVDSS

SEQ ID NO: 2852468 - protein, 9 aa, Entamoeba invadens
EKVECEKKG

SEQ ID NO: 2852469 - protein, 13 aa, Entamoeba invadens
EKVEDEKNENNTI

SEQ ID NO: 2852470 - protein, 10 aa, Entamoeba invadens
EKVEDNSQIV

SEQ ID NO: 2852471 - protein, 16 aa, Entamoeba invadens
EKVEDQRFTKDDQSDF

SEQ ID NO: 2852472 - protein, 19 aa, Entamoeba invadens
EKVEEAVAPIPANQKEEDK

SEQ ID NO: 2852473 - protein, 6 aa, Entamoeba invadens
EKVEEG

SEQ ID NO: 2852474 - protein, 13 aa, Entamoeba invadens
EKVEEKNTQIESP

SEQ ID NO: 2852475 - protein, 21 aa, Entamoeba invadens
EKVEENLDSKVETVENKENEI

SEQ ID NO: 2852476 - protein, 7 aa, Entamoeba invadens
EKVEEPV

SEQ ID NO: 2852477 - protein, 12 aa, Entamoeba invadens
EKVEESETNKRF

SEQ ID NO: 2852478 - protein, 10 aa, Entamoeba invadens
EKVEHSIDEP

SEQ ID NO: 2852479 - protein, 6 aa, Entamoeba invadens
EKVEKD

SEQ ID NO: 2852480 - protein, 38 aa, Entamoeba invadens
EKVEKGEKQEKDNLMEDSTEEVVKSSNTLLSPEMSQEM

SEQ ID NO: 2852481 - protein, 32 aa, Entamoeba invadens
EKVEKKEDDKRHGQQTLPRTTNHFDNSPRHMG

SEQ ID NO: 2852482 - protein, 21 aa, Entamoeba invadens
EKVEKSQSKIEKVENSPGERN

SEQ ID NO: 2852483 - protein, 12 aa, Entamoeba invadens
EKVEKTAFKGSK

SEQ ID NO: 2852484 - protein, 14 aa, Entamoeba invadens
EKVENELKEKIRRN

SEQ ID NO: 2852485 - protein, 14 aa, Entamoeba invadens
EKVENETIEEPPQL

SEQ ID NO: 2852486 - protein, 14 aa, Entamoeba invadens
EKVENNKNEKEVNK

SEQ ID NO: 2852487 - protein, 11 aa, Entamoeba invadens
EKVEPSKSPIK

SEQ ID NO: 2852488 - protein, 18 aa, Entamoeba invadens
EKVEQEDEDPYADLPEQT

SEQ ID NO: 2852489 - protein, 7 aa, Entamoeba invadens
EKVEQPI

SEQ ID NO: 2852490 - protein, 13 aa, Entamoeba invadens
EKVEQSAESTCQP

SEQ ID NO: 2852491 - protein, 8 aa, Entamoeba invadens
EKVESVNG

SEQ ID NO: 2852492 - protein, 7 aa, Entamoeba invadens
EKVGEGI

SEQ ID NO: 2852493 - protein, 7 aa, Entamoeba invadens
EKVGGQK

SEQ ID NO: 2852494 - protein, 8 aa, Entamoeba invadens
EKVGKQEE

SEQ ID NO: 2852495 - protein, 6 aa, Entamoeba invadens
EKVGKT

SEQ ID NO: 2852496 - protein, 9 aa, Entamoeba invadens
EKVGPNEKV

SEQ ID NO: 2852497 - protein, 5 aa, Entamoeba invadens
EKVHR

SEQ ID NO: 2852498 - protein, 4 aa, Entamoeba invadens
EKVK

SEQ ID NO: 2852499 - protein, 7 aa, Entamoeba invadens
EKVKDAF

SEQ ID NO: 2852500 - protein, 15 aa, Entamoeba invadens
EKVKEKNEKFEKTTK

SEQ ID NO: 2852501 - protein, 12 aa, Entamoeba invadens
EKVKENKLGVPK

SEQ ID NO: 2852502 - protein, 8 aa, Entamoeba invadens
EKVKGAEY

SEQ ID NO: 2852503 - protein, 7 aa, Entamoeba invadens
EKVKKNI

SEQ ID NO: 2852504 - protein, 13 aa, Entamoeba invadens
EKVKNVEKTDGAS

SEQ ID NO: 2852505 - protein, 11 aa, Entamoeba invadens
EKVKPKPGELE

SEQ ID NO: 2852506 - protein, 10 aa, Entamoeba invadens
EKVKSTDDIQ

SEQ ID NO: 2852507 - protein, 7 aa, Entamoeba invadens
EKVNEIE

SEQ ID NO: 2852508 - protein, 7 aa, Entamoeba invadens
EKVNEKI

SEQ ID NO: 2852509 - protein, 5 aa, Entamoeba invadens
EKVNG

SEQ ID NO: 2852510 - protein, 15 aa, Entamoeba invadens
EKVNGKLTDFGSPRN

SEQ ID NO: 2852511 - protein, 9 aa, Entamoeba invadens
EKVNNDIAE

SEQ ID NO: 2852512 - protein, 17 aa, Entamoeba invadens
EKVNQENTQQNEKMKND

SEQ ID NO: 2852513 - protein, 7 aa, Entamoeba invadens
EKVNRKN

SEQ ID NO: 2852514 - protein, 34 aa, Entamoeba invadens
EKVNTSFKANTSLKNKRDRLKEKCEAQKKEFKGG

SEQ ID NO: 2852515 - protein, 4 aa, Entamoeba invadens
EKVP

SEQ ID NO: 2852516 - protein, 8 aa, Entamoeba invadens
EKVPEGHK

SEQ ID NO: 2852517 - protein, 8 aa, Entamoeba invadens
EKVPEVKE

SEQ ID NO: 2852518 - protein, 7 aa, Entamoeba invadens
EKVPHEK

SEQ ID NO: 2852519 - protein, 14 aa, Entamoeba invadens
EKVPNYNKWKNQQT

SEQ ID NO: 2852520 - protein, 16 aa, Entamoeba invadens
EKVQKLAQSREEAKAR

SEQ ID NO: 2852521 - protein, 7 aa, Entamoeba invadens
EKVQKQD

SEQ ID NO: 2852522 - protein, 7 aa, Entamoeba invadens
EKVQRSL

SEQ ID NO: 2852523 - protein, 10 aa, Entamoeba invadens
EKVRPTDDDV

SEQ ID NO: 2852524 - protein, 9 aa, Entamoeba invadens
EKVRSDEAD

SEQ ID NO: 2852525 - protein, 11 aa, Entamoeba invadens
EKVSKDNTKSL

SEQ ID NO: 2852526 - protein, 16 aa, Entamoeba invadens
EKVSKNKPNTVMSGDN

SEQ ID NO: 2852527 - protein, 6 aa, Entamoeba invadens
EKVSKS

SEQ ID NO: 2852528 - protein, 30 aa, Entamoeba invadens
EKVSSSPVNQKKPRTSKKNVRKTKKRWDNK

SEQ ID NO: 2852529 - protein, 10 aa, Entamoeba invadens
EKVSTSPSTV

SEQ ID NO: 2852530 - protein, 7 aa, Entamoeba invadens
EKVSYPN

SEQ ID NO: 2852531 - protein, 4 aa, Entamoeba invadens
EKVT

SEQ ID NO: 2852532 - protein, 17 aa, Entamoeba invadens
EKVTKELTSKSKKREEE

SEQ ID NO: 2852533 - protein, 10 aa, Entamoeba invadens
EKVTPNSKSH

SEQ ID NO: 2852534 - protein, 8 aa, Entamoeba invadens
EKVTTPVN

SEQ ID NO: 2852535 - protein, 7 aa, Entamoeba invadens
EKVVDGT

SEQ ID NO: 2852536 - protein, 11 aa, Entamoeba invadens
EKWGNGHSGQY

SEQ ID NO: 2852537 - protein, 4 aa, Entamoeba invadens
EKWN

SEQ ID NO: 2852538 - protein, 9 aa, Entamoeba invadens
EKWPKDPVA

SEQ ID NO: 2852539 - protein, 8 aa, Entamoeba invadens
EKWPTPNP

SEQ ID NO: 2852540 - protein, 16 aa, Entamoeba invadens
EKWRNGVEKEKSKIEI

SEQ ID NO: 2852541 - protein, 26 aa, Entamoeba invadens
EKYAESSSSSDDSPREKKADAPKKEK

SEQ ID NO: 2852542 - protein, 27 aa, Entamoeba invadens
EKYDDLKNEKEYNEATQQSNEKVGDEF

SEQ ID NO: 2852543 - protein, 7 aa, Entamoeba invadens
EKYDDTV

SEQ ID NO: 2852544 - protein, 7 aa, Entamoeba invadens
EKYDNKV

SEQ ID NO: 2852545 - protein, 8 aa, Entamoeba invadens
EKYDNNTR

SEQ ID NO: 2852546 - protein, 6 aa, Entamoeba invadens
EKYEDC

SEQ ID NO: 2852547 - protein, 13 aa, Entamoeba invadens
EKYEEKNENEIPT

SEQ ID NO: 2852548 - protein, 5 aa, Entamoeba invadens
EKYEK

SEQ ID NO: 2852549 - protein, 11 aa, Entamoeba invadens
EKYEKDIETQR

SEQ ID NO: 2852550 - protein, 8 aa, Entamoeba invadens
EKYEPSIE

SEQ ID NO: 2852551 - protein, 13 aa, Entamoeba invadens
EKYETLKKTNNKV

SEQ ID NO: 2852552 - protein, 8 aa, Entamoeba invadens
EKYGQKAF

SEQ ID NO: 2852553 - protein, 17 aa, Entamoeba invadens
EKYGTEGPFGVFKLCYE

SEQ ID NO: 2852554 - protein, 8 aa, Entamoeba invadens
EKYHNAEE

SEQ ID NO: 2852555 - protein, 4 aa, Entamoeba invadens
EKYI

SEQ ID NO: 2852556 - protein, 7 aa, Entamoeba invadens
EKYIDGT

SEQ ID NO: 2852557 - protein, 29 aa, Entamoeba invadens
EKYKDDLKLKSNGISHEEKEALEKFSNSK

SEQ ID NO: 2852558 - protein, 6 aa, Entamoeba invadens
EKYKHA

SEQ ID NO: 2852559 - protein, 6 aa, Entamoeba invadens
EKYKIS

SEQ ID NO: 2852560 - protein, 9 aa, Entamoeba invadens
EKYKKADGV

SEQ ID NO: 2852561 - protein, 9 aa, Entamoeba invadens
EKYKKPADI

SEQ ID NO: 2852562 - protein, 6 aa, Entamoeba invadens
EKYKMP

SEQ ID NO: 2852563 - protein, 6 aa, Entamoeba invadens
EKYKMS

SEQ ID NO: 2852564 - protein, 7 aa, Entamoeba invadens
EKYKNVE

SEQ ID NO: 2852565 - protein, 14 aa, Entamoeba invadens
EKYKSKDLENSKKI

SEQ ID NO: 2852566 - protein, 14 aa, Entamoeba invadens
EKYKVTAKLSEAVR

SEQ ID NO: 2852567 - protein, 4 aa, Entamoeba invadens
EKYL

SEQ ID NO: 2852568 - protein, 5 aa, Entamoeba invadens
EKYNK

SEQ ID NO: 2852569 - protein, 7 aa, Entamoeba invadens
EKYNKDT

SEQ ID NO: 2852570 - protein, 5 aa, Entamoeba invadens
EKYNS

SEQ ID NO: 2852571 - protein, 8 aa, Entamoeba invadens
EKYPDEVP

SEQ ID NO: 2852572 - protein, 8 aa, Entamoeba invadens
EKYPGNEI

SEQ ID NO: 2852573 - protein, 8 aa, Entamoeba invadens
EKYPINDK

SEQ ID NO: 2852574 - protein, 5 aa, Entamoeba invadens
EKYQE

SEQ ID NO: 2852575 - protein, 19 aa, Entamoeba invadens
EKYQKKEKLDDPPKEYPED

SEQ ID NO: 2852576 - protein, 9 aa, Entamoeba invadens
EKYQNDPEN

SEQ ID NO: 2852577 - protein, 5 aa, Entamoeba invadens
EKYQS

SEQ ID NO: 2852578 - protein, 10 aa, Entamoeba invadens
EKYQSDRQDA

SEQ ID NO: 2852579 - protein, 6 aa, Entamoeba invadens
EKYRMP

SEQ ID NO: 2852580 - protein, 17 aa, Entamoeba invadens
EKYRTNPIKIDNKTTSL

SEQ ID NO: 2852581 - protein, 6 aa, Entamoeba invadens
EKYSAT

SEQ ID NO: 2852582 - protein, 9 aa, Entamoeba invadens
EKYSEKNEY

SEQ ID NO: 2852583 - protein, 12 aa, Entamoeba invadens
EKYSENDGKWRE

SEQ ID NO: 2852584 - protein, 10 aa, Entamoeba invadens
EKYSIRTEPK

SEQ ID NO: 2852585 - protein, 7 aa, Entamoeba invadens
EKYSKSD

SEQ ID NO: 2852586 - protein, 4 aa, Entamoeba invadens
EKYT

SEQ ID NO: 2852587 - protein, 10 aa, Entamoeba invadens
EKYTCKTEKG

SEQ ID NO: 2852588 - protein, 7 aa, Entamoeba invadens
EKYTPIY

SEQ ID NO: 2852589 - protein, 5 aa, Entamoeba invadens
EKYYV

SEQ ID NO: 2852590 - protein, 5 aa, Entamoeba invadens
ELAAG

SEQ ID NO: 2852591 - protein, 12 aa, Entamoeba invadens
ELAAKDKEIETV

SEQ ID NO: 2852592 - protein, 9 aa, Entamoeba invadens
ELAAQNEKV

SEQ ID NO: 2852593 - protein, 23 aa, Entamoeba invadens
ELADERNKQEERNYENTSQNDLT

SEQ ID NO: 2852594 - protein, 7 aa, Entamoeba invadens
ELADKPK

SEQ ID NO: 2852595 - protein, 18 aa, Entamoeba invadens
ELAEAEDEESTSQDVEEE

SEQ ID NO: 2852596 - protein, 6 aa, Entamoeba invadens
ELAEGK

SEQ ID NO: 2852597 - protein, 12 aa, Entamoeba invadens
ELAEGKSPYRED

SEQ ID NO: 2852598 - protein, 11 aa, Entamoeba invadens
ELAERSKTQIQ

SEQ ID NO: 2852599 - protein, 10 aa, Entamoeba invadens
ELAGKDVRDS

SEQ ID NO: 2852600 - protein, 8 aa, Entamoeba invadens
ELAKSEDK

SEQ ID NO: 2852601 - protein, 33 aa, Entamoeba invadens
ELAKSPDFAALPPNEKAEKVKEEVKKQTDGRQI

SEQ ID NO: 2852602 - protein, 34 aa, Entamoeba invadens
ELAKSPDFAALPPNEKAEKVKEEVKKQTDGRQIE

SEQ ID NO: 2852603 - protein, 4 aa, Entamoeba invadens
ELAP

SEQ ID NO: 2852604 - protein, 7 aa, Entamoeba invadens
ELAPGKY

SEQ ID NO: 2852605 - protein, 5 aa, Entamoeba invadens
ELAPL

SEQ ID NO: 2852606 - protein, 5 aa, Entamoeba invadens
ELDAM

SEQ ID NO: 2852607 - protein, 6 aa, Entamoeba invadens
ELDARS

SEQ ID NO: 2852608 - protein, 9 aa, Entamoeba invadens
ELDESEREE

SEQ ID NO: 2852609 - protein, 15 aa, Entamoeba invadens
ELDGIKDKETPNKVN

SEQ ID NO: 2852610 - protein, 9 aa, Entamoeba invadens
ELDGVPKEA

SEQ ID NO: 2852611 - protein, 4 aa, Entamoeba invadens
ELDI

SEQ ID NO: 2852612 - protein, 9 aa, Entamoeba invadens
ELDKQSKAL

SEQ ID NO: 2852613 - protein, 19 aa, Entamoeba invadens
ELDKTGDEFTGNTQTSGKI

SEQ ID NO: 2852614 - protein, 12 aa, Entamoeba invadens
ELDNQEKQLAEK

SEQ ID NO: 2852615 - protein, 7 aa, Entamoeba invadens
ELDPKEL

SEQ ID NO: 2852616 - protein, 4 aa, Entamoeba invadens
ELDQ

SEQ ID NO: 2852617 - protein, 14 aa, Entamoeba invadens
ELDQEKKDHSKTQL

SEQ ID NO: 2852618 - protein, 13 aa, Entamoeba invadens
ELDQEKKDHTKTQ

SEQ ID NO: 2852619 - protein, 15 aa, Entamoeba invadens
ELDQEKKDHTKTQLI

SEQ ID NO: 2852620 - protein, 12 aa, Entamoeba invadens
ELDQEKKYRAET

SEQ ID NO: 2852621 - protein, 23 aa, Entamoeba invadens
ELDTENDDTTNENVGTSNKSNAM

SEQ ID NO: 2852622 - protein, 13 aa, Entamoeba invadens
ELDTNKQEGEKKI

SEQ ID NO: 2852623 - protein, 8 aa, Entamoeba invadens
ELEDDKKQ

SEQ ID NO: 2852624 - protein, 10 aa, Entamoeba invadens
ELEDPDNVPD

SEQ ID NO: 2852625 - protein, 13 aa, Entamoeba invadens
ELEDRGKDDGQIH

SEQ ID NO: 2852626 - protein, 9 aa, Entamoeba invadens
ELEDSQLES

SEQ ID NO: 2852627 - protein, 10 aa, Entamoeba invadens
ELEEDEKLGE

SEQ ID NO: 2852628 - protein, 9 aa, Entamoeba invadens
ELEEKNKAL

SEQ ID NO: 2852629 - protein, 10 aa, Entamoeba invadens
ELEENSKNLT

SEQ ID NO: 2852630 - protein, 18 aa, Entamoeba invadens
ELEESAKTIWESGNENVI

SEQ ID NO: 2852631 - protein, 12 aa, Entamoeba invadens
ELEETKQIGEGS

SEQ ID NO: 2852632 - protein, 6 aa, Entamoeba invadens
ELEGEA

SEQ ID NO: 2852633 - protein, 8 aa, Entamoeba invadens
ELEGKGRG

SEQ ID NO: 2852634 - protein, 5 aa, Entamoeba invadens
ELEGN

SEQ ID NO: 2852635 - protein, 5 aa, Entamoeba invadens
ELEIS

SEQ ID NO: 2852636 - protein, 4 aa, Entamoeba invadens
ELEK

SEQ ID NO: 2852637 - protein, 10 aa, Entamoeba invadens
ELEKEEEQQL

SEQ ID NO: 2852638 - protein, 6 aa, Entamoeba invadens
ELEKGG

SEQ ID NO: 2852639 - protein, 9 aa, Entamoeba invadens
ELEKGKEVT

SEQ ID NO: 2852640 - protein, 13 aa, Entamoeba invadens
ELEKNDKKKTTKV

SEQ ID NO: 2852641 - protein, 10 aa, Entamoeba invadens
ELEKRKGKYK

SEQ ID NO: 2852642 - protein, 13 aa, Entamoeba invadens
ELENEQLQSEQNY

SEQ ID NO: 2852643 - protein, 13 aa, Entamoeba invadens
ELENETEYNSSEL

SEQ ID NO: 2852644 - protein, 5 aa, Entamoeba invadens
ELENG

SEQ ID NO: 2852645 - protein, 6 aa, Entamoeba invadens
ELENGE

SEQ ID NO: 2852646 - protein, 8 aa, Entamoeba invadens
ELENNTSV

SEQ ID NO: 2852647 - protein, 22 aa, Entamoeba invadens
ELEPKEVKPSSVVPKKKGFATS

SEQ ID NO: 2852648 - protein, 9 aa, Entamoeba invadens
ELEQESKLQ

SEQ ID NO: 2852649 - protein, 5 aa, Entamoeba invadens
ELEQF

SEQ ID NO: 2852650 - protein, 10 aa, Entamoeba invadens
ELERKEAVEE

SEQ ID NO: 2852651 - protein, 6 aa, Entamoeba invadens
ELESEN

SEQ ID NO: 2852652 - protein, 5 aa, Entamoeba invadens
ELESQ

SEQ ID NO: 2852653 - protein, 6 aa, Entamoeba invadens
ELESQA

SEQ ID NO: 2852654 - protein, 11 aa, Entamoeba invadens
ELESQLRQTDY

SEQ ID NO: 2852655 - protein, 6 aa, Entamoeba invadens
ELESQT

SEQ ID NO: 2852656 - protein, 15 aa, Entamoeba invadens
ELESSQRKQMEKDPY

SEQ ID NO: 2852657 - protein, 35 aa, Entamoeba invadens
ELETNKKLQEESEKKSKRMEDDIKSEQEKSNKLKE

SEQ ID NO: 2852658 - protein, 11 aa, Entamoeba invadens
ELETQESKTVI

SEQ ID NO: 2852659 - protein, 6 aa, Entamoeba invadens
ELGDSD

SEQ ID NO: 2852660 - protein, 15 aa, Entamoeba invadens
ELGEKKEQSQITQNT

SEQ ID NO: 2852661 - protein, 12 aa, Entamoeba invadens
ELGGQHHQRAND

SEQ ID NO: 2852662 - protein, 7 aa, Entamoeba invadens
ELGGRDT

SEQ ID NO: 2852663 - protein, 10 aa, Entamoeba invadens
ELGKDASNIG

SEQ ID NO: 2852664 - protein, 8 aa, Entamoeba invadens
ELGKSTSQ

SEQ ID NO: 2852665 - protein, 15 aa, Entamoeba invadens
ELGNKEDDFSENDFN

SEQ ID NO: 2852666 - protein, 6 aa, Entamoeba invadens
ELGPPV

SEQ ID NO: 2852667 - protein, 5 aa, Entamoeba invadens
ELGTY

SEQ ID NO: 2852668 - protein, 16 aa, Entamoeba invadens
ELHEEEKRCEANTQQM

SEQ ID NO: 2852669 - protein, 13 aa, Entamoeba invadens
ELHETKKEEPKTQ

SEQ ID NO: 2852670 - protein, 79 aa, Entamoeba invadens
ELHSKQKKQKVEKIEKENVEEKSESKSPQMKVEQKDKNEKKKETQKEEKKENLNVSSKDEWKEKHKKGPRQEKKQLKAK

SEQ ID NO: 2852671 - protein, 11 aa, Entamoeba invadens
ELIKKSPGTYQ

SEQ ID NO: 2852672 - protein, 11 aa, Entamoeba invadens
ELIRSGSTVGL

SEQ ID NO: 2852673 - protein, 10 aa, Entamoeba invadens
ELKDENSVLR

SEQ ID NO: 2852674 - protein, 10 aa, Entamoeba invadens
ELKDFTGEDV

SEQ ID NO: 2852675 - protein, 8 aa, Entamoeba invadens
ELKDIEDT

SEQ ID NO: 2852676 - protein, 9 aa, Entamoeba invadens
ELKDNSDKS

SEQ ID NO: 2852677 - protein, 8 aa, Entamoeba invadens
ELKDPRRY

SEQ ID NO: 2852678 - protein, 16 aa, Entamoeba invadens
ELKDSKEKNQTETVTR

SEQ ID NO: 2852679 - protein, 5 aa, Entamoeba invadens
ELKED

SEQ ID NO: 2852680 - protein, 12 aa, Entamoeba invadens
ELKEDKKLGEGS

SEQ ID NO: 2852681 - protein, 8 aa, Entamoeba invadens
ELKEEDNK

SEQ ID NO: 2852682 - protein, 7 aa, Entamoeba invadens
ELKEGNH

SEQ ID NO: 2852683 - protein, 20 aa, Entamoeba invadens
ELKEKSQKNMSQPQDKPTNL

SEQ ID NO: 2852684 - protein, 9 aa, Entamoeba invadens
ELKENEKSQ

SEQ ID NO: 2852685 - protein, 10 aa, Entamoeba invadens
ELKENKEGTG

SEQ ID NO: 2852686 - protein, 9 aa, Entamoeba invadens
ELKERGETI

SEQ ID NO: 2852687 - protein, 11 aa, Entamoeba invadens
ELKETTGYVDR

SEQ ID NO: 2852688 - protein, 7 aa, Entamoeba invadens
ELKHKSV

SEQ ID NO: 2852689 - protein, 8 aa, Entamoeba invadens
ELKKDEDE

SEQ ID NO: 2852690 - protein, 5 aa, Entamoeba invadens
ELKKE

SEQ ID NO: 2852691 - protein, 17 aa, Entamoeba invadens
ELKKKDTTKRRPNDTEG

SEQ ID NO: 2852692 - protein, 15 aa, Entamoeba invadens
ELKKTREAKESKQTF

SEQ ID NO: 2852693 - protein, 7 aa, Entamoeba invadens
ELKNAYK

SEQ ID NO: 2852694 - protein, 7 aa, Entamoeba invadens
ELKNETR

SEQ ID NO: 2852695 - protein, 7 aa, Entamoeba invadens
ELKNTNS

SEQ ID NO: 2852696 - protein, 8 aa, Entamoeba invadens
ELKPEKEF

SEQ ID NO: 2852697 - protein, 8 aa, Entamoeba invadens
ELKPNAEL

SEQ ID NO: 2852698 - protein, 13 aa, Entamoeba invadens
ELKQEKKKLTAER

SEQ ID NO: 2852699 - protein, 12 aa, Entamoeba invadens
ELKQENKEKQMQ

SEQ ID NO: 2852700 - protein, 16 aa, Entamoeba invadens
ELKQKEETLNEKQGDL

SEQ ID NO: 2852701 - protein, 11 aa, Entamoeba invadens
ELKQKNPNVTV

SEQ ID NO: 2852702 - protein, 5 aa, Entamoeba invadens
ELKRN

SEQ ID NO: 2852703 - protein, 16 aa, Entamoeba invadens
ELKRQQQAEDTPEQVA

SEQ ID NO: 2852704 - protein, 8 aa, Entamoeba invadens
ELKSDGVE

SEQ ID NO: 2852705 - protein, 30 aa, Entamoeba invadens
ELKSDLKTLNEDKSAAAKDDELRKQPNVTQ

SEQ ID NO: 2852706 - protein, 18 aa, Entamoeba invadens
ELKSLNDKCEEKTDLEDQ

SEQ ID NO: 2852707 - protein, 7 aa, Entamoeba invadens
ELKSTNS

SEQ ID NO: 2852708 - protein, 9 aa, Entamoeba invadens
ELKTCSNTL

SEQ ID NO: 2852709 - protein, 13 aa, Entamoeba invadens
ELKTEQQQIPKQI

SEQ ID NO: 2852710 - protein, 5 aa, Entamoeba invadens
ELKTN

SEQ ID NO: 2852711 - protein, 21 aa, Entamoeba invadens
ELKTSQGRKISKEDSIKSPSI

SEQ ID NO: 2852712 - protein, 8 aa, Entamoeba invadens
ELKTTNHQ

SEQ ID NO: 2852713 - protein, 14 aa, Entamoeba invadens
ELLDQQGKKQTQNV

SEQ ID NO: 2852714 - protein, 14 aa, Entamoeba invadens
ELLEEKNDSGETPL

SEQ ID NO: 2852715 - protein, 45 aa, Entamoeba invadens
ELLNSGNTLDTSLSSSEDSLLSSDDDSSEENVQQPHQDEHNDEHM

SEQ ID NO: 2852716 - protein, 10 aa, Entamoeba invadens
ELLTSTSETC

SEQ ID NO: 2852717 - protein, 4 aa, Entamoeba invadens
ELMS

SEQ ID NO: 2852718 - protein, 4 aa, Entamoeba invadens
ELND

SEQ ID NO: 2852719 - protein, 9 aa, Entamoeba invadens
ELNDENKAS

SEQ ID NO: 2852720 - protein, 8 aa, Entamoeba invadens
ELNEEKTF

SEQ ID NO: 2852721 - protein, 9 aa, Entamoeba invadens
ELNEETQTL

SEQ ID NO: 2852722 - protein, 7 aa, Entamoeba invadens
ELNEGKG

SEQ ID NO: 2852723 - protein, 13 aa, Entamoeba invadens
ELNEHDEASEYEQ

SEQ ID NO: 2852724 - protein, 13 aa, Entamoeba invadens
ELNEHDESSEYEQ

SEQ ID NO: 2852725 - protein, 14 aa, Entamoeba invadens
ELNEHNEVSENEQM

SEQ ID NO: 2852726 - protein, 5 aa, Entamoeba invadens
ELNEK

SEQ ID NO: 2852727 - protein, 16 aa, Entamoeba invadens
ELNELQQKTRDPDAYS

SEQ ID NO: 2852728 - protein, 12 aa, Entamoeba invadens
ELNENTKTITSN

SEQ ID NO: 2852729 - protein, 6 aa, Entamoeba invadens
ELNETC

SEQ ID NO: 2852730 - protein, 4 aa, Entamoeba invadens
ELNG

SEQ ID NO: 2852731 - protein, 9 aa, Entamoeba invadens
ELNGKEVDG

SEQ ID NO: 2852732 - protein, 15 aa, Entamoeba invadens
ELNIQKSSEKNSCTL

SEQ ID NO: 2852733 - protein, 7 aa, Entamoeba invadens
ELNKEGD

SEQ ID NO: 2852734 - protein, 10 aa, Entamoeba invadens
ELNKGKKEPI

SEQ ID NO: 2852735 - protein, 26 aa, Entamoeba invadens
ELNKQSKSSAEVQEEQKTDDKPFVGK

SEQ ID NO: 2852736 - protein, 6 aa, Entamoeba invadens
ELNKSG

SEQ ID NO: 2852737 - protein, 6 aa, Entamoeba invadens
ELNNFK

SEQ ID NO: 2852738 - protein, 6 aa, Entamoeba invadens
ELNNKI

SEQ ID NO: 2852739 - protein, 12 aa, Entamoeba invadens
ELNNNDEESSRV

SEQ ID NO: 2852740 - protein, 7 aa, Entamoeba invadens
ELNPTQE

SEQ ID NO: 2852741 - protein, 9 aa, Entamoeba invadens
ELNQSTQME

SEQ ID NO: 2852742 - protein, 6 aa, Entamoeba invadens
ELNRDD

SEQ ID NO: 2852743 - protein, 5 aa, Entamoeba invadens
ELNRL

SEQ ID NO: 2852744 - protein, 4 aa, Entamoeba invadens
ELNS

SEQ ID NO: 2852745 - protein, 8 aa, Entamoeba invadens
ELNSGDSV

SEQ ID NO: 2852746 - protein, 5 aa, Entamoeba invadens
ELNSI

SEQ ID NO: 2852747 - protein, 34 aa, Entamoeba invadens
ELNSLSEKGIKTGLHPQDSEKTDKSSKKADRNWS

SEQ ID NO: 2852748 - protein, 19 aa, Entamoeba invadens
ELNSNTSPSRLQSPAPSEG

SEQ ID NO: 2852749 - protein, 9 aa, Entamoeba invadens
ELNSQDQYI

SEQ ID NO: 2852750 - protein, 4 aa, Entamoeba invadens
ELNT

SEQ ID NO: 2852751 - protein, 9 aa, Entamoeba invadens
ELNTGGINY

SEQ ID NO: 2852752 - protein, 7 aa, Entamoeba invadens
ELNTKNE

SEQ ID NO: 2852753 - protein, 13 aa, Entamoeba invadens
ELNTNKKQGKKPY

SEQ ID NO: 2852754 - protein, 13 aa, Entamoeba invadens
ELNTNQKQGKKPY

SEQ ID NO: 2852755 - protein, 5 aa, Entamoeba invadens
ELNTQ

SEQ ID NO: 2852756 - protein, 72 aa, Entamoeba invadens
ELNTQKEKSNKQEKIIKEREDELNVSTQRIEEIEKEKKEAEDKSKQYEEEKEKITKKHDSVEKEKENVTQQY

SEQ ID NO: 2852757 - protein, 10 aa, Entamoeba invadens
ELNTTIKAES

SEQ ID NO: 2852758 - protein, 10 aa, Entamoeba invadens
ELPAEAQPMD

SEQ ID NO: 2852759 - protein, 16 aa, Entamoeba invadens
ELPAWTKPKPSDSQKE

SEQ ID NO: 2852760 - protein, 10 aa, Entamoeba invadens
ELPDKSKLNL

SEQ ID NO: 2852761 - protein, 5 aa, Entamoeba invadens
ELPDL

SEQ ID NO: 2852762 - protein, 12 aa, Entamoeba invadens
ELPDYNPPSQNQ

SEQ ID NO: 2852763 - protein, 13 aa, Entamoeba invadens
ELPEELNGYNEKG

SEQ ID NO: 2852764 - protein, 11 aa, Entamoeba invadens
ELPEGGKAWKG

SEQ ID NO: 2852765 - protein, 9 aa, Entamoeba invadens
ELPENKNDL

SEQ ID NO: 2852766 - protein, 8 aa, Entamoeba invadens
ELPESLTT

SEQ ID NO: 2852767 - protein, 11 aa, Entamoeba invadens
ELPESSKETNF

SEQ ID NO: 2852768 - protein, 14 aa, Entamoeba invadens
ELPETIGGTADLGA

SEQ ID NO: 2852769 - protein, 5 aa, Entamoeba invadens
ELPEV

SEQ ID NO: 2852770 - protein, 8 aa, Entamoeba invadens
ELPKEVKG

SEQ ID NO: 2852771 - protein, 11 aa, Entamoeba invadens
ELPKKKPNYIA

SEQ ID NO: 2852772 - protein, 9 aa, Entamoeba invadens
ELPKNWKSI

SEQ ID NO: 2852773 - protein, 21 aa, Entamoeba invadens
ELPKQISRDINSEQGKPDSEI

SEQ ID NO: 2852774 - protein, 7 aa, Entamoeba invadens
ELPNLKS

SEQ ID NO: 2852775 - protein, 5 aa, Entamoeba invadens
ELPNT

SEQ ID NO: 2852776 - protein, 7 aa, Entamoeba invadens
ELPNTKQ

SEQ ID NO: 2852777 - protein, 5 aa, Entamoeba invadens
ELPPA

SEQ ID NO: 2852778 - protein, 7 aa, Entamoeba invadens
ELPPDTR

SEQ ID NO: 2852779 - protein, 6 aa, Entamoeba invadens
ELPPKE

SEQ ID NO: 2852780 - protein, 7 aa, Entamoeba invadens
ELPPKEI

SEQ ID NO: 2852781 - protein, 8 aa, Entamoeba invadens
ELPPKELS

SEQ ID NO: 2852782 - protein, 5 aa, Entamoeba invadens
ELPQE

SEQ ID NO: 2852783 - protein, 11 aa, Entamoeba invadens
ELPQKANVEQT

SEQ ID NO: 2852784 - protein, 6 aa, Entamoeba invadens
ELPQNT

SEQ ID NO: 2852785 - protein, 11 aa, Entamoeba invadens
ELPQNTNHIEE

SEQ ID NO: 2852786 - protein, 41 aa, Entamoeba invadens
ELPQQNNEEVVENETEKTNEENDQPNDQNEENNWNDQDEEI

SEQ ID NO: 2852787 - protein, 49 aa, Entamoeba invadens
ELPQQNNEEVVENETEKTNEENDQPNDQNEENNWNDQDEETVQQNIETT

SEQ ID NO: 2852788 - protein, 45 aa, Entamoeba invadens
ELPQQNNEEVVENETKKINEENDQPNDQNEENNWNDQDEETVQQN

SEQ ID NO: 2852789 - protein, 9 aa, Entamoeba invadens
ELPQSTTLA

SEQ ID NO: 2852790 - protein, 6 aa, Entamoeba invadens
ELPSDV

SEQ ID NO: 2852791 - protein, 20 aa, Entamoeba invadens
ELPSKKMTEDERKKSRDCAL

SEQ ID NO: 2852792 - protein, 9 aa, Entamoeba invadens
ELPSKSVPL

SEQ ID NO: 2852793 - protein, 5 aa, Entamoeba invadens
ELPSL

SEQ ID NO: 2852794 - protein, 10 aa, Entamoeba invadens
ELPSQVNSIP

SEQ ID NO: 2852795 - protein, 5 aa, Entamoeba invadens
ELPSS

SEQ ID NO: 2852796 - protein, 7 aa, Entamoeba invadens
ELPSSIT

SEQ ID NO: 2852797 - protein, 8 aa, Entamoeba invadens
ELPSTNPI

SEQ ID NO: 2852798 - protein, 4 aa, Entamoeba invadens
ELPT

SEQ ID NO: 2852799 - protein, 5 aa, Entamoeba invadens
ELPTG

SEQ ID NO: 2852800 - protein, 22 aa, Entamoeba invadens
ELPTTEKKSVTSESSAAPTRNS

SEQ ID NO: 2852801 - protein, 9 aa, Entamoeba invadens
ELPTTYPQV

SEQ ID NO: 2852802 - protein, 11 aa, Entamoeba invadens
ELQDDTKVTQC

SEQ ID NO: 2852803 - protein, 9 aa, Entamoeba invadens
ELQEDDKKV

SEQ ID NO: 2852804 - protein, 44 aa, Entamoeba invadens
ELQEDNSDENTEASVEEGVSSEESSEEKPNKTQTKKHKKGPRGY

SEQ ID NO: 2852805 - protein, 7 aa, Entamoeba invadens
ELQEEKR

SEQ ID NO: 2852806 - protein, 17 aa, Entamoeba invadens
ELQEGNNNEANLPSRGE

SEQ ID NO: 2852807 - protein, 12 aa, Entamoeba invadens
ELQKDKTNLSNE

SEQ ID NO: 2852808 - protein, 8 aa, Entamoeba invadens
ELQKEADV

SEQ ID NO: 2852809 - protein, 6 aa, Entamoeba invadens
ELQKGV

SEQ ID NO: 2852810 - protein, 5 aa, Entamoeba invadens
ELQKM

SEQ ID NO: 2852811 - protein, 6 aa, Entamoeba invadens
ELQKSN

SEQ ID NO: 2852812 - protein, 6 aa, Entamoeba invadens
ELQKTK

SEQ ID NO: 2852813 - protein, 18 aa, Entamoeba invadens
ELQNKEDKKSSVVSPRVE

SEQ ID NO: 2852814 - protein, 12 aa, Entamoeba invadens
ELQNSTDDQLDL

SEQ ID NO: 2852815 - protein, 7 aa, Entamoeba invadens
ELQNSYK

SEQ ID NO: 2852816 - protein, 6 aa, Entamoeba invadens
ELQPKI

SEQ ID NO: 2852817 - protein, 18 aa, Entamoeba invadens
ELQPTENDIKEKNEIKED

SEQ ID NO: 2852818 - protein, 10 aa, Entamoeba invadens
ELQQNSKKDI

SEQ ID NO: 2852819 - protein, 20 aa, Entamoeba invadens
ELQQRKTSHKKDRSSERYNS

SEQ ID NO: 2852820 - protein, 15 aa, Entamoeba invadens
ELQRQKIQRNGTSPS

SEQ ID NO: 2852821 - protein, 39 aa, Entamoeba invadens
ELQRQVTSSKIEVAKTGEEIEKSKQSAQDALRKNEELTK

SEQ ID NO: 2852822 - protein, 8 aa, Entamoeba invadens
ELQTNQAE

SEQ ID NO: 2852823 - protein, 14 aa, Entamoeba invadens
ELRDNKFETPARNN

SEQ ID NO: 2852824 - protein, 8 aa, Entamoeba invadens
ELRNESDV

SEQ ID NO: 2852825 - protein, 13 aa, Entamoeba invadens
ELRNSTAKNKKKI

SEQ ID NO: 2852826 - protein, 11 aa, Entamoeba invadens
ELRPRTTKKER

SEQ ID NO: 2852827 - protein, 7 aa, Entamoeba invadens
ELRSYET

SEQ ID NO: 2852828 - protein, 27 aa, Entamoeba invadens
ELRTKGKSNSSSLQTESSMKNDPISPL

SEQ ID NO: 2852829 - protein, 8 aa, Entamoeba invadens
ELRTKRRQ

SEQ ID NO: 2852830 - protein, 9 aa, Entamoeba invadens
ELRTNTTTC

SEQ ID NO: 2852831 - protein, 25 aa, Entamoeba invadens
ELRTQYSSSEKLSYSDKITKDIENK

SEQ ID NO: 2852832 - protein, 10 aa, Entamoeba invadens
ELRTSRRQEL

SEQ ID NO: 2852833 - protein, 22 aa, Entamoeba invadens
ELRTTVEKAQKQKKRSEKEQQR

SEQ ID NO: 2852834 - protein, 4 aa, Entamoeba invadens
ELSA

SEQ ID NO: 2852835 - protein, 6 aa, Entamoeba invadens
ELSAKP

SEQ ID NO: 2852836 - protein, 9 aa, Entamoeba invadens
ELSDDEDLY

SEQ ID NO: 2852837 - protein, 31 aa, Entamoeba invadens
ELSDSENGEDEKLENKEEKDTNDAVEEDHSS

SEQ ID NO: 2852838 - protein, 28 aa, Entamoeba invadens
ELSEAKVGKYEEKKITEFNASKDGIKEQ

SEQ ID NO: 2852839 - protein, 6 aa, Entamoeba invadens
ELSEAS

SEQ ID NO: 2852840 - protein, 5 aa, Entamoeba invadens
ELSED

SEQ ID NO: 2852841 - protein, 8 aa, Entamoeba invadens
ELSEDGDV

SEQ ID NO: 2852842 - protein, 14 aa, Entamoeba invadens
ELSERYGNVFWNGF

SEQ ID NO: 2852843 - protein, 8 aa, Entamoeba invadens
ELSGENKY

SEQ ID NO: 2852844 - protein, 8 aa, Entamoeba invadens
ELSGETEE

SEQ ID NO: 2852845 - protein, 5 aa, Entamoeba invadens
ELSGI

SEQ ID NO: 2852846 - protein, 17 aa, Entamoeba invadens
ELSGKKDENGDKENMYR

SEQ ID NO: 2852847 - protein, 9 aa, Entamoeba invadens
ELSGSDSEV

SEQ ID NO: 2852848 - protein, 5 aa, Entamoeba invadens
ELSHK

SEQ ID NO: 2852849 - protein, 7 aa, Entamoeba invadens
ELSKGSI

SEQ ID NO: 2852850 - protein, 8 aa, Entamoeba invadens
ELSKTNVH

SEQ ID NO: 2852851 - protein, 11 aa, Entamoeba invadens
ELSKTTVDSVA

SEQ ID NO: 2852852 - protein, 4 aa, Entamoeba invadens
ELSL

SEQ ID NO: 2852853 - protein, 8 aa, Entamoeba invadens
ELSNEIEK

SEQ ID NO: 2852854 - protein, 20 aa, Entamoeba invadens
ELSNEKKNAMRAARDYSGDM

SEQ ID NO: 2852855 - protein, 9 aa, Entamoeba invadens
ELSNQLKDE

SEQ ID NO: 2852856 - protein, 8 aa, Entamoeba invadens
ELSNSDLT

SEQ ID NO: 2852857 - protein, 12 aa, Entamoeba invadens
ELSNSKKQRASI

SEQ ID NO: 2852858 - protein, 6 aa, Entamoeba invadens
ELSPED

SEQ ID NO: 2852859 - protein, 8 aa, Entamoeba invadens
ELSPFQAK

SEQ ID NO: 2852860 - protein, 21 aa, Entamoeba invadens
ELSPHKRQGKTTKSESEDQNI

SEQ ID NO: 2852861 - protein, 14 aa, Entamoeba invadens
ELSPIGKEKEGTYD

SEQ ID NO: 2852862 - protein, 25 aa, Entamoeba invadens
ELSPKNLAAQLPTKEEAFKEDTSDL

SEQ ID NO: 2852863 - protein, 8 aa, Entamoeba invadens
ELSPKSDI

SEQ ID NO: 2852864 - protein, 7 aa, Entamoeba invadens
ELSPKTI

SEQ ID NO: 2852865 - protein, 6 aa, Entamoeba invadens
ELSPNG

SEQ ID NO: 2852866 - protein, 31 aa, Entamoeba invadens
ELSPSHSVKSPRATPVEREDDSQKKGRRPIR

SEQ ID NO: 2852867 - protein, 11 aa, Entamoeba invadens
ELSPSQQRKEF

SEQ ID NO: 2852868 - protein, 15 aa, Entamoeba invadens
ELSQNGEGLNENKSA

SEQ ID NO: 2852869 - protein, 11 aa, Entamoeba invadens
ELSQPEGDREM

SEQ ID NO: 2852870 - protein, 10 aa, Entamoeba invadens
ELSQQATKKI

SEQ ID NO: 2852871 - protein, 6 aa, Entamoeba invadens
ELSRAK

SEQ ID NO: 2852872 - protein, 14 aa, Entamoeba invadens
ELSRDDQKLARDLK

SEQ ID NO: 2852873 - protein, 12 aa, Entamoeba invadens
ELSSEEREDIQN

SEQ ID NO: 2852874 - protein, 5 aa, Entamoeba invadens
ELSST

SEQ ID NO: 2852875 - protein, 10 aa, Entamoeba invadens
ELSSTEEKSM

SEQ ID NO: 2852876 - protein, 11 aa, Entamoeba invadens
ELSTKIDPDEL

SEQ ID NO: 2852877 - protein, 5 aa, Entamoeba invadens
ELSTR

SEQ ID NO: 2852878 - protein, 7 aa, Entamoeba invadens
ELSYEND

SEQ ID NO: 2852879 - protein, 12 aa, Entamoeba invadens
ELTAKEKEDLQQ

SEQ ID NO: 2852880 - protein, 9 aa, Entamoeba invadens
ELTDAQAGK

SEQ ID NO: 2852881 - protein, 8 aa, Entamoeba invadens
ELTDDAES

SEQ ID NO: 2852882 - protein, 7 aa, Entamoeba invadens
ELTDDPD

SEQ ID NO: 2852883 - protein, 10 aa, Entamoeba invadens
ELTDRGKSQL

SEQ ID NO: 2852884 - protein, 7 aa, Entamoeba invadens
ELTEEEL

SEQ ID NO: 2852885 - protein, 8 aa, Entamoeba invadens
ELTEETGF

SEQ ID NO: 2852886 - protein, 7 aa, Entamoeba invadens
ELTENTN

SEQ ID NO: 2852887 - protein, 8 aa, Entamoeba invadens
ELTEQTKK

SEQ ID NO: 2852888 - protein, 4 aa, Entamoeba invadens
ELTG

SEQ ID NO: 2852889 - protein, 7 aa, Entamoeba invadens
ELTGQQV

SEQ ID NO: 2852890 - protein, 14 aa, Entamoeba invadens
ELTGRKRWEGGSTV

SEQ ID NO: 2852891 - protein, 12 aa, Entamoeba invadens
ELTKPQKKCIGS

SEQ ID NO: 2852892 - protein, 12 aa, Entamoeba invadens
ELTNNTQNPNKK

SEQ ID NO: 2852893 - protein, 4 aa, Entamoeba invadens
ELTP

SEQ ID NO: 2852894 - protein, 16 aa, Entamoeba invadens
ELTQECQADIVSVLNC

SEQ ID NO: 2852895 - protein, 8 aa, Entamoeba invadens
ELTQEEEE

SEQ ID NO: 2852896 - protein, 16 aa, Entamoeba invadens
ELTQKAGVKSKQYNSL

SEQ ID NO: 2852897 - protein, 5 aa, Entamoeba invadens
ELTQP

SEQ ID NO: 2852898 - protein, 13 aa, Entamoeba invadens
ELTQQKASCETQI

SEQ ID NO: 2852899 - protein, 8 aa, Entamoeba invadens
ELTQSPHA

SEQ ID NO: 2852900 - protein, 12 aa, Entamoeba invadens
ELTRKDKEEDRM

SEQ ID NO: 2852901 - protein, 6 aa, Entamoeba invadens
ELTRQT

SEQ ID NO: 2852902 - protein, 20 aa, Entamoeba invadens
ELTSSENNEEELLEENNEQM

SEQ ID NO: 2852903 - protein, 4 aa, Entamoeba invadens
ELTT

SEQ ID NO: 2852904 - protein, 8 aa, Entamoeba invadens
ELTTSAEE

SEQ ID NO: 2852905 - protein, 8 aa, Entamoeba invadens
ELTTSKLD

SEQ ID NO: 2852906 - protein, 16 aa, Entamoeba invadens
ELTTSNKSKEEQVEEL

SEQ ID NO: 2852907 - protein, 12 aa, Entamoeba invadens
ELTTTGVPAEVT

SEQ ID NO: 2852908 - protein, 7 aa, Entamoeba invadens
ELTTTTK

SEQ ID NO: 2852909 - protein, 4 aa, Entamoeba invadens
ELTV

SEQ ID NO: 2852910 - protein, 5 aa, Entamoeba invadens
ELVGE

SEQ ID NO: 2852911 - protein, 12 aa, Entamoeba invadens
ELVKKQDKVSQT

SEQ ID NO: 2852912 - protein, 4 aa, Entamoeba invadens
ELVQ

SEQ ID NO: 2852913 - protein, 5 aa, Entamoeba invadens
ELYPG

SEQ ID NO: 2852914 - protein, 6 aa, Entamoeba invadens
ELYPNF

SEQ ID NO: 2852915 - protein, 11 aa, Entamoeba invadens
EMAKSDSAAVG

SEQ ID NO: 2852916 - protein, 15 aa, Entamoeba invadens
EMAKSENEKVKKEES

SEQ ID NO: 2852917 - protein, 11 aa, Entamoeba invadens
EMATGKKEDEF

SEQ ID NO: 2852918 - protein, 22 aa, Entamoeba invadens
EMCQGNNEKSLKGMNEENDTDM

SEQ ID NO: 2852919 - protein, 13 aa, Entamoeba invadens
EMDEDNEKTGVDI

SEQ ID NO: 2852920 - protein, 9 aa, Entamoeba invadens
EMDENETTN

SEQ ID NO: 2852921 - protein, 18 aa, Entamoeba invadens
EMDNYKKKKRERSSLSLL

SEQ ID NO: 2852922 - protein, 9 aa, Entamoeba invadens
EMDSGAFSD

SEQ ID NO: 2852923 - protein, 10 aa, Entamoeba invadens
EMEDSSDLKP

SEQ ID NO: 2852924 - protein, 10 aa, Entamoeba invadens
EMEEDTKIRN

SEQ ID NO: 2852925 - protein, 9 aa, Entamoeba invadens
EMEERKKKY

SEQ ID NO: 2852926 - protein, 13 aa, Entamoeba invadens
EMEESEKLGQQDS

SEQ ID NO: 2852927 - protein, 6 aa, Entamoeba invadens
EMEGKS

SEQ ID NO: 2852928 - protein, 14 aa, Entamoeba invadens
EMEKRNKTNRVTTE

SEQ ID NO: 2852929 - protein, 12 aa, Entamoeba invadens
EMEKSKNSPSVF

SEQ ID NO: 2852930 - protein, 4 aa, Entamoeba invadens
EMEN

SEQ ID NO: 2852931 - protein, 6 aa, Entamoeba invadens
EMENCE

SEQ ID NO: 2852932 - protein, 5 aa, Entamoeba invadens
EMENE

SEQ ID NO: 2852933 - protein, 15 aa, Entamoeba invadens
EMERRKGVKEKTTMR

SEQ ID NO: 2852934 - protein, 5 aa, Entamoeba invadens
EMESE

SEQ ID NO: 2852935 - protein, 11 aa, Entamoeba invadens
EMESVGKKPRI

SEQ ID NO: 2852936 - protein, 5 aa, Entamoeba invadens
EMETT

SEQ ID NO: 2852937 - protein, 8 aa, Entamoeba invadens
EMGEEGEV

SEQ ID NO: 2852938 - protein, 10 aa, Entamoeba invadens
EMGENPPRQN

SEQ ID NO: 2852939 - protein, 10 aa, Entamoeba invadens
EMGGENTPKS

SEQ ID NO: 2852940 - protein, 9 aa, Entamoeba invadens
EMGNNTNEF

SEQ ID NO: 2852941 - protein, 6 aa, Entamoeba invadens
EMGQSD

SEQ ID NO: 2852942 - protein, 7 aa, Entamoeba invadens
EMGSADA

SEQ ID NO: 2852943 - protein, 9 aa, Entamoeba invadens
EMKDKKTTV

SEQ ID NO: 2852944 - protein, 4 aa, Entamoeba invadens
EMKE

SEQ ID NO: 2852945 - protein, 20 aa, Entamoeba invadens
EMKETETKECTPEEKNQIVE

SEQ ID NO: 2852946 - protein, 24 aa, Entamoeba invadens
EMKGNQQREIENDGTKSVLGTTPQ

SEQ ID NO: 2852947 - protein, 12 aa, Entamoeba invadens
EMKKENEDLEKK

SEQ ID NO: 2852948 - protein, 28 aa, Entamoeba invadens
EMKKKENAKLRTEIETHKDVGENPMTSK

SEQ ID NO: 2852949 - protein, 5 aa, Entamoeba invadens
EMKKV

SEQ ID NO: 2852950 - protein, 5 aa, Entamoeba invadens
EMKNE

SEQ ID NO: 2852951 - protein, 10 aa, Entamoeba invadens
EMKNSALENA

SEQ ID NO: 2852952 - protein, 12 aa, Entamoeba invadens
EMKRRHDKLNEL

SEQ ID NO: 2852953 - protein, 9 aa, Entamoeba invadens
EMKSETVEK

SEQ ID NO: 2852954 - protein, 9 aa, Entamoeba invadens
EMKSRRQQI

SEQ ID NO: 2852955 - protein, 5 aa, Entamoeba invadens
EMKSV

SEQ ID NO: 2852956 - protein, 5 aa, Entamoeba invadens
EMKTG

SEQ ID NO: 2852957 - protein, 6 aa, Entamoeba invadens
EMKTGT

SEQ ID NO: 2852958 - protein, 7 aa, Entamoeba invadens
EMKTSEL

SEQ ID NO: 2852959 - protein, 15 aa, Entamoeba invadens
EMKTTGDEEGFEVLE

SEQ ID NO: 2852960 - protein, 4 aa, Entamoeba invadens
EMLS

SEQ ID NO: 2852961 - protein, 5 aa, Entamoeba invadens
EMNEE

SEQ ID NO: 2852962 - protein, 5 aa, Entamoeba invadens
EMNEN

SEQ ID NO: 2852963 - protein, 9 aa, Entamoeba invadens
EMNGQATLE

SEQ ID NO: 2852964 - protein, 15 aa, Entamoeba invadens
EMNKDGSDTDTRSSY

SEQ ID NO: 2852965 - protein, 8 aa, Entamoeba invadens
EMNKENLD

SEQ ID NO: 2852966 - protein, 9 aa, Entamoeba invadens
EMNKESLNQ

SEQ ID NO: 2852967 - protein, 9 aa, Entamoeba invadens
EMNKKASNI

SEQ ID NO: 2852968 - protein, 5 aa, Entamoeba invadens
EMNPD

SEQ ID NO: 2852969 - protein, 7 aa, Entamoeba invadens
EMNPNNV

SEQ ID NO: 2852970 - protein, 5 aa, Entamoeba invadens
EMNQP

SEQ ID NO: 2852971 - protein, 9 aa, Entamoeba invadens
EMNSDTGKN

SEQ ID NO: 2852972 - protein, 8 aa, Entamoeba invadens
EMNTRIPE

SEQ ID NO: 2852973 - protein, 10 aa, Entamoeba invadens
EMPAESGYPA

SEQ ID NO: 2852974 - protein, 8 aa, Entamoeba invadens
EMPEGGNA

SEQ ID NO: 2852975 - protein, 12 aa, Entamoeba invadens
EMPEKREDNNNA

SEQ ID NO: 2852976 - protein, 11 aa, Entamoeba invadens
EMPGKQGKPEK

SEQ ID NO: 2852977 - protein, 6 aa, Entamoeba invadens
EMPGTK

SEQ ID NO: 2852978 - protein, 11 aa, Entamoeba invadens
EMPKDTKEILE

SEQ ID NO: 2852979 - protein, 9 aa, Entamoeba invadens
EMPKNERDI

SEQ ID NO: 2852980 - protein, 13 aa, Entamoeba invadens
EMPQQEKMKEMPG

SEQ ID NO: 2852981 - protein, 12 aa, Entamoeba invadens
EMQDDTLKGKRN

SEQ ID NO: 2852982 - protein, 4 aa, Entamoeba invadens
EMQG

SEQ ID NO: 2852983 - protein, 20 aa, Entamoeba invadens
EMQKAASSSELEKSNELPDG

SEQ ID NO: 2852984 - protein, 8 aa, Entamoeba invadens
EMQNTGQG

SEQ ID NO: 2852985 - protein, 11 aa, Entamoeba invadens
EMQRENEKKMV

SEQ ID NO: 2852986 - protein, 6 aa, Entamoeba invadens
EMQRQN

SEQ ID NO: 2852987 - protein, 6 aa, Entamoeba invadens
EMQSFN

SEQ ID NO: 2852988 - protein, 10 aa, Entamoeba invadens
EMRDSDKKIV

SEQ ID NO: 2852989 - protein, 17 aa, Entamoeba invadens
EMREARINREKQNAETL

SEQ ID NO: 2852990 - protein, 5 aa, Entamoeba invadens
EMRNS

SEQ ID NO: 2852991 - protein, 9 aa, Entamoeba invadens
EMRQEEEDM

SEQ ID NO: 2852992 - protein, 12 aa, Entamoeba invadens
EMRRNDSAEYNK

SEQ ID NO: 2852993 - protein, 34 aa, Entamoeba invadens
EMSDEENSLSEYDKSQDDPQDESQDESDDEITDF

SEQ ID NO: 2852994 - protein, 10 aa, Entamoeba invadens
EMSDNAKDHL

SEQ ID NO: 2852995 - protein, 14 aa, Entamoeba invadens
EMSETMDTEEGEYS

SEQ ID NO: 2852996 - protein, 16 aa, Entamoeba invadens
EMSGDSTLSKGELSTT

SEQ ID NO: 2852997 - protein, 7 aa, Entamoeba invadens
EMSKDLD

SEQ ID NO: 2852998 - protein, 10 aa, Entamoeba invadens
EMSPTTSIET

SEQ ID NO: 2852999 - protein, 4 aa, Entamoeba invadens
EMSS

SEQ ID NO: 2853000 - protein, 8 aa, Entamoeba invadens
EMTDKNTS

SEQ ID NO: 2853001 - protein, 13 aa, Entamoeba invadens
EMTDSTNKKLDPL

SEQ ID NO: 2853002 - protein, 7 aa, Entamoeba invadens
EMTESEK

SEQ ID NO: 2853003 - protein, 12 aa, Entamoeba invadens
EMTEVPKSKEIA

SEQ ID NO: 2853004 - protein, 6 aa, Entamoeba invadens
EMTKKD

SEQ ID NO: 2853005 - protein, 4 aa, Entamoeba invadens
EMTQ

SEQ ID NO: 2853006 - protein, 21 aa, Entamoeba invadens
EMTQNDVQKVENKLSNATIRD

SEQ ID NO: 2853007 - protein, 6 aa, Entamoeba invadens
EMTQTD

SEQ ID NO: 2853008 - protein, 12 aa, Entamoeba invadens
EMTRRPKKEASM

SEQ ID NO: 2853009 - protein, 5 aa, Entamoeba invadens
EMTST

SEQ ID NO: 2853010 - protein, 5 aa, Entamoeba invadens
EMTTK

SEQ ID NO: 2853011 - protein, 5 aa, Entamoeba invadens
EMTYG

SEQ ID NO: 2853012 - protein, 11 aa, Entamoeba invadens
EMVDSTTATLT

SEQ ID NO: 2853013 - protein, 4 aa, Entamoeba invadens
EMVT

SEQ ID NO: 2853014 - protein, 9 aa, Entamoeba invadens
EMYQSNESL

SEQ ID NO: 2853015 - protein, 9 aa, Entamoeba invadens
ENAAEAKGK

SEQ ID NO: 2853016 - protein, 7 aa, Entamoeba invadens
ENAANKV

SEQ ID NO: 2853017 - protein, 7 aa, Entamoeba invadens
ENAAQNL

SEQ ID NO: 2853018 - protein, 8 aa, Entamoeba invadens
ENACSQNQ

SEQ ID NO: 2853019 - protein, 40 aa, Entamoeba invadens
ENADDDQEVKRVETPYSAISKQQKTKAPQSPSKVQDHKKN

SEQ ID NO: 2853020 - protein, 5 aa, Entamoeba invadens
ENADR

SEQ ID NO: 2853021 - protein, 4 aa, Entamoeba invadens
ENAE

SEQ ID NO: 2853022 - protein, 10 aa, Entamoeba invadens
ENAEADKDSL

SEQ ID NO: 2853023 - protein, 9 aa, Entamoeba invadens
ENAEDKVRG

SEQ ID NO: 2853024 - protein, 5 aa, Entamoeba invadens
ENAEE

SEQ ID NO: 2853025 - protein, 15 aa, Entamoeba invadens
ENAEFEKDEYYNKEY

SEQ ID NO: 2853026 - protein, 5 aa, Entamoeba invadens
ENAEG

SEQ ID NO: 2853027 - protein, 16 aa, Entamoeba invadens
ENAESQQSHNKENVIK

SEQ ID NO: 2853028 - protein, 10 aa, Entamoeba invadens
ENAETQNTEL

SEQ ID NO: 2853029 - protein, 7 aa, Entamoeba invadens
ENAETVR

SEQ ID NO: 2853030 - protein, 4 aa, Entamoeba invadens
ENAG

SEQ ID NO: 2853031 - protein, 6 aa, Entamoeba invadens
ENAGRD

SEQ ID NO: 2853032 - protein, 5 aa, Entamoeba invadens
ENAHL

SEQ ID NO: 2853033 - protein, 8 aa, Entamoeba invadens
ENAIEASS

SEQ ID NO: 2853034 - protein, 10 aa, Entamoeba invadens
ENAIPNRSQC

SEQ ID NO: 2853035 - protein, 8 aa, Entamoeba invadens
ENAISSTT

SEQ ID NO: 2853036 - protein, 4 aa, Entamoeba invadens
ENAK

SEQ ID NO: 2853037 - protein, 11 aa, Entamoeba invadens
ENAKASANALE

SEQ ID NO: 2853038 - protein, 5 aa, Entamoeba invadens
ENAKD

SEQ ID NO: 2853039 - protein, 6 aa, Entamoeba invadens
ENAKPM

SEQ ID NO: 2853040 - protein, 9 aa, Entamoeba invadens
ENAKSNPVQ

SEQ ID NO: 2853041 - protein, 7 aa, Entamoeba invadens
ENALEDI

SEQ ID NO: 2853042 - protein, 12 aa, Entamoeba invadens
ENALQKNRLTQQ

SEQ ID NO: 2853043 - protein, 22 aa, Entamoeba invadens
ENANDEKAIKEEEQKVSSVPVQ

SEQ ID NO: 2853044 - protein, 10 aa, Entamoeba invadens
ENANKITDDV

SEQ ID NO: 2853045 - protein, 8 aa, Entamoeba invadens
ENANNTEL

SEQ ID NO: 2853046 - protein, 9 aa, Entamoeba invadens
ENAPEKFTE

SEQ ID NO: 2853047 - protein, 7 aa, Entamoeba invadens
ENAPIPE

SEQ ID NO: 2853048 - protein, 5 aa, Entamoeba invadens
ENAPT

SEQ ID NO: 2853049 - protein, 8 aa, Entamoeba invadens
ENAQIRER

SEQ ID NO: 2853050 - protein, 8 aa, Entamoeba invadens
ENAQTRKD

SEQ ID NO: 2853051 - protein, 5 aa, Entamoeba invadens
ENARK

SEQ ID NO: 2853052 - protein, 17 aa, Entamoeba invadens
ENARLAQSDDVWIMEKK

SEQ ID NO: 2853053 - protein, 8 aa, Entamoeba invadens
ENARQEFK

SEQ ID NO: 2853054 - protein, 16 aa, Entamoeba invadens
ENASDKGNVTNQEDIK

SEQ ID NO: 2853055 - protein, 9 aa, Entamoeba invadens
ENASGRSNA

SEQ ID NO: 2853056 - protein, 22 aa, Entamoeba invadens
ENASLRAGGAKKNKIDDEQREA

SEQ ID NO: 2853057 - protein, 13 aa, Entamoeba invadens
ENASTAAKKRSAS

SEQ ID NO: 2853058 - protein, 6 aa, Entamoeba invadens
ENASTQ

SEQ ID NO: 2853059 - protein, 13 aa, Entamoeba invadens
ENASTQAKKRSAS

SEQ ID NO: 2853060 - protein, 6 aa, Entamoeba invadens
ENASVG

SEQ ID NO: 2853061 - protein, 8 aa, Entamoeba invadens
ENATESAI

SEQ ID NO: 2853062 - protein, 10 aa, Entamoeba invadens
ENATFSGNLP

SEQ ID NO: 2853063 - protein, 23 aa, Entamoeba invadens
ENATIEKQEKVEKKRETLRKPNE

SEQ ID NO: 2853064 - protein, 6 aa, Entamoeba invadens
ENATST

SEQ ID NO: 2853065 - protein, 5 aa, Entamoeba invadens
ENAWN

SEQ ID NO: 2853066 - protein, 4 aa, Entamoeba invadens
ENCD

SEQ ID NO: 2853067 - protein, 4 aa, Entamoeba invadens
ENCE

SEQ ID NO: 2853068 - protein, 10 aa, Entamoeba invadens
ENCGNTSDPF

SEQ ID NO: 2853069 - protein, 9 aa, Entamoeba invadens
ENCNSDEEV

SEQ ID NO: 2853070 - protein, 15 aa, Entamoeba invadens
ENCQVKNSRVAESFE

SEQ ID NO: 2853071 - protein, 8 aa, Entamoeba invadens
ENCSETNR

SEQ ID NO: 2853072 - protein, 5 aa, Entamoeba invadens
ENDAF

SEQ ID NO: 2853073 - protein, 5 aa, Entamoeba invadens
ENDAH

SEQ ID NO: 2853074 - protein, 6 aa, Entamoeba invadens
ENDAKT

SEQ ID NO: 2853075 - protein, 7 aa, Entamoeba invadens
ENDAKTL

SEQ ID NO: 2853076 - protein, 14 aa, Entamoeba invadens
ENDANEMSKGRIPA

SEQ ID NO: 2853077 - protein, 12 aa, Entamoeba invadens
ENDCDENDIITK

SEQ ID NO: 2853078 - protein, 8 aa, Entamoeba invadens
ENDEDDYQ

SEQ ID NO: 2853079 - protein, 9 aa, Entamoeba invadens
ENDEIDKRL

SEQ ID NO: 2853080 - protein, 7 aa, Entamoeba invadens
ENDENFG

SEQ ID NO: 2853081 - protein, 55 aa, Entamoeba invadens
ENDENGEEEESSENSEGSNSKEMDEENNEANDGQDNGSESGENAMSEDDVPNLSD

SEQ ID NO: 2853082 - protein, 6 aa, Entamoeba invadens
ENDENI

SEQ ID NO: 2853083 - protein, 8 aa, Entamoeba invadens
ENDETKAL

SEQ ID NO: 2853084 - protein, 5 aa, Entamoeba invadens
ENDFE

SEQ ID NO: 2853085 - protein, 4 aa, Entamoeba invadens
ENDG

SEQ ID NO: 2853086 - protein, 13 aa, Entamoeba invadens
ENDGDVRSRENEV

SEQ ID NO: 2853087 - protein, 6 aa, Entamoeba invadens
ENDGKK

SEQ ID NO: 2853088 - protein, 7 aa, Entamoeba invadens
ENDGVKR

SEQ ID NO: 2853089 - protein, 9 aa, Entamoeba invadens
ENDHSVKDK

SEQ ID NO: 2853090 - protein, 7 aa, Entamoeba invadens
ENDINET

SEQ ID NO: 2853091 - protein, 17 aa, Entamoeba invadens
ENDKGQLTMVSDESSPI

SEQ ID NO: 2853092 - protein, 11 aa, Entamoeba invadens
ENDKKKEEERE

SEQ ID NO: 2853093 - protein, 8 aa, Entamoeba invadens
ENDKLQKD

SEQ ID NO: 2853094 - protein, 5 aa, Entamoeba invadens
ENDKM

SEQ ID NO: 2853095 - protein, 100 aa, Entamoeba invadens
ENDKNASAPPPPPPSRGGCPPPPPGRRPGPPTSSSGMQVPSKRPPPPPKKKLPPPPPNKNAPGTPAHQNVPPPVPRKQGPPIPAPRTNGPPAPPPPRHGG

SEQ ID NO: 2853096 - protein, 15 aa, Entamoeba invadens
ENDLNTTKKDYTTQI

SEQ ID NO: 2853097 - protein, 4 aa, Entamoeba invadens
ENDM

SEQ ID NO: 2853098 - protein, 5 aa, Entamoeba invadens
ENDMN

SEQ ID NO: 2853099 - protein, 6 aa, Entamoeba invadens
ENDMRN

SEQ ID NO: 2853100 - protein, 11 aa, Entamoeba invadens
ENDMSPGLRDY

SEQ ID NO: 2853101 - protein, 4 aa, Entamoeba invadens
ENDN

SEQ ID NO: 2853102 - protein, 7 aa, Entamoeba invadens
ENDNGEV

SEQ ID NO: 2853103 - protein, 12 aa, Entamoeba invadens
ENDNKSNNTEED

SEQ ID NO: 2853104 - protein, 5 aa, Entamoeba invadens
ENDNM

SEQ ID NO: 2853105 - protein, 9 aa, Entamoeba invadens
ENDNPTKCT

SEQ ID NO: 2853106 - protein, 11 aa, Entamoeba invadens
ENDNSNQTTKK

SEQ ID NO: 2853107 - protein, 5 aa, Entamoeba invadens
ENDNT

SEQ ID NO: 2853108 - protein, 11 aa, Entamoeba invadens
ENDNTKSGIIP

SEQ ID NO: 2853109 - protein, 5 aa, Entamoeba invadens
ENDPD

SEQ ID NO: 2853110 - protein, 12 aa, Entamoeba invadens
ENDPNGKMGSFD

SEQ ID NO: 2853111 - protein, 7 aa, Entamoeba invadens
ENDPRLG

SEQ ID NO: 2853112 - protein, 7 aa, Entamoeba invadens
ENDQFEK

SEQ ID NO: 2853113 - protein, 8 aa, Entamoeba invadens
ENDQHHGL

SEQ ID NO: 2853114 - protein, 15 aa, Entamoeba invadens
ENDQQHHQQSITTTK

SEQ ID NO: 2853115 - protein, 7 aa, Entamoeba invadens
ENDQTPV

SEQ ID NO: 2853116 - protein, 10 aa, Entamoeba invadens
ENDRISPSVT

SEQ ID NO: 2853117 - protein, 8 aa, Entamoeba invadens
ENDRKCSK

SEQ ID NO: 2853118 - protein, 17 aa, Entamoeba invadens
ENDRNKFGNKIPSSVTS

SEQ ID NO: 2853119 - protein, 5 aa, Entamoeba invadens
ENDSE

SEQ ID NO: 2853120 - protein, 13 aa, Entamoeba invadens
ENDSKNVVTYPQD

SEQ ID NO: 2853121 - protein, 30 aa, Entamoeba invadens
ENDSLRSGGEEAATLKTTNEGLKKKISEYE

SEQ ID NO: 2853122 - protein, 6 aa, Entamoeba invadens
ENDSNN

SEQ ID NO: 2853123 - protein, 9 aa, Entamoeba invadens
ENDTKENTL

SEQ ID NO: 2853124 - protein, 5 aa, Entamoeba invadens
ENDTS

SEQ ID NO: 2853125 - protein, 51 aa, Entamoeba invadens
ENDTTEIFNQNDKNKEMEDIRKNTEKKFDQKINKNSYKNETKAKKEDDSSE

SEQ ID NO: 2853126 - protein, 5 aa, Entamoeba invadens
ENDTY

SEQ ID NO: 2853127 - protein, 4 aa, Entamoeba invadens
ENDV

SEQ ID NO: 2853128 - protein, 11 aa, Entamoeba invadens
ENDVDETRVSE

SEQ ID NO: 2853129 - protein, 5 aa, Entamoeba invadens
ENDVI

SEQ ID NO: 2853130 - protein, 15 aa, Entamoeba invadens
ENDVMDASKKEYEYG

SEQ ID NO: 2853131 - protein, 12 aa, Entamoeba invadens
ENDVPDLNQPEN

SEQ ID NO: 2853132 - protein, 6 aa, Entamoeba invadens
ENDVQE

SEQ ID NO: 2853133 - protein, 7 aa, Entamoeba invadens
ENDVQKR

SEQ ID NO: 2853134 - protein, 7 aa, Entamoeba invadens
ENDVQQP

SEQ ID NO: 2853135 - protein, 13 aa, Entamoeba invadens
ENDYTQYMKWQTE

SEQ ID NO: 2853136 - protein, 8 aa, Entamoeba invadens
ENEADPLI

SEQ ID NO: 2853137 - protein, 15 aa, Entamoeba invadens
ENECETTAAISQKTG

SEQ ID NO: 2853138 - protein, 8 aa, Entamoeba invadens
ENECQSAN

SEQ ID NO: 2853139 - protein, 6 aa, Entamoeba invadens
ENEDCE

SEQ ID NO: 2853140 - protein, 11 aa, Entamoeba invadens
ENEDDQQLSND

SEQ ID NO: 2853141 - protein, 7 aa, Entamoeba invadens
ENEDFET

SEQ ID NO: 2853142 - protein, 18 aa, Entamoeba invadens
ENEDKNDTESEQDDQDDL

SEQ ID NO: 2853143 - protein, 11 aa, Entamoeba invadens
ENEDKTKLRQL

SEQ ID NO: 2853144 - protein, 6 aa, Entamoeba invadens
ENEDNK

SEQ ID NO: 2853145 - protein, 5 aa, Entamoeba invadens
ENEDY

SEQ ID NO: 2853146 - protein, 6 aa, Entamoeba invadens
ENEEAV

SEQ ID NO: 2853147 - protein, 20 aa, Entamoeba invadens
ENEEDAAKAVSAPKNSVLGN

SEQ ID NO: 2853148 - protein, 7 aa, Entamoeba invadens
ENEEDEQ

SEQ ID NO: 2853149 - protein, 8 aa, Entamoeba invadens
ENEEDGVD

SEQ ID NO: 2853150 - protein, 16 aa, Entamoeba invadens
ENEEDRAVQAKVESLD

SEQ ID NO: 2853151 - protein, 9 aa, Entamoeba invadens
ENEEDRDEV

SEQ ID NO: 2853152 - protein, 6 aa, Entamoeba invadens
ENEEEI

SEQ ID NO: 2853153 - protein, 10 aa, Entamoeba invadens
ENEEGGGKQM

SEQ ID NO: 2853154 - protein, 12 aa, Entamoeba invadens
ENEEIQIDKESR

SEQ ID NO: 2853155 - protein, 17 aa, Entamoeba invadens
ENEELKNKMKEQQFSSG

SEQ ID NO: 2853156 - protein, 9 aa, Entamoeba invadens
ENEEQQHPD

SEQ ID NO: 2853157 - protein, 12 aa, Entamoeba invadens
ENEESNEESGQM

SEQ ID NO: 2853158 - protein, 7 aa, Entamoeba invadens
ENEETYP

SEQ ID NO: 2853159 - protein, 5 aa, Entamoeba invadens
ENEEW

SEQ ID NO: 2853160 - protein, 7 aa, Entamoeba invadens
ENEEYHT

SEQ ID NO: 2853161 - protein, 6 aa, Entamoeba invadens
ENEFDE

SEQ ID NO: 2853162 - protein, 8 aa, Entamoeba invadens
ENEGNCST

SEQ ID NO: 2853163 - protein, 7 aa, Entamoeba invadens
ENEGQDL

SEQ ID NO: 2853164 - protein, 13 aa, Entamoeba invadens
ENEGTEDDTKKRI

SEQ ID NO: 2853165 - protein, 4 aa, Entamoeba invadens
ENEH

SEQ ID NO: 2853166 - protein, 13 aa, Entamoeba invadens
ENEHKKDKENEVH

SEQ ID NO: 2853167 - protein, 4 aa, Entamoeba invadens
ENEI

SEQ ID NO: 2853168 - protein, 6 aa, Entamoeba invadens
ENEIAE

SEQ ID NO: 2853169 - protein, 7 aa, Entamoeba invadens
ENEIDDV

SEQ ID NO: 2853170 - protein, 6 aa, Entamoeba invadens
ENEIDG

SEQ ID NO: 2853171 - protein, 6 aa, Entamoeba invadens
ENEIGK

SEQ ID NO: 2853172 - protein, 15 aa, Entamoeba invadens
ENEINGSGEPRASLS

SEQ ID NO: 2853173 - protein, 8 aa, Entamoeba invadens
ENEIRGKP

SEQ ID NO: 2853174 - protein, 4 aa, Entamoeba invadens
ENEK

SEQ ID NO: 2853175 - protein, 10 aa, Entamoeba invadens
ENEKDDRGNR

SEQ ID NO: 2853176 - protein, 14 aa, Entamoeba invadens
ENEKDGEKKEKRNL

SEQ ID NO: 2853177 - protein, 15 aa, Entamoeba invadens
ENEKDHSSYKDNRKI

SEQ ID NO: 2853178 - protein, 5 aa, Entamoeba invadens
ENEKE

SEQ ID NO: 2853179 - protein, 8 aa, Entamoeba invadens
ENEKELEK

SEQ ID NO: 2853180 - protein, 6 aa, Entamoeba invadens
ENEKEM

SEQ ID NO: 2853181 - protein, 5 aa, Entamoeba invadens
ENEKI

SEQ ID NO: 2853182 - protein, 13 aa, Entamoeba invadens
ENEKIKEDTQQKE

SEQ ID NO: 2853183 - protein, 39 aa, Entamoeba invadens
ENEKKKAEKKEKLEKRINESQKYNKQHQKQTEKKEKGIE

SEQ ID NO: 2853184 - protein, 14 aa, Entamoeba invadens
ENEKLRKDSSGKRL

SEQ ID NO: 2853185 - protein, 14 aa, Entamoeba invadens
ENEKREKAEHKSED

SEQ ID NO: 2853186 - protein, 9 aa, Entamoeba invadens
ENEKTKISL

SEQ ID NO: 2853187 - protein, 8 aa, Entamoeba invadens
ENEKVRSE

SEQ ID NO: 2853188 - protein, 8 aa, Entamoeba invadens
ENELDKKD

SEQ ID NO: 2853189 - protein, 8 aa, Entamoeba invadens
ENELNRPR

SEQ ID NO: 2853190 - protein, 5 aa, Entamoeba invadens
ENEMN

SEQ ID NO: 2853191 - protein, 5 aa, Entamoeba invadens
ENENA

SEQ ID NO: 2853192 - protein, 6 aa, Entamoeba invadens
ENENDN

SEQ ID NO: 2853193 - protein, 6 aa, Entamoeba invadens
ENENFG

SEQ ID NO: 2853194 - protein, 7 aa, Entamoeba invadens
ENENNMS

SEQ ID NO: 2853195 - protein, 5 aa, Entamoeba invadens
ENENV

SEQ ID NO: 2853196 - protein, 7 aa, Entamoeba invadens
ENEPMPC

SEQ ID NO: 2853197 - protein, 26 aa, Entamoeba invadens
ENEPQGCQSQCDDGYYETTENGTAKC

SEQ ID NO: 2853198 - protein, 9 aa, Entamoeba invadens
ENEPSVTSD

SEQ ID NO: 2853199 - protein, 5 aa, Entamoeba invadens
ENEQA

SEQ ID NO: 2853200 - protein, 86 aa, Entamoeba invadens
ENEQKVEQKNEESTPQSVESQSNEQQQIPPQVQQQRRVTPPNLQQNSVPNAQQPKSPRERNLPPIPPQTKPPMHPKPNRPMHQKTE

SEQ ID NO: 2853201 - protein, 16 aa, Entamoeba invadens
ENEQNYNNDEDRIADE

SEQ ID NO: 2853202 - protein, 16 aa, Entamoeba invadens
ENERATAAQCLENKWF

SEQ ID NO: 2853203 - protein, 29 aa, Entamoeba invadens
ENERDEGDFDVDGNYTKSQRKSDDERDDW

SEQ ID NO: 2853204 - protein, 11 aa, Entamoeba invadens
ENERESLNVTS

SEQ ID NO: 2853205 - protein, 7 aa, Entamoeba invadens
ENERETF

SEQ ID NO: 2853206 - protein, 5 aa, Entamoeba invadens
ENERK

SEQ ID NO: 2853207 - protein, 12 aa, Entamoeba invadens
ENERKSVSKTPL

SEQ ID NO: 2853208 - protein, 18 aa, Entamoeba invadens
ENERNEKAQSALETTKSG

SEQ ID NO: 2853209 - protein, 5 aa, Entamoeba invadens
ENERV

SEQ ID NO: 2853210 - protein, 15 aa, Entamoeba invadens
ENERVQNENAEEVKK

SEQ ID NO: 2853211 - protein, 7 aa, Entamoeba invadens
ENESDEL

SEQ ID NO: 2853212 - protein, 5 aa, Entamoeba invadens
ENESH

SEQ ID NO: 2853213 - protein, 6 aa, Entamoeba invadens
ENESIK

SEQ ID NO: 2853214 - protein, 10 aa, Entamoeba invadens
ENESKEVDTL

SEQ ID NO: 2853215 - protein, 8 aa, Entamoeba invadens
ENESSAAN

SEQ ID NO: 2853216 - protein, 7 aa, Entamoeba invadens
ENETDSV

SEQ ID NO: 2853217 - protein, 6 aa, Entamoeba invadens
ENETET

SEQ ID NO: 2853218 - protein, 6 aa, Entamoeba invadens
ENETFG

SEQ ID NO: 2853219 - protein, 9 aa, Entamoeba invadens
ENETGEDVG

SEQ ID NO: 2853220 - protein, 7 aa, Entamoeba invadens
ENETKNF

SEQ ID NO: 2853221 - protein, 6 aa, Entamoeba invadens
ENETTT

SEQ ID NO: 2853222 - protein, 5 aa, Entamoeba invadens
ENEVP

SEQ ID NO: 2853223 - protein, 18 aa, Entamoeba invadens
ENEVQRHKEITQKFSEEK

SEQ ID NO: 2853224 - protein, 11 aa, Entamoeba invadens
ENEYDAPKNGL

SEQ ID NO: 2853225 - protein, 14 aa, Entamoeba invadens
ENFDEYDVSKTEQT

SEQ ID NO: 2853226 - protein, 5 aa, Entamoeba invadens
ENFEN

SEQ ID NO: 2853227 - protein, 11 aa, Entamoeba invadens
ENFENTSRNCQ

SEQ ID NO: 2853228 - protein, 20 aa, Entamoeba invadens
ENFESDDEDIGVTDKDKEIA

SEQ ID NO: 2853229 - protein, 10 aa, Entamoeba invadens
ENFEVSDSRI

SEQ ID NO: 2853230 - protein, 7 aa, Entamoeba invadens
ENFGEVD

SEQ ID NO: 2853231 - protein, 5 aa, Entamoeba invadens
ENFGN

SEQ ID NO: 2853232 - protein, 6 aa, Entamoeba invadens
ENFGND

SEQ ID NO: 2853233 - protein, 6 aa, Entamoeba invadens
ENFGNG

SEQ ID NO: 2853234 - protein, 22 aa, Entamoeba invadens
ENFGSDSTGVGTPLSDARRRDF

SEQ ID NO: 2853235 - protein, 9 aa, Entamoeba invadens
ENFKTDPKP

SEQ ID NO: 2853236 - protein, 4 aa, Entamoeba invadens
ENFN

SEQ ID NO: 2853237 - protein, 11 aa, Entamoeba invadens
ENFNASTKTPE

SEQ ID NO: 2853238 - protein, 23 aa, Entamoeba invadens
ENFNTGDEIVEENEDDDDIFGDE

SEQ ID NO: 2853239 - protein, 6 aa, Entamoeba invadens
ENFQRR

SEQ ID NO: 2853240 - protein, 12 aa, Entamoeba invadens
ENGAVEEGIPST

SEQ ID NO: 2853241 - protein, 7 aa, Entamoeba invadens
ENGAVTQ

SEQ ID NO: 2853242 - protein, 6 aa, Entamoeba invadens
ENGCNT

SEQ ID NO: 2853243 - protein, 7 aa, Entamoeba invadens
ENGDCEN

SEQ ID NO: 2853244 - protein, 6 aa, Entamoeba invadens
ENGDKS

SEQ ID NO: 2853245 - protein, 8 aa, Entamoeba invadens
ENGDSNKF

SEQ ID NO: 2853246 - protein, 7 aa, Entamoeba invadens
ENGDTNE

SEQ ID NO: 2853247 - protein, 5 aa, Entamoeba invadens
ENGDV

SEQ ID NO: 2853248 - protein, 7 aa, Entamoeba invadens
ENGEAVA

SEQ ID NO: 2853249 - protein, 15 aa, Entamoeba invadens
ENGEETQFKDEVKGA

SEQ ID NO: 2853250 - protein, 11 aa, Entamoeba invadens
ENGEGLYDTEE

SEQ ID NO: 2853251 - protein, 10 aa, Entamoeba invadens
ENGEKSGGKV

SEQ ID NO: 2853252 - protein, 15 aa, Entamoeba invadens
ENGEREKLEELSNKT

SEQ ID NO: 2853253 - protein, 14 aa, Entamoeba invadens
ENGERKKLEELSKM

SEQ ID NO: 2853254 - protein, 5 aa, Entamoeba invadens
ENGES

SEQ ID NO: 2853255 - protein, 10 aa, Entamoeba invadens
ENGETKRELK

SEQ ID NO: 2853256 - protein, 19 aa, Entamoeba invadens
ENGEYDESDVNCQEGEYQK

SEQ ID NO: 2853257 - protein, 8 aa, Entamoeba invadens
ENGGIVRG

SEQ ID NO: 2853258 - protein, 6 aa, Entamoeba invadens
ENGGVS

SEQ ID NO: 2853259 - protein, 4 aa, Entamoeba invadens
ENGH

SEQ ID NO: 2853260 - protein, 23 aa, Entamoeba invadens
ENGHETLPKDIPRTVKEIEEFMK

SEQ ID NO: 2853261 - protein, 4 aa, Entamoeba invadens
ENGI

SEQ ID NO: 2853262 - protein, 22 aa, Entamoeba invadens
ENGIDTSSCSSENLVDGGEGYK

SEQ ID NO: 2853263 - protein, 6 aa, Entamoeba invadens
ENGILE

SEQ ID NO: 2853264 - protein, 8 aa, Entamoeba invadens
ENGIPSCD

SEQ ID NO: 2853265 - protein, 12 aa, Entamoeba invadens
ENGKDGRSGQRF

SEQ ID NO: 2853266 - protein, 6 aa, Entamoeba invadens
ENGKEM

SEQ ID NO: 2853267 - protein, 16 aa, Entamoeba invadens
ENGKKKCGKYNIKEKR

SEQ ID NO: 2853268 - protein, 15 aa, Entamoeba invadens
ENGKKKTSGIFSEEE

SEQ ID NO: 2853269 - protein, 5 aa, Entamoeba invadens
ENGKL

SEQ ID NO: 2853270 - protein, 20 aa, Entamoeba invadens
ENGKLDVEKSIQASPYQDAI

SEQ ID NO: 2853271 - protein, 6 aa, Entamoeba invadens
ENGKLR

SEQ ID NO: 2853272 - protein, 30 aa, Entamoeba invadens
ENGKNPSERVEKKEQKDLKSEKYMKESEEY

SEQ ID NO: 2853273 - protein, 5 aa, Entamoeba invadens
ENGKR

SEQ ID NO: 2853274 - protein, 12 aa, Entamoeba invadens
ENGKVKKVRGGE

SEQ ID NO: 2853275 - protein, 5 aa, Entamoeba invadens
ENGKY

SEQ ID NO: 2853276 - protein, 7 aa, Entamoeba invadens
ENGLEEF

SEQ ID NO: 2853277 - protein, 7 aa, Entamoeba invadens
ENGLKQR

SEQ ID NO: 2853278 - protein, 7 aa, Entamoeba invadens
ENGLPEE

SEQ ID NO: 2853279 - protein, 7 aa, Entamoeba invadens
ENGNEKR

SEQ ID NO: 2853280 - protein, 8 aa, Entamoeba invadens
ENGNETDI

SEQ ID NO: 2853281 - protein, 11 aa, Entamoeba invadens
ENGNKKCEKCK

SEQ ID NO: 2853282 - protein, 6 aa, Entamoeba invadens
ENGNSA

SEQ ID NO: 2853283 - protein, 17 aa, Entamoeba invadens
ENGNYGAETLTTTFSNN

SEQ ID NO: 2853284 - protein, 7 aa, Entamoeba invadens
ENGPIEV

SEQ ID NO: 2853285 - protein, 7 aa, Entamoeba invadens
ENGPIRE

SEQ ID NO: 2853286 - protein, 15 aa, Entamoeba invadens
ENGQKFDKKVDNDTV

SEQ ID NO: 2853287 - protein, 6 aa, Entamoeba invadens
ENGQVN

SEQ ID NO: 2853288 - protein, 5 aa, Entamoeba invadens
ENGRW

SEQ ID NO: 2853289 - protein, 6 aa, Entamoeba invadens
ENGSEV

SEQ ID NO: 2853290 - protein, 6 aa, Entamoeba invadens
ENGTED

SEQ ID NO: 2853291 - protein, 8 aa, Entamoeba invadens
ENGTFDVQ

SEQ ID NO: 2853292 - protein, 9 aa, Entamoeba invadens
ENGTKGELD

SEQ ID NO: 2853293 - protein, 15 aa, Entamoeba invadens
ENGTKGVKTKTTATL

SEQ ID NO: 2853294 - protein, 13 aa, Entamoeba invadens
ENGTLKTENETLK

SEQ ID NO: 2853295 - protein, 5 aa, Entamoeba invadens
ENGVA

SEQ ID NO: 2853296 - protein, 5 aa, Entamoeba invadens
ENGVC

SEQ ID NO: 2853297 - protein, 5 aa, Entamoeba invadens
ENGVD

SEQ ID NO: 2853298 - protein, 5 aa, Entamoeba invadens
ENGVG

SEQ ID NO: 2853299 - protein, 7 aa, Entamoeba invadens
ENGVPPS

SEQ ID NO: 2853300 - protein, 14 aa, Entamoeba invadens
ENGWKAETDASTPL

SEQ ID NO: 2853301 - protein, 7 aa, Entamoeba invadens
ENHHPEE

SEQ ID NO: 2853302 - protein, 7 aa, Entamoeba invadens
ENHKISE

SEQ ID NO: 2853303 - protein, 13 aa, Entamoeba invadens
ENHLKDDEYLEQD

SEQ ID NO: 2853304 - protein, 4 aa, Entamoeba invadens
ENHM

SEQ ID NO: 2853305 - protein, 7 aa, Entamoeba invadens
ENHMDKD

SEQ ID NO: 2853306 - protein, 69 aa, Entamoeba invadens
ENHQKEKDTNSEEQDVKKISDDEWNEVPSKKKKKTTKKVKKVSKKNKKEKITKPEREEMSRSQKENVIE

SEQ ID NO: 2853307 - protein, 21 aa, Entamoeba invadens
ENHQQTLPNDVAQNYNTKHEI

SEQ ID NO: 2853308 - protein, 8 aa, Entamoeba invadens
ENHSDEEK

SEQ ID NO: 2853309 - protein, 12 aa, Entamoeba invadens
ENHTKKGKITVP

SEQ ID NO: 2853310 - protein, 4 aa, Entamoeba invadens
ENID

SEQ ID NO: 2853311 - protein, 9 aa, Entamoeba invadens
ENIDCENKP

SEQ ID NO: 2853312 - protein, 11 aa, Entamoeba invadens
ENIDDKKAPFV

SEQ ID NO: 2853313 - protein, 19 aa, Entamoeba invadens
ENIEDKSVTMETHNKSGPI

SEQ ID NO: 2853314 - protein, 9 aa, Entamoeba invadens
ENIKRARDM

SEQ ID NO: 2853315 - protein, 4 aa, Entamoeba invadens
ENIN

SEQ ID NO: 2853316 - protein, 7 aa, Entamoeba invadens
ENINTTE

SEQ ID NO: 2853317 - protein, 4 aa, Entamoeba invadens
ENIP

SEQ ID NO: 2853318 - protein, 6 aa, Entamoeba invadens
ENIPES

SEQ ID NO: 2853319 - protein, 13 aa, Entamoeba invadens
ENIPNRSRKQCRE

SEQ ID NO: 2853320 - protein, 9 aa, Entamoeba invadens
ENIRKDERV

SEQ ID NO: 2853321 - protein, 96 aa, Entamoeba invadens
ENISEVSENGNVSATVSIPSEVNEEQKKDIAKKKTPQTEEDIRSVESSQTPTTPTNTEIPSEQSSVDEKPTTAQAEGTPPESQSKLEDQNTDISSL

SEQ ID NO: 2853322 - protein, 30 aa, Entamoeba invadens
ENISNVPKKSVVKSTQKDIQSEQKEQEKAV

SEQ ID NO: 2853323 - protein, 10 aa, Entamoeba invadens
ENISQKKLEP

SEQ ID NO: 2853324 - protein, 16 aa, Entamoeba invadens
ENITDTLTHKQSSVTE

SEQ ID NO: 2853325 - protein, 7 aa, Entamoeba invadens
ENITPES

SEQ ID NO: 2853326 - protein, 5 aa, Entamoeba invadens
ENITT

SEQ ID NO: 2853327 - protein, 31 aa, Entamoeba invadens
ENKAKEDKRKRLKRKTKEQGINGVTPAIQTE

SEQ ID NO: 2853328 - protein, 18 aa, Entamoeba invadens
ENKAKEDLANKKKVTLTE

SEQ ID NO: 2853329 - protein, 6 aa, Entamoeba invadens
ENKAKK

SEQ ID NO: 2853330 - protein, 10 aa, Entamoeba invadens
ENKAQNREQL

SEQ ID NO: 2853331 - protein, 7 aa, Entamoeba invadens
ENKATIP

SEQ ID NO: 2853332 - protein, 9 aa, Entamoeba invadens
ENKDADDTE

SEQ ID NO: 2853333 - protein, 10 aa, Entamoeba invadens
ENKDDKLSES

SEQ ID NO: 2853334 - protein, 9 aa, Entamoeba invadens
ENKDRSGLK

SEQ ID NO: 2853335 - protein, 5 aa, Entamoeba invadens
ENKDS

SEQ ID NO: 2853336 - protein, 5 aa, Entamoeba invadens
ENKDT

SEQ ID NO: 2853337 - protein, 6 aa, Entamoeba invadens
ENKDTI

SEQ ID NO: 2853338 - protein, 7 aa, Entamoeba invadens
ENKDVKE

SEQ ID NO: 2853339 - protein, 9 aa, Entamoeba invadens
ENKDVRDTS

SEQ ID NO: 2853340 - protein, 5 aa, Entamoeba invadens
ENKEC

SEQ ID NO: 2853341 - protein, 18 aa, Entamoeba invadens
ENKEEEKMTKEEKRAARK

SEQ ID NO: 2853342 - protein, 8 aa, Entamoeba invadens
ENKEEELS

SEQ ID NO: 2853343 - protein, 7 aa, Entamoeba invadens
ENKEEGL

SEQ ID NO: 2853344 - protein, 45 aa, Entamoeba invadens
ENKEIEGKEEKRMRRRKKQGDFMDETESDHVNEKIEKKENESDEI

SEQ ID NO: 2853345 - protein, 54 aa, Entamoeba invadens
ENKEKNDASLRRRENSISSTKVNRTSVTSTVARRKKSPHGKKEKERLLSQILIT

SEQ ID NO: 2853346 - protein, 53 aa, Entamoeba invadens
ENKENKKIAVEEKTLSKNVGLEKKDDVVKEEKSGKKGHLRKNSEENEKRGKKQ

SEQ ID NO: 2853347 - protein, 11 aa, Entamoeba invadens
ENKESATKELT

SEQ ID NO: 2853348 - protein, 9 aa, Entamoeba invadens
ENKETRLKE

SEQ ID NO: 2853349 - protein, 31 aa, Entamoeba invadens
ENKETSMRSSAGHQHSPSVPQSYSYTPKSSI

SEQ ID NO: 2853350 - protein, 14 aa, Entamoeba invadens
ENKFGEYKEQAEKS

SEQ ID NO: 2853351 - protein, 7 aa, Entamoeba invadens
ENKGKWY

SEQ ID NO: 2853352 - protein, 7 aa, Entamoeba invadens
ENKGKYP

SEQ ID NO: 2853353 - protein, 11 aa, Entamoeba invadens
ENKHKSKTFEA

SEQ ID NO: 2853354 - protein, 4 aa, Entamoeba invadens
ENKI

SEQ ID NO: 2853355 - protein, 24 aa, Entamoeba invadens
ENKIEKEKPAADNNNEDSVSKRES

SEQ ID NO: 2853356 - protein, 4 aa, Entamoeba invadens
ENKK

SEQ ID NO: 2853357 - protein, 10 aa, Entamoeba invadens
ENKKEEEALK

SEQ ID NO: 2853358 - protein, 9 aa, Entamoeba invadens
ENKKESGTL

SEQ ID NO: 2853359 - protein, 5 aa, Entamoeba invadens
ENKKF

SEQ ID NO: 2853360 - protein, 7 aa, Entamoeba invadens
ENKKPHI

SEQ ID NO: 2853361 - protein, 16 aa, Entamoeba invadens
ENKKSVGSVPDGVTEL

SEQ ID NO: 2853362 - protein, 8 aa, Entamoeba invadens
ENKLGEGS

SEQ ID NO: 2853363 - protein, 7 aa, Entamoeba invadens
ENKLNES

SEQ ID NO: 2853364 - protein, 11 aa, Entamoeba invadens
ENKMVSSTSPI

SEQ ID NO: 2853365 - protein, 12 aa, Entamoeba invadens
ENKMVSSTSPIE

SEQ ID NO: 2853366 - protein, 15 aa, Entamoeba invadens
ENKNLTKQKESLEEN

SEQ ID NO: 2853367 - protein, 10 aa, Entamoeba invadens
ENKNQRSATY

SEQ ID NO: 2853368 - protein, 16 aa, Entamoeba invadens
ENKNTAITQLQNTNEE

SEQ ID NO: 2853369 - protein, 6 aa, Entamoeba invadens
ENKNVS

SEQ ID NO: 2853370 - protein, 9 aa, Entamoeba invadens
ENKQKNETI

SEQ ID NO: 2853371 - protein, 6 aa, Entamoeba invadens
ENKQQA

SEQ ID NO: 2853372 - protein, 11 aa, Entamoeba invadens
ENKQYKTQEFD

SEQ ID NO: 2853373 - protein, 9 aa, Entamoeba invadens
ENKRTYKDT

SEQ ID NO: 2853374 - protein, 9 aa, Entamoeba invadens
ENKSEKIKE

SEQ ID NO: 2853375 - protein, 5 aa, Entamoeba invadens
ENKSL

SEQ ID NO: 2853376 - protein, 17 aa, Entamoeba invadens
ENKSPNDNKNNTGICVA

SEQ ID NO: 2853377 - protein, 6 aa, Entamoeba invadens
ENKTDH

SEQ ID NO: 2853378 - protein, 6 aa, Entamoeba invadens
ENKTIN

SEQ ID NO: 2853379 - protein, 10 aa, Entamoeba invadens
ENKTKKEWGE

SEQ ID NO: 2853380 - protein, 6 aa, Entamoeba invadens
ENKTTS

SEQ ID NO: 2853381 - protein, 10 aa, Entamoeba invadens
ENKVDDAGKV

SEQ ID NO: 2853382 - protein, 10 aa, Entamoeba invadens
ENKVKDNYFG

SEQ ID NO: 2853383 - protein, 23 aa, Entamoeba invadens
ENKVQLNDKATLEMGTFKMTFHI

SEQ ID NO: 2853384 - protein, 9 aa, Entamoeba invadens
ENKYTTNTS

SEQ ID NO: 2853385 - protein, 18 aa, Entamoeba invadens
ENLDKKHSNQLNDDKDIQ

SEQ ID NO: 2853386 - protein, 15 aa, Entamoeba invadens
ENLDPKEKKSDEEMK

SEQ ID NO: 2853387 - protein, 5 aa, Entamoeba invadens
ENLEH

SEQ ID NO: 2853388 - protein, 12 aa, Entamoeba invadens
ENLEKDEVAIDR

SEQ ID NO: 2853389 - protein, 8 aa, Entamoeba invadens
ENLEKKGF

SEQ ID NO: 2853390 - protein, 20 aa, Entamoeba invadens
ENLHTTANQVTSDDEKVPPR

SEQ ID NO: 2853391 - protein, 10 aa, Entamoeba invadens
ENLKKKKKDF

SEQ ID NO: 2853392 - protein, 5 aa, Entamoeba invadens
ENLND

SEQ ID NO: 2853393 - protein, 6 aa, Entamoeba invadens
ENLNED

SEQ ID NO: 2853394 - protein, 17 aa, Entamoeba invadens
ENLNERNVPTINLQSLQ

SEQ ID NO: 2853395 - protein, 10 aa, Entamoeba invadens
ENLNKDEKCA

SEQ ID NO: 2853396 - protein, 8 aa, Entamoeba invadens
ENLNKTIG

SEQ ID NO: 2853397 - protein, 5 aa, Entamoeba invadens
ENLNP

SEQ ID NO: 2853398 - protein, 8 aa, Entamoeba invadens
ENLNPTYL

SEQ ID NO: 2853399 - protein, 15 aa, Entamoeba invadens
ENLNTQQQQRPTGVR

SEQ ID NO: 2853400 - protein, 31 aa, Entamoeba invadens
ENLNTSKNGIEKEKNRIASELNDSKSQNERL

SEQ ID NO: 2853401 - protein, 5 aa, Entamoeba invadens
ENLPA

SEQ ID NO: 2853402 - protein, 14 aa, Entamoeba invadens
ENLPDAKVKPNQEE

SEQ ID NO: 2853403 - protein, 6 aa, Entamoeba invadens
ENLPPT

SEQ ID NO: 2853404 - protein, 11 aa, Entamoeba invadens
ENLREGNDADI

SEQ ID NO: 2853405 - protein, 10 aa, Entamoeba invadens
ENLRKSGNFG

SEQ ID NO: 2853406 - protein, 5 aa, Entamoeba invadens
ENLRT

SEQ ID NO: 2853407 - protein, 12 aa, Entamoeba invadens
ENLSSEFGVMVY

SEQ ID NO: 2853408 - protein, 11 aa, Entamoeba invadens
ENLTGKRREEI

SEQ ID NO: 2853409 - protein, 5 aa, Entamoeba invadens
ENLTS

SEQ ID NO: 2853410 - protein, 4 aa, Entamoeba invadens
ENME

SEQ ID NO: 2853411 - protein, 20 aa, Entamoeba invadens
ENMETSQVQEKTKKPIPKEV

SEQ ID NO: 2853412 - protein, 12 aa, Entamoeba invadens
ENMGSKTRNEVT

SEQ ID NO: 2853413 - protein, 7 aa, Entamoeba invadens
ENMPSHL

SEQ ID NO: 2853414 - protein, 4 aa, Entamoeba invadens
ENMT

SEQ ID NO: 2853415 - protein, 4 aa, Entamoeba invadens
ENND

SEQ ID NO: 2853416 - protein, 5 aa, Entamoeba invadens
ENNDK

SEQ ID NO: 2853417 - protein, 7 aa, Entamoeba invadens
ENNDSVS

SEQ ID NO: 2853418 - protein, 8 aa, Entamoeba invadens
ENNEENEY

SEQ ID NO: 2853419 - protein, 9 aa, Entamoeba invadens
ENNEGSTEW

SEQ ID NO: 2853420 - protein, 6 aa, Entamoeba invadens
ENNEGW

SEQ ID NO: 2853421 - protein, 10 aa, Entamoeba invadens
ENNEKQQEAA

SEQ ID NO: 2853422 - protein, 8 aa, Entamoeba invadens
ENNELTKA

SEQ ID NO: 2853423 - protein, 15 aa, Entamoeba invadens
ENNENPIELYKKLYA

SEQ ID NO: 2853424 - protein, 6 aa, Entamoeba invadens
ENNEYI

SEQ ID NO: 2853425 - protein, 6 aa, Entamoeba invadens
ENNEYN

SEQ ID NO: 2853426 - protein, 4 aa, Entamoeba invadens
ENNF

SEQ ID NO: 2853427 - protein, 5 aa, Entamoeba invadens
ENNFS

SEQ ID NO: 2853428 - protein, 10 aa, Entamoeba invadens
ENNGCTPCDP

SEQ ID NO: 2853429 - protein, 42 aa, Entamoeba invadens
ENNGIETETQEESESASSRVQNEEKSRENSEGQIVLGADDFL

SEQ ID NO: 2853430 - protein, 5 aa, Entamoeba invadens
ENNGN

SEQ ID NO: 2853431 - protein, 6 aa, Entamoeba invadens
ENNGQF

SEQ ID NO: 2853432 - protein, 17 aa, Entamoeba invadens
ENNGQLKKIEKSVSQNR

SEQ ID NO: 2853433 - protein, 10 aa, Entamoeba invadens
ENNHYDGNGI

SEQ ID NO: 2853434 - protein, 14 aa, Entamoeba invadens
ENNIKSVDVPQTVT

SEQ ID NO: 2853435 - protein, 5 aa, Entamoeba invadens
ENNIL

SEQ ID NO: 2853436 - protein, 9 aa, Entamoeba invadens
ENNKEIASE

SEQ ID NO: 2853437 - protein, 7 aa, Entamoeba invadens
ENNKFGG

SEQ ID NO: 2853438 - protein, 8 aa, Entamoeba invadens
ENNKIAER

SEQ ID NO: 2853439 - protein, 41 aa, Entamoeba invadens
ENNKKEISRSKDENENLKKENSSLSCENEKIETAKNEIENS

SEQ ID NO: 2853440 - protein, 8 aa, Entamoeba invadens
ENNKKPAF

SEQ ID NO: 2853441 - protein, 8 aa, Entamoeba invadens
ENNKNSIE

SEQ ID NO: 2853442 - protein, 13 aa, Entamoeba invadens
ENNLNQKSQEYYD

SEQ ID NO: 2853443 - protein, 5 aa, Entamoeba invadens
ENNLS

SEQ ID NO: 2853444 - protein, 7 aa, Entamoeba invadens
ENNMENA

SEQ ID NO: 2853445 - protein, 12 aa, Entamoeba invadens
ENNNKPVEVGKV

SEQ ID NO: 2853446 - protein, 7 aa, Entamoeba invadens
ENNNTFG

SEQ ID NO: 2853447 - protein, 8 aa, Entamoeba invadens
ENNPHLGY

SEQ ID NO: 2853448 - protein, 8 aa, Entamoeba invadens
ENNPNALE

SEQ ID NO: 2853449 - protein, 21 aa, Entamoeba invadens
ENNQLKEENEKLKSVTESLSV

SEQ ID NO: 2853450 - protein, 9 aa, Entamoeba invadens
ENNQNYTLQ

SEQ ID NO: 2853451 - protein, 5 aa, Entamoeba invadens
ENNQT

SEQ ID NO: 2853452 - protein, 5 aa, Entamoeba invadens
ENNQV

SEQ ID NO: 2853453 - protein, 4 aa, Entamoeba invadens
ENNR

SEQ ID NO: 2853454 - protein, 6 aa, Entamoeba invadens
ENNRIS

SEQ ID NO: 2853455 - protein, 11 aa, Entamoeba invadens
ENNSETDKDGM

SEQ ID NO: 2853456 - protein, 6 aa, Entamoeba invadens
ENNSGS

SEQ ID NO: 2853457 - protein, 10 aa, Entamoeba invadens
ENNSKMEDDI

SEQ ID NO: 2853458 - protein, 18 aa, Entamoeba invadens
ENNSKQQNSEKDEKMETQ

SEQ ID NO: 2853459 - protein, 10 aa, Entamoeba invadens
ENNSKSAELG

SEQ ID NO: 2853460 - protein, 5 aa, Entamoeba invadens
ENNTE

SEQ ID NO: 2853461 - protein, 9 aa, Entamoeba invadens
ENNTESVTS

SEQ ID NO: 2853462 - protein, 20 aa, Entamoeba invadens
ENNTLKSTIDADDTKLKTQE

SEQ ID NO: 2853463 - protein, 17 aa, Entamoeba invadens
ENNTTRETTSKIYPPKV

SEQ ID NO: 2853464 - protein, 13 aa, Entamoeba invadens
ENNYIGQKSTKPF

SEQ ID NO: 2853465 - protein, 6 aa, Entamoeba invadens
ENPAAN

SEQ ID NO: 2853466 - protein, 5 aa, Entamoeba invadens
ENPAD

SEQ ID NO: 2853467 - protein, 8 aa, Entamoeba invadens
ENPDKVNY

SEQ ID NO: 2853468 - protein, 8 aa, Entamoeba invadens
ENPDSVED

SEQ ID NO: 2853469 - protein, 4 aa, Entamoeba invadens
ENPE

SEQ ID NO: 2853470 - protein, 12 aa, Entamoeba invadens
ENPEDDKNMAPN

SEQ ID NO: 2853471 - protein, 10 aa, Entamoeba invadens
ENPERQSDQI

SEQ ID NO: 2853472 - protein, 6 aa, Entamoeba invadens
ENPEVD

SEQ ID NO: 2853473 - protein, 4 aa, Entamoeba invadens
ENPF

SEQ ID NO: 2853474 - protein, 6 aa, Entamoeba invadens
ENPFGR

SEQ ID NO: 2853475 - protein, 8 aa, Entamoeba invadens
ENPGQNDV

SEQ ID NO: 2853476 - protein, 10 aa, Entamoeba invadens
ENPHAQKKKK

SEQ ID NO: 2853477 - protein, 6 aa, Entamoeba invadens
ENPIDY

SEQ ID NO: 2853478 - protein, 6 aa, Entamoeba invadens
ENPKFA

SEQ ID NO: 2853479 - protein, 9 aa, Entamoeba invadens
ENPKTKTTA

SEQ ID NO: 2853480 - protein, 4 aa, Entamoeba invadens
ENPL

SEQ ID NO: 2853481 - protein, 7 aa, Entamoeba invadens
ENPLTGR

SEQ ID NO: 2853482 - protein, 7 aa, Entamoeba invadens
ENPMTSG

SEQ ID NO: 2853483 - protein, 11 aa, Entamoeba invadens
ENPNDFGKGKK

SEQ ID NO: 2853484 - protein, 7 aa, Entamoeba invadens
ENPNSTD

SEQ ID NO: 2853485 - protein, 9 aa, Entamoeba invadens
ENPPANTEA

SEQ ID NO: 2853486 - protein, 6 aa, Entamoeba invadens
ENPPEN

SEQ ID NO: 2853487 - protein, 5 aa, Entamoeba invadens
ENPPI

SEQ ID NO: 2853488 - protein, 5 aa, Entamoeba invadens
ENPPK

SEQ ID NO: 2853489 - protein, 6 aa, Entamoeba invadens
ENPPKM

SEQ ID NO: 2853490 - protein, 7 aa, Entamoeba invadens
ENPPLFD

SEQ ID NO: 2853491 - protein, 8 aa, Entamoeba invadens
ENPPLSSI

SEQ ID NO: 2853492 - protein, 6 aa, Entamoeba invadens
ENPPPS

SEQ ID NO: 2853493 - protein, 11 aa, Entamoeba invadens
ENPPSQKQIDS

SEQ ID NO: 2853494 - protein, 6 aa, Entamoeba invadens
ENPQPF

SEQ ID NO: 2853495 - protein, 15 aa, Entamoeba invadens
ENPQRSDQKSGKMNI

SEQ ID NO: 2853496 - protein, 13 aa, Entamoeba invadens
ENPQYSTSSTQKD

SEQ ID NO: 2853497 - protein, 7 aa, Entamoeba invadens
ENPSITS

SEQ ID NO: 2853498 - protein, 6 aa, Entamoeba invadens
ENPSML

SEQ ID NO: 2853499 - protein, 6 aa, Entamoeba invadens
ENPSRV

SEQ ID NO: 2853500 - protein, 8 aa, Entamoeba invadens
ENPTDKKS

SEQ ID NO: 2853501 - protein, 5 aa, Entamoeba invadens
ENPTF

SEQ ID NO: 2853502 - protein, 5 aa, Entamoeba invadens
ENPTH

SEQ ID NO: 2853503 - protein, 10 aa, Entamoeba invadens
ENPTKFDPRE

SEQ ID NO: 2853504 - protein, 7 aa, Entamoeba invadens
ENPTSKM

SEQ ID NO: 2853505 - protein, 7 aa, Entamoeba invadens
ENPTSSI

SEQ ID NO: 2853506 - protein, 6 aa, Entamoeba invadens
ENPTTQ

SEQ ID NO: 2853507 - protein, 7 aa, Entamoeba invadens
ENPTVQT

SEQ ID NO: 2853508 - protein, 6 aa, Entamoeba invadens
ENPVGK

SEQ ID NO: 2853509 - protein, 6 aa, Entamoeba invadens
ENPVPL

SEQ ID NO: 2853510 - protein, 5 aa, Entamoeba invadens
ENPYD

SEQ ID NO: 2853511 - protein, 11 aa, Entamoeba invadens
ENPYEQPGTDN

SEQ ID NO: 2853512 - protein, 10 aa, Entamoeba invadens
ENPYNQWTAP

SEQ ID NO: 2853513 - protein, 5 aa, Entamoeba invadens
ENPYV

SEQ ID NO: 2853514 - protein, 4 aa, Entamoeba invadens
ENQD

SEQ ID NO: 2853515 - protein, 11 aa, Entamoeba invadens
ENQDGGEGNTG

SEQ ID NO: 2853516 - protein, 10 aa, Entamoeba invadens
ENQDGGIGGR

SEQ ID NO: 2853517 - protein, 45 aa, Entamoeba invadens
ENQDNQDNQDESKNKNEEKKDDEGENDGEDDADTDINSKAGGVTK

SEQ ID NO: 2853518 - protein, 4 aa, Entamoeba invadens
ENQE

SEQ ID NO: 2853519 - protein, 12 aa, Entamoeba invadens
ENQEADKSEFAT

SEQ ID NO: 2853520 - protein, 6 aa, Entamoeba invadens
ENQEDF

SEQ ID NO: 2853521 - protein, 8 aa, Entamoeba invadens
ENQFESQQ

SEQ ID NO: 2853522 - protein, 29 aa, Entamoeba invadens
ENQFSHPPIPRKEVEGESVYDKQEREDLN

SEQ ID NO: 2853523 - protein, 5 aa, Entamoeba invadens
ENQGF

SEQ ID NO: 2853524 - protein, 15 aa, Entamoeba invadens
ENQHQKSETKRAEEK

SEQ ID NO: 2853525 - protein, 49 aa, Entamoeba invadens
ENQKIKTKNEQKEDLKKDEERVKKSKDEILKDREDRKRKKEEERKQKAK

SEQ ID NO: 2853526 - protein, 60 aa, Entamoeba invadens
ENQKKLQDIERQKKAADDEKKRLEKERKKAKREEKEAKAKIEELKEKQKERAKEKEALEL

SEQ ID NO: 2853527 - protein, 18 aa, Entamoeba invadens
ENQKQFSAKYKEAIKSMS

SEQ ID NO: 2853528 - protein, 9 aa, Entamoeba invadens
ENQKRLTEM

SEQ ID NO: 2853529 - protein, 11 aa, Entamoeba invadens
ENQKSRRTIEV

SEQ ID NO: 2853530 - protein, 20 aa, Entamoeba invadens
ENQMDEERAENVNLLGGFEE

SEQ ID NO: 2853531 - protein, 6 aa, Entamoeba invadens
ENQNLK

SEQ ID NO: 2853532 - protein, 14 aa, Entamoeba invadens
ENQNLPFSTMFSSI

SEQ ID NO: 2853533 - protein, 25 aa, Entamoeba invadens
ENQNQVDNNEINKVTEVKQNTLQCT

SEQ ID NO: 2853534 - protein, 13 aa, Entamoeba invadens
ENQQKNEKGVLEE

SEQ ID NO: 2853535 - protein, 16 aa, Entamoeba invadens
ENQQNYNNDEDRIADE

SEQ ID NO: 2853536 - protein, 7 aa, Entamoeba invadens
ENQQQSW

SEQ ID NO: 2853537 - protein, 10 aa, Entamoeba invadens
ENQRQIAPDG

SEQ ID NO: 2853538 - protein, 5 aa, Entamoeba invadens
ENQRS

SEQ ID NO: 2853539 - protein, 8 aa, Entamoeba invadens
ENQSTPPE

SEQ ID NO: 2853540 - protein, 55 aa, Entamoeba invadens
ENQTEEEEEQNKDKNKEEKKTEESSEESPENKQEKQNKETIEDMRDEKDNTNANL

SEQ ID NO: 2853541 - protein, 7 aa, Entamoeba invadens
ENQTEKS

SEQ ID NO: 2853542 - protein, 6 aa, Entamoeba invadens
ENQTSN

SEQ ID NO: 2853543 - protein, 8 aa, Entamoeba invadens
ENQYRRYT

SEQ ID NO: 2853544 - protein, 7 aa, Entamoeba invadens
ENRDAFS

SEQ ID NO: 2853545 - protein, 4 aa, Entamoeba invadens
ENRE

SEQ ID NO: 2853546 - protein, 7 aa, Entamoeba invadens
ENREGIR

SEQ ID NO: 2853547 - protein, 15 aa, Entamoeba invadens
ENREKSSLSKNRTQS

SEQ ID NO: 2853548 - protein, 4 aa, Entamoeba invadens
ENRG

SEQ ID NO: 2853549 - protein, 10 aa, Entamoeba invadens
ENRGKNVPQS

SEQ ID NO: 2853550 - protein, 8 aa, Entamoeba invadens
ENRGNKLS

SEQ ID NO: 2853551 - protein, 9 aa, Entamoeba invadens
ENRGNPKID

SEQ ID NO: 2853552 - protein, 10 aa, Entamoeba invadens
ENRKTTQLPK

SEQ ID NO: 2853553 - protein, 10 aa, Entamoeba invadens
ENRNYQSQQE

SEQ ID NO: 2853554 - protein, 6 aa, Entamoeba invadens
ENRRSL

SEQ ID NO: 2853555 - protein, 4 aa, Entamoeba invadens
ENRT

SEQ ID NO: 2853556 - protein, 34 aa, Entamoeba invadens
ENRTPLAQTQAQQIPQLPQNTNPMPSMTQPQQMT

SEQ ID NO: 2853557 - protein, 14 aa, Entamoeba invadens
ENRVEGSKRIEKGT

SEQ ID NO: 2853558 - protein, 5 aa, Entamoeba invadens
ENRVV

SEQ ID NO: 2853559 - protein, 12 aa, Entamoeba invadens
ENRYEELTGDYE

SEQ ID NO: 2853560 - protein, 17 aa, Entamoeba invadens
ENRYTPETYKYRNRPEE

SEQ ID NO: 2853561 - protein, 5 aa, Entamoeba invadens
ENSAV

SEQ ID NO: 2853562 - protein, 9 aa, Entamoeba invadens
ENSDDGAIV

SEQ ID NO: 2853563 - protein, 5 aa, Entamoeba invadens
ENSDR

SEQ ID NO: 2853564 - protein, 49 aa, Entamoeba invadens
ENSDSNDFEEEEHERSETKSKESHTTQDSGSDDVTKNPKGVKMEEENKA

SEQ ID NO: 2853565 - protein, 5 aa, Entamoeba invadens
ENSEA

SEQ ID NO: 2853566 - protein, 10 aa, Entamoeba invadens
ENSEAERKRR

SEQ ID NO: 2853567 - protein, 8 aa, Entamoeba invadens
ENSEDDSE

SEQ ID NO: 2853568 - protein, 19 aa, Entamoeba invadens
ENSEDTEVEVEGKAEDKKR

SEQ ID NO: 2853569 - protein, 5 aa, Entamoeba invadens
ENSEE

SEQ ID NO: 2853570 - protein, 10 aa, Entamoeba invadens
ENSEGEYSNV

SEQ ID NO: 2853571 - protein, 5 aa, Entamoeba invadens
ENSEH

SEQ ID NO: 2853572 - protein, 11 aa, Entamoeba invadens
ENSEKNGNDNM

SEQ ID NO: 2853573 - protein, 6 aa, Entamoeba invadens
ENSERD

SEQ ID NO: 2853574 - protein, 9 aa, Entamoeba invadens
ENSERESQA

SEQ ID NO: 2853575 - protein, 7 aa, Entamoeba invadens
ENSETVS

SEQ ID NO: 2853576 - protein, 8 aa, Entamoeba invadens
ENSEYASS

SEQ ID NO: 2853577 - protein, 8 aa, Entamoeba invadens
ENSFETEK

SEQ ID NO: 2853578 - protein, 5 aa, Entamoeba invadens
ENSFG

SEQ ID NO: 2853579 - protein, 10 aa, Entamoeba invadens
ENSFSEERSK

SEQ ID NO: 2853580 - protein, 4 aa, Entamoeba invadens
ENSG

SEQ ID NO: 2853581 - protein, 12 aa, Entamoeba invadens
ENSGGSRAKRVS

SEQ ID NO: 2853582 - protein, 6 aa, Entamoeba invadens
ENSGKE

SEQ ID NO: 2853583 - protein, 8 aa, Entamoeba invadens
ENSGPEKV

SEQ ID NO: 2853584 - protein, 15 aa, Entamoeba invadens
ENSIPTKKESFNASS

SEQ ID NO: 2853585 - protein, 5 aa, Entamoeba invadens
ENSIS

SEQ ID NO: 2853586 - protein, 6 aa, Entamoeba invadens
ENSITN

SEQ ID NO: 2853587 - protein, 12 aa, Entamoeba invadens
ENSKARTSSASL

SEQ ID NO: 2853588 - protein, 10 aa, Entamoeba invadens
ENSKEGLPDV

SEQ ID NO: 2853589 - protein, 15 aa, Entamoeba invadens
ENSKFQSETAKTIEN

SEQ ID NO: 2853590 - protein, 7 aa, Entamoeba invadens
ENSKNAL

SEQ ID NO: 2853591 - protein, 7 aa, Entamoeba invadens
ENSKNGV

SEQ ID NO: 2853592 - protein, 7 aa, Entamoeba invadens
ENSKTEE

SEQ ID NO: 2853593 - protein, 6 aa, Entamoeba invadens
ENSKTF

SEQ ID NO: 2853594 - protein, 11 aa, Entamoeba invadens
ENSKVNEDLAE

SEQ ID NO: 2853595 - protein, 8 aa, Entamoeba invadens
ENSKYKTK

SEQ ID NO: 2853596 - protein, 11 aa, Entamoeba invadens
ENSLDTENTLA

SEQ ID NO: 2853597 - protein, 10 aa, Entamoeba invadens
ENSLQEKKEQ

SEQ ID NO: 2853598 - protein, 9 aa, Entamoeba invadens
ENSLTGNEC

SEQ ID NO: 2853599 - protein, 10 aa, Entamoeba invadens
ENSNGGRDSH

SEQ ID NO: 2853600 - protein, 5 aa, Entamoeba invadens
ENSNP

SEQ ID NO: 2853601 - protein, 7 aa, Entamoeba invadens
ENSNTGC

SEQ ID NO: 2853602 - protein, 7 aa, Entamoeba invadens
ENSNVQD

SEQ ID NO: 2853603 - protein, 8 aa, Entamoeba invadens
ENSPKDGI

SEQ ID NO: 2853604 - protein, 10 aa, Entamoeba invadens
ENSPKNEGEM

SEQ ID NO: 2853605 - protein, 5 aa, Entamoeba invadens
ENSPY

SEQ ID NO: 2853606 - protein, 6 aa, Entamoeba invadens
ENSQKS

SEQ ID NO: 2853607 - protein, 12 aa, Entamoeba invadens
ENSREYSTTKIT

SEQ ID NO: 2853608 - protein, 8 aa, Entamoeba invadens
ENSRKCPK

SEQ ID NO: 2853609 - protein, 11 aa, Entamoeba invadens
ENSSFPPKTED

SEQ ID NO: 2853610 - protein, 7 aa, Entamoeba invadens
ENSSFTN

SEQ ID NO: 2853611 - protein, 11 aa, Entamoeba invadens
ENSSGYAEIQD

SEQ ID NO: 2853612 - protein, 9 aa, Entamoeba invadens
ENSSSVERA

SEQ ID NO: 2853613 - protein, 8 aa, Entamoeba invadens
ENSSVRSD

SEQ ID NO: 2853614 - protein, 5 aa, Entamoeba invadens
ENSTE

SEQ ID NO: 2853615 - protein, 16 aa, Entamoeba invadens
ENSTEGIKSEKIEKKH

SEQ ID NO: 2853616 - protein, 7 aa, Entamoeba invadens
ENSTKLD

SEQ ID NO: 2853617 - protein, 7 aa, Entamoeba invadens
ENSTKLN

SEQ ID NO: 2853618 - protein, 10 aa, Entamoeba invadens
ENSTLAGEDQ

SEQ ID NO: 2853619 - protein, 12 aa, Entamoeba invadens
ENSTNEKNSYQD

SEQ ID NO: 2853620 - protein, 6 aa, Entamoeba invadens
ENSTNG

SEQ ID NO: 2853621 - protein, 32 aa, Entamoeba invadens
ENSTTADNSVDPQTSDSSQESEDLNEKVELDS

SEQ ID NO: 2853622 - protein, 7 aa, Entamoeba invadens
ENSTTSE

SEQ ID NO: 2853623 - protein, 6 aa, Entamoeba invadens
ENSVVN

SEQ ID NO: 2853624 - protein, 6 aa, Entamoeba invadens
ENSYPK

SEQ ID NO: 2853625 - protein, 5 aa, Entamoeba invadens
ENSYV

SEQ ID NO: 2853626 - protein, 11 aa, Entamoeba invadens
ENTADGIDKAE

SEQ ID NO: 2853627 - protein, 13 aa, Entamoeba invadens
ENTAFDENVLIIR

SEQ ID NO: 2853628 - protein, 19 aa, Entamoeba invadens
ENTDDAKKAISSNGVEFDG

SEQ ID NO: 2853629 - protein, 5 aa, Entamoeba invadens
ENTDG

SEQ ID NO: 2853630 - protein, 7 aa, Entamoeba invadens
ENTDGRI

SEQ ID NO: 2853631 - protein, 5 aa, Entamoeba invadens
ENTDI

SEQ ID NO: 2853632 - protein, 18 aa, Entamoeba invadens
ENTDNMPMPEKEEKSYDT

SEQ ID NO: 2853633 - protein, 8 aa, Entamoeba invadens
ENTEFNQR

SEQ ID NO: 2853634 - protein, 7 aa, Entamoeba invadens
ENTENAD

SEQ ID NO: 2853635 - protein, 39 aa, Entamoeba invadens
ENTENADYTCQQSHQSNRRRNERRVGNSKTEIAKKEKRG

SEQ ID NO: 2853636 - protein, 5 aa, Entamoeba invadens
ENTEQ

SEQ ID NO: 2853637 - protein, 5 aa, Entamoeba invadens
ENTEV

SEQ ID NO: 2853638 - protein, 7 aa, Entamoeba invadens
ENTGEDM

SEQ ID NO: 2853639 - protein, 12 aa, Entamoeba invadens
ENTIPHKKYTES

SEQ ID NO: 2853640 - protein, 49 aa, Entamoeba invadens
ENTIQNTNEELDKKEENNEKQENVIENDEIKKPKRKTSRKRSSNLPAPV

SEQ ID NO: 2853641 - protein, 9 aa, Entamoeba invadens
ENTKETIKT

SEQ ID NO: 2853642 - protein, 5 aa, Entamoeba invadens
ENTKN

SEQ ID NO: 2853643 - protein, 7 aa, Entamoeba invadens
ENTKNIE

SEQ ID NO: 2853644 - protein, 6 aa, Entamoeba invadens
ENTKNQ

SEQ ID NO: 2853645 - protein, 9 aa, Entamoeba invadens
ENTKNYKRI

SEQ ID NO: 2853646 - protein, 6 aa, Entamoeba invadens
ENTKSH

SEQ ID NO: 2853647 - protein, 4 aa, Entamoeba invadens
ENTL

SEQ ID NO: 2853648 - protein, 7 aa, Entamoeba invadens
ENTLPPV

SEQ ID NO: 2853649 - protein, 8 aa, Entamoeba invadens
ENTLSNEE

SEQ ID NO: 2853650 - protein, 15 aa, Entamoeba invadens
ENTMNGVSKKMEEEP

SEQ ID NO: 2853651 - protein, 5 aa, Entamoeba invadens
ENTND

SEQ ID NO: 2853652 - protein, 6 aa, Entamoeba invadens
ENTNNS

SEQ ID NO: 2853653 - protein, 11 aa, Entamoeba invadens
ENTNQSQNKQL

SEQ ID NO: 2853654 - protein, 4 aa, Entamoeba invadens
ENTP

SEQ ID NO: 2853655 - protein, 5 aa, Entamoeba invadens
ENTPA

SEQ ID NO: 2853656 - protein, 8 aa, Entamoeba invadens
ENTPENYT

SEQ ID NO: 2853657 - protein, 5 aa, Entamoeba invadens
ENTPF

SEQ ID NO: 2853658 - protein, 8 aa, Entamoeba invadens
ENTPKTLP

SEQ ID NO: 2853659 - protein, 8 aa, Entamoeba invadens
ENTPNIKQ

SEQ ID NO: 2853660 - protein, 5 aa, Entamoeba invadens
ENTPR

SEQ ID NO: 2853661 - protein, 4 aa, Entamoeba invadens
ENTQ

SEQ ID NO: 2853662 - protein, 9 aa, Entamoeba invadens
ENTQFQEQD

SEQ ID NO: 2853663 - protein, 5 aa, Entamoeba invadens
ENTQL

SEQ ID NO: 2853664 - protein, 16 aa, Entamoeba invadens
ENTQSYHQPLSPTFSE

SEQ ID NO: 2853665 - protein, 7 aa, Entamoeba invadens
ENTQTEV

SEQ ID NO: 2853666 - protein, 4 aa, Entamoeba invadens
ENTR

SEQ ID NO: 2853667 - protein, 16 aa, Entamoeba invadens
ENTREDSSDDDASNYI

SEQ ID NO: 2853668 - protein, 8 aa, Entamoeba invadens
ENTRENYY

SEQ ID NO: 2853669 - protein, 11 aa, Entamoeba invadens
ENTRGASFTYG

SEQ ID NO: 2853670 - protein, 8 aa, Entamoeba invadens
ENTRKRKG

SEQ ID NO: 2853671 - protein, 13 aa, Entamoeba invadens
ENTRSKRSRAWQT

SEQ ID NO: 2853672 - protein, 12 aa, Entamoeba invadens
ENTRSKRTRAWQ

SEQ ID NO: 2853673 - protein, 4 aa, Entamoeba invadens
ENTS

SEQ ID NO: 2853674 - protein, 8 aa, Entamoeba invadens
ENTSATRV

SEQ ID NO: 2853675 - protein, 5 aa, Entamoeba invadens
ENTSD

SEQ ID NO: 2853676 - protein, 7 aa, Entamoeba invadens
ENTSDVS

SEQ ID NO: 2853677 - protein, 22 aa, Entamoeba invadens
ENTSNIPSSEFQTASDPQYVDR

SEQ ID NO: 2853678 - protein, 6 aa, Entamoeba invadens
ENTSTP

SEQ ID NO: 2853679 - protein, 6 aa, Entamoeba invadens
ENTSYY

SEQ ID NO: 2853680 - protein, 7 aa, Entamoeba invadens
ENTTDIK

SEQ ID NO: 2853681 - protein, 12 aa, Entamoeba invadens
ENTTNDKLDTIE

SEQ ID NO: 2853682 - protein, 5 aa, Entamoeba invadens
ENTTT

SEQ ID NO: 2853683 - protein, 11 aa, Entamoeba invadens
ENTTTRYKTQY

SEQ ID NO: 2853684 - protein, 10 aa, Entamoeba invadens
ENTYDESSSF

SEQ ID NO: 2853685 - protein, 7 aa, Entamoeba invadens
ENTYEDS

SEQ ID NO: 2853686 - protein, 5 aa, Entamoeba invadens
ENTYL

SEQ ID NO: 2853687 - protein, 10 aa, Entamoeba invadens
ENVDESDSQF

SEQ ID NO: 2853688 - protein, 11 aa, Entamoeba invadens
ENVDNSSDIQR

SEQ ID NO: 2853689 - protein, 25 aa, Entamoeba invadens
ENVDQDVEAEQVDLQTSNRPDTRGR

SEQ ID NO: 2853690 - protein, 5 aa, Entamoeba invadens
ENVEE

SEQ ID NO: 2853691 - protein, 14 aa, Entamoeba invadens
ENVEKEKRENKETF

SEQ ID NO: 2853692 - protein, 8 aa, Entamoeba invadens
ENVERRKK

SEQ ID NO: 2853693 - protein, 6 aa, Entamoeba invadens
ENVETA

SEQ ID NO: 2853694 - protein, 8 aa, Entamoeba invadens
ENVGEKMS

SEQ ID NO: 2853695 - protein, 6 aa, Entamoeba invadens
ENVGNT

SEQ ID NO: 2853696 - protein, 10 aa, Entamoeba invadens
ENVINDKSQT

SEQ ID NO: 2853697 - protein, 9 aa, Entamoeba invadens
ENVKEVGNE

SEQ ID NO: 2853698 - protein, 7 aa, Entamoeba invadens
ENVKNNS

SEQ ID NO: 2853699 - protein, 6 aa, Entamoeba invadens
ENVKTE

SEQ ID NO: 2853700 - protein, 4 aa, Entamoeba invadens
ENVN

SEQ ID NO: 2853701 - protein, 7 aa, Entamoeba invadens
ENVNEKN

SEQ ID NO: 2853702 - protein, 21 aa, Entamoeba invadens
ENVNENKAPVQPKVATSAFGG

SEQ ID NO: 2853703 - protein, 30 aa, Entamoeba invadens
ENVNKETSDRTSQHQNDSQSVDLICEQLLE

SEQ ID NO: 2853704 - protein, 6 aa, Entamoeba invadens
ENVNSK

SEQ ID NO: 2853705 - protein, 12 aa, Entamoeba invadens
ENVNSSSEKDIL

SEQ ID NO: 2853706 - protein, 8 aa, Entamoeba invadens
ENVNSTVS

SEQ ID NO: 2853707 - protein, 9 aa, Entamoeba invadens
ENVNTESAI

SEQ ID NO: 2853708 - protein, 12 aa, Entamoeba invadens
ENVPDTINTNRA

SEQ ID NO: 2853709 - protein, 7 aa, Entamoeba invadens
ENVPPPH

SEQ ID NO: 2853710 - protein, 7 aa, Entamoeba invadens
ENVPQSQ

SEQ ID NO: 2853711 - protein, 5 aa, Entamoeba invadens
ENVPS

SEQ ID NO: 2853712 - protein, 7 aa, Entamoeba invadens
ENVPSSI

SEQ ID NO: 2853713 - protein, 5 aa, Entamoeba invadens
ENVQD

SEQ ID NO: 2853714 - protein, 16 aa, Entamoeba invadens
ENVQGNYNTKKAELDS

SEQ ID NO: 2853715 - protein, 15 aa, Entamoeba invadens
ENVQKTAAWSKEEDS

SEQ ID NO: 2853716 - protein, 7 aa, Entamoeba invadens
ENVQQSG

SEQ ID NO: 2853717 - protein, 4 aa, Entamoeba invadens
ENVS

SEQ ID NO: 2853718 - protein, 14 aa, Entamoeba invadens
ENVSDVSSLEEDGQ

SEQ ID NO: 2853719 - protein, 7 aa, Entamoeba invadens
ENVSEEN

SEQ ID NO: 2853720 - protein, 8 aa, Entamoeba invadens
ENVSGSRI

SEQ ID NO: 2853721 - protein, 13 aa, Entamoeba invadens
ENVSKKSENDDKT

SEQ ID NO: 2853722 - protein, 7 aa, Entamoeba invadens
ENVSPQF

SEQ ID NO: 2853723 - protein, 6 aa, Entamoeba invadens
ENVSTI

SEQ ID NO: 2853724 - protein, 6 aa, Entamoeba invadens
ENVSTQ

SEQ ID NO: 2853725 - protein, 5 aa, Entamoeba invadens
ENVTE

SEQ ID NO: 2853726 - protein, 11 aa, Entamoeba invadens
ENVTKKQWSVE

SEQ ID NO: 2853727 - protein, 8 aa, Entamoeba invadens
ENVTKSQP

SEQ ID NO: 2853728 - protein, 7 aa, Entamoeba invadens
ENVTQGD

SEQ ID NO: 2853729 - protein, 6 aa, Entamoeba invadens
ENVTQI

SEQ ID NO: 2853730 - protein, 6 aa, Entamoeba invadens
ENWQPN

SEQ ID NO: 2853731 - protein, 7 aa, Entamoeba invadens
ENWYENT

SEQ ID NO: 2853732 - protein, 13 aa, Entamoeba invadens
ENYDEAEDANLID

SEQ ID NO: 2853733 - protein, 6 aa, Entamoeba invadens
ENYDEK

SEQ ID NO: 2853734 - protein, 5 aa, Entamoeba invadens
ENYDQ

SEQ ID NO: 2853735 - protein, 13 aa, Entamoeba invadens
ENYEKSERLREKS

SEQ ID NO: 2853736 - protein, 14 aa, Entamoeba invadens
ENYENEQKEHNKTL

SEQ ID NO: 2853737 - protein, 7 aa, Entamoeba invadens
ENYEQQE

SEQ ID NO: 2853738 - protein, 7 aa, Entamoeba invadens
ENYESKD

SEQ ID NO: 2853739 - protein, 6 aa, Entamoeba invadens
ENYGQD

SEQ ID NO: 2853740 - protein, 8 aa, Entamoeba invadens
ENYIENSS

SEQ ID NO: 2853741 - protein, 7 aa, Entamoeba invadens
ENYIKSS

SEQ ID NO: 2853742 - protein, 10 aa, Entamoeba invadens
ENYKEKMNEI

SEQ ID NO: 2853743 - protein, 10 aa, Entamoeba invadens
ENYKKEPITP

SEQ ID NO: 2853744 - protein, 12 aa, Entamoeba invadens
ENYKSKEKETDQ

SEQ ID NO: 2853745 - protein, 9 aa, Entamoeba invadens
ENYKTTRER

SEQ ID NO: 2853746 - protein, 4 aa, Entamoeba invadens
ENYL

SEQ ID NO: 2853747 - protein, 7 aa, Entamoeba invadens
ENYNAEK

SEQ ID NO: 2853748 - protein, 6 aa, Entamoeba invadens
ENYNEG

SEQ ID NO: 2853749 - protein, 13 aa, Entamoeba invadens
ENYNEKSNEGVEH

SEQ ID NO: 2853750 - protein, 8 aa, Entamoeba invadens
ENYPPNPS

SEQ ID NO: 2853751 - protein, 7 aa, Entamoeba invadens
ENYPSNA

SEQ ID NO: 2853752 - protein, 7 aa, Entamoeba invadens
ENYPTND

SEQ ID NO: 2853753 - protein, 4 aa, Entamoeba invadens
ENYR

SEQ ID NO: 2853754 - protein, 45 aa, Entamoeba invadens
ENYSEDDDDDEGEGDFDENETCEDQDEKEKIEQKENEDNTNETDS

SEQ ID NO: 2853755 - protein, 5 aa, Entamoeba invadens
ENYSK

SEQ ID NO: 2853756 - protein, 10 aa, Entamoeba invadens
ENYSNTKRNL

SEQ ID NO: 2853757 - protein, 8 aa, Entamoeba invadens
ENYTTTKM

SEQ ID NO: 2853758 - protein, 7 aa, Entamoeba invadens
EPAGSHG

SEQ ID NO: 2853759 - protein, 7 aa, Entamoeba invadens
EPAPGYN

SEQ ID NO: 2853760 - protein, 14 aa, Entamoeba invadens
EPAQSSAVKSGLPT

SEQ ID NO: 2853761 - protein, 6 aa, Entamoeba invadens
EPAREY

SEQ ID NO: 2853762 - protein, 19 aa, Entamoeba invadens
EPARSEPPKEIEVEESSAH

SEQ ID NO: 2853763 - protein, 5 aa, Entamoeba invadens
EPASD

SEQ ID NO: 2853764 - protein, 15 aa, Entamoeba invadens
EPASKASLVTETSPK

SEQ ID NO: 2853765 - protein, 17 aa, Entamoeba invadens
EPASTSEHSAFVISSLT

SEQ ID NO: 2853766 - protein, 25 aa, Entamoeba invadens
EPATPEKKSSHDKVHTPSTKKDEKI

SEQ ID NO: 2853767 - protein, 5 aa, Entamoeba invadens
EPCNS

SEQ ID NO: 2853768 - protein, 6 aa, Entamoeba invadens
EPDAGK

SEQ ID NO: 2853769 - protein, 6 aa, Entamoeba invadens
EPDAVK

SEQ ID NO: 2853770 - protein, 10 aa, Entamoeba invadens
EPDESSDRKI

SEQ ID NO: 2853771 - protein, 4 aa, Entamoeba invadens
EPDM

SEQ ID NO: 2853772 - protein, 10 aa, Entamoeba invadens
EPDPKETVTI

SEQ ID NO: 2853773 - protein, 5 aa, Entamoeba invadens
EPDYI

SEQ ID NO: 2853774 - protein, 4 aa, Entamoeba invadens
EPEA

SEQ ID NO: 2853775 - protein, 5 aa, Entamoeba invadens
EPEAE

SEQ ID NO: 2853776 - protein, 11 aa, Entamoeba invadens
EPEAENESVYD

SEQ ID NO: 2853777 - protein, 10 aa, Entamoeba invadens
EPEDDDRENS

SEQ ID NO: 2853778 - protein, 11 aa, Entamoeba invadens
EPEDSSLPTTK

SEQ ID NO: 2853779 - protein, 10 aa, Entamoeba invadens
EPEDVQEELE

SEQ ID NO: 2853780 - protein, 21 aa, Entamoeba invadens
EPEEEKDAIVDASEEDVSHNE

SEQ ID NO: 2853781 - protein, 6 aa, Entamoeba invadens
EPEEQN

SEQ ID NO: 2853782 - protein, 17 aa, Entamoeba invadens
EPEERPEFTEIYKVLKA

SEQ ID NO: 2853783 - protein, 19 aa, Entamoeba invadens
EPEESAVLEGKPKGPHGIQ

SEQ ID NO: 2853784 - protein, 10 aa, Entamoeba invadens
EPEHPVEEQP

SEQ ID NO: 2853785 - protein, 11 aa, Entamoeba invadens
EPEKEKEKKKI

SEQ ID NO: 2853786 - protein, 10 aa, Entamoeba invadens
EPEKFSDEQI

SEQ ID NO: 2853787 - protein, 8 aa, Entamoeba invadens
EPEKGTQL

SEQ ID NO: 2853788 - protein, 6 aa, Entamoeba invadens
EPEKVE

SEQ ID NO: 2853789 - protein, 5 aa, Entamoeba invadens
EPELA

SEQ ID NO: 2853790 - protein, 5 aa, Entamoeba invadens
EPELK

SEQ ID NO: 2853791 - protein, 9 aa, Entamoeba invadens
EPEQREKAK

SEQ ID NO: 2853792 - protein, 8 aa, Entamoeba invadens
EPERDSAL

SEQ ID NO: 2853793 - protein, 7 aa, Entamoeba invadens
EPESNVK

SEQ ID NO: 2853794 - protein, 4 aa, Entamoeba invadens
EPET

SEQ ID NO: 2853795 - protein, 17 aa, Entamoeba invadens
EPETVNESTCRLNVCTI

SEQ ID NO: 2853796 - protein, 4 aa, Entamoeba invadens
EPEV

SEQ ID NO: 2853797 - protein, 5 aa, Entamoeba invadens
EPEVD

SEQ ID NO: 2853798 - protein, 12 aa, Entamoeba invadens
EPEYDSKEYKTE

SEQ ID NO: 2853799 - protein, 21 aa, Entamoeba invadens
EPFKGKNKKGAKKGWEVCFVL

SEQ ID NO: 2853800 - protein, 5 aa, Entamoeba invadens
EPFKP

SEQ ID NO: 2853801 - protein, 6 aa, Entamoeba invadens
EPFPSN

SEQ ID NO: 2853802 - protein, 4 aa, Entamoeba invadens
EPFQ

SEQ ID NO: 2853803 - protein, 7 aa, Entamoeba invadens
EPFSAEN

SEQ ID NO: 2853804 - protein, 14 aa, Entamoeba invadens
EPFYPEKYPQGTTF

SEQ ID NO: 2853805 - protein, 6 aa, Entamoeba invadens
EPGIAK

SEQ ID NO: 2853806 - protein, 17 aa, Entamoeba invadens
EPGNKEAEKGASAMQTE

SEQ ID NO: 2853807 - protein, 9 aa, Entamoeba invadens
EPGNTEDAD

SEQ ID NO: 2853808 - protein, 6 aa, Entamoeba invadens
EPGRED

SEQ ID NO: 2853809 - protein, 8 aa, Entamoeba invadens
EPGTNGQH

SEQ ID NO: 2853810 - protein, 9 aa, Entamoeba invadens
EPGTPVGAL

SEQ ID NO: 2853811 - protein, 4 aa, Entamoeba invadens
EPHE

SEQ ID NO: 2853812 - protein, 10 aa, Entamoeba invadens
EPHKEKPVGV

SEQ ID NO: 2853813 - protein, 21 aa, Entamoeba invadens
EPIDLAPENSVCKESKERSEY

SEQ ID NO: 2853814 - protein, 5 aa, Entamoeba invadens
EPIEH

SEQ ID NO: 2853815 - protein, 22 aa, Entamoeba invadens
EPIEQNNKKKYTEEDKRRDISE

SEQ ID NO: 2853816 - protein, 20 aa, Entamoeba invadens
EPIETTSSNYQVNSKKHIDN

SEQ ID NO: 2853817 - protein, 6 aa, Entamoeba invadens
EPIGDV

SEQ ID NO: 2853818 - protein, 6 aa, Entamoeba invadens
EPIGEG

SEQ ID NO: 2853819 - protein, 19 aa, Entamoeba invadens
EPIKEEKPAEPKKVEPKKR

SEQ ID NO: 2853820 - protein, 4 aa, Entamoeba invadens
EPIN

SEQ ID NO: 2853821 - protein, 11 aa, Entamoeba invadens
EPISKKVTSSI

SEQ ID NO: 2853822 - protein, 16 aa, Entamoeba invadens
EPITKDENGNGQVIND

SEQ ID NO: 2853823 - protein, 4 aa, Entamoeba invadens
EPKD

SEQ ID NO: 2853824 - protein, 15 aa, Entamoeba invadens
EPKEDKNEKKEKDEE

SEQ ID NO: 2853825 - protein, 10 aa, Entamoeba invadens
EPKEKEEPNV

SEQ ID NO: 2853826 - protein, 14 aa, Entamoeba invadens
EPKEKSEKESEVKR

SEQ ID NO: 2853827 - protein, 12 aa, Entamoeba invadens
EPKELQENNDCS

SEQ ID NO: 2853828 - protein, 6 aa, Entamoeba invadens
EPKESH

SEQ ID NO: 2853829 - protein, 15 aa, Entamoeba invadens
EPKEVKPETTEPKKE

SEQ ID NO: 2853830 - protein, 7 aa, Entamoeba invadens
EPKGRSC

SEQ ID NO: 2853831 - protein, 5 aa, Entamoeba invadens
EPKIT

SEQ ID NO: 2853832 - protein, 9 aa, Entamoeba invadens
EPKIVDGPS

SEQ ID NO: 2853833 - protein, 10 aa, Entamoeba invadens
EPKKEDVEKA

SEQ ID NO: 2853834 - protein, 9 aa, Entamoeba invadens
EPKKEPLRK

SEQ ID NO: 2853835 - protein, 14 aa, Entamoeba invadens
EPKKERQKMNITDR

SEQ ID NO: 2853836 - protein, 5 aa, Entamoeba invadens
EPKKI

SEQ ID NO: 2853837 - protein, 16 aa, Entamoeba invadens
EPKKKESEEKIEPQNE

SEQ ID NO: 2853838 - protein, 38 aa, Entamoeba invadens
EPKKKKKKQADITVTPQKGKRGRTKTLVEKTKADRLND

SEQ ID NO: 2853839 - protein, 6 aa, Entamoeba invadens
EPKKVE

SEQ ID NO: 2853840 - protein, 19 aa, Entamoeba invadens
EPKLEEKGESVKQSENVTK

SEQ ID NO: 2853841 - protein, 13 aa, Entamoeba invadens
EPKLERDDHPEVE

SEQ ID NO: 2853842 - protein, 5 aa, Entamoeba invadens
EPKMG

SEQ ID NO: 2853843 - protein, 5 aa, Entamoeba invadens
EPKMS

SEQ ID NO: 2853844 - protein, 40 aa, Entamoeba invadens
EPKNETMECEEKSEESDGEAHSEKDETNETLQKEKMEEDN

SEQ ID NO: 2853845 - protein, 6 aa, Entamoeba invadens
EPKNRI

SEQ ID NO: 2853846 - protein, 9 aa, Entamoeba invadens
EPKNRPDIN

SEQ ID NO: 2853847 - protein, 18 aa, Entamoeba invadens
EPKPSQPEPAPRREICTV

SEQ ID NO: 2853848 - protein, 7 aa, Entamoeba invadens
EPKPTPF

SEQ ID NO: 2853849 - protein, 10 aa, Entamoeba invadens
EPKQESDQIE

SEQ ID NO: 2853850 - protein, 9 aa, Entamoeba invadens
EPKQGKRCE

SEQ ID NO: 2853851 - protein, 8 aa, Entamoeba invadens
EPKSAFTP

SEQ ID NO: 2853852 - protein, 35 aa, Entamoeba invadens
EPKSHPPQKAKKEKRNEFTSSEDLSESTDESEGDE

SEQ ID NO: 2853853 - protein, 7 aa, Entamoeba invadens
EPKSKEC

SEQ ID NO: 2853854 - protein, 9 aa, Entamoeba invadens
EPKTELEDE

SEQ ID NO: 2853855 - protein, 18 aa, Entamoeba invadens
EPKTLDERQMKSDVKNNQ

SEQ ID NO: 2853856 - protein, 9 aa, Entamoeba invadens
EPKTRADAT

SEQ ID NO: 2853857 - protein, 9 aa, Entamoeba invadens
EPKTRAESL

SEQ ID NO: 2853858 - protein, 6 aa, Entamoeba invadens
EPKTTG

SEQ ID NO: 2853859 - protein, 16 aa, Entamoeba invadens
EPKTTKYNATEQEVSE

SEQ ID NO: 2853860 - protein, 17 aa, Entamoeba invadens
EPKVDDEITDEAKKCVL

SEQ ID NO: 2853861 - protein, 11 aa, Entamoeba invadens
EPKVKTEQSIE

SEQ ID NO: 2853862 - protein, 4 aa, Entamoeba invadens
EPLA

SEQ ID NO: 2853863 - protein, 11 aa, Entamoeba invadens
EPLAAPQIPQE

SEQ ID NO: 2853864 - protein, 7 aa, Entamoeba invadens
EPLDEAE

SEQ ID NO: 2853865 - protein, 34 aa, Entamoeba invadens
EPLDSPQTSVPIQPPPVSQQQIDPPKLPDPEHMT

SEQ ID NO: 2853866 - protein, 5 aa, Entamoeba invadens
EPLEN

SEQ ID NO: 2853867 - protein, 21 aa, Entamoeba invadens
EPLGANEDELPSIGLTPSQQI

SEQ ID NO: 2853868 - protein, 7 aa, Entamoeba invadens
EPLISSD

SEQ ID NO: 2853869 - protein, 5 aa, Entamoeba invadens
EPLKE

SEQ ID NO: 2853870 - protein, 10 aa, Entamoeba invadens
EPLNKEARSV

SEQ ID NO: 2853871 - protein, 4 aa, Entamoeba invadens
EPLP

SEQ ID NO: 2853872 - protein, 13 aa, Entamoeba invadens
EPLPTQPKPEVLS

SEQ ID NO: 2853873 - protein, 13 aa, Entamoeba invadens
EPLQSEPPKCPSC

SEQ ID NO: 2853874 - protein, 5 aa, Entamoeba invadens
EPLQV

SEQ ID NO: 2853875 - protein, 6 aa, Entamoeba invadens
EPLRGY

SEQ ID NO: 2853876 - protein, 11 aa, Entamoeba invadens
EPLSDIPRKSR

SEQ ID NO: 2853877 - protein, 8 aa, Entamoeba invadens
EPLTEEYA

SEQ ID NO: 2853878 - protein, 13 aa, Entamoeba invadens
EPLTPRGSTQPSL

SEQ ID NO: 2853879 - protein, 6 aa, Entamoeba invadens
EPNDQH

SEQ ID NO: 2853880 - protein, 11 aa, Entamoeba invadens
EPNGNGELSVT

SEQ ID NO: 2853881 - protein, 16 aa, Entamoeba invadens
EPNGRGNALKVKEGEQ

SEQ ID NO: 2853882 - protein, 4 aa, Entamoeba invadens
EPNK

SEQ ID NO: 2853883 - protein, 5 aa, Entamoeba invadens
EPNKD

SEQ ID NO: 2853884 - protein, 12 aa, Entamoeba invadens
EPNKDNTEQQRT

SEQ ID NO: 2853885 - protein, 6 aa, Entamoeba invadens
EPNKHQ

SEQ ID NO: 2853886 - protein, 5 aa, Entamoeba invadens
EPNKK

SEQ ID NO: 2853887 - protein, 6 aa, Entamoeba invadens
EPNKTQ

SEQ ID NO: 2853888 - protein, 8 aa, Entamoeba invadens
EPNLPTSV

SEQ ID NO: 2853889 - protein, 5 aa, Entamoeba invadens
EPNMV

SEQ ID NO: 2853890 - protein, 4 aa, Entamoeba invadens
EPNN

SEQ ID NO: 2853891 - protein, 6 aa, Entamoeba invadens
EPNPHH

SEQ ID NO: 2853892 - protein, 7 aa, Entamoeba invadens
EPNPQQM

SEQ ID NO: 2853893 - protein, 6 aa, Entamoeba invadens
EPNQPL

SEQ ID NO: 2853894 - protein, 8 aa, Entamoeba invadens
EPNQYKIK

SEQ ID NO: 2853895 - protein, 5 aa, Entamoeba invadens
EPNRN

SEQ ID NO: 2853896 - protein, 5 aa, Entamoeba invadens
EPNRV

SEQ ID NO: 2853897 - protein, 9 aa, Entamoeba invadens
EPNSKPKKM

SEQ ID NO: 2853898 - protein, 6 aa, Entamoeba invadens
EPPDHD

SEQ ID NO: 2853899 - protein, 12 aa, Entamoeba invadens
EPPFQSGSKDAL

SEQ ID NO: 2853900 - protein, 8 aa, Entamoeba invadens
EPPGTGPL

SEQ ID NO: 2853901 - protein, 10 aa, Entamoeba invadens
EPPHKESDGA

SEQ ID NO: 2853902 - protein, 12 aa, Entamoeba invadens
EPPKHEGREEHN

SEQ ID NO: 2853903 - protein, 10 aa, Entamoeba invadens
EPPKQESPRS

SEQ ID NO: 2853904 - protein, 12 aa, Entamoeba invadens
EPPKTKTTTNMN

SEQ ID NO: 2853905 - protein, 12 aa, Entamoeba invadens
EPPKTVRTEKIK

SEQ ID NO: 2853906 - protein, 4 aa, Entamoeba invadens
EPPL

SEQ ID NO: 2853907 - protein, 6 aa, Entamoeba invadens
EPPLEQ

SEQ ID NO: 2853908 - protein, 11 aa, Entamoeba invadens
EPPMNPQENKM

SEQ ID NO: 2853909 - protein, 6 aa, Entamoeba invadens
EPPNEG

SEQ ID NO: 2853910 - protein, 6 aa, Entamoeba invadens
EPPNFN

SEQ ID NO: 2853911 - protein, 11 aa, Entamoeba invadens
EPPNISNDKGI

SEQ ID NO: 2853912 - protein, 11 aa, Entamoeba invadens
EPPQEEKDERV

SEQ ID NO: 2853913 - protein, 11 aa, Entamoeba invadens
EPPQVQEDNGD

SEQ ID NO: 2853914 - protein, 9 aa, Entamoeba invadens
EPPSAVSKN

SEQ ID NO: 2853915 - protein, 9 aa, Entamoeba invadens
EPPTSGPLS

SEQ ID NO: 2853916 - protein, 4 aa, Entamoeba invadens
EPPY

SEQ ID NO: 2853917 - protein, 5 aa, Entamoeba invadens
EPQEC

SEQ ID NO: 2853918 - protein, 9 aa, Entamoeba invadens
EPQHEKITS

SEQ ID NO: 2853919 - protein, 7 aa, Entamoeba invadens
EPQKQNI

SEQ ID NO: 2853920 - protein, 6 aa, Entamoeba invadens
EPQNAL

SEQ ID NO: 2853921 - protein, 7 aa, Entamoeba invadens
EPQNESQ

SEQ ID NO: 2853922 - protein, 15 aa, Entamoeba invadens
EPQNETEMGNNTNEF

SEQ ID NO: 2853923 - protein, 7 aa, Entamoeba invadens
EPQNPQI

SEQ ID NO: 2853924 - protein, 67 aa, Entamoeba invadens
EPQQGETIHQATEETQPTESGVNKSVTGSSPAIEIGDNEQNQHETPEAVENKQTTASQHDISVEQFF

SEQ ID NO: 2853925 - protein, 4 aa, Entamoeba invadens
EPQS

SEQ ID NO: 2853926 - protein, 5 aa, Entamoeba invadens
EPQTI

SEQ ID NO: 2853927 - protein, 9 aa, Entamoeba invadens
EPQVEVKPD

SEQ ID NO: 2853928 - protein, 10 aa, Entamoeba invadens
EPRAIPGKGR

SEQ ID NO: 2853929 - protein, 4 aa, Entamoeba invadens
EPRC

SEQ ID NO: 2853930 - protein, 5 aa, Entamoeba invadens
EPRDG

SEQ ID NO: 2853931 - protein, 12 aa, Entamoeba invadens
EPRKKSKEYEYL

SEQ ID NO: 2853932 - protein, 12 aa, Entamoeba invadens
EPRLQQRLNITQ

SEQ ID NO: 2853933 - protein, 7 aa, Entamoeba invadens
EPRNAIK

SEQ ID NO: 2853934 - protein, 7 aa, Entamoeba invadens
EPRNDTM

SEQ ID NO: 2853935 - protein, 11 aa, Entamoeba invadens
EPRNEIVDEKT

SEQ ID NO: 2853936 - protein, 5 aa, Entamoeba invadens
EPRNV

SEQ ID NO: 2853937 - protein, 4 aa, Entamoeba invadens
EPRP

SEQ ID NO: 2853938 - protein, 8 aa, Entamoeba invadens
EPRPYKTT

SEQ ID NO: 2853939 - protein, 5 aa, Entamoeba invadens
EPRSV

SEQ ID NO: 2853940 - protein, 4 aa, Entamoeba invadens
EPRY

SEQ ID NO: 2853941 - protein, 8 aa, Entamoeba invadens
EPSEELTK

SEQ ID NO: 2853942 - protein, 37 aa, Entamoeba invadens
EPSEFSDSELEKEIEKEERAVASAQKSFKNKPLPSLP

SEQ ID NO: 2853943 - protein, 15 aa, Entamoeba invadens
EPSEKRKRKDHEKLD

SEQ ID NO: 2853944 - protein, 6 aa, Entamoeba invadens
EPSGDW

SEQ ID NO: 2853945 - protein, 5 aa, Entamoeba invadens
EPSGF

SEQ ID NO: 2853946 - protein, 8 aa, Entamoeba invadens
EPSGTTYG

SEQ ID NO: 2853947 - protein, 50 aa, Entamoeba invadens
EPSHKPAPPLPHKAAPPPPPAKKAPPPLPKQKVPEQKPQGDFEKPEIEQK

SEQ ID NO: 2853948 - protein, 7 aa, Entamoeba invadens
EPSKDSY

SEQ ID NO: 2853949 - protein, 5 aa, Entamoeba invadens
EPSKT

SEQ ID NO: 2853950 - protein, 8 aa, Entamoeba invadens
EPSLPDNK

SEQ ID NO: 2853951 - protein, 6 aa, Entamoeba invadens
EPSNQS

SEQ ID NO: 2853952 - protein, 11 aa, Entamoeba invadens
EPSQQTQQVEG

SEQ ID NO: 2853953 - protein, 4 aa, Entamoeba invadens
EPSR

SEQ ID NO: 2853954 - protein, 9 aa, Entamoeba invadens
EPSSATSTL

SEQ ID NO: 2853955 - protein, 13 aa, Entamoeba invadens
EPSSEIEKETAQL

SEQ ID NO: 2853956 - protein, 17 aa, Entamoeba invadens
EPSSGEQSQDEGASSDI

SEQ ID NO: 2853957 - protein, 5 aa, Entamoeba invadens
EPSSH

SEQ ID NO: 2853958 - protein, 5 aa, Entamoeba invadens
EPSTE

SEQ ID NO: 2853959 - protein, 7 aa, Entamoeba invadens
EPSTQRS

SEQ ID NO: 2853960 - protein, 7 aa, Entamoeba invadens
EPSTRTP

SEQ ID NO: 2853961 - protein, 6 aa, Entamoeba invadens
EPSTVK

SEQ ID NO: 2853962 - protein, 7 aa, Entamoeba invadens
EPSVGKT

SEQ ID NO: 2853963 - protein, 10 aa, Entamoeba invadens
EPSVGKTSTI

SEQ ID NO: 2853964 - protein, 5 aa, Entamoeba invadens
EPSVK

SEQ ID NO: 2853965 - protein, 5 aa, Entamoeba invadens
EPSVL

SEQ ID NO: 2853966 - protein, 15 aa, Entamoeba invadens
EPSYKYNDGQSDIPK

SEQ ID NO: 2853967 - protein, 11 aa, Entamoeba invadens
EPSYQQQPIYP

SEQ ID NO: 2853968 - protein, 4 aa, Entamoeba invadens
EPTA

SEQ ID NO: 2853969 - protein, 6 aa, Entamoeba invadens
EPTAAA

SEQ ID NO: 2853970 - protein, 8 aa, Entamoeba invadens
EPTAAAYN

SEQ ID NO: 2853971 - protein, 6 aa, Entamoeba invadens
EPTAAT

SEQ ID NO: 2853972 - protein, 8 aa, Entamoeba invadens
EPTAIEQD

SEQ ID NO: 2853973 - protein, 16 aa, Entamoeba invadens
EPTDATIAKSIDENLE

SEQ ID NO: 2853974 - protein, 5 aa, Entamoeba invadens
EPTDD

SEQ ID NO: 2853975 - protein, 17 aa, Entamoeba invadens
EPTDLNTIGKKVKKGEY

SEQ ID NO: 2853976 - protein, 6 aa, Entamoeba invadens
EPTDPE

SEQ ID NO: 2853977 - protein, 6 aa, Entamoeba invadens
EPTDQN

SEQ ID NO: 2853978 - protein, 8 aa, Entamoeba invadens
EPTDYTNS

SEQ ID NO: 2853979 - protein, 4 aa, Entamoeba invadens
EPTE

SEQ ID NO: 2853980 - protein, 8 aa, Entamoeba invadens
EPTEDDVQ

SEQ ID NO: 2853981 - protein, 6 aa, Entamoeba invadens
EPTEEN

SEQ ID NO: 2853982 - protein, 12 aa, Entamoeba invadens
EPTEPCLSTTNY

SEQ ID NO: 2853983 - protein, 6 aa, Entamoeba invadens
EPTEQN

SEQ ID NO: 2853984 - protein, 6 aa, Entamoeba invadens
EPTERM

SEQ ID NO: 2853985 - protein, 8 aa, Entamoeba invadens
EPTETALN

SEQ ID NO: 2853986 - protein, 4 aa, Entamoeba invadens
EPTF

SEQ ID NO: 2853987 - protein, 10 aa, Entamoeba invadens
EPTGDLDSYN

SEQ ID NO: 2853988 - protein, 11 aa, Entamoeba invadens
EPTGDLDTKNT

SEQ ID NO: 2853989 - protein, 5 aa, Entamoeba invadens
EPTGF

SEQ ID NO: 2853990 - protein, 6 aa, Entamoeba invadens
EPTGLN

SEQ ID NO: 2853991 - protein, 18 aa, Entamoeba invadens
EPTGTIPPPPTEQQPQYP

SEQ ID NO: 2853992 - protein, 12 aa, Entamoeba invadens
EPTHSKSENNEL

SEQ ID NO: 2853993 - protein, 6 aa, Entamoeba invadens
EPTIED

SEQ ID NO: 2853994 - protein, 14 aa, Entamoeba invadens
EPTINTDRQCESPV

SEQ ID NO: 2853995 - protein, 64 aa, Entamoeba invadens
EPTKDEVKDDKIENKKENKSEEGEKQEGQKEEEKLQPEKKEEKHEENATEKKEEKKAVPQLSTD

SEQ ID NO: 2853996 - protein, 5 aa, Entamoeba invadens
EPTKG

SEQ ID NO: 2853997 - protein, 11 aa, Entamoeba invadens
EPTKTEKSEVN

SEQ ID NO: 2853998 - protein, 7 aa, Entamoeba invadens
EPTLDEP

SEQ ID NO: 2853999 - protein, 8 aa, Entamoeba invadens
EPTLPKQR

SEQ ID NO: 2854000 - protein, 33 aa, Entamoeba invadens
EPTPRNPNNVTTQNEQIVESKEEKTVDTPKPLD

SEQ ID NO: 2854001 - protein, 13 aa, Entamoeba invadens
EPTPRNTDGTATD

SEQ ID NO: 2854002 - protein, 14 aa, Entamoeba invadens
EPTQLSYNQQDNAT

SEQ ID NO: 2854003 - protein, 6 aa, Entamoeba invadens
EPTSKR

SEQ ID NO: 2854004 - protein, 7 aa, Entamoeba invadens
EPTSPTD

SEQ ID NO: 2854005 - protein, 6 aa, Entamoeba invadens
EPTTAA

SEQ ID NO: 2854006 - protein, 8 aa, Entamoeba invadens
EPTTETPY

SEQ ID NO: 2854007 - protein, 5 aa, Entamoeba invadens
EPTTI

SEQ ID NO: 2854008 - protein, 4 aa, Entamoeba invadens
EPTV

SEQ ID NO: 2854009 - protein, 4 aa, Entamoeba invadens
EPVI

SEQ ID NO: 2854010 - protein, 7 aa, Entamoeba invadens
EPVKTNS

SEQ ID NO: 2854011 - protein, 15 aa, Entamoeba invadens
EPVVRKKKVVKRVAE

SEQ ID NO: 2854012 - protein, 4 aa, Entamoeba invadens
EPYG

SEQ ID NO: 2854013 - protein, 13 aa, Entamoeba invadens
EPYHNNNKDNANY

SEQ ID NO: 2854014 - protein, 4 aa, Entamoeba invadens
EPYK

SEQ ID NO: 2854015 - protein, 5 aa, Entamoeba invadens
EPYKE

SEQ ID NO: 2854016 - protein, 10 aa, Entamoeba invadens
EPYQITDDDY

SEQ ID NO: 2854017 - protein, 27 aa, Entamoeba invadens
EPYRPSRSGNASPIMGSRPTRKDQLSH

SEQ ID NO: 2854018 - protein, 4 aa, Entamoeba invadens
EPYY

SEQ ID NO: 2854019 - protein, 18 aa, Entamoeba invadens
EQAAKTYKQSKNTYEKKL

SEQ ID NO: 2854020 - protein, 9 aa, Entamoeba invadens
EQADQKPAT

SEQ ID NO: 2854021 - protein, 7 aa, Entamoeba invadens
EQAKEQQ

SEQ ID NO: 2854022 - protein, 5 aa, Entamoeba invadens
EQAKI

SEQ ID NO: 2854023 - protein, 15 aa, Entamoeba invadens
EQAKSLQRSDLTDKE

SEQ ID NO: 2854024 - protein, 16 aa, Entamoeba invadens
EQAKTSEAIKQLTESQ

SEQ ID NO: 2854025 - protein, 8 aa, Entamoeba invadens
EQALNEGK

SEQ ID NO: 2854026 - protein, 5 aa, Entamoeba invadens
EQALT

SEQ ID NO: 2854027 - protein, 8 aa, Entamoeba invadens
EQAMGPAQ

SEQ ID NO: 2854028 - protein, 6 aa, Entamoeba invadens
EQANKR

SEQ ID NO: 2854029 - protein, 5 aa, Entamoeba invadens
EQANR

SEQ ID NO: 2854030 - protein, 5 aa, Entamoeba invadens
EQASD

SEQ ID NO: 2854031 - protein, 5 aa, Entamoeba invadens
EQATH

SEQ ID NO: 2854032 - protein, 5 aa, Entamoeba invadens
EQATL

SEQ ID NO: 2854033 - protein, 4 aa, Entamoeba invadens
EQAV

SEQ ID NO: 2854034 - protein, 7 aa, Entamoeba invadens
EQCGGKK

SEQ ID NO: 2854035 - protein, 4 aa, Entamoeba invadens
EQDA

SEQ ID NO: 2854036 - protein, 10 aa, Entamoeba invadens
EQDAEERKAE

SEQ ID NO: 2854037 - protein, 6 aa, Entamoeba invadens
EQDARE

SEQ ID NO: 2854038 - protein, 7 aa, Entamoeba invadens
EQDCRTE

SEQ ID NO: 2854039 - protein, 5 aa, Entamoeba invadens
EQDDF

SEQ ID NO: 2854040 - protein, 10 aa, Entamoeba invadens
EQDEDTNSEY

SEQ ID NO: 2854041 - protein, 24 aa, Entamoeba invadens
EQDEKLAKKIEEKQEELEKTEKLL

SEQ ID NO: 2854042 - protein, 5 aa, Entamoeba invadens
EQDFG

SEQ ID NO: 2854043 - protein, 8 aa, Entamoeba invadens
EQDFGKDD

SEQ ID NO: 2854044 - protein, 10 aa, Entamoeba invadens
EQDGRPSASE

SEQ ID NO: 2854045 - protein, 7 aa, Entamoeba invadens
EQDGSYE

SEQ ID NO: 2854046 - protein, 4 aa, Entamoeba invadens
EQDK

SEQ ID NO: 2854047 - protein, 9 aa, Entamoeba invadens
EQDKTNFEN

SEQ ID NO: 2854048 - protein, 8 aa, Entamoeba invadens
EQDKTNGI

SEQ ID NO: 2854049 - protein, 8 aa, Entamoeba invadens
EQDNRPKA

SEQ ID NO: 2854050 - protein, 9 aa, Entamoeba invadens
EQDPLMTNP

SEQ ID NO: 2854051 - protein, 5 aa, Entamoeba invadens
EQDRL

SEQ ID NO: 2854052 - protein, 12 aa, Entamoeba invadens
EQDRMKGKKSFK

SEQ ID NO: 2854053 - protein, 21 aa, Entamoeba invadens
EQDTNKQIRKDIKKGTTQNEK

SEQ ID NO: 2854054 - protein, 15 aa, Entamoeba invadens
EQDTNQHNLRNEQSV

SEQ ID NO: 2854055 - protein, 19 aa, Entamoeba invadens
EQDVESKKEKKGQSMSQSE

SEQ ID NO: 2854056 - protein, 8 aa, Entamoeba invadens
EQDVSKSN

SEQ ID NO: 2854057 - protein, 6 aa, Entamoeba invadens
EQDWRP

SEQ ID NO: 2854058 - protein, 8 aa, Entamoeba invadens
EQDYTKGE

SEQ ID NO: 2854059 - protein, 6 aa, Entamoeba invadens
EQEAFE

SEQ ID NO: 2854060 - protein, 5 aa, Entamoeba invadens
EQEDD

SEQ ID NO: 2854061 - protein, 9 aa, Entamoeba invadens
EQEDEFQKG

SEQ ID NO: 2854062 - protein, 11 aa, Entamoeba invadens
EQEEREQAERI

SEQ ID NO: 2854063 - protein, 13 aa, Entamoeba invadens
EQEGYGDNERRET

SEQ ID NO: 2854064 - protein, 10 aa, Entamoeba invadens
EQEITNERMK

SEQ ID NO: 2854065 - protein, 8 aa, Entamoeba invadens
EQEKADNR

SEQ ID NO: 2854066 - protein, 7 aa, Entamoeba invadens
EQEKIPE

SEQ ID NO: 2854067 - protein, 14 aa, Entamoeba invadens
EQEKIRSVSSTKQL

SEQ ID NO: 2854068 - protein, 5 aa, Entamoeba invadens
EQEKK

SEQ ID NO: 2854069 - protein, 34 aa, Entamoeba invadens
EQEKNKKPNLIKTKSEKIEKKKSIEKTHSLPEIQ

SEQ ID NO: 2854070 - protein, 10 aa, Entamoeba invadens
EQEKSCKEKG

SEQ ID NO: 2854071 - protein, 15 aa, Entamoeba invadens
EQEKVDETWKKQNEW

SEQ ID NO: 2854072 - protein, 8 aa, Entamoeba invadens
EQEKYNSS

SEQ ID NO: 2854073 - protein, 6 aa, Entamoeba invadens
EQENDT

SEQ ID NO: 2854074 - protein, 19 aa, Entamoeba invadens
EQENEEETHQSVDQQEDGV

SEQ ID NO: 2854075 - protein, 40 aa, Entamoeba invadens
EQENERKRLEDERRRTEDLENEKREKEKFEKEKQKIERER

SEQ ID NO: 2854076 - protein, 11 aa, Entamoeba invadens
EQENGKEGCGL

SEQ ID NO: 2854077 - protein, 12 aa, Entamoeba invadens
EQENHAEGKDLD

SEQ ID NO: 2854078 - protein, 11 aa, Entamoeba invadens
EQENKTSALQS

SEQ ID NO: 2854079 - protein, 5 aa, Entamoeba invadens
EQENL

SEQ ID NO: 2854080 - protein, 6 aa, Entamoeba invadens
EQENPE

SEQ ID NO: 2854081 - protein, 17 aa, Entamoeba invadens
EQENSQLLSDAKKSVLG

SEQ ID NO: 2854082 - protein, 27 aa, Entamoeba invadens
EQEQKLPEANPPRQKISRSIPPPSQAT

SEQ ID NO: 2854083 - protein, 9 aa, Entamoeba invadens
EQEQNQAGL

SEQ ID NO: 2854084 - protein, 17 aa, Entamoeba invadens
EQEQRNYKDEVKENPMS

SEQ ID NO: 2854085 - protein, 4 aa, Entamoeba invadens
EQER

SEQ ID NO: 2854086 - protein, 6 aa, Entamoeba invadens
EQESDN

SEQ ID NO: 2854087 - protein, 7 aa, Entamoeba invadens
EQESVGV

SEQ ID NO: 2854088 - protein, 13 aa, Entamoeba invadens
EQETLTKKAEKLK

SEQ ID NO: 2854089 - protein, 10 aa, Entamoeba invadens
EQEVATSSSA

SEQ ID NO: 2854090 - protein, 5 aa, Entamoeba invadens
EQEVG

SEQ ID NO: 2854091 - protein, 6 aa, Entamoeba invadens
EQFAQS

SEQ ID NO: 2854092 - protein, 4 aa, Entamoeba invadens
EQFK

SEQ ID NO: 2854093 - protein, 4 aa, Entamoeba invadens
EQFN

SEQ ID NO: 2854094 - protein, 14 aa, Entamoeba invadens
EQGAEFKSVTEEEL

SEQ ID NO: 2854095 - protein, 4 aa, Entamoeba invadens
EQGF

SEQ ID NO: 2854096 - protein, 23 aa, Entamoeba invadens
EQGFGTPPGAASSSKATGATGVG

SEQ ID NO: 2854097 - protein, 22 aa, Entamoeba invadens
EQGKESTEKHIKPRKKSKTCTI

SEQ ID NO: 2854098 - protein, 6 aa, Entamoeba invadens
EQGKET

SEQ ID NO: 2854099 - protein, 7 aa, Entamoeba invadens
EQGKPNK

SEQ ID NO: 2854100 - protein, 9 aa, Entamoeba invadens
EQGKVKDDD

SEQ ID NO: 2854101 - protein, 5 aa, Entamoeba invadens
EQGLS

SEQ ID NO: 2854102 - protein, 11 aa, Entamoeba invadens
EQGQDEYKTET

SEQ ID NO: 2854103 - protein, 10 aa, Entamoeba invadens
EQGTKTSSFY

SEQ ID NO: 2854104 - protein, 8 aa, Entamoeba invadens
EQGTNTRK

SEQ ID NO: 2854105 - protein, 7 aa, Entamoeba invadens
EQGVPLN

SEQ ID NO: 2854106 - protein, 4 aa, Entamoeba invadens
EQHA

SEQ ID NO: 2854107 - protein, 5 aa, Entamoeba invadens
EQHKI

SEQ ID NO: 2854108 - protein, 17 aa, Entamoeba invadens
EQHNKEIRDKYGEENLT

SEQ ID NO: 2854109 - protein, 46 aa, Entamoeba invadens
  misc_feature (27)..(28): Xaa can be any naturally occurring amino acid
EQHPDVHSKGGSKEGLSLFGCLNKCIXXDEKIGDIDQQIKDAKTQI

SEQ ID NO: 2854110 - protein, 7 aa, Entamoeba invadens
EQHPQTE

SEQ ID NO: 2854111 - protein, 7 aa, Entamoeba invadens
EQHSLDT

SEQ ID NO: 2854112 - protein, 4 aa, Entamoeba invadens
EQHV

SEQ ID NO: 2854113 - protein, 16 aa, Entamoeba invadens
EQHVSQSVEPQQPTLT

SEQ ID NO: 2854114 - protein, 10 aa, Entamoeba invadens
EQIAKDSDKI

SEQ ID NO: 2854115 - protein, 4 aa, Entamoeba invadens
EQIE

SEQ ID NO: 2854116 - protein, 8 aa, Entamoeba invadens
EQIEDKSL

SEQ ID NO: 2854117 - protein, 9 aa, Entamoeba invadens
EQIEEKQNA

SEQ ID NO: 2854118 - protein, 37 aa, Entamoeba invadens
EQIENDKKLNEDAFDKEAKRFDETRKEFEKTKSEKIA

SEQ ID NO: 2854119 - protein, 12 aa, Entamoeba invadens
EQIENKDSNSFT

SEQ ID NO: 2854120 - protein, 13 aa, Entamoeba invadens
EQIENNKDQNAAF

SEQ ID NO: 2854121 - protein, 11 aa, Entamoeba invadens
EQIETDKSELK

SEQ ID NO: 2854122 - protein, 4 aa, Entamoeba invadens
EQIK

SEQ ID NO: 2854123 - protein, 10 aa, Entamoeba invadens
EQIKESRKLE

SEQ ID NO: 2854124 - protein, 5 aa, Entamoeba invadens
EQIKP

SEQ ID NO: 2854125 - protein, 12 aa, Entamoeba invadens
EQINNKSDTTIV

SEQ ID NO: 2854126 - protein, 16 aa, Entamoeba invadens
EQINPAIDNTKKGCSL

SEQ ID NO: 2854127 - protein, 5 aa, Entamoeba invadens
EQIPE

SEQ ID NO: 2854128 - protein, 6 aa, Entamoeba invadens
EQIPPK

SEQ ID NO: 2854129 - protein, 6 aa, Entamoeba invadens
EQIPPN

SEQ ID NO: 2854130 - protein, 5 aa, Entamoeba invadens
EQIPQ

SEQ ID NO: 2854131 - protein, 9 aa, Entamoeba invadens
EQISNAKKE

SEQ ID NO: 2854132 - protein, 18 aa, Entamoeba invadens
EQITPESEEIELKDSKEM

SEQ ID NO: 2854133 - protein, 11 aa, Entamoeba invadens
EQITTENKDQT

SEQ ID NO: 2854134 - protein, 13 aa, Entamoeba invadens
EQITTSKVMNILK

SEQ ID NO: 2854135 - protein, 7 aa, Entamoeba invadens
EQKDSKN

SEQ ID NO: 2854136 - protein, 14 aa, Entamoeba invadens
EQKDVTKSATGNDN

SEQ ID NO: 2854137 - protein, 6 aa, Entamoeba invadens
EQKDYV

SEQ ID NO: 2854138 - protein, 10 aa, Entamoeba invadens
EQKEEKHVEL

SEQ ID NO: 2854139 - protein, 35 aa, Entamoeba invadens
EQKEIKSEKIEGKQQEKEEDKNSKKDEKITSDNLQ

SEQ ID NO: 2854140 - protein, 26 aa, Entamoeba invadens
EQKEKSEENCVKTSEELKNTKDENVK

SEQ ID NO: 2854141 - protein, 13 aa, Entamoeba invadens
EQKEQAKGNTQRV

SEQ ID NO: 2854142 - protein, 15 aa, Entamoeba invadens
EQKEQNTKKKSKYSL

SEQ ID NO: 2854143 - protein, 12 aa, Entamoeba invadens
EQKEQTKGNEKH

SEQ ID NO: 2854144 - protein, 10 aa, Entamoeba invadens
EQKHDKDGNV

SEQ ID NO: 2854145 - protein, 9 aa, Entamoeba invadens
EQKKNDGMS

SEQ ID NO: 2854146 - protein, 27 aa, Entamoeba invadens
EQKKNEIEKEGTLTEVQEAKEKAIKTH

SEQ ID NO: 2854147 - protein, 8 aa, Entamoeba invadens
EQKKPKAC

SEQ ID NO: 2854148 - protein, 82 aa, Entamoeba invadens
EQKKQKLVEEQKARELKEQQEKAAKEEKARQDKIAAKKEAQRQREIEAQKALEKQQLQEKKEKERLAKEEEKRKKKIAEELE

SEQ ID NO: 2854149 - protein, 8 aa, Entamoeba invadens
EQKKRPVK

SEQ ID NO: 2854150 - protein, 10 aa, Entamoeba invadens
EQKKSKQFED

SEQ ID NO: 2854151 - protein, 6 aa, Entamoeba invadens
EQKKTT

SEQ ID NO: 2854152 - protein, 16 aa, Entamoeba invadens
EQKKYSNKLEKEVQDK

SEQ ID NO: 2854153 - protein, 7 aa, Entamoeba invadens
EQKLNNQ

SEQ ID NO: 2854154 - protein, 12 aa, Entamoeba invadens
EQKLTEEKEHYE

SEQ ID NO: 2854155 - protein, 4 aa, Entamoeba invadens
EQKN

SEQ ID NO: 2854156 - protein, 9 aa, Entamoeba invadens
EQKPLSFPS

SEQ ID NO: 2854157 - protein, 7 aa, Entamoeba invadens
EQKPSEN

SEQ ID NO: 2854158 - protein, 16 aa, Entamoeba invadens
EQKQDERPKKQEEVNN

SEQ ID NO: 2854159 - protein, 38 aa, Entamoeba invadens
EQKQEEQSDSLQVQQDTQKVGPSEVLDETNNNKKCPIQ

SEQ ID NO: 2854160 - protein, 10 aa, Entamoeba invadens
EQKQEIRQKS

SEQ ID NO: 2854161 - protein, 10 aa, Entamoeba invadens
EQKQLRKKEN

SEQ ID NO: 2854162 - protein, 8 aa, Entamoeba invadens
EQKQPFGI

SEQ ID NO: 2854163 - protein, 9 aa, Entamoeba invadens
EQKQPSYTE

SEQ ID NO: 2854164 - protein, 5 aa, Entamoeba invadens
EQKRN

SEQ ID NO: 2854165 - protein, 7 aa, Entamoeba invadens
EQKRNER

SEQ ID NO: 2854166 - protein, 16 aa, Entamoeba invadens
EQKRPETLTSDIEKKI

SEQ ID NO: 2854167 - protein, 4 aa, Entamoeba invadens
EQKS

SEQ ID NO: 2854168 - protein, 5 aa, Entamoeba invadens
EQKSH

SEQ ID NO: 2854169 - protein, 10 aa, Entamoeba invadens
EQKSKEIETL

SEQ ID NO: 2854170 - protein, 7 aa, Entamoeba invadens
EQKSVKK

SEQ ID NO: 2854171 - protein, 9 aa, Entamoeba invadens
EQKTGNITV

SEQ ID NO: 2854172 - protein, 7 aa, Entamoeba invadens
EQKTHSG

SEQ ID NO: 2854173 - protein, 8 aa, Entamoeba invadens
EQKVYTQS

SEQ ID NO: 2854174 - protein, 7 aa, Entamoeba invadens
EQKYKEI

SEQ ID NO: 2854175 - protein, 16 aa, Entamoeba invadens
EQLDDPNLDEETRQEI

SEQ ID NO: 2854176 - protein, 8 aa, Entamoeba invadens
EQLDQSTL

SEQ ID NO: 2854177 - protein, 9 aa, Entamoeba invadens
EQLDSGQDI

SEQ ID NO: 2854178 - protein, 17 aa, Entamoeba invadens
EQLDTTMEGKNEDERAV

SEQ ID NO: 2854179 - protein, 26 aa, Entamoeba invadens
EQLEEEKEKITKKLDSVEKEKEKITE

SEQ ID NO: 2854180 - protein, 13 aa, Entamoeba invadens
EQLEIERKGQLEA

SEQ ID NO: 2854181 - protein, 9 aa, Entamoeba invadens
EQLENNNKT

SEQ ID NO: 2854182 - protein, 37 aa, Entamoeba invadens
EQLENNNKTLSDELEKTKERNENITQKLKTTTNEKVD

SEQ ID NO: 2854183 - protein, 10 aa, Entamoeba invadens
EQLENRESQE

SEQ ID NO: 2854184 - protein, 8 aa, Entamoeba invadens
EQLEQRQK

SEQ ID NO: 2854185 - protein, 12 aa, Entamoeba invadens
EQLGTKKPETIE

SEQ ID NO: 2854186 - protein, 4 aa, Entamoeba invadens
EQLK

SEQ ID NO: 2854187 - protein, 10 aa, Entamoeba invadens
EQLKGNMEEV

SEQ ID NO: 2854188 - protein, 6 aa, Entamoeba invadens
EQLKSL

SEQ ID NO: 2854189 - protein, 13 aa, Entamoeba invadens
EQLNKTTSAFERG

SEQ ID NO: 2854190 - protein, 6 aa, Entamoeba invadens
EQLPEE

SEQ ID NO: 2854191 - protein, 27 aa, Entamoeba invadens
EQLQEKESEIEKEKERTAAAIEKSSGL

SEQ ID NO: 2854192 - protein, 17 aa, Entamoeba invadens
EQLQNNGIGTLKKDEMK

SEQ ID NO: 2854193 - protein, 11 aa, Entamoeba invadens
EQLSDPERRID

SEQ ID NO: 2854194 - protein, 5 aa, Entamoeba invadens
EQLSK

SEQ ID NO: 2854195 - protein, 14 aa, Entamoeba invadens
EQMAEENKQKVETL

SEQ ID NO: 2854196 - protein, 6 aa, Entamoeba invadens
EQMDKG

SEQ ID NO: 2854197 - protein, 33 aa, Entamoeba invadens
EQMESSTPLSPKVGDPSPLSSSKQDKRQKRKKS

SEQ ID NO: 2854198 - protein, 6 aa, Entamoeba invadens
EQMKEQ

SEQ ID NO: 2854199 - protein, 13 aa, Entamoeba invadens
EQMKESSLISAGG

SEQ ID NO: 2854200 - protein, 6 aa, Entamoeba invadens
EQMNNT

SEQ ID NO: 2854201 - protein, 5 aa, Entamoeba invadens
EQMQS

SEQ ID NO: 2854202 - protein, 5 aa, Entamoeba invadens
EQMSK

SEQ ID NO: 2854203 - protein, 9 aa, Entamoeba invadens
EQNAGKTAV

SEQ ID NO: 2854204 - protein, 10 aa, Entamoeba invadens
EQNCDKSSVS

SEQ ID NO: 2854205 - protein, 5 aa, Entamoeba invadens
EQNCT

SEQ ID NO: 2854206 - protein, 5 aa, Entamoeba invadens
EQNDA

SEQ ID NO: 2854207 - protein, 8 aa, Entamoeba invadens
EQNDNSFP

SEQ ID NO: 2854208 - protein, 4 aa, Entamoeba invadens
EQNE

SEQ ID NO: 2854209 - protein, 5 aa, Entamoeba invadens
EQNEK

SEQ ID NO: 2854210 - protein, 5 aa, Entamoeba invadens
EQNEL

SEQ ID NO: 2854211 - protein, 5 aa, Entamoeba invadens
EQNER

SEQ ID NO: 2854212 - protein, 6 aa, Entamoeba invadens
EQNETR

SEQ ID NO: 2854213 - protein, 9 aa, Entamoeba invadens
EQNGGKRGI

SEQ ID NO: 2854214 - protein, 5 aa, Entamoeba invadens
EQNGL

SEQ ID NO: 2854215 - protein, 7 aa, Entamoeba invadens
EQNGTTF

SEQ ID NO: 2854216 - protein, 4 aa, Entamoeba invadens
EQNI

SEQ ID NO: 2854217 - protein, 13 aa, Entamoeba invadens
EQNITTPEKDGNQ

SEQ ID NO: 2854218 - protein, 5 aa, Entamoeba invadens
EQNKE

SEQ ID NO: 2854219 - protein, 11 aa, Entamoeba invadens
EQNKNIENKNQ

SEQ ID NO: 2854220 - protein, 6 aa, Entamoeba invadens
EQNKQK

SEQ ID NO: 2854221 - protein, 5 aa, Entamoeba invadens
EQNKR

SEQ ID NO: 2854222 - protein, 11 aa, Entamoeba invadens
EQNKVQQPWSK

SEQ ID NO: 2854223 - protein, 51 aa, Entamoeba invadens
EQNPIEIKQKETEQKMKEKPKKRRRSGTSHRQGDELSVTEDKSVKEEKKKL

SEQ ID NO: 2854224 - protein, 8 aa, Entamoeba invadens
EQNPNFDD

SEQ ID NO: 2854225 - protein, 7 aa, Entamoeba invadens
EQNPSVV

SEQ ID NO: 2854226 - protein, 17 aa, Entamoeba invadens
EQNQKIEEEKKRREEEE

SEQ ID NO: 2854227 - protein, 9 aa, Entamoeba invadens
EQNTGVDKR

SEQ ID NO: 2854228 - protein, 16 aa, Entamoeba invadens
EQNTQLDAAKKDIKKR

SEQ ID NO: 2854229 - protein, 16 aa, Entamoeba invadens
EQNTQLDAAKKDMKKQ

SEQ ID NO: 2854230 - protein, 29 aa, Entamoeba invadens
EQNTQLDAAKKDMKKQSVEDASNIENYKS

SEQ ID NO: 2854231 - protein, 28 aa, Entamoeba invadens
EQNTRLQENTCQPTQYNGQGRDATNQCE

SEQ ID NO: 2854232 - protein, 6 aa, Entamoeba invadens
EQNVDK

SEQ ID NO: 2854233 - protein, 13 aa, Entamoeba invadens
EQPCAPTTNPLAP

SEQ ID NO: 2854234 - protein, 6 aa, Entamoeba invadens
EQPDKV

SEQ ID NO: 2854235 - protein, 11 aa, Entamoeba invadens
EQPDPDPQPRV

SEQ ID NO: 2854236 - protein, 25 aa, Entamoeba invadens
EQPEHHKRKKATNKEKSERREGELN

SEQ ID NO: 2854237 - protein, 22 aa, Entamoeba invadens
EQPEKPQQDKQPDKPEASPSQQ

SEQ ID NO: 2854238 - protein, 4 aa, Entamoeba invadens
EQPI

SEQ ID NO: 2854239 - protein, 5 aa, Entamoeba invadens
EQPIH

SEQ ID NO: 2854240 - protein, 5 aa, Entamoeba invadens
EQPIT

SEQ ID NO: 2854241 - protein, 12 aa, Entamoeba invadens
EQPKQEQPKTEN

SEQ ID NO: 2854242 - protein, 7 aa, Entamoeba invadens
EQPKTLA

SEQ ID NO: 2854243 - protein, 7 aa, Entamoeba invadens
EQPLTEQ

SEQ ID NO: 2854244 - protein, 12 aa, Entamoeba invadens
EQPNHTLNGDKA

SEQ ID NO: 2854245 - protein, 7 aa, Entamoeba invadens
EQPPTLP

SEQ ID NO: 2854246 - protein, 8 aa, Entamoeba invadens
EQPPVYSA

SEQ ID NO: 2854247 - protein, 5 aa, Entamoeba invadens
EQPQH

SEQ ID NO: 2854248 - protein, 7 aa, Entamoeba invadens
EQPSNTH

SEQ ID NO: 2854249 - protein, 16 aa, Entamoeba invadens
EQPSNTHYETKKKENV

SEQ ID NO: 2854250 - protein, 6 aa, Entamoeba invadens
EQPTGY

SEQ ID NO: 2854251 - protein, 55 aa, Entamoeba invadens
EQPTSLTRTIPKKDFEKKKGVFKTPKYSANRTTKEGIQSQLRESQQISGQETLEA

SEQ ID NO: 2854252 - protein, 5 aa, Entamoeba invadens
EQPTT

SEQ ID NO: 2854253 - protein, 13 aa, Entamoeba invadens
EQQDELHRSDLAK

SEQ ID NO: 2854254 - protein, 11 aa, Entamoeba invadens
EQQEEVDETPE

SEQ ID NO: 2854255 - protein, 9 aa, Entamoeba invadens
EQQETLKNT

SEQ ID NO: 2854256 - protein, 12 aa, Entamoeba invadens
EQQHQNVQPQLS

SEQ ID NO: 2854257 - protein, 30 aa, Entamoeba invadens
EQQHRQDVQSHYQESEQQQAAPQVKGNVSA

SEQ ID NO: 2854258 - protein, 4 aa, Entamoeba invadens
EQQK

SEQ ID NO: 2854259 - protein, 11 aa, Entamoeba invadens
EQQKEDKFNEY

SEQ ID NO: 2854260 - protein, 14 aa, Entamoeba invadens
EQQKKLQTTPQVQS

SEQ ID NO: 2854261 - protein, 14 aa, Entamoeba invadens
EQQKKVEGDRVAKD

SEQ ID NO: 2854262 - protein, 7 aa, Entamoeba invadens
EQQKQEQ

SEQ ID NO: 2854263 - protein, 10 aa, Entamoeba invadens
EQQKRGKSEI

SEQ ID NO: 2854264 - protein, 11 aa, Entamoeba invadens
EQQKRLTTHKK

SEQ ID NO: 2854265 - protein, 7 aa, Entamoeba invadens
EQQKYDD

SEQ ID NO: 2854266 - protein, 6 aa, Entamoeba invadens
EQQLPQ

SEQ ID NO: 2854267 - protein, 7 aa, Entamoeba invadens
EQQNASI

SEQ ID NO: 2854268 - protein, 7 aa, Entamoeba invadens
EQQNEQL

SEQ ID NO: 2854269 - protein, 5 aa, Entamoeba invadens
EQQPL

SEQ ID NO: 2854270 - protein, 5 aa, Entamoeba invadens
EQQPT

SEQ ID NO: 2854271 - protein, 7 aa, Entamoeba invadens
EQQQEGM

SEQ ID NO: 2854272 - protein, 7 aa, Entamoeba invadens
EQQQEYK

SEQ ID NO: 2854273 - protein, 9 aa, Entamoeba invadens
EQQQHEKEM

SEQ ID NO: 2854274 - protein, 11 aa, Entamoeba invadens
EQQQNKEKEWK

SEQ ID NO: 2854275 - protein, 9 aa, Entamoeba invadens
EQQQNNGQM

SEQ ID NO: 2854276 - protein, 17 aa, Entamoeba invadens
EQQRETTKEETHESEDD

SEQ ID NO: 2854277 - protein, 4 aa, Entamoeba invadens
EQQS

SEQ ID NO: 2854278 - protein, 11 aa, Entamoeba invadens
EQQTKKEASWT

SEQ ID NO: 2854279 - protein, 7 aa, Entamoeba invadens
EQQTPYD

SEQ ID NO: 2854280 - protein, 11 aa, Entamoeba invadens
EQQTRAQQNYS

SEQ ID NO: 2854281 - protein, 7 aa, Entamoeba invadens
EQRAVAQ

SEQ ID NO: 2854282 - protein, 5 aa, Entamoeba invadens
EQREA

SEQ ID NO: 2854283 - protein, 8 aa, Entamoeba invadens
EQREEEIK

SEQ ID NO: 2854284 - protein, 8 aa, Entamoeba invadens
EQRFDEPR

SEQ ID NO: 2854285 - protein, 25 aa, Entamoeba invadens
EQRGQSDYPYSQQPMYPPKEQFNGI

SEQ ID NO: 2854286 - protein, 7 aa, Entamoeba invadens
EQRKREV

SEQ ID NO: 2854287 - protein, 7 aa, Entamoeba invadens
EQRKSNQ

SEQ ID NO: 2854288 - protein, 8 aa, Entamoeba invadens
EQRKSRTV

SEQ ID NO: 2854289 - protein, 11 aa, Entamoeba invadens
EQRKTKYTLKR

SEQ ID NO: 2854290 - protein, 18 aa, Entamoeba invadens
EQRLRQSQPLNKEKHEKI

SEQ ID NO: 2854291 - protein, 6 aa, Entamoeba invadens
EQRLSA

SEQ ID NO: 2854292 - protein, 8 aa, Entamoeba invadens
EQRNNSQL

SEQ ID NO: 2854293 - protein, 19 aa, Entamoeba invadens
EQRNQSTFETKDVPINEEQ

SEQ ID NO: 2854294 - protein, 8 aa, Entamoeba invadens
EQRNSSTE

SEQ ID NO: 2854295 - protein, 6 aa, Entamoeba invadens
EQRREI

SEQ ID NO: 2854296 - protein, 4 aa, Entamoeba invadens
EQRT

SEQ ID NO: 2854297 - protein, 11 aa, Entamoeba invadens
EQRTKRDLPKA

SEQ ID NO: 2854298 - protein, 6 aa, Entamoeba invadens
EQRTQI

SEQ ID NO: 2854299 - protein, 6 aa, Entamoeba invadens
EQSAEE

SEQ ID NO: 2854300 - protein, 26 aa, Entamoeba invadens
EQSAKGKIKKSDKSITLDRPLGGGDY

SEQ ID NO: 2854301 - protein, 10 aa, Entamoeba invadens
EQSAKTKNGQ

SEQ ID NO: 2854302 - protein, 7 aa, Entamoeba invadens
EQSDAVN

SEQ ID NO: 2854303 - protein, 7 aa, Entamoeba invadens
EQSDEGL

SEQ ID NO: 2854304 - protein, 6 aa, Entamoeba invadens
EQSDTM

SEQ ID NO: 2854305 - protein, 8 aa, Entamoeba invadens
EQSEELTR

SEQ ID NO: 2854306 - protein, 10 aa, Entamoeba invadens
EQSEFSTPEN

SEQ ID NO: 2854307 - protein, 9 aa, Entamoeba invadens
EQSEKNQRP

SEQ ID NO: 2854308 - protein, 6 aa, Entamoeba invadens
EQSEQI

SEQ ID NO: 2854309 - protein, 10 aa, Entamoeba invadens
EQSESHKETK

SEQ ID NO: 2854310 - protein, 17 aa, Entamoeba invadens
EQSGEGKHFQKDSNGKV

SEQ ID NO: 2854311 - protein, 6 aa, Entamoeba invadens
EQSGMS

SEQ ID NO: 2854312 - protein, 7 aa, Entamoeba invadens
EQSITTR

SEQ ID NO: 2854313 - protein, 10 aa, Entamoeba invadens
EQSKPDTREI

SEQ ID NO: 2854314 - protein, 6 aa, Entamoeba invadens
EQSKRL

SEQ ID NO: 2854315 - protein, 10 aa, Entamoeba invadens
EQSKTNASYL

SEQ ID NO: 2854316 - protein, 14 aa, Entamoeba invadens
EQSKVGASDNPFEN

SEQ ID NO: 2854317 - protein, 11 aa, Entamoeba invadens
EQSNDLSTTSK

SEQ ID NO: 2854318 - protein, 7 aa, Entamoeba invadens
EQSNGSI

SEQ ID NO: 2854319 - protein, 9 aa, Entamoeba invadens
EQSNPCDGS

SEQ ID NO: 2854320 - protein, 19 aa, Entamoeba invadens
EQSNPHAEKGKTGSPEELA

SEQ ID NO: 2854321 - protein, 5 aa, Entamoeba invadens
EQSNQ

SEQ ID NO: 2854322 - protein, 8 aa, Entamoeba invadens
EQSNQQMQ

SEQ ID NO: 2854323 - protein, 7 aa, Entamoeba invadens
EQSNQTL

SEQ ID NO: 2854324 - protein, 11 aa, Entamoeba invadens
EQSQKLNTTVN

SEQ ID NO: 2854325 - protein, 10 aa, Entamoeba invadens
EQSQLNENTL

SEQ ID NO: 2854326 - protein, 6 aa, Entamoeba invadens
EQSVKG

SEQ ID NO: 2854327 - protein, 6 aa, Entamoeba invadens
EQSVTE

SEQ ID NO: 2854328 - protein, 4 aa, Entamoeba invadens
EQTA

SEQ ID NO: 2854329 - protein, 10 aa, Entamoeba invadens
EQTAEKYPNK

SEQ ID NO: 2854330 - protein, 5 aa, Entamoeba invadens
EQTDV

SEQ ID NO: 2854331 - protein, 7 aa, Entamoeba invadens
EQTEDNK

SEQ ID NO: 2854332 - protein, 12 aa, Entamoeba invadens
EQTEEVEKKYTT

SEQ ID NO: 2854333 - protein, 6 aa, Entamoeba invadens
EQTENT

SEQ ID NO: 2854334 - protein, 19 aa, Entamoeba invadens
EQTEREKESDVEKELQNSR

SEQ ID NO: 2854335 - protein, 6 aa, Entamoeba invadens
EQTESV

SEQ ID NO: 2854336 - protein, 12 aa, Entamoeba invadens
EQTFKDKGKRTS

SEQ ID NO: 2854337 - protein, 6 aa, Entamoeba invadens
EQTGES

SEQ ID NO: 2854338 - protein, 4 aa, Entamoeba invadens
EQTI

SEQ ID NO: 2854339 - protein, 8 aa, Entamoeba invadens
EQTKDSIV

SEQ ID NO: 2854340 - protein, 15 aa, Entamoeba invadens
EQTKEDSKREVAEIK

SEQ ID NO: 2854341 - protein, 11 aa, Entamoeba invadens
EQTKNIKEKNE

SEQ ID NO: 2854342 - protein, 6 aa, Entamoeba invadens
EQTKPL

SEQ ID NO: 2854343 - protein, 7 aa, Entamoeba invadens
EQTKRIE

SEQ ID NO: 2854344 - protein, 9 aa, Entamoeba invadens
EQTNNASYR

SEQ ID NO: 2854345 - protein, 10 aa, Entamoeba invadens
EQTPENRSLA

SEQ ID NO: 2854346 - protein, 7 aa, Entamoeba invadens
EQTPLNQ

SEQ ID NO: 2854347 - protein, 10 aa, Entamoeba invadens
EQTQHPPAQI

SEQ ID NO: 2854348 - protein, 6 aa, Entamoeba invadens
EQTQNN

SEQ ID NO: 2854349 - protein, 8 aa, Entamoeba invadens
EQTQNTGI

SEQ ID NO: 2854350 - protein, 7 aa, Entamoeba invadens
EQTQQTL

SEQ ID NO: 2854351 - protein, 6 aa, Entamoeba invadens
EQTRQK

SEQ ID NO: 2854352 - protein, 6 aa, Entamoeba invadens
EQTTKK

SEQ ID NO: 2854353 - protein, 24 aa, Entamoeba invadens
EQTTPTESHNESINESNENDLIEK

SEQ ID NO: 2854354 - protein, 6 aa, Entamoeba invadens
EQTVSS

SEQ ID NO: 2854355 - protein, 6 aa, Entamoeba invadens
EQTVTS

SEQ ID NO: 2854356 - protein, 5 aa, Entamoeba invadens
EQTVV

SEQ ID NO: 2854357 - protein, 4 aa, Entamoeba invadens
EQTW

SEQ ID NO: 2854358 - protein, 12 aa, Entamoeba invadens
EQVDGENKKNEI

SEQ ID NO: 2854359 - protein, 12 aa, Entamoeba invadens
EQVDTLNSQNKA

SEQ ID NO: 2854360 - protein, 32 aa, Entamoeba invadens
EQVEIEKKKVEDTLRETESQLKHTEDEQRELQ

SEQ ID NO: 2854361 - protein, 18 aa, Entamoeba invadens
EQVENTETLSFPSSQSTK

SEQ ID NO: 2854362 - protein, 15 aa, Entamoeba invadens
EQVESEKKEKTKQIE

SEQ ID NO: 2854363 - protein, 8 aa, Entamoeba invadens
EQVESNEK

SEQ ID NO: 2854364 - protein, 7 aa, Entamoeba invadens
EQVESVG

SEQ ID NO: 2854365 - protein, 12 aa, Entamoeba invadens
EQVGSDKFGEDS

SEQ ID NO: 2854366 - protein, 8 aa, Entamoeba invadens
EQVQESGY

SEQ ID NO: 2854367 - protein, 10 aa, Entamoeba invadens
EQVRGKDGKL

SEQ ID NO: 2854368 - protein, 12 aa, Entamoeba invadens
EQWKNAQKTDIN

SEQ ID NO: 2854369 - protein, 9 aa, Entamoeba invadens
EQYKEQQTT

SEQ ID NO: 2854370 - protein, 8 aa, Entamoeba invadens
EQYPKRTK

SEQ ID NO: 2854371 - protein, 7 aa, Entamoeba invadens
EQYQEKV

SEQ ID NO: 2854372 - protein, 5 aa, Entamoeba invadens
EQYSG

SEQ ID NO: 2854373 - protein, 7 aa, Entamoeba invadens
ERAEADN

SEQ ID NO: 2854374 - protein, 6 aa, Entamoeba invadens
ERAEGT

SEQ ID NO: 2854375 - protein, 11 aa, Entamoeba invadens
ERAHEVSDTAD

SEQ ID NO: 2854376 - protein, 8 aa, Entamoeba invadens
ERAHTPNK

SEQ ID NO: 2854377 - protein, 7 aa, Entamoeba invadens
ERAIGEA

SEQ ID NO: 2854378 - protein, 16 aa, Entamoeba invadens
ERAINEDDLNDKRDEI

SEQ ID NO: 2854379 - protein, 6 aa, Entamoeba invadens
ERAKEV

SEQ ID NO: 2854380 - protein, 7 aa, Entamoeba invadens
ERAKGSF

SEQ ID NO: 2854381 - protein, 8 aa, Entamoeba invadens
ERAKRRDK

SEQ ID NO: 2854382 - protein, 16 aa, Entamoeba invadens
ERAKSDKKDLEFVADL

SEQ ID NO: 2854383 - protein, 7 aa, Entamoeba invadens
ERAPQIE

SEQ ID NO: 2854384 - protein, 11 aa, Entamoeba invadens
ERAQEKNISGV

SEQ ID NO: 2854385 - protein, 7 aa, Entamoeba invadens
ERAQQGD

SEQ ID NO: 2854386 - protein, 8 aa, Entamoeba invadens
ERARQKKD

SEQ ID NO: 2854387 - protein, 5 aa, Entamoeba invadens
ERASL

SEQ ID NO: 2854388 - protein, 8 aa, Entamoeba invadens
ERASNTVN

SEQ ID NO: 2854389 - protein, 20 aa, Entamoeba invadens
ERASTTQPQTDISNTQQQKM

SEQ ID NO: 2854390 - protein, 15 aa, Entamoeba invadens
ERATPSQLLDMLISF

SEQ ID NO: 2854391 - protein, 17 aa, Entamoeba invadens
ERATRHTRQTKFANEEL

SEQ ID NO: 2854392 - protein, 4 aa, Entamoeba invadens
ERAV

SEQ ID NO: 2854393 - protein, 9 aa, Entamoeba invadens
ERCGSQSEQ

SEQ ID NO: 2854394 - protein, 11 aa, Entamoeba invadens
ERCSECNKSIN

SEQ ID NO: 2854395 - protein, 5 aa, Entamoeba invadens
ERCSR

SEQ ID NO: 2854396 - protein, 8 aa, Entamoeba invadens
ERDDENYT

SEQ ID NO: 2854397 - protein, 4 aa, Entamoeba invadens
ERDE

SEQ ID NO: 2854398 - protein, 5 aa, Entamoeba invadens
ERDEF

SEQ ID NO: 2854399 - protein, 13 aa, Entamoeba invadens
ERDFEKKSEQLER

SEQ ID NO: 2854400 - protein, 5 aa, Entamoeba invadens
ERDGC

SEQ ID NO: 2854401 - protein, 6 aa, Entamoeba invadens
ERDGEL

SEQ ID NO: 2854402 - protein, 10 aa, Entamoeba invadens
ERDKGKKVGR

SEQ ID NO: 2854403 - protein, 19 aa, Entamoeba invadens
ERDKTSGELSNEKETNGKL

SEQ ID NO: 2854404 - protein, 8 aa, Entamoeba invadens
ERDNNGSS

SEQ ID NO: 2854405 - protein, 14 aa, Entamoeba invadens
ERDQQNKVNSIQKE

SEQ ID NO: 2854406 - protein, 20 aa, Entamoeba invadens
ERDRRDREQIKQQAKGEGVK

SEQ ID NO: 2854407 - protein, 13 aa, Entamoeba invadens
ERDSIKSKLENAE

SEQ ID NO: 2854408 - protein, 6 aa, Entamoeba invadens
ERDSKK

SEQ ID NO: 2854409 - protein, 14 aa, Entamoeba invadens
ERDSKTNQYKTEKA

SEQ ID NO: 2854410 - protein, 7 aa, Entamoeba invadens
ERDSYEE

SEQ ID NO: 2854411 - protein, 8 aa, Entamoeba invadens
ERDTESSV

SEQ ID NO: 2854412 - protein, 14 aa, Entamoeba invadens
EREAKESSQKNELE

SEQ ID NO: 2854413 - protein, 18 aa, Entamoeba invadens
EREANTKMSEDDSDDGEI

SEQ ID NO: 2854414 - protein, 6 aa, Entamoeba invadens
EREARN

SEQ ID NO: 2854415 - protein, 4 aa, Entamoeba invadens
ERED

SEQ ID NO: 2854416 - protein, 7 aa, Entamoeba invadens
EREDDYA

SEQ ID NO: 2854417 - protein, 8 aa, Entamoeba invadens
EREDEIEK

SEQ ID NO: 2854418 - protein, 4 aa, Entamoeba invadens
EREE

SEQ ID NO: 2854419 - protein, 7 aa, Entamoeba invadens
EREEKGM

SEQ ID NO: 2854420 - protein, 18 aa, Entamoeba invadens
EREEKLKKAQEKIQNTTE

SEQ ID NO: 2854421 - protein, 6 aa, Entamoeba invadens
EREERE

SEQ ID NO: 2854422 - protein, 11 aa, Entamoeba invadens
EREERKKAIGE

SEQ ID NO: 2854423 - protein, 6 aa, Entamoeba invadens
EREGAV

SEQ ID NO: 2854424 - protein, 15 aa, Entamoeba invadens
EREGQQCTPIRNENG

SEQ ID NO: 2854425 - protein, 12 aa, Entamoeba invadens
EREGVKAIKNTG

SEQ ID NO: 2854426 - protein, 5 aa, Entamoeba invadens
EREKE

SEQ ID NO: 2854427 - protein, 9 aa, Entamoeba invadens
EREKEQQCL

SEQ ID NO: 2854428 - protein, 6 aa, Entamoeba invadens
EREKFG

SEQ ID NO: 2854429 - protein, 8 aa, Entamoeba invadens
EREKKDGW

SEQ ID NO: 2854430 - protein, 17 aa, Entamoeba invadens
EREKKVFDTKKLEADLK

SEQ ID NO: 2854431 - protein, 7 aa, Entamoeba invadens
EREKRDE

SEQ ID NO: 2854432 - protein, 6 aa, Entamoeba invadens
EREKTK

SEQ ID NO: 2854433 - protein, 27 aa, Entamoeba invadens
ERELESKVDDMNTKIRKGETDLAGEGN

SEQ ID NO: 2854434 - protein, 14 aa, Entamoeba invadens
ERENEEHKKIGERS

SEQ ID NO: 2854435 - protein, 8 aa, Entamoeba invadens
ERENEIKR

SEQ ID NO: 2854436 - protein, 14 aa, Entamoeba invadens
ERENKKSKEKMDNP

SEQ ID NO: 2854437 - protein, 7 aa, Entamoeba invadens
ERENPEK

SEQ ID NO: 2854438 - protein, 5 aa, Entamoeba invadens
ERENR

SEQ ID NO: 2854439 - protein, 6 aa, Entamoeba invadens
ERENTM

SEQ ID NO: 2854440 - protein, 5 aa, Entamoeba invadens
ERENV

SEQ ID NO: 2854441 - protein, 5 aa, Entamoeba invadens
ERENY

SEQ ID NO: 2854442 - protein, 9 aa, Entamoeba invadens
EREPSRDDQ

SEQ ID NO: 2854443 - protein, 4 aa, Entamoeba invadens
EREQ

SEQ ID NO: 2854444 - protein, 17 aa, Entamoeba invadens
EREQNELESEKKLEKME

SEQ ID NO: 2854445 - protein, 9 aa, Entamoeba invadens
EREQQQQEE

SEQ ID NO: 2854446 - protein, 10 aa, Entamoeba invadens
EREQSDEIGS

SEQ ID NO: 2854447 - protein, 13 aa, Entamoeba invadens
EREQYQKPLGPRN

SEQ ID NO: 2854448 - protein, 4 aa, Entamoeba invadens
ERER

SEQ ID NO: 2854449 - protein, 10 aa, Entamoeba invadens
ERERDEVDQK

SEQ ID NO: 2854450 - protein, 12 aa, Entamoeba invadens
ERERDRESGMGS

SEQ ID NO: 2854451 - protein, 7 aa, Entamoeba invadens
ERERKQQ

SEQ ID NO: 2854452 - protein, 5 aa, Entamoeba invadens
ERERR

SEQ ID NO: 2854453 - protein, 4 aa, Entamoeba invadens
ERES

SEQ ID NO: 2854454 - protein, 15 aa, Entamoeba invadens
ERESEREKIEEEIGE

SEQ ID NO: 2854455 - protein, 6 aa, Entamoeba invadens
ERETDV

SEQ ID NO: 2854456 - protein, 8 aa, Entamoeba invadens
ERETGKTT

SEQ ID NO: 2854457 - protein, 6 aa, Entamoeba invadens
ERETNF

SEQ ID NO: 2854458 - protein, 21 aa, Entamoeba invadens
EREYQKKKEQLENVGEQLTSV

SEQ ID NO: 2854459 - protein, 5 aa, Entamoeba invadens
ERFEA

SEQ ID NO: 2854460 - protein, 6 aa, Entamoeba invadens
ERFEGE

SEQ ID NO: 2854461 - protein, 12 aa, Entamoeba invadens
ERFEKDGEFQMG

SEQ ID NO: 2854462 - protein, 4 aa, Entamoeba invadens
ERFG

SEQ ID NO: 2854463 - protein, 12 aa, Entamoeba invadens
ERFGNEPPKYPA

SEQ ID NO: 2854464 - protein, 12 aa, Entamoeba invadens
ERFGSDGSTFPI

SEQ ID NO: 2854465 - protein, 5 aa, Entamoeba invadens
ERFPK

SEQ ID NO: 2854466 - protein, 11 aa, Entamoeba invadens
ERFRSQKHSSI

SEQ ID NO: 2854467 - protein, 27 aa, Entamoeba invadens
ERFSEGENLLENNSQEIDEIVDMFIDR

SEQ ID NO: 2854468 - protein, 10 aa, Entamoeba invadens
ERFTEQTKYT

SEQ ID NO: 2854469 - protein, 4 aa, Entamoeba invadens
ERGD

SEQ ID NO: 2854470 - protein, 16 aa, Entamoeba invadens
ERGDGIPEKTLSRRRQ

SEQ ID NO: 2854471 - protein, 8 aa, Entamoeba invadens
ERGDGKKV

SEQ ID NO: 2854472 - protein, 14 aa, Entamoeba invadens
ERGDVEPSSQVSDI

SEQ ID NO: 2854473 - protein, 5 aa, Entamoeba invadens
ERGEA

SEQ ID NO: 2854474 - protein, 5 aa, Entamoeba invadens
ERGEK

SEQ ID NO: 2854475 - protein, 9 aa, Entamoeba invadens
ERGEKEKGC

SEQ ID NO: 2854476 - protein, 6 aa, Entamoeba invadens
ERGEKG

SEQ ID NO: 2854477 - protein, 7 aa, Entamoeba invadens
ERGETVD

SEQ ID NO: 2854478 - protein, 8 aa, Entamoeba invadens
ERGGFNSE

SEQ ID NO: 2854479 - protein, 6 aa, Entamoeba invadens
ERGGGF

SEQ ID NO: 2854480 - protein, 5 aa, Entamoeba invadens
ERGGK

SEQ ID NO: 2854481 - protein, 10 aa, Entamoeba invadens
ERGGKKYEGF

SEQ ID NO: 2854482 - protein, 12 aa, Entamoeba invadens
ERGGRGNAGGLN

SEQ ID NO: 2854483 - protein, 7 aa, Entamoeba invadens
ERGGTLV

SEQ ID NO: 2854484 - protein, 4 aa, Entamoeba invadens
ERGI

SEQ ID NO: 2854485 - protein, 13 aa, Entamoeba invadens
ERGICDSKSAHTN

SEQ ID NO: 2854486 - protein, 15 aa, Entamoeba invadens
ERGISKQLSTVVDED

SEQ ID NO: 2854487 - protein, 8 aa, Entamoeba invadens
ERGISSND

SEQ ID NO: 2854488 - protein, 9 aa, Entamoeba invadens
ERGKVGEEI

SEQ ID NO: 2854489 - protein, 4 aa, Entamoeba invadens
ERGL

SEQ ID NO: 2854490 - protein, 11 aa, Entamoeba invadens
ERGLQKTSQDE

SEQ ID NO: 2854491 - protein, 8 aa, Entamoeba invadens
ERGNDLTS

SEQ ID NO: 2854492 - protein, 10 aa, Entamoeba invadens
ERGNETETNI

SEQ ID NO: 2854493 - protein, 10 aa, Entamoeba invadens
ERGNGDVSDQ

SEQ ID NO: 2854494 - protein, 24 aa, Entamoeba invadens
ERGNQSARKCGGERDVSVDSQDDD

SEQ ID NO: 2854495 - protein, 9 aa, Entamoeba invadens
ERGRKTRPD

SEQ ID NO: 2854496 - protein, 5 aa, Entamoeba invadens
ERGRV

SEQ ID NO: 2854497 - protein, 7 aa, Entamoeba invadens
ERGSKTH

SEQ ID NO: 2854498 - protein, 4 aa, Entamoeba invadens
ERGT

SEQ ID NO: 2854499 - protein, 11 aa, Entamoeba invadens
ERGTERGTEKS

SEQ ID NO: 2854500 - protein, 9 aa, Entamoeba invadens
ERGTKTSKY

SEQ ID NO: 2854501 - protein, 8 aa, Entamoeba invadens
ERHEPATC

SEQ ID NO: 2854502 - protein, 15 aa, Entamoeba invadens
ERHTGTGLTAQNVQK

SEQ ID NO: 2854503 - protein, 12 aa, Entamoeba invadens
ERIDQEKKGETY

SEQ ID NO: 2854504 - protein, 4 aa, Entamoeba invadens
ERIE

SEQ ID NO: 2854505 - protein, 4 aa, Entamoeba invadens
ERIK

SEQ ID NO: 2854506 - protein, 16 aa, Entamoeba invadens
ERIKESVNASGIHSET

SEQ ID NO: 2854507 - protein, 10 aa, Entamoeba invadens
ERIKKGKKSD

SEQ ID NO: 2854508 - protein, 5 aa, Entamoeba invadens
ERINN

SEQ ID NO: 2854509 - protein, 4 aa, Entamoeba invadens
ERIS

SEQ ID NO: 2854510 - protein, 5 aa, Entamoeba invadens
ERISS

SEQ ID NO: 2854511 - protein, 7 aa, Entamoeba invadens
ERISTSA

SEQ ID NO: 2854512 - protein, 4 aa, Entamoeba invadens
ERIT

SEQ ID NO: 2854513 - protein, 30 aa, Entamoeba invadens
ERITETSDTNAEDGSTFEAKESTSDDSDQA

SEQ ID NO: 2854514 - protein, 6 aa, Entamoeba invadens
ERITTE

SEQ ID NO: 2854515 - protein, 35 aa, Entamoeba invadens
ERKARSDGNEEKSDLDGIDKEEKEEFHSNTDGVLK

SEQ ID NO: 2854516 - protein, 8 aa, Entamoeba invadens
ERKARTYD

SEQ ID NO: 2854517 - protein, 11 aa, Entamoeba invadens
ERKDEPKNQGI

SEQ ID NO: 2854518 - protein, 8 aa, Entamoeba invadens
ERKDKMQK

SEQ ID NO: 2854519 - protein, 10 aa, Entamoeba invadens
ERKDPSGSTV

SEQ ID NO: 2854520 - protein, 10 aa, Entamoeba invadens
ERKDSEKRKI

SEQ ID NO: 2854521 - protein, 10 aa, Entamoeba invadens
ERKDSSGSTV

SEQ ID NO: 2854522 - protein, 12 aa, Entamoeba invadens
ERKEEKSPRKGF

SEQ ID NO: 2854523 - protein, 14 aa, Entamoeba invadens
ERKEEPPKITTPDL

SEQ ID NO: 2854524 - protein, 18 aa, Entamoeba invadens
ERKEKEKGSKKVLESDTA

SEQ ID NO: 2854525 - protein, 14 aa, Entamoeba invadens
ERKEKGKKSGNDKT

SEQ ID NO: 2854526 - protein, 36 aa, Entamoeba invadens
ERKENKNKGNKEKKPRKEKPKTISRARRHQGVPKAL

SEQ ID NO: 2854527 - protein, 6 aa, Entamoeba invadens
ERKEPK

SEQ ID NO: 2854528 - protein, 8 aa, Entamoeba invadens
ERKERSKQ

SEQ ID NO: 2854529 - protein, 11 aa, Entamoeba invadens
ERKESKTNKGF

SEQ ID NO: 2854530 - protein, 22 aa, Entamoeba invadens
ERKEVKKKLKKETRKAQKNEEI

SEQ ID NO: 2854531 - protein, 8 aa, Entamoeba invadens
ERKHGGGF

SEQ ID NO: 2854532 - protein, 14 aa, Entamoeba invadens
ERKIQNNTNSESIE

SEQ ID NO: 2854533 - protein, 10 aa, Entamoeba invadens
ERKKQTKREL

SEQ ID NO: 2854534 - protein, 22 aa, Entamoeba invadens
ERKKVGDIKQTGKASQEVVEFF

SEQ ID NO: 2854535 - protein, 5 aa, Entamoeba invadens
ERKNE

SEQ ID NO: 2854536 - protein, 6 aa, Entamoeba invadens
ERKNER

SEQ ID NO: 2854537 - protein, 21 aa, Entamoeba invadens
ERKNKKKEHKEEKTEEEEEKV

SEQ ID NO: 2854538 - protein, 15 aa, Entamoeba invadens
ERKNPDQSNVSLGRS

SEQ ID NO: 2854539 - protein, 5 aa, Entamoeba invadens
ERKNV

SEQ ID NO: 2854540 - protein, 6 aa, Entamoeba invadens
ERKPAV

SEQ ID NO: 2854541 - protein, 7 aa, Entamoeba invadens
ERKQKTH

SEQ ID NO: 2854542 - protein, 4 aa, Entamoeba invadens
ERKR

SEQ ID NO: 2854543 - protein, 6 aa, Entamoeba invadens
ERKRAG

SEQ ID NO: 2854544 - protein, 9 aa, Entamoeba invadens
ERKSAQSSA

SEQ ID NO: 2854545 - protein, 7 aa, Entamoeba invadens
ERKSSAV

SEQ ID NO: 2854546 - protein, 6 aa, Entamoeba invadens
ERKSVV

SEQ ID NO: 2854547 - protein, 20 aa, Entamoeba invadens
ERKTAEEIQSDTKEEKNNEV

SEQ ID NO: 2854548 - protein, 17 aa, Entamoeba invadens
ERKTKKYWTNEQKKIAV

SEQ ID NO: 2854549 - protein, 8 aa, Entamoeba invadens
ERKTRKVC

SEQ ID NO: 2854550 - protein, 20 aa, Entamoeba invadens
ERLAIEGKSDFDKIDQEKAA

SEQ ID NO: 2854551 - protein, 8 aa, Entamoeba invadens
ERLDEKKG

SEQ ID NO: 2854552 - protein, 17 aa, Entamoeba invadens
ERLDGASGAEIKATCTE

SEQ ID NO: 2854553 - protein, 4 aa, Entamoeba invadens
ERLE

SEQ ID NO: 2854554 - protein, 10 aa, Entamoeba invadens
ERLERPKDMR

SEQ ID NO: 2854555 - protein, 13 aa, Entamoeba invadens
ERLGAESQRLENE

SEQ ID NO: 2854556 - protein, 6 aa, Entamoeba invadens
ERLKGG

SEQ ID NO: 2854557 - protein, 10 aa, Entamoeba invadens
ERLKQQINKK

SEQ ID NO: 2854558 - protein, 20 aa, Entamoeba invadens
ERLKTEKSKTVLSATKKTQK

SEQ ID NO: 2854559 - protein, 9 aa, Entamoeba invadens
ERLKTETSK

SEQ ID NO: 2854560 - protein, 16 aa, Entamoeba invadens
ERLNSEVAAGSSLKTA

SEQ ID NO: 2854561 - protein, 14 aa, Entamoeba invadens
ERLNSLKSKGEERL

SEQ ID NO: 2854562 - protein, 6 aa, Entamoeba invadens
ERLPQK

SEQ ID NO: 2854563 - protein, 4 aa, Entamoeba invadens
ERLS

SEQ ID NO: 2854564 - protein, 12 aa, Entamoeba invadens
ERLSKKNKDEFR

SEQ ID NO: 2854565 - protein, 6 aa, Entamoeba invadens
ERLSPT

SEQ ID NO: 2854566 - protein, 8 aa, Entamoeba invadens
ERLTDPGE

SEQ ID NO: 2854567 - protein, 10 aa, Entamoeba invadens
ERLTKKEENY

SEQ ID NO: 2854568 - protein, 25 aa, Entamoeba invadens
ERMEEEKKRMDEKEKEEEKKKNDKI

SEQ ID NO: 2854569 - protein, 15 aa, Entamoeba invadens
ERMEGCQKDQRKVPN

SEQ ID NO: 2854570 - protein, 7 aa, Entamoeba invadens
ERMENNT

SEQ ID NO: 2854571 - protein, 4 aa, Entamoeba invadens
ERMK

SEQ ID NO: 2854572 - protein, 14 aa, Entamoeba invadens
ERMKEKKQEDKRVN

SEQ ID NO: 2854573 - protein, 22 aa, Entamoeba invadens
ERMNTTKDNKNGSTPSSPRGEM

SEQ ID NO: 2854574 - protein, 14 aa, Entamoeba invadens
ERMSGDMKDVILGA

SEQ ID NO: 2854575 - protein, 6 aa, Entamoeba invadens
ERMTPP

SEQ ID NO: 2854576 - protein, 7 aa, Entamoeba invadens
ERNAGDI

SEQ ID NO: 2854577 - protein, 17 aa, Entamoeba invadens
ERNDFKNTTQQAKYVGG

SEQ ID NO: 2854578 - protein, 11 aa, Entamoeba invadens
ERNEDTERRAV

SEQ ID NO: 2854579 - protein, 6 aa, Entamoeba invadens
ERNEKG

SEQ ID NO: 2854580 - protein, 5 aa, Entamoeba invadens
ERNFE

SEQ ID NO: 2854581 - protein, 7 aa, Entamoeba invadens
ERNGPLK

SEQ ID NO: 2854582 - protein, 14 aa, Entamoeba invadens
ERNGTEKVSTKKGD

SEQ ID NO: 2854583 - protein, 16 aa, Entamoeba invadens
ERNHKGTYEGKKHQKL

SEQ ID NO: 2854584 - protein, 6 aa, Entamoeba invadens
ERNISN

SEQ ID NO: 2854585 - protein, 7 aa, Entamoeba invadens
ERNKIER

SEQ ID NO: 2854586 - protein, 10 aa, Entamoeba invadens
ERNKTLGLNG

SEQ ID NO: 2854587 - protein, 5 aa, Entamoeba invadens
ERNLP

SEQ ID NO: 2854588 - protein, 6 aa, Entamoeba invadens
ERNLRH

SEQ ID NO: 2854589 - protein, 4 aa, Entamoeba invadens
ERNN

SEQ ID NO: 2854590 - protein, 15 aa, Entamoeba invadens
ERNTDEKMTGFISKN

SEQ ID NO: 2854591 - protein, 13 aa, Entamoeba invadens
ERNTFKERVSPSY

SEQ ID NO: 2854592 - protein, 12 aa, Entamoeba invadens
ERNTTKILFYTM

SEQ ID NO: 2854593 - protein, 7 aa, Entamoeba invadens
ERNTYVA

SEQ ID NO: 2854594 - protein, 7 aa, Entamoeba invadens
ERNVGKG

SEQ ID NO: 2854595 - protein, 23 aa, Entamoeba invadens
ERNYDDDRAEKKAEKRWRKETAE

SEQ ID NO: 2854596 - protein, 11 aa, Entamoeba invadens
ERPAKMTKNTL

SEQ ID NO: 2854597 - protein, 5 aa, Entamoeba invadens
ERPDG

SEQ ID NO: 2854598 - protein, 10 aa, Entamoeba invadens
ERPEDTKQTI

SEQ ID NO: 2854599 - protein, 7 aa, Entamoeba invadens
ERPEKTL

SEQ ID NO: 2854600 - protein, 5 aa, Entamoeba invadens
ERPEY

SEQ ID NO: 2854601 - protein, 9 aa, Entamoeba invadens
ERPGKESTI

SEQ ID NO: 2854602 - protein, 12 aa, Entamoeba invadens
ERPGKQSKMTSS

SEQ ID NO: 2854603 - protein, 7 aa, Entamoeba invadens
ERPGKRT

SEQ ID NO: 2854604 - protein, 14 aa, Entamoeba invadens
ERPIRQQREEREKM

SEQ ID NO: 2854605 - protein, 15 aa, Entamoeba invadens
ERPIRQQREKREKME

SEQ ID NO: 2854606 - protein, 23 aa, Entamoeba invadens
ERPKQKRQKTPNPESKPYVGRPQ

SEQ ID NO: 2854607 - protein, 4 aa, Entamoeba invadens
ERPL

SEQ ID NO: 2854608 - protein, 6 aa, Entamoeba invadens
ERPNDG

SEQ ID NO: 2854609 - protein, 12 aa, Entamoeba invadens
ERPPKLSKVTAQ

SEQ ID NO: 2854610 - protein, 7 aa, Entamoeba invadens
ERPQGEL

SEQ ID NO: 2854611 - protein, 10 aa, Entamoeba invadens
ERPQQEENQQ

SEQ ID NO: 2854612 - protein, 9 aa, Entamoeba invadens
ERPQSKHEN

SEQ ID NO: 2854613 - protein, 18 aa, Entamoeba invadens
ERPRKYGAKGKSYTQQAM

SEQ ID NO: 2854614 - protein, 6 aa, Entamoeba invadens
ERPSRR

SEQ ID NO: 2854615 - protein, 6 aa, Entamoeba invadens
ERPSSI

SEQ ID NO: 2854616 - protein, 12 aa, Entamoeba invadens
ERPTRVKELDGK

SEQ ID NO: 2854617 - protein, 44 aa, Entamoeba invadens
ERPVEESGEDTEEESMRYTTGEDGNEKETVQRYEVKDDKEVLKR

SEQ ID NO: 2854618 - protein, 5 aa, Entamoeba invadens
ERPYC

SEQ ID NO: 2854619 - protein, 12 aa, Entamoeba invadens
ERQATSPGGNVD

SEQ ID NO: 2854620 - protein, 18 aa, Entamoeba invadens
ERQGEKHPKDPHEYPGKC

SEQ ID NO: 2854621 - protein, 6 aa, Entamoeba invadens
ERQGIS

SEQ ID NO: 2854622 - protein, 17 aa, Entamoeba invadens
ERQKREEEAQRLEEEKL

SEQ ID NO: 2854623 - protein, 19 aa, Entamoeba invadens
ERQKTPKVKEDVKGAVRQS

SEQ ID NO: 2854624 - protein, 7 aa, Entamoeba invadens
ERQMPPQ

SEQ ID NO: 2854625 - protein, 12 aa, Entamoeba invadens
ERQNTTKPITTK

SEQ ID NO: 2854626 - protein, 19 aa, Entamoeba invadens
ERQNTTKPITTKKMGNVAE

SEQ ID NO: 2854627 - protein, 6 aa, Entamoeba invadens
ERQPTL

SEQ ID NO: 2854628 - protein, 14 aa, Entamoeba invadens
ERQQKQQKEEEEKR

SEQ ID NO: 2854629 - protein, 9 aa, Entamoeba invadens
ERQRYEEEV

SEQ ID NO: 2854630 - protein, 10 aa, Entamoeba invadens
ERQTIQRPSE

SEQ ID NO: 2854631 - protein, 10 aa, Entamoeba invadens
ERRDNTDGLR

SEQ ID NO: 2854632 - protein, 14 aa, Entamoeba invadens
ERREDAYRSQAKKE

SEQ ID NO: 2854633 - protein, 5 aa, Entamoeba invadens
ERREF

SEQ ID NO: 2854634 - protein, 5 aa, Entamoeba invadens
ERRES

SEQ ID NO: 2854635 - protein, 6 aa, Entamoeba invadens
ERRESG

SEQ ID NO: 2854636 - protein, 9 aa, Entamoeba invadens
ERRETNIDQ

SEQ ID NO: 2854637 - protein, 9 aa, Entamoeba invadens
ERRGDVGRA

SEQ ID NO: 2854638 - protein, 8 aa, Entamoeba invadens
ERRGQGKM

SEQ ID NO: 2854639 - protein, 9 aa, Entamoeba invadens
ERRGSLGRS

SEQ ID NO: 2854640 - protein, 6 aa, Entamoeba invadens
ERRHGV

SEQ ID NO: 2854641 - protein, 9 aa, Entamoeba invadens
ERRIDNPAD

SEQ ID NO: 2854642 - protein, 10 aa, Entamoeba invadens
ERRKAQAEIS

SEQ ID NO: 2854643 - protein, 21 aa, Entamoeba invadens
ERRKDIATEYSDDEDDWSDDD

SEQ ID NO: 2854644 - protein, 8 aa, Entamoeba invadens
ERRKEDVD

SEQ ID NO: 2854645 - protein, 12 aa, Entamoeba invadens
ERRKKKNADELT

SEQ ID NO: 2854646 - protein, 7 aa, Entamoeba invadens
ERRKTPM

SEQ ID NO: 2854647 - protein, 8 aa, Entamoeba invadens
ERRNDISD

SEQ ID NO: 2854648 - protein, 9 aa, Entamoeba invadens
ERRNKKSWK

SEQ ID NO: 2854649 - protein, 9 aa, Entamoeba invadens
ERRRQSENK

SEQ ID NO: 2854650 - protein, 6 aa, Entamoeba invadens
ERRSES

SEQ ID NO: 2854651 - protein, 12 aa, Entamoeba invadens
ERRSKKQRGVTA

SEQ ID NO: 2854652 - protein, 15 aa, Entamoeba invadens
ERRSNLNIDKNEGIL

SEQ ID NO: 2854653 - protein, 4 aa, Entamoeba invadens
ERRT

SEQ ID NO: 2854654 - protein, 9 aa, Entamoeba invadens
ERRTECENL

SEQ ID NO: 2854655 - protein, 8 aa, Entamoeba invadens
ERRTENDG

SEQ ID NO: 2854656 - protein, 8 aa, Entamoeba invadens
ERSEEKLS

SEQ ID NO: 2854657 - protein, 5 aa, Entamoeba invadens
ERSEI

SEQ ID NO: 2854658 - protein, 12 aa, Entamoeba invadens
ERSESQQRQKPT

SEQ ID NO: 2854659 - protein, 9 aa, Entamoeba invadens
ERSGCGDDH

SEQ ID NO: 2854660 - protein, 8 aa, Entamoeba invadens
ERSGEYKV

SEQ ID NO: 2854661 - protein, 8 aa, Entamoeba invadens
ERSGGIPM

SEQ ID NO: 2854662 - protein, 41 aa, Entamoeba invadens
ERSGGTTAQKRRENEEEEKTDTEQVSHKSQLKVPNKNGLQE

SEQ ID NO: 2854663 - protein, 7 aa, Entamoeba invadens
ERSGPIA

SEQ ID NO: 2854664 - protein, 4 aa, Entamoeba invadens
ERSI

SEQ ID NO: 2854665 - protein, 7 aa, Entamoeba invadens
ERSKAEL

SEQ ID NO: 2854666 - protein, 5 aa, Entamoeba invadens
ERSKK

SEQ ID NO: 2854667 - protein, 7 aa, Entamoeba invadens
ERSKLQS

SEQ ID NO: 2854668 - protein, 10 aa, Entamoeba invadens
ERSKSPKMPH

SEQ ID NO: 2854669 - protein, 4 aa, Entamoeba invadens
ERSL

SEQ ID NO: 2854670 - protein, 9 aa, Entamoeba invadens
ERSNEYSVR

SEQ ID NO: 2854671 - protein, 6 aa, Entamoeba invadens
ERSQAQ

SEQ ID NO: 2854672 - protein, 8 aa, Entamoeba invadens
ERSRLNEQ

SEQ ID NO: 2854673 - protein, 6 aa, Entamoeba invadens
ERSRPD

SEQ ID NO: 2854674 - protein, 6 aa, Entamoeba invadens
ERSSIC

SEQ ID NO: 2854675 - protein, 8 aa, Entamoeba invadens
ERSSKEEV

SEQ ID NO: 2854676 - protein, 9 aa, Entamoeba invadens
ERSSPEDVL

SEQ ID NO: 2854677 - protein, 6 aa, Entamoeba invadens
ERSYGE

SEQ ID NO: 2854678 - protein, 5 aa, Entamoeba invadens
ERTDA

SEQ ID NO: 2854679 - protein, 9 aa, Entamoeba invadens
ERTDKKPQQ

SEQ ID NO: 2854680 - protein, 9 aa, Entamoeba invadens
ERTEDTKKV

SEQ ID NO: 2854681 - protein, 5 aa, Entamoeba invadens
ERTEK

SEQ ID NO: 2854682 - protein, 9 aa, Entamoeba invadens
ERTENPSFG

SEQ ID NO: 2854683 - protein, 6 aa, Entamoeba invadens
ERTEPF

SEQ ID NO: 2854684 - protein, 8 aa, Entamoeba invadens
ERTETSVG

SEQ ID NO: 2854685 - protein, 5 aa, Entamoeba invadens
ERTGI

SEQ ID NO: 2854686 - protein, 7 aa, Entamoeba invadens
ERTGKDS

SEQ ID NO: 2854687 - protein, 16 aa, Entamoeba invadens
ERTGSIRGSGASPNLL

SEQ ID NO: 2854688 - protein, 5 aa, Entamoeba invadens
ERTGT

SEQ ID NO: 2854689 - protein, 6 aa, Entamoeba invadens
ERTKGC

SEQ ID NO: 2854690 - protein, 14 aa, Entamoeba invadens
ERTKMRDGLQEMCE

SEQ ID NO: 2854691 - protein, 7 aa, Entamoeba invadens
ERTKNAQ

SEQ ID NO: 2854692 - protein, 4 aa, Entamoeba invadens
ERTL

SEQ ID NO: 2854693 - protein, 16 aa, Entamoeba invadens
ERTNGKSKKDSGDEFK

SEQ ID NO: 2854694 - protein, 8 aa, Entamoeba invadens
ERTPLDRS

SEQ ID NO: 2854695 - protein, 7 aa, Entamoeba invadens
ERTQTRI

SEQ ID NO: 2854696 - protein, 7 aa, Entamoeba invadens
ERTRAAE

SEQ ID NO: 2854697 - protein, 11 aa, Entamoeba invadens
ERTRQIPPTGG

SEQ ID NO: 2854698 - protein, 4 aa, Entamoeba invadens
ERTS

SEQ ID NO: 2854699 - protein, 33 aa, Entamoeba invadens
ERTSDDSMKSSGSVSDEADNEEIKPTTLDDHES

SEQ ID NO: 2854700 - protein, 5 aa, Entamoeba invadens
ERTSL

SEQ ID NO: 2854701 - protein, 18 aa, Entamoeba invadens
ERTTAQQAKAQKKKYAEK

SEQ ID NO: 2854702 - protein, 19 aa, Entamoeba invadens
ERTTAQQAKAQKKSNADKL

SEQ ID NO: 2854703 - protein, 18 aa, Entamoeba invadens
ERTTAQQAKARKKKYADK

SEQ ID NO: 2854704 - protein, 18 aa, Entamoeba invadens
ERTTAQQTKAQKKKYADK

SEQ ID NO: 2854705 - protein, 17 aa, Entamoeba invadens
ERTTARQRYKGLGEMNP

SEQ ID NO: 2854706 - protein, 5 aa, Entamoeba invadens
ERTTI

SEQ ID NO: 2854707 - protein, 9 aa, Entamoeba invadens
ERTTKDTFE

SEQ ID NO: 2854708 - protein, 29 aa, Entamoeba invadens
ERTTSRAKYRQSTSRSISAKVTRSISSNS

SEQ ID NO: 2854709 - protein, 8 aa, Entamoeba invadens
ERTVNGND

SEQ ID NO: 2854710 - protein, 14 aa, Entamoeba invadens
ERVAPKDIEDSDKT

SEQ ID NO: 2854711 - protein, 10 aa, Entamoeba invadens
ERVDGNAEST

SEQ ID NO: 2854712 - protein, 4 aa, Entamoeba invadens
ERVE

SEQ ID NO: 2854713 - protein, 9 aa, Entamoeba invadens
ERVESTSLQ

SEQ ID NO: 2854714 - protein, 14 aa, Entamoeba invadens
ERVGYNEDDIDKMA

SEQ ID NO: 2854715 - protein, 4 aa, Entamoeba invadens
ERVI

SEQ ID NO: 2854716 - protein, 7 aa, Entamoeba invadens
ERVKNNI

SEQ ID NO: 2854717 - protein, 14 aa, Entamoeba invadens
ERVQPQAEVQQHKE

SEQ ID NO: 2854718 - protein, 13 aa, Entamoeba invadens
ERVSEEMGELGNQ

SEQ ID NO: 2854719 - protein, 6 aa, Entamoeba invadens
ERVSNE

SEQ ID NO: 2854720 - protein, 5 aa, Entamoeba invadens
ERVSS

SEQ ID NO: 2854721 - protein, 8 aa, Entamoeba invadens
ERVSTGLN

SEQ ID NO: 2854722 - protein, 14 aa, Entamoeba invadens
ERVYGKKSKIVQSE

SEQ ID NO: 2854723 - protein, 4 aa, Entamoeba invadens
ERYA

SEQ ID NO: 2854724 - protein, 11 aa, Entamoeba invadens
ERYDEASEELD

SEQ ID NO: 2854725 - protein, 7 aa, Entamoeba invadens
ERYDELS

SEQ ID NO: 2854726 - protein, 5 aa, Entamoeba invadens
ERYEE

SEQ ID NO: 2854727 - protein, 27 aa, Entamoeba invadens
ERYEGEKNTAPNAKKVRQTRRHKDINR

SEQ ID NO: 2854728 - protein, 9 aa, Entamoeba invadens
ERYEQEDAT

SEQ ID NO: 2854729 - protein, 7 aa, Entamoeba invadens
ERYINET

SEQ ID NO: 2854730 - protein, 7 aa, Entamoeba invadens
ERYKPSD

SEQ ID NO: 2854731 - protein, 13 aa, Entamoeba invadens
ERYNGTPTPFSDD

SEQ ID NO: 2854732 - protein, 9 aa, Entamoeba invadens
ERYPDTPKY

SEQ ID NO: 2854733 - protein, 5 aa, Entamoeba invadens
ERYSG

SEQ ID NO: 2854734 - protein, 6 aa, Entamoeba invadens
ERYSPK

SEQ ID NO: 2854735 - protein, 10 aa, Entamoeba invadens
ERYTSKPKGE

SEQ ID NO: 2854736 - protein, 9 aa, Entamoeba invadens
ESAAEISKS

SEQ ID NO: 2854737 - protein, 7 aa, Entamoeba invadens
ESAAHQV

SEQ ID NO: 2854738 - protein, 6 aa, Entamoeba invadens
ESAATG

SEQ ID NO: 2854739 - protein, 4 aa, Entamoeba invadens
ESAD

SEQ ID NO: 2854740 - protein, 6 aa, Entamoeba invadens
ESADEM

SEQ ID NO: 2854741 - protein, 6 aa, Entamoeba invadens
ESADKY

SEQ ID NO: 2854742 - protein, 11 aa, Entamoeba invadens
ESADNANEEGE

SEQ ID NO: 2854743 - protein, 6 aa, Entamoeba invadens
ESAEEM

SEQ ID NO: 2854744 - protein, 9 aa, Entamoeba invadens
ESAERGEDY

SEQ ID NO: 2854745 - protein, 10 aa, Entamoeba invadens
ESAFSENSSL

SEQ ID NO: 2854746 - protein, 6 aa, Entamoeba invadens
ESAGKQ

SEQ ID NO: 2854747 - protein, 13 aa, Entamoeba invadens
ESAIGSSREEAFD

SEQ ID NO: 2854748 - protein, 56 aa, Entamoeba invadens
ESAKDEEKPVEVKEEAPVEATKVEQKEEKQVEETKEPKKEEKKPEEVKPLDQHDTD

SEQ ID NO: 2854749 - protein, 11 aa, Entamoeba invadens
ESAKRPTKEFR

SEQ ID NO: 2854750 - protein, 13 aa, Entamoeba invadens
ESAKRRDKDAVEK

SEQ ID NO: 2854751 - protein, 9 aa, Entamoeba invadens
ESAKSIRNK

SEQ ID NO: 2854752 - protein, 16 aa, Entamoeba invadens
ESAKTKTWILENTVEL

SEQ ID NO: 2854753 - protein, 7 aa, Entamoeba invadens
ESALPDE

SEQ ID NO: 2854754 - protein, 12 aa, Entamoeba invadens
ESANDWHTNEKE

SEQ ID NO: 2854755 - protein, 10 aa, Entamoeba invadens
ESANKYADAT

SEQ ID NO: 2854756 - protein, 5 aa, Entamoeba invadens
ESANR

SEQ ID NO: 2854757 - protein, 9 aa, Entamoeba invadens
ESANTTSLK

SEQ ID NO: 2854758 - protein, 7 aa, Entamoeba invadens
ESANTTW

SEQ ID NO: 2854759 - protein, 8 aa, Entamoeba invadens
ESAPPTLA

SEQ ID NO: 2854760 - protein, 8 aa, Entamoeba invadens
ESAPWSLQ

SEQ ID NO: 2854761 - protein, 13 aa, Entamoeba invadens
ESAQDDSSSDRQS

SEQ ID NO: 2854762 - protein, 6 aa, Entamoeba invadens
ESAQKA

SEQ ID NO: 2854763 - protein, 84 aa, Entamoeba invadens
ESAQKKAEESKAAAEESKKKASEATKAANEAAQKAEESKKAAEAADSRAKASAQAAEQAKKDEETSIAKEKDAEAAKAEVTKAL

SEQ ID NO: 2854764 - protein, 10 aa, Entamoeba invadens
ESAQSIEPET

SEQ ID NO: 2854765 - protein, 7 aa, Entamoeba invadens
ESAQVDD

SEQ ID NO: 2854766 - protein, 5 aa, Entamoeba invadens
ESASH

SEQ ID NO: 2854767 - protein, 16 aa, Entamoeba invadens
ESASKTICSEPNCTRQ

SEQ ID NO: 2854768 - protein, 7 aa, Entamoeba invadens
ESASNVL

SEQ ID NO: 2854769 - protein, 4 aa, Entamoeba invadens
ESAT

SEQ ID NO: 2854770 - protein, 7 aa, Entamoeba invadens
ESATGKT

SEQ ID NO: 2854771 - protein, 73 aa, Entamoeba invadens
ESATKKAEESKAAAEESRKKTAEAKSAATEATKKAEESKEKAEEAAKKVEEADQTAKVASEAADVAKKDEDVA

SEQ ID NO: 2854772 - protein, 19 aa, Entamoeba invadens
ESATKSAECYKESMGAGNE

SEQ ID NO: 2854773 - protein, 5 aa, Entamoeba invadens
ESATM

SEQ ID NO: 2854774 - protein, 7 aa, Entamoeba invadens
ESATSIG

SEQ ID NO: 2854775 - protein, 5 aa, Entamoeba invadens
ESCAQ

SEQ ID NO: 2854776 - protein, 6 aa, Entamoeba invadens
ESCEPQ

SEQ ID NO: 2854777 - protein, 9 aa, Entamoeba invadens
ESCKTDEKL

SEQ ID NO: 2854778 - protein, 8 aa, Entamoeba invadens
ESCNDAKQ

SEQ ID NO: 2854779 - protein, 9 aa, Entamoeba invadens
ESCNGETIS

SEQ ID NO: 2854780 - protein, 4 aa, Entamoeba invadens
ESCP

SEQ ID NO: 2854781 - protein, 21 aa, Entamoeba invadens
ESCPTGQYLSPNGCASCAEQT

SEQ ID NO: 2854782 - protein, 9 aa, Entamoeba invadens
ESCQEEDGV

SEQ ID NO: 2854783 - protein, 10 aa, Entamoeba invadens
ESCQSKETCD

SEQ ID NO: 2854784 - protein, 6 aa, Entamoeba invadens
ESCSRD

SEQ ID NO: 2854785 - protein, 16 aa, Entamoeba invadens
ESDAITSSQNNEINTD

SEQ ID NO: 2854786 - protein, 4 aa, Entamoeba invadens
ESDC

SEQ ID NO: 2854787 - protein, 15 aa, Entamoeba invadens
ESDDETLDSGFYSVT

SEQ ID NO: 2854788 - protein, 10 aa, Entamoeba invadens
ESDDKNQEVV

SEQ ID NO: 2854789 - protein, 38 aa, Entamoeba invadens
ESDDTESSEITSDRSEKTNPVPQKRDDPLVSPRYQTGQ

SEQ ID NO: 2854790 - protein, 8 aa, Entamoeba invadens
ESDEEAID

SEQ ID NO: 2854791 - protein, 24 aa, Entamoeba invadens
ESDEEDTRSKLQKRKKKVEKKEIE

SEQ ID NO: 2854792 - protein, 12 aa, Entamoeba invadens
ESDEIRLGQQKE

SEQ ID NO: 2854793 - protein, 8 aa, Entamoeba invadens
ESDETFGN

SEQ ID NO: 2854794 - protein, 6 aa, Entamoeba invadens
ESDEYT

SEQ ID NO: 2854795 - protein, 12 aa, Entamoeba invadens
ESDFDGITEDNV

SEQ ID NO: 2854796 - protein, 9 aa, Entamoeba invadens
ESDFDQSSM

SEQ ID NO: 2854797 - protein, 30 aa, Entamoeba invadens
ESDFDSEEASTPSENSDKDDEEKTSKSEES

SEQ ID NO: 2854798 - protein, 15 aa, Entamoeba invadens
ESDFTTSKQQYGETK

SEQ ID NO: 2854799 - protein, 7 aa, Entamoeba invadens
ESDGLPR

SEQ ID NO: 2854800 - protein, 5 aa, Entamoeba invadens
ESDIE

SEQ ID NO: 2854801 - protein, 12 aa, Entamoeba invadens
ESDINWETDDHE

SEQ ID NO: 2854802 - protein, 8 aa, Entamoeba invadens
ESDKASQT

SEQ ID NO: 2854803 - protein, 12 aa, Entamoeba invadens
ESDKKIKQETAV

SEQ ID NO: 2854804 - protein, 12 aa, Entamoeba invadens
ESDKTIPSSQLA

SEQ ID NO: 2854805 - protein, 6 aa, Entamoeba invadens
ESDLPR

SEQ ID NO: 2854806 - protein, 12 aa, Entamoeba invadens
ESDLSKKEEIEK

SEQ ID NO: 2854807 - protein, 12 aa, Entamoeba invadens
ESDNKSPLKTTV

SEQ ID NO: 2854808 - protein, 7 aa, Entamoeba invadens
ESDNTSI

SEQ ID NO: 2854809 - protein, 7 aa, Entamoeba invadens
ESDPSQI

SEQ ID NO: 2854810 - protein, 6 aa, Entamoeba invadens
ESDQFN

SEQ ID NO: 2854811 - protein, 10 aa, Entamoeba invadens
ESDSEELGGF

SEQ ID NO: 2854812 - protein, 17 aa, Entamoeba invadens
ESDSEITTERTGTGDSF

SEQ ID NO: 2854813 - protein, 8 aa, Entamoeba invadens
ESDSMRGE

SEQ ID NO: 2854814 - protein, 14 aa, Entamoeba invadens
ESDVDENENNERIE

SEQ ID NO: 2854815 - protein, 12 aa, Entamoeba invadens
ESDVRSYKPNYT

SEQ ID NO: 2854816 - protein, 5 aa, Entamoeba invadens
ESDWD

SEQ ID NO: 2854817 - protein, 14 aa, Entamoeba invadens
ESDYPNSWSTGWGE

SEQ ID NO: 2854818 - protein, 6 aa, Entamoeba invadens
ESEAEN

SEQ ID NO: 2854819 - protein, 5 aa, Entamoeba invadens
ESEAI

SEQ ID NO: 2854820 - protein, 10 aa, Entamoeba invadens
ESEAQSRMGK

SEQ ID NO: 2854821 - protein, 23 aa, Entamoeba invadens
ESEASTALDPDELHKENKLGEGG

SEQ ID NO: 2854822 - protein, 5 aa, Entamoeba invadens
ESECV

SEQ ID NO: 2854823 - protein, 8 aa, Entamoeba invadens
ESEDAKPL

SEQ ID NO: 2854824 - protein, 9 aa, Entamoeba invadens
ESEDKNKVI

SEQ ID NO: 2854825 - protein, 7 aa, Entamoeba invadens
ESEDLTP

SEQ ID NO: 2854826 - protein, 10 aa, Entamoeba invadens
ESEDPDIPFT

SEQ ID NO: 2854827 - protein, 7 aa, Entamoeba invadens
ESEDSSL

SEQ ID NO: 2854828 - protein, 5 aa, Entamoeba invadens
ESEDV

SEQ ID NO: 2854829 - protein, 7 aa, Entamoeba invadens
ESEEDIP

SEQ ID NO: 2854830 - protein, 12 aa, Entamoeba invadens
ESEEEEDTVFEE

SEQ ID NO: 2854831 - protein, 8 aa, Entamoeba invadens
ESEEERDD

SEQ ID NO: 2854832 - protein, 7 aa, Entamoeba invadens
ESEENFG

SEQ ID NO: 2854833 - protein, 9 aa, Entamoeba invadens
ESEEPHDFP

SEQ ID NO: 2854834 - protein, 7 aa, Entamoeba invadens
ESEEQSI

SEQ ID NO: 2854835 - protein, 21 aa, Entamoeba invadens
ESEFKSAGYSEKSKGEEANEK

SEQ ID NO: 2854836 - protein, 5 aa, Entamoeba invadens
ESEGG

SEQ ID NO: 2854837 - protein, 9 aa, Entamoeba invadens
ESEGHSEYQ

SEQ ID NO: 2854838 - protein, 5 aa, Entamoeba invadens
ESEHI

SEQ ID NO: 2854839 - protein, 7 aa, Entamoeba invadens
ESEIKRT

SEQ ID NO: 2854840 - protein, 9 aa, Entamoeba invadens
ESEISNSQT

SEQ ID NO: 2854841 - protein, 9 aa, Entamoeba invadens
ESEKKEEIK

SEQ ID NO: 2854842 - protein, 11 aa, Entamoeba invadens
ESEKKTLEQSI

SEQ ID NO: 2854843 - protein, 10 aa, Entamoeba invadens
ESEKSGKEIS

SEQ ID NO: 2854844 - protein, 7 aa, Entamoeba invadens
ESEKSSH

SEQ ID NO: 2854845 - protein, 19 aa, Entamoeba invadens
ESEKSSNLDADKVICKKKI

SEQ ID NO: 2854846 - protein, 13 aa, Entamoeba invadens
ESEKTKESHLPPK

SEQ ID NO: 2854847 - protein, 5 aa, Entamoeba invadens
ESEKV

SEQ ID NO: 2854848 - protein, 4 aa, Entamoeba invadens
ESEL

SEQ ID NO: 2854849 - protein, 5 aa, Entamoeba invadens
ESELD

SEQ ID NO: 2854850 - protein, 7 aa, Entamoeba invadens
ESEMGGK

SEQ ID NO: 2854851 - protein, 8 aa, Entamoeba invadens
ESEMTKNA

SEQ ID NO: 2854852 - protein, 5 aa, Entamoeba invadens
ESEMV

SEQ ID NO: 2854853 - protein, 6 aa, Entamoeba invadens
ESENEL

SEQ ID NO: 2854854 - protein, 8 aa, Entamoeba invadens
ESENELPY

SEQ ID NO: 2854855 - protein, 6 aa, Entamoeba invadens
ESENLE

SEQ ID NO: 2854856 - protein, 8 aa, Entamoeba invadens
ESENNGRV

SEQ ID NO: 2854857 - protein, 6 aa, Entamoeba invadens
ESENNT

SEQ ID NO: 2854858 - protein, 10 aa, Entamoeba invadens
ESENRGNIPN

SEQ ID NO: 2854859 - protein, 40 aa, Entamoeba invadens
ESENVGGKKEDLGDKKKEKTSVQKEENNQPISSEAAVGCK

SEQ ID NO: 2854860 - protein, 7 aa, Entamoeba invadens
ESEPDEQ

SEQ ID NO: 2854861 - protein, 7 aa, Entamoeba invadens
ESEPIPQ

SEQ ID NO: 2854862 - protein, 5 aa, Entamoeba invadens
ESEPN

SEQ ID NO: 2854863 - protein, 7 aa, Entamoeba invadens
ESEPRHA

SEQ ID NO: 2854864 - protein, 4 aa, Entamoeba invadens
ESEQ

SEQ ID NO: 2854865 - protein, 8 aa, Entamoeba invadens
ESEQHITQ

SEQ ID NO: 2854866 - protein, 15 aa, Entamoeba invadens
ESERKRTATYTKRSH

SEQ ID NO: 2854867 - protein, 10 aa, Entamoeba invadens
ESERKTLEQS

SEQ ID NO: 2854868 - protein, 27 aa, Entamoeba invadens
ESERTAEERNMPSPISSFSNENPNQPF

SEQ ID NO: 2854869 - protein, 7 aa, Entamoeba invadens
ESERTKK

SEQ ID NO: 2854870 - protein, 5 aa, Entamoeba invadens
ESESD

SEQ ID NO: 2854871 - protein, 6 aa, Entamoeba invadens
ESESHA

SEQ ID NO: 2854872 - protein, 5 aa, Entamoeba invadens
ESESS

SEQ ID NO: 2854873 - protein, 8 aa, Entamoeba invadens
ESETEKIK

SEQ ID NO: 2854874 - protein, 7 aa, Entamoeba invadens
ESETKAN

SEQ ID NO: 2854875 - protein, 6 aa, Entamoeba invadens
ESETKG

SEQ ID NO: 2854876 - protein, 6 aa, Entamoeba invadens
ESETLR

SEQ ID NO: 2854877 - protein, 28 aa, Entamoeba invadens
ESETTENTEEEITTKRSEQRTCENKQTN

SEQ ID NO: 2854878 - protein, 6 aa, Entamoeba invadens
ESEVAS

SEQ ID NO: 2854879 - protein, 19 aa, Entamoeba invadens
ESEWNSSSNEIEWGNPDSY

SEQ ID NO: 2854880 - protein, 9 aa, Entamoeba invadens
ESEYKGDLK

SEQ ID NO: 2854881 - protein, 5 aa, Entamoeba invadens
ESEYP

SEQ ID NO: 2854882 - protein, 9 aa, Entamoeba invadens
ESFDKVKND

SEQ ID NO: 2854883 - protein, 18 aa, Entamoeba invadens
ESFEDSDKKCVKKDRNSD

SEQ ID NO: 2854884 - protein, 7 aa, Entamoeba invadens
ESFEKGE

SEQ ID NO: 2854885 - protein, 12 aa, Entamoeba invadens
ESFEKKQNDTLD

SEQ ID NO: 2854886 - protein, 6 aa, Entamoeba invadens
ESFEKR

SEQ ID NO: 2854887 - protein, 6 aa, Entamoeba invadens
ESFESG

SEQ ID NO: 2854888 - protein, 10 aa, Entamoeba invadens
ESFETSEVER

SEQ ID NO: 2854889 - protein, 4 aa, Entamoeba invadens
ESFG

SEQ ID NO: 2854890 - protein, 6 aa, Entamoeba invadens
ESFGQT

SEQ ID NO: 2854891 - protein, 6 aa, Entamoeba invadens
ESFQTE

SEQ ID NO: 2854892 - protein, 5 aa, Entamoeba invadens
ESFSD

SEQ ID NO: 2854893 - protein, 10 aa, Entamoeba invadens
ESFSNNTPQA

SEQ ID NO: 2854894 - protein, 6 aa, Entamoeba invadens
ESFSRR

SEQ ID NO: 2854895 - protein, 10 aa, Entamoeba invadens
ESFSSTPSLV

SEQ ID NO: 2854896 - protein, 4 aa, Entamoeba invadens
ESFT

SEQ ID NO: 2854897 - protein, 22 aa, Entamoeba invadens
ESFTDSGSLETPPTRPPCNTKS

SEQ ID NO: 2854898 - protein, 12 aa, Entamoeba invadens
ESFTTDRLLAFS

SEQ ID NO: 2854899 - protein, 9 aa, Entamoeba invadens
ESGANGLSK

SEQ ID NO: 2854900 - protein, 10 aa, Entamoeba invadens
ESGARVAPEQ

SEQ ID NO: 2854901 - protein, 28 aa, Entamoeba invadens
ESGATQTQRLKDTIEKTEEETKTKKNEY

SEQ ID NO: 2854902 - protein, 7 aa, Entamoeba invadens
ESGCKTP

SEQ ID NO: 2854903 - protein, 9 aa, Entamoeba invadens
ESGDEIDSK

SEQ ID NO: 2854904 - protein, 9 aa, Entamoeba invadens
ESGDGVTHV

SEQ ID NO: 2854905 - protein, 10 aa, Entamoeba invadens
ESGDNLYSKT

SEQ ID NO: 2854906 - protein, 9 aa, Entamoeba invadens
ESGDPTTDE

SEQ ID NO: 2854907 - protein, 6 aa, Entamoeba invadens
ESGDYE

SEQ ID NO: 2854908 - protein, 9 aa, Entamoeba invadens
ESGEDQRLL

SEQ ID NO: 2854909 - protein, 8 aa, Entamoeba invadens
ESGEKEIN

SEQ ID NO: 2854910 - protein, 11 aa, Entamoeba invadens
ESGEKSESFNI

SEQ ID NO: 2854911 - protein, 9 aa, Entamoeba invadens
ESGEQKIKK

SEQ ID NO: 2854912 - protein, 6 aa, Entamoeba invadens
ESGEST

SEQ ID NO: 2854913 - protein, 8 aa, Entamoeba invadens
ESGEVTRQ

SEQ ID NO: 2854914 - protein, 7 aa, Entamoeba invadens
ESGGQPQ

SEQ ID NO: 2854915 - protein, 6 aa, Entamoeba invadens
ESGGRI

SEQ ID NO: 2854916 - protein, 10 aa, Entamoeba invadens
ESGGYRNVEG

SEQ ID NO: 2854917 - protein, 6 aa, Entamoeba invadens
ESGIDK

SEQ ID NO: 2854918 - protein, 20 aa, Entamoeba invadens
ESGIKQKTAFRRTQSNKRSQ

SEQ ID NO: 2854919 - protein, 14 aa, Entamoeba invadens
ESGIQGVKGRLGDL

SEQ ID NO: 2854920 - protein, 4 aa, Entamoeba invadens
ESGK

SEQ ID NO: 2854921 - protein, 14 aa, Entamoeba invadens
ESGKLVKSKEVKNV

SEQ ID NO: 2854922 - protein, 10 aa, Entamoeba invadens
ESGKNDRPIE

SEQ ID NO: 2854923 - protein, 7 aa, Entamoeba invadens
ESGKPPM

SEQ ID NO: 2854924 - protein, 7 aa, Entamoeba invadens
ESGKTEL

SEQ ID NO: 2854925 - protein, 26 aa, Entamoeba invadens
ESGKTTQQIKPQNLENIEKKNSLTNK

SEQ ID NO: 2854926 - protein, 4 aa, Entamoeba invadens
ESGL

SEQ ID NO: 2854927 - protein, 13 aa, Entamoeba invadens
ESGLDSVSSGATI

SEQ ID NO: 2854928 - protein, 12 aa, Entamoeba invadens
ESGLESSKGRGF

SEQ ID NO: 2854929 - protein, 10 aa, Entamoeba invadens
ESGMKGGTTR

SEQ ID NO: 2854930 - protein, 4 aa, Entamoeba invadens
ESGN

SEQ ID NO: 2854931 - protein, 6 aa, Entamoeba invadens
ESGNAY

SEQ ID NO: 2854932 - protein, 7 aa, Entamoeba invadens
ESGNIPH

SEQ ID NO: 2854933 - protein, 8 aa, Entamoeba invadens
ESGNISRP

SEQ ID NO: 2854934 - protein, 12 aa, Entamoeba invadens
ESGNSFTTTADR

SEQ ID NO: 2854935 - protein, 10 aa, Entamoeba invadens
ESGPDESSNK

SEQ ID NO: 2854936 - protein, 23 aa, Entamoeba invadens
ESGQQKDLLNASKDKTRDSSSKN

SEQ ID NO: 2854937 - protein, 14 aa, Entamoeba invadens
ESGQYKKPKKGYIP

SEQ ID NO: 2854938 - protein, 4 aa, Entamoeba invadens
ESGR

SEQ ID NO: 2854939 - protein, 13 aa, Entamoeba invadens
ESGRAGRDGKPSE

SEQ ID NO: 2854940 - protein, 7 aa, Entamoeba invadens
ESGRFDG

SEQ ID NO: 2854941 - protein, 5 aa, Entamoeba invadens
ESGRM

SEQ ID NO: 2854942 - protein, 5 aa, Entamoeba invadens
ESGSI

SEQ ID NO: 2854943 - protein, 5 aa, Entamoeba invadens
ESGSL

SEQ ID NO: 2854944 - protein, 82 aa, Entamoeba invadens
ESGSLNSKPVEEKKELSSQNNEPSPQKEKKDLFPQQQKDIQSSVDEKKTLFTQQNDVQPHEEETNPSPQQQKEVQPHEKERN

SEQ ID NO: 2854945 - protein, 9 aa, Entamoeba invadens
ESGSSSMFG

SEQ ID NO: 2854946 - protein, 7 aa, Entamoeba invadens
ESGTAFY

SEQ ID NO: 2854947 - protein, 10 aa, Entamoeba invadens
ESGTEIPQEN

SEQ ID NO: 2854948 - protein, 9 aa, Entamoeba invadens
ESGTGKSSI

SEQ ID NO: 2854949 - protein, 8 aa, Entamoeba invadens
ESGTGSGC

SEQ ID NO: 2854950 - protein, 11 aa, Entamoeba invadens
ESGTGSLKKPG

SEQ ID NO: 2854951 - protein, 18 aa, Entamoeba invadens
ESGTLSNSVATENPTQQV

SEQ ID NO: 2854952 - protein, 10 aa, Entamoeba invadens
ESGTNSLRKT

SEQ ID NO: 2854953 - protein, 7 aa, Entamoeba invadens
ESGTRNY

SEQ ID NO: 2854954 - protein, 5 aa, Entamoeba invadens
ESGVG

SEQ ID NO: 2854955 - protein, 8 aa, Entamoeba invadens
ESGVGKST

SEQ ID NO: 2854956 - protein, 5 aa, Entamoeba invadens
ESGVS

SEQ ID NO: 2854957 - protein, 7 aa, Entamoeba invadens
ESGVTGK

SEQ ID NO: 2854958 - protein, 5 aa, Entamoeba invadens
ESGWN

SEQ ID NO: 2854959 - protein, 8 aa, Entamoeba invadens
ESHGEYAK

SEQ ID NO: 2854960 - protein, 6 aa, Entamoeba invadens
ESHKAK

SEQ ID NO: 2854961 - protein, 10 aa, Entamoeba invadens
ESHKQSDKVS

SEQ ID NO: 2854962 - protein, 6 aa, Entamoeba invadens
ESHNKL

SEQ ID NO: 2854963 - protein, 15 aa, Entamoeba invadens
ESHNPSAKTKAMDTY

SEQ ID NO: 2854964 - protein, 6 aa, Entamoeba invadens
ESHPFQ

SEQ ID NO: 2854965 - protein, 4 aa, Entamoeba invadens
ESHR

SEQ ID NO: 2854966 - protein, 8 aa, Entamoeba invadens
ESHSAARE

SEQ ID NO: 2854967 - protein, 6 aa, Entamoeba invadens
ESHSPN

SEQ ID NO: 2854968 - protein, 6 aa, Entamoeba invadens
ESHTAE

SEQ ID NO: 2854969 - protein, 9 aa, Entamoeba invadens
ESIADEQRR

SEQ ID NO: 2854970 - protein, 5 aa, Entamoeba invadens
ESIDE

SEQ ID NO: 2854971 - protein, 12 aa, Entamoeba invadens
ESIDFTTDEVRG

SEQ ID NO: 2854972 - protein, 6 aa, Entamoeba invadens
ESIDKK

SEQ ID NO: 2854973 - protein, 4 aa, Entamoeba invadens
ESIE

SEQ ID NO: 2854974 - protein, 6 aa, Entamoeba invadens
ESIEEF

SEQ ID NO: 2854975 - protein, 10 aa, Entamoeba invadens
ESIEGKAADQ

SEQ ID NO: 2854976 - protein, 22 aa, Entamoeba invadens
ESIESVAAKEEKNEVKTQTPED

SEQ ID NO: 2854977 - protein, 4 aa, Entamoeba invadens
ESIG

SEQ ID NO: 2854978 - protein, 6 aa, Entamoeba invadens
ESIGEE

SEQ ID NO: 2854979 - protein, 6 aa, Entamoeba invadens
ESIGKT

SEQ ID NO: 2854980 - protein, 5 aa, Entamoeba invadens
ESIKS

SEQ ID NO: 2854981 - protein, 10 aa, Entamoeba invadens
ESIKSKTAEI

SEQ ID NO: 2854982 - protein, 13 aa, Entamoeba invadens
ESIKYEDKQKMKL

SEQ ID NO: 2854983 - protein, 11 aa, Entamoeba invadens
ESINEAEKMKD

SEQ ID NO: 2854984 - protein, 8 aa, Entamoeba invadens
ESINRSPT

SEQ ID NO: 2854985 - protein, 13 aa, Entamoeba invadens
ESIPKLETQSTTP

SEQ ID NO: 2854986 - protein, 11 aa, Entamoeba invadens
ESIPKTKQRTP

SEQ ID NO: 2854987 - protein, 14 aa, Entamoeba invadens
ESIQPSQKVRQEID

SEQ ID NO: 2854988 - protein, 56 aa, Entamoeba invadens
ESISDEEKSPNETKTLSKETNDVSSKSESSSHQSEDKKDTSSSGEEDENLDTQKKV

SEQ ID NO: 2854989 - protein, 18 aa, Entamoeba invadens
ESITEKEIREGLGEEGEI

SEQ ID NO: 2854990 - protein, 43 aa, Entamoeba invadens
ESITEKKKKTKKGSKEKDDSKAVKKPKEDDGEKKKNTKKKTKK

SEQ ID NO: 2854991 - protein, 7 aa, Entamoeba invadens
ESITGDE

SEQ ID NO: 2854992 - protein, 12 aa, Entamoeba invadens
ESITKNLDTPQI

SEQ ID NO: 2854993 - protein, 9 aa, Entamoeba invadens
ESITKPKLR

SEQ ID NO: 2854994 - protein, 10 aa, Entamoeba invadens
ESITPTKSSL

SEQ ID NO: 2854995 - protein, 6 aa, Entamoeba invadens
ESITTV

SEQ ID NO: 2854996 - protein, 4 aa, Entamoeba invadens
ESIV

SEQ ID NO: 2854997 - protein, 5 aa, Entamoeba invadens
ESIYN

SEQ ID NO: 2854998 - protein, 4 aa, Entamoeba invadens
ESKA

SEQ ID NO: 2854999 - protein, 12 aa, Entamoeba invadens
ESKAFSDSSDMT

SEQ ID NO: 2855000 - protein, 14 aa, Entamoeba invadens
ESKASQKATKQTKS

SEQ ID NO: 2855001 - protein, 4 aa, Entamoeba invadens
ESKD

SEQ ID NO: 2855002 - protein, 7 aa, Entamoeba invadens
ESKDDNL

SEQ ID NO: 2855003 - protein, 5 aa, Entamoeba invadens
ESKDG

SEQ ID NO: 2855004 - protein, 12 aa, Entamoeba invadens
ESKDGNSENKTY

SEQ ID NO: 2855005 - protein, 16 aa, Entamoeba invadens
ESKDVAGSANRKTLNT

SEQ ID NO: 2855006 - protein, 8 aa, Entamoeba invadens
ESKEIRES

SEQ ID NO: 2855007 - protein, 7 aa, Entamoeba invadens
ESKELDR

SEQ ID NO: 2855008 - protein, 6 aa, Entamoeba invadens
ESKEQQ

SEQ ID NO: 2855009 - protein, 19 aa, Entamoeba invadens
ESKESKKKETTKPKKHRDV

SEQ ID NO: 2855010 - protein, 12 aa, Entamoeba invadens
ESKETDNSENEK

SEQ ID NO: 2855011 - protein, 6 aa, Entamoeba invadens
ESKGCR

SEQ ID NO: 2855012 - protein, 8 aa, Entamoeba invadens
ESKGNEFN

SEQ ID NO: 2855013 - protein, 20 aa, Entamoeba invadens
ESKGRPSQSISTSSSFSSTL

SEQ ID NO: 2855014 - protein, 8 aa, Entamoeba invadens
ESKGSPYE

SEQ ID NO: 2855015 - protein, 7 aa, Entamoeba invadens
ESKGVAQ

SEQ ID NO: 2855016 - protein, 8 aa, Entamoeba invadens
ESKHMSDK

SEQ ID NO: 2855017 - protein, 8 aa, Entamoeba invadens
ESKHNRLE

SEQ ID NO: 2855018 - protein, 8 aa, Entamoeba invadens
ESKIKHAS

SEQ ID NO: 2855019 - protein, 13 aa, Entamoeba invadens
ESKIKSARKNDVN

SEQ ID NO: 2855020 - protein, 5 aa, Entamoeba invadens
ESKIP

SEQ ID NO: 2855021 - protein, 15 aa, Entamoeba invadens
ESKKDTDIAEWVNKP

SEQ ID NO: 2855022 - protein, 28 aa, Entamoeba invadens
ESKKEGELLNERGESTVERKERRDSEVG

SEQ ID NO: 2855023 - protein, 7 aa, Entamoeba invadens
ESKKFNP

SEQ ID NO: 2855024 - protein, 12 aa, Entamoeba invadens
ESKKGFEATTEE

SEQ ID NO: 2855025 - protein, 5 aa, Entamoeba invadens
ESKKM

SEQ ID NO: 2855026 - protein, 9 aa, Entamoeba invadens
ESKKQSYVN

SEQ ID NO: 2855027 - protein, 8 aa, Entamoeba invadens
ESKLGEGS

SEQ ID NO: 2855028 - protein, 9 aa, Entamoeba invadens
ESKLNEKEV

SEQ ID NO: 2855029 - protein, 5 aa, Entamoeba invadens
ESKME

SEQ ID NO: 2855030 - protein, 7 aa, Entamoeba invadens
ESKMPAK

SEQ ID NO: 2855031 - protein, 8 aa, Entamoeba invadens
ESKNTDFA

SEQ ID NO: 2855032 - protein, 9 aa, Entamoeba invadens
ESKNTVGNI

SEQ ID NO: 2855033 - protein, 34 aa, Entamoeba invadens
ESKPEESASDVLQKRKPKQAKRRGGSWKPTDGPI

SEQ ID NO: 2855034 - protein, 8 aa, Entamoeba invadens
ESKPFTTG

SEQ ID NO: 2855035 - protein, 14 aa, Entamoeba invadens
ESKPHTRSGSKQYM

SEQ ID NO: 2855036 - protein, 7 aa, Entamoeba invadens
ESKPKMT

SEQ ID NO: 2855037 - protein, 11 aa, Entamoeba invadens
ESKPSNIQKAE

SEQ ID NO: 2855038 - protein, 8 aa, Entamoeba invadens
ESKPVTSI

SEQ ID NO: 2855039 - protein, 12 aa, Entamoeba invadens
ESKQPKKVGEVD

SEQ ID NO: 2855040 - protein, 12 aa, Entamoeba invadens
ESKQRTSNHQTT

SEQ ID NO: 2855041 - protein, 8 aa, Entamoeba invadens
ESKQSVPE

SEQ ID NO: 2855042 - protein, 8 aa, Entamoeba invadens
ESKQTDYV

SEQ ID NO: 2855043 - protein, 5 aa, Entamoeba invadens
ESKRE

SEQ ID NO: 2855044 - protein, 13 aa, Entamoeba invadens
ESKRKEIQTTTRE

SEQ ID NO: 2855045 - protein, 8 aa, Entamoeba invadens
ESKRVETA

SEQ ID NO: 2855046 - protein, 11 aa, Entamoeba invadens
ESKSDSKNKGN

SEQ ID NO: 2855047 - protein, 8 aa, Entamoeba invadens
ESKSFEAI

SEQ ID NO: 2855048 - protein, 8 aa, Entamoeba invadens
ESKSSKTK

SEQ ID NO: 2855049 - protein, 8 aa, Entamoeba invadens
ESKTQRGM

SEQ ID NO: 2855050 - protein, 7 aa, Entamoeba invadens
ESKTSNR

SEQ ID NO: 2855051 - protein, 9 aa, Entamoeba invadens
ESKTSTGEY

SEQ ID NO: 2855052 - protein, 7 aa, Entamoeba invadens
ESKTYRQ

SEQ ID NO: 2855053 - protein, 6 aa, Entamoeba invadens
ESKVKI

SEQ ID NO: 2855054 - protein, 6 aa, Entamoeba invadens
ESKYKE

SEQ ID NO: 2855055 - protein, 8 aa, Entamoeba invadens
ESKYNSRS

SEQ ID NO: 2855056 - protein, 12 aa, Entamoeba invadens
ESLAGPKEQFER

SEQ ID NO: 2855057 - protein, 6 aa, Entamoeba invadens
ESLATT

SEQ ID NO: 2855058 - protein, 9 aa, Entamoeba invadens
ESLDAARDD

SEQ ID NO: 2855059 - protein, 5 aa, Entamoeba invadens
ESLDK

SEQ ID NO: 2855060 - protein, 10 aa, Entamoeba invadens
ESLDKENETL

SEQ ID NO: 2855061 - protein, 10 aa, Entamoeba invadens
ESLEERKRGL

SEQ ID NO: 2855062 - protein, 8 aa, Entamoeba invadens
ESLEGMNQ

SEQ ID NO: 2855063 - protein, 6 aa, Entamoeba invadens
ESLEQK

SEQ ID NO: 2855064 - protein, 47 aa, Entamoeba invadens
ESLEQSRAAAMKKRDSSKQHNGGSVERECRSSCKKSEKREKEQRVEQ

SEQ ID NO: 2855065 - protein, 9 aa, Entamoeba invadens
ESLGEGSYG

SEQ ID NO: 2855066 - protein, 10 aa, Entamoeba invadens
ESLGSSNAEM

SEQ ID NO: 2855067 - protein, 4 aa, Entamoeba invadens
ESLI

SEQ ID NO: 2855068 - protein, 11 aa, Entamoeba invadens
ESLIETGNGTI

SEQ ID NO: 2855069 - protein, 35 aa, Entamoeba invadens
ESLISQDNEIGTTGNKRDEKREKTDCTTAANAEKA

SEQ ID NO: 2855070 - protein, 14 aa, Entamoeba invadens
ESLKKDTESTLKDC

SEQ ID NO: 2855071 - protein, 11 aa, Entamoeba invadens
ESLKKLEKSSF

SEQ ID NO: 2855072 - protein, 13 aa, Entamoeba invadens
ESLKKNNESEMKN

SEQ ID NO: 2855073 - protein, 20 aa, Entamoeba invadens
ESLKNEKNKIEDKCTELTNE

SEQ ID NO: 2855074 - protein, 8 aa, Entamoeba invadens
ESLKTEVQ

SEQ ID NO: 2855075 - protein, 8 aa, Entamoeba invadens
ESLKTQDG

SEQ ID NO: 2855076 - protein, 11 aa, Entamoeba invadens
ESLKTRINDQE

SEQ ID NO: 2855077 - protein, 6 aa, Entamoeba invadens
ESLKYK

SEQ ID NO: 2855078 - protein, 12 aa, Entamoeba invadens
ESLMSEKQKKAV

SEQ ID NO: 2855079 - protein, 5 aa, Entamoeba invadens
ESLPD

SEQ ID NO: 2855080 - protein, 30 aa, Entamoeba invadens
ESLPEISEDDGFTTVKSKKKKEKKKTEHTI

SEQ ID NO: 2855081 - protein, 6 aa, Entamoeba invadens
ESLPVR

SEQ ID NO: 2855082 - protein, 4 aa, Entamoeba invadens
ESLQ

SEQ ID NO: 2855083 - protein, 11 aa, Entamoeba invadens
ESLQNSNRKSL

SEQ ID NO: 2855084 - protein, 10 aa, Entamoeba invadens
ESLQNSNRRS

SEQ ID NO: 2855085 - protein, 7 aa, Entamoeba invadens
ESLQQNV

SEQ ID NO: 2855086 - protein, 17 aa, Entamoeba invadens
ESLQTAEEKLKTAEREL

SEQ ID NO: 2855087 - protein, 9 aa, Entamoeba invadens
ESLRECDNE

SEQ ID NO: 2855088 - protein, 5 aa, Entamoeba invadens
ESLRK

SEQ ID NO: 2855089 - protein, 8 aa, Entamoeba invadens
ESLSDPRA

SEQ ID NO: 2855090 - protein, 6 aa, Entamoeba invadens
ESLSKD

SEQ ID NO: 2855091 - protein, 13 aa, Entamoeba invadens
ESLSNKEVLGEEP

SEQ ID NO: 2855092 - protein, 13 aa, Entamoeba invadens
ESLSPQDTEPVAQ

SEQ ID NO: 2855093 - protein, 6 aa, Entamoeba invadens
ESLSQV

SEQ ID NO: 2855094 - protein, 8 aa, Entamoeba invadens
ESLSSKTL

SEQ ID NO: 2855095 - protein, 12 aa, Entamoeba invadens
ESLSTEGISGST

SEQ ID NO: 2855096 - protein, 5 aa, Entamoeba invadens
ESLTD

SEQ ID NO: 2855097 - protein, 6 aa, Entamoeba invadens
ESLTEK

SEQ ID NO: 2855098 - protein, 7 aa, Entamoeba invadens
ESLTSKN

SEQ ID NO: 2855099 - protein, 10 aa, Entamoeba invadens
ESLVNTRPDE

SEQ ID NO: 2855100 - protein, 6 aa, Entamoeba invadens
ESMDDA

SEQ ID NO: 2855101 - protein, 7 aa, Entamoeba invadens
ESMGGEE

SEQ ID NO: 2855102 - protein, 6 aa, Entamoeba invadens
ESMKQT

SEQ ID NO: 2855103 - protein, 5 aa, Entamoeba invadens
ESMPN

SEQ ID NO: 2855104 - protein, 15 aa, Entamoeba invadens
ESMQIGGEKTAELSA

SEQ ID NO: 2855105 - protein, 8 aa, Entamoeba invadens
ESMQTQTK

SEQ ID NO: 2855106 - protein, 8 aa, Entamoeba invadens
ESMTSKSM

SEQ ID NO: 2855107 - protein, 6 aa, Entamoeba invadens
ESNADQ

SEQ ID NO: 2855108 - protein, 22 aa, Entamoeba invadens
ESNDINSSSKNGTTLEKPTMKD

SEQ ID NO: 2855109 - protein, 8 aa, Entamoeba invadens
ESNDKQKQ

SEQ ID NO: 2855110 - protein, 7 aa, Entamoeba invadens
ESNECKN

SEQ ID NO: 2855111 - protein, 19 aa, Entamoeba invadens
ESNEVEKKIAKKPSGYVDP

SEQ ID NO: 2855112 - protein, 39 aa, Entamoeba invadens
ESNEVKEAKKAAEEEKKRLAEEEQKKVEEAQRAEEEKNR

SEQ ID NO: 2855113 - protein, 11 aa, Entamoeba invadens
ESNGKKDDEID

SEQ ID NO: 2855114 - protein, 5 aa, Entamoeba invadens
ESNHT

SEQ ID NO: 2855115 - protein, 4 aa, Entamoeba invadens
ESNI

SEQ ID NO: 2855116 - protein, 16 aa, Entamoeba invadens
ESNKDGRYASAADGNA

SEQ ID NO: 2855117 - protein, 8 aa, Entamoeba invadens
ESNKEDRL

SEQ ID NO: 2855118 - protein, 9 aa, Entamoeba invadens
ESNKGTRDL

SEQ ID NO: 2855119 - protein, 8 aa, Entamoeba invadens
ESNKKTQA

SEQ ID NO: 2855120 - protein, 5 aa, Entamoeba invadens
ESNKN

SEQ ID NO: 2855121 - protein, 20 aa, Entamoeba invadens
ESNKPSCDKTETFQQDTNGY

SEQ ID NO: 2855122 - protein, 15 aa, Entamoeba invadens
ESNKPSNRAGSKAYM

SEQ ID NO: 2855123 - protein, 7 aa, Entamoeba invadens
ESNKVTK

SEQ ID NO: 2855124 - protein, 6 aa, Entamoeba invadens
ESNNDL

SEQ ID NO: 2855125 - protein, 8 aa, Entamoeba invadens
ESNNEELR

SEQ ID NO: 2855126 - protein, 6 aa, Entamoeba invadens
ESNNSV

SEQ ID NO: 2855127 - protein, 9 aa, Entamoeba invadens
ESNPPPQEV

SEQ ID NO: 2855128 - protein, 10 aa, Entamoeba invadens
ESNQKTISDS

SEQ ID NO: 2855129 - protein, 9 aa, Entamoeba invadens
ESNRDRIDK

SEQ ID NO: 2855130 - protein, 15 aa, Entamoeba invadens
ESNSESDSDSENDDF

SEQ ID NO: 2855131 - protein, 9 aa, Entamoeba invadens
ESNSNEYSG

SEQ ID NO: 2855132 - protein, 14 aa, Entamoeba invadens
ESNSPSVKKEEKSK

SEQ ID NO: 2855133 - protein, 7 aa, Entamoeba invadens
ESNTDEW

SEQ ID NO: 2855134 - protein, 6 aa, Entamoeba invadens
ESNTNK

SEQ ID NO: 2855135 - protein, 7 aa, Entamoeba invadens
ESNTTGI

SEQ ID NO: 2855136 - protein, 4 aa, Entamoeba invadens
ESNV

SEQ ID NO: 2855137 - protein, 9 aa, Entamoeba invadens
ESPAITTKR

SEQ ID NO: 2855138 - protein, 4 aa, Entamoeba invadens
ESPC

SEQ ID NO: 2855139 - protein, 10 aa, Entamoeba invadens
ESPDDQTKLG

SEQ ID NO: 2855140 - protein, 5 aa, Entamoeba invadens
ESPDF

SEQ ID NO: 2855141 - protein, 6 aa, Entamoeba invadens
ESPDGD

SEQ ID NO: 2855142 - protein, 4 aa, Entamoeba invadens
ESPE

SEQ ID NO: 2855143 - protein, 13 aa, Entamoeba invadens
ESPEVKTYYKNQS

SEQ ID NO: 2855144 - protein, 5 aa, Entamoeba invadens
ESPGM

SEQ ID NO: 2855145 - protein, 6 aa, Entamoeba invadens
ESPLLD

SEQ ID NO: 2855146 - protein, 7 aa, Entamoeba invadens
ESPNPSV

SEQ ID NO: 2855147 - protein, 7 aa, Entamoeba invadens
ESPNRLP

SEQ ID NO: 2855148 - protein, 20 aa, Entamoeba invadens
ESPPDEATSVLEDPKKPFTP

SEQ ID NO: 2855149 - protein, 10 aa, Entamoeba invadens
ESPPSREITA

SEQ ID NO: 2855150 - protein, 8 aa, Entamoeba invadens
ESPPTFPR

SEQ ID NO: 2855151 - protein, 7 aa, Entamoeba invadens
ESPRDQP

SEQ ID NO: 2855152 - protein, 34 aa, Entamoeba invadens
ESPREDKKGKERSSAEISREEAVEKEGEDFSTSS

SEQ ID NO: 2855153 - protein, 9 aa, Entamoeba invadens
ESPRLSPRS

SEQ ID NO: 2855154 - protein, 13 aa, Entamoeba invadens
ESPSETVDDEQNK

SEQ ID NO: 2855155 - protein, 7 aa, Entamoeba invadens
ESPSISN

SEQ ID NO: 2855156 - protein, 12 aa, Entamoeba invadens
ESPSKPAEMPSE

SEQ ID NO: 2855157 - protein, 19 aa, Entamoeba invadens
ESPSPLPRKKFRNSFINLF

SEQ ID NO: 2855158 - protein, 9 aa, Entamoeba invadens
ESPSYTGSR

SEQ ID NO: 2855159 - protein, 4 aa, Entamoeba invadens
ESPT

SEQ ID NO: 2855160 - protein, 7 aa, Entamoeba invadens
ESPTFEA

SEQ ID NO: 2855161 - protein, 8 aa, Entamoeba invadens
ESPTGTGK

SEQ ID NO: 2855162 - protein, 7 aa, Entamoeba invadens
ESPTPEM

SEQ ID NO: 2855163 - protein, 7 aa, Entamoeba invadens
ESPTQPE

SEQ ID NO: 2855164 - protein, 6 aa, Entamoeba invadens
ESPTVI

SEQ ID NO: 2855165 - protein, 5 aa, Entamoeba invadens
ESPVD

SEQ ID NO: 2855166 - protein, 13 aa, Entamoeba invadens
ESPWGETVTGKKI

SEQ ID NO: 2855167 - protein, 5 aa, Entamoeba invadens
ESPYF

SEQ ID NO: 2855168 - protein, 6 aa, Entamoeba invadens
ESPYFG

SEQ ID NO: 2855169 - protein, 11 aa, Entamoeba invadens
ESPYPTPTNFA

SEQ ID NO: 2855170 - protein, 13 aa, Entamoeba invadens
ESPYTKNKSQNTF

SEQ ID NO: 2855171 - protein, 7 aa, Entamoeba invadens
ESQATKE

SEQ ID NO: 2855172 - protein, 10 aa, Entamoeba invadens
ESQDIENKQT

SEQ ID NO: 2855173 - protein, 7 aa, Entamoeba invadens
ESQEEIR

SEQ ID NO: 2855174 - protein, 7 aa, Entamoeba invadens
ESQEEND

SEQ ID NO: 2855175 - protein, 11 aa, Entamoeba invadens
ESQEQKSDDLR

SEQ ID NO: 2855176 - protein, 48 aa, Entamoeba invadens
ESQINDSRTNHSASKVDVKEAPQSLLGTSQAQNVIEDDTQDSNRPFTS

SEQ ID NO: 2855177 - protein, 9 aa, Entamoeba invadens
ESQKPQDEP

SEQ ID NO: 2855178 - protein, 7 aa, Entamoeba invadens
ESQKRRN

SEQ ID NO: 2855179 - protein, 14 aa, Entamoeba invadens
ESQLPKNPPPQVTT

SEQ ID NO: 2855180 - protein, 19 aa, Entamoeba invadens
ESQNVQSQTQSQGVQSQGQ

SEQ ID NO: 2855181 - protein, 8 aa, Entamoeba invadens
ESQNVTID

SEQ ID NO: 2855182 - protein, 23 aa, Entamoeba invadens
ESQNVTLRKGSGNNKTMKDGTKK

SEQ ID NO: 2855183 - protein, 9 aa, Entamoeba invadens
ESQPPYKEH

SEQ ID NO: 2855184 - protein, 8 aa, Entamoeba invadens
ESQPYNYG

SEQ ID NO: 2855185 - protein, 4 aa, Entamoeba invadens
ESQQ

SEQ ID NO: 2855186 - protein, 10 aa, Entamoeba invadens
ESQQKELNRT

SEQ ID NO: 2855187 - protein, 21 aa, Entamoeba invadens
ESQQQNETTGENENGDDEPKL

SEQ ID NO: 2855188 - protein, 7 aa, Entamoeba invadens
ESQQSIP

SEQ ID NO: 2855189 - protein, 13 aa, Entamoeba invadens
ESQQTERSQQRSI

SEQ ID NO: 2855190 - protein, 10 aa, Entamoeba invadens
ESQRKAYKDD

SEQ ID NO: 2855191 - protein, 8 aa, Entamoeba invadens
ESQRRSEM

SEQ ID NO: 2855192 - protein, 37 aa, Entamoeba invadens
ESQTQCTKCGNNQYVQADGSCGDTCPEKHRKGDGYCE

SEQ ID NO: 2855193 - protein, 9 aa, Entamoeba invadens
ESQTYTNDF

SEQ ID NO: 2855194 - protein, 4 aa, Entamoeba invadens
ESQV

SEQ ID NO: 2855195 - protein, 8 aa, Entamoeba invadens
ESQYIQTT

SEQ ID NO: 2855196 - protein, 6 aa, Entamoeba invadens
ESQYPN

SEQ ID NO: 2855197 - protein, 8 aa, Entamoeba invadens
ESQYRPNI

SEQ ID NO: 2855198 - protein, 4 aa, Entamoeba invadens
ESRE

SEQ ID NO: 2855199 - protein, 14 aa, Entamoeba invadens
ESRENSFDTYPQPE

SEQ ID NO: 2855200 - protein, 7 aa, Entamoeba invadens
ESRGLTK

SEQ ID NO: 2855201 - protein, 5 aa, Entamoeba invadens
ESRGW

SEQ ID NO: 2855202 - protein, 7 aa, Entamoeba invadens
ESRIDEK

SEQ ID NO: 2855203 - protein, 13 aa, Entamoeba invadens
ESRITKAEKQYNA

SEQ ID NO: 2855204 - protein, 6 aa, Entamoeba invadens
ESRKFG

SEQ ID NO: 2855205 - protein, 7 aa, Entamoeba invadens
ESRKNIE

SEQ ID NO: 2855206 - protein, 7 aa, Entamoeba invadens
ESRKNKS

SEQ ID NO: 2855207 - protein, 8 aa, Entamoeba invadens
ESRNEQNI

SEQ ID NO: 2855208 - protein, 6 aa, Entamoeba invadens
ESRNKA

SEQ ID NO: 2855209 - protein, 7 aa, Entamoeba invadens
ESRQPTN

SEQ ID NO: 2855210 - protein, 10 aa, Entamoeba invadens
ESRRSVRDRV

SEQ ID NO: 2855211 - protein, 10 aa, Entamoeba invadens
ESRRTGNKTA

SEQ ID NO: 2855212 - protein, 7 aa, Entamoeba invadens
ESRSETI

SEQ ID NO: 2855213 - protein, 10 aa, Entamoeba invadens
ESRSKSHEDI

SEQ ID NO: 2855214 - protein, 9 aa, Entamoeba invadens
ESRSKVRKE

SEQ ID NO: 2855215 - protein, 18 aa, Entamoeba invadens
ESRSTSAPPQVDRTGASE

SEQ ID NO: 2855216 - protein, 6 aa, Entamoeba invadens
ESRTEI

SEQ ID NO: 2855217 - protein, 6 aa, Entamoeba invadens
ESRTET

SEQ ID NO: 2855218 - protein, 8 aa, Entamoeba invadens
ESRTGELK

SEQ ID NO: 2855219 - protein, 8 aa, Entamoeba invadens
ESRTKRRS

SEQ ID NO: 2855220 - protein, 4 aa, Entamoeba invadens
ESRY

SEQ ID NO: 2855221 - protein, 19 aa, Entamoeba invadens
ESRYGQQKRNNPPPAAPSW

SEQ ID NO: 2855222 - protein, 4 aa, Entamoeba invadens
ESSA

SEQ ID NO: 2855223 - protein, 5 aa, Entamoeba invadens
ESSAI

SEQ ID NO: 2855224 - protein, 9 aa, Entamoeba invadens
ESSAKKALN

SEQ ID NO: 2855225 - protein, 7 aa, Entamoeba invadens
ESSAPNE

SEQ ID NO: 2855226 - protein, 4 aa, Entamoeba invadens
ESSC

SEQ ID NO: 2855227 - protein, 10 aa, Entamoeba invadens
ESSDASTSLS

SEQ ID NO: 2855228 - protein, 7 aa, Entamoeba invadens
ESSDAWT

SEQ ID NO: 2855229 - protein, 7 aa, Entamoeba invadens
ESSDMPP

SEQ ID NO: 2855230 - protein, 48 aa, Entamoeba invadens
ESSDSHGDNKQAKELAEKVKKAHKEAEEKVKAAQKSKDPKSIAEAEAA

SEQ ID NO: 2855231 - protein, 4 aa, Entamoeba invadens
ESSE

SEQ ID NO: 2855232 - protein, 31 aa, Entamoeba invadens
ESSEEKLTEQIEQGTTKSEKEVLTPNPTPTF

SEQ ID NO: 2855233 - protein, 8 aa, Entamoeba invadens
ESSEERDN

SEQ ID NO: 2855234 - protein, 47 aa, Entamoeba invadens
ESSESSEQDVESEDEMEVEREKEQPKEEPREEQKEDEENEDKAVTQE

SEQ ID NO: 2855235 - protein, 10 aa, Entamoeba invadens
ESSETESPGY

SEQ ID NO: 2855236 - protein, 22 aa, Entamoeba invadens
ESSFAQKEQITKDGVKQALNKV

SEQ ID NO: 2855237 - protein, 7 aa, Entamoeba invadens
ESSFDAA

SEQ ID NO: 2855238 - protein, 11 aa, Entamoeba invadens
ESSFEGNLTTP

SEQ ID NO: 2855239 - protein, 5 aa, Entamoeba invadens
ESSFS

SEQ ID NO: 2855240 - protein, 10 aa, Entamoeba invadens
ESSGAGRREK

SEQ ID NO: 2855241 - protein, 5 aa, Entamoeba invadens
ESSGM

SEQ ID NO: 2855242 - protein, 6 aa, Entamoeba invadens
ESSHPL

SEQ ID NO: 2855243 - protein, 7 aa, Entamoeba invadens
ESSIDES

SEQ ID NO: 2855244 - protein, 26 aa, Entamoeba invadens
ESSIEEESGWDDDKAQQDKRKKGSTD

SEQ ID NO: 2855245 - protein, 4 aa, Entamoeba invadens
ESSK

SEQ ID NO: 2855246 - protein, 11 aa, Entamoeba invadens
ESSKDDEKSKE

SEQ ID NO: 2855247 - protein, 9 aa, Entamoeba invadens
ESSKDISKN

SEQ ID NO: 2855248 - protein, 9 aa, Entamoeba invadens
ESSKHTQEA

SEQ ID NO: 2855249 - protein, 16 aa, Entamoeba invadens
ESSKKHKAKANDEWKK
